United States Patent 10,706,955 (BIOINFORMATIC PROCESSES FOR DETERMINATION OF PEPTIDE BINDING) - sequence listing, part 65

SEQ ID NO: 2480458 - protein, 17 aa, Entamoeba dispar
ETLLEINEGIIINITNT

SEQ ID NO: 2480459 - protein, 24 aa, Entamoeba dispar
ETLLEITSPIPLQYNEEIKLSSDH

SEQ ID NO: 2480460 - protein, 24 aa, Entamoeba dispar
ETLLWGLACHLHLLVIQKKQNDLA

SEQ ID NO: 2480461 - protein, 20 aa, Entamoeba dispar
ETLMGFPYCVIDLTNGEVYL

SEQ ID NO: 2480462 - protein, 20 aa, Entamoeba dispar
ETLNSLWPTVKPLPGAIRIL

SEQ ID NO: 2480463 - protein, 17 aa, Entamoeba dispar
ETLSLELLGEVNVGGCV

SEQ ID NO: 2480464 - protein, 19 aa, Entamoeba dispar
ETLSLLGLNNKYALTLYIR

SEQ ID NO: 2480465 - protein, 30 aa, Entamoeba dispar
ETLSSFIVKLFPEFSLLFNGAELEKLKPNK

SEQ ID NO: 2480466 - protein, 23 aa, Entamoeba dispar
ETMLKSEHLVAIGYEDVTKANEM

SEQ ID NO: 2480467 - protein, 19 aa, Entamoeba dispar
ETMNIRLTVVNGKQLKAKD

SEQ ID NO: 2480468 - protein, 25 aa, Entamoeba dispar
ETNEYWKKLHLEVLEKDTIQFDPMH

SEQ ID NO: 2480469 - protein, 25 aa, Entamoeba dispar
ETPFLNRIIHLIRLFSNPSDNKSLQ

SEQ ID NO: 2480470 - protein, 20 aa, Entamoeba dispar
ETPLHLACLCGIIDNVELLL

SEQ ID NO: 2480471 - protein, 18 aa, Entamoeba dispar
ETPLMYAARFHRNDFLIY

SEQ ID NO: 2480472 - protein, 26 aa, Entamoeba dispar
ETPPVPVEIQILWKLENDDLVPAIMK

SEQ ID NO: 2480473 - protein, 19 aa, Entamoeba dispar
ETPQTLHLLAFDSLVDSAK

SEQ ID NO: 2480474 - protein, 21 aa, Entamoeba dispar
ETPSKRKFIFETNDFNDEIES

SEQ ID NO: 2480475 - protein, 20 aa, Entamoeba dispar
ETPTGWKFFGNLMDSGKISL

SEQ ID NO: 2480476 - protein, 19 aa, Entamoeba dispar
ETQFKRIVKRGRQVELEMY

SEQ ID NO: 2480477 - protein, 22 aa, Entamoeba dispar
ETQGRKAFLGMGFQERSEAFDF

SEQ ID NO: 2480478 - protein, 21 aa, Entamoeba dispar
ETQNFICWSNEFNKKAIMIPD

SEQ ID NO: 2480479 - protein, 26 aa, Entamoeba dispar
ETQRPKGCGFVKFMTHEDAKLCVEEA

SEQ ID NO: 2480480 - protein, 27 aa, Entamoeba dispar
ETQRPKGCGFVKFMTHEDAKLCVEEAP

SEQ ID NO: 2480481 - protein, 18 aa, Entamoeba dispar
ETRCKIGITATPIREDYK

SEQ ID NO: 2480482 - protein, 18 aa, Entamoeba dispar
ETRECIECEKGYYLNSTK

SEQ ID NO: 2480483 - protein, 18 aa, Entamoeba dispar
ETRFQIITGPNMGGKSTY

SEQ ID NO: 2480484 - protein, 23 aa, Entamoeba dispar
ETRLMPKVLHHIFDALELTAPST

SEQ ID NO: 2480485 - protein, 23 aa, Entamoeba dispar
ETRRRTVVLSIEITRLLNEFQNI

SEQ ID NO: 2480486 - protein, 19 aa, Entamoeba dispar
ETRYHFAVQLYPFAEQIKD

SEQ ID NO: 2480487 - protein, 25 aa, Entamoeba dispar
ETRYLRPGEYIQMSGRAGRRGKDEQ

SEQ ID NO: 2480488 - protein, 17 aa, Entamoeba dispar
ETSDLIVHLGVIKVLLH

SEQ ID NO: 2480489 - protein, 24 aa, Entamoeba dispar
ETSEVMLDSVLVKFSEDYNKLKRD

SEQ ID NO: 2480490 - protein, 28 aa, Entamoeba dispar
ETSFRTPCLFCKEFLDIDFLLKHMNERH

SEQ ID NO: 2480491 - protein, 21 aa, Entamoeba dispar
ETSGRGALMFVRAVEPDTFPI

SEQ ID NO: 2480492 - protein, 25 aa, Entamoeba dispar
ETSKMAAVVLRFFLDTESESSLDME

SEQ ID NO: 2480493 - protein, 18 aa, Entamoeba dispar
ETSLKVVSMLAEVLSIIC

SEQ ID NO: 2480494 - protein, 23 aa, Entamoeba dispar
ETSLWRFSSLVSISECSIPKEDS

SEQ ID NO: 2480495 - protein, 24 aa, Entamoeba dispar
ETSPFFIPQRMNSYYHLKTFVETP

SEQ ID NO: 2480496 - protein, 18 aa, Entamoeba dispar
ETSVHLKGAVAAAVSNFA

SEQ ID NO: 2480497 - protein, 31 aa, Entamoeba dispar
ETSYFPFKGIHILCVVFDFSNDSIKNIGNWI

SEQ ID NO: 2480498 - protein, 18 aa, Entamoeba dispar
ETTCAKYSPSGYYICSGD

SEQ ID NO: 2480499 - protein, 19 aa, Entamoeba dispar
ETTCAKYSPSGYYICSGDV

SEQ ID NO: 2480500 - protein, 24 aa, Entamoeba dispar
ETTQTGLFSYFFGKTDEYDEPPKY

SEQ ID NO: 2480501 - protein, 22 aa, Entamoeba dispar
ETVIKLLIGNKCDLEDERAVTV

SEQ ID NO: 2480502 - protein, 29 aa, Entamoeba dispar
ETVKEGKLLFGERFLRVDPILPGQILLDN

SEQ ID NO: 2480503 - protein, 25 aa, Entamoeba dispar
ETVRMLKEKFCYVGYDLAVENRLGT

SEQ ID NO: 2480504 - protein, 24 aa, Entamoeba dispar
ETVRNFLKRIGLEQLTEQFIGFGY

SEQ ID NO: 2480505 - protein, 17 aa, Entamoeba dispar
ETVSNFVAATFDEPFGI

SEQ ID NO: 2480506 - protein, 23 aa, Entamoeba dispar
ETWVEEFVRYYSLLIIQNANCIP

SEQ ID NO: 2480507 - protein, 29 aa, Entamoeba dispar
ETWVLNPRATSIGIEICKYLNNSIKIVNS

SEQ ID NO: 2480508 - protein, 18 aa, Entamoeba dispar
ETYFGSAKEFINLTDREV

SEQ ID NO: 2480509 - protein, 22 aa, Entamoeba dispar
ETYGNAALIMLRKGEITKAESY

SEQ ID NO: 2480510 - protein, 23 aa, Entamoeba dispar
ETYIRPYFSDVFRPVKKGDHFLC

SEQ ID NO: 2480511 - protein, 20 aa, Entamoeba dispar
ETYLEFKRKYEEHGKNKDYY

SEQ ID NO: 2480512 - protein, 24 aa, Entamoeba dispar
ETYLKKEFDFGVVVNVEKKDIAEQ

SEQ ID NO: 2480513 - protein, 22 aa, Entamoeba dispar
ETYRFFTTFNYLYAIDNFFDYS

SEQ ID NO: 2480514 - protein, 19 aa, Entamoeba dispar
ETYYQASGCSSKISEHATR

SEQ ID NO: 2480515 - protein, 24 aa, Entamoeba dispar
EVAAAYRRLIERGSVPDINKAPFF

SEQ ID NO: 2480516 - protein, 25 aa, Entamoeba dispar
EVAIKLELLKCKHPQLKDEFELYQK

SEQ ID NO: 2480517 - protein, 17 aa, Entamoeba dispar
EVAKVVVEDVCINTRLV

SEQ ID NO: 2480518 - protein, 17 aa, Entamoeba dispar
EVANWKRKLYVYGNQIQ

SEQ ID NO: 2480519 - protein, 31 aa, Entamoeba dispar
EVAQKKFPFIPLILKYIEAMTFYSNDFNEFE

SEQ ID NO: 2480520 - protein, 23 aa, Entamoeba dispar
EVCCSNPAKLFGIYPEKGCLGIG

SEQ ID NO: 2480521 - protein, 24 aa, Entamoeba dispar
EVCDRKKIMLHMIHIYKEKKEVEE

SEQ ID NO: 2480522 - protein, 25 aa, Entamoeba dispar
EVCNEKITGLCYVKENIIVGTPSGQ

SEQ ID NO: 2480523 - protein, 20 aa, Entamoeba dispar
EVCPKCKGKGVVVNEKDLCK

SEQ ID NO: 2480524 - protein, 22 aa, Entamoeba dispar
EVDALYKIIFELSKEMIKKYQT

SEQ ID NO: 2480525 - protein, 34 aa, Entamoeba dispar
EVDGVPVYINHLWRKCYGDESCKNYLNIRYPLPE

SEQ ID NO: 2480526 - protein, 19 aa, Entamoeba dispar
EVDKTIPLEKLLLVHSKEY

SEQ ID NO: 2480527 - protein, 25 aa, Entamoeba dispar
EVEDKLRVGLLYALKYEDKAQDIIE

SEQ ID NO: 2480528 - protein, 26 aa, Entamoeba dispar
EVEDKLRVGLLYALKYEDKAQDIIEE

SEQ ID NO: 2480529 - protein, 34 aa, Entamoeba dispar
EVEENNRYLLLNGICVALKMGNPDYERTHLSVST

SEQ ID NO: 2480530 - protein, 23 aa, Entamoeba dispar
EVEFNRFYSIFSRVYSLQEINEF

SEQ ID NO: 2480531 - protein, 21 aa, Entamoeba dispar
EVEGTLLHFVDNCFTAFGKRM

SEQ ID NO: 2480532 - protein, 29 aa, Entamoeba dispar
EVEKQPCYFVPELMRLTGMSDDMRADNQF

SEQ ID NO: 2480533 - protein, 23 aa, Entamoeba dispar
EVEPLPSWSYDGLNLIYKLSQEE

SEQ ID NO: 2480534 - protein, 19 aa, Entamoeba dispar
EVESRIGIFDTDHKFISGV

SEQ ID NO: 2480535 - protein, 23 aa, Entamoeba dispar
EVEWLDGKLRYMIQLEAEDLMGV

SEQ ID NO: 2480536 - protein, 24 aa, Entamoeba dispar
EVFEIAFQVGFTMIKKEMIQSLNY

SEQ ID NO: 2480537 - protein, 20 aa, Entamoeba dispar
EVFEMAAKVALGMEDETRDK

SEQ ID NO: 2480538 - protein, 20 aa, Entamoeba dispar
EVFGNVKYKKIDIITNDFCP

SEQ ID NO: 2480539 - protein, 19 aa, Entamoeba dispar
EVFIKRNNNILTIIKEYPI

SEQ ID NO: 2480540 - protein, 22 aa, Entamoeba dispar
EVFPDLDMLPLFLTKKKILSRV

SEQ ID NO: 2480541 - protein, 19 aa, Entamoeba dispar
EVFSTGFGEHLEKLAHSNG

SEQ ID NO: 2480542 - protein, 19 aa, Entamoeba dispar
EVFTSPLLVDKIVLNVDFW

SEQ ID NO: 2480543 - protein, 17 aa, Entamoeba dispar
EVGENMQGLALNSMTKT

SEQ ID NO: 2480544 - protein, 23 aa, Entamoeba dispar
EVGNKVCLVIGEKGLVGRSKTKE

SEQ ID NO: 2480545 - protein, 18 aa, Entamoeba dispar
EVHIKWLTLSIHKPLPSG

SEQ ID NO: 2480546 - protein, 18 aa, Entamoeba dispar
EVHRENYNTFAISYNCRH

SEQ ID NO: 2480547 - protein, 19 aa, Entamoeba dispar
EVHSIDCELERLKISLELL

SEQ ID NO: 2480548 - protein, 29 aa, Entamoeba dispar
EVIELPIKHPELFESLGIAQPKGVLLYGP

SEQ ID NO: 2480549 - protein, 30 aa, Entamoeba dispar
EVIELPIKHPELFESLGIAQPKGVLLYGPP

SEQ ID NO: 2480550 - protein, 18 aa, Entamoeba dispar
EVIGCGFTLPVDDHKTIA

SEQ ID NO: 2480551 - protein, 22 aa, Entamoeba dispar
EVIGDAAFWGCCSIRRILFPSS

SEQ ID NO: 2480552 - protein, 19 aa, Entamoeba dispar
EVIGGAVFANNNFNPLTAV

SEQ ID NO: 2480553 - protein, 25 aa, Entamoeba dispar
EVIIDRIIPELSLLDVNEIKDNQIY

SEQ ID NO: 2480554 - protein, 20 aa, Entamoeba dispar
EVIIHYNIWDFPNWEVNNNL

SEQ ID NO: 2480555 - protein, 25 aa, Entamoeba dispar
EVIIPIDDLLPFAAMKMFPNALFGN

SEQ ID NO: 2480556 - protein, 21 aa, Entamoeba dispar
EVINTLKYVFEKLAKEKEIVK

SEQ ID NO: 2480557 - protein, 25 aa, Entamoeba dispar
EVIPFRLPPELVQASIQQEKPSRTL

SEQ ID NO: 2480558 - protein, 19 aa, Entamoeba dispar
EVISDPIGVMKRIYQKVGM

SEQ ID NO: 2480559 - protein, 28 aa, Entamoeba dispar
EVITPYVYHLRLLISTMHQALNSYRPYQ

SEQ ID NO: 2480560 - protein, 18 aa, Entamoeba dispar
EVITYVSLYELDAANIKS

SEQ ID NO: 2480561 - protein, 25 aa, Entamoeba dispar
EVIYSRWVPHNSKVLKIKFNKDNTM

SEQ ID NO: 2480562 - protein, 27 aa, Entamoeba dispar
EVKDIFTTPCLPFIGTYLTDYTFLDDG

SEQ ID NO: 2480563 - protein, 20 aa, Entamoeba dispar
EVKEIRKGLDELIQLEKEKK

SEQ ID NO: 2480564 - protein, 21 aa, Entamoeba dispar
EVKELKEGCVCEVQTMPVQKG

SEQ ID NO: 2480565 - protein, 21 aa, Entamoeba dispar
EVKGMMNLCGLILSKQLERKV

SEQ ID NO: 2480566 - protein, 22 aa, Entamoeba dispar
EVKMKCLYEMGDWEALDEVANK

SEQ ID NO: 2480567 - protein, 17 aa, Entamoeba dispar
EVKMVKCHQMKIVDTSN

SEQ ID NO: 2480568 - protein, 19 aa, Entamoeba dispar
EVKSLGDNCFEYCNELTSI

SEQ ID NO: 2480569 - protein, 25 aa, Entamoeba dispar
EVKSLGHGCFCYCASLTSIDIPSSI

SEQ ID NO: 2480570 - protein, 22 aa, Entamoeba dispar
EVKSLGNGCFKQCYELTTINIP

SEQ ID NO: 2480571 - protein, 27 aa, Entamoeba dispar
EVKSLGNSCFKHCYELRSINIPSSVSK

SEQ ID NO: 2480572 - protein, 25 aa, Entamoeba dispar
EVKSLGYKCFKYCSSLTSINIPTTI

SEQ ID NO: 2480573 - protein, 23 aa, Entamoeba dispar
EVKSLGYKCFKYCSSLTTINIPS

SEQ ID NO: 2480574 - protein, 24 aa, Entamoeba dispar
EVKSLRDWCFKNCDELSSITIPTP

SEQ ID NO: 2480575 - protein, 23 aa, Entamoeba dispar
EVKSRALFYLNIINSEITITLEK

SEQ ID NO: 2480576 - protein, 25 aa, Entamoeba dispar
EVLETAILHCLKKILEKSSGVSDIS

SEQ ID NO: 2480577 - protein, 18 aa, Entamoeba dispar
EVLEYGFEFAQKKMGIDR

SEQ ID NO: 2480578 - protein, 20 aa, Entamoeba dispar
EVLFRRSLFGYCIRTNTSSL

SEQ ID NO: 2480579 - protein, 19 aa, Entamoeba dispar
EVLIIKQIVDGLLKNKVKE

SEQ ID NO: 2480580 - protein, 21 aa, Entamoeba dispar
EVLKIFDIKTSMMFGKADQQE

SEQ ID NO: 2480581 - protein, 20 aa, Entamoeba dispar
EVLKRMPGITTNQLFDIEHN

SEQ ID NO: 2480582 - protein, 28 aa, Entamoeba dispar
EVLLDKISLFFGFPITFYKAHCPLQTNG

SEQ ID NO: 2480583 - protein, 20 aa, Entamoeba dispar
EVLLHKRIKDILPNEIPEII

SEQ ID NO: 2480584 - protein, 20 aa, Entamoeba dispar
EVLNCLYLTQYVVQRQSSFR

SEQ ID NO: 2480585 - protein, 18 aa, Entamoeba dispar
EVLQKCNEYCIMIDNLCQ

SEQ ID NO: 2480586 - protein, 20 aa, Entamoeba dispar
EVLQRRVAETKGHITPKVVW

SEQ ID NO: 2480587 - protein, 18 aa, Entamoeba dispar
EVLTYKGPVPSYVDQVLI

SEQ ID NO: 2480588 - protein, 30 aa, Entamoeba dispar
EVMFNKRLGSYYQLECEPEGFDKEDSEKVT

SEQ ID NO: 2480589 - protein, 17 aa, Entamoeba dispar
EVMKKTKYGITFIDGKR

SEQ ID NO: 2480590 - protein, 19 aa, Entamoeba dispar
EVMLLYNIVYSICASQDDR

SEQ ID NO: 2480591 - protein, 24 aa, Entamoeba dispar
EVMNRIINILIYFIKDNTEQAMFV

SEQ ID NO: 2480592 - protein, 20 aa, Entamoeba dispar
EVMPKLALELKRKYYSQTKT

SEQ ID NO: 2480593 - protein, 32 aa, Entamoeba dispar
EVMVLTWGNLKGEFRAVPGYDVSTPKTFNAPT

SEQ ID NO: 2480594 - protein, 22 aa, Entamoeba dispar
EVMYAHAMKEGFVMSNSIGDRI

SEQ ID NO: 2480595 - protein, 26 aa, Entamoeba dispar
EVMYLLGVDVGQAFGYSIMKLLFEGK

SEQ ID NO: 2480596 - protein, 25 aa, Entamoeba dispar
EVNANEIILSFGPKTKVKKWNIKNM

SEQ ID NO: 2480597 - protein, 21 aa, Entamoeba dispar
EVNATQRLSLNKIINRLYDSY

SEQ ID NO: 2480598 - protein, 19 aa, Entamoeba dispar
EVNDVCWSKSNSNWIAASI

SEQ ID NO: 2480599 - protein, 17 aa, Entamoeba dispar
EVNELFEQIKLFQQCID

SEQ ID NO: 2480600 - protein, 22 aa, Entamoeba dispar
EVNGKWTCCGRVRQHSHTVKSL

SEQ ID NO: 2480601 - protein, 24 aa, Entamoeba dispar
EVNGRCPLCKQLIPTHDLKQIRNL

SEQ ID NO: 2480602 - protein, 32 aa, Entamoeba dispar
EVNGRWRFELHRGVIYEGMIGMYLGKNDSEKK

SEQ ID NO: 2480603 - protein, 20 aa, Entamoeba dispar
EVNIRYLALDTFVLLGQANY

SEQ ID NO: 2480604 - protein, 22 aa, Entamoeba dispar
EVNKEIRELICIGNENKEKKKI

SEQ ID NO: 2480605 - protein, 18 aa, Entamoeba dispar
EVNKYSKSLCLSGSKSST

SEQ ID NO: 2480606 - protein, 18 aa, Entamoeba dispar
EVNLPIVVKFISVSNKKL

SEQ ID NO: 2480607 - protein, 24 aa, Entamoeba dispar
EVNPKIYRFRPFIIKLTINTSFGI

SEQ ID NO: 2480608 - protein, 20 aa, Entamoeba dispar
EVNSLGNFCFYSCALLKSIN

SEQ ID NO: 2480609 - protein, 29 aa, Entamoeba dispar
EVNTFLFCYRDLYEAQEFILKYGKGYKKY

SEQ ID NO: 2480610 - protein, 19 aa, Entamoeba dispar
EVPHEGPMCDLLWSDPEEK

SEQ ID NO: 2480611 - protein, 21 aa, Entamoeba dispar
EVPILPIRKSLILAQENNENT

SEQ ID NO: 2480612 - protein, 20 aa, Entamoeba dispar
EVPPPIQVNTDFKFSIAEQN

SEQ ID NO: 2480613 - protein, 22 aa, Entamoeba dispar
EVPRTVTVILERYLVVGLTAGQ

SEQ ID NO: 2480614 - protein, 24 aa, Entamoeba dispar
EVPSRLETLIKIMTRFCLLYSYFP

SEQ ID NO: 2480615 - protein, 17 aa, Entamoeba dispar
EVPWMCFKNLGCVNENN

SEQ ID NO: 2480616 - protein, 21 aa, Entamoeba dispar
EVQEGIYWCGHKIDTFSKEIE

SEQ ID NO: 2480617 - protein, 24 aa, Entamoeba dispar
EVQERACFMLAIVRQFESLREQGI

SEQ ID NO: 2480618 - protein, 27 aa, Entamoeba dispar
EVQIIQRICLYWLKYDESTEEVIMEKT

SEQ ID NO: 2480619 - protein, 18 aa, Entamoeba dispar
EVQILTGIVGNRAKHVIN

SEQ ID NO: 2480620 - protein, 21 aa, Entamoeba dispar
EVQLLNKLHCYLRGSTEQAEQ

SEQ ID NO: 2480621 - protein, 21 aa, Entamoeba dispar
EVQQWWKIILAIFASSIKMCR

SEQ ID NO: 2480622 - protein, 19 aa, Entamoeba dispar
EVQYLPPHFNVLIQKIINR

SEQ ID NO: 2480623 - protein, 17 aa, Entamoeba dispar
EVRFFFETFKKLRVGAV

SEQ ID NO: 2480624 - protein, 19 aa, Entamoeba dispar
EVRFKRIVSELGEQSYEID

SEQ ID NO: 2480625 - protein, 20 aa, Entamoeba dispar
EVRKRLVVINATPNKLKVPS

SEQ ID NO: 2480626 - protein, 23 aa, Entamoeba dispar
EVRLTEIIKLLKTMMDYVESAKI

SEQ ID NO: 2480627 - protein, 19 aa, Entamoeba dispar
EVRPVFKGIDITSSDISDK

SEQ ID NO: 2480628 - protein, 24 aa, Entamoeba dispar
EVRSEVWKLLLLKDLDYKTLQDEF

SEQ ID NO: 2480629 - protein, 24 aa, Entamoeba dispar
EVRSWALLCLSKLWEGTIEIKIRA

SEQ ID NO: 2480630 - protein, 25 aa, Entamoeba dispar
EVSCMDKSRLDYMFHWKKPNENPII

SEQ ID NO: 2480631 - protein, 18 aa, Entamoeba dispar
EVSEAYAVLSDHEKREMY

SEQ ID NO: 2480632 - protein, 24 aa, Entamoeba dispar
EVSENGEYCCFEYESWNTVSKSHF

SEQ ID NO: 2480633 - protein, 26 aa, Entamoeba dispar
EVSGLLFHRAVFFTAALLRFHINTLV

SEQ ID NO: 2480634 - protein, 19 aa, Entamoeba dispar
EVSGMILKYLYGIAQNKLG

SEQ ID NO: 2480635 - protein, 18 aa, Entamoeba dispar
EVSNALIRFITKINNDVP

SEQ ID NO: 2480636 - protein, 21 aa, Entamoeba dispar
EVSQRILIDGINWINKRRTGI

SEQ ID NO: 2480637 - protein, 20 aa, Entamoeba dispar
EVSVSEFYYLVFKNSGILDY

SEQ ID NO: 2480638 - protein, 18 aa, Entamoeba dispar
EVTKMSVSLLNMLDSRQE

SEQ ID NO: 2480639 - protein, 23 aa, Entamoeba dispar
EVTMGISCIEFKPETTEAIRTSV

SEQ ID NO: 2480640 - protein, 27 aa, Entamoeba dispar
EVTSLGYECFARMYGLLTIIIPTMIKR

SEQ ID NO: 2480641 - protein, 25 aa, Entamoeba dispar
EVVCCRFSPCLYKSVNFDGKKRAFS

SEQ ID NO: 2480642 - protein, 18 aa, Entamoeba dispar
EVVCVGSIDPERRKLEGI

SEQ ID NO: 2480643 - protein, 21 aa, Entamoeba dispar
EVVDGIPYWDTELFMMKDLHI

SEQ ID NO: 2480644 - protein, 24 aa, Entamoeba dispar
EVVEHINESFSIYMSQINCRGSVE

SEQ ID NO: 2480645 - protein, 19 aa, Entamoeba dispar
EVVEIFLAQWHQFSPNNQK

SEQ ID NO: 2480646 - protein, 17 aa, Entamoeba dispar
EVVKELFTNGVINKLIE

SEQ ID NO: 2480647 - protein, 18 aa, Entamoeba dispar
EVVPVDLLDPEKVYQYEQ

SEQ ID NO: 2480648 - protein, 26 aa, Entamoeba dispar
EVVSGSIDALIRWAVNPNIDNNIKFI

SEQ ID NO: 2480649 - protein, 21 aa, Entamoeba dispar
EVVVTFGGHLYRGNRVQKLKA

SEQ ID NO: 2480650 - protein, 18 aa, Entamoeba dispar
EVVWDCFGDIKKQGGAPC

SEQ ID NO: 2480651 - protein, 22 aa, Entamoeba dispar
EVYCLRMLKSIGVCVVPGSGFG

SEQ ID NO: 2480652 - protein, 19 aa, Entamoeba dispar
EVYEVFSCYFGDKSMAPVL

SEQ ID NO: 2480653 - protein, 18 aa, Entamoeba dispar
EVYIKDIFLMPTESVNPS

SEQ ID NO: 2480654 - protein, 24 aa, Entamoeba dispar
EVYKRGIKYVMHFGEELPTSLSLT

SEQ ID NO: 2480655 - protein, 19 aa, Entamoeba dispar
EVYLFPYYSVHDFINTNTF

SEQ ID NO: 2480656 - protein, 18 aa, Entamoeba dispar
EVYLQYSSAPAFFRISNL

SEQ ID NO: 2480657 - protein, 23 aa, Entamoeba dispar
EVYRIKMNFPNSVSMTHLTMYNI

SEQ ID NO: 2480658 - protein, 19 aa, Entamoeba dispar
EVYRKKIAIELLTTERTYV

SEQ ID NO: 2480659 - protein, 17 aa, Entamoeba dispar
EVYSLLISCLFDLHVIL

SEQ ID NO: 2480660 - protein, 26 aa, Entamoeba dispar
EVYWEHKKGWAIGGINGRYGMFPLAK

SEQ ID NO: 2480661 - protein, 26 aa, Entamoeba dispar
EWAEELGASCFAHWFQPLSQTTARKY

SEQ ID NO: 2480662 - protein, 18 aa, Entamoeba dispar
EWALEGGALVLADEGVCL

SEQ ID NO: 2480663 - protein, 28 aa, Entamoeba dispar
EWCDGEFNVICATIAFGMGIDKPDVRFV

SEQ ID NO: 2480664 - protein, 21 aa, Entamoeba dispar
EWCGNLIVVEFSETIESKRNR

SEQ ID NO: 2480665 - protein, 22 aa, Entamoeba dispar
EWCGNLIVVEFSETIESKRNRR

SEQ ID NO: 2480666 - protein, 23 aa, Entamoeba dispar
EWDKKLFNCITCLDHIPNCSYPT

SEQ ID NO: 2480667 - protein, 25 aa, Entamoeba dispar
EWELNFPLVECICSLMVLNDIESNE

SEQ ID NO: 2480668 - protein, 27 aa, Entamoeba dispar
EWFPPQWKVNFAKRLPIGNVKKYPPGN

SEQ ID NO: 2480669 - protein, 26 aa, Entamoeba dispar
EWHIQAVCAITVWLKERNYNFWMDET

SEQ ID NO: 2480670 - protein, 20 aa, Entamoeba dispar
EWIKLMQCFIQRKEIDEARK

SEQ ID NO: 2480671 - protein, 23 aa, Entamoeba dispar
EWIVKRLEQINSIEGIELIGKIY

SEQ ID NO: 2480672 - protein, 24 aa, Entamoeba dispar
EWKVPECVKHLMFIGLTIQTLPKI

SEQ ID NO: 2480673 - protein, 20 aa, Entamoeba dispar
EWLKECIEYIKGNVKLITEF

SEQ ID NO: 2480674 - protein, 19 aa, Entamoeba dispar
EWLYAMKMQSYRAALELFI

SEQ ID NO: 2480675 - protein, 19 aa, Entamoeba dispar
EWNECKSIIYTKHEREKYG

SEQ ID NO: 2480676 - protein, 25 aa, Entamoeba dispar
EWSFCECPRLSIIEYNSHNTMKTQI

SEQ ID NO: 2480677 - protein, 22 aa, Entamoeba dispar
EWTGRIKMNIIFDSDIDDQNVV

SEQ ID NO: 2480678 - protein, 19 aa, Entamoeba dispar
EWVFNRSFIPLKFSLDKKN

SEQ ID NO: 2480679 - protein, 21 aa, Entamoeba dispar
EWVKQCEILLYRGAWQEWEIE

SEQ ID NO: 2480680 - protein, 20 aa, Entamoeba dispar
EWVLEGGALVLADMGICCID

SEQ ID NO: 2480681 - protein, 23 aa, Entamoeba dispar
EWVRCMIRQLKLTDFKKEKFYYI

SEQ ID NO: 2480682 - protein, 19 aa, Entamoeba dispar
EWVYLYLQLLRKIFKYNPR

SEQ ID NO: 2480683 - protein, 17 aa, Entamoeba dispar
EWYFIKTKKEVIALSTY

SEQ ID NO: 2480684 - protein, 25 aa, Entamoeba dispar
EYAQKYPFVCFAKITWEDSNKPFPE

SEQ ID NO: 2480685 - protein, 26 aa, Entamoeba dispar
EYCFIPFKYRDGYLLSILKETEGKSI

SEQ ID NO: 2480686 - protein, 25 aa, Entamoeba dispar
EYCFNKWDGIFIMKRTINEYLAQVA

SEQ ID NO: 2480687 - protein, 17 aa, Entamoeba dispar
EYCFRLQKDRVYYVRLS

SEQ ID NO: 2480688 - protein, 26 aa, Entamoeba dispar
EYCLDIPKEFKIGSIHKGRIMYYSAF

SEQ ID NO: 2480689 - protein, 21 aa, Entamoeba dispar
EYCLMIKKWFSSIKNGTEQVT

SEQ ID NO: 2480690 - protein, 18 aa, Entamoeba dispar
EYCVSIFNGHFIFYDKNN

SEQ ID NO: 2480691 - protein, 17 aa, Entamoeba dispar
EYDDMFLNELKKLIEKK

SEQ ID NO: 2480692 - protein, 33 aa, Entamoeba dispar
EYDKIETIIFPFSSKNKYGLIVYVNKINIIRKE

SEQ ID NO: 2480693 - protein, 24 aa, Entamoeba dispar
EYEAFKLAASYFLYNQYFVNGKWP

SEQ ID NO: 2480694 - protein, 18 aa, Entamoeba dispar
EYEKEFKEATKLGDQLAL

SEQ ID NO: 2480695 - protein, 19 aa, Entamoeba dispar
EYEKRIEIFKTYIHDDIKC

SEQ ID NO: 2480696 - protein, 17 aa, Entamoeba dispar
EYEQIYKLFNFRQKKDI

SEQ ID NO: 2480697 - protein, 18 aa, Entamoeba dispar
EYEVFGPIGEFIRLKDNK

SEQ ID NO: 2480698 - protein, 19 aa, Entamoeba dispar
EYFCVCGFNTRKIQLEVGE

SEQ ID NO: 2480699 - protein, 18 aa, Entamoeba dispar
EYFETALMNIQKRTSFSY

SEQ ID NO: 2480700 - protein, 17 aa, Entamoeba dispar
EYFGGAVTAICSCQNNM

SEQ ID NO: 2480701 - protein, 18 aa, Entamoeba dispar
EYFRNALFKYFDKYLREI

SEQ ID NO: 2480702 - protein, 17 aa, Entamoeba dispar
EYGEIKKIVIIKDLKGI

SEQ ID NO: 2480703 - protein, 27 aa, Entamoeba dispar
EYGFIKRVCPFVQSYYRSLIQTKQMKE

SEQ ID NO: 2480704 - protein, 28 aa, Entamoeba dispar
EYHLKLCLCPLCKHGIEVFGSKRPVSWI

SEQ ID NO: 2480705 - protein, 22 aa, Entamoeba dispar
EYHSGEKFRVLSLDGGGVKCIY

SEQ ID NO: 2480706 - protein, 19 aa, Entamoeba dispar
EYICRVRGKLEKTVVTSKI

SEQ ID NO: 2480707 - protein, 26 aa, Entamoeba dispar
EYIDYSFLKICFNGVIEFNFNPMTKI

SEQ ID NO: 2480708 - protein, 25 aa, Entamoeba dispar
EYIEEFPPLLSQVGMGARIRNYCRR

SEQ ID NO: 2480709 - protein, 18 aa, Entamoeba dispar
EYIFSAYCDREYCKTTKT

SEQ ID NO: 2480710 - protein, 19 aa, Entamoeba dispar
EYIHCLELLPSNEYLVDAF

SEQ ID NO: 2480711 - protein, 17 aa, Entamoeba dispar
EYIIHFYGAVFIPNKIC

SEQ ID NO: 2480712 - protein, 19 aa, Entamoeba dispar
EYIIKCSKIKPINKKDIEN

SEQ ID NO: 2480713 - protein, 31 aa, Entamoeba dispar
EYIIMVELLARRIIPNFVVHEGREEQTLSLL

SEQ ID NO: 2480714 - protein, 17 aa, Entamoeba dispar
EYIKRKYSLFIVDAQFT

SEQ ID NO: 2480715 - protein, 25 aa, Entamoeba dispar
EYIMHSSMKNWSFIPVTLADYPYLP

SEQ ID NO: 2480716 - protein, 25 aa, Entamoeba dispar
EYIQPLIIGCWRLCNEDKCQKEFIE

SEQ ID NO: 2480717 - protein, 25 aa, Entamoeba dispar
EYITCLELFPFDCNSVLVGSSNGLV

SEQ ID NO: 2480718 - protein, 18 aa, Entamoeba dispar
EYITLKSVVSKFVVNCLQ

SEQ ID NO: 2480719 - protein, 25 aa, Entamoeba dispar
EYKEAIKIYQECAAELHNLIDDINY

SEQ ID NO: 2480720 - protein, 21 aa, Entamoeba dispar
EYKEKILTFDGINLGGNKIEV

SEQ ID NO: 2480721 - protein, 21 aa, Entamoeba dispar
EYKKLEAISRMPASVTVLNAE

SEQ ID NO: 2480722 - protein, 19 aa, Entamoeba dispar
EYKLNIILRYYNKSKIVIN

SEQ ID NO: 2480723 - protein, 26 aa, Entamoeba dispar
EYKPIETKPSFGMLMRFTHNTKTSQI

SEQ ID NO: 2480724 - protein, 21 aa, Entamoeba dispar
EYLCAAWGQKVGSYYGRGTAQ

SEQ ID NO: 2480725 - protein, 21 aa, Entamoeba dispar
EYLDYRLENKLDQQGVNDVIN

SEQ ID NO: 2480726 - protein, 25 aa, Entamoeba dispar
EYLEKASVFKIDYKIELIVSSLLEE

SEQ ID NO: 2480727 - protein, 17 aa, Entamoeba dispar
EYLIPFCEFQKICEEHG

SEQ ID NO: 2480728 - protein, 19 aa, Entamoeba dispar
EYLIRAGVTNLTLYYPEMN

SEQ ID NO: 2480729 - protein, 17 aa, Entamoeba dispar
EYLKEVFGLNSEINSCV

SEQ ID NO: 2480730 - protein, 17 aa, Entamoeba dispar
EYLNTPITIKWKNEEKV

SEQ ID NO: 2480731 - protein, 18 aa, Entamoeba dispar
EYLRPCEVMQIFKELLEK

SEQ ID NO: 2480732 - protein, 17 aa, Entamoeba dispar
EYLTCAVITGSVMVIPR

SEQ ID NO: 2480733 - protein, 25 aa, Entamoeba dispar
EYLTIGIAIDCRRVDVIKEILRKTK

SEQ ID NO: 2480734 - protein, 27 aa, Entamoeba dispar
EYMKCSYCLNCGAFVCDNQECFINHKS

SEQ ID NO: 2480735 - protein, 17 aa, Entamoeba dispar
EYMKFEIFDNGELNYYN

SEQ ID NO: 2480736 - protein, 21 aa, Entamoeba dispar
EYMSRLLRACGYIYTTSAQME

SEQ ID NO: 2480737 - protein, 24 aa, Entamoeba dispar
EYMVNRLNVLLLQHIQKCLPGLKQ

SEQ ID NO: 2480738 - protein, 23 aa, Entamoeba dispar
EYMYCVNRIYNLLKRSHGNYFGD

SEQ ID NO: 2480739 - protein, 20 aa, Entamoeba dispar
EYNCFRREIELIKILIHPNI

SEQ ID NO: 2480740 - protein, 19 aa, Entamoeba dispar
EYNFYPQFCYVNNQVTVQG

SEQ ID NO: 2480741 - protein, 26 aa, Entamoeba dispar
EYNLLWWKNKVYVIDVGQSIELSHPQ

SEQ ID NO: 2480742 - protein, 26 aa, Entamoeba dispar
EYNLRPTKYLLMWLDFLIKDIESNLL

SEQ ID NO: 2480743 - protein, 26 aa, Entamoeba dispar
EYNLRPTKYLLMWLDFLIKDVDSNLM

SEQ ID NO: 2480744 - protein, 25 aa, Entamoeba dispar
EYNRCKRAKLKKSDFETIKVIGRGG

SEQ ID NO: 2480745 - protein, 22 aa, Entamoeba dispar
EYNRIRENGGYVINDRTNGILA

SEQ ID NO: 2480746 - protein, 23 aa, Entamoeba dispar
EYPFFKMIRNWINALGDLANILG

SEQ ID NO: 2480747 - protein, 25 aa, Entamoeba dispar
EYPKIYNILCAINYVLEISNDQIER

SEQ ID NO: 2480748 - protein, 17 aa, Entamoeba dispar
EYPRVYNINAWDETNND

SEQ ID NO: 2480749 - protein, 29 aa, Entamoeba dispar
EYPSLKRLVLRPIGWLSLSQLFIDKSHRI

SEQ ID NO: 2480750 - protein, 36 aa, Entamoeba dispar
EYQLSAEVGDIFYVEKIIGSWAIVIVDQERFIFPSS

SEQ ID NO: 2480751 - protein, 24 aa, Entamoeba dispar
EYQNALRLYIDWDKANLKEVPKTC

SEQ ID NO: 2480752 - protein, 26 aa, Entamoeba dispar
EYQNGIPCFWLHVLKNSGIFDGLSGN

SEQ ID NO: 2480753 - protein, 19 aa, Entamoeba dispar
EYQNRINLDHIRRTFEGII

SEQ ID NO: 2480754 - protein, 17 aa, Entamoeba dispar
EYRITDFGVDSIVMTQI

SEQ ID NO: 2480755 - protein, 22 aa, Entamoeba dispar
EYRMLYFNFKTRKIFFLRHAKV

SEQ ID NO: 2480756 - protein, 18 aa, Entamoeba dispar
EYSFLKCPFNEMIQTPPL

SEQ ID NO: 2480757 - protein, 20 aa, Entamoeba dispar
EYSKRILYEYIRKSERSIID

SEQ ID NO: 2480758 - protein, 33 aa, Entamoeba dispar
EYSLFKERIELMKTLFPIIKFDSISFFFRTWEV

SEQ ID NO: 2480759 - protein, 25 aa, Entamoeba dispar
EYSPILFKLVFRADLIVEYITIFNG

SEQ ID NO: 2480760 - protein, 21 aa, Entamoeba dispar
EYSQLTAPCFGKGEMIIPDSI

SEQ ID NO: 2480761 - protein, 27 aa, Entamoeba dispar
EYSVDIIACLLKCFLQKMPTHIIDTMK

SEQ ID NO: 2480762 - protein, 17 aa, Entamoeba dispar
EYTDCIQEFLAPLNLFD

SEQ ID NO: 2480763 - protein, 21 aa, Entamoeba dispar
EYTNTFAFNLCINMCDSINLI

SEQ ID NO: 2480764 - protein, 27 aa, Entamoeba dispar
EYVFLIDAGKIWLWFGSKALNETKKFS

SEQ ID NO: 2480765 - protein, 20 aa, Entamoeba dispar
EYVIKCGIQGLVIEGQRGKN

SEQ ID NO: 2480766 - protein, 19 aa, Entamoeba dispar
EYVKYIGIIDFQLTDYILL

SEQ ID NO: 2480767 - protein, 20 aa, Entamoeba dispar
EYVYRFLISSLHRIIISPND

SEQ ID NO: 2480768 - protein, 25 aa, Entamoeba dispar
EYVYRSSLRSGEFVEFMKNSYKRTP

SEQ ID NO: 2480769 - protein, 20 aa, Entamoeba dispar
EYYDGGSLFDLIGDLTQPIL

SEQ ID NO: 2480770 - protein, 32 aa, Entamoeba dispar
EYYETPSFYGRRVGTCFVKIVLQLSLPLTIII

SEQ ID NO: 2480771 - protein, 22 aa, Entamoeba dispar
EYYGESSHSIFVASQAGCIDNV

SEQ ID NO: 2480772 - protein, 23 aa, Entamoeba dispar
EYYKKADVVPAYYRVADKESGEP

SEQ ID NO: 2480773 - protein, 18 aa, Entamoeba dispar
EYYLVKWKDYSILECSWV

SEQ ID NO: 2480774 - protein, 20 aa, Entamoeba dispar
EYYMHLGCIEEWCVRTFNEG

SEQ ID NO: 2480775 - protein, 25 aa, Entamoeba dispar
EYYQGRGTLEIEYGKKLLGLTTYLN

SEQ ID NO: 2480776 - protein, 19 aa, Entamoeba dispar
FAACRAIENGCWVFCPNRI

SEQ ID NO: 2480777 - protein, 18 aa, Entamoeba dispar
FAAQSRSAYQMIFMNPYY

SEQ ID NO: 2480778 - protein, 17 aa, Entamoeba dispar
FACKLRYIIELDEIRND

SEQ ID NO: 2480779 - protein, 21 aa, Entamoeba dispar
FACSRGRRDLVELFLGKWKEG

SEQ ID NO: 2480780 - protein, 23 aa, Entamoeba dispar
FADCPIKPVFDDILIAELQPHQH

SEQ ID NO: 2480781 - protein, 27 aa, Entamoeba dispar
FADERIKSFKNILCEWSQKKDMKLIYD

SEQ ID NO: 2480782 - protein, 24 aa, Entamoeba dispar
FADMNNRVAMMMKFIEVANELESL

SEQ ID NO: 2480783 - protein, 20 aa, Entamoeba dispar
FADNKIKGIIFTLESMIGVE

SEQ ID NO: 2480784 - protein, 22 aa, Entamoeba dispar
FADSKLEKIIPCSPRPHCSIIN

SEQ ID NO: 2480785 - protein, 17 aa, Entamoeba dispar
FAEFLKTRCYEHFRYDI

SEQ ID NO: 2480786 - protein, 18 aa, Entamoeba dispar
FAEGKAKIIARAIEGEST

SEQ ID NO: 2480787 - protein, 18 aa, Entamoeba dispar
FAEIVMEFCDGGTLKSFK

SEQ ID NO: 2480788 - protein, 19 aa, Entamoeba dispar
FAFCARLKEVVLQGSLYTL

SEQ ID NO: 2480789 - protein, 17 aa, Entamoeba dispar
FAFCGCSSLRSVNIPCI

SEQ ID NO: 2480790 - protein, 18 aa, Entamoeba dispar
FAFMKALYTKGFPTPIPV

SEQ ID NO: 2480791 - protein, 25 aa, Entamoeba dispar
FAFSFSNPYGHGAIRYICDEPETTL

SEQ ID NO: 2480792 - protein, 22 aa, Entamoeba dispar
FAGHKEYTGWVIPDPLCLMCYL

SEQ ID NO: 2480793 - protein, 27 aa, Entamoeba dispar
FAGKVFPYNEFHVFESLFSLFENYLSI

SEQ ID NO: 2480794 - protein, 18 aa, Entamoeba dispar
FAGLIIISTELLYLEDNA

SEQ ID NO: 2480795 - protein, 18 aa, Entamoeba dispar
FAGLPSLSSICIPSSVTK

SEQ ID NO: 2480796 - protein, 18 aa, Entamoeba dispar
FAGSSKEVILRWRRGKKE

SEQ ID NO: 2480797 - protein, 24 aa, Entamoeba dispar
FAGTSEGVIFGWIKKQKKFELIFA

SEQ ID NO: 2480798 - protein, 17 aa, Entamoeba dispar
FAGVKGVLTVDRLDMTE

SEQ ID NO: 2480799 - protein, 17 aa, Entamoeba dispar
FAIDFIKEIIYKYIEEN

SEQ ID NO: 2480800 - protein, 27 aa, Entamoeba dispar
FAIPDEYRHLFFYLISFLKKLIEMGED

SEQ ID NO: 2480801 - protein, 20 aa, Entamoeba dispar
FAIPRSCLQKPIALKSAISV

SEQ ID NO: 2480802 - protein, 25 aa, Entamoeba dispar
FAIQRCDPAPFYLFDEIDSNLDTLY

SEQ ID NO: 2480803 - protein, 17 aa, Entamoeba dispar
FAIRHACDLIRKGELKV

SEQ ID NO: 2480804 - protein, 18 aa, Entamoeba dispar
FAISSSWDHTLRLWDLTK

SEQ ID NO: 2480805 - protein, 19 aa, Entamoeba dispar
FAIVSACCYAISLRYAGTL

SEQ ID NO: 2480806 - protein, 25 aa, Entamoeba dispar
FAKEIIFGSIFGFKCIGGINEEIAL

SEQ ID NO: 2480807 - protein, 19 aa, Entamoeba dispar
FAKGITSEMLINFLQPNLP

SEQ ID NO: 2480808 - protein, 19 aa, Entamoeba dispar
FAKLKGSTFTPFILEKSTS

SEQ ID NO: 2480809 - protein, 28 aa, Entamoeba dispar
FAKPTPTIARRVFNVLMGESMEIKKRER

SEQ ID NO: 2480810 - protein, 17 aa, Entamoeba dispar
FAKSSCRTFLRTTLKNV

SEQ ID NO: 2480811 - protein, 23 aa, Entamoeba dispar
FAKTNAVQLFIPFRPMLAKPKKS

SEQ ID NO: 2480812 - protein, 27 aa, Entamoeba dispar
FALDFLDGYALFMACSLCNHSCRENMG

SEQ ID NO: 2480813 - protein, 18 aa, Entamoeba dispar
FALIRNMTPPIIPRLNGR

SEQ ID NO: 2480814 - protein, 18 aa, Entamoeba dispar
FALKCLDAMDDAELIMFL

SEQ ID NO: 2480815 - protein, 21 aa, Entamoeba dispar
FALKKRKLKKLTHDQNTSCLE

SEQ ID NO: 2480816 - protein, 17 aa, Entamoeba dispar
FALLKSRMLGMLEEYNR

SEQ ID NO: 2480817 - protein, 18 aa, Entamoeba dispar
FALLSVCVPNGGKLESVS

SEQ ID NO: 2480818 - protein, 24 aa, Entamoeba dispar
FALRNLCILRDQIIPFTEVDVSLR

SEQ ID NO: 2480819 - protein, 23 aa, Entamoeba dispar
FALTSHIYFPFHVIVITETSLFI

SEQ ID NO: 2480820 - protein, 22 aa, Entamoeba dispar
FANDLKSIFYPFAQPCLEVVLK

SEQ ID NO: 2480821 - protein, 17 aa, Entamoeba dispar
FANHFGVGIAFIRKSRS

SEQ ID NO: 2480822 - protein, 25 aa, Entamoeba dispar
FAPKGKKLPIGFLGVYSNAHENQRI

SEQ ID NO: 2480823 - protein, 25 aa, Entamoeba dispar
FAPKILCVELAHLDVPLSLEKSIIV

SEQ ID NO: 2480824 - protein, 17 aa, Entamoeba dispar
FAPMLDVFGKLEDKNYF

SEQ ID NO: 2480825 - protein, 17 aa, Entamoeba dispar
FAPPPVKPFINYTNPFL

SEQ ID NO: 2480826 - protein, 21 aa, Entamoeba dispar
FAPSACNYRPIKFMVINRPKL

SEQ ID NO: 2480827 - protein, 17 aa, Entamoeba dispar
FAPVHSVLPPQRVGVTP

SEQ ID NO: 2480828 - protein, 23 aa, Entamoeba dispar
FAQDAINDMVHWIDDISAVIESI

SEQ ID NO: 2480829 - protein, 18 aa, Entamoeba dispar
FAQMREGIQWVIQNKDIS

SEQ ID NO: 2480830 - protein, 17 aa, Entamoeba dispar
FARGCSSDELGIMCKNF

SEQ ID NO: 2480831 - protein, 19 aa, Entamoeba dispar
FARILNYYKPNIIAYNTLT

SEQ ID NO: 2480832 - protein, 26 aa, Entamoeba dispar
FARPTECLPKVLPFPGHIETKGTVQF

SEQ ID NO: 2480833 - protein, 17 aa, Entamoeba dispar
FASHYYLADSFNHNSDI

SEQ ID NO: 2480834 - protein, 25 aa, Entamoeba dispar
FASLKSIFPICKFQYAIAQLLGIGT

SEQ ID NO: 2480835 - protein, 26 aa, Entamoeba dispar
FASYSMLNRVVELWKQQGVYTQLNKL

SEQ ID NO: 2480836 - protein, 20 aa, Entamoeba dispar
FATDELKHWTGSKLEIASQL

SEQ ID NO: 2480837 - protein, 25 aa, Entamoeba dispar
FATETCFYFIMDYCSGGDFYHTLKE

SEQ ID NO: 2480838 - protein, 22 aa, Entamoeba dispar
FATYLDICKKLGFDQTPDYLQL

SEQ ID NO: 2480839 - protein, 29 aa, Entamoeba dispar
FAVASCYERSVIFIDEIDSLLSARSESEH

SEQ ID NO: 2480840 - protein, 26 aa, Entamoeba dispar
FAVEACKIGLEFQKKVFCVLGGYGLF

SEQ ID NO: 2480841 - protein, 25 aa, Entamoeba dispar
FAVFCIADGCGMGKRPAVSAHVACE

SEQ ID NO: 2480842 - protein, 24 aa, Entamoeba dispar
FAVLKGMCDGGVYVPHSATRFAGA

SEQ ID NO: 2480843 - protein, 23 aa, Entamoeba dispar
FAYPENKLYFFIAASLLVQHKEI

SEQ ID NO: 2480844 - protein, 28 aa, Entamoeba dispar
FCAKHIQPRCCYECLISLECLKNAKCPL

SEQ ID NO: 2480845 - protein, 23 aa, Entamoeba dispar
FCDDKRIPVCKINNSDNNFHRVK

SEQ ID NO: 2480846 - protein, 17 aa, Entamoeba dispar
FCDGGTLQSFFEKSYPV

SEQ ID NO: 2480847 - protein, 22 aa, Entamoeba dispar
FCDMDPQSAFQFNFFCEEKSIC

SEQ ID NO: 2480848 - protein, 19 aa, Entamoeba dispar
FCDNINFTNCKINSMRCDV

SEQ ID NO: 2480849 - protein, 21 aa, Entamoeba dispar
FCDSLCIIYLFFPNIKENQIQ

SEQ ID NO: 2480850 - protein, 23 aa, Entamoeba dispar
FCEAAIKFAPTFKIKIGKQGIYE

SEQ ID NO: 2480851 - protein, 19 aa, Entamoeba dispar
FCEDCVRAYHVLRQNASLI

SEQ ID NO: 2480852 - protein, 18 aa, Entamoeba dispar
FCEFKTSVAVLINQSTLY

SEQ ID NO: 2480853 - protein, 17 aa, Entamoeba dispar
FCEKGNETFKIIVQIGR

SEQ ID NO: 2480854 - protein, 25 aa, Entamoeba dispar
FCENIKRYAVETARSTKSFATGNRY

SEQ ID NO: 2480855 - protein, 26 aa, Entamoeba dispar
FCEPPSKGIICDLLWSDPITEEFLNE

SEQ ID NO: 2480856 - protein, 26 aa, Entamoeba dispar
FCETKPTECLGCFFTGITNVDSSSSN

SEQ ID NO: 2480857 - protein, 18 aa, Entamoeba dispar
FCFEGCSSLTSITIPPLV

SEQ ID NO: 2480858 - protein, 17 aa, Entamoeba dispar
FCFKDCINLQSIVIPSS

SEQ ID NO: 2480859 - protein, 27 aa, Entamoeba dispar
FCFLKYKDPRSCVLAIDNFNGIELNGR

SEQ ID NO: 2480860 - protein, 17 aa, Entamoeba dispar
FCFSEGETLLTQRNLLF

SEQ ID NO: 2480861 - protein, 19 aa, Entamoeba dispar
FCFYSCALLKSINIPTRVT

SEQ ID NO: 2480862 - protein, 17 aa, Entamoeba dispar
FCGCSSLTYINIPSSIN

SEQ ID NO: 2480863 - protein, 25 aa, Entamoeba dispar
FCGIPPEWENMFIALGITKEEIKSN

SEQ ID NO: 2480864 - protein, 23 aa, Entamoeba dispar
FCGRAECIEVFSALNEFSKIGEI

SEQ ID NO: 2480865 - protein, 18 aa, Entamoeba dispar
FCGRYLYVQFGYQVISNL

SEQ ID NO: 2480866 - protein, 23 aa, Entamoeba dispar
FCGTPDYLAPEILTAKGYGIEVD

SEQ ID NO: 2480867 - protein, 25 aa, Entamoeba dispar
FCGTPEYLAPEILLGNGYGFAVDWW

SEQ ID NO: 2480868 - protein, 22 aa, Entamoeba dispar
FCGTPEYLAPEVVIGKDYSEPV

SEQ ID NO: 2480869 - protein, 22 aa, Entamoeba dispar
FCGTPEYLAPEVVKGLDYNEYI

SEQ ID NO: 2480870 - protein, 21 aa, Entamoeba dispar
FCHECQIPIIGLVENMSGYLC

SEQ ID NO: 2480871 - protein, 20 aa, Entamoeba dispar
FCHFICKNFIERLILMNSNE

SEQ ID NO: 2480872 - protein, 25 aa, Entamoeba dispar
FCHIPSIRVIPNWNDSISMYASDGD

SEQ ID NO: 2480873 - protein, 21 aa, Entamoeba dispar
FCKEKKKQIEIRIMYNVENNC

SEQ ID NO: 2480874 - protein, 18 aa, Entamoeba dispar
FCKMFVVHYDRLVFNNLM

SEQ ID NO: 2480875 - protein, 18 aa, Entamoeba dispar
FCLHLGEGHWHNERLREF

SEQ ID NO: 2480876 - protein, 18 aa, Entamoeba dispar
FCNCKELTRIDIPTTVSE

SEQ ID NO: 2480877 - protein, 20 aa, Entamoeba dispar
FCNKQGLNMSSVRFLSDGVR

SEQ ID NO: 2480878 - protein, 25 aa, Entamoeba dispar
FCPLLTTVELRMCVNVTDSGIQMLL

SEQ ID NO: 2480879 - protein, 23 aa, Entamoeba dispar
FCPNPQCGRAIIVLSSERASDNI

SEQ ID NO: 2480880 - protein, 23 aa, Entamoeba dispar
FCPSGLPRNEFTSLTQLTGLTIT

SEQ ID NO: 2480881 - protein, 17 aa, Entamoeba dispar
FCPYNFQVSSKMTADPR

SEQ ID NO: 2480882 - protein, 25 aa, Entamoeba dispar
FCQSLCLLSKMFLDHKTLYYDVEPF

SEQ ID NO: 2480883 - protein, 20 aa, Entamoeba dispar
FCQTEIMVLVVTKVDQKEGR

SEQ ID NO: 2480884 - protein, 19 aa, Entamoeba dispar
FCSCFYDDKILFLGDKNGR

SEQ ID NO: 2480885 - protein, 22 aa, Entamoeba dispar
FCSDLIKGCSRFNINTTIGNIF

SEQ ID NO: 2480886 - protein, 17 aa, Entamoeba dispar
FCSGGTLKSMLKPRNQG

SEQ ID NO: 2480887 - protein, 29 aa, Entamoeba dispar
FCSKIRKLRISIDFCMKFQLKHPEYFTQL

SEQ ID NO: 2480888 - protein, 26 aa, Entamoeba dispar
FCSKIRKLRMEGYYCKKVIEKHPEYF

SEQ ID NO: 2480889 - protein, 21 aa, Entamoeba dispar
FCSSLRRINIPTSISSFGKSC

SEQ ID NO: 2480890 - protein, 22 aa, Entamoeba dispar
FCTASIKTHCFGVDSDKLISNP

SEQ ID NO: 2480891 - protein, 30 aa, Entamoeba dispar
FCTEEEPTFACPFCGTDMGNSSKLQKHVSQ

SEQ ID NO: 2480892 - protein, 18 aa, Entamoeba dispar
FCTPDFRVALQHSDVVTD

SEQ ID NO: 2480893 - protein, 21 aa, Entamoeba dispar
FCTSPLITVIIPIAYHQEIEV

SEQ ID NO: 2480894 - protein, 17 aa, Entamoeba dispar
FCVGRYCDWIHNYAPTF

SEQ ID NO: 2480895 - protein, 17 aa, Entamoeba dispar
FCVHGGLSPDLITIQTI

SEQ ID NO: 2480896 - protein, 24 aa, Entamoeba dispar
FCVTRGRLSEGINFTNHLARAVLI

SEQ ID NO: 2480897 - protein, 19 aa, Entamoeba dispar
FCVYAKMAYVNIFKSSQKC

SEQ ID NO: 2480898 - protein, 20 aa, Entamoeba dispar
FCYAMIIFGIIVIRDDMLDN

SEQ ID NO: 2480899 - protein, 17 aa, Entamoeba dispar
FCYIGDSPIYIKSNKQV

SEQ ID NO: 2480900 - protein, 21 aa, Entamoeba dispar
FCYSACSVFTKGLKEWGSAIL

SEQ ID NO: 2480901 - protein, 19 aa, Entamoeba dispar
FDAARDWMTLFSKIATHIL

SEQ ID NO: 2480902 - protein, 18 aa, Entamoeba dispar
FDAEFPLTLEPKIEKLTF

SEQ ID NO: 2480903 - protein, 23 aa, Entamoeba dispar
FDAEKYTGAGYVQWATCVTDLFK

SEQ ID NO: 2480904 - protein, 17 aa, Entamoeba dispar
FDAIERWMNELKNGCDS

SEQ ID NO: 2480905 - protein, 17 aa, Entamoeba dispar
FDALPLAALVEGNSLGR

SEQ ID NO: 2480906 - protein, 19 aa, Entamoeba dispar
FDAVKMLRINPGLKPQNMI

SEQ ID NO: 2480907 - protein, 19 aa, Entamoeba dispar
FDCFKGCKSLKSITIDKLQ

SEQ ID NO: 2480908 - protein, 30 aa, Entamoeba dispar
FDCPYSERLFKWFIKRNEIIKKQNKKGGEY

SEQ ID NO: 2480909 - protein, 19 aa, Entamoeba dispar
FDCSVSLKQIGRIRGHKVA

SEQ ID NO: 2480910 - protein, 26 aa, Entamoeba dispar
FDDANLAAMDWFEFKAIVSTNGEKIT

SEQ ID NO: 2480911 - protein, 23 aa, Entamoeba dispar
FDDDRLIPTYGFGDVTTTNKSLF

SEQ ID NO: 2480912 - protein, 28 aa, Entamoeba dispar
FDDIHMIPFLWIQLTFGCDGCIGYYERP

SEQ ID NO: 2480913 - protein, 26 aa, Entamoeba dispar
FDDMKWKLEILLILKVKNDTFDSNDI

SEQ ID NO: 2480914 - protein, 25 aa, Entamoeba dispar
FDDRRVFKYVIWYLVSYSEYLKKKE

SEQ ID NO: 2480915 - protein, 18 aa, Entamoeba dispar
FDDRSCVDLKDKWRNIEN

SEQ ID NO: 2480916 - protein, 18 aa, Entamoeba dispar
FDDRSCVDLKDKWRNLEF

SEQ ID NO: 2480917 - protein, 20 aa, Entamoeba dispar
FDDTDTFLLPKGITVLSEII

SEQ ID NO: 2480918 - protein, 24 aa, Entamoeba dispar
FDEALRLLQHYPLKNFNDLDLNAK

SEQ ID NO: 2480919 - protein, 27 aa, Entamoeba dispar
FDEDLIKHCIKPMIHDGDYVNGIEYLY

SEQ ID NO: 2480920 - protein, 17 aa, Entamoeba dispar
FDEEFPLTLEPKIEKLT

SEQ ID NO: 2480921 - protein, 17 aa, Entamoeba dispar
FDEFSKLVSCQNIGELS

SEQ ID NO: 2480922 - protein, 17 aa, Entamoeba dispar
FDEKELQHFVQIMNENG

SEQ ID NO: 2480923 - protein, 22 aa, Entamoeba dispar
FDELFKFILKCLSVYKNQKMIT

SEQ ID NO: 2480924 - protein, 22 aa, Entamoeba dispar
FDELIEILKGFDLSNVKQSHKL

SEQ ID NO: 2480925 - protein, 19 aa, Entamoeba dispar
FDENVEINKFIKPPEFTQN

SEQ ID NO: 2480926 - protein, 18 aa, Entamoeba dispar
FDEPFGIDIEKTMEEFEK

SEQ ID NO: 2480927 - protein, 19 aa, Entamoeba dispar
FDEPFGIDIEKTMEEFEKK

SEQ ID NO: 2480928 - protein, 24 aa, Entamoeba dispar
FDEPRLMCMYVDKVLSGSHAVQTL

SEQ ID NO: 2480929 - protein, 19 aa, Entamoeba dispar
FDEQWKLCIYNKTLEYALR

SEQ ID NO: 2480930 - protein, 17 aa, Entamoeba dispar
FDFDPYYLYSVYNPIIY

SEQ ID NO: 2480931 - protein, 19 aa, Entamoeba dispar
FDFIFKIIISSIECKNKEA

SEQ ID NO: 2480932 - protein, 26 aa, Entamoeba dispar
FDFIKKSFDGDGLFYLADSNEELNTN

SEQ ID NO: 2480933 - protein, 24 aa, Entamoeba dispar
FDFKYLLERAKVLKVKDFSSFSKL

SEQ ID NO: 2480934 - protein, 21 aa, Entamoeba dispar
FDFPYATFNWHKKAITSVEWC

SEQ ID NO: 2480935 - protein, 23 aa, Entamoeba dispar
FDFRPSDLPSIIFPDTSKFIIKS

SEQ ID NO: 2480936 - protein, 18 aa, Entamoeba dispar
FDFSDMFINRCYNVETVC

SEQ ID NO: 2480937 - protein, 24 aa, Entamoeba dispar
FDFVPSTIMYLEFKERETPLPKHI

SEQ ID NO: 2480938 - protein, 18 aa, Entamoeba dispar
FDGAGQRPLFSLRTLCLA

SEQ ID NO: 2480939 - protein, 17 aa, Entamoeba dispar
FDGFVFVDGRSHKEINN

SEQ ID NO: 2480940 - protein, 18 aa, Entamoeba dispar
FDGKIKFFNGNFEFDGKF

SEQ ID NO: 2480941 - protein, 17 aa, Entamoeba dispar
FDGLKIGVSPYHYQLVN

SEQ ID NO: 2480942 - protein, 18 aa, Entamoeba dispar
FDGVPLILENSFRFIEKV

SEQ ID NO: 2480943 - protein, 20 aa, Entamoeba dispar
FDGYGNVIGFEIEGMNKLNY

SEQ ID NO: 2480944 - protein, 18 aa, Entamoeba dispar
FDHFKNSFSMIMGTIVSK

SEQ ID NO: 2480945 - protein, 26 aa, Entamoeba dispar
FDHFPLLYKACLDFDGVSFDFSDMFI

SEQ ID NO: 2480946 - protein, 17 aa, Entamoeba dispar
FDHGLIYMKHRPYPDHR

SEQ ID NO: 2480947 - protein, 17 aa, Entamoeba dispar
FDHKKFDIFKFTRQVAT

SEQ ID NO: 2480948 - protein, 18 aa, Entamoeba dispar
FDIEFVCRMVHSHEVMEF

SEQ ID NO: 2480949 - protein, 25 aa, Entamoeba dispar
FDIEIGDDCFWGCPDNLKKNKVLRE

SEQ ID NO: 2480950 - protein, 20 aa, Entamoeba dispar
FDIEYHRYLLSRAFTKIICK

SEQ ID NO: 2480951 - protein, 17 aa, Entamoeba dispar
FDIFIETLIKWIINSKD

SEQ ID NO: 2480952 - protein, 19 aa, Entamoeba dispar
FDIFLEKYLDGLSNNALYK

SEQ ID NO: 2480953 - protein, 20 aa, Entamoeba dispar
FDIIKEWSYEVFFNTNGTSN

SEQ ID NO: 2480954 - protein, 19 aa, Entamoeba dispar
FDIIQWLFFGIPFTKDTII

SEQ ID NO: 2480955 - protein, 20 aa, Entamoeba dispar
FDIKDPQYAFGLYNQLDGGL

SEQ ID NO: 2480956 - protein, 17 aa, Entamoeba dispar
FDIKIIRQIKEAFETKV

SEQ ID NO: 2480957 - protein, 24 aa, Entamoeba dispar
FDIKKCCFSYCNETAIGTLKFIHP

SEQ ID NO: 2480958 - protein, 20 aa, Entamoeba dispar
FDIKTFVWKQHPVVLEDFQD

SEQ ID NO: 2480959 - protein, 22 aa, Entamoeba dispar
FDIPQCMGMIGGKPGYAHYFHT

SEQ ID NO: 2480960 - protein, 20 aa, Entamoeba dispar
FDIYIRKLNESWNNAITNAS

SEQ ID NO: 2480961 - protein, 24 aa, Entamoeba dispar
FDKAQRIELFISFYNESVKPELKK

SEQ ID NO: 2480962 - protein, 23 aa, Entamoeba dispar
FDKAYGCCGFPICESKSFKPSYI

SEQ ID NO: 2480963 - protein, 25 aa, Entamoeba dispar
FDKCKKLCIDECENCQFIIDKNQIK

SEQ ID NO: 2480964 - protein, 25 aa, Entamoeba dispar
FDKCKKLCIDECENCQFIINKNQIK

SEQ ID NO: 2480965 - protein, 26 aa, Entamoeba dispar
FDKCKKMCSVVRNFDKINSIPYVISH

SEQ ID NO: 2480966 - protein, 20 aa, Entamoeba dispar
FDKCKVDALNLPKEVNHITL

SEQ ID NO: 2480967 - protein, 20 aa, Entamoeba dispar
FDKELFRLKFFFKRDFQEID

SEQ ID NO: 2480968 - protein, 18 aa, Entamoeba dispar
FDKLDLSNIISIKDLSLY

SEQ ID NO: 2480969 - protein, 23 aa, Entamoeba dispar
FDKLNCKWSDFMKRVISGKRDDC

SEQ ID NO: 2480970 - protein, 18 aa, Entamoeba dispar
FDKYCNRLRRIINERYSN

SEQ ID NO: 2480971 - protein, 19 aa, Entamoeba dispar
FDKYLREITLNKGMVKMSL

SEQ ID NO: 2480972 - protein, 19 aa, Entamoeba dispar
FDLFRRFNIATSKKEIQSV

SEQ ID NO: 2480973 - protein, 19 aa, Entamoeba dispar
FDLIVRFVEMLGMPSDEII

SEQ ID NO: 2480974 - protein, 23 aa, Entamoeba dispar
FDLKDHTIHFGAYKNQWFNITPQ

SEQ ID NO: 2480975 - protein, 18 aa, Entamoeba dispar
FDLKFKYDSIKDSLIVTP

SEQ ID NO: 2480976 - protein, 24 aa, Entamoeba dispar
FDLKIKIMEDIVVGLAFLHENQII

SEQ ID NO: 2480977 - protein, 26 aa, Entamoeba dispar
FDLKKELSEGILFAKLINYLQNDLIN

SEQ ID NO: 2480978 - protein, 25 aa, Entamoeba dispar
FDLKKELSEGVLLAKLLNYLQKDII

SEQ ID NO: 2480979 - protein, 18 aa, Entamoeba dispar
FDLLPPGVKLLARIFNEY

SEQ ID NO: 2480980 - protein, 17 aa, Entamoeba dispar
FDLPQQFKQASVQHYFI

SEQ ID NO: 2480981 - protein, 20 aa, Entamoeba dispar
FDLTAICFVAPSSNARLTAN

SEQ ID NO: 2480982 - protein, 18 aa, Entamoeba dispar
FDLVESLKYYESALKLLP

SEQ ID NO: 2480983 - protein, 18 aa, Entamoeba dispar
FDLVKDLSQLTCILNNGN

SEQ ID NO: 2480984 - protein, 22 aa, Entamoeba dispar
FDLYIFEYYLMIQLYSITKDDL

SEQ ID NO: 2480985 - protein, 31 aa, Entamoeba dispar
FDMCSTSLALLWVFYIRQSFIGSYDHEETHL

SEQ ID NO: 2480986 - protein, 17 aa, Entamoeba dispar
FDMDLTHTLPILVDLIL

SEQ ID NO: 2480987 - protein, 21 aa, Entamoeba dispar
FDMGFGPQIKRIIEGIRPDKQ

SEQ ID NO: 2480988 - protein, 19 aa, Entamoeba dispar
FDMKEVYEHESLRNNKIYK

SEQ ID NO: 2480989 - protein, 29 aa, Entamoeba dispar
FDMTKMFCPKCGYHDLRRISYYVLANGLI

SEQ ID NO: 2480990 - protein, 23 aa, Entamoeba dispar
FDNCFFNEIEVFKRCKLIRNPLF

SEQ ID NO: 2480991 - protein, 24 aa, Entamoeba dispar
FDNEELKELIGVGIGIHHAGMNKE

SEQ ID NO: 2480992 - protein, 23 aa, Entamoeba dispar
FDNEIRLTALWLLANLLGLAPSL

SEQ ID NO: 2480993 - protein, 19 aa, Entamoeba dispar
FDNGEYFTYLKLFKEAIPK

SEQ ID NO: 2480994 - protein, 25 aa, Entamoeba dispar
FDNGEYRWAATILNHLVFANPSNEE

SEQ ID NO: 2480995 - protein, 25 aa, Entamoeba dispar
FDNHKKTLLSICEYLIDSGINCELY

SEQ ID NO: 2480996 - protein, 27 aa, Entamoeba dispar
FDNIDAFWLQRIIKGVVEDDNTAQEYA

SEQ ID NO: 2480997 - protein, 20 aa, Entamoeba dispar
FDNKFSKYTLERVPKEFANV

SEQ ID NO: 2480998 - protein, 22 aa, Entamoeba dispar
FDNKSSILLHSIFNHPKNNFLS

SEQ ID NO: 2480999 - protein, 18 aa, Entamoeba dispar
FDNSDGFFHGYDYSEDLR

SEQ ID NO: 2481000 - protein, 26 aa, Entamoeba dispar
FDNSSHWIKIDWNDIVCILKRRYLLQ

SEQ ID NO: 2481001 - protein, 23 aa, Entamoeba dispar
FDNYKRMCECFKDVEDGVEEGTY

SEQ ID NO: 2481002 - protein, 24 aa, Entamoeba dispar
FDPMRRTGQFYGRGEYFGKTADIS

SEQ ID NO: 2481003 - protein, 18 aa, Entamoeba dispar
FDPRQYLGPARQALKELY

SEQ ID NO: 2481004 - protein, 22 aa, Entamoeba dispar
FDPRYDPRFERFDLRYDPRYDR

SEQ ID NO: 2481005 - protein, 23 aa, Entamoeba dispar
FDPRYDPRFERFDLRYDPRYDRY

SEQ ID NO: 2481006 - protein, 17 aa, Entamoeba dispar
FDPSLESCYLKIQKEKQ

SEQ ID NO: 2481007 - protein, 18 aa, Entamoeba dispar
FDPSLPRSGSLSPKPGSR

SEQ ID NO: 2481008 - protein, 17 aa, Entamoeba dispar
FDQFKGVLPQLVELMCD

SEQ ID NO: 2481009 - protein, 26 aa, Entamoeba dispar
FDQLVLQICILFLCPFNQNVIQISQL

SEQ ID NO: 2481010 - protein, 17 aa, Entamoeba dispar
FDQLYRATIGVDFAVKF

SEQ ID NO: 2481011 - protein, 21 aa, Entamoeba dispar
FDQMRVTKVFINIFVEDLLRE

SEQ ID NO: 2481012 - protein, 17 aa, Entamoeba dispar
FDREPIRSFGRIKKITA

SEQ ID NO: 2481013 - protein, 17 aa, Entamoeba dispar
FDRHWSLTSINIENLQF

SEQ ID NO: 2481014 - protein, 21 aa, Entamoeba dispar
FDRLEPFFDGILVSMKSFSLT

SEQ ID NO: 2481015 - protein, 27 aa, Entamoeba dispar
FDRLKRLRPLLEISVKKVDSNICIVEK

SEQ ID NO: 2481016 - protein, 24 aa, Entamoeba dispar
  misc_feature (19)..(21): Xaa can be any naturally occurring amino acid
FDRTDELFLRRGRITSHVXXXWYN

SEQ ID NO: 2481017 - protein, 18 aa, Entamoeba dispar
FDSFIKFLPHNMKHRLLQ

SEQ ID NO: 2481018 - protein, 21 aa, Entamoeba dispar
FDSFIRWQFLKLKEMGKIQFG

SEQ ID NO: 2481019 - protein, 19 aa, Entamoeba dispar
FDSISFFFRTWEVEENGTY

SEQ ID NO: 2481020 - protein, 18 aa, Entamoeba dispar
FDSKRIQLIPTLNGCLLL

SEQ ID NO: 2481021 - protein, 20 aa, Entamoeba dispar
FDSLGSVFGGYMNKPIQTTD

SEQ ID NO: 2481022 - protein, 23 aa, Entamoeba dispar
FDSLVCIMQIFLTSPIYRLKNTI

SEQ ID NO: 2481023 - protein, 20 aa, Entamoeba dispar
FDSLWLSPYANFNFQSFSMN

SEQ ID NO: 2481024 - protein, 27 aa, Entamoeba dispar
FDSQQYPGYNVPQGMQQYGQMNGVPRF

SEQ ID NO: 2481025 - protein, 18 aa, Entamoeba dispar
FDSWEHGKLFLTNYRIKF

SEQ ID NO: 2481026 - protein, 20 aa, Entamoeba dispar
FDTCSLLKSILLPSTISELH

SEQ ID NO: 2481027 - protein, 19 aa, Entamoeba dispar
FDTLIGEGLNESFYLVTSL

SEQ ID NO: 2481028 - protein, 18 aa, Entamoeba dispar
FDVAVGFNKRTEYRMLWF

SEQ ID NO: 2481029 - protein, 19 aa, Entamoeba dispar
FDVCHLNCIPNICECEEDI

SEQ ID NO: 2481030 - protein, 18 aa, Entamoeba dispar
FDVFKLCRSHNCHNCLTK

SEQ ID NO: 2481031 - protein, 23 aa, Entamoeba dispar
FDVKCNLLTLLNFFVKTGHFNDQ

SEQ ID NO: 2481032 - protein, 19 aa, Entamoeba dispar
FDVLCSFNDNYKALRTEIS

SEQ ID NO: 2481033 - protein, 19 aa, Entamoeba dispar
FDVLFDIVVDLSKTNISEN

SEQ ID NO: 2481034 - protein, 19 aa, Entamoeba dispar
FDVPLTCPIGLNRIENPVR

SEQ ID NO: 2481035 - protein, 18 aa, Entamoeba dispar
FDVPRVSIRPSLQPPLRQ

SEQ ID NO: 2481036 - protein, 18 aa, Entamoeba dispar
FDVQIYVYSIKFGDKRYL

SEQ ID NO: 2481037 - protein, 26 aa, Entamoeba dispar
FDVSLKYPLHPNAMYSLISVRGKQQQ

SEQ ID NO: 2481038 - protein, 25 aa, Entamoeba dispar
FDVVDCPLRQLYKILQYLGTIESNL

SEQ ID NO: 2481039 - protein, 23 aa, Entamoeba dispar
FDVVKGWELIDYILKFQPSLYQS

SEQ ID NO: 2481040 - protein, 27 aa, Entamoeba dispar
FDWSKCMGCGICATKCTFGVLVKQPPK

SEQ ID NO: 2481041 - protein, 17 aa, Entamoeba dispar
FDYCISALTIFENMISF

SEQ ID NO: 2481042 - protein, 17 aa, Entamoeba dispar
FDYFVPYNLKDFYEDAT

SEQ ID NO: 2481043 - protein, 18 aa, Entamoeba dispar
FDYGDARVGIVGMSGVGK

SEQ ID NO: 2481044 - protein, 18 aa, Entamoeba dispar
FDYILCSKLDGMKDMQTI

SEQ ID NO: 2481045 - protein, 17 aa, Entamoeba dispar
FDYKKHINYIVPIQGDV

SEQ ID NO: 2481046 - protein, 25 aa, Entamoeba dispar
FDYRLAMSCPDLWVEYLKTKKDEEW

SEQ ID NO: 2481047 - protein, 27 aa, Entamoeba dispar
FEAIDRGRYYVMYTRIKGMRDEDIDVH

SEQ ID NO: 2481048 - protein, 18 aa, Entamoeba dispar
FEALFKPGCALKVREGKL

SEQ ID NO: 2481049 - protein, 18 aa, Entamoeba dispar
FEASIHWMNFARYNELND

SEQ ID NO: 2481050 - protein, 24 aa, Entamoeba dispar
FECFSTFVRKGVVFIAAVDTKKKS

SEQ ID NO: 2481051 - protein, 23 aa, Entamoeba dispar
FEDCKGSALGYIVCDVDHLTYIT

SEQ ID NO: 2481052 - protein, 17 aa, Entamoeba dispar
FEDCNQKEFDRCMKCVD

SEQ ID NO: 2481053 - protein, 17 aa, Entamoeba dispar
FEDEEGICTISKDKIPS

SEQ ID NO: 2481054 - protein, 18 aa, Entamoeba dispar
FEDEYCVGRCEDNEKKPK

SEQ ID NO: 2481055 - protein, 19 aa, Entamoeba dispar
FEDIRYCRMEKLRAGLRTI

SEQ ID NO: 2481056 - protein, 17 aa, Entamoeba dispar
FEDKWNIVKSIFFNSKV

SEQ ID NO: 2481057 - protein, 20 aa, Entamoeba dispar
FEDNAEYGFGMFKANEQRRL

SEQ ID NO: 2481058 - protein, 26 aa, Entamoeba dispar
FEDNCARAALHGIDFSKDKITFYGIH

SEQ ID NO: 2481059 - protein, 17 aa, Entamoeba dispar
FEEANRKTNFSFRYSMP

SEQ ID NO: 2481060 - protein, 18 aa, Entamoeba dispar
FEEARIFINNRIDVDDIY

SEQ ID NO: 2481061 - protein, 17 aa, Entamoeba dispar
FEECFYNFFNKIKTNKT

SEQ ID NO: 2481062 - protein, 17 aa, Entamoeba dispar
FEEEICKTLLNDVPVCF

SEQ ID NO: 2481063 - protein, 25 aa, Entamoeba dispar
FEEEMPMHIDIRWLFTDSYFQKTTL

SEQ ID NO: 2481064 - protein, 24 aa, Entamoeba dispar
FEEEVYGPICVELNVAKDEYTNFV

SEQ ID NO: 2481065 - protein, 22 aa, Entamoeba dispar
FEEFDPHYNIIIGRNGTGKSNF

SEQ ID NO: 2481066 - protein, 25 aa, Entamoeba dispar
FEEGRKLILEQGITKNLIEGFKKNR

SEQ ID NO: 2481067 - protein, 18 aa, Entamoeba dispar
FEEICMNAFIIIRKHGPL

SEQ ID NO: 2481068 - protein, 25 aa, Entamoeba dispar
FEEIRISDEFRCFVVHRELIIISQR

SEQ ID NO: 2481069 - protein, 19 aa, Entamoeba dispar
FEEIYTCLNNMMLEQKVIG

SEQ ID NO: 2481070 - protein, 20 aa, Entamoeba dispar
FEEKRLYSTVFVIMNNLENS

SEQ ID NO: 2481071 - protein, 35 aa, Entamoeba dispar
FEEKYKSIICELYFELHPIFIKSCTLNKVKSLGEL

SEQ ID NO: 2481072 - protein, 23 aa, Entamoeba dispar
FEELKTFVGVFYGRYATLEQKVQ

SEQ ID NO: 2481073 - protein, 26 aa, Entamoeba dispar
FEELNLYCCCSLLEIFSNTILQKDFT

SEQ ID NO: 2481074 - protein, 25 aa, Entamoeba dispar
FEERDERLALLKLFLPEPVLSTSII

SEQ ID NO: 2481075 - protein, 17 aa, Entamoeba dispar
FEERGDVKLSHMGCTIQ

SEQ ID NO: 2481076 - protein, 25 aa, Entamoeba dispar
FEESPMRIQFCKYSIPNNYYSKKVT

SEQ ID NO: 2481077 - protein, 36 aa, Entamoeba dispar
FEETLKEIARYCNMYQFFGYECKEDKVIVTNALSQI

SEQ ID NO: 2481078 - protein, 25 aa, Entamoeba dispar
FEEYQRFHLIPSLVHKNYYQLFNLV

SEQ ID NO: 2481079 - protein, 17 aa, Entamoeba dispar
FEFANISLISKRLSELS

SEQ ID NO: 2481080 - protein, 17 aa, Entamoeba dispar
FEFCVYAIQFGQWETTR

SEQ ID NO: 2481081 - protein, 17 aa, Entamoeba dispar
FEFGARLLDCVVIAIHH

SEQ ID NO: 2481082 - protein, 17 aa, Entamoeba dispar
FEFKDKCSFDELSQDKK

SEQ ID NO: 2481083 - protein, 25 aa, Entamoeba dispar
FEFKSMSAVDAFKLVQCKNKDNTVS

SEQ ID NO: 2481084 - protein, 17 aa, Entamoeba dispar
FEFRRPERFAIKTIQYL

SEQ ID NO: 2481085 - protein, 17 aa, Entamoeba dispar
FEGCPTLTSINIPSSIT

SEQ ID NO: 2481086 - protein, 30 aa, Entamoeba dispar
FEGITPILLTWDFPTPRVLPLIDSLKKAVS

SEQ ID NO: 2481087 - protein, 21 aa, Entamoeba dispar
FEGLKRGKYCVRVFLDNTKTE

SEQ ID NO: 2481088 - protein, 18 aa, Entamoeba dispar
FEGSREWFVQKIMKVVEF

SEQ ID NO: 2481089 - protein, 31 aa, Entamoeba dispar
FEGTIKMGLTFPHGRYVMKWFEEDTHKHSTP

SEQ ID NO: 2481090 - protein, 18 aa, Entamoeba dispar
FEHFILIEIFTQMGAPLK

SEQ ID NO: 2481091 - protein, 23 aa, Entamoeba dispar
FEHICAHKDIYLALPNEPVNGEN

SEQ ID NO: 2481092 - protein, 18 aa, Entamoeba dispar
FEHIFDWEFEIKQIAPEA

SEQ ID NO: 2481093 - protein, 23 aa, Entamoeba dispar
FEHLEVWRKEFISGGNPSDPESF

SEQ ID NO: 2481094 - protein, 17 aa, Entamoeba dispar
FEHPKGMFVLPFEIPKS

SEQ ID NO: 2481095 - protein, 26 aa, Entamoeba dispar
FEHQRIGVKWMYELFKQHAGGIVGDE

SEQ ID NO: 2481096 - protein, 23 aa, Entamoeba dispar
FEIDELKLLPGQILGCNLAALQS

SEQ ID NO: 2481097 - protein, 20 aa, Entamoeba dispar
FEIECWNEHLGFGIFSKKWF

SEQ ID NO: 2481098 - protein, 17 aa, Entamoeba dispar
FEIERLRQIASGWGEQP

SEQ ID NO: 2481099 - protein, 17 aa, Entamoeba dispar
FEIFITIKCTTKIKEQI

SEQ ID NO: 2481100 - protein, 19 aa, Entamoeba dispar
FEIGLRFFFTDVKLLIDFA

SEQ ID NO: 2481101 - protein, 17 aa, Entamoeba dispar
FEIGTAQTIGKRVYMED

SEQ ID NO: 2481102 - protein, 20 aa, Entamoeba dispar
FEIISKKILRERYNHAPKNR

SEQ ID NO: 2481103 - protein, 21 aa, Entamoeba dispar
FEIISKKILRERYNHAPKNRI

SEQ ID NO: 2481104 - protein, 25 aa, Entamoeba dispar
FEIISPSNVCISDFGSDFSKMCHDQ

SEQ ID NO: 2481105 - protein, 25 aa, Entamoeba dispar
FEILFSEQAIVCWVNNILCVKGNCD

SEQ ID NO: 2481106 - protein, 21 aa, Entamoeba dispar
FEILIRFYETFGLIEDKLTPS

SEQ ID NO: 2481107 - protein, 21 aa, Entamoeba dispar
FEILSDLSLTYVMLEKIMQDI

SEQ ID NO: 2481108 - protein, 22 aa, Entamoeba dispar
FEIMGKEIKSVFDSLTKDNNDI

SEQ ID NO: 2481109 - protein, 20 aa, Entamoeba dispar
FEINDKFKLAIKQIDKLPLR

SEQ ID NO: 2481110 - protein, 20 aa, Entamoeba dispar
FEINKLPILLKVWEVDCSES

SEQ ID NO: 2481111 - protein, 19 aa, Entamoeba dispar
FEINSCAIYGIDIMIDSHF

SEQ ID NO: 2481112 - protein, 17 aa, Entamoeba dispar
FEIPRCVSPLREHPPSS

SEQ ID NO: 2481113 - protein, 26 aa, Entamoeba dispar
FEIPTIKLPVMFSLSESRLECLKKIS

SEQ ID NO: 2481114 - protein, 17 aa, Entamoeba dispar
FEIQRFIEFSALKNSLN

SEQ ID NO: 2481115 - protein, 23 aa, Entamoeba dispar
FEKAEKFIGLAHINGMKINMNKI

SEQ ID NO: 2481116 - protein, 17 aa, Entamoeba dispar
FEKAVDDACGWPAEPNN

SEQ ID NO: 2481117 - protein, 17 aa, Entamoeba dispar
FEKEEYKHLLIQYQNSP

SEQ ID NO: 2481118 - protein, 17 aa, Entamoeba dispar
FEKEFQRELNLFPNIET

SEQ ID NO: 2481119 - protein, 17 aa, Entamoeba dispar
FEKEPFKYEKYKEAIIM

SEQ ID NO: 2481120 - protein, 18 aa, Entamoeba dispar
FEKEQRILDFFSYGVVKH

SEQ ID NO: 2481121 - protein, 18 aa, Entamoeba dispar
FEKERRKQQYIKIRKDLK

SEQ ID NO: 2481122 - protein, 25 aa, Entamoeba dispar
FEKEVDSVRALSCITTMLDARVCIA

SEQ ID NO: 2481123 - protein, 19 aa, Entamoeba dispar
FEKKAFCYAMIIFGIIVIR

SEQ ID NO: 2481124 - protein, 22 aa, Entamoeba dispar
FEKKLLKRKVFFLMDKKTYIEQ

SEQ ID NO: 2481125 - protein, 19 aa, Entamoeba dispar
FEKKYRAVINQECWGFISC

SEQ ID NO: 2481126 - protein, 20 aa, Entamoeba dispar
FEKLKKIAIEEGLSKALRPL

SEQ ID NO: 2481127 - protein, 18 aa, Entamoeba dispar
FEKLPPIIKDFIENLTKL

SEQ ID NO: 2481128 - protein, 24 aa, Entamoeba dispar
FEKVKEQAHRAAFKEVQIYMVDED

SEQ ID NO: 2481129 - protein, 21 aa, Entamoeba dispar
FEKVKWWLDDKALDGNFVLLT

SEQ ID NO: 2481130 - protein, 24 aa, Entamoeba dispar
FEKVLLRYHGLYWVTMILVDNNLI

SEQ ID NO: 2481131 - protein, 24 aa, Entamoeba dispar
FEKYKILRKEFLQKAQIFEPKAEA

SEQ ID NO: 2481132 - protein, 19 aa, Entamoeba dispar
FELCCGLCEMIKLLNIEIN

SEQ ID NO: 2481133 - protein, 20 aa, Entamoeba dispar
FELEHCINRYGIIIDETRNY

SEQ ID NO: 2481134 - protein, 22 aa, Entamoeba dispar
FELELLKKAYLDSVKCSDSVNM

SEQ ID NO: 2481135 - protein, 18 aa, Entamoeba dispar
FELETRWATASKEISHSF

SEQ ID NO: 2481136 - protein, 19 aa, Entamoeba dispar
FELHFYPLLQQYLYSTHEY

SEQ ID NO: 2481137 - protein, 28 aa, Entamoeba dispar
FELKKNISRRCLVDYFLYSTMIYNDSIE

SEQ ID NO: 2481138 - protein, 21 aa, Entamoeba dispar
FELKSVFIGIDIQLLFHDLSE

SEQ ID NO: 2481139 - protein, 18 aa, Entamoeba dispar
FELLYFIHCVGGFFHNVF

SEQ ID NO: 2481140 - protein, 26 aa, Entamoeba dispar
FELPRLPEYIKYLCVYSTNSNIVINQ

SEQ ID NO: 2481141 - protein, 24 aa, Entamoeba dispar
FELSIEFMTLLLLDDDTEKINQSI

SEQ ID NO: 2481142 - protein, 25 aa, Entamoeba dispar
FELSWKLTRPNGIVALVAMYESNQS

SEQ ID NO: 2481143 - protein, 24 aa, Entamoeba dispar
FEMCRVTGIPLSYLLPRGQQVKVI

SEQ ID NO: 2481144 - protein, 19 aa, Entamoeba dispar
FEMINCFYDTELELLISGM

SEQ ID NO: 2481145 - protein, 22 aa, Entamoeba dispar
FEMYCMKSNMLELLRIIKDPQQ

SEQ ID NO: 2481146 - protein, 24 aa, Entamoeba dispar
FENAHMYREFGGRINGFKHNEKQK

SEQ ID NO: 2481147 - protein, 23 aa, Entamoeba dispar
FENEFICNFHETFNQVNPNFGSF

SEQ ID NO: 2481148 - protein, 24 aa, Entamoeba dispar
FENFTKWKFVPFIKQHEGNKNQQQ

SEQ ID NO: 2481149 - protein, 23 aa, Entamoeba dispar
FENIRVGAMSGALANKGGVAYRM

SEQ ID NO: 2481150 - protein, 22 aa, Entamoeba dispar
FENLRIKDYFSIEYTSYQLTTQ

SEQ ID NO: 2481151 - protein, 23 aa, Entamoeba dispar
FENSCVRGVFKLSNENFYSTETA

SEQ ID NO: 2481152 - protein, 20 aa, Entamoeba dispar
FENVSNWVEQCCKYNGKHII

SEQ ID NO: 2481153 - protein, 22 aa, Entamoeba dispar
FENYYRHCIRKLNYHLKEENNL

SEQ ID NO: 2481154 - protein, 24 aa, Entamoeba dispar
FEPEEISGMILKYLYEIAQAKLGN

SEQ ID NO: 2481155 - protein, 22 aa, Entamoeba dispar
FEPEEISGMILKYLYEIAQEKL

SEQ ID NO: 2481156 - protein, 23 aa, Entamoeba dispar
FEPEEISGMILKYLYEIAQKKLG

SEQ ID NO: 2481157 - protein, 25 aa, Entamoeba dispar
FEPEEISGMILRYLYENAQAKLGNH

SEQ ID NO: 2481158 - protein, 19 aa, Entamoeba dispar
FEPEEVSGMILKYLYGIAQ

SEQ ID NO: 2481159 - protein, 17 aa, Entamoeba dispar
FEPEKWYNFPKTIQTKR

SEQ ID NO: 2481160 - protein, 18 aa, Entamoeba dispar
FEPFDFNKFEEVKPVPQQ

SEQ ID NO: 2481161 - protein, 18 aa, Entamoeba dispar
FEPFTLVPYCSRLIDISL

SEQ ID NO: 2481162 - protein, 17 aa, Entamoeba dispar
FEPKYKKMRLFSQEAIN

SEQ ID NO: 2481163 - protein, 26 aa, Entamoeba dispar
FEPLTCNWCYRTVCFPEDSIKIISRK

SEQ ID NO: 2481164 - protein, 17 aa, Entamoeba dispar
FEPSGLVQQESFLGGTP

SEQ ID NO: 2481165 - protein, 18 aa, Entamoeba dispar
FEPSSARKAFPCFDEPNY

SEQ ID NO: 2481166 - protein, 19 aa, Entamoeba dispar
FEPYLPIEGSYIPKEFIRE

SEQ ID NO: 2481167 - protein, 26 aa, Entamoeba dispar
FEPYPFCGGCVLCSTFNCTTLKGTNK

SEQ ID NO: 2481168 - protein, 17 aa, Entamoeba dispar
FEQASAIFLTASNNIKL

SEQ ID NO: 2481169 - protein, 17 aa, Entamoeba dispar
FEQKRRVIINSMKEDEE

SEQ ID NO: 2481170 - protein, 21 aa, Entamoeba dispar
FEQKYCILIRCDSEKKLTFNL

SEQ ID NO: 2481171 - protein, 30 aa, Entamoeba dispar
FEQLWEIKGSIEWNRIGVAYELSFRHQEAI

SEQ ID NO: 2481172 - protein, 23 aa, Entamoeba dispar
FEQMDCSNFLPPTSLMYKNIPGF

SEQ ID NO: 2481173 - protein, 18 aa, Entamoeba dispar
FEQMKKKLDNLLISKEFI

SEQ ID NO: 2481174 - protein, 19 aa, Entamoeba dispar
FERDIWRRDFYFWEGKKST

SEQ ID NO: 2481175 - protein, 23 aa, Entamoeba dispar
FERELLTIRSLYTFNTSCAIFIQ

SEQ ID NO: 2481176 - protein, 27 aa, Entamoeba dispar
FERVVCFPGKFFKFYLLSCPCLFHQND

SEQ ID NO: 2481177 - protein, 20 aa, Entamoeba dispar
FERYVIPIKLFKDVEKKIPE

SEQ ID NO: 2481178 - protein, 20 aa, Entamoeba dispar
FESDLNLPLWSSFPSHIELL

SEQ ID NO: 2481179 - protein, 17 aa, Entamoeba dispar
FESGDALSGDFCKGLFS

SEQ ID NO: 2481180 - protein, 17 aa, Entamoeba dispar
FESKLVPSDIVFLKGWI

SEQ ID NO: 2481181 - protein, 17 aa, Entamoeba dispar
FESLDRWLSELRDNADK

SEQ ID NO: 2481182 - protein, 20 aa, Entamoeba dispar
FESLIQLPLIGLTININEKI

SEQ ID NO: 2481183 - protein, 18 aa, Entamoeba dispar
FESLKIPYRVVNIVSGAL

SEQ ID NO: 2481184 - protein, 23 aa, Entamoeba dispar
FESRLLWRVYVFIADMHKKYVVT

SEQ ID NO: 2481185 - protein, 24 aa, Entamoeba dispar
FESYTCSSLALFLLKRALKNRGDM

SEQ ID NO: 2481186 - protein, 28 aa, Entamoeba dispar
FETEELKYFGIFMSQSFLFIKESSIEIV

SEQ ID NO: 2481187 - protein, 21 aa, Entamoeba dispar
FETIFNWRQVNGLKHDDYTRY

SEQ ID NO: 2481188 - protein, 19 aa, Entamoeba dispar
FETKVFDLNAICFVAQSSN

SEQ ID NO: 2481189 - protein, 19 aa, Entamoeba dispar
FETKVFDLTAICFVAPSSN

SEQ ID NO: 2481190 - protein, 17 aa, Entamoeba dispar
FETPLYFIADNNTSLPF

SEQ ID NO: 2481191 - protein, 18 aa, Entamoeba dispar
FETVNIVQRPLCPRYMLL

SEQ ID NO: 2481192 - protein, 26 aa, Entamoeba dispar
FEVCLKSSPLNTIWKSYVLMARHFMN

SEQ ID NO: 2481193 - protein, 25 aa, Entamoeba dispar
FEVFEKYFMMFGAFVECWPDDAFIQ

SEQ ID NO: 2481194 - protein, 29 aa, Entamoeba dispar
FEVIAAINISKGFKIEYSKVLGQVNITDM

SEQ ID NO: 2481195 - protein, 26 aa, Entamoeba dispar
FEVIIPIDDLLPFAAMKMFPNALFGN

SEQ ID NO: 2481196 - protein, 17 aa, Entamoeba dispar
FEVLRRINIPDDILMRK

SEQ ID NO: 2481197 - protein, 24 aa, Entamoeba dispar
FEWAYSAQILLSFEPPEPNDYLSI

SEQ ID NO: 2481198 - protein, 19 aa, Entamoeba dispar
FEWKNEYDQQIVLAVQKNG

SEQ ID NO: 2481199 - protein, 25 aa, Entamoeba dispar
FEWLAESHINEFCQFGREINENPPV

SEQ ID NO: 2481200 - protein, 22 aa, Entamoeba dispar
FEWVKRRFDYGLYISGEIKTPI

SEQ ID NO: 2481201 - protein, 27 aa, Entamoeba dispar
FEWVSDFYCSLGFVLTTYIDKIDSNQF

SEQ ID NO: 2481202 - protein, 17 aa, Entamoeba dispar
FEYDWEFAGQKIKLTGT

SEQ ID NO: 2481203 - protein, 17 aa, Entamoeba dispar
FEYKLKNLLVLKDNLII

SEQ ID NO: 2481204 - protein, 28 aa, Entamoeba dispar
FEYKVPEIKKLIQFGNGFGNILRLTGKE

SEQ ID NO: 2481205 - protein, 17 aa, Entamoeba dispar
FEYKYFMKKTEVVWEDG

SEQ ID NO: 2481206 - protein, 25 aa, Entamoeba dispar
FEYLLESLGFAFALPMESSQTIGNT

SEQ ID NO: 2481207 - protein, 19 aa, Entamoeba dispar
FEYSLFVYTLFFERSTQLV

SEQ ID NO: 2481208 - protein, 31 aa, Entamoeba dispar
FEYSNLIPREWLTKFDIVFQCGIPEETFYTT

SEQ ID NO: 2481209 - protein, 19 aa, Entamoeba dispar
FEYYETFIVKSSVYKAFVI

SEQ ID NO: 2481210 - protein, 25 aa, Entamoeba dispar
FFALPIEMSKALLLSTIENKESIKL

SEQ ID NO: 2481211 - protein, 18 aa, Entamoeba dispar
FFDHIARLIPSMKRPEEI

SEQ ID NO: 2481212 - protein, 20 aa, Entamoeba dispar
FFDIPSEITSLIPSMEHFTR

SEQ ID NO: 2481213 - protein, 23 aa, Entamoeba dispar
FFDKEFTQYIPLQIYELLQTIGT

SEQ ID NO: 2481214 - protein, 18 aa, Entamoeba dispar
FFDPSEIEYCDGLLSLRP

SEQ ID NO: 2481215 - protein, 22 aa, Entamoeba dispar
FFECGYELHGYCLVFELHIINL

SEQ ID NO: 2481216 - protein, 23 aa, Entamoeba dispar
FFECGYELHGYCLVFELHIINLN

SEQ ID NO: 2481217 - protein, 18 aa, Entamoeba dispar
FFEDGFRRVIPYYKEFKV

SEQ ID NO: 2481218 - protein, 18 aa, Entamoeba dispar
FFEILKFGVNLEEAINYT

SEQ ID NO: 2481219 - protein, 19 aa, Entamoeba dispar
FFEKIFVVDPFERINTFQL

SEQ ID NO: 2481220 - protein, 18 aa, Entamoeba dispar
FFENCGFIQVSLPSTLRS

SEQ ID NO: 2481221 - protein, 25 aa, Entamoeba dispar
FFENCSKAQCSLELQMKGEVNKEED

SEQ ID NO: 2481222 - protein, 19 aa, Entamoeba dispar
FFERHWDIVCHLKEFKKES

SEQ ID NO: 2481223 - protein, 21 aa, Entamoeba dispar
FFERIRWNTLLSESREDIFVP

SEQ ID NO: 2481224 - protein, 27 aa, Entamoeba dispar
FFFETFKKLRVGAVLYLLYGRQSQNSR

SEQ ID NO: 2481225 - protein, 27 aa, Entamoeba dispar
FFGCDELEFPLCFTVFSASLYSLNNQS

SEQ ID NO: 2481226 - protein, 17 aa, Entamoeba dispar
FFGEVIIHYNIWDFPNW

SEQ ID NO: 2481227 - protein, 26 aa, Entamoeba dispar
FFGKCLRGGFMPLEKDFLFKTLTMQD

SEQ ID NO: 2481228 - protein, 27 aa, Entamoeba dispar
FFGYYLKEEWECIASIFEKYQIYTKNT

SEQ ID NO: 2481229 - protein, 20 aa, Entamoeba dispar
FFIHKLCKHQQLTFDVTENY

SEQ ID NO: 2481230 - protein, 18 aa, Entamoeba dispar
FFIKYSYDDLVNKKFPKG

SEQ ID NO: 2481231 - protein, 21 aa, Entamoeba dispar
FFIPKEIYRLIDYIIQHYEPN

SEQ ID NO: 2481232 - protein, 26 aa, Entamoeba dispar
FFISLCTSLVYRCHNYFASYIIFSTL

SEQ ID NO: 2481233 - protein, 20 aa, Entamoeba dispar
FFKIQVDIIIAVFIKLSRGT

SEQ ID NO: 2481234 - protein, 17 aa, Entamoeba dispar
FFLAEGILLPENIKIHG

SEQ ID NO: 2481235 - protein, 17 aa, Entamoeba dispar
FFLECFSPEYSFEEPIY

SEQ ID NO: 2481236 - protein, 17 aa, Entamoeba dispar
FFLLCVDDPVPNVRIHL

SEQ ID NO: 2481237 - protein, 18 aa, Entamoeba dispar
FFLMNAMKEAVKYVDQSE

SEQ ID NO: 2481238 - protein, 32 aa, Entamoeba dispar
FFLNIFGSLLLKFNIYGGWTFIYQILYSVLKY

SEQ ID NO: 2481239 - protein, 19 aa, Entamoeba dispar
FFLRRLGEAQAKYETMLPL

SEQ ID NO: 2481240 - protein, 17 aa, Entamoeba dispar
FFMITVIRELLKDCTDQ

SEQ ID NO: 2481241 - protein, 18 aa, Entamoeba dispar
FFNFIMKTAERFYEQRNF

SEQ ID NO: 2481242 - protein, 26 aa, Entamoeba dispar
FFNILKKREEVWEKLEVLKLSNCEIT

SEQ ID NO: 2481243 - protein, 19 aa, Entamoeba dispar
FFNKNIKVFFNKIKKETMY

SEQ ID NO: 2481244 - protein, 17 aa, Entamoeba dispar
FFNQRGNVMPYLIQNKL

SEQ ID NO: 2481245 - protein, 21 aa, Entamoeba dispar
FFNVPCSFDPLKQNEQINGIV

SEQ ID NO: 2481246 - protein, 18 aa, Entamoeba dispar
FFPDSRQIVLKTFEELCN

SEQ ID NO: 2481247 - protein, 21 aa, Entamoeba dispar
FFPTYRDVYRFIKVNRKCLET

SEQ ID NO: 2481248 - protein, 23 aa, Entamoeba dispar
FFQMYPFEIIVQFDALGIFELSI

SEQ ID NO: 2481249 - protein, 24 aa, Entamoeba dispar
FFQMYPFEIIVQFDALGIFELSIS

SEQ ID NO: 2481250 - protein, 23 aa, Entamoeba dispar
FFREFNRPLAMSFDGIRHDSESP

SEQ ID NO: 2481251 - protein, 17 aa, Entamoeba dispar
FFRSLCEIILEQIDQRS

SEQ ID NO: 2481252 - protein, 23 aa, Entamoeba dispar
FFRSVKFQLIRNIPPPIIPEVNG

SEQ ID NO: 2481253 - protein, 23 aa, Entamoeba dispar
FFSAPNPLFSRLQTLSPEPLNTQ

SEQ ID NO: 2481254 - protein, 20 aa, Entamoeba dispar
FFSIELMNFMLMAKKDDFNL

SEQ ID NO: 2481255 - protein, 24 aa, Entamoeba dispar
FFSMKEMFIEFKVSKTQINQIVGY

SEQ ID NO: 2481256 - protein, 18 aa, Entamoeba dispar
FFSQPIPVKCSILDQPLS

SEQ ID NO: 2481257 - protein, 17 aa, Entamoeba dispar
FFSRKDMHIGFISNTFM

SEQ ID NO: 2481258 - protein, 17 aa, Entamoeba dispar
FFSRQRELVISKPNALF

SEQ ID NO: 2481259 - protein, 18 aa, Entamoeba dispar
FFSTDFYSAFNYVMNQTF

SEQ ID NO: 2481260 - protein, 23 aa, Entamoeba dispar
FFTCQRFKEPTLLTCEKGIYLMV

SEQ ID NO: 2481261 - protein, 18 aa, Entamoeba dispar
FFTHLVVEACHRTLHGYE

SEQ ID NO: 2481262 - protein, 24 aa, Entamoeba dispar
FFTKEQLYHYGISVIQKCYYVPQL

SEQ ID NO: 2481263 - protein, 18 aa, Entamoeba dispar
FFTSESLSMNCPRVTQTF

SEQ ID NO: 2481264 - protein, 17 aa, Entamoeba dispar
FFVFTLRNPHNIQPIKF

SEQ ID NO: 2481265 - protein, 18 aa, Entamoeba dispar
FFVNKTLITLCISKDENL

SEQ ID NO: 2481266 - protein, 19 aa, Entamoeba dispar
FFVTDGLFYKILKKTKASG

SEQ ID NO: 2481267 - protein, 21 aa, Entamoeba dispar
FFWDYKALKKFCQSGPARTFC

SEQ ID NO: 2481268 - protein, 20 aa, Entamoeba dispar
FFWMAYCPIKPKSEKLSQII

SEQ ID NO: 2481269 - protein, 29 aa, Entamoeba dispar
FFYDLPSTLFKYLLYPIIFKDSFSQQSII

SEQ ID NO: 2481270 - protein, 21 aa, Entamoeba dispar
FFYDQRTIFYFFKKNFENKAC

SEQ ID NO: 2481271 - protein, 25 aa, Entamoeba dispar
FFYKIKRKPSLILNIGYYQLRLVFN

SEQ ID NO: 2481272 - protein, 19 aa, Entamoeba dispar
FGAEPKAVPGVPNLSVMEV

SEQ ID NO: 2481273 - protein, 17 aa, Entamoeba dispar
FGAKATFTNRGKRVSDI

SEQ ID NO: 2481274 - protein, 17 aa, Entamoeba dispar
FGARAMMLQVRVSNKPA

SEQ ID NO: 2481275 - protein, 17 aa, Entamoeba dispar
FGCDGCIGYYERPLSNV

SEQ ID NO: 2481276 - protein, 19 aa, Entamoeba dispar
FGCGSCGPRAFYGTTTEHL

SEQ ID NO: 2481277 - protein, 26 aa, Entamoeba dispar
FGCIAAELILGIPIFPGSSEYNQLER

SEQ ID NO: 2481278 - protein, 25 aa, Entamoeba dispar
FGCVAAELFLGIPLFPGENEYNQLT

SEQ ID NO: 2481279 - protein, 18 aa, Entamoeba dispar
FGDCFEVAMNREKFPEKI

SEQ ID NO: 2481280 - protein, 17 aa, Entamoeba dispar
FGDCKVGVLTKDLTVIF

SEQ ID NO: 2481281 - protein, 21 aa, Entamoeba dispar
FGDDMARVVIIVGIPYPSLGD

SEQ ID NO: 2481282 - protein, 26 aa, Entamoeba dispar
FGDDQFYHRFGFETSTKYGIKTDIPC

SEQ ID NO: 2481283 - protein, 25 aa, Entamoeba dispar
FGDFKDFLVKMANVRKDYAKSMLRM

SEQ ID NO: 2481284 - protein, 17 aa, Entamoeba dispar
FGDGCFCECGCEEELMK

SEQ ID NO: 2481285 - protein, 26 aa, Entamoeba dispar
FGDIELYKFIGRVVAKTVYDGEFLDV

SEQ ID NO: 2481286 - protein, 22 aa, Entamoeba dispar
FGDIKISVVLVRPMHEDNIGAV

SEQ ID NO: 2481287 - protein, 26 aa, Entamoeba dispar
FGDYNIAKCRIITFKGKSESRGFGYL

SEQ ID NO: 2481288 - protein, 21 aa, Entamoeba dispar
FGEDLSHTGIRLSLSRFNTEE

SEQ ID NO: 2481289 - protein, 18 aa, Entamoeba dispar
FGEKPIKSQYLIQNADYT

SEQ ID NO: 2481290 - protein, 26 aa, Entamoeba dispar
FGELYRRAANMGSWKQVLIKNYSRIQ

SEQ ID NO: 2481291 - protein, 18 aa, Entamoeba dispar
FGENMTVLCVMNGKIDPA

SEQ ID NO: 2481292 - protein, 24 aa, Entamoeba dispar
FGEVGSLIPFCDFSNHCTQAKVTY

SEQ ID NO: 2481293 - protein, 17 aa, Entamoeba dispar
FGFLKTKHEFLIKLFTK

SEQ ID NO: 2481294 - protein, 26 aa, Entamoeba dispar
FGFPLQFKIPLAFSLSVVANIKDYQA

SEQ ID NO: 2481295 - protein, 18 aa, Entamoeba dispar
FGGCYQLRPLVSLPDQCY

SEQ ID NO: 2481296 - protein, 17 aa, Entamoeba dispar
FGGDAYEYIKLTKTKTP

SEQ ID NO: 2481297 - protein, 27 aa, Entamoeba dispar
FGGDCNRIRFIPSTSFIVTQQSLISTN

SEQ ID NO: 2481298 - protein, 19 aa, Entamoeba dispar
FGGFCTAAPGLHDDNHTSV

SEQ ID NO: 2481299 - protein, 19 aa, Entamoeba dispar
FGGFCTAAPGLHDDNLTSI

SEQ ID NO: 2481300 - protein, 20 aa, Entamoeba dispar
FGGGILYVSCCKIVNDNVII

SEQ ID NO: 2481301 - protein, 18 aa, Entamoeba dispar
FGGKRGWVPNEFIKPMGL

SEQ ID NO: 2481302 - protein, 23 aa, Entamoeba dispar
FGHFLGNIIKLGFYNKESAPFVL

SEQ ID NO: 2481303 - protein, 36 aa, Entamoeba dispar
FGHQFEKRSGIGVVCPHGQYSPIFFQFLDCVNILLH

SEQ ID NO: 2481304 - protein, 22 aa, Entamoeba dispar
FGHRVKSVSLAIFSMAEVDAIK

SEQ ID NO: 2481305 - protein, 23 aa, Entamoeba dispar
FGIEGLCHSGIFHAGKRRFVSLA

SEQ ID NO: 2481306 - protein, 20 aa, Entamoeba dispar
FGIEICKNVYLGSAAAGANI

SEQ ID NO: 2481307 - protein, 17 aa, Entamoeba dispar
FGIELLDIIITDHFESL

SEQ ID NO: 2481308 - protein, 17 aa, Entamoeba dispar
FGIKPTLSDHPLFAVSR

SEQ ID NO: 2481309 - protein, 30 aa, Entamoeba dispar
FGILIFKLLTGFCPFELIQMDPFTAIHVQA

SEQ ID NO: 2481310 - protein, 28 aa, Entamoeba dispar
FGIPDTLRLEIWKLFLQPKKEIVEEKTA

SEQ ID NO: 2481311 - protein, 17 aa, Entamoeba dispar
FGIPLLSMHSIREIGGI

SEQ ID NO: 2481312 - protein, 26 aa, Entamoeba dispar
FGIPLQRLNQIPTIITLICQRLASHQ

SEQ ID NO: 2481313 - protein, 19 aa, Entamoeba dispar
FGIQLCVGNSLLAAKACQV

SEQ ID NO: 2481314 - protein, 25 aa, Entamoeba dispar
FGITKKAINEWILKSLIKNIQKKRE

SEQ ID NO: 2481315 - protein, 24 aa, Entamoeba dispar
FGIYLKSRIGLVGPNGTGKSTLMK

SEQ ID NO: 2481316 - protein, 17 aa, Entamoeba dispar
FGKDATRQEIIDALNKF

SEQ ID NO: 2481317 - protein, 26 aa, Entamoeba dispar
FGKDVKKNFIAILTFCDGQTPKILSS

SEQ ID NO: 2481318 - protein, 21 aa, Entamoeba dispar
FGKDVKKNFIAMLTFCDAEDP

SEQ ID NO: 2481319 - protein, 23 aa, Entamoeba dispar
FGKEYIRLRCPHAQFTEAKSSES

SEQ ID NO: 2481320 - protein, 24 aa, Entamoeba dispar
FGKEYIRLRCPHAQFTEAKSSESD

SEQ ID NO: 2481321 - protein, 28 aa, Entamoeba dispar
FGKKEKLPCPFTYLQLSEMCGWNDTDKK

SEQ ID NO: 2481322 - protein, 25 aa, Entamoeba dispar
FGKKVKYCMIMKKIPLINPLSLFSL

SEQ ID NO: 2481323 - protein, 21 aa, Entamoeba dispar
FGKNRSGIIQTIFKDKGMEAT

SEQ ID NO: 2481324 - protein, 17 aa, Entamoeba dispar
FGKYYEVEHAISSGINE

SEQ ID NO: 2481325 - protein, 18 aa, Entamoeba dispar
FGLEKEIWDEMVKIGISL

SEQ ID NO: 2481326 - protein, 24 aa, Entamoeba dispar
FGLESIACCIPLGVDTIEFVFNLV

SEQ ID NO: 2481327 - protein, 21 aa, Entamoeba dispar
FGLRNNPRIILYVNNPNTGEM

SEQ ID NO: 2481328 - protein, 30 aa, Entamoeba dispar
FGNDFMAKFNGAYCNLPLLEHMTFIDSPGV

SEQ ID NO: 2481329 - protein, 31 aa, Entamoeba dispar
FGNDFMAKFNGSFCNLPLLEHLTFIDSPGVL

SEQ ID NO: 2481330 - protein, 31 aa, Entamoeba dispar
FGNEFMAKFNGSFCNLPLLEHLTFIDSPGVL

SEQ ID NO: 2481331 - protein, 23 aa, Entamoeba dispar
FGNKCLSCSTSNFDTEEIITTEK

SEQ ID NO: 2481332 - protein, 18 aa, Entamoeba dispar
FGNKHSINKLILLCSQKV

SEQ ID NO: 2481333 - protein, 18 aa, Entamoeba dispar
FGNKVRSIHVNKMIANII

SEQ ID NO: 2481334 - protein, 24 aa, Entamoeba dispar
FGNLFPFLKICCGMNDDLIQQSMN

SEQ ID NO: 2481335 - protein, 28 aa, Entamoeba dispar
FGNNQLNFPLCFTIFGATHYSFKNKAAV

SEQ ID NO: 2481336 - protein, 25 aa, Entamoeba dispar
FGNSMYFQNCGFLGNILNKAFKQNI

SEQ ID NO: 2481337 - protein, 19 aa, Entamoeba dispar
FGNSMYIDFALNQNEENIN

SEQ ID NO: 2481338 - protein, 18 aa, Entamoeba dispar
FGNSNFFSIDKKPENVNG

SEQ ID NO: 2481339 - protein, 18 aa, Entamoeba dispar
FGPACVRNPDLTWEQCAN

SEQ ID NO: 2481340 - protein, 21 aa, Entamoeba dispar
FGPFKRFVLKGIQMLEHQPGF

SEQ ID NO: 2481341 - protein, 17 aa, Entamoeba dispar
FGPSGEEPRTFEIHCGT

SEQ ID NO: 2481342 - protein, 23 aa, Entamoeba dispar
FGPSLKPFTCMIAGSYWANLTVI

SEQ ID NO: 2481343 - protein, 19 aa, Entamoeba dispar
FGPSWIKFNGLTVVRTSVE

SEQ ID NO: 2481344 - protein, 24 aa, Entamoeba dispar
FGQKARKALSDSLDIIYECIGASD

SEQ ID NO: 2481345 - protein, 18 aa, Entamoeba dispar
FGQSNGWINKVSNLEDYQ

SEQ ID NO: 2481346 - protein, 18 aa, Entamoeba dispar
FGQWGFLIYYILSKGGSV

SEQ ID NO: 2481347 - protein, 25 aa, Entamoeba dispar
FGQYIRIDWDYGFVEGRQYGRGDGG

SEQ ID NO: 2481348 - protein, 25 aa, Entamoeba dispar
FGRIYKKVMNLWDLKYKLIDWKSYF

SEQ ID NO: 2481349 - protein, 19 aa, Entamoeba dispar
FGSCWNDGRVVTAIIHSLF

SEQ ID NO: 2481350 - protein, 22 aa, Entamoeba dispar
FGSDWKRSYLFCYYEITTDQLT

SEQ ID NO: 2481351 - protein, 19 aa, Entamoeba dispar
FGSFLAGAVNYVLPSVDEQ

SEQ ID NO: 2481352 - protein, 20 aa, Entamoeba dispar
FGSHHWPTWGNQRVNEYWEK

SEQ ID NO: 2481353 - protein, 23 aa, Entamoeba dispar
FGSNTCWHLYGIILRTEKHYEEA

SEQ ID NO: 2481354 - protein, 17 aa, Entamoeba dispar
FGSTMGGFGNNNTFGNT

SEQ ID NO: 2481355 - protein, 22 aa, Entamoeba dispar
FGTACFYKCGCEEMLKPNKTIP

SEQ ID NO: 2481356 - protein, 22 aa, Entamoeba dispar
FGTACFYKCGCEEMLKQNKTIP

SEQ ID NO: 2481357 - protein, 18 aa, Entamoeba dispar
FGTCYEIENGDGIFFKDE

SEQ ID NO: 2481358 - protein, 25 aa, Entamoeba dispar
FGTHNWPTWGNKRIVEYYEKQRDMY

SEQ ID NO: 2481359 - protein, 28 aa, Entamoeba dispar
FGTKETNMWIKIPIDQGIIKEIDNRTYL

SEQ ID NO: 2481360 - protein, 19 aa, Entamoeba dispar
FGTKNDFKQLCEVAHQNNI

SEQ ID NO: 2481361 - protein, 17 aa, Entamoeba dispar
FGTQALKKLIVVSMNDN

SEQ ID NO: 2481362 - protein, 17 aa, Entamoeba dispar
FGTTNNLSFNVFNSDLQ

SEQ ID NO: 2481363 - protein, 17 aa, Entamoeba dispar
FGVIMPQCTLFRNSNGY

SEQ ID NO: 2481364 - protein, 25 aa, Entamoeba dispar
FGVKEMLNIYGFRNSISLLPYSKRK

SEQ ID NO: 2481365 - protein, 23 aa, Entamoeba dispar
FGYCKKEVKTQISYSANLYGFAE

SEQ ID NO: 2481366 - protein, 33 aa, Entamoeba dispar
FGYLRYEMDQTKKFLCVCWCGQAAPDNLKTKFV

SEQ ID NO: 2481367 - protein, 18 aa, Entamoeba dispar
FGYVFGAFVSVPIHETNK

SEQ ID NO: 2481368 - protein, 24 aa, Entamoeba dispar
FHADTCIGDLLSLLITYITPYLSF

SEQ ID NO: 2481369 - protein, 23 aa, Entamoeba dispar
FHANPRSFCGYVYPDKFESTRVI

SEQ ID NO: 2481370 - protein, 22 aa, Entamoeba dispar
FHATWCKDCINVRPLYRKLITE

SEQ ID NO: 2481371 - protein, 18 aa, Entamoeba dispar
FHDIIKVKGSIYLMGLAL

SEQ ID NO: 2481372 - protein, 19 aa, Entamoeba dispar
FHEGCFVCSVCGIPLNENF

SEQ ID NO: 2481373 - protein, 18 aa, Entamoeba dispar
FHFIRDGKIEDIKKMIDT

SEQ ID NO: 2481374 - protein, 18 aa, Entamoeba dispar
FHFNPIQFKSLFKNPQKK

SEQ ID NO: 2481375 - protein, 31 aa, Entamoeba dispar
FHFPFYFEYLSKWPEMCFIAKDCNGRVEGYH

SEQ ID NO: 2481376 - protein, 18 aa, Entamoeba dispar
FHIGFFRPIIQVLQCVCK

SEQ ID NO: 2481377 - protein, 22 aa, Entamoeba dispar
FHIHFCTIHSPLFQSLNSVIGR

SEQ ID NO: 2481378 - protein, 18 aa, Entamoeba dispar
FHIIPSIQAMSNYLNESV

SEQ ID NO: 2481379 - protein, 17 aa, Entamoeba dispar
FHIPRLIIPNDRINISP

SEQ ID NO: 2481380 - protein, 23 aa, Entamoeba dispar
FHKEITIIIKLIIPKILEDNPTN

SEQ ID NO: 2481381 - protein, 19 aa, Entamoeba dispar
FHKKLTWLKKFPKEQEELA

SEQ ID NO: 2481382 - protein, 23 aa, Entamoeba dispar
FHKKVINGQDCFVHESFDPTDFS

SEQ ID NO: 2481383 - protein, 32 aa, Entamoeba dispar
FHKLEYKTGICFKHEFFVRDAPEFLDKIKRKK

SEQ ID NO: 2481384 - protein, 17 aa, Entamoeba dispar
FHKLLCQKEYYLNELEQ

SEQ ID NO: 2481385 - protein, 25 aa, Entamoeba dispar
FHKSAVKALCFEINRNNVILSGGGI

SEQ ID NO: 2481386 - protein, 19 aa, Entamoeba dispar
FHPEHFVCSFCVNPLTESS

SEQ ID NO: 2481387 - protein, 18 aa, Entamoeba dispar
FHPFLPWIYSTGADGTIQ

SEQ ID NO: 2481388 - protein, 18 aa, Entamoeba dispar
FHPHEFARQITLMQNDLF

SEQ ID NO: 2481389 - protein, 17 aa, Entamoeba dispar
FHPIEYFSPKETKLGEV

SEQ ID NO: 2481390 - protein, 18 aa, Entamoeba dispar
FHPLITRIVAERKMIFNE

SEQ ID NO: 2481391 - protein, 18 aa, Entamoeba dispar
FHPNVFKDGRICLDILQD

SEQ ID NO: 2481392 - protein, 26 aa, Entamoeba dispar
FHQMKQWSVCIPKLNAKTMIREEVVK

SEQ ID NO: 2481393 - protein, 28 aa, Entamoeba dispar
FHQMLLKGELPLSIGGGIGQSRLCMFYL

SEQ ID NO: 2481394 - protein, 18 aa, Entamoeba dispar
FHRKEYQEGITFGLKQRE

SEQ ID NO: 2481395 - protein, 17 aa, Entamoeba dispar
FHRPLFIEIHTISVFVP

SEQ ID NO: 2481396 - protein, 22 aa, Entamoeba dispar
FHRVKGRFKRRDQIFEIESIIQ

SEQ ID NO: 2481397 - protein, 26 aa, Entamoeba dispar
FHRVYFKILESIGYYHCKVITINNNK

SEQ ID NO: 2481398 - protein, 18 aa, Entamoeba dispar
FHSELALFRDREIPSNTT

SEQ ID NO: 2481399 - protein, 23 aa, Entamoeba dispar
FHSHLPSTLLLTLLDRNKTQLII

SEQ ID NO: 2481400 - protein, 24 aa, Entamoeba dispar
FHSSLRPVPLIAHIDGFPTKAYCP

SEQ ID NO: 2481401 - protein, 24 aa, Entamoeba dispar
FHVFNCIWNKFIFKASPHIVNNEI

SEQ ID NO: 2481402 - protein, 20 aa, Entamoeba dispar
FHVIYIPLLRHPIIFPTMKL

SEQ ID NO: 2481403 - protein, 25 aa, Entamoeba dispar
FHVQANCLICHKPLTPRDLICRYCQ

SEQ ID NO: 2481404 - protein, 27 aa, Entamoeba dispar
FHYHMYFKDNCLLSDFTIHSINTIVFT

SEQ ID NO: 2481405 - protein, 17 aa, Entamoeba dispar
FHYKEFSRQISFQQNEL

SEQ ID NO: 2481406 - protein, 19 aa, Entamoeba dispar
FHYLFGVKEAGFYGIVKMD

SEQ ID NO: 2481407 - protein, 23 aa, Entamoeba dispar
FHYLHRHILRFISSVEEINSNVF

SEQ ID NO: 2481408 - protein, 17 aa, Entamoeba dispar
FIAGGSCDNSYSVYSIE

SEQ ID NO: 2481409 - protein, 26 aa, Entamoeba dispar
FIAKDMWRVMFGYGVDVGRVKGKTNE

SEQ ID NO: 2481410 - protein, 20 aa, Entamoeba dispar
FICDLCASLHTECKHTKQTY

SEQ ID NO: 2481411 - protein, 19 aa, Entamoeba dispar
FICGPCSRSHMKLSHKQLK

SEQ ID NO: 2481412 - protein, 19 aa, Entamoeba dispar
FICPCCHKESSIFPPTHGG

SEQ ID NO: 2481413 - protein, 19 aa, Entamoeba dispar
FICSTCCIQFSSSEERTTH

SEQ ID NO: 2481414 - protein, 22 aa, Entamoeba dispar
FIDCELPFSISLYPHHLKNIKG

SEQ ID NO: 2481415 - protein, 24 aa, Entamoeba dispar
FIDDGEKLFLHGLHLYSKKLQDME

SEQ ID NO: 2481416 - protein, 17 aa, Entamoeba dispar
FIDEINDVIKLFVIEEI

SEQ ID NO: 2481417 - protein, 25 aa, Entamoeba dispar
FIDESLRLKIKYALKLSTGKRDLIK

SEQ ID NO: 2481418 - protein, 22 aa, Entamoeba dispar
FIDESYIIFDLLLFKEIIEKGY

SEQ ID NO: 2481419 - protein, 34 aa, Entamoeba dispar
FIDGYQFCIGFYFSIQSVKEWEWIVVGQNSFAFM

SEQ ID NO: 2481420 - protein, 18 aa, Entamoeba dispar
FIDHCEAIANLLLPSSMT

SEQ ID NO: 2481421 - protein, 20 aa, Entamoeba dispar
FIDIVIDLRSDYSPLLETLN

SEQ ID NO: 2481422 - protein, 21 aa, Entamoeba dispar
FIDKCKLLYPKGNIKGKKEQW

SEQ ID NO: 2481423 - protein, 22 aa, Entamoeba dispar
FIDKCKLLYPKGNIKGKKEQWI

SEQ ID NO: 2481424 - protein, 22 aa, Entamoeba dispar
FIDKLNCYYLNTSHIQNLREIS

SEQ ID NO: 2481425 - protein, 24 aa, Entamoeba dispar
FIDKLNCYYLNVSHIQNLRDLSTI

SEQ ID NO: 2481426 - protein, 23 aa, Entamoeba dispar
FIDKLNCYYLNVSHIQNLREIST

SEQ ID NO: 2481427 - protein, 24 aa, Entamoeba dispar
FIDKLNCYYLNVSHIQNLRELSTI

SEQ ID NO: 2481428 - protein, 24 aa, Entamoeba dispar
FIDKVAQCTIVIACNGDDNALYDI

SEQ ID NO: 2481429 - protein, 25 aa, Entamoeba dispar
FIDKVLTKQGYLRRIIIQNDNGSKT

SEQ ID NO: 2481430 - protein, 17 aa, Entamoeba dispar
FIDNFIIYNPWKEFDLS

SEQ ID NO: 2481431 - protein, 18 aa, Entamoeba dispar
FIDYDFKDIHSLKRQYDE

SEQ ID NO: 2481432 - protein, 17 aa, Entamoeba dispar
FIEDKWYYHSIDFSDFL

SEQ ID NO: 2481433 - protein, 24 aa, Entamoeba dispar
FIEFFNWKEVYDVYVRYLVEADDG

SEQ ID NO: 2481434 - protein, 20 aa, Entamoeba dispar
FIEFGFGCFYRCGCEETLRK

SEQ ID NO: 2481435 - protein, 27 aa, Entamoeba dispar
FIEGDLITALRNGYWILLDEINLASHD

SEQ ID NO: 2481436 - protein, 26 aa, Entamoeba dispar
FIEKIKEYFLSFFIKQEPSFDTKTLS

SEQ ID NO: 2481437 - protein, 25 aa, Entamoeba dispar
FIELLRIIKWSSIQKHIILVLNKQH

SEQ ID NO: 2481438 - protein, 18 aa, Entamoeba dispar
FIERSLIYTEEVSKASGL

SEQ ID NO: 2481439 - protein, 25 aa, Entamoeba dispar
FIESSSWILKTKFADIPVLLMIPWK

SEQ ID NO: 2481440 - protein, 19 aa, Entamoeba dispar
FIEYCLKNNYWNCPLCEKK

SEQ ID NO: 2481441 - protein, 25 aa, Entamoeba dispar
FIEYLSNFKNPICYFHNLGYDGRFL

SEQ ID NO: 2481442 - protein, 20 aa, Entamoeba dispar
FIFCGLEGNNFVILKHFEKE

SEQ ID NO: 2481443 - protein, 28 aa, Entamoeba dispar
FIFDTMSRWLLCYGKNMFSIRLLDETTH

SEQ ID NO: 2481444 - protein, 18 aa, Entamoeba dispar
FIFERDYIYIGGRYRKYS

SEQ ID NO: 2481445 - protein, 19 aa, Entamoeba dispar
FIFHILLNCQINFSSKNDK

SEQ ID NO: 2481446 - protein, 19 aa, Entamoeba dispar
FIFSFDDLKMLLGCGKTLK

SEQ ID NO: 2481447 - protein, 19 aa, Entamoeba dispar
FIGDDCFSGCLSLTSMNID

SEQ ID NO: 2481448 - protein, 18 aa, Entamoeba dispar
FIGIGGIIPLLSNNLSEP

SEQ ID NO: 2481449 - protein, 17 aa, Entamoeba dispar
FIGKNRLASQAFNDFKQ

SEQ ID NO: 2481450 - protein, 18 aa, Entamoeba dispar
FIGLLPLYIELLEHWYIK

SEQ ID NO: 2481451 - protein, 25 aa, Entamoeba dispar
FIGNQVLRFYRRIVRDYLTRNYTAS

SEQ ID NO: 2481452 - protein, 18 aa, Entamoeba dispar
FIGRIEVFLFQKIFNCSQ

SEQ ID NO: 2481453 - protein, 20 aa, Entamoeba dispar
FIGTGCGIGAKGHKITIDEA

SEQ ID NO: 2481454 - protein, 17 aa, Entamoeba dispar
FIGYRNDLYISLIKTTC

SEQ ID NO: 2481455 - protein, 17 aa, Entamoeba dispar
FIHAFGYVKEATAYANC

SEQ ID NO: 2481456 - protein, 18 aa, Entamoeba dispar
FIHCGGLVGHIEDIVVTS

SEQ ID NO: 2481457 - protein, 24 aa, Entamoeba dispar
FIHKRHIDKLKQWTGLTKYRIIYN

SEQ ID NO: 2481458 - protein, 17 aa, Entamoeba dispar
FIHLFIICLENHRDIDF

SEQ ID NO: 2481459 - protein, 18 aa, Entamoeba dispar
FIHQLFYETFDFENYTIC

SEQ ID NO: 2481460 - protein, 21 aa, Entamoeba dispar
FIIECGNSVWVGLNTNQLNVI

SEQ ID NO: 2481461 - protein, 18 aa, Entamoeba dispar
FIIGDIVYPMLMGEYDFN

SEQ ID NO: 2481462 - protein, 26 aa, Entamoeba dispar
FIIITKTGYAFGCFCHKKIPYPKKSY

SEQ ID NO: 2481463 - protein, 22 aa, Entamoeba dispar
FIIKNKCKPFISFIQIKQEESS

SEQ ID NO: 2481464 - protein, 17 aa, Entamoeba dispar
FIILRPHQYGILIEIYR

SEQ ID NO: 2481465 - protein, 18 aa, Entamoeba dispar
FIINICIYLLRNISLNTQ

SEQ ID NO: 2481466 - protein, 17 aa, Entamoeba dispar
FIIPPKQYKAIKPMDDD

SEQ ID NO: 2481467 - protein, 22 aa, Entamoeba dispar
FIIPPSITKLGEYCFSGCSTLT

SEQ ID NO: 2481468 - protein, 28 aa, Entamoeba dispar
FIIPSSINKLGYRCFNGCLSLTTINIPT

SEQ ID NO: 2481469 - protein, 28 aa, Entamoeba dispar
FIIPSSITKLGYRCFKECSTLKSINIPS

SEQ ID NO: 2481470 - protein, 28 aa, Entamoeba dispar
FIIPSSITKLGYRCFNGCISLTSINIPS

SEQ ID NO: 2481471 - protein, 27 aa, Entamoeba dispar
FIIPSSITKLGYRCFNGCISLTTINIP

SEQ ID NO: 2481472 - protein, 26 aa, Entamoeba dispar
FIIPSSITKLGYRCFSKCSTLKSINI

SEQ ID NO: 2481473 - protein, 27 aa, Entamoeba dispar
FIIPSSITKLGYRCFSKCSTLKSINIP

SEQ ID NO: 2481474 - protein, 30 aa, Entamoeba dispar
FIIPTTITKLGWKCFEYCTSLTSIDIPTTI

SEQ ID NO: 2481475 - protein, 24 aa, Entamoeba dispar
FIIPTTITKLGWNCFEGCTSLKSI

SEQ ID NO: 2481476 - protein, 17 aa, Entamoeba dispar
FIISIFSKIKWTDSELV

SEQ ID NO: 2481477 - protein, 24 aa, Entamoeba dispar
FIITCKLLPLIRKTLNSRIIEVGS

SEQ ID NO: 2481478 - protein, 17 aa, Entamoeba dispar
FIITTICLIPYLTESEL

SEQ ID NO: 2481479 - protein, 17 aa, Entamoeba dispar
FIIYGKCLLYYYQFEEA

SEQ ID NO: 2481480 - protein, 22 aa, Entamoeba dispar
FIKAECLEKIIGAVQLLSHRQE

SEQ ID NO: 2481481 - protein, 21 aa, Entamoeba dispar
FIKCLQTLEILHRVSPTVFHH

SEQ ID NO: 2481482 - protein, 23 aa, Entamoeba dispar
FIKEDFLKVLHFLLVKKKLPTKP

SEQ ID NO: 2481483 - protein, 25 aa, Entamoeba dispar
FIKEICIDIPFLLRKPFSKNNWVIN

SEQ ID NO: 2481484 - protein, 23 aa, Entamoeba dispar
FIKIDKEEVCIASISGKNLNSPV

SEQ ID NO: 2481485 - protein, 19 aa, Entamoeba dispar
FIKIMKDNTAFIGIGDTGI

SEQ ID NO: 2481486 - protein, 17 aa, Entamoeba dispar
FIKNKMEPYGLVQKITI

SEQ ID NO: 2481487 - protein, 18 aa, Entamoeba dispar
FIKPCSLTPSQIFNSSYS

SEQ ID NO: 2481488 - protein, 19 aa, Entamoeba dispar
FIKPKSRFNLLLLEPGEQY

SEQ ID NO: 2481489 - protein, 22 aa, Entamoeba dispar
FIKQDINEFIIPPSITELGDNC

SEQ ID NO: 2481490 - protein, 25 aa, Entamoeba dispar
FIKRPEMFWKMCSELRKYTEGKKPT

SEQ ID NO: 2481491 - protein, 24 aa, Entamoeba dispar
FIKRSIRFQMNLHLALAQNNDLNV

SEQ ID NO: 2481492 - protein, 17 aa, Entamoeba dispar
FIKTFKPFIKSIPTNII

SEQ ID NO: 2481493 - protein, 21 aa, Entamoeba dispar
FIKTTFCFIQTIGIQCLQFPF

SEQ ID NO: 2481494 - protein, 17 aa, Entamoeba dispar
FIKTYSITLEFMIRVKM

SEQ ID NO: 2481495 - protein, 19 aa, Entamoeba dispar
FIKVMGRSASHIALEAALE

SEQ ID NO: 2481496 - protein, 19 aa, Entamoeba dispar
FILDFSWFSTEEVTENIVI

SEQ ID NO: 2481497 - protein, 17 aa, Entamoeba dispar
FILLKYQLEKDEQEAEA

SEQ ID NO: 2481498 - protein, 26 aa, Entamoeba dispar
FILLTPKTKFIWKGKFRNEKYVEFAV

SEQ ID NO: 2481499 - protein, 19 aa, Entamoeba dispar
FILTQKIVDTFSRYVQNPL

SEQ ID NO: 2481500 - protein, 22 aa, Entamoeba dispar
FILTTRVGGLGINLTGADRVIM

SEQ ID NO: 2481501 - protein, 18 aa, Entamoeba dispar
FILTTSIPSLIHPCLPPS

SEQ ID NO: 2481502 - protein, 19 aa, Entamoeba dispar
FINDLICLITTLTKSHFNI

SEQ ID NO: 2481503 - protein, 31 aa, Entamoeba dispar
FINGFCKTKGFFEWKKSLTLSGKAKKMTELF

SEQ ID NO: 2481504 - protein, 17 aa, Entamoeba dispar
FINHSFKSVSWNDPRPK

SEQ ID NO: 2481505 - protein, 19 aa, Entamoeba dispar
FINIICTFSRFGQTPEVNE

SEQ ID NO: 2481506 - protein, 23 aa, Entamoeba dispar
FINKLPLTLSIFIVHQNTFLSNP

SEQ ID NO: 2481507 - protein, 24 aa, Entamoeba dispar
FINKQECLDIVPPESPIENIQNTV

SEQ ID NO: 2481508 - protein, 29 aa, Entamoeba dispar
FINKRIENMLEWFNKMLFFVDLLKEKRDK

SEQ ID NO: 2481509 - protein, 25 aa, Entamoeba dispar
FINKYIECGYCYDKAGAYGIQDNAG

SEQ ID NO: 2481510 - protein, 17 aa, Entamoeba dispar
FINNCVDSLTSLLILRQ

SEQ ID NO: 2481511 - protein, 18 aa, Entamoeba dispar
FINPGEMVGSIAAQSIGA

SEQ ID NO: 2481512 - protein, 18 aa, Entamoeba dispar
FINPKSYLVNGVLKKEKE

SEQ ID NO: 2481513 - protein, 23 aa, Entamoeba dispar
FIPDKIICVRLIKGDAFEKQNDK

SEQ ID NO: 2481514 - protein, 29 aa, Entamoeba dispar
FIPIFKQKWILKLKEMMLFVVDLTEIKDK

SEQ ID NO: 2481515 - protein, 25 aa, Entamoeba dispar
FIPKCYKMIAKLCGGYNLEGINRYS

SEQ ID NO: 2481516 - protein, 26 aa, Entamoeba dispar
FIPLRMMRICRASFEKVIEALEKKLN

SEQ ID NO: 2481517 - protein, 18 aa, Entamoeba dispar
FIPPIGVKLDDEFANKLY

SEQ ID NO: 2481518 - protein, 23 aa, Entamoeba dispar
FIPSGLYMICLPYIDDVLTPLLS

SEQ ID NO: 2481519 - protein, 17 aa, Entamoeba dispar
FIPYLKVYYQFIGNSGV

SEQ ID NO: 2481520 - protein, 25 aa, Entamoeba dispar
FIQEMFEFRIQNFLDIYLHESSQST

SEQ ID NO: 2481521 - protein, 17 aa, Entamoeba dispar
FIQKKMMLISWMESILK

SEQ ID NO: 2481522 - protein, 23 aa, Entamoeba dispar
FIQNCLEQLTLMRVINQNIYDAY

SEQ ID NO: 2481523 - protein, 27 aa, Entamoeba dispar
FIQSLERSNCYLLKPRKSFSKNIPQEY

SEQ ID NO: 2481524 - protein, 20 aa, Entamoeba dispar
FIQYPACLYYLEQLQNPDFR

SEQ ID NO: 2481525 - protein, 21 aa, Entamoeba dispar
FIRCECNKLTLSQFGEEEIKI

SEQ ID NO: 2481526 - protein, 23 aa, Entamoeba dispar
FIRCGDVAQCDWISATHENEYIQ

SEQ ID NO: 2481527 - protein, 22 aa, Entamoeba dispar
FIRDWKKYYPTKVMLYSCKTTT

SEQ ID NO: 2481528 - protein, 19 aa, Entamoeba dispar
FIREFRVPVNTMVWQLAAG

SEQ ID NO: 2481529 - protein, 24 aa, Entamoeba dispar
FIRIKEIYSILGNDIFVILRNIAL

SEQ ID NO: 2481530 - protein, 23 aa, Entamoeba dispar
FIRKNFQLANLWVGKLNHQSVTE

SEQ ID NO: 2481531 - protein, 17 aa, Entamoeba dispar
FIRLKQPIICVSVRVNE

SEQ ID NO: 2481532 - protein, 18 aa, Entamoeba dispar
FIRMVSGFETCQKLINEL

SEQ ID NO: 2481533 - protein, 30 aa, Entamoeba dispar
FIRNNVNYLFCYRWIVLLFKRDFNSRDCLN

SEQ ID NO: 2481534 - protein, 19 aa, Entamoeba dispar
FIRNYPAVVSLLFELLDRL

SEQ ID NO: 2481535 - protein, 19 aa, Entamoeba dispar
FIRSEEWYFIKTKKEVIAL

SEQ ID NO: 2481536 - protein, 25 aa, Entamoeba dispar
FIRTNCGDWLKKVLEYLFENVQAKD

SEQ ID NO: 2481537 - protein, 25 aa, Entamoeba dispar
FIRVYDLRKGLIISDDIKKPLTSLS

SEQ ID NO: 2481538 - protein, 19 aa, Entamoeba dispar
FIRYKLRGSAEFAKVAMSD

SEQ ID NO: 2481539 - protein, 25 aa, Entamoeba dispar
FISAHKKYICRVIGYMGSCIVNKPI

SEQ ID NO: 2481540 - protein, 17 aa, Entamoeba dispar
FISCPIEYITCALSSRI

SEQ ID NO: 2481541 - protein, 23 aa, Entamoeba dispar
FISCVFPKVKRLYIQKRMIECDD

SEQ ID NO: 2481542 - protein, 19 aa, Entamoeba dispar
FISDIQWKPEVFGDSAIFA

SEQ ID NO: 2481543 - protein, 23 aa, Entamoeba dispar
FISEFKGSLQIIGIGKFNGKEFG

SEQ ID NO: 2481544 - protein, 19 aa, Entamoeba dispar
FISEQCNFIIEKMESLLKT

SEQ ID NO: 2481545 - protein, 24 aa, Entamoeba dispar
FISFNDIQTILSFVDNLNKTIPIT

SEQ ID NO: 2481546 - protein, 19 aa, Entamoeba dispar
FISGSADRTVHLWDIRSSS

SEQ ID NO: 2481547 - protein, 17 aa, Entamoeba dispar
FISKEIPSFYNVMKALL

SEQ ID NO: 2481548 - protein, 18 aa, Entamoeba dispar
FISLNVWEVVSSLSNDPE

SEQ ID NO: 2481549 - protein, 26 aa, Entamoeba dispar
FISNSMPFQFLSLHLSKSVIYIPSVG

SEQ ID NO: 2481550 - protein, 23 aa, Entamoeba dispar
FISRNRYEWYIAQYAMQKNGIIP

SEQ ID NO: 2481551 - protein, 18 aa, Entamoeba dispar
FISYEPWLNKLSKSKSNI

SEQ ID NO: 2481552 - protein, 27 aa, Entamoeba dispar
FITCDYCLPELLSLVAECVTNDSMNSL

SEQ ID NO: 2481553 - protein, 19 aa, Entamoeba dispar
FITINLCSVKILLLSNCTN

SEQ ID NO: 2481554 - protein, 25 aa, Entamoeba dispar
FITKSDMNDLCWFLPQIAIATNSGV

SEQ ID NO: 2481555 - protein, 17 aa, Entamoeba dispar
FITQKLQCVFVHINQFF

SEQ ID NO: 2481556 - protein, 18 aa, Entamoeba dispar
FITQKLQCVFVHINQFFV

SEQ ID NO: 2481557 - protein, 22 aa, Entamoeba dispar
FITRPIPTISFQILDMRPRPIP

SEQ ID NO: 2481558 - protein, 24 aa, Entamoeba dispar
FITSGKHKVLIASFIPGICEQVKL

SEQ ID NO: 2481559 - protein, 29 aa, Entamoeba dispar
FITSLQPCFPRYLSLLFPNDLPTTFWQRC

SEQ ID NO: 2481560 - protein, 20 aa, Entamoeba dispar
FITTKATSITSCFAQMELIR

SEQ ID NO: 2481561 - protein, 23 aa, Entamoeba dispar
FITVLRGTRGMRGGYRGNNRGNL

SEQ ID NO: 2481562 - protein, 18 aa, Entamoeba dispar
FIVCAKCNKKVCNTCATT

SEQ ID NO: 2481563 - protein, 17 aa, Entamoeba dispar
FIVEKMISYGILDILKE

SEQ ID NO: 2481564 - protein, 18 aa, Entamoeba dispar
FIVSKLLFWYFPSYSKKF

SEQ ID NO: 2481565 - protein, 22 aa, Entamoeba dispar
FIWMSIKRSFNFISSLIDGESK

SEQ ID NO: 2481566 - protein, 17 aa, Entamoeba dispar
FIWQENDSILFIKNDGT

SEQ ID NO: 2481567 - protein, 25 aa, Entamoeba dispar
FIWSWKKGKILKVFEHAHKGCVTDV

SEQ ID NO: 2481568 - protein, 17 aa, Entamoeba dispar
FIYFLRFHDEPTIVECL

SEQ ID NO: 2481569 - protein, 17 aa, Entamoeba dispar
FIYLKNFYQRINKIRYK

SEQ ID NO: 2481570 - protein, 17 aa, Entamoeba dispar
FKAAKKMLSKDSTKKKR

SEQ ID NO: 2481571 - protein, 34 aa, Entamoeba dispar
FKADVPAGYYDIRICTYSGLTRLAVYTRVFEVSK

SEQ ID NO: 2481572 - protein, 17 aa, Entamoeba dispar
FKANGYIQTKWMNELYL

SEQ ID NO: 2481573 - protein, 17 aa, Entamoeba dispar
FKAPPLITDQMILNIHL

SEQ ID NO: 2481574 - protein, 23 aa, Entamoeba dispar
FKASKYISCKIINYFTNNSVQMI

SEQ ID NO: 2481575 - protein, 17 aa, Entamoeba dispar
FKAVITVPANFSSEQRD

SEQ ID NO: 2481576 - protein, 18 aa, Entamoeba dispar
FKCGCGQLTECVCVTCRK

SEQ ID NO: 2481577 - protein, 20 aa, Entamoeba dispar
FKCHICKKICDPMMIRSIKF

SEQ ID NO: 2481578 - protein, 22 aa, Entamoeba dispar
FKCPIEFCECIANCLLPKEKRL

SEQ ID NO: 2481579 - protein, 35 aa, Entamoeba dispar
FKCRDEMKWAEFEYCILFPFNVLKMKSIKIMIKYP

SEQ ID NO: 2481580 - protein, 21 aa, Entamoeba dispar
FKCYPLYDFGVSIIDSIEGVT

SEQ ID NO: 2481581 - protein, 21 aa, Entamoeba dispar
FKDACLAAFQLGRQRIKEPMY

SEQ ID NO: 2481582 - protein, 20 aa, Entamoeba dispar
FKDCSFYSGESCDTDNGMVA

SEQ ID NO: 2481583 - protein, 25 aa, Entamoeba dispar
FKDDDAPIVYGFRPYMKEFIRKIDQ

SEQ ID NO: 2481584 - protein, 25 aa, Entamoeba dispar
FKDEEIPVVRSLSSFEGKDCGKNSY

SEQ ID NO: 2481585 - protein, 23 aa, Entamoeba dispar
FKDGIIFKHVIWYPVNRDKYGNT

SEQ ID NO: 2481586 - protein, 26 aa, Entamoeba dispar
FKDGKVFCALIHRHRPDLLDWETVGE

SEQ ID NO: 2481587 - protein, 20 aa, Entamoeba dispar
FKDGRICLDILQDKWSSVYS

SEQ ID NO: 2481588 - protein, 17 aa, Entamoeba dispar
FKDKCSFDELSQDKKQL

SEQ ID NO: 2481589 - protein, 21 aa, Entamoeba dispar
FKDKLKQLFNLIVPTIKNLKG

SEQ ID NO: 2481590 - protein, 24 aa, Entamoeba dispar
FKDLKEFYFNYNTIMEVSQAIASP

SEQ ID NO: 2481591 - protein, 23 aa, Entamoeba dispar
FKDPIKVRASHEYLFVNDSETKI

SEQ ID NO: 2481592 - protein, 21 aa, Entamoeba dispar
FKDVKHWKYWNLMKWVVEHKL

SEQ ID NO: 2481593 - protein, 21 aa, Entamoeba dispar
FKDYKLRIVDHKEIFPNNKDL

SEQ ID NO: 2481594 - protein, 19 aa, Entamoeba dispar
FKEAIRAGVNYKDSLFSKP

SEQ ID NO: 2481595 - protein, 25 aa, Entamoeba dispar
FKEAPHVFHVLKAMISVIDYNQNIP

SEQ ID NO: 2481596 - protein, 18 aa, Entamoeba dispar
FKEATKLGDQLALLNKEI

SEQ ID NO: 2481597 - protein, 18 aa, Entamoeba dispar
FKEEESPTLIQNVQTNLA

SEQ ID NO: 2481598 - protein, 26 aa, Entamoeba dispar
FKEESKELLIEIGFNKYAVQKQDIAD

SEQ ID NO: 2481599 - protein, 17 aa, Entamoeba dispar
FKEFIIEALQKPTKARI

SEQ ID NO: 2481600 - protein, 24 aa, Entamoeba dispar
FKEGFYSIIPFEMINCFYDTELEL

SEQ ID NO: 2481601 - protein, 20 aa, Entamoeba dispar
FKEGLKKLAAALAVGAKLGG

SEQ ID NO: 2481602 - protein, 21 aa, Entamoeba dispar
FKEIFKEKGFNNLKIVFDTED

SEQ ID NO: 2481603 - protein, 19 aa, Entamoeba dispar
FKEIFSFDDSATFERIKPI

SEQ ID NO: 2481604 - protein, 28 aa, Entamoeba dispar
FKEISDIGKIEWKKNIFDLLEKQIQEVV

SEQ ID NO: 2481605 - protein, 21 aa, Entamoeba dispar
FKEKYIWTDIINFEKEEQPFA

SEQ ID NO: 2481606 - protein, 18 aa, Entamoeba dispar
FKELAHAVIKYSSKGYLK

SEQ ID NO: 2481607 - protein, 21 aa, Entamoeba dispar
FKELCSSALLSLRKQGSLFIY

SEQ ID NO: 2481608 - protein, 24 aa, Entamoeba dispar
FKELIKILEIRKGILESSYLDECI

SEQ ID NO: 2481609 - protein, 17 aa, Entamoeba dispar
FKEMFKTKGQYQELPEN

SEQ ID NO: 2481610 - protein, 17 aa, Entamoeba dispar
FKENVFIYTNMVKSNKI

SEQ ID NO: 2481611 - protein, 21 aa, Entamoeba dispar
FKEQRRVIVEFSIDDMVKLHK

SEQ ID NO: 2481612 - protein, 17 aa, Entamoeba dispar
FKERVMAVYMRNYQAIV

SEQ ID NO: 2481613 - protein, 23 aa, Entamoeba dispar
FKESKDAWRIFGDKWYLRDEEYL

SEQ ID NO: 2481614 - protein, 21 aa, Entamoeba dispar
FKESPFSLIVQLFPCYIDLLI

SEQ ID NO: 2481615 - protein, 17 aa, Entamoeba dispar
FKESVISFRHCDDDDTR

SEQ ID NO: 2481616 - protein, 21 aa, Entamoeba dispar
FKEVIWYPVSYLTYLKEKEAG

SEQ ID NO: 2481617 - protein, 21 aa, Entamoeba dispar
FKEVVDRLAGATNNVQYAHIS

SEQ ID NO: 2481618 - protein, 25 aa, Entamoeba dispar
FKEYTRLKGINIYDGIKGEKERKNH

SEQ ID NO: 2481619 - protein, 17 aa, Entamoeba dispar
FKFLEGFEKRILNIHLY

SEQ ID NO: 2481620 - protein, 22 aa, Entamoeba dispar
FKFTPVHIRKGKYRFPGTDLWY

SEQ ID NO: 2481621 - protein, 17 aa, Entamoeba dispar
FKFTRQVATKFFDLAVS

SEQ ID NO: 2481622 - protein, 20 aa, Entamoeba dispar
FKFVLYEESKELPVTTDINN

SEQ ID NO: 2481623 - protein, 18 aa, Entamoeba dispar
FKGCISCDLDECFECPNG

SEQ ID NO: 2481624 - protein, 18 aa, Entamoeba dispar
FKGDEKLSLAKVLHSVEV

SEQ ID NO: 2481625 - protein, 20 aa, Entamoeba dispar
FKGDTGLLVYSLKDWVFTSI

SEQ ID NO: 2481626 - protein, 17 aa, Entamoeba dispar
FKGEIQMKFKEQQKLIE

SEQ ID NO: 2481627 - protein, 20 aa, Entamoeba dispar
FKGKASYGIYLFLEKNNIHC

SEQ ID NO: 2481628 - protein, 17 aa, Entamoeba dispar
FKGKIAIKEALLCTEDS

SEQ ID NO: 2481629 - protein, 17 aa, Entamoeba dispar
FKGNYLIEECLTIASKI

SEQ ID NO: 2481630 - protein, 18 aa, Entamoeba dispar
FKGTLMDVCCTFTSATEL

SEQ ID NO: 2481631 - protein, 26 aa, Entamoeba dispar
FKGTRSARKTIKMYRIKKMESPTKVI

SEQ ID NO: 2481632 - protein, 21 aa, Entamoeba dispar
FKGYCTKGNVQLPKFDFNVVV

SEQ ID NO: 2481633 - protein, 27 aa, Entamoeba dispar
FKGYPFTEWFWMIEFQDKYFGFQTIFT

SEQ ID NO: 2481634 - protein, 17 aa, Entamoeba dispar
FKHFYAFCRQYKMLGKE

SEQ ID NO: 2481635 - protein, 19 aa, Entamoeba dispar
FKHIRELLHIAEIHEEDEY

SEQ ID NO: 2481636 - protein, 17 aa, Entamoeba dispar
FKHISVIQALAKSGLIK

SEQ ID NO: 2481637 - protein, 17 aa, Entamoeba dispar
FKHKIGASWKKEYFWLS

SEQ ID NO: 2481638 - protein, 22 aa, Entamoeba dispar
FKHKVFSLKGAEFGWHSSGKKL

SEQ ID NO: 2481639 - protein, 19 aa, Entamoeba dispar
FKHRIIIQFENIFQLINTI

SEQ ID NO: 2481640 - protein, 21 aa, Entamoeba dispar
FKHTYGLPICKITAGKNADIH

SEQ ID NO: 2481641 - protein, 25 aa, Entamoeba dispar
FKIAYDYRCSLGMGITGYAAQEYIE

SEQ ID NO: 2481642 - protein, 19 aa, Entamoeba dispar
FKICIHCIQSTQLICACCN

SEQ ID NO: 2481643 - protein, 19 aa, Entamoeba dispar
FKIDEVYKNLTRVEQVEPN

SEQ ID NO: 2481644 - protein, 19 aa, Entamoeba dispar
FKIDVSILCKKDNLTRRSV

SEQ ID NO: 2481645 - protein, 18 aa, Entamoeba dispar
FKIFEDIANGVAACHRFD

SEQ ID NO: 2481646 - protein, 19 aa, Entamoeba dispar
FKIGMTYTSNGWYIMQCEP

SEQ ID NO: 2481647 - protein, 34 aa, Entamoeba dispar
FKIHELRCRKMYKICPFCGKKLLINSEELQKHLD

SEQ ID NO: 2481648 - protein, 20 aa, Entamoeba dispar
FKIKDILDYMLTQNKITNNS

SEQ ID NO: 2481649 - protein, 20 aa, Entamoeba dispar
FKIKLPRLTINKMDEVLEYE

SEQ ID NO: 2481650 - protein, 17 aa, Entamoeba dispar
FKIKRFGKKPIEVGSII

SEQ ID NO: 2481651 - protein, 20 aa, Entamoeba dispar
FKIPTSLLYLYLPKPKNYYQ

SEQ ID NO: 2481652 - protein, 19 aa, Entamoeba dispar
FKIQIQPAINHLKSAAYIF

SEQ ID NO: 2481653 - protein, 20 aa, Entamoeba dispar
FKIQVATIIIFKGYSKENFN

SEQ ID NO: 2481654 - protein, 19 aa, Entamoeba dispar
FKIRRYEKFLGVKEEEVSE

SEQ ID NO: 2481655 - protein, 20 aa, Entamoeba dispar
FKITKDIQCSLYYFHSVLLN

SEQ ID NO: 2481656 - protein, 29 aa, Entamoeba dispar
FKIYYNKEMFKLVCCPLFVGFFSRNICLS

SEQ ID NO: 2481657 - protein, 18 aa, Entamoeba dispar
FKKAISICINDCYETVIR

SEQ ID NO: 2481658 - protein, 17 aa, Entamoeba dispar
FKKALSDSFVKSVNQGV

SEQ ID NO: 2481659 - protein, 21 aa, Entamoeba dispar
FKKDFYVESPITLNRNIEEVS

SEQ ID NO: 2481660 - protein, 20 aa, Entamoeba dispar
FKKDINEFIIPSSINKLGYR

SEQ ID NO: 2481661 - protein, 20 aa, Entamoeba dispar
FKKDINEFIIPSSISELGFS

SEQ ID NO: 2481662 - protein, 20 aa, Entamoeba dispar
FKKDINEFIIPSSISKLGDS

SEQ ID NO: 2481663 - protein, 20 aa, Entamoeba dispar
FKKDINEFIIPSSITKIGYG

SEQ ID NO: 2481664 - protein, 20 aa, Entamoeba dispar
FKKDINEFIIPSSITKLDRQ

SEQ ID NO: 2481665 - protein, 20 aa, Entamoeba dispar
FKKDINEFIIPSSITKLGDR

SEQ ID NO: 2481666 - protein, 20 aa, Entamoeba dispar
FKKDINEFIIPSSITKLGSG

SEQ ID NO: 2481667 - protein, 20 aa, Entamoeba dispar
FKKDINEFIIPSSITKLGYG

SEQ ID NO: 2481668 - protein, 20 aa, Entamoeba dispar
FKKDINEFIIPSSITKLGYR

SEQ ID NO: 2481669 - protein, 21 aa, Entamoeba dispar
FKKDINEFIIPSSITKVGSGC

SEQ ID NO: 2481670 - protein, 20 aa, Entamoeba dispar
FKKDINKFIIPSSITKLDDW

SEQ ID NO: 2481671 - protein, 20 aa, Entamoeba dispar
FKKDINKFIIPSSITKVGDY

SEQ ID NO: 2481672 - protein, 22 aa, Entamoeba dispar
FKKEEESCCEILFSSIIKGYQV

SEQ ID NO: 2481673 - protein, 21 aa, Entamoeba dispar
FKKEEKFEERQLKQLKPKEKP

SEQ ID NO: 2481674 - protein, 18 aa, Entamoeba dispar
FKKGEIVIIIGNIENGWI

SEQ ID NO: 2481675 - protein, 20 aa, Entamoeba dispar
FKKGSSMLSVECVDGDIKAM

SEQ ID NO: 2481676 - protein, 35 aa, Entamoeba dispar
FKKINCKIADFILRESRYLKAHFIIIYDSPINCQL

SEQ ID NO: 2481677 - protein, 26 aa, Entamoeba dispar
FKKISMINFLIFIYGYDLHEVVNAPQ

SEQ ID NO: 2481678 - protein, 17 aa, Entamoeba dispar
FKKKEFIVDGTHIVSQI

SEQ ID NO: 2481679 - protein, 22 aa, Entamoeba dispar
FKKKPFPPARIRKITKINTNNK

SEQ ID NO: 2481680 - protein, 19 aa, Entamoeba dispar
FKKKQCFISSQVKHYKKMK

SEQ ID NO: 2481681 - protein, 23 aa, Entamoeba dispar
FKKLGIRPSHGVLLYGPSGCAKT

SEQ ID NO: 2481682 - protein, 18 aa, Entamoeba dispar
FKKLIKYLPQFTSSVIVG

SEQ ID NO: 2481683 - protein, 27 aa, Entamoeba dispar
FKKLKITPFSGGFIFMYDIRYITDLIR

SEQ ID NO: 2481684 - protein, 17 aa, Entamoeba dispar
FKKLYLLRDKIARIEDE

SEQ ID NO: 2481685 - protein, 21 aa, Entamoeba dispar
FKKMGELDCSLFPLQEEEIEF

SEQ ID NO: 2481686 - protein, 20 aa, Entamoeba dispar
FKKNAKWSINKNVPNFGDET

SEQ ID NO: 2481687 - protein, 24 aa, Entamoeba dispar
FKKNLKSKCKFILKRGNDKKTITQ

SEQ ID NO: 2481688 - protein, 21 aa, Entamoeba dispar
FKKQILMYLVPLKLRCGMYLP

SEQ ID NO: 2481689 - protein, 19 aa, Entamoeba dispar
FKKVWRAYANYARRRKNIP

SEQ ID NO: 2481690 - protein, 19 aa, Entamoeba dispar
FKLDITLRYYKGDKIESSR

SEQ ID NO: 2481691 - protein, 19 aa, Entamoeba dispar
FKLDLEIVKQLLGTASSCG

SEQ ID NO: 2481692 - protein, 19 aa, Entamoeba dispar
FKLEVKIIRCIDNQEKTTL

SEQ ID NO: 2481693 - protein, 18 aa, Entamoeba dispar
FKLFTIERIKTKSPSNQK

SEQ ID NO: 2481694 - protein, 18 aa, Entamoeba dispar
FKLHCYIAKDNEYSVRIR

SEQ ID NO: 2481695 - protein, 21 aa, Entamoeba dispar
FKLKLPISCTCFEDLSDSLTP

SEQ ID NO: 2481696 - protein, 33 aa, Entamoeba dispar
FKLLASSCVYFFLKEFIPIFQFNPCLIFGETFT

SEQ ID NO: 2481697 - protein, 17 aa, Entamoeba dispar
FKLLRLASQTDNVGVVN

SEQ ID NO: 2481698 - protein, 19 aa, Entamoeba dispar
FKLLVGRLPFELMQMDSLS

SEQ ID NO: 2481699 - protein, 17 aa, Entamoeba dispar
FKLPDNYKIIIQTESIK

SEQ ID NO: 2481700 - protein, 19 aa, Entamoeba dispar
FKLQKHFKDFVGQFAEQKC

SEQ ID NO: 2481701 - protein, 20 aa, Entamoeba dispar
FKLSEKVIPIYGSIEPGSNI

SEQ ID NO: 2481702 - protein, 25 aa, Entamoeba dispar
FKLSLKRPIPLVGFCTYFEADISNH

SEQ ID NO: 2481703 - protein, 19 aa, Entamoeba dispar
FKLSLQLLVKEVSNLWDDF

SEQ ID NO: 2481704 - protein, 20 aa, Entamoeba dispar
FKLTLCCLPIFELYGIFLLQ

SEQ ID NO: 2481705 - protein, 21 aa, Entamoeba dispar
FKLVSHFPSIIAYDANKIFII

SEQ ID NO: 2481706 - protein, 18 aa, Entamoeba dispar
FKLYENPSRISISVNKHL

SEQ ID NO: 2481707 - protein, 17 aa, Entamoeba dispar
FKLYRKLFDILASPLKF

SEQ ID NO: 2481708 - protein, 18 aa, Entamoeba dispar
FKMIGKFDGKIKFFNGNF

SEQ ID NO: 2481709 - protein, 17 aa, Entamoeba dispar
FKMKGAGSCCLVLQSLL

SEQ ID NO: 2481710 - protein, 22 aa, Entamoeba dispar
FKMKNNEMISNFLVDEESPFFN

SEQ ID NO: 2481711 - protein, 21 aa, Entamoeba dispar
FKMPCKEILHGVGPIGENAIQ

SEQ ID NO: 2481712 - protein, 33 aa, Entamoeba dispar
FKMTEPQMAYVLREVMKGLLYLHQRHKIHRDIK

SEQ ID NO: 2481713 - protein, 22 aa, Entamoeba dispar
FKNASKVFLTYSLTNGDSVRTL

SEQ ID NO: 2481714 - protein, 22 aa, Entamoeba dispar
FKNCLRLSSIYLPSRLLKLKSN

SEQ ID NO: 2481715 - protein, 19 aa, Entamoeba dispar
FKNDLFSAFIYSFEHDITI

SEQ ID NO: 2481716 - protein, 24 aa, Entamoeba dispar
FKNEFKLKVLNFLTLLLDTNQTEE

SEQ ID NO: 2481717 - protein, 17 aa, Entamoeba dispar
FKNEKGIVGEKEYLNER

SEQ ID NO: 2481718 - protein, 21 aa, Entamoeba dispar
FKNGCKIGNETYCYQCKEEFI

SEQ ID NO: 2481719 - protein, 31 aa, Entamoeba dispar
FKNGCKIGNETYCYQCKEGFIKENGECKKID

SEQ ID NO: 2481720 - protein, 21 aa, Entamoeba dispar
FKNGCKIGNETYCYQCKEGYI

SEQ ID NO: 2481721 - protein, 18 aa, Entamoeba dispar
FKNICSLLPTETKQTDVI

SEQ ID NO: 2481722 - protein, 25 aa, Entamoeba dispar
FKNIGIKPPRGILLYGPPGCGKTMI

SEQ ID NO: 2481723 - protein, 20 aa, Entamoeba dispar
FKNKVPHDFSKKGVDYEIND

SEQ ID NO: 2481724 - protein, 18 aa, Entamoeba dispar
FKNPEEWINNLVESDELI

SEQ ID NO: 2481725 - protein, 20 aa, Entamoeba dispar
FKNPKLWTTQLVDFVAQCLI

SEQ ID NO: 2481726 - protein, 23 aa, Entamoeba dispar
FKNRPKRRFNRRPGYANRNNRGR

SEQ ID NO: 2481727 - protein, 19 aa, Entamoeba dispar
FKNSFCFEQGVLLYLLNQY

SEQ ID NO: 2481728 - protein, 19 aa, Entamoeba dispar
FKNSFSMIMGTIVSKEPNK

SEQ ID NO: 2481729 - protein, 20 aa, Entamoeba dispar
FKNSLDLFKLHSLPSSSFSI

SEQ ID NO: 2481730 - protein, 18 aa, Entamoeba dispar
FKNTIKAMRTMNITDDEQ

SEQ ID NO: 2481731 - protein, 20 aa, Entamoeba dispar
FKNYFSRYGELFDYTILIDK

SEQ ID NO: 2481732 - protein, 30 aa, Entamoeba dispar
FKPEIQNGRFIPTILYGARASIPGVKNNSD

SEQ ID NO: 2481733 - protein, 30 aa, Entamoeba dispar
FKPEIQNGRFIPTILYGARASIPGVKNNTE

SEQ ID NO: 2481734 - protein, 26 aa, Entamoeba dispar
FKPELQNGRFIPCVLYGAKAQLPGMN

SEQ ID NO: 2481735 - protein, 27 aa, Entamoeba dispar
FKPELQNGRFIPCVLYGAKAQLPGMTG

SEQ ID NO: 2481736 - protein, 17 aa, Entamoeba dispar
FKPFPFNLKYVLQGVTY

SEQ ID NO: 2481737 - protein, 22 aa, Entamoeba dispar
FKPFYFRIFLMYRKLTWTSGHI

SEQ ID NO: 2481738 - protein, 25 aa, Entamoeba dispar
FKPGMHPRIRLDILHEVEKRIPGFP

SEQ ID NO: 2481739 - protein, 19 aa, Entamoeba dispar
FKPIKCFSIDRVFRNETVD

SEQ ID NO: 2481740 - protein, 21 aa, Entamoeba dispar
FKPILGEKVSEIFEGKHTRFV

SEQ ID NO: 2481741 - protein, 20 aa, Entamoeba dispar
FKPIPSYSINLWSVLITGFK

SEQ ID NO: 2481742 - protein, 17 aa, Entamoeba dispar
FKPKILNIRNKTVKMQI

SEQ ID NO: 2481743 - protein, 19 aa, Entamoeba dispar
FKPKPRVGPKGKLAKKETP

SEQ ID NO: 2481744 - protein, 22 aa, Entamoeba dispar
FKPNLKTSFPLTDEELQTIKPK

SEQ ID NO: 2481745 - protein, 25 aa, Entamoeba dispar
FKPSIPEQQLEPFINYLFNISNQDN

SEQ ID NO: 2481746 - protein, 17 aa, Entamoeba dispar
FKPVIKQKYIEASLGLV

SEQ ID NO: 2481747 - protein, 22 aa, Entamoeba dispar
FKQELVKILTLKTPASYWSFQK

SEQ ID NO: 2481748 - protein, 20 aa, Entamoeba dispar
FKQIFQFMKTYFHYHDTDVQ

SEQ ID NO: 2481749 - protein, 18 aa, Entamoeba dispar
FKQIYKLFEKCPYYEKYF

SEQ ID NO: 2481750 - protein, 23 aa, Entamoeba dispar
FKQQRFLEYNAELGAHEGRVHKN

SEQ ID NO: 2481751 - protein, 23 aa, Entamoeba dispar
FKQQRFLEYNAERGLFDEVNKVF

SEQ ID NO: 2481752 - protein, 23 aa, Entamoeba dispar
FKQQRFLEYNAERGLFDEVYKIF

SEQ ID NO: 2481753 - protein, 23 aa, Entamoeba dispar
FKQQRFLEYNSERGLFDEVYKIF

SEQ ID NO: 2481754 - protein, 22 aa, Entamoeba dispar
FKQRVSFEERKAFAIQLRQKKP

SEQ ID NO: 2481755 - protein, 17 aa, Entamoeba dispar
FKQTILKRIKKIDELND

SEQ ID NO: 2481756 - protein, 17 aa, Entamoeba dispar
FKQTITFFKSSILENRL

SEQ ID NO: 2481757 - protein, 21 aa, Entamoeba dispar
FKQVIWYLVNYSIYFKEKEQG

SEQ ID NO: 2481758 - protein, 20 aa, Entamoeba dispar
FKQVIWYQVEYWRYLFEKKQ

SEQ ID NO: 2481759 - protein, 25 aa, Entamoeba dispar
FKQYCVDESLIGRLWSHFSQEFYPK

SEQ ID NO: 2481760 - protein, 18 aa, Entamoeba dispar
FKQYLPTIIPILLSELTK

SEQ ID NO: 2481761 - protein, 20 aa, Entamoeba dispar
FKRDSAFRDWLLQKLVNGER

SEQ ID NO: 2481762 - protein, 27 aa, Entamoeba dispar
FKREYPEIKISYGLVKKVLEQQGLLPP

SEQ ID NO: 2481763 - protein, 20 aa, Entamoeba dispar
FKRISYVHALEEKFGEKIPR

SEQ ID NO: 2481764 - protein, 24 aa, Entamoeba dispar
FKRKKRLSGLSSLFTKRKPDRSVT

SEQ ID NO: 2481765 - protein, 17 aa, Entamoeba dispar
FKRKKYDDWSIPKCVLT

SEQ ID NO: 2481766 - protein, 17 aa, Entamoeba dispar
FKRLFFGNQELKRRNEV

SEQ ID NO: 2481767 - protein, 26 aa, Entamoeba dispar
FKRLQWAHQSFWSRAFLVIYPQPFGE

SEQ ID NO: 2481768 - protein, 21 aa, Entamoeba dispar
FKRNDCKIALNPFNFMNRLEE

SEQ ID NO: 2481769 - protein, 23 aa, Entamoeba dispar
FKRRTDICMRRAFTVDSDKTKIR

SEQ ID NO: 2481770 - protein, 17 aa, Entamoeba dispar
FKRSEVKINSYLNSMMR

SEQ ID NO: 2481771 - protein, 22 aa, Entamoeba dispar
FKRVKIYECYHSYDELVAVLKQ

SEQ ID NO: 2481772 - protein, 29 aa, Entamoeba dispar
FKSCHCVECLYWLAPEVIETSTFELESDV

SEQ ID NO: 2481773 - protein, 28 aa, Entamoeba dispar
FKSDCWSVGCVLYCLITGNFYKLSYNKT

SEQ ID NO: 2481774 - protein, 19 aa, Entamoeba dispar
FKSDLRQIGPLPPPPENYE

SEQ ID NO: 2481775 - protein, 19 aa, Entamoeba dispar
FKSHFNSIFVIVKKIPSEL

SEQ ID NO: 2481776 - protein, 18 aa, Entamoeba dispar
FKSHLCIVFELLSINLYD

SEQ ID NO: 2481777 - protein, 18 aa, Entamoeba dispar
FKSKREFEEDNNIYTEPN

SEQ ID NO: 2481778 - protein, 24 aa, Entamoeba dispar
FKSKYIEILGCLISSNSLMVKLEV

SEQ ID NO: 2481779 - protein, 19 aa, Entamoeba dispar
FKSKYNIIGNNELGEGAFS

SEQ ID NO: 2481780 - protein, 26 aa, Entamoeba dispar
FKSLDTWKKEFLNGANVTNPNDFPFV

SEQ ID NO: 2481781 - protein, 22 aa, Entamoeba dispar
FKSLEKFEVIKILIEIIKKNLS

SEQ ID NO: 2481782 - protein, 22 aa, Entamoeba dispar
FKSLKKMKVLNCNNINCNNLNS

SEQ ID NO: 2481783 - protein, 29 aa, Entamoeba dispar
FKSNGIKWVFWDVCGQAKFRSLWKSYYTN

SEQ ID NO: 2481784 - protein, 20 aa, Entamoeba dispar
FKSNGKYAIILGKILNECNL

SEQ ID NO: 2481785 - protein, 24 aa, Entamoeba dispar
FKSNLEQIKCLILNQQPPASSSIQ

SEQ ID NO: 2481786 - protein, 28 aa, Entamoeba dispar
FKSNYCIPLILAKCFKIIDEYQYQPSSP

SEQ ID NO: 2481787 - protein, 22 aa, Entamoeba dispar
FKSSFADGIYGFVIDVPSHRSA

SEQ ID NO: 2481788 - protein, 18 aa, Entamoeba dispar
FKSYARKTTIGKFDSKFN

SEQ ID NO: 2481789 - protein, 20 aa, Entamoeba dispar
FKTACSSIWGLIKPTIDKLN

SEQ ID NO: 2481790 - protein, 18 aa, Entamoeba dispar
FKTAGVALADEFSKVLFG

SEQ ID NO: 2481791 - protein, 17 aa, Entamoeba dispar
FKTAITIWDVLSNKLLF

SEQ ID NO: 2481792 - protein, 21 aa, Entamoeba dispar
FKTALSNLIDLVFEIDKELLN

SEQ ID NO: 2481793 - protein, 17 aa, Entamoeba dispar
FKTATIGAMGLRNPTKV

SEQ ID NO: 2481794 - protein, 19 aa, Entamoeba dispar
FKTIGKFCVSQHDRVCAVL

SEQ ID NO: 2481795 - protein, 20 aa, Entamoeba dispar
FKTKCFNDGRIFEYSGCLRD

SEQ ID NO: 2481796 - protein, 24 aa, Entamoeba dispar
FKTKIIYLALMVNWILKADETGEL

SEQ ID NO: 2481797 - protein, 25 aa, Entamoeba dispar
FKTKRSCKEIIDILKKCQEPINVNE

SEQ ID NO: 2481798 - protein, 24 aa, Entamoeba dispar
FKTKRSQIEYCFNQYPLYAEKLLQ

SEQ ID NO: 2481799 - protein, 18 aa, Entamoeba dispar
FKTKSLIECEQFSSRIEK

SEQ ID NO: 2481800 - protein, 18 aa, Entamoeba dispar
FKTLCSPKKIIGADLPCN

SEQ ID NO: 2481801 - protein, 21 aa, Entamoeba dispar
FKTLPVQVLLKLQQRKLDIDT

SEQ ID NO: 2481802 - protein, 27 aa, Entamoeba dispar
FKTPEECTSKCCCFYVSLNHQQLPMKV

SEQ ID NO: 2481803 - protein, 23 aa, Entamoeba dispar
FKTPRVSFMGMITPYVPPKNENN

SEQ ID NO: 2481804 - protein, 21 aa, Entamoeba dispar
FKTSKVCLQFFKIETLKFSDT

SEQ ID NO: 2481805 - protein, 20 aa, Entamoeba dispar
FKTTCSSIWGLIKPTIDKLN

SEQ ID NO: 2481806 - protein, 19 aa, Entamoeba dispar
FKTYLSRISAIDAMVNSFI

SEQ ID NO: 2481807 - protein, 25 aa, Entamoeba dispar
FKVDVWSCGVLMYTLAVGRNPFEFN

SEQ ID NO: 2481808 - protein, 17 aa, Entamoeba dispar
FKVGDIPVICEGFEKGV

SEQ ID NO: 2481809 - protein, 20 aa, Entamoeba dispar
FKVGEIYEGIVVAKREKIML

SEQ ID NO: 2481810 - protein, 20 aa, Entamoeba dispar
FKVNSSFVVKHFLDVTFKEP

SEQ ID NO: 2481811 - protein, 17 aa, Entamoeba dispar
FKWCESLTSLSIPSNIK

SEQ ID NO: 2481812 - protein, 20 aa, Entamoeba dispar
FKYCFEVIRVDVLRNVKKLG

SEQ ID NO: 2481813 - protein, 19 aa, Entamoeba dispar
FKYCPKCGNNKFLIETFKS

SEQ ID NO: 2481814 - protein, 19 aa, Entamoeba dispar
FKYGTAFGGDKLDDMSKIL

SEQ ID NO: 2481815 - protein, 20 aa, Entamoeba dispar
FKYIEACARSGQFQELARVV

SEQ ID NO: 2481816 - protein, 21 aa, Entamoeba dispar
FKYIIGEAFLIKNYPRIQTVI

SEQ ID NO: 2481817 - protein, 20 aa, Entamoeba dispar
FKYISNFSWNVQKKIFIELI

SEQ ID NO: 2481818 - protein, 18 aa, Entamoeba dispar
FKYLNKVQIKSLYNKHHR

SEQ ID NO: 2481819 - protein, 19 aa, Entamoeba dispar
FKYPLDFASVTSMVPAKGS

SEQ ID NO: 2481820 - protein, 21 aa, Entamoeba dispar
FKYSPYESFIFRSNLGNDISS

SEQ ID NO: 2481821 - protein, 19 aa, Entamoeba dispar
FKYVIWYDISYSIYLKEKG

SEQ ID NO: 2481822 - protein, 22 aa, Entamoeba dispar
FKYVIWYKVRYSTYLKEKEQGN

SEQ ID NO: 2481823 - protein, 20 aa, Entamoeba dispar
FKYVRAIGAFYLRLVGSSKE

SEQ ID NO: 2481824 - protein, 21 aa, Entamoeba dispar
FKYYRLNTLRTKVFPSISNKV

SEQ ID NO: 2481825 - protein, 21 aa, Entamoeba dispar
FLADEIKVLLKGNNEIIELDH

SEQ ID NO: 2481826 - protein, 18 aa, Entamoeba dispar
FLAIAGFGNLPGDVEIYD

SEQ ID NO: 2481827 - protein, 19 aa, Entamoeba dispar
FLAPELFFNPEIFSSDFTT

SEQ ID NO: 2481828 - protein, 18 aa, Entamoeba dispar
FLAVAGFGNCPGEVDVYE

SEQ ID NO: 2481829 - protein, 24 aa, Entamoeba dispar
FLCIQCAGLHRGLGVHLTFVRSVD

SEQ ID NO: 2481830 - protein, 18 aa, Entamoeba dispar
FLCRDCSNCHKNQLKSTI

SEQ ID NO: 2481831 - protein, 20 aa, Entamoeba dispar
FLCYFKVELYYGEKPLCPAL

SEQ ID NO: 2481832 - protein, 18 aa, Entamoeba dispar
FLDARPINPCISSSNEQL

SEQ ID NO: 2481833 - protein, 21 aa, Entamoeba dispar
FLDEIPFALTLPEPTQTIQSS

SEQ ID NO: 2481834 - protein, 25 aa, Entamoeba dispar
FLDRLGNDLPLIIFLSTKVEYREYA

SEQ ID NO: 2481835 - protein, 19 aa, Entamoeba dispar
FLDRLNLRIDQSNERIKVL

SEQ ID NO: 2481836 - protein, 24 aa, Entamoeba dispar
FLDYSQCIPLSITGSYEYPIESDT

SEQ ID NO: 2481837 - protein, 19 aa, Entamoeba dispar
FLEEMMSTVGIDFEFKELK

SEQ ID NO: 2481838 - protein, 27 aa, Entamoeba dispar
FLEGKTFYGICIQRNPLQFIGFGNRIL

SEQ ID NO: 2481839 - protein, 21 aa, Entamoeba dispar
FLEKMGFLMVGEYDYIELYKK

SEQ ID NO: 2481840 - protein, 17 aa, Entamoeba dispar
FLEKVFPLIEKYTRISK

SEQ ID NO: 2481841 - protein, 28 aa, Entamoeba dispar
FLELQPSLDYPTLHLIIYNVPKTFDKSQ

SEQ ID NO: 2481842 - protein, 18 aa, Entamoeba dispar
FLEYMKGIHNTILESCNQ

SEQ ID NO: 2481843 - protein, 20 aa, Entamoeba dispar
FLEYRHCELLDEISVLREMN

SEQ ID NO: 2481844 - protein, 19 aa, Entamoeba dispar
FLFCSYLSNRFSEFNEKTI

SEQ ID NO: 2481845 - protein, 17 aa, Entamoeba dispar
FLFDFTLDQQRLIKNFL

SEQ ID NO: 2481846 - protein, 19 aa, Entamoeba dispar
FLFHGHVCIVTELLSINLY

SEQ ID NO: 2481847 - protein, 17 aa, Entamoeba dispar
FLFIGPIYGNYIKGELK

SEQ ID NO: 2481848 - protein, 17 aa, Entamoeba dispar
FLFNIERLLNMIIQTKA

SEQ ID NO: 2481849 - protein, 23 aa, Entamoeba dispar
FLFTRRSHLNWSKFDKNESSLIK

SEQ ID NO: 2481850 - protein, 25 aa, Entamoeba dispar
FLFVLNGKGAYPFKLERKDTLRSFT

SEQ ID NO: 2481851 - protein, 17 aa, Entamoeba dispar
FLGDIALGLRYLHFTKG

SEQ ID NO: 2481852 - protein, 25 aa, Entamoeba dispar
FLGEGWRPLYQRTFTTFAKLWKLQQ

SEQ ID NO: 2481853 - protein, 21 aa, Entamoeba dispar
FLGERYMRFDPVLPDNLDLDC

SEQ ID NO: 2481854 - protein, 18 aa, Entamoeba dispar
FLHDKHLKHFGLLQLIMF

SEQ ID NO: 2481855 - protein, 18 aa, Entamoeba dispar
FLHESPWERLRLLRKRIP

SEQ ID NO: 2481856 - protein, 26 aa, Entamoeba dispar
FLHLFVIKKDKCFPIGDKSLDQPIEL

SEQ ID NO: 2481857 - protein, 21 aa, Entamoeba dispar
FLHTSVFCVGRYCDWIHNYAP

SEQ ID NO: 2481858 - protein, 19 aa, Entamoeba dispar
FLICPFCGSEFVVEQPFVM

SEQ ID NO: 2481859 - protein, 17 aa, Entamoeba dispar
FLIDCLREFNYQFDSKY

SEQ ID NO: 2481860 - protein, 29 aa, Entamoeba dispar
FLIEGKFNCCWKVTVKDVRIIIWQMKECK

SEQ ID NO: 2481861 - protein, 17 aa, Entamoeba dispar
FLIEIPLFYNSFDSNWN

SEQ ID NO: 2481862 - protein, 18 aa, Entamoeba dispar
FLIIGYDLNQPFSLTPKY

SEQ ID NO: 2481863 - protein, 17 aa, Entamoeba dispar
FLIKEFKEDCELNQIYT

SEQ ID NO: 2481864 - protein, 17 aa, Entamoeba dispar
FLINYSAGNVLRPHVFA

SEQ ID NO: 2481865 - protein, 17 aa, Entamoeba dispar
FLIPEIDFSPLFDPTQI

SEQ ID NO: 2481866 - protein, 17 aa, Entamoeba dispar
FLIRGIGSLLFENIKGV

SEQ ID NO: 2481867 - protein, 23 aa, Entamoeba dispar
FLKAKCKKVKEYFINYFDKKVQV

SEQ ID NO: 2481868 - protein, 24 aa, Entamoeba dispar
FLKCVSTIHPRCIYTSGKASSAAG

SEQ ID NO: 2481869 - protein, 21 aa, Entamoeba dispar
FLKDGCIIGGNLLGKIITKVQ

SEQ ID NO: 2481870 - protein, 27 aa, Entamoeba dispar
FLKDNDFSYDWIASIQVPIQDNLENEN

SEQ ID NO: 2481871 - protein, 24 aa, Entamoeba dispar
FLKGYYKACIEVNYILPSEFLEYH

SEQ ID NO: 2481872 - protein, 19 aa, Entamoeba dispar
FLKKMGYNFQSRLTEGKKD

SEQ ID NO: 2481873 - protein, 25 aa, Entamoeba dispar
FLKNARIADQIPFIIVCDKHGYVEE

SEQ ID NO: 2481874 - protein, 19 aa, Entamoeba dispar
FLKNVIIKKEIVPFRKHNG

SEQ ID NO: 2481875 - protein, 19 aa, Entamoeba dispar
FLKTLKYIHDYGFSYLTQE

SEQ ID NO: 2481876 - protein, 20 aa, Entamoeba dispar
FLKVIKPQASEEWIETMNKQ

SEQ ID NO: 2481877 - protein, 18 aa, Entamoeba dispar
FLKVNLWNFDYCDSCYNL

SEQ ID NO: 2481878 - protein, 21 aa, Entamoeba dispar
FLLHRLNTLSSLPFVEDPLTL

SEQ ID NO: 2481879 - protein, 32 aa, Entamoeba dispar
FLLKKAFECCVIKSQFKALVEVLSQAILNMDF

SEQ ID NO: 2481880 - protein, 19 aa, Entamoeba dispar
FLLKMVAAAREFMGSTTID

SEQ ID NO: 2481881 - protein, 20 aa, Entamoeba dispar
FLLNIAFYFETVQDLITLSF

SEQ ID NO: 2481882 - protein, 18 aa, Entamoeba dispar
FLLPEIFNMKELDEIFES

SEQ ID NO: 2481883 - protein, 19 aa, Entamoeba dispar
FLLSNVKYYAEEFGFDGFR

SEQ ID NO: 2481884 - protein, 24 aa, Entamoeba dispar
FLLSTRAGGLGINLTTADTVIIYD

SEQ ID NO: 2481885 - protein, 22 aa, Entamoeba dispar
FLLSTRSGGLGINLQSADTVIL

SEQ ID NO: 2481886 - protein, 18 aa, Entamoeba dispar
FLLTSIEWGCGEGMMGYP

SEQ ID NO: 2481887 - protein, 17 aa, Entamoeba dispar
FLLVGWTPFLRCLFEIE

SEQ ID NO: 2481888 - protein, 19 aa, Entamoeba dispar
FLMDRSCKVKQDLKSKRNV

SEQ ID NO: 2481889 - protein, 18 aa, Entamoeba dispar
FLMGCKAKLFGDDETFKL

SEQ ID NO: 2481890 - protein, 21 aa, Entamoeba dispar
FLMNIKEVFFQKEGKEYKGHI

SEQ ID NO: 2481891 - protein, 17 aa, Entamoeba dispar
FLMPKSKALALVEFEIA

SEQ ID NO: 2481892 - protein, 23 aa, Entamoeba dispar
FLMQYPTRLAWRPFDLSQVKEVR

SEQ ID NO: 2481893 - protein, 21 aa, Entamoeba dispar
FLMTKPINWYWERLMSEDQVT

SEQ ID NO: 2481894 - protein, 17 aa, Entamoeba dispar
FLNCSSLKSIELPTSLI

SEQ ID NO: 2481895 - protein, 24 aa, Entamoeba dispar
FLNELLDLLHLIAMNKEITKMNIE

SEQ ID NO: 2481896 - protein, 25 aa, Entamoeba dispar
FLNELLDLLHLIAMNKEITKMNIEN

SEQ ID NO: 2481897 - protein, 17 aa, Entamoeba dispar
FLNEQFISFIKLNSQDN

SEQ ID NO: 2481898 - protein, 22 aa, Entamoeba dispar
FLNGGFWLSVDIFNKLLPHQRT

SEQ ID NO: 2481899 - protein, 20 aa, Entamoeba dispar
FLNGGGCMHCSGQINQHTTS

SEQ ID NO: 2481900 - protein, 23 aa, Entamoeba dispar
FLNGKTCIFFRWTSDMKQPHIDR

SEQ ID NO: 2481901 - protein, 19 aa, Entamoeba dispar
FLNINCGQALDFRLISLYV

SEQ ID NO: 2481902 - protein, 18 aa, Entamoeba dispar
FLNIVYITCFLKEQDEQF

SEQ ID NO: 2481903 - protein, 20 aa, Entamoeba dispar
FLNKILVKPWIYRDIYDRAR

SEQ ID NO: 2481904 - protein, 18 aa, Entamoeba dispar
FLNNKYLFQFSRLTDEVH

SEQ ID NO: 2481905 - protein, 19 aa, Entamoeba dispar
FLNPPLILQRCMTLTNKEL

SEQ ID NO: 2481906 - protein, 23 aa, Entamoeba dispar
FLNQRFLLKMVIQAADAFKKQNL

SEQ ID NO: 2481907 - protein, 19 aa, Entamoeba dispar
FLNRLNLRIDQSNERIKVL

SEQ ID NO: 2481908 - protein, 17 aa, Entamoeba dispar
FLNSLKTVIMTEINTLS

SEQ ID NO: 2481909 - protein, 18 aa, Entamoeba dispar
FLNTSSLTFKDYKLRIVD

SEQ ID NO: 2481910 - protein, 28 aa, Entamoeba dispar
FLNVLKKWTGLEHFDIVFEYAVDGYDRT

SEQ ID NO: 2481911 - protein, 30 aa, Entamoeba dispar
FLNVLKQGYLSFIIKLKMECLEKLMDDFDA

SEQ ID NO: 2481912 - protein, 21 aa, Entamoeba dispar
FLPIEIINSFASIKMKKSDYQ

SEQ ID NO: 2481913 - protein, 19 aa, Entamoeba dispar
FLPISAYLLAPVSHFSVYP

SEQ ID NO: 2481914 - protein, 22 aa, Entamoeba dispar
FLPNEIMTLPIPLSESGSLQLR

SEQ ID NO: 2481915 - protein, 25 aa, Entamoeba dispar
FLPRRIGDDLIDLVGACHFVLDDYQ

SEQ ID NO: 2481916 - protein, 17 aa, Entamoeba dispar
FLQDRIRDFLNSNNGMT

SEQ ID NO: 2481917 - protein, 17 aa, Entamoeba dispar
FLQEAGKKIDLGVVSGS

SEQ ID NO: 2481918 - protein, 18 aa, Entamoeba dispar
FLQHYIIYDCVMVTLDAL

SEQ ID NO: 2481919 - protein, 23 aa, Entamoeba dispar
FLQIKGETFINGKLSKLVKKNDC

SEQ ID NO: 2481920 - protein, 17 aa, Entamoeba dispar
FLQKGYYKECDYWSVGC

SEQ ID NO: 2481921 - protein, 17 aa, Entamoeba dispar
FLQKKLDKIINLKKLIT

SEQ ID NO: 2481922 - protein, 17 aa, Entamoeba dispar
FLQKRFISEQCNFIIEK

SEQ ID NO: 2481923 - protein, 23 aa, Entamoeba dispar
FLQNFPFPFLDLMQPFIETDAPY

SEQ ID NO: 2481924 - protein, 21 aa, Entamoeba dispar
FLQRSSMLLSIFNSNMERSMI

SEQ ID NO: 2481925 - protein, 24 aa, Entamoeba dispar
FLQSDYYKIGLFGLNGEYYESQLS

SEQ ID NO: 2481926 - protein, 34 aa, Entamoeba dispar
FLQSSFPCLELKVIKEIWKKNNYNMVRTTDDLME

SEQ ID NO: 2481927 - protein, 26 aa, Entamoeba dispar
FLQYPPRIVQSLKRHFADICKEPLEE

SEQ ID NO: 2481928 - protein, 18 aa, Entamoeba dispar
FLRCLKSFGRLESVEEVG

SEQ ID NO: 2481929 - protein, 18 aa, Entamoeba dispar
FLRCYCAEFVKGKMAPEC

SEQ ID NO: 2481930 - protein, 23 aa, Entamoeba dispar
FLRHLEKGFPLFLIAEKYYRETN

SEQ ID NO: 2481931 - protein, 24 aa, Entamoeba dispar
FLRKGIYTCQALVMKSETISKEFV

SEQ ID NO: 2481932 - protein, 19 aa, Entamoeba dispar
FLRNLPIHIFDRITTKKIF

SEQ ID NO: 2481933 - protein, 25 aa, Entamoeba dispar
FLRVIKIVLPSCSFYNKYVNIQYCS

SEQ ID NO: 2481934 - protein, 17 aa, Entamoeba dispar
FLSFIASEAADVPKGSV

SEQ ID NO: 2481935 - protein, 23 aa, Entamoeba dispar
FLSMFKRKAFLHLYTEEGMEESE

SEQ ID NO: 2481936 - protein, 17 aa, Entamoeba dispar
FLSPKGHYDVKIYEDSV

SEQ ID NO: 2481937 - protein, 31 aa, Entamoeba dispar
FLSSSKFTILLNRELLNNLVIMATAQTDEPS

SEQ ID NO: 2481938 - protein, 18 aa, Entamoeba dispar
FLTFRVVVINSLCSFMMV

SEQ ID NO: 2481939 - protein, 24 aa, Entamoeba dispar
FLTKESFYKFGRDVCELIKEKLVH

SEQ ID NO: 2481940 - protein, 20 aa, Entamoeba dispar
FLTKEVQNECLIIKEKLNEI

SEQ ID NO: 2481941 - protein, 17 aa, Entamoeba dispar
FLTKLKTVFGEFVNNKS

SEQ ID NO: 2481942 - protein, 17 aa, Entamoeba dispar
FLTRMLLCCIIENGVDN

SEQ ID NO: 2481943 - protein, 18 aa, Entamoeba dispar
FLTSLCIGGVSCAHYSPI

SEQ ID NO: 2481944 - protein, 35 aa, Entamoeba dispar
FLTSQFIKQFSFRLLEIITLVSMCRDIQKQQLLAT

SEQ ID NO: 2481945 - protein, 19 aa, Entamoeba dispar
FLTVYRDFITPIELLNKFI

SEQ ID NO: 2481946 - protein, 19 aa, Entamoeba dispar
FLVAQGLGDIVLLGEKGKL

SEQ ID NO: 2481947 - protein, 18 aa, Entamoeba dispar
FLVDDGCVNPYPPLSDCH

SEQ ID NO: 2481948 - protein, 26 aa, Entamoeba dispar
FLVDILSEFGYFFQVSRTIGKNGTPT

SEQ ID NO: 2481949 - protein, 20 aa, Entamoeba dispar
FLVDLICSFIKKYKHFGNTF

SEQ ID NO: 2481950 - protein, 18 aa, Entamoeba dispar
FLVELDCQNNQGILELPP

SEQ ID NO: 2481951 - protein, 19 aa, Entamoeba dispar
FLVEVMLSYIYPNFAEEAQ

SEQ ID NO: 2481952 - protein, 25 aa, Entamoeba dispar
FLVFDEIAHVFGVFVNEILQPGQWL

SEQ ID NO: 2481953 - protein, 27 aa, Entamoeba dispar
FLVKTKRIVSVPKKWSIKKSINCAISI

SEQ ID NO: 2481954 - protein, 24 aa, Entamoeba dispar
FLYCNHLCIVFELLGTNLYQMLQI

SEQ ID NO: 2481955 - protein, 21 aa, Entamoeba dispar
FLYEMLKSIGYNASLKSTRAT

SEQ ID NO: 2481956 - protein, 26 aa, Entamoeba dispar
FLYNKLFRYLWPPSISQLENIDYTDS

SEQ ID NO: 2481957 - protein, 24 aa, Entamoeba dispar
FLYPKEPWWDGYFKSETEEDISKW

SEQ ID NO: 2481958 - protein, 19 aa, Entamoeba dispar
FLYSGYWGNVIARLDNEMK

SEQ ID NO: 2481959 - protein, 17 aa, Entamoeba dispar
FLYTGDPCYPIQDLIVV

SEQ ID NO: 2481960 - protein, 37 aa, Entamoeba dispar
FMAECKMKYSLILYRQFCSLFDSLPLVCIVHRDIGDF

SEQ ID NO: 2481961 - protein, 22 aa, Entamoeba dispar
FMANLRLEKIGFVFQTYNLLST

SEQ ID NO: 2481962 - protein, 18 aa, Entamoeba dispar
FMANVLLYFTKFSDVKSF

SEQ ID NO: 2481963 - protein, 19 aa, Entamoeba dispar
FMCGGLGCLLNEIQDCQPD

SEQ ID NO: 2481964 - protein, 19 aa, Entamoeba dispar
FMCHKHLILELSPQVNFIV

SEQ ID NO: 2481965 - protein, 24 aa, Entamoeba dispar
FMEPSPKMLLFYRALKLDDMNYNE

SEQ ID NO: 2481966 - protein, 18 aa, Entamoeba dispar
FMEVIGMFDGHHGQDAAI

SEQ ID NO: 2481967 - protein, 18 aa, Entamoeba dispar
FMFGPTIYYSELFTNLEL

SEQ ID NO: 2481968 - protein, 19 aa, Entamoeba dispar
FMGGIYLEKIRLVPSKSTT

SEQ ID NO: 2481969 - protein, 25 aa, Entamoeba dispar
FMGRTFKFLTELGIPTEHIRFRQHL

SEQ ID NO: 2481970 - protein, 17 aa, Entamoeba dispar
FMHWKGPAVKRMVMVKA

SEQ ID NO: 2481971 - protein, 20 aa, Entamoeba dispar
FMIFAGILIRNSPQQPPLFL

SEQ ID NO: 2481972 - protein, 17 aa, Entamoeba dispar
FMKAKEKTITLSWDEFI

SEQ ID NO: 2481973 - protein, 30 aa, Entamoeba dispar
FMKEKPIRLECVLNLPLKHYFKNHKRSYLF

SEQ ID NO: 2481974 - protein, 17 aa, Entamoeba dispar
FMKGERFVFLLCTRAGG

SEQ ID NO: 2481975 - protein, 19 aa, Entamoeba dispar
FMKHTRLTLQPSTQIEIIQ

SEQ ID NO: 2481976 - protein, 22 aa, Entamoeba dispar
FMKSLKRQPCDEGVLSCLLNST

SEQ ID NO: 2481977 - protein, 24 aa, Entamoeba dispar
FMKTKEAWQVIPLLLTSEPNVPFY

SEQ ID NO: 2481978 - protein, 20 aa, Entamoeba dispar
FMLTEGVKLSFEKTPLNMLT

SEQ ID NO: 2481979 - protein, 18 aa, Entamoeba dispar
FMMLLWDVLEKELPEEEF

SEQ ID NO: 2481980 - protein, 35 aa, Entamoeba dispar
FMNPEMNRFIFLLCTRAGGFGINLSEADTVIIYDS

SEQ ID NO: 2481981 - protein, 24 aa, Entamoeba dispar
FMNTWNDILCKLAIEAVTICAGGD

SEQ ID NO: 2481982 - protein, 26 aa, Entamoeba dispar
FMPEGFKTRTAFCLETQHFPDSPHHP

SEQ ID NO: 2481983 - protein, 18 aa, Entamoeba dispar
FMPERRVLEHIILSKEWN

SEQ ID NO: 2481984 - protein, 23 aa, Entamoeba dispar
FMPNKVKHCYLTYLCINKQCIVF

SEQ ID NO: 2481985 - protein, 17 aa, Entamoeba dispar
FMQFLVLRIFTAKPEIK

SEQ ID NO: 2481986 - protein, 25 aa, Entamoeba dispar
FMQIPMLIESCARCVAKHLVGKSPA

SEQ ID NO: 2481987 - protein, 24 aa, Entamoeba dispar
FMSKEEFRVLTAIEMGMRNHELVP

SEQ ID NO: 2481988 - protein, 28 aa, Entamoeba dispar
FMSKEMNWIRLGGKYICGYCRHNNEKFY

SEQ ID NO: 2481989 - protein, 19 aa, Entamoeba dispar
FMSSCKAVKFYSDLLNYID

SEQ ID NO: 2481990 - protein, 20 aa, Entamoeba dispar
FMTCVFIFVKALLFISDNQL

SEQ ID NO: 2481991 - protein, 18 aa, Entamoeba dispar
FMTPIPFFNIMCSDEIEP

SEQ ID NO: 2481992 - protein, 20 aa, Entamoeba dispar
FMTSADCALELQELTQLQSI

SEQ ID NO: 2481993 - protein, 32 aa, Entamoeba dispar
FMVKRGHIVRNWLQRWFVLTNDILYYFDEQKL

SEQ ID NO: 2481994 - protein, 24 aa, Entamoeba dispar
FMVLDCVHAIDIICQDPKIGPSTK

SEQ ID NO: 2481995 - protein, 22 aa, Entamoeba dispar
FNAALKKTFKFTEAGEMVTENE

SEQ ID NO: 2481996 - protein, 20 aa, Entamoeba dispar
FNACCLLKNQIELMINILPT

SEQ ID NO: 2481997 - protein, 18 aa, Entamoeba dispar
FNAVLRGDMAKIVIGENS

SEQ ID NO: 2481998 - protein, 32 aa, Entamoeba dispar
FNAYFFRILLKIFRVYLKIARYQTIGLGLSER

SEQ ID NO: 2481999 - protein, 37 aa, Entamoeba dispar
FNCGHCCYCYCCSESLGLTFKCPKCNKINVKPVYFEE

SEQ ID NO: 2482000 - protein, 17 aa, Entamoeba dispar
FNCKEIWHSGLTCSQYQ

SEQ ID NO: 2482001 - protein, 19 aa, Entamoeba dispar
FNCLVVALVFDVEMNSKIT

SEQ ID NO: 2482002 - protein, 25 aa, Entamoeba dispar
FNDEFKLELPFPLNENYQLIFNVQE

SEQ ID NO: 2482003 - protein, 24 aa, Entamoeba dispar
FNDGKAILALCHAYTRLTGENGFE

SEQ ID NO: 2482004 - protein, 17 aa, Entamoeba dispar
FNDHIYFSDMMTYVHTV

SEQ ID NO: 2482005 - protein, 21 aa, Entamoeba dispar
FNDHPIRVVLSNKVIKSKNES

SEQ ID NO: 2482006 - protein, 30 aa, Entamoeba dispar
FNDIQCKSMLLSIFSKFTFPEANQIIPKIL

SEQ ID NO: 2482007 - protein, 17 aa, Entamoeba dispar
FNDKICCIVKRKETRNP

SEQ ID NO: 2482008 - protein, 18 aa, Entamoeba dispar
FNDLKVELLRDFYNDMND

SEQ ID NO: 2482009 - protein, 44 aa, Entamoeba dispar
FNDLVQFRIKECLRKLLVGKKFEAKECYRRSFTKEEKTIEEIFY

SEQ ID NO: 2482010 - protein, 18 aa, Entamoeba dispar
FNDNFLLIQRIIKEENTF

SEQ ID NO: 2482011 - protein, 18 aa, Entamoeba dispar
FNDQAINRVVPWFETTFV

SEQ ID NO: 2482012 - protein, 18 aa, Entamoeba dispar
FNDRIIWFAVSKGSKIGK

SEQ ID NO: 2482013 - protein, 22 aa, Entamoeba dispar
FNEAFLRLVLGLTNQLEHLDSI

SEQ ID NO: 2482014 - protein, 17 aa, Entamoeba dispar
FNECYSLKSINVENIKY

SEQ ID NO: 2482015 - protein, 21 aa, Entamoeba dispar
FNEFKHCIVPRDFNDTAHPVL

SEQ ID NO: 2482016 - protein, 18 aa, Entamoeba dispar
FNEIKGGYECFVRLNEFS

SEQ ID NO: 2482017 - protein, 26 aa, Entamoeba dispar
FNEISEPFLFLGIGMKDGYCYGYKIN

SEQ ID NO: 2482018 - protein, 17 aa, Entamoeba dispar
FNELIEFRMREVIRKLI

SEQ ID NO: 2482019 - protein, 24 aa, Entamoeba dispar
FNELPCVVHEILLFLYHSLLFENE

SEQ ID NO: 2482020 - protein, 18 aa, Entamoeba dispar
FNELRSGDTFKKVMNKLT

SEQ ID NO: 2482021 - protein, 18 aa, Entamoeba dispar
FNEMSEWLWGIYNKNFLK

SEQ ID NO: 2482022 - protein, 19 aa, Entamoeba dispar
FNENIELLIKFITGSESLA

SEQ ID NO: 2482023 - protein, 17 aa, Entamoeba dispar
FNEPMMRNCVGISHFFV

SEQ ID NO: 2482024 - protein, 18 aa, Entamoeba dispar
FNETGNLLFSTSADGSIT

SEQ ID NO: 2482025 - protein, 25 aa, Entamoeba dispar
FNFEIVYHVAPLLPYYNGEEQLERK

SEQ ID NO: 2482026 - protein, 22 aa, Entamoeba dispar
FNFLNIPAIVFAKQVTLIEYDL

SEQ ID NO: 2482027 - protein, 22 aa, Entamoeba dispar
FNFPETDLSPFIHKLSNDLLHH

SEQ ID NO: 2482028 - protein, 17 aa, Entamoeba dispar
FNFRVVEIISCDINELL

SEQ ID NO: 2482029 - protein, 18 aa, Entamoeba dispar
FNGFFGINSESIRFSNLG

SEQ ID NO: 2482030 - protein, 23 aa, Entamoeba dispar
FNGKEFCATLVRLPCVVETHKSY

SEQ ID NO: 2482031 - protein, 18 aa, Entamoeba dispar
FNGKGIVTGGYRGEKIIE

SEQ ID NO: 2482032 - protein, 27 aa, Entamoeba dispar
FNGKKFGIPLLIGFTYEYPISAPEMIC

SEQ ID NO: 2482033 - protein, 23 aa, Entamoeba dispar
FNGLNIGEKMFKYMDSHPATVKE

SEQ ID NO: 2482034 - protein, 20 aa, Entamoeba dispar
FNGNFEFDGKFDGTVESNQN

SEQ ID NO: 2482035 - protein, 24 aa, Entamoeba dispar
FNGNSTCCFLPLSFNADLQTNHPD

SEQ ID NO: 2482036 - protein, 30 aa, Entamoeba dispar
FNGVNKRGCDRCMKKTLAMNKIIIDDEICK

SEQ ID NO: 2482037 - protein, 17 aa, Entamoeba dispar
FNHAISLVRNGEIPLDQ

SEQ ID NO: 2482038 - protein, 17 aa, Entamoeba dispar
FNHFYLRYYNGHNNQYG

SEQ ID NO: 2482039 - protein, 26 aa, Entamoeba dispar
FNHKHLLLPYCELFIKNVLNQLEIVF

SEQ ID NO: 2482040 - protein, 25 aa, Entamoeba dispar
FNIDFIPLFSCICGNDFTKPFSHKL

SEQ ID NO: 2482041 - protein, 19 aa, Entamoeba dispar
FNIDYYKTFDVVINALDNL

SEQ ID NO: 2482042 - protein, 18 aa, Entamoeba dispar
FNIESLWLTPNMVDSILS

SEQ ID NO: 2482043 - protein, 24 aa, Entamoeba dispar
FNIIWELINLFGKIDFGINQSTVL

SEQ ID NO: 2482044 - protein, 19 aa, Entamoeba dispar
FNIKLGKLNSEESLKELQE

SEQ ID NO: 2482045 - protein, 18 aa, Entamoeba dispar
FNILKYLKLEYGNINNWN

SEQ ID NO: 2482046 - protein, 17 aa, Entamoeba dispar
FNILKYSSKFYIQLQLY

SEQ ID NO: 2482047 - protein, 21 aa, Entamoeba dispar
FNIQTYRCFINFLIDAKTNCH

SEQ ID NO: 2482048 - protein, 17 aa, Entamoeba dispar
FNIRKCQKFHKLCKKIV

SEQ ID NO: 2482049 - protein, 17 aa, Entamoeba dispar
FNIYKGFNEYVNSPEME

SEQ ID NO: 2482050 - protein, 27 aa, Entamoeba dispar
FNKCIGCLQCVRICPTKVLTSTHMKST

SEQ ID NO: 2482051 - protein, 19 aa, Entamoeba dispar
FNKDMREMASFIKEFLGDK

SEQ ID NO: 2482052 - protein, 21 aa, Entamoeba dispar
FNKEAYFSLVLDKLQMIVNSK

SEQ ID NO: 2482053 - protein, 24 aa, Entamoeba dispar
FNKEVVEYTELFKLKEEVTALLYS

SEQ ID NO: 2482054 - protein, 24 aa, Entamoeba dispar
FNKFIKTCLKYIGIDEFLSTHYYW

SEQ ID NO: 2482055 - protein, 18 aa, Entamoeba dispar
FNKFLWGLLNSHPSFLKF

SEQ ID NO: 2482056 - protein, 24 aa, Entamoeba dispar
FNKFRLSHNLKYIVKFISDIFPLK

SEQ ID NO: 2482057 - protein, 21 aa, Entamoeba dispar
FNKGIAVVREILCDLYNGRQT

SEQ ID NO: 2482058 - protein, 17 aa, Entamoeba dispar
FNKGIEINKRYVFDKEI

SEQ ID NO: 2482059 - protein, 21 aa, Entamoeba dispar
FNKITYIRLVNFESFNSSLKV

SEQ ID NO: 2482060 - protein, 18 aa, Entamoeba dispar
FNKLIIPSEFTKPGDVET

SEQ ID NO: 2482061 - protein, 19 aa, Entamoeba dispar
FNKLLLFTRDYFRIKNIPH

SEQ ID NO: 2482062 - protein, 21 aa, Entamoeba dispar
FNKMAICYRAINIEIENKNIY

SEQ ID NO: 2482063 - protein, 24 aa, Entamoeba dispar
FNKNTWKLMPLQSLIINCIEELNG

SEQ ID NO: 2482064 - protein, 26 aa, Entamoeba dispar
FNKQWEIPITKLFGSAPVKILMITPK

SEQ ID NO: 2482065 - protein, 22 aa, Entamoeba dispar
FNKRNDAALAMKALDRTQVFGQ

SEQ ID NO: 2482066 - protein, 20 aa, Entamoeba dispar
FNKTLFYDGFIFKTYKMSQL

SEQ ID NO: 2482067 - protein, 17 aa, Entamoeba dispar
FNKVILPNNLEILGDSC

SEQ ID NO: 2482068 - protein, 26 aa, Entamoeba dispar
FNLLSRYPKYLTFEAKAQVFRKQIKK

SEQ ID NO: 2482069 - protein, 25 aa, Entamoeba dispar
FNLNCTVRVVGGWVRDKILKKNSHD

SEQ ID NO: 2482070 - protein, 20 aa, Entamoeba dispar
FNLQCYITCSFDRYICTPTE

SEQ ID NO: 2482071 - protein, 22 aa, Entamoeba dispar
FNLSIETVRFMLSIHKQCENVS

SEQ ID NO: 2482072 - protein, 17 aa, Entamoeba dispar
FNMLCLMDYVCKRNVSF

SEQ ID NO: 2482073 - protein, 17 aa, Entamoeba dispar
FNNCESIEFNMYKIRNL

SEQ ID NO: 2482074 - protein, 22 aa, Entamoeba dispar
FNNCLIVLGIDGCSYVKKVLRI

SEQ ID NO: 2482075 - protein, 18 aa, Entamoeba dispar
FNNEINWFLKKSVPQRIL

SEQ ID NO: 2482076 - protein, 23 aa, Entamoeba dispar
FNNIEVLSCDECIIDISSVPDPI

SEQ ID NO: 2482077 - protein, 17 aa, Entamoeba dispar
FNNKALQPEYLKYLSQS

SEQ ID NO: 2482078 - protein, 22 aa, Entamoeba dispar
FNNSCCEVGYWLSPKFQHQGIM

SEQ ID NO: 2482079 - protein, 25 aa, Entamoeba dispar
FNNSKEVFNQLGIIRTNCIDCLDRT

SEQ ID NO: 2482080 - protein, 19 aa, Entamoeba dispar
FNPEERWSAIQLLEHPFLK

SEQ ID NO: 2482081 - protein, 20 aa, Entamoeba dispar
FNPEVRGVIQVCLVEPTSQI

SEQ ID NO: 2482082 - protein, 23 aa, Entamoeba dispar
FNPKRILLVGGVLRSEEQLTVMQ

SEQ ID NO: 2482083 - protein, 22 aa, Entamoeba dispar
FNPKWLTSQFNHIFIVVQPEIN

SEQ ID NO: 2482084 - protein, 17 aa, Entamoeba dispar
FNPLSIIKEEGFDNSDT

SEQ ID NO: 2482085 - protein, 23 aa, Entamoeba dispar
FNPMYITTVGIDFRVKNIELDNK

SEQ ID NO: 2482086 - protein, 24 aa, Entamoeba dispar
FNPSRHLSEVFTIFSAPNYCDYYK

SEQ ID NO: 2482087 - protein, 29 aa, Entamoeba dispar
FNQELNCSVYLGRKYLLIFKDNTNPLTDI

SEQ ID NO: 2482088 - protein, 18 aa, Entamoeba dispar
FNQLSEKQKLLFSGIKEK

SEQ ID NO: 2482089 - protein, 24 aa, Entamoeba dispar
FNQRKIIKGKRMFIGIIGELINGH

SEQ ID NO: 2482090 - protein, 23 aa, Entamoeba dispar
FNREFPSHRKLNLDGKKILDELI

SEQ ID NO: 2482091 - protein, 20 aa, Entamoeba dispar
FNREICLLAAKSIEQSITDI

SEQ ID NO: 2482092 - protein, 17 aa, Entamoeba dispar
FNREILILQDLRDGPNI

SEQ ID NO: 2482093 - protein, 18 aa, Entamoeba dispar
FNRIEIMSQLVIPEMVIQ

SEQ ID NO: 2482094 - protein, 17 aa, Entamoeba dispar
FNRKGNDSGGSWELNPT

SEQ ID NO: 2482095 - protein, 22 aa, Entamoeba dispar
FNRKKKFRMISIDGGGIKCILQ

SEQ ID NO: 2482096 - protein, 25 aa, Entamoeba dispar
FNRLFKYQAALILFAMASRTEVYAQ

SEQ ID NO: 2482097 - protein, 20 aa, Entamoeba dispar
FNRQFPYLFIDCRRQESFDL

SEQ ID NO: 2482098 - protein, 22 aa, Entamoeba dispar
FNRVFMCSFPYFTNSKTVLQKL

SEQ ID NO: 2482099 - protein, 17 aa, Entamoeba dispar
FNSFFKEEWNNGRAQGC

SEQ ID NO: 2482100 - protein, 18 aa, Entamoeba dispar
FNSFPILFGKQITCSEIM

SEQ ID NO: 2482101 - protein, 17 aa, Entamoeba dispar
FNSITVKYPRWFEFYDM

SEQ ID NO: 2482102 - protein, 21 aa, Entamoeba dispar
FNSKVCCCSNVLVIVITEDGS

SEQ ID NO: 2482103 - protein, 18 aa, Entamoeba dispar
FNSMTWEPPCELLDCGTS

SEQ ID NO: 2482104 - protein, 22 aa, Entamoeba dispar
FNSPKKIPFVFHYDTQNILISL

SEQ ID NO: 2482105 - protein, 30 aa, Entamoeba dispar
FNSPYRGNGMVPLIRPSYINNPTQRQSIYS

SEQ ID NO: 2482106 - protein, 20 aa, Entamoeba dispar
FNSQCPLRQIPGVPNDICKR

SEQ ID NO: 2482107 - protein, 18 aa, Entamoeba dispar
FNSSYGFATINYDQNHKI

SEQ ID NO: 2482108 - protein, 18 aa, Entamoeba dispar
FNSVETFLLLVALKVKYP

SEQ ID NO: 2482109 - protein, 26 aa, Entamoeba dispar
FNSVRGCSYCYGFAAVRRFLIKNDLV

SEQ ID NO: 2482110 - protein, 17 aa, Entamoeba dispar
FNTISFSYNSQFLAIAG

SEQ ID NO: 2482111 - protein, 18 aa, Entamoeba dispar
FNTLISIIVFRYDDKESF

SEQ ID NO: 2482112 - protein, 20 aa, Entamoeba dispar
FNTLQFPAAVHFCVTEKTIG

SEQ ID NO: 2482113 - protein, 21 aa, Entamoeba dispar
FNTLQFPAAVHFCVTEKTIGC

SEQ ID NO: 2482114 - protein, 24 aa, Entamoeba dispar
FNTNCGPIRFEVWDTAGQEKFGGL

SEQ ID NO: 2482115 - protein, 23 aa, Entamoeba dispar
FNTNELYYIWDILFAHNNPLSLL

SEQ ID NO: 2482116 - protein, 17 aa, Entamoeba dispar
FNTQLVINCLKKTAQTT

SEQ ID NO: 2482117 - protein, 19 aa, Entamoeba dispar
FNVACAKYKLYNDTRLLNI

SEQ ID NO: 2482118 - protein, 19 aa, Entamoeba dispar
FNVLECVRTLQTYQEEEVA

SEQ ID NO: 2482119 - protein, 21 aa, Entamoeba dispar
FNVLHEFLSFYVVLMKFINYK

SEQ ID NO: 2482120 - protein, 20 aa, Entamoeba dispar
FNVSKMEWKLRGIKDKDIPF

SEQ ID NO: 2482121 - protein, 17 aa, Entamoeba dispar
FNWIGDTIVDCFNECPK

SEQ ID NO: 2482122 - protein, 27 aa, Entamoeba dispar
FNYFVYCISDSYLKCSTSSVVSLRHLV

SEQ ID NO: 2482123 - protein, 19 aa, Entamoeba dispar
FNYICCIENNRIIGIVITR

SEQ ID NO: 2482124 - protein, 17 aa, Entamoeba dispar
FNYIIPIFNYLKENEEI

SEQ ID NO: 2482125 - protein, 18 aa, Entamoeba dispar
FNYISIRFTMAGLIEEDD

SEQ ID NO: 2482126 - protein, 17 aa, Entamoeba dispar
FNYKTCGQIHTMTIVQT

SEQ ID NO: 2482127 - protein, 17 aa, Entamoeba dispar
FNYLPLGVIIKRKIGKF

SEQ ID NO: 2482128 - protein, 23 aa, Entamoeba dispar
FNYRTAYPGMVHFIVIDHFRNQT

SEQ ID NO: 2482129 - protein, 17 aa, Entamoeba dispar
FNYSLPTLMESIVTVLS

SEQ ID NO: 2482130 - protein, 17 aa, Entamoeba dispar
FNYYAVVLSDKFSSMHI

SEQ ID NO: 2482131 - protein, 27 aa, Entamoeba dispar
FPACTPTSCRVRFCISAAHTDEDIEKA

SEQ ID NO: 2482132 - protein, 17 aa, Entamoeba dispar
FPAEKYVNGSIFLQKPP

SEQ ID NO: 2482133 - protein, 22 aa, Entamoeba dispar
FPALHYRMAQVLFREKNYIQVE

SEQ ID NO: 2482134 - protein, 21 aa, Entamoeba dispar
FPAPMNCYFEKVKTAKTNRYD

SEQ ID NO: 2482135 - protein, 21 aa, Entamoeba dispar
FPCIVSYPLSIKYHIMIIKRY

SEQ ID NO: 2482136 - protein, 22 aa, Entamoeba dispar
FPDFLDCFNYSLPTLMESIVTV

SEQ ID NO: 2482137 - protein, 21 aa, Entamoeba dispar
FPDGESILKFVGAGKRLEIPS

SEQ ID NO: 2482138 - protein, 30 aa, Entamoeba dispar
FPDGFYLYFYKRFPGLLILVYNIVKKHYPN

SEQ ID NO: 2482139 - protein, 18 aa, Entamoeba dispar
FPDKLMARPETVQFMTQH

SEQ ID NO: 2482140 - protein, 22 aa, Entamoeba dispar
FPDLKGSVLSLIKSELGDKILT

SEQ ID NO: 2482141 - protein, 17 aa, Entamoeba dispar
FPDYSRLIKVSSEIQKV

SEQ ID NO: 2482142 - protein, 29 aa, Entamoeba dispar
FPEFKNPLVRRLVEMILLKNVSWDYTYED

SEQ ID NO: 2482143 - protein, 28 aa, Entamoeba dispar
FPEIDFYECYKLNSINVVMEYVDGEIRQ

SEQ ID NO: 2482144 - protein, 26 aa, Entamoeba dispar
FPEIVLKCLPLLPFEITDDYLKGRYD

SEQ ID NO: 2482145 - protein, 17 aa, Entamoeba dispar
FPEKIVGIAQSPDVDIH

SEQ ID NO: 2482146 - protein, 25 aa, Entamoeba dispar
FPEKSLPGLLIYKGDCMVKSLFGSE

SEQ ID NO: 2482147 - protein, 20 aa, Entamoeba dispar
FPELKKWWNDECNKDLVIGV

SEQ ID NO: 2482148 - protein, 22 aa, Entamoeba dispar
FPERKCLNSVITKSVKRQSTTN

SEQ ID NO: 2482149 - protein, 19 aa, Entamoeba dispar
FPERYEVKDPLILEANSPI

SEQ ID NO: 2482150 - protein, 25 aa, Entamoeba dispar
FPERYEVKDPLILEANSPIDREKIQ

SEQ ID NO: 2482151 - protein, 20 aa, Entamoeba dispar
FPESAIRSIAIIIFHRLITP

SEQ ID NO: 2482152 - protein, 25 aa, Entamoeba dispar
FPESLLSRFDLIFIILDSSTEELDR

SEQ ID NO: 2482153 - protein, 19 aa, Entamoeba dispar
FPETVCRIPSLTQLELDNN

SEQ ID NO: 2482154 - protein, 23 aa, Entamoeba dispar
FPFEEIYNNLALSIAPEIYGLED

SEQ ID NO: 2482155 - protein, 19 aa, Entamoeba dispar
FPFEIVLPENCCVTVVMGN

SEQ ID NO: 2482156 - protein, 18 aa, Entamoeba dispar
FPFKGNKIGESYCLYSAE

SEQ ID NO: 2482157 - protein, 25 aa, Entamoeba dispar
FPFTKYNVLKVIQLRVYPELINLLP

SEQ ID NO: 2482158 - protein, 25 aa, Entamoeba dispar
FPFYPFWKHVCIVWTKCYCYTPKNI

SEQ ID NO: 2482159 - protein, 21 aa, Entamoeba dispar
FPGIKEKQALIILEKNNWDMK

SEQ ID NO: 2482160 - protein, 22 aa, Entamoeba dispar
FPGILKGALIVRARKITDNMAI

SEQ ID NO: 2482161 - protein, 26 aa, Entamoeba dispar
FPGINKCAFVAMKVMKKYHPKIFYHL

SEQ ID NO: 2482162 - protein, 19 aa, Entamoeba dispar
FPGKCGGLLQIIQSLIQNP

SEQ ID NO: 2482163 - protein, 22 aa, Entamoeba dispar
FPGNALDCFNSWIQNLDVSISL

SEQ ID NO: 2482164 - protein, 20 aa, Entamoeba dispar
FPGQVVDTWLGLSKKGEIHI

SEQ ID NO: 2482165 - protein, 17 aa, Entamoeba dispar
FPGTKPIFISRQHYKIL

SEQ ID NO: 2482166 - protein, 19 aa, Entamoeba dispar
FPHTTDLVIGTLLNSSVGY

SEQ ID NO: 2482167 - protein, 24 aa, Entamoeba dispar
FPIDRRLREVLIYLFSQEYSEADK

SEQ ID NO: 2482168 - protein, 24 aa, Entamoeba dispar
FPIESLDLTRFVKHYDPTTPPIYN

SEQ ID NO: 2482169 - protein, 20 aa, Entamoeba dispar
FPIKSIQLIHKWRDNSVEFW

SEQ ID NO: 2482170 - protein, 20 aa, Entamoeba dispar
FPILFGKQITCSEIMDIVNQ

SEQ ID NO: 2482171 - protein, 18 aa, Entamoeba dispar
FPIQTKVSINPIFISQNV

SEQ ID NO: 2482172 - protein, 19 aa, Entamoeba dispar
FPIRSFNILYESIKRSITL

SEQ ID NO: 2482173 - protein, 25 aa, Entamoeba dispar
FPISDFWEHVCIVWTKCFNYTPLKK

SEQ ID NO: 2482174 - protein, 26 aa, Entamoeba dispar
FPISKIRLRQQIIWDAEQEDLKDKSS

SEQ ID NO: 2482175 - protein, 18 aa, Entamoeba dispar
FPIVQPLNGYLQQLTSLP

SEQ ID NO: 2482176 - protein, 18 aa, Entamoeba dispar
FPKDKHVRKLICSCSTEQ

SEQ ID NO: 2482177 - protein, 24 aa, Entamoeba dispar
FPKEIYKYPWDIANTISTGKRPPI

SEQ ID NO: 2482178 - protein, 23 aa, Entamoeba dispar
FPKEVFRILHDCSGEKSIAKEES

SEQ ID NO: 2482179 - protein, 24 aa, Entamoeba dispar
FPKGCPCGYDLLKEVRECMKKDIV

SEQ ID NO: 2482180 - protein, 19 aa, Entamoeba dispar
FPKIRDSSQVMSFIKTQSD

SEQ ID NO: 2482181 - protein, 24 aa, Entamoeba dispar
FPKKMKQCIKKYVFELIGDNITEV

SEQ ID NO: 2482182 - protein, 20 aa, Entamoeba dispar
FPKLTNQFLYSRNDNKIKGV

SEQ ID NO: 2482183 - protein, 19 aa, Entamoeba dispar
FPKMHRYKVSKDAKDLIKE

SEQ ID NO: 2482184 - protein, 18 aa, Entamoeba dispar
FPKNTPPAIREFISDLLQ

SEQ ID NO: 2482185 - protein, 18 aa, Entamoeba dispar
FPLFPRDAFTYYINTEKH

SEQ ID NO: 2482186 - protein, 26 aa, Entamoeba dispar
FPLKDNDCYLCLKGVNHFATMAPMLD

SEQ ID NO: 2482187 - protein, 20 aa, Entamoeba dispar
FPLKLYSFIHIRGELEIPSN

SEQ ID NO: 2482188 - protein, 17 aa, Entamoeba dispar
FPLNCFNEVLVNARILY

SEQ ID NO: 2482189 - protein, 21 aa, Entamoeba dispar
FPLQDILSLKLKYIEGRDPKL

SEQ ID NO: 2482190 - protein, 19 aa, Entamoeba dispar
FPLQGMTLVLRHLALEGDQ

SEQ ID NO: 2482191 - protein, 22 aa, Entamoeba dispar
FPLQSKLSLFITFYNEYSKLFL

SEQ ID NO: 2482192 - protein, 22 aa, Entamoeba dispar
FPNDLPTTFWQRCNISHIESLA

SEQ ID NO: 2482193 - protein, 18 aa, Entamoeba dispar
FPNFLQRYTTQYYVPNID

SEQ ID NO: 2482194 - protein, 19 aa, Entamoeba dispar
FPNIETFYIYIISDEEFDD

SEQ ID NO: 2482195 - protein, 18 aa, Entamoeba dispar
FPNIETFYIYNYNDEIFK

SEQ ID NO: 2482196 - protein, 28 aa, Entamoeba dispar
FPNILLKGSEIALPFGEIMQMEKVKDAV

SEQ ID NO: 2482197 - protein, 18 aa, Entamoeba dispar
FPNLKVQKLYAWNDTQIP

SEQ ID NO: 2482198 - protein, 21 aa, Entamoeba dispar
FPNNNVTLWIDEYGIKLVSEQ

SEQ ID NO: 2482199 - protein, 19 aa, Entamoeba dispar
FPNVITAWDRNGIDKATAN

SEQ ID NO: 2482200 - protein, 17 aa, Entamoeba dispar
FPNYICPAIEQTIVNQQ

SEQ ID NO: 2482201 - protein, 18 aa, Entamoeba dispar
FPPFKLKDTINVPIYQAL

SEQ ID NO: 2482202 - protein, 17 aa, Entamoeba dispar
FPPLKPIFYEFNLSIKQ

SEQ ID NO: 2482203 - protein, 21 aa, Entamoeba dispar
FPPRGEFFCCGKIEKSSFSND

SEQ ID NO: 2482204 - protein, 17 aa, Entamoeba dispar
FPPSPKSKFTMIKEIGK

SEQ ID NO: 2482205 - protein, 20 aa, Entamoeba dispar
FPQNRFGIAPDYKWDGVDRG

SEQ ID NO: 2482206 - protein, 27 aa, Entamoeba dispar
FPQSDLSYCIKFFNKLEETIKRIEQYG

SEQ ID NO: 2482207 - protein, 24 aa, Entamoeba dispar
FPRCSIKRNLCIKINKTKLEIGEK

SEQ ID NO: 2482208 - protein, 25 aa, Entamoeba dispar
FPRDRSFVDWLLCKTINGERASLES

SEQ ID NO: 2482209 - protein, 19 aa, Entamoeba dispar
FPRELKILQIYKCPLISFE

SEQ ID NO: 2482210 - protein, 17 aa, Entamoeba dispar
FPRKFFTYYQQLSNSFV

SEQ ID NO: 2482211 - protein, 21 aa, Entamoeba dispar
FPRKILKIAAAQIAMSAGYTD

SEQ ID NO: 2482212 - protein, 22 aa, Entamoeba dispar
FPRLLEEVNLFCGVSASSFICA

SEQ ID NO: 2482213 - protein, 27 aa, Entamoeba dispar
FPRQYLIQRLQPIFDVFEIVDIGIQIE

SEQ ID NO: 2482214 - protein, 20 aa, Entamoeba dispar
FPRSSCVMCHGCNRYYHEKC

SEQ ID NO: 2482215 - protein, 18 aa, Entamoeba dispar
FPSALLILQLLINVLLNQ

SEQ ID NO: 2482216 - protein, 17 aa, Entamoeba dispar
FPSFEPIQQQPQQNQFP

SEQ ID NO: 2482217 - protein, 17 aa, Entamoeba dispar
FPSHIELLFKSICSSWT

SEQ ID NO: 2482218 - protein, 19 aa, Entamoeba dispar
FPSIIAYDANKIFIIEPEK

SEQ ID NO: 2482219 - protein, 23 aa, Entamoeba dispar
FPSILYKKLLGIPLTFDDYNILD

SEQ ID NO: 2482220 - protein, 17 aa, Entamoeba dispar
FPSINIKIREWLGLSPT

SEQ ID NO: 2482221 - protein, 17 aa, Entamoeba dispar
FPSITSRNLKSITNSND

SEQ ID NO: 2482222 - protein, 22 aa, Entamoeba dispar
FPSKQFYSGELIDGRDESILPC

SEQ ID NO: 2482223 - protein, 18 aa, Entamoeba dispar
FPSLSVLDLSCNNLSVIP

SEQ ID NO: 2482224 - protein, 20 aa, Entamoeba dispar
FPSNYLIHFTEVILTSLTMN

SEQ ID NO: 2482225 - protein, 38 aa, Entamoeba dispar
FPSQIFYERCKRIKKIAIFICCDEYLFGVYHHSQLIPS

SEQ ID NO: 2482226 - protein, 28 aa, Entamoeba dispar
FPSSELVKGCVFNCKKNQIRISLWVGEH

SEQ ID NO: 2482227 - protein, 24 aa, Entamoeba dispar
FPSSLKELHICFTNTKNYTYKNES

SEQ ID NO: 2482228 - protein, 25 aa, Entamoeba dispar
FPSYGGKVDFDWFVEKIALCYIEVA

SEQ ID NO: 2482229 - protein, 25 aa, Entamoeba dispar
FPTDISEQFCRFMVAIGEHKDKLDF

SEQ ID NO: 2482230 - protein, 23 aa, Entamoeba dispar
FPTKAKREKCLFEEKKKTDEIEK

SEQ ID NO: 2482231 - protein, 23 aa, Entamoeba dispar
FPTMKLKILELLNFVCEKNVFCE

SEQ ID NO: 2482232 - protein, 26 aa, Entamoeba dispar
FPTNMRERARFIPLRITQPERKMLRL

SEQ ID NO: 2482233 - protein, 17 aa, Entamoeba dispar
FPTPLYQANKFCKMLND

SEQ ID NO: 2482234 - protein, 24 aa, Entamoeba dispar
FPTYLIELANAFNIQVDVYQPYNY

SEQ ID NO: 2482235 - protein, 25 aa, Entamoeba dispar
FPVDDFWKHVCIVWTNCSYNKSENE

SEQ ID NO: 2482236 - protein, 23 aa, Entamoeba dispar
FPVETFRPIKLIAVDSRNSVILV

SEQ ID NO: 2482237 - protein, 26 aa, Entamoeba dispar
FPVYEFWEHVCVVWSKCYCYTPQNVI

SEQ ID NO: 2482238 - protein, 18 aa, Entamoeba dispar
FPYDSRCITIQDFCTTNT

SEQ ID NO: 2482239 - protein, 20 aa, Entamoeba dispar
FPYSQPNLFTPNPTTSYQQY

SEQ ID NO: 2482240 - protein, 19 aa, Entamoeba dispar
FQALLSVIVGHKFKYPLDF

SEQ ID NO: 2482241 - protein, 18 aa, Entamoeba dispar
FQAPILFEVKSKSQKFTK

SEQ ID NO: 2482242 - protein, 25 aa, Entamoeba dispar
FQCDDLFKLLLEWCDREEESTMVLK

SEQ ID NO: 2482243 - protein, 18 aa, Entamoeba dispar
FQCIPFILLQARLSQVLE

SEQ ID NO: 2482244 - protein, 20 aa, Entamoeba dispar
FQCIPFILLQARLSQVLEGF

SEQ ID NO: 2482245 - protein, 18 aa, Entamoeba dispar
FQDSIYIFKCENSAVKVN

SEQ ID NO: 2482246 - protein, 25 aa, Entamoeba dispar
FQEALQFVFYCWQDIPGNVKQLLND

SEQ ID NO: 2482247 - protein, 18 aa, Entamoeba dispar
FQEFKNVLEKVCNSKPSA

SEQ ID NO: 2482248 - protein, 19 aa, Entamoeba dispar
FQEFPELTMDLQIIIQSAT

SEQ ID NO: 2482249 - protein, 25 aa, Entamoeba dispar
FQENILFRFYLKFIGSPIATKIFEK

SEQ ID NO: 2482250 - protein, 25 aa, Entamoeba dispar
FQERPEPFVQFTVKIQKNYFDYLKQ

SEQ ID NO: 2482251 - protein, 21 aa, Entamoeba dispar
FQFISQLAFSLPIILTQQQQQ

SEQ ID NO: 2482252 - protein, 19 aa, Entamoeba dispar
FQFKSVFESVTIYKPESSR

SEQ ID NO: 2482253 - protein, 18 aa, Entamoeba dispar
FQFLDCVNILLHQFPDDF

SEQ ID NO: 2482254 - protein, 18 aa, Entamoeba dispar
FQFTRVEGTLSRLQSFLK

SEQ ID NO: 2482255 - protein, 17 aa, Entamoeba dispar
FQFYLVSHVPRKGLVKP

SEQ ID NO: 2482256 - protein, 23 aa, Entamoeba dispar
FQGHLRLLFLENMLDLGSYERKC

SEQ ID NO: 2482257 - protein, 18 aa, Entamoeba dispar
FQGNIERFHFNPIPLDKY

SEQ ID NO: 2482258 - protein, 18 aa, Entamoeba dispar
FQGNMERFHFNPIPLNEH

SEQ ID NO: 2482259 - protein, 18 aa, Entamoeba dispar
FQGNMERFHFNPIPLNEY

SEQ ID NO: 2482260 - protein, 18 aa, Entamoeba dispar
FQGNMERFHFNPIPLNYY

SEQ ID NO: 2482261 - protein, 19 aa, Entamoeba dispar
FQGNMERFRFNPIPLNHYS

SEQ ID NO: 2482262 - protein, 18 aa, Entamoeba dispar
FQGSIELIDIHSIIPNGR

SEQ ID NO: 2482263 - protein, 25 aa, Entamoeba dispar
FQHFHIPHILSIYSLRQLDTSEFLK

SEQ ID NO: 2482264 - protein, 17 aa, Entamoeba dispar
FQHGHPVLTCFNSTQHL

SEQ ID NO: 2482265 - protein, 23 aa, Entamoeba dispar
FQHIMRYKIQLNRIMETLPKYDS

SEQ ID NO: 2482266 - protein, 23 aa, Entamoeba dispar
FQIDIRYAFSITNLLPRTIYIGN

SEQ ID NO: 2482267 - protein, 17 aa, Entamoeba dispar
FQIFTGPVVEKLLITLK

SEQ ID NO: 2482268 - protein, 22 aa, Entamoeba dispar
FQIHSYCLWDDKKIRTTLTYPS

SEQ ID NO: 2482269 - protein, 23 aa, Entamoeba dispar
FQIIDILFVRKGENGLGQLQIQQ

SEQ ID NO: 2482270 - protein, 17 aa, Entamoeba dispar
FQILFCIYDVNDKESIQ

SEQ ID NO: 2482271 - protein, 17 aa, Entamoeba dispar
FQIRAFVGKGSRSSLKI

SEQ ID NO: 2482272 - protein, 18 aa, Entamoeba dispar
FQKAVQFDREHNITSSIK

SEQ ID NO: 2482273 - protein, 19 aa, Entamoeba dispar
FQKELKLFPQIETVRIDEN

SEQ ID NO: 2482274 - protein, 21 aa, Entamoeba dispar
FQKFNMHYKIENCMFEEAQNL

SEQ ID NO: 2482275 - protein, 18 aa, Entamoeba dispar
FQKIHCHDFYLSRKNNTL

SEQ ID NO: 2482276 - protein, 19 aa, Entamoeba dispar
FQKIWRYLVPFYIRCGLHP

SEQ ID NO: 2482277 - protein, 25 aa, Entamoeba dispar
FQKKVFCVLGGYGLFDSTQVQIKNI

SEQ ID NO: 2482278 - protein, 26 aa, Entamoeba dispar
FQKLAHFLKTYCSYVNSTDAITEHEN

SEQ ID NO: 2482279 - protein, 23 aa, Entamoeba dispar
FQKRCFPGLKLSHRLNTQEYYDI

SEQ ID NO: 2482280 - protein, 25 aa, Entamoeba dispar
FQKTYWKWFISLSEIPRPSYHCELF

SEQ ID NO: 2482281 - protein, 19 aa, Entamoeba dispar
FQLFFFKIFHNYFQCFKAN

SEQ ID NO: 2482282 - protein, 18 aa, Entamoeba dispar
FQLPERALDMILSNLSNE

SEQ ID NO: 2482283 - protein, 20 aa, Entamoeba dispar
FQLQPMKFVITFKLGSGLDV

SEQ ID NO: 2482284 - protein, 17 aa, Entamoeba dispar
FQLRKDFFPAAKLQMED

SEQ ID NO: 2482285 - protein, 23 aa, Entamoeba dispar
FQLYEEFGKQWVIYQLSMFKSLK

SEQ ID NO: 2482286 - protein, 17 aa, Entamoeba dispar
FQMKGMEDDARRLLIRR

SEQ ID NO: 2482287 - protein, 20 aa, Entamoeba dispar
FQNDCILIFKICDVKDPEVT

SEQ ID NO: 2482288 - protein, 23 aa, Entamoeba dispar
FQNESHFLFSNHSFYSEPLYSYQ

SEQ ID NO: 2482289 - protein, 18 aa, Entamoeba dispar
FQNGMALDITKYVMPKTI

SEQ ID NO: 2482290 - protein, 26 aa, Entamoeba dispar
FQNICVPRKIVLFAQKHHCFVTLYTR

SEQ ID NO: 2482291 - protein, 18 aa, Entamoeba dispar
FQNVLSVFIPLFFQVLFE

SEQ ID NO: 2482292 - protein, 17 aa, Entamoeba dispar
FQNYYLRVCHATVSLII

SEQ ID NO: 2482293 - protein, 18 aa, Entamoeba dispar
FQPGKFIFSFDDLKMLLG

SEQ ID NO: 2482294 - protein, 17 aa, Entamoeba dispar
FQPLFGRGNCGGLDIVI

SEQ ID NO: 2482295 - protein, 18 aa, Entamoeba dispar
FQQAVLIYLLSRAGVTVE

SEQ ID NO: 2482296 - protein, 23 aa, Entamoeba dispar
FQQCKSQCKLMLIFHHSPQSPLS

SEQ ID NO: 2482297 - protein, 26 aa, Entamoeba dispar
FQQHLLPKRCLLNFQQQNFEIATPYI

SEQ ID NO: 2482298 - protein, 17 aa, Entamoeba dispar
FQQIGRLLVQNNLLITT

SEQ ID NO: 2482299 - protein, 18 aa, Entamoeba dispar
FQQIGRLLVQNNLLITTN

SEQ ID NO: 2482300 - protein, 19 aa, Entamoeba dispar
FQQKFTRKQYSHFLYFIFR

SEQ ID NO: 2482301 - protein, 24 aa, Entamoeba dispar
FQQMPLCLELSKLLMLDDPQTLKD

SEQ ID NO: 2482302 - protein, 17 aa, Entamoeba dispar
FQQRGNTEIEYAKHLIQ

SEQ ID NO: 2482303 - protein, 24 aa, Entamoeba dispar
FQQVKNFIVLSHFIPEGVTLVKDI

SEQ ID NO: 2482304 - protein, 17 aa, Entamoeba dispar
FQRAASGSFALAECLTG

SEQ ID NO: 2482305 - protein, 23 aa, Entamoeba dispar
FQRMKNLFLEEIRSFSIQINTLV

SEQ ID NO: 2482306 - protein, 34 aa, Entamoeba dispar
FQRVYKWKDCGKIWRMRACCVIYVNFANKKENTC

SEQ ID NO: 2482307 - protein, 22 aa, Entamoeba dispar
FQSEIKPKIKLTNYESEDDQLI

SEQ ID NO: 2482308 - protein, 35 aa, Entamoeba dispar
FQSIIRGYLTRRVFGLKLMIKRKAALMEFLTTEES

SEQ ID NO: 2482309 - protein, 22 aa, Entamoeba dispar
FQSISLFFFVACCHPMAEIRQN

SEQ ID NO: 2482310 - protein, 32 aa, Entamoeba dispar
FQSLDLAWSLLRTFPRDMLKRISNETLDKYYD

SEQ ID NO: 2482311 - protein, 24 aa, Entamoeba dispar
FQSMCLQLNLLKKRIIANTYLESK

SEQ ID NO: 2482312 - protein, 17 aa, Entamoeba dispar
FQTALNFFQAVPENIQY

SEQ ID NO: 2482313 - protein, 18 aa, Entamoeba dispar
FQTKIKILEWLNSSHQMT

SEQ ID NO: 2482314 - protein, 22 aa, Entamoeba dispar
FQTLQYWTGFNHIQIIYDSNKN

SEQ ID NO: 2482315 - protein, 17 aa, Entamoeba dispar
FQTPFSGFVEVATPTTN

SEQ ID NO: 2482316 - protein, 17 aa, Entamoeba dispar
FQVCPKCQAKYIDKCPI

SEQ ID NO: 2482317 - protein, 25 aa, Entamoeba dispar
FQVIKNLYLLLGSVDFLGNPVGLVS

SEQ ID NO: 2482318 - protein, 18 aa, Entamoeba dispar
FQVSDRGNNVIVYGTIAG

SEQ ID NO: 2482319 - protein, 17 aa, Entamoeba dispar
FQYIKSLIDKIIISDEL

SEQ ID NO: 2482320 - protein, 27 aa, Entamoeba dispar
FQYSRFPPHFKCCIEDFELGKIDIEID

SEQ ID NO: 2482321 - protein, 17 aa, Entamoeba dispar
FRALLNGGRLEDILNGF

SEQ ID NO: 2482322 - protein, 17 aa, Entamoeba dispar
FRDAWREKHANDKTERI

SEQ ID NO: 2482323 - protein, 20 aa, Entamoeba dispar
FRDFILRKLINGERTAMFSP

SEQ ID NO: 2482324 - protein, 17 aa, Entamoeba dispar
FRDGKKIGNPICDKGKG

SEQ ID NO: 2482325 - protein, 17 aa, Entamoeba dispar
FRDILLAHFQCPYCHYE

SEQ ID NO: 2482326 - protein, 19 aa, Entamoeba dispar
FRDLIKRMLVYDPNKRISL

SEQ ID NO: 2482327 - protein, 20 aa, Entamoeba dispar
FREDFVYGFSTWFDVSFPQS

SEQ ID NO: 2482328 - protein, 17 aa, Entamoeba dispar
FREDVEFFSKLEMEIKN

SEQ ID NO: 2482329 - protein, 18 aa, Entamoeba dispar
FREEFGDYNIAKCRIITF

SEQ ID NO: 2482330 - protein, 17 aa, Entamoeba dispar
FREGIIKTIFLTFNEIE

SEQ ID NO: 2482331 - protein, 22 aa, Entamoeba dispar
FREKITRMCYIFAKDHKDKNYQ

SEQ ID NO: 2482332 - protein, 23 aa, Entamoeba dispar
FREMKGRITDFYVQRTEVEAITK

SEQ ID NO: 2482333 - protein, 23 aa, Entamoeba dispar
FREPPEDGLFCDLLWSDPLQYEV

SEQ ID NO: 2482334 - protein, 26 aa, Entamoeba dispar
FRERFKRTLKGGVGIIELYHKSNMLA

SEQ ID NO: 2482335 - protein, 17 aa, Entamoeba dispar
FRFDTIKALNEVFEGAV

SEQ ID NO: 2482336 - protein, 20 aa, Entamoeba dispar
FRFEELKQMYLFMTITQPSY

SEQ ID NO: 2482337 - protein, 27 aa, Entamoeba dispar
FRFGSWPHAGCGIGLERITMLYLGIPN

SEQ ID NO: 2482338 - protein, 19 aa, Entamoeba dispar
FRGDRAIEISKAFYQGEEF

SEQ ID NO: 2482339 - protein, 17 aa, Entamoeba dispar
FRGETVLLKGKRRKETV

SEQ ID NO: 2482340 - protein, 17 aa, Entamoeba dispar
FRGIVHISGENNSVFSG

SEQ ID NO: 2482341 - protein, 20 aa, Entamoeba dispar
FRGNGQWLKEFRVNEIDPGD

SEQ ID NO: 2482342 - protein, 17 aa, Entamoeba dispar
FRGNIERFHFNPIPLDE

SEQ ID NO: 2482343 - protein, 18 aa, Entamoeba dispar
FRGNIERFHFNPIPLNEH

SEQ ID NO: 2482344 - protein, 18 aa, Entamoeba dispar
FRGNIERFHFNPIPLNEY

SEQ ID NO: 2482345 - protein, 18 aa, Entamoeba dispar
FRGNIERFHFNPIPLNNY

SEQ ID NO: 2482346 - protein, 18 aa, Entamoeba dispar
FRGNMERFHFNPIPLNEY

SEQ ID NO: 2482347 - protein, 17 aa, Entamoeba dispar
FRGTRPFRLITTGEDNY

SEQ ID NO: 2482348 - protein, 31 aa, Entamoeba dispar
FRGTYGQLFECFRKLFICKTDTDSKSQLIIS

SEQ ID NO: 2482349 - protein, 17 aa, Entamoeba dispar
FRHCGIAKKKTPTQYDA

SEQ ID NO: 2482350 - protein, 23 aa, Entamoeba dispar
FRIKENYKEFKICVHPKNCNSDL

SEQ ID NO: 2482351 - protein, 21 aa, Entamoeba dispar
FRIPLPDILHWMNIDISSPSG

SEQ ID NO: 2482352 - protein, 22 aa, Entamoeba dispar
FRIPLPDILHWMNIDISSSGKT

SEQ ID NO: 2482353 - protein, 24 aa, Entamoeba dispar
FRIQVSAMDCTGCEVCTTACPVKC

SEQ ID NO: 2482354 - protein, 18 aa, Entamoeba dispar
FRITEGIAGSSGDDMGTG

SEQ ID NO: 2482355 - protein, 17 aa, Entamoeba dispar
FRITSMDGIDEITKNEC

SEQ ID NO: 2482356 - protein, 17 aa, Entamoeba dispar
FRIVSHNILKHGITPTS

SEQ ID NO: 2482357 - protein, 28 aa, Entamoeba dispar
FRIYIKHYRIIKTYVDLVLKKHLQTDTL

SEQ ID NO: 2482358 - protein, 26 aa, Entamoeba dispar
FRKAKMTWFGVEVCLMLKEFFENNNM

SEQ ID NO: 2482359 - protein, 20 aa, Entamoeba dispar
FRKENVCSIDPPGCTDIDDA

SEQ ID NO: 2482360 - protein, 17 aa, Entamoeba dispar
FRKGEKRVLITTDVWAR

SEQ ID NO: 2482361 - protein, 18 aa, Entamoeba dispar
FRKGISGNTFYFGNNDIL

SEQ ID NO: 2482362 - protein, 20 aa, Entamoeba dispar
FRKGNYACIAEMIRGNKTLK

SEQ ID NO: 2482363 - protein, 32 aa, Entamoeba dispar
FRKHHCRKCGLCICSNCSKQTIIINGKKERVC

SEQ ID NO: 2482364 - protein, 20 aa, Entamoeba dispar
FRKLEPEQAILVLQDLLRTN

SEQ ID NO: 2482365 - protein, 17 aa, Entamoeba dispar
FRKPLLIEVINENKIAK

SEQ ID NO: 2482366 - protein, 18 aa, Entamoeba dispar
FRKRCDNEPLGIDQSTEI

SEQ ID NO: 2482367 - protein, 17 aa, Entamoeba dispar
FRKRKSKELFFNEIEPF

SEQ ID NO: 2482368 - protein, 19 aa, Entamoeba dispar
FRKRLGLKPKTIKQPYNIL

SEQ ID NO: 2482369 - protein, 19 aa, Entamoeba dispar
FRKRVFPLKSPQRIEKSND

SEQ ID NO: 2482370 - protein, 20 aa, Entamoeba dispar
FRKTSSFYLFRKCIDVLGNS

SEQ ID NO: 2482371 - protein, 21 aa, Entamoeba dispar
FRKVFEVGPVFRAENSNTRRH

SEQ ID NO: 2482372 - protein, 20 aa, Entamoeba dispar
FRLKTGILRIEKAFFCENNQ

SEQ ID NO: 2482373 - protein, 20 aa, Entamoeba dispar
FRLNNCAHIHVGECINVMCK

SEQ ID NO: 2482374 - protein, 19 aa, Entamoeba dispar
FRLTTNMIDCFGPQSENGL

SEQ ID NO: 2482375 - protein, 19 aa, Entamoeba dispar
FRLTVDAVIERYLQIVLKL

SEQ ID NO: 2482376 - protein, 24 aa, Entamoeba dispar
FRLYLTEGLPYFLLYKEVPKEILE

SEQ ID NO: 2482377 - protein, 17 aa, Entamoeba dispar
FRMTCEIVMTVLRENKD

SEQ ID NO: 2482378 - protein, 18 aa, Entamoeba dispar
FRNEVSILASQGVVRKVC

SEQ ID NO: 2482379 - protein, 17 aa, Entamoeba dispar
FRNGRWKPVKEVKCHDA

SEQ ID NO: 2482380 - protein, 21 aa, Entamoeba dispar
FRNGVLMVIAKLAIKNIQIKN

SEQ ID NO: 2482381 - protein, 17 aa, Entamoeba dispar
FRNIHFASFRSPLRKVH

SEQ ID NO: 2482382 - protein, 18 aa, Entamoeba dispar
FRNLQSRSITCLNEIDKQ

SEQ ID NO: 2482383 - protein, 17 aa, Entamoeba dispar
FRNYLYLCRKLQNVYRL

SEQ ID NO: 2482384 - protein, 25 aa, Entamoeba dispar
FRPEGPIASSFFSYNYCDFELVEDI

SEQ ID NO: 2482385 - protein, 20 aa, Entamoeba dispar
FRPLSYRDTDCFVIVFSYID

SEQ ID NO: 2482386 - protein, 22 aa, Entamoeba dispar
FRPYLNDCIEIVKALISIQHSF

SEQ ID NO: 2482387 - protein, 17 aa, Entamoeba dispar
FRQCGIMDQSLPFFMFE

SEQ ID NO: 2482388 - protein, 17 aa, Entamoeba dispar
FRQELPPHIFALSEETY

SEQ ID NO: 2482389 - protein, 20 aa, Entamoeba dispar
FRQESNFHYLFGVKEAGFYG

SEQ ID NO: 2482390 - protein, 18 aa, Entamoeba dispar
FRQTLRWLTEEPNKEKKS

SEQ ID NO: 2482391 - protein, 22 aa, Entamoeba dispar
FRRDEISVIFCSKIGDVGLDLP

SEQ ID NO: 2482392 - protein, 18 aa, Entamoeba dispar
FRRGEFGACPRVLCDNHA

SEQ ID NO: 2482393 - protein, 18 aa, Entamoeba dispar
FRSEDFLQEIAIMSLLHN

SEQ ID NO: 2482394 - protein, 20 aa, Entamoeba dispar
FRSEYIIQFYGVFIHNKICM

SEQ ID NO: 2482395 - protein, 18 aa, Entamoeba dispar
FRSIPMEEIVSVASRIPI

SEQ ID NO: 2482396 - protein, 24 aa, Entamoeba dispar
FRSKGRIPAATWWNREKGVIMRSS

SEQ ID NO: 2482397 - protein, 24 aa, Entamoeba dispar
FRSKGRIPIVSWISEGNGLLVRSS

SEQ ID NO: 2482398 - protein, 18 aa, Entamoeba dispar
FRSMHGYVTINLKENDKL

SEQ ID NO: 2482399 - protein, 30 aa, Entamoeba dispar
FRSMIDLYFRKAVGAFIVYDVMLRDSFQHL

SEQ ID NO: 2482400 - protein, 23 aa, Entamoeba dispar
FRSRLSCLYCLKCYKEQGETEEL

SEQ ID NO: 2482401 - protein, 19 aa, Entamoeba dispar
FRSVMPVYFRGADCAIIVY

SEQ ID NO: 2482402 - protein, 20 aa, Entamoeba dispar
FRTECLFANIKELVFSSLSD

SEQ ID NO: 2482403 - protein, 17 aa, Entamoeba dispar
FRTIKHPNIINYLDHIV

SEQ ID NO: 2482404 - protein, 17 aa, Entamoeba dispar
FRTLPLPIQGKRNVEQC

SEQ ID NO: 2482405 - protein, 19 aa, Entamoeba dispar
FRTNELLRREKMKEMIKEI

SEQ ID NO: 2482406 - protein, 18 aa, Entamoeba dispar
FRTNESLRREKMKEMIKE

SEQ ID NO: 2482407 - protein, 23 aa, Entamoeba dispar
FRTPKLTKFFKIIITERNDLREM

SEQ ID NO: 2482408 - protein, 19 aa, Entamoeba dispar
FRTPPKYLQQLLVDAGPID

SEQ ID NO: 2482409 - protein, 19 aa, Entamoeba dispar
FRTSASYKIVGRVKSILDG

SEQ ID NO: 2482410 - protein, 18 aa, Entamoeba dispar
FRVGMINGVLSMVKNESV

SEQ ID NO: 2482411 - protein, 19 aa, Entamoeba dispar
FRVKVSIAQHLPILRTMSF

SEQ ID NO: 2482412 - protein, 18 aa, Entamoeba dispar
FRVLMMIPKRDSYFTSLN

SEQ ID NO: 2482413 - protein, 20 aa, Entamoeba dispar
FRVTYLLNCVVIPWLHETNV

SEQ ID NO: 2482414 - protein, 20 aa, Entamoeba dispar
FRVVEIISCDINELLIGNVI

SEQ ID NO: 2482415 - protein, 20 aa, Entamoeba dispar
FRVVVINSLCSFMMVNQRYC

SEQ ID NO: 2482416 - protein, 20 aa, Entamoeba dispar
FRYDISHGVALKTAKRRYQT

SEQ ID NO: 2482417 - protein, 19 aa, Entamoeba dispar
FRYELKCHCKSIASTSVTI

SEQ ID NO: 2482418 - protein, 17 aa, Entamoeba dispar
FRYEYVTETKEQTAKEV

SEQ ID NO: 2482419 - protein, 23 aa, Entamoeba dispar
FRYFESKLAIGMFIHQFAKEHPD

SEQ ID NO: 2482420 - protein, 22 aa, Entamoeba dispar
FRYFNCIGNILSFKICSIDDKS

SEQ ID NO: 2482421 - protein, 17 aa, Entamoeba dispar
FRYKEDINRLNPNGKLE

SEQ ID NO: 2482422 - protein, 17 aa, Entamoeba dispar
FSADEINEFMEIVKSSH

SEQ ID NO: 2482423 - protein, 23 aa, Entamoeba dispar
FSAHCTTEWYWTYDSKALVFCGC

SEQ ID NO: 2482424 - protein, 25 aa, Entamoeba dispar
FSAKFCTNCGTPVKSTPSNNLKTAS

SEQ ID NO: 2482425 - protein, 18 aa, Entamoeba dispar
FSAPTLFTPRMNHLGYIT

SEQ ID NO: 2482426 - protein, 19 aa, Entamoeba dispar
FSATFPKQIQRLAADFLDN

SEQ ID NO: 2482427 - protein, 26 aa, Entamoeba dispar
FSATFPKQIQRLAADFLDNYVFITVG

SEQ ID NO: 2482428 - protein, 20 aa, Entamoeba dispar
FSCDTCGYRSNEVKCGGPVS

SEQ ID NO: 2482429 - protein, 30 aa, Entamoeba dispar
FSCIKRISLKSCTIKQLLFQKNIFESIELI

SEQ ID NO: 2482430 - protein, 23 aa, Entamoeba dispar
FSCKEIQDILSLTLQRSSIVCKR

SEQ ID NO: 2482431 - protein, 21 aa, Entamoeba dispar
FSCKNPSRVIFRIEEYTRAVW

SEQ ID NO: 2482432 - protein, 27 aa, Entamoeba dispar
FSCLCKPKNNIIGLNWIHCSPATSNHL

SEQ ID NO: 2482433 - protein, 23 aa, Entamoeba dispar
FSDCSRSYLHLVGYEEVTDSIKE

SEQ ID NO: 2482434 - protein, 23 aa, Entamoeba dispar
FSDECSRLLFFIERHAFDVCKIL

SEQ ID NO: 2482435 - protein, 24 aa, Entamoeba dispar
FSDECSRLLFFIERHAFDVCKILL

SEQ ID NO: 2482436 - protein, 17 aa, Entamoeba dispar
FSDGLIQRKWYDDVVFK

SEQ ID NO: 2482437 - protein, 19 aa, Entamoeba dispar
FSDRKSLRLSSCRKSYHQR

SEQ ID NO: 2482438 - protein, 27 aa, Entamoeba dispar
FSECFNLRFVPFPPSVHQIERFAFSRC

SEQ ID NO: 2482439 - protein, 25 aa, Entamoeba dispar
FSEEHGAVCPINWKTGKDTIEPTPE

SEQ ID NO: 2482440 - protein, 25 aa, Entamoeba dispar
FSEEHGAVCPINWKTGKDTIEQTPE

SEQ ID NO: 2482441 - protein, 30 aa, Entamoeba dispar
FSEETTCAISLFVFEGWLNTFIKFINNQRK

SEQ ID NO: 2482442 - protein, 17 aa, Entamoeba dispar
FSEICQKISNLLFGTML

SEQ ID NO: 2482443 - protein, 17 aa, Entamoeba dispar
FSEKIFPIEIGISSYSL

SEQ ID NO: 2482444 - protein, 20 aa, Entamoeba dispar
FSEKLPILINKERPKYQIKE

SEQ ID NO: 2482445 - protein, 19 aa, Entamoeba dispar
FSEMGYPLFEYGINSLYQT

SEQ ID NO: 2482446 - protein, 25 aa, Entamoeba dispar
FSENCIKPEGRNLVSCKMYNEVVFH

SEQ ID NO: 2482447 - protein, 24 aa, Entamoeba dispar
FSESIRISWDQAIKEALECPDYLE

SEQ ID NO: 2482448 - protein, 27 aa, Entamoeba dispar
FSEVPRRVSDCFVICACDGVWDVFSNE

SEQ ID NO: 2482449 - protein, 19 aa, Entamoeba dispar
FSFAPFPFHPAVPLFQELC

SEQ ID NO: 2482450 - protein, 18 aa, Entamoeba dispar
FSFDSSRIDMSWIEHGKT

SEQ ID NO: 2482451 - protein, 18 aa, Entamoeba dispar
FSFDSSRIDMSWIEYGKT

SEQ ID NO: 2482452 - protein, 30 aa, Entamoeba dispar
FSFIIRSTYSYTFELWFIFKNEDNSLRMSF

SEQ ID NO: 2482453 - protein, 24 aa, Entamoeba dispar
FSFIPRLREPFITSILTDFIDKDE

SEQ ID NO: 2482454 - protein, 18 aa, Entamoeba dispar
FSFQWKKEDRLVLLNIVN

SEQ ID NO: 2482455 - protein, 17 aa, Entamoeba dispar
FSFSHCSSLRQIKLPPL

SEQ ID NO: 2482456 - protein, 25 aa, Entamoeba dispar
FSFYEFWEHVCIVWTKCYCYIPQKE

SEQ ID NO: 2482457 - protein, 17 aa, Entamoeba dispar
FSGAKGCIAVFDYSSPD

SEQ ID NO: 2482458 - protein, 19 aa, Entamoeba dispar
FSGCIRNIIIAKLIMRIGF

SEQ ID NO: 2482459 - protein, 26 aa, Entamoeba dispar
FSGCNARPSVCPCWSVEPKLGTNPLV

SEQ ID NO: 2482460 - protein, 24 aa, Entamoeba dispar
FSGGRDGKLCFWKMDKKPSYYNIY

SEQ ID NO: 2482461 - protein, 26 aa, Entamoeba dispar
FSGGWRMRISIAKAIYMHPDLLLLDE

SEQ ID NO: 2482462 - protein, 17 aa, Entamoeba dispar
FSGKEYLPSVIDIKNPS

SEQ ID NO: 2482463 - protein, 18 aa, Entamoeba dispar
FSGMIHYLLQGLKNKNNE

SEQ ID NO: 2482464 - protein, 18 aa, Entamoeba dispar
FSGNVWLNHIKRCLQRTK

SEQ ID NO: 2482465 - protein, 19 aa, Entamoeba dispar
FSGQNCGIVGLTLNNDNIR

SEQ ID NO: 2482466 - protein, 25 aa, Entamoeba dispar
FSHEMAKFYIAELLLAIDSIHQLNY

SEQ ID NO: 2482467 - protein, 18 aa, Entamoeba dispar
FSHNYIIQYIPLFSKLFS

SEQ ID NO: 2482468 - protein, 33 aa, Entamoeba dispar
FSHTKIGQFLSELKVELPFPLKKTHHLLFTITD

SEQ ID NO: 2482469 - protein, 20 aa, Entamoeba dispar
FSIFHYIDLSKCVPLKMDVL

SEQ ID NO: 2482470 - protein, 23 aa, Entamoeba dispar
FSIGYCPFITKIPYLGYDGYFLK

SEQ ID NO: 2482471 - protein, 20 aa, Entamoeba dispar
FSIKIPLKDLVLFFDSIISE

SEQ ID NO: 2482472 - protein, 28 aa, Entamoeba dispar
FSIKKICDLAEALLLAVIEYLNKRKEYK

SEQ ID NO: 2482473 - protein, 23 aa, Entamoeba dispar
FSIKTGVIVGSLFHHTARVHTLI

SEQ ID NO: 2482474 - protein, 18 aa, Entamoeba dispar
FSILSKFFIKLSNKLPNP

SEQ ID NO: 2482475 - protein, 17 aa, Entamoeba dispar
FSILYGLINRLVKYSSI

SEQ ID NO: 2482476 - protein, 18 aa, Entamoeba dispar
FSINPPLYGIAWFNKYNF

SEQ ID NO: 2482477 - protein, 23 aa, Entamoeba dispar
FSIPVDLNPSFTLKMNNGLKNEE

SEQ ID NO: 2482478 - protein, 20 aa, Entamoeba dispar
FSKDGMRIGGNPSYIDLDPR

SEQ ID NO: 2482479 - protein, 23 aa, Entamoeba dispar
FSKIWPCNLFPPSLPTPNIENEE

SEQ ID NO: 2482480 - protein, 17 aa, Entamoeba dispar
FSKKGERTISLFDQRKE

SEQ ID NO: 2482481 - protein, 23 aa, Entamoeba dispar
FSKLREVMKIAVPPCLPFIGSTM

SEQ ID NO: 2482482 - protein, 21 aa, Entamoeba dispar
FSKLVSCQNIGELSIEQQKKV

SEQ ID NO: 2482483 - protein, 19 aa, Entamoeba dispar
FSKMFPHTTDLVIGTLLNS

SEQ ID NO: 2482484 - protein, 21 aa, Entamoeba dispar
FSKNEIDERMLLNLQKKKWTD

SEQ ID NO: 2482485 - protein, 34 aa, Entamoeba dispar
FSKQILPKFFKHSNICSFVRQLNIYGFRKLETQT

SEQ ID NO: 2482486 - protein, 17 aa, Entamoeba dispar
FSKVMKCYDQLRNCQVA

SEQ ID NO: 2482487 - protein, 19 aa, Entamoeba dispar
FSLAKSFLYDQFEYYSSTP

SEQ ID NO: 2482488 - protein, 18 aa, Entamoeba dispar
FSLENRWFTFPILLHQYI

SEQ ID NO: 2482489 - protein, 17 aa, Entamoeba dispar
FSLFELKLMTSLEKVTI

SEQ ID NO: 2482490 - protein, 19 aa, Entamoeba dispar
FSLGKYRIFGETIDIAVGN

SEQ ID NO: 2482491 - protein, 19 aa, Entamoeba dispar
FSLIHCNLCNTDVCCYIPR

SEQ ID NO: 2482492 - protein, 27 aa, Entamoeba dispar
FSLIIPEIDKPWYLKFNNAAIYDDDIK

SEQ ID NO: 2482493 - protein, 18 aa, Entamoeba dispar
FSLINSKCLKAIHCLLRN

SEQ ID NO: 2482494 - protein, 26 aa, Entamoeba dispar
FSLIRSVVFETCIPKLITNEFDKINI

SEQ ID NO: 2482495 - protein, 25 aa, Entamoeba dispar
FSLLFVFPMSGFIPICVEYLQQHQK

SEQ ID NO: 2482496 - protein, 23 aa, Entamoeba dispar
FSLLMPIFRWVISKKDKTTEIVK

SEQ ID NO: 2482497 - protein, 18 aa, Entamoeba dispar
FSLLTNLYLPYIISEELF

SEQ ID NO: 2482498 - protein, 17 aa, Entamoeba dispar
FSLNGFYNFIKRRRFST

SEQ ID NO: 2482499 - protein, 20 aa, Entamoeba dispar
FSLNNAKAFYSLYSKESKEE

SEQ ID NO: 2482500 - protein, 17 aa, Entamoeba dispar
FSLPYLLEHCVRILQDL

SEQ ID NO: 2482501 - protein, 17 aa, Entamoeba dispar
FSLQQFVVIPRDLFITH

SEQ ID NO: 2482502 - protein, 22 aa, Entamoeba dispar
FSLQTICPFTLAKLASFGKEVL

SEQ ID NO: 2482503 - protein, 18 aa, Entamoeba dispar
FSLQYFLIINVHLKDTSN

SEQ ID NO: 2482504 - protein, 28 aa, Entamoeba dispar
FSLSESRLECLKKISTIIQMLNYAPINK

SEQ ID NO: 2482505 - protein, 20 aa, Entamoeba dispar
FSLSNIRGVNKWRKDPFNIN

SEQ ID NO: 2482506 - protein, 20 aa, Entamoeba dispar
FSLSRAHSFIQPKHIGTKIK

SEQ ID NO: 2482507 - protein, 17 aa, Entamoeba dispar
FSLSSFSTYPCFKNVKQ

SEQ ID NO: 2482508 - protein, 21 aa, Entamoeba dispar
FSMINKRCGQVLLLFEENPIP

SEQ ID NO: 2482509 - protein, 27 aa, Entamoeba dispar
FSMVREIRSGFHFPMRTNEVVLSTQLK

SEQ ID NO: 2482510 - protein, 25 aa, Entamoeba dispar
FSNALLYQFHLKKGDAIGFISRNRY

SEQ ID NO: 2482511 - protein, 23 aa, Entamoeba dispar
FSNDCIYCDGEVDFNLKNECIVN

SEQ ID NO: 2482512 - protein, 22 aa, Entamoeba dispar
FSNEPVEFILFIHCVEAIIRQN

SEQ ID NO: 2482513 - protein, 17 aa, Entamoeba dispar
FSNGGKIVGCIMSSYLL

SEQ ID NO: 2482514 - protein, 18 aa, Entamoeba dispar
FSNICIMNNDYLIEGKLE

SEQ ID NO: 2482515 - protein, 17 aa, Entamoeba dispar
FSNIKFALIRNMTPPII

SEQ ID NO: 2482516 - protein, 17 aa, Entamoeba dispar
FSNLEELFILKDIYESI

SEQ ID NO: 2482517 - protein, 22 aa, Entamoeba dispar
FSNLKSIYSYCGSKINVSSLKS

SEQ ID NO: 2482518 - protein, 19 aa, Entamoeba dispar
FSNNLKYIIKFIYDILPFS

SEQ ID NO: 2482519 - protein, 19 aa, Entamoeba dispar
FSNPLISLTQIWIYHDSLK

SEQ ID NO: 2482520 - protein, 17 aa, Entamoeba dispar
FSNSFFTLNDLDNIVND

SEQ ID NO: 2482521 - protein, 18 aa, Entamoeba dispar
FSNSGKIIPQYLYDDQLS

SEQ ID NO: 2482522 - protein, 19 aa, Entamoeba dispar
FSNSGKIIPQYLYDDQLSL

SEQ ID NO: 2482523 - protein, 25 aa, Entamoeba dispar
FSNSPVKCLRWHKNATNIFISLFEN

SEQ ID NO: 2482524 - protein, 26 aa, Entamoeba dispar
FSNYGWSLTCELSFLQSLYQYGNNME

SEQ ID NO: 2482525 - protein, 17 aa, Entamoeba dispar
FSPAFSCVTRYHNDSYI

SEQ ID NO: 2482526 - protein, 20 aa, Entamoeba dispar
FSPAIPFVCKTNADIQFKPL

SEQ ID NO: 2482527 - protein, 19 aa, Entamoeba dispar
FSPCPSGIMNELIYLCEDM

SEQ ID NO: 2482528 - protein, 17 aa, Entamoeba dispar
FSPDGSMCVCVSSDKSI

SEQ ID NO: 2482529 - protein, 18 aa, Entamoeba dispar
FSPDGSMCVCVSSDKSIS

SEQ ID NO: 2482530 - protein, 17 aa, Entamoeba dispar
FSPEQGIRLFDTLISDQ

SEQ ID NO: 2482531 - protein, 19 aa, Entamoeba dispar
FSPIELTTPIATFVFSHPN

SEQ ID NO: 2482532 - protein, 19 aa, Entamoeba dispar
FSPSIGMPSSIMDELQYSP

SEQ ID NO: 2482533 - protein, 29 aa, Entamoeba dispar
FSPSSKFFKKWFEKYSMLSNFPFVYIVDV

SEQ ID NO: 2482534 - protein, 17 aa, Entamoeba dispar
FSPSTSFDWNTINIDRK

SEQ ID NO: 2482535 - protein, 24 aa, Entamoeba dispar
FSPYDSGLVFSIFFPERNRFPGVI

SEQ ID NO: 2482536 - protein, 23 aa, Entamoeba dispar
FSQANIFSGSTLIYLIKGDGKTM

SEQ ID NO: 2482537 - protein, 17 aa, Entamoeba dispar
FSQIIAWFNQVDKDHSG

SEQ ID NO: 2482538 - protein, 23 aa, Entamoeba dispar
FSQKGYLSTISMFLDDKETTKQE

SEQ ID NO: 2482539 - protein, 19 aa, Entamoeba dispar
FSQLFLDLFGRYFAFFEQQ

SEQ ID NO: 2482540 - protein, 21 aa, Entamoeba dispar
FSQPRFNDMPSVTVSIEDIIN

SEQ ID NO: 2482541 - protein, 17 aa, Entamoeba dispar
FSQPRFNDMSSVTVNIE

SEQ ID NO: 2482542 - protein, 17 aa, Entamoeba dispar
FSQVIGNGIKIRKEDIF

SEQ ID NO: 2482543 - protein, 24 aa, Entamoeba dispar
FSRESHKLYAIKIIKNSSVKRTTM

SEQ ID NO: 2482544 - protein, 17 aa, Entamoeba dispar
FSREWDILLDKIVVDQL

SEQ ID NO: 2482545 - protein, 28 aa, Entamoeba dispar
FSRGQAFVQSWFDHWGIVPGDPLDKEIK

SEQ ID NO: 2482546 - protein, 17 aa, Entamoeba dispar
FSRICPKEIKEISENID

SEQ ID NO: 2482547 - protein, 20 aa, Entamoeba dispar
FSRLRVAALKNLKASSLTIT

SEQ ID NO: 2482548 - protein, 21 aa, Entamoeba dispar
FSRNICLSINTFLMFSKYLDD

SEQ ID NO: 2482549 - protein, 18 aa, Entamoeba dispar
FSRSVLRNRPSEYIQQEK

SEQ ID NO: 2482550 - protein, 20 aa, Entamoeba dispar
FSRVVDFEFLATLVGKKGEK

SEQ ID NO: 2482551 - protein, 19 aa, Entamoeba dispar
FSSCCLICKIQCECDSNNH

SEQ ID NO: 2482552 - protein, 20 aa, Entamoeba dispar
FSSCCLICKIQCECDSNNHQ

SEQ ID NO: 2482553 - protein, 19 aa, Entamoeba dispar
FSSDLIIKYCNILKGIDAG

SEQ ID NO: 2482554 - protein, 20 aa, Entamoeba dispar
FSSDVLKTLCEFINKTQQRK

SEQ ID NO: 2482555 - protein, 17 aa, Entamoeba dispar
FSSFITDRCRKRKSNDI

SEQ ID NO: 2482556 - protein, 30 aa, Entamoeba dispar
FSSIIPEIDEPWYLKFNNSAIFANKTTDEF

SEQ ID NO: 2482557 - protein, 27 aa, Entamoeba dispar
FSSIIPEIDKPWYLKFNNSAIYDDDIK

SEQ ID NO: 2482558 - protein, 20 aa, Entamoeba dispar
FSSIIPEINEPWYLKFNNSA

SEQ ID NO: 2482559 - protein, 18 aa, Entamoeba dispar
FSSIIPYIDEPWYLKFNN

SEQ ID NO: 2482560 - protein, 19 aa, Entamoeba dispar
FSSIIPYIDKPWYLKFNNS

SEQ ID NO: 2482561 - protein, 17 aa, Entamoeba dispar
FSSLLAIQNDFEEELFI

SEQ ID NO: 2482562 - protein, 17 aa, Entamoeba dispar
FSSLTFLDISFNKLNLI

SEQ ID NO: 2482563 - protein, 25 aa, Entamoeba dispar
FSSLYQLIFHPIKFFTPTEKKVGEV

SEQ ID NO: 2482564 - protein, 21 aa, Entamoeba dispar
FSSMKTFVVFIVLDNPSNESI

SEQ ID NO: 2482565 - protein, 25 aa, Entamoeba dispar
FSSNLKFIGSYAFVGCAFNKVILPN

SEQ ID NO: 2482566 - protein, 17 aa, Entamoeba dispar
FSSPARCLVLDSIKNVQ

SEQ ID NO: 2482567 - protein, 18 aa, Entamoeba dispar
FSSPSLSIIRHFSHLFNL

SEQ ID NO: 2482568 - protein, 24 aa, Entamoeba dispar
FSSRNIQCIIKRNAVYTGTPDEMK

SEQ ID NO: 2482569 - protein, 22 aa, Entamoeba dispar
FSSSELDSGFVSPMVSVTREIP

SEQ ID NO: 2482570 - protein, 17 aa, Entamoeba dispar
FSSSVKEHSECPVCKSP

SEQ ID NO: 2482571 - protein, 20 aa, Entamoeba dispar
FSTIIPEIDEPWYLKFNNSA

SEQ ID NO: 2482572 - protein, 33 aa, Entamoeba dispar
FSTIIPEIDKPWYLKFNCLYIYKDNTENPLTQN

SEQ ID NO: 2482573 - protein, 21 aa, Entamoeba dispar
FSTIIPEIDKPWYLKFNNSAI

SEQ ID NO: 2482574 - protein, 19 aa, Entamoeba dispar
FSTIIPYIDKPWYLKFNNS

SEQ ID NO: 2482575 - protein, 20 aa, Entamoeba dispar
FSTNCLKTNLLIKTKNQGEF

SEQ ID NO: 2482576 - protein, 21 aa, Entamoeba dispar
FSTRLQRISQFFLTQPGISKE

SEQ ID NO: 2482577 - protein, 22 aa, Entamoeba dispar
FSTRVRLLRFIQFSKNETSDVK

SEQ ID NO: 2482578 - protein, 27 aa, Entamoeba dispar
FSTSHRIWLWIVNMPQIIHAMNVLAPP

SEQ ID NO: 2482579 - protein, 17 aa, Entamoeba dispar
FSTYKGILHISATSVSL

SEQ ID NO: 2482580 - protein, 25 aa, Entamoeba dispar
FSTYYPYWRFEIIYMSHNNSFHFFN

SEQ ID NO: 2482581 - protein, 24 aa, Entamoeba dispar
FSVECTYAGTAFRGNARTFLQKTQ

SEQ ID NO: 2482582 - protein, 25 aa, Entamoeba dispar
FSVFTKPHWKKILLDTFNHCTNIET

SEQ ID NO: 2482583 - protein, 22 aa, Entamoeba dispar
FSVLPPFVPWVLLSTATTTFEL

SEQ ID NO: 2482584 - protein, 21 aa, Entamoeba dispar
FSVNVLPQYAGKLYISLTPYD

SEQ ID NO: 2482585 - protein, 17 aa, Entamoeba dispar
FSVQRIIAFETEADNIL

SEQ ID NO: 2482586 - protein, 20 aa, Entamoeba dispar
FSVRGAELLSKYVGETEKNI

SEQ ID NO: 2482587 - protein, 25 aa, Entamoeba dispar
FSVSLELQGLLNLKGKYQIDELTER

SEQ ID NO: 2482588 - protein, 24 aa, Entamoeba dispar
FSVTVEIFGKMAFKQITEQKYFDV

SEQ ID NO: 2482589 - protein, 19 aa, Entamoeba dispar
FSYGIILWEMTYRTIHQKY

SEQ ID NO: 2482590 - protein, 25 aa, Entamoeba dispar
FSYRKELLEATGFSTFNVVYDSKIN

SEQ ID NO: 2482591 - protein, 29 aa, Entamoeba dispar
FSYTFPELIKIRSEFKFFNVIQLKLQMAD

SEQ ID NO: 2482592 - protein, 27 aa, Entamoeba dispar
FTAFGKRMLRERFLLKPLMDVNKILHR

SEQ ID NO: 2482593 - protein, 17 aa, Entamoeba dispar
FTAICIVWVQCLVDLHF

SEQ ID NO: 2482594 - protein, 18 aa, Entamoeba dispar
FTAIDTWINEYSRALNGK

SEQ ID NO: 2482595 - protein, 24 aa, Entamoeba dispar
FTAQIKASCGIAQGPFYPQPEKNK

SEQ ID NO: 2482596 - protein, 24 aa, Entamoeba dispar
FTARGCSCISLGRCTVCGCSCSEH

SEQ ID NO: 2482597 - protein, 17 aa, Entamoeba dispar
FTAVFVFASSMTQQQVM

SEQ ID NO: 2482598 - protein, 23 aa, Entamoeba dispar
FTCGINICMTGDNLLLMSDGIYD

SEQ ID NO: 2482599 - protein, 25 aa, Entamoeba dispar
FTCKCADCISLGVPLEFTQKDMPKW

SEQ ID NO: 2482600 - protein, 17 aa, Entamoeba dispar
FTDCVISVPGYFTENQR

SEQ ID NO: 2482601 - protein, 18 aa, Entamoeba dispar
FTDFWNGYGSCITPDKIV

SEQ ID NO: 2482602 - protein, 21 aa, Entamoeba dispar
FTDIKGIFIVFSLDNMESLNH

SEQ ID NO: 2482603 - protein, 22 aa, Entamoeba dispar
FTDIKGIFIVFSLDNMESLNHC

SEQ ID NO: 2482604 - protein, 20 aa, Entamoeba dispar
FTDIKPFYSSFHIEDDNSSS

SEQ ID NO: 2482605 - protein, 20 aa, Entamoeba dispar
FTDKELSHFGRLGSTSDDGR

SEQ ID NO: 2482606 - protein, 24 aa, Entamoeba dispar
FTDKRKPWTGILLFGPPGTGKSFL

SEQ ID NO: 2482607 - protein, 18 aa, Entamoeba dispar
FTDPRFFWNESLVSILQP

SEQ ID NO: 2482608 - protein, 26 aa, Entamoeba dispar
FTDTYQRMVFLWMIWLIMNQHPQVFG

SEQ ID NO: 2482609 - protein, 23 aa, Entamoeba dispar
FTEFMKMKFNFEGTKEELQSFSN

SEQ ID NO: 2482610 - protein, 23 aa, Entamoeba dispar
FTEKLEFDEMLFSNNHILLEVLS

SEQ ID NO: 2482611 - protein, 22 aa, Entamoeba dispar
FTEKNEIFFMDNFMMPIYLHDS

SEQ ID NO: 2482612 - protein, 26 aa, Entamoeba dispar
FTEMFMCGVIYKLTQQYILMNIHQKQ

SEQ ID NO: 2482613 - protein, 18 aa, Entamoeba dispar
FTENKIIVIVAIDDREES

SEQ ID NO: 2482614 - protein, 25 aa, Entamoeba dispar
FTERKCYYGVIFVLKYMMILDLMRK

SEQ ID NO: 2482615 - protein, 24 aa, Entamoeba dispar
FTETARIAALFGMNQILRRETSEL

SEQ ID NO: 2482616 - protein, 18 aa, Entamoeba dispar
FTFDQIINAFDFFQNKPT

SEQ ID NO: 2482617 - protein, 24 aa, Entamoeba dispar
FTFKILKGQMEWNGCELSNGTAQP

SEQ ID NO: 2482618 - protein, 19 aa, Entamoeba dispar
FTFNFPIVQPLNGYLQQLT

SEQ ID NO: 2482619 - protein, 24 aa, Entamoeba dispar
FTFRFPLIHSSIYCHVLFIQIPHI

SEQ ID NO: 2482620 - protein, 17 aa, Entamoeba dispar
FTGDILWTTLKIVNSIV

SEQ ID NO: 2482621 - protein, 19 aa, Entamoeba dispar
FTGEVSPLPVIFKAGDDIR

SEQ ID NO: 2482622 - protein, 17 aa, Entamoeba dispar
FTGYNIMNFDFKYLLER

SEQ ID NO: 2482623 - protein, 27 aa, Entamoeba dispar
FTHEDLDIILSFCLCINVTIDQNIKNS

SEQ ID NO: 2482624 - protein, 23 aa, Entamoeba dispar
FTHKTPCLVIINGIKEGVNYNDP

SEQ ID NO: 2482625 - protein, 27 aa, Entamoeba dispar
FTHPQLSFRFIEWCILNYSEIIHQCQI

SEQ ID NO: 2482626 - protein, 19 aa, Entamoeba dispar
FTICDPCFFTEFRDACMAA

SEQ ID NO: 2482627 - protein, 21 aa, Entamoeba dispar
FTIEMINILLKRREYDKQTAS

SEQ ID NO: 2482628 - protein, 18 aa, Entamoeba dispar
FTIKEFRNEVSILASQGV

SEQ ID NO: 2482629 - protein, 24 aa, Entamoeba dispar
FTIKKIKMIRCFNLSLKDHDISPF

SEQ ID NO: 2482630 - protein, 17 aa, Entamoeba dispar
FTILQRICEIIGASLDT

SEQ ID NO: 2482631 - protein, 23 aa, Entamoeba dispar
FTILRPFGTEMWDIEMINFCDMT

SEQ ID NO: 2482632 - protein, 27 aa, Entamoeba dispar
FTIMDSRFLPFRELQGFEGNIINSISH

SEQ ID NO: 2482633 - protein, 17 aa, Entamoeba dispar
FTINGGIYPVHNLVDED

SEQ ID NO: 2482634 - protein, 18 aa, Entamoeba dispar
FTIPFGYYEVKVIEAKTM

SEQ ID NO: 2482635 - protein, 18 aa, Entamoeba dispar
FTIYCSKQPIGQHGIYQN

SEQ ID NO: 2482636 - protein, 25 aa, Entamoeba dispar
FTKGLKEWGSAILVGFNGDPNGKDE

SEQ ID NO: 2482637 - protein, 18 aa, Entamoeba dispar
FTKLPPYNSPIIDIPFFL

SEQ ID NO: 2482638 - protein, 24 aa, Entamoeba dispar
FTKLRASWNSNRMAGAKIIATKLA

SEQ ID NO: 2482639 - protein, 20 aa, Entamoeba dispar
FTKLRIFFPNIIDLKHVTNQ

SEQ ID NO: 2482640 - protein, 18 aa, Entamoeba dispar
FTKPERNEYIFGSVIDVS

SEQ ID NO: 2482641 - protein, 18 aa, Entamoeba dispar
FTKPQQWKLIDNILSSHS

SEQ ID NO: 2482642 - protein, 19 aa, Entamoeba dispar
FTKRIVCGVESFSSPDFTY

SEQ ID NO: 2482643 - protein, 17 aa, Entamoeba dispar
FTLADGTFWPIPITMSV

SEQ ID NO: 2482644 - protein, 30 aa, Entamoeba dispar
FTLIKNVQCFKLSLKLLQPFDLIRIKEYDI

SEQ ID NO: 2482645 - protein, 30 aa, Entamoeba dispar
FTLKPEYAIELKFIIKMICTAFVNDEIGII

SEQ ID NO: 2482646 - protein, 17 aa, Entamoeba dispar
FTLLGRVGAAACSQQLS

SEQ ID NO: 2482647 - protein, 26 aa, Entamoeba dispar
FTMFKVDSGFCYLSCPDCKKKIADGS

SEQ ID NO: 2482648 - protein, 18 aa, Entamoeba dispar
FTMPSLQSIQFNKNRITS

SEQ ID NO: 2482649 - protein, 19 aa, Entamoeba dispar
FTNAGLIPRSINALIEELK

SEQ ID NO: 2482650 - protein, 17 aa, Entamoeba dispar
FTNCSIGIIADGCGWGF

SEQ ID NO: 2482651 - protein, 19 aa, Entamoeba dispar
FTNHLARAVLIIGAPYLQS

SEQ ID NO: 2482652 - protein, 22 aa, Entamoeba dispar
FTNKEFKTWFIENLMIHIERRK

SEQ ID NO: 2482653 - protein, 18 aa, Entamoeba dispar
FTNLYRPVLAYKEIQENF

SEQ ID NO: 2482654 - protein, 23 aa, Entamoeba dispar
FTNQRLCKSVQFDKQLGLDSSFD

SEQ ID NO: 2482655 - protein, 28 aa, Entamoeba dispar
FTNRCGHSFCKQCILEQILTGMRENGKS

SEQ ID NO: 2482656 - protein, 17 aa, Entamoeba dispar
FTPEILPGITAGNCVVS

SEQ ID NO: 2482657 - protein, 20 aa, Entamoeba dispar
FTPELSRCHLKDLKLFDCEN

SEQ ID NO: 2482658 - protein, 26 aa, Entamoeba dispar
FTPIIDECYPLWVYKSTPGLFCIQSF

SEQ ID NO: 2482659 - protein, 18 aa, Entamoeba dispar
FTPNEIKKIHGFSSEFTT

SEQ ID NO: 2482660 - protein, 19 aa, Entamoeba dispar
FTQHYADLMGYKDGVESKD

SEQ ID NO: 2482661 - protein, 34 aa, Entamoeba dispar
FTQIQHCILNIFSLTRFNLITGLLSIELFLEALD

SEQ ID NO: 2482662 - protein, 28 aa, Entamoeba dispar
FTQKEIRLPFCIKILEIFVEYLTDIEIV

SEQ ID NO: 2482663 - protein, 18 aa, Entamoeba dispar
FTQKVKDYIIFKASEQGV

SEQ ID NO: 2482664 - protein, 22 aa, Entamoeba dispar
FTQLGDGCFERCSSLANIHIPT

SEQ ID NO: 2482665 - protein, 22 aa, Entamoeba dispar
FTRKTNGYSLWVFGSIDNLLSV

SEQ ID NO: 2482666 - protein, 26 aa, Entamoeba dispar
FTRLKIEKYPALKVWIQQLCPTYPPC

SEQ ID NO: 2482667 - protein, 17 aa, Entamoeba dispar
FTRLKIELLKSYFSPDR

SEQ ID NO: 2482668 - protein, 18 aa, Entamoeba dispar
FTRLPTKHIQEFKTSTEY

SEQ ID NO: 2482669 - protein, 19 aa, Entamoeba dispar
FTRRSFLSSITKTSLPSLF

SEQ ID NO: 2482670 - protein, 22 aa, Entamoeba dispar
FTRSVALMSMVGYILGLGDRHP

SEQ ID NO: 2482671 - protein, 20 aa, Entamoeba dispar
FTRTFFRKTLAYFVIVDSTI

SEQ ID NO: 2482672 - protein, 21 aa, Entamoeba dispar
FTRVGKRYDVCLVSEHKGTVL

SEQ ID NO: 2482673 - protein, 18 aa, Entamoeba dispar
FTSDCLDILIDSELWDLR

SEQ ID NO: 2482674 - protein, 24 aa, Entamoeba dispar
FTSDFHLALFVLRLLLSKKNELKD

SEQ ID NO: 2482675 - protein, 19 aa, Entamoeba dispar
FTSEPSLWINPQFIQGLDA

SEQ ID NO: 2482676 - protein, 17 aa, Entamoeba dispar
FTSFNACCLLKNQIELM

SEQ ID NO: 2482677 - protein, 18 aa, Entamoeba dispar
FTSGNEFIFKSFKVTLID

SEQ ID NO: 2482678 - protein, 18 aa, Entamoeba dispar
FTSPFKIKAFREDFVYGF

SEQ ID NO: 2482679 - protein, 18 aa, Entamoeba dispar
FTSQHWIVRIYKVNKPNP

SEQ ID NO: 2482680 - protein, 23 aa, Entamoeba dispar
FTSSIPLVLCKSTIEFQQPKKKG

SEQ ID NO: 2482681 - protein, 20 aa, Entamoeba dispar
FTTLKIKFKNHLTSFHKAFY

SEQ ID NO: 2482682 - protein, 17 aa, Entamoeba dispar
FTTLPFDSSFFIGLLDL

SEQ ID NO: 2482683 - protein, 20 aa, Entamoeba dispar
FTTRLNNVFVIGKGTETLVN

SEQ ID NO: 2482684 - protein, 21 aa, Entamoeba dispar
FTTSCIFRNLYSQQKVVIFYC

SEQ ID NO: 2482685 - protein, 19 aa, Entamoeba dispar
FTTTITLSTSWREYHHLSS

SEQ ID NO: 2482686 - protein, 20 aa, Entamoeba dispar
FTVCIDWKSDSLIKYDQSIA

SEQ ID NO: 2482687 - protein, 18 aa, Entamoeba dispar
FTVEKVIVIWDRFISDPR

SEQ ID NO: 2482688 - protein, 17 aa, Entamoeba dispar
FTVKKKKYFKLLVILST

SEQ ID NO: 2482689 - protein, 17 aa, Entamoeba dispar
FTVKLPWEFTTSETPIK

SEQ ID NO: 2482690 - protein, 21 aa, Entamoeba dispar
FTVKYNKRYIGYIDIDLNLLP

SEQ ID NO: 2482691 - protein, 23 aa, Entamoeba dispar
FTVYCSKQPIGQHGIYQNDVNMK

SEQ ID NO: 2482692 - protein, 25 aa, Entamoeba dispar
FTVYNFVQGFGFDGFVFVDGRSHKE

SEQ ID NO: 2482693 - protein, 17 aa, Entamoeba dispar
FTYLKLFKEAIPKFKVI

SEQ ID NO: 2482694 - protein, 17 aa, Entamoeba dispar
FVACDKFGEDANTQICT

SEQ ID NO: 2482695 - protein, 20 aa, Entamoeba dispar
FVALAVRLYVKLMKKAGLEY

SEQ ID NO: 2482696 - protein, 26 aa, Entamoeba dispar
FVALKCGCVISKLALDEIKSINGHKC

SEQ ID NO: 2482697 - protein, 19 aa, Entamoeba dispar
FVALYARKFLQQELHPKLL

SEQ ID NO: 2482698 - protein, 17 aa, Entamoeba dispar
FVAQTAFSNLINTLKLM

SEQ ID NO: 2482699 - protein, 18 aa, Entamoeba dispar
FVARKEWIIVGSDDMMIR

SEQ ID NO: 2482700 - protein, 22 aa, Entamoeba dispar
FVCKNCKKPLGTNPFHNVENSP

SEQ ID NO: 2482701 - protein, 22 aa, Entamoeba dispar
FVCNLKPSKLRGIPSEAMILAA

SEQ ID NO: 2482702 - protein, 17 aa, Entamoeba dispar
FVCRENKTYIKIIDGKL

SEQ ID NO: 2482703 - protein, 24 aa, Entamoeba dispar
FVCTNCGAPIQGSYMIKNGKIVCK

SEQ ID NO: 2482704 - protein, 20 aa, Entamoeba dispar
FVDFESIRPLIPIIQSNTNS

SEQ ID NO: 2482705 - protein, 19 aa, Entamoeba dispar
FVDKVIFIYRFQKETLQRL

SEQ ID NO: 2482706 - protein, 22 aa, Entamoeba dispar
FVDLIFILYIKWERTNDDWVQL

SEQ ID NO: 2482707 - protein, 29 aa, Entamoeba dispar
FVDLNYGCFLCCACGRAHMLFPKVQNTSN

SEQ ID NO: 2482708 - protein, 18 aa, Entamoeba dispar
FVDNTIRIYRGEVSEMPK

SEQ ID NO: 2482709 - protein, 23 aa, Entamoeba dispar
FVDWLSKHYKEFGAHLEFVTDKS

SEQ ID NO: 2482710 - protein, 24 aa, Entamoeba dispar
FVDWNLPKTIRCCADIIQENETTR

SEQ ID NO: 2482711 - protein, 23 aa, Entamoeba dispar
FVDYDWDSLISISFNRINFSGVF

SEQ ID NO: 2482712 - protein, 19 aa, Entamoeba dispar
FVEELWGLCQMGEKSKDGI

SEQ ID NO: 2482713 - protein, 23 aa, Entamoeba dispar
FVEMCVPISVLKGFVVTNKKDED

SEQ ID NO: 2482714 - protein, 19 aa, Entamoeba dispar
FVFCSCSLDNLDYDVYIPE

SEQ ID NO: 2482715 - protein, 24 aa, Entamoeba dispar
FVFESKCWKEVIKKCVILHTQHRQ

SEQ ID NO: 2482716 - protein, 25 aa, Entamoeba dispar
FVFYDLKPLDRWTAIVPSQCMSEFN

SEQ ID NO: 2482717 - protein, 18 aa, Entamoeba dispar
FVGCCKAFKRKHDLKKHI

SEQ ID NO: 2482718 - protein, 25 aa, Entamoeba dispar
FVGKTSDVSYLWSLGIILLRFWLGY

SEQ ID NO: 2482719 - protein, 17 aa, Entamoeba dispar
FVGSEWPTTFSLSRLLC

SEQ ID NO: 2482720 - protein, 17 aa, Entamoeba dispar
FVHQLKIVVELWKKQEI

SEQ ID NO: 2482721 - protein, 17 aa, Entamoeba dispar
FVHSISLTSINIPSTIT

SEQ ID NO: 2482722 - protein, 33 aa, Entamoeba dispar
FVHVLHAWFHIKILRLFTDSVLHYGLPTKYDLI

SEQ ID NO: 2482723 - protein, 24 aa, Entamoeba dispar
FVIFPEHIVKIIAMQYILLIEALT

SEQ ID NO: 2482724 - protein, 20 aa, Entamoeba dispar
FVILMKGIVNFFREKLREAP

SEQ ID NO: 2482725 - protein, 18 aa, Entamoeba dispar
FVINFLFVKGCNDYFDSP

SEQ ID NO: 2482726 - protein, 21 aa, Entamoeba dispar
FVINLRPKFDANRFAIPTIIR

SEQ ID NO: 2482727 - protein, 20 aa, Entamoeba dispar
FVKACSQLIEGCEKESAVAL

SEQ ID NO: 2482728 - protein, 23 aa, Entamoeba dispar
FVKEVKKQPTLVLFPVSTIAQMR

SEQ ID NO: 2482729 - protein, 25 aa, Entamoeba dispar
FVKFECYQTFSARYRLSHFKCIRKA

SEQ ID NO: 2482730 - protein, 17 aa, Entamoeba dispar
FVKHVPKEFVFEDQEGF

SEQ ID NO: 2482731 - protein, 22 aa, Entamoeba dispar
FVKKLFHTMKEPSFLDWKLNVS

SEQ ID NO: 2482732 - protein, 23 aa, Entamoeba dispar
FVKMFKGSDLIIKGCEETLISLI

SEQ ID NO: 2482733 - protein, 19 aa, Entamoeba dispar
FVKRMGYILSNTVGVDLFH

SEQ ID NO: 2482734 - protein, 21 aa, Entamoeba dispar
FVKYQCVYHILDLLKSSNKSP

SEQ ID NO: 2482735 - protein, 27 aa, Entamoeba dispar
FVLCAFDGFFSFMCAAKNYAKTNSMKI

SEQ ID NO: 2482736 - protein, 28 aa, Entamoeba dispar
FVLDALSAYCRYLPPAGTLFQPLVASLL

SEQ ID NO: 2482737 - protein, 17 aa, Entamoeba dispar
FVLHYLHSILLSVTGCY

SEQ ID NO: 2482738 - protein, 25 aa, Entamoeba dispar
FVLLSENKRQCEFYIYGTKPNSIEK

SEQ ID NO: 2482739 - protein, 27 aa, Entamoeba dispar
FVLSECFSCCYIAGEIKCSSKIMKKLM

SEQ ID NO: 2482740 - protein, 18 aa, Entamoeba dispar
FVLTESMIYVFAGERGTP

SEQ ID NO: 2482741 - protein, 26 aa, Entamoeba dispar
FVLYSVDLKLVIALTIYLCKNNQTNT

SEQ ID NO: 2482742 - protein, 25 aa, Entamoeba dispar
FVMELCLGGSLAEHVAISPFSIPVA

SEQ ID NO: 2482743 - protein, 22 aa, Entamoeba dispar
FVMGESWVGVYVVNREKNEHYH

SEQ ID NO: 2482744 - protein, 25 aa, Entamoeba dispar
FVMNCKSQVIGLILFTDTRKNTTTI

SEQ ID NO: 2482745 - protein, 26 aa, Entamoeba dispar
FVNKRIIRKAIEFLINKGLLERVEKN

SEQ ID NO: 2482746 - protein, 23 aa, Entamoeba dispar
FVNSFQMNCCTFSSNTGIFQTLF

SEQ ID NO: 2482747 - protein, 18 aa, Entamoeba dispar
FVPAFGGRIKKGLYGFSI

SEQ ID NO: 2482748 - protein, 19 aa, Entamoeba dispar
FVPEMRRLISSSLDEKNKD

SEQ ID NO: 2482749 - protein, 17 aa, Entamoeba dispar
FVPGNMVSCLDFVESVF

SEQ ID NO: 2482750 - protein, 18 aa, Entamoeba dispar
FVPGVCIECGEAGVKGLI

SEQ ID NO: 2482751 - protein, 22 aa, Entamoeba dispar
FVPSRLIESFVIFHKSNYVFCV

SEQ ID NO: 2482752 - protein, 17 aa, Entamoeba dispar
FVQASVCMRDIKQELMD

SEQ ID NO: 2482753 - protein, 25 aa, Entamoeba dispar
FVQELLEKFLFVAIEDFSGTKGMLS

SEQ ID NO: 2482754 - protein, 24 aa, Entamoeba dispar
FVQFFPQYIAYTFFQIPEFRLELL

SEQ ID NO: 2482755 - protein, 17 aa, Entamoeba dispar
FVQKKCRNDTFPVICCG

SEQ ID NO: 2482756 - protein, 21 aa, Entamoeba dispar
FVQKQFICYEPDPKKLKDVIP

SEQ ID NO: 2482757 - protein, 18 aa, Entamoeba dispar
FVQSLVLHNCPIKRIDSF

SEQ ID NO: 2482758 - protein, 24 aa, Entamoeba dispar
FVQSPRYSPLGLHVQGSPTTSIYS

SEQ ID NO: 2482759 - protein, 30 aa, Entamoeba dispar
FVQVNKKCKRAICSLRYSQWYNEGSNKIFH

SEQ ID NO: 2482760 - protein, 23 aa, Entamoeba dispar
FVRAWSYKSGYYMKTTEKGTMFY

SEQ ID NO: 2482761 - protein, 24 aa, Entamoeba dispar
FVRAWSYKSGYYMKTTEKGTMFYY

SEQ ID NO: 2482762 - protein, 20 aa, Entamoeba dispar
FVRFNIATAVSKEQALPIMP

SEQ ID NO: 2482763 - protein, 18 aa, Entamoeba dispar
FVRINVGNFNKCITKLES

SEQ ID NO: 2482764 - protein, 21 aa, Entamoeba dispar
FVSACSITRLNIQDLKVFVNM

SEQ ID NO: 2482765 - protein, 22 aa, Entamoeba dispar
FVSEKCIRLWDAIIAYPKNKFH

SEQ ID NO: 2482766 - protein, 24 aa, Entamoeba dispar
FVSFKELHQLLSPQFSMVHTIGSA

SEQ ID NO: 2482767 - protein, 25 aa, Entamoeba dispar
FVSKEVVNMVCEIPRGTNAKMEIST

SEQ ID NO: 2482768 - protein, 19 aa, Entamoeba dispar
FVSKSMRIVDDMIVDMDVK

SEQ ID NO: 2482769 - protein, 23 aa, Entamoeba dispar
FVSMLRKKAFIYLYTEEGMEESE

SEQ ID NO: 2482770 - protein, 25 aa, Entamoeba dispar
FVSSEYTYVIGLKICSKFFEEPLSK

SEQ ID NO: 2482771 - protein, 20 aa, Entamoeba dispar
FVSVRPGARELLKNLVGKYE

SEQ ID NO: 2482772 - protein, 22 aa, Entamoeba dispar
FVTHCARYKAGIYGDVLNDPDV

SEQ ID NO: 2482773 - protein, 25 aa, Entamoeba dispar
FVTHKLKISVLMYMKLLMDNGIKGP

SEQ ID NO: 2482774 - protein, 24 aa, Entamoeba dispar
FVVEMGMKFSQRYTDSSLAGDTLF

SEQ ID NO: 2482775 - protein, 17 aa, Entamoeba dispar
FVVETYLALTFKSKNVK

SEQ ID NO: 2482776 - protein, 26 aa, Entamoeba dispar
FVVNEICMLCLPLIESVQGKLQLIDQ

SEQ ID NO: 2482777 - protein, 21 aa, Entamoeba dispar
FVYEPPPGYSVFIEQTTEQKE

SEQ ID NO: 2482778 - protein, 19 aa, Entamoeba dispar
FVYFDFIPIKMEPIFDLLS

SEQ ID NO: 2482779 - protein, 27 aa, Entamoeba dispar
FVYLISFLKKMICLGENEVLLITRFTP

SEQ ID NO: 2482780 - protein, 18 aa, Entamoeba dispar
FVYTLAGKPVFSRYGNDI

SEQ ID NO: 2482781 - protein, 26 aa, Entamoeba dispar
FVYVISIAPGELWKTLYSNLILFLNH

SEQ ID NO: 2482782 - protein, 18 aa, Entamoeba dispar
FWELKNRLPRSLTTLNWE

SEQ ID NO: 2482783 - protein, 25 aa, Entamoeba dispar
FWGDEWKNHIEILQQFWDKNVNEKD

SEQ ID NO: 2482784 - protein, 25 aa, Entamoeba dispar
FWLSQCPNGFCPNSIEGWKQDLCKC

SEQ ID NO: 2482785 - protein, 19 aa, Entamoeba dispar
FWPTEGFEYDDLTKGLSHL

SEQ ID NO: 2482786 - protein, 18 aa, Entamoeba dispar
FWQHLCIIWTNCYYHIPK

SEQ ID NO: 2482787 - protein, 23 aa, Entamoeba dispar
FWRVRLQIASSFSRVVQSVGESV

SEQ ID NO: 2482788 - protein, 19 aa, Entamoeba dispar
FWSRDRCGDSLEIKKYQGT

SEQ ID NO: 2482789 - protein, 18 aa, Entamoeba dispar
FYALEIIPSSSFGPCNVV

SEQ ID NO: 2482790 - protein, 26 aa, Entamoeba dispar
FYASWCGPCKMISPVFIELAQDYPLI

SEQ ID NO: 2482791 - protein, 18 aa, Entamoeba dispar
FYCLEDFTVYCSKQPIGQ

SEQ ID NO: 2482792 - protein, 19 aa, Entamoeba dispar
FYCTECGKKKRNASLIETS

SEQ ID NO: 2482793 - protein, 17 aa, Entamoeba dispar
FYDKYFKGELDDEMEEE

SEQ ID NO: 2482794 - protein, 17 aa, Entamoeba dispar
FYEAFGKNLKLGIHEDS

SEQ ID NO: 2482795 - protein, 27 aa, Entamoeba dispar
FYEIHLYNRFQIISSLPYKTNYHLKSN

SEQ ID NO: 2482796 - protein, 17 aa, Entamoeba dispar
FYEIKRPQDYYMSQVNV

SEQ ID NO: 2482797 - protein, 19 aa, Entamoeba dispar
FYEITDAFLTLLDNNHLTV

SEQ ID NO: 2482798 - protein, 28 aa, Entamoeba dispar
FYEKYLCVWDYAAASLIVKEAGGIIRTI

SEQ ID NO: 2482799 - protein, 20 aa, Entamoeba dispar
FYEMLSRDSGTLSIIDALYQ

SEQ ID NO: 2482800 - protein, 28 aa, Entamoeba dispar
FYERRLHRMEARMLKAFSEVEKKPRKPK

SEQ ID NO: 2482801 - protein, 17 aa, Entamoeba dispar
FYERRLHRMEARMMKAF

SEQ ID NO: 2482802 - protein, 25 aa, Entamoeba dispar
FYEYYPGKHLFPFCIPLKNFPHSIN

SEQ ID NO: 2482803 - protein, 19 aa, Entamoeba dispar
FYFQFNFIDTLNLFKNGSF

SEQ ID NO: 2482804 - protein, 25 aa, Entamoeba dispar
FYFQKCHGCALVFDRTSQESFDALQ

SEQ ID NO: 2482805 - protein, 24 aa, Entamoeba dispar
FYHPKIMNLIICCYSIIKKNEYEN

SEQ ID NO: 2482806 - protein, 20 aa, Entamoeba dispar
FYHQFILSRSPENVWFIVSE

SEQ ID NO: 2482807 - protein, 27 aa, Entamoeba dispar
FYHRLEWLCGFSGFTGEIVITQKRACL

SEQ ID NO: 2482808 - protein, 19 aa, Entamoeba dispar
FYINQGVKCSKGMEAKDQK

SEQ ID NO: 2482809 - protein, 17 aa, Entamoeba dispar
FYIPYGILDNSDPINSL

SEQ ID NO: 2482810 - protein, 18 aa, Entamoeba dispar
FYKACIDVPFMSILTEYI

SEQ ID NO: 2482811 - protein, 21 aa, Entamoeba dispar
FYKCNCFRDGDSMSNHLTDFL

SEQ ID NO: 2482812 - protein, 19 aa, Entamoeba dispar
FYKEVNFDKSYFVQIEYFC

SEQ ID NO: 2482813 - protein, 21 aa, Entamoeba dispar
FYKFFGERNLTGFGDTLQELM

SEQ ID NO: 2482814 - protein, 21 aa, Entamoeba dispar
FYKKDWDCFNSVDVEMTDKQM

SEQ ID NO: 2482815 - protein, 29 aa, Entamoeba dispar
FYKKHLDKLFEIINKYLLHQHPRVRNMAL

SEQ ID NO: 2482816 - protein, 20 aa, Entamoeba dispar
FYKLFKIIREYIIQQLNDLL

SEQ ID NO: 2482817 - protein, 17 aa, Entamoeba dispar
FYKLRGIGNLIKEIQMK

SEQ ID NO: 2482818 - protein, 26 aa, Entamoeba dispar
FYKWTKLNQCRLVFDSTIEYDPDEHE

SEQ ID NO: 2482819 - protein, 18 aa, Entamoeba dispar
FYLAEVLLALEYLHLNGI

SEQ ID NO: 2482820 - protein, 24 aa, Entamoeba dispar
FYMDAISLITSWQHKPWICCFCKQ

SEQ ID NO: 2482821 - protein, 20 aa, Entamoeba dispar
FYNDEFILALNRNDLNMAYH

SEQ ID NO: 2482822 - protein, 19 aa, Entamoeba dispar
FYNELTKLFIVLASQQNSK

SEQ ID NO: 2482823 - protein, 19 aa, Entamoeba dispar
FYNKIFTCFFKEQCNAKQI

SEQ ID NO: 2482824 - protein, 28 aa, Entamoeba dispar
FYNQFAITIRYAWISSQFVPSKKDKEDY

SEQ ID NO: 2482825 - protein, 18 aa, Entamoeba dispar
FYNQFVRYYFKNYLLDTF

SEQ ID NO: 2482826 - protein, 35 aa, Entamoeba dispar
FYNQRLFFFDVCQSFPRSSICFLNNKYLFQFSRLT

SEQ ID NO: 2482827 - protein, 24 aa, Entamoeba dispar
FYPKGGINPFCYINFNNPTTEQII

SEQ ID NO: 2482828 - protein, 17 aa, Entamoeba dispar
FYPLKFSLELRSVKNLK

SEQ ID NO: 2482829 - protein, 18 aa, Entamoeba dispar
FYPPFSMQGFAQLSQGQF

SEQ ID NO: 2482830 - protein, 24 aa, Entamoeba dispar
FYQELKHGKKLLVQKRTKGQSQNS

SEQ ID NO: 2482831 - protein, 17 aa, Entamoeba dispar
FYQKIRLVNYIIDDDGS

SEQ ID NO: 2482832 - protein, 21 aa, Entamoeba dispar
FYQKRINILTEEIFKLNQIIE

SEQ ID NO: 2482833 - protein, 18 aa, Entamoeba dispar
FYQLVAHRVMRILKKYFI

SEQ ID NO: 2482834 - protein, 23 aa, Entamoeba dispar
FYQSLKSLLMFSRLYPKNLKQYF

SEQ ID NO: 2482835 - protein, 18 aa, Entamoeba dispar
FYSCRSLKSIKIPKYVQF

SEQ ID NO: 2482836 - protein, 25 aa, Entamoeba dispar
FYSDSRPSLMLLNKMIQKWGITDSC

SEQ ID NO: 2482837 - protein, 22 aa, Entamoeba dispar
FYSGDGTLFFQGRVIDDIIFLT

SEQ ID NO: 2482838 - protein, 19 aa, Entamoeba dispar
FYSNINFLNNKEHVYFGFR

SEQ ID NO: 2482839 - protein, 17 aa, Entamoeba dispar
FYSPLLLENIDNVIIGS

SEQ ID NO: 2482840 - protein, 17 aa, Entamoeba dispar
FYSQFQYLFISQKDPLL

SEQ ID NO: 2482841 - protein, 18 aa, Entamoeba dispar
FYSQFQYLFISQKYPLLS

SEQ ID NO: 2482842 - protein, 18 aa, Entamoeba dispar
FYTLRLKIINGYPSSMNS

SEQ ID NO: 2482843 - protein, 21 aa, Entamoeba dispar
FYTSITRARFEEINIDLFKST

SEQ ID NO: 2482844 - protein, 24 aa, Entamoeba dispar
FYTSITRARFEEINIDLFKSTIGP

SEQ ID NO: 2482845 - protein, 24 aa, Entamoeba dispar
FYVNEGFPIIFVFIRNEEVVSMEI

SEQ ID NO: 2482846 - protein, 17 aa, Entamoeba dispar
FYYNSFNIIIGKQGAGK

SEQ ID NO: 2482847 - protein, 18 aa, Entamoeba dispar
GAAFKPLFNQAIQMHLKR

SEQ ID NO: 2482848 - protein, 25 aa, Entamoeba dispar
GAATQLSCVMIAFGTAMTMGNGVTG

SEQ ID NO: 2482849 - protein, 18 aa, Entamoeba dispar
GACIPYVNTYLRKIVEIN

SEQ ID NO: 2482850 - protein, 24 aa, Entamoeba dispar
GADENWPITGMKPFFEGLISAMQG

SEQ ID NO: 2482851 - protein, 28 aa, Entamoeba dispar
GADFHTWKKRWFVMKDQYIWYFPKNTGS

SEQ ID NO: 2482852 - protein, 23 aa, Entamoeba dispar
GADKCIRGGIALYHNYPCVVIAT

SEQ ID NO: 2482853 - protein, 20 aa, Entamoeba dispar
GADRKFLEKCCSVHSTNQHF

SEQ ID NO: 2482854 - protein, 21 aa, Entamoeba dispar
GADSFAPTWTKSGLRELRFLK

SEQ ID NO: 2482855 - protein, 20 aa, Entamoeba dispar
GAEGISIYKTKQAVIIGYFS

SEQ ID NO: 2482856 - protein, 18 aa, Entamoeba dispar
GAERACSRDGSIIDKQYI

SEQ ID NO: 2482857 - protein, 20 aa, Entamoeba dispar
GAFKNCAKVSHLILSTNITS

SEQ ID NO: 2482858 - protein, 18 aa, Entamoeba dispar
GAGNFGMVKVLLEFGKMN

SEQ ID NO: 2482859 - protein, 18 aa, Entamoeba dispar
GAIAEVITLLYRSRNKMV

SEQ ID NO: 2482860 - protein, 19 aa, Entamoeba dispar
GAIARPSYDLGESCDASKY

SEQ ID NO: 2482861 - protein, 22 aa, Entamoeba dispar
GAKRLANIYQWVVKREEFNWSE

SEQ ID NO: 2482862 - protein, 20 aa, Entamoeba dispar
GAKVRSGKVWSQYIDNTIVK

SEQ ID NO: 2482863 - protein, 23 aa, Entamoeba dispar
GALHGVCGNGWIKETQQQRNKYQ

SEQ ID NO: 2482864 - protein, 21 aa, Entamoeba dispar
GALKRGTEIVVCTPGRMIDIL

SEQ ID NO: 2482865 - protein, 17 aa, Entamoeba dispar
GALLEKAYDYFHKLPEP

SEQ ID NO: 2482866 - protein, 19 aa, Entamoeba dispar
GALNYYADIIFKQPAKKSI

SEQ ID NO: 2482867 - protein, 19 aa, Entamoeba dispar
GALQSIFAKYAIKIGEQYY

SEQ ID NO: 2482868 - protein, 22 aa, Entamoeba dispar
GALRTTAPYTLYFAAGTNAASG

SEQ ID NO: 2482869 - protein, 18 aa, Entamoeba dispar
GALSRKSNFYDLGGDSFV

SEQ ID NO: 2482870 - protein, 19 aa, Entamoeba dispar
GAMEIFIEWMYLQRSPLLE

SEQ ID NO: 2482871 - protein, 18 aa, Entamoeba dispar
GAMFNYYLDEHWKPLKHI

SEQ ID NO: 2482872 - protein, 23 aa, Entamoeba dispar
GAMFNYYLDEHWKPLKHILKKYQ

SEQ ID NO: 2482873 - protein, 34 aa, Entamoeba dispar
GAMLVDGICSIYCSKGIYHICGYYDSLHNIVCKE

SEQ ID NO: 2482874 - protein, 22 aa, Entamoeba dispar
GAPEMSLGFCIGKEGNVNLDQV

SEQ ID NO: 2482875 - protein, 19 aa, Entamoeba dispar
GAPYPKDIFPFPWNIAEFI

SEQ ID NO: 2482876 - protein, 25 aa, Entamoeba dispar
GAQLKAVCVEAGMIALRREALEIKH

SEQ ID NO: 2482877 - protein, 25 aa, Entamoeba dispar
GAQSPEVMAQFLIDNNFNILFTLGG

SEQ ID NO: 2482878 - protein, 20 aa, Entamoeba dispar
GAQSYPACNTQQPIPQFPNN

SEQ ID NO: 2482879 - protein, 18 aa, Entamoeba dispar
GASAKLVPFDGHSIFNGI

SEQ ID NO: 2482880 - protein, 18 aa, Entamoeba dispar
GASALAHLIKAKVIPDCV

SEQ ID NO: 2482881 - protein, 24 aa, Entamoeba dispar
GASNLSICFAPSVITSPDINPTLE

SEQ ID NO: 2482882 - protein, 19 aa, Entamoeba dispar
GASTLPILMTLVGYDIDTV

SEQ ID NO: 2482883 - protein, 23 aa, Entamoeba dispar
GATFKVRLTPLVNIMVHVKGSIP

SEQ ID NO: 2482884 - protein, 23 aa, Entamoeba dispar
GAVESFSFLLTHFDEMFCEIEKR

SEQ ID NO: 2482885 - protein, 20 aa, Entamoeba dispar
GAVGKTCLLVSYTTNAFPTE

SEQ ID NO: 2482886 - protein, 18 aa, Entamoeba dispar
GAVGRLCANYGINKLYIV

SEQ ID NO: 2482887 - protein, 28 aa, Entamoeba dispar
GAVICLNCGDTICEKCLEKGVCPSCNEE

SEQ ID NO: 2482888 - protein, 18 aa, Entamoeba dispar
GAYEQLQMNAKRAGVPFF

SEQ ID NO: 2482889 - protein, 17 aa, Entamoeba dispar
GAYFASSFIEFNKDIPN

SEQ ID NO: 2482890 - protein, 20 aa, Entamoeba dispar
GAYGCWLSYSYNGNAIFASY

SEQ ID NO: 2482891 - protein, 18 aa, Entamoeba dispar
GAYQMCIGRLVDIILSKM

SEQ ID NO: 2482892 - protein, 21 aa, Entamoeba dispar
GCAILSLREAFKMKEKGIDKT

SEQ ID NO: 2482893 - protein, 20 aa, Entamoeba dispar
GCDCSFHLQCACPPIASDKI

SEQ ID NO: 2482894 - protein, 21 aa, Entamoeba dispar
GCDFDMIWLSYNFGLYVVNCI

SEQ ID NO: 2482895 - protein, 21 aa, Entamoeba dispar
GCDVGVCYGDASVGRVFLGYL

SEQ ID NO: 2482896 - protein, 22 aa, Entamoeba dispar
GCFGESRISKSFIFPSSIKEIG

SEQ ID NO: 2482897 - protein, 23 aa, Entamoeba dispar
GCFNGCNQLSCIILPKTIASIQE

SEQ ID NO: 2482898 - protein, 24 aa, Entamoeba dispar
GCFRCSVCGCRLDGYLIKNHDLCC

SEQ ID NO: 2482899 - protein, 17 aa, Entamoeba dispar
GCFYGCGCVEELKKNET

SEQ ID NO: 2482900 - protein, 17 aa, Entamoeba dispar
GCFYGCSSLTSITVPSP

SEQ ID NO: 2482901 - protein, 20 aa, Entamoeba dispar
GCGEKARKQGIRYTIGEKMK

SEQ ID NO: 2482902 - protein, 17 aa, Entamoeba dispar
GCGICKNGYYRNGKGCS

SEQ ID NO: 2482903 - protein, 19 aa, Entamoeba dispar
GCGKTMIARAIANETGAFF

SEQ ID NO: 2482904 - protein, 17 aa, Entamoeba dispar
GCGLKTVKYYKIYYSLR

SEQ ID NO: 2482905 - protein, 20 aa, Entamoeba dispar
GCGNEGYNSQILIQKALDDW

SEQ ID NO: 2482906 - protein, 21 aa, Entamoeba dispar
GCGSLKVKTREGAETIIKKVD

SEQ ID NO: 2482907 - protein, 21 aa, Entamoeba dispar
GCHEGCWCWKHANQLENEGYK

SEQ ID NO: 2482908 - protein, 17 aa, Entamoeba dispar
GCIEIITFILIDYPHIY

SEQ ID NO: 2482909 - protein, 19 aa, Entamoeba dispar
GCIFAEMARGEILFAGNDS

SEQ ID NO: 2482910 - protein, 18 aa, Entamoeba dispar
GCIKNAWCKDMKIPKEDI

SEQ ID NO: 2482911 - protein, 18 aa, Entamoeba dispar
GCLECTRRECTKCNKGYE

SEQ ID NO: 2482912 - protein, 19 aa, Entamoeba dispar
GCNFTCQFCQNWDISQCTL

SEQ ID NO: 2482913 - protein, 17 aa, Entamoeba dispar
GCNKLSVIEFPSSLHHI

SEQ ID NO: 2482914 - protein, 17 aa, Entamoeba dispar
GCNPDIIGILSKDNKTI

SEQ ID NO: 2482915 - protein, 24 aa, Entamoeba dispar
GCNVSRVLMGWGVQNITFVDNGII

SEQ ID NO: 2482916 - protein, 19 aa, Entamoeba dispar
GCQKFMILYQLNSGELFGT

SEQ ID NO: 2482917 - protein, 20 aa, Entamoeba dispar
GCQLLKNFIESSVTFSDITE

SEQ ID NO: 2482918 - protein, 19 aa, Entamoeba dispar
GCQQPEYNTQQPIPQQPIQ

SEQ ID NO: 2482919 - protein, 24 aa, Entamoeba dispar
GCQYCPPQNSFMVFEINGTFWYFT

SEQ ID NO: 2482920 - protein, 23 aa, Entamoeba dispar
GCQYHGIVPYFFLVERKAVIQYA

SEQ ID NO: 2482921 - protein, 25 aa, Entamoeba dispar
GCSCISSGRCTVCGCSCSEHKRVSY

SEQ ID NO: 2482922 - protein, 20 aa, Entamoeba dispar
GCSDSSIRLYDFKKTQIVNG

SEQ ID NO: 2482923 - protein, 19 aa, Entamoeba dispar
GCTPNIFSFDEDLQFEQHQ

SEQ ID NO: 2482924 - protein, 26 aa, Entamoeba dispar
GCTSLQRIQLPLGIDIIEDESFMNCI

SEQ ID NO: 2482925 - protein, 18 aa, Entamoeba dispar
GCVCEMSSLVTLNVSGND

SEQ ID NO: 2482926 - protein, 21 aa, Entamoeba dispar
GCVGASFGGYSVYWLAGHHQK

SEQ ID NO: 2482927 - protein, 19 aa, Entamoeba dispar
GCVGIKRKPNEPVLETKRK

SEQ ID NO: 2482928 - protein, 22 aa, Entamoeba dispar
GCVIRCGISLELERKTKNDEEG

SEQ ID NO: 2482929 - protein, 19 aa, Entamoeba dispar
GCVMGKDSFSTAFLPMILN

SEQ ID NO: 2482930 - protein, 26 aa, Entamoeba dispar
GCYENVMMIGCGFSDKTIIYEYGKEI

SEQ ID NO: 2482931 - protein, 18 aa, Entamoeba dispar
GCYLSNFVQIPYYYNLNL

SEQ ID NO: 2482932 - protein, 24 aa, Entamoeba dispar
GCYSSKLRSPMSLRDNDFDVRDDN

SEQ ID NO: 2482933 - protein, 25 aa, Entamoeba dispar
GCYVNSCIQLLFSMKSFVSYLSFNS

SEQ ID NO: 2482934 - protein, 21 aa, Entamoeba dispar
GDAAISIAVVHHFSTFERRVA

SEQ ID NO: 2482935 - protein, 22 aa, Entamoeba dispar
GDALSGDFCKGLFSFLNEQENF

SEQ ID NO: 2482936 - protein, 20 aa, Entamoeba dispar
GDALVKCIELMAPLAEYTLL

SEQ ID NO: 2482937 - protein, 18 aa, Entamoeba dispar
GDCDKSWRRQIISNEENG

SEQ ID NO: 2482938 - protein, 17 aa, Entamoeba dispar
GDCGVAVGMHSFGASAP

SEQ ID NO: 2482939 - protein, 26 aa, Entamoeba dispar
GDCLKELSLLCGLSLSHMLCADAPGS

SEQ ID NO: 2482940 - protein, 19 aa, Entamoeba dispar
GDDCFDWCLSLTSMNIDNI

SEQ ID NO: 2482941 - protein, 20 aa, Entamoeba dispar
GDDKALIVLLTFINSVGLML

SEQ ID NO: 2482942 - protein, 22 aa, Entamoeba dispar
GDDVSPFGMLIIFKTSFRSSFC

SEQ ID NO: 2482943 - protein, 20 aa, Entamoeba dispar
GDECFKNCVSLTHINIPTSI

SEQ ID NO: 2482944 - protein, 17 aa, Entamoeba dispar
GDEIILCSDGIWDVTTP

SEQ ID NO: 2482945 - protein, 17 aa, Entamoeba dispar
GDEKASIAWDIRTGKML

SEQ ID NO: 2482946 - protein, 26 aa, Entamoeba dispar
GDEKCGKTSLTRRFIGEEFKEEVEPF

SEQ ID NO: 2482947 - protein, 23 aa, Entamoeba dispar
GDEKQIIALLGFLMKKEKSTIRK

SEQ ID NO: 2482948 - protein, 17 aa, Entamoeba dispar
GDELIKIPMFYVDSCPD

SEQ ID NO: 2482949 - protein, 17 aa, Entamoeba dispar
GDESINLNQRIKLIDIV

SEQ ID NO: 2482950 - protein, 20 aa, Entamoeba dispar
GDEVINVFHKYAIIKRLRRK

SEQ ID NO: 2482951 - protein, 37 aa, Entamoeba dispar
GDFAIIEFGKKMKFKWYKLKIPSFITSACVLKKMLHV

SEQ ID NO: 2482952 - protein, 17 aa, Entamoeba dispar
GDFCFDRCISLTTINIP

SEQ ID NO: 2482953 - protein, 17 aa, Entamoeba dispar
GDFKKPPTFEVLNENNI

SEQ ID NO: 2482954 - protein, 22 aa, Entamoeba dispar
GDFNSSCLIYSILSIFCSDVRN

SEQ ID NO: 2482955 - protein, 17 aa, Entamoeba dispar
GDFRKVFEVGPVFRAEN

SEQ ID NO: 2482956 - protein, 24 aa, Entamoeba dispar
GDFSRLIKDISLINEKCKILTGGC

SEQ ID NO: 2482957 - protein, 21 aa, Entamoeba dispar
GDGCFYKCSSLEYINIPTTIT

SEQ ID NO: 2482958 - protein, 20 aa, Entamoeba dispar
GDGILHSVNYFDILRSVQPP

SEQ ID NO: 2482959 - protein, 21 aa, Entamoeba dispar
GDGKFCLGGIVEPLKATEKEV

SEQ ID NO: 2482960 - protein, 22 aa, Entamoeba dispar
GDGKGARPLCCVKEIVKKQMTL

SEQ ID NO: 2482961 - protein, 20 aa, Entamoeba dispar
GDGKSSLGNFILKKDVFSVS

SEQ ID NO: 2482962 - protein, 19 aa, Entamoeba dispar
GDGKSSLGNFILKKKSNGF

SEQ ID NO: 2482963 - protein, 20 aa, Entamoeba dispar
GDGKSSLGNFILKKNAFAVG

SEQ ID NO: 2482964 - protein, 20 aa, Entamoeba dispar
GDGKSSLGNFILKKNAFKVS

SEQ ID NO: 2482965 - protein, 20 aa, Entamoeba dispar
GDGKSSLGNFILKKNVFKVS

SEQ ID NO: 2482966 - protein, 21 aa, Entamoeba dispar
GDGKSSLGNFILKNDVFKVSD

SEQ ID NO: 2482967 - protein, 21 aa, Entamoeba dispar
GDGKSSLGNFVLKNDVFKVSD

SEQ ID NO: 2482968 - protein, 20 aa, Entamoeba dispar
GDGKSSLGNYILKKRVFGER

SEQ ID NO: 2482969 - protein, 24 aa, Entamoeba dispar
GDGLVCGRYLSLFGYEVTIYYPKQ

SEQ ID NO: 2482970 - protein, 17 aa, Entamoeba dispar
GDGSLRMFDLRSLEHST

SEQ ID NO: 2482971 - protein, 18 aa, Entamoeba dispar
GDGTVGWVMNELRKAELK

SEQ ID NO: 2482972 - protein, 18 aa, Entamoeba dispar
GDGYELSDSILLDGPMII

SEQ ID NO: 2482973 - protein, 25 aa, Entamoeba dispar
GDHCIAFALNCWDVLVHKLEMKKEP

SEQ ID NO: 2482974 - protein, 23 aa, Entamoeba dispar
GDHFKIAEIIKMRIYHSQTKEDK

SEQ ID NO: 2482975 - protein, 20 aa, Entamoeba dispar
GDIHIFDIINSYPLNITPYE

SEQ ID NO: 2482976 - protein, 25 aa, Entamoeba dispar
GDIHLKFIYQPFLHWPDTMITLIEE

SEQ ID NO: 2482977 - protein, 17 aa, Entamoeba dispar
GDIKIMIDETGIGKREI

SEQ ID NO: 2482978 - protein, 30 aa, Entamoeba dispar
GDIKKGCACIGAKECCEVCGCHYTEHANST

SEQ ID NO: 2482979 - protein, 25 aa, Entamoeba dispar
GDIKWKEGCLNKIRKAIKIITDQTK

SEQ ID NO: 2482980 - protein, 17 aa, Entamoeba dispar
GDILSMLPLIKTPSALP

SEQ ID NO: 2482981 - protein, 23 aa, Entamoeba dispar
GDIPLEVFNCVIVKHIDIIDLIF

SEQ ID NO: 2482982 - protein, 18 aa, Entamoeba dispar
GDISAIIKYITKKGNGMS

SEQ ID NO: 2482983 - protein, 18 aa, Entamoeba dispar
GDITSTYSLFSFGVQMFD

SEQ ID NO: 2482984 - protein, 18 aa, Entamoeba dispar
GDITSTYSLFSFSIQMFD

SEQ ID NO: 2482985 - protein, 26 aa, Entamoeba dispar
GDKCVKEYLKGNAFLYDEIDIRQDEQ

SEQ ID NO: 2482986 - protein, 27 aa, Entamoeba dispar
GDKGEWSTKCVLAYCDSGYKFDYNKNK

SEQ ID NO: 2482987 - protein, 17 aa, Entamoeba dispar
GDKISEQIAFAVLEGTV

SEQ ID NO: 2482988 - protein, 20 aa, Entamoeba dispar
GDKVGKAPYEVCVGEGVDNQ

SEQ ID NO: 2482989 - protein, 24 aa, Entamoeba dispar
GDKVGKAPYEVCVGEGVDNQKSGV

SEQ ID NO: 2482990 - protein, 18 aa, Entamoeba dispar
GDLAKTAKRQRIISKEYP

SEQ ID NO: 2482991 - protein, 19 aa, Entamoeba dispar
GDLEIESYILLLVVIACLD

SEQ ID NO: 2482992 - protein, 17 aa, Entamoeba dispar
GDLHWFKVPPKVFFEPF

SEQ ID NO: 2482993 - protein, 23 aa, Entamoeba dispar
GDLKMKFETLFDFSEQIAKGLEY

SEQ ID NO: 2482994 - protein, 17 aa, Entamoeba dispar
GDLLKRFIEAKMETNPV

SEQ ID NO: 2482995 - protein, 19 aa, Entamoeba dispar
GDLNSCRKIGESLSLEDIG

SEQ ID NO: 2482996 - protein, 19 aa, Entamoeba dispar
GDLSQVCLYDIRKISENQN

SEQ ID NO: 2482997 - protein, 27 aa, Entamoeba dispar
GDLSRFIKKRMGDLISEDLVWNIFLQI

SEQ ID NO: 2482998 - protein, 17 aa, Entamoeba dispar
GDMFLTMHSNMYYNVVI

SEQ ID NO: 2482999 - protein, 17 aa, Entamoeba dispar
GDMGQLFYWLLVGENEK

SEQ ID NO: 2483000 - protein, 20 aa, Entamoeba dispar
GDMQTLRCESDLVYLKVPPK

SEQ ID NO: 2483001 - protein, 18 aa, Entamoeba dispar
GDMSQFAIDFIKEIIYKY

SEQ ID NO: 2483002 - protein, 17 aa, Entamoeba dispar
GDMYEVAERGANLSGGQ

SEQ ID NO: 2483003 - protein, 17 aa, Entamoeba dispar
GDNASCQMLVNFISNPK

SEQ ID NO: 2483004 - protein, 20 aa, Entamoeba dispar
GDNCFRGCSSLTSINIPSST

SEQ ID NO: 2483005 - protein, 25 aa, Entamoeba dispar
GDNDKTQCLSIWKGLENKNNQIVNS

SEQ ID NO: 2483006 - protein, 26 aa, Entamoeba dispar
GDNGEWSTKCVLSYCDEGYKFDYNNN

SEQ ID NO: 2483007 - protein, 27 aa, Entamoeba dispar
GDNRAHRRGVSFGKFGNSGLFGKHDSN

SEQ ID NO: 2483008 - protein, 18 aa, Entamoeba dispar
GDNVVGLLSGHRSFGEIF

SEQ ID NO: 2483009 - protein, 23 aa, Entamoeba dispar
GDPKRGLASIALKTLIQIIKNIK

SEQ ID NO: 2483010 - protein, 27 aa, Entamoeba dispar
GDPVADAYGFYRCRNFLIYSVNDGCGW

SEQ ID NO: 2483011 - protein, 25 aa, Entamoeba dispar
GDPYPLYLKHVFNIEQQRMNRLAMY

SEQ ID NO: 2483012 - protein, 29 aa, Entamoeba dispar
GDQFYLYEPMLAYHCYEFGSQSKMQNDIV

SEQ ID NO: 2483013 - protein, 17 aa, Entamoeba dispar
GDRCFKYCTLLTSITIS

SEQ ID NO: 2483014 - protein, 33 aa, Entamoeba dispar
GDRLGINTLKLFKICYNSTTFNNYRDWLLQYIK

SEQ ID NO: 2483015 - protein, 25 aa, Entamoeba dispar
GDRLIGRIKFELFREVCPKTVENFR

SEQ ID NO: 2483016 - protein, 18 aa, Entamoeba dispar
GDSCFCKCSSLQSINIPS

SEQ ID NO: 2483017 - protein, 18 aa, Entamoeba dispar
GDSCFFECVSLEYFSVPS

SEQ ID NO: 2483018 - protein, 17 aa, Entamoeba dispar
GDSCTRNHFQPEISRTI

SEQ ID NO: 2483019 - protein, 36 aa, Entamoeba dispar
GDSIISFLMKYKFAELALLFVRDVHAKFAIALQCGN

SEQ ID NO: 2483020 - protein, 17 aa, Entamoeba dispar
GDSIMTIKVFDLSKKNF

SEQ ID NO: 2483021 - protein, 20 aa, Entamoeba dispar
GDSPILICTLICDKEANVVI

SEQ ID NO: 2483022 - protein, 19 aa, Entamoeba dispar
GDSPLHYAVNIALNNIEAG

SEQ ID NO: 2483023 - protein, 17 aa, Entamoeba dispar
GDSYLAIDVIVMSLMEE

SEQ ID NO: 2483024 - protein, 19 aa, Entamoeba dispar
GDTHYLLYIIDQLRNECID

SEQ ID NO: 2483025 - protein, 17 aa, Entamoeba dispar
GDVIGCGYIHQLNCPFY

SEQ ID NO: 2483026 - protein, 24 aa, Entamoeba dispar
GDVKCKTFVSCIPEFSEVPRRVSD

SEQ ID NO: 2483027 - protein, 30 aa, Entamoeba dispar
GDVLRKMCKNELLKDCALLILGNKKDIKGA

SEQ ID NO: 2483028 - protein, 36 aa, Entamoeba dispar
GDVRRNSEYMKWLKKRVVDLMAVFPSYMRIKRFIIV

SEQ ID NO: 2483029 - protein, 27 aa, Entamoeba dispar
GDVSAIIKYITKKGVGMFKGDPSNKED

SEQ ID NO: 2483030 - protein, 19 aa, Entamoeba dispar
GDVYYEVVFNLVIFSPFQG

SEQ ID NO: 2483031 - protein, 21 aa, Entamoeba dispar
GDYCFYGCTSLESINIPSSVS

SEQ ID NO: 2483032 - protein, 19 aa, Entamoeba dispar
GDYCFYKCTSLTNITIPST

SEQ ID NO: 2483033 - protein, 28 aa, Entamoeba dispar
GDYHLKLCFCPFCQSGIKSMGLDKKDNK

SEQ ID NO: 2483034 - protein, 29 aa, Entamoeba dispar
GDYLPFRPGSFDGCISISAIQWLCQADKK

SEQ ID NO: 2483035 - protein, 24 aa, Entamoeba dispar
GDYNWAVTVLNHLVFYNPQNLRAR

SEQ ID NO: 2483036 - protein, 28 aa, Entamoeba dispar
GDYQFGKTKIFFRVGILAEIEEVREAKI

SEQ ID NO: 2483037 - protein, 17 aa, Entamoeba dispar
GDYRRSFSIVEAVHDAE

SEQ ID NO: 2483038 - protein, 34 aa, Entamoeba dispar
GDYSAEVLFYLLAHKICYPERVFMLRGNHETRLM

SEQ ID NO: 2483039 - protein, 18 aa, Entamoeba dispar
GDYYRYFAEFTVDEKRKE

SEQ ID NO: 2483040 - protein, 19 aa, Entamoeba dispar
GEACEFKLTVTPLCSSKLN

SEQ ID NO: 2483041 - protein, 17 aa, Entamoeba dispar
GEAENAFELFLSTTEIK

SEQ ID NO: 2483042 - protein, 23 aa, Entamoeba dispar
GEAHGGYSYCAVAALALLGRIDE

SEQ ID NO: 2483043 - protein, 27 aa, Entamoeba dispar
GEAIKKPKLRAVMSILKGDVKNIINYF

SEQ ID NO: 2483044 - protein, 25 aa, Entamoeba dispar
GEAKIKVPEMMTGEYWHDCLSISKR

SEQ ID NO: 2483045 - protein, 20 aa, Entamoeba dispar
GEALKSLSTPFGYIYRSQKP

SEQ ID NO: 2483046 - protein, 17 aa, Entamoeba dispar
GEALSCMTYVSKVTIIS

SEQ ID NO: 2483047 - protein, 30 aa, Entamoeba dispar
GEARITFSLFPKLIICRGFGMYTLNILTKE

SEQ ID NO: 2483048 - protein, 22 aa, Entamoeba dispar
GEAVMFPFGFHCTGMPIKACAD

SEQ ID NO: 2483049 - protein, 17 aa, Entamoeba dispar
GEAYYMLGECSLNGDGV

SEQ ID NO: 2483050 - protein, 17 aa, Entamoeba dispar
GECCIKNGTIYGYLFFN

SEQ ID NO: 2483051 - protein, 24 aa, Entamoeba dispar
GECGKRGGMFACTNIPEFARLMMY

SEQ ID NO: 2483052 - protein, 18 aa, Entamoeba dispar
GECKAYVSFINKLPDSQR

SEQ ID NO: 2483053 - protein, 24 aa, Entamoeba dispar
GECVGNSFKSCLVKNKITDEGDEK

SEQ ID NO: 2483054 - protein, 17 aa, Entamoeba dispar
GEDALILTHNFTSDTLI

SEQ ID NO: 2483055 - protein, 18 aa, Entamoeba dispar
GEDGFKWNGKTFNTTDRL

SEQ ID NO: 2483056 - protein, 29 aa, Entamoeba dispar
GEDKKVVILCFKEFVGALLELKNNESPTQ

SEQ ID NO: 2483057 - protein, 22 aa, Entamoeba dispar
GEDPLKLDYWIKGKKKNTKKEF

SEQ ID NO: 2483058 - protein, 25 aa, Entamoeba dispar
GEDVLLTCRWFFYIREKDSSISSSF

SEQ ID NO: 2483059 - protein, 22 aa, Entamoeba dispar
GEDVNPIFIRQMVNNIKKKINS

SEQ ID NO: 2483060 - protein, 18 aa, Entamoeba dispar
GEEEVWEVLNDVVQPIIA

SEQ ID NO: 2483061 - protein, 22 aa, Entamoeba dispar
GEEIISKLLSIYLIKKNNSSIY

SEQ ID NO: 2483062 - protein, 22 aa, Entamoeba dispar
GEEIPPLLLVCIDTIKEHANDM

SEQ ID NO: 2483063 - protein, 23 aa, Entamoeba dispar
GEEKDEWEIEDWMLMNEDDERNA

SEQ ID NO: 2483064 - protein, 17 aa, Entamoeba dispar
GEELMKAIVNEGIPEPK

SEQ ID NO: 2483065 - protein, 20 aa, Entamoeba dispar
GEELPCKQICEILFNKFTGR

SEQ ID NO: 2483066 - protein, 20 aa, Entamoeba dispar
GEEPFKYDVYHFKTKEEIKE

SEQ ID NO: 2483067 - protein, 17 aa, Entamoeba dispar
GEERIQYGLSIAEDKME

SEQ ID NO: 2483068 - protein, 29 aa, Entamoeba dispar
GEESVKLFCPRCGDLYIPMPPYDSHIDGA

SEQ ID NO: 2483069 - protein, 20 aa, Entamoeba dispar
GEEYLDCKNFYYKGTEIIIS

SEQ ID NO: 2483070 - protein, 25 aa, Entamoeba dispar
GEEYTLVCAVYFILKYCGKKGNVCK

SEQ ID NO: 2483071 - protein, 25 aa, Entamoeba dispar
GEFAHKPGIVYRDFEEIKKEIENET

SEQ ID NO: 2483072 - protein, 26 aa, Entamoeba dispar
GEFKWLPKHQSYFLSVVKGFSFQLVV

SEQ ID NO: 2483073 - protein, 20 aa, Entamoeba dispar
GEGAFGMVFEGSYRGQKVAV

SEQ ID NO: 2483074 - protein, 21 aa, Entamoeba dispar
GEGDAAWVVLVKCEKKDGTPD

SEQ ID NO: 2483075 - protein, 20 aa, Entamoeba dispar
GEGDCSLLLRHFKWNVNKMN

SEQ ID NO: 2483076 - protein, 23 aa, Entamoeba dispar
GEGGLPYIFSVMGIYLASQGIDS

SEQ ID NO: 2483077 - protein, 17 aa, Entamoeba dispar
GEGIKELYEHIMKMLFE

SEQ ID NO: 2483078 - protein, 21 aa, Entamoeba dispar
GEGIPDLVAVLIAMTQRLMLE

SEQ ID NO: 2483079 - protein, 20 aa, Entamoeba dispar
GEGKLKMAKDIVGQNCYCVG

SEQ ID NO: 2483080 - protein, 21 aa, Entamoeba dispar
GEGKLKMAKDIVGQNCYCVGM

SEQ ID NO: 2483081 - protein, 25 aa, Entamoeba dispar
GEGKRAGVYGAFLLACRDEDSGDFE

SEQ ID NO: 2483082 - protein, 21 aa, Entamoeba dispar
GEGLQAIVVVLNFNEDRFQKI

SEQ ID NO: 2483083 - protein, 19 aa, Entamoeba dispar
GEGMSGVVFHCYETSTNKE

SEQ ID NO: 2483084 - protein, 17 aa, Entamoeba dispar
GEGPIGIVFAPIRELAE

SEQ ID NO: 2483085 - protein, 25 aa, Entamoeba dispar
GEGSVGKSALCLQFVREVFSVEYSP

SEQ ID NO: 2483086 - protein, 23 aa, Entamoeba dispar
GEHPSRILCVFNILSQYDPKELL

SEQ ID NO: 2483087 - protein, 17 aa, Entamoeba dispar
GEIAKLTLCVSADTNKL

SEQ ID NO: 2483088 - protein, 19 aa, Entamoeba dispar
GEIDINEYLGIIVTEDNEH

SEQ ID NO: 2483089 - protein, 33 aa, Entamoeba dispar
GEIDKAVEFCIKTKRFADALIMTENNKEIHSKV

SEQ ID NO: 2483090 - protein, 17 aa, Entamoeba dispar
GEIEFENLPATWVAFFK

SEQ ID NO: 2483091 - protein, 21 aa, Entamoeba dispar
GEIEGGIPFLALSDLTGMPVK

SEQ ID NO: 2483092 - protein, 24 aa, Entamoeba dispar
GEIERARQIYLFGIDNIKEENKKI

SEQ ID NO: 2483093 - protein, 18 aa, Entamoeba dispar
GEIGCIDYVIKHSYSTDT

SEQ ID NO: 2483094 - protein, 18 aa, Entamoeba dispar
GEIIRYSQLPSFYEDGSL

SEQ ID NO: 2483095 - protein, 17 aa, Entamoeba dispar
GEIKAIIIGESSVGKTS

SEQ ID NO: 2483096 - protein, 19 aa, Entamoeba dispar
GEIKECFRNLQSRSITCLN

SEQ ID NO: 2483097 - protein, 20 aa, Entamoeba dispar
GEIKRLKTGQSFDENEEDQL

SEQ ID NO: 2483098 - protein, 21 aa, Entamoeba dispar
GEIKRTLKLRNCYGEIKKVCC

SEQ ID NO: 2483099 - protein, 24 aa, Entamoeba dispar
GEIKVLRINGKIVSIIDNKNEKQK

SEQ ID NO: 2483100 - protein, 17 aa, Entamoeba dispar
GEILCIMGESFTTNFVQ

SEQ ID NO: 2483101 - protein, 19 aa, Entamoeba dispar
GEIPWPSIIKKIYDQRTVI

SEQ ID NO: 2483102 - protein, 31 aa, Entamoeba dispar
GEISKDWKMCILCTDILIIARPFAFGKKTAK

SEQ ID NO: 2483103 - protein, 18 aa, Entamoeba dispar
GEIVVLLIHQWIENGGTG

SEQ ID NO: 2483104 - protein, 21 aa, Entamoeba dispar
GEIWLGFYSQLIISFILTIDE

SEQ ID NO: 2483105 - protein, 21 aa, Entamoeba dispar
GEKAVSFKGLMYNAVQDGLSI

SEQ ID NO: 2483106 - protein, 25 aa, Entamoeba dispar
GEKINAKLGEVWRAMSKEEKQPFFD

SEQ ID NO: 2483107 - protein, 20 aa, Entamoeba dispar
GEKLPVLIVLKDERTKTSII

SEQ ID NO: 2483108 - protein, 27 aa, Entamoeba dispar
GEKRCCKRIKLLLAQYYIDIQNNEQAK

SEQ ID NO: 2483109 - protein, 37 aa, Entamoeba dispar
GEKSLSMSCSDKILKWEVLGIQGGILANHFEMIIPSL

SEQ ID NO: 2483110 - protein, 20 aa, Entamoeba dispar
GEKSMCCIESTYLTEESHLL

SEQ ID NO: 2483111 - protein, 18 aa, Entamoeba dispar
GEKTLSSLALIFALHHYK

SEQ ID NO: 2483112 - protein, 17 aa, Entamoeba dispar
GEKVIEKAIKFGYHVNI

SEQ ID NO: 2483113 - protein, 18 aa, Entamoeba dispar
GEKVIVFDVGGMRVLSGH

SEQ ID NO: 2483114 - protein, 21 aa, Entamoeba dispar
GEKYKVECPFCDGNKENIKEM

SEQ ID NO: 2483115 - protein, 20 aa, Entamoeba dispar
GELEDIRIEWESKRIEKTYP

SEQ ID NO: 2483116 - protein, 25 aa, Entamoeba dispar
GELHKYDSALCLEEMLLQAVLFNDI

SEQ ID NO: 2483117 - protein, 17 aa, Entamoeba dispar
GELIKAKKQVLIDLKKL

SEQ ID NO: 2483118 - protein, 18 aa, Entamoeba dispar
GELILRKLNDTVLTLNKD

SEQ ID NO: 2483119 - protein, 31 aa, Entamoeba dispar
GELKIKDEVFRKFICCGPMYFIENVNTPPSK

SEQ ID NO: 2483120 - protein, 17 aa, Entamoeba dispar
GELKIVITQSEEFAIDQ

SEQ ID NO: 2483121 - protein, 22 aa, Entamoeba dispar
GELKTKACGLLKETVTQDRFSG

SEQ ID NO: 2483122 - protein, 26 aa, Entamoeba dispar
GELLETGNDIIFFWVARMVMMSLELM

SEQ ID NO: 2483123 - protein, 18 aa, Entamoeba dispar
GELLVTCDDKGYLANVFR

SEQ ID NO: 2483124 - protein, 18 aa, Entamoeba dispar
GELPEIPKIFFTATTFKE

SEQ ID NO: 2483125 - protein, 23 aa, Entamoeba dispar
GELPMLGANFVKNIQFLKMAATY

SEQ ID NO: 2483126 - protein, 18 aa, Entamoeba dispar
GELQKLYLNIQPLEENLR

SEQ ID NO: 2483127 - protein, 17 aa, Entamoeba dispar
GELQLSVEIKKKLINEI

SEQ ID NO: 2483128 - protein, 20 aa, Entamoeba dispar
GELRKDLFLFELEKIEKNEY

SEQ ID NO: 2483129 - protein, 23 aa, Entamoeba dispar
GELRQHMAALYFANPEEIKLSEK

SEQ ID NO: 2483130 - protein, 17 aa, Entamoeba dispar
GELRSEYERLEIMKNEI

SEQ ID NO: 2483131 - protein, 28 aa, Entamoeba dispar
GELSELEFAGACVCRQLINPIAEFVHIC

SEQ ID NO: 2483132 - protein, 20 aa, Entamoeba dispar
GELSGCPVVEAFNPAEKTTR

SEQ ID NO: 2483133 - protein, 22 aa, Entamoeba dispar
GELSKKCCLFLSSPQKQEFITS

SEQ ID NO: 2483134 - protein, 25 aa, Entamoeba dispar
GELSKRNKQTFSFGVLNILKYLTKQ

SEQ ID NO: 2483135 - protein, 21 aa, Entamoeba dispar
GELTFEQFQLFMIVYERSLNP

SEQ ID NO: 2483136 - protein, 20 aa, Entamoeba dispar
GELTIHRIIHQFNLTVKREE

SEQ ID NO: 2483137 - protein, 19 aa, Entamoeba dispar
GELVETYYILIIKLMTKCT

SEQ ID NO: 2483138 - protein, 19 aa, Entamoeba dispar
GEMERDCMISHGVSSLLKE

SEQ ID NO: 2483139 - protein, 30 aa, Entamoeba dispar
GENDPNRCCKACVFNNFIPGYDCKISDACL

SEQ ID NO: 2483140 - protein, 21 aa, Entamoeba dispar
GENIVSYKLLHSLLVFQSAVL

SEQ ID NO: 2483141 - protein, 19 aa, Entamoeba dispar
GENMQGLALNSMTKTAVAR

SEQ ID NO: 2483142 - protein, 21 aa, Entamoeba dispar
GENSLDLLSCEQCDFNDKIYE

SEQ ID NO: 2483143 - protein, 18 aa, Entamoeba dispar
GEPSLLIQIKGRRRLRSY

SEQ ID NO: 2483144 - protein, 19 aa, Entamoeba dispar
GEQTIDFTIKVNQNGMMEL

SEQ ID NO: 2483145 - protein, 20 aa, Entamoeba dispar
GEQTIDFTIKVNRNGMMELS

SEQ ID NO: 2483146 - protein, 18 aa, Entamoeba dispar
GERCFKRCRCEPKLIEQG

SEQ ID NO: 2483147 - protein, 24 aa, Entamoeba dispar
GERKFKIEVNEGISVAFPLDEVAE

SEQ ID NO: 2483148 - protein, 25 aa, Entamoeba dispar
GERKKRIKFVLQLRHSNKNGELIQI

SEQ ID NO: 2483149 - protein, 22 aa, Entamoeba dispar
GERLQGFLLINVKKRVIVNQLH

SEQ ID NO: 2483150 - protein, 17 aa, Entamoeba dispar
GERNSTVVFEFDTKTQF

SEQ ID NO: 2483151 - protein, 28 aa, Entamoeba dispar
GERTINLFLIRWKNNFHYVIDEKVAITA

SEQ ID NO: 2483152 - protein, 28 aa, Entamoeba dispar
GERTINLFLIRWKNNFHYVIDEKVPITS

SEQ ID NO: 2483153 - protein, 30 aa, Entamoeba dispar
GERTINLFLIRWKNNFHYVIDEKVPITSYF

SEQ ID NO: 2483154 - protein, 20 aa, Entamoeba dispar
GESCFFKCVSLKLITMSSSL

SEQ ID NO: 2483155 - protein, 19 aa, Entamoeba dispar
GESCFKECTGLTCVNIPTR

SEQ ID NO: 2483156 - protein, 19 aa, Entamoeba dispar
GESCFYGCGYVEELSQNKR

SEQ ID NO: 2483157 - protein, 24 aa, Entamoeba dispar
GESFKCRICGAKIHPSCKDNFVIP

SEQ ID NO: 2483158 - protein, 18 aa, Entamoeba dispar
GESIGDVCLRVYVHKVEI

SEQ ID NO: 2483159 - protein, 20 aa, Entamoeba dispar
GESKLSKIIFKNSYSTTTTP

SEQ ID NO: 2483160 - protein, 17 aa, Entamoeba dispar
GESLEKYGLLKETEQKI

SEQ ID NO: 2483161 - protein, 22 aa, Entamoeba dispar
GESLKGITLLPKRAVHVRDCEI

SEQ ID NO: 2483162 - protein, 23 aa, Entamoeba dispar
GESPAGALWWLARELEEAKKYKP

SEQ ID NO: 2483163 - protein, 24 aa, Entamoeba dispar
GESPLHIACLCGYKNIVESLELFG

SEQ ID NO: 2483164 - protein, 17 aa, Entamoeba dispar
GESSLIFYEEDINDKYI

SEQ ID NO: 2483165 - protein, 19 aa, Entamoeba dispar
GESTILFADFECFTNSDYH

SEQ ID NO: 2483166 - protein, 20 aa, Entamoeba dispar
GESTILFADFECFTNSDYHK

SEQ ID NO: 2483167 - protein, 21 aa, Entamoeba dispar
GESVIFNYKLVNSHSKEIELC

SEQ ID NO: 2483168 - protein, 22 aa, Entamoeba dispar
GESYLCKACSYDKRVVIAEYQL

SEQ ID NO: 2483169 - protein, 25 aa, Entamoeba dispar
GESYLKGRIEQVRYFGYELAKRNIP

SEQ ID NO: 2483170 - protein, 24 aa, Entamoeba dispar
GETCFTFDCSPDFIHFDMDFVHKA

SEQ ID NO: 2483171 - protein, 17 aa, Entamoeba dispar
GETGFSHCFCKGVSVGV

SEQ ID NO: 2483172 - protein, 23 aa, Entamoeba dispar
GETKIKLSVKFIKEEITLKELQK

SEQ ID NO: 2483173 - protein, 24 aa, Entamoeba dispar
GETKYKLVGIVIHSGGAHGGHYFS

SEQ ID NO: 2483174 - protein, 25 aa, Entamoeba dispar
GETLQFRLVINIGDAAIFRNNNEIQ

SEQ ID NO: 2483175 - protein, 21 aa, Entamoeba dispar
GETRTRYTVNFIQILDSIASG

SEQ ID NO: 2483176 - protein, 17 aa, Entamoeba dispar
GETRYKGEVDMWSVGCV

SEQ ID NO: 2483177 - protein, 20 aa, Entamoeba dispar
GETTEGIFRIPGKQEEVDGY

SEQ ID NO: 2483178 - protein, 24 aa, Entamoeba dispar
GEVEQLKLDIVFSQGEIISISNEG

SEQ ID NO: 2483179 - protein, 17 aa, Entamoeba dispar
GEVFCWDTQSKKLETVL

SEQ ID NO: 2483180 - protein, 19 aa, Entamoeba dispar
GEVFRCMWEDPKSKSKTHY

SEQ ID NO: 2483181 - protein, 21 aa, Entamoeba dispar
GEVLIIKHIVGGLLKNKVKEN

SEQ ID NO: 2483182 - protein, 21 aa, Entamoeba dispar
GEVLKLCKTEYLTYRTFLQQQ

SEQ ID NO: 2483183 - protein, 32 aa, Entamoeba dispar
GEVNRAKESFWCASGKGVNVCRVLQQQSIPHI

SEQ ID NO: 2483184 - protein, 20 aa, Entamoeba dispar
GEVRIEVILSLMIKSYLEEI

SEQ ID NO: 2483185 - protein, 20 aa, Entamoeba dispar
GEVSFKDVITFNLDEYYPMK

SEQ ID NO: 2483186 - protein, 17 aa, Entamoeba dispar
GEVSQTWNSRIIKDQAL

SEQ ID NO: 2483187 - protein, 18 aa, Entamoeba dispar
GEVSRYCGSHGILQTIIV

SEQ ID NO: 2483188 - protein, 20 aa, Entamoeba dispar
GEYEECFNLDIFIQAIEHWK

SEQ ID NO: 2483189 - protein, 24 aa, Entamoeba dispar
GEYGEGDLFLGVPLPSIRKETKVF

SEQ ID NO: 2483190 - protein, 25 aa, Entamoeba dispar
GEYICLMNPFKFFPSLTEIKSCVWA

SEQ ID NO: 2483191 - protein, 18 aa, Entamoeba dispar
GEYKPVRIINQMTTTSSK

SEQ ID NO: 2483192 - protein, 24 aa, Entamoeba dispar
GEYKVVPVAGLFYAIGHSPNSKFL

SEQ ID NO: 2483193 - protein, 20 aa, Entamoeba dispar
GEYQLYIGWYDGNPAHLDQL

SEQ ID NO: 2483194 - protein, 22 aa, Entamoeba dispar
GEYWKDSFRKLINQVRKSKGLP

SEQ ID NO: 2483195 - protein, 26 aa, Entamoeba dispar
GEYYYRCKHGPLVPCPQEVGDIFEYS

SEQ ID NO: 2483196 - protein, 24 aa, Entamoeba dispar
GFAELPLFLCVALINKYSSELQQK

SEQ ID NO: 2483197 - protein, 24 aa, Entamoeba dispar
GFAKGEVVTLTYKYPKEVNEIIDK

SEQ ID NO: 2483198 - protein, 25 aa, Entamoeba dispar
GFAKWQMPFKFLVDDGCVNPYPPLS

SEQ ID NO: 2483199 - protein, 18 aa, Entamoeba dispar
GFAQNVSDEIAIQNNMHR

SEQ ID NO: 2483200 - protein, 22 aa, Entamoeba dispar
GFCKEGEMYYRIEGKRIEIYSK

SEQ ID NO: 2483201 - protein, 17 aa, Entamoeba dispar
GFDCFRDNTSLTSINID

SEQ ID NO: 2483202 - protein, 20 aa, Entamoeba dispar
GFDGFRFDGVTSMIYTHHGV

SEQ ID NO: 2483203 - protein, 25 aa, Entamoeba dispar
GFDTRFKAKVCKFKDSSSAFVKLIE

SEQ ID NO: 2483204 - protein, 25 aa, Entamoeba dispar
GFEFYKRLYKYWNWSLESIPINGVT

SEQ ID NO: 2483205 - protein, 18 aa, Entamoeba dispar
GFEHPKGMFVLPFETPKS

SEQ ID NO: 2483206 - protein, 27 aa, Entamoeba dispar
GFEIECGECKKVFTYRAYQERDMKCRC

SEQ ID NO: 2483207 - protein, 22 aa, Entamoeba dispar
GFEVYLRLIPMNYFTMLNGISK

SEQ ID NO: 2483208 - protein, 19 aa, Entamoeba dispar
GFFCPHGVRGSLKVVVKLI

SEQ ID NO: 2483209 - protein, 17 aa, Entamoeba dispar
GFFGLSFKKKNKRKLMR

SEQ ID NO: 2483210 - protein, 24 aa, Entamoeba dispar
GFGETRKGILHDIGIITGATVISN

SEQ ID NO: 2483211 - protein, 25 aa, Entamoeba dispar
GFGKYISSIGMEFITTLRVDGIPSG

SEQ ID NO: 2483212 - protein, 23 aa, Entamoeba dispar
GFHCTGMPIKACADKLKTEIEKY

SEQ ID NO: 2483213 - protein, 24 aa, Entamoeba dispar
GFIINGVLLKPAFIGITQTELYPI

SEQ ID NO: 2483214 - protein, 17 aa, Entamoeba dispar
GFIPICVEYLQQHQKEY

SEQ ID NO: 2483215 - protein, 18 aa, Entamoeba dispar
GFIPNNMPMGGFIPDNMP

SEQ ID NO: 2483216 - protein, 23 aa, Entamoeba dispar
GFIRGYVNFSGFVFRKQGKDCLC

SEQ ID NO: 2483217 - protein, 19 aa, Entamoeba dispar
GFISVSIGFLLPEKGEINY

SEQ ID NO: 2483218 - protein, 21 aa, Entamoeba dispar
GFKEIKENLEIIIKNEIKGEG

SEQ ID NO: 2483219 - protein, 19 aa, Entamoeba dispar
GFLDEIRRQNGLKKEWEDC

SEQ ID NO: 2483220 - protein, 19 aa, Entamoeba dispar
GFLENEFIFTNAFPSVRTN

SEQ ID NO: 2483221 - protein, 29 aa, Entamoeba dispar
GFMKKEDWFSVCKNFTLADGTFWPIPITM

SEQ ID NO: 2483222 - protein, 25 aa, Entamoeba dispar
GFMKTSGCMSICLSATKDIIFTGHV

SEQ ID NO: 2483223 - protein, 18 aa, Entamoeba dispar
GFMKYCGQIQRIELPQSI

SEQ ID NO: 2483224 - protein, 24 aa, Entamoeba dispar
GFNEKVCGRKNLLIIVVSGKSIFG

SEQ ID NO: 2483225 - protein, 18 aa, Entamoeba dispar
GFNILFDVIQVFYKNIDD

SEQ ID NO: 2483226 - protein, 28 aa, Entamoeba dispar
GFNKLYHCIVALGYLHIVKFLVSTFPNE

SEQ ID NO: 2483227 - protein, 23 aa, Entamoeba dispar
GFNKNALCLKRVIKKFTDKTYIL

SEQ ID NO: 2483228 - protein, 25 aa, Entamoeba dispar
GFNLELDITYSYAIRIQPEVMSNAF

SEQ ID NO: 2483229 - protein, 18 aa, Entamoeba dispar
GFNLLTEFCKEKKKQIEI

SEQ ID NO: 2483230 - protein, 19 aa, Entamoeba dispar
GFNPLSIIKEEGFDNSDTM

SEQ ID NO: 2483231 - protein, 25 aa, Entamoeba dispar
GFNSTECYVCLLSNLKSICLAKGRC

SEQ ID NO: 2483232 - protein, 22 aa, Entamoeba dispar
GFPETIRVVTSCYVYIQCIGDQ

SEQ ID NO: 2483233 - protein, 19 aa, Entamoeba dispar
GFQFIGAIIHRGSYTCGHY

SEQ ID NO: 2483234 - protein, 20 aa, Entamoeba dispar
GFRIECGSLVNSLIEDTEKV

SEQ ID NO: 2483235 - protein, 17 aa, Entamoeba dispar
GFSLYLRNVKNTVVDVK

SEQ ID NO: 2483236 - protein, 23 aa, Entamoeba dispar
GFTQMFWQLGMKNFDDFIEKLIK

SEQ ID NO: 2483237 - protein, 19 aa, Entamoeba dispar
GFVDASLSSIEWDYLDYAF

SEQ ID NO: 2483238 - protein, 17 aa, Entamoeba dispar
GFYEEKLLQFIVESIEG

SEQ ID NO: 2483239 - protein, 33 aa, Entamoeba dispar
GFYKKEETYNCSFCPFTFCVECYKHLCLTLGTP

SEQ ID NO: 2483240 - protein, 20 aa, Entamoeba dispar
GFYYERRVVPLIKQEREYDC

SEQ ID NO: 2483241 - protein, 21 aa, Entamoeba dispar
GGAFIKFVPFLKSYTQYATNQ

SEQ ID NO: 2483242 - protein, 18 aa, Entamoeba dispar
GGAIFELLMDGFGVNKIL

SEQ ID NO: 2483243 - protein, 17 aa, Entamoeba dispar
GGAKIFDIFENVYRPII

SEQ ID NO: 2483244 - protein, 20 aa, Entamoeba dispar
GGALCHRLFYQSFKAKDTQF

SEQ ID NO: 2483245 - protein, 19 aa, Entamoeba dispar
GGALFELIMNGFGVNRILG

SEQ ID NO: 2483246 - protein, 17 aa, Entamoeba dispar
GGALVLADEGVCLIDEF

SEQ ID NO: 2483247 - protein, 19 aa, Entamoeba dispar
GGAPALPPPRRGTKNVPPP

SEQ ID NO: 2483248 - protein, 17 aa, Entamoeba dispar
GGCCYCKESGNAYIGFN

SEQ ID NO: 2483249 - protein, 19 aa, Entamoeba dispar
GGCRYCGDVNHFAKDCPNK

SEQ ID NO: 2483250 - protein, 17 aa, Entamoeba dispar
GGDKLLFFSHNSIKANF

SEQ ID NO: 2483251 - protein, 27 aa, Entamoeba dispar
GGDNVCFNCGKPGHMSRECPEPRKDNR

SEQ ID NO: 2483252 - protein, 19 aa, Entamoeba dispar
GGDVLCFNNLFGYIQQSIP

SEQ ID NO: 2483253 - protein, 24 aa, Entamoeba dispar
GGEKTIAALALLFAVQSYYPSPFF

SEQ ID NO: 2483254 - protein, 21 aa, Entamoeba dispar
GGERLAFRAINGYGERIVLKR

SEQ ID NO: 2483255 - protein, 24 aa, Entamoeba dispar
GGESALRLWYCFYSLLSDINEHPK

SEQ ID NO: 2483256 - protein, 17 aa, Entamoeba dispar
GGESVVHIWDERKVTDP

SEQ ID NO: 2483257 - protein, 19 aa, Entamoeba dispar
GGFTFIIIDYFSLGQLSDY

SEQ ID NO: 2483258 - protein, 25 aa, Entamoeba dispar
GGGLSPRCWWGFYGKLLNRQQLNKF

SEQ ID NO: 2483259 - protein, 17 aa, Entamoeba dispar
GGGRYDNLVGIFGANKI

SEQ ID NO: 2483260 - protein, 22 aa, Entamoeba dispar
GGGTFWGLCCLLTNYKSFDEML

SEQ ID NO: 2483261 - protein, 25 aa, Entamoeba dispar
GGGWKNWKHRWFVLDGTTLTYYKDQ

SEQ ID NO: 2483262 - protein, 27 aa, Entamoeba dispar
GGHCYKVGNTWRVEGVIALSRSLGDRA

SEQ ID NO: 2483263 - protein, 24 aa, Entamoeba dispar
GGHNIWPAEICDIMIAHPKIQEAA

SEQ ID NO: 2483264 - protein, 17 aa, Entamoeba dispar
GGIEALFKLLEKQKNKL

SEQ ID NO: 2483265 - protein, 20 aa, Entamoeba dispar
GGIFKKGNVDRLEWEKEEKE

SEQ ID NO: 2483266 - protein, 22 aa, Entamoeba dispar
GGIGGILRYQLSMDELDDNFNM

SEQ ID NO: 2483267 - protein, 19 aa, Entamoeba dispar
GGIINCRYCHSLGRILKVS

SEQ ID NO: 2483268 - protein, 30 aa, Entamoeba dispar
GGKCLPIGNICYLYKCCQMNPYQIKLNDDV

SEQ ID NO: 2483269 - protein, 18 aa, Entamoeba dispar
GGKFFVRYYAPWCGFCKM

SEQ ID NO: 2483270 - protein, 23 aa, Entamoeba dispar
GGKLRFGVPLAKAECIWKNLILM

SEQ ID NO: 2483271 - protein, 22 aa, Entamoeba dispar
GGKRGGRGRPAAAVRQKVESFF

SEQ ID NO: 2483272 - protein, 20 aa, Entamoeba dispar
GGKYPESKRMIFKDYVRCAM

SEQ ID NO: 2483273 - protein, 17 aa, Entamoeba dispar
GGLDIGWTAYLIGAISE

SEQ ID NO: 2483274 - protein, 18 aa, Entamoeba dispar
GGLDVKTGTTGVHSYISH

SEQ ID NO: 2483275 - protein, 18 aa, Entamoeba dispar
GGLKNELLNYLDGIDESY

SEQ ID NO: 2483276 - protein, 27 aa, Entamoeba dispar
GGLQACARAFAARKHFSVLREQQVAVI

SEQ ID NO: 2483277 - protein, 19 aa, Entamoeba dispar
GGLQFPELGLNRFDDMIND

SEQ ID NO: 2483278 - protein, 20 aa, Entamoeba dispar
GGMIGKIEIEYCCIREIIGN

SEQ ID NO: 2483279 - protein, 17 aa, Entamoeba dispar
GGMPKGFSFNVGGMPGG

SEQ ID NO: 2483280 - protein, 26 aa, Entamoeba dispar
GGNKIEVCSGVDGFKHLPKASLNELF

SEQ ID NO: 2483281 - protein, 17 aa, Entamoeba dispar
GGNLGPSIEMFVKGLEV

SEQ ID NO: 2483282 - protein, 18 aa, Entamoeba dispar
GGNTLYPGFAERLASGVQ

SEQ ID NO: 2483283 - protein, 17 aa, Entamoeba dispar
GGNVGGIHELVFKEEGQ

SEQ ID NO: 2483284 - protein, 18 aa, Entamoeba dispar
GGPLKKGQSLNFIIEKRK

SEQ ID NO: 2483285 - protein, 18 aa, Entamoeba dispar
GGPQCAVSQFWSYRWNFL

SEQ ID NO: 2483286 - protein, 19 aa, Entamoeba dispar
GGQSLDCIYPYVKSLVRSY

SEQ ID NO: 2483287 - protein, 28 aa, Entamoeba dispar
GGRVSDGFISRSLPHFALHSRTPQAKGF

SEQ ID NO: 2483288 - protein, 20 aa, Entamoeba dispar
GGSDALFFFQYTKLPMNILS

SEQ ID NO: 2483289 - protein, 18 aa, Entamoeba dispar
GGSDYYLVCRDFDGYVKV

SEQ ID NO: 2483290 - protein, 25 aa, Entamoeba dispar
GGSSDFKQALLVAKLALANRVDKIY

SEQ ID NO: 2483291 - protein, 33 aa, Entamoeba dispar
GGSVKNWKKRWFVLKPTRLWYFKAKNSTSAQGY

SEQ ID NO: 2483292 - protein, 22 aa, Entamoeba dispar
GGSVRLEPRFQFIVTSNYSLAE

SEQ ID NO: 2483293 - protein, 18 aa, Entamoeba dispar
GGTFKKFTKVQMECKNDC

SEQ ID NO: 2483294 - protein, 26 aa, Entamoeba dispar
GGTIFRCIWCSLFVHNTCQPKLLNCC

SEQ ID NO: 2483295 - protein, 17 aa, Entamoeba dispar
GGTIGKYEDCVWVNKMA

SEQ ID NO: 2483296 - protein, 19 aa, Entamoeba dispar
GGTMTKIVFWIPGDTDIDL

SEQ ID NO: 2483297 - protein, 17 aa, Entamoeba dispar
GGTSLKKSTDRVLQPPK

SEQ ID NO: 2483298 - protein, 25 aa, Entamoeba dispar
GGVEKIPFIAPKPVWAKEEKKSTKK

SEQ ID NO: 2483299 - protein, 18 aa, Entamoeba dispar
GGVGARFWPLSRESKPKQ

SEQ ID NO: 2483300 - protein, 18 aa, Entamoeba dispar
GGVKCIYQCILLKRIIKE

SEQ ID NO: 2483301 - protein, 18 aa, Entamoeba dispar
GGVSCAHYSPILNDDKSF

SEQ ID NO: 2483302 - protein, 24 aa, Entamoeba dispar
GGVSRSDCMLQFQADICNCTVVRL

SEQ ID NO: 2483303 - protein, 20 aa, Entamoeba dispar
GGVTLHSFAGIGLGDQSVDM

SEQ ID NO: 2483304 - protein, 23 aa, Entamoeba dispar
GGWRMRISLATALFLQPDLLILD

SEQ ID NO: 2483305 - protein, 18 aa, Entamoeba dispar
GGWYFSDNKDLPFDSNEW

SEQ ID NO: 2483306 - protein, 25 aa, Entamoeba dispar
GGWYVPLPLYRLIPFLEESNYYITP

SEQ ID NO: 2483307 - protein, 27 aa, Entamoeba dispar
GGYKNWKKRYFVLKDKKLWYFDSKDSV

SEQ ID NO: 2483308 - protein, 23 aa, Entamoeba dispar
GHDLDLTIIDWLRLQDYRIQPKK

SEQ ID NO: 2483309 - protein, 17 aa, Entamoeba dispar
GHDSGMIIFKLNEERIP

SEQ ID NO: 2483310 - protein, 23 aa, Entamoeba dispar
GHEAGVCCVCYLINDTRPYLLSG

SEQ ID NO: 2483311 - protein, 25 aa, Entamoeba dispar
GHENIKKGILLLLFGGVHKTTKEGI

SEQ ID NO: 2483312 - protein, 25 aa, Entamoeba dispar
GHGPGVDWWSLGILIYEMIVGIPPF

SEQ ID NO: 2483313 - protein, 21 aa, Entamoeba dispar
GHGSFGIVFEGVYNSMKCAIK

SEQ ID NO: 2483314 - protein, 18 aa, Entamoeba dispar
GHHFDLKKGIQLSQGISL

SEQ ID NO: 2483315 - protein, 21 aa, Entamoeba dispar
GHIFHPSCIKKEFINNKTPFA

SEQ ID NO: 2483316 - protein, 22 aa, Entamoeba dispar
GHIKLTDFGLCTGFHKDHEGSY

SEQ ID NO: 2483317 - protein, 18 aa, Entamoeba dispar
GHIVLTFTPLLRVYSDYC

SEQ ID NO: 2483318 - protein, 17 aa, Entamoeba dispar
GHKALIFCQTRQMLNII

SEQ ID NO: 2483319 - protein, 26 aa, Entamoeba dispar
GHLCPCAPSTFPCFPASTDPFILEEP

SEQ ID NO: 2483320 - protein, 21 aa, Entamoeba dispar
GHLIHIDFGFMFDRSPGGDMG

SEQ ID NO: 2483321 - protein, 23 aa, Entamoeba dispar
GHLQRSAIMAIQIAKKRKDKKEK

SEQ ID NO: 2483322 - protein, 18 aa, Entamoeba dispar
GHMFCWECLREWLSRQET

SEQ ID NO: 2483323 - protein, 17 aa, Entamoeba dispar
GHNYLRVTRIFNSLHAF

SEQ ID NO: 2483324 - protein, 24 aa, Entamoeba dispar
GHQRVKSAFSQRPIFFSEINEVQK

SEQ ID NO: 2483325 - protein, 21 aa, Entamoeba dispar
GHSENILFILFDNGKIRVYRT

SEQ ID NO: 2483326 - protein, 19 aa, Entamoeba dispar
GHSFCKECVIEHILTCMKE

SEQ ID NO: 2483327 - protein, 22 aa, Entamoeba dispar
GHSFEILDAVAFSKEILPKYYK

SEQ ID NO: 2483328 - protein, 23 aa, Entamoeba dispar
GHSFEILDAVAFSKEILPKYYKH

SEQ ID NO: 2483329 - protein, 19 aa, Entamoeba dispar
GHSGAFVEIDMLGGVDEEV

SEQ ID NO: 2483330 - protein, 25 aa, Entamoeba dispar
GHSGSVDWWTFGIFMYEILYGRTPF

SEQ ID NO: 2483331 - protein, 20 aa, Entamoeba dispar
GHSPLIPPHCLKVASMYIPV

SEQ ID NO: 2483332 - protein, 23 aa, Entamoeba dispar
GHTDFLMKTIDAMNEADVAVVVV

SEQ ID NO: 2483333 - protein, 21 aa, Entamoeba dispar
GHVDGGAGWRMSDQGNRIIVA

SEQ ID NO: 2483334 - protein, 19 aa, Entamoeba dispar
GHVIFDFCNTGILFKTIQQ

SEQ ID NO: 2483335 - protein, 17 aa, Entamoeba dispar
GHVTYFWNGNKSGYFDD

SEQ ID NO: 2483336 - protein, 17 aa, Entamoeba dispar
GHVYLQFQSIIQSEITG

SEQ ID NO: 2483337 - protein, 25 aa, Entamoeba dispar
GHYGLECLLLLVALKLRFPQRISLL

SEQ ID NO: 2483338 - protein, 20 aa, Entamoeba dispar
GIAAPLMVCAVVARTLSIIW

SEQ ID NO: 2483339 - protein, 19 aa, Entamoeba dispar
GIACPQFIIIQSYQEMMRF

SEQ ID NO: 2483340 - protein, 18 aa, Entamoeba dispar
GIAEEGLVYLLESLCQNT

SEQ ID NO: 2483341 - protein, 23 aa, Entamoeba dispar
GIAPRIICAAVYKYTKKKMEFLW

SEQ ID NO: 2483342 - protein, 19 aa, Entamoeba dispar
GIARPTFVQLLLKVNPAMY

SEQ ID NO: 2483343 - protein, 19 aa, Entamoeba dispar
GICAYACHAHLLKKDNVQI

SEQ ID NO: 2483344 - protein, 20 aa, Entamoeba dispar
GICCFYKCASLTSMNIDNIQ

SEQ ID NO: 2483345 - protein, 17 aa, Entamoeba dispar
GICLFEMVSRRIFNPLN

SEQ ID NO: 2483346 - protein, 25 aa, Entamoeba dispar
GIDAFFKMFNKLMMNPHFKVTEIPE

SEQ ID NO: 2483347 - protein, 23 aa, Entamoeba dispar
GIDFRASLLTNLFNICEQCGLDL

SEQ ID NO: 2483348 - protein, 20 aa, Entamoeba dispar
GIDGCSYVKKVLRIAMNGSM

SEQ ID NO: 2483349 - protein, 23 aa, Entamoeba dispar
GIDLLKFLCNSFVLLNGTFTQQF

SEQ ID NO: 2483350 - protein, 22 aa, Entamoeba dispar
GIDLLNKMLCCYPNKRIDAKEA

SEQ ID NO: 2483351 - protein, 27 aa, Entamoeba dispar
GIDNLCIVVAPTFFWKKGEIQRQNGFE

SEQ ID NO: 2483352 - protein, 17 aa, Entamoeba dispar
GIDNLSLDSLVLLHRLM

SEQ ID NO: 2483353 - protein, 28 aa, Entamoeba dispar
GIEALKELLLKIQICRATADIEYAQSFF

SEQ ID NO: 2483354 - protein, 18 aa, Entamoeba dispar
GIECIGIEGKEEYIKAMK

SEQ ID NO: 2483355 - protein, 19 aa, Entamoeba dispar
GIECIGIEGKEEYIKAMKE

SEQ ID NO: 2483356 - protein, 19 aa, Entamoeba dispar
GIEDLLRWVKNIPPMSVQN

SEQ ID NO: 2483357 - protein, 20 aa, Entamoeba dispar
GIEEGELYTLLPSGSLLKDS

SEQ ID NO: 2483358 - protein, 25 aa, Entamoeba dispar
GIEELNIWSKMEMSGVLKKTGEKSR

SEQ ID NO: 2483359 - protein, 23 aa, Entamoeba dispar
GIEEYRILVSMEHACYPRYTSPP

SEQ ID NO: 2483360 - protein, 25 aa, Entamoeba dispar
GIEFCCKITEGVLLRKVLSDLIKQS

SEQ ID NO: 2483361 - protein, 29 aa, Entamoeba dispar
GIEFCCKITEGVLLRMVLSDLIKQSQSKL

SEQ ID NO: 2483362 - protein, 25 aa, Entamoeba dispar
GIEIFLTFLCGSWKKNGISRISKQN

SEQ ID NO: 2483363 - protein, 24 aa, Entamoeba dispar
GIEPSLILSRAIKLFKAVIRNNKV

SEQ ID NO: 2483364 - protein, 18 aa, Entamoeba dispar
GIEQLCWSKDSRKIAYTC

SEQ ID NO: 2483365 - protein, 22 aa, Entamoeba dispar
GIESWLVRSMFVFKKMKTRQMV

SEQ ID NO: 2483366 - protein, 18 aa, Entamoeba dispar
GIESYYRNNMVDVAMLLN

SEQ ID NO: 2483367 - protein, 24 aa, Entamoeba dispar
GIEYSGCCGLLCIIEIKEKKRIIH

SEQ ID NO: 2483368 - protein, 20 aa, Entamoeba dispar
GIFDPSCKSTLGVNFLTKTC

SEQ ID NO: 2483369 - protein, 26 aa, Entamoeba dispar
GIFKALMPHVCDFEKVFTTRKVGSIT

SEQ ID NO: 2483370 - protein, 20 aa, Entamoeba dispar
GIFLNCKKENVFVFGSEYRP

SEQ ID NO: 2483371 - protein, 25 aa, Entamoeba dispar
GIFPLKDTIDAIGFYNLPYSVTVRK

SEQ ID NO: 2483372 - protein, 25 aa, Entamoeba dispar
GIFRIWDFRTMKTIKAFQAPNKSSI

SEQ ID NO: 2483373 - protein, 25 aa, Entamoeba dispar
GIFRNGGFNCCKKHLPLINNKEKIL

SEQ ID NO: 2483374 - protein, 17 aa, Entamoeba dispar
GIFTARALQSCKMHGMK

SEQ ID NO: 2483375 - protein, 20 aa, Entamoeba dispar
GIGCFKGCSSIMSINIPSPV

SEQ ID NO: 2483376 - protein, 26 aa, Entamoeba dispar
GIGEEMLKVLGWSEGKGAGKFEQGIE

SEQ ID NO: 2483377 - protein, 22 aa, Entamoeba dispar
GIGEGRKALEIFDKNLQKYYEI

SEQ ID NO: 2483378 - protein, 18 aa, Entamoeba dispar
GIGFHVADILLLELTIAF

SEQ ID NO: 2483379 - protein, 18 aa, Entamoeba dispar
GIGLKKALKIVGSCKTIK

SEQ ID NO: 2483380 - protein, 20 aa, Entamoeba dispar
GIGLPRKYPLICIDREEKYF

SEQ ID NO: 2483381 - protein, 26 aa, Entamoeba dispar
GIGMDRGEMYFINWNKKYTTWMDPRS

SEQ ID NO: 2483382 - protein, 20 aa, Entamoeba dispar
GIGVYELYLNDSLLDYSLTM

SEQ ID NO: 2483383 - protein, 20 aa, Entamoeba dispar
GIHPSLIITNDWFTGMVPAY

SEQ ID NO: 2483384 - protein, 24 aa, Entamoeba dispar
GIHVFPFCLQFDVMDKFIRGGRKF

SEQ ID NO: 2483385 - protein, 21 aa, Entamoeba dispar
GIICAEVNWDKKLIVTGSEDN

SEQ ID NO: 2483386 - protein, 18 aa, Entamoeba dispar
GIIEIAVVLIRFKCDYTI

SEQ ID NO: 2483387 - protein, 17 aa, Entamoeba dispar
GIIKFLNIKSEIKDIKY

SEQ ID NO: 2483388 - protein, 18 aa, Entamoeba dispar
GIIKLVVSDIIKYIEEEF

SEQ ID NO: 2483389 - protein, 19 aa, Entamoeba dispar
GIIKRNWKPLPGYIKQESS

SEQ ID NO: 2483390 - protein, 25 aa, Entamoeba dispar
GIIPKNKLDVIFLHFPDVQSMNSSF

SEQ ID NO: 2483391 - protein, 23 aa, Entamoeba dispar
GIIREVPKLINTVYHELKDVFNK

SEQ ID NO: 2483392 - protein, 24 aa, Entamoeba dispar
GIIREVPKLINTVYHELKDVFNKR

SEQ ID NO: 2483393 - protein, 21 aa, Entamoeba dispar
GIISNMLLGIVLRLIDDNDSI

SEQ ID NO: 2483394 - protein, 24 aa, Entamoeba dispar
GIISYMNFERIEGIIKILNEEEQE

SEQ ID NO: 2483395 - protein, 23 aa, Entamoeba dispar
GIKCILQAIIFSRLVEKFPTLLE

SEQ ID NO: 2483396 - protein, 23 aa, Entamoeba dispar
GIKELRAGYLSYWNLINQKKREA

SEQ ID NO: 2483397 - protein, 17 aa, Entamoeba dispar
GIKIRTYEVCAKKFDEI

SEQ ID NO: 2483398 - protein, 21 aa, Entamoeba dispar
GIKKSENVLVHFVKTNFIDIP

SEQ ID NO: 2483399 - protein, 20 aa, Entamoeba dispar
GIKLLYEIFCLFIRAETKVY

SEQ ID NO: 2483400 - protein, 22 aa, Entamoeba dispar
GIKQVCLFNQYVLYFTHSYSKT

SEQ ID NO: 2483401 - protein, 20 aa, Entamoeba dispar
GIKYEGYCSVLIGDEVPGKF

SEQ ID NO: 2483402 - protein, 22 aa, Entamoeba dispar
GIKYRGKVFSLKLSQPNKEEKG

SEQ ID NO: 2483403 - protein, 24 aa, Entamoeba dispar
GILCSCIKGIEPLPMDKDIEWLKS

SEQ ID NO: 2483404 - protein, 17 aa, Entamoeba dispar
GILEMKIGGGIIRVITC

SEQ ID NO: 2483405 - protein, 28 aa, Entamoeba dispar
GILMTRISLLLPLFLEFIKQNKLNERYH

SEQ ID NO: 2483406 - protein, 18 aa, Entamoeba dispar
GILNRFIGLSSREVKLIH

SEQ ID NO: 2483407 - protein, 19 aa, Entamoeba dispar
GILPEILENLLAARKQAKK

SEQ ID NO: 2483408 - protein, 23 aa, Entamoeba dispar
GILYQPRLTKIIPARDLVPEKIL

SEQ ID NO: 2483409 - protein, 23 aa, Entamoeba dispar
GIMENCNGLILGSVLRAVTPNVK

SEQ ID NO: 2483410 - protein, 24 aa, Entamoeba dispar
GIMKSWKRKWVRLTKTDVYVFDNP

SEQ ID NO: 2483411 - protein, 23 aa, Entamoeba dispar
GIMNRCKIRLAFISKNNIGYLEE

SEQ ID NO: 2483412 - protein, 19 aa, Entamoeba dispar
GIMPKKVIDCLAEVKKSMW

SEQ ID NO: 2483413 - protein, 26 aa, Entamoeba dispar
GIMVSMGVCSHGEYGINTGLFYSMPV

SEQ ID NO: 2483414 - protein, 26 aa, Entamoeba dispar
GINAVRWVGGVELELLAIATGARIVP

SEQ ID NO: 2483415 - protein, 19 aa, Entamoeba dispar
GINCKLTDFGKPFPKEIYK

SEQ ID NO: 2483416 - protein, 17 aa, Entamoeba dispar
GINCKLTDFGSSRHDDN

SEQ ID NO: 2483417 - protein, 19 aa, Entamoeba dispar
GINDIEILSGALLHDTVED

SEQ ID NO: 2483418 - protein, 17 aa, Entamoeba dispar
GINDLILEYAYQNKDKW

SEQ ID NO: 2483419 - protein, 19 aa, Entamoeba dispar
GINGFLKKFYYTMKEPSYI

SEQ ID NO: 2483420 - protein, 20 aa, Entamoeba dispar
GINGVEVFMLLIALKVKYPR

SEQ ID NO: 2483421 - protein, 18 aa, Entamoeba dispar
GINGYVIGMMCSKIKENQ

SEQ ID NO: 2483422 - protein, 18 aa, Entamoeba dispar
GINKLGEMMRGMMLNENI

SEQ ID NO: 2483423 - protein, 18 aa, Entamoeba dispar
GINKSICNEQFKSIMKDY

SEQ ID NO: 2483424 - protein, 18 aa, Entamoeba dispar
GINLRTLTDILIKTEIGS

SEQ ID NO: 2483425 - protein, 19 aa, Entamoeba dispar
GINPPNYPAVVPHPAAPYE

SEQ ID NO: 2483426 - protein, 18 aa, Entamoeba dispar
GINYIIRLLYDGYPNTRY

SEQ ID NO: 2483427 - protein, 22 aa, Entamoeba dispar
GIPEYTAREWLIPKIQEDNINK

SEQ ID NO: 2483428 - protein, 19 aa, Entamoeba dispar
GIPIMTIWMHDIVNINCIP

SEQ ID NO: 2483429 - protein, 24 aa, Entamoeba dispar
GIPKGGRSKRSFNMGGMPREFGGF

SEQ ID NO: 2483430 - protein, 26 aa, Entamoeba dispar
GIPKRKTGKCVIEFTTQVNENGIMEL

SEQ ID NO: 2483431 - protein, 21 aa, Entamoeba dispar
GIPLKSAIKKSQWRVPLPIFR

SEQ ID NO: 2483432 - protein, 25 aa, Entamoeba dispar
GIPWIGIGKVAVWPLEKSGKMIDPI

SEQ ID NO: 2483433 - protein, 18 aa, Entamoeba dispar
GIQPRAFYLQDNESKTLC

SEQ ID NO: 2483434 - protein, 19 aa, Entamoeba dispar
GIQVTLNFTDSVFIDQCYF

SEQ ID NO: 2483435 - protein, 18 aa, Entamoeba dispar
GIQYDYFIGRYINGNEQY

SEQ ID NO: 2483436 - protein, 18 aa, Entamoeba dispar
GIRCISKCDFYLKQTRSQ

SEQ ID NO: 2483437 - protein, 22 aa, Entamoeba dispar
GIRETDRWYYGGGLYMGKKMPE

SEQ ID NO: 2483438 - protein, 19 aa, Entamoeba dispar
GIRIFRKKEMPIVGPLLNG

SEQ ID NO: 2483439 - protein, 25 aa, Entamoeba dispar
GIRQGKTGKCYADFEDEETWKNVKA

SEQ ID NO: 2483440 - protein, 22 aa, Entamoeba dispar
GIRRILCSLMERISSYVTANPQ

SEQ ID NO: 2483441 - protein, 19 aa, Entamoeba dispar
GISANCNKITFSTTTNEPY

SEQ ID NO: 2483442 - protein, 19 aa, Entamoeba dispar
GISDLDLVGTNWKFFSLER

SEQ ID NO: 2483443 - protein, 33 aa, Entamoeba dispar
GISEKSWKLVWVVIKYTFIFVFKSRDDTTLIET

SEQ ID NO: 2483444 - protein, 41 aa, Entamoeba dispar
GISFLDVKYSLLFEYNMYLAYYCWIKSSGSNVERHKAIERL

SEQ ID NO: 2483445 - protein, 18 aa, Entamoeba dispar
GISKSNEKKIILLTQSGL

SEQ ID NO: 2483446 - protein, 23 aa, Entamoeba dispar
GISLGELNKYYCLVYSCFEDISY

SEQ ID NO: 2483447 - protein, 23 aa, Entamoeba dispar
GISNAKIFNGFRLDNCHSVPLEA

SEQ ID NO: 2483448 - protein, 18 aa, Entamoeba dispar
GISNIPIVSEQWLIDTIK

SEQ ID NO: 2483449 - protein, 17 aa, Entamoeba dispar
GITELGFHSPYITKEDI

SEQ ID NO: 2483450 - protein, 22 aa, Entamoeba dispar
GITGIGKVRFITGLGKHSSRQG

SEQ ID NO: 2483451 - protein, 23 aa, Entamoeba dispar
GITHLRLLIQVSKEVKRCVESID

SEQ ID NO: 2483452 - protein, 18 aa, Entamoeba dispar
GITKIPPKVFNQIHFPKL

SEQ ID NO: 2483453 - protein, 18 aa, Entamoeba dispar
GITLDSIGYKNCNILIYK

SEQ ID NO: 2483454 - protein, 18 aa, Entamoeba dispar
GITPLMYAIELGFDDIAL

SEQ ID NO: 2483455 - protein, 20 aa, Entamoeba dispar
GITTLEIWIPVYVINNSIIP

SEQ ID NO: 2483456 - protein, 24 aa, Entamoeba dispar
GIVIQCLSCVISLLKAEPTPSKII

SEQ ID NO: 2483457 - protein, 23 aa, Entamoeba dispar
GIVKEKYNSIVIGLINTSAECIF

SEQ ID NO: 2483458 - protein, 22 aa, Entamoeba dispar
GIVKVWDILGVESLEVMRSKVT

SEQ ID NO: 2483459 - protein, 26 aa, Entamoeba dispar
GIVTSLKARCSVIAAANPKTGKYNPN

SEQ ID NO: 2483460 - protein, 26 aa, Entamoeba dispar
GIVVKCMQRGYWLMMENVNFCNPTVL

SEQ ID NO: 2483461 - protein, 20 aa, Entamoeba dispar
GIVYFKYFFDLSDLTLEQLR

SEQ ID NO: 2483462 - protein, 18 aa, Entamoeba dispar
GIYGCCECPITPDIYTAV

SEQ ID NO: 2483463 - protein, 19 aa, Entamoeba dispar
GIYGCCECPITPDIYTAVF

SEQ ID NO: 2483464 - protein, 27 aa, Entamoeba dispar
GIYGYVYCFLNGISIEILVAQVISENY

SEQ ID NO: 2483465 - protein, 23 aa, Entamoeba dispar
GIYKVGGIALLLALILKSDTKIK

SEQ ID NO: 2483466 - protein, 18 aa, Entamoeba dispar
GIYLKKFKDTFSVVREYL

SEQ ID NO: 2483467 - protein, 20 aa, Entamoeba dispar
GKAEGLIRILSIEEHGDIID

SEQ ID NO: 2483468 - protein, 23 aa, Entamoeba dispar
GKAGEQIIDFTIKVNQNGMMELS

SEQ ID NO: 2483469 - protein, 30 aa, Entamoeba dispar
GKCCSCNRSVVKRTLFKCGHCMCDQCLEKL

SEQ ID NO: 2483470 - protein, 31 aa, Entamoeba dispar
GKCLKKEAKKRCKISEIFVDEWIKDNLCESE

SEQ ID NO: 2483471 - protein, 34 aa, Entamoeba dispar
GKCLKKEAKKRCKISEIFVHEWIKDNLCESEVLD

SEQ ID NO: 2483472 - protein, 19 aa, Entamoeba dispar
GKCNTGYVCSKGSVCVIKP

SEQ ID NO: 2483473 - protein, 18 aa, Entamoeba dispar
GKCSTTLLDKAPTKIESL

SEQ ID NO: 2483474 - protein, 19 aa, Entamoeba dispar
GKCVGCAAANGATKEKIQT

SEQ ID NO: 2483475 - protein, 20 aa, Entamoeba dispar
GKCYHMYPRAFARELGRYSE

SEQ ID NO: 2483476 - protein, 19 aa, Entamoeba dispar
GKDHGDFGLKLNMSNGGPA

SEQ ID NO: 2483477 - protein, 21 aa, Entamoeba dispar
GKDIICSKTIYSNKIKAFHSV

SEQ ID NO: 2483478 - protein, 19 aa, Entamoeba dispar
GKDIIKIGLPIIQLSSIDI

SEQ ID NO: 2483479 - protein, 18 aa, Entamoeba dispar
GKDIKELLEMGIGVHNAG

SEQ ID NO: 2483480 - protein, 18 aa, Entamoeba dispar
GKDIPIYHMYTFEDQFII

SEQ ID NO: 2483481 - protein, 17 aa, Entamoeba dispar
GKDKAAELGVKYIETSA

SEQ ID NO: 2483482 - protein, 20 aa, Entamoeba dispar
GKDKSKCYMLGYIPPQYKNG

SEQ ID NO: 2483483 - protein, 23 aa, Entamoeba dispar
GKDLCKNKAFGVKYLLKTNKKHP

SEQ ID NO: 2483484 - protein, 30 aa, Entamoeba dispar
GKDMLQELCVLKGKLCWIIYVDVVVVEDDG

SEQ ID NO: 2483485 - protein, 19 aa, Entamoeba dispar
GKDNTIWMVDPFMMRVVKK

SEQ ID NO: 2483486 - protein, 26 aa, Entamoeba dispar
GKDYDCLIDVWSLGIMCREMMEGYPP

SEQ ID NO: 2483487 - protein, 21 aa, Entamoeba dispar
GKEFMKQLCLDGIQFSFLSSE

SEQ ID NO: 2483488 - protein, 21 aa, Entamoeba dispar
GKEGISLYGCLNKCMTKGGSK

SEQ ID NO: 2483489 - protein, 24 aa, Entamoeba dispar
GKEGRFKILVELFGKTDDSELKAT

SEQ ID NO: 2483490 - protein, 22 aa, Entamoeba dispar
GKEHGWKVIVADWGAEACGDAV

SEQ ID NO: 2483491 - protein, 18 aa, Entamoeba dispar
GKEIPKVNPIEFEKDDDN

SEQ ID NO: 2483492 - protein, 29 aa, Entamoeba dispar
GKEKGRIRLCSTCLQFIVNEIYIRYLKIF

SEQ ID NO: 2483493 - protein, 18 aa, Entamoeba dispar
GKELKGRNSHIIELIRNW

SEQ ID NO: 2483494 - protein, 18 aa, Entamoeba dispar
GKENILLMVFTKKGYVFG

SEQ ID NO: 2483495 - protein, 23 aa, Entamoeba dispar
GKENKERVFSIGLCNDNGTEEAK

SEQ ID NO: 2483496 - protein, 22 aa, Entamoeba dispar
GKERKRSGIVIKVSLRDSDNNI

SEQ ID NO: 2483497 - protein, 20 aa, Entamoeba dispar
GKESILFICIADGIRFGCFH

SEQ ID NO: 2483498 - protein, 18 aa, Entamoeba dispar
GKESIVLVIFDSEGNVFG

SEQ ID NO: 2483499 - protein, 19 aa, Entamoeba dispar
GKETLKRKEYIQIIRANEI

SEQ ID NO: 2483500 - protein, 19 aa, Entamoeba dispar
GKEVCLFENIGFLSPKGHY

SEQ ID NO: 2483501 - protein, 20 aa, Entamoeba dispar
GKEVKFVFESKCWKEVIKKC

SEQ ID NO: 2483502 - protein, 18 aa, Entamoeba dispar
GKEVKMIRCHNMKMIDTS

SEQ ID NO: 2483503 - protein, 19 aa, Entamoeba dispar
GKEVKMVRCHNIKIIDTSN

SEQ ID NO: 2483504 - protein, 24 aa, Entamoeba dispar
GKEVLTILSEMWKKLDPVEKDKYN

SEQ ID NO: 2483505 - protein, 23 aa, Entamoeba dispar
GKEWCGNLIIVEFSETIESKRNR

SEQ ID NO: 2483506 - protein, 18 aa, Entamoeba dispar
GKEYVCICKFHEAISDEQ

SEQ ID NO: 2483507 - protein, 19 aa, Entamoeba dispar
GKFFDRNWYSLYFINSMRE

SEQ ID NO: 2483508 - protein, 20 aa, Entamoeba dispar
GKFFGFKHINEIGCHFNQII

SEQ ID NO: 2483509 - protein, 26 aa, Entamoeba dispar
GKFGIEVMCLLYLFKIQFPNQFFLLR

SEQ ID NO: 2483510 - protein, 19 aa, Entamoeba dispar
GKFKLHITALPYLAQYCQS

SEQ ID NO: 2483511 - protein, 19 aa, Entamoeba dispar
GKFKVGVTAVIRVTLKNGV

SEQ ID NO: 2483512 - protein, 19 aa, Entamoeba dispar
GKFLHAAETVMVFKATSTT

SEQ ID NO: 2483513 - protein, 17 aa, Entamoeba dispar
GKFLKYISGYLKQNKIS

SEQ ID NO: 2483514 - protein, 18 aa, Entamoeba dispar
GKFSIEIIKENKVKSPIS

SEQ ID NO: 2483515 - protein, 19 aa, Entamoeba dispar
GKFSMYYNINMENAVNIFS

SEQ ID NO: 2483516 - protein, 17 aa, Entamoeba dispar
GKFTVKLPWEFTTSETP

SEQ ID NO: 2483517 - protein, 23 aa, Entamoeba dispar
GKGADFPPYAFVKFTDEKSAGLA

SEQ ID NO: 2483518 - protein, 25 aa, Entamoeba dispar
GKGAVLLCVIRGRLSEGIDFTNHLA

SEQ ID NO: 2483519 - protein, 25 aa, Entamoeba dispar
GKGEARICKVYDSPCLPESEASFAI

SEQ ID NO: 2483520 - protein, 24 aa, Entamoeba dispar
GKGEGSSLFGLKPFDIEITITVIQ

SEQ ID NO: 2483521 - protein, 24 aa, Entamoeba dispar
GKGFEVKDAIALLRMDDIFVDSFE

SEQ ID NO: 2483522 - protein, 21 aa, Entamoeba dispar
GKGFLVSWCGRIEKLFIVGFN

SEQ ID NO: 2483523 - protein, 22 aa, Entamoeba dispar
GKGKIKYQAKRPFEEKLTSTFF

SEQ ID NO: 2483524 - protein, 23 aa, Entamoeba dispar
GKGKIKYQAKRPFEEKLTSTFFN

SEQ ID NO: 2483525 - protein, 17 aa, Entamoeba dispar
GKGKILITGFHFEFDEQ

SEQ ID NO: 2483526 - protein, 24 aa, Entamoeba dispar
GKGNKKYDVKFMRADVKKSFLKGK

SEQ ID NO: 2483527 - protein, 17 aa, Entamoeba dispar
GKGPVNFTIHCVNKVGT

SEQ ID NO: 2483528 - protein, 18 aa, Entamoeba dispar
GKGPYVFASELNKIKVNS

SEQ ID NO: 2483529 - protein, 20 aa, Entamoeba dispar
GKGRGVICCRPIKAGELVFK

SEQ ID NO: 2483530 - protein, 23 aa, Entamoeba dispar
GKGYGSKLVECFIQKVKEKGIRK

SEQ ID NO: 2483531 - protein, 19 aa, Entamoeba dispar
GKGYIFIFPKNTWSYVNEY

SEQ ID NO: 2483532 - protein, 19 aa, Entamoeba dispar
GKHGRFRGNLLGKRVDFSG

SEQ ID NO: 2483533 - protein, 23 aa, Entamoeba dispar
GKHIISRCGACMTLIGPSNTPFQ

SEQ ID NO: 2483534 - protein, 30 aa, Entamoeba dispar
GKHPKWMERTSGCTFGFGGKMGIFKGKEVL

SEQ ID NO: 2483535 - protein, 17 aa, Entamoeba dispar
GKHVFSKLRHQAKAEYR

SEQ ID NO: 2483536 - protein, 25 aa, Entamoeba dispar
GKIAMSRKVERRWRLVGWGEVVKGT

SEQ ID NO: 2483537 - protein, 25 aa, Entamoeba dispar
GKIDLKYKANFCINWLNSMENNKEK

SEQ ID NO: 2483538 - protein, 17 aa, Entamoeba dispar
GKIEELFLWAFKEENCN

SEQ ID NO: 2483539 - protein, 23 aa, Entamoeba dispar
GKIEGFLPLTGTAFVAWGDKVQL

SEQ ID NO: 2483540 - protein, 19 aa, Entamoeba dispar
GKIFGELSLALNNNALVSD

SEQ ID NO: 2483541 - protein, 25 aa, Entamoeba dispar
GKIFKEVIWYKVDYSTYLKEKETGN

SEQ ID NO: 2483542 - protein, 24 aa, Entamoeba dispar
GKIFKKIIWYKVDYSTYLKEKEQG

SEQ ID NO: 2483543 - protein, 20 aa, Entamoeba dispar
GKIFKKRKKNEISVNIEYTQ

SEQ ID NO: 2483544 - protein, 23 aa, Entamoeba dispar
GKIFKKVIWYKVSYSTYLQEKEQ

SEQ ID NO: 2483545 - protein, 20 aa, Entamoeba dispar
GKIFKKVIWYLVDYSTYLKE

SEQ ID NO: 2483546 - protein, 20 aa, Entamoeba dispar
GKIFKKVIWYLVKDRYTYGN

SEQ ID NO: 2483547 - protein, 20 aa, Entamoeba dispar
GKIFKKVIWYLVNYSTYLKE

SEQ ID NO: 2483548 - protein, 18 aa, Entamoeba dispar
GKIFKQLIWYPVSYDEFL

SEQ ID NO: 2483549 - protein, 20 aa, Entamoeba dispar
GKIFKQVIWYQVDYLTYLQE

SEQ ID NO: 2483550 - protein, 18 aa, Entamoeba dispar
GKIFKYIIWYKVSYSTHL

SEQ ID NO: 2483551 - protein, 19 aa, Entamoeba dispar
GKIFKYVIWYEVNYSTYLK

SEQ ID NO: 2483552 - protein, 23 aa, Entamoeba dispar
GKIFKYVIWYLVEYSKYLQEKEK

SEQ ID NO: 2483553 - protein, 20 aa, Entamoeba dispar
GKIFKYVIWYTIGYSRYLQE

SEQ ID NO: 2483554 - protein, 18 aa, Entamoeba dispar
GKIFRILDDINWSEVKST

SEQ ID NO: 2483555 - protein, 17 aa, Entamoeba dispar
GKIGYKNAISYLDLPLN

SEQ ID NO: 2483556 - protein, 18 aa, Entamoeba dispar
GKIHLLEFFAIKAEYVQE

SEQ ID NO: 2483557 - protein, 20 aa, Entamoeba dispar
GKIIFCCYNLTDLNIYSKFL

SEQ ID NO: 2483558 - protein, 25 aa, Entamoeba dispar
GKIIKQVIWYKVEYSRYSKEKEQGN

SEQ ID NO: 2483559 - protein, 22 aa, Entamoeba dispar
GKIINQYLCELFVSSRITVKKN

SEQ ID NO: 2483560 - protein, 23 aa, Entamoeba dispar
GKIKARWMRKNARRLDIEHYTRT

SEQ ID NO: 2483561 - protein, 23 aa, Entamoeba dispar
GKIKARWMRKNARRLDIETYARS

SEQ ID NO: 2483562 - protein, 25 aa, Entamoeba dispar
GKIKARWMRKNARRLDVEQYTRTDL

SEQ ID NO: 2483563 - protein, 29 aa, Entamoeba dispar
GKIKDICRICLKGGVAVVGVGFPACTPTS

SEQ ID NO: 2483564 - protein, 24 aa, Entamoeba dispar
GKIKSRWLRKNARRIDMENYTKED

SEQ ID NO: 2483565 - protein, 24 aa, Entamoeba dispar
GKIKSRWMRKNARRLDIENYTRND

SEQ ID NO: 2483566 - protein, 21 aa, Entamoeba dispar
GKILPKLLIRTLFYNIDQVMT

SEQ ID NO: 2483567 - protein, 24 aa, Entamoeba dispar
GKILSELHIDCNFNGKLIGIEENP

SEQ ID NO: 2483568 - protein, 24 aa, Entamoeba dispar
GKIMRSCIGSNCFESLIEHMPEQL

SEQ ID NO: 2483569 - protein, 20 aa, Entamoeba dispar
GKIPLISKFFRDVSLIDPQS

SEQ ID NO: 2483570 - protein, 17 aa, Entamoeba dispar
GKIRYNLIHNIKGTILA

SEQ ID NO: 2483571 - protein, 18 aa, Entamoeba dispar
GKISENVGCLRDVTQSKL

SEQ ID NO: 2483572 - protein, 23 aa, Entamoeba dispar
GKISRQSFFYIILEFIKNQTNCE

SEQ ID NO: 2483573 - protein, 34 aa, Entamoeba dispar
GKISRRTVSGPKGRRRPTMKKVQFDEHTERLIKE

SEQ ID NO: 2483574 - protein, 25 aa, Entamoeba dispar
GKISYEEFCSIILKNSENIGEKLTI

SEQ ID NO: 2483575 - protein, 23 aa, Entamoeba dispar
GKITCSVLFFLKSIVLSLEKECN

SEQ ID NO: 2483576 - protein, 22 aa, Entamoeba dispar
GKIYDCLSMETSYFTKISLKDQ

SEQ ID NO: 2483577 - protein, 21 aa, Entamoeba dispar
GKKCFYKCSSITRIDIAKIHY

SEQ ID NO: 2483578 - protein, 17 aa, Entamoeba dispar
GKKCSRKEWELLKMLAN

SEQ ID NO: 2483579 - protein, 17 aa, Entamoeba dispar
GKKECPEGYRVINNIGE

SEQ ID NO: 2483580 - protein, 22 aa, Entamoeba dispar
GKKGICKIDIAYKVYNKNKLMF

SEQ ID NO: 2483581 - protein, 17 aa, Entamoeba dispar
GKKGVASAEAMLKKLEE

SEQ ID NO: 2483582 - protein, 27 aa, Entamoeba dispar
GKKIIGNSCTLMICLDSFIVKKGNEIE

SEQ ID NO: 2483583 - protein, 17 aa, Entamoeba dispar
GKKKIAWKEEEDTRLIQ

SEQ ID NO: 2483584 - protein, 27 aa, Entamoeba dispar
GKKLHINFSYISRLCDMDGSYQNIRNY

SEQ ID NO: 2483585 - protein, 24 aa, Entamoeba dispar
GKKQFHASEPIEWDNVKKVSHPVE

SEQ ID NO: 2483586 - protein, 25 aa, Entamoeba dispar
GKKRAFSCFVIGGLDNSLSVWVARK

SEQ ID NO: 2483587 - protein, 28 aa, Entamoeba dispar
GKKRKPVVGCFFELLVLKTQGVIDLQQQ

SEQ ID NO: 2483588 - protein, 19 aa, Entamoeba dispar
GKKVGKLEVGYILFNAFKS

SEQ ID NO: 2483589 - protein, 19 aa, Entamoeba dispar
GKKVYCGLLKQRTNPKGIN

SEQ ID NO: 2483590 - protein, 24 aa, Entamoeba dispar
GKLFKEIIWYKVDYSTYLKEKEAG

SEQ ID NO: 2483591 - protein, 17 aa, Entamoeba dispar
GKLFYVYHNNIYLNEPI

SEQ ID NO: 2483592 - protein, 20 aa, Entamoeba dispar
GKLGKGIYMYRTYKEAIKKN

SEQ ID NO: 2483593 - protein, 23 aa, Entamoeba dispar
GKLIKKLMIRYSKYNNKYDNNIP

SEQ ID NO: 2483594 - protein, 23 aa, Entamoeba dispar
GKLKKSECGFIPQSVTALTVLCG

SEQ ID NO: 2483595 - protein, 17 aa, Entamoeba dispar
GKLKYILNGGAPLTEEL

SEQ ID NO: 2483596 - protein, 21 aa, Entamoeba dispar
GKLLHYKREYFGGAVTAICSC

SEQ ID NO: 2483597 - protein, 18 aa, Entamoeba dispar
GKLLKPISLLISGMENSI

SEQ ID NO: 2483598 - protein, 18 aa, Entamoeba dispar
GKLLLKGYKPGMKVCTRF

SEQ ID NO: 2483599 - protein, 17 aa, Entamoeba dispar
GKLRGNVYYVDCNNEDI

SEQ ID NO: 2483600 - protein, 20 aa, Entamoeba dispar
GKLVEQWYQLLIKYWSGYST

SEQ ID NO: 2483601 - protein, 18 aa, Entamoeba dispar
GKMAPECNTNARLLVEYF

SEQ ID NO: 2483602 - protein, 18 aa, Entamoeba dispar
GKMIELMAIFNSKLNPQF

SEQ ID NO: 2483603 - protein, 23 aa, Entamoeba dispar
GKMPLQRLGDLLSIVEEGAKTIG

SEQ ID NO: 2483604 - protein, 17 aa, Entamoeba dispar
GKMRILNTLQEYLDYRL

SEQ ID NO: 2483605 - protein, 20 aa, Entamoeba dispar
GKNAFGVLCEFAVRLYSTDL

SEQ ID NO: 2483606 - protein, 21 aa, Entamoeba dispar
GKNCFYECICADMLKENGAVP

SEQ ID NO: 2483607 - protein, 19 aa, Entamoeba dispar
GKNIFEYNYIFLPFHQNSH

SEQ ID NO: 2483608 - protein, 24 aa, Entamoeba dispar
GKNKKEIGCIISSMKQKEKLKVIK

SEQ ID NO: 2483609 - protein, 17 aa, Entamoeba dispar
GKNLILFNEKKGESIVT

SEQ ID NO: 2483610 - protein, 23 aa, Entamoeba dispar
GKNNTCPVCDILMNGADYMNVTC

SEQ ID NO: 2483611 - protein, 20 aa, Entamoeba dispar
GKNSELMWCKLIGNDPVVFG

SEQ ID NO: 2483612 - protein, 24 aa, Entamoeba dispar
GKNSIEVITLLLLYKLKYPHSIFL

SEQ ID NO: 2483613 - protein, 18 aa, Entamoeba dispar
GKNSYYKRESCASVCIAG

SEQ ID NO: 2483614 - protein, 19 aa, Entamoeba dispar
GKPFVMCLINSDPSSNKIH

SEQ ID NO: 2483615 - protein, 25 aa, Entamoeba dispar
GKPIPPPRPGNRDALSHHHSDVPLP

SEQ ID NO: 2483616 - protein, 18 aa, Entamoeba dispar
GKPLELWNIDSLEDTTPL

SEQ ID NO: 2483617 - protein, 24 aa, Entamoeba dispar
GKPLNPIMLWYSEHRYRETYITSN

SEQ ID NO: 2483618 - protein, 17 aa, Entamoeba dispar
GKQCYLLNMLLETKEWT

SEQ ID NO: 2483619 - protein, 19 aa, Entamoeba dispar
GKQGWTISFLPLTSSVTNV

SEQ ID NO: 2483620 - protein, 17 aa, Entamoeba dispar
GKQIVLWMTEIAQEMKA

SEQ ID NO: 2483621 - protein, 22 aa, Entamoeba dispar
GKQKIRMVKDLKSELKKSKISG

SEQ ID NO: 2483622 - protein, 25 aa, Entamoeba dispar
GKQKVFKVNQEWTVSQIYALVKKET

SEQ ID NO: 2483623 - protein, 17 aa, Entamoeba dispar
GKQLIVFYGKDASKAKR

SEQ ID NO: 2483624 - protein, 31 aa, Entamoeba dispar
GKQLKAMDIRSSDPYVIVSVGIEQRKTKTVT

SEQ ID NO: 2483625 - protein, 18 aa, Entamoeba dispar
GKQLWSYCHKNFISDIQW

SEQ ID NO: 2483626 - protein, 19 aa, Entamoeba dispar
GKQTFRLLFDSSRDGLLPA

SEQ ID NO: 2483627 - protein, 18 aa, Entamoeba dispar
GKQTKFRCVVTDKDNNQI

SEQ ID NO: 2483628 - protein, 18 aa, Entamoeba dispar
GKQYIRLAGLRDDISNNN

SEQ ID NO: 2483629 - protein, 22 aa, Entamoeba dispar
GKRIEECSGHFAVINLELPVFH

SEQ ID NO: 2483630 - protein, 26 aa, Entamoeba dispar
GKRLEIPSGCLFSEVIERCWQQDPRD

SEQ ID NO: 2483631 - protein, 19 aa, Entamoeba dispar
GKRRIGYNEIMITSKYFND

SEQ ID NO: 2483632 - protein, 22 aa, Entamoeba dispar
GKRRKETVCLVEVLEDYPDNHV

SEQ ID NO: 2483633 - protein, 22 aa, Entamoeba dispar
GKRWSKSVMDMGYEVLVVSQFT

SEQ ID NO: 2483634 - protein, 29 aa, Entamoeba dispar
GKSAEELWNYVELFGSLELENGKEGNDLD

SEQ ID NO: 2483635 - protein, 24 aa, Entamoeba dispar
GKSESRGFGYLDFFNINEAQRCID

SEQ ID NO: 2483636 - protein, 17 aa, Entamoeba dispar
GKSGGTIFRCIWCSLFV

SEQ ID NO: 2483637 - protein, 27 aa, Entamoeba dispar
GKSIFKLELPQIISFTINCSILAISTS

SEQ ID NO: 2483638 - protein, 20 aa, Entamoeba dispar
GKSKGYGFVTFIRKEDAETA

SEQ ID NO: 2483639 - protein, 18 aa, Entamoeba dispar
GKSLCIWNSSCRVYTFTV

SEQ ID NO: 2483640 - protein, 17 aa, Entamoeba dispar
GKSNIGKYFGIIEDIVV

SEQ ID NO: 2483641 - protein, 22 aa, Entamoeba dispar
GKSNLLLRFTRDEFDPEKKSTI

SEQ ID NO: 2483642 - protein, 23 aa, Entamoeba dispar
GKSNLLLRFTRNEFDAEKRSTIG

SEQ ID NO: 2483643 - protein, 23 aa, Entamoeba dispar
GKSNLLLRFTRNEFEPEKKFTIG

SEQ ID NO: 2483644 - protein, 23 aa, Entamoeba dispar
GKSQLRFVLMPTGLFQFAANETL

SEQ ID NO: 2483645 - protein, 19 aa, Entamoeba dispar
GKSSFLLSILGELEQSKGE

SEQ ID NO: 2483646 - protein, 18 aa, Entamoeba dispar
GKSTLMRVIATRNVAIPD

SEQ ID NO: 2483647 - protein, 17 aa, Entamoeba dispar
GKSTSIQLIERFYEPTN

SEQ ID NO: 2483648 - protein, 24 aa, Entamoeba dispar
GKSVEELRSTFGITNDFTKEEEAE

SEQ ID NO: 2483649 - protein, 20 aa, Entamoeba dispar
GKTAAFSIGVLQQIDTNSKV

SEQ ID NO: 2483650 - protein, 25 aa, Entamoeba dispar
GKTCLYNIWRGLSIPDEYIKTTEME

SEQ ID NO: 2483651 - protein, 29 aa, Entamoeba dispar
GKTEFAIQEIFLKFNTFMLRGDSLFDAYD

SEQ ID NO: 2483652 - protein, 19 aa, Entamoeba dispar
GKTEFAIQEIFMKYNTFLL

SEQ ID NO: 2483653 - protein, 22 aa, Entamoeba dispar
GKTEFAIQEIFMKYNTFLLRGD

SEQ ID NO: 2483654 - protein, 19 aa, Entamoeba dispar
GKTEFAIQEIFMKYPTFML

SEQ ID NO: 2483655 - protein, 17 aa, Entamoeba dispar
GKTGLVLSSAGKGWINV

SEQ ID NO: 2483656 - protein, 17 aa, Entamoeba dispar
GKTIDITDLKEWIKKYW

SEQ ID NO: 2483657 - protein, 19 aa, Entamoeba dispar
GKTLAFLIPIVEILNKIHF

SEQ ID NO: 2483658 - protein, 18 aa, Entamoeba dispar
GKTLPQWLSQKKKKELRK

SEQ ID NO: 2483659 - protein, 19 aa, Entamoeba dispar
GKTSLITRYINDIYFDSKL

SEQ ID NO: 2483660 - protein, 18 aa, Entamoeba dispar
GKTSLLLRYCDSTFSTTY

SEQ ID NO: 2483661 - protein, 20 aa, Entamoeba dispar
GKTSLVRRFLEDKFIEESTP

SEQ ID NO: 2483662 - protein, 19 aa, Entamoeba dispar
GKTTCLNMIGLIDKPSHGK

SEQ ID NO: 2483663 - protein, 18 aa, Entamoeba dispar
GKTTLCKLIKGYFEKSFI

SEQ ID NO: 2483664 - protein, 23 aa, Entamoeba dispar
GKTYVCTLNGLYVFTQCDNESIQ

SEQ ID NO: 2483665 - protein, 21 aa, Entamoeba dispar
GKVCYCDSCKGVVKPDIVFFG

SEQ ID NO: 2483666 - protein, 25 aa, Entamoeba dispar
GKVEFPLSLPSLFIKMERNLLNPNV

SEQ ID NO: 2483667 - protein, 18 aa, Entamoeba dispar
GKVHFKRYDVGEIAAKIA

SEQ ID NO: 2483668 - protein, 19 aa, Entamoeba dispar
GKVKDFISIMIINSKQISN

SEQ ID NO: 2483669 - protein, 24 aa, Entamoeba dispar
GKVKRTKLLVLLGETRIGKSEFIN

SEQ ID NO: 2483670 - protein, 20 aa, Entamoeba dispar
GKVKVLAKVGEMKRSVMVQS

SEQ ID NO: 2483671 - protein, 20 aa, Entamoeba dispar
GKVNQMIAAINLCKDFHSVN

SEQ ID NO: 2483672 - protein, 19 aa, Entamoeba dispar
GKVQVCSWNPIDGSVLATG

SEQ ID NO: 2483673 - protein, 25 aa, Entamoeba dispar
GKVSMLGFCKKYKFLEEKQKEEANE

SEQ ID NO: 2483674 - protein, 20 aa, Entamoeba dispar
GKVSVHVIVKFAGKKEIKKE

SEQ ID NO: 2483675 - protein, 20 aa, Entamoeba dispar
GKVTCLYCTFDADKKEKPKG

SEQ ID NO: 2483676 - protein, 20 aa, Entamoeba dispar
GKVTGFGKCFGMRYEKGGLY

SEQ ID NO: 2483677 - protein, 34 aa, Entamoeba dispar
GKVWHHECFICAKCGGKISGGFVNWDGKPVCKNC

SEQ ID NO: 2483678 - protein, 25 aa, Entamoeba dispar
GKVWRMRACCIAFVNLAKVGAMTEL

SEQ ID NO: 2483679 - protein, 17 aa, Entamoeba dispar
GKYDVISSYQIVGTFEI

SEQ ID NO: 2483680 - protein, 19 aa, Entamoeba dispar
GKYEEAIELFKKCHKKEQR

SEQ ID NO: 2483681 - protein, 23 aa, Entamoeba dispar
GKYFIEVFKACGIQEGAAEFVWA

SEQ ID NO: 2483682 - protein, 21 aa, Entamoeba dispar
GKYFNKLEHIFSINQNHRNYR

SEQ ID NO: 2483683 - protein, 22 aa, Entamoeba dispar
GKYFTTSCIMRGKVSTHDVEEQ

SEQ ID NO: 2483684 - protein, 18 aa, Entamoeba dispar
GKYGRFFHDSCPQVVPEC

SEQ ID NO: 2483685 - protein, 22 aa, Entamoeba dispar
GKYGRFKGIYGIPENVDIKNII

SEQ ID NO: 2483686 - protein, 26 aa, Entamoeba dispar
GKYGTSPFILCRYGFGDVAQGFSRSS

SEQ ID NO: 2483687 - protein, 22 aa, Entamoeba dispar
GKYNNSQSFSWYNGQQALELAE

SEQ ID NO: 2483688 - protein, 22 aa, Entamoeba dispar
GKYPICCECLIKQLIDNEQYYR

SEQ ID NO: 2483689 - protein, 24 aa, Entamoeba dispar
GKYQKCLCASLFFCQNRNGVIGIG

SEQ ID NO: 2483690 - protein, 19 aa, Entamoeba dispar
GKYYGVWWGCKLVFDCMKY

SEQ ID NO: 2483691 - protein, 19 aa, Entamoeba dispar
GLAAASFFARCNFKKIVVF

SEQ ID NO: 2483692 - protein, 18 aa, Entamoeba dispar
GLALIVRCYPGFQATMIY

SEQ ID NO: 2483693 - protein, 19 aa, Entamoeba dispar
GLCGDIVKLIGYICAATLR

SEQ ID NO: 2483694 - protein, 17 aa, Entamoeba dispar
GLCGDSGVGKTGIFKRY

SEQ ID NO: 2483695 - protein, 18 aa, Entamoeba dispar
GLCSATIALSSKRFIDAD

SEQ ID NO: 2483696 - protein, 32 aa, Entamoeba dispar
GLDEMRESIKYIYELILSPPLSDRFTTFMELV

SEQ ID NO: 2483697 - protein, 19 aa, Entamoeba dispar
GLDFDEMMKQLDIPTDSNV

SEQ ID NO: 2483698 - protein, 18 aa, Entamoeba dispar
GLDFEDGESEFFNITKES

SEQ ID NO: 2483699 - protein, 34 aa, Entamoeba dispar
GLDKTAFVKYKWTSEIFDPAYFIVVIDSLKTISV

SEQ ID NO: 2483700 - protein, 25 aa, Entamoeba dispar
GLDLLRDILESFGYFFNTKKSSGKK

SEQ ID NO: 2483701 - protein, 17 aa, Entamoeba dispar
GLDRACLINGEEIIDCI

SEQ ID NO: 2483702 - protein, 17 aa, Entamoeba dispar
GLDVVRREWCPLSKEIG

SEQ ID NO: 2483703 - protein, 17 aa, Entamoeba dispar
GLDWRITPFRVISTGNT

SEQ ID NO: 2483704 - protein, 22 aa, Entamoeba dispar
GLEDLKKALLLTVVGAPTRRMK

SEQ ID NO: 2483705 - protein, 18 aa, Entamoeba dispar
GLEELKGMFPNIDSKLIE

SEQ ID NO: 2483706 - protein, 19 aa, Entamoeba dispar
GLEHIEFPDTLDIIGEECF

SEQ ID NO: 2483707 - protein, 23 aa, Entamoeba dispar
GLEKCNIHVKALYDYTAEAESEL

SEQ ID NO: 2483708 - protein, 18 aa, Entamoeba dispar
GLEKRLPDIKKYFPENCQ

SEQ ID NO: 2483709 - protein, 28 aa, Entamoeba dispar
GLELRNCFLACYRRLLNLRVSSRVIDQV

SEQ ID NO: 2483710 - protein, 27 aa, Entamoeba dispar
GLESPKLWLQNDILNFMIHKLGILDKQ

SEQ ID NO: 2483711 - protein, 22 aa, Entamoeba dispar
GLEVFEGKEVVLKWKRGKKDTN

SEQ ID NO: 2483712 - protein, 20 aa, Entamoeba dispar
GLEVTCSASAITQPQGATAS

SEQ ID NO: 2483713 - protein, 20 aa, Entamoeba dispar
GLEYFLLIFHGDFTKTTEYI

SEQ ID NO: 2483714 - protein, 18 aa, Entamoeba dispar
GLFAELNKGTAISGGLKH

SEQ ID NO: 2483715 - protein, 23 aa, Entamoeba dispar
GLFDEVYKIFSQVEKKVGAHEGR

SEQ ID NO: 2483716 - protein, 29 aa, Entamoeba dispar
GLFIRYCSFIRKWLKWNIVKENDDNSFNQ

SEQ ID NO: 2483717 - protein, 20 aa, Entamoeba dispar
GLFKEHLLEYIVSKEPSLKP

SEQ ID NO: 2483718 - protein, 21 aa, Entamoeba dispar
GLFKRALQIFEEFDDIRRVLA

SEQ ID NO: 2483719 - protein, 18 aa, Entamoeba dispar
GLFNIAFDTLKLAYVNES

SEQ ID NO: 2483720 - protein, 19 aa, Entamoeba dispar
GLFRRLPIPLIPSNINSKI

SEQ ID NO: 2483721 - protein, 23 aa, Entamoeba dispar
GLFSIEYFISIVIIDSDSRRFFS

SEQ ID NO: 2483722 - protein, 21 aa, Entamoeba dispar
GLFYNCGFKEFDVPKGVSAIG

SEQ ID NO: 2483723 - protein, 19 aa, Entamoeba dispar
GLGCKTYGVFCFPLEAVVK

SEQ ID NO: 2483724 - protein, 26 aa, Entamoeba dispar
GLGNLKWIVVGKLFGLRAIIGNSSDS

SEQ ID NO: 2483725 - protein, 25 aa, Entamoeba dispar
GLGPQRLTSIMPRYITPKDIMYVGI

SEQ ID NO: 2483726 - protein, 24 aa, Entamoeba dispar
GLHGSFGCCIWFEKQKICECVTQI

SEQ ID NO: 2483727 - protein, 20 aa, Entamoeba dispar
GLIEGLAFSSFVIQYYGLIL

SEQ ID NO: 2483728 - protein, 25 aa, Entamoeba dispar
GLIELNRCRKLFGQIMIALEYVHDN

SEQ ID NO: 2483729 - protein, 18 aa, Entamoeba dispar
GLIGLPLPLFQLLPNDFE

SEQ ID NO: 2483730 - protein, 21 aa, Entamoeba dispar
GLIKLFCRLINGININCGYYE

SEQ ID NO: 2483731 - protein, 19 aa, Entamoeba dispar
GLIKLIEHVIRYSFKKDSI

SEQ ID NO: 2483732 - protein, 19 aa, Entamoeba dispar
GLIQRKWYDDVVFKNQAKE

SEQ ID NO: 2483733 - protein, 21 aa, Entamoeba dispar
GLISFVLKAGISFEMGKDWLK

SEQ ID NO: 2483734 - protein, 17 aa, Entamoeba dispar
GLITKELIVMLSSTEES

SEQ ID NO: 2483735 - protein, 18 aa, Entamoeba dispar
GLIVKYAILKGGKFEILR

SEQ ID NO: 2483736 - protein, 22 aa, Entamoeba dispar
GLKEFVTNCARQILTEQRYLDD

SEQ ID NO: 2483737 - protein, 26 aa, Entamoeba dispar
GLKENVRGFGWKKCLGGSYEELYVPS

SEQ ID NO: 2483738 - protein, 25 aa, Entamoeba dispar
GLKEVMIQAVKVCVGNGHTKTSTPT

SEQ ID NO: 2483739 - protein, 18 aa, Entamoeba dispar
GLKNGMGGAGGFPGGFSF

SEQ ID NO: 2483740 - protein, 24 aa, Entamoeba dispar
GLKPYMESLFTFFKENIQYFKNCR

SEQ ID NO: 2483741 - protein, 20 aa, Entamoeba dispar
GLKRGIKYLLLKYGFECIRA

SEQ ID NO: 2483742 - protein, 22 aa, Entamoeba dispar
GLKYLFCGTPIKTGLQLCEMNP

SEQ ID NO: 2483743 - protein, 18 aa, Entamoeba dispar
GLLATFGYELKINKLYKK

SEQ ID NO: 2483744 - protein, 17 aa, Entamoeba dispar
GLLEFFLKKNLNKSVKK

SEQ ID NO: 2483745 - protein, 19 aa, Entamoeba dispar
GLLEQIRQGKKLKKVETVD

SEQ ID NO: 2483746 - protein, 22 aa, Entamoeba dispar
GLLKECKENLISLMTDKFGHYC

SEQ ID NO: 2483747 - protein, 17 aa, Entamoeba dispar
GLLKQIVKSGVHHQGSY

SEQ ID NO: 2483748 - protein, 17 aa, Entamoeba dispar
GLLLPKRKDIWYYFNKV

SEQ ID NO: 2483749 - protein, 21 aa, Entamoeba dispar
GLLNEVFHVIYIPLLRHPIIF

SEQ ID NO: 2483750 - protein, 20 aa, Entamoeba dispar
GLLNIKGIKFVNAVISVMYN

SEQ ID NO: 2483751 - protein, 19 aa, Entamoeba dispar
GLLQLSSWRSYLHQIAMVV

SEQ ID NO: 2483752 - protein, 25 aa, Entamoeba dispar
GLLSCAKKIVEWAQYISSALMNGEP

SEQ ID NO: 2483753 - protein, 29 aa, Entamoeba dispar
GLLSIKSNCFRHCNKLAFIELPSRLEVIG

SEQ ID NO: 2483754 - protein, 17 aa, Entamoeba dispar
GLLWQLIDYDLRKTLGS

SEQ ID NO: 2483755 - protein, 22 aa, Entamoeba dispar
GLLYCIKPTMFSTIKHKYFYIE

SEQ ID NO: 2483756 - protein, 24 aa, Entamoeba dispar
GLMFCPELFKKVDFIEKLSSGIVT

SEQ ID NO: 2483757 - protein, 23 aa, Entamoeba dispar
GLMLPETTGFCLMQKKNLYVPGS

SEQ ID NO: 2483758 - protein, 21 aa, Entamoeba dispar
GLMTEEIPLYIELERNGFEKI

SEQ ID NO: 2483759 - protein, 20 aa, Entamoeba dispar
GLMVEIRGLDLLVFTDQMGL

SEQ ID NO: 2483760 - protein, 17 aa, Entamoeba dispar
GLNDLGVRELVYKLSFI

SEQ ID NO: 2483761 - protein, 17 aa, Entamoeba dispar
GLNLFAFKETGRLLNQL

SEQ ID NO: 2483762 - protein, 20 aa, Entamoeba dispar
GLNMKIEIIAAYISIKEKEK

SEQ ID NO: 2483763 - protein, 31 aa, Entamoeba dispar
GLNVELLKDFILEEVDRCFITDHIIISLIQN

SEQ ID NO: 2483764 - protein, 22 aa, Entamoeba dispar
GLNWDEMKQFFNTESLGKMKES

SEQ ID NO: 2483765 - protein, 19 aa, Entamoeba dispar
GLPKPDIVFFLELSLEDAE

SEQ ID NO: 2483766 - protein, 25 aa, Entamoeba dispar
GLPQMIFECIKKCPLTSRRPLLNHI

SEQ ID NO: 2483767 - protein, 24 aa, Entamoeba dispar
GLRRVLPYFYIFKVNAKGRWIGRT

SEQ ID NO: 2483768 - protein, 17 aa, Entamoeba dispar
GLSAVAHLFGERRKLEI

SEQ ID NO: 2483769 - protein, 23 aa, Entamoeba dispar
GLSCGHYYCKNCWREYIEEAMKR

SEQ ID NO: 2483770 - protein, 26 aa, Entamoeba dispar
GLSKALRPLAWKIFLKVIKPQASEEW

SEQ ID NO: 2483771 - protein, 25 aa, Entamoeba dispar
GLSKRLKSIMKMMSKTYLVYGHMRW

SEQ ID NO: 2483772 - protein, 24 aa, Entamoeba dispar
GLSKYKIIFDSCIDHLVTDVFNQK

SEQ ID NO: 2483773 - protein, 20 aa, Entamoeba dispar
GLSPQFYFDICMIYNEDSSV

SEQ ID NO: 2483774 - protein, 23 aa, Entamoeba dispar
GLSPRRRGNSSGEYEKLKNENII

SEQ ID NO: 2483775 - protein, 18 aa, Entamoeba dispar
GLSQFAVIVSHLEPVCMH

SEQ ID NO: 2483776 - protein, 19 aa, Entamoeba dispar
GLSSDPYCKVISRQCTQQT

SEQ ID NO: 2483777 - protein, 18 aa, Entamoeba dispar
GLSVIFERLYLFILNSSL

SEQ ID NO: 2483778 - protein, 19 aa, Entamoeba dispar
GLTACSFNTLLKGKENILL

SEQ ID NO: 2483779 - protein, 18 aa, Entamoeba dispar
GLTHFPYIYDFIIPLCER

SEQ ID NO: 2483780 - protein, 17 aa, Entamoeba dispar
GLTKYIVVEVCYEDDSV

SEQ ID NO: 2483781 - protein, 20 aa, Entamoeba dispar
GLTSIFLNYFFDTTIVHMAP

SEQ ID NO: 2483782 - protein, 18 aa, Entamoeba dispar
GLVEKAMYTYYCMDNRNN

SEQ ID NO: 2483783 - protein, 25 aa, Entamoeba dispar
GLVFVCPTCESFCCNRLASKKDGKL

SEQ ID NO: 2483784 - protein, 25 aa, Entamoeba dispar
GLVIEMIRMYGIRACELGPFGFEWD

SEQ ID NO: 2483785 - protein, 26 aa, Entamoeba dispar
GLVKPTVLVLFPFKTPAIIFIKTLLT

SEQ ID NO: 2483786 - protein, 21 aa, Entamoeba dispar
GLVPLLRLAWNHFDPNFIATF

SEQ ID NO: 2483787 - protein, 23 aa, Entamoeba dispar
GLVSFKSYWSGVIAEELLNSTEI

SEQ ID NO: 2483788 - protein, 19 aa, Entamoeba dispar
GLVTIRIENEFGQSDSCVD

SEQ ID NO: 2483789 - protein, 26 aa, Entamoeba dispar
GLVVGRRDFVHFRRIRGPEGIDKKKE

SEQ ID NO: 2483790 - protein, 32 aa, Entamoeba dispar
GLVYSNLWRYWCPWLMWFVSPFFKIFWKTPEE

SEQ ID NO: 2483791 - protein, 17 aa, Entamoeba dispar
GLYCLVQPNTPYEIIYE

SEQ ID NO: 2483792 - protein, 18 aa, Entamoeba dispar
GLYGFSIGTIEGMYNSHG

SEQ ID NO: 2483793 - protein, 25 aa, Entamoeba dispar
GLYLTRVPWKISINQFAPAVKIKYL

SEQ ID NO: 2483794 - protein, 18 aa, Entamoeba dispar
GLYYRGAAVVTPVFSLRT

SEQ ID NO: 2483795 - protein, 25 aa, Entamoeba dispar
GMCCFKRCYFLKEVICDQIQEIDKD

SEQ ID NO: 2483796 - protein, 19 aa, Entamoeba dispar
GMCLLEIFQQHEIYQDKPF

SEQ ID NO: 2483797 - protein, 35 aa, Entamoeba dispar
GMEFLKEWLAAPSFQEWKERVIIDNALKLNIQHPG

SEQ ID NO: 2483798 - protein, 19 aa, Entamoeba dispar
GMFRSCVPSGASTGVHEAV

SEQ ID NO: 2483799 - protein, 23 aa, Entamoeba dispar
GMFSPRSRSEMRFREKRREEEQE

SEQ ID NO: 2483800 - protein, 30 aa, Entamoeba dispar
GMGIDRGDVRFVIHWNIPKTIEGFMQEAGR

SEQ ID NO: 2483801 - protein, 18 aa, Entamoeba dispar
GMISLGFEKMWTKLVNSN

SEQ ID NO: 2483802 - protein, 27 aa, Entamoeba dispar
GMISYNRVRILFKFIVSILKVKSYDNL

SEQ ID NO: 2483803 - protein, 26 aa, Entamoeba dispar
GMKHPCILDLKMGCRTWFEDSSPEKI

SEQ ID NO: 2483804 - protein, 30 aa, Entamoeba dispar
GMKLMIGSIYLFKTIKGIEVIEGKECNEEE

SEQ ID NO: 2483805 - protein, 22 aa, Entamoeba dispar
GMKLRPLSVFAPLHYFELPELL

SEQ ID NO: 2483806 - protein, 20 aa, Entamoeba dispar
GMKMKEFQRGSSPAEILNLS

SEQ ID NO: 2483807 - protein, 20 aa, Entamoeba dispar
GMKQRFIKEITILSPPTIQI

SEQ ID NO: 2483808 - protein, 26 aa, Entamoeba dispar
GMKRKEEWHPYLLFCKEHREELKQEG

SEQ ID NO: 2483809 - protein, 19 aa, Entamoeba dispar
GMLEYLKFFNIHKIIPIFV

SEQ ID NO: 2483810 - protein, 24 aa, Entamoeba dispar
GMLGKYRLNSVVNHRGTLNNGHYY

SEQ ID NO: 2483811 - protein, 31 aa, Entamoeba dispar
GMLNKYCRKGIKKRVCFLFSDQVFIYGSPGV

SEQ ID NO: 2483812 - protein, 18 aa, Entamoeba dispar
GMMKCLYYNKAYPMPIRM

SEQ ID NO: 2483813 - protein, 18 aa, Entamoeba dispar
GMMYNCICLGNDGIEDIL

SEQ ID NO: 2483814 - protein, 24 aa, Entamoeba dispar
GMNHLKRIRRYEGQLEIIICKIEE

SEQ ID NO: 2483815 - protein, 23 aa, Entamoeba dispar
GMPEEIFNIASLQRLDFVGCNIT

SEQ ID NO: 2483816 - protein, 32 aa, Entamoeba dispar
GMPGMPPPPPGFGFRPPGAPALKVQTTLSKLK

SEQ ID NO: 2483817 - protein, 23 aa, Entamoeba dispar
GMPHDIRNVFVLTCNVSMEYEKS

SEQ ID NO: 2483818 - protein, 19 aa, Entamoeba dispar
GMPPPPPGMPGMPPPPPGF

SEQ ID NO: 2483819 - protein, 19 aa, Entamoeba dispar
GMPPPPPGMPGMPPPPPGG

SEQ ID NO: 2483820 - protein, 25 aa, Entamoeba dispar
GMPREFGGFSGFGMPQGGRYTFNTG

SEQ ID NO: 2483821 - protein, 19 aa, Entamoeba dispar
GMRNFGYFPICASGNKGAT

SEQ ID NO: 2483822 - protein, 18 aa, Entamoeba dispar
GMSCNGKNVLKCKDCNKY

SEQ ID NO: 2483823 - protein, 17 aa, Entamoeba dispar
GMSCNRAAGAMYLFPRI

SEQ ID NO: 2483824 - protein, 23 aa, Entamoeba dispar
GMSDLCGFLILILQEEEEVYWGF

SEQ ID NO: 2483825 - protein, 24 aa, Entamoeba dispar
GMSEIFYSLQVCVHLLIFYEECIS

SEQ ID NO: 2483826 - protein, 18 aa, Entamoeba dispar
GMSIKYLVPDSVINYITE

SEQ ID NO: 2483827 - protein, 27 aa, Entamoeba dispar
GMTEECQRMAFLIGLLNYRGVGLIIAR

SEQ ID NO: 2483828 - protein, 22 aa, Entamoeba dispar
GMTVKAGCRVRVPFGKQQERIG

SEQ ID NO: 2483829 - protein, 24 aa, Entamoeba dispar
GMVVSKFCCEICGTSSIHSEPFSL

SEQ ID NO: 2483830 - protein, 19 aa, Entamoeba dispar
GMYLKALPLLLNNIENLEN

SEQ ID NO: 2483831 - protein, 21 aa, Entamoeba dispar
GNAGLIQWLIKLSDFNIFARK

SEQ ID NO: 2483832 - protein, 27 aa, Entamoeba dispar
GNAIFREGYLLFFRISDVYFEELSKNY

SEQ ID NO: 2483833 - protein, 19 aa, Entamoeba dispar
GNAYLGLVHALAYKIANHF

SEQ ID NO: 2483834 - protein, 19 aa, Entamoeba dispar
GNCCICLEPITPSILAIQL

SEQ ID NO: 2483835 - protein, 24 aa, Entamoeba dispar
GNCHQRQALAYAFVAVSKGNEQYS

SEQ ID NO: 2483836 - protein, 20 aa, Entamoeba dispar
GNDGHTFNLIGILLELEKAV

SEQ ID NO: 2483837 - protein, 19 aa, Entamoeba dispar
GNDIIQTIVIPQKYRNQTV

SEQ ID NO: 2483838 - protein, 24 aa, Entamoeba dispar
GNDIRLVGRYELQRKLGEGSEGCV

SEQ ID NO: 2483839 - protein, 24 aa, Entamoeba dispar
GNDIYRIFCDILYQTIIYKDHRLF

SEQ ID NO: 2483840 - protein, 27 aa, Entamoeba dispar
GNDLIEWIKKIFIPHIHQIRKQKNYEG

SEQ ID NO: 2483841 - protein, 18 aa, Entamoeba dispar
GNDSMKFGDVTRVDEIPK

SEQ ID NO: 2483842 - protein, 19 aa, Entamoeba dispar
GNDVKKNFIAMLTFCDGKT

SEQ ID NO: 2483843 - protein, 19 aa, Entamoeba dispar
GNDVPEFEPYLPIEGSYIP

SEQ ID NO: 2483844 - protein, 17 aa, Entamoeba dispar
GNDVYLWIGTKASSTLR

SEQ ID NO: 2483845 - protein, 27 aa, Entamoeba dispar
GNECFYKCGIRSISIPITISRIGNNCF

SEQ ID NO: 2483846 - protein, 17 aa, Entamoeba dispar
GNECLFKCMSLVDIDID

SEQ ID NO: 2483847 - protein, 20 aa, Entamoeba dispar
GNECLYFYCSPYFSQQVKFT

SEQ ID NO: 2483848 - protein, 23 aa, Entamoeba dispar
GNEIKCIVHRKGATRAFAPLNPV

SEQ ID NO: 2483849 - protein, 23 aa, Entamoeba dispar
GNEKAWWKFAVEAIKKKRMNEEN

SEQ ID NO: 2483850 - protein, 19 aa, Entamoeba dispar
GNEKECYLILLSDFYRSVV

SEQ ID NO: 2483851 - protein, 21 aa, Entamoeba dispar
GNEKRTFVEFILEPIYKIVGI

SEQ ID NO: 2483852 - protein, 23 aa, Entamoeba dispar
GNEKTVRNFGKWLNKQKATHKIV

SEQ ID NO: 2483853 - protein, 18 aa, Entamoeba dispar
GNEMIWYFMKYIRESNKI

SEQ ID NO: 2483854 - protein, 17 aa, Entamoeba dispar
GNEMKKMNNVFNETSLK

SEQ ID NO: 2483855 - protein, 25 aa, Entamoeba dispar
GNERRIREFMKLKYQDKKWFDQAAY

SEQ ID NO: 2483856 - protein, 19 aa, Entamoeba dispar
GNEVIFDKQCEFWVKPEIK

SEQ ID NO: 2483857 - protein, 20 aa, Entamoeba dispar
GNFGVKSWILNNTQDKTRTS

SEQ ID NO: 2483858 - protein, 23 aa, Entamoeba dispar
GNFKNIFRGIDFVSVNDFNFACN

SEQ ID NO: 2483859 - protein, 19 aa, Entamoeba dispar
GNFPEWYSQIVVQSGLIEY

SEQ ID NO: 2483860 - protein, 25 aa, Entamoeba dispar
GNGAFGVVCKGMWLGTTPVAMKAID

SEQ ID NO: 2483861 - protein, 25 aa, Entamoeba dispar
GNGAFGVVCKGMWLGTTPVAMKAVN

SEQ ID NO: 2483862 - protein, 17 aa, Entamoeba dispar
GNGCFNGCMSLTSINIP

SEQ ID NO: 2483863 - protein, 20 aa, Entamoeba dispar
GNGCFSRCSLLTSINIPSSI

SEQ ID NO: 2483864 - protein, 23 aa, Entamoeba dispar
GNGCFYRCRCEKELKKNERIPID

SEQ ID NO: 2483865 - protein, 25 aa, Entamoeba dispar
GNGCFYRCRCEKELKKNERIPIDCF

SEQ ID NO: 2483866 - protein, 19 aa, Entamoeba dispar
GNGCYLVKVVDGILKGNCY

SEQ ID NO: 2483867 - protein, 20 aa, Entamoeba dispar
GNGGVMLPDVHIGRDAMVAS

SEQ ID NO: 2483868 - protein, 34 aa, Entamoeba dispar
GNGIKIRKEDIFTIGGSVMKYIKDTFGKNEENTV

SEQ ID NO: 2483869 - protein, 23 aa, Entamoeba dispar
GNGKGNEGSNEWVFGEMTNYVLS

SEQ ID NO: 2483870 - protein, 18 aa, Entamoeba dispar
GNGLFYLIDPKGGVNTID

SEQ ID NO: 2483871 - protein, 18 aa, Entamoeba dispar
GNGMIYWLTTGALKITQS

SEQ ID NO: 2483872 - protein, 24 aa, Entamoeba dispar
GNGNSALDVLVQWAEQHGMNSIIS

SEQ ID NO: 2483873 - protein, 24 aa, Entamoeba dispar
GNGTPLFIKVNLNIDLKENIEEQE

SEQ ID NO: 2483874 - protein, 25 aa, Entamoeba dispar
GNHETRLMCEYMTFLLECNNKYNMK

SEQ ID NO: 2483875 - protein, 25 aa, Entamoeba dispar
GNHETRMMTERMGFMKECQKKYNIN

SEQ ID NO: 2483876 - protein, 21 aa, Entamoeba dispar
GNHNPLDCKLQYDYIIKSQLY

SEQ ID NO: 2483877 - protein, 24 aa, Entamoeba dispar
GNIDRLGGFEAPPSFISVFVGEKL

SEQ ID NO: 2483878 - protein, 17 aa, Entamoeba dispar
GNIDSSCKLEYFNFNNE

SEQ ID NO: 2483879 - protein, 26 aa, Entamoeba dispar
GNIEIAFHISTWLPFMETNDQQLDKK

SEQ ID NO: 2483880 - protein, 33 aa, Entamoeba dispar
GNIENSCLFSHFSIDEIYGWQSFVSKKEYDEVW

SEQ ID NO: 2483881 - protein, 25 aa, Entamoeba dispar
GNIFVYEIINLVQIRSYGRMEISSI

SEQ ID NO: 2483882 - protein, 23 aa, Entamoeba dispar
GNIKSIRYEIELGKQELSRTRLI

SEQ ID NO: 2483883 - protein, 21 aa, Entamoeba dispar
GNILLAEAAAFEYRLTGKIEN

SEQ ID NO: 2483884 - protein, 21 aa, Entamoeba dispar
GNIPLIWKTKETDLFKPRGKF

SEQ ID NO: 2483885 - protein, 21 aa, Entamoeba dispar
GNIQQFLSLVFFIAKKSNTRI

SEQ ID NO: 2483886 - protein, 28 aa, Entamoeba dispar
GNKFRIELFTSHSLCDGRTIFNCFDVIR

SEQ ID NO: 2483887 - protein, 18 aa, Entamoeba dispar
GNKGAFALANLLKITKTL

SEQ ID NO: 2483888 - protein, 21 aa, Entamoeba dispar
GNKPNRCSYCGGTEFRNEQGS

SEQ ID NO: 2483889 - protein, 17 aa, Entamoeba dispar
GNLCGKETYDILRTLAR

SEQ ID NO: 2483890 - protein, 19 aa, Entamoeba dispar
GNLFGGFGNNASFGTSNIS

SEQ ID NO: 2483891 - protein, 17 aa, Entamoeba dispar
GNLFINYLYLLLKEYSY

SEQ ID NO: 2483892 - protein, 24 aa, Entamoeba dispar
GNLKEKITVLSLFVYDDIVDLSQF

SEQ ID NO: 2483893 - protein, 22 aa, Entamoeba dispar
GNLSRTSFKVMIYSMSDISISQ

SEQ ID NO: 2483894 - protein, 27 aa, Entamoeba dispar
GNLTLILGLLWTLILKYQIAQNKMDAS

SEQ ID NO: 2483895 - protein, 24 aa, Entamoeba dispar
GNMNIKFGVFDRVKGVLSIDKSNE

SEQ ID NO: 2483896 - protein, 18 aa, Entamoeba dispar
GNMSSGLLFNAFDIEQFP

SEQ ID NO: 2483897 - protein, 20 aa, Entamoeba dispar
GNMVSCLDFVESVFGNAGNP

SEQ ID NO: 2483898 - protein, 18 aa, Entamoeba dispar
GNNGGDGLVCGRYLSLFG

SEQ ID NO: 2483899 - protein, 19 aa, Entamoeba dispar
GNNIFGFTGEHHFLVMEYC

SEQ ID NO: 2483900 - protein, 21 aa, Entamoeba dispar
GNNKLRGIGLFIDTLLTVTEP

SEQ ID NO: 2483901 - protein, 24 aa, Entamoeba dispar
GNNLEFVDYLFLAMMIQIREPILE

SEQ ID NO: 2483902 - protein, 24 aa, Entamoeba dispar
GNNPKFWVNLCQSQDDFKIIINRE

SEQ ID NO: 2483903 - protein, 25 aa, Entamoeba dispar
GNNQLNFPLCFTIFGATHYSFKNKA

SEQ ID NO: 2483904 - protein, 19 aa, Entamoeba dispar
GNNYGFPCLIGAKKLKEDN

SEQ ID NO: 2483905 - protein, 25 aa, Entamoeba dispar
GNQAIKDYYLILATRCNKEDIVSLL

SEQ ID NO: 2483906 - protein, 23 aa, Entamoeba dispar
GNQCSCGKWISPAFQIATSKIDK

SEQ ID NO: 2483907 - protein, 18 aa, Entamoeba dispar
GNQPFVFDYIGFCNDFNT

SEQ ID NO: 2483908 - protein, 21 aa, Entamoeba dispar
GNRGRGRPSFGGRDQQPSGEL

SEQ ID NO: 2483909 - protein, 20 aa, Entamoeba dispar
GNRKKLYEGRNVVVLTYAVD

SEQ ID NO: 2483910 - protein, 22 aa, Entamoeba dispar
GNRMQIVPAVDGFVIDNAITKI

SEQ ID NO: 2483911 - protein, 20 aa, Entamoeba dispar
GNSCFEWCSLLNTIDIPSSV

SEQ ID NO: 2483912 - protein, 17 aa, Entamoeba dispar
GNSCFKECYSLSSINIP

SEQ ID NO: 2483913 - protein, 23 aa, Entamoeba dispar
GNSCFYKSGCEKSLREITRIPKN

SEQ ID NO: 2483914 - protein, 18 aa, Entamoeba dispar
GNSCFYRCGCTEELKKNE

SEQ ID NO: 2483915 - protein, 18 aa, Entamoeba dispar
GNSDIGGVVPKWIVNNMA

SEQ ID NO: 2483916 - protein, 24 aa, Entamoeba dispar
GNSDIKSQVLSFFSSILKIYSGSV

SEQ ID NO: 2483917 - protein, 19 aa, Entamoeba dispar
GNSFYGRERPVFNGNKQCL

SEQ ID NO: 2483918 - protein, 21 aa, Entamoeba dispar
GNSIFKLYGNYLFSVIIRLDH

SEQ ID NO: 2483919 - protein, 23 aa, Entamoeba dispar
GNSNKIILCIGGLTNNLFNHQLF

SEQ ID NO: 2483920 - protein, 22 aa, Entamoeba dispar
GNSRTSYSIPPSVTVIGESAFS

SEQ ID NO: 2483921 - protein, 18 aa, Entamoeba dispar
GNSTFELELEKIQNKTRD

SEQ ID NO: 2483922 - protein, 29 aa, Entamoeba dispar
GNTCCIIFCGWRPHLDIDLTELNKRINEP

SEQ ID NO: 2483923 - protein, 18 aa, Entamoeba dispar
GNTLFSRIYSLYLTQYCS

SEQ ID NO: 2483924 - protein, 21 aa, Entamoeba dispar
GNTQSKCKFSLNKTNLIQVKN

SEQ ID NO: 2483925 - protein, 18 aa, Entamoeba dispar
GNVAAFTSKFTQYAQKDQ

SEQ ID NO: 2483926 - protein, 19 aa, Entamoeba dispar
GNVGKTCMLMCYTSDEFPT

SEQ ID NO: 2483927 - protein, 24 aa, Entamoeba dispar
GNVIKRWYGLTLISVRGNLFYPRS

SEQ ID NO: 2483928 - protein, 19 aa, Entamoeba dispar
GNVLKKYLNLMPNKLPISL

SEQ ID NO: 2483929 - protein, 19 aa, Entamoeba dispar
GNVLLPIVQNFALIKDQQM

SEQ ID NO: 2483930 - protein, 27 aa, Entamoeba dispar
GNVLQVCVRKSLKMRGQAFVIYDTKES

SEQ ID NO: 2483931 - protein, 28 aa, Entamoeba dispar
GNVLRLTLHMYGCRVVQKAVEYASVKDR

SEQ ID NO: 2483932 - protein, 28 aa, Entamoeba dispar
GNVLRLTLHMYGCRVVQKAVEYVSMKDR

SEQ ID NO: 2483933 - protein, 22 aa, Entamoeba dispar
GNVPRTKDVILLGDLIDKAQPG

SEQ ID NO: 2483934 - protein, 25 aa, Entamoeba dispar
GNVSCLKTLPLHSLYIQNFHKLVSL

SEQ ID NO: 2483935 - protein, 17 aa, Entamoeba dispar
GNVSELISDMKKKVANE

SEQ ID NO: 2483936 - protein, 17 aa, Entamoeba dispar
GNVSVRMRDIWDDPSVN

SEQ ID NO: 2483937 - protein, 19 aa, Entamoeba dispar
GNVSYRLISIIEHRGNQIR

SEQ ID NO: 2483938 - protein, 24 aa, Entamoeba dispar
GNVTCPMCKKLFVVPTTLSCGHTF

SEQ ID NO: 2483939 - protein, 26 aa, Entamoeba dispar
GNWEKEFKKWLGVERIPVQTGSSDSS

SEQ ID NO: 2483940 - protein, 17 aa, Entamoeba dispar
GNYCFDKCLSLTTINIP

SEQ ID NO: 2483941 - protein, 21 aa, Entamoeba dispar
GNYPLHLSGYIVVDMTEATAA

SEQ ID NO: 2483942 - protein, 17 aa, Entamoeba dispar
GNYSRVIDRLNILSNEA

SEQ ID NO: 2483943 - protein, 23 aa, Entamoeba dispar
GPDKQLMYFVKWVGLQYSECSWE

SEQ ID NO: 2483944 - protein, 26 aa, Entamoeba dispar
GPEIIKSRLTGLGFIGATQCTVDILS

SEQ ID NO: 2483945 - protein, 17 aa, Entamoeba dispar
GPEKWRVNAHIKNNCIG

SEQ ID NO: 2483946 - protein, 18 aa, Entamoeba dispar
GPESVTCAFDCAVNLGYR

SEQ ID NO: 2483947 - protein, 27 aa, Entamoeba dispar
GPETMAIRLTVVSGKQLKAMDIRSSDP

SEQ ID NO: 2483948 - protein, 24 aa, Entamoeba dispar
GPEWIWPYGYYVMAILIYNPDNLN

SEQ ID NO: 2483949 - protein, 23 aa, Entamoeba dispar
GPFNLRYLRRIIIYLNNTSTSLK

SEQ ID NO: 2483950 - protein, 20 aa, Entamoeba dispar
GPGKCYRLYTQKAYLNEMPI

SEQ ID NO: 2483951 - protein, 17 aa, Entamoeba dispar
GPIGIVFAPIRELAEQI

SEQ ID NO: 2483952 - protein, 17 aa, Entamoeba dispar
GPIKCTIGLEQEMFIID

SEQ ID NO: 2483953 - protein, 25 aa, Entamoeba dispar
GPKELVCSFSKLWAVHYADNLLIFL

SEQ ID NO: 2483954 - protein, 30 aa, Entamoeba dispar
GPKLNWEIICGIAIDIAEGLVCLKENDIVH

SEQ ID NO: 2483955 - protein, 27 aa, Entamoeba dispar
GPKRERKVCLIRMDYDIVSKGIEQRPL

SEQ ID NO: 2483956 - protein, 17 aa, Entamoeba dispar
GPLYRFFDWIFNKSPLM

SEQ ID NO: 2483957 - protein, 21 aa, Entamoeba dispar
GPNKHIHAFFQLEDTTHTRKK

SEQ ID NO: 2483958 - protein, 24 aa, Entamoeba dispar
GPNKTQCILWEFYQSISKIDPRIE

SEQ ID NO: 2483959 - protein, 31 aa, Entamoeba dispar
GPPAKHSVELIREIIEEVKIRGKSTREASKQ

SEQ ID NO: 2483960 - protein, 23 aa, Entamoeba dispar
GPPGCGKTLLAKAVASQCKANFI

SEQ ID NO: 2483961 - protein, 23 aa, Entamoeba dispar
GPPGCGKTLMARQIGKMVSSVEP

SEQ ID NO: 2483962 - protein, 22 aa, Entamoeba dispar
GPRMVRDVFRLARENAPSIVFI

SEQ ID NO: 2483963 - protein, 22 aa, Entamoeba dispar
GPSCFQPFSQRMMDTRLPNQCI

SEQ ID NO: 2483964 - protein, 17 aa, Entamoeba dispar
GPSCSHTALKFSHNKSV

SEQ ID NO: 2483965 - protein, 26 aa, Entamoeba dispar
GPSNMKLTYLESWKAVELSNALFGFD

SEQ ID NO: 2483966 - protein, 18 aa, Entamoeba dispar
GPSYIYVCGCEGTWNIQF

SEQ ID NO: 2483967 - protein, 19 aa, Entamoeba dispar
GPTFARSVSKEGLAVPSFQ

SEQ ID NO: 2483968 - protein, 17 aa, Entamoeba dispar
GPVKEFVEGNENGSAVC

SEQ ID NO: 2483969 - protein, 18 aa, Entamoeba dispar
GPVLEALVARIKLFMESN

SEQ ID NO: 2483970 - protein, 17 aa, Entamoeba dispar
GPVYVVTDFGTFVCQTC

SEQ ID NO: 2483971 - protein, 19 aa, Entamoeba dispar
GPYEVMIAGAFDLIHPGHI

SEQ ID NO: 2483972 - protein, 23 aa, Entamoeba dispar
GPYIFWKEYSMKSISEVKCVNAL

SEQ ID NO: 2483973 - protein, 20 aa, Entamoeba dispar
GQALDFRLISLYVKTRTPTQ

SEQ ID NO: 2483974 - protein, 22 aa, Entamoeba dispar
GQELRLKQEYFFSSATILDVVR

SEQ ID NO: 2483975 - protein, 23 aa, Entamoeba dispar
GQELRLKQEYFFSSATILDVVRR

SEQ ID NO: 2483976 - protein, 25 aa, Entamoeba dispar
GQERYRSLIPSYIRDSSAAVIVYDI

SEQ ID NO: 2483977 - protein, 23 aa, Entamoeba dispar
GQESFQSIIPMYFRNASCVILVF

SEQ ID NO: 2483978 - protein, 23 aa, Entamoeba dispar
GQFGVGFYSSYLVAEKVTVITKH

SEQ ID NO: 2483979 - protein, 23 aa, Entamoeba dispar
GQFKEINCEVIGVSVDSVYCHQA

SEQ ID NO: 2483980 - protein, 18 aa, Entamoeba dispar
GQGTMWWIQRELDEKKKY

SEQ ID NO: 2483981 - protein, 20 aa, Entamoeba dispar
GQIEVFTWSASGQVISEALS

SEQ ID NO: 2483982 - protein, 24 aa, Entamoeba dispar
GQILFVERFIKTWAICFRADGKKG

SEQ ID NO: 2483983 - protein, 18 aa, Entamoeba dispar
GQIPEGITDIGYKAFNGS

SEQ ID NO: 2483984 - protein, 19 aa, Entamoeba dispar
GQIPINYIASFRIEERNQL

SEQ ID NO: 2483985 - protein, 23 aa, Entamoeba dispar
GQKRKLEIIKECAEHGYFVISEV

SEQ ID NO: 2483986 - protein, 31 aa, Entamoeba dispar
GQKSRLVFAEICWKKPHLLLLDEPTNHLDAD

SEQ ID NO: 2483987 - protein, 20 aa, Entamoeba dispar
GQLGFKVEIHLPCLNGLPPI

SEQ ID NO: 2483988 - protein, 25 aa, Entamoeba dispar
GQLKAIKTAVDFARLGEVKMLESYN

SEQ ID NO: 2483989 - protein, 22 aa, Entamoeba dispar
GQLKKWEIKYYKGLGTSKDSDA

SEQ ID NO: 2483990 - protein, 21 aa, Entamoeba dispar
GQLKLKELFLTINNDIHGEYL

SEQ ID NO: 2483991 - protein, 22 aa, Entamoeba dispar
GQLLKIRIISFDKQLLLCSLNL

SEQ ID NO: 2483992 - protein, 23 aa, Entamoeba dispar
GQLPRFVLIKIIPYLENISNVLH

SEQ ID NO: 2483993 - protein, 19 aa, Entamoeba dispar
GQLPSEFKASKYISCKIIN

SEQ ID NO: 2483994 - protein, 20 aa, Entamoeba dispar
GQMLYNCLVYLMSQNIETPL

SEQ ID NO: 2483995 - protein, 17 aa, Entamoeba dispar
GQNCYCVGMYVCGGSKD

SEQ ID NO: 2483996 - protein, 24 aa, Entamoeba dispar
GQNIIKTIIVPRVVKSCSHETLIK

SEQ ID NO: 2483997 - protein, 22 aa, Entamoeba dispar
GQNQVICIFSFHATKSEEHLLL

SEQ ID NO: 2483998 - protein, 33 aa, Entamoeba dispar
GQNRLKDFPNIKCLREIKTLILQKNMLGSIPLE

SEQ ID NO: 2483999 - protein, 29 aa, Entamoeba dispar
GQPKILATKLSAWIERLGGKITIRPKDAD

SEQ ID NO: 2484000 - protein, 23 aa, Entamoeba dispar
GQPPSRGVLFYGPPGCGKTMMAK

SEQ ID NO: 2484001 - protein, 31 aa, Entamoeba dispar
GQPSSLSLWALQEMYIFLPVMLSSNNYEELI

SEQ ID NO: 2484002 - protein, 21 aa, Entamoeba dispar
GQSCIFGVCACSERDCSNIRD

SEQ ID NO: 2484003 - protein, 25 aa, Entamoeba dispar
GQSFPINFSDSISFRGKDEKKDKLL

SEQ ID NO: 2484004 - protein, 18 aa, Entamoeba dispar
GQSMCFCNLASSIFKGYE

SEQ ID NO: 2484005 - protein, 18 aa, Entamoeba dispar
GQSSMHWAAHSGYPNTIE

SEQ ID NO: 2484006 - protein, 31 aa, Entamoeba dispar
GQTDNETRCSFAVSAMGTVICNGKLYHYLPH

SEQ ID NO: 2484007 - protein, 20 aa, Entamoeba dispar
GQTLMVLPFKNMIVATETKM

SEQ ID NO: 2484008 - protein, 18 aa, Entamoeba dispar
GQTPPPVTHHPVVQDNIH

SEQ ID NO: 2484009 - protein, 26 aa, Entamoeba dispar
GQTPTLQRYAAWRGGAMIANTRSIQN

SEQ ID NO: 2484010 - protein, 26 aa, Entamoeba dispar
GQVNCLKLRLLDGGNLLTKMVEKDKE

SEQ ID NO: 2484011 - protein, 18 aa, Entamoeba dispar
GQVNDLWLPLSKKGQIHI

SEQ ID NO: 2484012 - protein, 22 aa, Entamoeba dispar
GQVYFKVVRLPLASMELQIQRK

SEQ ID NO: 2484013 - protein, 23 aa, Entamoeba dispar
GQVYFKVVRLPLASMELQIQRKE

SEQ ID NO: 2484014 - protein, 20 aa, Entamoeba dispar
GQYILPKIVEFGSEEIKDNV

SEQ ID NO: 2484015 - protein, 22 aa, Entamoeba dispar
GQYKGNCSKEFVTLTLNSIPNT

SEQ ID NO: 2484016 - protein, 27 aa, Entamoeba dispar
GQYQGYRCGCNFLATILSSESSEDNNR

SEQ ID NO: 2484017 - protein, 21 aa, Entamoeba dispar
GQYYCKYCQRVLDKVLDEGQE

SEQ ID NO: 2484018 - protein, 20 aa, Entamoeba dispar
GRAMKGFMIPLLKNIINDFK

SEQ ID NO: 2484019 - protein, 19 aa, Entamoeba dispar
GRANIQFREIKCEKGVIDQ

SEQ ID NO: 2484020 - protein, 17 aa, Entamoeba dispar
GRCAECLLYEVMSQCLG

SEQ ID NO: 2484021 - protein, 25 aa, Entamoeba dispar
GRCFKFCPYGAIIHKSIPCVKACPC

SEQ ID NO: 2484022 - protein, 17 aa, Entamoeba dispar
GRCKLVIGKEGTKNSYS

SEQ ID NO: 2484023 - protein, 22 aa, Entamoeba dispar
GRDFPELSNFKMIGKFDGKIKF

SEQ ID NO: 2484024 - protein, 19 aa, Entamoeba dispar
GRDVFSLNAARFVFDGSIN

SEQ ID NO: 2484025 - protein, 20 aa, Entamoeba dispar
GREDAEFDPSVTMQTSVKPT

SEQ ID NO: 2484026 - protein, 18 aa, Entamoeba dispar
GRESFKLQTLRDEINTIT

SEQ ID NO: 2484027 - protein, 20 aa, Entamoeba dispar
GRFLAKYGIVKIIKRENIIY

SEQ ID NO: 2484028 - protein, 21 aa, Entamoeba dispar
GRFLICANVGDSEVLIISEGK

SEQ ID NO: 2484029 - protein, 17 aa, Entamoeba dispar
GRFMELITWAIDIDFLS

SEQ ID NO: 2484030 - protein, 17 aa, Entamoeba dispar
GRFVIGGPMGDAGLTGR

SEQ ID NO: 2484031 - protein, 22 aa, Entamoeba dispar
GRGGFSVVHRAIYKKTHEVVAL

SEQ ID NO: 2484032 - protein, 20 aa, Entamoeba dispar
GRGRGGRKPPTKKLIERQKK

SEQ ID NO: 2484033 - protein, 20 aa, Entamoeba dispar
GRGSFGKVMMVRKKDDGRIF

SEQ ID NO: 2484034 - protein, 23 aa, Entamoeba dispar
GRHCKDRTLLSLGEDGVYITNCS

SEQ ID NO: 2484035 - protein, 25 aa, Entamoeba dispar
GRIDEWKLCLSFAEYLENQEDIGGA

SEQ ID NO: 2484036 - protein, 18 aa, Entamoeba dispar
GRIFKEIIWYLVDYSTYL

SEQ ID NO: 2484037 - protein, 20 aa, Entamoeba dispar
GRIFKEIIWYTVDYSTYLKE

SEQ ID NO: 2484038 - protein, 24 aa, Entamoeba dispar
GRIFKKIIWYKVDYSKYLKEKETE

SEQ ID NO: 2484039 - protein, 23 aa, Entamoeba dispar
GRIFKKIIWYKVEYSTYLQEKES

SEQ ID NO: 2484040 - protein, 24 aa, Entamoeba dispar
GRIFKKIIWYKVEYSTYLQEKESG

SEQ ID NO: 2484041 - protein, 23 aa, Entamoeba dispar
GRIFKKIIWYKVSYSKYLQEKEQ

SEQ ID NO: 2484042 - protein, 23 aa, Entamoeba dispar
GRIFKKMIWYKVKYSTYYERNNK

SEQ ID NO: 2484043 - protein, 22 aa, Entamoeba dispar
GRIFKKVIWYDISYSQYLKEKE

SEQ ID NO: 2484044 - protein, 23 aa, Entamoeba dispar
GRIFKKVIWYFVEYSTYLKKKKK

SEQ ID NO: 2484045 - protein, 24 aa, Entamoeba dispar
GRIFKKVIWYKVEYSKYLFEKEQG

SEQ ID NO: 2484046 - protein, 23 aa, Entamoeba dispar
GRIFKKVIWYLVSYSKYLKEKEQ

SEQ ID NO: 2484047 - protein, 22 aa, Entamoeba dispar
GRIFKKVIWYLVSYSKYLQEKE

SEQ ID NO: 2484048 - protein, 24 aa, Entamoeba dispar
GRIFKKVIWYRVDYSTHLKEKEQG

SEQ ID NO: 2484049 - protein, 22 aa, Entamoeba dispar
GRIFKQVIWYDIRCSSLTSINI

SEQ ID NO: 2484050 - protein, 22 aa, Entamoeba dispar
GRIFKQVIWYLVNYSTYLKEKE

SEQ ID NO: 2484051 - protein, 18 aa, Entamoeba dispar
GRIIKQCKNVLNQITQKY

SEQ ID NO: 2484052 - protein, 24 aa, Entamoeba dispar
GRIIKRELWYTVSYSIHIEEKEKG

SEQ ID NO: 2484053 - protein, 17 aa, Entamoeba dispar
GRIKEMMKFDIKQPENA

SEQ ID NO: 2484054 - protein, 19 aa, Entamoeba dispar
GRIKKGLYGFSIGTIEGMY

SEQ ID NO: 2484055 - protein, 25 aa, Entamoeba dispar
GRIKVWDMRQQKCVVVFNEHHDYIS

SEQ ID NO: 2484056 - protein, 24 aa, Entamoeba dispar
GRILFYSWCFDLIVISAHTKMKII

SEQ ID NO: 2484057 - protein, 19 aa, Entamoeba dispar
GRILKKVIWYTIDYSEYLK

SEQ ID NO: 2484058 - protein, 17 aa, Entamoeba dispar
GRIPRPTQRSVGVSNQR

SEQ ID NO: 2484059 - protein, 20 aa, Entamoeba dispar
GRIQFGFNGITIFHIGNEII

SEQ ID NO: 2484060 - protein, 19 aa, Entamoeba dispar
GRISIGRKGGRNSFSRRGR

SEQ ID NO: 2484061 - protein, 20 aa, Entamoeba dispar
GRISYVRGFVDYDWDSLISI

SEQ ID NO: 2484062 - protein, 19 aa, Entamoeba dispar
GRITKEIIWYDISYSKYLK

SEQ ID NO: 2484063 - protein, 20 aa, Entamoeba dispar
GRITKEIIWYKVNYSTYLKE

SEQ ID NO: 2484064 - protein, 22 aa, Entamoeba dispar
GRKCAKKIIFKFETEKKKEEKK

SEQ ID NO: 2484065 - protein, 17 aa, Entamoeba dispar
GRKEYNARFIWIHREPV

SEQ ID NO: 2484066 - protein, 24 aa, Entamoeba dispar
GRKGEIIVAAVVYLLSREYSSKKE

SEQ ID NO: 2484067 - protein, 17 aa, Entamoeba dispar
GRKGSFPVPELDPVIQI

SEQ ID NO: 2484068 - protein, 18 aa, Entamoeba dispar
GRKPKTRSVTVLQNTPQS

SEQ ID NO: 2484069 - protein, 17 aa, Entamoeba dispar
GRLAACFLDSLATLNYP

SEQ ID NO: 2484070 - protein, 19 aa, Entamoeba dispar
GRLAMTGSIRRYLAEHPKD

SEQ ID NO: 2484071 - protein, 17 aa, Entamoeba dispar
GRLEFERHEEILNLEEF

SEQ ID NO: 2484072 - protein, 19 aa, Entamoeba dispar
GRLKMTWEEVGNFSKKMKA

SEQ ID NO: 2484073 - protein, 42 aa, Entamoeba dispar
GRLKYVPEFLFKFLLWLRKWLYPRNFLGGLFVDNHDMDRIMF

SEQ ID NO: 2484074 - protein, 19 aa, Entamoeba dispar
GRLWHDISIEDTFESSDTI

SEQ ID NO: 2484075 - protein, 19 aa, Entamoeba dispar
GRMKMWDLRINMCCCERTV

SEQ ID NO: 2484076 - protein, 20 aa, Entamoeba dispar
GRMNSLFTWAFEKELCNKGQ

SEQ ID NO: 2484077 - protein, 19 aa, Entamoeba dispar
GRNCLHYLCLNKLVNENLL

SEQ ID NO: 2484078 - protein, 20 aa, Entamoeba dispar
GRNCSFTFINHETKNTEFEE

SEQ ID NO: 2484079 - protein, 21 aa, Entamoeba dispar
GRNEPFGVFIDFTHSRNSLEF

SEQ ID NO: 2484080 - protein, 19 aa, Entamoeba dispar
GRNEPVLAIRDISFGNKSE

SEQ ID NO: 2484081 - protein, 25 aa, Entamoeba dispar
GRNGVLAIESWISLSDKGGCDAGWN

SEQ ID NO: 2484082 - protein, 18 aa, Entamoeba dispar
GRPLGAPPRKPAAKPKHK

SEQ ID NO: 2484083 - protein, 19 aa, Entamoeba dispar
GRPPYYPQKVIDFEISLYR

SEQ ID NO: 2484084 - protein, 25 aa, Entamoeba dispar
GRRDWECIEALRLGLLNDHLCGLMQ

SEQ ID NO: 2484085 - protein, 26 aa, Entamoeba dispar
GRREYWRIVNNKVRIWDRSGKIEELS

SEQ ID NO: 2484086 - protein, 21 aa, Entamoeba dispar
GRRGIHIWVCDDIAMEMTDTL

SEQ ID NO: 2484087 - protein, 22 aa, Entamoeba dispar
GRRGYPGYMYTDLASIYERAGR

SEQ ID NO: 2484088 - protein, 24 aa, Entamoeba dispar
GRRKIPLRRLCDACYQVTYDKKYY

SEQ ID NO: 2484089 - protein, 21 aa, Entamoeba dispar
GRRNIFLALQYKRLFTQEEFL

SEQ ID NO: 2484090 - protein, 25 aa, Entamoeba dispar
GRRSHKLFFINAIARIWKEVLQYNL

SEQ ID NO: 2484091 - protein, 18 aa, Entamoeba dispar
GRSCLEKCCSLTTLTLPN

SEQ ID NO: 2484092 - protein, 17 aa, Entamoeba dispar
GRSGLCIVFVEKEDKTP

SEQ ID NO: 2484093 - protein, 19 aa, Entamoeba dispar
GRSLLSYKNGTKIKTTPLN

SEQ ID NO: 2484094 - protein, 22 aa, Entamoeba dispar
GRSRSATIVTAFIMKKYKIKLN

SEQ ID NO: 2484095 - protein, 21 aa, Entamoeba dispar
GRSSSFPFIISIELACNDIFI

SEQ ID NO: 2484096 - protein, 25 aa, Entamoeba dispar
GRSYKFNKRFEFPLKMKWKDKEMEL

SEQ ID NO: 2484097 - protein, 20 aa, Entamoeba dispar
GRSYLKMIIIHHFDIVEHEI

SEQ ID NO: 2484098 - protein, 20 aa, Entamoeba dispar
GRTDCFYEKYLCVWDYAAAS

SEQ ID NO: 2484099 - protein, 17 aa, Entamoeba dispar
GRTLGGTNWKICNGCDE

SEQ ID NO: 2484100 - protein, 20 aa, Entamoeba dispar
GRTLVALPFLQVVRIQLSEE

SEQ ID NO: 2484101 - protein, 19 aa, Entamoeba dispar
GRTQLNLKDFKGIKKIEFV

SEQ ID NO: 2484102 - protein, 20 aa, Entamoeba dispar
GRVAKILHIYQFTKIFVQCP

SEQ ID NO: 2484103 - protein, 17 aa, Entamoeba dispar
GRVDILWLYVNGDEPNW

SEQ ID NO: 2484104 - protein, 18 aa, Entamoeba dispar
GRVLDMLDRQAIDPNTVK

SEQ ID NO: 2484105 - protein, 18 aa, Entamoeba dispar
GRVVEAVRFAEHKNLQLD

SEQ ID NO: 2484106 - protein, 23 aa, Entamoeba dispar
GRVYPLKLGYVGVLNRSQHDIDT

SEQ ID NO: 2484107 - protein, 18 aa, Entamoeba dispar
GRVYYCFIESYISFYLTN

SEQ ID NO: 2484108 - protein, 20 aa, Entamoeba dispar
GRYCASCYNESISLRGPSSL

SEQ ID NO: 2484109 - protein, 20 aa, Entamoeba dispar
GRYCAYCYDDSRSLRGFGSV

SEQ ID NO: 2484110 - protein, 19 aa, Entamoeba dispar
GRYDFRKENVCSIDPPGCT

SEQ ID NO: 2484111 - protein, 19 aa, Entamoeba dispar
GRYDNLVGIFGANKIPCVG

SEQ ID NO: 2484112 - protein, 18 aa, Entamoeba dispar
GRYIRNMLYETLINEYIN

SEQ ID NO: 2484113 - protein, 17 aa, Entamoeba dispar
GRYLIHFGGVKITSKEF

SEQ ID NO: 2484114 - protein, 21 aa, Entamoeba dispar
GRYSSLYIRLLPVLKELLNTK

SEQ ID NO: 2484115 - protein, 17 aa, Entamoeba dispar
GRYSVYSRKDCFEIMYH

SEQ ID NO: 2484116 - protein, 21 aa, Entamoeba dispar
GSADLGRPLWVETFANHFGVG

SEQ ID NO: 2484117 - protein, 24 aa, Entamoeba dispar
GSAELKLLLKWRDIIVKKIKKEQE

SEQ ID NO: 2484118 - protein, 17 aa, Entamoeba dispar
GSAIGSILFNGKYYIAS

SEQ ID NO: 2484119 - protein, 19 aa, Entamoeba dispar
GSALLVLDIHCRLIENPVG

SEQ ID NO: 2484120 - protein, 20 aa, Entamoeba dispar
GSANKIWYGITLKGDDIAIL

SEQ ID NO: 2484121 - protein, 19 aa, Entamoeba dispar
GSAPHSMGGMPSRGAPRGM

SEQ ID NO: 2484122 - protein, 26 aa, Entamoeba dispar
GSAPPRLRSIPDLGFIDSEIPSPKHE

SEQ ID NO: 2484123 - protein, 26 aa, Entamoeba dispar
GSASCLRIESKIHPVQTFYLDDVISF

SEQ ID NO: 2484124 - protein, 25 aa, Entamoeba dispar
GSATQLSCVMIAFGTAMTMGNGVTG

SEQ ID NO: 2484125 - protein, 24 aa, Entamoeba dispar
GSCCIPLVRKTICDMFGENKIIGF

SEQ ID NO: 2484126 - protein, 23 aa, Entamoeba dispar
GSCGFGSVQWSFKRRVSFAKVCL

SEQ ID NO: 2484127 - protein, 24 aa, Entamoeba dispar
GSCIDGRLTSAWNWCSSVDKKEYY

SEQ ID NO: 2484128 - protein, 23 aa, Entamoeba dispar
GSCKKGLLLFKLTINNKVTSFAT

SEQ ID NO: 2484129 - protein, 21 aa, Entamoeba dispar
GSCKSSFGYFILKKNVFKVNS

SEQ ID NO: 2484130 - protein, 26 aa, Entamoeba dispar
GSCSIPIVRRLICGMFSKDKVVGTSF

SEQ ID NO: 2484131 - protein, 19 aa, Entamoeba dispar
GSDCCCIVQSILKNKTLKS

SEQ ID NO: 2484132 - protein, 22 aa, Entamoeba dispar
GSDESFPLGTIIILNQKQLSAI

SEQ ID NO: 2484133 - protein, 23 aa, Entamoeba dispar
GSDKALVEFIFWNYVEPESTIED

SEQ ID NO: 2484134 - protein, 24 aa, Entamoeba dispar
GSDMKELVKDAAYGPIRELNSLEM

SEQ ID NO: 2484135 - protein, 19 aa, Entamoeba dispar
GSDMSRQLVCCLLGCMQDV

SEQ ID NO: 2484136 - protein, 18 aa, Entamoeba dispar
GSDSEAYIQLQRSTSIPI

SEQ ID NO: 2484137 - protein, 17 aa, Entamoeba dispar
GSEALKYLDGIFICTKY

SEQ ID NO: 2484138 - protein, 17 aa, Entamoeba dispar
GSECVNKSIGVLLAPAI

SEQ ID NO: 2484139 - protein, 24 aa, Entamoeba dispar
GSEEAVNIALGRIVEVKTLQSFQK

SEQ ID NO: 2484140 - protein, 23 aa, Entamoeba dispar
GSEGCVRLGINRRTGEKKAIKIF

SEQ ID NO: 2484141 - protein, 27 aa, Entamoeba dispar
GSEIIKSRLTGLGFIGATQCTVDILSK

SEQ ID NO: 2484142 - protein, 22 aa, Entamoeba dispar
GSELLKVMGTPGVIGEETTSNH

SEQ ID NO: 2484143 - protein, 25 aa, Entamoeba dispar
GSERFCSLGPVFFRGADCCVLVCDV

SEQ ID NO: 2484144 - protein, 22 aa, Entamoeba dispar
GSETKIIKVIRCFHSDFKGKIN

SEQ ID NO: 2484145 - protein, 24 aa, Entamoeba dispar
GSFDMKVKLWDLISKSNTPLMSLN

SEQ ID NO: 2484146 - protein, 21 aa, Entamoeba dispar
GSFDYLLKVDHTFIIRNLLLS

SEQ ID NO: 2484147 - protein, 18 aa, Entamoeba dispar
GSFFCVHGGISPSLQKIS

SEQ ID NO: 2484148 - protein, 25 aa, Entamoeba dispar
GSFFFWMAYCPIKPKSEKLIQIVDK

SEQ ID NO: 2484149 - protein, 29 aa, Entamoeba dispar
GSFHLKCFKCDNCGKQLGGKFGLRGQKKL

SEQ ID NO: 2484150 - protein, 18 aa, Entamoeba dispar
GSFLFLFNPEVRGVIQVC

SEQ ID NO: 2484151 - protein, 17 aa, Entamoeba dispar
GSFNCCYSLTTINIPTL

SEQ ID NO: 2484152 - protein, 18 aa, Entamoeba dispar
GSFRSCRSLVSVTIPTTV

SEQ ID NO: 2484153 - protein, 27 aa, Entamoeba dispar
GSFSKFCEFLKQLGIHFCNGNISIDKR

SEQ ID NO: 2484154 - protein, 18 aa, Entamoeba dispar
GSFYGCCSLKTIDIPTTV

SEQ ID NO: 2484155 - protein, 22 aa, Entamoeba dispar
GSGCFEGCSSLTYINIPTSVTE

SEQ ID NO: 2484156 - protein, 21 aa, Entamoeba dispar
GSGHELHFFCWIVLLVQLKVI

SEQ ID NO: 2484157 - protein, 18 aa, Entamoeba dispar
GSGKSSLGNFILKKLNKF

SEQ ID NO: 2484158 - protein, 30 aa, Entamoeba dispar
GSGKTLAFLIPLIEFMYRSRWTELDGLCSI

SEQ ID NO: 2484159 - protein, 22 aa, Entamoeba dispar
GSGLFSGMVFYIQREVPRHPVA

SEQ ID NO: 2484160 - protein, 20 aa, Entamoeba dispar
GSGMCKAGFAGDDAPRAVFP

SEQ ID NO: 2484161 - protein, 26 aa, Entamoeba dispar
GSGTFGIVYRAEWRGVDVAVKLMKTD

SEQ ID NO: 2484162 - protein, 17 aa, Entamoeba dispar
GSGTITFSVSFYGVSAW

SEQ ID NO: 2484163 - protein, 26 aa, Entamoeba dispar
GSHCFENCSALRSFFIPLTIISLNNN

SEQ ID NO: 2484164 - protein, 18 aa, Entamoeba dispar
GSHPKKVIIYRGSANTGD

SEQ ID NO: 2484165 - protein, 18 aa, Entamoeba dispar
GSHSRLPSFLFGTNEPIN

SEQ ID NO: 2484166 - protein, 24 aa, Entamoeba dispar
GSHSSALGVYCLRSVDKSKKKNYK

SEQ ID NO: 2484167 - protein, 18 aa, Entamoeba dispar
GSIAHLGFELSKLYHINR

SEQ ID NO: 2484168 - protein, 22 aa, Entamoeba dispar
GSIELSQFRILMKFLSKNFDNF

SEQ ID NO: 2484169 - protein, 18 aa, Entamoeba dispar
GSIKFKVSNGNMLVSGST

SEQ ID NO: 2484170 - protein, 23 aa, Entamoeba dispar
GSIKGIPIELVFKEKGIENTLKR

SEQ ID NO: 2484171 - protein, 25 aa, Entamoeba dispar
GSIKRYHKQIGMGFVTPAEAINGTY

SEQ ID NO: 2484172 - protein, 24 aa, Entamoeba dispar
GSIKVWRLDETLCLGNSNCNTHEH

SEQ ID NO: 2484173 - protein, 20 aa, Entamoeba dispar
GSILPLLVERSVRPTAANLL

SEQ ID NO: 2484174 - protein, 20 aa, Entamoeba dispar
GSILTCERVDLRTSHKRSKL

SEQ ID NO: 2484175 - protein, 26 aa, Entamoeba dispar
GSINRCEYCRAFINPFVEWQVPGTRF

SEQ ID NO: 2484176 - protein, 18 aa, Entamoeba dispar
GSIPKELILWASTKNVPI

SEQ ID NO: 2484177 - protein, 21 aa, Entamoeba dispar
GSIRSSAFGYFQITKDCIQTS

SEQ ID NO: 2484178 - protein, 23 aa, Entamoeba dispar
GSISELIWKLSQYDYNQHVQMIC

SEQ ID NO: 2484179 - protein, 17 aa, Entamoeba dispar
GSIVCFHEIAKLVRETV

SEQ ID NO: 2484180 - protein, 29 aa, Entamoeba dispar
GSKCILQALILARLVTKFPRLLEEVNLFC

SEQ ID NO: 2484181 - protein, 17 aa, Entamoeba dispar
GSKGCSVSGEICIDDLK

SEQ ID NO: 2484182 - protein, 19 aa, Entamoeba dispar
GSKNLWSFISVLSSKGNKQ

SEQ ID NO: 2484183 - protein, 35 aa, Entamoeba dispar
GSKVYWKWFLALDEIPRRSGAREAPSNWLIEVAKK

SEQ ID NO: 2484184 - protein, 19 aa, Entamoeba dispar
GSLEIKWVNNVLFTPTELH

SEQ ID NO: 2484185 - protein, 17 aa, Entamoeba dispar
GSLFKMRMTAVSLISGY

SEQ ID NO: 2484186 - protein, 19 aa, Entamoeba dispar
GSLHALRFMDLSINRIQSV

SEQ ID NO: 2484187 - protein, 22 aa, Entamoeba dispar
GSLICENCGLVIDNSRALIAEL

SEQ ID NO: 2484188 - protein, 22 aa, Entamoeba dispar
GSLKDTFGRKAFFGVKAAISPN

SEQ ID NO: 2484189 - protein, 25 aa, Entamoeba dispar
GSLKEEYRCISLCRSPRYDTKQKKE

SEQ ID NO: 2484190 - protein, 17 aa, Entamoeba dispar
GSLKEINIPTSITLFGN

SEQ ID NO: 2484191 - protein, 21 aa, Entamoeba dispar
GSLLNGLNCYVESTREQRMRL

SEQ ID NO: 2484192 - protein, 18 aa, Entamoeba dispar
GSLQNFLNAFTFPDHTMY

SEQ ID NO: 2484193 - protein, 21 aa, Entamoeba dispar
GSLRPFGCSLLIGGVDQHGYS

SEQ ID NO: 2484194 - protein, 27 aa, Entamoeba dispar
GSLRYKQFIRCLGWYQSLEDLICDPEF

SEQ ID NO: 2484195 - protein, 18 aa, Entamoeba dispar
GSLSLKHIFIKDDEIKLA

SEQ ID NO: 2484196 - protein, 19 aa, Entamoeba dispar
GSLSLKHIFIKDDEIKLAF

SEQ ID NO: 2484197 - protein, 23 aa, Entamoeba dispar
GSLTKRSKGILFFGPPGTGKTML

SEQ ID NO: 2484198 - protein, 18 aa, Entamoeba dispar
GSNAISFGGNVNNKVNGK

SEQ ID NO: 2484199 - protein, 20 aa, Entamoeba dispar
GSNIKRVFMLAVDVIMKNMA

SEQ ID NO: 2484200 - protein, 30 aa, Entamoeba dispar
GSNLALTDFRCCYCGMFVHPQCIQQAPAFC

SEQ ID NO: 2484201 - protein, 17 aa, Entamoeba dispar
GSNMFSIQELSFKTPTE

SEQ ID NO: 2484202 - protein, 18 aa, Entamoeba dispar
GSNRKTCISERIIYVQPN

SEQ ID NO: 2484203 - protein, 20 aa, Entamoeba dispar
GSNVTLMFQQLVDLMLKNKI

SEQ ID NO: 2484204 - protein, 18 aa, Entamoeba dispar
GSPAKKDKDCIFLEDDPS

SEQ ID NO: 2484205 - protein, 17 aa, Entamoeba dispar
GSPFYGEVNKQFICKDY

SEQ ID NO: 2484206 - protein, 19 aa, Entamoeba dispar
GSPLEIAFTMFDLSQLQII

SEQ ID NO: 2484207 - protein, 20 aa, Entamoeba dispar
GSPMSSPFHSPRENLTGTSV

SEQ ID NO: 2484208 - protein, 17 aa, Entamoeba dispar
GSPRQPNCPLALSTPLP

SEQ ID NO: 2484209 - protein, 25 aa, Entamoeba dispar
GSQEAKLRFAFQVYDVDNDGFISNP

SEQ ID NO: 2484210 - protein, 17 aa, Entamoeba dispar
GSQPVKSTPEWEEKPID

SEQ ID NO: 2484211 - protein, 18 aa, Entamoeba dispar
GSRLDCIKTVIENKLHLN

SEQ ID NO: 2484212 - protein, 21 aa, Entamoeba dispar
GSRNGFSYNSLKEFEETMYGI

SEQ ID NO: 2484213 - protein, 17 aa, Entamoeba dispar
GSSCYKTVEDYQTKCKF

SEQ ID NO: 2484214 - protein, 21 aa, Entamoeba dispar
GSSELVGGCILNIENPEKHLS

SEQ ID NO: 2484215 - protein, 23 aa, Entamoeba dispar
GSSIEFRLVMSLVSSNFKNKKLQ

SEQ ID NO: 2484216 - protein, 17 aa, Entamoeba dispar
GSSKELGNWTEGYTMTY

SEQ ID NO: 2484217 - protein, 18 aa, Entamoeba dispar
GSSKFSFKGILSGEEEIS

SEQ ID NO: 2484218 - protein, 28 aa, Entamoeba dispar
GSSNECKMCLQALFDAAFMLAEKMKEMM

SEQ ID NO: 2484219 - protein, 18 aa, Entamoeba dispar
GSSNSLVYFDFVQQDQPN

SEQ ID NO: 2484220 - protein, 27 aa, Entamoeba dispar
GSSPYYRDICLSYGFFNSFLRLYTSLY

SEQ ID NO: 2484221 - protein, 21 aa, Entamoeba dispar
GSSYGRWLTSCSTFQKKWNQE

SEQ ID NO: 2484222 - protein, 17 aa, Entamoeba dispar
GSTFTHAVLACDPCAKT

SEQ ID NO: 2484223 - protein, 21 aa, Entamoeba dispar
GSTNYKRFWIQQISVVLLPQL

SEQ ID NO: 2484224 - protein, 17 aa, Entamoeba dispar
GSTVLKNEVKTEEESHK

SEQ ID NO: 2484225 - protein, 24 aa, Entamoeba dispar
GSVAVFLCGLYYMKVIDEKLLIEL

SEQ ID NO: 2484226 - protein, 26 aa, Entamoeba dispar
GSVISALKINPWFTSERDINKFCRIF

SEQ ID NO: 2484227 - protein, 25 aa, Entamoeba dispar
GSVKRYHKQIGMGFVTPAEAINGTY

SEQ ID NO: 2484228 - protein, 30 aa, Entamoeba dispar
GSVKTWKKRWFVLKENRLWYFASKTAEEAK

SEQ ID NO: 2484229 - protein, 31 aa, Entamoeba dispar
GSVKTWKKRWFVLKENRLWYFASKTAEEAKG

SEQ ID NO: 2484230 - protein, 22 aa, Entamoeba dispar
GSVMAVSFKTAITIWDVLSNKL

SEQ ID NO: 2484231 - protein, 24 aa, Entamoeba dispar
GSVSNALRIYSYCVASDSSDFDMT

SEQ ID NO: 2484232 - protein, 24 aa, Entamoeba dispar
GSVSNALRIYSYCVASDSSRFNMT

SEQ ID NO: 2484233 - protein, 19 aa, Entamoeba dispar
GSVSNALRVYSYAVGSDSD

SEQ ID NO: 2484234 - protein, 18 aa, Entamoeba dispar
GSVVWKKLQYLTISNAGI

SEQ ID NO: 2484235 - protein, 21 aa, Entamoeba dispar
GSWCFWGCSSLKYITIPTSVS

SEQ ID NO: 2484236 - protein, 21 aa, Entamoeba dispar
GSYCFKGCSLLTTINIPSSIS

SEQ ID NO: 2484237 - protein, 31 aa, Entamoeba dispar
GSYEELRTIILTDFFKHAFDGSGADNFYDAG

SEQ ID NO: 2484238 - protein, 25 aa, Entamoeba dispar
GSYELPFELELMYKDGWERSCDVCL

SEQ ID NO: 2484239 - protein, 17 aa, Entamoeba dispar
GSYGEYTPNIGKSMKAA

SEQ ID NO: 2484240 - protein, 18 aa, Entamoeba dispar
GSYGTIFENFKKVYDVKV

SEQ ID NO: 2484241 - protein, 18 aa, Entamoeba dispar
GSYKAAGIKVCISGINGK

SEQ ID NO: 2484242 - protein, 29 aa, Entamoeba dispar
GSYPGCIRLSPQTALRFMRIFDTSRTGHL

SEQ ID NO: 2484243 - protein, 19 aa, Entamoeba dispar
GSYQSCYCSTWNPLSSQLI

SEQ ID NO: 2484244 - protein, 24 aa, Entamoeba dispar
GSYTAEILARCGIGHLTIVDADTI

SEQ ID NO: 2484245 - protein, 23 aa, Entamoeba dispar
GSYWDAGCKIGLTVCGWKNGFYK

SEQ ID NO: 2484246 - protein, 19 aa, Entamoeba dispar
GSYYRQTIIYSRYQTPLLN

SEQ ID NO: 2484247 - protein, 27 aa, Entamoeba dispar
GTAEAHRACMKYCKPGMYEFELEAEFY

SEQ ID NO: 2484248 - protein, 22 aa, Entamoeba dispar
GTAEIKQIIAMEFLDNYNQINK

SEQ ID NO: 2484249 - protein, 24 aa, Entamoeba dispar
GTAHRPSALIGYSMLLKDQKDPVY

SEQ ID NO: 2484250 - protein, 25 aa, Entamoeba dispar
GTANSYRWCMEVFDYLNIAALIDGK

SEQ ID NO: 2484251 - protein, 23 aa, Entamoeba dispar
GTARAKCHGFSFNTLQKLSDTKT

SEQ ID NO: 2484252 - protein, 19 aa, Entamoeba dispar
GTCFYGCKLLKNINIKNVQ

SEQ ID NO: 2484253 - protein, 17 aa, Entamoeba dispar
GTCKMPKIIDEVASLFD

SEQ ID NO: 2484254 - protein, 21 aa, Entamoeba dispar
GTCKMPRIRDEVAKLFDRQTF

SEQ ID NO: 2484255 - protein, 17 aa, Entamoeba dispar
GTECFMSCNLLENVFLP

SEQ ID NO: 2484256 - protein, 22 aa, Entamoeba dispar
GTEYGKKCVMRAKIDMKHKNKA

SEQ ID NO: 2484257 - protein, 18 aa, Entamoeba dispar
GTFFTYFYDKFQALDNGI

SEQ ID NO: 2484258 - protein, 17 aa, Entamoeba dispar
GTFGIVYIGEFRGNQVA

SEQ ID NO: 2484259 - protein, 17 aa, Entamoeba dispar
GTFKFSFHCPDDFDGNF

SEQ ID NO: 2484260 - protein, 18 aa, Entamoeba dispar
GTGAIPYIVTHDGRTIRY

SEQ ID NO: 2484261 - protein, 18 aa, Entamoeba dispar
GTGGTWPLKPNESIELPP

SEQ ID NO: 2484262 - protein, 29 aa, Entamoeba dispar
GTGICSIISSLCCILCDDYFRTIKGFIAL

SEQ ID NO: 2484263 - protein, 25 aa, Entamoeba dispar
GTGLKKLRIAGGLKQTQQLGTSIVQ

SEQ ID NO: 2484264 - protein, 23 aa, Entamoeba dispar
GTGRIIMLNGMMLISGRGSSIVN

SEQ ID NO: 2484265 - protein, 17 aa, Entamoeba dispar
GTGSGLGSKIMEMISEK

SEQ ID NO: 2484266 - protein, 24 aa, Entamoeba dispar
GTGSTCSVYRGIYKKNNREGGTTD

SEQ ID NO: 2484267 - protein, 25 aa, Entamoeba dispar
GTGVFMCCYELKSIELPNSINSISE

SEQ ID NO: 2484268 - protein, 17 aa, Entamoeba dispar
GTHPYIVGTLLFSLKNK

SEQ ID NO: 2484269 - protein, 25 aa, Entamoeba dispar
GTIEQRISGAIGFDSEIFGQNMWGD

SEQ ID NO: 2484270 - protein, 25 aa, Entamoeba dispar
GTIISEIFICFSRLLSDETICEKIL

SEQ ID NO: 2484271 - protein, 17 aa, Entamoeba dispar
GTIKKCISKIEDDKPLI

SEQ ID NO: 2484272 - protein, 25 aa, Entamoeba dispar
GTKAFKDTDWIGAIRMYSSALGHVE

SEQ ID NO: 2484273 - protein, 24 aa, Entamoeba dispar
GTKKIRGFFVFPYTKTMSLLQREM

SEQ ID NO: 2484274 - protein, 27 aa, Entamoeba dispar
GTKLVDCVHLLPSHFHQLLRFISVEVG

SEQ ID NO: 2484275 - protein, 22 aa, Entamoeba dispar
GTKQKFWYSRVNSYTARTGDIS

SEQ ID NO: 2484276 - protein, 21 aa, Entamoeba dispar
GTKRRIFVIPYLMYSTMERAV

SEQ ID NO: 2484277 - protein, 25 aa, Entamoeba dispar
GTKVDFILKCIKIIGNIPGIKLAVL

SEQ ID NO: 2484278 - protein, 22 aa, Entamoeba dispar
GTLFKNKHRLFIGPIQVDSNAR

SEQ ID NO: 2484279 - protein, 18 aa, Entamoeba dispar
GTLITSILVPERYITLLV

SEQ ID NO: 2484280 - protein, 18 aa, Entamoeba dispar
GTLMYKLSSKDIVAKASV

SEQ ID NO: 2484281 - protein, 23 aa, Entamoeba dispar
GTLNFCSLPKINECTSKPVPVSD

SEQ ID NO: 2484282 - protein, 22 aa, Entamoeba dispar
GTLPYLRVYRMFVGNNSVGLQA

SEQ ID NO: 2484283 - protein, 30 aa, Entamoeba dispar
GTLRKSSNPWFKWKLTTSFENHRIQLKIVR

SEQ ID NO: 2484284 - protein, 24 aa, Entamoeba dispar
GTLSSFKRVFAIPIQKAQDGNASI

SEQ ID NO: 2484285 - protein, 28 aa, Entamoeba dispar
GTMFYYFGWNSWNGWIPAWCVNKATKTM

SEQ ID NO: 2484286 - protein, 17 aa, Entamoeba dispar
GTMGWAMNECKKHNVSP

SEQ ID NO: 2484287 - protein, 27 aa, Entamoeba dispar
GTMKMGCPITLPSRNNMDLGRVTGIEL

SEQ ID NO: 2484288 - protein, 17 aa, Entamoeba dispar
GTMRENRTIPRRTIASK

SEQ ID NO: 2484289 - protein, 20 aa, Entamoeba dispar
GTNFLFKKLLGLLYFELNRR

SEQ ID NO: 2484290 - protein, 33 aa, Entamoeba dispar
GTNIISLRCPLSFCPITTPIKGVLCKHSTVVNA

SEQ ID NO: 2484291 - protein, 18 aa, Entamoeba dispar
GTNSDLICMSVGNQIVAV

SEQ ID NO: 2484292 - protein, 23 aa, Entamoeba dispar
GTNTSNPFGSFTSNTTNTTTTST

SEQ ID NO: 2484293 - protein, 24 aa, Entamoeba dispar
GTNYEFSRYGTLCIERTTNTNVGA

SEQ ID NO: 2484294 - protein, 35 aa, Entamoeba dispar
GTNYFKVFRLVNNIFRPSLVAEFFELYKECYYKKR

SEQ ID NO: 2484295 - protein, 21 aa, Entamoeba dispar
GTPHIHCLVLFNSAKRISTLK

SEQ ID NO: 2484296 - protein, 32 aa, Entamoeba dispar
GTPLFRGNTPFIRFYNFYLFFYCNEYLTKTTS

SEQ ID NO: 2484297 - protein, 26 aa, Entamoeba dispar
GTPLVYSCIKILMQRVPQNVSIKKLK

SEQ ID NO: 2484298 - protein, 22 aa, Entamoeba dispar
GTPRKVCDACILEQFTKQQEAN

SEQ ID NO: 2484299 - protein, 24 aa, Entamoeba dispar
GTPVYNFLCSYLLKTYKHQSKGLF

SEQ ID NO: 2484300 - protein, 23 aa, Entamoeba dispar
GTPVYSFLCSYLLKTNTPQSKGL

SEQ ID NO: 2484301 - protein, 23 aa, Entamoeba dispar
GTQFKCVKEYALFQNTQLVHTNF

SEQ ID NO: 2484302 - protein, 26 aa, Entamoeba dispar
GTREINIFLFRWGKGNHYIINNNIKV

SEQ ID NO: 2484303 - protein, 24 aa, Entamoeba dispar
GTRIIYKIRYNIIFLNEDLNEVDI

SEQ ID NO: 2484304 - protein, 21 aa, Entamoeba dispar
GTRRRVFVIPYLLYQTMNRAS

SEQ ID NO: 2484305 - protein, 22 aa, Entamoeba dispar
GTRVLKKIAAIMPRNKQEFEQI

SEQ ID NO: 2484306 - protein, 23 aa, Entamoeba dispar
GTRYRVLCLLGQGAFGQVVKCFD

SEQ ID NO: 2484307 - protein, 17 aa, Entamoeba dispar
GTSDELAARVIVMNISK

SEQ ID NO: 2484308 - protein, 17 aa, Entamoeba dispar
GTSEGLDLWTFNRNEIV

SEQ ID NO: 2484309 - protein, 21 aa, Entamoeba dispar
GTSIKTVRCFGGVPQSCQMKD

SEQ ID NO: 2484310 - protein, 22 aa, Entamoeba dispar
GTSLNILPIYSIGNIQLDSAND

SEQ ID NO: 2484311 - protein, 18 aa, Entamoeba dispar
GTSVYFWAFPSEEFVNKK

SEQ ID NO: 2484312 - protein, 17 aa, Entamoeba dispar
GTSYLLKFEVPGIDKKS

SEQ ID NO: 2484313 - protein, 20 aa, Entamoeba dispar
GTTICGLVCEQGQTVVLACD

SEQ ID NO: 2484314 - protein, 17 aa, Entamoeba dispar
GTTKFAFESNCWNRVIP

SEQ ID NO: 2484315 - protein, 18 aa, Entamoeba dispar
GTTTREEVTISMKTPSTS

SEQ ID NO: 2484316 - protein, 19 aa, Entamoeba dispar
GTTYSCVGIWQNDRVEIIA

SEQ ID NO: 2484317 - protein, 23 aa, Entamoeba dispar
GTTYSSIAYCIGKTGKIETIKDE

SEQ ID NO: 2484318 - protein, 31 aa, Entamoeba dispar
GTVAFGSGLHGWAFTLEKFAKMWSAKFGIDR

SEQ ID NO: 2484319 - protein, 20 aa, Entamoeba dispar
GTVGKTCLLISYTKNSFPKK

SEQ ID NO: 2484320 - protein, 18 aa, Entamoeba dispar
GTVGKTCMLMCYTSNDFP

SEQ ID NO: 2484321 - protein, 19 aa, Entamoeba dispar
GTVKLSNFGFAAILTSAHP

SEQ ID NO: 2484322 - protein, 22 aa, Entamoeba dispar
GTVLKPKCKNWSIIAKVMDLQG

SEQ ID NO: 2484323 - protein, 23 aa, Entamoeba dispar
GTYFKNNKFHIYKSNDIQTSSSS

SEQ ID NO: 2484324 - protein, 24 aa, Entamoeba dispar
GTYFPCELSEYAFLYKRYCNQSII

SEQ ID NO: 2484325 - protein, 17 aa, Entamoeba dispar
GTYGFVFKVRNVHDKQY

SEQ ID NO: 2484326 - protein, 29 aa, Entamoeba dispar
GTYMRTLCVHLGYLMGCGAHMEELRRVRS

SEQ ID NO: 2484327 - protein, 22 aa, Entamoeba dispar
GVADMKKAAVVMVSQNKYAIDG

SEQ ID NO: 2484328 - protein, 20 aa, Entamoeba dispar
GVADTCRYKGGIHAYASQPD

SEQ ID NO: 2484329 - protein, 19 aa, Entamoeba dispar
GVAGLRNALAIVFNVANIN

SEQ ID NO: 2484330 - protein, 23 aa, Entamoeba dispar
GVDDCWKQYCTLSQQSRDLLDWL

SEQ ID NO: 2484331 - protein, 21 aa, Entamoeba dispar
GVDELLERLILILLSHHYSLI

SEQ ID NO: 2484332 - protein, 18 aa, Entamoeba dispar
GVDLLMKVYREFLPHGGY

SEQ ID NO: 2484333 - protein, 21 aa, Entamoeba dispar
GVDMKKFLSFFSLFSKSKSEK

SEQ ID NO: 2484334 - protein, 18 aa, Entamoeba dispar
GVEDKCFFFMDNEWKEVI

SEQ ID NO: 2484335 - protein, 19 aa, Entamoeba dispar
GVEICISYIHPGEASLEIT

SEQ ID NO: 2484336 - protein, 26 aa, Entamoeba dispar
GVEIPACVVVKFLAMNGIIMEKMGYY

SEQ ID NO: 2484337 - protein, 19 aa, Entamoeba dispar
GVEVLRRICELPPENTPNG

SEQ ID NO: 2484338 - protein, 23 aa, Entamoeba dispar
GVFDDACIYEWIKSKNLEEEDLK

SEQ ID NO: 2484339 - protein, 17 aa, Entamoeba dispar
GVFGDKNHFVFTIKNNV

SEQ ID NO: 2484340 - protein, 25 aa, Entamoeba dispar
GVFGGDWRYKYLLQTIICSFVERPF

SEQ ID NO: 2484341 - protein, 23 aa, Entamoeba dispar
GVFRIGEWMIINGLKTKSEIKAM

SEQ ID NO: 2484342 - protein, 20 aa, Entamoeba dispar
GVGFEIFEKFLKTMKDNIEK

SEQ ID NO: 2484343 - protein, 22 aa, Entamoeba dispar
GVGKTCLVKQFINKKNKEDGKS

SEQ ID NO: 2484344 - protein, 17 aa, Entamoeba dispar
GVGKTTLFELIKEEDAD

SEQ ID NO: 2484345 - protein, 25 aa, Entamoeba dispar
GVGRTGVYCLLSRIIEMVTYEILEK

SEQ ID NO: 2484346 - protein, 26 aa, Entamoeba dispar
GVIELMKYNGGYSWWRHNSLTVFIDK

SEQ ID NO: 2484347 - protein, 24 aa, Entamoeba dispar
GVIEVKDVMNFLSFSNEKEYQEFI

SEQ ID NO: 2484348 - protein, 27 aa, Entamoeba dispar
GVIIKRKIGKFFCCHGGISPEINKIEE

SEQ ID NO: 2484349 - protein, 20 aa, Entamoeba dispar
GVIIRKVINGIMNKIPKEYQ

SEQ ID NO: 2484350 - protein, 19 aa, Entamoeba dispar
GVIKCNICHLEYQSTIEDD

SEQ ID NO: 2484351 - protein, 28 aa, Entamoeba dispar
GVILKSRYEATVKHFLWRSVKQADDLIK

SEQ ID NO: 2484352 - protein, 31 aa, Entamoeba dispar
GVIRKILELMYKYHHELMYIYTYDRDWYYPY

SEQ ID NO: 2484353 - protein, 20 aa, Entamoeba dispar
GVISGAKGSCLIQKENSKVI

SEQ ID NO: 2484354 - protein, 24 aa, Entamoeba dispar
GVISGAKGSCLIQKENSKVISSVQ

SEQ ID NO: 2484355 - protein, 31 aa, Entamoeba dispar
GVKFMYHCIMRGGECGCILADEMGLGKTLQT

SEQ ID NO: 2484356 - protein, 23 aa, Entamoeba dispar
GVKKRFAKKEVQVDSLIGKSFGQ

SEQ ID NO: 2484357 - protein, 26 aa, Entamoeba dispar
GVKNFKGIHYLGGRFIPLELKDKLHL

SEQ ID NO: 2484358 - protein, 18 aa, Entamoeba dispar
GVKRENVHLLNLPFYQTG

SEQ ID NO: 2484359 - protein, 18 aa, Entamoeba dispar
GVKRVSIMQEGFLKYHKN

SEQ ID NO: 2484360 - protein, 19 aa, Entamoeba dispar
GVKYLKFVDQSIMELDDKI

SEQ ID NO: 2484361 - protein, 27 aa, Entamoeba dispar
GVLDKKTEICIVKGYATGEVNEVIVHP

SEQ ID NO: 2484362 - protein, 19 aa, Entamoeba dispar
GVLDMLAPLMFFGDFTPTI

SEQ ID NO: 2484363 - protein, 18 aa, Entamoeba dispar
GVLNERKMRVNLNIILGK

SEQ ID NO: 2484364 - protein, 24 aa, Entamoeba dispar
GVLRKEIYHNPIIQYQLEEINGIR

SEQ ID NO: 2484365 - protein, 19 aa, Entamoeba dispar
GVLSRCFEPYMSGYVDLEN

SEQ ID NO: 2484366 - protein, 19 aa, Entamoeba dispar
GVMKKVNSCFVMNESYGPK

SEQ ID NO: 2484367 - protein, 24 aa, Entamoeba dispar
GVMKRIYQKVGMEFTREVETKINE

SEQ ID NO: 2484368 - protein, 18 aa, Entamoeba dispar
GVMTCTFGLLKTQSDPRI

SEQ ID NO: 2484369 - protein, 18 aa, Entamoeba dispar
GVNCIEVVGNKIIVGSSD

SEQ ID NO: 2484370 - protein, 18 aa, Entamoeba dispar
GVNDWAKLFKPRHLFCGY

SEQ ID NO: 2484371 - protein, 24 aa, Entamoeba dispar
GVNFRIVPEFLFLYKDRFTSHRNE

SEQ ID NO: 2484372 - protein, 17 aa, Entamoeba dispar
GVNKRYVVRLIKSDDFN

SEQ ID NO: 2484373 - protein, 24 aa, Entamoeba dispar
GVPDCLKCDNITAFGIDFKKILCN

SEQ ID NO: 2484374 - protein, 25 aa, Entamoeba dispar
GVPEKGKYPLGLSFEIVNQSEMTFE

SEQ ID NO: 2484375 - protein, 21 aa, Entamoeba dispar
GVPGYEVLRNIYIELTPFSEA

SEQ ID NO: 2484376 - protein, 24 aa, Entamoeba dispar
GVPLSLIICCDVYEPPNLKKSSGW

SEQ ID NO: 2484377 - protein, 18 aa, Entamoeba dispar
GVPQIEVTFDIDANGILN

SEQ ID NO: 2484378 - protein, 21 aa, Entamoeba dispar
GVPREKFPAIFSAVDKLDKVS

SEQ ID NO: 2484379 - protein, 22 aa, Entamoeba dispar
GVQFHICMALELTLRTIPLLNA

SEQ ID NO: 2484380 - protein, 18 aa, Entamoeba dispar
GVQFKVDIGERVLHIHSM

SEQ ID NO: 2484381 - protein, 17 aa, Entamoeba dispar
GVRAAVCFAAMALEYAE

SEQ ID NO: 2484382 - protein, 19 aa, Entamoeba dispar
GVRERLTSWEFIQTLPEKI

SEQ ID NO: 2484383 - protein, 23 aa, Entamoeba dispar
GVRISRVKSLLMDKIEGDSINIV

SEQ ID NO: 2484384 - protein, 25 aa, Entamoeba dispar
GVRLDETWNNIGLKDFEIIKRINGG

SEQ ID NO: 2484385 - protein, 19 aa, Entamoeba dispar
GVRYFDLRIQKFKDDIYTV

SEQ ID NO: 2484386 - protein, 24 aa, Entamoeba dispar
GVSACAICDGAVPIFRNKVLMVVG

SEQ ID NO: 2484387 - protein, 18 aa, Entamoeba dispar
GVSFISAMGQKFHPEHFV

SEQ ID NO: 2484388 - protein, 24 aa, Entamoeba dispar
GVSGVTLYIQWKCGKESGILPRSI

SEQ ID NO: 2484389 - protein, 19 aa, Entamoeba dispar
GVSHFVSFAPMLDVFGKLE

SEQ ID NO: 2484390 - protein, 18 aa, Entamoeba dispar
GVSISFASQECGKWEEVQ

SEQ ID NO: 2484391 - protein, 18 aa, Entamoeba dispar
GVSISWAVSEEIILKSLS

SEQ ID NO: 2484392 - protein, 22 aa, Entamoeba dispar
GVSKEWFSLIVKELFKVDFGMF

SEQ ID NO: 2484393 - protein, 23 aa, Entamoeba dispar
GVSLKDQMCFVLFKNDDTITKIE

SEQ ID NO: 2484394 - protein, 24 aa, Entamoeba dispar
GVSRKERRIQVASLMLAGRIFDND

SEQ ID NO: 2484395 - protein, 28 aa, Entamoeba dispar
GVSTLMNFKVCFIKSISLQVSTDNGSTW

SEQ ID NO: 2484396 - protein, 19 aa, Entamoeba dispar
GVSVDMLKIQYRMHPLIRE

SEQ ID NO: 2484397 - protein, 29 aa, Entamoeba dispar
GVTAPCQVRYVYYFDCYHRTFSEYVPIPQ

SEQ ID NO: 2484398 - protein, 19 aa, Entamoeba dispar
GVTEGQWWGPSFASDIAAE

SEQ ID NO: 2484399 - protein, 20 aa, Entamoeba dispar
GVTEGQWWGPSFASDIAAEH

SEQ ID NO: 2484400 - protein, 18 aa, Entamoeba dispar
GVTFCFDNEALFKIASDI

SEQ ID NO: 2484401 - protein, 18 aa, Entamoeba dispar
GVTGYNFSVFICGNGNDA

SEQ ID NO: 2484402 - protein, 22 aa, Entamoeba dispar
GVTIPSQLKYVGYWGSTLLARL

SEQ ID NO: 2484403 - protein, 19 aa, Entamoeba dispar
GVTLYYLIRCEPFSHFGIE

SEQ ID NO: 2484404 - protein, 19 aa, Entamoeba dispar
GVTNLSRCTFLILDEADRM

SEQ ID NO: 2484405 - protein, 21 aa, Entamoeba dispar
GVTSIRWSGNENILYTSSRDR

SEQ ID NO: 2484406 - protein, 23 aa, Entamoeba dispar
GVTVDCWDYLTSNKVLYAENRVS

SEQ ID NO: 2484407 - protein, 23 aa, Entamoeba dispar
GVTYRLTLGVIKNIMPAIASTNS

SEQ ID NO: 2484408 - protein, 17 aa, Entamoeba dispar
GVTYVAAAMCRRLTEDL

SEQ ID NO: 2484409 - protein, 34 aa, Entamoeba dispar
GVVDLMKYNGGYSWWKRNSLTVFIDKKLYKDPTE

SEQ ID NO: 2484410 - protein, 34 aa, Entamoeba dispar
GVVELMKYNGGYNWWKRNSLTVFIDKKLYKDPIE

SEQ ID NO: 2484411 - protein, 21 aa, Entamoeba dispar
GVVMSKFLFIGPIYGNYIKGE

SEQ ID NO: 2484412 - protein, 18 aa, Entamoeba dispar
GVYLPIKGGYIVSNGLQR

SEQ ID NO: 2484413 - protein, 17 aa, Entamoeba dispar
GVYSGRVAKILHIYQFT

SEQ ID NO: 2484414 - protein, 18 aa, Entamoeba dispar
GWDNMTLLVVKFKSFNPQ

SEQ ID NO: 2484415 - protein, 26 aa, Entamoeba dispar
GWLKKKGYEVHSWKRRYFVIKNQFIY

SEQ ID NO: 2484416 - protein, 18 aa, Entamoeba dispar
GWNSYNIYNEFTRMRLEG

SEQ ID NO: 2484417 - protein, 32 aa, Entamoeba dispar
GWSKERVKGTLVWLLNLGILWVDDQFSLDGKT

SEQ ID NO: 2484418 - protein, 17 aa, Entamoeba dispar
GWTVSPFGSMPPTPLPQ

SEQ ID NO: 2484419 - protein, 18 aa, Entamoeba dispar
GWVEVKWKNGTVCQYRWG

SEQ ID NO: 2484420 - protein, 19 aa, Entamoeba dispar
GWWKGELNGQEGWIPNNYV

SEQ ID NO: 2484421 - protein, 24 aa, Entamoeba dispar
GWYHSHPGFGCWLSSIDISTQQSF

SEQ ID NO: 2484422 - protein, 18 aa, Entamoeba dispar
GWYTIQIQIDREINELIK

SEQ ID NO: 2484423 - protein, 20 aa, Entamoeba dispar
GYAAPMMCKSLDRREVGTFC

SEQ ID NO: 2484424 - protein, 17 aa, Entamoeba dispar
GYAFDIALCNEIVKKGN

SEQ ID NO: 2484425 - protein, 20 aa, Entamoeba dispar
GYCHRDIKVENVLILNGEYK

SEQ ID NO: 2484426 - protein, 30 aa, Entamoeba dispar
GYCINPLFVTMEFFNGGSLYHLINETSMEF

SEQ ID NO: 2484427 - protein, 29 aa, Entamoeba dispar
GYCLLSFGLCYDENCLFDFDEQHVGWFEG

SEQ ID NO: 2484428 - protein, 17 aa, Entamoeba dispar
GYCNVCGCHHSEHANFK

SEQ ID NO: 2484429 - protein, 21 aa, Entamoeba dispar
GYDCFYYNLFKSIDLSHVLQL

SEQ ID NO: 2484430 - protein, 21 aa, Entamoeba dispar
GYDELCDRFMYSLEKETNIHV

SEQ ID NO: 2484431 - protein, 23 aa, Entamoeba dispar
GYDGRFLAKYGINNIIEKGKMIY

SEQ ID NO: 2484432 - protein, 18 aa, Entamoeba dispar
GYDGRFLAKYGIVKIIKR

SEQ ID NO: 2484433 - protein, 22 aa, Entamoeba dispar
GYDGRFLAQYGIIGITRKGSNI

SEQ ID NO: 2484434 - protein, 18 aa, Entamoeba dispar
GYDSKRLVGRKVDEIKDW

SEQ ID NO: 2484435 - protein, 23 aa, Entamoeba dispar
GYECFDRRWSLTSINIENLQFIS

SEQ ID NO: 2484436 - protein, 18 aa, Entamoeba dispar
GYECFKDCYELTTINIPT

SEQ ID NO: 2484437 - protein, 22 aa, Entamoeba dispar
GYECFYNCLSLTSINIVNIKFI

SEQ ID NO: 2484438 - protein, 26 aa, Entamoeba dispar
GYEQAMFKERFCDFYDNGSNIKKNPM

SEQ ID NO: 2484439 - protein, 27 aa, Entamoeba dispar
GYFNKEFIRQKCLTFGDVVGVSLKDQM

SEQ ID NO: 2484440 - protein, 18 aa, Entamoeba dispar
GYFQECFVLAYRLVTTPG

SEQ ID NO: 2484441 - protein, 26 aa, Entamoeba dispar
GYFSIFFYVFALKYIPKFFQSAIHLI

SEQ ID NO: 2484442 - protein, 18 aa, Entamoeba dispar
GYGAIGISLRLSETSSKK

SEQ ID NO: 2484443 - protein, 21 aa, Entamoeba dispar
GYGCFCKCTSLQSINIPTSIN

SEQ ID NO: 2484444 - protein, 19 aa, Entamoeba dispar
GYGCFYGCSTLTRIDIAKI

SEQ ID NO: 2484445 - protein, 23 aa, Entamoeba dispar
GYGCKRCEEGYYLTRDMKCLKCD

SEQ ID NO: 2484446 - protein, 21 aa, Entamoeba dispar
GYGEHQCKYIFAIKKLIYNEV

SEQ ID NO: 2484447 - protein, 17 aa, Entamoeba dispar
GYGMPIGTTGKRGDLYL

SEQ ID NO: 2484448 - protein, 24 aa, Entamoeba dispar
GYGRGLCANKEFKQDEIIMSIPYS

SEQ ID NO: 2484449 - protein, 24 aa, Entamoeba dispar
GYGSGLLPKIILVVIEELTSETKK

SEQ ID NO: 2484450 - protein, 27 aa, Entamoeba dispar
GYHLYKHILWLIDHCYIDHIYFDIMKW

SEQ ID NO: 2484451 - protein, 21 aa, Entamoeba dispar
GYICNGEKFIAVSHAPCLPPL

SEQ ID NO: 2484452 - protein, 24 aa, Entamoeba dispar
GYIEKTKIGIQLDRKKTDTGLSNL

SEQ ID NO: 2484453 - protein, 18 aa, Entamoeba dispar
GYIGEWKEMELILTNDLM

SEQ ID NO: 2484454 - protein, 17 aa, Entamoeba dispar
GYIKLFKFIEGLNELEY

SEQ ID NO: 2484455 - protein, 30 aa, Entamoeba dispar
GYINEECFLLWLYDEVIPFVTEQRKKTGNE

SEQ ID NO: 2484456 - protein, 17 aa, Entamoeba dispar
GYIPFIGVIIQDLTFID

SEQ ID NO: 2484457 - protein, 18 aa, Entamoeba dispar
GYITLTFNKPIFIKNILV

SEQ ID NO: 2484458 - protein, 23 aa, Entamoeba dispar
GYKPGMKVCTRFPPEPSGYLHIG

SEQ ID NO: 2484459 - protein, 20 aa, Entamoeba dispar
GYLCPHCSTVTNIFSSNGGK

SEQ ID NO: 2484460 - protein, 17 aa, Entamoeba dispar
GYLDHLFVLKRGTTTAI

SEQ ID NO: 2484461 - protein, 31 aa, Entamoeba dispar
GYLKYWIPRLSELFPSITFYQSECDVNPLVY

SEQ ID NO: 2484462 - protein, 17 aa, Entamoeba dispar
GYLLLKYINEKKIQFDR

SEQ ID NO: 2484463 - protein, 23 aa, Entamoeba dispar
GYLMLRRNIGFLTRIISLLFSFD

SEQ ID NO: 2484464 - protein, 37 aa, Entamoeba dispar
GYLQITLKVEGFEFERCVDDFIFFCFLVGNDFLPHIP

SEQ ID NO: 2484465 - protein, 20 aa, Entamoeba dispar
GYMNNVAKFDTMWAQEHSGD

SEQ ID NO: 2484466 - protein, 19 aa, Entamoeba dispar
GYMNNVAKFDTMWNQEHDR

SEQ ID NO: 2484467 - protein, 25 aa, Entamoeba dispar
GYNAFKGCGLTSIELPPNEDGIGCY

SEQ ID NO: 2484468 - protein, 34 aa, Entamoeba dispar
GYNYRAFDLANHFCEWCGFDCNWDSYPNEETQRR

SEQ ID NO: 2484469 - protein, 26 aa, Entamoeba dispar
GYPNLRPVHRLDRMTSGILLLAKTIQ

SEQ ID NO: 2484470 - protein, 21 aa, Entamoeba dispar
GYPTEINYLFLGDYVDRGKYG

SEQ ID NO: 2484471 - protein, 28 aa, Entamoeba dispar
GYQYWKLHCLEYSKKQVIDFIKKIEGEL

SEQ ID NO: 2484472 - protein, 19 aa, Entamoeba dispar
GYSAWDYNSPVFIIKDEFG

SEQ ID NO: 2484473 - protein, 24 aa, Entamoeba dispar
GYSLKRGSGYGIGFIYLNKYNEIT

SEQ ID NO: 2484474 - protein, 19 aa, Entamoeba dispar
GYSVIEMFETSNLERLRVV

SEQ ID NO: 2484475 - protein, 25 aa, Entamoeba dispar
GYTKESLQIVWLWEVINEMENSLKG

SEQ ID NO: 2484476 - protein, 21 aa, Entamoeba dispar
GYTRRYGKGKILITGFHFEFD

SEQ ID NO: 2484477 - protein, 26 aa, Entamoeba dispar
GYVQWATCVTDLFKTAGVALADEFSK

SEQ ID NO: 2484478 - protein, 26 aa, Entamoeba dispar
GYYDPNVACIWGWWGTLMSNHELKRY

SEQ ID NO: 2484479 - protein, 23 aa, Entamoeba dispar
GYYKFKGIEGISKITDVKPYSEK

SEQ ID NO: 2484480 - protein, 18 aa, Entamoeba dispar
GYYLCNIIDTPGHSDFID

SEQ ID NO: 2484481 - protein, 17 aa, Entamoeba dispar
GYYLMKCVSHFMTMVPF

SEQ ID NO: 2484482 - protein, 17 aa, Entamoeba dispar
HAAVSIIACCMSKVAND

SEQ ID NO: 2484483 - protein, 24 aa, Entamoeba dispar
HADFLIKSIISYHCNHHVLEQLIK

SEQ ID NO: 2484484 - protein, 18 aa, Entamoeba dispar
HAEFAEALYLAEKAAQEE

SEQ ID NO: 2484485 - protein, 17 aa, Entamoeba dispar
HAFDGSGADNFYDAGSC

SEQ ID NO: 2484486 - protein, 25 aa, Entamoeba dispar
HAFQPYCLSEAITPEAALEHLSNGN

SEQ ID NO: 2484487 - protein, 21 aa, Entamoeba dispar
HAFYWKCMCGCGVKPSEQLTA

SEQ ID NO: 2484488 - protein, 18 aa, Entamoeba dispar
HAGLCHRVLVQLSYAIGV

SEQ ID NO: 2484489 - protein, 25 aa, Entamoeba dispar
HAGVKLALNVGREFIDMSDLTFNIF

SEQ ID NO: 2484490 - protein, 21 aa, Entamoeba dispar
HAINLKCILDKINEMYQIIRD

SEQ ID NO: 2484491 - protein, 19 aa, Entamoeba dispar
HAKLYPFHQASIYRLNQRE

SEQ ID NO: 2484492 - protein, 21 aa, Entamoeba dispar
HAKNGFMLYDCFGNLQFETYK

SEQ ID NO: 2484493 - protein, 18 aa, Entamoeba dispar
HALFLFKNPEEWINNLVE

SEQ ID NO: 2484494 - protein, 21 aa, Entamoeba dispar
HALGEVCPICGGRFVDMERHT

SEQ ID NO: 2484495 - protein, 26 aa, Entamoeba dispar
HAMEITHCELLRCFIKILKRIKDINE

SEQ ID NO: 2484496 - protein, 20 aa, Entamoeba dispar
HANFKFRYEYVTETKEQTAK

SEQ ID NO: 2484497 - protein, 17 aa, Entamoeba dispar
HANLCLDAMNEGRTPPI

SEQ ID NO: 2484498 - protein, 28 aa, Entamoeba dispar
HANVKVEGFWPIVMAKALANADIEDLIM

SEQ ID NO: 2484499 - protein, 19 aa, Entamoeba dispar
HAPCLPPLNSIIYDEIAKI

SEQ ID NO: 2484500 - protein, 33 aa, Entamoeba dispar
HAQFYIPIARECECFGCFGIPLDIAVQRGEWKV

SEQ ID NO: 2484501 - protein, 21 aa, Entamoeba dispar
HAQKFFKKKGITLKMAGERTN

SEQ ID NO: 2484502 - protein, 31 aa, Entamoeba dispar
HAQVKGSALVFCSAFSSFPRDTEFISILINE

SEQ ID NO: 2484503 - protein, 18 aa, Entamoeba dispar
HARILFEMIQSLKKEGQE

SEQ ID NO: 2484504 - protein, 17 aa, Entamoeba dispar
HARRYLHRDLKPQNILI

SEQ ID NO: 2484505 - protein, 17 aa, Entamoeba dispar
HARTITVGMNNVRKFIF

SEQ ID NO: 2484506 - protein, 18 aa, Entamoeba dispar
HASEIEAALMVKMSTERK

SEQ ID NO: 2484507 - protein, 24 aa, Entamoeba dispar
HASELKRTPLFIVGDMDSVSQETI

SEQ ID NO: 2484508 - protein, 25 aa, Entamoeba dispar
HATLHAFSHWSWCISNHQLVIVDLQ

SEQ ID NO: 2484509 - protein, 18 aa, Entamoeba dispar
HAVIKYSSKGYLKRKRIM

SEQ ID NO: 2484510 - protein, 20 aa, Entamoeba dispar
HAVNEIGGFLAVASGNELEL

SEQ ID NO: 2484511 - protein, 20 aa, Entamoeba dispar
HCDEEDCTGGLIDEITQTLH

SEQ ID NO: 2484512 - protein, 26 aa, Entamoeba dispar
HCDTGDFKPSPGFKMPCKEILHGVGP

SEQ ID NO: 2484513 - protein, 21 aa, Entamoeba dispar
HCFELPLKRMQEGLTPTTYTN

SEQ ID NO: 2484514 - protein, 18 aa, Entamoeba dispar
HCFYGCTSLKSINIPSSI

SEQ ID NO: 2484515 - protein, 17 aa, Entamoeba dispar
HCGCHEGCWCWKHANQL

SEQ ID NO: 2484516 - protein, 23 aa, Entamoeba dispar
HCGLKSLILPFSITSIALDAFDS

SEQ ID NO: 2484517 - protein, 24 aa, Entamoeba dispar
HCHIPRNCFRNCGTIKQIIINDWV

SEQ ID NO: 2484518 - protein, 30 aa, Entamoeba dispar
HCIDEFMYSIPFFFHLKKLKIGYSSYFNFN

SEQ ID NO: 2484519 - protein, 19 aa, Entamoeba dispar
HCIHEIIHYIQLLKKVYSF

SEQ ID NO: 2484520 - protein, 26 aa, Entamoeba dispar
HCIHLKRKILEILVKCFFETLDEELP

SEQ ID NO: 2484521 - protein, 31 aa, Entamoeba dispar
HCKLRNCIVGCLMCGCEILPPSTYYICSECE

SEQ ID NO: 2484522 - protein, 25 aa, Entamoeba dispar
HCLAGRGRTGTVITSFLQYIKLCTT

SEQ ID NO: 2484523 - protein, 17 aa, Entamoeba dispar
HCMIHLWDTIAADIVYL

SEQ ID NO: 2484524 - protein, 19 aa, Entamoeba dispar
HCQYRLGRVDSYTLADGIQ

SEQ ID NO: 2484525 - protein, 25 aa, Entamoeba dispar
HCRAGRGRTGIVVCSVLLALGKAKN

SEQ ID NO: 2484526 - protein, 26 aa, Entamoeba dispar
HCSISKLIIRRCQFIENILLPFQCQS

SEQ ID NO: 2484527 - protein, 22 aa, Entamoeba dispar
HCTCCPKCKIPVERIKGCNFIR

SEQ ID NO: 2484528 - protein, 19 aa, Entamoeba dispar
HDEHFSVLPIEITKQKTLE

SEQ ID NO: 2484529 - protein, 19 aa, Entamoeba dispar
HDFCFYRCSSLVFISIPST

SEQ ID NO: 2484530 - protein, 20 aa, Entamoeba dispar
HDGKRRIRYFGGLKFVTPGE

SEQ ID NO: 2484531 - protein, 17 aa, Entamoeba dispar
HDICYALTCISSVLPSA

SEQ ID NO: 2484532 - protein, 18 aa, Entamoeba dispar
HDIHCKIEGPAVNDIERN

SEQ ID NO: 2484533 - protein, 17 aa, Entamoeba dispar
HDISHCIQTIVVGSDVK

SEQ ID NO: 2484534 - protein, 20 aa, Entamoeba dispar
HDIYLKKGVILLFYTDYYLQ

SEQ ID NO: 2484535 - protein, 26 aa, Entamoeba dispar
HDKESWKAIPAMRLMPLLETALGYEV

SEQ ID NO: 2484536 - protein, 23 aa, Entamoeba dispar
HDLEPSLKLLVEFQNSLPVVLKK

SEQ ID NO: 2484537 - protein, 23 aa, Entamoeba dispar
HDNDPFKSWTLWWKEKRNTYPSL

SEQ ID NO: 2484538 - protein, 19 aa, Entamoeba dispar
HDNQCLKLILKQSKSFDPI

SEQ ID NO: 2484539 - protein, 28 aa, Entamoeba dispar
HDPRKKDLILNVVMYKNGFVVNDGPLRN

SEQ ID NO: 2484540 - protein, 25 aa, Entamoeba dispar
HDPTIRFVGAYGKRNNRVMFIGINN

SEQ ID NO: 2484541 - protein, 20 aa, Entamoeba dispar
HDQKRFQVFESYNEKKVVIE

SEQ ID NO: 2484542 - protein, 18 aa, Entamoeba dispar
HDSNNGFNPLSIIKEEGF

SEQ ID NO: 2484543 - protein, 20 aa, Entamoeba dispar
HDSNNGFNPLSIIKEEGFDN

SEQ ID NO: 2484544 - protein, 17 aa, Entamoeba dispar
HDVCKAMMLCGKIDGPI

SEQ ID NO: 2484545 - protein, 18 aa, Entamoeba dispar
HDVRCRYGIIKRRALRLE

SEQ ID NO: 2484546 - protein, 27 aa, Entamoeba dispar
HDVRRMSVSVKQRYKVIEGKQRTQPNF

SEQ ID NO: 2484547 - protein, 21 aa, Entamoeba dispar
HDYIIWMGDLNYRIEMEDSVV

SEQ ID NO: 2484548 - protein, 24 aa, Entamoeba dispar
HDYNYRLLMLESEVIIVQQPPSTK

SEQ ID NO: 2484549 - protein, 24 aa, Entamoeba dispar
HDYNYRLLMLESEVIIVQQPPTTK

SEQ ID NO: 2484550 - protein, 29 aa, Entamoeba dispar
HDYVQWVFPTFVKSMFNWNSYALDKEEAI

SEQ ID NO: 2484551 - protein, 17 aa, Entamoeba dispar
HEAELRQILSVLGRPLS

SEQ ID NO: 2484552 - protein, 22 aa, Entamoeba dispar
HEAELRQILSVLGRPLSNSEVE

SEQ ID NO: 2484553 - protein, 21 aa, Entamoeba dispar
HECPICHEHYWSTATTRVKTC

SEQ ID NO: 2484554 - protein, 23 aa, Entamoeba dispar
HEDCTGYCYLPCFLQQNQSQSSS

SEQ ID NO: 2484555 - protein, 26 aa, Entamoeba dispar
HEDEHICIINEGFPVKIHLCETKEQI

SEQ ID NO: 2484556 - protein, 24 aa, Entamoeba dispar
HEDHFFRVKVTVLLEGKNIGDVLS

SEQ ID NO: 2484557 - protein, 26 aa, Entamoeba dispar
HEDMLFKVIFKLTNKMGEEIATLHSF

SEQ ID NO: 2484558 - protein, 20 aa, Entamoeba dispar
HEEELLWNAFEETLTEEARL

SEQ ID NO: 2484559 - protein, 25 aa, Entamoeba dispar
HEEFLELLPKLAHGEKVDKKCFEGE

SEQ ID NO: 2484560 - protein, 21 aa, Entamoeba dispar
HEEKSFLFSMMNNFVPIAKTI

SEQ ID NO: 2484561 - protein, 18 aa, Entamoeba dispar
HEGKERITTIIVYDKGKK

SEQ ID NO: 2484562 - protein, 26 aa, Entamoeba dispar
HEGKTLCPFCGLWISENKFKIHQSQC

SEQ ID NO: 2484563 - protein, 19 aa, Entamoeba dispar
HEIDSTKLLIQMLLCSTQS

SEQ ID NO: 2484564 - protein, 17 aa, Entamoeba dispar
HEITAYYGLAHGETLAM

SEQ ID NO: 2484565 - protein, 25 aa, Entamoeba dispar
HEKEFDCLKSLEIEEKINVVKFVHQ

SEQ ID NO: 2484566 - protein, 24 aa, Entamoeba dispar
HEKNFKKELPFFANIIRNNGTSGD

SEQ ID NO: 2484567 - protein, 18 aa, Entamoeba dispar
HEKPSFILNHIFKQLECA

SEQ ID NO: 2484568 - protein, 29 aa, Entamoeba dispar
HEKTYGLDIFKVRIRKVGKAKEIPKIFGI

SEQ ID NO: 2484569 - protein, 25 aa, Entamoeba dispar
HELLQRYFCFIGNYELPNWTNEYKE

SEQ ID NO: 2484570 - protein, 17 aa, Entamoeba dispar
HELRICDLETNLEMVLT

SEQ ID NO: 2484571 - protein, 22 aa, Entamoeba dispar
HELTVQFILRTNISISSFVISD

SEQ ID NO: 2484572 - protein, 20 aa, Entamoeba dispar
HELVGVLYYCISRDIQSWKG

SEQ ID NO: 2484573 - protein, 25 aa, Entamoeba dispar
HELYIKEGDGFILVYAVNDSDSFNS

SEQ ID NO: 2484574 - protein, 19 aa, Entamoeba dispar
HEMKIQSSITLFFDNKLNM

SEQ ID NO: 2484575 - protein, 26 aa, Entamoeba dispar
HENDLFDRFGRFCIIPIENIMNENIY

SEQ ID NO: 2484576 - protein, 20 aa, Entamoeba dispar
HEPVSCGVHYGRENNVDLYF

SEQ ID NO: 2484577 - protein, 23 aa, Entamoeba dispar
HERDNIELLLGFMKRNKVDVRIV

SEQ ID NO: 2484578 - protein, 20 aa, Entamoeba dispar
HERIFEGTEGVVLANKLLHS

SEQ ID NO: 2484579 - protein, 18 aa, Entamoeba dispar
HERRGVVFEVEKTVIFGT

SEQ ID NO: 2484580 - protein, 18 aa, Entamoeba dispar
HESFTEMMRVLKTVLVEV

SEQ ID NO: 2484581 - protein, 17 aa, Entamoeba dispar
HEVKRTEQFYCSALEVE

SEQ ID NO: 2484582 - protein, 21 aa, Entamoeba dispar
HEVLLKLKKEREIMENEIKAL

SEQ ID NO: 2484583 - protein, 23 aa, Entamoeba dispar
HEYAKEFLMNYLLTSLKPSLEEL

SEQ ID NO: 2484584 - protein, 24 aa, Entamoeba dispar
HEYFPGTHAVPFSIIIPIVPHPSL

SEQ ID NO: 2484585 - protein, 23 aa, Entamoeba dispar
HEYLKRKEMEALQGDVEKNQAQL

SEQ ID NO: 2484586 - protein, 24 aa, Entamoeba dispar
HFAAPEHYLFAGIDGHSGKYVSYM

SEQ ID NO: 2484587 - protein, 17 aa, Entamoeba dispar
HFCNEIFCQVQTYNPQT

SEQ ID NO: 2484588 - protein, 25 aa, Entamoeba dispar
HFDEIFNILSPFIFSSEKFRNYRFN

SEQ ID NO: 2484589 - protein, 20 aa, Entamoeba dispar
HFDLRNRRVFTIDNKETKMR

SEQ ID NO: 2484590 - protein, 25 aa, Entamoeba dispar
HFDMSYRAVPMSTKFIVLPEDEKEN

SEQ ID NO: 2484591 - protein, 28 aa, Entamoeba dispar
HFECPICNFCYCELPIQCKICNAILLLS

SEQ ID NO: 2484592 - protein, 25 aa, Entamoeba dispar
HFEEEFPYQIVFGVIQKDPTNVLGL

SEQ ID NO: 2484593 - protein, 28 aa, Entamoeba dispar
HFENLRIITKLLNKWNVLNKENIHQNPE

SEQ ID NO: 2484594 - protein, 23 aa, Entamoeba dispar
HFFKNGPIVWKWGNDSIKQLNKF

SEQ ID NO: 2484595 - protein, 23 aa, Entamoeba dispar
HFGCFVCKAALKGKSYKDIGGEP

SEQ ID NO: 2484596 - protein, 19 aa, Entamoeba dispar
HFGGDGFGIFTDEDETGNG

SEQ ID NO: 2484597 - protein, 27 aa, Entamoeba dispar
HFHPKPEMPFVISSSYDNTVRVWDIKD

SEQ ID NO: 2484598 - protein, 25 aa, Entamoeba dispar
HFHVPVYVCTGTYKICPNFPTNSNG

SEQ ID NO: 2484599 - protein, 19 aa, Entamoeba dispar
HFIDIYLPDVLEFDKNLYK

SEQ ID NO: 2484600 - protein, 35 aa, Entamoeba dispar
HFIGHSLGGLYLRFAIPILFKRGIFNNLNWIPFSF

SEQ ID NO: 2484601 - protein, 25 aa, Entamoeba dispar
HFILEKKFTVSRLKLLKTLDQDVVE

SEQ ID NO: 2484602 - protein, 24 aa, Entamoeba dispar
HFILPTKRIRAIKPKEQVKIDDDM

SEQ ID NO: 2484603 - protein, 18 aa, Entamoeba dispar
HFKEFNLGPIDAKVEDGT

SEQ ID NO: 2484604 - protein, 24 aa, Entamoeba dispar
HFKEPECLCIIGTKPLTHLFEEIL

SEQ ID NO: 2484605 - protein, 20 aa, Entamoeba dispar
HFKIGEQFIEFEQPTQSSHR

SEQ ID NO: 2484606 - protein, 23 aa, Entamoeba dispar
HFKIILKHQCFVREYLKNGIDNL

SEQ ID NO: 2484607 - protein, 19 aa, Entamoeba dispar
HFKTISKFQLFNKVKINAS

SEQ ID NO: 2484608 - protein, 18 aa, Entamoeba dispar
HFLAPEIVDETGYNEKVD

SEQ ID NO: 2484609 - protein, 17 aa, Entamoeba dispar
HFLFTFRNKMNIGHIKF

SEQ ID NO: 2484610 - protein, 17 aa, Entamoeba dispar
HFLKKVEMEECSGIDIK

SEQ ID NO: 2484611 - protein, 23 aa, Entamoeba dispar
HFLMRYEPKIIKEIYYTLFKSEK

SEQ ID NO: 2484612 - protein, 25 aa, Entamoeba dispar
HFLQDILLDYGYFFTLATEKGKKST

SEQ ID NO: 2484613 - protein, 21 aa, Entamoeba dispar
HFLRGKQCINPDCTYLHQLVS

SEQ ID NO: 2484614 - protein, 17 aa, Entamoeba dispar
HFLSCGGSFGDLMKMKY

SEQ ID NO: 2484615 - protein, 25 aa, Entamoeba dispar
HFLSFLIPHMSKFLSVEYIPTINDL

SEQ ID NO: 2484616 - protein, 31 aa, Entamoeba dispar
HFLVLYRYYLRHVPKNIAKLCSIGMTDEIEL

SEQ ID NO: 2484617 - protein, 22 aa, Entamoeba dispar
HFMDREKFNVLYNSQQSVIQQL

SEQ ID NO: 2484618 - protein, 17 aa, Entamoeba dispar
HFNHIFVIVQPISKEEA

SEQ ID NO: 2484619 - protein, 22 aa, Entamoeba dispar
HFNMLKEMYGEITVINLLNNNG

SEQ ID NO: 2484620 - protein, 23 aa, Entamoeba dispar
HFQKVIECYDKKEIQTFNDFFYA

SEQ ID NO: 2484621 - protein, 23 aa, Entamoeba dispar
HFQPEISRTILLTHLYDNPYIHK

SEQ ID NO: 2484622 - protein, 20 aa, Entamoeba dispar
HFQPVVLPPQLIMKYYSQIQ

SEQ ID NO: 2484623 - protein, 25 aa, Entamoeba dispar
HFRCDEVPASWVLQILGNIDDPFIG

SEQ ID NO: 2484624 - protein, 17 aa, Entamoeba dispar
HFSPLCHSFGLPMNCSQ

SEQ ID NO: 2484625 - protein, 25 aa, Entamoeba dispar
HFTANCKINDLWYRFDDETVKPLNK

SEQ ID NO: 2484626 - protein, 17 aa, Entamoeba dispar
HFTSRYMYLTLWGDEIS

SEQ ID NO: 2484627 - protein, 19 aa, Entamoeba dispar
HFYELFKSCEEGEVIKRLE

SEQ ID NO: 2484628 - protein, 20 aa, Entamoeba dispar
HFYPHLASLILPHIHSLPQS

SEQ ID NO: 2484629 - protein, 19 aa, Entamoeba dispar
HGAYKFKPGMHPRIRLDIL

SEQ ID NO: 2484630 - protein, 23 aa, Entamoeba dispar
HGDESYIRHCVRPLETLLTKYKK

SEQ ID NO: 2484631 - protein, 24 aa, Entamoeba dispar
HGDILRVYCAFSITETLDINFRPD

SEQ ID NO: 2484632 - protein, 20 aa, Entamoeba dispar
HGEAALPLFEHADIDSIELL

SEQ ID NO: 2484633 - protein, 25 aa, Entamoeba dispar
HGEDYKDVIVCVGQNKKILSNSSLS

SEQ ID NO: 2484634 - protein, 23 aa, Entamoeba dispar
HGEIPELLIPFVIQSKKASHADF

SEQ ID NO: 2484635 - protein, 18 aa, Entamoeba dispar
HGETKWNLLGKIQGCTDI

SEQ ID NO: 2484636 - protein, 19 aa, Entamoeba dispar
HGFNKYRGGLDVASGSTGT

SEQ ID NO: 2484637 - protein, 19 aa, Entamoeba dispar
HGGIVIEKGRREYWRIVNN

SEQ ID NO: 2484638 - protein, 29 aa, Entamoeba dispar
HGICMPWLVIDLIKLIPLICIEKREIVSF

SEQ ID NO: 2484639 - protein, 24 aa, Entamoeba dispar
HGIDVKKIRSMIEDFGERIVQPPW

SEQ ID NO: 2484640 - protein, 25 aa, Entamoeba dispar
HGINIPFEFMDRSMIELNDRGDRFN

SEQ ID NO: 2484641 - protein, 22 aa, Entamoeba dispar
HGIPGDFLDRLIIVKTQEYTSD

SEQ ID NO: 2484642 - protein, 19 aa, Entamoeba dispar
HGKTQMIDLLFKYSHDKII

SEQ ID NO: 2484643 - protein, 26 aa, Entamoeba dispar
HGLLDKIMFCYGIGYKNPRKEGGPHY

SEQ ID NO: 2484644 - protein, 29 aa, Entamoeba dispar
HGLLDKIMFCYGIGYKNPRKEGGPHYDIV

SEQ ID NO: 2484645 - protein, 25 aa, Entamoeba dispar
HGLSWRLQCRVKHHISLIDGLEEYF

SEQ ID NO: 2484646 - protein, 24 aa, Entamoeba dispar
HGPPGCGKTLLAKAIAGEVGVAFI

SEQ ID NO: 2484647 - protein, 30 aa, Entamoeba dispar
HGRGGQSSVRFARLRLEKRHNYVRQVGELA

SEQ ID NO: 2484648 - protein, 21 aa, Entamoeba dispar
HGRVAGILLPHIIRYNAKAPV

SEQ ID NO: 2484649 - protein, 23 aa, Entamoeba dispar
HGSELFEGSIIRGMRRLEELLVQ

SEQ ID NO: 2484650 - protein, 18 aa, Entamoeba dispar
HGSINSFSSSPCHIEIIL

SEQ ID NO: 2484651 - protein, 26 aa, Entamoeba dispar
HGSLQPFGGLIAWLRMYATDEFLNVK

SEQ ID NO: 2484652 - protein, 18 aa, Entamoeba dispar
HGTGHGVGYYLLVHECPP

SEQ ID NO: 2484653 - protein, 28 aa, Entamoeba dispar
HGTGKICQCIKCGYRGNADVILPKGLIP

SEQ ID NO: 2484654 - protein, 25 aa, Entamoeba dispar
HGVIKGMFKTAAFGAQYLRDETKAT

SEQ ID NO: 2484655 - protein, 17 aa, Entamoeba dispar
HGVKLILGLLYTLYRKY

SEQ ID NO: 2484656 - protein, 27 aa, Entamoeba dispar
HGVTVHFLRLPYFFNYLQIAAGEEEVW

SEQ ID NO: 2484657 - protein, 18 aa, Entamoeba dispar
HGYEAKFAKQTSTPKDIV

SEQ ID NO: 2484658 - protein, 20 aa, Entamoeba dispar
HGYLKMVGISYSFMYKWIIL

SEQ ID NO: 2484659 - protein, 27 aa, Entamoeba dispar
HHHSRLCLVINGLPGGPYYSAPFVLQA

SEQ ID NO: 2484660 - protein, 27 aa, Entamoeba dispar
HHIWSSCFALGCLHFNKGLEFNHIEIM

SEQ ID NO: 2484661 - protein, 22 aa, Entamoeba dispar
HHLKRLNAPHHWMLSKLGGTFA

SEQ ID NO: 2484662 - protein, 18 aa, Entamoeba dispar
HHLSICFDPITKTIVMYG

SEQ ID NO: 2484663 - protein, 24 aa, Entamoeba dispar
HHLSTDPYTGFALVLTPTRELASQ

SEQ ID NO: 2484664 - protein, 36 aa, Entamoeba dispar
HHLYKCSKCGFGVCSECLKKGPTCRCNQGMIPLTEE

SEQ ID NO: 2484665 - protein, 25 aa, Entamoeba dispar
HHRLRKWYYRNGFSIIDKNYKQPSY

SEQ ID NO: 2484666 - protein, 17 aa, Entamoeba dispar
HHTCITLIKIQNETGEI

SEQ ID NO: 2484667 - protein, 23 aa, Entamoeba dispar
HIARLEYKYGSLIKEDQFKQKLS

SEQ ID NO: 2484668 - protein, 23 aa, Entamoeba dispar
HIASCAFIALGRFLIKGYDHLSE

SEQ ID NO: 2484669 - protein, 20 aa, Entamoeba dispar
HIEMRWKEIVQERQIALDNM

SEQ ID NO: 2484670 - protein, 17 aa, Entamoeba dispar
HIFCNHFANVQSYKTVL

SEQ ID NO: 2484671 - protein, 18 aa, Entamoeba dispar
HIFCNHFANVQSYKTVLQ

SEQ ID NO: 2484672 - protein, 18 aa, Entamoeba dispar
HIFIYKNLCKEVMEYCFV

SEQ ID NO: 2484673 - protein, 21 aa, Entamoeba dispar
HIGTQLICICIEKIERSDSKK

SEQ ID NO: 2484674 - protein, 24 aa, Entamoeba dispar
HIICFLIPCCTGSIVSYVNSHYDD

SEQ ID NO: 2484675 - protein, 17 aa, Entamoeba dispar
HIIEHSTLCGSDHYTTK

SEQ ID NO: 2484676 - protein, 18 aa, Entamoeba dispar
HIIIISNMIVDLWKNNDC

SEQ ID NO: 2484677 - protein, 18 aa, Entamoeba dispar
HIISFCLNPFYLNEQNYG

SEQ ID NO: 2484678 - protein, 17 aa, Entamoeba dispar
HIITMIECFPDFVYEIY

SEQ ID NO: 2484679 - protein, 23 aa, Entamoeba dispar
HIKEIPKHIDGFWVEVDHIPVNA

SEQ ID NO: 2484680 - protein, 24 aa, Entamoeba dispar
HIKEMRWEVIKCIQEIYNEIINLT

SEQ ID NO: 2484681 - protein, 22 aa, Entamoeba dispar
HIKFNIEGFKIIKQISEASFNL

SEQ ID NO: 2484682 - protein, 24 aa, Entamoeba dispar
HIKNSELLQCIYIICKKLIINNSA

SEQ ID NO: 2484683 - protein, 19 aa, Entamoeba dispar
HILEAIRFNDILISSNGAL

SEQ ID NO: 2484684 - protein, 35 aa, Entamoeba dispar
HILIQHIVCLNINRLEIFWEQFLLSVLSFCLKENG

SEQ ID NO: 2484685 - protein, 23 aa, Entamoeba dispar
HILLRWQDLMVISLLLLKMEQRF

SEQ ID NO: 2484686 - protein, 17 aa, Entamoeba dispar
HILRTALHRGIFERAAG

SEQ ID NO: 2484687 - protein, 26 aa, Entamoeba dispar
HINEFEPRFLFKVIEKEANQMVGKQN

SEQ ID NO: 2484688 - protein, 19 aa, Entamoeba dispar
HINLKLGNLQQIYTVNSSV

SEQ ID NO: 2484689 - protein, 25 aa, Entamoeba dispar
HINLLDRMVVEFDKKDALILVYNHF

SEQ ID NO: 2484690 - protein, 25 aa, Entamoeba dispar
HINNLKLEFIRFFKVKHVNINEVIE

SEQ ID NO: 2484691 - protein, 24 aa, Entamoeba dispar
HINSIWFSFVFPQINPKNYITDPF

SEQ ID NO: 2484692 - protein, 23 aa, Entamoeba dispar
HIPQGRVALIGTLFKKSKKIPTL

SEQ ID NO: 2484693 - protein, 26 aa, Entamoeba dispar
HIPSLISKLGLWCFYGCTSLTSVNLP

SEQ ID NO: 2484694 - protein, 17 aa, Entamoeba dispar
HIPSSISEIGDWCFNEC

SEQ ID NO: 2484695 - protein, 18 aa, Entamoeba dispar
HIQIPLRKFRQIQREEDR

SEQ ID NO: 2484696 - protein, 19 aa, Entamoeba dispar
HIRGQMQRKVWINVNDVIL

SEQ ID NO: 2484697 - protein, 19 aa, Entamoeba dispar
HIRIHPICDGIYLLIGKLL

SEQ ID NO: 2484698 - protein, 24 aa, Entamoeba dispar
HISHPLCIAKIFATILISQNIEKS

SEQ ID NO: 2484699 - protein, 24 aa, Entamoeba dispar
HITEWCGVVMDWSKYPTKEEQDFF

SEQ ID NO: 2484700 - protein, 26 aa, Entamoeba dispar
HITYASSVKLMLKKLQTILLDPAKKM

SEQ ID NO: 2484701 - protein, 24 aa, Entamoeba dispar
HIVICAPFLKDKYVSYSLKKLKFY

SEQ ID NO: 2484702 - protein, 37 aa, Entamoeba dispar
HIYIYMLEQGYRDAAKVFKKEARVDYDAEASCIECIS

SEQ ID NO: 2484703 - protein, 21 aa, Entamoeba dispar
HIYQSIPYWVWMILKEENNEV

SEQ ID NO: 2484704 - protein, 22 aa, Entamoeba dispar
HIYQSIPYWVWMILKEENNEVE

SEQ ID NO: 2484705 - protein, 25 aa, Entamoeba dispar
HIYSFESMKLLPLKPLLTPHNRTIR

SEQ ID NO: 2484706 - protein, 20 aa, Entamoeba dispar
HKAETVWIPEIYRVAPGASI

SEQ ID NO: 2484707 - protein, 21 aa, Entamoeba dispar
HKCIFNCHKMEITGLAVDSNN

SEQ ID NO: 2484708 - protein, 17 aa, Entamoeba dispar
HKCRHLGCDKTYVSLRY

SEQ ID NO: 2484709 - protein, 18 aa, Entamoeba dispar
HKDFRVIFTSNPINGEIS

SEQ ID NO: 2484710 - protein, 18 aa, Entamoeba dispar
HKDGVALSYFIQALKKQP

SEQ ID NO: 2484711 - protein, 18 aa, Entamoeba dispar
HKEIKLIKKIEGLQQKEI

SEQ ID NO: 2484712 - protein, 20 aa, Entamoeba dispar
HKELRIYTDAGRCTRPLFTV

SEQ ID NO: 2484713 - protein, 25 aa, Entamoeba dispar
HKFPRIDAQTLLPVCTELNGRKEEW

SEQ ID NO: 2484714 - protein, 32 aa, Entamoeba dispar
HKFYKGKIQIMPKCTLAGFNWFNAYYTPGVSR

SEQ ID NO: 2484715 - protein, 24 aa, Entamoeba dispar
HKGFMKHVLGYTIEFLLRNICDKV

SEQ ID NO: 2484716 - protein, 25 aa, Entamoeba dispar
HKGFSYKLKLGKKIHQNRGVPQWFR

SEQ ID NO: 2484717 - protein, 21 aa, Entamoeba dispar
HKGGCGKIAIIGGSVEYTGAP

SEQ ID NO: 2484718 - protein, 27 aa, Entamoeba dispar
HKGGVLSYKYSSKFIKILANKIFQDKR

SEQ ID NO: 2484719 - protein, 17 aa, Entamoeba dispar
HKGKGFFPKLLNFICNP

SEQ ID NO: 2484720 - protein, 17 aa, Entamoeba dispar
HKGKHIISRCGACMTLI

SEQ ID NO: 2484721 - protein, 25 aa, Entamoeba dispar
HKGKYSWHCPGHMGGVAFLRSPPGK

SEQ ID NO: 2484722 - protein, 21 aa, Entamoeba dispar
HKGLFSRKSALSFSDKKENDK

SEQ ID NO: 2484723 - protein, 22 aa, Entamoeba dispar
HKHIHGGLTPGGRVRMEKLASL

SEQ ID NO: 2484724 - protein, 22 aa, Entamoeba dispar
HKHYLCTGFDLFTTHEPCLMCG

SEQ ID NO: 2484725 - protein, 22 aa, Entamoeba dispar
HKIELKEALDFIKQKIGLEQGT

SEQ ID NO: 2484726 - protein, 28 aa, Entamoeba dispar
HKIFVQGCIWNVNSFDQWGVELGKQLAK

SEQ ID NO: 2484727 - protein, 26 aa, Entamoeba dispar
HKIGASWKKEYFWLSSRRDCYIKGGI

SEQ ID NO: 2484728 - protein, 23 aa, Entamoeba dispar
HKIGEYPGSVYIEIPIEIRDKIM

SEQ ID NO: 2484729 - protein, 20 aa, Entamoeba dispar
HKIKRKQLLNVYKLINDYGT

SEQ ID NO: 2484730 - protein, 22 aa, Entamoeba dispar
HKIKRKQLLNVYKLINDYGTVD

SEQ ID NO: 2484731 - protein, 26 aa, Entamoeba dispar
HKINGVIVGSFFDYFVPYNLKDFYED

SEQ ID NO: 2484732 - protein, 25 aa, Entamoeba dispar
HKINYGMRTHERFGSGRRWFESSDF

SEQ ID NO: 2484733 - protein, 23 aa, Entamoeba dispar
HKIRIWRKQSIRQFGPLIDGMII

SEQ ID NO: 2484734 - protein, 18 aa, Entamoeba dispar
HKIVYLLNDMICWEGDKI

SEQ ID NO: 2484735 - protein, 22 aa, Entamoeba dispar
HKKAPIGLKGFIRGYVNFSGFV

SEQ ID NO: 2484736 - protein, 21 aa, Entamoeba dispar
HKKFDIFKFTRQVATKFFDLA

SEQ ID NO: 2484737 - protein, 19 aa, Entamoeba dispar
HKKGLFDLFSRIKHTTNEE

SEQ ID NO: 2484738 - protein, 21 aa, Entamoeba dispar
HKKGSCCFNLSKNYINLENTG

SEQ ID NO: 2484739 - protein, 22 aa, Entamoeba dispar
HKKLIFIPILSYCVLKYQFNTE

SEQ ID NO: 2484740 - protein, 22 aa, Entamoeba dispar
HKKRYGSYGSIHGWYDNYKFVN

SEQ ID NO: 2484741 - protein, 27 aa, Entamoeba dispar
HKKYFKLSGLLPICYFLEKKDYTSEEL

SEQ ID NO: 2484742 - protein, 24 aa, Entamoeba dispar
HKMDPHPTFGLSYQNIILETNRPL

SEQ ID NO: 2484743 - protein, 22 aa, Entamoeba dispar
HKNANKIALTFKELLQMSEKLG

SEQ ID NO: 2484744 - protein, 18 aa, Entamoeba dispar
HKNFMVSFGRNLYNTLIE

SEQ ID NO: 2484745 - protein, 21 aa, Entamoeba dispar
HKNLVTCVAWHPQSAYLLASA

SEQ ID NO: 2484746 - protein, 20 aa, Entamoeba dispar
HKNYKACGVLSEKKKDLDKH

SEQ ID NO: 2484747 - protein, 25 aa, Entamoeba dispar
HKREEFKFKGFRQLLKEMTVSSIHD

SEQ ID NO: 2484748 - protein, 19 aa, Entamoeba dispar
HKRGVQCIVAPYGADAQMA

SEQ ID NO: 2484749 - protein, 21 aa, Entamoeba dispar
HKSEILNNKFIMYFEIENEDS

SEQ ID NO: 2484750 - protein, 17 aa, Entamoeba dispar
HKSFRNIYEYVQQIKEY

SEQ ID NO: 2484751 - protein, 23 aa, Entamoeba dispar
HKSKELFMKGVILYTDSKGLIIV

SEQ ID NO: 2484752 - protein, 17 aa, Entamoeba dispar
HKSMRAEKSHPFYDLVV

SEQ ID NO: 2484753 - protein, 18 aa, Entamoeba dispar
HKTEFLMMLLENYRALMN

SEQ ID NO: 2484754 - protein, 38 aa, Entamoeba dispar
HKTILKILFMLSKWMSSFPHDFMDGGKEALLPLLDQFI

SEQ ID NO: 2484755 - protein, 20 aa, Entamoeba dispar
HKTNFKKIILNSTIKHLKLD

SEQ ID NO: 2484756 - protein, 25 aa, Entamoeba dispar
HKTPRLMNELEIDMLRGFQCTSSYV

SEQ ID NO: 2484757 - protein, 21 aa, Entamoeba dispar
HKVLDFYAGGLIKERVSSKIV

SEQ ID NO: 2484758 - protein, 17 aa, Entamoeba dispar
HKVSQPSVMKWEQMKLM

SEQ ID NO: 2484759 - protein, 18 aa, Entamoeba dispar
HKYFFESVETFVVLEPTN

SEQ ID NO: 2484760 - protein, 19 aa, Entamoeba dispar
HKYSFFVIKRVPILLDDKE

SEQ ID NO: 2484761 - protein, 25 aa, Entamoeba dispar
HLAKSSKLLAQWIVLCPSSVIPVFS

SEQ ID NO: 2484762 - protein, 17 aa, Entamoeba dispar
HLAMPFGGTISADDYEY

SEQ ID NO: 2484763 - protein, 25 aa, Entamoeba dispar
HLARKRMLMTGGLMMELFKNSLKRM

SEQ ID NO: 2484764 - protein, 19 aa, Entamoeba dispar
HLASIVKMYSFLIRALKRE

SEQ ID NO: 2484765 - protein, 19 aa, Entamoeba dispar
HLCTHRFVHIDFGYILNKK

SEQ ID NO: 2484766 - protein, 23 aa, Entamoeba dispar
HLDRNCQWIRLFEEIYGCDLEGL

SEQ ID NO: 2484767 - protein, 18 aa, Entamoeba dispar
HLEAKYSALFKKLDSGQF

SEQ ID NO: 2484768 - protein, 17 aa, Entamoeba dispar
HLEELQRKINLLDQQIQ

SEQ ID NO: 2484769 - protein, 18 aa, Entamoeba dispar
HLGCDKTYVSLRYLRAHE

SEQ ID NO: 2484770 - protein, 17 aa, Entamoeba dispar
HLGEAFSQFIPLLNVYK

SEQ ID NO: 2484771 - protein, 24 aa, Entamoeba dispar
HLGEGKYFIRYSLPAEKGEYHINC

SEQ ID NO: 2484772 - protein, 19 aa, Entamoeba dispar
HLHLLKIQPIVPRLQINQV

SEQ ID NO: 2484773 - protein, 17 aa, Entamoeba dispar
HLHLSFSTNCLKTNLLI

SEQ ID NO: 2484774 - protein, 21 aa, Entamoeba dispar
HLIICCCLNIGIEPPGYKKPK

SEQ ID NO: 2484775 - protein, 19 aa, Entamoeba dispar
HLILELSPQVNFIVGENGS

SEQ ID NO: 2484776 - protein, 18 aa, Entamoeba dispar
HLIRIGCIKESKANGGSR

SEQ ID NO: 2484777 - protein, 19 aa, Entamoeba dispar
HLIYHCIVSLFLQSKQSPL

SEQ ID NO: 2484778 - protein, 17 aa, Entamoeba dispar
HLKCIQTIHSLEIAEKL

SEQ ID NO: 2484779 - protein, 18 aa, Entamoeba dispar
HLKDFSIVHCFKSLAKIK

SEQ ID NO: 2484780 - protein, 18 aa, Entamoeba dispar
HLKDIYLTSFTVVSTVGP

SEQ ID NO: 2484781 - protein, 25 aa, Entamoeba dispar
HLKNEFKNYVYFTSKVECIGDANIQ

SEQ ID NO: 2484782 - protein, 17 aa, Entamoeba dispar
HLKSSRKKVSFFIGKKT

SEQ ID NO: 2484783 - protein, 22 aa, Entamoeba dispar
HLKTTIIVNMHIWKSLNASFKI

SEQ ID NO: 2484784 - protein, 21 aa, Entamoeba dispar
HLLCLKRLGRENHICSHCKTH

SEQ ID NO: 2484785 - protein, 20 aa, Entamoeba dispar
HLLFFYELIGSCFSLPLSHS

SEQ ID NO: 2484786 - protein, 18 aa, Entamoeba dispar
HLLFPNYICPAIEQTIVN

SEQ ID NO: 2484787 - protein, 25 aa, Entamoeba dispar
HLLIDLLFELGYIFVSRVTKGAQGS

SEQ ID NO: 2484788 - protein, 24 aa, Entamoeba dispar
HLLIDLLIIRGGYEFESKYAEGKA

SEQ ID NO: 2484789 - protein, 17 aa, Entamoeba dispar
HLLKVVGEIVNFLQSDP

SEQ ID NO: 2484790 - protein, 18 aa, Entamoeba dispar
HLLLCGQPGIGKTTSIHC

SEQ ID NO: 2484791 - protein, 25 aa, Entamoeba dispar
HLLLDMLRMYGITFNTTFSSGKHNS

SEQ ID NO: 2484792 - protein, 17 aa, Entamoeba dispar
HLLLFALPLREEYAKSM

SEQ ID NO: 2484793 - protein, 17 aa, Entamoeba dispar
HLLPKHVLENVLMVSTQ

SEQ ID NO: 2484794 - protein, 19 aa, Entamoeba dispar
HLLSVLCILLASLNYKVLI

SEQ ID NO: 2484795 - protein, 25 aa, Entamoeba dispar
HLNKEFCCYCGIGIDAYQLRTKENK

SEQ ID NO: 2484796 - protein, 18 aa, Entamoeba dispar
HLNVWRYGEIEDEEEKDK

SEQ ID NO: 2484797 - protein, 21 aa, Entamoeba dispar
HLPESIILPRGLTFSDTLSIQ

SEQ ID NO: 2484798 - protein, 26 aa, Entamoeba dispar
HLPLLKRMRFEVLKYINSVTSLKEEE

SEQ ID NO: 2484799 - protein, 18 aa, Entamoeba dispar
HLRIHLCDYISFEETNDA

SEQ ID NO: 2484800 - protein, 19 aa, Entamoeba dispar
HLSKGYGFIYFYTSIIANN

SEQ ID NO: 2484801 - protein, 19 aa, Entamoeba dispar
HLSKTFKYFVPSTELFFEN

SEQ ID NO: 2484802 - protein, 23 aa, Entamoeba dispar
HLSLKIPVIEIWKHEMKIQSSIT

SEQ ID NO: 2484803 - protein, 18 aa, Entamoeba dispar
HLSRAFRNRFIELHFDEI

SEQ ID NO: 2484804 - protein, 21 aa, Entamoeba dispar
HLTNVCIFIKGKIENSTRTNV

SEQ ID NO: 2484805 - protein, 29 aa, Entamoeba dispar
HLTQSFYQYARWAWEKVKELSQNIITLFT

SEQ ID NO: 2484806 - protein, 19 aa, Entamoeba dispar
HLVEKMEYCVVKYAKSLLC

SEQ ID NO: 2484807 - protein, 17 aa, Entamoeba dispar
HLVIDFTQWCDFLEFSP

SEQ ID NO: 2484808 - protein, 18 aa, Entamoeba dispar
HLVNIFFKHIVHVQDYYQ

SEQ ID NO: 2484809 - protein, 18 aa, Entamoeba dispar
HLYLCPSNILISRDPASI

SEQ ID NO: 2484810 - protein, 18 aa, Entamoeba dispar
HLYPVGRKPELFGMKCYA

SEQ ID NO: 2484811 - protein, 19 aa, Entamoeba dispar
HMCKRLGVNLEEFTLNQLG

SEQ ID NO: 2484812 - protein, 23 aa, Entamoeba dispar
HMFPVHKYIRIRQWINLNNKDCL

SEQ ID NO: 2484813 - protein, 17 aa, Entamoeba dispar
HMKELSPLFSALINEQI

SEQ ID NO: 2484814 - protein, 22 aa, Entamoeba dispar
HMKQIKFKLVIGNTINTDVEKS

SEQ ID NO: 2484815 - protein, 25 aa, Entamoeba dispar
HMLTTGWTYWFDLGMNQVFSTSGVT

SEQ ID NO: 2484816 - protein, 23 aa, Entamoeba dispar
HMNPSPIPIAFFLDDMDDEDREV

SEQ ID NO: 2484817 - protein, 25 aa, Entamoeba dispar
HMNTELRKAIFIALMGAMDYVDGYQ

SEQ ID NO: 2484818 - protein, 25 aa, Entamoeba dispar
HMTCKCGYEFCWLCGVKYTPEHWSN

SEQ ID NO: 2484819 - protein, 27 aa, Entamoeba dispar
HMTCPKCHGEWCWMCRGDWKTHGEKTG

SEQ ID NO: 2484820 - protein, 26 aa, Entamoeba dispar
HMTRKCGYKFCWLCCVKYTPEQWMDN

SEQ ID NO: 2484821 - protein, 27 aa, Entamoeba dispar
HMYCWRCLLQYLVLCPAPHKCPVCNAL

SEQ ID NO: 2484822 - protein, 25 aa, Entamoeba dispar
HNELKRLVVGAVQYPSLYKKFGVDT

SEQ ID NO: 2484823 - protein, 24 aa, Entamoeba dispar
HNELWKVVMKFVITLDTPLLFEKL

SEQ ID NO: 2484824 - protein, 25 aa, Entamoeba dispar
HNFNRITYHLSPFGEFYTHEQQRNS

SEQ ID NO: 2484825 - protein, 18 aa, Entamoeba dispar
HNGIKMELLGIIENDSSK

SEQ ID NO: 2484826 - protein, 20 aa, Entamoeba dispar
HNIGLLAITCIKRYLIDWDK

SEQ ID NO: 2484827 - protein, 26 aa, Entamoeba dispar
HNIILKEYFIHYSFIINYYAPCELNK

SEQ ID NO: 2484828 - protein, 20 aa, Entamoeba dispar
HNIMGKWSIYEKMIELKIIT

SEQ ID NO: 2484829 - protein, 26 aa, Entamoeba dispar
HNIRIPIMPGLFAPYSCISSSCTSAA

SEQ ID NO: 2484830 - protein, 29 aa, Entamoeba dispar
HNIVPAVFGLRWIRMLYAREFHIDDVVIL

SEQ ID NO: 2484831 - protein, 17 aa, Entamoeba dispar
HNLKLSEFVGETLMVLP

SEQ ID NO: 2484832 - protein, 29 aa, Entamoeba dispar
HNLKYSKEVFDWLDFLLIDIESNLIDSTT

SEQ ID NO: 2484833 - protein, 18 aa, Entamoeba dispar
HNLLQWLSSISNEFVALY

SEQ ID NO: 2484834 - protein, 21 aa, Entamoeba dispar
HNLNKSVLLYSLYNSIHNSDI

SEQ ID NO: 2484835 - protein, 23 aa, Entamoeba dispar
HNLRPRIQSSKAVDFIDEIQINR

SEQ ID NO: 2484836 - protein, 20 aa, Entamoeba dispar
HNMMKRGCDDFDKIHAINPD

SEQ ID NO: 2484837 - protein, 24 aa, Entamoeba dispar
HNNFICVGYKCGTIKYIDTEDIHK

SEQ ID NO: 2484838 - protein, 18 aa, Entamoeba dispar
HNNGVSWERIVLMGHSLG

SEQ ID NO: 2484839 - protein, 26 aa, Entamoeba dispar
HNNLGLSYQGLNMWTEAVEHYCESLL

SEQ ID NO: 2484840 - protein, 19 aa, Entamoeba dispar
HNNVKWFPFPDHHNPSLIV

SEQ ID NO: 2484841 - protein, 21 aa, Entamoeba dispar
HNRGSARFMQLSSLQERNELN

SEQ ID NO: 2484842 - protein, 24 aa, Entamoeba dispar
HNRKKIGECLIHLSKEQKQDLYQL

SEQ ID NO: 2484843 - protein, 25 aa, Entamoeba dispar
HNSIKKILFKPLKVFGSAAKLTVEK

SEQ ID NO: 2484844 - protein, 20 aa, Entamoeba dispar
HNTIKLIAFKSIKDTDKKTN

SEQ ID NO: 2484845 - protein, 17 aa, Entamoeba dispar
HNTIQLFHHFFPCANIF

SEQ ID NO: 2484846 - protein, 17 aa, Entamoeba dispar
HNTVECFIFHSLRQNRL

SEQ ID NO: 2484847 - protein, 31 aa, Entamoeba dispar
HNVFKEHFMYPILIIRISRIIDNCLWPKLFS

SEQ ID NO: 2484848 - protein, 32 aa, Entamoeba dispar
HNYHPNCFVCTRCGKPFNGSYMLINGQPVCKK

SEQ ID NO: 2484849 - protein, 19 aa, Entamoeba dispar
HNYIKRRSINDYLAIQVRM

SEQ ID NO: 2484850 - protein, 23 aa, Entamoeba dispar
HNYRVIPSLHFPLLSSDWGADEE

SEQ ID NO: 2484851 - protein, 19 aa, Entamoeba dispar
HNYYPSWKMDRIGISIDEY

SEQ ID NO: 2484852 - protein, 24 aa, Entamoeba dispar
HPAPEFLEALQFSIGSFGTIYPFN

SEQ ID NO: 2484853 - protein, 17 aa, Entamoeba dispar
HPDIIAVHLHPGLVYSN

SEQ ID NO: 2484854 - protein, 34 aa, Entamoeba dispar
HPDQCKTIQAAKYWRQMIIKEILQKVSEIQNGTL

SEQ ID NO: 2484855 - protein, 29 aa, Entamoeba dispar
HPDSLYILGVMYYKGKYVFEDKTLAMEYI

SEQ ID NO: 2484856 - protein, 21 aa, Entamoeba dispar
HPEDVMELALLCPPEEIEGKT

SEQ ID NO: 2484857 - protein, 17 aa, Entamoeba dispar
HPEFFTSESLSMNCPRV

SEQ ID NO: 2484858 - protein, 18 aa, Entamoeba dispar
HPEFPSTYLKKGELYHHV

SEQ ID NO: 2484859 - protein, 17 aa, Entamoeba dispar
HPENWDFIFPITVLIKS

SEQ ID NO: 2484860 - protein, 23 aa, Entamoeba dispar
HPEVHKKAVVMMYQSLIRDLNIT

SEQ ID NO: 2484861 - protein, 17 aa, Entamoeba dispar
HPEVIIVEKKCRISKYG

SEQ ID NO: 2484862 - protein, 24 aa, Entamoeba dispar
HPEYCKPFTFPIEDILHKFHLQKK

SEQ ID NO: 2484863 - protein, 25 aa, Entamoeba dispar
HPFFDSLRVQPKFTKSMSVYSYKFE

SEQ ID NO: 2484864 - protein, 18 aa, Entamoeba dispar
HPGASIKGHFFIDHGVGV

SEQ ID NO: 2484865 - protein, 24 aa, Entamoeba dispar
HPHLKVHFIVSLGIESNFFRSIDY

SEQ ID NO: 2484866 - protein, 19 aa, Entamoeba dispar
HPHSALGYRSPREYLRQRA

SEQ ID NO: 2484867 - protein, 17 aa, Entamoeba dispar
HPIESLEVFCANNNSLS

SEQ ID NO: 2484868 - protein, 25 aa, Entamoeba dispar
HPINRKVKSISCIPLQPNRNQRRSE

SEQ ID NO: 2484869 - protein, 19 aa, Entamoeba dispar
HPIQRFISKLITFHPDITL

SEQ ID NO: 2484870 - protein, 17 aa, Entamoeba dispar
HPKGIELDKGIQSMHIV

SEQ ID NO: 2484871 - protein, 21 aa, Entamoeba dispar
HPKIRVSHQVFKELRAIQEEK

SEQ ID NO: 2484872 - protein, 18 aa, Entamoeba dispar
HPKTRRNALHYLSISDIS

SEQ ID NO: 2484873 - protein, 20 aa, Entamoeba dispar
HPLEEFQIYLQATKMDLNFI

SEQ ID NO: 2484874 - protein, 21 aa, Entamoeba dispar
HPLPPLPKQRILFGQPVQQKP

SEQ ID NO: 2484875 - protein, 27 aa, Entamoeba dispar
HPLQLPRTCRVLHIKSLIKTESLDFSL

SEQ ID NO: 2484876 - protein, 21 aa, Entamoeba dispar
HPNGSRYQYSYVNFKDNQIIT

SEQ ID NO: 2484877 - protein, 22 aa, Entamoeba dispar
HPNICAFFDYYVDVQCYLVMEY

SEQ ID NO: 2484878 - protein, 19 aa, Entamoeba dispar
HPNLNVTIVEWLRVQDYRH

SEQ ID NO: 2484879 - protein, 18 aa, Entamoeba dispar
HPQFFVINKDFVKPRTSS

SEQ ID NO: 2484880 - protein, 17 aa, Entamoeba dispar
HPQVIIEGWRIALKAAQ

SEQ ID NO: 2484881 - protein, 17 aa, Entamoeba dispar
HPSEAWIISSSDDRTIR

SEQ ID NO: 2484882 - protein, 17 aa, Entamoeba dispar
HPSFIDWALDEKRASQI

SEQ ID NO: 2484883 - protein, 18 aa, Entamoeba dispar
HPSISLLFDCVDLIHQDL

SEQ ID NO: 2484884 - protein, 25 aa, Entamoeba dispar
HPSPKIPITALWMGEIIRYSQLPSF

SEQ ID NO: 2484885 - protein, 18 aa, Entamoeba dispar
HPTDWKPKMIKELEHVEY

SEQ ID NO: 2484886 - protein, 19 aa, Entamoeba dispar
HPTLLPIGIGHDFFIDSHQ

SEQ ID NO: 2484887 - protein, 19 aa, Entamoeba dispar
HPVGHLLASCAHDQTTKFW

SEQ ID NO: 2484888 - protein, 20 aa, Entamoeba dispar
HPVQTFYLDDVISFTNYSID

SEQ ID NO: 2484889 - protein, 17 aa, Entamoeba dispar
HPYGCRVIQRLIEKNSQ

SEQ ID NO: 2484890 - protein, 17 aa, Entamoeba dispar
HQCCVRKAPRQCSYGVL

SEQ ID NO: 2484891 - protein, 18 aa, Entamoeba dispar
HQCYGRIAPRSSLALKYG

SEQ ID NO: 2484892 - protein, 25 aa, Entamoeba dispar
HQDYQARITFCYAATVALNTSLLCG

SEQ ID NO: 2484893 - protein, 24 aa, Entamoeba dispar
HQDYQARITFCYAATVALNTTLLC

SEQ ID NO: 2484894 - protein, 25 aa, Entamoeba dispar
HQDYQARITFCYAATVALNTTLLCG

SEQ ID NO: 2484895 - protein, 23 aa, Entamoeba dispar
HQEVKEKIGQEVIEQIETTIQNI

SEQ ID NO: 2484896 - protein, 20 aa, Entamoeba dispar
HQFVGTILFTLSANKQAFIT

SEQ ID NO: 2484897 - protein, 23 aa, Entamoeba dispar
HQHITPKLLRFFPHIQTLSCSFE

SEQ ID NO: 2484898 - protein, 27 aa, Entamoeba dispar
HQIETRLGQIFKLFTPFFKVYFLYISH

SEQ ID NO: 2484899 - protein, 24 aa, Entamoeba dispar
HQIKDCGDVNCIGRIHTFLEQMQW

SEQ ID NO: 2484900 - protein, 18 aa, Entamoeba dispar
HQIKKPVPAISINLFNSS

SEQ ID NO: 2484901 - protein, 17 aa, Entamoeba dispar
HQIKLPVFTNFNATPIN

SEQ ID NO: 2484902 - protein, 18 aa, Entamoeba dispar
HQIRHILLTLVQAYQVQT

SEQ ID NO: 2484903 - protein, 24 aa, Entamoeba dispar
HQIYYPEYLGIFTFVNNGLRVANK

SEQ ID NO: 2484904 - protein, 23 aa, Entamoeba dispar
HQKCVMKLKILLKETQKINSKID

SEQ ID NO: 2484905 - protein, 25 aa, Entamoeba dispar
HQKRVYEIFNRFFGDNVNFTQCDLP

SEQ ID NO: 2484906 - protein, 19 aa, Entamoeba dispar
HQLNPAKLISIFDFSTTIR

SEQ ID NO: 2484907 - protein, 27 aa, Entamoeba dispar
HQNCVALNPKWCRCLLSTKDSGGRIGS

SEQ ID NO: 2484908 - protein, 23 aa, Entamoeba dispar
HQNKEGWLKWNINESNHCLFNQL

SEQ ID NO: 2484909 - protein, 26 aa, Entamoeba dispar
HQPIVFKFFFKDDVKLGNVIIVCRPT

SEQ ID NO: 2484910 - protein, 24 aa, Entamoeba dispar
HQPLEILCFDWDRIGDDDFLGKFS

SEQ ID NO: 2484911 - protein, 21 aa, Entamoeba dispar
HQQMAEFFLGYANGSSIDYKF

SEQ ID NO: 2484912 - protein, 23 aa, Entamoeba dispar
HQSLIICGVEFFMVDKNKIINSK

SEQ ID NO: 2484913 - protein, 24 aa, Entamoeba dispar
HQSLRCAQISSFMYAIPESNSLIF

SEQ ID NO: 2484914 - protein, 23 aa, Entamoeba dispar
HQSQPCYKKGLKYTEIEELVPAI

SEQ ID NO: 2484915 - protein, 32 aa, Entamoeba dispar
HQSYYLERIFSLYLPMLFGYQIYISSKSVYQQ

SEQ ID NO: 2484916 - protein, 21 aa, Entamoeba dispar
HQWKMKKERLGKLVLGDNDML

SEQ ID NO: 2484917 - protein, 22 aa, Entamoeba dispar
HRDIKPDNFLVVTIDDNIGINC

SEQ ID NO: 2484918 - protein, 19 aa, Entamoeba dispar
HRECLLKWIQMIDRLEEGE

SEQ ID NO: 2484919 - protein, 23 aa, Entamoeba dispar
HREHCPYHFPPGLLIYKDDKKHL

SEQ ID NO: 2484920 - protein, 18 aa, Entamoeba dispar
HREIKFGEGKNVYITGFD

SEQ ID NO: 2484921 - protein, 25 aa, Entamoeba dispar
HRHLQLDLCSQVNFIVGENGSGKSA

SEQ ID NO: 2484922 - protein, 19 aa, Entamoeba dispar
HRIHIKLQPWKEENSLVKN

SEQ ID NO: 2484923 - protein, 22 aa, Entamoeba dispar
HRIPSLVYLCVMYICEPEHITQ

SEQ ID NO: 2484924 - protein, 20 aa, Entamoeba dispar
HRITHFLGWVQSDEENNDVD

SEQ ID NO: 2484925 - protein, 20 aa, Entamoeba dispar
HRLNVMITLVHQWFKNYEFG

SEQ ID NO: 2484926 - protein, 24 aa, Entamoeba dispar
HRLRKWYYRNGFSIIDKNYKQPSY

SEQ ID NO: 2484927 - protein, 24 aa, Entamoeba dispar
HRMEARAMKAFKEIEKKPRQPKEE

SEQ ID NO: 2484928 - protein, 24 aa, Entamoeba dispar
HRMFCPNCDTPLVLVEDDHNHDGN

SEQ ID NO: 2484929 - protein, 23 aa, Entamoeba dispar
HRMFCPNCDTPLVLVEDDHSHDR

SEQ ID NO: 2484930 - protein, 25 aa, Entamoeba dispar
HRMKAWNTLCDFLKSRYIEAERNCE

SEQ ID NO: 2484931 - protein, 19 aa, Entamoeba dispar
HRMKRVKCEGSQMFVVTNQ

SEQ ID NO: 2484932 - protein, 20 aa, Entamoeba dispar
HRMKRVKCEGSQMFVVTNQM

SEQ ID NO: 2484933 - protein, 33 aa, Entamoeba dispar
HRNANKMSISFNWILDRCLSFGYEFKKRSTKPT

SEQ ID NO: 2484934 - protein, 18 aa, Entamoeba dispar
HRPEFKLIITSATLDANK

SEQ ID NO: 2484935 - protein, 20 aa, Entamoeba dispar
HRQCARCIICNKFSDRKKCL

SEQ ID NO: 2484936 - protein, 17 aa, Entamoeba dispar
HRQLPIQKFQKLRVPIN

SEQ ID NO: 2484937 - protein, 25 aa, Entamoeba dispar
HRREVLKKRMELFAPKTRAKPKRAD

SEQ ID NO: 2484938 - protein, 26 aa, Entamoeba dispar
HRRKVIIEFISWIFGEVKSMDEGLSI

SEQ ID NO: 2484939 - protein, 27 aa, Entamoeba dispar
HRSFDCATPLLIQWTYQAMIHEFLGIN

SEQ ID NO: 2484940 - protein, 18 aa, Entamoeba dispar
HRTRCRVHCNCTFEQMLK

SEQ ID NO: 2484941 - protein, 27 aa, Entamoeba dispar
HRVFYLFHCPFCLKFTVLRNQLPEGTL

SEQ ID NO: 2484942 - protein, 19 aa, Entamoeba dispar
HRVILPFELHFKLLSIKSI

SEQ ID NO: 2484943 - protein, 17 aa, Entamoeba dispar
HRVLVQLSYAIGVSHPL

SEQ ID NO: 2484944 - protein, 27 aa, Entamoeba dispar
HRVTEGINNYWSFHFQEDHSSLKDLND

SEQ ID NO: 2484945 - protein, 26 aa, Entamoeba dispar
HRVWITCFRYLMNIIKHLYIDNKPLF

SEQ ID NO: 2484946 - protein, 22 aa, Entamoeba dispar
HRYQFNCLRKDEPHKTLFQSVS

SEQ ID NO: 2484947 - protein, 24 aa, Entamoeba dispar
HSALCGRDSFGITLIEYSCLSYLA

SEQ ID NO: 2484948 - protein, 23 aa, Entamoeba dispar
HSCAGYCVATYLLGIGDRHSDNV

SEQ ID NO: 2484949 - protein, 21 aa, Entamoeba dispar
HSCQLDHAFSMEMWGGATFDV

SEQ ID NO: 2484950 - protein, 19 aa, Entamoeba dispar
HSECIIPLPSKSTEIPDLK

SEQ ID NO: 2484951 - protein, 25 aa, Entamoeba dispar
HSEGVFRLAGQAGLMKTMKSYMNTH

SEQ ID NO: 2484952 - protein, 23 aa, Entamoeba dispar
HSEPKLGMIKTVWDTHRIRELWL

SEQ ID NO: 2484953 - protein, 21 aa, Entamoeba dispar
HSEQFKRCAYTLGVMNKIIEF

SEQ ID NO: 2484954 - protein, 34 aa, Entamoeba dispar
HSFFYCFAEDQFFWVYKFLKGVQERDVFRISYDN

SEQ ID NO: 2484955 - protein, 18 aa, Entamoeba dispar
HSFIKSDIFNDYINYISK

SEQ ID NO: 2484956 - protein, 21 aa, Entamoeba dispar
HSFKDPNNCEIMFPTIEYIEK

SEQ ID NO: 2484957 - protein, 19 aa, Entamoeba dispar
HSFNDGKVYLALAHVISNK

SEQ ID NO: 2484958 - protein, 20 aa, Entamoeba dispar
HSFQVGDFVLGRDLSQNCFK

SEQ ID NO: 2484959 - protein, 25 aa, Entamoeba dispar
HSFYSCKLLESLFIPSSVQNYGSYV

SEQ ID NO: 2484960 - protein, 24 aa, Entamoeba dispar
HSGKTKETYYFFVVSKTCPLLKFE

SEQ ID NO: 2484961 - protein, 32 aa, Entamoeba dispar
HSGKYVSYMFSIRFPEIFYEMLSRDSGTLSII

SEQ ID NO: 2484962 - protein, 17 aa, Entamoeba dispar
HSHTIPPLLSIKEKQNG

SEQ ID NO: 2484963 - protein, 18 aa, Entamoeba dispar
HSIEIYRNVFKDIDKEIN

SEQ ID NO: 2484964 - protein, 23 aa, Entamoeba dispar
HSIGCGPSLWLANQIQLNKLKKY

SEQ ID NO: 2484965 - protein, 22 aa, Entamoeba dispar
HSIHSPMCRFAHSQLSDHKRVF

SEQ ID NO: 2484966 - protein, 26 aa, Entamoeba dispar
HSIIPKPEDFWRILIDNRDNIAEHEL

SEQ ID NO: 2484967 - protein, 29 aa, Entamoeba dispar
HSIKLWSLKNWNWKLIWKYEEHSKPVVDV

SEQ ID NO: 2484968 - protein, 20 aa, Entamoeba dispar
HSILIFSHRVWITCFRYLMN

SEQ ID NO: 2484969 - protein, 24 aa, Entamoeba dispar
HSILLKVIQKLPICYQDELYYKKI

SEQ ID NO: 2484970 - protein, 21 aa, Entamoeba dispar
HSITPLSLFYAHYMKDPTLPE

SEQ ID NO: 2484971 - protein, 23 aa, Entamoeba dispar
HSIYHLRAGVRILQRASKLNLPM

SEQ ID NO: 2484972 - protein, 22 aa, Entamoeba dispar
HSKCNYPYPKVIKIPFQSMEAA

SEQ ID NO: 2484973 - protein, 23 aa, Entamoeba dispar
HSLDGYDEFEWVQFHPMGHVVIA

SEQ ID NO: 2484974 - protein, 18 aa, Entamoeba dispar
HSLDLLIQIIDLLNRNIL

SEQ ID NO: 2484975 - protein, 23 aa, Entamoeba dispar
HSLFKMICIFNIDSISSPTDSFP

SEQ ID NO: 2484976 - protein, 22 aa, Entamoeba dispar
HSLLCNKLKGLINYCKINHISH

SEQ ID NO: 2484977 - protein, 20 aa, Entamoeba dispar
HSLLCNKLKGLINYCNINHI

SEQ ID NO: 2484978 - protein, 18 aa, Entamoeba dispar
HSLMGLEGLELLKCFFSM

SEQ ID NO: 2484979 - protein, 25 aa, Entamoeba dispar
HSLNVARVLLINGIRTTQRNSFGHI

SEQ ID NO: 2484980 - protein, 23 aa, Entamoeba dispar
HSLPISCCYLCNFLTSIQLSTTL

SEQ ID NO: 2484981 - protein, 26 aa, Entamoeba dispar
HSNELFKNTYHMIPSTALQNGVHQIP

SEQ ID NO: 2484982 - protein, 23 aa, Entamoeba dispar
HSNEPCGFCFVEFNKRNDAALAM

SEQ ID NO: 2484983 - protein, 28 aa, Entamoeba dispar
HSNIKVEGFWPIIMAKALANANIEDLIM

SEQ ID NO: 2484984 - protein, 18 aa, Entamoeba dispar
HSNKLLANYCISKIIEVF

SEQ ID NO: 2484985 - protein, 19 aa, Entamoeba dispar
HSPIPLMIGFEGIITNIQI

SEQ ID NO: 2484986 - protein, 18 aa, Entamoeba dispar
HSQLKAMIYELNKENNCL

SEQ ID NO: 2484987 - protein, 18 aa, Entamoeba dispar
HSQLRTSKRLEMLASKRT

SEQ ID NO: 2484988 - protein, 26 aa, Entamoeba dispar
HSQVCGKLTDFGTCRNISERAIQLQP

SEQ ID NO: 2484989 - protein, 20 aa, Entamoeba dispar
HSRKFFPNIETFYIYIISDE

SEQ ID NO: 2484990 - protein, 25 aa, Entamoeba dispar
HSRNSLEFLSHFPGVEDKVSPINCI

SEQ ID NO: 2484991 - protein, 27 aa, Entamoeba dispar
HSSELFPERWFDLIVVLRTDNTVLYDR

SEQ ID NO: 2484992 - protein, 20 aa, Entamoeba dispar
HSSFKTQLFGIIQQNSYLKL

SEQ ID NO: 2484993 - protein, 17 aa, Entamoeba dispar
HSSHCSSPLMYVENLIK

SEQ ID NO: 2484994 - protein, 21 aa, Entamoeba dispar
HSSICKICQRVFGVIRDSFWR

SEQ ID NO: 2484995 - protein, 21 aa, Entamoeba dispar
HSSIKPFAIFILSNKITLQAL

SEQ ID NO: 2484996 - protein, 18 aa, Entamoeba dispar
HSTAECYFIPPTGLLSLK

SEQ ID NO: 2484997 - protein, 18 aa, Entamoeba dispar
HSTIPIPFDDRSQISVQI

SEQ ID NO: 2484998 - protein, 17 aa, Entamoeba dispar
HSTSSQELLSFQSNEEL

SEQ ID NO: 2484999 - protein, 28 aa, Entamoeba dispar
HSTYEGFIVCIFRPYRVDVIGYNSTFRP

SEQ ID NO: 2485000 - protein, 25 aa, Entamoeba dispar
HSVKTLQLYSCDELLSIKKIEKLIL

SEQ ID NO: 2485001 - protein, 19 aa, Entamoeba dispar
HSYHILLIICDGQVDNEKD

SEQ ID NO: 2485002 - protein, 23 aa, Entamoeba dispar
HSYKNRVSMGLNILLKEIRKHGY

SEQ ID NO: 2485003 - protein, 17 aa, Entamoeba dispar
HSYWKNGAIVIVQKGGN

SEQ ID NO: 2485004 - protein, 20 aa, Entamoeba dispar
HTAFSVTWPVTARQFVSLHD

SEQ ID NO: 2485005 - protein, 23 aa, Entamoeba dispar
HTALNARCSILAAANPSNGNYNV

SEQ ID NO: 2485006 - protein, 19 aa, Entamoeba dispar
HTDCFTCSVCGEKFGGNRK

SEQ ID NO: 2485007 - protein, 18 aa, Entamoeba dispar
HTFLQIFPFELNKSDDLI

SEQ ID NO: 2485008 - protein, 26 aa, Entamoeba dispar
HTIASLFKLYFRELPDSLVTEENTDL

SEQ ID NO: 2485009 - protein, 19 aa, Entamoeba dispar
HTIHLWKGKVIEEKEITYY

SEQ ID NO: 2485010 - protein, 19 aa, Entamoeba dispar
HTIIPPKPSQWVIRDKNHF

SEQ ID NO: 2485011 - protein, 22 aa, Entamoeba dispar
HTKCKYKGLLEYFKQMENQYSP

SEQ ID NO: 2485012 - protein, 17 aa, Entamoeba dispar
HTKGVRCVEVWDKENMV

SEQ ID NO: 2485013 - protein, 22 aa, Entamoeba dispar
HTKKVVITPTFQGRVSNNSFEM

SEQ ID NO: 2485014 - protein, 21 aa, Entamoeba dispar
HTKNAISAFEFVLNNYEPIFF

SEQ ID NO: 2485015 - protein, 24 aa, Entamoeba dispar
HTLFRATFFPTWEGLFWEKSSGFE

SEQ ID NO: 2485016 - protein, 24 aa, Entamoeba dispar
HTLFRKEYKGVFATSLEEEGEYDI

SEQ ID NO: 2485017 - protein, 28 aa, Entamoeba dispar
HTPRMKKERSWRTAQIFQKEKVLKVVDS

SEQ ID NO: 2485018 - protein, 28 aa, Entamoeba dispar
HTTAYIVPRSRFLPVKACNDLFIIQSTL

SEQ ID NO: 2485019 - protein, 19 aa, Entamoeba dispar
HTTFRIRSVPDMGYLTSND

SEQ ID NO: 2485020 - protein, 26 aa, Entamoeba dispar
HTTGDFGSIGWRSDWKVEEAQKTILR

SEQ ID NO: 2485021 - protein, 27 aa, Entamoeba dispar
HTTSGRRPRYIDPFTQEVHQSAPPVVE

SEQ ID NO: 2485022 - protein, 28 aa, Entamoeba dispar
HTYEGSEHWLLMKSAIYIVQFLSTMCSF

SEQ ID NO: 2485023 - protein, 20 aa, Entamoeba dispar
HVALPVPLPRTFDYLLPEGM

SEQ ID NO: 2485024 - protein, 21 aa, Entamoeba dispar
HVCCSYHSLNVARVLLINGIR

SEQ ID NO: 2485025 - protein, 17 aa, Entamoeba dispar
HVDHCASLPYLILERQF

SEQ ID NO: 2485026 - protein, 22 aa, Entamoeba dispar
HVDYVHRFGRDMGDQPPYNTEF

SEQ ID NO: 2485027 - protein, 22 aa, Entamoeba dispar
HVFDIVCPCFEYQNCQTTVNIS

SEQ ID NO: 2485028 - protein, 27 aa, Entamoeba dispar
HVFPHSKLFFCRIHIERSLIKYFKSDH

SEQ ID NO: 2485029 - protein, 26 aa, Entamoeba dispar
HVFPHSKLFFCRIHIERSLTKYFKND

SEQ ID NO: 2485030 - protein, 27 aa, Entamoeba dispar
HVFPHSKLFFCRIHIERSLTKYFKNDH

SEQ ID NO: 2485031 - protein, 25 aa, Entamoeba dispar
HVGTIGGVFKTEFPPSPKSKFTMIK

SEQ ID NO: 2485032 - protein, 27 aa, Entamoeba dispar
HVIEIYKRATHIVCHNFGRTIKMLKGI

SEQ ID NO: 2485033 - protein, 19 aa, Entamoeba dispar
HVIGETILLTGISDGFNLI

SEQ ID NO: 2485034 - protein, 18 aa, Entamoeba dispar
HVIIPFNYTQWFDYSQMT

SEQ ID NO: 2485035 - protein, 17 aa, Entamoeba dispar
HVIWYPVSYSTYLKEKE

SEQ ID NO: 2485036 - protein, 19 aa, Entamoeba dispar
HVNKHFCTEEEPTFACPFC

SEQ ID NO: 2485037 - protein, 20 aa, Entamoeba dispar
HVNKKAKDQYKGFIEQQEGL

SEQ ID NO: 2485038 - protein, 22 aa, Entamoeba dispar
HVPFFFECCHSGGLFQPDESCI

SEQ ID NO: 2485039 - protein, 26 aa, Entamoeba dispar
HVRGLKCLGITNSVEFFDICRIKDAL

SEQ ID NO: 2485040 - protein, 17 aa, Entamoeba dispar
HVRKLICSCSTEQYCVM

SEQ ID NO: 2485041 - protein, 26 aa, Entamoeba dispar
HVRLIPRIIPIITKFQSLQSLTINFG

SEQ ID NO: 2485042 - protein, 26 aa, Entamoeba dispar
HVSAPHCWSFMLGSLTWLKDAGDVVC

SEQ ID NO: 2485043 - protein, 23 aa, Entamoeba dispar
HVSELKSYINRCLSIDNIQLRLK

SEQ ID NO: 2485044 - protein, 24 aa, Entamoeba dispar
HVSGKRYLVPEEVKTGKCKEYEIE

SEQ ID NO: 2485045 - protein, 25 aa, Entamoeba dispar
HVTEKTTRCLLFYLMYSLGNSQIFE

SEQ ID NO: 2485046 - protein, 21 aa, Entamoeba dispar
HVTVFFECCHSGGLFQPDESC

SEQ ID NO: 2485047 - protein, 19 aa, Entamoeba dispar
HVVCSLLKHYLRSLPTPLL

SEQ ID NO: 2485048 - protein, 17 aa, Entamoeba dispar
HVVLPLLIKVIPDNCFK

SEQ ID NO: 2485049 - protein, 27 aa, Entamoeba dispar
HVVREGWQKLCWYCMQLPEHYKTSQII

SEQ ID NO: 2485050 - protein, 18 aa, Entamoeba dispar
HVYDYVVIRKIMIPFPIC

SEQ ID NO: 2485051 - protein, 18 aa, Entamoeba dispar
HVYLNCHYHFVFNLLNSY

SEQ ID NO: 2485052 - protein, 19 aa, Entamoeba dispar
HVYNLKFVLQVIESKANSS

SEQ ID NO: 2485053 - protein, 17 aa, Entamoeba dispar
HWGDGKYTYFECSAKTG

SEQ ID NO: 2485054 - protein, 21 aa, Entamoeba dispar
HWKQTCFYFDLPFDNAGSGDI

SEQ ID NO: 2485055 - protein, 19 aa, Entamoeba dispar
HWKRKCPLTTAALQAVYLG

SEQ ID NO: 2485056 - protein, 17 aa, Entamoeba dispar
HWLCYNGEKEKVCKAIS

SEQ ID NO: 2485057 - protein, 27 aa, Entamoeba dispar
HWLTFHSGYDFGYLLRLLTCEKLPSSV

SEQ ID NO: 2485058 - protein, 29 aa, Entamoeba dispar
HWLTFHSGYDFGYMLKLLTCEKLPSNVDG

SEQ ID NO: 2485059 - protein, 30 aa, Entamoeba dispar
HWLTFHSGYDFGYMLKLLTCEKLPSNVDGF

SEQ ID NO: 2485060 - protein, 18 aa, Entamoeba dispar
HWMLSKLGGTFAPKPSHG

SEQ ID NO: 2485061 - protein, 20 aa, Entamoeba dispar
HWNKEIKAVQSWNNSTLWGE

SEQ ID NO: 2485062 - protein, 19 aa, Entamoeba dispar
HWTKEDFIKACFGNVEQKN

SEQ ID NO: 2485063 - protein, 18 aa, Entamoeba dispar
HWVLKPQNGMLWQRTFFR

SEQ ID NO: 2485064 - protein, 18 aa, Entamoeba dispar
HWYFFSKLEQFRVSQEQW

SEQ ID NO: 2485065 - protein, 27 aa, Entamoeba dispar
HWYLSKDYDFCFSLRSLFSKEPLMLLR

SEQ ID NO: 2485066 - protein, 23 aa, Entamoeba dispar
HYDGCIRPSSIIEIAKEQNIELP

SEQ ID NO: 2485067 - protein, 30 aa, Entamoeba dispar
HYDPCGRLVMWDCQLYLPFSIEDKLKPIDY

SEQ ID NO: 2485068 - protein, 21 aa, Entamoeba dispar
HYEKTKRPLVVKIGTISSDGT

SEQ ID NO: 2485069 - protein, 24 aa, Entamoeba dispar
HYELRIVDHITRKITPVGVPGEIE

SEQ ID NO: 2485070 - protein, 19 aa, Entamoeba dispar
HYETFKAVLDQFVVTQIEL

SEQ ID NO: 2485071 - protein, 25 aa, Entamoeba dispar
HYFILYRSTLCWIKDIYNNKLTKQE

SEQ ID NO: 2485072 - protein, 23 aa, Entamoeba dispar
HYFNCIYSNYFAFANRFSCDLTL

SEQ ID NO: 2485073 - protein, 22 aa, Entamoeba dispar
HYFNRLVPVLILEIAEKYPRNL

SEQ ID NO: 2485074 - protein, 24 aa, Entamoeba dispar
HYFTSWQALCPGFSTITEKAQRQF

SEQ ID NO: 2485075 - protein, 20 aa, Entamoeba dispar
HYHQLCEEFEERGDVKLSHM

SEQ ID NO: 2485076 - protein, 19 aa, Entamoeba dispar
HYHSVHIVSFITSEEALSD

SEQ ID NO: 2485077 - protein, 26 aa, Entamoeba dispar
HYIFCGELLNLYSAWCLNTCNRYFDL

SEQ ID NO: 2485078 - protein, 26 aa, Entamoeba dispar
HYIIPNRISDEWITLGIRDYLAEQFI

SEQ ID NO: 2485079 - protein, 18 aa, Entamoeba dispar
HYIISSIFIQFFRDSLEQ

SEQ ID NO: 2485080 - protein, 23 aa, Entamoeba dispar
HYINCFKPILFDEIRATIQKSLI

SEQ ID NO: 2485081 - protein, 20 aa, Entamoeba dispar
HYIQGLPFVAQTAFSNLINT

SEQ ID NO: 2485082 - protein, 20 aa, Entamoeba dispar
HYKFGVLYCKAHQTDEDEMF

SEQ ID NO: 2485083 - protein, 33 aa, Entamoeba dispar
HYKGWNILLAVCYDLRFPVWLRNTLENHYDILI

SEQ ID NO: 2485084 - protein, 17 aa, Entamoeba dispar
HYKTNFGEELFLNLDDS

SEQ ID NO: 2485085 - protein, 23 aa, Entamoeba dispar
HYLELIWKIPDAHIIINSLKNGI

SEQ ID NO: 2485086 - protein, 20 aa, Entamoeba dispar
HYLLPLPYFFHFVSQFNNGM

SEQ ID NO: 2485087 - protein, 18 aa, Entamoeba dispar
HYLMDLLRLHGYFYNSYY

SEQ ID NO: 2485088 - protein, 18 aa, Entamoeba dispar
HYLPHVGDQFISYMKSSS

SEQ ID NO: 2485089 - protein, 22 aa, Entamoeba dispar
HYLWVVWDRALELCLLQINNHC

SEQ ID NO: 2485090 - protein, 18 aa, Entamoeba dispar
HYPGAWSCRPSFSPDGQY

SEQ ID NO: 2485091 - protein, 18 aa, Entamoeba dispar
HYPSFKQTITFFKSSILE

SEQ ID NO: 2485092 - protein, 19 aa, Entamoeba dispar
HYRAIEIILGLPYSCAIDM

SEQ ID NO: 2485093 - protein, 19 aa, Entamoeba dispar
HYRAPEIILGLPYSCSIDM

SEQ ID NO: 2485094 - protein, 23 aa, Entamoeba dispar
HYRSFSFNNFDVLFDIVVDLSKT

SEQ ID NO: 2485095 - protein, 19 aa, Entamoeba dispar
HYRSPEIIIGLPYSPAIDM

SEQ ID NO: 2485096 - protein, 19 aa, Entamoeba dispar
HYRSPEVILGLPYSSAIDM

SEQ ID NO: 2485097 - protein, 18 aa, Entamoeba dispar
HYSFKNKAAVMLITDTNI

SEQ ID NO: 2485098 - protein, 28 aa, Entamoeba dispar
HYTYPWKNLFRHALFFWLGKNASILHRG

SEQ ID NO: 2485099 - protein, 27 aa, Entamoeba dispar
HYVIKMKRIKSISGFGVDYQTWKDISL

SEQ ID NO: 2485100 - protein, 18 aa, Entamoeba dispar
HYVMKGVSHFVSFAPMLD

SEQ ID NO: 2485101 - protein, 23 aa, Entamoeba dispar
IAAELVLGIPLFPGNSEFNQLFK

SEQ ID NO: 2485102 - protein, 20 aa, Entamoeba dispar
IAAINLCKDFHSVNMMTYKE

SEQ ID NO: 2485103 - protein, 22 aa, Entamoeba dispar
IACCKHMKNMVISLINNNDIVP

SEQ ID NO: 2485104 - protein, 18 aa, Entamoeba dispar
IACFKKNNFLGSIEMTTL

SEQ ID NO: 2485105 - protein, 18 aa, Entamoeba dispar
IACIARLREEEMICLEEI

SEQ ID NO: 2485106 - protein, 27 aa, Entamoeba dispar
IADDAVLVFDCGSSFIKVGVAGEEQPR

SEQ ID NO: 2485107 - protein, 17 aa, Entamoeba dispar
IADFLTSLCIGGVSCAH

SEQ ID NO: 2485108 - protein, 18 aa, Entamoeba dispar
IADGCGMGSRPAKSARVA

SEQ ID NO: 2485109 - protein, 17 aa, Entamoeba dispar
IADGCGWGIQPHQASLI

SEQ ID NO: 2485110 - protein, 24 aa, Entamoeba dispar
IADHVCDYCPYEGMTYRVFNALHE

SEQ ID NO: 2485111 - protein, 25 aa, Entamoeba dispar
IADKAETFFSLRLRGEDGVFGVDPT

SEQ ID NO: 2485112 - protein, 21 aa, Entamoeba dispar
IADPFKVKGPGLIQMHCNNCQ

SEQ ID NO: 2485113 - protein, 26 aa, Entamoeba dispar
IADRFVSDDGFLRCIIGNKADMEKKV

SEQ ID NO: 2485114 - protein, 23 aa, Entamoeba dispar
IADTRGDPLLSLMKEHPEIIKPN

SEQ ID NO: 2485115 - protein, 19 aa, Entamoeba dispar
IADYVWVKFCRNLIRLEEV

SEQ ID NO: 2485116 - protein, 18 aa, Entamoeba dispar
IAEAIAYCHSINCIHRDL

SEQ ID NO: 2485117 - protein, 17 aa, Entamoeba dispar
IAEARIKLVESRKKQEE

SEQ ID NO: 2485118 - protein, 18 aa, Entamoeba dispar
IAEEFKLDITLRYYKGDK

SEQ ID NO: 2485119 - protein, 21 aa, Entamoeba dispar
IAELDRFIQYRKITISLVESW

SEQ ID NO: 2485120 - protein, 21 aa, Entamoeba dispar
IAEPDRLLTFDIVGGKIEGFL

SEQ ID NO: 2485121 - protein, 17 aa, Entamoeba dispar
IAETCIRELSPYSPRST

SEQ ID NO: 2485122 - protein, 19 aa, Entamoeba dispar
IAEYLTEIFESPSISRSAY

SEQ ID NO: 2485123 - protein, 17 aa, Entamoeba dispar
IAFEDNSMFLLPNSIIS

SEQ ID NO: 2485124 - protein, 21 aa, Entamoeba dispar
IAFGMKEWAEELGASCFAHWF

SEQ ID NO: 2485125 - protein, 19 aa, Entamoeba dispar
IAFSCISTGIFGFPQNIAS

SEQ ID NO: 2485126 - protein, 19 aa, Entamoeba dispar
IAGDYCSLSYDVKKGKTSS

SEQ ID NO: 2485127 - protein, 24 aa, Entamoeba dispar
IAGEDKLILVYGISLSAFLCIFET

SEQ ID NO: 2485128 - protein, 36 aa, Entamoeba dispar
IAGICKAHGLGVMFTCKFYDRFIKKPLEKFDVDKKG

SEQ ID NO: 2485129 - protein, 19 aa, Entamoeba dispar
IAHGIKDAFSKPSDNLLDP

SEQ ID NO: 2485130 - protein, 25 aa, Entamoeba dispar
IAHHCKKCGYPYIQLDGSVAATKRT

SEQ ID NO: 2485131 - protein, 22 aa, Entamoeba dispar
IAHLIPLKRLLIITNNKVTEEK

SEQ ID NO: 2485132 - protein, 19 aa, Entamoeba dispar
IAIEEARSSTGIANELSKE

SEQ ID NO: 2485133 - protein, 19 aa, Entamoeba dispar
IAIERIGEEMFKEIEKKFG

SEQ ID NO: 2485134 - protein, 25 aa, Entamoeba dispar
IAIISLFYNYGIKLVKNIGRRANKY

SEQ ID NO: 2485135 - protein, 28 aa, Entamoeba dispar
IAIKALWIAIGFFRLGKDYQNCISEDEK

SEQ ID NO: 2485136 - protein, 25 aa, Entamoeba dispar
IAIKEPLYRIATCAPHLDKRYPKGF

SEQ ID NO: 2485137 - protein, 18 aa, Entamoeba dispar
IAILEPWVDGLSSCTNTP

SEQ ID NO: 2485138 - protein, 18 aa, Entamoeba dispar
IAIVPKRRTHQLIPSIKT

SEQ ID NO: 2485139 - protein, 23 aa, Entamoeba dispar
IAKCISGGCQIIRQMISPNAKML

SEQ ID NO: 2485140 - protein, 23 aa, Entamoeba dispar
IAKFASTLQQVWAVKNKPKVNRL

SEQ ID NO: 2485141 - protein, 25 aa, Entamoeba dispar
IAKFFRIVIVDALFIGYGLTETTGM

SEQ ID NO: 2485142 - protein, 24 aa, Entamoeba dispar
IAKHCPRIVNVIDISHDIYPQNIL

SEQ ID NO: 2485143 - protein, 18 aa, Entamoeba dispar
IAKKRIVKAKTIQKEGKE

SEQ ID NO: 2485144 - protein, 18 aa, Entamoeba dispar
IAKLAAGIADDFLTTTFL

SEQ ID NO: 2485145 - protein, 17 aa, Entamoeba dispar
IAKNCMVKGKIINLLPQ

SEQ ID NO: 2485146 - protein, 18 aa, Entamoeba dispar
IAKQLTMVDFGIYKNVRP

SEQ ID NO: 2485147 - protein, 26 aa, Entamoeba dispar
IAKSLVHAGLCHRVLVQLSYAIGVSH

SEQ ID NO: 2485148 - protein, 19 aa, Entamoeba dispar
IALAIKLALNTKVSNDLSI

SEQ ID NO: 2485149 - protein, 18 aa, Entamoeba dispar
IALCEKLTFTDIIKKVAD

SEQ ID NO: 2485150 - protein, 26 aa, Entamoeba dispar
IALCQAGVVFGYRVNIVMPSTMSLER

SEQ ID NO: 2485151 - protein, 21 aa, Entamoeba dispar
IALEEYVTLEFARYLQDAFNV

SEQ ID NO: 2485152 - protein, 34 aa, Entamoeba dispar
IALEISCLQQGFGYEVFDEGLGVALVYNLQDENI

SEQ ID NO: 2485153 - protein, 17 aa, Entamoeba dispar
IALEKNKLGTIVFVTPE

SEQ ID NO: 2485154 - protein, 24 aa, Entamoeba dispar
IALFRCGHKIPYQIFFKDVVNQRL

SEQ ID NO: 2485155 - protein, 18 aa, Entamoeba dispar
IALKAAQEKLETMQFDVS

SEQ ID NO: 2485156 - protein, 23 aa, Entamoeba dispar
IALKRKLHAKIDEVHKGKTKNLN

SEQ ID NO: 2485157 - protein, 26 aa, Entamoeba dispar
IALQRQMMFLTRFFKTLVDLPSNISD

SEQ ID NO: 2485158 - protein, 17 aa, Entamoeba dispar
IALRPSFDNFLKFVSGV

SEQ ID NO: 2485159 - protein, 22 aa, Entamoeba dispar
IALSAPRCYSKIPAKIQKQMTE

SEQ ID NO: 2485160 - protein, 17 aa, Entamoeba dispar
IALVKEVLSKHPQYQLL

SEQ ID NO: 2485161 - protein, 17 aa, Entamoeba dispar
IALYNWVKLCVATFKHF

SEQ ID NO: 2485162 - protein, 27 aa, Entamoeba dispar
IAMKLRHCTRLVLKDFYSPLLLENTDE

SEQ ID NO: 2485163 - protein, 21 aa, Entamoeba dispar
IAMMPYYLVIDGDEGKDIPKM

SEQ ID NO: 2485164 - protein, 19 aa, Entamoeba dispar
IANENFRIFGTMNPGGDFG

SEQ ID NO: 2485165 - protein, 21 aa, Entamoeba dispar
IANGVVPLFKIMGAFEQHVEP

SEQ ID NO: 2485166 - protein, 18 aa, Entamoeba dispar
IANNLSLYNDIRHFVSDK

SEQ ID NO: 2485167 - protein, 17 aa, Entamoeba dispar
IANQIKLIIPLKIETLE

SEQ ID NO: 2485168 - protein, 25 aa, Entamoeba dispar
IAQECCKTILPLLFCSTYNQIELLD

SEQ ID NO: 2485169 - protein, 27 aa, Entamoeba dispar
IAQHFSQTRYKGWPKVEEFLNGLENYS

SEQ ID NO: 2485170 - protein, 21 aa, Entamoeba dispar
IAQKRVPLMTIKQVEEKEKEL

SEQ ID NO: 2485171 - protein, 34 aa, Entamoeba dispar
IAQYYKTDWPLLVICPSSLRANWKNEIITNCKCY

SEQ ID NO: 2485172 - protein, 22 aa, Entamoeba dispar
IARIGGLLNKGLKSFVRGHKRD

SEQ ID NO: 2485173 - protein, 23 aa, Entamoeba dispar
IARKRVSESWFRGKKEAGDLIPW

SEQ ID NO: 2485174 - protein, 21 aa, Entamoeba dispar
IARLIPRNLVFVSALEPNGIE

SEQ ID NO: 2485175 - protein, 21 aa, Entamoeba dispar
IARMALWKHEFLIKIDKCYLF

SEQ ID NO: 2485176 - protein, 17 aa, Entamoeba dispar
IARSCPNGIEYILRILK

SEQ ID NO: 2485177 - protein, 24 aa, Entamoeba dispar
IARVCYKAPWPVTAREFVGVQNWF

SEQ ID NO: 2485178 - protein, 26 aa, Entamoeba dispar
IASFIPGICEQVKLDLVIGEEIIFSN

SEQ ID NO: 2485179 - protein, 24 aa, Entamoeba dispar
IASKYLKFCKDFAEFIKSLQPTEV

SEQ ID NO: 2485180 - protein, 19 aa, Entamoeba dispar
IASMIAIETIINWLYENPF

SEQ ID NO: 2485181 - protein, 21 aa, Entamoeba dispar
IASPENFGLLGVESKVSPKAR

SEQ ID NO: 2485182 - protein, 27 aa, Entamoeba dispar
IASPLFIKIELLRYERRVPLNDIRTIQ

SEQ ID NO: 2485183 - protein, 24 aa, Entamoeba dispar
IASPQSAPVLGEFLSQLYILYADY

SEQ ID NO: 2485184 - protein, 23 aa, Entamoeba dispar
IASQLNCELKFKITELTRENERI

SEQ ID NO: 2485185 - protein, 20 aa, Entamoeba dispar
IASQPIKKAAVWCVGEYFDL

SEQ ID NO: 2485186 - protein, 17 aa, Entamoeba dispar
IASRLFSAIIFESIESL

SEQ ID NO: 2485187 - protein, 22 aa, Entamoeba dispar
IATEIPVSAYICSDITLCEKKM

SEQ ID NO: 2485188 - protein, 18 aa, Entamoeba dispar
IATETILQVLKHMIIIDN

SEQ ID NO: 2485189 - protein, 19 aa, Entamoeba dispar
IATLLSMKLFNTMIENKCD

SEQ ID NO: 2485190 - protein, 18 aa, Entamoeba dispar
IATNACFGIKQVDGCYIS

SEQ ID NO: 2485191 - protein, 25 aa, Entamoeba dispar
IATPTLEFYQWFASMVEQYSDFGIP

SEQ ID NO: 2485192 - protein, 17 aa, Entamoeba dispar
IATPYILSKYYFEHLLK

SEQ ID NO: 2485193 - protein, 17 aa, Entamoeba dispar
IATRPQYIVSLVNIKDE

SEQ ID NO: 2485194 - protein, 24 aa, Entamoeba dispar
IATRSKLRAGLNCISEISKSLYFD

SEQ ID NO: 2485195 - protein, 26 aa, Entamoeba dispar
IATTMCPKCRELLCEESITYIEEIKL

SEQ ID NO: 2485196 - protein, 17 aa, Entamoeba dispar
IATVFINPFKLSQFYTF

SEQ ID NO: 2485197 - protein, 24 aa, Entamoeba dispar
IAVEKWLARCLPFENEKEIYEFVK

SEQ ID NO: 2485198 - protein, 30 aa, Entamoeba dispar
IAVIKEFFTKMGLPDVRFKPAYNPYTEPSM

SEQ ID NO: 2485199 - protein, 24 aa, Entamoeba dispar
IAVKEAFEKYLNCIAEKYDNIIKI

SEQ ID NO: 2485200 - protein, 24 aa, Entamoeba dispar
IAVKRKLFHLDPIYLHDFGYKQYD

SEQ ID NO: 2485201 - protein, 19 aa, Entamoeba dispar
IAVYCLKDTYLPIKLLEKL

SEQ ID NO: 2485202 - protein, 24 aa, Entamoeba dispar
IAYICKRVLQGLVYLHKMGIIHRD

SEQ ID NO: 2485203 - protein, 20 aa, Entamoeba dispar
IAYQSGWFKPVGGILEESLY

SEQ ID NO: 2485204 - protein, 19 aa, Entamoeba dispar
IAYRKYWFEGNIEQNDDSL

SEQ ID NO: 2485205 - protein, 23 aa, Entamoeba dispar
IAYYTLFVKPVFEIYQKTSKSRD

SEQ ID NO: 2485206 - protein, 18 aa, Entamoeba dispar
ICAAKGTVLILGKEKHFL

SEQ ID NO: 2485207 - protein, 21 aa, Entamoeba dispar
ICAATLRDGMNYQRVIIGAAL

SEQ ID NO: 2485208 - protein, 17 aa, Entamoeba dispar
ICADCLFREVSYVDLDY

SEQ ID NO: 2485209 - protein, 26 aa, Entamoeba dispar
ICADDSFKMNISTVMPIFQTGITADI

SEQ ID NO: 2485210 - protein, 17 aa, Entamoeba dispar
ICALEYLHMEGVVYRDL

SEQ ID NO: 2485211 - protein, 25 aa, Entamoeba dispar
ICCRPIKAGELVFKERASILYIGPE

SEQ ID NO: 2485212 - protein, 25 aa, Entamoeba dispar
ICCSKGFQFKFFMTYMDMLSLEDEY

SEQ ID NO: 2485213 - protein, 30 aa, Entamoeba dispar
ICDCPLCSGPIDPWRAFKCSCGGIIYPEPE

SEQ ID NO: 2485214 - protein, 24 aa, Entamoeba dispar
ICDEITRLGSVPVFVSNWHDAYAE

SEQ ID NO: 2485215 - protein, 17 aa, Entamoeba dispar
ICDKCGIAFNGNKSYEK

SEQ ID NO: 2485216 - protein, 19 aa, Entamoeba dispar
ICDLWDCAHVLATQNIPQN

SEQ ID NO: 2485217 - protein, 26 aa, Entamoeba dispar
ICDSYYFQDCIDFILKLLPKDKLLAL

SEQ ID NO: 2485218 - protein, 18 aa, Entamoeba dispar
ICDVLLFRKTLFDCYNEY

SEQ ID NO: 2485219 - protein, 27 aa, Entamoeba dispar
ICEAPPVPAPRRGLVLGRRSSSISSEE

SEQ ID NO: 2485220 - protein, 17 aa, Entamoeba dispar
ICECPKCQCEMISFDKE

SEQ ID NO: 2485221 - protein, 19 aa, Entamoeba dispar
ICEIKELLFSKDLKKKSEE

SEQ ID NO: 2485222 - protein, 18 aa, Entamoeba dispar
ICENFYYRKMIKETSPFH

SEQ ID NO: 2485223 - protein, 27 aa, Entamoeba dispar
ICERIFKELCCAVQFLQKEFNLIHRDI

SEQ ID NO: 2485224 - protein, 18 aa, Entamoeba dispar
ICETNIYPAPTLSGVICN

SEQ ID NO: 2485225 - protein, 28 aa, Entamoeba dispar
ICEVKSCINLYFDEIFFKANKETGATLM

SEQ ID NO: 2485226 - protein, 20 aa, Entamoeba dispar
ICFQCLGKYCYFKDDVLLQP

SEQ ID NO: 2485227 - protein, 23 aa, Entamoeba dispar
ICGNEVSEFVCDLEVFTLKDIIN

SEQ ID NO: 2485228 - protein, 27 aa, Entamoeba dispar
ICGTNCIKLLQIVYGATFKKLAAEQEK

SEQ ID NO: 2485229 - protein, 18 aa, Entamoeba dispar
ICIAPGFIRKSAINDLTQ

SEQ ID NO: 2485230 - protein, 21 aa, Entamoeba dispar
ICIEYSRYSTIFTMYRSLGKK

SEQ ID NO: 2485231 - protein, 20 aa, Entamoeba dispar
ICIGYLCIWCSGETSSFHSY

SEQ ID NO: 2485232 - protein, 23 aa, Entamoeba dispar
ICILRKSIKWFIQLYGNLINSTT

SEQ ID NO: 2485233 - protein, 20 aa, Entamoeba dispar
ICISIFPTINKIFLYDLPLE

SEQ ID NO: 2485234 - protein, 17 aa, Entamoeba dispar
ICKGEGLEKEYLIKCSF

SEQ ID NO: 2485235 - protein, 18 aa, Entamoeba dispar
ICKHIKYTESDREKYGCL

SEQ ID NO: 2485236 - protein, 18 aa, Entamoeba dispar
ICKLKISNVIFAAFVSPI

SEQ ID NO: 2485237 - protein, 17 aa, Entamoeba dispar
ICLADIFQKQAFNQPLC

SEQ ID NO: 2485238 - protein, 17 aa, Entamoeba dispar
ICLDCCDIIEYHFPPNR

SEQ ID NO: 2485239 - protein, 18 aa, Entamoeba dispar
ICLLRQLNHRNIIKILGV

SEQ ID NO: 2485240 - protein, 20 aa, Entamoeba dispar
ICLNEGLAPVNALKEGFNRM

SEQ ID NO: 2485241 - protein, 17 aa, Entamoeba dispar
ICLWSSLPEHIQFYLKE

SEQ ID NO: 2485242 - protein, 19 aa, Entamoeba dispar
ICMDAKYPYITFHTPNKVE

SEQ ID NO: 2485243 - protein, 19 aa, Entamoeba dispar
ICNGCDEIIYAVGNDLNNG

SEQ ID NO: 2485244 - protein, 44 aa, Entamoeba dispar
ICNILKTNSLTSVPFKLDINSSPQIFGFEHCFKQLTQFIENIQK

SEQ ID NO: 2485245 - protein, 20 aa, Entamoeba dispar
ICNKPNVMIIIVTKDGSIFG

SEQ ID NO: 2485246 - protein, 17 aa, Entamoeba dispar
ICNKVGGNLKIDKDELY

SEQ ID NO: 2485247 - protein, 18 aa, Entamoeba dispar
ICNPSGLNNIVYRQLQRG

SEQ ID NO: 2485248 - protein, 24 aa, Entamoeba dispar
ICNSGILFPMCLQLKRLYAKLLFQ

SEQ ID NO: 2485249 - protein, 24 aa, Entamoeba dispar
ICPELCGLRMCKLAIMLVTTGGIS

SEQ ID NO: 2485250 - protein, 20 aa, Entamoeba dispar
ICPENLKLGNFEIQIDKPQP

SEQ ID NO: 2485251 - protein, 21 aa, Entamoeba dispar
ICPKMPESLSILVKPKTKTKE

SEQ ID NO: 2485252 - protein, 21 aa, Entamoeba dispar
ICPRYYCNKAALLPFSPSDKL

SEQ ID NO: 2485253 - protein, 17 aa, Entamoeba dispar
ICQCKQKHCGFAAGILV

SEQ ID NO: 2485254 - protein, 18 aa, Entamoeba dispar
ICRIYSRKVKYLLQDCND

SEQ ID NO: 2485255 - protein, 17 aa, Entamoeba dispar
ICRNVCFFTWAYELLIY

SEQ ID NO: 2485256 - protein, 18 aa, Entamoeba dispar
ICRNYYGKQCYLLNMLLE

SEQ ID NO: 2485257 - protein, 23 aa, Entamoeba dispar
ICSAEYLCTILIALSSKSISTNE

SEQ ID NO: 2485258 - protein, 23 aa, Entamoeba dispar
ICSEFGWSDVGTWGSLHTLQQKD

SEQ ID NO: 2485259 - protein, 22 aa, Entamoeba dispar
ICSGIWIKTIIMKNEYNKYLNI

SEQ ID NO: 2485260 - protein, 17 aa, Entamoeba dispar
ICSGSGYVNTDIIYSAV

SEQ ID NO: 2485261 - protein, 17 aa, Entamoeba dispar
ICSKGYCIDDNYYEQEE

SEQ ID NO: 2485262 - protein, 25 aa, Entamoeba dispar
ICSPEACGFVTMNRPGCFEENTAGP

SEQ ID NO: 2485263 - protein, 17 aa, Entamoeba dispar
ICSRYYRAPELIFDCTH

SEQ ID NO: 2485264 - protein, 21 aa, Entamoeba dispar
ICSTPQLLTSLSFHDQFQLLK

SEQ ID NO: 2485265 - protein, 22 aa, Entamoeba dispar
ICSVNIKKGLSHIVITSDGADT

SEQ ID NO: 2485266 - protein, 26 aa, Entamoeba dispar
ICTDFCKTDNSIFCVGLSNGDIVLYN

SEQ ID NO: 2485267 - protein, 18 aa, Entamoeba dispar
ICTLKGHGDWVLNLDWHY

SEQ ID NO: 2485268 - protein, 20 aa, Entamoeba dispar
ICTNTAYILFYQKRNANPED

SEQ ID NO: 2485269 - protein, 24 aa, Entamoeba dispar
ICVGSFFRHPVPIFNSLPIYINSI

SEQ ID NO: 2485270 - protein, 20 aa, Entamoeba dispar
ICVICRLTSYNYMYIIPSFR

SEQ ID NO: 2485271 - protein, 19 aa, Entamoeba dispar
ICVLTLVITFTSIRRISSL

SEQ ID NO: 2485272 - protein, 25 aa, Entamoeba dispar
ICVNCGKKAAFSLRISTEESIEVIG

SEQ ID NO: 2485273 - protein, 18 aa, Entamoeba dispar
ICYENCLNVANQLQSEVL

SEQ ID NO: 2485274 - protein, 19 aa, Entamoeba dispar
IDAALDFDPEVIGISNTML

SEQ ID NO: 2485275 - protein, 30 aa, Entamoeba dispar
IDADFGILPSRRFICCGPMYLTNNLVSKPT

SEQ ID NO: 2485276 - protein, 17 aa, Entamoeba dispar
IDAEEWVFNRSFIPLKF

SEQ ID NO: 2485277 - protein, 22 aa, Entamoeba dispar
IDAEGVPSMLFSTIKKCPLTSR

SEQ ID NO: 2485278 - protein, 24 aa, Entamoeba dispar
IDAGLKVIACIGETEAQRIANQTE

SEQ ID NO: 2485279 - protein, 20 aa, Entamoeba dispar
IDAKELFDEYCRTRYTYAEL

SEQ ID NO: 2485280 - protein, 21 aa, Entamoeba dispar
IDALGGFVGLRSMKENQLLES

SEQ ID NO: 2485281 - protein, 17 aa, Entamoeba dispar
IDALLKHLIRINPNLPL

SEQ ID NO: 2485282 - protein, 25 aa, Entamoeba dispar
IDALPKCTACGQPISVYAYEFCGYP

SEQ ID NO: 2485283 - protein, 20 aa, Entamoeba dispar
IDAPHYRTGTQFKCYPLYDF

SEQ ID NO: 2485284 - protein, 26 aa, Entamoeba dispar
IDASLMIYSYRVDDIYQAFANFAELI

SEQ ID NO: 2485285 - protein, 20 aa, Entamoeba dispar
IDATFNLGMNLLKFTRLWNG

SEQ ID NO: 2485286 - protein, 18 aa, Entamoeba dispar
IDCKYLRLLDGMADLTTL

SEQ ID NO: 2485287 - protein, 21 aa, Entamoeba dispar
IDCLDSFSLFSKIRGRKNVHI

SEQ ID NO: 2485288 - protein, 21 aa, Entamoeba dispar
IDCYKMIRADHVIPSVIGEGQ

SEQ ID NO: 2485289 - protein, 23 aa, Entamoeba dispar
IDDDFYGYVTWINCLTNENFIET

SEQ ID NO: 2485290 - protein, 24 aa, Entamoeba dispar
IDDEICKQCFGCIQNQVTKHFNKY

SEQ ID NO: 2485291 - protein, 24 aa, Entamoeba dispar
IDDFANDVRLVFKNAMKYNPPRNT

SEQ ID NO: 2485292 - protein, 19 aa, Entamoeba dispar
IDDGIKWLTMTYYYICILR

SEQ ID NO: 2485293 - protein, 30 aa, Entamoeba dispar
IDDLIHCNSFRLTPMWTYLTQIQIKEQFEQ

SEQ ID NO: 2485294 - protein, 18 aa, Entamoeba dispar
IDDLKVFSFDSSRIDMSW

SEQ ID NO: 2485295 - protein, 18 aa, Entamoeba dispar
IDDLMDIDLSKTMTAEIT

SEQ ID NO: 2485296 - protein, 19 aa, Entamoeba dispar
IDDVEIWFDPDITNSVIEE

SEQ ID NO: 2485297 - protein, 20 aa, Entamoeba dispar
IDDWCFYKCNSLKSINIPTT

SEQ ID NO: 2485298 - protein, 17 aa, Entamoeba dispar
IDDYIDVYFHFRNSIRL

SEQ ID NO: 2485299 - protein, 17 aa, Entamoeba dispar
IDEAIAFSKIINQAQQM

SEQ ID NO: 2485300 - protein, 25 aa, Entamoeba dispar
IDEGYKNIVLCGAIGTRFDHSLSNV

SEQ ID NO: 2485301 - protein, 17 aa, Entamoeba dispar
IDEKFKVAPHLVPCGNV

SEQ ID NO: 2485302 - protein, 18 aa, Entamoeba dispar
IDEKKYLSFMKFQDYCKY

SEQ ID NO: 2485303 - protein, 21 aa, Entamoeba dispar
IDEPWYLKFNNSAIYDDNTED

SEQ ID NO: 2485304 - protein, 21 aa, Entamoeba dispar
IDEPWYLKFNNSAIYDDNTGD

SEQ ID NO: 2485305 - protein, 21 aa, Entamoeba dispar
IDEPWYLKFNNSAIYSENTED

SEQ ID NO: 2485306 - protein, 18 aa, Entamoeba dispar
IDEVYLLLTDLLRYKEQE

SEQ ID NO: 2485307 - protein, 17 aa, Entamoeba dispar
IDFAIVLKDLFNFNEQG

SEQ ID NO: 2485308 - protein, 26 aa, Entamoeba dispar
IDFDEGWYVIFGCTYQPGIERKYSME

SEQ ID NO: 2485309 - protein, 22 aa, Entamoeba dispar
IDFDYPPLLAPFLPPPLPTHLS

SEQ ID NO: 2485310 - protein, 29 aa, Entamoeba dispar
IDFFISVFHGLFFYNEFNGAYLIYNVLSN

SEQ ID NO: 2485311 - protein, 17 aa, Entamoeba dispar
IDFGDDMARVVIIVGIP

SEQ ID NO: 2485312 - protein, 18 aa, Entamoeba dispar
IDFGEEWRNKNHIDPHHL

SEQ ID NO: 2485313 - protein, 19 aa, Entamoeba dispar
IDFGFVINLRPKFDANRFA

SEQ ID NO: 2485314 - protein, 17 aa, Entamoeba dispar
IDFGKNPSFSFTRKDGS

SEQ ID NO: 2485315 - protein, 26 aa, Entamoeba dispar
IDFITACTNIRCAIFNLQGISRFEVQ

SEQ ID NO: 2485316 - protein, 24 aa, Entamoeba dispar
IDFLLKCIKQKLNQNMHFYDTQQT

SEQ ID NO: 2485317 - protein, 21 aa, Entamoeba dispar
IDFPKQWPDMINLIQQTYQSG

SEQ ID NO: 2485318 - protein, 27 aa, Entamoeba dispar
IDFQVGSCLRVKQFSLPSPVLNKEMAQ

SEQ ID NO: 2485319 - protein, 25 aa, Entamoeba dispar
IDFRMKRIECNGSPYKLQIWDTAGQ

SEQ ID NO: 2485320 - protein, 18 aa, Entamoeba dispar
IDFSVNRIKGLLEVVDSY

SEQ ID NO: 2485321 - protein, 21 aa, Entamoeba dispar
IDFYCLMPSTYISYLTSNTDE

SEQ ID NO: 2485322 - protein, 22 aa, Entamoeba dispar
IDGAVCAKEVVPYLSQALLDLD

SEQ ID NO: 2485323 - protein, 17 aa, Entamoeba dispar
IDGCYWNVVGFPSFRFC

SEQ ID NO: 2485324 - protein, 17 aa, Entamoeba dispar
IDGDTIPVMITGQEGVQ

SEQ ID NO: 2485325 - protein, 18 aa, Entamoeba dispar
IDGILQFLKFEKITENKN

SEQ ID NO: 2485326 - protein, 18 aa, Entamoeba dispar
IDGIPEFPVIKATDEVPI

SEQ ID NO: 2485327 - protein, 18 aa, Entamoeba dispar
IDGIVLNCLKRVSQGNSF

SEQ ID NO: 2485328 - protein, 19 aa, Entamoeba dispar
IDGKRFVKSMIVSNVVNIL

SEQ ID NO: 2485329 - protein, 22 aa, Entamoeba dispar
IDGKSGVLTNVFSLEVDCFNAD

SEQ ID NO: 2485330 - protein, 22 aa, Entamoeba dispar
IDGLKGLIILYHYIKVDPLPLL

SEQ ID NO: 2485331 - protein, 17 aa, Entamoeba dispar
IDGMGITSSGLREICLL

SEQ ID NO: 2485332 - protein, 17 aa, Entamoeba dispar
IDGMRWVVPYVYWFEVI

SEQ ID NO: 2485333 - protein, 22 aa, Entamoeba dispar
IDGNMKAIFYFFVVNGKVLELM

SEQ ID NO: 2485334 - protein, 17 aa, Entamoeba dispar
IDGRALILITLSLMKKC

SEQ ID NO: 2485335 - protein, 22 aa, Entamoeba dispar
IDGVCPIAKMIQQRKRRFTTDC

SEQ ID NO: 2485336 - protein, 25 aa, Entamoeba dispar
IDHAAAYRYAKLLKIDVPKELRTGD

SEQ ID NO: 2485337 - protein, 17 aa, Entamoeba dispar
IDHAIGIPNSFFKEVRK

SEQ ID NO: 2485338 - protein, 21 aa, Entamoeba dispar
IDHYHKAFVYCFDCRKNYCKH

SEQ ID NO: 2485339 - protein, 26 aa, Entamoeba dispar
IDHYSKKLIFILKIQFEEELEEGQCQ

SEQ ID NO: 2485340 - protein, 18 aa, Entamoeba dispar
IDIELFKKIQSSPERFII

SEQ ID NO: 2485341 - protein, 17 aa, Entamoeba dispar
IDIFKQGYAKVLLSKQM

SEQ ID NO: 2485342 - protein, 17 aa, Entamoeba dispar
IDIGITFEPRIINNITE

SEQ ID NO: 2485343 - protein, 18 aa, Entamoeba dispar
IDIGKALKMPDLEEAHAF

SEQ ID NO: 2485344 - protein, 20 aa, Entamoeba dispar
IDIGYSKLRIPKLVKAENIV

SEQ ID NO: 2485345 - protein, 23 aa, Entamoeba dispar
IDIIKDIPISVAIVETHLIHLSP

SEQ ID NO: 2485346 - protein, 24 aa, Entamoeba dispar
IDIIPGTVYFKACLHQNFEHSTLF

SEQ ID NO: 2485347 - protein, 29 aa, Entamoeba dispar
IDIKGTLHLPRKSAFLLGKYEDIIFEQST

SEQ ID NO: 2485348 - protein, 19 aa, Entamoeba dispar
IDIKPKRIIFKSIEEYIKV

SEQ ID NO: 2485349 - protein, 25 aa, Entamoeba dispar
IDIMPFERLSILIKYIHSRNHHQIL

SEQ ID NO: 2485350 - protein, 17 aa, Entamoeba dispar
IDIPFFLKEDQIKHADN

SEQ ID NO: 2485351 - protein, 17 aa, Entamoeba dispar
IDIPHIIPLSPKFIKQV

SEQ ID NO: 2485352 - protein, 25 aa, Entamoeba dispar
IDIPKCPKCGGLIKLDVVLFGEELE

SEQ ID NO: 2485353 - protein, 17 aa, Entamoeba dispar
IDIPPVYSGEYSYYMNQ

SEQ ID NO: 2485354 - protein, 26 aa, Entamoeba dispar
IDIPRSEWGVGMGHKHIHGGLTPGGR

SEQ ID NO: 2485355 - protein, 23 aa, Entamoeba dispar
IDITSCDALTCLSFPTTLTKMII

SEQ ID NO: 2485356 - protein, 19 aa, Entamoeba dispar
IDIVSGLCNLKVLDISNNH

SEQ ID NO: 2485357 - protein, 17 aa, Entamoeba dispar
IDIWSLGIMCREMMEGV

SEQ ID NO: 2485358 - protein, 25 aa, Entamoeba dispar
IDIWSVGCVLFECIIGDVLFPADND

SEQ ID NO: 2485359 - protein, 19 aa, Entamoeba dispar
IDKCKNYPGGTFVVGLDTA

SEQ ID NO: 2485360 - protein, 23 aa, Entamoeba dispar
IDKDWCFYEYSSLTSMNIDNLQF

SEQ ID NO: 2485361 - protein, 23 aa, Entamoeba dispar
IDKFLNSIIIEFSQTRSFPPSQI

SEQ ID NO: 2485362 - protein, 17 aa, Entamoeba dispar
IDKGKGGESVWIGIIDL

SEQ ID NO: 2485363 - protein, 23 aa, Entamoeba dispar
IDKIEKIKGWGLLICDEGHRLKN

SEQ ID NO: 2485364 - protein, 19 aa, Entamoeba dispar
IDKIYCGKGIKKVRIYKIK

SEQ ID NO: 2485365 - protein, 20 aa, Entamoeba dispar
IDKKCLTLAKAINQLIRDRN

SEQ ID NO: 2485366 - protein, 18 aa, Entamoeba dispar
IDKLKCHSFILQIRIPSL

SEQ ID NO: 2485367 - protein, 35 aa, Entamoeba dispar
IDKLKWVPIRRKMAADNSCLFHCLEYLFYNKSRND

SEQ ID NO: 2485368 - protein, 23 aa, Entamoeba dispar
IDKNLPKEWTIICLSIDEIEKSI

SEQ ID NO: 2485369 - protein, 25 aa, Entamoeba dispar
IDKPFLEYDLEWFPPQWKVNFAKRL

SEQ ID NO: 2485370 - protein, 20 aa, Entamoeba dispar
IDKPWYLKFNNSAIYADNTE

SEQ ID NO: 2485371 - protein, 24 aa, Entamoeba dispar
IDKQKAAGIIIDWDDNGDEEDPSG

SEQ ID NO: 2485372 - protein, 23 aa, Entamoeba dispar
IDKRYRVIAIFDYILYLLADSTY

SEQ ID NO: 2485373 - protein, 20 aa, Entamoeba dispar
IDKVFFFSYTFPELIKIRSE

SEQ ID NO: 2485374 - protein, 20 aa, Entamoeba dispar
IDKWFMKLFNHWNNTVRQIF

SEQ ID NO: 2485375 - protein, 21 aa, Entamoeba dispar
IDKYGYCPIHYTIIQNNKELF

SEQ ID NO: 2485376 - protein, 20 aa, Entamoeba dispar
IDLALSILKAIHCFPNETSF

SEQ ID NO: 2485377 - protein, 19 aa, Entamoeba dispar
IDLFARYRYLKEITALILD

SEQ ID NO: 2485378 - protein, 24 aa, Entamoeba dispar
IDLFDKFLCLSVELDINPKVFNQI

SEQ ID NO: 2485379 - protein, 17 aa, Entamoeba dispar
IDLFGNDVINNFIAMLT

SEQ ID NO: 2485380 - protein, 17 aa, Entamoeba dispar
IDLGFGYFTYFKMQNVI

SEQ ID NO: 2485381 - protein, 18 aa, Entamoeba dispar
IDLGICVAQATVVLEANN

SEQ ID NO: 2485382 - protein, 21 aa, Entamoeba dispar
IDLGTTFSCCHFFNIQTKKYE

SEQ ID NO: 2485383 - protein, 22 aa, Entamoeba dispar
IDLGTTFSCCHFFNTQTKKYEC

SEQ ID NO: 2485384 - protein, 18 aa, Entamoeba dispar
IDLLTPVNHYGLLFPQLL

SEQ ID NO: 2485385 - protein, 24 aa, Entamoeba dispar
IDLLTRIRVVYGIDAVRPYQKNVI

SEQ ID NO: 2485386 - protein, 35 aa, Entamoeba dispar
IDLMDSRMATLFKEINTQGSLICDVHQETSERLIS

SEQ ID NO: 2485387 - protein, 22 aa, Entamoeba dispar
IDLNGKCLWTMEKKGVSCVELS

SEQ ID NO: 2485388 - protein, 26 aa, Entamoeba dispar
IDLNIDCLKEITVDFFNVFNSRYLNN

SEQ ID NO: 2485389 - protein, 17 aa, Entamoeba dispar
IDLNMVLSIPFDIKEID

SEQ ID NO: 2485390 - protein, 18 aa, Entamoeba dispar
IDLPEWVRRYSKKKRDDF

SEQ ID NO: 2485391 - protein, 24 aa, Entamoeba dispar
IDLPTILGGMRFICLDVKPEQIVA

SEQ ID NO: 2485392 - protein, 28 aa, Entamoeba dispar
IDLSGSIGFFEFLALWNFMNLCNETFKH

SEQ ID NO: 2485393 - protein, 17 aa, Entamoeba dispar
IDLTKAIVSRTIEMEIP

SEQ ID NO: 2485394 - protein, 25 aa, Entamoeba dispar
IDLYNEILLFPGLPASIQNEIGNAT

SEQ ID NO: 2485395 - protein, 20 aa, Entamoeba dispar
IDMFCFYKCKSLASIDIPTS

SEQ ID NO: 2485396 - protein, 26 aa, Entamoeba dispar
IDMGGLRKEWLRVIATSMFNADYLLF

SEQ ID NO: 2485397 - protein, 21 aa, Entamoeba dispar
IDMKGDWSYQSYFCKDNKSMN

SEQ ID NO: 2485398 - protein, 27 aa, Entamoeba dispar
IDMKKRCLYCQLQYPFECVSTQCPISF

SEQ ID NO: 2485399 - protein, 17 aa, Entamoeba dispar
IDNCLVVGDGRRCAGAL

SEQ ID NO: 2485400 - protein, 21 aa, Entamoeba dispar
IDNDSKFPSFEPIQQQPQQNQ

SEQ ID NO: 2485401 - protein, 24 aa, Entamoeba dispar
IDNFISCVCRILMIEGIPFQPQAI

SEQ ID NO: 2485402 - protein, 17 aa, Entamoeba dispar
IDNILSLLRIEKPMEEE

SEQ ID NO: 2485403 - protein, 18 aa, Entamoeba dispar
IDNKCAPAAIVLCEAAMK

SEQ ID NO: 2485404 - protein, 20 aa, Entamoeba dispar
IDNLKGLDFEDGESEFFNIT

SEQ ID NO: 2485405 - protein, 18 aa, Entamoeba dispar
IDNLPTILPETATQGPLP

SEQ ID NO: 2485406 - protein, 24 aa, Entamoeba dispar
IDNLREFLVSGGSVVWKKLQYLTI

SEQ ID NO: 2485407 - protein, 19 aa, Entamoeba dispar
IDNLSCLLQLQGIRKEGKR

SEQ ID NO: 2485408 - protein, 27 aa, Entamoeba dispar
IDNMIWNWVNEKVKGYGLYVDNPSTSF

SEQ ID NO: 2485409 - protein, 17 aa, Entamoeba dispar
IDNPIIKYYLLKHFGVI

SEQ ID NO: 2485410 - protein, 24 aa, Entamoeba dispar
IDPALLRGGRLGDWIYLGLPSDGD

SEQ ID NO: 2485411 - protein, 23 aa, Entamoeba dispar
IDPCILLYMKLVIGLTGEKIGLF

SEQ ID NO: 2485412 - protein, 24 aa, Entamoeba dispar
IDPDKAVAVGAALQGASMIGQMQE

SEQ ID NO: 2485413 - protein, 19 aa, Entamoeba dispar
IDPEQRYSIEQVIDSSFAK

SEQ ID NO: 2485414 - protein, 25 aa, Entamoeba dispar
IDPILQCLNVIKSRIDNQFIAYKRS

SEQ ID NO: 2485415 - protein, 21 aa, Entamoeba dispar
IDPNFNRTILINTKFDNRVKE

SEQ ID NO: 2485416 - protein, 22 aa, Entamoeba dispar
IDPNIIITPLFSNFKVYCSESN

SEQ ID NO: 2485417 - protein, 22 aa, Entamoeba dispar
IDPPRGCLLYGPPGTGKTMLAK

SEQ ID NO: 2485418 - protein, 17 aa, Entamoeba dispar
IDPTITRKEFEEECEKR

SEQ ID NO: 2485419 - protein, 20 aa, Entamoeba dispar
IDPTKRFNSIQALNHLFFTQ

SEQ ID NO: 2485420 - protein, 19 aa, Entamoeba dispar
IDPWSCGIILLEMTQNNIT

SEQ ID NO: 2485421 - protein, 17 aa, Entamoeba dispar
IDQIFEFGIKIKEYQIV

SEQ ID NO: 2485422 - protein, 30 aa, Entamoeba dispar
IDQIGLKSDEFFPFGDTALIKNNLKPSPSP

SEQ ID NO: 2485423 - protein, 21 aa, Entamoeba dispar
IDQIPSFPFTIIRDRLNTSSS

SEQ ID NO: 2485424 - protein, 20 aa, Entamoeba dispar
IDQLLLYFGTEQWEAAAHAQ

SEQ ID NO: 2485425 - protein, 25 aa, Entamoeba dispar
IDQRRIELCYARLINLTANVRINAK

SEQ ID NO: 2485426 - protein, 17 aa, Entamoeba dispar
IDQSFDFELLAQLSEGK

SEQ ID NO: 2485427 - protein, 36 aa, Entamoeba dispar
IDRDHYMCIICFKRMSRGYACCHCIEEHQDITDELK

SEQ ID NO: 2485428 - protein, 19 aa, Entamoeba dispar
IDREYSCYFTMKLSKKHQI

SEQ ID NO: 2485429 - protein, 27 aa, Entamoeba dispar
IDRFNKFIRRYFQVSAQQQVIQQQPQQ

SEQ ID NO: 2485430 - protein, 20 aa, Entamoeba dispar
IDRINMFSHLTVFTESPYYN

SEQ ID NO: 2485431 - protein, 18 aa, Entamoeba dispar
IDRKTCDMDKVIELALKY

SEQ ID NO: 2485432 - protein, 23 aa, Entamoeba dispar
IDRLGPYIFWECNNLKKLEIPNV

SEQ ID NO: 2485433 - protein, 25 aa, Entamoeba dispar
IDSAIRLFIGFVVEGEIPRYGATRI

SEQ ID NO: 2485434 - protein, 19 aa, Entamoeba dispar
IDSDILKHGYSIFTCGSLE

SEQ ID NO: 2485435 - protein, 24 aa, Entamoeba dispar
IDSELFIPCLTFIGNLAIDNISTA

SEQ ID NO: 2485436 - protein, 23 aa, Entamoeba dispar
IDSEVWKEYDLVLKKGYKAIRFE

SEQ ID NO: 2485437 - protein, 19 aa, Entamoeba dispar
IDSFNSFLINIEEIEDRIC

SEQ ID NO: 2485438 - protein, 27 aa, Entamoeba dispar
IDSGKRVWKELVFKPNIFEIINECLCY

SEQ ID NO: 2485439 - protein, 25 aa, Entamoeba dispar
IDSICMRMKPGFKVALRQVKVRRGV

SEQ ID NO: 2485440 - protein, 20 aa, Entamoeba dispar
IDSIETCYKFSMVNKKCLEA

SEQ ID NO: 2485441 - protein, 18 aa, Entamoeba dispar
IDSIFISCCNVYGSVLVS

SEQ ID NO: 2485442 - protein, 18 aa, Entamoeba dispar
IDSKVSIMMIPKDNELNG

SEQ ID NO: 2485443 - protein, 25 aa, Entamoeba dispar
IDSLIELFPSIKLLFTDIYEKDISF

SEQ ID NO: 2485444 - protein, 18 aa, Entamoeba dispar
IDSLIYIMLIHIYSFNQF

SEQ ID NO: 2485445 - protein, 19 aa, Entamoeba dispar
IDSPIRWFGRDDKPSTCFF

SEQ ID NO: 2485446 - protein, 18 aa, Entamoeba dispar
IDSRSSFGNISQRWLPEI

SEQ ID NO: 2485447 - protein, 22 aa, Entamoeba dispar
IDSSECNCLFNMIESEEVESGK

SEQ ID NO: 2485448 - protein, 24 aa, Entamoeba dispar
IDSSKLLVCRLCEHQYKLSQFCDH

SEQ ID NO: 2485449 - protein, 25 aa, Entamoeba dispar
IDSSRANEVFKIFSDYLRTHKLMKM

SEQ ID NO: 2485450 - protein, 17 aa, Entamoeba dispar
IDSTQCVIIVPTRELAV

SEQ ID NO: 2485451 - protein, 17 aa, Entamoeba dispar
IDSVFKAYGIDVDPRHL

SEQ ID NO: 2485452 - protein, 17 aa, Entamoeba dispar
IDTAVDFIPGGNIIKKG

SEQ ID NO: 2485453 - protein, 18 aa, Entamoeba dispar
IDTCDPMSAFKPCNNGIV

SEQ ID NO: 2485454 - protein, 19 aa, Entamoeba dispar
IDTEFLKTVLRRLIRCDTQ

SEQ ID NO: 2485455 - protein, 21 aa, Entamoeba dispar
IDTEYLMTIFVVISKQQHKEF

SEQ ID NO: 2485456 - protein, 24 aa, Entamoeba dispar
IDTHFPLVFSSVLTKRLNLHIQKC

SEQ ID NO: 2485457 - protein, 18 aa, Entamoeba dispar
IDTIIKRLLTKCKVDELK

SEQ ID NO: 2485458 - protein, 25 aa, Entamoeba dispar
IDTKKRIIGLLKIWTSNVSPNIIQA

SEQ ID NO: 2485459 - protein, 21 aa, Entamoeba dispar
IDTLGNIVIEFMKRVNELTPE

SEQ ID NO: 2485460 - protein, 17 aa, Entamoeba dispar
IDTLKGRIPTTLSIQRK

SEQ ID NO: 2485461 - protein, 18 aa, Entamoeba dispar
IDTLKLVLRYQPFLNTSK

SEQ ID NO: 2485462 - protein, 25 aa, Entamoeba dispar
IDTMKSLEMISIFLKNKTESIELKR

SEQ ID NO: 2485463 - protein, 20 aa, Entamoeba dispar
IDVCAFKKCTSLTQINLCSS

SEQ ID NO: 2485464 - protein, 17 aa, Entamoeba dispar
IDVIRLYLYTGHVEMAA

SEQ ID NO: 2485465 - protein, 17 aa, Entamoeba dispar
IDVLLKMNGSSLGSKKV

SEQ ID NO: 2485466 - protein, 24 aa, Entamoeba dispar
IDVPEIKKRIWFGCENTEEFKSCV

SEQ ID NO: 2485467 - protein, 18 aa, Entamoeba dispar
IDWNTSFNLYSFDDYPPK

SEQ ID NO: 2485468 - protein, 28 aa, Entamoeba dispar
IDYFFCYKWNALLFKRFFLNEDLIRIWD

SEQ ID NO: 2485469 - protein, 21 aa, Entamoeba dispar
IDYLCEIYDIPGLNNINVKFV

SEQ ID NO: 2485470 - protein, 19 aa, Entamoeba dispar
IDYRVLKKQIDQFTCKPSN

SEQ ID NO: 2485471 - protein, 24 aa, Entamoeba dispar
IDYSEAFPKYVEVINISKMLCQSF

SEQ ID NO: 2485472 - protein, 20 aa, Entamoeba dispar
IDYYFVKGPHKFDYQGMEIK

SEQ ID NO: 2485473 - protein, 17 aa, Entamoeba dispar
IEAFRIVSHNILKHGIT

SEQ ID NO: 2485474 - protein, 20 aa, Entamoeba dispar
IEAIEWPITHSKEFKKLGIR

SEQ ID NO: 2485475 - protein, 17 aa, Entamoeba dispar
IEAKAKSAKKCEGKNLD

SEQ ID NO: 2485476 - protein, 20 aa, Entamoeba dispar
IEAKIVKGYSEYHMVNTVHF

SEQ ID NO: 2485477 - protein, 23 aa, Entamoeba dispar
IEAKLKGGNNFNINGRVIKVRAG

SEQ ID NO: 2485478 - protein, 17 aa, Entamoeba dispar
IEAKTMRIILGKSNVFV

SEQ ID NO: 2485479 - protein, 17 aa, Entamoeba dispar
IEALKLTWISSASETQR

SEQ ID NO: 2485480 - protein, 20 aa, Entamoeba dispar
IEALTILIKDVWKNLKDERE

SEQ ID NO: 2485481 - protein, 20 aa, Entamoeba dispar
IEARKRFYEYSSLDAEPYQP

SEQ ID NO: 2485482 - protein, 21 aa, Entamoeba dispar
IEASAIVFLNFGRVVILTDDQ

SEQ ID NO: 2485483 - protein, 18 aa, Entamoeba dispar
IECAGRKGSFPVPELDPV

SEQ ID NO: 2485484 - protein, 17 aa, Entamoeba dispar
IECEKGYYLNSTKECQY

SEQ ID NO: 2485485 - protein, 22 aa, Entamoeba dispar
IECELKGVIVMSVPSLTTPKVQ

SEQ ID NO: 2485486 - protein, 25 aa, Entamoeba dispar
IECIKHKEPVLLIGETGCGKTTVCQ

SEQ ID NO: 2485487 - protein, 22 aa, Entamoeba dispar
IECLIRKGRVVEAVRFAEHKNL

SEQ ID NO: 2485488 - protein, 18 aa, Entamoeba dispar
IECPESLKDLVLNNLDNL

SEQ ID NO: 2485489 - protein, 17 aa, Entamoeba dispar
IECYLINEMLWLVMEYM

SEQ ID NO: 2485490 - protein, 18 aa, Entamoeba dispar
IECYSKYDGGDVFIDRES

SEQ ID NO: 2485491 - protein, 25 aa, Entamoeba dispar
IEDARPVAEGRFHRLLGKLKETPFL

SEQ ID NO: 2485492 - protein, 24 aa, Entamoeba dispar
IEDCLDLGGGVGRVTKDVLSRYYK

SEQ ID NO: 2485493 - protein, 23 aa, Entamoeba dispar
IEDFFPELLLLDLSNNEIEVLEN

SEQ ID NO: 2485494 - protein, 18 aa, Entamoeba dispar
IEDGYCIEIGKGACTQNT

SEQ ID NO: 2485495 - protein, 29 aa, Entamoeba dispar
IEDIYPYISVPSHWGYSFDIALFTEIIEK

SEQ ID NO: 2485496 - protein, 24 aa, Entamoeba dispar
IEDMPRTSFGKVYAPKLKEIVKDC

SEQ ID NO: 2485497 - protein, 18 aa, Entamoeba dispar
IEDSFRTSITIGDDSYPI

SEQ ID NO: 2485498 - protein, 21 aa, Entamoeba dispar
IEDVCFSRCYSLISINMLSPV

SEQ ID NO: 2485499 - protein, 23 aa, Entamoeba dispar
IEDYGELIPFCYDGMANLYRDEA

SEQ ID NO: 2485500 - protein, 18 aa, Entamoeba dispar
IEEAELYTLLPSGSLLKH

SEQ ID NO: 2485501 - protein, 22 aa, Entamoeba dispar
IEECDLCGAKISLKQMQHHKEY

SEQ ID NO: 2485502 - protein, 23 aa, Entamoeba dispar
IEECFRTPQSIFKRNSTYLRVLK

SEQ ID NO: 2485503 - protein, 18 aa, Entamoeba dispar
IEEEFTCLFELVDRVKDM

SEQ ID NO: 2485504 - protein, 18 aa, Entamoeba dispar
IEEEVFKLLTNFENKDGN

SEQ ID NO: 2485505 - protein, 26 aa, Entamoeba dispar
IEEFKECACAAAIIKEYLRELPDPLI

SEQ ID NO: 2485506 - protein, 18 aa, Entamoeba dispar
IEEGCIECEHLKGDPIQY

SEQ ID NO: 2485507 - protein, 20 aa, Entamoeba dispar
IEEGIKYLINCMKIEDKEIY

SEQ ID NO: 2485508 - protein, 31 aa, Entamoeba dispar
IEEIFKILYTKGCYTKGIFRENSLASKDTID

SEQ ID NO: 2485509 - protein, 24 aa, Entamoeba dispar
IEEIKKGILINSKWSKIISLINKY

SEQ ID NO: 2485510 - protein, 23 aa, Entamoeba dispar
IEEKGGIVTPQLVRAILEELNYN

SEQ ID NO: 2485511 - protein, 17 aa, Entamoeba dispar
IEEKGRQGVFVREKPVF

SEQ ID NO: 2485512 - protein, 34 aa, Entamoeba dispar
IEEKGVFQCIVFWQRDLFEIYGFEEKDQEINLRL

SEQ ID NO: 2485513 - protein, 18 aa, Entamoeba dispar
IEEKIGREKVILVKQNDN

SEQ ID NO: 2485514 - protein, 22 aa, Entamoeba dispar
IEEKKLKSGVVIPNNVIYQTPE

SEQ ID NO: 2485515 - protein, 17 aa, Entamoeba dispar
IEEKKVFIEQMKKKIDE

SEQ ID NO: 2485516 - protein, 18 aa, Entamoeba dispar
IEELCMRMSVTNFNEIPC

SEQ ID NO: 2485517 - protein, 22 aa, Entamoeba dispar
IEELFPLLKIIASSPLLQHFEL

SEQ ID NO: 2485518 - protein, 18 aa, Entamoeba dispar
IEELKKVKFNDGRSNLDE

SEQ ID NO: 2485519 - protein, 18 aa, Entamoeba dispar
IEELMKWKLKNGRNAGRG

SEQ ID NO: 2485520 - protein, 23 aa, Entamoeba dispar
IEELSHAVYIYWRAKEMVKTKEF

SEQ ID NO: 2485521 - protein, 17 aa, Entamoeba dispar
IEELWLPEVAFYDEGAY

SEQ ID NO: 2485522 - protein, 26 aa, Entamoeba dispar
IEERIKELQKDAGVNFDQHFMDEDFD

SEQ ID NO: 2485523 - protein, 25 aa, Entamoeba dispar
IEESKKSLCFEVVYDKQFVFFCKDD

SEQ ID NO: 2485524 - protein, 19 aa, Entamoeba dispar
IEETVKWLGHTPCAVTYSS

SEQ ID NO: 2485525 - protein, 24 aa, Entamoeba dispar
IEEVDCWRSVFNTEYDKNGPIING

SEQ ID NO: 2485526 - protein, 33 aa, Entamoeba dispar
IEEVKRFYEEWTHFKCQLEFWNKMPNELSEAPN

SEQ ID NO: 2485527 - protein, 18 aa, Entamoeba dispar
IEEVPSFHSIDILQQQGI

SEQ ID NO: 2485528 - protein, 26 aa, Entamoeba dispar
IEFGDYCFCKCLSLKEINIPTTITAF

SEQ ID NO: 2485529 - protein, 18 aa, Entamoeba dispar
IEFHGSEIDEEIIIGNNK

SEQ ID NO: 2485530 - protein, 25 aa, Entamoeba dispar
IEFICKTCDFIIIFIDISIELNQSE

SEQ ID NO: 2485531 - protein, 22 aa, Entamoeba dispar
IEFIPELQCYFNGDELEKQRPI

SEQ ID NO: 2485532 - protein, 20 aa, Entamoeba dispar
IEFIPIDYNKQWKFFEDSKK

SEQ ID NO: 2485533 - protein, 28 aa, Entamoeba dispar
IEFLDCIPELYLQHCMIHCYGFSPLPNA

SEQ ID NO: 2485534 - protein, 17 aa, Entamoeba dispar
IEFLSIFDSFFIQKVPK

SEQ ID NO: 2485535 - protein, 26 aa, Entamoeba dispar
IEFLSYRQFPLLAFTDFMSLFVKHFN

SEQ ID NO: 2485536 - protein, 20 aa, Entamoeba dispar
IEFPLHCNKVLLLNNSNALE

SEQ ID NO: 2485537 - protein, 22 aa, Entamoeba dispar
IEFPQLKIVWSYSPQMTVHIFN

SEQ ID NO: 2485538 - protein, 25 aa, Entamoeba dispar
IEFSIIRRRDFGLEYTAQVWGGMLG

SEQ ID NO: 2485539 - protein, 25 aa, Entamoeba dispar
IEFVPLKGCSFLLHINGKNNNNTIT

SEQ ID NO: 2485540 - protein, 27 aa, Entamoeba dispar
IEGELKILTDNIFRYKEDINRLNPNGK

SEQ ID NO: 2485541 - protein, 19 aa, Entamoeba dispar
IEGETGLYCVCKINEKKYR

SEQ ID NO: 2485542 - protein, 19 aa, Entamoeba dispar
IEGFEYTFLNEGFGYDVYN

SEQ ID NO: 2485543 - protein, 18 aa, Entamoeba dispar
IEGFPTLKLYDGASLISE

SEQ ID NO: 2485544 - protein, 19 aa, Entamoeba dispar
IEGHLKPIRVHTVVISTQH

SEQ ID NO: 2485545 - protein, 20 aa, Entamoeba dispar
IEGHLKPIRVHTVVISTQHA

SEQ ID NO: 2485546 - protein, 17 aa, Entamoeba dispar
IEGILRLSGGSDEVHRL

SEQ ID NO: 2485547 - protein, 32 aa, Entamoeba dispar
IEGITMHKNCFRCSVCKKILNGSNFAKNHGIY

SEQ ID NO: 2485548 - protein, 24 aa, Entamoeba dispar
IEGKIEFTEFLYGTFRREIPLPTD

SEQ ID NO: 2485549 - protein, 17 aa, Entamoeba dispar
IEGLHLFGDKKEMTLFK

SEQ ID NO: 2485550 - protein, 21 aa, Entamoeba dispar
IEGLQSIIILTHLLYEVTKTW

SEQ ID NO: 2485551 - protein, 18 aa, Entamoeba dispar
IEGLRISLNNGISKLNEI

SEQ ID NO: 2485552 - protein, 18 aa, Entamoeba dispar
IEGLRISLNNGLSKMNNI

SEQ ID NO: 2485553 - protein, 17 aa, Entamoeba dispar
IEGLRISLNNGLSKMSE

SEQ ID NO: 2485554 - protein, 23 aa, Entamoeba dispar
IEGMIRIILFFQFAQFQEASIVK

SEQ ID NO: 2485555 - protein, 21 aa, Entamoeba dispar
IEGNICAIIYYNGKVYIGKTN

SEQ ID NO: 2485556 - protein, 24 aa, Entamoeba dispar
IEGRGKYKLERLVVSYLYDETIGD

SEQ ID NO: 2485557 - protein, 28 aa, Entamoeba dispar
IEGVFKCLDCGWESPPIPQQFKYTQPMR

SEQ ID NO: 2485558 - protein, 21 aa, Entamoeba dispar
IEGVKKWKANIDDRVLFNNEK

SEQ ID NO: 2485559 - protein, 20 aa, Entamoeba dispar
IEGYSTKLLIDKENDEMTDV

SEQ ID NO: 2485560 - protein, 27 aa, Entamoeba dispar
IEHCYNDVYCPFKYITTHEMKDDSFNF

SEQ ID NO: 2485561 - protein, 18 aa, Entamoeba dispar
IEHFAIFSIFIIDPLLFI

SEQ ID NO: 2485562 - protein, 34 aa, Entamoeba dispar
IEHQCVIGILDIFGFEIFPVNGFEQFCINYVNEK

SEQ ID NO: 2485563 - protein, 36 aa, Entamoeba dispar
IEIAILYDKLSAIGFELNYFITWFADLFIDVFPVRL

SEQ ID NO: 2485564 - protein, 19 aa, Entamoeba dispar
IEICTKETVSFIVQIIMFS

SEQ ID NO: 2485565 - protein, 17 aa, Entamoeba dispar
IEIDDALRLMFDTFVMG

SEQ ID NO: 2485566 - protein, 23 aa, Entamoeba dispar
IEIEMTSPIGILLRSIKFTENTT

SEQ ID NO: 2485567 - protein, 18 aa, Entamoeba dispar
IEIFPFQINNSIEYNTKR

SEQ ID NO: 2485568 - protein, 24 aa, Entamoeba dispar
IEIGISFPDFYSSIQLTETQTFLN

SEQ ID NO: 2485569 - protein, 18 aa, Entamoeba dispar
IEIGKDCFYGCSSLTNMS

SEQ ID NO: 2485570 - protein, 18 aa, Entamoeba dispar
IEIGKDCFYGCSSLTSMS

SEQ ID NO: 2485571 - protein, 25 aa, Entamoeba dispar
IEIGKEWGEHFGIAFQMRDDLLDID

SEQ ID NO: 2485572 - protein, 22 aa, Entamoeba dispar
IEIGSSCFNECISLISINIPTV

SEQ ID NO: 2485573 - protein, 18 aa, Entamoeba dispar
IEIGYDCFKGCSSLTSIN

SEQ ID NO: 2485574 - protein, 22 aa, Entamoeba dispar
IEIGYKCFKECYSLTSINIPSS

SEQ ID NO: 2485575 - protein, 19 aa, Entamoeba dispar
IEIIEEIIFDPAIGKKKKR

SEQ ID NO: 2485576 - protein, 20 aa, Entamoeba dispar
IEIIKKCNKIPMKQHATDIR

SEQ ID NO: 2485577 - protein, 18 aa, Entamoeba dispar
IEIKDIYPNNIFIDESYI

SEQ ID NO: 2485578 - protein, 20 aa, Entamoeba dispar
IEIKGETSIDIDELIEEKMN

SEQ ID NO: 2485579 - protein, 23 aa, Entamoeba dispar
IEIKHPERLAAKTVQFLIVTELF

SEQ ID NO: 2485580 - protein, 32 aa, Entamoeba dispar
IEIKLFPSLIFKSSKCVFGGNITSSRGKTVTV

SEQ ID NO: 2485581 - protein, 20 aa, Entamoeba dispar
IEILKLPVVDSYNFPLRDYL

SEQ ID NO: 2485582 - protein, 19 aa, Entamoeba dispar
IEILSKRLGKEIKISYMRA

SEQ ID NO: 2485583 - protein, 21 aa, Entamoeba dispar
IEIMCNVFPFYPFWKHVCIVW

SEQ ID NO: 2485584 - protein, 20 aa, Entamoeba dispar
IEIMKRLLFGTYYSTLQQYC

SEQ ID NO: 2485585 - protein, 20 aa, Entamoeba dispar
IEIMQKWKLFLENTKDYIKN

SEQ ID NO: 2485586 - protein, 19 aa, Entamoeba dispar
IEINKRYVFDKEIGSGSFS

SEQ ID NO: 2485587 - protein, 17 aa, Entamoeba dispar
IEINLWLNNQLKYYNSI

SEQ ID NO: 2485588 - protein, 23 aa, Entamoeba dispar
IEIPECLEMINGKTFEKKDINEF

SEQ ID NO: 2485589 - protein, 18 aa, Entamoeba dispar
IEIPEHLIIINGKNIEKK

SEQ ID NO: 2485590 - protein, 17 aa, Entamoeba dispar
IEIPESVVFNNKENEYE

SEQ ID NO: 2485591 - protein, 17 aa, Entamoeba dispar
IEIPESVVLNNKENKYE

SEQ ID NO: 2485592 - protein, 19 aa, Entamoeba dispar
IEIPKEIYFNAEIIEKFEI

SEQ ID NO: 2485593 - protein, 24 aa, Entamoeba dispar
IEIPTVRWSDVGGCNEAKKQIKQE

SEQ ID NO: 2485594 - protein, 22 aa, Entamoeba dispar
IEISLCPSIHSISFPSSICSIY

SEQ ID NO: 2485595 - protein, 18 aa, Entamoeba dispar
IEITHYIQGLPFVAQTAF

SEQ ID NO: 2485596 - protein, 24 aa, Entamoeba dispar
IEIYERRTNILLQNYNKFHETNER

SEQ ID NO: 2485597 - protein, 25 aa, Entamoeba dispar
IEIYRKENIPLFGPLVTGSIVCFHE

SEQ ID NO: 2485598 - protein, 22 aa, Entamoeba dispar
IEKCFMCANLKGRQEILKEIYG

SEQ ID NO: 2485599 - protein, 19 aa, Entamoeba dispar
IEKECCIEMLIYISTLLYD

SEQ ID NO: 2485600 - protein, 17 aa, Entamoeba dispar
IEKEGKKKIAWKEEEDT

SEQ ID NO: 2485601 - protein, 17 aa, Entamoeba dispar
IEKEIIVIVGGNDGIMF

SEQ ID NO: 2485602 - protein, 20 aa, Entamoeba dispar
IEKEIRRRHFMVVNKMNKEI

SEQ ID NO: 2485603 - protein, 27 aa, Entamoeba dispar
IEKEMVCHVLTFKYPFNSEITRFDCPP

SEQ ID NO: 2485604 - protein, 19 aa, Entamoeba dispar
IEKERRLEELPPINTTTKH

SEQ ID NO: 2485605 - protein, 29 aa, Entamoeba dispar
IEKFEIPKYLGKIILRITGIAIYQRISLL

SEQ ID NO: 2485606 - protein, 25 aa, Entamoeba dispar
IEKFPLPSKHPIVMMKLNVSQSNLM

SEQ ID NO: 2485607 - protein, 25 aa, Entamoeba dispar
IEKFPNLRLVGISAYANLFESCEKL

SEQ ID NO: 2485608 - protein, 22 aa, Entamoeba dispar
IEKGESLFDVIGFGDNINNISF

SEQ ID NO: 2485609 - protein, 21 aa, Entamoeba dispar
IEKGGELWYRVNGSKKIIAVK

SEQ ID NO: 2485610 - protein, 33 aa, Entamoeba dispar
IEKGPGIGFWAPMWRVWIFLLRGLIPILERWLG

SEQ ID NO: 2485611 - protein, 19 aa, Entamoeba dispar
IEKHELFGGAKIFDIFENV

SEQ ID NO: 2485612 - protein, 18 aa, Entamoeba dispar
IEKIPRMEEKIMFNEKKI

SEQ ID NO: 2485613 - protein, 17 aa, Entamoeba dispar
IEKKLDEAIEMMRKKDK

SEQ ID NO: 2485614 - protein, 19 aa, Entamoeba dispar
IEKKVVIITEKWILVDEKE

SEQ ID NO: 2485615 - protein, 17 aa, Entamoeba dispar
IEKLIKWARGLKPIDKE

SEQ ID NO: 2485616 - protein, 19 aa, Entamoeba dispar
IEKLIRIVLLIIHNLLNVD

SEQ ID NO: 2485617 - protein, 18 aa, Entamoeba dispar
IEKLKCQEIHIFYYRGQE

SEQ ID NO: 2485618 - protein, 33 aa, Entamoeba dispar
IEKLLHRLLGLIVFRIDIHISKRDIRGVFELNL

SEQ ID NO: 2485619 - protein, 21 aa, Entamoeba dispar
IEKLYKLPKLDTIMGLSDENG

SEQ ID NO: 2485620 - protein, 24 aa, Entamoeba dispar
IEKMEIVNLMYFLKGQIKGSDIVL

SEQ ID NO: 2485621 - protein, 23 aa, Entamoeba dispar
IEKNGREFLLFEGYCGNEKFRKN

SEQ ID NO: 2485622 - protein, 21 aa, Entamoeba dispar
IEKQCICSSLAIEFNQLHVTE

SEQ ID NO: 2485623 - protein, 21 aa, Entamoeba dispar
IEKQEEWEIIKSDYQFLRNIH

SEQ ID NO: 2485624 - protein, 22 aa, Entamoeba dispar
IEKRCINEFIIPTTITKLGDYC

SEQ ID NO: 2485625 - protein, 23 aa, Entamoeba dispar
IEKRCINEFIIPTTITKLGDYCF

SEQ ID NO: 2485626 - protein, 17 aa, Entamoeba dispar
IEKRLDSLNALSVIADK

SEQ ID NO: 2485627 - protein, 17 aa, Entamoeba dispar
IEKRMIGNEAIFFITDV

SEQ ID NO: 2485628 - protein, 20 aa, Entamoeba dispar
IEKRNCCFNRLKLQPKQSLS

SEQ ID NO: 2485629 - protein, 23 aa, Entamoeba dispar
IEKVKVIICQKLYPNQWKKISTF

SEQ ID NO: 2485630 - protein, 20 aa, Entamoeba dispar
IEKVVQCITLIIIKLKSLLT

SEQ ID NO: 2485631 - protein, 29 aa, Entamoeba dispar
IEKYEKEFICKKIKFLLKRNEKGCDLSEL

SEQ ID NO: 2485632 - protein, 20 aa, Entamoeba dispar
IEKYHIPYLFPIPYLSDEKY

SEQ ID NO: 2485633 - protein, 23 aa, Entamoeba dispar
IELAENEISFFFSGAAGTGKSYV

SEQ ID NO: 2485634 - protein, 17 aa, Entamoeba dispar
IELARKLFPEKLDQFNP

SEQ ID NO: 2485635 - protein, 17 aa, Entamoeba dispar
IELDDMNFEKDLEEFTK

SEQ ID NO: 2485636 - protein, 19 aa, Entamoeba dispar
IELDKGIQSMHIVSSSEAI

SEQ ID NO: 2485637 - protein, 17 aa, Entamoeba dispar
IELEFVHWNGLLFPVKK

SEQ ID NO: 2485638 - protein, 20 aa, Entamoeba dispar
IELENKIELEWLSWGELSKR

SEQ ID NO: 2485639 - protein, 25 aa, Entamoeba dispar
IELFIKKIGGLFIEKSSGRKNAYDF

SEQ ID NO: 2485640 - protein, 26 aa, Entamoeba dispar
IELFIKKLIKVNVFNAYYDLVELPEL

SEQ ID NO: 2485641 - protein, 18 aa, Entamoeba dispar
IELFKHISVIQALAKSGL

SEQ ID NO: 2485642 - protein, 20 aa, Entamoeba dispar
IELGNDCFRQCSLLTSVTIP

SEQ ID NO: 2485643 - protein, 25 aa, Entamoeba dispar
IELGREFYPLPVIEEFDKQQKMTKK

SEQ ID NO: 2485644 - protein, 17 aa, Entamoeba dispar
IELIGSGSYGKVYSVIR

SEQ ID NO: 2485645 - protein, 26 aa, Entamoeba dispar
IELKGSTTFVKFGVLTLYDPETKPKN

SEQ ID NO: 2485646 - protein, 18 aa, Entamoeba dispar
IELKKMVYMYLCTYSEKY

SEQ ID NO: 2485647 - protein, 17 aa, Entamoeba dispar
IELKRKLYKKIIFSLPD

SEQ ID NO: 2485648 - protein, 17 aa, Entamoeba dispar
IELLDIIITDHFESLDK

SEQ ID NO: 2485649 - protein, 18 aa, Entamoeba dispar
IELLKKWSNKTQYQIIYR

SEQ ID NO: 2485650 - protein, 19 aa, Entamoeba dispar
IELLLGELVADDFEVQTVN

SEQ ID NO: 2485651 - protein, 17 aa, Entamoeba dispar
IELLPMIIEQFWNDTNQ

SEQ ID NO: 2485652 - protein, 21 aa, Entamoeba dispar
IELMSLIVLNPFKYSVCLKDF

SEQ ID NO: 2485653 - protein, 20 aa, Entamoeba dispar
IELNSSILYNDFVKMTSLTK

SEQ ID NO: 2485654 - protein, 23 aa, Entamoeba dispar
IELPIEILEELPIELFKEKDNTV

SEQ ID NO: 2485655 - protein, 17 aa, Entamoeba dispar
IELPKIEGLAIINLPTY

SEQ ID NO: 2485656 - protein, 26 aa, Entamoeba dispar
IELPRLPEYIKYLCVHSINSNIVINQ

SEQ ID NO: 2485657 - protein, 18 aa, Entamoeba dispar
IELRLDVLCEKYKIPKFG

SEQ ID NO: 2485658 - protein, 20 aa, Entamoeba dispar
IELSGGPIFKGYYCNDQANK

SEQ ID NO: 2485659 - protein, 19 aa, Entamoeba dispar
IELVPLQSIEEGIENEWGG

SEQ ID NO: 2485660 - protein, 42 aa, Entamoeba dispar
IELVTHPFNFPGLILHDIILRFIPEQNEFFLTKGSKSDFDIL

SEQ ID NO: 2485661 - protein, 17 aa, Entamoeba dispar
IELWARGSLKEIEIRLP

SEQ ID NO: 2485662 - protein, 17 aa, Entamoeba dispar
IELYYKWNQKITNWVAY

SEQ ID NO: 2485663 - protein, 19 aa, Entamoeba dispar
IEMALKISMNDEIYVDVAK

SEQ ID NO: 2485664 - protein, 19 aa, Entamoeba dispar
IEMFEGIFASYPVVLSQIY

SEQ ID NO: 2485665 - protein, 19 aa, Entamoeba dispar
IEMFLPMLLQVNQFPQQPT

SEQ ID NO: 2485666 - protein, 17 aa, Entamoeba dispar
IEMKDGIVVYVIKQGNE

SEQ ID NO: 2485667 - protein, 20 aa, Entamoeba dispar
IEMKEKLDGVDIIKRELEKT

SEQ ID NO: 2485668 - protein, 20 aa, Entamoeba dispar
IEMKGALKVKNFIKNLKKQA

SEQ ID NO: 2485669 - protein, 26 aa, Entamoeba dispar
IEMLKEFRKLGGIIGVVSFSDEQNIL

SEQ ID NO: 2485670 - protein, 17 aa, Entamoeba dispar
IEMLMKSGMSFIEAQRF

SEQ ID NO: 2485671 - protein, 26 aa, Entamoeba dispar
IEMQLFLLRWVRLLFCQVYPINTIKP

SEQ ID NO: 2485672 - protein, 23 aa, Entamoeba dispar
IEMSDLLIREMIKEQPINREGMS

SEQ ID NO: 2485673 - protein, 17 aa, Entamoeba dispar
IEMWKKNRFEERRIEVV

SEQ ID NO: 2485674 - protein, 23 aa, Entamoeba dispar
IENACHNFFRSVAYITSITTQGG

SEQ ID NO: 2485675 - protein, 25 aa, Entamoeba dispar
IENALFLFRWMSLLLTEELPINSLV

SEQ ID NO: 2485676 - protein, 24 aa, Entamoeba dispar
IENCKKFRFEGEYEEYGNIQFINC

SEQ ID NO: 2485677 - protein, 21 aa, Entamoeba dispar
IENEIKMDECMEIFDQKIQEK

SEQ ID NO: 2485678 - protein, 18 aa, Entamoeba dispar
IENELNIDLDVKQKMCKH

SEQ ID NO: 2485679 - protein, 17 aa, Entamoeba dispar
IENIKYNKIRIEEKITI

SEQ ID NO: 2485680 - protein, 17 aa, Entamoeba dispar
IENILVYLYNKGCTTHG

SEQ ID NO: 2485681 - protein, 20 aa, Entamoeba dispar
IENIREAFEYKYFMKKTEVV

SEQ ID NO: 2485682 - protein, 17 aa, Entamoeba dispar
IENIVFKYCKIVNSYND

SEQ ID NO: 2485683 - protein, 18 aa, Entamoeba dispar
IENLPKIISNVIQIYCSD

SEQ ID NO: 2485684 - protein, 18 aa, Entamoeba dispar
IENLPVLDDEGLFYYFEI

SEQ ID NO: 2485685 - protein, 23 aa, Entamoeba dispar
IENLQYGFEFFINEPSHQRFPII

SEQ ID NO: 2485686 - protein, 20 aa, Entamoeba dispar
IENNRIIGIVITRVLNKTHS

SEQ ID NO: 2485687 - protein, 18 aa, Entamoeba dispar
IENNRPLLFIALMESDIE

SEQ ID NO: 2485688 - protein, 18 aa, Entamoeba dispar
IENPFLLLKPELKYDSFE

SEQ ID NO: 2485689 - protein, 20 aa, Entamoeba dispar
IENPKRWVIDYVNAGASLIT

SEQ ID NO: 2485690 - protein, 21 aa, Entamoeba dispar
IENRIKIHFQRIGTPQKAQIA

SEQ ID NO: 2485691 - protein, 24 aa, Entamoeba dispar
IENRKDAKWSWNNYVNQRALKQAE

SEQ ID NO: 2485692 - protein, 23 aa, Entamoeba dispar
IENSAKIRVVFETFLEQFNSIFG

SEQ ID NO: 2485693 - protein, 18 aa, Entamoeba dispar
IENSNAYGECVKKLVSMY

SEQ ID NO: 2485694 - protein, 17 aa, Entamoeba dispar
IENVELELSYILNQNST

SEQ ID NO: 2485695 - protein, 24 aa, Entamoeba dispar
IENWKKDMVKTFPGQLVKNLQDAL

SEQ ID NO: 2485696 - protein, 23 aa, Entamoeba dispar
IENYTRNDLLPWREEMEEVQTIR

SEQ ID NO: 2485697 - protein, 24 aa, Entamoeba dispar
IENYTRTDLLPWREDMEEIQTIRK

SEQ ID NO: 2485698 - protein, 28 aa, Entamoeba dispar
IEPEIISVDIPIHHYFTGYQEEIEINGQ

SEQ ID NO: 2485699 - protein, 24 aa, Entamoeba dispar
IEPELYRKRLLLFINSVFMIMPDD

SEQ ID NO: 2485700 - protein, 21 aa, Entamoeba dispar
IEPNSKWVIFTMIELYQITKK

SEQ ID NO: 2485701 - protein, 23 aa, Entamoeba dispar
IEPNTNCYFLLTTVETPIIENNE

SEQ ID NO: 2485702 - protein, 20 aa, Entamoeba dispar
IEPPPWRPTRRMEINNNRPI

SEQ ID NO: 2485703 - protein, 24 aa, Entamoeba dispar
IEPQKRPTFKEIYKILEKVMEKIP

SEQ ID NO: 2485704 - protein, 19 aa, Entamoeba dispar
IEPRIKDALTLSELELIDE

SEQ ID NO: 2485705 - protein, 18 aa, Entamoeba dispar
IEPRNIIRPDEWDMNENP

SEQ ID NO: 2485706 - protein, 18 aa, Entamoeba dispar
IEPSELILNQCKEILERS

SEQ ID NO: 2485707 - protein, 25 aa, Entamoeba dispar
IEPVQRFPRYILLLESLIKATPTFT

SEQ ID NO: 2485708 - protein, 25 aa, Entamoeba dispar
IEQIVKWYCIEWIIRDNLIQQLNHS

SEQ ID NO: 2485709 - protein, 20 aa, Entamoeba dispar
IEQLSGKAPHHYLSRGVFLA

SEQ ID NO: 2485710 - protein, 20 aa, Entamoeba dispar
IERCVKNVIKSADWAIEDID

SEQ ID NO: 2485711 - protein, 25 aa, Entamoeba dispar
IERGWIWNSYIKRWYEMNEKYLMIF

SEQ ID NO: 2485712 - protein, 20 aa, Entamoeba dispar
IERIKELILIATEDPSIEKR

SEQ ID NO: 2485713 - protein, 26 aa, Entamoeba dispar
IERIYKVAICLSEKVEIEQEKIGMYL

SEQ ID NO: 2485714 - protein, 20 aa, Entamoeba dispar
IERKQGDLGFRISNDNDSVF

SEQ ID NO: 2485715 - protein, 18 aa, Entamoeba dispar
IERLFKYLDKFIEVSIEG

SEQ ID NO: 2485716 - protein, 21 aa, Entamoeba dispar
IERLKVGVVSLIDIDQLMVHT

SEQ ID NO: 2485717 - protein, 23 aa, Entamoeba dispar
IERLRKEIELQKLLNETKKMDMR

SEQ ID NO: 2485718 - protein, 23 aa, Entamoeba dispar
IERNCSYKYGYKAINKFLQDNQC

SEQ ID NO: 2485719 - protein, 18 aa, Entamoeba dispar
IERPPLKYLFQTNAFTTI

SEQ ID NO: 2485720 - protein, 20 aa, Entamoeba dispar
IERRIKEIVTFEVSTNVPLK

SEQ ID NO: 2485721 - protein, 18 aa, Entamoeba dispar
IERWIRKGLERESIEKTV

SEQ ID NO: 2485722 - protein, 39 aa, Entamoeba dispar
IERYAVRKINCGEFINFLHLHYKGVILGYIRELFNDQQA

SEQ ID NO: 2485723 - protein, 21 aa, Entamoeba dispar
IESALPIIASFVYDSDSNIVE

SEQ ID NO: 2485724 - protein, 25 aa, Entamoeba dispar
IESEQKLGILVYQFDCFVTEKGVFD

SEQ ID NO: 2485725 - protein, 18 aa, Entamoeba dispar
IESFSKWLNTLIEHQRFC

SEQ ID NO: 2485726 - protein, 27 aa, Entamoeba dispar
IESIVKRLLKCWTLYNFDGGYQQGMSD

SEQ ID NO: 2485727 - protein, 23 aa, Entamoeba dispar
IESIWKEGINCFDIDLIGNIPGD

SEQ ID NO: 2485728 - protein, 21 aa, Entamoeba dispar
IESIYKRYLMIIGTMKEKEIE

SEQ ID NO: 2485729 - protein, 32 aa, Entamoeba dispar
IESKNGFNLDLCEFIFWGMVRYCTDEELLEFM

SEQ ID NO: 2485730 - protein, 21 aa, Entamoeba dispar
IESKNGVKVIFADETVVNYLI

SEQ ID NO: 2485731 - protein, 22 aa, Entamoeba dispar
IESLIKEKNRAIVTLATSAALR

SEQ ID NO: 2485732 - protein, 20 aa, Entamoeba dispar
IESLKEGFNIFYVTITSDEK

SEQ ID NO: 2485733 - protein, 30 aa, Entamoeba dispar
IESLKNIPKSFVFKDQEGFEIPTDEEQSYK

SEQ ID NO: 2485734 - protein, 20 aa, Entamoeba dispar
IESLLKIIPYLSHYREVFTF

SEQ ID NO: 2485735 - protein, 18 aa, Entamoeba dispar
IESLLRNGAYGAFKDDEE

SEQ ID NO: 2485736 - protein, 19 aa, Entamoeba dispar
IESLSFYVCECEKNGTSSL

SEQ ID NO: 2485737 - protein, 18 aa, Entamoeba dispar
IESNFRMQLRIFISTLCK

SEQ ID NO: 2485738 - protein, 27 aa, Entamoeba dispar
IESNYWPKYVEYYLFCCEKHLSGTRIV

SEQ ID NO: 2485739 - protein, 23 aa, Entamoeba dispar
IESPCGCSDTILFKEIDDQIKSI

SEQ ID NO: 2485740 - protein, 17 aa, Entamoeba dispar
IESRAFMGCSHLKSISL

SEQ ID NO: 2485741 - protein, 26 aa, Entamoeba dispar
IESSPLLKEMSKLCVNTIDGFQGREM

SEQ ID NO: 2485742 - protein, 17 aa, Entamoeba dispar
IESVSYLLLHGLMCPLL

SEQ ID NO: 2485743 - protein, 20 aa, Entamoeba dispar
IESYILLLVVIACLDNQKYP

SEQ ID NO: 2485744 - protein, 20 aa, Entamoeba dispar
IETFFLIGLLAQHASIKFSI

SEQ ID NO: 2485745 - protein, 24 aa, Entamoeba dispar
IETFVLKFPLIVKGISLEERETII

SEQ ID NO: 2485746 - protein, 23 aa, Entamoeba dispar
IETGCFKNCLSLRSINIPSSVSQ

SEQ ID NO: 2485747 - protein, 17 aa, Entamoeba dispar
IETGCLLDYLYKHQLTN

SEQ ID NO: 2485748 - protein, 19 aa, Entamoeba dispar
IETIINWLYENPFTSIKKV

SEQ ID NO: 2485749 - protein, 19 aa, Entamoeba dispar
IETKNKFKLPFSIEEEEIQ

SEQ ID NO: 2485750 - protein, 17 aa, Entamoeba dispar
IETLIKWIINSKDIMLR

SEQ ID NO: 2485751 - protein, 25 aa, Entamoeba dispar
IETLKHLMLKSAVKIRIEEEEQVSV

SEQ ID NO: 2485752 - protein, 25 aa, Entamoeba dispar
IETLYEEKKRLEAENEQLKKEQEQL

SEQ ID NO: 2485753 - protein, 17 aa, Entamoeba dispar
IETMLGDVCVCIHSKDE

SEQ ID NO: 2485754 - protein, 19 aa, Entamoeba dispar
IETQGIFMEGFKFKSIDEK

SEQ ID NO: 2485755 - protein, 22 aa, Entamoeba dispar
IETRITVLMSSRIYMKYSSQIT

SEQ ID NO: 2485756 - protein, 18 aa, Entamoeba dispar
IETSLCDRILRLINAEEK

SEQ ID NO: 2485757 - protein, 18 aa, Entamoeba dispar
IETWKYIYNILKTNDNII

SEQ ID NO: 2485758 - protein, 33 aa, Entamoeba dispar
IETYARSDLFPWREEMEEIQLIRKWLKCASGNK

SEQ ID NO: 2485759 - protein, 18 aa, Entamoeba dispar
IETYRVFYRQVISGATKG

SEQ ID NO: 2485760 - protein, 18 aa, Entamoeba dispar
IETYRVFYRQVISGTTKG

SEQ ID NO: 2485761 - protein, 17 aa, Entamoeba dispar
IEVARQIQTSFVYEPPP

SEQ ID NO: 2485762 - protein, 19 aa, Entamoeba dispar
IEVDKCFSVAFQITNAFMN

SEQ ID NO: 2485763 - protein, 32 aa, Entamoeba dispar
IEVFGSKRPVSWILICRIIIYSLMEIHKGVLY

SEQ ID NO: 2485764 - protein, 21 aa, Entamoeba dispar
IEVFTLLMLYKVMYPTRISLM

SEQ ID NO: 2485765 - protein, 19 aa, Entamoeba dispar
IEVGQYIKCVGKIKKFSQE

SEQ ID NO: 2485766 - protein, 18 aa, Entamoeba dispar
IEVICIGIGDGPFETFRN

SEQ ID NO: 2485767 - protein, 24 aa, Entamoeba dispar
IEVILDCIQSIIITMGENSLEPQM

SEQ ID NO: 2485768 - protein, 17 aa, Entamoeba dispar
IEVITIPGFNSEQNNIT

SEQ ID NO: 2485769 - protein, 17 aa, Entamoeba dispar
IEVKCPPTFRLFASQNP

SEQ ID NO: 2485770 - protein, 17 aa, Entamoeba dispar
IEVKEIRTWIKKALERK

SEQ ID NO: 2485771 - protein, 26 aa, Entamoeba dispar
IEVKKKKIIICWKLTKEVKERNEYNY

SEQ ID NO: 2485772 - protein, 21 aa, Entamoeba dispar
IEVKKRLGYKSIQEIKSHPWF

SEQ ID NO: 2485773 - protein, 18 aa, Entamoeba dispar
IEVKLIRVGDVFFSECQS

SEQ ID NO: 2485774 - protein, 25 aa, Entamoeba dispar
IEVKMKCFYCVVNSFIRYKNNEFLQ

SEQ ID NO: 2485775 - protein, 20 aa, Entamoeba dispar
IEVLCLVYALKARYPQQFFI

SEQ ID NO: 2485776 - protein, 18 aa, Entamoeba dispar
IEVLYKMLICSPPESLHF

SEQ ID NO: 2485777 - protein, 23 aa, Entamoeba dispar
IEVNKEIRELICIGNENKEKKKI

SEQ ID NO: 2485778 - protein, 17 aa, Entamoeba dispar
IEVNLPLHLIRFGTESQ

SEQ ID NO: 2485779 - protein, 18 aa, Entamoeba dispar
IEVQKGSFLFLFNPEVRG

SEQ ID NO: 2485780 - protein, 27 aa, Entamoeba dispar
IEVSNCFSCILAAVTINMIIRISSERT

SEQ ID NO: 2485781 - protein, 24 aa, Entamoeba dispar
IEVTHERKCFTRLDVVKNAICQQV

SEQ ID NO: 2485782 - protein, 25 aa, Entamoeba dispar
IEVVDCKSPTSPIISPRQKFTPRAS

SEQ ID NO: 2485783 - protein, 21 aa, Entamoeba dispar
IEWKLLVKKAEKWLETKQPLP

SEQ ID NO: 2485784 - protein, 17 aa, Entamoeba dispar
IEYAQSFFIPLSTPNED

SEQ ID NO: 2485785 - protein, 18 aa, Entamoeba dispar
IEYARGDTHYLLYIIDQL

SEQ ID NO: 2485786 - protein, 17 aa, Entamoeba dispar
IEYCKEHKIGVVNVAGY

SEQ ID NO: 2485787 - protein, 19 aa, Entamoeba dispar
IEYEKGCFEGCEKLREVIE

SEQ ID NO: 2485788 - protein, 22 aa, Entamoeba dispar
IEYITHTSFCYIFIHALTEEKS

SEQ ID NO: 2485789 - protein, 23 aa, Entamoeba dispar
IEYLRLTSLGVIGAMSKTRDPQI

SEQ ID NO: 2485790 - protein, 17 aa, Entamoeba dispar
IEYQKICSLKTQIENEA

SEQ ID NO: 2485791 - protein, 25 aa, Entamoeba dispar
IEYQMKILQRIQCIIRICQHSIEQI

SEQ ID NO: 2485792 - protein, 20 aa, Entamoeba dispar
IEYRCFYGCISLKTITIPTA

SEQ ID NO: 2485793 - protein, 19 aa, Entamoeba dispar
IEYSQLFFKEKKYNNMVEL

SEQ ID NO: 2485794 - protein, 25 aa, Entamoeba dispar
IEYVEILIMRALSLGLVKGYISQTT

SEQ ID NO: 2485795 - protein, 19 aa, Entamoeba dispar
IFAKYAIKIGEQYYEKLKD

SEQ ID NO: 2485796 - protein, 25 aa, Entamoeba dispar
IFCYSLTIFEIFIERSLIYTEEVSK

SEQ ID NO: 2485797 - protein, 23 aa, Entamoeba dispar
IFDENKNAFGWYFPQGINENGTG

SEQ ID NO: 2485798 - protein, 28 aa, Entamoeba dispar
IFDFESLKWKKVILDIQFERAYHTATYY

SEQ ID NO: 2485799 - protein, 19 aa, Entamoeba dispar
IFDGLSVILNPDIQRTQTA

SEQ ID NO: 2485800 - protein, 27 aa, Entamoeba dispar
IFDGYWNCIGKLFNERKLEYGIISIGR

SEQ ID NO: 2485801 - protein, 19 aa, Entamoeba dispar
IFDHCSRLTKLNASYNQLT

SEQ ID NO: 2485802 - protein, 24 aa, Entamoeba dispar
IFDIWRLLIDILRGIDQLLLPNVF

SEQ ID NO: 2485803 - protein, 25 aa, Entamoeba dispar
IFDLHPPSVPAWELSEQRLPQPPSF

SEQ ID NO: 2485804 - protein, 27 aa, Entamoeba dispar
IFDPGKGAKCIYVWLGKSSNKMEKGKA

SEQ ID NO: 2485805 - protein, 21 aa, Entamoeba dispar
IFDSRGCFVVFAMEGNVYIWV

SEQ ID NO: 2485806 - protein, 25 aa, Entamoeba dispar
IFDTLYDGWGRKSFNKHVMGKKGVM

SEQ ID NO: 2485807 - protein, 18 aa, Entamoeba dispar
IFECTQFDTIVSIVSFCP

SEQ ID NO: 2485808 - protein, 19 aa, Entamoeba dispar
IFEIQRFIEFSALKNSLNE

SEQ ID NO: 2485809 - protein, 23 aa, Entamoeba dispar
IFEKAKVMAIGFLCQMDPSHADL

SEQ ID NO: 2485810 - protein, 19 aa, Entamoeba dispar
IFEKAMVFNFKKDVPLPYF

SEQ ID NO: 2485811 - protein, 18 aa, Entamoeba dispar
IFEKCIKCIERMFQDIEL

SEQ ID NO: 2485812 - protein, 19 aa, Entamoeba dispar
IFEKLPPIIKDFIENLTKL

SEQ ID NO: 2485813 - protein, 24 aa, Entamoeba dispar
IFEKSNQVFKTWIDSTKVFYFINV

SEQ ID NO: 2485814 - protein, 19 aa, Entamoeba dispar
IFEKVAITVLNKVPISSYK

SEQ ID NO: 2485815 - protein, 18 aa, Entamoeba dispar
IFELEKKGISKDATTVVL

SEQ ID NO: 2485816 - protein, 19 aa, Entamoeba dispar
IFELFPFPHSYEIEQIVNE

SEQ ID NO: 2485817 - protein, 25 aa, Entamoeba dispar
IFEMYCLKSNMLELLRIIKDPQQIS

SEQ ID NO: 2485818 - protein, 21 aa, Entamoeba dispar
IFETKLPYWAQPNVDISQEID

SEQ ID NO: 2485819 - protein, 17 aa, Entamoeba dispar
IFEVKRLMGKRVDSEGL

SEQ ID NO: 2485820 - protein, 19 aa, Entamoeba dispar
IFFDEIDAIASKRKGGSVF

SEQ ID NO: 2485821 - protein, 36 aa, Entamoeba dispar
IFFIPLNRRINIVLKELWKREFGVFQSRNTLPPNAL

SEQ ID NO: 2485822 - protein, 18 aa, Entamoeba dispar
IFFLKSSFNSSLIQRLQF

SEQ ID NO: 2485823 - protein, 17 aa, Entamoeba dispar
IFFPNIIDLKHVTNQIS

SEQ ID NO: 2485824 - protein, 18 aa, Entamoeba dispar
IFFQCTFAKKIFVKAKSI

SEQ ID NO: 2485825 - protein, 17 aa, Entamoeba dispar
IFFQFLEAVHHLMKNNS

SEQ ID NO: 2485826 - protein, 17 aa, Entamoeba dispar
IFGKIKVISMYNTDGTK

SEQ ID NO: 2485827 - protein, 18 aa, Entamoeba dispar
IFGNFSFNGFGTTEKKQD

SEQ ID NO: 2485828 - protein, 21 aa, Entamoeba dispar
IFGRGGAVVHITCDCREVIIQ

SEQ ID NO: 2485829 - protein, 24 aa, Entamoeba dispar
IFGTEIKSSVIAREEENTLIPSVI

SEQ ID NO: 2485830 - protein, 26 aa, Entamoeba dispar
IFGVDLEPILPIPRCTTYVGDITTGM

SEQ ID NO: 2485831 - protein, 23 aa, Entamoeba dispar
IFHIDFGYVFGKLVPGKSDEPEI

SEQ ID NO: 2485832 - protein, 23 aa, Entamoeba dispar
IFHIIQPRFLVLIKDNDGKIPLV

SEQ ID NO: 2485833 - protein, 18 aa, Entamoeba dispar
IFHPNVLLIMGIIAEKGI

SEQ ID NO: 2485834 - protein, 17 aa, Entamoeba dispar
IFIDEIDTVVGIRSGGT

SEQ ID NO: 2485835 - protein, 17 aa, Entamoeba dispar
IFIESLIALCIKIINNP

SEQ ID NO: 2485836 - protein, 17 aa, Entamoeba dispar
IFIGGCSFYILGVEFKT

SEQ ID NO: 2485837 - protein, 18 aa, Entamoeba dispar
IFIGGEWVGKHLVGPMRQ

SEQ ID NO: 2485838 - protein, 19 aa, Entamoeba dispar
IFIKEEIGIISDIILDLCK

SEQ ID NO: 2485839 - protein, 17 aa, Entamoeba dispar
IFIKNILVCLSSVHYFG

SEQ ID NO: 2485840 - protein, 24 aa, Entamoeba dispar
IFIKSKDFSVVKCIIYSEIFKTIR

SEQ ID NO: 2485841 - protein, 18 aa, Entamoeba dispar
IFIQCLLGYFPKELSLID

SEQ ID NO: 2485842 - protein, 19 aa, Entamoeba dispar
IFISCCNVYGSVLVSEEEY

SEQ ID NO: 2485843 - protein, 17 aa, Entamoeba dispar
IFISNPINDRKSKFIAF

SEQ ID NO: 2485844 - protein, 22 aa, Entamoeba dispar
IFKEYLAQCSFINCVNYLMKKT

SEQ ID NO: 2485845 - protein, 17 aa, Entamoeba dispar
IFKILLIHQDRILRNTL

SEQ ID NO: 2485846 - protein, 21 aa, Entamoeba dispar
IFKKDINEFIIPSSISELGYE

SEQ ID NO: 2485847 - protein, 22 aa, Entamoeba dispar
IFKKDINEFIIPSSISKLGDLC

SEQ ID NO: 2485848 - protein, 21 aa, Entamoeba dispar
IFKKDINEFIIPSSITKLDDW

SEQ ID NO: 2485849 - protein, 22 aa, Entamoeba dispar
IFKKDINEFIIPSSITKLGDGC

SEQ ID NO: 2485850 - protein, 22 aa, Entamoeba dispar
IFKKDINEFIIPSSITKLGEYC

SEQ ID NO: 2485851 - protein, 21 aa, Entamoeba dispar
IFKKDINEFIIPSSITKLGYR

SEQ ID NO: 2485852 - protein, 21 aa, Entamoeba dispar
IFKKDINEFIVPSSITKLGYG

SEQ ID NO: 2485853 - protein, 21 aa, Entamoeba dispar
IFKKDINKFIIPSSITKLGFC

SEQ ID NO: 2485854 - protein, 30 aa, Entamoeba dispar
IFKKVKGSCKVYKKYCNFIMRNNREEENKN

SEQ ID NO: 2485855 - protein, 22 aa, Entamoeba dispar
IFKLKGNELHGSCTSDQSIVIN

SEQ ID NO: 2485856 - protein, 26 aa, Entamoeba dispar
IFKLTNHLYIIFSMNGESYYVHLLSI

SEQ ID NO: 2485857 - protein, 25 aa, Entamoeba dispar
IFKRCKCLYIPYVGNLVLEAVQLFD

SEQ ID NO: 2485858 - protein, 24 aa, Entamoeba dispar
IFKTSFRSSFCASLSNVYEYIKDD

SEQ ID NO: 2485859 - protein, 21 aa, Entamoeba dispar
IFKYQIKGVQDVKCINDKIYI

SEQ ID NO: 2485860 - protein, 20 aa, Entamoeba dispar
IFKYVIWYQVEYWRYLFEKN

SEQ ID NO: 2485861 - protein, 17 aa, Entamoeba dispar
IFLDYYHNVFGIYLPNG

SEQ ID NO: 2485862 - protein, 24 aa, Entamoeba dispar
IFLFCLKLQYPNRVHLLRGNHECR

SEQ ID NO: 2485863 - protein, 17 aa, Entamoeba dispar
IFLHPAIYINNFSESEQ

SEQ ID NO: 2485864 - protein, 17 aa, Entamoeba dispar
IFLKECAAPELIKICIN

SEQ ID NO: 2485865 - protein, 17 aa, Entamoeba dispar
IFLKQCAAMADKISVNK

SEQ ID NO: 2485866 - protein, 23 aa, Entamoeba dispar
IFLNKCLHYKLEVHQLLFDTLTQ

SEQ ID NO: 2485867 - protein, 23 aa, Entamoeba dispar
IFLNSTACLINFSCYNELHPLLL

SEQ ID NO: 2485868 - protein, 19 aa, Entamoeba dispar
IFMAIEILSKFHSIQIQLI

SEQ ID NO: 2485869 - protein, 24 aa, Entamoeba dispar
IFMIHFPSKMKAFYMSKVPGHPDL

SEQ ID NO: 2485870 - protein, 17 aa, Entamoeba dispar
IFMKEIIGVIKTLLKQS

SEQ ID NO: 2485871 - protein, 19 aa, Entamoeba dispar
IFMQHYIYFLCHKKDYVRT

SEQ ID NO: 2485872 - protein, 17 aa, Entamoeba dispar
IFNDIFLLADGKGLFNS

SEQ ID NO: 2485873 - protein, 18 aa, Entamoeba dispar
IFNELKLSLDHLYDNVVN

SEQ ID NO: 2485874 - protein, 19 aa, Entamoeba dispar
IFNELKLSLDHLYDNVVNS

SEQ ID NO: 2485875 - protein, 25 aa, Entamoeba dispar
IFNGEKKGILSFMYQILSKYRLGNC

SEQ ID NO: 2485876 - protein, 18 aa, Entamoeba dispar
IFNRPVIQLDFKHISDPN

SEQ ID NO: 2485877 - protein, 20 aa, Entamoeba dispar
IFNYVDPFFALPIEMSKALL

SEQ ID NO: 2485878 - protein, 26 aa, Entamoeba dispar
IFPISDFWEHVCIVWTKCYNYTPEEV

SEQ ID NO: 2485879 - protein, 23 aa, Entamoeba dispar
IFPLKDIWKHVCIARRLKPIDEK

SEQ ID NO: 2485880 - protein, 23 aa, Entamoeba dispar
IFPLSKWTTSIVHFTGQLLSINE

SEQ ID NO: 2485881 - protein, 28 aa, Entamoeba dispar
IFPNRGTNLFTIFGCYQIGQFECSPMKK

SEQ ID NO: 2485882 - protein, 20 aa, Entamoeba dispar
IFPSLPRDTFVSIHEPKTLN

SEQ ID NO: 2485883 - protein, 22 aa, Entamoeba dispar
IFPSMIGRPLLRSEEKIGEVEI

SEQ ID NO: 2485884 - protein, 23 aa, Entamoeba dispar
IFPVQRIPRYILLMKEYIKNTEK

SEQ ID NO: 2485885 - protein, 21 aa, Entamoeba dispar
IFQKEIKTIPKKEIKRINNKQ

SEQ ID NO: 2485886 - protein, 24 aa, Entamoeba dispar
IFQKEIQYAVGFLCQMDPSHAELY

SEQ ID NO: 2485887 - protein, 17 aa, Entamoeba dispar
IFQMAPIVIGDETEFIG

SEQ ID NO: 2485888 - protein, 20 aa, Entamoeba dispar
IFQMPPVINIKGYIKEPSMY

SEQ ID NO: 2485889 - protein, 17 aa, Entamoeba dispar
IFQPRSYIYNGFLSFAM

SEQ ID NO: 2485890 - protein, 35 aa, Entamoeba dispar
IFRGGLEYIRPVGCMRCALHVLGMFDGGNNIWLGC

SEQ ID NO: 2485891 - protein, 23 aa, Entamoeba dispar
IFRHVPFSIEFSAPPLWLSQNSI

SEQ ID NO: 2485892 - protein, 18 aa, Entamoeba dispar
IFRKCATMRKHWRQIQYT

SEQ ID NO: 2485893 - protein, 28 aa, Entamoeba dispar
IFRKDHRGLCVMTGYTIGDGMRLSIVTH

SEQ ID NO: 2485894 - protein, 21 aa, Entamoeba dispar
IFRSKIWKVFFGFLPENTALW

SEQ ID NO: 2485895 - protein, 17 aa, Entamoeba dispar
IFSGLKRGIKYLLLKYG

SEQ ID NO: 2485896 - protein, 17 aa, Entamoeba dispar
IFSGVKCLSEEDHLIPF

SEQ ID NO: 2485897 - protein, 25 aa, Entamoeba dispar
IFSLFGRGRFDPAFVDDRCKKLDAW

SEQ ID NO: 2485898 - protein, 19 aa, Entamoeba dispar
IFSLFPFFHYHMYFKDNCL

SEQ ID NO: 2485899 - protein, 21 aa, Entamoeba dispar
IFSLIIPEIDEPWYLKFNNSA

SEQ ID NO: 2485900 - protein, 24 aa, Entamoeba dispar
IFTDLRSGLALIRLMEKLTGKTLD

SEQ ID NO: 2485901 - protein, 20 aa, Entamoeba dispar
IFTILKILIKYHSFIPSSDV

SEQ ID NO: 2485902 - protein, 25 aa, Entamoeba dispar
IFTIWCVLMGLKIMNMHDLVHLDVK

SEQ ID NO: 2485903 - protein, 25 aa, Entamoeba dispar
IFTSESMKGWTLKQLINYTSDFGQQ

SEQ ID NO: 2485904 - protein, 27 aa, Entamoeba dispar
IFTSLIDWAFSPSCIFPKALTPELTVN

SEQ ID NO: 2485905 - protein, 24 aa, Entamoeba dispar
IFTVKEMTRIIGIQANQRKEIYPL

SEQ ID NO: 2485906 - protein, 18 aa, Entamoeba dispar
IFVGINYLLPSNKLSPVF

SEQ ID NO: 2485907 - protein, 30 aa, Entamoeba dispar
IFWEIARMYDFYLLRLLIRHSSATVIEFWD

SEQ ID NO: 2485908 - protein, 17 aa, Entamoeba dispar
IFYREFNVIPINWNSDT

SEQ ID NO: 2485909 - protein, 18 aa, Entamoeba dispar
IFYTGGFVAHNPVVWEAI

SEQ ID NO: 2485910 - protein, 18 aa, Entamoeba dispar
IGACEAGVEKYMYFFKNA

SEQ ID NO: 2485911 - protein, 23 aa, Entamoeba dispar
IGARAMGCVAAFAKSEHGREILI

SEQ ID NO: 2485912 - protein, 27 aa, Entamoeba dispar
IGCALCVKKCPFEAIKIINLPKNLEQC

SEQ ID NO: 2485913 - protein, 18 aa, Entamoeba dispar
IGCDGLWNVISYDFCADI

SEQ ID NO: 2485914 - protein, 19 aa, Entamoeba dispar
IGCEVCLTSNMVSRSIKGY

SEQ ID NO: 2485915 - protein, 23 aa, Entamoeba dispar
IGCEVLKTWAMMGLSSGKGLIHI

SEQ ID NO: 2485916 - protein, 24 aa, Entamoeba dispar
IGCEVLKTWAMMGLSSGKGLIHIT

SEQ ID NO: 2485917 - protein, 19 aa, Entamoeba dispar
IGCFYGCGCEKELKKNKTI

SEQ ID NO: 2485918 - protein, 18 aa, Entamoeba dispar
IGCGVGNSMVPLLRVNPS

SEQ ID NO: 2485919 - protein, 34 aa, Entamoeba dispar
IGCPRGGYINEERCLFCIDLLLKYYEILTKSRTL

SEQ ID NO: 2485920 - protein, 20 aa, Entamoeba dispar
IGCQCFDWCIALTRIDIPSR

SEQ ID NO: 2485921 - protein, 18 aa, Entamoeba dispar
IGCSLSAPLYQRKFNKKE

SEQ ID NO: 2485922 - protein, 22 aa, Entamoeba dispar
IGCTQPRRVAAISVSQRVAEEM

SEQ ID NO: 2485923 - protein, 21 aa, Entamoeba dispar
IGCVIPSIQTSLFLQPEYPWK

SEQ ID NO: 2485924 - protein, 20 aa, Entamoeba dispar
IGDACFCRCYSLTSVTIPSS

SEQ ID NO: 2485925 - protein, 22 aa, Entamoeba dispar
IGDCCFYRCSLLKSINISSSII

SEQ ID NO: 2485926 - protein, 29 aa, Entamoeba dispar
IGDCFKRRVNDVIIPPIYHDIFFNKRQSV

SEQ ID NO: 2485927 - protein, 20 aa, Entamoeba dispar
IGDDCFKKCLSLTSINIPSS

SEQ ID NO: 2485928 - protein, 22 aa, Entamoeba dispar
IGDDCFYGCLSLKSINIPNSVT

SEQ ID NO: 2485929 - protein, 22 aa, Entamoeba dispar
IGDDCFYGCLSLKSINIPSTIS

SEQ ID NO: 2485930 - protein, 18 aa, Entamoeba dispar
IGDDCFYGCYLLKSINIP

SEQ ID NO: 2485931 - protein, 26 aa, Entamoeba dispar
IGDDGRPIPFWLYKLHGLGTEFKCEI

SEQ ID NO: 2485932 - protein, 28 aa, Entamoeba dispar
IGDECFRYCKNLEKVDCYRNYSFGGRKF

SEQ ID NO: 2485933 - protein, 22 aa, Entamoeba dispar
IGDECFYGCLSLTSINIPSKIS

SEQ ID NO: 2485934 - protein, 21 aa, Entamoeba dispar
IGDGCFKECFNLTKVEINKSV

SEQ ID NO: 2485935 - protein, 19 aa, Entamoeba dispar
IGDGCFLNCVSLISINLQT

SEQ ID NO: 2485936 - protein, 22 aa, Entamoeba dispar
IGDGKSSLGNFILENNSFVVGY

SEQ ID NO: 2485937 - protein, 18 aa, Entamoeba dispar
IGDLMYKRQSELPPQSQI

SEQ ID NO: 2485938 - protein, 17 aa, Entamoeba dispar
IGDNCIINFNCTVLEGG

SEQ ID NO: 2485939 - protein, 25 aa, Entamoeba dispar
IGDNGYRLMVEIAKQLSCESLGMIQ

SEQ ID NO: 2485940 - protein, 17 aa, Entamoeba dispar
IGDRIYKIISELMNSSS

SEQ ID NO: 2485941 - protein, 26 aa, Entamoeba dispar
IGDSLCCGYGMFPLPQCDNVPLQSDS

SEQ ID NO: 2485942 - protein, 20 aa, Entamoeba dispar
IGDTSFLFQMHRRASDVHNV

SEQ ID NO: 2485943 - protein, 23 aa, Entamoeba dispar
IGDVCFEGCELLSSINIPNSVNE

SEQ ID NO: 2485944 - protein, 18 aa, Entamoeba dispar
IGDYCFSCCISLTRITIP

SEQ ID NO: 2485945 - protein, 17 aa, Entamoeba dispar
IGDYCFYGCSSLKSINI

SEQ ID NO: 2485946 - protein, 20 aa, Entamoeba dispar
IGDYCFYKCTSLKSINIPMS

SEQ ID NO: 2485947 - protein, 17 aa, Entamoeba dispar
IGEALTFEKEKTAEEKA

SEQ ID NO: 2485948 - protein, 18 aa, Entamoeba dispar
IGEAMKMKYGRHEEENNY

SEQ ID NO: 2485949 - protein, 17 aa, Entamoeba dispar
IGECDHSFICCFCSFKR

SEQ ID NO: 2485950 - protein, 19 aa, Entamoeba dispar
IGECFNGIICRRLNENDSI

SEQ ID NO: 2485951 - protein, 23 aa, Entamoeba dispar
IGECKYNLPPKEDYSPFVGDNYH

SEQ ID NO: 2485952 - protein, 17 aa, Entamoeba dispar
IGECLANLYLIRFDEEH

SEQ ID NO: 2485953 - protein, 17 aa, Entamoeba dispar
IGEEVIYKIFNKKDFDY

SEQ ID NO: 2485954 - protein, 24 aa, Entamoeba dispar
IGEEVPDLVAPIIGNICSQLLSSV

SEQ ID NO: 2485955 - protein, 20 aa, Entamoeba dispar
IGEGTFRIVYIGEFRGNQVS

SEQ ID NO: 2485956 - protein, 26 aa, Entamoeba dispar
IGEGTSGIVFKGRFREHTVAIKDMKD

SEQ ID NO: 2485957 - protein, 20 aa, Entamoeba dispar
IGEKEWICSIQFISTISKSK

SEQ ID NO: 2485958 - protein, 26 aa, Entamoeba dispar
IGELKKAKFPGGIKVDDKTIKRLMRI

SEQ ID NO: 2485959 - protein, 19 aa, Entamoeba dispar
IGELRRYGPDKGNVPKFLC

SEQ ID NO: 2485960 - protein, 23 aa, Entamoeba dispar
IGELSMIGLDFAKRGVKRVSIMQ

SEQ ID NO: 2485961 - protein, 23 aa, Entamoeba dispar
IGEMVGDIFGKIGRDGAVDIETG

SEQ ID NO: 2485962 - protein, 20 aa, Entamoeba dispar
IGESCFWKCYSLKSINIPSS

SEQ ID NO: 2485963 - protein, 19 aa, Entamoeba dispar
IGEWCRIYQSVTLGAMHFQ

SEQ ID NO: 2485964 - protein, 24 aa, Entamoeba dispar
IGEYCFRDCVLLKLISILSSISKI

SEQ ID NO: 2485965 - protein, 24 aa, Entamoeba dispar
IGEYPYGYCIIIGCCTDKNDVFGS

SEQ ID NO: 2485966 - protein, 22 aa, Entamoeba dispar
IGFIKDVFREMVLLPSQIEVTT

SEQ ID NO: 2485967 - protein, 19 aa, Entamoeba dispar
IGFNKTGSFCDFNGIPAID

SEQ ID NO: 2485968 - protein, 18 aa, Entamoeba dispar
IGFSKCLPYLCRKEEYIN

SEQ ID NO: 2485969 - protein, 19 aa, Entamoeba dispar
IGFVGGIDLCIGRYDTHDH

SEQ ID NO: 2485970 - protein, 24 aa, Entamoeba dispar
IGGCKSTYGTGCFVVKNIGNSIKE

SEQ ID NO: 2485971 - protein, 21 aa, Entamoeba dispar
IGGELSLDAGALVLADGGVCC

SEQ ID NO: 2485972 - protein, 24 aa, Entamoeba dispar
IGGKYEIGNGFTIAGAHLDSPSLK

SEQ ID NO: 2485973 - protein, 24 aa, Entamoeba dispar
IGGLGSGCGHGIFEYLKVMIIDEV

SEQ ID NO: 2485974 - protein, 21 aa, Entamoeba dispar
IGGNEIMKALNIPTLKEASAY

SEQ ID NO: 2485975 - protein, 19 aa, Entamoeba dispar
IGGNGIQIGEFIPNNMPIG

SEQ ID NO: 2485976 - protein, 17 aa, Entamoeba dispar
IGGQASQLADVFSLGIT

SEQ ID NO: 2485977 - protein, 17 aa, Entamoeba dispar
IGGSYIKQSDRIAIEQL

SEQ ID NO: 2485978 - protein, 18 aa, Entamoeba dispar
IGGTSLWKASAALKNTSY

SEQ ID NO: 2485979 - protein, 21 aa, Entamoeba dispar
IGGYFIINGIERYLRMIVYAK

SEQ ID NO: 2485980 - protein, 22 aa, Entamoeba dispar
IGHDCFYCCKSLTSITIPTSVS

SEQ ID NO: 2485981 - protein, 18 aa, Entamoeba dispar
IGHIKWTIEQEGKKVYCG

SEQ ID NO: 2485982 - protein, 30 aa, Entamoeba dispar
IGHSLGGVYFRLAIPILFNRNIFNNPNYIP

SEQ ID NO: 2485983 - protein, 19 aa, Entamoeba dispar
IGHWKSILNAYKFDGRSCV

SEQ ID NO: 2485984 - protein, 19 aa, Entamoeba dispar
IGIDICNNFQKVSLKCRIK

SEQ ID NO: 2485985 - protein, 19 aa, Entamoeba dispar
IGIECFKECYSLTSINIPS

SEQ ID NO: 2485986 - protein, 18 aa, Entamoeba dispar
IGIGHDFFIDSHQYQPPK

SEQ ID NO: 2485987 - protein, 17 aa, Entamoeba dispar
IGIGTPFNSMILNDSLQ

SEQ ID NO: 2485988 - protein, 21 aa, Entamoeba dispar
IGIIKRLFDLYGTDNLIDTCT

SEQ ID NO: 2485989 - protein, 26 aa, Entamoeba dispar
IGIIPMNEIMYGRERIDSIRIRKVNN

SEQ ID NO: 2485990 - protein, 17 aa, Entamoeba dispar
IGIKTWELRVMKIQDTS

SEQ ID NO: 2485991 - protein, 20 aa, Entamoeba dispar
IGINGLRTFTSLTRLDVDGV

SEQ ID NO: 2485992 - protein, 22 aa, Entamoeba dispar
IGIRRWLLVDSLLRAKSRIQEE

SEQ ID NO: 2485993 - protein, 23 aa, Entamoeba dispar
IGIRRWLLVDSLLRAKSRIQEEI

SEQ ID NO: 2485994 - protein, 23 aa, Entamoeba dispar
IGIRRWLLVDSLLRAKSRIQEEV

SEQ ID NO: 2485995 - protein, 20 aa, Entamoeba dispar
IGISLAMRARTRVHLPIQST

SEQ ID NO: 2485996 - protein, 23 aa, Entamoeba dispar
IGIYAYELFNFYGVKRIIRIGSA

SEQ ID NO: 2485997 - protein, 21 aa, Entamoeba dispar
IGIYCFSRCLLILINIPSSIS

SEQ ID NO: 2485998 - protein, 23 aa, Entamoeba dispar
IGKEEYKGIIDIIRKYLKKTNEF

SEQ ID NO: 2485999 - protein, 17 aa, Entamoeba dispar
IGKEWTSLLTHNKLTQP

SEQ ID NO: 2486000 - protein, 23 aa, Entamoeba dispar
IGKGAFGKVFLCNKINTKEEVAI

SEQ ID NO: 2486001 - protein, 20 aa, Entamoeba dispar
IGKGLGAKVYYYSTTGKHED

SEQ ID NO: 2486002 - protein, 22 aa, Entamoeba dispar
IGKKCFYKCSSITRIDIAEIHY

SEQ ID NO: 2486003 - protein, 25 aa, Entamoeba dispar
IGKKGKELCKGYVDLAHYADLNGVG

SEQ ID NO: 2486004 - protein, 31 aa, Entamoeba dispar
IGKKYGLIFMTRIRRVLGFSNTKESVFGWND

SEQ ID NO: 2486005 - protein, 25 aa, Entamoeba dispar
IGKLAVLGCSVSLKVESFAQADAFM

SEQ ID NO: 2486006 - protein, 17 aa, Entamoeba dispar
IGKLDFLIENVKNMIYR

SEQ ID NO: 2486007 - protein, 19 aa, Entamoeba dispar
IGKNILKEDSFPFSLKCNG

SEQ ID NO: 2486008 - protein, 17 aa, Entamoeba dispar
IGKRRIGYNEIMIVSMY

SEQ ID NO: 2486009 - protein, 22 aa, Entamoeba dispar
IGKRVLSAFGDNVFNTRINVMI

SEQ ID NO: 2486010 - protein, 23 aa, Entamoeba dispar
IGKYCFKYCRSLISINIPTTISK

SEQ ID NO: 2486011 - protein, 30 aa, Entamoeba dispar
IGKYIIVLCFDMLFCFDQEIKYVFSTPVNH

SEQ ID NO: 2486012 - protein, 17 aa, Entamoeba dispar
IGLCGSSSPSTRKNATS

SEQ ID NO: 2486013 - protein, 23 aa, Entamoeba dispar
IGLDECMNRLNLKNNILMTKTEC

SEQ ID NO: 2486014 - protein, 19 aa, Entamoeba dispar
IGLEPVLPSEFHMMRATLC

SEQ ID NO: 2486015 - protein, 18 aa, Entamoeba dispar
IGLFKKLLYDAVQDGLSI

SEQ ID NO: 2486016 - protein, 17 aa, Entamoeba dispar
IGLHYQRMFFIKYTGIE

SEQ ID NO: 2486017 - protein, 24 aa, Entamoeba dispar
IGLLDCTKNWFGNYQVLYTHQTPI

SEQ ID NO: 2486018 - protein, 23 aa, Entamoeba dispar
IGLLNYRGVGLIIARRSKKAEKA

SEQ ID NO: 2486019 - protein, 23 aa, Entamoeba dispar
IGLNSFNAWNRKFAKKKGLKSVD

SEQ ID NO: 2486020 - protein, 22 aa, Entamoeba dispar
IGLTRFEGFLNVLKQGYLSFII

SEQ ID NO: 2486021 - protein, 18 aa, Entamoeba dispar
IGMMGWKYIAQIEQIKRL

SEQ ID NO: 2486022 - protein, 21 aa, Entamoeba dispar
IGMNSFNAWNRKFAKKTNKKM

SEQ ID NO: 2486023 - protein, 22 aa, Entamoeba dispar
IGNARLTTHLNHSQFTKLNQEV

SEQ ID NO: 2486024 - protein, 18 aa, Entamoeba dispar
IGNCCFGECKSLTLINIP

SEQ ID NO: 2486025 - protein, 22 aa, Entamoeba dispar
IGNCCFYECYSLISINIPSSIT

SEQ ID NO: 2486026 - protein, 26 aa, Entamoeba dispar
IGNCEGCFPVMLLVESCRKQKLSISG

SEQ ID NO: 2486027 - protein, 22 aa, Entamoeba dispar
IGNECFYGCLSLKSINIPSTIS

SEQ ID NO: 2486028 - protein, 17 aa, Entamoeba dispar
IGNELGMSFDFAENEIG

SEQ ID NO: 2486029 - protein, 24 aa, Entamoeba dispar
IGNFKIGLMHGHQVIPWGDREALA

SEQ ID NO: 2486030 - protein, 17 aa, Entamoeba dispar
IGNGCFEGSQIKEITIP

SEQ ID NO: 2486031 - protein, 20 aa, Entamoeba dispar
IGNGCFEVCASLTSINIPTT

SEQ ID NO: 2486032 - protein, 23 aa, Entamoeba dispar
IGNGCFKNCFKLKKINIPTSIKE

SEQ ID NO: 2486033 - protein, 20 aa, Entamoeba dispar
IGNGCFYGCISLTSINIPTS

SEQ ID NO: 2486034 - protein, 20 aa, Entamoeba dispar
IGNHVIQIFIEKSEEIKEVI

SEQ ID NO: 2486035 - protein, 19 aa, Entamoeba dispar
IGNIMADCRLNINVDKYIE

SEQ ID NO: 2486036 - protein, 19 aa, Entamoeba dispar
IGNKISGWVRIRSKTQSLA

SEQ ID NO: 2486037 - protein, 20 aa, Entamoeba dispar
IGNKISGWVRIRSKTQSLAI

SEQ ID NO: 2486038 - protein, 17 aa, Entamoeba dispar
IGNLVLKTRNTEPHYPI

SEQ ID NO: 2486039 - protein, 26 aa, Entamoeba dispar
IGNNFKCIIEKAISLTVYLIYIPEKN

SEQ ID NO: 2486040 - protein, 25 aa, Entamoeba dispar
IGNRCFRGCSSIIFINIPTHVSKLG

SEQ ID NO: 2486041 - protein, 17 aa, Entamoeba dispar
IGNRVSLGFQFSPNTTS

SEQ ID NO: 2486042 - protein, 20 aa, Entamoeba dispar
IGNSCFSSCVSLTSINIPST

SEQ ID NO: 2486043 - protein, 19 aa, Entamoeba dispar
IGNTLPHHCDFVMNNKNDD

SEQ ID NO: 2486044 - protein, 17 aa, Entamoeba dispar
IGNWGLKTSEPFFEVFV

SEQ ID NO: 2486045 - protein, 19 aa, Entamoeba dispar
IGNYCFKECLSLTSINIPS

SEQ ID NO: 2486046 - protein, 17 aa, Entamoeba dispar
IGNYCFYECTSLISINI

SEQ ID NO: 2486047 - protein, 18 aa, Entamoeba dispar
IGPFYCNFGRYISIGDNC

SEQ ID NO: 2486048 - protein, 24 aa, Entamoeba dispar
IGPTEIDYLWAYMAGKLPTGGDME

SEQ ID NO: 2486049 - protein, 18 aa, Entamoeba dispar
IGQEFKETEVLSFQTLDF

SEQ ID NO: 2486050 - protein, 22 aa, Entamoeba dispar
IGQEVKLGRRINMIMQTVFFKL

SEQ ID NO: 2486051 - protein, 19 aa, Entamoeba dispar
IGQIKGFELFNRKIISYSS

SEQ ID NO: 2486052 - protein, 24 aa, Entamoeba dispar
IGQLKFQKKIVEWTNMRNYRILYR

SEQ ID NO: 2486053 - protein, 21 aa, Entamoeba dispar
IGRDIEDWVGLSLKNKRTKKQ

SEQ ID NO: 2486054 - protein, 21 aa, Entamoeba dispar
IGRYSRRGNNLFIPQAKKEKI

SEQ ID NO: 2486055 - protein, 18 aa, Entamoeba dispar
IGSAKWCASIYSITKKLS

SEQ ID NO: 2486056 - protein, 17 aa, Entamoeba dispar
IGSEFVKNIQFLKMEAT

SEQ ID NO: 2486057 - protein, 25 aa, Entamoeba dispar
IGSEYLRPYMHGYFMHIKLYQRAMA

SEQ ID NO: 2486058 - protein, 27 aa, Entamoeba dispar
IGSFERINGLILIRFIEEISHSKCNYP

SEQ ID NO: 2486059 - protein, 23 aa, Entamoeba dispar
IGSIDAKGGFTIKAKLQPHQLEN

SEQ ID NO: 2486060 - protein, 21 aa, Entamoeba dispar
IGSIHKGRIMYYSAFDGYCGI

SEQ ID NO: 2486061 - protein, 20 aa, Entamoeba dispar
IGSISMKVLLRIMILHHNKN

SEQ ID NO: 2486062 - protein, 24 aa, Entamoeba dispar
IGSKVFDFTISFIIPNEDDARSLF

SEQ ID NO: 2486063 - protein, 18 aa, Entamoeba dispar
IGSLCLIPSLVDEAEKMG

SEQ ID NO: 2486064 - protein, 21 aa, Entamoeba dispar
IGSLRQVLEIISLRTETAPIP

SEQ ID NO: 2486065 - protein, 20 aa, Entamoeba dispar
IGSSCFEDCWNLKMIQLNNS

SEQ ID NO: 2486066 - protein, 21 aa, Entamoeba dispar
IGSSCFEKCLSLKSLVIPDCI

SEQ ID NO: 2486067 - protein, 17 aa, Entamoeba dispar
IGSSGRISLYRALIKQL

SEQ ID NO: 2486068 - protein, 17 aa, Entamoeba dispar
IGSTISYYTSLVGISYS

SEQ ID NO: 2486069 - protein, 24 aa, Entamoeba dispar
IGSTPSLLIKWSYTSTDNESLPIS

SEQ ID NO: 2486070 - protein, 20 aa, Entamoeba dispar
IGTGCCKLVIGKEGTKNSYS

SEQ ID NO: 2486071 - protein, 17 aa, Entamoeba dispar
IGTKYSVIFPMNDLSIQ

SEQ ID NO: 2486072 - protein, 23 aa, Entamoeba dispar
IGTLKMEECFDIVNVVGQFTIQE

SEQ ID NO: 2486073 - protein, 23 aa, Entamoeba dispar
IGTMRASSMMLEFLGYSEESVLI

SEQ ID NO: 2486074 - protein, 19 aa, Entamoeba dispar
IGTPVKLKCFEIFLNYEHP

SEQ ID NO: 2486075 - protein, 25 aa, Entamoeba dispar
IGTPVYKFLCPYLLKTNKHQPKGLF

SEQ ID NO: 2486076 - protein, 25 aa, Entamoeba dispar
IGTPVYKFLCSYLLKTNTHQSKGLF

SEQ ID NO: 2486077 - protein, 35 aa, Entamoeba dispar
IGVESFKGKIPQLLSWRLNGELSLWNLGQKNQIMT

SEQ ID NO: 2486078 - protein, 18 aa, Entamoeba dispar
IGVLGFPLLVAIRKSGWR

SEQ ID NO: 2486079 - protein, 17 aa, Entamoeba dispar
IGVLMVYLLQFDGNRSH

SEQ ID NO: 2486080 - protein, 19 aa, Entamoeba dispar
IGVLNKFYDIRIEKPKLNK

SEQ ID NO: 2486081 - protein, 21 aa, Entamoeba dispar
IGVVGKEEWVWVVDKGNNRVQ

SEQ ID NO: 2486082 - protein, 20 aa, Entamoeba dispar
IGWCDPFCVFTNNGKEYKTT

SEQ ID NO: 2486083 - protein, 20 aa, Entamoeba dispar
IGYDCFKDCFGLTSITIPSS

SEQ ID NO: 2486084 - protein, 24 aa, Entamoeba dispar
IGYDFSDELIKIFQEKVHLKHTQL

SEQ ID NO: 2486085 - protein, 19 aa, Entamoeba dispar
IGYDGEISYSEWEIIKTKH

SEQ ID NO: 2486086 - protein, 23 aa, Entamoeba dispar
IGYECFYNCLSLTSINIVNIKFI

SEQ ID NO: 2486087 - protein, 19 aa, Entamoeba dispar
IGYGCFECCSSLQTINIPT

SEQ ID NO: 2486088 - protein, 19 aa, Entamoeba dispar
IGYGCFNELLLSLKIPENL

SEQ ID NO: 2486089 - protein, 19 aa, Entamoeba dispar
IGYGCFRGCSSLTSVNIPT

SEQ ID NO: 2486090 - protein, 20 aa, Entamoeba dispar
IGYGCFRGCSSLTSVNIPTS

SEQ ID NO: 2486091 - protein, 20 aa, Entamoeba dispar
IGYGCFYECLSLTTINIPTS

SEQ ID NO: 2486092 - protein, 17 aa, Entamoeba dispar
IGYICAATLRDGMNYQR

SEQ ID NO: 2486093 - protein, 17 aa, Entamoeba dispar
IGYKNAISYLDLPLNQK

SEQ ID NO: 2486094 - protein, 17 aa, Entamoeba dispar
IGYKVVFQNGQIIENPI

SEQ ID NO: 2486095 - protein, 21 aa, Entamoeba dispar
IGYNCFYCCTSLKSITIPSSI

SEQ ID NO: 2486096 - protein, 17 aa, Entamoeba dispar
IGYNCLPLPSPINPSLI

SEQ ID NO: 2486097 - protein, 21 aa, Entamoeba dispar
IHATIPFKLETKYVIENIKLL

SEQ ID NO: 2486098 - protein, 17 aa, Entamoeba dispar
IHCSDGWDRTSQCCSLT

SEQ ID NO: 2486099 - protein, 28 aa, Entamoeba dispar
IHCSRYVQCFGTYGWSCEGVRNLSVRID

SEQ ID NO: 2486100 - protein, 17 aa, Entamoeba dispar
IHDFILWLTSFCSNHEN

SEQ ID NO: 2486101 - protein, 26 aa, Entamoeba dispar
IHDIASFPSISIVFPFNGVSGQLLTV

SEQ ID NO: 2486102 - protein, 17 aa, Entamoeba dispar
IHEYKRQSLAILGTIAQ

SEQ ID NO: 2486103 - protein, 17 aa, Entamoeba dispar
IHFDLHHKSFRNIYEYV

SEQ ID NO: 2486104 - protein, 17 aa, Entamoeba dispar
IHFVNCIFDEEIILPKS

SEQ ID NO: 2486105 - protein, 26 aa, Entamoeba dispar
IHGCEKPILRRVCVNLKEECEKYSEW

SEQ ID NO: 2486106 - protein, 19 aa, Entamoeba dispar
IHGDLKPGNILKEKDTMKI

SEQ ID NO: 2486107 - protein, 19 aa, Entamoeba dispar
IHGVFPFFTNFRVKDSVGI

SEQ ID NO: 2486108 - protein, 23 aa, Entamoeba dispar
IHGVKLILGLLYTLYRKYRLSVL

SEQ ID NO: 2486109 - protein, 17 aa, Entamoeba dispar
IHHGLFLLVESLKLIVY

SEQ ID NO: 2486110 - protein, 17 aa, Entamoeba dispar
IHHPNIIDYYASYETTK

SEQ ID NO: 2486111 - protein, 17 aa, Entamoeba dispar
IHIELWKDNELELVLSI

SEQ ID NO: 2486112 - protein, 17 aa, Entamoeba dispar
IHIQIIFQTGAPAPGMV

SEQ ID NO: 2486113 - protein, 21 aa, Entamoeba dispar
IHIQSLFFNRVVIIITSPIDF

SEQ ID NO: 2486114 - protein, 31 aa, Entamoeba dispar
IHITKTNNKRCCVSRLSELYKEMNDNDLFNT

SEQ ID NO: 2486115 - protein, 26 aa, Entamoeba dispar
IHIVREIWTNIALAAYSWEGEIEEQK

SEQ ID NO: 2486116 - protein, 17 aa, Entamoeba dispar
IHKDSFSCCSIKEIHIP

SEQ ID NO: 2486117 - protein, 21 aa, Entamoeba dispar
IHKIIPIFVFDGATLPSKKLI

SEQ ID NO: 2486118 - protein, 20 aa, Entamoeba dispar
IHKSILYHPFIQNILLNSKV

SEQ ID NO: 2486119 - protein, 21 aa, Entamoeba dispar
IHKSILYHPFIQNILLNSKVS

SEQ ID NO: 2486120 - protein, 19 aa, Entamoeba dispar
IHKYFDPFGPIIGVDIVYK

SEQ ID NO: 2486121 - protein, 17 aa, Entamoeba dispar
IHLIRLSSFNDKFHSNE

SEQ ID NO: 2486122 - protein, 17 aa, Entamoeba dispar
IHLKVTKTLLLFDETFR

SEQ ID NO: 2486123 - protein, 18 aa, Entamoeba dispar
IHLKYCLRIIEEANEILK

SEQ ID NO: 2486124 - protein, 24 aa, Entamoeba dispar
IHNGEIIFDIEIFKSHIDAQLSRQ

SEQ ID NO: 2486125 - protein, 21 aa, Entamoeba dispar
IHPEYNDFCIINLPISDEYGF

SEQ ID NO: 2486126 - protein, 18 aa, Entamoeba dispar
IHPFEINDKFKLAIKQID

SEQ ID NO: 2486127 - protein, 23 aa, Entamoeba dispar
IHPGASIKGHFFIDHGVGVVIGE

SEQ ID NO: 2486128 - protein, 19 aa, Entamoeba dispar
IHPNEFPSLSVLDLSCNNL

SEQ ID NO: 2486129 - protein, 18 aa, Entamoeba dispar
IHPQIPMQPLTVSQPNQK

SEQ ID NO: 2486130 - protein, 20 aa, Entamoeba dispar
IHPTAFNFCYSKILDDPFKK

SEQ ID NO: 2486131 - protein, 23 aa, Entamoeba dispar
IHRDLKLANIFIHNMNVKIGDFG

SEQ ID NO: 2486132 - protein, 25 aa, Entamoeba dispar
IHRFTKPIYCYSILEGSQFQLNSKF

SEQ ID NO: 2486133 - protein, 24 aa, Entamoeba dispar
IHSAADTFSAWLLAGVTGSGKTEV

SEQ ID NO: 2486134 - protein, 25 aa, Entamoeba dispar
IHSEDIPIGWGLKENVYKEIMDKDK

SEQ ID NO: 2486135 - protein, 25 aa, Entamoeba dispar
IHSELLLRAFRVIFDATLLLNIHES

SEQ ID NO: 2486136 - protein, 20 aa, Entamoeba dispar
IHSFPNFHKFILNTKLNEFI

SEQ ID NO: 2486137 - protein, 21 aa, Entamoeba dispar
IHSIIQIHILNIFVTIQNING

SEQ ID NO: 2486138 - protein, 19 aa, Entamoeba dispar
IHSLHCFELPLKRMQEGLT

SEQ ID NO: 2486139 - protein, 22 aa, Entamoeba dispar
IHSLLIKPTFDWINEAIQRDAK

SEQ ID NO: 2486140 - protein, 18 aa, Entamoeba dispar
IHSLQLIKFIPIPNNSNE

SEQ ID NO: 2486141 - protein, 17 aa, Entamoeba dispar
IHSVGLTTFLGCVILKI

SEQ ID NO: 2486142 - protein, 26 aa, Entamoeba dispar
IHTCPQRIGTMLSFFLEALTRNDKVS

SEQ ID NO: 2486143 - protein, 17 aa, Entamoeba dispar
IHTGYKMNCFVIELERY

SEQ ID NO: 2486144 - protein, 18 aa, Entamoeba dispar
IHTIKMLIVEEIKYRPTG

SEQ ID NO: 2486145 - protein, 19 aa, Entamoeba dispar
IHTTRFLQMASEFPENLKS

SEQ ID NO: 2486146 - protein, 17 aa, Entamoeba dispar
IHVAGEINELCNILVDV

SEQ ID NO: 2486147 - protein, 35 aa, Entamoeba dispar
IHVYGEIIGNICFQWKEYREKIIIKLRSITPIFNS

SEQ ID NO: 2486148 - protein, 25 aa, Entamoeba dispar
IHWQLDVCWDAPAYVSWDFKFLEWR

SEQ ID NO: 2486149 - protein, 18 aa, Entamoeba dispar
IHYAALFGNEAVIRILIR

SEQ ID NO: 2486150 - protein, 25 aa, Entamoeba dispar
IHYCQYEIIYIYAILNRMANIGINN

SEQ ID NO: 2486151 - protein, 22 aa, Entamoeba dispar
IHYFKEEIPDLIELSIASNQIG

SEQ ID NO: 2486152 - protein, 25 aa, Entamoeba dispar
IHYFVFCYELPYSTAVILKEKMITC

SEQ ID NO: 2486153 - protein, 20 aa, Entamoeba dispar
IHYRDINLVFFLLSHTSLID

SEQ ID NO: 2486154 - protein, 21 aa, Entamoeba dispar
IHYSPIPMRAFDFNEDDNEYC

SEQ ID NO: 2486155 - protein, 23 aa, Entamoeba dispar
IIAAEPYQSIAFKIPNVEVELDE

SEQ ID NO: 2486156 - protein, 25 aa, Entamoeba dispar
IIADGYRTGLKFFNDHCEDLVLSTL

SEQ ID NO: 2486157 - protein, 23 aa, Entamoeba dispar
IIADYPCCLRLIKIDVSDSRKLP

SEQ ID NO: 2486158 - protein, 20 aa, Entamoeba dispar
IIAGIGFGVFKVICDGVEKI

SEQ ID NO: 2486159 - protein, 18 aa, Entamoeba dispar
IIAICLKANVDEKVTQLY

SEQ ID NO: 2486160 - protein, 24 aa, Entamoeba dispar
IIAKLLRSSFDWLKSIKDSQVDQK

SEQ ID NO: 2486161 - protein, 18 aa, Entamoeba dispar
IIAPGEAEAQCYQLEHDG

SEQ ID NO: 2486162 - protein, 26 aa, Entamoeba dispar
IIASGGHSLFNWSFVTSKTLPFHNYK

SEQ ID NO: 2486163 - protein, 25 aa, Entamoeba dispar
IICEAKRFIGRRVKPSEIENDKSLL

SEQ ID NO: 2486164 - protein, 17 aa, Entamoeba dispar
IICENLVNDSTNLPKEL

SEQ ID NO: 2486165 - protein, 20 aa, Entamoeba dispar
IICFSIDSRSSFGNISQRWL

SEQ ID NO: 2486166 - protein, 28 aa, Entamoeba dispar
IICHPCMLKKLPKCTHCNNPIKGNCVVV

SEQ ID NO: 2486167 - protein, 22 aa, Entamoeba dispar
IICHTNFKIFMELINEVYPMAL

SEQ ID NO: 2486168 - protein, 17 aa, Entamoeba dispar
IICSVCDNIVITGGQTG

SEQ ID NO: 2486169 - protein, 21 aa, Entamoeba dispar
IICVVCKEVGPNEPLTREKLS

SEQ ID NO: 2486170 - protein, 18 aa, Entamoeba dispar
IIDASGLLILPGAVDGHT

SEQ ID NO: 2486171 - protein, 24 aa, Entamoeba dispar
IIDCKNYPTGFSYFMHKVSIELHK

SEQ ID NO: 2486172 - protein, 17 aa, Entamoeba dispar
IIDDFLQVYSIYFGACY

SEQ ID NO: 2486173 - protein, 25 aa, Entamoeba dispar
IIDDLLKREWGFIIFDEVHGSTTDN

SEQ ID NO: 2486174 - protein, 19 aa, Entamoeba dispar
IIDEFPFDNIEIALNQYLE

SEQ ID NO: 2486175 - protein, 22 aa, Entamoeba dispar
IIDFSNRLVGVINEITNNDHLL

SEQ ID NO: 2486176 - protein, 30 aa, Entamoeba dispar
IIDGSLQLCKMCFEIAFQSIHIVLLSDFLQ

SEQ ID NO: 2486177 - protein, 24 aa, Entamoeba dispar
IIDGTNLFTDWRKVLISNLERGEY

SEQ ID NO: 2486178 - protein, 19 aa, Entamoeba dispar
IIDIFKILFSQSYYEKIAL

SEQ ID NO: 2486179 - protein, 25 aa, Entamoeba dispar
IIDIKWVGNIICCIGGLYDGKEYKD

SEQ ID NO: 2486180 - protein, 24 aa, Entamoeba dispar
IIDKNGFHYSDFISFKEKLTTFKR

SEQ ID NO: 2486181 - protein, 24 aa, Entamoeba dispar
IIDLTQPTSFEWARNYISNKLGIE

SEQ ID NO: 2486182 - protein, 17 aa, Entamoeba dispar
IIDMLGLPPKNILEQGS

SEQ ID NO: 2486183 - protein, 25 aa, Entamoeba dispar
IIDNVPCGVAWPYLIGAKGIGIDPK

SEQ ID NO: 2486184 - protein, 23 aa, Entamoeba dispar
IIDSKCKEGYHFELSKDDIGSLL

SEQ ID NO: 2486185 - protein, 18 aa, Entamoeba dispar
IIDSVLFIEDLKSYFVNA

SEQ ID NO: 2486186 - protein, 17 aa, Entamoeba dispar
IIDSYLLTSYVNGTFQG

SEQ ID NO: 2486187 - protein, 23 aa, Entamoeba dispar
IIDTLRIGKIMKLSRITEILKSS

SEQ ID NO: 2486188 - protein, 18 aa, Entamoeba dispar
IIDYCSITGTIIVLDDLT

SEQ ID NO: 2486189 - protein, 18 aa, Entamoeba dispar
IIEEPIVNIEALRIKVMK

SEQ ID NO: 2486190 - protein, 25 aa, Entamoeba dispar
IIEGIKCLDSIIVHEGQRKRQYTID

SEQ ID NO: 2486191 - protein, 23 aa, Entamoeba dispar
  misc_feature (18)..(19): Xaa can be any naturally occurring amino acid
IIEIFHFCFRKCTSLTSXXLSIT

SEQ ID NO: 2486192 - protein, 20 aa, Entamoeba dispar
IIEIGDWCFDECTSLTSINI

SEQ ID NO: 2486193 - protein, 24 aa, Entamoeba dispar
IIEIGSSCFNECISLISINIPSLI

SEQ ID NO: 2486194 - protein, 20 aa, Entamoeba dispar
IIEIGYKCFKECSTLKSINI

SEQ ID NO: 2486195 - protein, 17 aa, Entamoeba dispar
IIEKGECIGYIELGEKR

SEQ ID NO: 2486196 - protein, 27 aa, Entamoeba dispar
IIEKRSLIPPTYCKKLVNILKDLEKQR

SEQ ID NO: 2486197 - protein, 24 aa, Entamoeba dispar
IIEKRTFIYFTILKKYQLPMENED

SEQ ID NO: 2486198 - protein, 24 aa, Entamoeba dispar
IIEKSFFHKFYEPLKEWTSKQTFK

SEQ ID NO: 2486199 - protein, 29 aa, Entamoeba dispar
IIELSKGCFRVCDFLKSFTFNSIIVSIPD

SEQ ID NO: 2486200 - protein, 22 aa, Entamoeba dispar
IIEMIKEANFCLNTVQNEREAA

SEQ ID NO: 2486201 - protein, 17 aa, Entamoeba dispar
IIEQCCKGVQWLHNGMN

SEQ ID NO: 2486202 - protein, 19 aa, Entamoeba dispar
IIESSKLYFKIEGKKRITL

SEQ ID NO: 2486203 - protein, 24 aa, Entamoeba dispar
IIETFSKIFSFFIHKLCKHQQLTF

SEQ ID NO: 2486204 - protein, 24 aa, Entamoeba dispar
IIEVFSRMNFSYVLLSKRNLNTFV

SEQ ID NO: 2486205 - protein, 23 aa, Entamoeba dispar
IIFCNELKPAGFYKEKLKLQKCY

SEQ ID NO: 2486206 - protein, 25 aa, Entamoeba dispar
IIFDECARKLFNMSADEMNVLDEDD

SEQ ID NO: 2486207 - protein, 17 aa, Entamoeba dispar
IIFELSKEMIKKYQTKE

SEQ ID NO: 2486208 - protein, 23 aa, Entamoeba dispar
IIFEPYDEFEWFLFNGNEMVVLR

SEQ ID NO: 2486209 - protein, 31 aa, Entamoeba dispar
IIFKKVKGSCKVYKKYCKFIMRNNREEENKN

SEQ ID NO: 2486210 - protein, 19 aa, Entamoeba dispar
IIFKKVKGSCKVYKKYCNF

SEQ ID NO: 2486211 - protein, 31 aa, Entamoeba dispar
IIFKKVKGSCKVYKKYCNFIMRNNREEENKN

SEQ ID NO: 2486212 - protein, 31 aa, Entamoeba dispar
IIFKKVKGSCKVYKKYCNFLMRNNREEEIKN

SEQ ID NO: 2486213 - protein, 31 aa, Entamoeba dispar
IIFKKVKGSCKVYKKYCNFLMRNNREEENKN

SEQ ID NO: 2486214 - protein, 17 aa, Entamoeba dispar
IIFKLVMNSSYGKTIQK

SEQ ID NO: 2486215 - protein, 18 aa, Entamoeba dispar
IIFLRSISNYFLRCTEDS

SEQ ID NO: 2486216 - protein, 20 aa, Entamoeba dispar
IIFMRYFLYNSLNSCDPLYV

SEQ ID NO: 2486217 - protein, 23 aa, Entamoeba dispar
IIFPKLPKVYIYKTQKYVIKESI

SEQ ID NO: 2486218 - protein, 17 aa, Entamoeba dispar
IIFRSDQQITFKFIRIY

SEQ ID NO: 2486219 - protein, 17 aa, Entamoeba dispar
IIGDSGVGKTCISSRLV

SEQ ID NO: 2486220 - protein, 21 aa, Entamoeba dispar
IIGINRYVHYIGMEESLESLY

SEQ ID NO: 2486221 - protein, 17 aa, Entamoeba dispar
IIGKFGCGKQIKWIGVG

SEQ ID NO: 2486222 - protein, 18 aa, Entamoeba dispar
IIGKRRIGHNSIMITSKY

SEQ ID NO: 2486223 - protein, 27 aa, Entamoeba dispar
IIGLLANKKTVCFFEYEIDKLNSQRYT

SEQ ID NO: 2486224 - protein, 26 aa, Entamoeba dispar
IIGTLKICSFSVFFASNEQSFPIRRI

SEQ ID NO: 2486225 - protein, 26 aa, Entamoeba dispar
IIHAPIIKHFFIILGYPNQPYQSVYV

SEQ ID NO: 2486226 - protein, 17 aa, Entamoeba dispar
IIHKPMLLETIQQVLEQ

SEQ ID NO: 2486227 - protein, 17 aa, Entamoeba dispar
IIHLDIKPANILISDDC

SEQ ID NO: 2486228 - protein, 24 aa, Entamoeba dispar
IIHLVSRSDLFGLLTSLSILLDSQ

SEQ ID NO: 2486229 - protein, 18 aa, Entamoeba dispar
IIHRDIQNSWIFGVGYGF

SEQ ID NO: 2486230 - protein, 17 aa, Entamoeba dispar
IIHYKNIIVLLYNDLNK

SEQ ID NO: 2486231 - protein, 25 aa, Entamoeba dispar
IIICCTDERCSFIGVHNPQINSNNR

SEQ ID NO: 2486232 - protein, 22 aa, Entamoeba dispar
IIICDFAWVVLNQVDAIADFVK

SEQ ID NO: 2486233 - protein, 18 aa, Entamoeba dispar
IIIEIIDIGITFEPRIIN

SEQ ID NO: 2486234 - protein, 24 aa, Entamoeba dispar
IIIGMCKIFDIWADGKVSRLESIK

SEQ ID NO: 2486235 - protein, 18 aa, Entamoeba dispar
IIIGSPIYVHSKCIIVDD

SEQ ID NO: 2486236 - protein, 17 aa, Entamoeba dispar
IIIHLSGISKETRESLS

SEQ ID NO: 2486237 - protein, 18 aa, Entamoeba dispar
IIIINSIYQYIYLDKESI

SEQ ID NO: 2486238 - protein, 17 aa, Entamoeba dispar
IIIKCIKKGAVKEGIVA

SEQ ID NO: 2486239 - protein, 17 aa, Entamoeba dispar
IIIKEIGRVLVLNQKNL

SEQ ID NO: 2486240 - protein, 23 aa, Entamoeba dispar
IIIKLKSLLTRGLMIKYLHLLIT

SEQ ID NO: 2486241 - protein, 17 aa, Entamoeba dispar
IIIKVIMKNCGSYFVKN

SEQ ID NO: 2486242 - protein, 19 aa, Entamoeba dispar
IIINEILALKCIDVETRTV

SEQ ID NO: 2486243 - protein, 20 aa, Entamoeba dispar
IIINEILALKCIDVETRTVK

SEQ ID NO: 2486244 - protein, 21 aa, Entamoeba dispar
IIINEILALKCIDVKTRTPKA

SEQ ID NO: 2486245 - protein, 22 aa, Entamoeba dispar
IIINIAPLISFDFFNEKFGEYE

SEQ ID NO: 2486246 - protein, 26 aa, Entamoeba dispar
IIIPEIKRAFSLSLCDGDRIFYDDRR

SEQ ID NO: 2486247 - protein, 23 aa, Entamoeba dispar
IIIPMLGIFFNFSQTDSKEVEVH

SEQ ID NO: 2486248 - protein, 18 aa, Entamoeba dispar
IIIRCMREDITTLTNTLH

SEQ ID NO: 2486249 - protein, 19 aa, Entamoeba dispar
IIIRVFPYIVSEPIPKLYV

SEQ ID NO: 2486250 - protein, 18 aa, Entamoeba dispar
IIISPGYRMLSTQHVVPP

SEQ ID NO: 2486251 - protein, 26 aa, Entamoeba dispar
IIIVIKPNINGMYGIRIFRKKEMPIV

SEQ ID NO: 2486252 - protein, 23 aa, Entamoeba dispar
IIKALKLLFPPSFDKDQTNKEKA

SEQ ID NO: 2486253 - protein, 20 aa, Entamoeba dispar
IIKCKRLLRNNGEIIPSIGR

SEQ ID NO: 2486254 - protein, 19 aa, Entamoeba dispar
IIKDNRFGPNDMKVAEKIF

SEQ ID NO: 2486255 - protein, 17 aa, Entamoeba dispar
IIKEDIHLLSLLISHLH

SEQ ID NO: 2486256 - protein, 27 aa, Entamoeba dispar
IIKFELSEGSALVFGDLWNVIKRQLLE

SEQ ID NO: 2486257 - protein, 21 aa, Entamoeba dispar
IIKGDHIYNIVIPRYTLHPTS

SEQ ID NO: 2486258 - protein, 25 aa, Entamoeba dispar
IIKGERLEIPKNCQYEELMKKCWLE

SEQ ID NO: 2486259 - protein, 19 aa, Entamoeba dispar
IIKGGKFTKDDLIIYNSDD

SEQ ID NO: 2486260 - protein, 19 aa, Entamoeba dispar
IIKGIRKENKYIKFINEIV

SEQ ID NO: 2486261 - protein, 25 aa, Entamoeba dispar
IIKHYAEKSIDAYIYSLTKMHNKTV

SEQ ID NO: 2486262 - protein, 18 aa, Entamoeba dispar
IIKIHGWSTTIVNEIVGM

SEQ ID NO: 2486263 - protein, 23 aa, Entamoeba dispar
IIKKECFHKCLSLKSIKIPLSVT

SEQ ID NO: 2486264 - protein, 19 aa, Entamoeba dispar
IIKKEIATIRFIKEDYHTS

SEQ ID NO: 2486265 - protein, 18 aa, Entamoeba dispar
IIKKPMCIENIKTKLSDN

SEQ ID NO: 2486266 - protein, 21 aa, Entamoeba dispar
IIKKYKFGVIYVKDGQKEENE

SEQ ID NO: 2486267 - protein, 19 aa, Entamoeba dispar
IIKLFGGKTELGYPPFQRH

SEQ ID NO: 2486268 - protein, 18 aa, Entamoeba dispar
IIKLKNILHEAALLQVEI

SEQ ID NO: 2486269 - protein, 20 aa, Entamoeba dispar
IIKLKNILHEAALLQVEISY

SEQ ID NO: 2486270 - protein, 21 aa, Entamoeba dispar
IIKLKNILHEAALLQVEISYS

SEQ ID NO: 2486271 - protein, 27 aa, Entamoeba dispar
IIKLNGVYNLIPWMCKNLLLNQFVDGE

SEQ ID NO: 2486272 - protein, 38 aa, Entamoeba dispar
IIKMFPFKFDLIYKWLRREGKSILKLSSFLNSQKQNTE

SEQ ID NO: 2486273 - protein, 27 aa, Entamoeba dispar
IIKMKELLEGIFLRLFSFKMIPDSFKS

SEQ ID NO: 2486274 - protein, 21 aa, Entamoeba dispar
IIKMKVINYKAINLIISILML

SEQ ID NO: 2486275 - protein, 17 aa, Entamoeba dispar
IIKPKCKDILNETDDNI

SEQ ID NO: 2486276 - protein, 21 aa, Entamoeba dispar
IIKQEFALILPLINKSIKKVL

SEQ ID NO: 2486277 - protein, 33 aa, Entamoeba dispar
IIKQNRWYPKFSIYPVNEITIFFNYAQIDVNYL

SEQ ID NO: 2486278 - protein, 23 aa, Entamoeba dispar
IIKSFSIPTSFFIYLSNKLPIEK

SEQ ID NO: 2486279 - protein, 19 aa, Entamoeba dispar
IIKSLCQFTKDVLLFFKKQ

SEQ ID NO: 2486280 - protein, 23 aa, Entamoeba dispar
IIKSLGNECFKYCYDLKTIDIPT

SEQ ID NO: 2486281 - protein, 18 aa, Entamoeba dispar
IIKSLLCSPSVKDDIIKK

SEQ ID NO: 2486282 - protein, 23 aa, Entamoeba dispar
IIKSQECPLDILNVSLFNQLNNL

SEQ ID NO: 2486283 - protein, 24 aa, Entamoeba dispar
IIKSSIKKGIKYKFEEEKKEEQEV

SEQ ID NO: 2486284 - protein, 23 aa, Entamoeba dispar
IIKVYKEDGEWWYGENKGKTGYF

SEQ ID NO: 2486285 - protein, 18 aa, Entamoeba dispar
IILAHGAGSFGHVPAAKY

SEQ ID NO: 2486286 - protein, 23 aa, Entamoeba dispar
IILHILNYLLLWNKINNEINNSF

SEQ ID NO: 2486287 - protein, 19 aa, Entamoeba dispar
IILHSIQFDECVIIKNSIH

SEQ ID NO: 2486288 - protein, 25 aa, Entamoeba dispar
IILIIKELICLLDDLKIIEDKELDN

SEQ ID NO: 2486289 - protein, 20 aa, Entamoeba dispar
IILKWLQDILSLYEIDLSST

SEQ ID NO: 2486290 - protein, 30 aa, Entamoeba dispar
IILLFRRDFPHSACVRLWDAIFAYPENKLY

SEQ ID NO: 2486291 - protein, 19 aa, Entamoeba dispar
IILNEVKKAIIARTKTDKF

SEQ ID NO: 2486292 - protein, 19 aa, Entamoeba dispar
IILNLAEAIIQYKDINQMG

SEQ ID NO: 2486293 - protein, 17 aa, Entamoeba dispar
IILNYSIEWLNKEESSC

SEQ ID NO: 2486294 - protein, 18 aa, Entamoeba dispar
IILTFIDIFHQYRSIRQT

SEQ ID NO: 2486295 - protein, 18 aa, Entamoeba dispar
IIMELGRSELLNTDQVSN

SEQ ID NO: 2486296 - protein, 19 aa, Entamoeba dispar
IIMKNEYNKYLNIINKKEI

SEQ ID NO: 2486297 - protein, 23 aa, Entamoeba dispar
IIMRGKMIYKMVVKYKGKKIIFK

SEQ ID NO: 2486298 - protein, 17 aa, Entamoeba dispar
IINAGIVLGGYYQMLKY

SEQ ID NO: 2486299 - protein, 18 aa, Entamoeba dispar
IINDIGFVEKQRFLKMCE

SEQ ID NO: 2486300 - protein, 19 aa, Entamoeba dispar
IINDLSYRISKIIDSGNLE

SEQ ID NO: 2486301 - protein, 18 aa, Entamoeba dispar
IINDVLFSIVTLYLESTS

SEQ ID NO: 2486302 - protein, 23 aa, Entamoeba dispar
IINELRMTWKNNRYNYLTKALIT

SEQ ID NO: 2486303 - protein, 25 aa, Entamoeba dispar
IINEQRLNGILNMFTGIIYEHQIIS

SEQ ID NO: 2486304 - protein, 17 aa, Entamoeba dispar
IININGIIHQTSFVLPK

SEQ ID NO: 2486305 - protein, 35 aa, Entamoeba dispar
IINKEFKLLLNDSFSIPLLNFFSLKELTDISIGYN

SEQ ID NO: 2486306 - protein, 17 aa, Entamoeba dispar
IINKMIIHISRSIYKRI

SEQ ID NO: 2486307 - protein, 26 aa, Entamoeba dispar
IINLPNTIKVLYWRQNFAHIGKDVSV

SEQ ID NO: 2486308 - protein, 26 aa, Entamoeba dispar
IINRKEINTTIGFLFEIETNKIIEER

SEQ ID NO: 2486309 - protein, 27 aa, Entamoeba dispar
IINTAGWKSGFGLELLELELSLSRTMF

SEQ ID NO: 2486310 - protein, 20 aa, Entamoeba dispar
IIPCKSIKKEQLQMCFELVK

SEQ ID NO: 2486311 - protein, 18 aa, Entamoeba dispar
IIPECLQEYTTLKKLILS

SEQ ID NO: 2486312 - protein, 22 aa, Entamoeba dispar
IIPEPMNLHLLLNLVSSIHTRQ

SEQ ID NO: 2486313 - protein, 17 aa, Entamoeba dispar
IIPHIAQGKEARFEVEI

SEQ ID NO: 2486314 - protein, 18 aa, Entamoeba dispar
IIPHILNLLIVVIKEKKP

SEQ ID NO: 2486315 - protein, 22 aa, Entamoeba dispar
IIPKYCFSHCNALFSITLPISI

SEQ ID NO: 2486316 - protein, 23 aa, Entamoeba dispar
IIPLCERVKIYLNYFVENKDESN

SEQ ID NO: 2486317 - protein, 20 aa, Entamoeba dispar
IIPLFPNLQTFYVRRCPERL

SEQ ID NO: 2486318 - protein, 21 aa, Entamoeba dispar
IIPNNNCEIILEKCSEYPDGI

SEQ ID NO: 2486319 - protein, 22 aa, Entamoeba dispar
IIPPTYPAIIPISSISSEMISD

SEQ ID NO: 2486320 - protein, 26 aa, Entamoeba dispar
IIPSSINKLGYRCFNGCLSLTTINIP

SEQ ID NO: 2486321 - protein, 28 aa, Entamoeba dispar
IIPSSITKIGDWCFSYFLSLKSTNIPSS

SEQ ID NO: 2486322 - protein, 30 aa, Entamoeba dispar
IIPSSITKLGDWCFCYCYSLTSIIIPSSVI

SEQ ID NO: 2486323 - protein, 31 aa, Entamoeba dispar
IIPSSITKLGDWCFKGCYSLTSINIPSSIKE

SEQ ID NO: 2486324 - protein, 24 aa, Entamoeba dispar
IIPSSITKLGDWCFNKCSSLKSIH

SEQ ID NO: 2486325 - protein, 26 aa, Entamoeba dispar
IIPSSITKLGDWCFNKCSSLKSIHIP

SEQ ID NO: 2486326 - protein, 26 aa, Entamoeba dispar
IIPSSVSKIGRWCFNDCSSLNNVNIP

SEQ ID NO: 2486327 - protein, 30 aa, Entamoeba dispar
IIPTTITKLGDWCFSGCLSLTSVDIPTTIS

SEQ ID NO: 2486328 - protein, 33 aa, Entamoeba dispar
IIPTTITKLGDWCFYEYSSLISINIPSTINELG

SEQ ID NO: 2486329 - protein, 24 aa, Entamoeba dispar
IIQCLCDGCSIGIAPKLAATAAGQ

SEQ ID NO: 2486330 - protein, 18 aa, Entamoeba dispar
IIQFGIELLDIIITDHFE

SEQ ID NO: 2486331 - protein, 22 aa, Entamoeba dispar
IIQFGIELLDIIITDHFESLDK

SEQ ID NO: 2486332 - protein, 26 aa, Entamoeba dispar
IIQGSRITPDWMALIFKTIQYPGCLH

SEQ ID NO: 2486333 - protein, 34 aa, Entamoeba dispar
IIQIPEDFIKLKLTVSIPEATAFISLTENEPIFN

SEQ ID NO: 2486334 - protein, 20 aa, Entamoeba dispar
IIQKEMFESELMVPKEIEYE

SEQ ID NO: 2486335 - protein, 17 aa, Entamoeba dispar
IIQKMNYEMIQKDTEIK

SEQ ID NO: 2486336 - protein, 17 aa, Entamoeba dispar
IIQLINLRLETIKSSIK

SEQ ID NO: 2486337 - protein, 21 aa, Entamoeba dispar
IIQLLDGIKFQNEKIFEMQEE

SEQ ID NO: 2486338 - protein, 17 aa, Entamoeba dispar
IIQNDICVIIFKEYNSI

SEQ ID NO: 2486339 - protein, 19 aa, Entamoeba dispar
IIQNLPAILSHQIINQPKQ

SEQ ID NO: 2486340 - protein, 19 aa, Entamoeba dispar
IIQPIPWLQSNDINESLER

SEQ ID NO: 2486341 - protein, 18 aa, Entamoeba dispar
IIQREIIEFYKFNTNELL

SEQ ID NO: 2486342 - protein, 29 aa, Entamoeba dispar
IIQTLKGECKFTFKEMQTLNVKRDKLNLK

SEQ ID NO: 2486343 - protein, 19 aa, Entamoeba dispar
IIRCQKIKLEFKRNSFKDV

SEQ ID NO: 2486344 - protein, 21 aa, Entamoeba dispar
IIREFGKKYSTLKCPHAQFTE

SEQ ID NO: 2486345 - protein, 26 aa, Entamoeba dispar
IIRELGKKYFALKCSHAQFTDSKSKI

SEQ ID NO: 2486346 - protein, 17 aa, Entamoeba dispar
IIRGHQWVNDGVEMHYF

SEQ ID NO: 2486347 - protein, 18 aa, Entamoeba dispar
IIRGRVVELSKHMYGCRV

SEQ ID NO: 2486348 - protein, 24 aa, Entamoeba dispar
IIRKDWRDSIFFFGSNKVMQVALG

SEQ ID NO: 2486349 - protein, 23 aa, Entamoeba dispar
IIRLKELWLPNTTNINIIQSIIK

SEQ ID NO: 2486350 - protein, 19 aa, Entamoeba dispar
IIRLKKRVNELIDKINETE

SEQ ID NO: 2486351 - protein, 24 aa, Entamoeba dispar
IIRMISCKRFFLLPKLQQKNDVNM

SEQ ID NO: 2486352 - protein, 29 aa, Entamoeba dispar
IIRRSLMLLSRYPLPLFKDLEPEVEEMRE

SEQ ID NO: 2486353 - protein, 19 aa, Entamoeba dispar
IIRTCCSIASIKHFDIKIH

SEQ ID NO: 2486354 - protein, 17 aa, Entamoeba dispar
IIRTRYGKQIFTMKMHD

SEQ ID NO: 2486355 - protein, 20 aa, Entamoeba dispar
IISALRILGFFVSQRTAVLL

SEQ ID NO: 2486356 - protein, 22 aa, Entamoeba dispar
IISASVLRAEIYGIKKEISNEE

SEQ ID NO: 2486357 - protein, 19 aa, Entamoeba dispar
IISCFMPPVISKIHVLSSS

SEQ ID NO: 2486358 - protein, 18 aa, Entamoeba dispar
IISCNGKKGFSLTPNDMN

SEQ ID NO: 2486359 - protein, 25 aa, Entamoeba dispar
IISDIPRFGSLIIEKMTPNECGQNE

SEQ ID NO: 2486360 - protein, 25 aa, Entamoeba dispar
IISDIPRFGSLIIERMTIAESGQIE

SEQ ID NO: 2486361 - protein, 20 aa, Entamoeba dispar
IISDTKYRWNAVDIDVEVYG

SEQ ID NO: 2486362 - protein, 19 aa, Entamoeba dispar
IISEVRFNVDIFILESNEI

SEQ ID NO: 2486363 - protein, 23 aa, Entamoeba dispar
IISFGDGCFSYCLSLTSINIPSS

SEQ ID NO: 2486364 - protein, 24 aa, Entamoeba dispar
IISFGDGCFYGCGCEDELMKNKRI

SEQ ID NO: 2486365 - protein, 24 aa, Entamoeba dispar
IISFGRGCFYKCGCEDELMKNKRI

SEQ ID NO: 2486366 - protein, 18 aa, Entamoeba dispar
IISFKYDGKKTIKIIEEV

SEQ ID NO: 2486367 - protein, 17 aa, Entamoeba dispar
IISIDCYEDLILTISSD

SEQ ID NO: 2486368 - protein, 21 aa, Entamoeba dispar
IISILIRLEDSMQIPMKETET

SEQ ID NO: 2486369 - protein, 19 aa, Entamoeba dispar
IISLCKCKLLKQLILSKTT

SEQ ID NO: 2486370 - protein, 19 aa, Entamoeba dispar
IISNIFPISDFWEHVCIVW

SEQ ID NO: 2486371 - protein, 25 aa, Entamoeba dispar
IISQLYWLRHNLLATLGLSIGFSSF

SEQ ID NO: 2486372 - protein, 18 aa, Entamoeba dispar
IISQWYLILCELSETLQK

SEQ ID NO: 2486373 - protein, 26 aa, Entamoeba dispar
IISTLFPHCYQYCGVQTNTFDCSNLK

SEQ ID NO: 2486374 - protein, 17 aa, Entamoeba dispar
IISTSSFPITPRSQNKQ

SEQ ID NO: 2486375 - protein, 17 aa, Entamoeba dispar
IITAFPYSNWQIPYTAF

SEQ ID NO: 2486376 - protein, 24 aa, Entamoeba dispar
IITEIKRIYNLFIERSSTINYELK

SEQ ID NO: 2486377 - protein, 22 aa, Entamoeba dispar
IITELKQSISDIDVLKTENQTL

SEQ ID NO: 2486378 - protein, 23 aa, Entamoeba dispar
IITESGCSFGSFNEQSMLGDAEG

SEQ ID NO: 2486379 - protein, 18 aa, Entamoeba dispar
IITFILIDYPHIYPNDVD

SEQ ID NO: 2486380 - protein, 23 aa, Entamoeba dispar
IITFKKIFVREIVKPKTEPKDST

SEQ ID NO: 2486381 - protein, 17 aa, Entamoeba dispar
IITFKYMTNIVIRYSAV

SEQ ID NO: 2486382 - protein, 20 aa, Entamoeba dispar
IITHFKFGVIYVKPNQNDEN

SEQ ID NO: 2486383 - protein, 17 aa, Entamoeba dispar
IITKDWKTLRHDMLCET

SEQ ID NO: 2486384 - protein, 21 aa, Entamoeba dispar
IITLDFLRYSFYTNISAIKTA

SEQ ID NO: 2486385 - protein, 24 aa, Entamoeba dispar
IITLKRLKIGIGEDKQYFTVLQRL

SEQ ID NO: 2486386 - protein, 24 aa, Entamoeba dispar
IITLKSIRNVCRFCDDNKVNINDV

SEQ ID NO: 2486387 - protein, 24 aa, Entamoeba dispar
IITPRFAVSCTRDLMKKLGQLAQE

SEQ ID NO: 2486388 - protein, 23 aa, Entamoeba dispar
IITRMISCCFMKLTNTLKEEIIS

SEQ ID NO: 2486389 - protein, 18 aa, Entamoeba dispar
IITTCVLYIENRCDKRMK

SEQ ID NO: 2486390 - protein, 17 aa, Entamoeba dispar
IIVGGGFNLKGDLIVVT

SEQ ID NO: 2486391 - protein, 18 aa, Entamoeba dispar
IIVQLCLDSVESNWVSSF

SEQ ID NO: 2486392 - protein, 24 aa, Entamoeba dispar
IIVRCFSCKWNQWIKENIKVDTVF

SEQ ID NO: 2486393 - protein, 22 aa, Entamoeba dispar
IIVTKHGYVFGSFNSLKLPVPK

SEQ ID NO: 2486394 - protein, 17 aa, Entamoeba dispar
IIWYAVNYSTYFQEKGT

SEQ ID NO: 2486395 - protein, 18 aa, Entamoeba dispar
IIYCSCGSVVTSSLCPFC

SEQ ID NO: 2486396 - protein, 23 aa, Entamoeba dispar
IIYECPKISGIDFGDGVIELENI

SEQ ID NO: 2486397 - protein, 21 aa, Entamoeba dispar
IIYHCCLPKLLPSTSQIYFKM

SEQ ID NO: 2486398 - protein, 17 aa, Entamoeba dispar
IIYHPTIEKDESKLQKL

SEQ ID NO: 2486399 - protein, 28 aa, Entamoeba dispar
IIYIRLFSYELIRGLAYIHSLNIIHQDI

SEQ ID NO: 2486400 - protein, 17 aa, Entamoeba dispar
IIYKDHRLFSKSINMSL

SEQ ID NO: 2486401 - protein, 21 aa, Entamoeba dispar
IIYKFDFFDFILTELRNSFNN

SEQ ID NO: 2486402 - protein, 19 aa, Entamoeba dispar
IIYLLKCDSSDFSVEEKRI

SEQ ID NO: 2486403 - protein, 23 aa, Entamoeba dispar
IIYLLKGTLPWQGLHVGKGENRY

SEQ ID NO: 2486404 - protein, 23 aa, Entamoeba dispar
IIYRKTYCGFALSNAFDSFETNN

SEQ ID NO: 2486405 - protein, 20 aa, Entamoeba dispar
IIYSYRFLQVNSLDLTLTTG

SEQ ID NO: 2486406 - protein, 27 aa, Entamoeba dispar
IIYTCVVNLMKRCLVNTGINKQDIAAI

SEQ ID NO: 2486407 - protein, 17 aa, Entamoeba dispar
IKAEIEIKMNEIKQGEK

SEQ ID NO: 2486408 - protein, 21 aa, Entamoeba dispar
IKAETGVVLLNFDNKGIPIKK

SEQ ID NO: 2486409 - protein, 19 aa, Entamoeba dispar
IKAGKGFYLTTEMKTSIAL

SEQ ID NO: 2486410 - protein, 20 aa, Entamoeba dispar
IKAHARFIVRSFKVNEMEFF

SEQ ID NO: 2486411 - protein, 20 aa, Entamoeba dispar
IKAISGLAIGIGFNKFSRYT

SEQ ID NO: 2486412 - protein, 19 aa, Entamoeba dispar
IKAIYPIPDVIYFNRKSLK

SEQ ID NO: 2486413 - protein, 19 aa, Entamoeba dispar
IKAKLPIVLTPQHHLLFVI

SEQ ID NO: 2486414 - protein, 28 aa, Entamoeba dispar
IKAKVIPDCVSSIWVCCVDKRYENGRNG

SEQ ID NO: 2486415 - protein, 17 aa, Entamoeba dispar
IKALIAINNEFEEYENS

SEQ ID NO: 2486416 - protein, 24 aa, Entamoeba dispar
IKAQLPVAESFGFTDDMLGQTSGA

SEQ ID NO: 2486417 - protein, 18 aa, Entamoeba dispar
IKAVQSWNNSTLWGELEE

SEQ ID NO: 2486418 - protein, 21 aa, Entamoeba dispar
IKAVSGSDCDWISSDYFICST

SEQ ID NO: 2486419 - protein, 17 aa, Entamoeba dispar
IKCAESVIRDLIGHPVV

SEQ ID NO: 2486420 - protein, 30 aa, Entamoeba dispar
IKCPVDYPTNICLISSFELFIIDSTNQTSI

SEQ ID NO: 2486421 - protein, 21 aa, Entamoeba dispar
IKCQIAAFCELLRDYSNDNYE

SEQ ID NO: 2486422 - protein, 20 aa, Entamoeba dispar
IKCRVPRCSIKICNVSNNKE

SEQ ID NO: 2486423 - protein, 20 aa, Entamoeba dispar
IKCVCALKKVVKLDITGLNF

SEQ ID NO: 2486424 - protein, 19 aa, Entamoeba dispar
IKDAILKEDVHDLLVETLK

SEQ ID NO: 2486425 - protein, 17 aa, Entamoeba dispar
IKDDIEIRCPKQIEKEL

SEQ ID NO: 2486426 - protein, 25 aa, Entamoeba dispar
IKDFELHSSSLLKYCQRDFLEHVTI

SEQ ID NO: 2486427 - protein, 23 aa, Entamoeba dispar
IKDFERRNRLIITRLKEEENKGK

SEQ ID NO: 2486428 - protein, 17 aa, Entamoeba dispar
IKDFMIQGGDFTRHNGT

SEQ ID NO: 2486429 - protein, 18 aa, Entamoeba dispar
IKDFSIKWNKFIENSSFV

SEQ ID NO: 2486430 - protein, 19 aa, Entamoeba dispar
IKDFSKYVINLSYLCIMAC

SEQ ID NO: 2486431 - protein, 20 aa, Entamoeba dispar
IKDFVDAFAKLRNMKKVEEL

SEQ ID NO: 2486432 - protein, 17 aa, Entamoeba dispar
IKDGCYCIGDNGYCKVC

SEQ ID NO: 2486433 - protein, 26 aa, Entamoeba dispar
IKDGDEFPFHISVPIDLPPTIKNDCV

SEQ ID NO: 2486434 - protein, 19 aa, Entamoeba dispar
IKDGETIREKRMKEKESKN

SEQ ID NO: 2486435 - protein, 17 aa, Entamoeba dispar
IKDGMVLDSHLIATFTQ

SEQ ID NO: 2486436 - protein, 21 aa, Entamoeba dispar
IKDGSTCLCIFICDKKFYIAN

SEQ ID NO: 2486437 - protein, 24 aa, Entamoeba dispar
IKDIKRITNILINLFLDKPSNAAR

SEQ ID NO: 2486438 - protein, 18 aa, Entamoeba dispar
IKDIKYILLKIIRKITKK

SEQ ID NO: 2486439 - protein, 22 aa, Entamoeba dispar
IKDIPEFGALLIYSCEHCFNGT

SEQ ID NO: 2486440 - protein, 20 aa, Entamoeba dispar
IKDIPSLYLYTISDAQHACS

SEQ ID NO: 2486441 - protein, 24 aa, Entamoeba dispar
IKDKEWLDVFQLKGYTSMTYSNDW

SEQ ID NO: 2486442 - protein, 25 aa, Entamoeba dispar
IKDKKKLKIVIIIRLIIEIVEKETD

SEQ ID NO: 2486443 - protein, 22 aa, Entamoeba dispar
IKDLDYLIGPILYQENWKDLIK

SEQ ID NO: 2486444 - protein, 25 aa, Entamoeba dispar
IKDLKCFGLGIGPIIWMKGELASSN

SEQ ID NO: 2486445 - protein, 21 aa, Entamoeba dispar
IKDLNGGIIYNILARNDTQRI

SEQ ID NO: 2486446 - protein, 25 aa, Entamoeba dispar
IKDNYAFTSVCMFKPIETSPFFIPQ

SEQ ID NO: 2486447 - protein, 19 aa, Entamoeba dispar
IKDRRTMSLHSFHHRCSEE

SEQ ID NO: 2486448 - protein, 24 aa, Entamoeba dispar
IKDSLRPLLFIFREIDPLCTLQLE

SEQ ID NO: 2486449 - protein, 28 aa, Entamoeba dispar
IKDTLFYYRMMWNLDVGPSYSLPPKSAT

SEQ ID NO: 2486450 - protein, 24 aa, Entamoeba dispar
IKDTYFKFRLIQVDFPIKQEDVEK

SEQ ID NO: 2486451 - protein, 17 aa, Entamoeba dispar
IKDVLLESLGYHIFPIF

SEQ ID NO: 2486452 - protein, 17 aa, Entamoeba dispar
IKDVYYILCSFDGDKNT

SEQ ID NO: 2486453 - protein, 26 aa, Entamoeba dispar
IKDWKCELESPLKLTIEFTHQQLRED

SEQ ID NO: 2486454 - protein, 24 aa, Entamoeba dispar
IKDYNCDRLILFDGGFKIINEDEI

SEQ ID NO: 2486455 - protein, 25 aa, Entamoeba dispar
IKDYNCDRLILFDGGFKIINEDEII

SEQ ID NO: 2486456 - protein, 17 aa, Entamoeba dispar
IKEACSTFGFPPISNTL

SEQ ID NO: 2486457 - protein, 18 aa, Entamoeba dispar
IKECFRNLQSRSITCLNE

SEQ ID NO: 2486458 - protein, 19 aa, Entamoeba dispar
IKECFRNLQSRSITCLNEI

SEQ ID NO: 2486459 - protein, 22 aa, Entamoeba dispar
IKECFRNLQSRSITCLNEIDKQ

SEQ ID NO: 2486460 - protein, 17 aa, Entamoeba dispar
IKECIDFKPNIGKKMLE

SEQ ID NO: 2486461 - protein, 21 aa, Entamoeba dispar
IKEDYCRRLINSIKRGDDITT

SEQ ID NO: 2486462 - protein, 18 aa, Entamoeba dispar
IKEEKYYGLIPFNNCWPA

SEQ ID NO: 2486463 - protein, 21 aa, Entamoeba dispar
IKEEMKTALIWWNNHSDEERR

SEQ ID NO: 2486464 - protein, 26 aa, Entamoeba dispar
IKEEVITPITMNWILYGYRASKNIDG

SEQ ID NO: 2486465 - protein, 24 aa, Entamoeba dispar
IKEFGKGCFVNCSLAVNTLYVPEE

SEQ ID NO: 2486466 - protein, 21 aa, Entamoeba dispar
IKEFIRFGFIEMSQRCERDKR

SEQ ID NO: 2486467 - protein, 18 aa, Entamoeba dispar
IKEFPREIIGGIDDIVGF

SEQ ID NO: 2486468 - protein, 29 aa, Entamoeba dispar
IKEGGSWKTWKKRMFKLSKEKIEYFKDEG

SEQ ID NO: 2486469 - protein, 17 aa, Entamoeba dispar
IKEGIEFCCKITEGVLL

SEQ ID NO: 2486470 - protein, 22 aa, Entamoeba dispar
IKEGIMSQYFFTIFFNDLTIYG

SEQ ID NO: 2486471 - protein, 19 aa, Entamoeba dispar
IKEGIYWEGGKVSLFKEKI

SEQ ID NO: 2486472 - protein, 17 aa, Entamoeba dispar
IKEGLAVMNRAKKAAVK

SEQ ID NO: 2486473 - protein, 30 aa, Entamoeba dispar
IKEGMFIRPTPRRLNVTIVPPPSSNKPHTI

SEQ ID NO: 2486474 - protein, 20 aa, Entamoeba dispar
IKEIERIRCVKLTGEEAKEI

SEQ ID NO: 2486475 - protein, 21 aa, Entamoeba dispar
IKEIGKYCFKECSSLTSINIP

SEQ ID NO: 2486476 - protein, 26 aa, Entamoeba dispar
IKEIGNSCFHKCLSLKSINIPSTTSK

SEQ ID NO: 2486477 - protein, 25 aa, Entamoeba dispar
IKEIGYKCFYGCSSLKSIDIKNIQY

SEQ ID NO: 2486478 - protein, 18 aa, Entamoeba dispar
IKEIGYRCFWNCESLKSV

SEQ ID NO: 2486479 - protein, 22 aa, Entamoeba dispar
IKEIKEEFQVGVDNILDSYIDI

SEQ ID NO: 2486480 - protein, 18 aa, Entamoeba dispar
IKEILYCQVIEPMKIFIE

SEQ ID NO: 2486481 - protein, 21 aa, Entamoeba dispar
IKEINKFLGKEFVFKVKGKMN

SEQ ID NO: 2486482 - protein, 26 aa, Entamoeba dispar
IKEIPKGLLATIGWEIDGKITYALEG

SEQ ID NO: 2486483 - protein, 18 aa, Entamoeba dispar
IKEIQRLGQLIGKGQYEI

SEQ ID NO: 2486484 - protein, 20 aa, Entamoeba dispar
IKEIRKSKVREIWIDENTQD

SEQ ID NO: 2486485 - protein, 21 aa, Entamoeba dispar
IKEISTFFNLRELNLSNNEIY

SEQ ID NO: 2486486 - protein, 19 aa, Entamoeba dispar
IKEKFIKIFKELQEETQNI

SEQ ID NO: 2486487 - protein, 20 aa, Entamoeba dispar
IKEKFIKIFKELQEETQNII

SEQ ID NO: 2486488 - protein, 29 aa, Entamoeba dispar
IKEKHLRLLWITLIPCLNVSSLTPIDLLE

SEQ ID NO: 2486489 - protein, 19 aa, Entamoeba dispar
IKEKLCYVAEDFNEEMQKA

SEQ ID NO: 2486490 - protein, 24 aa, Entamoeba dispar
IKEKLPEKKQFVLEKPQVVIKPEF

SEQ ID NO: 2486491 - protein, 24 aa, Entamoeba dispar
IKEKMYWLLGHSFTKYGEIYYCKE

SEQ ID NO: 2486492 - protein, 18 aa, Entamoeba dispar
IKEKRKVHQYGFEINELI

SEQ ID NO: 2486493 - protein, 22 aa, Entamoeba dispar
IKEKRLAEMRAIAEKNKYKEVV

SEQ ID NO: 2486494 - protein, 20 aa, Entamoeba dispar
IKEKVELFRKGSWDYTEKEY

SEQ ID NO: 2486495 - protein, 17 aa, Entamoeba dispar
IKEKVVGIFTFTSDSIF

SEQ ID NO: 2486496 - protein, 24 aa, Entamoeba dispar
IKEKWTRYIEFWVLYARYEEKLQH

SEQ ID NO: 2486497 - protein, 19 aa, Entamoeba dispar
IKELCKVSIYGKISAAKLI

SEQ ID NO: 2486498 - protein, 18 aa, Entamoeba dispar
IKELCSYKAISHDQQIIK

SEQ ID NO: 2486499 - protein, 18 aa, Entamoeba dispar
IKELEDIVSGKEEEINKI

SEQ ID NO: 2486500 - protein, 30 aa, Entamoeba dispar
IKELFQLECFTFKIVYNFVNLDEIEDKILK

SEQ ID NO: 2486501 - protein, 18 aa, Entamoeba dispar
IKELLEMGIGVHNAGMFR

SEQ ID NO: 2486502 - protein, 21 aa, Entamoeba dispar
IKELLPHKLFPGNRPTNSIVF

SEQ ID NO: 2486503 - protein, 26 aa, Entamoeba dispar
IKENCDIKVPIVHRQGTYQLVNQHLC

SEQ ID NO: 2486504 - protein, 21 aa, Entamoeba dispar
IKENICGLFLLSQIFKDKEII

SEQ ID NO: 2486505 - protein, 18 aa, Entamoeba dispar
IKEPITSYIIRIPTVNLH

SEQ ID NO: 2486506 - protein, 26 aa, Entamoeba dispar
IKERGERLIKLFGLLDEENFKKMMKK

SEQ ID NO: 2486507 - protein, 19 aa, Entamoeba dispar
IKERVEEWIPGYYRNKRGM

SEQ ID NO: 2486508 - protein, 21 aa, Entamoeba dispar
IKERVELMVNLIFKDDESIKR

SEQ ID NO: 2486509 - protein, 24 aa, Entamoeba dispar
IKESIKYGTCRSCHEHGIFGKLCE

SEQ ID NO: 2486510 - protein, 17 aa, Entamoeba dispar
IKESIPGYYKRKRGMTQ

SEQ ID NO: 2486511 - protein, 17 aa, Entamoeba dispar
IKESIVGVFKRMKVNLE

SEQ ID NO: 2486512 - protein, 24 aa, Entamoeba dispar
IKESLESFVPIPLHSYEKIKRSNS

SEQ ID NO: 2486513 - protein, 18 aa, Entamoeba dispar
IKESSLHFIGYSKLIILV

SEQ ID NO: 2486514 - protein, 24 aa, Entamoeba dispar
IKESYEFKNTIDIFDSKFKVEQII

SEQ ID NO: 2486515 - protein, 22 aa, Entamoeba dispar
IKETKRTFFFWNQENDINSFYK

SEQ ID NO: 2486516 - protein, 25 aa, Entamoeba dispar
IKETSSTIKFCFSSRNIQCIIKRNA

SEQ ID NO: 2486517 - protein, 22 aa, Entamoeba dispar
IKEVCFALSFVCVVEEIQDLKK

SEQ ID NO: 2486518 - protein, 22 aa, Entamoeba dispar
IKEVQYFKGIVYGLINEIGENN

SEQ ID NO: 2486519 - protein, 20 aa, Entamoeba dispar
IKEVRELFRTYGTLRGVRLP

SEQ ID NO: 2486520 - protein, 17 aa, Entamoeba dispar
IKEYCFCGYDLKNSHLI

SEQ ID NO: 2486521 - protein, 19 aa, Entamoeba dispar
IKEYIPCPQPFWDTNGLNE

SEQ ID NO: 2486522 - protein, 25 aa, Entamoeba dispar
IKFFKCPKPSYPLVEYLTDRLYPML

SEQ ID NO: 2486523 - protein, 23 aa, Entamoeba dispar
IKFFKHPTCTTAEINLYKAIGGL

SEQ ID NO: 2486524 - protein, 19 aa, Entamoeba dispar
IKFGRELGLLGSEYKNIIT

SEQ ID NO: 2486525 - protein, 26 aa, Entamoeba dispar
IKFIAETFKTFGFKSNESCVLLLRNC

SEQ ID NO: 2486526 - protein, 28 aa, Entamoeba dispar
IKFLSAKKKWDGIVNMTVPLDFPSCFDF

SEQ ID NO: 2486527 - protein, 20 aa, Entamoeba dispar
IKFNIYKGFGKCVNSYKMEY

SEQ ID NO: 2486528 - protein, 31 aa, Entamoeba dispar
IKFNKSLKTFQCMRCMKLTKIELPITVESIK

SEQ ID NO: 2486529 - protein, 18 aa, Entamoeba dispar
IKFPDPVIKIFYQPYEAK

SEQ ID NO: 2486530 - protein, 20 aa, Entamoeba dispar
IKFSAEQKVYLTGFDGEKIG

SEQ ID NO: 2486531 - protein, 20 aa, Entamoeba dispar
IKFSEIKPKIVIVTQTNIST

SEQ ID NO: 2486532 - protein, 25 aa, Entamoeba dispar
IKFSPEKIDTMIIQAVSLLDDLDKE

SEQ ID NO: 2486533 - protein, 17 aa, Entamoeba dispar
IKFSSLLAIQNDFEEEL

SEQ ID NO: 2486534 - protein, 19 aa, Entamoeba dispar
IKFTFSLSPICDSYYFQDC

SEQ ID NO: 2486535 - protein, 20 aa, Entamoeba dispar
IKFVCKKGISHLVDNKKMKK

SEQ ID NO: 2486536 - protein, 23 aa, Entamoeba dispar
IKFVERIYKWKVLSHFERKDIIE

SEQ ID NO: 2486537 - protein, 20 aa, Entamoeba dispar
IKFVHEFRSILQVTNQEYNE

SEQ ID NO: 2486538 - protein, 29 aa, Entamoeba dispar
IKFYFKDKIWEIIWKCIFEYNKDTIKINI

SEQ ID NO: 2486539 - protein, 17 aa, Entamoeba dispar
IKFYNSIHKLFLYQLSS

SEQ ID NO: 2486540 - protein, 27 aa, Entamoeba dispar
IKGDIKDGCCCIGANGYCKICGCHYTQ

SEQ ID NO: 2486541 - protein, 23 aa, Entamoeba dispar
IKGDMKKNCACIGDKECCTVCKC

SEQ ID NO: 2486542 - protein, 26 aa, Entamoeba dispar
IKGECYTCQCDIWSIGVITYLVLSGN

SEQ ID NO: 2486543 - protein, 20 aa, Entamoeba dispar
IKGELRGCIGCFSPSQPLYE

SEQ ID NO: 2486544 - protein, 17 aa, Entamoeba dispar
IKGIVLASRDLYCIYNP

SEQ ID NO: 2486545 - protein, 31 aa, Entamoeba dispar
IKGKKISCAVLYCWCVSLLLEKLNNTEKVNN

SEQ ID NO: 2486546 - protein, 17 aa, Entamoeba dispar
IKGKNLILFNEKKGESI

SEQ ID NO: 2486547 - protein, 21 aa, Entamoeba dispar
IKGKSEYCWISVGLSSTKTMI

SEQ ID NO: 2486548 - protein, 22 aa, Entamoeba dispar
IKGLLINYFHTFWPSLLKIDNF

SEQ ID NO: 2486549 - protein, 21 aa, Entamoeba dispar
IKGMSTLCCECSCYKPELYGE

SEQ ID NO: 2486550 - protein, 26 aa, Entamoeba dispar
IKGRHFKKLKQWIGLSKYKIIFDSCI

SEQ ID NO: 2486551 - protein, 18 aa, Entamoeba dispar
IKGSCVFNEKVLNHNNLA

SEQ ID NO: 2486552 - protein, 17 aa, Entamoeba dispar
IKGSGFGTSPMVFIGNK

SEQ ID NO: 2486553 - protein, 25 aa, Entamoeba dispar
IKGTAILFCELHFGYDIHIQSRSVS

SEQ ID NO: 2486554 - protein, 17 aa, Entamoeba dispar
IKGTEEWNITFKTVEGI

SEQ ID NO: 2486555 - protein, 17 aa, Entamoeba dispar
IKGYFLSARIFTLYSND

SEQ ID NO: 2486556 - protein, 25 aa, Entamoeba dispar
IKGYLAVVICGFVFIDQECSKRVHL

SEQ ID NO: 2486557 - protein, 24 aa, Entamoeba dispar
IKHEKEEYFEILLPLLGTLVEDKE

SEQ ID NO: 2486558 - protein, 21 aa, Entamoeba dispar
IKHFNIIGGIHPIKLSDQILN

SEQ ID NO: 2486559 - protein, 20 aa, Entamoeba dispar
IKHKYFYIEKGILYSQNITW

SEQ ID NO: 2486560 - protein, 25 aa, Entamoeba dispar
IKHLEEFDWIALFERVHSTIIKSTE

SEQ ID NO: 2486561 - protein, 24 aa, Entamoeba dispar
IKHLRNCLNTYGFCNIEFGNNIQM

SEQ ID NO: 2486562 - protein, 17 aa, Entamoeba dispar
IKHNSYRFGYKGKSKSI

SEQ ID NO: 2486563 - protein, 17 aa, Entamoeba dispar
IKHPDVWSKVKKSKTQI

SEQ ID NO: 2486564 - protein, 20 aa, Entamoeba dispar
IKHYAEKSIDAYIYSLTKMH

SEQ ID NO: 2486565 - protein, 26 aa, Entamoeba dispar
IKIAEFGEALDLFFYVLQQSAERVVL

SEQ ID NO: 2486566 - protein, 27 aa, Entamoeba dispar
IKIASDYCWACFEFKKGKPSVVCSQMK

SEQ ID NO: 2486567 - protein, 17 aa, Entamoeba dispar
IKICPWVITSTYKESEW

SEQ ID NO: 2486568 - protein, 18 aa, Entamoeba dispar
IKIDEMNEEASIKETKIK

SEQ ID NO: 2486569 - protein, 20 aa, Entamoeba dispar
IKIDFIGSIEYSYDRSSTSN

SEQ ID NO: 2486570 - protein, 34 aa, Entamoeba dispar
IKIEGITMHKNCFRCSVCKKILNGANFAKNHGVY

SEQ ID NO: 2486571 - protein, 20 aa, Entamoeba dispar
IKIEIQRRLNIRDNILLKTV

SEQ ID NO: 2486572 - protein, 20 aa, Entamoeba dispar
IKIEIQRRLNIRDNIVLKAV

SEQ ID NO: 2486573 - protein, 21 aa, Entamoeba dispar
IKIETLRILSAYFKLQTTQSS

SEQ ID NO: 2486574 - protein, 18 aa, Entamoeba dispar
IKIFSYESLDEFTQVDAF

SEQ ID NO: 2486575 - protein, 24 aa, Entamoeba dispar
IKIFYKEIRKIFLAVTQMIINLYY

SEQ ID NO: 2486576 - protein, 17 aa, Entamoeba dispar
IKIGCECFLYCTSLKSI

SEQ ID NO: 2486577 - protein, 20 aa, Entamoeba dispar
IKIGDGCFKECSSLKSINIP

SEQ ID NO: 2486578 - protein, 25 aa, Entamoeba dispar
IKIGDGCFYKCRCEKSLKKNKRIPE

SEQ ID NO: 2486579 - protein, 26 aa, Entamoeba dispar
IKIGGGCCFYVCPSLTSINIPSSISK

SEQ ID NO: 2486580 - protein, 21 aa, Entamoeba dispar
IKIGLLGDMGVGKTCIVQRFC

SEQ ID NO: 2486581 - protein, 17 aa, Entamoeba dispar
IKIGLPIIQLSSIDIGT

SEQ ID NO: 2486582 - protein, 25 aa, Entamoeba dispar
IKIIEPIIAYMLFKNIIIREKRIHS

SEQ ID NO: 2486583 - protein, 30 aa, Entamoeba dispar
IKIIKEMFPELLQRILLASKISFEKSKEGG

SEQ ID NO: 2486584 - protein, 17 aa, Entamoeba dispar
IKIIKKEIEIIFSEING

SEQ ID NO: 2486585 - protein, 20 aa, Entamoeba dispar
IKIILIVEGLTFYQKGIDAV

SEQ ID NO: 2486586 - protein, 17 aa, Entamoeba dispar
IKIIMELGRSELLNTDQ

SEQ ID NO: 2486587 - protein, 17 aa, Entamoeba dispar
IKIKCIIMNTIPNNDLL

SEQ ID NO: 2486588 - protein, 24 aa, Entamoeba dispar
IKIKEGNGVIDLRELKTMSLRIEL

SEQ ID NO: 2486589 - protein, 34 aa, Entamoeba dispar
IKIKEMFIERFRIIKEFTEYMIQYINWYNWLERD

SEQ ID NO: 2486590 - protein, 18 aa, Entamoeba dispar
IKIKGIGIASGIEAFCKQ

SEQ ID NO: 2486591 - protein, 23 aa, Entamoeba dispar
IKIKKLSKDICMIIFDSIEEYFI

SEQ ID NO: 2486592 - protein, 24 aa, Entamoeba dispar
IKIKRMYHDIMICIHSNFIQINDK

SEQ ID NO: 2486593 - protein, 20 aa, Entamoeba dispar
IKIKSEFIVELIGVERRKEI

SEQ ID NO: 2486594 - protein, 24 aa, Entamoeba dispar
IKILESKTMWGFDCSPINNEIESI

SEQ ID NO: 2486595 - protein, 20 aa, Entamoeba dispar
IKILKGIKLYLPNIVLLDSN

SEQ ID NO: 2486596 - protein, 19 aa, Entamoeba dispar
IKILPRRLFIQNDTNELFK

SEQ ID NO: 2486597 - protein, 26 aa, Entamoeba dispar
IKILQKKLSEFIVRSEGIIKNSSFSP

SEQ ID NO: 2486598 - protein, 21 aa, Entamoeba dispar
IKILRKCLIGNSHLVKDVDRT

SEQ ID NO: 2486599 - protein, 26 aa, Entamoeba dispar
IKIMTRFCLLYSYFPLQETIDVYEEI

SEQ ID NO: 2486600 - protein, 24 aa, Entamoeba dispar
IKINEILKELGIEIEHQITVDNIE

SEQ ID NO: 2486601 - protein, 26 aa, Entamoeba dispar
IKIPHCSVCNCVICTINENLDIFSFL

SEQ ID NO: 2486602 - protein, 24 aa, Entamoeba dispar
IKIPKEINLGIVMGTFAIHLSDKG

SEQ ID NO: 2486603 - protein, 17 aa, Entamoeba dispar
IKIPMFYVDSCPDEDDD

SEQ ID NO: 2486604 - protein, 17 aa, Entamoeba dispar
IKIPRIEGDFTGVGDTL

SEQ ID NO: 2486605 - protein, 17 aa, Entamoeba dispar
IKIQFKFNLKELSVSSS

SEQ ID NO: 2486606 - protein, 20 aa, Entamoeba dispar
IKIRIINTIRTNNRIEENKE

SEQ ID NO: 2486607 - protein, 22 aa, Entamoeba dispar
IKISDFGLSFFVSDNEVGHKTS

SEQ ID NO: 2486608 - protein, 24 aa, Entamoeba dispar
IKISELKEGNLFVELFEKLSQTKL

SEQ ID NO: 2486609 - protein, 17 aa, Entamoeba dispar
IKISIGKLKVIDIEKKE

SEQ ID NO: 2486610 - protein, 18 aa, Entamoeba dispar
IKITDDFRYIIINEDNLK

SEQ ID NO: 2486611 - protein, 20 aa, Entamoeba dispar
IKITRNYLFIVFENMVSIMD

SEQ ID NO: 2486612 - protein, 20 aa, Entamoeba dispar
IKIYLEYLEEYYGINEDEIK

SEQ ID NO: 2486613 - protein, 18 aa, Entamoeba dispar
IKIYLKFLPENGYITENG

SEQ ID NO: 2486614 - protein, 22 aa, Entamoeba dispar
IKKAEIMHLVLLNGEPPSAISQ

SEQ ID NO: 2486615 - protein, 18 aa, Entamoeba dispar
IKKALKFHKDVVGSAPTG

SEQ ID NO: 2486616 - protein, 17 aa, Entamoeba dispar
IKKALPYITSAVGNITF

SEQ ID NO: 2486617 - protein, 17 aa, Entamoeba dispar
IKKAVFVKDDQLFTVYN

SEQ ID NO: 2486618 - protein, 17 aa, Entamoeba dispar
IKKCKYCHQNINRNESY

SEQ ID NO: 2486619 - protein, 27 aa, Entamoeba dispar
IKKCYAKEDLHSFIPIFDSKRIQLIPT

SEQ ID NO: 2486620 - protein, 19 aa, Entamoeba dispar
IKKDIKILKGIKLYLPNIV

SEQ ID NO: 2486621 - protein, 17 aa, Entamoeba dispar
IKKECRKNIRINGEPLV

SEQ ID NO: 2486622 - protein, 21 aa, Entamoeba dispar
IKKEKQVIFMIYQNMNNLEQL

SEQ ID NO: 2486623 - protein, 17 aa, Entamoeba dispar
IKKEVLPSLPTRQEKFI

SEQ ID NO: 2486624 - protein, 19 aa, Entamoeba dispar
IKKFCTGMVDVIKHVLDIV

SEQ ID NO: 2486625 - protein, 25 aa, Entamoeba dispar
IKKGNPFIIHGCVTTLKYIVCEPYS

SEQ ID NO: 2486626 - protein, 18 aa, Entamoeba dispar
IKKHYKIQEEQLRKLEEE

SEQ ID NO: 2486627 - protein, 18 aa, Entamoeba dispar
IKKIHGFSSEFTTQVDGI

SEQ ID NO: 2486628 - protein, 25 aa, Entamoeba dispar
IKKIKTPYYLYAFSVIQYILAKTNH

SEQ ID NO: 2486629 - protein, 20 aa, Entamoeba dispar
IKKIYCIGRSVDLSELNKKM

SEQ ID NO: 2486630 - protein, 23 aa, Entamoeba dispar
IKKKCLSFNSLALFSNVAIENQY

SEQ ID NO: 2486631 - protein, 19 aa, Entamoeba dispar
IKKKLFLTFVHHINQFFDN

SEQ ID NO: 2486632 - protein, 17 aa, Entamoeba dispar
IKKKSCEQVDVIESNDL

SEQ ID NO: 2486633 - protein, 33 aa, Entamoeba dispar
IKKLIASCGIDWVKSRILPSVISLASSGLYHHR

SEQ ID NO: 2486634 - protein, 21 aa, Entamoeba dispar
IKKLKNLNCPALPKIYETNES

SEQ ID NO: 2486635 - protein, 18 aa, Entamoeba dispar
IKKMGSMVAASSFYLNKW

SEQ ID NO: 2486636 - protein, 23 aa, Entamoeba dispar
IKKMKINALIPARMQCVIDALLV

SEQ ID NO: 2486637 - protein, 22 aa, Entamoeba dispar
IKKNKFPSVVYVLLVSSVDLEL

SEQ ID NO: 2486638 - protein, 29 aa, Entamoeba dispar
IKKPKRFVVESLFDIPLMKSLEPNITEMK

SEQ ID NO: 2486639 - protein, 17 aa, Entamoeba dispar
IKKRQYNSLDFVGDDIQ

SEQ ID NO: 2486640 - protein, 17 aa, Entamoeba dispar
IKKRYNITEEDIKSMKE

SEQ ID NO: 2486641 - protein, 21 aa, Entamoeba dispar
IKKSGVFKIRIKKKKEKNNNI

SEQ ID NO: 2486642 - protein, 26 aa, Entamoeba dispar
IKKSKEWKVDTLILKKYPALVDEILS

SEQ ID NO: 2486643 - protein, 23 aa, Entamoeba dispar
IKKSSLVQFVIELLKYFENGEVI

SEQ ID NO: 2486644 - protein, 21 aa, Entamoeba dispar
IKKSTLASFVVRTENDKKKLR

SEQ ID NO: 2486645 - protein, 24 aa, Entamoeba dispar
IKKYEFAFCPLFCVGLTEEFDTND

SEQ ID NO: 2486646 - protein, 32 aa, Entamoeba dispar
IKKYKMTVFIPMHFPRFSTMQGNRCKENLELL

SEQ ID NO: 2486647 - protein, 18 aa, Entamoeba dispar
IKKYLKRHPLLIEEEILE

SEQ ID NO: 2486648 - protein, 22 aa, Entamoeba dispar
IKKYLKRHPLLIEEEIPEELIE

SEQ ID NO: 2486649 - protein, 26 aa, Entamoeba dispar
IKKYPNCKEWDIGIVTPYRQQLLLIK

SEQ ID NO: 2486650 - protein, 29 aa, Entamoeba dispar
IKKYPTCRMLLKHCIDLTIRCLEEMDLSY

SEQ ID NO: 2486651 - protein, 20 aa, Entamoeba dispar
IKKYRVLKIVGWGTFGIVVG

SEQ ID NO: 2486652 - protein, 21 aa, Entamoeba dispar
IKKYVVDFVQMWIEAINPEFH

SEQ ID NO: 2486653 - protein, 18 aa, Entamoeba dispar
IKLDVQIILKSATLNLRP

SEQ ID NO: 2486654 - protein, 20 aa, Entamoeba dispar
IKLECYKAAISDAERCVEID

SEQ ID NO: 2486655 - protein, 25 aa, Entamoeba dispar
IKLEFKRNSFKDVILKQCNDIIIKG

SEQ ID NO: 2486656 - protein, 17 aa, Entamoeba dispar
IKLEGTVVLTDFLRKEH

SEQ ID NO: 2486657 - protein, 23 aa, Entamoeba dispar
IKLEIKPSNAFELIQLTNEEITS

SEQ ID NO: 2486658 - protein, 21 aa, Entamoeba dispar
IKLEPCQELSLIIEKPKDGIS

SEQ ID NO: 2486659 - protein, 17 aa, Entamoeba dispar
IKLFGLLFEHCKYEKSY

SEQ ID NO: 2486660 - protein, 17 aa, Entamoeba dispar
IKLFNGTLFWLKQNNTI

SEQ ID NO: 2486661 - protein, 19 aa, Entamoeba dispar
IKLFNGVSEIECHVKDIEL

SEQ ID NO: 2486662 - protein, 26 aa, Entamoeba dispar
IKLFPSDKIPIHFTKINIEIVENYGI

SEQ ID NO: 2486663 - protein, 18 aa, Entamoeba dispar
IKLGDFGLSRVFRSESKH

SEQ ID NO: 2486664 - protein, 18 aa, Entamoeba dispar
IKLGMSLKPQKIIKNVLY

SEQ ID NO: 2486665 - protein, 17 aa, Entamoeba dispar
IKLGPFDIACFQFSLYK

SEQ ID NO: 2486666 - protein, 24 aa, Entamoeba dispar
IKLIDFGSACFERSTLYTYIQSRH

SEQ ID NO: 2486667 - protein, 20 aa, Entamoeba dispar
IKLIDFRKMEIEDSHELKEN

SEQ ID NO: 2486668 - protein, 21 aa, Entamoeba dispar
IKLIIIDSIPTFYKKTICNDT

SEQ ID NO: 2486669 - protein, 21 aa, Entamoeba dispar
IKLKIPIGLGEFSRFVQIKER

SEQ ID NO: 2486670 - protein, 22 aa, Entamoeba dispar
IKLKRRGSTMIHTTDFSNSDKL

SEQ ID NO: 2486671 - protein, 19 aa, Entamoeba dispar
IKLKRRSFMFKDKKDKDRN

SEQ ID NO: 2486672 - protein, 19 aa, Entamoeba dispar
IKLLQKIQLIFTEQRDQIL

SEQ ID NO: 2486673 - protein, 18 aa, Entamoeba dispar
IKLLTEFQSLVNYESNFK

SEQ ID NO: 2486674 - protein, 28 aa, Entamoeba dispar
IKLLYPIAPHFCDYVWRDLLGNKTFLWN

SEQ ID NO: 2486675 - protein, 18 aa, Entamoeba dispar
IKLMKTIYNRIILEGPSV

SEQ ID NO: 2486676 - protein, 19 aa, Entamoeba dispar
IKLNDEIISTIELDKKTKI

SEQ ID NO: 2486677 - protein, 17 aa, Entamoeba dispar
IKLNDKLFKTIELDKKT

SEQ ID NO: 2486678 - protein, 23 aa, Entamoeba dispar
IKLNRDTIRSLYPSIPIICATSN

SEQ ID NO: 2486679 - protein, 20 aa, Entamoeba dispar
IKLNSSLKQNVIYSYTDLVR

SEQ ID NO: 2486680 - protein, 25 aa, Entamoeba dispar
IKLPTEFLPYAFNWLLQFTSVPDQD

SEQ ID NO: 2486681 - protein, 17 aa, Entamoeba dispar
IKLQPWKEENSLVKNSR

SEQ ID NO: 2486682 - protein, 17 aa, Entamoeba dispar
IKLRKAFDKLYKNTISQ

SEQ ID NO: 2486683 - protein, 17 aa, Entamoeba dispar
IKLRSLFSLTSNYKRYR

SEQ ID NO: 2486684 - protein, 25 aa, Entamoeba dispar
IKLSKDLHCLNNFLTHLNYIYQSIL

SEQ ID NO: 2486685 - protein, 22 aa, Entamoeba dispar
IKLSKKIYQVFKMNTKINKILN

SEQ ID NO: 2486686 - protein, 22 aa, Entamoeba dispar
IKLTKEFLMNMSYLFNNQPNLK

SEQ ID NO: 2486687 - protein, 18 aa, Entamoeba dispar
IKLTRMHTSLSRNGTIDL

SEQ ID NO: 2486688 - protein, 26 aa, Entamoeba dispar
IKLTSPEFFEFFSFIDNLLMNEAVAL

SEQ ID NO: 2486689 - protein, 25 aa, Entamoeba dispar
IKLVDLDISFNIPKFKFICNGTLCN

SEQ ID NO: 2486690 - protein, 18 aa, Entamoeba dispar
IKLYINMEKIEIIYNKQE

SEQ ID NO: 2486691 - protein, 17 aa, Entamoeba dispar
IKLYLLFYEKSYEMIKY

SEQ ID NO: 2486692 - protein, 21 aa, Entamoeba dispar
IKLYNKFVVSRVLQDFKREYP

SEQ ID NO: 2486693 - protein, 17 aa, Entamoeba dispar
IKMEPIFDLLSRHWQNP

SEQ ID NO: 2486694 - protein, 18 aa, Entamoeba dispar
IKMICSRYPKVIKGSCIS

SEQ ID NO: 2486695 - protein, 20 aa, Entamoeba dispar
IKMIKKRYPLSEVEMTEAAI

SEQ ID NO: 2486696 - protein, 22 aa, Entamoeba dispar
IKMKDLRLAAELQKKKLGDKVE

SEQ ID NO: 2486697 - protein, 24 aa, Entamoeba dispar
IKMKEVLTNVSWKYHRTTTISSQY

SEQ ID NO: 2486698 - protein, 24 aa, Entamoeba dispar
IKMKRARMGEACKLCDRPFDVYKW

SEQ ID NO: 2486699 - protein, 25 aa, Entamoeba dispar
IKMLRLVDPYITYGYPTLETVQKLI

SEQ ID NO: 2486700 - protein, 17 aa, Entamoeba dispar
IKMNRPQLICIPRDINK

SEQ ID NO: 2486701 - protein, 20 aa, Entamoeba dispar
IKMVCRSAIDGLIRKLEHQY

SEQ ID NO: 2486702 - protein, 19 aa, Entamoeba dispar
IKNAEILMKYFHAHGRLEE

SEQ ID NO: 2486703 - protein, 19 aa, Entamoeba dispar
IKNDIKVITFYEFNIESKT

SEQ ID NO: 2486704 - protein, 20 aa, Entamoeba dispar
IKNDTVGVCEWSHDEQTSLD

SEQ ID NO: 2486705 - protein, 20 aa, Entamoeba dispar
IKNEELAIMADLEKLIKGIN

SEQ ID NO: 2486706 - protein, 23 aa, Entamoeba dispar
IKNEIQSLLFLCGCPSVNEAHSI

SEQ ID NO: 2486707 - protein, 18 aa, Entamoeba dispar
IKNEKVCLFLLIYCECNM

SEQ ID NO: 2486708 - protein, 23 aa, Entamoeba dispar
IKNFVDRTVCLFDMKTYGIKPSL

SEQ ID NO: 2486709 - protein, 20 aa, Entamoeba dispar
IKNGIKLFGTDVSKWNINFN

SEQ ID NO: 2486710 - protein, 19 aa, Entamoeba dispar
IKNGLSLDNLGDWLRTVAY

SEQ ID NO: 2486711 - protein, 17 aa, Entamoeba dispar
IKNGMWLKQAYNLCPQL

SEQ ID NO: 2486712 - protein, 17 aa, Entamoeba dispar
IKNIIGLWSTWKDQTEL

SEQ ID NO: 2486713 - protein, 29 aa, Entamoeba dispar
IKNKELLKRITFCYKECYKKGFDNEILIQ

SEQ ID NO: 2486714 - protein, 27 aa, Entamoeba dispar
IKNKELLKRITFCYKECYNNMSNSVII

SEQ ID NO: 2486715 - protein, 18 aa, Entamoeba dispar
IKNKLDILSVDDIPKVIH

SEQ ID NO: 2486716 - protein, 21 aa, Entamoeba dispar
IKNNCFYGCYSLKSINIPSSV

SEQ ID NO: 2486717 - protein, 33 aa, Entamoeba dispar
IKNNVPIKFVKREVNSYSTWLFPDDSENILCFA

SEQ ID NO: 2486718 - protein, 23 aa, Entamoeba dispar
IKNPFFQKACTKIEFADFVSRVE

SEQ ID NO: 2486719 - protein, 24 aa, Entamoeba dispar
IKNPLQCSSLNWILQNVSKEEIMA

SEQ ID NO: 2486720 - protein, 18 aa, Entamoeba dispar
IKNQIGWVAKGIGSLKWW

SEQ ID NO: 2486721 - protein, 18 aa, Entamoeba dispar
IKNRILYKIIKLNNIKTK

SEQ ID NO: 2486722 - protein, 22 aa, Entamoeba dispar
IKNRNTREWGDIMTTYVMLKYR

SEQ ID NO: 2486723 - protein, 19 aa, Entamoeba dispar
IKNRTAFEKWNKVEVLLID

SEQ ID NO: 2486724 - protein, 20 aa, Entamoeba dispar
IKNYCYPTFNAIQNLLNENR

SEQ ID NO: 2486725 - protein, 18 aa, Entamoeba dispar
IKPANILISDDCEIKLTD

SEQ ID NO: 2486726 - protein, 17 aa, Entamoeba dispar
IKPESKLSMIFNNIKKE

SEQ ID NO: 2486727 - protein, 17 aa, Entamoeba dispar
IKPESKLTMIFNNIKKE

SEQ ID NO: 2486728 - protein, 27 aa, Entamoeba dispar
IKPFQFLHCHILRGYLQITLKVEGFEF

SEQ ID NO: 2486729 - protein, 28 aa, Entamoeba dispar
IKPFQFLHCHILRGYLQITLKVEGFEFE

SEQ ID NO: 2486730 - protein, 21 aa, Entamoeba dispar
IKPHKSGVLQLGVIDSYHFCS

SEQ ID NO: 2486731 - protein, 26 aa, Entamoeba dispar
IKPIESLSAFIYRLPHSSSLFDHKVI

SEQ ID NO: 2486732 - protein, 18 aa, Entamoeba dispar
IKPKIVIVTQTNISTGVY

SEQ ID NO: 2486733 - protein, 31 aa, Entamoeba dispar
IKPKIYKRRVDGILPTLCLWSNENQENVFSV

SEQ ID NO: 2486734 - protein, 20 aa, Entamoeba dispar
IKPLAFSNCRSLTKVELPSF

SEQ ID NO: 2486735 - protein, 18 aa, Entamoeba dispar
IKPLYSMEKTIGMMEKEE

SEQ ID NO: 2486736 - protein, 32 aa, Entamoeba dispar
IKPMVESLGVQWEEFISLFKYSTPEDLFDLLI

SEQ ID NO: 2486737 - protein, 26 aa, Entamoeba dispar
IKPNFPELFLPYTLPKSSAALFTFCE

SEQ ID NO: 2486738 - protein, 19 aa, Entamoeba dispar
IKPPTTITRSHIGINPKTG

SEQ ID NO: 2486739 - protein, 26 aa, Entamoeba dispar
IKPQIVVFSCKSFIFKKTSNFKYGII

SEQ ID NO: 2486740 - protein, 18 aa, Entamoeba dispar
IKPSINLFQSNKKAAEIF

SEQ ID NO: 2486741 - protein, 20 aa, Entamoeba dispar
IKPSLDCLTEYLQTNKIPSN

SEQ ID NO: 2486742 - protein, 19 aa, Entamoeba dispar
IKPSPQFVIEGDIVYTSVF

SEQ ID NO: 2486743 - protein, 18 aa, Entamoeba dispar
IKPTMEIKSKLSTQPVIK

SEQ ID NO: 2486744 - protein, 26 aa, Entamoeba dispar
IKPTNSCKWCQESLLSVISEEGVQFH

SEQ ID NO: 2486745 - protein, 18 aa, Entamoeba dispar
IKPVPKWNVPVEEEKMTF

SEQ ID NO: 2486746 - protein, 23 aa, Entamoeba dispar
IKPWKGGDMIGLVSGGKDKQVRL

SEQ ID NO: 2486747 - protein, 19 aa, Entamoeba dispar
IKPWMKSPEIKRIITNEFM

SEQ ID NO: 2486748 - protein, 23 aa, Entamoeba dispar
IKQFIEKLIRKFGEDTVEEGVVG

SEQ ID NO: 2486749 - protein, 22 aa, Entamoeba dispar
IKQIVYFLFKFKNLTEELKKEY

SEQ ID NO: 2486750 - protein, 26 aa, Entamoeba dispar
IKQKNILMGISFLENIEKLCGKFFDN

SEQ ID NO: 2486751 - protein, 22 aa, Entamoeba dispar
IKQKRNGIDFGPFDVTKVMEFE

SEQ ID NO: 2486752 - protein, 18 aa, Entamoeba dispar
IKQLFLDNNFQLLKENNL

SEQ ID NO: 2486753 - protein, 22 aa, Entamoeba dispar
IKQPENAFIMWDKNNNYLFGFG

SEQ ID NO: 2486754 - protein, 19 aa, Entamoeba dispar
IKQQEWFKTFRIQFVGEQG

SEQ ID NO: 2486755 - protein, 17 aa, Entamoeba dispar
IKQQKECEHAGERYEQL

SEQ ID NO: 2486756 - protein, 20 aa, Entamoeba dispar
IKQQRIIEITQIYSNKQLEY

SEQ ID NO: 2486757 - protein, 25 aa, Entamoeba dispar
IKQRLKEAVQWPLRFKEQLDKFHIR

SEQ ID NO: 2486758 - protein, 23 aa, Entamoeba dispar
IKQRVIGKCWLIFNKPKYIENVK

SEQ ID NO: 2486759 - protein, 32 aa, Entamoeba dispar
IKQSLLLLFRSICIDEKIESYNFIPFINSLIE

SEQ ID NO: 2486760 - protein, 24 aa, Entamoeba dispar
IKQSSFKFIQWVSSSNDVEFIRLF

SEQ ID NO: 2486761 - protein, 19 aa, Entamoeba dispar
IKQTYEIFYLNRDKVNNNQ

SEQ ID NO: 2486762 - protein, 28 aa, Entamoeba dispar
IKQVFSSLFFLRYCFLPLVKYPSLLKIL

SEQ ID NO: 2486763 - protein, 19 aa, Entamoeba dispar
IKQVSIIKLFGLLFEHCKY

SEQ ID NO: 2486764 - protein, 25 aa, Entamoeba dispar
IKQYETVCKIVELFEQSTEPPMEIV

SEQ ID NO: 2486765 - protein, 23 aa, Entamoeba dispar
IKREVPDYCLIKAGFTNSLTINH

SEQ ID NO: 2486766 - protein, 21 aa, Entamoeba dispar
IKRFIEKKSMEGYYREKIELR

SEQ ID NO: 2486767 - protein, 21 aa, Entamoeba dispar
IKRFKECVDNIDLIEGFEMKE

SEQ ID NO: 2486768 - protein, 31 aa, Entamoeba dispar
IKRIYNGISKPEFWQHLCIILTNCYCYIPEK

SEQ ID NO: 2486769 - protein, 19 aa, Entamoeba dispar
IKRLESIPKSSDLSIECGD

SEQ ID NO: 2486770 - protein, 18 aa, Entamoeba dispar
IKRLLPSQWKIVLDDPLL

SEQ ID NO: 2486771 - protein, 24 aa, Entamoeba dispar
IKRMKEIIDQISFTLSQIEMNNKK

SEQ ID NO: 2486772 - protein, 21 aa, Entamoeba dispar
IKRMLVVDVNQRINIENCLLH

SEQ ID NO: 2486773 - protein, 24 aa, Entamoeba dispar
IKRNEIRVKLKLKKIYDNMRNTIE

SEQ ID NO: 2486774 - protein, 25 aa, Entamoeba dispar
IKRNIPREFYDSVSYEEYVHTKNSE

SEQ ID NO: 2486775 - protein, 19 aa, Entamoeba dispar
IKRQCLVINTLKYIYFRIE

SEQ ID NO: 2486776 - protein, 20 aa, Entamoeba dispar
IKRQIVLCSATLTGDVIEIG

SEQ ID NO: 2486777 - protein, 22 aa, Entamoeba dispar
IKRRPKNCIVGLKKLIQVHSIE

SEQ ID NO: 2486778 - protein, 19 aa, Entamoeba dispar
IKRSKSMPFLFFKEEEEDF

SEQ ID NO: 2486779 - protein, 24 aa, Entamoeba dispar
IKRTKRTPPIKIIDTPGFGDTRGD

SEQ ID NO: 2486780 - protein, 19 aa, Entamoeba dispar
IKRVRTWQSLHPSIEKEEG

SEQ ID NO: 2486781 - protein, 18 aa, Entamoeba dispar
IKRYESYLKKHTKLPSGY

SEQ ID NO: 2486782 - protein, 20 aa, Entamoeba dispar
IKRYTVEVVTMWYRPPELIQ

SEQ ID NO: 2486783 - protein, 22 aa, Entamoeba dispar
IKRYTVEVVTMWYRPPELIQKY

SEQ ID NO: 2486784 - protein, 18 aa, Entamoeba dispar
IKSAHILDPNVTLGTVVK

SEQ ID NO: 2486785 - protein, 25 aa, Entamoeba dispar
IKSAMKEWYDGGAVQMSPMKQKAKE

SEQ ID NO: 2486786 - protein, 19 aa, Entamoeba dispar
IKSCIKIVLDAANDCEIEC

SEQ ID NO: 2486787 - protein, 17 aa, Entamoeba dispar
IKSDEPYAFQIRFAGVK

SEQ ID NO: 2486788 - protein, 22 aa, Entamoeba dispar
IKSDGIGKGFALWLTTKPIVSG

SEQ ID NO: 2486789 - protein, 22 aa, Entamoeba dispar
IKSEACWLLANTIFKINDSMYN

SEQ ID NO: 2486790 - protein, 21 aa, Entamoeba dispar
IKSEIKITDFGTARIVGEGEM

SEQ ID NO: 2486791 - protein, 19 aa, Entamoeba dispar
IKSFCSIAAHAPTIDLSPF

SEQ ID NO: 2486792 - protein, 17 aa, Entamoeba dispar
IKSGAFYQCCSLTSVTI

SEQ ID NO: 2486793 - protein, 17 aa, Entamoeba dispar
IKSGNPINFEYTTLNKV

SEQ ID NO: 2486794 - protein, 22 aa, Entamoeba dispar
IKSHPWFEGINWNTLLSESRED

SEQ ID NO: 2486795 - protein, 20 aa, Entamoeba dispar
IKSIDFWENFDLQRPKGVIV

SEQ ID NO: 2486796 - protein, 22 aa, Entamoeba dispar
IKSIKLTCCESFNEEVIKLVKK

SEQ ID NO: 2486797 - protein, 18 aa, Entamoeba dispar
IKSLCSMAIRVIAQEPSL

SEQ ID NO: 2486798 - protein, 25 aa, Entamoeba dispar
IKSLFKEIEMIYSFNHKQEHPFELI

SEQ ID NO: 2486799 - protein, 19 aa, Entamoeba dispar
IKSLPFFKVKTLYNVYESI

SEQ ID NO: 2486800 - protein, 20 aa, Entamoeba dispar
IKSMKELYNYNGSNNILSVE

SEQ ID NO: 2486801 - protein, 30 aa, Entamoeba dispar
IKSPKELLKLLSIKDFYLMFMLFFDDDNTK

SEQ ID NO: 2486802 - protein, 38 aa, Entamoeba dispar
IKSQEKYDGVGIIPLDCPWYICYFMGRPQAHFVCTTQN

SEQ ID NO: 2486803 - protein, 21 aa, Entamoeba dispar
IKSRVGVLLCGKSGCGKTSLA

SEQ ID NO: 2486804 - protein, 20 aa, Entamoeba dispar
IKSSFSLPFDKILKNCVIAN

SEQ ID NO: 2486805 - protein, 19 aa, Entamoeba dispar
IKSSIPYFKTIKNTFLTKT

SEQ ID NO: 2486806 - protein, 22 aa, Entamoeba dispar
IKSTILMFKKMSSITVYHTQHY

SEQ ID NO: 2486807 - protein, 18 aa, Entamoeba dispar
IKSTLNIGLDDGGRVSIL

SEQ ID NO: 2486808 - protein, 17 aa, Entamoeba dispar
IKSTNFLVASCRRATEK

SEQ ID NO: 2486809 - protein, 20 aa, Entamoeba dispar
IKSVIKKFHFISHKQFMVCE

SEQ ID NO: 2486810 - protein, 24 aa, Entamoeba dispar
IKTAIRLFELITKYVFIRRVGGGV

SEQ ID NO: 2486811 - protein, 19 aa, Entamoeba dispar
IKTAKGEELRRDCDQVARL

SEQ ID NO: 2486812 - protein, 24 aa, Entamoeba dispar
IKTGESYCKIIVYLRNRGENSLNH

SEQ ID NO: 2486813 - protein, 17 aa, Entamoeba dispar
IKTGFERYIPSIMSNVI

SEQ ID NO: 2486814 - protein, 23 aa, Entamoeba dispar
IKTGKICGICIEKNFNGNSDYII

SEQ ID NO: 2486815 - protein, 20 aa, Entamoeba dispar
IKTIFCPTKNIFSVSTSGIN

SEQ ID NO: 2486816 - protein, 30 aa, Entamoeba dispar
IKTIKRKKVKRQRKGNEYKPMKNNSEVFKI

SEQ ID NO: 2486817 - protein, 18 aa, Entamoeba dispar
IKTIPMNFTPSIMKVYGN

SEQ ID NO: 2486818 - protein, 23 aa, Entamoeba dispar
IKTISIDDVCLCLKYCKENKRFI

SEQ ID NO: 2486819 - protein, 17 aa, Entamoeba dispar
IKTKGFQAISTFTELYI

SEQ ID NO: 2486820 - protein, 20 aa, Entamoeba dispar
IKTKLTQYLPELFKNAVKMH

SEQ ID NO: 2486821 - protein, 20 aa, Entamoeba dispar
IKTLKFISIHYYKTVNNKII

SEQ ID NO: 2486822 - protein, 23 aa, Entamoeba dispar
IKTMLKLICNVFPTEGFWEHVCI

SEQ ID NO: 2486823 - protein, 19 aa, Entamoeba dispar
IKTNGRFLLTNSIEEYQEN

SEQ ID NO: 2486824 - protein, 17 aa, Entamoeba dispar
IKTNWNIIENRIEESDK

SEQ ID NO: 2486825 - protein, 19 aa, Entamoeba dispar
IKTPKIVKAIIPKKGKGKR

SEQ ID NO: 2486826 - protein, 27 aa, Entamoeba dispar
IKTPQRIISTLSLFRLDKFSGTNALQV

SEQ ID NO: 2486827 - protein, 23 aa, Entamoeba dispar
IKTRQYIKIFLKHSSNLNNSPKY

SEQ ID NO: 2486828 - protein, 17 aa, Entamoeba dispar
IKTSIPLTNYKITFESD

SEQ ID NO: 2486829 - protein, 18 aa, Entamoeba dispar
IKTSMMFGKADQQEREIN

SEQ ID NO: 2486830 - protein, 18 aa, Entamoeba dispar
IKTTCTFDSRILNIHIQS

SEQ ID NO: 2486831 - protein, 27 aa, Entamoeba dispar
IKTVGCWGEKGIVCISKENKVTFFNVL

SEQ ID NO: 2486832 - protein, 36 aa, Entamoeba dispar
IKVCKLLFDHIRCHPLCSWVYMLLGHLINNYKDDVQ

SEQ ID NO: 2486833 - protein, 20 aa, Entamoeba dispar
IKVDCGPLALTDVQILGLLD

SEQ ID NO: 2486834 - protein, 22 aa, Entamoeba dispar
IKVFKKRNQLLIEELKEEKKEK

SEQ ID NO: 2486835 - protein, 24 aa, Entamoeba dispar
IKVIDFGSACFDNYTLYTYVQSRH

SEQ ID NO: 2486836 - protein, 19 aa, Entamoeba dispar
IKVMEMMSSVYLRNEKTDI

SEQ ID NO: 2486837 - protein, 17 aa, Entamoeba dispar
IKVPLKEAEEICIVSMK

SEQ ID NO: 2486838 - protein, 21 aa, Entamoeba dispar
IKVRRSSRLSSRKSLGLESVP

SEQ ID NO: 2486839 - protein, 20 aa, Entamoeba dispar
IKVTEEFSRSGVGAYFTSFN

SEQ ID NO: 2486840 - protein, 19 aa, Entamoeba dispar
IKVTELLNRAITLEEKTKE

SEQ ID NO: 2486841 - protein, 24 aa, Entamoeba dispar
IKVVDRMSNGLWKGTLNNQTGLFH

SEQ ID NO: 2486842 - protein, 20 aa, Entamoeba dispar
IKVYEIHSDISLENNDVSEF

SEQ ID NO: 2486843 - protein, 18 aa, Entamoeba dispar
IKVYKISDIMSMLLTAKE

SEQ ID NO: 2486844 - protein, 22 aa, Entamoeba dispar
IKWFPLLGAIKLKYLDISNNPI

SEQ ID NO: 2486845 - protein, 21 aa, Entamoeba dispar
IKWNNETCCLLNSQETMKKSY

SEQ ID NO: 2486846 - protein, 31 aa, Entamoeba dispar
IKWNNEYHILYFWQGRKCPILDKGTSARLTV

SEQ ID NO: 2486847 - protein, 27 aa, Entamoeba dispar
IKWQIPAICKHQSFVDWNLPKTIRCCA

SEQ ID NO: 2486848 - protein, 20 aa, Entamoeba dispar
IKYEIIMIDWGFYNKLLQTN

SEQ ID NO: 2486849 - protein, 19 aa, Entamoeba dispar
IKYENIWIGIYDRYETNLH

SEQ ID NO: 2486850 - protein, 25 aa, Entamoeba dispar
IKYIEQFPGLAFFVSKEESLAGDKK

SEQ ID NO: 2486851 - protein, 23 aa, Entamoeba dispar
IKYKETIENIVFKYCKIVNNYDD

SEQ ID NO: 2486852 - protein, 24 aa, Entamoeba dispar
IKYKKRKILCTVVLMNNICFFLTK

SEQ ID NO: 2486853 - protein, 17 aa, Entamoeba dispar
IKYKKVYLIPKYSQIPY

SEQ ID NO: 2486854 - protein, 24 aa, Entamoeba dispar
IKYKLCSIEKEFSFGDEESIEIEM

SEQ ID NO: 2486855 - protein, 18 aa, Entamoeba dispar
IKYLPQFTSSVIVGGMAI

SEQ ID NO: 2486856 - protein, 18 aa, Entamoeba dispar
IKYMELQMSAPQKEIEEK

SEQ ID NO: 2486857 - protein, 19 aa, Entamoeba dispar
IKYNCVLLLPPASLIKDLA

SEQ ID NO: 2486858 - protein, 21 aa, Entamoeba dispar
IKYQGKPSIFQGRKGNEDISE

SEQ ID NO: 2486859 - protein, 19 aa, Entamoeba dispar
IKYQPLIVLLFQLLLEDLN

SEQ ID NO: 2486860 - protein, 20 aa, Entamoeba dispar
IKYSNVDAFIIISRGAYTKS

SEQ ID NO: 2486861 - protein, 21 aa, Entamoeba dispar
IKYTIPRKIKYENIWIGIYDR

SEQ ID NO: 2486862 - protein, 17 aa, Entamoeba dispar
IKYVFKLLPIIYDSSIF

SEQ ID NO: 2486863 - protein, 21 aa, Entamoeba dispar
IKYVIDSGLGKWKIYNPKIGM

SEQ ID NO: 2486864 - protein, 25 aa, Entamoeba dispar
IKYWNCPEEGRILGYMERNEYLNRI

SEQ ID NO: 2486865 - protein, 20 aa, Entamoeba dispar
IKYYQVVLHYSFLNEFVTTN

SEQ ID NO: 2486866 - protein, 20 aa, Entamoeba dispar
ILAETCIKALFAANKSFENT

SEQ ID NO: 2486867 - protein, 27 aa, Entamoeba dispar
ILAFPERRLYYFISMCIIKEYSDIIIS

SEQ ID NO: 2486868 - protein, 20 aa, Entamoeba dispar
ILANLKSRQYLQCFCVSMII

SEQ ID NO: 2486869 - protein, 24 aa, Entamoeba dispar
ILCCNSLILKGNFLISKLFLVFNH

SEQ ID NO: 2486870 - protein, 23 aa, Entamoeba dispar
ILCDCKVSLMVFKDDKLVVYSTN

SEQ ID NO: 2486871 - protein, 20 aa, Entamoeba dispar
ILCIECVREALIKEKGNDKD

SEQ ID NO: 2486872 - protein, 21 aa, Entamoeba dispar
ILCIMGESFTTNFVQADQQGT

SEQ ID NO: 2486873 - protein, 25 aa, Entamoeba dispar
ILCSQFKLKFLNIFEQAANGIGNIM

SEQ ID NO: 2486874 - protein, 19 aa, Entamoeba dispar
ILDDCKLAEKLAKEPNERL

SEQ ID NO: 2486875 - protein, 19 aa, Entamoeba dispar
ILDEFRLYLTEGLPYFLLY

SEQ ID NO: 2486876 - protein, 20 aa, Entamoeba dispar
ILDEHIRVVISAMIHTPYII

SEQ ID NO: 2486877 - protein, 19 aa, Entamoeba dispar
ILDELILFKVDEIIEDVLK

SEQ ID NO: 2486878 - protein, 27 aa, Entamoeba dispar
ILDHFLFNRHICIVFELLGMNLYDVLR

SEQ ID NO: 2486879 - protein, 26 aa, Entamoeba dispar
ILDKFAFCLYEEPSFKEFLKEQIEKV

SEQ ID NO: 2486880 - protein, 23 aa, Entamoeba dispar
ILDLACSPWDMSIFATASSDRSA

SEQ ID NO: 2486881 - protein, 19 aa, Entamoeba dispar
ILDMGFKKDLTAILEHLPK

SEQ ID NO: 2486882 - protein, 24 aa, Entamoeba dispar
ILDNSCFYKCFGLTSIHIPSNVKS

SEQ ID NO: 2486883 - protein, 25 aa, Entamoeba dispar
ILDPALLRPGRLDQLLFIPLPDKAS

SEQ ID NO: 2486884 - protein, 21 aa, Entamoeba dispar
ILDRIINIVVCHKVSYKTYKQ

SEQ ID NO: 2486885 - protein, 17 aa, Entamoeba dispar
ILDRPGVGEVMRIAVTK

SEQ ID NO: 2486886 - protein, 18 aa, Entamoeba dispar
ILDRPGVGEVMRIAVTKG

SEQ ID NO: 2486887 - protein, 19 aa, Entamoeba dispar
ILDRVKPDYIRKMYDVKQW

SEQ ID NO: 2486888 - protein, 25 aa, Entamoeba dispar
ILDSDCVYPVFKQMGLLDSLQTGLK

SEQ ID NO: 2486889 - protein, 27 aa, Entamoeba dispar
ILDSEGRYYYQLPRIIENILVYLYNKG

SEQ ID NO: 2486890 - protein, 19 aa, Entamoeba dispar
ILDSMRLGLIVGNINDIVN

SEQ ID NO: 2486891 - protein, 20 aa, Entamoeba dispar
ILDYCSKKSIDEMILKKMKG

SEQ ID NO: 2486892 - protein, 18 aa, Entamoeba dispar
ILEDGNEIGFYFSETYLF

SEQ ID NO: 2486893 - protein, 18 aa, Entamoeba dispar
ILEEFKLKEGALQQEIKE

SEQ ID NO: 2486894 - protein, 25 aa, Entamoeba dispar
ILEGGCSLKNLIIQNIPSIVQIYSN

SEQ ID NO: 2486895 - protein, 18 aa, Entamoeba dispar
ILEHGFAIPTGRYNISSE

SEQ ID NO: 2486896 - protein, 18 aa, Entamoeba dispar
ILEIIGFNRTEEIEGKIG

SEQ ID NO: 2486897 - protein, 19 aa, Entamoeba dispar
ILEKNVLMEFGKLLDGVVK

SEQ ID NO: 2486898 - protein, 30 aa, Entamoeba dispar
ILEKRGIELYEYYMKLILTIDQYVGLEETR

SEQ ID NO: 2486899 - protein, 24 aa, Entamoeba dispar
ILENELKPFFNKAMETVLVIIEEN

SEQ ID NO: 2486900 - protein, 19 aa, Entamoeba dispar
ILENHWAKYGRNYYQRYDF

SEQ ID NO: 2486901 - protein, 34 aa, Entamoeba dispar
ILENIFSSMLFEYIWPPCYDKFQTSKEVINDIKL

SEQ ID NO: 2486902 - protein, 21 aa, Entamoeba dispar
ILENRIRGCMQLQRDIEKAMI

SEQ ID NO: 2486903 - protein, 17 aa, Entamoeba dispar
ILEQSYCEFLNSIDKTI

SEQ ID NO: 2486904 - protein, 19 aa, Entamoeba dispar
ILESCRRSTIGFSDDLIQQ

SEQ ID NO: 2486905 - protein, 28 aa, Entamoeba dispar
ILESEGRPYYQLPRMIENILIYLYNKGC

SEQ ID NO: 2486906 - protein, 17 aa, Entamoeba dispar
ILESFRKYFRGITIPTF

SEQ ID NO: 2486907 - protein, 32 aa, Entamoeba dispar
ILEVSRFDPLICLKLIKYIIVECSTFFVIKEY

SEQ ID NO: 2486908 - protein, 20 aa, Entamoeba dispar
ILEYCKNKLIGCTDTSVIYD

SEQ ID NO: 2486909 - protein, 18 aa, Entamoeba dispar
ILEYYGYDDNVWKESSSE

SEQ ID NO: 2486910 - protein, 25 aa, Entamoeba dispar
ILFDVLKNPVHFFKGTMGQYEPKEE

SEQ ID NO: 2486911 - protein, 18 aa, Entamoeba dispar
ILFGGGFPEQERATHKSS

SEQ ID NO: 2486912 - protein, 28 aa, Entamoeba dispar
ILFKRNCRKAKPIGSNCRIQINSEIDDL

SEQ ID NO: 2486913 - protein, 18 aa, Entamoeba dispar
ILFLDSRGKCSIEHWLNW

SEQ ID NO: 2486914 - protein, 26 aa, Entamoeba dispar
ILFPKYREAYLKGMWYVINKALDEVC

SEQ ID NO: 2486915 - protein, 18 aa, Entamoeba dispar
ILFQPNPFFRTMCLTNFS

SEQ ID NO: 2486916 - protein, 22 aa, Entamoeba dispar
ILFSLQIIKHWIYLFDNNDAQL

SEQ ID NO: 2486917 - protein, 22 aa, Entamoeba dispar
ILFYECPKKSLLSLTRKSNEGQ

SEQ ID NO: 2486918 - protein, 17 aa, Entamoeba dispar
ILGAIIFGKPASINKQG

SEQ ID NO: 2486919 - protein, 20 aa, Entamoeba dispar
ILGEWCRIYQSVTLGAMHFQ

SEQ ID NO: 2486920 - protein, 27 aa, Entamoeba dispar
ILGEYKFCRFCEGEPYETNVCYLPIIN

SEQ ID NO: 2486921 - protein, 23 aa, Entamoeba dispar
ILGKDVFQIFGGRKMKSTVAICI

SEQ ID NO: 2486922 - protein, 20 aa, Entamoeba dispar
ILHGCIEFKGSINGICKGCY

SEQ ID NO: 2486923 - protein, 25 aa, Entamoeba dispar
ILHLKRFEFDYETLQRIKINDRYEF

SEQ ID NO: 2486924 - protein, 25 aa, Entamoeba dispar
ILHPDCAKRIIIEATKILKQEPNMI

SEQ ID NO: 2486925 - protein, 21 aa, Entamoeba dispar
ILIDKCLKKNVQILYEKETSQ

SEQ ID NO: 2486926 - protein, 22 aa, Entamoeba dispar
ILIECIKCLNKLISLPQTCGSI

SEQ ID NO: 2486927 - protein, 19 aa, Entamoeba dispar
ILIFLKFNYGNILGIFFQK

SEQ ID NO: 2486928 - protein, 27 aa, Entamoeba dispar
ILIFYAQEIFKIYPIVIVHLLDKFLQL

SEQ ID NO: 2486929 - protein, 20 aa, Entamoeba dispar
ILIHLINTFIIFKDYCIKYY

SEQ ID NO: 2486930 - protein, 21 aa, Entamoeba dispar
ILIHLINTFIIFKDYCIKYYC

SEQ ID NO: 2486931 - protein, 19 aa, Entamoeba dispar
ILIHLINTFIIFKDYLYKY

SEQ ID NO: 2486932 - protein, 24 aa, Entamoeba dispar
ILIKGKRRKSTICIVMAEEGLTEN

SEQ ID NO: 2486933 - protein, 25 aa, Entamoeba dispar
ILIKGKRRKSTICIVMAEEGLTENM

SEQ ID NO: 2486934 - protein, 19 aa, Entamoeba dispar
ILIKQLGAIVSFRRTKKTK

SEQ ID NO: 2486935 - protein, 18 aa, Entamoeba dispar
ILILFANVCNDMVQKGIF

SEQ ID NO: 2486936 - protein, 17 aa, Entamoeba dispar
ILIPGCGLARLPYELQK

SEQ ID NO: 2486937 - protein, 25 aa, Entamoeba dispar
ILIRCDSEKKLTFNLIRNDQIIGAQ

SEQ ID NO: 2486938 - protein, 19 aa, Entamoeba dispar
ILITKSVFYFDSCCWGWRR

SEQ ID NO: 2486939 - protein, 18 aa, Entamoeba dispar
ILIYEMIVGIPPFYDDDV

SEQ ID NO: 2486940 - protein, 17 aa, Entamoeba dispar
ILKDQERLFRRSQQLRG

SEQ ID NO: 2486941 - protein, 17 aa, Entamoeba dispar
ILKDTLHGLAYLHKMHM

SEQ ID NO: 2486942 - protein, 23 aa, Entamoeba dispar
ILKEAKALYGNRWTLIKMKLPGR

SEQ ID NO: 2486943 - protein, 19 aa, Entamoeba dispar
ILKEPRYNPHIDLLTVPHP

SEQ ID NO: 2486944 - protein, 17 aa, Entamoeba dispar
ILKEVQYLPPHFNVLIQ

SEQ ID NO: 2486945 - protein, 28 aa, Entamoeba dispar
ILKGNCYCGWVGRVYLSMLINKQDLDAL

SEQ ID NO: 2486946 - protein, 24 aa, Entamoeba dispar
ILKGRNGLKIDTVFKNKDTVTELH

SEQ ID NO: 2486947 - protein, 18 aa, Entamoeba dispar
ILKICDFGLSRFNSTDNL

SEQ ID NO: 2486948 - protein, 21 aa, Entamoeba dispar
ILKILNFKGKIAIKEALLCTE

SEQ ID NO: 2486949 - protein, 20 aa, Entamoeba dispar
ILKKRLMTICFLRNDNSILN

SEQ ID NO: 2486950 - protein, 17 aa, Entamoeba dispar
ILKLCSKIDSMSDINAM

SEQ ID NO: 2486951 - protein, 24 aa, Entamoeba dispar
ILKLFDWKLCHFIQKERTNIHVVI

SEQ ID NO: 2486952 - protein, 21 aa, Entamoeba dispar
ILKLPCISNVFKIENSSQLII

SEQ ID NO: 2486953 - protein, 19 aa, Entamoeba dispar
ILKMTKIVVDAHCQYRLGR

SEQ ID NO: 2486954 - protein, 19 aa, Entamoeba dispar
ILKNMDLRTLTNLLNKDSP

SEQ ID NO: 2486955 - protein, 18 aa, Entamoeba dispar
ILKQCLKQISQRKFDLIV

SEQ ID NO: 2486956 - protein, 19 aa, Entamoeba dispar
ILKQCTFIASNLVVSESFK

SEQ ID NO: 2486957 - protein, 20 aa, Entamoeba dispar
ILKRCIEGISCLSEEEQKIF

SEQ ID NO: 2486958 - protein, 17 aa, Entamoeba dispar
ILKRLCVVNSSYVQKQN

SEQ ID NO: 2486959 - protein, 24 aa, Entamoeba dispar
ILLCLRYGGSDVWSSVHEQYRNLK

SEQ ID NO: 2486960 - protein, 19 aa, Entamoeba dispar
ILLDCGVDCNFTREIIEKY

SEQ ID NO: 2486961 - protein, 17 aa, Entamoeba dispar
ILLEMCMSCVTRSEFIL

SEQ ID NO: 2486962 - protein, 30 aa, Entamoeba dispar
ILLEYFQIIFVLRKSFFERIGLADEFEQLN

SEQ ID NO: 2486963 - protein, 25 aa, Entamoeba dispar
ILLFKPNCKILIAFSKSDLPNSGID

SEQ ID NO: 2486964 - protein, 17 aa, Entamoeba dispar
ILLGLDMEFVIKVMEAV

SEQ ID NO: 2486965 - protein, 26 aa, Entamoeba dispar
ILLGNGYGFAVDWWSYGTLIYEMLLG

SEQ ID NO: 2486966 - protein, 19 aa, Entamoeba dispar
ILLKCHLREELKFYYSLYQ

SEQ ID NO: 2486967 - protein, 17 aa, Entamoeba dispar
ILLKDWSEEVVLESKEK

SEQ ID NO: 2486968 - protein, 25 aa, Entamoeba dispar
ILLKIFRVYMKIARYQTIGLGLSER

SEQ ID NO: 2486969 - protein, 18 aa, Entamoeba dispar
ILLLTNIVNDIGYRFNSE

SEQ ID NO: 2486970 - protein, 17 aa, Entamoeba dispar
ILLNLCKSSYVDAIVTV

SEQ ID NO: 2486971 - protein, 20 aa, Entamoeba dispar
ILLQKCTKISHLIIGGTSIS

SEQ ID NO: 2486972 - protein, 17 aa, Entamoeba dispar
ILLQLLRKVLYTENPDQ

SEQ ID NO: 2486973 - protein, 24 aa, Entamoeba dispar
ILLQRLSAEFPNMFANCNLFCGCS

SEQ ID NO: 2486974 - protein, 23 aa, Entamoeba dispar
ILLRLSIFPFHFNFYNYCVISLE

SEQ ID NO: 2486975 - protein, 17 aa, Entamoeba dispar
ILLSIRIPENIKEINKK

SEQ ID NO: 2486976 - protein, 28 aa, Entamoeba dispar
ILLSIYAKVFCRLFKYISAIIQNILLFI

SEQ ID NO: 2486977 - protein, 20 aa, Entamoeba dispar
ILLTKSFIMRNINLMGIVKE

SEQ ID NO: 2486978 - protein, 21 aa, Entamoeba dispar
ILMDPYLRGVREIPECCSPYE

SEQ ID NO: 2486979 - protein, 27 aa, Entamoeba dispar
ILMKIMLEQCPLCWIDSVEKDNLKEVV

SEQ ID NO: 2486980 - protein, 23 aa, Entamoeba dispar
ILMKTFESYRIFTIQTENNKGSF

SEQ ID NO: 2486981 - protein, 17 aa, Entamoeba dispar
ILMKYKGIKLISSNGSI

SEQ ID NO: 2486982 - protein, 20 aa, Entamoeba dispar
ILMNCLKYNGGDFDVLKLLG

SEQ ID NO: 2486983 - protein, 17 aa, Entamoeba dispar
ILMTLNLINKGFKVQKW

SEQ ID NO: 2486984 - protein, 18 aa, Entamoeba dispar
ILNCIKRIVSNGQCVEII

SEQ ID NO: 2486985 - protein, 21 aa, Entamoeba dispar
ILNDFCSIVLLPSLKSQEFEK

SEQ ID NO: 2486986 - protein, 21 aa, Entamoeba dispar
ILNEHGFIFSQCFDQIDYNQF

SEQ ID NO: 2486987 - protein, 22 aa, Entamoeba dispar
ILNEHGFIFSQCFDQIDYNQFV

SEQ ID NO: 2486988 - protein, 21 aa, Entamoeba dispar
ILNEIKKLLIYPKMFDTNLKT

SEQ ID NO: 2486989 - protein, 21 aa, Entamoeba dispar
ILNEYGFIFSQCFDQIDYNQF

SEQ ID NO: 2486990 - protein, 54 aa, Entamoeba dispar
ILNGEPKPIITLMFYLMYRFRLNDTPVRIIDFSKWIKCILKINNPLFDLKTEFS

SEQ ID NO: 2486991 - protein, 20 aa, Entamoeba dispar
ILNKKGDWWQGECQGNIGFF

SEQ ID NO: 2486992 - protein, 25 aa, Entamoeba dispar
ILNKYRLELLSGKVPIYCSGGITGI

SEQ ID NO: 2486993 - protein, 17 aa, Entamoeba dispar
ILNLGERTVKLQIWDTA

SEQ ID NO: 2486994 - protein, 21 aa, Entamoeba dispar
ILNNYSFKHRIIIQFENIFQL

SEQ ID NO: 2486995 - protein, 18 aa, Entamoeba dispar
ILNQIGIYEKLRREDDAK

SEQ ID NO: 2486996 - protein, 24 aa, Entamoeba dispar
ILNRHWIDYCINTFYSYEHLSTIY

SEQ ID NO: 2486997 - protein, 23 aa, Entamoeba dispar
ILNSFKILRCYIIDPNPHINTKF

SEQ ID NO: 2486998 - protein, 23 aa, Entamoeba dispar
ILNYFKKHHIPIALATSTTKSVF

SEQ ID NO: 2486999 - protein, 19 aa, Entamoeba dispar
ILPCGEYAIGQKLPPHLSP

SEQ ID NO: 2487000 - protein, 20 aa, Entamoeba dispar
ILPECIQISFIRLSSYHQFI

SEQ ID NO: 2487001 - protein, 24 aa, Entamoeba dispar
ILPFGEERIKGINGLREMKEIDIL

SEQ ID NO: 2487002 - protein, 24 aa, Entamoeba dispar
ILPKKDKLVGMYIHSTNKNELCYF

SEQ ID NO: 2487003 - protein, 20 aa, Entamoeba dispar
ILPNNLYGVFGMGESLEVAH

SEQ ID NO: 2487004 - protein, 28 aa, Entamoeba dispar
ILPPISSRCIKFRFSALPKEIVSNRLQM

SEQ ID NO: 2487005 - protein, 26 aa, Entamoeba dispar
ILPSHLKFEQGICYAMETLLKIFINT

SEQ ID NO: 2487006 - protein, 18 aa, Entamoeba dispar
ILPTILTCIIFISDQLKK

SEQ ID NO: 2487007 - protein, 24 aa, Entamoeba dispar
ILPVQRLPRYVLLLESLLKATPPI

SEQ ID NO: 2487008 - protein, 18 aa, Entamoeba dispar
ILQASWILSTAIPYFPDD

SEQ ID NO: 2487009 - protein, 24 aa, Entamoeba dispar
ILQCVKLTKLNFCFLNQVSEENSI

SEQ ID NO: 2487010 - protein, 17 aa, Entamoeba dispar
ILQDLRDGPNIIQLYDV

SEQ ID NO: 2487011 - protein, 27 aa, Entamoeba dispar
ILQEVLGGQGFLIAIGCISSINQQETI

SEQ ID NO: 2487012 - protein, 17 aa, Entamoeba dispar
ILQFSIVDDRIWMRNYQ

SEQ ID NO: 2487013 - protein, 18 aa, Entamoeba dispar
ILQIFICGTDDTMGANPD

SEQ ID NO: 2487014 - protein, 24 aa, Entamoeba dispar
ILQKRLMYSFDLFPLNMLTGIKDF

SEQ ID NO: 2487015 - protein, 17 aa, Entamoeba dispar
ILQLKFKGLLISTKKYS

SEQ ID NO: 2487016 - protein, 27 aa, Entamoeba dispar
ILQPKQDIVFCYPPPPIFIAERGQFSN

SEQ ID NO: 2487017 - protein, 26 aa, Entamoeba dispar
ILQPRGKRTKTLPCFNSNGRLCSLEK

SEQ ID NO: 2487018 - protein, 21 aa, Entamoeba dispar
ILQRGFVQFCFDPITKLFNAI

SEQ ID NO: 2487019 - protein, 17 aa, Entamoeba dispar
ILQRICEIIGASLDTLK

SEQ ID NO: 2487020 - protein, 19 aa, Entamoeba dispar
ILQSFGYKFIFYKNPNKKK

SEQ ID NO: 2487021 - protein, 18 aa, Entamoeba dispar
ILQTAGLVNFIGKAEDIS

SEQ ID NO: 2487022 - protein, 27 aa, Entamoeba dispar
ILQYIFRFFTCVNIGEYAGRIIFTTSR

SEQ ID NO: 2487023 - protein, 23 aa, Entamoeba dispar
ILRDCFYLYITSFLFHKNITIIQ

SEQ ID NO: 2487024 - protein, 22 aa, Entamoeba dispar
ILRDPRPLQQMIALDTLQASVS

SEQ ID NO: 2487025 - protein, 18 aa, Entamoeba dispar
ILRHPKTQYSRVILIRDQ

SEQ ID NO: 2487026 - protein, 19 aa, Entamoeba dispar
ILRIFKKPYLTFGDKTGII

SEQ ID NO: 2487027 - protein, 20 aa, Entamoeba dispar
ILRIFKKPYLTFGDKTGIIQ

SEQ ID NO: 2487028 - protein, 22 aa, Entamoeba dispar
ILRKIRIELTKAMNLFSVNNTP

SEQ ID NO: 2487029 - protein, 23 aa, Entamoeba dispar
ILRSGEISLRLKSFNKTDFSSVL

SEQ ID NO: 2487030 - protein, 25 aa, Entamoeba dispar
ILRSKLNLIPSFLNNVEWIIMDEAQ

SEQ ID NO: 2487031 - protein, 24 aa, Entamoeba dispar
ILRVKEATSFPIVFVANKVDLVKD

SEQ ID NO: 2487032 - protein, 20 aa, Entamoeba dispar
ILSALCYIHSNGIGHRDLKP

SEQ ID NO: 2487033 - protein, 18 aa, Entamoeba dispar
ILSAPVCDDSYCTEHDLV

SEQ ID NO: 2487034 - protein, 23 aa, Entamoeba dispar
ILSDIDLIWSNAFEYNAPNSEVW

SEQ ID NO: 2487035 - protein, 19 aa, Entamoeba dispar
ILSFGKNCFYECICADMLK

SEQ ID NO: 2487036 - protein, 17 aa, Entamoeba dispar
ILSGALLHDTVEDTNTT

SEQ ID NO: 2487037 - protein, 19 aa, Entamoeba dispar
ILSKLRHPFLVNLYYSFQT

SEQ ID NO: 2487038 - protein, 25 aa, Entamoeba dispar
ILSKQRFASLTGMNVEWDFVELPSQ

SEQ ID NO: 2487039 - protein, 28 aa, Entamoeba dispar
ILSKYPKFRFGTLTSRISGNQLLVLTGF

SEQ ID NO: 2487040 - protein, 24 aa, Entamoeba dispar
ILSLPKSCFELCTSLRTIILPNSL

SEQ ID NO: 2487041 - protein, 18 aa, Entamoeba dispar
ILSNGFWDTVVLHIKNGE

SEQ ID NO: 2487042 - protein, 20 aa, Entamoeba dispar
ILSNLNHRFCVYYDDGREVF

SEQ ID NO: 2487043 - protein, 19 aa, Entamoeba dispar
ILSQIRWQVTVVDEAQRLK

SEQ ID NO: 2487044 - protein, 19 aa, Entamoeba dispar
ILTAKGYGIEVDWWSLGVV

SEQ ID NO: 2487045 - protein, 26 aa, Entamoeba dispar
ILTDLKDGLILIRFLTNISGKEVLKT

SEQ ID NO: 2487046 - protein, 19 aa, Entamoeba dispar
ILTEQSIHFGCPPPDSNPI

SEQ ID NO: 2487047 - protein, 17 aa, Entamoeba dispar
ILTGCFILIQGKTVSVI

SEQ ID NO: 2487048 - protein, 17 aa, Entamoeba dispar
ILTGLQFTQKDFERPTK

SEQ ID NO: 2487049 - protein, 27 aa, Entamoeba dispar
ILTLDGVCDRSHLYNCKINTFTCDIIR

SEQ ID NO: 2487050 - protein, 17 aa, Entamoeba dispar
ILTLKYPIEHGIVNNWD

SEQ ID NO: 2487051 - protein, 23 aa, Entamoeba dispar
ILTLNCSYFRTFKTHQIMEQIKY

SEQ ID NO: 2487052 - protein, 24 aa, Entamoeba dispar
ILTPYALNSCVAFGTVNLASPHDI

SEQ ID NO: 2487053 - protein, 18 aa, Entamoeba dispar
ILTTDPWSSVYYTSEDWT

SEQ ID NO: 2487054 - protein, 18 aa, Entamoeba dispar
ILTTSVYITLDFTTIFNC

SEQ ID NO: 2487055 - protein, 18 aa, Entamoeba dispar
ILVEYGLMNLVFRHQYEN

SEQ ID NO: 2487056 - protein, 19 aa, Entamoeba dispar
ILVGDLMKSISVYSFDNNG

SEQ ID NO: 2487057 - protein, 21 aa, Entamoeba dispar
ILVHICEYGTISLRTLNIIEN

SEQ ID NO: 2487058 - protein, 28 aa, Entamoeba dispar
ILVKIHFYQRIQIIIISSIVIFKNKTSI

SEQ ID NO: 2487059 - protein, 17 aa, Entamoeba dispar
ILVLKKILKDACLSGGQ

SEQ ID NO: 2487060 - protein, 31 aa, Entamoeba dispar
ILWNDQKWRKLGMSDLCDFEGVQKWYKKAVI

SEQ ID NO: 2487061 - protein, 22 aa, Entamoeba dispar
ILYERRRDVVAGFSVQKSKETQ

SEQ ID NO: 2487062 - protein, 26 aa, Entamoeba dispar
ILYGKGAGCGPTLYLAHKIQKSIKPE

SEQ ID NO: 2487063 - protein, 19 aa, Entamoeba dispar
ILYKEGKVMFTRKQSLCVI

SEQ ID NO: 2487064 - protein, 21 aa, Entamoeba dispar
ILYPGKWWKCDYCQQVFGKNK

SEQ ID NO: 2487065 - protein, 17 aa, Entamoeba dispar
ILYQIPLSSECCNKLIK

SEQ ID NO: 2487066 - protein, 18 aa, Entamoeba dispar
ILYRSSKDGLSARSLNAR

SEQ ID NO: 2487067 - protein, 17 aa, Entamoeba dispar
IMAECHLNAAQFIEKNI

SEQ ID NO: 2487068 - protein, 21 aa, Entamoeba dispar
IMAKEVIKYLYKVDMTDMKIK

SEQ ID NO: 2487069 - protein, 32 aa, Entamoeba dispar
IMCHKAKILPWRTLRFNECVCTPYNADFDGDE

SEQ ID NO: 2487070 - protein, 31 aa, Entamoeba dispar
IMDQSLPFFMFEWNYLWFIHSLKFELAIRVF

SEQ ID NO: 2487071 - protein, 25 aa, Entamoeba dispar
IMEILKRGGKCLIPVFSLGRAQEFE

SEQ ID NO: 2487072 - protein, 21 aa, Entamoeba dispar
IMEIPCTLIIISKGNEIPISI

SEQ ID NO: 2487073 - protein, 22 aa, Entamoeba dispar
IMEKRFEICHNRRIDMDRYHDS

SEQ ID NO: 2487074 - protein, 23 aa, Entamoeba dispar
IMEKRFEICHNRRVDMDRYHDSV

SEQ ID NO: 2487075 - protein, 20 aa, Entamoeba dispar
IMELCNAGSLKDIIKTLNAP

SEQ ID NO: 2487076 - protein, 20 aa, Entamoeba dispar
IMEYCPKYINVFKEIDLNQN

SEQ ID NO: 2487077 - protein, 17 aa, Entamoeba dispar
IMFEILTALLYLHSIGV

SEQ ID NO: 2487078 - protein, 25 aa, Entamoeba dispar
IMFHSDLRESVGIMENCNGLILGSV

SEQ ID NO: 2487079 - protein, 17 aa, Entamoeba dispar
IMFITSFTLDMFKKPVC

SEQ ID NO: 2487080 - protein, 18 aa, Entamoeba dispar
IMFMYFQKTEIIQPILCV

SEQ ID NO: 2487081 - protein, 28 aa, Entamoeba dispar
IMFVNACLRKGILPIMLEEMLSTRQHIK

SEQ ID NO: 2487082 - protein, 30 aa, Entamoeba dispar
IMGFRLQRPQLIFRDSFLQLPTLKEWSYDI

SEQ ID NO: 2487083 - protein, 17 aa, Entamoeba dispar
IMGLKLSDPLLRLDALV

SEQ ID NO: 2487084 - protein, 20 aa, Entamoeba dispar
IMGRIDLPFIQRIYNSYMGF

SEQ ID NO: 2487085 - protein, 21 aa, Entamoeba dispar
IMGRIDLPFIQRIYNSYMGFC

SEQ ID NO: 2487086 - protein, 20 aa, Entamoeba dispar
IMHVGRTFIQMTFDRLSSII

SEQ ID NO: 2487087 - protein, 17 aa, Entamoeba dispar
IMIAFGVDPITINCLIK

SEQ ID NO: 2487088 - protein, 18 aa, Entamoeba dispar
IMIESCWKQNPQDRITFD

SEQ ID NO: 2487089 - protein, 18 aa, Entamoeba dispar
IMIKGCDLVQSKVHCKLL

SEQ ID NO: 2487090 - protein, 18 aa, Entamoeba dispar
IMIPPKINTSIMVTPTEI

SEQ ID NO: 2487091 - protein, 20 aa, Entamoeba dispar
IMISGGFMRTFGIDLFIKLG

SEQ ID NO: 2487092 - protein, 19 aa, Entamoeba dispar
IMKCFDCFDNITSIGLLQM

SEQ ID NO: 2487093 - protein, 28 aa, Entamoeba dispar
IMKCPIDCRSDLFGTINLIGAASKLKGM

SEQ ID NO: 2487094 - protein, 29 aa, Entamoeba dispar
IMKFPGLLPDIYIKHFLGDIALGLRYLHF

SEQ ID NO: 2487095 - protein, 24 aa, Entamoeba dispar
IMKLVAKCYMEWQHKNISNEQIYA

SEQ ID NO: 2487096 - protein, 18 aa, Entamoeba dispar
IMKMCRIKPVINQVELNV

SEQ ID NO: 2487097 - protein, 18 aa, Entamoeba dispar
IMLDLIISIDGSGFSDST

SEQ ID NO: 2487098 - protein, 30 aa, Entamoeba dispar
IMLYRDFHHSYKLFIQFIIRHIEHSVIFTN

SEQ ID NO: 2487099 - protein, 18 aa, Entamoeba dispar
IMNACCFSPFTPNLLATG

SEQ ID NO: 2487100 - protein, 17 aa, Entamoeba dispar
IMNIAVGILQEYTNYTV

SEQ ID NO: 2487101 - protein, 17 aa, Entamoeba dispar
IMNIFWVSFFNKLFHNI

SEQ ID NO: 2487102 - protein, 24 aa, Entamoeba dispar
IMNKCILDNLFIICLSKNYCIILI

SEQ ID NO: 2487103 - protein, 19 aa, Entamoeba dispar
IMNTGICQLLYHMRVNSHF

SEQ ID NO: 2487104 - protein, 18 aa, Entamoeba dispar
IMPLELRALISGLPFCVV

SEQ ID NO: 2487105 - protein, 26 aa, Entamoeba dispar
IMQCDNCMGAIIGRYANRIYKGDLVI

SEQ ID NO: 2487106 - protein, 30 aa, Entamoeba dispar
IMQHLSEAWRCWKANIPWKVPGLPEPIEAM

SEQ ID NO: 2487107 - protein, 26 aa, Entamoeba dispar
IMRLDFLCVIRDYPLMIEINCPSIHN

SEQ ID NO: 2487108 - protein, 17 aa, Entamoeba dispar
IMSCYNFEECVHKLLSL

SEQ ID NO: 2487109 - protein, 20 aa, Entamoeba dispar
IMSDLICVSPELKLCKSKDE

SEQ ID NO: 2487110 - protein, 24 aa, Entamoeba dispar
IMSIQQAFEVIKIIIEYYEDIINL

SEQ ID NO: 2487111 - protein, 19 aa, Entamoeba dispar
IMSKGCALDSVKLSANSIF

SEQ ID NO: 2487112 - protein, 21 aa, Entamoeba dispar
IMTNEFLKGAVKLIFLNKMDL

SEQ ID NO: 2487113 - protein, 21 aa, Entamoeba dispar
IMTRNRYEWYILQFAMQRQGI

SEQ ID NO: 2487114 - protein, 18 aa, Entamoeba dispar
IMVCEELKKVLDQVTSNI

SEQ ID NO: 2487115 - protein, 23 aa, Entamoeba dispar
IMYYRLLDQFTCIRSIRNITRIT

SEQ ID NO: 2487116 - protein, 33 aa, Entamoeba dispar
INAAKELFKKACWTIEINNHFYVTLKEYESLLL

SEQ ID NO: 2487117 - protein, 18 aa, Entamoeba dispar
INAALEVAKRKKAEKEKQ

SEQ ID NO: 2487118 - protein, 28 aa, Entamoeba dispar
INALEWYSKELICYGMYIEKINKIRELI

SEQ ID NO: 2487119 - protein, 17 aa, Entamoeba dispar
INALKTVGFKMGIDLAF

SEQ ID NO: 2487120 - protein, 18 aa, Entamoeba dispar
INALPRITSFSMQGVTYS

SEQ ID NO: 2487121 - protein, 31 aa, Entamoeba dispar
INALYKRAVEINSKFNLLFVEFMQKSTDTSL

SEQ ID NO: 2487122 - protein, 23 aa, Entamoeba dispar
INAPLRLICKGKILDPHKSLEQN

SEQ ID NO: 2487123 - protein, 17 aa, Entamoeba dispar
INCCRFSPDGSMCVCVS

SEQ ID NO: 2487124 - protein, 18 aa, Entamoeba dispar
INCFTKDMLFEYTGNVRE

SEQ ID NO: 2487125 - protein, 23 aa, Entamoeba dispar
INCKCGQKFCFKCGREMHKPISC

SEQ ID NO: 2487126 - protein, 19 aa, Entamoeba dispar
INCNETLQFPDDVEIHDDA

SEQ ID NO: 2487127 - protein, 24 aa, Entamoeba dispar
INDCLVLKYSPLVARSAELIKQNG

SEQ ID NO: 2487128 - protein, 17 aa, Entamoeba dispar
INDCQMVFTGVWHGTTH

SEQ ID NO: 2487129 - protein, 25 aa, Entamoeba dispar
INDFIEKILHQFKDTEICPTEESDT

SEQ ID NO: 2487130 - protein, 23 aa, Entamoeba dispar
INDKYFIRKGINMILNNDSTGID

SEQ ID NO: 2487131 - protein, 24 aa, Entamoeba dispar
INDLPRNCCIQSFLIDTGKDNTKR

SEQ ID NO: 2487132 - protein, 18 aa, Entamoeba dispar
INDLYDIIKFCEKSGLSI

SEQ ID NO: 2487133 - protein, 17 aa, Entamoeba dispar
INDMQFMLNQSLKKVEM

SEQ ID NO: 2487134 - protein, 19 aa, Entamoeba dispar
INDVIKLFVIEEIDDKKEI

SEQ ID NO: 2487135 - protein, 25 aa, Entamoeba dispar
INDWMICDALANKVVTQFLRSHEEY

SEQ ID NO: 2487136 - protein, 21 aa, Entamoeba dispar
INDYRMSIATILEVSEEEDFS

SEQ ID NO: 2487137 - protein, 23 aa, Entamoeba dispar
INDYRQLLEIGFDEIKYHEQLGF

SEQ ID NO: 2487138 - protein, 18 aa, Entamoeba dispar
INEEIELILNRVKIGNEH

SEQ ID NO: 2487139 - protein, 17 aa, Entamoeba dispar
INEFKIITKTILKCTEC

SEQ ID NO: 2487140 - protein, 25 aa, Entamoeba dispar
INEFSRLMLVPLKRLSSGDEKVIEA

SEQ ID NO: 2487141 - protein, 25 aa, Entamoeba dispar
INEIGDACFRDCYSLTSINIPSSIS

SEQ ID NO: 2487142 - protein, 30 aa, Entamoeba dispar
INEISDSIVHKWRVQGYFYDFVGYVLFPVK

SEQ ID NO: 2487143 - protein, 32 aa, Entamoeba dispar
INEKIYGIGFFLSFNLNDSFFLFGENSYSSLT

SEQ ID NO: 2487144 - protein, 18 aa, Entamoeba dispar
INEKLFLKGNIELTLTTN

SEQ ID NO: 2487145 - protein, 17 aa, Entamoeba dispar
INEKTLINEKVFSGQNC

SEQ ID NO: 2487146 - protein, 26 aa, Entamoeba dispar
INELGNWYFKGCTSLTRIDIPTTVNV

SEQ ID NO: 2487147 - protein, 33 aa, Entamoeba dispar
INELIKFFPTKEEKLKILPIIKKLEEEKSEWKN

SEQ ID NO: 2487148 - protein, 20 aa, Entamoeba dispar
INELKLILESILNPTVILSK

SEQ ID NO: 2487149 - protein, 18 aa, Entamoeba dispar
INELLIKRLESIPKSSDL

SEQ ID NO: 2487150 - protein, 25 aa, Entamoeba dispar
INELPIEIWLHVIPQIIARIQSEIG

SEQ ID NO: 2487151 - protein, 20 aa, Entamoeba dispar
INEMLIAVAHRCDHTQVISI

SEQ ID NO: 2487152 - protein, 21 aa, Entamoeba dispar
INEMLNKVIISFKYDGKKTIK

SEQ ID NO: 2487153 - protein, 18 aa, Entamoeba dispar
INEMLWLVMEYMNGGCLT

SEQ ID NO: 2487154 - protein, 25 aa, Entamoeba dispar
INEPKFASLYVEFFIQVKRNPKIYD

SEQ ID NO: 2487155 - protein, 21 aa, Entamoeba dispar
INEPWYLKFNNSAIFANKTKD

SEQ ID NO: 2487156 - protein, 21 aa, Entamoeba dispar
INEPWYLKFNNSGIYDDSTGD

SEQ ID NO: 2487157 - protein, 22 aa, Entamoeba dispar
INERYRLNIVFDLNESQLIFKN

SEQ ID NO: 2487158 - protein, 20 aa, Entamoeba dispar
INESFYPSEMIVVGSTNGKC

SEQ ID NO: 2487159 - protein, 18 aa, Entamoeba dispar
INETMSFDLTILKHKDGG

SEQ ID NO: 2487160 - protein, 31 aa, Entamoeba dispar
INEVANLIKLWFRELPTLLLNGLTSTQIQMS

SEQ ID NO: 2487161 - protein, 18 aa, Entamoeba dispar
INFAMFLTAIQRWLHLTM

SEQ ID NO: 2487162 - protein, 17 aa, Entamoeba dispar
INFDISVIINEKNIEVY

SEQ ID NO: 2487163 - protein, 18 aa, Entamoeba dispar
INFFNEWNDNSNKEVKKT

SEQ ID NO: 2487164 - protein, 18 aa, Entamoeba dispar
INFLDERFVLHYLHSILL

SEQ ID NO: 2487165 - protein, 18 aa, Entamoeba dispar
INFLNFFQMFNPNVIVPQ

SEQ ID NO: 2487166 - protein, 23 aa, Entamoeba dispar
INFMGRECFDRCISLTSMNIDNL

SEQ ID NO: 2487167 - protein, 18 aa, Entamoeba dispar
INFPEAIRDIQWGKDDVL

SEQ ID NO: 2487168 - protein, 23 aa, Entamoeba dispar
INFPMHFSNLFIDHCEAIANLLL

SEQ ID NO: 2487169 - protein, 21 aa, Entamoeba dispar
INFYFKQIITGIQYIHSKNII

SEQ ID NO: 2487170 - protein, 17 aa, Entamoeba dispar
INFYQKRINILTEEIFK

SEQ ID NO: 2487171 - protein, 21 aa, Entamoeba dispar
INGDCSIAWNKRFELKINEIS

SEQ ID NO: 2487172 - protein, 23 aa, Entamoeba dispar
INGDVWLKLSVQGRIHVKLETFK

SEQ ID NO: 2487173 - protein, 26 aa, Entamoeba dispar
INGEIKYSKALFQFGLSYTSINGSKR

SEQ ID NO: 2487174 - protein, 25 aa, Entamoeba dispar
INGEMKKIIGGFIIHENLKFKEMEC

SEQ ID NO: 2487175 - protein, 18 aa, Entamoeba dispar
INGFLKKFYYTMKEPSYI

SEQ ID NO: 2487176 - protein, 26 aa, Entamoeba dispar
INGGRKATVGLGFVDRSNAFDFSAVL

SEQ ID NO: 2487177 - protein, 27 aa, Entamoeba dispar
INGHKCPLCETEGLEFILLNPPLEEME

SEQ ID NO: 2487178 - protein, 18 aa, Entamoeba dispar
INGIIVKQLIKYGNEEVK

SEQ ID NO: 2487179 - protein, 26 aa, Entamoeba dispar
INGILPRFLQVISHILYFEYICNTSN

SEQ ID NO: 2487180 - protein, 22 aa, Entamoeba dispar
INGISGMMLIEYYINMNYLDGI

SEQ ID NO: 2487181 - protein, 19 aa, Entamoeba dispar
INGKYSILFDLTGVNYNLK

SEQ ID NO: 2487182 - protein, 18 aa, Entamoeba dispar
INGLRIVGVSGIYKSFDE

SEQ ID NO: 2487183 - protein, 22 aa, Entamoeba dispar
INGNLLGLCYGNFLDHMGSLVE

SEQ ID NO: 2487184 - protein, 22 aa, Entamoeba dispar
INGRSNLTFVILTSDKWVFGCF

SEQ ID NO: 2487185 - protein, 28 aa, Entamoeba dispar
INGTSWPACPTIKCISLPKEIEKGEEVM

SEQ ID NO: 2487186 - protein, 17 aa, Entamoeba dispar
INGYPILENDVKEPSEK

SEQ ID NO: 2487187 - protein, 17 aa, Entamoeba dispar
INGYVIGMMCSKIKENQ

SEQ ID NO: 2487188 - protein, 18 aa, Entamoeba dispar
INHIITILNSMGEETLNE

SEQ ID NO: 2487189 - protein, 26 aa, Entamoeba dispar
INHISHPLCIAKIFATILISQNIEKS

SEQ ID NO: 2487190 - protein, 23 aa, Entamoeba dispar
INHPNFLALKGIVLTPLALLVDY

SEQ ID NO: 2487191 - protein, 23 aa, Entamoeba dispar
INHQPEGRYCIIREGSYLKVINS

SEQ ID NO: 2487192 - protein, 21 aa, Entamoeba dispar
INHRIIHGFYNRYSYSINSPH

SEQ ID NO: 2487193 - protein, 17 aa, Entamoeba dispar
INHRPATCEQWRLWQEL

SEQ ID NO: 2487194 - protein, 20 aa, Entamoeba dispar
INHWKDVSSMVLGRTRKQCR

SEQ ID NO: 2487195 - protein, 17 aa, Entamoeba dispar
INICGKLAKGLPRSPRI

SEQ ID NO: 2487196 - protein, 18 aa, Entamoeba dispar
INICHEGIIIPKINEIKE

SEQ ID NO: 2487197 - protein, 20 aa, Entamoeba dispar
INIEFRFSKLTKINVPSSLT

SEQ ID NO: 2487198 - protein, 23 aa, Entamoeba dispar
INIFYKGIELMQAVFNGEQIQPF

SEQ ID NO: 2487199 - protein, 18 aa, Entamoeba dispar
INIIFCYEEKGIKVIDVE

SEQ ID NO: 2487200 - protein, 17 aa, Entamoeba dispar
INIIGRLMINTFFWEND

SEQ ID NO: 2487201 - protein, 18 aa, Entamoeba dispar
INIIPSMLLECCEADSYW

SEQ ID NO: 2487202 - protein, 21 aa, Entamoeba dispar
INIKEGIEILSKRLGKEIKIS

SEQ ID NO: 2487203 - protein, 22 aa, Entamoeba dispar
INIKGRFCLGVFDLIPNGMVRR

SEQ ID NO: 2487204 - protein, 22 aa, Entamoeba dispar
INIKICSMIKLEIESRNKQNIE

SEQ ID NO: 2487205 - protein, 25 aa, Entamoeba dispar
INIKREWSDDFDLFFQNKEGLLSYS

SEQ ID NO: 2487206 - protein, 24 aa, Entamoeba dispar
INIMKEVMIITKLIKCSDNIKRRT

SEQ ID NO: 2487207 - protein, 19 aa, Entamoeba dispar
INIPFKRPSVESIRGHPLI

SEQ ID NO: 2487208 - protein, 23 aa, Entamoeba dispar
INIPLPITVESLYNILLPYLDSP

SEQ ID NO: 2487209 - protein, 26 aa, Entamoeba dispar
INIPLSINEIGNWCFSYCSSLKSINI

SEQ ID NO: 2487210 - protein, 29 aa, Entamoeba dispar
INIPSSISKLGICCFKECYSLKSINIPAS

SEQ ID NO: 2487211 - protein, 19 aa, Entamoeba dispar
INIPSSVIFIGKAAFSHCT

SEQ ID NO: 2487212 - protein, 20 aa, Entamoeba dispar
INIPTSIEWIGESCFKECTG

SEQ ID NO: 2487213 - protein, 28 aa, Entamoeba dispar
INIQKYIILCVLLRSIHPIYIEMTNELF

SEQ ID NO: 2487214 - protein, 17 aa, Entamoeba dispar
INIRLEIYYHIFHDWIK

SEQ ID NO: 2487215 - protein, 21 aa, Entamoeba dispar
INISIDLNRLTAIEKYTVDEL

SEQ ID NO: 2487216 - protein, 18 aa, Entamoeba dispar
INISTAIKEIGSLSFKNC

SEQ ID NO: 2487217 - protein, 25 aa, Entamoeba dispar
INIYYEFCESFNYLPLGVIIKRKIG

SEQ ID NO: 2487218 - protein, 26 aa, Entamoeba dispar
INKAFFDEKFHLMITNVLRTPPGYRC

SEQ ID NO: 2487219 - protein, 17 aa, Entamoeba dispar
INKAIQLCQEINSSISL

SEQ ID NO: 2487220 - protein, 19 aa, Entamoeba dispar
INKCFRNIIYHNNITLQMS

SEQ ID NO: 2487221 - protein, 23 aa, Entamoeba dispar
INKCGQIPLYLLVRGDTEKELNR

SEQ ID NO: 2487222 - protein, 20 aa, Entamoeba dispar
INKCQREFYELKNAQEGMWI

SEQ ID NO: 2487223 - protein, 19 aa, Entamoeba dispar
INKEFNYFRMENGQLNKYA

SEQ ID NO: 2487224 - protein, 21 aa, Entamoeba dispar
INKELRRRGSPIAVVGIPKTI

SEQ ID NO: 2487225 - protein, 20 aa, Entamoeba dispar
INKELRRRGSPIVVVGIPKT

SEQ ID NO: 2487226 - protein, 17 aa, Entamoeba dispar
INKELYHTLKLAYGKEY

SEQ ID NO: 2487227 - protein, 21 aa, Entamoeba dispar
INKFCRIFNPPTCNCNLLNVD

SEQ ID NO: 2487228 - protein, 26 aa, Entamoeba dispar
INKFHWHFKNFDGFALFQNGEKILTG

SEQ ID NO: 2487229 - protein, 20 aa, Entamoeba dispar
INKIEFYKPTQLSYSYQEKT

SEQ ID NO: 2487230 - protein, 24 aa, Entamoeba dispar
INKIFPFTFCENLLNDANFICFCL

SEQ ID NO: 2487231 - protein, 24 aa, Entamoeba dispar
INKISRAIDTIGFEQMKKKLDNLL

SEQ ID NO: 2487232 - protein, 17 aa, Entamoeba dispar
INKKCGIAINSLKINPW

SEQ ID NO: 2487233 - protein, 25 aa, Entamoeba dispar
INKKCRIINLFCKQLKGGNPEKTGL

SEQ ID NO: 2487234 - protein, 29 aa, Entamoeba dispar
INKKEITRCASWLIHVCSIKNETIKQFII

SEQ ID NO: 2487235 - protein, 18 aa, Entamoeba dispar
INKKFFLALKKLRETHQI

SEQ ID NO: 2487236 - protein, 20 aa, Entamoeba dispar
INKKKAWEIFVKGLKNKDST

SEQ ID NO: 2487237 - protein, 19 aa, Entamoeba dispar
INKLICLVMKIMKREKSKS

SEQ ID NO: 2487238 - protein, 21 aa, Entamoeba dispar
INKLLRWLVQRQKPIEGGFDG

SEQ ID NO: 2487239 - protein, 23 aa, Entamoeba dispar
INKLTGCKEEFEIEIEVLADETE

SEQ ID NO: 2487240 - protein, 18 aa, Entamoeba dispar
INKMLFVIFQHCHIDDTF

SEQ ID NO: 2487241 - protein, 23 aa, Entamoeba dispar
INKNTLWLIMRFLSKVIQNTSVN

SEQ ID NO: 2487242 - protein, 18 aa, Entamoeba dispar
INKPTALQFIGYHCFHGC

SEQ ID NO: 2487243 - protein, 27 aa, Entamoeba dispar
INKTTIRWRITFISGNTRLAPYALCLH

SEQ ID NO: 2487244 - protein, 17 aa, Entamoeba dispar
INKVERVICCLNEMVEL

SEQ ID NO: 2487245 - protein, 18 aa, Entamoeba dispar
INKVRWNKNGKWFLTCSK

SEQ ID NO: 2487246 - protein, 25 aa, Entamoeba dispar
INLCIPEFIHFFSINVTQGHVQCSF

SEQ ID NO: 2487247 - protein, 23 aa, Entamoeba dispar
INLFNYLPLCVLLLQPIGTFFLC

SEQ ID NO: 2487248 - protein, 20 aa, Entamoeba dispar
INLIISILMLKYTVHSYWKN

SEQ ID NO: 2487249 - protein, 18 aa, Entamoeba dispar
INLKCILDKINEMYQIIR

SEQ ID NO: 2487250 - protein, 24 aa, Entamoeba dispar
INLKIRCARSISFNKCENINFKID

SEQ ID NO: 2487251 - protein, 27 aa, Entamoeba dispar
INLKLDGCFTCIELPTSLTSLKFNSLK

SEQ ID NO: 2487252 - protein, 21 aa, Entamoeba dispar
INLKNGKLCYLSAEQEVIDPV

SEQ ID NO: 2487253 - protein, 20 aa, Entamoeba dispar
INLKNVMAIGDAMNDIPMLD

SEQ ID NO: 2487254 - protein, 18 aa, Entamoeba dispar
INLLHVLSHIPSRIVPVK

SEQ ID NO: 2487255 - protein, 20 aa, Entamoeba dispar
INLLPRGWHGLLSLTHMILL

SEQ ID NO: 2487256 - protein, 19 aa, Entamoeba dispar
INLLQYFLLHSCTGDDLKL

SEQ ID NO: 2487257 - protein, 17 aa, Entamoeba dispar
INLNHCISNDKSISYFF

SEQ ID NO: 2487258 - protein, 18 aa, Entamoeba dispar
INLNHIWPEVKLPKFNEG

SEQ ID NO: 2487259 - protein, 24 aa, Entamoeba dispar
INLNVLNALLIEWTSTSEGKAISH

SEQ ID NO: 2487260 - protein, 17 aa, Entamoeba dispar
INLPQIVVVGSQSAGKS

SEQ ID NO: 2487261 - protein, 22 aa, Entamoeba dispar
INLPSFMAVGSFKNYFYGSDLS

SEQ ID NO: 2487262 - protein, 24 aa, Entamoeba dispar
INLPSSITKLGIGCFYKCSSLTTI

SEQ ID NO: 2487263 - protein, 17 aa, Entamoeba dispar
INLPTFIVEVFESINTI

SEQ ID NO: 2487264 - protein, 21 aa, Entamoeba dispar
INLQPLRGMNWKVYDNFDSFT

SEQ ID NO: 2487265 - protein, 25 aa, Entamoeba dispar
INLRAFELSLHFPEIVQRYRDMMIN

SEQ ID NO: 2487266 - protein, 17 aa, Entamoeba dispar
INLTITVEEMIKHIEKV

SEQ ID NO: 2487267 - protein, 25 aa, Entamoeba dispar
INLVKEIQRRVYGFLSRKSSKSTMK

SEQ ID NO: 2487268 - protein, 21 aa, Entamoeba dispar
INLWPKLTVLLKLLKMCEKTN

SEQ ID NO: 2487269 - protein, 24 aa, Entamoeba dispar
INLYKWRKVYELIQQVLNAKGQTT

SEQ ID NO: 2487270 - protein, 25 aa, Entamoeba dispar
INLYKWRKVYELTQQFLDARPINPC

SEQ ID NO: 2487271 - protein, 25 aa, Entamoeba dispar
INMIECGYSDFGYIMVMDIHGINLK

SEQ ID NO: 2487272 - protein, 19 aa, Entamoeba dispar
INMKKIMIAGKTCYISDPN

SEQ ID NO: 2487273 - protein, 18 aa, Entamoeba dispar
INMLQLIYQIPRKNEEQR

SEQ ID NO: 2487274 - protein, 19 aa, Entamoeba dispar
INMRFDPYVFLSLAIPNKQ

SEQ ID NO: 2487275 - protein, 20 aa, Entamoeba dispar
INNCDPELQFALDIIQQLMV

SEQ ID NO: 2487276 - protein, 20 aa, Entamoeba dispar
INNDDCKLHQKMFDEFRQLI

SEQ ID NO: 2487277 - protein, 24 aa, Entamoeba dispar
INNDLLELRVRMDTVEKGSIVNDV

SEQ ID NO: 2487278 - protein, 24 aa, Entamoeba dispar
INNFKEWFREIVIKEINKKKNTNK

SEQ ID NO: 2487279 - protein, 17 aa, Entamoeba dispar
INNHNKLILAFEGVLYQ

SEQ ID NO: 2487280 - protein, 25 aa, Entamoeba dispar
INNIFLRMDIRTELICLGAEKFIAN

SEQ ID NO: 2487281 - protein, 18 aa, Entamoeba dispar
INNIRLLIQNSLIKNEEI

SEQ ID NO: 2487282 - protein, 18 aa, Entamoeba dispar
INNLIILLCECVECMDDI

SEQ ID NO: 2487283 - protein, 23 aa, Entamoeba dispar
INNLKRINGIPIRERYINEFVIP

SEQ ID NO: 2487284 - protein, 18 aa, Entamoeba dispar
INNSFGYIELFDLLYSIS

SEQ ID NO: 2487285 - protein, 17 aa, Entamoeba dispar
INNTFEIIICCTDERCS

SEQ ID NO: 2487286 - protein, 32 aa, Entamoeba dispar
INNTKHPFVFVCPATRISMCSLPKKNYVKQPN

SEQ ID NO: 2487287 - protein, 17 aa, Entamoeba dispar
INNYWSFHFQEDHSSLK

SEQ ID NO: 2487288 - protein, 25 aa, Entamoeba dispar
INPFEFHSFFYLRTVKLSDEIKEIP

SEQ ID NO: 2487289 - protein, 17 aa, Entamoeba dispar
INPFFTLQFVTKFDPSQ

SEQ ID NO: 2487290 - protein, 18 aa, Entamoeba dispar
INPFKLSQFYTFSQINKI

SEQ ID NO: 2487291 - protein, 20 aa, Entamoeba dispar
INPFKLSQFYTFSQINKIFP

SEQ ID NO: 2487292 - protein, 17 aa, Entamoeba dispar
INPFPPFINETGIYNHD

SEQ ID NO: 2487293 - protein, 25 aa, Entamoeba dispar
INPINITNMIWKIPGNNRCAECGKL

SEQ ID NO: 2487294 - protein, 18 aa, Entamoeba dispar
INPIRKVIKEVFKTKIKT

SEQ ID NO: 2487295 - protein, 28 aa, Entamoeba dispar
INPIYQRLWFALGICCLQISDISGAKKA

SEQ ID NO: 2487296 - protein, 22 aa, Entamoeba dispar
INPKECCWKSVQFSKYKLECEK

SEQ ID NO: 2487297 - protein, 19 aa, Entamoeba dispar
INPMANFFIGVGVQQEEIE

SEQ ID NO: 2487298 - protein, 18 aa, Entamoeba dispar
INPSLFYLCEGRPLTQTK

SEQ ID NO: 2487299 - protein, 19 aa, Entamoeba dispar
INQCKPFDIKVERQKIQNS

SEQ ID NO: 2487300 - protein, 19 aa, Entamoeba dispar
INQCVKPIIQYLVLCLIEK

SEQ ID NO: 2487301 - protein, 23 aa, Entamoeba dispar
INQEITVLNGYYVNDFVQLSEGV

SEQ ID NO: 2487302 - protein, 17 aa, Entamoeba dispar
INQIGFRQHHIIQPPTA

SEQ ID NO: 2487303 - protein, 26 aa, Entamoeba dispar
INQKSVRCHPCLPFTIVLQQKSTKLY

SEQ ID NO: 2487304 - protein, 25 aa, Entamoeba dispar
INQNRVVKMIHDYAFSQTTESEQSY

SEQ ID NO: 2487305 - protein, 26 aa, Entamoeba dispar
INQPAVYKLPSSEHYVVYGEPRNEYM

SEQ ID NO: 2487306 - protein, 24 aa, Entamoeba dispar
INQPEFFPKEGLVFSLNPSQKIYT

SEQ ID NO: 2487307 - protein, 17 aa, Entamoeba dispar
INQPFVLDPEHLLSDKA

SEQ ID NO: 2487308 - protein, 17 aa, Entamoeba dispar
INQSFVLQGMITLITRL

SEQ ID NO: 2487309 - protein, 19 aa, Entamoeba dispar
INQVIGFRSKGRIPAATWW

SEQ ID NO: 2487310 - protein, 22 aa, Entamoeba dispar
INRCVGFNVGIEEFWRRYDEEE

SEQ ID NO: 2487311 - protein, 18 aa, Entamoeba dispar
INRFCEPPSKGIICDLLW

SEQ ID NO: 2487312 - protein, 26 aa, Entamoeba dispar
INRIIKKVRICRSVVYQFNAMKTINK

SEQ ID NO: 2487313 - protein, 19 aa, Entamoeba dispar
INRKFVCYIEDGISIDELS

SEQ ID NO: 2487314 - protein, 23 aa, Entamoeba dispar
INRKTVIHWFLDFYNVECPYSIH

SEQ ID NO: 2487315 - protein, 23 aa, Entamoeba dispar
INRKVFNGIKFKNDLFSAFIYSF

SEQ ID NO: 2487316 - protein, 22 aa, Entamoeba dispar
INRPNETTAYAFVKYDNTLSPS

SEQ ID NO: 2487317 - protein, 25 aa, Entamoeba dispar
INRSKEFFKYILSFITDNEIVIGEG

SEQ ID NO: 2487318 - protein, 26 aa, Entamoeba dispar
INRSKELFKYVLMYLTKGEIICNDKS

SEQ ID NO: 2487319 - protein, 18 aa, Entamoeba dispar
INRVFGFYDECIRRYDES

SEQ ID NO: 2487320 - protein, 22 aa, Entamoeba dispar
INRVKEWILSKHPSALYPEPYL

SEQ ID NO: 2487321 - protein, 17 aa, Entamoeba dispar
INRVVPWFETTFVPNWV

SEQ ID NO: 2487322 - protein, 19 aa, Entamoeba dispar
INRYEYLSLVYKYYTLPCK

SEQ ID NO: 2487323 - protein, 18 aa, Entamoeba dispar
INSALSKKGFSLIQGPPG

SEQ ID NO: 2487324 - protein, 19 aa, Entamoeba dispar
INSDLSLLRQWTGKQTFRL

SEQ ID NO: 2487325 - protein, 29 aa, Entamoeba dispar
INSEKRLCLLYVIDMIVKIDVNRIYVNLF

SEQ ID NO: 2487326 - protein, 23 aa, Entamoeba dispar
INSFCQNTKFLAAPALKILVRLC

SEQ ID NO: 2487327 - protein, 23 aa, Entamoeba dispar
INSFKPTKSIVLSGYSALGNASI

SEQ ID NO: 2487328 - protein, 25 aa, Entamoeba dispar
INSGLLMSICCNLIYDPTDQFCQKN

SEQ ID NO: 2487329 - protein, 22 aa, Entamoeba dispar
INSKGPKGYRLFVIICDNETDF

SEQ ID NO: 2487330 - protein, 20 aa, Entamoeba dispar
INSKIEFKDPIKVRASHEYL

SEQ ID NO: 2487331 - protein, 19 aa, Entamoeba dispar
INSLIGIISHETMWQEQTE

SEQ ID NO: 2487332 - protein, 18 aa, Entamoeba dispar
INSLKINPWFTSKRDINQ

SEQ ID NO: 2487333 - protein, 18 aa, Entamoeba dispar
INSLTMIMGIELPYQEWY

SEQ ID NO: 2487334 - protein, 21 aa, Entamoeba dispar
INSSFIFPDYINLRPFTFNKI

SEQ ID NO: 2487335 - protein, 17 aa, Entamoeba dispar
INSSSFFNVFIQELVNE

SEQ ID NO: 2487336 - protein, 18 aa, Entamoeba dispar
INSVEFKKDITIQEEDNL

SEQ ID NO: 2487337 - protein, 19 aa, Entamoeba dispar
INTDFLLLLIKKLITRNKT

SEQ ID NO: 2487338 - protein, 28 aa, Entamoeba dispar
INTKCFIYRNLKCLVIDEADRIMEVGFE

SEQ ID NO: 2487339 - protein, 23 aa, Entamoeba dispar
INTKLIRTGICDHLIAVVREGCD

SEQ ID NO: 2487340 - protein, 18 aa, Entamoeba dispar
INTLPLIECIQNKDIITC

SEQ ID NO: 2487341 - protein, 26 aa, Entamoeba dispar
INTQIVRYMVRSCGSEEAYSTYCDCT

SEQ ID NO: 2487342 - protein, 28 aa, Entamoeba dispar
INTVLKEFKFPISDCGKLEDVESVRKVL

SEQ ID NO: 2487343 - protein, 25 aa, Entamoeba dispar
INVCKSDALLKRTIREIENIKDKLK

SEQ ID NO: 2487344 - protein, 21 aa, Entamoeba dispar
INVDVSYDFYTILQLNGISCN

SEQ ID NO: 2487345 - protein, 21 aa, Entamoeba dispar
INVEGIFRMNGRVGRIEEMKK

SEQ ID NO: 2487346 - protein, 23 aa, Entamoeba dispar
INVEKILRRGGPEYKAIITEEKS

SEQ ID NO: 2487347 - protein, 22 aa, Entamoeba dispar
INVFYGFELFFIISNQQVIVLN

SEQ ID NO: 2487348 - protein, 20 aa, Entamoeba dispar
INVGCHWLTVEGVQPLIPQN

SEQ ID NO: 2487349 - protein, 17 aa, Entamoeba dispar
INVGFLLENWRKVPRAF

SEQ ID NO: 2487350 - protein, 17 aa, Entamoeba dispar
INVISMDCVPRLSKAQC

SEQ ID NO: 2487351 - protein, 23 aa, Entamoeba dispar
INVKSKCPINKLIIAESKEVNIT

SEQ ID NO: 2487352 - protein, 22 aa, Entamoeba dispar
INVKSKCPINKLIIAESKEVSI

SEQ ID NO: 2487353 - protein, 24 aa, Entamoeba dispar
INVPKCKKFLTRIVAAMNKGDIFN

SEQ ID NO: 2487354 - protein, 19 aa, Entamoeba dispar
INVPYEYFRTIEINLISNK

SEQ ID NO: 2487355 - protein, 19 aa, Entamoeba dispar
INVRPLYRKLITEAPSTTY

SEQ ID NO: 2487356 - protein, 19 aa, Entamoeba dispar
INVSLRVYEMMGFIDELLF

SEQ ID NO: 2487357 - protein, 24 aa, Entamoeba dispar
INVVECIKQIILRRKTIIAENENT

SEQ ID NO: 2487358 - protein, 22 aa, Entamoeba dispar
INYDGSCSKPIILITTKTNVLI

SEQ ID NO: 2487359 - protein, 33 aa, Entamoeba dispar
INYELKKLICFISRSVMWRTEFVESTQKIRRST

SEQ ID NO: 2487360 - protein, 19 aa, Entamoeba dispar
INYHQKCALIYKKGIVDII

SEQ ID NO: 2487361 - protein, 19 aa, Entamoeba dispar
INYIASFRIEERNQLYGLV

SEQ ID NO: 2487362 - protein, 20 aa, Entamoeba dispar
INYLDLYLSDDFSQNKPVQE

SEQ ID NO: 2487363 - protein, 24 aa, Entamoeba dispar
INYLGICVAPSFFSQEITYMTTTE

SEQ ID NO: 2487364 - protein, 24 aa, Entamoeba dispar
INYPKEQVFLFGFINEVEKIILIG

SEQ ID NO: 2487365 - protein, 18 aa, Entamoeba dispar
INYPKGRHDFKARLFQFY

SEQ ID NO: 2487366 - protein, 17 aa, Entamoeba dispar
INYPKQFFFLRGNHESK

SEQ ID NO: 2487367 - protein, 21 aa, Entamoeba dispar
INYRLEYRWFNQLSEKQKLLF

SEQ ID NO: 2487368 - protein, 24 aa, Entamoeba dispar
INYSHCYGWLPLLYKITQEDFFAS

SEQ ID NO: 2487369 - protein, 24 aa, Entamoeba dispar
IPADMVICAFGFGPDASFVEGTPD

SEQ ID NO: 2487370 - protein, 34 aa, Entamoeba dispar
IPAELRAYVWYALLLRPSNPWEIKHLYSEENGKE

SEQ ID NO: 2487371 - protein, 26 aa, Entamoeba dispar
IPALKVCKVLFKYIRILYNDIKDLPE

SEQ ID NO: 2487372 - protein, 20 aa, Entamoeba dispar
IPAQRLETFQTHLTMPDLQN

SEQ ID NO: 2487373 - protein, 26 aa, Entamoeba dispar
IPCLFEIPQENPVVFSCRLNELKTFF

SEQ ID NO: 2487374 - protein, 18 aa, Entamoeba dispar
IPCLQCVEDCVCIGLYYW

SEQ ID NO: 2487375 - protein, 21 aa, Entamoeba dispar
IPCLYYCGLDMLKRMKNYSKL

SEQ ID NO: 2487376 - protein, 18 aa, Entamoeba dispar
IPCPKTPTIFARKTEFEC

SEQ ID NO: 2487377 - protein, 20 aa, Entamoeba dispar
IPCTYCYSEHSLLKSKYTAI

SEQ ID NO: 2487378 - protein, 22 aa, Entamoeba dispar
IPDACLWKCYSLTSIQFPSNLS

SEQ ID NO: 2487379 - protein, 18 aa, Entamoeba dispar
IPDGMEWDVFVKDVISPL

SEQ ID NO: 2487380 - protein, 22 aa, Entamoeba dispar
IPDIRFPLPSLQILDLSSNGLT

SEQ ID NO: 2487381 - protein, 25 aa, Entamoeba dispar
IPDSISWKILCETISVYELPTQNCK

SEQ ID NO: 2487382 - protein, 18 aa, Entamoeba dispar
IPDVLFKHYIKYHPMRLN

SEQ ID NO: 2487383 - protein, 18 aa, Entamoeba dispar
IPDWIRKSSRKFIDDDDD

SEQ ID NO: 2487384 - protein, 20 aa, Entamoeba dispar
IPDYCFYKCSALTSVTLPTT

SEQ ID NO: 2487385 - protein, 20 aa, Entamoeba dispar
IPDYYLSNIVQIPDYYHNVS

SEQ ID NO: 2487386 - protein, 21 aa, Entamoeba dispar
IPDYYLSNIVQIPDYYLSNIV

SEQ ID NO: 2487387 - protein, 23 aa, Entamoeba dispar
IPEDEIKKVVGFAKALVSNTPIS

SEQ ID NO: 2487388 - protein, 23 aa, Entamoeba dispar
IPEEMRYGYDIINGCKHNDILEN

SEQ ID NO: 2487389 - protein, 20 aa, Entamoeba dispar
IPEGFYDLAMILYGALHQSH

SEQ ID NO: 2487390 - protein, 17 aa, Entamoeba dispar
IPEGMTWENFVKDVISP

SEQ ID NO: 2487391 - protein, 28 aa, Entamoeba dispar
IPEGRKFQIPLWLAITLQNYGYVRIIVN

SEQ ID NO: 2487392 - protein, 22 aa, Entamoeba dispar
IPEKRYKHTDVILFMLGGGNYM

SEQ ID NO: 2487393 - protein, 19 aa, Entamoeba dispar
IPELSTIVSTIKFIPLHHG

SEQ ID NO: 2487394 - protein, 19 aa, Entamoeba dispar
IPELTKIVQDWIKKLLKNK

SEQ ID NO: 2487395 - protein, 23 aa, Entamoeba dispar
IPENCFRMCDKLVSFNIPSSIEI

SEQ ID NO: 2487396 - protein, 19 aa, Entamoeba dispar
IPENLKLINKMNFIKQDIN

SEQ ID NO: 2487397 - protein, 19 aa, Entamoeba dispar
IPEPSDLVCNQISPCQNQI

SEQ ID NO: 2487398 - protein, 23 aa, Entamoeba dispar
IPEQNAKVLIKFRDGIVTFMEKV

SEQ ID NO: 2487399 - protein, 18 aa, Entamoeba dispar
IPERDLVSSLGMSGGSQI

SEQ ID NO: 2487400 - protein, 24 aa, Entamoeba dispar
IPESIKVLSPRCLCKNSLHSLIIP

SEQ ID NO: 2487401 - protein, 20 aa, Entamoeba dispar
IPETRFTEIEKPAVEMKYLN

SEQ ID NO: 2487402 - protein, 18 aa, Entamoeba dispar
IPEVRQFFEIPFVVQLYY

SEQ ID NO: 2487403 - protein, 17 aa, Entamoeba dispar
IPFDDSLLEIPRTLNSF

SEQ ID NO: 2487404 - protein, 21 aa, Entamoeba dispar
IPFDKVHNGLCDCEDGSDENE

SEQ ID NO: 2487405 - protein, 25 aa, Entamoeba dispar
IPFEFKTIHLFECFNPTLQINDSMN

SEQ ID NO: 2487406 - protein, 17 aa, Entamoeba dispar
IPFELPHPIHEALTGML

SEQ ID NO: 2487407 - protein, 21 aa, Entamoeba dispar
IPFFVSTGMIEQCINLGKKWM

SEQ ID NO: 2487408 - protein, 17 aa, Entamoeba dispar
IPFGLLCIKEEGIEANS

SEQ ID NO: 2487409 - protein, 18 aa, Entamoeba dispar
IPFIAPKPVWAKEEKKST

SEQ ID NO: 2487410 - protein, 17 aa, Entamoeba dispar
IPFILLQARLSQVLEGF

SEQ ID NO: 2487411 - protein, 24 aa, Entamoeba dispar
IPFKEIDQLPILLFVNKNYEKEQF

SEQ ID NO: 2487412 - protein, 17 aa, Entamoeba dispar
IPFLGSTLGDLVFTKEN

SEQ ID NO: 2487413 - protein, 24 aa, Entamoeba dispar
IPFLRRESFGQYPTQRNFRSSSGF

SEQ ID NO: 2487414 - protein, 22 aa, Entamoeba dispar
IPFLTRCCINLVTALQYLSSQN

SEQ ID NO: 2487415 - protein, 26 aa, Entamoeba dispar
IPFMVKSPTGYPVIIFSIGIDLPKDI

SEQ ID NO: 2487416 - protein, 23 aa, Entamoeba dispar
IPFNNCWPAKLFVQKIFTACNRL

SEQ ID NO: 2487417 - protein, 26 aa, Entamoeba dispar
IPFRDSQYLYRCFVFEQLSYGIKITD

SEQ ID NO: 2487418 - protein, 21 aa, Entamoeba dispar
IPGDDPLFCICITRRELLQFP

SEQ ID NO: 2487419 - protein, 20 aa, Entamoeba dispar
IPGFIKEVLNNHLFIYKLLE

SEQ ID NO: 2487420 - protein, 18 aa, Entamoeba dispar
IPGFVKAFLKEGKNKYYV

SEQ ID NO: 2487421 - protein, 20 aa, Entamoeba dispar
IPGKYIFKTTMSDLMKIVLK

SEQ ID NO: 2487422 - protein, 17 aa, Entamoeba dispar
IPGNNRCAECGKLEPEW

SEQ ID NO: 2487423 - protein, 23 aa, Entamoeba dispar
IPGPLRAKLAIGESIKLGNGNII

SEQ ID NO: 2487424 - protein, 23 aa, Entamoeba dispar
IPGQKVSFCICKIRKGKCPGGNV

SEQ ID NO: 2487425 - protein, 18 aa, Entamoeba dispar
IPGSGACWGKEVWMKNYI

SEQ ID NO: 2487426 - protein, 23 aa, Entamoeba dispar
IPHEGAMCDLLWSDPDPATNDWK

SEQ ID NO: 2487427 - protein, 17 aa, Entamoeba dispar
IPHEMEISSNTFLWDVF

SEQ ID NO: 2487428 - protein, 17 aa, Entamoeba dispar
IPHIIPLSPKFIKQVNI

SEQ ID NO: 2487429 - protein, 21 aa, Entamoeba dispar
IPHIKDFISHLIVFDTTKRYG

SEQ ID NO: 2487430 - protein, 25 aa, Entamoeba dispar
IPHNDPRLFTNTVNCFINMTRLIII

SEQ ID NO: 2487431 - protein, 26 aa, Entamoeba dispar
IPHQKIPFCRLTGMIKTSIKKDSDLP

SEQ ID NO: 2487432 - protein, 20 aa, Entamoeba dispar
IPHYEFPEIVLKCLPLLPFE

SEQ ID NO: 2487433 - protein, 18 aa, Entamoeba dispar
IPICKRNDFEYTQGPEEF

SEQ ID NO: 2487434 - protein, 17 aa, Entamoeba dispar
IPIEIIATVPVVSGIQY

SEQ ID NO: 2487435 - protein, 22 aa, Entamoeba dispar
IPIERMPMVISVDITKDLEDEV

SEQ ID NO: 2487436 - protein, 19 aa, Entamoeba dispar
IPIIAGIDELVQFGKQYQR

SEQ ID NO: 2487437 - protein, 25 aa, Entamoeba dispar
IPIIHLLFPIALKYSLIQCSPKSIQ

SEQ ID NO: 2487438 - protein, 18 aa, Entamoeba dispar
IPIILRISIEDYKKAQTK

SEQ ID NO: 2487439 - protein, 21 aa, Entamoeba dispar
IPIKISAHYLLPKGIPFITFL

SEQ ID NO: 2487440 - protein, 23 aa, Entamoeba dispar
IPIKNERSVGTIPQWNEEENQLL

SEQ ID NO: 2487441 - protein, 18 aa, Entamoeba dispar
IPILCSFHPDTFSLIYSI

SEQ ID NO: 2487442 - protein, 19 aa, Entamoeba dispar
IPIMLKRSQFKVQLFDEIP

SEQ ID NO: 2487443 - protein, 20 aa, Entamoeba dispar
IPINCSVIFVTKKGYNEDMI

SEQ ID NO: 2487444 - protein, 18 aa, Entamoeba dispar
IPINLTLNIHQIICSGSG

SEQ ID NO: 2487445 - protein, 17 aa, Entamoeba dispar
IPISFRPPLLTKQDLSL

SEQ ID NO: 2487446 - protein, 21 aa, Entamoeba dispar
IPITWMVPHQFAIEKNETVDF

SEQ ID NO: 2487447 - protein, 22 aa, Entamoeba dispar
IPIVVCGSCDGTMRIYKIENGE

SEQ ID NO: 2487448 - protein, 40 aa, Entamoeba dispar
IPKEEIKDVILVGGPTKLCCFKKMIKEFFGKQPLTTIDTM

SEQ ID NO: 2487449 - protein, 19 aa, Entamoeba dispar
IPKEFVFENQKGFKILTDD

SEQ ID NO: 2487450 - protein, 20 aa, Entamoeba dispar
IPKEFVFENQKGFKILTDDE

SEQ ID NO: 2487451 - protein, 23 aa, Entamoeba dispar
IPKEIKSIGGRCFENCISLINVV

SEQ ID NO: 2487452 - protein, 17 aa, Entamoeba dispar
IPKEKATLIKRRVVIAL

SEQ ID NO: 2487453 - protein, 17 aa, Entamoeba dispar
IPKEKKDGFVYVKNDEN

SEQ ID NO: 2487454 - protein, 22 aa, Entamoeba dispar
IPKELWRLGSDIISEIKADTLI

SEQ ID NO: 2487455 - protein, 18 aa, Entamoeba dispar
IPKEPSQALSVLKPNKKK

SEQ ID NO: 2487456 - protein, 21 aa, Entamoeba dispar
IPKGFMKYCGQIQRIELPQSI

SEQ ID NO: 2487457 - protein, 21 aa, Entamoeba dispar
IPKIRRSRHNKGRKDKEINKD

SEQ ID NO: 2487458 - protein, 17 aa, Entamoeba dispar
IPKKVCEIKEYCFCGYD

SEQ ID NO: 2487459 - protein, 22 aa, Entamoeba dispar
IPKLYCNGALDGDEVSISILSP

SEQ ID NO: 2487460 - protein, 19 aa, Entamoeba dispar
IPKQDSFSPQRVVKSPEPA

SEQ ID NO: 2487461 - protein, 29 aa, Entamoeba dispar
IPKQYFDYFSVFILYKLVIKQLSLIVQDL

SEQ ID NO: 2487462 - protein, 17 aa, Entamoeba dispar
IPKSRYVILNKLHSARF

SEQ ID NO: 2487463 - protein, 17 aa, Entamoeba dispar
IPKTGILVLTHIFLITN

SEQ ID NO: 2487464 - protein, 18 aa, Entamoeba dispar
IPKVCLIHTAVMPLINKN

SEQ ID NO: 2487465 - protein, 19 aa, Entamoeba dispar
IPKYHSHLFDIKSIEIPSN

SEQ ID NO: 2487466 - protein, 25 aa, Entamoeba dispar
IPKYKIVVEKCMLFDRAEQQMIKAA

SEQ ID NO: 2487467 - protein, 19 aa, Entamoeba dispar
IPLACSVGTTVIVDNLFDK

SEQ ID NO: 2487468 - protein, 21 aa, Entamoeba dispar
IPLALRYNSLLIYNQQINSGE

SEQ ID NO: 2487469 - protein, 19 aa, Entamoeba dispar
IPLDCEIILFVFIGQKSIG

SEQ ID NO: 2487470 - protein, 17 aa, Entamoeba dispar
IPLDILHLYPLDLEETE

SEQ ID NO: 2487471 - protein, 19 aa, Entamoeba dispar
IPLELATCIEPVRRYKKHN

SEQ ID NO: 2487472 - protein, 23 aa, Entamoeba dispar
IPLELKDKLHLILPYKENELIVK

SEQ ID NO: 2487473 - protein, 20 aa, Entamoeba dispar
IPLEMSFCDTILCTVSTAAN

SEQ ID NO: 2487474 - protein, 18 aa, Entamoeba dispar
IPLKSAIKKSQWRVPLPI

SEQ ID NO: 2487475 - protein, 19 aa, Entamoeba dispar
IPLNECFVSTTLQLDNEFR

SEQ ID NO: 2487476 - protein, 24 aa, Entamoeba dispar
IPLNKYSRRFFPNIETFHIYNEED

SEQ ID NO: 2487477 - protein, 23 aa, Entamoeba dispar
IPLNYYSRRFFPNIETFHIYNEE

SEQ ID NO: 2487478 - protein, 25 aa, Entamoeba dispar
IPLPKEVDGYFPVVFIGKEGLPKFF

SEQ ID NO: 2487479 - protein, 23 aa, Entamoeba dispar
IPLPNLMVDKFFSFSLQSNLKLQ

SEQ ID NO: 2487480 - protein, 19 aa, Entamoeba dispar
IPLPSKFDSIYPSNPEHFK

SEQ ID NO: 2487481 - protein, 19 aa, Entamoeba dispar
IPLSEDFDFQRFYKAQTNY

SEQ ID NO: 2487482 - protein, 30 aa, Entamoeba dispar
IPLSIMGWFRLCGGIYNIVEIIPIGNSSGI

SEQ ID NO: 2487483 - protein, 19 aa, Entamoeba dispar
IPLSLPFSIKSLSLKQCDG

SEQ ID NO: 2487484 - protein, 20 aa, Entamoeba dispar
IPLSVSEFGCDCFDGCSSLT

SEQ ID NO: 2487485 - protein, 21 aa, Entamoeba dispar
IPLVKVFRGNGQWLKEFRVNE

SEQ ID NO: 2487486 - protein, 19 aa, Entamoeba dispar
IPLVSSMGAGGRFDPTKIQ

SEQ ID NO: 2487487 - protein, 24 aa, Entamoeba dispar
IPLYRVSLKKEIYALDRIVPIALG

SEQ ID NO: 2487488 - protein, 17 aa, Entamoeba dispar
IPMQLLRIPKCKICSAY

SEQ ID NO: 2487489 - protein, 17 aa, Entamoeba dispar
IPMVEPLSTFLNEMVNL

SEQ ID NO: 2487490 - protein, 22 aa, Entamoeba dispar
IPNAIVGYSSMQGWRKTMEDAH

SEQ ID NO: 2487491 - protein, 23 aa, Entamoeba dispar
IPNAQVRYVTYCELSKLTSITTQ

SEQ ID NO: 2487492 - protein, 20 aa, Entamoeba dispar
IPNEELKELISLIKFAPSAC

SEQ ID NO: 2487493 - protein, 17 aa, Entamoeba dispar
IPNEIVNDIGFTKNGTL

SEQ ID NO: 2487494 - protein, 17 aa, Entamoeba dispar
IPNHVKLAPLQITVNDD

SEQ ID NO: 2487495 - protein, 18 aa, Entamoeba dispar
IPNIECCCDISGLLNYLH

SEQ ID NO: 2487496 - protein, 17 aa, Entamoeba dispar
IPNILGAKEIGESFELN

SEQ ID NO: 2487497 - protein, 18 aa, Entamoeba dispar
IPNKIRIKFMLDGAKGIS

SEQ ID NO: 2487498 - protein, 24 aa, Entamoeba dispar
IPNLFKYLSTHSFVSLTRKVASKT

SEQ ID NO: 2487499 - protein, 26 aa, Entamoeba dispar
IPNLNILNGLQIINGFQFFGQSFPFK

SEQ ID NO: 2487500 - protein, 20 aa, Entamoeba dispar
IPNNCTWDYNLNCKTLTSLC

SEQ ID NO: 2487501 - protein, 17 aa, Entamoeba dispar
IPNNIEWIGENCFKECT

SEQ ID NO: 2487502 - protein, 17 aa, Entamoeba dispar
IPNNNCEIILEKCSEYP

SEQ ID NO: 2487503 - protein, 22 aa, Entamoeba dispar
IPNPCPEEIKTLLIQLKDQSTY

SEQ ID NO: 2487504 - protein, 17 aa, Entamoeba dispar
IPNPISGDFFVTMKEEN

SEQ ID NO: 2487505 - protein, 24 aa, Entamoeba dispar
IPNPQSFGTFLFRKEQSIHDKKLY

SEQ ID NO: 2487506 - protein, 24 aa, Entamoeba dispar
IPNQFKCVLTKQVIEKMLYCCRSS

SEQ ID NO: 2487507 - protein, 22 aa, Entamoeba dispar
IPNRINCGWTITLLLDLIKEEE

SEQ ID NO: 2487508 - protein, 19 aa, Entamoeba dispar
IPNRKAREQTIKFTIQINE

SEQ ID NO: 2487509 - protein, 40 aa, Entamoeba dispar
IPNSYPKFDEFFTQLHLYCLKNPFFYYEIDNEYLYVKTRL

SEQ ID NO: 2487510 - protein, 20 aa, Entamoeba dispar
IPNTWYINNQLIYVPIPDSI

SEQ ID NO: 2487511 - protein, 20 aa, Entamoeba dispar
IPPEVASIIYGCFEGDEELT

SEQ ID NO: 2487512 - protein, 24 aa, Entamoeba dispar
IPPKEEILIEVELTLVQKKYYRAL

SEQ ID NO: 2487513 - protein, 17 aa, Entamoeba dispar
IPPKQYKAIKPMDDDEE

SEQ ID NO: 2487514 - protein, 20 aa, Entamoeba dispar
IPPPILPKVDGIGIENTLRS

SEQ ID NO: 2487515 - protein, 19 aa, Entamoeba dispar
IPPQFTAAYGAPIKQKPQL

SEQ ID NO: 2487516 - protein, 17 aa, Entamoeba dispar
IPPSFSFCSKCSNRVEM

SEQ ID NO: 2487517 - protein, 17 aa, Entamoeba dispar
IPPSPHISIHFGKVEKG

SEQ ID NO: 2487518 - protein, 18 aa, Entamoeba dispar
IPPSVTFSKDFQFISDYQ

SEQ ID NO: 2487519 - protein, 17 aa, Entamoeba dispar
IPPTGAYCELLWSDPDE

SEQ ID NO: 2487520 - protein, 20 aa, Entamoeba dispar
IPPTKFVKKSIFGPSVGINF

SEQ ID NO: 2487521 - protein, 22 aa, Entamoeba dispar
IPQARPSAYTLLKHSFISMRNK

SEQ ID NO: 2487522 - protein, 22 aa, Entamoeba dispar
IPQCPIVYCGTFNPFHKAHKKI

SEQ ID NO: 2487523 - protein, 20 aa, Entamoeba dispar
IPQEGIIDVIGWVDNNRKNS

SEQ ID NO: 2487524 - protein, 24 aa, Entamoeba dispar
IPQIICFIKNYYFDDGILTDEKLK

SEQ ID NO: 2487525 - protein, 17 aa, Entamoeba dispar
IPQIIGFSSTMIPITGG

SEQ ID NO: 2487526 - protein, 23 aa, Entamoeba dispar
IPQIKMRLMEFVENLEIGMFNKL

SEQ ID NO: 2487527 - protein, 18 aa, Entamoeba dispar
IPQIRYRDYETIKYSMRS

SEQ ID NO: 2487528 - protein, 23 aa, Entamoeba dispar
IPQKCFKNCRSLSSISFNGKITE

SEQ ID NO: 2487529 - protein, 20 aa, Entamoeba dispar
IPQKERRSGNGITTGLAKGT

SEQ ID NO: 2487530 - protein, 49 aa, Entamoeba dispar
IPQKTEWSFSVQTCGNCGGTVIGGITCCACGIYICSNCRQTYTIDNGNY

SEQ ID NO: 2487531 - protein, 18 aa, Entamoeba dispar
IPQLLRIISSLNPQENAL

SEQ ID NO: 2487532 - protein, 20 aa, Entamoeba dispar
IPQLPGKLILPSSLTSLTTP

SEQ ID NO: 2487533 - protein, 24 aa, Entamoeba dispar
IPQNKLPAVEAWIVNDKIECSEKA

SEQ ID NO: 2487534 - protein, 17 aa, Entamoeba dispar
IPQRMSVIPKKSLNVLF

SEQ ID NO: 2487535 - protein, 23 aa, Entamoeba dispar
IPQSIIRLGDWCLGLCSSLTSIV

SEQ ID NO: 2487536 - protein, 22 aa, Entamoeba dispar
IPQSRYVVISALGSGTFGQVLK

SEQ ID NO: 2487537 - protein, 26 aa, Entamoeba dispar
IPQTGEVLLRIQWEGDVLPVQPERVL

SEQ ID NO: 2487538 - protein, 17 aa, Entamoeba dispar
IPQYLPFEMKLGNLKKS

SEQ ID NO: 2487539 - protein, 17 aa, Entamoeba dispar
IPRDINVGCHWLTVEGV

SEQ ID NO: 2487540 - protein, 23 aa, Entamoeba dispar
IPRLHELYRIVSLDSTILPINDF

SEQ ID NO: 2487541 - protein, 20 aa, Entamoeba dispar
IPRPSELFFQHPSIQQLPKM

SEQ ID NO: 2487542 - protein, 19 aa, Entamoeba dispar
IPRSLKYLFEKVNTQMDTG

SEQ ID NO: 2487543 - protein, 28 aa, Entamoeba dispar
IPSDEPFPYCFDGATSISPTGRFEKYLR

SEQ ID NO: 2487544 - protein, 27 aa, Entamoeba dispar
IPSDTFWSRVLHVLMFNGIIDANTLLQ

SEQ ID NO: 2487545 - protein, 22 aa, Entamoeba dispar
IPSEVKLLGYGYFEYYNELTSI

SEQ ID NO: 2487546 - protein, 24 aa, Entamoeba dispar
IPSEVKSLGDYCFDECYELTTINI

SEQ ID NO: 2487547 - protein, 23 aa, Entamoeba dispar
IPSEVKSLGDYCFGYYNELTTID

SEQ ID NO: 2487548 - protein, 25 aa, Entamoeba dispar
IPSEVKSLGDYCFKDCYELTTINIP

SEQ ID NO: 2487549 - protein, 23 aa, Entamoeba dispar
IPSEVKSLGDYCFNRCDSLTTID

SEQ ID NO: 2487550 - protein, 25 aa, Entamoeba dispar
IPSEWKLNLRKAGIHKKDLKDEKTR

SEQ ID NO: 2487551 - protein, 22 aa, Entamoeba dispar
IPSGICSGCNHLTNVMMDDTVE

SEQ ID NO: 2487552 - protein, 17 aa, Entamoeba dispar
IPSICPLLVHPNITLRQ

SEQ ID NO: 2487553 - protein, 27 aa, Entamoeba dispar
IPSIISSIGDRCFVHSISLTSINIPST

SEQ ID NO: 2487554 - protein, 30 aa, Entamoeba dispar
IPSILMKLLVCPRLTLYALQSLQFILFCNS

SEQ ID NO: 2487555 - protein, 17 aa, Entamoeba dispar
IPSKDINNLVPFINTAH

SEQ ID NO: 2487556 - protein, 19 aa, Entamoeba dispar
IPSKFVVYGVTYYLHLKRS

SEQ ID NO: 2487557 - protein, 18 aa, Entamoeba dispar
IPSLCCLPKTEIEELKLV

SEQ ID NO: 2487558 - protein, 17 aa, Entamoeba dispar
IPSLFSRYINLIIRKNS

SEQ ID NO: 2487559 - protein, 23 aa, Entamoeba dispar
IPSLHPFTQIFVIVEPIQGFVPN

SEQ ID NO: 2487560 - protein, 29 aa, Entamoeba dispar
IPSNCKSGSYLLSCIEILIECFKSINELN

SEQ ID NO: 2487561 - protein, 33 aa, Entamoeba dispar
IPSNCKSGSYLLSCIEILIKCFKSINELNTNNI

SEQ ID NO: 2487562 - protein, 30 aa, Entamoeba dispar
IPSNCKSGSYVLSCIEILIECFKSINELNT

SEQ ID NO: 2487563 - protein, 27 aa, Entamoeba dispar
IPSPVISIGHWCFRECSSLTSMNIDNL

SEQ ID NO: 2487564 - protein, 29 aa, Entamoeba dispar
IPSPVISIGHWCFRECSSLTSMNIDNLQF

SEQ ID NO: 2487565 - protein, 24 aa, Entamoeba dispar
IPSQGDFNGLSSFGSETNQNQSNP

SEQ ID NO: 2487566 - protein, 25 aa, Entamoeba dispar
IPSSDGRIIYSFNGNNIFLIDRIEN

SEQ ID NO: 2487567 - protein, 19 aa, Entamoeba dispar
IPSSFYLVMVDIAYKKSIE

SEQ ID NO: 2487568 - protein, 19 aa, Entamoeba dispar
IPSSILSIGDRCFYNCTQL

SEQ ID NO: 2487569 - protein, 22 aa, Entamoeba dispar
IPSSINKLGYWCFYGCSSVKSI

SEQ ID NO: 2487570 - protein, 17 aa, Entamoeba dispar
IPSSISFIGDDCFSGCL

SEQ ID NO: 2487571 - protein, 18 aa, Entamoeba dispar
IPSSISKLGNRCFEGYES

SEQ ID NO: 2487572 - protein, 19 aa, Entamoeba dispar
IPSSISKLGNRCFEGYESL

SEQ ID NO: 2487573 - protein, 21 aa, Entamoeba dispar
IPSSITKFGRRCFCGCGCEEE

SEQ ID NO: 2487574 - protein, 22 aa, Entamoeba dispar
IPSSITKLGDRCFSKCSSLKSI

SEQ ID NO: 2487575 - protein, 22 aa, Entamoeba dispar
IPSSITKLGDWCFNACSSLTSI

SEQ ID NO: 2487576 - protein, 19 aa, Entamoeba dispar
IPSSITKLGEYCFSGCSTL

SEQ ID NO: 2487577 - protein, 21 aa, Entamoeba dispar
IPSSITKLGNRCFILCTTLTS

SEQ ID NO: 2487578 - protein, 20 aa, Entamoeba dispar
IPSSITKLGYHCFYKCSSLK

SEQ ID NO: 2487579 - protein, 27 aa, Entamoeba dispar
IPSSMFTRCNIMFNRWCQSIPPNRTED

SEQ ID NO: 2487580 - protein, 26 aa, Entamoeba dispar
IPSSQRPKVILDIFKQIILSSKDESV

SEQ ID NO: 2487581 - protein, 30 aa, Entamoeba dispar
IPSSVNELGYWCFYKCLSLTTINIPSLISE

SEQ ID NO: 2487582 - protein, 27 aa, Entamoeba dispar
IPSSVNELGYWCFYKCVSLTTINIPSS

SEQ ID NO: 2487583 - protein, 18 aa, Entamoeba dispar
IPSSVSFIRYGCFSGCTS

SEQ ID NO: 2487584 - protein, 28 aa, Entamoeba dispar
IPSSVSKIGDWCFSYCLSLTSINIPSSI

SEQ ID NO: 2487585 - protein, 25 aa, Entamoeba dispar
IPSSVSKLGNWCFCECSSITSVSVD

SEQ ID NO: 2487586 - protein, 23 aa, Entamoeba dispar
IPSTDCVHFFPVIMNGLLNVNKI

SEQ ID NO: 2487587 - protein, 26 aa, Entamoeba dispar
IPSTIKEFGYWCFNKCSSLTSINIPS

SEQ ID NO: 2487588 - protein, 28 aa, Entamoeba dispar
IPSTISIIGDECFKGCSSLTHIDIPSSV

SEQ ID NO: 2487589 - protein, 28 aa, Entamoeba dispar
IPSTISKIGYRCFSCCGSLTTINIPTNV

SEQ ID NO: 2487590 - protein, 22 aa, Entamoeba dispar
IPSTITSVGYRCLYECSSLTSI

SEQ ID NO: 2487591 - protein, 24 aa, Entamoeba dispar
IPSTPRRAAVSLKELIAQQHQQQK

SEQ ID NO: 2487592 - protein, 29 aa, Entamoeba dispar
IPSVFHLAWLSFLLYKSFKDSSEKSDESL

SEQ ID NO: 2487593 - protein, 23 aa, Entamoeba dispar
IPTDEYITFPWTEYFKTFDKLLS

SEQ ID NO: 2487594 - protein, 19 aa, Entamoeba dispar
IPTDIMLRNATLVASTLFE

SEQ ID NO: 2487595 - protein, 19 aa, Entamoeba dispar
IPTEILGMIVKEFSENCIK

SEQ ID NO: 2487596 - protein, 17 aa, Entamoeba dispar
IPTETFYTLLLPIQKIE

SEQ ID NO: 2487597 - protein, 18 aa, Entamoeba dispar
IPTFFKKTIEFINREGIT

SEQ ID NO: 2487598 - protein, 23 aa, Entamoeba dispar
IPTKTSWISGEWNELTAGGCFNS

SEQ ID NO: 2487599 - protein, 17 aa, Entamoeba dispar
IPTLSPSNVIDWVVEVN

SEQ ID NO: 2487600 - protein, 20 aa, Entamoeba dispar
IPTMRIEKINEWLNCIESCI

SEQ ID NO: 2487601 - protein, 21 aa, Entamoeba dispar
IPTPEFIVSHLIRRHPKSKAF

SEQ ID NO: 2487602 - protein, 29 aa, Entamoeba dispar
IPTQVNELGKWCFYGCMLLTSINIPSSIS

SEQ ID NO: 2487603 - protein, 18 aa, Entamoeba dispar
IPTRAFCGCFSLKEVELP

SEQ ID NO: 2487604 - protein, 27 aa, Entamoeba dispar
IPTSISKIGNWCFKYCSSLKSINIPSS

SEQ ID NO: 2487605 - protein, 31 aa, Entamoeba dispar
IPTSISKLGNWCFSRCYSLISLHLPTTITSF

SEQ ID NO: 2487606 - protein, 19 aa, Entamoeba dispar
IPTSITKLGYYCFEGCSML

SEQ ID NO: 2487607 - protein, 18 aa, Entamoeba dispar
IPTSVKRIYLQKEIDDEQ

SEQ ID NO: 2487608 - protein, 23 aa, Entamoeba dispar
IPTSVSEFGCWCFSECPSLTSID

SEQ ID NO: 2487609 - protein, 24 aa, Entamoeba dispar
IPTSVSEFGCWCFSECPSLTSIDI

SEQ ID NO: 2487610 - protein, 30 aa, Entamoeba dispar
IPTSVSRIGKWCFYECRSLINVNIPTTIKE

SEQ ID NO: 2487611 - protein, 30 aa, Entamoeba dispar
IPTTIKEFGYWCFYKCYSLTSISIPPSVNK

SEQ ID NO: 2487612 - protein, 24 aa, Entamoeba dispar
IPTTIKEIGDWCFGACELLSNINI

SEQ ID NO: 2487613 - protein, 25 aa, Entamoeba dispar
IPTTIKEIGDWCFWICSSLTSITIP

SEQ ID NO: 2487614 - protein, 30 aa, Entamoeba dispar
IPTTISKLGKYCFKECYSLTSIIIPTTINK

SEQ ID NO: 2487615 - protein, 30 aa, Entamoeba dispar
IPTTITKLVHEWFKEMKFLKTITIPFSIIE

SEQ ID NO: 2487616 - protein, 22 aa, Entamoeba dispar
IPTTITSLGNYCFSNVSIYSDN

SEQ ID NO: 2487617 - protein, 31 aa, Entamoeba dispar
IPTTVSRIGKWCFYECRSLVNVNIPTTIKEI

SEQ ID NO: 2487618 - protein, 17 aa, Entamoeba dispar
IPVASYIEDGIKLITKQ

SEQ ID NO: 2487619 - protein, 17 aa, Entamoeba dispar
IPVEQRRTFTFKHTFNQ

SEQ ID NO: 2487620 - protein, 18 aa, Entamoeba dispar
IPVGFCNEVPMVTTQAVL

SEQ ID NO: 2487621 - protein, 26 aa, Entamoeba dispar
IPVPRELPCNAKVLYPFKSCDSKTLS

SEQ ID NO: 2487622 - protein, 17 aa, Entamoeba dispar
IPVRFDPKVEMNFNIEL

SEQ ID NO: 2487623 - protein, 17 aa, Entamoeba dispar
IPVRFMLTKINPYNFSL

SEQ ID NO: 2487624 - protein, 18 aa, Entamoeba dispar
IPVSDSWEGKIDISGVTG

SEQ ID NO: 2487625 - protein, 18 aa, Entamoeba dispar
IPVSDSWEGKIDITGVTG

SEQ ID NO: 2487626 - protein, 30 aa, Entamoeba dispar
IPVSGVGLGPIFKKDVMKTLIMKEKNPDYA

SEQ ID NO: 2487627 - protein, 20 aa, Entamoeba dispar
IPVSTEWKGAMKHLGGRDYS

SEQ ID NO: 2487628 - protein, 22 aa, Entamoeba dispar
IPYCYYNLNLIGGILPNDYYKG

SEQ ID NO: 2487629 - protein, 26 aa, Entamoeba dispar
IPYEMWKEAIELASKEFYINKNFKQM

SEQ ID NO: 2487630 - protein, 18 aa, Entamoeba dispar
IPYLIEIGSNAFYNCRLL

SEQ ID NO: 2487631 - protein, 21 aa, Entamoeba dispar
IPYRDSRLTFMLKDSLGGNCK

SEQ ID NO: 2487632 - protein, 20 aa, Entamoeba dispar
IPYYCFHNCFSLSNVAIPTT

SEQ ID NO: 2487633 - protein, 21 aa, Entamoeba dispar
IPYYVCFKNDGNKSINMLQGD

SEQ ID NO: 2487634 - protein, 30 aa, Entamoeba dispar
IQAAPAFPESFPHLFGKQKIRCLIPCAIDQ

SEQ ID NO: 2487635 - protein, 30 aa, Entamoeba dispar
  misc_feature (29)..(30): Xaa can be any naturally occurring amino acid
IQAAPAFPESFPHLFGKQKIRCLIPCAIXX

SEQ ID NO: 2487636 - protein, 24 aa, Entamoeba dispar
IQAELKIAGILLHGSEKIQADKPK

SEQ ID NO: 2487637 - protein, 27 aa, Entamoeba dispar
IQAFLQILIPFEWQGVLIPMLPIEESY

SEQ ID NO: 2487638 - protein, 19 aa, Entamoeba dispar
IQAIEHWKTLTLQNKQSLL

SEQ ID NO: 2487639 - protein, 21 aa, Entamoeba dispar
IQCDECKITIVIDKNTGKTKG

SEQ ID NO: 2487640 - protein, 22 aa, Entamoeba dispar
IQCEREGFFPVDYSIHRQRQVF

SEQ ID NO: 2487641 - protein, 25 aa, Entamoeba dispar
IQCINNLHCALTFMERDMLVKNPGC

SEQ ID NO: 2487642 - protein, 20 aa, Entamoeba dispar
IQCIRSVYHNVFPQFIPQDN

SEQ ID NO: 2487643 - protein, 28 aa, Entamoeba dispar
IQCKLPSLRKLSCCEFIPSEFITNLTFL

SEQ ID NO: 2487644 - protein, 18 aa, Entamoeba dispar
IQCLPPEHMTVFKETMKL

SEQ ID NO: 2487645 - protein, 18 aa, Entamoeba dispar
IQCMKDAKLRKKDISDVV

SEQ ID NO: 2487646 - protein, 21 aa, Entamoeba dispar
IQDCFSQFCDLILSINEQTLF

SEQ ID NO: 2487647 - protein, 24 aa, Entamoeba dispar
IQDLYKFRIDNNIIQLSSAQAATL

SEQ ID NO: 2487648 - protein, 19 aa, Entamoeba dispar
IQDRDRFKSIAKNFTTQFT

SEQ ID NO: 2487649 - protein, 17 aa, Entamoeba dispar
IQEAVLIGILSRHCSIV

SEQ ID NO: 2487650 - protein, 19 aa, Entamoeba dispar
IQEDVLFNVCKLCKILMTD

SEQ ID NO: 2487651 - protein, 24 aa, Entamoeba dispar
IQEEVKGILPWIINFNYHSSLKQY

SEQ ID NO: 2487652 - protein, 24 aa, Entamoeba dispar
IQEHPHKVFLIDGFPRNEENKNVW

SEQ ID NO: 2487653 - protein, 22 aa, Entamoeba dispar
IQEKAVNVLIEFFSMNLEEEKE

SEQ ID NO: 2487654 - protein, 27 aa, Entamoeba dispar
IQEKIINIIPCLKKETKKIGIITQNQN

SEQ ID NO: 2487655 - protein, 25 aa, Entamoeba dispar
IQEKISSWTSFSFKQVIFNSDQNEW

SEQ ID NO: 2487656 - protein, 17 aa, Entamoeba dispar
IQEKRNLLTKSILEGEI

SEQ ID NO: 2487657 - protein, 18 aa, Entamoeba dispar
IQELCRIGLALAHQTIIQ

SEQ ID NO: 2487658 - protein, 18 aa, Entamoeba dispar
IQELKLSGLDSIKSISFP

SEQ ID NO: 2487659 - protein, 26 aa, Entamoeba dispar
IQELMKRLLLIYAIKHPASGYVQGMS

SEQ ID NO: 2487660 - protein, 21 aa, Entamoeba dispar
IQELRSIRSSKEIEMIKQIHI

SEQ ID NO: 2487661 - protein, 24 aa, Entamoeba dispar
IQETRLKSLSLKQVEDKIRPKINK

SEQ ID NO: 2487662 - protein, 18 aa, Entamoeba dispar
IQFDECVIIKNSIHQLLQ

SEQ ID NO: 2487663 - protein, 17 aa, Entamoeba dispar
IQFEIGEPLPEESLPQD

SEQ ID NO: 2487664 - protein, 20 aa, Entamoeba dispar
IQFEKTCFNISQYNEVYCGE

SEQ ID NO: 2487665 - protein, 24 aa, Entamoeba dispar
IQFIPTNICFIKLFHMNSTDWIID

SEQ ID NO: 2487666 - protein, 22 aa, Entamoeba dispar
IQFKESREIILFVGSPASGKTS

SEQ ID NO: 2487667 - protein, 19 aa, Entamoeba dispar
IQFKLNNEIEINQKVEKEK

SEQ ID NO: 2487668 - protein, 18 aa, Entamoeba dispar
IQFLKLMKPNSFKVFDVN

SEQ ID NO: 2487669 - protein, 28 aa, Entamoeba dispar
IQFLSSVEFCLFPSFFTGLASFKDQKKS

SEQ ID NO: 2487670 - protein, 17 aa, Entamoeba dispar
IQFMKEFSYYASNFPLC

SEQ ID NO: 2487671 - protein, 19 aa, Entamoeba dispar
IQGEAVVAFVVIKKDCSFD

SEQ ID NO: 2487672 - protein, 25 aa, Entamoeba dispar
IQGGTCAIPGAFGCGKTVISQALSK

SEQ ID NO: 2487673 - protein, 25 aa, Entamoeba dispar
IQGKRDIKQILSILLNSGRETMPSI

SEQ ID NO: 2487674 - protein, 23 aa, Entamoeba dispar
IQGPFSFPIEYEFGKRSQHETLH

SEQ ID NO: 2487675 - protein, 18 aa, Entamoeba dispar
IQGSIVNRILTNIDLGNI

SEQ ID NO: 2487676 - protein, 18 aa, Entamoeba dispar
IQGVCEGYGMPIGTTGKR

SEQ ID NO: 2487677 - protein, 19 aa, Entamoeba dispar
IQHLLEFGNDIIREAIINE

SEQ ID NO: 2487678 - protein, 19 aa, Entamoeba dispar
IQHWGVIWSNLYSMIESTN

SEQ ID NO: 2487679 - protein, 18 aa, Entamoeba dispar
IQICDPKDVGCFIKALGD

SEQ ID NO: 2487680 - protein, 22 aa, Entamoeba dispar
IQIEGTCCPNALLRYLELKPIN

SEQ ID NO: 2487681 - protein, 18 aa, Entamoeba dispar
IQIGNCFYLTDPAILSLS

SEQ ID NO: 2487682 - protein, 19 aa, Entamoeba dispar
IQIKMKLRSLLLKKNNQPD

SEQ ID NO: 2487683 - protein, 17 aa, Entamoeba dispar
IQIKNPLYIVAMPRSGS

SEQ ID NO: 2487684 - protein, 24 aa, Entamoeba dispar
IQIKQCIEFLKPIMNTIIQTIHFI

SEQ ID NO: 2487685 - protein, 25 aa, Entamoeba dispar
IQIKSEFSVNEFVTYSLDNPEVYEA

SEQ ID NO: 2487686 - protein, 19 aa, Entamoeba dispar
IQIKVFLLSGTSIHLPTLQ

SEQ ID NO: 2487687 - protein, 18 aa, Entamoeba dispar
IQILLRLGQHLDSKTRIE

SEQ ID NO: 2487688 - protein, 24 aa, Entamoeba dispar
IQILNCFYTGCATCKKKIEQDNCK

SEQ ID NO: 2487689 - protein, 30 aa, Entamoeba dispar
IQIPLESSLSFNLNDSFFLFGENSYSSLTI

SEQ ID NO: 2487690 - protein, 17 aa, Entamoeba dispar
IQIPPVINKSTSINQTS

SEQ ID NO: 2487691 - protein, 19 aa, Entamoeba dispar
IQISFIRLSSYHQFIPQID

SEQ ID NO: 2487692 - protein, 24 aa, Entamoeba dispar
IQISKRFQIVLSYFQSNPISVKSL

SEQ ID NO: 2487693 - protein, 29 aa, Entamoeba dispar
IQIVFCCYNYKGIIADAIVSPNLPLRMYC

SEQ ID NO: 2487694 - protein, 20 aa, Entamoeba dispar
IQIVIQFAMSCFEYSTNDND

SEQ ID NO: 2487695 - protein, 26 aa, Entamoeba dispar
IQKALLSWKEMKEKLNELSPGVIVDC

SEQ ID NO: 2487696 - protein, 24 aa, Entamoeba dispar
IQKEFKLIGILSHNFLERSTPYEI

SEQ ID NO: 2487697 - protein, 26 aa, Entamoeba dispar
IQKERGEEFWVIFGQLLNYSDTLPKF

SEQ ID NO: 2487698 - protein, 20 aa, Entamoeba dispar
IQKHKSIIVECLKDRDHAIR

SEQ ID NO: 2487699 - protein, 25 aa, Entamoeba dispar
IQKIGSKCYTRLFEIINLKFHKAWE

SEQ ID NO: 2487700 - protein, 27 aa, Entamoeba dispar
IQKKCCQCEFVCQLYLSAAFSNPRKEV

SEQ ID NO: 2487701 - protein, 18 aa, Entamoeba dispar
IQKKCGDVQFLVISLKDT

SEQ ID NO: 2487702 - protein, 22 aa, Entamoeba dispar
IQKLELISCNSFYTLNIPSSLI

SEQ ID NO: 2487703 - protein, 23 aa, Entamoeba dispar
IQKLSKFVVGNPFQSLRNQQVTQ

SEQ ID NO: 2487704 - protein, 21 aa, Entamoeba dispar
IQKMESLTCVSFLPEQLIEVV

SEQ ID NO: 2487705 - protein, 20 aa, Entamoeba dispar
IQKNGVWRIDFEDFEQQIIS

SEQ ID NO: 2487706 - protein, 19 aa, Entamoeba dispar
IQKNLPLITIELCQRDTHH

SEQ ID NO: 2487707 - protein, 26 aa, Entamoeba dispar
IQKSFYKGCLMGGVHGGIYNICEISK

SEQ ID NO: 2487708 - protein, 27 aa, Entamoeba dispar
IQKVCFKCGKPGHIGRDCPQPDDRVCF

SEQ ID NO: 2487709 - protein, 25 aa, Entamoeba dispar
IQKVKKWKDGIAIYYKDNKKFELYE

SEQ ID NO: 2487710 - protein, 18 aa, Entamoeba dispar
IQKVRIGKTIIRINTNLT

SEQ ID NO: 2487711 - protein, 17 aa, Entamoeba dispar
IQKWKLEPKKVGEFCFE

SEQ ID NO: 2487712 - protein, 23 aa, Entamoeba dispar
IQKWRSWQLKSWNKIADNIIEKH

SEQ ID NO: 2487713 - protein, 19 aa, Entamoeba dispar
IQLCFFKAVIQLLLNYKQF

SEQ ID NO: 2487714 - protein, 17 aa, Entamoeba dispar
IQLCLKKDFDGALIEIK

SEQ ID NO: 2487715 - protein, 19 aa, Entamoeba dispar
IQLCQEINSSISLDISEID

SEQ ID NO: 2487716 - protein, 24 aa, Entamoeba dispar
IQLEAICFEVTYSQFLEFQKEKIK

SEQ ID NO: 2487717 - protein, 25 aa, Entamoeba dispar
IQLFHDIMRDFPIRRDIMDMALTNY

SEQ ID NO: 2487718 - protein, 22 aa, Entamoeba dispar
IQLFIRCDHTLFIWSSKSFCNS

SEQ ID NO: 2487719 - protein, 17 aa, Entamoeba dispar
IQLGDQEFLFFSLNGFY

SEQ ID NO: 2487720 - protein, 32 aa, Entamoeba dispar
IQLISSISCFINFLFTKCCKEILVIFTNMCYN

SEQ ID NO: 2487721 - protein, 17 aa, Entamoeba dispar
IQLKNQFLIEKKQMMEK

SEQ ID NO: 2487722 - protein, 20 aa, Entamoeba dispar
IQLLDGIKFQNEKIFEMQEE

SEQ ID NO: 2487723 - protein, 17 aa, Entamoeba dispar
IQLLWDMLESVTGDQMM

SEQ ID NO: 2487724 - protein, 21 aa, Entamoeba dispar
IQLMFSGVFKINGKISENVGC

SEQ ID NO: 2487725 - protein, 17 aa, Entamoeba dispar
IQLMTELKNKGELSKIN

SEQ ID NO: 2487726 - protein, 21 aa, Entamoeba dispar
IQLPCYHYFHSECIDNLKTSG

SEQ ID NO: 2487727 - protein, 17 aa, Entamoeba dispar
IQLPIFLLNKMNSVISY

SEQ ID NO: 2487728 - protein, 24 aa, Entamoeba dispar
IQLPKNKKGGILVSKGKLGLGTKQ

SEQ ID NO: 2487729 - protein, 21 aa, Entamoeba dispar
IQLPLMVKISRYFTKEDMTAL

SEQ ID NO: 2487730 - protein, 20 aa, Entamoeba dispar
IQLPSLLPPIQFIYEIVPNN

SEQ ID NO: 2487731 - protein, 21 aa, Entamoeba dispar
IQLRLKAITFLSNAVGFIETT

SEQ ID NO: 2487732 - protein, 17 aa, Entamoeba dispar
IQMFDFTIMDSRFLPFR

SEQ ID NO: 2487733 - protein, 20 aa, Entamoeba dispar
IQMGEVIKMIKKRYPLSEVE

SEQ ID NO: 2487734 - protein, 23 aa, Entamoeba dispar
IQMHCNNCQFRHSSQHNAKISEE

SEQ ID NO: 2487735 - protein, 21 aa, Entamoeba dispar
IQMIICGDFCQLPPISRNGTT

SEQ ID NO: 2487736 - protein, 19 aa, Entamoeba dispar
IQMKLNFLMDRSCKVKQDL

SEQ ID NO: 2487737 - protein, 22 aa, Entamoeba dispar
IQMKRVESIAIDNGIINLSQSN

SEQ ID NO: 2487738 - protein, 23 aa, Entamoeba dispar
IQMPPSLLSRFDLIYLILDQPNP

SEQ ID NO: 2487739 - protein, 22 aa, Entamoeba dispar
IQMVCWPWKYYHDSNQFTLGNI

SEQ ID NO: 2487740 - protein, 18 aa, Entamoeba dispar
IQNELFCCESFYKELSKK

SEQ ID NO: 2487741 - protein, 26 aa, Entamoeba dispar
IQNEYLICYNGAMICHGNETIFESEI

SEQ ID NO: 2487742 - protein, 23 aa, Entamoeba dispar
IQNIKICICYEIKNNSDFTKIEL

SEQ ID NO: 2487743 - protein, 27 aa, Entamoeba dispar
IQNLEMYKGIIPFKWLKEEENEEILMN

SEQ ID NO: 2487744 - protein, 23 aa, Entamoeba dispar
IQNLREISTIIVYGPTAEVISTG

SEQ ID NO: 2487745 - protein, 26 aa, Entamoeba dispar
IQNNCKYVKMILGHISLLFSPEKIDV

SEQ ID NO: 2487746 - protein, 24 aa, Entamoeba dispar
IQNSLKHNILYPLKKEIIINQLQK

SEQ ID NO: 2487747 - protein, 18 aa, Entamoeba dispar
IQNVAYTNAVDWWGLGIL

SEQ ID NO: 2487748 - protein, 19 aa, Entamoeba dispar
IQNVFKVSLAKVFGLTLNV

SEQ ID NO: 2487749 - protein, 22 aa, Entamoeba dispar
IQPEMLHSLEFILQYEGNDMEE

SEQ ID NO: 2487750 - protein, 17 aa, Entamoeba dispar
IQPFKPSGILLYGPSGC

SEQ ID NO: 2487751 - protein, 17 aa, Entamoeba dispar
IQPFKVFEYKREGKQSI

SEQ ID NO: 2487752 - protein, 20 aa, Entamoeba dispar
IQPIEVCLVNDLQGRTLPLL

SEQ ID NO: 2487753 - protein, 23 aa, Entamoeba dispar
IQPIQRLPRYVLLLKELIKTTPE

SEQ ID NO: 2487754 - protein, 24 aa, Entamoeba dispar
IQPKAIKIMAIKALTDISNLKLQL

SEQ ID NO: 2487755 - protein, 23 aa, Entamoeba dispar
IQPKRVLLQPSFKDFVQTNPEEI

SEQ ID NO: 2487756 - protein, 21 aa, Entamoeba dispar
IQPMRRFIVRASIADSTSSVW

SEQ ID NO: 2487757 - protein, 20 aa, Entamoeba dispar
IQPNCRRNLILITKIIQNIA

SEQ ID NO: 2487758 - protein, 17 aa, Entamoeba dispar
IQPPCYVVGDLHGNYRD

SEQ ID NO: 2487759 - protein, 27 aa, Entamoeba dispar
IQPQPIIKNKYDILAQIQLEQQQQPSS

SEQ ID NO: 2487760 - protein, 30 aa, Entamoeba dispar
IQPRANISSNISFVYCININVFDCIDSTCN

SEQ ID NO: 2487761 - protein, 19 aa, Entamoeba dispar
IQQECIIMAIGILTTLKLT

SEQ ID NO: 2487762 - protein, 17 aa, Entamoeba dispar
IQQGISFKLQPTQVPVS

SEQ ID NO: 2487763 - protein, 19 aa, Entamoeba dispar
IQQIMIWLIKNGFRHVSEL

SEQ ID NO: 2487764 - protein, 22 aa, Entamoeba dispar
IQQLCIPPLLSFHNVLGGAETG

SEQ ID NO: 2487765 - protein, 24 aa, Entamoeba dispar
IQQPSNSADLFWSNQQQSIPQQQQ

SEQ ID NO: 2487766 - protein, 21 aa, Entamoeba dispar
IQQQICKLIFEKVNDVIQNAQ

SEQ ID NO: 2487767 - protein, 26 aa, Entamoeba dispar
IQQRYGIDFDSVFKIVKEFRKNKKKV

SEQ ID NO: 2487768 - protein, 17 aa, Entamoeba dispar
IQREQLLVIGLMPVNKM

SEQ ID NO: 2487769 - protein, 25 aa, Entamoeba dispar
IQREVPRHPVAFVIETLGGIIVDNV

SEQ ID NO: 2487770 - protein, 19 aa, Entamoeba dispar
IQRKFLRVEYSIYDRDDFG

SEQ ID NO: 2487771 - protein, 17 aa, Entamoeba dispar
IQRLPRYQMLLIQLIQS

SEQ ID NO: 2487772 - protein, 19 aa, Entamoeba dispar
IQRNLCRYRNAMKKIPLES

SEQ ID NO: 2487773 - protein, 30 aa, Entamoeba dispar
IQRNSFCFFIVCLFLLYKTYPTQFEFNESL

SEQ ID NO: 2487774 - protein, 17 aa, Entamoeba dispar
IQRQNGFEIVQYMVNHF

SEQ ID NO: 2487775 - protein, 20 aa, Entamoeba dispar
IQRRCGRCLEEIVKEDPVFQ

SEQ ID NO: 2487776 - protein, 19 aa, Entamoeba dispar
IQRRKYLKDTDFVIFFLKS

SEQ ID NO: 2487777 - protein, 18 aa, Entamoeba dispar
IQRSLVYRAPEVLTNVSL

SEQ ID NO: 2487778 - protein, 43 aa, Entamoeba dispar
IQRTLKSWVTFRNWAWWKLYVKARPMLKRRNFEEEGKKKDKEI

SEQ ID NO: 2487779 - protein, 22 aa, Entamoeba dispar
IQSDGKCGVYFHDKETHELYQY

SEQ ID NO: 2487780 - protein, 21 aa, Entamoeba dispar
IQSNCLREIAILKKLNHNNII

SEQ ID NO: 2487781 - protein, 24 aa, Entamoeba dispar
IQSNLKPYAFIVATEIEYFIFGRK

SEQ ID NO: 2487782 - protein, 18 aa, Entamoeba dispar
IQSRCAKMRFGPLSPNAL

SEQ ID NO: 2487783 - protein, 17 aa, Entamoeba dispar
IQSRVFMSAYYMMRQLK

SEQ ID NO: 2487784 - protein, 17 aa, Entamoeba dispar
IQSRVVVTDTAYELKDQ

SEQ ID NO: 2487785 - protein, 17 aa, Entamoeba dispar
IQSSFGIRRRVVRDYGF

SEQ ID NO: 2487786 - protein, 17 aa, Entamoeba dispar
IQSSPFIIGKNVKNLIV

SEQ ID NO: 2487787 - protein, 18 aa, Entamoeba dispar
IQSSRLVFYPKNSAQLFG

SEQ ID NO: 2487788 - protein, 26 aa, Entamoeba dispar
IQSVDRFPPQIGFLFYTLRLKIINGY

SEQ ID NO: 2487789 - protein, 24 aa, Entamoeba dispar
IQSVGKGGAAFIFKGKLRTKENEM

SEQ ID NO: 2487790 - protein, 27 aa, Entamoeba dispar
IQTGVLLLEILLRFYGAQHTSIFMDLL

SEQ ID NO: 2487791 - protein, 27 aa, Entamoeba dispar
IQTIGIQCLQFPFTLSIHQQPLHFFSH

SEQ ID NO: 2487792 - protein, 17 aa, Entamoeba dispar
IQTKEIFALPKSNKNDV

SEQ ID NO: 2487793 - protein, 19 aa, Entamoeba dispar
IQTVLCTGNLCGKETYDIL

SEQ ID NO: 2487794 - protein, 25 aa, Entamoeba dispar
IQVECLRGKFGSCGGINCFHSSDSA

SEQ ID NO: 2487795 - protein, 23 aa, Entamoeba dispar
IQVFFQFLSKYGFDYNSLNNQCI

SEQ ID NO: 2487796 - protein, 18 aa, Entamoeba dispar
IQVGIGMTQLNAVIGGEG

SEQ ID NO: 2487797 - protein, 18 aa, Entamoeba dispar
IQVLESIQAYIWKNEETP

SEQ ID NO: 2487798 - protein, 19 aa, Entamoeba dispar
IQVNTDFKFSIAEQNKEHT

SEQ ID NO: 2487799 - protein, 19 aa, Entamoeba dispar
IQVRGNIPLIWKTKETDLF

SEQ ID NO: 2487800 - protein, 19 aa, Entamoeba dispar
IQYCYKLKTLTLHLDPSQL

SEQ ID NO: 2487801 - protein, 17 aa, Entamoeba dispar
IQYFKYLQSFCALHNII

SEQ ID NO: 2487802 - protein, 22 aa, Entamoeba dispar
IQYKRLRAINYIRIEKLFEEPF

SEQ ID NO: 2487803 - protein, 17 aa, Entamoeba dispar
IQYLAAFGIGKLVIVDN

SEQ ID NO: 2487804 - protein, 21 aa, Entamoeba dispar
IQYSINYYVQAFMNYISSILS

SEQ ID NO: 2487805 - protein, 18 aa, Entamoeba dispar
IRAASLLNNPTFLPIIHS

SEQ ID NO: 2487806 - protein, 23 aa, Entamoeba dispar
IRACELGPFGFEWDNKDEEDRKG

SEQ ID NO: 2487807 - protein, 17 aa, Entamoeba dispar
IRAELVSTWSFGVILYR

SEQ ID NO: 2487808 - protein, 22 aa, Entamoeba dispar
IRAKRAFNPAEWIEKKCTMLNN

SEQ ID NO: 2487809 - protein, 20 aa, Entamoeba dispar
IRALTLKFILTISEKELIQP

SEQ ID NO: 2487810 - protein, 17 aa, Entamoeba dispar
IRCGITKSIIYKFHPFY

SEQ ID NO: 2487811 - protein, 18 aa, Entamoeba dispar
IRCLGWCGVPDDFNSRFS

SEQ ID NO: 2487812 - protein, 17 aa, Entamoeba dispar
IRCLKIYKQWLTTSNSP

SEQ ID NO: 2487813 - protein, 23 aa, Entamoeba dispar
IRCMAFLLRCRLLIVTHQQETFR

SEQ ID NO: 2487814 - protein, 22 aa, Entamoeba dispar
IRCSCGGLVKPDIVFFNESLPD

SEQ ID NO: 2487815 - protein, 21 aa, Entamoeba dispar
IRCYENPELVLSVTNNIDKVC

SEQ ID NO: 2487816 - protein, 18 aa, Entamoeba dispar
IRCYPGFQAVIVYRIAHI

SEQ ID NO: 2487817 - protein, 25 aa, Entamoeba dispar
IRDAVGCPWTPFDLSTTPLASRSYL

SEQ ID NO: 2487818 - protein, 19 aa, Entamoeba dispar
IRDEYCVIIAFLKKMTDIG

SEQ ID NO: 2487819 - protein, 20 aa, Entamoeba dispar
IRDGLRFTKIKFVLLQIIRY

SEQ ID NO: 2487820 - protein, 22 aa, Entamoeba dispar
IRDLEFMIGPMLYEASWQELAK

SEQ ID NO: 2487821 - protein, 21 aa, Entamoeba dispar
IRDNIIKKWIEQIGGKIATRA

SEQ ID NO: 2487822 - protein, 23 aa, Entamoeba dispar
IRDNRSSFDINNFQYIKSLIDKI

SEQ ID NO: 2487823 - protein, 22 aa, Entamoeba dispar
IRDSCFRECKSLKSINIPTSVS

SEQ ID NO: 2487824 - protein, 18 aa, Entamoeba dispar
IRDSFWRNARSKLNAYFL

SEQ ID NO: 2487825 - protein, 25 aa, Entamoeba dispar
IRDWSFNGCISLKSIIVPSSITKLG

SEQ ID NO: 2487826 - protein, 22 aa, Entamoeba dispar
IRDYCFKKCLSLTSINIPSSIT

SEQ ID NO: 2487827 - protein, 19 aa, Entamoeba dispar
IRDYIPVLIISYEQVRSHV

SEQ ID NO: 2487828 - protein, 24 aa, Entamoeba dispar
IREEKELKEKLAMLQGLQTDNFFE

SEQ ID NO: 2487829 - protein, 18 aa, Entamoeba dispar
IREFAWLLCIGYYNYKST

SEQ ID NO: 2487830 - protein, 20 aa, Entamoeba dispar
IREGHALLAIMQQITHSIVK

SEQ ID NO: 2487831 - protein, 17 aa, Entamoeba dispar
IREKMLYSATKATIKQA

SEQ ID NO: 2487832 - protein, 25 aa, Entamoeba dispar
IREKYCSSFGYYLVKGLQNIRRHAY

SEQ ID NO: 2487833 - protein, 34 aa, Entamoeba dispar
IRELCVECSCRRKCLLKYFGETSFKPNKRCCDLC

SEQ ID NO: 2487834 - protein, 22 aa, Entamoeba dispar
IRELWLLLFKFIDHPLKLNNIE

SEQ ID NO: 2487835 - protein, 27 aa, Entamoeba dispar
IREMAFKNFLQLAIKCIEIKNFNSFNS

SEQ ID NO: 2487836 - protein, 18 aa, Entamoeba dispar
IREMIDWSKMKMNVKFQV

SEQ ID NO: 2487837 - protein, 19 aa, Entamoeba dispar
IRENYLVNMPMGIFMAKLD

SEQ ID NO: 2487838 - protein, 19 aa, Entamoeba dispar
IRERLSTPIARGYQPNPYE

SEQ ID NO: 2487839 - protein, 21 aa, Entamoeba dispar
IRFAFSLRYQFIDYWYSSFYY

SEQ ID NO: 2487840 - protein, 26 aa, Entamoeba dispar
IRFIELRSAIFNFHFDIGGEFDVKEL

SEQ ID NO: 2487841 - protein, 23 aa, Entamoeba dispar
IRFIPKNLKGERVIGDELMMHTA

SEQ ID NO: 2487842 - protein, 17 aa, Entamoeba dispar
IRFITHIQLFDYWCSIQ

SEQ ID NO: 2487843 - protein, 18 aa, Entamoeba dispar
IRFIYSLCATCYLLNDWG

SEQ ID NO: 2487844 - protein, 18 aa, Entamoeba dispar
IRFLFLLELAHWYYMDNW

SEQ ID NO: 2487845 - protein, 20 aa, Entamoeba dispar
IRFNPDIVVCGMQELEMGVD

SEQ ID NO: 2487846 - protein, 17 aa, Entamoeba dispar
IRFPKTYPVIYKTLRVD

SEQ ID NO: 2487847 - protein, 25 aa, Entamoeba dispar
IRGEICATLPVLCEGGIAENEHLHI

SEQ ID NO: 2487848 - protein, 24 aa, Entamoeba dispar
IRGGKNSYYMWSINFSQINAILLS

SEQ ID NO: 2487849 - protein, 19 aa, Entamoeba dispar
IRGITLKFLCHVSEREIIQ

SEQ ID NO: 2487850 - protein, 27 aa, Entamoeba dispar
IRGKPMFNALCKFENFFTYKRYKFGVL

SEQ ID NO: 2487851 - protein, 23 aa, Entamoeba dispar
IRGKVAAFFLFIAPPSMEILEQR

SEQ ID NO: 2487852 - protein, 19 aa, Entamoeba dispar
IRGLPLKWGDIEFSKYFKK

SEQ ID NO: 2487853 - protein, 18 aa, Entamoeba dispar
IRGPFIFISMNNKDKNIS

SEQ ID NO: 2487854 - protein, 17 aa, Entamoeba dispar
IRGRLHGKVSVFDKSKF

SEQ ID NO: 2487855 - protein, 17 aa, Entamoeba dispar
IRHACDLIRKGELKVDV

SEQ ID NO: 2487856 - protein, 22 aa, Entamoeba dispar
IRHINDYGAFLLLDKRYSTNPV

SEQ ID NO: 2487857 - protein, 18 aa, Entamoeba dispar
IRHPRNVLEITTSIRRIL

SEQ ID NO: 2487858 - protein, 17 aa, Entamoeba dispar
IRIAEGTGNVVFSVKFE

SEQ ID NO: 2487859 - protein, 19 aa, Entamoeba dispar
IRIAMGCGIAGERRNPLND

SEQ ID NO: 2487860 - protein, 25 aa, Entamoeba dispar
IRIGYNGIINCGDWEVVANNTNSNR

SEQ ID NO: 2487861 - protein, 20 aa, Entamoeba dispar
IRIIAQQMLFGFDIESSLVS

SEQ ID NO: 2487862 - protein, 21 aa, Entamoeba dispar
IRIIHEIFPVYEFWEHVCVVW

SEQ ID NO: 2487863 - protein, 18 aa, Entamoeba dispar
IRIKMERFLTYDSVEVFP

SEQ ID NO: 2487864 - protein, 19 aa, Entamoeba dispar
IRIKPNIITIEGGYACEFE

SEQ ID NO: 2487865 - protein, 18 aa, Entamoeba dispar
IRILGEFVGRVVGEILYR

SEQ ID NO: 2487866 - protein, 24 aa, Entamoeba dispar
IRILRLEYKGFVFSKQLLCKLGES

SEQ ID NO: 2487867 - protein, 27 aa, Entamoeba dispar
IRIRLSEYLKRLEMEECDLIDIDNEMK

SEQ ID NO: 2487868 - protein, 19 aa, Entamoeba dispar
IRISDIFTTLIKRINAMNQ

SEQ ID NO: 2487869 - protein, 19 aa, Entamoeba dispar
IRISDIFTTLIKRINSSNG

SEQ ID NO: 2487870 - protein, 20 aa, Entamoeba dispar
IRKEDCVVLSLSNGFEHSED

SEQ ID NO: 2487871 - protein, 20 aa, Entamoeba dispar
IRKENKYIKFINEIVNTVMN

SEQ ID NO: 2487872 - protein, 27 aa, Entamoeba dispar
IRKETSPICILVFLPGMAEIEEMKSRL

SEQ ID NO: 2487873 - protein, 24 aa, Entamoeba dispar
IRKFPGQYGNLIVHFNIQNPTYLS

SEQ ID NO: 2487874 - protein, 17 aa, Entamoeba dispar
IRKKIEFVKHVPKEFVF

SEQ ID NO: 2487875 - protein, 19 aa, Entamoeba dispar
IRKKLEIVTSMTKGFQFED

SEQ ID NO: 2487876 - protein, 22 aa, Entamoeba dispar
IRKKRFPINMKEINTLQSINSP

SEQ ID NO: 2487877 - protein, 23 aa, Entamoeba dispar
IRKLCFEAAEYKFASVCVNPTWV

SEQ ID NO: 2487878 - protein, 17 aa, Entamoeba dispar
IRKLCSLTRRNMIKTAI

SEQ ID NO: 2487879 - protein, 17 aa, Entamoeba dispar
IRKLCSTDEEFKEMLNT

SEQ ID NO: 2487880 - protein, 17 aa, Entamoeba dispar
IRKMPLENVTLLRSILK

SEQ ID NO: 2487881 - protein, 20 aa, Entamoeba dispar
IRKPLFDIRINYLKSSASSK

SEQ ID NO: 2487882 - protein, 21 aa, Entamoeba dispar
IRKSKTFYGVDEMKQVTGIQD

SEQ ID NO: 2487883 - protein, 19 aa, Entamoeba dispar
IRKSLPVYQKREEFLKLVR

SEQ ID NO: 2487884 - protein, 24 aa, Entamoeba dispar
IRKVEELYMRMSVTNFEDIPVDVI

SEQ ID NO: 2487885 - protein, 20 aa, Entamoeba dispar
IRLADLISRNLLRNEGLLPH

SEQ ID NO: 2487886 - protein, 17 aa, Entamoeba dispar
IRLDHTRYSKAVAEAIA

SEQ ID NO: 2487887 - protein, 17 aa, Entamoeba dispar
IRLKIPICVSPQKCFDL

SEQ ID NO: 2487888 - protein, 25 aa, Entamoeba dispar
IRLLPEQVSALILLKVKELILKIHK

SEQ ID NO: 2487889 - protein, 19 aa, Entamoeba dispar
IRLLVSLSQIKSRVGSLAR

SEQ ID NO: 2487890 - protein, 17 aa, Entamoeba dispar
IRLPTSITNLNILSNVT

SEQ ID NO: 2487891 - protein, 19 aa, Entamoeba dispar
IRLRCPHAQFTEAKSSESD

SEQ ID NO: 2487892 - protein, 21 aa, Entamoeba dispar
IRLREKLTYSHTFGIYVDLQL

SEQ ID NO: 2487893 - protein, 18 aa, Entamoeba dispar
IRLRKIVLLDSVGNIQQA

SEQ ID NO: 2487894 - protein, 19 aa, Entamoeba dispar
IRLSEEFITTMLIASPQLR

SEQ ID NO: 2487895 - protein, 20 aa, Entamoeba dispar
IRLSESLKKFEMEECDLIDI

SEQ ID NO: 2487896 - protein, 21 aa, Entamoeba dispar
IRLSPQTALRMMRIFDTDFNG

SEQ ID NO: 2487897 - protein, 19 aa, Entamoeba dispar
IRLSTDMKISCFDQNNQIH

SEQ ID NO: 2487898 - protein, 18 aa, Entamoeba dispar
IRLVCLATKHILAKTEYE

SEQ ID NO: 2487899 - protein, 18 aa, Entamoeba dispar
IRLVFQNRCQIIEKQDNY

SEQ ID NO: 2487900 - protein, 24 aa, Entamoeba dispar
IRLYYVCLLNNFPVDEINQLMAEK

SEQ ID NO: 2487901 - protein, 18 aa, Entamoeba dispar
IRMEKSLRIIFGNYMKSC

SEQ ID NO: 2487902 - protein, 17 aa, Entamoeba dispar
IRMKGIPKSAIIGTANE

SEQ ID NO: 2487903 - protein, 22 aa, Entamoeba dispar
IRMMDHFMFKSHLCIVFELLSI

SEQ ID NO: 2487904 - protein, 26 aa, Entamoeba dispar
IRMYETFKPKMAKFMKDFIDKQEKKT

SEQ ID NO: 2487905 - protein, 17 aa, Entamoeba dispar
IRNGKICHQKEFNMISL

SEQ ID NO: 2487906 - protein, 21 aa, Entamoeba dispar
IRNKIVPIIVHKYVCNSNDGI

SEQ ID NO: 2487907 - protein, 18 aa, Entamoeba dispar
IRNLGLDVDMLFKKYQHA

SEQ ID NO: 2487908 - protein, 19 aa, Entamoeba dispar
IRNNIKFTHIENGSRKILL

SEQ ID NO: 2487909 - protein, 19 aa, Entamoeba dispar
IRNNSAWSHRFYTLKSLNL

SEQ ID NO: 2487910 - protein, 30 aa, Entamoeba dispar
IRNSGSIEWVVYHVNFKNGELVEDDTGTTV

SEQ ID NO: 2487911 - protein, 23 aa, Entamoeba dispar
IRNTEMKDLIQVVGEKYKREIIR

SEQ ID NO: 2487912 - protein, 18 aa, Entamoeba dispar
IRNVFVLTCNVSMEYEKS

SEQ ID NO: 2487913 - protein, 24 aa, Entamoeba dispar
IRNVTKFLYGLREGLGQLLQKIPE

SEQ ID NO: 2487914 - protein, 18 aa, Entamoeba dispar
IRNYCRRDDEAVVPEKYH

SEQ ID NO: 2487915 - protein, 24 aa, Entamoeba dispar
IRPEDILYAGLRMRVLKVRTTDEV

SEQ ID NO: 2487916 - protein, 17 aa, Entamoeba dispar
IRPGILPSPGGNTQHAL

SEQ ID NO: 2487917 - protein, 20 aa, Entamoeba dispar
IRPGLTCFKQGIPKIKIEEI

SEQ ID NO: 2487918 - protein, 21 aa, Entamoeba dispar
IRPKLTWASIDVFRKRSVTIY

SEQ ID NO: 2487919 - protein, 19 aa, Entamoeba dispar
IRPRRRKTKKITMPTRKRK

SEQ ID NO: 2487920 - protein, 19 aa, Entamoeba dispar
IRQEMKLISKFYPNDFDEV

SEQ ID NO: 2487921 - protein, 25 aa, Entamoeba dispar
IRQGSFRVSIIFGDKNKWGSRSLTD

SEQ ID NO: 2487922 - protein, 21 aa, Entamoeba dispar
IRQRSVYIIMRILNSMPDNYT

SEQ ID NO: 2487923 - protein, 21 aa, Entamoeba dispar
IRQTNSFLIVYSIVEEKTFET

SEQ ID NO: 2487924 - protein, 17 aa, Entamoeba dispar
IRRFMYGETISNYEPTI

SEQ ID NO: 2487925 - protein, 21 aa, Entamoeba dispar
IRRHHCRFCGKCVCNDCSLMR

SEQ ID NO: 2487926 - protein, 21 aa, Entamoeba dispar
IRRKHLDNSFVIYSSDEIDPE

SEQ ID NO: 2487927 - protein, 22 aa, Entamoeba dispar
IRRKPYSVILFDEMKKHIHKLT

SEQ ID NO: 2487928 - protein, 23 aa, Entamoeba dispar
IRRLGKDCFKGCSSLSDIDIPTT

SEQ ID NO: 2487929 - protein, 21 aa, Entamoeba dispar
IRRRAVDVLYALCTPQSVRKV

SEQ ID NO: 2487930 - protein, 25 aa, Entamoeba dispar
IRRRFEKRIYIGLPDASARAKMIKW

SEQ ID NO: 2487931 - protein, 23 aa, Entamoeba dispar
IRRVAKPLHYCVKTLEGGSIALQ

SEQ ID NO: 2487932 - protein, 25 aa, Entamoeba dispar
IRSLKRGDITWCYNSLQFKFELFKM

SEQ ID NO: 2487933 - protein, 21 aa, Entamoeba dispar
IRSMREWATVPILGKLSKCQV

SEQ ID NO: 2487934 - protein, 23 aa, Entamoeba dispar
IRSNCSHHLICLNHYKRFNNKQK

SEQ ID NO: 2487935 - protein, 23 aa, Entamoeba dispar
IRSNEKLLLGYGFVEENNPCDNL

SEQ ID NO: 2487936 - protein, 19 aa, Entamoeba dispar
IRSSHELLFSNVKPRFQQS

SEQ ID NO: 2487937 - protein, 17 aa, Entamoeba dispar
IRSSKEIEMIKQIHIND

SEQ ID NO: 2487938 - protein, 18 aa, Entamoeba dispar
IRSSYEINKEVLKQINKK

SEQ ID NO: 2487939 - protein, 21 aa, Entamoeba dispar
IRSVYNFAPYIKNYYIVTMGQ

SEQ ID NO: 2487940 - protein, 18 aa, Entamoeba dispar
IRTAALVDNSLWIGTFAG

SEQ ID NO: 2487941 - protein, 18 aa, Entamoeba dispar
IRTALTMISQGYRNSPAF

SEQ ID NO: 2487942 - protein, 24 aa, Entamoeba dispar
IRTASLPIHRVFALNHLLSISITV

SEQ ID NO: 2487943 - protein, 17 aa, Entamoeba dispar
IRTDGRANIQFREIKCE

SEQ ID NO: 2487944 - protein, 18 aa, Entamoeba dispar
IRTEFKRYQIQKLNPFWW

SEQ ID NO: 2487945 - protein, 23 aa, Entamoeba dispar
IRTHCPDTPFLLIGTKSDIRDDY

SEQ ID NO: 2487946 - protein, 24 aa, Entamoeba dispar
IRTIICPKGLLALVNSPRSSPKSS

SEQ ID NO: 2487947 - protein, 19 aa, Entamoeba dispar
IRTILDAMERWRMRTEELM

SEQ ID NO: 2487948 - protein, 25 aa, Entamoeba dispar
IRTIQSCAIFYSFIKPFNTNQIELL

SEQ ID NO: 2487949 - protein, 21 aa, Entamoeba dispar
IRTKISNVLYIFAREHNDLGY

SEQ ID NO: 2487950 - protein, 24 aa, Entamoeba dispar
IRTLFRKDFLALDWQEKIKTFDCT

SEQ ID NO: 2487951 - protein, 18 aa, Entamoeba dispar
IRTNALWVISNIATTKKA

SEQ ID NO: 2487952 - protein, 20 aa, Entamoeba dispar
IRTNGIIVCNTLFNEIKVID

SEQ ID NO: 2487953 - protein, 20 aa, Entamoeba dispar
IRTNGIIVCNTLFNEIKVLN

SEQ ID NO: 2487954 - protein, 25 aa, Entamoeba dispar
IRTQVCAFSGFKIPVAKGRKYVRLD

SEQ ID NO: 2487955 - protein, 20 aa, Entamoeba dispar
IRTRDGFILMYSITSRYSFD

SEQ ID NO: 2487956 - protein, 19 aa, Entamoeba dispar
IRTSLPIFLANLMPCSSAS

SEQ ID NO: 2487957 - protein, 17 aa, Entamoeba dispar
IRTTPLIQNVENLKYLN

SEQ ID NO: 2487958 - protein, 17 aa, Entamoeba dispar
IRTTRAFEKEILKRVST

SEQ ID NO: 2487959 - protein, 23 aa, Entamoeba dispar
IRVELSKALSLSGCSSDDFLIYT

SEQ ID NO: 2487960 - protein, 24 aa, Entamoeba dispar
IRVGKTGKCYADFENAETLERVKE

SEQ ID NO: 2487961 - protein, 18 aa, Entamoeba dispar
IRVKRTALLILNQKLTAL

SEQ ID NO: 2487962 - protein, 23 aa, Entamoeba dispar
IRVKTCFIEIWKFIFEKQKIEGN

SEQ ID NO: 2487963 - protein, 18 aa, Entamoeba dispar
IRVPKASSLTSIYHELLI

SEQ ID NO: 2487964 - protein, 31 aa, Entamoeba dispar
IRVRIKEGCRWKKGYKLVCCATKRKSNLYSA

SEQ ID NO: 2487965 - protein, 21 aa, Entamoeba dispar
IRVSASVFRTTLQFLMSTTKG

SEQ ID NO: 2487966 - protein, 17 aa, Entamoeba dispar
IRVWKGDITKLKIDSIV

SEQ ID NO: 2487967 - protein, 18 aa, Entamoeba dispar
IRVYEMICVAKGIIQNKP

SEQ ID NO: 2487968 - protein, 24 aa, Entamoeba dispar
IRWAAPGSCVIGSFYGYITYPPAP

SEQ ID NO: 2487969 - protein, 19 aa, Entamoeba dispar
IRWVGSLKLITCVEKPNGN

SEQ ID NO: 2487970 - protein, 20 aa, Entamoeba dispar
IRYDCFLGCQSLTSMNMDNL

SEQ ID NO: 2487971 - protein, 20 aa, Entamoeba dispar
IRYEELQYALGTHRLGLNTE

SEQ ID NO: 2487972 - protein, 19 aa, Entamoeba dispar
IRYFGGLKFVTPGEISKDW

SEQ ID NO: 2487973 - protein, 19 aa, Entamoeba dispar
IRYIPTYIFVIDITCTELE

SEQ ID NO: 2487974 - protein, 27 aa, Entamoeba dispar
IRYKIFKGCSSLRLINLGKIKFISEER

SEQ ID NO: 2487975 - protein, 27 aa, Entamoeba dispar
IRYKQNGGYFLFTFINFYGIEPQIFYT

SEQ ID NO: 2487976 - protein, 20 aa, Entamoeba dispar
IRYLDCPNGSHLISCGFHEE

SEQ ID NO: 2487977 - protein, 22 aa, Entamoeba dispar
IRYLESFSISYGDIILIGKQIN

SEQ ID NO: 2487978 - protein, 19 aa, Entamoeba dispar
IRYYLPIIQYIGELRKKEI

SEQ ID NO: 2487979 - protein, 18 aa, Entamoeba dispar
ISAADALKHPFFDPLNKP

SEQ ID NO: 2487980 - protein, 32 aa, Entamoeba dispar
ISADKTKQIGICWKELLIVPSEVVDPSSFGGS

SEQ ID NO: 2487981 - protein, 18 aa, Entamoeba dispar
ISADVVIIFDSIFEQQYA

SEQ ID NO: 2487982 - protein, 18 aa, Entamoeba dispar
ISAGFGIVTTIKFIYTQG

SEQ ID NO: 2487983 - protein, 21 aa, Entamoeba dispar
ISAGLLHGWNYQALIKEVMEY

SEQ ID NO: 2487984 - protein, 17 aa, Entamoeba dispar
ISAIIIDCITLKFEDIQ

SEQ ID NO: 2487985 - protein, 17 aa, Entamoeba dispar
ISAIQWLCQADKKTHNP

SEQ ID NO: 2487986 - protein, 23 aa, Entamoeba dispar
ISAKDYLECHPLRSSAEDSIDKL

SEQ ID NO: 2487987 - protein, 25 aa, Entamoeba dispar
ISAKKIVFCMKKFLRQLEGIINIYL

SEQ ID NO: 2487988 - protein, 21 aa, Entamoeba dispar
ISALTMRGCSCIVNGRCTVCG

SEQ ID NO: 2487989 - protein, 19 aa, Entamoeba dispar
ISALVLPLARYDHNSIQQQ

SEQ ID NO: 2487990 - protein, 17 aa, Entamoeba dispar
ISALYDYYSDLVDLQDM

SEQ ID NO: 2487991 - protein, 21 aa, Entamoeba dispar
ISAPIVELFNGMTNEAYGESQ

SEQ ID NO: 2487992 - protein, 21 aa, Entamoeba dispar
ISASLLRAEIYGIKKEISNEE

SEQ ID NO: 2487993 - protein, 26 aa, Entamoeba dispar
ISATCYPLEIDLWLAYSEYATMGLKL

SEQ ID NO: 2487994 - protein, 19 aa, Entamoeba dispar
ISCGLLILRGDEIMVIGGL

SEQ ID NO: 2487995 - protein, 21 aa, Entamoeba dispar
ISCIPCHQRKIIKSLLCSPSV

SEQ ID NO: 2487996 - protein, 19 aa, Entamoeba dispar
ISCKSRKSIPSTFLPSHLL

SEQ ID NO: 2487997 - protein, 18 aa, Entamoeba dispar
ISDAEFYLLDGPIDENDA

SEQ ID NO: 2487998 - protein, 23 aa, Entamoeba dispar
ISDEFNLYGLRAFIEHYEQALDI

SEQ ID NO: 2487999 - protein, 22 aa, Entamoeba dispar
ISDEIHCDLLLTKQHIHTGSLP

SEQ ID NO: 2488000 - protein, 24 aa, Entamoeba dispar
ISDEIRITLDYTFRLVKQITSKQI

SEQ ID NO: 2488001 - protein, 25 aa, Entamoeba dispar
ISDGKWILSEDWIEAIIKNNAIIEE

SEQ ID NO: 2488002 - protein, 17 aa, Entamoeba dispar
ISDICYIMNCFQIHSYC

SEQ ID NO: 2488003 - protein, 18 aa, Entamoeba dispar
ISDIMSMLLTAKETPLVF

SEQ ID NO: 2488004 - protein, 17 aa, Entamoeba dispar
ISDIQFYNEIMDISLNI

SEQ ID NO: 2488005 - protein, 17 aa, Entamoeba dispar
ISDIQWKPEVFGDSAIF

SEQ ID NO: 2488006 - protein, 22 aa, Entamoeba dispar
ISDISCPWCYVGRKRMLNAIST

SEQ ID NO: 2488007 - protein, 24 aa, Entamoeba dispar
ISDKKCLQGICGLKKEKKEKHHKH

SEQ ID NO: 2488008 - protein, 25 aa, Entamoeba dispar
ISDLLRYFFHFVKSTCPYIVEYNSN

SEQ ID NO: 2488009 - protein, 18 aa, Entamoeba dispar
ISDMKKKVANEVREETEK

SEQ ID NO: 2488010 - protein, 19 aa, Entamoeba dispar
ISDNAHFLFTFRNKMNIGH

SEQ ID NO: 2488011 - protein, 25 aa, Entamoeba dispar
ISDNFWKIICEEIGNHNPLDCKLQY

SEQ ID NO: 2488012 - protein, 18 aa, Entamoeba dispar
ISDSKSMREWLGVTQNNC

SEQ ID NO: 2488013 - protein, 22 aa, Entamoeba dispar
ISDSLVRLEFHFIQQLLNLKSV

SEQ ID NO: 2488014 - protein, 30 aa, Entamoeba dispar
ISDVIVYQGCEWKWKQCSIYDNNEYQIELF

SEQ ID NO: 2488015 - protein, 26 aa, Entamoeba dispar
ISDYKPILIDGFKLSLQLLVKEVSNL

SEQ ID NO: 2488016 - protein, 24 aa, Entamoeba dispar
ISDYRKTKMSWIIKANLNSNIIHK

SEQ ID NO: 2488017 - protein, 23 aa, Entamoeba dispar
ISEALHLIFNYSLLVDPRLLQQD

SEQ ID NO: 2488018 - protein, 17 aa, Entamoeba dispar
ISEEVLLKISEDVAKAI

SEQ ID NO: 2488019 - protein, 18 aa, Entamoeba dispar
ISEFWFQIQKDFEAVELS

SEQ ID NO: 2488020 - protein, 17 aa, Entamoeba dispar
ISEHLHVLMDILINNGT

SEQ ID NO: 2488021 - protein, 24 aa, Entamoeba dispar
ISEIGDWCFYECYSLTTINIPSSI

SEQ ID NO: 2488022 - protein, 20 aa, Entamoeba dispar
ISEIGNWCFYECTSLTSIII

SEQ ID NO: 2488023 - protein, 21 aa, Entamoeba dispar
ISEIGNWCFYECTSLTSIIIP

SEQ ID NO: 2488024 - protein, 25 aa, Entamoeba dispar
ISEIGYECFYGCTSLTSMNIENLKY

SEQ ID NO: 2488025 - protein, 21 aa, Entamoeba dispar
ISEIHPYIFPKGEFASEKIGE

SEQ ID NO: 2488026 - protein, 17 aa, Entamoeba dispar
ISEKDLVLACLKNNKPF

SEQ ID NO: 2488027 - protein, 25 aa, Entamoeba dispar
ISEKPRPPFFDGFIDLLKRFKEQGG

SEQ ID NO: 2488028 - protein, 24 aa, Entamoeba dispar
ISEKVRRHYIHFVIVQTLHRMKFI

SEQ ID NO: 2488029 - protein, 25 aa, Entamoeba dispar
ISELPFGCFQCCPSLNPINIPSSVS

SEQ ID NO: 2488030 - protein, 22 aa, Entamoeba dispar
ISELPKGCFGFCSSLTTINIPT

SEQ ID NO: 2488031 - protein, 17 aa, Entamoeba dispar
ISELSVFDGIVLLKEIG

SEQ ID NO: 2488032 - protein, 22 aa, Entamoeba dispar
ISERTKLIFFMYFDNGNIMGLY

SEQ ID NO: 2488033 - protein, 26 aa, Entamoeba dispar
ISESNYPFAFLSEYQFNSQFITNNYH

SEQ ID NO: 2488034 - protein, 19 aa, Entamoeba dispar
ISETEVFIGGLGVFTDKRN

SEQ ID NO: 2488035 - protein, 35 aa, Entamoeba dispar
ISEVATNWCRYCCSIESSLLKWLFNPLSDGSIHIV

SEQ ID NO: 2488036 - protein, 17 aa, Entamoeba dispar
ISEVFKMKTTIIKDNKD

SEQ ID NO: 2488037 - protein, 24 aa, Entamoeba dispar
ISEVVRFAPPLSIIIIKPGTYEET

SEQ ID NO: 2488038 - protein, 17 aa, Entamoeba dispar
ISEYLMTCPICGKQKYC

SEQ ID NO: 2488039 - protein, 19 aa, Entamoeba dispar
ISEYSWLKFIASCPQLRTL

SEQ ID NO: 2488040 - protein, 18 aa, Entamoeba dispar
ISFCDKPKKLSLTSKNIR

SEQ ID NO: 2488041 - protein, 19 aa, Entamoeba dispar
ISFCYKNKIINVYCGSDLT

SEQ ID NO: 2488042 - protein, 20 aa, Entamoeba dispar
ISFDLSELELDAMIGDKELT

SEQ ID NO: 2488043 - protein, 20 aa, Entamoeba dispar
ISFFPRLRQITICLDYGSDT

SEQ ID NO: 2488044 - protein, 23 aa, Entamoeba dispar
ISFGDGCFYLCGCKEKLKKNKRI

SEQ ID NO: 2488045 - protein, 17 aa, Entamoeba dispar
ISFIFDTMSRWLLCYGK

SEQ ID NO: 2488046 - protein, 17 aa, Entamoeba dispar
ISFKCMTNLKWVEIKKM

SEQ ID NO: 2488047 - protein, 27 aa, Entamoeba dispar
ISFNRINFSGVFPCLGDNLELVNFVEC

SEQ ID NO: 2488048 - protein, 17 aa, Entamoeba dispar
ISFRFTKNTFITAYDPT

SEQ ID NO: 2488049 - protein, 23 aa, Entamoeba dispar
ISFTCPTLSGFHYKQSKTKEKNL

SEQ ID NO: 2488050 - protein, 23 aa, Entamoeba dispar
ISFYRYGMDIIILALRENNLYVH

SEQ ID NO: 2488051 - protein, 18 aa, Entamoeba dispar
ISGAFPVQDICSYYYGTS

SEQ ID NO: 2488052 - protein, 19 aa, Entamoeba dispar
ISGDDWGDDFGFPEDQKDG

SEQ ID NO: 2488053 - protein, 23 aa, Entamoeba dispar
ISGDTIIPVIVYLLLHSSIPNIN

SEQ ID NO: 2488054 - protein, 17 aa, Entamoeba dispar
ISGETINGLDFIGYESK

SEQ ID NO: 2488055 - protein, 20 aa, Entamoeba dispar
ISGFNRKTLYKKIIGEKNIM

SEQ ID NO: 2488056 - protein, 19 aa, Entamoeba dispar
ISGGAKIFSVFENNFRPTI

SEQ ID NO: 2488057 - protein, 19 aa, Entamoeba dispar
ISGILTFGPCYLVSEEASE

SEQ ID NO: 2488058 - protein, 18 aa, Entamoeba dispar
ISGIPAKVFSCIRTTFEH

SEQ ID NO: 2488059 - protein, 24 aa, Entamoeba dispar
ISGKTLFFAYTFIINGITTLTFTC

SEQ ID NO: 2488060 - protein, 18 aa, Entamoeba dispar
ISGNQLLVLTGFLPILFN

SEQ ID NO: 2488061 - protein, 25 aa, Entamoeba dispar
ISGTKFILYCWSRPDLRGYLNSQGV

SEQ ID NO: 2488062 - protein, 30 aa, Entamoeba dispar
ISHGFACGIFSCAYLKLSEKQEVCGKRLKL

SEQ ID NO: 2488063 - protein, 24 aa, Entamoeba dispar
ISHHCPKAPYLLVGTKIDIRDEQK

SEQ ID NO: 2488064 - protein, 28 aa, Entamoeba dispar
ISHIPMKGVVRPVLYTSLYNSTEFTQQQ

SEQ ID NO: 2488065 - protein, 26 aa, Entamoeba dispar
ISHPIECFIIRIDLSQRLNHLLIFTN

SEQ ID NO: 2488066 - protein, 19 aa, Entamoeba dispar
ISHSFYARAKKGVVEKEST

SEQ ID NO: 2488067 - protein, 20 aa, Entamoeba dispar
ISIEGIFRMAGSKQRIEQLI

SEQ ID NO: 2488068 - protein, 20 aa, Entamoeba dispar
ISIFSKIKWTDSELVAQSIS

SEQ ID NO: 2488069 - protein, 22 aa, Entamoeba dispar
ISIGSCCFDHCINLKSLTIPNN

SEQ ID NO: 2488070 - protein, 18 aa, Entamoeba dispar
ISIICIGVGDGPFDKMET

SEQ ID NO: 2488071 - protein, 19 aa, Entamoeba dispar
ISIIDCRPKLNASANLIKG

SEQ ID NO: 2488072 - protein, 21 aa, Entamoeba dispar
ISIINCIDVHFTLPLNLIKLD

SEQ ID NO: 2488073 - protein, 21 aa, Entamoeba dispar
ISIISGCMFIFSYIFSLSNTI

SEQ ID NO: 2488074 - protein, 28 aa, Entamoeba dispar
ISIKGWASTCGWAEEIVRYHSEELKKAG

SEQ ID NO: 2488075 - protein, 21 aa, Entamoeba dispar
ISIMQMIEWYYQGLLNTIAPF

SEQ ID NO: 2488076 - protein, 17 aa, Entamoeba dispar
ISINEVFGKFIVDPQTW

SEQ ID NO: 2488077 - protein, 29 aa, Entamoeba dispar
ISINQDFSCFAIGTTVGFRVFGIENGRFR

SEQ ID NO: 2488078 - protein, 24 aa, Entamoeba dispar
ISINSEFLPYVSIIQEEISFVSTP

SEQ ID NO: 2488079 - protein, 22 aa, Entamoeba dispar
ISIPLKEIDSIIVASDGISSIP

SEQ ID NO: 2488080 - protein, 17 aa, Entamoeba dispar
ISISAIQWLCQADKKTH

SEQ ID NO: 2488081 - protein, 19 aa, Entamoeba dispar
ISISELLFVVWKHCNESMK

SEQ ID NO: 2488082 - protein, 20 aa, Entamoeba dispar
ISISRIMGYKERWENEYNNK

SEQ ID NO: 2488083 - protein, 20 aa, Entamoeba dispar
ISISSLRLFPKIQTQCLYHK

SEQ ID NO: 2488084 - protein, 19 aa, Entamoeba dispar
ISITYGSTVIYCEKLMEKP

SEQ ID NO: 2488085 - protein, 26 aa, Entamoeba dispar
ISKANPFLVKKCRCFLNDNEKKEYND

SEQ ID NO: 2488086 - protein, 26 aa, Entamoeba dispar
ISKCKGKLSPKFYMRRNKIYNMIKKE

SEQ ID NO: 2488087 - protein, 17 aa, Entamoeba dispar
ISKCTKNNIDFMALKNP

SEQ ID NO: 2488088 - protein, 17 aa, Entamoeba dispar
ISKDGRIIKQCKNVLNQ

SEQ ID NO: 2488089 - protein, 23 aa, Entamoeba dispar
ISKECLKELLFKPEGSKELDEFF

SEQ ID NO: 2488090 - protein, 18 aa, Entamoeba dispar
ISKELKERLEFRKEYIKA

SEQ ID NO: 2488091 - protein, 22 aa, Entamoeba dispar
ISKEMVEFCQKFIYKNQYLVVN

SEQ ID NO: 2488092 - protein, 22 aa, Entamoeba dispar
ISKEQMIRIILQHLHVKGYNES

SEQ ID NO: 2488093 - protein, 23 aa, Entamoeba dispar
ISKEYLALALFHFQKSEFINSFG

SEQ ID NO: 2488094 - protein, 17 aa, Entamoeba dispar
ISKICFVDTVSIPLKDQ

SEQ ID NO: 2488095 - protein, 21 aa, Entamoeba dispar
ISKIGIACFKKCFSLTKINIP

SEQ ID NO: 2488096 - protein, 32 aa, Entamoeba dispar
ISKIGKYCFEYCKSLRRIKIPSSISKLGDGCF

SEQ ID NO: 2488097 - protein, 17 aa, Entamoeba dispar
ISKIGNYCFNYCTSLKS

SEQ ID NO: 2488098 - protein, 24 aa, Entamoeba dispar
ISKIGRSCFRECISLKSINIPSTA

SEQ ID NO: 2488099 - protein, 24 aa, Entamoeba dispar
ISKIGYDCFYGCTSLISINIENLQ

SEQ ID NO: 2488100 - protein, 23 aa, Entamoeba dispar
ISKIGYECFDRCLSLKELTIQNI

SEQ ID NO: 2488101 - protein, 24 aa, Entamoeba dispar
ISKIGYKCFKGCSSLKSINIPSSI

SEQ ID NO: 2488102 - protein, 18 aa, Entamoeba dispar
ISKIKGHKSGIVGLEQIS

SEQ ID NO: 2488103 - protein, 24 aa, Entamoeba dispar
ISKITEFFNNIVLVTVINNVKKSD

SEQ ID NO: 2488104 - protein, 23 aa, Entamoeba dispar
ISKKGVVMINCLHRIVTENEVYF

SEQ ID NO: 2488105 - protein, 23 aa, Entamoeba dispar
ISKKKWTVEPLVEPFNITGNCLI

SEQ ID NO: 2488106 - protein, 17 aa, Entamoeba dispar
ISKKRYAGLYFNRVDKW

SEQ ID NO: 2488107 - protein, 25 aa, Entamoeba dispar
ISKKSCIICIQLLFHRIDESTGKYQ

SEQ ID NO: 2488108 - protein, 20 aa, Entamoeba dispar
ISKLGYDCFYGCTSLISINI

SEQ ID NO: 2488109 - protein, 26 aa, Entamoeba dispar
ISKLYPRLKLDQFELLWNNITTTLED

SEQ ID NO: 2488110 - protein, 19 aa, Entamoeba dispar
ISKNCYESFQMMHTNPNYS

SEQ ID NO: 2488111 - protein, 30 aa, Entamoeba dispar
ISKNSPFIQMCWKGIFEILYIASLDEDTTV

SEQ ID NO: 2488112 - protein, 37 aa, Entamoeba dispar
ISKSFKGRYYPYILGIRKDFLSNIFITFPNEPIIIPV

SEQ ID NO: 2488113 - protein, 29 aa, Entamoeba dispar
ISKSILRRLPHVFFYKRILSDNDKHFQSF

SEQ ID NO: 2488114 - protein, 26 aa, Entamoeba dispar
ISKSLSWPTILYVVGSIVKGWLQKEL

SEQ ID NO: 2488115 - protein, 26 aa, Entamoeba dispar
ISKSLYFDCLKSFLIQNQSNQMIVES

SEQ ID NO: 2488116 - protein, 25 aa, Entamoeba dispar
ISKTNWFGMNYLKKICQSVSFKTKI

SEQ ID NO: 2488117 - protein, 18 aa, Entamoeba dispar
ISKTPDLNISFRRRTNRR

SEQ ID NO: 2488118 - protein, 17 aa, Entamoeba dispar
ISLAIGKYNKAVVVEDT

SEQ ID NO: 2488119 - protein, 22 aa, Entamoeba dispar
ISLARLTKLLSIEASKKPLENE

SEQ ID NO: 2488120 - protein, 19 aa, Entamoeba dispar
ISLCKKLPESMTIGDLLTV

SEQ ID NO: 2488121 - protein, 18 aa, Entamoeba dispar
ISLDRLLLEYQREIKSQE

SEQ ID NO: 2488122 - protein, 17 aa, Entamoeba dispar
ISLEFTKRVAAECDQLY

SEQ ID NO: 2488123 - protein, 21 aa, Entamoeba dispar
ISLFIHSIVLWKVSNTDSDTI

SEQ ID NO: 2488124 - protein, 24 aa, Entamoeba dispar
ISLHAGICPLPLIKFTRNGVDLRV

SEQ ID NO: 2488125 - protein, 25 aa, Entamoeba dispar
ISLIIKQLYHFLAYYVLDTLFTQPE

SEQ ID NO: 2488126 - protein, 17 aa, Entamoeba dispar
ISLIRKIMESINNEEEM

SEQ ID NO: 2488127 - protein, 23 aa, Entamoeba dispar
ISLIRWKVEDGLFYCEKRCTMFV

SEQ ID NO: 2488128 - protein, 21 aa, Entamoeba dispar
ISLIYKSRMLKDNAQTLGGLG

SEQ ID NO: 2488129 - protein, 20 aa, Entamoeba dispar
ISLKEYRKGLRNIFIELDKK

SEQ ID NO: 2488130 - protein, 17 aa, Entamoeba dispar
ISLKGYMNNVAKFDTMW

SEQ ID NO: 2488131 - protein, 19 aa, Entamoeba dispar
ISLKKDDIVLVHRKDGDWW

SEQ ID NO: 2488132 - protein, 27 aa, Entamoeba dispar
ISLKRFYKIFFELHLVFAKAPKSEQTR

SEQ ID NO: 2488133 - protein, 17 aa, Entamoeba dispar
ISLKVLSTVFQWIIGDS

SEQ ID NO: 2488134 - protein, 18 aa, Entamoeba dispar
ISLLERYKHNYNYNENIP

SEQ ID NO: 2488135 - protein, 19 aa, Entamoeba dispar
ISLLPYRYSFIAITTPPIS

SEQ ID NO: 2488136 - protein, 17 aa, Entamoeba dispar
ISLLSIDYYDNFINNRN

SEQ ID NO: 2488137 - protein, 21 aa, Entamoeba dispar
ISLNCGHYFCKKCWEERIKTM

SEQ ID NO: 2488138 - protein, 27 aa, Entamoeba dispar
ISLNINRLRLVLLIEEYMITSSFVSHF

SEQ ID NO: 2488139 - protein, 25 aa, Entamoeba dispar
ISLNKEFKSNGYGYVEFETEEECKR

SEQ ID NO: 2488140 - protein, 17 aa, Entamoeba dispar
ISLNLGIVICLECCGAH

SEQ ID NO: 2488141 - protein, 23 aa, Entamoeba dispar
ISLNNFIIFCFVNEPSIKQPHFA

SEQ ID NO: 2488142 - protein, 20 aa, Entamoeba dispar
ISLNSYNAWVKRKYGKTVKK

SEQ ID NO: 2488143 - protein, 18 aa, Entamoeba dispar
ISLPCKRNIPMEQFSDYI

SEQ ID NO: 2488144 - protein, 17 aa, Entamoeba dispar
ISLPHTLLLGLLHKDPI

SEQ ID NO: 2488145 - protein, 17 aa, Entamoeba dispar
ISLPLKGKVPATVDMKI

SEQ ID NO: 2488146 - protein, 17 aa, Entamoeba dispar
ISLPSFVGLFNFVDSHI

SEQ ID NO: 2488147 - protein, 19 aa, Entamoeba dispar
ISLPYSRFNVAFMQYTGIG

SEQ ID NO: 2488148 - protein, 18 aa, Entamoeba dispar
ISLQNCQLINLKVKCNSI

SEQ ID NO: 2488149 - protein, 17 aa, Entamoeba dispar
ISLRSKILLEVYNSMCG

SEQ ID NO: 2488150 - protein, 21 aa, Entamoeba dispar
ISLSDKGGCDAGWNIIAEQDS

SEQ ID NO: 2488151 - protein, 17 aa, Entamoeba dispar
ISLTGFFDGIKKLKIKS

SEQ ID NO: 2488152 - protein, 25 aa, Entamoeba dispar
ISMEELYTMFGWPLAKKYGTLHDAF

SEQ ID NO: 2488153 - protein, 18 aa, Entamoeba dispar
ISMLFDFKSNPDVQISIQ

SEQ ID NO: 2488154 - protein, 23 aa, Entamoeba dispar
ISMLRSNCYSYVYGSPMSPVEAQ

SEQ ID NO: 2488155 - protein, 19 aa, Entamoeba dispar
ISMRCYEKIFNIMTNCSTD

SEQ ID NO: 2488156 - protein, 17 aa, Entamoeba dispar
ISMTFVPAFGGRIKKGL

SEQ ID NO: 2488157 - protein, 23 aa, Entamoeba dispar
ISNAVETWGTLNFARNTKNIKMK

SEQ ID NO: 2488158 - protein, 18 aa, Entamoeba dispar
ISNAVLYSPLINCKTETV

SEQ ID NO: 2488159 - protein, 18 aa, Entamoeba dispar
ISNCKRIDCNKEMKELMV

SEQ ID NO: 2488160 - protein, 20 aa, Entamoeba dispar
ISNDILKFLLTFNDISENII

SEQ ID NO: 2488161 - protein, 26 aa, Entamoeba dispar
ISNEEMDLMLAFLIRDFGKLLVNESN

SEQ ID NO: 2488162 - protein, 24 aa, Entamoeba dispar
ISNELKEQMLLILGDFIEDCQYEQ

SEQ ID NO: 2488163 - protein, 27 aa, Entamoeba dispar
ISNELWDLLELKGCYCSMKRFPNDVIN

SEQ ID NO: 2488164 - protein, 26 aa, Entamoeba dispar
ISNFKLSLKIGPSILNLVIQGGETYF

SEQ ID NO: 2488165 - protein, 18 aa, Entamoeba dispar
ISNHIVCALSQLQNLMKN

SEQ ID NO: 2488166 - protein, 27 aa, Entamoeba dispar
ISNILPLSNFYGLERLWLANNQIKYFT

SEQ ID NO: 2488167 - protein, 24 aa, Entamoeba dispar
ISNKCPVCKQVFINTENFKKHLEI

SEQ ID NO: 2488168 - protein, 21 aa, Entamoeba dispar
ISNLIIKGRVPSIEIEAEPWI

SEQ ID NO: 2488169 - protein, 34 aa, Entamoeba dispar
ISNLIKLWFRELPRPILNVLSCDQIFYSTEPSES

SEQ ID NO: 2488170 - protein, 22 aa, Entamoeba dispar
ISNLYKCVVPCINFFKSNIHIE

SEQ ID NO: 2488171 - protein, 24 aa, Entamoeba dispar
ISNRCPYHQLLADRYHCGLQDARH

SEQ ID NO: 2488172 - protein, 18 aa, Entamoeba dispar
ISNRDSFEYLQDWVNDVS

SEQ ID NO: 2488173 - protein, 17 aa, Entamoeba dispar
ISNRIFIFVTYSIPVEL

SEQ ID NO: 2488174 - protein, 24 aa, Entamoeba dispar
ISPDLRWIWRTNTFEMKATTLKST

SEQ ID NO: 2488175 - protein, 17 aa, Entamoeba dispar
ISPEFQNFCKYLRERQN

SEQ ID NO: 2488176 - protein, 20 aa, Entamoeba dispar
ISPFPPYLDSGVYRMDLKFR

SEQ ID NO: 2488177 - protein, 23 aa, Entamoeba dispar
ISPKLCSGNGYIYLQGGSLRKIQ

SEQ ID NO: 2488178 - protein, 26 aa, Entamoeba dispar
ISPLYYKIRACIGLVQHQELMPMLLQ

SEQ ID NO: 2488179 - protein, 17 aa, Entamoeba dispar
ISPNFYYDLAIRVLSEK

SEQ ID NO: 2488180 - protein, 21 aa, Entamoeba dispar
ISPRCLCCICEQEVTLLKENK

SEQ ID NO: 2488181 - protein, 22 aa, Entamoeba dispar
ISPRDSLCCKSFLHLYSSKQIN

SEQ ID NO: 2488182 - protein, 26 aa, Entamoeba dispar
ISPRSPRKFIPWGLSPSPTFSRSPSP

SEQ ID NO: 2488183 - protein, 28 aa, Entamoeba dispar
ISPSILEAFYKFKIPKATDFLHDFIDCF

SEQ ID NO: 2488184 - protein, 17 aa, Entamoeba dispar
ISPTLDHWDCKRRLQQK

SEQ ID NO: 2488185 - protein, 25 aa, Entamoeba dispar
ISPTNSCWNCQIFLEDLSDEVVDKL

SEQ ID NO: 2488186 - protein, 18 aa, Entamoeba dispar
ISQATYMRMLECVEKVGE

SEQ ID NO: 2488187 - protein, 18 aa, Entamoeba dispar
ISQCLKIKSFDFLNKCSV

SEQ ID NO: 2488188 - protein, 18 aa, Entamoeba dispar
ISQFPTKTFCNFNPINTS

SEQ ID NO: 2488189 - protein, 17 aa, Entamoeba dispar
ISQHIPYIIPPLNIIQN

SEQ ID NO: 2488190 - protein, 18 aa, Entamoeba dispar
ISQHWKEFGNIQINISFK

SEQ ID NO: 2488191 - protein, 20 aa, Entamoeba dispar
ISQIPYKFSCSTLLESDTWN

SEQ ID NO: 2488192 - protein, 23 aa, Entamoeba dispar
ISQLKLIPLQSIPFYPLSSPIST

SEQ ID NO: 2488193 - protein, 17 aa, Entamoeba dispar
ISQQSSFGIKSTSPYSA

SEQ ID NO: 2488194 - protein, 21 aa, Entamoeba dispar
ISQRLINEVIHICYQSTNIPN

SEQ ID NO: 2488195 - protein, 21 aa, Entamoeba dispar
ISRAKRLSMIPTLSLKKTEIS

SEQ ID NO: 2488196 - protein, 17 aa, Entamoeba dispar
ISRDQVIELLRALGKAP

SEQ ID NO: 2488197 - protein, 17 aa, Entamoeba dispar
ISREIIEICKKEKEKRE

SEQ ID NO: 2488198 - protein, 17 aa, Entamoeba dispar
ISRFNIDTQRWFECSNF

SEQ ID NO: 2488199 - protein, 18 aa, Entamoeba dispar
ISRIGCAESVMINKFENN

SEQ ID NO: 2488200 - protein, 24 aa, Entamoeba dispar
ISRKEMYFMLCLIDYMISNYEPFR

SEQ ID NO: 2488201 - protein, 26 aa, Entamoeba dispar
ISRKIRRGSEFSGVYSPLMINIGSTK

SEQ ID NO: 2488202 - protein, 22 aa, Entamoeba dispar
ISRYNEIIQLYLATSAQQEQIP

SEQ ID NO: 2488203 - protein, 18 aa, Entamoeba dispar
ISSCPLVPERIRKDYSSN

SEQ ID NO: 2488204 - protein, 21 aa, Entamoeba dispar
ISSDGKFIAGGSCDNSYSVYS

SEQ ID NO: 2488205 - protein, 17 aa, Entamoeba dispar
ISSEIYPPLEIIDNKES

SEQ ID NO: 2488206 - protein, 28 aa, Entamoeba dispar
ISSFFPPHPLHFFSLPILPSIIHTPSLP

SEQ ID NO: 2488207 - protein, 28 aa, Entamoeba dispar
ISSFLQRIRIILKYCYPDGSFNDNTLKQ

SEQ ID NO: 2488208 - protein, 17 aa, Entamoeba dispar
ISSFVLFKNLSGMQKIE

SEQ ID NO: 2488209 - protein, 21 aa, Entamoeba dispar
ISSGFPTKSIQQITSRIKWCQ

SEQ ID NO: 2488210 - protein, 23 aa, Entamoeba dispar
ISSGKLNGTMFFFSDYLIFAKSE

SEQ ID NO: 2488211 - protein, 24 aa, Entamoeba dispar
ISSHPSYGFHVFQYCHLLKEVLIT

SEQ ID NO: 2488212 - protein, 18 aa, Entamoeba dispar
ISSIEFFNLPTSVECISL

SEQ ID NO: 2488213 - protein, 27 aa, Entamoeba dispar
ISSILSRSIMNWDLKGMFYLINNNDYE

SEQ ID NO: 2488214 - protein, 18 aa, Entamoeba dispar
ISSKARCGELIKRVSMLI

SEQ ID NO: 2488215 - protein, 20 aa, Entamoeba dispar
ISSKIGTFISTFTSSKPSSH

SEQ ID NO: 2488216 - protein, 23 aa, Entamoeba dispar
ISSKRFFKTCAFTTDLETVAFKQ

SEQ ID NO: 2488217 - protein, 22 aa, Entamoeba dispar
ISSKRVNKMFLFDNNNPTDRNK

SEQ ID NO: 2488218 - protein, 24 aa, Entamoeba dispar
ISSKSPRPKAVIVDKDNLKEEFEK

SEQ ID NO: 2488219 - protein, 18 aa, Entamoeba dispar
ISSLGSMVVVFDRLGNVQ

SEQ ID NO: 2488220 - protein, 22 aa, Entamoeba dispar
ISSLHAAFPTHRFVGEETNDTH

SEQ ID NO: 2488221 - protein, 22 aa, Entamoeba dispar
ISSLKYLILMKLMQQKINEIDF

SEQ ID NO: 2488222 - protein, 21 aa, Entamoeba dispar
ISSLLKLLRFQIVQFQVATSS

SEQ ID NO: 2488223 - protein, 18 aa, Entamoeba dispar
ISSLPGFGLLLFNNYDCD

SEQ ID NO: 2488224 - protein, 22 aa, Entamoeba dispar
ISSLRKKLWMEHLGFKEQLAFL

SEQ ID NO: 2488225 - protein, 17 aa, Entamoeba dispar
ISSPKIIIFYSSIDEEY

SEQ ID NO: 2488226 - protein, 22 aa, Entamoeba dispar
ISSPLAIQCPNSITAYRISQTI

SEQ ID NO: 2488227 - protein, 20 aa, Entamoeba dispar
ISSQLGWLKNSIGFHSDDGK

SEQ ID NO: 2488228 - protein, 25 aa, Entamoeba dispar
ISSQVLEHYSYIGSEPFQQLNKYAE

SEQ ID NO: 2488229 - protein, 26 aa, Entamoeba dispar
ISSQVLEHYSYIGSEPFQQLNKYAET

SEQ ID NO: 2488230 - protein, 17 aa, Entamoeba dispar
ISSQVLKHCSYTESKPF

SEQ ID NO: 2488231 - protein, 18 aa, Entamoeba dispar
ISSRYRGTYCFICGYNGY

SEQ ID NO: 2488232 - protein, 21 aa, Entamoeba dispar
ISSSDIIDWNGIIPKSEEDVQ

SEQ ID NO: 2488233 - protein, 30 aa, Entamoeba dispar
ISSSEIRSSIEFLELLFVDLLFGDKEIPFI

SEQ ID NO: 2488234 - protein, 19 aa, Entamoeba dispar
ISSSSFRKRVFPLKSPQRI

SEQ ID NO: 2488235 - protein, 17 aa, Entamoeba dispar
ISTALGMNIGAREFAIH

SEQ ID NO: 2488236 - protein, 18 aa, Entamoeba dispar
ISTLKYWVEQSNGRKKRY

SEQ ID NO: 2488237 - protein, 17 aa, Entamoeba dispar
ISTLTLTFKILINELKN

SEQ ID NO: 2488238 - protein, 17 aa, Entamoeba dispar
ISTTKCTKCHSNDIYIF

SEQ ID NO: 2488239 - protein, 20 aa, Entamoeba dispar
ISTTLITYGMLNFEDIFAVL

SEQ ID NO: 2488240 - protein, 26 aa, Entamoeba dispar
ISTVPCPFKPYEVAQGYMVWGKKVSE

SEQ ID NO: 2488241 - protein, 19 aa, Entamoeba dispar
ISVATPCWNQLKENRAMEF

SEQ ID NO: 2488242 - protein, 22 aa, Entamoeba dispar
ISVAVPIPFKPGVIGGLSCEKS

SEQ ID NO: 2488243 - protein, 17 aa, Entamoeba dispar
ISVCKLSGVIINEILAA

SEQ ID NO: 2488244 - protein, 20 aa, Entamoeba dispar
ISVDIPIHHYFTGYQEEIEI

SEQ ID NO: 2488245 - protein, 17 aa, Entamoeba dispar
ISVEQHAREFLKKPIEI

SEQ ID NO: 2488246 - protein, 23 aa, Entamoeba dispar
ISVESYINFPLPFCIIDPSRRSV

SEQ ID NO: 2488247 - protein, 19 aa, Entamoeba dispar
ISVEYAFKNKKGERYGDAS

SEQ ID NO: 2488248 - protein, 18 aa, Entamoeba dispar
ISVFPAHYSDGIIPIELP

SEQ ID NO: 2488249 - protein, 18 aa, Entamoeba dispar
ISVGSILGVPCIGKNIRL

SEQ ID NO: 2488250 - protein, 21 aa, Entamoeba dispar
ISVIQKCYYVPQLKDILIIPK

SEQ ID NO: 2488251 - protein, 30 aa, Entamoeba dispar
ISVIREILYRNGLKIALSRRDENTLEPLMT

SEQ ID NO: 2488252 - protein, 26 aa, Entamoeba dispar
ISVLRLCVFNNIYLPEKFIEEIKQSI

SEQ ID NO: 2488253 - protein, 19 aa, Entamoeba dispar
ISVLRTYRRLGIATKLIRA

SEQ ID NO: 2488254 - protein, 24 aa, Entamoeba dispar
ISVPELIESVAISFENMCDGCAVD

SEQ ID NO: 2488255 - protein, 17 aa, Entamoeba dispar
ISVREISKVFLVGGSSY

SEQ ID NO: 2488256 - protein, 17 aa, Entamoeba dispar
ISVRGNLFYPRSLELSD

SEQ ID NO: 2488257 - protein, 17 aa, Entamoeba dispar
ISYACATSSQYIEVASV

SEQ ID NO: 2488258 - protein, 30 aa, Entamoeba dispar
ISYFLGEICSGLWYLHFNKRLIHRDLKPAN

SEQ ID NO: 2488259 - protein, 19 aa, Entamoeba dispar
ISYIYGRNEFILIPKQMRN

SEQ ID NO: 2488260 - protein, 19 aa, Entamoeba dispar
ISYLKAFKNILCHHPYLIN

SEQ ID NO: 2488261 - protein, 23 aa, Entamoeba dispar
ISYQEAINFCVIKTLCLYETYIK

SEQ ID NO: 2488262 - protein, 30 aa, Entamoeba dispar
ISYSEMRVAYELSDKLKINVFIGSNYITTQ

SEQ ID NO: 2488263 - protein, 19 aa, Entamoeba dispar
ISYSIVKKRIQSFNELLDI

SEQ ID NO: 2488264 - protein, 17 aa, Entamoeba dispar
ISYYLMYQFGVVDEQKQ

SEQ ID NO: 2488265 - protein, 24 aa, Entamoeba dispar
ITACGALFYCSYLPSGIKRSKQTF

SEQ ID NO: 2488266 - protein, 17 aa, Entamoeba dispar
ITADLFLVFLKQLKEKS

SEQ ID NO: 2488267 - protein, 17 aa, Entamoeba dispar
ITAIKFQDNYPFEIPYN

SEQ ID NO: 2488268 - protein, 24 aa, Entamoeba dispar
ITAKGLQCLLKLLKTQKSSDLIGK

SEQ ID NO: 2488269 - protein, 25 aa, Entamoeba dispar
ITAMLRRILQIYSIIHVDRGYFQGL

SEQ ID NO: 2488270 - protein, 26 aa, Entamoeba dispar
ITAPFSIGIEGRFGKIIFLVEKGNEL

SEQ ID NO: 2488271 - protein, 25 aa, Entamoeba dispar
ITAQKFVDELFCSISKIDLTRNQYD

SEQ ID NO: 2488272 - protein, 17 aa, Entamoeba dispar
ITASADKTCKIWNAEDG

SEQ ID NO: 2488273 - protein, 19 aa, Entamoeba dispar
ITATALKYAQAMKASCVFC

SEQ ID NO: 2488274 - protein, 24 aa, Entamoeba dispar
ITATVRPSLLLARNQLEQKQKEKQ

SEQ ID NO: 2488275 - protein, 25 aa, Entamoeba dispar
ITAYNLDFFIYFSFNNKKITYIRQK

SEQ ID NO: 2488276 - protein, 21 aa, Entamoeba dispar
ITCAGFLPDARKLAKKAQEEA

SEQ ID NO: 2488277 - protein, 19 aa, Entamoeba dispar
ITCCECGYSSESFDPFNCI

SEQ ID NO: 2488278 - protein, 17 aa, Entamoeba dispar
ITCIKCFPVEREKRGIG

SEQ ID NO: 2488279 - protein, 20 aa, Entamoeba dispar
ITCIKRYLIDWDKETSNYQE

SEQ ID NO: 2488280 - protein, 17 aa, Entamoeba dispar
ITCKLGIQEQFYRNSRK

SEQ ID NO: 2488281 - protein, 23 aa, Entamoeba dispar
ITDCSFETFPIAGDLPRLLKHLS

SEQ ID NO: 2488282 - protein, 24 aa, Entamoeba dispar
ITDEKPYCTLRCYKSALEHNITSS

SEQ ID NO: 2488283 - protein, 17 aa, Entamoeba dispar
ITDFKFFVETFVREVKW

SEQ ID NO: 2488284 - protein, 20 aa, Entamoeba dispar
ITDFRSVLFNGGKSLKEGEV

SEQ ID NO: 2488285 - protein, 17 aa, Entamoeba dispar
ITDKIDIYFQPHNSKTY

SEQ ID NO: 2488286 - protein, 20 aa, Entamoeba dispar
ITDQFKIICENLVNDSTNLP

SEQ ID NO: 2488287 - protein, 19 aa, Entamoeba dispar
ITDVVRLIAKIQCKGGIIK

SEQ ID NO: 2488288 - protein, 18 aa, Entamoeba dispar
ITEICFMKQIIKVLFATQ

SEQ ID NO: 2488289 - protein, 23 aa, Entamoeba dispar
ITEIGYRCFKECIGLKSINIPTS

SEQ ID NO: 2488290 - protein, 23 aa, Entamoeba dispar
ITEIKGSRFVGVKKPGRGILILK

SEQ ID NO: 2488291 - protein, 24 aa, Entamoeba dispar
ITEKGITPMGGFPHYGVVKNDFLM

SEQ ID NO: 2488292 - protein, 29 aa, Entamoeba dispar
ITELIRFFSQIWICYQPTEIELWKILTNC

SEQ ID NO: 2488293 - protein, 18 aa, Entamoeba dispar
ITELQAALPQLGFNLNKQ

SEQ ID NO: 2488294 - protein, 26 aa, Entamoeba dispar
ITEMCPGTFKYAFSINTNENFHITSL

SEQ ID NO: 2488295 - protein, 23 aa, Entamoeba dispar
ITEMSEGLAIYLKHLPPYHNEDI

SEQ ID NO: 2488296 - protein, 19 aa, Entamoeba dispar
ITETNLWIPQRDRVDDFIK

SEQ ID NO: 2488297 - protein, 24 aa, Entamoeba dispar
ITEVKFIQSIIPFKAIERKEREEI

SEQ ID NO: 2488298 - protein, 20 aa, Entamoeba dispar
ITEVPLNWYLQQKKLLQNKE

SEQ ID NO: 2488299 - protein, 21 aa, Entamoeba dispar
ITFCGNCWFCQHGYINNCEYG

SEQ ID NO: 2488300 - protein, 26 aa, Entamoeba dispar
ITFDLCHLHYSILSSIYIPAHLFEAN

SEQ ID NO: 2488301 - protein, 17 aa, Entamoeba dispar
ITFESYDLFIDCAKTYE

SEQ ID NO: 2488302 - protein, 17 aa, Entamoeba dispar
ITFRGDEVINLLQKDDI

SEQ ID NO: 2488303 - protein, 18 aa, Entamoeba dispar
ITFWDTPRQISFFGPTPY

SEQ ID NO: 2488304 - protein, 23 aa, Entamoeba dispar
ITGACGYLGVYIVDAVAKNEKIK

SEQ ID NO: 2488305 - protein, 31 aa, Entamoeba dispar
ITGDKEILDILGFRPPHHIDLTEFQPKIQIT

SEQ ID NO: 2488306 - protein, 18 aa, Entamoeba dispar
ITGISNFYSLVGGIRAPK

SEQ ID NO: 2488307 - protein, 17 aa, Entamoeba dispar
ITGNCLIPHFKINISPN

SEQ ID NO: 2488308 - protein, 18 aa, Entamoeba dispar
ITGPCTFGPGMIVSDDLK

SEQ ID NO: 2488309 - protein, 20 aa, Entamoeba dispar
ITGVIKRLIQENGKLQFQID

SEQ ID NO: 2488310 - protein, 27 aa, Entamoeba dispar
ITGVLLRKKISVVWAKLTPEIQEQIEN

SEQ ID NO: 2488311 - protein, 18 aa, Entamoeba dispar
ITHAMTLMQERMIGLDTT

SEQ ID NO: 2488312 - protein, 19 aa, Entamoeba dispar
ITHDPRILLLYTKITSLPK

SEQ ID NO: 2488313 - protein, 17 aa, Entamoeba dispar
ITHFLSRSLVEFEKELL

SEQ ID NO: 2488314 - protein, 18 aa, Entamoeba dispar
ITHFSFDHMSRANADILR

SEQ ID NO: 2488315 - protein, 18 aa, Entamoeba dispar
ITHFSFSLAKSFLYDQFE

SEQ ID NO: 2488316 - protein, 19 aa, Entamoeba dispar
ITHLWKEGCHPPCGKCNTG

SEQ ID NO: 2488317 - protein, 19 aa, Entamoeba dispar
ITHNRIPQFTIIPFSYCFY

SEQ ID NO: 2488318 - protein, 20 aa, Entamoeba dispar
ITHPIFRSLMTTNISILQDA

SEQ ID NO: 2488319 - protein, 25 aa, Entamoeba dispar
ITHVWEVNGTIWACKKVEGNKSMIS

SEQ ID NO: 2488320 - protein, 34 aa, Entamoeba dispar
ITHYEIGELLGTFYRIGYDKNLYPYIPVHISQVK

SEQ ID NO: 2488321 - protein, 17 aa, Entamoeba dispar
ITIEGVFMKFNLQTDKG

SEQ ID NO: 2488322 - protein, 17 aa, Entamoeba dispar
ITIGVVGKEEWVWVVDK

SEQ ID NO: 2488323 - protein, 27 aa, Entamoeba dispar
ITIHEVPKAIKIVIHFDISYFQLLNFQ

SEQ ID NO: 2488324 - protein, 19 aa, Entamoeba dispar
ITIIIPYFIDLLKEIPLSW

SEQ ID NO: 2488325 - protein, 18 aa, Entamoeba dispar
ITIIRVGKGTLVFVDLAG

SEQ ID NO: 2488326 - protein, 17 aa, Entamoeba dispar
ITIIRWIQIENIEQEIK

SEQ ID NO: 2488327 - protein, 17 aa, Entamoeba dispar
ITIKAHFTFDSFTKSII

SEQ ID NO: 2488328 - protein, 20 aa, Entamoeba dispar
ITILDMYRHGLWCKDIIVTL

SEQ ID NO: 2488329 - protein, 18 aa, Entamoeba dispar
ITIPCYHSPFAFPVPEEL

SEQ ID NO: 2488330 - protein, 17 aa, Entamoeba dispar
ITIPQIIQLKQYDNIIS

SEQ ID NO: 2488331 - protein, 26 aa, Entamoeba dispar
ITIQKACLNICSLLFEKIDEYKMTVY

SEQ ID NO: 2488332 - protein, 28 aa, Entamoeba dispar
ITISIKFPICNNSLPWSWKMKPSQFSSP

SEQ ID NO: 2488333 - protein, 33 aa, Entamoeba dispar
ITITGFKGVLLIVFKTKIEFIDIASLNIISTVN

SEQ ID NO: 2488334 - protein, 17 aa, Entamoeba dispar
ITKEGYSFGCFNKKQIP

SEQ ID NO: 2488335 - protein, 17 aa, Entamoeba dispar
ITKIGFNCFEECLSLTT

SEQ ID NO: 2488336 - protein, 19 aa, Entamoeba dispar
ITKIGNYCFYKCGCEDELK

SEQ ID NO: 2488337 - protein, 21 aa, Entamoeba dispar
ITKIGPFCFKDCINLQSIVIP

SEQ ID NO: 2488338 - protein, 24 aa, Entamoeba dispar
ITKIGSCCFFNCYSLTMLKIPKGI

SEQ ID NO: 2488339 - protein, 24 aa, Entamoeba dispar
ITKIGYGCFSYCYSLKSINIPSSI

SEQ ID NO: 2488340 - protein, 20 aa, Entamoeba dispar
ITKIKVGVFYDCFQMSRIQI

SEQ ID NO: 2488341 - protein, 24 aa, Entamoeba dispar
ITKILSVKFPEEYAKYSNGITEIL

SEQ ID NO: 2488342 - protein, 25 aa, Entamoeba dispar
ITKKASFSSISGWLREFQQNKNSSF

SEQ ID NO: 2488343 - protein, 17 aa, Entamoeba dispar
ITKKCWRDEMESRPTAR

SEQ ID NO: 2488344 - protein, 22 aa, Entamoeba dispar
ITKKEYSCLSALAYAKDLNESD

SEQ ID NO: 2488345 - protein, 17 aa, Entamoeba dispar
ITKKLNTLFSLEFSSNV

SEQ ID NO: 2488346 - protein, 18 aa, Entamoeba dispar
ITKKTKRAVVREVVVLSK

SEQ ID NO: 2488347 - protein, 25 aa, Entamoeba dispar
ITKKTSFESVEKWLAELHENADKKV

SEQ ID NO: 2488348 - protein, 22 aa, Entamoeba dispar
ITKKYFDWFWKEENQEIIEQIV

SEQ ID NO: 2488349 - protein, 25 aa, Entamoeba dispar
ITKLCIEKSFGVQILDYYKKTSDEK

SEQ ID NO: 2488350 - protein, 23 aa, Entamoeba dispar
ITKLDDCCFYKCSSLTSIKIPSS

SEQ ID NO: 2488351 - protein, 25 aa, Entamoeba dispar
ITKLGKCCFYECPTLTSINIPSSIS

SEQ ID NO: 2488352 - protein, 17 aa, Entamoeba dispar
ITKLGKCCFYECSSLKS

SEQ ID NO: 2488353 - protein, 23 aa, Entamoeba dispar
ITKLGNSCFNWCAPLKSINIHST

SEQ ID NO: 2488354 - protein, 25 aa, Entamoeba dispar
ITKMQVLCFEYCGFYEGSTYSKEVL

SEQ ID NO: 2488355 - protein, 24 aa, Entamoeba dispar
ITKPAIRRLARRGGVKRINGAVYD

SEQ ID NO: 2488356 - protein, 25 aa, Entamoeba dispar
ITKPAIRRLARRGGVKRINGAVYDE

SEQ ID NO: 2488357 - protein, 22 aa, Entamoeba dispar
ITKPFIFVDCHVLRQYLNKTIK

SEQ ID NO: 2488358 - protein, 25 aa, Entamoeba dispar
ITKQNFLHCISIPKASTPVAPVVNK

SEQ ID NO: 2488359 - protein, 30 aa, Entamoeba dispar
ITKRLSPCLCQFALCVPNQVCWKPLNHQLL

SEQ ID NO: 2488360 - protein, 23 aa, Entamoeba dispar
ITKRVPIPISKIVKCQLCDFNDI

SEQ ID NO: 2488361 - protein, 17 aa, Entamoeba dispar
ITKSIIYKFHPFYKHLY

SEQ ID NO: 2488362 - protein, 23 aa, Entamoeba dispar
ITKVTRLSTGRVETSVHKIPHQP

SEQ ID NO: 2488363 - protein, 18 aa, Entamoeba dispar
ITKYPLFIREIKPLLVSI

SEQ ID NO: 2488364 - protein, 24 aa, Entamoeba dispar
ITLAKCYYFKYIINLYNIERKNND

SEQ ID NO: 2488365 - protein, 21 aa, Entamoeba dispar
ITLCKTLLPSMKIREISCFDR

SEQ ID NO: 2488366 - protein, 17 aa, Entamoeba dispar
ITLCSKIGEKMMNTDNT

SEQ ID NO: 2488367 - protein, 20 aa, Entamoeba dispar
ITLIECPNDLNGMLDCAKIA

SEQ ID NO: 2488368 - protein, 24 aa, Entamoeba dispar
ITLLEIKGKIPLNRISETINENFN

SEQ ID NO: 2488369 - protein, 25 aa, Entamoeba dispar
ITLLKDEKSIFCIIKSQIGIDEANK

SEQ ID NO: 2488370 - protein, 24 aa, Entamoeba dispar
ITLPGCIGCTVVSNTFSPTTQLDY

SEQ ID NO: 2488371 - protein, 26 aa, Entamoeba dispar
ITLPLLKRKDEILSIPDFLWITKQKC

SEQ ID NO: 2488372 - protein, 24 aa, Entamoeba dispar
ITLPQYYLSFLIGGGLKLLLDYGC

SEQ ID NO: 2488373 - protein, 30 aa, Entamoeba dispar
ITLQTPLVFWKWANEHILAIVTSTTVFHFD

SEQ ID NO: 2488374 - protein, 19 aa, Entamoeba dispar
ITLTPKLYYSLYIEIQTIF

SEQ ID NO: 2488375 - protein, 18 aa, Entamoeba dispar
ITMALKYLHSLNIFIEIL

SEQ ID NO: 2488376 - protein, 18 aa, Entamoeba dispar
ITMALKYLHSLNIIHRDL

SEQ ID NO: 2488377 - protein, 30 aa, Entamoeba dispar
ITMKSRATGMLRVKKFLLFLRELIEEKQNN

SEQ ID NO: 2488378 - protein, 23 aa, Entamoeba dispar
ITMTCLKKSIVIAGVDKDTKCEL

SEQ ID NO: 2488379 - protein, 17 aa, Entamoeba dispar
ITNCLRCNRTCHYPCDI

SEQ ID NO: 2488380 - protein, 22 aa, Entamoeba dispar
ITNEERISCYLKIIESYISMGY

SEQ ID NO: 2488381 - protein, 24 aa, Entamoeba dispar
ITNFKRFFNLEGEYEKEIFPYNYY

SEQ ID NO: 2488382 - protein, 17 aa, Entamoeba dispar
ITNKSIENHHFLIDLLE

SEQ ID NO: 2488383 - protein, 25 aa, Entamoeba dispar
ITNLCPFGIFLQLRYLSLKNNRIED

SEQ ID NO: 2488384 - protein, 35 aa, Entamoeba dispar
ITNLPRYLPYIIETCIPFLESITCFPLMEHPKQTK

SEQ ID NO: 2488385 - protein, 18 aa, Entamoeba dispar
ITNNALEFLINYSAGNVL

SEQ ID NO: 2488386 - protein, 18 aa, Entamoeba dispar
ITNQIGIQYQRYCTPTVT

SEQ ID NO: 2488387 - protein, 27 aa, Entamoeba dispar
ITNVLRTPPGYRCVFSQSGKLFTCELH

SEQ ID NO: 2488388 - protein, 17 aa, Entamoeba dispar
ITNWKFAITNNIVAACN

SEQ ID NO: 2488389 - protein, 26 aa, Entamoeba dispar
ITPAVMFCDSIGFLSANFYSKNLFDE

SEQ ID NO: 2488390 - protein, 25 aa, Entamoeba dispar
ITPEIFKTKDFRIIQYYIHPQTSDL

SEQ ID NO: 2488391 - protein, 18 aa, Entamoeba dispar
ITPKYLFSNLIEYLIFHK

SEQ ID NO: 2488392 - protein, 19 aa, Entamoeba dispar
ITPKYLFSNLIEYLIFHKF

SEQ ID NO: 2488393 - protein, 18 aa, Entamoeba dispar
ITPLFIFEVQYDLFVNIF

SEQ ID NO: 2488394 - protein, 21 aa, Entamoeba dispar
ITPLWECHTQNKLEEYEQLLN

SEQ ID NO: 2488395 - protein, 25 aa, Entamoeba dispar
ITPMTRGHFKPMMMKCSARMNYGTI

SEQ ID NO: 2488396 - protein, 26 aa, Entamoeba dispar
ITPNVFRHLLEIIISLNVVTPKLCIN

SEQ ID NO: 2488397 - protein, 18 aa, Entamoeba dispar
ITPPMPKDGLVWEKQGEE

SEQ ID NO: 2488398 - protein, 25 aa, Entamoeba dispar
ITPWYLEYICSFLIKIILEEKKENE

SEQ ID NO: 2488399 - protein, 18 aa, Entamoeba dispar
ITQCRKHYNSCPHCNAIN

SEQ ID NO: 2488400 - protein, 17 aa, Entamoeba dispar
ITQDILLTIPIMNVLTK

SEQ ID NO: 2488401 - protein, 19 aa, Entamoeba dispar
ITQEFFGWNQNKFIDDIVF

SEQ ID NO: 2488402 - protein, 19 aa, Entamoeba dispar
ITQIIPIYEGYVISSCVHK

SEQ ID NO: 2488403 - protein, 17 aa, Entamoeba dispar
ITQNLSIRCIYAGHALG

SEQ ID NO: 2488404 - protein, 27 aa, Entamoeba dispar
ITREHFRYIIKYIFSFISKDKQHEQLM

SEQ ID NO: 2488405 - protein, 17 aa, Entamoeba dispar
ITRGVSIHIFEPADISE

SEQ ID NO: 2488406 - protein, 24 aa, Entamoeba dispar
ITRKALTVFPELLIKKEKEDIQII

SEQ ID NO: 2488407 - protein, 22 aa, Entamoeba dispar
ITRMSNEPELIYGIKSQCSDSD

SEQ ID NO: 2488408 - protein, 22 aa, Entamoeba dispar
ITSDFWKECKNGIIPDVTDIIQ

SEQ ID NO: 2488409 - protein, 19 aa, Entamoeba dispar
ITSEIALVMILKGSNSIGL

SEQ ID NO: 2488410 - protein, 25 aa, Entamoeba dispar
ITSFGKYCFYGCVSMMNDNLSTKIK

SEQ ID NO: 2488411 - protein, 25 aa, Entamoeba dispar
ITSFGRGCFYGCGCEEELMKNETIP

SEQ ID NO: 2488412 - protein, 25 aa, Entamoeba dispar
ITSFGYGCFYGCGCVEELMKNKTIP

SEQ ID NO: 2488413 - protein, 19 aa, Entamoeba dispar
ITSFKRLLYSPVIDGSKEL

SEQ ID NO: 2488414 - protein, 18 aa, Entamoeba dispar
ITSFLDLCNECLNLYETI

SEQ ID NO: 2488415 - protein, 25 aa, Entamoeba dispar
ITSFRWQYIKYLFKMSYNALHYTHL

SEQ ID NO: 2488416 - protein, 24 aa, Entamoeba dispar
ITSIGGGCFWGCSSITTINIPSSI

SEQ ID NO: 2488417 - protein, 28 aa, Entamoeba dispar
ITSIGKLCFCGCCLLTSISIPSSISKIK

SEQ ID NO: 2488418 - protein, 24 aa, Entamoeba dispar
ITSKRSKLTLPFLKINTISFTSED

SEQ ID NO: 2488419 - protein, 22 aa, Entamoeba dispar
ITSLCFSGVLLQSSSLDGTIVR

SEQ ID NO: 2488420 - protein, 19 aa, Entamoeba dispar
ITSLLKYGAYGLLKDDDDK

SEQ ID NO: 2488421 - protein, 17 aa, Entamoeba dispar
ITSMDGIDEITKNECDL

SEQ ID NO: 2488422 - protein, 21 aa, Entamoeba dispar
ITSMFGIKCAESVIRDLIGHP

SEQ ID NO: 2488423 - protein, 24 aa, Entamoeba dispar
ITSMRFLREYKKIINIMKNCSTNK

SEQ ID NO: 2488424 - protein, 18 aa, Entamoeba dispar
ITSNLSFRKSELISKQKD

SEQ ID NO: 2488425 - protein, 17 aa, Entamoeba dispar
ITSREFFVNKTLITLCI

SEQ ID NO: 2488426 - protein, 20 aa, Entamoeba dispar
ITSRFNERFVLSLSDNKNSI

SEQ ID NO: 2488427 - protein, 18 aa, Entamoeba dispar
ITTEIFPSLPRDTFVSIH

SEQ ID NO: 2488428 - protein, 20 aa, Entamoeba dispar
ITTEVLMTCTFRALDKSCSA

SEQ ID NO: 2488429 - protein, 26 aa, Entamoeba dispar
ITTFSDWKLILYFINLLGKFGGEPNY

SEQ ID NO: 2488430 - protein, 25 aa, Entamoeba dispar
ITTIKCAWIGTSTRILFEKNLNVNI

SEQ ID NO: 2488431 - protein, 23 aa, Entamoeba dispar
ITTKKIFQRWIEIIDAQIDSKII

SEQ ID NO: 2488432 - protein, 23 aa, Entamoeba dispar
ITTLKTGCSFAFENNKFSVFTDQ

SEQ ID NO: 2488433 - protein, 21 aa, Entamoeba dispar
ITTPRGWKGKLSYFQATLTLK

SEQ ID NO: 2488434 - protein, 27 aa, Entamoeba dispar
ITTQLKRLHVFGEIFAENGYLVRSDAR

SEQ ID NO: 2488435 - protein, 19 aa, Entamoeba dispar
ITVDCCSILGYTTTVTEFY

SEQ ID NO: 2488436 - protein, 17 aa, Entamoeba dispar
ITVFGVFDGHMGTSASD

SEQ ID NO: 2488437 - protein, 21 aa, Entamoeba dispar
ITVGICLNGKPLIKKQLNKNN

SEQ ID NO: 2488438 - protein, 32 aa, Entamoeba dispar
ITVIRCSSCKEILEGVCDCILQLISPLNNDWK

SEQ ID NO: 2488439 - protein, 26 aa, Entamoeba dispar
ITVKYPRWFEFYDMIQVIETLHKKVE

SEQ ID NO: 2488440 - protein, 18 aa, Entamoeba dispar
ITVLTSWAETQHVVLRKG

SEQ ID NO: 2488441 - protein, 22 aa, Entamoeba dispar
ITVPGVKVVINFGMEKSMQFDT

SEQ ID NO: 2488442 - protein, 20 aa, Entamoeba dispar
ITVQLCSGVCLQISNDEDVQ

SEQ ID NO: 2488443 - protein, 24 aa, Entamoeba dispar
ITWMHEIDGIFSLQQQKLISRIEN

SEQ ID NO: 2488444 - protein, 25 aa, Entamoeba dispar
ITYFGQELYICFNDSEYLPMSWTSG

SEQ ID NO: 2488445 - protein, 23 aa, Entamoeba dispar
ITYNCPPIRCSYKQENKLPTGCY

SEQ ID NO: 2488446 - protein, 23 aa, Entamoeba dispar
ITYPELKVSFTYFDINGKDKQIK

SEQ ID NO: 2488447 - protein, 25 aa, Entamoeba dispar
ITYQEGAFCDLEILNKNPALFSREG

SEQ ID NO: 2488448 - protein, 20 aa, Entamoeba dispar
ITYTEWKLKPNGSYYKTETR

SEQ ID NO: 2488449 - protein, 19 aa, Entamoeba dispar
IVACDGFWNVFKYEDAISL

SEQ ID NO: 2488450 - protein, 26 aa, Entamoeba dispar
IVAEAKMKECINILLSISENNEVREQ

SEQ ID NO: 2488451 - protein, 37 aa, Entamoeba dispar
IVAEKKIPCLNSIVNIDCEFNETIILNCQIVQQLSFN

SEQ ID NO: 2488452 - protein, 17 aa, Entamoeba dispar
IVAEKWLYDSIGSMKVM

SEQ ID NO: 2488453 - protein, 22 aa, Entamoeba dispar
IVAELLTGQILFRGMTTSDQLG

SEQ ID NO: 2488454 - protein, 22 aa, Entamoeba dispar
IVAGCYSGICAMIDIGTMSAYQ

SEQ ID NO: 2488455 - protein, 17 aa, Entamoeba dispar
IVAGMLHLGNVEYSQGR

SEQ ID NO: 2488456 - protein, 23 aa, Entamoeba dispar
IVCDSSFKKKCFDSQRIKFIFDC

SEQ ID NO: 2488457 - protein, 19 aa, Entamoeba dispar
IVCESCGNHIGWKFTTHND

SEQ ID NO: 2488458 - protein, 19 aa, Entamoeba dispar
IVCGSIVNGNFAYVTKSKD

SEQ ID NO: 2488459 - protein, 25 aa, Entamoeba dispar
IVCLQEFRLVNSMFSKPISLLFPTS

SEQ ID NO: 2488460 - protein, 27 aa, Entamoeba dispar
IVDEFDLGIDIPNEFIIKEKKDLTSEI

SEQ ID NO: 2488461 - protein, 23 aa, Entamoeba dispar
IVDGTCHSMNFYGCKIETVTCDV

SEQ ID NO: 2488462 - protein, 19 aa, Entamoeba dispar
IVDHKEIFPNIKDLPVFNS

SEQ ID NO: 2488463 - protein, 25 aa, Entamoeba dispar
IVDIREFRCELPFHLFNQNFKLIPK

SEQ ID NO: 2488464 - protein, 17 aa, Entamoeba dispar
IVDMYLQPLQMMINQGI

SEQ ID NO: 2488465 - protein, 19 aa, Entamoeba dispar
IVDQCLRCIEHVHKKGYIH

SEQ ID NO: 2488466 - protein, 17 aa, Entamoeba dispar
IVDSIILTLYGNAMSDR

SEQ ID NO: 2488467 - protein, 17 aa, Entamoeba dispar
IVDVAAVVSKIFQQESI

SEQ ID NO: 2488468 - protein, 19 aa, Entamoeba dispar
IVEILKCTIMIVDDMNKNI

SEQ ID NO: 2488469 - protein, 18 aa, Entamoeba dispar
IVESISLFYSVVYNSVGE

SEQ ID NO: 2488470 - protein, 23 aa, Entamoeba dispar
IVESKGFFYRAEFVEVATGANVL

SEQ ID NO: 2488471 - protein, 22 aa, Entamoeba dispar
IVESWCDGMTFAQLIHGSELFE

SEQ ID NO: 2488472 - protein, 26 aa, Entamoeba dispar
IVEYLNIINLEWWKKIKDNILKDIPR

SEQ ID NO: 2488473 - protein, 38 aa, Entamoeba dispar
IVFHPCGDHLIACSFDKKCIWYDLQAGLDPFKVLRLHT

SEQ ID NO: 2488474 - protein, 30 aa, Entamoeba dispar
IVFKLTAFGSRAGIFVKAICMFLTTITTPD

SEQ ID NO: 2488475 - protein, 22 aa, Entamoeba dispar
IVFLLICDQYFFGFFNSQCLQT

SEQ ID NO: 2488476 - protein, 18 aa, Entamoeba dispar
IVGEIEGVLSMIENSIAN

SEQ ID NO: 2488477 - protein, 19 aa, Entamoeba dispar
IVGHKFKYPLDFASVTSMV

SEQ ID NO: 2488478 - protein, 24 aa, Entamoeba dispar
IVGKLCSAMRFYEERKMYKDELDK

SEQ ID NO: 2488479 - protein, 24 aa, Entamoeba dispar
IVGLLKLFNYLSINFDRLLDIIEK

SEQ ID NO: 2488480 - protein, 19 aa, Entamoeba dispar
IVGLSEIRRELGMKENTSE

SEQ ID NO: 2488481 - protein, 28 aa, Entamoeba dispar
IVGSPYSNLYCKLLIKKWNKMPNMMEQS

SEQ ID NO: 2488482 - protein, 17 aa, Entamoeba dispar
IVGVSGIYKSFDEIKPY

SEQ ID NO: 2488483 - protein, 17 aa, Entamoeba dispar
IVGYGHSGSVDWWTFGI

SEQ ID NO: 2488484 - protein, 17 aa, Entamoeba dispar
IVHCDIKPSNFVVKGKE

SEQ ID NO: 2488485 - protein, 17 aa, Entamoeba dispar
IVHLFDIRNGKQIGKYK

SEQ ID NO: 2488486 - protein, 18 aa, Entamoeba dispar
IVHLFDIRNGKQIGKYKG

SEQ ID NO: 2488487 - protein, 18 aa, Entamoeba dispar
IVHLPRIDGLQVTSHIEY

SEQ ID NO: 2488488 - protein, 19 aa, Entamoeba dispar
IVHRDLALRNVLYIHDKLG

SEQ ID NO: 2488489 - protein, 23 aa, Entamoeba dispar
IVHSYFEGMNWVLGYYYKGCQSW

SEQ ID NO: 2488490 - protein, 18 aa, Entamoeba dispar
IVIALKIANPKYEDTKYT

SEQ ID NO: 2488491 - protein, 17 aa, Entamoeba dispar
IVICLDINNPRLLNSTK

SEQ ID NO: 2488492 - protein, 18 aa, Entamoeba dispar
IVICTPFISSVQCIEFLA

SEQ ID NO: 2488493 - protein, 23 aa, Entamoeba dispar
IVIDEFDTVFGIYLHYPLISPFK

SEQ ID NO: 2488494 - protein, 24 aa, Entamoeba dispar
IVIDNCQFFYFGLKQSICAYESVL

SEQ ID NO: 2488495 - protein, 17 aa, Entamoeba dispar
IVIKLSYYIKTFLIDCK

SEQ ID NO: 2488496 - protein, 20 aa, Entamoeba dispar
IVIVCPQSLIGNWEKEFKKW

SEQ ID NO: 2488497 - protein, 18 aa, Entamoeba dispar
IVKCDNCKVNIKSDSIGS

SEQ ID NO: 2488498 - protein, 18 aa, Entamoeba dispar
IVKCFPDENGSVSITSGT

SEQ ID NO: 2488499 - protein, 21 aa, Entamoeba dispar
IVKDCIKKRWEALIQENHNPV

SEQ ID NO: 2488500 - protein, 17 aa, Entamoeba dispar
IVKDIVMGMKWFIEKEL

SEQ ID NO: 2488501 - protein, 18 aa, Entamoeba dispar
IVKLCHKIMLHSSKNLMN

SEQ ID NO: 2488502 - protein, 19 aa, Entamoeba dispar
IVKMWKINIPSSFKSSETL

SEQ ID NO: 2488503 - protein, 20 aa, Entamoeba dispar
IVKMWKINIPSSFKSSETLS

SEQ ID NO: 2488504 - protein, 23 aa, Entamoeba dispar
IVKNGGVVMNLFGTKRVNGQIMV

SEQ ID NO: 2488505 - protein, 24 aa, Entamoeba dispar
IVKPGLKTTMFISVTYTMTKRIEF

SEQ ID NO: 2488506 - protein, 22 aa, Entamoeba dispar
IVKSDHCSINFPSIGFEIPSTA

SEQ ID NO: 2488507 - protein, 19 aa, Entamoeba dispar
IVLDRCFDGYTPLIPNTSV

SEQ ID NO: 2488508 - protein, 25 aa, Entamoeba dispar
IVLEGKKPIRICRMNGSGSSEYLLP

SEQ ID NO: 2488509 - protein, 17 aa, Entamoeba dispar
IVLEWQEYFLKKFEVKT

SEQ ID NO: 2488510 - protein, 18 aa, Entamoeba dispar
IVLFELLEGYPPHYELRG

SEQ ID NO: 2488511 - protein, 19 aa, Entamoeba dispar
IVLFVLVMEKIMGRIDLPF

SEQ ID NO: 2488512 - protein, 24 aa, Entamoeba dispar
IVLKERIGYKMIQVININQIKEYI

SEQ ID NO: 2488513 - protein, 18 aa, Entamoeba dispar
IVLKGHEKPITKIELTRE

SEQ ID NO: 2488514 - protein, 17 aa, Entamoeba dispar
IVLLGPTYVGKSAISFR

SEQ ID NO: 2488515 - protein, 17 aa, Entamoeba dispar
IVLLGSGSVGKSAIATR

SEQ ID NO: 2488516 - protein, 17 aa, Entamoeba dispar
IVLLKLKAFVNGLNKMS

SEQ ID NO: 2488517 - protein, 23 aa, Entamoeba dispar
IVLNCTLLSFAKMLEFEKYDLPE

SEQ ID NO: 2488518 - protein, 28 aa, Entamoeba dispar
IVLPETIMKLGERCFIWCSSLSEINIPK

SEQ ID NO: 2488519 - protein, 24 aa, Entamoeba dispar
IVLPPCFISLSDMCFVSCKATKIV

SEQ ID NO: 2488520 - protein, 24 aa, Entamoeba dispar
IVLRGCLDGGSATVLLRGANTTML

SEQ ID NO: 2488521 - protein, 25 aa, Entamoeba dispar
IVLRNGGECFGCYQHDPIALSRPTN

SEQ ID NO: 2488522 - protein, 18 aa, Entamoeba dispar
IVLTFVMSLIPFFFQKYI

SEQ ID NO: 2488523 - protein, 18 aa, Entamoeba dispar
IVLTRAKDSVAIERDALF

SEQ ID NO: 2488524 - protein, 20 aa, Entamoeba dispar
IVLYECPNIVRGIPLSKKKE

SEQ ID NO: 2488525 - protein, 22 aa, Entamoeba dispar
IVMEFCAHFSLFDVLNDPNQQI

SEQ ID NO: 2488526 - protein, 17 aa, Entamoeba dispar
IVMIQRYDEIFGDFRSA

SEQ ID NO: 2488527 - protein, 17 aa, Entamoeba dispar
IVMKAGPLLRAGIDIEN

SEQ ID NO: 2488528 - protein, 20 aa, Entamoeba dispar
IVMKVIESCYEMKKDTTEIR

SEQ ID NO: 2488529 - protein, 27 aa, Entamoeba dispar
IVMNLLIDLLFEFGYLFEIQKETKEGY

SEQ ID NO: 2488530 - protein, 18 aa, Entamoeba dispar
IVMWGKEKVGKSTIVNVW

SEQ ID NO: 2488531 - protein, 24 aa, Entamoeba dispar
IVMYGELLYNYEIYQYSFPILVDF

SEQ ID NO: 2488532 - protein, 18 aa, Entamoeba dispar
IVNCCYVMAVNREITLFP

SEQ ID NO: 2488533 - protein, 20 aa, Entamoeba dispar
IVNEIYIRYLKIFNKQLSVT

SEQ ID NO: 2488534 - protein, 27 aa, Entamoeba dispar
IVNGRQVFTFDKCRSNCSSSRNHHKDQ

SEQ ID NO: 2488535 - protein, 17 aa, Entamoeba dispar
IVNKRINVEYVMIIGHI

SEQ ID NO: 2488536 - protein, 17 aa, Entamoeba dispar
IVNPALMALYAEGKETG

SEQ ID NO: 2488537 - protein, 23 aa, Entamoeba dispar
IVPEEVTWNFILLIQQNIELQSY

SEQ ID NO: 2488538 - protein, 17 aa, Entamoeba dispar
IVPHCKEELVMKRVNDT

SEQ ID NO: 2488539 - protein, 37 aa, Entamoeba dispar
IVPHPSLHLKGGVGVRYRLQAKLQIIPLKRKEGSEKA

SEQ ID NO: 2488540 - protein, 25 aa, Entamoeba dispar
IVPIPCASHLILLHLLEGKKEEMSA

SEQ ID NO: 2488541 - protein, 18 aa, Entamoeba dispar
IVPLALLRSRKHKITHSI

SEQ ID NO: 2488542 - protein, 18 aa, Entamoeba dispar
IVPPEFLKTLGNIFTDLM

SEQ ID NO: 2488543 - protein, 25 aa, Entamoeba dispar
IVPQELSLVFIVRKYLSNIVRSLSK

SEQ ID NO: 2488544 - protein, 25 aa, Entamoeba dispar
IVQEFKSQLFLFFINFFSKDSDAKE

SEQ ID NO: 2488545 - protein, 23 aa, Entamoeba dispar
IVQFLSTMCSFDIFSDNETQLKN

SEQ ID NO: 2488546 - protein, 26 aa, Entamoeba dispar
IVQKLWDIVKFYLFRESDTNTRFVYF

SEQ ID NO: 2488547 - protein, 24 aa, Entamoeba dispar
IVQKNVLEFKEFINTIINEAVQPE

SEQ ID NO: 2488548 - protein, 23 aa, Entamoeba dispar
IVQSILCALKVTPPNSLALRSFN

SEQ ID NO: 2488549 - protein, 32 aa, Entamoeba dispar
IVRIDGCIRLQKFPFLSRFHHDLKFRSVPTTY

SEQ ID NO: 2488550 - protein, 22 aa, Entamoeba dispar
IVRKNETIMLMGNVNTLPKKED

SEQ ID NO: 2488551 - protein, 19 aa, Entamoeba dispar
IVRMFKVEIQRIIVQSVSL

SEQ ID NO: 2488552 - protein, 26 aa, Entamoeba dispar
IVRRMFSILARNGWWEKLGGMDGLME

SEQ ID NO: 2488553 - protein, 23 aa, Entamoeba dispar
IVRSEAGIYRCIIISEDSALKCE

SEQ ID NO: 2488554 - protein, 18 aa, Entamoeba dispar
IVRSRVNEFPKFLRKIPK

SEQ ID NO: 2488555 - protein, 27 aa, Entamoeba dispar
IVRTEIPILPLFFLQYCAIEELQFEKL

SEQ ID NO: 2488556 - protein, 19 aa, Entamoeba dispar
IVRVILQMVQFYKHSIPMQ

SEQ ID NO: 2488557 - protein, 30 aa, Entamoeba dispar
IVRVVECVFLFATECFKIYNIEPFPQIPIE

SEQ ID NO: 2488558 - protein, 18 aa, Entamoeba dispar
IVSFIGADLAQKVIPVIK

SEQ ID NO: 2488559 - protein, 18 aa, Entamoeba dispar
IVSFQYSRCSDYFSLGSM

SEQ ID NO: 2488560 - protein, 17 aa, Entamoeba dispar
IVSHKIFEMYCMKSNML

SEQ ID NO: 2488561 - protein, 18 aa, Entamoeba dispar
IVSHVLHSFIPLPTIKQT

SEQ ID NO: 2488562 - protein, 26 aa, Entamoeba dispar
IVSSCLRVFECLYKKNTSYMISFINS

SEQ ID NO: 2488563 - protein, 24 aa, Entamoeba dispar
IVSVKAHCFGGIEITMNVLQFEIL

SEQ ID NO: 2488564 - protein, 23 aa, Entamoeba dispar
IVSWKGVNFLLCICNDIRFPAFL

SEQ ID NO: 2488565 - protein, 25 aa, Entamoeba dispar
IVTFKHPFESFSFMASLIGEILNGT

SEQ ID NO: 2488566 - protein, 17 aa, Entamoeba dispar
IVTKKWTKKFSVKKDQM

SEQ ID NO: 2488567 - protein, 17 aa, Entamoeba dispar
IVVACDGLWDVFDNQTV

SEQ ID NO: 2488568 - protein, 25 aa, Entamoeba dispar
IVVALKLAEIFKCEVNELPLHLILS

SEQ ID NO: 2488569 - protein, 17 aa, Entamoeba dispar
IVVDAHCQYRLGRVDSY

SEQ ID NO: 2488570 - protein, 24 aa, Entamoeba dispar
IVVDCGYGMCQVVPIYNGYMMEHA

SEQ ID NO: 2488571 - protein, 25 aa, Entamoeba dispar
IVVELWKKQEIIDGFVDLDGMSVGE

SEQ ID NO: 2488572 - protein, 18 aa, Entamoeba dispar
IVVHIRFRVGSISECSNI

SEQ ID NO: 2488573 - protein, 17 aa, Entamoeba dispar
IVVHPNWIIDSIKYGTL

SEQ ID NO: 2488574 - protein, 26 aa, Entamoeba dispar
IVVKRIFPASFEFVCRTTKDNDFRFE

SEQ ID NO: 2488575 - protein, 24 aa, Entamoeba dispar
IVVQPRIAGSFTITHSFSSQLQTF

SEQ ID NO: 2488576 - protein, 24 aa, Entamoeba dispar
IVVVYPRKLNYLILLQQSIWNNQQ

SEQ ID NO: 2488577 - protein, 24 aa, Entamoeba dispar
IVYAKANHPLAVIRPSWTNKGAHF

SEQ ID NO: 2488578 - protein, 17 aa, Entamoeba dispar
IVYGCIYGIGPFSLADQ

SEQ ID NO: 2488579 - protein, 25 aa, Entamoeba dispar
IVYNKRILFLLLHIVETISKMNTSN

SEQ ID NO: 2488580 - protein, 21 aa, Entamoeba dispar
IVYPSIPIITVILNYPEYCLA

SEQ ID NO: 2488581 - protein, 17 aa, Entamoeba dispar
IVYRYKFPESIAYKKLQ

SEQ ID NO: 2488582 - protein, 17 aa, Entamoeba dispar
IVYSYKFETRDGRITYP

SEQ ID NO: 2488583 - protein, 19 aa, Entamoeba dispar
IWAIIGISGKVVYKTESII

SEQ ID NO: 2488584 - protein, 18 aa, Entamoeba dispar
IWAIPAIHRTGLLGRFSP

SEQ ID NO: 2488585 - protein, 19 aa, Entamoeba dispar
IWDKLEFDGNCTIEQFCQE

SEQ ID NO: 2488586 - protein, 28 aa, Entamoeba dispar
IWDLLHQRPMEFFEIIYVTGTVLRGLRE

SEQ ID NO: 2488587 - protein, 19 aa, Entamoeba dispar
IWEIESLGLIVSARIQLPL

SEQ ID NO: 2488588 - protein, 25 aa, Entamoeba dispar
IWENQCSVVKRPDMDQHQLERFIRD

SEQ ID NO: 2488589 - protein, 24 aa, Entamoeba dispar
IWERHPYEALSIFCKNDQTLSVNE

SEQ ID NO: 2488590 - protein, 21 aa, Entamoeba dispar
IWGNLCLLGGNAIKYIDDHKV

SEQ ID NO: 2488591 - protein, 25 aa, Entamoeba dispar
IWGNLPRRRIDLMDENTLLTEVKLY

SEQ ID NO: 2488592 - protein, 17 aa, Entamoeba dispar
IWHKRKVRTCSFNPYAS

SEQ ID NO: 2488593 - protein, 17 aa, Entamoeba dispar
IWIPCLFEIPQENPVVF

SEQ ID NO: 2488594 - protein, 20 aa, Entamoeba dispar
IWKKKLYITTEHPLPSELIR

SEQ ID NO: 2488595 - protein, 17 aa, Entamoeba dispar
IWLNSALSGKTKRVKTL

SEQ ID NO: 2488596 - protein, 18 aa, Entamoeba dispar
IWLNSALSGRTKRIKTLV

SEQ ID NO: 2488597 - protein, 18 aa, Entamoeba dispar
IWLNSALSGRTKRVKTLV

SEQ ID NO: 2488598 - protein, 17 aa, Entamoeba dispar
IWLRRTRAQKRDYQILV

SEQ ID NO: 2488599 - protein, 32 aa, Entamoeba dispar
IWLVKALKIIIEFDFGKKLALLSGKKEESHEL

SEQ ID NO: 2488600 - protein, 18 aa, Entamoeba dispar
IWNIAFVCAHIMQLKEKC

SEQ ID NO: 2488601 - protein, 36 aa, Entamoeba dispar
IWNVFPIADFWRHVCIVWTKCYCYFPTEVIEEKKKS

SEQ ID NO: 2488602 - protein, 30 aa, Entamoeba dispar
IWNVFPITDFWRHVCVVWTKCYCYIPKEVI

SEQ ID NO: 2488603 - protein, 21 aa, Entamoeba dispar
IWNVGLKLFSSVGLAKEQKYE

SEQ ID NO: 2488604 - protein, 20 aa, Entamoeba dispar
IWPLLEKKLKISGETLDGKE

SEQ ID NO: 2488605 - protein, 25 aa, Entamoeba dispar
IWSCGCVLAEMIIRNYPLFEGECLN

SEQ ID NO: 2488606 - protein, 17 aa, Entamoeba dispar
IWSIGVITYLVLSGNLP

SEQ ID NO: 2488607 - protein, 25 aa, Entamoeba dispar
IWSKNEFIISIGNFYQGWIDIASIG

SEQ ID NO: 2488608 - protein, 23 aa, Entamoeba dispar
IWSLGIMCREMMEGVPPYIDDPP

SEQ ID NO: 2488609 - protein, 17 aa, Entamoeba dispar
IWVHRRFLMNEAEKIIQ

SEQ ID NO: 2488610 - protein, 17 aa, Entamoeba dispar
IYACIGCICDYYDNTEY

SEQ ID NO: 2488611 - protein, 21 aa, Entamoeba dispar
IYALCILLKDNIRSFEVLHPP

SEQ ID NO: 2488612 - protein, 17 aa, Entamoeba dispar
IYCAVCRYLMKNNECLS

SEQ ID NO: 2488613 - protein, 21 aa, Entamoeba dispar
IYCCMICGKYYQGRDVGSPAY

SEQ ID NO: 2488614 - protein, 20 aa, Entamoeba dispar
IYCSKCKIEIEAEEFNQLPG

SEQ ID NO: 2488615 - protein, 17 aa, Entamoeba dispar
IYCTDLSSVLSLIESIL

SEQ ID NO: 2488616 - protein, 25 aa, Entamoeba dispar
IYCYDEITMCQPLSSVAISYMFIDK

SEQ ID NO: 2488617 - protein, 26 aa, Entamoeba dispar
IYDDRNCLSLGFGFIDFYSVNDALSL

SEQ ID NO: 2488618 - protein, 25 aa, Entamoeba dispar
IYDEFVSCFDCLPLCALINQNVNGR

SEQ ID NO: 2488619 - protein, 23 aa, Entamoeba dispar
IYDEHHFAFSFAHSGELNSVCVY

SEQ ID NO: 2488620 - protein, 18 aa, Entamoeba dispar
IYDHYASLVYRLMNDLEF

SEQ ID NO: 2488621 - protein, 21 aa, Entamoeba dispar
IYDNCWPKAIEMLTSMGRLID

SEQ ID NO: 2488622 - protein, 23 aa, Entamoeba dispar
IYDPIAFCDKLFRDIKGSRNRFA

SEQ ID NO: 2488623 - protein, 18 aa, Entamoeba dispar
IYDPRTGKMRILNTLQEY

SEQ ID NO: 2488624 - protein, 19 aa, Entamoeba dispar
IYDRVKLDVVKLVDHINYT

SEQ ID NO: 2488625 - protein, 21 aa, Entamoeba dispar
IYDYELWKYLNKLNVDVTCYS

SEQ ID NO: 2488626 - protein, 17 aa, Entamoeba dispar
IYDYFGIEITPEAEKQL

SEQ ID NO: 2488627 - protein, 31 aa, Entamoeba dispar
IYEDIFPLLSILYPRIETINTTYFILSMLSQ

SEQ ID NO: 2488628 - protein, 20 aa, Entamoeba dispar
IYFDHWLSAFVLDKPTLTDI

SEQ ID NO: 2488629 - protein, 26 aa, Entamoeba dispar
IYFINECNIIDLMPLNSVPLSLKLMY

SEQ ID NO: 2488630 - protein, 17 aa, Entamoeba dispar
IYFIPFLLESGFKNEQV

SEQ ID NO: 2488631 - protein, 18 aa, Entamoeba dispar
IYFKGIRTSDVISYFNFN

SEQ ID NO: 2488632 - protein, 23 aa, Entamoeba dispar
IYFLKGKLPWQGFNRQNNTEKFD

SEQ ID NO: 2488633 - protein, 18 aa, Entamoeba dispar
IYFNAEIIEKFEIPKYLG

SEQ ID NO: 2488634 - protein, 24 aa, Entamoeba dispar
IYFQRNPTFIIWGLYLGSVNSTYD

SEQ ID NO: 2488635 - protein, 21 aa, Entamoeba dispar
IYFTHKHFRREGDDVVYYIND

SEQ ID NO: 2488636 - protein, 23 aa, Entamoeba dispar
IYFTLSGIVSYYFVVQNQIKPTI

SEQ ID NO: 2488637 - protein, 17 aa, Entamoeba dispar
IYGCAWSPDSRMLVSAS

SEQ ID NO: 2488638 - protein, 24 aa, Entamoeba dispar
IYGCDLEGLTLILASMKLYQPILI

SEQ ID NO: 2488639 - protein, 21 aa, Entamoeba dispar
IYGCKEVFLRLDNKTNESFVI

SEQ ID NO: 2488640 - protein, 31 aa, Entamoeba dispar
IYGFHKLDCKEGLCFKHEFFQRTHPELLEKI

SEQ ID NO: 2488641 - protein, 34 aa, Entamoeba dispar
IYGFRKLETQTGFCFRHESFIAGHPELLPNIQRK

SEQ ID NO: 2488642 - protein, 17 aa, Entamoeba dispar
IYGFVIDVPSHRSANFK

SEQ ID NO: 2488643 - protein, 26 aa, Entamoeba dispar
IYGKELIEAFKYCLRYEKEYKEGEEI

SEQ ID NO: 2488644 - protein, 20 aa, Entamoeba dispar
IYGYCLNPLSIVMEYFNGGS

SEQ ID NO: 2488645 - protein, 25 aa, Entamoeba dispar
IYGYCVICKLPGNTLLHLIYSNLVP

SEQ ID NO: 2488646 - protein, 19 aa, Entamoeba dispar
IYHIEAFITINLCSVKILL

SEQ ID NO: 2488647 - protein, 18 aa, Entamoeba dispar
IYHNPIIQYQIEEINGIR

SEQ ID NO: 2488648 - protein, 18 aa, Entamoeba dispar
IYHNPIIQYQLEEINGIR

SEQ ID NO: 2488649 - protein, 28 aa, Entamoeba dispar
IYIKNIESIKVRRCELFRCFVNDQNKLI

SEQ ID NO: 2488650 - protein, 21 aa, Entamoeba dispar
IYIKPNHNFIFCGLEGNNFVI

SEQ ID NO: 2488651 - protein, 30 aa, Entamoeba dispar
IYINRLRQFLDYYLKAAIELLPNDKLLKKC

SEQ ID NO: 2488652 - protein, 17 aa, Entamoeba dispar
IYIPYVVQQLGKGYYIP

SEQ ID NO: 2488653 - protein, 18 aa, Entamoeba dispar
IYKIRTYLHLPRNTEQDN

SEQ ID NO: 2488654 - protein, 19 aa, Entamoeba dispar
IYKLFNFRQKKDIERVNEL

SEQ ID NO: 2488655 - protein, 17 aa, Entamoeba dispar
IYKNIFVGINYLLPSNK

SEQ ID NO: 2488656 - protein, 18 aa, Entamoeba dispar
IYKSEWIKYIQILLQSTQ

SEQ ID NO: 2488657 - protein, 19 aa, Entamoeba dispar
IYLARVVGYFPDFIEVNLP

SEQ ID NO: 2488658 - protein, 17 aa, Entamoeba dispar
IYLDGSIINKSYFISFS

SEQ ID NO: 2488659 - protein, 20 aa, Entamoeba dispar
IYLHAWRYIVDDEIFETKLP

SEQ ID NO: 2488660 - protein, 22 aa, Entamoeba dispar
IYLKDERKGNVFKNIEYTKSDR

SEQ ID NO: 2488661 - protein, 18 aa, Entamoeba dispar
IYLLDCFEKQLPLEPSQL

SEQ ID NO: 2488662 - protein, 19 aa, Entamoeba dispar
IYLLSRAGVTVEIKKQKKS

SEQ ID NO: 2488663 - protein, 21 aa, Entamoeba dispar
IYLNIEFDLNFSRTAYTSLPD

SEQ ID NO: 2488664 - protein, 18 aa, Entamoeba dispar
IYLRMSYINIAIANQYYD

SEQ ID NO: 2488665 - protein, 27 aa, Entamoeba dispar
IYLRSTFWPQMSIDLYKRYQDTYFTQS

SEQ ID NO: 2488666 - protein, 18 aa, Entamoeba dispar
IYLYECQTFLTTQNITYP

SEQ ID NO: 2488667 - protein, 17 aa, Entamoeba dispar
IYMKWKGRELIRENPTL

SEQ ID NO: 2488668 - protein, 17 aa, Entamoeba dispar
IYMLVIRQIHDIYNEYY

SEQ ID NO: 2488669 - protein, 20 aa, Entamoeba dispar
IYNALCKFENFFTYKRYKFG

SEQ ID NO: 2488670 - protein, 17 aa, Entamoeba dispar
IYNIKALMIKKELMKNE

SEQ ID NO: 2488671 - protein, 25 aa, Entamoeba dispar
IYNKIIRLYMDYDVRDIFQDSIEKL

SEQ ID NO: 2488672 - protein, 21 aa, Entamoeba dispar
IYNKNFFGFQIRFRDLARGGL

SEQ ID NO: 2488673 - protein, 19 aa, Entamoeba dispar
IYNSIQYSINYYVQAFMNY

SEQ ID NO: 2488674 - protein, 22 aa, Entamoeba dispar
IYNVDCGYCLINTIVVVREEYI

SEQ ID NO: 2488675 - protein, 19 aa, Entamoeba dispar
IYPHPELNKVCFITENGSE

SEQ ID NO: 2488676 - protein, 18 aa, Entamoeba dispar
IYPIIPINIIFNKVLELI

SEQ ID NO: 2488677 - protein, 18 aa, Entamoeba dispar
IYPKIKYTLIKREQTFTL

SEQ ID NO: 2488678 - protein, 25 aa, Entamoeba dispar
IYPKKEIEWLMGISWNKGNKSRYKQ

SEQ ID NO: 2488679 - protein, 26 aa, Entamoeba dispar
IYPKKEIEWLMGISWNKGNKSRYKQD

SEQ ID NO: 2488680 - protein, 17 aa, Entamoeba dispar
IYPNFEFHGKNAKTTAN

SEQ ID NO: 2488681 - protein, 19 aa, Entamoeba dispar
IYPSASIGFVVFNLDSKVN

SEQ ID NO: 2488682 - protein, 17 aa, Entamoeba dispar
IYPWGTRMRYLYIALEW

SEQ ID NO: 2488683 - protein, 26 aa, Entamoeba dispar
IYQCKKCLKYYCNECDSFIHDVLYNC

SEQ ID NO: 2488684 - protein, 17 aa, Entamoeba dispar
IYQEIDSGLTLTANEII

SEQ ID NO: 2488685 - protein, 18 aa, Entamoeba dispar
IYQFNTWIGGMIGKIEIE

SEQ ID NO: 2488686 - protein, 21 aa, Entamoeba dispar
IYQIRIEKELERKEERRVELK

SEQ ID NO: 2488687 - protein, 18 aa, Entamoeba dispar
IYQQLFILETLVLLQYTK

SEQ ID NO: 2488688 - protein, 19 aa, Entamoeba dispar
IYQSGTLLRCCPVDYTHFT

SEQ ID NO: 2488689 - protein, 22 aa, Entamoeba dispar
IYQYSFPILVDFPSDYPKLLPI

SEQ ID NO: 2488690 - protein, 24 aa, Entamoeba dispar
IYRGDICGFIGHPTRTKTGELSLI

SEQ ID NO: 2488691 - protein, 19 aa, Entamoeba dispar
IYRGFGRYVTSIGMETITK

SEQ ID NO: 2488692 - protein, 19 aa, Entamoeba dispar
IYRIPKRVESLWDQCKDYP

SEQ ID NO: 2488693 - protein, 22 aa, Entamoeba dispar
IYRKRIEMRTMIVEVIIEGIEW

SEQ ID NO: 2488694 - protein, 21 aa, Entamoeba dispar
IYRLSELFVQFSENLIDLSTV

SEQ ID NO: 2488695 - protein, 22 aa, Entamoeba dispar
IYRNLICKILIRNVGKSELPNE

SEQ ID NO: 2488696 - protein, 21 aa, Entamoeba dispar
IYRNLLCRTVNNEGIYRLPFP

SEQ ID NO: 2488697 - protein, 23 aa, Entamoeba dispar
IYRRLREFFQDRTVIINYLETPQ

SEQ ID NO: 2488698 - protein, 18 aa, Entamoeba dispar
IYRVITIDGPSSPSFARN

SEQ ID NO: 2488699 - protein, 20 aa, Entamoeba dispar
IYRVRLCDFLQKIFIIDPTQ

SEQ ID NO: 2488700 - protein, 17 aa, Entamoeba dispar
IYSAGIVLFELLEGYPP

SEQ ID NO: 2488701 - protein, 17 aa, Entamoeba dispar
IYSCLKLHGRWINEGPL

SEQ ID NO: 2488702 - protein, 23 aa, Entamoeba dispar
IYSENCALVYFKSLSTLSSQEEN

SEQ ID NO: 2488703 - protein, 17 aa, Entamoeba dispar
IYSFSTCQGKIFQSTIE

SEQ ID NO: 2488704 - protein, 17 aa, Entamoeba dispar
IYSPVPIWFKGYLTDSG

SEQ ID NO: 2488705 - protein, 26 aa, Entamoeba dispar
IYSQELKELIPVIPKKKIKNEQLPEN

SEQ ID NO: 2488706 - protein, 26 aa, Entamoeba dispar
IYSQELKELIPVIPKKSMGYIEMKLM

SEQ ID NO: 2488707 - protein, 17 aa, Entamoeba dispar
IYTGCIITHKKENISED

SEQ ID NO: 2488708 - protein, 18 aa, Entamoeba dispar
IYTIPGYITPLIPTNKPI

SEQ ID NO: 2488709 - protein, 26 aa, Entamoeba dispar
IYTLFPRLSNEIIYKLLSNFHTDDMD

SEQ ID NO: 2488710 - protein, 23 aa, Entamoeba dispar
IYTRLSSISRYLCPKDDDQILEY

SEQ ID NO: 2488711 - protein, 18 aa, Entamoeba dispar
IYTSIPIPVQTKYIDITS

SEQ ID NO: 2488712 - protein, 23 aa, Entamoeba dispar
IYVCGRTGNMLLLLDPHFVQKAH

SEQ ID NO: 2488713 - protein, 24 aa, Entamoeba dispar
IYVKKEILEFIIGLLNCDNEHSAL

SEQ ID NO: 2488714 - protein, 18 aa, Entamoeba dispar
IYVLLRIEINIASNKACI

SEQ ID NO: 2488715 - protein, 20 aa, Entamoeba dispar
IYVPESQVSLSPYNPSVNNT

SEQ ID NO: 2488716 - protein, 18 aa, Entamoeba dispar
IYYHPLIQSCTWDTLAAQ

SEQ ID NO: 2488717 - protein, 25 aa, Entamoeba dispar
IYYIPSLGIAPSWCSFLENLTEELE

SEQ ID NO: 2488718 - protein, 17 aa, Entamoeba dispar
IYYNIIDGIEFYLRKNN

SEQ ID NO: 2488719 - protein, 20 aa, Entamoeba dispar
KAAGIKVCISGINGKGIGCG

SEQ ID NO: 2488720 - protein, 35 aa, Entamoeba dispar
KAAKEINGKEFLGYHLRADWEVNKGMKRNIRKTIF

SEQ ID NO: 2488721 - protein, 24 aa, Entamoeba dispar
KAALCIFAEMTFVPGEMLQAEDRL

SEQ ID NO: 2488722 - protein, 18 aa, Entamoeba dispar
KAASFGVVDQMNFTNSEK

SEQ ID NO: 2488723 - protein, 21 aa, Entamoeba dispar
KACIIVYDITKAVTFNSVDKW

SEQ ID NO: 2488724 - protein, 25 aa, Entamoeba dispar
KACNSEEKAKEIIEQKLEERPMEYD

SEQ ID NO: 2488725 - protein, 19 aa, Entamoeba dispar
KACPVVLEVVRDWLEVNPL

SEQ ID NO: 2488726 - protein, 19 aa, Entamoeba dispar
KADDGYCQIVLDYPDKEEE

SEQ ID NO: 2488727 - protein, 18 aa, Entamoeba dispar
KADGVKLVNIDAQNIVDG

SEQ ID NO: 2488728 - protein, 26 aa, Entamoeba dispar
KADIWALGCTIIELITGNPPYYDLNP

SEQ ID NO: 2488729 - protein, 18 aa, Entamoeba dispar
KADIWSIGIMIMEMTEGD

SEQ ID NO: 2488730 - protein, 20 aa, Entamoeba dispar
KADIYSCGIVLYNMICNNFP

SEQ ID NO: 2488731 - protein, 22 aa, Entamoeba dispar
KADLFTFALLITKLWTGKLPYS

SEQ ID NO: 2488732 - protein, 21 aa, Entamoeba dispar
KADMEKPLFSNAVEEVDASDD

SEQ ID NO: 2488733 - protein, 19 aa, Entamoeba dispar
KADVIQWCDPYILMKYTEE

SEQ ID NO: 2488734 - protein, 27 aa, Entamoeba dispar
KADVWAAGCLLYKLEFFVTPFDGSPMK

SEQ ID NO: 2488735 - protein, 20 aa, Entamoeba dispar
KADVWALGCVLYKICYFDTP

SEQ ID NO: 2488736 - protein, 25 aa, Entamoeba dispar
KAEAKPDMSTFVFVRVLTNVDNFKI

SEQ ID NO: 2488737 - protein, 27 aa, Entamoeba dispar
KAEAVRLARRIAMEWEAYIKHTNAIRK

SEQ ID NO: 2488738 - protein, 20 aa, Entamoeba dispar
KAECVIKKYKNGACDRVVCP

SEQ ID NO: 2488739 - protein, 20 aa, Entamoeba dispar
KAEEERKRLEAERKRKEEEE

SEQ ID NO: 2488740 - protein, 21 aa, Entamoeba dispar
KAEEWFRKVIFIDPSYGDAWI

SEQ ID NO: 2488741 - protein, 24 aa, Entamoeba dispar
KAEIGAKFVLFGGAVSGEIIDLKV

SEQ ID NO: 2488742 - protein, 18 aa, Entamoeba dispar
KAEIKYLKKILVEKDPSL

SEQ ID NO: 2488743 - protein, 18 aa, Entamoeba dispar
KAEKCVIGDTSFLFQMHR

SEQ ID NO: 2488744 - protein, 26 aa, Entamoeba dispar
KAEKKNARYGFFYGIFQTTIESAFFG

SEQ ID NO: 2488745 - protein, 18 aa, Entamoeba dispar
KAELKPKIFVIPLGTGND

SEQ ID NO: 2488746 - protein, 21 aa, Entamoeba dispar
KAENLMKLVSIMEEVHQKDKV

SEQ ID NO: 2488747 - protein, 19 aa, Entamoeba dispar
KAEVLTTIFRELLDNKENS

SEQ ID NO: 2488748 - protein, 17 aa, Entamoeba dispar
KAEVVDLAISMQHYSVG

SEQ ID NO: 2488749 - protein, 26 aa, Entamoeba dispar
KAEVYRVGAELKLPDIILGAVPSADL

SEQ ID NO: 2488750 - protein, 18 aa, Entamoeba dispar
KAEWKVPAMNNGETTYHI

SEQ ID NO: 2488751 - protein, 17 aa, Entamoeba dispar
KAFCIKKNGEGYFSTKI

SEQ ID NO: 2488752 - protein, 17 aa, Entamoeba dispar
KAFKEAMDSTTKKKKKT

SEQ ID NO: 2488753 - protein, 21 aa, Entamoeba dispar
KAFRYRIVLSTLLGQTIRITS

SEQ ID NO: 2488754 - protein, 24 aa, Entamoeba dispar
KAFTRLAGVMKADIQPYLNTIVPI

SEQ ID NO: 2488755 - protein, 19 aa, Entamoeba dispar
KAFVTQAIITCCIKTINVM

SEQ ID NO: 2488756 - protein, 19 aa, Entamoeba dispar
KAFYKMSLKYHPDKHPDDK

SEQ ID NO: 2488757 - protein, 17 aa, Entamoeba dispar
KAGDGVVDLSLISDLHK

SEQ ID NO: 2488758 - protein, 21 aa, Entamoeba dispar
KAGDILVIIGVGPSGTGMEET

SEQ ID NO: 2488759 - protein, 22 aa, Entamoeba dispar
KAGEQSFEFTIKVNENGMMEIS

SEQ ID NO: 2488760 - protein, 22 aa, Entamoeba dispar
KAGEQSFEFTINVNKNGMMELS

SEQ ID NO: 2488761 - protein, 20 aa, Entamoeba dispar
KAGGVQTIIMKCFDCFDNIT

SEQ ID NO: 2488762 - protein, 18 aa, Entamoeba dispar
KAGLKMLMEAEENAKQVV

SEQ ID NO: 2488763 - protein, 23 aa, Entamoeba dispar
KAGPLLRAGIDIENVMDYYMVDN

SEQ ID NO: 2488764 - protein, 24 aa, Entamoeba dispar
KAGSLKLGGFVVIEKFPCKITEFN

SEQ ID NO: 2488765 - protein, 20 aa, Entamoeba dispar
KAGTFANELIVSYVFEMVIK

SEQ ID NO: 2488766 - protein, 24 aa, Entamoeba dispar
KAGVDHYFCFGISSLIKLLQSVHN

SEQ ID NO: 2488767 - protein, 18 aa, Entamoeba dispar
KAGVGFGSTMGGFGNNNT

SEQ ID NO: 2488768 - protein, 26 aa, Entamoeba dispar
KAGYCKCNYYPPPLYRIPPPNIPPNG

SEQ ID NO: 2488769 - protein, 25 aa, Entamoeba dispar
KAHKEASVILLRYFNPIGAHKSGLL

SEQ ID NO: 2488770 - protein, 17 aa, Entamoeba dispar
KAICQYIEKEFERKYKR

SEQ ID NO: 2488771 - protein, 18 aa, Entamoeba dispar
KAIDFGVVEDYYWEKTEK

SEQ ID NO: 2488772 - protein, 17 aa, Entamoeba dispar
KAIECFCRGKIVVDVGC

SEQ ID NO: 2488773 - protein, 28 aa, Entamoeba dispar
KAIERLFYLRILMERCKPIEKKLKYQID

SEQ ID NO: 2488774 - protein, 21 aa, Entamoeba dispar
KAIGNCLSCGRIHCSEEGPGK

SEQ ID NO: 2488775 - protein, 22 aa, Entamoeba dispar
KAIKIEIQRRLSIRDDAVLKAV

SEQ ID NO: 2488776 - protein, 17 aa, Entamoeba dispar
KAILKKAGALIIATNNS

SEQ ID NO: 2488777 - protein, 20 aa, Entamoeba dispar
KAINLECLSKITLWLEKDRV

SEQ ID NO: 2488778 - protein, 25 aa, Entamoeba dispar
KAKDLLPRMQVEWRNVVQFVTSESG

SEQ ID NO: 2488779 - protein, 19 aa, Entamoeba dispar
KAKDVMKEFQVPGNENTSK

SEQ ID NO: 2488780 - protein, 18 aa, Entamoeba dispar
KAKEFAVQRNELKKEFKK

SEQ ID NO: 2488781 - protein, 17 aa, Entamoeba dispar
KAKEFSLTKEKTPKQQQ

SEQ ID NO: 2488782 - protein, 25 aa, Entamoeba dispar
KAKHHVAYRLLKKCDSVQEMQPILI

SEQ ID NO: 2488783 - protein, 19 aa, Entamoeba dispar
KAKHKRELKQLNEEKESGN

SEQ ID NO: 2488784 - protein, 25 aa, Entamoeba dispar
KAKIIYPRIDPFSCFTYYNPTLHLK

SEQ ID NO: 2488785 - protein, 21 aa, Entamoeba dispar
KAKSIFYYHYFVPELNLNDVK

SEQ ID NO: 2488786 - protein, 17 aa, Entamoeba dispar
KAKTIVYGCIYGIGPFS

SEQ ID NO: 2488787 - protein, 20 aa, Entamoeba dispar
KAKYSDSCFPPFDKELNIKA

SEQ ID NO: 2488788 - protein, 29 aa, Entamoeba dispar
KALANELHCSWCLVSAKTGEGVSNAFESI

SEQ ID NO: 2488789 - protein, 22 aa, Entamoeba dispar
KALCLILKSPIALKRIDLSNIG

SEQ ID NO: 2488790 - protein, 18 aa, Entamoeba dispar
KALERHRPSLLFSTPRVF

SEQ ID NO: 2488791 - protein, 32 aa, Entamoeba dispar
KALFFHPEHHHWLKINFSKAFDNIIKEYDLDK

SEQ ID NO: 2488792 - protein, 17 aa, Entamoeba dispar
KALKARDAHLIKISTWN

SEQ ID NO: 2488793 - protein, 27 aa, Entamoeba dispar
KALKESFAYKKFLGIVISLGNYLNGGN

SEQ ID NO: 2488794 - protein, 17 aa, Entamoeba dispar
KALKSGKKFDKKQKITK

SEQ ID NO: 2488795 - protein, 20 aa, Entamoeba dispar
KALLRRYGRYLATTNPKALN

SEQ ID NO: 2488796 - protein, 20 aa, Entamoeba dispar
KALNAYIFIGPVYYQKLKHM

SEQ ID NO: 2488797 - protein, 23 aa, Entamoeba dispar
KALNIFLTQAIDWEDPHEAAEAI

SEQ ID NO: 2488798 - protein, 23 aa, Entamoeba dispar
KALPGLMSCLLVGGMDVMKQSIQ

SEQ ID NO: 2488799 - protein, 18 aa, Entamoeba dispar
KALQEIPDQYAFIKEHGY

SEQ ID NO: 2488800 - protein, 22 aa, Entamoeba dispar
KALRTALPVIFNVGNINCDGYL

SEQ ID NO: 2488801 - protein, 25 aa, Entamoeba dispar
KAMEKGYCCKITRFPQTGDSLYIRP

SEQ ID NO: 2488802 - protein, 21 aa, Entamoeba dispar
KAMENGTCPVCGNKHIDNESI

SEQ ID NO: 2488803 - protein, 18 aa, Entamoeba dispar
KAMHSIILPIYCSSNSVK

SEQ ID NO: 2488804 - protein, 25 aa, Entamoeba dispar
KAMKELYPLFLWILSGLFPQITNVS

SEQ ID NO: 2488805 - protein, 20 aa, Entamoeba dispar
KAMTCFAEIITIYPENDYLP

SEQ ID NO: 2488806 - protein, 21 aa, Entamoeba dispar
KAMVQWCGLLLNRIVLEQLEN

SEQ ID NO: 2488807 - protein, 20 aa, Entamoeba dispar
KANANVHSAYVLSVELDTTL

SEQ ID NO: 2488808 - protein, 18 aa, Entamoeba dispar
KANGGSRKEECYTLKAPI

SEQ ID NO: 2488809 - protein, 26 aa, Entamoeba dispar
KANINWLLEMIVYIALSPNINKETHD

SEQ ID NO: 2488810 - protein, 22 aa, Entamoeba dispar
KANNDCVLFSALILNSKIVVLG

SEQ ID NO: 2488811 - protein, 21 aa, Entamoeba dispar
KANTEVIAFMASTFGIKKSNV

SEQ ID NO: 2488812 - protein, 17 aa, Entamoeba dispar
KAPHHYLSRGVFLAEKS

SEQ ID NO: 2488813 - protein, 17 aa, Entamoeba dispar
KAPPIKIIDTPGFGDTR

SEQ ID NO: 2488814 - protein, 19 aa, Entamoeba dispar
KAPQAVAAMNACTLTIHWQ

SEQ ID NO: 2488815 - protein, 30 aa, Entamoeba dispar
KAPQLPKAYGFHVCVTKWLTLVQLLMGEIP

SEQ ID NO: 2488816 - protein, 18 aa, Entamoeba dispar
KAPVFEFPDPGDFDTCAV

SEQ ID NO: 2488817 - protein, 18 aa, Entamoeba dispar
KAPYEVCVGEGVDNQKSG

SEQ ID NO: 2488818 - protein, 25 aa, Entamoeba dispar
KAQEVDEALNISGAIGTARQQINNG

SEQ ID NO: 2488819 - protein, 24 aa, Entamoeba dispar
KAQEYRKPFGSKRGRKGGFNRRGA

SEQ ID NO: 2488820 - protein, 18 aa, Entamoeba dispar
KAQICIPHNFYFYNDDFS

SEQ ID NO: 2488821 - protein, 28 aa, Entamoeba dispar
KAQITKLPWKAAISYFKAAFISEVKENK

SEQ ID NO: 2488822 - protein, 25 aa, Entamoeba dispar
KAQKKIALDKFLFLYAKELQSEPIT

SEQ ID NO: 2488823 - protein, 20 aa, Entamoeba dispar
KAQKTVRMKKIIMVKKDNKP

SEQ ID NO: 2488824 - protein, 24 aa, Entamoeba dispar
KAQTCNTCKGNGFRVVRVQQGFCI

SEQ ID NO: 2488825 - protein, 22 aa, Entamoeba dispar
KARCPQLRYEYNLYKILMETGE

SEQ ID NO: 2488826 - protein, 18 aa, Entamoeba dispar
KAREEQRIKEEIAEQNLI

SEQ ID NO: 2488827 - protein, 20 aa, Entamoeba dispar
KARLEGAEVIKMMKASQSGG

SEQ ID NO: 2488828 - protein, 18 aa, Entamoeba dispar
KASIKIYLEYFGFNVIFK

SEQ ID NO: 2488829 - protein, 21 aa, Entamoeba dispar
KASKEFSDPAPVFNMPRDPRR

SEQ ID NO: 2488830 - protein, 19 aa, Entamoeba dispar
KASLGEFSFEEKIRRDIKK

SEQ ID NO: 2488831 - protein, 21 aa, Entamoeba dispar
KASNKKAQWNTFTIDIKNGIH

SEQ ID NO: 2488832 - protein, 18 aa, Entamoeba dispar
KATLKGIIDYIIDYKEKD

SEQ ID NO: 2488833 - protein, 26 aa, Entamoeba dispar
KATMHHICLLRGKLVKYRKMLAPIKF

SEQ ID NO: 2488834 - protein, 18 aa, Entamoeba dispar
KATMKRFAQFFGTISSPS

SEQ ID NO: 2488835 - protein, 20 aa, Entamoeba dispar
KATPYWGYKSEGGKKVFGKY

SEQ ID NO: 2488836 - protein, 22 aa, Entamoeba dispar
KATYNILFEYIRNIALSTKNCN

SEQ ID NO: 2488837 - protein, 21 aa, Entamoeba dispar
KAVDDACGWPAEPNNHLLKTL

SEQ ID NO: 2488838 - protein, 19 aa, Entamoeba dispar
KAVECVLIMDGFKMGIYKQ

SEQ ID NO: 2488839 - protein, 17 aa, Entamoeba dispar
KAVPGVPNLSVMEVDVK

SEQ ID NO: 2488840 - protein, 20 aa, Entamoeba dispar
KAVQHLRIYITGNFKVSEWR

SEQ ID NO: 2488841 - protein, 19 aa, Entamoeba dispar
KAVQLRWAITDCTLENGSG

SEQ ID NO: 2488842 - protein, 18 aa, Entamoeba dispar
KAVRGMLPKNNYRGKLAL

SEQ ID NO: 2488843 - protein, 18 aa, Entamoeba dispar
KAVVEKLKKESIKKLENS

SEQ ID NO: 2488844 - protein, 18 aa, Entamoeba dispar
KAYCIPRLTENASNKLSD

SEQ ID NO: 2488845 - protein, 27 aa, Entamoeba dispar
KAYEKRGIKELFEWQEECLKEKGVREG

SEQ ID NO: 2488846 - protein, 22 aa, Entamoeba dispar
KAYRNMFPFFILASQINGLPLF

SEQ ID NO: 2488847 - protein, 24 aa, Entamoeba dispar
KAYSDIVYLISFFDEKRQIQQGLA

SEQ ID NO: 2488848 - protein, 23 aa, Entamoeba dispar
KAYTRYIIRHNFLTYSFNPEVHI

SEQ ID NO: 2488849 - protein, 19 aa, Entamoeba dispar
KCALCCGFYKKEETYNCSF

SEQ ID NO: 2488850 - protein, 19 aa, Entamoeba dispar
KCANYSLPSSERVSKIEPS

SEQ ID NO: 2488851 - protein, 18 aa, Entamoeba dispar
KCCGIDCKRIIHVIKTGK

SEQ ID NO: 2488852 - protein, 23 aa, Entamoeba dispar
KCDFAYQFAMDMLKRMNKNNNQI

SEQ ID NO: 2488853 - protein, 18 aa, Entamoeba dispar
KCEFLNSRIESIYKCYSI

SEQ ID NO: 2488854 - protein, 26 aa, Entamoeba dispar
KCEVKADISGAVIFNGLLEISVRQWE

SEQ ID NO: 2488855 - protein, 19 aa, Entamoeba dispar
KCFEIFLNYEHPFELKHTQ

SEQ ID NO: 2488856 - protein, 20 aa, Entamoeba dispar
KCFSTLFALKVNPLLRNDND

SEQ ID NO: 2488857 - protein, 19 aa, Entamoeba dispar
KCFSVAFQITNAFMNTKVL

SEQ ID NO: 2488858 - protein, 17 aa, Entamoeba dispar
KCFYGCSTLTTINIPTS

SEQ ID NO: 2488859 - protein, 19 aa, Entamoeba dispar
KCGDQWIARENKILMLCQH

SEQ ID NO: 2488860 - protein, 30 aa, Entamoeba dispar
KCGKESGILPRSICVDGKASLGEFSFEEKI

SEQ ID NO: 2488861 - protein, 23 aa, Entamoeba dispar
KCGKVLRVTIPIWRNTNKRRGFA

SEQ ID NO: 2488862 - protein, 18 aa, Entamoeba dispar
KCGYNCIHLTPIQKIGPS

SEQ ID NO: 2488863 - protein, 19 aa, Entamoeba dispar
KCHDAIPILQRLFEKEEDI

SEQ ID NO: 2488864 - protein, 22 aa, Entamoeba dispar
KCHICGQKLFSFAKFYNDNGEI

SEQ ID NO: 2488865 - protein, 24 aa, Entamoeba dispar
KCHKGSRVDLFIKMNQEGMLNITI

SEQ ID NO: 2488866 - protein, 19 aa, Entamoeba dispar
KCHPDRCHHPLSNTAISCL

SEQ ID NO: 2488867 - protein, 24 aa, Entamoeba dispar
KCHSLSAVISIDFMNKMTINYGNT

SEQ ID NO: 2488868 - protein, 21 aa, Entamoeba dispar
KCIDEIFLRGNVPIPKQIRFI

SEQ ID NO: 2488869 - protein, 21 aa, Entamoeba dispar
KCIKSPLFHSLVGYEKKILNV

SEQ ID NO: 2488870 - protein, 27 aa, Entamoeba dispar
KCIKVFEFDDPITLVNGWRMVDNNNQL

SEQ ID NO: 2488871 - protein, 25 aa, Entamoeba dispar
KCIVNWKYDSCFGKSILSTLNNMLP

SEQ ID NO: 2488872 - protein, 19 aa, Entamoeba dispar
KCIYQCAILQRILDKFPNF

SEQ ID NO: 2488873 - protein, 26 aa, Entamoeba dispar
KCKDICEHWGIIWLNFEKLIRSHNEN

SEQ ID NO: 2488874 - protein, 19 aa, Entamoeba dispar
KCKECGLHLTLKNFFFDQG

SEQ ID NO: 2488875 - protein, 21 aa, Entamoeba dispar
KCKLGTFLFETEVSGWVHSIA

SEQ ID NO: 2488876 - protein, 19 aa, Entamoeba dispar
KCKNSIDIFKILSEEIEKE

SEQ ID NO: 2488877 - protein, 18 aa, Entamoeba dispar
KCKQDYVLDIGYVQGLEV

SEQ ID NO: 2488878 - protein, 23 aa, Entamoeba dispar
KCKQHGLTAFTYLRITRGLLDDG

SEQ ID NO: 2488879 - protein, 23 aa, Entamoeba dispar
KCKQHGLTAFTYLRMTRGLLDDG

SEQ ID NO: 2488880 - protein, 18 aa, Entamoeba dispar
KCKVIRWDNLISTNKDIS

SEQ ID NO: 2488881 - protein, 25 aa, Entamoeba dispar
KCLECGEGICTKCYNNLLFKNNKCQ

SEQ ID NO: 2488882 - protein, 19 aa, Entamoeba dispar
KCLHSVLTLGYIVSNKTSA

SEQ ID NO: 2488883 - protein, 22 aa, Entamoeba dispar
KCLKAIHCLLRNPNIVNVEGES

SEQ ID NO: 2488884 - protein, 17 aa, Entamoeba dispar
KCLQFITSKNCEDSYFT

SEQ ID NO: 2488885 - protein, 19 aa, Entamoeba dispar
KCLSEALSGIEEYRILVSM

SEQ ID NO: 2488886 - protein, 23 aa, Entamoeba dispar
KCNEDMILWGLFSLANAIHFLNI

SEQ ID NO: 2488887 - protein, 19 aa, Entamoeba dispar
KCNNAVFGNDSFRPSQEAI

SEQ ID NO: 2488888 - protein, 22 aa, Entamoeba dispar
KCNPPLYPYERIRLEEYKSIIK

SEQ ID NO: 2488889 - protein, 18 aa, Entamoeba dispar
KCNSLWLSMNSFVLSIFN

SEQ ID NO: 2488890 - protein, 19 aa, Entamoeba dispar
KCNYGQFNERIHLLEILIK

SEQ ID NO: 2488891 - protein, 21 aa, Entamoeba dispar
KCPELLQKIKAFRKDTGSLMS

SEQ ID NO: 2488892 - protein, 19 aa, Entamoeba dispar
KCPLISFEGIENIYMNTLE

SEQ ID NO: 2488893 - protein, 18 aa, Entamoeba dispar
KCPMRLENKLLALVVSKN

SEQ ID NO: 2488894 - protein, 21 aa, Entamoeba dispar
KCPSDLCGMTSLRSLDLSYNG

SEQ ID NO: 2488895 - protein, 20 aa, Entamoeba dispar
KCQIEWNIKGEIIPKEINNF

SEQ ID NO: 2488896 - protein, 21 aa, Entamoeba dispar
KCQIEWNIKGEIIPKEINNFY

SEQ ID NO: 2488897 - protein, 17 aa, Entamoeba dispar
KCQPTFFIAVPRVLQKI

SEQ ID NO: 2488898 - protein, 21 aa, Entamoeba dispar
KCRCPECKKLYTSTDLVSKGK

SEQ ID NO: 2488899 - protein, 24 aa, Entamoeba dispar
KCRIFCTTLQKFSFVETQLPSDLN

SEQ ID NO: 2488900 - protein, 17 aa, Entamoeba dispar
KCRRIQRISTNTKPKSS

SEQ ID NO: 2488901 - protein, 19 aa, Entamoeba dispar
KCRSIKKDIKFIGYRNDLY

SEQ ID NO: 2488902 - protein, 19 aa, Entamoeba dispar
KCSCATVGCNIKFTDEVKR

SEQ ID NO: 2488903 - protein, 17 aa, Entamoeba dispar
KCSCSEAPTARYFKITM

SEQ ID NO: 2488904 - protein, 31 aa, Entamoeba dispar
KCSECICPHSVKCLKLYNCRNWKFQELNHLQ

SEQ ID NO: 2488905 - protein, 19 aa, Entamoeba dispar
KCSEVLFEPNIIGKETSGI

SEQ ID NO: 2488906 - protein, 22 aa, Entamoeba dispar
KCSEYPDGIEIPAAMSTNQLIL

SEQ ID NO: 2488907 - protein, 29 aa, Entamoeba dispar
KCSICGNELLYEFEILPSIISLIKDIPEF

SEQ ID NO: 2488908 - protein, 19 aa, Entamoeba dispar
KCSIRFSGCGSHINKMKLS

SEQ ID NO: 2488909 - protein, 22 aa, Entamoeba dispar
KCSNCGKPIIGSSLSALGKKYH

SEQ ID NO: 2488910 - protein, 21 aa, Entamoeba dispar
KCSNCLCPKGAANVKRQCNHP

SEQ ID NO: 2488911 - protein, 25 aa, Entamoeba dispar
KCSRKEWELLKMLANKVIMKMVDRP

SEQ ID NO: 2488912 - protein, 23 aa, Entamoeba dispar
KCSVCNMNVHKKCIKKIKTPCRP

SEQ ID NO: 2488913 - protein, 29 aa, Entamoeba dispar
KCTIKHVPKFCGVSSLTIRSFISSVTSLD

SEQ ID NO: 2488914 - protein, 19 aa, Entamoeba dispar
KCVHCCTSAQRDNFIDEIC

SEQ ID NO: 2488915 - protein, 17 aa, Entamoeba dispar
KCVKLQIWDTAGQERFA

SEQ ID NO: 2488916 - protein, 21 aa, Entamoeba dispar
KCVLNTMLIPGLRELFIKYKQ

SEQ ID NO: 2488917 - protein, 18 aa, Entamoeba dispar
KCVSHFMTPIPFFNIMCS

SEQ ID NO: 2488918 - protein, 18 aa, Entamoeba dispar
KCVWQCIINSRLNEGNEI

SEQ ID NO: 2488919 - protein, 26 aa, Entamoeba dispar
KCYFFKRLPWVLPIQLKRFTWDEKKI

SEQ ID NO: 2488920 - protein, 17 aa, Entamoeba dispar
KCYRCLCCDSVFHIDCK

SEQ ID NO: 2488921 - protein, 17 aa, Entamoeba dispar
KCYSSLIASISYEQTRK

SEQ ID NO: 2488922 - protein, 20 aa, Entamoeba dispar
KCYSYPCLKVDASNGSTQLS

SEQ ID NO: 2488923 - protein, 40 aa, Entamoeba dispar
KDAEMCIKIKPDFIKGYNRKAFSHFCMKEYNKALTEYERA

SEQ ID NO: 2488924 - protein, 21 aa, Entamoeba dispar
KDAIFIWLNLLYEMNLNIPLE

SEQ ID NO: 2488925 - protein, 19 aa, Entamoeba dispar
KDALFILSCHLDRSSNREI

SEQ ID NO: 2488926 - protein, 19 aa, Entamoeba dispar
KDAMEKISPSVLSYLMGSY

SEQ ID NO: 2488927 - protein, 22 aa, Entamoeba dispar
KDAQSIMEVFGWGETFLNINKK

SEQ ID NO: 2488928 - protein, 21 aa, Entamoeba dispar
KDCFNFEENAFGYVSLNNQSD

SEQ ID NO: 2488929 - protein, 21 aa, Entamoeba dispar
KDCKNYNPYIRHCMYGLDADL

SEQ ID NO: 2488930 - protein, 21 aa, Entamoeba dispar
KDCTDELYLLGEKKDNWDEAE

SEQ ID NO: 2488931 - protein, 27 aa, Entamoeba dispar
KDDALDVIEIFKIASLTGLGGISNSPV

SEQ ID NO: 2488932 - protein, 24 aa, Entamoeba dispar
KDDILKLKTIQSIHKDQKTNNLKP

SEQ ID NO: 2488933 - protein, 20 aa, Entamoeba dispar
KDDKIRIGLKSEKEKKILQK

SEQ ID NO: 2488934 - protein, 21 aa, Entamoeba dispar
KDDLNSFVSVVDWSMLSSTTT

SEQ ID NO: 2488935 - protein, 20 aa, Entamoeba dispar
KDDSKVYVLKMMFGMTDKDI

SEQ ID NO: 2488936 - protein, 21 aa, Entamoeba dispar
KDDVVCKLSDYWNIQQITGVS

SEQ ID NO: 2488937 - protein, 19 aa, Entamoeba dispar
KDDVWAFKSKREFEEDNNI

SEQ ID NO: 2488938 - protein, 18 aa, Entamoeba dispar
KDEAGAFYNPVQELNRDL

SEQ ID NO: 2488939 - protein, 20 aa, Entamoeba dispar
KDECSFEQGGYFIIKGSEKV

SEQ ID NO: 2488940 - protein, 17 aa, Entamoeba dispar
KDEEISLLFSQTIQTKS

SEQ ID NO: 2488941 - protein, 19 aa, Entamoeba dispar
KDEEYCLAGVIVHSGNCTG

SEQ ID NO: 2488942 - protein, 19 aa, Entamoeba dispar
KDEHGIWRRRSLSSERNSP

SEQ ID NO: 2488943 - protein, 17 aa, Entamoeba dispar
KDEICLNENIDIQDMIA

SEQ ID NO: 2488944 - protein, 26 aa, Entamoeba dispar
KDEIKKEDKGSCLILIELENKEKIKE

SEQ ID NO: 2488945 - protein, 18 aa, Entamoeba dispar
KDEIKMCVEDPLDSSKIE

SEQ ID NO: 2488946 - protein, 17 aa, Entamoeba dispar
KDEIKRLKEIVEQYKLT

SEQ ID NO: 2488947 - protein, 17 aa, Entamoeba dispar
KDEILQYFDQCLIEIEV

SEQ ID NO: 2488948 - protein, 20 aa, Entamoeba dispar
KDEIWGLVSKYIDEIVTYSI

SEQ ID NO: 2488949 - protein, 27 aa, Entamoeba dispar
KDEIYNCVFKWIHFFVMKDVKIVRRKE

SEQ ID NO: 2488950 - protein, 22 aa, Entamoeba dispar
KDELKQGCSFKTALKRTEGHKI

SEQ ID NO: 2488951 - protein, 18 aa, Entamoeba dispar
KDELLFWVEGQKKIDNFM

SEQ ID NO: 2488952 - protein, 17 aa, Entamoeba dispar
KDELLQETIDLWKKLRE

SEQ ID NO: 2488953 - protein, 25 aa, Entamoeba dispar
KDELLRSIYSYGFEKPSAIQQRAIV

SEQ ID NO: 2488954 - protein, 24 aa, Entamoeba dispar
KDEQPITMAHCFRRNKKNPEVEMK

SEQ ID NO: 2488955 - protein, 20 aa, Entamoeba dispar
KDEQRLSVMEKWHSKTTMMN

SEQ ID NO: 2488956 - protein, 17 aa, Entamoeba dispar
KDEVECIKMMEEEHKTN

SEQ ID NO: 2488957 - protein, 34 aa, Entamoeba dispar
KDEVEIGRCYRYNCLPIQFCMMLYSLLSVKYSVI

SEQ ID NO: 2488958 - protein, 25 aa, Entamoeba dispar
KDEVFPRILANYSHMLLKKGSKIEP

SEQ ID NO: 2488959 - protein, 19 aa, Entamoeba dispar
KDEVGMVLCLSRETNFIFT

SEQ ID NO: 2488960 - protein, 34 aa, Entamoeba dispar
KDEYDERIGKCIISPEVIPPNIIVNFDNSYVYVE

SEQ ID NO: 2488961 - protein, 23 aa, Entamoeba dispar
KDFDNCKGLLLGTPTIVGDALPS

SEQ ID NO: 2488962 - protein, 23 aa, Entamoeba dispar
KDFFDDLIENILLTVGDKEVVRS

SEQ ID NO: 2488963 - protein, 25 aa, Entamoeba dispar
KDFFEKCKIKGYNLLIQKIVNDAPS

SEQ ID NO: 2488964 - protein, 17 aa, Entamoeba dispar
KDFGVPTADPISFQKNQ

SEQ ID NO: 2488965 - protein, 18 aa, Entamoeba dispar
KDFHSMAVFATVFNSADH

SEQ ID NO: 2488966 - protein, 17 aa, Entamoeba dispar
KDFIKLTKWNDINYAKL

SEQ ID NO: 2488967 - protein, 22 aa, Entamoeba dispar
KDFKYGKDFMYEHEVHIYVNRI

SEQ ID NO: 2488968 - protein, 25 aa, Entamoeba dispar
KDFLPRGSGIVTRRPLIVQCVRSNV

SEQ ID NO: 2488969 - protein, 23 aa, Entamoeba dispar
KDFLQRRYLFLCSLKELKLTDYT

SEQ ID NO: 2488970 - protein, 17 aa, Entamoeba dispar
KDFPNEVMGCLELAANS

SEQ ID NO: 2488971 - protein, 31 aa, Entamoeba dispar
KDGFTQMFWEFGMKSFDEFIKKLIKLPRKSL

SEQ ID NO: 2488972 - protein, 27 aa, Entamoeba dispar
KDGFTQMFWELGMKSFDEFIEKLKKLP

SEQ ID NO: 2488973 - protein, 27 aa, Entamoeba dispar
KDGFTQMFWQLGMKSFDEFIEKLIKLP

SEQ ID NO: 2488974 - protein, 19 aa, Entamoeba dispar
KDGISRDWYVSSNTWITEP

SEQ ID NO: 2488975 - protein, 26 aa, Entamoeba dispar
KDGIWAALCWVSILAAESERAQRLVG

SEQ ID NO: 2488976 - protein, 25 aa, Entamoeba dispar
KDGKIITSLGCCTLVADTDDDNSNV

SEQ ID NO: 2488977 - protein, 17 aa, Entamoeba dispar
KDGKKYFFGNAHVVGIV

SEQ ID NO: 2488978 - protein, 29 aa, Entamoeba dispar
KDGQIKGHQWFTGIDWDLLLQKKVPVPWK

SEQ ID NO: 2488979 - protein, 25 aa, Entamoeba dispar
KDGRIFKHIIWCIVEYSTYLQEKEK

SEQ ID NO: 2488980 - protein, 29 aa, Entamoeba dispar
KDGRIFKKVIWYKVDYSIYLKDERKGNVF

SEQ ID NO: 2488981 - protein, 26 aa, Entamoeba dispar
KDGRIFKQVIWYKVYYSTYLKEKKQG

SEQ ID NO: 2488982 - protein, 19 aa, Entamoeba dispar
KDGRIFKQVIWYTVNYSTY

SEQ ID NO: 2488983 - protein, 24 aa, Entamoeba dispar
KDGRIFKYIIWYTISYSTYLKEKE

SEQ ID NO: 2488984 - protein, 21 aa, Entamoeba dispar
KDGRIFKYVIWYDISYSKYLF

SEQ ID NO: 2488985 - protein, 21 aa, Entamoeba dispar
KDGRIIKYVTWYTIEYSTYLQ

SEQ ID NO: 2488986 - protein, 21 aa, Entamoeba dispar
KDGRKVFMTEMLKHINQMLCN

SEQ ID NO: 2488987 - protein, 19 aa, Entamoeba dispar
KDGTKWFLCNDEQVIEVKR

SEQ ID NO: 2488988 - protein, 29 aa, Entamoeba dispar
KDGTPSLLFKYNVNFIFGNNPYLRNNPYL

SEQ ID NO: 2488989 - protein, 25 aa, Entamoeba dispar
KDGWERSCDVCLLKEMERCGLCYFE

SEQ ID NO: 2488990 - protein, 21 aa, Entamoeba dispar
KDGWICFKNSQLLCGQIEKSI

SEQ ID NO: 2488991 - protein, 18 aa, Entamoeba dispar
KDGWRLISRNDCYDLYYD

SEQ ID NO: 2488992 - protein, 24 aa, Entamoeba dispar
KDGYEVFKTFLTFSCNITIQDYIL

SEQ ID NO: 2488993 - protein, 18 aa, Entamoeba dispar
KDHDFEIIARANNIFKLS

SEQ ID NO: 2488994 - protein, 17 aa, Entamoeba dispar
KDHFYHRLMFLHIQNKC

SEQ ID NO: 2488995 - protein, 18 aa, Entamoeba dispar
KDHIEGVEIIHDIAHLNT

SEQ ID NO: 2488996 - protein, 24 aa, Entamoeba dispar
KDHSVEQFLNLFYEFTKTLLNTTE

SEQ ID NO: 2488997 - protein, 18 aa, Entamoeba dispar
KDICCGGYHTLALNIWGE

SEQ ID NO: 2488998 - protein, 17 aa, Entamoeba dispar
KDICWVGCPSEYRREVW

SEQ ID NO: 2488999 - protein, 19 aa, Entamoeba dispar
KDIDFRSFVPVFKSVTKLK

SEQ ID NO: 2489000 - protein, 24 aa, Entamoeba dispar
KDIEVFKYNQLISAKQGFDPDLKK

SEQ ID NO: 2489001 - protein, 17 aa, Entamoeba dispar
KDIFRKDHRGLCVMTGY

SEQ ID NO: 2489002 - protein, 20 aa, Entamoeba dispar
KDIGGSFAIKNIKYNDKYDS

SEQ ID NO: 2489003 - protein, 23 aa, Entamoeba dispar
KDIIPHLLTLISLQNIISTEEYY

SEQ ID NO: 2489004 - protein, 19 aa, Entamoeba dispar
KDIITCFIYSYTNKKINQL

SEQ ID NO: 2489005 - protein, 33 aa, Entamoeba dispar
KDIIYKLTELFITFNFSNTFLYFMSRALIELHA

SEQ ID NO: 2489006 - protein, 17 aa, Entamoeba dispar
KDIKIPLGLTSIGVSCF

SEQ ID NO: 2489007 - protein, 22 aa, Entamoeba dispar
KDIKRITNILINLFLDKPSNAA

SEQ ID NO: 2489008 - protein, 20 aa, Entamoeba dispar
KDIKSVFTAVFRLLDIKDQG

SEQ ID NO: 2489009 - protein, 25 aa, Entamoeba dispar
KDILSEYPWFCIVLDEGHKIKNPNA

SEQ ID NO: 2489010 - protein, 25 aa, Entamoeba dispar
KDIMLRYHVITVFVLIAQKKLVPHL

SEQ ID NO: 2489011 - protein, 17 aa, Entamoeba dispar
KDIMSFKGLKGNTEIET

SEQ ID NO: 2489012 - protein, 18 aa, Entamoeba dispar
KDINEFIILSSISELGYC

SEQ ID NO: 2489013 - protein, 18 aa, Entamoeba dispar
KDINEFIIPSSISKLGNH

SEQ ID NO: 2489014 - protein, 18 aa, Entamoeba dispar
KDINEFIIPSSITKLEHR

SEQ ID NO: 2489015 - protein, 18 aa, Entamoeba dispar
KDINEFIIPSSITKLGDD

SEQ ID NO: 2489016 - protein, 18 aa, Entamoeba dispar
KDINEFIIPSSITKLGDH

SEQ ID NO: 2489017 - protein, 18 aa, Entamoeba dispar
KDINEFIIPSSITKLGEY

SEQ ID NO: 2489018 - protein, 17 aa, Entamoeba dispar
KDINEFIIPSSITKLGK

SEQ ID NO: 2489019 - protein, 18 aa, Entamoeba dispar
KDINEFIIPSSITKLGNY

SEQ ID NO: 2489020 - protein, 19 aa, Entamoeba dispar
KDINIVSGIANEVVTGFQV

SEQ ID NO: 2489021 - protein, 20 aa, Entamoeba dispar
KDIPISSSIIKRTILSDVFW

SEQ ID NO: 2489022 - protein, 23 aa, Entamoeba dispar
KDIPLELEQSFFIAFDAYVARAS

SEQ ID NO: 2489023 - protein, 22 aa, Entamoeba dispar
KDIPRTEIDGIYFKRESQDYYK

SEQ ID NO: 2489024 - protein, 26 aa, Entamoeba dispar
KDIQNELYESFSLCFSNELSQKQMKY

SEQ ID NO: 2489025 - protein, 18 aa, Entamoeba dispar
KDISSVPFLLFIPFSIPS

SEQ ID NO: 2489026 - protein, 19 aa, Entamoeba dispar
KDIVCTGKVFIDCDYEEFM

SEQ ID NO: 2489027 - protein, 18 aa, Entamoeba dispar
KDIVIKMNKLWVQYIDKI

SEQ ID NO: 2489028 - protein, 20 aa, Entamoeba dispar
KDIVLPSCITRIGHSSFENC

SEQ ID NO: 2489029 - protein, 23 aa, Entamoeba dispar
KDIWKKKLYITTEHPLPSELIRQ

SEQ ID NO: 2489030 - protein, 26 aa, Entamoeba dispar
KDIWQEIKILLNITMKYFPQILSTCD

SEQ ID NO: 2489031 - protein, 22 aa, Entamoeba dispar
KDIYEHWGLIWYTYHRTLKIKM

SEQ ID NO: 2489032 - protein, 18 aa, Entamoeba dispar
KDIYEILSKINYQPSTIY

SEQ ID NO: 2489033 - protein, 22 aa, Entamoeba dispar
KDIYIKSTFGISNFDLILNHPV

SEQ ID NO: 2489034 - protein, 18 aa, Entamoeba dispar
KDKALGCNDLVKPYFAIV

SEQ ID NO: 2489035 - protein, 19 aa, Entamoeba dispar
KDKCIICGEGYFMSSTGIC

SEQ ID NO: 2489036 - protein, 20 aa, Entamoeba dispar
KDKCIICGEGYFMSSTGICK

SEQ ID NO: 2489037 - protein, 21 aa, Entamoeba dispar
KDKCIKCGEGYFMSSTGICKS

SEQ ID NO: 2489038 - protein, 23 aa, Entamoeba dispar
KDKDGTLFYCYTYLVKNKGGDEH

SEQ ID NO: 2489039 - protein, 36 aa, Entamoeba dispar
KDKEELFEEVMCCGSFGASLFSAWMKTSSGSNLSIR

SEQ ID NO: 2489040 - protein, 18 aa, Entamoeba dispar
KDKEILNIASLYEKETIY

SEQ ID NO: 2489041 - protein, 18 aa, Entamoeba dispar
KDKEKKKQMELMIEEDPE

SEQ ID NO: 2489042 - protein, 25 aa, Entamoeba dispar
KDKEWITTVGMTFALNLSSFIANKK

SEQ ID NO: 2489043 - protein, 18 aa, Entamoeba dispar
KDKFRPIIPKAPFQYFGK

SEQ ID NO: 2489044 - protein, 23 aa, Entamoeba dispar
KDKGLYITVEFEFDGSRIEQYNE

SEQ ID NO: 2489045 - protein, 17 aa, Entamoeba dispar
KDKIELYVEKVLARGLC

SEQ ID NO: 2489046 - protein, 21 aa, Entamoeba dispar
KDKILEKLERCIKSVVDSANW

SEQ ID NO: 2489047 - protein, 21 aa, Entamoeba dispar
KDKKDLLALCTKIKKAQEKFE

SEQ ID NO: 2489048 - protein, 21 aa, Entamoeba dispar
KDKLIEKIERCVKNVIKSADW

SEQ ID NO: 2489049 - protein, 18 aa, Entamoeba dispar
KDKLLFGNLAEFTTEDEA

SEQ ID NO: 2489050 - protein, 27 aa, Entamoeba dispar
KDKNGLKVMLFSGINKYSTYLIYSQEL

SEQ ID NO: 2489051 - protein, 24 aa, Entamoeba dispar
KDKPCPYCKTVSPKIVLNDSKTGF

SEQ ID NO: 2489052 - protein, 23 aa, Entamoeba dispar
KDKPKELDEIITIINQLNDPNNK

SEQ ID NO: 2489053 - protein, 23 aa, Entamoeba dispar
KDKPKIDNLFGEYTIKSQENKVE

SEQ ID NO: 2489054 - protein, 22 aa, Entamoeba dispar
KDKRFPPVSGLVRAFFHISGYM

SEQ ID NO: 2489055 - protein, 22 aa, Entamoeba dispar
KDKRNIKCKEILNQQIINLKEV

SEQ ID NO: 2489056 - protein, 26 aa, Entamoeba dispar
KDKSKGEVIITWYSMYQNILKQKLRI

SEQ ID NO: 2489057 - protein, 17 aa, Entamoeba dispar
KDKTVEHIILFINKQLR

SEQ ID NO: 2489058 - protein, 17 aa, Entamoeba dispar
KDKWEIEDWMLMNEEEE

SEQ ID NO: 2489059 - protein, 18 aa, Entamoeba dispar
KDKYRLSDDYITKTKALF

SEQ ID NO: 2489060 - protein, 21 aa, Entamoeba dispar
KDLAIEVIHQLQILFTEMSIG

SEQ ID NO: 2489061 - protein, 19 aa, Entamoeba dispar
KDLCASTLYYWIKSSEHKT

SEQ ID NO: 2489062 - protein, 20 aa, Entamoeba dispar
KDLCFKCGEPIVGDYIIING

SEQ ID NO: 2489063 - protein, 25 aa, Entamoeba dispar
KDLCLEMMKRILTDPSLYKGNNLGC

SEQ ID NO: 2489064 - protein, 17 aa, Entamoeba dispar
KDLCNPETVKLLITTVE

SEQ ID NO: 2489065 - protein, 21 aa, Entamoeba dispar
KDLEESFALIITNARRIGNIM

SEQ ID NO: 2489066 - protein, 23 aa, Entamoeba dispar
KDLELKCSIRFELIHKKKNAFIT

SEQ ID NO: 2489067 - protein, 19 aa, Entamoeba dispar
KDLICFIIEKSIDIEYKLL

SEQ ID NO: 2489068 - protein, 18 aa, Entamoeba dispar
KDLIKTPIYGMNYEKFMP

SEQ ID NO: 2489069 - protein, 23 aa, Entamoeba dispar
KDLKVSNIVLIRFNNFDVFPETI

SEQ ID NO: 2489070 - protein, 30 aa, Entamoeba dispar
KDLLGEGSCCQECYSIFEEIDMKGHLYGMK

SEQ ID NO: 2489071 - protein, 20 aa, Entamoeba dispar
KDLLRKVGIKFDEVVQKGFK

SEQ ID NO: 2489072 - protein, 25 aa, Entamoeba dispar
KDLLTNHCLFCLYTHTAMFGEDKFP

SEQ ID NO: 2489073 - protein, 22 aa, Entamoeba dispar
KDLNMLLTDIIELADKANMLST

SEQ ID NO: 2489074 - protein, 24 aa, Entamoeba dispar
KDLNRTAISFSWLIQLAEQNGISF

SEQ ID NO: 2489075 - protein, 22 aa, Entamoeba dispar
KDLPEKSARYAVYDLEYDTPEG

SEQ ID NO: 2489076 - protein, 18 aa, Entamoeba dispar
KDLQKALIEELYKSDKIT

SEQ ID NO: 2489077 - protein, 20 aa, Entamoeba dispar
KDLRTLCGEYNEKRIVEEEN

SEQ ID NO: 2489078 - protein, 17 aa, Entamoeba dispar
KDLTAILEHLPKQRQTM

SEQ ID NO: 2489079 - protein, 26 aa, Entamoeba dispar
KDLTKRYLCAASFNALIQKVEKSAFI

SEQ ID NO: 2489080 - protein, 20 aa, Entamoeba dispar
KDLTMRRLLYVVLNDMIPMT

SEQ ID NO: 2489081 - protein, 19 aa, Entamoeba dispar
KDLTTRAGYLTSEGKRKVI

SEQ ID NO: 2489082 - protein, 35 aa, Entamoeba dispar
KDLTVHFVFVSLNILCFRTCYKIIKKGENDIYLDM

SEQ ID NO: 2489083 - protein, 21 aa, Entamoeba dispar
KDLWIVMEICGAGSVCDIMHI

SEQ ID NO: 2489084 - protein, 18 aa, Entamoeba dispar
KDMARYLVDVAIKRKTLD

SEQ ID NO: 2489085 - protein, 18 aa, Entamoeba dispar
KDMCKRKDININKLTLHK

SEQ ID NO: 2489086 - protein, 25 aa, Entamoeba dispar
KDMHPEIIKAMIISFENEDIFIKKY

SEQ ID NO: 2489087 - protein, 21 aa, Entamoeba dispar
KDMIIRGGHNIWPAEICDIMI

SEQ ID NO: 2489088 - protein, 17 aa, Entamoeba dispar
  misc_feature (17)..(17): Xaa can be any naturally occurring amino acid
KDMKIKESPIISTTYSX

SEQ ID NO: 2489089 - protein, 22 aa, Entamoeba dispar
KDMNKMFSVVFMLYGSTQFQQK

SEQ ID NO: 2489090 - protein, 17 aa, Entamoeba dispar
KDMQVAFDCLKKHGVII

SEQ ID NO: 2489091 - protein, 18 aa, Entamoeba dispar
KDMYGISVAEHYMNIFVH

SEQ ID NO: 2489092 - protein, 17 aa, Entamoeba dispar
KDNCIDCSIFTSDCLQC

SEQ ID NO: 2489093 - protein, 25 aa, Entamoeba dispar
KDNDFRFELQMKKYIRSDLREVLKI

SEQ ID NO: 2489094 - protein, 19 aa, Entamoeba dispar
KDNELELVLSITSSLIVND

SEQ ID NO: 2489095 - protein, 24 aa, Entamoeba dispar
KDNIPHPRIMIIFTPDEEIGESCD

SEQ ID NO: 2489096 - protein, 21 aa, Entamoeba dispar
KDNKKVDCYFEQIRQCLPTKP

SEQ ID NO: 2489097 - protein, 28 aa, Entamoeba dispar
KDNLITCSLCFCCFSCFNYYNPIFTDDT

SEQ ID NO: 2489098 - protein, 24 aa, Entamoeba dispar
KDNLKEVVSFLVMVWTKVKPPMEN

SEQ ID NO: 2489099 - protein, 18 aa, Entamoeba dispar
KDNQIVWSSCVGSIESEY

SEQ ID NO: 2489100 - protein, 19 aa, Entamoeba dispar
KDPDNFIIPPKQYKAIKPM

SEQ ID NO: 2489101 - protein, 18 aa, Entamoeba dispar
KDPDNFIIPPKQYKTIKP

SEQ ID NO: 2489102 - protein, 22 aa, Entamoeba dispar
KDPEDPKRCYIERIIEMDPRGS

SEQ ID NO: 2489103 - protein, 19 aa, Entamoeba dispar
KDPENGLCRIKYYNEKTIS

SEQ ID NO: 2489104 - protein, 22 aa, Entamoeba dispar
KDPKHFIFSLLNPSGIQPRAFY

SEQ ID NO: 2489105 - protein, 17 aa, Entamoeba dispar
KDPLEGIYVEYASENNI

SEQ ID NO: 2489106 - protein, 19 aa, Entamoeba dispar
KDPLFGPVIVFGMGGVTVE

SEQ ID NO: 2489107 - protein, 20 aa, Entamoeba dispar
KDPLILKAFGLFREVVLSNN

SEQ ID NO: 2489108 - protein, 22 aa, Entamoeba dispar
KDPQGLLIFYNFINDLICLITT

SEQ ID NO: 2489109 - protein, 23 aa, Entamoeba dispar
KDPTQHIPICLVGNKSDLESERT

SEQ ID NO: 2489110 - protein, 18 aa, Entamoeba dispar
KDQELVGLLFQLKECEQI

SEQ ID NO: 2489111 - protein, 20 aa, Entamoeba dispar
KDQYTLCIILNLAEAIIQYK

SEQ ID NO: 2489112 - protein, 26 aa, Entamoeba dispar
KDRELFKRRCKRCGEFGHFPKECKNE

SEQ ID NO: 2489113 - protein, 19 aa, Entamoeba dispar
KDRIKDYPKYRSPGSSPKT

SEQ ID NO: 2489114 - protein, 17 aa, Entamoeba dispar
KDRITNQFIGLTEVIGH

SEQ ID NO: 2489115 - protein, 26 aa, Entamoeba dispar
KDRKRAARCLGELVDLFESKIVQELI

SEQ ID NO: 2489116 - protein, 21 aa, Entamoeba dispar
KDRLKRLVFRLTDSKVVLDRN

SEQ ID NO: 2489117 - protein, 22 aa, Entamoeba dispar
KDRMKKLVCEKVLNNGEPMDDL

SEQ ID NO: 2489118 - protein, 22 aa, Entamoeba dispar
KDRNRCTVNFDLHERGNLTEIP

SEQ ID NO: 2489119 - protein, 19 aa, Entamoeba dispar
KDRSTACYGHISKANPFLV

SEQ ID NO: 2489120 - protein, 18 aa, Entamoeba dispar
KDRYCVIDGEELIVYNSV

SEQ ID NO: 2489121 - protein, 18 aa, Entamoeba dispar
KDSIRWNQGFKLFQDIFP

SEQ ID NO: 2489122 - protein, 20 aa, Entamoeba dispar
KDSKLLKALCNIQTNHKVLL

SEQ ID NO: 2489123 - protein, 21 aa, Entamoeba dispar
KDSNTVVLCPSLVHYYEVSIK

SEQ ID NO: 2489124 - protein, 22 aa, Entamoeba dispar
KDSPGILLLCFQVYKEIVKNIK

SEQ ID NO: 2489125 - protein, 24 aa, Entamoeba dispar
KDSPNSLHCFRILSLSSSEVDITF

SEQ ID NO: 2489126 - protein, 25 aa, Entamoeba dispar
KDSRNFHCWGYYLWILEQGKISQED

SEQ ID NO: 2489127 - protein, 26 aa, Entamoeba dispar
KDSVIKRLNVTVSEKETLIGTNIKGL

SEQ ID NO: 2489128 - protein, 19 aa, Entamoeba dispar
KDTHFAFVLLKYFFLCLPK

SEQ ID NO: 2489129 - protein, 20 aa, Entamoeba dispar
KDTLHGLAYLHKMHMIHRDI

SEQ ID NO: 2489130 - protein, 23 aa, Entamoeba dispar
KDTLRFILMNKIKDWKCELESPL

SEQ ID NO: 2489131 - protein, 19 aa, Entamoeba dispar
KDTMTVIIYQTVVDYLNSS

SEQ ID NO: 2489132 - protein, 19 aa, Entamoeba dispar
KDTPFRFITDNELQKQLDN

SEQ ID NO: 2489133 - protein, 23 aa, Entamoeba dispar
KDTRFYRKWEICESTNPTKFGSI

SEQ ID NO: 2489134 - protein, 25 aa, Entamoeba dispar
KDTYIRSGDGFAIVYSITSLTTFLE

SEQ ID NO: 2489135 - protein, 20 aa, Entamoeba dispar
KDTYLPIKLLEKLMSLVNGF

SEQ ID NO: 2489136 - protein, 18 aa, Entamoeba dispar
KDVAEMILYLTKNRVSKN

SEQ ID NO: 2489137 - protein, 24 aa, Entamoeba dispar
KDVALECYNRLKIAYEKRKLEEFE

SEQ ID NO: 2489138 - protein, 25 aa, Entamoeba dispar
KDVEIIKNYSLLKCRNKTIKELIQL

SEQ ID NO: 2489139 - protein, 19 aa, Entamoeba dispar
KDVGIKFGVGDDISDDEIN

SEQ ID NO: 2489140 - protein, 30 aa, Entamoeba dispar
KDVISPLRLKIMNFVRTWMKNAWKDFEAKE

SEQ ID NO: 2489141 - protein, 35 aa, Entamoeba dispar
KDVISPLRLKVMNFVRIWIKNAWRDFEGQTELMEK

SEQ ID NO: 2489142 - protein, 18 aa, Entamoeba dispar
KDVKIALNKRKAINDRFN

SEQ ID NO: 2489143 - protein, 22 aa, Entamoeba dispar
KDVKKKGIIKYSRKTKVEDKEE

SEQ ID NO: 2489144 - protein, 21 aa, Entamoeba dispar
KDVKKNFIAILTFCDGQTPKI

SEQ ID NO: 2489145 - protein, 19 aa, Entamoeba dispar
KDVKKNFIAMLTFCDGKKP

SEQ ID NO: 2489146 - protein, 19 aa, Entamoeba dispar
KDVLYTIKIVFVGDPCTLD

SEQ ID NO: 2489147 - protein, 21 aa, Entamoeba dispar
KDVVKCIGYLIAAALRDGDGY

SEQ ID NO: 2489148 - protein, 25 aa, Entamoeba dispar
KDWKCELESPLKLTIEFTHQQLRED

SEQ ID NO: 2489149 - protein, 23 aa, Entamoeba dispar
KDWKELKDYISPEGFHLIEIHMK

SEQ ID NO: 2489150 - protein, 20 aa, Entamoeba dispar
KDWVRIAVVINENYNDYDGF

SEQ ID NO: 2489151 - protein, 20 aa, Entamoeba dispar
KDYAIYCVQTLAAKAAEEKM

SEQ ID NO: 2489152 - protein, 21 aa, Entamoeba dispar
KDYDPLPVFLVRSTYGSETAM

SEQ ID NO: 2489153 - protein, 20 aa, Entamoeba dispar
KDYFTAYEIRVNLNDQIDRF

SEQ ID NO: 2489154 - protein, 18 aa, Entamoeba dispar
KDYFYLCLLNEIPNKDII

SEQ ID NO: 2489155 - protein, 19 aa, Entamoeba dispar
KDYFYLCLLNEIPNKDIIS

SEQ ID NO: 2489156 - protein, 17 aa, Entamoeba dispar
KDYISIQEDVLFNVCKL

SEQ ID NO: 2489157 - protein, 19 aa, Entamoeba dispar
KDYKLAQFVVESHSMNHPD

SEQ ID NO: 2489158 - protein, 17 aa, Entamoeba dispar
KDYKQTFEIVRRHKINY

SEQ ID NO: 2489159 - protein, 26 aa, Entamoeba dispar
KDYPKFLIPTYFTAFIKKIYNFIVQG

SEQ ID NO: 2489160 - protein, 17 aa, Entamoeba dispar
KDYPKYRSPGSSPKTIP

SEQ ID NO: 2489161 - protein, 20 aa, Entamoeba dispar
KDYQMTFGLQKLFVDMLKGI

SEQ ID NO: 2489162 - protein, 17 aa, Entamoeba dispar
KDYSLLLIHIIKQLKIN

SEQ ID NO: 2489163 - protein, 19 aa, Entamoeba dispar
KEAALFKRVVESLKSTIDK

SEQ ID NO: 2489164 - protein, 25 aa, Entamoeba dispar
KEADSNYRACVQLTNDRVHDYYTSQ

SEQ ID NO: 2489165 - protein, 21 aa, Entamoeba dispar
KEAFGNCLNVCYDYVPTEVAL

SEQ ID NO: 2489166 - protein, 22 aa, Entamoeba dispar
KEAFSLKGTFFTYFYDKFQALD

SEQ ID NO: 2489167 - protein, 18 aa, Entamoeba dispar
KEAFSRLFNLNSISIENN

SEQ ID NO: 2489168 - protein, 20 aa, Entamoeba dispar
KEAGANVVLCQWGFDDEANH

SEQ ID NO: 2489169 - protein, 20 aa, Entamoeba dispar
KEAINSIDVVLLRELCREFG

SEQ ID NO: 2489170 - protein, 23 aa, Entamoeba dispar
KEALKVISSFCGMDDLLNADILD

SEQ ID NO: 2489171 - protein, 23 aa, Entamoeba dispar
KEALKYIIACGCSMKINDEEKYT

SEQ ID NO: 2489172 - protein, 18 aa, Entamoeba dispar
KEALLPLLDQFIKQNEND

SEQ ID NO: 2489173 - protein, 17 aa, Entamoeba dispar
KEALSHNKAIHFTSRYM

SEQ ID NO: 2489174 - protein, 21 aa, Entamoeba dispar
KEALSRLKINPFINEFNDTEC

SEQ ID NO: 2489175 - protein, 24 aa, Entamoeba dispar
KEAMKIVLEKDGNVLIAMHRRALV

SEQ ID NO: 2489176 - protein, 18 aa, Entamoeba dispar
KEANLLIVHAPVVIIGDI

SEQ ID NO: 2489177 - protein, 20 aa, Entamoeba dispar
KEAPERVCVIDVDAGTEGSL

SEQ ID NO: 2489178 - protein, 22 aa, Entamoeba dispar
KEAPHDGAFCDLLWSDPEPEVD

SEQ ID NO: 2489179 - protein, 24 aa, Entamoeba dispar
KEAPIHFIPTFKIICGKDEYIDDR

SEQ ID NO: 2489180 - protein, 18 aa, Entamoeba dispar
KEAQAAAIAAARDPKNII

SEQ ID NO: 2489181 - protein, 21 aa, Entamoeba dispar
KEARLKISEMIIGQVTSEGKD

SEQ ID NO: 2489182 - protein, 19 aa, Entamoeba dispar
KEAVELPLSHPELYEEIGI

SEQ ID NO: 2489183 - protein, 28 aa, Entamoeba dispar
KEAYNIIKYSFVFEFFIKEYEQIYKLFN

SEQ ID NO: 2489184 - protein, 18 aa, Entamoeba dispar
KECARITSNDAFWKGFTG

SEQ ID NO: 2489185 - protein, 19 aa, Entamoeba dispar
KECFFHCALLKEINIPKRL

SEQ ID NO: 2489186 - protein, 23 aa, Entamoeba dispar
KECFNCKMFCQCPNLKNIKFIDS

SEQ ID NO: 2489187 - protein, 21 aa, Entamoeba dispar
KECHCNLSISSYKLLKGTNEI

SEQ ID NO: 2489188 - protein, 29 aa, Entamoeba dispar
KECIDESVLQKHRIEVMYIKESIANFCLP

SEQ ID NO: 2489189 - protein, 19 aa, Entamoeba dispar
KECNCHTIASLFKLFLREL

SEQ ID NO: 2489190 - protein, 21 aa, Entamoeba dispar
KECQKAVMINHSFIDKTITLY

SEQ ID NO: 2489191 - protein, 17 aa, Entamoeba dispar
KECSLVLENDEKKSYNF

SEQ ID NO: 2489192 - protein, 25 aa, Entamoeba dispar
KECTGKRFIENFIMPKTYSAKRILL

SEQ ID NO: 2489193 - protein, 17 aa, Entamoeba dispar
KECYCNNPSLSIFEVPY

SEQ ID NO: 2489194 - protein, 19 aa, Entamoeba dispar
KEDCECSTIFSVLKTNSQI

SEQ ID NO: 2489195 - protein, 22 aa, Entamoeba dispar
KEDDLRQVILFVRKTLNIPTTI

SEQ ID NO: 2489196 - protein, 19 aa, Entamoeba dispar
KEDEAHIVGCGFDTIKKQV

SEQ ID NO: 2489197 - protein, 18 aa, Entamoeba dispar
KEDFENMVISEPTDFRQI

SEQ ID NO: 2489198 - protein, 20 aa, Entamoeba dispar
KEDIEIFILKYIIGKIPEND

SEQ ID NO: 2489199 - protein, 20 aa, Entamoeba dispar
KEDIHLLSLLISHLHQFYSQ

SEQ ID NO: 2489200 - protein, 27 aa, Entamoeba dispar
KEDIKKVVPVQCFFCGSTEHLAKDCPK

SEQ ID NO: 2489201 - protein, 19 aa, Entamoeba dispar
KEDIKVDPISGLKEENGDE

SEQ ID NO: 2489202 - protein, 23 aa, Entamoeba dispar
KEDILKVITFISIEITEKKYWMG

SEQ ID NO: 2489203 - protein, 20 aa, Entamoeba dispar
KEDKTWGEIITRLRHLKTTI

SEQ ID NO: 2489204 - protein, 19 aa, Entamoeba dispar
KEDLFPWKEENEGVQTIRK

SEQ ID NO: 2489205 - protein, 23 aa, Entamoeba dispar
KEDLKKCFPGFGDIHKINQNLII

SEQ ID NO: 2489206 - protein, 26 aa, Entamoeba dispar
KEDLRAYDIFLRKRFGYSERILEEMT

SEQ ID NO: 2489207 - protein, 25 aa, Entamoeba dispar
KEDPMAFSRRPSYHQNFLKQNDLQY

SEQ ID NO: 2489208 - protein, 26 aa, Entamoeba dispar
KEDSFPFSLKCNGELNVSKKFVRCKA

SEQ ID NO: 2489209 - protein, 17 aa, Entamoeba dispar
KEEALEWQELIEKQKEN

SEQ ID NO: 2489210 - protein, 21 aa, Entamoeba dispar
KEECQCKIAFASSDDTPDLVR

SEQ ID NO: 2489211 - protein, 19 aa, Entamoeba dispar
KEEECQIADFTVRIKEKEN

SEQ ID NO: 2489212 - protein, 17 aa, Entamoeba dispar
KEEEKRKMMAITAEQKK

SEQ ID NO: 2489213 - protein, 22 aa, Entamoeba dispar
KEEEMKIVLRRVQMIIESGANV

SEQ ID NO: 2489214 - protein, 24 aa, Entamoeba dispar
KEEEQRLRQEAARLKEEEERLKLE

SEQ ID NO: 2489215 - protein, 23 aa, Entamoeba dispar
KEEEVMELLTVLDCKTWLSKCKG

SEQ ID NO: 2489216 - protein, 20 aa, Entamoeba dispar
KEEEWSYIPSFLKTKPPKPK

SEQ ID NO: 2489217 - protein, 23 aa, Entamoeba dispar
KEEGCALEKLLDVEDFIQEIRTN

SEQ ID NO: 2489218 - protein, 20 aa, Entamoeba dispar
KEEGESHLINGYTPFQTPIQ

SEQ ID NO: 2489219 - protein, 20 aa, Entamoeba dispar
KEEGPLLKNAWLSCLKVISH

SEQ ID NO: 2489220 - protein, 20 aa, Entamoeba dispar
KEEIEFWGFIGGVKIFNEKN

SEQ ID NO: 2489221 - protein, 20 aa, Entamoeba dispar
KEEIKDLRLELSQEEKRINE

SEQ ID NO: 2489222 - protein, 20 aa, Entamoeba dispar
KEEKERKIAEEKRKKEEEER

SEQ ID NO: 2489223 - protein, 25 aa, Entamoeba dispar
KEEKKEKQKCCINIKEETKQEEHIS

SEQ ID NO: 2489224 - protein, 18 aa, Entamoeba dispar
KEEKLDFISRDDLILGED

SEQ ID NO: 2489225 - protein, 21 aa, Entamoeba dispar
KEEKRGTFSPMYSVDNEEMNI

SEQ ID NO: 2489226 - protein, 19 aa, Entamoeba dispar
KEELIGLLVKRFNPQRPEG

SEQ ID NO: 2489227 - protein, 19 aa, Entamoeba dispar
KEELKSEITEEVHTIPLPP

SEQ ID NO: 2489228 - protein, 17 aa, Entamoeba dispar
KEELNIPTYIDITSHSI

SEQ ID NO: 2489229 - protein, 24 aa, Entamoeba dispar
KEELSIETKINWYNSVINYGRVNW

SEQ ID NO: 2489230 - protein, 23 aa, Entamoeba dispar
KEELSMNIYLVYLYEKRKEIEAL

SEQ ID NO: 2489231 - protein, 18 aa, Entamoeba dispar
KEELSRQIPTLGNILTVH

SEQ ID NO: 2489232 - protein, 22 aa, Entamoeba dispar
KEEMICSGVLPIDRMQDCLGPI

SEQ ID NO: 2489233 - protein, 24 aa, Entamoeba dispar
KEENICLFRGKFILEETTDGSRFE

SEQ ID NO: 2489234 - protein, 19 aa, Entamoeba dispar
KEENVICSIQRFKEVSRCI

SEQ ID NO: 2489235 - protein, 22 aa, Entamoeba dispar
KEEPEECGICFGEIDNCYTIPG

SEQ ID NO: 2489236 - protein, 18 aa, Entamoeba dispar
KEEPFIKAIEVDVQPNAL

SEQ ID NO: 2489237 - protein, 21 aa, Entamoeba dispar
KEEPKKIIPILPKEKKSAITE

SEQ ID NO: 2489238 - protein, 21 aa, Entamoeba dispar
KEEPVELKGVIKNNASENASL

SEQ ID NO: 2489239 - protein, 21 aa, Entamoeba dispar
KEEQLELLVGFNYAPVNSVIG

SEQ ID NO: 2489240 - protein, 19 aa, Entamoeba dispar
KEERSEGVVILKRNETNQM

SEQ ID NO: 2489241 - protein, 18 aa, Entamoeba dispar
KEETRNKILILLKNITKC

SEQ ID NO: 2489242 - protein, 23 aa, Entamoeba dispar
KEEYNPRIDPKMTSFLNDDTWKK

SEQ ID NO: 2489243 - protein, 17 aa, Entamoeba dispar
KEFAPKSYDLIVEVLET

SEQ ID NO: 2489244 - protein, 27 aa, Entamoeba dispar
KEFAYQWRLYPEMELFAHWSKDHLPIN

SEQ ID NO: 2489245 - protein, 18 aa, Entamoeba dispar
KEFCRIGYYVNNEFEGID

SEQ ID NO: 2489246 - protein, 20 aa, Entamoeba dispar
KEFDEVCFQYGIELDDVVEE

SEQ ID NO: 2489247 - protein, 20 aa, Entamoeba dispar
KEFDSAIPISVRHSQQLTVT

SEQ ID NO: 2489248 - protein, 18 aa, Entamoeba dispar
KEFEEECYKRGIYEEFIN

SEQ ID NO: 2489249 - protein, 25 aa, Entamoeba dispar
KEFEYRPTQSFDILLKDALNYYYQD

SEQ ID NO: 2489250 - protein, 19 aa, Entamoeba dispar
KEFFCMKCATHFMTPAPFL

SEQ ID NO: 2489251 - protein, 20 aa, Entamoeba dispar
KEFIPFIPFSLHSTLSIANS

SEQ ID NO: 2489252 - protein, 19 aa, Entamoeba dispar
KEFIPRIIQIVQQTFQLRE

SEQ ID NO: 2489253 - protein, 22 aa, Entamoeba dispar
KEFKEVFPMVTSVIINNRSIER

SEQ ID NO: 2489254 - protein, 19 aa, Entamoeba dispar
KEFKHLTLVQNIRFSFQVP

SEQ ID NO: 2489255 - protein, 17 aa, Entamoeba dispar
KEFKKEEESCCEILFSS

SEQ ID NO: 2489256 - protein, 27 aa, Entamoeba dispar
KEFKPESVFKFNMAFKPKMTKLSVMQA

SEQ ID NO: 2489257 - protein, 19 aa, Entamoeba dispar
KEFLNCIDEKKYLSFMKFQ

SEQ ID NO: 2489258 - protein, 18 aa, Entamoeba dispar
KEFNELNLVYAIGGQISF

SEQ ID NO: 2489259 - protein, 19 aa, Entamoeba dispar
KEFNGCFPKILLDQLKNQH

SEQ ID NO: 2489260 - protein, 22 aa, Entamoeba dispar
KEFNGPAMLKTFIEDINISREI

SEQ ID NO: 2489261 - protein, 20 aa, Entamoeba dispar
KEFNKIPLLGCGMEKVEKLR

SEQ ID NO: 2489262 - protein, 23 aa, Entamoeba dispar
KEFNLLFWKYLMKTKPLPSREVV

SEQ ID NO: 2489263 - protein, 25 aa, Entamoeba dispar
KEFPIKTSDVLKHWRRPSWSDDGSM

SEQ ID NO: 2489264 - protein, 21 aa, Entamoeba dispar
KEFRENCGFAQTTARELKILQ

SEQ ID NO: 2489265 - protein, 20 aa, Entamoeba dispar
KEFSEELAISPVEIINFHGT

SEQ ID NO: 2489266 - protein, 23 aa, Entamoeba dispar
KEFSEKQIKCEELSKRQQEHQDT

SEQ ID NO: 2489267 - protein, 22 aa, Entamoeba dispar
KEFSSHLAFICPYCKEHYYCSL

SEQ ID NO: 2489268 - protein, 24 aa, Entamoeba dispar
KEFTRATTLFCATIFREFKNPDGK

SEQ ID NO: 2489269 - protein, 20 aa, Entamoeba dispar
KEFTSGAVFIVKILVPEFAN

SEQ ID NO: 2489270 - protein, 21 aa, Entamoeba dispar
KEFVFNLLESSGFIEIYTLGL

SEQ ID NO: 2489271 - protein, 23 aa, Entamoeba dispar
KEFVYCCDTFGFQLYEGKQIECY

SEQ ID NO: 2489272 - protein, 18 aa, Entamoeba dispar
KEFYRNSFTLMIVQMTCG

SEQ ID NO: 2489273 - protein, 23 aa, Entamoeba dispar
KEGCGKAMCNLGRCYFDGEGIEC

SEQ ID NO: 2489274 - protein, 25 aa, Entamoeba dispar
KEGCGNPRCDIAYCKSNPEHCSIDE

SEQ ID NO: 2489275 - protein, 18 aa, Entamoeba dispar
KEGCYYASLGNSIGIKPQ

SEQ ID NO: 2489276 - protein, 23 aa, Entamoeba dispar
KEGDWRNELEIAKKQLAKEERMK

SEQ ID NO: 2489277 - protein, 18 aa, Entamoeba dispar
KEGEDISDLISLIESNKK

SEQ ID NO: 2489278 - protein, 18 aa, Entamoeba dispar
KEGEEFVPRKGGEGAERN

SEQ ID NO: 2489279 - protein, 19 aa, Entamoeba dispar
KEGEILTGYIIKSNEEEGV

SEQ ID NO: 2489280 - protein, 23 aa, Entamoeba dispar
KEGESGLHLMIKMCYNSITKNEN

SEQ ID NO: 2489281 - protein, 20 aa, Entamoeba dispar
KEGFVCIRFELFGNGIQCYL

SEQ ID NO: 2489282 - protein, 20 aa, Entamoeba dispar
KEGGFLIEIIEEIIFDPAIG

SEQ ID NO: 2489283 - protein, 24 aa, Entamoeba dispar
KEGGKKKSAFCIFATGGMGGDCCI

SEQ ID NO: 2489284 - protein, 20 aa, Entamoeba dispar
KEGHLLYLLLDLIGDKEQTV

SEQ ID NO: 2489285 - protein, 19 aa, Entamoeba dispar
KEGILYFLHEESVQKAIEY

SEQ ID NO: 2489286 - protein, 24 aa, Entamoeba dispar
KEGIPPDQQRLIFAGKQLEEGKTL

SEQ ID NO: 2489287 - protein, 22 aa, Entamoeba dispar
KEGITVLRFRTEEEINTFNKTK

SEQ ID NO: 2489288 - protein, 25 aa, Entamoeba dispar
KEGKDCWEYAKELECVDTLIESTPD

SEQ ID NO: 2489289 - protein, 24 aa, Entamoeba dispar
KEGKIKNIFVVGGCDGAKAGRNYY

SEQ ID NO: 2489290 - protein, 21 aa, Entamoeba dispar
KEGKQKVVVVIPVATRADKVH

SEQ ID NO: 2489291 - protein, 21 aa, Entamoeba dispar
KEGKQKVVVVIPVATRADKVQ

SEQ ID NO: 2489292 - protein, 21 aa, Entamoeba dispar
KEGKTSTLSIMFKKKELGEDT

SEQ ID NO: 2489293 - protein, 26 aa, Entamoeba dispar
KEGLIPPEYPCVIPHQKIPFCRLTGM

SEQ ID NO: 2489294 - protein, 22 aa, Entamoeba dispar
KEGLKKYMAILGNMGKIKSTLM

SEQ ID NO: 2489295 - protein, 25 aa, Entamoeba dispar
KEGNCIRAKGIQILLEIIKIEKKNE

SEQ ID NO: 2489296 - protein, 26 aa, Entamoeba dispar
KEGNQIEALICWKQAIDITPFHASKV

SEQ ID NO: 2489297 - protein, 22 aa, Entamoeba dispar
KEGNSIIQMPQLVFKQPIQQTE

SEQ ID NO: 2489298 - protein, 20 aa, Entamoeba dispar
KEGPGNCVTLANPSYYNKLL

SEQ ID NO: 2489299 - protein, 20 aa, Entamoeba dispar
KEGRRKLSFKYEEKIIKQEL

SEQ ID NO: 2489300 - protein, 18 aa, Entamoeba dispar
KEGSVIMIRVWSGQLMIC

SEQ ID NO: 2489301 - protein, 17 aa, Entamoeba dispar
KEGTFKGCVSLKTIKLS

SEQ ID NO: 2489302 - protein, 20 aa, Entamoeba dispar
KEGTGSFGYDVRKNVYCDLM

SEQ ID NO: 2489303 - protein, 19 aa, Entamoeba dispar
KEGVQMLHRCCLFKNHLNQ

SEQ ID NO: 2489304 - protein, 22 aa, Entamoeba dispar
KEGWRVVVGKIRKEEMPGGEKR

SEQ ID NO: 2489305 - protein, 21 aa, Entamoeba dispar
KEGYIKYFSYLIHHPVGSYTD

SEQ ID NO: 2489306 - protein, 20 aa, Entamoeba dispar
KEGYPIFAETCIQYLELTND

SEQ ID NO: 2489307 - protein, 30 aa, Entamoeba dispar
KEHATFYIKEIFKRYYQGIIQLPNFNSQLF

SEQ ID NO: 2489308 - protein, 25 aa, Entamoeba dispar
KEHEIGRFILPLTFIITNQYIEKCI

SEQ ID NO: 2489309 - protein, 23 aa, Entamoeba dispar
KEHFKDIYFTLSSCFELYRQKKI

SEQ ID NO: 2489310 - protein, 19 aa, Entamoeba dispar
KEHKIGVVNVAGYSTESVT

SEQ ID NO: 2489311 - protein, 17 aa, Entamoeba dispar
KEHKYSFFVIKRVPILL

SEQ ID NO: 2489312 - protein, 19 aa, Entamoeba dispar
KEHLQRILIQKTIKLPHIQ

SEQ ID NO: 2489313 - protein, 19 aa, Entamoeba dispar
KEHMNSVCPKRLIKCEYCS

SEQ ID NO: 2489314 - protein, 17 aa, Entamoeba dispar
KEHPDIIAVHLHPGLVY

SEQ ID NO: 2489315 - protein, 19 aa, Entamoeba dispar
KEHRLVLDVLSKVEPSRKC

SEQ ID NO: 2489316 - protein, 24 aa, Entamoeba dispar
KEHSECPVCKSPLTVAFLVDLCHK

SEQ ID NO: 2489317 - protein, 19 aa, Entamoeba dispar
KEHSRCTCTNPLYSFSVCA

SEQ ID NO: 2489318 - protein, 18 aa, Entamoeba dispar
KEIAETFIGKEVKNAVIT

SEQ ID NO: 2489319 - protein, 28 aa, Entamoeba dispar
KEIAKAEMPAVCGDIVIHFRELAKHASC

SEQ ID NO: 2489320 - protein, 18 aa, Entamoeba dispar
KEIAQWRSIFVLYGITCF

SEQ ID NO: 2489321 - protein, 20 aa, Entamoeba dispar
KEIDGSIVVVQISRPQDRKR

SEQ ID NO: 2489322 - protein, 19 aa, Entamoeba dispar
KEIEECNGIEEIEKYSEIT

SEQ ID NO: 2489323 - protein, 18 aa, Entamoeba dispar
KEIEKIEIIKADSFKNRA

SEQ ID NO: 2489324 - protein, 25 aa, Entamoeba dispar
KEIESLCFCRCYSLSNIIIPSSISK

SEQ ID NO: 2489325 - protein, 18 aa, Entamoeba dispar
KEIEYEKRIEIFKNYIHI

SEQ ID NO: 2489326 - protein, 21 aa, Entamoeba dispar
KEIFNLTELCSLELDNNLIRK

SEQ ID NO: 2489327 - protein, 20 aa, Entamoeba dispar
KEIFRIDKVFFFSYTFPELI

SEQ ID NO: 2489328 - protein, 26 aa, Entamoeba dispar
KEIGDEGFLIAKFCKQPKNLKTNLYI

SEQ ID NO: 2489329 - protein, 23 aa, Entamoeba dispar
KEIGDKCFWGCSSLTTINIPSSV

SEQ ID NO: 2489330 - protein, 21 aa, Entamoeba dispar
KEIGDYCFLGCSSLKSINIPT

SEQ ID NO: 2489331 - protein, 23 aa, Entamoeba dispar
KEIGRYCFNKCTGLKRVDIPIGI

SEQ ID NO: 2489332 - protein, 19 aa, Entamoeba dispar
KEIGVCWFECSSNTVGLCQ

SEQ ID NO: 2489333 - protein, 18 aa, Entamoeba dispar
KEIICCIEHNETIDKKYY

SEQ ID NO: 2489334 - protein, 20 aa, Entamoeba dispar
KEIIHDVKVPTEKKVKELGV

SEQ ID NO: 2489335 - protein, 19 aa, Entamoeba dispar
KEIIMKGWNERLMKSHKDI

SEQ ID NO: 2489336 - protein, 21 aa, Entamoeba dispar
KEIINRDVFWTGIDTNEIGKE

SEQ ID NO: 2489337 - protein, 20 aa, Entamoeba dispar
KEIIQNVIFIISGKKTEYDK

SEQ ID NO: 2489338 - protein, 18 aa, Entamoeba dispar
KEIKCIENPIKQETDKEI

SEQ ID NO: 2489339 - protein, 21 aa, Entamoeba dispar
KEIKELQSIIEEWKVKEKEWK

SEQ ID NO: 2489340 - protein, 17 aa, Entamoeba dispar
KEIKKALPYITSAVGNI

SEQ ID NO: 2489341 - protein, 17 aa, Entamoeba dispar
KEIKKRYNITEEDIKSM

SEQ ID NO: 2489342 - protein, 24 aa, Entamoeba dispar
KEIKNTFLHWMIKVLRIVLIIGEK

SEQ ID NO: 2489343 - protein, 26 aa, Entamoeba dispar
KEIKSCGIPNFWIEVFNEVGLIGNLE

SEQ ID NO: 2489344 - protein, 24 aa, Entamoeba dispar
KEIKSLEKRNRLIISKIKKEDDKE

SEQ ID NO: 2489345 - protein, 20 aa, Entamoeba dispar
KEIKVDNLFEDIGIQSNSQP

SEQ ID NO: 2489346 - protein, 21 aa, Entamoeba dispar
KEIKYILKLLEELLIQNEFNF

SEQ ID NO: 2489347 - protein, 19 aa, Entamoeba dispar
KEILFEFIMNCRSYDFAFG

SEQ ID NO: 2489348 - protein, 18 aa, Entamoeba dispar
KEILKLKLTTAIQECSNY

SEQ ID NO: 2489349 - protein, 22 aa, Entamoeba dispar
KEILKRHNEEIISLKNTAKNNQ

SEQ ID NO: 2489350 - protein, 25 aa, Entamoeba dispar
KEILKWFDDVDESFKQIGEMINNFE

SEQ ID NO: 2489351 - protein, 18 aa, Entamoeba dispar
KEILLFVRNILLNSNNTT

SEQ ID NO: 2489352 - protein, 24 aa, Entamoeba dispar
KEILPFVCPDNIVVGGWDISKVNM

SEQ ID NO: 2489353 - protein, 25 aa, Entamoeba dispar
KEILTVKLLLLFGDRIFSTPKISKQ

SEQ ID NO: 2489354 - protein, 22 aa, Entamoeba dispar
KEILYTYTFKYIAMKIVLLWLS

SEQ ID NO: 2489355 - protein, 21 aa, Entamoeba dispar
KEIMSLKGIYIVQLISEFMYK

SEQ ID NO: 2489356 - protein, 19 aa, Entamoeba dispar
KEINDGLCKMREMQQNKIK

SEQ ID NO: 2489357 - protein, 26 aa, Entamoeba dispar
KEINEIRIKIVFGIFSLIGLDDRILS

SEQ ID NO: 2489358 - protein, 20 aa, Entamoeba dispar
KEINFCKKIGLPIIGVVENM

SEQ ID NO: 2489359 - protein, 17 aa, Entamoeba dispar
KEINGKYSILFDLTGVN

SEQ ID NO: 2489360 - protein, 24 aa, Entamoeba dispar
KEINKRCIGIIYLAIGYNENKIEE

SEQ ID NO: 2489361 - protein, 18 aa, Entamoeba dispar
KEINWTILEKLDLKEFDR

SEQ ID NO: 2489362 - protein, 22 aa, Entamoeba dispar
KEIPGLACDGCLVRATNGSKKF

SEQ ID NO: 2489363 - protein, 18 aa, Entamoeba dispar
KEIQGIVIVSNFNQDRFP

SEQ ID NO: 2489364 - protein, 26 aa, Entamoeba dispar
KEIQLCLSYQLACNIIHRITSAPGTI

SEQ ID NO: 2489365 - protein, 22 aa, Entamoeba dispar
KEIRRTELEGCIVKGKNCPKPI

SEQ ID NO: 2489366 - protein, 25 aa, Entamoeba dispar
KEIRYYEAFDRLSLFINNPKTINFY

SEQ ID NO: 2489367 - protein, 19 aa, Entamoeba dispar
KEISKQIKFHALITTYEMI

SEQ ID NO: 2489368 - protein, 25 aa, Entamoeba dispar
KEISLRYRIIDILTQIIQIYPDVIT

SEQ ID NO: 2489369 - protein, 25 aa, Entamoeba dispar
KEITELYISIPLVHVIRDSVFVVHG

SEQ ID NO: 2489370 - protein, 24 aa, Entamoeba dispar
KEITPQCIAAWKKESLLSLILNYS

SEQ ID NO: 2489371 - protein, 24 aa, Entamoeba dispar
KEITRIPFPTGYSLNPKDKILGVV

SEQ ID NO: 2489372 - protein, 18 aa, Entamoeba dispar
KEIVKAMEGMRGFHKDNG

SEQ ID NO: 2489373 - protein, 26 aa, Entamoeba dispar
KEIYNFPWDIADAITSGKRPPIIQEV

SEQ ID NO: 2489374 - protein, 19 aa, Entamoeba dispar
KEIYVEGVVNQFYFNCIDW

SEQ ID NO: 2489375 - protein, 31 aa, Entamoeba dispar
KEKAIKIGVCGSDGFVSLFVRTFIEITSKKL

SEQ ID NO: 2489376 - protein, 28 aa, Entamoeba dispar
KEKDELFYILGCWDIKTNDCVIDSVKYS

SEQ ID NO: 2489377 - protein, 23 aa, Entamoeba dispar
KEKDKFGKFVEEFKKEDSLKKEK

SEQ ID NO: 2489378 - protein, 21 aa, Entamoeba dispar
KEKDKIIIRIINIIRTNNTTE

SEQ ID NO: 2489379 - protein, 19 aa, Entamoeba dispar
KEKDTIFMILDLAEGSLDK

SEQ ID NO: 2489380 - protein, 23 aa, Entamoeba dispar
KEKEEFCCHLELNDAIDIGATYP

SEQ ID NO: 2489381 - protein, 33 aa, Entamoeba dispar
KEKEIILPLLKWKGKCIDLSTSMFIIKSSIVSV

SEQ ID NO: 2489382 - protein, 23 aa, Entamoeba dispar
KEKEIKNTLIILNKVIVCLEQIK

SEQ ID NO: 2489383 - protein, 29 aa, Entamoeba dispar
KEKELFNFNKLRIMHKVVMDIINYQPGEP

SEQ ID NO: 2489384 - protein, 18 aa, Entamoeba dispar
KEKEPKCNKSERMKLKEK

SEQ ID NO: 2489385 - protein, 17 aa, Entamoeba dispar
KEKEVMNGIIISIPESY

SEQ ID NO: 2489386 - protein, 18 aa, Entamoeba dispar
KEKEWFSNHPIYSKIADR

SEQ ID NO: 2489387 - protein, 17 aa, Entamoeba dispar
KEKEYNFLMDINVSSIQ

SEQ ID NO: 2489388 - protein, 24 aa, Entamoeba dispar
KEKGISRGTGFVCFRKRGVADKII

SEQ ID NO: 2489389 - protein, 24 aa, Entamoeba dispar
KEKGYTRWQLKNGVLYAYLQEEKN

SEQ ID NO: 2489390 - protein, 20 aa, Entamoeba dispar
KEKHICKGKMQPKPEPEPEP

SEQ ID NO: 2489391 - protein, 18 aa, Entamoeba dispar
KEKIICFTEMWIVEREIN

SEQ ID NO: 2489392 - protein, 19 aa, Entamoeba dispar
KEKIICMGVYSEGQYGIPK

SEQ ID NO: 2489393 - protein, 18 aa, Entamoeba dispar
KEKIKCFKITYTQKDRIK

SEQ ID NO: 2489394 - protein, 19 aa, Entamoeba dispar
KEKIKYCKSEIDFMNINQC

SEQ ID NO: 2489395 - protein, 18 aa, Entamoeba dispar
KEKIKYSGLTKEFSELLR

SEQ ID NO: 2489396 - protein, 20 aa, Entamoeba dispar
KEKKEVERNNSLLTEELNTL

SEQ ID NO: 2489397 - protein, 23 aa, Entamoeba dispar
KEKKKGMFSKIFGKKDKKEKKDK

SEQ ID NO: 2489398 - protein, 27 aa, Entamoeba dispar
KEKKPRKDCVCGLDLLQEPKRDKLIIL

SEQ ID NO: 2489399 - protein, 25 aa, Entamoeba dispar
KEKKPRKDCVCGLDTLKEETRNKIL

SEQ ID NO: 2489400 - protein, 21 aa, Entamoeba dispar
KEKKVKLINCFIGREAMIHQR

SEQ ID NO: 2489401 - protein, 27 aa, Entamoeba dispar
KEKKVSRERLLSFMFKRKTNEKTTISE

SEQ ID NO: 2489402 - protein, 24 aa, Entamoeba dispar
KEKLFLEWCCELEKKLESYASQYG

SEQ ID NO: 2489403 - protein, 19 aa, Entamoeba dispar
KEKLKKPKIFRLSLNKREQ

SEQ ID NO: 2489404 - protein, 19 aa, Entamoeba dispar
KEKLLKLDINTIKAEAIFT

SEQ ID NO: 2489405 - protein, 22 aa, Entamoeba dispar
KEKNVSCSILLSRIDEYEKEAK

SEQ ID NO: 2489406 - protein, 21 aa, Entamoeba dispar
KEKRAKGLIEREKGYKHRQNL

SEQ ID NO: 2489407 - protein, 20 aa, Entamoeba dispar
KEKREMIWMNQIIPKKEIKT

SEQ ID NO: 2489408 - protein, 24 aa, Entamoeba dispar
KEKRMKKIRIIAEDIKKSFSGNTN

SEQ ID NO: 2489409 - protein, 23 aa, Entamoeba dispar
KEKRTDYQWNIKLPIEADGVEDI

SEQ ID NO: 2489410 - protein, 20 aa, Entamoeba dispar
KEKSLLYSCVTPRTNKKRTM

SEQ ID NO: 2489411 - protein, 23 aa, Entamoeba dispar
KEKSSLLGPIGFVGGLVAGVTGV

SEQ ID NO: 2489412 - protein, 22 aa, Entamoeba dispar
KEKTAKELFSIYFQTLESDREM

SEQ ID NO: 2489413 - protein, 20 aa, Entamoeba dispar
KEKTITLSWDEFIKTTLSPR

SEQ ID NO: 2489414 - protein, 19 aa, Entamoeba dispar
KEKTVIIQQHFIYVIKELM

SEQ ID NO: 2489415 - protein, 20 aa, Entamoeba dispar
KEKVEGISPHFIFNVDEFGF

SEQ ID NO: 2489416 - protein, 26 aa, Entamoeba dispar
KEKVFPYDVSMYLLKEWQKGRAKTRT

SEQ ID NO: 2489417 - protein, 26 aa, Entamoeba dispar
KEKVPIKFDIGAVFDKLLIGVTNTPL

SEQ ID NO: 2489418 - protein, 28 aa, Entamoeba dispar
KEKWKIKEVYALCDWKVLEIVNEKIQFF

SEQ ID NO: 2489419 - protein, 32 aa, Entamoeba dispar
KEKYDVIKYTKICQFIDAFIFKYKTFTIAHVA

SEQ ID NO: 2489420 - protein, 18 aa, Entamoeba dispar
KEKYGIQVFGKWPNDGYV

SEQ ID NO: 2489421 - protein, 22 aa, Entamoeba dispar
KEKYIDIMVNLLFYIPMRNDYL

SEQ ID NO: 2489422 - protein, 30 aa, Entamoeba dispar
KELARDPCWHVRYVCAVNIGKCCDAIPGDV

SEQ ID NO: 2489423 - protein, 23 aa, Entamoeba dispar
KELAVSFYTLFCHTVGPFLLYEI

SEQ ID NO: 2489424 - protein, 24 aa, Entamoeba dispar
KELCEKFFFNYQIPKQTTIYKQTV

SEQ ID NO: 2489425 - protein, 17 aa, Entamoeba dispar
KELDKNLAFETTQQIIN

SEQ ID NO: 2489426 - protein, 17 aa, Entamoeba dispar
KELEECKTEINDAKDRL

SEQ ID NO: 2489427 - protein, 24 aa, Entamoeba dispar
KELEFPEGTRFIAEPGRYLASNVF

SEQ ID NO: 2489428 - protein, 22 aa, Entamoeba dispar
KELEGRPIILKWDRGLQSKVSD

SEQ ID NO: 2489429 - protein, 17 aa, Entamoeba dispar
KELEICDSIKKSIMINK

SEQ ID NO: 2489430 - protein, 17 aa, Entamoeba dispar
KELEIMAKTCNRMDLTS

SEQ ID NO: 2489431 - protein, 21 aa, Entamoeba dispar
KELEKLFIFLVQNIDKLLDIV

SEQ ID NO: 2489432 - protein, 17 aa, Entamoeba dispar
KELELKYFEVSAKTGDG

SEQ ID NO: 2489433 - protein, 20 aa, Entamoeba dispar
KELELYFNRDLYYIKVVSED

SEQ ID NO: 2489434 - protein, 17 aa, Entamoeba dispar
KELEMLEDDDIIYKLED

SEQ ID NO: 2489435 - protein, 21 aa, Entamoeba dispar
KELERIKGEIEVLKIKESGDS

SEQ ID NO: 2489436 - protein, 23 aa, Entamoeba dispar
KELEYDKRIEIFKTYIHNDIKCH

SEQ ID NO: 2489437 - protein, 17 aa, Entamoeba dispar
KELEYEKRIEIFKTYIH

SEQ ID NO: 2489438 - protein, 26 aa, Entamoeba dispar
KELFGREEINVCKKISSLRKKLWMEH

SEQ ID NO: 2489439 - protein, 20 aa, Entamoeba dispar
KELFYGCSNLTLIDFGYGWN

SEQ ID NO: 2489440 - protein, 18 aa, Entamoeba dispar
KELGDFLCCHGGISPDMS

SEQ ID NO: 2489441 - protein, 19 aa, Entamoeba dispar
KELGDFLCCHGGISPDMSS

SEQ ID NO: 2489442 - protein, 23 aa, Entamoeba dispar
KELGEVMTKLGYEDFDIINDIGF

SEQ ID NO: 2489443 - protein, 18 aa, Entamoeba dispar
KELGRAEGYTAFLTAQTT

SEQ ID NO: 2489444 - protein, 19 aa, Entamoeba dispar
KELHINYGQEPFLYNIYKE

SEQ ID NO: 2489445 - protein, 24 aa, Entamoeba dispar
KELHKEFNVPLNRVVDLDECDDKK

SEQ ID NO: 2489446 - protein, 20 aa, Entamoeba dispar
KELHKTYLMLVQKSNIQLQV

SEQ ID NO: 2489447 - protein, 20 aa, Entamoeba dispar
KELHLRKCSIPAIVLKEIIE

SEQ ID NO: 2489448 - protein, 18 aa, Entamoeba dispar
KELIKRNDIDSLHKYFPL

SEQ ID NO: 2489449 - protein, 29 aa, Entamoeba dispar
KELILPPLEELRPFPSNRNGVVKVKEVMR

SEQ ID NO: 2489450 - protein, 25 aa, Entamoeba dispar
KELIRKELKYEIQININGNNCIITA

SEQ ID NO: 2489451 - protein, 17 aa, Entamoeba dispar
KELKAMVIPNTIKEIRE

SEQ ID NO: 2489452 - protein, 21 aa, Entamoeba dispar
KELKASSIGKLICIKGTVIRA

SEQ ID NO: 2489453 - protein, 25 aa, Entamoeba dispar
KELKIIKCINILSSIALNGKITSSN

SEQ ID NO: 2489454 - protein, 23 aa, Entamoeba dispar
KELKIKFVGELGVDQGGVSKEWF

SEQ ID NO: 2489455 - protein, 17 aa, Entamoeba dispar
KELKIKLNDKLFKTIEL

SEQ ID NO: 2489456 - protein, 21 aa, Entamoeba dispar
KELKISSPISVLNQTNEKVKV

SEQ ID NO: 2489457 - protein, 25 aa, Entamoeba dispar
KELKKCWGESVIKELEKTDILEWLK

SEQ ID NO: 2489458 - protein, 17 aa, Entamoeba dispar
KELKKLPKYLGEETEDS

SEQ ID NO: 2489459 - protein, 22 aa, Entamoeba dispar
KELKTKFGQVVLKCYKHSIFFF

SEQ ID NO: 2489460 - protein, 19 aa, Entamoeba dispar
KELKTKLSKEVKNLIDELT

SEQ ID NO: 2489461 - protein, 17 aa, Entamoeba dispar
KELLAKTFADLRKSDMT

SEQ ID NO: 2489462 - protein, 26 aa, Entamoeba dispar
KELLIKKGEMPFFQFVLNVKSFGQTV

SEQ ID NO: 2489463 - protein, 28 aa, Entamoeba dispar
KELLKRLVLNCFYHFNSLFSSFHKEIIR

SEQ ID NO: 2489464 - protein, 22 aa, Entamoeba dispar
KELLKVLFVLHIQWTQYEGDWI

SEQ ID NO: 2489465 - protein, 19 aa, Entamoeba dispar
KELLSLKIRTSFNNYIIKA

SEQ ID NO: 2489466 - protein, 19 aa, Entamoeba dispar
KELMERIAQIKILDPEQSR

SEQ ID NO: 2489467 - protein, 21 aa, Entamoeba dispar
KELNICKSLINSNPQEIKHSP

SEQ ID NO: 2489468 - protein, 21 aa, Entamoeba dispar
KELNSLVSITPRIPVYSFWIS

SEQ ID NO: 2489469 - protein, 25 aa, Entamoeba dispar
KELPFKYGFIEPWYSNNFIFESCSI

SEQ ID NO: 2489470 - protein, 25 aa, Entamoeba dispar
KELPIKGGNGILYCSLYITKYQMIN

SEQ ID NO: 2489471 - protein, 23 aa, Entamoeba dispar
KELPLLIIGSYYFRQRIQENNII

SEQ ID NO: 2489472 - protein, 27 aa, Entamoeba dispar
KELQLPILDCRALRVQGKFNDGKIIGE

SEQ ID NO: 2489473 - protein, 23 aa, Entamoeba dispar
KELRFNCYDVFCLDSLDDRMILS

SEQ ID NO: 2489474 - protein, 19 aa, Entamoeba dispar
KELRNQLNDERKEWKEEKE

SEQ ID NO: 2489475 - protein, 21 aa, Entamoeba dispar
KELSGLPLLVYANKFDLLQSK

SEQ ID NO: 2489476 - protein, 24 aa, Entamoeba dispar
KELTPFECAFIRHYKDLGIEIKEN

SEQ ID NO: 2489477 - protein, 17 aa, Entamoeba dispar
KELTRKWFIRITSSIYS

SEQ ID NO: 2489478 - protein, 20 aa, Entamoeba dispar
KELTRLTKLFILRRTSKVNQ

SEQ ID NO: 2489479 - protein, 21 aa, Entamoeba dispar
KELVPEFYSNINFLNNKEHVY

SEQ ID NO: 2489480 - protein, 20 aa, Entamoeba dispar
KELYFHVWMNSFFKESIGTL

SEQ ID NO: 2489481 - protein, 21 aa, Entamoeba dispar
KELYHTLKLAYGKEYIKIIPE

SEQ ID NO: 2489482 - protein, 27 aa, Entamoeba dispar
KEMCELFRIDLFGSIVYSILIEKTRKL

SEQ ID NO: 2489483 - protein, 25 aa, Entamoeba dispar
KEMEASELLESWSEAMKKLKFMVEL

SEQ ID NO: 2489484 - protein, 19 aa, Entamoeba dispar
KEMEEVYILLKENYVEDDD

SEQ ID NO: 2489485 - protein, 17 aa, Entamoeba dispar
KEMENILGLNQPQNLMC

SEQ ID NO: 2489486 - protein, 26 aa, Entamoeba dispar
KEMERCGLCYFEGYVQNDCINYVLTQ

SEQ ID NO: 2489487 - protein, 26 aa, Entamoeba dispar
KEMGCCFYTKYQIIKFIGSGSFGKVF

SEQ ID NO: 2489488 - protein, 17 aa, Entamoeba dispar
KEMHVNIDLSRENGETA

SEQ ID NO: 2489489 - protein, 21 aa, Entamoeba dispar
KEMIGLYFERSGFKVIDKSES

SEQ ID NO: 2489490 - protein, 19 aa, Entamoeba dispar
KEMIQDMYAELGVNQPKPT

SEQ ID NO: 2489491 - protein, 17 aa, Entamoeba dispar
KEMKAGGVQTIIMKCFD

SEQ ID NO: 2489492 - protein, 18 aa, Entamoeba dispar
KEMKEFRENCGFAQTTAR

SEQ ID NO: 2489493 - protein, 19 aa, Entamoeba dispar
KEMKIFGGLETLHIDINSL

SEQ ID NO: 2489494 - protein, 26 aa, Entamoeba dispar
KEMLNKEVLLKITRKALTVFPELLIK

SEQ ID NO: 2489495 - protein, 20 aa, Entamoeba dispar
KEMLQKYCLGYLLQNDSEFK

SEQ ID NO: 2489496 - protein, 20 aa, Entamoeba dispar
KEMLSGWMKKSLVIADKNWE

SEQ ID NO: 2489497 - protein, 24 aa, Entamoeba dispar
KEMNELKQRIEIIEEENNVLRKEN

SEQ ID NO: 2489498 - protein, 17 aa, Entamoeba dispar
KEMNNKFVFIEEVIHGL

SEQ ID NO: 2489499 - protein, 17 aa, Entamoeba dispar
KEMRVAIINGIKDNIND

SEQ ID NO: 2489500 - protein, 33 aa, Entamoeba dispar
KEMSKLKLDVIEFNKRIATSVKEIAGLMDEIKK

SEQ ID NO: 2489501 - protein, 17 aa, Entamoeba dispar
KEMSRVTFKMIHSGENC

SEQ ID NO: 2489502 - protein, 23 aa, Entamoeba dispar
KEMTMPVPCFNVINGGAHAGNAL

SEQ ID NO: 2489503 - protein, 23 aa, Entamoeba dispar
KEMVLRCIDYLIKQEKTPIVSSY

SEQ ID NO: 2489504 - protein, 26 aa, Entamoeba dispar
KENDARLGYVSAMAVAPSGEYCIIGT

SEQ ID NO: 2489505 - protein, 28 aa, Entamoeba dispar
KENEIETLKNFIPHEDEIIISTKEITNL

SEQ ID NO: 2489506 - protein, 21 aa, Entamoeba dispar
KENFGLLASNEIEWSKKVRQE

SEQ ID NO: 2489507 - protein, 21 aa, Entamoeba dispar
KENFPELRLLDISHNHIKKIK

SEQ ID NO: 2489508 - protein, 22 aa, Entamoeba dispar
KENHGFCLYNKQLFIDYILPKH

SEQ ID NO: 2489509 - protein, 20 aa, Entamoeba dispar
KENHVSIAFVGHRFVHGGSY

SEQ ID NO: 2489510 - protein, 21 aa, Entamoeba dispar
KENIHIIKSLLIKINNILETV

SEQ ID NO: 2489511 - protein, 25 aa, Entamoeba dispar
KENIITVGICLNGKPLINKQLNENL

SEQ ID NO: 2489512 - protein, 25 aa, Entamoeba dispar
KENIVTVGICLNGKPLINKQLNENL

SEQ ID NO: 2489513 - protein, 25 aa, Entamoeba dispar
KENKERINILISRYIPIEKNNELTK

SEQ ID NO: 2489514 - protein, 25 aa, Entamoeba dispar
KENKPQLSRLFLMLKQHTKQSSIYQ

SEQ ID NO: 2489515 - protein, 25 aa, Entamoeba dispar
KENKRFGIDTTHIFYDLFKNTNFNS

SEQ ID NO: 2489516 - protein, 30 aa, Entamoeba dispar
KENLLFLCSCLPCISLGMNCKLNNKIITPT

SEQ ID NO: 2489517 - protein, 20 aa, Entamoeba dispar
KENTDLYSNVGLKMNGIDGV

SEQ ID NO: 2489518 - protein, 29 aa, Entamoeba dispar
KENYKIHFYYRFLIILTDYKMYIYNMRKM

SEQ ID NO: 2489519 - protein, 21 aa, Entamoeba dispar
KEPGHTCCVLIRAVHSGKFLG

SEQ ID NO: 2489520 - protein, 22 aa, Entamoeba dispar
KEPIRIEICPTQHGVVRPVPHR

SEQ ID NO: 2489521 - protein, 17 aa, Entamoeba dispar
KEPKRPREDVVIEFIDE

SEQ ID NO: 2489522 - protein, 18 aa, Entamoeba dispar
KEPLKSIFIEELPRMLGL

SEQ ID NO: 2489523 - protein, 17 aa, Entamoeba dispar
KEPLRILVDEQFLQETN

SEQ ID NO: 2489524 - protein, 21 aa, Entamoeba dispar
KEPPFAYWIYYVHTNIHVLNN

SEQ ID NO: 2489525 - protein, 18 aa, Entamoeba dispar
KEPPRIRIVKKLAGGVCF

SEQ ID NO: 2489526 - protein, 21 aa, Entamoeba dispar
KEPYSKPGWDNMTLLVVKFKS

SEQ ID NO: 2489527 - protein, 27 aa, Entamoeba dispar
KEQAEELARLWGISFIETSAKKKSNIN

SEQ ID NO: 2489528 - protein, 29 aa, Entamoeba dispar
KEQFGGKLKFIFNGGAPLTYGLYEWLRVC

SEQ ID NO: 2489529 - protein, 18 aa, Entamoeba dispar
KEQIIIFCDSIIVLKEIS

SEQ ID NO: 2489530 - protein, 23 aa, Entamoeba dispar
KEQIKIDPFISLKKLTKSKYYQE

SEQ ID NO: 2489531 - protein, 22 aa, Entamoeba dispar
KEQKKIYHWYVKRYSEKESMVL

SEQ ID NO: 2489532 - protein, 26 aa, Entamoeba dispar
KEQKKWFPEKTCPFILSYLLSEQSNV

SEQ ID NO: 2489533 - protein, 24 aa, Entamoeba dispar
KEQLEEINRSYSLKFISEVASHAV

SEQ ID NO: 2489534 - protein, 19 aa, Entamoeba dispar
KEQPNYIVPIRVSTSSEHP

SEQ ID NO: 2489535 - protein, 22 aa, Entamoeba dispar
KEQPVEMNLMDFLGTESITEEI

SEQ ID NO: 2489536 - protein, 37 aa, Entamoeba dispar
KEQSYVIGCDCCFYIRSNCPCHVPSNFCDNYNEPSGK

SEQ ID NO: 2489537 - protein, 19 aa, Entamoeba dispar
KEREYWVEYIIRELNNTQE

SEQ ID NO: 2489538 - protein, 20 aa, Entamoeba dispar
KERFKNIPILSVEHTDEKLR

SEQ ID NO: 2489539 - protein, 23 aa, Entamoeba dispar
KERFWSNVYGFDFSCILSDVTVD

SEQ ID NO: 2489540 - protein, 19 aa, Entamoeba dispar
KERGEGVVKFIIDGHQLGV

SEQ ID NO: 2489541 - protein, 21 aa, Entamoeba dispar
KERICETPKYFKEAVETINQM

SEQ ID NO: 2489542 - protein, 20 aa, Entamoeba dispar
KERIEGYITLTFNKPIFIKN

SEQ ID NO: 2489543 - protein, 27 aa, Entamoeba dispar
KERINSCIPLEGLFRGIKGYYNYSLII

SEQ ID NO: 2489544 - protein, 17 aa, Entamoeba dispar
KERIRIEEVVRMLEIIK

SEQ ID NO: 2489545 - protein, 18 aa, Entamoeba dispar
KERITIKEVVRMLERIEN

SEQ ID NO: 2489546 - protein, 18 aa, Entamoeba dispar
KERIWKLHRCVFVICKNE

SEQ ID NO: 2489547 - protein, 17 aa, Entamoeba dispar
KERKKREGSGMVSLNAL

SEQ ID NO: 2489548 - protein, 27 aa, Entamoeba dispar
KERKSLGWMAPLYKEYPGGEEVMFKER

SEQ ID NO: 2489549 - protein, 17 aa, Entamoeba dispar
KERLEFRKEYIKALEEI

SEQ ID NO: 2489550 - protein, 28 aa, Entamoeba dispar
KERLQNCDFSKFPKLDMRVINAVDDALG

SEQ ID NO: 2489551 - protein, 26 aa, Entamoeba dispar
KERLRRFNHMSSWGVLLMTIRVGACG

SEQ ID NO: 2489552 - protein, 22 aa, Entamoeba dispar
KERMAKEWVEENIKSIDFWENF

SEQ ID NO: 2489553 - protein, 20 aa, Entamoeba dispar
KERMQWDDFFIHPFIQRCRD

SEQ ID NO: 2489554 - protein, 17 aa, Entamoeba dispar
KERNISIIYLVIGNCTQ

SEQ ID NO: 2489555 - protein, 25 aa, Entamoeba dispar
KERRLSYNSDLLWAINTVEKQLIAK

SEQ ID NO: 2489556 - protein, 25 aa, Entamoeba dispar
KERTILKKICDPYAININELKNNIA

SEQ ID NO: 2489557 - protein, 19 aa, Entamoeba dispar
KERVFVVEMGMKFSQRYTD

SEQ ID NO: 2489558 - protein, 17 aa, Entamoeba dispar
KESAAREVIRMKYGERG

SEQ ID NO: 2489559 - protein, 19 aa, Entamoeba dispar
KESAAREVIRMKYGERGMK

SEQ ID NO: 2489560 - protein, 21 aa, Entamoeba dispar
KESDECLSHLYSLDNAVKQEV

SEQ ID NO: 2489561 - protein, 19 aa, Entamoeba dispar
KESDKCKVETLPRRPTQSI

SEQ ID NO: 2489562 - protein, 23 aa, Entamoeba dispar
KESEIYCGMCQRYVHIPYCNLDD

SEQ ID NO: 2489563 - protein, 18 aa, Entamoeba dispar
KESEQFRVLSIENLQRKV

SEQ ID NO: 2489564 - protein, 18 aa, Entamoeba dispar
KESFLLFDGDGDGYLTLN

SEQ ID NO: 2489565 - protein, 18 aa, Entamoeba dispar
KESGVVFPLAEKIFNNMT

SEQ ID NO: 2489566 - protein, 17 aa, Entamoeba dispar
KESHIFANIPYSIIDVV

SEQ ID NO: 2489567 - protein, 19 aa, Entamoeba dispar
KESIELFEFYEKKKEIKEK

SEQ ID NO: 2489568 - protein, 21 aa, Entamoeba dispar
KESKIPIILFIDEIHTVLGAG

SEQ ID NO: 2489569 - protein, 22 aa, Entamoeba dispar
KESKIPIILFIDEIHTVLGAGA

SEQ ID NO: 2489570 - protein, 33 aa, Entamoeba dispar
KESKYQCPKCNILYCSIDCYKAHKINCKKKEAP

SEQ ID NO: 2489571 - protein, 24 aa, Entamoeba dispar
KESLCAGFPHFNTGYMRNWGRDTF

SEQ ID NO: 2489572 - protein, 24 aa, Entamoeba dispar
KESLKSIFQSGAFADECYNPFTKI

SEQ ID NO: 2489573 - protein, 24 aa, Entamoeba dispar
KESLKVIHFYVWDSIITPSGHEIT

SEQ ID NO: 2489574 - protein, 17 aa, Entamoeba dispar
KESLLIKPSSKIQCVTE

SEQ ID NO: 2489575 - protein, 22 aa, Entamoeba dispar
KESNQWLDPLRVFYEQINSEDQ

SEQ ID NO: 2489576 - protein, 25 aa, Entamoeba dispar
KESPEIIKKLIIKRLLQRTKADIKL

SEQ ID NO: 2489577 - protein, 22 aa, Entamoeba dispar
KESPESFYFLKRYTQLKSLSLI

SEQ ID NO: 2489578 - protein, 21 aa, Entamoeba dispar
KESRHGVAQVLSRLTFTSALA

SEQ ID NO: 2489579 - protein, 18 aa, Entamoeba dispar
KESRMKTSRYEEITIPYR

SEQ ID NO: 2489580 - protein, 24 aa, Entamoeba dispar
KESSSKLLFVEKLIKIFHSTEKKV

SEQ ID NO: 2489581 - protein, 19 aa, Entamoeba dispar
KESTMLFHYILQKFTINEI

SEQ ID NO: 2489582 - protein, 25 aa, Entamoeba dispar
KESTVVCLRWLMGAEFIVESCKPLI

SEQ ID NO: 2489583 - protein, 19 aa, Entamoeba dispar
KESVECMSDSLKIRVKVEW

SEQ ID NO: 2489584 - protein, 28 aa, Entamoeba dispar
KESVPILRSVCINPVLKGKRTEGILEAH

SEQ ID NO: 2489585 - protein, 22 aa, Entamoeba dispar
KESVTTCFTSFLTNTSKEKTTT

SEQ ID NO: 2489586 - protein, 19 aa, Entamoeba dispar
KETELMGKLLKPISLLISG

SEQ ID NO: 2489587 - protein, 18 aa, Entamoeba dispar
KETFEQLEYWLNDVKGNC

SEQ ID NO: 2489588 - protein, 18 aa, Entamoeba dispar
KETFKVAIDVVRGKAEEK

SEQ ID NO: 2489589 - protein, 21 aa, Entamoeba dispar
KETHATLPLFSVKERDQKGFR

SEQ ID NO: 2489590 - protein, 20 aa, Entamoeba dispar
KETIDISAILVDWDQDYVRC

SEQ ID NO: 2489591 - protein, 26 aa, Entamoeba dispar
KETIEFRLGGVFSFLNMLQPYFTHLY

SEQ ID NO: 2489592 - protein, 24 aa, Entamoeba dispar
KETIGDKGQDEFIRPVFVPDSDSP

SEQ ID NO: 2489593 - protein, 28 aa, Entamoeba dispar
KETISITSFRAYFALSLHYGIRYLEKEK

SEQ ID NO: 2489594 - protein, 20 aa, Entamoeba dispar
KETKIEFEVYAVFVKPVPYS

SEQ ID NO: 2489595 - protein, 18 aa, Entamoeba dispar
KETKKLAKKELKDEKKMT

SEQ ID NO: 2489596 - protein, 24 aa, Entamoeba dispar
KETLKGFITWCYTNKIEMEMKECL

SEQ ID NO: 2489597 - protein, 18 aa, Entamoeba dispar
KETMKMTTTLLLHENDEN

SEQ ID NO: 2489598 - protein, 22 aa, Entamoeba dispar
KETNGKCQFIIGGMAPMDDPYA

SEQ ID NO: 2489599 - protein, 19 aa, Entamoeba dispar
KETRFQIITGPNMGGKSTY

SEQ ID NO: 2489600 - protein, 24 aa, Entamoeba dispar
KETSFGLSETVIFVRNLPFSMDSF

SEQ ID NO: 2489601 - protein, 23 aa, Entamoeba dispar
KETSKLISLRSYLFSIPMFHYLQ

SEQ ID NO: 2489602 - protein, 27 aa, Entamoeba dispar
KETYDNCPILLKRVNEFITNSLTTLLK

SEQ ID NO: 2489603 - protein, 19 aa, Entamoeba dispar
KETYVALGKAFVLSDYDKL

SEQ ID NO: 2489604 - protein, 21 aa, Entamoeba dispar
KEVCLKYQVPFDEIQIKDQYK

SEQ ID NO: 2489605 - protein, 25 aa, Entamoeba dispar
KEVCSMVRPHISSVININDSKSIED

SEQ ID NO: 2489606 - protein, 22 aa, Entamoeba dispar
KEVDVKMGFLLLKNYLLNLPVP

SEQ ID NO: 2489607 - protein, 26 aa, Entamoeba dispar
KEVEIIECINRLSSIALNGKINSSNE

SEQ ID NO: 2489608 - protein, 19 aa, Entamoeba dispar
KEVILRWRRGKKESNKGKF

SEQ ID NO: 2489609 - protein, 21 aa, Entamoeba dispar
KEVISVPSFFFIFSDATSYIS

SEQ ID NO: 2489610 - protein, 23 aa, Entamoeba dispar
KEVKGEYKYLFDTIIPVNELKEC

SEQ ID NO: 2489611 - protein, 17 aa, Entamoeba dispar
KEVKHGYELMDQKTNDL

SEQ ID NO: 2489612 - protein, 18 aa, Entamoeba dispar
KEVKLFCKTDLLRGGMNE

SEQ ID NO: 2489613 - protein, 23 aa, Entamoeba dispar
KEVKQEAVVLFDYVSKGEYQLSA

SEQ ID NO: 2489614 - protein, 17 aa, Entamoeba dispar
KEVKYKLSETFNHKINM

SEQ ID NO: 2489615 - protein, 21 aa, Entamoeba dispar
KEVLDGFQLEIKVGKIIEAGP

SEQ ID NO: 2489616 - protein, 19 aa, Entamoeba dispar
KEVLERKGIDNLKVEFDTS

SEQ ID NO: 2489617 - protein, 17 aa, Entamoeba dispar
KEVLIVKSGEEWVETAF

SEQ ID NO: 2489618 - protein, 20 aa, Entamoeba dispar
KEVLKTDGFCIELFVNYDCD

SEQ ID NO: 2489619 - protein, 23 aa, Entamoeba dispar
KEVLLCSLLDLYQYILRTIKTNQ

SEQ ID NO: 2489620 - protein, 17 aa, Entamoeba dispar
KEVLLKKMVGNVSIKKM

SEQ ID NO: 2489621 - protein, 21 aa, Entamoeba dispar
KEVLMTCVFLNYGEQTLPPIY

SEQ ID NO: 2489622 - protein, 25 aa, Entamoeba dispar
KEVLPEHFEVFKLLCKLFTEIINRK

SEQ ID NO: 2489623 - protein, 17 aa, Entamoeba dispar
KEVLPSLPTRQEKFIYC

SEQ ID NO: 2489624 - protein, 18 aa, Entamoeba dispar
KEVLRKENKWGIICVDEK

SEQ ID NO: 2489625 - protein, 23 aa, Entamoeba dispar
KEVLRKENKWGIICVDEKERIFG

SEQ ID NO: 2489626 - protein, 20 aa, Entamoeba dispar
KEVLRNCIFNEFYDEKNQSI

SEQ ID NO: 2489627 - protein, 17 aa, Entamoeba dispar
KEVNCQMILSSKNERYI

SEQ ID NO: 2489628 - protein, 20 aa, Entamoeba dispar
KEVNKPLSIRFRPTKEQETE

SEQ ID NO: 2489629 - protein, 17 aa, Entamoeba dispar
  misc_feature (16)..(17): Xaa can be any naturally occurring amino acid
KEVNYGNIMRIIKIKXX

SEQ ID NO: 2489630 - protein, 25 aa, Entamoeba dispar
KEVPHWSSDMIYQFKENINKTHCKI

SEQ ID NO: 2489631 - protein, 28 aa, Entamoeba dispar
KEVQCIMKKLLLQKQMKGIWIHVKGVQS

SEQ ID NO: 2489632 - protein, 20 aa, Entamoeba dispar
KEVQTMFDLRGMKTEPFKKL

SEQ ID NO: 2489633 - protein, 28 aa, Entamoeba dispar
KEVSEEVGLKCGICWDTSSDVVSTACGH

SEQ ID NO: 2489634 - protein, 23 aa, Entamoeba dispar
KEVSLRQSPLLSLIDRIPNPSLK

SEQ ID NO: 2489635 - protein, 20 aa, Entamoeba dispar
KEVVDRLAGATNNVQYAHIS

SEQ ID NO: 2489636 - protein, 23 aa, Entamoeba dispar
KEVVEGICVIFNMIIQYHCPELI

SEQ ID NO: 2489637 - protein, 20 aa, Entamoeba dispar
KEWDDAVVKLGQKTAIFSSV

SEQ ID NO: 2489638 - protein, 17 aa, Entamoeba dispar
KEWDFSFIPTIELTLRL

SEQ ID NO: 2489639 - protein, 25 aa, Entamoeba dispar
KEWEKLRAIAIYNVFEQYDVINAVC

SEQ ID NO: 2489640 - protein, 18 aa, Entamoeba dispar
KEWKERIGLDVPKQISTE

SEQ ID NO: 2489641 - protein, 17 aa, Entamoeba dispar
KEWKFDEIGIIGIGYNE

SEQ ID NO: 2489642 - protein, 21 aa, Entamoeba dispar
KEWLSLCKKPEIQINKVIEQL

SEQ ID NO: 2489643 - protein, 27 aa, Entamoeba dispar
KEWMKGKREFIEYGYCMILEILIEQRK

SEQ ID NO: 2489644 - protein, 17 aa, Entamoeba dispar
KEWNDKIEMVVGDISKE

SEQ ID NO: 2489645 - protein, 23 aa, Entamoeba dispar
KEWNGKRIVIEFSEAQTSKRNRR

SEQ ID NO: 2489646 - protein, 21 aa, Entamoeba dispar
KEYAKMVALFNLVFNAFNIGG

SEQ ID NO: 2489647 - protein, 25 aa, Entamoeba dispar
KEYCKKECCCPRIKAFKKFMNTFEK

SEQ ID NO: 2489648 - protein, 19 aa, Entamoeba dispar
KEYDEVWPSIKEQVSSGVR

SEQ ID NO: 2489649 - protein, 26 aa, Entamoeba dispar
KEYDKMICQSCGPTSIVKKIQIPYVF

SEQ ID NO: 2489650 - protein, 18 aa, Entamoeba dispar
KEYFCFQDIKNLREQIKK

SEQ ID NO: 2489651 - protein, 19 aa, Entamoeba dispar
KEYFEKASKFEINNQRNKT

SEQ ID NO: 2489652 - protein, 21 aa, Entamoeba dispar
KEYFKGNIIFGECVGNSFKSC

SEQ ID NO: 2489653 - protein, 19 aa, Entamoeba dispar
KEYIIPWINYIKKRDEISS

SEQ ID NO: 2489654 - protein, 17 aa, Entamoeba dispar
KEYIKEISLEFVYTMKN

SEQ ID NO: 2489655 - protein, 17 aa, Entamoeba dispar
KEYIKYTPIQRGKNPPE

SEQ ID NO: 2489656 - protein, 18 aa, Entamoeba dispar
KEYKEKKQILDLKKEIKA

SEQ ID NO: 2489657 - protein, 20 aa, Entamoeba dispar
KEYKLNIILRYYNKSKSVIN

SEQ ID NO: 2489658 - protein, 17 aa, Entamoeba dispar
KEYKLNIIVRYYNKSKI

SEQ ID NO: 2489659 - protein, 25 aa, Entamoeba dispar
KEYLIKCSFPTLSLILNVISIEKCI

SEQ ID NO: 2489660 - protein, 20 aa, Entamoeba dispar
KEYLKGFSYLLKENVIQIIF

SEQ ID NO: 2489661 - protein, 18 aa, Entamoeba dispar
KEYLKMSFEYAKAQLNKC

SEQ ID NO: 2489662 - protein, 26 aa, Entamoeba dispar
KEYLKMVIVHFIKRPIFFNYFTSSQM

SEQ ID NO: 2489663 - protein, 19 aa, Entamoeba dispar
KEYLMKRVVELTQQNALIN

SEQ ID NO: 2489664 - protein, 25 aa, Entamoeba dispar
KEYLQNVKLLNEFFIKYNKKTNGMT

SEQ ID NO: 2489665 - protein, 21 aa, Entamoeba dispar
KEYLTPMIYSFDGMVFDDTLS

SEQ ID NO: 2489666 - protein, 19 aa, Entamoeba dispar
KEYMKLINFKGFNIDEALR

SEQ ID NO: 2489667 - protein, 21 aa, Entamoeba dispar
KEYPFFRIISITTENDEIPLA

SEQ ID NO: 2489668 - protein, 24 aa, Entamoeba dispar
KEYTKRYDCCLNVINQAKGLLDRL

SEQ ID NO: 2489669 - protein, 26 aa, Entamoeba dispar
KEYYQIAKYCTKFTIFHQDYIMREKR

SEQ ID NO: 2489670 - protein, 25 aa, Entamoeba dispar
KFAQVECIRMNYGRNKEGQFYLGNA

SEQ ID NO: 2489671 - protein, 18 aa, Entamoeba dispar
KFASVCVNPTWVPLCAEL

SEQ ID NO: 2489672 - protein, 19 aa, Entamoeba dispar
KFCRLSGGLRSMRCSAKTG

SEQ ID NO: 2489673 - protein, 22 aa, Entamoeba dispar
KFCSNCGTSINGSKFCPNCGEK

SEQ ID NO: 2489674 - protein, 28 aa, Entamoeba dispar
KFCYSISRRFIIMFTELIRLINRIIPSN

SEQ ID NO: 2489675 - protein, 24 aa, Entamoeba dispar
KFDDDRLIPVFGFGDSKTQDDTVF

SEQ ID NO: 2489676 - protein, 21 aa, Entamoeba dispar
KFDTLCEIYDSMTITQSVIFC

SEQ ID NO: 2489677 - protein, 19 aa, Entamoeba dispar
KFEEYAHFINLYKRIMNDY

SEQ ID NO: 2489678 - protein, 19 aa, Entamoeba dispar
KFEGIKFPTPNGIGDVAKV

SEQ ID NO: 2489679 - protein, 24 aa, Entamoeba dispar
KFELTLPLSLQKLFIFSSKFTIPN

SEQ ID NO: 2489680 - protein, 38 aa, Entamoeba dispar
KFESTRSICCSSFIKKLVIRSSQEFPCKLSQYTQLINL

SEQ ID NO: 2489681 - protein, 27 aa, Entamoeba dispar
KFETLLFRCNEILKFEDIHSIEYVYST

SEQ ID NO: 2489682 - protein, 21 aa, Entamoeba dispar
KFFGSVPYWIAQLIEIENNIH

SEQ ID NO: 2489683 - protein, 22 aa, Entamoeba dispar
KFFKLEMNGWVFKSRDEYEMEN

SEQ ID NO: 2489684 - protein, 24 aa, Entamoeba dispar
KFFSEGKVIPWTCEEDQILVSNDT

SEQ ID NO: 2489685 - protein, 24 aa, Entamoeba dispar
KFFTPETIDSVFLITDMSIYNKVK

SEQ ID NO: 2489686 - protein, 19 aa, Entamoeba dispar
KFFVETFVREVKWKTFDLK

SEQ ID NO: 2489687 - protein, 18 aa, Entamoeba dispar
KFGDGCFYECGCKEELMK

SEQ ID NO: 2489688 - protein, 26 aa, Entamoeba dispar
KFGDSCFYQCHYRLFKDYILPERCFI

SEQ ID NO: 2489689 - protein, 27 aa, Entamoeba dispar
KFGEMELRAFLVFDVYKEVKKEEKVIE

SEQ ID NO: 2489690 - protein, 17 aa, Entamoeba dispar
KFGPFVNNVFIVLKEKF

SEQ ID NO: 2489691 - protein, 26 aa, Entamoeba dispar
KFHAKWNPTCQCVFQTLADIRINDEK

SEQ ID NO: 2489692 - protein, 18 aa, Entamoeba dispar
KFHGPKGVGALFIRAGKP

SEQ ID NO: 2489693 - protein, 25 aa, Entamoeba dispar
KFIDFASEIDLNFMIDEIYTKAVEY

SEQ ID NO: 2489694 - protein, 20 aa, Entamoeba dispar
KFIDFCIISDSQIGVIFDKS

SEQ ID NO: 2489695 - protein, 21 aa, Entamoeba dispar
KFIDWKCIVGKLTVKQRNIIA

SEQ ID NO: 2489696 - protein, 18 aa, Entamoeba dispar
KFIEKWAYPLCSQVYYYP

SEQ ID NO: 2489697 - protein, 21 aa, Entamoeba dispar
KFIGSGSFGKVFQIKRMNNNK

SEQ ID NO: 2489698 - protein, 19 aa, Entamoeba dispar
KFIHLMEVILLMGNFLNSG

SEQ ID NO: 2489699 - protein, 25 aa, Entamoeba dispar
KFIIPSSITKLGFCCFKECSTLKSI

SEQ ID NO: 2489700 - protein, 19 aa, Entamoeba dispar
KFIKGSKFIAAQIVNGIGL

SEQ ID NO: 2489701 - protein, 25 aa, Entamoeba dispar
KFIKKDCYKTMMFWNQPNELDAVIS

SEQ ID NO: 2489702 - protein, 23 aa, Entamoeba dispar
KFILCDSEKSFTYEYSFIRENVI

SEQ ID NO: 2489703 - protein, 20 aa, Entamoeba dispar
KFILRLLEKNGFLIQITKDI

SEQ ID NO: 2489704 - protein, 19 aa, Entamoeba dispar
KFIRGGRKFLIQLICSVID

SEQ ID NO: 2489705 - protein, 23 aa, Entamoeba dispar
KFIRKLRQWKLYGRLILANKRLQ

SEQ ID NO: 2489706 - protein, 19 aa, Entamoeba dispar
KFIYCPLTPKQRSMYLEYV

SEQ ID NO: 2489707 - protein, 19 aa, Entamoeba dispar
KFKELLVKSNCRIDNTHFN

SEQ ID NO: 2489708 - protein, 19 aa, Entamoeba dispar
KFKFICNGTLCNEDQAKMI

SEQ ID NO: 2489709 - protein, 18 aa, Entamoeba dispar
KFKGIIGGYAQMKQVDEF

SEQ ID NO: 2489710 - protein, 27 aa, Entamoeba dispar
KFKKFPTGSVICFELKLIKTLKKNWEI

SEQ ID NO: 2489711 - protein, 23 aa, Entamoeba dispar
KFKPESVPLCVSLVQFEKEFIAD

SEQ ID NO: 2489712 - protein, 17 aa, Entamoeba dispar
KFKRESRENSGMIMSAM

SEQ ID NO: 2489713 - protein, 21 aa, Entamoeba dispar
KFKSDSWKYIGEIAKKASKTL

SEQ ID NO: 2489714 - protein, 20 aa, Entamoeba dispar
KFKTIVPFLKAYKQFVSYNE

SEQ ID NO: 2489715 - protein, 20 aa, Entamoeba dispar
KFKYESRHLHAMKRQRGEGG

SEQ ID NO: 2489716 - protein, 26 aa, Entamoeba dispar
KFLFTRRSHLNWARFDKTETDVYKRQ

SEQ ID NO: 2489717 - protein, 25 aa, Entamoeba dispar
KFLIKCSSYIPSHFKTILRKIYHRV

SEQ ID NO: 2489718 - protein, 23 aa, Entamoeba dispar
KFLNSRIDILVVEYFKILQLQQK

SEQ ID NO: 2489719 - protein, 17 aa, Entamoeba dispar
KFLQQELHPKLLKSLSD

SEQ ID NO: 2489720 - protein, 17 aa, Entamoeba dispar
KFLREMKEKVFPYEVSM

SEQ ID NO: 2489721 - protein, 29 aa, Entamoeba dispar
KFLSKEFFQEILILPPPIIQYPFYSHIQL

SEQ ID NO: 2489722 - protein, 18 aa, Entamoeba dispar
KFLYELPTPLIPQTNIKY

SEQ ID NO: 2489723 - protein, 30 aa, Entamoeba dispar
KFMDSRGYAAIPMMYIRNTIMRLMSTDVKQ

SEQ ID NO: 2489724 - protein, 26 aa, Entamoeba dispar
KFMRKKLGKTSCVWANSQNKVLYSVK

SEQ ID NO: 2489725 - protein, 17 aa, Entamoeba dispar
KFMSIKRFKECVDNIDL

SEQ ID NO: 2489726 - protein, 26 aa, Entamoeba dispar
KFMVKEQYGGWTISFEYIQTLGNIIA

SEQ ID NO: 2489727 - protein, 24 aa, Entamoeba dispar
KFNDKKWLCLMKEEEQIELLATIV

SEQ ID NO: 2489728 - protein, 24 aa, Entamoeba dispar
KFNGLNIGEKMFKYMDSHPATVKE

SEQ ID NO: 2489729 - protein, 19 aa, Entamoeba dispar
KFNIYKGFGKYISSIGMEF

SEQ ID NO: 2489730 - protein, 30 aa, Entamoeba dispar
KFNKSLKTFQCMRCMKLTKIELPITVESIK

SEQ ID NO: 2489731 - protein, 27 aa, Entamoeba dispar
KFNKSLKTFQCMRCMKLTKTELPITVE

SEQ ID NO: 2489732 - protein, 30 aa, Entamoeba dispar
KFNLKDIRLRPRYLMKFLDTDGDWVTLIDD

SEQ ID NO: 2489733 - protein, 18 aa, Entamoeba dispar
KFNPCIEKEKDIIGALNK

SEQ ID NO: 2489734 - protein, 25 aa, Entamoeba dispar
KFPEKIPFRLTRMIVNAMEVSGIEG

SEQ ID NO: 2489735 - protein, 17 aa, Entamoeba dispar
KFQIIWPTEDFIRTSET

SEQ ID NO: 2489736 - protein, 20 aa, Entamoeba dispar
KFQRCDRFIQPISIEEIKKM

SEQ ID NO: 2489737 - protein, 20 aa, Entamoeba dispar
KFQWNSRINKEIQIINERIN

SEQ ID NO: 2489738 - protein, 24 aa, Entamoeba dispar
KFREINVSLHLKKNPIPLLIFVNV

SEQ ID NO: 2489739 - protein, 20 aa, Entamoeba dispar
KFRPFLDACFGLEVVGKSIA

SEQ ID NO: 2489740 - protein, 18 aa, Entamoeba dispar
KFRSFKCYDPDINKDLEL

SEQ ID NO: 2489741 - protein, 19 aa, Entamoeba dispar
KFSAKEAKLELDGQRHEIN

SEQ ID NO: 2489742 - protein, 24 aa, Entamoeba dispar
KFSDGECYYRIAIPERTSLVGRDV

SEQ ID NO: 2489743 - protein, 18 aa, Entamoeba dispar
KFSEISFDQKVYYDKATI

SEQ ID NO: 2489744 - protein, 17 aa, Entamoeba dispar
KFSIEIMDQSIMAREIY

SEQ ID NO: 2489745 - protein, 23 aa, Entamoeba dispar
KFSKKSNRFIAFIDFDSYENAVA

SEQ ID NO: 2489746 - protein, 20 aa, Entamoeba dispar
KFSLELRSVKNLKKLKLNGV

SEQ ID NO: 2489747 - protein, 27 aa, Entamoeba dispar
KFSLPRMTVGAFGTCLNTIWKSITNQD

SEQ ID NO: 2489748 - protein, 20 aa, Entamoeba dispar
KFSNSGKIIPQYLYDDQLSL

SEQ ID NO: 2489749 - protein, 27 aa, Entamoeba dispar
KFSPPTGELERSWKALVNEDAKMEKIA

SEQ ID NO: 2489750 - protein, 20 aa, Entamoeba dispar
KFSSKLTHWNLIFEETKEFI

SEQ ID NO: 2489751 - protein, 18 aa, Entamoeba dispar
KFTAEALWSMGRINGYDL

SEQ ID NO: 2489752 - protein, 23 aa, Entamoeba dispar
KFTFPDGHSILLLAEGRLVNLGC

SEQ ID NO: 2489753 - protein, 22 aa, Entamoeba dispar
KFTPRASMIQLVKGCPEEQIKI

SEQ ID NO: 2489754 - protein, 24 aa, Entamoeba dispar
KFTTIKKVRMVSDFMTDEEELLRL

SEQ ID NO: 2489755 - protein, 19 aa, Entamoeba dispar
KFTVSNGYFCLYPYASGVF

SEQ ID NO: 2489756 - protein, 28 aa, Entamoeba dispar
KFVCKEKDNFLCFLISFGMTSSPPIWLY

SEQ ID NO: 2489757 - protein, 21 aa, Entamoeba dispar
KFVFFLFKPFYFRIFLMYRKL

SEQ ID NO: 2489758 - protein, 26 aa, Entamoeba dispar
KFVLYAICIHANVALKPVLIVRLGDK

SEQ ID NO: 2489759 - protein, 17 aa, Entamoeba dispar
KFWYFTLKNSGYLDIVF

SEQ ID NO: 2489760 - protein, 25 aa, Entamoeba dispar
KFYIEKIVLQLTFVFAHKPSSQEQK

SEQ ID NO: 2489761 - protein, 25 aa, Entamoeba dispar
KFYLRNGNKWMCLENGILNDVNPKV

SEQ ID NO: 2489762 - protein, 22 aa, Entamoeba dispar
KFYNIAVEWLRQSLFSERILPD

SEQ ID NO: 2489763 - protein, 17 aa, Entamoeba dispar
KFYTRIFTNLTINLPSL

SEQ ID NO: 2489764 - protein, 17 aa, Entamoeba dispar
KGACVPFIAVVTKDLTF

SEQ ID NO: 2489765 - protein, 22 aa, Entamoeba dispar
KGAGSCCLVLQSLLPILISIEG

SEQ ID NO: 2489766 - protein, 17 aa, Entamoeba dispar
KGAILFCVTRGRLSEGI

SEQ ID NO: 2489767 - protein, 21 aa, Entamoeba dispar
KGAVKLIFLNKMDLFEEKLTK

SEQ ID NO: 2489768 - protein, 18 aa, Entamoeba dispar
KGAVLNLLGIELPEEDKE

SEQ ID NO: 2489769 - protein, 20 aa, Entamoeba dispar
KGCFTGCSSLGQITIPSKIT

SEQ ID NO: 2489770 - protein, 19 aa, Entamoeba dispar
KGCIMACNNLAVLQMIEGD

SEQ ID NO: 2489771 - protein, 20 aa, Entamoeba dispar
KGCKGEIDKEYGLNKEIREL

SEQ ID NO: 2489772 - protein, 19 aa, Entamoeba dispar
KGDEEFLVIASDGFWDVFS

SEQ ID NO: 2489773 - protein, 17 aa, Entamoeba dispar
KGDHVLHSHAYPIFQTS

SEQ ID NO: 2489774 - protein, 25 aa, Entamoeba dispar
KGDYDIRGWFQWYCRYYIGRRGPSD

SEQ ID NO: 2489775 - protein, 20 aa, Entamoeba dispar
KGEALWDMELSGKTAFLAKL

SEQ ID NO: 2489776 - protein, 20 aa, Entamoeba dispar
KGEDEIEVMKLWKDEIDHKK

SEQ ID NO: 2489777 - protein, 22 aa, Entamoeba dispar
KGEECQTCRGTRTECPGHFGYI

SEQ ID NO: 2489778 - protein, 22 aa, Entamoeba dispar
KGEEIYISYGLVNRKNNKKIIG

SEQ ID NO: 2489779 - protein, 25 aa, Entamoeba dispar
KGEEKTGKVVKLWQPSLSDFKEKLK

SEQ ID NO: 2489780 - protein, 20 aa, Entamoeba dispar
KGEEVMRKWYIKEHPNRKVD

SEQ ID NO: 2489781 - protein, 30 aa, Entamoeba dispar
KGEGIDSYFKLKANFLAVALKTRTAEKSST

SEQ ID NO: 2489782 - protein, 27 aa, Entamoeba dispar
KGEGLKKNFLFNGDCLISIHVDMNSIS

SEQ ID NO: 2489783 - protein, 26 aa, Entamoeba dispar
KGEIIPKEINNFYGMITCYIQCKEEI

SEQ ID NO: 2489784 - protein, 21 aa, Entamoeba dispar
KGEIKEGIDYLLISKKNKKMI

SEQ ID NO: 2489785 - protein, 23 aa, Entamoeba dispar
KGEIKHKIAFWKLPVVACEYINN

SEQ ID NO: 2489786 - protein, 17 aa, Entamoeba dispar
KGEIRIIEIPQYEEPKV

SEQ ID NO: 2489787 - protein, 27 aa, Entamoeba dispar
KGELIQRPWFFQSLESLRFKEEIEGGR

SEQ ID NO: 2489788 - protein, 22 aa, Entamoeba dispar
KGENVFYYYAYNAFGGWVPTWV

SEQ ID NO: 2489789 - protein, 17 aa, Entamoeba dispar
KGERFVFLLCTRAGGIG

SEQ ID NO: 2489790 - protein, 19 aa, Entamoeba dispar
KGESILIHCSDGWDRTSQC

SEQ ID NO: 2489791 - protein, 22 aa, Entamoeba dispar
KGESKLSKIIFKNSYSTTTTPP

SEQ ID NO: 2489792 - protein, 23 aa, Entamoeba dispar
KGEVRSNITWKCRSIGAYYGEPS

SEQ ID NO: 2489793 - protein, 21 aa, Entamoeba dispar
KGFEISLNYSNKVTHVVVSSK

SEQ ID NO: 2489794 - protein, 22 aa, Entamoeba dispar
KGFFKPECKPAKVIGDATILLP

SEQ ID NO: 2489795 - protein, 17 aa, Entamoeba dispar
KGFKGEIQMKFKEQQKL

SEQ ID NO: 2489796 - protein, 32 aa, Entamoeba dispar
KGFMKKEDWFSVCKNFTLADGTFWPIPITMSV

SEQ ID NO: 2489797 - protein, 19 aa, Entamoeba dispar
KGFMKYCGQIQRIELPQSI

SEQ ID NO: 2489798 - protein, 20 aa, Entamoeba dispar
KGFMTTLIVDCYKCYRNRTQ

SEQ ID NO: 2489799 - protein, 20 aa, Entamoeba dispar
KGFNDYRAQAILSIGLTRKE

SEQ ID NO: 2489800 - protein, 29 aa, Entamoeba dispar
KGFPLGPAGSIVFKFKLKINENGLMELSA

SEQ ID NO: 2489801 - protein, 24 aa, Entamoeba dispar
KGFSILRSTWVLREEIEGNSRIDP

SEQ ID NO: 2489802 - protein, 20 aa, Entamoeba dispar
KGFSYKLKLGKKIHQNRGVP

SEQ ID NO: 2489803 - protein, 26 aa, Entamoeba dispar
KGFVNSCLELAWSQIQTFLIKVLNNR

SEQ ID NO: 2489804 - protein, 24 aa, Entamoeba dispar
KGGCGCGFCYACGKEVSHHSAHIL

SEQ ID NO: 2489805 - protein, 18 aa, Entamoeba dispar
KGGESLVSHSFVLPETKH

SEQ ID NO: 2489806 - protein, 19 aa, Entamoeba dispar
KGGESVWIGIIDLELNENH

SEQ ID NO: 2489807 - protein, 17 aa, Entamoeba dispar
KGGIRWVVESLMSDLSE

SEQ ID NO: 2489808 - protein, 23 aa, Entamoeba dispar
KGGSSKISMFWKLKEENNLIQQP

SEQ ID NO: 2489809 - protein, 20 aa, Entamoeba dispar
KGGYKGHLYPVGRKPELFGM

SEQ ID NO: 2489810 - protein, 19 aa, Entamoeba dispar
KGHKGFRAGLDVNSNTTGI

SEQ ID NO: 2489811 - protein, 20 aa, Entamoeba dispar
KGICITNAFNNAFLTSYDPY

SEQ ID NO: 2489812 - protein, 19 aa, Entamoeba dispar
KGIFKEAWIEFETEKQAKL

SEQ ID NO: 2489813 - protein, 28 aa, Entamoeba dispar
KGIFLRNYILDCVKSILPSSTTEEPSEG

SEQ ID NO: 2489814 - protein, 24 aa, Entamoeba dispar
KGIFPNEYVDLYFTIIKHSYSTFD

SEQ ID NO: 2489815 - protein, 21 aa, Entamoeba dispar
KGIGRSSCEPFSYEYNGDKHP

SEQ ID NO: 2489816 - protein, 23 aa, Entamoeba dispar
KGIGSLKWWFGVENNVSDYASLI

SEQ ID NO: 2489817 - protein, 18 aa, Entamoeba dispar
KGIHNTILESCNQLTTQI

SEQ ID NO: 2489818 - protein, 18 aa, Entamoeba dispar
KGIISIGCNKRKKISLPG

SEQ ID NO: 2489819 - protein, 18 aa, Entamoeba dispar
KGIKFNRPPPDPVLPITK

SEQ ID NO: 2489820 - protein, 17 aa, Entamoeba dispar
KGIKIKLNDEVISTVQI

SEQ ID NO: 2489821 - protein, 18 aa, Entamoeba dispar
KGIKIRTYDVCAKKFDEI

SEQ ID NO: 2489822 - protein, 19 aa, Entamoeba dispar
KGIKIRTYEVCAKKFDEIF

SEQ ID NO: 2489823 - protein, 28 aa, Entamoeba dispar
KGIKKASDIAHLIHRVLFGTPGSVEERK

SEQ ID NO: 2489824 - protein, 19 aa, Entamoeba dispar
KGIKRVIGRYSRRGNNLFI

SEQ ID NO: 2489825 - protein, 20 aa, Entamoeba dispar
KGILDERAMGIVIGNIKKWK

SEQ ID NO: 2489826 - protein, 25 aa, Entamoeba dispar
KGININKGLMCLIDLIQHKENWIPS

SEQ ID NO: 2489827 - protein, 18 aa, Entamoeba dispar
KGIQAIVVVLDINQDRFA

SEQ ID NO: 2489828 - protein, 19 aa, Entamoeba dispar
KGISKGCGFVDFENEENAK

SEQ ID NO: 2489829 - protein, 31 aa, Entamoeba dispar
KGISVGPFKLGMPLFEILKSLDIGPSATNSA

SEQ ID NO: 2489830 - protein, 17 aa, Entamoeba dispar
KGISVSTLHPFNPLAEM

SEQ ID NO: 2489831 - protein, 20 aa, Entamoeba dispar
KGIVECTTPDEWKKVIDDWK

SEQ ID NO: 2489832 - protein, 25 aa, Entamoeba dispar
KGIVECTTPDEWKKVIDDWKRMPSS

SEQ ID NO: 2489833 - protein, 25 aa, Entamoeba dispar
KGIYKFLPEFLVSLHYNFHTLLYPS

SEQ ID NO: 2489834 - protein, 25 aa, Entamoeba dispar
KGKALSLLCRMLFVHIVQKAVEKSV

SEQ ID NO: 2489835 - protein, 18 aa, Entamoeba dispar
KGKEIPKVNPIEFEKDDD

SEQ ID NO: 2489836 - protein, 19 aa, Entamoeba dispar
KGKELRIITGENFTFKILK

SEQ ID NO: 2489837 - protein, 20 aa, Entamoeba dispar
KGKERYGLVFIIDRKVSDNE

SEQ ID NO: 2489838 - protein, 21 aa, Entamoeba dispar
KGKEVKMIRCHNIKIIDTSNS

SEQ ID NO: 2489839 - protein, 22 aa, Entamoeba dispar
KGKEVKMVRCHFIKMVDTSNSI

SEQ ID NO: 2489840 - protein, 20 aa, Entamoeba dispar
KGKEVKMVRCHNIKIIDTSN

SEQ ID NO: 2489841 - protein, 19 aa, Entamoeba dispar
KGKHIFLEKESRASKLLTF

SEQ ID NO: 2489842 - protein, 23 aa, Entamoeba dispar
KGKICSACSVLFNVDLTRKCIQK

SEQ ID NO: 2489843 - protein, 20 aa, Entamoeba dispar
KGKIKIRIINTIRTNNRTEE

SEQ ID NO: 2489844 - protein, 26 aa, Entamoeba dispar
KGKIPSFAVCINRICQRIGEISRFME

SEQ ID NO: 2489845 - protein, 24 aa, Entamoeba dispar
KGKKRIEFLKSFNLDDLTPYTYIE

SEQ ID NO: 2489846 - protein, 25 aa, Entamoeba dispar
KGKKYQMMFEWGRIGGTLHNTFRNG

SEQ ID NO: 2489847 - protein, 20 aa, Entamoeba dispar
KGKLCKDIEYELYQFCEKMM

SEQ ID NO: 2489848 - protein, 17 aa, Entamoeba dispar
KGKLEVMTHGIPERIFA

SEQ ID NO: 2489849 - protein, 20 aa, Entamoeba dispar
KGKLFITQNYFCFRSQYGKK

SEQ ID NO: 2489850 - protein, 25 aa, Entamoeba dispar
KGKLIEIMCIYSIINTSFFPDSRQI

SEQ ID NO: 2489851 - protein, 25 aa, Entamoeba dispar
KGKLKKGRWSGMRVYDAEKEGGLIV

SEQ ID NO: 2489852 - protein, 23 aa, Entamoeba dispar
KGKLKRKSLRLNLPINTTETVVI

SEQ ID NO: 2489853 - protein, 35 aa, Entamoeba dispar
KGKLYDCIGSIFVEFSHFFKVYKLIVGNSEAVLAV

SEQ ID NO: 2489854 - protein, 19 aa, Entamoeba dispar
KGKPMLGIVSKPFYNNEIT

SEQ ID NO: 2489855 - protein, 17 aa, Entamoeba dispar
KGKQCTKALGYLKYLLT

SEQ ID NO: 2489856 - protein, 17 aa, Entamoeba dispar
KGKSFECEIDIQCLGGV

SEQ ID NO: 2489857 - protein, 24 aa, Entamoeba dispar
KGKTLKAKLLISITSTQGVSTGNS

SEQ ID NO: 2489858 - protein, 25 aa, Entamoeba dispar
KGKVKKARLFIKISSTEGIVTGQSE

SEQ ID NO: 2489859 - protein, 20 aa, Entamoeba dispar
KGKVPRAKKGVILGHEGVGE

SEQ ID NO: 2489860 - protein, 17 aa, Entamoeba dispar
KGKYVVLLFYPLDWTFV

SEQ ID NO: 2489861 - protein, 19 aa, Entamoeba dispar
KGLALKGLVLYLNYKREFY

SEQ ID NO: 2489862 - protein, 19 aa, Entamoeba dispar
KGLDYWRRVKVIVSGVHVP

SEQ ID NO: 2489863 - protein, 17 aa, Entamoeba dispar
KGLEEEVKKLTTEIQAL

SEQ ID NO: 2489864 - protein, 17 aa, Entamoeba dispar
KGLFWLNNIVGVYGIKV

SEQ ID NO: 2489865 - protein, 19 aa, Entamoeba dispar
KGLIQCASLQSLDLENNQL

SEQ ID NO: 2489866 - protein, 17 aa, Entamoeba dispar
KGLKNFKLISALSSSTI

SEQ ID NO: 2489867 - protein, 26 aa, Entamoeba dispar
KGLLTRWSYENQIYCGITAIIPTMMY

SEQ ID NO: 2489868 - protein, 18 aa, Entamoeba dispar
KGLMKCQIYHQYKAFVLP

SEQ ID NO: 2489869 - protein, 18 aa, Entamoeba dispar
KGLNGRIIYEFKTKSEFE

SEQ ID NO: 2489870 - protein, 32 aa, Entamoeba dispar
KGLNLCLFETIFNWRQVNGLKHDDYTRYRRFC

SEQ ID NO: 2489871 - protein, 24 aa, Entamoeba dispar
KGLPQKYRSLVTMKKQSMINTTWL

SEQ ID NO: 2489872 - protein, 18 aa, Entamoeba dispar
KGLQAIVIVLDINQDRFA

SEQ ID NO: 2489873 - protein, 17 aa, Entamoeba dispar
KGLQAIVVVLDINQDRF

SEQ ID NO: 2489874 - protein, 24 aa, Entamoeba dispar
KGLQSRLKILTAENEKLRKAGAGA

SEQ ID NO: 2489875 - protein, 20 aa, Entamoeba dispar
KGLTKYLIIYLCAKDNDYVN

SEQ ID NO: 2489876 - protein, 24 aa, Entamoeba dispar
KGLVSYHLSRFISRLIIKCKNIEY

SEQ ID NO: 2489877 - protein, 29 aa, Entamoeba dispar
KGMVKMSLPLAMFLSGISFDVYAENETIK

SEQ ID NO: 2489878 - protein, 20 aa, Entamoeba dispar
KGMYCLRLHVKQSFETELVK

SEQ ID NO: 2489879 - protein, 25 aa, Entamoeba dispar
KGNCHQRQALAYAFVAVSKGNEQYS

SEQ ID NO: 2489880 - protein, 17 aa, Entamoeba dispar
KGNDEGYSRRDERNYRG

SEQ ID NO: 2489881 - protein, 20 aa, Entamoeba dispar
KGNEELLGIDAIQLAFTRFM

SEQ ID NO: 2489882 - protein, 28 aa, Entamoeba dispar
KGNEGLLMPYLCCILQRIYVISSSYLED

SEQ ID NO: 2489883 - protein, 25 aa, Entamoeba dispar
KGNEIELSIGFAAIERVSVLPYNDL

SEQ ID NO: 2489884 - protein, 28 aa, Entamoeba dispar
KGNEKRIILLLKLLSKWEFESLNEEAKN

SEQ ID NO: 2489885 - protein, 32 aa, Entamoeba dispar
KGNENVMIFFFLKRNIIVGIYFITPLQPDKQI

SEQ ID NO: 2489886 - protein, 19 aa, Entamoeba dispar
KGNERKFCYSISRRFIIMF

SEQ ID NO: 2489887 - protein, 24 aa, Entamoeba dispar
KGNEYKFLFCVKGGGSANKSYLFQ

SEQ ID NO: 2489888 - protein, 19 aa, Entamoeba dispar
KGNHIIVKFTPTVDNCTMA

SEQ ID NO: 2489889 - protein, 19 aa, Entamoeba dispar
KGNIYNASLLKKFLIQSNV

SEQ ID NO: 2489890 - protein, 18 aa, Entamoeba dispar
KGNLRQLFIGQIKSPDDN

SEQ ID NO: 2489891 - protein, 26 aa, Entamoeba dispar
KGNNRPCFICGEIGHLDRDCPHKNEK

SEQ ID NO: 2489892 - protein, 17 aa, Entamoeba dispar
KGNRIIIATGRSIHETK

SEQ ID NO: 2489893 - protein, 18 aa, Entamoeba dispar
KGNTFTMLNWVKEGLEKE

SEQ ID NO: 2489894 - protein, 17 aa, Entamoeba dispar
KGNVFKGNYLIEECLTI

SEQ ID NO: 2489895 - protein, 20 aa, Entamoeba dispar
KGNVGFIFTKGDLYQLKAKL

SEQ ID NO: 2489896 - protein, 20 aa, Entamoeba dispar
KGNVQLVLLIGGTCKMPKII

SEQ ID NO: 2489897 - protein, 17 aa, Entamoeba dispar
KGPDYNSEIPFFREVPQ

SEQ ID NO: 2489898 - protein, 17 aa, Entamoeba dispar
KGPKVKAEIEVKEKKQK

SEQ ID NO: 2489899 - protein, 25 aa, Entamoeba dispar
KGPTKFKFGPPTSTTKRGRTEIKPP

SEQ ID NO: 2489900 - protein, 24 aa, Entamoeba dispar
KGQELRLKQQFFFTSASLQDIVRR

SEQ ID NO: 2489901 - protein, 19 aa, Entamoeba dispar
KGQHIGGIDECEMIQKKDG

SEQ ID NO: 2489902 - protein, 19 aa, Entamoeba dispar
KGQQLPITFETVISYSGDD

SEQ ID NO: 2489903 - protein, 17 aa, Entamoeba dispar
KGQSIQVPLKCDLEDLY

SEQ ID NO: 2489904 - protein, 27 aa, Entamoeba dispar
KGRELLNQLVAISWRDEVIKSQVIISS

SEQ ID NO: 2489905 - protein, 20 aa, Entamoeba dispar
KGRELLSFASNYQMKEIPSS

SEQ ID NO: 2489906 - protein, 22 aa, Entamoeba dispar
KGRHDFKARLFQFYTSEDNELL

SEQ ID NO: 2489907 - protein, 19 aa, Entamoeba dispar
KGRYKEVFETQSFEEFLLK

SEQ ID NO: 2489908 - protein, 27 aa, Entamoeba dispar
KGSCISSLLRMLSIPSIRKDVLQLVMS

SEQ ID NO: 2489909 - protein, 19 aa, Entamoeba dispar
KGSDIVLVVRVLRKSGDDI

SEQ ID NO: 2489910 - protein, 25 aa, Entamoeba dispar
KGSELRTTLLFNKGRVLEEMKLWDE

SEQ ID NO: 2489911 - protein, 19 aa, Entamoeba dispar
KGSESSSLISPRGISQTAL

SEQ ID NO: 2489912 - protein, 22 aa, Entamoeba dispar
KGSEVEGIFRTSASYKIVGRVK

SEQ ID NO: 2489913 - protein, 20 aa, Entamoeba dispar
KGSHGVHCKIELSDEDLNKR

SEQ ID NO: 2489914 - protein, 18 aa, Entamoeba dispar
KGSLKRVFAKDETMSGKI

SEQ ID NO: 2489915 - protein, 19 aa, Entamoeba dispar
KGSNILSRTKGDHCEKFNK

SEQ ID NO: 2489916 - protein, 20 aa, Entamoeba dispar
KGSRNRFAVRLMELDLLSRV

SEQ ID NO: 2489917 - protein, 18 aa, Entamoeba dispar
KGSVIAMAVNASKKEDAN

SEQ ID NO: 2489918 - protein, 20 aa, Entamoeba dispar
KGSVMYPELEEYFFHANPRS

SEQ ID NO: 2489919 - protein, 17 aa, Entamoeba dispar
KGTAITFVLNEDKDYIT

SEQ ID NO: 2489920 - protein, 20 aa, Entamoeba dispar
KGTDAMDVLYGRVYPLKLGY

SEQ ID NO: 2489921 - protein, 17 aa, Entamoeba dispar
KGTEFITQIGLLSLKDI

SEQ ID NO: 2489922 - protein, 20 aa, Entamoeba dispar
KGTESLLLHSIHGISSTAAS

SEQ ID NO: 2489923 - protein, 25 aa, Entamoeba dispar
KGTGIKMRLSAELRDIGIYNHLEQL

SEQ ID NO: 2489924 - protein, 24 aa, Entamoeba dispar
KGTHPSDGLALFISTILYLQSLAS

SEQ ID NO: 2489925 - protein, 19 aa, Entamoeba dispar
KGTKDLIAMGIMLGLTTSQ

SEQ ID NO: 2489926 - protein, 20 aa, Entamoeba dispar
KGTLVRRTYEFHKMLKRKFI

SEQ ID NO: 2489927 - protein, 30 aa, Entamoeba dispar
KGTLYELFCSYCLPFLFYKQIILVNRDLLM

SEQ ID NO: 2489928 - protein, 17 aa, Entamoeba dispar
KGTNDFYYAFIEYDRPE

SEQ ID NO: 2489929 - protein, 27 aa, Entamoeba dispar
KGVLKNCALIHILRVILWALREPISSN

SEQ ID NO: 2489930 - protein, 24 aa, Entamoeba dispar
KGVLKQLNCINGIVKGNQFGVIMP

SEQ ID NO: 2489931 - protein, 19 aa, Entamoeba dispar
KGVLPQLVELMCDEVDAIR

SEQ ID NO: 2489932 - protein, 17 aa, Entamoeba dispar
KGVRCVEVWDKENMVSA

SEQ ID NO: 2489933 - protein, 19 aa, Entamoeba dispar
KGVSAKVSFNTVWNTNYAY

SEQ ID NO: 2489934 - protein, 28 aa, Entamoeba dispar
KGVSTLMNFRVCFIKSISLQVSTDNGST

SEQ ID NO: 2489935 - protein, 29 aa, Entamoeba dispar
KGVSTLMNFRVCFIKSISLQVSTDNGSTW

SEQ ID NO: 2489936 - protein, 20 aa, Entamoeba dispar
KGVTTLELYIPISPLQLPTV

SEQ ID NO: 2489937 - protein, 17 aa, Entamoeba dispar
KGVVQRIGATMFTTTHQ

SEQ ID NO: 2489938 - protein, 22 aa, Entamoeba dispar
KGWCEICGNKLFSKGMYCAQCG

SEQ ID NO: 2489939 - protein, 19 aa, Entamoeba dispar
KGWIGGIIINMLKKDGHEV

SEQ ID NO: 2489940 - protein, 20 aa, Entamoeba dispar
KGWIGGIIINMLKKDRHEVF

SEQ ID NO: 2489941 - protein, 28 aa, Entamoeba dispar
KGWLQKELFCDVFGWVVQKIFIELKTGQ

SEQ ID NO: 2489942 - protein, 30 aa, Entamoeba dispar
KGWYPEKRLVCGLCQSVICYLKNVKPPGSN

SEQ ID NO: 2489943 - protein, 17 aa, Entamoeba dispar
KGYDLLIKNARELYTEF

SEQ ID NO: 2489944 - protein, 25 aa, Entamoeba dispar
KGYECKELSSLINQYWKGCVIDIGS

SEQ ID NO: 2489945 - protein, 20 aa, Entamoeba dispar
KGYEYLIKQVELIEDAHYNI

SEQ ID NO: 2489946 - protein, 18 aa, Entamoeba dispar
KGYINGCIKILCQKAQEI

SEQ ID NO: 2489947 - protein, 17 aa, Entamoeba dispar
KGYKINQVFDMNKMELI

SEQ ID NO: 2489948 - protein, 30 aa, Entamoeba dispar
KGYKKMFECLSEIPIYVGLEKAGFCSQESK

SEQ ID NO: 2489949 - protein, 20 aa, Entamoeba dispar
KGYMNNMAKFDSMWIQEHDR

SEQ ID NO: 2489950 - protein, 21 aa, Entamoeba dispar
KGYNSIRYFWDIGTLRIDAEE

SEQ ID NO: 2489951 - protein, 25 aa, Entamoeba dispar
KGYPSIRSSILFTDYCKAIGVKFPS

SEQ ID NO: 2489952 - protein, 22 aa, Entamoeba dispar
KGYQPNGRIVPIKPFDKDFQKF

SEQ ID NO: 2489953 - protein, 17 aa, Entamoeba dispar
KGYTLSKTFGIYIKNHT

SEQ ID NO: 2489954 - protein, 18 aa, Entamoeba dispar
KGYYATGVPVVMKEGDVC

SEQ ID NO: 2489955 - protein, 31 aa, Entamoeba dispar
KGYYKECDYWSVGCILFEMLAGYPPFVSDDS

SEQ ID NO: 2489956 - protein, 26 aa, Entamoeba dispar
KGYYYGQGIGSVFQKLAHFLKTYCSY

SEQ ID NO: 2489957 - protein, 19 aa, Entamoeba dispar
KHAALICYIASGNVNKLID

SEQ ID NO: 2489958 - protein, 17 aa, Entamoeba dispar
KHAKKAWKEGFWGSCRN

SEQ ID NO: 2489959 - protein, 27 aa, Entamoeba dispar
KHDYMPLALNLILFLGKHHKLEQEVEK

SEQ ID NO: 2489960 - protein, 19 aa, Entamoeba dispar
KHEFLIKIDKCYLFENRVY

SEQ ID NO: 2489961 - protein, 23 aa, Entamoeba dispar
KHELMCILYNIGVTYCEEGDYKS

SEQ ID NO: 2489962 - protein, 19 aa, Entamoeba dispar
KHEVELKMDSLRALDDKIK

SEQ ID NO: 2489963 - protein, 21 aa, Entamoeba dispar
KHEVILKALFVDKVKRIITRI

SEQ ID NO: 2489964 - protein, 24 aa, Entamoeba dispar
KHEYLINMANGWNPKDIEIYFTKL

SEQ ID NO: 2489965 - protein, 20 aa, Entamoeba dispar
KHFDISFKFFKDALKMAKTS

SEQ ID NO: 2489966 - protein, 18 aa, Entamoeba dispar
KHFDTLCEILRSQTKKRY

SEQ ID NO: 2489967 - protein, 20 aa, Entamoeba dispar
KHFIAESLVPPIDFFIPQEA

SEQ ID NO: 2489968 - protein, 23 aa, Entamoeba dispar
KHFPAVNWNISFSKYIKSLDSYY

SEQ ID NO: 2489969 - protein, 18 aa, Entamoeba dispar
KHFRDLMRAVAMMTGGQF

SEQ ID NO: 2489970 - protein, 20 aa, Entamoeba dispar
KHFRREFCEENQYLITENNE

SEQ ID NO: 2489971 - protein, 30 aa, Entamoeba dispar
KHGANWKMVKYALETGIKEDYCRRLINSIK

SEQ ID NO: 2489972 - protein, 23 aa, Entamoeba dispar
KHGDCIRWKRVLKVEYDKKKDKD

SEQ ID NO: 2489973 - protein, 23 aa, Entamoeba dispar
KHGISIDCLLHLEPSKPKECENN

SEQ ID NO: 2489974 - protein, 21 aa, Entamoeba dispar
KHGKTFWARRSLNIYNGLIAL

SEQ ID NO: 2489975 - protein, 23 aa, Entamoeba dispar
KHGLKKCTEIVCTHGHIDHIAGL

SEQ ID NO: 2489976 - protein, 26 aa, Entamoeba dispar
KHGPLFIYLFRLMLATGIPELQSAKD

SEQ ID NO: 2489977 - protein, 23 aa, Entamoeba dispar
KHGSECKGDEGLIQKYVECLVKI

SEQ ID NO: 2489978 - protein, 25 aa, Entamoeba dispar
KHGSKECTGNGYAIYGTIEDAQLTK

SEQ ID NO: 2489979 - protein, 18 aa, Entamoeba dispar
KHGSPRLYYGISNKKTNV

SEQ ID NO: 2489980 - protein, 19 aa, Entamoeba dispar
KHHSHSLCLPSTLNCSAIE

SEQ ID NO: 2489981 - protein, 24 aa, Entamoeba dispar
KHIDFRFIDVIVHYVSSFYSMFYP

SEQ ID NO: 2489982 - protein, 22 aa, Entamoeba dispar
KHIKRLGKFSFKDCTSLKSVSV

SEQ ID NO: 2489983 - protein, 22 aa, Entamoeba dispar
KHIPEYRIQRVIIESSRSFIES

SEQ ID NO: 2489984 - protein, 21 aa, Entamoeba dispar
KHIPKEVVTIIHGFEKSSLKE

SEQ ID NO: 2489985 - protein, 18 aa, Entamoeba dispar
KHIQSLYELYGRGEYIDR

SEQ ID NO: 2489986 - protein, 18 aa, Entamoeba dispar
KHIRKLTARKEFKTKEQL

SEQ ID NO: 2489987 - protein, 21 aa, Entamoeba dispar
KHKITQPSIMKWETKKLMNKP

SEQ ID NO: 2489988 - protein, 23 aa, Entamoeba dispar
KHKLGGMMILCIPPYRLPRDKLD

SEQ ID NO: 2489989 - protein, 23 aa, Entamoeba dispar
KHKSKWVVKDIFKDPIGFSNSIY

SEQ ID NO: 2489990 - protein, 19 aa, Entamoeba dispar
KHKVVIQSCCHSCGKCSTT

SEQ ID NO: 2489991 - protein, 23 aa, Entamoeba dispar
KHLALHLLDIFTFEHKETESTFK

SEQ ID NO: 2489992 - protein, 18 aa, Entamoeba dispar
KHLFLSTCLHKFKFSQQR

SEQ ID NO: 2489993 - protein, 17 aa, Entamoeba dispar
KHLKFKPNIKIITFINK

SEQ ID NO: 2489994 - protein, 19 aa, Entamoeba dispar
KHLKGCKFFCAEHGLEAVA

SEQ ID NO: 2489995 - protein, 20 aa, Entamoeba dispar
KHLLSLKIVQSFPVCDPSFF

SEQ ID NO: 2489996 - protein, 19 aa, Entamoeba dispar
KHMFAFTLSNPFNVPTQKY

SEQ ID NO: 2489997 - protein, 28 aa, Entamoeba dispar
KHMICCDLKNVISCCLYTNIWNCPFCLM

SEQ ID NO: 2489998 - protein, 18 aa, Entamoeba dispar
KHMQQSLETLNWVIKVVM

SEQ ID NO: 2489999 - protein, 25 aa, Entamoeba dispar
KHPDLAIPLWYSYGTVVILLEEIVS

SEQ ID NO: 2490000 - protein, 23 aa, Entamoeba dispar
KHPNIVGFFGCFELDNYLYISME

SEQ ID NO: 2490001 - protein, 19 aa, Entamoeba dispar
KHPNVITMYGLYKNEESLF

SEQ ID NO: 2490002 - protein, 20 aa, Entamoeba dispar
KHPQLKDEFELYQKLTGDEK

SEQ ID NO: 2490003 - protein, 20 aa, Entamoeba dispar
KHPYILKSLQKCVSEWIREG

SEQ ID NO: 2490004 - protein, 18 aa, Entamoeba dispar
KHQLELNYRCAEDNYQAC

SEQ ID NO: 2490005 - protein, 23 aa, Entamoeba dispar
KHQLSDCWELWVDEMSGSFSSSE

SEQ ID NO: 2490006 - protein, 25 aa, Entamoeba dispar
KHQPHSFAKLCHWTETTELLYNISQ

SEQ ID NO: 2490007 - protein, 19 aa, Entamoeba dispar
KHQRKIVSLLWNKIPPLKN

SEQ ID NO: 2490008 - protein, 23 aa, Entamoeba dispar
KHQRLILIFQCVIRRVYLRFETE

SEQ ID NO: 2490009 - protein, 19 aa, Entamoeba dispar
KHRVDFVIHFAALKAVGES

SEQ ID NO: 2490010 - protein, 19 aa, Entamoeba dispar
KHRVLFKGLLNEVFHVIYI

SEQ ID NO: 2490011 - protein, 26 aa, Entamoeba dispar
KHSFITLRELFKWADRHANSYEELAR

SEQ ID NO: 2490012 - protein, 19 aa, Entamoeba dispar
KHSPICYPNYLSPLKATRK

SEQ ID NO: 2490013 - protein, 24 aa, Entamoeba dispar
KHSRLRVEEFFRTMFRSNNQCHKL

SEQ ID NO: 2490014 - protein, 24 aa, Entamoeba dispar
KHSRRGSISRVFSRSTSRRSSPEH

SEQ ID NO: 2490015 - protein, 24 aa, Entamoeba dispar
KHSTRWFGCYDCWIQATPNGTSTI

SEQ ID NO: 2490016 - protein, 26 aa, Entamoeba dispar
KHSVEVFKPGKFCLVHMKSAEMYCYT

SEQ ID NO: 2490017 - protein, 18 aa, Entamoeba dispar
KHTLPLIEFHGSEIDEEI

SEQ ID NO: 2490018 - protein, 30 aa, Entamoeba dispar
KHTNFCGFSRQLSLYGFKKFDNEYRFQNSN

SEQ ID NO: 2490019 - protein, 20 aa, Entamoeba dispar
KHVKFDFSMVREIRSGFHFP

SEQ ID NO: 2490020 - protein, 19 aa, Entamoeba dispar
KHVLDIVILTDKWSIKISL

SEQ ID NO: 2490021 - protein, 20 aa, Entamoeba dispar
KHVNRMCVCANVPLIDGGTS

SEQ ID NO: 2490022 - protein, 18 aa, Entamoeba dispar
KHVTLRNAFSIYQIKDFS

SEQ ID NO: 2490023 - protein, 22 aa, Entamoeba dispar
KHWKKRKSSHCETFPHYLEING

SEQ ID NO: 2490024 - protein, 24 aa, Entamoeba dispar
KHYSKYIQMRFVFHQKHHKIKILF

SEQ ID NO: 2490025 - protein, 17 aa, Entamoeba dispar
KHYSVIAKFILINKKCW

SEQ ID NO: 2490026 - protein, 20 aa, Entamoeba dispar
KIAFHLLFTLKQGLTRFIDE

SEQ ID NO: 2490027 - protein, 21 aa, Entamoeba dispar
KIAKDEIILIMPLKTDPETGY

SEQ ID NO: 2490028 - protein, 17 aa, Entamoeba dispar
KIALKITLKSFISCQKT

SEQ ID NO: 2490029 - protein, 24 aa, Entamoeba dispar
KIALSQFVIEWELFKIKENEIIND

SEQ ID NO: 2490030 - protein, 20 aa, Entamoeba dispar
KIANIILSKGVTISESNLSS

SEQ ID NO: 2490031 - protein, 26 aa, Entamoeba dispar
KIANSIPCIISKYIIEPLLLNERKFE

SEQ ID NO: 2490032 - protein, 17 aa, Entamoeba dispar
KIASLIDRYENNDRKKQ

SEQ ID NO: 2490033 - protein, 23 aa, Entamoeba dispar
KIASLPSLFPFQLTRIDISQNLI

SEQ ID NO: 2490034 - protein, 18 aa, Entamoeba dispar
KIAVLLCAVSRWTFNGKT

SEQ ID NO: 2490035 - protein, 18 aa, Entamoeba dispar
KIAYRCVVIGLANETQDY

SEQ ID NO: 2490036 - protein, 17 aa, Entamoeba dispar
KICKGDVDWNRIKGKDT

SEQ ID NO: 2490037 - protein, 18 aa, Entamoeba dispar
KICLSTMFYVCDLDENRS

SEQ ID NO: 2490038 - protein, 20 aa, Entamoeba dispar
KICSINSYIIPLKRIIIGEF

SEQ ID NO: 2490039 - protein, 26 aa, Entamoeba dispar
KIDAVSLLFVCKKGSPQFMLKYKTNV

SEQ ID NO: 2490040 - protein, 24 aa, Entamoeba dispar
KIDDSICVKFAFIEFIGDKSPRLQ

SEQ ID NO: 2490041 - protein, 19 aa, Entamoeba dispar
KIDFEPRKDGLIPIEEMHN

SEQ ID NO: 2490042 - protein, 19 aa, Entamoeba dispar
KIDFIGSIEYSYDRSSTSN

SEQ ID NO: 2490043 - protein, 24 aa, Entamoeba dispar
KIDIWSLGCCIYWMATGHPIYPID

SEQ ID NO: 2490044 - protein, 20 aa, Entamoeba dispar
KIDNFLVEFITPIVKVKRGK

SEQ ID NO: 2490045 - protein, 25 aa, Entamoeba dispar
KIDPFSFKILLPRIVLNQKEEAELL

SEQ ID NO: 2490046 - protein, 25 aa, Entamoeba dispar
KIDPMNNLRMWNRILSGIEKSVKRV

SEQ ID NO: 2490047 - protein, 21 aa, Entamoeba dispar
KIDRCYQWKETDGMPFKETFA

SEQ ID NO: 2490048 - protein, 19 aa, Entamoeba dispar
KIDVKGYLYIIAKCISGGC

SEQ ID NO: 2490049 - protein, 21 aa, Entamoeba dispar
KIDVVGIEWVHDCLTCQLKVS

SEQ ID NO: 2490050 - protein, 18 aa, Entamoeba dispar
KIDWNDIICILKRRYLLQ

SEQ ID NO: 2490051 - protein, 23 aa, Entamoeba dispar
KIEAFLNVVRFFAAVGKQGVFAI

SEQ ID NO: 2490052 - protein, 24 aa, Entamoeba dispar
KIEAPKGYPIIPLKPSYLPYPPQF

SEQ ID NO: 2490053 - protein, 21 aa, Entamoeba dispar
KIECFKIISELSVFDGIVLLK

SEQ ID NO: 2490054 - protein, 17 aa, Entamoeba dispar
KIEDLYINYHVLETQLF

SEQ ID NO: 2490055 - protein, 18 aa, Entamoeba dispar
KIEGGCFYECKSLTSINI

SEQ ID NO: 2490056 - protein, 21 aa, Entamoeba dispar
KIEIEYCCIREIIGNNISNIV

SEQ ID NO: 2490057 - protein, 22 aa, Entamoeba dispar
KIEIKNPMFIVSLPRSGSTYLH

SEQ ID NO: 2490058 - protein, 23 aa, Entamoeba dispar
KIEKCCIDARHSFSCALSSLQNQ

SEQ ID NO: 2490059 - protein, 18 aa, Entamoeba dispar
KIEKLRINVANMMEGLEM

SEQ ID NO: 2490060 - protein, 22 aa, Entamoeba dispar
KIENPKLIPFGSYYRGQSQSQV

SEQ ID NO: 2490061 - protein, 18 aa, Entamoeba dispar
KIEPFPRQYLIQRLQPIF

SEQ ID NO: 2490062 - protein, 26 aa, Entamoeba dispar
KIESEQRLGILINQFNWFISPKRSFD

SEQ ID NO: 2490063 - protein, 20 aa, Entamoeba dispar
KIETLFRFTPDPVTENKKLK

SEQ ID NO: 2490064 - protein, 27 aa, Entamoeba dispar
KIETPKLVNRFSFFSIFKEKESEEDLI

SEQ ID NO: 2490065 - protein, 22 aa, Entamoeba dispar
KIFDAVLLKMVEWLRMKSRILF

SEQ ID NO: 2490066 - protein, 18 aa, Entamoeba dispar
KIFECLTAKLLTHPSNTL

SEQ ID NO: 2490067 - protein, 23 aa, Entamoeba dispar
KIFEMIESLDILPQSSRYLVITK

SEQ ID NO: 2490068 - protein, 19 aa, Entamoeba dispar
KIFGLEYLSEFSSLSNSPF

SEQ ID NO: 2490069 - protein, 22 aa, Entamoeba dispar
KIFGRPDSITTIALLLQSSSPN

SEQ ID NO: 2490070 - protein, 30 aa, Entamoeba dispar
KIFHVASGLSICWGSLFGHIGMKTAYSGEC

SEQ ID NO: 2490071 - protein, 17 aa, Entamoeba dispar
KIFKEIIWYAVNYSTYF

SEQ ID NO: 2490072 - protein, 24 aa, Entamoeba dispar
KIFKEVIWYKVDYSRYLKEKETGN

SEQ ID NO: 2490073 - protein, 19 aa, Entamoeba dispar
KIFKGKFIIHLGGYNEYYD

SEQ ID NO: 2490074 - protein, 24 aa, Entamoeba dispar
KIFKKIIWYEVDYSTYLKEKEKWD

SEQ ID NO: 2490075 - protein, 25 aa, Entamoeba dispar
KIFKKIIWYKVEYWRYLFEKKQGNI

SEQ ID NO: 2490076 - protein, 22 aa, Entamoeba dispar
KIFKYVIWYKVEYLTYLEEKGQ

SEQ ID NO: 2490077 - protein, 17 aa, Entamoeba dispar
KIFKYVIWYKVSYSTYL

SEQ ID NO: 2490078 - protein, 17 aa, Entamoeba dispar
KIFKYVIWYLVSYSKYL

SEQ ID NO: 2490079 - protein, 17 aa, Entamoeba dispar
KIFKYVIWYPVDYLTYL

SEQ ID NO: 2490080 - protein, 17 aa, Entamoeba dispar
KIFLNFLKKCQILYDEI

SEQ ID NO: 2490081 - protein, 17 aa, Entamoeba dispar
KIFQNYYLRVCHATVSL

SEQ ID NO: 2490082 - protein, 23 aa, Entamoeba dispar
KIFSEISYGFPLLSKIDLSNNNL

SEQ ID NO: 2490083 - protein, 30 aa, Entamoeba dispar
KIFSEYKEKCVFMIKYSLELRQWKEVQNNN

SEQ ID NO: 2490084 - protein, 20 aa, Entamoeba dispar
KIFTRRIEVTGGEIEINNMI

SEQ ID NO: 2490085 - protein, 17 aa, Entamoeba dispar
KIFYYKLYYSLSKCLTS

SEQ ID NO: 2490086 - protein, 21 aa, Entamoeba dispar
KIGADCFIGCTSLRSINIPSS

SEQ ID NO: 2490087 - protein, 22 aa, Entamoeba dispar
KIGDGCFRECYSLTSINIPATI

SEQ ID NO: 2490088 - protein, 20 aa, Entamoeba dispar
KIGDGCFYKCISLTSMNIPS

SEQ ID NO: 2490089 - protein, 19 aa, Entamoeba dispar
KIGEKCFINCSSMTGLTIP

SEQ ID NO: 2490090 - protein, 22 aa, Entamoeba dispar
KIGERPDPIILSKHIIDNKKSF

SEQ ID NO: 2490091 - protein, 18 aa, Entamoeba dispar
KIGERYHLIGIYQSSRFD

SEQ ID NO: 2490092 - protein, 23 aa, Entamoeba dispar
KIGGDCFYGCLSLKSINIPSTIS

SEQ ID NO: 2490093 - protein, 19 aa, Entamoeba dispar
KIGGEWCFIPPNTIIEEIQ

SEQ ID NO: 2490094 - protein, 17 aa, Entamoeba dispar
KIGGYCFGGCSSLTLIN

SEQ ID NO: 2490095 - protein, 21 aa, Entamoeba dispar
KIGHWCFKECYSLTSISIDNL

SEQ ID NO: 2490096 - protein, 20 aa, Entamoeba dispar
KIGILRPAFISGNSVSGCSN

SEQ ID NO: 2490097 - protein, 17 aa, Entamoeba dispar
KIGISLEKVELFKSVST

SEQ ID NO: 2490098 - protein, 24 aa, Entamoeba dispar
KIGNEVINSFELVLIEGLKKNFDI

SEQ ID NO: 2490099 - protein, 22 aa, Entamoeba dispar
KIGNGCFYGCSSLESINIPSSI

SEQ ID NO: 2490100 - protein, 19 aa, Entamoeba dispar
KIGNPICDKGKGAFFEDMA

SEQ ID NO: 2490101 - protein, 17 aa, Entamoeba dispar
KIGNYCFNYCTSLKSIN

SEQ ID NO: 2490102 - protein, 22 aa, Entamoeba dispar
KIGNYCFYECYSLKSINIPSSV

SEQ ID NO: 2490103 - protein, 23 aa, Entamoeba dispar
KIGNYCFYGCLSLTTINIPSTII

SEQ ID NO: 2490104 - protein, 23 aa, Entamoeba dispar
KIGNYCFYGCLSLTTINIPSTIS

SEQ ID NO: 2490105 - protein, 18 aa, Entamoeba dispar
KIGSNCFFECSSLIEINI

SEQ ID NO: 2490106 - protein, 19 aa, Entamoeba dispar
KIGSYCFYECSSLKSINIP

SEQ ID NO: 2490107 - protein, 23 aa, Entamoeba dispar
KIGSYCFYHCLSLTSINIPSSVI

SEQ ID NO: 2490108 - protein, 19 aa, Entamoeba dispar
KIGTVCSIVQYGWSDFIVC

SEQ ID NO: 2490109 - protein, 23 aa, Entamoeba dispar
KIGYGCFCKCSSITTINIPTSIT

SEQ ID NO: 2490110 - protein, 18 aa, Entamoeba dispar
KIHHCYFDCHIFNVYLMN

SEQ ID NO: 2490111 - protein, 20 aa, Entamoeba dispar
KIHKDQFTWSKLNNLPRTLE

SEQ ID NO: 2490112 - protein, 19 aa, Entamoeba dispar
KIIARHLAVIKTRPIIWRS

SEQ ID NO: 2490113 - protein, 20 aa, Entamoeba dispar
KIIASCFVDNVARLVRREEL

SEQ ID NO: 2490114 - protein, 19 aa, Entamoeba dispar
KIIEILGMYLQYFNQNEQK

SEQ ID NO: 2490115 - protein, 21 aa, Entamoeba dispar
KIIETCLLSPALIVVEYTVQL

SEQ ID NO: 2490116 - protein, 18 aa, Entamoeba dispar
KIIGKYGVIQCFHSLNYE

SEQ ID NO: 2490117 - protein, 22 aa, Entamoeba dispar
KIIGSIISFIGMDCPEYLNNEV

SEQ ID NO: 2490118 - protein, 23 aa, Entamoeba dispar
KIIHFMKSLILLPSRDVFESLFW

SEQ ID NO: 2490119 - protein, 25 aa, Entamoeba dispar
KIIHLPELIENISFDTKQSYYQFDQ

SEQ ID NO: 2490120 - protein, 18 aa, Entamoeba dispar
KIIKDFIEENSFKPENEC

SEQ ID NO: 2490121 - protein, 26 aa, Entamoeba dispar
KIIKELYNGMFLKLVFIIKKCFACDE

SEQ ID NO: 2490122 - protein, 17 aa, Entamoeba dispar
KIIKFSSLLAIQNDFEE

SEQ ID NO: 2490123 - protein, 18 aa, Entamoeba dispar
KIIKPCIFVSDSLVQDEK

SEQ ID NO: 2490124 - protein, 21 aa, Entamoeba dispar
KIIKSLLCSPSVKDDIIKKKQ

SEQ ID NO: 2490125 - protein, 19 aa, Entamoeba dispar
KIILIYQMSYRKTKDLKKT

SEQ ID NO: 2490126 - protein, 17 aa, Entamoeba dispar
KIILYCWSIIMDIKSLQ

SEQ ID NO: 2490127 - protein, 18 aa, Entamoeba dispar
KIINRYYIQIPFSQLDKY

SEQ ID NO: 2490128 - protein, 20 aa, Entamoeba dispar
KIIPRMTFYASRPLPIVTTE

SEQ ID NO: 2490129 - protein, 25 aa, Entamoeba dispar
KIIPTRMDYQLSQVFERAGIIITEK

SEQ ID NO: 2490130 - protein, 20 aa, Entamoeba dispar
KIIQEIKDTINILDKKVSTI

SEQ ID NO: 2490131 - protein, 25 aa, Entamoeba dispar
KIISLRGSIWNGYVSFVLVQSKLKE

SEQ ID NO: 2490132 - protein, 21 aa, Entamoeba dispar
KIISSMPQWIVDALEKRFTDI

SEQ ID NO: 2490133 - protein, 20 aa, Entamoeba dispar
KIISTWSRTFFFLLDGISQY

SEQ ID NO: 2490134 - protein, 19 aa, Entamoeba dispar
KIISVLEILSRPEIIENIK

SEQ ID NO: 2490135 - protein, 17 aa, Entamoeba dispar
KIKAFDTFEKFKDVVTS

SEQ ID NO: 2490136 - protein, 19 aa, Entamoeba dispar
KIKAGLEIIERHLSKEEAE

SEQ ID NO: 2490137 - protein, 28 aa, Entamoeba dispar
KIKAKESINIICPKSLLQIKVKVSDYCN

SEQ ID NO: 2490138 - protein, 23 aa, Entamoeba dispar
KIKAQCKLGLTATLIREDDRIRD

SEQ ID NO: 2490139 - protein, 20 aa, Entamoeba dispar
KIKASLILRQKINKNFRVNL

SEQ ID NO: 2490140 - protein, 20 aa, Entamoeba dispar
KIKECVNILSSITLNGNSLN

SEQ ID NO: 2490141 - protein, 17 aa, Entamoeba dispar
KIKEFNKKVLSEEKEKK

SEQ ID NO: 2490142 - protein, 36 aa, Entamoeba dispar
KIKEGKEMKKRLEMMFGKIKIGILGLEEMKDESKDD

SEQ ID NO: 2490143 - protein, 17 aa, Entamoeba dispar
KIKEIKPSINLFQSNKK

SEQ ID NO: 2490144 - protein, 18 aa, Entamoeba dispar
KIKELVEEECKKRYLQKR

SEQ ID NO: 2490145 - protein, 22 aa, Entamoeba dispar
KIKEMYEFIGKVIGKIILDGVT

SEQ ID NO: 2490146 - protein, 19 aa, Entamoeba dispar
KIKENEIINDLSYRISKII

SEQ ID NO: 2490147 - protein, 18 aa, Entamoeba dispar
KIKENRLFQVIKPPKYQY

SEQ ID NO: 2490148 - protein, 19 aa, Entamoeba dispar
KIKEWCFYECTSLINTNIP

SEQ ID NO: 2490149 - protein, 27 aa, Entamoeba dispar
KIKFGSHFDGWFDLRGSPYGNEYVCGR

SEQ ID NO: 2490150 - protein, 21 aa, Entamoeba dispar
KIKFILECSKVIHNSYNDIVP

SEQ ID NO: 2490151 - protein, 22 aa, Entamoeba dispar
KIKGEYCYFPFDDHNAPQFEII

SEQ ID NO: 2490152 - protein, 25 aa, Entamoeba dispar
KIKGRQIRVEPCYKNYDKIKQKKAE

SEQ ID NO: 2490153 - protein, 24 aa, Entamoeba dispar
KIKHEFNCLKTDYKNLVDELTQSL

SEQ ID NO: 2490154 - protein, 18 aa, Entamoeba dispar
KIKIDIDTMFYLEESVIG

SEQ ID NO: 2490155 - protein, 23 aa, Entamoeba dispar
KIKIFSFPLIRNIIKMMNDKEKT

SEQ ID NO: 2490156 - protein, 17 aa, Entamoeba dispar
KIKILNKKGDWWQGECQ

SEQ ID NO: 2490157 - protein, 25 aa, Entamoeba dispar
KIKIWRITKPIIIWETLPQKSQTVI

SEQ ID NO: 2490158 - protein, 23 aa, Entamoeba dispar
KIKKPERRSQKTLQLMLVEELYE

SEQ ID NO: 2490159 - protein, 23 aa, Entamoeba dispar
KIKKSIIGSLRFNTTLKTLSMNK

SEQ ID NO: 2490160 - protein, 25 aa, Entamoeba dispar
KIKLIDFGSACFENSTLYSYIQSRH

SEQ ID NO: 2490161 - protein, 17 aa, Entamoeba dispar
KIKLIFTGETIKVNIIN

SEQ ID NO: 2490162 - protein, 18 aa, Entamoeba dispar
KIKLNDKLFKTIELDKKT

SEQ ID NO: 2490163 - protein, 19 aa, Entamoeba dispar
KIKLNDKLFKTIELDKKTK

SEQ ID NO: 2490164 - protein, 22 aa, Entamoeba dispar
KIKLRSIDIFKPFIAQNNIQFE

SEQ ID NO: 2490165 - protein, 21 aa, Entamoeba dispar
KIKPTLYSFILIKNYETRYEI

SEQ ID NO: 2490166 - protein, 18 aa, Entamoeba dispar
KIKSEAFNRCTSLSEIII

SEQ ID NO: 2490167 - protein, 18 aa, Entamoeba dispar
KIKSFDFLNKCSVLTSLE

SEQ ID NO: 2490168 - protein, 23 aa, Entamoeba dispar
KIKSRLIEGLSMLVYSCSKNITK

SEQ ID NO: 2490169 - protein, 23 aa, Entamoeba dispar
KIKVILCKNCMAVFDSIKESKLL

SEQ ID NO: 2490170 - protein, 19 aa, Entamoeba dispar
KIKVKEHMTNVTFKTSGEF

SEQ ID NO: 2490171 - protein, 20 aa, Entamoeba dispar
KIKWLNERIEKIDWEKISQK

SEQ ID NO: 2490172 - protein, 19 aa, Entamoeba dispar
KIKYTIGIDGIKIIHVNEK

SEQ ID NO: 2490173 - protein, 19 aa, Entamoeba dispar
KILAKQLILFDWRMTENIN

SEQ ID NO: 2490174 - protein, 27 aa, Entamoeba dispar
KILDDFRKAAAVQIVMLGGEYIGNKRK

SEQ ID NO: 2490175 - protein, 35 aa, Entamoeba dispar
KILDLKGKLILPSLCTFGNLPFRKAVKRFGCDVTM

SEQ ID NO: 2490176 - protein, 17 aa, Entamoeba dispar
KILEKVIEFMTYHHNHS

SEQ ID NO: 2490177 - protein, 19 aa, Entamoeba dispar
KILELFNKVFESFLYCIRS

SEQ ID NO: 2490178 - protein, 25 aa, Entamoeba dispar
KILETRLKRGLLPIINGGTFICKID

SEQ ID NO: 2490179 - protein, 19 aa, Entamoeba dispar
KILGMLASVEIRLAKILVE

SEQ ID NO: 2490180 - protein, 23 aa, Entamoeba dispar
KILICSDTHLGAGEKSHCLNDDC

SEQ ID NO: 2490181 - protein, 19 aa, Entamoeba dispar
KILKDACLSGGQLEEYFFN

SEQ ID NO: 2490182 - protein, 18 aa, Entamoeba dispar
KILKDHLLPITKFFEEKY

SEQ ID NO: 2490183 - protein, 27 aa, Entamoeba dispar
KILLADRCEDFKCIGNTLGNTEELTAL

SEQ ID NO: 2490184 - protein, 18 aa, Entamoeba dispar
KILLGNLDKSCVRPFHKI

SEQ ID NO: 2490185 - protein, 26 aa, Entamoeba dispar
KILLKRGPLLTAICNTVCTFLKIFNP

SEQ ID NO: 2490186 - protein, 26 aa, Entamoeba dispar
KILLQWCKGKSLSIRYDSKYDGESQK

SEQ ID NO: 2490187 - protein, 19 aa, Entamoeba dispar
KILLRRKLSRLSEQPMVGI

SEQ ID NO: 2490188 - protein, 25 aa, Entamoeba dispar
KILLTCKRYHPMFHYYYYNNNYLDN

SEQ ID NO: 2490189 - protein, 25 aa, Entamoeba dispar
KILPFFKKEVEEIIKYKKEQTGNSK

SEQ ID NO: 2490190 - protein, 24 aa, Entamoeba dispar
KILPKEPLIWIAAARIEEIKGHNP

SEQ ID NO: 2490191 - protein, 22 aa, Entamoeba dispar
KILPKETKLVIGVFQTEEQIGV

SEQ ID NO: 2490192 - protein, 20 aa, Entamoeba dispar
KILQKIGFKEMTVIFDTLYD

SEQ ID NO: 2490193 - protein, 20 aa, Entamoeba dispar
KILRKCLIGNSHLVKDVDRT

SEQ ID NO: 2490194 - protein, 26 aa, Entamoeba dispar
KILSMFKIKPTYTFTMLNLELKQPEQ

SEQ ID NO: 2490195 - protein, 20 aa, Entamoeba dispar
KILTVPIKFFRKIDAVRSPS

SEQ ID NO: 2490196 - protein, 22 aa, Entamoeba dispar
KILYEKYIGLKYMIKNTLNEYQ

SEQ ID NO: 2490197 - protein, 19 aa, Entamoeba dispar
KIMCTKDCRCQLLEQLTSR

SEQ ID NO: 2490198 - protein, 18 aa, Entamoeba dispar
KIMCTSEGGVFFVTGANK

SEQ ID NO: 2490199 - protein, 19 aa, Entamoeba dispar
KIMKFLRGMKKVNGIDELK

SEQ ID NO: 2490200 - protein, 17 aa, Entamoeba dispar
KIMMSLPSFSGVMKKVN

SEQ ID NO: 2490201 - protein, 21 aa, Entamoeba dispar
KIMYEQMNFTGFFEFYSGLNS

SEQ ID NO: 2490202 - protein, 19 aa, Entamoeba dispar
KINAFAGARITTRCASQYY

SEQ ID NO: 2490203 - protein, 18 aa, Entamoeba dispar
KINCFAWCYLLTSIDIPT

SEQ ID NO: 2490204 - protein, 19 aa, Entamoeba dispar
KINEFLMVMYYPCKSAEEM

SEQ ID NO: 2490205 - protein, 19 aa, Entamoeba dispar
KINESMYLPLQELFLPIFI

SEQ ID NO: 2490206 - protein, 22 aa, Entamoeba dispar
KINEYGHHWTLISQFIPGRAPN

SEQ ID NO: 2490207 - protein, 19 aa, Entamoeba dispar
KINFWRNVYGFNMTPMRAE

SEQ ID NO: 2490208 - protein, 17 aa, Entamoeba dispar
KINGFCKEGEMYYRIEG

SEQ ID NO: 2490209 - protein, 19 aa, Entamoeba dispar
KINGFFLIPEKGSWNYSLS

SEQ ID NO: 2490210 - protein, 22 aa, Entamoeba dispar
KINGIRCALCHDHYTAVMCRRH

SEQ ID NO: 2490211 - protein, 18 aa, Entamoeba dispar
KINGKISENVGCLRDVTQ

SEQ ID NO: 2490212 - protein, 17 aa, Entamoeba dispar
KINHCFIYLLDDRSFHY

SEQ ID NO: 2490213 - protein, 18 aa, Entamoeba dispar
KINIKSDCIEKLKLEGNI

SEQ ID NO: 2490214 - protein, 18 aa, Entamoeba dispar
KINISMVITTVMKVNKKI

SEQ ID NO: 2490215 - protein, 17 aa, Entamoeba dispar
KINKMKEACCIGFKWAM

SEQ ID NO: 2490216 - protein, 29 aa, Entamoeba dispar
KINKMKEACCIGFKWAMSSGPLCEEEMRN

SEQ ID NO: 2490217 - protein, 21 aa, Entamoeba dispar
KINKNEFVWFLNNERSFIYNL

SEQ ID NO: 2490218 - protein, 23 aa, Entamoeba dispar
KINKRLELVEGFYENSEIGLKIK

SEQ ID NO: 2490219 - protein, 28 aa, Entamoeba dispar
KINPKFCSSESFVSFFKRFQTDTFEGCD

SEQ ID NO: 2490220 - protein, 21 aa, Entamoeba dispar
KINYCYLPSAHVFDQQIALAF

SEQ ID NO: 2490221 - protein, 18 aa, Entamoeba dispar
KINYFYKLFKIIREYIIQ

SEQ ID NO: 2490222 - protein, 17 aa, Entamoeba dispar
KINYMIMSMTTRGPNKH

SEQ ID NO: 2490223 - protein, 18 aa, Entamoeba dispar
KIPEEFKKALSDSFVKSV

SEQ ID NO: 2490224 - protein, 26 aa, Entamoeba dispar
KIPEKEWFCRVCSYRLGITKLDIPEN

SEQ ID NO: 2490225 - protein, 25 aa, Entamoeba dispar
KIPESIKKINGGIIKCEDINDFRIP

SEQ ID NO: 2490226 - protein, 17 aa, Entamoeba dispar
KIPEYKAFLEGNEMNIL

SEQ ID NO: 2490227 - protein, 19 aa, Entamoeba dispar
KIPFGLNYSERVEGWDDET

SEQ ID NO: 2490228 - protein, 20 aa, Entamoeba dispar
KIPILMDVKDLICERPDPKS

SEQ ID NO: 2490229 - protein, 17 aa, Entamoeba dispar
KIPKLGLGTWMSANGEV

SEQ ID NO: 2490230 - protein, 26 aa, Entamoeba dispar
KIPKPVARPVLKRVVKEFNNGYDLAR

SEQ ID NO: 2490231 - protein, 19 aa, Entamoeba dispar
KIPLQGLLCDLLWSDPHDL

SEQ ID NO: 2490232 - protein, 24 aa, Entamoeba dispar
KIPNSFTGIGAHCFSDCTNLTQLS

SEQ ID NO: 2490233 - protein, 19 aa, Entamoeba dispar
KIPQLRNDIKYILDAPSLL

SEQ ID NO: 2490234 - protein, 18 aa, Entamoeba dispar
KIPSCSFDSILNKAISVQ

SEQ ID NO: 2490235 - protein, 18 aa, Entamoeba dispar
KIPSLPIHNDFLINQFLN

SEQ ID NO: 2490236 - protein, 20 aa, Entamoeba dispar
KIPTTIKEIGHWCFENCSSL

SEQ ID NO: 2490237 - protein, 21 aa, Entamoeba dispar
KIQCKGGIIKIHRDYIINYVD

SEQ ID NO: 2490238 - protein, 20 aa, Entamoeba dispar
KIQEFMIPKGIELKVAENIE

SEQ ID NO: 2490239 - protein, 24 aa, Entamoeba dispar
KIQGETLVAFVIVKSGSSFTNLEM

SEQ ID NO: 2490240 - protein, 23 aa, Entamoeba dispar
KIQKRLGDHITRRDVSVKFKRES

SEQ ID NO: 2490241 - protein, 18 aa, Entamoeba dispar
KIQLEVGEQITINYQFIS

SEQ ID NO: 2490242 - protein, 21 aa, Entamoeba dispar
KIQMGEVIKMIKKRYPLSEVE

SEQ ID NO: 2490243 - protein, 20 aa, Entamoeba dispar
KIQYRMHPLIREFPSKQFYS

SEQ ID NO: 2490244 - protein, 19 aa, Entamoeba dispar
KIRAVGYDLNYKRGLQYSP

SEQ ID NO: 2490245 - protein, 24 aa, Entamoeba dispar
KIRKEKLIVLDLFNQIKGNSNITI

SEQ ID NO: 2490246 - protein, 24 aa, Entamoeba dispar
KIRKKKVIKKSVNFEDSDEEKEKP

SEQ ID NO: 2490247 - protein, 21 aa, Entamoeba dispar
KIRKLFVCDNGKRIDSFIETT

SEQ ID NO: 2490248 - protein, 24 aa, Entamoeba dispar
KIRLIDFGSACFQDSPLYTYIQSR

SEQ ID NO: 2490249 - protein, 26 aa, Entamoeba dispar
KIRNVPIRLCFDLKKIQSIDISCNNI

SEQ ID NO: 2490250 - protein, 25 aa, Entamoeba dispar
KIRNWAYKMILFFPNIQTFRIKDLN

SEQ ID NO: 2490251 - protein, 19 aa, Entamoeba dispar
KIRSLPFTSTKHVISVIDA

SEQ ID NO: 2490252 - protein, 20 aa, Entamoeba dispar
KIRTFKEKKSEYMRCVDSDY

SEQ ID NO: 2490253 - protein, 18 aa, Entamoeba dispar
KIRVSLEVFNQLKQIQKQ

SEQ ID NO: 2490254 - protein, 21 aa, Entamoeba dispar
KIRWQSFNGKIYVDYNSKLNE

SEQ ID NO: 2490255 - protein, 22 aa, Entamoeba dispar
KISDLLCEGESNVLLKEPTKKF

SEQ ID NO: 2490256 - protein, 27 aa, Entamoeba dispar
KISEGEMYNVLVLTDFVAQKSPQFRTQ

SEQ ID NO: 2490257 - protein, 25 aa, Entamoeba dispar
KISELDLPIPLCELTLIQCRKLQTL

SEQ ID NO: 2490258 - protein, 20 aa, Entamoeba dispar
KISEMLGGLQACARAFAARK

SEQ ID NO: 2490259 - protein, 22 aa, Entamoeba dispar
KISFIYCEIMAKFYGVDIEEAL

SEQ ID NO: 2490260 - protein, 21 aa, Entamoeba dispar
KISIELCSKLDEWGLIKEKER

SEQ ID NO: 2490261 - protein, 29 aa, Entamoeba dispar
KISIIRFRKFMRINLGLMFTKVINQILGS

SEQ ID NO: 2490262 - protein, 24 aa, Entamoeba dispar
KISKKTFPLLTIKFVHRCTPDGNQ

SEQ ID NO: 2490263 - protein, 18 aa, Entamoeba dispar
KISKRIKLFNGVSEIECH

SEQ ID NO: 2490264 - protein, 27 aa, Entamoeba dispar
KISKTIICYLLRFGTKIDEENMILFNK

SEQ ID NO: 2490265 - protein, 18 aa, Entamoeba dispar
KISLPGLLFKFITIKPCD

SEQ ID NO: 2490266 - protein, 21 aa, Entamoeba dispar
KISLPSGRNLLYFNQIEIDED

SEQ ID NO: 2490267 - protein, 18 aa, Entamoeba dispar
KISLSSLPVPAKWDSYKE

SEQ ID NO: 2490268 - protein, 20 aa, Entamoeba dispar
KISLWIYGSICSLIHFHSIH

SEQ ID NO: 2490269 - protein, 20 aa, Entamoeba dispar
KISNCLFGGNANGIFLKPLY

SEQ ID NO: 2490270 - protein, 21 aa, Entamoeba dispar
KISNFSSFLLRYNPHHIQQIM

SEQ ID NO: 2490271 - protein, 19 aa, Entamoeba dispar
KISPYHMYLFKALRNYFMT

SEQ ID NO: 2490272 - protein, 18 aa, Entamoeba dispar
KISRDQVIELLRALGKAP

SEQ ID NO: 2490273 - protein, 19 aa, Entamoeba dispar
KISSGTLIYSLSHIDMNGK

SEQ ID NO: 2490274 - protein, 24 aa, Entamoeba dispar
KISSVNCFIVFSHCGLPVGVFGTR

SEQ ID NO: 2490275 - protein, 19 aa, Entamoeba dispar
KISYFSIYLFYLQTKKIKM

SEQ ID NO: 2490276 - protein, 25 aa, Entamoeba dispar
KITCKRFDRDKCSWFCDSMNRCTCS

SEQ ID NO: 2490277 - protein, 17 aa, Entamoeba dispar
KITDDFRYIIINEDNLK

SEQ ID NO: 2490278 - protein, 17 aa, Entamoeba dispar
KITDDFRYIIINEGNLE

SEQ ID NO: 2490279 - protein, 17 aa, Entamoeba dispar
KITETKWKLIFAWKNVD

SEQ ID NO: 2490280 - protein, 22 aa, Entamoeba dispar
KITFAEMIPHLYSSTTDMDSDA

SEQ ID NO: 2490281 - protein, 17 aa, Entamoeba dispar
KITFYGIHMRPTPSCES

SEQ ID NO: 2490282 - protein, 23 aa, Entamoeba dispar
KITGNHSHVFWAIVRNKKLCYYQ

SEQ ID NO: 2490283 - protein, 21 aa, Entamoeba dispar
KITKKGCEIKQQKECEHAGER

SEQ ID NO: 2490284 - protein, 19 aa, Entamoeba dispar
KITLKRIRELSAYYRRVYL

SEQ ID NO: 2490285 - protein, 18 aa, Entamoeba dispar
KITLRLLWDLICLSTNNQ

SEQ ID NO: 2490286 - protein, 22 aa, Entamoeba dispar
KITPFILQNPFDLIPVRFDPKV

SEQ ID NO: 2490287 - protein, 22 aa, Entamoeba dispar
KITSLRLSDFGLLSKIENIELC

SEQ ID NO: 2490288 - protein, 18 aa, Entamoeba dispar
KITTIKCKDFCSAEDQYG

SEQ ID NO: 2490289 - protein, 21 aa, Entamoeba dispar
KIVCPPSIMPSKFKYQTYTTQ

SEQ ID NO: 2490290 - protein, 19 aa, Entamoeba dispar
KIVDSKCPIRKSFNEESQE

SEQ ID NO: 2490291 - protein, 20 aa, Entamoeba dispar
KIVDWCFSWCSSLTSINIPS

SEQ ID NO: 2490292 - protein, 17 aa, Entamoeba dispar
KIVFKYLPIKEIKCVTI

SEQ ID NO: 2490293 - protein, 20 aa, Entamoeba dispar
KIVISDALGVIFDGEPLAGD

SEQ ID NO: 2490294 - protein, 19 aa, Entamoeba dispar
KIVKIPMYFVDSRPDDDEI

SEQ ID NO: 2490295 - protein, 23 aa, Entamoeba dispar
KIVLDCHDCVKQFYEKCGIHYKD

SEQ ID NO: 2490296 - protein, 24 aa, Entamoeba dispar
KIVLLRSILIRREIYKKNIKDMTQ

SEQ ID NO: 2490297 - protein, 18 aa, Entamoeba dispar
KIVLPSLITSIGDFAFNN

SEQ ID NO: 2490298 - protein, 24 aa, Entamoeba dispar
KIVLQQCQLLGAKVTLTSDDLTQP

SEQ ID NO: 2490299 - protein, 18 aa, Entamoeba dispar
KIVNEFGIVFFKRINPNC

SEQ ID NO: 2490300 - protein, 26 aa, Entamoeba dispar
KIVQSFPVCDPSFFTSFRDACMACRE

SEQ ID NO: 2490301 - protein, 18 aa, Entamoeba dispar
KIVSSSMKDFIVAYEAKK

SEQ ID NO: 2490302 - protein, 30 aa, Entamoeba dispar
KIWAKDMYLLYFWQGRSCAVIDKGTSARLT

SEQ ID NO: 2490303 - protein, 21 aa, Entamoeba dispar
KIWSNEEFESIYLKTDEITSK

SEQ ID NO: 2490304 - protein, 19 aa, Entamoeba dispar
KIYGALYLFIEIIEKETII

SEQ ID NO: 2490305 - protein, 24 aa, Entamoeba dispar
KIYHHLKSSLLLNYSNSLDLNLAF

SEQ ID NO: 2490306 - protein, 24 aa, Entamoeba dispar
KIYHHLKSSLLLNYSNSPDLNLAF

SEQ ID NO: 2490307 - protein, 18 aa, Entamoeba dispar
KIYLEAHVSNSDEFLFTS

SEQ ID NO: 2490308 - protein, 20 aa, Entamoeba dispar
KIYLEYFGFNVIFKENIIDY

SEQ ID NO: 2490309 - protein, 19 aa, Entamoeba dispar
KIYLVGGLQYEEIMKGIDV

SEQ ID NO: 2490310 - protein, 18 aa, Entamoeba dispar
KIYNCIGEDIFTVIENND

SEQ ID NO: 2490311 - protein, 24 aa, Entamoeba dispar
KIYNIEPFPQIPIEEVKKNIPSAQ

SEQ ID NO: 2490312 - protein, 27 aa, Entamoeba dispar
KIYNSCCVYKSLYFCEILHFIKTNKDI

SEQ ID NO: 2490313 - protein, 21 aa, Entamoeba dispar
KIYPFIPIKKSHIIDQIDQFL

SEQ ID NO: 2490314 - protein, 20 aa, Entamoeba dispar
KIYVEDIVDKCVIDLINKYV

SEQ ID NO: 2490315 - protein, 17 aa, Entamoeba dispar
KKAAITLKKLEMDESNN

SEQ ID NO: 2490316 - protein, 17 aa, Entamoeba dispar
KKAAMGMEERQNWEQEI

SEQ ID NO: 2490317 - protein, 20 aa, Entamoeba dispar
KKAAVWCVGEYFDLLKNIIK

SEQ ID NO: 2490318 - protein, 26 aa, Entamoeba dispar
KKAEERKGRRENPYTSVIGKLQQKLF

SEQ ID NO: 2490319 - protein, 25 aa, Entamoeba dispar
KKAEFMFRNCCEIPLMKKTASKFGI

SEQ ID NO: 2490320 - protein, 23 aa, Entamoeba dispar
KKAIKLVNKFFISRDYPPLAEQS

SEQ ID NO: 2490321 - protein, 21 aa, Entamoeba dispar
KKAKITPREKLVGFIKRQMKD

SEQ ID NO: 2490322 - protein, 20 aa, Entamoeba dispar
KKAKKRKSLINEEMTVTLNL

SEQ ID NO: 2490323 - protein, 20 aa, Entamoeba dispar
KKAKRLEVVMDVGSALIHKN

SEQ ID NO: 2490324 - protein, 22 aa, Entamoeba dispar
KKALKEYHFFCTLANERSKMRD

SEQ ID NO: 2490325 - protein, 18 aa, Entamoeba dispar
KKANECRKTIYLDEMPSV

SEQ ID NO: 2490326 - protein, 25 aa, Entamoeba dispar
KKAQTKLIKSYRALKYEQDHNPKLE

SEQ ID NO: 2490327 - protein, 21 aa, Entamoeba dispar
KKATVIFIPLRMMRICRASFE

SEQ ID NO: 2490328 - protein, 17 aa, Entamoeba dispar
KKAYQMEAIKIEGITMH

SEQ ID NO: 2490329 - protein, 17 aa, Entamoeba dispar
KKAYRKLAIKYHPDKNP

SEQ ID NO: 2490330 - protein, 19 aa, Entamoeba dispar
KKCIFSFNLMLSIKSADIQ

SEQ ID NO: 2490331 - protein, 23 aa, Entamoeba dispar
KKCKEHLKEGGIIIIKENVGTDG

SEQ ID NO: 2490332 - protein, 17 aa, Entamoeba dispar
KKCKQTQLINESTPTQT

SEQ ID NO: 2490333 - protein, 18 aa, Entamoeba dispar
KKCKSCAIHPDEHIFISL

SEQ ID NO: 2490334 - protein, 28 aa, Entamoeba dispar
KKCPVCKCPVIKSYGCNKITCICGTYFC

SEQ ID NO: 2490335 - protein, 25 aa, Entamoeba dispar
KKCVYGEGVSTVFKKFTGFLKCYTV

SEQ ID NO: 2490336 - protein, 19 aa, Entamoeba dispar
KKDAEALVNLRNKKAASEN

SEQ ID NO: 2490337 - protein, 18 aa, Entamoeba dispar
KKDATNFMNAYDSASEHD

SEQ ID NO: 2490338 - protein, 21 aa, Entamoeba dispar
KKDCLVALDLMDVVRLSSDPD

SEQ ID NO: 2490339 - protein, 19 aa, Entamoeba dispar
KKDDLWILLPQEYPYSFNS

SEQ ID NO: 2490340 - protein, 18 aa, Entamoeba dispar
KKDGRNCIDYDPKEKAIR

SEQ ID NO: 2490341 - protein, 25 aa, Entamoeba dispar
KKDGSLYQLCEFDYIRRCVMKHEKI

SEQ ID NO: 2490342 - protein, 20 aa, Entamoeba dispar
KKDIEGKVYIAWKDTGSDCE

SEQ ID NO: 2490343 - protein, 24 aa, Entamoeba dispar
KKDIKCSNELIAAYQAMQEGNLVI

SEQ ID NO: 2490344 - protein, 20 aa, Entamoeba dispar
KKDILLKRCIFVGDDDSDKT

SEQ ID NO: 2490345 - protein, 21 aa, Entamoeba dispar
KKDINEFIIPPSITKLGEYCF

SEQ ID NO: 2490346 - protein, 19 aa, Entamoeba dispar
KKDINEFIIPSSIIEIFHF

SEQ ID NO: 2490347 - protein, 19 aa, Entamoeba dispar
KKDINEFIIPSSITKIGDW

SEQ ID NO: 2490348 - protein, 19 aa, Entamoeba dispar
KKDINEFIIPSSITKLDDW

SEQ ID NO: 2490349 - protein, 19 aa, Entamoeba dispar
KKDINEFIIPSSITKLGDD

SEQ ID NO: 2490350 - protein, 19 aa, Entamoeba dispar
KKDINEFIIPSSITKLGDW

SEQ ID NO: 2490351 - protein, 18 aa, Entamoeba dispar
KKDINEFIIPSSITKLGN

SEQ ID NO: 2490352 - protein, 19 aa, Entamoeba dispar
KKDINEFIIPSSITKLGYK

SEQ ID NO: 2490353 - protein, 18 aa, Entamoeba dispar
KKDINKFIIPSSITKLDN

SEQ ID NO: 2490354 - protein, 18 aa, Entamoeba dispar
KKDINKFIIPSSITKLGE

SEQ ID NO: 2490355 - protein, 20 aa, Entamoeba dispar
KKDISDVVLVGGMTRMPLIQ

SEQ ID NO: 2490356 - protein, 21 aa, Entamoeba dispar
KKDLLKSAVWYENALTKGFND

SEQ ID NO: 2490357 - protein, 19 aa, Entamoeba dispar
KKDLLPHIGTDNFESKAQF

SEQ ID NO: 2490358 - protein, 24 aa, Entamoeba dispar
KKDMKLEIQRNVFAQYEEENQNAV

SEQ ID NO: 2490359 - protein, 24 aa, Entamoeba dispar
KKDRTKEGFDINGMIENEMSQFDS

SEQ ID NO: 2490360 - protein, 28 aa, Entamoeba dispar
KKDSRYVCPRCYQGVCSVNCYQTHNNGN

SEQ ID NO: 2490361 - protein, 24 aa, Entamoeba dispar
KKDVNLACMFWRKAKVLGSEKAVQ

SEQ ID NO: 2490362 - protein, 23 aa, Entamoeba dispar
KKDWYRLNIYYLKKAGAIVDDSK

SEQ ID NO: 2490363 - protein, 17 aa, Entamoeba dispar
KKEDCIKKLNELQNEIK

SEQ ID NO: 2490364 - protein, 30 aa, Entamoeba dispar
KKEEVIPIKKGDIWKVCHVKKEICTLKRGN

SEQ ID NO: 2490365 - protein, 24 aa, Entamoeba dispar
KKEFKKELQSSVGMSKEVGDYLLK

SEQ ID NO: 2490366 - protein, 18 aa, Entamoeba dispar
KKEFPLKDALIIDPLGYV

SEQ ID NO: 2490367 - protein, 23 aa, Entamoeba dispar
KKEFPQICVNCMKSYTDYINELN

SEQ ID NO: 2490368 - protein, 19 aa, Entamoeba dispar
KKEGFALFRTQCQAGTYMR

SEQ ID NO: 2490369 - protein, 21 aa, Entamoeba dispar
KKEGKLFMKMRIKNISGVIIN

SEQ ID NO: 2490370 - protein, 19 aa, Entamoeba dispar
KKEIFKKQYQIAINEREKQ

SEQ ID NO: 2490371 - protein, 21 aa, Entamoeba dispar
KKEIYRISLTNFIQLKDNELL

SEQ ID NO: 2490372 - protein, 35 aa, Entamoeba dispar
KKEKCVFKIGFFLSEMKLRCHEMFQWNEDEYDQIC

SEQ ID NO: 2490373 - protein, 25 aa, Entamoeba dispar
KKEKEKREGIIMKIIENMIRNEVVV

SEQ ID NO: 2490374 - protein, 20 aa, Entamoeba dispar
KKEKELIINGISYLEIIKIY

SEQ ID NO: 2490375 - protein, 24 aa, Entamoeba dispar
KKEKELKERIVLIEKKLDEAIEMM

SEQ ID NO: 2490376 - protein, 26 aa, Entamoeba dispar
KKEKGLRFGARIFSLFPEASKAKVAS

SEQ ID NO: 2490377 - protein, 20 aa, Entamoeba dispar
KKEKIKAICYNSQKEMPSKN

SEQ ID NO: 2490378 - protein, 22 aa, Entamoeba dispar
KKEKRNGNEWKDGMKEFEQGSP

SEQ ID NO: 2490379 - protein, 23 aa, Entamoeba dispar
KKELEENGCIELEPSDIDGSSSI

SEQ ID NO: 2490380 - protein, 18 aa, Entamoeba dispar
KKELKIFPKVEEIHGEIE

SEQ ID NO: 2490381 - protein, 22 aa, Entamoeba dispar
KKELKTNYIIKYCSCNSLKSKT

SEQ ID NO: 2490382 - protein, 24 aa, Entamoeba dispar
KKEMRIRVCYDVSIALSYLHHLNI

SEQ ID NO: 2490383 - protein, 18 aa, Entamoeba dispar
KKEMVVLREHFMKKCHGY

SEQ ID NO: 2490384 - protein, 23 aa, Entamoeba dispar
KKEPILFKEMRAWLNNVPSHYLD

SEQ ID NO: 2490385 - protein, 20 aa, Entamoeba dispar
KKEPYQKIEFSLTIEQSNEG

SEQ ID NO: 2490386 - protein, 19 aa, Entamoeba dispar
KKEQVKWSVGVSLPSFGIS

SEQ ID NO: 2490387 - protein, 21 aa, Entamoeba dispar
KKERELHGIIIVFNYNQDRFP

SEQ ID NO: 2490388 - protein, 20 aa, Entamoeba dispar
KKEREVMNITLQRMKNENEA

SEQ ID NO: 2490389 - protein, 17 aa, Entamoeba dispar
KKERKGRFVNFDQAAED

SEQ ID NO: 2490390 - protein, 20 aa, Entamoeba dispar
KKERVCDICANKNKKLSEST

SEQ ID NO: 2490391 - protein, 25 aa, Entamoeba dispar
KKESERKKRMVILYERKLDSMRELL

SEQ ID NO: 2490392 - protein, 17 aa, Entamoeba dispar
KKESIKKLENSGLDNEE

SEQ ID NO: 2490393 - protein, 23 aa, Entamoeba dispar
KKESWKKEVYVTLSTSDYFQNKI

SEQ ID NO: 2490394 - protein, 20 aa, Entamoeba dispar
KKETGYAIKMYPIDNRSWIL

SEQ ID NO: 2490395 - protein, 25 aa, Entamoeba dispar
KKEVYSQILSTLWQMSLIDMKYSMR

SEQ ID NO: 2490396 - protein, 17 aa, Entamoeba dispar
KKFAKKRSKAVVNGTIP

SEQ ID NO: 2490397 - protein, 20 aa, Entamoeba dispar
KKFDLCDVVLGKAYAQFAGR

SEQ ID NO: 2490398 - protein, 24 aa, Entamoeba dispar
KKFEKKPRRPGLIQHETLQQQMKA

SEQ ID NO: 2490399 - protein, 20 aa, Entamoeba dispar
KKFELIFAVYATDRLREVKY

SEQ ID NO: 2490400 - protein, 19 aa, Entamoeba dispar
KKFGWVSNYFILKDGKLIH

SEQ ID NO: 2490401 - protein, 19 aa, Entamoeba dispar
KKFHKYKPLKVPGVCLICK

SEQ ID NO: 2490402 - protein, 23 aa, Entamoeba dispar
KKFIHNRLFKWKLKEITAKQLDK

SEQ ID NO: 2490403 - protein, 19 aa, Entamoeba dispar
KKFIICLNKTNGLLYGFDQ

SEQ ID NO: 2490404 - protein, 18 aa, Entamoeba dispar
KKFIKIFIDLIKTPETFD

SEQ ID NO: 2490405 - protein, 20 aa, Entamoeba dispar
KKFISILPFDALKESFNELI

SEQ ID NO: 2490406 - protein, 20 aa, Entamoeba dispar
KKFKDFTAWVKKLGRNTSTH

SEQ ID NO: 2490407 - protein, 17 aa, Entamoeba dispar
KKFPFAQEDTLYLLQYL

SEQ ID NO: 2490408 - protein, 23 aa, Entamoeba dispar
KKFQEQAIWMLNAMWPKDQGKSA

SEQ ID NO: 2490409 - protein, 17 aa, Entamoeba dispar
KKFRLTEQLKKIEMEKC

SEQ ID NO: 2490410 - protein, 21 aa, Entamoeba dispar
KKFTEDGSQMFVHFPTRIELF

SEQ ID NO: 2490411 - protein, 17 aa, Entamoeba dispar
KKFTEKAVGHFGSGWCW

SEQ ID NO: 2490412 - protein, 18 aa, Entamoeba dispar
KKFYKEKEEFKRKTEQYI

SEQ ID NO: 2490413 - protein, 20 aa, Entamoeba dispar
KKFYLEALDLLQPVEKVTCQ

SEQ ID NO: 2490414 - protein, 17 aa, Entamoeba dispar
KKGAEGISIYKTKQAVI

SEQ ID NO: 2490415 - protein, 20 aa, Entamoeba dispar
KKGDTTPCYWVLTQSVLSLY

SEQ ID NO: 2490416 - protein, 27 aa, Entamoeba dispar
KKGDTVRFKNEFILDTKGIKVGEKENK

SEQ ID NO: 2490417 - protein, 17 aa, Entamoeba dispar
KKGDVIVSIGSPKSSST

SEQ ID NO: 2490418 - protein, 18 aa, Entamoeba dispar
KKGELVCVLGSVGSGKSS

SEQ ID NO: 2490419 - protein, 28 aa, Entamoeba dispar
KKGEPRTMFKFVLEFLKLSLQNEDTDEG

SEQ ID NO: 2490420 - protein, 24 aa, Entamoeba dispar
KKGFTIEIIASIGLTGLEDDIQYV

SEQ ID NO: 2490421 - protein, 17 aa, Entamoeba dispar
KKGGILVSKGKLGLGTK

SEQ ID NO: 2490422 - protein, 20 aa, Entamoeba dispar
KKGIKIRCSDEFEKKFDCVF

SEQ ID NO: 2490423 - protein, 24 aa, Entamoeba dispar
KKGKLIFKNFDVIKTIKYLSIDGD

SEQ ID NO: 2490424 - protein, 24 aa, Entamoeba dispar
KKGMFKIYMRGVVLALKHIDEPTI

SEQ ID NO: 2490425 - protein, 18 aa, Entamoeba dispar
KKGMKVGMKKGFKKGFHK

SEQ ID NO: 2490426 - protein, 18 aa, Entamoeba dispar
KKGNHFHGTLSYQQYLDL

SEQ ID NO: 2490427 - protein, 20 aa, Entamoeba dispar
KKGNTCKFIYYSKEDKKKFG

SEQ ID NO: 2490428 - protein, 17 aa, Entamoeba dispar
KKGRYLIHFGGVKITSK

SEQ ID NO: 2490429 - protein, 25 aa, Entamoeba dispar
KKGSQRLKLLKAQRNYLNKVLSFTN

SEQ ID NO: 2490430 - protein, 21 aa, Entamoeba dispar
KKGVSRTIILIGYKPKRFSDK

SEQ ID NO: 2490431 - protein, 26 aa, Entamoeba dispar
KKGYECKELSSLINQYWKGCVIDIGS

SEQ ID NO: 2490432 - protein, 19 aa, Entamoeba dispar
KKHAITIEGIFRVSGSKDN

SEQ ID NO: 2490433 - protein, 18 aa, Entamoeba dispar
KKHCDMIVANQLNVPGAG

SEQ ID NO: 2490434 - protein, 26 aa, Entamoeba dispar
KKHDIAIKIALRIGIEDLSKMLLTLI

SEQ ID NO: 2490435 - protein, 19 aa, Entamoeba dispar
KKHGMGMVVVRNGTHYGIA

SEQ ID NO: 2490436 - protein, 19 aa, Entamoeba dispar
KKHIFCYKLKTSESNNIHQ

SEQ ID NO: 2490437 - protein, 18 aa, Entamoeba dispar
KKHLSLDKTMTFVRNKNP

SEQ ID NO: 2490438 - protein, 22 aa, Entamoeba dispar
KKHPQCCHSYFGVLLMNIHQSL

SEQ ID NO: 2490439 - protein, 20 aa, Entamoeba dispar
KKHPQCCHSYYGVLLMNIHQ

SEQ ID NO: 2490440 - protein, 20 aa, Entamoeba dispar
KKHQNEIITFFFNAIKEKSI

SEQ ID NO: 2490441 - protein, 19 aa, Entamoeba dispar
KKHREIIQEPIIRKDGRKV

SEQ ID NO: 2490442 - protein, 25 aa, Entamoeba dispar
KKIALEFYDKIAIAIDEVIDDGIIL

SEQ ID NO: 2490443 - protein, 31 aa, Entamoeba dispar
KKICKRTEYRCIQCMKDAKLRKKDISDVVLV

SEQ ID NO: 2490444 - protein, 24 aa, Entamoeba dispar
KKICSRSVLIKTVYEIWGEAKTYE

SEQ ID NO: 2490445 - protein, 30 aa, Entamoeba dispar
KKIDGEGIFDISMLFSLKICNEDIDIVTAE

SEQ ID NO: 2490446 - protein, 17 aa, Entamoeba dispar
KKIDGRALILITLSLMK

SEQ ID NO: 2490447 - protein, 29 aa, Entamoeba dispar
KKIEFKGKLDGFFKLLESITIPSPIFEII

SEQ ID NO: 2490448 - protein, 19 aa, Entamoeba dispar
KKIEGIKKIKQGRIEIESE

SEQ ID NO: 2490449 - protein, 18 aa, Entamoeba dispar
KKIFCVQITPSSITFLPP

SEQ ID NO: 2490450 - protein, 20 aa, Entamoeba dispar
KKIFKSGLVMRNELYQSLFE

SEQ ID NO: 2490451 - protein, 26 aa, Entamoeba dispar
KKIFRTRTKMLSYWRRNLEDILSGEQ

SEQ ID NO: 2490452 - protein, 24 aa, Entamoeba dispar
KKIGDKCFKGCLLLKTVVIPTTIG

SEQ ID NO: 2490453 - protein, 25 aa, Entamoeba dispar
KKIGEKGIFAGIIKKEIATIRFIKE

SEQ ID NO: 2490454 - protein, 23 aa, Entamoeba dispar
KKIGKYAFKSSILLQTPIIPNGC

SEQ ID NO: 2490455 - protein, 21 aa, Entamoeba dispar
KKIGNPICDYYQLLLYNNTII

SEQ ID NO: 2490456 - protein, 26 aa, Entamoeba dispar
KKIHERANAFNLKWMKSNINGKWSGK

SEQ ID NO: 2490457 - protein, 20 aa, Entamoeba dispar
KKIIADFRNGVLMVIAKLAI

SEQ ID NO: 2490458 - protein, 20 aa, Entamoeba dispar
KKIICDGGCCILFKRLADNS

SEQ ID NO: 2490459 - protein, 21 aa, Entamoeba dispar
KKIIEKWKIIKRIDDIINKTK

SEQ ID NO: 2490460 - protein, 17 aa, Entamoeba dispar
KKIIIVDVSCVFVEQIV

SEQ ID NO: 2490461 - protein, 17 aa, Entamoeba dispar
KKIIRIIFEKMRKYKSG

SEQ ID NO: 2490462 - protein, 23 aa, Entamoeba dispar
KKIIWSTIIPFKVRSIIATETHV

SEQ ID NO: 2490463 - protein, 22 aa, Entamoeba dispar
KKIKECCFFNCKHLSSVTIPSS

SEQ ID NO: 2490464 - protein, 21 aa, Entamoeba dispar
KKIKKDEWSSVQQKLKEGYNE

SEQ ID NO: 2490465 - protein, 22 aa, Entamoeba dispar
KKIKKSKTVFVYSSLPTQFQGR

SEQ ID NO: 2490466 - protein, 27 aa, Entamoeba dispar
KKIKRKKRRLNALKMIYINILGYEIDV

SEQ ID NO: 2490467 - protein, 30 aa, Entamoeba dispar
KKIKTETYSGISLRVIFPAFGGDAKTIQQL

SEQ ID NO: 2490468 - protein, 25 aa, Entamoeba dispar
KKIKVRTVIALKGLLLDAFEECDES

SEQ ID NO: 2490469 - protein, 21 aa, Entamoeba dispar
KKILRCQCGMGHHNTVGFSKI

SEQ ID NO: 2490470 - protein, 24 aa, Entamoeba dispar
KKILRLFLFGLYKMKALSPPVLRI

SEQ ID NO: 2490471 - protein, 27 aa, Entamoeba dispar
KKIMDLGFKGPFLIITDKENLGFYQEN

SEQ ID NO: 2490472 - protein, 39 aa, Entamoeba dispar
KKINAQGCGWYVRKTEWKGMTGKELLSFEDFNKCVSIDT

SEQ ID NO: 2490473 - protein, 28 aa, Entamoeba dispar
KKINKPRFIYLFNDMLMYGIGDERKLSV

SEQ ID NO: 2490474 - protein, 21 aa, Entamoeba dispar
KKIQIPYVFRYLAAELSAMNV

SEQ ID NO: 2490475 - protein, 26 aa, Entamoeba dispar
KKIQPCLTGIFVALMRMFAAYTIINS

SEQ ID NO: 2490476 - protein, 17 aa, Entamoeba dispar
KKIRINTGISLNKKLIF

SEQ ID NO: 2490477 - protein, 19 aa, Entamoeba dispar
KKIRRTHTPQKVTFSTFKI

SEQ ID NO: 2490478 - protein, 21 aa, Entamoeba dispar
KKISIAFCGNSAVGKTALFTR

SEQ ID NO: 2490479 - protein, 18 aa, Entamoeba dispar
KKISLSENIPESLALHLF

SEQ ID NO: 2490480 - protein, 25 aa, Entamoeba dispar
KKITNEFLNTIIIDALYQLEELELS

SEQ ID NO: 2490481 - protein, 28 aa, Entamoeba dispar
KKITSLCLRTGIKIGCSRLKLDQNTSDI

SEQ ID NO: 2490482 - protein, 19 aa, Entamoeba dispar
KKITYWMLVREKYFEENLP

SEQ ID NO: 2490483 - protein, 19 aa, Entamoeba dispar
KKIVKRLKRKKQRENNSSS

SEQ ID NO: 2490484 - protein, 33 aa, Entamoeba dispar
KKIVQEAVIWPMLRPDIFTGLRAPPKGLLLFGP

SEQ ID NO: 2490485 - protein, 23 aa, Entamoeba dispar
KKIYCIIKLNLWYTKPKTIKYGN

SEQ ID NO: 2490486 - protein, 19 aa, Entamoeba dispar
KKIYCVIKLNRWYTKPKTI

SEQ ID NO: 2490487 - protein, 17 aa, Entamoeba dispar
KKIYDYFGIEITPEAEK

SEQ ID NO: 2490488 - protein, 19 aa, Entamoeba dispar
KKIYITIMSCYNFEECVHK

SEQ ID NO: 2490489 - protein, 27 aa, Entamoeba dispar
KKKAEKCVICDTSFLFQMRRRASDVHN

SEQ ID NO: 2490490 - protein, 18 aa, Entamoeba dispar
KKKASICVSQIDLENTEE

SEQ ID NO: 2490491 - protein, 21 aa, Entamoeba dispar
KKKCLRYRFIKGMTETFYHCF

SEQ ID NO: 2490492 - protein, 21 aa, Entamoeba dispar
KKKCSYIIHCYIRKEDTKFHR

SEQ ID NO: 2490493 - protein, 27 aa, Entamoeba dispar
KKKCTEPSDWILFYLFNCVDREQYAMS

SEQ ID NO: 2490494 - protein, 22 aa, Entamoeba dispar
KKKDRIQFLLTFNKSKKKLNKI

SEQ ID NO: 2490495 - protein, 23 aa, Entamoeba dispar
KKKEIIFGTGFVDLSPFTTVKIK

SEQ ID NO: 2490496 - protein, 18 aa, Entamoeba dispar
KKKEIPKFSLPIKTLKWS

SEQ ID NO: 2490497 - protein, 17 aa, Entamoeba dispar
KKKEIRCVSSTNLDREG

SEQ ID NO: 2490498 - protein, 28 aa, Entamoeba dispar
KKKELIHILRIILPLKKENNIKQEKMIK

SEQ ID NO: 2490499 - protein, 19 aa, Entamoeba dispar
KKKERKIWKIADDRLEEDL

SEQ ID NO: 2490500 - protein, 26 aa, Entamoeba dispar
KKKEVYGNGIAQCFIGEFGKFEEYAH

SEQ ID NO: 2490501 - protein, 18 aa, Entamoeba dispar
KKKFEIMDTAFIENLIGE

SEQ ID NO: 2490502 - protein, 26 aa, Entamoeba dispar
KKKFGVGVTVKPKFAMDGDEINTNAP

SEQ ID NO: 2490503 - protein, 22 aa, Entamoeba dispar
KKKGELEWLIEIEFIHDNEINS

SEQ ID NO: 2490504 - protein, 19 aa, Entamoeba dispar
KKKGFFRYKFNKRNESIPL

SEQ ID NO: 2490505 - protein, 20 aa, Entamoeba dispar
KKKGHYNLIGSPARYDPLKH

SEQ ID NO: 2490506 - protein, 22 aa, Entamoeba dispar
KKKGKKLACSYLISITKKYQES

SEQ ID NO: 2490507 - protein, 19 aa, Entamoeba dispar
KKKGLKLLSEAKCVLHLLN

SEQ ID NO: 2490508 - protein, 21 aa, Entamoeba dispar
KKKIEVCDFFIRRFDEQSQIV

SEQ ID NO: 2490509 - protein, 19 aa, Entamoeba dispar
KKKIEVLKREEIWAKYRDQ

SEQ ID NO: 2490510 - protein, 17 aa, Entamoeba dispar
KKKIFDNSVIWSIGVIF

SEQ ID NO: 2490511 - protein, 21 aa, Entamoeba dispar
KKKIKIKPLRTCKTGDQDLII

SEQ ID NO: 2490512 - protein, 23 aa, Entamoeba dispar
KKKKEERAKRDAEFAKLTGGDVD

SEQ ID NO: 2490513 - protein, 21 aa, Entamoeba dispar
KKKKFKVIIVVPIWSEGELKS

SEQ ID NO: 2490514 - protein, 19 aa, Entamoeba dispar
KKKKFLGIDLKELCQLSGE

SEQ ID NO: 2490515 - protein, 20 aa, Entamoeba dispar
KKKKGVLTVDDWIFAMKSYG

SEQ ID NO: 2490516 - protein, 20 aa, Entamoeba dispar
KKKKKGIFSKLFGKKKEETT

SEQ ID NO: 2490517 - protein, 18 aa, Entamoeba dispar
KKKKRVNTDIVFPKLENF

SEQ ID NO: 2490518 - protein, 18 aa, Entamoeba dispar
KKKLCFNNTLKLLDMSFA

SEQ ID NO: 2490519 - protein, 21 aa, Entamoeba dispar
KKKLDNLLISKEFIEAETQGI

SEQ ID NO: 2490520 - protein, 24 aa, Entamoeba dispar
KKKLKDKLVHLFKIQAMLSDLNSS

SEQ ID NO: 2490521 - protein, 24 aa, Entamoeba dispar
KKKLKEVKAIFSVKLPAGPIDYQT

SEQ ID NO: 2490522 - protein, 20 aa, Entamoeba dispar
KKKLKIPINHLVKEDDTTQN

SEQ ID NO: 2490523 - protein, 28 aa, Entamoeba dispar
KKKLLIMFINHYIYFFPLLDQITPDKIT

SEQ ID NO: 2490524 - protein, 21 aa, Entamoeba dispar
KKKLMGHLNVLRGFSQLLKEE

SEQ ID NO: 2490525 - protein, 22 aa, Entamoeba dispar
KKKLQSFIVWLVCILPHSLKIH

SEQ ID NO: 2490526 - protein, 31 aa, Entamoeba dispar
KKKLTPGSFSVIFPKEIGVFEYTQPTKCLIN

SEQ ID NO: 2490527 - protein, 20 aa, Entamoeba dispar
KKKMVCIGRVLLSRKAKDFI

SEQ ID NO: 2490528 - protein, 20 aa, Entamoeba dispar
KKKNRKGLDELLEKEEFADV

SEQ ID NO: 2490529 - protein, 19 aa, Entamoeba dispar
KKKNTEWERIIIKTKLKDV

SEQ ID NO: 2490530 - protein, 20 aa, Entamoeba dispar
KKKQKEILEGHVSMEELEDY

SEQ ID NO: 2490531 - protein, 19 aa, Entamoeba dispar
KKKRAHIKYIAIGKTTQGA

SEQ ID NO: 2490532 - protein, 23 aa, Entamoeba dispar
KKKRDIIDLTQAYQIAKQNAEIE

SEQ ID NO: 2490533 - protein, 23 aa, Entamoeba dispar
KKKRKRKFSLFSFGDKKSQEEEI

SEQ ID NO: 2490534 - protein, 19 aa, Entamoeba dispar
KKKRSCSPINIKYKETVSP

SEQ ID NO: 2490535 - protein, 18 aa, Entamoeba dispar
KKKSEAHIVIHSTEKKPK

SEQ ID NO: 2490536 - protein, 19 aa, Entamoeba dispar
KKKSGLSINMATAKREELI

SEQ ID NO: 2490537 - protein, 20 aa, Entamoeba dispar
KKKSRVIAIRNGNIERKRAS

SEQ ID NO: 2490538 - protein, 17 aa, Entamoeba dispar
KKKTIRNGLLYLLFFLR

SEQ ID NO: 2490539 - protein, 22 aa, Entamoeba dispar
KKKTITCLWNKLFKQIGKLVIE

SEQ ID NO: 2490540 - protein, 28 aa, Entamoeba dispar
KKKTSEDFIDLLLEKKVEAKEKKPTKKN

SEQ ID NO: 2490541 - protein, 17 aa, Entamoeba dispar
KKKVEGCCGKWIEWYEE

SEQ ID NO: 2490542 - protein, 19 aa, Entamoeba dispar
KKKVENLIGKFAKRIIMED

SEQ ID NO: 2490543 - protein, 19 aa, Entamoeba dispar
KKKVFSLDDLPGFGTNELR

SEQ ID NO: 2490544 - protein, 19 aa, Entamoeba dispar
KKKWLIWKEYIDTMLKLNR

SEQ ID NO: 2490545 - protein, 28 aa, Entamoeba dispar
KKKYIKHCICIPLDLPPMPLYPDQMKEK

SEQ ID NO: 2490546 - protein, 18 aa, Entamoeba dispar
KKLACSYLISITKKYQES

SEQ ID NO: 2490547 - protein, 18 aa, Entamoeba dispar
KKLAKKELKDEKKMTKGL

SEQ ID NO: 2490548 - protein, 19 aa, Entamoeba dispar
KKLDEAIEMMRKKDKLTNE

SEQ ID NO: 2490549 - protein, 25 aa, Entamoeba dispar
KKLELKYLFCSPISKGIELIEKNPS

SEQ ID NO: 2490550 - protein, 19 aa, Entamoeba dispar
KKLEPMDASLAQKVNDAQE

SEQ ID NO: 2490551 - protein, 19 aa, Entamoeba dispar
KKLFHTMKEPSFLDWRLNV

SEQ ID NO: 2490552 - protein, 20 aa, Entamoeba dispar
KKLFIPQFIPTIKILPELLN

SEQ ID NO: 2490553 - protein, 25 aa, Entamoeba dispar
KKLGEGMCGKVYLAFHEKTGVKVAI

SEQ ID NO: 2490554 - protein, 19 aa, Entamoeba dispar
KKLGGFATWGIGRLEKKQI

SEQ ID NO: 2490555 - protein, 24 aa, Entamoeba dispar
KKLGKFNEIFLLNSWFSSNPNASS

SEQ ID NO: 2490556 - protein, 25 aa, Entamoeba dispar
KKLGKFNEIFLLNSWFSSNPNASSL

SEQ ID NO: 2490557 - protein, 18 aa, Entamoeba dispar
KKLGSWKIPDNTQCKLNP

SEQ ID NO: 2490558 - protein, 27 aa, Entamoeba dispar
KKLHLFIPRVPAFSVTLSFLTSLPKKN

SEQ ID NO: 2490559 - protein, 20 aa, Entamoeba dispar
KKLHNMFIELKGIKEEREKL

SEQ ID NO: 2490560 - protein, 18 aa, Entamoeba dispar
KKLHPMNDYFSLKKDIYL

SEQ ID NO: 2490561 - protein, 25 aa, Entamoeba dispar
KKLIEKPRQLFKIYVPESQVSLSPY

SEQ ID NO: 2490562 - protein, 18 aa, Entamoeba dispar
KKLIEYAERYLLEKQKID

SEQ ID NO: 2490563 - protein, 19 aa, Entamoeba dispar
KKLIPTLAISQRHAFLPLY

SEQ ID NO: 2490564 - protein, 17 aa, Entamoeba dispar
KKLKARYVFSDTNEVKN

SEQ ID NO: 2490565 - protein, 26 aa, Entamoeba dispar
KKLKEEELRIAEEFKQKREQWRKERK

SEQ ID NO: 2490566 - protein, 20 aa, Entamoeba dispar
KKLKEIYGDIIVINLLDNHG

SEQ ID NO: 2490567 - protein, 20 aa, Entamoeba dispar
KKLKEKRLLENQIKEENDSQ

SEQ ID NO: 2490568 - protein, 23 aa, Entamoeba dispar
KKLKITPISGGFVFMYDVSAICD

SEQ ID NO: 2490569 - protein, 21 aa, Entamoeba dispar
KKLKQKRIDAGALMLASSEIK

SEQ ID NO: 2490570 - protein, 17 aa, Entamoeba dispar
KKLLEWVKRLESIKFGR

SEQ ID NO: 2490571 - protein, 22 aa, Entamoeba dispar
KKLLRKIDCYMNEGGIKRKKEE

SEQ ID NO: 2490572 - protein, 28 aa, Entamoeba dispar
KKLMCKSCACPKCKVCGEAIEGKIIRVE

SEQ ID NO: 2490573 - protein, 19 aa, Entamoeba dispar
KKLNIEVVDCKSPTSPIIS

SEQ ID NO: 2490574 - protein, 30 aa, Entamoeba dispar
KKLNKLYEKFPRVVKQFARNRPLEYGPNRH

SEQ ID NO: 2490575 - protein, 23 aa, Entamoeba dispar
KKLPNLCSLILRSTTISQFSSIH

SEQ ID NO: 2490576 - protein, 17 aa, Entamoeba dispar
KKLQSQFSLYVSSVNSL

SEQ ID NO: 2490577 - protein, 19 aa, Entamoeba dispar
KKLREVCKNYNILVEAYRP

SEQ ID NO: 2490578 - protein, 19 aa, Entamoeba dispar
KKLRKEHKKQYKIERREKL

SEQ ID NO: 2490579 - protein, 21 aa, Entamoeba dispar
KKLRKEHKKQYKIERREKLKH

SEQ ID NO: 2490580 - protein, 17 aa, Entamoeba dispar
KKLRLVVDGEDLNKRNL

SEQ ID NO: 2490581 - protein, 17 aa, Entamoeba dispar
KKLRPSLQGKLHRRKTT

SEQ ID NO: 2490582 - protein, 19 aa, Entamoeba dispar
KKLSDFICNSGILFPMCLQ

SEQ ID NO: 2490583 - protein, 28 aa, Entamoeba dispar
KKLSGELVFECWDWDRMNSDDLLGTVKV

SEQ ID NO: 2490584 - protein, 18 aa, Entamoeba dispar
KKLSNCVYYKPLPQKKNK

SEQ ID NO: 2490585 - protein, 20 aa, Entamoeba dispar
KKLSPYRKYIQPAIEVSGLL

SEQ ID NO: 2490586 - protein, 21 aa, Entamoeba dispar
KKLSSSLFYYCISLKSIEIPS

SEQ ID NO: 2490587 - protein, 25 aa, Entamoeba dispar
KKLTTKCPVCGTITLKDKLQEHTKF

SEQ ID NO: 2490588 - protein, 18 aa, Entamoeba dispar
KKLVEMNQLIDACGNLVD

SEQ ID NO: 2490589 - protein, 21 aa, Entamoeba dispar
KKLVIPEMKRTVELLEDKLKD

SEQ ID NO: 2490590 - protein, 17 aa, Entamoeba dispar
KKLVTFFRQTIKVQGRA

SEQ ID NO: 2490591 - protein, 26 aa, Entamoeba dispar
KKLYESCFYRSMLDNNCLVVYAENII

SEQ ID NO: 2490592 - protein, 17 aa, Entamoeba dispar
KKMEFLWTGDMKLNTVH

SEQ ID NO: 2490593 - protein, 29 aa, Entamoeba dispar
KKMFLEKGYCIFTNWIVSFYSFIISNINN

SEQ ID NO: 2490594 - protein, 24 aa, Entamoeba dispar
KKMGEIDLSLAFSIVPNEELKIKN

SEQ ID NO: 2490595 - protein, 20 aa, Entamoeba dispar
KKMIACGIGQSVCEIIRVIH

SEQ ID NO: 2490596 - protein, 21 aa, Entamoeba dispar
KKMKEVMVLNQEINQMKVLIV

SEQ ID NO: 2490597 - protein, 20 aa, Entamoeba dispar
KKMLDECLLYYSYDMNITLN

SEQ ID NO: 2490598 - protein, 23 aa, Entamoeba dispar
KKMNNSYCIFVGKVSAITTESTL

SEQ ID NO: 2490599 - protein, 23 aa, Entamoeba dispar
KKMRLDLVWIERINKISNKIIEN

SEQ ID NO: 2490600 - protein, 24 aa, Entamoeba dispar
KKMSELKISIGGILISIPDGTDYS

SEQ ID NO: 2490601 - protein, 21 aa, Entamoeba dispar
KKMSFGACTVDELKLIARRKK

SEQ ID NO: 2490602 - protein, 19 aa, Entamoeba dispar
KKMSGCRPLAYQVDDEKGE

SEQ ID NO: 2490603 - protein, 19 aa, Entamoeba dispar
KKMVFSFKGNDKIIPIMKE

SEQ ID NO: 2490604 - protein, 17 aa, Entamoeba dispar
KKNAFRIKVTQEMIKTE

SEQ ID NO: 2490605 - protein, 30 aa, Entamoeba dispar
KKNDGSEYWTCFGTAYKEMCNYFDSIPPES

SEQ ID NO: 2490606 - protein, 18 aa, Entamoeba dispar
KKNERFWKAKDKLSEVQA

SEQ ID NO: 2490607 - protein, 28 aa, Entamoeba dispar
KKNFKNIYCVIKLNLWYIKPKTIKYGNV

SEQ ID NO: 2490608 - protein, 23 aa, Entamoeba dispar
KKNFNLSVKIPKEIISPRKKTLK

SEQ ID NO: 2490609 - protein, 27 aa, Entamoeba dispar
KKNGRLPAIEFMFGLPLETPRNKQRRQ

SEQ ID NO: 2490610 - protein, 20 aa, Entamoeba dispar
KKNIKKICEKYGIRVELKYY

SEQ ID NO: 2490611 - protein, 19 aa, Entamoeba dispar
KKNILLLINQCKPFDIKVE

SEQ ID NO: 2490612 - protein, 19 aa, Entamoeba dispar
KKNINEFIIPSSITKLGGH

SEQ ID NO: 2490613 - protein, 30 aa, Entamoeba dispar
KKNKKYCKIFRIIFRFISKVITERIDEEDN

SEQ ID NO: 2490614 - protein, 23 aa, Entamoeba dispar
KKNKTKLVIMLLKYQCLSSEINQ

SEQ ID NO: 2490615 - protein, 23 aa, Entamoeba dispar
KKNLKRYLTVLSNPHYQFLTFLK

SEQ ID NO: 2490616 - protein, 18 aa, Entamoeba dispar
KKNLRFVSNLYQIVNAPQ

SEQ ID NO: 2490617 - protein, 19 aa, Entamoeba dispar
KKNMEDFESLIQLPLIGLT

SEQ ID NO: 2490618 - protein, 18 aa, Entamoeba dispar
KKNPFARLVECSWESLNS

SEQ ID NO: 2490619 - protein, 25 aa, Entamoeba dispar
KKNPIRCVLCDFGLCSEYNSHYVSQ

SEQ ID NO: 2490620 - protein, 19 aa, Entamoeba dispar
KKNPQRAADCIKKQTIQAE

SEQ ID NO: 2490621 - protein, 20 aa, Entamoeba dispar
KKNQIRISLWVGEHDDSKAV

SEQ ID NO: 2490622 - protein, 20 aa, Entamoeba dispar
KKNRKICCQILQEISSVKRD

SEQ ID NO: 2490623 - protein, 24 aa, Entamoeba dispar
KKNRLKFMMRNGLINNVTQCLDML

SEQ ID NO: 2490624 - protein, 19 aa, Entamoeba dispar
KKNRLSRSFLGLFEKKKKE

SEQ ID NO: 2490625 - protein, 18 aa, Entamoeba dispar
KKNSCPRHMKVVTTESRC

SEQ ID NO: 2490626 - protein, 25 aa, Entamoeba dispar
KKNSKKISVSFTRFEMDFDNYNDES

SEQ ID NO: 2490627 - protein, 19 aa, Entamoeba dispar
KKNSYKESINFVVDLLIEL

SEQ ID NO: 2490628 - protein, 23 aa, Entamoeba dispar
KKNTKALIVGRSFLQEDDKKELM

SEQ ID NO: 2490629 - protein, 19 aa, Entamoeba dispar
KKNTRPSFEDLLIQPVQRL

SEQ ID NO: 2490630 - protein, 19 aa, Entamoeba dispar
KKNVFDIEMVDSMGVEKDD

SEQ ID NO: 2490631 - protein, 25 aa, Entamoeba dispar
KKNVGIGMCTIRFSVEVADKNHKQA

SEQ ID NO: 2490632 - protein, 17 aa, Entamoeba dispar
KKNWKGIEYHITTQMAK

SEQ ID NO: 2490633 - protein, 23 aa, Entamoeba dispar
KKNYCSKLRYSVLTLDSALSSTQ

SEQ ID NO: 2490634 - protein, 29 aa, Entamoeba dispar
KKNYLPPVPLVFGIGIMFVVEKEDKENHE

SEQ ID NO: 2490635 - protein, 19 aa, Entamoeba dispar
KKPFFISLPCKRNIPMEQF

SEQ ID NO: 2490636 - protein, 21 aa, Entamoeba dispar
KKPFIIIDGILQFLKFEKITE

SEQ ID NO: 2490637 - protein, 18 aa, Entamoeba dispar
KKPFPSLLRNYLRELRSL

SEQ ID NO: 2490638 - protein, 25 aa, Entamoeba dispar
KKPFRGGFDSCWLCEKGIESINFFS

SEQ ID NO: 2490639 - protein, 26 aa, Entamoeba dispar
KKPFVKPKEGVIFIVDCHSYDDQPFD

SEQ ID NO: 2490640 - protein, 17 aa, Entamoeba dispar
KKPGCDGHGGCHRQGGC

SEQ ID NO: 2490641 - protein, 19 aa, Entamoeba dispar
KKPGCKGKIKLDHSKRILD

SEQ ID NO: 2490642 - protein, 24 aa, Entamoeba dispar
KKPGCSGKIRLDHSKKILDVEVSM

SEQ ID NO: 2490643 - protein, 23 aa, Entamoeba dispar
KKPGCVPTCPAHIDIPGFISELK

SEQ ID NO: 2490644 - protein, 18 aa, Entamoeba dispar
KKPIIVICGGDGSVESCL

SEQ ID NO: 2490645 - protein, 26 aa, Entamoeba dispar
KKPIPPCPSKNLFPFIQYQPPNTSKV

SEQ ID NO: 2490646 - protein, 19 aa, Entamoeba dispar
KKPIPVFVEKPGKNWGPAC

SEQ ID NO: 2490647 - protein, 17 aa, Entamoeba dispar
KKPISMKMAEKLIKDLK

SEQ ID NO: 2490648 - protein, 21 aa, Entamoeba dispar
KKPKDKFFINFYDGVNTLKEV

SEQ ID NO: 2490649 - protein, 20 aa, Entamoeba dispar
KKPKKSFLDFLGNVGGALFE

SEQ ID NO: 2490650 - protein, 20 aa, Entamoeba dispar
KKPKLPLSLRKESNNFQPKQ

SEQ ID NO: 2490651 - protein, 22 aa, Entamoeba dispar
KKPKVSSNIFGWINTKEHKKRE

SEQ ID NO: 2490652 - protein, 19 aa, Entamoeba dispar
KKPPSIDSIHIFIKSLDFF

SEQ ID NO: 2490653 - protein, 22 aa, Entamoeba dispar
KKPRLSKTLLEKEVKKNNTTTH

SEQ ID NO: 2490654 - protein, 19 aa, Entamoeba dispar
KKPTKVMRRPIGIQQLKQD

SEQ ID NO: 2490655 - protein, 18 aa, Entamoeba dispar
KKQCFLVKDVTPFCEAKQ

SEQ ID NO: 2490656 - protein, 19 aa, Entamoeba dispar
KKQFHWLYLYVLFKMVHHS

SEQ ID NO: 2490657 - protein, 17 aa, Entamoeba dispar
KKQFIKFKSLLHQNIPP

SEQ ID NO: 2490658 - protein, 24 aa, Entamoeba dispar
KKQFPAMIIPISLRVNEVIEDFPL

SEQ ID NO: 2490659 - protein, 25 aa, Entamoeba dispar
KKQGGAPCNFAMHMAQLGFESYAFI

SEQ ID NO: 2490660 - protein, 23 aa, Entamoeba dispar
KKQIKRIIKWLDTIFPKAVQLRW

SEQ ID NO: 2490661 - protein, 20 aa, Entamoeba dispar
KKQIPQFILFTTPKNCREVS

SEQ ID NO: 2490662 - protein, 18 aa, Entamoeba dispar
KKQKKFELIFAVYATDRL

SEQ ID NO: 2490663 - protein, 20 aa, Entamoeba dispar
KKQKNEILSMKKDIIKKNEE

SEQ ID NO: 2490664 - protein, 20 aa, Entamoeba dispar
KKQLINFSCLSNIVREAILS

SEQ ID NO: 2490665 - protein, 39 aa, Entamoeba dispar
KKQLNVELVIPFERFTVVDWVDIEGSPAFGLITDSGETL

SEQ ID NO: 2490666 - protein, 31 aa, Entamoeba dispar
KKQMIKMLYSLKIREAIKMGLISGYENICEE

SEQ ID NO: 2490667 - protein, 24 aa, Entamoeba dispar
KKQNFRIIWKRIKFTSHDHEEFGN

SEQ ID NO: 2490668 - protein, 24 aa, Entamoeba dispar
KKQNFRLVLINGKYYLQAESQEQM

SEQ ID NO: 2490669 - protein, 17 aa, Entamoeba dispar
KKQNWKKSILDAFNHCP

SEQ ID NO: 2490670 - protein, 19 aa, Entamoeba dispar
KKQQCVHLAPVNNQILALF

SEQ ID NO: 2490671 - protein, 22 aa, Entamoeba dispar
KKQRKEIIETIVSQEKTLKDQT

SEQ ID NO: 2490672 - protein, 20 aa, Entamoeba dispar
KKQRNCLFSNLLNALNNTYS

SEQ ID NO: 2490673 - protein, 24 aa, Entamoeba dispar
KKQSDWRANIKIDSIQDTRKQQPA

SEQ ID NO: 2490674 - protein, 19 aa, Entamoeba dispar
KKQVHGIELQYIFLTEEIG

SEQ ID NO: 2490675 - protein, 22 aa, Entamoeba dispar
KKRAERAKKFAISDSDDDDDAK

SEQ ID NO: 2490676 - protein, 20 aa, Entamoeba dispar
KKRATLKRQAFGNFASAMQQ

SEQ ID NO: 2490677 - protein, 28 aa, Entamoeba dispar
KKREMAIMLPDLYAIYNRARGTLVSPEE

SEQ ID NO: 2490678 - protein, 19 aa, Entamoeba dispar
KKREVNVIVKLVEADLRDN

SEQ ID NO: 2490679 - protein, 23 aa, Entamoeba dispar
KKRFWRETYAGAKLFNLSGITHG

SEQ ID NO: 2490680 - protein, 18 aa, Entamoeba dispar
KKRGEVFDLLKLNDYLTY

SEQ ID NO: 2490681 - protein, 18 aa, Entamoeba dispar
KKRGRLCGHDTAITCCII

SEQ ID NO: 2490682 - protein, 19 aa, Entamoeba dispar
KKRIDEFNNNIAIYDDLIR

SEQ ID NO: 2490683 - protein, 23 aa, Entamoeba dispar
KKRIKLKLNDEIISTVQVDTKTK

SEQ ID NO: 2490684 - protein, 17 aa, Entamoeba dispar
KKRINEMVNKKTEIHLT

SEQ ID NO: 2490685 - protein, 18 aa, Entamoeba dispar
KKRIQSFNELLDIYIKNK

SEQ ID NO: 2490686 - protein, 19 aa, Entamoeba dispar
KKRIVEYIHKYYVDPATDK

SEQ ID NO: 2490687 - protein, 17 aa, Entamoeba dispar
KKRKALEKLQNICQSLG

SEQ ID NO: 2490688 - protein, 19 aa, Entamoeba dispar
KKRKGEMNSNDFFENCSKA

SEQ ID NO: 2490689 - protein, 20 aa, Entamoeba dispar
KKRKLKQSDFVKGGDKAKNM

SEQ ID NO: 2490690 - protein, 22 aa, Entamoeba dispar
KKRKMPIIIKKVKGINQYVNEP

SEQ ID NO: 2490691 - protein, 20 aa, Entamoeba dispar
KKRLFQLINLIRTDCGELSC

SEQ ID NO: 2490692 - protein, 17 aa, Entamoeba dispar
KKRLKDISIKREFEDGK

SEQ ID NO: 2490693 - protein, 18 aa, Entamoeba dispar
KKRNAIIMKGFQLEELAE

SEQ ID NO: 2490694 - protein, 17 aa, Entamoeba dispar
KKRPIVFICHTGKERYC

SEQ ID NO: 2490695 - protein, 21 aa, Entamoeba dispar
KKRPLQDFEILHFLSEICSGL

SEQ ID NO: 2490696 - protein, 17 aa, Entamoeba dispar
KKRRAGYRAFSMADILN

SEQ ID NO: 2490697 - protein, 20 aa, Entamoeba dispar
KKRRISIACYLIVNGYTLNE

SEQ ID NO: 2490698 - protein, 26 aa, Entamoeba dispar
KKRSIPIPRKFIKFIEGPEVKNKLRD

SEQ ID NO: 2490699 - protein, 25 aa, Entamoeba dispar
KKRVAWTIICKYILKALANINEKQY

SEQ ID NO: 2490700 - protein, 21 aa, Entamoeba dispar
KKRYGSYGSIHGWYGNYKFVN

SEQ ID NO: 2490701 - protein, 17 aa, Entamoeba dispar
KKSAITEICEIPDKQTT

SEQ ID NO: 2490702 - protein, 18 aa, Entamoeba dispar
KKSCFNLYQFKEIIQYFY

SEQ ID NO: 2490703 - protein, 20 aa, Entamoeba dispar
KKSCIIFFDEIDAIGGTRFQ

SEQ ID NO: 2490704 - protein, 23 aa, Entamoeba dispar
KKSEKFFKLFVPIFIQCFHDQLQ

SEQ ID NO: 2490705 - protein, 17 aa, Entamoeba dispar
KKSFVPDLRILKRGVEY

SEQ ID NO: 2490706 - protein, 23 aa, Entamoeba dispar
KKSIDSRLSMSIMKTTFEKSFKK

SEQ ID NO: 2490707 - protein, 35 aa, Entamoeba dispar
KKSIEIIKLPPFNELKLPRLTAISSDNQTSLNQNI

SEQ ID NO: 2490708 - protein, 18 aa, Entamoeba dispar
KKSIFGPSVGINFNGYKS

SEQ ID NO: 2490709 - protein, 18 aa, Entamoeba dispar
KKSKVLMFNSNEEEPKAE

SEQ ID NO: 2490710 - protein, 17 aa, Entamoeba dispar
KKSLCICCINEEMKNKG

SEQ ID NO: 2490711 - protein, 17 aa, Entamoeba dispar
KKSLIVIEMSIEQLLND

SEQ ID NO: 2490712 - protein, 19 aa, Entamoeba dispar
KKSNKPRYFYLFNDVMVYG

SEQ ID NO: 2490713 - protein, 24 aa, Entamoeba dispar
KKSPIPFLAPTSFKRHSVNQLLHQ

SEQ ID NO: 2490714 - protein, 21 aa, Entamoeba dispar
KKSQASGFCYINDIVCAILEL

SEQ ID NO: 2490715 - protein, 18 aa, Entamoeba dispar
KKSRELLDTILVEISNFK

SEQ ID NO: 2490716 - protein, 25 aa, Entamoeba dispar
KKSSEIKMKLLFPPKLDNDEWKEKP

SEQ ID NO: 2490717 - protein, 20 aa, Entamoeba dispar
KKSTESLDWDEMKKKVEKMY

SEQ ID NO: 2490718 - protein, 22 aa, Entamoeba dispar
KKSVKECVRFILQQSEDIQQKK

SEQ ID NO: 2490719 - protein, 18 aa, Entamoeba dispar
KKSVSLPVYDYVTHSRKP

SEQ ID NO: 2490720 - protein, 24 aa, Entamoeba dispar
KKSYIKSLLCIVRSLISSNRSTLI

SEQ ID NO: 2490721 - protein, 19 aa, Entamoeba dispar
KKSYQVLIQKNFKEMLDGF

SEQ ID NO: 2490722 - protein, 26 aa, Entamoeba dispar
KKTEELFSFGDAFNFDATENKESNHE

SEQ ID NO: 2490723 - protein, 17 aa, Entamoeba dispar
KKTEFFKSLPSNIQTNA

SEQ ID NO: 2490724 - protein, 21 aa, Entamoeba dispar
KKTEPLPEKKMTVAQQDDLTS

SEQ ID NO: 2490725 - protein, 24 aa, Entamoeba dispar
KKTIGIKCPLKIYKEGSPQYFQIV

SEQ ID NO: 2490726 - protein, 21 aa, Entamoeba dispar
KKTKLQILESFIKKNQKKSIS

SEQ ID NO: 2490727 - protein, 18 aa, Entamoeba dispar
KKTKRRITNKTLKSKIQE

SEQ ID NO: 2490728 - protein, 18 aa, Entamoeba dispar
KKTLIPLNIQKLVIDKLT

SEQ ID NO: 2490729 - protein, 25 aa, Entamoeba dispar
KKTLWRFVEYYCVDPSKKIIKDFIE

SEQ ID NO: 2490730 - protein, 27 aa, Entamoeba dispar
KKTNSRLDQWILHRLNVMITLVHQWFK

SEQ ID NO: 2490731 - protein, 27 aa, Entamoeba dispar
KKTRPCHITTRLVRVSSLTFGTKTYSA

SEQ ID NO: 2490732 - protein, 24 aa, Entamoeba dispar
KKTSEYKCCYSFKENRDYQSEQES

SEQ ID NO: 2490733 - protein, 32 aa, Entamoeba dispar
KKTYLLNIWKSTYSINFSKFIQINNNQKSEKF

SEQ ID NO: 2490734 - protein, 17 aa, Entamoeba dispar
KKVCSLSDCQILIGKPN

SEQ ID NO: 2490735 - protein, 18 aa, Entamoeba dispar
KKVCYNFKEIENFDELFK

SEQ ID NO: 2490736 - protein, 24 aa, Entamoeba dispar
KKVEADLYWCLSLLLEHVQDHYTS

SEQ ID NO: 2490737 - protein, 29 aa, Entamoeba dispar
KKVEEARKIIKRMRVNSSVVRNTSSSPLL

SEQ ID NO: 2490738 - protein, 17 aa, Entamoeba dispar
KKVEKNSGFGFVEYARH

SEQ ID NO: 2490739 - protein, 18 aa, Entamoeba dispar
KKVENLIGKFAKRIIMED

SEQ ID NO: 2490740 - protein, 22 aa, Entamoeba dispar
KKVESIWRVFHSPIIGTKKVER

SEQ ID NO: 2490741 - protein, 18 aa, Entamoeba dispar
KKVFGTKETNMWIKIPID

SEQ ID NO: 2490742 - protein, 20 aa, Entamoeba dispar
KKVIWYKLKYSTYLEEKQKG

SEQ ID NO: 2490743 - protein, 23 aa, Entamoeba dispar
KKVKEKKKKVEFENLFDDKEDVD

SEQ ID NO: 2490744 - protein, 20 aa, Entamoeba dispar
KKVLCMGVAVGNVKLTEDQL

SEQ ID NO: 2490745 - protein, 17 aa, Entamoeba dispar
KKVLDLIKIKIDEYQLT

SEQ ID NO: 2490746 - protein, 19 aa, Entamoeba dispar
KKVLVCAPSNIAVDQLGIK

SEQ ID NO: 2490747 - protein, 25 aa, Entamoeba dispar
KKVNTFILKSFISFHTLSPYYKTIL

SEQ ID NO: 2490748 - protein, 31 aa, Entamoeba dispar
KKVPFNVNEMWKNWRIKLAANPKTASYLNDP

SEQ ID NO: 2490749 - protein, 19 aa, Entamoeba dispar
KKVPYLKEYMASYFTLKNG

SEQ ID NO: 2490750 - protein, 17 aa, Entamoeba dispar
KKVQVISDMLNLIGDMS

SEQ ID NO: 2490751 - protein, 21 aa, Entamoeba dispar
KKVRELWCAKYDEDFYCWVKT

SEQ ID NO: 2490752 - protein, 19 aa, Entamoeba dispar
KKVRSIVRISKLEDTVDKT

SEQ ID NO: 2490753 - protein, 24 aa, Entamoeba dispar
KKVSRERLLSFMFKRKTNEKTTIS

SEQ ID NO: 2490754 - protein, 20 aa, Entamoeba dispar
KKVTQQNGILKKEEECQIAD

SEQ ID NO: 2490755 - protein, 20 aa, Entamoeba dispar
KKVTYFFCHHIPLTTPFQPK

SEQ ID NO: 2490756 - protein, 24 aa, Entamoeba dispar
KKVVDWCNITGLSLIQTLPVNDTT

SEQ ID NO: 2490757 - protein, 19 aa, Entamoeba dispar
KKVVEEFSNKLPVNKIPLT

SEQ ID NO: 2490758 - protein, 26 aa, Entamoeba dispar
KKVVLLMDYCPISTINVLERTYPNPI

SEQ ID NO: 2490759 - protein, 18 aa, Entamoeba dispar
KKVYCQQPIEGVCEFIEK

SEQ ID NO: 2490760 - protein, 17 aa, Entamoeba dispar
KKWEIVQKNVLEFKEFI

SEQ ID NO: 2490761 - protein, 18 aa, Entamoeba dispar
KKWFEQRIKQKKDRYNIN

SEQ ID NO: 2490762 - protein, 21 aa, Entamoeba dispar
KKWIITLLYELSVYKDQLLNV

SEQ ID NO: 2490763 - protein, 25 aa, Entamoeba dispar
KKWKKRYLIWKGMVLYFYDKKGSKD

SEQ ID NO: 2490764 - protein, 17 aa, Entamoeba dispar
KKWKNNYKISVLGITGV

SEQ ID NO: 2490765 - protein, 17 aa, Entamoeba dispar
KKWPIGNIKFETMSLKQ

SEQ ID NO: 2490766 - protein, 22 aa, Entamoeba dispar
KKWRRIWCCLRCICEDGKGNCV

SEQ ID NO: 2490767 - protein, 19 aa, Entamoeba dispar
KKYALIVDVILRMIRVLER

SEQ ID NO: 2490768 - protein, 16 aa, Entamoeba dispar
KKYECINYLNGSSTIP

SEQ ID NO: 2490769 - protein, 19 aa, Entamoeba dispar
KKYFESVKTLPIYQQISDF

SEQ ID NO: 2490770 - protein, 18 aa, Entamoeba dispar
KKYFKLLVILSTIYELIL

SEQ ID NO: 2490771 - protein, 21 aa, Entamoeba dispar
KKYGKENWKSVSDCLPNKTRK

SEQ ID NO: 2490772 - protein, 19 aa, Entamoeba dispar
KKYHPIIGQVIKRKRGNSR

SEQ ID NO: 2490773 - protein, 19 aa, Entamoeba dispar
KKYIPIQCIPNFIHRYNKY

SEQ ID NO: 2490774 - protein, 26 aa, Entamoeba dispar
KKYIVPIVCFHIDFYVRMFVLVKSSV

SEQ ID NO: 2490775 - protein, 20 aa, Entamoeba dispar
KKYKGEWSKKSIDSRLSMSI

SEQ ID NO: 2490776 - protein, 19 aa, Entamoeba dispar
KKYKKSIIPLIIQNSKAAN

SEQ ID NO: 2490777 - protein, 20 aa, Entamoeba dispar
KKYKRMVCIETVWYKANAVL

SEQ ID NO: 2490778 - protein, 18 aa, Entamoeba dispar
KKYLNLMPNKLPISLQTV

SEQ ID NO: 2490779 - protein, 19 aa, Entamoeba dispar
KKYLPTVFDNYLAKVQYKK

SEQ ID NO: 2490780 - protein, 31 aa, Entamoeba dispar
KKYMKCLDPLLEFCRLLTMPMSLEIIQMKDE

SEQ ID NO: 2490781 - protein, 25 aa, Entamoeba dispar
KKYNCKMIDFAHNWILSEEECTVED

SEQ ID NO: 2490782 - protein, 20 aa, Entamoeba dispar
KKYNGKMIFIKSHIIKENTI

SEQ ID NO: 2490783 - protein, 19 aa, Entamoeba dispar
KKYNGTYSIMFHVAPLLPN

SEQ ID NO: 2490784 - protein, 18 aa, Entamoeba dispar
KKYPVMVATNVLSRGIDI

SEQ ID NO: 2490785 - protein, 24 aa, Entamoeba dispar
KKYSCPECGKKFRTMAEVRRHSVT

SEQ ID NO: 2490786 - protein, 19 aa, Entamoeba dispar
KKYYCKSTPNPKPFHQIKF

SEQ ID NO: 2490787 - protein, 17 aa, Entamoeba dispar
KLACSYLISITKKYQES

SEQ ID NO: 2490788 - protein, 22 aa, Entamoeba dispar
KLADEWKVLFFETSAKAKINIA

SEQ ID NO: 2490789 - protein, 23 aa, Entamoeba dispar
KLAGDCINSVILKREDLFDRFIE

SEQ ID NO: 2490790 - protein, 19 aa, Entamoeba dispar
KLALANRVDKIYTQRIILF

SEQ ID NO: 2490791 - protein, 35 aa, Entamoeba dispar
KLALKKPYWSLVYRIANGKGLMWDLPRKKKEEKTE

SEQ ID NO: 2490792 - protein, 24 aa, Entamoeba dispar
KLALLQFLQCFAILVENIKTTNFL

SEQ ID NO: 2490793 - protein, 18 aa, Entamoeba dispar
KLALWKGDITKLSVDSIV

SEQ ID NO: 2490794 - protein, 25 aa, Entamoeba dispar
KLASHSNFFLRPSWSPEGTQLVMVG

SEQ ID NO: 2490795 - protein, 20 aa, Entamoeba dispar
KLASLKAWLKKSLDETARKY

SEQ ID NO: 2490796 - protein, 18 aa, Entamoeba dispar
KLCDYCFKECSSLTSINI

SEQ ID NO: 2490797 - protein, 21 aa, Entamoeba dispar
KLCEAEGEFDEPAVITETPIE

SEQ ID NO: 2490798 - protein, 17 aa, Entamoeba dispar
KLCEFIENGLSPSLILK

SEQ ID NO: 2490799 - protein, 18 aa, Entamoeba dispar
KLCGDAVTELGKVIVQKV

SEQ ID NO: 2490800 - protein, 18 aa, Entamoeba dispar
KLCGDAVTEVGKVIIQKV

SEQ ID NO: 2490801 - protein, 19 aa, Entamoeba dispar
KLDAIGFSTCNQRLTLQRA

SEQ ID NO: 2490802 - protein, 19 aa, Entamoeba dispar
KLDAKEFSEELAISPVEII

SEQ ID NO: 2490803 - protein, 18 aa, Entamoeba dispar
KLDDCLLSIPLPLRTPTK

SEQ ID NO: 2490804 - protein, 23 aa, Entamoeba dispar
KLDDFCTFGFLIKNFHEIDDFMK

SEQ ID NO: 2490805 - protein, 26 aa, Entamoeba dispar
KLDDMCYRLNKFIITLFPEYKDVFNG

SEQ ID NO: 2490806 - protein, 30 aa, Entamoeba dispar
KLDGCTGCYACSPKESFYCVIKDGFEEIMQ

SEQ ID NO: 2490807 - protein, 28 aa, Entamoeba dispar
KLDKIIKVTEKWGDFDAHFTCSTLSGNK

SEQ ID NO: 2490808 - protein, 23 aa, Entamoeba dispar
KLDKRYPKLIALPIYASLSTEQQ

SEQ ID NO: 2490809 - protein, 22 aa, Entamoeba dispar
KLDQCGALKYIQLFTKLCNHPA

SEQ ID NO: 2490810 - protein, 18 aa, Entamoeba dispar
KLEAITKDELINWLNNEL

SEQ ID NO: 2490811 - protein, 21 aa, Entamoeba dispar
KLEGFLPLRDMDFIVWNEKIT

SEQ ID NO: 2490812 - protein, 19 aa, Entamoeba dispar
KLEGLFRVPGKQDDIDGYK

SEQ ID NO: 2490813 - protein, 19 aa, Entamoeba dispar
KLEILSSITKNYLVILETR

SEQ ID NO: 2490814 - protein, 22 aa, Entamoeba dispar
KLEKCCFRYCRSLQSINIPSSI

SEQ ID NO: 2490815 - protein, 22 aa, Entamoeba dispar
KLEKIILYFKKINCKIADFILR

SEQ ID NO: 2490816 - protein, 23 aa, Entamoeba dispar
KLELKLAGINAKVLKKKNKILNK

SEQ ID NO: 2490817 - protein, 18 aa, Entamoeba dispar
KLELKRFNTQPIDVSSII

SEQ ID NO: 2490818 - protein, 18 aa, Entamoeba dispar
KLENFKCPVEYNEKLMEV

SEQ ID NO: 2490819 - protein, 21 aa, Entamoeba dispar
KLENGDIYWWLKSIGFEDSIF

SEQ ID NO: 2490820 - protein, 27 aa, Entamoeba dispar
KLEPKKVGEFCFELIKSLGHSMKQTIK

SEQ ID NO: 2490821 - protein, 19 aa, Entamoeba dispar
KLEQCRNIFLQQKLPNLKT

SEQ ID NO: 2490822 - protein, 26 aa, Entamoeba dispar
KLERCIKSVVDSANWKVNDINYVLAI

SEQ ID NO: 2490823 - protein, 20 aa, Entamoeba dispar
KLERFGIALKFLMTDIMSIR

SEQ ID NO: 2490824 - protein, 20 aa, Entamoeba dispar
KLESIRRCERISKYLDENGI

SEQ ID NO: 2490825 - protein, 24 aa, Entamoeba dispar
KLESYRFRGGAFIQDEKSKKVHFL

SEQ ID NO: 2490826 - protein, 18 aa, Entamoeba dispar
KLEVLKLSNCEITKIPED

SEQ ID NO: 2490827 - protein, 18 aa, Entamoeba dispar
KLEYWCFYGCSSLKSINI

SEQ ID NO: 2490828 - protein, 22 aa, Entamoeba dispar
KLFCPRCGEIYSIPDGCCGSNL

SEQ ID NO: 2490829 - protein, 18 aa, Entamoeba dispar
KLFDLFAKEYINEHPHEK

SEQ ID NO: 2490830 - protein, 19 aa, Entamoeba dispar
KLFEALFGCLKRGTRAVFQ

SEQ ID NO: 2490831 - protein, 29 aa, Entamoeba dispar
KLFEIALEKGLQMINGININEGRNFVDEI

SEQ ID NO: 2490832 - protein, 26 aa, Entamoeba dispar
KLFELFGIQCEFYFLFNNEIGENKGK

SEQ ID NO: 2490833 - protein, 23 aa, Entamoeba dispar
KLFEWKVPLPQCGNVYIVCLEKG

SEQ ID NO: 2490834 - protein, 25 aa, Entamoeba dispar
KLFGEPLAQVVLCLDHIRYELAVNV

SEQ ID NO: 2490835 - protein, 18 aa, Entamoeba dispar
KLFIVRHAVRHDYIDLKW

SEQ ID NO: 2490836 - protein, 42 aa, Entamoeba dispar
KLFKEAIPKFKVIMKLAIEKVRLKGLMLLFMSIGGVIEVKDV

SEQ ID NO: 2490837 - protein, 17 aa, Entamoeba dispar
KLFKKLKKIMDLGFKGP

SEQ ID NO: 2490838 - protein, 17 aa, Entamoeba dispar
KLFKSSTFRDLPSKTLS

SEQ ID NO: 2490839 - protein, 25 aa, Entamoeba dispar
KLFLRELPTPIIPPIYYDKFVNEDV

SEQ ID NO: 2490840 - protein, 18 aa, Entamoeba dispar
KLFMVVRPVELVFFKEKD

SEQ ID NO: 2490841 - protein, 20 aa, Entamoeba dispar
KLFPEKLDQFNPAFVIVDEE

SEQ ID NO: 2490842 - protein, 24 aa, Entamoeba dispar
KLFPFKKVTICLGSYHDFYTSKTE

SEQ ID NO: 2490843 - protein, 20 aa, Entamoeba dispar
KLFPLMRIASQPIKKAAVWC

SEQ ID NO: 2490844 - protein, 18 aa, Entamoeba dispar
KLFRDITQEFFGWNQNKF

SEQ ID NO: 2490845 - protein, 27 aa, Entamoeba dispar
KLFRTFWFYCVVLKFVIKEEYNEIYYN

SEQ ID NO: 2490846 - protein, 18 aa, Entamoeba dispar
KLFTKIVFPSHFGLKRLV

SEQ ID NO: 2490847 - protein, 25 aa, Entamoeba dispar
KLGAGVYRLSLSIHESLKISKELFS

SEQ ID NO: 2490848 - protein, 20 aa, Entamoeba dispar
KLGDGCFRYCSSLTSINIPP

SEQ ID NO: 2490849 - protein, 19 aa, Entamoeba dispar
KLGDICFEHCISLSNITIP

SEQ ID NO: 2490850 - protein, 23 aa, Entamoeba dispar
KLGDLCFHKCWSLISINIPTTIS

SEQ ID NO: 2490851 - protein, 23 aa, Entamoeba dispar
KLGDRCFYECFALTSINIPSSIT

SEQ ID NO: 2490852 - protein, 20 aa, Entamoeba dispar
KLGDYCFSYYPSLTLINIPS

SEQ ID NO: 2490853 - protein, 23 aa, Entamoeba dispar
KLGDYCFYKCISLKSITIPSSIT

SEQ ID NO: 2490854 - protein, 22 aa, Entamoeba dispar
KLGEGMCGKVYLAFHEKTGVKV

SEQ ID NO: 2490855 - protein, 23 aa, Entamoeba dispar
KLGEKCFCGCISLSIINIPISFT

SEQ ID NO: 2490856 - protein, 19 aa, Entamoeba dispar
KLGEYCFSYCPSLSEIILP

SEQ ID NO: 2490857 - protein, 19 aa, Entamoeba dispar
KLGGDCFNKCLSLKSINIP

SEQ ID NO: 2490858 - protein, 20 aa, Entamoeba dispar
KLGGIPWDVLTNNKLFKTMI

SEQ ID NO: 2490859 - protein, 23 aa, Entamoeba dispar
KLGKCCFYECPTLTSINIPTSIS

SEQ ID NO: 2490860 - protein, 23 aa, Entamoeba dispar
KLGKCFYYCLSLKSINIPTSISE

SEQ ID NO: 2490861 - protein, 18 aa, Entamoeba dispar
KLGKKVPVEPYDFTDAQL

SEQ ID NO: 2490862 - protein, 21 aa, Entamoeba dispar
KLGNACFNRCYSLITINIPTY

SEQ ID NO: 2490863 - protein, 23 aa, Entamoeba dispar
KLGNKCFDQFWSLASITIATTIK

SEQ ID NO: 2490864 - protein, 22 aa, Entamoeba dispar
KLGNKCFDQFWSLTSITIATTI

SEQ ID NO: 2490865 - protein, 22 aa, Entamoeba dispar
KLGNKCFLGCSSLTKINIPTSV

SEQ ID NO: 2490866 - protein, 22 aa, Entamoeba dispar
KLGNNCFDQFWSLASITIATTI

SEQ ID NO: 2490867 - protein, 20 aa, Entamoeba dispar
KLGNSCFCQCTSLKSINIPS

SEQ ID NO: 2490868 - protein, 26 aa, Entamoeba dispar
KLGQLFTVWFNTWFVKGTTLTLTKLE

SEQ ID NO: 2490869 - protein, 25 aa, Entamoeba dispar
KLGRTKCKFMLIQIDSVRDGIIPCI

SEQ ID NO: 2490870 - protein, 23 aa, Entamoeba dispar
KLGRYLLKQVYSFILSDKDFDLT

SEQ ID NO: 2490871 - protein, 26 aa, Entamoeba dispar
KLGSYCFKNCPSLKAIDIPTSISEIG

SEQ ID NO: 2490872 - protein, 17 aa, Entamoeba dispar
KLGVEVMGNAMLIIPKT

SEQ ID NO: 2490873 - protein, 21 aa, Entamoeba dispar
KLGYDCFKECYSLTSISIPSS

SEQ ID NO: 2490874 - protein, 19 aa, Entamoeba dispar
KLGYECFDSCISLTDINIL

SEQ ID NO: 2490875 - protein, 20 aa, Entamoeba dispar
KLGYGCFYYCYSLKSINIPT

SEQ ID NO: 2490876 - protein, 19 aa, Entamoeba dispar
KLHFIACSESNRDKWLNLI

SEQ ID NO: 2490877 - protein, 19 aa, Entamoeba dispar
KLHIGHICKSFGIRDTPTS

SEQ ID NO: 2490878 - protein, 21 aa, Entamoeba dispar
KLHLLCTSLNHLIRQYLSHSF

SEQ ID NO: 2490879 - protein, 19 aa, Entamoeba dispar
KLHPKRFLLIKEFIKLLFI

SEQ ID NO: 2490880 - protein, 32 aa, Entamoeba dispar
KLHPRQFPKFTCQWIELFSHRSLLLSLSKPSE

SEQ ID NO: 2490881 - protein, 23 aa, Entamoeba dispar
KLHQKFIECCSIINTEKDDIVHD

SEQ ID NO: 2490882 - protein, 20 aa, Entamoeba dispar
KLIAELQLSIGKERSNIVIP

SEQ ID NO: 2490883 - protein, 19 aa, Entamoeba dispar
KLICIPINIDDDIIINSLN

SEQ ID NO: 2490884 - protein, 21 aa, Entamoeba dispar
KLIDESCSFWEKQMKFAKSVD

SEQ ID NO: 2490885 - protein, 19 aa, Entamoeba dispar
KLIDITFNLCVDKCSECIC

SEQ ID NO: 2490886 - protein, 19 aa, Entamoeba dispar
KLIEKTCEPLMNFISQWMS

SEQ ID NO: 2490887 - protein, 17 aa, Entamoeba dispar
KLIHCIIHNILRCNNLN

SEQ ID NO: 2490888 - protein, 28 aa, Entamoeba dispar
KLIIDWFSRFGIEVGDFKTSFNDGLLIC

SEQ ID NO: 2490889 - protein, 25 aa, Entamoeba dispar
KLIILYKPLIEWGKELYEYGNCRGL

SEQ ID NO: 2490890 - protein, 21 aa, Entamoeba dispar
KLIINKSNVRICLLDHTSMTF

SEQ ID NO: 2490891 - protein, 20 aa, Entamoeba dispar
KLIIQIGCSILRKDQNNISY

SEQ ID NO: 2490892 - protein, 18 aa, Entamoeba dispar
KLIKEFKENIESISILFN

SEQ ID NO: 2490893 - protein, 24 aa, Entamoeba dispar
KLIKIMLEKHVHVFLGDKQLSLKG

SEQ ID NO: 2490894 - protein, 19 aa, Entamoeba dispar
KLINFYKVRSIGIILMDLQ

SEQ ID NO: 2490895 - protein, 26 aa, Entamoeba dispar
KLIQQIRVNKFISHSCIYDEKLYISQ

SEQ ID NO: 2490896 - protein, 18 aa, Entamoeba dispar
KLIRVGDVFFSECQSNLL

SEQ ID NO: 2490897 - protein, 29 aa, Entamoeba dispar
KLISARIEGILDYLISVTMFDSKRSTFEE

SEQ ID NO: 2490898 - protein, 17 aa, Entamoeba dispar
KLISKGIRFEHIKNCKG

SEQ ID NO: 2490899 - protein, 21 aa, Entamoeba dispar
KLISKRWGFAEVQLKKKEEKM

SEQ ID NO: 2490900 - protein, 26 aa, Entamoeba dispar
KLIYCIKRIRELLRELIFISNELKDV

SEQ ID NO: 2490901 - protein, 20 aa, Entamoeba dispar
KLIYEKFKPITPTPLSNQIE

SEQ ID NO: 2490902 - protein, 18 aa, Entamoeba dispar
KLKCILEKLIRELADEIN

SEQ ID NO: 2490903 - protein, 18 aa, Entamoeba dispar
KLKEAFVSVGEIKNSRVA

SEQ ID NO: 2490904 - protein, 17 aa, Entamoeba dispar
KLKEFFEEFYIDNPLSE

SEQ ID NO: 2490905 - protein, 21 aa, Entamoeba dispar
KLKEIFSKFEVVEATIVKTHK

SEQ ID NO: 2490906 - protein, 17 aa, Entamoeba dispar
KLKEIRKELKLLDAPSW

SEQ ID NO: 2490907 - protein, 22 aa, Entamoeba dispar
KLKEKIIPLLERIEAETFDESI

SEQ ID NO: 2490908 - protein, 19 aa, Entamoeba dispar
KLKESINCIQLINNELATM

SEQ ID NO: 2490909 - protein, 23 aa, Entamoeba dispar
KLKEWCFEDCLSLTSINIPSTIN

SEQ ID NO: 2490910 - protein, 19 aa, Entamoeba dispar
KLKIGDLVTTIPTIGFNLE

SEQ ID NO: 2490911 - protein, 23 aa, Entamoeba dispar
KLKIKKYCNIIELIEKTQLSLSL

SEQ ID NO: 2490912 - protein, 17 aa, Entamoeba dispar
KLKKSLGSHQKKILDAY

SEQ ID NO: 2490913 - protein, 19 aa, Entamoeba dispar
KLKMDQCSFNIPKIPVDNE

SEQ ID NO: 2490914 - protein, 23 aa, Entamoeba dispar
KLKMEIFYPSIVIHVVKKKDLGV

SEQ ID NO: 2490915 - protein, 22 aa, Entamoeba dispar
KLKMKIYYFYAHFLETVKQIDI

SEQ ID NO: 2490916 - protein, 20 aa, Entamoeba dispar
KLKNFSSILAQFSRLEKDSQ

SEQ ID NO: 2490917 - protein, 19 aa, Entamoeba dispar
KLKNINSLISFKANNIQLT

SEQ ID NO: 2490918 - protein, 18 aa, Entamoeba dispar
KLKPFSLIHCNLCNTDVC

SEQ ID NO: 2490919 - protein, 23 aa, Entamoeba dispar
KLKQIQGNELVKFVSEKLQFPND

SEQ ID NO: 2490920 - protein, 20 aa, Entamoeba dispar
KLKQNCPVHCAVYCDKLLIV

SEQ ID NO: 2490921 - protein, 25 aa, Entamoeba dispar
KLKRVICSHKGWVSSICFDPSNQWF

SEQ ID NO: 2490922 - protein, 17 aa, Entamoeba dispar
KLKSCNKNGELLLNGID

SEQ ID NO: 2490923 - protein, 25 aa, Entamoeba dispar
KLKTLKCIKCKVNVIGAGIFEKKLF

SEQ ID NO: 2490924 - protein, 20 aa, Entamoeba dispar
KLKWRLNANPTISKEIKDQV

SEQ ID NO: 2490925 - protein, 21 aa, Entamoeba dispar
KLKYINRLCSLFIHTDTVIGA

SEQ ID NO: 2490926 - protein, 22 aa, Entamoeba dispar
KLKYKSKAWIFRKKERQREKGM

SEQ ID NO: 2490927 - protein, 20 aa, Entamoeba dispar
KLLAKIAVFESMLKQANSEI

SEQ ID NO: 2490928 - protein, 18 aa, Entamoeba dispar
KLLARCWNKTPNKRPNFV

SEQ ID NO: 2490929 - protein, 22 aa, Entamoeba dispar
KLLCYADKFFSKSHLEDTLTHQ

SEQ ID NO: 2490930 - protein, 19 aa, Entamoeba dispar
KLLDAIFVLAGVPREKFPA

SEQ ID NO: 2490931 - protein, 18 aa, Entamoeba dispar
KLLECKTFAEATTVLQKI

SEQ ID NO: 2490932 - protein, 25 aa, Entamoeba dispar
KLLEFRRYIIQCIDIPFDHAEMNPN

SEQ ID NO: 2490933 - protein, 19 aa, Entamoeba dispar
KLLEHARTITVGMNNVRKF

SEQ ID NO: 2490934 - protein, 17 aa, Entamoeba dispar
KLLEWLKSIDNDGAELL

SEQ ID NO: 2490935 - protein, 31 aa, Entamoeba dispar
KLLFPRDKKEIFVFRTPDIIVSKHFSSSYDI

SEQ ID NO: 2490936 - protein, 25 aa, Entamoeba dispar
KLLIKSLYSSPSFICSVLGITSDML

SEQ ID NO: 2490937 - protein, 19 aa, Entamoeba dispar
KLLIRYATSYGLLREVLSS

SEQ ID NO: 2490938 - protein, 26 aa, Entamoeba dispar
KLLKEKKPRISSIVKESSDLLPKKES

SEQ ID NO: 2490939 - protein, 17 aa, Entamoeba dispar
KLLKIGVNFKFVTTIID

SEQ ID NO: 2490940 - protein, 20 aa, Entamoeba dispar
KLLLEPNLFKFLYFNKKNYC

SEQ ID NO: 2490941 - protein, 18 aa, Entamoeba dispar
KLLQCMRINSTNSEQQYF

SEQ ID NO: 2490942 - protein, 25 aa, Entamoeba dispar
KLLQPRKRLIRPFDENVEINKFIKP

SEQ ID NO: 2490943 - protein, 20 aa, Entamoeba dispar
KLLTEDGIYIIWFSNIQFNE

SEQ ID NO: 2490944 - protein, 18 aa, Entamoeba dispar
KLLTIPFLQIQRLCFSDD

SEQ ID NO: 2490945 - protein, 24 aa, Entamoeba dispar
KLLYPGKFKNVFARTQMIHGIDAR

SEQ ID NO: 2490946 - protein, 18 aa, Entamoeba dispar
KLLYRGQNDLARAIMQYE

SEQ ID NO: 2490947 - protein, 24 aa, Entamoeba dispar
KLMDDLWKKNGIDFRMTIYNVLAT

SEQ ID NO: 2490948 - protein, 19 aa, Entamoeba dispar
KLMDICRKNTDEIVKDKIE

SEQ ID NO: 2490949 - protein, 26 aa, Entamoeba dispar
KLMDPSGKAPLMWRYDEINAPTYFEV

SEQ ID NO: 2490950 - protein, 22 aa, Entamoeba dispar
KLMGVAVDWRRSFITTDHNPYF

SEQ ID NO: 2490951 - protein, 21 aa, Entamoeba dispar
KLMGYKCGFCGEMIDRTDSNS

SEQ ID NO: 2490952 - protein, 19 aa, Entamoeba dispar
KLMKHFKTLILDTTIQKYI

SEQ ID NO: 2490953 - protein, 24 aa, Entamoeba dispar
KLMKIRFIIELSRCSIVEPNKEKS

SEQ ID NO: 2490954 - protein, 21 aa, Entamoeba dispar
KLMNETLFTYLLLKSSDSDLF

SEQ ID NO: 2490955 - protein, 22 aa, Entamoeba dispar
KLMQLANAFKVLQSLTFSLLPP

SEQ ID NO: 2490956 - protein, 19 aa, Entamoeba dispar
KLMSFGVVSSLTYKERVPI

SEQ ID NO: 2490957 - protein, 21 aa, Entamoeba dispar
KLNCKSKIAIILHGIIINERI

SEQ ID NO: 2490958 - protein, 18 aa, Entamoeba dispar
KLNECIEMEKEIKELQEN

SEQ ID NO: 2490959 - protein, 20 aa, Entamoeba dispar
KLNECIMKLLSSNVLNQISS

SEQ ID NO: 2490960 - protein, 29 aa, Entamoeba dispar
KLNEFSYFIPEFMYMTGLSSKMKSDKKLL

SEQ ID NO: 2490961 - protein, 17 aa, Entamoeba dispar
KLNELELVFSTDCSMIN

SEQ ID NO: 2490962 - protein, 21 aa, Entamoeba dispar
KLNGLLRRIIEMMMNVCKSIN

SEQ ID NO: 2490963 - protein, 25 aa, Entamoeba dispar
KLNGLLRRIIEMMMNVCKSINWYEQ

SEQ ID NO: 2490964 - protein, 32 aa, Entamoeba dispar
KLNKKMIINFSIRRCGIIVLNEVKEIMKAEVE

SEQ ID NO: 2490965 - protein, 19 aa, Entamoeba dispar
KLNKSAVFLEMEKYDECIK

SEQ ID NO: 2490966 - protein, 17 aa, Entamoeba dispar
KLNMQYIQFAFRWFNCC

SEQ ID NO: 2490967 - protein, 19 aa, Entamoeba dispar
KLNSAMAYSYATLYFSYCK

SEQ ID NO: 2490968 - protein, 25 aa, Entamoeba dispar
KLNTKRNMLICFARIGEEVPDLVAP

SEQ ID NO: 2490969 - protein, 18 aa, Entamoeba dispar
KLNYEERDDIALKALKEA

SEQ ID NO: 2490970 - protein, 23 aa, Entamoeba dispar
KLNYSCCSLHFNIPINITVCVIP

SEQ ID NO: 2490971 - protein, 22 aa, Entamoeba dispar
KLPEQPNSIGFRQMEEKDVDVV

SEQ ID NO: 2490972 - protein, 23 aa, Entamoeba dispar
KLPEVKEWFNLIETIFISVKKAI

SEQ ID NO: 2490973 - protein, 18 aa, Entamoeba dispar
KLPIGFVSACSITRLNIQ

SEQ ID NO: 2490974 - protein, 23 aa, Entamoeba dispar
KLPKELICFNKYFFDAVWSDSVK

SEQ ID NO: 2490975 - protein, 25 aa, Entamoeba dispar
KLPKGRSSIDIPEFHKINEIQEESK

SEQ ID NO: 2490976 - protein, 18 aa, Entamoeba dispar
KLPKITTIKCKDFCSAED

SEQ ID NO: 2490977 - protein, 20 aa, Entamoeba dispar
KLPLSSILMKRSRQVDQLKQ

SEQ ID NO: 2490978 - protein, 19 aa, Entamoeba dispar
KLPQVKALYPYTAANDEEL

SEQ ID NO: 2490979 - protein, 19 aa, Entamoeba dispar
KLPRISLKQSREVLKRREQ

SEQ ID NO: 2490980 - protein, 25 aa, Entamoeba dispar
KLPTESWRFYCFKGDEEIEHPFVMN

SEQ ID NO: 2490981 - protein, 21 aa, Entamoeba dispar
KLPTGLTFIGIHCFDDCTSLK

SEQ ID NO: 2490982 - protein, 18 aa, Entamoeba dispar
KLPVNKIPLTDEVINDLY

SEQ ID NO: 2490983 - protein, 23 aa, Entamoeba dispar
KLQDIRILHYLKNYMFDTTNYQI

SEQ ID NO: 2490984 - protein, 19 aa, Entamoeba dispar
KLQETRIALVKEVLSKHPQ

SEQ ID NO: 2490985 - protein, 19 aa, Entamoeba dispar
KLQIEMPKQLQLTMNSVET

SEQ ID NO: 2490986 - protein, 18 aa, Entamoeba dispar
KLQILDVRHCGLPKDIVH

SEQ ID NO: 2490987 - protein, 19 aa, Entamoeba dispar
KLQQLCRLEIYDFRDKSIQ

SEQ ID NO: 2490988 - protein, 18 aa, Entamoeba dispar
KLQTLTIRFTQKVIQSLS

SEQ ID NO: 2490989 - protein, 20 aa, Entamoeba dispar
KLRATIMKSKRNWNNEFIDN

SEQ ID NO: 2490990 - protein, 23 aa, Entamoeba dispar
KLREINFEDIVQCLNDRKERLMN

SEQ ID NO: 2490991 - protein, 18 aa, Entamoeba dispar
KLRGDFSSIIELLGNINL

SEQ ID NO: 2490992 - protein, 23 aa, Entamoeba dispar
KLRKEQHGSHVFLLNIMSYPDLA

SEQ ID NO: 2490993 - protein, 25 aa, Entamoeba dispar
KLRMFSPEILFLSFHCEICNSSTSV

SEQ ID NO: 2490994 - protein, 32 aa, Entamoeba dispar
KLRSVSLPRQIKYLFCLNNQYPILITNKKSLK

SEQ ID NO: 2490995 - protein, 18 aa, Entamoeba dispar
KLRTRKGAKITALDKPAW

SEQ ID NO: 2490996 - protein, 18 aa, Entamoeba dispar
KLSDDSLFSKIEYQEGSK

SEQ ID NO: 2490997 - protein, 17 aa, Entamoeba dispar
KLSIFLDNAILKRMIST

SEQ ID NO: 2490998 - protein, 24 aa, Entamoeba dispar
KLSKEKFLEYPIFDEYQFNCINDH

SEQ ID NO: 2490999 - protein, 20 aa, Entamoeba dispar
KLSNMAKLYPEEIVINPSGV

SEQ ID NO: 2491000 - protein, 33 aa, Entamoeba dispar
KLSPIRMKVMGFIRSWVNWRFSDFDDIDMRTTL

SEQ ID NO: 2491001 - protein, 21 aa, Entamoeba dispar
KLSPVIVSNFCKMFVVHYDRL

SEQ ID NO: 2491002 - protein, 25 aa, Entamoeba dispar
KLSRCTLETFLSVYSSRVAQIYQVY

SEQ ID NO: 2491003 - protein, 19 aa, Entamoeba dispar
KLSSISFLLTQKIISQVIS

SEQ ID NO: 2491004 - protein, 24 aa, Entamoeba dispar
KLSSLKKVIIFCSINKLYEISELF

SEQ ID NO: 2491005 - protein, 24 aa, Entamoeba dispar
KLSSRLFFKSTIIYVGENDMSVEK

SEQ ID NO: 2491006 - protein, 17 aa, Entamoeba dispar
KLSVIAFTFELTERYPD

SEQ ID NO: 2491007 - protein, 27 aa, Entamoeba dispar
KLSVIDLIYRTMFPFNLDAQKVIEQIF

SEQ ID NO: 2491008 - protein, 24 aa, Entamoeba dispar
KLSVLKSLFVILSYDPLFPSNKRP

SEQ ID NO: 2491009 - protein, 18 aa, Entamoeba dispar
KLTAIRCASELAASCPEQ

SEQ ID NO: 2491010 - protein, 21 aa, Entamoeba dispar
KLTDLTIKWGVRGSRISHSHS

SEQ ID NO: 2491011 - protein, 24 aa, Entamoeba dispar
KLTDPNWIPTFTVVSDDKLEEENP

SEQ ID NO: 2491012 - protein, 24 aa, Entamoeba dispar
KLTEAGCKYSDFGTRRRFSKEVHE

SEQ ID NO: 2491013 - protein, 19 aa, Entamoeba dispar
KLTFFSPLILRCIPTSVKR

SEQ ID NO: 2491014 - protein, 24 aa, Entamoeba dispar
KLTIPSCFEKGLFSEDGINAIHLA

SEQ ID NO: 2491015 - protein, 25 aa, Entamoeba dispar
KLTKEIKETMLISNHFIKTLSIEEI

SEQ ID NO: 2491016 - protein, 17 aa, Entamoeba dispar
KLTKKCCFSYPGKIQSI

SEQ ID NO: 2491017 - protein, 26 aa, Entamoeba dispar
KLTMEKEDFLSIGFEMMKMNVVMDDN

SEQ ID NO: 2491018 - protein, 22 aa, Entamoeba dispar
KLTNLKASLIIGGSKLSDQFDN

SEQ ID NO: 2491019 - protein, 22 aa, Entamoeba dispar
KLTPPQCQPVPPSVTEVNFDDF

SEQ ID NO: 2491020 - protein, 23 aa, Entamoeba dispar
KLTPSSRRKLILVSKTLQAISNV

SEQ ID NO: 2491021 - protein, 30 aa, Entamoeba dispar
KLTQWKKYYCEICGIVLNGEKEWDIHLISK

SEQ ID NO: 2491022 - protein, 19 aa, Entamoeba dispar
KLVCVNPIRSRYCGNVGDV

SEQ ID NO: 2491023 - protein, 24 aa, Entamoeba dispar
KLVCVNPIRSRYCGNVGDVVVGRI

SEQ ID NO: 2491024 - protein, 30 aa, Entamoeba dispar
KLVEHPKLFWRYILELLLLCELKVVKVYCK

SEQ ID NO: 2491025 - protein, 17 aa, Entamoeba dispar
KLVGKYFVAMVALLKDC

SEQ ID NO: 2491026 - protein, 19 aa, Entamoeba dispar
KLVHHLIMEYGIYKRLNIY

SEQ ID NO: 2491027 - protein, 20 aa, Entamoeba dispar
KLVHHLIMEYGIYKRLNIYK

SEQ ID NO: 2491028 - protein, 19 aa, Entamoeba dispar
KLVIDHIMNIFKRADRDAV

SEQ ID NO: 2491029 - protein, 17 aa, Entamoeba dispar
KLVINVCIYEITKNPTD

SEQ ID NO: 2491030 - protein, 30 aa, Entamoeba dispar
KLVNCAKGLQLKFFFSIMEAEMSDIKKLSP

SEQ ID NO: 2491031 - protein, 18 aa, Entamoeba dispar
KLVPFSIPTYIFQLQDMP

SEQ ID NO: 2491032 - protein, 17 aa, Entamoeba dispar
KLVPQGKGTLVMLKKPY

SEQ ID NO: 2491033 - protein, 18 aa, Entamoeba dispar
KLVSNGVRYDHIKTCQGS

SEQ ID NO: 2491034 - protein, 18 aa, Entamoeba dispar
KLVTCYRDDAIGSLVDTI

SEQ ID NO: 2491035 - protein, 20 aa, Entamoeba dispar
KLVYECKTLLPVIPSTCLSW

SEQ ID NO: 2491036 - protein, 19 aa, Entamoeba dispar
KLWKILTIIYTNGIENING

SEQ ID NO: 2491037 - protein, 20 aa, Entamoeba dispar
KLWYHSVMIISVFQGNIERF

SEQ ID NO: 2491038 - protein, 18 aa, Entamoeba dispar
KLWYQNSFERPLILECFA

SEQ ID NO: 2491039 - protein, 19 aa, Entamoeba dispar
KLYEFARYWNERNVSMAVA

SEQ ID NO: 2491040 - protein, 19 aa, Entamoeba dispar
KLYEVHNLLQWLSSISNEF

SEQ ID NO: 2491041 - protein, 31 aa, Entamoeba dispar
KLYIHRCGRVARAGRMGKCYNFVQTDEVGYL

SEQ ID NO: 2491042 - protein, 21 aa, Entamoeba dispar
KLYIKTSCTPFFIMVNQHDLI

SEQ ID NO: 2491043 - protein, 19 aa, Entamoeba dispar
KLYINYCGITSLKKNSFTP

SEQ ID NO: 2491044 - protein, 18 aa, Entamoeba dispar
KLYKIFENYYRHCIRKLN

SEQ ID NO: 2491045 - protein, 21 aa, Entamoeba dispar
KLYPRVYPQIMLDSKSVSVIR

SEQ ID NO: 2491046 - protein, 40 aa, Entamoeba dispar
KLYSSNLIPEFSKYLPSKCNPEYLFDYALKQHFYTLFKIH

SEQ ID NO: 2491047 - protein, 18 aa, Entamoeba dispar
KMALEMIQEVANKVNETS

SEQ ID NO: 2491048 - protein, 21 aa, Entamoeba dispar
KMCDLPEWIRRYSKKIEDFGD

SEQ ID NO: 2491049 - protein, 18 aa, Entamoeba dispar
KMCECKDNDDIILEIALT

SEQ ID NO: 2491050 - protein, 17 aa, Entamoeba dispar
KMCSSLIGTFTRIIFFE

SEQ ID NO: 2491051 - protein, 17 aa, Entamoeba dispar
KMDHLKQLVRVYFTLMT

SEQ ID NO: 2491052 - protein, 18 aa, Entamoeba dispar
KMDKELRIIGEHYIYLQN

SEQ ID NO: 2491053 - protein, 19 aa, Entamoeba dispar
KMEDICLIVFTSGTSGTPK

SEQ ID NO: 2491054 - protein, 18 aa, Entamoeba dispar
KMEEEEIIPNELRKIEEG

SEQ ID NO: 2491055 - protein, 24 aa, Entamoeba dispar
KMEHKAGVYSVTWGNDSKRFITAS

SEQ ID NO: 2491056 - protein, 23 aa, Entamoeba dispar
KMEQKLKKTTDWVSEQLDENSKS

SEQ ID NO: 2491057 - protein, 24 aa, Entamoeba dispar
KMEQLCGIVIFMFAKPEIVPLMKN

SEQ ID NO: 2491058 - protein, 22 aa, Entamoeba dispar
KMESLKEFVIMASRNCYFNPVS

SEQ ID NO: 2491059 - protein, 24 aa, Entamoeba dispar
KMFGSDWGRTYIIPIISLYYTHPN

SEQ ID NO: 2491060 - protein, 24 aa, Entamoeba dispar
KMFNSSIFIRCFYLASSNNQSIKQ

SEQ ID NO: 2491061 - protein, 18 aa, Entamoeba dispar
KMGAIKFMECSALTQSNL

SEQ ID NO: 2491062 - protein, 25 aa, Entamoeba dispar
KMGEEIATLHSFPIRVISKADGKKK

SEQ ID NO: 2491063 - protein, 21 aa, Entamoeba dispar
KMGGIPWKTEIDSGFSDGMTV

SEQ ID NO: 2491064 - protein, 23 aa, Entamoeba dispar
KMGHLFKPDSFIFGNGGAGNNWG

SEQ ID NO: 2491065 - protein, 17 aa, Entamoeba dispar
KMGLMMIGWGGNNGTTV

SEQ ID NO: 2491066 - protein, 22 aa, Entamoeba dispar
KMGNIEFVDFLLYNGARVEDKT

SEQ ID NO: 2491067 - protein, 27 aa, Entamoeba dispar
KMHDTHLFLFKAMRKYVSLKSCPNPLE

SEQ ID NO: 2491068 - protein, 23 aa, Entamoeba dispar
KMHRRVSLLIGKYLKEHAQNIVK

SEQ ID NO: 2491069 - protein, 23 aa, Entamoeba dispar
KMIELKIITGRELIEYINERKEK

SEQ ID NO: 2491070 - protein, 18 aa, Entamoeba dispar
KMIKCKLLQKTLFPSTLK

SEQ ID NO: 2491071 - protein, 17 aa, Entamoeba dispar
KMINLKPGEYITNCLRC

SEQ ID NO: 2491072 - protein, 18 aa, Entamoeba dispar
KMISFIFTELHFHRIELK

SEQ ID NO: 2491073 - protein, 31 aa, Entamoeba dispar
KMISGIYMGWFSRLAIRELIEKKVIFERYAN

SEQ ID NO: 2491074 - protein, 29 aa, Entamoeba dispar
KMKALSPPVLRIVKQMYFEPVNIPCQSKI

SEQ ID NO: 2491075 - protein, 17 aa, Entamoeba dispar
KMKAYGSTIDAIYIDDS

SEQ ID NO: 2491076 - protein, 20 aa, Entamoeba dispar
KMKEFGVVEVVERIEDVGID

SEQ ID NO: 2491077 - protein, 17 aa, Entamoeba dispar
KMKILEYMVDPFAPKDF

SEQ ID NO: 2491078 - protein, 18 aa, Entamoeba dispar
KMLCTIPTIVKCIILGEN

SEQ ID NO: 2491079 - protein, 25 aa, Entamoeba dispar
KMLDFVPWFIVEITLLKRASDLEFK

SEQ ID NO: 2491080 - protein, 24 aa, Entamoeba dispar
KMLGEIKLAYQLSINKEDTVVEVM

SEQ ID NO: 2491081 - protein, 31 aa, Entamoeba dispar
KMLKHGRAGVPVEVMGLMLGEYVDDYTVRVV

SEQ ID NO: 2491082 - protein, 17 aa, Entamoeba dispar
KMNDLFNSLVLLETQRG

SEQ ID NO: 2491083 - protein, 18 aa, Entamoeba dispar
KMNGLCAAPEIISNELFS

SEQ ID NO: 2491084 - protein, 25 aa, Entamoeba dispar
KMNKFKKQAQELAEKVEDLEGQLEK

SEQ ID NO: 2491085 - protein, 18 aa, Entamoeba dispar
KMNQRYSLLDSILKDVVK

SEQ ID NO: 2491086 - protein, 22 aa, Entamoeba dispar
KMPGAPMHLSLDIQGVSSSEKM

SEQ ID NO: 2491087 - protein, 19 aa, Entamoeba dispar
KMPRIKDRVAKLFDIQTFA

SEQ ID NO: 2491088 - protein, 26 aa, Entamoeba dispar
KMQKDEGGVVHFLDLYYDYTKQLLGG

SEQ ID NO: 2491089 - protein, 21 aa, Entamoeba dispar
KMRKMELPFTLIVDDPMANSY

SEQ ID NO: 2491090 - protein, 17 aa, Entamoeba dispar
KMRNCDIGFMVVSDPMI

SEQ ID NO: 2491091 - protein, 18 aa, Entamoeba dispar
KMSEEVRQDFSLSDTEDV

SEQ ID NO: 2491092 - protein, 17 aa, Entamoeba dispar
KMSEIIFEESIYILEIL

SEQ ID NO: 2491093 - protein, 23 aa, Entamoeba dispar
KMSKRLKLLRTYENTRLEEELQI

SEQ ID NO: 2491094 - protein, 21 aa, Entamoeba dispar
KMTDFTKWIKSILKIEDNSFD

SEQ ID NO: 2491095 - protein, 20 aa, Entamoeba dispar
KMTFTCPMWHPNIYPNGDVC

SEQ ID NO: 2491096 - protein, 17 aa, Entamoeba dispar
KMTGVLFMPNAIPNHVK

SEQ ID NO: 2491097 - protein, 20 aa, Entamoeba dispar
KMTMRTLHFFVWKKYILPNG

SEQ ID NO: 2491098 - protein, 28 aa, Entamoeba dispar
KMTRMFQVAIHFSVNFILLIPPTALRTS

SEQ ID NO: 2491099 - protein, 18 aa, Entamoeba dispar
KMVDAYGIKGQQHGRSIF

SEQ ID NO: 2491100 - protein, 23 aa, Entamoeba dispar
KMVDSCTSASLASYSLIEDYTQR

SEQ ID NO: 2491101 - protein, 27 aa, Entamoeba dispar
KMVTKIFKARCISFDYPGYGLNKNKKD

SEQ ID NO: 2491102 - protein, 19 aa, Entamoeba dispar
KMVYMYLCTYSEKYPELSI

SEQ ID NO: 2491103 - protein, 31 aa, Entamoeba dispar
KMWEHLKTNWKLYGDMGLVITIYRNFSYEML

SEQ ID NO: 2491104 - protein, 21 aa, Entamoeba dispar
KMYCANCGDSRALLIQRNTEN

SEQ ID NO: 2491105 - protein, 21 aa, Entamoeba dispar
KNACAELLFMAQENGSNEVPT

SEQ ID NO: 2491106 - protein, 24 aa, Entamoeba dispar
KNAGLKFQAVMSFHKCGGNVGDSV

SEQ ID NO: 2491107 - protein, 20 aa, Entamoeba dispar
KNAKNVFDLIEYEFDDTLKK

SEQ ID NO: 2491108 - protein, 18 aa, Entamoeba dispar
KNASCIMEYFSAYGKMQD

SEQ ID NO: 2491109 - protein, 20 aa, Entamoeba dispar
KNATSVLYLFVKSNFERDEN

SEQ ID NO: 2491110 - protein, 17 aa, Entamoeba dispar
KNATVCACFITEDFLTF

SEQ ID NO: 2491111 - protein, 25 aa, Entamoeba dispar
KNAYPFCLPAPLSLPKKNYNKIFEH

SEQ ID NO: 2491112 - protein, 19 aa, Entamoeba dispar
KNCIKTVAVSPHYLALGGT

SEQ ID NO: 2491113 - protein, 17 aa, Entamoeba dispar
KNCKAFSIILRYNLNTH

SEQ ID NO: 2491114 - protein, 27 aa, Entamoeba dispar
KNCKAICCSHGPILRGYIRERVDLWRQ

SEQ ID NO: 2491115 - protein, 23 aa, Entamoeba dispar
KNCKFCPKCEAGLLMTDNKLKVQ

SEQ ID NO: 2491116 - protein, 24 aa, Entamoeba dispar
KNCKLDSFYFIGWIGKTTLNHNIS

SEQ ID NO: 2491117 - protein, 21 aa, Entamoeba dispar
KNCKSELILEEVIPYCNRVLR

SEQ ID NO: 2491118 - protein, 24 aa, Entamoeba dispar
KNCNKTCHYPCHVPFFISALTMRG

SEQ ID NO: 2491119 - protein, 21 aa, Entamoeba dispar
KNCQYEELMKKCWLENTEQRP

SEQ ID NO: 2491120 - protein, 17 aa, Entamoeba dispar
KNDEGLQNFNIISVCDE

SEQ ID NO: 2491121 - protein, 19 aa, Entamoeba dispar
KNDHVVGFDLAGPENGFMP

SEQ ID NO: 2491122 - protein, 22 aa, Entamoeba dispar
KNDIVPRLSFDSIKNIQPLINE

SEQ ID NO: 2491123 - protein, 26 aa, Entamoeba dispar
KNDKIVLDFFVWWKCPIQTINTIKQL

SEQ ID NO: 2491124 - protein, 24 aa, Entamoeba dispar
KNDKSWVISLLINLCNGAVPSSWN

SEQ ID NO: 2491125 - protein, 27 aa, Entamoeba dispar
KNDSVWLKYLVTLPYQFYKEGLEINGN

SEQ ID NO: 2491126 - protein, 31 aa, Entamoeba dispar
KNDVGLIVCFLLRYEIFEPYHAFFIPPNYPH

SEQ ID NO: 2491127 - protein, 24 aa, Entamoeba dispar
KNEEEFPIDIGICEMKGRRPSMQD

SEQ ID NO: 2491128 - protein, 23 aa, Entamoeba dispar
KNEEFKKAILIFSNLINDMINNK

SEQ ID NO: 2491129 - protein, 22 aa, Entamoeba dispar
KNEFYFLIDFNKQFKDNDSFRE

SEQ ID NO: 2491130 - protein, 18 aa, Entamoeba dispar
KNEGCIKFYSINGNGEIT

SEQ ID NO: 2491131 - protein, 19 aa, Entamoeba dispar
KNEINKWLPSIKVALMGGT

SEQ ID NO: 2491132 - protein, 18 aa, Entamoeba dispar
KNEISELVNYRLGDMENA

SEQ ID NO: 2491133 - protein, 24 aa, Entamoeba dispar
KNEKENIVRIGILLNEKPIIKKQL

SEQ ID NO: 2491134 - protein, 24 aa, Entamoeba dispar
KNEKENIVRIGILLNEKPLIKKQL

SEQ ID NO: 2491135 - protein, 22 aa, Entamoeba dispar
KNELKTDLFIQIITKYIENIKT

SEQ ID NO: 2491136 - protein, 23 aa, Entamoeba dispar
KNELKTDLFIQIITKYIENIKTT

SEQ ID NO: 2491137 - protein, 24 aa, Entamoeba dispar
KNELNFKGIQLFTIVNGTKTFFAS

SEQ ID NO: 2491138 - protein, 19 aa, Entamoeba dispar
KNEMCFQAAVSLALLHPFC

SEQ ID NO: 2491139 - protein, 22 aa, Entamoeba dispar
KNENWEFIPFDLSTTPLIGRNY

SEQ ID NO: 2491140 - protein, 23 aa, Entamoeba dispar
KNERKSSLILLKMVSNKLVRTKG

SEQ ID NO: 2491141 - protein, 27 aa, Entamoeba dispar
KNESGSTALHWAVRGDIQIVQMMLDAG

SEQ ID NO: 2491142 - protein, 17 aa, Entamoeba dispar
KNESIEISEVLKEPNSS

SEQ ID NO: 2491143 - protein, 17 aa, Entamoeba dispar
KNFAMILGPLVIHPLPG

SEQ ID NO: 2491144 - protein, 22 aa, Entamoeba dispar
KNFDMRPGMIIKELGLTKPIFQ

SEQ ID NO: 2491145 - protein, 20 aa, Entamoeba dispar
KNFFKELLKIYNITENGWNL

SEQ ID NO: 2491146 - protein, 24 aa, Entamoeba dispar
KNFICKSLTYLEERGKFTSIGKLF

SEQ ID NO: 2491147 - protein, 19 aa, Entamoeba dispar
KNFIGRKVIEKMNIIEYRN

SEQ ID NO: 2491148 - protein, 19 aa, Entamoeba dispar
KNFKLREGKYILVPCTSEA

SEQ ID NO: 2491149 - protein, 22 aa, Entamoeba dispar
KNFLLHSPLKYTGINLRTLTDI

SEQ ID NO: 2491150 - protein, 27 aa, Entamoeba dispar
KNFLTEIYFDVAITFGKRTEYRMLYFN

SEQ ID NO: 2491151 - protein, 20 aa, Entamoeba dispar
KNFNSVMSMISYLLKAPVVP

SEQ ID NO: 2491152 - protein, 17 aa, Entamoeba dispar
KNFYVVYIAIYDEYYLT

SEQ ID NO: 2491153 - protein, 19 aa, Entamoeba dispar
KNGIEELSQKLAFVKDESI

SEQ ID NO: 2491154 - protein, 17 aa, Entamoeba dispar
KNGINVWEVLYKQWETI

SEQ ID NO: 2491155 - protein, 21 aa, Entamoeba dispar
KNGKFPFVIIGNKIDKGSVIS

SEQ ID NO: 2491156 - protein, 17 aa, Entamoeba dispar
KNGKLCYLSAEQEVIDP

SEQ ID NO: 2491157 - protein, 22 aa, Entamoeba dispar
KNGKLLYKVMEYLELYCSKETE

SEQ ID NO: 2491158 - protein, 23 aa, Entamoeba dispar
KNGKRLLVLATVRYFEIKVYGLA

SEQ ID NO: 2491159 - protein, 20 aa, Entamoeba dispar
KNGLARLLIKEKIDEENYRI

SEQ ID NO: 2491160 - protein, 27 aa, Entamoeba dispar
KNGLASPKWKFTFIQLIATLPAETKMI

SEQ ID NO: 2491161 - protein, 21 aa, Entamoeba dispar
KNGRLKPGMEIIEATSGNTGI

SEQ ID NO: 2491162 - protein, 21 aa, Entamoeba dispar
KNGTCLLTPMIVRRLLDAAKN

SEQ ID NO: 2491163 - protein, 22 aa, Entamoeba dispar
KNGVEVLCLLYALKIKYPEHIY

SEQ ID NO: 2491164 - protein, 17 aa, Entamoeba dispar
KNGYLLIPSNELIYGCF

SEQ ID NO: 2491165 - protein, 17 aa, Entamoeba dispar
KNHFVFTIKNNVPIKFV

SEQ ID NO: 2491166 - protein, 24 aa, Entamoeba dispar
KNHMELSFYLVLHFLFHEEIILSP

SEQ ID NO: 2491167 - protein, 25 aa, Entamoeba dispar
KNHSIRYNGKISDLFDVPKTISPNA

SEQ ID NO: 2491168 - protein, 24 aa, Entamoeba dispar
KNHVQELLKVFQFVCCSDYHAKNK

SEQ ID NO: 2491169 - protein, 20 aa, Entamoeba dispar
KNIAVCLAPSILTFDDTDTF

SEQ ID NO: 2491170 - protein, 29 aa, Entamoeba dispar
KNIDACALCSIQAYEFMETTLIDIYSISI

SEQ ID NO: 2491171 - protein, 22 aa, Entamoeba dispar
KNIDIPSILTSLFLEDITVPLK

SEQ ID NO: 2491172 - protein, 18 aa, Entamoeba dispar
KNIEHIVGMINRLQPIEV

SEQ ID NO: 2491173 - protein, 21 aa, Entamoeba dispar
KNIEMPEGWEFQSEKHSKQCI

SEQ ID NO: 2491174 - protein, 24 aa, Entamoeba dispar
KNIFKKDINEFIIPSSINKLGYRC

SEQ ID NO: 2491175 - protein, 24 aa, Entamoeba dispar
KNIFKKDINEFIIPSSITKIGYDC

SEQ ID NO: 2491176 - protein, 24 aa, Entamoeba dispar
KNIFKKDINEFIIPSSITKLGYDC

SEQ ID NO: 2491177 - protein, 17 aa, Entamoeba dispar
KNIFKKDINEFIVPSSI

SEQ ID NO: 2491178 - protein, 17 aa, Entamoeba dispar
KNIFKKDINKFIIPSSI

SEQ ID NO: 2491179 - protein, 23 aa, Entamoeba dispar
KNIGISINWGIRFENDDDVKQFI

SEQ ID NO: 2491180 - protein, 22 aa, Entamoeba dispar
KNIGMNIIFHYMKYHKVTSESQ

SEQ ID NO: 2491181 - protein, 17 aa, Entamoeba dispar
KNIHEVIRQCSISQSDL

SEQ ID NO: 2491182 - protein, 22 aa, Entamoeba dispar
KNIKIKERVMFTIKGSGFGTSP

SEQ ID NO: 2491183 - protein, 35 aa, Entamoeba dispar
KNIKLIIFLMFELYLRKYNELYLTVFKKMLFELIH

SEQ ID NO: 2491184 - protein, 21 aa, Entamoeba dispar
KNIKLPPSIKKLILEFTGRIG

SEQ ID NO: 2491185 - protein, 19 aa, Entamoeba dispar
KNIKRQSSELMEIDSTFNF

SEQ ID NO: 2491186 - protein, 18 aa, Entamoeba dispar
KNIKRVFSEVHTLKQKDK

SEQ ID NO: 2491187 - protein, 29 aa, Entamoeba dispar
KNIKRWLVICRTELIFKKNMEDFESLIQL

SEQ ID NO: 2491188 - protein, 20 aa, Entamoeba dispar
KNILEGLKEWIVHKDKDARQ

SEQ ID NO: 2491189 - protein, 25 aa, Entamoeba dispar
KNIMKDVLEAISFLHKNFIVHRDIK

SEQ ID NO: 2491190 - protein, 25 aa, Entamoeba dispar
KNIPFGCFDLLLARVHLTHTNKGEN

SEQ ID NO: 2491191 - protein, 25 aa, Entamoeba dispar
KNIQFWRQLWRTCEQSDVILQIVDG

SEQ ID NO: 2491192 - protein, 26 aa, Entamoeba dispar
KNISFLRFFSIVGILNCENLKDYEIK

SEQ ID NO: 2491193 - protein, 23 aa, Entamoeba dispar
KNISKEIPIRIVSGKENITKDIN

SEQ ID NO: 2491194 - protein, 17 aa, Entamoeba dispar
KNISKKINIVFSEETTC

SEQ ID NO: 2491195 - protein, 17 aa, Entamoeba dispar
KNISLTIEPDFIKTVGE

SEQ ID NO: 2491196 - protein, 33 aa, Entamoeba dispar
KNITKEIAHEIFLEVYNVFSLKEEEREVLMPFA

SEQ ID NO: 2491197 - protein, 18 aa, Entamoeba dispar
KNIVKEGFLFKEKLKKMQ

SEQ ID NO: 2491198 - protein, 19 aa, Entamoeba dispar
KNIYGDGVMKIEPSTTIID

SEQ ID NO: 2491199 - protein, 25 aa, Entamoeba dispar
KNIYLLCSIYDPRSSIMPFRDGGHL

SEQ ID NO: 2491200 - protein, 19 aa, Entamoeba dispar
KNIYLSNIHKFSFIKETIN

SEQ ID NO: 2491201 - protein, 18 aa, Entamoeba dispar
KNKDFSFDSCFYPKEQII

SEQ ID NO: 2491202 - protein, 24 aa, Entamoeba dispar
KNKDGSGYDCYGKWRRLADDKIEI

SEQ ID NO: 2491203 - protein, 19 aa, Entamoeba dispar
KNKDTFILHVFDREINAQT

SEQ ID NO: 2491204 - protein, 24 aa, Entamoeba dispar
KNKEFKVIIGGSLILNFENYKNWL

SEQ ID NO: 2491205 - protein, 21 aa, Entamoeba dispar
KNKEKVQCPFCRTQLTKKDVH

SEQ ID NO: 2491206 - protein, 26 aa, Entamoeba dispar
KNKEMCKIYSWSKMEMGIFFDEQQAI

SEQ ID NO: 2491207 - protein, 20 aa, Entamoeba dispar
KNKEVKGIVLSVISQERKEE

SEQ ID NO: 2491208 - protein, 21 aa, Entamoeba dispar
KNKEYINYGGYFIEKGNEEIK

SEQ ID NO: 2491209 - protein, 27 aa, Entamoeba dispar
KNKGFSIRTIRKFLFQLLRALRTLSHA

SEQ ID NO: 2491210 - protein, 22 aa, Entamoeba dispar
KNKGSILIHCVAGRSRSGTIAI

SEQ ID NO: 2491211 - protein, 17 aa, Entamoeba dispar
KNKGVSMPAQIRYVNYF

SEQ ID NO: 2491212 - protein, 26 aa, Entamoeba dispar
KNKIESFKFEKCVGVVATVSLAEEQT

SEQ ID NO: 2491213 - protein, 18 aa, Entamoeba dispar
KNKIPRVMTCTEEVIEIC

SEQ ID NO: 2491214 - protein, 21 aa, Entamoeba dispar
KNKKMIAADVMSEFLFALFDC

SEQ ID NO: 2491215 - protein, 21 aa, Entamoeba dispar
KNKLAAICSGIIPPGENPPGA

SEQ ID NO: 2491216 - protein, 20 aa, Entamoeba dispar
KNKLIGCTDTSVIYDIFNTI

SEQ ID NO: 2491217 - protein, 17 aa, Entamoeba dispar
KNKLKAVQWQKIPERQL

SEQ ID NO: 2491218 - protein, 34 aa, Entamoeba dispar
KNKLKKFQCKVCGEKQSYKHIFGISNQAKDLRTL

SEQ ID NO: 2491219 - protein, 23 aa, Entamoeba dispar
KNKLKKLCGDAVIEVGKVIVQKV

SEQ ID NO: 2491220 - protein, 18 aa, Entamoeba dispar
KNKLKKLCGDAVTEVGKV

SEQ ID NO: 2491221 - protein, 24 aa, Entamoeba dispar
KNKLKKLWGDAVIEVGKVIIQKVD

SEQ ID NO: 2491222 - protein, 24 aa, Entamoeba dispar
KNKLKNLWGEAVTEVGKVIIQKVE

SEQ ID NO: 2491223 - protein, 18 aa, Entamoeba dispar
KNKMEPYGLVQKITIPRG

SEQ ID NO: 2491224 - protein, 23 aa, Entamoeba dispar
KNKPGYKPSAVVMEVDEDLLKDL

SEQ ID NO: 2491225 - protein, 19 aa, Entamoeba dispar
KNKPVKVVVRFNSISQLEI

SEQ ID NO: 2491226 - protein, 18 aa, Entamoeba dispar
KNKQEFLEFLRIVMKATA

SEQ ID NO: 2491227 - protein, 18 aa, Entamoeba dispar
KNKSDCDGFIKALSESPV

SEQ ID NO: 2491228 - protein, 23 aa, Entamoeba dispar
KNKSIKFAYIFTGAKGGVVPYQG

SEQ ID NO: 2491229 - protein, 23 aa, Entamoeba dispar
KNKVRLSPALAMMLNGMSQNEYG

SEQ ID NO: 2491230 - protein, 26 aa, Entamoeba dispar
KNKYIKFFTKYCVKYYHKLKKGYNIL

SEQ ID NO: 2491231 - protein, 23 aa, Entamoeba dispar
KNKYPFARGGIRNAYHGINKLTK

SEQ ID NO: 2491232 - protein, 20 aa, Entamoeba dispar
KNKYSFNVDEIFLNKKEPQK

SEQ ID NO: 2491233 - protein, 18 aa, Entamoeba dispar
KNLCKEVMEYCFVNNDNQ

SEQ ID NO: 2491234 - protein, 17 aa, Entamoeba dispar
KNLCSHGLGFLSNEDKE

SEQ ID NO: 2491235 - protein, 17 aa, Entamoeba dispar
KNLEKWFLYDLNVNNNQ

SEQ ID NO: 2491236 - protein, 22 aa, Entamoeba dispar
KNLFANFSFDGLKGSENKEDKK

SEQ ID NO: 2491237 - protein, 19 aa, Entamoeba dispar
KNLIARPELVPGGGASEMH

SEQ ID NO: 2491238 - protein, 18 aa, Entamoeba dispar
KNLIKNAFFEKGIESRKV

SEQ ID NO: 2491239 - protein, 17 aa, Entamoeba dispar
KNLILRKSVLFTDIGKK

SEQ ID NO: 2491240 - protein, 17 aa, Entamoeba dispar
KNLIPRIQQLKVKEVNK

SEQ ID NO: 2491241 - protein, 28 aa, Entamoeba dispar
KNLKGFIQSCVFHPLKPMIAIATLSKIV

SEQ ID NO: 2491242 - protein, 23 aa, Entamoeba dispar
KNLKGQPLLNICDLISSVIETLG

SEQ ID NO: 2491243 - protein, 23 aa, Entamoeba dispar
KNLMRYVVHFNIILLLPPIDIIK

SEQ ID NO: 2491244 - protein, 24 aa, Entamoeba dispar
KNLNDFNCLVFGGLNVDLKDKYQM

SEQ ID NO: 2491245 - protein, 21 aa, Entamoeba dispar
KNLNFALNMESRIALVGRNGC

SEQ ID NO: 2491246 - protein, 17 aa, Entamoeba dispar
KNLNFVEAGMCELHMVH

SEQ ID NO: 2491247 - protein, 25 aa, Entamoeba dispar
KNLNGLKRLYNLRVLSVKNNLIDRQ

SEQ ID NO: 2491248 - protein, 17 aa, Entamoeba dispar
KNLNIRGLIQMIDEKEK

SEQ ID NO: 2491249 - protein, 19 aa, Entamoeba dispar
KNLRLDMNIIGFNHYTVQK

SEQ ID NO: 2491250 - protein, 19 aa, Entamoeba dispar
KNLVKCLIEREMIIKKPWK

SEQ ID NO: 2491251 - protein, 19 aa, Entamoeba dispar
KNMEVGCVIFQIKDTTSPI

SEQ ID NO: 2491252 - protein, 27 aa, Entamoeba dispar
KNMSLKYLINYDDLPSFAFKSKQTRIN

SEQ ID NO: 2491253 - protein, 31 aa, Entamoeba dispar
KNMSLKYLINYDDLPSFAFKSKQTRINWTDK

SEQ ID NO: 2491254 - protein, 25 aa, Entamoeba dispar
KNMSLKYLINYDELPSFAFKSKQTR

SEQ ID NO: 2491255 - protein, 19 aa, Entamoeba dispar
KNMVFPRTDPCIIVVVRHP

SEQ ID NO: 2491256 - protein, 36 aa, Entamoeba dispar
KNNCDEFKSVIDLVKKWKFVVVENIDIWEFTDDRMV

SEQ ID NO: 2491257 - protein, 19 aa, Entamoeba dispar
KNNCLTLTSGILLINHINE

SEQ ID NO: 2491258 - protein, 21 aa, Entamoeba dispar
KNNDEISFGYSIELPLNNGEK

SEQ ID NO: 2491259 - protein, 24 aa, Entamoeba dispar
KNNEWEMVDIIGARDWSGYSTSLC

SEQ ID NO: 2491260 - protein, 25 aa, Entamoeba dispar
KNNIIKEIKEWFGINESKEAESLFK

SEQ ID NO: 2491261 - protein, 19 aa, Entamoeba dispar
KNNIIKIDLNIDCLKEITV

SEQ ID NO: 2491262 - protein, 17 aa, Entamoeba dispar
KNNINIQRVMYRKKKNG

SEQ ID NO: 2491263 - protein, 17 aa, Entamoeba dispar
KNNKEDLWWSRHGMDDI

SEQ ID NO: 2491264 - protein, 18 aa, Entamoeba dispar
KNNKILLYYPIDFDAKIC

SEQ ID NO: 2491265 - protein, 19 aa, Entamoeba dispar
KNNLAPVIIFSFNRKELEI

SEQ ID NO: 2491266 - protein, 23 aa, Entamoeba dispar
KNNLKLHHKGMEYVFTIFNQLGC

SEQ ID NO: 2491267 - protein, 17 aa, Entamoeba dispar
KNNVMIIKQLFGLLYKI

SEQ ID NO: 2491268 - protein, 33 aa, Entamoeba dispar
KNNYWNCPLCEKKCYYCSLIVDRSLMEIIKGAP

SEQ ID NO: 2491269 - protein, 24 aa, Entamoeba dispar
KNPFKEIFKLFSNIGNHTVSQIPF

SEQ ID NO: 2491270 - protein, 18 aa, Entamoeba dispar
KNPGCSAEDIIDAEKYGN

SEQ ID NO: 2491271 - protein, 24 aa, Entamoeba dispar
KNPIIKGVPIFKYKTVSLNNFSVY

SEQ ID NO: 2491272 - protein, 18 aa, Entamoeba dispar
KNPIRFDFCSTQRERFIE

SEQ ID NO: 2491273 - protein, 20 aa, Entamoeba dispar
KNPISMILDDVFAHYYEVTD

SEQ ID NO: 2491274 - protein, 19 aa, Entamoeba dispar
KNPIVVIAYLELPRFDKKQ

SEQ ID NO: 2491275 - protein, 24 aa, Entamoeba dispar
KNPKFSFDLSEFISLTSLSLIIKN

SEQ ID NO: 2491276 - protein, 24 aa, Entamoeba dispar
KNPKFSFDLSEFMSLTSLSLIIKN

SEQ ID NO: 2491277 - protein, 20 aa, Entamoeba dispar
KNPKQFPIILEYTGVIEHLF

SEQ ID NO: 2491278 - protein, 20 aa, Entamoeba dispar
KNPNKECFVFRSSRTGANIR

SEQ ID NO: 2491279 - protein, 18 aa, Entamoeba dispar
KNPPSWAEIIKYYRGSDL

SEQ ID NO: 2491280 - protein, 25 aa, Entamoeba dispar
KNPRNCKMCRECIREERSEYIKLGR

SEQ ID NO: 2491281 - protein, 26 aa, Entamoeba dispar
KNPYEPNKIFLLLNIIEKIIIFQSNL

SEQ ID NO: 2491282 - protein, 18 aa, Entamoeba dispar
KNQCKLIIQMFTKKCQIK

SEQ ID NO: 2491283 - protein, 23 aa, Entamoeba dispar
KNQDIPRRKKCIINLKKTKNGFM

SEQ ID NO: 2491284 - protein, 26 aa, Entamoeba dispar
KNQDWYHFVCIAIELLHPSMVKKRKE

SEQ ID NO: 2491285 - protein, 30 aa, Entamoeba dispar
KNQECYGKILAIVIRWVMYRYGKTIETCEN

SEQ ID NO: 2491286 - protein, 26 aa, Entamoeba dispar
KNQGEFLFILFIRRFVELLKSNGCKL

SEQ ID NO: 2491287 - protein, 18 aa, Entamoeba dispar
KNQIELMINILPTLIQYT

SEQ ID NO: 2491288 - protein, 26 aa, Entamoeba dispar
KNQIKAFDLFKAAAFKKHPDSLYILG

SEQ ID NO: 2491289 - protein, 60 aa, Entamoeba dispar
KNQYSFRLPHELKNLQVSLCLLIYKFMYCGAPYKVYGCYDEKFNVFIVITKLTVENYPST

SEQ ID NO: 2491290 - protein, 21 aa, Entamoeba dispar
KNRAPALLIAYLIQNNKMSFM

SEQ ID NO: 2491291 - protein, 19 aa, Entamoeba dispar
KNRDPLERDIQQVFIGKDS

SEQ ID NO: 2491292 - protein, 17 aa, Entamoeba dispar
KNRDWVNMRSWWFNEDK

SEQ ID NO: 2491293 - protein, 24 aa, Entamoeba dispar
KNREEIIGRIAIARAPNEEIKEAI

SEQ ID NO: 2491294 - protein, 18 aa, Entamoeba dispar
KNRIAIGDIIALKEIEEN

SEQ ID NO: 2491295 - protein, 20 aa, Entamoeba dispar
KNRIASQAFTGFKQQRFLEY

SEQ ID NO: 2491296 - protein, 18 aa, Entamoeba dispar
KNRIVSMNRPARVVELGR

SEQ ID NO: 2491297 - protein, 20 aa, Entamoeba dispar
KNRKCIQEAVLIGILSRHCS

SEQ ID NO: 2491298 - protein, 21 aa, Entamoeba dispar
KNRKIIFESLARKIKETNEQP

SEQ ID NO: 2491299 - protein, 27 aa, Entamoeba dispar
KNRKWLLPYIVYKCCGMNGVPTMENLK

SEQ ID NO: 2491300 - protein, 25 aa, Entamoeba dispar
KNRLHEWPTYCYLLKEIKSIETQDP

SEQ ID NO: 2491301 - protein, 18 aa, Entamoeba dispar
KNRMSLLPLSSHSSVPTP

SEQ ID NO: 2491302 - protein, 24 aa, Entamoeba dispar
KNRRRIGHNLFWFLKAEIHDARVT

SEQ ID NO: 2491303 - protein, 18 aa, Entamoeba dispar
KNRSWKTLCSLKAELNTD

SEQ ID NO: 2491304 - protein, 23 aa, Entamoeba dispar
KNSIKLLTEILLQYQNEINYLEQ

SEQ ID NO: 2491305 - protein, 18 aa, Entamoeba dispar
KNSLKEPLTFTFSSSLKE

SEQ ID NO: 2491306 - protein, 25 aa, Entamoeba dispar
KNSLKRNGFEIIQFLIKMISVSPQN

SEQ ID NO: 2491307 - protein, 18 aa, Entamoeba dispar
KNSLPLINSFTELFTEQS

SEQ ID NO: 2491308 - protein, 20 aa, Entamoeba dispar
KNSMCRIEYNSPKLLLVPDV

SEQ ID NO: 2491309 - protein, 25 aa, Entamoeba dispar
KNSMISNDVFIRMLPLLIFIPDYIC

SEQ ID NO: 2491310 - protein, 25 aa, Entamoeba dispar
KNSMLRPLVILIRYLLHQAGFTSVM

SEQ ID NO: 2491311 - protein, 17 aa, Entamoeba dispar
KNSPCLKSSELKKHVQA

SEQ ID NO: 2491312 - protein, 19 aa, Entamoeba dispar
KNSQMILGFFKQIDKLPEF

SEQ ID NO: 2491313 - protein, 21 aa, Entamoeba dispar
KNSTIRVCEDIVFPTFIPFYD

SEQ ID NO: 2491314 - protein, 17 aa, Entamoeba dispar
KNTCVVKEDCTFAVDGI

SEQ ID NO: 2491315 - protein, 23 aa, Entamoeba dispar
KNTDFKCYFTWFYETTQGVIKLG

SEQ ID NO: 2491316 - protein, 19 aa, Entamoeba dispar
KNTEMVFSYYISEGKISQL

SEQ ID NO: 2491317 - protein, 19 aa, Entamoeba dispar
KNTFQLFIILSEFHQKQYQ

SEQ ID NO: 2491318 - protein, 19 aa, Entamoeba dispar
KNTHPIAVSSAYFAYPTYD

SEQ ID NO: 2491319 - protein, 20 aa, Entamoeba dispar
KNTIFINWLLQHGCNATLLD

SEQ ID NO: 2491320 - protein, 24 aa, Entamoeba dispar
KNTLWYLCYFCQEVVKNVEKTQMN

SEQ ID NO: 2491321 - protein, 17 aa, Entamoeba dispar
KNTPFHFFCKNFSNPNC

SEQ ID NO: 2491322 - protein, 26 aa, Entamoeba dispar
KNTPLKKLMEAFCNKQGLNMSSVRFL

SEQ ID NO: 2491323 - protein, 21 aa, Entamoeba dispar
KNTRKLFFMNIQHRLYQPKEN

SEQ ID NO: 2491324 - protein, 22 aa, Entamoeba dispar
KNTRLQGIVLTMDFRINRFSTN

SEQ ID NO: 2491325 - protein, 22 aa, Entamoeba dispar
KNTSEFSFSPLIKEEYDETLSK

SEQ ID NO: 2491326 - protein, 24 aa, Entamoeba dispar
KNVIEGCKWYQFLHSILVGAVLIV

SEQ ID NO: 2491327 - protein, 34 aa, Entamoeba dispar
KNVIIYSCLMGRIGVLIPFNFREDVEFFSKLEME

SEQ ID NO: 2491328 - protein, 25 aa, Entamoeba dispar
KNVKVSYCNIMLYIPIKKFTVRVLN

SEQ ID NO: 2491329 - protein, 21 aa, Entamoeba dispar
KNVLKGHVALDQFEEMIDHIV

SEQ ID NO: 2491330 - protein, 19 aa, Entamoeba dispar
KNVMRKCKTKFTQILLNSE

SEQ ID NO: 2491331 - protein, 17 aa, Entamoeba dispar
KNVPIKGSIRLKNHEEG

SEQ ID NO: 2491332 - protein, 22 aa, Entamoeba dispar
KNVPIYSRHILKSVYDNYLDEE

SEQ ID NO: 2491333 - protein, 22 aa, Entamoeba dispar
KNVREVYEIIAQHFSQTRYKGW

SEQ ID NO: 2491334 - protein, 25 aa, Entamoeba dispar
KNVRIGWLYCQRGFETGYIPQNFTS

SEQ ID NO: 2491335 - protein, 18 aa, Entamoeba dispar
KNVYWTIDPAQPFIDKLV

SEQ ID NO: 2491336 - protein, 19 aa, Entamoeba dispar
KNWERVICLKDEIENELDA

SEQ ID NO: 2491337 - protein, 17 aa, Entamoeba dispar
KNWKNYKCTVFNEFFLQ

SEQ ID NO: 2491338 - protein, 18 aa, Entamoeba dispar
KNYFTNKEFKTWFIENLM

SEQ ID NO: 2491339 - protein, 30 aa, Entamoeba dispar
KNYHCWSHRVWVCNKFNCWVGELAYTQKMI

SEQ ID NO: 2491340 - protein, 21 aa, Entamoeba dispar
KNYIENIGWIIDICKNYIEMN

SEQ ID NO: 2491341 - protein, 23 aa, Entamoeba dispar
KNYKCTVFNEFFLQRLLSTLLNF

SEQ ID NO: 2491342 - protein, 23 aa, Entamoeba dispar
KNYKILLDIILQFIKEQKILNNE

SEQ ID NO: 2491343 - protein, 17 aa, Entamoeba dispar
KNYKSFFRVGSLKKISK

SEQ ID NO: 2491344 - protein, 17 aa, Entamoeba dispar
KNYLLEWTNSYDYEKLY

SEQ ID NO: 2491345 - protein, 25 aa, Entamoeba dispar
KNYLMKGYHMIGLFDGHGGDTVSKL

SEQ ID NO: 2491346 - protein, 23 aa, Entamoeba dispar
KPAEEWICGGVPLTIMMNMEQRN

SEQ ID NO: 2491347 - protein, 27 aa, Entamoeba dispar
KPAEKLRPLYWNRIVIDMNNDKSIWRE

SEQ ID NO: 2491348 - protein, 17 aa, Entamoeba dispar
KPAELFVDPIETVRNFL

SEQ ID NO: 2491349 - protein, 17 aa, Entamoeba dispar
KPAEMLDIGCGWGGLVR

SEQ ID NO: 2491350 - protein, 25 aa, Entamoeba dispar
KPAPKKSNNDWGFDFDSDIGGGNSG

SEQ ID NO: 2491351 - protein, 26 aa, Entamoeba dispar
KPAQMKKFLKQFGKLESYRFRGGAFI

SEQ ID NO: 2491352 - protein, 28 aa, Entamoeba dispar
KPAYCDRILYKECKGLKIKCLKYTSKKE

SEQ ID NO: 2491353 - protein, 24 aa, Entamoeba dispar
KPCHSGMIPWIIKEIARVKEVNEE

SEQ ID NO: 2491354 - protein, 21 aa, Entamoeba dispar
KPCKEVHKLPNKKLPVPPQKC

SEQ ID NO: 2491355 - protein, 18 aa, Entamoeba dispar
KPDDFFMYCLVSLHRFII

SEQ ID NO: 2491356 - protein, 23 aa, Entamoeba dispar
KPDDQLIQWFWSIVESFSEEEKS

SEQ ID NO: 2491357 - protein, 23 aa, Entamoeba dispar
KPDLMITISLFIGNLLKLQEFIK

SEQ ID NO: 2491358 - protein, 21 aa, Entamoeba dispar
KPEIHRLIFTILKILIKYHSF

SEQ ID NO: 2491359 - protein, 20 aa, Entamoeba dispar
KPEIKEMIQNAHVIRSIYIT

SEQ ID NO: 2491360 - protein, 20 aa, Entamoeba dispar
KPEIPLKILQNHTGEVIFIK

SEQ ID NO: 2491361 - protein, 20 aa, Entamoeba dispar
KPELFGMKCYAKIGQIEEKV

SEQ ID NO: 2491362 - protein, 34 aa, Entamoeba dispar
KPELFKTKVLKLLHEYGILYSFRKSQFRSLNYPK

SEQ ID NO: 2491363 - protein, 24 aa, Entamoeba dispar
KPELKTESPLSCSLKTSHQKQPIQ

SEQ ID NO: 2491364 - protein, 17 aa, Entamoeba dispar
KPFKETYFGSAKEFINL

SEQ ID NO: 2491365 - protein, 20 aa, Entamoeba dispar
KPFQRKIIFNNYLLDIDVIV

SEQ ID NO: 2491366 - protein, 24 aa, Entamoeba dispar
KPFSSSKIELCIPLAKQIKQEILI

SEQ ID NO: 2491367 - protein, 27 aa, Entamoeba dispar
KPGEGFLQCLHRLLSTRIGYESFVENK

SEQ ID NO: 2491368 - protein, 23 aa, Entamoeba dispar
KPGEILCDAFAGVGPFAIPAALK

SEQ ID NO: 2491369 - protein, 17 aa, Entamoeba dispar
KPGEIVVLIPSSWFSKW

SEQ ID NO: 2491370 - protein, 27 aa, Entamoeba dispar
KPGKCRLECKKTCPINRAGGLCIEVLP

SEQ ID NO: 2491371 - protein, 19 aa, Entamoeba dispar
KPGKKFKKSLLLDLKIQLM

SEQ ID NO: 2491372 - protein, 19 aa, Entamoeba dispar
KPGWKFSEYEMRGIPIRIE

SEQ ID NO: 2491373 - protein, 24 aa, Entamoeba dispar
KPGYKSRIRGYLELKKTNEMIEDI

SEQ ID NO: 2491374 - protein, 23 aa, Entamoeba dispar
KPHKRKNTIVFNQRFDNKFSKYT

SEQ ID NO: 2491375 - protein, 34 aa, Entamoeba dispar
KPHQTDCLCFLLPSCCPVSQSQIICRFYKEQMRN

SEQ ID NO: 2491376 - protein, 32 aa, Entamoeba dispar
KPHQTDCLCFLLPSCCPVSQSQILCKFYKEQM

SEQ ID NO: 2491377 - protein, 26 aa, Entamoeba dispar
KPHQTDCLCFLLPSYCPVSQSQILCK

SEQ ID NO: 2491378 - protein, 21 aa, Entamoeba dispar
KPIEIVLHLPILCEDKNVPYV

SEQ ID NO: 2491379 - protein, 22 aa, Entamoeba dispar
KPIETKRKWLYDKMNNNNDFIS

SEQ ID NO: 2491380 - protein, 18 aa, Entamoeba dispar
KPIICPQVNEPPFRPIQI

SEQ ID NO: 2491381 - protein, 17 aa, Entamoeba dispar
KPIIQYLVLCLIEKAKG

SEQ ID NO: 2491382 - protein, 23 aa, Entamoeba dispar
KPIKGRLSIGRVKSDIHVVKPKR

SEQ ID NO: 2491383 - protein, 22 aa, Entamoeba dispar
KPIKIRRLSTGRVESNINSIPH

SEQ ID NO: 2491384 - protein, 19 aa, Entamoeba dispar
KPILKCIENILKQTQGEMA

SEQ ID NO: 2491385 - protein, 18 aa, Entamoeba dispar
KPITCGFKMSVLGKLADT

SEQ ID NO: 2491386 - protein, 17 aa, Entamoeba dispar
KPIVFKAKIHRKRKNED

SEQ ID NO: 2491387 - protein, 23 aa, Entamoeba dispar
KPKDLYYFFLFKDIFVQTKVKKL

SEQ ID NO: 2491388 - protein, 18 aa, Entamoeba dispar
KPKFAANFEEYYPVNTLR

SEQ ID NO: 2491389 - protein, 21 aa, Entamoeba dispar
KPKILCPICNSYLNLSDTYCV

SEQ ID NO: 2491390 - protein, 19 aa, Entamoeba dispar
KPKKKWDLVNEDFLKLLKE

SEQ ID NO: 2491391 - protein, 19 aa, Entamoeba dispar
KPKKMRGSTSLVDGDGLKT

SEQ ID NO: 2491392 - protein, 24 aa, Entamoeba dispar
KPKKPKNAYLLFSSEKYPQYKKQF

SEQ ID NO: 2491393 - protein, 19 aa, Entamoeba dispar
KPKMEIIQISGIEMQDLEE

SEQ ID NO: 2491394 - protein, 19 aa, Entamoeba dispar
KPKQPPLCAKNLLDELSSK

SEQ ID NO: 2491395 - protein, 23 aa, Entamoeba dispar
KPKRKQLNERKVLKSTKNKKVKK

SEQ ID NO: 2491396 - protein, 30 aa, Entamoeba dispar
KPKRRIDFFSRPPICFKGTSSTARLQTIGE

SEQ ID NO: 2491397 - protein, 20 aa, Entamoeba dispar
KPKVKWEVAVRITKDIKNMV

SEQ ID NO: 2491398 - protein, 17 aa, Entamoeba dispar
KPLCKLFDIENEEKDDM

SEQ ID NO: 2491399 - protein, 18 aa, Entamoeba dispar
KPLKERRDILHSTFHEVS

SEQ ID NO: 2491400 - protein, 18 aa, Entamoeba dispar
KPLKRPQHVFDIPKEEKK

SEQ ID NO: 2491401 - protein, 26 aa, Entamoeba dispar
KPLLDDIRMGSPMLKETRQNKEKGTS

SEQ ID NO: 2491402 - protein, 22 aa, Entamoeba dispar
KPLSYAINCLKQIDSVRTAQDK

SEQ ID NO: 2491403 - protein, 18 aa, Entamoeba dispar
KPLVCWTCNNNFKCDFHK

SEQ ID NO: 2491404 - protein, 26 aa, Entamoeba dispar
KPLVMSTAKALRVVNEIKEKLIKIEE

SEQ ID NO: 2491405 - protein, 22 aa, Entamoeba dispar
KPMVEGIFDIRVMYEKKKLTEE

SEQ ID NO: 2491406 - protein, 24 aa, Entamoeba dispar
KPNDIKTINGFNFNLTSTFGSSTS

SEQ ID NO: 2491407 - protein, 21 aa, Entamoeba dispar
KPNEDYCGYYFFPYDIVEQHQ

SEQ ID NO: 2491408 - protein, 20 aa, Entamoeba dispar
KPNEKCSWCNENNEIKSFTI

SEQ ID NO: 2491409 - protein, 17 aa, Entamoeba dispar
KPNESIELPPPMNDLLN

SEQ ID NO: 2491410 - protein, 26 aa, Entamoeba dispar
KPNGNGWVCILLLHIGKGAINQTTKD

SEQ ID NO: 2491411 - protein, 17 aa, Entamoeba dispar
KPNLISKPLKDRMKDST

SEQ ID NO: 2491412 - protein, 24 aa, Entamoeba dispar
KPNLRFIKELFMNRIDFIIISSSL

SEQ ID NO: 2491413 - protein, 23 aa, Entamoeba dispar
KPNSELFYIIYFLPFTINIDNDR

SEQ ID NO: 2491414 - protein, 24 aa, Entamoeba dispar
KPNSVFVLNCPWTGAELEAQLPGS

SEQ ID NO: 2491415 - protein, 24 aa, Entamoeba dispar
KPNTIAVVTIFFVLRYYNVLNGSI

SEQ ID NO: 2491416 - protein, 24 aa, Entamoeba dispar
KPNTVAAVVICFVCETEKCLTQEL

SEQ ID NO: 2491417 - protein, 24 aa, Entamoeba dispar
KPPKSLCKRSFFAALDETHFFYHT

SEQ ID NO: 2491418 - protein, 20 aa, Entamoeba dispar
KPPRLPCSLKKDSSPLPKNI

SEQ ID NO: 2491419 - protein, 17 aa, Entamoeba dispar
KPPTFEVLNENNITCIK

SEQ ID NO: 2491420 - protein, 22 aa, Entamoeba dispar
KPPVKISCCRRLRSQPICECSP

SEQ ID NO: 2491421 - protein, 20 aa, Entamoeba dispar
KPQGDFKIGIIPFNDDDDFD

SEQ ID NO: 2491422 - protein, 19 aa, Entamoeba dispar
KPQMRRVADEFNYSMNSKR

SEQ ID NO: 2491423 - protein, 25 aa, Entamoeba dispar
KPQPKPDVFASLGSYHPKAKTTQPE

SEQ ID NO: 2491424 - protein, 19 aa, Entamoeba dispar
KPQSAYFLYLNEHRASIKE

SEQ ID NO: 2491425 - protein, 25 aa, Entamoeba dispar
KPRIVCPQCSFVYCYNCKEEYHEGY

SEQ ID NO: 2491426 - protein, 19 aa, Entamoeba dispar
KPRKVEKRINHIYTKEQKT

SEQ ID NO: 2491427 - protein, 25 aa, Entamoeba dispar
KPRLIGSKCVGFYQLNMADIKEGDE

SEQ ID NO: 2491428 - protein, 28 aa, Entamoeba dispar
KPRLYGRRLKRIFVYRCGISDNLMKAIR

SEQ ID NO: 2491429 - protein, 21 aa, Entamoeba dispar
KPRRVIKIFKELIKLKEFYQI

SEQ ID NO: 2491430 - protein, 19 aa, Entamoeba dispar
KPSALKGFLIPVTKSGSPI

SEQ ID NO: 2491431 - protein, 19 aa, Entamoeba dispar
KPSEAMLVACAKSVAANAM

SEQ ID NO: 2491432 - protein, 19 aa, Entamoeba dispar
KPSFNIEIPYYFNKEMHLF

SEQ ID NO: 2491433 - protein, 22 aa, Entamoeba dispar
KPSHGKLTMFGTEINEKTRESF

SEQ ID NO: 2491434 - protein, 32 aa, Entamoeba dispar
KPSHGPHGMKECLPLILILRNRLNYALNGREV

SEQ ID NO: 2491435 - protein, 19 aa, Entamoeba dispar
KPSIKLIVKEVMVIHLNQN

SEQ ID NO: 2491436 - protein, 22 aa, Entamoeba dispar
KPSKLRLVKRASPTIGLSLIKL

SEQ ID NO: 2491437 - protein, 17 aa, Entamoeba dispar
KPSNILITFKIDNNVFG

SEQ ID NO: 2491438 - protein, 18 aa, Entamoeba dispar
KPSPRKPRQTKDKSKITH

SEQ ID NO: 2491439 - protein, 18 aa, Entamoeba dispar
KPSQFPVGGCCYCKESGN

SEQ ID NO: 2491440 - protein, 19 aa, Entamoeba dispar
KPSQFPVGGCCYCKESGNA

SEQ ID NO: 2491441 - protein, 26 aa, Entamoeba dispar
KPTGIPLCIEYNSFIRRLQHRAVNNY

SEQ ID NO: 2491442 - protein, 18 aa, Entamoeba dispar
KPTIAREIMAMWFNLPDR

SEQ ID NO: 2491443 - protein, 23 aa, Entamoeba dispar
KPTPLPKKGCVKPKVPEKKEEPI

SEQ ID NO: 2491444 - protein, 25 aa, Entamoeba dispar
KPTPLPLICSFLIDGKLCFHTYPIV

SEQ ID NO: 2491445 - protein, 22 aa, Entamoeba dispar
KPTQKLTMCLEKSSGIVKYEQK

SEQ ID NO: 2491446 - protein, 18 aa, Entamoeba dispar
KPTQWNYFFLFSDRLIGT

SEQ ID NO: 2491447 - protein, 18 aa, Entamoeba dispar
KPTTKREEKFIIGTRSTL

SEQ ID NO: 2491448 - protein, 20 aa, Entamoeba dispar
KPTTLTIAFHLYRAGLIDEA

SEQ ID NO: 2491449 - protein, 20 aa, Entamoeba dispar
KPVAMPKLTLAANEIQNALH

SEQ ID NO: 2491450 - protein, 17 aa, Entamoeba dispar
KPVFQLLLYFLVLDIDN

SEQ ID NO: 2491451 - protein, 26 aa, Entamoeba dispar
KPVILRLDVKYVLGLVLGYGLNHGMF

SEQ ID NO: 2491452 - protein, 19 aa, Entamoeba dispar
KPVPAISINLFNSSILQPR

SEQ ID NO: 2491453 - protein, 24 aa, Entamoeba dispar
KPVPYNFAGINGFTHAGIYKAALN

SEQ ID NO: 2491454 - protein, 29 aa, Entamoeba dispar
KPVQLKLLCHPLRIEFIEEFNKIFSKNSN

SEQ ID NO: 2491455 - protein, 17 aa, Entamoeba dispar
KPVREPTQFSPFIHIQR

SEQ ID NO: 2491456 - protein, 19 aa, Entamoeba dispar
KPVSCCFTLYPSKTLPDKL

SEQ ID NO: 2491457 - protein, 22 aa, Entamoeba dispar
KPVSNPCYKYTLTLIKDIEIFV

SEQ ID NO: 2491458 - protein, 18 aa, Entamoeba dispar
KPYECLICHKHFARHSDL

SEQ ID NO: 2491459 - protein, 18 aa, Entamoeba dispar
KPYGKARISNSSRKSLLD

SEQ ID NO: 2491460 - protein, 18 aa, Entamoeba dispar
KPYIPGFLPPLPDARTYK

SEQ ID NO: 2491461 - protein, 19 aa, Entamoeba dispar
KPYIPKRNKKVYDLDEIGG

SEQ ID NO: 2491462 - protein, 19 aa, Entamoeba dispar
KPYSIIHKWIIDKASSSFY

SEQ ID NO: 2491463 - protein, 22 aa, Entamoeba dispar
KPYYERRKAIIMGAPLTDEEIQ

SEQ ID NO: 2491464 - protein, 28 aa, Entamoeba dispar
KQADFKAAVQCMKRIQLLPSSIVTKQYL

SEQ ID NO: 2491465 - protein, 31 aa, Entamoeba dispar
KQADPSSCYIFDCMTRIYVWMGDESIPLQQK

SEQ ID NO: 2491466 - protein, 17 aa, Entamoeba dispar
KQAIKFNAICSEPQTTA

SEQ ID NO: 2491467 - protein, 18 aa, Entamoeba dispar
KQAISLCGINRTKVKEIQ

SEQ ID NO: 2491468 - protein, 20 aa, Entamoeba dispar
KQAKGILEFVSLIRDLVIKF

SEQ ID NO: 2491469 - protein, 20 aa, Entamoeba dispar
KQAKQHGCLTLWNPAPAPKE

SEQ ID NO: 2491470 - protein, 17 aa, Entamoeba dispar
KQALIILEKNNWDMKLT

SEQ ID NO: 2491471 - protein, 18 aa, Entamoeba dispar
KQALRCDFFSRSQMKDVV

SEQ ID NO: 2491472 - protein, 29 aa, Entamoeba dispar
KQAMAAAFCSGCDFIRAEGYVFGHVADEG

SEQ ID NO: 2491473 - protein, 18 aa, Entamoeba dispar
KQCIVFCGSVLRTEVIFR

SEQ ID NO: 2491474 - protein, 23 aa, Entamoeba dispar
KQCKKAEVTHQFFRIKLIQFSIE

SEQ ID NO: 2491475 - protein, 18 aa, Entamoeba dispar
KQCWKLLDSNFCLKTGVK

SEQ ID NO: 2491476 - protein, 26 aa, Entamoeba dispar
KQDDWRWSDLLQFKIIILVEGKMYEK

SEQ ID NO: 2491477 - protein, 18 aa, Entamoeba dispar
KQEAIKESGIIKEKEQIA

SEQ ID NO: 2491478 - protein, 17 aa, Entamoeba dispar
KQEEFYIVLNYMQQLNL

SEQ ID NO: 2491479 - protein, 17 aa, Entamoeba dispar
KQEFIRFLPKQTSLNKS

SEQ ID NO: 2491480 - protein, 21 aa, Entamoeba dispar
KQEICCAEDLDILFSAVEYFK

SEQ ID NO: 2491481 - protein, 19 aa, Entamoeba dispar
KQEIKEMFDKIWINNNQKF

SEQ ID NO: 2491482 - protein, 20 aa, Entamoeba dispar
KQEKELFPTLGEGRNLPIPQ

SEQ ID NO: 2491483 - protein, 29 aa, Entamoeba dispar
KQEKGRLIPRFFSYCTSVAISRGINEEGI

SEQ ID NO: 2491484 - protein, 23 aa, Entamoeba dispar
KQEKRIGLLKGKMKNLTEELDGF

SEQ ID NO: 2491485 - protein, 20 aa, Entamoeba dispar
KQEQLHIIVVIQFILFGIDN

SEQ ID NO: 2491486 - protein, 25 aa, Entamoeba dispar
KQEVCGKRLKLLYEELNIQSGEIGL

SEQ ID NO: 2491487 - protein, 19 aa, Entamoeba dispar
KQEVITCIKASQNQTIQAI

SEQ ID NO: 2491488 - protein, 21 aa, Entamoeba dispar
KQEYPELASFVIVYNNSILHS

SEQ ID NO: 2491489 - protein, 17 aa, Entamoeba dispar
KQFCGRYLYVQFGYQVI

SEQ ID NO: 2491490 - protein, 21 aa, Entamoeba dispar
KQFECLKSIHYGPMDVQCEWI

SEQ ID NO: 2491491 - protein, 19 aa, Entamoeba dispar
KQFIFTMYSAFWLTTDGKV

SEQ ID NO: 2491492 - protein, 23 aa, Entamoeba dispar
KQFKKQFIREFFQLVDENQKEIY

SEQ ID NO: 2491493 - protein, 25 aa, Entamoeba dispar
KQFKSHCSQLLTAARVSMEDQSPLL

SEQ ID NO: 2491494 - protein, 17 aa, Entamoeba dispar
KQFLDIMHVGRTFIQMT

SEQ ID NO: 2491495 - protein, 22 aa, Entamoeba dispar
KQFNELDYYYSIIQYYSPNPDE

SEQ ID NO: 2491496 - protein, 20 aa, Entamoeba dispar
KQFNLELLESVFTTNPEKMF

SEQ ID NO: 2491497 - protein, 20 aa, Entamoeba dispar
KQFPYSVSFITKYQSKGRNS

SEQ ID NO: 2491498 - protein, 17 aa, Entamoeba dispar
KQFSGKIRKRFGKSGLK

SEQ ID NO: 2491499 - protein, 18 aa, Entamoeba dispar
KQFYEKCGIHYKDNCMAI

SEQ ID NO: 2491500 - protein, 21 aa, Entamoeba dispar
KQGAHPIVWEEVFKKGNAKKD

SEQ ID NO: 2491501 - protein, 19 aa, Entamoeba dispar
KQGDGFVLIYSITSKESFE

SEQ ID NO: 2491502 - protein, 21 aa, Entamoeba dispar
KQGGLYCSICNKMFSDSTSFT

SEQ ID NO: 2491503 - protein, 32 aa, Entamoeba dispar
KQGGSWKSWKRRWFVIKDRKMWYFAGKNDTEA

SEQ ID NO: 2491504 - protein, 17 aa, Entamoeba dispar
KQGIPKIKIEEIPGLKE

SEQ ID NO: 2491505 - protein, 17 aa, Entamoeba dispar
KQGNGFYILFKEGFVCI

SEQ ID NO: 2491506 - protein, 18 aa, Entamoeba dispar
KQGSLFIYLFRLMLATGI

SEQ ID NO: 2491507 - protein, 26 aa, Entamoeba dispar
KQGYEKDICMRIMKIWINQKDRIMHL

SEQ ID NO: 2491508 - protein, 25 aa, Entamoeba dispar
KQHDLIPLVEFVFGGRQRRFIINLE

SEQ ID NO: 2491509 - protein, 22 aa, Entamoeba dispar
KQIASGVGFIMCYTTLSVYSSQ

SEQ ID NO: 2491510 - protein, 19 aa, Entamoeba dispar
KQICNEIIDVLIKFTTSSI

SEQ ID NO: 2491511 - protein, 17 aa, Entamoeba dispar
KQIDAVLGEEQWKNAQK

SEQ ID NO: 2491512 - protein, 27 aa, Entamoeba dispar
KQIEEVKRLKGLILKQEEAQTEIVSGY

SEQ ID NO: 2491513 - protein, 22 aa, Entamoeba dispar
KQIEIYDRYGIELFEESIGKNN

SEQ ID NO: 2491514 - protein, 28 aa, Entamoeba dispar
KQIFPYSKLFLCRIHIERSLIKYFKSDH

SEQ ID NO: 2491515 - protein, 18 aa, Entamoeba dispar
KQIFPYSKLFLYNDDDEN

SEQ ID NO: 2491516 - protein, 18 aa, Entamoeba dispar
KQIFTNKGINHFDEYTHL

SEQ ID NO: 2491517 - protein, 24 aa, Entamoeba dispar
KQIGRGSFWDVYCVRDPNDGILKV

SEQ ID NO: 2491518 - protein, 23 aa, Entamoeba dispar
KQIHVVGPLAYVEFKTHQQALKV

SEQ ID NO: 2491519 - protein, 18 aa, Entamoeba dispar
KQIKAKFKAEERIRPKMI

SEQ ID NO: 2491520 - protein, 17 aa, Entamoeba dispar
KQIKEAFETKVFDLTAI

SEQ ID NO: 2491521 - protein, 23 aa, Entamoeba dispar
KQILERFGIKCVHINSFSGGSVL

SEQ ID NO: 2491522 - protein, 21 aa, Entamoeba dispar
KQILFKIKMVLDDPYVASEFI

SEQ ID NO: 2491523 - protein, 21 aa, Entamoeba dispar
KQILKSARLKPSHLANKEIVT

SEQ ID NO: 2491524 - protein, 21 aa, Entamoeba dispar
KQILSQDAFEFGKGITSSIEN

SEQ ID NO: 2491525 - protein, 17 aa, Entamoeba dispar
KQINAAMSLIGFNDVVI

SEQ ID NO: 2491526 - protein, 19 aa, Entamoeba dispar
KQIQRLAADFLDNYVFITV

SEQ ID NO: 2491527 - protein, 18 aa, Entamoeba dispar
KQISSLECVCFDTEDMNI

SEQ ID NO: 2491528 - protein, 27 aa, Entamoeba dispar
KQITFAGNCLMSFPVALTSISSLSSLN

SEQ ID NO: 2491529 - protein, 26 aa, Entamoeba dispar
KQIYIKIPYIKSICLINEKTIGYCCF

SEQ ID NO: 2491530 - protein, 18 aa, Entamoeba dispar
KQKAFYFFGIHHDQLLFL

SEQ ID NO: 2491531 - protein, 26 aa, Entamoeba dispar
KQKAVYCTVCNIYLHEKKCIDKFRKE

SEQ ID NO: 2491532 - protein, 30 aa, Entamoeba dispar
KQKDSFQCISCKLVIHKSCDPYKHNIQAVC

SEQ ID NO: 2491533 - protein, 18 aa, Entamoeba dispar
KQKECKKSSFLFINNNQI

SEQ ID NO: 2491534 - protein, 24 aa, Entamoeba dispar
KQKELRSMIYLLFSVANELMKFNE

SEQ ID NO: 2491535 - protein, 18 aa, Entamoeba dispar
KQKFWYSRVNSYTARTGD

SEQ ID NO: 2491536 - protein, 26 aa, Entamoeba dispar
KQKGYPWWPAKIIIMDKLNEKKKRQL

SEQ ID NO: 2491537 - protein, 20 aa, Entamoeba dispar
KQKKGLFDLFSRIKHTTSEE

SEQ ID NO: 2491538 - protein, 26 aa, Entamoeba dispar
KQKLFEMLGHVFNYCFINYENTFDFI

SEQ ID NO: 2491539 - protein, 19 aa, Entamoeba dispar
KQKLGERALPGDISCINSE

SEQ ID NO: 2491540 - protein, 30 aa, Entamoeba dispar
KQKMCKHIFHIPSMKGCPIAWEDLNKEKIF

SEQ ID NO: 2491541 - protein, 27 aa, Entamoeba dispar
KQKNCVDCGCYMLYYIRKIASQPKRTL

SEQ ID NO: 2491542 - protein, 24 aa, Entamoeba dispar
KQKNYEGFCAFVINTFYYNDIKPI

SEQ ID NO: 2491543 - protein, 27 aa, Entamoeba dispar
KQKRKCLIPLDIEKDGYCIECDESSIE

SEQ ID NO: 2491544 - protein, 36 aa, Entamoeba dispar
KQLFGQKDFGVFCVTEYGNVFGIFFHSVKILRNQTF

SEQ ID NO: 2491545 - protein, 35 aa, Entamoeba dispar
KQLFGQKDFGVFCVTKYGNVFGIFFHSVKILRNQT

SEQ ID NO: 2491546 - protein, 36 aa, Entamoeba dispar
KQLFGQKDFGVFCVTKYGNVFGIFFHSVKSFGDQTF

SEQ ID NO: 2491547 - protein, 19 aa, Entamoeba dispar
KQLGTLIRSLGCAPTEDEV

SEQ ID NO: 2491548 - protein, 19 aa, Entamoeba dispar
KQLHCLPWESMPNFDNIMI

SEQ ID NO: 2491549 - protein, 26 aa, Entamoeba dispar
KQLICVKWKGLSYLHIEWISEEQFLL

SEQ ID NO: 2491550 - protein, 17 aa, Entamoeba dispar
KQLKALGMNDFIQSPSY

SEQ ID NO: 2491551 - protein, 18 aa, Entamoeba dispar
KQLKEVILVLNINEEIED

SEQ ID NO: 2491552 - protein, 20 aa, Entamoeba dispar
KQLKFVFFGSDGCGKSNLIN

SEQ ID NO: 2491553 - protein, 24 aa, Entamoeba dispar
KQLKIKKLVRGCVGIKRKPNEPVL

SEQ ID NO: 2491554 - protein, 19 aa, Entamoeba dispar
KQLKKGIVPVLTFKQVYEY

SEQ ID NO: 2491555 - protein, 20 aa, Entamoeba dispar
KQLLEFIIAEAILAKEKVIS

SEQ ID NO: 2491556 - protein, 17 aa, Entamoeba dispar
KQLLESLVILFRNGIIH

SEQ ID NO: 2491557 - protein, 26 aa, Entamoeba dispar
KQLLLPKQLKALGMNDFIQSPSYLTL

SEQ ID NO: 2491558 - protein, 18 aa, Entamoeba dispar
KQLLWYKRQVHLDWKGKK

SEQ ID NO: 2491559 - protein, 23 aa, Entamoeba dispar
KQLNCPSIMAGEVMEHLCDNIIP

SEQ ID NO: 2491560 - protein, 24 aa, Entamoeba dispar
KQLNLLLCKYSCFPNLKSQFMYLK

SEQ ID NO: 2491561 - protein, 17 aa, Entamoeba dispar
KQLNPRKPLKGKKKVKK

SEQ ID NO: 2491562 - protein, 17 aa, Entamoeba dispar
KQLPSLDESVGFYPVQR

SEQ ID NO: 2491563 - protein, 21 aa, Entamoeba dispar
KQLRLDPGIYDKLQIEKVTLG

SEQ ID NO: 2491564 - protein, 22 aa, Entamoeba dispar
KQLRRKLEEFNIEKIKLKDEQK

SEQ ID NO: 2491565 - protein, 25 aa, Entamoeba dispar
KQLTFIECRFHLVCKKDEYNGETRT

SEQ ID NO: 2491566 - protein, 19 aa, Entamoeba dispar
KQLTIDFVQPVLISGNNNN

SEQ ID NO: 2491567 - protein, 17 aa, Entamoeba dispar
KQLYCIQYKTPIEVEGE

SEQ ID NO: 2491568 - protein, 19 aa, Entamoeba dispar
KQMMEVFKPLMKKLEKPNT

SEQ ID NO: 2491569 - protein, 17 aa, Entamoeba dispar
KQMNILICGLDGAGKTA

SEQ ID NO: 2491570 - protein, 18 aa, Entamoeba dispar
KQNECVEMTKKVGELNDS

SEQ ID NO: 2491571 - protein, 19 aa, Entamoeba dispar
KQNIDSFIYNFKWKEHEIN

SEQ ID NO: 2491572 - protein, 28 aa, Entamoeba dispar
KQNIFSDICPITFGSFFYFIEKVVSLII

SEQ ID NO: 2491573 - protein, 20 aa, Entamoeba dispar
KQNIPKGCCRIVKLTDNKYS

SEQ ID NO: 2491574 - protein, 18 aa, Entamoeba dispar
KQNITWSGGKLKPDIDDE

SEQ ID NO: 2491575 - protein, 17 aa, Entamoeba dispar
KQNKCIHKEIVKDKDGT

SEQ ID NO: 2491576 - protein, 18 aa, Entamoeba dispar
KQNLFGIIQGGLQQNLRE

SEQ ID NO: 2491577 - protein, 25 aa, Entamoeba dispar
KQNQLQKEEECLIKEEENNKKLKES

SEQ ID NO: 2491578 - protein, 21 aa, Entamoeba dispar
KQPFRSCINYNSSSARRPYSF

SEQ ID NO: 2491579 - protein, 17 aa, Entamoeba dispar
KQPHGWVISDLIIEPMQ

SEQ ID NO: 2491580 - protein, 17 aa, Entamoeba dispar
KQPIFRDLQFGIYLKSR

SEQ ID NO: 2491581 - protein, 19 aa, Entamoeba dispar
KQPIKGIVICCYGTTIDIP

SEQ ID NO: 2491582 - protein, 21 aa, Entamoeba dispar
KQPQNTVVMFDLIGEESKEES

SEQ ID NO: 2491583 - protein, 25 aa, Entamoeba dispar
KQPQRLTSICLMSFSNILLSEKKSD

SEQ ID NO: 2491584 - protein, 22 aa, Entamoeba dispar
KQPYCIGCATAMGMCRIQKCSR

SEQ ID NO: 2491585 - protein, 21 aa, Entamoeba dispar
KQQEFESMLKMAEQSLKELDS

SEQ ID NO: 2491586 - protein, 19 aa, Entamoeba dispar
KQQEGWRYHARDLAVYRAH

SEQ ID NO: 2491587 - protein, 17 aa, Entamoeba dispar
KQQEIKKIIPFGLIGKT

SEQ ID NO: 2491588 - protein, 17 aa, Entamoeba dispar
KQQGVSFVMPKFHDITI

SEQ ID NO: 2491589 - protein, 18 aa, Entamoeba dispar
KQQIESFSYDTILSNIML

SEQ ID NO: 2491590 - protein, 28 aa, Entamoeba dispar
KQQPTSLKLCFCPLCDKQQMLLERQPLQ

SEQ ID NO: 2491591 - protein, 26 aa, Entamoeba dispar
KQQRILECVNILSSIALNNKVTSSNE

SEQ ID NO: 2491592 - protein, 25 aa, Entamoeba dispar
KQQRKPNCSKQLLTRIESKYFDETL

SEQ ID NO: 2491593 - protein, 19 aa, Entamoeba dispar
KQQVCKIIQERVKQSIKQE

SEQ ID NO: 2491594 - protein, 24 aa, Entamoeba dispar
KQQVLKTNPLIKLQNENQPQNTTK

SEQ ID NO: 2491595 - protein, 18 aa, Entamoeba dispar
KQRAFGIGCSITKDIYIG

SEQ ID NO: 2491596 - protein, 18 aa, Entamoeba dispar
KQREAAIRIAQRVSEDNI

SEQ ID NO: 2491597 - protein, 19 aa, Entamoeba dispar
KQRIIKISTALGMNIGARE

SEQ ID NO: 2491598 - protein, 23 aa, Entamoeba dispar
KQRKEELQVEKSLLEKEIQESSQ

SEQ ID NO: 2491599 - protein, 25 aa, Entamoeba dispar
KQRKWKYHKGYQKWFKKLNDPIYTS

SEQ ID NO: 2491600 - protein, 18 aa, Entamoeba dispar
KQRLEKMGFSVKQTKDSV

SEQ ID NO: 2491601 - protein, 20 aa, Entamoeba dispar
KQRLFVFCLNPFRQKLPLYL

SEQ ID NO: 2491602 - protein, 24 aa, Entamoeba dispar
KQRMKSKGGIVFNGRVYGSMVVSR

SEQ ID NO: 2491603 - protein, 29 aa, Entamoeba dispar
KQRMVSCGIVQLLCEICISTDSVLIKSLS

SEQ ID NO: 2491604 - protein, 22 aa, Entamoeba dispar
KQRSENHWAPFWDSLNSLFKKC

SEQ ID NO: 2491605 - protein, 19 aa, Entamoeba dispar
KQRVESGFDIELRAAVLHE

SEQ ID NO: 2491606 - protein, 24 aa, Entamoeba dispar
KQRYDIEECLSHPFIINTKRDHLD

SEQ ID NO: 2491607 - protein, 19 aa, Entamoeba dispar
KQRYSIIGIDFGNENIVIG

SEQ ID NO: 2491608 - protein, 23 aa, Entamoeba dispar
KQSCVVWRTNLQIVKEGIENIKK

SEQ ID NO: 2491609 - protein, 25 aa, Entamoeba dispar
KQSDFEIQRNIPIPDNVKINEFEFE

SEQ ID NO: 2491610 - protein, 25 aa, Entamoeba dispar
KQSFWMKRVAYLAAQICLHESDDVL

SEQ ID NO: 2491611 - protein, 19 aa, Entamoeba dispar
KQSICPDDAILVYSKHSTR

SEQ ID NO: 2491612 - protein, 23 aa, Entamoeba dispar
KQSPSKTGFWFWGSKASDEDDDN

SEQ ID NO: 2491613 - protein, 24 aa, Entamoeba dispar
KQSSLRPTMFFDSCCENDALEEDM

SEQ ID NO: 2491614 - protein, 20 aa, Entamoeba dispar
KQTFWYTRVNSYTSRTGDIS

SEQ ID NO: 2491615 - protein, 17 aa, Entamoeba dispar
KQTIESFKEEDKKKKSS

SEQ ID NO: 2491616 - protein, 21 aa, Entamoeba dispar
KQTIPRLIPTSAIDSSKLLVC

SEQ ID NO: 2491617 - protein, 28 aa, Entamoeba dispar
KQTNNGWKGGKFGDYSCNGEKIDRNNVE

SEQ ID NO: 2491618 - protein, 17 aa, Entamoeba dispar
KQTVKMYLPETINLNGT

SEQ ID NO: 2491619 - protein, 18 aa, Entamoeba dispar
KQTVKMYLPETVNLNGTL

SEQ ID NO: 2491620 - protein, 23 aa, Entamoeba dispar
KQVKFLIDYFFAVKEKLDIETLM

SEQ ID NO: 2491621 - protein, 18 aa, Entamoeba dispar
KQVNELFHRLSVSDISSF

SEQ ID NO: 2491622 - protein, 24 aa, Entamoeba dispar
KQVSDELIELISIINEFQKSIEEM

SEQ ID NO: 2491623 - protein, 26 aa, Entamoeba dispar
KQVVKRPRASTVFTEQRVDKNLSKEG

SEQ ID NO: 2491624 - protein, 24 aa, Entamoeba dispar
KQWIPSIRMKLIYDSSQQFFDSKG

SEQ ID NO: 2491625 - protein, 20 aa, Entamoeba dispar
KQWISLDFAEDIITKVKEKE

SEQ ID NO: 2491626 - protein, 27 aa, Entamoeba dispar
KQWQVECPMYFYRHSCDLSKQVIQLNK

SEQ ID NO: 2491627 - protein, 26 aa, Entamoeba dispar
KQYDDVLRINCQLVEIADGCERCRQK

SEQ ID NO: 2491628 - protein, 26 aa, Entamoeba dispar
KQYECGECDRHGFCNFLHVIEPNHSL

SEQ ID NO: 2491629 - protein, 20 aa, Entamoeba dispar
KQYFSGKGCELLIKNHITTV

SEQ ID NO: 2491630 - protein, 24 aa, Entamoeba dispar
KQYHTVVLPAFYKRFDVQFQSAKD

SEQ ID NO: 2491631 - protein, 19 aa, Entamoeba dispar
KQYIKEIIQTIELGIGENG

SEQ ID NO: 2491632 - protein, 25 aa, Entamoeba dispar
KQYIKRLFNCFNEFNAEKVCETIML

SEQ ID NO: 2491633 - protein, 17 aa, Entamoeba dispar
KQYIRLAGLRDDISNNN

SEQ ID NO: 2491634 - protein, 18 aa, Entamoeba dispar
KQYYCLLQTISQKRFIGV

SEQ ID NO: 2491635 - protein, 21 aa, Entamoeba dispar
KRAERAKKFAISDSDDDDDVK

SEQ ID NO: 2491636 - protein, 19 aa, Entamoeba dispar
KRAFELLKGEYPITIREVR

SEQ ID NO: 2491637 - protein, 19 aa, Entamoeba dispar
KRALYALAIHSLKNQDVNY

SEQ ID NO: 2491638 - protein, 29 aa, Entamoeba dispar
KRAPEVIVAPPGFPVEYLEMFNSADNDTK

SEQ ID NO: 2491639 - protein, 26 aa, Entamoeba dispar
KRAQWASAEDFVFPGAIQYFGPSEVC

SEQ ID NO: 2491640 - protein, 27 aa, Entamoeba dispar
KRASIASMLDCEWIKKNSVYFPDKKKR

SEQ ID NO: 2491641 - protein, 18 aa, Entamoeba dispar
KRAVCTLKDLNILQQLQS

SEQ ID NO: 2491642 - protein, 19 aa, Entamoeba dispar
KRAYCPYVETVDRNLIDFD

SEQ ID NO: 2491643 - protein, 20 aa, Entamoeba dispar
KRCEEYKIKTAHNLSGAIRD

SEQ ID NO: 2491644 - protein, 19 aa, Entamoeba dispar
KRCKEGYYLTKDMKCLKCD

SEQ ID NO: 2491645 - protein, 23 aa, Entamoeba dispar
KRDEQKVFCSIRRNMDFSKENFI

SEQ ID NO: 2491646 - protein, 17 aa, Entamoeba dispar
KRDFKLNYIETMDESED

SEQ ID NO: 2491647 - protein, 23 aa, Entamoeba dispar
KRDGCFLWVLVQSFFSEICQKIS

SEQ ID NO: 2491648 - protein, 18 aa, Entamoeba dispar
KRDICLQLYKKGIKDRVT

SEQ ID NO: 2491649 - protein, 24 aa, Entamoeba dispar
KRDKELKNDEFIEGDAEEAQRIQK

SEQ ID NO: 2491650 - protein, 29 aa, Entamoeba dispar
KRDPACPFPRVVLSPLAFILGVLYLSNGD

SEQ ID NO: 2491651 - protein, 21 aa, Entamoeba dispar
KRDVIPFSSPIDSLFSNVVLP

SEQ ID NO: 2491652 - protein, 18 aa, Entamoeba dispar
KRDVNGFVIPTSITELEN

SEQ ID NO: 2491653 - protein, 19 aa, Entamoeba dispar
KREAFMCPALYLISPTKES

SEQ ID NO: 2491654 - protein, 23 aa, Entamoeba dispar
KREDAYKTLMKWIKEDPQIYYLR

SEQ ID NO: 2491655 - protein, 22 aa, Entamoeba dispar
KREEEKFDRLVAQSHQADEYLD

SEQ ID NO: 2491656 - protein, 39 aa, Entamoeba dispar
KREFSLSNIFRIWDSIFAYPSRKFHLFIGASILLDHSQK

SEQ ID NO: 2491657 - protein, 24 aa, Entamoeba dispar
KREGDDLHCTINITLLQALTGCEI

SEQ ID NO: 2491658 - protein, 18 aa, Entamoeba dispar
KREIAKLNYLNGLKKKYK

SEQ ID NO: 2491659 - protein, 19 aa, Entamoeba dispar
KREIKGMINDGLISVQRTI

SEQ ID NO: 2491660 - protein, 22 aa, Entamoeba dispar
KRELKRGQEIVHEFSSEGVNDW

SEQ ID NO: 2491661 - protein, 22 aa, Entamoeba dispar
KREMPVLFHFQQISSLMFPDIS

SEQ ID NO: 2491662 - protein, 18 aa, Entamoeba dispar
KREMRLSGNALISIGNGN

SEQ ID NO: 2491663 - protein, 21 aa, Entamoeba dispar
KREVTMLKEINKLKASGDFEK

SEQ ID NO: 2491664 - protein, 22 aa, Entamoeba dispar
KREYTELKMCMVFTPEGEGIEV

SEQ ID NO: 2491665 - protein, 17 aa, Entamoeba dispar
KRFDEVIKVLKEDSICK

SEQ ID NO: 2491666 - protein, 19 aa, Entamoeba dispar
KRFECREVIIEKLKEKGLY

SEQ ID NO: 2491667 - protein, 17 aa, Entamoeba dispar
KRFEFKKPNLISKPLKD

SEQ ID NO: 2491668 - protein, 24 aa, Entamoeba dispar
KRFEFPIPIEIIIDCYKNNNNEEI

SEQ ID NO: 2491669 - protein, 21 aa, Entamoeba dispar
KRFERMYGCLAKFALVQPIRR

SEQ ID NO: 2491670 - protein, 20 aa, Entamoeba dispar
KRFEYELDFLQSLANPHYIQ

SEQ ID NO: 2491671 - protein, 20 aa, Entamoeba dispar
KRFNEKKMHSLAVILETPQK

SEQ ID NO: 2491672 - protein, 20 aa, Entamoeba dispar
KRFNELCSFSILTHTVSSKF

SEQ ID NO: 2491673 - protein, 26 aa, Entamoeba dispar
KRFRLDRCMRFLPQLQNTGGFFVAVL

SEQ ID NO: 2491674 - protein, 17 aa, Entamoeba dispar
KRFSEVYNNLSTSQEIK

SEQ ID NO: 2491675 - protein, 23 aa, Entamoeba dispar
KRFSKGIPKWFIRKKYENEEIEM

SEQ ID NO: 2491676 - protein, 24 aa, Entamoeba dispar
KRFTVKQCLSHEFFSRKRDKTKTK

SEQ ID NO: 2491677 - protein, 19 aa, Entamoeba dispar
KRGAPPVGDGEVLINSSII

SEQ ID NO: 2491678 - protein, 25 aa, Entamoeba dispar
KRGKTFWNKRVLDIYNGGIYLYENN

SEQ ID NO: 2491679 - protein, 17 aa, Entamoeba dispar
KRGKYTVRIFVSETNEG

SEQ ID NO: 2491680 - protein, 20 aa, Entamoeba dispar
KRGLRPSVIEVRTTYSTYYS

SEQ ID NO: 2491681 - protein, 19 aa, Entamoeba dispar
KRGRKRKAFNLEETRKRKR

SEQ ID NO: 2491682 - protein, 23 aa, Entamoeba dispar
KRGTICWSPKGNLLAVGTTADTI

SEQ ID NO: 2491683 - protein, 20 aa, Entamoeba dispar
KRGTIKMEYITRIYLNHHLL

SEQ ID NO: 2491684 - protein, 18 aa, Entamoeba dispar
KRGVTCQYITIPGVKQEL

SEQ ID NO: 2491685 - protein, 18 aa, Entamoeba dispar
KRHIPIMKNEIGMKHSLI

SEQ ID NO: 2491686 - protein, 20 aa, Entamoeba dispar
KRHLFPYVNVCVIDKNGVEE

SEQ ID NO: 2491687 - protein, 20 aa, Entamoeba dispar
KRHSLFKGIKNAVARSDDKK

SEQ ID NO: 2491688 - protein, 19 aa, Entamoeba dispar
KRIAHSKTLRSFLGHATEK

SEQ ID NO: 2491689 - protein, 17 aa, Entamoeba dispar
KRIDAKEALKHPFISFY

SEQ ID NO: 2491690 - protein, 17 aa, Entamoeba dispar
KRIEEITKREEIINMPL

SEQ ID NO: 2491691 - protein, 17 aa, Entamoeba dispar
KRIEEKEKIIIRNTQKL

SEQ ID NO: 2491692 - protein, 21 aa, Entamoeba dispar
KRIELCKLPPISKNISLSIGI

SEQ ID NO: 2491693 - protein, 18 aa, Entamoeba dispar
KRIENKKEGIALENNKTK

SEQ ID NO: 2491694 - protein, 17 aa, Entamoeba dispar
KRIGFLVFDEIAHVFGV

SEQ ID NO: 2491695 - protein, 20 aa, Entamoeba dispar
KRIGNGCFEGSQIKEITIPS

SEQ ID NO: 2491696 - protein, 20 aa, Entamoeba dispar
KRIGSQINLLITFNNYCSEK

SEQ ID NO: 2491697 - protein, 18 aa, Entamoeba dispar
KRIHEMKEIQEIKRDNVN

SEQ ID NO: 2491698 - protein, 27 aa, Entamoeba dispar
KRIIIKCSYCSTPFFVNIEKIHQFNSM

SEQ ID NO: 2491699 - protein, 21 aa, Entamoeba dispar
KRIKESGGMIINGRVSGDVAI

SEQ ID NO: 2491700 - protein, 21 aa, Entamoeba dispar
KRIKESGGMIINGRVSGDVAN

SEQ ID NO: 2491701 - protein, 20 aa, Entamoeba dispar
KRIKNEFQLREDIPQHSDIT

SEQ ID NO: 2491702 - protein, 17 aa, Entamoeba dispar
KRIKRSKSMPFLFFKEE

SEQ ID NO: 2491703 - protein, 20 aa, Entamoeba dispar
KRIKTLVIVSDTKMGENRIC

SEQ ID NO: 2491704 - protein, 19 aa, Entamoeba dispar
KRIKTLVLVSDTRMGKTEF

SEQ ID NO: 2491705 - protein, 17 aa, Entamoeba dispar
KRILKMNKQSIGIVGAT

SEQ ID NO: 2491706 - protein, 18 aa, Entamoeba dispar
KRILREVFIPLDSKKISL

SEQ ID NO: 2491707 - protein, 26 aa, Entamoeba dispar
KRINELNIQYCIGVTIISQVQKCISI

SEQ ID NO: 2491708 - protein, 21 aa, Entamoeba dispar
KRINKQIFHNLSYYVLDTLIQ

SEQ ID NO: 2491709 - protein, 20 aa, Entamoeba dispar
KRINVAGFNKRVPKNAQNPT

SEQ ID NO: 2491710 - protein, 20 aa, Entamoeba dispar
KRIQLIPTLNGCLLLINGNV

SEQ ID NO: 2491711 - protein, 20 aa, Entamoeba dispar
KRISSPLIEDSVSEVKIEDL

SEQ ID NO: 2491712 - protein, 17 aa, Entamoeba dispar
KRITALEARVEQFQKVE

SEQ ID NO: 2491713 - protein, 34 aa, Entamoeba dispar
KRITRDDLVVCWYSRITRSIGFIINGVQLGPAFV

SEQ ID NO: 2491714 - protein, 21 aa, Entamoeba dispar
KRIVYCFNDGKGIEERIQIGE

SEQ ID NO: 2491715 - protein, 21 aa, Entamoeba dispar
KRKANVYHFACSRGRRDLVEL

SEQ ID NO: 2491716 - protein, 22 aa, Entamoeba dispar
KRKEIGNKWTIIASYLEGRSPN

SEQ ID NO: 2491717 - protein, 23 aa, Entamoeba dispar
KRKEIGNKWTIIASYLKGRSPND

SEQ ID NO: 2491718 - protein, 21 aa, Entamoeba dispar
KRKELAECLILIDVTNQDTIK

SEQ ID NO: 2491719 - protein, 17 aa, Entamoeba dispar
KRKELKRLGIEAPIPKR

SEQ ID NO: 2491720 - protein, 18 aa, Entamoeba dispar
KRKEVFYSSFLSLFLNDS

SEQ ID NO: 2491721 - protein, 35 aa, Entamoeba dispar
KRKFGIICFKYHCERCGFVVCDVCSRNRKIVPPNP

SEQ ID NO: 2491722 - protein, 21 aa, Entamoeba dispar
KRKGKDYEVTFGREEEQDKVI

SEQ ID NO: 2491723 - protein, 19 aa, Entamoeba dispar
KRKGYLMVEQTMKYKHAHI

SEQ ID NO: 2491724 - protein, 18 aa, Entamoeba dispar
KRKKEIEEFKLFSAKRKL

SEQ ID NO: 2491725 - protein, 21 aa, Entamoeba dispar
KRKKESLIRGFPLTYRLSDFT

SEQ ID NO: 2491726 - protein, 28 aa, Entamoeba dispar
KRKKYYCKKCLNYICSKCWNSIGKCCLK

SEQ ID NO: 2491727 - protein, 19 aa, Entamoeba dispar
KRKLDEIIITPSPTHLNER

SEQ ID NO: 2491728 - protein, 18 aa, Entamoeba dispar
KRKLRLFKIDEVYKNLTR

SEQ ID NO: 2491729 - protein, 19 aa, Entamoeba dispar
KRKNTIVFNQRFDNKFSKY

SEQ ID NO: 2491730 - protein, 20 aa, Entamoeba dispar
KRKPNEPVLETKRKVEEDKV

SEQ ID NO: 2491731 - protein, 30 aa, Entamoeba dispar
KRKPSNLTLPKWFPTQPIPFDFKSNKIEDE

SEQ ID NO: 2491732 - protein, 24 aa, Entamoeba dispar
KRKQKVSVGSLVYIPSVTENKVKS

SEQ ID NO: 2491733 - protein, 21 aa, Entamoeba dispar
KRKTLNGRKGIKRKKKQIEEI

SEQ ID NO: 2491734 - protein, 17 aa, Entamoeba dispar
KRKTPLPTEEEINKRSL

SEQ ID NO: 2491735 - protein, 21 aa, Entamoeba dispar
KRKVHQYGFEINELINIEEKL

SEQ ID NO: 2491736 - protein, 25 aa, Entamoeba dispar
KRKVIEGTIPIIVRIPFKSEEKFTL

SEQ ID NO: 2491737 - protein, 18 aa, Entamoeba dispar
KRKYGAWIGGKLFASLSS

SEQ ID NO: 2491738 - protein, 19 aa, Entamoeba dispar
KRKYSLFIVDAQFTDSNDI

SEQ ID NO: 2491739 - protein, 26 aa, Entamoeba dispar
KRLAWTTLCRLVFLSIYQRSPVDFIN

SEQ ID NO: 2491740 - protein, 28 aa, Entamoeba dispar
KRLDCKIKELYFPRALALFCEYPLFNEM

SEQ ID NO: 2491741 - protein, 20 aa, Entamoeba dispar
KRLDRHSLSLTFRKKKNNVI

SEQ ID NO: 2491742 - protein, 18 aa, Entamoeba dispar
KRLDTEMSKRSIFEQQKI

SEQ ID NO: 2491743 - protein, 17 aa, Entamoeba dispar
KRLDVIILLVKKLITDQ

SEQ ID NO: 2491744 - protein, 17 aa, Entamoeba dispar
KRLEEMVVPEITKEEIM

SEQ ID NO: 2491745 - protein, 17 aa, Entamoeba dispar
KRLESIDLLDAIELNQI

SEQ ID NO: 2491746 - protein, 19 aa, Entamoeba dispar
KRLEVEAIVTVPNDFCKLA

SEQ ID NO: 2491747 - protein, 21 aa, Entamoeba dispar
KRLFEDSKEPIGIYQNYVQGQ

SEQ ID NO: 2491748 - protein, 19 aa, Entamoeba dispar
KRLFLMYLSCIKRVDEQGK

SEQ ID NO: 2491749 - protein, 26 aa, Entamoeba dispar
KRLFNYAFECNVEYPLNRDEWQNLYD

SEQ ID NO: 2491750 - protein, 17 aa, Entamoeba dispar
KRLHKANSITICETQNA

SEQ ID NO: 2491751 - protein, 19 aa, Entamoeba dispar
KRLIGRRFSDPAIQNDMKH

SEQ ID NO: 2491752 - protein, 17 aa, Entamoeba dispar
KRLIRKYQHSMKIDIDQ

SEQ ID NO: 2491753 - protein, 17 aa, Entamoeba dispar
KRLKLLIEKSSSFSESL

SEQ ID NO: 2491754 - protein, 19 aa, Entamoeba dispar
KRLKYRNGRFLPFLMAGNP

SEQ ID NO: 2491755 - protein, 22 aa, Entamoeba dispar
KRLLEQHISRWTLPEDEDTPAW

SEQ ID NO: 2491756 - protein, 21 aa, Entamoeba dispar
KRLLLKENPEAVVMDNEISVT

SEQ ID NO: 2491757 - protein, 25 aa, Entamoeba dispar
KRLLMKRLKTPPAVNIFANHTLDKS

SEQ ID NO: 2491758 - protein, 24 aa, Entamoeba dispar
KRLMKIIQRPVCHLNAIDVSGAKL

SEQ ID NO: 2491759 - protein, 19 aa, Entamoeba dispar
KRLNERIEQLQLNLHQKDL

SEQ ID NO: 2491760 - protein, 25 aa, Entamoeba dispar
KRLNLHIQKCPSCIDDLNTLKCLRS

SEQ ID NO: 2491761 - protein, 29 aa, Entamoeba dispar
KRLQIKYPKLKLGITLSKYSSNQYISLEG

SEQ ID NO: 2491762 - protein, 28 aa, Entamoeba dispar
KRLRIDETMPLLLKIMIESCWKQNPQDR

SEQ ID NO: 2491763 - protein, 18 aa, Entamoeba dispar
KRLSAPLVSIILSNSSKH

SEQ ID NO: 2491764 - protein, 18 aa, Entamoeba dispar
KRLSASRLVTSEFHKELF

SEQ ID NO: 2491765 - protein, 19 aa, Entamoeba dispar
KRLSDQFCKEFFNKNIKVF

SEQ ID NO: 2491766 - protein, 23 aa, Entamoeba dispar
KRLSEGYSPCSLINDIPHPITPP

SEQ ID NO: 2491767 - protein, 21 aa, Entamoeba dispar
KRLSSEFPLFSTYIALFRCGH

SEQ ID NO: 2491768 - protein, 22 aa, Entamoeba dispar
KRLYEIGILCFGKCITQEPSLF

SEQ ID NO: 2491769 - protein, 21 aa, Entamoeba dispar
KRLYYVMKEPSYLDWKLNVSG

SEQ ID NO: 2491770 - protein, 26 aa, Entamoeba dispar
KRMKDFTCTYATRFLGFKPSVAPMGQ

SEQ ID NO: 2491771 - protein, 22 aa, Entamoeba dispar
KRMKEAGIILVEGQKRINGVGV

SEQ ID NO: 2491772 - protein, 20 aa, Entamoeba dispar
KRMKFLLKEMLVFDQNKRPN

SEQ ID NO: 2491773 - protein, 18 aa, Entamoeba dispar
KRMPAIGEVTEFGHDNSN

SEQ ID NO: 2491774 - protein, 19 aa, Entamoeba dispar
KRMSMSYMNSLNKILPTRD

SEQ ID NO: 2491775 - protein, 22 aa, Entamoeba dispar
KRNFKASVPVLKLTDKQTLIVL

SEQ ID NO: 2491776 - protein, 20 aa, Entamoeba dispar
KRNGNVISLAIGKYNKAVVV

SEQ ID NO: 2491777 - protein, 18 aa, Entamoeba dispar
KRNILIMEFMIKLMRKEK

SEQ ID NO: 2491778 - protein, 20 aa, Entamoeba dispar
KRNIPVFLPPGGHAIYIETD

SEQ ID NO: 2491779 - protein, 24 aa, Entamoeba dispar
KRNNRLRMDPVFYQKYIKERNSVQ

SEQ ID NO: 2491780 - protein, 18 aa, Entamoeba dispar
KRPFVRQVECTWKSMNSG

SEQ ID NO: 2491781 - protein, 19 aa, Entamoeba dispar
KRPKKEMMPNEVKRTEYDD

SEQ ID NO: 2491782 - protein, 21 aa, Entamoeba dispar
KRPKLPNSLQEKRLKEKRTSI

SEQ ID NO: 2491783 - protein, 18 aa, Entamoeba dispar
KRPMTLRMQRMVLDLIEF

SEQ ID NO: 2491784 - protein, 22 aa, Entamoeba dispar
KRPNCLTFVRMFDGHVLDMEEM

SEQ ID NO: 2491785 - protein, 20 aa, Entamoeba dispar
KRPVDEKEVIVLMEECSPLK

SEQ ID NO: 2491786 - protein, 20 aa, Entamoeba dispar
KRQNGCFLVRLSSKTVEHPF

SEQ ID NO: 2491787 - protein, 17 aa, Entamoeba dispar
KRQSVYFTRHRPNQHET

SEQ ID NO: 2491788 - protein, 18 aa, Entamoeba dispar
KRQSVYFTRYKPKQKQGK

SEQ ID NO: 2491789 - protein, 19 aa, Entamoeba dispar
KRRFCLVPLTAEQAKFKLC

SEQ ID NO: 2491790 - protein, 18 aa, Entamoeba dispar
KRRFGLLASCGSLIHDMA

SEQ ID NO: 2491791 - protein, 18 aa, Entamoeba dispar
KRRFVSLASKMEMLHNLY

SEQ ID NO: 2491792 - protein, 20 aa, Entamoeba dispar
KRRLDAWLATDFADNHLRQT

SEQ ID NO: 2491793 - protein, 21 aa, Entamoeba dispar
KRRLEAWLNTDFVDNTLRQTS

SEQ ID NO: 2491794 - protein, 25 aa, Entamoeba dispar
KRRLREMKANFKAEKEVRLKKELAI

SEQ ID NO: 2491795 - protein, 18 aa, Entamoeba dispar
KRRNECYEEYKKVYREIV

SEQ ID NO: 2491796 - protein, 20 aa, Entamoeba dispar
KRRNECYEEYKKVYREIVEI

SEQ ID NO: 2491797 - protein, 18 aa, Entamoeba dispar
KRRNSLSAFTPVESTLEY

SEQ ID NO: 2491798 - protein, 19 aa, Entamoeba dispar
KRRRNVCEFLYSIETQEST

SEQ ID NO: 2491799 - protein, 28 aa, Entamoeba dispar
KRRSKKTECPFRINLNYRANTNTWNITK

SEQ ID NO: 2491800 - protein, 27 aa, Entamoeba dispar
KRRSKKTECPFRINLNYRTKTKTWNIT

SEQ ID NO: 2491801 - protein, 17 aa, Entamoeba dispar
KRRSSEISIKKEKKNIE

SEQ ID NO: 2491802 - protein, 19 aa, Entamoeba dispar
KRRTIEVLYSLCTKNNIRN

SEQ ID NO: 2491803 - protein, 24 aa, Entamoeba dispar
KRRTRGLESISFRSLDDVLESELD

SEQ ID NO: 2491804 - protein, 19 aa, Entamoeba dispar
KRRTVDWLGDRLVEKIDRD

SEQ ID NO: 2491805 - protein, 18 aa, Entamoeba dispar
KRRVNPFIRPKSILLKEN

SEQ ID NO: 2491806 - protein, 18 aa, Entamoeba dispar
KRRVQICYEKYLSNPRNE

SEQ ID NO: 2491807 - protein, 21 aa, Entamoeba dispar
KRRYCQYKPQMRRVADEFNYS

SEQ ID NO: 2491808 - protein, 19 aa, Entamoeba dispar
KRSEAMEAFNMGEVDKAIA

SEQ ID NO: 2491809 - protein, 24 aa, Entamoeba dispar
KRSFFKKSIKPMIVQQEHTEEKLQ

SEQ ID NO: 2491810 - protein, 20 aa, Entamoeba dispar
KRSGGICLHDSKRLIGETVK

SEQ ID NO: 2491811 - protein, 26 aa, Entamoeba dispar
KRSGVEGFVPRSFVKIQKFVKPYRKE

SEQ ID NO: 2491812 - protein, 21 aa, Entamoeba dispar
KRSKEVISLLGSYFHPMQFIK

SEQ ID NO: 2491813 - protein, 21 aa, Entamoeba dispar
KRSKFKQEIAAVIIDYMVPQM

SEQ ID NO: 2491814 - protein, 25 aa, Entamoeba dispar
KRSKKSVTISICFNTIATVGLTGSV

SEQ ID NO: 2491815 - protein, 20 aa, Entamoeba dispar
KRSNLASFIVRSENDKKKLR

SEQ ID NO: 2491816 - protein, 21 aa, Entamoeba dispar
KRSPGSYIKILLRSAISSSPY

SEQ ID NO: 2491817 - protein, 26 aa, Entamoeba dispar
KRSPREICKRCIYQFVHSTGKKIFTI

SEQ ID NO: 2491818 - protein, 19 aa, Entamoeba dispar
KRSSLKFPDTIVIEKSLKD

SEQ ID NO: 2491819 - protein, 18 aa, Entamoeba dispar
KRSTIGVEFATRSIQHEG

SEQ ID NO: 2491820 - protein, 23 aa, Entamoeba dispar
KRSWNNKITFIRTIQSCAIFYSF

SEQ ID NO: 2491821 - protein, 20 aa, Entamoeba dispar
KRSYEFYKSKLLQSNEYYEK

SEQ ID NO: 2491822 - protein, 25 aa, Entamoeba dispar
KRSYRELPLRYAEFGVLHRNELTGA

SEQ ID NO: 2491823 - protein, 17 aa, Entamoeba dispar
KRSYRKLLTIPFLQIQR

SEQ ID NO: 2491824 - protein, 17 aa, Entamoeba dispar
KRTEKKKDMKIKESPII

SEQ ID NO: 2491825 - protein, 21 aa, Entamoeba dispar
KRTELDGIYFFNLSDIKNSMI

SEQ ID NO: 2491826 - protein, 17 aa, Entamoeba dispar
KRTGEKFALKMVEKKKV

SEQ ID NO: 2491827 - protein, 19 aa, Entamoeba dispar
KRTGKPIYNAIVWQSKQSG

SEQ ID NO: 2491828 - protein, 25 aa, Entamoeba dispar
KRTKPRLRGIYNFVKFLEQADNVHR

SEQ ID NO: 2491829 - protein, 38 aa, Entamoeba dispar
KRTMLKTQYRMHPAIAEFSNKMFYSFKLENGVDGEDRF

SEQ ID NO: 2491830 - protein, 19 aa, Entamoeba dispar
KRTRDILNELGIRGNILNN

SEQ ID NO: 2491831 - protein, 19 aa, Entamoeba dispar
KRTTMSFRLTDAFNKKPQP

SEQ ID NO: 2491832 - protein, 19 aa, Entamoeba dispar
KRTTPSCVSFTPTGILVGE

SEQ ID NO: 2491833 - protein, 20 aa, Entamoeba dispar
KRTTTSISFEKNGNRFLSGG

SEQ ID NO: 2491834 - protein, 30 aa, Entamoeba dispar
KRTVELIKKIPCFWGRIMNVADLNYNNLGD

SEQ ID NO: 2491835 - protein, 17 aa, Entamoeba dispar
KRTVQLVLLIGGTCKMP

SEQ ID NO: 2491836 - protein, 20 aa, Entamoeba dispar
KRVDPFTAFLQGDQKIDTEF

SEQ ID NO: 2491837 - protein, 17 aa, Entamoeba dispar
KRVEGYLSINTLTGHVY

SEQ ID NO: 2491838 - protein, 22 aa, Entamoeba dispar
KRVGKKVLQPICLSDFNEDGFV

SEQ ID NO: 2491839 - protein, 26 aa, Entamoeba dispar
KRVIPELKEVIPLLKILGEGQQGEFK

SEQ ID NO: 2491840 - protein, 24 aa, Entamoeba dispar
KRVKEIAEGIGMKIKIYDPFITTE

SEQ ID NO: 2491841 - protein, 20 aa, Entamoeba dispar
KRVKTLVIVSETKMGKTEFV

SEQ ID NO: 2491842 - protein, 20 aa, Entamoeba dispar
KRVKWDYVVTMQERIDDVCA

SEQ ID NO: 2491843 - protein, 17 aa, Entamoeba dispar
KRVNTDIVFPKLENFKC

SEQ ID NO: 2491844 - protein, 22 aa, Entamoeba dispar
KRVPRLVSVLPNGPVYHPTVNA

SEQ ID NO: 2491845 - protein, 24 aa, Entamoeba dispar
KRVQELKNSIGRELTLKEQWYKAK

SEQ ID NO: 2491846 - protein, 17 aa, Entamoeba dispar
KRVTCVIKPIEDTKNNN

SEQ ID NO: 2491847 - protein, 24 aa, Entamoeba dispar
KRVTDKLVEYVWELSINQYGNYVI

SEQ ID NO: 2491848 - protein, 24 aa, Entamoeba dispar
KRVVFKSIEECIGTPLKEAEEIFI

SEQ ID NO: 2491849 - protein, 21 aa, Entamoeba dispar
KRVVLQFPEGLIAQGVGLQQR

SEQ ID NO: 2491850 - protein, 18 aa, Entamoeba dispar
KRVYKERVKANMGKLEKQ

SEQ ID NO: 2491851 - protein, 37 aa, Entamoeba dispar
KRVYWKEFSEAIVSLLMKGKCLSSYAVTATLRKNLRN

SEQ ID NO: 2491852 - protein, 37 aa, Entamoeba dispar
KRVYWKEFTEAIVSLLMKGKCLSSYAVTATLRKNLRN

SEQ ID NO: 2491853 - protein, 17 aa, Entamoeba dispar
KRWSLYRLMYNEETDLE

SEQ ID NO: 2491854 - protein, 20 aa, Entamoeba dispar
KRYAGLYFNRVDKWDHVDTK

SEQ ID NO: 2491855 - protein, 24 aa, Entamoeba dispar
KRYCEEEFFEFYPINTLTAKKTGE

SEQ ID NO: 2491856 - protein, 21 aa, Entamoeba dispar
KRYEELEAMTNLRSRLNQFAI

SEQ ID NO: 2491857 - protein, 18 aa, Entamoeba dispar
KRYFSFDNCHVGWNQYSI

SEQ ID NO: 2491858 - protein, 25 aa, Entamoeba dispar
KRYGFKKRRIRGIDYFINEEFDPND

SEQ ID NO: 2491859 - protein, 17 aa, Entamoeba dispar
KRYGMMILDEVHSSVAK

SEQ ID NO: 2491860 - protein, 19 aa, Entamoeba dispar
KRYGSYGSIRSWYGNYKLV

SEQ ID NO: 2491861 - protein, 21 aa, Entamoeba dispar
KRYGYEIPRDPAIKSIGKDCF

SEQ ID NO: 2491862 - protein, 20 aa, Entamoeba dispar
KRYIEQVVSLLPQFQALKIQ

SEQ ID NO: 2491863 - protein, 20 aa, Entamoeba dispar
KRYINGRFLPDKAIDLVDEA

SEQ ID NO: 2491864 - protein, 21 aa, Entamoeba dispar
KRYIRLLCIVYRLMDVDADGF

SEQ ID NO: 2491865 - protein, 18 aa, Entamoeba dispar
KRYKRYYNSAGRYVSRQY

SEQ ID NO: 2491866 - protein, 17 aa, Entamoeba dispar
KRYLALIWAESMKELKI

SEQ ID NO: 2491867 - protein, 22 aa, Entamoeba dispar
KRYLLIFNKCIEKLLEIPEFMK

SEQ ID NO: 2491868 - protein, 21 aa, Entamoeba dispar
KRYLYCGNVVKEFITTENTYC

SEQ ID NO: 2491869 - protein, 18 aa, Entamoeba dispar
KRYNRFIIRISIIELGVC

SEQ ID NO: 2491870 - protein, 21 aa, Entamoeba dispar
KRYNVSINIVLKWFDKLEMTI

SEQ ID NO: 2491871 - protein, 17 aa, Entamoeba dispar
KRYSFFRYKTIGFSTQK

SEQ ID NO: 2491872 - protein, 25 aa, Entamoeba dispar
KRYSKPRYVKIVYKNNGPQYSNKRY

SEQ ID NO: 2491873 - protein, 17 aa, Entamoeba dispar
KRYTNCQNKFAIGSEAI

SEQ ID NO: 2491874 - protein, 24 aa, Entamoeba dispar
KRYWTKEECLAFEKIIKFLNINCG

SEQ ID NO: 2491875 - protein, 21 aa, Entamoeba dispar
KRYYEYYRNPEILAFIRKIEI

SEQ ID NO: 2491876 - protein, 19 aa, Entamoeba dispar
KSAAAAVRIIRKCPNYSDI

SEQ ID NO: 2491877 - protein, 23 aa, Entamoeba dispar
KSAENEIKKCLNREENLKIEIKP

SEQ ID NO: 2491878 - protein, 23 aa, Entamoeba dispar
KSAETFNIFCWYGNNSSVGKKGV

SEQ ID NO: 2491879 - protein, 19 aa, Entamoeba dispar
KSAGNLLNLIRRIRPDTME

SEQ ID NO: 2491880 - protein, 26 aa, Entamoeba dispar
KSAKNGIGIVRLMGRDAGFIALYASL

SEQ ID NO: 2491881 - protein, 22 aa, Entamoeba dispar
KSALDFLNLPISITRGVLGNLK

SEQ ID NO: 2491882 - protein, 17 aa, Entamoeba dispar
KSAMLPYVEQLLTQLFN

SEQ ID NO: 2491883 - protein, 19 aa, Entamoeba dispar
KSCFYKCGCEDELKKNKKI

SEQ ID NO: 2491884 - protein, 22 aa, Entamoeba dispar
KSCQIALWDVCCQCERKGSLDS

SEQ ID NO: 2491885 - protein, 23 aa, Entamoeba dispar
KSCSGKTTWIRKNKCEEIEEKYK

SEQ ID NO: 2491886 - protein, 17 aa, Entamoeba dispar
KSCYKIHNIVDPTPGFR

SEQ ID NO: 2491887 - protein, 20 aa, Entamoeba dispar
KSDIETGKFIAMQFTSQKEI

SEQ ID NO: 2491888 - protein, 18 aa, Entamoeba dispar
KSDPFLLSSINIIIQLLQ

SEQ ID NO: 2491889 - protein, 18 aa, Entamoeba dispar
KSEDFFKNFKDFYESYEK

SEQ ID NO: 2491890 - protein, 23 aa, Entamoeba dispar
KSEELKKRINVLNKMAEMIGLLD

SEQ ID NO: 2491891 - protein, 17 aa, Entamoeba dispar
KSEIEWFNQIIERNVHL

SEQ ID NO: 2491892 - protein, 18 aa, Entamoeba dispar
KSEIKTVAIHAGLENSII

SEQ ID NO: 2491893 - protein, 28 aa, Entamoeba dispar
KSEILKPLPSLIGLTGMITLFYQYVSKK

SEQ ID NO: 2491894 - protein, 24 aa, Entamoeba dispar
KSELQIRISSLIGYENVLPMREMH

SEQ ID NO: 2491895 - protein, 23 aa, Entamoeba dispar
KSELRCISLIKLINFLSTNLKDK

SEQ ID NO: 2491896 - protein, 32 aa, Entamoeba dispar
KSEMRRYICDVLSLDPGRFISIAQHLPILRTM

SEQ ID NO: 2491897 - protein, 25 aa, Entamoeba dispar
KSEMRRYICDVLSLDPGRFSELFRN

SEQ ID NO: 2491898 - protein, 18 aa, Entamoeba dispar
KSFCTPKMIEARNMPLME

SEQ ID NO: 2491899 - protein, 19 aa, Entamoeba dispar
KSFEARKQLYSKLNQMENI

SEQ ID NO: 2491900 - protein, 25 aa, Entamoeba dispar
KSFEDTEGWLFFGMSHSDPKVQFII

SEQ ID NO: 2491901 - protein, 22 aa, Entamoeba dispar
KSFEPKKVKFLIIDEADAILNT

SEQ ID NO: 2491902 - protein, 17 aa, Entamoeba dispar
KSFFLMNAMKEAVKYVD

SEQ ID NO: 2491903 - protein, 19 aa, Entamoeba dispar
KSFFQKRYFQFLLSNPSQS

SEQ ID NO: 2491904 - protein, 25 aa, Entamoeba dispar
KSFGKSCFYGCGCIEKLKQNKTISI

SEQ ID NO: 2491905 - protein, 23 aa, Entamoeba dispar
KSFGRGCFYGCYSLKSINIPSSI

SEQ ID NO: 2491906 - protein, 20 aa, Entamoeba dispar
KSFIKESGIELFPPCMYSIY

SEQ ID NO: 2491907 - protein, 18 aa, Entamoeba dispar
KSFIPSLQQWTGMQKYDV

SEQ ID NO: 2491908 - protein, 18 aa, Entamoeba dispar
KSFLKGKSVEELKPGNYQ

SEQ ID NO: 2491909 - protein, 23 aa, Entamoeba dispar
KSFLKLLEVILIIGNYMNKASKK

SEQ ID NO: 2491910 - protein, 25 aa, Entamoeba dispar
KSFLNIVTVMWDWPKESIQRLNNVL

SEQ ID NO: 2491911 - protein, 18 aa, Entamoeba dispar
KSFQECKLNEDILDGING

SEQ ID NO: 2491912 - protein, 28 aa, Entamoeba dispar
KSFSGGVPSFYSELAKWILSFNPLQQYK

SEQ ID NO: 2491913 - protein, 28 aa, Entamoeba dispar
KSFSSFAIGMKVMFPKTLGKISKRGGNQ

SEQ ID NO: 2491914 - protein, 27 aa, Entamoeba dispar
KSGFLPQVLICLLNWLTSVSDDDVEDW

SEQ ID NO: 2491915 - protein, 23 aa, Entamoeba dispar
KSGHWYLFIVCCQLYKKSEEKSK

SEQ ID NO: 2491916 - protein, 20 aa, Entamoeba dispar
KSGIPSGGFAPSAPSISASL

SEQ ID NO: 2491917 - protein, 24 aa, Entamoeba dispar
KSGKELFNNIGYYKLKDGIITSIS

SEQ ID NO: 2491918 - protein, 25 aa, Entamoeba dispar
KSGKIPRALFHRVYKFVPLNKRKKY

SEQ ID NO: 2491919 - protein, 28 aa, Entamoeba dispar
KSGKRQNKAWKRLVTKATFVGENFTRKP

SEQ ID NO: 2491920 - protein, 27 aa, Entamoeba dispar
KSGLVKSALPVLCMNQLVNGGLIALEA

SEQ ID NO: 2491921 - protein, 19 aa, Entamoeba dispar
KSGQLLACKKIEIGESRIN

SEQ ID NO: 2491922 - protein, 23 aa, Entamoeba dispar
KSGTHAGYGFVEFVDSTTARFAK

SEQ ID NO: 2491923 - protein, 18 aa, Entamoeba dispar
KSGWKVLIQCVRFAAEYE

SEQ ID NO: 2491924 - protein, 23 aa, Entamoeba dispar
KSGWRVPNPIYRCIEYLEHNNGI

SEQ ID NO: 2491925 - protein, 19 aa, Entamoeba dispar
KSGYFMVPSISELRELEED

SEQ ID NO: 2491926 - protein, 29 aa, Entamoeba dispar
KSHIAGIFIKDKIKVIGKNILKEDSFPFS

SEQ ID NO: 2491927 - protein, 24 aa, Entamoeba dispar
KSIAFPCISTGIFGYSNEKACPVV

SEQ ID NO: 2491928 - protein, 26 aa, Entamoeba dispar
KSICLAKGRCKGGLNDTYQVIRKLLT

SEQ ID NO: 2491929 - protein, 18 aa, Entamoeba dispar
KSICTALNSLVFVPPTSL

SEQ ID NO: 2491930 - protein, 19 aa, Entamoeba dispar
KSIEDCLKEGLIEYLDVNE

SEQ ID NO: 2491931 - protein, 18 aa, Entamoeba dispar
KSIEELFIILSPLLNKYY

SEQ ID NO: 2491932 - protein, 26 aa, Entamoeba dispar
KSIEKELPVVISFSIQRISDVFKEES

SEQ ID NO: 2491933 - protein, 19 aa, Entamoeba dispar
KSIEVFSFLMKLYGNNISF

SEQ ID NO: 2491934 - protein, 20 aa, Entamoeba dispar
KSIFWKEMEQDLPLNNLVTT

SEQ ID NO: 2491935 - protein, 30 aa, Entamoeba dispar
KSIGCASVKVFNAWGVLKRGVQLVHLEEGR

SEQ ID NO: 2491936 - protein, 23 aa, Entamoeba dispar
KSIIFRELCDCFDQFKIMDVHIC

SEQ ID NO: 2491937 - protein, 25 aa, Entamoeba dispar
KSIKARMFLGKCVIDKDLQIHISDK

SEQ ID NO: 2491938 - protein, 28 aa, Entamoeba dispar
KSIKDLIPKAVIHFLVFKTRDSLQRELI

SEQ ID NO: 2491939 - protein, 23 aa, Entamoeba dispar
KSIKRKRKPLLFANRLNNEEVND

SEQ ID NO: 2491940 - protein, 17 aa, Entamoeba dispar
KSIKVLYFVITNTIDET

SEQ ID NO: 2491941 - protein, 27 aa, Entamoeba dispar
KSILNAYKFDGRSCVDLKDKWRNIENS

SEQ ID NO: 2491942 - protein, 19 aa, Entamoeba dispar
KSIMEGINFEEFNQQWIYK

SEQ ID NO: 2491943 - protein, 21 aa, Entamoeba dispar
KSINIPSLITLFGRGCFYKCG

SEQ ID NO: 2491944 - protein, 21 aa, Entamoeba dispar
KSINMSLMLLVKIYISKYSIT

SEQ ID NO: 2491945 - protein, 21 aa, Entamoeba dispar
KSIPLICEFMSSLKHLDLFPT

SEQ ID NO: 2491946 - protein, 19 aa, Entamoeba dispar
KSIPLKASIHVDRPTEIRI

SEQ ID NO: 2491947 - protein, 20 aa, Entamoeba dispar
KSIQAISFYLITPIQRIPRY

SEQ ID NO: 2491948 - protein, 20 aa, Entamoeba dispar
KSIQETIRFIESFKGYHFVK

SEQ ID NO: 2491949 - protein, 17 aa, Entamoeba dispar
KSIRFIPLPGSALTSGT

SEQ ID NO: 2491950 - protein, 25 aa, Entamoeba dispar
KSIRKFTVMCLNTFGTLYKDGFCNQ

SEQ ID NO: 2491951 - protein, 25 aa, Entamoeba dispar
KSISEVKCVNALFTYLITNISDFID

SEQ ID NO: 2491952 - protein, 17 aa, Entamoeba dispar
KSISSKIGTFISTFTSS

SEQ ID NO: 2491953 - protein, 21 aa, Entamoeba dispar
KSITLSPVFDESVGVPIRKAR

SEQ ID NO: 2491954 - protein, 25 aa, Entamoeba dispar
KSIYCKKRGSSILIEKILIDKDIVL

SEQ ID NO: 2491955 - protein, 19 aa, Entamoeba dispar
KSKAVSVMRRVLEKLTGKD

SEQ ID NO: 2491956 - protein, 25 aa, Entamoeba dispar
KSKCLSFKSISRIVCRQFPQYENEI

SEQ ID NO: 2491957 - protein, 17 aa, Entamoeba dispar
KSKEILLKRIQGGTSTL

SEQ ID NO: 2491958 - protein, 29 aa, Entamoeba dispar
KSKEPIVVSVGWRRYQTIATFSMEDLKGK

SEQ ID NO: 2491959 - protein, 28 aa, Entamoeba dispar
KSKETREAMALGIYGIVKIHIPKTQNAT

SEQ ID NO: 2491960 - protein, 20 aa, Entamoeba dispar
KSKEVFFNEIAPFQMKKYVI

SEQ ID NO: 2491961 - protein, 19 aa, Entamoeba dispar
KSKFERPWNAPKYLKQKKE

SEQ ID NO: 2491962 - protein, 20 aa, Entamoeba dispar
KSKFKRSAKELLYEKKKINS

SEQ ID NO: 2491963 - protein, 19 aa, Entamoeba dispar
KSKIFARDYIIRFYGGKEH

SEQ ID NO: 2491964 - protein, 19 aa, Entamoeba dispar
KSKKPGIVTEKAMRILQTW

SEQ ID NO: 2491965 - protein, 17 aa, Entamoeba dispar
KSKKTEELFSFGDAFNF

SEQ ID NO: 2491966 - protein, 17 aa, Entamoeba dispar
KSKLMSDLSSGSDGLSK

SEQ ID NO: 2491967 - protein, 17 aa, Entamoeba dispar
KSKLYLFDCRYDYEYEG

SEQ ID NO: 2491968 - protein, 20 aa, Entamoeba dispar
KSKQPRLSANLTNEDVPDRS

SEQ ID NO: 2491969 - protein, 20 aa, Entamoeba dispar
KSKRSIIHIHYTGWPDFGVP

SEQ ID NO: 2491970 - protein, 24 aa, Entamoeba dispar
KSKSAGWRLDYFFISKDLVDSVTQ

SEQ ID NO: 2491971 - protein, 21 aa, Entamoeba dispar
KSKSCLPYQFHDLMKSKGSPI

SEQ ID NO: 2491972 - protein, 21 aa, Entamoeba dispar
KSKVHPINFTPPIAKLEVNPK

SEQ ID NO: 2491973 - protein, 34 aa, Entamoeba dispar
KSKWTCSEIFRLLPGMCQSLLLRIIFLKERITIH

SEQ ID NO: 2491974 - protein, 28 aa, Entamoeba dispar
KSLAMPDAHSGYGFSIGGVAAMRLDDPN

SEQ ID NO: 2491975 - protein, 21 aa, Entamoeba dispar
KSLDAEWSYNLYVYVVLEELS

SEQ ID NO: 2491976 - protein, 19 aa, Entamoeba dispar
KSLDRREVGTFCCEETMKM

SEQ ID NO: 2491977 - protein, 22 aa, Entamoeba dispar
KSLFLKRDLYCLQMQNHDYNGA

SEQ ID NO: 2491978 - protein, 22 aa, Entamoeba dispar
KSLFWKPQFKKSPKLSERSSRS

SEQ ID NO: 2491979 - protein, 25 aa, Entamoeba dispar
KSLFYHNFINLCSHLLLQIPNASTM

SEQ ID NO: 2491980 - protein, 19 aa, Entamoeba dispar
KSLGDQCFKHCTSLKSINI

SEQ ID NO: 2491981 - protein, 19 aa, Entamoeba dispar
KSLGDQCFYTCKSLKSINI

SEQ ID NO: 2491982 - protein, 19 aa, Entamoeba dispar
KSLGQSGLRVKPTIIPTKD

SEQ ID NO: 2491983 - protein, 23 aa, Entamoeba dispar
KSLGYECFERCYSLTSINIPSSV

SEQ ID NO: 2491984 - protein, 23 aa, Entamoeba dispar
KSLGYECFYECSLLTTINIPSSV

SEQ ID NO: 2491985 - protein, 17 aa, Entamoeba dispar
KSLGYGFIEFETKEGCE

SEQ ID NO: 2491986 - protein, 20 aa, Entamoeba dispar
KSLGYKCFDECYSLTSINIP

SEQ ID NO: 2491987 - protein, 20 aa, Entamoeba dispar
KSLHGHSHFISDLVLSNDGQ

SEQ ID NO: 2491988 - protein, 19 aa, Entamoeba dispar
KSLISLKFAKTVNKIGVEC

SEQ ID NO: 2491989 - protein, 17 aa, Entamoeba dispar
KSLKQSREVLKKREQIK

SEQ ID NO: 2491990 - protein, 20 aa, Entamoeba dispar
KSLKSINIPSSISFIGDDCF

SEQ ID NO: 2491991 - protein, 19 aa, Entamoeba dispar
KSLKSVIIPTSINRIEDEC

SEQ ID NO: 2491992 - protein, 23 aa, Entamoeba dispar
KSLLITNCESIDFSVNRIKGLLE

SEQ ID NO: 2491993 - protein, 31 aa, Entamoeba dispar
KSLLKTVVDPGCLKAGFEVVSMIYKDLPEDG

SEQ ID NO: 2491994 - protein, 23 aa, Entamoeba dispar
KSLNRCCFIIFTGNHFDVICLSR

SEQ ID NO: 2491995 - protein, 19 aa, Entamoeba dispar
KSLPKGLAKCVDMNYIELT

SEQ ID NO: 2491996 - protein, 30 aa, Entamoeba dispar
KSLQRKSKSSLKRKSLSLMKKSSISLKEQN

SEQ ID NO: 2491997 - protein, 22 aa, Entamoeba dispar
KSLRRKQFKNFNLSYNININEN

SEQ ID NO: 2491998 - protein, 21 aa, Entamoeba dispar
KSLRRSCIKMYYEIDPHLNQF

SEQ ID NO: 2491999 - protein, 17 aa, Entamoeba dispar
KSLSEIEQMIVLLNQQI

SEQ ID NO: 2492000 - protein, 26 aa, Entamoeba dispar
KSLYLHAYQSYVWNQVVSKRFEKYGN

SEQ ID NO: 2492001 - protein, 19 aa, Entamoeba dispar
KSLYLYCSSITIFNKNDIQ

SEQ ID NO: 2492002 - protein, 21 aa, Entamoeba dispar
KSLYNKICQDLDIITKELNSA

SEQ ID NO: 2492003 - protein, 19 aa, Entamoeba dispar
KSMKGEVISLGHTKDGYWI

SEQ ID NO: 2492004 - protein, 18 aa, Entamoeba dispar
KSMLQKYDCEEDFNENEN

SEQ ID NO: 2492005 - protein, 19 aa, Entamoeba dispar
KSMLTDTVKIMGRNIYVDS

SEQ ID NO: 2492006 - protein, 30 aa, Entamoeba dispar
KSMWQELQGEFKISTIAKIDLENQIESLKS

SEQ ID NO: 2492007 - protein, 21 aa, Entamoeba dispar
KSNECKIEIYVDGIFLGSVVG

SEQ ID NO: 2492008 - protein, 21 aa, Entamoeba dispar
KSNEEMMLWIEGKKELSIPEQ

SEQ ID NO: 2492009 - protein, 26 aa, Entamoeba dispar
KSNEMFELWEGLWVMIQDTCIETSVK

SEQ ID NO: 2492010 - protein, 20 aa, Entamoeba dispar
KSNESCVLLLRNCIDENGLS

SEQ ID NO: 2492011 - protein, 18 aa, Entamoeba dispar
KSNFTWSGIEEIKDEEEE

SEQ ID NO: 2492012 - protein, 21 aa, Entamoeba dispar
KSNGTILSFHHTRFDNEQKRK

SEQ ID NO: 2492013 - protein, 21 aa, Entamoeba dispar
KSNICKPRISSVPVTQKDFDV

SEQ ID NO: 2492014 - protein, 26 aa, Entamoeba dispar
KSNIEMMNTVLFEWVEVLQQILDTPV

SEQ ID NO: 2492015 - protein, 17 aa, Entamoeba dispar
KSNIKIIYNPTVSPANE

SEQ ID NO: 2492016 - protein, 25 aa, Entamoeba dispar
KSNILDAICFVMGIQNLSLVRVQTL

SEQ ID NO: 2492017 - protein, 18 aa, Entamoeba dispar
KSNIVKTIMKLFRKTIIS

SEQ ID NO: 2492018 - protein, 20 aa, Entamoeba dispar
KSNLRLNDKTAFRMIEMYWT

SEQ ID NO: 2492019 - protein, 23 aa, Entamoeba dispar
KSNPFCLSQTLLVSKFIQKAMAQ

SEQ ID NO: 2492020 - protein, 27 aa, Entamoeba dispar
KSNPRKMVKMWAEKEMRNLKRLNTAGI

SEQ ID NO: 2492021 - protein, 20 aa, Entamoeba dispar
KSNRKLFAFTKEFDNLLKES

SEQ ID NO: 2492022 - protein, 25 aa, Entamoeba dispar
KSNVIDGLLFVFGRRAKQIRQQKVV

SEQ ID NO: 2492023 - protein, 22 aa, Entamoeba dispar
KSNYKNFLWKILKTLFDDYVDF

SEQ ID NO: 2492024 - protein, 25 aa, Entamoeba dispar
KSNYVFCVPYAFAIVGSGKSAVSPK

SEQ ID NO: 2492025 - protein, 20 aa, Entamoeba dispar
KSPEIKRIITNEFMYVNTLT

SEQ ID NO: 2492026 - protein, 19 aa, Entamoeba dispar
KSPELDRNFDILKEKMKYK

SEQ ID NO: 2492027 - protein, 17 aa, Entamoeba dispar
KSPEQFLKSSLFDNNPS

SEQ ID NO: 2492028 - protein, 33 aa, Entamoeba dispar
KSPFAKRRLLELSKRIGPYILRRTKKDVFGDDR

SEQ ID NO: 2492029 - protein, 18 aa, Entamoeba dispar
KSPISLSLLTRGQSEINL

SEQ ID NO: 2492030 - protein, 26 aa, Entamoeba dispar
KSPIWPEEFLQPLVSCMDSQNKMSLI

SEQ ID NO: 2492031 - protein, 20 aa, Entamoeba dispar
KSPSVFSYFISVAKSCLTIG

SEQ ID NO: 2492032 - protein, 24 aa, Entamoeba dispar
KSPVGSPRLSGPVQQKIDEKDNLI

SEQ ID NO: 2492033 - protein, 20 aa, Entamoeba dispar
KSQEYYKIHHCYFDCHIFNV

SEQ ID NO: 2492034 - protein, 17 aa, Entamoeba dispar
KSQILFIPIFYKTMTDF

SEQ ID NO: 2492035 - protein, 21 aa, Entamoeba dispar
KSQKKLTAFFNVSKKSETNSQ

SEQ ID NO: 2492036 - protein, 19 aa, Entamoeba dispar
KSQLLRYVMSIAPLAVSTN

SEQ ID NO: 2492037 - protein, 18 aa, Entamoeba dispar
KSQLRSNPNRVIVKQSTL

SEQ ID NO: 2492038 - protein, 19 aa, Entamoeba dispar
KSQQIFPQLIHLKRLHLYS

SEQ ID NO: 2492039 - protein, 23 aa, Entamoeba dispar
KSQYKMYVEFFIKNIDFKEPESR

SEQ ID NO: 2492040 - protein, 22 aa, Entamoeba dispar
KSRCIQCFIQPLSDFLVGTESS

SEQ ID NO: 2492041 - protein, 19 aa, Entamoeba dispar
KSRCRLEAESLGATITNDY

SEQ ID NO: 2492042 - protein, 19 aa, Entamoeba dispar
KSREQIIEFTMQINEKGVM

SEQ ID NO: 2492043 - protein, 27 aa, Entamoeba dispar
KSRQYLQCFCVSMIISIKDELMEKEFD

SEQ ID NO: 2492044 - protein, 20 aa, Entamoeba dispar
KSSCFESCTSLLKIDLPACL

SEQ ID NO: 2492045 - protein, 17 aa, Entamoeba dispar
KSSEECNYCDNKNNSLS

SEQ ID NO: 2492046 - protein, 20 aa, Entamoeba dispar
KSSEFKFDELLIYLQSLQGF

SEQ ID NO: 2492047 - protein, 24 aa, Entamoeba dispar
KSSEGLKNLLGKCLKKEAKKRCKI

SEQ ID NO: 2492048 - protein, 20 aa, Entamoeba dispar
KSSEVILDLQGMQFDDEGIN

SEQ ID NO: 2492049 - protein, 24 aa, Entamoeba dispar
KSSEWRERRISCLLLGEMAKQTTH

SEQ ID NO: 2492050 - protein, 18 aa, Entamoeba dispar
KSSGYIFVYSRINKKENE

SEQ ID NO: 2492051 - protein, 19 aa, Entamoeba dispar
KSSIDISKCHLKKLVLNNY

SEQ ID NO: 2492052 - protein, 20 aa, Entamoeba dispar
KSSIVSSCWENDNIFISFED

SEQ ID NO: 2492053 - protein, 20 aa, Entamoeba dispar
KSSLLNWLVGKKVTSVSSHP

SEQ ID NO: 2492054 - protein, 21 aa, Entamoeba dispar
KSSRKKVSFFIGKKTSKPTEP

SEQ ID NO: 2492055 - protein, 25 aa, Entamoeba dispar
KSSSRRRGRSYSRHRSSHRREHSSR

SEQ ID NO: 2492056 - protein, 24 aa, Entamoeba dispar
KSSSRRRGRSYSRHRSSHRRGHSS

SEQ ID NO: 2492057 - protein, 20 aa, Entamoeba dispar
KSSSWEIYRSIMNQIDPVEC

SEQ ID NO: 2492058 - protein, 21 aa, Entamoeba dispar
KSSVEDLQWSPNEADVFLSCS

SEQ ID NO: 2492059 - protein, 23 aa, Entamoeba dispar
KSTACTILLRGGSKDVLNEVERN

SEQ ID NO: 2492060 - protein, 17 aa, Entamoeba dispar
KSTALTACIVAKDDTRW

SEQ ID NO: 2492061 - protein, 20 aa, Entamoeba dispar
KSTDCLCSWIQYSTISVDYY

SEQ ID NO: 2492062 - protein, 19 aa, Entamoeba dispar
KSTDIIFIYMYKMFTIKHI

SEQ ID NO: 2492063 - protein, 21 aa, Entamoeba dispar
KSTELKALMNRNISSVDIKYG

SEQ ID NO: 2492064 - protein, 20 aa, Entamoeba dispar
KSTGEWSLFTLENELLQTDC

SEQ ID NO: 2492065 - protein, 19 aa, Entamoeba dispar
KSTHSVFITSFPVAPTSCF

SEQ ID NO: 2492066 - protein, 18 aa, Entamoeba dispar
KSTKSVTIAICFNTVATV

SEQ ID NO: 2492067 - protein, 26 aa, Entamoeba dispar
KSTLLRTVCLAVIMAQMGMRCTGEEI

SEQ ID NO: 2492068 - protein, 19 aa, Entamoeba dispar
KSTLPAKEYHYLFISLNEK

SEQ ID NO: 2492069 - protein, 20 aa, Entamoeba dispar
KSTNKKLSFEDIILNGNIPS

SEQ ID NO: 2492070 - protein, 17 aa, Entamoeba dispar
KSTRDLLTFEAEQPISK

SEQ ID NO: 2492071 - protein, 20 aa, Entamoeba dispar
KSTRISLCNHIIGITDDEKV

SEQ ID NO: 2492072 - protein, 21 aa, Entamoeba dispar
KSTRVKQVFMLLKSLPEENYT

SEQ ID NO: 2492073 - protein, 23 aa, Entamoeba dispar
KSTSLPRLNIRSSTVVDRPKNIG

SEQ ID NO: 2492074 - protein, 26 aa, Entamoeba dispar
KSTTDPCRFMGCGPSSSTSSGYRKGG

SEQ ID NO: 2492075 - protein, 23 aa, Entamoeba dispar
KSVHFLKTYCSYVNSTDAINEHE

SEQ ID NO: 2492076 - protein, 22 aa, Entamoeba dispar
KSVLIVLDCRAMANAVANRLSG

SEQ ID NO: 2492077 - protein, 26 aa, Entamoeba dispar
KSVPCAATEYFSLRFKEMGLRTYQPI

SEQ ID NO: 2492078 - protein, 21 aa, Entamoeba dispar
KSVYQRFGLIPLQTLFEEATN

SEQ ID NO: 2492079 - protein, 18 aa, Entamoeba dispar
KSYKDMNCVNKFNETMLK

SEQ ID NO: 2492080 - protein, 17 aa, Entamoeba dispar
KSYKNYFICSAKTGDGC

SEQ ID NO: 2492081 - protein, 18 aa, Entamoeba dispar
KSYLCSKDSYGITKKEYS

SEQ ID NO: 2492082 - protein, 20 aa, Entamoeba dispar
KSYLEGMNWVFNYYCGNTFS

SEQ ID NO: 2492083 - protein, 17 aa, Entamoeba dispar
KSYLRAFQYSDKNAIII

SEQ ID NO: 2492084 - protein, 19 aa, Entamoeba dispar
KSYVKTQSGWYCCDDTNVY

SEQ ID NO: 2492085 - protein, 24 aa, Entamoeba dispar
KSYVSSMETCIKGYYDPLIQSGHS

SEQ ID NO: 2492086 - protein, 21 aa, Entamoeba dispar
KTAAFALPIIHHLSTDPYTGF

SEQ ID NO: 2492087 - protein, 18 aa, Entamoeba dispar
KTAAFLFPIISDILKNPP

SEQ ID NO: 2492088 - protein, 18 aa, Entamoeba dispar
KTATFSIGILQNVESNKR

SEQ ID NO: 2492089 - protein, 17 aa, Entamoeba dispar
KTAWKLGNPEEIIAAIE

SEQ ID NO: 2492090 - protein, 20 aa, Entamoeba dispar
KTCMLIRLSQNFFDTQHNPT

SEQ ID NO: 2492091 - protein, 18 aa, Entamoeba dispar
KTCMNNCDVQLFVPLIPL

SEQ ID NO: 2492092 - protein, 19 aa, Entamoeba dispar
KTCQAEMWIGKGSIELSQF

SEQ ID NO: 2492093 - protein, 25 aa, Entamoeba dispar
KTCSLYYKMVMSIGVEEEEMDFSEQ

SEQ ID NO: 2492094 - protein, 27 aa, Entamoeba dispar
KTCTVRKFIVREDFNVFLFTDNSLQVF

SEQ ID NO: 2492095 - protein, 26 aa, Entamoeba dispar
KTDPVRVCRYLKMIIEGVRYLHMNFL

SEQ ID NO: 2492096 - protein, 23 aa, Entamoeba dispar
KTDRKALDEYLRKVFTTYTTVLT

SEQ ID NO: 2492097 - protein, 21 aa, Entamoeba dispar
KTDRSLYRFIITNTLEATKAV

SEQ ID NO: 2492098 - protein, 19 aa, Entamoeba dispar
KTEEGRISYVRGFVDYDWD

SEQ ID NO: 2492099 - protein, 19 aa, Entamoeba dispar
KTEFYYSSYCAHLVLQKIM

SEQ ID NO: 2492100 - protein, 22 aa, Entamoeba dispar
KTEGKKALAVEAFARALRQLPM

SEQ ID NO: 2492101 - protein, 21 aa, Entamoeba dispar
KTEKCSNCDKDIILGTFVYTC

SEQ ID NO: 2492102 - protein, 21 aa, Entamoeba dispar
KTEKGLTPWDYCQFSDKICID

SEQ ID NO: 2492103 - protein, 23 aa, Entamoeba dispar
KTEKLEELCFIFTSLSLLSEQAE

SEQ ID NO: 2492104 - protein, 24 aa, Entamoeba dispar
KTEKVFWVCRECGYIFESTQPPKV

SEQ ID NO: 2492105 - protein, 20 aa, Entamoeba dispar
KTELCRSFVETGTCRYGNKC

SEQ ID NO: 2492106 - protein, 17 aa, Entamoeba dispar
KTELPIFIQHLIAATFS

SEQ ID NO: 2492107 - protein, 22 aa, Entamoeba dispar
KTELRLTALESIIKLVRNTEVA

SEQ ID NO: 2492108 - protein, 22 aa, Entamoeba dispar
KTEMAHYARDCWDAEIRLSYGW

SEQ ID NO: 2492109 - protein, 22 aa, Entamoeba dispar
KTEMDKMADIEETWRKMKSQTE

SEQ ID NO: 2492110 - protein, 26 aa, Entamoeba dispar
KTENWNKKCCDICKKVQIEITPEAII

SEQ ID NO: 2492111 - protein, 17 aa, Entamoeba dispar
KTEQYILELERSLSQID

SEQ ID NO: 2492112 - protein, 19 aa, Entamoeba dispar
KTERCRRESPTHSVKNSPR

SEQ ID NO: 2492113 - protein, 26 aa, Entamoeba dispar
KTERIICFTEKWFVERDASSYTVKYA

SEQ ID NO: 2492114 - protein, 26 aa, Entamoeba dispar
KTEWGYKSLRKLCRYYGKANNEEEFK

SEQ ID NO: 2492115 - protein, 26 aa, Entamoeba dispar
KTEYKRIRENGGFVIGNRTNGGLAVS

SEQ ID NO: 2492116 - protein, 31 aa, Entamoeba dispar
KTFCINCTNLPNIILSFNFQQLLTYIGFELP

SEQ ID NO: 2492117 - protein, 29 aa, Entamoeba dispar
KTFEGLRSPCRIVVVLLFHYLNKMYELNY

SEQ ID NO: 2492118 - protein, 24 aa, Entamoeba dispar
KTFILRDDIQLIFFGFDKKGSNIN

SEQ ID NO: 2492119 - protein, 17 aa, Entamoeba dispar
KTFKAQVNIVRKVIEIL

SEQ ID NO: 2492120 - protein, 18 aa, Entamoeba dispar
KTFKELRNSKTISIKIEP

SEQ ID NO: 2492121 - protein, 17 aa, Entamoeba dispar
KTFLYNKLFRYLWPPSI

SEQ ID NO: 2492122 - protein, 18 aa, Entamoeba dispar
KTFMKGHQKMSGKNAQFN

SEQ ID NO: 2492123 - protein, 24 aa, Entamoeba dispar
KTGDEKLVYCTVGVMLRKVLGNPD

SEQ ID NO: 2492124 - protein, 22 aa, Entamoeba dispar
KTGEIPPPPPLHIDSTGNPILS

SEQ ID NO: 2492125 - protein, 17 aa, Entamoeba dispar
KTGELVWNDMKKINSEL

SEQ ID NO: 2492126 - protein, 17 aa, Entamoeba dispar
KTGIFKRYITGQYTGTE

SEQ ID NO: 2492127 - protein, 17 aa, Entamoeba dispar
KTGKPHFKVSCYCGHEF

SEQ ID NO: 2492128 - protein, 24 aa, Entamoeba dispar
KTGNDGRCALCFGYNNKKPIYICS

SEQ ID NO: 2492129 - protein, 26 aa, Entamoeba dispar
KTGTRIFVLSFIFRNIIQSISTNSFD

SEQ ID NO: 2492130 - protein, 25 aa, Entamoeba dispar
KTHANWKGACWVPTEKTTIVTISDS

SEQ ID NO: 2492131 - protein, 17 aa, Entamoeba dispar
KTHKLYLEKSIKLVKIT

SEQ ID NO: 2492132 - protein, 25 aa, Entamoeba dispar
KTIAEFKKNVELFGVLDEDDRKSLF

SEQ ID NO: 2492133 - protein, 26 aa, Entamoeba dispar
KTIDGAIRCWKEIVKKRYDNRSLLVG

SEQ ID NO: 2492134 - protein, 18 aa, Entamoeba dispar
KTIDSLCIDSKDGKIITS

SEQ ID NO: 2492135 - protein, 19 aa, Entamoeba dispar
KTIEGFSLQYFLIINVHLK

SEQ ID NO: 2492136 - protein, 24 aa, Entamoeba dispar
KTIEYAPLWLPQSIQNCQLCGKSF

SEQ ID NO: 2492137 - protein, 18 aa, Entamoeba dispar
KTIGCILVKIHFYQRIQI

SEQ ID NO: 2492138 - protein, 18 aa, Entamoeba dispar
KTIHLILTLCLNIGTDSP

SEQ ID NO: 2492139 - protein, 25 aa, Entamoeba dispar
KTIIKEFDFDEGIDFVVKGNRLFIQ

SEQ ID NO: 2492140 - protein, 24 aa, Entamoeba dispar
KTIIKLRKICNIKIGYENKEIIPL

SEQ ID NO: 2492141 - protein, 22 aa, Entamoeba dispar
KTIIPLSIYLKSVFKNNEIKLI

SEQ ID NO: 2492142 - protein, 25 aa, Entamoeba dispar
KTIIYCFRYSFSLLGEGEQNNGLVD

SEQ ID NO: 2492143 - protein, 20 aa, Entamoeba dispar
KTIKCWDLESNKVVKHFHGH

SEQ ID NO: 2492144 - protein, 23 aa, Entamoeba dispar
KTIKFIDCNISFNKINFYPLQML

SEQ ID NO: 2492145 - protein, 23 aa, Entamoeba dispar
KTIKICVYDSLFDEIKPSKFYEK

SEQ ID NO: 2492146 - protein, 22 aa, Entamoeba dispar
KTIKPLRVVCMTSDYTMQNVMM

SEQ ID NO: 2492147 - protein, 24 aa, Entamoeba dispar
KTILRFEAIRVVSEMSYRYNELVS

SEQ ID NO: 2492148 - protein, 26 aa, Entamoeba dispar
KTINILFPIEIGYDIKGPQLMTERSR

SEQ ID NO: 2492149 - protein, 23 aa, Entamoeba dispar
KTIPLFKKGCMGIDPETSITELL

SEQ ID NO: 2492150 - protein, 21 aa, Entamoeba dispar
KTIPPHFIRSLQIINEEVENK

SEQ ID NO: 2492151 - protein, 22 aa, Entamoeba dispar
KTIPSYFNTYVNTFKYHTPQPS

SEQ ID NO: 2492152 - protein, 18 aa, Entamoeba dispar
KTIPWSIIKEDINVTGVV

SEQ ID NO: 2492153 - protein, 29 aa, Entamoeba dispar
KTIQYKPDWSRGYSRKAFALLKLEKYEEA

SEQ ID NO: 2492154 - protein, 20 aa, Entamoeba dispar
KTITIFLCIIKRIDSLNLSE

SEQ ID NO: 2492155 - protein, 23 aa, Entamoeba dispar
KTKEADLIFDSRCDKYEMLMNTV

SEQ ID NO: 2492156 - protein, 26 aa, Entamoeba dispar
KTKEEFRHWAKIIGLGCKTYGVFCFP

SEQ ID NO: 2492157 - protein, 17 aa, Entamoeba dispar
KTKEKQNLFGIIQGGLQ

SEQ ID NO: 2492158 - protein, 24 aa, Entamoeba dispar
KTKEVAQMSFLIWALNRKFSFSFQ

SEQ ID NO: 2492159 - protein, 19 aa, Entamoeba dispar
KTKFLEYDRTLLVADPRRC

SEQ ID NO: 2492160 - protein, 18 aa, Entamoeba dispar
KTKILTQFVYFKQHQPII

SEQ ID NO: 2492161 - protein, 19 aa, Entamoeba dispar
KTKISRALFVASLLNELPI

SEQ ID NO: 2492162 - protein, 23 aa, Entamoeba dispar
KTKKLEEFCCFLLSDYFLMTKVK

SEQ ID NO: 2492163 - protein, 18 aa, Entamoeba dispar
KTKKYWSFEQKMFAVEKV

SEQ ID NO: 2492164 - protein, 18 aa, Entamoeba dispar
KTKLHVFNDMIILVQKQG

SEQ ID NO: 2492165 - protein, 24 aa, Entamoeba dispar
KTKLKFKIPGLLVMDTPGHEAFNN

SEQ ID NO: 2492166 - protein, 20 aa, Entamoeba dispar
KTKQAFDFKFIREGSSSVDD

SEQ ID NO: 2492167 - protein, 24 aa, Entamoeba dispar
KTKRRRYIICGPRIKRREFVNTTV

SEQ ID NO: 2492168 - protein, 22 aa, Entamoeba dispar
KTKSRELLGEWIVALQSSTVII

SEQ ID NO: 2492169 - protein, 18 aa, Entamoeba dispar
KTLALLFESCFKDEVNTI

SEQ ID NO: 2492170 - protein, 20 aa, Entamoeba dispar
KTLAQRKKRNAIIMKGFQLE

SEQ ID NO: 2492171 - protein, 17 aa, Entamoeba dispar
KTLCEFINKTQQRKLIE

SEQ ID NO: 2492172 - protein, 25 aa, Entamoeba dispar
KTLEFNCIRSIKILDGMKKEGRSKR

SEQ ID NO: 2492173 - protein, 23 aa, Entamoeba dispar
KTLESISLLGYLYHVQDCHGPHI

SEQ ID NO: 2492174 - protein, 22 aa, Entamoeba dispar
KTLEYAKPLSFPTITSDFTKAL

SEQ ID NO: 2492175 - protein, 17 aa, Entamoeba dispar
KTLFMFSNICIMNNDYL

SEQ ID NO: 2492176 - protein, 18 aa, Entamoeba dispar
KTLFMFSNICIMNNDYLI

SEQ ID NO: 2492177 - protein, 20 aa, Entamoeba dispar
KTLGEFCFSNSLNTSIIIPT

SEQ ID NO: 2492178 - protein, 17 aa, Entamoeba dispar
KTLGNWFCQCDMNDFVW

SEQ ID NO: 2492179 - protein, 17 aa, Entamoeba dispar
KTLGVWDAVASSEKVWI

SEQ ID NO: 2492180 - protein, 18 aa, Entamoeba dispar
KTLIAQEHIDTMQPVSKT

SEQ ID NO: 2492181 - protein, 23 aa, Entamoeba dispar
KTLIKRKIPVIDCDKLGHELYQK

SEQ ID NO: 2492182 - protein, 19 aa, Entamoeba dispar
KTLKLPVTVDHSSKKTPTI

SEQ ID NO: 2492183 - protein, 31 aa, Entamoeba dispar
KTLKNLSHFVALKCCVEVGGTAAQAKYSQAS

SEQ ID NO: 2492184 - protein, 25 aa, Entamoeba dispar
KTLKYIGRSCFKFCVSLDSINFPTT

SEQ ID NO: 2492185 - protein, 24 aa, Entamoeba dispar
KTLLFKEGFLKILTDIIGRTDNQN

SEQ ID NO: 2492186 - protein, 26 aa, Entamoeba dispar
KTLLKDVALEIANRAEIKEQQQKELT

SEQ ID NO: 2492187 - protein, 21 aa, Entamoeba dispar
KTLLQMYENMYGIKVNKNEEE

SEQ ID NO: 2492188 - protein, 22 aa, Entamoeba dispar
KTLLQMYENMYGIKVNKNEEEI

SEQ ID NO: 2492189 - protein, 17 aa, Entamoeba dispar
KTLPEPNLFVFKYLFMF

SEQ ID NO: 2492190 - protein, 25 aa, Entamoeba dispar
KTLPLLRKLRNIIGINNRIKVILIS

SEQ ID NO: 2492191 - protein, 19 aa, Entamoeba dispar
KTLRINRTRLVHIYLALQP

SEQ ID NO: 2492192 - protein, 25 aa, Entamoeba dispar
KTLRNVIWMICEYCNHYDEVINMFK

SEQ ID NO: 2492193 - protein, 20 aa, Entamoeba dispar
KTLSCIKQTIEVLKKSNEHY

SEQ ID NO: 2492194 - protein, 18 aa, Entamoeba dispar
KTLSVKWKYTIDKSTMLI

SEQ ID NO: 2492195 - protein, 23 aa, Entamoeba dispar
KTLSVKYANNWVVITGTRQIEGK

SEQ ID NO: 2492196 - protein, 18 aa, Entamoeba dispar
KTLVEYAFALTYFRDIVV

SEQ ID NO: 2492197 - protein, 22 aa, Entamoeba dispar
KTLYYGSRWGVVRQLDAASMME

SEQ ID NO: 2492198 - protein, 21 aa, Entamoeba dispar
KTMDWWSCVIIGDEEIDTKKI

SEQ ID NO: 2492199 - protein, 26 aa, Entamoeba dispar
KTMFGISISDIIDWNGIIPKSEEDVQ

SEQ ID NO: 2492200 - protein, 20 aa, Entamoeba dispar
KTMIFKTFLKGEVNRAKESF

SEQ ID NO: 2492201 - protein, 19 aa, Entamoeba dispar
KTMLPLARIIIEYKNLGCI

SEQ ID NO: 2492202 - protein, 20 aa, Entamoeba dispar
KTMMCCKCMEEFSVDSQESQ

SEQ ID NO: 2492203 - protein, 25 aa, Entamoeba dispar
KTMPIRWTAPEAAARGIFTIKNDVW

SEQ ID NO: 2492204 - protein, 25 aa, Entamoeba dispar
KTMQPNRLKRSLFLRRENSDRVRKN

SEQ ID NO: 2492205 - protein, 21 aa, Entamoeba dispar
KTMQTEDRMRTALKGQVLRFL

SEQ ID NO: 2492206 - protein, 25 aa, Entamoeba dispar
KTMRTPPGYWCVFTQNGKTMQCELH

SEQ ID NO: 2492207 - protein, 23 aa, Entamoeba dispar
KTNARLAIEVLWVHKTSRRKMVA

SEQ ID NO: 2492208 - protein, 19 aa, Entamoeba dispar
KTNCFCVYCDKKFSKETVL

SEQ ID NO: 2492209 - protein, 20 aa, Entamoeba dispar
KTNDIFSVFNGFWISNNNEC

SEQ ID NO: 2492210 - protein, 20 aa, Entamoeba dispar
KTNFISFLFEILPFKPPLTY

SEQ ID NO: 2492211 - protein, 23 aa, Entamoeba dispar
KTNFSFRYSMPSADFDRNRVKGL

SEQ ID NO: 2492212 - protein, 25 aa, Entamoeba dispar
KTNGRTASISGLWISILLVMKTGGD

SEQ ID NO: 2492213 - protein, 17 aa, Entamoeba dispar
KTNIYFIVEDSFGNIFG

SEQ ID NO: 2492214 - protein, 18 aa, Entamoeba dispar
KTNLSYHTSVQWYCNDTM

SEQ ID NO: 2492215 - protein, 26 aa, Entamoeba dispar
KTNPDIIIPFIFNFIKPQYIDSIEIL

SEQ ID NO: 2492216 - protein, 22 aa, Entamoeba dispar
KTNPKCFHWPYINVLPKTYDCP

SEQ ID NO: 2492217 - protein, 20 aa, Entamoeba dispar
KTNPLVLKWLQTSSTFVNIL

SEQ ID NO: 2492218 - protein, 25 aa, Entamoeba dispar
KTNQIPIEVCIRSPSLELSQSLYET

SEQ ID NO: 2492219 - protein, 23 aa, Entamoeba dispar
KTNRISDGVVRIRFVAGDAAYKN

SEQ ID NO: 2492220 - protein, 22 aa, Entamoeba dispar
KTNVRLSGILSRVKATNKSSST

SEQ ID NO: 2492221 - protein, 19 aa, Entamoeba dispar
KTNWICLTYEGPKSKKLVI

SEQ ID NO: 2492222 - protein, 27 aa, Entamoeba dispar
KTPALSVLHRVRFIFQPNQLMKTTEAV

SEQ ID NO: 2492223 - protein, 20 aa, Entamoeba dispar
KTPARRVYPIGLIYVKKGMK

SEQ ID NO: 2492224 - protein, 25 aa, Entamoeba dispar
KTPDLLEKIRCLYSLAIFIKKLDYV

SEQ ID NO: 2492225 - protein, 23 aa, Entamoeba dispar
KTPEEIRKTFGIVNDFTPEEEEQ

SEQ ID NO: 2492226 - protein, 22 aa, Entamoeba dispar
KTPELKLRIALNKSGILELVDA

SEQ ID NO: 2492227 - protein, 32 aa, Entamoeba dispar
KTPGFEVINHIPSVCPLCTPPELAKLTMKITE

SEQ ID NO: 2492228 - protein, 20 aa, Entamoeba dispar
KTPIDFIILPPLKLKDQQSQ

SEQ ID NO: 2492229 - protein, 22 aa, Entamoeba dispar
KTPKTIPLKAIEKVIEQVGNNQ

SEQ ID NO: 2492230 - protein, 19 aa, Entamoeba dispar
KTPKYGLIFHAALIGQAPA

SEQ ID NO: 2492231 - protein, 21 aa, Entamoeba dispar
KTPKYRVVVRITNKTVIAQIA

SEQ ID NO: 2492232 - protein, 19 aa, Entamoeba dispar
KTPLFSIKSWTNCEKFEMI

SEQ ID NO: 2492233 - protein, 18 aa, Entamoeba dispar
KTPLFSIKSWTNCENDMN

SEQ ID NO: 2492234 - protein, 18 aa, Entamoeba dispar
KTPNKRPNFVSIIKELLI

SEQ ID NO: 2492235 - protein, 26 aa, Entamoeba dispar
KTPRIIPKQCRLLMRSFEELHDSVRP

SEQ ID NO: 2492236 - protein, 24 aa, Entamoeba dispar
KTQADIKCVNWNVKVPHIIALTLS

SEQ ID NO: 2492237 - protein, 19 aa, Entamoeba dispar
KTQAYHILVIIADGQVDNE

SEQ ID NO: 2492238 - protein, 17 aa, Entamoeba dispar
KTQHFLIGIDIIYFLTP

SEQ ID NO: 2492239 - protein, 17 aa, Entamoeba dispar
KTQILIVLKQWMQSYPN

SEQ ID NO: 2492240 - protein, 20 aa, Entamoeba dispar
KTQLKISYSPIKQAQTPVLP

SEQ ID NO: 2492241 - protein, 18 aa, Entamoeba dispar
KTQMLLKRIHAIINGEMK

SEQ ID NO: 2492242 - protein, 25 aa, Entamoeba dispar
KTQNVWPRRVKDLIMNKKQILINTK

SEQ ID NO: 2492243 - protein, 25 aa, Entamoeba dispar
KTQPSGPQYPGYNVQQADGKQNTPQ

SEQ ID NO: 2492244 - protein, 29 aa, Entamoeba dispar
KTQSTYCLCVGHSLLRFIRYSPRPSPSIQ

SEQ ID NO: 2492245 - protein, 19 aa, Entamoeba dispar
KTQVATIIIFKGYSKENFN

SEQ ID NO: 2492246 - protein, 19 aa, Entamoeba dispar
KTQVATIVIFKGYSKENFG

SEQ ID NO: 2492247 - protein, 25 aa, Entamoeba dispar
KTRIFYLKKYEYFEISYKSNISLQM

SEQ ID NO: 2492248 - protein, 20 aa, Entamoeba dispar
KTRKADEFYQLHDFMSTSQP

SEQ ID NO: 2492249 - protein, 19 aa, Entamoeba dispar
KTRKGCRRIIRETDSNIII

SEQ ID NO: 2492250 - protein, 18 aa, Entamoeba dispar
KTRRLVALARYKVVYTEQ

SEQ ID NO: 2492251 - protein, 19 aa, Entamoeba dispar
KTRTKATPYWGYKSEGGKK

SEQ ID NO: 2492252 - protein, 19 aa, Entamoeba dispar
KTRVIQCSDGQLIIFSIEA

SEQ ID NO: 2492253 - protein, 17 aa, Entamoeba dispar
KTSCIGDLILNGTNKEE

SEQ ID NO: 2492254 - protein, 27 aa, Entamoeba dispar
KTSECLMIPLLKVERCWAYSNELQPVD

SEQ ID NO: 2492255 - protein, 22 aa, Entamoeba dispar
KTSFKYRIMNRFKDEEYVIYDS

SEQ ID NO: 2492256 - protein, 24 aa, Entamoeba dispar
KTSFRLGKIDIPVAVIQDDVFSLQ

SEQ ID NO: 2492257 - protein, 25 aa, Entamoeba dispar
KTSFYKKYLKPMGYEWINMDTLGNK

SEQ ID NO: 2492258 - protein, 17 aa, Entamoeba dispar
KTSGLFLIDLIQEKQNE

SEQ ID NO: 2492259 - protein, 27 aa, Entamoeba dispar
KTSIKNNRLPSCINVGSLNKITLSYLQ

SEQ ID NO: 2492260 - protein, 23 aa, Entamoeba dispar
KTSIRYKLILGEFATNIPTTIGF

SEQ ID NO: 2492261 - protein, 18 aa, Entamoeba dispar
KTSIVKEIAKNEIMQVIR

SEQ ID NO: 2492262 - protein, 24 aa, Entamoeba dispar
KTSLVKRYCEGIFLEEMMSTVGID

SEQ ID NO: 2492263 - protein, 23 aa, Entamoeba dispar
KTSNCKLSIYGRHKRLDLKKMSL

SEQ ID NO: 2492264 - protein, 23 aa, Entamoeba dispar
KTSSIKGVLTFSFKSTPFADKLY

SEQ ID NO: 2492265 - protein, 18 aa, Entamoeba dispar
KTSVAVLINQSTLYTIDS

SEQ ID NO: 2492266 - protein, 18 aa, Entamoeba dispar
KTSVLIQFVSGHFVTIYD

SEQ ID NO: 2492267 - protein, 18 aa, Entamoeba dispar
KTTALVFHSGKLVVTGGK

SEQ ID NO: 2492268 - protein, 25 aa, Entamoeba dispar
KTTEHWKFLHNYILHRDCILDLACS

SEQ ID NO: 2492269 - protein, 27 aa, Entamoeba dispar
KTTELLYRFICKLINRPYVRFNNEIYN

SEQ ID NO: 2492270 - protein, 18 aa, Entamoeba dispar
KTTFVKKYCHAEDMKESF

SEQ ID NO: 2492271 - protein, 22 aa, Entamoeba dispar
KTTIFFESFIKLLNEQKEIIML

SEQ ID NO: 2492272 - protein, 17 aa, Entamoeba dispar
KTTIIWNCWILFIFRNE

SEQ ID NO: 2492273 - protein, 24 aa, Entamoeba dispar
KTTILSRFDMIFMIRDKHDAKRDK

SEQ ID NO: 2492274 - protein, 17 aa, Entamoeba dispar
KTTINLCKDFEPKNYGF

SEQ ID NO: 2492275 - protein, 17 aa, Entamoeba dispar
KTTISIKSTDEYGVTTI

SEQ ID NO: 2492276 - protein, 19 aa, Entamoeba dispar
KTTKTKSGFIVIINNKQIC

SEQ ID NO: 2492277 - protein, 25 aa, Entamoeba dispar
KTTMYRVKWPGTFELFISEEPDTFF

SEQ ID NO: 2492278 - protein, 20 aa, Entamoeba dispar
KTTRLCVLILQSLKEIKPLQ

SEQ ID NO: 2492279 - protein, 19 aa, Entamoeba dispar
KTTVPLLRLMVALKNAEDE

SEQ ID NO: 2492280 - protein, 17 aa, Entamoeba dispar
KTTWSLSDQTIFALNDG

SEQ ID NO: 2492281 - protein, 17 aa, Entamoeba dispar
KTVAVSPHYLALGGTDD

SEQ ID NO: 2492282 - protein, 18 aa, Entamoeba dispar
KTVCIRINKIEIERKNVS

SEQ ID NO: 2492283 - protein, 19 aa, Entamoeba dispar
KTVCYKCHDQISATSAFVV

SEQ ID NO: 2492284 - protein, 17 aa, Entamoeba dispar
KTVEGLAEDNCYISFLL

SEQ ID NO: 2492285 - protein, 17 aa, Entamoeba dispar
KTVEHIILFINKQLRDT

SEQ ID NO: 2492286 - protein, 22 aa, Entamoeba dispar
KTVGDLAWYFIKLIEINHSTLF

SEQ ID NO: 2492287 - protein, 19 aa, Entamoeba dispar
KTVSSFLFYYKCSQCTNEQ

SEQ ID NO: 2492288 - protein, 18 aa, Entamoeba dispar
KTVTGCIQYLVKAANDQV

SEQ ID NO: 2492289 - protein, 22 aa, Entamoeba dispar
KTWEKLSLAARVIAGISNETPS

SEQ ID NO: 2492290 - protein, 25 aa, Entamoeba dispar
KTWGKNVRPGISFEQFVAQLYKLGK

SEQ ID NO: 2492291 - protein, 18 aa, Entamoeba dispar
KTWPEIKNQINVCKHLHE

SEQ ID NO: 2492292 - protein, 19 aa, Entamoeba dispar
KTWSILLPVAQQWKILMKK

SEQ ID NO: 2492293 - protein, 21 aa, Entamoeba dispar
KTYDCPLSYTIDELNIMKGTK

SEQ ID NO: 2492294 - protein, 24 aa, Entamoeba dispar
KTYDCWSSLLLPEELWIDEVYHPF

SEQ ID NO: 2492295 - protein, 17 aa, Entamoeba dispar
KTYGFIVMEKDNLGHVF

SEQ ID NO: 2492296 - protein, 22 aa, Entamoeba dispar
KTYKSRISVVGALLLNESLTHV

SEQ ID NO: 2492297 - protein, 19 aa, Entamoeba dispar
KTYLCITTETKIRIIAFEG

SEQ ID NO: 2492298 - protein, 18 aa, Entamoeba dispar
KTYLDFLQRTLCWDPKFR

SEQ ID NO: 2492299 - protein, 25 aa, Entamoeba dispar
KTYLFSTLCPTPWTAFAVGYLKTAC

SEQ ID NO: 2492300 - protein, 26 aa, Entamoeba dispar
KTYYCCTCNEILCPECYVLDHSGDVV

SEQ ID NO: 2492301 - protein, 20 aa, Entamoeba dispar
KVAEGFKQTILKRIKKIDEL

SEQ ID NO: 2492302 - protein, 28 aa, Entamoeba dispar
KVAGHRGYYLKGWGFKLNQALINYSTNF

SEQ ID NO: 2492303 - protein, 17 aa, Entamoeba dispar
KVCISVRSFSHNKLNID

SEQ ID NO: 2492304 - protein, 18 aa, Entamoeba dispar
KVCNTCATTKIALVAGGT

SEQ ID NO: 2492305 - protein, 19 aa, Entamoeba dispar
KVDCPPILCVPTVYDTLTQ

SEQ ID NO: 2492306 - protein, 20 aa, Entamoeba dispar
KVDEFRGRFMMDGHNETIKY

SEQ ID NO: 2492307 - protein, 25 aa, Entamoeba dispar
KVDELTKRVEVIKSITEFLHPELNE

SEQ ID NO: 2492308 - protein, 25 aa, Entamoeba dispar
KVDMWAAGIMMYFLATGKHPFEQLV

SEQ ID NO: 2492309 - protein, 18 aa, Entamoeba dispar
KVDNMMLEAMELVKEESS

SEQ ID NO: 2492310 - protein, 22 aa, Entamoeba dispar
KVDYKAIVVLTFIDQEKLLHYV

SEQ ID NO: 2492311 - protein, 21 aa, Entamoeba dispar
KVEASLDEWEFCKTFAENGIV

SEQ ID NO: 2492312 - protein, 23 aa, Entamoeba dispar
KVEFKRGLIERTFEFQKKYGNKG

SEQ ID NO: 2492313 - protein, 24 aa, Entamoeba dispar
KVEGAVLEKVIQWLLFHNEHPLMY

SEQ ID NO: 2492314 - protein, 24 aa, Entamoeba dispar
KVEIKKGMGLDRFFRITTDMSPAA

SEQ ID NO: 2492315 - protein, 18 aa, Entamoeba dispar
KVEIKKPIYIVALPRSGS

SEQ ID NO: 2492316 - protein, 21 aa, Entamoeba dispar
KVEKERFVLQSIGAIIGSELS

SEQ ID NO: 2492317 - protein, 25 aa, Entamoeba dispar
KVELRNGWDKIIEEWRSFDEENTND

SEQ ID NO: 2492318 - protein, 24 aa, Entamoeba dispar
KVERSRFKPSFSMGPDDYGVQQLD

SEQ ID NO: 2492319 - protein, 18 aa, Entamoeba dispar
KVEVCKRCVAAGAEYVKT

SEQ ID NO: 2492320 - protein, 18 aa, Entamoeba dispar
KVEYCLTVKTIQREKDLT

SEQ ID NO: 2492321 - protein, 22 aa, Entamoeba dispar
KVFCKHFNMTIGLLTGGIDISK

SEQ ID NO: 2492322 - protein, 25 aa, Entamoeba dispar
KVFDRVTVCFNYWYSGIDSRIIVLH

SEQ ID NO: 2492323 - protein, 22 aa, Entamoeba dispar
KVFEIKGKYFIVTGVKDDENVM

SEQ ID NO: 2492324 - protein, 27 aa, Entamoeba dispar
KVFESFDYFNHLRLIRRRDIALRFKEQ

SEQ ID NO: 2492325 - protein, 25 aa, Entamoeba dispar
KVFEVEKFPSIFPERKCLNSVITKS

SEQ ID NO: 2492326 - protein, 23 aa, Entamoeba dispar
KVFLPTKCLTSFKSFISLEKLTL

SEQ ID NO: 2492327 - protein, 19 aa, Entamoeba dispar
KVFLSEVVHYLKSLENVYT

SEQ ID NO: 2492328 - protein, 19 aa, Entamoeba dispar
KVFQEMKKSVIIINMARGP

SEQ ID NO: 2492329 - protein, 19 aa, Entamoeba dispar
KVGCKELYQKMNLQSITLK

SEQ ID NO: 2492330 - protein, 24 aa, Entamoeba dispar
KVGIISVHLYRPWSAKHFLGEIPN

SEQ ID NO: 2492331 - protein, 28 aa, Entamoeba dispar
KVGKAKEIPKIFGICKDYVLLADEDGGN

SEQ ID NO: 2492332 - protein, 22 aa, Entamoeba dispar
KVGSGCFYLCYSLTYINIPSSI

SEQ ID NO: 2492333 - protein, 18 aa, Entamoeba dispar
KVGSISVIVSLKKGALER

SEQ ID NO: 2492334 - protein, 19 aa, Entamoeba dispar
KVHAAFVLSELVLIPNTKV

SEQ ID NO: 2492335 - protein, 27 aa, Entamoeba dispar
KVHDDIIRVCFLFNTMFIITKIKTFQG

SEQ ID NO: 2492336 - protein, 22 aa, Entamoeba dispar
KVHRQKLVNGRLVIEDKERKYT

SEQ ID NO: 2492337 - protein, 21 aa, Entamoeba dispar
KVHSLCYYCLIEYADEEELYR

SEQ ID NO: 2492338 - protein, 17 aa, Entamoeba dispar
KVIDCLAEVKKSMWELG

SEQ ID NO: 2492339 - protein, 21 aa, Entamoeba dispar
KVIDDWKRMPSSNIIDGNIVE

SEQ ID NO: 2492340 - protein, 25 aa, Entamoeba dispar
KVIDDWKRMPSSNIIDGNIVESYLE

SEQ ID NO: 2492341 - protein, 26 aa, Entamoeba dispar
KVIDLLQKFDCWEGLFYFLSQIVNTT

SEQ ID NO: 2492342 - protein, 22 aa, Entamoeba dispar
KVIECEKCGCVLFQSDKKIHQD

SEQ ID NO: 2492343 - protein, 30 aa, Entamoeba dispar
KVIEKAIKFGYHVNIMRPAFIVADSKKGIC

SEQ ID NO: 2492344 - protein, 20 aa, Entamoeba dispar
KVIFYISAMILCNMDSKNVS

SEQ ID NO: 2492345 - protein, 24 aa, Entamoeba dispar
KVIGEGAYGVWSWRRNLQPSTSNT

SEQ ID NO: 2492346 - protein, 20 aa, Entamoeba dispar
KVIIEQCADLKTLIITSPVI

SEQ ID NO: 2492347 - protein, 26 aa, Entamoeba dispar
KVIIKIICFICSFITEKEEIQEIVSS

SEQ ID NO: 2492348 - protein, 17 aa, Entamoeba dispar
KVILWDIITGKQIGVLD

SEQ ID NO: 2492349 - protein, 31 aa, Entamoeba dispar
KVIMKILKRYDEILAQIVYFIISYNFNDCFD

SEQ ID NO: 2492350 - protein, 22 aa, Entamoeba dispar
KVIPCTIDGLTMIVNVPPSVPG

SEQ ID NO: 2492351 - protein, 20 aa, Entamoeba dispar
KVIPEITSLIHLKEFYYSNI

SEQ ID NO: 2492352 - protein, 19 aa, Entamoeba dispar
KVIRVHSGFHNEYILNQLK

SEQ ID NO: 2492353 - protein, 33 aa, Entamoeba dispar
KVISDIFLFSEFWKHTCIVWTKCYNFIPRKKIE

SEQ ID NO: 2492354 - protein, 29 aa, Entamoeba dispar
KVISPMRWKGDTAYFMFVGGCWCIIITDE

SEQ ID NO: 2492355 - protein, 22 aa, Entamoeba dispar
KVITKFDFLRLVIDDLKSTNSL

SEQ ID NO: 2492356 - protein, 31 aa, Entamoeba dispar
KVIVIDFFATWCGPCRSIGPYFEELAGQHNN

SEQ ID NO: 2492357 - protein, 24 aa, Entamoeba dispar
KVIVKLVPRFNIAHFQEIAKKMRL

SEQ ID NO: 2492358 - protein, 17 aa, Entamoeba dispar
KVIWIVCGTMADLPKRI

SEQ ID NO: 2492359 - protein, 18 aa, Entamoeba dispar
KVKCIKFATEAAITILRI

SEQ ID NO: 2492360 - protein, 18 aa, Entamoeba dispar
KVKEELKENCPIETQISK

SEQ ID NO: 2492361 - protein, 18 aa, Entamoeba dispar
KVKEELPLSCQLSKELEE

SEQ ID NO: 2492362 - protein, 19 aa, Entamoeba dispar
KVKEFKVAFPDLSHGDFYK

SEQ ID NO: 2492363 - protein, 24 aa, Entamoeba dispar
KVKEMLMTFKLYYSYDLDITLTLQ

SEQ ID NO: 2492364 - protein, 19 aa, Entamoeba dispar
KVKFPERIILLRGNHESRQ

SEQ ID NO: 2492365 - protein, 21 aa, Entamoeba dispar
KVKGTHFYPFVIMKYKEQIIQ

SEQ ID NO: 2492366 - protein, 19 aa, Entamoeba dispar
KVKIISFKGTDSINDLISD

SEQ ID NO: 2492367 - protein, 24 aa, Entamoeba dispar
KVKIRYEKDLNFQSKTWFPDMPSH

SEQ ID NO: 2492368 - protein, 29 aa, Entamoeba dispar
KVKIYEDVVSFALRCEGHYLNVLKDMKDL

SEQ ID NO: 2492369 - protein, 23 aa, Entamoeba dispar
KVKKMGGLDLFFTIKPKNGESAL

SEQ ID NO: 2492370 - protein, 19 aa, Entamoeba dispar
KVKLGDYIRERIMEVDKKG

SEQ ID NO: 2492371 - protein, 19 aa, Entamoeba dispar
KVKLKLSNMAKLYPEEIVI

SEQ ID NO: 2492372 - protein, 26 aa, Entamoeba dispar
KVKNGWRLPLGNSFKFLNEIISQCWD

SEQ ID NO: 2492373 - protein, 18 aa, Entamoeba dispar
KVKQDLKSKRNVLMSEMR

SEQ ID NO: 2492374 - protein, 22 aa, Entamoeba dispar
KVKQEIIGMIALSQREYSENKI

SEQ ID NO: 2492375 - protein, 30 aa, Entamoeba dispar
KVKRIFHILFPYFLKQSFRRIILLLWKGID

SEQ ID NO: 2492376 - protein, 23 aa, Entamoeba dispar
KVKSYDCFDRESIICCLPLEEND

SEQ ID NO: 2492377 - protein, 23 aa, Entamoeba dispar
KVKYPGSIFICRGDHECARINRR

SEQ ID NO: 2492378 - protein, 21 aa, Entamoeba dispar
KVLCDEIQYCISYQIRSVNHK

SEQ ID NO: 2492379 - protein, 21 aa, Entamoeba dispar
KVLDLFCCVGGDSIQQAVAGS

SEQ ID NO: 2492380 - protein, 17 aa, Entamoeba dispar
KVLEDLGNLKWIVVGKL

SEQ ID NO: 2492381 - protein, 20 aa, Entamoeba dispar
KVLELLLWMFEKELTENPPE

SEQ ID NO: 2492382 - protein, 18 aa, Entamoeba dispar
KVLESMRCPTICYFYGAC

SEQ ID NO: 2492383 - protein, 22 aa, Entamoeba dispar
KVLFLPLSVPKYAVIESTEEIN

SEQ ID NO: 2492384 - protein, 19 aa, Entamoeba dispar
KVLILNRRITIWINGVEVI

SEQ ID NO: 2492385 - protein, 24 aa, Entamoeba dispar
KVLKECGCAILVGFDGDSYGKDDE

SEQ ID NO: 2492386 - protein, 18 aa, Entamoeba dispar
KVLKLVLLTLYHRKKYSI

SEQ ID NO: 2492387 - protein, 20 aa, Entamoeba dispar
KVLKNKASYMRQAMLEIAVL

SEQ ID NO: 2492388 - protein, 26 aa, Entamoeba dispar
KVLLGKCRVAVEYFKTGRDQALQEVD

SEQ ID NO: 2492389 - protein, 18 aa, Entamoeba dispar
KVLLPCDFFAVHYAEPKL

SEQ ID NO: 2492390 - protein, 18 aa, Entamoeba dispar
KVLNLDFWRESKYSNTNY

SEQ ID NO: 2492391 - protein, 27 aa, Entamoeba dispar
KVLNVKRILSLMAMLVTLMRELNGIYY

SEQ ID NO: 2492392 - protein, 19 aa, Entamoeba dispar
KVLVSCDVFGGHYADERVF

SEQ ID NO: 2492393 - protein, 19 aa, Entamoeba dispar
KVLYLERVLSEMLIANSHG

SEQ ID NO: 2492394 - protein, 24 aa, Entamoeba dispar
KVMEAVSFLWPYERDRRKQIEIWE

SEQ ID NO: 2492395 - protein, 23 aa, Entamoeba dispar
KVMFKENCFFINFDKKGNVFGAF

SEQ ID NO: 2492396 - protein, 26 aa, Entamoeba dispar
KVMLTNCRICGCSKAGLHCGGKEIRC

SEQ ID NO: 2492397 - protein, 27 aa, Entamoeba dispar
KVMQTPECLRVYVSSFWDQPFKDTLFT

SEQ ID NO: 2492398 - protein, 22 aa, Entamoeba dispar
KVMYPTRISLMRGNHESRQVTQ

SEQ ID NO: 2492399 - protein, 25 aa, Entamoeba dispar
KVNCLKLRLLDGGNLLTKMVEKDKE

SEQ ID NO: 2492400 - protein, 23 aa, Entamoeba dispar
KVNCTTTLFFARMGSIKKEELKQ

SEQ ID NO: 2492401 - protein, 24 aa, Entamoeba dispar
KVNCTTTLFFARMGSIKKEELKQY

SEQ ID NO: 2492402 - protein, 17 aa, Entamoeba dispar
KVNDINYVLAIGGSCSI

SEQ ID NO: 2492403 - protein, 25 aa, Entamoeba dispar
KVNEFNIAMGKLVLGIYLMGKKIIP

SEQ ID NO: 2492404 - protein, 19 aa, Entamoeba dispar
KVNEIILRNSIAARDEYIR

SEQ ID NO: 2492405 - protein, 26 aa, Entamoeba dispar
KVNGLYRSLQLFGISTSDFYQQYRSL

SEQ ID NO: 2492406 - protein, 27 aa, Entamoeba dispar
KVNGTLRFLLKEVINSKILEQFIHENG

SEQ ID NO: 2492407 - protein, 20 aa, Entamoeba dispar
KVNIEVMRAWITSKIIDILE

SEQ ID NO: 2492408 - protein, 22 aa, Entamoeba dispar
KVNLRVPLPYTQINKSFNYPIP

SEQ ID NO: 2492409 - protein, 24 aa, Entamoeba dispar
KVNNFKIFNCIDVTDLLKEGKNII

SEQ ID NO: 2492410 - protein, 20 aa, Entamoeba dispar
KVNPRMTIIRSFDINKPGTL

SEQ ID NO: 2492411 - protein, 17 aa, Entamoeba dispar
KVNPWFTSERDVNKFCN

SEQ ID NO: 2492412 - protein, 19 aa, Entamoeba dispar
KVNQMKLLRIITVDCCSIL

SEQ ID NO: 2492413 - protein, 18 aa, Entamoeba dispar
KVNQYRWGEDDCHDVEVI

SEQ ID NO: 2492414 - protein, 17 aa, Entamoeba dispar
KVNSCFVMNESYGPKGV

SEQ ID NO: 2492415 - protein, 28 aa, Entamoeba dispar
KVNTECPRCKQSICAECFSSSVKEHSEC

SEQ ID NO: 2492416 - protein, 23 aa, Entamoeba dispar
KVNTFILKSFISFHTLSPYYKTI

SEQ ID NO: 2492417 - protein, 24 aa, Entamoeba dispar
KVNTFILKSFISFHTLSPYYKTIL

SEQ ID NO: 2492418 - protein, 18 aa, Entamoeba dispar
KVNTKWVGIPWIGIGKVA

SEQ ID NO: 2492419 - protein, 19 aa, Entamoeba dispar
KVPLNRVEPNIARMKNIAN

SEQ ID NO: 2492420 - protein, 18 aa, Entamoeba dispar
KVPLRPQTFYDLVSTKNG

SEQ ID NO: 2492421 - protein, 24 aa, Entamoeba dispar
KVPSEIIIFCPKKHKFTIRSLKQK

SEQ ID NO: 2492422 - protein, 18 aa, Entamoeba dispar
KVPSQMKVREVIEKTMIS

SEQ ID NO: 2492423 - protein, 21 aa, Entamoeba dispar
KVQEILESFFTKIFDLKLPDS

SEQ ID NO: 2492424 - protein, 19 aa, Entamoeba dispar
KVQFPIVFINDCRYSGIIE

SEQ ID NO: 2492425 - protein, 25 aa, Entamoeba dispar
KVQLKLMQRLGVFELIGNNCHRSLL

SEQ ID NO: 2492426 - protein, 26 aa, Entamoeba dispar
KVQTPLFFVDYFRVFVSHYELGKKYI

SEQ ID NO: 2492427 - protein, 17 aa, Entamoeba dispar
KVQTRFEDQWQINKQLL

SEQ ID NO: 2492428 - protein, 24 aa, Entamoeba dispar
KVQWESIQSYVLFRSISLRNKYDL

SEQ ID NO: 2492429 - protein, 21 aa, Entamoeba dispar
KVQWNLLPSSYISSYSKEPTF

SEQ ID NO: 2492430 - protein, 17 aa, Entamoeba dispar
KVRNSKFARRRRERKAN

SEQ ID NO: 2492431 - protein, 23 aa, Entamoeba dispar
KVRRICEQIAQFVGFEYHSVLEI

SEQ ID NO: 2492432 - protein, 23 aa, Entamoeba dispar
KVRRVCEQIAQFVGFEYHSVLEI

SEQ ID NO: 2492433 - protein, 20 aa, Entamoeba dispar
KVRVEGGAYGCWLSYSYNGN

SEQ ID NO: 2492434 - protein, 17 aa, Entamoeba dispar
KVRVSYQKLLKCYVINE

SEQ ID NO: 2492435 - protein, 21 aa, Entamoeba dispar
KVSAHPLANVSVQFEKLFNDI

SEQ ID NO: 2492436 - protein, 21 aa, Entamoeba dispar
KVSDIKTIIAYSKAIRLSTAS

SEQ ID NO: 2492437 - protein, 22 aa, Entamoeba dispar
KVSDLNAICFVAKSSNTRLTEN

SEQ ID NO: 2492438 - protein, 17 aa, Entamoeba dispar
KVSDLNAICFVAQSSNA

SEQ ID NO: 2492439 - protein, 17 aa, Entamoeba dispar
KVSEKKAAITLKKLEMD

SEQ ID NO: 2492440 - protein, 20 aa, Entamoeba dispar
KVSFGGQCLHYINPQFPIFN

SEQ ID NO: 2492441 - protein, 21 aa, Entamoeba dispar
KVSLPLCRRMATIARQMNICE

SEQ ID NO: 2492442 - protein, 18 aa, Entamoeba dispar
KVSLPRVNQCMLGANLEV

SEQ ID NO: 2492443 - protein, 18 aa, Entamoeba dispar
KVSPKARRNLILVTKVLQ

SEQ ID NO: 2492444 - protein, 26 aa, Entamoeba dispar
KVSPNSPLKSSFREIAPTYMKKVNEM

SEQ ID NO: 2492445 - protein, 21 aa, Entamoeba dispar
KVSVEECGLCLIEDSDDMVCN

SEQ ID NO: 2492446 - protein, 18 aa, Entamoeba dispar
KVTDGAVVTVTFLTPSHI

SEQ ID NO: 2492447 - protein, 25 aa, Entamoeba dispar
KVTKRIEMFDSWEILVLKYSLDEIS

SEQ ID NO: 2492448 - protein, 17 aa, Entamoeba dispar
KVTKRKKVEMMDFSSVA

SEQ ID NO: 2492449 - protein, 17 aa, Entamoeba dispar
KVTLIESYEIDGMIKKD

SEQ ID NO: 2492450 - protein, 25 aa, Entamoeba dispar
KVTLKIKQIRAFKKHIRKLTARKEF

SEQ ID NO: 2492451 - protein, 18 aa, Entamoeba dispar
KVTQCLSNAVDIEIERAK

SEQ ID NO: 2492452 - protein, 21 aa, Entamoeba dispar
KVTQEVIRPIGIELSSYDIHG

SEQ ID NO: 2492453 - protein, 20 aa, Entamoeba dispar
KVTRKVRSELGAYFVKNNDR

SEQ ID NO: 2492454 - protein, 19 aa, Entamoeba dispar
KVTSLRIFQFMPFIDKMKY

SEQ ID NO: 2492455 - protein, 18 aa, Entamoeba dispar
KVVEILGELFTRKILKEP

SEQ ID NO: 2492456 - protein, 18 aa, Entamoeba dispar
KVVGRGSFGKVLQVKKKD

SEQ ID NO: 2492457 - protein, 27 aa, Entamoeba dispar
KVVMKLCGWIIGRACLVLPSLYLGLMK

SEQ ID NO: 2492458 - protein, 20 aa, Entamoeba dispar
KVVNYNSLFIKLNERSHKGD

SEQ ID NO: 2492459 - protein, 23 aa, Entamoeba dispar
KVVPLKKKMRGLKFDQEIIEKRE

SEQ ID NO: 2492460 - protein, 18 aa, Entamoeba dispar
KVVPPVPHRSLPPKPVRS

SEQ ID NO: 2492461 - protein, 24 aa, Entamoeba dispar
KVVQSGCLPLLFGLFDNTDDDQLI

SEQ ID NO: 2492462 - protein, 22 aa, Entamoeba dispar
KVVRLNRIVKVVESIHQSHQNE

SEQ ID NO: 2492463 - protein, 22 aa, Entamoeba dispar
KVVWMRHEFDFIGGSLGCAEGE

SEQ ID NO: 2492464 - protein, 25 aa, Entamoeba dispar
KVWSMLVHHFYLRDALFELKGHDFV

SEQ ID NO: 2492465 - protein, 21 aa, Entamoeba dispar
KVWYLANSRLRHSLTGHNGKV

SEQ ID NO: 2492466 - protein, 17 aa, Entamoeba dispar
KVYFNILITNSFIEKEV

SEQ ID NO: 2492467 - protein, 17 aa, Entamoeba dispar
KVYRANRQFELISLSTC

SEQ ID NO: 2492468 - protein, 17 aa, Entamoeba dispar
KVYREIVEIEISNIPIK

SEQ ID NO: 2492469 - protein, 18 aa, Entamoeba dispar
KWADVFEGYNYNPKHPLL

SEQ ID NO: 2492470 - protein, 20 aa, Entamoeba dispar
KWCFNGCSSLKSITIPTTIS

SEQ ID NO: 2492471 - protein, 18 aa, Entamoeba dispar
KWDFNEWIPDYVMINIGS

SEQ ID NO: 2492472 - protein, 20 aa, Entamoeba dispar
KWFMNKWYFFYFVSIDAEDN

SEQ ID NO: 2492473 - protein, 29 aa, Entamoeba dispar
KWIKCASGNKFRMGNLFIVGPTKTGKTEF

SEQ ID NO: 2492474 - protein, 20 aa, Entamoeba dispar
KWISRDRFVLSNGHGSTLLY

SEQ ID NO: 2492475 - protein, 19 aa, Entamoeba dispar
KWISSGLFSSKKLLEVVES

SEQ ID NO: 2492476 - protein, 23 aa, Entamoeba dispar
KWKFNCKDAEEWKTKTINEVGMT

SEQ ID NO: 2492477 - protein, 21 aa, Entamoeba dispar
KWKKMFDEICVFNEQDITEIV

SEQ ID NO: 2492478 - protein, 19 aa, Entamoeba dispar
KWKLCDVHFNSAIEKMGCC

SEQ ID NO: 2492479 - protein, 20 aa, Entamoeba dispar
KWLNVACILGSSYGKRKINH

SEQ ID NO: 2492480 - protein, 24 aa, Entamoeba dispar
KWLPSIKVALMGGTRESREDCRKE

SEQ ID NO: 2492481 - protein, 32 aa, Entamoeba dispar
KWLTMTYYYICILRSPLLYGLQPNDFTNDPTL

SEQ ID NO: 2492482 - protein, 19 aa, Entamoeba dispar
KWLYDSIGSMKVMDYKSYK

SEQ ID NO: 2492483 - protein, 17 aa, Entamoeba dispar
KWNHAVENCIKKSTLAS

SEQ ID NO: 2492484 - protein, 18 aa, Entamoeba dispar
KWNPIFDLNLFKEIKEKG

SEQ ID NO: 2492485 - protein, 26 aa, Entamoeba dispar
KWPDYQLRPNFLITLVEAPNLFIDHL

SEQ ID NO: 2492486 - protein, 19 aa, Entamoeba dispar
KWQSVPSGYSIYVTGSNSE

SEQ ID NO: 2492487 - protein, 19 aa, Entamoeba dispar
KWSAGEIEQLITLSRSSMY

SEQ ID NO: 2492488 - protein, 25 aa, Entamoeba dispar
KWSIKKSINCAISIKRDSSVLYSFG

SEQ ID NO: 2492489 - protein, 27 aa, Entamoeba dispar
KWTGKFPSVIICDYCRRQKYDNPKYKD

SEQ ID NO: 2492490 - protein, 17 aa, Entamoeba dispar
KWTTLSTQRIVFYTNNS

SEQ ID NO: 2492491 - protein, 21 aa, Entamoeba dispar
KWVSLCDLQKVLLKKKLIKSD

SEQ ID NO: 2492492 - protein, 29 aa, Entamoeba dispar
KWYCFPLLIEIAMNWKLNIYDSIFQIIQL

SEQ ID NO: 2492493 - protein, 19 aa, Entamoeba dispar
KYAIPRPLNIPIIPLYWNI

SEQ ID NO: 2492494 - protein, 25 aa, Entamoeba dispar
KYAKEKKLLLAQKMWNVLLDYSQLT

SEQ ID NO: 2492495 - protein, 18 aa, Entamoeba dispar
KYAKGIVNFLVWSEQKYG

SEQ ID NO: 2492496 - protein, 25 aa, Entamoeba dispar
KYAMVKWLEFVLQKEIGSFERINGL

SEQ ID NO: 2492497 - protein, 26 aa, Entamoeba dispar
KYCEYYCLRDVLVLREGFLKYRQMVQ

SEQ ID NO: 2492498 - protein, 18 aa, Entamoeba dispar
KYCGCPISEKSLELLSKT

SEQ ID NO: 2492499 - protein, 17 aa, Entamoeba dispar
KYCGYKINFTSFSKKYF

SEQ ID NO: 2492500 - protein, 23 aa, Entamoeba dispar
KYCIGDADIPYTIKDEAELSYPL

SEQ ID NO: 2492501 - protein, 18 aa, Entamoeba dispar
KYCQIAKIFICYYFIIYY

SEQ ID NO: 2492502 - protein, 18 aa, Entamoeba dispar
KYCSYKIGKQVYYYNSYQ

SEQ ID NO: 2492503 - protein, 21 aa, Entamoeba dispar
KYCTEAFDYLGLAAIIDQKIF

SEQ ID NO: 2492504 - protein, 24 aa, Entamoeba dispar
KYCTMPLISQCFIYGESSDIFITA

SEQ ID NO: 2492505 - protein, 19 aa, Entamoeba dispar
KYDEDFYCWVKTGEKIKFE

SEQ ID NO: 2492506 - protein, 18 aa, Entamoeba dispar
KYDFHFIGGCPVPKQHKV

SEQ ID NO: 2492507 - protein, 17 aa, Entamoeba dispar
KYDGCVLSSNIVQIRGK

SEQ ID NO: 2492508 - protein, 20 aa, Entamoeba dispar
KYDILNPFSEQICEKIVTEE

SEQ ID NO: 2492509 - protein, 20 aa, Entamoeba dispar
KYDKLWKEECEKTIQLFDYS

SEQ ID NO: 2492510 - protein, 22 aa, Entamoeba dispar
KYDRAVLFLLTLGQEKVLLPKE

SEQ ID NO: 2492511 - protein, 19 aa, Entamoeba dispar
KYEEFDIENAFLWADPQIK

SEQ ID NO: 2492512 - protein, 24 aa, Entamoeba dispar
KYEGFYYYKHFKLCKVNIEKAQES

SEQ ID NO: 2492513 - protein, 26 aa, Entamoeba dispar
KYEISKLFFCHQGRTSVETDLSMFMN

SEQ ID NO: 2492514 - protein, 25 aa, Entamoeba dispar
KYEISKLFFCHQGRTSVETNLSMFM

SEQ ID NO: 2492515 - protein, 33 aa, Entamoeba dispar
KYELPLFKRCIWRYPPQYFYLLLNPRFVAQKLT

SEQ ID NO: 2492516 - protein, 18 aa, Entamoeba dispar
KYEMILAGIYYIVLDLIN

SEQ ID NO: 2492517 - protein, 19 aa, Entamoeba dispar
KYEMLLCQMIQKYLYFISQ

SEQ ID NO: 2492518 - protein, 20 aa, Entamoeba dispar
KYESLFLFDSEDSYIGEITK

SEQ ID NO: 2492519 - protein, 25 aa, Entamoeba dispar
KYEVHCYWRNGAIVVIEDTDGSGKG

SEQ ID NO: 2492520 - protein, 22 aa, Entamoeba dispar
KYFETICAYSQLFGVVSSMIDN

SEQ ID NO: 2492521 - protein, 20 aa, Entamoeba dispar
KYFIGIPIIEKSFFHKFYEP

SEQ ID NO: 2492522 - protein, 22 aa, Entamoeba dispar
KYFKEGYYQYHFIQEASDDEIV

SEQ ID NO: 2492523 - protein, 30 aa, Entamoeba dispar
KYFKEIVNILLRPCCFKFLHIPIQSGSSSV

SEQ ID NO: 2492524 - protein, 21 aa, Entamoeba dispar
KYFLNDQCFEFYSRPLWYHVQ

SEQ ID NO: 2492525 - protein, 24 aa, Entamoeba dispar
KYFMKYKRCQGGYQGKTLDQILTM

SEQ ID NO: 2492526 - protein, 22 aa, Entamoeba dispar
KYFPTKCHRFLKLLNDKGILKM

SEQ ID NO: 2492527 - protein, 17 aa, Entamoeba dispar
KYFQFISQLAFSLPIIL

SEQ ID NO: 2492528 - protein, 17 aa, Entamoeba dispar
KYFQVLPEIAMKSAYKS

SEQ ID NO: 2492529 - protein, 19 aa, Entamoeba dispar
KYFRFGNIFCMSKQLYMKR

SEQ ID NO: 2492530 - protein, 19 aa, Entamoeba dispar
KYFRKPVREPTQFSPFIHI

SEQ ID NO: 2492531 - protein, 17 aa, Entamoeba dispar
KYFSSPIGELRNFEYNY

SEQ ID NO: 2492532 - protein, 21 aa, Entamoeba dispar
KYGDFKGVLLSVIRKNDRKLL

SEQ ID NO: 2492533 - protein, 18 aa, Entamoeba dispar
KYGFNGSHSEFFKDLQQN

SEQ ID NO: 2492534 - protein, 17 aa, Entamoeba dispar
KYGKIVMNVLYSLQNEF

SEQ ID NO: 2492535 - protein, 23 aa, Entamoeba dispar
KYGKKVSVRNCLAWTEFMNNCKK

SEQ ID NO: 2492536 - protein, 24 aa, Entamoeba dispar
KYGKLLGLKGHALYKEKSKQYKLL

SEQ ID NO: 2492537 - protein, 24 aa, Entamoeba dispar
KYGKSRSASLLTFYLLKKYQITIN

SEQ ID NO: 2492538 - protein, 23 aa, Entamoeba dispar
KYGNCYECPICFQKARIRTKSTV

SEQ ID NO: 2492539 - protein, 28 aa, Entamoeba dispar
KYGNSDVWKMCCDLFDLLALSALIDNRI

SEQ ID NO: 2492540 - protein, 26 aa, Entamoeba dispar
KYGPGCFYGCISLPFRLILPPISLRK

SEQ ID NO: 2492541 - protein, 27 aa, Entamoeba dispar
KYGPGCFYGCISLPFRLILPPISLRKV

SEQ ID NO: 2492542 - protein, 25 aa, Entamoeba dispar
KYGRNALLFNLCFVFDEGTTDGTIS

SEQ ID NO: 2492543 - protein, 27 aa, Entamoeba dispar
KYGSCPHGGYGLGVERLVMWLLGEDHI

SEQ ID NO: 2492544 - protein, 19 aa, Entamoeba dispar
KYHLAEGFHKTGVIECEMA

SEQ ID NO: 2492545 - protein, 20 aa, Entamoeba dispar
KYICELKEKYQINCENEMIS

SEQ ID NO: 2492546 - protein, 18 aa, Entamoeba dispar
KYIERYPSLLLLLKEKDI

SEQ ID NO: 2492547 - protein, 39 aa, Entamoeba dispar
KYIETHPTMTWSDFCKDKTLIRPQRIVTITKCPSHSSSQ

SEQ ID NO: 2492548 - protein, 21 aa, Entamoeba dispar
KYIGIQFHNVYNFGFGDTDIN

SEQ ID NO: 2492549 - protein, 23 aa, Entamoeba dispar
KYIGNNFFKGCTSLQTINIPSSI

SEQ ID NO: 2492550 - protein, 20 aa, Entamoeba dispar
KYIHQVLDGLAFIHDQGIVH

SEQ ID NO: 2492551 - protein, 17 aa, Entamoeba dispar
KYIIGHAELKYIFTSNE

SEQ ID NO: 2492552 - protein, 26 aa, Entamoeba dispar
KYIIPGEFWLYYVINVNKHKEEYLKY

SEQ ID NO: 2492553 - protein, 24 aa, Entamoeba dispar
KYIKESIPFFYKWTKLNQCRLVFD

SEQ ID NO: 2492554 - protein, 17 aa, Entamoeba dispar
KYIKLPYVVKGMDISLT

SEQ ID NO: 2492555 - protein, 23 aa, Entamoeba dispar
KYIKNDKDFFVFSLRSKELTQPV

SEQ ID NO: 2492556 - protein, 23 aa, Entamoeba dispar
KYIKRFDFKNEVVVLELRHTNED

SEQ ID NO: 2492557 - protein, 18 aa, Entamoeba dispar
KYILKGIIVHFGTVNIGH

SEQ ID NO: 2492558 - protein, 24 aa, Entamoeba dispar
KYINYAFIRFSRFVGNCITKSQKI

SEQ ID NO: 2492559 - protein, 33 aa, Entamoeba dispar
KYIPIAPCKRKAFDMDEPNRFMVFPVKTPKCPT

SEQ ID NO: 2492560 - protein, 20 aa, Entamoeba dispar
KYIRALRSAVFVLGLSKESK

SEQ ID NO: 2492561 - protein, 27 aa, Entamoeba dispar
KYIRSDLREVLKINPKIYPTSYPSDPS

SEQ ID NO: 2492562 - protein, 25 aa, Entamoeba dispar
KYIVKLNYLRDVVVARFLDEASSRY

SEQ ID NO: 2492563 - protein, 20 aa, Entamoeba dispar
KYKCKSYCEVVNKLLNIYDS

SEQ ID NO: 2492564 - protein, 20 aa, Entamoeba dispar
KYKEIPDRLPAEDVEEKKDV

SEQ ID NO: 2492565 - protein, 24 aa, Entamoeba dispar
KYKGPSILILPHFFKKIIQDQILF

SEQ ID NO: 2492566 - protein, 17 aa, Entamoeba dispar
KYKGTAFARTFIYILEL

SEQ ID NO: 2492567 - protein, 20 aa, Entamoeba dispar
KYKHYRCFYNSSLDGLYSAK

SEQ ID NO: 2492568 - protein, 23 aa, Entamoeba dispar
KYKKYRIELPIDRNITTGYSVDV

SEQ ID NO: 2492569 - protein, 19 aa, Entamoeba dispar
KYKNGACDRVVCPTDEERE

SEQ ID NO: 2492570 - protein, 35 aa, Entamoeba dispar
KYKNVSICFKLIIKECLLIRQMLRTQLTKCSIITA

SEQ ID NO: 2492571 - protein, 23 aa, Entamoeba dispar
KYKQEIPKTISYGGNTTKKPNTL

SEQ ID NO: 2492572 - protein, 17 aa, Entamoeba dispar
KYKRTGEKFALKMVEKK

SEQ ID NO: 2492573 - protein, 17 aa, Entamoeba dispar
KYKTAYTNTHFNLHLLR

SEQ ID NO: 2492574 - protein, 26 aa, Entamoeba dispar
KYKTYKLPEKIIFYIKSHLNDERALL

SEQ ID NO: 2492575 - protein, 19 aa, Entamoeba dispar
KYLAYARANIHPQLNEEAK

SEQ ID NO: 2492576 - protein, 20 aa, Entamoeba dispar
KYLCEGCEWKTEIVKKKYHE

SEQ ID NO: 2492577 - protein, 25 aa, Entamoeba dispar
KYLENFPRELIEMIKKCKLNSQSKV

SEQ ID NO: 2492578 - protein, 19 aa, Entamoeba dispar
KYLFYYAVVAYLIQIKDDI

SEQ ID NO: 2492579 - protein, 22 aa, Entamoeba dispar
KYLINDPKFFVFSLKAYNSSIS

SEQ ID NO: 2492580 - protein, 25 aa, Entamoeba dispar
KYLKERGIEVIKMPVNEDGIVDPKD

SEQ ID NO: 2492581 - protein, 20 aa, Entamoeba dispar
KYLLKYFLTLCEDFDKKLKG

SEQ ID NO: 2492582 - protein, 33 aa, Entamoeba dispar
KYLLQGWTMLGSCCVQHPTVPLMRERGGKKCIC

SEQ ID NO: 2492583 - protein, 24 aa, Entamoeba dispar
KYLNEACPMEMTFAEVILVLKANY

SEQ ID NO: 2492584 - protein, 17 aa, Entamoeba dispar
KYLNLTNCFGINGDSIL

SEQ ID NO: 2492585 - protein, 20 aa, Entamoeba dispar
KYLNWCLKETNDLLIHLSNK

SEQ ID NO: 2492586 - protein, 20 aa, Entamoeba dispar
KYLPQLSSYISRMYREENKQ

SEQ ID NO: 2492587 - protein, 19 aa, Entamoeba dispar
KYLQSFCALHNIIIHLVYF

SEQ ID NO: 2492588 - protein, 22 aa, Entamoeba dispar
KYLRAICDSIIIYYEMFKNEFR

SEQ ID NO: 2492589 - protein, 18 aa, Entamoeba dispar
KYLSTFFPINAIFKSALQ

SEQ ID NO: 2492590 - protein, 21 aa, Entamoeba dispar
KYLTQLLKEFGDDVNELRMKA

SEQ ID NO: 2492591 - protein, 24 aa, Entamoeba dispar
KYLTYVEHYICLADIFQKQAFNQP

SEQ ID NO: 2492592 - protein, 26 aa, Entamoeba dispar
KYLYDILCKILNGWNEQEFIDFFYKE

SEQ ID NO: 2492593 - protein, 23 aa, Entamoeba dispar
KYLYLELFKSYDFTERKCYYGVI

SEQ ID NO: 2492594 - protein, 29 aa, Entamoeba dispar
KYMECSALTRKGLKEVFETAVKYVLENNA

SEQ ID NO: 2492595 - protein, 20 aa, Entamoeba dispar
KYMGIECSYAQFKDSKTRIT

SEQ ID NO: 2492596 - protein, 18 aa, Entamoeba dispar
KYMIFSYQFADFITNFED

SEQ ID NO: 2492597 - protein, 32 aa, Entamoeba dispar
KYMKMFKGLCYNRIKTKCVIPYNSERMILLET

SEQ ID NO: 2492598 - protein, 22 aa, Entamoeba dispar
KYNCKVDSSLLFTLQNYSKSSF

SEQ ID NO: 2492599 - protein, 24 aa, Entamoeba dispar
KYNDCQRINYDFLNLLKTTVLMND

SEQ ID NO: 2492600 - protein, 22 aa, Entamoeba dispar
KYNEFFIAITFTTKVSKNEKFQ

SEQ ID NO: 2492601 - protein, 24 aa, Entamoeba dispar
KYNIPEVLITLSLDKVKIDNLREF

SEQ ID NO: 2492602 - protein, 24 aa, Entamoeba dispar
KYNKEVICVMGKLGKLIGTIHKKG

SEQ ID NO: 2492603 - protein, 31 aa, Entamoeba dispar
KYNPPRNTIHIFASTLLRYFDDQIKEIYDCR

SEQ ID NO: 2492604 - protein, 18 aa, Entamoeba dispar
KYNPRKGVKTGIVINEES

SEQ ID NO: 2492605 - protein, 19 aa, Entamoeba dispar
KYPDFKLPVLDPINDMKIK

SEQ ID NO: 2492606 - protein, 23 aa, Entamoeba dispar
KYPELPFGIFFIYNKNFFGFQIR

SEQ ID NO: 2492607 - protein, 19 aa, Entamoeba dispar
KYPEVSVPIIFLLMRDTVI

SEQ ID NO: 2492608 - protein, 25 aa, Entamoeba dispar
KYPHLPFFFHCRKSWSDLCQLNKEL

SEQ ID NO: 2492609 - protein, 27 aa, Entamoeba dispar
KYPILKNSWKLVLSIFDFNSSCRQNSE

SEQ ID NO: 2492610 - protein, 33 aa, Entamoeba dispar
KYPLGCAVSKSGWRYPIPIYRGIEYLQKNKGSE

SEQ ID NO: 2492611 - protein, 20 aa, Entamoeba dispar
KYPLPKCDWIALPDFEAGAM

SEQ ID NO: 2492612 - protein, 21 aa, Entamoeba dispar
KYPRLYYTWIDKVVQTQEKSG

SEQ ID NO: 2492613 - protein, 18 aa, Entamoeba dispar
KYPSLLIESVYKLNEGPI

SEQ ID NO: 2492614 - protein, 23 aa, Entamoeba dispar
KYQCLSFSLVQIFKRLLTEPTSE

SEQ ID NO: 2492615 - protein, 22 aa, Entamoeba dispar
KYQDYELCLGKNFTKNNQLIGT

SEQ ID NO: 2492616 - protein, 20 aa, Entamoeba dispar
KYQESWDRQPSNIVGREVYN

SEQ ID NO: 2492617 - protein, 19 aa, Entamoeba dispar
KYQGKCIPMSFRDDVQRLM

SEQ ID NO: 2492618 - protein, 18 aa, Entamoeba dispar
KYQKEFIQGTEIENKIFD

SEQ ID NO: 2492619 - protein, 29 aa, Entamoeba dispar
KYQKIGELCIQCWKGLIKYKEIQTKLKEY

SEQ ID NO: 2492620 - protein, 23 aa, Entamoeba dispar
KYQMSLKVAFQYVSDRRHIVCPN

SEQ ID NO: 2492621 - protein, 17 aa, Entamoeba dispar
KYQWKWDTRGFIIHDCE

SEQ ID NO: 2492622 - protein, 17 aa, Entamoeba dispar
KYRDGRTKKHIEYNEDK

SEQ ID NO: 2492623 - protein, 19 aa, Entamoeba dispar
KYREEFIPIIEVSRLLTMP

SEQ ID NO: 2492624 - protein, 25 aa, Entamoeba dispar
KYRKHEVIIKAIFVDKVRKIISYIK

SEQ ID NO: 2492625 - protein, 26 aa, Entamoeba dispar
KYRLKEMFQDFNFIKKCWVVTKKLLN

SEQ ID NO: 2492626 - protein, 20 aa, Entamoeba dispar
KYRLKEMFSNFNLLIQCWDI

SEQ ID NO: 2492627 - protein, 19 aa, Entamoeba dispar
KYRPSYIPLTVRRTAQVPL

SEQ ID NO: 2492628 - protein, 25 aa, Entamoeba dispar
KYRQWQLALRRAISFVDFLKDSSDD

SEQ ID NO: 2492629 - protein, 20 aa, Entamoeba dispar
KYRSSPLLHLSWLNNIIEKE

SEQ ID NO: 2492630 - protein, 23 aa, Entamoeba dispar
KYSEGPFNIIFKIIKENTGEYIG

SEQ ID NO: 2492631 - protein, 24 aa, Entamoeba dispar
KYSELKRYTLLLTNLPHKRLRDVA

SEQ ID NO: 2492632 - protein, 20 aa, Entamoeba dispar
KYSGHGFGCRVMQRIIEKRF

SEQ ID NO: 2492633 - protein, 22 aa, Entamoeba dispar
KYSGLAFKCNRTYLDGKFTMTS

SEQ ID NO: 2492634 - protein, 26 aa, Entamoeba dispar
KYSKCFLSIRTTFWDEVNPMKFHIIT

SEQ ID NO: 2492635 - protein, 17 aa, Entamoeba dispar
KYSNLFSQFLIAKLINA

SEQ ID NO: 2492636 - protein, 17 aa, Entamoeba dispar
KYSRFLQKSGFDIKKDS

SEQ ID NO: 2492637 - protein, 25 aa, Entamoeba dispar
KYSSFKSLHVQFPFSNSSILVNSFT

SEQ ID NO: 2492638 - protein, 19 aa, Entamoeba dispar
KYSSFKSLLVQFPFSNSSI

SEQ ID NO: 2492639 - protein, 20 aa, Entamoeba dispar
KYSTLKCPHAQFTEAINKFV

SEQ ID NO: 2492640 - protein, 18 aa, Entamoeba dispar
KYSTVFIFYTPVLRSKFM

SEQ ID NO: 2492641 - protein, 25 aa, Entamoeba dispar
KYSYGMICWEMITRLITGEHVIPYY

SEQ ID NO: 2492642 - protein, 23 aa, Entamoeba dispar
KYSYLKPQFEQMIISKTEKDPTL

SEQ ID NO: 2492643 - protein, 21 aa, Entamoeba dispar
KYTDLSICERIFKELCCAVQF

SEQ ID NO: 2492644 - protein, 24 aa, Entamoeba dispar
KYTHCVQCQKTVLLSLTINCQFCG

SEQ ID NO: 2492645 - protein, 18 aa, Entamoeba dispar
KYTKEIYLYSFGDSISRG

SEQ ID NO: 2492646 - protein, 24 aa, Entamoeba dispar
KYTKEIYLYSFGDSISRGTSTCNM

SEQ ID NO: 2492647 - protein, 19 aa, Entamoeba dispar
KYTKTRQYLEHLMQNINNI

SEQ ID NO: 2492648 - protein, 19 aa, Entamoeba dispar
KYTMVRDIIKGELKIKDEV

SEQ ID NO: 2492649 - protein, 26 aa, Entamoeba dispar
KYTPDFEWYCNIVIHILELNKVEPMQ

SEQ ID NO: 2492650 - protein, 17 aa, Entamoeba dispar
KYTSYFIDCLKLCPIEI

SEQ ID NO: 2492651 - protein, 24 aa, Entamoeba dispar
KYTYPEGILSINFNFRLYTQQNNF

SEQ ID NO: 2492652 - protein, 20 aa, Entamoeba dispar
KYVECYLINDMLWLVTELMD

SEQ ID NO: 2492653 - protein, 17 aa, Entamoeba dispar
KYVEFAVGLGKVHQFME

SEQ ID NO: 2492654 - protein, 19 aa, Entamoeba dispar
KYVFPSLYLHIFNNEVEMK

SEQ ID NO: 2492655 - protein, 19 aa, Entamoeba dispar
KYVISYVVETLFNKKNHLL

SEQ ID NO: 2492656 - protein, 20 aa, Entamoeba dispar
KYVIWYEVNYSTYLKEKEAR

SEQ ID NO: 2492657 - protein, 18 aa, Entamoeba dispar
KYVIWYLVEYSKYLQEKE

SEQ ID NO: 2492658 - protein, 17 aa, Entamoeba dispar
KYVKALFTLASKLSPCV

SEQ ID NO: 2492659 - protein, 19 aa, Entamoeba dispar
KYVKMILGHISLLFSPENR

SEQ ID NO: 2492660 - protein, 31 aa, Entamoeba dispar
KYVRCIAALIIRYSIQFNLLLSYLKPFVDDR

SEQ ID NO: 2492661 - protein, 20 aa, Entamoeba dispar
KYVRSNEHLYVFLNKGPLQF

SEQ ID NO: 2492662 - protein, 23 aa, Entamoeba dispar
KYWKFKDKRDVGFALASLEETLV

SEQ ID NO: 2492663 - protein, 19 aa, Entamoeba dispar
KYYEVLKRITETYELVIKK

SEQ ID NO: 2492664 - protein, 19 aa, Entamoeba dispar
KYYGFRFDTIKALNEVFEG

SEQ ID NO: 2492665 - protein, 20 aa, Entamoeba dispar
KYYGLIPFNNCWPAKLFVQK

SEQ ID NO: 2492666 - protein, 31 aa, Entamoeba dispar
KYYHLAKQYGYRARSAFKLVQMNKRYDFLSS

SEQ ID NO: 2492667 - protein, 18 aa, Entamoeba dispar
KYYILKKINKIISEGGIS

SEQ ID NO: 2492668 - protein, 21 aa, Entamoeba dispar
KYYNDFTFFIALRNCINETTK

SEQ ID NO: 2492669 - protein, 35 aa, Entamoeba dispar
KYYQIHNLYHKWSVDGISFCLLKKQFIKFKSLLHQ

SEQ ID NO: 2492670 - protein, 17 aa, Entamoeba dispar
KYYYLVMEYCNFGTLAQ

SEQ ID NO: 2492671 - protein, 22 aa, Entamoeba dispar
KYYYYHLLLWPSITYLAESVDG

SEQ ID NO: 2492672 - protein, 19 aa, Entamoeba dispar
LAARLASFYERAGMVECLG

SEQ ID NO: 2492673 - protein, 18 aa, Entamoeba dispar
LAAVSVPVGLFIELDNEK

SEQ ID NO: 2492674 - protein, 17 aa, Entamoeba dispar
LACGLGAICIAQLLQTK

SEQ ID NO: 2492675 - protein, 21 aa, Entamoeba dispar
LACKNHKEVYCSQNDKCSEIM

SEQ ID NO: 2492676 - protein, 17 aa, Entamoeba dispar
LADCPGMMFPMINQSQL

SEQ ID NO: 2492677 - protein, 21 aa, Entamoeba dispar
LADMGICCIDEFDKMDETDRT

SEQ ID NO: 2492678 - protein, 23 aa, Entamoeba dispar
LADPDTVQMLFGIITAQVEAGNI

SEQ ID NO: 2492679 - protein, 20 aa, Entamoeba dispar
LADRGIVCVDEFDKMSIEDR

SEQ ID NO: 2492680 - protein, 28 aa, Entamoeba dispar
LADVGLPLKMISILEAHSFFTEKSIGYV

SEQ ID NO: 2492681 - protein, 19 aa, Entamoeba dispar
LADVLEEWNGLGFNSRGKR

SEQ ID NO: 2492682 - protein, 25 aa, Entamoeba dispar
LAECKGCRDEMQDFMCFSENFVQKG

SEQ ID NO: 2492683 - protein, 20 aa, Entamoeba dispar
LAEEAALLMAQFMGDSSEED

SEQ ID NO: 2492684 - protein, 19 aa, Entamoeba dispar
LAEEWKIPFFETSAQNNIN

SEQ ID NO: 2492685 - protein, 22 aa, Entamoeba dispar
LAEGMLKQCCKLEEEVRTLETM

SEQ ID NO: 2492686 - protein, 25 aa, Entamoeba dispar
LAEHLKRTGGIYVTRFPPEPNGYLH

SEQ ID NO: 2492687 - protein, 25 aa, Entamoeba dispar
LAEKLRYPILPVIRKQFSDGELYYK

SEQ ID NO: 2492688 - protein, 22 aa, Entamoeba dispar
LAEPEIKKEVIVIKKDIIQVDD

SEQ ID NO: 2492689 - protein, 23 aa, Entamoeba dispar
LAEQWKVLFFETSAKAKINITET

SEQ ID NO: 2492690 - protein, 19 aa, Entamoeba dispar
LAERNGINLNEFVEYAQNF

SEQ ID NO: 2492691 - protein, 17 aa, Entamoeba dispar
LAEVCADAVLSVYDKER

SEQ ID NO: 2492692 - protein, 17 aa, Entamoeba dispar
LAEYLVYENRVISNIEE

SEQ ID NO: 2492693 - protein, 22 aa, Entamoeba dispar
LAFSTCFVCHQMGHISRDCPNN

SEQ ID NO: 2492694 - protein, 19 aa, Entamoeba dispar
LAFTEGCSSFIRMLYEFDD

SEQ ID NO: 2492695 - protein, 25 aa, Entamoeba dispar
LAFVPLKLFYDFLIPKILNEKSLYG

SEQ ID NO: 2492696 - protein, 22 aa, Entamoeba dispar
LAGCIKRGWAKDVGIPVEDLYT

SEQ ID NO: 2492697 - protein, 19 aa, Entamoeba dispar
LAGFSKARTFSIQWKDKEE

SEQ ID NO: 2492698 - protein, 18 aa, Entamoeba dispar
LAGIRPIKELTRELPKLH

SEQ ID NO: 2492699 - protein, 18 aa, Entamoeba dispar
LAHLIKAKVIPDCVSSIW

SEQ ID NO: 2492700 - protein, 17 aa, Entamoeba dispar
LAHLPSCVLYLMDVSGS

SEQ ID NO: 2492701 - protein, 20 aa, Entamoeba dispar
LAHRLNCWGNVNILNCSIDQ

SEQ ID NO: 2492702 - protein, 21 aa, Entamoeba dispar
LAIALPLIRKILFPSLKTQTP

SEQ ID NO: 2492703 - protein, 20 aa, Entamoeba dispar
LAICIYPNQQILCFVNGNFI

SEQ ID NO: 2492704 - protein, 19 aa, Entamoeba dispar
LAICSCKILTSIDTNLAQL

SEQ ID NO: 2492705 - protein, 20 aa, Entamoeba dispar
LAIDCNLFKTVALSSIVNTE

SEQ ID NO: 2492706 - protein, 17 aa, Entamoeba dispar
LAIEVERPAKKGIKNQV

SEQ ID NO: 2492707 - protein, 17 aa, Entamoeba dispar
LAIFSMAEVDAIKKSGN

SEQ ID NO: 2492708 - protein, 17 aa, Entamoeba dispar
LAIGCLVICEYPSGKEL

SEQ ID NO: 2492709 - protein, 18 aa, Entamoeba dispar
LAILRIIHHPNIIDYYAS

SEQ ID NO: 2492710 - protein, 18 aa, Entamoeba dispar
LAINYCNEDPYLVANLVK

SEQ ID NO: 2492711 - protein, 18 aa, Entamoeba dispar
LAIRCYESALVLDTICID

SEQ ID NO: 2492712 - protein, 20 aa, Entamoeba dispar
LAITTLRYFNEFILSRILEN

SEQ ID NO: 2492713 - protein, 25 aa, Entamoeba dispar
LAKEFLMKMSYSFDTQFPIKEMIGK

SEQ ID NO: 2492714 - protein, 20 aa, Entamoeba dispar
LAKESVKVILEMKKPQDDEY

SEQ ID NO: 2492715 - protein, 22 aa, Entamoeba dispar
LAKKFHHCKEIFFNTTELNLLE

SEQ ID NO: 2492716 - protein, 24 aa, Entamoeba dispar
LAKKRAERAKKFAISDSDDDDEDI

SEQ ID NO: 2492717 - protein, 19 aa, Entamoeba dispar
LAKNMLFCALQIKRTIEDR

SEQ ID NO: 2492718 - protein, 25 aa, Entamoeba dispar
LAKPSSLPFLKLVLSIPPSLAQQIN

SEQ ID NO: 2492719 - protein, 19 aa, Entamoeba dispar
LAKRTHIIVQLCLDSVESN

SEQ ID NO: 2492720 - protein, 17 aa, Entamoeba dispar
LAKSIRNMMLIRLRRIY

SEQ ID NO: 2492721 - protein, 17 aa, Entamoeba dispar
LALECLHQMNVIYRDVK

SEQ ID NO: 2492722 - protein, 20 aa, Entamoeba dispar
LALGCAHLIMHINAVAQGKS

SEQ ID NO: 2492723 - protein, 18 aa, Entamoeba dispar
LALHPSVVNCLTPSQRTE

SEQ ID NO: 2492724 - protein, 26 aa, Entamoeba dispar
LALHYCDRAGIIIVRVGSTFDLKRLC

SEQ ID NO: 2492725 - protein, 21 aa, Entamoeba dispar
LALKKPYWSLVYRIANGKGLM

SEQ ID NO: 2492726 - protein, 23 aa, Entamoeba dispar
LALLHPFCGFTIRRPIKASTATN

SEQ ID NO: 2492727 - protein, 18 aa, Entamoeba dispar
LALNTKVSNDLSITELYD

SEQ ID NO: 2492728 - protein, 21 aa, Entamoeba dispar
LALTTLQYYLPLFRMAEHLKR

SEQ ID NO: 2492729 - protein, 24 aa, Entamoeba dispar
LALVEGYDSMGFEFSRPQLRAETE

SEQ ID NO: 2492730 - protein, 17 aa, Entamoeba dispar
LALWDTAGQEKYRSMVS

SEQ ID NO: 2492731 - protein, 29 aa, Entamoeba dispar
LAMLKEAKRYAAILNRYKVLKAHGMKVVS

SEQ ID NO: 2492732 - protein, 21 aa, Entamoeba dispar
LAMTCPGVMRFNKEKNAKKLA

SEQ ID NO: 2492733 - protein, 18 aa, Entamoeba dispar
LANAIPYYTSRVLAENHT

SEQ ID NO: 2492734 - protein, 23 aa, Entamoeba dispar
LANCERLKCVYCHRSQKPELTVN

SEQ ID NO: 2492735 - protein, 24 aa, Entamoeba dispar
LANGEIQQFLSLIFFIGQKSGTRI

SEQ ID NO: 2492736 - protein, 17 aa, Entamoeba dispar
LANKGGVAYRMKVYDST

SEQ ID NO: 2492737 - protein, 17 aa, Entamoeba dispar
LANSGAVGARYSVGVCF

SEQ ID NO: 2492738 - protein, 19 aa, Entamoeba dispar
LAPCGSFDKCLKEMNYEIK

SEQ ID NO: 2492739 - protein, 19 aa, Entamoeba dispar
LAPDVLRNLDVWEAFTQHM

SEQ ID NO: 2492740 - protein, 19 aa, Entamoeba dispar
LAPFAKGGERLAFRAINGY

SEQ ID NO: 2492741 - protein, 18 aa, Entamoeba dispar
LAPLPPLPPKVHGKRKKA

SEQ ID NO: 2492742 - protein, 17 aa, Entamoeba dispar
LAQCKNIAFPLFPQIVL

SEQ ID NO: 2492743 - protein, 18 aa, Entamoeba dispar
LAQDDVLGDAVVRAQDVK

SEQ ID NO: 2492744 - protein, 17 aa, Entamoeba dispar
LAQEAKQSMAEAAAHSR

SEQ ID NO: 2492745 - protein, 18 aa, Entamoeba dispar
LAQKLCGLDKTAFVKYKW

SEQ ID NO: 2492746 - protein, 20 aa, Entamoeba dispar
LAQSVARLRFSNEVNSQDVD

SEQ ID NO: 2492747 - protein, 20 aa, Entamoeba dispar
LARIKLNELIQVIKSPDIIP

SEQ ID NO: 2492748 - protein, 17 aa, Entamoeba dispar
LASCMWFEQPLIRNLYF

SEQ ID NO: 2492749 - protein, 21 aa, Entamoeba dispar
LASEERKSFPFPEHTKTPQRS

SEQ ID NO: 2492750 - protein, 20 aa, Entamoeba dispar
LASGKLGYPHRGFPDKFIER

SEQ ID NO: 2492751 - protein, 33 aa, Entamoeba dispar
LASIKDWLSVLAEIFKANIIAWEYPGYTKGSHY

SEQ ID NO: 2492752 - protein, 18 aa, Entamoeba dispar
LASIKEIVERSFAVKTLV

SEQ ID NO: 2492753 - protein, 23 aa, Entamoeba dispar
LASIRRIAFIIAKTEYNCPYTQG

SEQ ID NO: 2492754 - protein, 33 aa, Entamoeba dispar
LASPLKFTLPINCYSSWINLALLIIFKSPFPNK

SEQ ID NO: 2492755 - protein, 22 aa, Entamoeba dispar
LASPPPKFFALKNRGITKIKEQ

SEQ ID NO: 2492756 - protein, 17 aa, Entamoeba dispar
LASQLSVCLDNHAKIYY

SEQ ID NO: 2492757 - protein, 23 aa, Entamoeba dispar
LASRLPLVVDVNHMMTHLIECAY

SEQ ID NO: 2492758 - protein, 24 aa, Entamoeba dispar
LASSNPRLFVCSASSEINEVIFSA

SEQ ID NO: 2492759 - protein, 29 aa, Entamoeba dispar
LASTPYLYHYTLRCMKSFIESIRPNVNVI

SEQ ID NO: 2492760 - protein, 21 aa, Entamoeba dispar
LASVEIRLAKILVEPFNSLLQ

SEQ ID NO: 2492761 - protein, 19 aa, Entamoeba dispar
LATEFLSFIASEAADVPKG

SEQ ID NO: 2492762 - protein, 25 aa, Entamoeba dispar
LATGAKHPVCLYVSGSNTQVIAFSL

SEQ ID NO: 2492763 - protein, 21 aa, Entamoeba dispar
LATKISREYQCHRIIQPDPLM

SEQ ID NO: 2492764 - protein, 21 aa, Entamoeba dispar
LATKIVCLRVFNDLFETFIEN

SEQ ID NO: 2492765 - protein, 19 aa, Entamoeba dispar
LATRKACNTSNCPPKPKHI

SEQ ID NO: 2492766 - protein, 18 aa, Entamoeba dispar
LAVEFKNDHVVGFDLAGP

SEQ ID NO: 2492767 - protein, 29 aa, Entamoeba dispar
LAYLNSTLSWICIYLTKSLRNERNEKVNQ

SEQ ID NO: 2492768 - protein, 19 aa, Entamoeba dispar
LAYYVIILFDENCDIHFEN

SEQ ID NO: 2492769 - protein, 17 aa, Entamoeba dispar
LCADAPGSIILNILKDS

SEQ ID NO: 2492770 - protein, 18 aa, Entamoeba dispar
LCATCYLLNDWGNINKEI

SEQ ID NO: 2492771 - protein, 18 aa, Entamoeba dispar
LCCDSVFHIDCKPLRDCK

SEQ ID NO: 2492772 - protein, 20 aa, Entamoeba dispar
LCCNCGYHPSVEYEYSNGTE

SEQ ID NO: 2492773 - protein, 17 aa, Entamoeba dispar
LCCRALKSINIPSSVRE

SEQ ID NO: 2492774 - protein, 21 aa, Entamoeba dispar
LCCTSIKTSVSPFLDSIYINA

SEQ ID NO: 2492775 - protein, 17 aa, Entamoeba dispar
LCDCPGLVFPSFLSSKE

SEQ ID NO: 2492776 - protein, 25 aa, Entamoeba dispar
LCDECPLAKHYVCKYYCKKHNHHLQ

SEQ ID NO: 2492777 - protein, 20 aa, Entamoeba dispar
LCDEIQYCISCQIRSVNPKV

SEQ ID NO: 2492778 - protein, 20 aa, Entamoeba dispar
LCDELLRQSILIGKYPFDIH

SEQ ID NO: 2492779 - protein, 18 aa, Entamoeba dispar
LCDEPMEGLIFIIDEILI

SEQ ID NO: 2492780 - protein, 26 aa, Entamoeba dispar
LCDSKLPDSMKICYATILHNIHPVIH

SEQ ID NO: 2492781 - protein, 20 aa, Entamoeba dispar
LCDSLQTLLFCLRGSSELYS

SEQ ID NO: 2492782 - protein, 22 aa, Entamoeba dispar
LCEETRFSRGFSGEMKGETTKT

SEQ ID NO: 2492783 - protein, 21 aa, Entamoeba dispar
LCELLKSTVFERLKVLETIKT

SEQ ID NO: 2492784 - protein, 25 aa, Entamoeba dispar
LCEVHMICFIASFLEGGEAFNSLNK

SEQ ID NO: 2492785 - protein, 18 aa, Entamoeba dispar
LCFLDKVVQIGCYGDAAT

SEQ ID NO: 2492786 - protein, 18 aa, Entamoeba dispar
LCGCKSLQQLSFKSPLLK

SEQ ID NO: 2492787 - protein, 22 aa, Entamoeba dispar
LCGEESFGTGCCGIREKDGIWA

SEQ ID NO: 2492788 - protein, 21 aa, Entamoeba dispar
LCGHDTAITCCIIDNNNNIII

SEQ ID NO: 2492789 - protein, 20 aa, Entamoeba dispar
LCGIPSSGLGNLFMLMDLHT

SEQ ID NO: 2492790 - protein, 17 aa, Entamoeba dispar
LCGKKTFFVYDARPKLN

SEQ ID NO: 2492791 - protein, 20 aa, Entamoeba dispar
LCGTEFFQHYAGMYDQFKID

SEQ ID NO: 2492792 - protein, 22 aa, Entamoeba dispar
LCGTKFSALVLELNASDERGID

SEQ ID NO: 2492793 - protein, 19 aa, Entamoeba dispar
LCHSRLYSAILEQFGVALL

SEQ ID NO: 2492794 - protein, 17 aa, Entamoeba dispar
LCHYFDHYFVPRPVDVF

SEQ ID NO: 2492795 - protein, 19 aa, Entamoeba dispar
LCIAIKPEILFLHLEAKYS

SEQ ID NO: 2492796 - protein, 23 aa, Entamoeba dispar
LCICNDIRFPAFLRNLKLEYDVI

SEQ ID NO: 2492797 - protein, 17 aa, Entamoeba dispar
LCIGCALCVKKCPFEAI

SEQ ID NO: 2492798 - protein, 20 aa, Entamoeba dispar
LCIGHKLIKENIDLINNTSY

SEQ ID NO: 2492799 - protein, 18 aa, Entamoeba dispar
LCIHPNVVEFHDYFECEN

SEQ ID NO: 2492800 - protein, 18 aa, Entamoeba dispar
LCIIKESQMLTGTLDKNQ

SEQ ID NO: 2492801 - protein, 26 aa, Entamoeba dispar
LCIMACCGNDAIGCFVRKPIESTNKC

SEQ ID NO: 2492802 - protein, 24 aa, Entamoeba dispar
LCINGTGCLYSFVKKLLDSDYETM

SEQ ID NO: 2492803 - protein, 25 aa, Entamoeba dispar
LCIYCVARFSFRIGERYYSQSMEEI

SEQ ID NO: 2492804 - protein, 26 aa, Entamoeba dispar
LCIYCVARFSFRIGERYYSQSMEEII

SEQ ID NO: 2492805 - protein, 21 aa, Entamoeba dispar
LCIYFDEWFENFHLINNYEGF

SEQ ID NO: 2492806 - protein, 20 aa, Entamoeba dispar
LCKEGLTFFDDIPKTSTFNI

SEQ ID NO: 2492807 - protein, 17 aa, Entamoeba dispar
LCKHPNLVEYKDYFEWN

SEQ ID NO: 2492808 - protein, 17 aa, Entamoeba dispar
LCKKICKRTEYPCIQCM

SEQ ID NO: 2492809 - protein, 22 aa, Entamoeba dispar
LCKPALSLLLTFFSKKVISNDI

SEQ ID NO: 2492810 - protein, 19 aa, Entamoeba dispar
LCKSCKGKGTKSGNEPKRC

SEQ ID NO: 2492811 - protein, 20 aa, Entamoeba dispar
LCLIFPYSPPHFSYSLDARK

SEQ ID NO: 2492812 - protein, 21 aa, Entamoeba dispar
LCLIVESMSAPQWFVPVKAGD

SEQ ID NO: 2492813 - protein, 20 aa, Entamoeba dispar
LCLKNAIAARDSWVEEKPER

SEQ ID NO: 2492814 - protein, 26 aa, Entamoeba dispar
LCLLYRKGFKTELFINNNIYSLVNAQ

SEQ ID NO: 2492815 - protein, 18 aa, Entamoeba dispar
LCNACNAPTQQMFDMSLF

SEQ ID NO: 2492816 - protein, 23 aa, Entamoeba dispar
LCNDGWRGLSVVHMGDQDVPNCL

SEQ ID NO: 2492817 - protein, 21 aa, Entamoeba dispar
LCNSINGCLFGFGGGYEGDIC

SEQ ID NO: 2492818 - protein, 20 aa, Entamoeba dispar
LCNSLKSGTILCYLAKTIDD

SEQ ID NO: 2492819 - protein, 25 aa, Entamoeba dispar
LCPNTDLNKIIPWKTKSSTQTKIKK

SEQ ID NO: 2492820 - protein, 20 aa, Entamoeba dispar
LCPPIYGHYIVKTAIVLVLF

SEQ ID NO: 2492821 - protein, 18 aa, Entamoeba dispar
LCPQLVVVGYDFDEYEKT

SEQ ID NO: 2492822 - protein, 23 aa, Entamoeba dispar
LCQAGVVFGYRVNIVMPSTMSLE

SEQ ID NO: 2492823 - protein, 24 aa, Entamoeba dispar
LCQFLPQDRVSAFSSLNPAELLRE

SEQ ID NO: 2492824 - protein, 19 aa, Entamoeba dispar
LCQFTKDVLLFFKKQATMK

SEQ ID NO: 2492825 - protein, 20 aa, Entamoeba dispar
LCQKCGIIVHYNCSEYAYSY

SEQ ID NO: 2492826 - protein, 19 aa, Entamoeba dispar
LCQKCHDTIEWKKKFHKYK

SEQ ID NO: 2492827 - protein, 17 aa, Entamoeba dispar
LCQLVAMNLSILSNLDI

SEQ ID NO: 2492828 - protein, 27 aa, Entamoeba dispar
LCQYKYCSIVPLLERRFISLFMRKGNE

SEQ ID NO: 2492829 - protein, 19 aa, Entamoeba dispar
LCRVLGGTVHRGQELFILP

SEQ ID NO: 2492830 - protein, 20 aa, Entamoeba dispar
LCSCLGSFISSIPIQILPLS

SEQ ID NO: 2492831 - protein, 18 aa, Entamoeba dispar
LCSPNACPIMNGGPNMEY

SEQ ID NO: 2492832 - protein, 19 aa, Entamoeba dispar
LCSSELYKSYYQYFNKNSR

SEQ ID NO: 2492833 - protein, 23 aa, Entamoeba dispar
LCSVPGCKAGLELFRSHVDRLPI

SEQ ID NO: 2492834 - protein, 17 aa, Entamoeba dispar
LCSVYCNEIKQVLPSLL

SEQ ID NO: 2492835 - protein, 18 aa, Entamoeba dispar
LCTIPFSTKMTAVCWNET

SEQ ID NO: 2492836 - protein, 17 aa, Entamoeba dispar
LCTMPIGGLPAIYKNLV

SEQ ID NO: 2492837 - protein, 21 aa, Entamoeba dispar
LCTSQLPYLYVYITNNPVSVP

SEQ ID NO: 2492838 - protein, 19 aa, Entamoeba dispar
LCTTCCFNTDTSLLFQDYQ

SEQ ID NO: 2492839 - protein, 30 aa, Entamoeba dispar
LCTYSEKYPELSILCVNTFYKDCRDSNPIV

SEQ ID NO: 2492840 - protein, 20 aa, Entamoeba dispar
LCVDGAIVYEVCKKVNEFIE

SEQ ID NO: 2492841 - protein, 25 aa, Entamoeba dispar
LCVEGIAICLKTFLKMKEFPKYTVK

SEQ ID NO: 2492842 - protein, 20 aa, Entamoeba dispar
LCVIPKVLAQNAAKDASELL

SEQ ID NO: 2492843 - protein, 20 aa, Entamoeba dispar
LCVNCYKQGTTRLMLTEIPY

SEQ ID NO: 2492844 - protein, 22 aa, Entamoeba dispar
LCVVLMLLPRSKICSGDGVNVF

SEQ ID NO: 2492845 - protein, 19 aa, Entamoeba dispar
LCYSFKNDTFFFKKKELPM

SEQ ID NO: 2492846 - protein, 17 aa, Entamoeba dispar
LCYYKIIQYAPDSIRFV

SEQ ID NO: 2492847 - protein, 32 aa, Entamoeba dispar
LDAFFKSSYPVNGFPLFPKRSISYPMRDTALC

SEQ ID NO: 2492848 - protein, 17 aa, Entamoeba dispar
LDAGALVLADGGVCCID

SEQ ID NO: 2492849 - protein, 20 aa, Entamoeba dispar
LDAHISEFILLYKDIVYSML

SEQ ID NO: 2492850 - protein, 21 aa, Entamoeba dispar
LDAKLPIVVYKKILGINLQMK

SEQ ID NO: 2492851 - protein, 22 aa, Entamoeba dispar
LDALRFLFNISAPEKKLHREID

SEQ ID NO: 2492852 - protein, 23 aa, Entamoeba dispar
LDAQFAAVARGFRLYNQNPNSDI

SEQ ID NO: 2492853 - protein, 33 aa, Entamoeba dispar
LDAQKAFSVMHLRWFNMHLLRVEYYPESKIPIV

SEQ ID NO: 2492854 - protein, 17 aa, Entamoeba dispar
LDATRYVEKEFKQKITD

SEQ ID NO: 2492855 - protein, 26 aa, Entamoeba dispar
LDAVLRFCYLWFNFMPLTRGTAGCGM

SEQ ID NO: 2492856 - protein, 21 aa, Entamoeba dispar
LDCGKLKSLRVRNTVVNSQLE

SEQ ID NO: 2492857 - protein, 22 aa, Entamoeba dispar
LDCGYETCYLVAIKNHRTTIVL

SEQ ID NO: 2492858 - protein, 19 aa, Entamoeba dispar
LDCHLLEYFITFNYKDKLI

SEQ ID NO: 2492859 - protein, 19 aa, Entamoeba dispar
LDCKTWLSKCKGFNKLYHC

SEQ ID NO: 2492860 - protein, 19 aa, Entamoeba dispar
LDCSDGDLHSFILCSECAE

SEQ ID NO: 2492861 - protein, 20 aa, Entamoeba dispar
LDCVPPIYRQIMFDLLCSSP

SEQ ID NO: 2492862 - protein, 19 aa, Entamoeba dispar
LDCYHIMVIAKYFEYESDF

SEQ ID NO: 2492863 - protein, 17 aa, Entamoeba dispar
LDDEGLFYYFEIKDVLI

SEQ ID NO: 2492864 - protein, 25 aa, Entamoeba dispar
LDDEVLTMYLVYYVLKDKNIRDDEE

SEQ ID NO: 2492865 - protein, 19 aa, Entamoeba dispar
LDDFNEWTVTLAPLTQSIG

SEQ ID NO: 2492866 - protein, 25 aa, Entamoeba dispar
LDDGGRVSILLQRLRSINPDFYNIP

SEQ ID NO: 2492867 - protein, 17 aa, Entamoeba dispar
LDDIIVFTPLSEKELKE

SEQ ID NO: 2492868 - protein, 19 aa, Entamoeba dispar
LDDKLDCFIGSDEHIFAAR

SEQ ID NO: 2492869 - protein, 31 aa, Entamoeba dispar
LDDLDSFIILMKKWWCDGQPHIELNVLPMIM

SEQ ID NO: 2492870 - protein, 17 aa, Entamoeba dispar
LDDMNCKFEEIKKSIEK

SEQ ID NO: 2492871 - protein, 34 aa, Entamoeba dispar
LDDNCPPEQLPESWKIILREAGVKKKDLQNPETR

SEQ ID NO: 2492872 - protein, 20 aa, Entamoeba dispar
LDDRIRVVGEYGGIGKTIPQ

SEQ ID NO: 2492873 - protein, 21 aa, Entamoeba dispar
LDDRKKLLWGYYHNHQSQVLK

SEQ ID NO: 2492874 - protein, 22 aa, Entamoeba dispar
LDDTCLIGCFAFYHNITVRRST

SEQ ID NO: 2492875 - protein, 24 aa, Entamoeba dispar
LDDWKKQLFQSLSFEDLNNFPFVV

SEQ ID NO: 2492876 - protein, 26 aa, Entamoeba dispar
LDDYYKYFRMGITFIEESDKFKQMKE

SEQ ID NO: 2492877 - protein, 26 aa, Entamoeba dispar
LDEALLRPGRFDRILYVGLPDFDTRK

SEQ ID NO: 2492878 - protein, 18 aa, Entamoeba dispar
LDEFFSFTQQNYFTENEL

SEQ ID NO: 2492879 - protein, 25 aa, Entamoeba dispar
LDEFYVPNIIGVLILSMSKRIMNEL

SEQ ID NO: 2492880 - protein, 17 aa, Entamoeba dispar
LDEICNIIEGWEFGIKE

SEQ ID NO: 2492881 - protein, 21 aa, Entamoeba dispar
LDELFYFKIGNRFNSSADLFV

SEQ ID NO: 2492882 - protein, 18 aa, Entamoeba dispar
LDELKKWTKKEICQVIYD

SEQ ID NO: 2492883 - protein, 23 aa, Entamoeba dispar
LDELKLIKTIWAIIGISGKVVYK

SEQ ID NO: 2492884 - protein, 18 aa, Entamoeba dispar
LDELRIKFLELQNKSKTT

SEQ ID NO: 2492885 - protein, 20 aa, Entamoeba dispar
LDEMHRVLPPPIPFKPEFGN

SEQ ID NO: 2492886 - protein, 24 aa, Entamoeba dispar
LDESEIFWLFKSVMDMMEQFYKPR

SEQ ID NO: 2492887 - protein, 23 aa, Entamoeba dispar
LDESPRNRLLAVIIINKLFTLDK

SEQ ID NO: 2492888 - protein, 21 aa, Entamoeba dispar
LDETLCFGQALLTQSSQTNNL

SEQ ID NO: 2492889 - protein, 24 aa, Entamoeba dispar
LDEVCLKGELDLVKGIMTVKTTRK

SEQ ID NO: 2492890 - protein, 17 aa, Entamoeba dispar
LDEVFSIDWSLDGSSVA

SEQ ID NO: 2492891 - protein, 22 aa, Entamoeba dispar
LDEWTSQIDFSFLESQRKQSST

SEQ ID NO: 2492892 - protein, 19 aa, Entamoeba dispar
LDFAKRGVKRVSIMQEGFL

SEQ ID NO: 2492893 - protein, 18 aa, Entamoeba dispar
LDFDLNLVGLITLNQMNI

SEQ ID NO: 2492894 - protein, 24 aa, Entamoeba dispar
LDFKMYYQSIDFIPNIERNCSYKY

SEQ ID NO: 2492895 - protein, 27 aa, Entamoeba dispar
LDFLQRTLCWDPKFRLTPAQAMQHPFL

SEQ ID NO: 2492896 - protein, 26 aa, Entamoeba dispar
LDFRYPDPQIRGFALRCIDTMTDDQL

SEQ ID NO: 2492897 - protein, 18 aa, Entamoeba dispar
LDGFGIDKEGPGNCVTLA

SEQ ID NO: 2492898 - protein, 18 aa, Entamoeba dispar
LDGFGYQYIEQWILDNSK

SEQ ID NO: 2492899 - protein, 18 aa, Entamoeba dispar
LDGFHSEGVFRLAGQAGL

SEQ ID NO: 2492900 - protein, 18 aa, Entamoeba dispar
LDGFKFEIFHVKGEYYTF

SEQ ID NO: 2492901 - protein, 29 aa, Entamoeba dispar
LDGFKKERIYNHICLKKHVMILVFTTDGN

SEQ ID NO: 2492902 - protein, 20 aa, Entamoeba dispar
LDGIPHLHVIEIYKRATHIV

SEQ ID NO: 2492903 - protein, 17 aa, Entamoeba dispar
LDGKCIITNKVTTKYTS

SEQ ID NO: 2492904 - protein, 17 aa, Entamoeba dispar
LDGNPNWQATKYPFLPN

SEQ ID NO: 2492905 - protein, 23 aa, Entamoeba dispar
LDGRVGLKAEIIEPLDCKERGHI

SEQ ID NO: 2492906 - protein, 21 aa, Entamoeba dispar
LDHGCKSVVLASHLGRPDGHV

SEQ ID NO: 2492907 - protein, 21 aa, Entamoeba dispar
LDHHPPRFNHLLKVVGEIVNF

SEQ ID NO: 2492908 - protein, 17 aa, Entamoeba dispar
LDHLKRYSFFRYKTIGF

SEQ ID NO: 2492909 - protein, 19 aa, Entamoeba dispar
LDIAFSKRLGILIDKKPEN

SEQ ID NO: 2492910 - protein, 23 aa, Entamoeba dispar
LDIASVISICIEYSRYSTIFTMY

SEQ ID NO: 2492911 - protein, 24 aa, Entamoeba dispar
LDICGGGEYRRAPLVIFDNNGSTS

SEQ ID NO: 2492912 - protein, 17 aa, Entamoeba dispar
LDIDEEIKRIQITNKDS

SEQ ID NO: 2492913 - protein, 22 aa, Entamoeba dispar
LDIEHYTRTDLLPWKEDMEEIQ

SEQ ID NO: 2492914 - protein, 32 aa, Entamoeba dispar
LDIEMPETLFIFPRLFKIEIAILYDKLSAIGF

SEQ ID NO: 2492915 - protein, 23 aa, Entamoeba dispar
LDIFCFCGCKSLASIDIPTSVKE

SEQ ID NO: 2492916 - protein, 20 aa, Entamoeba dispar
LDIFKELRVFELYGNSSQMQ

SEQ ID NO: 2492917 - protein, 18 aa, Entamoeba dispar
LDIFQFHLGSHLKHLSIM

SEQ ID NO: 2492918 - protein, 25 aa, Entamoeba dispar
LDIGDNIEVVLKWRRGDKKENKGTI

SEQ ID NO: 2492919 - protein, 19 aa, Entamoeba dispar
LDIGKGCFSSCTSLKSICI

SEQ ID NO: 2492920 - protein, 24 aa, Entamoeba dispar
LDIIDIPAIEFARQMTLIIHTAFS

SEQ ID NO: 2492921 - protein, 17 aa, Entamoeba dispar
LDIIIRVALSRGFTDIV

SEQ ID NO: 2492922 - protein, 26 aa, Entamoeba dispar
LDIIPKCCGYQLPSLFEQHEYQPFNF

SEQ ID NO: 2492923 - protein, 19 aa, Entamoeba dispar
LDIKHFFNDYGLLNIYYNG

SEQ ID NO: 2492924 - protein, 23 aa, Entamoeba dispar
LDIKRILNKRVQVLSGGELQLFV

SEQ ID NO: 2492925 - protein, 25 aa, Entamoeba dispar
LDIKTHCQSPCHCSWIMEIIGAGFK

SEQ ID NO: 2492926 - protein, 18 aa, Entamoeba dispar
LDILHLYPLDLEETETIE

SEQ ID NO: 2492927 - protein, 24 aa, Entamoeba dispar
LDILRDFFGFSFEECVKKKPEKKF

SEQ ID NO: 2492928 - protein, 18 aa, Entamoeba dispar
LDIRGCTLIRDYLSGNGR

SEQ ID NO: 2492929 - protein, 18 aa, Entamoeba dispar
LDISLSLKVTEVKSVFIG

SEQ ID NO: 2492930 - protein, 20 aa, Entamoeba dispar
LDIVSTLAYSTVSKIIVAIN

SEQ ID NO: 2492931 - protein, 25 aa, Entamoeba dispar
LDIYKGSKSWVFGIEKGFWIHSKQN

SEQ ID NO: 2492932 - protein, 17 aa, Entamoeba dispar
LDIYTGCIITHKKENIS

SEQ ID NO: 2492933 - protein, 19 aa, Entamoeba dispar
LDKCYCVGIVYISEDTLTI

SEQ ID NO: 2492934 - protein, 30 aa, Entamoeba dispar
LDKDYKGTVPVDRIKIFLTKTLNGKANLLS

SEQ ID NO: 2492935 - protein, 27 aa, Entamoeba dispar
LDKEHKPSCYFCADIVAPTDSLSRRTL

SEQ ID NO: 2492936 - protein, 17 aa, Entamoeba dispar
LDKEIYLSNVFIIIRIE

SEQ ID NO: 2492937 - protein, 19 aa, Entamoeba dispar
LDKFHIRPTRGILLHGPPG

SEQ ID NO: 2492938 - protein, 18 aa, Entamoeba dispar
LDKFPNFFEKIDVITGVS

SEQ ID NO: 2492939 - protein, 20 aa, Entamoeba dispar
LDKGAFGKIFVARRKDDSKV

SEQ ID NO: 2492940 - protein, 24 aa, Entamoeba dispar
LDKIKRKYIAFKKVFEEHGEDVEY

SEQ ID NO: 2492941 - protein, 25 aa, Entamoeba dispar
LDKIKRKYIAFKKVFEEHGEDVEYL

SEQ ID NO: 2492942 - protein, 19 aa, Entamoeba dispar
LDKIVIKNPIFITSLPRSG

SEQ ID NO: 2492943 - protein, 19 aa, Entamoeba dispar
LDKIYSIELTPNMTVMEFV

SEQ ID NO: 2492944 - protein, 18 aa, Entamoeba dispar
LDKLKKCITASYFYNAAK

SEQ ID NO: 2492945 - protein, 23 aa, Entamoeba dispar
LDKLLCGGFETGSITELFGEFRT

SEQ ID NO: 2492946 - protein, 17 aa, Entamoeba dispar
LDKNLAFETTQQIINLY

SEQ ID NO: 2492947 - protein, 20 aa, Entamoeba dispar
LDKQFKIVIADECHYLKNSQ

SEQ ID NO: 2492948 - protein, 23 aa, Entamoeba dispar
LDKRCSCLAPWCEGEECEKSIKT

SEQ ID NO: 2492949 - protein, 21 aa, Entamoeba dispar
LDKRITSYIRERISEINSDED

SEQ ID NO: 2492950 - protein, 21 aa, Entamoeba dispar
LDKRLGDDGGFFKNIGKQQKR

SEQ ID NO: 2492951 - protein, 25 aa, Entamoeba dispar
LDKSCVRPFHKIGLIYVKNGQHDQY

SEQ ID NO: 2492952 - protein, 17 aa, Entamoeba dispar
LDKYSRKSVRELKEEVC

SEQ ID NO: 2492953 - protein, 25 aa, Entamoeba dispar
LDLDCYRTIYQLIGHIFNDKRDELM

SEQ ID NO: 2492954 - protein, 17 aa, Entamoeba dispar
LDLDLCYQAKKASDGRS

SEQ ID NO: 2492955 - protein, 17 aa, Entamoeba dispar
LDLFGSSIIKIPSFPNL

SEQ ID NO: 2492956 - protein, 18 aa, Entamoeba dispar
LDLFSNLFIRASELIEQP

SEQ ID NO: 2492957 - protein, 19 aa, Entamoeba dispar
LDLHADLYFLIHAMYQDNN

SEQ ID NO: 2492958 - protein, 17 aa, Entamoeba dispar
LDLLIYFAAKSSKENVK

SEQ ID NO: 2492959 - protein, 18 aa, Entamoeba dispar
LDLLQPVEKVTCQLSKDG

SEQ ID NO: 2492960 - protein, 29 aa, Entamoeba dispar
LDLLSPENFPLLFDFIGSYFSFVLPVDKT

SEQ ID NO: 2492961 - protein, 19 aa, Entamoeba dispar
LDLNAICFVEKSSNARLTI

SEQ ID NO: 2492962 - protein, 22 aa, Entamoeba dispar
LDLRGDGLFIKNSLFKDEAKDE

SEQ ID NO: 2492963 - protein, 31 aa, Entamoeba dispar
LDLRSYLIMPVQRLPRYELLLKDLLKNTKPD

SEQ ID NO: 2492964 - protein, 36 aa, Entamoeba dispar
LDLRSYLIMPVQRLPRYKLLLTDLIKHTDDGFVDKP

SEQ ID NO: 2492965 - protein, 24 aa, Entamoeba dispar
LDLSELTLTCFIQSTFRSKLLVNE

SEQ ID NO: 2492966 - protein, 20 aa, Entamoeba dispar
LDLSNIISIKDLSLYSSSKK

SEQ ID NO: 2492967 - protein, 17 aa, Entamoeba dispar
LDLTKTLNRDGSPMDIH

SEQ ID NO: 2492968 - protein, 19 aa, Entamoeba dispar
LDLYYDYTKQLLGGIEASI

SEQ ID NO: 2492969 - protein, 33 aa, Entamoeba dispar
LDMFFKEMHSICLLNHIQLIFVFDGMTQTIKFH

SEQ ID NO: 2492970 - protein, 32 aa, Entamoeba dispar
LDMKMFKKRWEIPKSGKLTMKNGIGIIKDLST

SEQ ID NO: 2492971 - protein, 26 aa, Entamoeba dispar
LDMRPRPIPIDNLHTFRGSTRTVLHS

SEQ ID NO: 2492972 - protein, 19 aa, Entamoeba dispar
LDNDKEFLEYMKGIHNTIL

SEQ ID NO: 2492973 - protein, 17 aa, Entamoeba dispar
LDNKCLCSYNYYDKIES

SEQ ID NO: 2492974 - protein, 28 aa, Entamoeba dispar
LDNNAIMSMKFMKRARAKEIEEMKDILA

SEQ ID NO: 2492975 - protein, 29 aa, Entamoeba dispar
LDNNAIMSMKFMKRARAKEIEEMKDILAD

SEQ ID NO: 2492976 - protein, 18 aa, Entamoeba dispar
LDNYKFYIEKIVLQLTFV

SEQ ID NO: 2492977 - protein, 24 aa, Entamoeba dispar
LDNYRCGVQFVQPGTSIIIMTDGI

SEQ ID NO: 2492978 - protein, 20 aa, Entamoeba dispar
LDPALLRPGRIDRKIEFPNP

SEQ ID NO: 2492979 - protein, 21 aa, Entamoeba dispar
LDPALLRPGRIDRKIEFPNPK

SEQ ID NO: 2492980 - protein, 25 aa, Entamoeba dispar
LDPALLRPGRLDRKIEFPLPDRRQK

SEQ ID NO: 2492981 - protein, 19 aa, Entamoeba dispar
LDPALLRSGRFDRKIEFPT

SEQ ID NO: 2492982 - protein, 23 aa, Entamoeba dispar
LDPDEFFQFYYLFEYYVDENGEF

SEQ ID NO: 2492983 - protein, 26 aa, Entamoeba dispar
LDPFLPEYLTSIFVYVAPLFTSLEFI

SEQ ID NO: 2492984 - protein, 17 aa, Entamoeba dispar
LDPKDGVLCTLKTKKGE

SEQ ID NO: 2492985 - protein, 21 aa, Entamoeba dispar
LDPKLVEMLLENEVEEDLILD

SEQ ID NO: 2492986 - protein, 24 aa, Entamoeba dispar
LDPMLRNNWWWNLVQSISVTQFNS

SEQ ID NO: 2492987 - protein, 35 aa, Entamoeba dispar
LDPQDISSCLSIALDSCWKLNKEIELIIQSKKVKM

SEQ ID NO: 2492988 - protein, 20 aa, Entamoeba dispar
LDPRKVLSIFRSLIREDIET

SEQ ID NO: 2492989 - protein, 19 aa, Entamoeba dispar
LDPVLELRKQEVENVKRRE

SEQ ID NO: 2492990 - protein, 19 aa, Entamoeba dispar
LDQICPIHIAIQSCVNKGS

SEQ ID NO: 2492991 - protein, 25 aa, Entamoeba dispar
LDQIKRWTEMKSFKKICNIEGDGDQ

SEQ ID NO: 2492992 - protein, 24 aa, Entamoeba dispar
LDQIKYAYPCDREAMVDLVREIMQ

SEQ ID NO: 2492993 - protein, 25 aa, Entamoeba dispar
LDQTRIHFSRYGLAETIVDDAFTGK

SEQ ID NO: 2492994 - protein, 23 aa, Entamoeba dispar
LDREVMRKERLSSGINSRELNLQ

SEQ ID NO: 2492995 - protein, 17 aa, Entamoeba dispar
LDRFFRITTDMSPAAIE

SEQ ID NO: 2492996 - protein, 24 aa, Entamoeba dispar
LDRKRKYITWRAKEGNSIIQMPQL

SEQ ID NO: 2492997 - protein, 25 aa, Entamoeba dispar
LDRKVICPRMLIWKLEETHRIVLEV

SEQ ID NO: 2492998 - protein, 21 aa, Entamoeba dispar
LDRTLRLVGFYFERSNDIEDY

SEQ ID NO: 2492999 - protein, 24 aa, Entamoeba dispar
LDRVLRPGGVFFFRDYGEGDMKQD

SEQ ID NO: 2493000 - protein, 19 aa, Entamoeba dispar
LDRWCFYWCESLTSITIPT

SEQ ID NO: 2493001 - protein, 21 aa, Entamoeba dispar
LDSALIRPGRIDRKIEFPLPD

SEQ ID NO: 2493002 - protein, 21 aa, Entamoeba dispar
LDSFIKIIGLCVDTPKYFSKK

SEQ ID NO: 2493003 - protein, 17 aa, Entamoeba dispar
LDSIGYKNCNMMIYKEE

SEQ ID NO: 2493004 - protein, 18 aa, Entamoeba dispar
LDSLNALSVIADKHPDLA

SEQ ID NO: 2493005 - protein, 39 aa, Entamoeba dispar
LDSRSIRSAIEYKTKILFVFETKSGVIGFYQEDIIPTLQ

SEQ ID NO: 2493006 - protein, 27 aa, Entamoeba dispar
LDSSLALKLSVIFLICADFIPEKKDLL

SEQ ID NO: 2493007 - protein, 30 aa, Entamoeba dispar
LDSSTPWILYWSLNPLRLFGYNVDEYLNEY

SEQ ID NO: 2493008 - protein, 24 aa, Entamoeba dispar
LDSYFGSVCELDLIYYFHKVYQVI

SEQ ID NO: 2493009 - protein, 24 aa, Entamoeba dispar
LDTFFYIVVFRGEAVADWMKQKLE

SEQ ID NO: 2493010 - protein, 25 aa, Entamoeba dispar
LDTHYPCEFCCIPPHVSTINITIFW

SEQ ID NO: 2493011 - protein, 18 aa, Entamoeba dispar
LDTIMGLSDENGYLKGEI

SEQ ID NO: 2493012 - protein, 28 aa, Entamoeba dispar
LDTIRSGKMGHFFKPDSFIFGHGGAGNN

SEQ ID NO: 2493013 - protein, 21 aa, Entamoeba dispar
LDTLCKLIKRDIDIENGDIEI

SEQ ID NO: 2493014 - protein, 23 aa, Entamoeba dispar
LDTWFSSGLFPFSVMGWPEKTKD

SEQ ID NO: 2493015 - protein, 18 aa, Entamoeba dispar
LDVAHCGKGIVCSSEDKI

SEQ ID NO: 2493016 - protein, 23 aa, Entamoeba dispar
LDVCKKAKQVIFLSGTPALSRPM

SEQ ID NO: 2493017 - protein, 23 aa, Entamoeba dispar
LDVDFLFKIADFDGDDKIGVDDA

SEQ ID NO: 2493018 - protein, 19 aa, Entamoeba dispar
LDVLVCLQQDFSNYPPLKK

SEQ ID NO: 2493019 - protein, 18 aa, Entamoeba dispar
LDVPLSLEKSIIVNGMEY

SEQ ID NO: 2493020 - protein, 24 aa, Entamoeba dispar
LDVQVLLELGCKYIAEMIKGKSVE

SEQ ID NO: 2493021 - protein, 19 aa, Entamoeba dispar
LDVTCCKIANDSIIVESCG

SEQ ID NO: 2493022 - protein, 19 aa, Entamoeba dispar
LDVTCCKIVNDNIIVESSG

SEQ ID NO: 2493023 - protein, 19 aa, Entamoeba dispar
LDYGYEMPVSLVAKKTADF

SEQ ID NO: 2493024 - protein, 17 aa, Entamoeba dispar
LDYIDAKLELKLAGINA

SEQ ID NO: 2493025 - protein, 26 aa, Entamoeba dispar
LDYILMAAVLKRFFRSLPEKVFDRTN

SEQ ID NO: 2493026 - protein, 19 aa, Entamoeba dispar
LDYKGVLRRSLSCGDSVDI

SEQ ID NO: 2493027 - protein, 17 aa, Entamoeba dispar
LDYRTITISDFTQILQG

SEQ ID NO: 2493028 - protein, 25 aa, Entamoeba dispar
LDYRTLFKWYDGPLIEAMKNGDMFL

SEQ ID NO: 2493029 - protein, 17 aa, Entamoeba dispar
LDYTIRFFVKNINVDNK

SEQ ID NO: 2493030 - protein, 20 aa, Entamoeba dispar
LDYYHNVFGIYLPNGLVESN

SEQ ID NO: 2493031 - protein, 19 aa, Entamoeba dispar
LEAEYKYDYLISPLMRQAD

SEQ ID NO: 2493032 - protein, 24 aa, Entamoeba dispar
LEAFACKLEFPVKLSEILPDIKKV

SEQ ID NO: 2493033 - protein, 25 aa, Entamoeba dispar
LEAFIKCSRIILNSRIASGRYKGDF

SEQ ID NO: 2493034 - protein, 17 aa, Entamoeba dispar
LEAILICTDILARGMDF

SEQ ID NO: 2493035 - protein, 23 aa, Entamoeba dispar
LEAKELFMVFVFLLNNNTSINGP

SEQ ID NO: 2493036 - protein, 19 aa, Entamoeba dispar
LEAKKLLYIPTVDLDEDCE

SEQ ID NO: 2493037 - protein, 17 aa, Entamoeba dispar
LEALIIVLQGVIRLYLN

SEQ ID NO: 2493038 - protein, 18 aa, Entamoeba dispar
LEALKIVYPSIPIITVIL

SEQ ID NO: 2493039 - protein, 23 aa, Entamoeba dispar
LEALKPLIKCELIGWDNEISQSK

SEQ ID NO: 2493040 - protein, 20 aa, Entamoeba dispar
LEAPIPRIYILQKLVISAEA

SEQ ID NO: 2493041 - protein, 18 aa, Entamoeba dispar
LEAPKVIFPTSGIFWETL

SEQ ID NO: 2493042 - protein, 26 aa, Entamoeba dispar
LEASLPFMHFFDGFRTSHEIQKIHQL

SEQ ID NO: 2493043 - protein, 18 aa, Entamoeba dispar
LECCEADSYWGLDSIMSR

SEQ ID NO: 2493044 - protein, 29 aa, Entamoeba dispar
LECKLKKKWKLRFVIVNGSTLYYYKTELD

SEQ ID NO: 2493045 - protein, 18 aa, Entamoeba dispar
LECSSLDDFNEWTVTLAP

SEQ ID NO: 2493046 - protein, 20 aa, Entamoeba dispar
LEDISFQFSMKVHSLTVPQI

SEQ ID NO: 2493047 - protein, 20 aa, Entamoeba dispar
LEDKRWLNSKQRMVVNEGIN

SEQ ID NO: 2493048 - protein, 19 aa, Entamoeba dispar
LEDLFAIGCDTGLKVFKLE

SEQ ID NO: 2493049 - protein, 27 aa, Entamoeba dispar
LEDLGNLKWIVVGKLFGLRTIVNKKPK

SEQ ID NO: 2493050 - protein, 18 aa, Entamoeba dispar
LEDLKACNFTRVGYSWDC

SEQ ID NO: 2493051 - protein, 25 aa, Entamoeba dispar
LEDRLKELPKRMPNPKQAYGDSGLI

SEQ ID NO: 2493052 - protein, 29 aa, Entamoeba dispar
LEDVPLKEGLPLPVYDSLKYFKENPTLLE

SEQ ID NO: 2493053 - protein, 19 aa, Entamoeba dispar
LEDYFGYQVIQCMNITDVD

SEQ ID NO: 2493054 - protein, 23 aa, Entamoeba dispar
LEEAVKALSLDGLTIKGASVKVR

SEQ ID NO: 2493055 - protein, 20 aa, Entamoeba dispar
LEEDRRKLLEYTDTRSVSRK

SEQ ID NO: 2493056 - protein, 20 aa, Entamoeba dispar
LEEDRRKLLEYTDTRTVSHK

SEQ ID NO: 2493057 - protein, 24 aa, Entamoeba dispar
LEEEFPGFLARTSLFCGVSASSLL

SEQ ID NO: 2493058 - protein, 25 aa, Entamoeba dispar
LEEEFTCITMGKKIYLGGKGGIFEV

SEQ ID NO: 2493059 - protein, 18 aa, Entamoeba dispar
LEEERKEKESISNEFEET

SEQ ID NO: 2493060 - protein, 21 aa, Entamoeba dispar
LEEFYRFKSLAPLIDLKVAPA

SEQ ID NO: 2493061 - protein, 22 aa, Entamoeba dispar
LEEGYVWVVMEFMDSGCLTEVL

SEQ ID NO: 2493062 - protein, 37 aa, Entamoeba dispar
LEEIKRIGLECPKIWIKNPFLQISMIKFGIKTEQEQI

SEQ ID NO: 2493063 - protein, 22 aa, Entamoeba dispar
LEEIRKKYALIVPRRPAWTPDM

SEQ ID NO: 2493064 - protein, 25 aa, Entamoeba dispar
LEEKEHWKLVEYDSALRALKNKEMT

SEQ ID NO: 2493065 - protein, 25 aa, Entamoeba dispar
LEEKEKRKSAELELENKKDDIIELQ

SEQ ID NO: 2493066 - protein, 20 aa, Entamoeba dispar
LEEKGRIFGGYDDDVKQLRR

SEQ ID NO: 2493067 - protein, 25 aa, Entamoeba dispar
LEELCKGCNVIQNLEMYKGIIPFKW

SEQ ID NO: 2493068 - protein, 20 aa, Entamoeba dispar
LEELKKLFFIVELLPNKEVF

SEQ ID NO: 2493069 - protein, 18 aa, Entamoeba dispar
LEELLRCFPSLHKQLDTR

SEQ ID NO: 2493070 - protein, 24 aa, Entamoeba dispar
LEELSSYYLLCFNPTQKFKVEISP

SEQ ID NO: 2493071 - protein, 24 aa, Entamoeba dispar
LEESKVGLIYICVIVKERIEKREL

SEQ ID NO: 2493072 - protein, 17 aa, Entamoeba dispar
LEESVKFLLQIISALKY

SEQ ID NO: 2493073 - protein, 23 aa, Entamoeba dispar
LEETKGGCLISDYEIIQPIPWLQ

SEQ ID NO: 2493074 - protein, 17 aa, Entamoeba dispar
LEEVGINYIINCTPDVM

SEQ ID NO: 2493075 - protein, 21 aa, Entamoeba dispar
LEEYLTVIKLEIENIDNENIS

SEQ ID NO: 2493076 - protein, 17 aa, Entamoeba dispar
LEEYPPFLIPINNSKID

SEQ ID NO: 2493077 - protein, 23 aa, Entamoeba dispar
LEFAICAVFRSWMGKRAVDYRRE

SEQ ID NO: 2493078 - protein, 18 aa, Entamoeba dispar
LEFCCSGFGMTELCGLMY

SEQ ID NO: 2493079 - protein, 20 aa, Entamoeba dispar
LEFCSSLCQKSLLIDEQTYD

SEQ ID NO: 2493080 - protein, 28 aa, Entamoeba dispar
LEFIGNGACGLVLKVERDGVIYAMKQSS

SEQ ID NO: 2493081 - protein, 17 aa, Entamoeba dispar
LEFLTRYLSELIGDIII

SEQ ID NO: 2493082 - protein, 21 aa, Entamoeba dispar
LEFNKNCYLDSKSLILKSESK

SEQ ID NO: 2493083 - protein, 18 aa, Entamoeba dispar
LEFPPRSIDITQIITTLQ

SEQ ID NO: 2493084 - protein, 17 aa, Entamoeba dispar
LEFYKKYGGDYLLTLPT

SEQ ID NO: 2493085 - protein, 19 aa, Entamoeba dispar
LEGALSVYTPYLVNYSESI

SEQ ID NO: 2493086 - protein, 19 aa, Entamoeba dispar
LEGDWVSAFERIDIIDNQT

SEQ ID NO: 2493087 - protein, 29 aa, Entamoeba dispar
LEGHNWLVFNWCRGKGCILADEMGLGKTV

SEQ ID NO: 2493088 - protein, 24 aa, Entamoeba dispar
LEGIRCPICFDLTRNVMTTKCGHL

SEQ ID NO: 2493089 - protein, 21 aa, Entamoeba dispar
LEGITNIVLQKRSDFGGFINE

SEQ ID NO: 2493090 - protein, 18 aa, Entamoeba dispar
LEGKLEFERKRIKTASEN

SEQ ID NO: 2493091 - protein, 20 aa, Entamoeba dispar
LEGLELLKCFFSMENEKAPE

SEQ ID NO: 2493092 - protein, 25 aa, Entamoeba dispar
LEGLTIPGFCLTIGKIKEIMHCLEL

SEQ ID NO: 2493093 - protein, 17 aa, Entamoeba dispar
LEGNNFVILKHFEKEIC

SEQ ID NO: 2493094 - protein, 21 aa, Entamoeba dispar
LEGRIPFDMFQVIQHDYKLRS

SEQ ID NO: 2493095 - protein, 24 aa, Entamoeba dispar
LEGRKLLKERINEINNIRLLIQNS

SEQ ID NO: 2493096 - protein, 26 aa, Entamoeba dispar
LEGRSRFARLGLFVHITASFMNPGIS

SEQ ID NO: 2493097 - protein, 18 aa, Entamoeba dispar
LEGTWLLIEKVELGSMFS

SEQ ID NO: 2493098 - protein, 26 aa, Entamoeba dispar
LEHAMCDIIGFGSALIKFNQRFSYCP

SEQ ID NO: 2493099 - protein, 33 aa, Entamoeba dispar
LEHDTKLPAVFFIFSRRLVMDYAKKLAKATKFD

SEQ ID NO: 2493100 - protein, 22 aa, Entamoeba dispar
LEHETKWFIMAKTSFGLEVMNC

SEQ ID NO: 2493101 - protein, 19 aa, Entamoeba dispar
LEHFIVSSPLRLDGFSPVI

SEQ ID NO: 2493102 - protein, 18 aa, Entamoeba dispar
LEHIEEKLGLSRGSLKFE

SEQ ID NO: 2493103 - protein, 17 aa, Entamoeba dispar
LEHISLYALDVKLYKSY

SEQ ID NO: 2493104 - protein, 21 aa, Entamoeba dispar
LEHLEWNTAVVLSEHTNTERG

SEQ ID NO: 2493105 - protein, 20 aa, Entamoeba dispar
LEHLTLFKYIMKLSYKISAY

SEQ ID NO: 2493106 - protein, 21 aa, Entamoeba dispar
LEHPSTLNGLKAWKLAKPLAE

SEQ ID NO: 2493107 - protein, 23 aa, Entamoeba dispar
LEHVKPLDCFQFERVGFFCCDTD

SEQ ID NO: 2493108 - protein, 24 aa, Entamoeba dispar
LEHWRREINEWTDMNVVVYLGTKE

SEQ ID NO: 2493109 - protein, 20 aa, Entamoeba dispar
LEIEQCPQLSSLTIPSNLLK

SEQ ID NO: 2493110 - protein, 22 aa, Entamoeba dispar
LEIFERYLMIIGSGHISIVEVI

SEQ ID NO: 2493111 - protein, 17 aa, Entamoeba dispar
LEIFRKSLDLSREPNQQ

SEQ ID NO: 2493112 - protein, 19 aa, Entamoeba dispar
LEIHIARLEYKYGSVDKGR

SEQ ID NO: 2493113 - protein, 29 aa, Entamoeba dispar
LEIHSLKPSVEFYLSIPSAEFYPLKFSLE

SEQ ID NO: 2493114 - protein, 30 aa, Entamoeba dispar
LEIIPLQLPSSIKINFSFEIKQIKNKLIVE

SEQ ID NO: 2493115 - protein, 20 aa, Entamoeba dispar
LEIIPPLRKSCASLMDFENE

SEQ ID NO: 2493116 - protein, 23 aa, Entamoeba dispar
LEIISCLFNGISVECNPDNLNIP

SEQ ID NO: 2493117 - protein, 19 aa, Entamoeba dispar
LEIKPDFTKGIIRLATIYE

SEQ ID NO: 2493118 - protein, 22 aa, Entamoeba dispar
LEILIPFEWQHIIITHLPVSMV

SEQ ID NO: 2493119 - protein, 17 aa, Entamoeba dispar
LEILREIKVLRELDHRN

SEQ ID NO: 2493120 - protein, 19 aa, Entamoeba dispar
LEIPACCYDDFLVYNKLIQ

SEQ ID NO: 2493121 - protein, 22 aa, Entamoeba dispar
LEIPMGYASILSSIGLQEKMIR

SEQ ID NO: 2493122 - protein, 22 aa, Entamoeba dispar
LEIPQFPEFLIIKSDIQTKKYD

SEQ ID NO: 2493123 - protein, 25 aa, Entamoeba dispar
LEIPSERIAISWTFSQEKIVIFQQL

SEQ ID NO: 2493124 - protein, 17 aa, Entamoeba dispar
LEIQSCLPKSLQPKFVC

SEQ ID NO: 2493125 - protein, 17 aa, Entamoeba dispar
LEIREFTSYLNYRTLER

SEQ ID NO: 2493126 - protein, 19 aa, Entamoeba dispar
LEIVPCFYDGPAVSMTYRS

SEQ ID NO: 2493127 - protein, 21 aa, Entamoeba dispar
LEIYTMLPSRLQMLVPEQIFT

SEQ ID NO: 2493128 - protein, 24 aa, Entamoeba dispar
LEKALKYLFLNGLNKEGLFRLSST

SEQ ID NO: 2493129 - protein, 24 aa, Entamoeba dispar
LEKECCLKECNWYNLSKDLNKEEK

SEQ ID NO: 2493130 - protein, 17 aa, Entamoeba dispar
LEKEGRRKLSFKYEEKI

SEQ ID NO: 2493131 - protein, 17 aa, Entamoeba dispar
LEKEGYNIMPFGSTQSK

SEQ ID NO: 2493132 - protein, 21 aa, Entamoeba dispar
LEKELKESGTIPMEEEQKSAG

SEQ ID NO: 2493133 - protein, 24 aa, Entamoeba dispar
LEKEPDEHICMVLCGNKCDMESDR

SEQ ID NO: 2493134 - protein, 20 aa, Entamoeba dispar
LEKERIKWLLNEEETRKEDV

SEQ ID NO: 2493135 - protein, 23 aa, Entamoeba dispar
LEKESKAVVRKCQNIQDCLNLLV

SEQ ID NO: 2493136 - protein, 21 aa, Entamoeba dispar
LEKGIKFPSITSRNLKSITNS

SEQ ID NO: 2493137 - protein, 18 aa, Entamoeba dispar
LEKIPGMKEYIILYPVSF

SEQ ID NO: 2493138 - protein, 21 aa, Entamoeba dispar
LEKIWEIVGLFKVYPKTKTGI

SEQ ID NO: 2493139 - protein, 21 aa, Entamoeba dispar
LEKKFVGGIVFSKEGMMGVKV

SEQ ID NO: 2493140 - protein, 18 aa, Entamoeba dispar
LEKKICDRLSTPEKIKTH

SEQ ID NO: 2493141 - protein, 20 aa, Entamoeba dispar
LEKKKGCLVCDMQTMSKSIP

SEQ ID NO: 2493142 - protein, 23 aa, Entamoeba dispar
LEKKLNGPVFIIGKRVVAHTKKT

SEQ ID NO: 2493143 - protein, 29 aa, Entamoeba dispar
LEKKPTIIVKFPVTVGWGKGTFEDNCARA

SEQ ID NO: 2493144 - protein, 24 aa, Entamoeba dispar
LEKKRIPILQSPVVNRPMFTSPLK

SEQ ID NO: 2493145 - protein, 17 aa, Entamoeba dispar
LEKLSGLYLSSNNFGKF

SEQ ID NO: 2493146 - protein, 20 aa, Entamoeba dispar
LEKMKAFVNLGFDEDMIKKI

SEQ ID NO: 2493147 - protein, 18 aa, Entamoeba dispar
LEKMKVFVNLGFDEDMLK

SEQ ID NO: 2493148 - protein, 19 aa, Entamoeba dispar
LEKNGRLEFERHEEILNLE

SEQ ID NO: 2493149 - protein, 19 aa, Entamoeba dispar
LEKNIYKFVGALVEKRLHE

SEQ ID NO: 2493150 - protein, 17 aa, Entamoeba dispar
LEKNSVVLFTKEKLFKE

SEQ ID NO: 2493151 - protein, 25 aa, Entamoeba dispar
LEKPQVVIKPEFSEFGVDDSSSDNE

SEQ ID NO: 2493152 - protein, 22 aa, Entamoeba dispar
LEKRLHSYESHFSEIETFQKKV

SEQ ID NO: 2493153 - protein, 20 aa, Entamoeba dispar
LEKRLKDFIEIYNKTLDEIV

SEQ ID NO: 2493154 - protein, 19 aa, Entamoeba dispar
LEKRVKILDERGKAMEKAE

SEQ ID NO: 2493155 - protein, 27 aa, Entamoeba dispar
LEKSCSVKRKLLPIVGYIYDDIDLTRF

SEQ ID NO: 2493156 - protein, 24 aa, Entamoeba dispar
LEKSQRLKTGFKMYDISSFITRFR

SEQ ID NO: 2493157 - protein, 30 aa, Entamoeba dispar
LEKYSIRAIINWATLLGVLISKDFLGLRVL

SEQ ID NO: 2493158 - protein, 24 aa, Entamoeba dispar
LELCKRSDIKKVYCVGRSSNKNEL

SEQ ID NO: 2493159 - protein, 18 aa, Entamoeba dispar
LELDGCKSLQRLELSSNL

SEQ ID NO: 2493160 - protein, 19 aa, Entamoeba dispar
LELEMIHKFIGCIKNGSVM

SEQ ID NO: 2493161 - protein, 17 aa, Entamoeba dispar
LELESQKLNGISINNIP

SEQ ID NO: 2493162 - protein, 20 aa, Entamoeba dispar
LELFHQICLLNDCQLIELAI

SEQ ID NO: 2493163 - protein, 27 aa, Entamoeba dispar
LELHHWIPSIFEQCFVRQNISYIEEWR

SEQ ID NO: 2493164 - protein, 18 aa, Entamoeba dispar
LELILYKRAIYLLLTLQP

SEQ ID NO: 2493165 - protein, 20 aa, Entamoeba dispar
LELKCSIRLELIHKKKNAFI

SEQ ID NO: 2493166 - protein, 17 aa, Entamoeba dispar
LELKEKYLKGAAQALTL

SEQ ID NO: 2493167 - protein, 19 aa, Entamoeba dispar
LELKRCLKYMKNLQTFEAP

SEQ ID NO: 2493168 - protein, 17 aa, Entamoeba dispar
LELKSQQLFGFKVDKNC

SEQ ID NO: 2493169 - protein, 17 aa, Entamoeba dispar
LELLGSCYGGRSLNSSK

SEQ ID NO: 2493170 - protein, 18 aa, Entamoeba dispar
LELLHLIKSVSRSTPDNY

SEQ ID NO: 2493171 - protein, 19 aa, Entamoeba dispar
LELLKEVLKTDGFCIELFV

SEQ ID NO: 2493172 - protein, 17 aa, Entamoeba dispar
LELLKFKKEIIEYHSSI

SEQ ID NO: 2493173 - protein, 20 aa, Entamoeba dispar
LELLLEIAKEFTLMNHLSRS

SEQ ID NO: 2493174 - protein, 17 aa, Entamoeba dispar
LELLQKMGCEYKEKGTK

SEQ ID NO: 2493175 - protein, 29 aa, Entamoeba dispar
LELMEKCIIWPDYCDLLLTALERSHNKPE

SEQ ID NO: 2493176 - protein, 25 aa, Entamoeba dispar
LELNCNPLGVNVLWSDGSLSWYSSD

SEQ ID NO: 2493177 - protein, 26 aa, Entamoeba dispar
LELNRKRIVNEFLLKNKNHQLLIKSA

SEQ ID NO: 2493178 - protein, 17 aa, Entamoeba dispar
LELPPDVTAAVYKKFLR

SEQ ID NO: 2493179 - protein, 23 aa, Entamoeba dispar
LELPPLTFCYLLKPGEDVIKVDG

SEQ ID NO: 2493180 - protein, 19 aa, Entamoeba dispar
LELRSLCLQLNQSIRTFRN

SEQ ID NO: 2493181 - protein, 19 aa, Entamoeba dispar
LELSELGTRRRVFVIPYLL

SEQ ID NO: 2493182 - protein, 24 aa, Entamoeba dispar
LELTKRYKRVCFVTHRSTQQAFMS

SEQ ID NO: 2493183 - protein, 18 aa, Entamoeba dispar
LELVKKSRLFSCKINDEE

SEQ ID NO: 2493184 - protein, 18 aa, Entamoeba dispar
LELYSFYNSLPIIKTQTL

SEQ ID NO: 2493185 - protein, 28 aa, Entamoeba dispar
LELYSTNILPRFLEQVLLSRDKVTQDYL

SEQ ID NO: 2493186 - protein, 17 aa, Entamoeba dispar
LEMCKCVQHPSKGLFLR

SEQ ID NO: 2493187 - protein, 30 aa, Entamoeba dispar
LEMCMSCVTRSEFILGIELIKKRQINETVS

SEQ ID NO: 2493188 - protein, 39 aa, Entamoeba dispar
LEMERIICKTIDFRFVRPLSIDFLRRFNKAAKANETEHT

SEQ ID NO: 2493189 - protein, 23 aa, Entamoeba dispar
LEMKEGRELLDYGIQPPSDSNIE

SEQ ID NO: 2493190 - protein, 22 aa, Entamoeba dispar
LEMKIGGGIIRVITCQPEIKEL

SEQ ID NO: 2493191 - protein, 20 aa, Entamoeba dispar
LEMKNRALLQFYLEIKSLPD

SEQ ID NO: 2493192 - protein, 24 aa, Entamoeba dispar
LEMKNRVRKLFGDIPIQLIGLEGE

SEQ ID NO: 2493193 - protein, 23 aa, Entamoeba dispar
LEMLKYKVECKFIGDVLRGNSTT

SEQ ID NO: 2493194 - protein, 24 aa, Entamoeba dispar
LEMTIYRLGGVIGLMSQGIPTLVE

SEQ ID NO: 2493195 - protein, 25 aa, Entamoeba dispar
LEMTTHFNMCLAFATIHPQIHQSII

SEQ ID NO: 2493196 - protein, 24 aa, Entamoeba dispar
LENCLLLKEALNFREVIEDALTIA

SEQ ID NO: 2493197 - protein, 18 aa, Entamoeba dispar
LENDGIAIANGFRNIQNV

SEQ ID NO: 2493198 - protein, 19 aa, Entamoeba dispar
LENELKTNVLPFIHDQKNL

SEQ ID NO: 2493199 - protein, 21 aa, Entamoeba dispar
LENGDCCLCIINETFNSSNKI

SEQ ID NO: 2493200 - protein, 19 aa, Entamoeba dispar
LENGYEMIFHYQFNEPIKT

SEQ ID NO: 2493201 - protein, 23 aa, Entamoeba dispar
LENIINVLIDFCEYSPEYLANIT

SEQ ID NO: 2493202 - protein, 28 aa, Entamoeba dispar
LENKDLIDWIGLIPHFFNSFTLNNDTFI

SEQ ID NO: 2493203 - protein, 19 aa, Entamoeba dispar
LENKLMLQENIILQLKEEI

SEQ ID NO: 2493204 - protein, 35 aa, Entamoeba dispar
LENKVVDCFKRFIPYLKVYKMFIGNNEICLHALAA

SEQ ID NO: 2493205 - protein, 21 aa, Entamoeba dispar
LENLQEVFLQLIIKEVPLSSW

SEQ ID NO: 2493206 - protein, 23 aa, Entamoeba dispar
LENRGWHYLIRRLIKQAHPQALV

SEQ ID NO: 2493207 - protein, 20 aa, Entamoeba dispar
LENVPTCNGVPYPVYELISY

SEQ ID NO: 2493208 - protein, 25 aa, Entamoeba dispar
LENYALKFLGEICVKTEDTSIIQIE

SEQ ID NO: 2493209 - protein, 26 aa, Entamoeba dispar
LENYTCLKYLVALLYELSKNPKSKMT

SEQ ID NO: 2493210 - protein, 18 aa, Entamoeba dispar
LEPIYYHLTFAIDFVGTE

SEQ ID NO: 2493211 - protein, 17 aa, Entamoeba dispar
LEPKRSYFEVFEEKVIE

SEQ ID NO: 2493212 - protein, 18 aa, Entamoeba dispar
LEPLISFNSSDNMITLPL

SEQ ID NO: 2493213 - protein, 19 aa, Entamoeba dispar
LEPMKNFIDYDFKDIHSLK

SEQ ID NO: 2493214 - protein, 26 aa, Entamoeba dispar
LEPNDKGLFVCRAFSNNNSAGRFLSP

SEQ ID NO: 2493215 - protein, 17 aa, Entamoeba dispar
LEPNFSNHILINPKTPN

SEQ ID NO: 2493216 - protein, 28 aa, Entamoeba dispar
LEQARAEIYYVQMLKEIEFLVGTDYSKN

SEQ ID NO: 2493217 - protein, 18 aa, Entamoeba dispar
LEQCIEYYYKPFLQCSEL

SEQ ID NO: 2493218 - protein, 19 aa, Entamoeba dispar
LEQELRVTKELYSKIQTNP

SEQ ID NO: 2493219 - protein, 24 aa, Entamoeba dispar
LEQFGVALLKYAKKFPFQNQFCQD

SEQ ID NO: 2493220 - protein, 24 aa, Entamoeba dispar
LEQFSANCRFIFICNEVHLITPAI

SEQ ID NO: 2493221 - protein, 20 aa, Entamoeba dispar
LEQGKSRWSPVEDKIIEQFQ

SEQ ID NO: 2493222 - protein, 19 aa, Entamoeba dispar
LEQIKSYPLFDIFHEGCGN

SEQ ID NO: 2493223 - protein, 19 aa, Entamoeba dispar
LEQILPLVYQAIMNKLNHP

SEQ ID NO: 2493224 - protein, 17 aa, Entamoeba dispar
LEQKRLKTSWTVTYNSS

SEQ ID NO: 2493225 - protein, 24 aa, Entamoeba dispar
LEQLKHWYTPMIISDGTDFVESNC

SEQ ID NO: 2493226 - protein, 22 aa, Entamoeba dispar
LEQLKNKLLEIVINRINTSKQV

SEQ ID NO: 2493227 - protein, 23 aa, Entamoeba dispar
LEQLKNKLLEIVINRINTSKQVN

SEQ ID NO: 2493228 - protein, 24 aa, Entamoeba dispar
LEQLKNKLLKIIIKRIHIQKPVHI

SEQ ID NO: 2493229 - protein, 24 aa, Entamoeba dispar
LEQLKNKLLKIIIKRIHIQKQVHI

SEQ ID NO: 2493230 - protein, 25 aa, Entamoeba dispar
LEQLTEQFIGFGYLSVENILSMDQI

SEQ ID NO: 2493231 - protein, 20 aa, Entamoeba dispar
LEQREMSVVFIGGGLFHAEA

SEQ ID NO: 2493232 - protein, 23 aa, Entamoeba dispar
LEQYAEVFICFGYISQDDLFSMD

SEQ ID NO: 2493233 - protein, 17 aa, Entamoeba dispar
LEREIKEIQSIYKTINT

SEQ ID NO: 2493234 - protein, 19 aa, Entamoeba dispar
LERHGRIERELAQLRQAHE

SEQ ID NO: 2493235 - protein, 24 aa, Entamoeba dispar
LERHKKLTEKWVHLACTDKKIVEN

SEQ ID NO: 2493236 - protein, 25 aa, Entamoeba dispar
LERHKKLTEKWVHLACTDKKIVENT

SEQ ID NO: 2493237 - protein, 25 aa, Entamoeba dispar
LERIFKKECGKGIKKDISFIHTDTH

SEQ ID NO: 2493238 - protein, 22 aa, Entamoeba dispar
LERIKNEIGIRVKNEEKAEVLR

SEQ ID NO: 2493239 - protein, 17 aa, Entamoeba dispar
LERIRKVAAAEIEEKEK

SEQ ID NO: 2493240 - protein, 24 aa, Entamoeba dispar
LERKEKRVPILFIVGKTKTGKTEF

SEQ ID NO: 2493241 - protein, 18 aa, Entamoeba dispar
LERLKINPWFASSESIIK

SEQ ID NO: 2493242 - protein, 18 aa, Entamoeba dispar
LERPCLIYEYFPKEYRIQ

SEQ ID NO: 2493243 - protein, 18 aa, Entamoeba dispar
LERPSFVNDPTIIKKLNK

SEQ ID NO: 2493244 - protein, 18 aa, Entamoeba dispar
LERPSFVNDPTIMKRLSK

SEQ ID NO: 2493245 - protein, 20 aa, Entamoeba dispar
LERPVEGWKDLIPIIKSFSI

SEQ ID NO: 2493246 - protein, 17 aa, Entamoeba dispar
LERQFKGKVLMTPPTKE

SEQ ID NO: 2493247 - protein, 19 aa, Entamoeba dispar
LERVIRYAFEASRKRRNHV

SEQ ID NO: 2493248 - protein, 18 aa, Entamoeba dispar
LERVKRQRLELLREESKK

SEQ ID NO: 2493249 - protein, 24 aa, Entamoeba dispar
LERYREIITKFPLLGESALSSAKD

SEQ ID NO: 2493250 - protein, 20 aa, Entamoeba dispar
LESAGFSRSNPYYIVQQNRV

SEQ ID NO: 2493251 - protein, 17 aa, Entamoeba dispar
LESCRRSTIGFSDDLIQ

SEQ ID NO: 2493252 - protein, 18 aa, Entamoeba dispar
LESECFYFASGLKTIDIP

SEQ ID NO: 2493253 - protein, 22 aa, Entamoeba dispar
LESEHLKHLLSILTSLQQIWNV

SEQ ID NO: 2493254 - protein, 21 aa, Entamoeba dispar
LESFPINVLLLDFIQINDPFI

SEQ ID NO: 2493255 - protein, 21 aa, Entamoeba dispar
LESGGTCLNMNWEEVGKKKVE

SEQ ID NO: 2493256 - protein, 25 aa, Entamoeba dispar
LESGNFDELVRWVKEDWFQKKFIFI

SEQ ID NO: 2493257 - protein, 19 aa, Entamoeba dispar
LESIKKFYTLLIITKYFNY

SEQ ID NO: 2493258 - protein, 28 aa, Entamoeba dispar
LESIKKLKAEFPNKVVIASIMCMDNADD

SEQ ID NO: 2493259 - protein, 19 aa, Entamoeba dispar
LESIRHCERISKYLDEQNI

SEQ ID NO: 2493260 - protein, 19 aa, Entamoeba dispar
LESLAYMFIYFLKGKLPWQ

SEQ ID NO: 2493261 - protein, 20 aa, Entamoeba dispar
LESLIKCLPEYLDEAKKIKT

SEQ ID NO: 2493262 - protein, 18 aa, Entamoeba dispar
LESLKINLNQNVPNSFQI

SEQ ID NO: 2493263 - protein, 24 aa, Entamoeba dispar
LESPICKFALFFGNRISEEVELNY

SEQ ID NO: 2493264 - protein, 25 aa, Entamoeba dispar
LESPKRLNVALTRARNNLFFIIHKS

SEQ ID NO: 2493265 - protein, 26 aa, Entamoeba dispar
LESPKRLNVALTRARNNLFFIIHKSI

SEQ ID NO: 2493266 - protein, 24 aa, Entamoeba dispar
LESPMCKFALFFGNRISEEVELNY

SEQ ID NO: 2493267 - protein, 31 aa, Entamoeba dispar
LESVKPIIIFWGLRICGLMLYSTAEENTEKK

SEQ ID NO: 2493268 - protein, 17 aa, Entamoeba dispar
LESVMKRSIDDKTTIIQ

SEQ ID NO: 2493269 - protein, 17 aa, Entamoeba dispar
LETCSPISLLVTDKDSL

SEQ ID NO: 2493270 - protein, 23 aa, Entamoeba dispar
LETFCLKLDVDIENIRPGVELIQ

SEQ ID NO: 2493271 - protein, 25 aa, Entamoeba dispar
LETIYEWLRKMSLLLHSVVVGYEYP

SEQ ID NO: 2493272 - protein, 23 aa, Entamoeba dispar
LETKKRPSIVVSLENQFKYMCDN

SEQ ID NO: 2493273 - protein, 18 aa, Entamoeba dispar
LETLKLQLDLFYKTVENK

SEQ ID NO: 2493274 - protein, 18 aa, Entamoeba dispar
LETMFNYDYRIHGTSLGY

SEQ ID NO: 2493275 - protein, 23 aa, Entamoeba dispar
LETNRPLSYYNFENDTLLYVCPT

SEQ ID NO: 2493276 - protein, 18 aa, Entamoeba dispar
LETPELYQQYTLPYISTI

SEQ ID NO: 2493277 - protein, 20 aa, Entamoeba dispar
LETSCSLFANKIDTIPTTNQ

SEQ ID NO: 2493278 - protein, 17 aa, Entamoeba dispar
LETVKLTFFSPLILRCI

SEQ ID NO: 2493279 - protein, 17 aa, Entamoeba dispar
LETVTARLEKLEGKNTS

SEQ ID NO: 2493280 - protein, 27 aa, Entamoeba dispar
LETVYHIARYLVYWGKAKIIEAIQLDD

SEQ ID NO: 2493281 - protein, 29 aa, Entamoeba dispar
LETYPDWDIKCFAFAPAAAFSKEIACCKH

SEQ ID NO: 2493282 - protein, 21 aa, Entamoeba dispar
LEVGCGQALPSVLLKKHGIEV

SEQ ID NO: 2493283 - protein, 20 aa, Entamoeba dispar
LEVIKRKAIVEIIVKDGKIA

SEQ ID NO: 2493284 - protein, 20 aa, Entamoeba dispar
LEVKSLGDECFKKFSELTNI

SEQ ID NO: 2493285 - protein, 25 aa, Entamoeba dispar
LEVKSLGYGCFYECYSLTSINIPAP

SEQ ID NO: 2493286 - protein, 17 aa, Entamoeba dispar
LEVMIKVLLPVSETGFC

SEQ ID NO: 2493287 - protein, 17 aa, Entamoeba dispar
LEVQACESLGDMKLPSS

SEQ ID NO: 2493288 - protein, 19 aa, Entamoeba dispar
LEVRSPIMMKEYLNNPEAN

SEQ ID NO: 2493289 - protein, 20 aa, Entamoeba dispar
LEVSVKYQIRISDILTTLIK

SEQ ID NO: 2493290 - protein, 24 aa, Entamoeba dispar
LEVYCKLLTLLSNDCSKTIIETKC

SEQ ID NO: 2493291 - protein, 24 aa, Entamoeba dispar
LEWLVKKDLAWKEDLVYCEENGRI

SEQ ID NO: 2493292 - protein, 17 aa, Entamoeba dispar
LEWNHMYITFETDIHGK

SEQ ID NO: 2493293 - protein, 26 aa, Entamoeba dispar
LEWPDELKMPVLKVGVKAIGITGSDD

SEQ ID NO: 2493294 - protein, 25 aa, Entamoeba dispar
LEYAQKLHCCDWSFNPHNCDIVNEI

SEQ ID NO: 2493295 - protein, 17 aa, Entamoeba dispar
LEYDCLLTHLSQALLGA

SEQ ID NO: 2493296 - protein, 17 aa, Entamoeba dispar
LEYGCWYINPILLSDSS

SEQ ID NO: 2493297 - protein, 25 aa, Entamoeba dispar
LEYIHRMYLKVGFYLTGEITDFNGI

SEQ ID NO: 2493298 - protein, 26 aa, Entamoeba dispar
LEYINRFIYYSSFIRKNIYLDGSIIN

SEQ ID NO: 2493299 - protein, 17 aa, Entamoeba dispar
LEYKDLMIYENYRFLAG

SEQ ID NO: 2493300 - protein, 24 aa, Entamoeba dispar
LEYKIQLMKLWKLKIGIGSEDCVR

SEQ ID NO: 2493301 - protein, 17 aa, Entamoeba dispar
LEYLKGIIATKLFEEHV

SEQ ID NO: 2493302 - protein, 23 aa, Entamoeba dispar
LEYWIIMEYCSFKSIDEYWKSNA

SEQ ID NO: 2493303 - protein, 23 aa, Entamoeba dispar
LFAHGLFYFIGLDSFFFQKSPNA

SEQ ID NO: 2493304 - protein, 20 aa, Entamoeba dispar
LFALKICYPNNIKMLRGNHE

SEQ ID NO: 2493305 - protein, 18 aa, Entamoeba dispar
LFALPLEFQSLPSSTIIH

SEQ ID NO: 2493306 - protein, 18 aa, Entamoeba dispar
LFARSVTQSIMFAKDEEE

SEQ ID NO: 2493307 - protein, 18 aa, Entamoeba dispar
LFCINEIINKQILFLYNS

SEQ ID NO: 2493308 - protein, 24 aa, Entamoeba dispar
LFCVCPTIVLSLFYENGFKTLRLQ

SEQ ID NO: 2493309 - protein, 23 aa, Entamoeba dispar
LFCVICGCPLLLDEGIRSMTTQS

SEQ ID NO: 2493310 - protein, 19 aa, Entamoeba dispar
LFDCFAVVANIDFPKQWPD

SEQ ID NO: 2493311 - protein, 18 aa, Entamoeba dispar
LFDFHSYIFNRFSADTYL

SEQ ID NO: 2493312 - protein, 18 aa, Entamoeba dispar
LFDHIPVLIQHHQKFISS

SEQ ID NO: 2493313 - protein, 18 aa, Entamoeba dispar
LFDIFPLLLKQTLSLLTS

SEQ ID NO: 2493314 - protein, 22 aa, Entamoeba dispar
LFDILQFASLVPEASQVIMNEP

SEQ ID NO: 2493315 - protein, 26 aa, Entamoeba dispar
LFDKCKKLYIDECENCQFIINKNQIK

SEQ ID NO: 2493316 - protein, 25 aa, Entamoeba dispar
LFDKIRSATTFMLLLLDPDWYNSES

SEQ ID NO: 2493317 - protein, 28 aa, Entamoeba dispar
LFDLKTEFSDGILFARILNYYKPNIIAY

SEQ ID NO: 2493318 - protein, 25 aa, Entamoeba dispar
LFDPFLRPYFANGYIPVTQGDVIQC

SEQ ID NO: 2493319 - protein, 21 aa, Entamoeba dispar
LFDQRLQAIVLNIVDVSYGGM

SEQ ID NO: 2493320 - protein, 18 aa, Entamoeba dispar
LFDSLFILEQLYFHGKMW

SEQ ID NO: 2493321 - protein, 19 aa, Entamoeba dispar
LFDSSRDGLLPAAFNTTTS

SEQ ID NO: 2493322 - protein, 18 aa, Entamoeba dispar
LFEGCVFLQPPTELQEKS

SEQ ID NO: 2493323 - protein, 20 aa, Entamoeba dispar
LFEGKCFQAGRDVKRPEEGV

SEQ ID NO: 2493324 - protein, 23 aa, Entamoeba dispar
LFEGKSKINGIIWVEETLKEENK

SEQ ID NO: 2493325 - protein, 24 aa, Entamoeba dispar
LFEGKSKINGIIWVEETLKEENKG

SEQ ID NO: 2493326 - protein, 27 aa, Entamoeba dispar
LFEKCPYYEKYFFLFLRCLKSFGRLES

SEQ ID NO: 2493327 - protein, 17 aa, Entamoeba dispar
LFEKLVLRHILLDRGMI

SEQ ID NO: 2493328 - protein, 18 aa, Entamoeba dispar
LFEKRGGAATPEMLKALD

SEQ ID NO: 2493329 - protein, 27 aa, Entamoeba dispar
LFEKYSFGKLLGCGSFGKVFQVITKNQ

SEQ ID NO: 2493330 - protein, 19 aa, Entamoeba dispar
LFELACIRGLSREAMNLLE

SEQ ID NO: 2493331 - protein, 25 aa, Entamoeba dispar
LFELILACRPEVYQVPIVQEILRNS

SEQ ID NO: 2493332 - protein, 24 aa, Entamoeba dispar
LFELLQLRCEEITKNLPKVIESIL

SEQ ID NO: 2493333 - protein, 17 aa, Entamoeba dispar
LFEMSSKSGVFAVEEVT

SEQ ID NO: 2493334 - protein, 19 aa, Entamoeba dispar
LFENIGFLSPKGHYDVKIY

SEQ ID NO: 2493335 - protein, 19 aa, Entamoeba dispar
LFERFKAPSVYFSIQPILS

SEQ ID NO: 2493336 - protein, 18 aa, Entamoeba dispar
LFESCFKDEVNTIQLPEQ

SEQ ID NO: 2493337 - protein, 23 aa, Entamoeba dispar
LFESDCFIIGDGMTKTITVDSDS

SEQ ID NO: 2493338 - protein, 19 aa, Entamoeba dispar
LFETIRLSTDMKISCFDQN

SEQ ID NO: 2493339 - protein, 23 aa, Entamoeba dispar
LFETKNSIFGCFYRPPIPSQPST

SEQ ID NO: 2493340 - protein, 24 aa, Entamoeba dispar
LFFDEWSSPVVPTEKWEMKYPKNW

SEQ ID NO: 2493341 - protein, 32 aa, Entamoeba dispar
LFFDQHHCFYDWMLKRGEGERIGLSMRMAHDL

SEQ ID NO: 2493342 - protein, 18 aa, Entamoeba dispar
LFFGMLLKRTLCDCGNYS

SEQ ID NO: 2493343 - protein, 18 aa, Entamoeba dispar
LFFKTFDEQFLFKELKPP

SEQ ID NO: 2493344 - protein, 19 aa, Entamoeba dispar
LFFNVEFFERVWSKTDPKD

SEQ ID NO: 2493345 - protein, 17 aa, Entamoeba dispar
LFFQKRILDEVVNDPDE

SEQ ID NO: 2493346 - protein, 17 aa, Entamoeba dispar
LFFWLGKNASILHRGKA

SEQ ID NO: 2493347 - protein, 18 aa, Entamoeba dispar
LFGELLTYFMKWLSSSRL

SEQ ID NO: 2493348 - protein, 17 aa, Entamoeba dispar
LFGLQLQPLPTVKRILE

SEQ ID NO: 2493349 - protein, 17 aa, Entamoeba dispar
LFGNGCFYKCGCESKLK

SEQ ID NO: 2493350 - protein, 17 aa, Entamoeba dispar
LFGNILCAGGNTLYPGF

SEQ ID NO: 2493351 - protein, 20 aa, Entamoeba dispar
LFGSSIIKIPSFPNLKRLSI

SEQ ID NO: 2493352 - protein, 17 aa, Entamoeba dispar
LFHCIETQYLYSPEEEI

SEQ ID NO: 2493353 - protein, 17 aa, Entamoeba dispar
LFHKTIRQFYIEVTNKE

SEQ ID NO: 2493354 - protein, 18 aa, Entamoeba dispar
LFHNIEIFHIYNKKDKIY

SEQ ID NO: 2493355 - protein, 18 aa, Entamoeba dispar
LFHYLSCEERIQFSVPSQ

SEQ ID NO: 2493356 - protein, 25 aa, Entamoeba dispar
LFIDVFPVRLVIRIWDYYLYEGKDV

SEQ ID NO: 2493357 - protein, 32 aa, Entamoeba dispar
LFIETPLIFDGCSWGWVGDGLQPGFLWMECPS

SEQ ID NO: 2493358 - protein, 20 aa, Entamoeba dispar
LFIGETQSGILLQRIIHKIA

SEQ ID NO: 2493359 - protein, 19 aa, Entamoeba dispar
LFIIKCAIIALKQKKVSSI

SEQ ID NO: 2493360 - protein, 18 aa, Entamoeba dispar
LFIILSPLLNKYYRDESI

SEQ ID NO: 2493361 - protein, 23 aa, Entamoeba dispar
LFIKSPVLLKMYLVNRLRSIYEK

SEQ ID NO: 2493362 - protein, 27 aa, Entamoeba dispar
LFIKYKVIEGLLQFVIQTFVNKQYDAS

SEQ ID NO: 2493363 - protein, 24 aa, Entamoeba dispar
LFILDRYAPGYISNSLRFKFSKKS

SEQ ID NO: 2493364 - protein, 24 aa, Entamoeba dispar
LFIPFSIPSVHEFLSTTSSSLARC

SEQ ID NO: 2493365 - protein, 27 aa, Entamoeba dispar
LFIQRKLFVSQLFCFYISYEDPINLRI

SEQ ID NO: 2493366 - protein, 29 aa, Entamoeba dispar
LFITKIHLIDALIRFIRKKELQYSFYCMS

SEQ ID NO: 2493367 - protein, 22 aa, Entamoeba dispar
LFIYLFRLMLATGIPELQHEKD

SEQ ID NO: 2493368 - protein, 20 aa, Entamoeba dispar
LFKEGICNVCNQKVEDPVKH

SEQ ID NO: 2493369 - protein, 24 aa, Entamoeba dispar
LFKGRCKIDQLFKIFSQLGTPTED

SEQ ID NO: 2493370 - protein, 19 aa, Entamoeba dispar
LFKIKALIFDNEYFNVEEF

SEQ ID NO: 2493371 - protein, 23 aa, Entamoeba dispar
LFKKDGVVYGFWIYKETISCGLF

SEQ ID NO: 2493372 - protein, 27 aa, Entamoeba dispar
LFKKGCKKFPIGTEGRYRRIAIYMKTK

SEQ ID NO: 2493373 - protein, 18 aa, Entamoeba dispar
LFKKIYAKFWKMNEREKI

SEQ ID NO: 2493374 - protein, 20 aa, Entamoeba dispar
LFKKRVVCDVVGRLYNKDGL

SEQ ID NO: 2493375 - protein, 22 aa, Entamoeba dispar
LFKTQCKEPIFILKQTNQSFKN

SEQ ID NO: 2493376 - protein, 20 aa, Entamoeba dispar
LFKYIMKLSYKISAYEDINL

SEQ ID NO: 2493377 - protein, 19 aa, Entamoeba dispar
LFKYLWPPMIALKEGQCIQ

SEQ ID NO: 2493378 - protein, 22 aa, Entamoeba dispar
LFLDMCTLVLKTLRHNKSVIIS

SEQ ID NO: 2493379 - protein, 18 aa, Entamoeba dispar
LFLIESLTLPSGEIIEYE

SEQ ID NO: 2493380 - protein, 20 aa, Entamoeba dispar
LFLKTGVEKLVLPALHVIGQ

SEQ ID NO: 2493381 - protein, 23 aa, Entamoeba dispar
LFLLDYRVLIIASKEQVAVSSET

SEQ ID NO: 2493382 - protein, 19 aa, Entamoeba dispar
LFLNYVIEVIIPRNEEKST

SEQ ID NO: 2493383 - protein, 19 aa, Entamoeba dispar
LFLPEPVLSTSIIILNKSG

SEQ ID NO: 2493384 - protein, 18 aa, Entamoeba dispar
LFLPLQMSVELSLESFFR

SEQ ID NO: 2493385 - protein, 17 aa, Entamoeba dispar
LFLQPNSPLLYAYCHLI

SEQ ID NO: 2493386 - protein, 25 aa, Entamoeba dispar
LFLRETFESYLLRISDENGIADDDL

SEQ ID NO: 2493387 - protein, 18 aa, Entamoeba dispar
LFLTFVHHINQFFDNYGD

SEQ ID NO: 2493388 - protein, 19 aa, Entamoeba dispar
LFNELSIDSFNSFLINIEE

SEQ ID NO: 2493389 - protein, 20 aa, Entamoeba dispar
LFNFICTFIAHPFNEKVDCS

SEQ ID NO: 2493390 - protein, 28 aa, Entamoeba dispar
LFNICEQCGLDLCVVMYVFKGLSDAFFE

SEQ ID NO: 2493391 - protein, 18 aa, Entamoeba dispar
LFNMGFKSKYVIYHELLL

SEQ ID NO: 2493392 - protein, 20 aa, Entamoeba dispar
LFNQFHWKYTVVDEAHRLKN

SEQ ID NO: 2493393 - protein, 20 aa, Entamoeba dispar
LFNSLALGIKMVMPKEVLKI

SEQ ID NO: 2493394 - protein, 22 aa, Entamoeba dispar
LFNVCKLCKILMTDSDSDTITT

SEQ ID NO: 2493395 - protein, 25 aa, Entamoeba dispar
LFPDHTRPVTVIPIIEFNPHELTIL

SEQ ID NO: 2493396 - protein, 23 aa, Entamoeba dispar
LFPEKQHLMLLFSDIVLFIPATK

SEQ ID NO: 2493397 - protein, 19 aa, Entamoeba dispar
LFPFVVFHSSPLIPFNSEI

SEQ ID NO: 2493398 - protein, 22 aa, Entamoeba dispar
LFPGNRPTNSIVFKKMTPYVLG

SEQ ID NO: 2493399 - protein, 18 aa, Entamoeba dispar
LFPKIPPKSIKEIINLCF

SEQ ID NO: 2493400 - protein, 23 aa, Entamoeba dispar
LFPKYRLALENEIEKMNNGVIGE

SEQ ID NO: 2493401 - protein, 22 aa, Entamoeba dispar
LFPRSIKSFSGINCILQSLDFS

SEQ ID NO: 2493402 - protein, 18 aa, Entamoeba dispar
LFPSFSNNQIKVEMRDQW

SEQ ID NO: 2493403 - protein, 25 aa, Entamoeba dispar
LFPSLKKSGSLVVYCQYLDKLARLF

SEQ ID NO: 2493404 - protein, 17 aa, Entamoeba dispar
LFQDLSIKVGPRTVTFS

SEQ ID NO: 2493405 - protein, 20 aa, Entamoeba dispar
LFQETRAVLTPSKLIDFIVT

SEQ ID NO: 2493406 - protein, 23 aa, Entamoeba dispar
LFQGDLYIASPVNLKVLHGSIQQ

SEQ ID NO: 2493407 - protein, 17 aa, Entamoeba dispar
LFQIRDIFILPIQEYST

SEQ ID NO: 2493408 - protein, 18 aa, Entamoeba dispar
LFQKECQKQISINSEFLP

SEQ ID NO: 2493409 - protein, 18 aa, Entamoeba dispar
LFQNFCLTQDNLIRKDIA

SEQ ID NO: 2493410 - protein, 18 aa, Entamoeba dispar
LFQPLLWKPKNEKYSKKK

SEQ ID NO: 2493411 - protein, 17 aa, Entamoeba dispar
LFQQCIDRLPKAMRAQL

SEQ ID NO: 2493412 - protein, 21 aa, Entamoeba dispar
LFQRKVKRTSVPYLLTTPTET

SEQ ID NO: 2493413 - protein, 18 aa, Entamoeba dispar
LFQTPRYAGPSIVDALKS

SEQ ID NO: 2493414 - protein, 23 aa, Entamoeba dispar
LFRCNDCSIPHLDGTNYFKVFRL

SEQ ID NO: 2493415 - protein, 36 aa, Entamoeba dispar
LFRDITIPIIFGLYLLKTGIRIELFKKILTYLRNNN

SEQ ID NO: 2493416 - protein, 23 aa, Entamoeba dispar
LFRKYCGELPITAIIITHSHGDH

SEQ ID NO: 2493417 - protein, 18 aa, Entamoeba dispar
LFSEYDFFRNDQVREHIK

SEQ ID NO: 2493418 - protein, 20 aa, Entamoeba dispar
LFSIEIPKNLQIINGKNVEK

SEQ ID NO: 2493419 - protein, 24 aa, Entamoeba dispar
LFSIESKGRIQGMNKFDIKQPQYA

SEQ ID NO: 2493420 - protein, 18 aa, Entamoeba dispar
LFSLCFKGSESDEITVER

SEQ ID NO: 2493421 - protein, 24 aa, Entamoeba dispar
LFSQFLRFVSVLSSNLLVGKKNGS

SEQ ID NO: 2493422 - protein, 25 aa, Entamoeba dispar
LFSSWNSLMNFEWNVYKLNLLRRPM

SEQ ID NO: 2493423 - protein, 18 aa, Entamoeba dispar
LFSYADGRSFVWSLDTGS

SEQ ID NO: 2493424 - protein, 17 aa, Entamoeba dispar
LFTKKVYCQAAFAEYEK

SEQ ID NO: 2493425 - protein, 26 aa, Entamoeba dispar
LFTLFLNKSEFCFNQTPKLNFTSILQ

SEQ ID NO: 2493426 - protein, 24 aa, Entamoeba dispar
LFTPFFKVYFLYISHYDDSNQVLT

SEQ ID NO: 2493427 - protein, 18 aa, Entamoeba dispar
LFTPPSLIKGKLSYTTTT

SEQ ID NO: 2493428 - protein, 27 aa, Entamoeba dispar
LFTVYNFVQGFGFDGFVFVDGRSHKEI

SEQ ID NO: 2493429 - protein, 19 aa, Entamoeba dispar
LFVDLCYVCSNMIAMNQSV

SEQ ID NO: 2493430 - protein, 19 aa, Entamoeba dispar
LFVKANLLPIKYFGFDFHK

SEQ ID NO: 2493431 - protein, 19 aa, Entamoeba dispar
LFVKIIFSSLINYVQPSSR

SEQ ID NO: 2493432 - protein, 26 aa, Entamoeba dispar
LFVNPVKAQVCGHVFSKEAIYNLIGR

SEQ ID NO: 2493433 - protein, 18 aa, Entamoeba dispar
LFVSRLLKRIANEMNVPL

SEQ ID NO: 2493434 - protein, 26 aa, Entamoeba dispar
LFWDKPKAIILYNCSLWVTRVLETYV

SEQ ID NO: 2493435 - protein, 22 aa, Entamoeba dispar
LFWLLNEFADLLGPSPLIVEKK

SEQ ID NO: 2493436 - protein, 18 aa, Entamoeba dispar
LFYFIINSSFPFGKKLIE

SEQ ID NO: 2493437 - protein, 27 aa, Entamoeba dispar
LGAELQEWRNLLAYRDECRKASAACIL

SEQ ID NO: 2493438 - protein, 25 aa, Entamoeba dispar
LGANSRPSMGLGLGAQPAGLGLGLG

SEQ ID NO: 2493439 - protein, 25 aa, Entamoeba dispar
LGAPQGKCYCLFEYQNPEYKEKILT

SEQ ID NO: 2493440 - protein, 18 aa, Entamoeba dispar
LGARRKVEPQTTPKPEDK

SEQ ID NO: 2493441 - protein, 24 aa, Entamoeba dispar
LGAYKPSLIMSKFFPALQGSMGKM

SEQ ID NO: 2493442 - protein, 20 aa, Entamoeba dispar
LGCEVLKALAMVGFQNLTII

SEQ ID NO: 2493443 - protein, 19 aa, Entamoeba dispar
LGDDCFRECSSLTSINIPS

SEQ ID NO: 2493444 - protein, 28 aa, Entamoeba dispar
LGDDLRQDCLILRAFKLFDNLWRMNGLD

SEQ ID NO: 2493445 - protein, 18 aa, Entamoeba dispar
LGDECFKKFSELTNINIP

SEQ ID NO: 2493446 - protein, 19 aa, Entamoeba dispar
LGDECFYNGYELTTMNIPS

SEQ ID NO: 2493447 - protein, 20 aa, Entamoeba dispar
LGDFCFKGCTSLESVNIPNS

SEQ ID NO: 2493448 - protein, 23 aa, Entamoeba dispar
LGDLCFRKCSLTTINVPTTVSVL

SEQ ID NO: 2493449 - protein, 21 aa, Entamoeba dispar
LGDLFPNIDIIGIFDGHNGEE

SEQ ID NO: 2493450 - protein, 20 aa, Entamoeba dispar
LGDNCFEGYDSLKMVIPSSV

SEQ ID NO: 2493451 - protein, 21 aa, Entamoeba dispar
LGDNCFEGYDSLKMVIPSSVT

SEQ ID NO: 2493452 - protein, 18 aa, Entamoeba dispar
LGDNCFREVSINKISLPS

SEQ ID NO: 2493453 - protein, 28 aa, Entamoeba dispar
LGDRCFEWCLSLSKIHLPMTLKKLGIGC

SEQ ID NO: 2493454 - protein, 21 aa, Entamoeba dispar
LGDSCFKECYSLTTFNIPSSV

SEQ ID NO: 2493455 - protein, 20 aa, Entamoeba dispar
LGDSCFKECYSLTTINIPSS

SEQ ID NO: 2493456 - protein, 22 aa, Entamoeba dispar
LGDSTIIIFLFLDGRQEEIRLR

SEQ ID NO: 2493457 - protein, 19 aa, Entamoeba dispar
LGDYCFFGCCSLTSISIPT

SEQ ID NO: 2493458 - protein, 17 aa, Entamoeba dispar
LGDYCFSYCSSITTINI

SEQ ID NO: 2493459 - protein, 18 aa, Entamoeba dispar
LGDYCFYRCSSLSTISLP

SEQ ID NO: 2493460 - protein, 18 aa, Entamoeba dispar
LGEDHIRKVCLYPRYLER

SEQ ID NO: 2493461 - protein, 25 aa, Entamoeba dispar
LGEDVNPIFIRQMVNNIKKKINSED

SEQ ID NO: 2493462 - protein, 19 aa, Entamoeba dispar
LGEFIEKVVQCITLIIIKL

SEQ ID NO: 2493463 - protein, 18 aa, Entamoeba dispar
LGEKKLGGFATWGIGRLE

SEQ ID NO: 2493464 - protein, 19 aa, Entamoeba dispar
LGELIKILTRTSVSAPDFI

SEQ ID NO: 2493465 - protein, 24 aa, Entamoeba dispar
LGELKKAKFPGGIKLDEDACRHLM

SEQ ID NO: 2493466 - protein, 27 aa, Entamoeba dispar
LGELPQAFARMSALYGGTYMLRAKIQE

SEQ ID NO: 2493467 - protein, 28 aa, Entamoeba dispar
LGELPQAFARMSALYGGTYMLRAKIQEI

SEQ ID NO: 2493468 - protein, 20 aa, Entamoeba dispar
LGENSTCLLVDVPLTSDIRK

SEQ ID NO: 2493469 - protein, 22 aa, Entamoeba dispar
LGEVQSRFAVQMKELPDDLKEI

SEQ ID NO: 2493470 - protein, 18 aa, Entamoeba dispar
LGEYCFYECKSLTSINIP

SEQ ID NO: 2493471 - protein, 27 aa, Entamoeba dispar
LGEYPQLLGGLAIKVASYITKQLPYVS

SEQ ID NO: 2493472 - protein, 43 aa, Entamoeba dispar
LGFFSRRRLEWHYLFIACSYIGARICSLYESLGKEAVKYIIGH

SEQ ID NO: 2493473 - protein, 21 aa, Entamoeba dispar
LGFKGSLQFASPNQHLGKKYI

SEQ ID NO: 2493474 - protein, 19 aa, Entamoeba dispar
LGFKVVLCGHLDTVDIGSG

SEQ ID NO: 2493475 - protein, 19 aa, Entamoeba dispar
LGFNIGMRMLEVINIRERE

SEQ ID NO: 2493476 - protein, 18 aa, Entamoeba dispar
LGGNCFIECSSLTSINIP

SEQ ID NO: 2493477 - protein, 18 aa, Entamoeba dispar
LGGQREYITMLPMVMDGA

SEQ ID NO: 2493478 - protein, 17 aa, Entamoeba dispar
LGGTPYLPKGFEYPKDL

SEQ ID NO: 2493479 - protein, 18 aa, Entamoeba dispar
LGGTPYLPKGFEYPKDLS

SEQ ID NO: 2493480 - protein, 30 aa, Entamoeba dispar
LGHCNCTRYDLKDVILVGGSTFIPFIQKLV

SEQ ID NO: 2493481 - protein, 24 aa, Entamoeba dispar
LGIFYQIANAIAFLHSQNPPIVHR

SEQ ID NO: 2493482 - protein, 26 aa, Entamoeba dispar
LGIGCFKGCSSIIYPTSITSFGNNIF

SEQ ID NO: 2493483 - protein, 19 aa, Entamoeba dispar
LGIGFGGSAEDIFKNDEKM

SEQ ID NO: 2493484 - protein, 26 aa, Entamoeba dispar
LGIKHILCVAPLIPSLFPNEFDYKNI

SEQ ID NO: 2493485 - protein, 19 aa, Entamoeba dispar
LGIKMVMPKEVLKIDNTML

SEQ ID NO: 2493486 - protein, 25 aa, Entamoeba dispar
LGIKRWPHRKLQRIEGEIKRIDESM

SEQ ID NO: 2493487 - protein, 25 aa, Entamoeba dispar
LGILKRIIEVGIRMNDLNNWNGLVE

SEQ ID NO: 2493488 - protein, 26 aa, Entamoeba dispar
LGILYCIRKNFFLWLLENKPSSALSY

SEQ ID NO: 2493489 - protein, 24 aa, Entamoeba dispar
LGINGESGYELYLLGHIGKCELYQ

SEQ ID NO: 2493490 - protein, 24 aa, Entamoeba dispar
LGINSSYCQIIFVLNQVDKFLDKE

SEQ ID NO: 2493491 - protein, 19 aa, Entamoeba dispar
LGIRIKRSANLNSLVEELC

SEQ ID NO: 2493492 - protein, 17 aa, Entamoeba dispar
LGITSSNGFKVIDNRDG

SEQ ID NO: 2493493 - protein, 17 aa, Entamoeba dispar
LGKEGYQHLYGMDYSPA

SEQ ID NO: 2493494 - protein, 17 aa, Entamoeba dispar
LGKLESIKKFPKQSRNE

SEQ ID NO: 2493495 - protein, 17 aa, Entamoeba dispar
LGKRCFDFCLGLEEFNF

SEQ ID NO: 2493496 - protein, 17 aa, Entamoeba dispar
LGKVIVWELNENGTNGK

SEQ ID NO: 2493497 - protein, 18 aa, Entamoeba dispar
LGKWKIYNPKIGMETLQI

SEQ ID NO: 2493498 - protein, 18 aa, Entamoeba dispar
LGKYCFCGSSSLTSITIP

SEQ ID NO: 2493499 - protein, 27 aa, Entamoeba dispar
LGKYLERFSSFLLNFIKLPTPNVLPYI

SEQ ID NO: 2493500 - protein, 26 aa, Entamoeba dispar
LGLFNFSKLRAIGSIITLLHSLQKIQ

SEQ ID NO: 2493501 - protein, 17 aa, Entamoeba dispar
LGLLCFDTKEFVRVFHG

SEQ ID NO: 2493502 - protein, 24 aa, Entamoeba dispar
LGLLYRFSGTLGKYAKKLESFAAT

SEQ ID NO: 2493503 - protein, 18 aa, Entamoeba dispar
LGLSHNWSSFKIKFSPEK

SEQ ID NO: 2493504 - protein, 19 aa, Entamoeba dispar
LGLSHSWSSIRVEILQFIE

SEQ ID NO: 2493505 - protein, 17 aa, Entamoeba dispar
LGLVASVSRKYIYQIIN

SEQ ID NO: 2493506 - protein, 24 aa, Entamoeba dispar
LGLVKSCYGNDVMFDVTELSRGNI

SEQ ID NO: 2493507 - protein, 27 aa, Entamoeba dispar
LGMNLLKFTRLWNGKGYIYMYVTVEGS

SEQ ID NO: 2493508 - protein, 19 aa, Entamoeba dispar
LGMNRSCLKSAKLGYEAKD

SEQ ID NO: 2493509 - protein, 17 aa, Entamoeba dispar
LGMPRIKELVMFAKKEI

SEQ ID NO: 2493510 - protein, 20 aa, Entamoeba dispar
LGNECFKDCYSLTSIDLPTS

SEQ ID NO: 2493511 - protein, 18 aa, Entamoeba dispar
LGNKCFKECLSLKSINIP

SEQ ID NO: 2493512 - protein, 19 aa, Entamoeba dispar
LGNKLKVAGVINREPAPFV

SEQ ID NO: 2493513 - protein, 30 aa, Entamoeba dispar
LGNLKVIIPWSDLLHKPIEVVLSDIVGLVE

SEQ ID NO: 2493514 - protein, 19 aa, Entamoeba dispar
LGNNCFGECTSLKTINIPT

SEQ ID NO: 2493515 - protein, 19 aa, Entamoeba dispar
LGNYCFNGCYSLKSINIPS

SEQ ID NO: 2493516 - protein, 21 aa, Entamoeba dispar
LGNYCFYKCYSLTSVTIPSSI

SEQ ID NO: 2493517 - protein, 18 aa, Entamoeba dispar
LGNYILKKRVFGERTEES

SEQ ID NO: 2493518 - protein, 19 aa, Entamoeba dispar
LGNYLKFAPVHSVLPPQRV

SEQ ID NO: 2493519 - protein, 17 aa, Entamoeba dispar
LGPERYMAPEILFNPSL

SEQ ID NO: 2493520 - protein, 21 aa, Entamoeba dispar
LGPFDIACFQFSLYKPHTNVR

SEQ ID NO: 2493521 - protein, 23 aa, Entamoeba dispar
LGPIRSDYIFSHFRQYDFKVTSR

SEQ ID NO: 2493522 - protein, 28 aa, Entamoeba dispar
LGPSLKCTKCSFVIHKGCKDTFYLKCSG

SEQ ID NO: 2493523 - protein, 19 aa, Entamoeba dispar
LGQEIARMALWKHEFLIKI

SEQ ID NO: 2493524 - protein, 19 aa, Entamoeba dispar
LGQEWKYYEVLKRITETYE

SEQ ID NO: 2493525 - protein, 19 aa, Entamoeba dispar
LGSGCTNTSRFQLLLDKSV

SEQ ID NO: 2493526 - protein, 26 aa, Entamoeba dispar
LGSGKSGSLFMFTKDHKFVIKVIPKR

SEQ ID NO: 2493527 - protein, 18 aa, Entamoeba dispar
LGSLLGLLTIGMNKPLRS

SEQ ID NO: 2493528 - protein, 28 aa, Entamoeba dispar
LGSMLIMPVQRTPRYVLLLNEVLKHTDK

SEQ ID NO: 2493529 - protein, 25 aa, Entamoeba dispar
LGSWEFKLKLGGIMEAIYRAFQDGS

SEQ ID NO: 2493530 - protein, 18 aa, Entamoeba dispar
LGTENNGYMGFGTERMGG

SEQ ID NO: 2493531 - protein, 19 aa, Entamoeba dispar
LGTNKEKIICMGVYSEGQY

SEQ ID NO: 2493532 - protein, 23 aa, Entamoeba dispar
LGTTFSCMAVWKENSKRVEIITN

SEQ ID NO: 2493533 - protein, 18 aa, Entamoeba dispar
LGVCNLGVLFQKIIPSGT

SEQ ID NO: 2493534 - protein, 20 aa, Entamoeba dispar
LGVCSCININGLRIVGVSGI

SEQ ID NO: 2493535 - protein, 18 aa, Entamoeba dispar
LGVHCLSGIGRAPTLVAI

SEQ ID NO: 2493536 - protein, 26 aa, Entamoeba dispar
LGVLGLKAMALILIRLITSNTQSNLV

SEQ ID NO: 2493537 - protein, 21 aa, Entamoeba dispar
LGVSLLRPVETVYRYLERKDL

SEQ ID NO: 2493538 - protein, 18 aa, Entamoeba dispar
LGVTELYLNDFVIGGVLS

SEQ ID NO: 2493539 - protein, 19 aa, Entamoeba dispar
LGVVYDWVDIMLKDLQSHQ

SEQ ID NO: 2493540 - protein, 22 aa, Entamoeba dispar
LGYCCFKECYSLTSINIPSSIS

SEQ ID NO: 2493541 - protein, 17 aa, Entamoeba dispar
LGYCCFYECTSLTTITI

SEQ ID NO: 2493542 - protein, 17 aa, Entamoeba dispar
LGYDCFKECTSLISINI

SEQ ID NO: 2493543 - protein, 24 aa, Entamoeba dispar
LGYDGRFLAKFGIINIIMRGKMIY

SEQ ID NO: 2493544 - protein, 21 aa, Entamoeba dispar
LGYECFYECLSLTSINIPTSI

SEQ ID NO: 2493545 - protein, 17 aa, Entamoeba dispar
LGYECFYGCKSLTTINI

SEQ ID NO: 2493546 - protein, 18 aa, Entamoeba dispar
LGYECFYNCRLLTTINIP

SEQ ID NO: 2493547 - protein, 17 aa, Entamoeba dispar
LGYEPQQASDLAMKEEI

SEQ ID NO: 2493548 - protein, 27 aa, Entamoeba dispar
LGYGCFSESGIRRFEITSQFQFIGGSI

SEQ ID NO: 2493549 - protein, 21 aa, Entamoeba dispar
LGYHYKRIVFLPLSLESIQHV

SEQ ID NO: 2493550 - protein, 23 aa, Entamoeba dispar
LGYKRTILVSIDYHRRVNDIKEI

SEQ ID NO: 2493551 - protein, 26 aa, Entamoeba dispar
LGYYQLCGVVLYVFFNKKIQNEISEV

SEQ ID NO: 2493552 - protein, 18 aa, Entamoeba dispar
LHALKCIPKAIPSLVCQF

SEQ ID NO: 2493553 - protein, 19 aa, Entamoeba dispar
LHATIRCIAGLIKSVNNIE

SEQ ID NO: 2493554 - protein, 17 aa, Entamoeba dispar
LHDALCVLHIIRKDTKM

SEQ ID NO: 2493555 - protein, 32 aa, Entamoeba dispar
LHDIAKYCNANAFFRYDCFEDKIMVSSALSTL

SEQ ID NO: 2493556 - protein, 23 aa, Entamoeba dispar
LHDSKRLIGETVKHYNEQKKLLP

SEQ ID NO: 2493557 - protein, 23 aa, Entamoeba dispar
LHDSKRLIGETVKHYNEQKSLLP

SEQ ID NO: 2493558 - protein, 20 aa, Entamoeba dispar
LHEECLYCCYLYDILSKTNK

SEQ ID NO: 2493559 - protein, 24 aa, Entamoeba dispar
LHEEKSGLVNELSRIKEEKQKIED

SEQ ID NO: 2493560 - protein, 17 aa, Entamoeba dispar
LHEHIPVILHLDLKSDN

SEQ ID NO: 2493561 - protein, 17 aa, Entamoeba dispar
LHEKIKIAKQVADGINF

SEQ ID NO: 2493562 - protein, 17 aa, Entamoeba dispar
LHEMTFPYDSRCITIQD

SEQ ID NO: 2493563 - protein, 22 aa, Entamoeba dispar
LHEVKLKRLDKKGISQSDNNQS

SEQ ID NO: 2493564 - protein, 17 aa, Entamoeba dispar
LHFKLLNEFSKKILKSQ

SEQ ID NO: 2493565 - protein, 28 aa, Entamoeba dispar
LHFLSEICSGLWYLHFNKHLLHRDLKLD

SEQ ID NO: 2493566 - protein, 17 aa, Entamoeba dispar
LHFLVDILSEFGYFFQV

SEQ ID NO: 2493567 - protein, 22 aa, Entamoeba dispar
LHFNYLCFLPPAIGSLSKLKLL

SEQ ID NO: 2493568 - protein, 26 aa, Entamoeba dispar
LHFPIARLEEYVKFFATTIKQSAPIN

SEQ ID NO: 2493569 - protein, 19 aa, Entamoeba dispar
LHFTSRYLYLTLWGDEIKN

SEQ ID NO: 2493570 - protein, 25 aa, Entamoeba dispar
LHFTSRYLYLTLWGDEIKNNIQFKE

SEQ ID NO: 2493571 - protein, 19 aa, Entamoeba dispar
LHFTSRYLYLTLWGDEVKN

SEQ ID NO: 2493572 - protein, 23 aa, Entamoeba dispar
LHFTSRYLYRTLWGDEIKNNIQF

SEQ ID NO: 2493573 - protein, 32 aa, Entamoeba dispar
LHGLGTEFKCEICGNKSYFGRKEYEKHFQEAQ

SEQ ID NO: 2493574 - protein, 20 aa, Entamoeba dispar
LHGLQIEGAIIMMKEEIEAR

SEQ ID NO: 2493575 - protein, 22 aa, Entamoeba dispar
LHGLQIEGAIMMMKEEVAARRK

SEQ ID NO: 2493576 - protein, 29 aa, Entamoeba dispar
LHGTGKICQCIKCGYRGNADVILPKGLIP

SEQ ID NO: 2493577 - protein, 24 aa, Entamoeba dispar
LHHIIPNELWKWVNKIVNKLQGDE

SEQ ID NO: 2493578 - protein, 21 aa, Entamoeba dispar
LHHPFIVKLYYAFQTADKLYM

SEQ ID NO: 2493579 - protein, 17 aa, Entamoeba dispar
LHHPRKFIRTKKNTRTV

SEQ ID NO: 2493580 - protein, 39 aa, Entamoeba dispar
LHHYKPTPIYVMDEIDAALDFRNVSIIAHYIKERTKNAQ

SEQ ID NO: 2493581 - protein, 19 aa, Entamoeba dispar
LHIEKVWKYPYQINTNSNQ

SEQ ID NO: 2493582 - protein, 19 aa, Entamoeba dispar
LHIPYGIIKSGIISEAQPN

SEQ ID NO: 2493583 - protein, 17 aa, Entamoeba dispar
LHIRKTRKVKLQTLEKC

SEQ ID NO: 2493584 - protein, 25 aa, Entamoeba dispar
LHKEMKELIQLFFIIDENIGMNNEI

SEQ ID NO: 2493585 - protein, 25 aa, Entamoeba dispar
LHKFKFSQQRLKYFNDIGISSELTN

SEQ ID NO: 2493586 - protein, 26 aa, Entamoeba dispar
LHKLTLRIGNVFQICHLKKYIEEIKT

SEQ ID NO: 2493587 - protein, 19 aa, Entamoeba dispar
LHKNVKVVGGHEVHIPSFL

SEQ ID NO: 2493588 - protein, 20 aa, Entamoeba dispar
LHKRDIPFVSSIITALTEIK

SEQ ID NO: 2493589 - protein, 24 aa, Entamoeba dispar
LHLDCVCYASLSSMAYAFFVNNCF

SEQ ID NO: 2493590 - protein, 20 aa, Entamoeba dispar
LHLIEMKKEINLMGSDNLAK

SEQ ID NO: 2493591 - protein, 25 aa, Entamoeba dispar
LHLLLDFLTEFGYFFEVNTTKGKKG

SEQ ID NO: 2493592 - protein, 17 aa, Entamoeba dispar
LHLLMDILSEFGYFFNT

SEQ ID NO: 2493593 - protein, 21 aa, Entamoeba dispar
LHLLSDILNEFGFTFRTSKTT

SEQ ID NO: 2493594 - protein, 21 aa, Entamoeba dispar
LHLLSDILNEFGFTFRTTKTT

SEQ ID NO: 2493595 - protein, 24 aa, Entamoeba dispar
LHLPPHFPNPLILSQFSSPNVLLS

SEQ ID NO: 2493596 - protein, 24 aa, Entamoeba dispar
LHLRVNVQFNFNFRKILPKAEVVD

SEQ ID NO: 2493597 - protein, 19 aa, Entamoeba dispar
LHNAIPKAFLDCHLMIENP

SEQ ID NO: 2493598 - protein, 23 aa, Entamoeba dispar
LHPDCAKRIITEATKILKQEPNM

SEQ ID NO: 2493599 - protein, 25 aa, Entamoeba dispar
LHPLLLKPSLFLLFNEAATKYSGDA

SEQ ID NO: 2493600 - protein, 19 aa, Entamoeba dispar
LHPPLSFEPEICSVNIKKG

SEQ ID NO: 2493601 - protein, 25 aa, Entamoeba dispar
LHPTLPMKECHIAYICKRVLQGLVY

SEQ ID NO: 2493602 - protein, 21 aa, Entamoeba dispar
LHQLFPIILTLVVTKQIGTNS

SEQ ID NO: 2493603 - protein, 23 aa, Entamoeba dispar
LHQSPKWCVEDILNKVHHQNKEN

SEQ ID NO: 2493604 - protein, 19 aa, Entamoeba dispar
LHRCCLFKNHLNQMKKIIP

SEQ ID NO: 2493605 - protein, 28 aa, Entamoeba dispar
LHRGLKKFWWKAMDYLSFKTLNKRKKEI

SEQ ID NO: 2493606 - protein, 22 aa, Entamoeba dispar
LHRIGLIPIPLYATLGVQSINY

SEQ ID NO: 2493607 - protein, 17 aa, Entamoeba dispar
LHRISKHVGCCMSGIYA

SEQ ID NO: 2493608 - protein, 20 aa, Entamoeba dispar
LHRQKYHLVDSIKTRSLDIT

SEQ ID NO: 2493609 - protein, 19 aa, Entamoeba dispar
LHRRKRKFQNITYDRLLSE

SEQ ID NO: 2493610 - protein, 17 aa, Entamoeba dispar
LHRSGCNAVDGRDGLVF

SEQ ID NO: 2493611 - protein, 18 aa, Entamoeba dispar
LHRYLAFPHPIEWDKFFD

SEQ ID NO: 2493612 - protein, 24 aa, Entamoeba dispar
LHSELGKFFCVHGGISPNLNSLQD

SEQ ID NO: 2493613 - protein, 19 aa, Entamoeba dispar
LHSFQTHYLFFSQYLYSKL

SEQ ID NO: 2493614 - protein, 17 aa, Entamoeba dispar
LHSGCGVCSTNNGECSV

SEQ ID NO: 2493615 - protein, 23 aa, Entamoeba dispar
LHSIFIGHFVEFEYEKEVNLMEP

SEQ ID NO: 2493616 - protein, 25 aa, Entamoeba dispar
LHSLIFCIRGTFSINDIVSDMILYG

SEQ ID NO: 2493617 - protein, 17 aa, Entamoeba dispar
LHSLLVFQSAVLRKDEN

SEQ ID NO: 2493618 - protein, 32 aa, Entamoeba dispar
LHSLPFPVQREFVAQLFLLIGVKQNEDLLNLP

SEQ ID NO: 2493619 - protein, 20 aa, Entamoeba dispar
LHSNFAFSGSLDGIVRMYDM

SEQ ID NO: 2493620 - protein, 26 aa, Entamoeba dispar
LHSTLSLKINTLWRNNLKYLEMVNTN

SEQ ID NO: 2493621 - protein, 17 aa, Entamoeba dispar
LHTGLGLTREIHYCVQH

SEQ ID NO: 2493622 - protein, 18 aa, Entamoeba dispar
LHTLNCVIQGFKNEIHME

SEQ ID NO: 2493623 - protein, 18 aa, Entamoeba dispar
LHVKICRVEMNLIRVESI

SEQ ID NO: 2493624 - protein, 25 aa, Entamoeba dispar
LHVPKECYFYLTGHFQFEVLQGDVY

SEQ ID NO: 2493625 - protein, 18 aa, Entamoeba dispar
LHVQFPFSNSSILVNSFK

SEQ ID NO: 2493626 - protein, 19 aa, Entamoeba dispar
LHVSVLYNKVEFIESLIVD

SEQ ID NO: 2493627 - protein, 25 aa, Entamoeba dispar
LHWGCPVDIWSHGCMIFEMLTGDYL

SEQ ID NO: 2493628 - protein, 18 aa, Entamoeba dispar
LHYACVFKNIPVALFLYN

SEQ ID NO: 2493629 - protein, 17 aa, Entamoeba dispar
LHYFKNSLIGFYSLINS

SEQ ID NO: 2493630 - protein, 17 aa, Entamoeba dispar
LHYFREINNKINIRLHK

SEQ ID NO: 2493631 - protein, 19 aa, Entamoeba dispar
LHYKLLIQTLLMLRHYNES

SEQ ID NO: 2493632 - protein, 17 aa, Entamoeba dispar
LHYKTLLIIPITPPLIS

SEQ ID NO: 2493633 - protein, 17 aa, Entamoeba dispar
LHYQRMFFIKYTGIESF

SEQ ID NO: 2493634 - protein, 17 aa, Entamoeba dispar
LIALCLTKIPEHAQIVA

SEQ ID NO: 2493635 - protein, 20 aa, Entamoeba dispar
LIALPIKRYESYLKKHTKLP

SEQ ID NO: 2493636 - protein, 32 aa, Entamoeba dispar
LIALTNMCHLHGWKLDNSYTIPTQIVLPTGHS

SEQ ID NO: 2493637 - protein, 17 aa, Entamoeba dispar
LIALTQFNNMLVKIPKI

SEQ ID NO: 2493638 - protein, 18 aa, Entamoeba dispar
LIANKELQMCISKDFVAI

SEQ ID NO: 2493639 - protein, 24 aa, Entamoeba dispar
LIAREIPWGSTFVADGLSVESQSS

SEQ ID NO: 2493640 - protein, 19 aa, Entamoeba dispar
LIATKGRFEYDLGKDDIEW

SEQ ID NO: 2493641 - protein, 31 aa, Entamoeba dispar
LIAYLMYKKMWSYKEAVIFIKKKRPIISPNS

SEQ ID NO: 2493642 - protein, 19 aa, Entamoeba dispar
LICEGKAKVHAILTPELEE

SEQ ID NO: 2493643 - protein, 17 aa, Entamoeba dispar
LICKRKENIQFVSLTAI

SEQ ID NO: 2493644 - protein, 17 aa, Entamoeba dispar
LICKSFRQFQTNNKLPE

SEQ ID NO: 2493645 - protein, 18 aa, Entamoeba dispar
LICNCFSQLFLDLFGRYF

SEQ ID NO: 2493646 - protein, 25 aa, Entamoeba dispar
LICPHPGCGKSFYTKKCLSVHMQTH

SEQ ID NO: 2493647 - protein, 19 aa, Entamoeba dispar
LICQRLASHQIRRLTYQLI

SEQ ID NO: 2493648 - protein, 26 aa, Entamoeba dispar
LICSKPNRNGCMFTYATSPLIKCNLI

SEQ ID NO: 2493649 - protein, 21 aa, Entamoeba dispar
LICTPCLLNTLSSNGFKISLN

SEQ ID NO: 2493650 - protein, 20 aa, Entamoeba dispar
LICVHVALCSKMEEFKRTKM

SEQ ID NO: 2493651 - protein, 19 aa, Entamoeba dispar
LIDEGFKKAISICINDCYE

SEQ ID NO: 2493652 - protein, 26 aa, Entamoeba dispar
LIDFKSLYPSIIMEFGVCFLNSQLGG

SEQ ID NO: 2493653 - protein, 17 aa, Entamoeba dispar
LIDGHLIATLRGHSKGV

SEQ ID NO: 2493654 - protein, 20 aa, Entamoeba dispar
LIDGKLCFHTYPIVLSALCV

SEQ ID NO: 2493655 - protein, 21 aa, Entamoeba dispar
LIDIDAAFYIKHYGKSFVYQN

SEQ ID NO: 2493656 - protein, 23 aa, Entamoeba dispar
LIDILNIYIIHFIRDNSEITAEY

SEQ ID NO: 2493657 - protein, 19 aa, Entamoeba dispar
LIDKICGGKVRPIGIKTWE

SEQ ID NO: 2493658 - protein, 17 aa, Entamoeba dispar
LIDKLLLYQAIKHVEIT

SEQ ID NO: 2493659 - protein, 17 aa, Entamoeba dispar
LIDMKIPQARASIVWVI

SEQ ID NO: 2493660 - protein, 21 aa, Entamoeba dispar
LIDSICPCAFFETSALYNVQV

SEQ ID NO: 2493661 - protein, 25 aa, Entamoeba dispar
LIDSSCSWKKISCLVDEVLEILYQI

SEQ ID NO: 2493662 - protein, 18 aa, Entamoeba dispar
LIDWLQKKVDTICNTSKQ

SEQ ID NO: 2493663 - protein, 17 aa, Entamoeba dispar
LIECKKISLSENIPESL

SEQ ID NO: 2493664 - protein, 25 aa, Entamoeba dispar
LIECKTSDCYIELETDSSVTSETIN

SEQ ID NO: 2493665 - protein, 17 aa, Entamoeba dispar
LIEEMKLCYEEIEKKAV

SEQ ID NO: 2493666 - protein, 26 aa, Entamoeba dispar
LIEFNLLLIRSVFDFLTILKDSMATV

SEQ ID NO: 2493667 - protein, 23 aa, Entamoeba dispar
LIEGCEKESAVALFHMSDENGDG

SEQ ID NO: 2493668 - protein, 24 aa, Entamoeba dispar
LIEGFEMKELITAPFNYITDFLEN

SEQ ID NO: 2493669 - protein, 31 aa, Entamoeba dispar
LIEGPFGFVPRKSIPKGKNWLNCEYYLTQKQ

SEQ ID NO: 2493670 - protein, 18 aa, Entamoeba dispar
LIEHVIRYSFKKDSIQSV

SEQ ID NO: 2493671 - protein, 22 aa, Entamoeba dispar
LIEIEAPCVIFGDLHGQFYDLA

SEQ ID NO: 2493672 - protein, 19 aa, Entamoeba dispar
LIEIFKTIGKFCVSQHDRV

SEQ ID NO: 2493673 - protein, 17 aa, Entamoeba dispar
LIEKCWDQDQSKRPRFD

SEQ ID NO: 2493674 - protein, 17 aa, Entamoeba dispar
LIEKIMKKKMDNNTTNE

SEQ ID NO: 2493675 - protein, 18 aa, Entamoeba dispar
LIEKRCYENRSIGFEEVL

SEQ ID NO: 2493676 - protein, 22 aa, Entamoeba dispar
LIELPSSLCIRLMDENDKITNS

SEQ ID NO: 2493677 - protein, 24 aa, Entamoeba dispar
LIELTIRMKLYITTSFLFAYSGKF

SEQ ID NO: 2493678 - protein, 26 aa, Entamoeba dispar
LIENKELYEILSLLEINNYFILPFNS

SEQ ID NO: 2493679 - protein, 26 aa, Entamoeba dispar
LIENVKNMIYRAFINLPYKTFPNYQS

SEQ ID NO: 2493680 - protein, 17 aa, Entamoeba dispar
LIEPTITRKEFEEECKS

SEQ ID NO: 2493681 - protein, 26 aa, Entamoeba dispar
LIEQRKLRGSVFGKEIIQFIKDKQLL

SEQ ID NO: 2493682 - protein, 19 aa, Entamoeba dispar
LIERVKACKTIEEEKTLIT

SEQ ID NO: 2493683 - protein, 19 aa, Entamoeba dispar
LIESTLISWNCKGKYVILD

SEQ ID NO: 2493684 - protein, 25 aa, Entamoeba dispar
LIETLRYILTMDFPGKCGGLLQIIQ

SEQ ID NO: 2493685 - protein, 18 aa, Entamoeba dispar
LIEVPLDITIKEVSDILD

SEQ ID NO: 2493686 - protein, 18 aa, Entamoeba dispar
LIEVWEWPSITEISCTEN

SEQ ID NO: 2493687 - protein, 20 aa, Entamoeba dispar
LIEYYPKLYKNLFIRLVKEN

SEQ ID NO: 2493688 - protein, 26 aa, Entamoeba dispar
LIFERHPREALKVFCEIDKTKKKQLI

SEQ ID NO: 2493689 - protein, 17 aa, Entamoeba dispar
LIFKCLSEALSGIEEYR

SEQ ID NO: 2493690 - protein, 19 aa, Entamoeba dispar
LIFKGIFKQNINSMKLIQY

SEQ ID NO: 2493691 - protein, 17 aa, Entamoeba dispar
LIFKTNINCIRRGERNE

SEQ ID NO: 2493692 - protein, 19 aa, Entamoeba dispar
LIFQEGILVEAVRKGYWIV

SEQ ID NO: 2493693 - protein, 21 aa, Entamoeba dispar
LIGCSRLILFDPDWNPAKDKQ

SEQ ID NO: 2493694 - protein, 19 aa, Entamoeba dispar
LIGDYCFYECTSLTSINIP

SEQ ID NO: 2493695 - protein, 18 aa, Entamoeba dispar
LIGFNLSIETVRFMLSIH

SEQ ID NO: 2493696 - protein, 26 aa, Entamoeba dispar
LIGGGLKLLLDYGCVDQLYSLLKCSL

SEQ ID NO: 2493697 - protein, 19 aa, Entamoeba dispar
LIGKLAWNLLISEIQLNPR

SEQ ID NO: 2493698 - protein, 18 aa, Entamoeba dispar
LIGNEYKFGFIPFDIVQP

SEQ ID NO: 2493699 - protein, 22 aa, Entamoeba dispar
LIGSPARYDPLKHKFSTGTKNQ

SEQ ID NO: 2493700 - protein, 18 aa, Entamoeba dispar
LIGTEWGYAFDIALCNEI

SEQ ID NO: 2493701 - protein, 20 aa, Entamoeba dispar
LIHCTYCSIVDGMSGGGLID

SEQ ID NO: 2493702 - protein, 18 aa, Entamoeba dispar
LIHIKGKKNPFARLVECS

SEQ ID NO: 2493703 - protein, 19 aa, Entamoeba dispar
LIHKACGWMLKEIGKKNKK

SEQ ID NO: 2493704 - protein, 26 aa, Entamoeba dispar
LIHKDVRLDNKFSISDICYIMNCFQI

SEQ ID NO: 2493705 - protein, 20 aa, Entamoeba dispar
LIHLCKRLESIDLLDAIELN

SEQ ID NO: 2493706 - protein, 20 aa, Entamoeba dispar
LIHLNLPLTLKQILEVIQAK

SEQ ID NO: 2493707 - protein, 29 aa, Entamoeba dispar
LIHLTGFVRLKIRVGDSIVTQVISMSPFE

SEQ ID NO: 2493708 - protein, 29 aa, Entamoeba dispar
LIHYRSSDNFLIYDLVICTVRLAKNGHEI

SEQ ID NO: 2493709 - protein, 20 aa, Entamoeba dispar
LIIEKFFFFLLETINTIKSF

SEQ ID NO: 2493710 - protein, 23 aa, Entamoeba dispar
LIIETKLLYGLIHQRFIVTGSGL

SEQ ID NO: 2493711 - protein, 25 aa, Entamoeba dispar
LIIHLKRFGNSCGYSRDKITTFVDF

SEQ ID NO: 2493712 - protein, 25 aa, Entamoeba dispar
LIIKKEFIKEFSLLNCPINININGN

SEQ ID NO: 2493713 - protein, 21 aa, Entamoeba dispar
LIILKDFYLQKLLDFNKDELL

SEQ ID NO: 2493714 - protein, 25 aa, Entamoeba dispar
LIILKRVVENFPHFLDNVDMICSVG

SEQ ID NO: 2493715 - protein, 17 aa, Entamoeba dispar
LIIQRIVGILDDNIALI

SEQ ID NO: 2493716 - protein, 21 aa, Entamoeba dispar
LIIRCYPGFQAVVVYRIAHIL

SEQ ID NO: 2493717 - protein, 17 aa, Entamoeba dispar
LIIRYIKGKVINEKIYT

SEQ ID NO: 2493718 - protein, 27 aa, Entamoeba dispar
LIISLLKRFGKHYEDWPKGVFQIFSTK

SEQ ID NO: 2493719 - protein, 22 aa, Entamoeba dispar
LIIVECLKKHFGEEVEKIVWKI

SEQ ID NO: 2493720 - protein, 17 aa, Entamoeba dispar
LIKEGKCNLIDPQLPTM

SEQ ID NO: 2493721 - protein, 17 aa, Entamoeba dispar
LIKEGKIKPQQPQTLES

SEQ ID NO: 2493722 - protein, 21 aa, Entamoeba dispar
LIKELMVKQAVPYPIQHYDAL

SEQ ID NO: 2493723 - protein, 21 aa, Entamoeba dispar
LIKFRDEVLIDSTLNKIFSWT

SEQ ID NO: 2493724 - protein, 19 aa, Entamoeba dispar
LIKKIPLVLLKKVSMKKAT

SEQ ID NO: 2493725 - protein, 24 aa, Entamoeba dispar
LIKKLPKYLTFVIKRFERNTFQGD

SEQ ID NO: 2493726 - protein, 33 aa, Entamoeba dispar
LIKKLYNVFPIPDFWEHVSIVWTKCFCYISEKK

SEQ ID NO: 2493727 - protein, 24 aa, Entamoeba dispar
LIKLHDFSCGIVLENGKRTNDCVG

SEQ ID NO: 2493728 - protein, 26 aa, Entamoeba dispar
LIKLHGTDLLPLFSIVMTACPKEFSS

SEQ ID NO: 2493729 - protein, 18 aa, Entamoeba dispar
LIKLWNLIDGHLIATLRG

SEQ ID NO: 2493730 - protein, 23 aa, Entamoeba dispar
LIKMKEAYLKKDIQINSLINELQ

SEQ ID NO: 2493731 - protein, 19 aa, Entamoeba dispar
LIKPFHVYMEYLLGRSVCL

SEQ ID NO: 2493732 - protein, 20 aa, Entamoeba dispar
LIKPRIDIVDSITYDIYNLI

SEQ ID NO: 2493733 - protein, 17 aa, Entamoeba dispar
LIKRFQQKFTRKQYSHF

SEQ ID NO: 2493734 - protein, 26 aa, Entamoeba dispar
LIKRVMKIRLSPYIVITSTVKETDQL

SEQ ID NO: 2493735 - protein, 20 aa, Entamoeba dispar
LIKSGIKKGYAIQLSTAIAK

SEQ ID NO: 2493736 - protein, 23 aa, Entamoeba dispar
LIKYKCKELISSIYLQNNPNINQ

SEQ ID NO: 2493737 - protein, 18 aa, Entamoeba dispar
LIKYMREHYLWKRDDKDH

SEQ ID NO: 2493738 - protein, 18 aa, Entamoeba dispar
LIKYVGAVFIENENQFNV

SEQ ID NO: 2493739 - protein, 23 aa, Entamoeba dispar
LILEKYCKARNLTYIPDDGNFDD

SEQ ID NO: 2493740 - protein, 20 aa, Entamoeba dispar
LILENSFRFIEKVTRETKAV

SEQ ID NO: 2493741 - protein, 17 aa, Entamoeba dispar
LILFDWRMTENINVNNI

SEQ ID NO: 2493742 - protein, 18 aa, Entamoeba dispar
LILGLLYTLYRKYRLSVL

SEQ ID NO: 2493743 - protein, 26 aa, Entamoeba dispar
LILKCTSMGLSTVWLGGTFTVSAFNV

SEQ ID NO: 2493744 - protein, 18 aa, Entamoeba dispar
LILLKANIIASLLTELNS

SEQ ID NO: 2493745 - protein, 20 aa, Entamoeba dispar
LILLNCLYDGHLHQFTKPFF

SEQ ID NO: 2493746 - protein, 18 aa, Entamoeba dispar
LILNLKILRYYKTQYTYY

SEQ ID NO: 2493747 - protein, 24 aa, Entamoeba dispar
LILPVQRLPRYILLLETLLKSTPE

SEQ ID NO: 2493748 - protein, 18 aa, Entamoeba dispar
LILQRGFNSLASKYTEEN

SEQ ID NO: 2493749 - protein, 17 aa, Entamoeba dispar
LILRFAISELSAEGLSA

SEQ ID NO: 2493750 - protein, 21 aa, Entamoeba dispar
LILRIFKKPYLTFGDKTGIIQ

SEQ ID NO: 2493751 - protein, 17 aa, Entamoeba dispar
LILTCLIKMAKELNEVR

SEQ ID NO: 2493752 - protein, 18 aa, Entamoeba dispar
LILWEVKTNLFGWNNIIK

SEQ ID NO: 2493753 - protein, 17 aa, Entamoeba dispar
LIMIMDIDRSWKNLLEN

SEQ ID NO: 2493754 - protein, 19 aa, Entamoeba dispar
LINDFWKRLTGRQIDETWF

SEQ ID NO: 2493755 - protein, 25 aa, Entamoeba dispar
LINEFPKLQWFFLLNCTSPKQERLT

SEQ ID NO: 2493756 - protein, 17 aa, Entamoeba dispar
LINEGKLSLINYDKIVG

SEQ ID NO: 2493757 - protein, 20 aa, Entamoeba dispar
LINFMLEHPTFPIANLLTNC

SEQ ID NO: 2493758 - protein, 22 aa, Entamoeba dispar
LINGPLRLETKIHHKNKEIMHL

SEQ ID NO: 2493759 - protein, 30 aa, Entamoeba dispar
LINHLLQLPKVVPFDFIVGGEFLRTTLQEH

SEQ ID NO: 2493760 - protein, 24 aa, Entamoeba dispar
LINIPKLQSCVIKNIIKEIEMNYE

SEQ ID NO: 2493761 - protein, 18 aa, Entamoeba dispar
LINKFSYWIEPIMSNFLY

SEQ ID NO: 2493762 - protein, 17 aa, Entamoeba dispar
LINLLELKIHEMSINLD

SEQ ID NO: 2493763 - protein, 19 aa, Entamoeba dispar
LINNCRELFQWIKKSDRYI

SEQ ID NO: 2493764 - protein, 17 aa, Entamoeba dispar
LINRLVKYSSIHMMTLK

SEQ ID NO: 2493765 - protein, 24 aa, Entamoeba dispar
LINSMCIVKSLSITSCPNISNIAL

SEQ ID NO: 2493766 - protein, 26 aa, Entamoeba dispar
LINSNHLICLPSIIKNIHLIEIDISC

SEQ ID NO: 2493767 - protein, 28 aa, Entamoeba dispar
LINTLKLMFRRYLKLENPLVAFINLTQN

SEQ ID NO: 2493768 - protein, 17 aa, Entamoeba dispar
LINTVMMIITFINPYQQ

SEQ ID NO: 2493769 - protein, 23 aa, Entamoeba dispar
LIPDKSFYGYSFIFEKKDYNDYL

SEQ ID NO: 2493770 - protein, 25 aa, Entamoeba dispar
LIPKSSIPYFLGWYDSLKQLEKNSE

SEQ ID NO: 2493771 - protein, 18 aa, Entamoeba dispar
LIPSSWFSKWTMMLNSSK

SEQ ID NO: 2493772 - protein, 18 aa, Entamoeba dispar
LIPTSAIDSSKLLVCRLC

SEQ ID NO: 2493773 - protein, 25 aa, Entamoeba dispar
LIQDSLRWNYSFSGIKFSESLRFTT

SEQ ID NO: 2493774 - protein, 17 aa, Entamoeba dispar
LIQENGKLQFQIDEIEE

SEQ ID NO: 2493775 - protein, 21 aa, Entamoeba dispar
LIQKFDIGVAYQEYRSVAAEE

SEQ ID NO: 2493776 - protein, 21 aa, Entamoeba dispar
LIQKQVRLMLGKKVDCPPILC

SEQ ID NO: 2493777 - protein, 17 aa, Entamoeba dispar
LIQLKSLYFEGSTEHDK

SEQ ID NO: 2493778 - protein, 17 aa, Entamoeba dispar
LIQRYDLWDSRNTIFNV

SEQ ID NO: 2493779 - protein, 18 aa, Entamoeba dispar
LIQSCTWDTLAAQVILEA

SEQ ID NO: 2493780 - protein, 24 aa, Entamoeba dispar
LIQTFKIMRIILLDASETLCDNCD

SEQ ID NO: 2493781 - protein, 24 aa, Entamoeba dispar
LIQVYPPFVTMKWEEVIEYQKKLN

SEQ ID NO: 2493782 - protein, 25 aa, Entamoeba dispar
LIQVYPPFVTMKWEEVIEYQKKLNQ

SEQ ID NO: 2493783 - protein, 18 aa, Entamoeba dispar
LIQYVIMWVIQRVGANIG

SEQ ID NO: 2493784 - protein, 19 aa, Entamoeba dispar
LIRANWPIINIIWETRIDE

SEQ ID NO: 2493785 - protein, 18 aa, Entamoeba dispar
LIRCGCGKYFCNGTGDGK

SEQ ID NO: 2493786 - protein, 23 aa, Entamoeba dispar
LIRIIKYSLSMIEQFQKNPEEAE

SEQ ID NO: 2493787 - protein, 17 aa, Entamoeba dispar
LIRKIMESINNEEEMSP

SEQ ID NO: 2493788 - protein, 19 aa, Entamoeba dispar
LIRMKGIPKSAIIGTANEK

SEQ ID NO: 2493789 - protein, 20 aa, Entamoeba dispar
LIRNELELHLSKKYYEEEII

SEQ ID NO: 2493790 - protein, 24 aa, Entamoeba dispar
LIRNLCKDYLLIVRKSIKDLIPKA

SEQ ID NO: 2493791 - protein, 20 aa, Entamoeba dispar
LIRPFHCFSLAEAESQGLVM

SEQ ID NO: 2493792 - protein, 22 aa, Entamoeba dispar
LIRSLTEIHILYGTKTIFINPF

SEQ ID NO: 2493793 - protein, 26 aa, Entamoeba dispar
LISCETYGGGVWTTWFDRDLGICGRV

SEQ ID NO: 2493794 - protein, 20 aa, Entamoeba dispar
LISELLVFVIFAARKSNDGV

SEQ ID NO: 2493795 - protein, 20 aa, Entamoeba dispar
LISFISCKRSLYTESIEIFY

SEQ ID NO: 2493796 - protein, 32 aa, Entamoeba dispar
LISKFPRFLCHKSEILGVVLHKIFEFVNDPRF

SEQ ID NO: 2493797 - protein, 18 aa, Entamoeba dispar
LISKKLEFYYAFINSQQY

SEQ ID NO: 2493798 - protein, 25 aa, Entamoeba dispar
LISLLDMFFEYGMSTKYLKYRPQNS

SEQ ID NO: 2493799 - protein, 22 aa, Entamoeba dispar
LISLLKQFGCEINYKTRGKSKY

SEQ ID NO: 2493800 - protein, 18 aa, Entamoeba dispar
LISLLSDFAKKISDDLVS

SEQ ID NO: 2493801 - protein, 18 aa, Entamoeba dispar
LISLVCRGKIKGIKLNGP

SEQ ID NO: 2493802 - protein, 18 aa, Entamoeba dispar
LISMLRPFLSKDVLYEPI

SEQ ID NO: 2493803 - protein, 25 aa, Entamoeba dispar
LISPELRRHGSLPIKVQSIPLPITS

SEQ ID NO: 2493804 - protein, 26 aa, Entamoeba dispar
LISSGLKWVRFGAMCMAIANRRLNTF

SEQ ID NO: 2493805 - protein, 18 aa, Entamoeba dispar
LISSSMDGKVLLWNFETG

SEQ ID NO: 2493806 - protein, 24 aa, Entamoeba dispar
LISTLRLIRTFPFNSIVSDITSDL

SEQ ID NO: 2493807 - protein, 17 aa, Entamoeba dispar
LISVAVKSRGRWIESQD

SEQ ID NO: 2493808 - protein, 25 aa, Entamoeba dispar
LISVLWPCVHFLLSVFQDKTVISMC

SEQ ID NO: 2493809 - protein, 17 aa, Entamoeba dispar
LISYSKRNELIRDNRSS

SEQ ID NO: 2493810 - protein, 32 aa, Entamoeba dispar
LITDKYRLAYLIACLRTFLKESIQRKIIVFFS

SEQ ID NO: 2493811 - protein, 26 aa, Entamoeba dispar
LITLFGRGCFYKCGCEEELKKNKRIP

SEQ ID NO: 2493812 - protein, 25 aa, Entamoeba dispar
LITQICCTDCEALLKDALINIKEDN

SEQ ID NO: 2493813 - protein, 17 aa, Entamoeba dispar
LITSFPMLGRFFDNGNN

SEQ ID NO: 2493814 - protein, 17 aa, Entamoeba dispar
LITTGSFSAYSVDKSIS

SEQ ID NO: 2493815 - protein, 18 aa, Entamoeba dispar
LITYPKWSVNGISTERHD

SEQ ID NO: 2493816 - protein, 20 aa, Entamoeba dispar
LIVACWRAEKRHHWITLTTA

SEQ ID NO: 2493817 - protein, 17 aa, Entamoeba dispar
LIVEEIKYRPTGKVLNQ

SEQ ID NO: 2493818 - protein, 18 aa, Entamoeba dispar
LIVENGISKVPHNFKDCI

SEQ ID NO: 2493819 - protein, 18 aa, Entamoeba dispar
LIVENGISKVPHNFKECI

SEQ ID NO: 2493820 - protein, 24 aa, Entamoeba dispar
LIVGKKFECKEAYKSENKKGEETI

SEQ ID NO: 2493821 - protein, 25 aa, Entamoeba dispar
LIVHGCKRILFKFNKFDETVEEFLS

SEQ ID NO: 2493822 - protein, 17 aa, Entamoeba dispar
LIVKREEWGEFDLIVVS

SEQ ID NO: 2493823 - protein, 21 aa, Entamoeba dispar
LIVLKRPRSFKARPIITHSDG

SEQ ID NO: 2493824 - protein, 31 aa, Entamoeba dispar
LIVPSLFALTCWRRIVWHCVLPLALSERKYL

SEQ ID NO: 2493825 - protein, 27 aa, Entamoeba dispar
LIVSARIQLPLTYAWGLSIHKSQGLTL

SEQ ID NO: 2493826 - protein, 18 aa, Entamoeba dispar
LIVSYVFEMVIKFEEYMK

SEQ ID NO: 2493827 - protein, 25 aa, Entamoeba dispar
LIVVDRLSLFYSIISKINFQFHSSI

SEQ ID NO: 2493828 - protein, 23 aa, Entamoeba dispar
LIWIEIPRNLKIINGKNIEKKDI

SEQ ID NO: 2493829 - protein, 21 aa, Entamoeba dispar
LIYEQVFPLFPRDAFTYYINT

SEQ ID NO: 2493830 - protein, 24 aa, Entamoeba dispar
LIYFPKTFGFCISAQPNYTVFDYF

SEQ ID NO: 2493831 - protein, 17 aa, Entamoeba dispar
LIYKRGALKIHGNRMPI

SEQ ID NO: 2493832 - protein, 23 aa, Entamoeba dispar
LIYQSCSISPYLSDEELTPYQKS

SEQ ID NO: 2493833 - protein, 19 aa, Entamoeba dispar
LKAGIDIRNKHVTISDDDN

SEQ ID NO: 2493834 - protein, 20 aa, Entamoeba dispar
LKAGISFEMGKDWLKIFELL

SEQ ID NO: 2493835 - protein, 20 aa, Entamoeba dispar
LKAGVMKYGKNEWARISSLI

SEQ ID NO: 2493836 - protein, 21 aa, Entamoeba dispar
LKAIHCFPNETSFLYDNQPIT

SEQ ID NO: 2493837 - protein, 21 aa, Entamoeba dispar
LKAIYHRLFVFIVNKVNEVMG

SEQ ID NO: 2493838 - protein, 18 aa, Entamoeba dispar
LKAKIDLLKEKTEKEYKE

SEQ ID NO: 2493839 - protein, 25 aa, Entamoeba dispar
LKALKKCIICGEIGHTSKGCPQNEN

SEQ ID NO: 2493840 - protein, 18 aa, Entamoeba dispar
LKALKYLHSAGIVHRDIK

SEQ ID NO: 2493841 - protein, 20 aa, Entamoeba dispar
LKALVLHGIAKLKINKRDNK

SEQ ID NO: 2493842 - protein, 20 aa, Entamoeba dispar
LKAPQAVAAMNACTLTIHWQ

SEQ ID NO: 2493843 - protein, 39 aa, Entamoeba dispar
LKAVEVLDFGKPIFEEFLMTWGVVLIMKGDYTLIPELTK

SEQ ID NO: 2493844 - protein, 22 aa, Entamoeba dispar
LKAYLRSMVEPLIPYKYFEYYA

SEQ ID NO: 2493845 - protein, 21 aa, Entamoeba dispar
LKCAQIILRLLTKYISYIKKD

SEQ ID NO: 2493846 - protein, 18 aa, Entamoeba dispar
LKCDKRCISLVCNANKRI

SEQ ID NO: 2493847 - protein, 17 aa, Entamoeba dispar
LKCFLRKESVCLLTYFL

SEQ ID NO: 2493848 - protein, 17 aa, Entamoeba dispar
LKCIKLITRYHANDSSQ

SEQ ID NO: 2493849 - protein, 17 aa, Entamoeba dispar
LKCKIPNNCTWDYNLNC

SEQ ID NO: 2493850 - protein, 22 aa, Entamoeba dispar
LKCLISYLPTERYGCICQIISS

SEQ ID NO: 2493851 - protein, 19 aa, Entamoeba dispar
LKCLNEFAYYYFVITPQQC

SEQ ID NO: 2493852 - protein, 18 aa, Entamoeba dispar
LKCMALEVAETCAVDDND

SEQ ID NO: 2493853 - protein, 17 aa, Entamoeba dispar
LKCMALEVAETCVVDDT

SEQ ID NO: 2493854 - protein, 21 aa, Entamoeba dispar
LKCRICGCYVHSKCIQGLTHL

SEQ ID NO: 2493855 - protein, 18 aa, Entamoeba dispar
LKCSNGYKIENNQCNGDN

SEQ ID NO: 2493856 - protein, 17 aa, Entamoeba dispar
LKCSNGYKIQNNQCNGD

SEQ ID NO: 2493857 - protein, 19 aa, Entamoeba dispar
LKCVLRKSNIDTGEAINRI

SEQ ID NO: 2493858 - protein, 19 aa, Entamoeba dispar
LKCVMTGGIFEIIIEEEPQ

SEQ ID NO: 2493859 - protein, 21 aa, Entamoeba dispar
LKDAGDVVCEGIDAMKQDLLD

SEQ ID NO: 2493860 - protein, 21 aa, Entamoeba dispar
LKDALEIISLLAQNKTALTRF

SEQ ID NO: 2493861 - protein, 18 aa, Entamoeba dispar
LKDAVLKLSPKGVAAPPS

SEQ ID NO: 2493862 - protein, 18 aa, Entamoeba dispar
LKDCLEYENDICILRKSI

SEQ ID NO: 2493863 - protein, 18 aa, Entamoeba dispar
LKDFKCVCCQKVVHSTCL

SEQ ID NO: 2493864 - protein, 29 aa, Entamoeba dispar
LKDFPKTKLICCWVEKNTCNNLIDLTHHT

SEQ ID NO: 2493865 - protein, 21 aa, Entamoeba dispar
LKDFYDMLSDMFKLAETAHIL

SEQ ID NO: 2493866 - protein, 22 aa, Entamoeba dispar
LKDGRYSQTYGVILRHHSTEEG

SEQ ID NO: 2493867 - protein, 20 aa, Entamoeba dispar
LKDIELYSGKGIINVDLENS

SEQ ID NO: 2493868 - protein, 23 aa, Entamoeba dispar
LKDIHFLVALAYTLPRLDLDSIK

SEQ ID NO: 2493869 - protein, 23 aa, Entamoeba dispar
LKDKIYQIRGFDISNMTFIRGEK

SEQ ID NO: 2493870 - protein, 24 aa, Entamoeba dispar
LKDKRLGICGCGYVGKRVKEIAEG

SEQ ID NO: 2493871 - protein, 17 aa, Entamoeba dispar
LKDLIHFHHLMEEKVNL

SEQ ID NO: 2493872 - protein, 21 aa, Entamoeba dispar
LKDLNMLFSDIIELSNKADIL

SEQ ID NO: 2493873 - protein, 17 aa, Entamoeba dispar
LKDMGLFDSVFVNVQGN

SEQ ID NO: 2493874 - protein, 19 aa, Entamoeba dispar
LKDNDEFLIQRIKRDKTRK

SEQ ID NO: 2493875 - protein, 17 aa, Entamoeba dispar
LKDNDFFVKEWKKRKRI

SEQ ID NO: 2493876 - protein, 23 aa, Entamoeba dispar
LKDNFSKKLFVCISNSAEEGKSI

SEQ ID NO: 2493877 - protein, 20 aa, Entamoeba dispar
LKDPSALVRRSAVIVLSELI

SEQ ID NO: 2493878 - protein, 19 aa, Entamoeba dispar
LKDQTCFTPLLPHLIELTN

SEQ ID NO: 2493879 - protein, 19 aa, Entamoeba dispar
LKDSWKKCMNSLSKEQRKL

SEQ ID NO: 2493880 - protein, 28 aa, Entamoeba dispar
LKDVIPLLKIELNKYIGFNAKFQLEGET

SEQ ID NO: 2493881 - protein, 25 aa, Entamoeba dispar
LKDVKEIKAALEASLVSNQMIQNKI

SEQ ID NO: 2493882 - protein, 22 aa, Entamoeba dispar
LKEAKPVPDFIPLESVDIPNEV

SEQ ID NO: 2493883 - protein, 23 aa, Entamoeba dispar
LKEAKYRVTYKVSEHGDYTIHCL

SEQ ID NO: 2493884 - protein, 19 aa, Entamoeba dispar
LKECLPLAPIHNPSSFSVI

SEQ ID NO: 2493885 - protein, 22 aa, Entamoeba dispar
LKECQFKISSIEIISQKSKTKL

SEQ ID NO: 2493886 - protein, 23 aa, Entamoeba dispar
LKEDVCVPHNKIIVVNPAVCSCV

SEQ ID NO: 2493887 - protein, 25 aa, Entamoeba dispar
LKEDYPICYCCMTNALLFNPQGVFD

SEQ ID NO: 2493888 - protein, 22 aa, Entamoeba dispar
LKEECIWFYQSNFRLLEKYGNF

SEQ ID NO: 2493889 - protein, 24 aa, Entamoeba dispar
LKEECPECEVMLIGSKSDLSYRRC

SEQ ID NO: 2493890 - protein, 19 aa, Entamoeba dispar
LKEEDPLEAEMCVDQRLEY

SEQ ID NO: 2493891 - protein, 25 aa, Entamoeba dispar
LKEELKCSISPPILIDESQLSSKKK

SEQ ID NO: 2493892 - protein, 18 aa, Entamoeba dispar
LKEESIDVIASFIKKLLI

SEQ ID NO: 2493893 - protein, 19 aa, Entamoeba dispar
LKEFIDYNIQCIEGQPHKR

SEQ ID NO: 2493894 - protein, 17 aa, Entamoeba dispar
LKEGLFYVIPYLNIKDI

SEQ ID NO: 2493895 - protein, 18 aa, Entamoeba dispar
LKEGYFGLVKFLNEEQSK

SEQ ID NO: 2493896 - protein, 21 aa, Entamoeba dispar
LKEHLKFYGIDINKLTKTQLS

SEQ ID NO: 2493897 - protein, 17 aa, Entamoeba dispar
LKEHLRDKVYWKESIIF

SEQ ID NO: 2493898 - protein, 38 aa, Entamoeba dispar
LKEIICLDCVKSQWSIEEIIWLFSCVNLSDIKLSIVYR

SEQ ID NO: 2493899 - protein, 20 aa, Entamoeba dispar
LKEINKLKASGDFEKRKEKE

SEQ ID NO: 2493900 - protein, 20 aa, Entamoeba dispar
LKEINRKEVLAMIEDEKKKI

SEQ ID NO: 2493901 - protein, 23 aa, Entamoeba dispar
LKEIPIIRARNGSLEDVIAKELT

SEQ ID NO: 2493902 - protein, 19 aa, Entamoeba dispar
LKEIVKIQMGEVIKMIKKR

SEQ ID NO: 2493903 - protein, 27 aa, Entamoeba dispar
LKEKHPKQKVCIVRFSKDVKILGDCTK

SEQ ID NO: 2493904 - protein, 19 aa, Entamoeba dispar
LKEKICDFQQFLSKDGELI

SEQ ID NO: 2493905 - protein, 18 aa, Entamoeba dispar
LKEKIKNNILHSGDDVEL

SEQ ID NO: 2493906 - protein, 25 aa, Entamoeba dispar
LKEKLKMRYIREKRAMSRDDSYFTS

SEQ ID NO: 2493907 - protein, 18 aa, Entamoeba dispar
LKEKLPLLEYLFKEKYGR

SEQ ID NO: 2493908 - protein, 24 aa, Entamoeba dispar
LKEKMKWEQIEGIIEELKENDPTS

SEQ ID NO: 2493909 - protein, 25 aa, Entamoeba dispar
LKEKMREVIKVLPKREQYRLLRKMD

SEQ ID NO: 2493910 - protein, 18 aa, Entamoeba dispar
LKEKREWDEFKDAHPRGS

SEQ ID NO: 2493911 - protein, 17 aa, Entamoeba dispar
LKEKVGMFSPHKTEINK

SEQ ID NO: 2493912 - protein, 17 aa, Entamoeba dispar
LKEKVIRSYEVSQAENK

SEQ ID NO: 2493913 - protein, 17 aa, Entamoeba dispar
LKEKYQINCENEMISKG

SEQ ID NO: 2493914 - protein, 17 aa, Entamoeba dispar
LKELCIYKDTACETHDL

SEQ ID NO: 2493915 - protein, 21 aa, Entamoeba dispar
LKELKCHWVPFHPINKKIVGE

SEQ ID NO: 2493916 - protein, 17 aa, Entamoeba dispar
LKELLGALIKNGECPLI

SEQ ID NO: 2493917 - protein, 19 aa, Entamoeba dispar
LKEMGFFDEEENLRVLQRV

SEQ ID NO: 2493918 - protein, 20 aa, Entamoeba dispar
LKEMIWEQLNLVRVYTKVPG

SEQ ID NO: 2493919 - protein, 19 aa, Entamoeba dispar
LKENITWNIDKKEGESEVN

SEQ ID NO: 2493920 - protein, 19 aa, Entamoeba dispar
LKEPLTFTFSSSLKEGDSI

SEQ ID NO: 2493921 - protein, 19 aa, Entamoeba dispar
LKEQFPEWLEKNKTIITSE

SEQ ID NO: 2493922 - protein, 17 aa, Entamoeba dispar
LKEQMGEFVTKKDIDKL

SEQ ID NO: 2493923 - protein, 21 aa, Entamoeba dispar
LKEQWYKAKYDYINIPISISR

SEQ ID NO: 2493924 - protein, 22 aa, Entamoeba dispar
LKERSFIIVGIILKLDKELKQI

SEQ ID NO: 2493925 - protein, 19 aa, Entamoeba dispar
LKESISYVTLNPITINSIK

SEQ ID NO: 2493926 - protein, 27 aa, Entamoeba dispar
LKESLNALCKIASLFNQSKKETEEANI

SEQ ID NO: 2493927 - protein, 19 aa, Entamoeba dispar
LKESVCFTTLDTYFETFEE

SEQ ID NO: 2493928 - protein, 18 aa, Entamoeba dispar
LKEVEGTFQIKNELVNTR

SEQ ID NO: 2493929 - protein, 21 aa, Entamoeba dispar
LKEVFKYNDLINFNKIDQNHY

SEQ ID NO: 2493930 - protein, 25 aa, Entamoeba dispar
LKEVIDNICSLIWQYKDSINVTFID

SEQ ID NO: 2493931 - protein, 21 aa, Entamoeba dispar
LKEVIRRQHEVLLKLKKEREI

SEQ ID NO: 2493932 - protein, 17 aa, Entamoeba dispar
LKEVLDSIVKQNKLYGV

SEQ ID NO: 2493933 - protein, 20 aa, Entamoeba dispar
LKEVRGLGDIEIYRDLETKG

SEQ ID NO: 2493934 - protein, 22 aa, Entamoeba dispar
LKEWCFEDCLSLTSINIPSTIN

SEQ ID NO: 2493935 - protein, 21 aa, Entamoeba dispar
LKEYFPYKIEIQGNNFIAHVG

SEQ ID NO: 2493936 - protein, 23 aa, Entamoeba dispar
LKEYGSDILTVFLQKAESVCENK

SEQ ID NO: 2493937 - protein, 21 aa, Entamoeba dispar
LKEYIKLYFFDGEKYRNDLLP

SEQ ID NO: 2493938 - protein, 17 aa, Entamoeba dispar
LKEYKGFSVPDIQQSTP

SEQ ID NO: 2493939 - protein, 18 aa, Entamoeba dispar
LKFAKTVNKIGVECFFGC

SEQ ID NO: 2493940 - protein, 23 aa, Entamoeba dispar
LKFCNKHLMQLIGTMIKFGNDIS

SEQ ID NO: 2493941 - protein, 17 aa, Entamoeba dispar
LKFEEIKDLCGLEGVKS

SEQ ID NO: 2493942 - protein, 19 aa, Entamoeba dispar
LKFENCIDGIDLTSIINLK

SEQ ID NO: 2493943 - protein, 18 aa, Entamoeba dispar
LKFKPNIKIITFINKSSY

SEQ ID NO: 2493944 - protein, 17 aa, Entamoeba dispar
LKFKRLDLPIENEIYSY

SEQ ID NO: 2493945 - protein, 19 aa, Entamoeba dispar
LKFLQCYSNSLPKKLPVTQ

SEQ ID NO: 2493946 - protein, 22 aa, Entamoeba dispar
LKFMNKYCSLVFDSECVNVAVA

SEQ ID NO: 2493947 - protein, 17 aa, Entamoeba dispar
LKFNGIVYNEMKEEETN

SEQ ID NO: 2493948 - protein, 22 aa, Entamoeba dispar
LKFNYGNILGIFFQKTLPRFGG

SEQ ID NO: 2493949 - protein, 19 aa, Entamoeba dispar
LKFPCPLHVLVDGPVEQNE

SEQ ID NO: 2493950 - protein, 28 aa, Entamoeba dispar
LKFRADIEVSCFAIGGVESVKRALLKGV

SEQ ID NO: 2493951 - protein, 18 aa, Entamoeba dispar
LKFVQGCQYHGIVPYFFL

SEQ ID NO: 2493952 - protein, 17 aa, Entamoeba dispar
LKFVQKQFICYEPDPKK

SEQ ID NO: 2493953 - protein, 24 aa, Entamoeba dispar
LKGGELKPGKGFNLQPHPFIQNQL

SEQ ID NO: 2493954 - protein, 20 aa, Entamoeba dispar
LKGIDFTTAYRSWGSCDPEE

SEQ ID NO: 2493955 - protein, 20 aa, Entamoeba dispar
LKGINCKRVSLSRRERIENG

SEQ ID NO: 2493956 - protein, 21 aa, Entamoeba dispar
LKGIYKIAALLPSLKTSPIVI

SEQ ID NO: 2493957 - protein, 23 aa, Entamoeba dispar
LKGKCMICIKEVISEYLMTCPIC

SEQ ID NO: 2493958 - protein, 27 aa, Entamoeba dispar
LKGKELKRHGLGMIHGIDVKKIRSMIE

SEQ ID NO: 2493959 - protein, 18 aa, Entamoeba dispar
LKGLCGVMFMNIPFYQNT

SEQ ID NO: 2493960 - protein, 17 aa, Entamoeba dispar
LKGLKVISAKKVTISKD

SEQ ID NO: 2493961 - protein, 24 aa, Entamoeba dispar
LKGLTDYYLLSGINVPETLRDIYN

SEQ ID NO: 2493962 - protein, 17 aa, Entamoeba dispar
LKGMPFIIYVNKIDLKP

SEQ ID NO: 2493963 - protein, 22 aa, Entamoeba dispar
LKGQVLRFLNRETIVILDSLNY

SEQ ID NO: 2493964 - protein, 24 aa, Entamoeba dispar
LKGRNELKEKLIIESNSNTIDIKD

SEQ ID NO: 2493965 - protein, 17 aa, Entamoeba dispar
LKGSIIDGLENLQETKE

SEQ ID NO: 2493966 - protein, 27 aa, Entamoeba dispar
LKGTGVKVCTVIGFPLGATPSDVKAYE

SEQ ID NO: 2493967 - protein, 17 aa, Entamoeba dispar
LKGTLLENGRIDSNPKF

SEQ ID NO: 2493968 - protein, 29 aa, Entamoeba dispar
LKGVEGRAYHFISIIPYNGILLLLDGLSE

SEQ ID NO: 2493969 - protein, 19 aa, Entamoeba dispar
LKGYIWNGVPVPLEDFTTP

SEQ ID NO: 2493970 - protein, 21 aa, Entamoeba dispar
LKGYMLQILQAIQFLHSNNIL

SEQ ID NO: 2493971 - protein, 19 aa, Entamoeba dispar
LKGYPSIVSHKIFEMYCLK

SEQ ID NO: 2493972 - protein, 21 aa, Entamoeba dispar
LKHAKEIGSYVIVGVYDDVIA

SEQ ID NO: 2493973 - protein, 34 aa, Entamoeba dispar
LKHGYSIFTCGSLEMKTEFIKFIIHVSYAEESQE

SEQ ID NO: 2493974 - protein, 25 aa, Entamoeba dispar
LKHIKPCPYRPFGNDGKVLPNVVMA

SEQ ID NO: 2493975 - protein, 17 aa, Entamoeba dispar
LKHKHIVRYIASTESHG

SEQ ID NO: 2493976 - protein, 30 aa, Entamoeba dispar
LKHKSSDLNLDWLTERIILSYLEYFEFVAS

SEQ ID NO: 2493977 - protein, 20 aa, Entamoeba dispar
LKHLEMNNVFASTMNFEQRL

SEQ ID NO: 2493978 - protein, 17 aa, Entamoeba dispar
LKHLGYVVFKRCFSLQN

SEQ ID NO: 2493979 - protein, 22 aa, Entamoeba dispar
LKHPYILKSLQKCVSEWIREGE

SEQ ID NO: 2493980 - protein, 24 aa, Entamoeba dispar
LKHRIFAIEFFIKVAEYLKKLNNF

SEQ ID NO: 2493981 - protein, 18 aa, Entamoeba dispar
LKHYRIVIQLNPNNYKGW

SEQ ID NO: 2493982 - protein, 17 aa, Entamoeba dispar
LKIADFGLARPITYREC

SEQ ID NO: 2493983 - protein, 18 aa, Entamoeba dispar
LKIAEMKDETGLKDIDDF

SEQ ID NO: 2493984 - protein, 18 aa, Entamoeba dispar
LKIAFKNKLSIPVKVNCL

SEQ ID NO: 2493985 - protein, 25 aa, Entamoeba dispar
LKIEKYHIPYLFPIPYLSDEKYSIA

SEQ ID NO: 2493986 - protein, 23 aa, Entamoeba dispar
LKIFKTGKWRKSILDALNHSLEV

SEQ ID NO: 2493987 - protein, 17 aa, Entamoeba dispar
LKIFSYLRIDSIRNVQL

SEQ ID NO: 2493988 - protein, 17 aa, Entamoeba dispar
LKIGLLKLKNYKHLFEW

SEQ ID NO: 2493989 - protein, 20 aa, Entamoeba dispar
LKIGVNFKFVTTIIDRVLIK

SEQ ID NO: 2493990 - protein, 19 aa, Entamoeba dispar
LKIIDSIIFAFKGRVLAFS

SEQ ID NO: 2493991 - protein, 23 aa, Entamoeba dispar
LKIIESYISMGYIKNAEIINERI

SEQ ID NO: 2493992 - protein, 17 aa, Entamoeba dispar
LKIIKIETFVALNNSTN

SEQ ID NO: 2493993 - protein, 23 aa, Entamoeba dispar
LKIIKKSCFEFCENLIEIEIPKS

SEQ ID NO: 2493994 - protein, 17 aa, Entamoeba dispar
LKIIVSFESFCSYFADK

SEQ ID NO: 2493995 - protein, 18 aa, Entamoeba dispar
LKIKCLKYTSKKEAIESD

SEQ ID NO: 2493996 - protein, 22 aa, Entamoeba dispar
LKIKKEKKVLVQFKIDISQVFR

SEQ ID NO: 2493997 - protein, 17 aa, Entamoeba dispar
LKIKRLLDASHLFSDSI

SEQ ID NO: 2493998 - protein, 19 aa, Entamoeba dispar
LKIKVIENGCRVIYAHEEN

SEQ ID NO: 2493999 - protein, 19 aa, Entamoeba dispar
LKIKVLIKGNRIGYIHYCD

SEQ ID NO: 2494000 - protein, 23 aa, Entamoeba dispar
LKILKEYYLEKILEEREDKTIRN

SEQ ID NO: 2494001 - protein, 17 aa, Entamoeba dispar
LKILKKVKWLELKKQLL

SEQ ID NO: 2494002 - protein, 25 aa, Entamoeba dispar
LKILKSGGMLGFFAMDNLNAITSLT

SEQ ID NO: 2494003 - protein, 18 aa, Entamoeba dispar
LKILPQSIQFHRDAKNKI

SEQ ID NO: 2494004 - protein, 21 aa, Entamoeba dispar
LKILQIYKCPLISFEGIENIY

SEQ ID NO: 2494005 - protein, 17 aa, Entamoeba dispar
LKINAEDGIAWMNLGEC

SEQ ID NO: 2494006 - protein, 20 aa, Entamoeba dispar
LKINLNQNVPNSFQILAKKS

SEQ ID NO: 2494007 - protein, 26 aa, Entamoeba dispar
LKINPFKYGAVIDVVYDNGIVYDAKA

SEQ ID NO: 2494008 - protein, 19 aa, Entamoeba dispar
LKINPWFTSKRDINQFCKT

SEQ ID NO: 2494009 - protein, 30 aa, Entamoeba dispar
LKINVICMFIQLLSKFILVWSSIYGDSPSK

SEQ ID NO: 2494010 - protein, 19 aa, Entamoeba dispar
LKIPCIVIPMDSTVTISRR

SEQ ID NO: 2494011 - protein, 21 aa, Entamoeba dispar
LKIPNGFTIPSLVPGETITSV

SEQ ID NO: 2494012 - protein, 18 aa, Entamoeba dispar
LKIRTSFNNYIIKAKQVI

SEQ ID NO: 2494013 - protein, 25 aa, Entamoeba dispar
LKISKRTSYIITFLFYNKEIIKRIN

SEQ ID NO: 2494014 - protein, 26 aa, Entamoeba dispar
LKISKRTSYIITFLFYNKEIIKRINN

SEQ ID NO: 2494015 - protein, 28 aa, Entamoeba dispar
LKISLIQIFRAHLWQKIHESIVMDLCQV

SEQ ID NO: 2494016 - protein, 17 aa, Entamoeba dispar
LKISLSCEGVRIKLSKD

SEQ ID NO: 2494017 - protein, 30 aa, Entamoeba dispar
LKITECKFLQFRSASFLSLEHLRIHLCDYI

SEQ ID NO: 2494018 - protein, 21 aa, Entamoeba dispar
LKITGRIPRQFYQTQQLKTIR

SEQ ID NO: 2494019 - protein, 19 aa, Entamoeba dispar
LKITSIKTMDYFNLLLKKK

SEQ ID NO: 2494020 - protein, 27 aa, Entamoeba dispar
LKIVGKLPGAAAWKVNKKVLEFYKEID

SEQ ID NO: 2494021 - protein, 20 aa, Entamoeba dispar
LKIVRKYLLGPLGMKTLDPT

SEQ ID NO: 2494022 - protein, 18 aa, Entamoeba dispar
LKIYLYPNEEFNQIDESD

SEQ ID NO: 2494023 - protein, 17 aa, Entamoeba dispar
LKIYLYPNEEFNQVDEN

SEQ ID NO: 2494024 - protein, 18 aa, Entamoeba dispar
LKIYLYPNEEFNTIDESD

SEQ ID NO: 2494025 - protein, 21 aa, Entamoeba dispar
LKIYLYPNERFNTIDESEAIA

SEQ ID NO: 2494026 - protein, 21 aa, Entamoeba dispar
LKIYNCLDSFYTNEEPVHKSP

SEQ ID NO: 2494027 - protein, 29 aa, Entamoeba dispar
LKKAALEALEVLNGKTIEKVCVDEIMQQR

SEQ ID NO: 2494028 - protein, 18 aa, Entamoeba dispar
LKKAKRFHIIQEMYTTEK

SEQ ID NO: 2494029 - protein, 17 aa, Entamoeba dispar
LKKARLTNETGEFDKAT

SEQ ID NO: 2494030 - protein, 22 aa, Entamoeba dispar
LKKASSFAGCIDKIPADIAKQF

SEQ ID NO: 2494031 - protein, 24 aa, Entamoeba dispar
LKKCEEDIRVILGYNKMMYQSVLE

SEQ ID NO: 2494032 - protein, 21 aa, Entamoeba dispar
LKKCKEDIIVILGYNNMIYTN

SEQ ID NO: 2494033 - protein, 21 aa, Entamoeba dispar
LKKCKEIIEEIKLNNKNNYLP

SEQ ID NO: 2494034 - protein, 17 aa, Entamoeba dispar
LKKCNPETTLFVICSKT

SEQ ID NO: 2494035 - protein, 26 aa, Entamoeba dispar
LKKCQSELFQPLSQIVVKRIFPASFE

SEQ ID NO: 2494036 - protein, 17 aa, Entamoeba dispar
LKKDCIMPYLNTVHEYL

SEQ ID NO: 2494037 - protein, 24 aa, Entamoeba dispar
LKKEIKTNILAIGNECLYFYCSPY

SEQ ID NO: 2494038 - protein, 24 aa, Entamoeba dispar
LKKEKYPCGILYGRMEEYLREREF

SEQ ID NO: 2494039 - protein, 26 aa, Entamoeba dispar
LKKFLKTFIESCSDWGTGNDVDITPS

SEQ ID NO: 2494040 - protein, 23 aa, Entamoeba dispar
LKKFPYEPLFNFVLPTERSYRKV

SEQ ID NO: 2494041 - protein, 26 aa, Entamoeba dispar
LKKGYRVPTPIQRKAIPAILRGNDII

SEQ ID NO: 2494042 - protein, 18 aa, Entamoeba dispar
LKKIIKIYLKDNKQKELV

SEQ ID NO: 2494043 - protein, 25 aa, Entamoeba dispar
LKKIKRIVLPIAVFARTPNSRNVDE

SEQ ID NO: 2494044 - protein, 26 aa, Entamoeba dispar
LKKIPREDLLSFSILYGLINRLVKYS

SEQ ID NO: 2494045 - protein, 19 aa, Entamoeba dispar
LKKIRIVLNTSTKESDLLV

SEQ ID NO: 2494046 - protein, 19 aa, Entamoeba dispar
LKKKCDAQDSLLKTKMKSE

SEQ ID NO: 2494047 - protein, 17 aa, Entamoeba dispar
LKKKFGLISDITKTETD

SEQ ID NO: 2494048 - protein, 18 aa, Entamoeba dispar
LKKKGKFNNIIGIEKVKE

SEQ ID NO: 2494049 - protein, 17 aa, Entamoeba dispar
LKKKGNYHFVKMEQLCG

SEQ ID NO: 2494050 - protein, 20 aa, Entamoeba dispar
LKKKMMKIRHEEQKKAADIR

SEQ ID NO: 2494051 - protein, 27 aa, Entamoeba dispar
LKKKPKRKLKIFKIFFMAIVEKELQYI

SEQ ID NO: 2494052 - protein, 17 aa, Entamoeba dispar
LKKKRKALEKLQNICQS

SEQ ID NO: 2494053 - protein, 17 aa, Entamoeba dispar
LKKLEMEECDLIDIDND

SEQ ID NO: 2494054 - protein, 21 aa, Entamoeba dispar
LKKLNNFDGFKAILAALDSSP

SEQ ID NO: 2494055 - protein, 20 aa, Entamoeba dispar
LKKLPPIFHLIRNPINNDIC

SEQ ID NO: 2494056 - protein, 21 aa, Entamoeba dispar
LKKLPRKSLETSREVLKRREQ

SEQ ID NO: 2494057 - protein, 17 aa, Entamoeba dispar
LKKLQTILLDPAKKMDI

SEQ ID NO: 2494058 - protein, 25 aa, Entamoeba dispar
LKKLRLERLKDILLIQRDFIENQEQ

SEQ ID NO: 2494059 - protein, 19 aa, Entamoeba dispar
LKKLVKFMKGEVEVIQDPD

SEQ ID NO: 2494060 - protein, 17 aa, Entamoeba dispar
LKKLVSNGVRYDHIKTC

SEQ ID NO: 2494061 - protein, 19 aa, Entamoeba dispar
LKKMLKFLWHKLIPHTKKH

SEQ ID NO: 2494062 - protein, 19 aa, Entamoeba dispar
LKKNGFITGLMNLLECEFN

SEQ ID NO: 2494063 - protein, 20 aa, Entamoeba dispar
LKKNNLREWLRVVSDKKDGF

SEQ ID NO: 2494064 - protein, 31 aa, Entamoeba dispar
LKKPNFWKLRRRDCPWIKQKRCNIIEDEDDQ

SEQ ID NO: 2494065 - protein, 27 aa, Entamoeba dispar
LKKPYRNIFKWAPLLALVNSLTNLSNF

SEQ ID NO: 2494066 - protein, 18 aa, Entamoeba dispar
LKKQKFVYLILDEAHSAK

SEQ ID NO: 2494067 - protein, 17 aa, Entamoeba dispar
LKKQRVKEVFNNDIIQF

SEQ ID NO: 2494068 - protein, 20 aa, Entamoeba dispar
LKKRIIPFHADTCIGDLLSL

SEQ ID NO: 2494069 - protein, 21 aa, Entamoeba dispar
LKKRKVDQLITREMLENTNKK

SEQ ID NO: 2494070 - protein, 19 aa, Entamoeba dispar
LKKRTKREISHDKKIKPNK

SEQ ID NO: 2494071 - protein, 21 aa, Entamoeba dispar
LKKSELFGSTSANVIASLNIK

SEQ ID NO: 2494072 - protein, 18 aa, Entamoeba dispar
LKKSFITLGNFQITNKQP

SEQ ID NO: 2494073 - protein, 21 aa, Entamoeba dispar
LKKSKGVKELEEIFEVNQKKL

SEQ ID NO: 2494074 - protein, 22 aa, Entamoeba dispar
LKKSPDLLAILLAEYCNHIVSS

SEQ ID NO: 2494075 - protein, 18 aa, Entamoeba dispar
LKKSSGWTTRSGRMRKSE

SEQ ID NO: 2494076 - protein, 20 aa, Entamoeba dispar
LKKYATFFIKLYINSLTKKE

SEQ ID NO: 2494077 - protein, 21 aa, Entamoeba dispar
LKKYEEIPWIKELRKEHQENE

SEQ ID NO: 2494078 - protein, 26 aa, Entamoeba dispar
LKKYKWNVEESIPWIIDNIRTFPKPE

SEQ ID NO: 2494079 - protein, 21 aa, Entamoeba dispar
LKKYLELFGSFYCEEKDRIKR

SEQ ID NO: 2494080 - protein, 19 aa, Entamoeba dispar
LKKYYRLLGEKNPSERWRV

SEQ ID NO: 2494081 - protein, 20 aa, Entamoeba dispar
LKLALLEELPFGEIDINEYL

SEQ ID NO: 2494082 - protein, 20 aa, Entamoeba dispar
LKLDKVLCKFTTPSTLTKLV

SEQ ID NO: 2494083 - protein, 20 aa, Entamoeba dispar
LKLENVMLCGVNLKVKLADF

SEQ ID NO: 2494084 - protein, 17 aa, Entamoeba dispar
LKLFLYTGDPCYPIQDL

SEQ ID NO: 2494085 - protein, 18 aa, Entamoeba dispar
LKLFSGIKVIRTDISNAL

SEQ ID NO: 2494086 - protein, 21 aa, Entamoeba dispar
LKLGLTPSHIKKILIDIFQID

SEQ ID NO: 2494087 - protein, 18 aa, Entamoeba dispar
LKLGTGYDHSFIINENAP

SEQ ID NO: 2494088 - protein, 18 aa, Entamoeba dispar
LKLHGRWINEGPLLYHYK

SEQ ID NO: 2494089 - protein, 18 aa, Entamoeba dispar
LKLIDDGKLLDIMKQKDI

SEQ ID NO: 2494090 - protein, 23 aa, Entamoeba dispar
LKLIDLGSSCFENYTLYTYIQSR

SEQ ID NO: 2494091 - protein, 20 aa, Entamoeba dispar
LKLKKYRILVLETTHGCSIL

SEQ ID NO: 2494092 - protein, 20 aa, Entamoeba dispar
LKLKNYKHLFEWYWQGIWNE

SEQ ID NO: 2494093 - protein, 25 aa, Entamoeba dispar
LKLKPKCPIHVLTIIHSKGVSVIGN

SEQ ID NO: 2494094 - protein, 17 aa, Entamoeba dispar
LKLKVEINSNVFDTKGI

SEQ ID NO: 2494095 - protein, 17 aa, Entamoeba dispar
LKLLAEINVSWNDITEL

SEQ ID NO: 2494096 - protein, 18 aa, Entamoeba dispar
LKLLCNVVYGYTGAGLSG

SEQ ID NO: 2494097 - protein, 17 aa, Entamoeba dispar
LKLLIQKNINDWDNLQN

SEQ ID NO: 2494098 - protein, 24 aa, Entamoeba dispar
LKLLKINPLERITCEDALKLDLFV

SEQ ID NO: 2494099 - protein, 17 aa, Entamoeba dispar
LKLLLSIPDNFDIIVDT

SEQ ID NO: 2494100 - protein, 18 aa, Entamoeba dispar
LKLLRLLIRNEGNLQRFC

SEQ ID NO: 2494101 - protein, 48 aa, Entamoeba dispar
LKLLSEAKCVLHLLNAFKRCNFADGICASELRDFCSMLNDHDELTLMY

SEQ ID NO: 2494102 - protein, 17 aa, Entamoeba dispar
LKLLSLPVDEQGAQLPE

SEQ ID NO: 2494103 - protein, 22 aa, Entamoeba dispar
LKLMEMSGLRALSLYCGFEENN

SEQ ID NO: 2494104 - protein, 24 aa, Entamoeba dispar
LKLMKCSFPNLPADEEDLCLKLLK

SEQ ID NO: 2494105 - protein, 18 aa, Entamoeba dispar
LKLNIIEQCCKGVQWLHN

SEQ ID NO: 2494106 - protein, 21 aa, Entamoeba dispar
LKLNRVDIIPSLYQRSIPFLS

SEQ ID NO: 2494107 - protein, 20 aa, Entamoeba dispar
LKLPDSFKYFMTTIGSHITE

SEQ ID NO: 2494108 - protein, 26 aa, Entamoeba dispar
LKLPTLKKVIIFCGMKEFQELSELFD

SEQ ID NO: 2494109 - protein, 20 aa, Entamoeba dispar
LKLQLSESIEKNSELESVMK

SEQ ID NO: 2494110 - protein, 27 aa, Entamoeba dispar
LKLRHQLLLKLLKIMDMFQLKKMLKFL

SEQ ID NO: 2494111 - protein, 28 aa, Entamoeba dispar
LKLSDPLLRLDALVSIAKNRQWNGEIND

SEQ ID NO: 2494112 - protein, 25 aa, Entamoeba dispar
LKLSECPYLCRTCLSFQSENLHFVM

SEQ ID NO: 2494113 - protein, 17 aa, Entamoeba dispar
LKLSEFVGETLMVLPNA

SEQ ID NO: 2494114 - protein, 22 aa, Entamoeba dispar
LKLSPVCLTQILGTNKNIARAL

SEQ ID NO: 2494115 - protein, 17 aa, Entamoeba dispar
LKLSRIVFYIYQPQAQT

SEQ ID NO: 2494116 - protein, 18 aa, Entamoeba dispar
LKLSVQGRIHVKLETFKG

SEQ ID NO: 2494117 - protein, 21 aa, Entamoeba dispar
LKLTNAFGVLNVINFAGQGMN

SEQ ID NO: 2494118 - protein, 17 aa, Entamoeba dispar
LKLVNFFRVRTYGSMLR

SEQ ID NO: 2494119 - protein, 20 aa, Entamoeba dispar
LKLYFRCFKTNKKGEITTEQ

SEQ ID NO: 2494120 - protein, 26 aa, Entamoeba dispar
LKLYIKLLPEQVIPKFIDDRLYELWK

SEQ ID NO: 2494121 - protein, 30 aa, Entamoeba dispar
LKLYRRDAIQIIPWKNITSITISTTSKEEY

SEQ ID NO: 2494122 - protein, 28 aa, Entamoeba dispar
LKMDKKNCFMRNPMKFDGVDDMSQLTHL

SEQ ID NO: 2494123 - protein, 23 aa, Entamoeba dispar
LKMGKGKIAAQCGHAVVECVLKS

SEQ ID NO: 2494124 - protein, 17 aa, Entamoeba dispar
LKMGRTVKELDEIAKGN

SEQ ID NO: 2494125 - protein, 19 aa, Entamoeba dispar
LKMILEIAKGLKYLHELKI

SEQ ID NO: 2494126 - protein, 25 aa, Entamoeba dispar
LKMKDCGDVNAIGRIHNFLEKAGWI

SEQ ID NO: 2494127 - protein, 30 aa, Entamoeba dispar
LKMKESLTVGKIKAAQGIKEDKKWEGKVVN

SEQ ID NO: 2494128 - protein, 31 aa, Entamoeba dispar
LKMKESLTVGKIKAAQGIKEDKKWEGKVVNK

SEQ ID NO: 2494129 - protein, 17 aa, Entamoeba dispar
LKMKMRQSEEIMQQRIY

SEQ ID NO: 2494130 - protein, 21 aa, Entamoeba dispar
LKMLCELNVRDNIKMKGMPEE

SEQ ID NO: 2494131 - protein, 19 aa, Entamoeba dispar
LKMLFKQMYPDGVDERKAP

SEQ ID NO: 2494132 - protein, 17 aa, Entamoeba dispar
LKMPNLEEAHAYLKDIS

SEQ ID NO: 2494133 - protein, 29 aa, Entamoeba dispar
LKMVEWLRMKSRILFSFMSLGYFQEMDMM

SEQ ID NO: 2494134 - protein, 17 aa, Entamoeba dispar
LKNAISIFNGTEWIYKQ

SEQ ID NO: 2494135 - protein, 21 aa, Entamoeba dispar
LKNAKCPLCGHGLNKKSKIIP

SEQ ID NO: 2494136 - protein, 18 aa, Entamoeba dispar
LKNCVTITNKIRENVYGK

SEQ ID NO: 2494137 - protein, 24 aa, Entamoeba dispar
LKNDKRIGKIYVHCDDYYDDTCVV

SEQ ID NO: 2494138 - protein, 21 aa, Entamoeba dispar
LKNDLYIKQILSYMEKKSNQL

SEQ ID NO: 2494139 - protein, 19 aa, Entamoeba dispar
LKNEGCIKFYSINGNGEIT

SEQ ID NO: 2494140 - protein, 17 aa, Entamoeba dispar
LKNEIMFITSFTLDMFK

SEQ ID NO: 2494141 - protein, 25 aa, Entamoeba dispar
LKNEKENIVRIGILLNEKPLIKKQL

SEQ ID NO: 2494142 - protein, 19 aa, Entamoeba dispar
LKNERVIDHLIEYELQTSQ

SEQ ID NO: 2494143 - protein, 21 aa, Entamoeba dispar
LKNEWKKLKKSLGSHQKKILD

SEQ ID NO: 2494144 - protein, 19 aa, Entamoeba dispar
LKNFCGFKKLLETNKEEII

SEQ ID NO: 2494145 - protein, 19 aa, Entamoeba dispar
LKNFCIYAKSNSKIIEENS

SEQ ID NO: 2494146 - protein, 19 aa, Entamoeba dispar
LKNFSMILGPLIIHIPYEI

SEQ ID NO: 2494147 - protein, 17 aa, Entamoeba dispar
LKNGTTIRARWNKGDCV

SEQ ID NO: 2494148 - protein, 21 aa, Entamoeba dispar
LKNICLQSAAAPGYFDPVNNH

SEQ ID NO: 2494149 - protein, 23 aa, Entamoeba dispar
LKNKKDHIILCFSSDTDRSQFKT

SEQ ID NO: 2494150 - protein, 25 aa, Entamoeba dispar
LKNKLLCAEGYYRLVRLNIFNENFH

SEQ ID NO: 2494151 - protein, 24 aa, Entamoeba dispar
LKNKPCYFRQGMLEIAMLHAANLH

SEQ ID NO: 2494152 - protein, 21 aa, Entamoeba dispar
LKNKRYSFVFLKHENLNTWAN

SEQ ID NO: 2494153 - protein, 17 aa, Entamoeba dispar
LKNLHLIRCRVNEKIEF

SEQ ID NO: 2494154 - protein, 22 aa, Entamoeba dispar
LKNLKITGCLTDYLIPNIDTVK

SEQ ID NO: 2494155 - protein, 31 aa, Entamoeba dispar
LKNLKTVYVLFQFRFPETIIYDFHNVDIQRT

SEQ ID NO: 2494156 - protein, 24 aa, Entamoeba dispar
LKNLKVDEFRGHFMLDGHNESIKY

SEQ ID NO: 2494157 - protein, 26 aa, Entamoeba dispar
LKNLPRHVLIPAFLIDSGIDSETRHC

SEQ ID NO: 2494158 - protein, 19 aa, Entamoeba dispar
LKNLVDRRCVKVDKNEKGK

SEQ ID NO: 2494159 - protein, 18 aa, Entamoeba dispar
LKNMMKMMRNPQLMSQAL

SEQ ID NO: 2494160 - protein, 18 aa, Entamoeba dispar
LKNPFIISEMIIKSKKFE

SEQ ID NO: 2494161 - protein, 18 aa, Entamoeba dispar
LKNQFLIEKKQMMEKQQQ

SEQ ID NO: 2494162 - protein, 20 aa, Entamoeba dispar
LKNRIEKRIDEEENKIQNER

SEQ ID NO: 2494163 - protein, 21 aa, Entamoeba dispar
LKNRLPRSLTTLNWEDSCVTV

SEQ ID NO: 2494164 - protein, 17 aa, Entamoeba dispar
LKNSVVKSAGNRQESST

SEQ ID NO: 2494165 - protein, 22 aa, Entamoeba dispar
LKNTCLPQRRIVKLTQSNLKLK

SEQ ID NO: 2494166 - protein, 17 aa, Entamoeba dispar
LKNTVPIPQHWCQKKRY

SEQ ID NO: 2494167 - protein, 17 aa, Entamoeba dispar
LKNTYLHSSISLNDFTH

SEQ ID NO: 2494168 - protein, 23 aa, Entamoeba dispar
LKNVDLWNCKGAISYIDKLRLYI

SEQ ID NO: 2494169 - protein, 17 aa, Entamoeba dispar
LKNVMAIGDAMNDIPML

SEQ ID NO: 2494170 - protein, 21 aa, Entamoeba dispar
LKPELKYDSFESFHEEIEKIK

SEQ ID NO: 2494171 - protein, 19 aa, Entamoeba dispar
LKPFGGIEQLCWSKDSRKI

SEQ ID NO: 2494172 - protein, 26 aa, Entamoeba dispar
LKPFTICTWFYIHSFPEYQTPSVSLF

SEQ ID NO: 2494173 - protein, 18 aa, Entamoeba dispar
LKPGEYITNCLRCNRTCH

SEQ ID NO: 2494174 - protein, 31 aa, Entamoeba dispar
LKPGEYITNCLYCHKTCCYPCDIKGDIKDGC

SEQ ID NO: 2494175 - protein, 37 aa, Entamoeba dispar
LKPGEYVTNCLYCHKTCHYPCYIKGDIKKGCSCIGAN

SEQ ID NO: 2494176 - protein, 18 aa, Entamoeba dispar
LKPKIFYGLRSDCYIFSQ

SEQ ID NO: 2494177 - protein, 22 aa, Entamoeba dispar
LKPKKLWTGKQLYGLALKPNKH

SEQ ID NO: 2494178 - protein, 20 aa, Entamoeba dispar
LKPKVLAPMKYHIKINDPNI

SEQ ID NO: 2494179 - protein, 26 aa, Entamoeba dispar
LKPQTMKIQCEITGPSIKIPIQDHPT

SEQ ID NO: 2494180 - protein, 19 aa, Entamoeba dispar
LKPTLLDICQKEYNSLIKF

SEQ ID NO: 2494181 - protein, 17 aa, Entamoeba dispar
LKPTNGIDIEFEENRCG

SEQ ID NO: 2494182 - protein, 19 aa, Entamoeba dispar
LKPYAFIVATEIEYFIFGR

SEQ ID NO: 2494183 - protein, 24 aa, Entamoeba dispar
LKPYESCLLDFLTLMDDVPRIMGL

SEQ ID NO: 2494184 - protein, 24 aa, Entamoeba dispar
LKQCGISSPLYAGRNVNDLSTIKQ

SEQ ID NO: 2494185 - protein, 23 aa, Entamoeba dispar
LKQFECLKSIHYGPMDVQCEWIL

SEQ ID NO: 2494186 - protein, 17 aa, Entamoeba dispar
LKQHFYTLFKIHDSLKH

SEQ ID NO: 2494187 - protein, 21 aa, Entamoeba dispar
LKQLAILCAGYDGIKPDLYDE

SEQ ID NO: 2494188 - protein, 20 aa, Entamoeba dispar
LKQLCRELTNENVIWGIQHV

SEQ ID NO: 2494189 - protein, 17 aa, Entamoeba dispar
LKQLFDPCHSIDASVVY

SEQ ID NO: 2494190 - protein, 18 aa, Entamoeba dispar
LKQLKFTTIKGQGKLKIN

SEQ ID NO: 2494191 - protein, 19 aa, Entamoeba dispar
LKQLKLYGVNKLKINEIKE

SEQ ID NO: 2494192 - protein, 24 aa, Entamoeba dispar
LKQLPLRYFIIPTIISKNNKATRM

SEQ ID NO: 2494193 - protein, 20 aa, Entamoeba dispar
LKQLYSIIAEELLDSKKGEL

SEQ ID NO: 2494194 - protein, 25 aa, Entamoeba dispar
LKQMAMKEIRIMKLFHHPNICAFFD

SEQ ID NO: 2494195 - protein, 23 aa, Entamoeba dispar
LKQMKMRVQEMISSLKEYKSIME

SEQ ID NO: 2494196 - protein, 24 aa, Entamoeba dispar
LKQNERFIFPNLIISFNISKLEFV

SEQ ID NO: 2494197 - protein, 20 aa, Entamoeba dispar
LKQNNLFISFGRKSIDCSAI

SEQ ID NO: 2494198 - protein, 19 aa, Entamoeba dispar
LKQNVIYSYTDLVRDVSFK

SEQ ID NO: 2494199 - protein, 17 aa, Entamoeba dispar
LKQPIICVSVRVNEETL

SEQ ID NO: 2494200 - protein, 19 aa, Entamoeba dispar
LKQRTQLFITSGKHKVLIA

SEQ ID NO: 2494201 - protein, 18 aa, Entamoeba dispar
LKQSISLLSKELKQKEIE

SEQ ID NO: 2494202 - protein, 17 aa, Entamoeba dispar
LKQSREVLKRREQIKTQ

SEQ ID NO: 2494203 - protein, 21 aa, Entamoeba dispar
LKQSVIYPGIIKYFKDIKENI

SEQ ID NO: 2494204 - protein, 27 aa, Entamoeba dispar
LKQTPLVDMVKWFRDGITALGINETNI

SEQ ID NO: 2494205 - protein, 22 aa, Entamoeba dispar
LKRILCSVQFLRKLEKVQIRCE

SEQ ID NO: 2494206 - protein, 21 aa, Entamoeba dispar
LKRKAEYLCDIFNKCDGMSCN

SEQ ID NO: 2494207 - protein, 22 aa, Entamoeba dispar
LKRKELTPPWIPPVKSQTETSQ

SEQ ID NO: 2494208 - protein, 27 aa, Entamoeba dispar
LKRKEVPKMKGLVLIPKFVEEREKQRK

SEQ ID NO: 2494209 - protein, 19 aa, Entamoeba dispar
LKRKLRKKMSMEYITHYEI

SEQ ID NO: 2494210 - protein, 25 aa, Entamoeba dispar
LKRMEQRNSYCFDFSEIPGVCNSKS

SEQ ID NO: 2494211 - protein, 18 aa, Entamoeba dispar
LKRNELFNKITYIRLVNF

SEQ ID NO: 2494212 - protein, 25 aa, Entamoeba dispar
LKRPKSFKARPIITHSDGTRQTFWY

SEQ ID NO: 2494213 - protein, 18 aa, Entamoeba dispar
LKRTVINFIINKVTITEE

SEQ ID NO: 2494214 - protein, 19 aa, Entamoeba dispar
LKRVICSHKGWVSSICFDP

SEQ ID NO: 2494215 - protein, 20 aa, Entamoeba dispar
LKSAAYIFNEILKVISGNEK

SEQ ID NO: 2494216 - protein, 23 aa, Entamoeba dispar
LKSAYCNQLKLPLSSPQFEENSF

SEQ ID NO: 2494217 - protein, 20 aa, Entamoeba dispar
LKSFIPLLIATKGRFEYDLG

SEQ ID NO: 2494218 - protein, 25 aa, Entamoeba dispar
LKSFLEKYPKVLFFKTTISDPEGIK

SEQ ID NO: 2494219 - protein, 24 aa, Entamoeba dispar
LKSGGDVVGCIEIITFIFIDYPHI

SEQ ID NO: 2494220 - protein, 17 aa, Entamoeba dispar
LKSGKKFDKKQKITKDV

SEQ ID NO: 2494221 - protein, 17 aa, Entamoeba dispar
LKSGLTPPTNRIVNKFQ

SEQ ID NO: 2494222 - protein, 17 aa, Entamoeba dispar
LKSIEMIDSRECKINVK

SEQ ID NO: 2494223 - protein, 26 aa, Entamoeba dispar
LKSIFIEELPRMLGLPDTSKLAQVNL

SEQ ID NO: 2494224 - protein, 24 aa, Entamoeba dispar
LKSILCVLGSLKFYHPKLVTINDK

SEQ ID NO: 2494225 - protein, 21 aa, Entamoeba dispar
LKSILMDQGMCISNEEADEAV

SEQ ID NO: 2494226 - protein, 31 aa, Entamoeba dispar
LKSKEMWKASIILYCCLNSHFTIPSYPNIYF

SEQ ID NO: 2494227 - protein, 21 aa, Entamoeba dispar
LKSKILNYLSIFIKKQIDDLH

SEQ ID NO: 2494228 - protein, 23 aa, Entamoeba dispar
LKSKSKWSKAIVNITVPAYFPDD

SEQ ID NO: 2494229 - protein, 21 aa, Entamoeba dispar
LKSKWLEVIYLRHTKVTDKSI

SEQ ID NO: 2494230 - protein, 20 aa, Entamoeba dispar
LKSLCDLAVVSLEVISAQDL

SEQ ID NO: 2494231 - protein, 24 aa, Entamoeba dispar
LKSLEIPKPADFIFTDYEGGLLAR

SEQ ID NO: 2494232 - protein, 19 aa, Entamoeba dispar
LKSLIGFLVQITEKSDLNK

SEQ ID NO: 2494233 - protein, 21 aa, Entamoeba dispar
LKSLKNWDLFFLKQKKQKTFL

SEQ ID NO: 2494234 - protein, 23 aa, Entamoeba dispar
LKSLKVFNCQSSIDISKCHLKEI

SEQ ID NO: 2494235 - protein, 37 aa, Entamoeba dispar
LKSLLDLFRIILIYRYHFYKESVKDIFLLIQQYISYR

SEQ ID NO: 2494236 - protein, 20 aa, Entamoeba dispar
LKSLPPEIGMLDKLQTLLVN

SEQ ID NO: 2494237 - protein, 22 aa, Entamoeba dispar
LKSNEKIIRFCMDQQGNRNKKI

SEQ ID NO: 2494238 - protein, 21 aa, Entamoeba dispar
LKSNLKYDIHYGGYEYQIKHM

SEQ ID NO: 2494239 - protein, 18 aa, Entamoeba dispar
LKSNRLTHYITFSTESRQ

SEQ ID NO: 2494240 - protein, 29 aa, Entamoeba dispar
LKSQEFEKELSIGLLWFINNNDFITFKKS

SEQ ID NO: 2494241 - protein, 21 aa, Entamoeba dispar
LKSQQLFGFKVDKNCIKTVAV

SEQ ID NO: 2494242 - protein, 18 aa, Entamoeba dispar
LKSSAVIIQRTTPCYSAM

SEQ ID NO: 2494243 - protein, 18 aa, Entamoeba dispar
LKSSIQMKVQQDIIREER

SEQ ID NO: 2494244 - protein, 23 aa, Entamoeba dispar
LKSTAFLEYLFKPVSFKEFNGPS

SEQ ID NO: 2494245 - protein, 17 aa, Entamoeba dispar
LKSTIVFIKNLYVKSSF

SEQ ID NO: 2494246 - protein, 19 aa, Entamoeba dispar
LKTEINLFIEEEYFKNYKE

SEQ ID NO: 2494247 - protein, 44 aa, Entamoeba dispar
LKTERCSSCNKDNILGTFVYKCECCKAILCGECIKKRKYQKKNQ

SEQ ID NO: 2494248 - protein, 18 aa, Entamoeba dispar
LKTGIVIIKCRFERLDMI

SEQ ID NO: 2494249 - protein, 18 aa, Entamoeba dispar
LKTGNIYVYGRGSADMKS

SEQ ID NO: 2494250 - protein, 17 aa, Entamoeba dispar
LKTGQSFDENEEDQLLC

SEQ ID NO: 2494251 - protein, 19 aa, Entamoeba dispar
LKTICKRQKVPLADSVNLE

SEQ ID NO: 2494252 - protein, 17 aa, Entamoeba dispar
LKTIGLIGRHCKDRTLL

SEQ ID NO: 2494253 - protein, 18 aa, Entamoeba dispar
LKTIYCDRIDCGQLNTKT

SEQ ID NO: 2494254 - protein, 24 aa, Entamoeba dispar
LKTKGRYTIRVSYIQIEDKKISDL

SEQ ID NO: 2494255 - protein, 17 aa, Entamoeba dispar
LKTKKLFDLFAKEYINE

SEQ ID NO: 2494256 - protein, 18 aa, Entamoeba dispar
LKTKSVLKAIDFLIDVAV

SEQ ID NO: 2494257 - protein, 18 aa, Entamoeba dispar
LKTLCKGIICKTCNKTLC

SEQ ID NO: 2494258 - protein, 20 aa, Entamoeba dispar
LKTLFGISSSDVIDWNGIIP

SEQ ID NO: 2494259 - protein, 25 aa, Entamoeba dispar
LKTLFKDTGIYFAFARDFDKIDDSI

SEQ ID NO: 2494260 - protein, 25 aa, Entamoeba dispar
LKTLICKSCYNLGTFLNLNITKIVY

SEQ ID NO: 2494261 - protein, 21 aa, Entamoeba dispar
LKTLIYYPQFSQIIPNSLLSP

SEQ ID NO: 2494262 - protein, 24 aa, Entamoeba dispar
LKTLNCFDCSSLEYINNLPNLVSL

SEQ ID NO: 2494263 - protein, 19 aa, Entamoeba dispar
LKTLPDWSVATRKIIDTAN

SEQ ID NO: 2494264 - protein, 17 aa, Entamoeba dispar
LKTMFWYLMESKIDPKY

SEQ ID NO: 2494265 - protein, 21 aa, Entamoeba dispar
LKTMVRYSLVTDRYLTQEKTS

SEQ ID NO: 2494266 - protein, 21 aa, Entamoeba dispar
LKTMWLPDIFLYCNIDTQIII

SEQ ID NO: 2494267 - protein, 30 aa, Entamoeba dispar
LKTNGIEFRKRFAFIDYMMFEYCKNIKDLF

SEQ ID NO: 2494268 - protein, 19 aa, Entamoeba dispar
LKTNVLPFIHDQKNLNDEN

SEQ ID NO: 2494269 - protein, 23 aa, Entamoeba dispar
LKTPRIADIACFLRDAAHFNDSG

SEQ ID NO: 2494270 - protein, 20 aa, Entamoeba dispar
LKTPVLKFLSQKQIKINHNK

SEQ ID NO: 2494271 - protein, 26 aa, Entamoeba dispar
LKTQCPSYEGILFPQILNSKQFPNSK

SEQ ID NO: 2494272 - protein, 23 aa, Entamoeba dispar
LKTQEFSFNFKVLKPSTEIKMKL

SEQ ID NO: 2494273 - protein, 23 aa, Entamoeba dispar
LKTRCYEHFRYDISHGVALKTAK

SEQ ID NO: 2494274 - protein, 18 aa, Entamoeba dispar
LKTSEPFFEVFVNEIVKN

SEQ ID NO: 2494275 - protein, 24 aa, Entamoeba dispar
LKTSKLSKVILQFFPVLFEKIIFR

SEQ ID NO: 2494276 - protein, 19 aa, Entamoeba dispar
LKTSMKIISLMIDDNSECQ

SEQ ID NO: 2494277 - protein, 18 aa, Entamoeba dispar
LKTSRCFSDEKLLEKAAE

SEQ ID NO: 2494278 - protein, 19 aa, Entamoeba dispar
LKTVLMIVDQCLRCIEHVH

SEQ ID NO: 2494279 - protein, 22 aa, Entamoeba dispar
LKTVPSLIGIVGMISVFHMFAR

SEQ ID NO: 2494280 - protein, 17 aa, Entamoeba dispar
LKVADFGLARSLDKETL

SEQ ID NO: 2494281 - protein, 19 aa, Entamoeba dispar
LKVAVGFNSTLGLIDLSTC

SEQ ID NO: 2494282 - protein, 19 aa, Entamoeba dispar
LKVDHTFIIRNLLLSQNSD

SEQ ID NO: 2494283 - protein, 26 aa, Entamoeba dispar
LKVEGAVLEKVIQWLLFHNEHPLMYP

SEQ ID NO: 2494284 - protein, 17 aa, Entamoeba dispar
LKVEIARPPKERKAVTE

SEQ ID NO: 2494285 - protein, 29 aa, Entamoeba dispar
LKVENCPFNLGSINTEWPILTQLVIQKAS

SEQ ID NO: 2494286 - protein, 18 aa, Entamoeba dispar
LKVIKLEQCRNIFLQQKL

SEQ ID NO: 2494287 - protein, 21 aa, Entamoeba dispar
LKVIQCNECTFNLLENQLKKV

SEQ ID NO: 2494288 - protein, 18 aa, Entamoeba dispar
LKVKEVNKPLSIRFRPTK

SEQ ID NO: 2494289 - protein, 23 aa, Entamoeba dispar
LKVLKKERKGLMQTSSIKESSSF

SEQ ID NO: 2494290 - protein, 20 aa, Entamoeba dispar
LKVLVSCDVFGGHYADERVF

SEQ ID NO: 2494291 - protein, 23 aa, Entamoeba dispar
LKVMRECPLFILSNNSDLSSTGA

SEQ ID NO: 2494292 - protein, 22 aa, Entamoeba dispar
LKVNPWFKSERDINKFCNIFNP

SEQ ID NO: 2494293 - protein, 19 aa, Entamoeba dispar
LKVNPWLTTPFSIIKFVYH

SEQ ID NO: 2494294 - protein, 27 aa, Entamoeba dispar
LKVNTEIPFKVNISISDGIILFEDNQE

SEQ ID NO: 2494295 - protein, 19 aa, Entamoeba dispar
LKVQCPICNTYFCTNCLCE

SEQ ID NO: 2494296 - protein, 20 aa, Entamoeba dispar
LKVSIPKGKSVTFKPLQNTF

SEQ ID NO: 2494297 - protein, 23 aa, Entamoeba dispar
LKVSNSIIDCISMNPTKQQIVYG

SEQ ID NO: 2494298 - protein, 22 aa, Entamoeba dispar
LKVTKTLLLFDETFRTMKAFEG

SEQ ID NO: 2494299 - protein, 17 aa, Entamoeba dispar
LKVTVITTHASQDKKKS

SEQ ID NO: 2494300 - protein, 17 aa, Entamoeba dispar
LKWAPRTLDLFQYSRRD

SEQ ID NO: 2494301 - protein, 19 aa, Entamoeba dispar
LKYCQRDFLEHVTIMEKIE

SEQ ID NO: 2494302 - protein, 18 aa, Entamoeba dispar
LKYFETFGPIKCGADGKK

SEQ ID NO: 2494303 - protein, 17 aa, Entamoeba dispar
LKYFGMYDECGRILGEL

SEQ ID NO: 2494304 - protein, 30 aa, Entamoeba dispar
LKYFLKTWIRFIHLCGTPAQLQDAAVVLVI

SEQ ID NO: 2494305 - protein, 19 aa, Entamoeba dispar
LKYGEQIARTMIVINDLES

SEQ ID NO: 2494306 - protein, 22 aa, Entamoeba dispar
LKYHSVEAIHIVSHNEKMLLSL

SEQ ID NO: 2494307 - protein, 18 aa, Entamoeba dispar
LKYIANITFESVLHYFSF

SEQ ID NO: 2494308 - protein, 26 aa, Entamoeba dispar
LKYIFFPGGSGNCYSSMSPIDRSFCS

SEQ ID NO: 2494309 - protein, 17 aa, Entamoeba dispar
LKYIHDYGFSYLTQEVT

SEQ ID NO: 2494310 - protein, 19 aa, Entamoeba dispar
LKYIPKFFQSAIHLIYDQQ

SEQ ID NO: 2494311 - protein, 19 aa, Entamoeba dispar
LKYKTYEWLFWDVSGAAKF

SEQ ID NO: 2494312 - protein, 22 aa, Entamoeba dispar
LKYLCRAKHAILDPHDSILPSY

SEQ ID NO: 2494313 - protein, 17 aa, Entamoeba dispar
LKYLDGIFICTKYSVYR

SEQ ID NO: 2494314 - protein, 23 aa, Entamoeba dispar
LKYLINYDDLPSFAFKSKQTRIN

SEQ ID NO: 2494315 - protein, 21 aa, Entamoeba dispar
LKYLINYDELPSFAFKSKQTI

SEQ ID NO: 2494316 - protein, 19 aa, Entamoeba dispar
LKYLKKFKLFDGAIPTLSF

SEQ ID NO: 2494317 - protein, 24 aa, Entamoeba dispar
LKYLLYKKMMVHRDIKLDNILLTL

SEQ ID NO: 2494318 - protein, 22 aa, Entamoeba dispar
LKYLNCESCVGFDDNAFISLIN

SEQ ID NO: 2494319 - protein, 22 aa, Entamoeba dispar
LKYNIAIQCSEALYIFHNLEGD

SEQ ID NO: 2494320 - protein, 17 aa, Entamoeba dispar
LKYNNSFIIVYCRQTAE

SEQ ID NO: 2494321 - protein, 17 aa, Entamoeba dispar
LKYPELVIFIVKGTQID

SEQ ID NO: 2494322 - protein, 22 aa, Entamoeba dispar
LKYPHKFAPFYSKIQYKQSPYS

SEQ ID NO: 2494323 - protein, 24 aa, Entamoeba dispar
LKYSGEIRPYFTINDPLIHSEKSF

SEQ ID NO: 2494324 - protein, 17 aa, Entamoeba dispar
LKYSLDEISQWCYSNNI

SEQ ID NO: 2494325 - protein, 26 aa, Entamoeba dispar
LKYTPKGVFCLMTFYGPACPSNSGII

SEQ ID NO: 2494326 - protein, 18 aa, Entamoeba dispar
LKYVCDLLKQFQKEGHKA

SEQ ID NO: 2494327 - protein, 19 aa, Entamoeba dispar
LKYVITYICEHKREDLIKV

SEQ ID NO: 2494328 - protein, 17 aa, Entamoeba dispar
LKYVLSVHIMSKSHINP

SEQ ID NO: 2494329 - protein, 17 aa, Entamoeba dispar
LLADLGLAYKSGKMLFL

SEQ ID NO: 2494330 - protein, 25 aa, Entamoeba dispar
LLAELMIFIRYCLKSQQINIVISTL

SEQ ID NO: 2494331 - protein, 19 aa, Entamoeba dispar
LLAKILRERTEIMGTSIDT

SEQ ID NO: 2494332 - protein, 24 aa, Entamoeba dispar
LLALSINPKEHWAPFANALKNELQ

SEQ ID NO: 2494333 - protein, 17 aa, Entamoeba dispar
LLATFGYELKINKLYKK

SEQ ID NO: 2494334 - protein, 24 aa, Entamoeba dispar
LLCCFKYGNIEFDKVLNYIKKIGG

SEQ ID NO: 2494335 - protein, 19 aa, Entamoeba dispar
LLCFAVIYEPSFQNLKEKW

SEQ ID NO: 2494336 - protein, 18 aa, Entamoeba dispar
LLCFNLLTKMVILNPDPM

SEQ ID NO: 2494337 - protein, 20 aa, Entamoeba dispar
LLCISSWLNYFIRYSQPLIS

SEQ ID NO: 2494338 - protein, 17 aa, Entamoeba dispar
LLCLKYNNPDSIILLRG

SEQ ID NO: 2494339 - protein, 23 aa, Entamoeba dispar
LLCTNKKCFIRSLSEQLFGEEKT

SEQ ID NO: 2494340 - protein, 20 aa, Entamoeba dispar
LLCYADKFFSKSHLEDTLTH

SEQ ID NO: 2494341 - protein, 17 aa, Entamoeba dispar
LLDAPSWALQLKHDDSL

SEQ ID NO: 2494342 - protein, 19 aa, Entamoeba dispar
LLDEGRLTDGRGRTVDFKN

SEQ ID NO: 2494343 - protein, 19 aa, Entamoeba dispar
LLDENYRVAGVVNQRDRID

SEQ ID NO: 2494344 - protein, 17 aa, Entamoeba dispar
LLDEVCVTLKYLMEHIV

SEQ ID NO: 2494345 - protein, 29 aa, Entamoeba dispar
LLDFRFPDEQVRLFALKCLDAMKDYELVN

SEQ ID NO: 2494346 - protein, 30 aa, Entamoeba dispar
LLDFRFPDEQVRLFALKCLDAMKDYELVNF

SEQ ID NO: 2494347 - protein, 20 aa, Entamoeba dispar
LLDGDYVYCRVVSKEKVPQV

SEQ ID NO: 2494348 - protein, 21 aa, Entamoeba dispar
LLDIEGLEWNQAWEIVVQTFA

SEQ ID NO: 2494349 - protein, 18 aa, Entamoeba dispar
LLDIYKPFVQEIIHNNIS

SEQ ID NO: 2494350 - protein, 23 aa, Entamoeba dispar
LLDLKIPFHLKENLSEFDPSTCE

SEQ ID NO: 2494351 - protein, 18 aa, Entamoeba dispar
LLDLPSFNIKPLMNKCID

SEQ ID NO: 2494352 - protein, 18 aa, Entamoeba dispar
LLDPDWYNSESFKKLRSL

SEQ ID NO: 2494353 - protein, 24 aa, Entamoeba dispar
LLDREIAYNLSLIYYKSGNKNLCI

SEQ ID NO: 2494354 - protein, 27 aa, Entamoeba dispar
LLDVEFLSIMKFCRGESIYVESSSESS

SEQ ID NO: 2494355 - protein, 18 aa, Entamoeba dispar
LLDYIFKYIERYPSLLLL

SEQ ID NO: 2494356 - protein, 27 aa, Entamoeba dispar
LLEAKTGNGKLEFCEKGNETFKIIVQI

SEQ ID NO: 2494357 - protein, 29 aa, Entamoeba dispar
LLEAKTGNGKLEFCEKGNETFKIIVQIGR

SEQ ID NO: 2494358 - protein, 17 aa, Entamoeba dispar
LLEALGYDNTFLEEFNE

SEQ ID NO: 2494359 - protein, 25 aa, Entamoeba dispar
LLEHTICFGTSMPRWEQYRKSSYER

SEQ ID NO: 2494360 - protein, 18 aa, Entamoeba dispar
LLEKRGVLVITKTLSISK

SEQ ID NO: 2494361 - protein, 24 aa, Entamoeba dispar
LLEKWRQLQSWLKGKNIFEYNYIF

SEQ ID NO: 2494362 - protein, 23 aa, Entamoeba dispar
LLELIRLGLELSELGTRRRVFVI

SEQ ID NO: 2494363 - protein, 18 aa, Entamoeba dispar
LLELLGILFDPTIPEGMT

SEQ ID NO: 2494364 - protein, 17 aa, Entamoeba dispar
LLESAAITFCFDNEALY

SEQ ID NO: 2494365 - protein, 23 aa, Entamoeba dispar
LLESFKAVVLMLHKENIDDPFVN

SEQ ID NO: 2494366 - protein, 17 aa, Entamoeba dispar
LLESFVFITNSFEAAGQ

SEQ ID NO: 2494367 - protein, 19 aa, Entamoeba dispar
LLESICKWINTQFNNLTEE

SEQ ID NO: 2494368 - protein, 17 aa, Entamoeba dispar
LLESLVILFRNGIIHCD

SEQ ID NO: 2494369 - protein, 18 aa, Entamoeba dispar
LLESSGFIEIYTLGLDRN

SEQ ID NO: 2494370 - protein, 18 aa, Entamoeba dispar
LLESSGVTFCFDNEALFK

SEQ ID NO: 2494371 - protein, 19 aa, Entamoeba dispar
LLEVCGKQGVTFLFTITSY

SEQ ID NO: 2494372 - protein, 18 aa, Entamoeba dispar
LLEWLEATVHNFEPKCAD

SEQ ID NO: 2494373 - protein, 19 aa, Entamoeba dispar
LLEWVREVTDGYGVTVENF

SEQ ID NO: 2494374 - protein, 23 aa, Entamoeba dispar
LLEYLSQFWIAMQGLGNCKLSHM

SEQ ID NO: 2494375 - protein, 25 aa, Entamoeba dispar
LLEYNLKINQIFSFIISHTPVVFPS

SEQ ID NO: 2494376 - protein, 19 aa, Entamoeba dispar
LLFCKEHREQLGTKYNGKE

SEQ ID NO: 2494377 - protein, 21 aa, Entamoeba dispar
LLFEECIKLVLTLSTLHPSHL

SEQ ID NO: 2494378 - protein, 18 aa, Entamoeba dispar
LLFEMKVQRNFINNFSPR

SEQ ID NO: 2494379 - protein, 23 aa, Entamoeba dispar
LLFFTDKGFIFGVCHKRIELNIT

SEQ ID NO: 2494380 - protein, 18 aa, Entamoeba dispar
LLFFWKELIQIACNGIAI

SEQ ID NO: 2494381 - protein, 24 aa, Entamoeba dispar
LLFHKIEHAHIISSLGSMVVVFDR

SEQ ID NO: 2494382 - protein, 18 aa, Entamoeba dispar
LLFHYFKFSNTIVNSLQS

SEQ ID NO: 2494383 - protein, 19 aa, Entamoeba dispar
LLFKCFTSYYPFESTGNRE

SEQ ID NO: 2494384 - protein, 27 aa, Entamoeba dispar
LLFKEAPHVFHVLKAMISVIDYNQNIP

SEQ ID NO: 2494385 - protein, 17 aa, Entamoeba dispar
LLFKEIIEKGYGMYKSY

SEQ ID NO: 2494386 - protein, 31 aa, Entamoeba dispar
LLFQLYSCYFCNFRFNCWNEFNSFGNRVMNF

SEQ ID NO: 2494387 - protein, 19 aa, Entamoeba dispar
LLFRKAFKKDLGEIPKLPI

SEQ ID NO: 2494388 - protein, 23 aa, Entamoeba dispar
LLFRVHVKLLLGDSVIGSIYSHP

SEQ ID NO: 2494389 - protein, 19 aa, Entamoeba dispar
LLFSDVCIFAQYKEAMLSK

SEQ ID NO: 2494390 - protein, 21 aa, Entamoeba dispar
LLFTFKFPEKIVGIAQSPDVD

SEQ ID NO: 2494391 - protein, 17 aa, Entamoeba dispar
LLGALIKNGECPLIGDI

SEQ ID NO: 2494392 - protein, 19 aa, Entamoeba dispar
LLGDFYFKGKELYPNGYNR

SEQ ID NO: 2494393 - protein, 20 aa, Entamoeba dispar
LLGEPSFYYNFFDVSHGILS

SEQ ID NO: 2494394 - protein, 18 aa, Entamoeba dispar
LLGILYRMGVKQQQKPIE

SEQ ID NO: 2494395 - protein, 18 aa, Entamoeba dispar
LLGLPCDNHLLLEGKTEH

SEQ ID NO: 2494396 - protein, 18 aa, Entamoeba dispar
LLGSQLYLFEGCLLVFSN

SEQ ID NO: 2494397 - protein, 18 aa, Entamoeba dispar
LLGYFPKELSLIDFICVS

SEQ ID NO: 2494398 - protein, 20 aa, Entamoeba dispar
LLHEIPHGKFVPDVDLDDDV

SEQ ID NO: 2494399 - protein, 17 aa, Entamoeba dispar
LLHGYKIDMNALPKQPI

SEQ ID NO: 2494400 - protein, 22 aa, Entamoeba dispar
LLHLHCSRFLSLGNDFPQGIKY

SEQ ID NO: 2494401 - protein, 24 aa, Entamoeba dispar
LLHNQRLGAFYKKMINQSQKEKRE

SEQ ID NO: 2494402 - protein, 35 aa, Entamoeba dispar
LLHRLGDDGKYWRHIYKSLLLIYYIIINGTPEAVE

SEQ ID NO: 2494403 - protein, 24 aa, Entamoeba dispar
LLHYELPQPLQLIITDNHIQKYNE

SEQ ID NO: 2494404 - protein, 25 aa, Entamoeba dispar
LLHYFEMVNWLLAKGAYVNAADKFR

SEQ ID NO: 2494405 - protein, 24 aa, Entamoeba dispar
LLIDKCIDNFFGIASVVSLREAKF

SEQ ID NO: 2494406 - protein, 34 aa, Entamoeba dispar
LLIDKITWWAGRLFFNEFEMLMKVLKESNENSGQ

SEQ ID NO: 2494407 - protein, 36 aa, Entamoeba dispar
LLIDKRGRCISLICYDRLMWVIPLGFDKTSYSINLE

SEQ ID NO: 2494408 - protein, 26 aa, Entamoeba dispar
LLIDLSFIMGYSFRSSFTSGNNHSMI

SEQ ID NO: 2494409 - protein, 17 aa, Entamoeba dispar
LLIEEFNDHITLHSRKN

SEQ ID NO: 2494410 - protein, 26 aa, Entamoeba dispar
LLIEFAQRCGYNFTIRGTRSSIYTVK

SEQ ID NO: 2494411 - protein, 19 aa, Entamoeba dispar
LLIGLSRSFGEWISSIFKK

SEQ ID NO: 2494412 - protein, 18 aa, Entamoeba dispar
LLIGNVICTLTFKPEIIS

SEQ ID NO: 2494413 - protein, 24 aa, Entamoeba dispar
LLIIFPKKYGFFIVPNPIYIIIDF

SEQ ID NO: 2494414 - protein, 23 aa, Entamoeba dispar
LLIKKIVILTGIIRQISLQVTKN

SEQ ID NO: 2494415 - protein, 18 aa, Entamoeba dispar
LLILVSGLLRYESTLRWT

SEQ ID NO: 2494416 - protein, 18 aa, Entamoeba dispar
LLIPKTNNEIIKFLVNHP

SEQ ID NO: 2494417 - protein, 18 aa, Entamoeba dispar
LLIQNSLIKNEEIKGLQL

SEQ ID NO: 2494418 - protein, 21 aa, Entamoeba dispar
LLISNIIQWKDEELLNILTSN

SEQ ID NO: 2494419 - protein, 27 aa, Entamoeba dispar
LLITRFTPPIFRCYDPTKLLPFTHFLE

SEQ ID NO: 2494420 - protein, 17 aa, Entamoeba dispar
LLIVPKGGRSVMPIIEL

SEQ ID NO: 2494421 - protein, 22 aa, Entamoeba dispar
LLKCHIKHLILCNVFSQSLYLP

SEQ ID NO: 2494422 - protein, 17 aa, Entamoeba dispar
LLKCNSQEKATEIIQFY

SEQ ID NO: 2494423 - protein, 20 aa, Entamoeba dispar
LLKDVEEFVRGMLYYQEISI

SEQ ID NO: 2494424 - protein, 23 aa, Entamoeba dispar
LLKEIPLSWYHRIIMFTFSNLAL

SEQ ID NO: 2494425 - protein, 17 aa, Entamoeba dispar
LLKELAAVLVIQNKDIL

SEQ ID NO: 2494426 - protein, 18 aa, Entamoeba dispar
LLKELEIAFELKKKTQEI

SEQ ID NO: 2494427 - protein, 20 aa, Entamoeba dispar
LLKGICDGVTLLGLARTNIG

SEQ ID NO: 2494428 - protein, 17 aa, Entamoeba dispar
LLKGKRRKETVCLVEVL

SEQ ID NO: 2494429 - protein, 20 aa, Entamoeba dispar
LLKGYPSIVSHKIFEMYCMK

SEQ ID NO: 2494430 - protein, 18 aa, Entamoeba dispar
LLKHYLRSLPTPLLTYPI

SEQ ID NO: 2494431 - protein, 26 aa, Entamoeba dispar
LLKISIPCVYLYPCVIPKEALDNSNY

SEQ ID NO: 2494432 - protein, 22 aa, Entamoeba dispar
LLKKACEALMLLGMFHGNKIGQ

SEQ ID NO: 2494433 - protein, 17 aa, Entamoeba dispar
LLKKGINYEVRVFKSNY

SEQ ID NO: 2494434 - protein, 19 aa, Entamoeba dispar
LLKKICIIKINGGLGTSMG

SEQ ID NO: 2494435 - protein, 17 aa, Entamoeba dispar
LLKKRPINYSLNGCIEH

SEQ ID NO: 2494436 - protein, 24 aa, Entamoeba dispar
LLKLHPTPFIPITFHSQIKEKYKK

SEQ ID NO: 2494437 - protein, 17 aa, Entamoeba dispar
LLKLHTLFYKKLTDRID

SEQ ID NO: 2494438 - protein, 18 aa, Entamoeba dispar
LLKPFGTELTNILQRLVN

SEQ ID NO: 2494439 - protein, 29 aa, Entamoeba dispar
LLKPTKFGKLRSFGDLCHFSISFKADKQC

SEQ ID NO: 2494440 - protein, 17 aa, Entamoeba dispar
LLKRIIKEIPDFFDKID

SEQ ID NO: 2494441 - protein, 21 aa, Entamoeba dispar
LLKSNCYSYVYGSPMSPVVAQ

SEQ ID NO: 2494442 - protein, 20 aa, Entamoeba dispar
LLKVIGRGSFGKVMMVRKKD

SEQ ID NO: 2494443 - protein, 17 aa, Entamoeba dispar
LLKYCSKSVPSLLLELY

SEQ ID NO: 2494444 - protein, 26 aa, Entamoeba dispar
LLKYFFLCLPKPMINDSVLKVFEMGL

SEQ ID NO: 2494445 - protein, 17 aa, Entamoeba dispar
LLLCSSNSIAFIIGCFT

SEQ ID NO: 2494446 - protein, 24 aa, Entamoeba dispar
LLLDERFLSILIHFYTEMPNVFGP

SEQ ID NO: 2494447 - protein, 21 aa, Entamoeba dispar
LLLEALLSFIYPHFADQANYK

SEQ ID NO: 2494448 - protein, 23 aa, Entamoeba dispar
LLLEKEKINCVGIHGGKRQIERT

SEQ ID NO: 2494449 - protein, 26 aa, Entamoeba dispar
LLLIHSNMALCWLKLENWNETKQQSE

SEQ ID NO: 2494450 - protein, 18 aa, Entamoeba dispar
LLLIRSIATKGYKKMFEC

SEQ ID NO: 2494451 - protein, 23 aa, Entamoeba dispar
LLLKSSNVFSSFTQKVIDFSVKE

SEQ ID NO: 2494452 - protein, 26 aa, Entamoeba dispar
LLLLRKKRYAATMILDGGKKKKELKG

SEQ ID NO: 2494453 - protein, 24 aa, Entamoeba dispar
LLLMPGHDELTFLIPEIDFSPLFD

SEQ ID NO: 2494454 - protein, 18 aa, Entamoeba dispar
LLLNRIGLPIIKQEGDQT

SEQ ID NO: 2494455 - protein, 24 aa, Entamoeba dispar
LLLQPIGTFFLCHGGISPSLRYFS

SEQ ID NO: 2494456 - protein, 27 aa, Entamoeba dispar
LLLQRHVPLHPSYRLVGVLDPYGILES

SEQ ID NO: 2494457 - protein, 17 aa, Entamoeba dispar
LLLSIPDNFDIIVDTNI

SEQ ID NO: 2494458 - protein, 18 aa, Entamoeba dispar
LLLSLPIEYFQSIVNEKH

SEQ ID NO: 2494459 - protein, 21 aa, Entamoeba dispar
LLLSSCFRNEAMFQRWYSQSL

SEQ ID NO: 2494460 - protein, 18 aa, Entamoeba dispar
LLLSSGYYRVRLMNLLPF

SEQ ID NO: 2494461 - protein, 23 aa, Entamoeba dispar
LLLSVYGAFWITNSFTLKLSSII

SEQ ID NO: 2494462 - protein, 17 aa, Entamoeba dispar
LLLVPDVINRIWESLKE

SEQ ID NO: 2494463 - protein, 17 aa, Entamoeba dispar
LLLVQPVQRIMRYPMLI

SEQ ID NO: 2494464 - protein, 28 aa, Entamoeba dispar
LLLYKGDYLFFKDINSLIPIIKNKSITI

SEQ ID NO: 2494465 - protein, 17 aa, Entamoeba dispar
LLLYPKIYHHLKSSLLL

SEQ ID NO: 2494466 - protein, 18 aa, Entamoeba dispar
LLLYPKIYHHLKSSLLLN

SEQ ID NO: 2494467 - protein, 17 aa, Entamoeba dispar
LLMDILSEFGYFFNTTK

SEQ ID NO: 2494468 - protein, 29 aa, Entamoeba dispar
LLMFISGLHKCCIYYNIVENLSILSHSKI

SEQ ID NO: 2494469 - protein, 23 aa, Entamoeba dispar
LLMKQELRVGGGHEEYYPVDPNY

SEQ ID NO: 2494470 - protein, 19 aa, Entamoeba dispar
LLMQPRASKFVKIQEIRIQ

SEQ ID NO: 2494471 - protein, 23 aa, Entamoeba dispar
LLMTELFFIDGLAISSRLTSLPS

SEQ ID NO: 2494472 - protein, 17 aa, Entamoeba dispar
LLNALKLVKKDIHECRM

SEQ ID NO: 2494473 - protein, 22 aa, Entamoeba dispar
LLNEFKTSCCIKIDQLDENVIG

SEQ ID NO: 2494474 - protein, 25 aa, Entamoeba dispar
LLNEKGFRFRSRFTYQKMGSLQKET

SEQ ID NO: 2494475 - protein, 25 aa, Entamoeba dispar
LLNEQKPEWNIHCYGFAPAATLSEN

SEQ ID NO: 2494476 - protein, 18 aa, Entamoeba dispar
LLNFLALDIQIEVIRLIT

SEQ ID NO: 2494477 - protein, 19 aa, Entamoeba dispar
LLNGCLLKPTAVAISNNKQ

SEQ ID NO: 2494478 - protein, 25 aa, Entamoeba dispar
LLNGFIRIIACLSIEERKYFFEFIK

SEQ ID NO: 2494479 - protein, 23 aa, Entamoeba dispar
LLNHLRKVILLPRVYDVSRDIRR

SEQ ID NO: 2494480 - protein, 18 aa, Entamoeba dispar
LLNIPFTLIKNVQCFKLS

SEQ ID NO: 2494481 - protein, 22 aa, Entamoeba dispar
LLNIVCDIFNNKPTKAFIMTLW

SEQ ID NO: 2494482 - protein, 23 aa, Entamoeba dispar
LLNNEITPIFVFDGARLPSKITT

SEQ ID NO: 2494483 - protein, 20 aa, Entamoeba dispar
LLNSIGFSFEFRRPERFAIK

SEQ ID NO: 2494484 - protein, 24 aa, Entamoeba dispar
LLNSIILVIPRFVQKTLNCLEQIV

SEQ ID NO: 2494485 - protein, 19 aa, Entamoeba dispar
LLNSLYLRQEFLPLKYKDL

SEQ ID NO: 2494486 - protein, 18 aa, Entamoeba dispar
LLNSRNHFLFAFDNTEDL

SEQ ID NO: 2494487 - protein, 25 aa, Entamoeba dispar
LLNSTMRHPFAISILLECFLTDEDF

SEQ ID NO: 2494488 - protein, 17 aa, Entamoeba dispar
LLNYVHRQNNDFVQVVP

SEQ ID NO: 2494489 - protein, 23 aa, Entamoeba dispar
LLPEEKKRLGAKGSEEVKNHPFF

SEQ ID NO: 2494490 - protein, 25 aa, Entamoeba dispar
LLPHQRTGIKWLWEHHNETKIHGCI

SEQ ID NO: 2494491 - protein, 22 aa, Entamoeba dispar
LLPLCIDGFLWSRKSMADDVAK

SEQ ID NO: 2494492 - protein, 22 aa, Entamoeba dispar
LLPNPLIPYNLYEEFIELRNNH

SEQ ID NO: 2494493 - protein, 22 aa, Entamoeba dispar
LLPQCKNALISLLLDEQLEEYN

SEQ ID NO: 2494494 - protein, 17 aa, Entamoeba dispar
LLPRGWHGLLSLTHMIL

SEQ ID NO: 2494495 - protein, 20 aa, Entamoeba dispar
LLPSKIFRKVMSIMLHGFIE

SEQ ID NO: 2494496 - protein, 23 aa, Entamoeba dispar
LLPTGDSYLHWIAASPPSSLKNS

SEQ ID NO: 2494497 - protein, 17 aa, Entamoeba dispar
LLPTLIVYRNTNHVKQF

SEQ ID NO: 2494498 - protein, 28 aa, Entamoeba dispar
LLPVPLVMHMMRCVINALRIPGNQFEFG

SEQ ID NO: 2494499 - protein, 17 aa, Entamoeba dispar
LLPWREDMEEIKTIRKW

SEQ ID NO: 2494500 - protein, 19 aa, Entamoeba dispar
LLPWREEMEEIKTIRKWVK

SEQ ID NO: 2494501 - protein, 17 aa, Entamoeba dispar
LLPWREEMEEVQTIRKW

SEQ ID NO: 2494502 - protein, 17 aa, Entamoeba dispar
LLQETIDLWKKLRERAG

SEQ ID NO: 2494503 - protein, 20 aa, Entamoeba dispar
LLQFNDGINCLKSFKQFIDT

SEQ ID NO: 2494504 - protein, 17 aa, Entamoeba dispar
LLQGPKLNWEIICGIAI

SEQ ID NO: 2494505 - protein, 22 aa, Entamoeba dispar
LLQKAGINFSYFKNAGITEEDF

SEQ ID NO: 2494506 - protein, 27 aa, Entamoeba dispar
LLQKKKYRLAYDCLSFIQPAPKDKEKQ

SEQ ID NO: 2494507 - protein, 23 aa, Entamoeba dispar
LLQLRTRITTVRMKISTYSQDAY

SEQ ID NO: 2494508 - protein, 30 aa, Entamoeba dispar
LLQRQTIGWKLVFDLAIQIIDAISFLHKQG

SEQ ID NO: 2494509 - protein, 28 aa, Entamoeba dispar
LLQSCITKSVLVTGRIPCCKTTHTMYHG

SEQ ID NO: 2494510 - protein, 18 aa, Entamoeba dispar
LLQSISIVILSSGRTHMM

SEQ ID NO: 2494511 - protein, 18 aa, Entamoeba dispar
LLQWKRLVQQEIGDGIIS

SEQ ID NO: 2494512 - protein, 18 aa, Entamoeba dispar
LLQYRWDKNIELVSSQFI

SEQ ID NO: 2494513 - protein, 19 aa, Entamoeba dispar
LLQYYLPMDSVDFAGNSII

SEQ ID NO: 2494514 - protein, 22 aa, Entamoeba dispar
LLRCFLHNPLSPKVRNSMIQIF

SEQ ID NO: 2494515 - protein, 24 aa, Entamoeba dispar
LLRCLALFLEYAWMKGIDGFNNEV

SEQ ID NO: 2494516 - protein, 23 aa, Entamoeba dispar
LLREDLRYNGIIMTDWYACKDTV

SEQ ID NO: 2494517 - protein, 24 aa, Entamoeba dispar
LLREMSLMYSDRVVQFITDNYRYF

SEQ ID NO: 2494518 - protein, 19 aa, Entamoeba dispar
LLRESNRAILTLAIATSLN

SEQ ID NO: 2494519 - protein, 21 aa, Entamoeba dispar
LLRGDCIQGYTVLSPPPKRKQ

SEQ ID NO: 2494520 - protein, 24 aa, Entamoeba dispar
LLRGLIPILERWLGNLLARQFEGR

SEQ ID NO: 2494521 - protein, 24 aa, Entamoeba dispar
LLRIPKCKICSAYFSPLTHWICPH

SEQ ID NO: 2494522 - protein, 18 aa, Entamoeba dispar
LLRLHPLPTTALKQYQTF

SEQ ID NO: 2494523 - protein, 22 aa, Entamoeba dispar
LLRLLEEMKIKYEELSRAKKEI

SEQ ID NO: 2494524 - protein, 22 aa, Entamoeba dispar
LLRLNYCSNLNISLISNKLKSI

SEQ ID NO: 2494525 - protein, 19 aa, Entamoeba dispar
LLRNISMLFGDAPRLIEAH

SEQ ID NO: 2494526 - protein, 18 aa, Entamoeba dispar
LLRRGASSPALLQRLQHD

SEQ ID NO: 2494527 - protein, 19 aa, Entamoeba dispar
LLRRQAELDGMPAINAKRV

SEQ ID NO: 2494528 - protein, 20 aa, Entamoeba dispar
LLRSFGYKLLERIIYIESTP

SEQ ID NO: 2494529 - protein, 18 aa, Entamoeba dispar
LLRSIGIDAFSDCSRLTS

SEQ ID NO: 2494530 - protein, 19 aa, Entamoeba dispar
LLSDLPFGENMTVLCVMNG

SEQ ID NO: 2494531 - protein, 24 aa, Entamoeba dispar
LLSHCTRTPNIIQYYGYTQLSDSM

SEQ ID NO: 2494532 - protein, 24 aa, Entamoeba dispar
LLSIKQCMLFKIIGKDGQVKKNAA

SEQ ID NO: 2494533 - protein, 17 aa, Entamoeba dispar
LLSKIVSILNFFKNYSY

SEQ ID NO: 2494534 - protein, 21 aa, Entamoeba dispar
LLSKMSVIIPYIYTQFKYDGM

SEQ ID NO: 2494535 - protein, 20 aa, Entamoeba dispar
LLSKSFRLKTGILRIEKAFF

SEQ ID NO: 2494536 - protein, 18 aa, Entamoeba dispar
LLSKYFRIEIGLPHTHST

SEQ ID NO: 2494537 - protein, 17 aa, Entamoeba dispar
LLSLHYIHALGCVHKDI

SEQ ID NO: 2494538 - protein, 23 aa, Entamoeba dispar
LLSLKDIIPFFIEHPQHLKIYEM

SEQ ID NO: 2494539 - protein, 17 aa, Entamoeba dispar
LLSLLCELSTSLDENVI

SEQ ID NO: 2494540 - protein, 18 aa, Entamoeba dispar
LLSNGINAVRWVGGVELE

SEQ ID NO: 2494541 - protein, 19 aa, Entamoeba dispar
LLSNLKVSDFGGDEEFEQL

SEQ ID NO: 2494542 - protein, 17 aa, Entamoeba dispar
LLSNTLLNALGYTRMDS

SEQ ID NO: 2494543 - protein, 28 aa, Entamoeba dispar
LLSNVWPYIRFSIDYNIAQSELKFLKTY

SEQ ID NO: 2494544 - protein, 25 aa, Entamoeba dispar
LLSPEYFLLQCFVYLNAQEFLEHIY

SEQ ID NO: 2494545 - protein, 20 aa, Entamoeba dispar
LLSPHFIKSMCDNAERIGGT

SEQ ID NO: 2494546 - protein, 25 aa, Entamoeba dispar
LLSPYCGFVLEYPRKQTIVTATLPL

SEQ ID NO: 2494547 - protein, 26 aa, Entamoeba dispar
LLSSKAGGCGLNLVGGANLVMFDPDW

SEQ ID NO: 2494548 - protein, 26 aa, Entamoeba dispar
LLSSKAGGVGLNLIGCSRLILFDPDW

SEQ ID NO: 2494549 - protein, 26 aa, Entamoeba dispar
LLSSLFRNKASFAFKEPVDPQLTGAI

SEQ ID NO: 2494550 - protein, 17 aa, Entamoeba dispar
LLSSLLQVVCLSLKNST

SEQ ID NO: 2494551 - protein, 25 aa, Entamoeba dispar
LLSVKYSVIRGWRGGVLCNIAVEES

SEQ ID NO: 2494552 - protein, 19 aa, Entamoeba dispar
LLSYGRLWHDISIEDTFES

SEQ ID NO: 2494553 - protein, 17 aa, Entamoeba dispar
LLTENGIIYGEKIDNEI

SEQ ID NO: 2494554 - protein, 19 aa, Entamoeba dispar
LLTKCWKDFGDYAQPMCLV

SEQ ID NO: 2494555 - protein, 23 aa, Entamoeba dispar
LLTKYATLLIKFFSKSQRVGSSF

SEQ ID NO: 2494556 - protein, 19 aa, Entamoeba dispar
LLTLPTLVFLYGMNINQTI

SEQ ID NO: 2494557 - protein, 22 aa, Entamoeba dispar
LLTNGDCCLGTIDSSGNTLLHY

SEQ ID NO: 2494558 - protein, 19 aa, Entamoeba dispar
LLTPEQIKLIFGGVSVIYG

SEQ ID NO: 2494559 - protein, 17 aa, Entamoeba dispar
LLTREFLENIEIHPISP

SEQ ID NO: 2494560 - protein, 18 aa, Entamoeba dispar
LLTSVVLCGQKIIPNYCF

SEQ ID NO: 2494561 - protein, 21 aa, Entamoeba dispar
LLTTGTWCVPDLLDGEEVNAK

SEQ ID NO: 2494562 - protein, 19 aa, Entamoeba dispar
LLTTVACGSLESFLEDNVF

SEQ ID NO: 2494563 - protein, 18 aa, Entamoeba dispar
LLTTYLQRIGHTCSLDDC

SEQ ID NO: 2494564 - protein, 18 aa, Entamoeba dispar
LLTYYSIVHLPRIDGLQV

SEQ ID NO: 2494565 - protein, 23 aa, Entamoeba dispar
LLVASTFGSFVKQFKEIIAKDKS

SEQ ID NO: 2494566 - protein, 20 aa, Entamoeba dispar
LLVCLPKEYLSSLIDKQYIY

SEQ ID NO: 2494567 - protein, 17 aa, Entamoeba dispar
LLVDCIPVSFKDLIISF

SEQ ID NO: 2494568 - protein, 23 aa, Entamoeba dispar
LLVETLKNFLLYYTETETSKNVV

SEQ ID NO: 2494569 - protein, 18 aa, Entamoeba dispar
LLVIGGRPTINWYNLFKN

SEQ ID NO: 2494570 - protein, 18 aa, Entamoeba dispar
LLVKKLRFENSIERDKEA

SEQ ID NO: 2494571 - protein, 18 aa, Entamoeba dispar
LLVKVIARYCEFIETDVF

SEQ ID NO: 2494572 - protein, 24 aa, Entamoeba dispar
LLVLKEMVIELIILDILLTSPDYH

SEQ ID NO: 2494573 - protein, 24 aa, Entamoeba dispar
LLVLQAPIYVCGDIHGQFYDLLTI

SEQ ID NO: 2494574 - protein, 17 aa, Entamoeba dispar
LLVRLLIHFISIMDDKQ

SEQ ID NO: 2494575 - protein, 17 aa, Entamoeba dispar
LLVSSRTGYGVDNLLFE

SEQ ID NO: 2494576 - protein, 19 aa, Entamoeba dispar
LLVVGGLKPQLFEIQGNKM

SEQ ID NO: 2494577 - protein, 17 aa, Entamoeba dispar
LLVWALRHPACGYVQGM

SEQ ID NO: 2494578 - protein, 18 aa, Entamoeba dispar
LLVWLEQNLEEFIIEMKQ

SEQ ID NO: 2494579 - protein, 19 aa, Entamoeba dispar
LLYCYAKLKKNEEIENFLK

SEQ ID NO: 2494580 - protein, 19 aa, Entamoeba dispar
LLYELYTSKMLFAIADVGE

SEQ ID NO: 2494581 - protein, 19 aa, Entamoeba dispar
LLYEYPKESAMKYASDNEY

SEQ ID NO: 2494582 - protein, 18 aa, Entamoeba dispar
LLYIDLFSKMGYYYDSVP

SEQ ID NO: 2494583 - protein, 17 aa, Entamoeba dispar
LLYLIRNELELHLSKKY

SEQ ID NO: 2494584 - protein, 19 aa, Entamoeba dispar
LLYLKNIYGDGVMKIEPST

SEQ ID NO: 2494585 - protein, 17 aa, Entamoeba dispar
LLYLLRTLGYSFDIKQT

SEQ ID NO: 2494586 - protein, 18 aa, Entamoeba dispar
LLYLLRTLGYSFSIKQTK

SEQ ID NO: 2494587 - protein, 17 aa, Entamoeba dispar
LLYVVGEGKEFVFVCEV

SEQ ID NO: 2494588 - protein, 25 aa, Entamoeba dispar
LMCESDCLISVAFANKVTTPIAVQC

SEQ ID NO: 2494589 - protein, 17 aa, Entamoeba dispar
LMCESLTSINVWCSEIH

SEQ ID NO: 2494590 - protein, 24 aa, Entamoeba dispar
LMCSIPVPQFPGSLIDKIIGTEGY

SEQ ID NO: 2494591 - protein, 17 aa, Entamoeba dispar
LMDCYDKQLEIIKCINR

SEQ ID NO: 2494592 - protein, 17 aa, Entamoeba dispar
LMDGLSYFFSKIYIDHT

SEQ ID NO: 2494593 - protein, 25 aa, Entamoeba dispar
LMDRYPLLRKINCRLSCLPTKNGLP

SEQ ID NO: 2494594 - protein, 17 aa, Entamoeba dispar
LMDVTIASFLCKVHYSY

SEQ ID NO: 2494595 - protein, 26 aa, Entamoeba dispar
LMEALMLKLKTMRANSNYDVTDNDGD

SEQ ID NO: 2494596 - protein, 24 aa, Entamoeba dispar
LMEDEHYCGMSFRGDEKKSIFGIF

SEQ ID NO: 2494597 - protein, 19 aa, Entamoeba dispar
LMEDKRALYALAIHSLKNQ

SEQ ID NO: 2494598 - protein, 23 aa, Entamoeba dispar
LMEHIVQLEVPLVVTVETGKKWG

SEQ ID NO: 2494599 - protein, 21 aa, Entamoeba dispar
LMEKLIQRFKEVTVEKSQLEI

SEQ ID NO: 2494600 - protein, 22 aa, Entamoeba dispar
LMEKSCDSIEEIMRNTVNIIFK

SEQ ID NO: 2494601 - protein, 17 aa, Entamoeba dispar
LMEKYSFMKSLNKEYLV

SEQ ID NO: 2494602 - protein, 21 aa, Entamoeba dispar
LMENFRRAIGIKITEIKDVYI

SEQ ID NO: 2494603 - protein, 19 aa, Entamoeba dispar
LMEQARIQLMTELKNKGEL

SEQ ID NO: 2494604 - protein, 25 aa, Entamoeba dispar
LMETFPHIMIRSHFDSIVNALILCV

SEQ ID NO: 2494605 - protein, 22 aa, Entamoeba dispar
LMEVPKQIPIMLKQTFNQYILK

SEQ ID NO: 2494606 - protein, 18 aa, Entamoeba dispar
LMGIYGHCNPTPKNSSPV

SEQ ID NO: 2494607 - protein, 26 aa, Entamoeba dispar
LMGRVYPLKLGYIGVVNRSQQDINNR

SEQ ID NO: 2494608 - protein, 26 aa, Entamoeba dispar
LMGSSYPPTKGWDRLGYLCNIFQIPL

SEQ ID NO: 2494609 - protein, 18 aa, Entamoeba dispar
LMIACIGMCSCLITEKKP

SEQ ID NO: 2494610 - protein, 25 aa, Entamoeba dispar
LMIILITFLPRFSMFDFKLLASSCV

SEQ ID NO: 2494611 - protein, 22 aa, Entamoeba dispar
LMIKGDIEFNGRVIVHVGDQYY

SEQ ID NO: 2494612 - protein, 19 aa, Entamoeba dispar
LMIKLEYSRLIIKIRTIAN

SEQ ID NO: 2494613 - protein, 21 aa, Entamoeba dispar
LMKDFKKKVLDLIKIKIDEYQ

SEQ ID NO: 2494614 - protein, 25 aa, Entamoeba dispar
LMKEGGSWKSWKKRYFELDNDTLSY

SEQ ID NO: 2494615 - protein, 18 aa, Entamoeba dispar
LMKELIKLYKRAEGTRIK

SEQ ID NO: 2494616 - protein, 18 aa, Entamoeba dispar
LMKLMKCSFDYSDEYSLL

SEQ ID NO: 2494617 - protein, 17 aa, Entamoeba dispar
LMKRSRQVDQLKQRSKP

SEQ ID NO: 2494618 - protein, 18 aa, Entamoeba dispar
LMKTKPLPSREVVPITLP

SEQ ID NO: 2494619 - protein, 22 aa, Entamoeba dispar
LMKTNIGSMPLQFNPEQTNDFK

SEQ ID NO: 2494620 - protein, 18 aa, Entamoeba dispar
LMKTYELMKYESLEKEDE

SEQ ID NO: 2494621 - protein, 27 aa, Entamoeba dispar
LMKVVLQFNRFEDVLEFIFINKKCADT

SEQ ID NO: 2494622 - protein, 31 aa, Entamoeba dispar
LMLDKSRCSEFKRKLSLVGKKIGEETEHQIK

SEQ ID NO: 2494623 - protein, 18 aa, Entamoeba dispar
LMLFKDLLIDKWFMKLFN

SEQ ID NO: 2494624 - protein, 22 aa, Entamoeba dispar
LMLLRHWTLYDSLFHTREIASK

SEQ ID NO: 2494625 - protein, 17 aa, Entamoeba dispar
LMLNRLVMQSGKTATEP

SEQ ID NO: 2494626 - protein, 18 aa, Entamoeba dispar
LMLSCIGETIALRDKVDG

SEQ ID NO: 2494627 - protein, 24 aa, Entamoeba dispar
LMMMRETIGLFPPSLLLRASQDIT

SEQ ID NO: 2494628 - protein, 19 aa, Entamoeba dispar
LMNALKFGRIYKKVMNLWD

SEQ ID NO: 2494629 - protein, 24 aa, Entamoeba dispar
LMNCFSLSAINPFYQDVFRLTLES

SEQ ID NO: 2494630 - protein, 17 aa, Entamoeba dispar
LMNCLKYNGGDFDVLKL

SEQ ID NO: 2494631 - protein, 18 aa, Entamoeba dispar
LMNPEKYGLCSNEQITLK

SEQ ID NO: 2494632 - protein, 18 aa, Entamoeba dispar
LMNPKANLAMSFRMLLSD

SEQ ID NO: 2494633 - protein, 24 aa, Entamoeba dispar
LMNVLICTPGRLLYHLDNTPHFNT

SEQ ID NO: 2494634 - protein, 18 aa, Entamoeba dispar
LMNVWIIQCNCMKYVTNY

SEQ ID NO: 2494635 - protein, 18 aa, Entamoeba dispar
LMPCEYESWGTKEGGGYK

SEQ ID NO: 2494636 - protein, 18 aa, Entamoeba dispar
LMPGLGKYFPTPTHYFLN

SEQ ID NO: 2494637 - protein, 23 aa, Entamoeba dispar
LMPQLPQLIPMFFDLLPHGGDED

SEQ ID NO: 2494638 - protein, 21 aa, Entamoeba dispar
LMQFRGIIMPQLYNQAKEVNT

SEQ ID NO: 2494639 - protein, 19 aa, Entamoeba dispar
LMRELYLLIIKSASEDTQI

SEQ ID NO: 2494640 - protein, 18 aa, Entamoeba dispar
LMRKPRKPTEIVVYTDPL

SEQ ID NO: 2494641 - protein, 21 aa, Entamoeba dispar
LMRRCIPLLPTSFDFIQLYKQ

SEQ ID NO: 2494642 - protein, 22 aa, Entamoeba dispar
LMRREGRRMYTHIIIDEAHERD

SEQ ID NO: 2494643 - protein, 26 aa, Entamoeba dispar
LMSQKKFYPYCSFTLNGSVYSTYYVD

SEQ ID NO: 2494644 - protein, 21 aa, Entamoeba dispar
LMSSLHFLQFLLQQNLEIEDI

SEQ ID NO: 2494645 - protein, 24 aa, Entamoeba dispar
LMVKLEVASIFPLITGNAHVVTQS

SEQ ID NO: 2494646 - protein, 19 aa, Entamoeba dispar
LMVNLIFKDDESIKRFGNK

SEQ ID NO: 2494647 - protein, 17 aa, Entamoeba dispar
LMVRRPVQPLSFRFKPT

SEQ ID NO: 2494648 - protein, 25 aa, Entamoeba dispar
LMVVCKYGEIVFGCYNSNMLSEKGQ

SEQ ID NO: 2494649 - protein, 23 aa, Entamoeba dispar
LMYQYPYFYFPYVYYPQPYNVNG

SEQ ID NO: 2494650 - protein, 26 aa, Entamoeba dispar
LMYYMYKFPFSVLDLNIYKQHTVDNH

SEQ ID NO: 2494651 - protein, 23 aa, Entamoeba dispar
LNAEVAEICMRNEVNDELSNPRI

SEQ ID NO: 2494652 - protein, 18 aa, Entamoeba dispar
LNAFQALLGFSKESGVVF

SEQ ID NO: 2494653 - protein, 18 aa, Entamoeba dispar
LNAICFVAQSSNARLTLN

SEQ ID NO: 2494654 - protein, 17 aa, Entamoeba dispar
LNAICFVAQSSNARLTV

SEQ ID NO: 2494655 - protein, 25 aa, Entamoeba dispar
LNAIRVCDIKDRIISCYLQHYTDQI

SEQ ID NO: 2494656 - protein, 17 aa, Entamoeba dispar
LNALVPMLTVSIQRIVK

SEQ ID NO: 2494657 - protein, 17 aa, Entamoeba dispar
LNAMKRRGGCDYCAMLS

SEQ ID NO: 2494658 - protein, 26 aa, Entamoeba dispar
LNATFKEDLTFAILKGDPLDPILHPK

SEQ ID NO: 2494659 - protein, 26 aa, Entamoeba dispar
LNAVAKGAACLAYLEQDECVGHEVIY

SEQ ID NO: 2494660 - protein, 33 aa, Entamoeba dispar
LNAVIWLEHYLMNWKKSLLLVSHDTSFLNNVCD

SEQ ID NO: 2494661 - protein, 25 aa, Entamoeba dispar
LNCELCHIDFTFVRRRHHCRACGRC

SEQ ID NO: 2494662 - protein, 17 aa, Entamoeba dispar
LNCFNEVLVNARILYLQ

SEQ ID NO: 2494663 - protein, 26 aa, Entamoeba dispar
LNCGKNRRRALLKFAKENGFTSIALG

SEQ ID NO: 2494664 - protein, 28 aa, Entamoeba dispar
LNCGKTTFLNLLQSLPFDKQYNPSSDKE

SEQ ID NO: 2494665 - protein, 19 aa, Entamoeba dispar
LNCLKRVSQGNSFTFNGFE

SEQ ID NO: 2494666 - protein, 21 aa, Entamoeba dispar
LNCPQFRPQVLNPDFVTLFER

SEQ ID NO: 2494667 - protein, 24 aa, Entamoeba dispar
LNDEDKVICKMKIENMNIGFEARV

SEQ ID NO: 2494668 - protein, 33 aa, Entamoeba dispar
LNDEMIISLGFPKKVKVSLCFIKTIQEAINIIV

SEQ ID NO: 2494669 - protein, 21 aa, Entamoeba dispar
LNDFCSLSAESSRHLLDSGFS

SEQ ID NO: 2494670 - protein, 19 aa, Entamoeba dispar
LNDFCTRELNDLISKLHQK

SEQ ID NO: 2494671 - protein, 17 aa, Entamoeba dispar
LNDFFIDMFMLKDICDD

SEQ ID NO: 2494672 - protein, 26 aa, Entamoeba dispar
LNDITWPEFKSLISTRGEQITINIKY

SEQ ID NO: 2494673 - protein, 20 aa, Entamoeba dispar
LNDIWRLRRSLFIICKQNKE

SEQ ID NO: 2494674 - protein, 22 aa, Entamoeba dispar
LNDKIELFGIIWSSKEALVKLL

SEQ ID NO: 2494675 - protein, 17 aa, Entamoeba dispar
LNDKTAFRMIEMYWTCY

SEQ ID NO: 2494676 - protein, 19 aa, Entamoeba dispar
LNDLKDERIEIMKCILNKN

SEQ ID NO: 2494677 - protein, 23 aa, Entamoeba dispar
LNDLLRWLFGEMIQSECIENNIE

SEQ ID NO: 2494678 - protein, 19 aa, Entamoeba dispar
LNDMCPCIIFVPTKKNVMK

SEQ ID NO: 2494679 - protein, 25 aa, Entamoeba dispar
LNDMFKKRLTECLLKTNDCTNELVD

SEQ ID NO: 2494680 - protein, 19 aa, Entamoeba dispar
LNDMICWEGDKILVDNKIV

SEQ ID NO: 2494681 - protein, 18 aa, Entamoeba dispar
LNDNCHHITPMEKFNTQL

SEQ ID NO: 2494682 - protein, 24 aa, Entamoeba dispar
LNDNCYRNIIPMFKVLSTNIHSLY

SEQ ID NO: 2494683 - protein, 18 aa, Entamoeba dispar
LNDPYSYFMISRINNPLI

SEQ ID NO: 2494684 - protein, 18 aa, Entamoeba dispar
LNDRVKGEYYFKSLKEIL

SEQ ID NO: 2494685 - protein, 25 aa, Entamoeba dispar
LNEEEPRFLKGKIKEINNSKIKEVE

SEQ ID NO: 2494686 - protein, 26 aa, Entamoeba dispar
LNEEFPRIVKEFSRNRPLEYGPNRHF

SEQ ID NO: 2494687 - protein, 18 aa, Entamoeba dispar
LNEEVKRLMASYQNEKQQ

SEQ ID NO: 2494688 - protein, 18 aa, Entamoeba dispar
LNEFFNQWIKNMNLVIMG

SEQ ID NO: 2494689 - protein, 19 aa, Entamoeba dispar
LNEGFGYDVYNEGAKTSVV

SEQ ID NO: 2494690 - protein, 23 aa, Entamoeba dispar
LNEIKRKLLSEINSINELSLIEL

SEQ ID NO: 2494691 - protein, 27 aa, Entamoeba dispar
LNEIRHFYLYLLWILKNMDLRTLTNLL

SEQ ID NO: 2494692 - protein, 18 aa, Entamoeba dispar
LNEITCFHFGCESASSLK

SEQ ID NO: 2494693 - protein, 23 aa, Entamoeba dispar
LNEKCTFTLKAEDAFGSCGDKER

SEQ ID NO: 2494694 - protein, 19 aa, Entamoeba dispar
LNEKFKYLRMDGLVSSNKR

SEQ ID NO: 2494695 - protein, 27 aa, Entamoeba dispar
LNEKLCYSHFVSYQWNDEITIFVMLKY

SEQ ID NO: 2494696 - protein, 25 aa, Entamoeba dispar
LNELEVSMIFKLEKNQIVSAEIIKM

SEQ ID NO: 2494697 - protein, 25 aa, Entamoeba dispar
LNELIEIIASLLFKSMGHERLSENI

SEQ ID NO: 2494698 - protein, 17 aa, Entamoeba dispar
LNELKNKQIITLNENQK

SEQ ID NO: 2494699 - protein, 23 aa, Entamoeba dispar
LNELKYNKEIGILKEKELAQQNN

SEQ ID NO: 2494700 - protein, 21 aa, Entamoeba dispar
LNELPRMSIMTIENIHLNSIH

SEQ ID NO: 2494701 - protein, 24 aa, Entamoeba dispar
LNELRMCKTYEEYFIKRHKGDHDF

SEQ ID NO: 2494702 - protein, 22 aa, Entamoeba dispar
LNELSFPLQFILLEIISINQYQ

SEQ ID NO: 2494703 - protein, 17 aa, Entamoeba dispar
LNELSPGVIVDCLLDTT

SEQ ID NO: 2494704 - protein, 24 aa, Entamoeba dispar
LNELSRKFKLHCLLNSRKSKSQTS

SEQ ID NO: 2494705 - protein, 28 aa, Entamoeba dispar
LNEMELVDLASLCYFFIFLQPKYVIHSL

SEQ ID NO: 2494706 - protein, 24 aa, Entamoeba dispar
LNEMTSLSKPYCVKRSEFELFLKY

SEQ ID NO: 2494707 - protein, 20 aa, Entamoeba dispar
LNENCIKFTFSLSPICDSYY

SEQ ID NO: 2494708 - protein, 23 aa, Entamoeba dispar
LNENMMKTMFCVIYREANTKNFE

SEQ ID NO: 2494709 - protein, 17 aa, Entamoeba dispar
LNENVLKRFRTIKHPNI

SEQ ID NO: 2494710 - protein, 22 aa, Entamoeba dispar
LNEPDLLFVKSLDELIALCQKH

SEQ ID NO: 2494711 - protein, 19 aa, Entamoeba dispar
LNERMQILLLSSLMGCTSD

SEQ ID NO: 2494712 - protein, 26 aa, Entamoeba dispar
LNESISLLANCRHRIVPPPKVITDPR

SEQ ID NO: 2494713 - protein, 17 aa, Entamoeba dispar
LNEVLQLTRIYQSVEKG

SEQ ID NO: 2494714 - protein, 18 aa, Entamoeba dispar
LNFDARRSLKEWKERIGL

SEQ ID NO: 2494715 - protein, 32 aa, Entamoeba dispar
LNFFPSPDFITAKYLVGWNEYIAVFNYSKMMV

SEQ ID NO: 2494716 - protein, 21 aa, Entamoeba dispar
LNFLFPNSFFTDMKKFIVKRI

SEQ ID NO: 2494717 - protein, 17 aa, Entamoeba dispar
LNFLNIPLGTWFHLAIC

SEQ ID NO: 2494718 - protein, 17 aa, Entamoeba dispar
LNFNAHEYVVWNKYYLR

SEQ ID NO: 2494719 - protein, 17 aa, Entamoeba dispar
LNFNIPISPIINEIFTV

SEQ ID NO: 2494720 - protein, 19 aa, Entamoeba dispar
LNFQYYVAQVMDFSSQLAK

SEQ ID NO: 2494721 - protein, 20 aa, Entamoeba dispar
LNFTYVCLENVTIESCSIDS

SEQ ID NO: 2494722 - protein, 31 aa, Entamoeba dispar
LNGESLLHYCARYGRALICREILKHNIDINS

SEQ ID NO: 2494723 - protein, 22 aa, Entamoeba dispar
LNGFQAMGGLECLSARRNRITM

SEQ ID NO: 2494724 - protein, 19 aa, Entamoeba dispar
LNGIPKFVFWEKYYFCNRK

SEQ ID NO: 2494725 - protein, 19 aa, Entamoeba dispar
LNGIYYMFYEIIFNTFVSL

SEQ ID NO: 2494726 - protein, 23 aa, Entamoeba dispar
LNGKDVPIIICGNKVDCQPRLVS

SEQ ID NO: 2494727 - protein, 17 aa, Entamoeba dispar
LNGLPPIPTSILPLFEM

SEQ ID NO: 2494728 - protein, 19 aa, Entamoeba dispar
LNGLTLFLIQVIKNKYTQN

SEQ ID NO: 2494729 - protein, 23 aa, Entamoeba dispar
LNGMLPTRIESVFTESVKSESYS

SEQ ID NO: 2494730 - protein, 23 aa, Entamoeba dispar
LNGNSAICFATFRRDLRSNSIGK

SEQ ID NO: 2494731 - protein, 17 aa, Entamoeba dispar
LNGNVCIGFVTVKEPID

SEQ ID NO: 2494732 - protein, 17 aa, Entamoeba dispar
LNGRYVCSCLSLEQKEI

SEQ ID NO: 2494733 - protein, 24 aa, Entamoeba dispar
LNGTSVLFNWCKKGHILLATTSTD

SEQ ID NO: 2494734 - protein, 18 aa, Entamoeba dispar
LNGWDLLFEFVEKYHDNF

SEQ ID NO: 2494735 - protein, 18 aa, Entamoeba dispar
LNHFKSIDFLNGKKVTLR

SEQ ID NO: 2494736 - protein, 32 aa, Entamoeba dispar
LNHHMQEYWELWNCKSTCAIQLIQTVSPQQIV

SEQ ID NO: 2494737 - protein, 23 aa, Entamoeba dispar
LNHPNILKLFGFFEDENRWFLVL

SEQ ID NO: 2494738 - protein, 18 aa, Entamoeba dispar
LNHQIGIENIYLECSERI

SEQ ID NO: 2494739 - protein, 24 aa, Entamoeba dispar
LNHRGEVKLADFGISVQLTKRKSK

SEQ ID NO: 2494740 - protein, 18 aa, Entamoeba dispar
LNHVVCGLLSLFLEPNPD

SEQ ID NO: 2494741 - protein, 32 aa, Entamoeba dispar
LNIEVLKLLMIRVKRLYEFICKQYSSIVAPVI

SEQ ID NO: 2494742 - protein, 22 aa, Entamoeba dispar
LNIFHCTLLYHFPNDILSFVLQ

SEQ ID NO: 2494743 - protein, 28 aa, Entamoeba dispar
LNIFPFRKWSDKEIPEFHEGEKVQLNCF

SEQ ID NO: 2494744 - protein, 22 aa, Entamoeba dispar
LNIGDCRSYLYSNSTLRTIYNY

SEQ ID NO: 2494745 - protein, 18 aa, Entamoeba dispar
LNIHKGKVDNMMLEAMEL

SEQ ID NO: 2494746 - protein, 19 aa, Entamoeba dispar
LNIILDLFESILLETSVIL

SEQ ID NO: 2494747 - protein, 19 aa, Entamoeba dispar
LNIKNIINATGYLRGGYDN

SEQ ID NO: 2494748 - protein, 23 aa, Entamoeba dispar
LNINSIMKCIKLRDEGLTLEEIE

SEQ ID NO: 2494749 - protein, 17 aa, Entamoeba dispar
LNIPFKNLLPFYYNLKH

SEQ ID NO: 2494750 - protein, 26 aa, Entamoeba dispar
LNIPIREGGLCLGTWQGIYLNEHRDD

SEQ ID NO: 2494751 - protein, 21 aa, Entamoeba dispar
LNISGCIRLSEEFITTMLIAS

SEQ ID NO: 2494752 - protein, 17 aa, Entamoeba dispar
LNIYDSIFQIIQLTTSH

SEQ ID NO: 2494753 - protein, 19 aa, Entamoeba dispar
LNIYYYYIRINQIQINSDN

SEQ ID NO: 2494754 - protein, 17 aa, Entamoeba dispar
LNKELFVNWTKLNDYGL

SEQ ID NO: 2494755 - protein, 17 aa, Entamoeba dispar
LNKFIGIVSTWELFCTI

SEQ ID NO: 2494756 - protein, 18 aa, Entamoeba dispar
LNKGFGFEVYREGVDVHI

SEQ ID NO: 2494757 - protein, 26 aa, Entamoeba dispar
LNKKCFKEQAIWMLNALWPTHKDTVA

SEQ ID NO: 2494758 - protein, 23 aa, Entamoeba dispar
LNKKFSVHEGVRFVSSKTGKTVG

SEQ ID NO: 2494759 - protein, 19 aa, Entamoeba dispar
LNKKGDWWQGECQGNIGFF

SEQ ID NO: 2494760 - protein, 24 aa, Entamoeba dispar
LNKKIIKYLVYFVSKQPFCESEGQ

SEQ ID NO: 2494761 - protein, 26 aa, Entamoeba dispar
LNKLKSVEVIECRECKINIKSDCIER

SEQ ID NO: 2494762 - protein, 27 aa, Entamoeba dispar
LNKLKSVEVINCRECKINIKSDCIEKL

SEQ ID NO: 2494763 - protein, 24 aa, Entamoeba dispar
LNKLRGLPIAAVRAPGFGETRKGI

SEQ ID NO: 2494764 - protein, 17 aa, Entamoeba dispar
LNKNWKKYGETKIKLSV

SEQ ID NO: 2494765 - protein, 27 aa, Entamoeba dispar
LNKQYDCIWIQWSILYLRDDDLIDMLK

SEQ ID NO: 2494766 - protein, 18 aa, Entamoeba dispar
LNKRRTYLLSSEQQSKLF

SEQ ID NO: 2494767 - protein, 23 aa, Entamoeba dispar
LNKSVGLSSLFYKNSKYVQLCTK

SEQ ID NO: 2494768 - protein, 27 aa, Entamoeba dispar
LNKYSLEFPSLLKLLLIENKTIFLSTD

SEQ ID NO: 2494769 - protein, 26 aa, Entamoeba dispar
LNLETFCVELPRICIDKGMNITMETE

SEQ ID NO: 2494770 - protein, 20 aa, Entamoeba dispar
LNLFGEVMYLLGVDVGQAFG

SEQ ID NO: 2494771 - protein, 19 aa, Entamoeba dispar
LNLFPSIKTLFLFNQNDVN

SEQ ID NO: 2494772 - protein, 18 aa, Entamoeba dispar
LNLHKKRYGSYGSIRSWY

SEQ ID NO: 2494773 - protein, 22 aa, Entamoeba dispar
LNLIDIAHTFGLENPTIVNTDL

SEQ ID NO: 2494774 - protein, 22 aa, Entamoeba dispar
LNLKSVNSFSYLTSLSIRHCRI

SEQ ID NO: 2494775 - protein, 17 aa, Entamoeba dispar
LNLKWIRTNSRPCPSCG

SEQ ID NO: 2494776 - protein, 17 aa, Entamoeba dispar
LNLLNEVTEYLKVNEPK

SEQ ID NO: 2494777 - protein, 20 aa, Entamoeba dispar
LNLLPRINRDMFIFIIDFLQ

SEQ ID NO: 2494778 - protein, 17 aa, Entamoeba dispar
LNLLRMVSSDDKNYGFA

SEQ ID NO: 2494779 - protein, 18 aa, Entamoeba dispar
LNLLYEMNLNIPLESIIM

SEQ ID NO: 2494780 - protein, 26 aa, Entamoeba dispar
LNLMKKIYKIFGFKTEIALSTRNEKK

SEQ ID NO: 2494781 - protein, 17 aa, Entamoeba dispar
LNLNESISYGVNVDMSL

SEQ ID NO: 2494782 - protein, 17 aa, Entamoeba dispar
LNLRLTVNILKQLVESL

SEQ ID NO: 2494783 - protein, 19 aa, Entamoeba dispar
LNLSHAVGIALNYMHMRLR

SEQ ID NO: 2494784 - protein, 19 aa, Entamoeba dispar
LNLSIPSKLMFYEITLLSH

SEQ ID NO: 2494785 - protein, 20 aa, Entamoeba dispar
LNLSPSVSIINCYEDNDKSD

SEQ ID NO: 2494786 - protein, 24 aa, Entamoeba dispar
LNLSTLPTLFAFALSTQSYKNYLT

SEQ ID NO: 2494787 - protein, 23 aa, Entamoeba dispar
LNLVGCPSLEILETEGLDIFQFH

SEQ ID NO: 2494788 - protein, 17 aa, Entamoeba dispar
LNLVKKLNGLVIEYNKK

SEQ ID NO: 2494789 - protein, 23 aa, Entamoeba dispar
LNLVPGAILLIVFEDYKSVEKPY

SEQ ID NO: 2494790 - protein, 18 aa, Entamoeba dispar
LNLWQIDFGEEWRNKNHI

SEQ ID NO: 2494791 - protein, 25 aa, Entamoeba dispar
LNMIQGAVFIPGFVVSVGDDGLVKV

SEQ ID NO: 2494792 - protein, 18 aa, Entamoeba dispar
LNNGEILSFLSVFVSDCN

SEQ ID NO: 2494793 - protein, 20 aa, Entamoeba dispar
LNNIFIKSGRALVGDLGTAI

SEQ ID NO: 2494794 - protein, 25 aa, Entamoeba dispar
LNNKIEWSIKLKKWDLRTEELIEPL

SEQ ID NO: 2494795 - protein, 17 aa, Entamoeba dispar
LNNLLAHKKEEYSKITE

SEQ ID NO: 2494796 - protein, 24 aa, Entamoeba dispar
LNNNWKNEKEILLKENESLKEQLD

SEQ ID NO: 2494797 - protein, 25 aa, Entamoeba dispar
LNNNYIKIVEPFFVKLFQNDILIRD

SEQ ID NO: 2494798 - protein, 18 aa, Entamoeba dispar
LNNPRIVLSSNTFNQVTS

SEQ ID NO: 2494799 - protein, 23 aa, Entamoeba dispar
LNNQAVFLFKGWGRSLDKRQSFK

SEQ ID NO: 2494800 - protein, 23 aa, Entamoeba dispar
LNNSGFAIVGNWAKYDINNRCLI

SEQ ID NO: 2494801 - protein, 17 aa, Entamoeba dispar
LNNSKGFNPIKIERKQG

SEQ ID NO: 2494802 - protein, 17 aa, Entamoeba dispar
LNNVNRKGIISVENCLS

SEQ ID NO: 2494803 - protein, 24 aa, Entamoeba dispar
LNNVPADNIILVFGNHEKKIIKEL

SEQ ID NO: 2494804 - protein, 19 aa, Entamoeba dispar
LNPEKRITCTNALNHPFLN

SEQ ID NO: 2494805 - protein, 21 aa, Entamoeba dispar
LNPGIIKGIFSNYGKVSRMHF

SEQ ID NO: 2494806 - protein, 18 aa, Entamoeba dispar
LNPGSWKALQKTAKEYED

SEQ ID NO: 2494807 - protein, 19 aa, Entamoeba dispar
LNPGSWKALQTRAKEFEDF

SEQ ID NO: 2494808 - protein, 19 aa, Entamoeba dispar
LNPLWSPNFKTMFQLICSN

SEQ ID NO: 2494809 - protein, 29 aa, Entamoeba dispar
LNPSFKTQIATIIIFKGYSKENFGYIYRQ

SEQ ID NO: 2494810 - protein, 19 aa, Entamoeba dispar
LNPSGEYLFGILPNQPTSL

SEQ ID NO: 2494811 - protein, 18 aa, Entamoeba dispar
LNPTWGDTFEFYNVVPGT

SEQ ID NO: 2494812 - protein, 23 aa, Entamoeba dispar
LNQAHLPINISIVNESQIHTPIK

SEQ ID NO: 2494813 - protein, 17 aa, Entamoeba dispar
LNQFAPLHVDGFEQYHR

SEQ ID NO: 2494814 - protein, 24 aa, Entamoeba dispar
LNQTFNFLSTFIVKSQKEGTYKEK

SEQ ID NO: 2494815 - protein, 24 aa, Entamoeba dispar
LNRAALTFNYLIKILESLGYFVST

SEQ ID NO: 2494816 - protein, 18 aa, Entamoeba dispar
LNRETIVILDSLNYNKSF

SEQ ID NO: 2494817 - protein, 17 aa, Entamoeba dispar
LNREVYIHRIGRSGRFG

SEQ ID NO: 2494818 - protein, 19 aa, Entamoeba dispar
LNRFIELLTSPGLINNDFN

SEQ ID NO: 2494819 - protein, 17 aa, Entamoeba dispar
LNRGVNAINEILNGTLT

SEQ ID NO: 2494820 - protein, 38 aa, Entamoeba dispar
LNRKQFCIHCGLCVCNGCYRGRFIFNGVNKRGCDRCMK

SEQ ID NO: 2494821 - protein, 20 aa, Entamoeba dispar
LNRLLRLIMDPLLADYITAK

SEQ ID NO: 2494822 - protein, 21 aa, Entamoeba dispar
LNRNFGFPVFCTVIEANTIEK

SEQ ID NO: 2494823 - protein, 24 aa, Entamoeba dispar
LNRNRLDELIPIFEEKRLYSTVFV

SEQ ID NO: 2494824 - protein, 17 aa, Entamoeba dispar
LNRRNGISGTNIIETIS

SEQ ID NO: 2494825 - protein, 24 aa, Entamoeba dispar
LNRTFKDLFHRTTELCETIDKQWG

SEQ ID NO: 2494826 - protein, 17 aa, Entamoeba dispar
LNRVCAIAFSQQLIILN

SEQ ID NO: 2494827 - protein, 24 aa, Entamoeba dispar
LNRVLSCRCDIIIKNGQVEAISIV

SEQ ID NO: 2494828 - protein, 21 aa, Entamoeba dispar
LNSDYDKCYSFFDSLFNKTKA

SEQ ID NO: 2494829 - protein, 17 aa, Entamoeba dispar
LNSFLIMPVQRVPRYRL

SEQ ID NO: 2494830 - protein, 18 aa, Entamoeba dispar
LNSFNAWNRKFNIKKGKK

SEQ ID NO: 2494831 - protein, 19 aa, Entamoeba dispar
LNSFNTWNRKFAKKYNKKT

SEQ ID NO: 2494832 - protein, 20 aa, Entamoeba dispar
LNSFNTWNRKFAKKYNKKTV

SEQ ID NO: 2494833 - protein, 18 aa, Entamoeba dispar
LNSFNVWNRKFTKKSNKK

SEQ ID NO: 2494834 - protein, 26 aa, Entamoeba dispar
LNSICFKKGQLPTFIYRGCQVLYHLY

SEQ ID NO: 2494835 - protein, 19 aa, Entamoeba dispar
LNSINIWSVETMKCIQSIP

SEQ ID NO: 2494836 - protein, 33 aa, Entamoeba dispar
LNSIVNLVCEFRISGPFKALILNDMFKVLNISF

SEQ ID NO: 2494837 - protein, 29 aa, Entamoeba dispar
LNSKSQWTRNYCIAICVSISDFNQKYMTR

SEQ ID NO: 2494838 - protein, 24 aa, Entamoeba dispar
LNSLLDHRATIFIPELNIEVKCPP

SEQ ID NO: 2494839 - protein, 24 aa, Entamoeba dispar
LNSLMIHLCPSRFSHFLMTSYTPL

SEQ ID NO: 2494840 - protein, 30 aa, Entamoeba dispar
LNSLSECRAFYWDDMRLRKPNTMVVPMEKV

SEQ ID NO: 2494841 - protein, 18 aa, Entamoeba dispar
LNSLVNYRAKGRFPVISW

SEQ ID NO: 2494842 - protein, 27 aa, Entamoeba dispar
LNSRHPPPSLNFAYLLQVQQQSTCRIK

SEQ ID NO: 2494843 - protein, 25 aa, Entamoeba dispar
LNSRKKLTLIILYRGVVVTDIPVIR

SEQ ID NO: 2494844 - protein, 17 aa, Entamoeba dispar
LNSSFEIGKLAVLGCSV

SEQ ID NO: 2494845 - protein, 22 aa, Entamoeba dispar
LNSSLKRALLIAHFNSIGLHKI

SEQ ID NO: 2494846 - protein, 19 aa, Entamoeba dispar
LNSTWYAKLGMWHKALNKL

SEQ ID NO: 2494847 - protein, 18 aa, Entamoeba dispar
LNSVDIVISFDLSDTATE

SEQ ID NO: 2494848 - protein, 20 aa, Entamoeba dispar
LNSYHFILISYFDLRDAKTV

SEQ ID NO: 2494849 - protein, 21 aa, Entamoeba dispar
LNSYHFILISYFDLRDAKTVY

SEQ ID NO: 2494850 - protein, 21 aa, Entamoeba dispar
LNSYHFILISYFDLRDVKTVY

SEQ ID NO: 2494851 - protein, 17 aa, Entamoeba dispar
LNTCPLPHDSIFTKTQG

SEQ ID NO: 2494852 - protein, 23 aa, Entamoeba dispar
LNTEGKFVFDILCTNGNNELGGN

SEQ ID NO: 2494853 - protein, 26 aa, Entamoeba dispar
LNTETRKLLFNYVALGVKLMNASNSN

SEQ ID NO: 2494854 - protein, 29 aa, Entamoeba dispar
LNTFSLKKNWMCSLCVCPNTGDDVVVINS

SEQ ID NO: 2494855 - protein, 17 aa, Entamoeba dispar
LNTGMLRLCSQCMDNET

SEQ ID NO: 2494856 - protein, 19 aa, Entamoeba dispar
LNTIVPIIISRASMNPEIT

SEQ ID NO: 2494857 - protein, 24 aa, Entamoeba dispar
LNTLCALRTLKLYINQSTYPTYLN

SEQ ID NO: 2494858 - protein, 18 aa, Entamoeba dispar
LNTLCGFEETRNSDFLQS

SEQ ID NO: 2494859 - protein, 21 aa, Entamoeba dispar
LNTLFSLEFSSNVLIGDFHTC

SEQ ID NO: 2494860 - protein, 28 aa, Entamoeba dispar
LNTLKCLRSTKTINLRGKYNTWLQQINK

SEQ ID NO: 2494861 - protein, 25 aa, Entamoeba dispar
LNTLKENRFAVGIDNRMKDFINDLT

SEQ ID NO: 2494862 - protein, 17 aa, Entamoeba dispar
LNTLLLLMLNDDDDITQ

SEQ ID NO: 2494863 - protein, 17 aa, Entamoeba dispar
LNTMVCICYNMKERDNW

SEQ ID NO: 2494864 - protein, 17 aa, Entamoeba dispar
LNTPITIKWENGEIPRS

SEQ ID NO: 2494865 - protein, 19 aa, Entamoeba dispar
LNTPNAFVNRALSSCVPIE

SEQ ID NO: 2494866 - protein, 17 aa, Entamoeba dispar
LNTRPSLTTTFTPKSIN

SEQ ID NO: 2494867 - protein, 18 aa, Entamoeba dispar
LNTTFGFYVEAINKVGLD

SEQ ID NO: 2494868 - protein, 17 aa, Entamoeba dispar
LNVAELFRDLLSVMNKD

SEQ ID NO: 2494869 - protein, 17 aa, Entamoeba dispar
LNVALRWIDVAKPMTRL

SEQ ID NO: 2494870 - protein, 20 aa, Entamoeba dispar
LNVFPKIEFNIIPKELIQIN

SEQ ID NO: 2494871 - protein, 20 aa, Entamoeba dispar
LNVIFPYPFISSIILASSRK

SEQ ID NO: 2494872 - protein, 19 aa, Entamoeba dispar
LNVKEILKKIHVYQPHDII

SEQ ID NO: 2494873 - protein, 22 aa, Entamoeba dispar
LNVLQPFMWQHILIPILPLFLS

SEQ ID NO: 2494874 - protein, 19 aa, Entamoeba dispar
LNVPDWLLKEIGTVQRLNN

SEQ ID NO: 2494875 - protein, 24 aa, Entamoeba dispar
LNVYCSRLPFIQLTGLKQLEVYNS

SEQ ID NO: 2494876 - protein, 24 aa, Entamoeba dispar
LNVYKLTVLLLISLKKIETASSTL

SEQ ID NO: 2494877 - protein, 19 aa, Entamoeba dispar
LNWIKKDAGHFIFTLINHQ

SEQ ID NO: 2494878 - protein, 27 aa, Entamoeba dispar
LNYGLMEGVALWALRKPFNEVIESSAT

SEQ ID NO: 2494879 - protein, 26 aa, Entamoeba dispar
LNYHRVLEFLLIFLLNLNDSIIPSSL

SEQ ID NO: 2494880 - protein, 20 aa, Entamoeba dispar
LNYIKSTTFSPVDINISYTN

SEQ ID NO: 2494881 - protein, 20 aa, Entamoeba dispar
LNYIRLKYIANITFESVLHY

SEQ ID NO: 2494882 - protein, 20 aa, Entamoeba dispar
LNYKIPVWFLNRQKDNKDGK

SEQ ID NO: 2494883 - protein, 17 aa, Entamoeba dispar
LNYKQFIGYTWISNENI

SEQ ID NO: 2494884 - protein, 25 aa, Entamoeba dispar
LNYLLDLLREFGFFFDSIYAKKTCK

SEQ ID NO: 2494885 - protein, 21 aa, Entamoeba dispar
LNYLYGIVVPQFIFLRKEIIG

SEQ ID NO: 2494886 - protein, 29 aa, Entamoeba dispar
LNYMKFYLIPKVDGIECKVQREMGELITI

SEQ ID NO: 2494887 - protein, 25 aa, Entamoeba dispar
LNYPVGSIALCLEPLLSSIIKLLTS

SEQ ID NO: 2494888 - protein, 18 aa, Entamoeba dispar
LPAFHPFSISLLQINQKN

SEQ ID NO: 2494889 - protein, 19 aa, Entamoeba dispar
LPAGAVRFEVECEITLDGT

SEQ ID NO: 2494890 - protein, 21 aa, Entamoeba dispar
LPAKEFIEALLAVPNATKVDQ

SEQ ID NO: 2494891 - protein, 18 aa, Entamoeba dispar
LPAKYVIHVVGPIVDTLK

SEQ ID NO: 2494892 - protein, 17 aa, Entamoeba dispar
LPAQLRSAAANRDDDRF

SEQ ID NO: 2494893 - protein, 19 aa, Entamoeba dispar
LPCINMFAGGMNFHSRREF

SEQ ID NO: 2494894 - protein, 26 aa, Entamoeba dispar
LPCLHKFHQECLLKSLSNIHLNESEK

SEQ ID NO: 2494895 - protein, 17 aa, Entamoeba dispar
LPCTVCGDIHGQFHDLK

SEQ ID NO: 2494896 - protein, 17 aa, Entamoeba dispar
LPDDNNCFILFIQLQNF

SEQ ID NO: 2494897 - protein, 21 aa, Entamoeba dispar
LPDEFKPIISQAIIESIPSHP

SEQ ID NO: 2494898 - protein, 24 aa, Entamoeba dispar
LPDERCSNCFHSIEAHTLPVELFN

SEQ ID NO: 2494899 - protein, 19 aa, Entamoeba dispar
LPDIKKYFPENCQKKVTAK

SEQ ID NO: 2494900 - protein, 22 aa, Entamoeba dispar
LPDIPLQQTLPMLKQENVSEAI

SEQ ID NO: 2494901 - protein, 23 aa, Entamoeba dispar
LPDLEARVGVLQANLRKSPVAPD

SEQ ID NO: 2494902 - protein, 24 aa, Entamoeba dispar
LPDMNEFYRNILIKQNTIIKDKLL

SEQ ID NO: 2494903 - protein, 24 aa, Entamoeba dispar
LPDPIIFLRACLKINEMNKEWEKL

SEQ ID NO: 2494904 - protein, 26 aa, Entamoeba dispar
LPDPLLFLRACMLRIDLNGKWLQEKV

SEQ ID NO: 2494905 - protein, 18 aa, Entamoeba dispar
LPDSLLFSNQLQKISLSH

SEQ ID NO: 2494906 - protein, 22 aa, Entamoeba dispar
LPEELYPFISEFHGYLMDSFGS

SEQ ID NO: 2494907 - protein, 21 aa, Entamoeba dispar
LPEHMKIPLNDLLKDLLEEQE

SEQ ID NO: 2494908 - protein, 18 aa, Entamoeba dispar
LPEIKHYEPKCKMMVVGT

SEQ ID NO: 2494909 - protein, 19 aa, Entamoeba dispar
LPEIKHYEPKCKMMVVGTK

SEQ ID NO: 2494910 - protein, 17 aa, Entamoeba dispar
LPEIPFIVLDEADRLLE

SEQ ID NO: 2494911 - protein, 20 aa, Entamoeba dispar
LPEKHFIAFEKVKWWLDDKA

SEQ ID NO: 2494912 - protein, 25 aa, Entamoeba dispar
LPEKLINTKLVFYDRFVKPINKDDI

SEQ ID NO: 2494913 - protein, 18 aa, Entamoeba dispar
LPELTLSILPSCLKSLFI

SEQ ID NO: 2494914 - protein, 25 aa, Entamoeba dispar
LPEMEPGKDWLLFPNMGAYTISMAT

SEQ ID NO: 2494915 - protein, 17 aa, Entamoeba dispar
LPENCCVTVVMGNCHLK

SEQ ID NO: 2494916 - protein, 23 aa, Entamoeba dispar
LPEPIEAMILRYVKKKADWWTDV

SEQ ID NO: 2494917 - protein, 28 aa, Entamoeba dispar
LPEPNLFVFKYLFMFLTKVMAESKINKM

SEQ ID NO: 2494918 - protein, 21 aa, Entamoeba dispar
LPESELIFLQQFYEQYTSSSQ

SEQ ID NO: 2494919 - protein, 17 aa, Entamoeba dispar
LPESLQIFLGPNLRPED

SEQ ID NO: 2494920 - protein, 18 aa, Entamoeba dispar
LPEYIIGILSDFIHSESF

SEQ ID NO: 2494921 - protein, 26 aa, Entamoeba dispar
LPEYIKYICLQARMPNLIIDDKQLEY

SEQ ID NO: 2494922 - protein, 23 aa, Entamoeba dispar
LPFDSEFELCSFIGKTTEKDSSV

SEQ ID NO: 2494923 - protein, 25 aa, Entamoeba dispar
LPFFMFGWHYTWFINAFNFELVLRI

SEQ ID NO: 2494924 - protein, 28 aa, Entamoeba dispar
LPFIKKKLHYRILGFYAIPHENELIMIL

SEQ ID NO: 2494925 - protein, 24 aa, Entamoeba dispar
LPFLYKELFIIDSCNCFLENTLQS

SEQ ID NO: 2494926 - protein, 29 aa, Entamoeba dispar
LPFNCLDVYVNHCIPVFIVITNGILSPLF

SEQ ID NO: 2494927 - protein, 22 aa, Entamoeba dispar
LPFNMQLKYSKECLKIKDYDLL

SEQ ID NO: 2494928 - protein, 23 aa, Entamoeba dispar
LPFSDIWKHICIVWTKCYNCFPP

SEQ ID NO: 2494929 - protein, 24 aa, Entamoeba dispar
LPFSKECIDFVNGPVCLLSEYTAE

SEQ ID NO: 2494930 - protein, 17 aa, Entamoeba dispar
LPFWFKKDSVVCAGETL

SEQ ID NO: 2494931 - protein, 22 aa, Entamoeba dispar
LPGGPYYSAPFVLQAREKRSAK

SEQ ID NO: 2494932 - protein, 25 aa, Entamoeba dispar
LPGIFKALMPHVGDFEKVFTTRKVG

SEQ ID NO: 2494933 - protein, 17 aa, Entamoeba dispar
LPGIFNALFPHVKDFEN

SEQ ID NO: 2494934 - protein, 24 aa, Entamoeba dispar
LPGKKGCTLDCTIQCIRSVYHNVI

SEQ ID NO: 2494935 - protein, 20 aa, Entamoeba dispar
LPGLLFKFITIKPCDRKIFV

SEQ ID NO: 2494936 - protein, 19 aa, Entamoeba dispar
LPGLYWVGVMDYELKKYDV

SEQ ID NO: 2494937 - protein, 18 aa, Entamoeba dispar
LPGMPIDYSAKVALTRFH

SEQ ID NO: 2494938 - protein, 22 aa, Entamoeba dispar
LPGRPWVVREVCLKHGNGCKGK

SEQ ID NO: 2494939 - protein, 18 aa, Entamoeba dispar
LPGVIKSLAMPDAHSGYG

SEQ ID NO: 2494940 - protein, 18 aa, Entamoeba dispar
LPHFFKKIIQDQILFSLF

SEQ ID NO: 2494941 - protein, 24 aa, Entamoeba dispar
LPHGRCVAVLLPHVIRYNGQKPRK

SEQ ID NO: 2494942 - protein, 17 aa, Entamoeba dispar
LPHGVKIIAKMHSELIK

SEQ ID NO: 2494943 - protein, 19 aa, Entamoeba dispar
LPHHCDFVMNNKNDDKGFI

SEQ ID NO: 2494944 - protein, 17 aa, Entamoeba dispar
LPHIPSLDIRDGAVDLL

SEQ ID NO: 2494945 - protein, 19 aa, Entamoeba dispar
LPHSLSYLGKTAFIDCTNL

SEQ ID NO: 2494946 - protein, 19 aa, Entamoeba dispar
LPHTLLLGLLHKDPIINSY

SEQ ID NO: 2494947 - protein, 20 aa, Entamoeba dispar
LPHYWKEDYGFVSRGFVENS

SEQ ID NO: 2494948 - protein, 22 aa, Entamoeba dispar
LPIDLTTLISLHLPDRWFVSRK

SEQ ID NO: 2494949 - protein, 23 aa, Entamoeba dispar
LPIDRGISSWFFLREPEGSELGF

SEQ ID NO: 2494950 - protein, 32 aa, Entamoeba dispar
LPIELILKLFFYCFNHSPSIYALQVISEKLFK

SEQ ID NO: 2494951 - protein, 17 aa, Entamoeba dispar
LPIEVITIPGFNSEQNN

SEQ ID NO: 2494952 - protein, 22 aa, Entamoeba dispar
LPIFDFLCKHGKKLEIFERYLM

SEQ ID NO: 2494953 - protein, 17 aa, Entamoeba dispar
LPIFLLNKMNSVISYTI

SEQ ID NO: 2494954 - protein, 32 aa, Entamoeba dispar
LPIGCKSDVWAFGCLVYKCLTLHTPFEDSPMK

SEQ ID NO: 2494955 - protein, 22 aa, Entamoeba dispar
LPIGEYEIELLKKWSNKTQYQI

SEQ ID NO: 2494956 - protein, 20 aa, Entamoeba dispar
LPIHDMFQALLTLINEVIPA

SEQ ID NO: 2494957 - protein, 19 aa, Entamoeba dispar
LPIHSSLSPLRAFRYDQSD

SEQ ID NO: 2494958 - protein, 29 aa, Entamoeba dispar
LPIIASGGIRNGFDIVKSMTLGASLASIT

SEQ ID NO: 2494959 - protein, 19 aa, Entamoeba dispar
LPIIHSFPIPLREKFLSNL

SEQ ID NO: 2494960 - protein, 19 aa, Entamoeba dispar
LPIILPIIMRTIDCSIIEQ

SEQ ID NO: 2494961 - protein, 17 aa, Entamoeba dispar
LPIIPLKTKRSICNNTY

SEQ ID NO: 2494962 - protein, 24 aa, Entamoeba dispar
LPIKCSYCHNPFCNKCIKTHQCDK

SEQ ID NO: 2494963 - protein, 19 aa, Entamoeba dispar
LPIKIYKPITIQRKIINNV

SEQ ID NO: 2494964 - protein, 19 aa, Entamoeba dispar
LPIKVIPPKVSPQHNSINN

SEQ ID NO: 2494965 - protein, 19 aa, Entamoeba dispar
LPILKALYSLYFSRRSLEG

SEQ ID NO: 2494966 - protein, 20 aa, Entamoeba dispar
LPILPRFYMKQELCGLHGEE

SEQ ID NO: 2494967 - protein, 23 aa, Entamoeba dispar
LPILTRVPVQFIHNGNLSCFDQL

SEQ ID NO: 2494968 - protein, 23 aa, Entamoeba dispar
LPIMPLKEPLSFIPDDIKLTDGF

SEQ ID NO: 2494969 - protein, 19 aa, Entamoeba dispar
LPINILRYIQPLNQSVDFL

SEQ ID NO: 2494970 - protein, 30 aa, Entamoeba dispar
LPIPLRHARLFTYQLCRGLSYIHSKGICHR

SEQ ID NO: 2494971 - protein, 25 aa, Entamoeba dispar
LPIQCKICNAILLLSHHFARSYHFM

SEQ ID NO: 2494972 - protein, 17 aa, Entamoeba dispar
LPKDIVHSILKGLADSR

SEQ ID NO: 2494973 - protein, 19 aa, Entamoeba dispar
LPKEPRKMSLLSENSDNRK

SEQ ID NO: 2494974 - protein, 17 aa, Entamoeba dispar
LPKGIVFEEHCFCKCFL

SEQ ID NO: 2494975 - protein, 18 aa, Entamoeba dispar
LPKKEYPKIYNILCAINY

SEQ ID NO: 2494976 - protein, 22 aa, Entamoeba dispar
LPKKIVICGCPYSGKTSLIRRF

SEQ ID NO: 2494977 - protein, 31 aa, Entamoeba dispar
LPKLTNLYCHGISLRRGYSFKGNDELCISIT

SEQ ID NO: 2494978 - protein, 22 aa, Entamoeba dispar
LPKPNPELFIKAMNKLNASTQN

SEQ ID NO: 2494979 - protein, 21 aa, Entamoeba dispar
LPKRKDIWYYFNKVIVLSKRQ

SEQ ID NO: 2494980 - protein, 18 aa, Entamoeba dispar
LPKSLTPELPKIAKEIPS

SEQ ID NO: 2494981 - protein, 25 aa, Entamoeba dispar
LPKSSAALFTFCEFSHLSCISLIAE

SEQ ID NO: 2494982 - protein, 25 aa, Entamoeba dispar
LPKTRIPHKRVRSIGATGKSTFYGE

SEQ ID NO: 2494983 - protein, 18 aa, Entamoeba dispar
LPKYKSLDFDGVCSPGSI

SEQ ID NO: 2494984 - protein, 18 aa, Entamoeba dispar
LPLCKRLIYNEISMKSKF

SEQ ID NO: 2494985 - protein, 19 aa, Entamoeba dispar
LPLHEGLVFVCPTCESFCC

SEQ ID NO: 2494986 - protein, 19 aa, Entamoeba dispar
LPLHIIEFHSSFSQYLSVI

SEQ ID NO: 2494987 - protein, 19 aa, Entamoeba dispar
LPLKGKVPATVDMKITSLI

SEQ ID NO: 2494988 - protein, 21 aa, Entamoeba dispar
LPLNECLKNSVDVRQTLTEYR

SEQ ID NO: 2494989 - protein, 24 aa, Entamoeba dispar
LPLQELFLPIFIEIVAQPNPLITE

SEQ ID NO: 2494990 - protein, 23 aa, Entamoeba dispar
LPLSCPKRVIKEIIEDDFFSREW

SEQ ID NO: 2494991 - protein, 19 aa, Entamoeba dispar
LPLSDCFGKLISVDATTYV

SEQ ID NO: 2494992 - protein, 21 aa, Entamoeba dispar
LPLSHPELYEEIGIKPPKGVI

SEQ ID NO: 2494993 - protein, 21 aa, Entamoeba dispar
LPLSLSFSGTVTFYLDIFSIL

SEQ ID NO: 2494994 - protein, 18 aa, Entamoeba dispar
LPLSLSYIGNAVFSNCFN

SEQ ID NO: 2494995 - protein, 25 aa, Entamoeba dispar
LPLTKDSLPYAFSMKDTTLIKPKVV

SEQ ID NO: 2494996 - protein, 19 aa, Entamoeba dispar
LPLVAGRHGLDYKTSINRM

SEQ ID NO: 2494997 - protein, 22 aa, Entamoeba dispar
LPLYLENKFHVQFVIDQQNKRI

SEQ ID NO: 2494998 - protein, 17 aa, Entamoeba dispar
LPLYSFGNLLSVSISPE

SEQ ID NO: 2494999 - protein, 21 aa, Entamoeba dispar
LPMGNCIEISEGRWFEFENEA

SEQ ID NO: 2495000 - protein, 17 aa, Entamoeba dispar
LPNCKNSILPDIIKKKE

SEQ ID NO: 2495001 - protein, 17 aa, Entamoeba dispar
LPNDEMAKEYSIQPYEQ

SEQ ID NO: 2495002 - protein, 21 aa, Entamoeba dispar
LPNEFSNLISLTNLHCSENKF

SEQ ID NO: 2495003 - protein, 22 aa, Entamoeba dispar
LPNEITKLLPHVEHNLRNISKG

SEQ ID NO: 2495004 - protein, 20 aa, Entamoeba dispar
LPNGEIKKAVFVKDDQLFTV

SEQ ID NO: 2495005 - protein, 23 aa, Entamoeba dispar
LPNGEIKKAVFVKDDQLFTVYNF

SEQ ID NO: 2495006 - protein, 19 aa, Entamoeba dispar
LPNIMKRIVYCFNDGKGIE

SEQ ID NO: 2495007 - protein, 18 aa, Entamoeba dispar
LPNKYDWEHFVIEKTQFS

SEQ ID NO: 2495008 - protein, 20 aa, Entamoeba dispar
LPNPEYHPLGLASLTQLTFL

SEQ ID NO: 2495009 - protein, 20 aa, Entamoeba dispar
LPNPLIPYNLYEEFIELRNN

SEQ ID NO: 2495010 - protein, 27 aa, Entamoeba dispar
LPNPRRVKTGIQFKTYFIHFTGDFVIP

SEQ ID NO: 2495011 - protein, 24 aa, Entamoeba dispar
LPNSFSKPTLVQVFALSKNFYVVY

SEQ ID NO: 2495012 - protein, 20 aa, Entamoeba dispar
LPNSLKFIGGGAFLNCSSLV

SEQ ID NO: 2495013 - protein, 22 aa, Entamoeba dispar
LPNTLPLPQIVVVGSQSSGKSS

SEQ ID NO: 2495014 - protein, 25 aa, Entamoeba dispar
LPNVFYKLLTVILLRSEIQPHHLII

SEQ ID NO: 2495015 - protein, 17 aa, Entamoeba dispar
LPPAIAQAVCSIRKENN

SEQ ID NO: 2495016 - protein, 19 aa, Entamoeba dispar
LPPDVTAAVYKKFLRELPN

SEQ ID NO: 2495017 - protein, 20 aa, Entamoeba dispar
LPPEDSYCKIRNIICEVNEI

SEQ ID NO: 2495018 - protein, 29 aa, Entamoeba dispar
LPPEHLTCLKYLVSFCSHLVKSEKSKMTI

SEQ ID NO: 2495019 - protein, 18 aa, Entamoeba dispar
LPPFNVAVLFEETEYKEK

SEQ ID NO: 2495020 - protein, 19 aa, Entamoeba dispar
LPPGYICNRCHKPGHYIKD

SEQ ID NO: 2495021 - protein, 18 aa, Entamoeba dispar
LPPKIKEINETTSNKFFE

SEQ ID NO: 2495022 - protein, 17 aa, Entamoeba dispar
LPPLNSIIYDEIAKIGI

SEQ ID NO: 2495023 - protein, 20 aa, Entamoeba dispar
LPPNIYKLLCELVGDISITI

SEQ ID NO: 2495024 - protein, 21 aa, Entamoeba dispar
LPPNIYKLLCELVGDISITIQ

SEQ ID NO: 2495025 - protein, 23 aa, Entamoeba dispar
LPPNLCSITQKFDKFVIRQLQKT

SEQ ID NO: 2495026 - protein, 26 aa, Entamoeba dispar
LPPPCYTRERCGLGLLEKEEFIENEM

SEQ ID NO: 2495027 - protein, 22 aa, Entamoeba dispar
LPPPGTSVVAFISKLYELVNNP

SEQ ID NO: 2495028 - protein, 18 aa, Entamoeba dispar
LPPPRRKTNYFKENTGEI

SEQ ID NO: 2495029 - protein, 23 aa, Entamoeba dispar
LPPQPNFLSPLSLQTKLSQVSQN

SEQ ID NO: 2495030 - protein, 32 aa, Entamoeba dispar
LPPSLANKFCCREFYGVLSFNIKSQYQLYLGW

SEQ ID NO: 2495031 - protein, 18 aa, Entamoeba dispar
LPPSLAVIFQPFKQFYLE

SEQ ID NO: 2495032 - protein, 18 aa, Entamoeba dispar
LPPSLIKTKYFTQLQGEC

SEQ ID NO: 2495033 - protein, 24 aa, Entamoeba dispar
LPPTITKLGEWCFYGCSSLKSINI

SEQ ID NO: 2495034 - protein, 20 aa, Entamoeba dispar
LPQCVELWIIFAEKENFENS

SEQ ID NO: 2495035 - protein, 20 aa, Entamoeba dispar
LPQFNEWKDARIQEGQLKKW

SEQ ID NO: 2495036 - protein, 17 aa, Entamoeba dispar
LPQLSLFDLRRYFTTYP

SEQ ID NO: 2495037 - protein, 19 aa, Entamoeba dispar
LPQNIAYKISQRIQSSLTV

SEQ ID NO: 2495038 - protein, 23 aa, Entamoeba dispar
LPQNKGKLLGFYVRCKNNFNGKI

SEQ ID NO: 2495039 - protein, 19 aa, Entamoeba dispar
LPRLIRCKYEKDSMRGEVR

SEQ ID NO: 2495040 - protein, 18 aa, Entamoeba dispar
LPRLVRCKYEKDSMRGEV

SEQ ID NO: 2495041 - protein, 36 aa, Entamoeba dispar
LPRVIEKMIHCMYEKGCYCKGIFRESQNASIRKVEE

SEQ ID NO: 2495042 - protein, 21 aa, Entamoeba dispar
LPSCKDYIFYCKKCGERCIQI

SEQ ID NO: 2495043 - protein, 25 aa, Entamoeba dispar
LPSFAFKSKQTIINWNDKSISNVEL

SEQ ID NO: 2495044 - protein, 17 aa, Entamoeba dispar
LPSFAFKSKQTRINWTD

SEQ ID NO: 2495045 - protein, 19 aa, Entamoeba dispar
LPSIEPFLIQKLNNINNTI

SEQ ID NO: 2495046 - protein, 17 aa, Entamoeba dispar
LPSIPIVNPQQLNKQTP

SEQ ID NO: 2495047 - protein, 17 aa, Entamoeba dispar
LPSIYIPVLLNGKVIGK

SEQ ID NO: 2495048 - protein, 19 aa, Entamoeba dispar
LPSKFRVTKPFNFFRKVQI

SEQ ID NO: 2495049 - protein, 19 aa, Entamoeba dispar
LPSKSRNAFLQHLNQPTTT

SEQ ID NO: 2495050 - protein, 27 aa, Entamoeba dispar
LPSLFLTRCCVNLATALQYLASENILH

SEQ ID NO: 2495051 - protein, 17 aa, Entamoeba dispar
LPSLLRFSKNLKEKQRN

SEQ ID NO: 2495052 - protein, 17 aa, Entamoeba dispar
LPSNFIGTLCVDIEGKC

SEQ ID NO: 2495053 - protein, 17 aa, Entamoeba dispar
LPSPLFGSTPPWLMQIP

SEQ ID NO: 2495054 - protein, 20 aa, Entamoeba dispar
LPSPVIPLNCYDKFVDEQTV

SEQ ID NO: 2495055 - protein, 20 aa, Entamoeba dispar
LPSQWKIVLDDPLLVSQAKT

SEQ ID NO: 2495056 - protein, 17 aa, Entamoeba dispar
LPSSIARNSRRLLSRRL

SEQ ID NO: 2495057 - protein, 18 aa, Entamoeba dispar
LPSSLIFIGEKSFNGCVK

SEQ ID NO: 2495058 - protein, 22 aa, Entamoeba dispar
LPSSPFILGELFSYFNKTTIIQ

SEQ ID NO: 2495059 - protein, 18 aa, Entamoeba dispar
LPSTLKFVLKESEPYKGN

SEQ ID NO: 2495060 - protein, 20 aa, Entamoeba dispar
LPTECKRQVTGHSSDILCFR

SEQ ID NO: 2495061 - protein, 22 aa, Entamoeba dispar
LPTEIFFSFGKIFTLNKIKRVI

SEQ ID NO: 2495062 - protein, 17 aa, Entamoeba dispar
LPTEWIKEYYEPLEHYL

SEQ ID NO: 2495063 - protein, 25 aa, Entamoeba dispar
LPTGFFKLKSLRFISLTNTLVDSFS

SEQ ID NO: 2495064 - protein, 23 aa, Entamoeba dispar
LPTIKRPLTFPSIPTHNNGFDNE

SEQ ID NO: 2495065 - protein, 19 aa, Entamoeba dispar
LPTIKRRGLIDNFISCVCR

SEQ ID NO: 2495066 - protein, 17 aa, Entamoeba dispar
LPTKHIQEFKTSTEYST

SEQ ID NO: 2495067 - protein, 17 aa, Entamoeba dispar
LPTLFVVALPRSGSTFT

SEQ ID NO: 2495068 - protein, 25 aa, Entamoeba dispar
LPTLHVVKGLSVIRFVAGEKIISGG

SEQ ID NO: 2495069 - protein, 21 aa, Entamoeba dispar
LPTNIRQSAGILFKNLFPIKG

SEQ ID NO: 2495070 - protein, 26 aa, Entamoeba dispar
LPTNQRLYILLWRIFGLTEYCLDSNG

SEQ ID NO: 2495071 - protein, 17 aa, Entamoeba dispar
LPTPISVSWIEVIKQNR

SEQ ID NO: 2495072 - protein, 33 aa, Entamoeba dispar
LPTSIKEIGCKSFGYCRSLKSIIIPTSVNKIGD

SEQ ID NO: 2495073 - protein, 17 aa, Entamoeba dispar
LPTSIQIISLCKCKLLK

SEQ ID NO: 2495074 - protein, 21 aa, Entamoeba dispar
LPTTFNLPLTAKKKSRIRQDM

SEQ ID NO: 2495075 - protein, 20 aa, Entamoeba dispar
LPTTLPLIFRGIDSRFFQQF

SEQ ID NO: 2495076 - protein, 27 aa, Entamoeba dispar
LPTVIRDELHFIPARALKKDGERYYAP

SEQ ID NO: 2495077 - protein, 26 aa, Entamoeba dispar
LPTVIRDELHFVPARVLKKDGERYYA

SEQ ID NO: 2495078 - protein, 17 aa, Entamoeba dispar
LPVFVCKQMVGNIIINI

SEQ ID NO: 2495079 - protein, 30 aa, Entamoeba dispar
LPVGSKVLFKIICFICSFITENEQIQKMVS

SEQ ID NO: 2495080 - protein, 19 aa, Entamoeba dispar
LPVLHKIVVECFGSNLEEV

SEQ ID NO: 2495081 - protein, 17 aa, Entamoeba dispar
LPVLKELLNTKGLTHLR

SEQ ID NO: 2495082 - protein, 18 aa, Entamoeba dispar
LPVLNLHIEKVWKYPYQI

SEQ ID NO: 2495083 - protein, 20 aa, Entamoeba dispar
LPVNICRFSPDGTILAVGND

SEQ ID NO: 2495084 - protein, 18 aa, Entamoeba dispar
LPVPCLLPIIHEDNDVIV

SEQ ID NO: 2495085 - protein, 19 aa, Entamoeba dispar
LPVQFLTEICEDFLSEDKV

SEQ ID NO: 2495086 - protein, 18 aa, Entamoeba dispar
LPYCHVIDSKVFVVHGGI

SEQ ID NO: 2495087 - protein, 19 aa, Entamoeba dispar
LPYHFLLSVNCVESKPKLK

SEQ ID NO: 2495088 - protein, 17 aa, Entamoeba dispar
LPYKMVIDADYYDGIQN

SEQ ID NO: 2495089 - protein, 17 aa, Entamoeba dispar
LPYLDIFIPELKKNITD

SEQ ID NO: 2495090 - protein, 19 aa, Entamoeba dispar
LPYLPTRFLFSLLSDYSKN

SEQ ID NO: 2495091 - protein, 17 aa, Entamoeba dispar
LPYQLNTPFNYTSSSIN

SEQ ID NO: 2495092 - protein, 17 aa, Entamoeba dispar
LPYRLDLDLCYQAKKAS

SEQ ID NO: 2495093 - protein, 18 aa, Entamoeba dispar
LPYYDFIELSPLLDSSAM

SEQ ID NO: 2495094 - protein, 18 aa, Entamoeba dispar
LQALFGIKIAYRCVVIGL

SEQ ID NO: 2495095 - protein, 19 aa, Entamoeba dispar
LQANFMAPISQVLNRGISV

SEQ ID NO: 2495096 - protein, 25 aa, Entamoeba dispar
LQAQCKALGLWERWDEITKMYSDVN

SEQ ID NO: 2495097 - protein, 24 aa, Entamoeba dispar
LQAWKKRYLLKQSFPEIFTCFDMK

SEQ ID NO: 2495098 - protein, 18 aa, Entamoeba dispar
LQCLHTQTGVEFLVIASP

SEQ ID NO: 2495099 - protein, 28 aa, Entamoeba dispar
LQCQSELPTIINLCYILSVIGKEEKAPL

SEQ ID NO: 2495100 - protein, 25 aa, Entamoeba dispar
LQCRSSCAYETVFARNFVGINDFSA

SEQ ID NO: 2495101 - protein, 19 aa, Entamoeba dispar
LQCSHSKKYLGRKHNKTKP

SEQ ID NO: 2495102 - protein, 24 aa, Entamoeba dispar
LQCVCKNCNRILLTNEERDFYLRR

SEQ ID NO: 2495103 - protein, 25 aa, Entamoeba dispar
LQDALKLNAILILPPVYSINDIDLT

SEQ ID NO: 2495104 - protein, 20 aa, Entamoeba dispar
LQDAVPIRFSQELRAYNCII

SEQ ID NO: 2495105 - protein, 21 aa, Entamoeba dispar
LQDQFLLDGFDFLRGYNDIVD

SEQ ID NO: 2495106 - protein, 28 aa, Entamoeba dispar
LQDTLRLLTILFKFGKYYEVEHAISSGI

SEQ ID NO: 2495107 - protein, 17 aa, Entamoeba dispar
LQEIERYASETVIKLLI

SEQ ID NO: 2495108 - protein, 22 aa, Entamoeba dispar
LQEKLKALSLSVSKIKLSDDQK

SEQ ID NO: 2495109 - protein, 18 aa, Entamoeba dispar
LQELLRVGCRTDNELIAL

SEQ ID NO: 2495110 - protein, 24 aa, Entamoeba dispar
LQELRCDELLLPKKLRIKKLVIDC

SEQ ID NO: 2495111 - protein, 21 aa, Entamoeba dispar
LQEQFSLVVYLSYFMNYAKKV

SEQ ID NO: 2495112 - protein, 21 aa, Entamoeba dispar
LQEQWLYYPWDCVTRKVKKIV

SEQ ID NO: 2495113 - protein, 22 aa, Entamoeba dispar
LQESIKPFFLRRMKNEVEKSIP

SEQ ID NO: 2495114 - protein, 26 aa, Entamoeba dispar
LQETKGKEGLVLKKRALLDVIEMLEG

SEQ ID NO: 2495115 - protein, 17 aa, Entamoeba dispar
LQETRIALVKEVLSKHP

SEQ ID NO: 2495116 - protein, 25 aa, Entamoeba dispar
LQEWYRMLWDYDYFEYIRDVMKLNK

SEQ ID NO: 2495117 - protein, 18 aa, Entamoeba dispar
LQEYKFDELMGFIKLSNC

SEQ ID NO: 2495118 - protein, 24 aa, Entamoeba dispar
LQFELLNQFDFVFVDSLPFSEITL

SEQ ID NO: 2495119 - protein, 19 aa, Entamoeba dispar
LQFGYSLTVSNVITSPKAV

SEQ ID NO: 2495120 - protein, 17 aa, Entamoeba dispar
LQFKYQPVSGLFQQYID

SEQ ID NO: 2495121 - protein, 17 aa, Entamoeba dispar
LQFLVELEKSCKFNDVL

SEQ ID NO: 2495122 - protein, 20 aa, Entamoeba dispar
LQFVRKIGGIAIAMGNAFDR

SEQ ID NO: 2495123 - protein, 21 aa, Entamoeba dispar
LQGEVERIALMPARSKNGEDG

SEQ ID NO: 2495124 - protein, 29 aa, Entamoeba dispar
LQGFSSSFNFCYQIKTNDSIRCVLNDTER

SEQ ID NO: 2495125 - protein, 26 aa, Entamoeba dispar
LQGNSALRPKAWQILLGYLPPNQFEW

SEQ ID NO: 2495126 - protein, 25 aa, Entamoeba dispar
LQGPFLIVVPLSMIEHWHREILEWT

SEQ ID NO: 2495127 - protein, 29 aa, Entamoeba dispar
LQGTEAILYCIFYNTRLAITILNSLGVLS

SEQ ID NO: 2495128 - protein, 17 aa, Entamoeba dispar
LQGTYMFNKHRIDIETW

SEQ ID NO: 2495129 - protein, 18 aa, Entamoeba dispar
LQGVLLFTCSKCLSQFHS

SEQ ID NO: 2495130 - protein, 17 aa, Entamoeba dispar
LQHKIIKKGYCYNPERK

SEQ ID NO: 2495131 - protein, 23 aa, Entamoeba dispar
LQHLTDLLISFGYCTVDNFMTMF

SEQ ID NO: 2495132 - protein, 22 aa, Entamoeba dispar
LQHPGVFPFFIKTECSNQVNFI

SEQ ID NO: 2495133 - protein, 18 aa, Entamoeba dispar
LQICELTTALFCEKYIDT

SEQ ID NO: 2495134 - protein, 18 aa, Entamoeba dispar
LQICKELRGQEEILDNIY

SEQ ID NO: 2495135 - protein, 22 aa, Entamoeba dispar
LQIDVLVRFKIRGMNFNHNPPI

SEQ ID NO: 2495136 - protein, 20 aa, Entamoeba dispar
LQIECLKAGIDIRNKHVTIS

SEQ ID NO: 2495137 - protein, 18 aa, Entamoeba dispar
LQIEEDFSQMGFFERMNA

SEQ ID NO: 2495138 - protein, 20 aa, Entamoeba dispar
LQIIRPTPIVILKKFEDTAV

SEQ ID NO: 2495139 - protein, 25 aa, Entamoeba dispar
LQIIRSASITTCFELERLRKLMENP

SEQ ID NO: 2495140 - protein, 17 aa, Entamoeba dispar
LQIKALIAINNEFEEYE

SEQ ID NO: 2495141 - protein, 19 aa, Entamoeba dispar
LQIKEEYLNLVNLLNGLVI

SEQ ID NO: 2495142 - protein, 23 aa, Entamoeba dispar
LQIKKEWLSQLCFALTGEQKTEF

SEQ ID NO: 2495143 - protein, 19 aa, Entamoeba dispar
LQILELFSVMLKGRLDLSQ

SEQ ID NO: 2495144 - protein, 17 aa, Entamoeba dispar
LQILKIMINHNSCKHFS

SEQ ID NO: 2495145 - protein, 19 aa, Entamoeba dispar
LQINQVDCIQCINFENEQP

SEQ ID NO: 2495146 - protein, 17 aa, Entamoeba dispar
LQIQFLLQIIEKIPKPI

SEQ ID NO: 2495147 - protein, 21 aa, Entamoeba dispar
LQIVPCGSFIFSIQSKNPSTC

SEQ ID NO: 2495148 - protein, 19 aa, Entamoeba dispar
LQIYYKNVFIFNYETIIKK

SEQ ID NO: 2495149 - protein, 17 aa, Entamoeba dispar
LQKCREQIKGWLQTEIK

SEQ ID NO: 2495150 - protein, 21 aa, Entamoeba dispar
LQKEPKFILVTSLRNIIDSLN

SEQ ID NO: 2495151 - protein, 19 aa, Entamoeba dispar
LQKFKRKYVEKEKKEQQDL

SEQ ID NO: 2495152 - protein, 17 aa, Entamoeba dispar
LQKIFLKECAAPELIKI

SEQ ID NO: 2495153 - protein, 22 aa, Entamoeba dispar
LQKKIGELLFDLKREEEQRKIL

SEQ ID NO: 2495154 - protein, 20 aa, Entamoeba dispar
LQKLFLKLIKNLIERDDIKM

SEQ ID NO: 2495155 - protein, 19 aa, Entamoeba dispar
LQKRVDVAKSIFVDHDYTI

SEQ ID NO: 2495156 - protein, 23 aa, Entamoeba dispar
LQKRVDVAKSIFVDNDYKIPINS

SEQ ID NO: 2495157 - protein, 25 aa, Entamoeba dispar
LQKSLSRSGVNWDAVKNNLEKRIEE

SEQ ID NO: 2495158 - protein, 18 aa, Entamoeba dispar
LQLDIIWTYCNISSETVD

SEQ ID NO: 2495159 - protein, 28 aa, Entamoeba dispar
LQLEFTSELPVAVKSYGEIVIAYNQKEM

SEQ ID NO: 2495160 - protein, 25 aa, Entamoeba dispar
LQLEPHLPFFFKYPILFEPHSFVLE

SEQ ID NO: 2495161 - protein, 17 aa, Entamoeba dispar
LQLFCSNDFLIQTLTRI

SEQ ID NO: 2495162 - protein, 19 aa, Entamoeba dispar
LQLFYIQGIINLPKTLQIF

SEQ ID NO: 2495163 - protein, 27 aa, Entamoeba dispar
LQLGEDIIDLPLQIRGIGSIDNKPNNA

SEQ ID NO: 2495164 - protein, 25 aa, Entamoeba dispar
LQLHELKIPVGEGIVTDMNAIRPME

SEQ ID NO: 2495165 - protein, 20 aa, Entamoeba dispar
LQLKIEFPNVLDAMVYLISN

SEQ ID NO: 2495166 - protein, 19 aa, Entamoeba dispar
LQLKKRKKKKLKKKRRKKQ

SEQ ID NO: 2495167 - protein, 18 aa, Entamoeba dispar
LQLLDKLMIYDARPNVLS

SEQ ID NO: 2495168 - protein, 22 aa, Entamoeba dispar
LQLLELLLDFFAQSHVLYSKLE

SEQ ID NO: 2495169 - protein, 19 aa, Entamoeba dispar
LQLLKAEDIHIQSLLTEVR

SEQ ID NO: 2495170 - protein, 18 aa, Entamoeba dispar
LQLMKWQLFRNLDLPAIQ

SEQ ID NO: 2495171 - protein, 18 aa, Entamoeba dispar
LQLNRFIYDRVKLDVVKL

SEQ ID NO: 2495172 - protein, 18 aa, Entamoeba dispar
LQLNVCNQSQYIINQIDN

SEQ ID NO: 2495173 - protein, 31 aa, Entamoeba dispar
LQLQQCFIASCALYFGMPYSLWRTGVIFKKQ

SEQ ID NO: 2495174 - protein, 19 aa, Entamoeba dispar
LQLQVDFECVLLALLSPHY

SEQ ID NO: 2495175 - protein, 19 aa, Entamoeba dispar
LQLRITCLESVYTNVYPTV

SEQ ID NO: 2495176 - protein, 26 aa, Entamoeba dispar
LQLYRFGQTVSVCFWSEHWKPSSYYP

SEQ ID NO: 2495177 - protein, 17 aa, Entamoeba dispar
LQMANYIEAEWWSKLIA

SEQ ID NO: 2495178 - protein, 17 aa, Entamoeba dispar
LQMASEFPENLKSIFGI

SEQ ID NO: 2495179 - protein, 24 aa, Entamoeba dispar
LQMKTKVIFIIDWLHKEDIEEVNE

SEQ ID NO: 2495180 - protein, 24 aa, Entamoeba dispar
LQMQEFYRQCCIILDETSKIKEKY

SEQ ID NO: 2495181 - protein, 18 aa, Entamoeba dispar
LQNCHSKDGIFFFDEESE

SEQ ID NO: 2495182 - protein, 17 aa, Entamoeba dispar
LQNEFLIHKFGMEIIPS

SEQ ID NO: 2495183 - protein, 20 aa, Entamoeba dispar
LQNFNLILQRGFNSLASKYT

SEQ ID NO: 2495184 - protein, 25 aa, Entamoeba dispar
LQNKRIGFLNSFFFTKLSKNWSLSG

SEQ ID NO: 2495185 - protein, 23 aa, Entamoeba dispar
LQNLPAPHCCRFLTDSYYICSCT

SEQ ID NO: 2495186 - protein, 22 aa, Entamoeba dispar
LQNMLNKKAKEFAVQRNELKKE

SEQ ID NO: 2495187 - protein, 23 aa, Entamoeba dispar
LQNSYAWCFCNICRSVSKQYNID

SEQ ID NO: 2495188 - protein, 24 aa, Entamoeba dispar
LQNVLKELPLVHFSVLKSLIGFLV

SEQ ID NO: 2495189 - protein, 22 aa, Entamoeba dispar
LQPDLVAAVFKKFLRDLPIHVI

SEQ ID NO: 2495190 - protein, 24 aa, Entamoeba dispar
LQPETIAPFILRGGLCGTFRQLLR

SEQ ID NO: 2495191 - protein, 19 aa, Entamoeba dispar
LQPGKFRYQGYGFASPTGT

SEQ ID NO: 2495192 - protein, 25 aa, Entamoeba dispar
LQPKFVCPGREFIMETNVILTWEEK

SEQ ID NO: 2495193 - protein, 26 aa, Entamoeba dispar
LQPLQCVSGFLVLRVICPAIMQPHKT

SEQ ID NO: 2495194 - protein, 23 aa, Entamoeba dispar
LQPQEIIDLIWLIENMSLNNINY

SEQ ID NO: 2495195 - protein, 19 aa, Entamoeba dispar
LQPQVPVAPQLRVQFPNNI

SEQ ID NO: 2495196 - protein, 24 aa, Entamoeba dispar
LQPSIELIQFIYLLKTQTHFYHQI

SEQ ID NO: 2495197 - protein, 23 aa, Entamoeba dispar
LQQFLDFYLKVALTVYPTDKILK

SEQ ID NO: 2495198 - protein, 25 aa, Entamoeba dispar
LQQKYAIKVAYDYAEERMKERKINI

SEQ ID NO: 2495199 - protein, 18 aa, Entamoeba dispar
LQQLICNEEIFGLCDGIE

SEQ ID NO: 2495200 - protein, 18 aa, Entamoeba dispar
LQQLKFYGKEVIVSECTP

SEQ ID NO: 2495201 - protein, 23 aa, Entamoeba dispar
LQQMLSKMLGFFVIEHQVQQTTE

SEQ ID NO: 2495202 - protein, 25 aa, Entamoeba dispar
LQRFKEYRIMPTIGNIPVIEKSVAI

SEQ ID NO: 2495203 - protein, 18 aa, Entamoeba dispar
LQRGFCLFMDNCKSNHVE

SEQ ID NO: 2495204 - protein, 17 aa, Entamoeba dispar
LQRLALLEDMFQKERAL

SEQ ID NO: 2495205 - protein, 19 aa, Entamoeba dispar
LQRLMELIFNKSLMSCDEL

SEQ ID NO: 2495206 - protein, 21 aa, Entamoeba dispar
LQRNKINGMKGFQMNYFVSCI

SEQ ID NO: 2495207 - protein, 23 aa, Entamoeba dispar
LQRRIKKNIIYFTQNLLIDFCSE

SEQ ID NO: 2495208 - protein, 19 aa, Entamoeba dispar
LQRRVDALISKAVEQDKII

SEQ ID NO: 2495209 - protein, 18 aa, Entamoeba dispar
LQRSCFKSCISLKTIILS

SEQ ID NO: 2495210 - protein, 25 aa, Entamoeba dispar
LQRSTSIPIRKGVLTWVHVLEEDTS

SEQ ID NO: 2495211 - protein, 24 aa, Entamoeba dispar
LQRSWACYMGEKFSKQTSNGYNSK

SEQ ID NO: 2495212 - protein, 17 aa, Entamoeba dispar
LQRVALVLCLGKPADVY

SEQ ID NO: 2495213 - protein, 18 aa, Entamoeba dispar
LQRVALVLCLGKPADVYL

SEQ ID NO: 2495214 - protein, 18 aa, Entamoeba dispar
LQSAVFEGCCSLKEINIP

SEQ ID NO: 2495215 - protein, 23 aa, Entamoeba dispar
LQSDIKQIIPFIVNALTLPYPDL

SEQ ID NO: 2495216 - protein, 20 aa, Entamoeba dispar
LQSERICFIATISSSISNAV

SEQ ID NO: 2495217 - protein, 18 aa, Entamoeba dispar
LQSFLNMVKFYELSKRIN

SEQ ID NO: 2495218 - protein, 18 aa, Entamoeba dispar
LQSIYRLLSTRMGYETFV

SEQ ID NO: 2495219 - protein, 28 aa, Entamoeba dispar
LQSLDAFTGRLYTKFINVISFLLAIRNT

SEQ ID NO: 2495220 - protein, 19 aa, Entamoeba dispar
LQSLEGLKIVGKLPGAAAW

SEQ ID NO: 2495221 - protein, 17 aa, Entamoeba dispar
LQSLKIVLFSNSQNYTF

SEQ ID NO: 2495222 - protein, 23 aa, Entamoeba dispar
LQSLPINIVIAVMKLCASFMAVG

SEQ ID NO: 2495223 - protein, 17 aa, Entamoeba dispar
LQSSVAVDGILKLVPEN

SEQ ID NO: 2495224 - protein, 24 aa, Entamoeba dispar
LQSVNLWICPPVENFDKIINQGCE

SEQ ID NO: 2495225 - protein, 25 aa, Entamoeba dispar
LQSVPFVRLQAMFDMLVQQRNNSAS

SEQ ID NO: 2495226 - protein, 25 aa, Entamoeba dispar
LQSVREVLQFNWKRGVDDGAVASCI

SEQ ID NO: 2495227 - protein, 26 aa, Entamoeba dispar
LQSVSVFRLKVSWEILQQSTKNIFKN

SEQ ID NO: 2495228 - protein, 19 aa, Entamoeba dispar
LQTIFGDSFLVNFNSPKKI

SEQ ID NO: 2495229 - protein, 17 aa, Entamoeba dispar
LQTIICSFVERPFIFTS

SEQ ID NO: 2495230 - protein, 19 aa, Entamoeba dispar
LQTIVLDECACEKIKKILR

SEQ ID NO: 2495231 - protein, 31 aa, Entamoeba dispar
LQTKFLKERFPKLGDSLISFGPCQTPTLGFC

SEQ ID NO: 2495232 - protein, 24 aa, Entamoeba dispar
LQTLKRFTTTDVIQRIIKTEFYYS

SEQ ID NO: 2495233 - protein, 25 aa, Entamoeba dispar
LQTSKVIFLPEIHSIPKPTTEEEMK

SEQ ID NO: 2495234 - protein, 21 aa, Entamoeba dispar
LQTVCDFFSRLILRHPTSSVI

SEQ ID NO: 2495235 - protein, 18 aa, Entamoeba dispar
LQTVYSLIQLKSLYFEGS

SEQ ID NO: 2495236 - protein, 19 aa, Entamoeba dispar
LQVAEPWIQKGIHPTIIIS

SEQ ID NO: 2495237 - protein, 27 aa, Entamoeba dispar
LQVDLKCSGLGRFKIVHKGLLNNKEEV

SEQ ID NO: 2495238 - protein, 28 aa, Entamoeba dispar
LQVILKMERLHMLASGWKEESNKVPIKE

SEQ ID NO: 2495239 - protein, 18 aa, Entamoeba dispar
LQVILPKITPIVPVQSYP

SEQ ID NO: 2495240 - protein, 19 aa, Entamoeba dispar
LQVKGCNLAIHTFNEITIE

SEQ ID NO: 2495241 - protein, 18 aa, Entamoeba dispar
LQVKLNYLLQNKKGERTV

SEQ ID NO: 2495242 - protein, 25 aa, Entamoeba dispar
LQYDLPRMIGIGLFTDVSTSQAMRN

SEQ ID NO: 2495243 - protein, 24 aa, Entamoeba dispar
LQYIEVVGLFGIIEVSHKQLLERV

SEQ ID NO: 2495244 - protein, 25 aa, Entamoeba dispar
LQYKFDLKGSMYGRKANEKERSKKS

SEQ ID NO: 2495245 - protein, 19 aa, Entamoeba dispar
LQYKFLIPIIPKLQANHFI

SEQ ID NO: 2495246 - protein, 17 aa, Entamoeba dispar
LQYLCSFFSKINYDINT

SEQ ID NO: 2495247 - protein, 24 aa, Entamoeba dispar
LQYLRLNPPFKFLNPAYEGIFLSI

SEQ ID NO: 2495248 - protein, 17 aa, Entamoeba dispar
LQYSPKDTGNCMSFAQP

SEQ ID NO: 2495249 - protein, 18 aa, Entamoeba dispar
LRAAVLHEINEIMPEGIK

SEQ ID NO: 2495250 - protein, 18 aa, Entamoeba dispar
LRAFGVIFETEITQKKPG

SEQ ID NO: 2495251 - protein, 22 aa, Entamoeba dispar
LRAKIWKLLLRYYTAEQKTWNN

SEQ ID NO: 2495252 - protein, 19 aa, Entamoeba dispar
LRANARLEALEPLLNQLTP

SEQ ID NO: 2495253 - protein, 18 aa, Entamoeba dispar
LRAQCSIVSHVLHSFIPL

SEQ ID NO: 2495254 - protein, 21 aa, Entamoeba dispar
LRAQDILKLRMSFQDTPLGMI

SEQ ID NO: 2495255 - protein, 20 aa, Entamoeba dispar
LRAYLKYLKQMFLEENKIQK

SEQ ID NO: 2495256 - protein, 17 aa, Entamoeba dispar
LRCIPLLGIGKAYLKEC

SEQ ID NO: 2495257 - protein, 23 aa, Entamoeba dispar
LRCNGTCHYPCYIKGDVKDGCYC

SEQ ID NO: 2495258 - protein, 25 aa, Entamoeba dispar
LRCNKTCCYPCYISGDVKDGCYCIG

SEQ ID NO: 2495259 - protein, 24 aa, Entamoeba dispar
LRCNREFASMVIKSWKDKTFEDSI

SEQ ID NO: 2495260 - protein, 18 aa, Entamoeba dispar
LRCPINPKHKFCEGCITK

SEQ ID NO: 2495261 - protein, 18 aa, Entamoeba dispar
LRCTCNRFKKLIDESTDI

SEQ ID NO: 2495262 - protein, 19 aa, Entamoeba dispar
LRDCKLCRTSDPLQHHMLH

SEQ ID NO: 2495263 - protein, 17 aa, Entamoeba dispar
LRDGKKVPIELGQFFMA

SEQ ID NO: 2495264 - protein, 25 aa, Entamoeba dispar
LRDGSGYCQCVIFGKELCDPEKIKL

SEQ ID NO: 2495265 - protein, 25 aa, Entamoeba dispar
LRDGTKMLYNFALIVAHNAAATVSE

SEQ ID NO: 2495266 - protein, 17 aa, Entamoeba dispar
LRDLDLFFNKLDIAHKF

SEQ ID NO: 2495267 - protein, 20 aa, Entamoeba dispar
LRDLFRKHGANWKMVKYALE

SEQ ID NO: 2495268 - protein, 25 aa, Entamoeba dispar
LRDRYSEKYGRLHARLLQTYLQAIT

SEQ ID NO: 2495269 - protein, 24 aa, Entamoeba dispar
LRDTLKELILRYGNNITNESTTDY

SEQ ID NO: 2495270 - protein, 20 aa, Entamoeba dispar
LRDTVICPKMPESLSILVKP

SEQ ID NO: 2495271 - protein, 17 aa, Entamoeba dispar
LRDVIVFSSKGNRPDPN

SEQ ID NO: 2495272 - protein, 27 aa, Entamoeba dispar
LRECHRKAVGATLPYLGMFLTDLLFTE

SEQ ID NO: 2495273 - protein, 17 aa, Entamoeba dispar
LREIFFITFPKSDYIAQ

SEQ ID NO: 2495274 - protein, 19 aa, Entamoeba dispar
LREIIQFTFDNCHLSQGKM

SEQ ID NO: 2495275 - protein, 20 aa, Entamoeba dispar
LREILRLLFHKHRTIQTNEL

SEQ ID NO: 2495276 - protein, 19 aa, Entamoeba dispar
LREINILFIEEVVNPSKKN

SEQ ID NO: 2495277 - protein, 18 aa, Entamoeba dispar
LREKLKLVYDERPKDLTM

SEQ ID NO: 2495278 - protein, 17 aa, Entamoeba dispar
LRELALWNGTFREDRVY

SEQ ID NO: 2495279 - protein, 20 aa, Entamoeba dispar
LRELIGKEVICIVRGNNYQE

SEQ ID NO: 2495280 - protein, 25 aa, Entamoeba dispar
LRELPDPLIPFQYYNEFVIIGRLKE

SEQ ID NO: 2495281 - protein, 21 aa, Entamoeba dispar
LRELRSLWISLLVGDSIVVLG

SEQ ID NO: 2495282 - protein, 18 aa, Entamoeba dispar
LREMSLMFSENVVEFITQ

SEQ ID NO: 2495283 - protein, 22 aa, Entamoeba dispar
LREPENMFSLQLVANNVFGEIK

SEQ ID NO: 2495284 - protein, 19 aa, Entamoeba dispar
LREPYSIVRFFLERLPLDK

SEQ ID NO: 2495285 - protein, 22 aa, Entamoeba dispar
LREQFNVEFDRAFIETFQNHVQ

SEQ ID NO: 2495286 - protein, 26 aa, Entamoeba dispar
LRERALKLLCRFLDLGPWACDQALAV

SEQ ID NO: 2495287 - protein, 25 aa, Entamoeba dispar
LRETILASLIKFAKVEQDEGLKKVF

SEQ ID NO: 2495288 - protein, 19 aa, Entamoeba dispar
LRETIPQIIGFSSTMIPIT

SEQ ID NO: 2495289 - protein, 31 aa, Entamoeba dispar
LRFEQMTKCFLKFVDVFKLYSSFVNNYDNAR

SEQ ID NO: 2495290 - protein, 20 aa, Entamoeba dispar
LRFHARFLLVCLLTDKLKMG

SEQ ID NO: 2495291 - protein, 18 aa, Entamoeba dispar
LRFIKVVQSLAPRHKGKA

SEQ ID NO: 2495292 - protein, 19 aa, Entamoeba dispar
LRFIPTLWTEDCDLLTQHF

SEQ ID NO: 2495293 - protein, 25 aa, Entamoeba dispar
LRFSEELGMRGNIFFNSVKYGDVHL

SEQ ID NO: 2495294 - protein, 21 aa, Entamoeba dispar
LRFSKSFNIIGDCFKEPNRFN

SEQ ID NO: 2495295 - protein, 18 aa, Entamoeba dispar
LRFTLQMLTPTSIVAKTN

SEQ ID NO: 2495296 - protein, 17 aa, Entamoeba dispar
LRGAQLQYRERIRGKMF

SEQ ID NO: 2495297 - protein, 17 aa, Entamoeba dispar
LRGEAFSELGEYDIIAK

SEQ ID NO: 2495298 - protein, 21 aa, Entamoeba dispar
LRGGLCGTFRQLLRSSNGILR

SEQ ID NO: 2495299 - protein, 20 aa, Entamoeba dispar
LRGGRKLKGKLRAFDQHLNI

SEQ ID NO: 2495300 - protein, 19 aa, Entamoeba dispar
LRGIVPKKIIIEPITNKEL

SEQ ID NO: 2495301 - protein, 22 aa, Entamoeba dispar
LRGLHGVLFCFDITKKETFNCI

SEQ ID NO: 2495302 - protein, 21 aa, Entamoeba dispar
LRGNHECRLLTTYFNFRQECS

SEQ ID NO: 2495303 - protein, 17 aa, Entamoeba dispar
LRGNVYYVDCNNEDISI

SEQ ID NO: 2495304 - protein, 25 aa, Entamoeba dispar
LRGSEPLQLIIGGIFKKGNVDRLEW

SEQ ID NO: 2495305 - protein, 20 aa, Entamoeba dispar
LRGSPYGNEYVCGRAHILFG

SEQ ID NO: 2495306 - protein, 17 aa, Entamoeba dispar
LRGTITHLIKAYPSSLT

SEQ ID NO: 2495307 - protein, 17 aa, Entamoeba dispar
LRGTKIYLNEDLTSSSE

SEQ ID NO: 2495308 - protein, 20 aa, Entamoeba dispar
LRGTYAYCAPEIYFSQPFTD

SEQ ID NO: 2495309 - protein, 21 aa, Entamoeba dispar
LRHFHCLCGIVDIVLTQPIDE

SEQ ID NO: 2495310 - protein, 29 aa, Entamoeba dispar
LRHLKTTIIVNLHIWKALNPSFKTQIATI

SEQ ID NO: 2495311 - protein, 18 aa, Entamoeba dispar
LRHPFLVNLYYSFQTPTH

SEQ ID NO: 2495312 - protein, 18 aa, Entamoeba dispar
LRICCLEKTEDWNEREPW

SEQ ID NO: 2495313 - protein, 23 aa, Entamoeba dispar
LRIEEQFKLLKSYVDKFNDKKWL

SEQ ID NO: 2495314 - protein, 18 aa, Entamoeba dispar
LRIEKLEILLSLAEETNV

SEQ ID NO: 2495315 - protein, 17 aa, Entamoeba dispar
LRIFYREFNVIPINWNS

SEQ ID NO: 2495316 - protein, 23 aa, Entamoeba dispar
LRIGKLPRGPTCLFKVEEYTLRK

SEQ ID NO: 2495317 - protein, 19 aa, Entamoeba dispar
LRIIIKPHFIFQNLTNEVF

SEQ ID NO: 2495318 - protein, 23 aa, Entamoeba dispar
LRIKFVLDCAKGIQYLHTNGIMH

SEQ ID NO: 2495319 - protein, 24 aa, Entamoeba dispar
LRIKGHIFPMALSPFTKRIEYKME

SEQ ID NO: 2495320 - protein, 21 aa, Entamoeba dispar
LRIKPAIISMIKFPERLIRGS

SEQ ID NO: 2495321 - protein, 18 aa, Entamoeba dispar
LRIKQLRCKNQLNEFKRR

SEQ ID NO: 2495322 - protein, 18 aa, Entamoeba dispar
LRIKYPINQDFDMFQLNN

SEQ ID NO: 2495323 - protein, 18 aa, Entamoeba dispar
LRILANFTKDHHLIEFFK

SEQ ID NO: 2495324 - protein, 17 aa, Entamoeba dispar
LRILKRGVEYMIENEYA

SEQ ID NO: 2495325 - protein, 17 aa, Entamoeba dispar
LRILNQIICNLTIKENK

SEQ ID NO: 2495326 - protein, 17 aa, Entamoeba dispar
LRINKIIKENTLICSPV

SEQ ID NO: 2495327 - protein, 20 aa, Entamoeba dispar
LRIQEMLHHQNVIKLKDSFL

SEQ ID NO: 2495328 - protein, 19 aa, Entamoeba dispar
LRITVITLIGNIAGDRAET

SEQ ID NO: 2495329 - protein, 20 aa, Entamoeba dispar
LRKASAKYPEWKKANHPEEK

SEQ ID NO: 2495330 - protein, 29 aa, Entamoeba dispar
LRKDIKMFKFVYAKVGITYPIWKDIFNVA

SEQ ID NO: 2495331 - protein, 20 aa, Entamoeba dispar
LRKEHSLLFILLIINYWLNL

SEQ ID NO: 2495332 - protein, 20 aa, Entamoeba dispar
LRKENKWGIICVDEKERIFG

SEQ ID NO: 2495333 - protein, 23 aa, Entamoeba dispar
LRKHVRRIAAMPSLPLTDIQYLD

SEQ ID NO: 2495334 - protein, 20 aa, Entamoeba dispar
LRKIEEGELEEKVKMNAVLK

SEQ ID NO: 2495335 - protein, 28 aa, Entamoeba dispar
LRKIFKYNPRIGFDFAYSEISFASLLGE

SEQ ID NO: 2495336 - protein, 18 aa, Entamoeba dispar
LRKIMNIAIPPTIPFIGS

SEQ ID NO: 2495337 - protein, 18 aa, Entamoeba dispar
LRKLILILFLPIHTKSTK

SEQ ID NO: 2495338 - protein, 26 aa, Entamoeba dispar
LRKMAAEKIKMYWQNKCENNPCPPST

SEQ ID NO: 2495339 - protein, 33 aa, Entamoeba dispar
LRKMSQLPGNKRCMDCQAIGPVYVVTDFGTFVC

SEQ ID NO: 2495340 - protein, 27 aa, Entamoeba dispar
LRKNPDAWGKWNIMRGINLHKTQCTIM

SEQ ID NO: 2495341 - protein, 25 aa, Entamoeba dispar
LRKQPKRTSVVELIGSSKPVVQENT

SEQ ID NO: 2495342 - protein, 19 aa, Entamoeba dispar
LRKRIVIDGADVAYYNSHG

SEQ ID NO: 2495343 - protein, 25 aa, Entamoeba dispar
LRKTQPRFSGLVAQPQQSTLMTNLK

SEQ ID NO: 2495344 - protein, 26 aa, Entamoeba dispar
LRKTSFEMIKHPFLEIKISKSEMAEL

SEQ ID NO: 2495345 - protein, 20 aa, Entamoeba dispar
LRKVCNHPFLIPGVEEKEIA

SEQ ID NO: 2495346 - protein, 25 aa, Entamoeba dispar
LRKVRKTRVELMRTLYKLVGKLSVP

SEQ ID NO: 2495347 - protein, 17 aa, Entamoeba dispar
LRLAFAEDDVMNEIEEI

SEQ ID NO: 2495348 - protein, 19 aa, Entamoeba dispar
LRLARATGASIVYRTEDLK

SEQ ID NO: 2495349 - protein, 17 aa, Entamoeba dispar
LRLDQIFNNKIPVSSDR

SEQ ID NO: 2495350 - protein, 20 aa, Entamoeba dispar
LRLDYCSNLNISLISNKLKS

SEQ ID NO: 2495351 - protein, 20 aa, Entamoeba dispar
LRLESCCSEGAITATNEVSL

SEQ ID NO: 2495352 - protein, 18 aa, Entamoeba dispar
LRLFECINNVIRFKDTKY

SEQ ID NO: 2495353 - protein, 19 aa, Entamoeba dispar
LRLFSFKMIPDSFKSFMTY

SEQ ID NO: 2495354 - protein, 17 aa, Entamoeba dispar
LRLGETVTTIPTIGVNI

SEQ ID NO: 2495355 - protein, 21 aa, Entamoeba dispar
LRLHSEYGILTTMDKAVVGPE

SEQ ID NO: 2495356 - protein, 17 aa, Entamoeba dispar
LRLHTLLQWIKETLQLI

SEQ ID NO: 2495357 - protein, 17 aa, Entamoeba dispar
LRLIERPPLKYLFQTNA

SEQ ID NO: 2495358 - protein, 17 aa, Entamoeba dispar
LRLKLVDSYQTATSSVN

SEQ ID NO: 2495359 - protein, 21 aa, Entamoeba dispar
LRLKSNEIVEVYWEHKKGWAI

SEQ ID NO: 2495360 - protein, 27 aa, Entamoeba dispar
LRLLKEIEENFLYLSIERFINKESIQV

SEQ ID NO: 2495361 - protein, 19 aa, Entamoeba dispar
LRLLMLKGCQCDFPEFDNA

SEQ ID NO: 2495362 - protein, 21 aa, Entamoeba dispar
LRLNASNALSELMINTRNNSI

SEQ ID NO: 2495363 - protein, 20 aa, Entamoeba dispar
LRLNEKAVFLKQLINGARGK

SEQ ID NO: 2495364 - protein, 20 aa, Entamoeba dispar
LRLNYCSNLNISLISNKLKS

SEQ ID NO: 2495365 - protein, 21 aa, Entamoeba dispar
LRLPQMYNLCNYYIGFNAWST

SEQ ID NO: 2495366 - protein, 26 aa, Entamoeba dispar
LRLQECREKGILPWLRPDSKSQVTLE

SEQ ID NO: 2495367 - protein, 19 aa, Entamoeba dispar
LRLREFKYKTLTVTKATKI

SEQ ID NO: 2495368 - protein, 24 aa, Entamoeba dispar
LRLRELGEPIMLFGEEFESRRERL

SEQ ID NO: 2495369 - protein, 22 aa, Entamoeba dispar
LRLRNIDIGKGWESLIESYIKN

SEQ ID NO: 2495370 - protein, 25 aa, Entamoeba dispar
LRLTKEKKKEIGFAGMMSDMFGKVV

SEQ ID NO: 2495371 - protein, 17 aa, Entamoeba dispar
LRLTVNILKQLVESLDV

SEQ ID NO: 2495372 - protein, 20 aa, Entamoeba dispar
LRLWDLTKMESVRRFVGHES

SEQ ID NO: 2495373 - protein, 19 aa, Entamoeba dispar
LRLWWNVMRHMSLLWIMND

SEQ ID NO: 2495374 - protein, 20 aa, Entamoeba dispar
LRMLCGSLLNKALQSADVKT

SEQ ID NO: 2495375 - protein, 27 aa, Entamoeba dispar
LRMLFWRIAKREGIEFDGQFDWIQYKG

SEQ ID NO: 2495376 - protein, 22 aa, Entamoeba dispar
LRMMACSVDGFVAFFEFNENEI

SEQ ID NO: 2495377 - protein, 25 aa, Entamoeba dispar
LRMQRMVLDLIEFWLSQCPNGFCPN

SEQ ID NO: 2495378 - protein, 17 aa, Entamoeba dispar
LRNCYGEIKKVCCKGDN

SEQ ID NO: 2495379 - protein, 31 aa, Entamoeba dispar
LRNDVDLLKCSILKRPWVNPFNQTTTNNPFI

SEQ ID NO: 2495380 - protein, 17 aa, Entamoeba dispar
LRNENLMSSKSIKKFAI

SEQ ID NO: 2495381 - protein, 19 aa, Entamoeba dispar
LRNGDVLMFGYSTREYVLL

SEQ ID NO: 2495382 - protein, 18 aa, Entamoeba dispar
LRNGFGLFKLTSGKQTSD

SEQ ID NO: 2495383 - protein, 19 aa, Entamoeba dispar
LRNGVLNERVNLLYDSSDI

SEQ ID NO: 2495384 - protein, 19 aa, Entamoeba dispar
LRNIPSFFYNVTIEGKGKG

SEQ ID NO: 2495385 - protein, 17 aa, Entamoeba dispar
LRNISVWETSLKKSKGV

SEQ ID NO: 2495386 - protein, 31 aa, Entamoeba dispar
LRNKELEKVCGIKGSIFCHSSGFLACNETYE

SEQ ID NO: 2495387 - protein, 20 aa, Entamoeba dispar
LRNKQGLKTDCIFTSLDGGL

SEQ ID NO: 2495388 - protein, 36 aa, Entamoeba dispar
LRNLVFFKYPKWTGGLYCSPSIPGSRAGNNIAGAWA

SEQ ID NO: 2495389 - protein, 18 aa, Entamoeba dispar
LRNPHNIQPIKFIKKDCY

SEQ ID NO: 2495390 - protein, 26 aa, Entamoeba dispar
LRNPMKRSPIKFPFTGKKGTLRIEDS

SEQ ID NO: 2495391 - protein, 25 aa, Entamoeba dispar
LRNSELYYRSIEFLKQLPDIDKIIT

SEQ ID NO: 2495392 - protein, 20 aa, Entamoeba dispar
LRNVCTEAGMFAIRDDRDYC

SEQ ID NO: 2495393 - protein, 25 aa, Entamoeba dispar
LRNVLRRVLRMFLYIHPKGYFQGLN

SEQ ID NO: 2495394 - protein, 23 aa, Entamoeba dispar
LRPELPQSNLIDLNNLISIDTHF

SEQ ID NO: 2495395 - protein, 20 aa, Entamoeba dispar
LRPIQLTLMKWTKCNDYHLI

SEQ ID NO: 2495396 - protein, 20 aa, Entamoeba dispar
LRPLSYPGTDIFLLCFAVIY

SEQ ID NO: 2495397 - protein, 20 aa, Entamoeba dispar
LRPLSYPSTDVFLVCFSVIA

SEQ ID NO: 2495398 - protein, 21 aa, Entamoeba dispar
LRPLTKEMIEYARGDTHYLLY

SEQ ID NO: 2495399 - protein, 19 aa, Entamoeba dispar
LRPTIPPSTPQKMATLIRQ

SEQ ID NO: 2495400 - protein, 20 aa, Entamoeba dispar
LRPYGVGLLVIGYDTKPRLF

SEQ ID NO: 2495401 - protein, 20 aa, Entamoeba dispar
LRPYWKCYYEKCSAIIFVVD

SEQ ID NO: 2495402 - protein, 22 aa, Entamoeba dispar
LRQFVHSIIRGRVVELSKHMYG

SEQ ID NO: 2495403 - protein, 18 aa, Entamoeba dispar
LRQILSVLGRPLSNSEVE

SEQ ID NO: 2495404 - protein, 19 aa, Entamoeba dispar
LRQKVEAFNQTLPRSYRIK

SEQ ID NO: 2495405 - protein, 17 aa, Entamoeba dispar
LRQRAVCPLDLKQWEYA

SEQ ID NO: 2495406 - protein, 24 aa, Entamoeba dispar
LRQSRREACLAKRRTSVSEESEEE

SEQ ID NO: 2495407 - protein, 20 aa, Entamoeba dispar
LRQYALDGLSHWGSDAQGIS

SEQ ID NO: 2495408 - protein, 20 aa, Entamoeba dispar
LRQYPTYKKLYAMQEKIDQM

SEQ ID NO: 2495409 - protein, 33 aa, Entamoeba dispar
LRRFIFNLNVKMCKDFKAILTLLDGIFTFQNKN

SEQ ID NO: 2495410 - protein, 34 aa, Entamoeba dispar
LRRFIFNLNVKMCKDFKAILTLLDGIFTFQNKNL

SEQ ID NO: 2495411 - protein, 19 aa, Entamoeba dispar
LRRFKEIASDAMGRDVKKA

SEQ ID NO: 2495412 - protein, 21 aa, Entamoeba dispar
LRRHVGMIIRLSMIVFGFDTQ

SEQ ID NO: 2495413 - protein, 20 aa, Entamoeba dispar
LRRKQFKNFNLSYNININEN

SEQ ID NO: 2495414 - protein, 17 aa, Entamoeba dispar
LRRLVTMGINEQYFKKI

SEQ ID NO: 2495415 - protein, 18 aa, Entamoeba dispar
LRRSTICCHILCQACLSV

SEQ ID NO: 2495416 - protein, 19 aa, Entamoeba dispar
LRRTVCVLIASIDDICGPI

SEQ ID NO: 2495417 - protein, 17 aa, Entamoeba dispar
LRSAVLLGKSSLQLLCD

SEQ ID NO: 2495418 - protein, 20 aa, Entamoeba dispar
LRSFATPGLFTCHQSFVDGS

SEQ ID NO: 2495419 - protein, 28 aa, Entamoeba dispar
LRSFLIMPVQRLPRYVLLLKELQKNTPK

SEQ ID NO: 2495420 - protein, 19 aa, Entamoeba dispar
LRSGDTFKKVMNKLTLEIF

SEQ ID NO: 2495421 - protein, 17 aa, Entamoeba dispar
LRSIEIPTSISIIPDYC

SEQ ID NO: 2495422 - protein, 21 aa, Entamoeba dispar
LRSKERIGNLVLKTRNTEPHY

SEQ ID NO: 2495423 - protein, 19 aa, Entamoeba dispar
LRSKFSYFRQGMLEVAMLS

SEQ ID NO: 2495424 - protein, 22 aa, Entamoeba dispar
LRSKILLEVYNSMCGIQLKELK

SEQ ID NO: 2495425 - protein, 18 aa, Entamoeba dispar
LRSKRFNEEYKRRKINEE

SEQ ID NO: 2495426 - protein, 19 aa, Entamoeba dispar
LRSKRFNEEYKRRKINEEE

SEQ ID NO: 2495427 - protein, 18 aa, Entamoeba dispar
LRSKRRTQSWSPIQSPKE

SEQ ID NO: 2495428 - protein, 18 aa, Entamoeba dispar
LRSLFSLTSNYKRYREVY

SEQ ID NO: 2495429 - protein, 17 aa, Entamoeba dispar
LRSLKLLKKNKIFSNDS

SEQ ID NO: 2495430 - protein, 20 aa, Entamoeba dispar
LRSRCLDIRIELPTYDELDR

SEQ ID NO: 2495431 - protein, 18 aa, Entamoeba dispar
LRSSGYGFGVCTIDDDVD

SEQ ID NO: 2495432 - protein, 25 aa, Entamoeba dispar
LRSYKMIIREGFLFFYSSKETFVVA

SEQ ID NO: 2495433 - protein, 23 aa, Entamoeba dispar
LRSYNIFLRHRFGYSERLLEEMT

SEQ ID NO: 2495434 - protein, 22 aa, Entamoeba dispar
LRSYNIIFPHIEYCKILNSSMN

SEQ ID NO: 2495435 - protein, 18 aa, Entamoeba dispar
LRTAKLIIETYADVKDID

SEQ ID NO: 2495436 - protein, 17 aa, Entamoeba dispar
LRTEELIEPLLIDEESS

SEQ ID NO: 2495437 - protein, 38 aa, Entamoeba dispar
LRTENGSICLISFYCWEIFFRRIVIRSQTYWKNNFEGL

SEQ ID NO: 2495438 - protein, 20 aa, Entamoeba dispar
LRTGFSCSTSIFGQTMENII

SEQ ID NO: 2495439 - protein, 20 aa, Entamoeba dispar
LRTIAWKIWLGVLPLPVNSV

SEQ ID NO: 2495440 - protein, 21 aa, Entamoeba dispar
LRTIFLMNFDKGNTMDIASDP

SEQ ID NO: 2495441 - protein, 17 aa, Entamoeba dispar
LRTKEIVNVIVKSINSF

SEQ ID NO: 2495442 - protein, 31 aa, Entamoeba dispar
LRTLCLALQYITDVTPFFGFERALYEGINMS

SEQ ID NO: 2495443 - protein, 24 aa, Entamoeba dispar
LRTLKEVYLSPIIKLVNKEHVTTI

SEQ ID NO: 2495444 - protein, 17 aa, Entamoeba dispar
LRTLKFIHRMISDDKGC

SEQ ID NO: 2495445 - protein, 22 aa, Entamoeba dispar
LRTLLKEIWGLSLAYPDNTPLE

SEQ ID NO: 2495446 - protein, 23 aa, Entamoeba dispar
LRTLTDILIKTEIGSVIKNSDND

SEQ ID NO: 2495447 - protein, 17 aa, Entamoeba dispar
LRTLVKYHGSDEKIRVV

SEQ ID NO: 2495448 - protein, 19 aa, Entamoeba dispar
LRTQLLILNEKKFGLENSL

SEQ ID NO: 2495449 - protein, 18 aa, Entamoeba dispar
LRTRSQIIGKKEIRLLVV

SEQ ID NO: 2495450 - protein, 20 aa, Entamoeba dispar
LRTSKRLEMLASKRTLADSI

SEQ ID NO: 2495451 - protein, 30 aa, Entamoeba dispar
LRTTKNEIVESFSFLHWYISDGSSVLNEMI

SEQ ID NO: 2495452 - protein, 23 aa, Entamoeba dispar
LRTVIPCIIQKGINDSDFIFIND

SEQ ID NO: 2495453 - protein, 22 aa, Entamoeba dispar
LRVIARNAGVDWSTCTVKKEET

SEQ ID NO: 2495454 - protein, 20 aa, Entamoeba dispar
LRVIPDLERLLSQCTSLTIT

SEQ ID NO: 2495455 - protein, 25 aa, Entamoeba dispar
LRVKIKELFKDALVIPSDSNNIVNG

SEQ ID NO: 2495456 - protein, 19 aa, Entamoeba dispar
LRVLGPLIKKSDEFATKIS

SEQ ID NO: 2495457 - protein, 24 aa, Entamoeba dispar
LRVLYKLYSSFKMPHLPKVGVLYF

SEQ ID NO: 2495458 - protein, 25 aa, Entamoeba dispar
LRVNGEFLCCVCGTMNPTFITYKNF

SEQ ID NO: 2495459 - protein, 17 aa, Entamoeba dispar
LRVNPLFDYSVVRNSIY

SEQ ID NO: 2495460 - protein, 25 aa, Entamoeba dispar
LRVNYKGCLVIGYPDTETSELLDIG

SEQ ID NO: 2495461 - protein, 19 aa, Entamoeba dispar
LRVPINCRYYCDYCREYGH

SEQ ID NO: 2495462 - protein, 18 aa, Entamoeba dispar
LRVPNTILVAFKGVEGEA

SEQ ID NO: 2495463 - protein, 35 aa, Entamoeba dispar
LRVRKRGKISSQMMVFKRMVNFDGQDLDPRDVLDV

SEQ ID NO: 2495464 - protein, 24 aa, Entamoeba dispar
LRVYPELINLLPYTLRHETHRFVA

SEQ ID NO: 2495465 - protein, 26 aa, Entamoeba dispar
LRYDNRKLLPLFGIKQDTQFFSIKNR

SEQ ID NO: 2495466 - protein, 21 aa, Entamoeba dispar
LRYFIELPIPVPLFKEYLIFV

SEQ ID NO: 2495467 - protein, 19 aa, Entamoeba dispar
LRYFKTQLFQSEFTDEAYS

SEQ ID NO: 2495468 - protein, 26 aa, Entamoeba dispar
LRYKEQEQFVGIEWLSKQCLIDKLLS

SEQ ID NO: 2495469 - protein, 20 aa, Entamoeba dispar
LRYRKMIGAEDVLVFTDIKK

SEQ ID NO: 2495470 - protein, 20 aa, Entamoeba dispar
LRYVEGIFDPSCKSTLGVNF

SEQ ID NO: 2495471 - protein, 18 aa, Entamoeba dispar
LRYVSEVTALLKNIKVGL

SEQ ID NO: 2495472 - protein, 17 aa, Entamoeba dispar
LSAALEFYDRKIKLVEG

SEQ ID NO: 2495473 - protein, 18 aa, Entamoeba dispar
LSAESSRHLLDSGFSSHV

SEQ ID NO: 2495474 - protein, 19 aa, Entamoeba dispar
LSAFAALDWYHKYNIEKVN

SEQ ID NO: 2495475 - protein, 27 aa, Entamoeba dispar
LSAFKAKEYRLVYKLLHDLIQTNHVQV

SEQ ID NO: 2495476 - protein, 28 aa, Entamoeba dispar
LSAFRPEDISAMLLRRFKEIASDAMGRD

SEQ ID NO: 2495477 - protein, 17 aa, Entamoeba dispar
LSAFRSPLSMFIPSNPK

SEQ ID NO: 2495478 - protein, 24 aa, Entamoeba dispar
LSALELIEPLSWPHPIVTLLPRCY

SEQ ID NO: 2495479 - protein, 17 aa, Entamoeba dispar
LSALNFLQQPGIRVIHC

SEQ ID NO: 2495480 - protein, 28 aa, Entamoeba dispar
LSAQKDSSSFCSFEFMKQKDFIIREEKD

SEQ ID NO: 2495481 - protein, 20 aa, Entamoeba dispar
LSAQKEFAFMKALYTKGFPT

SEQ ID NO: 2495482 - protein, 17 aa, Entamoeba dispar
LSCKSALLSVVNVLLAE

SEQ ID NO: 2495483 - protein, 17 aa, Entamoeba dispar
LSCNMCYAYNGHASPVT

SEQ ID NO: 2495484 - protein, 24 aa, Entamoeba dispar
LSCPNCSLKFNLPQNVSYSQQTKC

SEQ ID NO: 2495485 - protein, 18 aa, Entamoeba dispar
LSDCSYFDKTLLEMIQKK

SEQ ID NO: 2495486 - protein, 19 aa, Entamoeba dispar
LSDDCNFILLISSSELLMY

SEQ ID NO: 2495487 - protein, 23 aa, Entamoeba dispar
LSDEKRTVLSLYLRQAPEERARI

SEQ ID NO: 2495488 - protein, 29 aa, Entamoeba dispar
LSDFKEKDCGEGIGFELGYGMDSEDEIEP

SEQ ID NO: 2495489 - protein, 23 aa, Entamoeba dispar
LSDFKKWVLFIASYVKELYFKKN

SEQ ID NO: 2495490 - protein, 18 aa, Entamoeba dispar
LSDGCPICQNKCQCASCK

SEQ ID NO: 2495491 - protein, 22 aa, Entamoeba dispar
LSDICLRSSSAPTYFQPYQNFV

SEQ ID NO: 2495492 - protein, 28 aa, Entamoeba dispar
LSDIPYPPSFLLFLKTSMKIISLMIDDN

SEQ ID NO: 2495493 - protein, 24 aa, Entamoeba dispar
LSDIQRYILINAFQFDSGENDPNR

SEQ ID NO: 2495494 - protein, 24 aa, Entamoeba dispar
LSDKFKFIVCSFNEYDRQMANELI

SEQ ID NO: 2495495 - protein, 21 aa, Entamoeba dispar
LSDKLKWYVENQLTKAKEIRK

SEQ ID NO: 2495496 - protein, 19 aa, Entamoeba dispar
LSDNGFFIFSLNNPHHTMP

SEQ ID NO: 2495497 - protein, 17 aa, Entamoeba dispar
LSDNGKLLFPQNPVNSV

SEQ ID NO: 2495498 - protein, 28 aa, Entamoeba dispar
LSDNIKKMIRLICKIFPISDFWEHVSIV

SEQ ID NO: 2495499 - protein, 18 aa, Entamoeba dispar
LSDSILLDGPMIIEMVRL

SEQ ID NO: 2495500 - protein, 25 aa, Entamoeba dispar
LSDYKDWCLYWLGLNNFEPPLTGET

SEQ ID NO: 2495501 - protein, 18 aa, Entamoeba dispar
LSDYPSMMTIYSAVSNLT

SEQ ID NO: 2495502 - protein, 19 aa, Entamoeba dispar
LSEALARLYLDKQVRDDYV

SEQ ID NO: 2495503 - protein, 19 aa, Entamoeba dispar
LSEEFPLKVEYPTCVVEYK

SEQ ID NO: 2495504 - protein, 17 aa, Entamoeba dispar
LSEFFEVVDNFHITEHI

SEQ ID NO: 2495505 - protein, 26 aa, Entamoeba dispar
LSEFKQLRCVRLFLQKQGKVSDFFKN

SEQ ID NO: 2495506 - protein, 19 aa, Entamoeba dispar
LSEFNLKKAKRFHIIQEMY

SEQ ID NO: 2495507 - protein, 21 aa, Entamoeba dispar
LSEFPIEAELKPFVMTDADGT

SEQ ID NO: 2495508 - protein, 17 aa, Entamoeba dispar
LSEFVGETLMVLPNASE

SEQ ID NO: 2495509 - protein, 24 aa, Entamoeba dispar
LSEGDLRYGIGLLQKLSQGINHSV

SEQ ID NO: 2495510 - protein, 24 aa, Entamoeba dispar
LSEGKTRSSFELQHKGYYQIHLKT

SEQ ID NO: 2495511 - protein, 17 aa, Entamoeba dispar
LSEGVGLILEILPQNNR

SEQ ID NO: 2495512 - protein, 18 aa, Entamoeba dispar
LSEHWFIIPDILKSDIRR

SEQ ID NO: 2495513 - protein, 17 aa, Entamoeba dispar
LSEIKFFAPQTEQQNDK

SEQ ID NO: 2495514 - protein, 24 aa, Entamoeba dispar
LSEIKRTYEQISFYRDKVNNNKDY

SEQ ID NO: 2495515 - protein, 24 aa, Entamoeba dispar
LSEIKRTYEQISFYRDKVNNNQDF

SEQ ID NO: 2495516 - protein, 24 aa, Entamoeba dispar
LSEKCKMIGVYTCGDISLTSKEVL

SEQ ID NO: 2495517 - protein, 26 aa, Entamoeba dispar
LSELKGNPLENFDVFQPTERTQNEMI

SEQ ID NO: 2495518 - protein, 17 aa, Entamoeba dispar
LSELLFDVCHLNCIPNI

SEQ ID NO: 2495519 - protein, 21 aa, Entamoeba dispar
LSEMRSGLTGLKFYNPETKSW

SEQ ID NO: 2495520 - protein, 17 aa, Entamoeba dispar
LSEMVSVINGIRSQEYP

SEQ ID NO: 2495521 - protein, 23 aa, Entamoeba dispar
LSEPYSIYTYRYFLKSWPHLCFF

SEQ ID NO: 2495522 - protein, 24 aa, Entamoeba dispar
LSESLGALWKTLPTLPFLPKSNQL

SEQ ID NO: 2495523 - protein, 26 aa, Entamoeba dispar
LSESLKRLEMEECYLIDIDNDMKGKE

SEQ ID NO: 2495524 - protein, 24 aa, Entamoeba dispar
LSESPGECDLIKSMYPECKNYTDV

SEQ ID NO: 2495525 - protein, 26 aa, Entamoeba dispar
LSETSWKISQKFNMKKGNEMSHVFLL

SEQ ID NO: 2495526 - protein, 23 aa, Entamoeba dispar
LSEVPCYNCPYSSICSPTNVSCN

SEQ ID NO: 2495527 - protein, 18 aa, Entamoeba dispar
LSEYLKRRCLELKQDDID

SEQ ID NO: 2495528 - protein, 19 aa, Entamoeba dispar
LSFIKSIEGRNDIAIIIVN

SEQ ID NO: 2495529 - protein, 17 aa, Entamoeba dispar
LSFKEGDVITVLEKSGD

SEQ ID NO: 2495530 - protein, 17 aa, Entamoeba dispar
LSFNEYTIELSLDESVE

SEQ ID NO: 2495531 - protein, 19 aa, Entamoeba dispar
LSFSLPINILRYIQPLNQS

SEQ ID NO: 2495532 - protein, 17 aa, Entamoeba dispar
LSFSYSPLIGDDHSSRS

SEQ ID NO: 2495533 - protein, 22 aa, Entamoeba dispar
LSGDERYQCTLTFGYNGDNRRI

SEQ ID NO: 2495534 - protein, 26 aa, Entamoeba dispar
LSGFLQKPHHQFRGLLNYVHRQNNDF

SEQ ID NO: 2495535 - protein, 21 aa, Entamoeba dispar
LSGFSFLFAEYVRRQFRKDNK

SEQ ID NO: 2495536 - protein, 19 aa, Entamoeba dispar
LSGHPWPQVGVERNTISGG

SEQ ID NO: 2495537 - protein, 28 aa, Entamoeba dispar
LSGKRGRFDGRRGLSRIGRRHMNHSNRR

SEQ ID NO: 2495538 - protein, 18 aa, Entamoeba dispar
LSGLDSIKSISFPTTLTK

SEQ ID NO: 2495539 - protein, 18 aa, Entamoeba dispar
LSGLLQEPSMRVMQYPML

SEQ ID NO: 2495540 - protein, 25 aa, Entamoeba dispar
LSGLYLRTIAWRVWLGVLPTPISVS

SEQ ID NO: 2495541 - protein, 24 aa, Entamoeba dispar
LSGRVTINLHFTWYDTYLQEDSKP

SEQ ID NO: 2495542 - protein, 17 aa, Entamoeba dispar
LSHCDKLEAIYFPRELK

SEQ ID NO: 2495543 - protein, 17 aa, Entamoeba dispar
LSHEGIETMILGEQDQS

SEQ ID NO: 2495544 - protein, 17 aa, Entamoeba dispar
LSHFLPHLDIFGYKIEV

SEQ ID NO: 2495545 - protein, 19 aa, Entamoeba dispar
LSHMGCFIPAKAASIRPLT

SEQ ID NO: 2495546 - protein, 19 aa, Entamoeba dispar
LSHNKAIHFTSRYMYLTLW

SEQ ID NO: 2495547 - protein, 21 aa, Entamoeba dispar
LSHRVTVFPVALILAPTRELG

SEQ ID NO: 2495548 - protein, 22 aa, Entamoeba dispar
LSICQFLLPIELQYSSQLSISL

SEQ ID NO: 2495549 - protein, 25 aa, Entamoeba dispar
LSIDLLPILPIEQWKNTSSFVKEEV

SEQ ID NO: 2495550 - protein, 20 aa, Entamoeba dispar
LSIHPSRYYPLDVECIKSGN

SEQ ID NO: 2495551 - protein, 25 aa, Entamoeba dispar
LSIIRHFSHLFNLTYCYASGYYSYK

SEQ ID NO: 2495552 - protein, 25 aa, Entamoeba dispar
LSIKIHSCDFLFPMNFPQSLQSLDL

SEQ ID NO: 2495553 - protein, 17 aa, Entamoeba dispar
LSIKKALKFHKDVVGSA

SEQ ID NO: 2495554 - protein, 22 aa, Entamoeba dispar
LSIKRGQKIIIFDDSDPEGWLG

SEQ ID NO: 2495555 - protein, 20 aa, Entamoeba dispar
LSILCDCEVSLFIFANDKLV

SEQ ID NO: 2495556 - protein, 18 aa, Entamoeba dispar
LSILFLMCSIPVPQFPGS

SEQ ID NO: 2495557 - protein, 20 aa, Entamoeba dispar
LSIMRGKVPQLFDLKENSNI

SEQ ID NO: 2495558 - protein, 19 aa, Entamoeba dispar
LSINQILNFQYYVAQVMDF

SEQ ID NO: 2495559 - protein, 25 aa, Entamoeba dispar
LSIPQRLNVSITRAKYGLVVVGNPE

SEQ ID NO: 2495560 - protein, 21 aa, Entamoeba dispar
LSIRSDAKFNIYFNYWDDNFR

SEQ ID NO: 2495561 - protein, 25 aa, Entamoeba dispar
LSISQRNHFNFNFIKNSRRNLLAET

SEQ ID NO: 2495562 - protein, 17 aa, Entamoeba dispar
LSITSFGNYCFYKCYSL

SEQ ID NO: 2495563 - protein, 19 aa, Entamoeba dispar
LSIVCTTLYVIEVDPNKKL

SEQ ID NO: 2495564 - protein, 18 aa, Entamoeba dispar
LSKALAIQKFHSFLYTSK

SEQ ID NO: 2495565 - protein, 20 aa, Entamoeba dispar
LSKAVCRFIAKVSAHPLANV

SEQ ID NO: 2495566 - protein, 18 aa, Entamoeba dispar
LSKDDLKQFITIVDSLSQ

SEQ ID NO: 2495567 - protein, 17 aa, Entamoeba dispar
LSKEEFLEDPIFDEYQF

SEQ ID NO: 2495568 - protein, 21 aa, Entamoeba dispar
LSKEEIVGIVVQKLIPHVISS

SEQ ID NO: 2495569 - protein, 22 aa, Entamoeba dispar
LSKELFKCFNKAREIWVSLKEE

SEQ ID NO: 2495570 - protein, 21 aa, Entamoeba dispar
LSKELREKYNVIAVPIHKDDE

SEQ ID NO: 2495571 - protein, 17 aa, Entamoeba dispar
LSKENPYNFTFFVFHSA

SEQ ID NO: 2495572 - protein, 19 aa, Entamoeba dispar
LSKITLWLEKDRVISSFVN

SEQ ID NO: 2495573 - protein, 25 aa, Entamoeba dispar
LSKKFCPELTYIFTKVRLAVKERYG

SEQ ID NO: 2495574 - protein, 25 aa, Entamoeba dispar
LSKKLWCLFKKILKPTIYEIENCGT

SEQ ID NO: 2495575 - protein, 21 aa, Entamoeba dispar
LSKKNFDCWIEVKTSNTISEL

SEQ ID NO: 2495576 - protein, 17 aa, Entamoeba dispar
LSKKPKDKFFINFYDGV

SEQ ID NO: 2495577 - protein, 23 aa, Entamoeba dispar
LSKKTLLRQALGNTIDDREFQTS

SEQ ID NO: 2495578 - protein, 24 aa, Entamoeba dispar
LSKLFLKCNEWFGLCEVTPYEMSI

SEQ ID NO: 2495579 - protein, 23 aa, Entamoeba dispar
LSKLRDLFSLFFNVEFFERVWSK

SEQ ID NO: 2495580 - protein, 18 aa, Entamoeba dispar
LSKMSFVQRQRYLREQQD

SEQ ID NO: 2495581 - protein, 17 aa, Entamoeba dispar
LSKQGAFNQENVLNKPF

SEQ ID NO: 2495582 - protein, 19 aa, Entamoeba dispar
LSKQMGIVLKKALREKKKN

SEQ ID NO: 2495583 - protein, 23 aa, Entamoeba dispar
LSKRGFGEEEWAFHGSSVDSIQG

SEQ ID NO: 2495584 - protein, 24 aa, Entamoeba dispar
LSKRIRLLLMNIIQMMESGWTVSP

SEQ ID NO: 2495585 - protein, 20 aa, Entamoeba dispar
LSKTRWDLVSLLQKEVAKSI

SEQ ID NO: 2495586 - protein, 18 aa, Entamoeba dispar
LSKYLGMMSFIITESDFI

SEQ ID NO: 2495587 - protein, 17 aa, Entamoeba dispar
LSLAARVIAGISNETPS

SEQ ID NO: 2495588 - protein, 26 aa, Entamoeba dispar
LSLDQWYIIIVCFLDFSLQDISKTTT

SEQ ID NO: 2495589 - protein, 23 aa, Entamoeba dispar
LSLELFHQICLLNDCQLIELAID

SEQ ID NO: 2495590 - protein, 27 aa, Entamoeba dispar
LSLELFTQGNFEWKEKVVVVGVDMSSD

SEQ ID NO: 2495591 - protein, 19 aa, Entamoeba dispar
LSLIFAIQRCDPAPFYLFD

SEQ ID NO: 2495592 - protein, 17 aa, Entamoeba dispar
LSLIIQRIVGILDDNIA

SEQ ID NO: 2495593 - protein, 18 aa, Entamoeba dispar
LSLIPIKFSGIIRDLMAK

SEQ ID NO: 2495594 - protein, 26 aa, Entamoeba dispar
LSLKEMCKKCRVVIEIDTINNVKEFC

SEQ ID NO: 2495595 - protein, 17 aa, Entamoeba dispar
LSLKTLFGISSSDVIDW

SEQ ID NO: 2495596 - protein, 18 aa, Entamoeba dispar
LSLLNDIICLFKKKCKSY

SEQ ID NO: 2495597 - protein, 35 aa, Entamoeba dispar
LSLNNVCFLKLPILNEIKRCFPNELLTINTMNIEI

SEQ ID NO: 2495598 - protein, 17 aa, Entamoeba dispar
LSLPCTVCGDIHGQFHD

SEQ ID NO: 2495599 - protein, 29 aa, Entamoeba dispar
LSLQFELTCPIKVHIALEIAKGIKYLQSL

SEQ ID NO: 2495600 - protein, 19 aa, Entamoeba dispar
LSLQHPRNIWTLKPYNEQT

SEQ ID NO: 2495601 - protein, 17 aa, Entamoeba dispar
LSLQRFIIKNSKYPIND

SEQ ID NO: 2495602 - protein, 19 aa, Entamoeba dispar
LSLQSDIRTAALVDNSLWI

SEQ ID NO: 2495603 - protein, 17 aa, Entamoeba dispar
LSLREAFKMKEKGIDKT

SEQ ID NO: 2495604 - protein, 24 aa, Entamoeba dispar
LSLRPHPFDPYRVYTIPFEEQAFK

SEQ ID NO: 2495605 - protein, 18 aa, Entamoeba dispar
LSLRRQELEMAMGSVPAG

SEQ ID NO: 2495606 - protein, 23 aa, Entamoeba dispar
LSLTYKRFLGLPIPSTQFQGYPQ

SEQ ID NO: 2495607 - protein, 19 aa, Entamoeba dispar
LSLVRYPLSLDISMMNQHI

SEQ ID NO: 2495608 - protein, 19 aa, Entamoeba dispar
LSLYCGIGACEAGVEKYMY

SEQ ID NO: 2495609 - protein, 22 aa, Entamoeba dispar
LSLYRYRQSKAFLSSIKKDILK

SEQ ID NO: 2495610 - protein, 17 aa, Entamoeba dispar
LSMALSIFPRIKISNKS

SEQ ID NO: 2495611 - protein, 20 aa, Entamoeba dispar
LSMNCPRVTQTFFSAPNPLF

SEQ ID NO: 2495612 - protein, 26 aa, Entamoeba dispar
LSMRYDLTVPFARYLATNGVKKIKRY

SEQ ID NO: 2495613 - protein, 24 aa, Entamoeba dispar
LSNCKLNCIPKHFFDSLVQLTYLD

SEQ ID NO: 2495614 - protein, 26 aa, Entamoeba dispar
LSNDFPHLFIIFPKSFGFYINNQPNQ

SEQ ID NO: 2495615 - protein, 21 aa, Entamoeba dispar
LSNEMARMLSAVDEQSIGNQI

SEQ ID NO: 2495616 - protein, 18 aa, Entamoeba dispar
LSNIHKFSFIKETINSIH

SEQ ID NO: 2495617 - protein, 20 aa, Entamoeba dispar
LSNIKMCLGSELLGVVEASL

SEQ ID NO: 2495618 - protein, 17 aa, Entamoeba dispar
LSNILSFDDESVDFKTK

SEQ ID NO: 2495619 - protein, 19 aa, Entamoeba dispar
LSNIVLKLLEWLKSIDNDG

SEQ ID NO: 2495620 - protein, 17 aa, Entamoeba dispar
LSNLIIHNLIVYGINVE

SEQ ID NO: 2495621 - protein, 22 aa, Entamoeba dispar
LSNLKRKIHRGSRGNQKAKKIR

SEQ ID NO: 2495622 - protein, 22 aa, Entamoeba dispar
LSNLPCISFSYQTKISYPSLIF

SEQ ID NO: 2495623 - protein, 17 aa, Entamoeba dispar
LSNNRVSTVNIMKTLGF

SEQ ID NO: 2495624 - protein, 35 aa, Entamoeba dispar
LSNPRIGAVAPNPMAMKYGRIPQRVHVQDDIPDPL

SEQ ID NO: 2495625 - protein, 20 aa, Entamoeba dispar
LSNVPTRWFPSAKRSKYILN

SEQ ID NO: 2495626 - protein, 22 aa, Entamoeba dispar
LSNYIPKYICESYLPAYKIEVV

SEQ ID NO: 2495627 - protein, 24 aa, Entamoeba dispar
LSPCDVKSFFSYSILSINSYLSDS

SEQ ID NO: 2495628 - protein, 20 aa, Entamoeba dispar
LSPCKTLLIDSCINSSEIQN

SEQ ID NO: 2495629 - protein, 23 aa, Entamoeba dispar
LSPEKKPFFGMAAAIEQYKKIVP

SEQ ID NO: 2495630 - protein, 23 aa, Entamoeba dispar
LSPESKPFLGMAAAIERYKVVAS

SEQ ID NO: 2495631 - protein, 22 aa, Entamoeba dispar
LSPESQGLLSLHFSNEQETMRM

SEQ ID NO: 2495632 - protein, 25 aa, Entamoeba dispar
LSPFKTRGILLLKMNAICRGNTPVQ

SEQ ID NO: 2495633 - protein, 21 aa, Entamoeba dispar
LSPFLRKCIGNSFYNKHLIDL

SEQ ID NO: 2495634 - protein, 18 aa, Entamoeba dispar
LSPFPYSQPNLFTPNPTT

SEQ ID NO: 2495635 - protein, 17 aa, Entamoeba dispar
LSPFVDVFIQFISLSNF

SEQ ID NO: 2495636 - protein, 24 aa, Entamoeba dispar
LSPGSCFWLPHGTRIYNKLVQLIR

SEQ ID NO: 2495637 - protein, 19 aa, Entamoeba dispar
LSPIFHFLLPFLTSTTKEP

SEQ ID NO: 2495638 - protein, 17 aa, Entamoeba dispar
LSPKDIHILMTFVQGLP

SEQ ID NO: 2495639 - protein, 18 aa, Entamoeba dispar
LSPKTWGTWGEWTGDAKE

SEQ ID NO: 2495640 - protein, 26 aa, Entamoeba dispar
LSPPELSCFISQGMEIVKNHPFVKKD

SEQ ID NO: 2495641 - protein, 19 aa, Entamoeba dispar
LSPPLPIPLITELHISTFQ

SEQ ID NO: 2495642 - protein, 17 aa, Entamoeba dispar
LSPPSYHSSSFLNSSLS

SEQ ID NO: 2495643 - protein, 17 aa, Entamoeba dispar
LSPRVVRIGVHSKRAVS

SEQ ID NO: 2495644 - protein, 17 aa, Entamoeba dispar
LSPSKSTNCIISAPSSV

SEQ ID NO: 2495645 - protein, 21 aa, Entamoeba dispar
LSPSRALQFWLDFLKVADIKT

SEQ ID NO: 2495646 - protein, 25 aa, Entamoeba dispar
LSPTIQMYFSFRFLKQESAEEKRIG

SEQ ID NO: 2495647 - protein, 17 aa, Entamoeba dispar
LSQALIVAGRIVKDPKQ

SEQ ID NO: 2495648 - protein, 23 aa, Entamoeba dispar
LSQAVVILRCKWQSVPSGYSIYV

SEQ ID NO: 2495649 - protein, 24 aa, Entamoeba dispar
LSQDMCSPALFISKMDDYEIAKQL

SEQ ID NO: 2495650 - protein, 17 aa, Entamoeba dispar
LSQEFGNIDIKFFCGNH

SEQ ID NO: 2495651 - protein, 19 aa, Entamoeba dispar
LSQEKRCDIQIKIIKSPED

SEQ ID NO: 2495652 - protein, 22 aa, Entamoeba dispar
LSQEPYLIVGLIGNEYLPQGIK

SEQ ID NO: 2495653 - protein, 23 aa, Entamoeba dispar
LSQFKNELPLIITQFKNEVLDAF

SEQ ID NO: 2495654 - protein, 17 aa, Entamoeba dispar
LSQFYTFSQINKIFPVL

SEQ ID NO: 2495655 - protein, 18 aa, Entamoeba dispar
LSQFYTFSQINKIFPVLQ

SEQ ID NO: 2495656 - protein, 17 aa, Entamoeba dispar
LSQGLMHGWSYQSLIKE

SEQ ID NO: 2495657 - protein, 18 aa, Entamoeba dispar
LSQICCFFTQPTVSFIDS

SEQ ID NO: 2495658 - protein, 24 aa, Entamoeba dispar
LSQIPRERVEEIINTKKENSAKLK

SEQ ID NO: 2495659 - protein, 25 aa, Entamoeba dispar
LSQIYKLHFDYIFIRRAEKIEGLFT

SEQ ID NO: 2495660 - protein, 26 aa, Entamoeba dispar
LSQKHIDEFVTWMYNHLLVGYSNEFP

SEQ ID NO: 2495661 - protein, 18 aa, Entamoeba dispar
LSQKLAFVKDESILSQCI

SEQ ID NO: 2495662 - protein, 24 aa, Entamoeba dispar
LSQKNCIFCINILEQGIKEKPCWI

SEQ ID NO: 2495663 - protein, 22 aa, Entamoeba dispar
LSQLYILYADYVLKNPFIISEM

SEQ ID NO: 2495664 - protein, 17 aa, Entamoeba dispar
LSQMRFDEMFRNEIDKL

SEQ ID NO: 2495665 - protein, 21 aa, Entamoeba dispar
LSQNIITLFTFICYDSIEPIY

SEQ ID NO: 2495666 - protein, 19 aa, Entamoeba dispar
LSQPFICHPDLLKSVGNKL

SEQ ID NO: 2495667 - protein, 20 aa, Entamoeba dispar
LSRDGCLLCKDKFIENLPQQ

SEQ ID NO: 2495668 - protein, 20 aa, Entamoeba dispar
LSRECFKFNNITSVILGHHI

SEQ ID NO: 2495669 - protein, 21 aa, Entamoeba dispar
LSRECFKFNNITSVILGHHIR

SEQ ID NO: 2495670 - protein, 17 aa, Entamoeba dispar
LSRESISIIPREPEEEK

SEQ ID NO: 2495671 - protein, 19 aa, Entamoeba dispar
LSRFVDLSKQYTLVCVEQN

SEQ ID NO: 2495672 - protein, 32 aa, Entamoeba dispar
LSRLDCIQMEFKFSVTMFPVFPPEYNFLAPKL

SEQ ID NO: 2495673 - protein, 17 aa, Entamoeba dispar
LSRMGKYQKCLCASLFF

SEQ ID NO: 2495674 - protein, 25 aa, Entamoeba dispar
LSRRKIKVSSGLMPWEYDDEEEKKD

SEQ ID NO: 2495675 - protein, 25 aa, Entamoeba dispar
LSRRKIKVSSGLMPWEYDEEEEKKD

SEQ ID NO: 2495676 - protein, 23 aa, Entamoeba dispar
LSRSRKALSNALLVYHILLEGAT

SEQ ID NO: 2495677 - protein, 18 aa, Entamoeba dispar
LSRYELMDGAPVKGESMP

SEQ ID NO: 2495678 - protein, 21 aa, Entamoeba dispar
LSSDFIIPFVKCEESMFSYLA

SEQ ID NO: 2495679 - protein, 18 aa, Entamoeba dispar
LSSFCLQRMFICSNERIL

SEQ ID NO: 2495680 - protein, 18 aa, Entamoeba dispar
LSSFPIISICSIPNSRLI

SEQ ID NO: 2495681 - protein, 22 aa, Entamoeba dispar
LSSFSTYPCFKNVKQGEPNCDC

SEQ ID NO: 2495682 - protein, 32 aa, Entamoeba dispar
LSSGNTLLIRRGCDLAGIVFRILNFQKTSILP

SEQ ID NO: 2495683 - protein, 18 aa, Entamoeba dispar
LSSIKIMYLESIDTMEMQ

SEQ ID NO: 2495684 - protein, 20 aa, Entamoeba dispar
LSSIQKGKLLHGYKIDMNAL

SEQ ID NO: 2495685 - protein, 17 aa, Entamoeba dispar
LSSISFLLTQKIISQVI

SEQ ID NO: 2495686 - protein, 19 aa, Entamoeba dispar
LSSISRRKLELIKASRTNR

SEQ ID NO: 2495687 - protein, 24 aa, Entamoeba dispar
LSSKLKKKEFIAADEEIRQQIEYV

SEQ ID NO: 2495688 - protein, 20 aa, Entamoeba dispar
LSSLALIFALHHYKPTPIYV

SEQ ID NO: 2495689 - protein, 22 aa, Entamoeba dispar
LSSLENGFLCFIDRYNQSGRRK

SEQ ID NO: 2495690 - protein, 25 aa, Entamoeba dispar
LSSLIDVLHLLPLIYDKEYARQLLF

SEQ ID NO: 2495691 - protein, 25 aa, Entamoeba dispar
LSSLSCLFINCDILIKKITKKGCEI

SEQ ID NO: 2495692 - protein, 17 aa, Entamoeba dispar
LSSMGLIDIDFTGGEDA

SEQ ID NO: 2495693 - protein, 19 aa, Entamoeba dispar
LSSNFIFFVNLFQRSTLDM

SEQ ID NO: 2495694 - protein, 19 aa, Entamoeba dispar
LSSNGSWSSIPIIVTEKIE

SEQ ID NO: 2495695 - protein, 22 aa, Entamoeba dispar
LSSRFRPQIPLVKRTIESLIER

SEQ ID NO: 2495696 - protein, 17 aa, Entamoeba dispar
LSSSFGIETMKMITDEW

SEQ ID NO: 2495697 - protein, 38 aa, Entamoeba dispar
LSSSIAFQILKFLPPFYHCVLLLPHLIHYIPKSAAVEY

SEQ ID NO: 2495698 - protein, 21 aa, Entamoeba dispar
LSSTVEFPSALLILQLLINVL

SEQ ID NO: 2495699 - protein, 20 aa, Entamoeba dispar
LSSVNFPSSIQKLSLRSNFF

SEQ ID NO: 2495700 - protein, 21 aa, Entamoeba dispar
LSSYFPQLLFCDIQDCFSQFC

SEQ ID NO: 2495701 - protein, 28 aa, Entamoeba dispar
LSSYKIIFPRIQYCKILNSSTNTYKQLF

SEQ ID NO: 2495702 - protein, 17 aa, Entamoeba dispar
LSTATAFLKDMESYRNN

SEQ ID NO: 2495703 - protein, 17 aa, Entamoeba dispar
LSTCLFVSHFPELNNLE

SEQ ID NO: 2495704 - protein, 17 aa, Entamoeba dispar
LSTDNVFVFSVIPTDYV

SEQ ID NO: 2495705 - protein, 20 aa, Entamoeba dispar
LSTDVPRSFVAQVYSAPDSF

SEQ ID NO: 2495706 - protein, 26 aa, Entamoeba dispar
LSTESFCLTFYWNGSRNELDFIEFPY

SEQ ID NO: 2495707 - protein, 17 aa, Entamoeba dispar
LSTETLRAENARLRLNA

SEQ ID NO: 2495708 - protein, 20 aa, Entamoeba dispar
LSTFGGGLVLISHHQHMIES

SEQ ID NO: 2495709 - protein, 31 aa, Entamoeba dispar
LSTKLGEAFSQFIPMMNVYKLFLGNSDTSLQ

SEQ ID NO: 2495710 - protein, 18 aa, Entamoeba dispar
LSTKMHRVLEETLYQNVK

SEQ ID NO: 2495711 - protein, 17 aa, Entamoeba dispar
LSTLILKGYYHVCMDKF

SEQ ID NO: 2495712 - protein, 24 aa, Entamoeba dispar
LSTLKPKYWISGHMHCEYHAEEGP

SEQ ID NO: 2495713 - protein, 26 aa, Entamoeba dispar
LSTLNMLTWKGLKFRVEYANPNILDK

SEQ ID NO: 2495714 - protein, 19 aa, Entamoeba dispar
LSTLNRVIIKLVIDLNTFK

SEQ ID NO: 2495715 - protein, 25 aa, Entamoeba dispar
LSTLTISYCKSLWLSTLTGFENELD

SEQ ID NO: 2495716 - protein, 28 aa, Entamoeba dispar
LSTLYKDPRTILIFKVNSPINDKWGFPK

SEQ ID NO: 2495717 - protein, 23 aa, Entamoeba dispar
LSTMKGCLGLVFGNESNGLNTEE

SEQ ID NO: 2495718 - protein, 41 aa, Entamoeba dispar
LSTNEGFLFPMSDSFIFVFKRIRIIMFKDIKSVDILRMNAS

SEQ ID NO: 2495719 - protein, 18 aa, Entamoeba dispar
LSTPIWPQSLLQPMLSIT

SEQ ID NO: 2495720 - protein, 24 aa, Entamoeba dispar
LSTYKYLRPWKIIHYKNIIVLLYN

SEQ ID NO: 2495721 - protein, 25 aa, Entamoeba dispar
LSTYKYLRPWKIIHYKNIIVLLYND

SEQ ID NO: 2495722 - protein, 24 aa, Entamoeba dispar
LSVAVKSGNGWRQFTGNEMANLIA

SEQ ID NO: 2495723 - protein, 21 aa, Entamoeba dispar
LSVFIPLFFQVLFESFNQYYE

SEQ ID NO: 2495724 - protein, 17 aa, Entamoeba dispar
LSVIFTRLLFSIQTLSQ

SEQ ID NO: 2495725 - protein, 18 aa, Entamoeba dispar
LSVKCFIETELKKNEIER

SEQ ID NO: 2495726 - protein, 18 aa, Entamoeba dispar
LSVLKCRICGCYVHSKCI

SEQ ID NO: 2495727 - protein, 18 aa, Entamoeba dispar
LSVMAYVSYFRHYEAEKE

SEQ ID NO: 2495728 - protein, 18 aa, Entamoeba dispar
LSVMEKWHSKTTMMNISK

SEQ ID NO: 2495729 - protein, 21 aa, Entamoeba dispar
LSVSCETLFRDVVRHWYQLEK

SEQ ID NO: 2495730 - protein, 20 aa, Entamoeba dispar
LSVSLFKIQIQPAINHLKSA

SEQ ID NO: 2495731 - protein, 19 aa, Entamoeba dispar
LSVVKGFSFQLVVVNEIIE

SEQ ID NO: 2495732 - protein, 18 aa, Entamoeba dispar
LSWSEFFAHPYVQRACEV

SEQ ID NO: 2495733 - protein, 24 aa, Entamoeba dispar
LSYADTAIFERYIVNKYVKVVNGQ

SEQ ID NO: 2495734 - protein, 26 aa, Entamoeba dispar
LSYGACQFPTLGFVVDRYYQIKAFTK

SEQ ID NO: 2495735 - protein, 17 aa, Entamoeba dispar
LSYGKGSMRRVGVIEEM

SEQ ID NO: 2495736 - protein, 18 aa, Entamoeba dispar
LSYLDCIIDFCPENSIPE

SEQ ID NO: 2495737 - protein, 17 aa, Entamoeba dispar
LSYPQTDIFLLCFSVVY

SEQ ID NO: 2495738 - protein, 18 aa, Entamoeba dispar
LSYSIKFKLFKKLKKIMD

SEQ ID NO: 2495739 - protein, 29 aa, Entamoeba dispar
LSYTLGKKSASAWWKKYFSYKGNDIETTV

SEQ ID NO: 2495740 - protein, 21 aa, Entamoeba dispar
LTAILEFFPSIAMNEPQIAYV

SEQ ID NO: 2495741 - protein, 26 aa, Entamoeba dispar
LTALKHPFCCLSVLNLIVAFRQHTFI

SEQ ID NO: 2495742 - protein, 27 aa, Entamoeba dispar
LTAMGFCSSNFWKRLTPIKTNFQILET

SEQ ID NO: 2495743 - protein, 21 aa, Entamoeba dispar
LTANQKYIFGNIIDLFGKNVK

SEQ ID NO: 2495744 - protein, 19 aa, Entamoeba dispar
LTATIPVSDSWEGKIDISG

SEQ ID NO: 2495745 - protein, 19 aa, Entamoeba dispar
LTATIPVSDSWEGKIDITG

SEQ ID NO: 2495746 - protein, 20 aa, Entamoeba dispar
LTAVAKGAAYLSFLAQETAI

SEQ ID NO: 2495747 - protein, 23 aa, Entamoeba dispar
LTCDLKIFIVLKEMVHDIASHEK

SEQ ID NO: 2495748 - protein, 29 aa, Entamoeba dispar
LTCIIPTERYCIIVPFKFNVEKLQFSTEY

SEQ ID NO: 2495749 - protein, 18 aa, Entamoeba dispar
LTCNFKYGKRTEIYIPSL

SEQ ID NO: 2495750 - protein, 19 aa, Entamoeba dispar
LTCQLKVSKARYCLNEEDL

SEQ ID NO: 2495751 - protein, 21 aa, Entamoeba dispar
LTCYECLAMGNAVGMIEVVLR

SEQ ID NO: 2495752 - protein, 28 aa, Entamoeba dispar
LTDACFCKKELFLLCGTILSSSDNTRKV

SEQ ID NO: 2495753 - protein, 17 aa, Entamoeba dispar
LTDCIRGRIVFMFEPPK

SEQ ID NO: 2495754 - protein, 19 aa, Entamoeba dispar
LTDICTFNLFSNLQSIDIS

SEQ ID NO: 2495755 - protein, 18 aa, Entamoeba dispar
LTDISAMLRSPIYITSCN

SEQ ID NO: 2495756 - protein, 17 aa, Entamoeba dispar
LTDKILSMFKIKPTYTF

SEQ ID NO: 2495757 - protein, 25 aa, Entamoeba dispar
LTDKTSFEMVGYWLSEMEKDNNHPI

SEQ ID NO: 2495758 - protein, 26 aa, Entamoeba dispar
LTDLRFLLFPCHYETHWFTIIVCNKT

SEQ ID NO: 2495759 - protein, 19 aa, Entamoeba dispar
LTDRLYPMLSQEHSRDLIK

SEQ ID NO: 2495760 - protein, 17 aa, Entamoeba dispar
LTDSLVLSITNYINSQR

SEQ ID NO: 2495761 - protein, 26 aa, Entamoeba dispar
LTDYIFSVAHAFGFWNPQLNEEESAY

SEQ ID NO: 2495762 - protein, 19 aa, Entamoeba dispar
LTEALLNIGERCTTSEVGE

SEQ ID NO: 2495763 - protein, 22 aa, Entamoeba dispar
LTECEFKCVLIYDTPDKRIVPF

SEQ ID NO: 2495764 - protein, 20 aa, Entamoeba dispar
LTEFHWDRNRLFDRLICDLL

SEQ ID NO: 2495765 - protein, 25 aa, Entamoeba dispar
LTEIKSCVWASGSMTYPITGISPPI

SEQ ID NO: 2495766 - protein, 23 aa, Entamoeba dispar
LTEIPSYHKILLTGTPIQNNIDE

SEQ ID NO: 2495767 - protein, 26 aa, Entamoeba dispar
LTEISFKLKEMYYLLTQGGVAELELV

SEQ ID NO: 2495768 - protein, 28 aa, Entamoeba dispar
LTEKPLDAPPPFSLNGFSFSNSTEKQKD

SEQ ID NO: 2495769 - protein, 27 aa, Entamoeba dispar
LTEQLKKIEMEKCSKLNIESDVKGKEV

SEQ ID NO: 2495770 - protein, 20 aa, Entamoeba dispar
LTEQPFLFTLTEYFNQQKNI

SEQ ID NO: 2495771 - protein, 18 aa, Entamoeba dispar
LTERIRYFELRKRTDNDE

SEQ ID NO: 2495772 - protein, 22 aa, Entamoeba dispar
LTERLTNIQIEFDNFKKKKDEE

SEQ ID NO: 2495773 - protein, 29 aa, Entamoeba dispar
LTERRLGEFPLHWDRFNKKDVEIIKNYSL

SEQ ID NO: 2495774 - protein, 24 aa, Entamoeba dispar
LTERYYALCVKYRSSPLLHLSWLN

SEQ ID NO: 2495775 - protein, 18 aa, Entamoeba dispar
LTESCAIHRTIELHSGNI

SEQ ID NO: 2495776 - protein, 25 aa, Entamoeba dispar
LTESCGGCTTCLPGMNDPQILSCGS

SEQ ID NO: 2495777 - protein, 20 aa, Entamoeba dispar
LTETHWKIPRTFKLRKEQHG

SEQ ID NO: 2495778 - protein, 17 aa, Entamoeba dispar
LTEVCIQSAAAPGYFGS

SEQ ID NO: 2495779 - protein, 18 aa, Entamoeba dispar
LTEVCIQSAAAPGYFGSV

SEQ ID NO: 2495780 - protein, 34 aa, Entamoeba dispar
LTFKNKRLSGMTLDLLCKVLSSLLIPIQSKEFVL

SEQ ID NO: 2495781 - protein, 17 aa, Entamoeba dispar
LTFMLKDSLGGNCKTVI

SEQ ID NO: 2495782 - protein, 28 aa, Entamoeba dispar
LTFRSKGRIPAICWRGAGNQTISRSAQP

SEQ ID NO: 2495783 - protein, 41 aa, Entamoeba dispar
LTFYRYPQAWIICAQYFQRRGNIELAINFLERGRAAVNCPL

SEQ ID NO: 2495784 - protein, 17 aa, Entamoeba dispar
LTGENGFEYEEIANKTA

SEQ ID NO: 2495785 - protein, 17 aa, Entamoeba dispar
LTGHVYLQFQSIIQSEI

SEQ ID NO: 2495786 - protein, 18 aa, Entamoeba dispar
LTGIGLNETVLFNSYNKL

SEQ ID NO: 2495787 - protein, 23 aa, Entamoeba dispar
LTGKFTVKLPWEFTTSETPIKVI

SEQ ID NO: 2495788 - protein, 25 aa, Entamoeba dispar
LTGKGRGRCAVRICSRGYHLSDEKK

SEQ ID NO: 2495789 - protein, 23 aa, Entamoeba dispar
LTGNFGIRVYLINSFENISINPK

SEQ ID NO: 2495790 - protein, 17 aa, Entamoeba dispar
LTGPKRERKVCLIRMDY

SEQ ID NO: 2495791 - protein, 29 aa, Entamoeba dispar
LTGPKRERKVCLIRMDYDIVSKGIEQRPL

SEQ ID NO: 2495792 - protein, 24 aa, Entamoeba dispar
LTGPKTKRLFTFGFGGYDLTVMKK

SEQ ID NO: 2495793 - protein, 19 aa, Entamoeba dispar
LTGSGTFGKLGLNQTNNQG

SEQ ID NO: 2495794 - protein, 18 aa, Entamoeba dispar
LTGTTAFISDDFNEFYND

SEQ ID NO: 2495795 - protein, 22 aa, Entamoeba dispar
LTHGICTQLLLNVCLSSVYGYL

SEQ ID NO: 2495796 - protein, 17 aa, Entamoeba dispar
LTHNKCIIDSFDRPNEY

SEQ ID NO: 2495797 - protein, 19 aa, Entamoeba dispar
LTHTLPILVDLILGLFKND

SEQ ID NO: 2495798 - protein, 28 aa, Entamoeba dispar
LTHWICPHSRYYCCVCHQIVADQPRRFI

SEQ ID NO: 2495799 - protein, 17 aa, Entamoeba dispar
LTIAYTLHGNIYKEDYI

SEQ ID NO: 2495800 - protein, 26 aa, Entamoeba dispar
LTIEKGCSIQKLLARNNEISFIDSSI

SEQ ID NO: 2495801 - protein, 20 aa, Entamoeba dispar
LTIEKQCLQKRVECLEKEQT

SEQ ID NO: 2495802 - protein, 21 aa, Entamoeba dispar
LTIKQCKGLIGILEGKNSINI

SEQ ID NO: 2495803 - protein, 24 aa, Entamoeba dispar
LTINKCKNLTCIDGIEKLDIPFDE

SEQ ID NO: 2495804 - protein, 18 aa, Entamoeba dispar
LTKAKWLSNSSFIVGDEL

SEQ ID NO: 2495805 - protein, 25 aa, Entamoeba dispar
LTKCLLVAMACWELFSNTELFNVIV

SEQ ID NO: 2495806 - protein, 21 aa, Entamoeba dispar
LTKDFFYSHFILLDKQSLHFI

SEQ ID NO: 2495807 - protein, 26 aa, Entamoeba dispar
LTKERYREIVGLIMINLGELSKHQDL

SEQ ID NO: 2495808 - protein, 17 aa, Entamoeba dispar
LTKESNDRCPIMLVCQD

SEQ ID NO: 2495809 - protein, 33 aa, Entamoeba dispar
LTKESNDRCPIMLVCQDCFWRCTLQGGCEYICN

SEQ ID NO: 2495810 - protein, 34 aa, Entamoeba dispar
LTKESNDRCPIMLVCQDCFWRCTLQGGCEYICNN

SEQ ID NO: 2495811 - protein, 20 aa, Entamoeba dispar
LTKILPRFVSDINNEHLYEI

SEQ ID NO: 2495812 - protein, 18 aa, Entamoeba dispar
LTKKAIHSVGTYIKFEDS

SEQ ID NO: 2495813 - protein, 25 aa, Entamoeba dispar
LTKKRRATLISGKEKHEFIENTDSV

SEQ ID NO: 2495814 - protein, 21 aa, Entamoeba dispar
LTKLFNYFSVFVMQESLDKFV

SEQ ID NO: 2495815 - protein, 17 aa, Entamoeba dispar
LTKLFTAVIEYYDPIQT

SEQ ID NO: 2495816 - protein, 23 aa, Entamoeba dispar
LTKLKGIEGIKHLNQLKLLNNKF

SEQ ID NO: 2495817 - protein, 22 aa, Entamoeba dispar
LTKMMLLCLHKNEITSIQDIPR

SEQ ID NO: 2495818 - protein, 28 aa, Entamoeba dispar
LTKNYGMSFCIVEGFKSLVGLIQKYPVL

SEQ ID NO: 2495819 - protein, 19 aa, Entamoeba dispar
LTKQIKLLISLFDKKKKQE

SEQ ID NO: 2495820 - protein, 19 aa, Entamoeba dispar
LTKRIQFLLKIEGINLQMM

SEQ ID NO: 2495821 - protein, 28 aa, Entamoeba dispar
LTKRLEKGVCGWYDGPCLVELLDSIKLV

SEQ ID NO: 2495822 - protein, 18 aa, Entamoeba dispar
LTKSNGFGDFLAPYATVQ

SEQ ID NO: 2495823 - protein, 23 aa, Entamoeba dispar
LTKTMAELGCEVVVISPYYNMNK

SEQ ID NO: 2495824 - protein, 30 aa, Entamoeba dispar
LTKVKDCITGFVIECCQKMSGHINQESSNK

SEQ ID NO: 2495825 - protein, 17 aa, Entamoeba dispar
LTKYLIIYLCAKDNDYM

SEQ ID NO: 2495826 - protein, 25 aa, Entamoeba dispar
LTLEECVKSTVLFPSNLSSITLNNC

SEQ ID NO: 2495827 - protein, 23 aa, Entamoeba dispar
LTLIKEHVDGIILMTNKDIESSF

SEQ ID NO: 2495828 - protein, 20 aa, Entamoeba dispar
LTLIKSCIVIDLINSNPNKQ

SEQ ID NO: 2495829 - protein, 23 aa, Entamoeba dispar
LTLKCSCDLYMHFINQTTLANDF

SEQ ID NO: 2495830 - protein, 17 aa, Entamoeba dispar
LTLKKPNFWKLRRRDCP

SEQ ID NO: 2495831 - protein, 18 aa, Entamoeba dispar
LTLLDVFMLYQTSTLPAT

SEQ ID NO: 2495832 - protein, 21 aa, Entamoeba dispar
LTLLRLRGNKFNKFPDPILDL

SEQ ID NO: 2495833 - protein, 17 aa, Entamoeba dispar
LTLQQLRNALKDCGMND

SEQ ID NO: 2495834 - protein, 23 aa, Entamoeba dispar
LTLRMKEAYQRRNIISIMQMIEW

SEQ ID NO: 2495835 - protein, 20 aa, Entamoeba dispar
LTLSCCELYSVPQCIEKMNL

SEQ ID NO: 2495836 - protein, 27 aa, Entamoeba dispar
LTLSILPSCLKSLFINNIPIFELDLKT

SEQ ID NO: 2495837 - protein, 34 aa, Entamoeba dispar
LTLTNYKIVFVVKCVIFNVSIPLTKIAYFKKVNS

SEQ ID NO: 2495838 - protein, 18 aa, Entamoeba dispar
LTMIYTNFIEAMKSEEEN

SEQ ID NO: 2495839 - protein, 17 aa, Entamoeba dispar
LTMKIKYMELQMSAPQK

SEQ ID NO: 2495840 - protein, 18 aa, Entamoeba dispar
LTMKSFIDIELFKKIQSS

SEQ ID NO: 2495841 - protein, 21 aa, Entamoeba dispar
LTNCMPGLITPFTDILSICGV

SEQ ID NO: 2495842 - protein, 18 aa, Entamoeba dispar
LTNCPAVIAALFSICNEQ

SEQ ID NO: 2495843 - protein, 19 aa, Entamoeba dispar
LTNDIEWCLNQLIEKKLTK

SEQ ID NO: 2495844 - protein, 25 aa, Entamoeba dispar
LTNEIRPGFTKSWEDFDRIFRDVKN

SEQ ID NO: 2495845 - protein, 27 aa, Entamoeba dispar
LTNFSMKVAVPKWIELQLMSPTDSILQ

SEQ ID NO: 2495846 - protein, 17 aa, Entamoeba dispar
LTNFVGILSTGLRIAPP

SEQ ID NO: 2495847 - protein, 22 aa, Entamoeba dispar
LTNGLHPILFFTRDDYHDKDLR

SEQ ID NO: 2495848 - protein, 33 aa, Entamoeba dispar
LTNKKGFKQLCLENQLPEVLNHVDVSSSIINNL

SEQ ID NO: 2495849 - protein, 18 aa, Entamoeba dispar
LTNLTSLVFQSYERRKRI

SEQ ID NO: 2495850 - protein, 24 aa, Entamoeba dispar
LTNMKGNGLFYLIDPKGGVNTIDL

SEQ ID NO: 2495851 - protein, 17 aa, Entamoeba dispar
LTNWLNYTLKLCDEKKV

SEQ ID NO: 2495852 - protein, 17 aa, Entamoeba dispar
LTPDQALAHPFIIGTTI

SEQ ID NO: 2495853 - protein, 26 aa, Entamoeba dispar
LTPEIKLKLCTEMALSVNWLHNVVGM

SEQ ID NO: 2495854 - protein, 26 aa, Entamoeba dispar
LTPELRAVLKAAGLKRKDLCNPETVK

SEQ ID NO: 2495855 - protein, 25 aa, Entamoeba dispar
LTPELYDWLRVCTGAQIFQGYGMTE

SEQ ID NO: 2495856 - protein, 20 aa, Entamoeba dispar
LTPNAEPLIALFQVNLRGDV

SEQ ID NO: 2495857 - protein, 22 aa, Entamoeba dispar
LTPQNLRKANLIKIDNTQRNKR

SEQ ID NO: 2495858 - protein, 18 aa, Entamoeba dispar
LTPSSRVVPVKALPPKPS

SEQ ID NO: 2495859 - protein, 18 aa, Entamoeba dispar
LTPTLLLCHFNVEIKAIY

SEQ ID NO: 2495860 - protein, 34 aa, Entamoeba dispar
LTPTLLNTLLYEWYELRKLKAIDYRVLKKQIDQF

SEQ ID NO: 2495861 - protein, 30 aa, Entamoeba dispar
LTQDLFQWLRVCTGAKIFQGYGLTESFGGF

SEQ ID NO: 2495862 - protein, 25 aa, Entamoeba dispar
LTQLKRLAIYDGEFQHINNLKLEFI

SEQ ID NO: 2495863 - protein, 27 aa, Entamoeba dispar
LTQLLICLYQRIKIILPTILECHKTIK

SEQ ID NO: 2495864 - protein, 19 aa, Entamoeba dispar
LTQLRTNLIQELKNASSQV

SEQ ID NO: 2495865 - protein, 19 aa, Entamoeba dispar
LTQSELYKQIGIDPPRGCL

SEQ ID NO: 2495866 - protein, 30 aa, Entamoeba dispar
LTRDKIKTVSTCLQLAKSQLNIPILLSAQA

SEQ ID NO: 2495867 - protein, 23 aa, Entamoeba dispar
LTRESRYSPLFIGVDLEGILVPT

SEQ ID NO: 2495868 - protein, 22 aa, Entamoeba dispar
LTRIPFPVCITQARSFLQNFTD

SEQ ID NO: 2495869 - protein, 17 aa, Entamoeba dispar
LTRKWFIRITSSIYSLH

SEQ ID NO: 2495870 - protein, 22 aa, Entamoeba dispar
LTRLELIGIPTLTTVDGDCPSI

SEQ ID NO: 2495871 - protein, 25 aa, Entamoeba dispar
LTRLNLPILDVFWLSQYPAVLVSTG

SEQ ID NO: 2495872 - protein, 25 aa, Entamoeba dispar
LTRNLSVFLFPCFAINNKINLTTFK

SEQ ID NO: 2495873 - protein, 17 aa, Entamoeba dispar
LTRRPKISVRRRRFKTF

SEQ ID NO: 2495874 - protein, 18 aa, Entamoeba dispar
LTRRVMIDLVPPISTHFH

SEQ ID NO: 2495875 - protein, 22 aa, Entamoeba dispar
LTRVSSLLFKTDRDPTKRQTKK

SEQ ID NO: 2495876 - protein, 18 aa, Entamoeba dispar
LTSFDWIDDFIISGSCKG

SEQ ID NO: 2495877 - protein, 19 aa, Entamoeba dispar
LTSKIQICYKNVKDPLLNS

SEQ ID NO: 2495878 - protein, 20 aa, Entamoeba dispar
LTSLLCGVMANRRKDIADDE

SEQ ID NO: 2495879 - protein, 17 aa, Entamoeba dispar
LTSLNMERFAPWRESNE

SEQ ID NO: 2495880 - protein, 25 aa, Entamoeba dispar
LTSMFLNFISLDWNNPRFFINKFHL

SEQ ID NO: 2495881 - protein, 18 aa, Entamoeba dispar
LTSPDVFIWSCSDQIQRV

SEQ ID NO: 2495882 - protein, 28 aa, Entamoeba dispar
LTSTFFYRRIRSNPSYYFVEGREMSIIS

SEQ ID NO: 2495883 - protein, 17 aa, Entamoeba dispar
LTSYGLKLFYLSNDIIE

SEQ ID NO: 2495884 - protein, 18 aa, Entamoeba dispar
LTSYQLFIITKCFEDDLD

SEQ ID NO: 2495885 - protein, 17 aa, Entamoeba dispar
LTTALFCEKYIDTLFKL

SEQ ID NO: 2495886 - protein, 24 aa, Entamoeba dispar
LTTDVGWGCTIRAMQMMIANAMET

SEQ ID NO: 2495887 - protein, 31 aa, Entamoeba dispar
LTTFLGVVVLRTGTSFACMYCNIGDCRALVI

SEQ ID NO: 2495888 - protein, 19 aa, Entamoeba dispar
LTTISIKHPDVWSKVKKSK

SEQ ID NO: 2495889 - protein, 18 aa, Entamoeba dispar
LTTIYKLKKGELIKKSPG

SEQ ID NO: 2495890 - protein, 25 aa, Entamoeba dispar
LTTKRYSSGISLLLKYKPLKDITDY

SEQ ID NO: 2495891 - protein, 18 aa, Entamoeba dispar
LTTLCLPSLLTLIQISNC

SEQ ID NO: 2495892 - protein, 19 aa, Entamoeba dispar
LTTNLGITTLEIWIPVYVI

SEQ ID NO: 2495893 - protein, 26 aa, Entamoeba dispar
LTVALQLKLALAIDELERSAQVIDNK

SEQ ID NO: 2495894 - protein, 24 aa, Entamoeba dispar
LTVIFKNKFLNFLKNYDHKHDENT

SEQ ID NO: 2495895 - protein, 25 aa, Entamoeba dispar
LTVKGIPFLLKFAEIQLVGAKGEII

SEQ ID NO: 2495896 - protein, 26 aa, Entamoeba dispar
LTVMQALVLKHRWFPKLVKSKEPIVV

SEQ ID NO: 2495897 - protein, 21 aa, Entamoeba dispar
LTVPNTLRYSLKGLEIKCQNY

SEQ ID NO: 2495898 - protein, 17 aa, Entamoeba dispar
LTVTIPVSTEWKGAMKH

SEQ ID NO: 2495899 - protein, 18 aa, Entamoeba dispar
LTVYRDFITPIELLNKFI

SEQ ID NO: 2495900 - protein, 25 aa, Entamoeba dispar
LTYAKELFPDLGMKFIESRYDQIMN

SEQ ID NO: 2495901 - protein, 20 aa, Entamoeba dispar
LTYCYASGYYSYKWAEILEA

SEQ ID NO: 2495902 - protein, 18 aa, Entamoeba dispar
LTYFMKWLSSSRLHSRIA

SEQ ID NO: 2495903 - protein, 24 aa, Entamoeba dispar
LTYSKRLALDFVSQMLKEEFETHT

SEQ ID NO: 2495904 - protein, 19 aa, Entamoeba dispar
LVAIKNHRTTIVLTLLGGG

SEQ ID NO: 2495905 - protein, 26 aa, Entamoeba dispar
LVALKLRFPQRISLLRGNHECSLQTR

SEQ ID NO: 2495906 - protein, 36 aa, Entamoeba dispar
LVCNRTCHYPCYIEGDIKKRCYCIGDNECCNVCKCH

SEQ ID NO: 2495907 - protein, 19 aa, Entamoeba dispar
LVCQCSGKYRSCSYSPRGG

SEQ ID NO: 2495908 - protein, 21 aa, Entamoeba dispar
LVCQRCSGVHRGLGVQISKVR

SEQ ID NO: 2495909 - protein, 18 aa, Entamoeba dispar
LVDETYLLLGNDINSSDK

SEQ ID NO: 2495910 - protein, 25 aa, Entamoeba dispar
LVDFPSDYPKLLPIIKVNLPHIPRC

SEQ ID NO: 2495911 - protein, 23 aa, Entamoeba dispar
LVDHLKAVGGVFAFSETAVQIAD

SEQ ID NO: 2495912 - protein, 24 aa, Entamoeba dispar
LVDLKCPICLEIPNPKEMIEHNKC

SEQ ID NO: 2495913 - protein, 17 aa, Entamoeba dispar
LVDPLLIELKENGMKTH

SEQ ID NO: 2495914 - protein, 25 aa, Entamoeba dispar
LVDRGSRGLECIIGVLTLIIEYPNL

SEQ ID NO: 2495915 - protein, 25 aa, Entamoeba dispar
LVDSWKRERYLIGIIKGIRKENKYI

SEQ ID NO: 2495916 - protein, 20 aa, Entamoeba dispar
LVDTEFKMNNLIQFYGQSKS

SEQ ID NO: 2495917 - protein, 19 aa, Entamoeba dispar
LVEFKRYNKGNLYVEILNN

SEQ ID NO: 2495918 - protein, 30 aa, Entamoeba dispar
LVEGMSVKFAVPVCGPYECISKYKYHIKLT

SEQ ID NO: 2495919 - protein, 29 aa, Entamoeba dispar
LVEHPKLFWRYILELLLLCELKVVKVYCK

SEQ ID NO: 2495920 - protein, 30 aa, Entamoeba dispar
LVEIGPRYCMRCIKILAGCFSGSVVYLNEK

SEQ ID NO: 2495921 - protein, 25 aa, Entamoeba dispar
LVEILWKLGDSYFADVIDELYNGLH

SEQ ID NO: 2495922 - protein, 19 aa, Entamoeba dispar
LVEIYAGNAQRHFIINLDN

SEQ ID NO: 2495923 - protein, 17 aa, Entamoeba dispar
LVEKAMYTYYCMDNRNN

SEQ ID NO: 2495924 - protein, 20 aa, Entamoeba dispar
LVELLLRNGALVNFQTEGGQ

SEQ ID NO: 2495925 - protein, 18 aa, Entamoeba dispar
LVERRLLHRSCLPSTTPR

SEQ ID NO: 2495926 - protein, 18 aa, Entamoeba dispar
LVESEIRKYWNFGGVRIE

SEQ ID NO: 2495927 - protein, 25 aa, Entamoeba dispar
LVESLKLIVYRNLFDLVQKSLGTNK

SEQ ID NO: 2495928 - protein, 17 aa, Entamoeba dispar
LVESYCVNTKFKRKASA

SEQ ID NO: 2495929 - protein, 25 aa, Entamoeba dispar
LVFDKCGIELLEFILDPLSTHFLPP

SEQ ID NO: 2495930 - protein, 20 aa, Entamoeba dispar
LVFEPKFRHGPAIDIQLKPI

SEQ ID NO: 2495931 - protein, 18 aa, Entamoeba dispar
LVGAAIIPYEMWKEAIEL

SEQ ID NO: 2495932 - protein, 17 aa, Entamoeba dispar
LVGDLMKSISVYSFDNN

SEQ ID NO: 2495933 - protein, 25 aa, Entamoeba dispar
LVGFLNTLGMPFKIGEIAFYDYSIY

SEQ ID NO: 2495934 - protein, 22 aa, Entamoeba dispar
LVGGILFLRVLSSFIATPDTNN

SEQ ID NO: 2495935 - protein, 22 aa, Entamoeba dispar
LVGNVKGMFCFNRNSHSLDIVR

SEQ ID NO: 2495936 - protein, 24 aa, Entamoeba dispar
LVGPFCYLDLPDLLFIDKIQPQII

SEQ ID NO: 2495937 - protein, 19 aa, Entamoeba dispar
LVHGYCLAPALVLSLNIAS

SEQ ID NO: 2495938 - protein, 17 aa, Entamoeba dispar
LVHQWFKNYEFGNATQA

SEQ ID NO: 2495939 - protein, 18 aa, Entamoeba dispar
LVHSCLFQSDLFDELFIE

SEQ ID NO: 2495940 - protein, 20 aa, Entamoeba dispar
LVHSYEWYSLLTSGELKQID

SEQ ID NO: 2495941 - protein, 18 aa, Entamoeba dispar
LVICTVRLAKNGHEICDD

SEQ ID NO: 2495942 - protein, 38 aa, Entamoeba dispar
LVIDEPFRWEGCSWGWGWDTVDSWKVTRVEFIDNNIDQ

SEQ ID NO: 2495943 - protein, 17 aa, Entamoeba dispar
LVIKCRYSNEVEVLTYK

SEQ ID NO: 2495944 - protein, 17 aa, Entamoeba dispar
LVIKIKVLKKMINENSD

SEQ ID NO: 2495945 - protein, 29 aa, Entamoeba dispar
LVINTLKYIYFRIERLLTVSFAELGEEIK

SEQ ID NO: 2495946 - protein, 18 aa, Entamoeba dispar
LVIRNAVGKTVWGVKSIS

SEQ ID NO: 2495947 - protein, 23 aa, Entamoeba dispar
LVITIPGAFWVTSDGKVFSNSNI

SEQ ID NO: 2495948 - protein, 25 aa, Entamoeba dispar
LVIVPRTKGGFSYGYVDSMKQENRC

SEQ ID NO: 2495949 - protein, 26 aa, Entamoeba dispar
LVKCAEEICEVFADSVSSLVLMLVAL

SEQ ID NO: 2495950 - protein, 17 aa, Entamoeba dispar
LVKDGHVIFDFCNTGIL

SEQ ID NO: 2495951 - protein, 27 aa, Entamoeba dispar
LVKEGGKWKSWKRRFFVFDQTTLSYYK

SEQ ID NO: 2495952 - protein, 17 aa, Entamoeba dispar
LVKELLIPAIKVGDKMQ

SEQ ID NO: 2495953 - protein, 21 aa, Entamoeba dispar
LVKITALAKIAAREGEKERNN

SEQ ID NO: 2495954 - protein, 24 aa, Entamoeba dispar
LVKKGVIVSSVIPKGMRKMTKIII

SEQ ID NO: 2495955 - protein, 17 aa, Entamoeba dispar
LVKKVLEQQALLPANKK

SEQ ID NO: 2495956 - protein, 23 aa, Entamoeba dispar
LVKLKVICVRLMDQIIKADQKVK

SEQ ID NO: 2495957 - protein, 24 aa, Entamoeba dispar
LVKNKMFKWTLAKVSPRILFQMGI

SEQ ID NO: 2495958 - protein, 24 aa, Entamoeba dispar
LVKNSRIWLDTALNGNKKRIKTLV

SEQ ID NO: 2495959 - protein, 20 aa, Entamoeba dispar
LVKVMLSIKVPKNIIDKLCE

SEQ ID NO: 2495960 - protein, 19 aa, Entamoeba dispar
LVKVWDLEIQQCRQTIVGH

SEQ ID NO: 2495961 - protein, 17 aa, Entamoeba dispar
LVKYCLQTITPENVLLW

SEQ ID NO: 2495962 - protein, 17 aa, Entamoeba dispar
LVKYSSIHMMTLKNFAM

SEQ ID NO: 2495963 - protein, 19 aa, Entamoeba dispar
LVLFCKVPKTPSIEKSVKE

SEQ ID NO: 2495964 - protein, 25 aa, Entamoeba dispar
LVLLLRNGRNIPWDKDVFTAPVLRA

SEQ ID NO: 2495965 - protein, 17 aa, Entamoeba dispar
LVLNMKDAFIIREKAIK

SEQ ID NO: 2495966 - protein, 27 aa, Entamoeba dispar
LVLPNEERIRFVLGKPIYRAHLSLVAM

SEQ ID NO: 2495967 - protein, 18 aa, Entamoeba dispar
LVLRHILLDRGMIGEYIQ

SEQ ID NO: 2495968 - protein, 17 aa, Entamoeba dispar
LVLYLNYKREFYETFIK

SEQ ID NO: 2495969 - protein, 26 aa, Entamoeba dispar
LVMEFCPGGDLACLIREVGRLSEVTV

SEQ ID NO: 2495970 - protein, 20 aa, Entamoeba dispar
LVMEKIMGRIDLPFIQRIYN

SEQ ID NO: 2495971 - protein, 25 aa, Entamoeba dispar
LVNCEDCTFNIFSFKNKKVYIEESY

SEQ ID NO: 2495972 - protein, 29 aa, Entamoeba dispar
LVNEFNVFGWREIVDPNIIFYHDLNGYNI

SEQ ID NO: 2495973 - protein, 34 aa, Entamoeba dispar
LVNELPRYLTPQSPFHFYNLFSLYGSIIKVNVLS

SEQ ID NO: 2495974 - protein, 18 aa, Entamoeba dispar
LVNELVKHSTAINIIEES

SEQ ID NO: 2495975 - protein, 17 aa, Entamoeba dispar
LVNGVLLKSCGDSEETT

SEQ ID NO: 2495976 - protein, 25 aa, Entamoeba dispar
LVNGVVRKGKIVVVYPRKLNYLILL

SEQ ID NO: 2495977 - protein, 18 aa, Entamoeba dispar
LVNHSEKILPILSNFSLS

SEQ ID NO: 2495978 - protein, 24 aa, Entamoeba dispar
LVNSLRYNIQFPIILNELIIPFNG

SEQ ID NO: 2495979 - protein, 22 aa, Entamoeba dispar
LVPILSRLYVDIALNVKPICIT

SEQ ID NO: 2495980 - protein, 19 aa, Entamoeba dispar
LVPKILRFWCCDEKIINEN

SEQ ID NO: 2495981 - protein, 25 aa, Entamoeba dispar
LVPLKLRCGMYLPMEEMKKYGNKIL

SEQ ID NO: 2495982 - protein, 17 aa, Entamoeba dispar
LVPSGVLCIVFLTKDKI

SEQ ID NO: 2495983 - protein, 29 aa, Entamoeba dispar
LVQHEFNLIIPMLLSRTFSDSDIVEMLQE

SEQ ID NO: 2495984 - protein, 19 aa, Entamoeba dispar
LVQNIRFSFQVPYVSSSID

SEQ ID NO: 2495985 - protein, 24 aa, Entamoeba dispar
LVRKEDLFPLLIQFLQSEDPQYKI

SEQ ID NO: 2495986 - protein, 24 aa, Entamoeba dispar
LVRKTCGKWSPIEKVKVIICQKLY

SEQ ID NO: 2495987 - protein, 19 aa, Entamoeba dispar
LVRRKRSGAINVLQSRFIQ

SEQ ID NO: 2495988 - protein, 17 aa, Entamoeba dispar
LVRRSAVIVLSELIFHD

SEQ ID NO: 2495989 - protein, 17 aa, Entamoeba dispar
LVSCAKRIIKLKLVTSR

SEQ ID NO: 2495990 - protein, 26 aa, Entamoeba dispar
LVSDFLKFNYADGIFMLSPNPKQPNG

SEQ ID NO: 2495991 - protein, 24 aa, Entamoeba dispar
LVSELKSGCFSRRSSLTSIGIPPT

SEQ ID NO: 2495992 - protein, 24 aa, Entamoeba dispar
LVSFKSVEIELVFQMLEKLLNTYH

SEQ ID NO: 2495993 - protein, 17 aa, Entamoeba dispar
LVSGYKPRIDVTNACGR

SEQ ID NO: 2495994 - protein, 24 aa, Entamoeba dispar
LVSHIARFMFPRGCETKNALDLVI

SEQ ID NO: 2495995 - protein, 23 aa, Entamoeba dispar
LVSIKLKWGMEYKGVLVSRDAYM

SEQ ID NO: 2495996 - protein, 26 aa, Entamoeba dispar
LVSILQPYFAHWIVVFMDGFIKSIPL

SEQ ID NO: 2495997 - protein, 19 aa, Entamoeba dispar
LVSLSPRDVDLCLKAVEVL

SEQ ID NO: 2495998 - protein, 18 aa, Entamoeba dispar
LVSMVFGNRCHFIKSLGD

SEQ ID NO: 2495999 - protein, 22 aa, Entamoeba dispar
LVSRFDLWLNKYYPFGQLKLKE

SEQ ID NO: 2496000 - protein, 22 aa, Entamoeba dispar
LVSSGLKLQSIVSYNHLGNNDG

SEQ ID NO: 2496001 - protein, 19 aa, Entamoeba dispar
LVSSLIRIASRNDFEDLNE

SEQ ID NO: 2496002 - protein, 25 aa, Entamoeba dispar
LVSSYLFDLYELFFPLNDNSKKMQT

SEQ ID NO: 2496003 - protein, 18 aa, Entamoeba dispar
LVSTWSFGVILYRMITGY

SEQ ID NO: 2496004 - protein, 26 aa, Entamoeba dispar
LVSVTTMKGCVFLIGKVKGDNGFISC

SEQ ID NO: 2496005 - protein, 17 aa, Entamoeba dispar
LVTAARSKADFDSPTLG

SEQ ID NO: 2496006 - protein, 24 aa, Entamoeba dispar
LVTDCVLALLPLIQPFQWEGVVLP

SEQ ID NO: 2496007 - protein, 17 aa, Entamoeba dispar
LVTELSCDDAKATLTDK

SEQ ID NO: 2496008 - protein, 27 aa, Entamoeba dispar
LVTKNIKDALSFLPLLNYITLKHIIFH

SEQ ID NO: 2496009 - protein, 26 aa, Entamoeba dispar
LVTQNVCSFAFPLIKSTHSVFITSFP

SEQ ID NO: 2496010 - protein, 18 aa, Entamoeba dispar
LVTRLSNLTSLKCGKISQ

SEQ ID NO: 2496011 - protein, 19 aa, Entamoeba dispar
LVTSRSDFEIHWKTFINLK

SEQ ID NO: 2496012 - protein, 17 aa, Entamoeba dispar
LVTTVGVHPTRTNELKQ

SEQ ID NO: 2496013 - protein, 30 aa, Entamoeba dispar
LVVCVLGDTCGRDLSFLYKVHVLVHECTFG

SEQ ID NO: 2496014 - protein, 24 aa, Entamoeba dispar
LVVKFPATHPGDFVLLNNVVDKIN

SEQ ID NO: 2496015 - protein, 18 aa, Entamoeba dispar
LVVYDITKKTSFESVEKW

SEQ ID NO: 2496016 - protein, 24 aa, Entamoeba dispar
LVVYSEPFAVYGINLPNQAGATAE

SEQ ID NO: 2496017 - protein, 21 aa, Entamoeba dispar
LVVYSEPFYVYGVNLPNQSGA

SEQ ID NO: 2496018 - protein, 17 aa, Entamoeba dispar
LVYGMATHIIFSRRNSM

SEQ ID NO: 2496019 - protein, 25 aa, Entamoeba dispar
LVYHKGEVCGIDFNGSGTYIGTGAN

SEQ ID NO: 2496020 - protein, 18 aa, Entamoeba dispar
LVYLMNVVLFFPTYRDVY

SEQ ID NO: 2496021 - protein, 24 aa, Entamoeba dispar
LVYMYRSAYHYSLDNFYNTFQEIK

SEQ ID NO: 2496022 - protein, 26 aa, Entamoeba dispar
LVYSCVLAGCDYCKNISKVGIKKAMK

SEQ ID NO: 2496023 - protein, 19 aa, Entamoeba dispar
LVYSKGLVWHVSIVDILPN

SEQ ID NO: 2496024 - protein, 18 aa, Entamoeba dispar
LWARGSLKEIEIRLPKDE

SEQ ID NO: 2496025 - protein, 17 aa, Entamoeba dispar
LWDSRKLDHYFASSSNN

SEQ ID NO: 2496026 - protein, 18 aa, Entamoeba dispar
LWEGHVDGGAGWRMSDQG

SEQ ID NO: 2496027 - protein, 22 aa, Entamoeba dispar
LWEGKRQSFSFNSLTSERYVEE

SEQ ID NO: 2496028 - protein, 18 aa, Entamoeba dispar
LWEIKQIKSTEEENTILQ

SEQ ID NO: 2496029 - protein, 22 aa, Entamoeba dispar
LWERHPCEALYIFCKNDYTLTF

SEQ ID NO: 2496030 - protein, 18 aa, Entamoeba dispar
LWGDEIKNNIQFKEVVDR

SEQ ID NO: 2496031 - protein, 21 aa, Entamoeba dispar
LWINKNWTCGKVIDVICTEFG

SEQ ID NO: 2496032 - protein, 21 aa, Entamoeba dispar
LWKEAVLVFNAFHMKEDIKKC

SEQ ID NO: 2496033 - protein, 25 aa, Entamoeba dispar
LWKGVWKVVCGIIKEGSIEERKEYG

SEQ ID NO: 2496034 - protein, 17 aa, Entamoeba dispar
LWKILTIIYTNGIENIN

SEQ ID NO: 2496035 - protein, 17 aa, Entamoeba dispar
LWLEYTATRHPQMFPGF

SEQ ID NO: 2496036 - protein, 24 aa, Entamoeba dispar
LWLTNESMFDWALVHVDKKDMHYY

SEQ ID NO: 2496037 - protein, 22 aa, Entamoeba dispar
LWQELLKRDGLNLKWIRTNSRP

SEQ ID NO: 2496038 - protein, 30 aa, Entamoeba dispar
LWQLIDYDLRKTLGSMDCEGDVMKWVNTTL

SEQ ID NO: 2496039 - protein, 19 aa, Entamoeba dispar
LWQSSSPYRSLLLNEVIIP

SEQ ID NO: 2496040 - protein, 18 aa, Entamoeba dispar
LWQYIGIERHAQYGYYWM

SEQ ID NO: 2496041 - protein, 21 aa, Entamoeba dispar
LWRVVENGIEEWFQLKNFGDF

SEQ ID NO: 2496042 - protein, 20 aa, Entamoeba dispar
LWSLGCVFVELFSHTVLFHG

SEQ ID NO: 2496043 - protein, 19 aa, Entamoeba dispar
LWSSLPEHIQFYLKEITHG

SEQ ID NO: 2496044 - protein, 20 aa, Entamoeba dispar
LWSVCSSSDIGKALTLSLNE

SEQ ID NO: 2496045 - protein, 24 aa, Entamoeba dispar
LWTKNEFKGNLNIERAEEFINEKG

SEQ ID NO: 2496046 - protein, 23 aa, Entamoeba dispar
LWTPEGCKIREKMLYSATKATIK

SEQ ID NO: 2496047 - protein, 20 aa, Entamoeba dispar
LWVLHCIYQKVLISRSKTDA

SEQ ID NO: 2496048 - protein, 18 aa, Entamoeba dispar
LWYIFSFLRRVLEQQNIN

SEQ ID NO: 2496049 - protein, 17 aa, Entamoeba dispar
LWYIGEFLMEVVKNKEI

SEQ ID NO: 2496050 - protein, 19 aa, Entamoeba dispar
LYAILKAGVKIEITEIRGT

SEQ ID NO: 2496051 - protein, 19 aa, Entamoeba dispar
LYAILKAGVRIEITEIRGT

SEQ ID NO: 2496052 - protein, 25 aa, Entamoeba dispar
LYAIRKGKKVVIGFVNTPLFDFQNF

SEQ ID NO: 2496053 - protein, 17 aa, Entamoeba dispar
LYALGAFNQKGELTQRG

SEQ ID NO: 2496054 - protein, 29 aa, Entamoeba dispar
LYARDKWLIKGGLILPDKCTMHINGIEDQ

SEQ ID NO: 2496055 - protein, 19 aa, Entamoeba dispar
LYAYQRISGAFPVQDICSY

SEQ ID NO: 2496056 - protein, 18 aa, Entamoeba dispar
LYCCCKIKEDENDIIIFK

SEQ ID NO: 2496057 - protein, 18 aa, Entamoeba dispar
LYCGCCGKLYSTDSEGVL

SEQ ID NO: 2496058 - protein, 17 aa, Entamoeba dispar
LYCPCCNDIYIVPQQFA

SEQ ID NO: 2496059 - protein, 17 aa, Entamoeba dispar
LYCSINFVGESHEVLIP

SEQ ID NO: 2496060 - protein, 19 aa, Entamoeba dispar
LYCTVKAVLGVIDKIEVKR

SEQ ID NO: 2496061 - protein, 19 aa, Entamoeba dispar
LYCVDELFIENEICVNQED

SEQ ID NO: 2496062 - protein, 24 aa, Entamoeba dispar
LYDAGIKVGKGLMDGVLPVVGGAI

SEQ ID NO: 2496063 - protein, 26 aa, Entamoeba dispar
LYDCCLELPLNLIIPVLYFAFNNMLN

SEQ ID NO: 2496064 - protein, 26 aa, Entamoeba dispar
LYDEIKKFFIQYCGIEELNIWSKMEM

SEQ ID NO: 2496065 - protein, 30 aa, Entamoeba dispar
LYDEKKDLLGCGSFGKVYRGIVAGLPVAIK

SEQ ID NO: 2496066 - protein, 18 aa, Entamoeba dispar
LYDGRSFGNMKWEVFSIC

SEQ ID NO: 2496067 - protein, 23 aa, Entamoeba dispar
LYDHCYQCVKTFFEVTKSCHNLQ

SEQ ID NO: 2496068 - protein, 25 aa, Entamoeba dispar
LYDHKVYIGMEFCSGGTLKSMLKPR

SEQ ID NO: 2496069 - protein, 20 aa, Entamoeba dispar
LYDIIKFCEKSGLSIIEILP

SEQ ID NO: 2496070 - protein, 23 aa, Entamoeba dispar
LYDIPELKLVPYVSQKPISYKVQ

SEQ ID NO: 2496071 - protein, 24 aa, Entamoeba dispar
LYDKLKEMERILSPPSYIEDLNRI

SEQ ID NO: 2496072 - protein, 18 aa, Entamoeba dispar
LYDNLKFDTLIGEGLNES

SEQ ID NO: 2496073 - protein, 22 aa, Entamoeba dispar
LYDNSDMSAVHFINQKPITFNS

SEQ ID NO: 2496074 - protein, 19 aa, Entamoeba dispar
LYDNYNIIGPFLVIVPLST

SEQ ID NO: 2496075 - protein, 19 aa, Entamoeba dispar
LYDPKRIIGSNIRDISDED

SEQ ID NO: 2496076 - protein, 18 aa, Entamoeba dispar
LYDQCCPHSKDEEKDFMT

SEQ ID NO: 2496077 - protein, 21 aa, Entamoeba dispar
LYDRDHYKLALAQLSIAKKLV

SEQ ID NO: 2496078 - protein, 34 aa, Entamoeba dispar
LYEDGYCKKGKIGVTQPRRVACMSIARRVSEEIG

SEQ ID NO: 2496079 - protein, 23 aa, Entamoeba dispar
LYEECYPQYGKGEFARVDDKSGQ

SEQ ID NO: 2496080 - protein, 19 aa, Entamoeba dispar
LYEEIGIKPPKGVILYGPP

SEQ ID NO: 2496081 - protein, 18 aa, Entamoeba dispar
LYEGIDFYTSITRARFEE

SEQ ID NO: 2496082 - protein, 19 aa, Entamoeba dispar
LYEGRNVVVLTYAVDNLES

SEQ ID NO: 2496083 - protein, 18 aa, Entamoeba dispar
LYELYKILIQAIIIDEKI

SEQ ID NO: 2496084 - protein, 17 aa, Entamoeba dispar
LYERADALVGVARDLDK

SEQ ID NO: 2496085 - protein, 18 aa, Entamoeba dispar
LYERKVLVGINFELNIET

SEQ ID NO: 2496086 - protein, 32 aa, Entamoeba dispar
LYESITLPLLRPELFKKGSLTKRSKGILFFGP

SEQ ID NO: 2496087 - protein, 24 aa, Entamoeba dispar
LYESTRGWFGFGYQIPELSEEAIN

SEQ ID NO: 2496088 - protein, 18 aa, Entamoeba dispar
LYETPFFNEIVDMPSINQ

SEQ ID NO: 2496089 - protein, 20 aa, Entamoeba dispar
LYEYLIPKVDGIECKVQREM

SEQ ID NO: 2496090 - protein, 20 aa, Entamoeba dispar
LYFAQCGSIRSYIISNSNIK

SEQ ID NO: 2496091 - protein, 18 aa, Entamoeba dispar
LYFAYRFLALGTIEEKKI

SEQ ID NO: 2496092 - protein, 17 aa, Entamoeba dispar
LYFKELWEKSVEHKINN

SEQ ID NO: 2496093 - protein, 24 aa, Entamoeba dispar
LYFKPEKEYGIGSHSLCSIRLTPN

SEQ ID NO: 2496094 - protein, 17 aa, Entamoeba dispar
LYFNNCLLNPDDTIADL

SEQ ID NO: 2496095 - protein, 17 aa, Entamoeba dispar
LYFPESLLSRFDLIFII

SEQ ID NO: 2496096 - protein, 18 aa, Entamoeba dispar
LYGAISFLLEINGNKLTI

SEQ ID NO: 2496097 - protein, 18 aa, Entamoeba dispar
LYGCSVELFGNRFKDMGV

SEQ ID NO: 2496098 - protein, 17 aa, Entamoeba dispar
LYGHFFSKEAFLIQYTF

SEQ ID NO: 2496099 - protein, 17 aa, Entamoeba dispar
LYGLCPLLQNVFIYGES

SEQ ID NO: 2496100 - protein, 27 aa, Entamoeba dispar
LYGLELRFDSLFGIDIKDWIVSFIDHP

SEQ ID NO: 2496101 - protein, 20 aa, Entamoeba dispar
LYGNYLFSVIIRLDHTRYSK

SEQ ID NO: 2496102 - protein, 25 aa, Entamoeba dispar
LYGTSWKLLLKIICEKEKENNKESY

SEQ ID NO: 2496103 - protein, 17 aa, Entamoeba dispar
LYGTVSIVPCNKVCIIN

SEQ ID NO: 2496104 - protein, 17 aa, Entamoeba dispar
LYGVFEWAYSAQILLSF

SEQ ID NO: 2496105 - protein, 17 aa, Entamoeba dispar
LYGVFGMGESLEVAHLE

SEQ ID NO: 2496106 - protein, 19 aa, Entamoeba dispar
LYHGSRLTNFVGILSTGLR

SEQ ID NO: 2496107 - protein, 19 aa, Entamoeba dispar
LYHSHLCIVTELLGKNLYQ

SEQ ID NO: 2496108 - protein, 20 aa, Entamoeba dispar
LYIGIGSSWSRALLLEKSEE

SEQ ID NO: 2496109 - protein, 18 aa, Entamoeba dispar
LYIHSGIINAQKQNLVII

SEQ ID NO: 2496110 - protein, 25 aa, Entamoeba dispar
LYIKESIELINLIKVSSFCKEGVQM

SEQ ID NO: 2496111 - protein, 17 aa, Entamoeba dispar
LYINYDCDEYCTDFFQF

SEQ ID NO: 2496112 - protein, 21 aa, Entamoeba dispar
LYIPAVFCSIFGLSLDAKTPL

SEQ ID NO: 2496113 - protein, 17 aa, Entamoeba dispar
LYIPETFYESLFDESIF

SEQ ID NO: 2496114 - protein, 18 aa, Entamoeba dispar
LYIPISPLQLPTVIAPPF

SEQ ID NO: 2496115 - protein, 17 aa, Entamoeba dispar
LYIPPGKIVKEIIISIV

SEQ ID NO: 2496116 - protein, 20 aa, Entamoeba dispar
LYIPRHCSVTHTLIAADDHA

SEQ ID NO: 2496117 - protein, 19 aa, Entamoeba dispar
LYIRDFRTITHFFQVSKKC

SEQ ID NO: 2496118 - protein, 17 aa, Entamoeba dispar
LYIRPNKIYQVGNTPDA

SEQ ID NO: 2496119 - protein, 24 aa, Entamoeba dispar
LYKALKNYLPYFLINGNGNIQKLQ

SEQ ID NO: 2496120 - protein, 22 aa, Entamoeba dispar
LYKEIPPIIEIFNNFNGEKLPV

SEQ ID NO: 2496121 - protein, 17 aa, Entamoeba dispar
LYKIISHYLSKQGWELS

SEQ ID NO: 2496122 - protein, 20 aa, Entamoeba dispar
LYKKWNWTIPNGVKMDCVYS

SEQ ID NO: 2496123 - protein, 27 aa, Entamoeba dispar
LYKLNAELVYFNYFIPFPIPIDKNKKM

SEQ ID NO: 2496124 - protein, 19 aa, Entamoeba dispar
LYKQIGIDPPRGCLLYGPP

SEQ ID NO: 2496125 - protein, 18 aa, Entamoeba dispar
LYKSFVPEIDNFVNQPFF

SEQ ID NO: 2496126 - protein, 18 aa, Entamoeba dispar
LYKSYVLNWCNRYLDEIV

SEQ ID NO: 2496127 - protein, 31 aa, Entamoeba dispar
LYLDDLWYDTSLKVGDFIHLIFLEERTKNSL

SEQ ID NO: 2496128 - protein, 24 aa, Entamoeba dispar
LYLKNLKDVYSFLLISKKCKEALS

SEQ ID NO: 2496129 - protein, 20 aa, Entamoeba dispar
LYLLIGCIQYPMKLVCSKEY

SEQ ID NO: 2496130 - protein, 18 aa, Entamoeba dispar
LYLNDIIIRSVLEISGLL

SEQ ID NO: 2496131 - protein, 22 aa, Entamoeba dispar
LYLNDLVIRSVLDLSGLLTEKQ

SEQ ID NO: 2496132 - protein, 17 aa, Entamoeba dispar
LYLNYLFIIHGLNEYIG

SEQ ID NO: 2496133 - protein, 28 aa, Entamoeba dispar
LYLPFNELVELCLPLPSTLTELLLDNNK

SEQ ID NO: 2496134 - protein, 20 aa, Entamoeba dispar
LYLQLLRKIFKYNPRIGFDF

SEQ ID NO: 2496135 - protein, 19 aa, Entamoeba dispar
LYLRELPDSLIPKSMYNTF

SEQ ID NO: 2496136 - protein, 23 aa, Entamoeba dispar
LYLRSLPFPLLHPSKEYLGSISI

SEQ ID NO: 2496137 - protein, 17 aa, Entamoeba dispar
LYLSFFYDGIVDYSGNC

SEQ ID NO: 2496138 - protein, 18 aa, Entamoeba dispar
LYLSSLIKICCVGASLAQ

SEQ ID NO: 2496139 - protein, 25 aa, Entamoeba dispar
LYLTTYRIVLFESFSELVKMAISLL

SEQ ID NO: 2496140 - protein, 26 aa, Entamoeba dispar
LYLWFCCAPHGPSIKFFVENITTMSN

SEQ ID NO: 2496141 - protein, 25 aa, Entamoeba dispar
LYLYCFKLDSFICSFATYDKLNYIP

SEQ ID NO: 2496142 - protein, 24 aa, Entamoeba dispar
LYLYGCDDKSMIGLIAYRNDLIGG

SEQ ID NO: 2496143 - protein, 22 aa, Entamoeba dispar
LYNDHLECYSLIHDQRCEEQLE

SEQ ID NO: 2496144 - protein, 24 aa, Entamoeba dispar
LYNEYANRFLVDFAKNSLQEVLQN

SEQ ID NO: 2496145 - protein, 21 aa, Entamoeba dispar
LYNIRYSLDFIPPTRKINPHC

SEQ ID NO: 2496146 - protein, 23 aa, Entamoeba dispar
LYNKGCTTHGIFRETTNASIRDV

SEQ ID NO: 2496147 - protein, 23 aa, Entamoeba dispar
LYNKGCTTHGIFRETTNASTKGV

SEQ ID NO: 2496148 - protein, 19 aa, Entamoeba dispar
LYNKSIPSICYSRGNLMKK

SEQ ID NO: 2496149 - protein, 32 aa, Entamoeba dispar
LYNKSRFSLIYERLCKICEGISKHAPITKEIT

SEQ ID NO: 2496150 - protein, 18 aa, Entamoeba dispar
LYNLKLILRSDVREENVF

SEQ ID NO: 2496151 - protein, 23 aa, Entamoeba dispar
LYNNLWYKTMFQIKRDEDIKQWE

SEQ ID NO: 2496152 - protein, 19 aa, Entamoeba dispar
LYNYVAHHIELFKGKKVLE

SEQ ID NO: 2496153 - protein, 29 aa, Entamoeba dispar
LYPEECFDNFPVLCEILRAVTKKRCVTVG

SEQ ID NO: 2496154 - protein, 26 aa, Entamoeba dispar
LYPFRKMNCCLFCTQPFVSNKELELQ

SEQ ID NO: 2496155 - protein, 19 aa, Entamoeba dispar
LYPFTRHVFLSGGLAVGKT

SEQ ID NO: 2496156 - protein, 18 aa, Entamoeba dispar
LYPLPTIPSNLAIISSSL

SEQ ID NO: 2496157 - protein, 19 aa, Entamoeba dispar
LYPNEFIIFLGELFPPHIV

SEQ ID NO: 2496158 - protein, 22 aa, Entamoeba dispar
LYPNGVGIFISISAPGNLLLSN

SEQ ID NO: 2496159 - protein, 19 aa, Entamoeba dispar
LYPPKLRKGNNFSETTSCI

SEQ ID NO: 2496160 - protein, 21 aa, Entamoeba dispar
LYPQVFPLIKFTDTLGDFNNS

SEQ ID NO: 2496161 - protein, 24 aa, Entamoeba dispar
LYPSSKIYLIYLYKKNKLQHVDSN

SEQ ID NO: 2496162 - protein, 17 aa, Entamoeba dispar
LYQFGYNPFRLLPKPNG

SEQ ID NO: 2496163 - protein, 20 aa, Entamoeba dispar
LYQGEMIIAGIVIYHNRQVL

SEQ ID NO: 2496164 - protein, 31 aa, Entamoeba dispar
LYQILPTCDWEFEFPYFQLALCSVLSGNTLK

SEQ ID NO: 2496165 - protein, 19 aa, Entamoeba dispar
LYQKFLFNYLKIETHPEVR

SEQ ID NO: 2496166 - protein, 25 aa, Entamoeba dispar
LYQKYHWDIFASKSLLCIGPEEKSP

SEQ ID NO: 2496167 - protein, 26 aa, Entamoeba dispar
LYQKYHWDIFASKSLLCIGPEEKSPN

SEQ ID NO: 2496168 - protein, 18 aa, Entamoeba dispar
LYQLPPYLPLSLRTLLIN

SEQ ID NO: 2496169 - protein, 19 aa, Entamoeba dispar
LYQNCRSNDRIVLSLLSGL

SEQ ID NO: 2496170 - protein, 28 aa, Entamoeba dispar
LYQQSYKINNCWFCLSNSNSELKLIISC

SEQ ID NO: 2496171 - protein, 25 aa, Entamoeba dispar
LYQTELPEVLKGCQELISKHYETFK

SEQ ID NO: 2496172 - protein, 30 aa, Entamoeba dispar
LYRKMFIKHLWEVFTTSLFNFLWPPIIERN

SEQ ID NO: 2496173 - protein, 20 aa, Entamoeba dispar
LYRTLLLTIPKGGMKHLSRV

SEQ ID NO: 2496174 - protein, 18 aa, Entamoeba dispar
LYRWSLPIWVKEVKSTMS

SEQ ID NO: 2496175 - protein, 17 aa, Entamoeba dispar
LYSFRWVTLLFAQEFPI

SEQ ID NO: 2496176 - protein, 17 aa, Entamoeba dispar
LYSFSIEDFNAFTSHTT

SEQ ID NO: 2496177 - protein, 37 aa, Entamoeba dispar
LYSKCMYHSLLLIICRRGSYIFGVFVAESFEMKKDFY

SEQ ID NO: 2496178 - protein, 24 aa, Entamoeba dispar
LYSKLFKNECTIIRHIDIDDYIDV

SEQ ID NO: 2496179 - protein, 19 aa, Entamoeba dispar
LYSLFHIVWLQSFDEKLVE

SEQ ID NO: 2496180 - protein, 17 aa, Entamoeba dispar
LYSLGVILYQMATKEYP

SEQ ID NO: 2496181 - protein, 21 aa, Entamoeba dispar
LYSMEAFKVLLDPSVGGNEKF

SEQ ID NO: 2496182 - protein, 27 aa, Entamoeba dispar
LYSNISFIRKCCFDLTSENDYFLTQLE

SEQ ID NO: 2496183 - protein, 18 aa, Entamoeba dispar
LYSPDECFNQWTVIEKKY

SEQ ID NO: 2496184 - protein, 21 aa, Entamoeba dispar
LYSPEPSFWVSYTVSSDTPSL

SEQ ID NO: 2496185 - protein, 17 aa, Entamoeba dispar
LYSPLFFYTQTLISKND

SEQ ID NO: 2496186 - protein, 20 aa, Entamoeba dispar
LYSSEMRGLFGGDWRRSCIL

SEQ ID NO: 2496187 - protein, 18 aa, Entamoeba dispar
LYSSSSYCYSSLWEEEKH

SEQ ID NO: 2496188 - protein, 17 aa, Entamoeba dispar
LYSTCSIDISKEFYGLI

SEQ ID NO: 2496189 - protein, 24 aa, Entamoeba dispar
LYSTDSQWSPAFVVENQGDHFKIA

SEQ ID NO: 2496190 - protein, 18 aa, Entamoeba dispar
LYSVPQCIEKMNLICLDI

SEQ ID NO: 2496191 - protein, 17 aa, Entamoeba dispar
LYSYDFGQLGFKVEIHL

SEQ ID NO: 2496192 - protein, 24 aa, Entamoeba dispar
LYTCYYLRITHCPTLTTCTIPQTV

SEQ ID NO: 2496193 - protein, 18 aa, Entamoeba dispar
LYTEKGFNESLPKQTIPE

SEQ ID NO: 2496194 - protein, 20 aa, Entamoeba dispar
LYTICCGESNYIIIPEIKRA

SEQ ID NO: 2496195 - protein, 30 aa, Entamoeba dispar
LYTNIWNCPFCLMKSYYYDLFIDSRLKYYL

SEQ ID NO: 2496196 - protein, 30 aa, Entamoeba dispar
LYTNPDWKIRFQALSTFACLVVPNDDPITL

SEQ ID NO: 2496197 - protein, 20 aa, Entamoeba dispar
LYTSPECVINYLIPHISIDE

SEQ ID NO: 2496198 - protein, 19 aa, Entamoeba dispar
LYTTYGIPRFNEMIINRID

SEQ ID NO: 2496199 - protein, 19 aa, Entamoeba dispar
LYVCNCIRLTKLEPPQTVT

SEQ ID NO: 2496200 - protein, 18 aa, Entamoeba dispar
LYVDIALNVKPICITGYP

SEQ ID NO: 2496201 - protein, 17 aa, Entamoeba dispar
LYVKSSFYELRIFKERG

SEQ ID NO: 2496202 - protein, 24 aa, Entamoeba dispar
LYVLYCYYSTYPLSCSASVQLKAY

SEQ ID NO: 2496203 - protein, 26 aa, Entamoeba dispar
LYVLYSQGCLFRFIEKNDLSDLLILA

SEQ ID NO: 2496204 - protein, 23 aa, Entamoeba dispar
LYVMACGFPPFVEGENDGNRMLF

SEQ ID NO: 2496205 - protein, 18 aa, Entamoeba dispar
LYWKKGLLSSKHRVAMCQ

SEQ ID NO: 2496206 - protein, 20 aa, Entamoeba dispar
LYYEKEIEGAFRQCAGVTEM

SEQ ID NO: 2496207 - protein, 17 aa, Entamoeba dispar
LYYGGILSFDLSEGGPH

SEQ ID NO: 2496208 - protein, 25 aa, Entamoeba dispar
LYYGKYKLEMCFVKESSAVNITEPE

SEQ ID NO: 2496209 - protein, 36 aa, Entamoeba dispar
LYYHKKCICLSCYLKRCPKCDLCLEPITGSYVRTDK

SEQ ID NO: 2496210 - protein, 24 aa, Entamoeba dispar
LYYKFKTLIDILVNYYFTRQEELL

SEQ ID NO: 2496211 - protein, 17 aa, Entamoeba dispar
LYYKWNQKITNWVAYSI

SEQ ID NO: 2496212 - protein, 18 aa, Entamoeba dispar
LYYLLGEMHFHLGRRNEA

SEQ ID NO: 2496213 - protein, 24 aa, Entamoeba dispar
LYYPEYLWYPFLTLIISKLEQPNF

SEQ ID NO: 2496214 - protein, 18 aa, Entamoeba dispar
LYYPYLYEGEYNLFLSQL

SEQ ID NO: 2496215 - protein, 17 aa, Entamoeba dispar
LYYQSGLKKYLELFGSF

SEQ ID NO: 2496216 - protein, 22 aa, Entamoeba dispar
LYYRKCSERCVSLTHGEPLMEL

SEQ ID NO: 2496217 - protein, 17 aa, Entamoeba dispar
MAAIFSVFVFEPSNESQ

SEQ ID NO: 2496218 - protein, 18 aa, Entamoeba dispar
MAALSQCQPHYIRCIKPN

SEQ ID NO: 2496219 - protein, 23 aa, Entamoeba dispar
MACDLETLLYCPSKLPESLKIEL

SEQ ID NO: 2496220 - protein, 25 aa, Entamoeba dispar
MADWPINDFRMFVGNLGKEVDDTML

SEQ ID NO: 2496221 - protein, 17 aa, Entamoeba dispar
MAECIAGVHHLKPNLKK

SEQ ID NO: 2496222 - protein, 26 aa, Entamoeba dispar
MAEYIKVVICKKCYNCTRRKTEDTRV

SEQ ID NO: 2496223 - protein, 23 aa, Entamoeba dispar
MAFWKRKSSGIINDEEINEEERL

SEQ ID NO: 2496224 - protein, 29 aa, Entamoeba dispar
MAHISRFCARFLGDYGFSIGISDVTPSAD

SEQ ID NO: 2496225 - protein, 18 aa, Entamoeba dispar
MAHRASLKFMKYTGCTAV

SEQ ID NO: 2496226 - protein, 18 aa, Entamoeba dispar
MAIDCASGMAYLESLKIV

SEQ ID NO: 2496227 - protein, 21 aa, Entamoeba dispar
MAIDPFCILHLVHIGLLSSLN

SEQ ID NO: 2496228 - protein, 19 aa, Entamoeba dispar
MAKEVIKYLYKVDMTDMKI

SEQ ID NO: 2496229 - protein, 25 aa, Entamoeba dispar
MAKLWDIRMENCVATFTGHDADINA

SEQ ID NO: 2496230 - protein, 17 aa, Entamoeba dispar
MAKRLTAFSKTCQSLLN

SEQ ID NO: 2496231 - protein, 17 aa, Entamoeba dispar
MAKRPPRGFTEPVAVML

SEQ ID NO: 2496232 - protein, 25 aa, Entamoeba dispar
MALGSLPGIIPFLFEKLQKKKSFFL

SEQ ID NO: 2496233 - protein, 17 aa, Entamoeba dispar
MALKKCIITSKNEKSLI

SEQ ID NO: 2496234 - protein, 21 aa, Entamoeba dispar
MALLSQYGIKFIIQSPRKSSD

SEQ ID NO: 2496235 - protein, 19 aa, Entamoeba dispar
MALPQYKDVVCNLFSSWNS

SEQ ID NO: 2496236 - protein, 20 aa, Entamoeba dispar
MAQQYMVLSTLGFEASIHWM

SEQ ID NO: 2496237 - protein, 19 aa, Entamoeba dispar
MARAEAMTPPYVKFDKTEA

SEQ ID NO: 2496238 - protein, 18 aa, Entamoeba dispar
MARHCKRVTILEKDMLLA

SEQ ID NO: 2496239 - protein, 17 aa, Entamoeba dispar
MASKFVIEKNRKFLKEY

SEQ ID NO: 2496240 - protein, 18 aa, Entamoeba dispar
MAVLSSWRMKGFIDQKEE

SEQ ID NO: 2496241 - protein, 23 aa, Entamoeba dispar
MAYEIKDGSVFVFDFGGGTLDIS

SEQ ID NO: 2496242 - protein, 18 aa, Entamoeba dispar
MCELFKNKEKVQCPFCRT

SEQ ID NO: 2496243 - protein, 18 aa, Entamoeba dispar
MCEYMTFLLECHSKYNIK

SEQ ID NO: 2496244 - protein, 17 aa, Entamoeba dispar
MCFNNCISLTNMNIINL

SEQ ID NO: 2496245 - protein, 17 aa, Entamoeba dispar
MCGTPMYVSPELLNGQS

SEQ ID NO: 2496246 - protein, 20 aa, Entamoeba dispar
MCHGCNRYYHEKCLSAYVSI

SEQ ID NO: 2496247 - protein, 18 aa, Entamoeba dispar
MCILPNGKQIWININKDD

SEQ ID NO: 2496248 - protein, 26 aa, Entamoeba dispar
MCLQLKRLYAKLLFQSSGIGSIKKNF

SEQ ID NO: 2496249 - protein, 20 aa, Entamoeba dispar
MCMIEIFKKIHSTWLGVQLL

SEQ ID NO: 2496250 - protein, 20 aa, Entamoeba dispar
MCPIKNLIVRYIIREYILDN

SEQ ID NO: 2496251 - protein, 24 aa, Entamoeba dispar
MCQHLSVLRLRKLEAITKDELINW

SEQ ID NO: 2496252 - protein, 18 aa, Entamoeba dispar
MCSATIREITLLKMINHP

SEQ ID NO: 2496253 - protein, 18 aa, Entamoeba dispar
MDCSALVTRLSNLTSLKC

SEQ ID NO: 2496254 - protein, 17 aa, Entamoeba dispar
MDCTYYVIDWMKKNEYI

SEQ ID NO: 2496255 - protein, 23 aa, Entamoeba dispar
MDDIKLVFVHKSMRTEKVLDAIV

SEQ ID NO: 2496256 - protein, 23 aa, Entamoeba dispar
MDDPCLFDFGYGSSRVYVHKPTS

SEQ ID NO: 2496257 - protein, 23 aa, Entamoeba dispar
MDDRCCVKVIDFGLVVRKSSQPQ

SEQ ID NO: 2496258 - protein, 24 aa, Entamoeba dispar
MDDVTRLLCLPGYEGDIKSQYFIG

SEQ ID NO: 2496259 - protein, 25 aa, Entamoeba dispar
MDDYKQCVWLLIGIKDLGGKIRKSG

SEQ ID NO: 2496260 - protein, 17 aa, Entamoeba dispar
MDECMEIFDQKIQEKIE

SEQ ID NO: 2496261 - protein, 26 aa, Entamoeba dispar
MDEIDEFCHLYFLKKREMAIMLPDLY

SEQ ID NO: 2496262 - protein, 23 aa, Entamoeba dispar
MDERIVRVIRQCLGSSNLKIKQA

SEQ ID NO: 2496263 - protein, 26 aa, Entamoeba dispar
MDFSLDGRYCYGWGKSISIIELESGS

SEQ ID NO: 2496264 - protein, 27 aa, Entamoeba dispar
MDKDNCFHCVLNLICVDAANAIQPTLN

SEQ ID NO: 2496265 - protein, 17 aa, Entamoeba dispar
MDKRIFSQCKHIVGKGV

SEQ ID NO: 2496266 - protein, 17 aa, Entamoeba dispar
MDLFMKLQRTIIEQQSD

SEQ ID NO: 2496267 - protein, 17 aa, Entamoeba dispar
MDLLRLHGYFYNSYYSS

SEQ ID NO: 2496268 - protein, 23 aa, Entamoeba dispar
MDLNNWVACAAFVLQSRAIYQDL

SEQ ID NO: 2496269 - protein, 21 aa, Entamoeba dispar
MDLYCISKALLPSLLLYPKIY

SEQ ID NO: 2496270 - protein, 24 aa, Entamoeba dispar
MDLYCISKALLPSLLLYPKIYHHL

SEQ ID NO: 2496271 - protein, 17 aa, Entamoeba dispar
MDMCGVGSVKDLMKKTM

SEQ ID NO: 2496272 - protein, 19 aa, Entamoeba dispar
MDMGYEVLVVSQFTLYAIL

SEQ ID NO: 2496273 - protein, 22 aa, Entamoeba dispar
MDNKFIKGRIVHVTYAKADPYS

SEQ ID NO: 2496274 - protein, 19 aa, Entamoeba dispar
MDNYIVGLTNKYGWNIHQN

SEQ ID NO: 2496275 - protein, 23 aa, Entamoeba dispar
MDPCTDCKLDGYGGHTTDIRIVC

SEQ ID NO: 2496276 - protein, 20 aa, Entamoeba dispar
MDSMARKVAIQTLMETTKSQ

SEQ ID NO: 2496277 - protein, 19 aa, Entamoeba dispar
MDTFCKLAHMFGTKLVDCV

SEQ ID NO: 2496278 - protein, 18 aa, Entamoeba dispar
MDTFPFPHYIILHDLNTL

SEQ ID NO: 2496279 - protein, 20 aa, Entamoeba dispar
MDTFPFPHYIILHDLNTLPN

SEQ ID NO: 2496280 - protein, 28 aa, Entamoeba dispar
MDVEKRVGVDILRLFSEYDFFRNDQVRE

SEQ ID NO: 2496281 - protein, 26 aa, Entamoeba dispar
MDVGYQCLFLRTSSSSLYCFDLNTNQ

SEQ ID NO: 2496282 - protein, 19 aa, Entamoeba dispar
MDVLNVWDAIFAYGNNLEF

SEQ ID NO: 2496283 - protein, 17 aa, Entamoeba dispar
MDVQCEWILPTTITELS

SEQ ID NO: 2496284 - protein, 18 aa, Entamoeba dispar
MDVQCEWILPTTITELSA

SEQ ID NO: 2496285 - protein, 27 aa, Entamoeba dispar
MEAEGVPICEWPMWINSQIEHTETRPL

SEQ ID NO: 2496286 - protein, 21 aa, Entamoeba dispar
MEALTALTLLSFVGAAKPSLI

SEQ ID NO: 2496287 - protein, 20 aa, Entamoeba dispar
MEARMMKAFDEVAKKPRMPK

SEQ ID NO: 2496288 - protein, 24 aa, Entamoeba dispar
MEAVIRGFLIRRELSINNLLQRKN

SEQ ID NO: 2496289 - protein, 25 aa, Entamoeba dispar
MEAVWKIKVEDLLAFVLVDDKGNDF

SEQ ID NO: 2496290 - protein, 24 aa, Entamoeba dispar
MECEQCALQSCLNHQTELIKSKKL

SEQ ID NO: 2496291 - protein, 22 aa, Entamoeba dispar
MEDAICLSAVMLGKPHDDYSGD

SEQ ID NO: 2496292 - protein, 19 aa, Entamoeba dispar
MEDTCCVYETNIPFMEVIG

SEQ ID NO: 2496293 - protein, 17 aa, Entamoeba dispar
MEFEQSPIDKHCDAIIS

SEQ ID NO: 2496294 - protein, 17 aa, Entamoeba dispar
MEFKYIIGEAFLIKNYP

SEQ ID NO: 2496295 - protein, 21 aa, Entamoeba dispar
MEFQKFLFKLLHVTSDFNFQG

SEQ ID NO: 2496296 - protein, 22 aa, Entamoeba dispar
MEGMAPPSYPIFFDELYNKSSK

SEQ ID NO: 2496297 - protein, 25 aa, Entamoeba dispar
MEHKLFSEWTFWFDGFSNKSTETYG

SEQ ID NO: 2496298 - protein, 26 aa, Entamoeba dispar
MEHLGFKEQLAFLVEDAYECFESIWK

SEQ ID NO: 2496299 - protein, 22 aa, Entamoeba dispar
MEHVKLCGLAVSLGTLDTLIEH

SEQ ID NO: 2496300 - protein, 20 aa, Entamoeba dispar
MEIDSTFNFDNKKEEEYVDN

SEQ ID NO: 2496301 - protein, 19 aa, Entamoeba dispar
MEIHNMLCIYFDEWFENFH

SEQ ID NO: 2496302 - protein, 18 aa, Entamoeba dispar
MEKCKPKNDKFVVKREHF

SEQ ID NO: 2496303 - protein, 34 aa, Entamoeba dispar
MEKEKMAVPFLLRCCSDCANALLYLSQHNIIHRN

SEQ ID NO: 2496304 - protein, 20 aa, Entamoeba dispar
MEKGKAIELSKMIGKERGGV

SEQ ID NO: 2496305 - protein, 25 aa, Entamoeba dispar
MEKKWRFSNKYNKWVIQTPNGWMEF

SEQ ID NO: 2496306 - protein, 21 aa, Entamoeba dispar
MEKLIAAGIMKQSDLPIEEIL

SEQ ID NO: 2496307 - protein, 20 aa, Entamoeba dispar
MEKRCLEHCVSLKSLVIPSS

SEQ ID NO: 2496308 - protein, 22 aa, Entamoeba dispar
MEKRLPPSTFKTIKKLLINGGS

SEQ ID NO: 2496309 - protein, 23 aa, Entamoeba dispar
MEKRPRLSAEFKDAEEVTLSPLK

SEQ ID NO: 2496310 - protein, 21 aa, Entamoeba dispar
MEKRQALLILCESYKECIDES

SEQ ID NO: 2496311 - protein, 26 aa, Entamoeba dispar
MEKRTKILGQRRLDMDAAHDKYESIA

SEQ ID NO: 2496312 - protein, 20 aa, Entamoeba dispar
MEKSCDSIEEIMRNTVNIIF

SEQ ID NO: 2496313 - protein, 35 aa, Entamoeba dispar
MEKVMYEMYVIFFIRKGRTSTHFSYNVKKNGVDIG

SEQ ID NO: 2496314 - protein, 21 aa, Entamoeba dispar
MELAVPNWEWLICVSSKVMGN

SEQ ID NO: 2496315 - protein, 26 aa, Entamoeba dispar
MELCEKLRIVLEPSLASQMKGDYRTG

SEQ ID NO: 2496316 - protein, 27 aa, Entamoeba dispar
MELCHKSAEIIRMFPTDISEQFCRFMV

SEQ ID NO: 2496317 - protein, 19 aa, Entamoeba dispar
MELDNCVVSLTLRDTCGQE

SEQ ID NO: 2496318 - protein, 30 aa, Entamoeba dispar
MELECIIITGSLFRKEIFTVLQKKFIEEGS

SEQ ID NO: 2496319 - protein, 18 aa, Entamoeba dispar
MELPLKFIDITSCDALTC

SEQ ID NO: 2496320 - protein, 18 aa, Entamoeba dispar
MELSGKTAFLAKLLAFLR

SEQ ID NO: 2496321 - protein, 27 aa, Entamoeba dispar
MELVRAIKESVCYVALDYEAEMKKKAK

SEQ ID NO: 2496322 - protein, 17 aa, Entamoeba dispar
MEMCMHRLMSWIKVEDN

SEQ ID NO: 2496323 - protein, 21 aa, Entamoeba dispar
MEMLGLLYIWVLKNLNKEMLK

SEQ ID NO: 2496324 - protein, 18 aa, Entamoeba dispar
MEMNRLSFIKSIEGRNDI

SEQ ID NO: 2496325 - protein, 25 aa, Entamoeba dispar
MEMWGGATFDVCYSFLHESPWERLR

SEQ ID NO: 2496326 - protein, 17 aa, Entamoeba dispar
MENGLKVAKFLEQHEKI

SEQ ID NO: 2496327 - protein, 17 aa, Entamoeba dispar
MENGLLTQMIWKEILRN

SEQ ID NO: 2496328 - protein, 36 aa, Entamoeba dispar
MENLAVKADNKFCFDCGKGGATFVVSNFNIFVCPTC

SEQ ID NO: 2496329 - protein, 24 aa, Entamoeba dispar
MEPEIAHGLELISFHSISKGFYGE

SEQ ID NO: 2496330 - protein, 27 aa, Entamoeba dispar
MEQFIDLCILLGCDYCDTIKGVGPITA

SEQ ID NO: 2496331 - protein, 17 aa, Entamoeba dispar
MEQTIDILLSFTDNTPT

SEQ ID NO: 2496332 - protein, 17 aa, Entamoeba dispar
MESLKIVPISKASADQR

SEQ ID NO: 2496333 - protein, 19 aa, Entamoeba dispar
MESRMMKAFNEIEKKPRKP

SEQ ID NO: 2496334 - protein, 19 aa, Entamoeba dispar
MESVWPYQFAKTRTHKFRE

SEQ ID NO: 2496335 - protein, 19 aa, Entamoeba dispar
METIELFLYISEKFIKQET

SEQ ID NO: 2496336 - protein, 26 aa, Entamoeba dispar
METKSLITHYKFGVIYVKPDQTEENA

SEQ ID NO: 2496337 - protein, 17 aa, Entamoeba dispar
METNSMIDFLGDVLRDV

SEQ ID NO: 2496338 - protein, 17 aa, Entamoeba dispar
MEYCPGGDLATLLEHIG

SEQ ID NO: 2496339 - protein, 18 aa, Entamoeba dispar
MEYCTGGDLSKIIKNKEL

SEQ ID NO: 2496340 - protein, 20 aa, Entamoeba dispar
MEYCVVKYAKSLLCNPTLAT

SEQ ID NO: 2496341 - protein, 18 aa, Entamoeba dispar
MEYFKISSQTGVGVEEVM

SEQ ID NO: 2496342 - protein, 26 aa, Entamoeba dispar
MEYIGLKGQHCYGCMGMGIPNVIYHH

SEQ ID NO: 2496343 - protein, 18 aa, Entamoeba dispar
MEYLGGLFYGVKVEKERF

SEQ ID NO: 2496344 - protein, 26 aa, Entamoeba dispar
MEYVKQYGMCWEVIHDRLVVYNEFRL

SEQ ID NO: 2496345 - protein, 17 aa, Entamoeba dispar
MFASKMKAYGSTIDAIY

SEQ ID NO: 2496346 - protein, 20 aa, Entamoeba dispar
MFAVEKVRLIGLTKAARFLQ

SEQ ID NO: 2496347 - protein, 21 aa, Entamoeba dispar
MFCDIKEICLCTDSQGIGIIK

SEQ ID NO: 2496348 - protein, 17 aa, Entamoeba dispar
MFCSCGMDLSPNSISSE

SEQ ID NO: 2496349 - protein, 17 aa, Entamoeba dispar
MFDKIWINNNQKFSLIR

SEQ ID NO: 2496350 - protein, 24 aa, Entamoeba dispar
MFDLTLRLVEDVLFAASKRSDNNL

SEQ ID NO: 2496351 - protein, 22 aa, Entamoeba dispar
MFDQFTIRWVHYKLIDKKLDEL

SEQ ID NO: 2496352 - protein, 26 aa, Entamoeba dispar
MFEYQRIGVQFGLRKKGRLLIGDEMG

SEQ ID NO: 2496353 - protein, 24 aa, Entamoeba dispar
MFFAFAAPMILCLCEALNEDIKNG

SEQ ID NO: 2496354 - protein, 34 aa, Entamoeba dispar
MFHKVRASFHLPHSSCVAVLLPHTIRYNGQKPRK

SEQ ID NO: 2496355 - protein, 18 aa, Entamoeba dispar
MFHQERFKKSSFGTLSYI

SEQ ID NO: 2496356 - protein, 18 aa, Entamoeba dispar
MFIDFNIVDWNCTRNYIT

SEQ ID NO: 2496357 - protein, 19 aa, Entamoeba dispar
MFIKPSSDESIIFDMCDVL

SEQ ID NO: 2496358 - protein, 17 aa, Entamoeba dispar
MFKCHGATFEKAVDDAC

SEQ ID NO: 2496359 - protein, 19 aa, Entamoeba dispar
MFKKPVCLNQQDILKIGKR

SEQ ID NO: 2496360 - protein, 19 aa, Entamoeba dispar
MFLMFCAPGEVQIVDNIIE

SEQ ID NO: 2496361 - protein, 31 aa, Entamoeba dispar
MFLTVLRLDSLNLFSKFPYIELLALPDDIEM

SEQ ID NO: 2496362 - protein, 23 aa, Entamoeba dispar
MFMECPEMFVSMITNPVMDDQTT

SEQ ID NO: 2496363 - protein, 19 aa, Entamoeba dispar
MFNKCVLALEEIRKSRGLC

SEQ ID NO: 2496364 - protein, 30 aa, Entamoeba dispar
MFNKCVLALEEIRKSSGLCQNYSIIKDRYP

SEQ ID NO: 2496365 - protein, 22 aa, Entamoeba dispar
MFNKNPRWILFYELVLTTKEYV

SEQ ID NO: 2496366 - protein, 21 aa, Entamoeba dispar
MFPMAPSFPPVVFPSHEEKEK

SEQ ID NO: 2496367 - protein, 24 aa, Entamoeba dispar
MFQSRPVVRPHVKSTVRHDIPAET

SEQ ID NO: 2496368 - protein, 26 aa, Entamoeba dispar
MFSCKNEWLLTFGYSVRWPEKSDIAI

SEQ ID NO: 2496369 - protein, 25 aa, Entamoeba dispar
MFSERYIQEAICFHYTISKLICEAF

SEQ ID NO: 2496370 - protein, 18 aa, Entamoeba dispar
MFSNFNLLIQCWDITRLL

SEQ ID NO: 2496371 - protein, 19 aa, Entamoeba dispar
MFSNICIMNNDYLIEGKLE

SEQ ID NO: 2496372 - protein, 22 aa, Entamoeba dispar
MFSPRSRSEMRFREKRREEEQE

SEQ ID NO: 2496373 - protein, 33 aa, Entamoeba dispar
MFVECTRLVSNLCLFTPKPSYSIFTQFAEYLIY

SEQ ID NO: 2496374 - protein, 18 aa, Entamoeba dispar
MFVIFNIQDIIGLRDYYI

SEQ ID NO: 2496375 - protein, 20 aa, Entamoeba dispar
MFYCAPELYLNQINENSDIW

SEQ ID NO: 2496376 - protein, 18 aa, Entamoeba dispar
MFYDCTSLTAISIPNSVT

SEQ ID NO: 2496377 - protein, 21 aa, Entamoeba dispar
MGAICKVFLAELVSETQKVRD

SEQ ID NO: 2496378 - protein, 24 aa, Entamoeba dispar
MGAIDCLRQLITMFGDMKEESCQN

SEQ ID NO: 2496379 - protein, 19 aa, Entamoeba dispar
MGAPLKIFIPVTIITSQDN

SEQ ID NO: 2496380 - protein, 22 aa, Entamoeba dispar
MGCSSLRPISFELKKSIKKVGK

SEQ ID NO: 2496381 - protein, 19 aa, Entamoeba dispar
MGDSYLAIDVIVMSLMEEK

SEQ ID NO: 2496382 - protein, 17 aa, Entamoeba dispar
MGELITIEEYLTKFELS

SEQ ID NO: 2496383 - protein, 20 aa, Entamoeba dispar
MGFEFSRPQLRAETEKELTK

SEQ ID NO: 2496384 - protein, 23 aa, Entamoeba dispar
MGFPDYICIFALKKYKWNVEESI

SEQ ID NO: 2496385 - protein, 17 aa, Entamoeba dispar
MGGKGSTQFSIFEDLCI

SEQ ID NO: 2496386 - protein, 19 aa, Entamoeba dispar
MGGMPSRGAPRGMPSRGAP

SEQ ID NO: 2496387 - protein, 19 aa, Entamoeba dispar
MGGNPLMAAIAARANRGGS

SEQ ID NO: 2496388 - protein, 18 aa, Entamoeba dispar
MGHFELRFYTKFKQLKNK

SEQ ID NO: 2496389 - protein, 18 aa, Entamoeba dispar
MGHKSSVEDLQWSPNEAD

SEQ ID NO: 2496390 - protein, 17 aa, Entamoeba dispar
MGIDKPDVRFVIHHSLP

SEQ ID NO: 2496391 - protein, 19 aa, Entamoeba dispar
MGIFKGKEVLLKKMVGNVS

SEQ ID NO: 2496392 - protein, 26 aa, Entamoeba dispar
MGIGAPRLVGFMSLGGGNVQQTVQTL

SEQ ID NO: 2496393 - protein, 19 aa, Entamoeba dispar
MGISLNFCIESIFMLINIY

SEQ ID NO: 2496394 - protein, 27 aa, Entamoeba dispar
MGKAGAHSIGILDIAGFEIFRENSFEQ

SEQ ID NO: 2496395 - protein, 21 aa, Entamoeba dispar
MGKIRLIRFYNHIKEEEQQKI

SEQ ID NO: 2496396 - protein, 25 aa, Entamoeba dispar
MGKPYRLSYKMAENVILKHNNDTTL

SEQ ID NO: 2496397 - protein, 32 aa, Entamoeba dispar
MGLEVWQVRKAICDKMKFLGIELDNSLNEKSM

SEQ ID NO: 2496398 - protein, 25 aa, Entamoeba dispar
MGLLLNELFPGFGFEKKKTGINKEG

SEQ ID NO: 2496399 - protein, 28 aa, Entamoeba dispar
MGLTDHEVIEFLKFSAYHKIIDYVISLE

SEQ ID NO: 2496400 - protein, 25 aa, Entamoeba dispar
MGLVEAFIIRMGKKYQLVAHQLIWN

SEQ ID NO: 2496401 - protein, 17 aa, Entamoeba dispar
MGMCSELYITTHHYSRV

SEQ ID NO: 2496402 - protein, 22 aa, Entamoeba dispar
MGMKEFKEKLFSNELQESIRGM

SEQ ID NO: 2496403 - protein, 18 aa, Entamoeba dispar
MGMVVVRNGTHYGIAGYY

SEQ ID NO: 2496404 - protein, 17 aa, Entamoeba dispar
MGNDCFKECYSLISINK

SEQ ID NO: 2496405 - protein, 32 aa, Entamoeba dispar
MGNGIEVFCGLAFAETTGFCCLNREKNLQIDT

SEQ ID NO: 2496406 - protein, 20 aa, Entamoeba dispar
MGNSCFEECLSLTSINIPST

SEQ ID NO: 2496407 - protein, 27 aa, Entamoeba dispar
MGPGKRLRPLSLLLFFIGGGGKIEERK

SEQ ID NO: 2496408 - protein, 19 aa, Entamoeba dispar
MGPLFKMYADYCMNYHESD

SEQ ID NO: 2496409 - protein, 20 aa, Entamoeba dispar
MGRTHLQDAVPIRFSQELRA

SEQ ID NO: 2496410 - protein, 18 aa, Entamoeba dispar
MGSYFCVVLSKGKLYSWG

SEQ ID NO: 2496411 - protein, 17 aa, Entamoeba dispar
MGVCKITESTLVNSDGK

SEQ ID NO: 2496412 - protein, 22 aa, Entamoeba dispar
MGVDIIKSRMNKLMINEQQACR

SEQ ID NO: 2496413 - protein, 17 aa, Entamoeba dispar
MGVQLGFVGMAKFVREY

SEQ ID NO: 2496414 - protein, 23 aa, Entamoeba dispar
MGYIRTLLKYFFDKFDRTGAGTF

SEQ ID NO: 2496415 - protein, 20 aa, Entamoeba dispar
MGYPAEGIESYYRNNMVDVA

SEQ ID NO: 2496416 - protein, 20 aa, Entamoeba dispar
MHCKERGIHVAGEINELCNI

SEQ ID NO: 2496417 - protein, 19 aa, Entamoeba dispar
MHHICMMRAKMAKYQRELL

SEQ ID NO: 2496418 - protein, 20 aa, Entamoeba dispar
MHHICMMRAKMAKYQRELLA

SEQ ID NO: 2496419 - protein, 20 aa, Entamoeba dispar
MHHRFELHKIFSFDKTNTGK

SEQ ID NO: 2496420 - protein, 25 aa, Entamoeba dispar
MHLDLKPSNIFIFSLNPLDSVVAKL

SEQ ID NO: 2496421 - protein, 25 aa, Entamoeba dispar
MHLKIVCGNLFFKDSQPMFWEVACI

SEQ ID NO: 2496422 - protein, 25 aa, Entamoeba dispar
MHLYGPAMLACFPLQDILSLKLKYI

SEQ ID NO: 2496423 - protein, 21 aa, Entamoeba dispar
MHMICRDCLFQVIIAQTSRQE

SEQ ID NO: 2496424 - protein, 19 aa, Entamoeba dispar
MHPTLLGDFYFKGKELYPN

SEQ ID NO: 2496425 - protein, 28 aa, Entamoeba dispar
MHRRALVILLCWTLNIPYSKASEIDPKN

SEQ ID NO: 2496426 - protein, 20 aa, Entamoeba dispar
MHSYFPSFSCEVIKGQTPTL

SEQ ID NO: 2496427 - protein, 17 aa, Entamoeba dispar
MHTAELVFTEFMFCVKL

SEQ ID NO: 2496428 - protein, 20 aa, Entamoeba dispar
MHTFCSLTGLSLIGALPVKY

SEQ ID NO: 2496429 - protein, 19 aa, Entamoeba dispar
MIAGAFDLIHPGHIHYIQE

SEQ ID NO: 2496430 - protein, 24 aa, Entamoeba dispar
MICFSRRQNCCGAFQKENINEDKF

SEQ ID NO: 2496431 - protein, 24 aa, Entamoeba dispar
MICHILCCSPLHFGISVSGLLVQD

SEQ ID NO: 2496432 - protein, 20 aa, Entamoeba dispar
MICLSYRPSISLKKLKDDLC

SEQ ID NO: 2496433 - protein, 20 aa, Entamoeba dispar
MIDCCKGMTMMHSFNIIHRD

SEQ ID NO: 2496434 - protein, 17 aa, Entamoeba dispar
MIDEAKLSYTLGKKSAS

SEQ ID NO: 2496435 - protein, 18 aa, Entamoeba dispar
MIDHLERAIKCERFTRGP

SEQ ID NO: 2496436 - protein, 17 aa, Entamoeba dispar
MIDLRVQIMQDDGSVTA

SEQ ID NO: 2496437 - protein, 20 aa, Entamoeba dispar
MIDMKAIEIDDALRLMFDTF

SEQ ID NO: 2496438 - protein, 24 aa, Entamoeba dispar
MIDNKCAPAAIVLCEAAMKCNNYK

SEQ ID NO: 2496439 - protein, 19 aa, Entamoeba dispar
MIDVYKNMVIMSIADGCGM

SEQ ID NO: 2496440 - protein, 17 aa, Entamoeba dispar
MIEEFKKKLKEINDNGK

SEQ ID NO: 2496441 - protein, 18 aa, Entamoeba dispar
MIEFCNRVMDIYDLALND

SEQ ID NO: 2496442 - protein, 17 aa, Entamoeba dispar
MIEHQVGREELYSQPIL

SEQ ID NO: 2496443 - protein, 24 aa, Entamoeba dispar
MIENKRPQELFYYNSKNTSRNETK

SEQ ID NO: 2496444 - protein, 26 aa, Entamoeba dispar
MIEPVVDINTAFTLIETWKNVSESTY

SEQ ID NO: 2496445 - protein, 19 aa, Entamoeba dispar
MIERQRLLGAGFIFSASAP

SEQ ID NO: 2496446 - protein, 17 aa, Entamoeba dispar
MIFEFICGVPPFHEETP

SEQ ID NO: 2496447 - protein, 22 aa, Entamoeba dispar
MIFLAVRFSTLGWDKINDKYFV

SEQ ID NO: 2496448 - protein, 22 aa, Entamoeba dispar
MIGCSVCSLYSGMEMSQRLRNI

SEQ ID NO: 2496449 - protein, 17 aa, Entamoeba dispar
MIGDLPFAEIKPPENVL

SEQ ID NO: 2496450 - protein, 24 aa, Entamoeba dispar
MIGLCVIMAQIGMFIPCSEADISI

SEQ ID NO: 2496451 - protein, 23 aa, Entamoeba dispar
MIGLCVIMAQIGMFIPCSEVDIS

SEQ ID NO: 2496452 - protein, 24 aa, Entamoeba dispar
MIHCGSRGLGHQVCQDFVDLCVNQ

SEQ ID NO: 2496453 - protein, 27 aa, Entamoeba dispar
MIIAIPPLIAFQCLFSKSLVSHELTLS

SEQ ID NO: 2496454 - protein, 19 aa, Entamoeba dispar
MIIMKMITKLMKLRNNNGG

SEQ ID NO: 2496455 - protein, 24 aa, Entamoeba dispar
MIKCFKNLNINCCNFTKVKEMFQL

SEQ ID NO: 2496456 - protein, 21 aa, Entamoeba dispar
MIKGNAIAVHLNWEQELVQTE

SEQ ID NO: 2496457 - protein, 18 aa, Entamoeba dispar
MIKLIFIAMRGNDYYEFE

SEQ ID NO: 2496458 - protein, 17 aa, Entamoeba dispar
MIKMFPMLRRMKFDESF

SEQ ID NO: 2496459 - protein, 18 aa, Entamoeba dispar
MIKPESKLSMIFNNIKKE

SEQ ID NO: 2496460 - protein, 22 aa, Entamoeba dispar
MIKPESKLTMIFNNIKKEVEKK

SEQ ID NO: 2496461 - protein, 23 aa, Entamoeba dispar
MIKSETKLQFFGISHENLMELNN

SEQ ID NO: 2496462 - protein, 17 aa, Entamoeba dispar
MIKTSKGKIEWENDVKE

SEQ ID NO: 2496463 - protein, 24 aa, Entamoeba dispar
MILDMKMYVAWAGDSRAVLCRGGK

SEQ ID NO: 2496464 - protein, 18 aa, Entamoeba dispar
MIMENGIRTTLNEIQKDK

SEQ ID NO: 2496465 - protein, 22 aa, Entamoeba dispar
MIPDSFKSFMTYVSNEVNKTSP

SEQ ID NO: 2496466 - protein, 31 aa, Entamoeba dispar
MIPPKKVPIGGVPLFGGFNPGKVALKKTSYP

SEQ ID NO: 2496467 - protein, 19 aa, Entamoeba dispar
MIQKGEGFIDDFVISRPYR

SEQ ID NO: 2496468 - protein, 22 aa, Entamoeba dispar
MIQNAHVIRSIYITDIVAIDDD

SEQ ID NO: 2496469 - protein, 24 aa, Entamoeba dispar
MIQNLKIIIPELIKEIRDELIKII

SEQ ID NO: 2496470 - protein, 25 aa, Entamoeba dispar
MIRIRIIETIKKCGKYLEYSTIEKM

SEQ ID NO: 2496471 - protein, 18 aa, Entamoeba dispar
MIRNGTIIKECLLLKNQM

SEQ ID NO: 2496472 - protein, 17 aa, Entamoeba dispar
MISGELFLQVNNNQTIF

SEQ ID NO: 2496473 - protein, 26 aa, Entamoeba dispar
MISHNVVAMLLHYGVKPDLLFSKVEK

SEQ ID NO: 2496474 - protein, 24 aa, Entamoeba dispar
MISKELLSQLAFDSCEIIDHIAKQ

SEQ ID NO: 2496475 - protein, 19 aa, Entamoeba dispar
MITFQWKKKETPIIDTEMI

SEQ ID NO: 2496476 - protein, 25 aa, Entamoeba dispar
MIVDLWKNNDCIFTLENQKDIVILQ

SEQ ID NO: 2496477 - protein, 22 aa, Entamoeba dispar
MIVNDWCGFVGMDTTATELSIV

SEQ ID NO: 2496478 - protein, 24 aa, Entamoeba dispar
MIVRPRNLLYIAIDGVCPIAKMIQ

SEQ ID NO: 2496479 - protein, 25 aa, Entamoeba dispar
MIYDARPNVLSGLQLNEATSVKKLY

SEQ ID NO: 2496480 - protein, 20 aa, Entamoeba dispar
MIYLLVKSGFEVRVKRLDKS

SEQ ID NO: 2496481 - protein, 18 aa, Entamoeba dispar
MKAAIVGSIFVEDNNKYF

SEQ ID NO: 2496482 - protein, 22 aa, Entamoeba dispar
MKAEKEIEELKKLKSLKNLFNK

SEQ ID NO: 2496483 - protein, 17 aa, Entamoeba dispar
MKALLICFRNGIEKPSV

SEQ ID NO: 2496484 - protein, 22 aa, Entamoeba dispar
MKAMPAYTCIAYKSGEQEDKAQ

SEQ ID NO: 2496485 - protein, 26 aa, Entamoeba dispar
MKCEIRCKRDIINMVDFDSHLQELKE

SEQ ID NO: 2496486 - protein, 19 aa, Entamoeba dispar
MKCLIKYNDCDFIEDVDLC

SEQ ID NO: 2496487 - protein, 20 aa, Entamoeba dispar
MKCSCLLPHTPNFEVIICAE

SEQ ID NO: 2496488 - protein, 18 aa, Entamoeba dispar
MKCSFDYSDEYSLLLTLL

SEQ ID NO: 2496489 - protein, 18 aa, Entamoeba dispar
MKCVSHFMTMVPFFNIMC

SEQ ID NO: 2496490 - protein, 20 aa, Entamoeba dispar
MKDALFILSCHLDRSSNREI

SEQ ID NO: 2496491 - protein, 17 aa, Entamoeba dispar
MKDGIVVYVIKQGNESE

SEQ ID NO: 2496492 - protein, 25 aa, Entamoeba dispar
MKDILLKGYCFISLISELIKSLIES

SEQ ID NO: 2496493 - protein, 25 aa, Entamoeba dispar
MKDKIEITLLWCLDTILNIEKIKER

SEQ ID NO: 2496494 - protein, 18 aa, Entamoeba dispar
MKDRFIQFIKQINTIQSG

SEQ ID NO: 2496495 - protein, 22 aa, Entamoeba dispar
MKEERFGIVQALSDCYRIRKDK

SEQ ID NO: 2496496 - protein, 30 aa, Entamoeba dispar
MKEERISLINGIKGALGIKKECNMNDIIEE

SEQ ID NO: 2496497 - protein, 23 aa, Entamoeba dispar
MKEGGSWKSWKKRYFELENDTLS

SEQ ID NO: 2496498 - protein, 26 aa, Entamoeba dispar
MKEIKKRFPRVFGFDDMFDLLDGDEN

SEQ ID NO: 2496499 - protein, 21 aa, Entamoeba dispar
MKEIYKNIFGDYTFDEKSLPS

SEQ ID NO: 2496500 - protein, 26 aa, Entamoeba dispar
MKEKIREGWKYIFTLLSRIEQVFLTE

SEQ ID NO: 2496501 - protein, 20 aa, Entamoeba dispar
MKEKSRLIYEYGQMNKGESE

SEQ ID NO: 2496502 - protein, 31 aa, Entamoeba dispar
MKEKVFPYEVSMYLLKEWQKGRAKTRTTSAE

SEQ ID NO: 2496503 - protein, 24 aa, Entamoeba dispar
MKELGNPCIPYFGSFQNIFEKVLS

SEQ ID NO: 2496504 - protein, 26 aa, Entamoeba dispar
MKELKRIPTQLNLKGRSSSFPFIISI

SEQ ID NO: 2496505 - protein, 20 aa, Entamoeba dispar
MKELKRIPTQLNLKGTSSSF

SEQ ID NO: 2496506 - protein, 24 aa, Entamoeba dispar
MKELPFVILRPAIIYGPGDVTGIA

SEQ ID NO: 2496507 - protein, 30 aa, Entamoeba dispar
MKEMRQTFPQCFWCDPTAFFTDGPLMNMGC

SEQ ID NO: 2496508 - protein, 21 aa, Entamoeba dispar
MKEPSYLDWKLNVSGKIEDDT

SEQ ID NO: 2496509 - protein, 29 aa, Entamoeba dispar
MKERRRMSLKHLISYEDLPSFAFKSKETR

SEQ ID NO: 2496510 - protein, 29 aa, Entamoeba dispar
MKERRRMSLKHLISYEDLPSFAFKSKQTR

SEQ ID NO: 2496511 - protein, 17 aa, Entamoeba dispar
MKESPSFTELRTVVNEI

SEQ ID NO: 2496512 - protein, 24 aa, Entamoeba dispar
MKETEEYKKIISIIRDYAIHKATI

SEQ ID NO: 2496513 - protein, 27 aa, Entamoeba dispar
MKFDIKCGYLLALTCKKLNELFNRDSI

SEQ ID NO: 2496514 - protein, 19 aa, Entamoeba dispar
MKFNDTILTYLKRFDLMKN

SEQ ID NO: 2496515 - protein, 19 aa, Entamoeba dispar
MKFVITFKLGSGLDVLPSN

SEQ ID NO: 2496516 - protein, 20 aa, Entamoeba dispar
MKGDIGGLIGKEKMNTTEFN

SEQ ID NO: 2496517 - protein, 26 aa, Entamoeba dispar
MKGDYRTGKKINMKKVIPYIASGFKK

SEQ ID NO: 2496518 - protein, 20 aa, Entamoeba dispar
MKGFQMNYFVSCIQSQVFKK

SEQ ID NO: 2496519 - protein, 31 aa, Entamoeba dispar
MKGGYSILTICFCKSPLCSQMIIQFIYSSLQ

SEQ ID NO: 2496520 - protein, 32 aa, Entamoeba dispar
MKGGYSILTICFCKSPLCSQMIIQFIYSSLQS

SEQ ID NO: 2496521 - protein, 18 aa, Entamoeba dispar
MKGKFCEYSMKKYSSNVV

SEQ ID NO: 2496522 - protein, 19 aa, Entamoeba dispar
MKGNNWRVIVVDKYCSIHL

SEQ ID NO: 2496523 - protein, 18 aa, Entamoeba dispar
MKGSDILSIHIHPPTVEE

SEQ ID NO: 2496524 - protein, 17 aa, Entamoeba dispar
MKHGNVLNHYGAVPQTW

SEQ ID NO: 2496525 - protein, 18 aa, Entamoeba dispar
MKHHLTIREEEKGNLKEP

SEQ ID NO: 2496526 - protein, 21 aa, Entamoeba dispar
MKHKHIVLVLNKCDLVPTWAT

SEQ ID NO: 2496527 - protein, 30 aa, Entamoeba dispar
MKHLIVYDVNKRWGWKEIETSPFMYEYNGE

SEQ ID NO: 2496528 - protein, 27 aa, Entamoeba dispar
MKHMRNFDRLGVMKMIKIQTEYNQSIG

SEQ ID NO: 2496529 - protein, 20 aa, Entamoeba dispar
MKHPNLITMYGLYKEKDTIF

SEQ ID NO: 2496530 - protein, 26 aa, Entamoeba dispar
MKHRSKGRFPVLTWYNKKNGTVIVRS

SEQ ID NO: 2496531 - protein, 18 aa, Entamoeba dispar
MKHTRLTLQPSTQIEIIQ

SEQ ID NO: 2496532 - protein, 24 aa, Entamoeba dispar
MKIDAYITLCSKIGEKMMNTDNTS

SEQ ID NO: 2496533 - protein, 19 aa, Entamoeba dispar
MKIGDIKPVAVWRIDTEIT

SEQ ID NO: 2496534 - protein, 20 aa, Entamoeba dispar
MKIGDIKPVAVWRIDTEITS

SEQ ID NO: 2496535 - protein, 18 aa, Entamoeba dispar
MKIIKCKNTEITGKLDNI

SEQ ID NO: 2496536 - protein, 18 aa, Entamoeba dispar
MKIIRGSYELPKPIEDTE

SEQ ID NO: 2496537 - protein, 18 aa, Entamoeba dispar
MKIKQCQTFRHITLPPNV

SEQ ID NO: 2496538 - protein, 19 aa, Entamoeba dispar
MKINIPNNIEWIGENCFKE

SEQ ID NO: 2496539 - protein, 18 aa, Entamoeba dispar
MKINKEGNDKEIILEPKD

SEQ ID NO: 2496540 - protein, 25 aa, Entamoeba dispar
MKIPQARASIVWVIGEYSQMVPKLG

SEQ ID NO: 2496541 - protein, 19 aa, Entamoeba dispar
MKISFKYSIKQVNRNNTPM

SEQ ID NO: 2496542 - protein, 20 aa, Entamoeba dispar
MKITKCKNTEIIGKLDNIEE

SEQ ID NO: 2496543 - protein, 19 aa, Entamoeba dispar
MKIVDCRKLKIKGIPDKVE

SEQ ID NO: 2496544 - protein, 21 aa, Entamoeba dispar
MKIVDVIRFSSAVISMDISAD

SEQ ID NO: 2496545 - protein, 19 aa, Entamoeba dispar
MKKAYRVTEEFHIEEDIYS

SEQ ID NO: 2496546 - protein, 17 aa, Entamoeba dispar
MKKDEVECIKMMEEEHK

SEQ ID NO: 2496547 - protein, 21 aa, Entamoeba dispar
MKKGIKIRCDEMFAERFDEMF

SEQ ID NO: 2496548 - protein, 17 aa, Entamoeba dispar
MKKGMLFISSIFNTINI

SEQ ID NO: 2496549 - protein, 25 aa, Entamoeba dispar
MKKGNEMSHVFLLDIISYPEMNGKQ

SEQ ID NO: 2496550 - protein, 30 aa, Entamoeba dispar
MKKIGYSFMYKWLILLFRRDFVSEKCIRLW

SEQ ID NO: 2496551 - protein, 22 aa, Entamoeba dispar
MKKIKHLKYRSVNWDSEKIATI

SEQ ID NO: 2496552 - protein, 19 aa, Entamoeba dispar
MKKIMLHMIHIYKEKKEEE

SEQ ID NO: 2496553 - protein, 22 aa, Entamoeba dispar
MKKKGIKYSVAHNVDNILCKDV

SEQ ID NO: 2496554 - protein, 21 aa, Entamoeba dispar
MKKLNNFEGMKAVFSALESTP

SEQ ID NO: 2496555 - protein, 21 aa, Entamoeba dispar
MKKLNNFEGMKAVLSALESSP

SEQ ID NO: 2496556 - protein, 18 aa, Entamoeba dispar
MKKPWAEFEEVRKKAVGL

SEQ ID NO: 2496557 - protein, 31 aa, Entamoeba dispar
MKKQFKFHFSHSLNPSGLCEKVEIIYKKTMS

SEQ ID NO: 2496558 - protein, 25 aa, Entamoeba dispar
MKKRIKIRCGETFAKMFDEIFEEMN

SEQ ID NO: 2496559 - protein, 18 aa, Entamoeba dispar
MKKSVIIINMARGPIVVN

SEQ ID NO: 2496560 - protein, 22 aa, Entamoeba dispar
MKKYFGILFIKLPQEFIEFLEE

SEQ ID NO: 2496561 - protein, 23 aa, Entamoeba dispar
MKKYFQMISFCFTDSFKEYIEDV

SEQ ID NO: 2496562 - protein, 19 aa, Entamoeba dispar
MKKYLKKNNLREWLRVVSD

SEQ ID NO: 2496563 - protein, 19 aa, Entamoeba dispar
MKLAPIGVVAKAQMHPHVD

SEQ ID NO: 2496564 - protein, 18 aa, Entamoeba dispar
MKLDCDYLLNGINLSNCH

SEQ ID NO: 2496565 - protein, 22 aa, Entamoeba dispar
MKLGECGMCSATIREITLLKMI

SEQ ID NO: 2496566 - protein, 20 aa, Entamoeba dispar
MKLKEEVFPTVKYNLLLKIL

SEQ ID NO: 2496567 - protein, 23 aa, Entamoeba dispar
MKLKLEILLILKVKNDIFDSNDI

SEQ ID NO: 2496568 - protein, 24 aa, Entamoeba dispar
MKLLIEYCDALGCLDNVEFDMSLV

SEQ ID NO: 2496569 - protein, 19 aa, Entamoeba dispar
MKLLKRCKIDIGRQKFNIN

SEQ ID NO: 2496570 - protein, 19 aa, Entamoeba dispar
MKLLTSLEIEQCPQLSSLT

SEQ ID NO: 2496571 - protein, 26 aa, Entamoeba dispar
MKLLVWGEDSLFWLGKKTMELVTETT

SEQ ID NO: 2496572 - protein, 17 aa, Entamoeba dispar
MKLNLNESISYGVNVDM

SEQ ID NO: 2496573 - protein, 23 aa, Entamoeba dispar
MKLPEDFDLLCIINSSNCMLTSI

SEQ ID NO: 2496574 - protein, 20 aa, Entamoeba dispar
MKLPKDLYDDMFGVFTALDK

SEQ ID NO: 2496575 - protein, 20 aa, Entamoeba dispar
MKLQDELYLIFGKEKSVLDL

SEQ ID NO: 2496576 - protein, 21 aa, Entamoeba dispar
MKLRPLSVFAPLHYFELPELL

SEQ ID NO: 2496577 - protein, 33 aa, Entamoeba dispar
MKLSWHGIPFSIRYIIWKYLLRYIPVENKRVEL

SEQ ID NO: 2496578 - protein, 20 aa, Entamoeba dispar
MKLTEMSSMVAVTEAMNGVT

SEQ ID NO: 2496579 - protein, 17 aa, Entamoeba dispar
MKMDPRGAIILLDSTTE

SEQ ID NO: 2496580 - protein, 18 aa, Entamoeba dispar
MKMIEEVPRFNGRYPYDF

SEQ ID NO: 2496581 - protein, 19 aa, Entamoeba dispar
MKMILSASALHEEELKEMK

SEQ ID NO: 2496582 - protein, 17 aa, Entamoeba dispar
MKMNVKFQVSDRGNNVI

SEQ ID NO: 2496583 - protein, 21 aa, Entamoeba dispar
MKMQSYRAALELFIHNHLPSY

SEQ ID NO: 2496584 - protein, 17 aa, Entamoeba dispar
MKNFFGIGMHQLINTEN

SEQ ID NO: 2496585 - protein, 23 aa, Entamoeba dispar
MKNFPIQIQIEYKKKNGLKGVRV

SEQ ID NO: 2496586 - protein, 20 aa, Entamoeba dispar
MKNFSFKCGCGQLTECVCVT

SEQ ID NO: 2496587 - protein, 17 aa, Entamoeba dispar
MKNGIGIIKDLSTISAI

SEQ ID NO: 2496588 - protein, 23 aa, Entamoeba dispar
MKNGLRMNKYFGILRNIHRIQNE

SEQ ID NO: 2496589 - protein, 18 aa, Entamoeba dispar
MKNIYVVIGTLDYFEFSI

SEQ ID NO: 2496590 - protein, 21 aa, Entamoeba dispar
MKNKLIEWVESSLITDFNTIL

SEQ ID NO: 2496591 - protein, 17 aa, Entamoeba dispar
MKNPIIINTIKNYEVIS

SEQ ID NO: 2496592 - protein, 27 aa, Entamoeba dispar
MKPKDIKGHVTVSTWHVPCECLTTGFQ

SEQ ID NO: 2496593 - protein, 23 aa, Entamoeba dispar
MKPNAKVGVIWFDAHPDMNIPEN

SEQ ID NO: 2496594 - protein, 20 aa, Entamoeba dispar
MKPQLWERRILKTQEDHLFF

SEQ ID NO: 2496595 - protein, 23 aa, Entamoeba dispar
MKQENRCPFNYNYEHNSVFWAIK

SEQ ID NO: 2496596 - protein, 19 aa, Entamoeba dispar
MKQFDKNDVVIIYDVEAMN

SEQ ID NO: 2496597 - protein, 19 aa, Entamoeba dispar
MKQILRYTDLMIRIGSSEF

SEQ ID NO: 2496598 - protein, 17 aa, Entamoeba dispar
MKQKGLMKINEVRQAIN

SEQ ID NO: 2496599 - protein, 19 aa, Entamoeba dispar
MKQLETVYLMKVVLHVKDM

SEQ ID NO: 2496600 - protein, 20 aa, Entamoeba dispar
MKQLIPCGDTIEMIHMTYYL

SEQ ID NO: 2496601 - protein, 18 aa, Entamoeba dispar
MKQLKRMKSLFECYMDLH

SEQ ID NO: 2496602 - protein, 19 aa, Entamoeba dispar
MKQLKSLRLEYIEETKNVK

SEQ ID NO: 2496603 - protein, 26 aa, Entamoeba dispar
MKRECLCGICSLLVSVLMYSEVAKKK

SEQ ID NO: 2496604 - protein, 20 aa, Entamoeba dispar
MKRFEFKKPNLISKPLKDRM

SEQ ID NO: 2496605 - protein, 22 aa, Entamoeba dispar
MKRFKHVHFMNEDFPKEVIEKI

SEQ ID NO: 2496606 - protein, 21 aa, Entamoeba dispar
MKRNKICRYSHVIEMVNRIDE

SEQ ID NO: 2496607 - protein, 24 aa, Entamoeba dispar
MKRNPCGRCSQRAYVELKGYDEEI

SEQ ID NO: 2496608 - protein, 24 aa, Entamoeba dispar
MKSGEESYIIFGVIINRKEINTTI

SEQ ID NO: 2496609 - protein, 23 aa, Entamoeba dispar
MKSITPRQVKVVIIDEGKQEFSS

SEQ ID NO: 2496610 - protein, 17 aa, Entamoeba dispar
MKSKGIVMSIPMPGHPI

SEQ ID NO: 2496611 - protein, 19 aa, Entamoeba dispar
MKSKKGKSFECEIDIQCLG

SEQ ID NO: 2496612 - protein, 20 aa, Entamoeba dispar
MKSKRIEFIKNIKDRMDIID

SEQ ID NO: 2496613 - protein, 24 aa, Entamoeba dispar
MKSLKRIRIINSFQLSFCNCNSDS

SEQ ID NO: 2496614 - protein, 26 aa, Entamoeba dispar
MKSNCQYGKCGIHLKYCLRIIEEANE

SEQ ID NO: 2496615 - protein, 24 aa, Entamoeba dispar
MKSNGVIHLVMLMSILDRISDEEI

SEQ ID NO: 2496616 - protein, 18 aa, Entamoeba dispar
MKSPLLSALHTLSELEDD

SEQ ID NO: 2496617 - protein, 17 aa, Entamoeba dispar
MKTFIECTFKEKVNVGE

SEQ ID NO: 2496618 - protein, 18 aa, Entamoeba dispar
MKTFLTKYLEFERKYGDE

SEQ ID NO: 2496619 - protein, 23 aa, Entamoeba dispar
MKTLKRVVSGGIYGEYCGLIGKR

SEQ ID NO: 2496620 - protein, 25 aa, Entamoeba dispar
MKVIDWKIQMDLMINKQLSKFEINE

SEQ ID NO: 2496621 - protein, 18 aa, Entamoeba dispar
MKVLIDVLKGIQFLHRNN

SEQ ID NO: 2496622 - protein, 18 aa, Entamoeba dispar
MKVLLRIMILHHNKNYCF

SEQ ID NO: 2496623 - protein, 17 aa, Entamoeba dispar
MKVYGIPNSCCITPDGD

SEQ ID NO: 2496624 - protein, 25 aa, Entamoeba dispar
MKVYLDAVFLPRVRNDIYPFYQEGR

SEQ ID NO: 2496625 - protein, 17 aa, Entamoeba dispar
MKWQLFRNLDLPAIQAT

SEQ ID NO: 2496626 - protein, 25 aa, Entamoeba dispar
MKWWNDLWLNEGFASYMGDLFATAT

SEQ ID NO: 2496627 - protein, 25 aa, Entamoeba dispar
MKYGKNEWARISSLIVGKSPQQCKA

SEQ ID NO: 2496628 - protein, 19 aa, Entamoeba dispar
MKYIAIEIRHRLNIQSNVL

SEQ ID NO: 2496629 - protein, 24 aa, Entamoeba dispar
MKYIEALRLKGDFEKSIQESNVEK

SEQ ID NO: 2496630 - protein, 27 aa, Entamoeba dispar
MKYIMCLCDRPTLVSIYKGKIKTLSVN

SEQ ID NO: 2496631 - protein, 18 aa, Entamoeba dispar
MKYLITLSRKMIQINGMS

SEQ ID NO: 2496632 - protein, 19 aa, Entamoeba dispar
MKYLNGKFAVFDIKRSVGK

SEQ ID NO: 2496633 - protein, 18 aa, Entamoeba dispar
MLAPIKFESCITGEELKS

SEQ ID NO: 2496634 - protein, 17 aa, Entamoeba dispar
MLARIDYMKSRALLGST

SEQ ID NO: 2496635 - protein, 29 aa, Entamoeba dispar
MLCLMDYVCKRNVSFRCHLKDFSIVHCFK

SEQ ID NO: 2496636 - protein, 25 aa, Entamoeba dispar
MLCSRCGRPVYENGIKANRCVFHAE

SEQ ID NO: 2496637 - protein, 17 aa, Entamoeba dispar
MLDALAFMHSHRILHRD

SEQ ID NO: 2496638 - protein, 26 aa, Entamoeba dispar
MLDFKFPDQRVRDFALKCLDAMDDAE

SEQ ID NO: 2496639 - protein, 25 aa, Entamoeba dispar
MLDKFRSEYIIQFYGAVFIPNKICM

SEQ ID NO: 2496640 - protein, 24 aa, Entamoeba dispar
MLDLRTVTNIAIFRIQSACCGLFR

SEQ ID NO: 2496641 - protein, 22 aa, Entamoeba dispar
MLDLWKLQHFNIKKQQIAKLQK

SEQ ID NO: 2496642 - protein, 18 aa, Entamoeba dispar
MLDQYFAILLNFFKSKAQ

SEQ ID NO: 2496643 - protein, 17 aa, Entamoeba dispar
MLEALGFQFKDSKNRIL

SEQ ID NO: 2496644 - protein, 22 aa, Entamoeba dispar
MLECFNKMLFFVDLLKEKRDKI

SEQ ID NO: 2496645 - protein, 19 aa, Entamoeba dispar
MLEECLITCQILFKASSQL

SEQ ID NO: 2496646 - protein, 19 aa, Entamoeba dispar
MLEECRVFERFLQFIDRSV

SEQ ID NO: 2496647 - protein, 24 aa, Entamoeba dispar
MLEGKKWGKKWVVMKKNCLMIFRN

SEQ ID NO: 2496648 - protein, 17 aa, Entamoeba dispar
MLEGYHLSHSRKTVNLN

SEQ ID NO: 2496649 - protein, 18 aa, Entamoeba dispar
MLEIITWQNPFPKEIYNF

SEQ ID NO: 2496650 - protein, 17 aa, Entamoeba dispar
MLEKRLAGTETTYVQTI

SEQ ID NO: 2496651 - protein, 22 aa, Entamoeba dispar
MLFEMLKAATFMNIDMLVEATA

SEQ ID NO: 2496652 - protein, 17 aa, Entamoeba dispar
MLGKKVDCPPILCVPTV

SEQ ID NO: 2496653 - protein, 20 aa, Entamoeba dispar
MLGNAAMDCCYVACGRTDCF

SEQ ID NO: 2496654 - protein, 21 aa, Entamoeba dispar
MLGSIPLEMFTGSSLTALDLS

SEQ ID NO: 2496655 - protein, 21 aa, Entamoeba dispar
MLIDQCIKRIQFIHSKDFIHR

SEQ ID NO: 2496656 - protein, 22 aa, Entamoeba dispar
MLILKPFIQNGMIKQIYKSYSV

SEQ ID NO: 2496657 - protein, 21 aa, Entamoeba dispar
MLKDPSFEPLDPAAYLHTLHQ

SEQ ID NO: 2496658 - protein, 21 aa, Entamoeba dispar
MLKRFYPDRIDLLKQMEELKK

SEQ ID NO: 2496659 - protein, 19 aa, Entamoeba dispar
MLKSYLCDVMTEFPNEEAK

SEQ ID NO: 2496660 - protein, 20 aa, Entamoeba dispar
MLLCDFSIPILFTTLPLNII

SEQ ID NO: 2496661 - protein, 25 aa, Entamoeba dispar
MLLDTIDGLYVWLGSKCSANTKKMS

SEQ ID NO: 2496662 - protein, 19 aa, Entamoeba dispar
MLLEERFIFHSCTPETIHP

SEQ ID NO: 2496663 - protein, 23 aa, Entamoeba dispar
MLLERQPLQWIFIARLIVYSLKH

SEQ ID NO: 2496664 - protein, 24 aa, Entamoeba dispar
MLLFADKHGYKWSDVKDLLIQYSG

SEQ ID NO: 2496665 - protein, 18 aa, Entamoeba dispar
MLLKYGANIGQVYKGKPL

SEQ ID NO: 2496666 - protein, 21 aa, Entamoeba dispar
MLLKYRGNLLVDEKELKCGKI

SEQ ID NO: 2496667 - protein, 21 aa, Entamoeba dispar
MLLLKCRICVNNKVSSDINSE

SEQ ID NO: 2496668 - protein, 21 aa, Entamoeba dispar
MLLRAIYKILRQRIGNKKIGK

SEQ ID NO: 2496669 - protein, 21 aa, Entamoeba dispar
MLLTDCYLEYLKIATSDRLNA

SEQ ID NO: 2496670 - protein, 17 aa, Entamoeba dispar
MLLYSYCDKVLKNESNE

SEQ ID NO: 2496671 - protein, 18 aa, Entamoeba dispar
MLNDIVINFYIEFLQNEL

SEQ ID NO: 2496672 - protein, 25 aa, Entamoeba dispar
MLNELSEIYLLFNIFGQLMNKPTSF

SEQ ID NO: 2496673 - protein, 17 aa, Entamoeba dispar
MLNELVLLLTFAEENAT

SEQ ID NO: 2496674 - protein, 23 aa, Entamoeba dispar
MLNEYRDYIGYTWIADKESVVFS

SEQ ID NO: 2496675 - protein, 19 aa, Entamoeba dispar
MLNIKEFLNPPLILQRCMT

SEQ ID NO: 2496676 - protein, 24 aa, Entamoeba dispar
MLPCKHSACRSCIERHMEHHNECF

SEQ ID NO: 2496677 - protein, 21 aa, Entamoeba dispar
MLPEIIKKLVMRRRQIVSEME

SEQ ID NO: 2496678 - protein, 19 aa, Entamoeba dispar
MLPIIPRVVTVSPKYLEIS

SEQ ID NO: 2496679 - protein, 24 aa, Entamoeba dispar
MLPLETRLGITLYAIRKGKKVVIG

SEQ ID NO: 2496680 - protein, 18 aa, Entamoeba dispar
MLPRSCGDDLYFVCRRPN

SEQ ID NO: 2496681 - protein, 18 aa, Entamoeba dispar
MLPTELYETADIPETKEL

SEQ ID NO: 2496682 - protein, 19 aa, Entamoeba dispar
MLQKYKIVINAFKQCHDDR

SEQ ID NO: 2496683 - protein, 20 aa, Entamoeba dispar
MLREHFKASQFIVVSLKSGM

SEQ ID NO: 2496684 - protein, 25 aa, Entamoeba dispar
MLSNFPFVYIVDVFADFLKKYKKSI

SEQ ID NO: 2496685 - protein, 18 aa, Entamoeba dispar
MLSRGELRCIGATTIEEY

SEQ ID NO: 2496686 - protein, 17 aa, Entamoeba dispar
MLSRGELRCIGATTLEE

SEQ ID NO: 2496687 - protein, 22 aa, Entamoeba dispar
MLTEIPYFRDILLAHFQCPYCH

SEQ ID NO: 2496688 - protein, 24 aa, Entamoeba dispar
MLTKEIPIRKEVFIDNADGKKKVW

SEQ ID NO: 2496689 - protein, 18 aa, Entamoeba dispar
MLVELLCRLPEDMKRLQL

SEQ ID NO: 2496690 - protein, 19 aa, Entamoeba dispar
MLVNDYLNRIGIQPPTEKI

SEQ ID NO: 2496691 - protein, 19 aa, Entamoeba dispar
MLVYPYFRVRTYQAYVDDF

SEQ ID NO: 2496692 - protein, 27 aa, Entamoeba dispar
MLYPDECVEHFAILCEILRAVTKKRSV

SEQ ID NO: 2496693 - protein, 22 aa, Entamoeba dispar
MMALDCLYSLISTHSSELILKL

SEQ ID NO: 2496694 - protein, 17 aa, Entamoeba dispar
MMDLLEMKQYLGTIKDN

SEQ ID NO: 2496695 - protein, 20 aa, Entamoeba dispar
MMDMQKHCIGIIQSFSTNKE

SEQ ID NO: 2496696 - protein, 29 aa, Entamoeba dispar
MMEIRKIVLRKGCCLLPVECGGRIMEYME

SEQ ID NO: 2496697 - protein, 18 aa, Entamoeba dispar
MMERGFLTGYTKLKQFIP

SEQ ID NO: 2496698 - protein, 23 aa, Entamoeba dispar
MMIKPESKLSMIFNNIKKEVEKK

SEQ ID NO: 2496699 - protein, 24 aa, Entamoeba dispar
MMIKPESKLSMVFNNIKKTQKRFE

SEQ ID NO: 2496700 - protein, 23 aa, Entamoeba dispar
MMIKPESKLTMIFNNIKKEVEKK

SEQ ID NO: 2496701 - protein, 23 aa, Entamoeba dispar
MMIKTESKLSMIFNNIKKEVEKK

SEQ ID NO: 2496702 - protein, 24 aa, Entamoeba dispar
MMILCATKLKLGVDRYLKDYETLR

SEQ ID NO: 2496703 - protein, 26 aa, Entamoeba dispar
MMKESGVMVSRLFQDLSIKVGPRTVT

SEQ ID NO: 2496704 - protein, 26 aa, Entamoeba dispar
MMLDKFRSEYIIQFYGAVFIPNKICI

SEQ ID NO: 2496705 - protein, 26 aa, Entamoeba dispar
MMLDKFRSEYIIQFYGAVFIPNKICM

SEQ ID NO: 2496706 - protein, 18 aa, Entamoeba dispar
MMMVCGSIAHLGFELSKL

SEQ ID NO: 2496707 - protein, 24 aa, Entamoeba dispar
MMNKNCWDQVLLEKIVNEFGIVFF

SEQ ID NO: 2496708 - protein, 24 aa, Entamoeba dispar
MMPIQQPMGGMGMMNQPMQGMTPS

SEQ ID NO: 2496709 - protein, 26 aa, Entamoeba dispar
MMSDEMSKRIIVHYLMKLFEKNLDEK

SEQ ID NO: 2496710 - protein, 18 aa, Entamoeba dispar
MMSDMFGKVVERLLPSDK

SEQ ID NO: 2496711 - protein, 24 aa, Entamoeba dispar
MMSEQWFWDEVEKFSYYQNNFTKQ

SEQ ID NO: 2496712 - protein, 17 aa, Entamoeba dispar
MMSTVGIDFEFKELKIG

SEQ ID NO: 2496713 - protein, 19 aa, Entamoeba dispar
MMTERMGFMKECQKKYNIN

SEQ ID NO: 2496714 - protein, 21 aa, Entamoeba dispar
MMTFECLTNFDIHSVAGALKL

SEQ ID NO: 2496715 - protein, 23 aa, Entamoeba dispar
MNANLMRNGADFAVYINTAGDFD

SEQ ID NO: 2496716 - protein, 17 aa, Entamoeba dispar
MNCCPSKIISISAIETD

SEQ ID NO: 2496717 - protein, 20 aa, Entamoeba dispar
MNCLSYCFFSKKLFNKVSNI

SEQ ID NO: 2496718 - protein, 19 aa, Entamoeba dispar
MNCPGHCVMFASKKRSYRE

SEQ ID NO: 2496719 - protein, 19 aa, Entamoeba dispar
MNCYKRLKNNLIQPKSVEQ

SEQ ID NO: 2496720 - protein, 23 aa, Entamoeba dispar
MNDKRVYTLFGRFGNINRVIMGV

SEQ ID NO: 2496721 - protein, 17 aa, Entamoeba dispar
MNDLEFTIYIGTTLPPE

SEQ ID NO: 2496722 - protein, 21 aa, Entamoeba dispar
MNDRPSLKFQIKRKEETKPIP

SEQ ID NO: 2496723 - protein, 17 aa, Entamoeba dispar
MNEAITVLTSWAETQHV

SEQ ID NO: 2496724 - protein, 23 aa, Entamoeba dispar
MNECFKSPFFIELLDKIPNDLAD

SEQ ID NO: 2496725 - protein, 17 aa, Entamoeba dispar
MNEELRNGVLNERVNLL

SEQ ID NO: 2496726 - protein, 23 aa, Entamoeba dispar
MNEFPEMFYPRILENDITNFKLH

SEQ ID NO: 2496727 - protein, 22 aa, Entamoeba dispar
MNEICALCMEYSRNELESFIIF

SEQ ID NO: 2496728 - protein, 19 aa, Entamoeba dispar
MNEIKKLKAIQNFETEEKM

SEQ ID NO: 2496729 - protein, 25 aa, Entamoeba dispar
MNEIMYGRERIDSIQIRKVNNKQKT

SEQ ID NO: 2496730 - protein, 25 aa, Entamoeba dispar
MNEIRKSREGIIEKRESVKMQERAY

SEQ ID NO: 2496731 - protein, 22 aa, Entamoeba dispar
MNEIYKKAIQYMALDIAKPPPP

SEQ ID NO: 2496732 - protein, 23 aa, Entamoeba dispar
MNEMVFWYKYFSFLFKSENQNSL

SEQ ID NO: 2496733 - protein, 17 aa, Entamoeba dispar
MNFARRAIEKFNKPTQQ

SEQ ID NO: 2496734 - protein, 17 aa, Entamoeba dispar
MNFIKQDINEFIIPPSI

SEQ ID NO: 2496735 - protein, 18 aa, Entamoeba dispar
MNGFPGQVVDTWLGLSKK

SEQ ID NO: 2496736 - protein, 17 aa, Entamoeba dispar
MNHLFALIRKCNEYLSS

SEQ ID NO: 2496737 - protein, 18 aa, Entamoeba dispar
MNIACSLNPTIHCNRFIQ

SEQ ID NO: 2496738 - protein, 19 aa, Entamoeba dispar
MNIACSLNPTIHCNRFIQC

SEQ ID NO: 2496739 - protein, 32 aa, Entamoeba dispar
MNIENCVTCLAPSLRGYPFVYTYSIQHYSQLF

SEQ ID NO: 2496740 - protein, 19 aa, Entamoeba dispar
MNIETMIRLVFQNRCQIIE

SEQ ID NO: 2496741 - protein, 17 aa, Entamoeba dispar
MNIFKRADRDAVSQKQN

SEQ ID NO: 2496742 - protein, 21 aa, Entamoeba dispar
MNIGMCAEVTKSLSQLISITV

SEQ ID NO: 2496743 - protein, 26 aa, Entamoeba dispar
MNIKSVKDMALCLVIFASKKGSLIVD

SEQ ID NO: 2496744 - protein, 19 aa, Entamoeba dispar
MNIMLRLIKILQEPNEWRF

SEQ ID NO: 2496745 - protein, 21 aa, Entamoeba dispar
MNIPKNWRRVIQRIKNTAKQG

SEQ ID NO: 2496746 - protein, 23 aa, Entamoeba dispar
MNKDSVKGFNHLNSNTNDEKVLK

SEQ ID NO: 2496747 - protein, 25 aa, Entamoeba dispar
MNKFEALICSFKLSAAVNEEKMGKI

SEQ ID NO: 2496748 - protein, 23 aa, Entamoeba dispar
MNKICGVSGKMSLKLLQITEIGK

SEQ ID NO: 2496749 - protein, 25 aa, Entamoeba dispar
MNKITRLGCLVVIFQMSIHLELEQS

SEQ ID NO: 2496750 - protein, 24 aa, Entamoeba dispar
MNKKETKEPFSFGKSSSLITFGDK

SEQ ID NO: 2496751 - protein, 28 aa, Entamoeba dispar
MNKLPGIFVVCLQSIYIVQGLELRREVL

SEQ ID NO: 2496752 - protein, 19 aa, Entamoeba dispar
MNKSKITKRDLVFAMCSNA

SEQ ID NO: 2496753 - protein, 26 aa, Entamoeba dispar
MNLGNCAICSFNLGKKEIGIKLAEKA

SEQ ID NO: 2496754 - protein, 20 aa, Entamoeba dispar
MNLHLPQSMEARSEVMNIAL

SEQ ID NO: 2496755 - protein, 26 aa, Entamoeba dispar
MNLLPFDKILGGLAWGISATCYPLEI

SEQ ID NO: 2496756 - protein, 20 aa, Entamoeba dispar
MNLPSMFVIFNIQDIIGLRD

SEQ ID NO: 2496757 - protein, 18 aa, Entamoeba dispar
MNLYNHWYYFYLSLVRYP

SEQ ID NO: 2496758 - protein, 26 aa, Entamoeba dispar
MNMGCDFTCMPSMFEPSGLVQQESFL

SEQ ID NO: 2496759 - protein, 28 aa, Entamoeba dispar
MNNDGYLAFIERLFRLLHLIEMKKEINL

SEQ ID NO: 2496760 - protein, 25 aa, Entamoeba dispar
MNNKAIECLKEMIVFDTINKKNELD

SEQ ID NO: 2496761 - protein, 18 aa, Entamoeba dispar
MNNKYSVLLTAARAAEER

SEQ ID NO: 2496762 - protein, 23 aa, Entamoeba dispar
MNNSPNCFHMFQAESMYLESMNY

SEQ ID NO: 2496763 - protein, 17 aa, Entamoeba dispar
MNNVSKFDSVWAQEHSR

SEQ ID NO: 2496764 - protein, 23 aa, Entamoeba dispar
MNPYPRLHFFSSSIAPVSSALSM

SEQ ID NO: 2496765 - protein, 22 aa, Entamoeba dispar
MNRKRLFKNWGNDDIASYLDTL

SEQ ID NO: 2496766 - protein, 18 aa, Entamoeba dispar
MNRTILFMVSLWRMNGYK

SEQ ID NO: 2496767 - protein, 19 aa, Entamoeba dispar
MNRTILFMVSLWRMNGYKC

SEQ ID NO: 2496768 - protein, 17 aa, Entamoeba dispar
MNSKYAEQLFAFVRKIL

SEQ ID NO: 2496769 - protein, 18 aa, Entamoeba dispar
MNSLDCPHGEYIILDYNQ

SEQ ID NO: 2496770 - protein, 18 aa, Entamoeba dispar
MNSSNYFITKSIFTNDFV

SEQ ID NO: 2496771 - protein, 17 aa, Entamoeba dispar
MNTFEFIGMLQAQGFPK

SEQ ID NO: 2496772 - protein, 20 aa, Entamoeba dispar
MNVALTRAKNALWVIGNSNT

SEQ ID NO: 2496773 - protein, 23 aa, Entamoeba dispar
MNVIRKVLLYRGCDDDVREFVWK

SEQ ID NO: 2496774 - protein, 31 aa, Entamoeba dispar
MNVTCDICMRKCCVGCSIHTTIAPTLIMGIQ

SEQ ID NO: 2496775 - protein, 17 aa, Entamoeba dispar
MNWCTELDTQISQTQEQ

SEQ ID NO: 2496776 - protein, 28 aa, Entamoeba dispar
MNWMIEECLKHKIHFEFRGTRSAKYTVV

SEQ ID NO: 2496777 - protein, 41 aa, Entamoeba dispar
MNWVFNYYCGNTFSWKWGYKPHYAPLLCHFVDYFQPIEVTT

SEQ ID NO: 2496778 - protein, 19 aa, Entamoeba dispar
MNYEIKMKVLIDVLKGIQF

SEQ ID NO: 2496779 - protein, 23 aa, Entamoeba dispar
  misc_feature (18)..(19): Xaa can be any naturally occurring amino acid
MNYEKFMPALMQYYKQPXXIIIF

SEQ ID NO: 2496780 - protein, 18 aa, Entamoeba dispar
MNYFSITVIRCSSCKEIL

SEQ ID NO: 2496781 - protein, 19 aa, Entamoeba dispar
MNYHARWNYIAKIKEQLKI

SEQ ID NO: 2496782 - protein, 17 aa, Entamoeba dispar
MNYIQRGWIDKIEKQQQ

SEQ ID NO: 2496783 - protein, 25 aa, Entamoeba dispar
MNYLKELGCSTIFLSPIYKNHTTIT

SEQ ID NO: 2496784 - protein, 21 aa, Entamoeba dispar
MPEILKQLTVLPVESPVLLSG

SEQ ID NO: 2496785 - protein, 24 aa, Entamoeba dispar
MPEIPFSNPFYFSMFNNREIPDSP

SEQ ID NO: 2496786 - protein, 17 aa, Entamoeba dispar
MPGDFRMKAQINESNDD

SEQ ID NO: 2496787 - protein, 23 aa, Entamoeba dispar
MPGKDPRVSRPFKKRNRIEGIAS

SEQ ID NO: 2496788 - protein, 19 aa, Entamoeba dispar
MPHDIRNVFVLTCNVSMEY

SEQ ID NO: 2496789 - protein, 19 aa, Entamoeba dispar
MPITKKCRNLIKSSFNNNN

SEQ ID NO: 2496790 - protein, 24 aa, Entamoeba dispar
MPKEVLKIDNTMLYNECKSKNVPI

SEQ ID NO: 2496791 - protein, 35 aa, Entamoeba dispar
MPKEWNHSFFIPAFVGQKCIIRLMNKKAFSISTEK

SEQ ID NO: 2496792 - protein, 23 aa, Entamoeba dispar
MPLPNFGGMGGFNGMGGMDMQQA

SEQ ID NO: 2496793 - protein, 17 aa, Entamoeba dispar
MPLRYISKITRSNYIDW

SEQ ID NO: 2496794 - protein, 19 aa, Entamoeba dispar
MPLTICFLGDNKTPALSVL

SEQ ID NO: 2496795 - protein, 25 aa, Entamoeba dispar
MPMRIKELGPWCFSGCTSLKSINIP

SEQ ID NO: 2496796 - protein, 20 aa, Entamoeba dispar
MPNGDLCQFMIYRIQTDINY

SEQ ID NO: 2496797 - protein, 17 aa, Entamoeba dispar
MPPEDGIGLYLPSAKKW

SEQ ID NO: 2496798 - protein, 17 aa, Entamoeba dispar
MPPRGGPRGAPRGRGGM

SEQ ID NO: 2496799 - protein, 18 aa, Entamoeba dispar
MPPRGGPRGAPSRGSPAP

SEQ ID NO: 2496800 - protein, 17 aa, Entamoeba dispar
MPQQIQQGISFKLQPTQ

SEQ ID NO: 2496801 - protein, 24 aa, Entamoeba dispar
MPQTIYCEICFKAPIENPSKCEFC

SEQ ID NO: 2496802 - protein, 19 aa, Entamoeba dispar
MPRIKELVMFAKKEIATPS

SEQ ID NO: 2496803 - protein, 22 aa, Entamoeba dispar
MPRIREEVAKLFDIQTFSDKKF

SEQ ID NO: 2496804 - protein, 17 aa, Entamoeba dispar
MPSIILVGNKCDLKKQR

SEQ ID NO: 2496805 - protein, 25 aa, Entamoeba dispar
MPSPLLSRFDLIFVLVDNPDAEADK

SEQ ID NO: 2496806 - protein, 18 aa, Entamoeba dispar
MPSRGGPRGAPSRGSPAP

SEQ ID NO: 2496807 - protein, 25 aa, Entamoeba dispar
MPTIGGRIKYIFKQPFEYEMENAVE

SEQ ID NO: 2496808 - protein, 19 aa, Entamoeba dispar
MPVDIILFTDIILFVEKNK

SEQ ID NO: 2496809 - protein, 27 aa, Entamoeba dispar
MPVNASCDIWALGCLLYELYTSKMLFA

SEQ ID NO: 2496810 - protein, 24 aa, Entamoeba dispar
MPVQRLPRYNLLLTDLLKNTPTNH

SEQ ID NO: 2496811 - protein, 22 aa, Entamoeba dispar
MPVQRLPRYNLLLTDLLKRTPN

SEQ ID NO: 2496812 - protein, 26 aa, Entamoeba dispar
MPVQRVPRYRLLLQDLLKNTPDETLG

SEQ ID NO: 2496813 - protein, 27 aa, Entamoeba dispar
MPYSLWRTGVIFKKQICNEIIDVLIKF

SEQ ID NO: 2496814 - protein, 23 aa, Entamoeba dispar
MQCIIPKISKLVIESLIKNNTFD

SEQ ID NO: 2496815 - protein, 20 aa, Entamoeba dispar
MQDLLIEYGYYFKEKKSNRK

SEQ ID NO: 2496816 - protein, 23 aa, Entamoeba dispar
MQEVCNSCGCDFVQTEAVQWSLV

SEQ ID NO: 2496817 - protein, 19 aa, Entamoeba dispar
MQGIAFKQSYLFTEQAQWL

SEQ ID NO: 2496818 - protein, 17 aa, Entamoeba dispar
MQGKWMFEYMSKVASSM

SEQ ID NO: 2496819 - protein, 17 aa, Entamoeba dispar
MQGYPVATYCRGKLVFK

SEQ ID NO: 2496820 - protein, 17 aa, Entamoeba dispar
MQHILKTLPSLRITITE

SEQ ID NO: 2496821 - protein, 21 aa, Entamoeba dispar
MQIYFSYRFLALHSPEEKRVG

SEQ ID NO: 2496822 - protein, 17 aa, Entamoeba dispar
MQLFNEWDEKVFKQTIN

SEQ ID NO: 2496823 - protein, 17 aa, Entamoeba dispar
MQLLRIPKCKICSAYFS

SEQ ID NO: 2496824 - protein, 23 aa, Entamoeba dispar
MQLSLEIYDLITPLCKVNKTNLI

SEQ ID NO: 2496825 - protein, 18 aa, Entamoeba dispar
MQPILPGCPEIDEQAQYI

SEQ ID NO: 2496826 - protein, 22 aa, Entamoeba dispar
MQQRLAPLKVPQYEFGGKGHKE

SEQ ID NO: 2496827 - protein, 17 aa, Entamoeba dispar
MQQSIKNTLDWMTSIAR

SEQ ID NO: 2496828 - protein, 25 aa, Entamoeba dispar
MQRCQFRPMFNPVQVDGRFMQYPLQ

SEQ ID NO: 2496829 - protein, 24 aa, Entamoeba dispar
MQRMKLVPRVKIFAGKAAIGYDMA

SEQ ID NO: 2496830 - protein, 22 aa, Entamoeba dispar
MQRVDLLSILLLYGADINIPNK

SEQ ID NO: 2496831 - protein, 19 aa, Entamoeba dispar
MQSSCLLLLSSCLAVNPTL

SEQ ID NO: 2496832 - protein, 18 aa, Entamoeba dispar
MQSYLKGYNLYVANNAYA

SEQ ID NO: 2496833 - protein, 26 aa, Entamoeba dispar
MQTVFFKLANVIPFEKAIVLLKEAVQ

SEQ ID NO: 2496834 - protein, 21 aa, Entamoeba dispar
MQYQEFLSVIGRLSEYAQAIK

SEQ ID NO: 2496835 - protein, 29 aa, Entamoeba dispar
MQYVKHSYLSYMIQPRVKVSVIVKLIQLF

SEQ ID NO: 2496836 - protein, 17 aa, Entamoeba dispar
MRACCSTFTKYCKEKQG

SEQ ID NO: 2496837 - protein, 20 aa, Entamoeba dispar
MRALEELYALGAFNQKGELT

SEQ ID NO: 2496838 - protein, 25 aa, Entamoeba dispar
MRARNSAPCVIFFDELDALAPKRSE

SEQ ID NO: 2496839 - protein, 26 aa, Entamoeba dispar
MRAYETIKLLHLFYDIKYLTKRKNNN

SEQ ID NO: 2496840 - protein, 26 aa, Entamoeba dispar
MRDLPEPLFPSYAYKEIIEATREYDQ

SEQ ID NO: 2496841 - protein, 25 aa, Entamoeba dispar
MRDLYMKIANGFVLVYSITERSTYN

SEQ ID NO: 2496842 - protein, 17 aa, Entamoeba dispar
MREAIQRGVVIVDITQC

SEQ ID NO: 2496843 - protein, 18 aa, Entamoeba dispar
MREAKKLIENRSFVIDNS

SEQ ID NO: 2496844 - protein, 17 aa, Entamoeba dispar
MREHYLWKRDDKDHWSY

SEQ ID NO: 2496845 - protein, 17 aa, Entamoeba dispar
MREKRKAEKAASKEKKG

SEQ ID NO: 2496846 - protein, 17 aa, Entamoeba dispar
MRENGGYSWWRRNSLTV

SEQ ID NO: 2496847 - protein, 19 aa, Entamoeba dispar
MRENGGYSWWRRNSLTVFL

SEQ ID NO: 2496848 - protein, 26 aa, Entamoeba dispar
MRERGGKKCICVLCDDKYYVEDGNNL

SEQ ID NO: 2496849 - protein, 23 aa, Entamoeba dispar
MRFLCKKGALFFATLKRSFFLQE

SEQ ID NO: 2496850 - protein, 20 aa, Entamoeba dispar
MRGTRSGIPISLPKDNLPIL

SEQ ID NO: 2496851 - protein, 25 aa, Entamoeba dispar
MRIAINEFPQYVAIQLNDTHPTVGV

SEQ ID NO: 2496852 - protein, 17 aa, Entamoeba dispar
MRIIPFIRTMKLVSDAI

SEQ ID NO: 2496853 - protein, 23 aa, Entamoeba dispar
MRIKCIVCKIYPENIDDCIEYKC

SEQ ID NO: 2496854 - protein, 24 aa, Entamoeba dispar
MRILPPRIKLDIYLTKGTHQTEED

SEQ ID NO: 2496855 - protein, 17 aa, Entamoeba dispar
MRIVDDMIVDMDVKEEM

SEQ ID NO: 2496856 - protein, 27 aa, Entamoeba dispar
MRKDEIQFLIDFLIKYPSMKAVKNSND

SEQ ID NO: 2496857 - protein, 18 aa, Entamoeba dispar
MRKIELMKTESINLQNDI

SEQ ID NO: 2496858 - protein, 22 aa, Entamoeba dispar
MRKKDMTCTSIAAITPILNNAL

SEQ ID NO: 2496859 - protein, 21 aa, Entamoeba dispar
MRKQADEELKQFEASLNTQRD

SEQ ID NO: 2496860 - protein, 25 aa, Entamoeba dispar
MRKRFWFEKFHWFLSSENFIIISGK

SEQ ID NO: 2496861 - protein, 25 aa, Entamoeba dispar
MRLLDCPPLVLSVLQSLKIVLFSNS

SEQ ID NO: 2496862 - protein, 23 aa, Entamoeba dispar
MRLVDLCKTGLAIHKSSMKLEFA

SEQ ID NO: 2496863 - protein, 17 aa, Entamoeba dispar
MRMKVHMENGLKVAKFL

SEQ ID NO: 2496864 - protein, 19 aa, Entamoeba dispar
MRNDPRLDPRINYDTRYDR

SEQ ID NO: 2496865 - protein, 20 aa, Entamoeba dispar
MRNDPRLDPRINYDTRYDRL

SEQ ID NO: 2496866 - protein, 19 aa, Entamoeba dispar
MRNHQQSVFGFFTKASSIQ

SEQ ID NO: 2496867 - protein, 21 aa, Entamoeba dispar
MRNILGILLHICFDENQVDIV

SEQ ID NO: 2496868 - protein, 18 aa, Entamoeba dispar
MRNVIGITMPPGYSTLQP

SEQ ID NO: 2496869 - protein, 20 aa, Entamoeba dispar
MRPIKEYLAKEVKGQKKDMN

SEQ ID NO: 2496870 - protein, 17 aa, Entamoeba dispar
MRRVLKRLGYVSEDDII

SEQ ID NO: 2496871 - protein, 22 aa, Entamoeba dispar
MRSNIKIRKCVINKSNEKEKGI

SEQ ID NO: 2496872 - protein, 21 aa, Entamoeba dispar
MRSQAKITIWLKHNDENNVKT

SEQ ID NO: 2496873 - protein, 18 aa, Entamoeba dispar
MRTALKGQVLRFLNRETI

SEQ ID NO: 2496874 - protein, 22 aa, Entamoeba dispar
MRVGTDLKQEFTIFDAVPESEK

SEQ ID NO: 2496875 - protein, 17 aa, Entamoeba dispar
MRYALPQCERYKQMLKD

SEQ ID NO: 2496876 - protein, 29 aa, Entamoeba dispar
MSALKIIHVKIIIKPGCQKIFHFSFFDVV

SEQ ID NO: 2496877 - protein, 18 aa, Entamoeba dispar
MSCEVLITLLCMKVNNPS

SEQ ID NO: 2496878 - protein, 21 aa, Entamoeba dispar
MSDCSIAWFTAIKSVLKHFMT

SEQ ID NO: 2496879 - protein, 23 aa, Entamoeba dispar
MSDKGLCCIDEFDKMTEMTRSVL

SEQ ID NO: 2496880 - protein, 18 aa, Entamoeba dispar
MSDLLCFDGGSSNLIGTT

SEQ ID NO: 2496881 - protein, 22 aa, Entamoeba dispar
MSDPKVGPILSKLMSKFGQGAA

SEQ ID NO: 2496882 - protein, 20 aa, Entamoeba dispar
MSDQEWISAVLNHPVFGNSK

SEQ ID NO: 2496883 - protein, 18 aa, Entamoeba dispar
MSDREIFELITMNNYENS

SEQ ID NO: 2496884 - protein, 40 aa, Entamoeba dispar
MSEEFDIPKLLKCKKCGGLLTQACFMRCCKNTLCEECLNE

SEQ ID NO: 2496885 - protein, 27 aa, Entamoeba dispar
MSEKSRAKCLGLGITVFEGLMLPETTG

SEQ ID NO: 2496886 - protein, 22 aa, Entamoeba dispar
MSEMPKKGMAIELAKKEAVSDG

SEQ ID NO: 2496887 - protein, 23 aa, Entamoeba dispar
MSEPLFSSEVVDLFIKIIKDSPD

SEQ ID NO: 2496888 - protein, 21 aa, Entamoeba dispar
MSFCRSKFASAIPMKQKTKMD

SEQ ID NO: 2496889 - protein, 17 aa, Entamoeba dispar
MSFGAAFYRGSDCCLLV

SEQ ID NO: 2496890 - protein, 21 aa, Entamoeba dispar
MSFGDGCFYDCGCKDELKKNK

SEQ ID NO: 2496891 - protein, 23 aa, Entamoeba dispar
MSFPPRPKTGFSTPTKKKSRVIA

SEQ ID NO: 2496892 - protein, 25 aa, Entamoeba dispar
MSFRGDEKKSIFGIFDGYGGIGAAR

SEQ ID NO: 2496893 - protein, 19 aa, Entamoeba dispar
MSGNVPMVIARATELFLVD

SEQ ID NO: 2496894 - protein, 19 aa, Entamoeba dispar
MSGTTPFLLACGYGQKKMA

SEQ ID NO: 2496895 - protein, 19 aa, Entamoeba dispar
MSKCFKGEQSGLVPTSNLM

SEQ ID NO: 2496896 - protein, 25 aa, Entamoeba dispar
MSKRSKRGFQLERIIHIFYKNKFIM

SEQ ID NO: 2496897 - protein, 27 aa, Entamoeba dispar
MSKTYLVYGHMRWYDDTNMLGIDIIEK

SEQ ID NO: 2496898 - protein, 21 aa, Entamoeba dispar
MSKYFKFTISFPNKVPSKTLL

SEQ ID NO: 2496899 - protein, 22 aa, Entamoeba dispar
MSKYLRDRLLGMPITEIDRQME

SEQ ID NO: 2496900 - protein, 23 aa, Entamoeba dispar
MSLDQFNALPLWKRENLKKAKKL

SEQ ID NO: 2496901 - protein, 23 aa, Entamoeba dispar
MSLEMKNKFLLKMEGYSKFYHFE

SEQ ID NO: 2496902 - protein, 27 aa, Entamoeba dispar
MSLFPQSFIQFLAWQRLMQIYSKLDAS

SEQ ID NO: 2496903 - protein, 20 aa, Entamoeba dispar
MSLIPFFFQKYISKHTLVSS

SEQ ID NO: 2496904 - protein, 26 aa, Entamoeba dispar
MSLISDWKKLCFIKDELDYSNIFDNK

SEQ ID NO: 2496905 - protein, 17 aa, Entamoeba dispar
MSLKCVMTGGIFEIIIE

SEQ ID NO: 2496906 - protein, 18 aa, Entamoeba dispar
MSLKRGFYKISYGTEQDV

SEQ ID NO: 2496907 - protein, 17 aa, Entamoeba dispar
MSLKYLINYDDLPSFAF

SEQ ID NO: 2496908 - protein, 22 aa, Entamoeba dispar
MSLLPLCLKNISLYNVKKINLT

SEQ ID NO: 2496909 - protein, 21 aa, Entamoeba dispar
MSLLQREVRSVIFASGTLSPM

SEQ ID NO: 2496910 - protein, 19 aa, Entamoeba dispar
MSLLRKVSFTGVKQIPSGI

SEQ ID NO: 2496911 - protein, 17 aa, Entamoeba dispar
MSLPLDARFRFKKPVPN

SEQ ID NO: 2496912 - protein, 32 aa, Entamoeba dispar
MSLRHPRVCGYLMKQSYIFGTWTERYVIIKDN

SEQ ID NO: 2496913 - protein, 18 aa, Entamoeba dispar
MSMDISKKNAVKMVKAIK

SEQ ID NO: 2496914 - protein, 17 aa, Entamoeba dispar
MSMFFAYSSPMMKVLTE

SEQ ID NO: 2496915 - protein, 17 aa, Entamoeba dispar
MSMLRFHPQGCLETDKS

SEQ ID NO: 2496916 - protein, 26 aa, Entamoeba dispar
MSNDLMKYILAFGFNEDKTFIYTDYQ

SEQ ID NO: 2496917 - protein, 20 aa, Entamoeba dispar
MSNDLSVVLVKRGLMEMIYK

SEQ ID NO: 2496918 - protein, 19 aa, Entamoeba dispar
MSNEFFLDSHFHQIEELFI

SEQ ID NO: 2496919 - protein, 29 aa, Entamoeba dispar
MSNGVGICYELYPTVVLLKGRRVHGKPTI

SEQ ID NO: 2496920 - protein, 28 aa, Entamoeba dispar
MSNKPNIILPFQFCNFVHLKQLIVENLH

SEQ ID NO: 2496921 - protein, 23 aa, Entamoeba dispar
MSNQIFPLLMIWSEFGNSSVQLL

SEQ ID NO: 2496922 - protein, 24 aa, Entamoeba dispar
MSQMSECIILFKKLHHQVNQSIER

SEQ ID NO: 2496923 - protein, 20 aa, Entamoeba dispar
MSQSSYWNKLVVILSDSGVP

SEQ ID NO: 2496924 - protein, 24 aa, Entamoeba dispar
MSRECPEPRKDNRKGGFKRSFNEN

SEQ ID NO: 2496925 - protein, 21 aa, Entamoeba dispar
MSRPFGVALLIAGVDETGPRL

SEQ ID NO: 2496926 - protein, 22 aa, Entamoeba dispar
MSSIPSCKRAFELIKTTVEDMP

SEQ ID NO: 2496927 - protein, 22 aa, Entamoeba dispar
MSSLIRKRGRKKSENTFLQDRI

SEQ ID NO: 2496928 - protein, 20 aa, Entamoeba dispar
MSSTIKKIVRFKCSDKPAND

SEQ ID NO: 2496929 - protein, 20 aa, Entamoeba dispar
MSSTIKKIVRFKCSDKPASR

SEQ ID NO: 2496930 - protein, 17 aa, Entamoeba dispar
MSSVRFLSDGVRITPDK

SEQ ID NO: 2496931 - protein, 17 aa, Entamoeba dispar
MSTEIIITLFCMKINNP

SEQ ID NO: 2496932 - protein, 24 aa, Entamoeba dispar
MSTNEIKLMYSINHIQSIVAIPQA

SEQ ID NO: 2496933 - protein, 26 aa, Entamoeba dispar
MSTNRLKTRMLEPLLTFAQTQQQLSE

SEQ ID NO: 2496934 - protein, 25 aa, Entamoeba dispar
MSVELLQRFEECFYNFFNKIKTNKT

SEQ ID NO: 2496935 - protein, 25 aa, Entamoeba dispar
MSVESFLKMYKDFFFDKQNNLITIL

SEQ ID NO: 2496936 - protein, 19 aa, Entamoeba dispar
MSVIKCINRLYHLLQNTVP

SEQ ID NO: 2496937 - protein, 18 aa, Entamoeba dispar
MSVLLFQITVAPILDNPS

SEQ ID NO: 2496938 - protein, 20 aa, Entamoeba dispar
MSVNCFDFFETVQLIYSSVS

SEQ ID NO: 2496939 - protein, 18 aa, Entamoeba dispar
MSVPDTALDETLRLVVFL

SEQ ID NO: 2496940 - protein, 20 aa, Entamoeba dispar
MSVRCQACGEYMYKGKKFNS

SEQ ID NO: 2496941 - protein, 19 aa, Entamoeba dispar
MSVVFIGGGLFHAEAVAYN

SEQ ID NO: 2496942 - protein, 25 aa, Entamoeba dispar
MSVYQCLIHILRIPNAKSIFLRENG

SEQ ID NO: 2496943 - protein, 21 aa, Entamoeba dispar
MSWTSGHIWVGKKTINGPIHL

SEQ ID NO: 2496944 - protein, 17 aa, Entamoeba dispar
MSYCYESMFSVERIICI

SEQ ID NO: 2496945 - protein, 17 aa, Entamoeba dispar
MSYPLNTTHCFISNSMP

SEQ ID NO: 2496946 - protein, 25 aa, Entamoeba dispar
MTADPRFYELLKMYLPTRLEIQGGI

SEQ ID NO: 2496947 - protein, 19 aa, Entamoeba dispar
MTAQECLEHPFLHLLDVET

SEQ ID NO: 2496948 - protein, 24 aa, Entamoeba dispar
MTASVAWTILKLFLISLPTPLLHP

SEQ ID NO: 2496949 - protein, 19 aa, Entamoeba dispar
MTAVCWNETGDIFYSAGAN

SEQ ID NO: 2496950 - protein, 18 aa, Entamoeba dispar
MTCLHACGNLTPTLLRLS

SEQ ID NO: 2496951 - protein, 25 aa, Entamoeba dispar
MTCTAKLKGVCSFLDKMIIEGKKLL

SEQ ID NO: 2496952 - protein, 24 aa, Entamoeba dispar
MTDKFGHYCILYLLRHVDDKMALK

SEQ ID NO: 2496953 - protein, 23 aa, Entamoeba dispar
MTDKTILRRGYWMLSNISVSKFP

SEQ ID NO: 2496954 - protein, 20 aa, Entamoeba dispar
MTDTPKLRTIIDSMITHFTD

SEQ ID NO: 2496955 - protein, 26 aa, Entamoeba dispar
MTELLTRLGCEIIPLNIKPTGDFPHI

SEQ ID NO: 2496956 - protein, 23 aa, Entamoeba dispar
MTELWKKGDLSNFNYLMYLNIKA

SEQ ID NO: 2496957 - protein, 23 aa, Entamoeba dispar
MTELWKKGELSNFNYLMYLNIKA

SEQ ID NO: 2496958 - protein, 18 aa, Entamoeba dispar
MTEPQIAYVCRETLRALN

SEQ ID NO: 2496959 - protein, 26 aa, Entamoeba dispar
MTERLKWESPLLFTNIFHAFQTLFSI

SEQ ID NO: 2496960 - protein, 17 aa, Entamoeba dispar
MTERRGTSELVKNTFQC

SEQ ID NO: 2496961 - protein, 19 aa, Entamoeba dispar
MTERSRLFGGRRDFTKTTG

SEQ ID NO: 2496962 - protein, 21 aa, Entamoeba dispar
MTESAVISMSWPEMENQQRLS

SEQ ID NO: 2496963 - protein, 18 aa, Entamoeba dispar
MTFDCIGNEFLLVLKANT

SEQ ID NO: 2496964 - protein, 18 aa, Entamoeba dispar
MTGLRPTYEDSLELVPNF

SEQ ID NO: 2496965 - protein, 21 aa, Entamoeba dispar
MTGNLPLFYFAPTNINIPKFK

SEQ ID NO: 2496966 - protein, 25 aa, Entamoeba dispar
MTIDLPCYLAEWKYLERAILNIKTI

SEQ ID NO: 2496967 - protein, 23 aa, Entamoeba dispar
MTIIANQAWIVMKIVDENWIIGK

SEQ ID NO: 2496968 - protein, 17 aa, Entamoeba dispar
MTIKDVYYILCSFDGDK

SEQ ID NO: 2496969 - protein, 23 aa, Entamoeba dispar
MTIPRDFIYYFIFIKINKKTYNK

SEQ ID NO: 2496970 - protein, 18 aa, Entamoeba dispar
MTIRVGACGLNITGASRV

SEQ ID NO: 2496971 - protein, 27 aa, Entamoeba dispar
MTISECKVSICYYQLLKQLVYSIRDQP

SEQ ID NO: 2496972 - protein, 20 aa, Entamoeba dispar
MTISGYGLRSKERIGNLVLK

SEQ ID NO: 2496973 - protein, 21 aa, Entamoeba dispar
MTKDDGFFCFILKSPLIKQPI

SEQ ID NO: 2496974 - protein, 23 aa, Entamoeba dispar
MTLKSRIGNSLRRMLDCSKSVRI

SEQ ID NO: 2496975 - protein, 17 aa, Entamoeba dispar
MTLTYLVVIDCFALSFN

SEQ ID NO: 2496976 - protein, 23 aa, Entamoeba dispar
MTMDRYEADWSMVERGWKAHVRG

SEQ ID NO: 2496977 - protein, 29 aa, Entamoeba dispar
MTMFPDEYEFLGLEPNDLIAFKQLVEDAK

SEQ ID NO: 2496978 - protein, 17 aa, Entamoeba dispar
MTMVPFFNIMCADEIEA

SEQ ID NO: 2496979 - protein, 20 aa, Entamoeba dispar
MTNLMSVFVIRLTTTNQTLF

SEQ ID NO: 2496980 - protein, 24 aa, Entamoeba dispar
MTNSIYGCLGFKGSRFYCQKIAEW

SEQ ID NO: 2496981 - protein, 26 aa, Entamoeba dispar
MTPENFFFFRMPKFTPFDGKLLDPFK

SEQ ID NO: 2496982 - protein, 17 aa, Entamoeba dispar
MTPNILCRTVETVRGGG

SEQ ID NO: 2496983 - protein, 18 aa, Entamoeba dispar
MTPTRPETGYGYINYNNN

SEQ ID NO: 2496984 - protein, 26 aa, Entamoeba dispar
MTQAEGLLRMGLHPTIIADGYRTGLK

SEQ ID NO: 2496985 - protein, 19 aa, Entamoeba dispar
MTQPFGTSVLRQIEKNNVM

SEQ ID NO: 2496986 - protein, 17 aa, Entamoeba dispar
MTRYNLRTIAWKIWLGV

SEQ ID NO: 2496987 - protein, 19 aa, Entamoeba dispar
MTSFWRRHLEDVIVGEQLY

SEQ ID NO: 2496988 - protein, 18 aa, Entamoeba dispar
MTSTPCYIPLTYSTTQIP

SEQ ID NO: 2496989 - protein, 19 aa, Entamoeba dispar
MTTCECLELGLTTCLTSIE

SEQ ID NO: 2496990 - protein, 18 aa, Entamoeba dispar
MTTSPLLILNGFNQGGEQ

SEQ ID NO: 2496991 - protein, 17 aa, Entamoeba dispar
MTVELSVVADYDSFKAF

SEQ ID NO: 2496992 - protein, 17 aa, Entamoeba dispar
MTWVRALLKDKGIEEYQ

SEQ ID NO: 2496993 - protein, 17 aa, Entamoeba dispar
MTYACSILYKTKLPLII

SEQ ID NO: 2496994 - protein, 21 aa, Entamoeba dispar
MTYKDALNFVSSKRKCVFPNR

SEQ ID NO: 2496995 - protein, 19 aa, Entamoeba dispar
MVAAAREFMGSTTIDNETK

SEQ ID NO: 2496996 - protein, 20 aa, Entamoeba dispar
MVASHLLELTKIYNTYGTIY

SEQ ID NO: 2496997 - protein, 20 aa, Entamoeba dispar
MVCAVVARTLSIIWNIPLIG

SEQ ID NO: 2496998 - protein, 19 aa, Entamoeba dispar
MVDIAYKKSIEFKVDSLHK

SEQ ID NO: 2496999 - protein, 20 aa, Entamoeba dispar
MVDLPEWVRRYSKKNMDDLD

SEQ ID NO: 2497000 - protein, 18 aa, Entamoeba dispar
MVEFFNKFIKTCLKYIGI

SEQ ID NO: 2497001 - protein, 24 aa, Entamoeba dispar
MVELPLRHPQLFKNIGIKPPRGIL

SEQ ID NO: 2497002 - protein, 20 aa, Entamoeba dispar
MVEQICKFLYTPNDVDTLLK

SEQ ID NO: 2497003 - protein, 18 aa, Entamoeba dispar
MVFKGHTNAVMSLTLNPK

SEQ ID NO: 2497004 - protein, 19 aa, Entamoeba dispar
MVFPFCFPEGESMINKKDG

SEQ ID NO: 2497005 - protein, 24 aa, Entamoeba dispar
MVGESSVGKTCCMNRYVSNEFAEQ

SEQ ID NO: 2497006 - protein, 23 aa, Entamoeba dispar
MVGMSCIENGYKTYGIKCLKSGM

SEQ ID NO: 2497007 - protein, 21 aa, Entamoeba dispar
MVGSGRWIDESPFLTLIGVHQ

SEQ ID NO: 2497008 - protein, 22 aa, Entamoeba dispar
MVHCGSRGLGHQVCQDYIDLCM

SEQ ID NO: 2497009 - protein, 19 aa, Entamoeba dispar
MVHRNLRTSVIMIKINPIT

SEQ ID NO: 2497010 - protein, 24 aa, Entamoeba dispar
MVIDLAEGCLLDYVQNKGGKYPES

SEQ ID NO: 2497011 - protein, 17 aa, Entamoeba dispar
MVIPFQLAPVSSIIPSL

SEQ ID NO: 2497012 - protein, 17 aa, Entamoeba dispar
MVKELLIKKGEMPFFQF

SEQ ID NO: 2497013 - protein, 24 aa, Entamoeba dispar
MVKRHCKALRKMHVIDGVDGKYNS

SEQ ID NO: 2497014 - protein, 23 aa, Entamoeba dispar
MVLPGQIHPGLGIGHEIEEMLMD

SEQ ID NO: 2497015 - protein, 17 aa, Entamoeba dispar
MVLRTLYNILRQRIGNK

SEQ ID NO: 2497016 - protein, 17 aa, Entamoeba dispar
MVLSIPFDIKEIDDTKI

SEQ ID NO: 2497017 - protein, 18 aa, Entamoeba dispar
MVLTGWLRLDHGFYKILE

SEQ ID NO: 2497018 - protein, 21 aa, Entamoeba dispar
MVLVRLCLLHGQIYSPIYVQM

SEQ ID NO: 2497019 - protein, 18 aa, Entamoeba dispar
MVMDGARVILFFFDLTRV

SEQ ID NO: 2497020 - protein, 29 aa, Entamoeba dispar
MVNCLKGCCDKECKQQCTHLLSYIKEVDD

SEQ ID NO: 2497021 - protein, 20 aa, Entamoeba dispar
MVNFFPKTYGFIVMEKDNLG

SEQ ID NO: 2497022 - protein, 32 aa, Entamoeba dispar
MVNKKCLEAMKFLKINPCFTRNFYKNQTTQEV

SEQ ID NO: 2497023 - protein, 19 aa, Entamoeba dispar
MVNQLLFFDCIKVLTEKIN

SEQ ID NO: 2497024 - protein, 19 aa, Entamoeba dispar
MVNTLDFINNVLLSCITLP

SEQ ID NO: 2497025 - protein, 22 aa, Entamoeba dispar
MVPCHFEILRTELIDEIERRSK

SEQ ID NO: 2497026 - protein, 17 aa, Entamoeba dispar
MVPEIVKQVTLEGYTNS

SEQ ID NO: 2497027 - protein, 17 aa, Entamoeba dispar
MVPKTPGNFAFELTSGV

SEQ ID NO: 2497028 - protein, 18 aa, Entamoeba dispar
MVRFKQNYERAFAIRYFI

SEQ ID NO: 2497029 - protein, 24 aa, Entamoeba dispar
MVSKMFKARIIAFDYPGYGLNKNK

SEQ ID NO: 2497030 - protein, 25 aa, Entamoeba dispar
MVTRSGVFFHIDFGHFLGNFKSKFG

SEQ ID NO: 2497031 - protein, 18 aa, Entamoeba dispar
MVVNEGINGYVIGMMCSK

SEQ ID NO: 2497032 - protein, 18 aa, Entamoeba dispar
MWDLVAYRIKFFPHPVTG

SEQ ID NO: 2497033 - protein, 20 aa, Entamoeba dispar
MWLKDLDAFVKKYPQWLEEE

SEQ ID NO: 2497034 - protein, 29 aa, Entamoeba dispar
MWSFGCMAAELFVGIPIFPGNSEYNMLYK

SEQ ID NO: 2497035 - protein, 17 aa, Entamoeba dispar
MWSFGCVAAELFLGIPL

SEQ ID NO: 2497036 - protein, 26 aa, Entamoeba dispar
MWSIGCIIFECFIKRPPFQATTEAET

SEQ ID NO: 2497037 - protein, 29 aa, Entamoeba dispar
MWSLGCIAAEFFLGIPIFPGNSEYNQLYK

SEQ ID NO: 2497038 - protein, 24 aa, Entamoeba dispar
MWSLGCMLFQFLTGEFPFRGKSDK

SEQ ID NO: 2497039 - protein, 29 aa, Entamoeba dispar
MWSVGCIIAELFLGVPLFPADSEFDLIVR

SEQ ID NO: 2497040 - protein, 24 aa, Entamoeba dispar
MWVIQRVGANIGFILTLDEINKVY

SEQ ID NO: 2497041 - protein, 17 aa, Entamoeba dispar
MYAECYLLCDQRKVNEK

SEQ ID NO: 2497042 - protein, 23 aa, Entamoeba dispar
MYCIQKGLIEFCSKKLEDFKSMK

SEQ ID NO: 2497043 - protein, 22 aa, Entamoeba dispar
MYECTSVPASIAFLNGNFITSR

SEQ ID NO: 2497044 - protein, 21 aa, Entamoeba dispar
MYEHFCYRATAQVSIAAKALQ

SEQ ID NO: 2497045 - protein, 21 aa, Entamoeba dispar
MYFRNASCVILVFDVSNFQSF

SEQ ID NO: 2497046 - protein, 19 aa, Entamoeba dispar
MYFVDSRGLHGFDNTSSEN

SEQ ID NO: 2497047 - protein, 26 aa, Entamoeba dispar
MYIEEKFKECCFVKLLSDRCTGLIDQ

SEQ ID NO: 2497048 - protein, 19 aa, Entamoeba dispar
MYIVMEYVEGLTLAQYLQL

SEQ ID NO: 2497049 - protein, 20 aa, Entamoeba dispar
MYLKPIVRRNDIIIKQQKPK

SEQ ID NO: 2497050 - protein, 17 aa, Entamoeba dispar
MYNELFDDCILYYSSNI

SEQ ID NO: 2497051 - protein, 20 aa, Entamoeba dispar
MYNHLLVGYSNEFPLTGEMS

SEQ ID NO: 2497052 - protein, 24 aa, Entamoeba dispar
MYNVIEIRKQFAIDSVSREIEKMA

SEQ ID NO: 2497053 - protein, 18 aa, Entamoeba dispar
MYQWLLQALFGIKIAYRC

SEQ ID NO: 2497054 - protein, 20 aa, Entamoeba dispar
MYRHGLWCKDIIVTLTDIIS

SEQ ID NO: 2497055 - protein, 17 aa, Entamoeba dispar
MYSAFWLTTDGKVTFHQ

SEQ ID NO: 2497056 - protein, 22 aa, Entamoeba dispar
MYSYCLDCLKVQIINNKIEPIV

SEQ ID NO: 2497057 - protein, 25 aa, Entamoeba dispar
MYTPEFSFLNSFSIKDIIDVSFSSN

SEQ ID NO: 2497058 - protein, 23 aa, Entamoeba dispar
MYVEGIKFLPFELVTKNEEMKTI

SEQ ID NO: 2497059 - protein, 20 aa, Entamoeba dispar
MYYRDLSIIAEIGLACIVKE

SEQ ID NO: 2497060 - protein, 17 aa, Entamoeba dispar
MYYRIEGKRIEIYSKES

SEQ ID NO: 2497061 - protein, 35 aa, Entamoeba dispar
NAAIDRLCALGFGRSQCLQAYIACDKNEQLAANFL

SEQ ID NO: 2497062 - protein, 20 aa, Entamoeba dispar
NACRLLPLIGGDAEMFESIL

SEQ ID NO: 2497063 - protein, 28 aa, Entamoeba dispar
NADAMYNYGLCFYKGFGHLKKNQIKAFD

SEQ ID NO: 2497064 - protein, 28 aa, Entamoeba dispar
NADGIIFCKNCGIVLDKSAMEYIPEEHK

SEQ ID NO: 2497065 - protein, 29 aa, Entamoeba dispar
NADIHRAIRCGFILSGGPAAGGHNVVAGL

SEQ ID NO: 2497066 - protein, 22 aa, Entamoeba dispar
NADMVIRIDFIRAIHLGRNSTT

SEQ ID NO: 2497067 - protein, 23 aa, Entamoeba dispar
NAEAQWKFDCFLNTAMESDKYIN

SEQ ID NO: 2497068 - protein, 26 aa, Entamoeba dispar
NAEEYRFEKGYGMGFGTRKHVFLDGD

SEQ ID NO: 2497069 - protein, 23 aa, Entamoeba dispar
NAEFKRLTLLMTNLPNKRLRDVS

SEQ ID NO: 2497070 - protein, 19 aa, Entamoeba dispar
NAEIKKNRKICCQILQEIS

SEQ ID NO: 2497071 - protein, 24 aa, Entamoeba dispar
NAEKCKACGAPLPAKGIAKTKIGS

SEQ ID NO: 2497072 - protein, 23 aa, Entamoeba dispar
NAEKILKSVIAFPVNSDDINEEV

SEQ ID NO: 2497073 - protein, 29 aa, Entamoeba dispar
NAELAPTHPIRLGLALNFSVFYFEIMNDA

SEQ ID NO: 2497074 - protein, 25 aa, Entamoeba dispar
NAEVKILQPFVWKGANPYEKMDVND

SEQ ID NO: 2497075 - protein, 17 aa, Entamoeba dispar
NAEYRWELEKVTKQKTA

SEQ ID NO: 2497076 - protein, 18 aa, Entamoeba dispar
NAFCTYKKVPINESVQAF

SEQ ID NO: 2497077 - protein, 17 aa, Entamoeba dispar
NAFGGWVPTWVVNSLIS

SEQ ID NO: 2497078 - protein, 19 aa, Entamoeba dispar
NAFHYIPRVYGFKLASSDY

SEQ ID NO: 2497079 - protein, 18 aa, Entamoeba dispar
NAFKSCMRLKTINLPPTV

SEQ ID NO: 2497080 - protein, 19 aa, Entamoeba dispar
NAFKYIMPCQIVLPNSITR

SEQ ID NO: 2497081 - protein, 17 aa, Entamoeba dispar
NAGINEYIGNLVIDENR

SEQ ID NO: 2497082 - protein, 24 aa, Entamoeba dispar
NAGKRLVHERCFVCKVCKEKISGK

SEQ ID NO: 2497083 - protein, 24 aa, Entamoeba dispar
NAGKWLIPYCVYRALIKSVDTPLP

SEQ ID NO: 2497084 - protein, 18 aa, Entamoeba dispar
NAHLPPSLFSNRWKALNK

SEQ ID NO: 2497085 - protein, 20 aa, Entamoeba dispar
NAIAIICEKVMKIITIESTS

SEQ ID NO: 2497086 - protein, 19 aa, Entamoeba dispar
NAIAQFLLMLIRGYSRKTA

SEQ ID NO: 2497087 - protein, 19 aa, Entamoeba dispar
NAICGKGNIMIIVMTEDSD

SEQ ID NO: 2497088 - protein, 18 aa, Entamoeba dispar
NAIDCLYGTIVSLQCSSE

SEQ ID NO: 2497089 - protein, 17 aa, Entamoeba dispar
NAIKEERDELVKQIRNI

SEQ ID NO: 2497090 - protein, 25 aa, Entamoeba dispar
NAILDIFFLHCKKWGLNPNAATQWC

SEQ ID NO: 2497091 - protein, 19 aa, Entamoeba dispar
NAIQIKFVDQFGIEENGVD

SEQ ID NO: 2497092 - protein, 25 aa, Entamoeba dispar
NAIVKGRARATFVSFDKKPVEEPQT

SEQ ID NO: 2497093 - protein, 25 aa, Entamoeba dispar
NAIYMDIMKVVERFSNESLENISYW

SEQ ID NO: 2497094 - protein, 28 aa, Entamoeba dispar
NAKDIYEHWGIIWASLRMLLEMTPGTLG

SEQ ID NO: 2497095 - protein, 23 aa, Entamoeba dispar
NAKKIGKLDGVFELKYLETTLEM

SEQ ID NO: 2497096 - protein, 19 aa, Entamoeba dispar
NAKLADFGIAKKATIEGCS

SEQ ID NO: 2497097 - protein, 22 aa, Entamoeba dispar
NAKLFMRIGNAYFKQDKYTEAL

SEQ ID NO: 2497098 - protein, 20 aa, Entamoeba dispar
NAKTRPKIITQYDYNPEEEE

SEQ ID NO: 2497099 - protein, 27 aa, Entamoeba dispar
NAKVIPNCIGNIWVYVRDWPEEKGRSG

SEQ ID NO: 2497100 - protein, 19 aa, Entamoeba dispar
NALCKRLDCKIKELYFPRA

SEQ ID NO: 2497101 - protein, 21 aa, Entamoeba dispar
NALLYLLLKKGWTIQLTKTKT

SEQ ID NO: 2497102 - protein, 22 aa, Entamoeba dispar
NALNCIVEGFEIIFDKGLDKKI

SEQ ID NO: 2497103 - protein, 18 aa, Entamoeba dispar
NALNEWYPGTTLYESLEK

SEQ ID NO: 2497104 - protein, 20 aa, Entamoeba dispar
NAMSQFVSWLLADEDNILGI

SEQ ID NO: 2497105 - protein, 29 aa, Entamoeba dispar
NAPNLKLDFPRAFLIMELCDGGDLDTFLS

SEQ ID NO: 2497106 - protein, 30 aa, Entamoeba dispar
NAPNLKLDFPRAFLIMELCDGGDLDTFLSN

SEQ ID NO: 2497107 - protein, 18 aa, Entamoeba dispar
NAQDFICIPGASDDIESS

SEQ ID NO: 2497108 - protein, 27 aa, Entamoeba dispar
NAQGFLKEMLLWFGWEEIESTPPATFI

SEQ ID NO: 2497109 - protein, 19 aa, Entamoeba dispar
NAQPPYILVGAIDNGSAPS

SEQ ID NO: 2497110 - protein, 19 aa, Entamoeba dispar
NAQPPYILVGAIDNSSAPS

SEQ ID NO: 2497111 - protein, 17 aa, Entamoeba dispar
NAQSKCEIVYFEYNTET

SEQ ID NO: 2497112 - protein, 23 aa, Entamoeba dispar
NARDCSVAVPFASKGINICIDIV

SEQ ID NO: 2497113 - protein, 25 aa, Entamoeba dispar
NAREINDFIVYWIAKLNKNYYKVTI

SEQ ID NO: 2497114 - protein, 26 aa, Entamoeba dispar
NASILKHLLALCGRITNCPESKMDNY

SEQ ID NO: 2497115 - protein, 20 aa, Entamoeba dispar
NASLLKKFLIQSNVSVTSRD

SEQ ID NO: 2497116 - protein, 20 aa, Entamoeba dispar
NASLRAKYVDRFQKEKRIRI

SEQ ID NO: 2497117 - protein, 20 aa, Entamoeba dispar
NASLVIQKLPPGQMSNNELP

SEQ ID NO: 2497118 - protein, 30 aa, Entamoeba dispar
NASSKPTIRCFKCLECFTSISSVIQHWKLC

SEQ ID NO: 2497119 - protein, 23 aa, Entamoeba dispar
NATAEDGINCTIKFFESVGGITR

SEQ ID NO: 2497120 - protein, 18 aa, Entamoeba dispar
NATKGCQKFMILYQLNSG

SEQ ID NO: 2497121 - protein, 23 aa, Entamoeba dispar
NAVDGRDGLVFSGGDDGTAVMFD

SEQ ID NO: 2497122 - protein, 17 aa, Entamoeba dispar
NAVDLAFSALFDDIESI

SEQ ID NO: 2497123 - protein, 20 aa, Entamoeba dispar
NAVKGFDVTGEWQIISCGDE

SEQ ID NO: 2497124 - protein, 26 aa, Entamoeba dispar
NAVPFSRLLSFFSFIRLKQPIICVSV

SEQ ID NO: 2497125 - protein, 23 aa, Entamoeba dispar
NAVREVRPTLLTRRRNFNTRNEH

SEQ ID NO: 2497126 - protein, 20 aa, Entamoeba dispar
NAVVGLGFHKAAITGLAVTR

SEQ ID NO: 2497127 - protein, 18 aa, Entamoeba dispar
NAYSIGFAAMLTGRYVCY

SEQ ID NO: 2497128 - protein, 31 aa, Entamoeba dispar
NCAECYKTCCYPCRVPFFISNFTARGCSCIS

SEQ ID NO: 2497129 - protein, 20 aa, Entamoeba dispar
NCASFIRPSITILTHGLSMV

SEQ ID NO: 2497130 - protein, 23 aa, Entamoeba dispar
NCCDGFKLIMELVHSHIAAVVLK

SEQ ID NO: 2497131 - protein, 22 aa, Entamoeba dispar
NCDITNFWKVKGIIKMFTISNE

SEQ ID NO: 2497132 - protein, 25 aa, Entamoeba dispar
NCFDCPWDKDCCGCVLTDKILQQYD

SEQ ID NO: 2497133 - protein, 19 aa, Entamoeba dispar
NCFEGCSLTSINIPTTITK

SEQ ID NO: 2497134 - protein, 17 aa, Entamoeba dispar
NCFEIFKYNENELNKLS

SEQ ID NO: 2497135 - protein, 19 aa, Entamoeba dispar
NCFNGCVLLTAISIPSTIN

SEQ ID NO: 2497136 - protein, 17 aa, Entamoeba dispar
NCFSECFNLRFVPFPPS

SEQ ID NO: 2497137 - protein, 17 aa, Entamoeba dispar
NCFTKDMLFEYTGNVRE

SEQ ID NO: 2497138 - protein, 25 aa, Entamoeba dispar
NCFYGCSRLPSITIPSTINKMGHLC

SEQ ID NO: 2497139 - protein, 27 aa, Entamoeba dispar
NCIELKINGRYGVDMSMKTIVQKPTDT

SEQ ID NO: 2497140 - protein, 17 aa, Entamoeba dispar
NCIKNCVIQSNNKLIIQ

SEQ ID NO: 2497141 - protein, 19 aa, Entamoeba dispar
NCISYPSVMNVAGIISVYQ

SEQ ID NO: 2497142 - protein, 22 aa, Entamoeba dispar
NCKIINRVGGKLTIQMKTKTIT

SEQ ID NO: 2497143 - protein, 39 aa, Entamoeba dispar
NCKKCKKTCHYPCHVPSLVSFFTIRACHCIENGRCTVCG

SEQ ID NO: 2497144 - protein, 37 aa, Entamoeba dispar
NCKKCKRTCHYPCHVPSLISLFTIRACHCIENGRCTV

SEQ ID NO: 2497145 - protein, 37 aa, Entamoeba dispar
NCKKCNKTCHYPCSVPSIVSFFTMKFCHCIEDGYCNV

SEQ ID NO: 2497146 - protein, 25 aa, Entamoeba dispar
NCKSGSYLLSCIEILIECFKSINEL

SEQ ID NO: 2497147 - protein, 26 aa, Entamoeba dispar
NCKSGSYLLSCIEILIECFKSINELN

SEQ ID NO: 2497148 - protein, 21 aa, Entamoeba dispar
NCKYIPCIYVINKIDAMEPSE

SEQ ID NO: 2497149 - protein, 24 aa, Entamoeba dispar
NCLIPEIKNGWVLEPQKLAPIFLT

SEQ ID NO: 2497150 - protein, 29 aa, Entamoeba dispar
NCLKCNRTCHYPCYIKGDMKKNCACIGDK

SEQ ID NO: 2497151 - protein, 27 aa, Entamoeba dispar
NCLKCNRTCHYPCYISGDVKDRCYCIG

SEQ ID NO: 2497152 - protein, 24 aa, Entamoeba dispar
NCLPFKEVLFHSIVRDAQGRKMSK

SEQ ID NO: 2497153 - protein, 31 aa, Entamoeba dispar
NCLRCKNTSCHYPCFIPGDVKDGCYCIGANG

SEQ ID NO: 2497154 - protein, 27 aa, Entamoeba dispar
NCLRCNRTCHYPCYIEGDIKDGCYCIG

SEQ ID NO: 2497155 - protein, 20 aa, Entamoeba dispar
NCLTSLEICQNAKSFNLPNS

SEQ ID NO: 2497156 - protein, 22 aa, Entamoeba dispar
NCMGQSPLLLGIRNKHKESIEI

SEQ ID NO: 2497157 - protein, 27 aa, Entamoeba dispar
NCMTCKCGYQFCWLCMQPYTKTHWKNN

SEQ ID NO: 2497158 - protein, 19 aa, Entamoeba dispar
NCNQLLFKDLEKIIKNDSY

SEQ ID NO: 2497159 - protein, 21 aa, Entamoeba dispar
NCNSISWTILSFISPNNIYGV

SEQ ID NO: 2497160 - protein, 25 aa, Entamoeba dispar
NCPDDWKLNGLDIIHYVSDDELQNR

SEQ ID NO: 2497161 - protein, 19 aa, Entamoeba dispar
NCPYNIMSHNTPIEVSTFF

SEQ ID NO: 2497162 - protein, 19 aa, Entamoeba dispar
NCQFTRKVYQYDIQIELEN

SEQ ID NO: 2497163 - protein, 21 aa, Entamoeba dispar
NCQTIKAAIIYKEPQLLKYEE

SEQ ID NO: 2497164 - protein, 17 aa, Entamoeba dispar
NCQYKRCLTKCCIPLQG

SEQ ID NO: 2497165 - protein, 17 aa, Entamoeba dispar
NCRLSCLPTKNGLPEYI

SEQ ID NO: 2497166 - protein, 19 aa, Entamoeba dispar
NCRVRIIDLEFERNVDEQQ

SEQ ID NO: 2497167 - protein, 24 aa, Entamoeba dispar
NCRYCPQCGTGVIGDPNIPEIECQ

SEQ ID NO: 2497168 - protein, 18 aa, Entamoeba dispar
NCSEELQYIIAIPENSLE

SEQ ID NO: 2497169 - protein, 19 aa, Entamoeba dispar
NCSGLKSIQIPLGIHCLDE

SEQ ID NO: 2497170 - protein, 28 aa, Entamoeba dispar
NCSPSSKMKLSFAIRMSKKLPYVKQMLL

SEQ ID NO: 2497171 - protein, 18 aa, Entamoeba dispar
NCSVFKKTIGFTANIDLN

SEQ ID NO: 2497172 - protein, 21 aa, Entamoeba dispar
NCSYPTLYLIPQIITFTEHQL

SEQ ID NO: 2497173 - protein, 18 aa, Entamoeba dispar
NCTLPYYCLPNPFKRLGV

SEQ ID NO: 2497174 - protein, 26 aa, Entamoeba dispar
NCTVMVVADGCGWGVTSARAAHIAVE

SEQ ID NO: 2497175 - protein, 19 aa, Entamoeba dispar
NCVDSILCLMIQDNVSPQI

SEQ ID NO: 2497176 - protein, 19 aa, Entamoeba dispar
NCVECKEGYYLKGQTLKSQ

SEQ ID NO: 2497177 - protein, 22 aa, Entamoeba dispar
NCVEITRLIFEKMREENEVPCF

SEQ ID NO: 2497178 - protein, 17 aa, Entamoeba dispar
NCVKIHITSSLASRKLL

SEQ ID NO: 2497179 - protein, 17 aa, Entamoeba dispar
NCVLDVLRRAGLNEKTV

SEQ ID NO: 2497180 - protein, 26 aa, Entamoeba dispar
NCVRCNRSCHPRCFIPGDVKDGCSCI

SEQ ID NO: 2497181 - protein, 27 aa, Entamoeba dispar
NCVTPRSLFCSEIGFLSANLYATTVFG

SEQ ID NO: 2497182 - protein, 21 aa, Entamoeba dispar
NCYIHSILFIHKKVNQMEYSK

SEQ ID NO: 2497183 - protein, 20 aa, Entamoeba dispar
NCYKCVCGNVSISVKSVGEQ

SEQ ID NO: 2497184 - protein, 21 aa, Entamoeba dispar
NDAKTAFKRLVYSRYRGIPLY

SEQ ID NO: 2497185 - protein, 24 aa, Entamoeba dispar
NDARKRLQPDYVPEKVLAKKPFKQ

SEQ ID NO: 2497186 - protein, 28 aa, Entamoeba dispar
NDARLLSTISRGYAQLAMYVKAVNNNSS

SEQ ID NO: 2497187 - protein, 21 aa, Entamoeba dispar
NDCCDYCKNKRSVQAKYLGQI

SEQ ID NO: 2497188 - protein, 18 aa, Entamoeba dispar
NDCEKGICRTCNEMKLTD

SEQ ID NO: 2497189 - protein, 18 aa, Entamoeba dispar
NDCFRGCTSLQNLVIPTS

SEQ ID NO: 2497190 - protein, 22 aa, Entamoeba dispar
NDCICLFLLVLCIRLSLNKNVN

SEQ ID NO: 2497191 - protein, 20 aa, Entamoeba dispar
NDCNHLVFRNGLLLMSSSKG

SEQ ID NO: 2497192 - protein, 26 aa, Entamoeba dispar
NDDLFLVVGCINGFINIFSIKTGVIV

SEQ ID NO: 2497193 - protein, 25 aa, Entamoeba dispar
NDDWFLETYCGFIISGNEVMFNKRL

SEQ ID NO: 2497194 - protein, 23 aa, Entamoeba dispar
NDEEGYEMAMVWFEQAAELGSEE

SEQ ID NO: 2497195 - protein, 21 aa, Entamoeba dispar
NDEFFCISHKNLITVYNRKFE

SEQ ID NO: 2497196 - protein, 17 aa, Entamoeba dispar
NDELLEIGFDFSQPSEK

SEQ ID NO: 2497197 - protein, 24 aa, Entamoeba dispar
NDELSHSFLPPIISSQFNPTQNLI

SEQ ID NO: 2497198 - protein, 23 aa, Entamoeba dispar
NDELWMELIRVCGNDEKEIEVVF

SEQ ID NO: 2497199 - protein, 24 aa, Entamoeba dispar
NDEMKEIYYENSLSILFNTDNKKL

SEQ ID NO: 2497200 - protein, 18 aa, Entamoeba dispar
NDEMRGIFNKMYSLTNLH

SEQ ID NO: 2497201 - protein, 17 aa, Entamoeba dispar
NDFISFNGVISVIKDED

SEQ ID NO: 2497202 - protein, 18 aa, Entamoeba dispar
NDFISFNGVISVIKDEDR

SEQ ID NO: 2497203 - protein, 17 aa, Entamoeba dispar
NDFKLSHKFRYIVFKMN

SEQ ID NO: 2497204 - protein, 17 aa, Entamoeba dispar
NDFLKDTMTVIIYQTVV

SEQ ID NO: 2497205 - protein, 25 aa, Entamoeba dispar
NDFLPEYRRAYATVAFHGTYLPKHL

SEQ ID NO: 2497206 - protein, 27 aa, Entamoeba dispar
NDFLRKRNKYLLKIKNWIEEKCKPFPM

SEQ ID NO: 2497207 - protein, 24 aa, Entamoeba dispar
NDFQSEGLFNLSLLINDGGGDIDK

SEQ ID NO: 2497208 - protein, 19 aa, Entamoeba dispar
NDFRIPTMITKLDDNCFSE

SEQ ID NO: 2497209 - protein, 18 aa, Entamoeba dispar
NDFVPYCDIAIFEYSNLI

SEQ ID NO: 2497210 - protein, 22 aa, Entamoeba dispar
NDGKAILALCHAYTRLTGENGF

SEQ ID NO: 2497211 - protein, 25 aa, Entamoeba dispar
NDGLLNFCLSYGFKGEDNRPKASKE

SEQ ID NO: 2497212 - protein, 24 aa, Entamoeba dispar
NDGLRAEGIFRLSSSIDETKRLKE

SEQ ID NO: 2497213 - protein, 25 aa, Entamoeba dispar
NDGRIFKYVIWYKVDYSRYLQEKKQ

SEQ ID NO: 2497214 - protein, 26 aa, Entamoeba dispar
NDGRIIKLLIWYAVNYSTYLKEKKKG

SEQ ID NO: 2497215 - protein, 17 aa, Entamoeba dispar
NDHFGIIVNEMHNITED

SEQ ID NO: 2497216 - protein, 18 aa, Entamoeba dispar
NDHLHLFSNTSVFTTVKT

SEQ ID NO: 2497217 - protein, 17 aa, Entamoeba dispar
NDHQIIVGFAMETQDLI

SEQ ID NO: 2497218 - protein, 23 aa, Entamoeba dispar
NDICSTCIQSAIQHAEYLRSNPL

SEQ ID NO: 2497219 - protein, 17 aa, Entamoeba dispar
NDICWELVSGYKPRIDV

SEQ ID NO: 2497220 - protein, 19 aa, Entamoeba dispar
NDIIMLFLHTFSLCSQETE

SEQ ID NO: 2497221 - protein, 24 aa, Entamoeba dispar
NDIIPARIVNEWSSDIPKLTSNLS

SEQ ID NO: 2497222 - protein, 27 aa, Entamoeba dispar
NDIIQFCINLRLLLRLTDSKAKPNKLP

SEQ ID NO: 2497223 - protein, 17 aa, Entamoeba dispar
NDIIQRFIELTKGQSIK

SEQ ID NO: 2497224 - protein, 23 aa, Entamoeba dispar
NDIKDFYNGIIICKKFKEIPLMF

SEQ ID NO: 2497225 - protein, 24 aa, Entamoeba dispar
NDIKGDAYSSLILLLTNMGRIDIT

SEQ ID NO: 2497226 - protein, 23 aa, Entamoeba dispar
NDIKHWSVNPPFYSPIQQENIDN

SEQ ID NO: 2497227 - protein, 24 aa, Entamoeba dispar
NDIKIIPTTEFKELIQSNNIDIEK

SEQ ID NO: 2497228 - protein, 25 aa, Entamoeba dispar
NDIKKMLLEFVEFKNQFISFTNDDY

SEQ ID NO: 2497229 - protein, 21 aa, Entamoeba dispar
NDIKSGMIIEGIIKEINENGI

SEQ ID NO: 2497230 - protein, 17 aa, Entamoeba dispar
NDILFTLMESLRKIKQQ

SEQ ID NO: 2497231 - protein, 23 aa, Entamoeba dispar
NDIPFFVKNGFKGVARSMPTSAA

SEQ ID NO: 2497232 - protein, 25 aa, Entamoeba dispar
NDIPIDRIVGVFLIDEDWQFEDLPF

SEQ ID NO: 2497233 - protein, 20 aa, Entamoeba dispar
NDIPRTLTILKIENENNIVN

SEQ ID NO: 2497234 - protein, 25 aa, Entamoeba dispar
NDIQRIFKVLSFVREKGCNHIVQPM

SEQ ID NO: 2497235 - protein, 28 aa, Entamoeba dispar
NDIRIMASLCLLELIQKFDIGVAYQEYR

SEQ ID NO: 2497236 - protein, 23 aa, Entamoeba dispar
NDISKDRLKAVIGNVHRLGITNT

SEQ ID NO: 2497237 - protein, 25 aa, Entamoeba dispar
NDISPKDFHEWIPPEREFPFKVYGH

SEQ ID NO: 2497238 - protein, 23 aa, Entamoeba dispar
NDITRIKNALIYYIQYNQPISSV

SEQ ID NO: 2497239 - protein, 25 aa, Entamoeba dispar
NDITWPEFKSLISTRGEQITINIKY

SEQ ID NO: 2497240 - protein, 21 aa, Entamoeba dispar
NDIVPRLSFDSIKNIQPLINE

SEQ ID NO: 2497241 - protein, 17 aa, Entamoeba dispar
NDIYIFIKECVVFCNNC

SEQ ID NO: 2497242 - protein, 21 aa, Entamoeba dispar
NDKGKSILMLLSKIYQTFVNQ

SEQ ID NO: 2497243 - protein, 21 aa, Entamoeba dispar
NDKIKALALIVSSGPFNTYNY

SEQ ID NO: 2497244 - protein, 33 aa, Entamoeba dispar
NDKLPKCLVMVGGKPIIQWQIEVLEKLNVKELE

SEQ ID NO: 2497245 - protein, 20 aa, Entamoeba dispar
NDKLYICLYDGQSFCEECLH

SEQ ID NO: 2497246 - protein, 28 aa, Entamoeba dispar
NDKNRLNWCIPPLVFALLKAGRVQESLR

SEQ ID NO: 2497247 - protein, 22 aa, Entamoeba dispar
NDKRIGKIYVHYAYYDDTCVVV

SEQ ID NO: 2497248 - protein, 23 aa, Entamoeba dispar
NDKRLKLKGGNEVIIGFNDEIIN

SEQ ID NO: 2497249 - protein, 20 aa, Entamoeba dispar
NDKTLGYKRIKLILNADFNK

SEQ ID NO: 2497250 - protein, 22 aa, Entamoeba dispar
NDKWITGIHCGYYLGIEDSSFV

SEQ ID NO: 2497251 - protein, 26 aa, Entamoeba dispar
NDLDCLLKMVLIDSVKFFPHQYQSKE

SEQ ID NO: 2497252 - protein, 17 aa, Entamoeba dispar
NDLDHLPKALVNMKIIS

SEQ ID NO: 2497253 - protein, 18 aa, Entamoeba dispar
NDLFKYPTIQTIQSYLTN

SEQ ID NO: 2497254 - protein, 23 aa, Entamoeba dispar
NDLHFKLLNEFSKKILKSQYNLL

SEQ ID NO: 2497255 - protein, 21 aa, Entamoeba dispar
NDLIRLFYIYLLNSNESNLLQ

SEQ ID NO: 2497256 - protein, 24 aa, Entamoeba dispar
NDLKKAYRKLALKWHPDRNPNNKE

SEQ ID NO: 2497257 - protein, 23 aa, Entamoeba dispar
NDLKVNDCGLIIVVTDDEVFNNN

SEQ ID NO: 2497258 - protein, 23 aa, Entamoeba dispar
NDLKVNDCGLIIVVTDEEVINNN

SEQ ID NO: 2497259 - protein, 24 aa, Entamoeba dispar
NDLLREEVQNCYNAEDKSFELENY

SEQ ID NO: 2497260 - protein, 21 aa, Entamoeba dispar
NDLLRLCWGLMTVADFTVRRN

SEQ ID NO: 2497261 - protein, 19 aa, Entamoeba dispar
NDLNNIIWLCVIAKTEIPR

SEQ ID NO: 2497262 - protein, 26 aa, Entamoeba dispar
NDLVQELGIFLGRYISQYLYKTYGEY

SEQ ID NO: 2497263 - protein, 17 aa, Entamoeba dispar
NDLYGPVNPILENSEEI

SEQ ID NO: 2497264 - protein, 17 aa, Entamoeba dispar
NDMINNFIAMLTFCDGK

SEQ ID NO: 2497265 - protein, 24 aa, Entamoeba dispar
NDMKRKEVKMVRCHDIKIVDTSNS

SEQ ID NO: 2497266 - protein, 29 aa, Entamoeba dispar
NDMKSRMYLNFTICFSSKISSELLQYFAN

SEQ ID NO: 2497267 - protein, 19 aa, Entamoeba dispar
NDNCYRYANNLLPVVIRYS

SEQ ID NO: 2497268 - protein, 25 aa, Entamoeba dispar
NDNELKILILQTFHMVQKQIDELKI

SEQ ID NO: 2497269 - protein, 20 aa, Entamoeba dispar
NDNKMCYCRGLNYFNKIYLE

SEQ ID NO: 2497270 - protein, 22 aa, Entamoeba dispar
NDNLKLLLQNIIKNTSVAPIII

SEQ ID NO: 2497271 - protein, 20 aa, Entamoeba dispar
NDNLKVFFKQNIKDSIQNKC

SEQ ID NO: 2497272 - protein, 19 aa, Entamoeba dispar
NDNPFHWIVSFFGFNDNTK

SEQ ID NO: 2497273 - protein, 18 aa, Entamoeba dispar
NDPCCFRTTEEIIGVEDF

SEQ ID NO: 2497274 - protein, 25 aa, Entamoeba dispar
NDPDFKWEFPKELEIPAELKPKLLK

SEQ ID NO: 2497275 - protein, 26 aa, Entamoeba dispar
NDPIKRDGYKWFAIQKVINKKQTSRN

SEQ ID NO: 2497276 - protein, 23 aa, Entamoeba dispar
NDPLLFRLIEKIGRYSIKPKSCK

SEQ ID NO: 2497277 - protein, 19 aa, Entamoeba dispar
NDPNHFIFTLGGCRGTKPK

SEQ ID NO: 2497278 - protein, 17 aa, Entamoeba dispar
NDPSILSIRSLRQCHLP

SEQ ID NO: 2497279 - protein, 20 aa, Entamoeba dispar
NDQIIPWIISHQEILIQDES

SEQ ID NO: 2497280 - protein, 23 aa, Entamoeba dispar
NDQRLQFYTSYVQRNITSLRKNI

SEQ ID NO: 2497281 - protein, 30 aa, Entamoeba dispar
NDQSGWIYYRWLLGTGMKCYNELNKKEEWI

SEQ ID NO: 2497282 - protein, 23 aa, Entamoeba dispar
NDQSIFWKLYYKSTVYNNEHVLL

SEQ ID NO: 2497283 - protein, 25 aa, Entamoeba dispar
NDQVREHIKRVCVIYSLEHSELQYN

SEQ ID NO: 2497284 - protein, 25 aa, Entamoeba dispar
NDRFKIKLCDFGSCKCLNQKESYPT

SEQ ID NO: 2497285 - protein, 21 aa, Entamoeba dispar
NDRLIEIIGFISANHFIVCET

SEQ ID NO: 2497286 - protein, 31 aa, Entamoeba dispar
NDRSVIYWDIPFSEYKLGRNLTLIKEHVDGI

SEQ ID NO: 2497287 - protein, 19 aa, Entamoeba dispar
NDRYEFPRELDLYPYCIEH

SEQ ID NO: 2497288 - protein, 22 aa, Entamoeba dispar
NDSDNCIIFSFKANKKEPIIIT

SEQ ID NO: 2497289 - protein, 17 aa, Entamoeba dispar
NDSMKFGDVTRVDEIPK

SEQ ID NO: 2497290 - protein, 24 aa, Entamoeba dispar
NDSRDCSYFYGYEAVVQFLESNEI

SEQ ID NO: 2497291 - protein, 18 aa, Entamoeba dispar
NDTFPVICCGDFNVNGRA

SEQ ID NO: 2497292 - protein, 25 aa, Entamoeba dispar
NDTKKAETFTIPFGTKQQNQINKSK

SEQ ID NO: 2497293 - protein, 23 aa, Entamoeba dispar
NDTRLARRILRDMNYRGRTLDSV

SEQ ID NO: 2497294 - protein, 25 aa, Entamoeba dispar
NDVCYLCGKTGHWARDCNEKRYRRR

SEQ ID NO: 2497295 - protein, 19 aa, Entamoeba dispar
NDVDFVAAGIYCFQPYCVT

SEQ ID NO: 2497296 - protein, 22 aa, Entamoeba dispar
NDVIMGSLFIRLLHVKICRVEM

SEQ ID NO: 2497297 - protein, 22 aa, Entamoeba dispar
NDVINFASIMFIKPSSDESIIF

SEQ ID NO: 2497298 - protein, 18 aa, Entamoeba dispar
NDVINNFIAMLTFCDGED

SEQ ID NO: 2497299 - protein, 18 aa, Entamoeba dispar
NDVKKNFIAMLTFCDGKT

SEQ ID NO: 2497300 - protein, 20 aa, Entamoeba dispar
NDWVDGRMIKLVLGPEDPLG

SEQ ID NO: 2497301 - protein, 27 aa, Entamoeba dispar
NDYHSFLLNRHRRFKILGIEVPKSTTP

SEQ ID NO: 2497302 - protein, 18 aa, Entamoeba dispar
NDYSISLRIQLGDFVYST

SEQ ID NO: 2497303 - protein, 26 aa, Entamoeba dispar
NDYSKISPFYACSSVNCSDTTMDLEP

SEQ ID NO: 2497304 - protein, 18 aa, Entamoeba dispar
NEAACTRSKKGLLHNCEL

SEQ ID NO: 2497305 - protein, 19 aa, Entamoeba dispar
NEAIRCFESALTIDSNLIS

SEQ ID NO: 2497306 - protein, 25 aa, Entamoeba dispar
NEAKEPRFSLAINEGNEGSRLSHDH

SEQ ID NO: 2497307 - protein, 25 aa, Entamoeba dispar
NEAKGCNGLVLWLDCDREGENICFE

SEQ ID NO: 2497308 - protein, 21 aa, Entamoeba dispar
NEALCTVILGIGRLICYNPKV

SEQ ID NO: 2497309 - protein, 21 aa, Entamoeba dispar
NEAPRPVTIRVNTLKSRRREL

SEQ ID NO: 2497310 - protein, 17 aa, Entamoeba dispar
NEAQKIPLFIAAGCEST

SEQ ID NO: 2497311 - protein, 21 aa, Entamoeba dispar
NEAYRQVVWMMHQLYHDCNMV

SEQ ID NO: 2497312 - protein, 20 aa, Entamoeba dispar
NECFYECGLSSITIPITVSR

SEQ ID NO: 2497313 - protein, 17 aa, Entamoeba dispar
NECIAHILYYLNAQPIQ

SEQ ID NO: 2497314 - protein, 17 aa, Entamoeba dispar
NECILNYQEIWRKIESI

SEQ ID NO: 2497315 - protein, 29 aa, Entamoeba dispar
NECRFEIIKEIILFIKFVCQKHNIIKEEK

SEQ ID NO: 2497316 - protein, 25 aa, Entamoeba dispar
NEDAVYLLRCQIINSCISYMEEYAT

SEQ ID NO: 2497317 - protein, 22 aa, Entamoeba dispar
NEDCILELPLFIEKLSTIQSQI

SEQ ID NO: 2497318 - protein, 29 aa, Entamoeba dispar
NEDDCFRVGIKFGMNGVHFYSNFYESDLI

SEQ ID NO: 2497319 - protein, 18 aa, Entamoeba dispar
NEDIDGWFELKKKKEDKK

SEQ ID NO: 2497320 - protein, 20 aa, Entamoeba dispar
NEDIEICRMEKPLNYEYEEG

SEQ ID NO: 2497321 - protein, 25 aa, Entamoeba dispar
NEDIFKACIGCLWNLSIDPDVTPQM

SEQ ID NO: 2497322 - protein, 18 aa, Entamoeba dispar
NEDLCKKIDSIFTQSNNP

SEQ ID NO: 2497323 - protein, 26 aa, Entamoeba dispar
NEDLRIKIFLWKTIQCDKSLGTVRGG

SEQ ID NO: 2497324 - protein, 23 aa, Entamoeba dispar
NEEEPRFLKGKIKEINNSKIKEV

SEQ ID NO: 2497325 - protein, 26 aa, Entamoeba dispar
NEEFKCPNLEFIGCTSMNKNEDMGIG

SEQ ID NO: 2497326 - protein, 19 aa, Entamoeba dispar
NEEFKVIIQKPVKKASVTQ

SEQ ID NO: 2497327 - protein, 21 aa, Entamoeba dispar
NEEHRILPFNSYYDIINSLLI

SEQ ID NO: 2497328 - protein, 23 aa, Entamoeba dispar
NEEIKEFFNQAGEVVHVEQVIDT

SEQ ID NO: 2497329 - protein, 26 aa, Entamoeba dispar
NEEKAEVLRTCIDYQLNDFLDIIKTI

SEQ ID NO: 2497330 - protein, 29 aa, Entamoeba dispar
NEEKKELFSRVGMELGIYFDEAYIKKLVI

SEQ ID NO: 2497331 - protein, 19 aa, Entamoeba dispar
NEEPFGQVGLICIKNQNYF

SEQ ID NO: 2497332 - protein, 21 aa, Entamoeba dispar
NEEPFGQVGLICIKNQNYFCI

SEQ ID NO: 2497333 - protein, 23 aa, Entamoeba dispar
NEEQRVSVTIGLEQEFFLIDEKL

SEQ ID NO: 2497334 - protein, 25 aa, Entamoeba dispar
NEESQCLLCIGAPGYGLVIYKPPFA

SEQ ID NO: 2497335 - protein, 23 aa, Entamoeba dispar
NEEVKWRLIKRISQQKNRNVLLN

SEQ ID NO: 2497336 - protein, 22 aa, Entamoeba dispar
NEEVLKLIPLFIGETQSGILLQ

SEQ ID NO: 2497337 - protein, 23 aa, Entamoeba dispar
NEEWDLRPLFSQLINSPSIQNSI

SEQ ID NO: 2497338 - protein, 17 aa, Entamoeba dispar
NEEYEIFNDGKIFKYVI

SEQ ID NO: 2497339 - protein, 18 aa, Entamoeba dispar
NEEYKRRKINEEDNKIIR

SEQ ID NO: 2497340 - protein, 18 aa, Entamoeba dispar
NEEYKRRKINEEEDIKII

SEQ ID NO: 2497341 - protein, 21 aa, Entamoeba dispar
NEFALKIIIITFKYMTNIVIR

SEQ ID NO: 2497342 - protein, 20 aa, Entamoeba dispar
NEFCCRDFYGTLNFNIKSQY

SEQ ID NO: 2497343 - protein, 22 aa, Entamoeba dispar
NEFEFEEMTLPLSTSQYNELSE

SEQ ID NO: 2497344 - protein, 21 aa, Entamoeba dispar
NEFFLQRLLSTLLNFNHLTNS

SEQ ID NO: 2497345 - protein, 22 aa, Entamoeba dispar
NEFGNSCFYKCISLQSINIPLT

SEQ ID NO: 2497346 - protein, 21 aa, Entamoeba dispar
NEFIPMSLIDFYGEHCENVDE

SEQ ID NO: 2497347 - protein, 19 aa, Entamoeba dispar
NEFKNMIEFYLKNSEEEDP

SEQ ID NO: 2497348 - protein, 30 aa, Entamoeba dispar
NEFLRYYSMNDFIVCITKGFILGALENDKI

SEQ ID NO: 2497349 - protein, 23 aa, Entamoeba dispar
NEFSEKKIIIWGNLPRRRIDLMD

SEQ ID NO: 2497350 - protein, 23 aa, Entamoeba dispar
NEFTSDTLIKIAIQHTNLFNEII

SEQ ID NO: 2497351 - protein, 20 aa, Entamoeba dispar
NEGFLMMILYYLGCTIKMKR

SEQ ID NO: 2497352 - protein, 26 aa, Entamoeba dispar
NEGICTNCGLVVYGHETYVNDIINIE

SEQ ID NO: 2497353 - protein, 20 aa, Entamoeba dispar
NEGINYIYIPIILRISIEDY

SEQ ID NO: 2497354 - protein, 25 aa, Entamoeba dispar
NEGQRLIQVKAMGGIVEDQEIDSFI

SEQ ID NO: 2497355 - protein, 17 aa, Entamoeba dispar
NEHFPIKTIPSITRKPI

SEQ ID NO: 2497356 - protein, 24 aa, Entamoeba dispar
NEHIVRICVCLMKDYDINEIGLIS

SEQ ID NO: 2497357 - protein, 20 aa, Entamoeba dispar
NEHKFKLMGYKCGFCGEMID

SEQ ID NO: 2497358 - protein, 17 aa, Entamoeba dispar
NEHKGFIFEKIHTSIYI

SEQ ID NO: 2497359 - protein, 17 aa, Entamoeba dispar
NEHYPLLNVIDGDDPVV

SEQ ID NO: 2497360 - protein, 24 aa, Entamoeba dispar
NEIAPRNGLLRVREFTLAEIEYFV

SEQ ID NO: 2497361 - protein, 19 aa, Entamoeba dispar
NEICKNLSNEYLLSKESEQ

SEQ ID NO: 2497362 - protein, 24 aa, Entamoeba dispar
NEIDIQGILCFYKNNTLNKKENED

SEQ ID NO: 2497363 - protein, 24 aa, Entamoeba dispar
NEIELKTVLGKVVKSIEVLTKQSR

SEQ ID NO: 2497364 - protein, 24 aa, Entamoeba dispar
NEIGDACFRDCYSLTSINIPSSIS

SEQ ID NO: 2497365 - protein, 17 aa, Entamoeba dispar
NEIGNMVIRVAKQSENE

SEQ ID NO: 2497366 - protein, 22 aa, Entamoeba dispar
NEIGSGCFEFCSSLISINIPTS

SEQ ID NO: 2497367 - protein, 26 aa, Entamoeba dispar
NEIIDQLYLFPSIFIIQLSFTIDGSN

SEQ ID NO: 2497368 - protein, 20 aa, Entamoeba dispar
NEIIEGINIELPQITFPPTV

SEQ ID NO: 2497369 - protein, 23 aa, Entamoeba dispar
NEIIKEKLILKVLIKGEESEKWV

SEQ ID NO: 2497370 - protein, 18 aa, Entamoeba dispar
NEIIKFLVNHPHIQIQLR

SEQ ID NO: 2497371 - protein, 26 aa, Entamoeba dispar
NEIILQILFVDSIMKFSEKLFNKETI

SEQ ID NO: 2497372 - protein, 21 aa, Entamoeba dispar
NEIILRVLIERSFGEYHQVGA

SEQ ID NO: 2497373 - protein, 19 aa, Entamoeba dispar
NEIIYRCEEELIMKRINDM

SEQ ID NO: 2497374 - protein, 22 aa, Entamoeba dispar
NEIKEKILPRRKMEEKTQKTKE

SEQ ID NO: 2497375 - protein, 32 aa, Entamoeba dispar
NEIKEKSFIIGCAIRCGISLELERKTKNDEGL

SEQ ID NO: 2497376 - protein, 32 aa, Entamoeba dispar
NEIKEKSFIIGCVIRCGISLELERKTKNDEEG

SEQ ID NO: 2497377 - protein, 20 aa, Entamoeba dispar
NEIKGKPLLPSKSLKSKTMK

SEQ ID NO: 2497378 - protein, 17 aa, Entamoeba dispar
NEIKKYCKTLIQLHSVK

SEQ ID NO: 2497379 - protein, 19 aa, Entamoeba dispar
NEIKYCLTPTLLNTLLYEW

SEQ ID NO: 2497380 - protein, 27 aa, Entamoeba dispar
NEILNGKQQWRDVCIKIQNYYHNLINI

SEQ ID NO: 2497381 - protein, 27 aa, Entamoeba dispar
NEILNGKQQWRDVCIKIQNYYHNLINT

SEQ ID NO: 2497382 - protein, 27 aa, Entamoeba dispar
NEILNGKQQWRDVCIKIQNYYHNLITT

SEQ ID NO: 2497383 - protein, 18 aa, Entamoeba dispar
NEILPKPKMEIIQISGIE

SEQ ID NO: 2497384 - protein, 17 aa, Entamoeba dispar
NEIMFITSFTLDMFKKP

SEQ ID NO: 2497385 - protein, 23 aa, Entamoeba dispar
NEIMYGRERIDSIQIRKVNNKQK

SEQ ID NO: 2497386 - protein, 19 aa, Entamoeba dispar
NEIPFKIIPIRNVPRMYMN

SEQ ID NO: 2497387 - protein, 21 aa, Entamoeba dispar
NEIPLQPLLPSKIYTTKRTSI

SEQ ID NO: 2497388 - protein, 29 aa, Entamoeba dispar
NEIPSSLNFTSNSQLSFSNVFAQSNNKHD

SEQ ID NO: 2497389 - protein, 25 aa, Entamoeba dispar
NEIRKNPDLLIWAVYNLVRSVDYLH

SEQ ID NO: 2497390 - protein, 18 aa, Entamoeba dispar
NEISCWIEKNSCENFELQ

SEQ ID NO: 2497391 - protein, 23 aa, Entamoeba dispar
NEISIKFVHEIIGKKSLNYDKRG

SEQ ID NO: 2497392 - protein, 20 aa, Entamoeba dispar
NEITMSYLIPALDKYLQDYE

SEQ ID NO: 2497393 - protein, 29 aa, Entamoeba dispar
NEKAKEFDLFIKNGRYNALFGDKASKPNS

SEQ ID NO: 2497394 - protein, 22 aa, Entamoeba dispar
NEKCTFTLKAEDAFGSCGDKER

SEQ ID NO: 2497395 - protein, 22 aa, Entamoeba dispar
NEKEIPKSILLLYSTTLRLFAI

SEQ ID NO: 2497396 - protein, 24 aa, Entamoeba dispar
NEKELKYLLTTVMIRRLKNDVLKE

SEQ ID NO: 2497397 - protein, 22 aa, Entamoeba dispar
NEKIIGKLCCYFALSTNKINMK

SEQ ID NO: 2497398 - protein, 20 aa, Entamoeba dispar
NEKIKGKKNLAFIIMNESDM

SEQ ID NO: 2497399 - protein, 21 aa, Entamoeba dispar
NEKIVYKWRFNSWPEGKYSHV

SEQ ID NO: 2497400 - protein, 21 aa, Entamoeba dispar
NEKKLDVILGSYKWMSPERFL

SEQ ID NO: 2497401 - protein, 28 aa, Entamoeba dispar
NEKKRATTFQKRRHGLIKKAMELSILCD

SEQ ID NO: 2497402 - protein, 24 aa, Entamoeba dispar
NEKLLIRYPDWRLLTPQEADQETE

SEQ ID NO: 2497403 - protein, 21 aa, Entamoeba dispar
NEKLVECLTAWNYRGNVIDAY

SEQ ID NO: 2497404 - protein, 23 aa, Entamoeba dispar
NEKNKRLPVDSGIKDMIASNEYF

SEQ ID NO: 2497405 - protein, 27 aa, Entamoeba dispar
NEKPIYRLVERIGFIRRNIGIKTEKII

SEQ ID NO: 2497406 - protein, 24 aa, Entamoeba dispar
NEKRLIEIGMEFEQFISNSFKREK

SEQ ID NO: 2497407 - protein, 24 aa, Entamoeba dispar
NEKRLKLVDIFGQIFFDSFERQNQ

SEQ ID NO: 2497408 - protein, 26 aa, Entamoeba dispar
NEKSRALLTWLFDLMIEVSKNRETNK

SEQ ID NO: 2497409 - protein, 28 aa, Entamoeba dispar
NEKYMKSTICVARNIFTKGIIVGSFEGH

SEQ ID NO: 2497410 - protein, 18 aa, Entamoeba dispar
NELARLLIKYLKNGKIQS

SEQ ID NO: 2497411 - protein, 22 aa, Entamoeba dispar
NELARLLNIYFMNDIDEKEDLS

SEQ ID NO: 2497412 - protein, 19 aa, Entamoeba dispar
NELCIGGVFIRIFNQNPIC

SEQ ID NO: 2497413 - protein, 20 aa, Entamoeba dispar
NELCQLEKMFSRIQEQSTSY

SEQ ID NO: 2497414 - protein, 23 aa, Entamoeba dispar
NELDRIGACNGFVEVIRKSSLTT

SEQ ID NO: 2497415 - protein, 26 aa, Entamoeba dispar
NELDRNEFLLALALLKNQKAGFPVPK

SEQ ID NO: 2497416 - protein, 23 aa, Entamoeba dispar
NELELVFSTDCSMINKYLNMLKK

SEQ ID NO: 2497417 - protein, 20 aa, Entamoeba dispar
NELFDSISITSKYLEEFILK

SEQ ID NO: 2497418 - protein, 22 aa, Entamoeba dispar
NELFEQIKLFQQCIDRLPKAMR

SEQ ID NO: 2497419 - protein, 19 aa, Entamoeba dispar
NELFPRIVSLRECDNSFLQ

SEQ ID NO: 2497420 - protein, 24 aa, Entamoeba dispar
NELFVPCNYRIASVDVERIGINEI

SEQ ID NO: 2497421 - protein, 23 aa, Entamoeba dispar
NELGEFYAMVSFVNPDVLGSLSA

SEQ ID NO: 2497422 - protein, 25 aa, Entamoeba dispar
NELGGCCFYKCSLLKSINIPSSVSK

SEQ ID NO: 2497423 - protein, 18 aa, Entamoeba dispar
NELGMSFDFAENEIGQEN

SEQ ID NO: 2497424 - protein, 20 aa, Entamoeba dispar
NELHGSVIFALKEDSKIPNL

SEQ ID NO: 2497425 - protein, 18 aa, Entamoeba dispar
NELIAVIIEYKREYPNSL

SEQ ID NO: 2497426 - protein, 20 aa, Entamoeba dispar
NELIGLLLPFLSEQLKSTEW

SEQ ID NO: 2497427 - protein, 22 aa, Entamoeba dispar
NELIIYRIVIQLLQLYIEQIKI

SEQ ID NO: 2497428 - protein, 24 aa, Entamoeba dispar
NELINKFLFCLNGNTVHISPHEIN

SEQ ID NO: 2497429 - protein, 24 aa, Entamoeba dispar
NELIYCLFHKFFASIFDGYQKYLK

SEQ ID NO: 2497430 - protein, 25 aa, Entamoeba dispar
NELIYGCFIYCIFNPLKQPKFIDLL

SEQ ID NO: 2497431 - protein, 20 aa, Entamoeba dispar
NELKILPVQCFKNCSQLKDI

SEQ ID NO: 2497432 - protein, 17 aa, Entamoeba dispar
NELKNFICDGGDVKSKN

SEQ ID NO: 2497433 - protein, 18 aa, Entamoeba dispar
NELKRIIKEINLIYEERR

SEQ ID NO: 2497434 - protein, 17 aa, Entamoeba dispar
NELKSAKFPGGLRLDED

SEQ ID NO: 2497435 - protein, 20 aa, Entamoeba dispar
NELLESFSIRDRELSNLSED

SEQ ID NO: 2497436 - protein, 17 aa, Entamoeba dispar
NELLKQELQQEVLQSTP

SEQ ID NO: 2497437 - protein, 20 aa, Entamoeba dispar
NELLQLMSIMSYLSQPSLNE

SEQ ID NO: 2497438 - protein, 25 aa, Entamoeba dispar
NELNIPCPKVLYCNNLDIIMEYIEG

SEQ ID NO: 2497439 - protein, 20 aa, Entamoeba dispar
NELNLLFIPTDIFKKVDEIV

SEQ ID NO: 2497440 - protein, 21 aa, Entamoeba dispar
NELNLVYAIGGQISFDCYPVG

SEQ ID NO: 2497441 - protein, 25 aa, Entamoeba dispar
NELNMARQDFKFYTAVNNEASKKVE

SEQ ID NO: 2497442 - protein, 19 aa, Entamoeba dispar
NELPFPLIAHAILIGKHVS

SEQ ID NO: 2497443 - protein, 17 aa, Entamoeba dispar
NELPIELILKLFFYCFN

SEQ ID NO: 2497444 - protein, 23 aa, Entamoeba dispar
NELREYNVLYLKYVNEGIITISS

SEQ ID NO: 2497445 - protein, 17 aa, Entamoeba dispar
NELRKDEILQYFDQCLI

SEQ ID NO: 2497446 - protein, 32 aa, Entamoeba dispar
NELSIKTGDIIKVLSKEGDWWIGELNGQTGQF

SEQ ID NO: 2497447 - protein, 26 aa, Entamoeba dispar
NELSPECLDCLLPQILKDDGISIPYR

SEQ ID NO: 2497448 - protein, 23 aa, Entamoeba dispar
NELWSELIGWYLKGNKRNEAKEL

SEQ ID NO: 2497449 - protein, 17 aa, Entamoeba dispar
NEMCFSCLCKPKNNIIG

SEQ ID NO: 2497450 - protein, 23 aa, Entamoeba dispar
NEMETRNGFTFNSPRETWKVSRP

SEQ ID NO: 2497451 - protein, 17 aa, Entamoeba dispar
NEMKSPLLSALHTLSEL

SEQ ID NO: 2497452 - protein, 20 aa, Entamoeba dispar
NEMLGNYLGIFGDKLNDVTQ

SEQ ID NO: 2497453 - protein, 17 aa, Entamoeba dispar
NEMLKVIIKKMEEIIIN

SEQ ID NO: 2497454 - protein, 22 aa, Entamoeba dispar
NEMLVLIHRLMYQRQGSQKERL

SEQ ID NO: 2497455 - protein, 23 aa, Entamoeba dispar
NEMMRGFGMMGGFIHNNMPMRGF

SEQ ID NO: 2497456 - protein, 24 aa, Entamoeba dispar
NEMMRGFGMMGGFIHNNMPMRGFG

SEQ ID NO: 2497457 - protein, 26 aa, Entamoeba dispar
NEMMRGFGMMGGFIPNNMPMGGFIPD

SEQ ID NO: 2497458 - protein, 21 aa, Entamoeba dispar
NEMMRGFGMMGGFTHNNIPMG

SEQ ID NO: 2497459 - protein, 22 aa, Entamoeba dispar
NEMMRGFGMMGGFTHNNMPMGG

SEQ ID NO: 2497460 - protein, 31 aa, Entamoeba dispar
NENDEAYCMYKKCGVCENGTTYKCGNKTTNQ

SEQ ID NO: 2497461 - protein, 18 aa, Entamoeba dispar
NENIPLLIASFYPLFEPS

SEQ ID NO: 2497462 - protein, 24 aa, Entamoeba dispar
NENIYRPACEVISELASFTKYFTI

SEQ ID NO: 2497463 - protein, 23 aa, Entamoeba dispar
NENKFCKLYVRFIQTLRQQNGLT

SEQ ID NO: 2497464 - protein, 22 aa, Entamoeba dispar
NENPKCLREILIKVNEVIKGKE

SEQ ID NO: 2497465 - protein, 26 aa, Entamoeba dispar
NENTKLPLFLGREGKEFKEEGTFINL

SEQ ID NO: 2497466 - protein, 19 aa, Entamoeba dispar
NENVNDWGLCFVTDEVVNG

SEQ ID NO: 2497467 - protein, 21 aa, Entamoeba dispar
NEPINSIFYWIIKTIKNDFEE

SEQ ID NO: 2497468 - protein, 19 aa, Entamoeba dispar
NEPKFKEDIIKEIETTRGK

SEQ ID NO: 2497469 - protein, 21 aa, Entamoeba dispar
NEPKMSGGVCEYSSEEKSIPE

SEQ ID NO: 2497470 - protein, 29 aa, Entamoeba dispar
NEPKYSFARYWILDSIRAQHFMKNIQELP

SEQ ID NO: 2497471 - protein, 25 aa, Entamoeba dispar
NEPLNYRINFIGTFYISKDNVKEKH

SEQ ID NO: 2497472 - protein, 20 aa, Entamoeba dispar
NEPLVKRVIRVAGNLICLDL

SEQ ID NO: 2497473 - protein, 20 aa, Entamoeba dispar
NEPNFRVAVLPAVGSGTERE

SEQ ID NO: 2497474 - protein, 25 aa, Entamoeba dispar
NEPQKCCGCGQKIDMDRAVCVYGKN

SEQ ID NO: 2497475 - protein, 19 aa, Entamoeba dispar
NEPWYLKFNNSAIYDDNTG

SEQ ID NO: 2497476 - protein, 17 aa, Entamoeba dispar
NEQCCRDLYGALNHNIK

SEQ ID NO: 2497477 - protein, 17 aa, Entamoeba dispar
NEQFLLELNDAIFCSDF

SEQ ID NO: 2497478 - protein, 19 aa, Entamoeba dispar
NEQGIPLVVDVNVFPSYGG

SEQ ID NO: 2497479 - protein, 24 aa, Entamoeba dispar
NEQIKRRPGIISVMQTSSQQNNIP

SEQ ID NO: 2497480 - protein, 17 aa, Entamoeba dispar
NEQLRAIVENHFKIGEQ

SEQ ID NO: 2497481 - protein, 18 aa, Entamoeba dispar
NEQNCGFDGGVTISYRNK

SEQ ID NO: 2497482 - protein, 24 aa, Entamoeba dispar
NEQYRMHPGFSILSNTLFYGGCIM

SEQ ID NO: 2497483 - protein, 22 aa, Entamoeba dispar
NERIFPAFVQYIISDTNLILED

SEQ ID NO: 2497484 - protein, 18 aa, Entamoeba dispar
NERIKWETPLLFSNIFHG

SEQ ID NO: 2497485 - protein, 22 aa, Entamoeba dispar
NERIPFYIAKVIKSNRILLENI

SEQ ID NO: 2497486 - protein, 27 aa, Entamoeba dispar
NERKFELRFIVLMKYDILWKSQKPDIY

SEQ ID NO: 2497487 - protein, 17 aa, Entamoeba dispar
NERLIEFVLKEENIEKS

SEQ ID NO: 2497488 - protein, 20 aa, Entamoeba dispar
NERSIMLAVKILRTVLKKRN

SEQ ID NO: 2497489 - protein, 19 aa, Entamoeba dispar
NESFYPSEMIVVGSTNGKC

SEQ ID NO: 2497490 - protein, 21 aa, Entamoeba dispar
NESIKSNYLLLLIQTNTIENN

SEQ ID NO: 2497491 - protein, 25 aa, Entamoeba dispar
NESIRFNVLRLIGLLISTAPQQCER

SEQ ID NO: 2497492 - protein, 22 aa, Entamoeba dispar
NESIRINIYLDIPIVTEEFIKL

SEQ ID NO: 2497493 - protein, 21 aa, Entamoeba dispar
NESKCALLKPIKSMDSEKKPK

SEQ ID NO: 2497494 - protein, 20 aa, Entamoeba dispar
NESKFEFAQEMFISSTSSFK

SEQ ID NO: 2497495 - protein, 24 aa, Entamoeba dispar
NESLKIIAQNAWKEFNTLNQSIVT

SEQ ID NO: 2497496 - protein, 25 aa, Entamoeba dispar
NESSIQIQWLWEILAEYGKEDHVKL

SEQ ID NO: 2497497 - protein, 25 aa, Entamoeba dispar
NESWLNEMIKYIIGQGGIQAIIIVL

SEQ ID NO: 2497498 - protein, 25 aa, Entamoeba dispar
NESWLNEMIKYIIGQGGIQTIVIVL

SEQ ID NO: 2497499 - protein, 18 aa, Entamoeba dispar
NESYQIYVLLLKQQPEHC

SEQ ID NO: 2497500 - protein, 21 aa, Entamoeba dispar
NESYYHYSMCQKVGGQLQNVI

SEQ ID NO: 2497501 - protein, 22 aa, Entamoeba dispar
NETGLRLAQAVFKNDPKKCDKW

SEQ ID NO: 2497502 - protein, 21 aa, Entamoeba dispar
NETIPSILVFDEIDNLKNKCN

SEQ ID NO: 2497503 - protein, 21 aa, Entamoeba dispar
NETISTICFGNIPKKGTAFIE

SEQ ID NO: 2497504 - protein, 28 aa, Entamoeba dispar
NETITLPLKRSELFFSKLTQGAKGVLLF

SEQ ID NO: 2497505 - protein, 25 aa, Entamoeba dispar
NETLIFKEYFHDLAVKDDIVTSNTN

SEQ ID NO: 2497506 - protein, 22 aa, Entamoeba dispar
NETMTAFWLMKTIFIGLKRSKF

SEQ ID NO: 2497507 - protein, 24 aa, Entamoeba dispar
NETQIKLIVCQKIVTTDLLGTLWR

SEQ ID NO: 2497508 - protein, 19 aa, Entamoeba dispar
NETRFCFVNSHLAAHQQFL

SEQ ID NO: 2497509 - protein, 28 aa, Entamoeba dispar
NEVAKCKWIEQMFGKGWDMIEVKEDYLL

SEQ ID NO: 2497510 - protein, 25 aa, Entamoeba dispar
NEVECLLPITCCVAEKILEQLKKIH

SEQ ID NO: 2497511 - protein, 18 aa, Entamoeba dispar
NEVIKMKDIVLVSMLLNQ

SEQ ID NO: 2497512 - protein, 17 aa, Entamoeba dispar
NEVKCGGPVSPKAKKLI

SEQ ID NO: 2497513 - protein, 23 aa, Entamoeba dispar
NEVKEIKKAIELQEKQLKEIEKE

SEQ ID NO: 2497514 - protein, 24 aa, Entamoeba dispar
NEVLKEARFIDGFNKLIKSEDNNS

SEQ ID NO: 2497515 - protein, 18 aa, Entamoeba dispar
NEVMGCLELAANSLQVLC

SEQ ID NO: 2497516 - protein, 25 aa, Entamoeba dispar
NEVPILYCVKDVFDIKKPEEVCSRD

SEQ ID NO: 2497517 - protein, 18 aa, Entamoeba dispar
NEVSEKLPKLPISQQKER

SEQ ID NO: 2497518 - protein, 19 aa, Entamoeba dispar
NEVVFNCQVVLPPCSITYL

SEQ ID NO: 2497519 - protein, 21 aa, Entamoeba dispar
NEVYKSMAMLRLNPDEIRNLG

SEQ ID NO: 2497520 - protein, 21 aa, Entamoeba dispar
NEWNYCIFNDTLILLSQQPDN

SEQ ID NO: 2497521 - protein, 17 aa, Entamoeba dispar
NEWYESCGWCEDAIFFQ

SEQ ID NO: 2497522 - protein, 32 aa, Entamoeba dispar
NEYCIDLSLPIQFCLPKVFKLTNMITDTIQIS

SEQ ID NO: 2497523 - protein, 23 aa, Entamoeba dispar
NEYCKLGLLNLISEWIQVYPNTS

SEQ ID NO: 2497524 - protein, 24 aa, Entamoeba dispar
NEYCPIVERIIRGEIHCDKTQIKK

SEQ ID NO: 2497525 - protein, 24 aa, Entamoeba dispar
NEYFALFWRCIKEYCDDNSEIRNP

SEQ ID NO: 2497526 - protein, 21 aa, Entamoeba dispar
NEYKLHLIFNREHLLPGDWFG

SEQ ID NO: 2497527 - protein, 17 aa, Entamoeba dispar
NEYLPVLLKNSLTEFLQ

SEQ ID NO: 2497528 - protein, 26 aa, Entamoeba dispar
NEYLRKLLIERGIIFSTECEKIEVER

SEQ ID NO: 2497529 - protein, 27 aa, Entamoeba dispar
NEYLRKLLIERGIIFSTECEKIEVERI

SEQ ID NO: 2497530 - protein, 32 aa, Entamoeba dispar
NEYNKWWSYPICKLSFEEIFIRRVMNEDASFK

SEQ ID NO: 2497531 - protein, 18 aa, Entamoeba dispar
NEYNSWSIVLEEFLECDD

SEQ ID NO: 2497532 - protein, 21 aa, Entamoeba dispar
NEYPDIFFAEQVVQNACATQA

SEQ ID NO: 2497533 - protein, 22 aa, Entamoeba dispar
NEYRIKLCSFLVSLPQIYTEEI

SEQ ID NO: 2497534 - protein, 22 aa, Entamoeba dispar
NEYSCICEECFRNGNHEGHDYE

SEQ ID NO: 2497535 - protein, 22 aa, Entamoeba dispar
NEYVCGRAHILFGYDRTERNIN

SEQ ID NO: 2497536 - protein, 26 aa, Entamoeba dispar
NEYVLKLKLYIPFILIKDKTLLVLSL

SEQ ID NO: 2497537 - protein, 26 aa, Entamoeba dispar
NFAKSFALCCVLNYALMLRDRHGDNY

SEQ ID NO: 2497538 - protein, 22 aa, Entamoeba dispar
NFAPLIRKAIDIVRTTHSYHIL

SEQ ID NO: 2497539 - protein, 19 aa, Entamoeba dispar
NFCEFKTSVAVLINQSTLY

SEQ ID NO: 2497540 - protein, 23 aa, Entamoeba dispar
NFCGFSRQLSLYGFKKVCDPFTL

SEQ ID NO: 2497541 - protein, 18 aa, Entamoeba dispar
NFCKCSSSHYSLFSTEFK

SEQ ID NO: 2497542 - protein, 18 aa, Entamoeba dispar
NFCNKLWNAFKFSSMNFR

SEQ ID NO: 2497543 - protein, 23 aa, Entamoeba dispar
NFDLYKPCFDYLLSCLATNDGTI

SEQ ID NO: 2497544 - protein, 24 aa, Entamoeba dispar
NFDSLKQVTYWIGELKKENVDGMI

SEQ ID NO: 2497545 - protein, 22 aa, Entamoeba dispar
NFDSPSSFDWNLIIETLKKIKA

SEQ ID NO: 2497546 - protein, 18 aa, Entamoeba dispar
NFEDRYKNDLKRADSNIA

SEQ ID NO: 2497547 - protein, 24 aa, Entamoeba dispar
NFEFKYKKSIPFRPFEQLMSVLPP

SEQ ID NO: 2497548 - protein, 23 aa, Entamoeba dispar
NFELKDFFERFGKVVDVVIMKKY

SEQ ID NO: 2497549 - protein, 18 aa, Entamoeba dispar
NFEYILLFYKVFNKCSNS

SEQ ID NO: 2497550 - protein, 18 aa, Entamoeba dispar
NFFCIDKLAIGFRLSPHF

SEQ ID NO: 2497551 - protein, 24 aa, Entamoeba dispar
NFFGDASSLFGIFDGHGGDYGSCF

SEQ ID NO: 2497552 - protein, 31 aa, Entamoeba dispar
NFFKQLYKNEIHFPSLFLFNKNGLTTVLTDE

SEQ ID NO: 2497553 - protein, 20 aa, Entamoeba dispar
NFFMPFFLLCVDDPVPNVRI

SEQ ID NO: 2497554 - protein, 19 aa, Entamoeba dispar
NFGAFKFPLEIHTTQRKIN

SEQ ID NO: 2497555 - protein, 18 aa, Entamoeba dispar
NFGSTGFYYERRVVPLIK

SEQ ID NO: 2497556 - protein, 17 aa, Entamoeba dispar
NFHLRQILAGLRKNKKL

SEQ ID NO: 2497557 - protein, 20 aa, Entamoeba dispar
NFHLSMSVLINYPPEDIKRI

SEQ ID NO: 2497558 - protein, 27 aa, Entamoeba dispar
NFIKRPEMFWKMCSELRKYTEGKKPTK

SEQ ID NO: 2497559 - protein, 18 aa, Entamoeba dispar
NFILRSLIDPGYDYDFRG

SEQ ID NO: 2497560 - protein, 26 aa, Entamoeba dispar
NFISIKGPELLTMWYGESEANVRDVF

SEQ ID NO: 2497561 - protein, 26 aa, Entamoeba dispar
NFISVKGPELLTMWFGESEANVRNIF

SEQ ID NO: 2497562 - protein, 24 aa, Entamoeba dispar
NFKEGKQKVVVVIPVATRADKVQV

SEQ ID NO: 2497563 - protein, 22 aa, Entamoeba dispar
NFKGRRVVTFHSQRDFIFFRHH

SEQ ID NO: 2497564 - protein, 18 aa, Entamoeba dispar
NFKHYIKLIWENLNEQAK

SEQ ID NO: 2497565 - protein, 41 aa, Entamoeba dispar
NFKSDWEDGYAIKFIFADDHPFELFSQFGITQVIQEKNLGK

SEQ ID NO: 2497566 - protein, 25 aa, Entamoeba dispar
NFKTFPKYFIMSIKLFEMGYYGCIK

SEQ ID NO: 2497567 - protein, 30 aa, Entamoeba dispar
NFKTLAFCRRYVDKIGFAKWQMPFKFLVDD

SEQ ID NO: 2497568 - protein, 20 aa, Entamoeba dispar
NFLFPNSFFTDMQKFIVKRI

SEQ ID NO: 2497569 - protein, 18 aa, Entamoeba dispar
NFLISKLFLVFNHITIPT

SEQ ID NO: 2497570 - protein, 25 aa, Entamoeba dispar
NFLNIPCTPFLISEPLNSYIAIKSF

SEQ ID NO: 2497571 - protein, 20 aa, Entamoeba dispar
NFLNKCLNPDAPKRASAEEL

SEQ ID NO: 2497572 - protein, 18 aa, Entamoeba dispar
NFLSAFIFSVHLNDKNLI

SEQ ID NO: 2497573 - protein, 24 aa, Entamoeba dispar
NFLTCSALPQPFRYNKLKYPNEYY

SEQ ID NO: 2497574 - protein, 24 aa, Entamoeba dispar
NFMMPIYLHDSLLRAQNFSALSKS

SEQ ID NO: 2497575 - protein, 30 aa, Entamoeba dispar
NFNEKCPYCSSVLRKGEYYRFYQFDSLVSF

SEQ ID NO: 2497576 - protein, 26 aa, Entamoeba dispar
NFPESNGRYIVRFGTLEVVGQYINTN

SEQ ID NO: 2497577 - protein, 24 aa, Entamoeba dispar
NFQRAETYISMLFEHYFNVNYYPD

SEQ ID NO: 2497578 - protein, 28 aa, Entamoeba dispar
NFQRHFSDIWKFIERNAIIYPEQKEECI

SEQ ID NO: 2497579 - protein, 29 aa, Entamoeba dispar
NFQRHFSDIWKFIERNAIIYPEQKEECIE

SEQ ID NO: 2497580 - protein, 22 aa, Entamoeba dispar
NFQSFKGIKSWLSIALSSAPES

SEQ ID NO: 2497581 - protein, 26 aa, Entamoeba dispar
NFRAEFGDKCLLKFFKNEALRDMFLN

SEQ ID NO: 2497582 - protein, 29 aa, Entamoeba dispar
NFRERPSALELLKCDFMKPNGNRKRITDL

SEQ ID NO: 2497583 - protein, 26 aa, Entamoeba dispar
NFSEFLRNIFKPCFEATLHPEQHPNL

SEQ ID NO: 2497584 - protein, 24 aa, Entamoeba dispar
NFSELKLLSFETIGLFNVDNLIFP

SEQ ID NO: 2497585 - protein, 22 aa, Entamoeba dispar
NFSKEILDSLLLSDSPAEEYII

SEQ ID NO: 2497586 - protein, 25 aa, Entamoeba dispar
NFSKFPFYFEVGGNIAQEIGDVELA

SEQ ID NO: 2497587 - protein, 27 aa, Entamoeba dispar
NFSNPNCQEAMELFFRHGVNLEAQNKN

SEQ ID NO: 2497588 - protein, 20 aa, Entamoeba dispar
NFSNYSAWHHRSVIFSSYNN

SEQ ID NO: 2497589 - protein, 32 aa, Entamoeba dispar
NFTNKAECLMNFKWRQGLVLTNESFSLRNIIT

SEQ ID NO: 2497590 - protein, 24 aa, Entamoeba dispar
NFTPKWAGLPSEVSYYIAHMHSAV

SEQ ID NO: 2497591 - protein, 19 aa, Entamoeba dispar
NFTPSIMKVYGNYVFIAGR

SEQ ID NO: 2497592 - protein, 17 aa, Entamoeba dispar
NFVIPMYFVDSSPDEGV

SEQ ID NO: 2497593 - protein, 19 aa, Entamoeba dispar
NFVLNLLILPGNRICADCL

SEQ ID NO: 2497594 - protein, 26 aa, Entamoeba dispar
NFYGPTRVEGFWTYDENNISWNPYTN

SEQ ID NO: 2497595 - protein, 26 aa, Entamoeba dispar
NFYGPTRVEGFWTYDENNIYWNPYTN

SEQ ID NO: 2497596 - protein, 26 aa, Entamoeba dispar
NFYGPTRVEGFWTYDENYPFWNPYTN

SEQ ID NO: 2497597 - protein, 20 aa, Entamoeba dispar
NFYLSLLFLKYAQVFTPQYG

SEQ ID NO: 2497598 - protein, 19 aa, Entamoeba dispar
NGCFMFCRSLTNMSIENVK

SEQ ID NO: 2497599 - protein, 19 aa, Entamoeba dispar
NGCFYKCGCESKLKENKRI

SEQ ID NO: 2497600 - protein, 21 aa, Entamoeba dispar
NGCFYKCRCVEELKKNESIPR

SEQ ID NO: 2497601 - protein, 20 aa, Entamoeba dispar
NGCFYRCRCEKELKKNKRIP

SEQ ID NO: 2497602 - protein, 26 aa, Entamoeba dispar
NGDCGTFFKKLLPIVFTENSLCLAVM

SEQ ID NO: 2497603 - protein, 17 aa, Entamoeba dispar
NGDEILKYLEGVSKDRL

SEQ ID NO: 2497604 - protein, 23 aa, Entamoeba dispar
NGDRLTVIFSIKFDDRDDAVFGR

SEQ ID NO: 2497605 - protein, 21 aa, Entamoeba dispar
NGECPLIGDIIVKFSPSLEDC

SEQ ID NO: 2497606 - protein, 24 aa, Entamoeba dispar
NGERLRVTFALDCCDREALHWAVT

SEQ ID NO: 2497607 - protein, 25 aa, Entamoeba dispar
NGETHCKVSVYLRNRGEGAMDKEKY

SEQ ID NO: 2497608 - protein, 18 aa, Entamoeba dispar
NGEVFRFLDAALQDPESV

SEQ ID NO: 2497609 - protein, 26 aa, Entamoeba dispar
NGEYKFKLVGVLVHLGTLDSGHYYSY

SEQ ID NO: 2497610 - protein, 17 aa, Entamoeba dispar
NGFKGTKDLIAMGIMLG

SEQ ID NO: 2497611 - protein, 22 aa, Entamoeba dispar
NGFKTLRLQDDFFGDDNFLTKN

SEQ ID NO: 2497612 - protein, 17 aa, Entamoeba dispar
NGFSRSVLRNRPSEYIQ

SEQ ID NO: 2497613 - protein, 18 aa, Entamoeba dispar
NGFTGFGNTTGFGQTNTQ

SEQ ID NO: 2497614 - protein, 25 aa, Entamoeba dispar
NGGDFDVLKLLGFTELKLNKINETI

SEQ ID NO: 2497615 - protein, 23 aa, Entamoeba dispar
NGGELFHRLDLEECINEEQTRFY

SEQ ID NO: 2497616 - protein, 25 aa, Entamoeba dispar
NGGIIFDNYHIFKFKSIHEDEHICI

SEQ ID NO: 2497617 - protein, 27 aa, Entamoeba dispar
NGGKDWYKKRMQWLSKVGPGLDEESSG

SEQ ID NO: 2497618 - protein, 28 aa, Entamoeba dispar
NGGKIVGCIMSSYLLEKSRVVYQAREDR

SEQ ID NO: 2497619 - protein, 22 aa, Entamoeba dispar
NGGLLKECYSLLVQELSNGVED

SEQ ID NO: 2497620 - protein, 21 aa, Entamoeba dispar
NGGLLKECYSSFIKEINEGKA

SEQ ID NO: 2497621 - protein, 20 aa, Entamoeba dispar
NGGLVQWAPFLADLFMLARR

SEQ ID NO: 2497622 - protein, 18 aa, Entamoeba dispar
NGGTIWGNININKLVRCS

SEQ ID NO: 2497623 - protein, 24 aa, Entamoeba dispar
NGHCKLTDFGLCITVNDWEHEKIK

SEQ ID NO: 2497624 - protein, 25 aa, Entamoeba dispar
NGHIWIIQCCVLPRPTRWWYEVKQG

SEQ ID NO: 2497625 - protein, 27 aa, Entamoeba dispar
NGHPSILSNVLWSLGIIIQRYTSDMQS

SEQ ID NO: 2497626 - protein, 17 aa, Entamoeba dispar
NGHVGLGVKCAKEVAEA

SEQ ID NO: 2497627 - protein, 19 aa, Entamoeba dispar
NGIAFLFVCCNNAKPYEGS

SEQ ID NO: 2497628 - protein, 25 aa, Entamoeba dispar
NGIALSIEPKEYWAPFVDGIKKELK

SEQ ID NO: 2497629 - protein, 19 aa, Entamoeba dispar
NGIEFFIDMVGILFTLIPY

SEQ ID NO: 2497630 - protein, 21 aa, Entamoeba dispar
NGIEVPVHFPVKGMNNSVVEV

SEQ ID NO: 2497631 - protein, 17 aa, Entamoeba dispar
NGIEYILRILKSVYDFS

SEQ ID NO: 2497632 - protein, 20 aa, Entamoeba dispar
NGIICRRLNENDSILSIYLS

SEQ ID NO: 2497633 - protein, 24 aa, Entamoeba dispar
NGIIKHFACVSIRERDSWVEALLD

SEQ ID NO: 2497634 - protein, 33 aa, Entamoeba dispar
NGIIVCSFYDFGIDILCNISFIIIGIVLHTNDQ

SEQ ID NO: 2497635 - protein, 17 aa, Entamoeba dispar
NGIIVKQLINYGNEEVK

SEQ ID NO: 2497636 - protein, 17 aa, Entamoeba dispar
NGINCLHGGDGFDKKVF

SEQ ID NO: 2497637 - protein, 21 aa, Entamoeba dispar
NGIPPYFFNQFNSIEQPSSSY

SEQ ID NO: 2497638 - protein, 19 aa, Entamoeba dispar
NGIRICQINGSIPFRQENS

SEQ ID NO: 2497639 - protein, 19 aa, Entamoeba dispar
NGISEYLVSIPPGIVSGTK

SEQ ID NO: 2497640 - protein, 19 aa, Entamoeba dispar
NGISLEWCLNDFFKENMLG

SEQ ID NO: 2497641 - protein, 17 aa, Entamoeba dispar
NGISLNSYNAWVKRKYG

SEQ ID NO: 2497642 - protein, 27 aa, Entamoeba dispar
NGITFTILFSCLKCIQKHFPLNMPQLE

SEQ ID NO: 2497643 - protein, 18 aa, Entamoeba dispar
NGITNTLKFMVKEQYGGW

SEQ ID NO: 2497644 - protein, 18 aa, Entamoeba dispar
NGIVYDFTPGRTMDYNEF

SEQ ID NO: 2497645 - protein, 21 aa, Entamoeba dispar
NGKADRKYVVMIFNDSIIIIK

SEQ ID NO: 2497646 - protein, 24 aa, Entamoeba dispar
NGKCKECQEVFPGCSSCNKGKCKG

SEQ ID NO: 2497647 - protein, 24 aa, Entamoeba dispar
NGKDTCIISVRFPNGKKIQRRFNK

SEQ ID NO: 2497648 - protein, 24 aa, Entamoeba dispar
NGKFMPAIGLGTWLAAPGEVGKAV

SEQ ID NO: 2497649 - protein, 21 aa, Entamoeba dispar
NGKKKNVIIIFEFSLLDNVLM

SEQ ID NO: 2497650 - protein, 25 aa, Entamoeba dispar
NGKLQILEVLPFIKQKFEPNYIPYK

SEQ ID NO: 2497651 - protein, 23 aa, Entamoeba dispar
NGKPDVVFILGFSHSSRFDYAAI

SEQ ID NO: 2497652 - protein, 20 aa, Entamoeba dispar
NGKQLWSYCHKNFISDIQWK

SEQ ID NO: 2497653 - protein, 23 aa, Entamoeba dispar
NGKRFEKYYCIFTPEVIKKTKIS

SEQ ID NO: 2497654 - protein, 23 aa, Entamoeba dispar
NGKVLELMEWVAIKEIAEIHNPN

SEQ ID NO: 2497655 - protein, 20 aa, Entamoeba dispar
NGLGRFLCTHGGISPQLQKL

SEQ ID NO: 2497656 - protein, 19 aa, Entamoeba dispar
NGLICPEKNNFSIQLPRKY

SEQ ID NO: 2497657 - protein, 25 aa, Entamoeba dispar
NGLKAWKLAKPLAEKGKEFDSQTKY

SEQ ID NO: 2497658 - protein, 17 aa, Entamoeba dispar
NGLLEQRLEFMEFDNFE

SEQ ID NO: 2497659 - protein, 31 aa, Entamoeba dispar
NGLLTQMIWKEILRNSVMMGAKIQKFVYLDG

SEQ ID NO: 2497660 - protein, 18 aa, Entamoeba dispar
NGLMKYFGVLEEEKALIM

SEQ ID NO: 2497661 - protein, 32 aa, Entamoeba dispar
NGLPILMYRVKWLGKELFLSDELSSFFDKERN

SEQ ID NO: 2497662 - protein, 19 aa, Entamoeba dispar
NGLQRLPIDLTNLTNLNMC

SEQ ID NO: 2497663 - protein, 27 aa, Entamoeba dispar
NGLSRFVVCGTAFVWHQVRYMVGALFA

SEQ ID NO: 2497664 - protein, 25 aa, Entamoeba dispar
NGLSSFCVKGALTLLNNEITPIFVF

SEQ ID NO: 2497665 - protein, 20 aa, Entamoeba dispar
NGLTIQWIYSLLIKLISSPH

SEQ ID NO: 2497666 - protein, 28 aa, Entamoeba dispar
NGLTYKGCGFHRVIKDFMIQGGDFTRHN

SEQ ID NO: 2497667 - protein, 43 aa, Entamoeba dispar
NGLVKRFEECWTLDKSCVYNDCLYPRQQLHLYPFLEKIVPAKL

SEQ ID NO: 2497668 - protein, 22 aa, Entamoeba dispar
NGMEFHCLITLLLQIIQTPPVS

SEQ ID NO: 2497669 - protein, 24 aa, Entamoeba dispar
NGMEYDCIAAIYKRNNVLYSTRRL

SEQ ID NO: 2497670 - protein, 26 aa, Entamoeba dispar
NGMGGAGGFPGGFSFGNVDPMDIFEQ

SEQ ID NO: 2497671 - protein, 21 aa, Entamoeba dispar
NGMKEIGCIFGNTPQPNVIYH

SEQ ID NO: 2497672 - protein, 18 aa, Entamoeba dispar
NGMKEYEPIVSKRESDIY

SEQ ID NO: 2497673 - protein, 23 aa, Entamoeba dispar
NGMKLRPLSVFAPLHYFELPELL

SEQ ID NO: 2497674 - protein, 22 aa, Entamoeba dispar
NGMNNYIVWYGCGLKTVKYYKI

SEQ ID NO: 2497675 - protein, 23 aa, Entamoeba dispar
NGMNNYIVWYGCGLKTVKYYKIY

SEQ ID NO: 2497676 - protein, 24 aa, Entamoeba dispar
NGMNPRQEWSIKVGQIVKNVAETI

SEQ ID NO: 2497677 - protein, 30 aa, Entamoeba dispar
NGMVRRKSYKKMLVCNDIIFIVVDNSKKSF

SEQ ID NO: 2497678 - protein, 17 aa, Entamoeba dispar
NGNDPFEIIREFGNKYS

SEQ ID NO: 2497679 - protein, 29 aa, Entamoeba dispar
NGNICLCDQEYKILLTLRSFTFDKTGDKV

SEQ ID NO: 2497680 - protein, 20 aa, Entamoeba dispar
NGNIICCGNDTSIYSIDVMT

SEQ ID NO: 2497681 - protein, 28 aa, Entamoeba dispar
NGNLKISIPFIPKRIGDVNIQQINIYLS

SEQ ID NO: 2497682 - protein, 18 aa, Entamoeba dispar
NGNLRSQIFSNIHDFITL

SEQ ID NO: 2497683 - protein, 18 aa, Entamoeba dispar
NGNNCIITANFDRSERFK

SEQ ID NO: 2497684 - protein, 17 aa, Entamoeba dispar
NGNRFKIGMTYTSNGWY

SEQ ID NO: 2497685 - protein, 26 aa, Entamoeba dispar
NGNSDFKYLLGLLFQVYMNHHKSNLL

SEQ ID NO: 2497686 - protein, 24 aa, Entamoeba dispar
NGNYKCPLCQITLTEDDISRNDST

SEQ ID NO: 2497687 - protein, 17 aa, Entamoeba dispar
NGPKLYYWCIFKPKNKD

SEQ ID NO: 2497688 - protein, 17 aa, Entamoeba dispar
NGPNLVRIVDTFEDSIQ

SEQ ID NO: 2497689 - protein, 23 aa, Entamoeba dispar
NGQSKGCCFIEFEDKKGAERACS

SEQ ID NO: 2497690 - protein, 26 aa, Entamoeba dispar
NGQYEIGKMLFLLFVDFTIYCSKQPI

SEQ ID NO: 2497691 - protein, 20 aa, Entamoeba dispar
NGRCTVCGCSHSDHENESYK

SEQ ID NO: 2497692 - protein, 19 aa, Entamoeba dispar
NGRSLGYYVVPLLLILPFG

SEQ ID NO: 2497693 - protein, 25 aa, Entamoeba dispar
NGRSRRGLILFNDCILLTKKEEKLM

SEQ ID NO: 2497694 - protein, 19 aa, Entamoeba dispar
NGRVKECVDEPISTTTNKK

SEQ ID NO: 2497695 - protein, 17 aa, Entamoeba dispar
NGSAISRIADVSWKSSV

SEQ ID NO: 2497696 - protein, 28 aa, Entamoeba dispar
NGSHPFIKCCLELGILEYLIDYLKDNQT

SEQ ID NO: 2497697 - protein, 18 aa, Entamoeba dispar
NGSLPMEITIGINQNQST

SEQ ID NO: 2497698 - protein, 20 aa, Entamoeba dispar
NGSSQCKIVAKKSNLSIKTQ

SEQ ID NO: 2497699 - protein, 18 aa, Entamoeba dispar
NGTEWIYKQFSVVNEISY

SEQ ID NO: 2497700 - protein, 17 aa, Entamoeba dispar
NGVDIGKPLSFAKSILK

SEQ ID NO: 2497701 - protein, 23 aa, Entamoeba dispar
NGVFKYLYDRGMSYHYNQTDGDP

SEQ ID NO: 2497702 - protein, 24 aa, Entamoeba dispar
NGVGEIKALLAISIISLDSYYLSL

SEQ ID NO: 2497703 - protein, 19 aa, Entamoeba dispar
NGVIKDINIVSGIANEVVT

SEQ ID NO: 2497704 - protein, 22 aa, Entamoeba dispar
NGVMFHIDFGYILGKECKPFPP

SEQ ID NO: 2497705 - protein, 20 aa, Entamoeba dispar
NGVPLMRINQRYVIATSQKV

SEQ ID NO: 2497706 - protein, 19 aa, Entamoeba dispar
NGVPYPVYELISYLTEKQS

SEQ ID NO: 2497707 - protein, 24 aa, Entamoeba dispar
NGWQTSRVRIARSLDKEELNNTVE

SEQ ID NO: 2497708 - protein, 20 aa, Entamoeba dispar
NGWSGYRGGLDVKTGTTGVH

SEQ ID NO: 2497709 - protein, 19 aa, Entamoeba dispar
NGYCKICGCHYTRHTGSRY

SEQ ID NO: 2497710 - protein, 19 aa, Entamoeba dispar
NGYCKVCGCHYTQHANVEY

SEQ ID NO: 2497711 - protein, 19 aa, Entamoeba dispar
NGYCNVCGCHYTQHANSEY

SEQ ID NO: 2497712 - protein, 22 aa, Entamoeba dispar
NGYCNVCGCYYTQHTGSRYRFD

SEQ ID NO: 2497713 - protein, 25 aa, Entamoeba dispar
NGYFSLKYDVHWFIVDHWYLFSQLG

SEQ ID NO: 2497714 - protein, 17 aa, Entamoeba dispar
NGYGAKLANIFSTKFSI

SEQ ID NO: 2497715 - protein, 22 aa, Entamoeba dispar
NGYITLFLMESFIKKRKDDEIT

SEQ ID NO: 2497716 - protein, 17 aa, Entamoeba dispar
NGYNHCIGSVYFTKFEK

SEQ ID NO: 2497717 - protein, 23 aa, Entamoeba dispar
NGYPSFPTMRIAIMSQDNQVSAL

SEQ ID NO: 2497718 - protein, 22 aa, Entamoeba dispar
NGYPVAKYHAGMKSEERETIQK

SEQ ID NO: 2497719 - protein, 22 aa, Entamoeba dispar
NGYRLIDCARFYKNEKEIGEMG

SEQ ID NO: 2497720 - protein, 23 aa, Entamoeba dispar
NGYTIKFYYSGMFMEGLMSEMID

SEQ ID NO: 2497721 - protein, 23 aa, Entamoeba dispar
NGYVCINCTQVVFLNTICAPQTI

SEQ ID NO: 2497722 - protein, 21 aa, Entamoeba dispar
NHEAICAAFHRSNLQGTSLCY

SEQ ID NO: 2497723 - protein, 26 aa, Entamoeba dispar
NHEEYSFYCLWILQSIVQNNPIGQHG

SEQ ID NO: 2497724 - protein, 18 aa, Entamoeba dispar
NHETRMMTERMGFMKECQ

SEQ ID NO: 2497725 - protein, 19 aa, Entamoeba dispar
NHETRMMTERMGFMKECQK

SEQ ID NO: 2497726 - protein, 20 aa, Entamoeba dispar
NHFGVGIAFIRKSRSFEDTH

SEQ ID NO: 2497727 - protein, 24 aa, Entamoeba dispar
NHFKSIRNDINWLSIIYPNPIYYV

SEQ ID NO: 2497728 - protein, 19 aa, Entamoeba dispar
NHIKALVVVCPEQYEYPIN

SEQ ID NO: 2497729 - protein, 18 aa, Entamoeba dispar
NHIMLKIAGDYCSLSYDV

SEQ ID NO: 2497730 - protein, 27 aa, Entamoeba dispar
NHIQIHLRLLFALNFKEGCDPLPQTYL

SEQ ID NO: 2497731 - protein, 21 aa, Entamoeba dispar
NHIQMKYEPLIKEFPIQTKVS

SEQ ID NO: 2497732 - protein, 24 aa, Entamoeba dispar
NHISHPLCIAKIFATILISQNIEK

SEQ ID NO: 2497733 - protein, 18 aa, Entamoeba dispar
NHITIGLREEVPIENAKH

SEQ ID NO: 2497734 - protein, 22 aa, Entamoeba dispar
NHKEYKKLILVINECSSLYIQE

SEQ ID NO: 2497735 - protein, 27 aa, Entamoeba dispar
NHKQEHPFELIICGIGPSLKKYIDKHP

SEQ ID NO: 2497736 - protein, 21 aa, Entamoeba dispar
NHKVAWYCYHLMKERKNMSLK

SEQ ID NO: 2497737 - protein, 25 aa, Entamoeba dispar
NHLAKFPLIVLCRKGIHVITTQSNE

SEQ ID NO: 2497738 - protein, 25 aa, Entamoeba dispar
NHLECTLFLLTCGINNLIAAQTRIE

SEQ ID NO: 2497739 - protein, 17 aa, Entamoeba dispar
NHLIGVSYLDFDSYSEF

SEQ ID NO: 2497740 - protein, 21 aa, Entamoeba dispar
NHLKRFCKSIKLTSLTEINLS

SEQ ID NO: 2497741 - protein, 25 aa, Entamoeba dispar
NHLLIDILREFGYSFSTKVTDGKNG

SEQ ID NO: 2497742 - protein, 21 aa, Entamoeba dispar
NHLSRSYYCYVLAYHCTSSIK

SEQ ID NO: 2497743 - protein, 18 aa, Entamoeba dispar
NHLTDFLKRVIVEHPELV

SEQ ID NO: 2497744 - protein, 27 aa, Entamoeba dispar
NHMHIPFPLILIWALNQWRKEKNQTGI

SEQ ID NO: 2497745 - protein, 29 aa, Entamoeba dispar
NHMTCCRCHGEWCWMCRGDWKTHGPQTGG

SEQ ID NO: 2497746 - protein, 27 aa, Entamoeba dispar
NHMTCVNCGYQFCWLCMQEYTSSHFKN

SEQ ID NO: 2497747 - protein, 28 aa, Entamoeba dispar
NHNIPWKERLQIAISIAKGMTVFTSQKC

SEQ ID NO: 2497748 - protein, 30 aa, Entamoeba dispar
NHNTLKCPACLGVTGGLFSRFKRGEVKENT

SEQ ID NO: 2497749 - protein, 18 aa, Entamoeba dispar
NHPFPQKVIYSFDDLLQG

SEQ ID NO: 2497750 - protein, 25 aa, Entamoeba dispar
NHPNLIKMIGCWLFGNQVFISMEYC

SEQ ID NO: 2497751 - protein, 20 aa, Entamoeba dispar
NHPNLLAGYLGRGSAKAMLG

SEQ ID NO: 2497752 - protein, 18 aa, Entamoeba dispar
NHQTAWLRKHLFRPNILL

SEQ ID NO: 2497753 - protein, 26 aa, Entamoeba dispar
NHSGKTKETYYFFVVSKICTLLKSEK

SEQ ID NO: 2497754 - protein, 19 aa, Entamoeba dispar
NHSSPRYKMEKLRNRKSCQ

SEQ ID NO: 2497755 - protein, 18 aa, Entamoeba dispar
NHTSCIPGHCGCHEGCWC

SEQ ID NO: 2497756 - protein, 18 aa, Entamoeba dispar
NHVKQFIGLAEFGGNNMT

SEQ ID NO: 2497757 - protein, 26 aa, Entamoeba dispar
NHYDEVINMFKRLIVELPNKEETFIE

SEQ ID NO: 2497758 - protein, 18 aa, Entamoeba dispar
NHYFAMKILIKKQMEERN

SEQ ID NO: 2497759 - protein, 18 aa, Entamoeba dispar
NHYFLCGGVAVGKTTVMK

SEQ ID NO: 2497760 - protein, 24 aa, Entamoeba dispar
NIAPDYWLIGSLLMVALVNSVEGR

SEQ ID NO: 2497761 - protein, 20 aa, Entamoeba dispar
NICECPKCQCEMISFDKEYK

SEQ ID NO: 2497762 - protein, 22 aa, Entamoeba dispar
NICPICKYQINHFLPHQDEFKK

SEQ ID NO: 2497763 - protein, 19 aa, Entamoeba dispar
NICRYRISPTPVEIYDSVQ

SEQ ID NO: 2497764 - protein, 24 aa, Entamoeba dispar
NIDTQRWFECSNFDCPKNELRFGY

SEQ ID NO: 2497765 - protein, 18 aa, Entamoeba dispar
NIDYLKIKIFSFPLIRNI

SEQ ID NO: 2497766 - protein, 19 aa, Entamoeba dispar
NIDYLKIKIFSFPLIRNII

SEQ ID NO: 2497767 - protein, 21 aa, Entamoeba dispar
NIEEIFVFIAQQFVQRMKSNT

SEQ ID NO: 2497768 - protein, 22 aa, Entamoeba dispar
NIEIFNKFLMFILNRNKREEAI

SEQ ID NO: 2497769 - protein, 23 aa, Entamoeba dispar
NIEIPYYFNKEMHLFSMNMYHED

SEQ ID NO: 2497770 - protein, 23 aa, Entamoeba dispar
NIEKFKYIISYWIEHFSSDFTTQ

SEQ ID NO: 2497771 - protein, 17 aa, Entamoeba dispar
NIEKIYCDGKFLMGIND

SEQ ID NO: 2497772 - protein, 21 aa, Entamoeba dispar
NIELCSGYGEWLITKAEEKKE

SEQ ID NO: 2497773 - protein, 18 aa, Entamoeba dispar
NIELKIHFNVESFYYSNS

SEQ ID NO: 2497774 - protein, 17 aa, Entamoeba dispar
NIEMIRNRLQLEVETHH

SEQ ID NO: 2497775 - protein, 34 aa, Entamoeba dispar
NIEPEFKSPIYIDGFRLSMPYLFDKLQIACDQLM

SEQ ID NO: 2497776 - protein, 24 aa, Entamoeba dispar
NIESFNLYIGYLVARNEFGKAMNS

SEQ ID NO: 2497777 - protein, 19 aa, Entamoeba dispar
NIETLRCDIETIKILDLNL

SEQ ID NO: 2497778 - protein, 19 aa, Entamoeba dispar
NIEVIQWLFSHGADPLLRN

SEQ ID NO: 2497779 - protein, 28 aa, Entamoeba dispar
NIEVIVCADLRGWVVGYVVTKFLYQQVE

SEQ ID NO: 2497780 - protein, 27 aa, Entamoeba dispar
NIEYPLFPGENIISIIPETIHLHFNQT

SEQ ID NO: 2497781 - protein, 20 aa, Entamoeba dispar
NIEYTLKVGIPLEFYNEAHR

SEQ ID NO: 2497782 - protein, 26 aa, Entamoeba dispar
NIFDYYRVCSSEELILKDQEKKSNEE

SEQ ID NO: 2497783 - protein, 24 aa, Entamoeba dispar
NIFEPCYMPTVGVDFKLKLMKLNN

SEQ ID NO: 2497784 - protein, 27 aa, Entamoeba dispar
NIFIADVMITFYLYCGWMDQLTEKLAD

SEQ ID NO: 2497785 - protein, 20 aa, Entamoeba dispar
NIFIELFLPYINRLLTSDSL

SEQ ID NO: 2497786 - protein, 20 aa, Entamoeba dispar
NIFIFKRIIKSGNCYDFSEK

SEQ ID NO: 2497787 - protein, 18 aa, Entamoeba dispar
NIFIKMQSYLKGYNLYVA

SEQ ID NO: 2497788 - protein, 25 aa, Entamoeba dispar
NIFKSLGYKCFKYCSTITTINIPSS

SEQ ID NO: 2497789 - protein, 30 aa, Entamoeba dispar
NIFMKLNMVQCFICPSFITRSLKIIGSDSI

SEQ ID NO: 2497790 - protein, 25 aa, Entamoeba dispar
NIFYFKWRHCFIDGISLKDRLQELV

SEQ ID NO: 2497791 - protein, 24 aa, Entamoeba dispar
NIGCTPLPLCVRVNQKSKYRDLLQ

SEQ ID NO: 2497792 - protein, 19 aa, Entamoeba dispar
NIGDCRCLLIGDDYFLPLT

SEQ ID NO: 2497793 - protein, 18 aa, Entamoeba dispar
NIGDHVYYVPSFHEEYLK

SEQ ID NO: 2497794 - protein, 25 aa, Entamoeba dispar
NIGERVMSLLACRYIDNLVIGAPRG

SEQ ID NO: 2497795 - protein, 18 aa, Entamoeba dispar
NIGFKELIKNQVKQQTKK

SEQ ID NO: 2497796 - protein, 24 aa, Entamoeba dispar
NIHKIPFNNCIISNSLLITLLNKI

SEQ ID NO: 2497797 - protein, 25 aa, Entamoeba dispar
NIHKLYKLYCFEGHTAIQQLQEKQT

SEQ ID NO: 2497798 - protein, 23 aa, Entamoeba dispar
NIIDKALKYGFLDDEDVNEFQEE

SEQ ID NO: 2497799 - protein, 23 aa, Entamoeba dispar
NIIDKLCENCYAILCLTESQRKE

SEQ ID NO: 2497800 - protein, 20 aa, Entamoeba dispar
NIIDVRSCFSRGHHFDLKKG

SEQ ID NO: 2497801 - protein, 19 aa, Entamoeba dispar
NIIECITLIESIINIFMNK

SEQ ID NO: 2497802 - protein, 25 aa, Entamoeba dispar
NIIERPVPDFPYRYNMPPIMMSHFY

SEQ ID NO: 2497803 - protein, 24 aa, Entamoeba dispar
NIIESYLKYGWIFEIKNKYKEALM

SEQ ID NO: 2497804 - protein, 17 aa, Entamoeba dispar
NIIGIDICNNFQKVSLK

SEQ ID NO: 2497805 - protein, 17 aa, Entamoeba dispar
NIIGNGVICCDRTGTEI

SEQ ID NO: 2497806 - protein, 17 aa, Entamoeba dispar
NIIIIQNCEKNEYTKFD

SEQ ID NO: 2497807 - protein, 18 aa, Entamoeba dispar
NIIITPLFSNFKVYCSES

SEQ ID NO: 2497808 - protein, 25 aa, Entamoeba dispar
NIIKEYSIKIGRPIWVLNDAVYCRV

SEQ ID NO: 2497809 - protein, 27 aa, Entamoeba dispar
NIIKIYNCFFCYFNGSLQFWIVMEKCT

SEQ ID NO: 2497810 - protein, 23 aa, Entamoeba dispar
NIIKNIPFGYGIKQIEINILRFF

SEQ ID NO: 2497811 - protein, 23 aa, Entamoeba dispar
NIILENMYQLWILAELDLFDPQH

SEQ ID NO: 2497812 - protein, 24 aa, Entamoeba dispar
NIIPILCYNFYFQVYPIHPEYTYA

SEQ ID NO: 2497813 - protein, 24 aa, Entamoeba dispar
NIIRYDAIQDFLFYSLKSSLERQI

SEQ ID NO: 2497814 - protein, 20 aa, Entamoeba dispar
NIISCINCEINLKNNNCNLV

SEQ ID NO: 2497815 - protein, 20 aa, Entamoeba dispar
NIISGLKFIPSKDINNLVPF

SEQ ID NO: 2497816 - protein, 25 aa, Entamoeba dispar
NIISPLIFCLPCNRLCIVSLKTEYY

SEQ ID NO: 2497817 - protein, 26 aa, Entamoeba dispar
NIIVKRALELGTLIMKRIIKEDKTKM

SEQ ID NO: 2497818 - protein, 24 aa, Entamoeba dispar
NIIYPKYLQYLSVATLKKRMYYSY

SEQ ID NO: 2497819 - protein, 23 aa, Entamoeba dispar
NIIYRYSKPCVLDIKIGNKTWCD

SEQ ID NO: 2497820 - protein, 22 aa, Entamoeba dispar
NIKADALTGLLLSKKDVITLKD

SEQ ID NO: 2497821 - protein, 23 aa, Entamoeba dispar
NIKDRIKLLILEIYNYCINLFIH

SEQ ID NO: 2497822 - protein, 21 aa, Entamoeba dispar
NIKFSGVLQFHYKEFSRQISF

SEQ ID NO: 2497823 - protein, 18 aa, Entamoeba dispar
NIKGEYQLYIGWYDGNPA

SEQ ID NO: 2497824 - protein, 27 aa, Entamoeba dispar
NIKHEIMEVWHFIRLTGTTAFISDDFN

SEQ ID NO: 2497825 - protein, 18 aa, Entamoeba dispar
NIKHFLFIQRKLFVSQLF

SEQ ID NO: 2497826 - protein, 25 aa, Entamoeba dispar
NIKIDDVSCLLSFDSIEKCKEWSQT

SEQ ID NO: 2497827 - protein, 25 aa, Entamoeba dispar
NIKIVASALLCLSIYAAELKTSLMP

SEQ ID NO: 2497828 - protein, 24 aa, Entamoeba dispar
NIKIWNCFNALVLGVFFGLIANNK

SEQ ID NO: 2497829 - protein, 23 aa, Entamoeba dispar
NIKKREIDLLFSYEDNVMSQITV

SEQ ID NO: 2497830 - protein, 24 aa, Entamoeba dispar
NIKKYAKEFTRFFSYSKKKPNFNV

SEQ ID NO: 2497831 - protein, 20 aa, Entamoeba dispar
NIKLDRCNDGDIIIIATDGY

SEQ ID NO: 2497832 - protein, 25 aa, Entamoeba dispar
NIKLIDFGSACFENFTMNTYIQSRH

SEQ ID NO: 2497833 - protein, 26 aa, Entamoeba dispar
NIKLSKEEFLEYPIFDEYQFNCINDH

SEQ ID NO: 2497834 - protein, 17 aa, Entamoeba dispar
NIKLVFTALPFIRTFLL

SEQ ID NO: 2497835 - protein, 22 aa, Entamoeba dispar
NIKPGEACGCIFNSKQYKEADR

SEQ ID NO: 2497836 - protein, 25 aa, Entamoeba dispar
NIKRTKRTPPIKIIDTPGLEIQEEL

SEQ ID NO: 2497837 - protein, 22 aa, Entamoeba dispar
NIKTFWKRMKRYGFKKRRIRGI

SEQ ID NO: 2497838 - protein, 31 aa, Entamoeba dispar
NIKTGLTPFYFKEFVETLIGKSIGKKLNNGK

SEQ ID NO: 2497839 - protein, 18 aa, Entamoeba dispar
NILERIVVIMKSFTIITL

SEQ ID NO: 2497840 - protein, 20 aa, Entamoeba dispar
NILFEYPHTFIWQENDSILF

SEQ ID NO: 2497841 - protein, 26 aa, Entamoeba dispar
NILHLFRAMTLHKAILMEGSPGVGKT

SEQ ID NO: 2497842 - protein, 25 aa, Entamoeba dispar
NILKDLKDGLVLIRLLRNLSGCDIP

SEQ ID NO: 2497843 - protein, 18 aa, Entamoeba dispar
NILLAEAAAFEYRLTGKI

SEQ ID NO: 2497844 - protein, 24 aa, Entamoeba dispar
NILLKREPNILIDRSHNRRYLFNL

SEQ ID NO: 2497845 - protein, 22 aa, Entamoeba dispar
NILNCGYLLLQLEDTVFYYKEN

SEQ ID NO: 2497846 - protein, 20 aa, Entamoeba dispar
NILNELKRKIEVELKVSVEE

SEQ ID NO: 2497847 - protein, 18 aa, Entamoeba dispar
NILPGWKDGTKIRFEGYG

SEQ ID NO: 2497848 - protein, 20 aa, Entamoeba dispar
NILRGKVRFSNDIKISDDCK

SEQ ID NO: 2497849 - protein, 23 aa, Entamoeba dispar
NILRVLKKWPIIATYYINETSII

SEQ ID NO: 2497850 - protein, 33 aa, Entamoeba dispar
NILSEFDVLLNFVVCNMLFNWNLPSIVNSSDPL

SEQ ID NO: 2497851 - protein, 25 aa, Entamoeba dispar
NILSPSCLCRILLKTLGITSFENKY

SEQ ID NO: 2497852 - protein, 25 aa, Entamoeba dispar
NIMLPSLVTKLGWNSFERCTSLKEI

SEQ ID NO: 2497853 - protein, 17 aa, Entamoeba dispar
NINELKNELIIIEQKLK

SEQ ID NO: 2497854 - protein, 18 aa, Entamoeba dispar
NINFCPILPNILGIVASC

SEQ ID NO: 2497855 - protein, 24 aa, Entamoeba dispar
NINFDISFNNCFNIEQEEWSIAVK

SEQ ID NO: 2497856 - protein, 18 aa, Entamoeba dispar
NINHLVEMGFLRDDAIKA

SEQ ID NO: 2497857 - protein, 23 aa, Entamoeba dispar
NINHYKALFVQNVFIQGKESIGF

SEQ ID NO: 2497858 - protein, 23 aa, Entamoeba dispar
NINIRYIPISGLSGENLIKPTNS

SEQ ID NO: 2497859 - protein, 30 aa, Entamoeba dispar
NINIYYEFCESFNYLPLGVIIKRKIGKFFC

SEQ ID NO: 2497860 - protein, 31 aa, Entamoeba dispar
NINIYYEFCESFNYLPLGVIIKRKIGKFFCC

SEQ ID NO: 2497861 - protein, 25 aa, Entamoeba dispar
NINRFFPDINITFLLDRPTTVPLQK

SEQ ID NO: 2497862 - protein, 28 aa, Entamoeba dispar
NINTCKGARFYNCSTLKTLSIKEAEVVI

SEQ ID NO: 2497863 - protein, 23 aa, Entamoeba dispar
NIPCYDYFWKCHNLKNTLCTIAA

SEQ ID NO: 2497864 - protein, 18 aa, Entamoeba dispar
NIPEKCFILKAESEEDKI

SEQ ID NO: 2497865 - protein, 27 aa, Entamoeba dispar
NIPHTIKCLICQELIDIDSVISHIVEH

SEQ ID NO: 2497866 - protein, 24 aa, Entamoeba dispar
NIPIECGQLILTNIVQLPAEMNRP

SEQ ID NO: 2497867 - protein, 18 aa, Entamoeba dispar
NIPIKEGIEFCCKITEGV

SEQ ID NO: 2497868 - protein, 24 aa, Entamoeba dispar
NIPINKIVMIIGFDPSEIKNIINS

SEQ ID NO: 2497869 - protein, 18 aa, Entamoeba dispar
NIPKHIYANTSFKIQFDI

SEQ ID NO: 2497870 - protein, 18 aa, Entamoeba dispar
NIPKRKNISFKHDNQTEK

SEQ ID NO: 2497871 - protein, 25 aa, Entamoeba dispar
NIPKSISKIGDWCFSGCTSLTNIDI

SEQ ID NO: 2497872 - protein, 24 aa, Entamoeba dispar
NIPMDLRVPYPFPKLQEFYNSIDI

SEQ ID NO: 2497873 - protein, 30 aa, Entamoeba dispar
NIPSSFTSFGIGCFYKCRCVEELKQNKTIP

SEQ ID NO: 2497874 - protein, 28 aa, Entamoeba dispar
NIPSSIISFGWGCFSECGCKEELMKNKR

SEQ ID NO: 2497875 - protein, 29 aa, Entamoeba dispar
NIPSSITSFGWGCFYECGCVEELKKNKRI

SEQ ID NO: 2497876 - protein, 29 aa, Entamoeba dispar
NIPSSITSFGWGCFYGCGCEEELKKNKRI

SEQ ID NO: 2497877 - protein, 29 aa, Entamoeba dispar
NIPSSITSFGWGCFYKCGCEEELMKNERI

SEQ ID NO: 2497878 - protein, 30 aa, Entamoeba dispar
NIPSSITSFGWGCFYKCGCEKELKKNKRIP

SEQ ID NO: 2497879 - protein, 27 aa, Entamoeba dispar
NIPSSITSFGYRCFYGCGCEEELKQNK

SEQ ID NO: 2497880 - protein, 29 aa, Entamoeba dispar
NIPSTISKIGYRCFSCCGSLTTINIPTNV

SEQ ID NO: 2497881 - protein, 30 aa, Entamoeba dispar
NIPSTITSIGYRWFYGCKSLKSINIPSSII

SEQ ID NO: 2497882 - protein, 26 aa, Entamoeba dispar
NIPTSIKTIGHWCFKECTSLQTINIP

SEQ ID NO: 2497883 - protein, 32 aa, Entamoeba dispar
NIPTSISRLGWYCFKGCYSLMSINIPSSISEI

SEQ ID NO: 2497884 - protein, 26 aa, Entamoeba dispar
NIPTSVSKLGYWCFYGCTSLKSINIP

SEQ ID NO: 2497885 - protein, 21 aa, Entamoeba dispar
NIQEVYHCIAIIPFGSHIFVL

SEQ ID NO: 2497886 - protein, 24 aa, Entamoeba dispar
NIQFKEVVDRLAGATSNVQYAHVS

SEQ ID NO: 2497887 - protein, 26 aa, Entamoeba dispar
NIQLPECLICPSLSLDQWYIIIVCFL

SEQ ID NO: 2497888 - protein, 18 aa, Entamoeba dispar
NIQNILTFLPDIYYETLK

SEQ ID NO: 2497889 - protein, 21 aa, Entamoeba dispar
NIQRVCVALQQFGEIVYNFVQ

SEQ ID NO: 2497890 - protein, 19 aa, Entamoeba dispar
NIQSLVLQYICKLPSLNLW

SEQ ID NO: 2497891 - protein, 18 aa, Entamoeba dispar
NIQTCVGNLLQPKQKEES

SEQ ID NO: 2497892 - protein, 23 aa, Entamoeba dispar
NIQWKTDSLFVITSKGVIIMKEQ

SEQ ID NO: 2497893 - protein, 25 aa, Entamoeba dispar
NIRDMLGDNCCIVIVGNKMDLIQQR

SEQ ID NO: 2497894 - protein, 24 aa, Entamoeba dispar
NIREIFKKLCFIVSQKKNGVGILM

SEQ ID NO: 2497895 - protein, 18 aa, Entamoeba dispar
NIRKEDFSSSVMDKNSTS

SEQ ID NO: 2497896 - protein, 25 aa, Entamoeba dispar
NIRLIDFGSSCFENSTLYTYIQSRH

SEQ ID NO: 2497897 - protein, 28 aa, Entamoeba dispar
NIRQDICYACLPLEFLKKEEYLTLAMTK

SEQ ID NO: 2497898 - protein, 23 aa, Entamoeba dispar
NIRTRVNLFRNWMDKTSLKENIQ

SEQ ID NO: 2497899 - protein, 18 aa, Entamoeba dispar
NISERGGMDGGWFMLTEH

SEQ ID NO: 2497900 - protein, 22 aa, Entamoeba dispar
NISKIITCLAFITNNNFKTKEY

SEQ ID NO: 2497901 - protein, 26 aa, Entamoeba dispar
NISKMKFNNCFPNIKELVLRQCDNCS

SEQ ID NO: 2497902 - protein, 18 aa, Entamoeba dispar
NISPLFSLKLQDNINNTL

SEQ ID NO: 2497903 - protein, 32 aa, Entamoeba dispar
NISQRWLPEIKHFCPNAPFLLAATKTDLRESE

SEQ ID NO: 2497904 - protein, 25 aa, Entamoeba dispar
NISRCGQCFELFGPSLKPFTCMIAG

SEQ ID NO: 2497905 - protein, 18 aa, Entamoeba dispar
NISSCLLAEYLVYENRVI

SEQ ID NO: 2497906 - protein, 23 aa, Entamoeba dispar
NISSRYSGYYGIRNEEEPNGIKG

SEQ ID NO: 2497907 - protein, 27 aa, Entamoeba dispar
NISTKSMFCFNALYTIWGMSKETIQSS

SEQ ID NO: 2497908 - protein, 18 aa, Entamoeba dispar
NITACSIGDLIFISDTKC

SEQ ID NO: 2497909 - protein, 22 aa, Entamoeba dispar
NITCDIYAFSMVIWQIFTQRLL

SEQ ID NO: 2497910 - protein, 27 aa, Entamoeba dispar
NITDLPSCVKFSCDFRQSVLELLLWCN

SEQ ID NO: 2497911 - protein, 17 aa, Entamoeba dispar
NITERPLDVFIADNNQI

SEQ ID NO: 2497912 - protein, 28 aa, Entamoeba dispar
NITFLFSVSNGFVFGCHFGQIPKTCQHL

SEQ ID NO: 2497913 - protein, 23 aa, Entamoeba dispar
NITISCIQWKLNEIKQIPNQIEI

SEQ ID NO: 2497914 - protein, 18 aa, Entamoeba dispar
NITLRLKLVDSYQTATSS

SEQ ID NO: 2497915 - protein, 28 aa, Entamoeba dispar
NITSCSLHKFKLFRCNELKTLTIPTTIT

SEQ ID NO: 2497916 - protein, 26 aa, Entamoeba dispar
NITTREGFFRINFNVPRETEEGTVYV

SEQ ID NO: 2497917 - protein, 18 aa, Entamoeba dispar
NITVCPSKIQIPYESICK

SEQ ID NO: 2497918 - protein, 23 aa, Entamoeba dispar
NITVCVIPPLPLLKPLSFPLSIT

SEQ ID NO: 2497919 - protein, 25 aa, Entamoeba dispar
NITYGWWDLNRSDCWVAQMRDADSV

SEQ ID NO: 2497920 - protein, 25 aa, Entamoeba dispar
NIVCICERWSLIFSHHEKVIIVDNE

SEQ ID NO: 2497921 - protein, 24 aa, Entamoeba dispar
NIVEGIFRIPGERQLADNMKKTIE

SEQ ID NO: 2497922 - protein, 20 aa, Entamoeba dispar
NIVGFEGCWIFDNRVYIGME

SEQ ID NO: 2497923 - protein, 20 aa, Entamoeba dispar
NIVGFEGCWLYNNQVYIGME

SEQ ID NO: 2497924 - protein, 18 aa, Entamoeba dispar
NIVLKWFDKLEMTIPKDL

SEQ ID NO: 2497925 - protein, 24 aa, Entamoeba dispar
NIVLQPKFVKLLLAISLVRRHPLK

SEQ ID NO: 2497926 - protein, 19 aa, Entamoeba dispar
NIVLWSIGVTIVLNERKHK

SEQ ID NO: 2497927 - protein, 36 aa, Entamoeba dispar
NIVQRPLCPRYMLLLNEIIRLSLLIEFDKQRISNSE

SEQ ID NO: 2497928 - protein, 24 aa, Entamoeba dispar
NIVRFYGVIVKKQFSMVMEYCSKG

SEQ ID NO: 2497929 - protein, 18 aa, Entamoeba dispar
NIVRRELTRIYTVSTATE

SEQ ID NO: 2497930 - protein, 22 aa, Entamoeba dispar
NIWNYFCEYIAFKLINNQLIVH

SEQ ID NO: 2497931 - protein, 20 aa, Entamoeba dispar
NIYERSFINPGEMVGSIAAQ

SEQ ID NO: 2497932 - protein, 18 aa, Entamoeba dispar
NIYGETWNSNTWIRNVHP

SEQ ID NO: 2497933 - protein, 28 aa, Entamoeba dispar
NIYHCSCLCSLKILGLVSYLILLPTSLT

SEQ ID NO: 2497934 - protein, 24 aa, Entamoeba dispar
NIYIKRIAIEFIGNTPTLIIGTSP

SEQ ID NO: 2497935 - protein, 23 aa, Entamoeba dispar
NIYIPELIFGHLLTSSNYKDDDK

SEQ ID NO: 2497936 - protein, 21 aa, Entamoeba dispar
NIYLIDCPGVVYPSGDTESEV

SEQ ID NO: 2497937 - protein, 17 aa, Entamoeba dispar
NIYREYDISAVLSLTTN

SEQ ID NO: 2497938 - protein, 22 aa, Entamoeba dispar
NIYSHLKYLLILNLKDFLNLNA

SEQ ID NO: 2497939 - protein, 27 aa, Entamoeba dispar
NIYSMRVREWYGWHFPELSKYINDHMA

SEQ ID NO: 2497940 - protein, 19 aa, Entamoeba dispar
NIYSNVFPFGSFNNELLII

SEQ ID NO: 2497941 - protein, 27 aa, Entamoeba dispar
NKAEFDRLSGLFQRNFGGFRNEVKDIF

SEQ ID NO: 2497942 - protein, 23 aa, Entamoeba dispar
NKAFRIPYKLIVKGHENRNETDD

SEQ ID NO: 2497943 - protein, 18 aa, Entamoeba dispar
NKAIELYSLISSSLPENI

SEQ ID NO: 2497944 - protein, 17 aa, Entamoeba dispar
NKAIMLYKSREHKQEHI

SEQ ID NO: 2497945 - protein, 18 aa, Entamoeba dispar
NKAIMSFNGTKVGKNEIM

SEQ ID NO: 2497946 - protein, 19 aa, Entamoeba dispar
NKAKSLSIYGVSEMGYKPE

SEQ ID NO: 2497947 - protein, 30 aa, Entamoeba dispar
NKALKAIGLHKCYCACWGVMSEKSRAKCLG

SEQ ID NO: 2497948 - protein, 27 aa, Entamoeba dispar
NKALLNRLMKLCYRISLNHDDTQMDSL

SEQ ID NO: 2497949 - protein, 26 aa, Entamoeba dispar
NKARWKCFVCSCCEPTAMNRNIFIKK

SEQ ID NO: 2497950 - protein, 21 aa, Entamoeba dispar
NKCGIAFLMGCNSVELNQQGD

SEQ ID NO: 2497951 - protein, 24 aa, Entamoeba dispar
NKCNLKLIMCEGISESLQSESITS

SEQ ID NO: 2497952 - protein, 19 aa, Entamoeba dispar
NKCTLVFDIGGVYDHKIKR

SEQ ID NO: 2497953 - protein, 21 aa, Entamoeba dispar
NKCWELFCLEHGIQPDGTAIG

SEQ ID NO: 2497954 - protein, 20 aa, Entamoeba dispar
NKCWELFCLEHGIQSDGTAI

SEQ ID NO: 2497955 - protein, 18 aa, Entamoeba dispar
NKCYACECNHFMLMAMNT

SEQ ID NO: 2497956 - protein, 18 aa, Entamoeba dispar
NKCYSFQLSDKNTRSLGL

SEQ ID NO: 2497957 - protein, 18 aa, Entamoeba dispar
NKDCPIFYMRVKVQHSIN

SEQ ID NO: 2497958 - protein, 32 aa, Entamoeba dispar
NKDELLKWATVCYKAALEFVGNSSIQCNSLTL

SEQ ID NO: 2497959 - protein, 24 aa, Entamoeba dispar
NKDENCGYCHIGVVANINSNEPTR

SEQ ID NO: 2497960 - protein, 24 aa, Entamoeba dispar
NKDKWSLNCCKEIALHGERREKLY

SEQ ID NO: 2497961 - protein, 25 aa, Entamoeba dispar
NKDNYKYWHRWALINFEVVNYYENM

SEQ ID NO: 2497962 - protein, 26 aa, Entamoeba dispar
NKDQKKLWIQLAIKLNYEERDDIALK

SEQ ID NO: 2497963 - protein, 22 aa, Entamoeba dispar
NKDYRYALSMEWFNVTFKRGVC

SEQ ID NO: 2497964 - protein, 24 aa, Entamoeba dispar
NKECGGCLYQSMGYQQQLEMKKKQ

SEQ ID NO: 2497965 - protein, 19 aa, Entamoeba dispar
NKECPVCSINLKIDEYLPK

SEQ ID NO: 2497966 - protein, 22 aa, Entamoeba dispar
NKEDFTTFCGKNIVFPFNQNYK

SEQ ID NO: 2497967 - protein, 18 aa, Entamoeba dispar
NKEDLWWSRHGMDDISVQ

SEQ ID NO: 2497968 - protein, 31 aa, Entamoeba dispar
NKEFKEQVCYRIGEMIRRGGIKCTNVVLEQD

SEQ ID NO: 2497969 - protein, 18 aa, Entamoeba dispar
NKEFPNNNVTLWIDEYGI

SEQ ID NO: 2497970 - protein, 22 aa, Entamoeba dispar
NKEGKLKIYLYPNEPFNQKDES

SEQ ID NO: 2497971 - protein, 25 aa, Entamoeba dispar
NKEGQFYLGNAFVEFVTEAEKDKFI

SEQ ID NO: 2497972 - protein, 26 aa, Entamoeba dispar
NKEIIEIDILYLLIIHFNKLTNEEIN

SEQ ID NO: 2497973 - protein, 19 aa, Entamoeba dispar
NKEIIPLTYDFERFNIKLG

SEQ ID NO: 2497974 - protein, 24 aa, Entamoeba dispar
NKEIKTKKGIFFYTIYSFIGNIIE

SEQ ID NO: 2497975 - protein, 18 aa, Entamoeba dispar
NKEITYEPFVLRASLSDK

SEQ ID NO: 2497976 - protein, 23 aa, Entamoeba dispar
NKELKNLITGAGIKDIPFIDKNE

SEQ ID NO: 2497977 - protein, 23 aa, Entamoeba dispar
NKELPFKIGNSINYEVLSVYALQ

SEQ ID NO: 2497978 - protein, 18 aa, Entamoeba dispar
NKELPIVLADDITKLPGD

SEQ ID NO: 2497979 - protein, 19 aa, Entamoeba dispar
NKELYDFGTKLQRHNIIKS

SEQ ID NO: 2497980 - protein, 20 aa, Entamoeba dispar
NKEMLKEWIENEVPSRLETL

SEQ ID NO: 2497981 - protein, 26 aa, Entamoeba dispar
NKENLLRFVFPLSRITLLPCNSKKDS

SEQ ID NO: 2497982 - protein, 22 aa, Entamoeba dispar
NKERLGGVYFDLYSRKGKRAGG

SEQ ID NO: 2497983 - protein, 23 aa, Entamoeba dispar
NKEYKVVGWYAGMANGEPLTSDI

SEQ ID NO: 2497984 - protein, 29 aa, Entamoeba dispar
NKFASLYCVFPLVGSEAIQVPFMLNSPDF

SEQ ID NO: 2497985 - protein, 17 aa, Entamoeba dispar
NKFAYAAESCNINGTFY

SEQ ID NO: 2497986 - protein, 17 aa, Entamoeba dispar
NKFCALKILKNKKAYLR

SEQ ID NO: 2497987 - protein, 20 aa, Entamoeba dispar
NKFCGFTIESPSKMSQITAT

SEQ ID NO: 2497988 - protein, 21 aa, Entamoeba dispar
NKFCKLYVRFIQTLRQQNGLT

SEQ ID NO: 2497989 - protein, 17 aa, Entamoeba dispar
NKFDKICICQYMRDITI

SEQ ID NO: 2497990 - protein, 28 aa, Entamoeba dispar
NKFDNWEFFDIIFGIPMDCYDENQQCVN

SEQ ID NO: 2497991 - protein, 19 aa, Entamoeba dispar
NKFEYNICQAIDYLKDYGT

SEQ ID NO: 2497992 - protein, 20 aa, Entamoeba dispar
NKFFPVVDFGKGVIVTITPD

SEQ ID NO: 2497993 - protein, 18 aa, Entamoeba dispar
NKFGGFIYQSVSMEESYI

SEQ ID NO: 2497994 - protein, 18 aa, Entamoeba dispar
NKFIFGVHGLFGMKVTKK

SEQ ID NO: 2497995 - protein, 26 aa, Entamoeba dispar
NKFIPFDRYSYLSIIIPEFKTISEMC

SEQ ID NO: 2497996 - protein, 24 aa, Entamoeba dispar
NKFKELIVEGGERIYIYGTIDSVR

SEQ ID NO: 2497997 - protein, 18 aa, Entamoeba dispar
NKFKGVSVETIIDNINSL

SEQ ID NO: 2497998 - protein, 28 aa, Entamoeba dispar
NKFKLTFFFFQCFIKSCVVADKEIKEIE

SEQ ID NO: 2497999 - protein, 24 aa, Entamoeba dispar
NKFPLPSSIKFELIKCNGCEPTQL

SEQ ID NO: 2498000 - protein, 17 aa, Entamoeba dispar
NKFVRLCIGNQLTEAKM

SEQ ID NO: 2498001 - protein, 18 aa, Entamoeba dispar
NKFYFLNQIEHWNAGDKD

SEQ ID NO: 2498002 - protein, 34 aa, Entamoeba dispar
NKGGIYCKNCGRVFVCDKCRENVDFISSLTSTEL

SEQ ID NO: 2498003 - protein, 19 aa, Entamoeba dispar
NKGKDKPYCVVFETDIVQM

SEQ ID NO: 2498004 - protein, 19 aa, Entamoeba dispar
NKGLMEVQCCVLVPQYATN

SEQ ID NO: 2498005 - protein, 17 aa, Entamoeba dispar
NKGNCKIINRVGGKLTI

SEQ ID NO: 2498006 - protein, 23 aa, Entamoeba dispar
NKGNKKYDVKFMRVDVDKSLLKG

SEQ ID NO: 2498007 - protein, 35 aa, Entamoeba dispar
NKGQELVRVLLFYQLCSFCLKCFYKELSSTTLQTR

SEQ ID NO: 2498008 - protein, 17 aa, Entamoeba dispar
NKHCDLLSVAIIPFKFL

SEQ ID NO: 2498009 - protein, 24 aa, Entamoeba dispar
NKHKMEIIPLLIIITTLFEMYGDQ

SEQ ID NO: 2498010 - protein, 19 aa, Entamoeba dispar
NKHLLGTYAVFYHKEGPQG

SEQ ID NO: 2498011 - protein, 17 aa, Entamoeba dispar
NKIDELGLFNFSKLRAI

SEQ ID NO: 2498012 - protein, 22 aa, Entamoeba dispar
NKIEEKRVLVLAGNKVDLSERV

SEQ ID NO: 2498013 - protein, 17 aa, Entamoeba dispar
NKIESIIKEHFRTNWDP

SEQ ID NO: 2498014 - protein, 17 aa, Entamoeba dispar
NKIFKGFVQLSCSEETT

SEQ ID NO: 2498015 - protein, 17 aa, Entamoeba dispar
NKIFSGVKCLSEEDHLI

SEQ ID NO: 2498016 - protein, 24 aa, Entamoeba dispar
NKIHCIRIRSSWVMTCAYAPSMKF

SEQ ID NO: 2498017 - protein, 18 aa, Entamoeba dispar
NKIIFEKKYRAVINQECW

SEQ ID NO: 2498018 - protein, 25 aa, Entamoeba dispar
NKIILADNIKEERIPSILEQLKEQP

SEQ ID NO: 2498019 - protein, 17 aa, Entamoeba dispar
NKIIVIVAIDDREESLL

SEQ ID NO: 2498020 - protein, 19 aa, Entamoeba dispar
NKIKGEIEIKDTIPNEIDL

SEQ ID NO: 2498021 - protein, 21 aa, Entamoeba dispar
NKIKMLIPLEILRAQNQKEKY

SEQ ID NO: 2498022 - protein, 18 aa, Entamoeba dispar
NKILEFNKNCYLDSKSLI

SEQ ID NO: 2498023 - protein, 22 aa, Entamoeba dispar
NKILEIFEGTGFQHVADTELLE

SEQ ID NO: 2498024 - protein, 21 aa, Entamoeba dispar
NKILFIPCWSVGNVGQLCVDL

SEQ ID NO: 2498025 - protein, 27 aa, Entamoeba dispar
NKIPVEDILPLLPLDWELGEFKGVIKN

SEQ ID NO: 2498026 - protein, 26 aa, Entamoeba dispar
NKIQSDRLKNALSLKDIKYNNDLDKM

SEQ ID NO: 2498027 - protein, 18 aa, Entamoeba dispar
NKKCGSVISALKINPWFT

SEQ ID NO: 2498028 - protein, 21 aa, Entamoeba dispar
NKKCWDVCQMMKINPMAIDKM

SEQ ID NO: 2498029 - protein, 23 aa, Entamoeba dispar
NKKEIFKGNIIELEEEFTCITMG

SEQ ID NO: 2498030 - protein, 23 aa, Entamoeba dispar
NKKESWVRYFLHTGHLHINGLKM

SEQ ID NO: 2498031 - protein, 20 aa, Entamoeba dispar
NKKFRLVCLDKKKHQIISTL

SEQ ID NO: 2498032 - protein, 25 aa, Entamoeba dispar
NKKLFGILIEAEWKNNSFLVNIGIG

SEQ ID NO: 2498033 - protein, 25 aa, Entamoeba dispar
NKKMIKRLYGFFDEDIIFPKLPKVY

SEQ ID NO: 2498034 - protein, 20 aa, Entamoeba dispar
NKKMVSWKKSFFDVSKPEEF

SEQ ID NO: 2498035 - protein, 26 aa, Entamoeba dispar
NKKNFLIRIAHGFHDLFIRTIKKLKI

SEQ ID NO: 2498036 - protein, 28 aa, Entamoeba dispar
NKKNRNLYCLVYYLLLGEITLNKKVILF

SEQ ID NO: 2498037 - protein, 25 aa, Entamoeba dispar
NKKQMKYPIAFLTEGKFDNRIVDTR

SEQ ID NO: 2498038 - protein, 22 aa, Entamoeba dispar
NKKRIKTLVLVSDTRMGKTEFV

SEQ ID NO: 2498039 - protein, 18 aa, Entamoeba dispar
NKKSTVLFPSFKQQVNIK

SEQ ID NO: 2498040 - protein, 22 aa, Entamoeba dispar
NKKTEIHLTLQAIREAHQLIEQ

SEQ ID NO: 2498041 - protein, 25 aa, Entamoeba dispar
NKKTLRVSFVLSFTFKQNPYLLYNT

SEQ ID NO: 2498042 - protein, 28 aa, Entamoeba dispar
NKKVISWQLLCRSILYSLSIVNAPRVYF

SEQ ID NO: 2498043 - protein, 21 aa, Entamoeba dispar
NKKVKCITGMISLQGKRPTNE

SEQ ID NO: 2498044 - protein, 29 aa, Entamoeba dispar
NKKVLRIGMRPLKVIPLKSLSPIERKKKA

SEQ ID NO: 2498045 - protein, 17 aa, Entamoeba dispar
NKKYGYRNGDLVFIVQV

SEQ ID NO: 2498046 - protein, 18 aa, Entamoeba dispar
NKLCSMNQVEPLKAFLKA

SEQ ID NO: 2498047 - protein, 24 aa, Entamoeba dispar
NKLELKKLVYLYLMNYSRSQPERA

SEQ ID NO: 2498048 - protein, 20 aa, Entamoeba dispar
NKLFYCSYLPSGQARLTKKF

SEQ ID NO: 2498049 - protein, 19 aa, Entamoeba dispar
NKLGDWCFNECKSLKSINI

SEQ ID NO: 2498050 - protein, 20 aa, Entamoeba dispar
NKLIDIFTLLGRVGAAACSQ

SEQ ID NO: 2498051 - protein, 24 aa, Entamoeba dispar
NKLIEFFGIIPIIHIEGRTFPVSV

SEQ ID NO: 2498052 - protein, 23 aa, Entamoeba dispar
NKLIKISEEFNVAVVITNQVMSD

SEQ ID NO: 2498053 - protein, 18 aa, Entamoeba dispar
NKLILAFEGVLYQDDTIQ

SEQ ID NO: 2498054 - protein, 23 aa, Entamoeba dispar
NKLKELFSPYGNVINSTIKKSSK

SEQ ID NO: 2498055 - protein, 17 aa, Entamoeba dispar
NKLKGLINYCNINHISH

SEQ ID NO: 2498056 - protein, 21 aa, Entamoeba dispar
NKLKGRVLTIGTKEIELERSV

SEQ ID NO: 2498057 - protein, 26 aa, Entamoeba dispar
NKLKIKDIIPLFGIGIYSEGDNAFSV

SEQ ID NO: 2498058 - protein, 20 aa, Entamoeba dispar
NKLKLFVYFSPYSEDPFQPN

SEQ ID NO: 2498059 - protein, 21 aa, Entamoeba dispar
NKLKNGKSFVIDASDIVKKYT

SEQ ID NO: 2498060 - protein, 17 aa, Entamoeba dispar
NKLKTIDKHCISTNDTN

SEQ ID NO: 2498061 - protein, 32 aa, Entamoeba dispar
NKLLCDRLSLNRMKMPSIDLISAEGNKEQLTF

SEQ ID NO: 2498062 - protein, 21 aa, Entamoeba dispar
NKLLKRCIPHPLNNTLIHVLT

SEQ ID NO: 2498063 - protein, 21 aa, Entamoeba dispar
NKLLLKFIETISFYLKEHSTL

SEQ ID NO: 2498064 - protein, 21 aa, Entamoeba dispar
NKLLNSVLIEFCNKDEMTELQ

SEQ ID NO: 2498065 - protein, 17 aa, Entamoeba dispar
NKLLYSIRDINRKASSI

SEQ ID NO: 2498066 - protein, 19 aa, Entamoeba dispar
NKLNMIKIIEVARLIHQII

SEQ ID NO: 2498067 - protein, 21 aa, Entamoeba dispar
NKLPFMPMILNISPDIVTIPQ

SEQ ID NO: 2498068 - protein, 19 aa, Entamoeba dispar
NKLPLSVNFGSTGFYYERR

SEQ ID NO: 2498069 - protein, 27 aa, Entamoeba dispar
NKLPTGCYCTYSLISKQECIFDCENEN

SEQ ID NO: 2498070 - protein, 17 aa, Entamoeba dispar
NKLQEYWGQILKFIGGY

SEQ ID NO: 2498071 - protein, 25 aa, Entamoeba dispar
NKLRSVKVVECHQCKINIKSDCIER

SEQ ID NO: 2498072 - protein, 25 aa, Entamoeba dispar
NKLRSVKVVECRDCQINIKSDCIER

SEQ ID NO: 2498073 - protein, 19 aa, Entamoeba dispar
NKLSPVFIKQNEETLIDDS

SEQ ID NO: 2498074 - protein, 21 aa, Entamoeba dispar
NKLTLEIFKKYGLTKKDSPKI

SEQ ID NO: 2498075 - protein, 25 aa, Entamoeba dispar
NKLTPLHYCCVYGMVHLIDDIIAIA

SEQ ID NO: 2498076 - protein, 20 aa, Entamoeba dispar
NKLWNAFKFSSMNFRKDFKP

SEQ ID NO: 2498077 - protein, 21 aa, Entamoeba dispar
NKLYGGSLFKKTLVQDSALEQ

SEQ ID NO: 2498078 - protein, 26 aa, Entamoeba dispar
NKMGHLCFYNCLSLTSINIVNIKFIS

SEQ ID NO: 2498079 - protein, 20 aa, Entamoeba dispar
NKMGKVFLERQTCVMTEKLG

SEQ ID NO: 2498080 - protein, 21 aa, Entamoeba dispar
NKMHSIIAIVVFYRVSDEYVL

SEQ ID NO: 2498081 - protein, 29 aa, Entamoeba dispar
NKMIQKWGITDSCIFYFVQLLQGRNAIKL

SEQ ID NO: 2498082 - protein, 27 aa, Entamoeba dispar
NKMKEACCIGFKWAMSSGPLCEEEMRN

SEQ ID NO: 2498083 - protein, 26 aa, Entamoeba dispar
NKMPVIWKLYIEWLIENREITQMRRV

SEQ ID NO: 2498084 - protein, 25 aa, Entamoeba dispar
NKNAIEFYTKFGFRKIKIIPRAYPR

SEQ ID NO: 2498085 - protein, 26 aa, Entamoeba dispar
NKNCPKRWFIKSGKEGGIKLFSNNDC

SEQ ID NO: 2498086 - protein, 19 aa, Entamoeba dispar
NKNEIVDCFMYIKEFEQAA

SEQ ID NO: 2498087 - protein, 18 aa, Entamoeba dispar
NKNELCYFGDENYGWLSI

SEQ ID NO: 2498088 - protein, 21 aa, Entamoeba dispar
NKNEWRIWIANTTKFGPIKLL

SEQ ID NO: 2498089 - protein, 24 aa, Entamoeba dispar
NKNFDMRPGMIIKELGLTKPIFQK

SEQ ID NO: 2498090 - protein, 25 aa, Entamoeba dispar
NKNFDMRPGMIIKELGLTKPIFQKT

SEQ ID NO: 2498091 - protein, 24 aa, Entamoeba dispar
NKNFEYIKYISLCYQTFLNNFITT

SEQ ID NO: 2498092 - protein, 17 aa, Entamoeba dispar
NKNFKQMMEVFKPLMKK

SEQ ID NO: 2498093 - protein, 26 aa, Entamoeba dispar
NKNGIDIIKNWYWREESINEINKIKF

SEQ ID NO: 2498094 - protein, 25 aa, Entamoeba dispar
NKNIKEQIKAGGLQRQEINRMVREN

SEQ ID NO: 2498095 - protein, 31 aa, Entamoeba dispar
NKNIKRQSSELMEIDSTFNFDNKKEEEYVDN

SEQ ID NO: 2498096 - protein, 22 aa, Entamoeba dispar
NKNKEIQQHTSIDCNNQSNNLY

SEQ ID NO: 2498097 - protein, 22 aa, Entamoeba dispar
NKNKYHSWRTLFDSCYVSSNNI

SEQ ID NO: 2498098 - protein, 26 aa, Entamoeba dispar
NKNNITFEFIVKWLLMLFKREFNSKE

SEQ ID NO: 2498099 - protein, 20 aa, Entamoeba dispar
NKNNIWKWVIKDNKDSNEIV

SEQ ID NO: 2498100 - protein, 23 aa, Entamoeba dispar
NKNPYWASLDFKTTSMFSSANLY

SEQ ID NO: 2498101 - protein, 17 aa, Entamoeba dispar
NKPGYKPSAVVMEVDPD

SEQ ID NO: 2498102 - protein, 17 aa, Entamoeba dispar
NKPLPLPIITSINCSVI

SEQ ID NO: 2498103 - protein, 22 aa, Entamoeba dispar
NKPSDMLWNDFIQNIIIPTRTR

SEQ ID NO: 2498104 - protein, 26 aa, Entamoeba dispar
NKPTKAFIMTLWLKSIFEQDLAYLMS

SEQ ID NO: 2498105 - protein, 17 aa, Entamoeba dispar
NKPVVILCLNIFKEGQI

SEQ ID NO: 2498106 - protein, 23 aa, Entamoeba dispar
NKQDVAIEFGVEFSTSEIEQKAD

SEQ ID NO: 2498107 - protein, 25 aa, Entamoeba dispar
NKQHYFHIGCKLLRTGVNELTSHSL

SEQ ID NO: 2498108 - protein, 18 aa, Entamoeba dispar
NKQLKWMLVRCHYPEITL

SEQ ID NO: 2498109 - protein, 25 aa, Entamoeba dispar
NKRECSIFLLLCCGDDVLESFFEVL

SEQ ID NO: 2498110 - protein, 18 aa, Entamoeba dispar
NKRGLLISRIFQTKIKIL

SEQ ID NO: 2498111 - protein, 22 aa, Entamoeba dispar
NKRGYVTTCCIAIIQSSPFTTS

SEQ ID NO: 2498112 - protein, 21 aa, Entamoeba dispar
NKRIEALQSLLITKEQEIQKI

SEQ ID NO: 2498113 - protein, 22 aa, Entamoeba dispar
NKRIEEFEKIMIHEAQLIIHKK

SEQ ID NO: 2498114 - protein, 22 aa, Entamoeba dispar
NKRIIPFPSKIIVVGTKLDIKK

SEQ ID NO: 2498115 - protein, 20 aa, Entamoeba dispar
NKRINVEYVMIIGHIKRHTG

SEQ ID NO: 2498116 - protein, 24 aa, Entamoeba dispar
NKRNFIYQNVFDWFDDIIPEKKLI

SEQ ID NO: 2498117 - protein, 32 aa, Entamoeba dispar
NKRPVIRKRIEAFVKCPVNFIFSRKKDKSFSV

SEQ ID NO: 2498118 - protein, 22 aa, Entamoeba dispar
NKRSTIGRIFFWLIKSELHIPE

SEQ ID NO: 2498119 - protein, 19 aa, Entamoeba dispar
NKRSVKELCELLKKSEMKK

SEQ ID NO: 2498120 - protein, 18 aa, Entamoeba dispar
NKRWIIVQQQAFTHWVNE

SEQ ID NO: 2498121 - protein, 19 aa, Entamoeba dispar
NKRYKRYYNSAGRYVSRQY

SEQ ID NO: 2498122 - protein, 18 aa, Entamoeba dispar
NKSFRYELKCHCKSIAST

SEQ ID NO: 2498123 - protein, 18 aa, Entamoeba dispar
NKSGGLWFHVEENDCLLS

SEQ ID NO: 2498124 - protein, 17 aa, Entamoeba dispar
NKSIGVLLAPAINIQRH

SEQ ID NO: 2498125 - protein, 25 aa, Entamoeba dispar
NKSIIKSNFTNIVFCDYVNSNESAD

SEQ ID NO: 2498126 - protein, 18 aa, Entamoeba dispar
NKSIKIVNEISVNDIDWN

SEQ ID NO: 2498127 - protein, 17 aa, Entamoeba dispar
NKSKEVFQMYPREINVL

SEQ ID NO: 2498128 - protein, 23 aa, Entamoeba dispar
NKSLEELRRFIIVQTEAGVISRQ

SEQ ID NO: 2498129 - protein, 18 aa, Entamoeba dispar
NKSLEIDNVFNLHQAKPR

SEQ ID NO: 2498130 - protein, 21 aa, Entamoeba dispar
NKSLKKLSFINQKLLSINDEI

SEQ ID NO: 2498131 - protein, 26 aa, Entamoeba dispar
NKSTYCIYDMKLAVLQFIPFYHTTQV

SEQ ID NO: 2498132 - protein, 26 aa, Entamoeba dispar
NKSWIKRLNIVISFLRDMRLIQRDIE

SEQ ID NO: 2498133 - protein, 18 aa, Entamoeba dispar
NKSWRQLKPQTMKIQCEI

SEQ ID NO: 2498134 - protein, 20 aa, Entamoeba dispar
NKTIILRWDLQNDLSVIEPI

SEQ ID NO: 2498135 - protein, 26 aa, Entamoeba dispar
NKTIKYCPLKTLYLKNLCQYQDLEYL

SEQ ID NO: 2498136 - protein, 18 aa, Entamoeba dispar
NKTIRILEYYGYDDNVWK

SEQ ID NO: 2498137 - protein, 24 aa, Entamoeba dispar
NKTKIPPPVYCRLIESLINDGQTS

SEQ ID NO: 2498138 - protein, 25 aa, Entamoeba dispar
NKTKSSCIQYSFEYKGIEDALCGKQ

SEQ ID NO: 2498139 - protein, 21 aa, Entamoeba dispar
NKTPVYCMRWTPDGRRIVTGN

SEQ ID NO: 2498140 - protein, 17 aa, Entamoeba dispar
NKTRKQCRERYYNCLSD

SEQ ID NO: 2498141 - protein, 21 aa, Entamoeba dispar
NKTSIPLQLIWNNFETNCFEN

SEQ ID NO: 2498142 - protein, 27 aa, Entamoeba dispar
NKTTAQICIRWLIQNGIIAIPKSTNPN

SEQ ID NO: 2498143 - protein, 26 aa, Entamoeba dispar
NKTTASLVLGFIWMLFDKFQEKNIKL

SEQ ID NO: 2498144 - protein, 24 aa, Entamoeba dispar
NKVECKSSWIIWNVLQEYKFIENV

SEQ ID NO: 2498145 - protein, 18 aa, Entamoeba dispar
NKVFESFLYCIRSKEIQY

SEQ ID NO: 2498146 - protein, 25 aa, Entamoeba dispar
NKVGKRKKEMLMVARSLAKDMKAIC

SEQ ID NO: 2498147 - protein, 17 aa, Entamoeba dispar
NKVGLGKIWTKLTDEKS

SEQ ID NO: 2498148 - protein, 27 aa, Entamoeba dispar
NKVGYRFTFNDCNGDTFLNGRTTNNSM

SEQ ID NO: 2498149 - protein, 18 aa, Entamoeba dispar
NKVLELILFKNLHLTTQT

SEQ ID NO: 2498150 - protein, 20 aa, Entamoeba dispar
NKVPKGYFNKEFIRQKCLTF

SEQ ID NO: 2498151 - protein, 23 aa, Entamoeba dispar
NKVTCLKFYKEELIIGTNGDSIT

SEQ ID NO: 2498152 - protein, 18 aa, Entamoeba dispar
NKWIDLIFGYLQRPPAAF

SEQ ID NO: 2498153 - protein, 24 aa, Entamoeba dispar
NKWIIQFPKRFVEIKGENTLFTYS

SEQ ID NO: 2498154 - protein, 22 aa, Entamoeba dispar
NKWNNWSVVWVKQKGYPWWPAK

SEQ ID NO: 2498155 - protein, 23 aa, Entamoeba dispar
NKWREKYGWVFDKDCNDCNFPKG

SEQ ID NO: 2498156 - protein, 23 aa, Entamoeba dispar
NKWRTQPCLFFQRYGFCRKGDDC

SEQ ID NO: 2498157 - protein, 26 aa, Entamoeba dispar
NKYCGMENCGATCYINSVIQQLHNNE

SEQ ID NO: 2498158 - protein, 18 aa, Entamoeba dispar
NKYDLKCAQIILRLLTKY

SEQ ID NO: 2498159 - protein, 18 aa, Entamoeba dispar
NKYGLPLLPKENFETLFT

SEQ ID NO: 2498160 - protein, 17 aa, Entamoeba dispar
NKYKISSIFGDKIKEFI

SEQ ID NO: 2498161 - protein, 21 aa, Entamoeba dispar
NKYRFCSVSDALLSIQFKTPY

SEQ ID NO: 2498162 - protein, 22 aa, Entamoeba dispar
NKYRIEPSFVLAILCGIISQQT

SEQ ID NO: 2498163 - protein, 19 aa, Entamoeba dispar
NKYYFCYDPKLMEKIFNKM

SEQ ID NO: 2498164 - protein, 19 aa, Entamoeba dispar
NLADRVRTAPFFTLQEKLF

SEQ ID NO: 2498165 - protein, 21 aa, Entamoeba dispar
NLADVNWTFNIRAHDIPYSPI

SEQ ID NO: 2498166 - protein, 19 aa, Entamoeba dispar
NLAGYRCVIEASNKFGRLL

SEQ ID NO: 2498167 - protein, 18 aa, Entamoeba dispar
NLAICLAPCILYDSKADI

SEQ ID NO: 2498168 - protein, 18 aa, Entamoeba dispar
NLAMSFRMLLSDHTLIGT

SEQ ID NO: 2498169 - protein, 17 aa, Entamoeba dispar
NLAYKYFSIKKICDLAE

SEQ ID NO: 2498170 - protein, 18 aa, Entamoeba dispar
NLCGACVFMPLITNDFNP

SEQ ID NO: 2498171 - protein, 19 aa, Entamoeba dispar
NLCGPRCYYCKQPIEDTAI

SEQ ID NO: 2498172 - protein, 20 aa, Entamoeba dispar
NLDIFSFLLKDFRLIIYEVN

SEQ ID NO: 2498173 - protein, 23 aa, Entamoeba dispar
NLDVLKRYWITCTITEKEHEIGR

SEQ ID NO: 2498174 - protein, 25 aa, Entamoeba dispar
NLEDCKVALSIRDRISTIGIDTNYS

SEQ ID NO: 2498175 - protein, 26 aa, Entamoeba dispar
NLEEVYLNLISFNGFFDFKNIKLPPS

SEQ ID NO: 2498176 - protein, 28 aa, Entamoeba dispar
NLEKFKSFCDFFKRRGHTQLIEEFSYLI

SEQ ID NO: 2498177 - protein, 18 aa, Entamoeba dispar
NLEKSRYGNISFRTWHKR

SEQ ID NO: 2498178 - protein, 17 aa, Entamoeba dispar
NLELLVVDIIYNLVKRP

SEQ ID NO: 2498179 - protein, 21 aa, Entamoeba dispar
NLETWRQLWRVVERSQVVLMI

SEQ ID NO: 2498180 - protein, 17 aa, Entamoeba dispar
NLEVILLRRFVSFLQQR

SEQ ID NO: 2498181 - protein, 17 aa, Entamoeba dispar
NLFCGCSASSVVAVTLS

SEQ ID NO: 2498182 - protein, 21 aa, Entamoeba dispar
NLFCLRVMTGCIILNDNISEL

SEQ ID NO: 2498183 - protein, 23 aa, Entamoeba dispar
NLFDCLPLSALIDQRYFCVHGGL

SEQ ID NO: 2498184 - protein, 25 aa, Entamoeba dispar
NLFFFPIHPSFPILNGITKLDLSNN

SEQ ID NO: 2498185 - protein, 18 aa, Entamoeba dispar
NLFIKSDEPYAFQIRFAG

SEQ ID NO: 2498186 - protein, 22 aa, Entamoeba dispar
NLFKDQPPRISITPKPTSNNPF

SEQ ID NO: 2498187 - protein, 17 aa, Entamoeba dispar
NLFKIIILGDSGVGKTS

SEQ ID NO: 2498188 - protein, 20 aa, Entamoeba dispar
NLFNRPPIIIKQNIQNKLVE

SEQ ID NO: 2498189 - protein, 17 aa, Entamoeba dispar
NLFRVFIRGPTGANEIP

SEQ ID NO: 2498190 - protein, 29 aa, Entamoeba dispar
NLFYYECIYKYGSLYIWNAFVSTFNVMPF

SEQ ID NO: 2498191 - protein, 22 aa, Entamoeba dispar
NLGLLKFSNPFSSRLNQNTTTN

SEQ ID NO: 2498192 - protein, 19 aa, Entamoeba dispar
NLGQITFKHFIILFNQDKT

SEQ ID NO: 2498193 - protein, 25 aa, Entamoeba dispar
NLGTFRIIICTSVGGIKRYLQSVHC

SEQ ID NO: 2498194 - protein, 20 aa, Entamoeba dispar
NLGYCCFRECYSLTSINIPA

SEQ ID NO: 2498195 - protein, 18 aa, Entamoeba dispar
NLHCLLLHNYPMFEKELK

SEQ ID NO: 2498196 - protein, 24 aa, Entamoeba dispar
NLHIPIGCLYSPLLPKPLIADRAP

SEQ ID NO: 2498197 - protein, 18 aa, Entamoeba dispar
NLHKRLPPNFKEKKDFIE

SEQ ID NO: 2498198 - protein, 19 aa, Entamoeba dispar
NLHQLVGTFAKLYCICFEV

SEQ ID NO: 2498199 - protein, 17 aa, Entamoeba dispar
NLHRCAYHLKDNLVVVG

SEQ ID NO: 2498200 - protein, 17 aa, Entamoeba dispar
NLIAMAFPATGFSQQWR

SEQ ID NO: 2498201 - protein, 17 aa, Entamoeba dispar
NLIAMGIPTTGITKQWR

SEQ ID NO: 2498202 - protein, 27 aa, Entamoeba dispar
NLIFKCHQMKASSLYFVLDDIGNENLI

SEQ ID NO: 2498203 - protein, 26 aa, Entamoeba dispar
NLIKEIKRVYPFASIIVLGNKLDLAY

SEQ ID NO: 2498204 - protein, 22 aa, Entamoeba dispar
NLIKISKYLTGRVDLKEMGIKA

SEQ ID NO: 2498205 - protein, 17 aa, Entamoeba dispar
NLIKPTNSCKWCQESLL

SEQ ID NO: 2498206 - protein, 19 aa, Entamoeba dispar
NLIKTCNLIYKFDEISPQT

SEQ ID NO: 2498207 - protein, 25 aa, Entamoeba dispar
NLIRKYESICLFGGKDDSFIMKLNE

SEQ ID NO: 2498208 - protein, 25 aa, Entamoeba dispar
NLISISPFWHWNFALDLHEVSISRF

SEQ ID NO: 2498209 - protein, 25 aa, Entamoeba dispar
NLISLTRLKGYRYALDSTFKYLCQF

SEQ ID NO: 2498210 - protein, 30 aa, Entamoeba dispar
NLISNCQKFNCNFIKQFQCDIIAIENFCLS

SEQ ID NO: 2498211 - protein, 26 aa, Entamoeba dispar
NLITQRSSVIFSFTLTEIVYLVELQI

SEQ ID NO: 2498212 - protein, 20 aa, Entamoeba dispar
NLIYKKAKEFSLTKEKTPKQ

SEQ ID NO: 2498213 - protein, 25 aa, Entamoeba dispar
NLKEAKYRVTYKVSEHGDYTIHCLL

SEQ ID NO: 2498214 - protein, 24 aa, Entamoeba dispar
NLKGETPLHISVKMGNIEFVDFLL

SEQ ID NO: 2498215 - protein, 24 aa, Entamoeba dispar
NLKKFDFLRSLSFDKCKVDALNLP

SEQ ID NO: 2498216 - protein, 23 aa, Entamoeba dispar
NLKLQLYRPIFIDLIPLIENEIN

SEQ ID NO: 2498217 - protein, 22 aa, Entamoeba dispar
NLKNCIKKLLELAVPSPSNLFD

SEQ ID NO: 2498218 - protein, 24 aa, Entamoeba dispar
NLKNCKVELNGRYRHLMLFNNSNK

SEQ ID NO: 2498219 - protein, 20 aa, Entamoeba dispar
NLKNSVAIRESWIKEDPKRA

SEQ ID NO: 2498220 - protein, 23 aa, Entamoeba dispar
NLKPLHRMMQPISISSHIGSTND

SEQ ID NO: 2498221 - protein, 22 aa, Entamoeba dispar
NLKQKRRDGCLTLQESKSRRKV

SEQ ID NO: 2498222 - protein, 19 aa, Entamoeba dispar
NLKSLYLPFNELVELCLPL

SEQ ID NO: 2498223 - protein, 24 aa, Entamoeba dispar
NLLADIRSGITLRSAADRKLDTAA

SEQ ID NO: 2498224 - protein, 18 aa, Entamoeba dispar
NLLADLGLAYKSGKMLFL

SEQ ID NO: 2498225 - protein, 20 aa, Entamoeba dispar
NLLDISVVYIVFDISNIDSY

SEQ ID NO: 2498226 - protein, 20 aa, Entamoeba dispar
NLLDLIIEFCFNKKKINAGV

SEQ ID NO: 2498227 - protein, 20 aa, Entamoeba dispar
NLLEPLKWSKSLYYQCILNG

SEQ ID NO: 2498228 - protein, 25 aa, Entamoeba dispar
NLLIDFCSEHGFFFNSIYSKKSPKT

SEQ ID NO: 2498229 - protein, 17 aa, Entamoeba dispar
NLLKYGSMTKHWKEFSF

SEQ ID NO: 2498230 - protein, 33 aa, Entamoeba dispar
NLLNKRLFETMPYCFSESGSIREPFYNIGKDFH

SEQ ID NO: 2498231 - protein, 22 aa, Entamoeba dispar
NLLPIKLLHLFTTPFYLTPTTY

SEQ ID NO: 2498232 - protein, 27 aa, Entamoeba dispar
NLLPIKYFGFDFHKICANKKYQNIEII

SEQ ID NO: 2498233 - protein, 17 aa, Entamoeba dispar
NLLSLLNKFGFKQQKTI

SEQ ID NO: 2498234 - protein, 17 aa, Entamoeba dispar
NLLSLSLQQIMKFSSAF

SEQ ID NO: 2498235 - protein, 25 aa, Entamoeba dispar
NLLTIPLWTKYYLRYSFPKIAELNL

SEQ ID NO: 2498236 - protein, 17 aa, Entamoeba dispar
NLMKPKDIKGHVTVSTW

SEQ ID NO: 2498237 - protein, 17 aa, Entamoeba dispar
NLMLLIITESGCSFGSF

SEQ ID NO: 2498238 - protein, 24 aa, Entamoeba dispar
NLMPCSSASAFAFYEIVLNCDDKK

SEQ ID NO: 2498239 - protein, 20 aa, Entamoeba dispar
NLMRKYRVAIREGKSKIFAR

SEQ ID NO: 2498240 - protein, 25 aa, Entamoeba dispar
NLNELRGGFDIGLTICKLELVKSFY

SEQ ID NO: 2498241 - protein, 18 aa, Entamoeba dispar
NLNEVICLISNFNQKQQL

SEQ ID NO: 2498242 - protein, 20 aa, Entamoeba dispar
NLNFALNMESRIALVGRNGC

SEQ ID NO: 2498243 - protein, 20 aa, Entamoeba dispar
NLNIIFSYLHYFREINNKIN

SEQ ID NO: 2498244 - protein, 17 aa, Entamoeba dispar
NLNKIIIDNNVMKNNIA

SEQ ID NO: 2498245 - protein, 23 aa, Entamoeba dispar
NLNKRLNAVLKILQSLEVIEMKN

SEQ ID NO: 2498246 - protein, 23 aa, Entamoeba dispar
NLNNCQRCLFNIEKQNILIEVLK

SEQ ID NO: 2498247 - protein, 25 aa, Entamoeba dispar
NLNNKKCYYHIMSIGITYREIENIK

SEQ ID NO: 2498248 - protein, 19 aa, Entamoeba dispar
NLNPLLFHEVIKQSSSETK

SEQ ID NO: 2498249 - protein, 25 aa, Entamoeba dispar
NLNQYPNTACCFIKKDVLIMTDSKR

SEQ ID NO: 2498250 - protein, 18 aa, Entamoeba dispar
NLNREIHFTEFIASEPQI

SEQ ID NO: 2498251 - protein, 19 aa, Entamoeba dispar
NLNTRPSLTTTFTPKSINN

SEQ ID NO: 2498252 - protein, 22 aa, Entamoeba dispar
NLPHLSSTVKYVMTFAETTRGA

SEQ ID NO: 2498253 - protein, 31 aa, Entamoeba dispar
NLPKLSNIAELSFRGSSPLLSIAPSVDLPDI

SEQ ID NO: 2498254 - protein, 28 aa, Entamoeba dispar
NLPKRSMVGIFFPNRAEWIIISQALHRI

SEQ ID NO: 2498255 - protein, 22 aa, Entamoeba dispar
NLPLTITKLGEWCFDGCTSLIS

SEQ ID NO: 2498256 - protein, 22 aa, Entamoeba dispar
NLPLTVCYLSINACYCLSSIAG

SEQ ID NO: 2498257 - protein, 22 aa, Entamoeba dispar
NLPLWSSFPSHIELLFKSICSS

SEQ ID NO: 2498258 - protein, 23 aa, Entamoeba dispar
NLPNELIPIFDFIKSKIIDQYGN

SEQ ID NO: 2498259 - protein, 20 aa, Entamoeba dispar
NLPNKRLRDVSLRVKYMKAK

SEQ ID NO: 2498260 - protein, 21 aa, Entamoeba dispar
NLPRRRDLPPITEVLAAKPIE

SEQ ID NO: 2498261 - protein, 21 aa, Entamoeba dispar
NLQFCVLPNFMKIYRDQLFNE

SEQ ID NO: 2498262 - protein, 19 aa, Entamoeba dispar
NLQRLRSCCDKAYSTYQLL

SEQ ID NO: 2498263 - protein, 25 aa, Entamoeba dispar
NLQSCLKTGFPGLIECEKIHNMLLR

SEQ ID NO: 2498264 - protein, 32 aa, Entamoeba dispar
NLQSVCPLLNIYSCYFTYCYSFMKPAELLFTM

SEQ ID NO: 2498265 - protein, 18 aa, Entamoeba dispar
NLQTYPAVDEYINTVLTS

SEQ ID NO: 2498266 - protein, 25 aa, Entamoeba dispar
NLRCVRGDIELVIAFFKKFTEDGSQ

SEQ ID NO: 2498267 - protein, 18 aa, Entamoeba dispar
NLRFPSTLYNSLNSLMIH

SEQ ID NO: 2498268 - protein, 18 aa, Entamoeba dispar
NLRKMAFEFEKNIVNKGD

SEQ ID NO: 2498269 - protein, 23 aa, Entamoeba dispar
NLRNHINEAFSFGETQHKIENQR

SEQ ID NO: 2498270 - protein, 24 aa, Entamoeba dispar
NLRQLHVLGEIFAENGFLVRSDAR

SEQ ID NO: 2498271 - protein, 30 aa, Entamoeba dispar
NLRSRLNQFAIKYKYLYLTNEETILKITMS

SEQ ID NO: 2498272 - protein, 25 aa, Entamoeba dispar
NLSKRIRLLLMNIIQMMESGWTVSP

SEQ ID NO: 2498273 - protein, 32 aa, Entamoeba dispar
NLSKRSFCIKFIPIIFQFKFKTGMNTLFRSQF

SEQ ID NO: 2498274 - protein, 18 aa, Entamoeba dispar
NLSNAFTALSYNTSFTQI

SEQ ID NO: 2498275 - protein, 17 aa, Entamoeba dispar
NLSRYIIMKTFEKFDQN

SEQ ID NO: 2498276 - protein, 23 aa, Entamoeba dispar
NLSSFFKELFVFAKQINNQINSS

SEQ ID NO: 2498277 - protein, 25 aa, Entamoeba dispar
NLSSLCACGIHCVINQNVDYNTISE

SEQ ID NO: 2498278 - protein, 19 aa, Entamoeba dispar
NLSVCWTPTMFSVNNDELS

SEQ ID NO: 2498279 - protein, 17 aa, Entamoeba dispar
NLSVDYLGVIPYIVEAL

SEQ ID NO: 2498280 - protein, 18 aa, Entamoeba dispar
NLTFKRVTVLSTQNKTDK

SEQ ID NO: 2498281 - protein, 18 aa, Entamoeba dispar
NLTIKICSILSQETEMTN

SEQ ID NO: 2498282 - protein, 22 aa, Entamoeba dispar
NLTLILGLLWTLILKYQIAQNK

SEQ ID NO: 2498283 - protein, 17 aa, Entamoeba dispar
NLTLSYNECMKKNEEIM

SEQ ID NO: 2498284 - protein, 18 aa, Entamoeba dispar
NLTMLFKIYCIDKTNIIS

SEQ ID NO: 2498285 - protein, 23 aa, Entamoeba dispar
NLTPTLLRLSIHIPQIKMICAVG

SEQ ID NO: 2498286 - protein, 25 aa, Entamoeba dispar
NLTRLIFPPSLKKIGAGCFNNVSSL

SEQ ID NO: 2498287 - protein, 22 aa, Entamoeba dispar
NLTSLNGFVYFDFIPIKMEPIF

SEQ ID NO: 2498288 - protein, 25 aa, Entamoeba dispar
NLTTFPIQICNFSKLQALIISNNNL

SEQ ID NO: 2498289 - protein, 21 aa, Entamoeba dispar
NLVFEGCPLLGKTTLPYSLTT

SEQ ID NO: 2498290 - protein, 18 aa, Entamoeba dispar
NLVSCKMYNEVVFHSILN

SEQ ID NO: 2498291 - protein, 23 aa, Entamoeba dispar
NLVSVRCPCGRSIHNDRNGPAEI

SEQ ID NO: 2498292 - protein, 24 aa, Entamoeba dispar
NLVSYTEVFVRLGYTTPQIMSLLT

SEQ ID NO: 2498293 - protein, 21 aa, Entamoeba dispar
NLYDFITTIHLDFSNYDTTSD

SEQ ID NO: 2498294 - protein, 21 aa, Entamoeba dispar
NLYDTKWIFKREKGMKLWADT

SEQ ID NO: 2498295 - protein, 24 aa, Entamoeba dispar
NLYETVPFDIGFEVSGKRLDTFIK

SEQ ID NO: 2498296 - protein, 19 aa, Entamoeba dispar
NLYVPKLTTLVTHPTATYF

SEQ ID NO: 2498297 - protein, 18 aa, Entamoeba dispar
NLYWENILYLFSIIPQEQ

SEQ ID NO: 2498298 - protein, 17 aa, Entamoeba dispar
NMACTYYLKALVPSTSY

SEQ ID NO: 2498299 - protein, 21 aa, Entamoeba dispar
NMAHLIFSVLVRRSIDLSEQF

SEQ ID NO: 2498300 - protein, 27 aa, Entamoeba dispar
NMELAEIIFKIIWRKYTPSTIENILED

SEQ ID NO: 2498301 - protein, 19 aa, Entamoeba dispar
NMEMMKIYFADPLENEPKV

SEQ ID NO: 2498302 - protein, 24 aa, Entamoeba dispar
NMGLRGHGGIAIRPVPQPMSRGQV

SEQ ID NO: 2498303 - protein, 25 aa, Entamoeba dispar
NMIIGNGKLLDWCIDNNIEYVDRQA

SEQ ID NO: 2498304 - protein, 24 aa, Entamoeba dispar
NMIPYPRLHFFSSSIAPVSSALSM

SEQ ID NO: 2498305 - protein, 26 aa, Entamoeba dispar
NMISVIPKYCFKGCTSLQRIQLPLGI

SEQ ID NO: 2498306 - protein, 26 aa, Entamoeba dispar
NMKETCKVMHFFVWNAVTSPQNVYFE

SEQ ID NO: 2498307 - protein, 18 aa, Entamoeba dispar
NMKHCNDELIGVFNSLVL

SEQ ID NO: 2498308 - protein, 24 aa, Entamoeba dispar
NMKLHYKDKCIILYGRNWTIRPCD

SEQ ID NO: 2498309 - protein, 25 aa, Entamoeba dispar
NMKRLHIIDSIALCKFFATMESKKG

SEQ ID NO: 2498310 - protein, 25 aa, Entamoeba dispar
NMLFDEAWFPYAHFHPFYASYHSMN

SEQ ID NO: 2498311 - protein, 23 aa, Entamoeba dispar
NMLPCGLYKFPVRNTTDLEMIMM

SEQ ID NO: 2498312 - protein, 24 aa, Entamoeba dispar
NMLRIKRKVFVDILFCDMDPQSAF

SEQ ID NO: 2498313 - protein, 25 aa, Entamoeba dispar
NMMNKNCWDQVLLEKIVNEFGIVFF

SEQ ID NO: 2498314 - protein, 25 aa, Entamoeba dispar
NMNDFPSNIVYLFLFNDIIVETKVI

SEQ ID NO: 2498315 - protein, 28 aa, Entamoeba dispar
NMNFFPKEFCKMSQMKVLIMNNNKIKVI

SEQ ID NO: 2498316 - protein, 20 aa, Entamoeba dispar
NMNKASIYQFSFIRMTSGYS

SEQ ID NO: 2498317 - protein, 18 aa, Entamoeba dispar
NMNKKLFIHPTFKANTIT

SEQ ID NO: 2498318 - protein, 20 aa, Entamoeba dispar
NMNQQWKELVFLYVQVDQVK

SEQ ID NO: 2498319 - protein, 34 aa, Entamoeba dispar
NMPFPPFLNSSWMKKGFGFEDFMLKKLINAERMT

SEQ ID NO: 2498320 - protein, 22 aa, Entamoeba dispar
NMPLPRKWNHIVLVGKGKKITL

SEQ ID NO: 2498321 - protein, 17 aa, Entamoeba dispar
NMPMGGFIPDNMPMGDD

SEQ ID NO: 2498322 - protein, 18 aa, Entamoeba dispar
NMRFGFAGEVLPFEVDLA

SEQ ID NO: 2498323 - protein, 20 aa, Entamoeba dispar
NMRNYRILYRSSKDGLSARS

SEQ ID NO: 2498324 - protein, 24 aa, Entamoeba dispar
NMSLKYLINYDDLPSFVFKSKQTI

SEQ ID NO: 2498325 - protein, 27 aa, Entamoeba dispar
NMTVPLDFPSCFDFLQFTNYTLKSIVS

SEQ ID NO: 2498326 - protein, 17 aa, Entamoeba dispar
NMVIMSIADGCGMGSRP

SEQ ID NO: 2498327 - protein, 18 aa, Entamoeba dispar
NMVTLWYRPPELLLGETR

SEQ ID NO: 2498328 - protein, 21 aa, Entamoeba dispar
NNAFEQFIFLYLRHPYDIEEI

SEQ ID NO: 2498329 - protein, 25 aa, Entamoeba dispar
NNAICTLFFIHYLFPFFKNYSDIPR

SEQ ID NO: 2498330 - protein, 26 aa, Entamoeba dispar
NNALMSRCNLVILKRLENESINKIIK

SEQ ID NO: 2498331 - protein, 23 aa, Entamoeba dispar
NNCFCKCSSLKTINIPSSISKIG

SEQ ID NO: 2498332 - protein, 20 aa, Entamoeba dispar
NNCFYGCSSLESINIPSSII

SEQ ID NO: 2498333 - protein, 22 aa, Entamoeba dispar
NNCGGSLPSFLVNSQAKNVLPK

SEQ ID NO: 2498334 - protein, 23 aa, Entamoeba dispar
NNCIGCGSCALSCRDNSTTAIVK

SEQ ID NO: 2498335 - protein, 19 aa, Entamoeba dispar
NNCKSLIKINIEYVTYIGD

SEQ ID NO: 2498336 - protein, 20 aa, Entamoeba dispar
NNCMAKLYINYDCDEYCTDF

SEQ ID NO: 2498337 - protein, 17 aa, Entamoeba dispar
NNCRREEMGSIKEENKT

SEQ ID NO: 2498338 - protein, 21 aa, Entamoeba dispar
NNCYLRYNRDPVVKTIHYLEK

SEQ ID NO: 2498339 - protein, 20 aa, Entamoeba dispar
NNDFPSGKLLLFVEEYACQV

SEQ ID NO: 2498340 - protein, 25 aa, Entamoeba dispar
NNDKESRRGISITIKQYCSTLVLYP

SEQ ID NO: 2498341 - protein, 24 aa, Entamoeba dispar
NNDKVIKLLACIIEDSCQLLQDNR

SEQ ID NO: 2498342 - protein, 18 aa, Entamoeba dispar
NNDSFKCHICKKICDPMM

SEQ ID NO: 2498343 - protein, 27 aa, Entamoeba dispar
NNECSPAFWKFMNLIGTKKQLKGWQNY

SEQ ID NO: 2498344 - protein, 26 aa, Entamoeba dispar
NNEIHGKWSVCWDLINKPDINKPLSE

SEQ ID NO: 2498345 - protein, 17 aa, Entamoeba dispar
NNEKFYLRYKFMERDGI

SEQ ID NO: 2498346 - protein, 27 aa, Entamoeba dispar
NNELPLSTKGSICIQYTIISSSSSAKT

SEQ ID NO: 2498347 - protein, 21 aa, Entamoeba dispar
NNELRGLISRMLVYDENRRIT

SEQ ID NO: 2498348 - protein, 24 aa, Entamoeba dispar
NNENRGCILFCEVALGKQWETPKD

SEQ ID NO: 2498349 - protein, 23 aa, Entamoeba dispar
NNESLKVIIFITRQLGGITPWYL

SEQ ID NO: 2498350 - protein, 17 aa, Entamoeba dispar
NNEVAHCYGCNKLCASM

SEQ ID NO: 2498351 - protein, 24 aa, Entamoeba dispar
NNEWKNKLICFGPKRCGPNILINL

SEQ ID NO: 2498352 - protein, 21 aa, Entamoeba dispar
NNFHKGMVWDYSFNIDGTLLA

SEQ ID NO: 2498353 - protein, 17 aa, Entamoeba dispar
NNFHYVIDEKVPITSYF

SEQ ID NO: 2498354 - protein, 17 aa, Entamoeba dispar
NNFLFRSILNFFTELSM

SEQ ID NO: 2498355 - protein, 17 aa, Entamoeba dispar
NNFMLERIECQKGIEEW

SEQ ID NO: 2498356 - protein, 21 aa, Entamoeba dispar
NNFTFVLPMVYSLSFFIKKNI

SEQ ID NO: 2498357 - protein, 25 aa, Entamoeba dispar
NNGDYRWAVTILNYLIFSNPKNEDA

SEQ ID NO: 2498358 - protein, 24 aa, Entamoeba dispar
NNGKIGGCIRIRAKSQGVALSLGD

SEQ ID NO: 2498359 - protein, 23 aa, Entamoeba dispar
NNGKWWKCNDKVVVEYNEKRILE

SEQ ID NO: 2498360 - protein, 19 aa, Entamoeba dispar
NNGMGLTFNRHVLRQLLES

SEQ ID NO: 2498361 - protein, 25 aa, Entamoeba dispar
NNGQYYWKFGKYAVKSIRDLTVGID

SEQ ID NO: 2498362 - protein, 17 aa, Entamoeba dispar
NNHYSLMIADFMEDDDE

SEQ ID NO: 2498363 - protein, 24 aa, Entamoeba dispar
NNIDELWTLLNFINPENFPSLENF

SEQ ID NO: 2498364 - protein, 18 aa, Entamoeba dispar
NNIFKSSRVKSVHQFINQ

SEQ ID NO: 2498365 - protein, 19 aa, Entamoeba dispar
NNIICIIEGNGITYYQYEE

SEQ ID NO: 2498366 - protein, 26 aa, Entamoeba dispar
NNIIPPRKTLGVGMGGMGMPQVTLAD

SEQ ID NO: 2498367 - protein, 21 aa, Entamoeba dispar
NNIKNVLDYIYIVTVDNTIIL

SEQ ID NO: 2498368 - protein, 17 aa, Entamoeba dispar
NNILEFIRWEYKRKEKE

SEQ ID NO: 2498369 - protein, 28 aa, Entamoeba dispar
NNINMGFGDKGKWILVSEKKEVHNLNKL

SEQ ID NO: 2498370 - protein, 24 aa, Entamoeba dispar
NNINWLLRICKYIEKESLKTEGNL

SEQ ID NO: 2498371 - protein, 17 aa, Entamoeba dispar
NNIPYLDSVIINTNVQP

SEQ ID NO: 2498372 - protein, 25 aa, Entamoeba dispar
NNIQFKEVVDRMAGATSNVQYAHIS

SEQ ID NO: 2498373 - protein, 25 aa, Entamoeba dispar
NNIQFKEVVDRMAGATSNVQYAHVS

SEQ ID NO: 2498374 - protein, 25 aa, Entamoeba dispar
NNIQYRSPNSLVLLPVHDSTATIIT

SEQ ID NO: 2498375 - protein, 23 aa, Entamoeba dispar
NNISICYPTFVIIQIEKGEMSFR

SEQ ID NO: 2498376 - protein, 17 aa, Entamoeba dispar
NNITKIGPFCFKDCINL

SEQ ID NO: 2498377 - protein, 22 aa, Entamoeba dispar
NNITKWKRLMNMKKQIMETIIS

SEQ ID NO: 2498378 - protein, 24 aa, Entamoeba dispar
NNIYSALIKQIWKEYELNTIDLTK

SEQ ID NO: 2498379 - protein, 23 aa, Entamoeba dispar
NNIYSMRTFTKCGGFTGVYEAQC

SEQ ID NO: 2498380 - protein, 17 aa, Entamoeba dispar
NNKECIISLDGFKENTT

SEQ ID NO: 2498381 - protein, 22 aa, Entamoeba dispar
NNKEIKCSFEINLNDSSDETNQ

SEQ ID NO: 2498382 - protein, 23 aa, Entamoeba dispar
NNKEWCGLAVKNGLQLVISEIIK

SEQ ID NO: 2498383 - protein, 27 aa, Entamoeba dispar
NNKGVPFFWIRALSAVSLFLSYNTVEE

SEQ ID NO: 2498384 - protein, 19 aa, Entamoeba dispar
NNKIHSFSLFGHKLYDNNI

SEQ ID NO: 2498385 - protein, 20 aa, Entamoeba dispar
NNKIRRIHKNIGFMTNLVEL

SEQ ID NO: 2498386 - protein, 24 aa, Entamoeba dispar
NNKNCLLEALTIAGSLLKKIGGKI

SEQ ID NO: 2498387 - protein, 19 aa, Entamoeba dispar
NNKTKILYRFAKLNENKSQ

SEQ ID NO: 2498388 - protein, 30 aa, Entamoeba dispar
NNKTLPMPLLMEIIWNCVMSNNLLNNQITI

SEQ ID NO: 2498389 - protein, 22 aa, Entamoeba dispar
NNKWKCRFCGTENECEKILPEE

SEQ ID NO: 2498390 - protein, 26 aa, Entamoeba dispar
NNLEMKIIQWEGGKSLYSPTSHYAQL

SEQ ID NO: 2498391 - protein, 22 aa, Entamoeba dispar
NNLENLCMKYAMGITSTSMTAA

SEQ ID NO: 2498392 - protein, 23 aa, Entamoeba dispar
NNLERFPAIKIPKTSEEVTEEKK

SEQ ID NO: 2498393 - protein, 25 aa, Entamoeba dispar
NNLERIMGFYYFYMSHGIKNHYYTH

SEQ ID NO: 2498394 - protein, 17 aa, Entamoeba dispar
NNLFFIIHKSILYHPFI

SEQ ID NO: 2498395 - protein, 23 aa, Entamoeba dispar
NNLGELWTLLNYIEPKTFSSLEE

SEQ ID NO: 2498396 - protein, 22 aa, Entamoeba dispar
NNLIKLSFCGVFVESVAKTMGL

SEQ ID NO: 2498397 - protein, 23 aa, Entamoeba dispar
NNLKEFLKEVSINIRESGYDMIY

SEQ ID NO: 2498398 - protein, 23 aa, Entamoeba dispar
NNLKQRAMLLLPLVGNEIERISV

SEQ ID NO: 2498399 - protein, 17 aa, Entamoeba dispar
NNLKRINGMSIRKRDVN

SEQ ID NO: 2498400 - protein, 17 aa, Entamoeba dispar
NNLKSLPPEIGMLDKLQ

SEQ ID NO: 2498401 - protein, 21 aa, Entamoeba dispar
NNLYIKLNIPIHTSTNGISAK

SEQ ID NO: 2498402 - protein, 19 aa, Entamoeba dispar
NNMLDVCRQLFNSTSEDAE

SEQ ID NO: 2498403 - protein, 25 aa, Entamoeba dispar
NNMNLRFPQTLTIINIIGCQSVICT

SEQ ID NO: 2498404 - protein, 19 aa, Entamoeba dispar
NNMSLTCFLFLMKTSFSVA

SEQ ID NO: 2498405 - protein, 23 aa, Entamoeba dispar
NNNLFIVYLMRAFAHGYYRKPTF

SEQ ID NO: 2498406 - protein, 22 aa, Entamoeba dispar
NNNLRRLTCDSINKITVSSPNL

SEQ ID NO: 2498407 - protein, 23 aa, Entamoeba dispar
NNNMIINEIINRINILEEKGNEF

SEQ ID NO: 2498408 - protein, 22 aa, Entamoeba dispar
NNNSSRFGKFIEIQFSNGGKIV

SEQ ID NO: 2498409 - protein, 18 aa, Entamoeba dispar
NNPCALPYPIYNAAMLPP

SEQ ID NO: 2498410 - protein, 25 aa, Entamoeba dispar
NNPNWLIEFLIGSSLRKGSQEHAIE

SEQ ID NO: 2498411 - protein, 19 aa, Entamoeba dispar
NNQCLYDKAILNLIIGDGE

SEQ ID NO: 2498412 - protein, 21 aa, Entamoeba dispar
NNQIEIIKWIRGIAPEIIKKT

SEQ ID NO: 2498413 - protein, 25 aa, Entamoeba dispar
NNQLSYWPLDMVLRDKYKFSEHDSK

SEQ ID NO: 2498414 - protein, 28 aa, Entamoeba dispar
NNQVISYIPWWTIVEMANNIFGDDGWSN

SEQ ID NO: 2498415 - protein, 19 aa, Entamoeba dispar
NNRESLSKVYSWYGEVNEK

SEQ ID NO: 2498416 - protein, 17 aa, Entamoeba dispar
NNRIITIICNYEGKRIC

SEQ ID NO: 2498417 - protein, 18 aa, Entamoeba dispar
NNSCSLEALNSSNLNDRA

SEQ ID NO: 2498418 - protein, 25 aa, Entamoeba dispar
NNSMLKKRCNAVIYLLIRGGLKNEL

SEQ ID NO: 2498419 - protein, 22 aa, Entamoeba dispar
NNSQPTYGRPGTYKDNVVEQKQ

SEQ ID NO: 2498420 - protein, 29 aa, Entamoeba dispar
NNSWTVDALKMYLNEIMYNIGTSKVDAIL

SEQ ID NO: 2498421 - protein, 29 aa, Entamoeba dispar
NNSWTVDALKMYLNEIMYTIGASKVDAIL

SEQ ID NO: 2498422 - protein, 30 aa, Entamoeba dispar
NNSWTVDALKMYLNEVMYNIGVGKVDAILF

SEQ ID NO: 2498423 - protein, 30 aa, Entamoeba dispar
NNSWTVDALKMYLNEVMYNIGVGKVDAITF

SEQ ID NO: 2498424 - protein, 25 aa, Entamoeba dispar
NNTCLKIGDELSFVFHILNKSRHDL

SEQ ID NO: 2498425 - protein, 24 aa, Entamoeba dispar
NNTFPYFFRMELICRRNVGIISTL

SEQ ID NO: 2498426 - protein, 18 aa, Entamoeba dispar
NNTFSRFHRPLFIEIHTI

SEQ ID NO: 2498427 - protein, 22 aa, Entamoeba dispar
NNTRLSVVKLMRDNYSFMNNIK

SEQ ID NO: 2498428 - protein, 23 aa, Entamoeba dispar
NNTTEKLLGFALKDYIATIKQIH

SEQ ID NO: 2498429 - protein, 19 aa, Entamoeba dispar
NNVIWRDDNGFNFITFSSN

SEQ ID NO: 2498430 - protein, 24 aa, Entamoeba dispar
NNVKNKLSISWICGAVKGAKLYKI

SEQ ID NO: 2498431 - protein, 28 aa, Entamoeba dispar
NNVLLSCITLPISEGVNFVKKEESFLTG

SEQ ID NO: 2498432 - protein, 19 aa, Entamoeba dispar
NNVPSCSTQLFVNCSGEDT

SEQ ID NO: 2498433 - protein, 21 aa, Entamoeba dispar
NNVSCLFKRVIDATISVYNKN

SEQ ID NO: 2498434 - protein, 17 aa, Entamoeba dispar
NNWPKADVIQWCDPYIL

SEQ ID NO: 2498435 - protein, 22 aa, Entamoeba dispar
NNWVKACLIRKYIPKHSRVLDF

SEQ ID NO: 2498436 - protein, 24 aa, Entamoeba dispar
NNYIKLASCLLKLKDYAGAVEAAK

SEQ ID NO: 2498437 - protein, 33 aa, Entamoeba dispar
NNYISTQILICYKEQWYLISFNQNILESLQREL

SEQ ID NO: 2498438 - protein, 22 aa, Entamoeba dispar
NNYKIKVSKEIKKKKKKKRNRR

SEQ ID NO: 2498439 - protein, 17 aa, Entamoeba dispar
NNYKPSKTHRVYTYPNQ

SEQ ID NO: 2498440 - protein, 27 aa, Entamoeba dispar
NNYKYRADFCLAATYALNGILATGIQQ

SEQ ID NO: 2498441 - protein, 23 aa, Entamoeba dispar
NNYQEIIQRIGLTNPFEELPSRD

SEQ ID NO: 2498442 - protein, 21 aa, Entamoeba dispar
NPAPLRLIALTQFNNMLVKIP

SEQ ID NO: 2498443 - protein, 21 aa, Entamoeba dispar
NPCIYCIYKDGLSKIIKEGIY

SEQ ID NO: 2498444 - protein, 17 aa, Entamoeba dispar
NPCTRILFINGTPGTGK

SEQ ID NO: 2498445 - protein, 17 aa, Entamoeba dispar
NPCTVQLELNRLIESSD

SEQ ID NO: 2498446 - protein, 19 aa, Entamoeba dispar
NPCVRCGKNIVGEIVEVDE

SEQ ID NO: 2498447 - protein, 19 aa, Entamoeba dispar
NPECGPIIEYMIRVYSINI

SEQ ID NO: 2498448 - protein, 22 aa, Entamoeba dispar
NPEGKWEFFNLFQVIENPSNIS

SEQ ID NO: 2498449 - protein, 21 aa, Entamoeba dispar
NPEGWLPKGIHSIGTEIHENQ

SEQ ID NO: 2498450 - protein, 17 aa, Entamoeba dispar
NPEIITGVIKRLIQENG

SEQ ID NO: 2498451 - protein, 24 aa, Entamoeba dispar
NPEKHLSNYLLFFGSGSEIKSLVT

SEQ ID NO: 2498452 - protein, 18 aa, Entamoeba dispar
NPELDEFIFLLSSKAGGC

SEQ ID NO: 2498453 - protein, 19 aa, Entamoeba dispar
NPELITIPNQWKLVQEYEK

SEQ ID NO: 2498454 - protein, 21 aa, Entamoeba dispar
NPEPYIIGIGFFINMISLVLE

SEQ ID NO: 2498455 - protein, 20 aa, Entamoeba dispar
NPFDLIPVRFDPKVEMNFNI

SEQ ID NO: 2498456 - protein, 29 aa, Entamoeba dispar
NPFIYSNRLIQCFGSFGWSGEGVKNLIPR

SEQ ID NO: 2498457 - protein, 17 aa, Entamoeba dispar
NPFKEWQTKMEASGCIN

SEQ ID NO: 2498458 - protein, 19 aa, Entamoeba dispar
NPFPDVMNFLDTFHGGHYK

SEQ ID NO: 2498459 - protein, 17 aa, Entamoeba dispar
NPGEPVGVLAGQSIGEP

SEQ ID NO: 2498460 - protein, 26 aa, Entamoeba dispar
NPHFLFRSGTSFDIIFIDSNLFRFES

SEQ ID NO: 2498461 - protein, 28 aa, Entamoeba dispar
NPHFVKLLCTCYGYFFADIFMLIPENSV

SEQ ID NO: 2498462 - protein, 25 aa, Entamoeba dispar
NPIEIKELYLSYLIGIIHGSLNSRG

SEQ ID NO: 2498463 - protein, 22 aa, Entamoeba dispar
NPIELKETIKLVFSNIPETELF

SEQ ID NO: 2498464 - protein, 29 aa, Entamoeba dispar
NPIHFLKQCRLLRRHGRLGKKVSLHLNEM

SEQ ID NO: 2498465 - protein, 33 aa, Entamoeba dispar
NPIKEYPLTMLLKKIEDISGYSIKYESFNDAYN

SEQ ID NO: 2498466 - protein, 22 aa, Entamoeba dispar
NPIKRIARLIALKIIKINPNEI

SEQ ID NO: 2498467 - protein, 17 aa, Entamoeba dispar
NPIKSFLLFKEVTTQFL

SEQ ID NO: 2498468 - protein, 24 aa, Entamoeba dispar
NPINRIEGYGAFTISNNGDIICGA

SEQ ID NO: 2498469 - protein, 32 aa, Entamoeba dispar
NPIPQLSFMFSRLVCLTNLLIDDIVSIPTVMK

SEQ ID NO: 2498470 - protein, 17 aa, Entamoeba dispar
NPISIKTKKLFPLIQTQ

SEQ ID NO: 2498471 - protein, 20 aa, Entamoeba dispar
NPIVLGSTCYSFLQVCPNRF

SEQ ID NO: 2498472 - protein, 22 aa, Entamoeba dispar
NPIVYPFIMEFMGVVGSSIEFR

SEQ ID NO: 2498473 - protein, 23 aa, Entamoeba dispar
NPIYRKGNCIRTIDIHPNSDKRF

SEQ ID NO: 2498474 - protein, 21 aa, Entamoeba dispar
NPKGFMKYCGQIQRIELPQSI

SEQ ID NO: 2498475 - protein, 19 aa, Entamoeba dispar
NPKKMKTILLKANSPEERA

SEQ ID NO: 2498476 - protein, 20 aa, Entamoeba dispar
NPKLSSLFREIKRLNVDPNS

SEQ ID NO: 2498477 - protein, 25 aa, Entamoeba dispar
NPKRVPFELYTKFYLENKPNKPAIF

SEQ ID NO: 2498478 - protein, 24 aa, Entamoeba dispar
NPKYVARRMIRFATEDIGLADTNA

SEQ ID NO: 2498479 - protein, 19 aa, Entamoeba dispar
NPLFRGNTLFSRIYSLYLT

SEQ ID NO: 2498480 - protein, 17 aa, Entamoeba dispar
NPLGMSRQDFKDFEKET

SEQ ID NO: 2498481 - protein, 22 aa, Entamoeba dispar
NPLLQFRLYQLLFKLLSEKKYP

SEQ ID NO: 2498482 - protein, 19 aa, Entamoeba dispar
NPLPILNYKCRAEVSNAET

SEQ ID NO: 2498483 - protein, 18 aa, Entamoeba dispar
NPLRIFKDLELVKEETRQ

SEQ ID NO: 2498484 - protein, 18 aa, Entamoeba dispar
NPLRLPSIHVKKPDDFFM

SEQ ID NO: 2498485 - protein, 17 aa, Entamoeba dispar
NPLVEFPIYITKCQGLK

SEQ ID NO: 2498486 - protein, 19 aa, Entamoeba dispar
NPLWCAYLQFFQNNNVLVH

SEQ ID NO: 2498487 - protein, 24 aa, Entamoeba dispar
NPLYALRILSRFITTTTMPAYSPH

SEQ ID NO: 2498488 - protein, 17 aa, Entamoeba dispar
NPLYIVAMPRSGSTFTH

SEQ ID NO: 2498489 - protein, 27 aa, Entamoeba dispar
NPLYWKRDITTIMSLLFQPSFNNKQII

SEQ ID NO: 2498490 - protein, 19 aa, Entamoeba dispar
NPMHLFGLFGSIGVQNHLF

SEQ ID NO: 2498491 - protein, 21 aa, Entamoeba dispar
NPNDFPFVVLVNKMDEDPSKR

SEQ ID NO: 2498492 - protein, 17 aa, Entamoeba dispar
NPNEIPSSLNFTSNSQL

SEQ ID NO: 2498493 - protein, 19 aa, Entamoeba dispar
NPNKWKKAFLDALSHSTYF

SEQ ID NO: 2498494 - protein, 19 aa, Entamoeba dispar
NPNLFDFYNPVFSTGSIVS

SEQ ID NO: 2498495 - protein, 19 aa, Entamoeba dispar
NPNLIGFCVDYLCDNFEKN

SEQ ID NO: 2498496 - protein, 26 aa, Entamoeba dispar
NPNRCCKACVFNNFISGHDCKIADAC

SEQ ID NO: 2498497 - protein, 18 aa, Entamoeba dispar
NPNSFYDKYFKGELDDEM

SEQ ID NO: 2498498 - protein, 22 aa, Entamoeba dispar
NPPESPIRYEVPFENLWGKESQ

SEQ ID NO: 2498499 - protein, 25 aa, Entamoeba dispar
NPPSIYPHKRFYVKIQDIITQIGEN

SEQ ID NO: 2498500 - protein, 17 aa, Entamoeba dispar
NPPSWAEIIKYYRGSDL

SEQ ID NO: 2498501 - protein, 25 aa, Entamoeba dispar
NPQEFKRIKECGGYTERGRVFGEYI

SEQ ID NO: 2498502 - protein, 19 aa, Entamoeba dispar
NPQFSMMFDQMISNPELLR

SEQ ID NO: 2498503 - protein, 20 aa, Entamoeba dispar
NPQLRRFLIETGDQVLVEAS

SEQ ID NO: 2498504 - protein, 18 aa, Entamoeba dispar
NPQVKFVLIHEANNLFNN

SEQ ID NO: 2498505 - protein, 34 aa, Entamoeba dispar
NPQWISVNLGIVFCIKCSAIHRSLGVAYSRVKST

SEQ ID NO: 2498506 - protein, 18 aa, Entamoeba dispar
NPRGIVIYINMNERDELK

SEQ ID NO: 2498507 - protein, 17 aa, Entamoeba dispar
NPRKEGGPHYDIVPGND

SEQ ID NO: 2498508 - protein, 24 aa, Entamoeba dispar
NPSKYCLTKTMELMRKYLMGTPKN

SEQ ID NO: 2498509 - protein, 24 aa, Entamoeba dispar
NPSLLFCYCDKLLKRDSSSFKINS

SEQ ID NO: 2498510 - protein, 18 aa, Entamoeba dispar
NPSNKRGYVTTCCIAIIQ

SEQ ID NO: 2498511 - protein, 20 aa, Entamoeba dispar
NPTLTWKDFCCEHKLNKQKR

SEQ ID NO: 2498512 - protein, 18 aa, Entamoeba dispar
NPTSRYVFQKPMNMNEDK

SEQ ID NO: 2498513 - protein, 19 aa, Entamoeba dispar
NPVHFGLLCQELVKLVNEN

SEQ ID NO: 2498514 - protein, 20 aa, Entamoeba dispar
NPVRGRACKHMICCDLKNVI

SEQ ID NO: 2498515 - protein, 17 aa, Entamoeba dispar
NPWIFWFESGKSSDRST

SEQ ID NO: 2498516 - protein, 20 aa, Entamoeba dispar
NPYLHCQRFIQCFGSHGWSG

SEQ ID NO: 2498517 - protein, 20 aa, Entamoeba dispar
NPYMPQQFYQPHSLQYQQQY

SEQ ID NO: 2498518 - protein, 19 aa, Entamoeba dispar
NPYVLRSMSLIHIFDTLCI

SEQ ID NO: 2498519 - protein, 22 aa, Entamoeba dispar
NPYWVCPNGLIIIERDNKNYQI

SEQ ID NO: 2498520 - protein, 29 aa, Entamoeba dispar
NQASAFVPFCFELKLVIIQQLICCNNLSI

SEQ ID NO: 2498521 - protein, 19 aa, Entamoeba dispar
NQCFERRKAAEFEQVTAGY

SEQ ID NO: 2498522 - protein, 23 aa, Entamoeba dispar
NQCIDLYELWFIKQEQVPQVILD

SEQ ID NO: 2498523 - protein, 23 aa, Entamoeba dispar
NQDVFPVIIHRNAVFNVFANYDF

SEQ ID NO: 2498524 - protein, 18 aa, Entamoeba dispar
NQEAIGIIHEIAKTMKDM

SEQ ID NO: 2498525 - protein, 24 aa, Entamoeba dispar
NQEKLELLISMGFNELQAKSTLLI

SEQ ID NO: 2498526 - protein, 18 aa, Entamoeba dispar
NQELPFKQITTMKNIFVD

SEQ ID NO: 2498527 - protein, 23 aa, Entamoeba dispar
NQELQKLLVFNGIFDVIFQAFAD

SEQ ID NO: 2498528 - protein, 22 aa, Entamoeba dispar
NQESGVIFAICSNLIYNINDKE

SEQ ID NO: 2498529 - protein, 21 aa, Entamoeba dispar
NQFELCLKLKILKDQNETLSF

SEQ ID NO: 2498530 - protein, 18 aa, Entamoeba dispar
NQFFLLRGNHESFSVSSR

SEQ ID NO: 2498531 - protein, 23 aa, Entamoeba dispar
NQFKCPKCLTDIFTEENQNSVLM

SEQ ID NO: 2498532 - protein, 22 aa, Entamoeba dispar
NQFKEMLSSTFIQTKKDLTSPQ

SEQ ID NO: 2498533 - protein, 23 aa, Entamoeba dispar
NQFVIKYKHLIKEIAESLKHDNN

SEQ ID NO: 2498534 - protein, 17 aa, Entamoeba dispar
NQFYPNRLNDFLNQCQC

SEQ ID NO: 2498535 - protein, 21 aa, Entamoeba dispar
NQGGSLGWVIRGQMCGAFQDV

SEQ ID NO: 2498536 - protein, 24 aa, Entamoeba dispar
NQGIGFLFHCLSPLFDEIEKKKIK

SEQ ID NO: 2498537 - protein, 25 aa, Entamoeba dispar
NQHATCCSVGKLLHLMVPVEHSFIS

SEQ ID NO: 2498538 - protein, 18 aa, Entamoeba dispar
NQHLCKLGYEPQQASDLA

SEQ ID NO: 2498539 - protein, 26 aa, Entamoeba dispar
NQHMKTLWGKEVWMKTSVLRDDGIVE

SEQ ID NO: 2498540 - protein, 27 aa, Entamoeba dispar
NQHSKFTFIWVKDLFTYLDKKPFSEED

SEQ ID NO: 2498541 - protein, 25 aa, Entamoeba dispar
NQHTFRTDVPFLFRDSFSRLKDLPI

SEQ ID NO: 2498542 - protein, 20 aa, Entamoeba dispar
NQIFKIVAGMLHLGNVEYSQ

SEQ ID NO: 2498543 - protein, 18 aa, Entamoeba dispar
NQIKKYFTIEGLNLINKT

SEQ ID NO: 2498544 - protein, 42 aa, Entamoeba dispar
NQIKLTIPISMWYPQFIEAMKCYARAIGFFRNEQEYYWANKS

SEQ ID NO: 2498545 - protein, 24 aa, Entamoeba dispar
NQIPELPEKFSLLTNLEILELSCN

SEQ ID NO: 2498546 - protein, 24 aa, Entamoeba dispar
NQIPLSIIIIFLLKQCNYSNELSE

SEQ ID NO: 2498547 - protein, 24 aa, Entamoeba dispar
NQIPNRRFTLWWSPTINRGSVYVG

SEQ ID NO: 2498548 - protein, 26 aa, Entamoeba dispar
NQKDVMGLTGWKIFESRKYKSEPKYS

SEQ ID NO: 2498549 - protein, 21 aa, Entamoeba dispar
NQKELLGDCLLQNQIQTSMQL

SEQ ID NO: 2498550 - protein, 24 aa, Entamoeba dispar
NQKKYMVTFPFPYMNGRLHLGHTF

SEQ ID NO: 2498551 - protein, 24 aa, Entamoeba dispar
NQKVMRQTVCLEFMENTLGKKIKI

SEQ ID NO: 2498552 - protein, 25 aa, Entamoeba dispar
NQKYQRPCWFWGVSKFGIEQSDISF

SEQ ID NO: 2498553 - protein, 17 aa, Entamoeba dispar
NQLDWQCVVSNPLSQAL

SEQ ID NO: 2498554 - protein, 24 aa, Entamoeba dispar
NQLFDFKVIYSLVIDKHNLKLSEF

SEQ ID NO: 2498555 - protein, 25 aa, Entamoeba dispar
NQLFLERFLLCLLPISFNKKPQVIQ

SEQ ID NO: 2498556 - protein, 28 aa, Entamoeba dispar
NQLGSDFFKKICSEHGILPDGSLSTNEF

SEQ ID NO: 2498557 - protein, 17 aa, Entamoeba dispar
NQLKCLWTKEQQKTTTI

SEQ ID NO: 2498558 - protein, 24 aa, Entamoeba dispar
NQLLGCFVPHHLCIDNAIHTFAGP

SEQ ID NO: 2498559 - protein, 23 aa, Entamoeba dispar
NQLLRATQKFGFPPIPNPILNIF

SEQ ID NO: 2498560 - protein, 24 aa, Entamoeba dispar
NQLLVLTGFLPILFNGKKFGIPLL

SEQ ID NO: 2498561 - protein, 22 aa, Entamoeba dispar
NQLPFLFPGVPITYIVNPSNDS

SEQ ID NO: 2498562 - protein, 17 aa, Entamoeba dispar
NQLRELALWNGTFREDR

SEQ ID NO: 2498563 - protein, 20 aa, Entamoeba dispar
NQLRKSMSLCTTQITSNTLE

SEQ ID NO: 2498564 - protein, 24 aa, Entamoeba dispar
NQLRVLSPLICFLTSLVNLNLSRN

SEQ ID NO: 2498565 - protein, 26 aa, Entamoeba dispar
NQLSLSYIEICKFLEYYQQKARIVLS

SEQ ID NO: 2498566 - protein, 20 aa, Entamoeba dispar
NQMFCGCIASIPAQFTTEKY

SEQ ID NO: 2498567 - protein, 22 aa, Entamoeba dispar
NQMFSVDFGKIFIGSDEIQSGS

SEQ ID NO: 2498568 - protein, 27 aa, Entamoeba dispar
NQMKLSLYLNLALCYLKVDKLNKALDN

SEQ ID NO: 2498569 - protein, 24 aa, Entamoeba dispar
NQNISFQITDSFIKLTGPNNTCLT

SEQ ID NO: 2498570 - protein, 23 aa, Entamoeba dispar
NQNLTEFIVCISKLLELDESIHV

SEQ ID NO: 2498571 - protein, 18 aa, Entamoeba dispar
NQPDLYKSEFNNINNILD

SEQ ID NO: 2498572 - protein, 19 aa, Entamoeba dispar
NQPEGFKFDNLIKESQSNY

SEQ ID NO: 2498573 - protein, 23 aa, Entamoeba dispar
NQPLGSSLFSFGVNNNKSATNTQ

SEQ ID NO: 2498574 - protein, 24 aa, Entamoeba dispar
NQPPLRCDMEIDYNKFNAIAPKYF

SEQ ID NO: 2498575 - protein, 17 aa, Entamoeba dispar
NQPQFIVLIDLLRKLFV

SEQ ID NO: 2498576 - protein, 25 aa, Entamoeba dispar
NQPSLRVCERLHLIKEGIQRERVLL

SEQ ID NO: 2498577 - protein, 17 aa, Entamoeba dispar
NQQCVNTLPSLLIEKSK

SEQ ID NO: 2498578 - protein, 17 aa, Entamoeba dispar
NQRAVICDFGMSIIDQP

SEQ ID NO: 2498579 - protein, 27 aa, Entamoeba dispar
NQRFDNKFSKYTLERVPKEFANVTQYK

SEQ ID NO: 2498580 - protein, 20 aa, Entamoeba dispar
NQRIISIPIYKGEGKKTNEE

SEQ ID NO: 2498581 - protein, 18 aa, Entamoeba dispar
NQRREVSFVFGVKELNQF

SEQ ID NO: 2498582 - protein, 21 aa, Entamoeba dispar
NQRWCSDGFEFCCDNGERLRV

SEQ ID NO: 2498583 - protein, 19 aa, Entamoeba dispar
NQSTCLMCFCGELNEETKV

SEQ ID NO: 2498584 - protein, 19 aa, Entamoeba dispar
NQTKRGICITVKKMCNHLL

SEQ ID NO: 2498585 - protein, 26 aa, Entamoeba dispar
NQVCHFLNVFKGCIQDITWLPGGLRM

SEQ ID NO: 2498586 - protein, 33 aa, Entamoeba dispar
NQVIQLFQYFGLNWKGLNSFKRPIIISESDIFI

SEQ ID NO: 2498587 - protein, 40 aa, Entamoeba dispar
NQYISLEGFLPIVYERKVFGVPMLIAFTYNYPLSPPELSC

SEQ ID NO: 2498588 - protein, 25 aa, Entamoeba dispar
NQYKQEILYSVAWKSFLKGSYKKEA

SEQ ID NO: 2498589 - protein, 24 aa, Entamoeba dispar
NQYKTRNVMKLIYLDLLGYNTQFA

SEQ ID NO: 2498590 - protein, 30 aa, Entamoeba dispar
NQYWYWYPFTLCLSLSFIPTTIIGVTEDLQ

SEQ ID NO: 2498591 - protein, 20 aa, Entamoeba dispar
NRACDCFELAIKLNDTEPLL

SEQ ID NO: 2498592 - protein, 23 aa, Entamoeba dispar
NRAEYNPFLLFCRDHRENVREKG

SEQ ID NO: 2498593 - protein, 24 aa, Entamoeba dispar
NRAIKLRAEKVIREIDRKRKSLIN

SEQ ID NO: 2498594 - protein, 18 aa, Entamoeba dispar
NRAVALTALSAFKAKEYR

SEQ ID NO: 2498595 - protein, 21 aa, Entamoeba dispar
NRCVGFNVGIEEFWRRYDDEE

SEQ ID NO: 2498596 - protein, 20 aa, Entamoeba dispar
NRDDFEIIRLLKEICEGIGM

SEQ ID NO: 2498597 - protein, 22 aa, Entamoeba dispar
NRDFGLSIFCLRSKKLQTPSLF

SEQ ID NO: 2498598 - protein, 24 aa, Entamoeba dispar
NRDVNGFGFRSPFISRLVAHEKII

SEQ ID NO: 2498599 - protein, 18 aa, Entamoeba dispar
NREEFKKKVRRCVRKSIE

SEQ ID NO: 2498600 - protein, 25 aa, Entamoeba dispar
NREREVRSNITWKCRSIGAYYGEPS

SEQ ID NO: 2498601 - protein, 17 aa, Entamoeba dispar
NRESIQIIPESNKIKRE

SEQ ID NO: 2498602 - protein, 34 aa, Entamoeba dispar
NRFMVFPVKTPKCPTRFVFKNGYYSGTPDGGIIL

SEQ ID NO: 2498603 - protein, 17 aa, Entamoeba dispar
NRGIQCYSCSSEQTKSS

SEQ ID NO: 2498604 - protein, 29 aa, Entamoeba dispar
NRHIIVWDRRFTKGIKFFDLKAKYVNPIK

SEQ ID NO: 2498605 - protein, 29 aa, Entamoeba dispar
NRHIIVWDRRFTKGIKFFDLKANSLKRMT

SEQ ID NO: 2498606 - protein, 18 aa, Entamoeba dispar
NRHLPIKIILIVEGLTFY

SEQ ID NO: 2498607 - protein, 19 aa, Entamoeba dispar
NRIANGCYRYQGQEYQLPI

SEQ ID NO: 2498608 - protein, 21 aa, Entamoeba dispar
NRIATFSSYGDRVVVMDIRKP

SEQ ID NO: 2498609 - protein, 20 aa, Entamoeba dispar
NRIGGEGVIDLDELIRKTEE

SEQ ID NO: 2498610 - protein, 18 aa, Entamoeba dispar
NRIHSFLYSGYWGNVIAR

SEQ ID NO: 2498611 - protein, 20 aa, Entamoeba dispar
NRIIEKFPELKVFTESQIDQ

SEQ ID NO: 2498612 - protein, 19 aa, Entamoeba dispar
NRIKACIALSEKMNPDEFY

SEQ ID NO: 2498613 - protein, 21 aa, Entamoeba dispar
NRIKTDMLISIDVSLRSMEKR

SEQ ID NO: 2498614 - protein, 23 aa, Entamoeba dispar
NRIKTYILCIAPSFIEEIKNKLQ

SEQ ID NO: 2498615 - protein, 25 aa, Entamoeba dispar
NRIPLKCFSFCFGLSTVVNLGNLIE

SEQ ID NO: 2498616 - protein, 20 aa, Entamoeba dispar
NRIREIDNFITISKRNDIDS

SEQ ID NO: 2498617 - protein, 22 aa, Entamoeba dispar
NRITPHLLTIDILKGSGYIERR

SEQ ID NO: 2498618 - protein, 23 aa, Entamoeba dispar
NRKAEMLDYLGVAFGYTPQLSKF

SEQ ID NO: 2498619 - protein, 25 aa, Entamoeba dispar
NRKELIDPALLRPGRFDCLIEVPKP

SEQ ID NO: 2498620 - protein, 23 aa, Entamoeba dispar
NRKEVNGKMIVGSFSREDLETIK

SEQ ID NO: 2498621 - protein, 24 aa, Entamoeba dispar
NRKIFNYQEFDIFGGKNPYDNMTT

SEQ ID NO: 2498622 - protein, 20 aa, Entamoeba dispar
NRKKKFRMISIDGGGSKCIL

SEQ ID NO: 2498623 - protein, 18 aa, Entamoeba dispar
NRKNFRRMILPSFDDEEP

SEQ ID NO: 2498624 - protein, 21 aa, Entamoeba dispar
NRKRKYGAWIGGKLFASLSSF

SEQ ID NO: 2498625 - protein, 18 aa, Entamoeba dispar
NRKVDAFTLPTMFDSKSC

SEQ ID NO: 2498626 - protein, 23 aa, Entamoeba dispar
NRLDFLRDYIISLGGKIPETKKE

SEQ ID NO: 2498627 - protein, 20 aa, Entamoeba dispar
NRLDQIEMFLPMLLQVNQFP

SEQ ID NO: 2498628 - protein, 19 aa, Entamoeba dispar
NRLFEKMTILESKKKELIK

SEQ ID NO: 2498629 - protein, 21 aa, Entamoeba dispar
NRLKKLCDVTATSKQLWKSGL

SEQ ID NO: 2498630 - protein, 22 aa, Entamoeba dispar
NRLLFELFVTLIFNEREEDVAK

SEQ ID NO: 2498631 - protein, 25 aa, Entamoeba dispar
NRLNRLPESLGRLISVTYLDARNNQ

SEQ ID NO: 2498632 - protein, 23 aa, Entamoeba dispar
NRLPIRSIFNCFHRTSVDYFTIN

SEQ ID NO: 2498633 - protein, 25 aa, Entamoeba dispar
NRLTQFPVCLGTQLTSLMISSNSIS

SEQ ID NO: 2498634 - protein, 20 aa, Entamoeba dispar
NRLVKYSSIHMMTLKNFSMI

SEQ ID NO: 2498635 - protein, 19 aa, Entamoeba dispar
NRLVNHFIAEFKRKYKKDI

SEQ ID NO: 2498636 - protein, 27 aa, Entamoeba dispar
NRMGLSRGRAGVITRASFEQTLEQFRR

SEQ ID NO: 2498637 - protein, 23 aa, Entamoeba dispar
NRMKECLDTFYIPLKKYMKEEDL

SEQ ID NO: 2498638 - protein, 23 aa, Entamoeba dispar
NRMLKITPFDLVNKIVMKIITMI

SEQ ID NO: 2498639 - protein, 19 aa, Entamoeba dispar
NRMQIVPAVDGYVIDNAIT

SEQ ID NO: 2498640 - protein, 17 aa, Entamoeba dispar
NRMQSTVYPTVFETDDN

SEQ ID NO: 2498641 - protein, 19 aa, Entamoeba dispar
NRMRALKCILNIIDNISTI

SEQ ID NO: 2498642 - protein, 19 aa, Entamoeba dispar
NRMRGCGEKARKQGIRYTI

SEQ ID NO: 2498643 - protein, 25 aa, Entamoeba dispar
NRNEAKMIYEMICKKKAPKVSSIEK

SEQ ID NO: 2498644 - protein, 23 aa, Entamoeba dispar
NRNEIEGEFSLFGGEHDALFIEQ

SEQ ID NO: 2498645 - protein, 18 aa, Entamoeba dispar
NRNFGIDTTHIFYDLFKN

SEQ ID NO: 2498646 - protein, 18 aa, Entamoeba dispar
NRNGIEIEERYKGKTLKQ

SEQ ID NO: 2498647 - protein, 20 aa, Entamoeba dispar
NRNGLKMFSAILLDNKPNSY

SEQ ID NO: 2498648 - protein, 18 aa, Entamoeba dispar
NRNIICKQVKFTKKDREN

SEQ ID NO: 2498649 - protein, 23 aa, Entamoeba dispar
NRNIPEILYFFDMNQLDIPSTDE

SEQ ID NO: 2498650 - protein, 22 aa, Entamoeba dispar
NRNKKIFCYGIQIGNNPPLIRI

SEQ ID NO: 2498651 - protein, 29 aa, Entamoeba dispar
NRNTLKCPACLGVTGGLFSRFKRGEVKEN

SEQ ID NO: 2498652 - protein, 17 aa, Entamoeba dispar
NRNVYMEFINLFNYLPL

SEQ ID NO: 2498653 - protein, 21 aa, Entamoeba dispar
NRPAAITGMVQRLRIAINAAD

SEQ ID NO: 2498654 - protein, 25 aa, Entamoeba dispar
NRPKASKEDMEWLKKVMDSIESDAK

SEQ ID NO: 2498655 - protein, 19 aa, Entamoeba dispar
NRPLLFIALMESDIELSQK

SEQ ID NO: 2498656 - protein, 18 aa, Entamoeba dispar
NRPLSFLSGYVICVSGYT

SEQ ID NO: 2498657 - protein, 20 aa, Entamoeba dispar
NRRGDMVLHLNVNYPTILTD

SEQ ID NO: 2498658 - protein, 19 aa, Entamoeba dispar
NRRITIWINGVEVINYLIK

SEQ ID NO: 2498659 - protein, 19 aa, Entamoeba dispar
NRSGGCASWLGKKVPNNVC

SEQ ID NO: 2498660 - protein, 24 aa, Entamoeba dispar
NRSKESWINNGLLYLLKMYGYNFN

SEQ ID NO: 2498661 - protein, 23 aa, Entamoeba dispar
NRSLCNRTNFSIFIVTGTTDVFG

SEQ ID NO: 2498662 - protein, 25 aa, Entamoeba dispar
NRSLRLIKLYGEFITMLNSIVPKKN

SEQ ID NO: 2498663 - protein, 20 aa, Entamoeba dispar
NRSSFDINNFQYIKSLIDKI

SEQ ID NO: 2498664 - protein, 19 aa, Entamoeba dispar
NRSTIGYARSISINKCENI

SEQ ID NO: 2498665 - protein, 21 aa, Entamoeba dispar
NRSYLLCLLLQYKYKTKHQEF

SEQ ID NO: 2498666 - protein, 20 aa, Entamoeba dispar
NRTAKAYLQMDWTKKGNLTP

SEQ ID NO: 2498667 - protein, 31 aa, Entamoeba dispar
NRTMFHFFERFLLCNNLYLTTYRIVLFESFS

SEQ ID NO: 2498668 - protein, 19 aa, Entamoeba dispar
NRTPECFKRVRDLETKQEC

SEQ ID NO: 2498669 - protein, 21 aa, Entamoeba dispar
NRTSYSYLPLAHVFEHEVTYI

SEQ ID NO: 2498670 - protein, 23 aa, Entamoeba dispar
NRVEAIKEMLTKEFGRAIIEQNF

SEQ ID NO: 2498671 - protein, 19 aa, Entamoeba dispar
NRVIIKLVIDLNTFKSNSE

SEQ ID NO: 2498672 - protein, 19 aa, Entamoeba dispar
NRVLAQISKICFVDTVSIP

SEQ ID NO: 2498673 - protein, 17 aa, Entamoeba dispar
NRVRLTKNYGMSFCIVE

SEQ ID NO: 2498674 - protein, 19 aa, Entamoeba dispar
NRVVISLNCPFSKCRMNNP

SEQ ID NO: 2498675 - protein, 19 aa, Entamoeba dispar
NRYDIIAIITINKDINPTV

SEQ ID NO: 2498676 - protein, 26 aa, Entamoeba dispar
NRYEILDFLGVGGFGVVRKVKRISDG

SEQ ID NO: 2498677 - protein, 21 aa, Entamoeba dispar
NRYFGHLKRLGITESDITASV

SEQ ID NO: 2498678 - protein, 18 aa, Entamoeba dispar
NRYHRFEKGYVLMEGFVD

SEQ ID NO: 2498679 - protein, 24 aa, Entamoeba dispar
NRYHRLFIKLALKKFFNVDITKKD

SEQ ID NO: 2498680 - protein, 24 aa, Entamoeba dispar
NRYKSKVVQFIVCDETKSSGEIIR

SEQ ID NO: 2498681 - protein, 17 aa, Entamoeba dispar
NRYQLIKGLGKGSFGQV

SEQ ID NO: 2498682 - protein, 20 aa, Entamoeba dispar
NRYYIQIPFSQLDKYKEKLL

SEQ ID NO: 2498683 - protein, 25 aa, Entamoeba dispar
NSADEMMLILSFLKSDYPITAQFYA

SEQ ID NO: 2498684 - protein, 21 aa, Entamoeba dispar
NSAIIKIALINAIASKKTSLI

SEQ ID NO: 2498685 - protein, 25 aa, Entamoeba dispar
NSAIQCLIHTIPLVQFFQKEDWKKE

SEQ ID NO: 2498686 - protein, 27 aa, Entamoeba dispar
NSCNEYKFEVLISMMSEQWFWDEVEKF

SEQ ID NO: 2498687 - protein, 24 aa, Entamoeba dispar
NSDDWFDIRVLLLSIAANTLYELK

SEQ ID NO: 2498688 - protein, 24 aa, Entamoeba dispar
NSDEKGQIFGLIELNRCRKLFGQI

SEQ ID NO: 2498689 - protein, 21 aa, Entamoeba dispar
NSDEYYSFFLAYLNHAHPEYF

SEQ ID NO: 2498690 - protein, 24 aa, Entamoeba dispar
NSDFMKGKCLYRLYDYDDDEAWMK

SEQ ID NO: 2498691 - protein, 24 aa, Entamoeba dispar
NSDYHKPFCIIVMDVNGIWKKFYG

SEQ ID NO: 2498692 - protein, 27 aa, Entamoeba dispar
NSEAVTCFEKALLIKYCVQNELYLANA

SEQ ID NO: 2498693 - protein, 23 aa, Entamoeba dispar
NSEFKFEYENAIDISAFTGNKEN

SEQ ID NO: 2498694 - protein, 24 aa, Entamoeba dispar
NSELNLANSVLFCILDLNNDGKVP

SEQ ID NO: 2498695 - protein, 18 aa, Entamoeba dispar
NSEMINWIIEIIQGISIT

SEQ ID NO: 2498696 - protein, 24 aa, Entamoeba dispar
NSEMINWIIEIVRGISITTYPPKK

SEQ ID NO: 2498697 - protein, 18 aa, Entamoeba dispar
NSEQIISILLDYQNIQEM

SEQ ID NO: 2498698 - protein, 19 aa, Entamoeba dispar
NSERIREMIDWSKMKMNVK

SEQ ID NO: 2498699 - protein, 30 aa, Entamoeba dispar
NSESKIGGLFIKLAPFLKIYGEYCKNYPEA

SEQ ID NO: 2498700 - protein, 27 aa, Entamoeba dispar
NSESNDNCKLCGGAQIQRVLKIYENKL

SEQ ID NO: 2498701 - protein, 19 aa, Entamoeba dispar
NSFECPIEIGTSNMCGKRD

SEQ ID NO: 2498702 - protein, 21 aa, Entamoeba dispar
NSFELSKYFARPKLIEKVNNF

SEQ ID NO: 2498703 - protein, 17 aa, Entamoeba dispar
NSFENVFSGNFSFDTPV

SEQ ID NO: 2498704 - protein, 19 aa, Entamoeba dispar
NSFIPPKNVKILFRQNTTT

SEQ ID NO: 2498705 - protein, 18 aa, Entamoeba dispar
NSFIRQLFHFSIYSIFEG

SEQ ID NO: 2498706 - protein, 22 aa, Entamoeba dispar
NSFKGCSAITEFDVPRDPNGDY

SEQ ID NO: 2498707 - protein, 17 aa, Entamoeba dispar
NSFLHCTQLKNIYVTSS

SEQ ID NO: 2498708 - protein, 19 aa, Entamoeba dispar
NSFLRLYTSLYMLQTMVNL

SEQ ID NO: 2498709 - protein, 20 aa, Entamoeba dispar
NSFLSFSFEPSHLKTNSTPP

SEQ ID NO: 2498710 - protein, 17 aa, Entamoeba dispar
NSFNIIIDVSRSLTKQQ

SEQ ID NO: 2498711 - protein, 23 aa, Entamoeba dispar
NSFPDITLVPGIAKDYLIIRSKF

SEQ ID NO: 2498712 - protein, 24 aa, Entamoeba dispar
NSFSKRLRKSEVRLDRKISSLHKV

SEQ ID NO: 2498713 - protein, 24 aa, Entamoeba dispar
NSFTCADHFIGIFYGIKNTGIKSK

SEQ ID NO: 2498714 - protein, 19 aa, Entamoeba dispar
NSFWDIGVTINIYIDKDLI

SEQ ID NO: 2498715 - protein, 18 aa, Entamoeba dispar
NSGCKHLLGTYALFQHLE

SEQ ID NO: 2498716 - protein, 19 aa, Entamoeba dispar
NSGECYMIYNNDFKEELKQ

SEQ ID NO: 2498717 - protein, 20 aa, Entamoeba dispar
NSGIYKRFVNKITEVTQRKG

SEQ ID NO: 2498718 - protein, 24 aa, Entamoeba dispar
NSHFSLIVICFDKTSGFSDLNEID

SEQ ID NO: 2498719 - protein, 17 aa, Entamoeba dispar
NSHGIFISISSPGNLLL

SEQ ID NO: 2498720 - protein, 19 aa, Entamoeba dispar
NSHINLFHFIRDGKIEDIK

SEQ ID NO: 2498721 - protein, 25 aa, Entamoeba dispar
NSHLKRLNFKQEIKWVQVYDNELYV

SEQ ID NO: 2498722 - protein, 17 aa, Entamoeba dispar
NSICADDSFKMNISTVM

SEQ ID NO: 2498723 - protein, 25 aa, Entamoeba dispar
NSIDPQISVFWGWKEGGKVKTIKRR

SEQ ID NO: 2498724 - protein, 17 aa, Entamoeba dispar
NSIEFLLKYIKNKLISQ

SEQ ID NO: 2498725 - protein, 32 aa, Entamoeba dispar
NSIEIKLFPSLFFKSSKCVFGGNITSISGKTV

SEQ ID NO: 2498726 - protein, 34 aa, Entamoeba dispar
NSIEIKLFPSLIFKSSKCVFGGNITSSRGKTVTV

SEQ ID NO: 2498727 - protein, 18 aa, Entamoeba dispar
NSIFHVINGYPILENDVK

SEQ ID NO: 2498728 - protein, 21 aa, Entamoeba dispar
NSIGKCCLKCHSLEKEKVSQK

SEQ ID NO: 2498729 - protein, 17 aa, Entamoeba dispar
NSIIPSYSSGLFGGQSI

SEQ ID NO: 2498730 - protein, 17 aa, Entamoeba dispar
NSIKEFYIPPSAKLVEV

SEQ ID NO: 2498731 - protein, 23 aa, Entamoeba dispar
NSILESISFWYGNNDCRCLDYLT

SEQ ID NO: 2498732 - protein, 23 aa, Entamoeba dispar
NSINQLICVIGFEDGVQLKIGER

SEQ ID NO: 2498733 - protein, 20 aa, Entamoeba dispar
NSIRVSADFRDVVADCGVEF

SEQ ID NO: 2498734 - protein, 24 aa, Entamoeba dispar
NSITFLYRLVNGISDSSYAIHSAR

SEQ ID NO: 2498735 - protein, 18 aa, Entamoeba dispar
NSIYNCIEQFNLYKKIPY

SEQ ID NO: 2498736 - protein, 20 aa, Entamoeba dispar
NSKCASAFMNLFEPFNTPIH

SEQ ID NO: 2498737 - protein, 17 aa, Entamoeba dispar
NSKDFLCSHCLKRQNNK

SEQ ID NO: 2498738 - protein, 22 aa, Entamoeba dispar
NSKEMKMFIGLNENDKKFISKE

SEQ ID NO: 2498739 - protein, 21 aa, Entamoeba dispar
NSKIFLISLMNSMKNLCIIDG

SEQ ID NO: 2498740 - protein, 23 aa, Entamoeba dispar
NSKIIIETIFKYVIVPITLSSSI

SEQ ID NO: 2498741 - protein, 17 aa, Entamoeba dispar
NSKIRYQSNLVFIVITN

SEQ ID NO: 2498742 - protein, 21 aa, Entamoeba dispar
NSKPCPVINFNLDLSQTQNID

SEQ ID NO: 2498743 - protein, 19 aa, Entamoeba dispar
NSKSYVIWYHRKWSISKME

SEQ ID NO: 2498744 - protein, 25 aa, Entamoeba dispar
NSKTYPWKMCVDPFKQFPFNMDINL

SEQ ID NO: 2498745 - protein, 20 aa, Entamoeba dispar
NSKTYWPLVLDIATKNTVNR

SEQ ID NO: 2498746 - protein, 25 aa, Entamoeba dispar
NSLCHKNILLPFSLIKIHFNGLYNR

SEQ ID NO: 2498747 - protein, 24 aa, Entamoeba dispar
NSLESCLWIFINITSMSDVYVFHV

SEQ ID NO: 2498748 - protein, 17 aa, Entamoeba dispar
NSLFDFGTTQTKQQPNT

SEQ ID NO: 2498749 - protein, 22 aa, Entamoeba dispar
NSLGNFCFCNCKELTRIDIPTT

SEQ ID NO: 2498750 - protein, 19 aa, Entamoeba dispar
NSLGRFFCTHGGISPFLTR

SEQ ID NO: 2498751 - protein, 24 aa, Entamoeba dispar
NSLGRLGSLLKYMVHPSDLEIIVT

SEQ ID NO: 2498752 - protein, 24 aa, Entamoeba dispar
NSLIKFKPTRRFLTVVKKSFPEET

SEQ ID NO: 2498753 - protein, 21 aa, Entamoeba dispar
NSLILSEFDILYFFKSDIELF

SEQ ID NO: 2498754 - protein, 24 aa, Entamoeba dispar
NSLKCLRYKCFVNCYSLQSIIIPN

SEQ ID NO: 2498755 - protein, 17 aa, Entamoeba dispar
NSLLIPNKIGININANY

SEQ ID NO: 2498756 - protein, 18 aa, Entamoeba dispar
NSLMASIILTYYNKEENE

SEQ ID NO: 2498757 - protein, 31 aa, Entamoeba dispar
NSLQKFSIEYLKILVPLCCIHSFDDESIATR

SEQ ID NO: 2498758 - protein, 19 aa, Entamoeba dispar
NSLSELIELILNRKEYNGH

SEQ ID NO: 2498759 - protein, 20 aa, Entamoeba dispar
NSLSELIELILNRKEYNGHK

SEQ ID NO: 2498760 - protein, 19 aa, Entamoeba dispar
NSLTGSFIMLRYINPAIFS

SEQ ID NO: 2498761 - protein, 20 aa, Entamoeba dispar
NSLVLKSYFDIIIQPALTPE

SEQ ID NO: 2498762 - protein, 19 aa, Entamoeba dispar
NSMGVLVGFGCEEQREVSN

SEQ ID NO: 2498763 - protein, 21 aa, Entamoeba dispar
NSMIDFLPLFIKDNCFSVIKT

SEQ ID NO: 2498764 - protein, 20 aa, Entamoeba dispar
NSMIQCFVPLFQQNTTNLII

SEQ ID NO: 2498765 - protein, 19 aa, Entamoeba dispar
NSMLHPSFIDWALDEKRAS

SEQ ID NO: 2498766 - protein, 20 aa, Entamoeba dispar
NSMLPEGWIIGNSHNETYYI

SEQ ID NO: 2498767 - protein, 23 aa, Entamoeba dispar
NSMMREWNEIIVVVLSGLIRLIP

SEQ ID NO: 2498768 - protein, 18 aa, Entamoeba dispar
NSMREVMGSMPFVETPFG

SEQ ID NO: 2498769 - protein, 23 aa, Entamoeba dispar
NSMVLRITKLLSLNKQILIELQM

SEQ ID NO: 2498770 - protein, 19 aa, Entamoeba dispar
NSMYELWILGALDEIGNIT

SEQ ID NO: 2498771 - protein, 24 aa, Entamoeba dispar
NSNEKIYGIGFLFILNDKKTKYDV

SEQ ID NO: 2498772 - protein, 25 aa, Entamoeba dispar
NSNKCFDENKIAYWILENPNSLEEK

SEQ ID NO: 2498773 - protein, 19 aa, Entamoeba dispar
NSNSIFAMKVMRKKDMIER

SEQ ID NO: 2498774 - protein, 26 aa, Entamoeba dispar
NSPFPSLFSFEINDFISPSYGILMNY

SEQ ID NO: 2498775 - protein, 25 aa, Entamoeba dispar
NSPFQHATLKPKFNFFERAEEERKS

SEQ ID NO: 2498776 - protein, 19 aa, Entamoeba dispar
NSPLLYAYCHLIQQSSNPT

SEQ ID NO: 2498777 - protein, 21 aa, Entamoeba dispar
NSPNPCMWDLVAYRIKFFPHP

SEQ ID NO: 2498778 - protein, 31 aa, Entamoeba dispar
NSPQSNSLICWSEPLKGTAICVNNPVQFAQE

SEQ ID NO: 2498779 - protein, 19 aa, Entamoeba dispar
NSPRSIGLMRGLQKEMSQT

SEQ ID NO: 2498780 - protein, 19 aa, Entamoeba dispar
NSPVPILFEQTGCPNIDES

SEQ ID NO: 2498781 - protein, 23 aa, Entamoeba dispar
NSQDLGMCLPFIENLAHQLKCNV

SEQ ID NO: 2498782 - protein, 19 aa, Entamoeba dispar
NSQELMRKIELMKTESINL

SEQ ID NO: 2498783 - protein, 18 aa, Entamoeba dispar
NSQIPSWVSFAKMEDSGV

SEQ ID NO: 2498784 - protein, 19 aa, Entamoeba dispar
NSQLIFSYFVEKERLAELI

SEQ ID NO: 2498785 - protein, 18 aa, Entamoeba dispar
NSQLKLYLKRTELSGYEK

SEQ ID NO: 2498786 - protein, 17 aa, Entamoeba dispar
NSQLLCGQIEKSIIGSG

SEQ ID NO: 2498787 - protein, 18 aa, Entamoeba dispar
NSQNKWNIWSWWSQPNQE

SEQ ID NO: 2498788 - protein, 24 aa, Entamoeba dispar
NSQSKRCRELLPVLINAEHTILLS

SEQ ID NO: 2498789 - protein, 17 aa, Entamoeba dispar
NSQYRVIGLLGQGSFGE

SEQ ID NO: 2498790 - protein, 24 aa, Entamoeba dispar
NSRGLLRCVLKNFELFENEGKFYP

SEQ ID NO: 2498791 - protein, 19 aa, Entamoeba dispar
NSRGVKGIRTFHLTVDTEN

SEQ ID NO: 2498792 - protein, 19 aa, Entamoeba dispar
NSRIIFKPIIQQLADTSKE

SEQ ID NO: 2498793 - protein, 23 aa, Entamoeba dispar
NSRREIVNISDLIFKSQTGKPCS

SEQ ID NO: 2498794 - protein, 27 aa, Entamoeba dispar
NSRTEIKLSEMKRQLNVSEELNEKRKE

SEQ ID NO: 2498795 - protein, 28 aa, Entamoeba dispar
NSSEYKLKLCFCPLCSSGITALGNTDSR

SEQ ID NO: 2498796 - protein, 21 aa, Entamoeba dispar
NSSFTPRAFGSKIDTSAKSGS

SEQ ID NO: 2498797 - protein, 29 aa, Entamoeba dispar
NSSHLCVSCSSCKRVAVSTNNLINLYDPT

SEQ ID NO: 2498798 - protein, 18 aa, Entamoeba dispar
NSSLGEDVLMHMLRQKDD

SEQ ID NO: 2498799 - protein, 19 aa, Entamoeba dispar
NSSLHHIYSIFKLNDRENQ

SEQ ID NO: 2498800 - protein, 21 aa, Entamoeba dispar
NSSLMLKAFFTMLKRFYPDRI

SEQ ID NO: 2498801 - protein, 17 aa, Entamoeba dispar
NSSQCPHCIKIISRDNR

SEQ ID NO: 2498802 - protein, 17 aa, Entamoeba dispar
NSSYLFDVMIKRIHEYK

SEQ ID NO: 2498803 - protein, 33 aa, Entamoeba dispar
NSTICLTEGIFSFIKKLFVKRTYNKIYVDKIRH

SEQ ID NO: 2498804 - protein, 18 aa, Entamoeba dispar
NSTIPAKKSEIFSTYTDN

SEQ ID NO: 2498805 - protein, 31 aa, Entamoeba dispar
NSTISLMCVCPLFPGEFTYKVLLLSDCYIGL

SEQ ID NO: 2498806 - protein, 22 aa, Entamoeba dispar
NSTKSNCLLLLLQLTSIDPSVS

SEQ ID NO: 2498807 - protein, 27 aa, Entamoeba dispar
NSTLYLRWLQIQTFFPLFRGNGEINGY

SEQ ID NO: 2498808 - protein, 33 aa, Entamoeba dispar
NSTRKKRIAIGIAKVMMKWCDRRIKLLDKVSYS

SEQ ID NO: 2498809 - protein, 26 aa, Entamoeba dispar
NSTSRDICKIYSLFAETIISTTSHVN

SEQ ID NO: 2498810 - protein, 34 aa, Entamoeba dispar
NSVFWKMARIIVPLCSDWEQWKSLSITSNLSFRK

SEQ ID NO: 2498811 - protein, 19 aa, Entamoeba dispar
NSVQCLWGATNYIIDSNEC

SEQ ID NO: 2498812 - protein, 17 aa, Entamoeba dispar
NSVRLCSLLKDIGSNNQ

SEQ ID NO: 2498813 - protein, 29 aa, Entamoeba dispar
NSVSYPPNFPMVVSAGIPITTPNLGQGHI

SEQ ID NO: 2498814 - protein, 20 aa, Entamoeba dispar
NSVTKLGDYCFSYCSSITTI

SEQ ID NO: 2498815 - protein, 23 aa, Entamoeba dispar
NSVYFCGINDYQIEYSLLNQLNS

SEQ ID NO: 2498816 - protein, 27 aa, Entamoeba dispar
NSWKSYAMGIGCVLAGMYQIYINPKTP

SEQ ID NO: 2498817 - protein, 24 aa, Entamoeba dispar
NSWYKRISYELNEQWNKKIICDGG

SEQ ID NO: 2498818 - protein, 21 aa, Entamoeba dispar
NSYCRELLFPLTIDENNIGVD

SEQ ID NO: 2498819 - protein, 25 aa, Entamoeba dispar
NSYGILRFRILSNIVINKQPLFDRL

SEQ ID NO: 2498820 - protein, 18 aa, Entamoeba dispar
NSYKRTPRLILLTKSLSN

SEQ ID NO: 2498821 - protein, 19 aa, Entamoeba dispar
NSYLKRIHEEPSYTLMTYQ

SEQ ID NO: 2498822 - protein, 18 aa, Entamoeba dispar
NSYTCVVKGAAYRAHQLS

SEQ ID NO: 2498823 - protein, 17 aa, Entamoeba dispar
NSYVILPIQRIPRYRLL

SEQ ID NO: 2498824 - protein, 30 aa, Entamoeba dispar
NSYYLERLFCFYIPIITRCSISIIDSTSTR

SEQ ID NO: 2498825 - protein, 30 aa, Entamoeba dispar
NTAKFKGIPCFWGRIIKRLPYFTPNTKEYP

SEQ ID NO: 2498826 - protein, 25 aa, Entamoeba dispar
NTCKLHYRMIEFNKPVKMNTFTANE

SEQ ID NO: 2498827 - protein, 23 aa, Entamoeba dispar
NTCYMNAVIQCIAHTQQFLEYAL

SEQ ID NO: 2498828 - protein, 30 aa, Entamoeba dispar
NTDDFILMSLEYLYFDSVWVTLKMELLDEE

SEQ ID NO: 2498829 - protein, 26 aa, Entamoeba dispar
NTDDFIYKFIRVCVMNNIGLSGPALD

SEQ ID NO: 2498830 - protein, 20 aa, Entamoeba dispar
NTDDYKNWFFVFFNYLHPSN

SEQ ID NO: 2498831 - protein, 34 aa, Entamoeba dispar
NTDNMFEFWDWVGGRYSLWSAIGLTIMISIGEQG

SEQ ID NO: 2498832 - protein, 17 aa, Entamoeba dispar
NTDWCVGMDLSTMSVDV

SEQ ID NO: 2498833 - protein, 26 aa, Entamoeba dispar
NTDYKSRIVGTIGYAAPEIVTGNYDN

SEQ ID NO: 2498834 - protein, 22 aa, Entamoeba dispar
NTEGCPAFYNFLNLLGNKIELH

SEQ ID NO: 2498835 - protein, 26 aa, Entamoeba dispar
NTEGRGVCLRFPRYIRTRDDKEVNDI

SEQ ID NO: 2498836 - protein, 18 aa, Entamoeba dispar
NTEIEYAKHLIQQCSTPM

SEQ ID NO: 2498837 - protein, 24 aa, Entamoeba dispar
NTEIPNKIRIKFMIDGAKGISYLH

SEQ ID NO: 2498838 - protein, 25 aa, Entamoeba dispar
NTEIPNKIRIKFMIDGAKGISYLHS

SEQ ID NO: 2498839 - protein, 26 aa, Entamoeba dispar
NTESFAEGLVRVIPNQAEILAGQQEI

SEQ ID NO: 2498840 - protein, 25 aa, Entamoeba dispar
NTETRKLLFNYVALGVKLMNASNSN

SEQ ID NO: 2498841 - protein, 17 aa, Entamoeba dispar
NTFDFGDFSSAQVQEKK

SEQ ID NO: 2498842 - protein, 24 aa, Entamoeba dispar
NTFDNTLYMLLTFANLSNNYVVKK

SEQ ID NO: 2498843 - protein, 19 aa, Entamoeba dispar
NTFGLFFKNYINSYEPLLN

SEQ ID NO: 2498844 - protein, 34 aa, Entamoeba dispar
NTFGRGHPRFRKPRIGGDGVYEFDILHYAGTVTY

SEQ ID NO: 2498845 - protein, 28 aa, Entamoeba dispar
NTFSMRIKEWYSWHFPELYNILNNDNKK

SEQ ID NO: 2498846 - protein, 23 aa, Entamoeba dispar
NTFTFKSSYFLAYSPINDVFYYN

SEQ ID NO: 2498847 - protein, 29 aa, Entamoeba dispar
NTFYLIKIYNLFCSFIIDIYFSSKVNLIR

SEQ ID NO: 2498848 - protein, 24 aa, Entamoeba dispar
NTGDCKCLLIKQDGFIQLTVEHRP

SEQ ID NO: 2498849 - protein, 26 aa, Entamoeba dispar
NTGNVLFRKSRVIRCKEIEEENERIK

SEQ ID NO: 2498850 - protein, 19 aa, Entamoeba dispar
NTGPFECFSTFVRKGVVFI

SEQ ID NO: 2498851 - protein, 19 aa, Entamoeba dispar
NTHCFSCNYQLTSVTISAL

SEQ ID NO: 2498852 - protein, 33 aa, Entamoeba dispar
NTHIMKINLTIPFWWKDDLFPYIVEHRPYSPSC

SEQ ID NO: 2498853 - protein, 24 aa, Entamoeba dispar
NTHRLGGFEAPPGIISIFLGDVIQ

SEQ ID NO: 2498854 - protein, 18 aa, Entamoeba dispar
NTIFAAGGDGCMSTWNIN

SEQ ID NO: 2498855 - protein, 20 aa, Entamoeba dispar
NTIFPFCFSEGETLLTQRNL

SEQ ID NO: 2498856 - protein, 20 aa, Entamoeba dispar
NTIGFLPIQIANFLNIHNEL

SEQ ID NO: 2498857 - protein, 26 aa, Entamoeba dispar
NTIGMPLPFAMRLTIAVPVNERNYEE

SEQ ID NO: 2498858 - protein, 17 aa, Entamoeba dispar
NTIHWPASDVLKKYIFV

SEQ ID NO: 2498859 - protein, 19 aa, Entamoeba dispar
NTILESCNQLTTQIQEATK

SEQ ID NO: 2498860 - protein, 17 aa, Entamoeba dispar
NTILTPRLLHIYSENKL

SEQ ID NO: 2498861 - protein, 23 aa, Entamoeba dispar
NTIQEFKSGIGRTILITTSLCAR

SEQ ID NO: 2498862 - protein, 17 aa, Entamoeba dispar
NTIRVMRKSVSMPNGSA

SEQ ID NO: 2498863 - protein, 25 aa, Entamoeba dispar
NTISQRLPVPLLRRRNVSQERPELL

SEQ ID NO: 2498864 - protein, 19 aa, Entamoeba dispar
NTIVNWCGDESINLNQRIK

SEQ ID NO: 2498865 - protein, 17 aa, Entamoeba dispar
NTKFKRKASAQKVVSFG

SEQ ID NO: 2498866 - protein, 22 aa, Entamoeba dispar
NTKGCLFPYLLDTKKFAATIYS

SEQ ID NO: 2498867 - protein, 20 aa, Entamoeba dispar
NTKKFAYLLSRIFYNAQYFE

SEQ ID NO: 2498868 - protein, 22 aa, Entamoeba dispar
NTKLILRSKCPLIDTVTSGNDE

SEQ ID NO: 2498869 - protein, 21 aa, Entamoeba dispar
NTKLPTLPSFNGINNPFRCPT

SEQ ID NO: 2498870 - protein, 24 aa, Entamoeba dispar
NTKNFEDIVGFLLAKIYNCIGEDI

SEQ ID NO: 2498871 - protein, 23 aa, Entamoeba dispar
NTKSNDIVLVFKFTESTCFKQLI

SEQ ID NO: 2498872 - protein, 18 aa, Entamoeba dispar
NTKWFCSKIRKLRISIDF

SEQ ID NO: 2498873 - protein, 30 aa, Entamoeba dispar
NTKWFCSKIRKLRMTDFFYMKDTIKHPEYF

SEQ ID NO: 2498874 - protein, 26 aa, Entamoeba dispar
NTKWINRWSNLIIHNLIFYGITVKEW

SEQ ID NO: 2498875 - protein, 24 aa, Entamoeba dispar
NTLCTRILTAYARITSKKFLSTTL

SEQ ID NO: 2498876 - protein, 20 aa, Entamoeba dispar
NTLELCFMANVLLYFTKFSD

SEQ ID NO: 2498877 - protein, 19 aa, Entamoeba dispar
NTLFDFGWVPIIADKKRKV

SEQ ID NO: 2498878 - protein, 20 aa, Entamoeba dispar
NTLFFLRYLFIPFKETPSLF

SEQ ID NO: 2498879 - protein, 18 aa, Entamoeba dispar
NTLFKIAYYYKSNAIHNK

SEQ ID NO: 2498880 - protein, 25 aa, Entamoeba dispar
NTLHELWSLLQFLLPEIFNMKELDE

SEQ ID NO: 2498881 - protein, 24 aa, Entamoeba dispar
NTLKDLLNKFGLAYTALPDAANKF

SEQ ID NO: 2498882 - protein, 17 aa, Entamoeba dispar
NTLKGIISGGGVFYNLT

SEQ ID NO: 2498883 - protein, 21 aa, Entamoeba dispar
NTLLYCFCDSLLKQDVNVSYI

SEQ ID NO: 2498884 - protein, 19 aa, Entamoeba dispar
NTLMPSLLIIFRVTQDRVG

SEQ ID NO: 2498885 - protein, 18 aa, Entamoeba dispar
NTLPCYKQLLSPSSESQH

SEQ ID NO: 2498886 - protein, 26 aa, Entamoeba dispar
NTLPSSWRFWEVMAQDFCATSKESFH

SEQ ID NO: 2498887 - protein, 18 aa, Entamoeba dispar
NTLQCRLKELKVWNMTKT

SEQ ID NO: 2498888 - protein, 21 aa, Entamoeba dispar
NTLWILMDMCGVGSVKDLMKK

SEQ ID NO: 2498889 - protein, 21 aa, Entamoeba dispar
NTLWYIFSFLRRVLEQQNINK

SEQ ID NO: 2498890 - protein, 25 aa, Entamoeba dispar
NTLYYVRTALNFGDILYSFGDRMKK

SEQ ID NO: 2498891 - protein, 18 aa, Entamoeba dispar
NTMKCWKIGDSTPTASFT

SEQ ID NO: 2498892 - protein, 23 aa, Entamoeba dispar
NTNEFRQPTSFHLMDDIKLTYND

SEQ ID NO: 2498893 - protein, 31 aa, Entamoeba dispar
NTNFNSFCKCFKRVKIDKALAVLSISDIKMK

SEQ ID NO: 2498894 - protein, 26 aa, Entamoeba dispar
NTPFIRLYSYYLFFYCSDFMNKTTSE

SEQ ID NO: 2498895 - protein, 22 aa, Entamoeba dispar
NTPGEAFFTFLINKKEKRVKVN

SEQ ID NO: 2498896 - protein, 24 aa, Entamoeba dispar
NTPIGLCWSFLFGEEGLQLDPKKV

SEQ ID NO: 2498897 - protein, 17 aa, Entamoeba dispar
NTPLSIPPPQIVPPPPI

SEQ ID NO: 2498898 - protein, 25 aa, Entamoeba dispar
NTPPLCYKRRLSEIISVDEDSPKQV

SEQ ID NO: 2498899 - protein, 25 aa, Entamoeba dispar
NTQLLDLEYFFFIKAIVASTMKLNG

SEQ ID NO: 2498900 - protein, 26 aa, Entamoeba dispar
NTQLPHKFIKKPFKIPTINIIIKDDE

SEQ ID NO: 2498901 - protein, 23 aa, Entamoeba dispar
NTQYLNDYRFFSFEFTGTEQRPV

SEQ ID NO: 2498902 - protein, 23 aa, Entamoeba dispar
NTRKACIDLSLTVEPVSIYNSKM

SEQ ID NO: 2498903 - protein, 26 aa, Entamoeba dispar
NTRLYPLECYPFFPIESSSQFDYSKS

SEQ ID NO: 2498904 - protein, 19 aa, Entamoeba dispar
NTRSTVVRPVFKPDNEALN

SEQ ID NO: 2498905 - protein, 23 aa, Entamoeba dispar
NTSCKKDVIPVLIVPPQSSNTSL

SEQ ID NO: 2498906 - protein, 24 aa, Entamoeba dispar
NTSFKRINFIPTYLFVECDQCLIG

SEQ ID NO: 2498907 - protein, 23 aa, Entamoeba dispar
NTSLKRALLYAHFQRRVITDGRM

SEQ ID NO: 2498908 - protein, 17 aa, Entamoeba dispar
NTSLLRFVHSPEQQVYV

SEQ ID NO: 2498909 - protein, 19 aa, Entamoeba dispar
NTSPFTFDKNSSFNEASTQ

SEQ ID NO: 2498910 - protein, 22 aa, Entamoeba dispar
NTSRLTESIAVFKDIMTNEFLK

SEQ ID NO: 2498911 - protein, 24 aa, Entamoeba dispar
NTSRNLPCLMVLKRHSLDQMILLT

SEQ ID NO: 2498912 - protein, 20 aa, Entamoeba dispar
NTSRYCLKIQQSIQKINWTN

SEQ ID NO: 2498913 - protein, 19 aa, Entamoeba dispar
NTTFAAFTMDCKMISRTDV

SEQ ID NO: 2498914 - protein, 23 aa, Entamoeba dispar
NTTFLYPRLINYKGDIKKIQNQM

SEQ ID NO: 2498915 - protein, 17 aa, Entamoeba dispar
NTTRFIGNAAFIDCTSL

SEQ ID NO: 2498916 - protein, 25 aa, Entamoeba dispar
NTTRRIGLRYVLMKQWFLVIYLFSL

SEQ ID NO: 2498917 - protein, 30 aa, Entamoeba dispar
NTTSKFFERMYCLFYPLDEKARCVLEEVVS

SEQ ID NO: 2498918 - protein, 19 aa, Entamoeba dispar
NTVDCRRTLVLQYFGEIFN

SEQ ID NO: 2498919 - protein, 19 aa, Entamoeba dispar
NTVFWLLDLEDIFYPEKLY

SEQ ID NO: 2498920 - protein, 19 aa, Entamoeba dispar
NTVHFSEFFYSKKTPTLDN

SEQ ID NO: 2498921 - protein, 24 aa, Entamoeba dispar
NTVKLCKVSILIDPVDIVRGNETE

SEQ ID NO: 2498922 - protein, 24 aa, Entamoeba dispar
NTVMKRYNLAAGDFPPIDVYKERL

SEQ ID NO: 2498923 - protein, 25 aa, Entamoeba dispar
NTVMKRYNLAIGDFPPIDVYRERLE

SEQ ID NO: 2498924 - protein, 23 aa, Entamoeba dispar
NTVPRKTTQLVLQKKPSIIVSIP

SEQ ID NO: 2498925 - protein, 18 aa, Entamoeba dispar
NTVWRLVGEYNQIDSNLY

SEQ ID NO: 2498926 - protein, 22 aa, Entamoeba dispar
NTYYPFCEFQYLSIENIHEVRN

SEQ ID NO: 2498927 - protein, 38 aa, Entamoeba dispar
NVACVHCKAGRGRTGLVCSCVLIGLGIYSNAKEAMEFF

SEQ ID NO: 2498928 - protein, 27 aa, Entamoeba dispar
NVAKDSVLWCYKKELAFSSNQKKRLKH

SEQ ID NO: 2498929 - protein, 25 aa, Entamoeba dispar
NVALLKPLGTYTIRIDTTGAGDITI

SEQ ID NO: 2498930 - protein, 28 aa, Entamoeba dispar
NVARIKGFPSILAVDVFKEYTRLKGINI

SEQ ID NO: 2498931 - protein, 29 aa, Entamoeba dispar
NVASGDAVDCWKKCLVILSSVDMLVAEKP

SEQ ID NO: 2498932 - protein, 20 aa, Entamoeba dispar
NVCFFTWAYELLIYDIEDPL

SEQ ID NO: 2498933 - protein, 20 aa, Entamoeba dispar
NVCGCYFNLQEIIKSPNNTI

SEQ ID NO: 2498934 - protein, 19 aa, Entamoeba dispar
NVDETFQMIVKRSRENKIN

SEQ ID NO: 2498935 - protein, 27 aa, Entamoeba dispar
NVDGLKVPVLLSDWGYEVMVTCSASQQ

SEQ ID NO: 2498936 - protein, 18 aa, Entamoeba dispar
NVDPCIPWHISAFHPDYL

SEQ ID NO: 2498937 - protein, 22 aa, Entamoeba dispar
NVDVCLIKIIPYLIQLYPEEEE

SEQ ID NO: 2498938 - protein, 18 aa, Entamoeba dispar
NVEEIFNRIEIMSQLVIP

SEQ ID NO: 2498939 - protein, 25 aa, Entamoeba dispar
NVEREPACFSSYVLHNPQIISKNRN

SEQ ID NO: 2498940 - protein, 20 aa, Entamoeba dispar
NVEYIPIIYVIGLKNEMTNY

SEQ ID NO: 2498941 - protein, 40 aa, Entamoeba dispar
NVFEKISLIGAGGFGEVWKVRHKSMRFISAAKIIKLNKSS

SEQ ID NO: 2498942 - protein, 19 aa, Entamoeba dispar
NVFGCFIHSPILITNKPIA

SEQ ID NO: 2498943 - protein, 18 aa, Entamoeba dispar
NVFLCLSNKVTDSIDNVE

SEQ ID NO: 2498944 - protein, 29 aa, Entamoeba dispar
NVFLQQRRIKVIDMCWVKGDIPVVLTHVK

SEQ ID NO: 2498945 - protein, 24 aa, Entamoeba dispar
NVFNPRFKYGRMMTDEDWEAEKRD

SEQ ID NO: 2498946 - protein, 21 aa, Entamoeba dispar
NVFNTRINVMINEGILNKIIM

SEQ ID NO: 2498947 - protein, 17 aa, Entamoeba dispar
NVFPFIFHILLNCQINF

SEQ ID NO: 2498948 - protein, 17 aa, Entamoeba dispar
NVFTFWRQHEGVELFTE

SEQ ID NO: 2498949 - protein, 19 aa, Entamoeba dispar
NVGKTCLLLTYTTNSFPDS

SEQ ID NO: 2498950 - protein, 22 aa, Entamoeba dispar
NVGKTCLLLTYTTNSFPDTYVP

SEQ ID NO: 2498951 - protein, 23 aa, Entamoeba dispar
NVGLREMFRRVIYSRNFEELETF

SEQ ID NO: 2498952 - protein, 26 aa, Entamoeba dispar
NVHRLPFPVNLVWQLTVAMQKYCELQ

SEQ ID NO: 2498953 - protein, 24 aa, Entamoeba dispar
NVIDFIHNGEWTLDNDKEFLEYMK

SEQ ID NO: 2498954 - protein, 24 aa, Entamoeba dispar
NVIEIGLRVLHPFMPFITEELWQR

SEQ ID NO: 2498955 - protein, 23 aa, Entamoeba dispar
NVIGCGCFKSCLSLSSITLSTSI

SEQ ID NO: 2498956 - protein, 24 aa, Entamoeba dispar
NVIGCGCFKSCLSLSSITLSTSIS

SEQ ID NO: 2498957 - protein, 24 aa, Entamoeba dispar
NVIKIANIILSKGVTISESNLSSP

SEQ ID NO: 2498958 - protein, 18 aa, Entamoeba dispar
NVIPLKIVDLPGFVEEQN

SEQ ID NO: 2498959 - protein, 24 aa, Entamoeba dispar
NVIQEIYMRMSVTNFLELPPDVTA

SEQ ID NO: 2498960 - protein, 22 aa, Entamoeba dispar
NVIRTNWYWKHQKRIIRFSKDK

SEQ ID NO: 2498961 - protein, 23 aa, Entamoeba dispar
NVISEIWGKLSIDQRGDLDSLFH

SEQ ID NO: 2498962 - protein, 25 aa, Entamoeba dispar
NVKEFLKQRFESLQGDEYYQFLKTV

SEQ ID NO: 2498963 - protein, 18 aa, Entamoeba dispar
NVKIKVRVGRGIVVGGFQ

SEQ ID NO: 2498964 - protein, 23 aa, Entamoeba dispar
NVKRIPSSVNFFSFNSTCKNENR

SEQ ID NO: 2498965 - protein, 21 aa, Entamoeba dispar
NVKSKCPINKLIIAESKEVNI

SEQ ID NO: 2498966 - protein, 29 aa, Entamoeba dispar
NVKVIAFRGTYSFKDCIYDIQLFTESSVP

SEQ ID NO: 2498967 - protein, 19 aa, Entamoeba dispar
NVLEWSYIHIELWKDNELE

SEQ ID NO: 2498968 - protein, 18 aa, Entamoeba dispar
NVLLCIPKAIKYNHNIKN

SEQ ID NO: 2498969 - protein, 17 aa, Entamoeba dispar
NVLLKIKIEKLIRIVLL

SEQ ID NO: 2498970 - protein, 20 aa, Entamoeba dispar
NVLLPLGLVKIAFIDCKYLR

SEQ ID NO: 2498971 - protein, 19 aa, Entamoeba dispar
NVLMEFGKLLDGVVKEQFQ

SEQ ID NO: 2498972 - protein, 26 aa, Entamoeba dispar
NVLMSEMRKVPGLIINELIQYYYEPH

SEQ ID NO: 2498973 - protein, 20 aa, Entamoeba dispar
NVLRYCSFGSDKIERIELTK

SEQ ID NO: 2498974 - protein, 23 aa, Entamoeba dispar
NVLWSDGSLSWYSSDLKQQKNYQ

SEQ ID NO: 2498975 - protein, 24 aa, Entamoeba dispar
NVMEPVMFYDLLTSLEIMKNAFFT

SEQ ID NO: 2498976 - protein, 22 aa, Entamoeba dispar
NVMKALCIFIANSIFTETEYAV

SEQ ID NO: 2498977 - protein, 19 aa, Entamoeba dispar
NVMKLRSSFTEKRSKSFNP

SEQ ID NO: 2498978 - protein, 20 aa, Entamoeba dispar
NVNFNLYSMEAFKVLLDPSV

SEQ ID NO: 2498979 - protein, 18 aa, Entamoeba dispar
NVNGGLFAICNTFFSEEN

SEQ ID NO: 2498980 - protein, 26 aa, Entamoeba dispar
NVNPQIRWVVCPKCLEIFTKKLKNIE

SEQ ID NO: 2498981 - protein, 19 aa, Entamoeba dispar
NVNRYGFFEVEGEKGELFI

SEQ ID NO: 2498982 - protein, 19 aa, Entamoeba dispar
NVNVADWVIIYLLEGNLYP

SEQ ID NO: 2498983 - protein, 17 aa, Entamoeba dispar
NVPAELFDKIKLIHGIN

SEQ ID NO: 2498984 - protein, 36 aa, Entamoeba dispar
NVPFLKELISFPIDKIVLVFLCDLEMEKVYNAFPYF

SEQ ID NO: 2498985 - protein, 21 aa, Entamoeba dispar
NVPKEIKLVEPMEEEIQDLDI

SEQ ID NO: 2498986 - protein, 24 aa, Entamoeba dispar
NVPLRQLLFTALRSVIPYACDVFV

SEQ ID NO: 2498987 - protein, 25 aa, Entamoeba dispar
NVPRRKTDEFYRYKMPDLIHKIEGK

SEQ ID NO: 2498988 - protein, 21 aa, Entamoeba dispar
NVPTDDCEVMLKWKRGKKQIN

SEQ ID NO: 2498989 - protein, 22 aa, Entamoeba dispar
NVQFFRSAFIYAKIKTANVREW

SEQ ID NO: 2498990 - protein, 20 aa, Entamoeba dispar
NVQLPKFDFNVVVFSNSSSQ

SEQ ID NO: 2498991 - protein, 22 aa, Entamoeba dispar
NVQYMIRCELIKKNGSKTRSNG

SEQ ID NO: 2498992 - protein, 19 aa, Entamoeba dispar
NVRCLKCMARDAQKAAELK

SEQ ID NO: 2498993 - protein, 25 aa, Entamoeba dispar
NVSEGECFIHSFALQQEDLDEKEEN

SEQ ID NO: 2498994 - protein, 18 aa, Entamoeba dispar
NVSFERLSVLALLGNKIS

SEQ ID NO: 2498995 - protein, 23 aa, Entamoeba dispar
NVSGDTFVPIVIYTLLKANLPHL

SEQ ID NO: 2498996 - protein, 24 aa, Entamoeba dispar
NVSGEFKISLEIEINKELFESEQF

SEQ ID NO: 2498997 - protein, 28 aa, Entamoeba dispar
NVSIARTRIEGLYATFIRMCNTISNSSF

SEQ ID NO: 2498998 - protein, 28 aa, Entamoeba dispar
NVSITLPLGVEITWKYQVQQENLIIRDE

SEQ ID NO: 2498999 - protein, 17 aa, Entamoeba dispar
NVSLCIPVASYIEDGIK

SEQ ID NO: 2499000 - protein, 24 aa, Entamoeba dispar
NVSNKCFFATYLKREAPHLKVYHD

SEQ ID NO: 2499001 - protein, 29 aa, Entamoeba dispar
NVSSFEVSRPGYGKVMWSNVDLTNVNLDI

SEQ ID NO: 2499002 - protein, 23 aa, Entamoeba dispar
NVSYIRCLINFYASRGKVIELLE

SEQ ID NO: 2499003 - protein, 18 aa, Entamoeba dispar
NVTDLSTMQFEYFTLLLQ

SEQ ID NO: 2499004 - protein, 18 aa, Entamoeba dispar
NVTGKLHLGHALTNSIQD

SEQ ID NO: 2499005 - protein, 18 aa, Entamoeba dispar
NVTICYYDDINFSRFPNL

SEQ ID NO: 2499006 - protein, 18 aa, Entamoeba dispar
NVVAFPLASVSPRSASSD

SEQ ID NO: 2499007 - protein, 17 aa, Entamoeba dispar
NVVCKLEPLTFEASQHP

SEQ ID NO: 2499008 - protein, 20 aa, Entamoeba dispar
NVVEAFSILVQRILEKNPPK

SEQ ID NO: 2499009 - protein, 26 aa, Entamoeba dispar
NVVEEFKKYLPLSLKIKGTDDCVLLD

SEQ ID NO: 2499010 - protein, 24 aa, Entamoeba dispar
NVVFASAIDGWGFDLVAISEVYAK

SEQ ID NO: 2499011 - protein, 19 aa, Entamoeba dispar
NVVFNKEYAYRVSTDSGTS

SEQ ID NO: 2499012 - protein, 27 aa, Entamoeba dispar
NVVKLSLHMYGCRVIQKILEVLSSEEV

SEQ ID NO: 2499013 - protein, 19 aa, Entamoeba dispar
NVVPGCRKLMTNLPGHLDE

SEQ ID NO: 2499014 - protein, 19 aa, Entamoeba dispar
NVVYFRVLMMIPKRDSYFT

SEQ ID NO: 2499015 - protein, 17 aa, Entamoeba dispar
NVWKESSSEEVITMKKD

SEQ ID NO: 2499016 - protein, 24 aa, Entamoeba dispar
NVYEISLFLGMLSKWCNITIERFN

SEQ ID NO: 2499017 - protein, 17 aa, Entamoeba dispar
NVYGFNMTPMRAEVLKE

SEQ ID NO: 2499018 - protein, 18 aa, Entamoeba dispar
NVYKELEGALSVYTPYLV

SEQ ID NO: 2499019 - protein, 20 aa, Entamoeba dispar
NWDFIFPITVLIKSNDRIRT

SEQ ID NO: 2499020 - protein, 36 aa, Entamoeba dispar
NWDIIKLQYKILFKEVKPGLFDCFVKAPNNVIKIVI

SEQ ID NO: 2499021 - protein, 23 aa, Entamoeba dispar
NWEELKGKMVIGYVDDQRRNQLR

SEQ ID NO: 2499022 - protein, 20 aa, Entamoeba dispar
NWFVLCEMRVYLARIETLSL

SEQ ID NO: 2499023 - protein, 23 aa, Entamoeba dispar
NWILPNCVQTIVLHNGSEETIFN

SEQ ID NO: 2499024 - protein, 19 aa, Entamoeba dispar
NWMKMEMEVKFEAIDRGRY

SEQ ID NO: 2499025 - protein, 23 aa, Entamoeba dispar
NWNNCIFYIFDIEDIQKRFNISF

SEQ ID NO: 2499026 - protein, 20 aa, Entamoeba dispar
NWPIINIIWETRIDEVETIK

SEQ ID NO: 2499027 - protein, 26 aa, Entamoeba dispar
NWRVFDCIYCGGLIYPDENEWICHTC

SEQ ID NO: 2499028 - protein, 19 aa, Entamoeba dispar
NWSGYRTQFRYHRQPIDNE

SEQ ID NO: 2499029 - protein, 19 aa, Entamoeba dispar
NWSGYRTQFRYNRQPIDNE

SEQ ID NO: 2499030 - protein, 20 aa, Entamoeba dispar
NWSGYRTQFRYNRQPIDNEV

SEQ ID NO: 2499031 - protein, 19 aa, Entamoeba dispar
NWSIKELLKHGPAVNDSDV

SEQ ID NO: 2499032 - protein, 28 aa, Entamoeba dispar
NWVEQCCKYNGKHIIFLAGNKIDLENRV

SEQ ID NO: 2499033 - protein, 25 aa, Entamoeba dispar
NWYFSLKLIKQISIARDFRYNYAPE

SEQ ID NO: 2499034 - protein, 21 aa, Entamoeba dispar
NYAFIMNVCMLDGFEKLFGTS

SEQ ID NO: 2499035 - protein, 17 aa, Entamoeba dispar
NYAPECPTACILFHSMS

SEQ ID NO: 2499036 - protein, 19 aa, Entamoeba dispar
NYCDFELVEDILFAFTLDG

SEQ ID NO: 2499037 - protein, 20 aa, Entamoeba dispar
NYCFYGCSSLESINIPSSII

SEQ ID NO: 2499038 - protein, 17 aa, Entamoeba dispar
NYCGTNGFEYCGAKNAL

SEQ ID NO: 2499039 - protein, 17 aa, Entamoeba dispar
NYCYPQQPYQGYIGQSQ

SEQ ID NO: 2499040 - protein, 22 aa, Entamoeba dispar
NYDFECLEALRLDDLNDTLTRL

SEQ ID NO: 2499041 - protein, 18 aa, Entamoeba dispar
NYDFKKKPFPPARIRKIT

SEQ ID NO: 2499042 - protein, 21 aa, Entamoeba dispar
NYEKFMPALMQYYKQPQEKHL

SEQ ID NO: 2499043 - protein, 24 aa, Entamoeba dispar
NYEMYRKVCYDFYAKEGEYYRIIN

SEQ ID NO: 2499044 - protein, 21 aa, Entamoeba dispar
NYETLRFLLSNVKYYAEEFGF

SEQ ID NO: 2499045 - protein, 25 aa, Entamoeba dispar
NYETRYEILGGLLAFIRTMDREVEG

SEQ ID NO: 2499046 - protein, 18 aa, Entamoeba dispar
NYFCYIRSEYEKFLLEFT

SEQ ID NO: 2499047 - protein, 19 aa, Entamoeba dispar
NYFRNAMATIIMFDVSNKE

SEQ ID NO: 2499048 - protein, 21 aa, Entamoeba dispar
NYFRNAMGGVIMFDVSNRQSF

SEQ ID NO: 2499049 - protein, 24 aa, Entamoeba dispar
NYGGKRIWNLISLTIGNKIIEAYK

SEQ ID NO: 2499050 - protein, 18 aa, Entamoeba dispar
NYHKRPSTSYLLKHLTEF

SEQ ID NO: 2499051 - protein, 23 aa, Entamoeba dispar
NYHRLEIIINKWFIQKWKLEPKK

SEQ ID NO: 2499052 - protein, 19 aa, Entamoeba dispar
NYIALRLLFEMKVQRNFIN

SEQ ID NO: 2499053 - protein, 17 aa, Entamoeba dispar
NYICPAIEQTIVNQQNM

SEQ ID NO: 2499054 - protein, 27 aa, Entamoeba dispar
NYIFILRFLWILIVHRRARGITTNDIF

SEQ ID NO: 2499055 - protein, 26 aa, Entamoeba dispar
NYIKGELKSVIILGLIHSEGIIIPEP

SEQ ID NO: 2499056 - protein, 20 aa, Entamoeba dispar
NYIKSCPDLGSGNDIKLGTN

SEQ ID NO: 2499057 - protein, 23 aa, Entamoeba dispar
NYINHFNKLFPRFADPINQQQKV

SEQ ID NO: 2499058 - protein, 20 aa, Entamoeba dispar
NYINLIRMFIDYVTPQELIE

SEQ ID NO: 2499059 - protein, 23 aa, Entamoeba dispar
NYKCIRLYKKGMMIEEYINEENL

SEQ ID NO: 2499060 - protein, 23 aa, Entamoeba dispar
NYKGENILMLAIQLGFNDIAFEI

SEQ ID NO: 2499061 - protein, 18 aa, Entamoeba dispar
NYKKCLDKELEFHFPENF

SEQ ID NO: 2499062 - protein, 24 aa, Entamoeba dispar
NYKVKFTMGTIIKEIILIEGNTLS

SEQ ID NO: 2499063 - protein, 18 aa, Entamoeba dispar
NYLAILIDSSCSWKKISC

SEQ ID NO: 2499064 - protein, 24 aa, Entamoeba dispar
NYLAWKYSFEKRGIYLTKESYLKE

SEQ ID NO: 2499065 - protein, 18 aa, Entamoeba dispar
NYLKERTALLSLKNPKFS

SEQ ID NO: 2499066 - protein, 19 aa, Entamoeba dispar
NYLKSPECSCYSDLQLSSD

SEQ ID NO: 2499067 - protein, 19 aa, Entamoeba dispar
NYLLGMICSIYADSYEYMS

SEQ ID NO: 2499068 - protein, 24 aa, Entamoeba dispar
NYLPPPCPLEYPRNVFFQQKAFLK

SEQ ID NO: 2499069 - protein, 17 aa, Entamoeba dispar
NYLRFSKSFNIIGDCFK

SEQ ID NO: 2499070 - protein, 25 aa, Entamoeba dispar
NYLRVTRIFNSLHAFGLKPYMESLF

SEQ ID NO: 2499071 - protein, 18 aa, Entamoeba dispar
NYLSDLFINEARFDEKIT

SEQ ID NO: 2499072 - protein, 26 aa, Entamoeba dispar
NYLSIGLERWFYCYQPYDIVIDDNDN

SEQ ID NO: 2499073 - protein, 18 aa, Entamoeba dispar
NYLVPELIERGGDESLLF

SEQ ID NO: 2499074 - protein, 22 aa, Entamoeba dispar
NYMSGDIIIMVCFMSKGKINII

SEQ ID NO: 2499075 - protein, 24 aa, Entamoeba dispar
NYNFKFFLMYPFLNIPPNYPNHGY

SEQ ID NO: 2499076 - protein, 23 aa, Entamoeba dispar
NYNGRALIIINHFVFKLMKNIEH

SEQ ID NO: 2499077 - protein, 19 aa, Entamoeba dispar
NYNLCHLDALIKRHTKNIQ

SEQ ID NO: 2499078 - protein, 26 aa, Entamoeba dispar
NYNRSEGYYAFCILLKGIDLNLFTFE

SEQ ID NO: 2499079 - protein, 19 aa, Entamoeba dispar
NYNSFGNLICVTHDNVIDV

SEQ ID NO: 2499080 - protein, 19 aa, Entamoeba dispar
NYPESYKFPSRLDLSDEVK

SEQ ID NO: 2499081 - protein, 18 aa, Entamoeba dispar
NYPKCDTVGKKYVRGVKL

SEQ ID NO: 2499082 - protein, 23 aa, Entamoeba dispar
NYPKMEISMYIPIQPDSGSPLKH

SEQ ID NO: 2499083 - protein, 17 aa, Entamoeba dispar
NYPRSSINITSFQTILH

SEQ ID NO: 2499084 - protein, 22 aa, Entamoeba dispar
NYQCAVEGILIALIAQHYSIEI

SEQ ID NO: 2499085 - protein, 24 aa, Entamoeba dispar
NYQKRLDNIITMEAVIRGFLIRRE

SEQ ID NO: 2499086 - protein, 27 aa, Entamoeba dispar
NYRAKGRFPVISWVGPMNQCLSRSAQP

SEQ ID NO: 2499087 - protein, 19 aa, Entamoeba dispar
NYRRSAVLYFGNFHETTVV

SEQ ID NO: 2499088 - protein, 30 aa, Entamoeba dispar
NYSDFEFKKEIGWLVTNCILSIKSPKELLK

SEQ ID NO: 2499089 - protein, 17 aa, Entamoeba dispar
NYSEINQLLPLFIDKFF

SEQ ID NO: 2499090 - protein, 25 aa, Entamoeba dispar
NYSFPTDFICKILLHINRNIKIVEK

SEQ ID NO: 2499091 - protein, 25 aa, Entamoeba dispar
NYSIHFRFLMYYSEENCILLRNNHM

SEQ ID NO: 2499092 - protein, 17 aa, Entamoeba dispar
NYSKLYFFVECLDGVDV

SEQ ID NO: 2499093 - protein, 21 aa, Entamoeba dispar
NYSLKPWLFFNSTNYINDEQL

SEQ ID NO: 2499094 - protein, 17 aa, Entamoeba dispar
NYSPCPLCHELLPPYDG

SEQ ID NO: 2499095 - protein, 20 aa, Entamoeba dispar
NYSTLLLNIFKTAFTDTNKF

SEQ ID NO: 2499096 - protein, 19 aa, Entamoeba dispar
NYTCPSWVDTLPEEEKNKK

SEQ ID NO: 2499097 - protein, 26 aa, Entamoeba dispar
NYTDIKRMDEAIWSEIYLHELDKCGF

SEQ ID NO: 2499098 - protein, 22 aa, Entamoeba dispar
NYYEQHPFYAFFYSEEKEQPEE

SEQ ID NO: 2499099 - protein, 19 aa, Entamoeba dispar
NYYLRVCHATVSLIIDELF

SEQ ID NO: 2499100 - protein, 19 aa, Entamoeba dispar
NYYNGINWIGRVISVNELA

SEQ ID NO: 2499101 - protein, 18 aa, Entamoeba dispar
NYYQKWNLILCGLHANQM

SEQ ID NO: 2499102 - protein, 22 aa, Entamoeba dispar
NYYTPKCTYHYSTKGIKTTIKT

SEQ ID NO: 2499103 - protein, 18 aa, Entamoeba dispar
NYYVIAASCVKGLDEDDE

SEQ ID NO: 2499104 - protein, 22 aa, Entamoeba dispar
PAALVSRFDLLFVLLDDATQDF

SEQ ID NO: 2499105 - protein, 18 aa, Entamoeba dispar
PAAPAALPPKHHQSLNSK

SEQ ID NO: 2499106 - protein, 22 aa, Entamoeba dispar
PACSICHPDRALVEIDHYDELQ

SEQ ID NO: 2499107 - protein, 30 aa, Entamoeba dispar
PAEYEKMKFGIWLKKLQLVLTEESKEIINI

SEQ ID NO: 2499108 - protein, 50 aa, Entamoeba dispar
PAFIQCIKEAFTLFFKERISFGVNVKAMFLFRECVQRCISHRLEIQDQEA

SEQ ID NO: 2499109 - protein, 17 aa, Entamoeba dispar
PAGAVRFEVECEITLDG

SEQ ID NO: 2499110 - protein, 22 aa, Entamoeba dispar
PAGKGTLFLWFAYTPLKNSRKE

SEQ ID NO: 2499111 - protein, 20 aa, Entamoeba dispar
PAIELRRILSTIGDNMEQKE

SEQ ID NO: 2499112 - protein, 17 aa, Entamoeba dispar
PAIIFIKTLLTIFGNQF

SEQ ID NO: 2499113 - protein, 21 aa, Entamoeba dispar
PAIKALNLFHPSSYEGGIDMK

SEQ ID NO: 2499114 - protein, 27 aa, Entamoeba dispar
PAKRRCKCFKSTQLVISEICTDILGTI

SEQ ID NO: 2499115 - protein, 20 aa, Entamoeba dispar
PALAMFGAEILVDWPHVNPY

SEQ ID NO: 2499116 - protein, 20 aa, Entamoeba dispar
PALHYRMAQVLFREKNYIQV

SEQ ID NO: 2499117 - protein, 17 aa, Entamoeba dispar
PALKLHAQNMLRLYMEP

SEQ ID NO: 2499118 - protein, 18 aa, Entamoeba dispar
PAPDIFIRAAELCGEKDM

SEQ ID NO: 2499119 - protein, 29 aa, Entamoeba dispar
PAPEEFFKPLASFIESWKNARKDNAKAKE

SEQ ID NO: 2499120 - protein, 20 aa, Entamoeba dispar
PAQIRYVNYFGELLSKQIYF

SEQ ID NO: 2499121 - protein, 18 aa, Entamoeba dispar
PARNCFFMATYNYNYPIS

SEQ ID NO: 2499122 - protein, 18 aa, Entamoeba dispar
PASFNGLINGCLNNTPQF

SEQ ID NO: 2499123 - protein, 26 aa, Entamoeba dispar
PASIFPKVKLSNFGLCDQFEQTIPNE

SEQ ID NO: 2499124 - protein, 22 aa, Entamoeba dispar
PASKEPTKWELFAKRKGIKKTK

SEQ ID NO: 2499125 - protein, 19 aa, Entamoeba dispar
PASLPGLIRHAALNYSRPV

SEQ ID NO: 2499126 - protein, 26 aa, Entamoeba dispar
PASPFPRLLVSPSCFIIPYILKQKSD

SEQ ID NO: 2499127 - protein, 27 aa, Entamoeba dispar
PATFIFRGNSSFTRLLCYYMEEELQDF

SEQ ID NO: 2499128 - protein, 19 aa, Entamoeba dispar
PATPKLYIHRCGRVARAGR

SEQ ID NO: 2499129 - protein, 18 aa, Entamoeba dispar
PATYRLMPKITVIKQNKK

SEQ ID NO: 2499130 - protein, 19 aa, Entamoeba dispar
PAVEMKYLNPVSGEKFDPV

SEQ ID NO: 2499131 - protein, 18 aa, Entamoeba dispar
PAVFCSIFGLSLDTKTPL

SEQ ID NO: 2499132 - protein, 18 aa, Entamoeba dispar
PAVKWWGMQDDWNLMVME

SEQ ID NO: 2499133 - protein, 23 aa, Entamoeba dispar
PCARRCCFACVLTGAPSLLEPMY

SEQ ID NO: 2499134 - protein, 17 aa, Entamoeba dispar
PCDFIINQEIFKSLEEC

SEQ ID NO: 2499135 - protein, 25 aa, Entamoeba dispar
PCELLDCGKTYLLKFEVPGIDKKSL

SEQ ID NO: 2499136 - protein, 19 aa, Entamoeba dispar
PCFSFVRDIIHAPIIKHFF

SEQ ID NO: 2499137 - protein, 19 aa, Entamoeba dispar
PCGKRCSFNEIVIDSHFIE

SEQ ID NO: 2499138 - protein, 20 aa, Entamoeba dispar
PCGSFTSLGFTFSPYAEPYR

SEQ ID NO: 2499139 - protein, 17 aa, Entamoeba dispar
PCHNLLMEALHNQKSQN

SEQ ID NO: 2499140 - protein, 19 aa, Entamoeba dispar
PCIDCHMRLVSIPDMDYDV

SEQ ID NO: 2499141 - protein, 20 aa, Entamoeba dispar
PCILRRKKGTLVLEIENYGV

SEQ ID NO: 2499142 - protein, 23 aa, Entamoeba dispar
PCIRGCVERVYPIKYKFKNEKGI

SEQ ID NO: 2499143 - protein, 20 aa, Entamoeba dispar
PCKARCQAFRAEVIKRTIKN

SEQ ID NO: 2499144 - protein, 18 aa, Entamoeba dispar
PCLNRQPAVVMKRSVTGN

SEQ ID NO: 2499145 - protein, 20 aa, Entamoeba dispar
PCMQIASSVTSYGRTMIELT

SEQ ID NO: 2499146 - protein, 20 aa, Entamoeba dispar
PCNGYRYGKGLYFANCASKS

SEQ ID NO: 2499147 - protein, 21 aa, Entamoeba dispar
PCNKEECDVFELCGGRCMYAN

SEQ ID NO: 2499148 - protein, 28 aa, Entamoeba dispar
PCNNRSRLSIGLMWWMLTREILRYQGKL

SEQ ID NO: 2499149 - protein, 34 aa, Entamoeba dispar
PCNNRSRLSIGLMWWMLTREILRYQGKLARDEKW

SEQ ID NO: 2499150 - protein, 21 aa, Entamoeba dispar
PCQEIPLAIHQHYLYSSPEYP

SEQ ID NO: 2499151 - protein, 22 aa, Entamoeba dispar
PCTSNIFFGKIFPVACFNNEGT

SEQ ID NO: 2499152 - protein, 25 aa, Entamoeba dispar
PCVCAFPYMFGERGLGIDIDNTVCL

SEQ ID NO: 2499153 - protein, 24 aa, Entamoeba dispar
PCVCAFPYVFGDKGFKADIQNTVC

SEQ ID NO: 2499154 - protein, 22 aa, Entamoeba dispar
PCVKACPCGAMLDSPEGVKTID

SEQ ID NO: 2499155 - protein, 24 aa, Entamoeba dispar
PCYIKGDVKDGCYCIGDNGYCNVC

SEQ ID NO: 2499156 - protein, 18 aa, Entamoeba dispar
PCYRLKDVEQTYKRIFLL

SEQ ID NO: 2499157 - protein, 19 aa, Entamoeba dispar
PDALYLAAIELLQKGTSND

SEQ ID NO: 2499158 - protein, 17 aa, Entamoeba dispar
PDAPVIWRGPKKGAAIE

SEQ ID NO: 2499159 - protein, 22 aa, Entamoeba dispar
PDAYCDRSFTFAHGYLDTPRLH

SEQ ID NO: 2499160 - protein, 24 aa, Entamoeba dispar
PDCILPLIVSTAIELIKGHEPEDT

SEQ ID NO: 2499161 - protein, 27 aa, Entamoeba dispar
PDCKYHTLRMYDHFVFYNHVCIVTELL

SEQ ID NO: 2499162 - protein, 26 aa, Entamoeba dispar
PDDFCCCSVCKIAYCEQHKNKLEIII

SEQ ID NO: 2499163 - protein, 17 aa, Entamoeba dispar
PDDFEFNEQFLLELNDA

SEQ ID NO: 2499164 - protein, 17 aa, Entamoeba dispar
PDDGFSFVRQYKSNVII

SEQ ID NO: 2499165 - protein, 19 aa, Entamoeba dispar
PDDGYDYSQHFAERGNGIF

SEQ ID NO: 2499166 - protein, 24 aa, Entamoeba dispar
PDDYLKPYLRRTTLIKEIIDKNDS

SEQ ID NO: 2499167 - protein, 21 aa, Entamoeba dispar
PDEHTFEWLANVLKHKGKSLD

SEQ ID NO: 2499168 - protein, 21 aa, Entamoeba dispar
PDEMKFMAFDFLKIVKDLDDV

SEQ ID NO: 2499169 - protein, 18 aa, Entamoeba dispar
PDENHYGLKEVNTTINVQ

SEQ ID NO: 2499170 - protein, 20 aa, Entamoeba dispar
PDERILAGLKQFKSHCSQLL

SEQ ID NO: 2499171 - protein, 21 aa, Entamoeba dispar
PDERKTLAFIPFFTTTGHIVL

SEQ ID NO: 2499172 - protein, 23 aa, Entamoeba dispar
PDEWYDSMCHKKYSSIEEYQSVL

SEQ ID NO: 2499173 - protein, 19 aa, Entamoeba dispar
PDFLELFRVGGRVPETNYI

SEQ ID NO: 2499174 - protein, 20 aa, Entamoeba dispar
PDFLEWELPDGINKEEYYNE

SEQ ID NO: 2499175 - protein, 21 aa, Entamoeba dispar
PDFSDDCHIVKGFNQKEETNL

SEQ ID NO: 2499176 - protein, 26 aa, Entamoeba dispar
PDFTYFPQWILDYLHLQPGDAATVLK

SEQ ID NO: 2499177 - protein, 40 aa, Entamoeba dispar
PDFVKWQETWRHVLGINVPWCIDCWQRVYKETSEEFYQTG

SEQ ID NO: 2499178 - protein, 22 aa, Entamoeba dispar
PDGHCELLYFGFLKPVDVEKFK

SEQ ID NO: 2499179 - protein, 27 aa, Entamoeba dispar
PDHKSDEGRSWFNYKGNNIIVIDLNKY

SEQ ID NO: 2499180 - protein, 19 aa, Entamoeba dispar
PDIEARMTLVKTLLNKVKN

SEQ ID NO: 2499181 - protein, 17 aa, Entamoeba dispar
PDIKLDVQIILKSATLN

SEQ ID NO: 2499182 - protein, 18 aa, Entamoeba dispar
PDILCPTTTILILQRNKI

SEQ ID NO: 2499183 - protein, 25 aa, Entamoeba dispar
PDILLRFLYENNLKFIVRSHEVKKY

SEQ ID NO: 2499184 - protein, 26 aa, Entamoeba dispar
PDIRVFVLHIVRWLNRVIRINPIRKV

SEQ ID NO: 2499185 - protein, 19 aa, Entamoeba dispar
PDLDMLVDLFKHFNEQTET

SEQ ID NO: 2499186 - protein, 18 aa, Entamoeba dispar
PDLFNISAAESWEKINKG

SEQ ID NO: 2499187 - protein, 24 aa, Entamoeba dispar
PDLFNISILLKYSYPNYIETQIEN

SEQ ID NO: 2499188 - protein, 19 aa, Entamoeba dispar
PDLIEHFNYWFWDYRSPYW

SEQ ID NO: 2499189 - protein, 20 aa, Entamoeba dispar
PDLLNSFNGTLLRKKSLSEI

SEQ ID NO: 2499190 - protein, 25 aa, Entamoeba dispar
PDLLYIYLRNGRICVHINSTLTASS

SEQ ID NO: 2499191 - protein, 17 aa, Entamoeba dispar
PDLRYMATSDFNNSLNK

SEQ ID NO: 2499192 - protein, 20 aa, Entamoeba dispar
PDLTRICFGNSRLNDEALQK

SEQ ID NO: 2499193 - protein, 18 aa, Entamoeba dispar
PDNSKCLFISSIDHSYKN

SEQ ID NO: 2499194 - protein, 20 aa, Entamoeba dispar
PDNYGQLALHYAAAVGCDIE

SEQ ID NO: 2499195 - protein, 26 aa, Entamoeba dispar
PDPTSPRLICQWIQGIKRIDLDEENG

SEQ ID NO: 2499196 - protein, 20 aa, Entamoeba dispar
PDPYFPYSSFERTIYKQRVD

SEQ ID NO: 2499197 - protein, 18 aa, Entamoeba dispar
PDRAALMFHQERFKKSSF

SEQ ID NO: 2499198 - protein, 23 aa, Entamoeba dispar
PDSEKEKYLEIAKQNKSKERKCF

SEQ ID NO: 2499199 - protein, 30 aa, Entamoeba dispar
PDSEVYHWAVKLKKQFETLWKNAFKEKKTG

SEQ ID NO: 2499200 - protein, 18 aa, Entamoeba dispar
PDSFDYVISKLFSSLTQW

SEQ ID NO: 2499201 - protein, 21 aa, Entamoeba dispar
PDSGKTAFIKRLIDDEFSETK

SEQ ID NO: 2499202 - protein, 23 aa, Entamoeba dispar
PDSKYRKIIMEYKQETEIIEVQH

SEQ ID NO: 2499203 - protein, 17 aa, Entamoeba dispar
PDSPCLILYSTILSNCL

SEQ ID NO: 2499204 - protein, 22 aa, Entamoeba dispar
PDSPMNFTLSFLGKDPISCIYL

SEQ ID NO: 2499205 - protein, 20 aa, Entamoeba dispar
PDSYGKECVDMFRANHKNER

SEQ ID NO: 2499206 - protein, 27 aa, Entamoeba dispar
PDTDKLVECYQLILDVAAWINEKKLYE

SEQ ID NO: 2499207 - protein, 18 aa, Entamoeba dispar
PDTFPIDELIAVKLTFNK

SEQ ID NO: 2499208 - protein, 17 aa, Entamoeba dispar
PDTLDIIGEECFCFCNG

SEQ ID NO: 2499209 - protein, 18 aa, Entamoeba dispar
PDVLKKFISQVIHVLVAL

SEQ ID NO: 2499210 - protein, 44 aa, Entamoeba dispar
PDVLPGYLPTASALPFFISLFSEIKWDDEISCLKEIAINIGKYY

SEQ ID NO: 2499211 - protein, 19 aa, Entamoeba dispar
PDVMMKHPFFKNMDFEMVK

SEQ ID NO: 2499212 - protein, 24 aa, Entamoeba dispar
PDWNQCFRIKGTLGEEIKFHLFDK

SEQ ID NO: 2499213 - protein, 17 aa, Entamoeba dispar
PDYCFKRVQLQETVAVY

SEQ ID NO: 2499214 - protein, 20 aa, Entamoeba dispar
PDYINLRPFTFNKIKDEEYC

SEQ ID NO: 2499215 - protein, 20 aa, Entamoeba dispar
PDYNSEIPFFREVPQGKFNP

SEQ ID NO: 2499216 - protein, 28 aa, Entamoeba dispar
PEAKSVLQGGGMGGLLEQIRQGKKLKKV

SEQ ID NO: 2499217 - protein, 22 aa, Entamoeba dispar
PEALKTMYFMKINDLRKVKELK

SEQ ID NO: 2499218 - protein, 22 aa, Entamoeba dispar
PEALKTMYFMKINDLRKVKIEF

SEQ ID NO: 2499219 - protein, 18 aa, Entamoeba dispar
PEARIHGVLLEKMVGFKY

SEQ ID NO: 2499220 - protein, 21 aa, Entamoeba dispar
PEASCAVESLLKVSSGLEQDE

SEQ ID NO: 2499221 - protein, 23 aa, Entamoeba dispar
PECGPLDALVRPLALAPCTSDTH

SEQ ID NO: 2499222 - protein, 18 aa, Entamoeba dispar
PECGPLDVICRPLVLTPC

SEQ ID NO: 2499223 - protein, 18 aa, Entamoeba dispar
PECIIEWESQGAKKVVVK

SEQ ID NO: 2499224 - protein, 17 aa, Entamoeba dispar
PECKLSYERTKTCLCSV

SEQ ID NO: 2499225 - protein, 18 aa, Entamoeba dispar
PECLICLNNSVKQLFLVG

SEQ ID NO: 2499226 - protein, 21 aa, Entamoeba dispar
PEDAGSLWVGMSLYEIKEGRI

SEQ ID NO: 2499227 - protein, 20 aa, Entamoeba dispar
PEDFLDMDVTEIWQEMEKLV

SEQ ID NO: 2499228 - protein, 20 aa, Entamoeba dispar
PEDGIGLYLPSAKKWLDNGT

SEQ ID NO: 2499229 - protein, 18 aa, Entamoeba dispar
PEDGLFCDLLWSDPMDDS

SEQ ID NO: 2499230 - protein, 22 aa, Entamoeba dispar
PEDLITIPFNMFLKPLSLSPTT

SEQ ID NO: 2499231 - protein, 24 aa, Entamoeba dispar
PEDVIKAVMSATCHKESIIESHLN

SEQ ID NO: 2499232 - protein, 19 aa, Entamoeba dispar
PEDVMELALLCPPEEIEGK

SEQ ID NO: 2499233 - protein, 25 aa, Entamoeba dispar
PEDYCKWTIRLVFGYNKMVSMGVDS

SEQ ID NO: 2499234 - protein, 23 aa, Entamoeba dispar
PEEAAKFHLEYTLRILPHQQNTG

SEQ ID NO: 2499235 - protein, 20 aa, Entamoeba dispar
PEEEVIALICQYLKEQKLQE

SEQ ID NO: 2499236 - protein, 23 aa, Entamoeba dispar
PEEFKRKYLPNVQTKRVKSEAKK

SEQ ID NO: 2499237 - protein, 29 aa, Entamoeba dispar
PEEIKKNEPIICLGLGKPIEQQLFSNNGE

SEQ ID NO: 2499238 - protein, 23 aa, Entamoeba dispar
PEEISGIILKYLYEIAQAKLGNH

SEQ ID NO: 2499239 - protein, 23 aa, Entamoeba dispar
PEEISGIILKYLYEIAQAKLGNQ

SEQ ID NO: 2499240 - protein, 22 aa, Entamoeba dispar
PEEISGMILKYLSFMAKSKLKN

SEQ ID NO: 2499241 - protein, 21 aa, Entamoeba dispar
PEEISGMILKYLYEIAQAKLG

SEQ ID NO: 2499242 - protein, 20 aa, Entamoeba dispar
PEEISGMILKYLYEITQARL

SEQ ID NO: 2499243 - protein, 17 aa, Entamoeba dispar
PEEISGMILKYLYETAQ

SEQ ID NO: 2499244 - protein, 26 aa, Entamoeba dispar
PEEKLRKDRFQNFNWSGHNYLRVTRI

SEQ ID NO: 2499245 - protein, 17 aa, Entamoeba dispar
PEELCKTQSIYINVGEL

SEQ ID NO: 2499246 - protein, 25 aa, Entamoeba dispar
PEELLKDRFNLIVFGHEHCSQVEEG

SEQ ID NO: 2499247 - protein, 25 aa, Entamoeba dispar
PEERGDLYIHFEVVLPSKAQIAQNI

SEQ ID NO: 2499248 - protein, 18 aa, Entamoeba dispar
PEEVLRKLLFSDKPMLLY

SEQ ID NO: 2499249 - protein, 26 aa, Entamoeba dispar
PEEYFRFLWELRLVFNSNLTQLEEVT

SEQ ID NO: 2499250 - protein, 26 aa, Entamoeba dispar
PEEYFRFLWELRMVFNRDLTQLESLV

SEQ ID NO: 2499251 - protein, 23 aa, Entamoeba dispar
PEEYKMVFCVRNDLKMGKGKIAA

SEQ ID NO: 2499252 - protein, 28 aa, Entamoeba dispar
PEFCNKFKIPFLFFKSQHPLYKIKEIYS

SEQ ID NO: 2499253 - protein, 17 aa, Entamoeba dispar
PEFDSIIADCWKVAKAR

SEQ ID NO: 2499254 - protein, 19 aa, Entamoeba dispar
PEFEEFNENIELLIKFITG

SEQ ID NO: 2499255 - protein, 21 aa, Entamoeba dispar
PEFLMKRCIEKGVDPATLKDY

SEQ ID NO: 2499256 - protein, 19 aa, Entamoeba dispar
PEFLNRLDDIIVFSPLSEK

SEQ ID NO: 2499257 - protein, 20 aa, Entamoeba dispar
PEFLNRLDDIIVFTPLSEKE

SEQ ID NO: 2499258 - protein, 19 aa, Entamoeba dispar
PEFLNRLDDITVFSPLSEK

SEQ ID NO: 2499259 - protein, 20 aa, Entamoeba dispar
PEFVNRLDDIIVFSPLSEKE

SEQ ID NO: 2499260 - protein, 25 aa, Entamoeba dispar
PEFYYNLYLFPYLVFIGFTHCHLPI

SEQ ID NO: 2499261 - protein, 22 aa, Entamoeba dispar
PEGAASILCRYSSDEDKANRFH

SEQ ID NO: 2499262 - protein, 21 aa, Entamoeba dispar
PEGCSLEVISITKNIHHKLLL

SEQ ID NO: 2499263 - protein, 26 aa, Entamoeba dispar
PEGDIRTSFKLSQPVFQVCTSKDSLI

SEQ ID NO: 2499264 - protein, 18 aa, Entamoeba dispar
PEGESCGLVKNFSLLTEV

SEQ ID NO: 2499265 - protein, 25 aa, Entamoeba dispar
PEGHRFKGKIRPYVSVPNPLVVEAL

SEQ ID NO: 2499266 - protein, 17 aa, Entamoeba dispar
PEGIELFAVGRKKHLNY

SEQ ID NO: 2499267 - protein, 26 aa, Entamoeba dispar
PEGLRQKIIFYLWTPEGCKIREKMLY

SEQ ID NO: 2499268 - protein, 19 aa, Entamoeba dispar
PEGMTLTPITPGFIQQQKQ

SEQ ID NO: 2499269 - protein, 21 aa, Entamoeba dispar
PEGNCLLRVIATLKRITTTTE

SEQ ID NO: 2499270 - protein, 28 aa, Entamoeba dispar
PEGRRFKGRLHPYVSIPNKHVVDALIEA

SEQ ID NO: 2499271 - protein, 18 aa, Entamoeba dispar
PEHFKQIFQFMKTYFHYH

SEQ ID NO: 2499272 - protein, 17 aa, Entamoeba dispar
PEHLQRFDLLSLLITPI

SEQ ID NO: 2499273 - protein, 17 aa, Entamoeba dispar
PEIAESIGKGFIREGWG

SEQ ID NO: 2499274 - protein, 37 aa, Entamoeba dispar
PEIAESIGKGFIREGWGCLLMNSGIWERVSQGLWKDE

SEQ ID NO: 2499275 - protein, 33 aa, Entamoeba dispar
PEIAESIGKGFIREGWGCLLMNSRIWERVSQGL

SEQ ID NO: 2499276 - protein, 24 aa, Entamoeba dispar
PEICITFGKDCFILVLKKILKDAC

SEQ ID NO: 2499277 - protein, 17 aa, Entamoeba dispar
PEIFRQFFTTSQMIFKY

SEQ ID NO: 2499278 - protein, 23 aa, Entamoeba dispar
PEIICFICISLASKIYEKRRRWI

SEQ ID NO: 2499279 - protein, 21 aa, Entamoeba dispar
PEIIIKVFAFIGEEGPHSKKP

SEQ ID NO: 2499280 - protein, 27 aa, Entamoeba dispar
PEIIISFLRAIRLVTRYTKTNPDIIIP

SEQ ID NO: 2499281 - protein, 21 aa, Entamoeba dispar
PEIKYPFNINFIKQLNIFEIS

SEQ ID NO: 2499282 - protein, 21 aa, Entamoeba dispar
PEIKYSIHIFTNISALSEGLL

SEQ ID NO: 2499283 - protein, 20 aa, Entamoeba dispar
PEILAAGALAKIVNTGYTTL

SEQ ID NO: 2499284 - protein, 22 aa, Entamoeba dispar
PEILPGITAGNCVVSGPGVDGG

SEQ ID NO: 2499285 - protein, 20 aa, Entamoeba dispar
PEILSDFSGITFSKQSSFIS

SEQ ID NO: 2499286 - protein, 31 aa, Entamoeba dispar
PEIPIALRISGHLLLGICRIYSRKVKYLLQD

SEQ ID NO: 2499287 - protein, 22 aa, Entamoeba dispar
PEIPVDTLFHFADVDGDGMIGG

SEQ ID NO: 2499288 - protein, 17 aa, Entamoeba dispar
PEIQFKVGLQSNHLHTL

SEQ ID NO: 2499289 - protein, 37 aa, Entamoeba dispar
PEIRKGSIYEDCIRRDFTINCLFYRIEDGVIEDYTSG

SEQ ID NO: 2499290 - protein, 20 aa, Entamoeba dispar
PEISYKLFFHQLYNILNYGH

SEQ ID NO: 2499291 - protein, 20 aa, Entamoeba dispar
PEKARQVGDMILMMCQRGQM

SEQ ID NO: 2499292 - protein, 27 aa, Entamoeba dispar
PEKIKTHPWWNGFDWDALYQKKIPAPF

SEQ ID NO: 2499293 - protein, 26 aa, Entamoeba dispar
PEKKEFVWKLYHEFEEKCGTTESLME

SEQ ID NO: 2499294 - protein, 23 aa, Entamoeba dispar
PEKLKLVGPHLKNEFKNYVYFTS

SEQ ID NO: 2499295 - protein, 23 aa, Entamoeba dispar
PEKLRPVTFDIPPFITLNEQQKQ

SEQ ID NO: 2499296 - protein, 21 aa, Entamoeba dispar
PEKRNQISFAPPPKRELLPVE

SEQ ID NO: 2499297 - protein, 20 aa, Entamoeba dispar
PEKYGLCSNEQITLKNKRNL

SEQ ID NO: 2499298 - protein, 19 aa, Entamoeba dispar
PELACQCISSLKKITKQCK

SEQ ID NO: 2499299 - protein, 17 aa, Entamoeba dispar
PELAKSIVEEWKNELSE

SEQ ID NO: 2499300 - protein, 19 aa, Entamoeba dispar
PELCLSPRVVRIGVHSKRA

SEQ ID NO: 2499301 - protein, 17 aa, Entamoeba dispar
PELFDFIQTTWKERNNK

SEQ ID NO: 2499302 - protein, 18 aa, Entamoeba dispar
PELHALCCADNMPQTMHN

SEQ ID NO: 2499303 - protein, 23 aa, Entamoeba dispar
PELHCCPDGWEFEQLSMKNKECP

SEQ ID NO: 2499304 - protein, 24 aa, Entamoeba dispar
PELHSGVHLTNWWTEQCDHELLVG

SEQ ID NO: 2499305 - protein, 25 aa, Entamoeba dispar
PELKKELKKVVGFVGVLKEHQPKEN

SEQ ID NO: 2499306 - protein, 20 aa, Entamoeba dispar
PELLLGCTSRCRTIFDTYVK

SEQ ID NO: 2499307 - protein, 30 aa, Entamoeba dispar
PELPNSSARKFICCGPVFAIQNMNDFPSNI

SEQ ID NO: 2499308 - protein, 19 aa, Entamoeba dispar
PELRQITGVLLRKKISVVW

SEQ ID NO: 2499309 - protein, 19 aa, Entamoeba dispar
PELRRHIENDFTIDHAAAY

SEQ ID NO: 2499310 - protein, 17 aa, Entamoeba dispar
PELSFSYSPLIGDDHSS

SEQ ID NO: 2499311 - protein, 19 aa, Entamoeba dispar
PELTLLYKIPETYIKDLLR

SEQ ID NO: 2499312 - protein, 25 aa, Entamoeba dispar
PELVKAEFVWPDFKGQESIDITIPL

SEQ ID NO: 2499313 - protein, 19 aa, Entamoeba dispar
PEMIGHYLGEFSITYKPVT

SEQ ID NO: 2499314 - protein, 20 aa, Entamoeba dispar
PEMIKLYLTTILKIFIAGDE

SEQ ID NO: 2499315 - protein, 18 aa, Entamoeba dispar
PEMKTVYSQFLLTSYQDT

SEQ ID NO: 2499316 - protein, 20 aa, Entamoeba dispar
PEMLRTSLASVILHMKKIGI

SEQ ID NO: 2499317 - protein, 24 aa, Entamoeba dispar
PEMRMAVLKPKLRGDFSSIIELLG

SEQ ID NO: 2499318 - protein, 18 aa, Entamoeba dispar
PENCIQWIEFGGIEASNK

SEQ ID NO: 2499319 - protein, 21 aa, Entamoeba dispar
PENDLLIGLLRLRLPTDEKFM

SEQ ID NO: 2499320 - protein, 22 aa, Entamoeba dispar
PENEFRPLLKTIFDIPQCMGMI

SEQ ID NO: 2499321 - protein, 17 aa, Entamoeba dispar
PENHITIGLREEVPIEN

SEQ ID NO: 2499322 - protein, 17 aa, Entamoeba dispar
PENIIEIMLQYCSETEN

SEQ ID NO: 2499323 - protein, 18 aa, Entamoeba dispar
PENIIREAIKNTSTLDEA

SEQ ID NO: 2499324 - protein, 25 aa, Entamoeba dispar
PENKPRYLMGVGYPVEMLLCVLFGV

SEQ ID NO: 2499325 - protein, 21 aa, Entamoeba dispar
PENRVSWEVLVDGMKQIEDFG

SEQ ID NO: 2499326 - protein, 25 aa, Entamoeba dispar
PENWKQPGCKECISGIEIPQENLWL

SEQ ID NO: 2499327 - protein, 25 aa, Entamoeba dispar
PEPDFPNRLAIYLSIALEPNELCKK

SEQ ID NO: 2499328 - protein, 17 aa, Entamoeba dispar
PEPEFDIELSISTCNET

SEQ ID NO: 2499329 - protein, 19 aa, Entamoeba dispar
PEPFGEVVWELQKCVTQIK

SEQ ID NO: 2499330 - protein, 28 aa, Entamoeba dispar
PEPHLVKLLGNLGCGFDCASLNEIKEVL

SEQ ID NO: 2499331 - protein, 18 aa, Entamoeba dispar
PEPIRLADLISRNLNEII

SEQ ID NO: 2499332 - protein, 21 aa, Entamoeba dispar
PEPPCPIYILATPCTNQLKEP

SEQ ID NO: 2499333 - protein, 20 aa, Entamoeba dispar
PEPRFKTMKAHRIASPVLRE

SEQ ID NO: 2499334 - protein, 19 aa, Entamoeba dispar
PEQIVACSSFPSFQNIYVL

SEQ ID NO: 2499335 - protein, 22 aa, Entamoeba dispar
PEQYLCGLTHDISKEPTRINLD

SEQ ID NO: 2499336 - protein, 25 aa, Entamoeba dispar
PERDLRIIGKMSKLLIDMKIPQARA

SEQ ID NO: 2499337 - protein, 17 aa, Entamoeba dispar
PEREFPFKVYGHSVSAD

SEQ ID NO: 2499338 - protein, 25 aa, Entamoeba dispar
PERFKKFSIQFEDIFVDYSKNLIDE

SEQ ID NO: 2499339 - protein, 19 aa, Entamoeba dispar
PERNEYIFGSVIDVSQMVS

SEQ ID NO: 2499340 - protein, 26 aa, Entamoeba dispar
PESCSPAFWKFLDLIGNKIELNGWSG

SEQ ID NO: 2499341 - protein, 23 aa, Entamoeba dispar
PESDGFDIPSIEGISLEVEDPSN

SEQ ID NO: 2499342 - protein, 17 aa, Entamoeba dispar
PESKLSIIFNNIKKEVE

SEQ ID NO: 2499343 - protein, 19 aa, Entamoeba dispar
PESKLSIIFNNIKKEVEKK

SEQ ID NO: 2499344 - protein, 18 aa, Entamoeba dispar
PESMLALQGTEAILYCIF

SEQ ID NO: 2499345 - protein, 26 aa, Entamoeba dispar
PESPLCPRSSVLLSLSAKVVTIKSLN

SEQ ID NO: 2499346 - protein, 23 aa, Entamoeba dispar
PESPVDFPGLFPYGLSVPPSPDC

SEQ ID NO: 2499347 - protein, 18 aa, Entamoeba dispar
PESRCAIADLLYVVIDRM

SEQ ID NO: 2499348 - protein, 23 aa, Entamoeba dispar
PESVESIILKHCRSTSVLCHSKK

SEQ ID NO: 2499349 - protein, 21 aa, Entamoeba dispar
PESYLINGIFVFGIEYAQLKK

SEQ ID NO: 2499350 - protein, 17 aa, Entamoeba dispar
PETGYGYINYNNNQFIE

SEQ ID NO: 2499351 - protein, 20 aa, Entamoeba dispar
PETLGQLTLVALSLVPSSTN

SEQ ID NO: 2499352 - protein, 18 aa, Entamoeba dispar
PETMIDLRVQIMQDDGSV

SEQ ID NO: 2499353 - protein, 25 aa, Entamoeba dispar
PETQTNLWEGFALRNEKLSEKVSEE

SEQ ID NO: 2499354 - protein, 23 aa, Entamoeba dispar
PETRSKLGPLRRITKTGAGLNKR

SEQ ID NO: 2499355 - protein, 17 aa, Entamoeba dispar
PETTLFVICSKTFTTAE

SEQ ID NO: 2499356 - protein, 17 aa, Entamoeba dispar
PETVKLLITTVEQAVKE

SEQ ID NO: 2499357 - protein, 20 aa, Entamoeba dispar
PETVPAYYLKSWREVKTMFC

SEQ ID NO: 2499358 - protein, 19 aa, Entamoeba dispar
PEVAFACAAMNEIPEQYAY

SEQ ID NO: 2499359 - protein, 21 aa, Entamoeba dispar
PEVEARWVIYQVVSALYYLHS

SEQ ID NO: 2499360 - protein, 24 aa, Entamoeba dispar
PEVEMKFKYGIIQKELTDEEQVKI

SEQ ID NO: 2499361 - protein, 18 aa, Entamoeba dispar
PEVIIVACLCSYREVPQL

SEQ ID NO: 2499362 - protein, 20 aa, Entamoeba dispar
PEVILGLHWGCPVDIWSHGC

SEQ ID NO: 2499363 - protein, 26 aa, Entamoeba dispar
PEVILGLPYSSAIDMWSFGCMAAELF

SEQ ID NO: 2499364 - protein, 21 aa, Entamoeba dispar
PEVILGLPYSTSIDMWSLGCI

SEQ ID NO: 2499365 - protein, 27 aa, Entamoeba dispar
PEVKSLGEYCFYGLKSINIPSTISKIR

SEQ ID NO: 2499366 - protein, 27 aa, Entamoeba dispar
PEVKSLGYDCFRECYSLTTINIPSSIS

SEQ ID NO: 2499367 - protein, 23 aa, Entamoeba dispar
PEVKSLGYECFYECDSLKSVNIP

SEQ ID NO: 2499368 - protein, 20 aa, Entamoeba dispar
PEVKSLGYQCFKGCDRLTSI

SEQ ID NO: 2499369 - protein, 18 aa, Entamoeba dispar
PEVKSVGDYCFYNCDELT

SEQ ID NO: 2499370 - protein, 21 aa, Entamoeba dispar
PEVRTTPAYYSFKSDCWSVGC

SEQ ID NO: 2499371 - protein, 17 aa, Entamoeba dispar
PEVSNEFESRIFDMILM

SEQ ID NO: 2499372 - protein, 21 aa, Entamoeba dispar
PEVTSLGNYCFKYCNELTSIN

SEQ ID NO: 2499373 - protein, 17 aa, Entamoeba dispar
PEVVKMLNHLEVIKEGA

SEQ ID NO: 2499374 - protein, 25 aa, Entamoeba dispar
PEWIPKELLTNIFIKKIISLLTQEH

SEQ ID NO: 2499375 - protein, 18 aa, Entamoeba dispar
PEWISLNLGIVICLECCG

SEQ ID NO: 2499376 - protein, 21 aa, Entamoeba dispar
PEYLFNVNFGDIFVVRSAGGV

SEQ ID NO: 2499377 - protein, 17 aa, Entamoeba dispar
PEYSISLSPSFLPINSA

SEQ ID NO: 2499378 - protein, 18 aa, Entamoeba dispar
PEYTEFLQNFVIPNGELI

SEQ ID NO: 2499379 - protein, 25 aa, Entamoeba dispar
PEYVPICLKELFKYSDYITHHLNYI

SEQ ID NO: 2499380 - protein, 29 aa, Entamoeba dispar
PFADKIWNIRFIKGLSWGRIFEDKESKQI

SEQ ID NO: 2499381 - protein, 17 aa, Entamoeba dispar
PFCIIVMDVNGIWKKFY

SEQ ID NO: 2499382 - protein, 24 aa, Entamoeba dispar
PFDEFFKMIFLQYPPRIVQSLKRH

SEQ ID NO: 2499383 - protein, 18 aa, Entamoeba dispar
PFDGSPMKIIRGSYELPK

SEQ ID NO: 2499384 - protein, 17 aa, Entamoeba dispar
PFDVYKWRMEETNLINK

SEQ ID NO: 2499385 - protein, 25 aa, Entamoeba dispar
PFEIKKPQWANGFEWKNEYDQQIVL

SEQ ID NO: 2499386 - protein, 21 aa, Entamoeba dispar
PFELHFKLLSIKSIFLNIYSH

SEQ ID NO: 2499387 - protein, 29 aa, Entamoeba dispar
PFEYTFAIGLCPLRYKKDKFIGWEENSIG

SEQ ID NO: 2499388 - protein, 17 aa, Entamoeba dispar
PFFTSLMTKHFQTLQYW

SEQ ID NO: 2499389 - protein, 19 aa, Entamoeba dispar
PFGKCPKELLHLSDNNPQS

SEQ ID NO: 2499390 - protein, 18 aa, Entamoeba dispar
PFGLKTLYKNGGPTMFFP

SEQ ID NO: 2499391 - protein, 36 aa, Entamoeba dispar
PFGPHPIEVFALIAALRILCPLNFVLLNPQYPLLNL

SEQ ID NO: 2499392 - protein, 23 aa, Entamoeba dispar
PFHAEARVGITFTENELKEAQSK

SEQ ID NO: 2499393 - protein, 17 aa, Entamoeba dispar
PFHCPFVGCCKAFKRKH

SEQ ID NO: 2499394 - protein, 17 aa, Entamoeba dispar
PFHSIGCEQEIDKFIQN

SEQ ID NO: 2499395 - protein, 19 aa, Entamoeba dispar
PFIDRKTIELHQIDILNDK

SEQ ID NO: 2499396 - protein, 19 aa, Entamoeba dispar
PFIGFQLSEFFEVVDNFHI

SEQ ID NO: 2499397 - protein, 19 aa, Entamoeba dispar
PFIGHPRSLISHKPKEEIH

SEQ ID NO: 2499398 - protein, 17 aa, Entamoeba dispar
PFIHGRPPYYPQKVIDF

SEQ ID NO: 2499399 - protein, 20 aa, Entamoeba dispar
PFIIAGFKYLDKVFTDAQIF

SEQ ID NO: 2499400 - protein, 18 aa, Entamoeba dispar
PFILNNRTPILLIQNPDY

SEQ ID NO: 2499401 - protein, 39 aa, Entamoeba dispar
PFIPILRFRMLKDIKQLPGLYVLMLLDYIFKYIERYPSL

SEQ ID NO: 2499402 - protein, 17 aa, Entamoeba dispar
PFIQLCIERSIKASDEK

SEQ ID NO: 2499403 - protein, 17 aa, Entamoeba dispar
PFISWYSKQVFDNASPQ

SEQ ID NO: 2499404 - protein, 25 aa, Entamoeba dispar
PFKEIPYYLLHPFRSLFIKENSSSN

SEQ ID NO: 2499405 - protein, 21 aa, Entamoeba dispar
PFKIKAFREDFVYGFSTWFDV

SEQ ID NO: 2499406 - protein, 24 aa, Entamoeba dispar
PFKIKIKGLHIISQPQTVFVFDAK

SEQ ID NO: 2499407 - protein, 23 aa, Entamoeba dispar
PFKINRLTVSFGKEGTHVLIPSI

SEQ ID NO: 2499408 - protein, 18 aa, Entamoeba dispar
PFKLCLADFGEACVYRND

SEQ ID NO: 2499409 - protein, 19 aa, Entamoeba dispar
PFKLCLADFGEACVYRNDK

SEQ ID NO: 2499410 - protein, 20 aa, Entamoeba dispar
PFKNCLIKLIQKHIITVDKL

SEQ ID NO: 2499411 - protein, 20 aa, Entamoeba dispar
PFLKSICLTPTVTDSKPPII

SEQ ID NO: 2499412 - protein, 19 aa, Entamoeba dispar
PFLQMLRTYYCSISLDKTF

SEQ ID NO: 2499413 - protein, 23 aa, Entamoeba dispar
PFLQTKLIQLLGILGHNDKANSS

SEQ ID NO: 2499414 - protein, 17 aa, Entamoeba dispar
PFMMNVLLYIRDFRTIT

SEQ ID NO: 2499415 - protein, 18 aa, Entamoeba dispar
PFMPKLQTLTIRFTQKVI

SEQ ID NO: 2499416 - protein, 28 aa, Entamoeba dispar
PFNFPDFFDCFSYSLPTMMEMLVNILSE

SEQ ID NO: 2499417 - protein, 21 aa, Entamoeba dispar
PFNFSKLKLFNPFIPDFLVDV

SEQ ID NO: 2499418 - protein, 20 aa, Entamoeba dispar
PFNGSELLEYCMLDDNELNS

SEQ ID NO: 2499419 - protein, 25 aa, Entamoeba dispar
PFNLRLVQHSTIFLGGPLVKLHDFS

SEQ ID NO: 2499420 - protein, 25 aa, Entamoeba dispar
PFNNQLKVFFKYFAQYLRQRVASRA

SEQ ID NO: 2499421 - protein, 25 aa, Entamoeba dispar
PFNRDILGSFCCHLLNSPAFSGDQS

SEQ ID NO: 2499422 - protein, 23 aa, Entamoeba dispar
PFNRLPPKESYGFVDCGFVMENL

SEQ ID NO: 2499423 - protein, 17 aa, Entamoeba dispar
PFPKTLYPHPWLIADAI

SEQ ID NO: 2499424 - protein, 20 aa, Entamoeba dispar
PFPPCSFPTISSDSNKFGYN

SEQ ID NO: 2499425 - protein, 22 aa, Entamoeba dispar
PFQENLGSVVIHKNSYFESDGQ

SEQ ID NO: 2499426 - protein, 20 aa, Entamoeba dispar
PFQIHKIFYFLYTIGYSSTG

SEQ ID NO: 2499427 - protein, 25 aa, Entamoeba dispar
PFQLPEFQDGFSFSLPYLLEHCVRI

SEQ ID NO: 2499428 - protein, 22 aa, Entamoeba dispar
PFQREMRGVISTAIDENIDALE

SEQ ID NO: 2499429 - protein, 19 aa, Entamoeba dispar
PFRCSKGRFITIGNNTVIN

SEQ ID NO: 2499430 - protein, 18 aa, Entamoeba dispar
PFRKSFRTSKSEDYVRSQ

SEQ ID NO: 2499431 - protein, 26 aa, Entamoeba dispar
PFRMTGTFDGVMSFDHNRFLFNGNAK

SEQ ID NO: 2499432 - protein, 18 aa, Entamoeba dispar
PFRVKKHILTAATEAAEM

SEQ ID NO: 2499433 - protein, 23 aa, Entamoeba dispar
PFSKECIDFVNGPVCLLSEYTAE

SEQ ID NO: 2499434 - protein, 20 aa, Entamoeba dispar
PFSPKPLKSCEINLFNRTDL

SEQ ID NO: 2499435 - protein, 26 aa, Entamoeba dispar
PFSQNFVRIGMNWKQADPSSCYIFDC

SEQ ID NO: 2499436 - protein, 18 aa, Entamoeba dispar
PFSSFKLVSEFITKTPQP

SEQ ID NO: 2499437 - protein, 17 aa, Entamoeba dispar
PFTCPPTEYYLYKKIQS

SEQ ID NO: 2499438 - protein, 18 aa, Entamoeba dispar
PFTIFPKKHRSFMKRWSK

SEQ ID NO: 2499439 - protein, 19 aa, Entamoeba dispar
PFTLGACTFKPINDTSEVK

SEQ ID NO: 2499440 - protein, 26 aa, Entamoeba dispar
PFTPLRLCDLSLPFGVLSQSDDDLAD

SEQ ID NO: 2499441 - protein, 18 aa, Entamoeba dispar
PFTQLIRMNAALEEILDQ

SEQ ID NO: 2499442 - protein, 21 aa, Entamoeba dispar
PFTTLYALRVLDTFDEQTVLY

SEQ ID NO: 2499443 - protein, 23 aa, Entamoeba dispar
PFVDPEIIKTALIDCNYDKNACA

SEQ ID NO: 2499444 - protein, 17 aa, Entamoeba dispar
PFVLGFGSSSGSYSKSG

SEQ ID NO: 2499445 - protein, 18 aa, Entamoeba dispar
PFVVGFSAIQFMQIEPKE

SEQ ID NO: 2499446 - protein, 18 aa, Entamoeba dispar
PFYAEALYQLKSWKELHA

SEQ ID NO: 2499447 - protein, 24 aa, Entamoeba dispar
PFYIPKEFYRLTSYIISHYQQSCF

SEQ ID NO: 2499448 - protein, 19 aa, Entamoeba dispar
PFYRQMHQRMFVEVTDEIQ

SEQ ID NO: 2499449 - protein, 17 aa, Entamoeba dispar
PFYRTISGFAVLIEKDW

SEQ ID NO: 2499450 - protein, 19 aa, Entamoeba dispar
PFYSLKPFTICTWFYIHSF

SEQ ID NO: 2499451 - protein, 27 aa, Entamoeba dispar
PFYTGFPMQRFPQMPIIPPNRQFPPYV

SEQ ID NO: 2499452 - protein, 18 aa, Entamoeba dispar
PGAIRILNYFKRHHIPIA

SEQ ID NO: 2499453 - protein, 18 aa, Entamoeba dispar
PGARELLKNLVGKYELIL

SEQ ID NO: 2499454 - protein, 18 aa, Entamoeba dispar
PGEAYNIMEDAGFILSQF

SEQ ID NO: 2499455 - protein, 24 aa, Entamoeba dispar
PGEYPWLAYIKFEIRIGEIKIAKE

SEQ ID NO: 2499456 - protein, 24 aa, Entamoeba dispar
PGFKKGEVKLIYKITVNRSGLVEV

SEQ ID NO: 2499457 - protein, 17 aa, Entamoeba dispar
PGGEAHGGYSYCAVAAL

SEQ ID NO: 2499458 - protein, 17 aa, Entamoeba dispar
PGIKLAVLGDYDMPLRY

SEQ ID NO: 2499459 - protein, 22 aa, Entamoeba dispar
PGIKRIIKSLIVYNQDKRYSWR

SEQ ID NO: 2499460 - protein, 26 aa, Entamoeba dispar
PGKCRLECKKTCPINRAGGLCIEVLP

SEQ ID NO: 2499461 - protein, 26 aa, Entamoeba dispar
PGKRCECCKCHKDGITAFMLRCPGCL

SEQ ID NO: 2499462 - protein, 25 aa, Entamoeba dispar
PGKVVESFSIWGLPSKFRVTKPFNF

SEQ ID NO: 2499463 - protein, 25 aa, Entamoeba dispar
PGKYHVKLGKKFPVEPYDFTDAQIA

SEQ ID NO: 2499464 - protein, 24 aa, Entamoeba dispar
PGLAKLEPLPGFSDSIKEKIPPIE

SEQ ID NO: 2499465 - protein, 21 aa, Entamoeba dispar
PGLIRHAALNYSRPVYLAPTT

SEQ ID NO: 2499466 - protein, 24 aa, Entamoeba dispar
PGLLKEGEKVILYRTVYKRKGISN

SEQ ID NO: 2499467 - protein, 20 aa, Entamoeba dispar
PGLSSSRVTSRFISKKEEAN

SEQ ID NO: 2499468 - protein, 24 aa, Entamoeba dispar
PGLVPRCLELLFQKKTKTASVSLS

SEQ ID NO: 2499469 - protein, 22 aa, Entamoeba dispar
PGMKQRFIKEITILSPPTIQIS

SEQ ID NO: 2499470 - protein, 26 aa, Entamoeba dispar
PGMPPPPPGGFGFRPAAPKPNAYVTM

SEQ ID NO: 2499471 - protein, 30 aa, Entamoeba dispar
PGMPPPPPGGFGFRPAAPVINGLVDTLPKP

SEQ ID NO: 2499472 - protein, 29 aa, Entamoeba dispar
PGNIIACGGHSLFNWSFFPPSTFISNVSS

SEQ ID NO: 2499473 - protein, 24 aa, Entamoeba dispar
PGQLKLFIDRTVMMMDWNTYSAKQ

SEQ ID NO: 2499474 - protein, 19 aa, Entamoeba dispar
PGQMIRPVIHRATGNIVNI

SEQ ID NO: 2499475 - protein, 23 aa, Entamoeba dispar
PGSGAALSLAEMIAAKQGKLKAT

SEQ ID NO: 2499476 - protein, 25 aa, Entamoeba dispar
PGSGFGCKGFYRISICQTPEYIQSI

SEQ ID NO: 2499477 - protein, 17 aa, Entamoeba dispar
PGSKFLEKMGFLMVGEY

SEQ ID NO: 2499478 - protein, 31 aa, Entamoeba dispar
PGTFRNSSQFVLLMKRIVNFFREKLHEAPTK

SEQ ID NO: 2499479 - protein, 26 aa, Entamoeba dispar
PGVCNSKSPIGFNLSNAFTALSYNTS

SEQ ID NO: 2499480 - protein, 32 aa, Entamoeba dispar
PGVEKYIYPPAIPKLKGNWLVDKEKSGSSSLF

SEQ ID NO: 2499481 - protein, 24 aa, Entamoeba dispar
PGVEMLYPHYIRYIYEVVTKVNPQ

SEQ ID NO: 2499482 - protein, 17 aa, Entamoeba dispar
PGVSCALLMAISSMTYT

SEQ ID NO: 2499483 - protein, 19 aa, Entamoeba dispar
PGVYKVTAIYDWIKNNKTA

SEQ ID NO: 2499484 - protein, 23 aa, Entamoeba dispar
PHAFPSRMTIAMLVESMASKVGA

SEQ ID NO: 2499485 - protein, 30 aa, Entamoeba dispar
PHCPTDYVCVGVCALFNLAIIPSIRTLINT

SEQ ID NO: 2499486 - protein, 20 aa, Entamoeba dispar
PHDFPFPPIFPLYQPSLRSQ

SEQ ID NO: 2499487 - protein, 18 aa, Entamoeba dispar
PHEELLRHSIPVIEHINN

SEQ ID NO: 2499488 - protein, 22 aa, Entamoeba dispar
PHFCPDCHQIMLPRSCGDDLYF

SEQ ID NO: 2499489 - protein, 26 aa, Entamoeba dispar
PHFKVSCYCGHEFCFGCGRERHEPAS

SEQ ID NO: 2499490 - protein, 25 aa, Entamoeba dispar
PHFLGQDILRLQGIFERAKQVKSIK

SEQ ID NO: 2499491 - protein, 29 aa, Entamoeba dispar
PHGCSLHTVEIKSGSFIDHLNKDELLFWV

SEQ ID NO: 2499492 - protein, 25 aa, Entamoeba dispar
PHGDVYRCLFKKTKAVVKFFSKADS

SEQ ID NO: 2499493 - protein, 25 aa, Entamoeba dispar
PHGIPLDLLDRLLVIVTKQYTLQEL

SEQ ID NO: 2499494 - protein, 22 aa, Entamoeba dispar
PHGTRSFFHGKFSLKYKSKDHQ

SEQ ID NO: 2499495 - protein, 24 aa, Entamoeba dispar
PHHLRCLRKSLFISKQQHYHSVHI

SEQ ID NO: 2499496 - protein, 17 aa, Entamoeba dispar
PHIRLFKDYSSGNYSVN

SEQ ID NO: 2499497 - protein, 18 aa, Entamoeba dispar
PHISSFIGNGEFTETLSI

SEQ ID NO: 2499498 - protein, 18 aa, Entamoeba dispar
PHKCLRTVEFYRQAPTED

SEQ ID NO: 2499499 - protein, 19 aa, Entamoeba dispar
PHKLLGCVGQHDFPIERLA

SEQ ID NO: 2499500 - protein, 25 aa, Entamoeba dispar
PHKRSTTTMQCFPISKIRLRQQIIW

SEQ ID NO: 2499501 - protein, 23 aa, Entamoeba dispar
PHLDKRYPKGFIIDKETELPAIG

SEQ ID NO: 2499502 - protein, 20 aa, Entamoeba dispar
PHLLCVFPVPIISEKDEYYV

SEQ ID NO: 2499503 - protein, 21 aa, Entamoeba dispar
PHLLLIEGMLNKYCRKGIKKR

SEQ ID NO: 2499504 - protein, 31 aa, Entamoeba dispar
PHLSFKLVKFTSVLEEYWSVVVFHVSVESSN

SEQ ID NO: 2499505 - protein, 28 aa, Entamoeba dispar
PHMLTIPSGLCWGCVMLTEVILPSCLRS

SEQ ID NO: 2499506 - protein, 19 aa, Entamoeba dispar
PHMVMAPVFTKYVEDGIKN

SEQ ID NO: 2499507 - protein, 18 aa, Entamoeba dispar
PHNFKDCIEWAREKYDIN

SEQ ID NO: 2499508 - protein, 18 aa, Entamoeba dispar
PHNFKECIEWAREKYDIN

SEQ ID NO: 2499509 - protein, 20 aa, Entamoeba dispar
PHPFCDKGRFVCLFVTECYV

SEQ ID NO: 2499510 - protein, 17 aa, Entamoeba dispar
PHPIFGISLKDANKSNY

SEQ ID NO: 2499511 - protein, 24 aa, Entamoeba dispar
PHPLRCLRKSLFITQQRQWDSVHI

SEQ ID NO: 2499512 - protein, 18 aa, Entamoeba dispar
PHQHMLIVLKRPRSFKAR

SEQ ID NO: 2499513 - protein, 19 aa, Entamoeba dispar
PHQRMEIVNLMSKIMDFTE

SEQ ID NO: 2499514 - protein, 26 aa, Entamoeba dispar
PHQTDCLCFLLPSCCPVSQSQIICRF

SEQ ID NO: 2499515 - protein, 33 aa, Entamoeba dispar
PHQTDCLCFLLPSCCPVSQSQILCRFYKEQMRN

SEQ ID NO: 2499516 - protein, 21 aa, Entamoeba dispar
PHRSLPPKPVRSSAINSPLTT

SEQ ID NO: 2499517 - protein, 27 aa, Entamoeba dispar
PHSFICCARGPSIVKMYSFLTNQLLNS

SEQ ID NO: 2499518 - protein, 20 aa, Entamoeba dispar
PHSFKARPIINHSDGTKQTF

SEQ ID NO: 2499519 - protein, 19 aa, Entamoeba dispar
PHSQYSPVFHQFIECVFIL

SEQ ID NO: 2499520 - protein, 24 aa, Entamoeba dispar
PHSSRKESLRKFPMKQKRFSKQSS

SEQ ID NO: 2499521 - protein, 29 aa, Entamoeba dispar
PHSVYDFFLRLPLSISSFHFYDSSGNIST

SEQ ID NO: 2499522 - protein, 24 aa, Entamoeba dispar
PHVNPYANAPMRFIPTVTDGVIII

SEQ ID NO: 2499523 - protein, 35 aa, Entamoeba dispar
PHVNRYVRRKDTDMCIVLGCDGVWDVLSNSKVADI

SEQ ID NO: 2499524 - protein, 30 aa, Entamoeba dispar
PHVSTINITIFWHRLHLFNEEIIEGITSFD

SEQ ID NO: 2499525 - protein, 28 aa, Entamoeba dispar
PIADRLKTRPAFVLFIKHFYIYVLQITP

SEQ ID NO: 2499526 - protein, 18 aa, Entamoeba dispar
PIAGCYAPIKSVELSPNN

SEQ ID NO: 2499527 - protein, 25 aa, Entamoeba dispar
PIALLRGHSDWVFGSKFIDEDVLFS

SEQ ID NO: 2499528 - protein, 17 aa, Entamoeba dispar
PIAPMSWILEGKEPTRE

SEQ ID NO: 2499529 - protein, 20 aa, Entamoeba dispar
PICESKSFKPSYIVAIQWSK

SEQ ID NO: 2499530 - protein, 23 aa, Entamoeba dispar
PICKDPRTADDMARSLQALRNLS

SEQ ID NO: 2499531 - protein, 19 aa, Entamoeba dispar
PICRTRFSNKLNHKKEINL

SEQ ID NO: 2499532 - protein, 24 aa, Entamoeba dispar
PIDHCFLIEDFIRQFVKLIDQNQL

SEQ ID NO: 2499533 - protein, 19 aa, Entamoeba dispar
PIDICISSFSTLRILDLSS

SEQ ID NO: 2499534 - protein, 26 aa, Entamoeba dispar
PIDIFNIINPLPFVLSSIHLFNESST

SEQ ID NO: 2499535 - protein, 24 aa, Entamoeba dispar
PIDISLPLYHSFPLINSYMSKPFP

SEQ ID NO: 2499536 - protein, 27 aa, Entamoeba dispar
PIDNRSWILGAHCCFYIGSKDNSFISP

SEQ ID NO: 2499537 - protein, 20 aa, Entamoeba dispar
PIDQVSWVGLYTVDGPLGRK

SEQ ID NO: 2499538 - protein, 22 aa, Entamoeba dispar
PIDREKIQLVSWLNQQLLTDKK

SEQ ID NO: 2499539 - protein, 18 aa, Entamoeba dispar
PIDYNIFEQILFNYWSFI

SEQ ID NO: 2499540 - protein, 25 aa, Entamoeba dispar
PIECKHLRIGIQLDDLSVFEPIEIE

SEQ ID NO: 2499541 - protein, 24 aa, Entamoeba dispar
PIEKAKILRDVYCVIENIVRQLIK

SEQ ID NO: 2499542 - protein, 24 aa, Entamoeba dispar
PIEKIKLIGKQVWILQKTGDIKVY

SEQ ID NO: 2499543 - protein, 24 aa, Entamoeba dispar
PIELFKRKKVVTSIVEDPCERIVS

SEQ ID NO: 2499544 - protein, 41 aa, Entamoeba dispar
PIELQEFYLKSEWKFADDLRLMLQIAKYGIGVYELYLNDSL

SEQ ID NO: 2499545 - protein, 25 aa, Entamoeba dispar
PIELRDIIFYRSLYRCLNTDLPSNS

SEQ ID NO: 2499546 - protein, 21 aa, Entamoeba dispar
PIELRERIIGLIIGQAVGDAV

SEQ ID NO: 2499547 - protein, 24 aa, Entamoeba dispar
PIEMELIQFIKLIIEYFSKEIDFP

SEQ ID NO: 2499548 - protein, 24 aa, Entamoeba dispar
PIEVMKKLLAPLGLEQYAEVFICF

SEQ ID NO: 2499549 - protein, 28 aa, Entamoeba dispar
PIFCSLCKTKRVCILYPSFSDIYYVFSQ

SEQ ID NO: 2499550 - protein, 28 aa, Entamoeba dispar
PIFDQICLAFRSVLRRESNLIVDIIETF

SEQ ID NO: 2499551 - protein, 21 aa, Entamoeba dispar
PIFNLRVSCNKVILNNSTRVN

SEQ ID NO: 2499552 - protein, 27 aa, Entamoeba dispar
PIFPSKHSCCAACWSDTTLFVGGTTKQ

SEQ ID NO: 2499553 - protein, 17 aa, Entamoeba dispar
PIFSIGIVLNTLNKRFN

SEQ ID NO: 2499554 - protein, 17 aa, Entamoeba dispar
PIFSIGMVLNTLNKRFD

SEQ ID NO: 2499555 - protein, 25 aa, Entamoeba dispar
PIFYDLAFCKLRRTLYAKALLIKYS

SEQ ID NO: 2499556 - protein, 18 aa, Entamoeba dispar
PIGDVKGKHIVIYDDLTR

SEQ ID NO: 2499557 - protein, 21 aa, Entamoeba dispar
PIGELMKKYLDSFNVYTEYFS

SEQ ID NO: 2499558 - protein, 19 aa, Entamoeba dispar
PIGICSGLLVSILLSLKIL

SEQ ID NO: 2499559 - protein, 19 aa, Entamoeba dispar
PIGKLRTGDLIEIKIDCRE

SEQ ID NO: 2499560 - protein, 20 aa, Entamoeba dispar
PIGTSFTFKCHGKFDKGSLD

SEQ ID NO: 2499561 - protein, 18 aa, Entamoeba dispar
PIHICIRLNQIELICCDG

SEQ ID NO: 2499562 - protein, 18 aa, Entamoeba dispar
PIHKEFESSIQLHLKSNL

SEQ ID NO: 2499563 - protein, 19 aa, Entamoeba dispar
PIHYWRYRCHVDMDEIIAD

SEQ ID NO: 2499564 - protein, 25 aa, Entamoeba dispar
PIIFSCGIIKICIILIKKSQVKFYT

SEQ ID NO: 2499565 - protein, 19 aa, Entamoeba dispar
PIIISRASMNPEITVGNKE

SEQ ID NO: 2499566 - protein, 19 aa, Entamoeba dispar
PIILLKCVCAMLYRSSVVK

SEQ ID NO: 2499567 - protein, 19 aa, Entamoeba dispar
PIISIDCYEDLILTISSDF

SEQ ID NO: 2499568 - protein, 27 aa, Entamoeba dispar
PIITVILNYPEYCLAPPKTNEEDVFVI

SEQ ID NO: 2499569 - protein, 23 aa, Entamoeba dispar
PIKSHCLKSLVLALKYVKTLPSS

SEQ ID NO: 2499570 - protein, 18 aa, Entamoeba dispar
PIKVCKILKDAGINDIEI

SEQ ID NO: 2499571 - protein, 18 aa, Entamoeba dispar
PIKVIEIINFIYFNLNGQ

SEQ ID NO: 2499572 - protein, 19 aa, Entamoeba dispar
PIKVIEIINFIYFNLNGQL

SEQ ID NO: 2499573 - protein, 27 aa, Entamoeba dispar
PILKEIIKSCFVIINILPQYFIQQQFI

SEQ ID NO: 2499574 - protein, 18 aa, Entamoeba dispar
PILSISIPFGDTIPKLPF

SEQ ID NO: 2499575 - protein, 22 aa, Entamoeba dispar
PILSSTPFEFGLMVKQYFTQKI

SEQ ID NO: 2499576 - protein, 25 aa, Entamoeba dispar
PIMALERRISRMFTFGNGNENIINA

SEQ ID NO: 2499577 - protein, 19 aa, Entamoeba dispar
PINCSWGVTIELCQTPYEV

SEQ ID NO: 2499578 - protein, 23 aa, Entamoeba dispar
PINIGYRNRMDYTFGDGYIGGPL

SEQ ID NO: 2499579 - protein, 18 aa, Entamoeba dispar
PINLEFEKVFFPYLLISK

SEQ ID NO: 2499580 - protein, 24 aa, Entamoeba dispar
PINSARPNIHFFLYKPRLIGSKCV

SEQ ID NO: 2499581 - protein, 25 aa, Entamoeba dispar
PIPAILKPVPKWTGKQVFTQILPTI

SEQ ID NO: 2499582 - protein, 22 aa, Entamoeba dispar
PIPKLYVSELIQLLKSKKIIVR

SEQ ID NO: 2499583 - protein, 26 aa, Entamoeba dispar
PIPLEFTNKCELDYLGVKNVLCGVDL

SEQ ID NO: 2499584 - protein, 25 aa, Entamoeba dispar
PIPNAPLKPGKGIDDCEMITKDPKH

SEQ ID NO: 2499585 - protein, 26 aa, Entamoeba dispar
PIQCASIPIALKMRDLIALAETGTGK

SEQ ID NO: 2499586 - protein, 22 aa, Entamoeba dispar
PIQFCSTIKRLIINGDKVSLPL

SEQ ID NO: 2499587 - protein, 28 aa, Entamoeba dispar
PIQRIPRYRLLLKELMKTVPQQHNEYKE

SEQ ID NO: 2499588 - protein, 27 aa, Entamoeba dispar
PIQRIPRYVLLISDLLRNISMLFGDAP

SEQ ID NO: 2499589 - protein, 24 aa, Entamoeba dispar
PIQRLPRYRLLLKDLLKHLRPSDI

SEQ ID NO: 2499590 - protein, 25 aa, Entamoeba dispar
PIQRPPRYKLLLGAVRDSLPSWWNK

SEQ ID NO: 2499591 - protein, 24 aa, Entamoeba dispar
PIQSIEIMSLLPFINANDFIIVSI

SEQ ID NO: 2499592 - protein, 20 aa, Entamoeba dispar
PIRELRAAKIGKLVRVKGIV

SEQ ID NO: 2499593 - protein, 23 aa, Entamoeba dispar
PISDFWEHVSIVWAKCFCDISPK

SEQ ID NO: 2499594 - protein, 30 aa, Entamoeba dispar
PISDSICPANIFDFSKFRVLLYINSSYQPL

SEQ ID NO: 2499595 - protein, 24 aa, Entamoeba dispar
PISEPWEVQSFFTICDTCISTSPT

SEQ ID NO: 2499596 - protein, 28 aa, Entamoeba dispar
PISFALELYGRFYPIIPLKFTEGEFKWL

SEQ ID NO: 2499597 - protein, 23 aa, Entamoeba dispar
PISFWKEFKDFLKVNELTMNELM

SEQ ID NO: 2499598 - protein, 27 aa, Entamoeba dispar
PISGLRLSMKSSYPFFSEKFILSGNQN

SEQ ID NO: 2499599 - protein, 19 aa, Entamoeba dispar
PISIISIGNKCFKNCFKLK

SEQ ID NO: 2499600 - protein, 20 aa, Entamoeba dispar
PISLLLKRYIEQVVSLLPQF

SEQ ID NO: 2499601 - protein, 20 aa, Entamoeba dispar
PISLQGRSCFTIIRDPSVRS

SEQ ID NO: 2499602 - protein, 17 aa, Entamoeba dispar
PISPIGLELSSYDIHGF

SEQ ID NO: 2499603 - protein, 17 aa, Entamoeba dispar
PISSLFFDVLQKNRIRC

SEQ ID NO: 2499604 - protein, 25 aa, Entamoeba dispar
PISVKSLRLFPQIKTQYLFNKNDKK

SEQ ID NO: 2499605 - protein, 17 aa, Entamoeba dispar
PITIKWKNEEKVTVNYK

SEQ ID NO: 2499606 - protein, 19 aa, Entamoeba dispar
PITISKLGDYCFYKCISLK

SEQ ID NO: 2499607 - protein, 25 aa, Entamoeba dispar
PITLFGRGCFYKCGCKEELMKNKRI

SEQ ID NO: 2499608 - protein, 23 aa, Entamoeba dispar
PITPPLRPKYFLGDKPLYDAPKY

SEQ ID NO: 2499609 - protein, 32 aa, Entamoeba dispar
PITSNPFFKVLRKEYLKADGFEKNFIATLFEN

SEQ ID NO: 2499610 - protein, 21 aa, Entamoeba dispar
PIVETCKTYQQLFENIEETTK

SEQ ID NO: 2499611 - protein, 19 aa, Entamoeba dispar
PIVKCLHNAIPKAFLDCHL

SEQ ID NO: 2499612 - protein, 18 aa, Entamoeba dispar
PIYCFLFEDTILLISSEQ

SEQ ID NO: 2499613 - protein, 17 aa, Entamoeba dispar
PIYEGYGTLLLHLVTAN

SEQ ID NO: 2499614 - protein, 17 aa, Entamoeba dispar
PIYHVAMEEYKFQKERK

SEQ ID NO: 2499615 - protein, 30 aa, Entamoeba dispar
PIYICSSCSNVFCAECQRVIADITKTNIQQ

SEQ ID NO: 2499616 - protein, 19 aa, Entamoeba dispar
PIYKIVGICLSKEGKELKQ

SEQ ID NO: 2499617 - protein, 25 aa, Entamoeba dispar
PIYNAAMLPPGWSIGQDYGEWYFID

SEQ ID NO: 2499618 - protein, 20 aa, Entamoeba dispar
PIYSKIADRLGIPYLTKTLN

SEQ ID NO: 2499619 - protein, 18 aa, Entamoeba dispar
PIYYPKIYNSGVTFYDGK

SEQ ID NO: 2499620 - protein, 19 aa, Entamoeba dispar
PKAESNLTITKEEPEQDNG

SEQ ID NO: 2499621 - protein, 18 aa, Entamoeba dispar
PKAKVCSTADMVVVHEVD

SEQ ID NO: 2499622 - protein, 25 aa, Entamoeba dispar
PKARNAQQLRIMLMEASVNISNIEK

SEQ ID NO: 2499623 - protein, 23 aa, Entamoeba dispar
PKCAKCGKPLVGNFVTCGGRNWH

SEQ ID NO: 2499624 - protein, 27 aa, Entamoeba dispar
PKDADVIICGQLKHHLTLREKKNDNVQ

SEQ ID NO: 2499625 - protein, 26 aa, Entamoeba dispar
PKDEAHLIAFMAIRTFFAKKQPILIN

SEQ ID NO: 2499626 - protein, 19 aa, Entamoeba dispar
PKDELKKEEVIPIKKGDIW

SEQ ID NO: 2499627 - protein, 20 aa, Entamoeba dispar
PKDIFPFPWNIAEFISQGNR

SEQ ID NO: 2499628 - protein, 25 aa, Entamoeba dispar
PKDIKKLMIEMCKHSFEKKSRGYME

SEQ ID NO: 2499629 - protein, 19 aa, Entamoeba dispar
PKDKIKEIVEMFGNDFDSV

SEQ ID NO: 2499630 - protein, 19 aa, Entamoeba dispar
PKDTGNCMSFAQPPPSKIK

SEQ ID NO: 2499631 - protein, 20 aa, Entamoeba dispar
PKDVGCFIKALGDLKIIFSA

SEQ ID NO: 2499632 - protein, 17 aa, Entamoeba dispar
PKEAIVVSYKKGSRIFS

SEQ ID NO: 2499633 - protein, 18 aa, Entamoeba dispar
PKECCHFISATYSPKSFL

SEQ ID NO: 2499634 - protein, 18 aa, Entamoeba dispar
PKEEIIFHIFGHDLVTKD

SEQ ID NO: 2499635 - protein, 18 aa, Entamoeba dispar
PKEFCFGSSESDDGSCEI

SEQ ID NO: 2499636 - protein, 20 aa, Entamoeba dispar
PKEFWKALGEKEGKIKSAED

SEQ ID NO: 2499637 - protein, 24 aa, Entamoeba dispar
PKEIKREFICCGPMYVVNDRVSLP

SEQ ID NO: 2499638 - protein, 22 aa, Entamoeba dispar
PKEIPNLTSLFIKSPVLLKMYL

SEQ ID NO: 2499639 - protein, 23 aa, Entamoeba dispar
PKEITSKLVEIWNGMSEEEKAKF

SEQ ID NO: 2499640 - protein, 29 aa, Entamoeba dispar
PKEIVFKVKYKLVLQIVQQFYKEGKSIEI

SEQ ID NO: 2499641 - protein, 19 aa, Entamoeba dispar
PKEKTGIVYIEAMTERKFA

SEQ ID NO: 2499642 - protein, 24 aa, Entamoeba dispar
PKELEYDKRIEIFKTYIHNDIKCH

SEQ ID NO: 2499643 - protein, 20 aa, Entamoeba dispar
PKELLKAISNLELRNKNVNL

SEQ ID NO: 2499644 - protein, 23 aa, Entamoeba dispar
PKENYRCVIPLGVDPAKYDKAFP

SEQ ID NO: 2499645 - protein, 25 aa, Entamoeba dispar
PKEPKLSSRHSLKHTISPTSSKPNR

SEQ ID NO: 2499646 - protein, 18 aa, Entamoeba dispar
PKERIMVAYCGIHKIFMC

SEQ ID NO: 2499647 - protein, 20 aa, Entamoeba dispar
PKERITIKEVVRMLERIENK

SEQ ID NO: 2499648 - protein, 19 aa, Entamoeba dispar
PKESVKWLLSATINDDIET

SEQ ID NO: 2499649 - protein, 24 aa, Entamoeba dispar
PKETNTICNLIWTSLQGKYPDDAK

SEQ ID NO: 2499650 - protein, 23 aa, Entamoeba dispar
PKEYCSILKYIIEHETVNLNKQE

SEQ ID NO: 2499651 - protein, 23 aa, Entamoeba dispar
PKFCTNCGAKLSGGKFCSECGAP

SEQ ID NO: 2499652 - protein, 18 aa, Entamoeba dispar
PKFLEPLPKLSRPTLKRT

SEQ ID NO: 2499653 - protein, 18 aa, Entamoeba dispar
PKFPEFFTDEMKEFIPVI

SEQ ID NO: 2499654 - protein, 17 aa, Entamoeba dispar
PKFPFTISKRVKSKTVH

SEQ ID NO: 2499655 - protein, 19 aa, Entamoeba dispar
PKFSFDLSEFTSLTSLSLI

SEQ ID NO: 2499656 - protein, 21 aa, Entamoeba dispar
PKGCPCGYDLLKEVRECMKKD

SEQ ID NO: 2499657 - protein, 20 aa, Entamoeba dispar
PKGFMKYCGQIQRIELPQSI

SEQ ID NO: 2499658 - protein, 20 aa, Entamoeba dispar
PKGIIPFQLPTMEDIKLFEG

SEQ ID NO: 2499659 - protein, 20 aa, Entamoeba dispar
PKGILAYQFPPPISAIKLTP

SEQ ID NO: 2499660 - protein, 21 aa, Entamoeba dispar
PKGSDCYYMKFGVTPNTTSYE

SEQ ID NO: 2499661 - protein, 19 aa, Entamoeba dispar
PKGTRKWECISRKSKKLSG

SEQ ID NO: 2499662 - protein, 18 aa, Entamoeba dispar
PKGVGALFIRAGKPITPL

SEQ ID NO: 2499663 - protein, 19 aa, Entamoeba dispar
PKIASLILSIGFDRLESLA

SEQ ID NO: 2499664 - protein, 18 aa, Entamoeba dispar
PKIFEYPAYISTLHFPYY

SEQ ID NO: 2499665 - protein, 25 aa, Entamoeba dispar
PKIIHFKCPFDFSLLNDNEITKFNK

SEQ ID NO: 2499666 - protein, 24 aa, Entamoeba dispar
PKIKEMKRRIWYARHSEPYFEDEN

SEQ ID NO: 2499667 - protein, 27 aa, Entamoeba dispar
PKIKNAGILLMRTGLFGSDSIATVGIY

SEQ ID NO: 2499668 - protein, 26 aa, Entamoeba dispar
PKIKRIGKSCFSHCSQLKKVVIPPTI

SEQ ID NO: 2499669 - protein, 21 aa, Entamoeba dispar
PKILPCRATVKQLYQPHSDKE

SEQ ID NO: 2499670 - protein, 22 aa, Entamoeba dispar
PKINKIGSFSFEGCYNLTYIEF

SEQ ID NO: 2499671 - protein, 23 aa, Entamoeba dispar
PKISKPLFVFPFQTTTTIPHLSK

SEQ ID NO: 2499672 - protein, 17 aa, Entamoeba dispar
PKISSPLNMKHCNDELI

SEQ ID NO: 2499673 - protein, 29 aa, Entamoeba dispar
PKITAYDRMICSYKLAFISTLGYEVDYGM

SEQ ID NO: 2499674 - protein, 25 aa, Entamoeba dispar
PKKCHLCGSSSFIPMRNTVKITETQ

SEQ ID NO: 2499675 - protein, 17 aa, Entamoeba dispar
PKKCISFGEDGRALINQ

SEQ ID NO: 2499676 - protein, 25 aa, Entamoeba dispar
PKKDFLRKFLFEPFPLESYFETVMA

SEQ ID NO: 2499677 - protein, 21 aa, Entamoeba dispar
PKKEIEWLMRISWNKGNKSRY

SEQ ID NO: 2499678 - protein, 26 aa, Entamoeba dispar
PKKIPKKRLIPIKNFQKIRKHNLRPR

SEQ ID NO: 2499679 - protein, 20 aa, Entamoeba dispar
PKKIVVFVVGGITFGEIASL

SEQ ID NO: 2499680 - protein, 21 aa, Entamoeba dispar
PKKKRKASVGSVFKGIGEALT

SEQ ID NO: 2499681 - protein, 18 aa, Entamoeba dispar
PKKMDMHLVYDVCHNIAK

SEQ ID NO: 2499682 - protein, 22 aa, Entamoeba dispar
PKKQQQVLCRFELKQLFLQAPM

SEQ ID NO: 2499683 - protein, 23 aa, Entamoeba dispar
PKKRSPCEMVKPNIIKRRQSNIK

SEQ ID NO: 2499684 - protein, 24 aa, Entamoeba dispar
PKKRSTVNFCFPDLIEIDFGKDKM

SEQ ID NO: 2499685 - protein, 32 aa, Entamoeba dispar
PKKSASDRLRFERKPRLRATFLEDSAHKRIND

SEQ ID NO: 2499686 - protein, 18 aa, Entamoeba dispar
PKKYAEELLKECKEVNVI

SEQ ID NO: 2499687 - protein, 20 aa, Entamoeba dispar
PKLGPDILRILAKTFIEEDK

SEQ ID NO: 2499688 - protein, 23 aa, Entamoeba dispar
PKLKRTDGLFCLILTPTRELTQQ

SEQ ID NO: 2499689 - protein, 25 aa, Entamoeba dispar
PKLLDVRMMLPMSVRCQACGEYMYK

SEQ ID NO: 2499690 - protein, 20 aa, Entamoeba dispar
PKLLKSISILFPLLPELVPE

SEQ ID NO: 2499691 - protein, 18 aa, Entamoeba dispar
PKLLKTSFNLLSRYPKYL

SEQ ID NO: 2499692 - protein, 18 aa, Entamoeba dispar
PKLLNCCRQLMLKSDQRT

SEQ ID NO: 2499693 - protein, 21 aa, Entamoeba dispar
PKLMCPLFYLGFCPYGKKCKF

SEQ ID NO: 2499694 - protein, 24 aa, Entamoeba dispar
PKLMSCVEITFSLVPPKDINVPGY

SEQ ID NO: 2499695 - protein, 19 aa, Entamoeba dispar
PKLPCFNNPSLVFSEIDGI

SEQ ID NO: 2499696 - protein, 17 aa, Entamoeba dispar
PKLPCQIDDDSFKDIEL

SEQ ID NO: 2499697 - protein, 18 aa, Entamoeba dispar
PKLPEIHHPIIMSLIDQL

SEQ ID NO: 2499698 - protein, 18 aa, Entamoeba dispar
PKLSEPVYESIVTFCGKF

SEQ ID NO: 2499699 - protein, 24 aa, Entamoeba dispar
PKLYKNLFIRLVKENATLEYWDKL

SEQ ID NO: 2499700 - protein, 21 aa, Entamoeba dispar
PKMRIVFVGTFGVGKTSLIQQ

SEQ ID NO: 2499701 - protein, 18 aa, Entamoeba dispar
PKNILIRNQRAVICDFGM

SEQ ID NO: 2499702 - protein, 22 aa, Entamoeba dispar
PKNIYFGYSLCKGNRKLVNHFS

SEQ ID NO: 2499703 - protein, 19 aa, Entamoeba dispar
PKNLLLIDVLERHILDTLI

SEQ ID NO: 2499704 - protein, 17 aa, Entamoeba dispar
PKNNFRLFFSEKRLPPF

SEQ ID NO: 2499705 - protein, 20 aa, Entamoeba dispar
PKNNGSVLKEMVRQMTELFE

SEQ ID NO: 2499706 - protein, 24 aa, Entamoeba dispar
PKPAILKPIPKWTGKQVITGILMH

SEQ ID NO: 2499707 - protein, 21 aa, Entamoeba dispar
PKPIYYRKYKRIVKQVKPVQH

SEQ ID NO: 2499708 - protein, 19 aa, Entamoeba dispar
PKPKNEWLQPVISKTPPEK

SEQ ID NO: 2499709 - protein, 17 aa, Entamoeba dispar
PKPMGFSPSPVSPRKTH

SEQ ID NO: 2499710 - protein, 19 aa, Entamoeba dispar
PKPNVLYCGRSLKEILDSE

SEQ ID NO: 2499711 - protein, 20 aa, Entamoeba dispar
PKPNVLYCGTKLKEILESEG

SEQ ID NO: 2499712 - protein, 20 aa, Entamoeba dispar
PKPSQWVIRDKNHFVFSLLN

SEQ ID NO: 2499713 - protein, 17 aa, Entamoeba dispar
PKPTYRPPQQTIPEPVQ

SEQ ID NO: 2499714 - protein, 22 aa, Entamoeba dispar
PKQKKDWCDALTKYSELQRKNS

SEQ ID NO: 2499715 - protein, 18 aa, Entamoeba dispar
PKQLEKGFNEYAWSFRSN

SEQ ID NO: 2499716 - protein, 22 aa, Entamoeba dispar
PKQPPYRRFFSSIPCSLNKTEG

SEQ ID NO: 2499717 - protein, 21 aa, Entamoeba dispar
PKQRRTGLFSATMPKELNKFI

SEQ ID NO: 2499718 - protein, 20 aa, Entamoeba dispar
PKQYQLMCPIIISSEPPSNP

SEQ ID NO: 2499719 - protein, 18 aa, Entamoeba dispar
PKRANVIMTVGEKKKKKE

SEQ ID NO: 2499720 - protein, 25 aa, Entamoeba dispar
PKRCKEVLNTIHLWKSGNEEMIKSC

SEQ ID NO: 2499721 - protein, 17 aa, Entamoeba dispar
PKRIIFKSIEEYIKVPL

SEQ ID NO: 2499722 - protein, 24 aa, Entamoeba dispar
PKRKARKSIWEDFRKDLKTKDKEV

SEQ ID NO: 2499723 - protein, 17 aa, Entamoeba dispar
PKRKQLHKIKKSISKTL

SEQ ID NO: 2499724 - protein, 26 aa, Entamoeba dispar
PKRLMLRRLVDVIIRLHKKRSLLLPF

SEQ ID NO: 2499725 - protein, 25 aa, Entamoeba dispar
PKRLPKEILNELKLTEETTLSEPRK

SEQ ID NO: 2499726 - protein, 20 aa, Entamoeba dispar
PKRPREDVVIEFIDEEQNEL

SEQ ID NO: 2499727 - protein, 27 aa, Entamoeba dispar
PKSAPKRLTRKRCNSASKIDRHLNTKL

SEQ ID NO: 2499728 - protein, 17 aa, Entamoeba dispar
PKSICTLTYSRSNTIII

SEQ ID NO: 2499729 - protein, 20 aa, Entamoeba dispar
PKSILLKENITWNIDKKEGE

SEQ ID NO: 2499730 - protein, 19 aa, Entamoeba dispar
PKSKFTMIKEIGKIPVSNI

SEQ ID NO: 2499731 - protein, 17 aa, Entamoeba dispar
PKSKRPKKEMMPNEVKR

SEQ ID NO: 2499732 - protein, 21 aa, Entamoeba dispar
PKSMKSERSWQSKNATRAIYS

SEQ ID NO: 2499733 - protein, 17 aa, Entamoeba dispar
PKSPFKADRIISVSFDI

SEQ ID NO: 2499734 - protein, 23 aa, Entamoeba dispar
PKSQTLFDFECESSFNSNSQKKD

SEQ ID NO: 2499735 - protein, 18 aa, Entamoeba dispar
PKSSLVFDVPDGKMEGFY

SEQ ID NO: 2499736 - protein, 20 aa, Entamoeba dispar
PKSVESQQLYAYSEIINHAL

SEQ ID NO: 2499737 - protein, 25 aa, Entamoeba dispar
PKTEFKFPWKIAEFISTGKRPPIIQ

SEQ ID NO: 2499738 - protein, 17 aa, Entamoeba dispar
PKTETKGTVLLKDAEQF

SEQ ID NO: 2499739 - protein, 22 aa, Entamoeba dispar
PKTFNAPTAFFVPRGVNEIYSL

SEQ ID NO: 2499740 - protein, 21 aa, Entamoeba dispar
PKTIIVFKCNENALKDGRYSQ

SEQ ID NO: 2499741 - protein, 21 aa, Entamoeba dispar
PKTIIVFKCNENALKDSRYSQ

SEQ ID NO: 2499742 - protein, 19 aa, Entamoeba dispar
PKTLDICSSLKRVFLHPIY

SEQ ID NO: 2499743 - protein, 23 aa, Entamoeba dispar
PKTLKEQFLEFLMVHETVSDYLQ

SEQ ID NO: 2499744 - protein, 17 aa, Entamoeba dispar
PKTPEEFNAEIVDGELI

SEQ ID NO: 2499745 - protein, 22 aa, Entamoeba dispar
PKTPGNFAFELTSGVGIISLRF

SEQ ID NO: 2499746 - protein, 17 aa, Entamoeba dispar
PKTSALWREKILAAKTI

SEQ ID NO: 2499747 - protein, 19 aa, Entamoeba dispar
PKTVFGHSIVSVLNPLIDV

SEQ ID NO: 2499748 - protein, 23 aa, Entamoeba dispar
PKTVNLWIGANVMMEYSFDEAKK

SEQ ID NO: 2499749 - protein, 20 aa, Entamoeba dispar
PKTYLKRKVGTISMSELGSN

SEQ ID NO: 2499750 - protein, 20 aa, Entamoeba dispar
PKVDGIECKVQREMGELITI

SEQ ID NO: 2499751 - protein, 18 aa, Entamoeba dispar
PKVLCSPNGMFLGVAAIG

SEQ ID NO: 2499752 - protein, 21 aa, Entamoeba dispar
PKVMDFCSIFSFIEYFLPPAI

SEQ ID NO: 2499753 - protein, 18 aa, Entamoeba dispar
PKVSFTVVGKTCIVPEQF

SEQ ID NO: 2499754 - protein, 25 aa, Entamoeba dispar
PKVYLKPDIPYISTFSHERISYFSV

SEQ ID NO: 2499755 - protein, 24 aa, Entamoeba dispar
PKYERFIRPAAMRFTKAHVTHPEL

SEQ ID NO: 2499756 - protein, 17 aa, Entamoeba dispar
PKYGVIFGSTFIARAEA

SEQ ID NO: 2499757 - protein, 18 aa, Entamoeba dispar
PKYIVCDERSKLLLELTV

SEQ ID NO: 2499758 - protein, 23 aa, Entamoeba dispar
PKYIVRRMIKISSEDIGLADVEA

SEQ ID NO: 2499759 - protein, 22 aa, Entamoeba dispar
PKYKKMRLFSQEAINVILNNLK

SEQ ID NO: 2499760 - protein, 30 aa, Entamoeba dispar
PKYKTSYFTVWRYYGIFLIPMRCYISQGAK

SEQ ID NO: 2499761 - protein, 20 aa, Entamoeba dispar
PKYSEYKRYLNYTFLNDKRT

SEQ ID NO: 2499762 - protein, 20 aa, Entamoeba dispar
PKYSYKEFVQFFDSFVNDLI

SEQ ID NO: 2499763 - protein, 28 aa, Entamoeba dispar
PLAALFKCSLGSFLLCHGGISPKLNMLD

SEQ ID NO: 2499764 - protein, 20 aa, Entamoeba dispar
PLAFYWTFWVDNFNDKNGTF

SEQ ID NO: 2499765 - protein, 19 aa, Entamoeba dispar
PLAMFCLQQIIGMGDVQVM

SEQ ID NO: 2499766 - protein, 26 aa, Entamoeba dispar
PLASRPWKGTRLRATELLKSEDFEGI

SEQ ID NO: 2499767 - protein, 20 aa, Entamoeba dispar
PLCETKCRSKDEFLKHIPTT

SEQ ID NO: 2499768 - protein, 19 aa, Entamoeba dispar
PLCFNEYSIDYILSQKNCI

SEQ ID NO: 2499769 - protein, 22 aa, Entamoeba dispar
PLCKNYCFTFIPPVLDTIFQFV

SEQ ID NO: 2499770 - protein, 18 aa, Entamoeba dispar
PLCQEFFNLIGKTIVLKG

SEQ ID NO: 2499771 - protein, 29 aa, Entamoeba dispar
PLCTFKKEIPRTLIFSKFNIIETIPCPKT

SEQ ID NO: 2499772 - protein, 22 aa, Entamoeba dispar
PLDALMLLGYRCPYRAVRAYCI

SEQ ID NO: 2499773 - protein, 26 aa, Entamoeba dispar
PLDISSLIGICFLNIPLYGGGAHPWG

SEQ ID NO: 2499774 - protein, 19 aa, Entamoeba dispar
PLDLPRLFQIKGQKRPFVR

SEQ ID NO: 2499775 - protein, 26 aa, Entamoeba dispar
PLEQWMIKDLLEGIDVKARGIRVGKT

SEQ ID NO: 2499776 - protein, 27 aa, Entamoeba dispar
PLESIIMIKRLIYFEIISKEIVIEWIL

SEQ ID NO: 2499777 - protein, 19 aa, Entamoeba dispar
PLESLCLQILLFGEKNPVQ

SEQ ID NO: 2499778 - protein, 20 aa, Entamoeba dispar
PLEYGKSSQCQLKMKTLQFN

SEQ ID NO: 2499779 - protein, 19 aa, Entamoeba dispar
PLFDEFRYVIFAIKIKENR

SEQ ID NO: 2499780 - protein, 18 aa, Entamoeba dispar
PLFDFRFTFEDFKRRTDI

SEQ ID NO: 2499781 - protein, 18 aa, Entamoeba dispar
PLFFDLYRSPTLSSSMKQ

SEQ ID NO: 2499782 - protein, 20 aa, Entamoeba dispar
PLFIKDNCFSVIKTTIINQI

SEQ ID NO: 2499783 - protein, 20 aa, Entamoeba dispar
PLFIREIKPLLVSIDTIELG

SEQ ID NO: 2499784 - protein, 23 aa, Entamoeba dispar
PLFIYDVIHFWCSQTKKMIVEIN

SEQ ID NO: 2499785 - protein, 24 aa, Entamoeba dispar
PLFLGEGVSEIMSSTAYEKLWYVI

SEQ ID NO: 2499786 - protein, 17 aa, Entamoeba dispar
PLFNQAIQMHLKRYEES

SEQ ID NO: 2499787 - protein, 17 aa, Entamoeba dispar
PLFPNLQTFYVRRCPER

SEQ ID NO: 2499788 - protein, 17 aa, Entamoeba dispar
PLFSELYQLVSVSKNGA

SEQ ID NO: 2499789 - protein, 19 aa, Entamoeba dispar
PLFSGDCKIGQLFQIFQIF

SEQ ID NO: 2499790 - protein, 26 aa, Entamoeba dispar
PLFSRFRHISPPMLFFVTSNNQLVSV

SEQ ID NO: 2499791 - protein, 17 aa, Entamoeba dispar
PLFWGFKNHPSVEGHHQ

SEQ ID NO: 2499792 - protein, 20 aa, Entamoeba dispar
PLFYTKRYLLIFNKCIEKLL

SEQ ID NO: 2499793 - protein, 18 aa, Entamoeba dispar
PLGADPFIKCVTGSVYDF

SEQ ID NO: 2499794 - protein, 17 aa, Entamoeba dispar
PLGELNWIFTAITDSIA

SEQ ID NO: 2499795 - protein, 18 aa, Entamoeba dispar
PLGPEFYYNLYLFPYLVF

SEQ ID NO: 2499796 - protein, 33 aa, Entamoeba dispar
PLGRFAVKLPLDYRLAKLVFFGLYFGVFTETAR

SEQ ID NO: 2499797 - protein, 19 aa, Entamoeba dispar
PLGSDLMILEYQRVFKKCV

SEQ ID NO: 2499798 - protein, 18 aa, Entamoeba dispar
PLGVVVCNFLPPNNDGIS

SEQ ID NO: 2499799 - protein, 18 aa, Entamoeba dispar
PLHDCIIESIWISIDNLI

SEQ ID NO: 2499800 - protein, 18 aa, Entamoeba dispar
PLHLFNWSLYILLNKQPY

SEQ ID NO: 2499801 - protein, 17 aa, Entamoeba dispar
PLHMLTTGWTYWFDLGM

SEQ ID NO: 2499802 - protein, 27 aa, Entamoeba dispar
PLHMLTTGWTYWFDLGMNQVFSTSGVT

SEQ ID NO: 2499803 - protein, 20 aa, Entamoeba dispar
PLHRRKRKFQNITYEKLLSE

SEQ ID NO: 2499804 - protein, 31 aa, Entamoeba dispar
PLHYFCLNFSNPNCEEAFSLFQQRSANMNAK

SEQ ID NO: 2499805 - protein, 18 aa, Entamoeba dispar
PLICSGFEESKNVLEQRY

SEQ ID NO: 2499806 - protein, 17 aa, Entamoeba dispar
PLIDCLIANGFTTEPQK

SEQ ID NO: 2499807 - protein, 31 aa, Entamoeba dispar
PLIDDSQCLLLFRKGLSQGILDLCIASINAL

SEQ ID NO: 2499808 - protein, 17 aa, Entamoeba dispar
PLIDTAVDFIPGGNIIK

SEQ ID NO: 2499809 - protein, 23 aa, Entamoeba dispar
PLIFPELEAPFFKQGLYEMFAGC

SEQ ID NO: 2499810 - protein, 19 aa, Entamoeba dispar
PLIHCHKNILMKLKESNPK

SEQ ID NO: 2499811 - protein, 18 aa, Entamoeba dispar
PLIKEFPIQTKVSINPIF

SEQ ID NO: 2499812 - protein, 22 aa, Entamoeba dispar
PLINCPVLSSFSLVNTQNPITL

SEQ ID NO: 2499813 - protein, 22 aa, Entamoeba dispar
PLIPCVTEDKILREESKKRDSI

SEQ ID NO: 2499814 - protein, 18 aa, Entamoeba dispar
PLIPYKYFEYYAQLPEGN

SEQ ID NO: 2499815 - protein, 24 aa, Entamoeba dispar
PLIQREWWYPLATSISGTEFKELQ

SEQ ID NO: 2499816 - protein, 18 aa, Entamoeba dispar
PLISEIDIQLTIELCTRL

SEQ ID NO: 2499817 - protein, 21 aa, Entamoeba dispar
PLISNCPFGTIFIKEKHLRLL

SEQ ID NO: 2499818 - protein, 19 aa, Entamoeba dispar
PLIVQCVRSNVAQDYGQFE

SEQ ID NO: 2499819 - protein, 22 aa, Entamoeba dispar
PLIWYPDIFVLNGGYRYFYQLF

SEQ ID NO: 2499820 - protein, 29 aa, Entamoeba dispar
PLKECPAPEQLPLKLGTLVMLLKNTQPEI

SEQ ID NO: 2499821 - protein, 21 aa, Entamoeba dispar
PLKELFIRIENFIQKLIIFYR

SEQ ID NO: 2499822 - protein, 18 aa, Entamoeba dispar
PLKGCTPNIFSFDEDLQF

SEQ ID NO: 2499823 - protein, 23 aa, Entamoeba dispar
PLKKCVTCDPSIVEKELKGDEEF

SEQ ID NO: 2499824 - protein, 23 aa, Entamoeba dispar
PLKLNIIVFSKFLFNAHDIYCSI

SEQ ID NO: 2499825 - protein, 24 aa, Entamoeba dispar
PLKPPKIDICFKEKECITVDLNKI

SEQ ID NO: 2499826 - protein, 24 aa, Entamoeba dispar
PLLAREGEIAWKTALKALQQKEPG

SEQ ID NO: 2499827 - protein, 19 aa, Entamoeba dispar
PLLCGGAVGGWKKELITNQ

SEQ ID NO: 2499828 - protein, 22 aa, Entamoeba dispar
PLLCSICNKPLIVVQGQNGELL

SEQ ID NO: 2499829 - protein, 21 aa, Entamoeba dispar
PLLDDLHPFYGDLLNVLYDRD

SEQ ID NO: 2499830 - protein, 24 aa, Entamoeba dispar
PLLELKKMYNVLSARHAILKVRHN

SEQ ID NO: 2499831 - protein, 17 aa, Entamoeba dispar
PLLELSSLIVLKVKENK

SEQ ID NO: 2499832 - protein, 23 aa, Entamoeba dispar
PLLFELCGISAMGNEEATRVIYI

SEQ ID NO: 2499833 - protein, 22 aa, Entamoeba dispar
PLLKGNGFFLVPDVKWNMKDMN

SEQ ID NO: 2499834 - protein, 19 aa, Entamoeba dispar
PLLNSCLFSKRSISEYTNS

SEQ ID NO: 2499835 - protein, 18 aa, Entamoeba dispar
PLLPLLVGMSSFAKEKNG

SEQ ID NO: 2499836 - protein, 19 aa, Entamoeba dispar
PLLPSVAPSVFVKFIQLHP

SEQ ID NO: 2499837 - protein, 23 aa, Entamoeba dispar
PLLQTLFKMIFIRNPTQRADIFQ

SEQ ID NO: 2499838 - protein, 18 aa, Entamoeba dispar
PLLRDPESMLALQGTEAI

SEQ ID NO: 2499839 - protein, 27 aa, Entamoeba dispar
PLLTKHLYCYPIDLQINVITRICTEIY

SEQ ID NO: 2499840 - protein, 26 aa, Entamoeba dispar
PLLTSKIESYWGYFPLKEEFGSPQLF

SEQ ID NO: 2499841 - protein, 18 aa, Entamoeba dispar
PLMKKTASKFGIEASKKL

SEQ ID NO: 2499842 - protein, 17 aa, Entamoeba dispar
PLMYPDFVIGDRDKNAD

SEQ ID NO: 2499843 - protein, 19 aa, Entamoeba dispar
PLNCSRITILDMIKEYISK

SEQ ID NO: 2499844 - protein, 20 aa, Entamoeba dispar
PLNDWCFISGSADRTVHLWD

SEQ ID NO: 2499845 - protein, 19 aa, Entamoeba dispar
PLNEYRLSFLQVDIDVLAQ

SEQ ID NO: 2499846 - protein, 18 aa, Entamoeba dispar
PLNFRISIRSNQNGQPTT

SEQ ID NO: 2499847 - protein, 18 aa, Entamoeba dispar
PLNIPIIPLYWNILRNIT

SEQ ID NO: 2499848 - protein, 19 aa, Entamoeba dispar
PLNKAGMLQIFIRTYNNTL

SEQ ID NO: 2499849 - protein, 18 aa, Entamoeba dispar
PLNPFKIVIAGAGRGPLV

SEQ ID NO: 2499850 - protein, 25 aa, Entamoeba dispar
PLNSVPLSLKLMYSHHIKEVQIVAE

SEQ ID NO: 2499851 - protein, 20 aa, Entamoeba dispar
PLNTRWNCEYKIINETTGLS

SEQ ID NO: 2499852 - protein, 18 aa, Entamoeba dispar
PLNYCSRKLFTNIETFHI

SEQ ID NO: 2499853 - protein, 17 aa, Entamoeba dispar
PLPASKEPTKWELFAKR

SEQ ID NO: 2499854 - protein, 19 aa, Entamoeba dispar
PLPEAYCYGLLTLIEPTRH

SEQ ID NO: 2499855 - protein, 24 aa, Entamoeba dispar
PLPEVDSLFLIHTFPLLEIFNNKL

SEQ ID NO: 2499856 - protein, 17 aa, Entamoeba dispar
PLPFNYFVYCISDSYLK

SEQ ID NO: 2499857 - protein, 19 aa, Entamoeba dispar
PLPKLSRPTLKRTIPGAFS

SEQ ID NO: 2499858 - protein, 17 aa, Entamoeba dispar
PLPLRKAKITCEAAKKK

SEQ ID NO: 2499859 - protein, 19 aa, Entamoeba dispar
PLQEVARIVGMSATSVKKL

SEQ ID NO: 2499860 - protein, 24 aa, Entamoeba dispar
PLQGLKLEGEFFVLTKRQFKRTRD

SEQ ID NO: 2499861 - protein, 25 aa, Entamoeba dispar
PLQIPTFAFYWIEFITPSFILNRVE

SEQ ID NO: 2499862 - protein, 19 aa, Entamoeba dispar
PLQISSSIEINGRIGKIVF

SEQ ID NO: 2499863 - protein, 30 aa, Entamoeba dispar
PLQLVCMPEILAGLTSPMCKIDLKLCLAPF

SEQ ID NO: 2499864 - protein, 23 aa, Entamoeba dispar
PLRKDPLFRMKIPSATVVYRSRN

SEQ ID NO: 2499865 - protein, 20 aa, Entamoeba dispar
PLRKSCASLMDFENEEDEDG

SEQ ID NO: 2499866 - protein, 24 aa, Entamoeba dispar
PLRMMRICRASFEKVIEALEKKLN

SEQ ID NO: 2499867 - protein, 21 aa, Entamoeba dispar
PLRQCDINIFFSLHYLFNQAK

SEQ ID NO: 2499868 - protein, 21 aa, Entamoeba dispar
PLRSRCLDIRIELPTYDELDR

SEQ ID NO: 2499869 - protein, 31 aa, Entamoeba dispar
PLRVACLKSGWRYPVPFFRSIQYLRYNGGIT

SEQ ID NO: 2499870 - protein, 18 aa, Entamoeba dispar
PLSCLPSIDIISLSTIKS

SEQ ID NO: 2499871 - protein, 19 aa, Entamoeba dispar
PLSDMQVTLVFDNPLDANA

SEQ ID NO: 2499872 - protein, 18 aa, Entamoeba dispar
PLSIKHFNIIGGIHPIKL

SEQ ID NO: 2499873 - protein, 18 aa, Entamoeba dispar
PLSIPLENYTCLKYLVAL

SEQ ID NO: 2499874 - protein, 23 aa, Entamoeba dispar
PLSNPFSLNGFSFGISTDKQKDT

SEQ ID NO: 2499875 - protein, 20 aa, Entamoeba dispar
PLSNVICLWQSSSPYRSLLL

SEQ ID NO: 2499876 - protein, 26 aa, Entamoeba dispar
PLSTMKGWEKLRWDDILHIKTIVEDD

SEQ ID NO: 2499877 - protein, 20 aa, Entamoeba dispar
PLTAKKKSRIRQDMSSKSGD

SEQ ID NO: 2499878 - protein, 30 aa, Entamoeba dispar
PLTEELYEWLRVCSGAIILQGYGLTETFGG

SEQ ID NO: 2499879 - protein, 25 aa, Entamoeba dispar
PLTFFFKIIYFISIASFGEIIQLKK

SEQ ID NO: 2499880 - protein, 20 aa, Entamoeba dispar
PLTFLKAVEFFGEYEDAIPL

SEQ ID NO: 2499881 - protein, 18 aa, Entamoeba dispar
PLTPSILGKRCFSGNTKL

SEQ ID NO: 2499882 - protein, 27 aa, Entamoeba dispar
PLTQIPGLIQFKGPMNLKHNRGSARFM

SEQ ID NO: 2499883 - protein, 24 aa, Entamoeba dispar
PLTSKCIFTGSGMRADMKELTDQI

SEQ ID NO: 2499884 - protein, 24 aa, Entamoeba dispar
PLTYRLSDFTKLYVTIENNIVKME

SEQ ID NO: 2499885 - protein, 18 aa, Entamoeba dispar
PLVFPMFECHNQIASIPV

SEQ ID NO: 2499886 - protein, 17 aa, Entamoeba dispar
PLVGLKTSRCFSDEKLL

SEQ ID NO: 2499887 - protein, 17 aa, Entamoeba dispar
PLVHGYPLSQAVLINNP

SEQ ID NO: 2499888 - protein, 17 aa, Entamoeba dispar
PLVLHALLDLLEELIEA

SEQ ID NO: 2499889 - protein, 33 aa, Entamoeba dispar
PLVRKHCFSAICHIYRLYPDLIPNASKLIYTAV

SEQ ID NO: 2499890 - protein, 20 aa, Entamoeba dispar
PLVRKIYGAAIGWCHKDDIF

SEQ ID NO: 2499891 - protein, 24 aa, Entamoeba dispar
PLWGCGSYSGIVAYQITGVIKECI

SEQ ID NO: 2499892 - protein, 20 aa, Entamoeba dispar
PLYEELCVLNHLPTEIFLTQ

SEQ ID NO: 2499893 - protein, 30 aa, Entamoeba dispar
PLYHKRRLLRLAEYLKQFDFTPQEKIVIAN

SEQ ID NO: 2499894 - protein, 19 aa, Entamoeba dispar
PLYKYRLKNGYLLIPSNEL

SEQ ID NO: 2499895 - protein, 17 aa, Entamoeba dispar
PLYVCRYQNRLDVNIQK

SEQ ID NO: 2499896 - protein, 20 aa, Entamoeba dispar
PLYWCSIGNLYYHTEQYSEA

SEQ ID NO: 2499897 - protein, 18 aa, Entamoeba dispar
PMELYNILSVLIKDIGTK

SEQ ID NO: 2499898 - protein, 17 aa, Entamoeba dispar
PMFHYLQPYSNFISLID

SEQ ID NO: 2499899 - protein, 28 aa, Entamoeba dispar
PMFRSTLFRWLEEIEYLNISGCIRLSEE

SEQ ID NO: 2499900 - protein, 18 aa, Entamoeba dispar
PMHQSFFVFEFCVYAIQF

SEQ ID NO: 2499901 - protein, 24 aa, Entamoeba dispar
PMHSGGMLGGWKFSNFKDGVFSEI

SEQ ID NO: 2499902 - protein, 25 aa, Entamoeba dispar
PMHSGGMLGGWKFSNFKDGVFSEIF

SEQ ID NO: 2499903 - protein, 19 aa, Entamoeba dispar
PMILFEYYETFIVKSSVYK

SEQ ID NO: 2499904 - protein, 25 aa, Entamoeba dispar
PMKCFKITQRYLLLGFERGIRIYKF

SEQ ID NO: 2499905 - protein, 25 aa, Entamoeba dispar
PMKDEKCTVCTLIPSAAPTERSENG

SEQ ID NO: 2499906 - protein, 19 aa, Entamoeba dispar
PMKEEYKLIVERLEHKNFL

SEQ ID NO: 2499907 - protein, 18 aa, Entamoeba dispar
PMKRDYLTILQRLLPLGA

SEQ ID NO: 2499908 - protein, 17 aa, Entamoeba dispar
PMLGRMINKVSHISTLL

SEQ ID NO: 2499909 - protein, 24 aa, Entamoeba dispar
PMLHPEAFENLGIDPPKGVLLYGP

SEQ ID NO: 2499910 - protein, 19 aa, Entamoeba dispar
PMLKDLICHLITHKEADRC

SEQ ID NO: 2499911 - protein, 17 aa, Entamoeba dispar
PMLKKKPKRKLKIFKIF

SEQ ID NO: 2499912 - protein, 21 aa, Entamoeba dispar
PMLMGEYDFNVFIFLYCSDLD

SEQ ID NO: 2499913 - protein, 19 aa, Entamoeba dispar
PMLSRGELRCIGATTIEEY

SEQ ID NO: 2499914 - protein, 20 aa, Entamoeba dispar
PMLSRGELRCIGATTIEEYR

SEQ ID NO: 2499915 - protein, 27 aa, Entamoeba dispar
PMMRNCVGISHFFVFDVFDKALCFLDK

SEQ ID NO: 2499916 - protein, 18 aa, Entamoeba dispar
PMNDWISERCEAVKVFLK

SEQ ID NO: 2499917 - protein, 31 aa, Entamoeba dispar
PMNQLCNLLLTYLCTYYKINVSTGLIQKQVR

SEQ ID NO: 2499918 - protein, 23 aa, Entamoeba dispar
PMPEILKQLTVLPVESPVLLSGT

SEQ ID NO: 2499919 - protein, 24 aa, Entamoeba dispar
PMRACKGKPLIRFRESDYEIKKKP

SEQ ID NO: 2499920 - protein, 18 aa, Entamoeba dispar
PMRFTLKPEYAIELKFII

SEQ ID NO: 2499921 - protein, 18 aa, Entamoeba dispar
PMRKCLQDFVAGKDEAKY

SEQ ID NO: 2499922 - protein, 22 aa, Entamoeba dispar
PMSQGVLLPGHLYQTVIKEEIQ

SEQ ID NO: 2499923 - protein, 20 aa, Entamoeba dispar
PMSSISFLPLAHVFAIVLEM

SEQ ID NO: 2499924 - protein, 25 aa, Entamoeba dispar
PMTDLTGYEWDRMRLSRELRKDHNL

SEQ ID NO: 2499925 - protein, 21 aa, Entamoeba dispar
PMTNPELFERVGVKAPKGVLL

SEQ ID NO: 2499926 - protein, 25 aa, Entamoeba dispar
PMYLCDIRCPTECIGKVFQVLDKRR

SEQ ID NO: 2499927 - protein, 24 aa, Entamoeba dispar
PMYLSEFAKALVLIYYAQQNQPIS

SEQ ID NO: 2499928 - protein, 22 aa, Entamoeba dispar
PNAEIFKPYAGFIGYAKNNMGL

SEQ ID NO: 2499929 - protein, 19 aa, Entamoeba dispar
PNAERKCFVCGKTGHKSRD

SEQ ID NO: 2499930 - protein, 20 aa, Entamoeba dispar
PNAFIGIAGVVTFKNGQSIR

SEQ ID NO: 2499931 - protein, 19 aa, Entamoeba dispar
PNAFNLHSFILLNISLNDL

SEQ ID NO: 2499932 - protein, 24 aa, Entamoeba dispar
PNALKRLPFGYIELMNNCPSQPML

SEQ ID NO: 2499933 - protein, 21 aa, Entamoeba dispar
PNAQPPYILVGAIDNSSAPSI

SEQ ID NO: 2499934 - protein, 24 aa, Entamoeba dispar
PNAQWQWYSDKGWLNYEDKQNKLI

SEQ ID NO: 2499935 - protein, 20 aa, Entamoeba dispar
PNATSLCLFNGKSQSQDVII

SEQ ID NO: 2499936 - protein, 29 aa, Entamoeba dispar
PNCDRIGLIRFSKSTVMIIADGCGWGIQP

SEQ ID NO: 2499937 - protein, 19 aa, Entamoeba dispar
PNCQCFKKNHFIFVGKCLA

SEQ ID NO: 2499938 - protein, 18 aa, Entamoeba dispar
PNDCYIILHQLDFSDVLL

SEQ ID NO: 2499939 - protein, 18 aa, Entamoeba dispar
PNDEGCLIERVLEVDPKG

SEQ ID NO: 2499940 - protein, 31 aa, Entamoeba dispar
PNDIENIRIFIKACFIEKQWTTENIQNTHQQ

SEQ ID NO: 2499941 - protein, 25 aa, Entamoeba dispar
PNDLFLRVCQLRIKPDLDMLVDLFK

SEQ ID NO: 2499942 - protein, 18 aa, Entamoeba dispar
PNDMRMSIRMSREEQYNS

SEQ ID NO: 2499943 - protein, 18 aa, Entamoeba dispar
PNDYLSIFVGMLNAIEQN

SEQ ID NO: 2499944 - protein, 26 aa, Entamoeba dispar
PNEAPCAGVAEVLRRYNEITPSVQMS

SEQ ID NO: 2499945 - protein, 24 aa, Entamoeba dispar
PNEFRRIRQNYGYVDKSGRLNGEV

SEQ ID NO: 2499946 - protein, 22 aa, Entamoeba dispar
PNEIFCLKEVLGTGSFGTVYHA

SEQ ID NO: 2499947 - protein, 19 aa, Entamoeba dispar
PNELEYPEATILAKTNPIP

SEQ ID NO: 2499948 - protein, 18 aa, Entamoeba dispar
PNELRKIEEGELEEKVKM

SEQ ID NO: 2499949 - protein, 20 aa, Entamoeba dispar
PNENFLCFLNSLKTVIMTEI

SEQ ID NO: 2499950 - protein, 19 aa, Entamoeba dispar
PNETPYLFLGDYVDRGKNS

SEQ ID NO: 2499951 - protein, 17 aa, Entamoeba dispar
PNFKTMFQLICSNDEIK

SEQ ID NO: 2499952 - protein, 25 aa, Entamoeba dispar
PNFPQKFYFFILKSLQFIYQKEFVV

SEQ ID NO: 2499953 - protein, 17 aa, Entamoeba dispar
PNFRLIGTRTIYKGGMK

SEQ ID NO: 2499954 - protein, 18 aa, Entamoeba dispar
PNGIAELIEKCWDQDQSK

SEQ ID NO: 2499955 - protein, 25 aa, Entamoeba dispar
PNGIILPNQCRLFITAIQGDDEFIL

SEQ ID NO: 2499956 - protein, 26 aa, Entamoeba dispar
PNGLKKFQIECCDRLDEIINIENSLI

SEQ ID NO: 2499957 - protein, 20 aa, Entamoeba dispar
PNGQLVFYIAVHKFIIFLKS

SEQ ID NO: 2499958 - protein, 32 aa, Entamoeba dispar
PNIACPIKGISCLNETIILYGIEKRNKSEYSP

SEQ ID NO: 2499959 - protein, 24 aa, Entamoeba dispar
PNICAECGQPLGPQRITALGKSYH

SEQ ID NO: 2499960 - protein, 18 aa, Entamoeba dispar
PNIETCLEHIEQIRKEYK

SEQ ID NO: 2499961 - protein, 17 aa, Entamoeba dispar
PNIETFNLYDLMDRVFK

SEQ ID NO: 2499962 - protein, 18 aa, Entamoeba dispar
PNIETFYIYCYNDEIFDD

SEQ ID NO: 2499963 - protein, 20 aa, Entamoeba dispar
PNIIIILIIDDCQFGVYQNQ

SEQ ID NO: 2499964 - protein, 17 aa, Entamoeba dispar
PNIIITPLFSNFKVYCS

SEQ ID NO: 2499965 - protein, 28 aa, Entamoeba dispar
PNILMPILFEYFFKRKAFIEERQEKLLV

SEQ ID NO: 2499966 - protein, 26 aa, Entamoeba dispar
PNINLLICFIDLFTPPSLIKGKLSYT

SEQ ID NO: 2499967 - protein, 17 aa, Entamoeba dispar
PNIPFKIVDSMEGSEVK

SEQ ID NO: 2499968 - protein, 19 aa, Entamoeba dispar
PNIYFKIQIEPTLLQTVQH

SEQ ID NO: 2499969 - protein, 18 aa, Entamoeba dispar
PNKRISCERALKHSYFQQ

SEQ ID NO: 2499970 - protein, 30 aa, Entamoeba dispar
PNKSSQQILNRIKWVAGGKKQNWEEFCVQC

SEQ ID NO: 2499971 - protein, 36 aa, Entamoeba dispar
PNKTIQQLTMRVHWLQIKETISWENYWKTFQRKEQQ

SEQ ID NO: 2499972 - protein, 20 aa, Entamoeba dispar
PNLLEGWIKYLYGRLKDPSA

SEQ ID NO: 2499973 - protein, 23 aa, Entamoeba dispar
PNLLFLCFSRSMVIGLWSSTEIK

SEQ ID NO: 2499974 - protein, 26 aa, Entamoeba dispar
PNLPIGINPWYIWQIIPNINENDKCF

SEQ ID NO: 2499975 - protein, 17 aa, Entamoeba dispar
PNLYSTCSIDISKEFYG

SEQ ID NO: 2499976 - protein, 19 aa, Entamoeba dispar
PNMYYLGVCSCININGLRI

SEQ ID NO: 2499977 - protein, 19 aa, Entamoeba dispar
PNNGQYYGQVDTFNTQQNV

SEQ ID NO: 2499978 - protein, 25 aa, Entamoeba dispar
PNNIKLYVRRVFIMDDCRELIPEWL

SEQ ID NO: 2499979 - protein, 31 aa, Entamoeba dispar
PNNIKSHPWFKGFDWEGLFQKKLSPPFVPVL

SEQ ID NO: 2499980 - protein, 21 aa, Entamoeba dispar
PNNILNCYYIFLGPKDTPYEG

SEQ ID NO: 2499981 - protein, 25 aa, Entamoeba dispar
PNNQFWKAMKAYGLAYTGQLEKADE

SEQ ID NO: 2499982 - protein, 27 aa, Entamoeba dispar
PNNVYRHIPSIFGLMILFDTNGFPLCL

SEQ ID NO: 2499983 - protein, 19 aa, Entamoeba dispar
PNPFFRTICLTSFTEEQYF

SEQ ID NO: 2499984 - protein, 18 aa, Entamoeba dispar
PNPFLRKLTRDIWSTNPD

SEQ ID NO: 2499985 - protein, 30 aa, Entamoeba dispar
PNPSKHFKGIPAFWHRIFIIENLSDESDMK

SEQ ID NO: 2499986 - protein, 23 aa, Entamoeba dispar
PNPYPKGMIWIEFGKESKTKNIP

SEQ ID NO: 2499987 - protein, 26 aa, Entamoeba dispar
PNQLFALRALFLCFFYIINEVSDEFR

SEQ ID NO: 2499988 - protein, 17 aa, Entamoeba dispar
PNQRLLAAIVCKNNLVT

SEQ ID NO: 2499989 - protein, 31 aa, Entamoeba dispar
PNRIKSHSWFKGFDWEGLFQKKLSPPFVPVL

SEQ ID NO: 2499990 - protein, 25 aa, Entamoeba dispar
PNRKVDFNPLLGIVSVKAHCFGGIE

SEQ ID NO: 2499991 - protein, 22 aa, Entamoeba dispar
PNRLFPPNVCISTVTIQEVVQE

SEQ ID NO: 2499992 - protein, 27 aa, Entamoeba dispar
PNRMIYSEFLKRYYFLGDKINRRASDE

SEQ ID NO: 2499993 - protein, 22 aa, Entamoeba dispar
PNSCFQECRCLSILHLPSVLTS

SEQ ID NO: 2499994 - protein, 33 aa, Entamoeba dispar
PNSLKTSLKILLRFQECQSFFKKTLENPNVRNY

SEQ ID NO: 2499995 - protein, 23 aa, Entamoeba dispar
PNSPRNCSFIYGYAAMSKFIENT

SEQ ID NO: 2499996 - protein, 19 aa, Entamoeba dispar
PNSVFKIGPLKLLEYPFSD

SEQ ID NO: 2499997 - protein, 25 aa, Entamoeba dispar
PNTFLCNACGLKALKKKKREQQMAT

SEQ ID NO: 2499998 - protein, 20 aa, Entamoeba dispar
PNTLRGGFYDALGVVSQSFS

SEQ ID NO: 2499999 - protein, 24 aa, Entamoeba dispar
PNTNYKAIIIWGSPDKLSHYDAEL

SEQ ID NO: 2500000 - protein, 37 aa, Entamoeba dispar
PNTRYAAFRYIELRTESIWKFLIPFISRILDCLEDED

SEQ ID NO: 2500001 - protein, 25 aa, Entamoeba dispar
PNTSLKSDGGWGCTIRACQMLLANA

SEQ ID NO: 2500002 - protein, 19 aa, Entamoeba dispar
PNTVAAWRQGVEMPLNEVL

SEQ ID NO: 2500003 - protein, 17 aa, Entamoeba dispar
PNVITAWDRNGIDKATA

SEQ ID NO: 2500004 - protein, 27 aa, Entamoeba dispar
PNVLFTMCGFEIRILPKCRSQEEEFSI

SEQ ID NO: 2500005 - protein, 22 aa, Entamoeba dispar
PNVNSFMKRVFYLMKEPQYLDW

SEQ ID NO: 2500006 - protein, 23 aa, Entamoeba dispar
PNVNSFMKRVFYLMKEPQYLDWR

SEQ ID NO: 2500007 - protein, 18 aa, Entamoeba dispar
PNVPIILVGTKIDIRDDP

SEQ ID NO: 2500008 - protein, 23 aa, Entamoeba dispar
PNWKKCILDALNHCSSIESGKDV

SEQ ID NO: 2500009 - protein, 20 aa, Entamoeba dispar
PNYCGRCGNIACIMRVGTDL

SEQ ID NO: 2500010 - protein, 29 aa, Entamoeba dispar
PNYFKAYEIRLTIKGQIARFNELIQKHLT

SEQ ID NO: 2500011 - protein, 18 aa, Entamoeba dispar
PNYIKFIQYPACLYYLEQ

SEQ ID NO: 2500012 - protein, 17 aa, Entamoeba dispar
PNYQIPENYVLPAHSTE

SEQ ID NO: 2500013 - protein, 28 aa, Entamoeba dispar
PNYVAKRFHCVIEICLNEGLAPVNALKE

SEQ ID NO: 2500014 - protein, 28 aa, Entamoeba dispar
PNYYLNLFKSFEILYSIGNSYFVETLFV

SEQ ID NO: 2500015 - protein, 18 aa, Entamoeba dispar
PPALALSTCMQFNKDDML

SEQ ID NO: 2500016 - protein, 25 aa, Entamoeba dispar
PPANPLICPQFCLRFNDLDNIGISG

SEQ ID NO: 2500017 - protein, 19 aa, Entamoeba dispar
PPDECLHNEINLIANTVDK

SEQ ID NO: 2500018 - protein, 27 aa, Entamoeba dispar
PPEEQYKMPLSWIILKRVVQGRDWHYG

SEQ ID NO: 2500019 - protein, 21 aa, Entamoeba dispar
PPEFTSLGILEKINKGNGDRV

SEQ ID NO: 2500020 - protein, 25 aa, Entamoeba dispar
PPELPEKFKAALLPENIKKNRYTDV

SEQ ID NO: 2500021 - protein, 21 aa, Entamoeba dispar
PPEVKSLGDNCFSYCDKLTTV

SEQ ID NO: 2500022 - protein, 23 aa, Entamoeba dispar
PPEVKSLGDYCFKNCNELTSINI

SEQ ID NO: 2500023 - protein, 24 aa, Entamoeba dispar
PPEVKSLGDYCFKYCSELTSINIP

SEQ ID NO: 2500024 - protein, 29 aa, Entamoeba dispar
PPEVKSLGYWCFCKCISLTTITIPTSVSE

SEQ ID NO: 2500025 - protein, 26 aa, Entamoeba dispar
PPFARSYCYNTSMLYHAEDLYFNQSS

SEQ ID NO: 2500026 - protein, 17 aa, Entamoeba dispar
PPFDLFKNIFLLLNAIK

SEQ ID NO: 2500027 - protein, 18 aa, Entamoeba dispar
PPFFKALVKYVHKGKYSW

SEQ ID NO: 2500028 - protein, 17 aa, Entamoeba dispar
PPFKEYSFHPIITTIPI

SEQ ID NO: 2500029 - protein, 18 aa, Entamoeba dispar
PPFLRYEISSENPHKTAT

SEQ ID NO: 2500030 - protein, 17 aa, Entamoeba dispar
PPGCGKTMIARAIANET

SEQ ID NO: 2500031 - protein, 25 aa, Entamoeba dispar
PPGCGKTYCAKALANECKANFIAVK

SEQ ID NO: 2500032 - protein, 25 aa, Entamoeba dispar
PPGIHRFPFSFILPQTHCPMLVLPN

SEQ ID NO: 2500033 - protein, 20 aa, Entamoeba dispar
PPGIISIFLGDVIQTLIDSI

SEQ ID NO: 2500034 - protein, 25 aa, Entamoeba dispar
PPGKYSWLKYVEKMYNVLFETEDEK

SEQ ID NO: 2500035 - protein, 18 aa, Entamoeba dispar
PPGLKAGEFKMIYKTTVN

SEQ ID NO: 2500036 - protein, 19 aa, Entamoeba dispar
PPGVNRFPFEIVLPENCCV

SEQ ID NO: 2500037 - protein, 18 aa, Entamoeba dispar
PPHPFAKPFSNRYSTGSE

SEQ ID NO: 2500038 - protein, 17 aa, Entamoeba dispar
PPHSLLMFATNYLTEKK

SEQ ID NO: 2500039 - protein, 19 aa, Entamoeba dispar
PPHYELRGEELMKAIVNEG

SEQ ID NO: 2500040 - protein, 22 aa, Entamoeba dispar
PPIMMSHFYSIWTAFTNKMEEG

SEQ ID NO: 2500041 - protein, 17 aa, Entamoeba dispar
PPIQIKTLEKIEVNKIS

SEQ ID NO: 2500042 - protein, 17 aa, Entamoeba dispar
PPKIFFEPHSIRYLAEL

SEQ ID NO: 2500043 - protein, 20 aa, Entamoeba dispar
PPKKELYGMYILVKGTPKYL

SEQ ID NO: 2500044 - protein, 19 aa, Entamoeba dispar
PPKQFKFITPNVYKKKAIK

SEQ ID NO: 2500045 - protein, 18 aa, Entamoeba dispar
PPLCFLIESIHLKGGLEH

SEQ ID NO: 2500046 - protein, 33 aa, Entamoeba dispar
PPLFDLFGGLCLKCLDSVKYFETICAYSQLFGV

SEQ ID NO: 2500047 - protein, 19 aa, Entamoeba dispar
PPLFYQICNGVRPLPNVKT

SEQ ID NO: 2500048 - protein, 21 aa, Entamoeba dispar
PPLIMKRSHILAEIDNETNST

SEQ ID NO: 2500049 - protein, 24 aa, Entamoeba dispar
PPLLDFPSSPSFHLPLSTQTYRSP

SEQ ID NO: 2500050 - protein, 24 aa, Entamoeba dispar
PPLLDIRINLIAPVIYFYYDGKEK

SEQ ID NO: 2500051 - protein, 21 aa, Entamoeba dispar
PPLLSRFDIILLLLDDRSKIW

SEQ ID NO: 2500052 - protein, 17 aa, Entamoeba dispar
PPLRALFKISTKGIPPV

SEQ ID NO: 2500053 - protein, 23 aa, Entamoeba dispar
PPLRELIEGGFFNFYLSDKYIIF

SEQ ID NO: 2500054 - protein, 18 aa, Entamoeba dispar
PPLSPSLLVRSGSLKISS

SEQ ID NO: 2500055 - protein, 18 aa, Entamoeba dispar
PPLTCIPEVIELESDGIT

SEQ ID NO: 2500056 - protein, 18 aa, Entamoeba dispar
PPMEIVVDLIQKMGQPPH

SEQ ID NO: 2500057 - protein, 18 aa, Entamoeba dispar
PPNIYKLLCELVGDISIT

SEQ ID NO: 2500058 - protein, 18 aa, Entamoeba dispar
PPNPFKFEVQTPADNFGL

SEQ ID NO: 2500059 - protein, 17 aa, Entamoeba dispar
PPPPPGMPGMPPPPPGG

SEQ ID NO: 2500060 - protein, 18 aa, Entamoeba dispar
PPPSFKISFKPIQTEFDE

SEQ ID NO: 2500061 - protein, 17 aa, Entamoeba dispar
PPPSNCRVVKKIVDRYP

SEQ ID NO: 2500062 - protein, 22 aa, Entamoeba dispar
PPRLATLLRLCVLKEPETRPTL

SEQ ID NO: 2500063 - protein, 22 aa, Entamoeba dispar
PPRLDSLDIMDARPPMDRPLPT

SEQ ID NO: 2500064 - protein, 19 aa, Entamoeba dispar
PPRSRSRSISSFEIEENKI

SEQ ID NO: 2500065 - protein, 21 aa, Entamoeba dispar
PPSFRQYKLLESFLEIMKTGK

SEQ ID NO: 2500066 - protein, 28 aa, Entamoeba dispar
PPSHFTMFSQFIKLCYKIHTYSDINLMN

SEQ ID NO: 2500067 - protein, 18 aa, Entamoeba dispar
PPSNCIFEIYIQHREFII

SEQ ID NO: 2500068 - protein, 17 aa, Entamoeba dispar
PPSPRKKTFHKINSVEK

SEQ ID NO: 2500069 - protein, 26 aa, Entamoeba dispar
PPTDYVWKCVCIHQSIVFLMKLTELL

SEQ ID NO: 2500070 - protein, 26 aa, Entamoeba dispar
PPTEPRIVVFSLWMKDMISLQEINVH

SEQ ID NO: 2500071 - protein, 17 aa, Entamoeba dispar
PPTKKLIERQKKMRTET

SEQ ID NO: 2500072 - protein, 20 aa, Entamoeba dispar
PPTLCYGCHSLSQISFPPYL

SEQ ID NO: 2500073 - protein, 22 aa, Entamoeba dispar
PPVFVELQIKFYLLARLLGVES

SEQ ID NO: 2500074 - protein, 19 aa, Entamoeba dispar
PPVPAPRNGLAHVRQSTVE

SEQ ID NO: 2500075 - protein, 19 aa, Entamoeba dispar
PPVTRAFVSFLPKVMDFCS

SEQ ID NO: 2500076 - protein, 18 aa, Entamoeba dispar
PQCITRLQIDSCNSIHEL

SEQ ID NO: 2500077 - protein, 23 aa, Entamoeba dispar
PQCMSIRPSNEFITVATNNILNF

SEQ ID NO: 2500078 - protein, 21 aa, Entamoeba dispar
PQDIDPVVTKRANFLGERKPQ

SEQ ID NO: 2500079 - protein, 24 aa, Entamoeba dispar
PQEESAVIEPCKYSYEGKIVENEE

SEQ ID NO: 2500080 - protein, 19 aa, Entamoeba dispar
PQEFIKESITLVIEKQSVV

SEQ ID NO: 2500081 - protein, 21 aa, Entamoeba dispar
PQEILNLILGKIFFSKQQESC

SEQ ID NO: 2500082 - protein, 25 aa, Entamoeba dispar
PQEIPICVNCVSSLTKMWYPMGKNV

SEQ ID NO: 2500083 - protein, 18 aa, Entamoeba dispar
PQEKCFGCGKEIDDRIEK

SEQ ID NO: 2500084 - protein, 26 aa, Entamoeba dispar
PQENMKIRLGCSIGDITSTYSLFSFG

SEQ ID NO: 2500085 - protein, 26 aa, Entamoeba dispar
PQENMKIRLGCSIGDITSTYSLFSFS

SEQ ID NO: 2500086 - protein, 17 aa, Entamoeba dispar
PQERVAIYLAMLQTENE

SEQ ID NO: 2500087 - protein, 22 aa, Entamoeba dispar
PQFAQSSCKVVEPPHSLNKLPI

SEQ ID NO: 2500088 - protein, 18 aa, Entamoeba dispar
PQFIMPGHYINGYLMQIK

SEQ ID NO: 2500089 - protein, 18 aa, Entamoeba dispar
PQFLDFCTQLLCLNPEKR

SEQ ID NO: 2500090 - protein, 30 aa, Entamoeba dispar
PQFTIIPFSYCFYKPLPLNKFGNIVNYSNE

SEQ ID NO: 2500091 - protein, 22 aa, Entamoeba dispar
PQFYRNSIRLFIGSNKFSNAST

SEQ ID NO: 2500092 - protein, 21 aa, Entamoeba dispar
PQGKEKLCFEIFYDKVYTFCC

SEQ ID NO: 2500093 - protein, 25 aa, Entamoeba dispar
PQGQWPELMPFLLTDSNVAKLKTIG

SEQ ID NO: 2500094 - protein, 17 aa, Entamoeba dispar
PQIAILALEILNSLATA

SEQ ID NO: 2500095 - protein, 18 aa, Entamoeba dispar
PQIGSAFYKLYQTSASLN

SEQ ID NO: 2500096 - protein, 23 aa, Entamoeba dispar
PQIICFIKNYYFDDGILTDEKLK

SEQ ID NO: 2500097 - protein, 22 aa, Entamoeba dispar
PQILIEYEELFGLNSDDADPAT

SEQ ID NO: 2500098 - protein, 20 aa, Entamoeba dispar
PQIRSGAFPHYFHIDCTETR

SEQ ID NO: 2500099 - protein, 18 aa, Entamoeba dispar
PQITKSLVKKIYSQLKLV

SEQ ID NO: 2500100 - protein, 20 aa, Entamoeba dispar
PQKCMLCGISKNNNIYQLQY

SEQ ID NO: 2500101 - protein, 24 aa, Entamoeba dispar
PQKRLTQTFQRFGRDSTPFCSRNE

SEQ ID NO: 2500102 - protein, 30 aa, Entamoeba dispar
PQLEALNFGDRWLNACEWVIRNISQSSPER

SEQ ID NO: 2500103 - protein, 17 aa, Entamoeba dispar
PQLKYSTTISFQSTVIY

SEQ ID NO: 2500104 - protein, 23 aa, Entamoeba dispar
PQLPEVWFNMGSLYIFHNQRDDA

SEQ ID NO: 2500105 - protein, 26 aa, Entamoeba dispar
PQLPFNPSLFQFRFTSVPSTHLDSLN

SEQ ID NO: 2500106 - protein, 25 aa, Entamoeba dispar
PQLQEWTGLNFKEILFDSNIHEMNA

SEQ ID NO: 2500107 - protein, 17 aa, Entamoeba dispar
PQLSKFWTGAGYQPTYL

SEQ ID NO: 2500108 - protein, 33 aa, Entamoeba dispar
PQLVLFCCKTFSFKRFVKFDCVLVDVQKEENIN

SEQ ID NO: 2500109 - protein, 26 aa, Entamoeba dispar
PQLYEVFSIPFKTFWKNDAERQKKIV

SEQ ID NO: 2500110 - protein, 24 aa, Entamoeba dispar
PQNKWMIQFPRIFHVCKGNKEEYT

SEQ ID NO: 2500111 - protein, 20 aa, Entamoeba dispar
PQNLRIAAILFQNSISLPYS

SEQ ID NO: 2500112 - protein, 18 aa, Entamoeba dispar
PQNMKCDFTFGKYADQWV

SEQ ID NO: 2500113 - protein, 25 aa, Entamoeba dispar
PQNRTELRLSLNPKYSNSMAQIDFN

SEQ ID NO: 2500114 - protein, 18 aa, Entamoeba dispar
PQNYCKVAIINGFFDNIL

SEQ ID NO: 2500115 - protein, 22 aa, Entamoeba dispar
PQPRPKRILGGWDNVINEVIEC

SEQ ID NO: 2500116 - protein, 22 aa, Entamoeba dispar
PQQCKARWYSWLDPSIKKTEWT

SEQ ID NO: 2500117 - protein, 21 aa, Entamoeba dispar
PQQPTIAPFDFAKEEEQKKQP

SEQ ID NO: 2500118 - protein, 19 aa, Entamoeba dispar
PQRLIEHQQFISGLIQSIT

SEQ ID NO: 2500119 - protein, 24 aa, Entamoeba dispar
PQRLKWFLEILGASYLLDKGASAF

SEQ ID NO: 2500120 - protein, 18 aa, Entamoeba dispar
PQSLIGNWEKEFKKWLGV

SEQ ID NO: 2500121 - protein, 25 aa, Entamoeba dispar
PQSQLRYLQSFAFNGDLLPDVIEPL

SEQ ID NO: 2500122 - protein, 25 aa, Entamoeba dispar
PQTLIPRFYGMFRIKPQKDEEYRYV

SEQ ID NO: 2500123 - protein, 18 aa, Entamoeba dispar
PQTLKVLSKRSFGCCRGL

SEQ ID NO: 2500124 - protein, 21 aa, Entamoeba dispar
PQTNECRGFAFIKYQKTEDGN

SEQ ID NO: 2500125 - protein, 20 aa, Entamoeba dispar
PQTPYFLYLHEHRASIKEEH

SEQ ID NO: 2500126 - protein, 17 aa, Entamoeba dispar
PQTTYLVLVEWDDLYIK

SEQ ID NO: 2500127 - protein, 17 aa, Entamoeba dispar
PQVLEKIRFSARTLKRR

SEQ ID NO: 2500128 - protein, 19 aa, Entamoeba dispar
PRALKILKGLGFAEDEMKS

SEQ ID NO: 2500129 - protein, 21 aa, Entamoeba dispar
PRANGFIGRTRPTPKPEEPKQ

SEQ ID NO: 2500130 - protein, 20 aa, Entamoeba dispar
PRASGIRFWEHIFPGSKTMN

SEQ ID NO: 2500131 - protein, 25 aa, Entamoeba dispar
PRCGKQCVFEWQLLPQFIYATNLDI

SEQ ID NO: 2500132 - protein, 20 aa, Entamoeba dispar
PRCLCKNSLHSLIIPSSIHS

SEQ ID NO: 2500133 - protein, 17 aa, Entamoeba dispar
PRDCFKKIHYRSTDETT

SEQ ID NO: 2500134 - protein, 21 aa, Entamoeba dispar
PRDIEEIDNILSLLRIEKPME

SEQ ID NO: 2500135 - protein, 28 aa, Entamoeba dispar
PREHVLCICILYGLINRLVKYSSIHMMT

SEQ ID NO: 2500136 - protein, 19 aa, Entamoeba dispar
PREIIGGIDDIVGFNNALE

SEQ ID NO: 2500137 - protein, 18 aa, Entamoeba dispar
PRELDLYPYCIEHINHPE

SEQ ID NO: 2500138 - protein, 19 aa, Entamoeba dispar
PRFFGKRGTLFESSRLSLM

SEQ ID NO: 2500139 - protein, 21 aa, Entamoeba dispar
PRFFWNESLVSILQPYFAHWI

SEQ ID NO: 2500140 - protein, 21 aa, Entamoeba dispar
PRFVKIKADLVIVLFIEIFRA

SEQ ID NO: 2500141 - protein, 19 aa, Entamoeba dispar
PRGKGFRNGIVCFAAALIE

SEQ ID NO: 2500142 - protein, 18 aa, Entamoeba dispar
PRGSIPTFVVASNKTNDA

SEQ ID NO: 2500143 - protein, 22 aa, Entamoeba dispar
PRHGASCPIGIGVSCSADRNIK

SEQ ID NO: 2500144 - protein, 20 aa, Entamoeba dispar
PRHKNFRLFANMNPPTDVGK

SEQ ID NO: 2500145 - protein, 20 aa, Entamoeba dispar
PRIIQLTKNFLFIGKEETKE

SEQ ID NO: 2500146 - protein, 23 aa, Entamoeba dispar
PRIISSLPTCRFILNTNTVDGPY

SEQ ID NO: 2500147 - protein, 18 aa, Entamoeba dispar
PRILLLYTKITSLPKMLF

SEQ ID NO: 2500148 - protein, 20 aa, Entamoeba dispar
PRIMVCVLYPKIIKIDAAFI

SEQ ID NO: 2500149 - protein, 20 aa, Entamoeba dispar
PRINQRWTVCSHGDGDGLCS

SEQ ID NO: 2500150 - protein, 18 aa, Entamoeba dispar
PRIPYRSPTIASFTNSMR

SEQ ID NO: 2500151 - protein, 22 aa, Entamoeba dispar
PRIRIVKKLAGGVCFTPTAKQS

SEQ ID NO: 2500152 - protein, 24 aa, Entamoeba dispar
PRKDTDWDGLLAIIQNIYENELDG

SEQ ID NO: 2500153 - protein, 20 aa, Entamoeba dispar
PRKELMNLIIEKMKASGDEM

SEQ ID NO: 2500154 - protein, 19 aa, Entamoeba dispar
PRKGKSIQVSLNCTLEDLY

SEQ ID NO: 2500155 - protein, 22 aa, Entamoeba dispar
PRKKLGKIYTVFYQTIQLKIEY

SEQ ID NO: 2500156 - protein, 21 aa, Entamoeba dispar
PRKSLKQSREVLMRREQIKTE

SEQ ID NO: 2500157 - protein, 20 aa, Entamoeba dispar
PRLEFIDFVKQIAFCVPTQS

SEQ ID NO: 2500158 - protein, 21 aa, Entamoeba dispar
PRLEQNYSLVCIELIKYIEQF

SEQ ID NO: 2500159 - protein, 20 aa, Entamoeba dispar
PRLFYCVSKTPNIKGEIPLT

SEQ ID NO: 2500160 - protein, 19 aa, Entamoeba dispar
PRLKVKAAVKTALKKKTEL

SEQ ID NO: 2500161 - protein, 17 aa, Entamoeba dispar
PRLTASQKYIFDNIIDL

SEQ ID NO: 2500162 - protein, 25 aa, Entamoeba dispar
PRLTASQKYIFGNIIDLFGKDVKKN

SEQ ID NO: 2500163 - protein, 25 aa, Entamoeba dispar
PRLTLNQKYIFRNIIDLFGNDEKEF

SEQ ID NO: 2500164 - protein, 21 aa, Entamoeba dispar
PRLTVFKKIDGEGIFDISMLF

SEQ ID NO: 2500165 - protein, 17 aa, Entamoeba dispar
PRLYSYWMDASRWSSKM

SEQ ID NO: 2500166 - protein, 24 aa, Entamoeba dispar
PRMKKEWKDILEFLSPESQGLLSL

SEQ ID NO: 2500167 - protein, 17 aa, Entamoeba dispar
PRMSIVLTVLASTTPFG

SEQ ID NO: 2500168 - protein, 18 aa, Entamoeba dispar
PRNLGLWLNISERGGMDG

SEQ ID NO: 2500169 - protein, 24 aa, Entamoeba dispar
PRNLRKIIMDSCLVQIKQIVCSTP

SEQ ID NO: 2500170 - protein, 24 aa, Entamoeba dispar
PRNYCVFCLSKRVAERGQKINKQK

SEQ ID NO: 2500171 - protein, 17 aa, Entamoeba dispar
PRPELGTDHSLCIKQIV

SEQ ID NO: 2500172 - protein, 25 aa, Entamoeba dispar
PRPLDGPEALAFLKKQAIKFNAICS

SEQ ID NO: 2500173 - protein, 21 aa, Entamoeba dispar
PRPVAHGNGGLGISNLTMTAG

SEQ ID NO: 2500174 - protein, 17 aa, Entamoeba dispar
PRRFEIRRHLTQFDIWF

SEQ ID NO: 2500175 - protein, 30 aa, Entamoeba dispar
PRRTRMPSLPFDFHFEFGRSLTNKVGIFGV

SEQ ID NO: 2500176 - protein, 25 aa, Entamoeba dispar
PRSEYKIILIKAIVRTAIDYGDVYT

SEQ ID NO: 2500177 - protein, 20 aa, Entamoeba dispar
PRSFKARPIITHSDGTRQTF

SEQ ID NO: 2500178 - protein, 17 aa, Entamoeba dispar
PRSPIKIRDDREEHDRQ

SEQ ID NO: 2500179 - protein, 28 aa, Entamoeba dispar
PRSSRDWSDLATLYIILKYRKWQLKDRR

SEQ ID NO: 2500180 - protein, 18 aa, Entamoeba dispar
PRSTRWWYSVTRANQIIR

SEQ ID NO: 2500181 - protein, 21 aa, Entamoeba dispar
PRTLGEYLVSFVLPQWKSCLE

SEQ ID NO: 2500182 - protein, 25 aa, Entamoeba dispar
PRTLKWSYSLLCGEIVLRREELKYP

SEQ ID NO: 2500183 - protein, 20 aa, Entamoeba dispar
PRTMPTICANIFIHEFHVDG

SEQ ID NO: 2500184 - protein, 21 aa, Entamoeba dispar
PRTSELYVHRSGRTARAGRSG

SEQ ID NO: 2500185 - protein, 18 aa, Entamoeba dispar
PRTYQLKIPKFIGNAPTG

SEQ ID NO: 2500186 - protein, 24 aa, Entamoeba dispar
PRTYRSHSPFILSVFQSSITNTIN

SEQ ID NO: 2500187 - protein, 19 aa, Entamoeba dispar
PRWMFGYQQAAEWYFSNDT

SEQ ID NO: 2500188 - protein, 21 aa, Entamoeba dispar
PRYDDKIAFRMWGIDDKDQPI

SEQ ID NO: 2500189 - protein, 21 aa, Entamoeba dispar
PRYELFIKQLIKNMPNHHKER

SEQ ID NO: 2500190 - protein, 19 aa, Entamoeba dispar
PRYFYLFNDILIYGIGDSN

SEQ ID NO: 2500191 - protein, 17 aa, Entamoeba dispar
PRYLTPQSPFHFYNLFS

SEQ ID NO: 2500192 - protein, 17 aa, Entamoeba dispar
PRYPLLLNTLIKVTNEN

SEQ ID NO: 2500193 - protein, 17 aa, Entamoeba dispar
PRYSLPMKKIKNYNEQK

SEQ ID NO: 2500194 - protein, 19 aa, Entamoeba dispar
PRYTSIVSVGNQVFLLHYI

SEQ ID NO: 2500195 - protein, 20 aa, Entamoeba dispar
PRYYNCCMCCHSQLDNPRNY

SEQ ID NO: 2500196 - protein, 23 aa, Entamoeba dispar
PSADCKECIVMLLEKDPEKRLTD

SEQ ID NO: 2500197 - protein, 18 aa, Entamoeba dispar
PSAHVFDQQIALAFMYGY

SEQ ID NO: 2500198 - protein, 19 aa, Entamoeba dispar
PSAYCINGAAFSVRQHNKI

SEQ ID NO: 2500199 - protein, 27 aa, Entamoeba dispar
PSDEGFPFCLDCATSIVQRGKIEMYAR

SEQ ID NO: 2500200 - protein, 26 aa, Entamoeba dispar
PSDESYRFYQLLLFNFSQFIADEEFN

SEQ ID NO: 2500201 - protein, 18 aa, Entamoeba dispar
PSDIRSYKIIDSKINEPT

SEQ ID NO: 2500202 - protein, 22 aa, Entamoeba dispar
PSDKFLQLFLLYVSKELTVDEE

SEQ ID NO: 2500203 - protein, 19 aa, Entamoeba dispar
PSEAELFLAGFAKSRKYYT

SEQ ID NO: 2500204 - protein, 31 aa, Entamoeba dispar
PSEEKSMMPFGRYKRDITNIFSVMKSEKKYW

SEQ ID NO: 2500205 - protein, 25 aa, Entamoeba dispar
PSEIDSVGIIKLWCETNHVDYVHRF

SEQ ID NO: 2500206 - protein, 24 aa, Entamoeba dispar
PSEIKRTMIRKVVGLNKKFKSTQS

SEQ ID NO: 2500207 - protein, 24 aa, Entamoeba dispar
PSENRLELVRGFTTFAAIYAEVTK

SEQ ID NO: 2500208 - protein, 27 aa, Entamoeba dispar
PSEVKLLGYQCFKYCYGLTTINIPSSI

SEQ ID NO: 2500209 - protein, 21 aa, Entamoeba dispar
PSEVKSLGDYCFNNCDSLTSI

SEQ ID NO: 2500210 - protein, 26 aa, Entamoeba dispar
PSEVKSLGYFCFRYCYELTSIDIPTS

SEQ ID NO: 2500211 - protein, 17 aa, Entamoeba dispar
PSEWAITIVNLKNKVTT

SEQ ID NO: 2500212 - protein, 25 aa, Entamoeba dispar
PSFCLSKELLLFVRVIMLERLSETS

SEQ ID NO: 2500213 - protein, 24 aa, Entamoeba dispar
PSFILQCIEYLLSEVAQKKFPFIP

SEQ ID NO: 2500214 - protein, 23 aa, Entamoeba dispar
PSFKTQIATIIIFKGYSKENFGY

SEQ ID NO: 2500215 - protein, 18 aa, Entamoeba dispar
PSFLDWKLNVSGKVSDDA

SEQ ID NO: 2500216 - protein, 21 aa, Entamoeba dispar
PSFQMSSLWLSIKDMIELKTR

SEQ ID NO: 2500217 - protein, 17 aa, Entamoeba dispar
PSFSFCSKCSNRVEMQD

SEQ ID NO: 2500218 - protein, 25 aa, Entamoeba dispar
PSFYNVYQCFTLRPPLNQHNSSLNS

SEQ ID NO: 2500219 - protein, 23 aa, Entamoeba dispar
PSGCACPPPPPVVGGCLPPPPPS

SEQ ID NO: 2500220 - protein, 35 aa, Entamoeba dispar
PSGLYEMYCNVPLFKEMLLPALKYGCTLLLPHTIY

SEQ ID NO: 2500221 - protein, 22 aa, Entamoeba dispar
PSGQIEWWDKIYFTSDQITDYP

SEQ ID NO: 2500222 - protein, 21 aa, Entamoeba dispar
PSGQPKISIMKIIVPPHTHLE

SEQ ID NO: 2500223 - protein, 17 aa, Entamoeba dispar
PSGRFVIGGPMGDAGLT

SEQ ID NO: 2500224 - protein, 22 aa, Entamoeba dispar
PSGRLPTTFPITLNQPNLQSFP

SEQ ID NO: 2500225 - protein, 21 aa, Entamoeba dispar
PSGSFWTWKATALGKNMTSVK

SEQ ID NO: 2500226 - protein, 25 aa, Entamoeba dispar
PSGVGHWNSMTWEPPCELLDCGKTY

SEQ ID NO: 2500227 - protein, 27 aa, Entamoeba dispar
PSHHNDIMFYRGYKFVVSLKVSGVALG

SEQ ID NO: 2500228 - protein, 21 aa, Entamoeba dispar
PSHPKFYTVIGESTIPNSFES

SEQ ID NO: 2500229 - protein, 20 aa, Entamoeba dispar
PSHQRFPIIKKLNGEPIRLM

SEQ ID NO: 2500230 - protein, 25 aa, Entamoeba dispar
PSHYLYCGMLIYLLQFNKEAYFSLV

SEQ ID NO: 2500231 - protein, 21 aa, Entamoeba dispar
PSIDSHAFDLIFVNPKESKGF

SEQ ID NO: 2500232 - protein, 18 aa, Entamoeba dispar
PSIENELRSLLSLIELLL

SEQ ID NO: 2500233 - protein, 25 aa, Entamoeba dispar
PSIFKELLLEFLSYCCFIYQCCSKV

SEQ ID NO: 2500234 - protein, 18 aa, Entamoeba dispar
PSIFKKDGKYYLNNNYGI

SEQ ID NO: 2500235 - protein, 17 aa, Entamoeba dispar
PSIFYCDPSLKNEKLLE

SEQ ID NO: 2500236 - protein, 29 aa, Entamoeba dispar
PSIGIYAYELFNFYGVKRIIRIGSAGAFD

SEQ ID NO: 2500237 - protein, 30 aa, Entamoeba dispar
PSIGIYAYELFNFYGVKRIIRIGSAGAINS

SEQ ID NO: 2500238 - protein, 25 aa, Entamoeba dispar
PSIGRCYICGIGGLEYVDEKYDFWK

SEQ ID NO: 2500239 - protein, 18 aa, Entamoeba dispar
PSIIPFIPSINEGKLPSV

SEQ ID NO: 2500240 - protein, 27 aa, Entamoeba dispar
PSIKLKKSCFFNCLLLKETCQTIPLYC

SEQ ID NO: 2500241 - protein, 24 aa, Entamoeba dispar
PSILKELYYAISNITACKDISLLQ

SEQ ID NO: 2500242 - protein, 22 aa, Entamoeba dispar
PSILSVTVPLLLSSGNTLLIRR

SEQ ID NO: 2500243 - protein, 27 aa, Entamoeba dispar
PSINEGKLPSVQQFSALKSNLPSSNEQ

SEQ ID NO: 2500244 - protein, 25 aa, Entamoeba dispar
PSIQKGLFCLMHILLQYHDPQLCHC

SEQ ID NO: 2500245 - protein, 22 aa, Entamoeba dispar
PSIRNTWWFPLINTIPLDQYTR

SEQ ID NO: 2500246 - protein, 31 aa, Entamoeba dispar
PSISKLFIRKCKYCKLPAISFETLNLLIEES

SEQ ID NO: 2500247 - protein, 17 aa, Entamoeba dispar
PSISNRYSMAFTKSPIN

SEQ ID NO: 2500248 - protein, 17 aa, Entamoeba dispar
PSISRGSYRQHIVSVNN

SEQ ID NO: 2500249 - protein, 18 aa, Entamoeba dispar
PSIVGRPRHVSVMAGMGQ

SEQ ID NO: 2500250 - protein, 18 aa, Entamoeba dispar
PSIVKGKECVDGYFSCEH

SEQ ID NO: 2500251 - protein, 22 aa, Entamoeba dispar
PSKCAPPLPTKCAPPVPQKKVA

SEQ ID NO: 2500252 - protein, 24 aa, Entamoeba dispar
PSKCVMSGPGLKTGEVLVPQEFTV

SEQ ID NO: 2500253 - protein, 17 aa, Entamoeba dispar
PSKEEMEPVYAYYKEHN

SEQ ID NO: 2500254 - protein, 20 aa, Entamoeba dispar
PSKGKHILVFDLKEVNEKNA

SEQ ID NO: 2500255 - protein, 17 aa, Entamoeba dispar
PSKKCLVTQQFIKVIKI

SEQ ID NO: 2500256 - protein, 20 aa, Entamoeba dispar
PSKKLIPLINAFQATHKIFQ

SEQ ID NO: 2500257 - protein, 27 aa, Entamoeba dispar
PSKLRSEATIHYVFVVALILTNKNHYH

SEQ ID NO: 2500258 - protein, 18 aa, Entamoeba dispar
PSKNELESLFFIKRQENV

SEQ ID NO: 2500259 - protein, 23 aa, Entamoeba dispar
PSKRYKIGISQTIGKHDRMQDTS

SEQ ID NO: 2500260 - protein, 20 aa, Entamoeba dispar
PSKSTNCIISAPSSVSSTPT

SEQ ID NO: 2500261 - protein, 20 aa, Entamoeba dispar
PSKWKKSLLDALSHSSFFES

SEQ ID NO: 2500262 - protein, 25 aa, Entamoeba dispar
PSLEDCAKYIFNYPAYLEKITSIMD

SEQ ID NO: 2500263 - protein, 20 aa, Entamoeba dispar
PSLIIPQFLEGMSEADEKIK

SEQ ID NO: 2500264 - protein, 19 aa, Entamoeba dispar
PSLINLTKMMLLCLHKNEI

SEQ ID NO: 2500265 - protein, 17 aa, Entamoeba dispar
PSLISGIEFQKRCFPGL

SEQ ID NO: 2500266 - protein, 22 aa, Entamoeba dispar
PSLKSIRISLMEIKRYNENSWA

SEQ ID NO: 2500267 - protein, 26 aa, Entamoeba dispar
PSLLRKRSVKFIQIFTKTIKDLLNGK

SEQ ID NO: 2500268 - protein, 17 aa, Entamoeba dispar
PSLPSLPYEKSYGYNQR

SEQ ID NO: 2500269 - protein, 26 aa, Entamoeba dispar
PSLQKIIPFESFKGIFTQSLSLILFY

SEQ ID NO: 2500270 - protein, 19 aa, Entamoeba dispar
PSLQYVQLIIGYDLMINEK

SEQ ID NO: 2500271 - protein, 19 aa, Entamoeba dispar
PSLSFDCYLNVISQTSPTF

SEQ ID NO: 2500272 - protein, 18 aa, Entamoeba dispar
PSMIPVVIDSSIYKDTTI

SEQ ID NO: 2500273 - protein, 24 aa, Entamoeba dispar
PSNEFSWFEGYAWQIIVCESCGNH

SEQ ID NO: 2500274 - protein, 18 aa, Entamoeba dispar
PSNELALCLNEILPETDP

SEQ ID NO: 2500275 - protein, 24 aa, Entamoeba dispar
PSNENRLLFAQCLYRVAKYDECRS

SEQ ID NO: 2500276 - protein, 23 aa, Entamoeba dispar
PSNFTVLIHLRYLSLSSNNLTTF

SEQ ID NO: 2500277 - protein, 23 aa, Entamoeba dispar
PSNGEAFSLLAACQYSKGPKKVN

SEQ ID NO: 2500278 - protein, 32 aa, Entamoeba dispar
PSNHLDFHALIWLEEVLKNWDGTLLIVSHQRQ

SEQ ID NO: 2500279 - protein, 27 aa, Entamoeba dispar
PSNHLLYRIKYYVPYYCYLENKKKWIH

SEQ ID NO: 2500280 - protein, 24 aa, Entamoeba dispar
PSNILTPFIRRVIFFLAPTTEMRT

SEQ ID NO: 2500281 - protein, 18 aa, Entamoeba dispar
PSNKPVIVSIKEFREVFI

SEQ ID NO: 2500282 - protein, 25 aa, Entamoeba dispar
PSNKRGFVTTCCIAIIQTIPFTSSQ

SEQ ID NO: 2500283 - protein, 24 aa, Entamoeba dispar
PSNLQCRVILYPVLHSIRCTIHKA

SEQ ID NO: 2500284 - protein, 19 aa, Entamoeba dispar
PSNSFIIGIGCFNGNVFEI

SEQ ID NO: 2500285 - protein, 18 aa, Entamoeba dispar
PSPDCLTYYFNVVQATNN

SEQ ID NO: 2500286 - protein, 19 aa, Entamoeba dispar
PSPEEKLFILISEKLTFLK

SEQ ID NO: 2500287 - protein, 29 aa, Entamoeba dispar
PSPKIPGKYFIKYMRNIPIHFQWFTQQKQ

SEQ ID NO: 2500288 - protein, 25 aa, Entamoeba dispar
PSPKLSLPLHFMVASGMVDSQMVMK

SEQ ID NO: 2500289 - protein, 24 aa, Entamoeba dispar
PSPQRSYCFNQMIKKYIINSPLFE

SEQ ID NO: 2500290 - protein, 24 aa, Entamoeba dispar
PSQAFWKFMNLIASKVTLEGYQNY

SEQ ID NO: 2500291 - protein, 22 aa, Entamoeba dispar
PSQFYQQFRIAKQLAQQHQNGI

SEQ ID NO: 2500292 - protein, 19 aa, Entamoeba dispar
PSQGSFLVLRWGECKRHNK

SEQ ID NO: 2500293 - protein, 17 aa, Entamoeba dispar
PSQIPSLRNYVVSRIFC

SEQ ID NO: 2500294 - protein, 20 aa, Entamoeba dispar
PSQIRFIIHTSTNYLPKNTF

SEQ ID NO: 2500295 - protein, 20 aa, Entamoeba dispar
PSQKMNWKAIINILNLAALD

SEQ ID NO: 2500296 - protein, 19 aa, Entamoeba dispar
  misc_feature (14)..(15): Xaa can be any naturally occurring amino acid
PSQQLSILCDTSFXXLPWL

SEQ ID NO: 2500297 - protein, 22 aa, Entamoeba dispar
PSQSRSGACWFIDNQDGKTTMA

SEQ ID NO: 2500298 - protein, 22 aa, Entamoeba dispar
PSRVSALGANCFKECSSLKSIN

SEQ ID NO: 2500299 - protein, 18 aa, Entamoeba dispar
PSRYKCVLNLHENGTSDS

SEQ ID NO: 2500300 - protein, 20 aa, Entamoeba dispar
PSSDESIIFDMCDVLQEVNE

SEQ ID NO: 2500301 - protein, 26 aa, Entamoeba dispar
PSSEDKWKWLTVFRDAFYHSAKDKLI

SEQ ID NO: 2500302 - protein, 24 aa, Entamoeba dispar
PSSICKCPLLKLYMDNNNISSITN

SEQ ID NO: 2500303 - protein, 18 aa, Entamoeba dispar
PSSIDRIRHSSLSSPQQQ

SEQ ID NO: 2500304 - protein, 20 aa, Entamoeba dispar
PSSIEWCHMIGLNYVSCSSY

SEQ ID NO: 2500305 - protein, 20 aa, Entamoeba dispar
PSSIIKLGYYCFDGCSSLTS

SEQ ID NO: 2500306 - protein, 29 aa, Entamoeba dispar
PSSIISFGRSCFYGCGCVEELKQNKRIPR

SEQ ID NO: 2500307 - protein, 24 aa, Entamoeba dispar
PSSIISFGYGCFDGCTSLKSINID

SEQ ID NO: 2500308 - protein, 18 aa, Entamoeba dispar
PSSIPISFWKEFKDFLKV

SEQ ID NO: 2500309 - protein, 17 aa, Entamoeba dispar
PSSISEFGWECFCECGC

SEQ ID NO: 2500310 - protein, 25 aa, Entamoeba dispar
PSSISKFGDWCFNRCISLISINIPS

SEQ ID NO: 2500311 - protein, 26 aa, Entamoeba dispar
PSSISKIGWNCFYKCSSLTSIVIPPL

SEQ ID NO: 2500312 - protein, 19 aa, Entamoeba dispar
PSSISKLGDRCFYKCTSLT

SEQ ID NO: 2500313 - protein, 23 aa, Entamoeba dispar
PSSISKLGITCFEECLSLTSMNI

SEQ ID NO: 2500314 - protein, 27 aa, Entamoeba dispar
PSSISKLGNHCFSGCYSLTSINIPITV

SEQ ID NO: 2500315 - protein, 27 aa, Entamoeba dispar
PSSISKLGYCCFCYCYSLKSINIPASV

SEQ ID NO: 2500316 - protein, 23 aa, Entamoeba dispar
PSSITKIGHWCFKECSSLTSINI

SEQ ID NO: 2500317 - protein, 19 aa, Entamoeba dispar
PSSITKLGDYCFSYYPSLT

SEQ ID NO: 2500318 - protein, 19 aa, Entamoeba dispar
PSSITKLGNYCFYQCSSLT

SEQ ID NO: 2500319 - protein, 26 aa, Entamoeba dispar
PSSITKLGSWCLCKCSSLKSITIPST

SEQ ID NO: 2500320 - protein, 21 aa, Entamoeba dispar
PSSITKLGYDCFNGCKSLKSI

SEQ ID NO: 2500321 - protein, 22 aa, Entamoeba dispar
PSSITSFGGYCFYNCGCEEELK

SEQ ID NO: 2500322 - protein, 22 aa, Entamoeba dispar
PSSITSFGWGCFYKCGCEDELK

SEQ ID NO: 2500323 - protein, 27 aa, Entamoeba dispar
PSSITSFGYKCFYRCLSLTLINIPSSI

SEQ ID NO: 2500324 - protein, 18 aa, Entamoeba dispar
PSSKRYEEIWKRKEIEEE

SEQ ID NO: 2500325 - protein, 20 aa, Entamoeba dispar
PSSLTKLVIYHIDKKDDILF

SEQ ID NO: 2500326 - protein, 25 aa, Entamoeba dispar
PSSMGLKSSAAQIVAQRKKLPKSGK

SEQ ID NO: 2500327 - protein, 19 aa, Entamoeba dispar
PSSMNSFLLYLIQESVITP

SEQ ID NO: 2500328 - protein, 32 aa, Entamoeba dispar
PSSPRRLRALSRESLRALSCKSISECNPNGQC

SEQ ID NO: 2500329 - protein, 24 aa, Entamoeba dispar
PSSQPCAQGLCYTLSTYFDDSGEF

SEQ ID NO: 2500330 - protein, 25 aa, Entamoeba dispar
PSSTREFGCWCFNKCSSLKSVNIPS

SEQ ID NO: 2500331 - protein, 29 aa, Entamoeba dispar
PSSVIKLGYRCFFYMFKIGNECFYDCKSL

SEQ ID NO: 2500332 - protein, 27 aa, Entamoeba dispar
PSSVKIIGGFCFKGCSSLKTINIPSSV

SEQ ID NO: 2500333 - protein, 24 aa, Entamoeba dispar
PSSVSKIGDWCFYGCKSLKSINIP

SEQ ID NO: 2500334 - protein, 21 aa, Entamoeba dispar
PSSVSKIGHWCFDGCSSLTSI

SEQ ID NO: 2500335 - protein, 24 aa, Entamoeba dispar
PSSVSKLGLCCFRQCSSLTSIIIP

SEQ ID NO: 2500336 - protein, 21 aa, Entamoeba dispar
PSSVSKLGMYCFSGCSSLTSV

SEQ ID NO: 2500337 - protein, 24 aa, Entamoeba dispar
PSSVSTLGYYCFDKCLSLTSINIP

SEQ ID NO: 2500338 - protein, 28 aa, Entamoeba dispar
PSSVTSFGMWCFSKCGCAKELKKNKQIP

SEQ ID NO: 2500339 - protein, 19 aa, Entamoeba dispar
PSTAFCVLLRLFQLNPTPD

SEQ ID NO: 2500340 - protein, 27 aa, Entamoeba dispar
PSTCFSSVLPFPFSVPISSPTPSPSIC

SEQ ID NO: 2500341 - protein, 25 aa, Entamoeba dispar
PSTCLSWDISCDIALLMCVSNYGLG

SEQ ID NO: 2500342 - protein, 25 aa, Entamoeba dispar
PSTEAQLLHCFEVIKYSFCDVQQRR

SEQ ID NO: 2500343 - protein, 23 aa, Entamoeba dispar
PSTIRLIECYCFGGCSSLQSINL

SEQ ID NO: 2500344 - protein, 26 aa, Entamoeba dispar
PSTISKLGICCFKECYSLKSINIPAS

SEQ ID NO: 2500345 - protein, 19 aa, Entamoeba dispar
PSTITSLGDYCFSQCSSLT

SEQ ID NO: 2500346 - protein, 24 aa, Entamoeba dispar
PSTITYIGAFSFSHCSSLRQIKLP

SEQ ID NO: 2500347 - protein, 22 aa, Entamoeba dispar
PSTLKRNSVILSRVPLEILNTL

SEQ ID NO: 2500348 - protein, 23 aa, Entamoeba dispar
PSTQRPLLIEVYSAYDPKNLYNA

SEQ ID NO: 2500349 - protein, 18 aa, Entamoeba dispar
PSTSFDWNTINIDRKVFD

SEQ ID NO: 2500350 - protein, 27 aa, Entamoeba dispar
PSVIELGTGCFRECTLLRNITIPTSVT

SEQ ID NO: 2500351 - protein, 23 aa, Entamoeba dispar
PSVINCSKGFFDSLVDFLTLPTN

SEQ ID NO: 2500352 - protein, 25 aa, Entamoeba dispar
PSVLSIHRSCLWICKQLRSLKIPQQ

SEQ ID NO: 2500353 - protein, 19 aa, Entamoeba dispar
PSVLTSIGDLCFFQCNRIT

SEQ ID NO: 2500354 - protein, 23 aa, Entamoeba dispar
PSVPLVCSLFKLLTTSLPEETKL

SEQ ID NO: 2500355 - protein, 25 aa, Entamoeba dispar
PSVTVEALTTFFSFTGNVTQVRLSD

SEQ ID NO: 2500356 - protein, 26 aa, Entamoeba dispar
PSVTWDVLRLITAFAQSAADGNIDPN

SEQ ID NO: 2500357 - protein, 25 aa, Entamoeba dispar
PSVTYTFHCPLSFSEIIPNELNGKI

SEQ ID NO: 2500358 - protein, 18 aa, Entamoeba dispar
PSVVKYLIQNGASIVSID

SEQ ID NO: 2500359 - protein, 21 aa, Entamoeba dispar
PSWFIPMAMHPAAYKHYKDFI

SEQ ID NO: 2500360 - protein, 26 aa, Entamoeba dispar
PSYRPPEIWFGAIIYGPAVDVWSIGC

SEQ ID NO: 2500361 - protein, 29 aa, Entamoeba dispar
PTAEQIMALPLFWDFNKKLNFIKSASDLF

SEQ ID NO: 2500362 - protein, 24 aa, Entamoeba dispar
PTDKRFPPIRIKARDPAKLASQRI

SEQ ID NO: 2500363 - protein, 24 aa, Entamoeba dispar
PTEGFWEHVCIVWTKCYNYTSEEV

SEQ ID NO: 2500364 - protein, 24 aa, Entamoeba dispar
PTEGFWEHVCVVWTKCLYNISENE

SEQ ID NO: 2500365 - protein, 31 aa, Entamoeba dispar
PTEIELWKILTNCYGKWIINQSVVSSWKDVM

SEQ ID NO: 2500366 - protein, 17 aa, Entamoeba dispar
PTEKFKILLGNLDKSCV

SEQ ID NO: 2500367 - protein, 23 aa, Entamoeba dispar
PTEKGKYSWYFNIVDRVLMTNIM

SEQ ID NO: 2500368 - protein, 24 aa, Entamoeba dispar
PTEKKCLFVRKSIMPEKRYTCVAG

SEQ ID NO: 2500369 - protein, 19 aa, Entamoeba dispar
PTENGHIFIQTSIKNDKVK

SEQ ID NO: 2500370 - protein, 24 aa, Entamoeba dispar
PTEVKRIGNGCFEGSQIKEITIPS

SEQ ID NO: 2500371 - protein, 20 aa, Entamoeba dispar
PTFLSNLIILQSRYFALTNA

SEQ ID NO: 2500372 - protein, 22 aa, Entamoeba dispar
PTFWYSLYQEFLFETKGLKEQE

SEQ ID NO: 2500373 - protein, 23 aa, Entamoeba dispar
PTGEEARSWWIMMQEDSKQMSAS

SEQ ID NO: 2500374 - protein, 23 aa, Entamoeba dispar
PTGEFKGPVIVQPGSPFFLSFDE

SEQ ID NO: 2500375 - protein, 18 aa, Entamoeba dispar
PTGIIQANCCILGNPETG

SEQ ID NO: 2500376 - protein, 17 aa, Entamoeba dispar
PTGKEVGTFMGIDVGGT

SEQ ID NO: 2500377 - protein, 18 aa, Entamoeba dispar
PTGKEVGTFMGIDVGGTN

SEQ ID NO: 2500378 - protein, 17 aa, Entamoeba dispar
PTGLIPVLVNFINHPNS

SEQ ID NO: 2500379 - protein, 20 aa, Entamoeba dispar
PTGLSANWTNPVLTTPIYSF

SEQ ID NO: 2500380 - protein, 24 aa, Entamoeba dispar
PTGQIGGIERYHGPGIVLGTSKII

SEQ ID NO: 2500381 - protein, 26 aa, Entamoeba dispar
PTGYKGSCFYRVIKNTVIQGGDIVNG

SEQ ID NO: 2500382 - protein, 20 aa, Entamoeba dispar
PTHKDTVAEEIWKFTHMFSE

SEQ ID NO: 2500383 - protein, 26 aa, Entamoeba dispar
PTHKFEVFNEGKYCLKHHSIKTYYCC

SEQ ID NO: 2500384 - protein, 23 aa, Entamoeba dispar
PTIKYLTCIVMIYIDISYVRYNI

SEQ ID NO: 2500385 - protein, 24 aa, Entamoeba dispar
PTILKSQLFGSGMIKYTHHPHVIL

SEQ ID NO: 2500386 - protein, 22 aa, Entamoeba dispar
PTIMCTQPVFRPAINSSSHENI

SEQ ID NO: 2500387 - protein, 34 aa, Entamoeba dispar
PTIMKRLSKLYEEFPRVVKQFARNRPLEYGPNRH

SEQ ID NO: 2500388 - protein, 32 aa, Entamoeba dispar
PTIPYLLCIICQVPVILPNYFDTIKEKKEDQN

SEQ ID NO: 2500389 - protein, 17 aa, Entamoeba dispar
PTITKLGEWCFDGCTSL

SEQ ID NO: 2500390 - protein, 25 aa, Entamoeba dispar
PTITLRYANPYSFIPKNTYKLSITG

SEQ ID NO: 2500391 - protein, 25 aa, Entamoeba dispar
PTKCTKLKIQKCKELTRLDLPSTLT

SEQ ID NO: 2500392 - protein, 17 aa, Entamoeba dispar
PTKEFSGGWRMRISIAK

SEQ ID NO: 2500393 - protein, 19 aa, Entamoeba dispar
PTKRSVVTRQYFKINELRR

SEQ ID NO: 2500394 - protein, 23 aa, Entamoeba dispar
PTKSSDIVPSFTLACNKEGPYSE

SEQ ID NO: 2500395 - protein, 17 aa, Entamoeba dispar
PTKVMFMPPSLNQQNDL

SEQ ID NO: 2500396 - protein, 26 aa, Entamoeba dispar
PTKYKRIIKEKVFCITDTCLYKINGW

SEQ ID NO: 2500397 - protein, 22 aa, Entamoeba dispar
PTKYLLMWLDFLIKDVESNLID

SEQ ID NO: 2500398 - protein, 25 aa, Entamoeba dispar
PTLEFLASIDCFWETKKTFDYGCFN

SEQ ID NO: 2500399 - protein, 31 aa, Entamoeba dispar
PTLKLLIPYFNDWYIRDGISGAWSVLLDVYN

SEQ ID NO: 2500400 - protein, 21 aa, Entamoeba dispar
PTLKYKTFEWLFWDVSGAAKF

SEQ ID NO: 2500401 - protein, 21 aa, Entamoeba dispar
PTLMKILIFMKNCLTAKDPEK

SEQ ID NO: 2500402 - protein, 18 aa, Entamoeba dispar
PTMKTCLGKINMMIQDNE

SEQ ID NO: 2500403 - protein, 22 aa, Entamoeba dispar
PTMMAGKLYKFIPENQNGRFYP

SEQ ID NO: 2500404 - protein, 20 aa, Entamoeba dispar
PTNKAPLLWNSHTHSKSLSI

SEQ ID NO: 2500405 - protein, 25 aa, Entamoeba dispar
PTNLFTIQFFFQVARILKLDGIFCL

SEQ ID NO: 2500406 - protein, 22 aa, Entamoeba dispar
PTNMKLTVIGTVTYEEDKNALK

SEQ ID NO: 2500407 - protein, 19 aa, Entamoeba dispar
PTPKEYRVINLLNKGVLNI

SEQ ID NO: 2500408 - protein, 25 aa, Entamoeba dispar
PTPKIPILPLWLGDIIHAHTAFSSN

SEQ ID NO: 2500409 - protein, 20 aa, Entamoeba dispar
PTPLDFLRRFSRAADNTEKP

SEQ ID NO: 2500410 - protein, 21 aa, Entamoeba dispar
PTPRRSSSVSVKYIPPQQIKG

SEQ ID NO: 2500411 - protein, 17 aa, Entamoeba dispar
PTPVEIYDSVQFKLIDP

SEQ ID NO: 2500412 - protein, 21 aa, Entamoeba dispar
PTQGKVFTRYSLNNENSILIC

SEQ ID NO: 2500413 - protein, 23 aa, Entamoeba dispar
PTQPEVGKGFTITMNGGSKLPTK

SEQ ID NO: 2500414 - protein, 20 aa, Entamoeba dispar
PTQRNFRSSSGFPLNKSIDV

SEQ ID NO: 2500415 - protein, 20 aa, Entamoeba dispar
PTQSWCFGWYSFQYSISENN

SEQ ID NO: 2500416 - protein, 21 aa, Entamoeba dispar
PTRDLKKGFKSLLQMNSDKVF

SEQ ID NO: 2500417 - protein, 19 aa, Entamoeba dispar
PTRLKRFASKYHYNEEDDI

SEQ ID NO: 2500418 - protein, 18 aa, Entamoeba dispar
PTRTARFGTAFSDDGLVT

SEQ ID NO: 2500419 - protein, 18 aa, Entamoeba dispar
PTRTCAFVTTKVYDNDQG

SEQ ID NO: 2500420 - protein, 19 aa, Entamoeba dispar
PTSDVIFCLNTDHITKIKQ

SEQ ID NO: 2500421 - protein, 22 aa, Entamoeba dispar
PTSETIIYPAFKNWISGHRDLP

SEQ ID NO: 2500422 - protein, 18 aa, Entamoeba dispar
PTSEVLNRIASGENVVGA

SEQ ID NO: 2500423 - protein, 21 aa, Entamoeba dispar
PTSIIKLGDRCFSGCTSLISI

SEQ ID NO: 2500424 - protein, 18 aa, Entamoeba dispar
PTSISILPINCFNGCKSL

SEQ ID NO: 2500425 - protein, 26 aa, Entamoeba dispar
PTSITSIGDWCFNRCSSITSINIPTS

SEQ ID NO: 2500426 - protein, 25 aa, Entamoeba dispar
PTSITSIGDWCFNRCSSITTINIPT

SEQ ID NO: 2500427 - protein, 25 aa, Entamoeba dispar
PTSNAILLLRWVVDWLEKDKRILMD

SEQ ID NO: 2500428 - protein, 17 aa, Entamoeba dispar
PTSRGKVSLFSQSVTDN

SEQ ID NO: 2500429 - protein, 25 aa, Entamoeba dispar
PTTIDCMRFFFSLCDVDNDNSLNEK

SEQ ID NO: 2500430 - protein, 25 aa, Entamoeba dispar
PTTISKIGYYCFNECLSLTSINIPT

SEQ ID NO: 2500431 - protein, 28 aa, Entamoeba dispar
PTTISKLGGWCFFGSTSLTSIDIPTTII

SEQ ID NO: 2500432 - protein, 26 aa, Entamoeba dispar
PTTISKLGRYCFKNCSSLKAIDIPTS

SEQ ID NO: 2500433 - protein, 20 aa, Entamoeba dispar
PTTISSFGVRCFVGCDKCKV

SEQ ID NO: 2500434 - protein, 24 aa, Entamoeba dispar
PTTKENRLDCTFDISIINENRGIK

SEQ ID NO: 2500435 - protein, 30 aa, Entamoeba dispar
PTTLPLIDRMSCIRSSCFYDSDNFEGSREW

SEQ ID NO: 2500436 - protein, 20 aa, Entamoeba dispar
PTTNIKVRFIDGKQKVFKVN

SEQ ID NO: 2500437 - protein, 19 aa, Entamoeba dispar
PTTPTLLTRATFFEPKYKK

SEQ ID NO: 2500438 - protein, 24 aa, Entamoeba dispar
PTTPWKYEVIFGPSNDFLYKQNPS

SEQ ID NO: 2500439 - protein, 17 aa, Entamoeba dispar
PTTTGMRLAQQATVRGM

SEQ ID NO: 2500440 - protein, 30 aa, Entamoeba dispar
PTTVSELGWKCFKWCSLKSINIPTTITKFG

SEQ ID NO: 2500441 - protein, 35 aa, Entamoeba dispar
PTVCDPEILSKIAWLFSNFCRFKPSIPEQQLEPFI

SEQ ID NO: 2500442 - protein, 21 aa, Entamoeba dispar
PTVMKNMFPERVIKEKVIKKV

SEQ ID NO: 2500443 - protein, 20 aa, Entamoeba dispar
PTVRTCCSFVSNNPYIKLVT

SEQ ID NO: 2500444 - protein, 23 aa, Entamoeba dispar
PTVTHCLFCVVGEMGIPLTEYIS

SEQ ID NO: 2500445 - protein, 24 aa, Entamoeba dispar
PTWTKSGLRELRFLKMKEEKTRSL

SEQ ID NO: 2500446 - protein, 20 aa, Entamoeba dispar
PTYGYRRVWALLRRQAELDG

SEQ ID NO: 2500447 - protein, 33 aa, Entamoeba dispar
PTYSNEIFIGLTLLRFGIHLEDVLNYVKPLNLN

SEQ ID NO: 2500448 - protein, 24 aa, Entamoeba dispar
PVAIRLKIYSPYVVDLTLVDLPGL

SEQ ID NO: 2500449 - protein, 17 aa, Entamoeba dispar
PVAQQWKILMKKITEGV

SEQ ID NO: 2500450 - protein, 18 aa, Entamoeba dispar
PVCSINLKIDEYLPKEMA

SEQ ID NO: 2500451 - protein, 19 aa, Entamoeba dispar
PVDEYKSAFYLMLNGRQKY

SEQ ID NO: 2500452 - protein, 21 aa, Entamoeba dispar
PVDSLSLPVANTIRVMRKSVS

SEQ ID NO: 2500453 - protein, 18 aa, Entamoeba dispar
PVDVPIQISPMYSQTNSV

SEQ ID NO: 2500454 - protein, 21 aa, Entamoeba dispar
PVECRDLQCFFSLSKDISRFE

SEQ ID NO: 2500455 - protein, 25 aa, Entamoeba dispar
PVEDIKLLIELAVALAEHRVSINGT

SEQ ID NO: 2500456 - protein, 23 aa, Entamoeba dispar
PVEDVKLVSVFVKNIPYGWATND

SEQ ID NO: 2500457 - protein, 23 aa, Entamoeba dispar
PVELSWYPGGIAYQLNASRGEIQ

SEQ ID NO: 2500458 - protein, 26 aa, Entamoeba dispar
PVERRRALCFTPLFTTAAHFQIDAIF

SEQ ID NO: 2500459 - protein, 19 aa, Entamoeba dispar
PVFPLGEPKTFQDTISGIE

SEQ ID NO: 2500460 - protein, 27 aa, Entamoeba dispar
PVFTHSVWRLLLWAADYYHHPIGDVLF

SEQ ID NO: 2500461 - protein, 23 aa, Entamoeba dispar
PVFVRSDFRTEFIFDCPELTQST

SEQ ID NO: 2500462 - protein, 19 aa, Entamoeba dispar
PVGQQWVKMGYYMSIYNGN

SEQ ID NO: 2500463 - protein, 30 aa, Entamoeba dispar
PVIADRKRLRVGFKLVFEFEKNEWFEETEL

SEQ ID NO: 2500464 - protein, 31 aa, Entamoeba dispar
PVINCNSYCLFHFCHEVFYFIAVTDIDVSPL

SEQ ID NO: 2500465 - protein, 17 aa, Entamoeba dispar
PVIQYLAAFGIGKLVIV

SEQ ID NO: 2500466 - protein, 17 aa, Entamoeba dispar
PVKEVLDGFQLEIKVGK

SEQ ID NO: 2500467 - protein, 20 aa, Entamoeba dispar
PVKIILGVLVYTIIKDFFSE

SEQ ID NO: 2500468 - protein, 20 aa, Entamoeba dispar
PVKVAEPFNPVASNTPYSPF

SEQ ID NO: 2500469 - protein, 23 aa, Entamoeba dispar
PVLGWGCPDPYACVWDNNEKWIK

SEQ ID NO: 2500470 - protein, 29 aa, Entamoeba dispar
PVLIKMVNRFKRIFVRDSNPHLPIHSSLS

SEQ ID NO: 2500471 - protein, 17 aa, Entamoeba dispar
PVLIVRLGDKLYPINKH

SEQ ID NO: 2500472 - protein, 17 aa, Entamoeba dispar
PVLLTCYAQLLSDNKVL

SEQ ID NO: 2500473 - protein, 27 aa, Entamoeba dispar
PVLNPPYFKQIFSWLISNLESQPKYIE

SEQ ID NO: 2500474 - protein, 23 aa, Entamoeba dispar
PVLPYVMSALCRMVDSPNKAIRP

SEQ ID NO: 2500475 - protein, 19 aa, Entamoeba dispar
PVLQRLLEIFNRYENEEVQ

SEQ ID NO: 2500476 - protein, 25 aa, Entamoeba dispar
PVNARIDIVIGLFKKIGMIMNDVKI

SEQ ID NO: 2500477 - protein, 26 aa, Entamoeba dispar
PVNASCDIWALGCLLYELYTSKMLFA

SEQ ID NO: 2500478 - protein, 19 aa, Entamoeba dispar
PVNVLIGFRSLKGIMQCDN

SEQ ID NO: 2500479 - protein, 17 aa, Entamoeba dispar
PVNVRFIIDSSGLFTVE

SEQ ID NO: 2500480 - protein, 18 aa, Entamoeba dispar
PVPAPRRGLTLGRKSVTN

SEQ ID NO: 2500481 - protein, 27 aa, Entamoeba dispar
PVPEHRERKASFLTRPKKGVNTNESEE

SEQ ID NO: 2500482 - protein, 19 aa, Entamoeba dispar
PVPHYKANQPFKCVPVKNL

SEQ ID NO: 2500483 - protein, 20 aa, Entamoeba dispar
PVPHYKANQPFKCVPVKNLT

SEQ ID NO: 2500484 - protein, 22 aa, Entamoeba dispar
PVPPKPRSGLMNESAPSSEDNE

SEQ ID NO: 2500485 - protein, 20 aa, Entamoeba dispar
PVQRIPRYVLLMKEYMKCTP

SEQ ID NO: 2500486 - protein, 28 aa, Entamoeba dispar
PVQRLPRYKLLLADLLKYTPACHPDHEN

SEQ ID NO: 2500487 - protein, 23 aa, Entamoeba dispar
PVQRLPRYNLLLNELLKHTPTDH

SEQ ID NO: 2500488 - protein, 21 aa, Entamoeba dispar
PVRFKETLLSYYTLSKVLYII

SEQ ID NO: 2500489 - protein, 17 aa, Entamoeba dispar
PVSFLFVDTLTFNVINS

SEQ ID NO: 2500490 - protein, 18 aa, Entamoeba dispar
PVSSLMFHPTEHLLATGC

SEQ ID NO: 2500491 - protein, 18 aa, Entamoeba dispar
PVSTEWKEEEIILDNANV

SEQ ID NO: 2500492 - protein, 18 aa, Entamoeba dispar
PVSTEWKGAMKHLGGRDY

SEQ ID NO: 2500493 - protein, 19 aa, Entamoeba dispar
PVTEIKYQLLRDNKFLEKS

SEQ ID NO: 2500494 - protein, 18 aa, Entamoeba dispar
PVVKLCKKIIIVDVSCVF

SEQ ID NO: 2500495 - protein, 35 aa, Entamoeba dispar
PVVKWLWEILHSYSIELKKKFLFFSTGSDRCPPGG

SEQ ID NO: 2500496 - protein, 25 aa, Entamoeba dispar
PVVVKIKVLFMRDGVQAEENANVYI

SEQ ID NO: 2500497 - protein, 23 aa, Entamoeba dispar
PVYFRGADCAIIVYDVTRRETFE

SEQ ID NO: 2500498 - protein, 20 aa, Entamoeba dispar
PVYPLSSLINLSSLDIESIT

SEQ ID NO: 2500499 - protein, 19 aa, Entamoeba dispar
PWDGMLCDLVWSDFSNTTS

SEQ ID NO: 2500500 - protein, 19 aa, Entamoeba dispar
PWDIADAITSGKRPPIIQE

SEQ ID NO: 2500501 - protein, 18 aa, Entamoeba dispar
PWIPEIYENFFANIGGIY

SEQ ID NO: 2500502 - protein, 19 aa, Entamoeba dispar
PWIQKGIHPTIIISGFLDA

SEQ ID NO: 2500503 - protein, 25 aa, Entamoeba dispar
PWKSNGEGLMYIGVMNKAERISDKP

SEQ ID NO: 2500504 - protein, 19 aa, Entamoeba dispar
PWKTMPDIFYAFPKHFYDN

SEQ ID NO: 2500505 - protein, 19 aa, Entamoeba dispar
PWLHETNVGIALQRQMMFL

SEQ ID NO: 2500506 - protein, 18 aa, Entamoeba dispar
PWMINSLPYVMSRGPALQ

SEQ ID NO: 2500507 - protein, 18 aa, Entamoeba dispar
PWNGLKFVDSDGLFIVPK

SEQ ID NO: 2500508 - protein, 29 aa, Entamoeba dispar
PWNKGKQTIKGFCFGSSFETSTLLIQIIS

SEQ ID NO: 2500509 - protein, 19 aa, Entamoeba dispar
PYADCKAEVLPWEMKKSCP

SEQ ID NO: 2500510 - protein, 19 aa, Entamoeba dispar
PYAFQIRFAGVKGVLTVDR

SEQ ID NO: 2500511 - protein, 17 aa, Entamoeba dispar
PYASLVLVKTMISSDDL

SEQ ID NO: 2500512 - protein, 21 aa, Entamoeba dispar
PYCLPLIPKTVEWLNSELPPN

SEQ ID NO: 2500513 - protein, 27 aa, Entamoeba dispar
PYDGFKTDIWCCGVMLFYMSTGMFPFN

SEQ ID NO: 2500514 - protein, 18 aa, Entamoeba dispar
PYDILLIVACWRAEKRHH

SEQ ID NO: 2500515 - protein, 18 aa, Entamoeba dispar
PYDPCYLLPLTYHALDRA

SEQ ID NO: 2500516 - protein, 23 aa, Entamoeba dispar
PYDPLCLDEYPLLLRMVEDDVIA

SEQ ID NO: 2500517 - protein, 18 aa, Entamoeba dispar
PYDPTCLKEYPLLLRIVE

SEQ ID NO: 2500518 - protein, 17 aa, Entamoeba dispar
PYDSMLMKTYISSNDII

SEQ ID NO: 2500519 - protein, 28 aa, Entamoeba dispar
PYDTSPRKFLIVMPKFFYEPIQQIKSEL

SEQ ID NO: 2500520 - protein, 20 aa, Entamoeba dispar
PYDYPMKPPFFFTDPSPDMV

SEQ ID NO: 2500521 - protein, 30 aa, Entamoeba dispar
PYETNVCYLPIINNRVGNFPIVLKLNPKCQ

SEQ ID NO: 2500522 - protein, 22 aa, Entamoeba dispar
PYEYKRKIFIGKQATLPDFRIK

SEQ ID NO: 2500523 - protein, 25 aa, Entamoeba dispar
PYFEKEIYVSLPIEKIPLSPSINCE

SEQ ID NO: 2500524 - protein, 29 aa, Entamoeba dispar
PYFKTSIFWKLCCVYDHIVVHTLIRYCST

SEQ ID NO: 2500525 - protein, 18 aa, Entamoeba dispar
PYFLISGKVLNSYITDGI

SEQ ID NO: 2500526 - protein, 19 aa, Entamoeba dispar
PYFQECFVLAYRLVTTPEK

SEQ ID NO: 2500527 - protein, 17 aa, Entamoeba dispar
PYFRKMLFTGSAEKKGC

SEQ ID NO: 2500528 - protein, 22 aa, Entamoeba dispar
PYGCSVVLFKLNIVSNICDVYQ

SEQ ID NO: 2500529 - protein, 28 aa, Entamoeba dispar
PYGNKIDCWSCGVVIYSLLYGTFPFAGE

SEQ ID NO: 2500530 - protein, 17 aa, Entamoeba dispar
PYGPWSIYMKDAEMYLG

SEQ ID NO: 2500531 - protein, 21 aa, Entamoeba dispar
PYHIKVLLEFYSSRGKLIDLL

SEQ ID NO: 2500532 - protein, 24 aa, Entamoeba dispar
PYHLKLCFCPLCQKGISVLLKERS

SEQ ID NO: 2500533 - protein, 19 aa, Entamoeba dispar
PYHLLYYLLNLFISSYSDN

SEQ ID NO: 2500534 - protein, 23 aa, Entamoeba dispar
PYIDELIRGTAILQYNISCLCEM

SEQ ID NO: 2500535 - protein, 17 aa, Entamoeba dispar
PYIKVDLTIKVIEVSTI

SEQ ID NO: 2500536 - protein, 19 aa, Entamoeba dispar
PYIPEHLLLLLSTSEACQV

SEQ ID NO: 2500537 - protein, 22 aa, Entamoeba dispar
PYKALEIYGNIISYIDHQQYIN

SEQ ID NO: 2500538 - protein, 19 aa, Entamoeba dispar
PYKNVSMFVIRNEENIKNP

SEQ ID NO: 2500539 - protein, 23 aa, Entamoeba dispar
PYKRTKLVAQWYLSGFAHAMKVV

SEQ ID NO: 2500540 - protein, 28 aa, Entamoeba dispar
PYLDSGVYRMDLKFRDFLMQKMINGERT

SEQ ID NO: 2500541 - protein, 23 aa, Entamoeba dispar
PYLHTLHFYKSITIHEVPKAIKI

SEQ ID NO: 2500542 - protein, 22 aa, Entamoeba dispar
PYLYIVCYYSHLSIPTLSHKGD

SEQ ID NO: 2500543 - protein, 24 aa, Entamoeba dispar
PYMEFPPLRALFLITTKGIPPLKN

SEQ ID NO: 2500544 - protein, 24 aa, Entamoeba dispar
PYMELPPLRALFLITTKGIPPLKE

SEQ ID NO: 2500545 - protein, 23 aa, Entamoeba dispar
PYMNGRLHLGHTFTVTKAEFAAR

SEQ ID NO: 2500546 - protein, 17 aa, Entamoeba dispar
PYNEIFIGGEWVGKHLV

SEQ ID NO: 2500547 - protein, 25 aa, Entamoeba dispar
PYNTEFWMDIPFNEIEMIQNAATAF

SEQ ID NO: 2500548 - protein, 24 aa, Entamoeba dispar
PYPYQFRKQHIFLGGSIATGKSTL

SEQ ID NO: 2500549 - protein, 21 aa, Entamoeba dispar
PYQHQSFYPPYGYNTSPYCQH

SEQ ID NO: 2500550 - protein, 25 aa, Entamoeba dispar
PYQRLLMRMSEGIAIVPKRRTHQLI

SEQ ID NO: 2500551 - protein, 23 aa, Entamoeba dispar
PYRELGMFKGLFKTATVGAPGLR

SEQ ID NO: 2500552 - protein, 18 aa, Entamoeba dispar
PYRRLVITPEDYPYHNLS

SEQ ID NO: 2500553 - protein, 20 aa, Entamoeba dispar
PYSCAIDMWSFGCVAAELFL

SEQ ID NO: 2500554 - protein, 35 aa, Entamoeba dispar
PYSCSIDMWSFGCVIAELLLGIPIFPGENEYNQLV

SEQ ID NO: 2500555 - protein, 18 aa, Entamoeba dispar
PYSERKIIYCSCGSVVTS

SEQ ID NO: 2500556 - protein, 25 aa, Entamoeba dispar
PYSGKTSLIRRFLCNSFVEEYSKTS

SEQ ID NO: 2500557 - protein, 21 aa, Entamoeba dispar
PYSLEELYIFYIQLRSLIPNE

SEQ ID NO: 2500558 - protein, 28 aa, Entamoeba dispar
PYSSIELSHISKLVGMEVHTVEKVISIM

SEQ ID NO: 2500559 - protein, 26 aa, Entamoeba dispar
PYSSSWDRLNFCVAFGNKCLSCSTSN

SEQ ID NO: 2500560 - protein, 23 aa, Entamoeba dispar
PYTRAELGVAITEAILNEKDIFK

SEQ ID NO: 2500561 - protein, 19 aa, Entamoeba dispar
PYVKAEDTRAFFLELYDSL

SEQ ID NO: 2500562 - protein, 17 aa, Entamoeba dispar
PYVLLFKRCDVNGDGVL

SEQ ID NO: 2500563 - protein, 26 aa, Entamoeba dispar
PYVRKTAVLCVLKLYCMEPNNIKEHG

SEQ ID NO: 2500564 - protein, 17 aa, Entamoeba dispar
PYVRPFDSNCITPGTEF

SEQ ID NO: 2500565 - protein, 17 aa, Entamoeba dispar
PYVTYGYPTLETVQKLI

SEQ ID NO: 2500566 - protein, 20 aa, Entamoeba dispar
PYVWDCFEQMHMKLTNDKYY

SEQ ID NO: 2500567 - protein, 27 aa, Entamoeba dispar
PYWSLVYRIANKKGLMWELPKKKKEIN

SEQ ID NO: 2500568 - protein, 24 aa, Entamoeba dispar
PYYCLPNPFKRLGVPQTVSLDQAL

SEQ ID NO: 2500569 - protein, 18 aa, Entamoeba dispar
PYYERRKAIIMGAPLTDE

SEQ ID NO: 2500570 - protein, 24 aa, Entamoeba dispar
PYYFKKCYISSVALLKMVMHAKQG

SEQ ID NO: 2500571 - protein, 21 aa, Entamoeba dispar
QAAVTLAEWKSMKYKDLLIIC

SEQ ID NO: 2500572 - protein, 39 aa, Entamoeba dispar
QADPQVVYDLCRWIYMHGIEVEGIFRISGNNEYIKKLIE

SEQ ID NO: 2500573 - protein, 19 aa, Entamoeba dispar
QADVIIRAVCDIVHGEPRL

SEQ ID NO: 2500574 - protein, 20 aa, Entamoeba dispar
QAFFQFLSKYGFDYNSLNNQ

SEQ ID NO: 2500575 - protein, 20 aa, Entamoeba dispar
QAFTGFKQQRFLEYNAELGA

SEQ ID NO: 2500576 - protein, 19 aa, Entamoeba dispar
QAGFKVCMIKCNNYSIFQE

SEQ ID NO: 2500577 - protein, 20 aa, Entamoeba dispar
QAGKIAVCRSSAWTSKIVTS

SEQ ID NO: 2500578 - protein, 17 aa, Entamoeba dispar
QAGRTLVALPFLQVVRI

SEQ ID NO: 2500579 - protein, 17 aa, Entamoeba dispar
QAGYKFRIQVSAMDCTG

SEQ ID NO: 2500580 - protein, 18 aa, Entamoeba dispar
QAHAKLMMHQNVTLMDAV

SEQ ID NO: 2500581 - protein, 17 aa, Entamoeba dispar
QAHLKKEIPGLACDGCL

SEQ ID NO: 2500582 - protein, 27 aa, Entamoeba dispar
QAIASPNILPRNSFQPIIISENDFNIQ

SEQ ID NO: 2500583 - protein, 20 aa, Entamoeba dispar
QAIDDCVCEFKIIEGHKKFV

SEQ ID NO: 2500584 - protein, 17 aa, Entamoeba dispar
QAILIALLTQFSTISVG

SEQ ID NO: 2500585 - protein, 20 aa, Entamoeba dispar
QAIMLPPVIPIGIPVTEFGN

SEQ ID NO: 2500586 - protein, 26 aa, Entamoeba dispar
QAIYSFWLYDFCDVYLEASKVIFKGP

SEQ ID NO: 2500587 - protein, 23 aa, Entamoeba dispar
QAKAFLTQFVLEFQGKFDEVLDT

SEQ ID NO: 2500588 - protein, 24 aa, Entamoeba dispar
QAKPRGVIGYQFMKETIKLLTLEE

SEQ ID NO: 2500589 - protein, 17 aa, Entamoeba dispar
QAKQRVWDRKKKKFVMA

SEQ ID NO: 2500590 - protein, 26 aa, Entamoeba dispar
QALCEGCILCDYRCEQCGKQNDAQRS

SEQ ID NO: 2500591 - protein, 21 aa, Entamoeba dispar
QALFVNCLIGLLISVNKKTIG

SEQ ID NO: 2500592 - protein, 18 aa, Entamoeba dispar
QALGPNGCISRLQVMDSI

SEQ ID NO: 2500593 - protein, 17 aa, Entamoeba dispar
QALMRIVRQKTERKDAD

SEQ ID NO: 2500594 - protein, 18 aa, Entamoeba dispar
QANKALIIELNKLKHQLE

SEQ ID NO: 2500595 - protein, 21 aa, Entamoeba dispar
QANQLDLGFKIDKQSNTTEEP

SEQ ID NO: 2500596 - protein, 20 aa, Entamoeba dispar
QAPEHLQRFDLLSLLITPIQ

SEQ ID NO: 2500597 - protein, 22 aa, Entamoeba dispar
QAPEVWLNGTFPNAASDVYSFA

SEQ ID NO: 2500598 - protein, 23 aa, Entamoeba dispar
QAPHLKGNVLVKFATEAMAAEAV

SEQ ID NO: 2500599 - protein, 23 aa, Entamoeba dispar
QAQGFPKVIGCLTHLDKVKNNKL

SEQ ID NO: 2500600 - protein, 17 aa, Entamoeba dispar
QARGIFIDWKGPKCKGI

SEQ ID NO: 2500601 - protein, 27 aa, Entamoeba dispar
QARYYYYLGRIQCIHLKYSDAYDSLTT

SEQ ID NO: 2500602 - protein, 19 aa, Entamoeba dispar
QAYSAYEKKIHWLNQKDTQ

SEQ ID NO: 2500603 - protein, 19 aa, Entamoeba dispar
QCDECKITIVIDKNTGKTK

SEQ ID NO: 2500604 - protein, 27 aa, Entamoeba dispar
QCDGLKLYPCLVIRGTRLYEMWRKGHY

SEQ ID NO: 2500605 - protein, 26 aa, Entamoeba dispar
QCELEPKEWLNISLIILSNIETQCTT

SEQ ID NO: 2500606 - protein, 33 aa, Entamoeba dispar
QCENVSLLHLIRWGKYVGNYGIESLKEGFNIFY

SEQ ID NO: 2500607 - protein, 17 aa, Entamoeba dispar
QCFKGCSSLQTINIPTS

SEQ ID NO: 2500608 - protein, 22 aa, Entamoeba dispar
QCFSCKMFQVHIKNKLKKFQCK

SEQ ID NO: 2500609 - protein, 22 aa, Entamoeba dispar
QCIAGIRYFDFRVVYNHKLKNF

SEQ ID NO: 2500610 - protein, 24 aa, Entamoeba dispar
QCIEIKCPMTIPFYEEYINNSKYR

SEQ ID NO: 2500611 - protein, 21 aa, Entamoeba dispar
QCIETIKLKTNEILNGKQQWR

SEQ ID NO: 2500612 - protein, 19 aa, Entamoeba dispar
QCINPDCTYLHQLVSEKDY

SEQ ID NO: 2500613 - protein, 19 aa, Entamoeba dispar
QCIRILQAFIDSVAEKGWT

SEQ ID NO: 2500614 - protein, 21 aa, Entamoeba dispar
QCISAILLISSLCIHHNLIQQ

SEQ ID NO: 2500615 - protein, 26 aa, Entamoeba dispar
QCKNIAFPLFPQIVLLMRELYLLIIK

SEQ ID NO: 2500616 - protein, 24 aa, Entamoeba dispar
QCKQYRSTLKMIIYLESLIDIDQL

SEQ ID NO: 2500617 - protein, 22 aa, Entamoeba dispar
QCLEITKSTIARMFTDGKLLGA

SEQ ID NO: 2500618 - protein, 21 aa, Entamoeba dispar
QCLEPPFQMICYLSNSTFQGK

SEQ ID NO: 2500619 - protein, 18 aa, Entamoeba dispar
QCLFYKCYSLTKLVLPEV

SEQ ID NO: 2500620 - protein, 17 aa, Entamoeba dispar
QCLSHSFYLTLSEATAV

SEQ ID NO: 2500621 - protein, 23 aa, Entamoeba dispar
QCNELGETVFITFCVNDKDIKVQ

SEQ ID NO: 2500622 - protein, 27 aa, Entamoeba dispar
QCPFKCSTCSMNYCIDCYKMVNQNLDY

SEQ ID NO: 2500623 - protein, 18 aa, Entamoeba dispar
QCQLKMKTLQFNRYYNYI

SEQ ID NO: 2500624 - protein, 18 aa, Entamoeba dispar
QCQVKFQLKKVLCMGVAV

SEQ ID NO: 2500625 - protein, 19 aa, Entamoeba dispar
QCRVIGLDMGALIAEHNIE

SEQ ID NO: 2500626 - protein, 19 aa, Entamoeba dispar
QCRVIGLDMGALIAGAQYR

SEQ ID NO: 2500627 - protein, 19 aa, Entamoeba dispar
QCSIPCIDGDTIPVMITGQ

SEQ ID NO: 2500628 - protein, 28 aa, Entamoeba dispar
QCSNLKLSSFGYRIKSLIINNVDVLTLS

SEQ ID NO: 2500629 - protein, 26 aa, Entamoeba dispar
QCSTPMRVGTLLLKKEVPLDSLENTM

SEQ ID NO: 2500630 - protein, 21 aa, Entamoeba dispar
QCTGETILRVYNILFQCVILP

SEQ ID NO: 2500631 - protein, 35 aa, Entamoeba dispar
QCTIMRRAVRLVKSCGRFVYSTCSLNPYEDEAVVA

SEQ ID NO: 2500632 - protein, 18 aa, Entamoeba dispar
QCTKALGYLKYLLTNKKG

SEQ ID NO: 2500633 - protein, 17 aa, Entamoeba dispar
QCTKCKEIVTSFFKHLV

SEQ ID NO: 2500634 - protein, 17 aa, Entamoeba dispar
QCTLFRNSNGYEEKLIK

SEQ ID NO: 2500635 - protein, 18 aa, Entamoeba dispar
QCVKSVVDSANWKVGDVN

SEQ ID NO: 2500636 - protein, 23 aa, Entamoeba dispar
QCYGMHFFHTFKLFAVAQEKRLH

SEQ ID NO: 2500637 - protein, 24 aa, Entamoeba dispar
QCYTDDYWLLPSFITLPEITLLHS

SEQ ID NO: 2500638 - protein, 24 aa, Entamoeba dispar
QDCKKEFNIIITLDYSVFMDVLEY

SEQ ID NO: 2500639 - protein, 20 aa, Entamoeba dispar
QDCQPDHLIAVPRVLQRIKM

SEQ ID NO: 2500640 - protein, 20 aa, Entamoeba dispar
QDDFELLKVIGRGSFGKVMM

SEQ ID NO: 2500641 - protein, 17 aa, Entamoeba dispar
QDDIILHQAIYVNTNNI

SEQ ID NO: 2500642 - protein, 25 aa, Entamoeba dispar
QDELRILTIRFLKNCIAVCDINGIE

SEQ ID NO: 2500643 - protein, 25 aa, Entamoeba dispar
QDEPKNTITFGICFNKEEIKEKFIK

SEQ ID NO: 2500644 - protein, 23 aa, Entamoeba dispar
QDFDKELALFVCKSHRGEVGESK

SEQ ID NO: 2500645 - protein, 18 aa, Entamoeba dispar
QDFHKIYGLNNLETNIPL

SEQ ID NO: 2500646 - protein, 25 aa, Entamoeba dispar
QDFSCFALGTTKGFCVYGIEQTRLR

SEQ ID NO: 2500647 - protein, 25 aa, Entamoeba dispar
QDFSCFALGTTKGFFVYGIEQTRLR

SEQ ID NO: 2500648 - protein, 24 aa, Entamoeba dispar
QDGISRKIFERWCTDKKNGVIIPG

SEQ ID NO: 2500649 - protein, 25 aa, Entamoeba dispar
QDGLIKYRNYWNIPLVSNQQDKINR

SEQ ID NO: 2500650 - protein, 24 aa, Entamoeba dispar
QDIGYCQKIGFLIGAIAKYCDESN

SEQ ID NO: 2500651 - protein, 23 aa, Entamoeba dispar
QDISVFPKWSIVDPCHSMSLPDN

SEQ ID NO: 2500652 - protein, 24 aa, Entamoeba dispar
QDKPSCFPAFILKPPENSICIDAC

SEQ ID NO: 2500653 - protein, 31 aa, Entamoeba dispar
QDKRTKVFFEFCKAKEAILITTDIAARGLDI

SEQ ID NO: 2500654 - protein, 23 aa, Entamoeba dispar
QDKTSNCLPDIYNYILDTYLFVR

SEQ ID NO: 2500655 - protein, 24 aa, Entamoeba dispar
QDLGKSVVFDEMFFKMQKRLEKEI

SEQ ID NO: 2500656 - protein, 17 aa, Entamoeba dispar
QDLKSSAVIIQRTTPCY

SEQ ID NO: 2500657 - protein, 19 aa, Entamoeba dispar
QDLLKEIIHDVKVPTEKKV

SEQ ID NO: 2500658 - protein, 19 aa, Entamoeba dispar
QDLNCPIIELPSLLEELTI

SEQ ID NO: 2500659 - protein, 26 aa, Entamoeba dispar
QDLYMKEGDGFILVFSLVSVATFNDL

SEQ ID NO: 2500660 - protein, 23 aa, Entamoeba dispar
QDMPRTSFGKVYIPKLKEIVKDL

SEQ ID NO: 2500661 - protein, 17 aa, Entamoeba dispar
QDPKNRWGCEELIEKIQ

SEQ ID NO: 2500662 - protein, 19 aa, Entamoeba dispar
QDPMNWYICDDACVINEEL

SEQ ID NO: 2500663 - protein, 23 aa, Entamoeba dispar
QDPTIQFQWWYPLVQNLSANDFR

SEQ ID NO: 2500664 - protein, 26 aa, Entamoeba dispar
QDRDLWLSTIETIRRLCIQSTEKYIS

SEQ ID NO: 2500665 - protein, 17 aa, Entamoeba dispar
QDRIRDFLNSNNGMTLK

SEQ ID NO: 2500666 - protein, 19 aa, Entamoeba dispar
QDRMIPFNELVKVLIKQID

SEQ ID NO: 2500667 - protein, 33 aa, Entamoeba dispar
QDRRIWPGLIDVALRYLLLFAGYSNENSKKIPS

SEQ ID NO: 2500668 - protein, 18 aa, Entamoeba dispar
QDTGTAICHGHKGENVLV

SEQ ID NO: 2500669 - protein, 23 aa, Entamoeba dispar
QDTLWYLCSFLYEIQLNEEKTRM

SEQ ID NO: 2500670 - protein, 19 aa, Entamoeba dispar
QDVLRLFVHYNKSYFQFIE

SEQ ID NO: 2500671 - protein, 19 aa, Entamoeba dispar
QDVSALAFLYSKLQQTVLR

SEQ ID NO: 2500672 - protein, 28 aa, Entamoeba dispar
QDVYLFKPYMDKIFENMNPLTFEVPDSC

SEQ ID NO: 2500673 - protein, 17 aa, Entamoeba dispar
QDYLKHGMKVHKTQTAI

SEQ ID NO: 2500674 - protein, 18 aa, Entamoeba dispar
QDYLQRLVSLSPRDVDLC

SEQ ID NO: 2500675 - protein, 19 aa, Entamoeba dispar
QEAIECYNHAMMLDKTNII

SEQ ID NO: 2500676 - protein, 25 aa, Entamoeba dispar
QEAINRFALHDSLKYNFLVQQLNNP

SEQ ID NO: 2500677 - protein, 30 aa, Entamoeba dispar
QEATYFHWILPFPFKRCYVSSSIFASKPNG

SEQ ID NO: 2500678 - protein, 17 aa, Entamoeba dispar
QECHEAIQIITTKTNEC

SEQ ID NO: 2500679 - protein, 25 aa, Entamoeba dispar
QEDIIKSGILPLVISLLSEQDTKTI

SEQ ID NO: 2500680 - protein, 34 aa, Entamoeba dispar
QEDLEPKAAMLLDCYDICYLWIGKDVSAIDKKFA

SEQ ID NO: 2500681 - protein, 17 aa, Entamoeba dispar
QEDLMSLSFTSFDSLVS

SEQ ID NO: 2500682 - protein, 17 aa, Entamoeba dispar
QEEFERIAAEEREQAER

SEQ ID NO: 2500683 - protein, 24 aa, Entamoeba dispar
QEEFWIVMEYCCYGSVADMMEILG

SEQ ID NO: 2500684 - protein, 24 aa, Entamoeba dispar
QEEGWKGTPYYLAKEVVLENKVTF

SEQ ID NO: 2500685 - protein, 22 aa, Entamoeba dispar
QEELDYKPGIYTQWESAYNHED

SEQ ID NO: 2500686 - protein, 17 aa, Entamoeba dispar
QEESLRNLLLILKDNLN

SEQ ID NO: 2500687 - protein, 27 aa, Entamoeba dispar
QEEVEGMPKYLWKQGVEDTVEIIEDKK

SEQ ID NO: 2500688 - protein, 22 aa, Entamoeba dispar
QEFCNVCGCDFQEISAKHNKNI

SEQ ID NO: 2500689 - protein, 18 aa, Entamoeba dispar
QEFHCIQIKMKLRSLLLK

SEQ ID NO: 2500690 - protein, 24 aa, Entamoeba dispar
QEFIKEYFKFAGINEENIPIDMKV

SEQ ID NO: 2500691 - protein, 18 aa, Entamoeba dispar
QEFLQDFITPCYEQNTTV

SEQ ID NO: 2500692 - protein, 23 aa, Entamoeba dispar
QEFPIESVLLVWDCILVDPTGDF

SEQ ID NO: 2500693 - protein, 26 aa, Entamoeba dispar
QEGKIIKLPIGFVSACSITRLNIQDL

SEQ ID NO: 2500694 - protein, 22 aa, Entamoeba dispar
QEGTKAVIIVLNFNTEILSENI

SEQ ID NO: 2500695 - protein, 24 aa, Entamoeba dispar
QEGYRARSAFKLIDVERDFHIFDG

SEQ ID NO: 2500696 - protein, 17 aa, Entamoeba dispar
QEHLILKICDFGLSRFN

SEQ ID NO: 2500697 - protein, 19 aa, Entamoeba dispar
QEIAMCYEVIYDIVQTPIG

SEQ ID NO: 2500698 - protein, 20 aa, Entamoeba dispar
QEIDSGLTLTANEIIERVKE

SEQ ID NO: 2500699 - protein, 25 aa, Entamoeba dispar
QEIEFKVVQGIYWKGSKVGLFKEKI

SEQ ID NO: 2500700 - protein, 30 aa, Entamoeba dispar
QEIKCKIALETLKIALEYPFSNGYEEEEDI

SEQ ID NO: 2500701 - protein, 17 aa, Entamoeba dispar
QEIKEGLAVMNRAKKAA

SEQ ID NO: 2500702 - protein, 23 aa, Entamoeba dispar
QEIKFKMVQGVYWKGSKVGLFKE

SEQ ID NO: 2500703 - protein, 24 aa, Entamoeba dispar
QEIKKESLVKCKIKSEELNKENQM

SEQ ID NO: 2500704 - protein, 21 aa, Entamoeba dispar
QEIKKIIPFGLIGKTEKQITV

SEQ ID NO: 2500705 - protein, 22 aa, Entamoeba dispar
QEIKKLPIDFERSTKVDTVVAA

SEQ ID NO: 2500706 - protein, 25 aa, Entamoeba dispar
QEIKRHFEEEFIKRQPMIDKAFTEK

SEQ ID NO: 2500707 - protein, 22 aa, Entamoeba dispar
QEIKSCILSVINQWIRNYTADF

SEQ ID NO: 2500708 - protein, 17 aa, Entamoeba dispar
QEIKYVFSTPVNHPNGM

SEQ ID NO: 2500709 - protein, 22 aa, Entamoeba dispar
QEIMERVLFLWALRHPASGYVQ

SEQ ID NO: 2500710 - protein, 24 aa, Entamoeba dispar
QEINEFQRNICKPIIETPEYFEQL

SEQ ID NO: 2500711 - protein, 21 aa, Entamoeba dispar
QEINKAIAFLKKWNNERHQKG

SEQ ID NO: 2500712 - protein, 25 aa, Entamoeba dispar
QEINLRLPLKDLLVFFESALIQTES

SEQ ID NO: 2500713 - protein, 25 aa, Entamoeba dispar
QEINNLRIPFGFYKRTLPHYWKEDY

SEQ ID NO: 2500714 - protein, 25 aa, Entamoeba dispar
QEINQMKVLIVNSIQKAKEEIKKKD

SEQ ID NO: 2500715 - protein, 25 aa, Entamoeba dispar
QEIPHEGAFCDLMWSDPDDSVEGMT

SEQ ID NO: 2500716 - protein, 21 aa, Entamoeba dispar
QEIRNTFFASIESVQSYFAYK

SEQ ID NO: 2500717 - protein, 25 aa, Entamoeba dispar
QEITFPCIYGMAARRTIPNGFYQNV

SEQ ID NO: 2500718 - protein, 21 aa, Entamoeba dispar
QEIWVISKIARYAVGKNVFIL

SEQ ID NO: 2500719 - protein, 19 aa, Entamoeba dispar
QEKEVDACMGIVTNELIDS

SEQ ID NO: 2500720 - protein, 26 aa, Entamoeba dispar
QEKIEIAQAIYIRWKTKKLINERMLT

SEQ ID NO: 2500721 - protein, 23 aa, Entamoeba dispar
QEKIEVCSNCYHLLGEMDLAQNI

SEQ ID NO: 2500722 - protein, 19 aa, Entamoeba dispar
QEKIIKEKVTILEEELEQT

SEQ ID NO: 2500723 - protein, 26 aa, Entamoeba dispar
QEKKKIDIVKVFKIMWTKNSPKKQKI

SEQ ID NO: 2500724 - protein, 27 aa, Entamoeba dispar
QEKLTVDMVNEWACEKGTNQRKNIRSL

SEQ ID NO: 2500725 - protein, 24 aa, Entamoeba dispar
QEKMNVLMSFGMRSVDNIVGIMKM

SEQ ID NO: 2500726 - protein, 21 aa, Entamoeba dispar
QELADKLGIPFLETSAASNSN

SEQ ID NO: 2500727 - protein, 17 aa, Entamoeba dispar
QELCNLYPIDTLVTDTS

SEQ ID NO: 2500728 - protein, 18 aa, Entamoeba dispar
QELEEEGINVFSKEEKNT

SEQ ID NO: 2500729 - protein, 18 aa, Entamoeba dispar
QELFKCLHDLAQFGSGEI

SEQ ID NO: 2500730 - protein, 20 aa, Entamoeba dispar
QELFYQINIIDGLRNRKIPI

SEQ ID NO: 2500731 - protein, 24 aa, Entamoeba dispar
QELKYPLNNLIPFFSKSLEQITLD

SEQ ID NO: 2500732 - protein, 18 aa, Entamoeba dispar
QELLEIICYILPNISELS

SEQ ID NO: 2500733 - protein, 17 aa, Entamoeba dispar
QELMKRALRKSGYTQKT

SEQ ID NO: 2500734 - protein, 20 aa, Entamoeba dispar
QELMQRDGLNLKWIRENSRP

SEQ ID NO: 2500735 - protein, 33 aa, Entamoeba dispar
QELPEGYLPKRIFKSTCKHIVEVSGTSFNLKYI

SEQ ID NO: 2500736 - protein, 17 aa, Entamoeba dispar
QELQIWKSETINKYLKS

SEQ ID NO: 2500737 - protein, 21 aa, Entamoeba dispar
QELRSNNDLIEFCSELYNLKR

SEQ ID NO: 2500738 - protein, 17 aa, Entamoeba dispar
QELSSWLDEIIEFENSK

SEQ ID NO: 2500739 - protein, 19 aa, Entamoeba dispar
QELTVTIPVSTEWKEEEII

SEQ ID NO: 2500740 - protein, 19 aa, Entamoeba dispar
QELYSWLMEPINVISTNEL

SEQ ID NO: 2500741 - protein, 24 aa, Entamoeba dispar
QEMELRKLVCMYIVNHSEKDPTNA

SEQ ID NO: 2500742 - protein, 22 aa, Entamoeba dispar
QENKTTFHIMIWRNKDVGTFKR

SEQ ID NO: 2500743 - protein, 22 aa, Entamoeba dispar
QENMGLGIADFFSLVESASDGI

SEQ ID NO: 2500744 - protein, 19 aa, Entamoeba dispar
QENYKWVLLEDSYAQKDYI

SEQ ID NO: 2500745 - protein, 18 aa, Entamoeba dispar
QEPIRIQPTYGLEFQLGK

SEQ ID NO: 2500746 - protein, 24 aa, Entamoeba dispar
QEPKLWFQLGCLYEKAGLFEQAEA

SEQ ID NO: 2500747 - protein, 24 aa, Entamoeba dispar
QEPKRDKLIILLRLVEKCNENQID

SEQ ID NO: 2500748 - protein, 21 aa, Entamoeba dispar
QEPLCISRRIVRSELIPGTDY

SEQ ID NO: 2500749 - protein, 23 aa, Entamoeba dispar
QEPTVIEFPFTVKFKENPQNPIL

SEQ ID NO: 2500750 - protein, 25 aa, Entamoeba dispar
QEQFKRLGIPSNLIIPLYHKLIEEN

SEQ ID NO: 2500751 - protein, 21 aa, Entamoeba dispar
QERKQFYAGQLVQFIGKGKRQ

SEQ ID NO: 2500752 - protein, 24 aa, Entamoeba dispar
QERYRSLIPSYIRDSSAAVIVYDI

SEQ ID NO: 2500753 - protein, 20 aa, Entamoeba dispar
QESFEQLEYLKGIIATKLFE

SEQ ID NO: 2500754 - protein, 24 aa, Entamoeba dispar
QESLKSTIILMVYMQSIQNFIPPH

SEQ ID NO: 2500755 - protein, 24 aa, Entamoeba dispar
QESPFKSIVPFALRGPLQRYQRES

SEQ ID NO: 2500756 - protein, 22 aa, Entamoeba dispar
QETAAVVMARCASFKADAESGR

SEQ ID NO: 2500757 - protein, 21 aa, Entamoeba dispar
QETECCIKLLIQKHIIDTQSI

SEQ ID NO: 2500758 - protein, 19 aa, Entamoeba dispar
QETFLTIMLEYGQEVDSTE

SEQ ID NO: 2500759 - protein, 24 aa, Entamoeba dispar
QETKVESFFDLFYPQELVLNNDIN

SEQ ID NO: 2500760 - protein, 18 aa, Entamoeba dispar
QETLDFIMGKIIFDQENM

SEQ ID NO: 2500761 - protein, 30 aa, Entamoeba dispar
QETLKLATPFGLRVCCCIGGESIQPQIEEL

SEQ ID NO: 2500762 - protein, 22 aa, Entamoeba dispar
QETPCQMLFTFRFNTAEICKQF

SEQ ID NO: 2500763 - protein, 25 aa, Entamoeba dispar
QETSFPFYYCKNLKEFIEQFEYEEN

SEQ ID NO: 2500764 - protein, 21 aa, Entamoeba dispar
QEVGKACGFQGSDLEILKQIH

SEQ ID NO: 2500765 - protein, 17 aa, Entamoeba dispar
QEVHEIFIIGHSTGCQD

SEQ ID NO: 2500766 - protein, 24 aa, Entamoeba dispar
QEVKTMLDVIKFSAQFLPTTEISK

SEQ ID NO: 2500767 - protein, 21 aa, Entamoeba dispar
QEVMQAMLFGIITNLFSNDQA

SEQ ID NO: 2500768 - protein, 23 aa, Entamoeba dispar
QEVTFPCIYGMAAKRTIPSGFYQ

SEQ ID NO: 2500769 - protein, 24 aa, Entamoeba dispar
QEVTFPCIYGMAAKRTIPSGFYQN

SEQ ID NO: 2500770 - protein, 26 aa, Entamoeba dispar
QEVTSIGYQCFDWCIALTRIDIPSRT

SEQ ID NO: 2500771 - protein, 19 aa, Entamoeba dispar
QEVVFKRLVTFKHQSQKDL

SEQ ID NO: 2500772 - protein, 27 aa, Entamoeba dispar
QEWKFKFPNELEEYAFLYNKYKQRGVF

SEQ ID NO: 2500773 - protein, 23 aa, Entamoeba dispar
QEYKEKWIGKDYKLPGIAGNDSS

SEQ ID NO: 2500774 - protein, 28 aa, Entamoeba dispar
QEYNGMKIWCFNAGHILGAAMFCIEING

SEQ ID NO: 2500775 - protein, 21 aa, Entamoeba dispar
QEYQNIVSFRAYVTAALFLGP

SEQ ID NO: 2500776 - protein, 17 aa, Entamoeba dispar
QFAADKFADTWNKIQQT

SEQ ID NO: 2500777 - protein, 18 aa, Entamoeba dispar
QFAAVARGFRMYNQNPNS

SEQ ID NO: 2500778 - protein, 21 aa, Entamoeba dispar
QFACLIISKCSNFNELDMNEI

SEQ ID NO: 2500779 - protein, 25 aa, Entamoeba dispar
QFANDEFHYFQGLVEFNEIYVKALL

SEQ ID NO: 2500780 - protein, 19 aa, Entamoeba dispar
QFCEYCIIGNKTLDRLFSL

SEQ ID NO: 2500781 - protein, 21 aa, Entamoeba dispar
QFDKNGVCNISIFDDNAYIIV

SEQ ID NO: 2500782 - protein, 18 aa, Entamoeba dispar
QFDTFKKLYLLRDKIARI

SEQ ID NO: 2500783 - protein, 17 aa, Entamoeba dispar
QFDVTLRGLRKVLVSED

SEQ ID NO: 2500784 - protein, 20 aa, Entamoeba dispar
QFEELVKYWIETIGLEEYFE

SEQ ID NO: 2500785 - protein, 19 aa, Entamoeba dispar
QFEKLRYQLEVNKYNIPEV

SEQ ID NO: 2500786 - protein, 21 aa, Entamoeba dispar
QFELRSSVINSEILEEDDLIT

SEQ ID NO: 2500787 - protein, 18 aa, Entamoeba dispar
QFEPFKWIQSSNIYSFEE

SEQ ID NO: 2500788 - protein, 23 aa, Entamoeba dispar
QFFPVLFEKIIFRQIMVTHNELE

SEQ ID NO: 2500789 - protein, 24 aa, Entamoeba dispar
QFGEDIIDLPLQIRGIGSIDNKPN

SEQ ID NO: 2500790 - protein, 24 aa, Entamoeba dispar
QFHDLKELFSIGGTPPQTHYIFLG

SEQ ID NO: 2500791 - protein, 46 aa, Entamoeba dispar
QFICPNYIEYSSWLNIIPLKMRCNEVFGVPLSVGVKKSGWRFPLPI

SEQ ID NO: 2500792 - protein, 25 aa, Entamoeba dispar
QFIEITALFLRHSPQAFQFKEDLLI

SEQ ID NO: 2500793 - protein, 25 aa, Entamoeba dispar
QFIPGRAPNSIKNRFYSHLSKVRNK

SEQ ID NO: 2500794 - protein, 24 aa, Entamoeba dispar
QFIPYKFGQLRSIILTSIPSKIPF

SEQ ID NO: 2500795 - protein, 18 aa, Entamoeba dispar
QFIRPPVIIKVRTFTSNK

SEQ ID NO: 2500796 - protein, 18 aa, Entamoeba dispar
QFITFQWELFDTDLNPID

SEQ ID NO: 2500797 - protein, 22 aa, Entamoeba dispar
QFKGDYMSTIGMDFNTKTISVN

SEQ ID NO: 2500798 - protein, 27 aa, Entamoeba dispar
QFKIVRLKDTFNLSGHFCMVFELLSYN

SEQ ID NO: 2500799 - protein, 23 aa, Entamoeba dispar
QFKMFSASVLFVYDGASKFEDQK

SEQ ID NO: 2500800 - protein, 24 aa, Entamoeba dispar
QFLAERIGFDYILIEMMIGIQIIN

SEQ ID NO: 2500801 - protein, 26 aa, Entamoeba dispar
QFLFCTICSIIPFPSIQNIFDQSYGA

SEQ ID NO: 2500802 - protein, 17 aa, Entamoeba dispar
QFLKTMIEKHVPIEQKI

SEQ ID NO: 2500803 - protein, 17 aa, Entamoeba dispar
QFLNRVCAIAFSQQLII

SEQ ID NO: 2500804 - protein, 18 aa, Entamoeba dispar
QFMIKRLIKTITNPQVKT

SEQ ID NO: 2500805 - protein, 19 aa, Entamoeba dispar
QFNCFCLNKKPQLFGRTSH

SEQ ID NO: 2500806 - protein, 29 aa, Entamoeba dispar
QFNCYATECPICGEHSVNLIEYPYTSTRD

SEQ ID NO: 2500807 - protein, 27 aa, Entamoeba dispar
QFNKGIPVFWFQVLKNSMLFDSANGSE

SEQ ID NO: 2500808 - protein, 18 aa, Entamoeba dispar
QFPDRYQAVHSYSIHSEL

SEQ ID NO: 2500809 - protein, 29 aa, Entamoeba dispar
QFPFKCFPLNRLERVCISFHKSVGYYYDF

SEQ ID NO: 2500810 - protein, 31 aa, Entamoeba dispar
QFPFRKSRLTRLLICWIKIFKEIIPNVYDSL

SEQ ID NO: 2500811 - protein, 24 aa, Entamoeba dispar
QFQAEINQLLSLIINAFYSNKDIF

SEQ ID NO: 2500812 - protein, 22 aa, Entamoeba dispar
QFQNGRFDGIINFGDDKLAIKV

SEQ ID NO: 2500813 - protein, 18 aa, Entamoeba dispar
QFREMKMFQTLALPTPQK

SEQ ID NO: 2500814 - protein, 32 aa, Entamoeba dispar
QFRETCFFKLSITLSKMIDWISYFYSNFNILF

SEQ ID NO: 2500815 - protein, 19 aa, Entamoeba dispar
QFRNIWSYFFGYWKDPNTE

SEQ ID NO: 2500816 - protein, 18 aa, Entamoeba dispar
QFSINIIETARFVIEEDT

SEQ ID NO: 2500817 - protein, 20 aa, Entamoeba dispar
QFSTITVFICFTDQQSTENA

SEQ ID NO: 2500818 - protein, 38 aa, Entamoeba dispar
QFTYMEASIFYKLEPSEFFGQAWAKAKLRHKAPNIIAS

SEQ ID NO: 2500819 - protein, 21 aa, Entamoeba dispar
QFVHSKGWIHRDIKPDNFIMG

SEQ ID NO: 2500820 - protein, 21 aa, Entamoeba dispar
QFYKNLKWLLENSVEGLEMKF

SEQ ID NO: 2500821 - protein, 21 aa, Entamoeba dispar
QFYNIFCNLILSALAKSEQFS

SEQ ID NO: 2500822 - protein, 22 aa, Entamoeba dispar
QGDKLMINWFKIRSIGNLVKEI

SEQ ID NO: 2500823 - protein, 23 aa, Entamoeba dispar
QGDKTLINWFKIRGIGNLIKELM

SEQ ID NO: 2500824 - protein, 23 aa, Entamoeba dispar
QGEKICIDRILKIDNDVIHNNFL

SEQ ID NO: 2500825 - protein, 23 aa, Entamoeba dispar
QGEPLEIMGILIGQTKGDSFVIT

SEQ ID NO: 2500826 - protein, 18 aa, Entamoeba dispar
QGFRGNGCILADGMGLGK

SEQ ID NO: 2500827 - protein, 24 aa, Entamoeba dispar
QGGKWSFLFECPRDYPNNPPKVTC

SEQ ID NO: 2500828 - protein, 25 aa, Entamoeba dispar
QGGMVCDIYGNPLCYPTSKKESMRH

SEQ ID NO: 2500829 - protein, 31 aa, Entamoeba dispar
QGGSWKSWKRRFFVLKDRKLWYFESENSTTA

SEQ ID NO: 2500830 - protein, 25 aa, Entamoeba dispar
QGHVYSLRDDFSWIEESVKKWESKL

SEQ ID NO: 2500831 - protein, 21 aa, Entamoeba dispar
QGIKEKPCWITQHFKNQLNII

SEQ ID NO: 2500832 - protein, 17 aa, Entamoeba dispar
QGIPVILVTSIKEGNNI

SEQ ID NO: 2500833 - protein, 19 aa, Entamoeba dispar
QGIPYRWNDNDLQFYFQQY

SEQ ID NO: 2500834 - protein, 30 aa, Entamoeba dispar
QGKEARFEVEIVKAIGLPVLGWGCPDPYAC

SEQ ID NO: 2500835 - protein, 23 aa, Entamoeba dispar
QGKKEILDYFDVIVLGDDPHVKE

SEQ ID NO: 2500836 - protein, 21 aa, Entamoeba dispar
QGKLIPGHLKFHVLLTTYEIV

SEQ ID NO: 2500837 - protein, 18 aa, Entamoeba dispar
QGKPILCKVLVNVSVDVN

SEQ ID NO: 2500838 - protein, 18 aa, Entamoeba dispar
QGKSFANQRGWLYKETSA

SEQ ID NO: 2500839 - protein, 17 aa, Entamoeba dispar
QGKSITLSPVFDESVGV

SEQ ID NO: 2500840 - protein, 39 aa, Entamoeba dispar
QGLFFKPKEDWFFYAFSKFYFEAALKFSDKFPTLINKDK

SEQ ID NO: 2500841 - protein, 18 aa, Entamoeba dispar
QGLIWKKLKTLKCIKCKV

SEQ ID NO: 2500842 - protein, 19 aa, Entamoeba dispar
QGLLCDLLWSDPHDLPVDG

SEQ ID NO: 2500843 - protein, 20 aa, Entamoeba dispar
QGLMHGWSYQSLIKETQKMN

SEQ ID NO: 2500844 - protein, 24 aa, Entamoeba dispar
QGLPPEFEKFLSISRSLKFEEEPD

SEQ ID NO: 2500845 - protein, 22 aa, Entamoeba dispar
QGLVPLLRLAWNHFDPNFIATF

SEQ ID NO: 2500846 - protein, 17 aa, Entamoeba dispar
QGNIERFHFNPIPLNEH

SEQ ID NO: 2500847 - protein, 17 aa, Entamoeba dispar
QGNIERFHFNPIPLNHY

SEQ ID NO: 2500848 - protein, 34 aa, Entamoeba dispar
QGNKKIYGALCLFKKRKQLFISYLPMEVRTNASL

SEQ ID NO: 2500849 - protein, 17 aa, Entamoeba dispar
QGNMERFHFNPIPLNQY

SEQ ID NO: 2500850 - protein, 17 aa, Entamoeba dispar
QGNMERFHFNPISLNKY

SEQ ID NO: 2500851 - protein, 18 aa, Entamoeba dispar
QGNMKRFHFNPIPLNEYS

SEQ ID NO: 2500852 - protein, 23 aa, Entamoeba dispar
QGPEEFFVFSLNNSKGFNPIKIE

SEQ ID NO: 2500853 - protein, 22 aa, Entamoeba dispar
QGSGIELRKRFYQETQPSSELF

SEQ ID NO: 2500854 - protein, 25 aa, Entamoeba dispar
QGSLFIYLFRLMLATGIPELKNEDD

SEQ ID NO: 2500855 - protein, 18 aa, Entamoeba dispar
QGTLRHVFWDCYDTQLID

SEQ ID NO: 2500856 - protein, 19 aa, Entamoeba dispar
QGVCGNILCSLGEKGLVKC

SEQ ID NO: 2500857 - protein, 30 aa, Entamoeba dispar
QGVDSWGVAGVLCYLFGTPITKKSMVAQAP

SEQ ID NO: 2500858 - protein, 18 aa, Entamoeba dispar
QGVQAIVIVLNFNKEVLS

SEQ ID NO: 2500859 - protein, 24 aa, Entamoeba dispar
QGYEYKSLNAIILLIRIFQQIGDF

SEQ ID NO: 2500860 - protein, 22 aa, Entamoeba dispar
QGYRCWCNILARKLSSKSSEDE

SEQ ID NO: 2500861 - protein, 21 aa, Entamoeba dispar
QHASIKFSILHPKEVDAAIPY

SEQ ID NO: 2500862 - protein, 19 aa, Entamoeba dispar
QHCLQCLQKALKDANLSNE

SEQ ID NO: 2500863 - protein, 26 aa, Entamoeba dispar
QHCYCPSCKNLLKDGWMDNCLHTPTA

SEQ ID NO: 2500864 - protein, 24 aa, Entamoeba dispar
QHDLIPLVEFVFGGRQRRFIINLE

SEQ ID NO: 2500865 - protein, 25 aa, Entamoeba dispar
QHEDMLFRVKFDLYNSQREKIETLY

SEQ ID NO: 2500866 - protein, 22 aa, Entamoeba dispar
QHEFIKEWNEVYSTMNTILRKE

SEQ ID NO: 2500867 - protein, 17 aa, Entamoeba dispar
QHETELFQQMLLHQTSE

SEQ ID NO: 2500868 - protein, 17 aa, Entamoeba dispar
QHFGYDFNYSKYGISVG

SEQ ID NO: 2500869 - protein, 19 aa, Entamoeba dispar
QHIKCKLFCCKGIGQDHAK

SEQ ID NO: 2500870 - protein, 23 aa, Entamoeba dispar
QHKEMIGRFCCIFQRCFLDYHFL

SEQ ID NO: 2500871 - protein, 20 aa, Entamoeba dispar
QHKGEEIMLTISYTDGKEKT

SEQ ID NO: 2500872 - protein, 19 aa, Entamoeba dispar
QHLEKCIEAKIVKGYSEYH

SEQ ID NO: 2500873 - protein, 20 aa, Entamoeba dispar
QHLEYLWSLLKGINSERTTI

SEQ ID NO: 2500874 - protein, 23 aa, Entamoeba dispar
QHLQCKKCSTIIPEQKITQKHYC

SEQ ID NO: 2500875 - protein, 23 aa, Entamoeba dispar
QHLTKLIIMNSLHCEQFNFYQFK

SEQ ID NO: 2500876 - protein, 21 aa, Entamoeba dispar
QHPFFKGFNWDTIFEQTPPYL

SEQ ID NO: 2500877 - protein, 24 aa, Entamoeba dispar
QHPIPTWINRMAWYGNQFEKFFGI

SEQ ID NO: 2500878 - protein, 17 aa, Entamoeba dispar
QHSFPLLSGDRATNDPY

SEQ ID NO: 2500879 - protein, 23 aa, Entamoeba dispar
QHSRICLCLDLPGGPFYSTPFIL

SEQ ID NO: 2500880 - protein, 23 aa, Entamoeba dispar
QHTKGVRCVEVWDKENMVSASFD

SEQ ID NO: 2500881 - protein, 19 aa, Entamoeba dispar
QHYLNCTLPYYCLPNPFKR

SEQ ID NO: 2500882 - protein, 20 aa, Entamoeba dispar
QHYLPLCVYLAIQREDKTHS

SEQ ID NO: 2500883 - protein, 24 aa, Entamoeba dispar
QIAEEFKLDITLRYYKGDKIESSR

SEQ ID NO: 2500884 - protein, 24 aa, Entamoeba dispar
QIAKFYTWINKWEKVIPDRRAVLL

SEQ ID NO: 2500885 - protein, 24 aa, Entamoeba dispar
QIALKGEEGINCLLQTNQVNIEPK

SEQ ID NO: 2500886 - protein, 21 aa, Entamoeba dispar
QICILHIRATYHLIVKTGFQL

SEQ ID NO: 2500887 - protein, 31 aa, Entamoeba dispar
QICIPLRADISLWFIAHSCLSKIPPANSPFI

SEQ ID NO: 2500888 - protein, 19 aa, Entamoeba dispar
QICLLKFNQPLSITDLQLL

SEQ ID NO: 2500889 - protein, 24 aa, Entamoeba dispar
QICQSENGASCLIMCTEKRMDYYK

SEQ ID NO: 2500890 - protein, 23 aa, Entamoeba dispar
QICWLKLKIYNTFVLPIDAGDNG

SEQ ID NO: 2500891 - protein, 32 aa, Entamoeba dispar
QIDCKGDVLACSWCPDINGMLAVGGEFGLKFL

SEQ ID NO: 2500892 - protein, 33 aa, Entamoeba dispar
QIDDLKLKLEIQRQCIDKLRMYTTALESEMSEI

SEQ ID NO: 2500893 - protein, 19 aa, Entamoeba dispar
QIDFLPYHFLLSVNCVESK

SEQ ID NO: 2500894 - protein, 23 aa, Entamoeba dispar
QIDITANILLKWISYLRSEGILL

SEQ ID NO: 2500895 - protein, 25 aa, Entamoeba dispar
QIDKLPEFINFYFSTTRIVFLSPFN

SEQ ID NO: 2500896 - protein, 21 aa, Entamoeba dispar
QIDSFCFFKCENLTSITLPSS

SEQ ID NO: 2500897 - protein, 23 aa, Entamoeba dispar
QIDSIVAKGRFHLFTAKGELKDK

SEQ ID NO: 2500898 - protein, 43 aa, Entamoeba dispar
QIEEIKTGNIYQFEPEKSYFYIMRNCDMLRFLDSNNTPMFASK

SEQ ID NO: 2500899 - protein, 19 aa, Entamoeba dispar
QIEGLRISINNGISKMSEI

SEQ ID NO: 2500900 - protein, 19 aa, Entamoeba dispar
QIEGLRISLNNGISKMDEI

SEQ ID NO: 2500901 - protein, 25 aa, Entamoeba dispar
QIEISRIQYYLTLYSKTRLRKIHQM

SEQ ID NO: 2500902 - protein, 26 aa, Entamoeba dispar
QIELYSHLPVMSRFVDFMKRENYFMC

SEQ ID NO: 2500903 - protein, 24 aa, Entamoeba dispar
QIENRGIAFVTFYDIRDAIKAHEE

SEQ ID NO: 2500904 - protein, 18 aa, Entamoeba dispar
QIESLNCNTWFMSPPCQP

SEQ ID NO: 2500905 - protein, 24 aa, Entamoeba dispar
QIEVICLLLALKIIAPDTVYLLRG

SEQ ID NO: 2500906 - protein, 26 aa, Entamoeba dispar
QIEVWPRIVKIYHYIGNESDILLDGT

SEQ ID NO: 2500907 - protein, 24 aa, Entamoeba dispar
QIEYASLFLPVFEMISKVMNPKVL

SEQ ID NO: 2500908 - protein, 19 aa, Entamoeba dispar
QIEYLCKRYQIPSITKNTV

SEQ ID NO: 2500909 - protein, 23 aa, Entamoeba dispar
QIFFYYNSFNIIIGKQGAGKTTF

SEQ ID NO: 2500910 - protein, 22 aa, Entamoeba dispar
QIFGFKGAIDILLNGSEGEIIV

SEQ ID NO: 2500911 - protein, 27 aa, Entamoeba dispar
QIFHYSKLFFCRIHIERSLIKYFKSDH

SEQ ID NO: 2500912 - protein, 25 aa, Entamoeba dispar
QIFPYSKLFFCRNHIERSLIKYFKS

SEQ ID NO: 2500913 - protein, 25 aa, Entamoeba dispar
QIGFEMWYFLSAIILDRNFVQETYL

SEQ ID NO: 2500914 - protein, 38 aa, Entamoeba dispar
QIGKWSCVRCNSCGTDCCLLCDGEIIINPSLKDVIRLR

SEQ ID NO: 2500915 - protein, 17 aa, Entamoeba dispar
QIGLIIYVANLHFDITE

SEQ ID NO: 2500916 - protein, 25 aa, Entamoeba dispar
QIGPKINIIPGFWYTVLHNAGLFDY

SEQ ID NO: 2500917 - protein, 21 aa, Entamoeba dispar
QIGVIFDKSIRIINIADKSLF

SEQ ID NO: 2500918 - protein, 26 aa, Entamoeba dispar
QIHHCAEILPSQAFTPIDTLKQTAIM

SEQ ID NO: 2500919 - protein, 19 aa, Entamoeba dispar
QIHIVFYDKVIIRGAQYYE

SEQ ID NO: 2500920 - protein, 17 aa, Entamoeba dispar
QIHLNTIDIQKEKHQMQ

SEQ ID NO: 2500921 - protein, 26 aa, Entamoeba dispar
QIHSYPQCLCDLTSIVDLDVSNNLMV

SEQ ID NO: 2500922 - protein, 18 aa, Entamoeba dispar
QIHTPIKIRKLSAGRVES

SEQ ID NO: 2500923 - protein, 17 aa, Entamoeba dispar
QIIDCTLDPIWNEKFDV

SEQ ID NO: 2500924 - protein, 34 aa, Entamoeba dispar
QIIIDLFINYDCMTFGMNLFEEFISLIYFILSSQ

SEQ ID NO: 2500925 - protein, 20 aa, Entamoeba dispar
QIIKACFAMTCVKETDREII

SEQ ID NO: 2500926 - protein, 19 aa, Entamoeba dispar
QIILKCISFNFKVIQELSL

SEQ ID NO: 2500927 - protein, 23 aa, Entamoeba dispar
QIIPKEQCIFCEKELEKEEDIIT

SEQ ID NO: 2500928 - protein, 21 aa, Entamoeba dispar
QIIQRVINIIGEIGPECDNRI

SEQ ID NO: 2500929 - protein, 23 aa, Entamoeba dispar
QIIRYKILDSLKCNCKEINEIIS

SEQ ID NO: 2500930 - protein, 25 aa, Entamoeba dispar
QIISALKYIHKWQICHRDIKLENIL

SEQ ID NO: 2500931 - protein, 17 aa, Entamoeba dispar
QIITSLRNPFLVQCYGM

SEQ ID NO: 2500932 - protein, 25 aa, Entamoeba dispar
QIKAAEPYDSFPIIMNGFVKDWSET

SEQ ID NO: 2500933 - protein, 26 aa, Entamoeba dispar
QIKAHGVTCFVSRQLIYPIPEQFFNA

SEQ ID NO: 2500934 - protein, 22 aa, Entamoeba dispar
QIKCCSMINSLVFLEYNYPNLQ

SEQ ID NO: 2500935 - protein, 22 aa, Entamoeba dispar
QIKCFDWKDLMIELKEREIKEV

SEQ ID NO: 2500936 - protein, 22 aa, Entamoeba dispar
QIKELKLKRIIDNKAGQFQIDE

SEQ ID NO: 2500937 - protein, 22 aa, Entamoeba dispar
QIKKAYRKLAIKYHPDKNPGDK

SEQ ID NO: 2500938 - protein, 22 aa, Entamoeba dispar
QIKKPTSWVIGKSVVRGRDWKW

SEQ ID NO: 2500939 - protein, 25 aa, Entamoeba dispar
QIKLIDFGSACFENNTLYTYIQSRH

SEQ ID NO: 2500940 - protein, 28 aa, Entamoeba dispar
QIKMERSRIKSECGIRRGDDKPVSRYSV

SEQ ID NO: 2500941 - protein, 24 aa, Entamoeba dispar
QIKYFWEIAKSLTLDQKKKLLIFV

SEQ ID NO: 2500942 - protein, 18 aa, Entamoeba dispar
QILEDTCVICYNLYLNEE

SEQ ID NO: 2500943 - protein, 33 aa, Entamoeba dispar
QILHLKFDIGLLLRLILCLSRSLNYDGDKRISI

SEQ ID NO: 2500944 - protein, 18 aa, Entamoeba dispar
QILIPIIGNFGVGKTSLL

SEQ ID NO: 2500945 - protein, 25 aa, Entamoeba dispar
QILKLACDHFCHPKVVLKDVPSNDK

SEQ ID NO: 2500946 - protein, 17 aa, Entamoeba dispar
QILLKLIVRDCNQDCYP

SEQ ID NO: 2500947 - protein, 17 aa, Entamoeba dispar
QILMKNKLIEWVESSLI

SEQ ID NO: 2500948 - protein, 20 aa, Entamoeba dispar
QILPGNVFKCKKRMDGKNCQ

SEQ ID NO: 2500949 - protein, 17 aa, Entamoeba dispar
QILYEIIDLIPSKCSKF

SEQ ID NO: 2500950 - protein, 21 aa, Entamoeba dispar
QIMCPECLMNGNINCLTEREI

SEQ ID NO: 2500951 - protein, 20 aa, Entamoeba dispar
QINCRGSVELDEKEEYDKYG

SEQ ID NO: 2500952 - protein, 23 aa, Entamoeba dispar
QINIKSDCIERLKLEGNKQTQFK

SEQ ID NO: 2500953 - protein, 24 aa, Entamoeba dispar
QINNNCVFREQYIQSIKFVEDQTR

SEQ ID NO: 2500954 - protein, 23 aa, Entamoeba dispar
QIPCGGMVCDLLWSDPGSMFGWK

SEQ ID NO: 2500955 - protein, 21 aa, Entamoeba dispar
QIPDYYLSNIVQIPDYYHNVS

SEQ ID NO: 2500956 - protein, 21 aa, Entamoeba dispar
QIPDYYLSNIVQIPDYYLSNI

SEQ ID NO: 2500957 - protein, 19 aa, Entamoeba dispar
QIPGYPLLIPYFIQHLKSL

SEQ ID NO: 2500958 - protein, 24 aa, Entamoeba dispar
QIPIMTVLMHYARTQFTDPNLIEL

SEQ ID NO: 2500959 - protein, 27 aa, Entamoeba dispar
QIPTFPILSYRSGIFSSLINSLELTKK

SEQ ID NO: 2500960 - protein, 24 aa, Entamoeba dispar
QIQEIRQFLGRFGLKGDTPKQQIQ

SEQ ID NO: 2500961 - protein, 18 aa, Entamoeba dispar
QIQFHMIKMFPMLRRMKF

SEQ ID NO: 2500962 - protein, 20 aa, Entamoeba dispar
QIQIPPLKWINPITGTGKIT

SEQ ID NO: 2500963 - protein, 25 aa, Entamoeba dispar
QIQLIWNCQEPIKMSINIDNGITIQ

SEQ ID NO: 2500964 - protein, 22 aa, Entamoeba dispar
QIQSIGSLLLFNSGVNVYADYS

SEQ ID NO: 2500965 - protein, 26 aa, Entamoeba dispar
QIRCSEWFRVMFVKYQCVYHILDLLK

SEQ ID NO: 2500966 - protein, 18 aa, Entamoeba dispar
QIRFLKNRLAGVYNKFSI

SEQ ID NO: 2500967 - protein, 27 aa, Entamoeba dispar
QIRKPISWLVGRKVKRGTDWKWSDQDG

SEQ ID NO: 2500968 - protein, 17 aa, Entamoeba dispar
QIRRYFQTWDFIKERIG

SEQ ID NO: 2500969 - protein, 25 aa, Entamoeba dispar
QIRVGEYLFSCTFFLYCSDIELQYK

SEQ ID NO: 2500970 - protein, 29 aa, Entamoeba dispar
QISEKEMYYTFCLIDYVLCNSPSFRRQVT

SEQ ID NO: 2500971 - protein, 18 aa, Entamoeba dispar
QISIRYYLSKGILKRTIF

SEQ ID NO: 2500972 - protein, 22 aa, Entamoeba dispar
QISLRMKWIRSQTNQSWDDFCK

SEQ ID NO: 2500973 - protein, 24 aa, Entamoeba dispar
QISMKYDRNCIFFFDEIGYQLYDE

SEQ ID NO: 2500974 - protein, 25 aa, Entamoeba dispar
QISYCLKAEFLKSSKIAQIIQVPPI

SEQ ID NO: 2500975 - protein, 22 aa, Entamoeba dispar
QITELLPLLLKGVGMHHSGLLP

SEQ ID NO: 2500976 - protein, 18 aa, Entamoeba dispar
QITFGLRYLHSIRILHRD

SEQ ID NO: 2500977 - protein, 24 aa, Entamoeba dispar
QITKCLLVKPSTIFDLWRQCHQPY

SEQ ID NO: 2500978 - protein, 22 aa, Entamoeba dispar
QITPLLYVFDGIFPLNVGIVQL

SEQ ID NO: 2500979 - protein, 22 aa, Entamoeba dispar
QIVEIPLNIFLTGGTIEVAIAN

SEQ ID NO: 2500980 - protein, 18 aa, Entamoeba dispar
QIVEPGMMYNCICLGNDG

SEQ ID NO: 2500981 - protein, 17 aa, Entamoeba dispar
QIVKPFSSLFLSGSADR

SEQ ID NO: 2500982 - protein, 18 aa, Entamoeba dispar
QIVLLMRELYLLIIKSAS

SEQ ID NO: 2500983 - protein, 21 aa, Entamoeba dispar
QIVLWCIGSTISYYTSLVGIS

SEQ ID NO: 2500984 - protein, 20 aa, Entamoeba dispar
QIVNYIAIHVIELLVENDKL

SEQ ID NO: 2500985 - protein, 20 aa, Entamoeba dispar
QIWLHAWKYSFNSHNWIAEI

SEQ ID NO: 2500986 - protein, 22 aa, Entamoeba dispar
QIWSEAVGWIVHSHQYNIIKTL

SEQ ID NO: 2500987 - protein, 18 aa, Entamoeba dispar
QIYCGITAIIPTMMYAQS

SEQ ID NO: 2500988 - protein, 19 aa, Entamoeba dispar
QIYFIYGTELFKINEELKI

SEQ ID NO: 2500989 - protein, 19 aa, Entamoeba dispar
QIYSMKNWILIPAKTTSTP

SEQ ID NO: 2500990 - protein, 18 aa, Entamoeba dispar
QIYVCDKCHMPAVANHKA

SEQ ID NO: 2500991 - protein, 23 aa, Entamoeba dispar
QIYYLRILQLLLRNEELHHQINR

SEQ ID NO: 2500992 - protein, 21 aa, Entamoeba dispar
QKAFDGCEMITSINIPSSVKI

SEQ ID NO: 2500993 - protein, 17 aa, Entamoeba dispar
QKAFGPGDVRRNSEYMK

SEQ ID NO: 2500994 - protein, 18 aa, Entamoeba dispar
QKAIPCEWYKRGFCKHGK

SEQ ID NO: 2500995 - protein, 17 aa, Entamoeba dispar
QKARIVLSIIKTEGINM

SEQ ID NO: 2500996 - protein, 21 aa, Entamoeba dispar
QKCSRCGKDIYGQVIDIKGKK

SEQ ID NO: 2500997 - protein, 30 aa, Entamoeba dispar
QKDARTMMCCLCQQLVPFLGYFELPYSLSS

SEQ ID NO: 2500998 - protein, 18 aa, Entamoeba dispar
QKDIPLIIVSDIYNKFFN

SEQ ID NO: 2500999 - protein, 26 aa, Entamoeba dispar
QKDLMKCRLVCKIWKDYLKTLPELTV

SEQ ID NO: 2501000 - protein, 22 aa, Entamoeba dispar
QKDVFTQIGIPLVETALNGYNS

SEQ ID NO: 2501001 - protein, 25 aa, Entamoeba dispar
QKEAFSIAPNGIWKIVLSTNIAETS

SEQ ID NO: 2501002 - protein, 18 aa, Entamoeba dispar
QKECCSATHINVPKCKKF

SEQ ID NO: 2501003 - protein, 17 aa, Entamoeba dispar
QKECERLSIGIGLISII

SEQ ID NO: 2501004 - protein, 21 aa, Entamoeba dispar
QKEECCSSCDEECHCECNHSQ

SEQ ID NO: 2501005 - protein, 23 aa, Entamoeba dispar
QKEEFSLYPTVSFSTDNEQYDYC

SEQ ID NO: 2501006 - protein, 23 aa, Entamoeba dispar
QKEENFGQIAYYFLLLSGFLQKP

SEQ ID NO: 2501007 - protein, 20 aa, Entamoeba dispar
QKEITDLFVFMGIDEQGVVK

SEQ ID NO: 2501008 - protein, 32 aa, Entamoeba dispar
QKEYEGILNLMKYNGGYSWWRRNSLTVFIDDK

SEQ ID NO: 2501009 - protein, 26 aa, Entamoeba dispar
QKFECIKEVLTIVAMLTVPNIFIRPK

SEQ ID NO: 2501010 - protein, 25 aa, Entamoeba dispar
QKFECTICKIPILREITKSDVEKIC

SEQ ID NO: 2501011 - protein, 19 aa, Entamoeba dispar
QKFEIPVIRSLRPMRTDDS

SEQ ID NO: 2501012 - protein, 24 aa, Entamoeba dispar
QKFFPSKLFYQWITRDGKYSQTRE

SEQ ID NO: 2501013 - protein, 20 aa, Entamoeba dispar
QKFLNKWIGIKSCLLTSTPM

SEQ ID NO: 2501014 - protein, 22 aa, Entamoeba dispar
QKFLTRRITLLRVHESDSELEE

SEQ ID NO: 2501015 - protein, 20 aa, Entamoeba dispar
QKFVPYKEIEVITTHLTIDK

SEQ ID NO: 2501016 - protein, 18 aa, Entamoeba dispar
QKGGLKEGIKQGGKTLAN

SEQ ID NO: 2501017 - protein, 24 aa, Entamoeba dispar
QKGKKVKHFYLFNDRLISGKPGNE

SEQ ID NO: 2501018 - protein, 20 aa, Entamoeba dispar
QKGLQAIVIVLDINQDRFAQ

SEQ ID NO: 2501019 - protein, 19 aa, Entamoeba dispar
QKGNDCFVETPLPQSDYVI

SEQ ID NO: 2501020 - protein, 22 aa, Entamoeba dispar
QKGNEFFSFIIYKEHISPKISE

SEQ ID NO: 2501021 - protein, 21 aa, Entamoeba dispar
QKGTRKFIFCVDNEVYLREFL

SEQ ID NO: 2501022 - protein, 19 aa, Entamoeba dispar
QKGVVQRIGATMFTTTHQT

SEQ ID NO: 2501023 - protein, 22 aa, Entamoeba dispar
QKGWELRLWFGDITESGYSNIY

SEQ ID NO: 2501024 - protein, 25 aa, Entamoeba dispar
QKHACKIIDFAHAWDVTEEECNVDD

SEQ ID NO: 2501025 - protein, 24 aa, Entamoeba dispar
QKHLKYGTKPCIFFMQNGYCKKGG

SEQ ID NO: 2501026 - protein, 21 aa, Entamoeba dispar
QKHLPKAVIVTSKISDISLLN

SEQ ID NO: 2501027 - protein, 39 aa, Entamoeba dispar
QKHNLCPYYYSRWATKRSKLILCPYNFVTSVSIRHSSDI

SEQ ID NO: 2501028 - protein, 28 aa, Entamoeba dispar
QKHVCNSVCFKLNLNGIDTFEADEEAET

SEQ ID NO: 2501029 - protein, 22 aa, Entamoeba dispar
QKHVSKNTGIHCTIETNNGKIV

SEQ ID NO: 2501030 - protein, 20 aa, Entamoeba dispar
QKIFEFFSQPIPVKCSILDQ

SEQ ID NO: 2501031 - protein, 23 aa, Entamoeba dispar
QKIFERYRPLMVIDDDENQTLNR

SEQ ID NO: 2501032 - protein, 22 aa, Entamoeba dispar
QKIKEFCIQFTTLERQESFETP

SEQ ID NO: 2501033 - protein, 17 aa, Entamoeba dispar
QKILKPIKIRRLSTGRV

SEQ ID NO: 2501034 - protein, 19 aa, Entamoeba dispar
QKINSLFCNSQINFNVVYN

SEQ ID NO: 2501035 - protein, 24 aa, Entamoeba dispar
QKISEQYMKFGIDKKHNYYPSWKM

SEQ ID NO: 2501036 - protein, 17 aa, Entamoeba dispar
QKISFVMEYAEMTFAKR

SEQ ID NO: 2501037 - protein, 22 aa, Entamoeba dispar
QKKEIKAPIVINKPIEKPKKGI

SEQ ID NO: 2501038 - protein, 25 aa, Entamoeba dispar
QKKGGPWLKEILKDMVELQIENPMI

SEQ ID NO: 2501039 - protein, 20 aa, Entamoeba dispar
QKKIITLYEFSFREFPKNWT

SEQ ID NO: 2501040 - protein, 25 aa, Entamoeba dispar
QKKILKDQLRLMATINITGLIQTLN

SEQ ID NO: 2501041 - protein, 17 aa, Entamoeba dispar
QKKKCHIYRTLSAGTVE

SEQ ID NO: 2501042 - protein, 25 aa, Entamoeba dispar
QKKKKRVNTDIVFPKLENFKCPVEY

SEQ ID NO: 2501043 - protein, 36 aa, Entamoeba dispar
QKKLFGRKGSPWEFNLRDILRFCKLYIEYNSNIENE

SEQ ID NO: 2501044 - protein, 17 aa, Entamoeba dispar
QKKNCKLYYLTIDSSIL

SEQ ID NO: 2501045 - protein, 22 aa, Entamoeba dispar
QKKNGVGILMEMCFNHKHLLLP

SEQ ID NO: 2501046 - protein, 18 aa, Entamoeba dispar
QKKVDTICNTSKQIEDDF

SEQ ID NO: 2501047 - protein, 25 aa, Entamoeba dispar
QKLIERYRVPKEFVIDSTKYVIDET

SEQ ID NO: 2501048 - protein, 21 aa, Entamoeba dispar
QKLIISGIVIALKIANPKYED

SEQ ID NO: 2501049 - protein, 27 aa, Entamoeba dispar
QKLRVIQIPQFRSGRMNEQLALGLEYL

SEQ ID NO: 2501050 - protein, 19 aa, Entamoeba dispar
QKLTEAFKVFDPEEKGVID

SEQ ID NO: 2501051 - protein, 21 aa, Entamoeba dispar
QKMKYHFFSSSLLFVYDAESY

SEQ ID NO: 2501052 - protein, 18 aa, Entamoeba dispar
QKMLLDGLYYLSGLFFCL

SEQ ID NO: 2501053 - protein, 19 aa, Entamoeba dispar
QKMQMGFSQIKSSLQKLPV

SEQ ID NO: 2501054 - protein, 25 aa, Entamoeba dispar
QKNCSSVAFNWIVKILQNIGYSFEF

SEQ ID NO: 2501055 - protein, 17 aa, Entamoeba dispar
QKNEIFDKRNFKLTVGN

SEQ ID NO: 2501056 - protein, 24 aa, Entamoeba dispar
QKNELKTDLFIQIITKYIENIKTT

SEQ ID NO: 2501057 - protein, 24 aa, Entamoeba dispar
QKNFKEMLDGFGLTADELAQNIKS

SEQ ID NO: 2501058 - protein, 17 aa, Entamoeba dispar
QKNGVGVWSELKKDENS

SEQ ID NO: 2501059 - protein, 17 aa, Entamoeba dispar
QKNHVKNIIALVGAGMS

SEQ ID NO: 2501060 - protein, 23 aa, Entamoeba dispar
QKNTCPILSEAVSLLNHKDSMIV

SEQ ID NO: 2501061 - protein, 18 aa, Entamoeba dispar
QKNYKSFCEVVSKLLELY

SEQ ID NO: 2501062 - protein, 18 aa, Entamoeba dispar
QKPIALKSAISVFLSMNS

SEQ ID NO: 2501063 - protein, 18 aa, Entamoeba dispar
QKPKEPKEVIIINKTQLK

SEQ ID NO: 2501064 - protein, 20 aa, Entamoeba dispar
QKPKRLQMLQSIVKNEYITY

SEQ ID NO: 2501065 - protein, 25 aa, Entamoeba dispar
QKPNEFAVLFPRKTAKIIDSGNDIS

SEQ ID NO: 2501066 - protein, 20 aa, Entamoeba dispar
QKPPIPICITKSSQNNSNSN

SEQ ID NO: 2501067 - protein, 18 aa, Entamoeba dispar
QKPVKRVYRKREKGNKIK

SEQ ID NO: 2501068 - protein, 20 aa, Entamoeba dispar
QKQIHVWPIIQFNITETVAI

SEQ ID NO: 2501069 - protein, 18 aa, Entamoeba dispar
QKQNSLFSLKQGYIESLI

SEQ ID NO: 2501070 - protein, 22 aa, Entamoeba dispar
QKQQCKCCRRYFGNDCLTNQKC

SEQ ID NO: 2501071 - protein, 25 aa, Entamoeba dispar
QKQVTPPAFVFGDFGTNEKTTPSFN

SEQ ID NO: 2501072 - protein, 22 aa, Entamoeba dispar
QKRALKIIPIKNEIQMIKNERE

SEQ ID NO: 2501073 - protein, 19 aa, Entamoeba dispar
QKREQWRKERKEIYKRIYD

SEQ ID NO: 2501074 - protein, 27 aa, Entamoeba dispar
QKRFCFCPKCLHKGIFTPMQFSLDSVR

SEQ ID NO: 2501075 - protein, 19 aa, Entamoeba dispar
QKRINGVGVARTLGNHFVK

SEQ ID NO: 2501076 - protein, 19 aa, Entamoeba dispar
QKRIRVDAKIGKFIKPKVE

SEQ ID NO: 2501077 - protein, 21 aa, Entamoeba dispar
QKRLPFKARYFISNSSYSQIC

SEQ ID NO: 2501078 - protein, 25 aa, Entamoeba dispar
QKRPSIRPNDGFLLYLKMLSQQNII

SEQ ID NO: 2501079 - protein, 20 aa, Entamoeba dispar
QKRRELRAAGIQVSYSHKIK

SEQ ID NO: 2501080 - protein, 17 aa, Entamoeba dispar
QKRVECLEKEQTENIAK

SEQ ID NO: 2501081 - protein, 18 aa, Entamoeba dispar
QKRVEQLFQEKERKIREF

SEQ ID NO: 2501082 - protein, 22 aa, Entamoeba dispar
QKRVKIVKMIVKLLKMIKKTAE

SEQ ID NO: 2501083 - protein, 21 aa, Entamoeba dispar
QKRWLFPNEVKSIGRRMKLIK

SEQ ID NO: 2501084 - protein, 23 aa, Entamoeba dispar
QKSEGMEGLMMWVNALLDGSGIE

SEQ ID NO: 2501085 - protein, 24 aa, Entamoeba dispar
QKSFDHSFCSSSIGRLEEWKKQQS

SEQ ID NO: 2501086 - protein, 21 aa, Entamoeba dispar
QKSGEIIPGIVSQFEIIRNNG

SEQ ID NO: 2501087 - protein, 30 aa, Entamoeba dispar
QKSGKTEAYFPYRLPSRAIYGGQNIEDSIQ

SEQ ID NO: 2501088 - protein, 17 aa, Entamoeba dispar
QKSIPIIYLISLYNPSK

SEQ ID NO: 2501089 - protein, 22 aa, Entamoeba dispar
QKSIWRIVDPVSEPVVQTHKKS

SEQ ID NO: 2501090 - protein, 17 aa, Entamoeba dispar
QKSNTFANLMNWYNETL

SEQ ID NO: 2501091 - protein, 22 aa, Entamoeba dispar
QKSSCKEGFFLFTHNYTTIEKM

SEQ ID NO: 2501092 - protein, 23 aa, Entamoeba dispar
QKSTKLYYEWNIFESIYSKNPTD

SEQ ID NO: 2501093 - protein, 24 aa, Entamoeba dispar
QKSYIGIGTINGFYVFDINNPSKA

SEQ ID NO: 2501094 - protein, 24 aa, Entamoeba dispar
QKSYLPRKVRLHSLHHKKVQHEEI

SEQ ID NO: 2501095 - protein, 18 aa, Entamoeba dispar
QKTFLIKILKKVFVEETE

SEQ ID NO: 2501096 - protein, 23 aa, Entamoeba dispar
QKTHSILLFISLGSRVKKDEDIQ

SEQ ID NO: 2501097 - protein, 17 aa, Entamoeba dispar
QKTLQLFLIESLTLPSG

SEQ ID NO: 2501098 - protein, 27 aa, Entamoeba dispar
QKTNPWIEWGKILNLRCMENQKNEKDC

SEQ ID NO: 2501099 - protein, 22 aa, Entamoeba dispar
QKVCMPQILKILIPYLPIQKES

SEQ ID NO: 2501100 - protein, 19 aa, Entamoeba dispar
QKVEFLALRVMDIIKNHKI

SEQ ID NO: 2501101 - protein, 21 aa, Entamoeba dispar
QKVESFFDLFYTPALPENLNL

SEQ ID NO: 2501102 - protein, 26 aa, Entamoeba dispar
QKVEWSECPYCVNSSIPKDLSLGKLL

SEQ ID NO: 2501103 - protein, 37 aa, Entamoeba dispar
QKVFKKRIMQLYSRLIRRYPRMLSYYMEYANWCKSIE

SEQ ID NO: 2501104 - protein, 17 aa, Entamoeba dispar
QKVKRFIHLSNAQVYDS

SEQ ID NO: 2501105 - protein, 18 aa, Entamoeba dispar
QKVNVCLIQVTKTEEKII

SEQ ID NO: 2501106 - protein, 26 aa, Entamoeba dispar
QKWSKLKCWGSAILFNINETTLAFLV

SEQ ID NO: 2501107 - protein, 18 aa, Entamoeba dispar
QKYFEIIDSVLFIEDLKS

SEQ ID NO: 2501108 - protein, 17 aa, Entamoeba dispar
QKYIFNNIINLFGKDVK

SEQ ID NO: 2501109 - protein, 29 aa, Entamoeba dispar
QKYNEIFKFLWKIKCMSISIDKAYRNMFP

SEQ ID NO: 2501110 - protein, 25 aa, Entamoeba dispar
QKYNWLRPHEDAFKISETEVFIGGL

SEQ ID NO: 2501111 - protein, 24 aa, Entamoeba dispar
QKYYQLEKMISWNTPLTYNNYIHQ

SEQ ID NO: 2501112 - protein, 18 aa, Entamoeba dispar
QKYYWKAKCLAKMGEFKQ

SEQ ID NO: 2501113 - protein, 24 aa, Entamoeba dispar
QLAELGNKCQIELFSVDHPFIPLW

SEQ ID NO: 2501114 - protein, 35 aa, Entamoeba dispar
QLANEQFKNFEFIKESEFLYLLCSFYNKSIESPYS

SEQ ID NO: 2501115 - protein, 17 aa, Entamoeba dispar
QLCEMNPTMGLITFDDT

SEQ ID NO: 2501116 - protein, 17 aa, Entamoeba dispar
QLCSLQLIKIKFDESKL

SEQ ID NO: 2501117 - protein, 18 aa, Entamoeba dispar
QLDNDFRKRLGLKPKTIK

SEQ ID NO: 2501118 - protein, 21 aa, Entamoeba dispar
QLDPEIAEIIASKRKHKKNEG

SEQ ID NO: 2501119 - protein, 17 aa, Entamoeba dispar
QLDRTIITSGDFTVYED

SEQ ID NO: 2501120 - protein, 19 aa, Entamoeba dispar
QLDYIVSICNVHEYIIVKL

SEQ ID NO: 2501121 - protein, 23 aa, Entamoeba dispar
QLDYTKLLLVIAYKKMKEVPSVL

SEQ ID NO: 2501122 - protein, 25 aa, Entamoeba dispar
QLEIKSLRSSECINIFTKDIDPSLL

SEQ ID NO: 2501123 - protein, 19 aa, Entamoeba dispar
QLEKCTPQPPLSFEKTPLV

SEQ ID NO: 2501124 - protein, 18 aa, Entamoeba dispar
QLEKSFIYPCVNIKRKDF

SEQ ID NO: 2501125 - protein, 20 aa, Entamoeba dispar
QLENLRRLNLFSNKIRNVPI

SEQ ID NO: 2501126 - protein, 18 aa, Entamoeba dispar
QLEPCLMNGLSYQEGAKR

SEQ ID NO: 2501127 - protein, 24 aa, Entamoeba dispar
QLFAKRGMCYYSLGKYMEAFTDGV

SEQ ID NO: 2501128 - protein, 19 aa, Entamoeba dispar
QLFCGCIATIPAQFTTEKY

SEQ ID NO: 2501129 - protein, 20 aa, Entamoeba dispar
QLFDPCHSIDASVVYDKDTN

SEQ ID NO: 2501130 - protein, 21 aa, Entamoeba dispar
QLFDSFQWNNCFYVVSEELCY

SEQ ID NO: 2501131 - protein, 35 aa, Entamoeba dispar
QLFGQKDFGVFCVTEYGNVFGIFFHSVKILRNQTF

SEQ ID NO: 2501132 - protein, 36 aa, Entamoeba dispar
QLFMADPFARMLILRFVFCRLVLLSLKLPGDSDNFD

SEQ ID NO: 2501133 - protein, 18 aa, Entamoeba dispar
QLFSNTISSLFKRINEEV

SEQ ID NO: 2501134 - protein, 19 aa, Entamoeba dispar
QLGFKVEIHLPCLNGLPPI

SEQ ID NO: 2501135 - protein, 20 aa, Entamoeba dispar
QLGGCLYIPAVFCSIFGLSL

SEQ ID NO: 2501136 - protein, 19 aa, Entamoeba dispar
QLGGDCFKDCYNLTSINIP

SEQ ID NO: 2501137 - protein, 29 aa, Entamoeba dispar
QLGKKEIKPCVACCACQKTGKCWQKDPTM

SEQ ID NO: 2501138 - protein, 20 aa, Entamoeba dispar
QLGTYFFKVFGNVSVIKYIK

SEQ ID NO: 2501139 - protein, 28 aa, Entamoeba dispar
QLGVRAGIEFFNRFDVFNASYKIAGEDL

SEQ ID NO: 2501140 - protein, 18 aa, Entamoeba dispar
QLHLKVVNYNSLFIKLNE

SEQ ID NO: 2501141 - protein, 17 aa, Entamoeba dispar
QLHNTQWGYICPAETPE

SEQ ID NO: 2501142 - protein, 19 aa, Entamoeba dispar
QLIALRLLHTIISLQIEQC

SEQ ID NO: 2501143 - protein, 18 aa, Entamoeba dispar
QLIDACGNLVDIGDYLIY

SEQ ID NO: 2501144 - protein, 28 aa, Entamoeba dispar
QLIDFNLQWYITCSFDRYICTPTEDEDI

SEQ ID NO: 2501145 - protein, 24 aa, Entamoeba dispar
QLIFNFLARKGCFMNYEKTKKNHF

SEQ ID NO: 2501146 - protein, 21 aa, Entamoeba dispar
QLIICGGMAYTFLAASKNMKI

SEQ ID NO: 2501147 - protein, 23 aa, Entamoeba dispar
QLIKENYIIPDIVTNPFCCKSLM

SEQ ID NO: 2501148 - protein, 20 aa, Entamoeba dispar
QLIQALKFELHHNSELAMFL

SEQ ID NO: 2501149 - protein, 20 aa, Entamoeba dispar
QLIQELCCVFDERNAHNIKD

SEQ ID NO: 2501150 - protein, 22 aa, Entamoeba dispar
QLIRSSGKLVLLDKLLPKLYAD

SEQ ID NO: 2501151 - protein, 18 aa, Entamoeba dispar
QLITKMKAYCNGFLPKKE

SEQ ID NO: 2501152 - protein, 18 aa, Entamoeba dispar
QLKDYVVIDVFEKNIPKE

SEQ ID NO: 2501153 - protein, 22 aa, Entamoeba dispar
QLKELFFVLFVKRKKYYLNKID

SEQ ID NO: 2501154 - protein, 19 aa, Entamoeba dispar
QLKGKIKCYFKGGVPKNLQ

SEQ ID NO: 2501155 - protein, 21 aa, Entamoeba dispar
QLKGSFPHKMIREGKLSSSHF

SEQ ID NO: 2501156 - protein, 19 aa, Entamoeba dispar
QLKKIWDLRIKNKEIVNEL

SEQ ID NO: 2501157 - protein, 24 aa, Entamoeba dispar
QLKKLPEYFLRGCRCIELVDTKNV

SEQ ID NO: 2501158 - protein, 23 aa, Entamoeba dispar
QLKKSQRCTVCGMQSSSSLCQAC

SEQ ID NO: 2501159 - protein, 25 aa, Entamoeba dispar
QLKLLRREIDVMRKLSNHPNVVKLY

SEQ ID NO: 2501160 - protein, 35 aa, Entamoeba dispar
QLKNYIIKKSMKFLVFMIIFVVSKGLEPIEVATEE

SEQ ID NO: 2501161 - protein, 19 aa, Entamoeba dispar
QLKTLRIVLQQLFPPIQAS

SEQ ID NO: 2501162 - protein, 26 aa, Entamoeba dispar
QLKVSPSSICRYMKKQEAREIYERIQ

SEQ ID NO: 2501163 - protein, 26 aa, Entamoeba dispar
QLLATIRKWKTLKIFENTLCEELESL

SEQ ID NO: 2501164 - protein, 26 aa, Entamoeba dispar
QLLDGLLREMMRTELETKLHQANYEK

SEQ ID NO: 2501165 - protein, 20 aa, Entamoeba dispar
QLLEKFMFGPTIYYSELFTN

SEQ ID NO: 2501166 - protein, 17 aa, Entamoeba dispar
QLLELKNIIDVNANETV

SEQ ID NO: 2501167 - protein, 18 aa, Entamoeba dispar
QLLISLKAPQAVAAMNAC

SEQ ID NO: 2501168 - protein, 19 aa, Entamoeba dispar
QLLISLKAPQAVVAMNACT

SEQ ID NO: 2501169 - protein, 20 aa, Entamoeba dispar
QLLISLKAPQAVVAMNACTL

SEQ ID NO: 2501170 - protein, 22 aa, Entamoeba dispar
QLLKELLMKEGAMKISSIIDGV

SEQ ID NO: 2501171 - protein, 20 aa, Entamoeba dispar
QLLKRERRLSLIRMDYDKVS

SEQ ID NO: 2501172 - protein, 22 aa, Entamoeba dispar
QLLLCSLNLFPEENVPEKYEDV

SEQ ID NO: 2501173 - protein, 19 aa, Entamoeba dispar
QLLLNVCLSSVYGYLAERY

SEQ ID NO: 2501174 - protein, 20 aa, Entamoeba dispar
QLLLPEIVSFIGADLAQKVI

SEQ ID NO: 2501175 - protein, 17 aa, Entamoeba dispar
QLLNLKSVNSFSYLTSL

SEQ ID NO: 2501176 - protein, 24 aa, Entamoeba dispar
QLLNSCSMKAHLMSELLKKLNTKY

SEQ ID NO: 2501177 - protein, 17 aa, Entamoeba dispar
QLLRALRTLSHANIVHC

SEQ ID NO: 2501178 - protein, 18 aa, Entamoeba dispar
QLLSCVFILSEFDQKTNF

SEQ ID NO: 2501179 - protein, 19 aa, Entamoeba dispar
QLLSSCLLIFKCLSEALSG

SEQ ID NO: 2501180 - protein, 17 aa, Entamoeba dispar
QLLSWLLDGFLELESDQ

SEQ ID NO: 2501181 - protein, 31 aa, Entamoeba dispar
QLMDINIFKKCFNLRELSCANNRILDLSNVQ

SEQ ID NO: 2501182 - protein, 21 aa, Entamoeba dispar
QLMICDTCYIGSKGVINLTKF

SEQ ID NO: 2501183 - protein, 24 aa, Entamoeba dispar
QLNCNAPPFKKRKGVEQPIAVKPL

SEQ ID NO: 2501184 - protein, 19 aa, Entamoeba dispar
QLNDLGLPFAICCHPMNST

SEQ ID NO: 2501185 - protein, 25 aa, Entamoeba dispar
QLNFKVKFTIIKAISGLAIGIGFNK

SEQ ID NO: 2501186 - protein, 20 aa, Entamoeba dispar
QLNNGMGGFGTFGQQQNNSI

SEQ ID NO: 2501187 - protein, 17 aa, Entamoeba dispar
QLNPRAMLMLVNTFINK

SEQ ID NO: 2501188 - protein, 18 aa, Entamoeba dispar
QLNQCFNLNINVLSNNLK

SEQ ID NO: 2501189 - protein, 23 aa, Entamoeba dispar
QLNYVRLIFLNSIDMDFINSLQL

SEQ ID NO: 2501190 - protein, 25 aa, Entamoeba dispar
QLPCTLKELPVCTFFNCIKLEKIEI

SEQ ID NO: 2501191 - protein, 22 aa, Entamoeba dispar
QLPDFFLNPEIPHLTLEQQEYI

SEQ ID NO: 2501192 - protein, 29 aa, Entamoeba dispar
QLPEELKTLFIHLLRLCNKIAQNEQINSM

SEQ ID NO: 2501193 - protein, 24 aa, Entamoeba dispar
QLPEEYRIEAVMNYYQEHNIPRIR

SEQ ID NO: 2501194 - protein, 23 aa, Entamoeba dispar
QLPEPLIPYEYYKQFIELPLKTT

SEQ ID NO: 2501195 - protein, 22 aa, Entamoeba dispar
QLPEYIKYLCVHSTNSNIVINQ

SEQ ID NO: 2501196 - protein, 20 aa, Entamoeba dispar
QLPKGIPSSCFFNDRDVNVQ

SEQ ID NO: 2501197 - protein, 17 aa, Entamoeba dispar
QLPMLLIPTTCTYLNVY

SEQ ID NO: 2501198 - protein, 17 aa, Entamoeba dispar
QLPTYVPCKVTAKYDYI

SEQ ID NO: 2501199 - protein, 24 aa, Entamoeba dispar
QLQCYILYVKMHFFPEMTEEAELV

SEQ ID NO: 2501200 - protein, 20 aa, Entamoeba dispar
QLRRMIALTYIPSFLASVSI

SEQ ID NO: 2501201 - protein, 20 aa, Entamoeba dispar
QLRSEFAFCLSSTPEEAIYS

SEQ ID NO: 2501202 - protein, 22 aa, Entamoeba dispar
QLRTIIHGTIFKKEQVIFNFEN

SEQ ID NO: 2501203 - protein, 21 aa, Entamoeba dispar
QLSELMGFIKIENINFAIVIQ

SEQ ID NO: 2501204 - protein, 22 aa, Entamoeba dispar
QLSIQSRSTFDFGELQNKQKLS

SEQ ID NO: 2501205 - protein, 23 aa, Entamoeba dispar
QLSKDESIHFGDTVISTQPSFEV

SEQ ID NO: 2501206 - protein, 18 aa, Entamoeba dispar
QLSLPYVEVKNNFVKYEQ

SEQ ID NO: 2501207 - protein, 22 aa, Entamoeba dispar
QLSTLKALFVILSYDPQIPQAN

SEQ ID NO: 2501208 - protein, 24 aa, Entamoeba dispar
QLSYGIKITDIFKIQPTPWCHPID

SEQ ID NO: 2501209 - protein, 26 aa, Entamoeba dispar
QLTFFAIKAADAWILQNIQAAYAQDP

SEQ ID NO: 2501210 - protein, 23 aa, Entamoeba dispar
QLTKLVLCGCSISNLTDLLHCSL

SEQ ID NO: 2501211 - protein, 24 aa, Entamoeba dispar
QLTPNCILPHLFLGSVESTTKPFL

SEQ ID NO: 2501212 - protein, 24 aa, Entamoeba dispar
QLTRSQIEIVYGFFHNDFDKTSKC

SEQ ID NO: 2501213 - protein, 18 aa, Entamoeba dispar
QLTSFGIHPWYCGDENLC

SEQ ID NO: 2501214 - protein, 20 aa, Entamoeba dispar
QLVHCLRLIGFDYVFDVDAG

SEQ ID NO: 2501215 - protein, 20 aa, Entamoeba dispar
QLVKGCPEEQIKIGYNVSLM

SEQ ID NO: 2501216 - protein, 26 aa, Entamoeba dispar
QLVKGDIIPVRFFLKNLQLTPTQTNI

SEQ ID NO: 2501217 - protein, 17 aa, Entamoeba dispar
QLVNIIMNYGCGSCGPR

SEQ ID NO: 2501218 - protein, 22 aa, Entamoeba dispar
QLVPALVYRLTHKSTYLTEDPE

SEQ ID NO: 2501219 - protein, 22 aa, Entamoeba dispar
QLVRQRLSSVSFIGRKTENGNG

SEQ ID NO: 2501220 - protein, 25 aa, Entamoeba dispar
QLWKIPMILSCGGYKQTYLLTKKSA

SEQ ID NO: 2501221 - protein, 20 aa, Entamoeba dispar
QLWSQLVLKYCEYIKKPIMK

SEQ ID NO: 2501222 - protein, 23 aa, Entamoeba dispar
QLYASSLFSWLADLIYLNISGCT

SEQ ID NO: 2501223 - protein, 29 aa, Entamoeba dispar
QLYHPFCQLLCGLLNFVKGITHFPVVLHF

SEQ ID NO: 2501224 - protein, 20 aa, Entamoeba dispar
QLYPIIFKRDSFISFCDTLK

SEQ ID NO: 2501225 - protein, 27 aa, Entamoeba dispar
QLYSLLKCSLFDFIPSFLLNKNDVPSS

SEQ ID NO: 2501226 - protein, 23 aa, Entamoeba dispar
QMAYDYRCSLGMGRTGYAAAVLQ

SEQ ID NO: 2501227 - protein, 27 aa, Entamoeba dispar
QMCQKQCRDANGFKCHCETEGHRRMME

SEQ ID NO: 2501228 - protein, 17 aa, Entamoeba dispar
QMDCYDKEVEIIECINI

SEQ ID NO: 2501229 - protein, 26 aa, Entamoeba dispar
QMDISEKIELLWEVVDPIFNSNVENM

SEQ ID NO: 2501230 - protein, 24 aa, Entamoeba dispar
QMEGFKFKLVQRIDLEKKTERFIK

SEQ ID NO: 2501231 - protein, 23 aa, Entamoeba dispar
QMEREIERLKGIMEDGKGIKQIK

SEQ ID NO: 2501232 - protein, 26 aa, Entamoeba dispar
QMEVLRYCLEAIKLYININIEDCFEY

SEQ ID NO: 2501233 - protein, 18 aa, Entamoeba dispar
QMFVHLFQFLNIKKNKFP

SEQ ID NO: 2501234 - protein, 19 aa, Entamoeba dispar
QMGHSYLFPNCVPRLEVYR

SEQ ID NO: 2501235 - protein, 30 aa, Entamoeba dispar
QMGLPPNFMMKFFFRPAEKVSDEIEELHSK

SEQ ID NO: 2501236 - protein, 23 aa, Entamoeba dispar
QMGWREIAEILVKFRQVAEPADG

SEQ ID NO: 2501237 - protein, 20 aa, Entamoeba dispar
QMICQVVRFAIKECARITSN

SEQ ID NO: 2501238 - protein, 19 aa, Entamoeba dispar
QMIDLLFKYSHDKIIDVDK

SEQ ID NO: 2501239 - protein, 25 aa, Entamoeba dispar
QMIIPHIFYKFIIMLVNRSEVQPHH

SEQ ID NO: 2501240 - protein, 24 aa, Entamoeba dispar
QMIPSKRLSLLSSVGTLAHRNLLV

SEQ ID NO: 2501241 - protein, 19 aa, Entamoeba dispar
QMIQQRFGIKPTLSDHPLF

SEQ ID NO: 2501242 - protein, 24 aa, Entamoeba dispar
QMKDEVFPSLPVSLISKTLHSFRL

SEQ ID NO: 2501243 - protein, 23 aa, Entamoeba dispar
QMKICQKSLFATHIKYTHCVQCQ

SEQ ID NO: 2501244 - protein, 37 aa, Entamoeba dispar
QMKKENNDILLLEFCKYCQLESLKIQNIGGCVDLTKD

SEQ ID NO: 2501245 - protein, 21 aa, Entamoeba dispar
QMKVLFSKEFDGVDKINTQIV

SEQ ID NO: 2501246 - protein, 26 aa, Entamoeba dispar
QMLGDGSYKLGPFLNTLFTVQDEDFK

SEQ ID NO: 2501247 - protein, 20 aa, Entamoeba dispar
QMMNIIYFTRIVVGSSSVTR

SEQ ID NO: 2501248 - protein, 23 aa, Entamoeba dispar
QMNAKRAGVPFFGIKEESDPVKV

SEQ ID NO: 2501249 - protein, 24 aa, Entamoeba dispar
QMNEVVMILRFLKKQSTHLSQIEF

SEQ ID NO: 2501250 - protein, 18 aa, Entamoeba dispar
QMNRISIQGNKEIEVRNE

SEQ ID NO: 2501251 - protein, 18 aa, Entamoeba dispar
QMPGCYLSNFVQIPYYYN

SEQ ID NO: 2501252 - protein, 26 aa, Entamoeba dispar
QMQEISCGAPAKMISQFYITYWMMLN

SEQ ID NO: 2501253 - protein, 22 aa, Entamoeba dispar
QMQKGIRGFQMIIDKNHTNELI

SEQ ID NO: 2501254 - protein, 18 aa, Entamoeba dispar
QMQKIKWVAECAKDFEVV

SEQ ID NO: 2501255 - protein, 20 aa, Entamoeba dispar
QMRFDEMFRNEIDKLVKEKC

SEQ ID NO: 2501256 - protein, 19 aa, Entamoeba dispar
QMRKELKDALDDVINQKTQ

SEQ ID NO: 2501257 - protein, 17 aa, Entamoeba dispar
QMRKRIELTKVFQKDKK

SEQ ID NO: 2501258 - protein, 20 aa, Entamoeba dispar
QMSKYAILVSDQWHSQLNKK

SEQ ID NO: 2501259 - protein, 17 aa, Entamoeba dispar
QMTCTYLNIFIQQLYSW

SEQ ID NO: 2501260 - protein, 26 aa, Entamoeba dispar
QMTLRIPKWENMILLLKKGVFHPKFV

SEQ ID NO: 2501261 - protein, 22 aa, Entamoeba dispar
QMTPEVWDYLFAEKEIPENTTI

SEQ ID NO: 2501262 - protein, 28 aa, Entamoeba dispar
QMYMRIAPELYLKELIVGGINRVYEIGR

SEQ ID NO: 2501263 - protein, 25 aa, Entamoeba dispar
QMYQDGCTWTTHFNRMYTSVHQLPT

SEQ ID NO: 2501264 - protein, 17 aa, Entamoeba dispar
QNAAWPITVLNTIVAES

SEQ ID NO: 2501265 - protein, 17 aa, Entamoeba dispar
QNARIHNNLGLSYQGLN

SEQ ID NO: 2501266 - protein, 17 aa, Entamoeba dispar
QNCFDIFYLISYIESTQ

SEQ ID NO: 2501267 - protein, 20 aa, Entamoeba dispar
QNCMDLECCVCHKRYHNKCF

SEQ ID NO: 2501268 - protein, 24 aa, Entamoeba dispar
QNDEIKEVLNISAQNEIKEYDNKS

SEQ ID NO: 2501269 - protein, 18 aa, Entamoeba dispar
QNDTTFFECFGITKITNL

SEQ ID NO: 2501270 - protein, 24 aa, Entamoeba dispar
QNEEYLRASITFNEIMKTKDILMT

SEQ ID NO: 2501271 - protein, 23 aa, Entamoeba dispar
QNEFNFLFTFIRELRNKFNEYPK

SEQ ID NO: 2501272 - protein, 21 aa, Entamoeba dispar
QNEGVIGFHLNSIIVKNSTSI

SEQ ID NO: 2501273 - protein, 17 aa, Entamoeba dispar
QNEIGIFGLRAVVDSMR

SEQ ID NO: 2501274 - protein, 25 aa, Entamoeba dispar
QNEILDCYNKFEVAYLEAMKEILKN

SEQ ID NO: 2501275 - protein, 26 aa, Entamoeba dispar
QNEKAPNWLVNWCFVEYVQYTHSMAS

SEQ ID NO: 2501276 - protein, 22 aa, Entamoeba dispar
QNELFFRYFSLIQNSVYHRFAL

SEQ ID NO: 2501277 - protein, 24 aa, Entamoeba dispar
QNEMMRGFGMMRGFIPNNMPMGGF

SEQ ID NO: 2501278 - protein, 18 aa, Entamoeba dispar
QNESRAGIIKKLKRFIAS

SEQ ID NO: 2501279 - protein, 25 aa, Entamoeba dispar
QNFLFDLCLEYGFWFESKPSRKSKK

SEQ ID NO: 2501280 - protein, 17 aa, Entamoeba dispar
QNFLIDCLREFNYQFDS

SEQ ID NO: 2501281 - protein, 18 aa, Entamoeba dispar
QNFLLSGYVNLKLWPDEE

SEQ ID NO: 2501282 - protein, 24 aa, Entamoeba dispar
QNGPCYKCLYPVMPSTTLNATAKT

SEQ ID NO: 2501283 - protein, 25 aa, Entamoeba dispar
QNGQLRLDQKVQLFQAITPQGTKQF

SEQ ID NO: 2501284 - protein, 24 aa, Entamoeba dispar
QNGSIFGGFTFKAPIEPKKYVVDP

SEQ ID NO: 2501285 - protein, 20 aa, Entamoeba dispar
QNGYCKKGGSCTFSHDISSL

SEQ ID NO: 2501286 - protein, 20 aa, Entamoeba dispar
QNHFATFYLLPGTYHVCSYS

SEQ ID NO: 2501287 - protein, 17 aa, Entamoeba dispar
QNICMLFKEESQRKEWK

SEQ ID NO: 2501288 - protein, 25 aa, Entamoeba dispar
QNIIPFIPLFAKKSFHLFTNSSEVV

SEQ ID NO: 2501289 - protein, 17 aa, Entamoeba dispar
QNIKRLISEEVFNEKEV

SEQ ID NO: 2501290 - protein, 20 aa, Entamoeba dispar
QNILQFWRKHFTTYENFFEV

SEQ ID NO: 2501291 - protein, 23 aa, Entamoeba dispar
QNISRLLEIYKTWGKNVRPGISF

SEQ ID NO: 2501292 - protein, 34 aa, Entamoeba dispar
QNKATQMLLPFYRFKSQYLLLLKVYIDSVQSFDK

SEQ ID NO: 2501293 - protein, 21 aa, Entamoeba dispar
QNKCNCIWDTIILNEIGECKY

SEQ ID NO: 2501294 - protein, 23 aa, Entamoeba dispar
QNKFKLIALNLFKEINIFEFPIH

SEQ ID NO: 2501295 - protein, 24 aa, Entamoeba dispar
QNKILLFGCNGFVGKFILRELIGK

SEQ ID NO: 2501296 - protein, 27 aa, Entamoeba dispar
QNKLRPLWRYYYSGTNAIIFVVDSNDD

SEQ ID NO: 2501297 - protein, 20 aa, Entamoeba dispar
QNKNIYFCVFIDKDESLEKV

SEQ ID NO: 2501298 - protein, 19 aa, Entamoeba dispar
QNKRPNIETCLEHIEQIRK

SEQ ID NO: 2501299 - protein, 26 aa, Entamoeba dispar
QNKTPMKSLCEKYMIQLVEKPNSKEK

SEQ ID NO: 2501300 - protein, 30 aa, Entamoeba dispar
QNKYDWALNFIKFLKEMVVYIKQYHTTGLT

SEQ ID NO: 2501301 - protein, 21 aa, Entamoeba dispar
QNLDSFSYFIYLREFVNCQNF

SEQ ID NO: 2501302 - protein, 21 aa, Entamoeba dispar
QNLFKACRKLFDLVIESFDLL

SEQ ID NO: 2501303 - protein, 23 aa, Entamoeba dispar
QNLFLMKEVKLFIDNIYNVEFIQ

SEQ ID NO: 2501304 - protein, 19 aa, Entamoeba dispar
QNLIFKRMKIIKEIQKSSK

SEQ ID NO: 2501305 - protein, 22 aa, Entamoeba dispar
QNLKLYKRKGLYQLTEMKECDK

SEQ ID NO: 2501306 - protein, 23 aa, Entamoeba dispar
QNLLIDLLDEFGFQFHTTLSRRS

SEQ ID NO: 2501307 - protein, 18 aa, Entamoeba dispar
QNLNQVYGLVLVRDHSIH

SEQ ID NO: 2501308 - protein, 17 aa, Entamoeba dispar
QNLPLLKRSISWHTGSI

SEQ ID NO: 2501309 - protein, 17 aa, Entamoeba dispar
QNLRDLSTIIVYGPTEE

SEQ ID NO: 2501310 - protein, 17 aa, Entamoeba dispar
QNLRDLSTIIVYGPTTE

SEQ ID NO: 2501311 - protein, 17 aa, Entamoeba dispar
QNLRELSTIIVYEPTAE

SEQ ID NO: 2501312 - protein, 17 aa, Entamoeba dispar
QNLRELSTIIVYGPTAE

SEQ ID NO: 2501313 - protein, 19 aa, Entamoeba dispar
QNLRELSTIIVYGPTAEAN

SEQ ID NO: 2501314 - protein, 19 aa, Entamoeba dispar
QNLVGRFAELWGMMEQELK

SEQ ID NO: 2501315 - protein, 26 aa, Entamoeba dispar
QNLVPFTLYCCSILVMLNIPPSDYSV

SEQ ID NO: 2501316 - protein, 26 aa, Entamoeba dispar
QNMARRSEILIARYALHKLYPDVEMT

SEQ ID NO: 2501317 - protein, 17 aa, Entamoeba dispar
QNMFYCAPELYLNQINE

SEQ ID NO: 2501318 - protein, 18 aa, Entamoeba dispar
QNMKFLWTLTSDKSSFFF

SEQ ID NO: 2501319 - protein, 18 aa, Entamoeba dispar
QNNGEWKGLLPIEEQPTL

SEQ ID NO: 2501320 - protein, 24 aa, Entamoeba dispar
QNNHCINFSSGVGMVEMIYESNGI

SEQ ID NO: 2501321 - protein, 18 aa, Entamoeba dispar
QNNIRIIGLSLPISDSKS

SEQ ID NO: 2501322 - protein, 25 aa, Entamoeba dispar
QNNLSELWSLFDFVYPGKLGTLPLF

SEQ ID NO: 2501323 - protein, 31 aa, Entamoeba dispar
QNPDLLCTWYLDNTCCVWNVETRRIAWSIPS

SEQ ID NO: 2501324 - protein, 34 aa, Entamoeba dispar
QNPESAKQIFLFVVDMIDLLNAFIPLPNEFQQVK

SEQ ID NO: 2501325 - protein, 24 aa, Entamoeba dispar
QNPETRKKVYAYMRQSVYVKKTQE

SEQ ID NO: 2501326 - protein, 31 aa, Entamoeba dispar
QNPGYFKAYEFRLALKSQISRYNEIIQLYLA

SEQ ID NO: 2501327 - protein, 20 aa, Entamoeba dispar
QNPTFCYDLINGIIGLCGSS

SEQ ID NO: 2501328 - protein, 23 aa, Entamoeba dispar
QNQCWKLFNECVSEISLDNFPAN

SEQ ID NO: 2501329 - protein, 23 aa, Entamoeba dispar
QNQFECLICLDTAHNAVVTQCGH

SEQ ID NO: 2501330 - protein, 25 aa, Entamoeba dispar
QNQFISNLIFEFELEHCINRYGIII

SEQ ID NO: 2501331 - protein, 20 aa, Entamoeba dispar
QNQVFGLVLVDAMLPRLTEE

SEQ ID NO: 2501332 - protein, 18 aa, Entamoeba dispar
QNRFGIAPDYKWDGVDRG

SEQ ID NO: 2501333 - protein, 17 aa, Entamoeba dispar
QNRFSNRKVDAFTLPTM

SEQ ID NO: 2501334 - protein, 28 aa, Entamoeba dispar
QNRNNLYLTFRCETYPSKIILPNGKYDL

SEQ ID NO: 2501335 - protein, 30 aa, Entamoeba dispar
QNRPKRDIIMGVAYLEWARNKYSQILKNTD

SEQ ID NO: 2501336 - protein, 22 aa, Entamoeba dispar
QNRWSSKCSREKKKDKFIEIQQ

SEQ ID NO: 2501337 - protein, 17 aa, Entamoeba dispar
QNTKFLFKTVILKILEE

SEQ ID NO: 2501338 - protein, 29 aa, Entamoeba dispar
QNTQVCGFCCYFDCLFYGKAHLTTKPGQP

SEQ ID NO: 2501339 - protein, 25 aa, Entamoeba dispar
QNVKWYFPIGIIFDALHNGSLPMEI

SEQ ID NO: 2501340 - protein, 18 aa, Entamoeba dispar
QNVLRKEMNVIRVNGPTA

SEQ ID NO: 2501341 - protein, 22 aa, Entamoeba dispar
QNVNLSKGFGFVTVKTSEEQKK

SEQ ID NO: 2501342 - protein, 18 aa, Entamoeba dispar
QNVPCSIKVLKPVKAKKF

SEQ ID NO: 2501343 - protein, 18 aa, Entamoeba dispar
QNVSCFDANEIIVIGLWD

SEQ ID NO: 2501344 - protein, 32 aa, Entamoeba dispar
QNVVPLLELCVKRKRPLVIISDTIDGDALTTL

SEQ ID NO: 2501345 - protein, 28 aa, Entamoeba dispar
QNWEEFCVQCSYQPFTISTYQKYTEHRE

SEQ ID NO: 2501346 - protein, 23 aa, Entamoeba dispar
QNYFLMQKLHFVRGNSIQDIYFK

SEQ ID NO: 2501347 - protein, 23 aa, Entamoeba dispar
QNYPDMYPTTAFKKTQNKTPMKS

SEQ ID NO: 2501348 - protein, 23 aa, Entamoeba dispar
QNYPIKIGDQFMKFDRVLCDVPC

SEQ ID NO: 2501349 - protein, 20 aa, Entamoeba dispar
QNYPTMVMEVFGKNEGDDSD

SEQ ID NO: 2501350 - protein, 27 aa, Entamoeba dispar
QPAIKIKEIFNAFCFGNSDIQNILITC

SEQ ID NO: 2501351 - protein, 24 aa, Entamoeba dispar
QPANTRLGAIRVHDVRCRYGIIKR

SEQ ID NO: 2501352 - protein, 17 aa, Entamoeba dispar
QPASDHYNLLREIAAET

SEQ ID NO: 2501353 - protein, 27 aa, Entamoeba dispar
QPCEWGIPCDLLLLKEVKKYGLESPKL

SEQ ID NO: 2501354 - protein, 18 aa, Entamoeba dispar
QPDDRVCFHCGKPGHIGK

SEQ ID NO: 2501355 - protein, 20 aa, Entamoeba dispar
QPDESCIFHTDRIIKNPTLD

SEQ ID NO: 2501356 - protein, 23 aa, Entamoeba dispar
QPDFLLIRGACQGVYGQDWRNEL

SEQ ID NO: 2501357 - protein, 32 aa, Entamoeba dispar
QPEGVRYKFDCCGTPIDGRIRDLIVIAQTEQT

SEQ ID NO: 2501358 - protein, 22 aa, Entamoeba dispar
QPEISYKLFFHQLYNILNYGHE

SEQ ID NO: 2501359 - protein, 31 aa, Entamoeba dispar
QPEYPWKQLKKLALRNCGITKIPPKVFNQIH

SEQ ID NO: 2501360 - protein, 19 aa, Entamoeba dispar
QPFECPLLYSQRTINDYNP

SEQ ID NO: 2501361 - protein, 17 aa, Entamoeba dispar
QPFTLFWNKIENLKQIQ

SEQ ID NO: 2501362 - protein, 31 aa, Entamoeba dispar
QPGNCFREVVAKFYLAEIICALEYLHMEGVV

SEQ ID NO: 2501363 - protein, 17 aa, Entamoeba dispar
QPGVLIQVFEGEASMTS

SEQ ID NO: 2501364 - protein, 17 aa, Entamoeba dispar
QPHFPRNISYDAKSVIM

SEQ ID NO: 2501365 - protein, 18 aa, Entamoeba dispar
QPHIDRIVFGSNFVDIIT

SEQ ID NO: 2501366 - protein, 35 aa, Entamoeba dispar
QPHKSDIPFGWFDFKCSFFYKHIRTANYYTKKCFR

SEQ ID NO: 2501367 - protein, 24 aa, Entamoeba dispar
QPHSPRNSSGCFVMNCKSQVIGLI

SEQ ID NO: 2501368 - protein, 17 aa, Entamoeba dispar
QPIAMRNVIGITMPPGY

SEQ ID NO: 2501369 - protein, 21 aa, Entamoeba dispar
QPICEELKIDPIVSAELISKR

SEQ ID NO: 2501370 - protein, 22 aa, Entamoeba dispar
QPIEIVLHLPILCEDKNVPYVF

SEQ ID NO: 2501371 - protein, 25 aa, Entamoeba dispar
QPIEMRKSSIPIFSKAPVMNKSGYF

SEQ ID NO: 2501372 - protein, 21 aa, Entamoeba dispar
QPIQRIPRYVLLLESLIKCLP

SEQ ID NO: 2501373 - protein, 19 aa, Entamoeba dispar
QPISMECHMPEFIKVDKEW

SEQ ID NO: 2501374 - protein, 18 aa, Entamoeba dispar
QPISTETINSWKNEESLT

SEQ ID NO: 2501375 - protein, 22 aa, Entamoeba dispar
QPIYQPRVGYQSEYIQPQVQQL

SEQ ID NO: 2501376 - protein, 21 aa, Entamoeba dispar
QPKCIDIIQSFGFSLDNLNSF

SEQ ID NO: 2501377 - protein, 18 aa, Entamoeba dispar
QPKHEVRLLGEIASNILK

SEQ ID NO: 2501378 - protein, 18 aa, Entamoeba dispar
QPKIPIKNERSVGTIPQW

SEQ ID NO: 2501379 - protein, 27 aa, Entamoeba dispar
QPKLPFKQRVSFEERKAFAIQLRQKKP

SEQ ID NO: 2501380 - protein, 21 aa, Entamoeba dispar
QPKPFRAVPVQPKPVKIDVPI

SEQ ID NO: 2501381 - protein, 22 aa, Entamoeba dispar
QPKPSIKLSTFLQTLKQNESQP

SEQ ID NO: 2501382 - protein, 22 aa, Entamoeba dispar
QPKRSRRTPIRIKKDDDDLSMS

SEQ ID NO: 2501383 - protein, 22 aa, Entamoeba dispar
QPKRSRRTPIRIKKEDDDLSMS

SEQ ID NO: 2501384 - protein, 23 aa, Entamoeba dispar
QPLFDRLGIFILTFNDNNIRLLK

SEQ ID NO: 2501385 - protein, 18 aa, Entamoeba dispar
QPLFGGFNPGTFKLKKTA

SEQ ID NO: 2501386 - protein, 31 aa, Entamoeba dispar
QPLFVIHVLWLRILYKISLPDDNNCFILFIQ

SEQ ID NO: 2501387 - protein, 21 aa, Entamoeba dispar
QPLINVCETINFSKISVLELT

SEQ ID NO: 2501388 - protein, 29 aa, Entamoeba dispar
QPLIPSFGTMEWNHLYLIFDANIDGTLTI

SEQ ID NO: 2501389 - protein, 17 aa, Entamoeba dispar
QPLKFRADIEVSCFAIG

SEQ ID NO: 2501390 - protein, 17 aa, Entamoeba dispar
QPLKLRHQLLLKLLKIM

SEQ ID NO: 2501391 - protein, 23 aa, Entamoeba dispar
QPLPLCFALALQNIDVWEFVYEG

SEQ ID NO: 2501392 - protein, 23 aa, Entamoeba dispar
QPLSFPSYVKVEFHLQDLIKKLI

SEQ ID NO: 2501393 - protein, 27 aa, Entamoeba dispar
QPNAMADVFKGLQFTNPFSNQTNQPPS

SEQ ID NO: 2501394 - protein, 18 aa, Entamoeba dispar
QPNGYKYPLIITSNAEMI

SEQ ID NO: 2501395 - protein, 19 aa, Entamoeba dispar
QPNLLKIYVEDIVDKCVID

SEQ ID NO: 2501396 - protein, 17 aa, Entamoeba dispar
QPNMERFHFNPIPLNEY

SEQ ID NO: 2501397 - protein, 18 aa, Entamoeba dispar
QPNNGMGGFGTFGQQQNS

SEQ ID NO: 2501398 - protein, 17 aa, Entamoeba dispar
QPNRCCELLSEIFNEVC

SEQ ID NO: 2501399 - protein, 23 aa, Entamoeba dispar
QPPEEMKNMIALKEEQDFDKQVL

SEQ ID NO: 2501400 - protein, 24 aa, Entamoeba dispar
QPPFHFYNLFSLYWSIIKVNVLSE

SEQ ID NO: 2501401 - protein, 21 aa, Entamoeba dispar
QPPGDILFFLTGQEEIDFTCL

SEQ ID NO: 2501402 - protein, 25 aa, Entamoeba dispar
QPPQLPPPRRGTSPANRSLNPSLST

SEQ ID NO: 2501403 - protein, 23 aa, Entamoeba dispar
QPPSLPIQTEFPLIQPPQEGILL

SEQ ID NO: 2501404 - protein, 19 aa, Entamoeba dispar
QPQKDIWGNPAQSQIGQQQ

SEQ ID NO: 2501405 - protein, 18 aa, Entamoeba dispar
QPQKDIWGNPTQSQIGQQ

SEQ ID NO: 2501406 - protein, 32 aa, Entamoeba dispar
QPQKLRLCEKCGLHPNICICQLIPKEKQHDNY

SEQ ID NO: 2501407 - protein, 27 aa, Entamoeba dispar
QPQNLMCDWYIPIDLKYKHLINQTQTM

SEQ ID NO: 2501408 - protein, 26 aa, Entamoeba dispar
QPQPIIKNKYDILAQIQLEQQQQPSS

SEQ ID NO: 2501409 - protein, 25 aa, Entamoeba dispar
QPQTQIILYWSFIHLFIICLENHRD

SEQ ID NO: 2501410 - protein, 20 aa, Entamoeba dispar
QPRIFELLKQLELLIKKINP

SEQ ID NO: 2501411 - protein, 30 aa, Entamoeba dispar
QPRLEELLHLPFIHLTQLVPLFNSLKDDFS

SEQ ID NO: 2501412 - protein, 25 aa, Entamoeba dispar
QPRQGPVVVCILDGFGIDKEGPGNC

SEQ ID NO: 2501413 - protein, 23 aa, Entamoeba dispar
QPRVANFCLWNLQPVQGSWMGAA

SEQ ID NO: 2501414 - protein, 18 aa, Entamoeba dispar
QPSICLFFFILFKSFFLL

SEQ ID NO: 2501415 - protein, 20 aa, Entamoeba dispar
QPSIFEAWAKKQGGSVKNWK

SEQ ID NO: 2501416 - protein, 18 aa, Entamoeba dispar
QPSKETLYIILLLIKNQI

SEQ ID NO: 2501417 - protein, 17 aa, Entamoeba dispar
QPSLSLSLEPIIKELKN

SEQ ID NO: 2501418 - protein, 26 aa, Entamoeba dispar
QPSQFFSFVTFHLWAYGEYTINYNIT

SEQ ID NO: 2501419 - protein, 27 aa, Entamoeba dispar
QPSTHWKCCVCCTKGIREREDVLRREV

SEQ ID NO: 2501420 - protein, 23 aa, Entamoeba dispar
QPTKAGCYAVSWNPVQSQIVSGH

SEQ ID NO: 2501421 - protein, 19 aa, Entamoeba dispar
QPVCAPTMRIDVNGESMKD

SEQ ID NO: 2501422 - protein, 19 aa, Entamoeba dispar
QPWHLPNTLQCRLKELKVW

SEQ ID NO: 2501423 - protein, 24 aa, Entamoeba dispar
QPWLDNIWEGCGILTIQKLLHYIS

SEQ ID NO: 2501424 - protein, 18 aa, Entamoeba dispar
QPYVPVKINSFIPKTNTE

SEQ ID NO: 2501425 - protein, 21 aa, Entamoeba dispar
QQCGLDTIMIENMHDVPYLNS

SEQ ID NO: 2501426 - protein, 18 aa, Entamoeba dispar
QQEALSMVGSITGNNQSQ

SEQ ID NO: 2501427 - protein, 22 aa, Entamoeba dispar
QQEDFEPYKECYVSQTPEEKYQ

SEQ ID NO: 2501428 - protein, 18 aa, Entamoeba dispar
QQELPHYKAFLSGTSLNI

SEQ ID NO: 2501429 - protein, 20 aa, Entamoeba dispar
QQETRFIFKVGDNLMQDMLT

SEQ ID NO: 2501430 - protein, 23 aa, Entamoeba dispar
QQFKELLGRCKVAEKRKEDMEFY

SEQ ID NO: 2501431 - protein, 23 aa, Entamoeba dispar
QQFKYSICFHWLSIPFRRKRMAL

SEQ ID NO: 2501432 - protein, 18 aa, Entamoeba dispar
QQFMKLLHVIGSFDQEFV

SEQ ID NO: 2501433 - protein, 19 aa, Entamoeba dispar
QQFWEGFKLLSSTTAEPYE

SEQ ID NO: 2501434 - protein, 17 aa, Entamoeba dispar
QQFYGCSSLEKINVPAP

SEQ ID NO: 2501435 - protein, 18 aa, Entamoeba dispar
QQGVYEWPEDVDVSDDCK

SEQ ID NO: 2501436 - protein, 22 aa, Entamoeba dispar
QQHEFNMYKSLGGRKTMDQFLK

SEQ ID NO: 2501437 - protein, 22 aa, Entamoeba dispar
QQHMPLFHFPRMGECKAYVSFI

SEQ ID NO: 2501438 - protein, 24 aa, Entamoeba dispar
QQHYHILVEFGLKLVVDSIESISG

SEQ ID NO: 2501439 - protein, 17 aa, Entamoeba dispar
QQIALAFMYGYGSVGFN

SEQ ID NO: 2501440 - protein, 25 aa, Entamoeba dispar
QQIDELYLRMAITSFEDLQPDLVAA

SEQ ID NO: 2501441 - protein, 20 aa, Entamoeba dispar
QQIFPIFTLKTIIQTDSLDS

SEQ ID NO: 2501442 - protein, 23 aa, Entamoeba dispar
QQIFSLLILRVLFSTIGFCTEIN

SEQ ID NO: 2501443 - protein, 19 aa, Entamoeba dispar
QQIIKKLKARYVFSDTNEV

SEQ ID NO: 2501444 - protein, 17 aa, Entamoeba dispar
QQIIKWLINTVKTNNFW

SEQ ID NO: 2501445 - protein, 22 aa, Entamoeba dispar
QQINGFGSFSGFGSNQTQNTGF

SEQ ID NO: 2501446 - protein, 17 aa, Entamoeba dispar
QQIQQGISFKLQPTQVP

SEQ ID NO: 2501447 - protein, 23 aa, Entamoeba dispar
QQIRSELMGFFNHLTKSKEMKKA

SEQ ID NO: 2501448 - protein, 22 aa, Entamoeba dispar
QQKDVRYSVLIPKNPENMKKPT

SEQ ID NO: 2501449 - protein, 25 aa, Entamoeba dispar
QQKEFPTFPGAILFTTNCLMKPLPS

SEQ ID NO: 2501450 - protein, 33 aa, Entamoeba dispar
QQKEFTAAMFLPFVMQFLENFENFTKWKFVPFI

SEQ ID NO: 2501451 - protein, 23 aa, Entamoeba dispar
QQKKAIGSFEWVDGIVVKCMQRG

SEQ ID NO: 2501452 - protein, 28 aa, Entamoeba dispar
QQKLKDIYEFWGFLWSQMFKILQEHCDG

SEQ ID NO: 2501453 - protein, 25 aa, Entamoeba dispar
QQKLWKLSDVIILWGNCSENTQQWA

SEQ ID NO: 2501454 - protein, 17 aa, Entamoeba dispar
QQKNLNFQKVVKLASTS

SEQ ID NO: 2501455 - protein, 27 aa, Entamoeba dispar
QQKRLLSQFKRSLCSSKYSYSTLLQHP

SEQ ID NO: 2501456 - protein, 25 aa, Entamoeba dispar
QQKYCPPNLFSIVFKGFNDVYRINS

SEQ ID NO: 2501457 - protein, 31 aa, Entamoeba dispar
QQLESPLLREARLFRSPFIKSFHIYCQQKDI

SEQ ID NO: 2501458 - protein, 24 aa, Entamoeba dispar
QQLEVCAKCGQTLNGNVLEALGRK

SEQ ID NO: 2501459 - protein, 28 aa, Entamoeba dispar
QQLKDAFKRSGLVCGVTCLIRYINGIKV

SEQ ID NO: 2501460 - protein, 17 aa, Entamoeba dispar
QQLKDIHFLVSVVYTLP

SEQ ID NO: 2501461 - protein, 17 aa, Entamoeba dispar
QQLKELQNQLELLQSQQ

SEQ ID NO: 2501462 - protein, 18 aa, Entamoeba dispar
QQLMIGFVSLKGELEKKK

SEQ ID NO: 2501463 - protein, 17 aa, Entamoeba dispar
QQLPAPPITVPIPTSTS

SEQ ID NO: 2501464 - protein, 23 aa, Entamoeba dispar
QQLPIKVIPPKVSPQHNSINNDS

SEQ ID NO: 2501465 - protein, 17 aa, Entamoeba dispar
QQLPPRWMFGYQQAAEW

SEQ ID NO: 2501466 - protein, 23 aa, Entamoeba dispar
QQLTLYEYELFKSIEAKEMLGNA

SEQ ID NO: 2501467 - protein, 17 aa, Entamoeba dispar
QQLYLGMLLNSTTEVCL

SEQ ID NO: 2501468 - protein, 26 aa, Entamoeba dispar
QQMSLSRLKYIFGEKIKIEEKLENRG

SEQ ID NO: 2501469 - protein, 17 aa, Entamoeba dispar
QQNHCIEILSDLKVLYD

SEQ ID NO: 2501470 - protein, 24 aa, Entamoeba dispar
QQNRINISFIISWLDDNDVTEVVE

SEQ ID NO: 2501471 - protein, 25 aa, Entamoeba dispar
QQNRLGQLLWDFGVPTAMSIWEASQ

SEQ ID NO: 2501472 - protein, 27 aa, Entamoeba dispar
QQPDVGEFRLIFAGRVLKDDEVLSTLG

SEQ ID NO: 2501473 - protein, 29 aa, Entamoeba dispar
QQPKCQLVIFKIYNIFCSKYLDNDFLKDT

SEQ ID NO: 2501474 - protein, 20 aa, Entamoeba dispar
QQQSGLRFAPTQATQLNVNQ

SEQ ID NO: 2501475 - protein, 23 aa, Entamoeba dispar
QQRSPKLLNHFLFNSTSLSTRDS

SEQ ID NO: 2501476 - protein, 18 aa, Entamoeba dispar
QQSFTWAVNALFSCLYEK

SEQ ID NO: 2501477 - protein, 22 aa, Entamoeba dispar
QQSNGFGGFGSFGQTNTQQNRL

SEQ ID NO: 2501478 - protein, 23 aa, Entamoeba dispar
QQSPRISLVMHRIVKEMQEKVGN

SEQ ID NO: 2501479 - protein, 20 aa, Entamoeba dispar
QQTFKWIGFCKKQTLKQQNT

SEQ ID NO: 2501480 - protein, 24 aa, Entamoeba dispar
QQTISLKCPISYQRIVIPARGLNC

SEQ ID NO: 2501481 - protein, 25 aa, Entamoeba dispar
QQTLQCWRRSESALFLLFCSDPLMQ

SEQ ID NO: 2501482 - protein, 31 aa, Entamoeba dispar
QQTNDVYFARWSPIISICNKVGGNLKIDKDE

SEQ ID NO: 2501483 - protein, 25 aa, Entamoeba dispar
QQVYYKIRCSLTFLDNDEETHDELM

SEQ ID NO: 2501484 - protein, 18 aa, Entamoeba dispar
QQWLFPKILHEIFDQCEK

SEQ ID NO: 2501485 - protein, 27 aa, Entamoeba dispar
QQYEILRREFLSALAFVEPTFDLSSAL

SEQ ID NO: 2501486 - protein, 19 aa, Entamoeba dispar
QQYPKAFVTQAIITCCIKT

SEQ ID NO: 2501487 - protein, 17 aa, Entamoeba dispar
QQYRKWTKLGIQGNKLF

SEQ ID NO: 2501488 - protein, 25 aa, Entamoeba dispar
QRAVKLAIRECIKKEIEIQESGLDI

SEQ ID NO: 2501489 - protein, 21 aa, Entamoeba dispar
QRCARCQDFLTTRDYLRDNIY

SEQ ID NO: 2501490 - protein, 19 aa, Entamoeba dispar
QRCDALKDGISRDWYVSSN

SEQ ID NO: 2501491 - protein, 17 aa, Entamoeba dispar
QRDIPIPLVSAGADKGN

SEQ ID NO: 2501492 - protein, 21 aa, Entamoeba dispar
QRDSLEFATAMYTYNRGVFDT

SEQ ID NO: 2501493 - protein, 28 aa, Entamoeba dispar
QREELQWCKAYLIGLLILCETRNSLSGL

SEQ ID NO: 2501494 - protein, 26 aa, Entamoeba dispar
QREHLRLQICSSFSYDESVLYTAGLD

SEQ ID NO: 2501495 - protein, 25 aa, Entamoeba dispar
QRELEDLKRIVLLMLDHCPQTFNLL

SEQ ID NO: 2501496 - protein, 23 aa, Entamoeba dispar
QRELERLKKEYIQQLNYQNDLEK

SEQ ID NO: 2501497 - protein, 25 aa, Entamoeba dispar
QRELKAEGLKSFFMTMSSEFHGEAD

SEQ ID NO: 2501498 - protein, 28 aa, Entamoeba dispar
QRFADIAGDLCSAGLQIAEDMRTQADGE

SEQ ID NO: 2501499 - protein, 18 aa, Entamoeba dispar
QRFDVIDPCILLYMKLVI

SEQ ID NO: 2501500 - protein, 20 aa, Entamoeba dispar
QRFGERVTELYLYKEKLEEY

SEQ ID NO: 2501501 - protein, 22 aa, Entamoeba dispar
QRFLSYSLIPPFFKQEQIKEYL

SEQ ID NO: 2501502 - protein, 26 aa, Entamoeba dispar
QRFNYKLRLGRGFTLKELRAAKIDKN

SEQ ID NO: 2501503 - protein, 29 aa, Entamoeba dispar
QRFPTLRTRSQIMWLFCSLVRRSENKQIN

SEQ ID NO: 2501504 - protein, 21 aa, Entamoeba dispar
QRFSYCPCCGNKMKYGGFGTH

SEQ ID NO: 2501505 - protein, 17 aa, Entamoeba dispar
QRGFDWTSNILSRKIEI

SEQ ID NO: 2501506 - protein, 26 aa, Entamoeba dispar
QRGRGLELLACVAKAIGKEQFRPYLN

SEQ ID NO: 2501507 - protein, 19 aa, Entamoeba dispar
QRHGYPYTTDLNVFGYDYN

SEQ ID NO: 2501508 - protein, 23 aa, Entamoeba dispar
QRHSVLFKTQFCLNVDDINNSTG

SEQ ID NO: 2501509 - protein, 21 aa, Entamoeba dispar
QRIADEFSVAVVLTNQVVAQV

SEQ ID NO: 2501510 - protein, 20 aa, Entamoeba dispar
QRICRYELLFESILKEIHQE

SEQ ID NO: 2501511 - protein, 22 aa, Entamoeba dispar
QRIDAAVLLGLIIQFRLTNNPI

SEQ ID NO: 2501512 - protein, 32 aa, Entamoeba dispar
QRIELAGGKVFYFHGWRVEGLLGVSRSIGDIA

SEQ ID NO: 2501513 - protein, 25 aa, Entamoeba dispar
QRIKELRIKGIEGMENFEGLPDKNL

SEQ ID NO: 2501514 - protein, 21 aa, Entamoeba dispar
QRILLPCGIDINKWYNTSLTR

SEQ ID NO: 2501515 - protein, 20 aa, Entamoeba dispar
QRIPLTSIWMSQYPGKYPAL

SEQ ID NO: 2501516 - protein, 20 aa, Entamoeba dispar
QRIPRYKLLLNDLLKHTPQN

SEQ ID NO: 2501517 - protein, 22 aa, Entamoeba dispar
QRIPRYNLLLSDFLKHTDRNDP

SEQ ID NO: 2501518 - protein, 28 aa, Entamoeba dispar
QRIPRYVMLVKDLCKWTQRNQWSNNLAL

SEQ ID NO: 2501519 - protein, 19 aa, Entamoeba dispar
QRIQHTFGAINLEDISQPN

SEQ ID NO: 2501520 - protein, 20 aa, Entamoeba dispar
QRISWEKLFNTLFVEECNKE

SEQ ID NO: 2501521 - protein, 23 aa, Entamoeba dispar
QRITHVFERLFNVALDVIEKVFG

SEQ ID NO: 2501522 - protein, 19 aa, Entamoeba dispar
QRKALVVSFNDGVLFSIIL

SEQ ID NO: 2501523 - protein, 24 aa, Entamoeba dispar
QRKEIYPLLLGIREGIKLNMEKVE

SEQ ID NO: 2501524 - protein, 19 aa, Entamoeba dispar
QRKGFGMKEAIIYHSEIFD

SEQ ID NO: 2501525 - protein, 26 aa, Entamoeba dispar
QRKGYKSGGVQLVLLIGGTSKIPKIR

SEQ ID NO: 2501526 - protein, 23 aa, Entamoeba dispar
QRKKIADILLFFIPTTKNCLIAK

SEQ ID NO: 2501527 - protein, 18 aa, Entamoeba dispar
QRKSDVIEIDRFVEERCA

SEQ ID NO: 2501528 - protein, 26 aa, Entamoeba dispar
QRLKEAKRDFAIDIFEDVALGKVNLV

SEQ ID NO: 2501529 - protein, 19 aa, Entamoeba dispar
QRLLAAIVCKNNLVTNQLP

SEQ ID NO: 2501530 - protein, 18 aa, Entamoeba dispar
QRLLCVKIGECFNGIICR

SEQ ID NO: 2501531 - protein, 22 aa, Entamoeba dispar
QRLRKIFFPDFFMKHQNISESH

SEQ ID NO: 2501532 - protein, 25 aa, Entamoeba dispar
QRLYGRRLSSCSFREEKIENNLYTL

SEQ ID NO: 2501533 - protein, 25 aa, Entamoeba dispar
QRMMTCPFCRGEFTNSLTIKHTSRC

SEQ ID NO: 2501534 - protein, 19 aa, Entamoeba dispar
QRMNRDWMHYGRRPSGICG

SEQ ID NO: 2501535 - protein, 18 aa, Entamoeba dispar
QRNNELERSIAISEKKKQ

SEQ ID NO: 2501536 - protein, 32 aa, Entamoeba dispar
QRNSNSISFRYDWRTLLAVIRMHLPPIEYFVG

SEQ ID NO: 2501537 - protein, 22 aa, Entamoeba dispar
QRPKRLEDIIGQESAIGIGTPF

SEQ ID NO: 2501538 - protein, 27 aa, Entamoeba dispar
QRPSGSAPRPALPRRKDSGAGAPPPPP

SEQ ID NO: 2501539 - protein, 27 aa, Entamoeba dispar
QRRVIKQKRNWGMLVFQLHQQHRRADL

SEQ ID NO: 2501540 - protein, 33 aa, Entamoeba dispar
QRSERKKWVSFFSDVDCAIFVTSLAEYDMKLYE

SEQ ID NO: 2501541 - protein, 17 aa, Entamoeba dispar
QRSFKRNRMNGEEKKQI

SEQ ID NO: 2501542 - protein, 18 aa, Entamoeba dispar
QRSFSYKGITNALCGKQN

SEQ ID NO: 2501543 - protein, 19 aa, Entamoeba dispar
QRSGLGCRYDIDVTPIVQT

SEQ ID NO: 2501544 - protein, 26 aa, Entamoeba dispar
QRSGRTEAYFPYKIPTRTIYGGKNID

SEQ ID NO: 2501545 - protein, 19 aa, Entamoeba dispar
QRSNTFLDELKEGIERKHI

SEQ ID NO: 2501546 - protein, 21 aa, Entamoeba dispar
QRSPGLFAFQALVVAASSNKQ

SEQ ID NO: 2501547 - protein, 26 aa, Entamoeba dispar
QRSREIAIQNIELWKQNDELKKAALE

SEQ ID NO: 2501548 - protein, 24 aa, Entamoeba dispar
QRSTSIPIRKGVLTWVHVLEEDTS

SEQ ID NO: 2501549 - protein, 26 aa, Entamoeba dispar
QRSTSIPIRNGVLTWVHVLEEDTSTI

SEQ ID NO: 2501550 - protein, 27 aa, Entamoeba dispar
QRSTSIPIRNGVLTWVHVLEEDTSTNS

SEQ ID NO: 2501551 - protein, 26 aa, Entamoeba dispar
QRSTSIPIRNGVLTWVHVLEEDTSTV

SEQ ID NO: 2501552 - protein, 27 aa, Entamoeba dispar
QRSTSIPIRNGVLTWVHVLEEDTSTVI

SEQ ID NO: 2501553 - protein, 18 aa, Entamoeba dispar
QRTFRCQSMIISQQEIDS

SEQ ID NO: 2501554 - protein, 18 aa, Entamoeba dispar
QRTPFYPHCILFDEDQLI

SEQ ID NO: 2501555 - protein, 17 aa, Entamoeba dispar
QRTPKCCFANENGIFEE

SEQ ID NO: 2501556 - protein, 24 aa, Entamoeba dispar
QRVEYKIVVSIKVCNRDLKNAIKN

SEQ ID NO: 2501557 - protein, 28 aa, Entamoeba dispar
QRVGSSFRCLCHYIRLFCENPLCSDIFT

SEQ ID NO: 2501558 - protein, 18 aa, Entamoeba dispar
QRVLCDYGTVTFQISALT

SEQ ID NO: 2501559 - protein, 20 aa, Entamoeba dispar
QRVYKKFKYQEVGLNRLYHL

SEQ ID NO: 2501560 - protein, 17 aa, Entamoeba dispar
QRYDMLDPIILLYMKLV

SEQ ID NO: 2501561 - protein, 23 aa, Entamoeba dispar
QRYDNKIGLLISHNLKRERGSKK

SEQ ID NO: 2501562 - protein, 20 aa, Entamoeba dispar
QRYFCVHGGLSPSLKKVDQI

SEQ ID NO: 2501563 - protein, 22 aa, Entamoeba dispar
QRYGFCRKGDDCNFSHEIPVSG

SEQ ID NO: 2501564 - protein, 18 aa, Entamoeba dispar
QRYNRDINELFPYEKEVV

SEQ ID NO: 2501565 - protein, 17 aa, Entamoeba dispar
QRYPKIRVSLEVFNQLK

SEQ ID NO: 2501566 - protein, 18 aa, Entamoeba dispar
QRYQLFSLYDKGILMDEE

SEQ ID NO: 2501567 - protein, 30 aa, Entamoeba dispar
QRYQYLMEFVPIWSKGWEKLTPIKTEQNEI

SEQ ID NO: 2501568 - protein, 18 aa, Entamoeba dispar
QRYYNRFICVNKKCFNIV

SEQ ID NO: 2501569 - protein, 28 aa, Entamoeba dispar
QSAIDWKLWCFHCKKPLDHGYVCSSCFG

SEQ ID NO: 2501570 - protein, 17 aa, Entamoeba dispar
QSAYFLFDQCITTPSKE

SEQ ID NO: 2501571 - protein, 26 aa, Entamoeba dispar
QSCSELIPLIPLPVFVCKQMVGNIII

SEQ ID NO: 2501572 - protein, 24 aa, Entamoeba dispar
QSDDIKYQIAWFFTNLAVSLDSET

SEQ ID NO: 2501573 - protein, 18 aa, Entamoeba dispar
QSDFKWSRQTDVGIQAFR

SEQ ID NO: 2501574 - protein, 21 aa, Entamoeba dispar
QSDGKCGVYFHDKETHELYQY

SEQ ID NO: 2501575 - protein, 23 aa, Entamoeba dispar
QSDIRIGVYGGRIGFAGEKVILN

SEQ ID NO: 2501576 - protein, 22 aa, Entamoeba dispar
QSDKGSVVFLKGFINSIFYRKS

SEQ ID NO: 2501577 - protein, 18 aa, Entamoeba dispar
QSDRPAYCIDQIRRFGYF

SEQ ID NO: 2501578 - protein, 23 aa, Entamoeba dispar
QSEFRFKLDGVISSRMDKVHSAF

SEQ ID NO: 2501579 - protein, 29 aa, Entamoeba dispar
QSEGFEELRLEFCRLMIQYNIHENNYIEN

SEQ ID NO: 2501580 - protein, 23 aa, Entamoeba dispar
QSEHLCNLLLYLPSELSIKEMLN

SEQ ID NO: 2501581 - protein, 24 aa, Entamoeba dispar
QSEIAVLAICYFDGLNVQLNMDSK

SEQ ID NO: 2501582 - protein, 27 aa, Entamoeba dispar
QSEIKFRYKFLITIFGEIFKRCKCLYI

SEQ ID NO: 2501583 - protein, 19 aa, Entamoeba dispar
QSEILKYVITYICEHKRED

SEQ ID NO: 2501584 - protein, 33 aa, Entamoeba dispar
QSEILNKFSPFFIHLVKIIFKRIDQLVEDKEGL

SEQ ID NO: 2501585 - protein, 18 aa, Entamoeba dispar
QSELSEFSQSQVIDIVSR

SEQ ID NO: 2501586 - protein, 27 aa, Entamoeba dispar
QSFEKISFLLFFRITKVIQRLIDSLSN

SEQ ID NO: 2501587 - protein, 19 aa, Entamoeba dispar
QSFHCSLNIIVNSSQLQIL

SEQ ID NO: 2501588 - protein, 23 aa, Entamoeba dispar
QSFKHFFFFCREFNFLSKDDIAP

SEQ ID NO: 2501589 - protein, 22 aa, Entamoeba dispar
QSFKTWWNYVEYFDESHFQSKI

SEQ ID NO: 2501590 - protein, 20 aa, Entamoeba dispar
QSFLCTPILIAAHRTLNLYL

SEQ ID NO: 2501591 - protein, 27 aa, Entamoeba dispar
QSFMLWQIRRMIGFAIVLTNFRLPIEQ

SEQ ID NO: 2501592 - protein, 22 aa, Entamoeba dispar
QSFTRRVLFNGAMYTVKCQIII

SEQ ID NO: 2501593 - protein, 18 aa, Entamoeba dispar
QSGAMKQDDICVGGSGST

SEQ ID NO: 2501594 - protein, 26 aa, Entamoeba dispar
QSGELKLIIEYGYLFPNIELIHITND

SEQ ID NO: 2501595 - protein, 25 aa, Entamoeba dispar
QSGELRNEIIFKPKIGTEQLLRNAI

SEQ ID NO: 2501596 - protein, 29 aa, Entamoeba dispar
QSGKLFVWEWDNWEYPKNSLKGHPESIES

SEQ ID NO: 2501597 - protein, 26 aa, Entamoeba dispar
QSGLKEIFELAAKVSMGLLDAVVSEA

SEQ ID NO: 2501598 - protein, 18 aa, Entamoeba dispar
QSGQLFVFCKFFTSKLSL

SEQ ID NO: 2501599 - protein, 17 aa, Entamoeba dispar
QSGWYCCDDTNVYPWNE

SEQ ID NO: 2501600 - protein, 23 aa, Entamoeba dispar
QSHFLEHILFLLGNRCVNCERHM

SEQ ID NO: 2501601 - protein, 17 aa, Entamoeba dispar
QSHILRLALSQYHFHPE

SEQ ID NO: 2501602 - protein, 18 aa, Entamoeba dispar
QSHVCYLIDFGLSQRYLK

SEQ ID NO: 2501603 - protein, 18 aa, Entamoeba dispar
QSIARKGLINEIIVSSTQ

SEQ ID NO: 2501604 - protein, 18 aa, Entamoeba dispar
QSICSCLSLIEYIESISV

SEQ ID NO: 2501605 - protein, 25 aa, Entamoeba dispar
QSIDIAKEMFKWLMSNNPEGVLDFL

SEQ ID NO: 2501606 - protein, 39 aa, Entamoeba dispar
QSIELYKKGLEYLFYNHLIEVGYKLIIPSYYFQQIQVSS

SEQ ID NO: 2501607 - protein, 24 aa, Entamoeba dispar
QSIIKDQLQHVAHIQQLISEKSKD

SEQ ID NO: 2501608 - protein, 24 aa, Entamoeba dispar
QSIKIMKIIHYFLSNGVSNELLGQ

SEQ ID NO: 2501609 - protein, 21 aa, Entamoeba dispar
QSIKNTLDWMTSIARTNYRTP

SEQ ID NO: 2501610 - protein, 25 aa, Entamoeba dispar
QSILKKLKDLYCEKLKIDKNTIINP

SEQ ID NO: 2501611 - protein, 18 aa, Entamoeba dispar
QSIPSFIQMCLKKYPESF

SEQ ID NO: 2501612 - protein, 19 aa, Entamoeba dispar
QSIQVCPEQSFFNYFFPTS

SEQ ID NO: 2501613 - protein, 20 aa, Entamoeba dispar
QSIRLLACEMINKAKSGHPG

SEQ ID NO: 2501614 - protein, 17 aa, Entamoeba dispar
QSISFSAKFCTNCGTPV

SEQ ID NO: 2501615 - protein, 18 aa, Entamoeba dispar
QSKDCIFSLIIPEIDEPW

SEQ ID NO: 2501616 - protein, 19 aa, Entamoeba dispar
QSKDLKIIVSFESFCSYFA

SEQ ID NO: 2501617 - protein, 18 aa, Entamoeba dispar
QSKECIFSSIIPYIDEPW

SEQ ID NO: 2501618 - protein, 20 aa, Entamoeba dispar
QSKIRPLWRHYYEGTQGLVF

SEQ ID NO: 2501619 - protein, 20 aa, Entamoeba dispar
QSKLPFTGRYEFVLPNENQK

SEQ ID NO: 2501620 - protein, 24 aa, Entamoeba dispar
QSKNRGVCLNELYESQVSFNKSMN

SEQ ID NO: 2501621 - protein, 18 aa, Entamoeba dispar
QSKRIWGELWKVVDSSDV

SEQ ID NO: 2501622 - protein, 29 aa, Entamoeba dispar
QSKRLFPAHLREIIKNIFFKVKSNRGEQQ

SEQ ID NO: 2501623 - protein, 21 aa, Entamoeba dispar
QSKTRNGIDYFIKVAYKCFKL

SEQ ID NO: 2501624 - protein, 18 aa, Entamoeba dispar
QSLCLLIEKCCSKHLVLN

SEQ ID NO: 2501625 - protein, 19 aa, Entamoeba dispar
QSLCLLIEKCCSKHLVLND

SEQ ID NO: 2501626 - protein, 22 aa, Entamoeba dispar
QSLCSNPSFLSSAIQSIIFEYL

SEQ ID NO: 2501627 - protein, 18 aa, Entamoeba dispar
QSLDWKLYFPNGKPAEML

SEQ ID NO: 2501628 - protein, 24 aa, Entamoeba dispar
QSLHNKRSLAFVIQFLECVEPPCC

SEQ ID NO: 2501629 - protein, 24 aa, Entamoeba dispar
QSLIKSQEKYTHFLPTTNEQSRIN

SEQ ID NO: 2501630 - protein, 23 aa, Entamoeba dispar
QSLKDLRFNRAPFLTDMQQIGTL

SEQ ID NO: 2501631 - protein, 17 aa, Entamoeba dispar
QSLKLTRKYIMTGEEKE

SEQ ID NO: 2501632 - protein, 19 aa, Entamoeba dispar
QSLPFAWTVPTLKHTLQIY

SEQ ID NO: 2501633 - protein, 19 aa, Entamoeba dispar
QSLYLYRNTYSQAIISISE

SEQ ID NO: 2501634 - protein, 17 aa, Entamoeba dispar
QSMEAANVLINFCNQLG

SEQ ID NO: 2501635 - protein, 24 aa, Entamoeba dispar
QSNGKGYRSAKMIDLDMIIGKYTI

SEQ ID NO: 2501636 - protein, 18 aa, Entamoeba dispar
QSNLKPYAFIVATEIEYF

SEQ ID NO: 2501637 - protein, 26 aa, Entamoeba dispar
QSNSIPLMYCCEEVFNSISQVKDDTD

SEQ ID NO: 2501638 - protein, 21 aa, Entamoeba dispar
QSPDDIFSFDGFTSAPAQTSQ

SEQ ID NO: 2501639 - protein, 25 aa, Entamoeba dispar
QSPSPFYLVCITIQLPIPHREVIEE

SEQ ID NO: 2501640 - protein, 29 aa, Entamoeba dispar
QSQIECPFWLAPEIFKGEQWTKASDVYSY

SEQ ID NO: 2501641 - protein, 26 aa, Entamoeba dispar
QSSGVSYKFERLYGYAEGDTAYDPLI

SEQ ID NO: 2501642 - protein, 40 aa, Entamoeba dispar
QSSIQKEAELLFSRAKTLGLDDCIEEWNKDLQSDIKRFQE

SEQ ID NO: 2501643 - protein, 18 aa, Entamoeba dispar
QSSRFGHIVLTFTPLLRV

SEQ ID NO: 2501644 - protein, 22 aa, Entamoeba dispar
QSSRLLKKWFNSRMFSNYFNDD

SEQ ID NO: 2501645 - protein, 18 aa, Entamoeba dispar
QSSSILIFYCEYSGERGP

SEQ ID NO: 2501646 - protein, 19 aa, Entamoeba dispar
QSSSQLSQIEYLKQQNQQL

SEQ ID NO: 2501647 - protein, 19 aa, Entamoeba dispar
QSSTFSINSPKSYLNFLSQ

SEQ ID NO: 2501648 - protein, 24 aa, Entamoeba dispar
QSSVTILLPHVWPAQQVITPQDQE

SEQ ID NO: 2501649 - protein, 22 aa, Entamoeba dispar
QSTGCSIIQCLALKEQNNQVLF

SEQ ID NO: 2501650 - protein, 24 aa, Entamoeba dispar
QSTTEWANSVSRPLVKEIDPNFNR

SEQ ID NO: 2501651 - protein, 31 aa, Entamoeba dispar
QSVEISTLIPLRFGAERCILIGDPQQLPATV

SEQ ID NO: 2501652 - protein, 23 aa, Entamoeba dispar
QSVFQWKEEFLKWSTIKPDAIKL

SEQ ID NO: 2501653 - protein, 17 aa, Entamoeba dispar
QSVICFININNSICELK

SEQ ID NO: 2501654 - protein, 25 aa, Entamoeba dispar
QSVKGRSNVMFIFRTIDQHIFGCFN

SEQ ID NO: 2501655 - protein, 24 aa, Entamoeba dispar
QSVKLKKLYSIPCVVANKTFTFQQ

SEQ ID NO: 2501656 - protein, 24 aa, Entamoeba dispar
QSVKPIVLFWALRITSILLCSSAD

SEQ ID NO: 2501657 - protein, 24 aa, Entamoeba dispar
QSYAFDVICDIGFEKINLNFGDTK

SEQ ID NO: 2501658 - protein, 25 aa, Entamoeba dispar
QSYERRKRIVGFPLSLKRLEVTYDQ

SEQ ID NO: 2501659 - protein, 27 aa, Entamoeba dispar
QSYLIMPIQRIPRYVLLIKDMLKNSPP

SEQ ID NO: 2501660 - protein, 17 aa, Entamoeba dispar
QSYRAALELFIHIHLPS

SEQ ID NO: 2501661 - protein, 24 aa, Entamoeba dispar
QSYYRKSNAVIMVYDISRKETFEQ

SEQ ID NO: 2501662 - protein, 18 aa, Entamoeba dispar
QTAAIFLRQILKKYYQEE

SEQ ID NO: 2501663 - protein, 18 aa, Entamoeba dispar
QTAVVWKGPKKNSLIRQF

SEQ ID NO: 2501664 - protein, 17 aa, Entamoeba dispar
QTCHFRPITIDNQHQLS

SEQ ID NO: 2501665 - protein, 18 aa, Entamoeba dispar
QTDYRFILTTSIPSLIHP

SEQ ID NO: 2501666 - protein, 26 aa, Entamoeba dispar
QTEIFKHCWLVLELLRKSIQQIGADE

SEQ ID NO: 2501667 - protein, 24 aa, Entamoeba dispar
QTEPIQLVDCFKLLNLPDEFSIDD

SEQ ID NO: 2501668 - protein, 18 aa, Entamoeba dispar
QTEYRGGAAKVILKVFQM

SEQ ID NO: 2501669 - protein, 20 aa, Entamoeba dispar
QTFCPFRLVDEINQGMDPLN

SEQ ID NO: 2501670 - protein, 32 aa, Entamoeba dispar
QTFFAAFNMKLFPRIMIYFGQTDNETRCSFAV

SEQ ID NO: 2501671 - protein, 17 aa, Entamoeba dispar
QTFMWTHTMFMSSSAMI

SEQ ID NO: 2501672 - protein, 23 aa, Entamoeba dispar
QTFPSTIRWFISKQIYSVGITED

SEQ ID NO: 2501673 - protein, 23 aa, Entamoeba dispar
QTFQRFAYNSAIISGDYCIFALN

SEQ ID NO: 2501674 - protein, 18 aa, Entamoeba dispar
QTFVFSATMILASEMMAK

SEQ ID NO: 2501675 - protein, 17 aa, Entamoeba dispar
QTFWYTRVNSYTSRTGD

SEQ ID NO: 2501676 - protein, 18 aa, Entamoeba dispar
QTGFKPFFGNVFEGETLN

SEQ ID NO: 2501677 - protein, 27 aa, Entamoeba dispar
QTGIWEPCYLMLIGSILYIYKNPVDIF

SEQ ID NO: 2501678 - protein, 21 aa, Entamoeba dispar
QTGNELWRSDIQNGIACVYDN

SEQ ID NO: 2501679 - protein, 25 aa, Entamoeba dispar
QTGSSFPLSICEFEKAEKFIGLAHI

SEQ ID NO: 2501680 - protein, 17 aa, Entamoeba dispar
QTICAKISMKNVKLPET

SEQ ID NO: 2501681 - protein, 25 aa, Entamoeba dispar
QTIKEEIKILGAYELYNHNLFLSLN

SEQ ID NO: 2501682 - protein, 22 aa, Entamoeba dispar
QTKEHPKAFGLFRSRAQSQSKK

SEQ ID NO: 2501683 - protein, 28 aa, Entamoeba dispar
QTKIIGIDKMCRYFMYINNYLIIETSEL

SEQ ID NO: 2501684 - protein, 17 aa, Entamoeba dispar
QTKITGIVLNFIQTNNI

SEQ ID NO: 2501685 - protein, 25 aa, Entamoeba dispar
QTKLELTKPFSIVLENKYQKIPFDI

SEQ ID NO: 2501686 - protein, 23 aa, Entamoeba dispar
QTKRSLRFVQRFESVNKKNRMQL

SEQ ID NO: 2501687 - protein, 24 aa, Entamoeba dispar
QTKSFFPFHLQPFLTHKLLIHIGK

SEQ ID NO: 2501688 - protein, 17 aa, Entamoeba dispar
QTKVCCTISKSELNKKI

SEQ ID NO: 2501689 - protein, 20 aa, Entamoeba dispar
QTLEARAEVATLMLTPTQII

SEQ ID NO: 2501690 - protein, 27 aa, Entamoeba dispar
QTLENLRFWPSILLHVVIKNIGEKKEP

SEQ ID NO: 2501691 - protein, 22 aa, Entamoeba dispar
QTLGDNCFYGYDSLKSVNIPTT

SEQ ID NO: 2501692 - protein, 17 aa, Entamoeba dispar
QTLKIFIINKEFKLLLN

SEQ ID NO: 2501693 - protein, 22 aa, Entamoeba dispar
QTLKSICRTLRKSIEDFGKDEI

SEQ ID NO: 2501694 - protein, 17 aa, Entamoeba dispar
QTLMFSATFPKQIQRLA

SEQ ID NO: 2501695 - protein, 17 aa, Entamoeba dispar
QTLMIKGDIEFNGRVIV

SEQ ID NO: 2501696 - protein, 17 aa, Entamoeba dispar
QTLNFLKKFILHEKFDE

SEQ ID NO: 2501697 - protein, 18 aa, Entamoeba dispar
QTLNQIRTALTMISQGYR

SEQ ID NO: 2501698 - protein, 18 aa, Entamoeba dispar
QTLRTCLLKTSTHKHLQK

SEQ ID NO: 2501699 - protein, 22 aa, Entamoeba dispar
QTLRVYLNYIIRCPYFVDHFPV

SEQ ID NO: 2501700 - protein, 20 aa, Entamoeba dispar
QTLYSVYLWIGKQTDQISRI

SEQ ID NO: 2501701 - protein, 22 aa, Entamoeba dispar
QTNDFKPEFQILPQHFSEQNTE

SEQ ID NO: 2501702 - protein, 23 aa, Entamoeba dispar
QTNFPLERLYIIQPENIDINALN

SEQ ID NO: 2501703 - protein, 17 aa, Entamoeba dispar
QTNNAICTLFFIHYLFP

SEQ ID NO: 2501704 - protein, 35 aa, Entamoeba dispar
QTNWFRPLIIPLLKLRPYELLQHMIIITDDLPQID

SEQ ID NO: 2501705 - protein, 17 aa, Entamoeba dispar
QTPENFRSFSLLGELIS

SEQ ID NO: 2501706 - protein, 32 aa, Entamoeba dispar
QTPETFDFNSSIPKPQPASVIRSRTNTFNFDQ

SEQ ID NO: 2501707 - protein, 34 aa, Entamoeba dispar
QTPETFDFNSSIPKPQPASVIRSRTNTFNFDQPK

SEQ ID NO: 2501708 - protein, 28 aa, Entamoeba dispar
QTPFGPKWKKGDVISICVDFNQRTIKVL

SEQ ID NO: 2501709 - protein, 22 aa, Entamoeba dispar
QTPLLPLSCDFHLENNNLTVLN

SEQ ID NO: 2501710 - protein, 17 aa, Entamoeba dispar
QTPTLGFCVDRQKEIDN

SEQ ID NO: 2501711 - protein, 25 aa, Entamoeba dispar
QTQAMWDWLDLLLPALSQLPYLKTS

SEQ ID NO: 2501712 - protein, 25 aa, Entamoeba dispar
QTQELLSLDRQWIITFGSNIKNLLS

SEQ ID NO: 2501713 - protein, 25 aa, Entamoeba dispar
QTQFKEIIDRIAGATNNVQYAHISP

SEQ ID NO: 2501714 - protein, 24 aa, Entamoeba dispar
QTQFKEIIDRLAGATNNVQYAHIS

SEQ ID NO: 2501715 - protein, 29 aa, Entamoeba dispar
QTQRIPQLLRFVSDLSPQESMVINELLQT

SEQ ID NO: 2501716 - protein, 20 aa, Entamoeba dispar
QTQYRIAMEIHESKNREKFL

SEQ ID NO: 2501717 - protein, 22 aa, Entamoeba dispar
QTRIKIGLNSKMPNRFPPVVFY

SEQ ID NO: 2501718 - protein, 20 aa, Entamoeba dispar
QTSFEWPELAIDPTKRTNQP

SEQ ID NO: 2501719 - protein, 18 aa, Entamoeba dispar
QTSLRYSIQLISLAMLKA

SEQ ID NO: 2501720 - protein, 27 aa, Entamoeba dispar
QTSNFMIIRGMKLFYFIINSSFPFGKK

SEQ ID NO: 2501721 - protein, 26 aa, Entamoeba dispar
QTSPCFKELICRVTPVLVDGISATDP

SEQ ID NO: 2501722 - protein, 25 aa, Entamoeba dispar
QTSYIKEVIKKYYLSGQNVFKQNPE

SEQ ID NO: 2501723 - protein, 23 aa, Entamoeba dispar
QTTAVSIFACLTLFTHGDSFETI

SEQ ID NO: 2501724 - protein, 19 aa, Entamoeba dispar
QTTGISFHIPRLIIPNDRI

SEQ ID NO: 2501725 - protein, 19 aa, Entamoeba dispar
QTTIKRKILNEVIIHSNYG

SEQ ID NO: 2501726 - protein, 25 aa, Entamoeba dispar
QTTSEATFTWVLPRILDKTQFTFVS

SEQ ID NO: 2501727 - protein, 24 aa, Entamoeba dispar
QTVKSCKSLILSTESFLMDFNEKQ

SEQ ID NO: 2501728 - protein, 20 aa, Entamoeba dispar
QTVLLSIKFKSQIRSDKREE

SEQ ID NO: 2501729 - protein, 19 aa, Entamoeba dispar
QTVMNAIFLKWDLESLNSE

SEQ ID NO: 2501730 - protein, 17 aa, Entamoeba dispar
QTYFPVVVDEIRLKYYK

SEQ ID NO: 2501731 - protein, 24 aa, Entamoeba dispar
QTYYCAKSFCTPKMIEARNMPLME

SEQ ID NO: 2501732 - protein, 17 aa, Entamoeba dispar
QVADIDFIASIEILGKK

SEQ ID NO: 2501733 - protein, 17 aa, Entamoeba dispar
QVALRVQLITKMKAYCN

SEQ ID NO: 2501734 - protein, 23 aa, Entamoeba dispar
QVAPLDLCRYISILDSGNDIATT

SEQ ID NO: 2501735 - protein, 26 aa, Entamoeba dispar
QVARILKLDGIFCLLTDSPIVVNIVN

SEQ ID NO: 2501736 - protein, 26 aa, Entamoeba dispar
QVCCKPFKCVFERTIERSLPKQDEYF

SEQ ID NO: 2501737 - protein, 21 aa, Entamoeba dispar
QVEKCKVALLKRNDEEIKTLA

SEQ ID NO: 2501738 - protein, 22 aa, Entamoeba dispar
QVELARALALRLENEHDPKRKA

SEQ ID NO: 2501739 - protein, 28 aa, Entamoeba dispar
QVEMPEYWLEAGNPWEIVRQDVKYEIKF

SEQ ID NO: 2501740 - protein, 18 aa, Entamoeba dispar
QVGDMILMMCQRGQMTGK

SEQ ID NO: 2501741 - protein, 18 aa, Entamoeba dispar
QVGVPLCFVYTPLCNEVD

SEQ ID NO: 2501742 - protein, 22 aa, Entamoeba dispar
QVHDWWFYPWLTEIVEDPSEKE

SEQ ID NO: 2501743 - protein, 17 aa, Entamoeba dispar
QVIECMKIIKNIIIKGF

SEQ ID NO: 2501744 - protein, 23 aa, Entamoeba dispar
QVILDCLKPVYTPLLSETMFDVN

SEQ ID NO: 2501745 - protein, 19 aa, Entamoeba dispar
QVISCKSFTILSHGYLLPE

SEQ ID NO: 2501746 - protein, 26 aa, Entamoeba dispar
QVITTMIPKFILRCSVEVIQELFNFI

SEQ ID NO: 2501747 - protein, 31 aa, Entamoeba dispar
QVIYQKLIKMFKEINIPYIIAPGEAEAQCYQ

SEQ ID NO: 2501748 - protein, 19 aa, Entamoeba dispar
QVKECQKKLAAIQKAAITG

SEQ ID NO: 2501749 - protein, 25 aa, Entamoeba dispar
QVKLGVSISNGMFKTAIDNAIVYKT

SEQ ID NO: 2501750 - protein, 24 aa, Entamoeba dispar
QVKRLKWAMKAMYQAYNMAYNSAN

SEQ ID NO: 2501751 - protein, 23 aa, Entamoeba dispar
QVKTMRFRTRLFSSAYNQQTETE

SEQ ID NO: 2501752 - protein, 23 aa, Entamoeba dispar
QVKVSSILPFYSFTFDAILKDKT

SEQ ID NO: 2501753 - protein, 22 aa, Entamoeba dispar
QVLCSLPPFVEYLKEVIPTDDM

SEQ ID NO: 2501754 - protein, 25 aa, Entamoeba dispar
QVLDMLWMIWNFDEEYSIFCKEKEK

SEQ ID NO: 2501755 - protein, 31 aa, Entamoeba dispar
QVLHGGCWHEEFLRMSCVILGEYPQLLGGLA

SEQ ID NO: 2501756 - protein, 24 aa, Entamoeba dispar
QVLSRLSYISALGMMTRLNSHFEK

SEQ ID NO: 2501757 - protein, 31 aa, Entamoeba dispar
QVLSVFGIKWLKMMFAREFLLADSVIIWDAI

SEQ ID NO: 2501758 - protein, 18 aa, Entamoeba dispar
QVMNRLETVTARLEKLEG

SEQ ID NO: 2501759 - protein, 34 aa, Entamoeba dispar
QVMPPTYGPGPMRRQRINPMGYRPMAPQQIRRQN

SEQ ID NO: 2501760 - protein, 24 aa, Entamoeba dispar
QVPKNAKHLACRIFYQSKTQTIAD

SEQ ID NO: 2501761 - protein, 18 aa, Entamoeba dispar
QVPLIKMFEDAFCKTSSE

SEQ ID NO: 2501762 - protein, 24 aa, Entamoeba dispar
QVQIKLKPGEYVTNCLRCKNTSCH

SEQ ID NO: 2501763 - protein, 24 aa, Entamoeba dispar
QVQLTQYIPFIFKSILTLEEKEYI

SEQ ID NO: 2501764 - protein, 27 aa, Entamoeba dispar
QVRKAALDCWDVIAIIVREYAMTLDNP

SEQ ID NO: 2501765 - protein, 19 aa, Entamoeba dispar
QVRRVIKNGHIKDKNVQKQ

SEQ ID NO: 2501766 - protein, 23 aa, Entamoeba dispar
QVRYKFPIHFILFSSCCNEIIKI

SEQ ID NO: 2501767 - protein, 23 aa, Entamoeba dispar
QVSEIDPSWLIEVAPHVFKEEDM

SEQ ID NO: 2501768 - protein, 18 aa, Entamoeba dispar
QVTCYKCGQVGHKSIDCP

SEQ ID NO: 2501769 - protein, 27 aa, Entamoeba dispar
QVVEARWNPNCYGFIASVAEEYDIHIW

SEQ ID NO: 2501770 - protein, 18 aa, Entamoeba dispar
QVVLCVSSYIQAQRDASM

SEQ ID NO: 2501771 - protein, 18 aa, Entamoeba dispar
QVVLPPCSITYLLDTNGS

SEQ ID NO: 2501772 - protein, 21 aa, Entamoeba dispar
QVVPECINFLSKFVGNDLYGS

SEQ ID NO: 2501773 - protein, 19 aa, Entamoeba dispar
QVVSLHFKEPLLNTIQLLQ

SEQ ID NO: 2501774 - protein, 30 aa, Entamoeba dispar
QVWPGALYIENEWGHKIVLLDDSNPYNKTK

SEQ ID NO: 2501775 - protein, 28 aa, Entamoeba dispar
QVYFRFGDWDTIRILRVIIKVQPITNMF

SEQ ID NO: 2501776 - protein, 19 aa, Entamoeba dispar
QVYSIYFGACYSFIQQDTL

SEQ ID NO: 2501777 - protein, 27 aa, Entamoeba dispar
QWFEVPNEAFGRILPKMSMYLDHIPHS

SEQ ID NO: 2501778 - protein, 19 aa, Entamoeba dispar
QWFQYTYLYVCLKQSPGGI

SEQ ID NO: 2501779 - protein, 32 aa, Entamoeba dispar
QWIFDCVNENFILPCGEYAIGQKLPPHLSPYV

SEQ ID NO: 2501780 - protein, 19 aa, Entamoeba dispar
QWKSLSITSNLSFRKSELI

SEQ ID NO: 2501781 - protein, 23 aa, Entamoeba dispar
QWLFDCIIERRFVSINNYILNPS

SEQ ID NO: 2501782 - protein, 20 aa, Entamoeba dispar
QWLFDCLKEGRVISINKYVL

SEQ ID NO: 2501783 - protein, 18 aa, Entamoeba dispar
QWLQCLKIVRCDASNEII

SEQ ID NO: 2501784 - protein, 22 aa, Entamoeba dispar
QWLRKRRATAVSVIPKYQDYSL

SEQ ID NO: 2501785 - protein, 29 aa, Entamoeba dispar
QWMSCYKCHCFFCWICMQITNDHQHKIGQ

SEQ ID NO: 2501786 - protein, 28 aa, Entamoeba dispar
QWMSCYKCHCFFCWVCMQVTNNHQHKPG

SEQ ID NO: 2501787 - protein, 18 aa, Entamoeba dispar
QWMVKDLLETIDVRARGI

SEQ ID NO: 2501788 - protein, 22 aa, Entamoeba dispar
QWNARYAALVALSLSVIPGKYI

SEQ ID NO: 2501789 - protein, 25 aa, Entamoeba dispar
QWPPNLYFKGYLTFDVTDIHKCIGI

SEQ ID NO: 2501790 - protein, 19 aa, Entamoeba dispar
QWTSLSGFVRYLETKEIVE

SEQ ID NO: 2501791 - protein, 18 aa, Entamoeba dispar
QWVDEVVDGIPYWDTELF

SEQ ID NO: 2501792 - protein, 21 aa, Entamoeba dispar
QWVSNICEILFVATLDFLLEQ

SEQ ID NO: 2501793 - protein, 20 aa, Entamoeba dispar
QWYKECYPNLDGLDSTKEII

SEQ ID NO: 2501794 - protein, 35 aa, Entamoeba dispar
QYDDVLRINCQLIEIADGCERCRQRIRQVQQPPLE

SEQ ID NO: 2501795 - protein, 27 aa, Entamoeba dispar
QYEEKEFYTIFGTYFKKNAKWSINKNV

SEQ ID NO: 2501796 - protein, 17 aa, Entamoeba dispar
QYEIPTFMTLFSKVIQC

SEQ ID NO: 2501797 - protein, 19 aa, Entamoeba dispar
QYEPLKFTYNEAIGTYTKS

SEQ ID NO: 2501798 - protein, 23 aa, Entamoeba dispar
QYEVPKKKFEVHEKKIKHFIKHQ

SEQ ID NO: 2501799 - protein, 19 aa, Entamoeba dispar
QYFLCSGLIETETIKEIMG

SEQ ID NO: 2501800 - protein, 22 aa, Entamoeba dispar
QYFPKLKRLILYNLLLSSSILH

SEQ ID NO: 2501801 - protein, 21 aa, Entamoeba dispar
QYFRNGHGFLIVYSVTDRNSF

SEQ ID NO: 2501802 - protein, 18 aa, Entamoeba dispar
QYGIPKGIFFSMPVVCYG

SEQ ID NO: 2501803 - protein, 19 aa, Entamoeba dispar
QYGIPKGIFFSMPVVCYGG

SEQ ID NO: 2501804 - protein, 24 aa, Entamoeba dispar
QYIGSRLKNVSAFLKKNGFTSRRE

SEQ ID NO: 2501805 - protein, 22 aa, Entamoeba dispar
QYIKYGDGFVLIYSITSKESFE

SEQ ID NO: 2501806 - protein, 19 aa, Entamoeba dispar
QYILPKIVEFGSEEIKDNV

SEQ ID NO: 2501807 - protein, 24 aa, Entamoeba dispar
QYINDVLKYMCLILSIQPIYSKFI

SEQ ID NO: 2501808 - protein, 37 aa, Entamoeba dispar
QYIQFAFRWFNCCLIREFPIELSLILWDGYISEPNGN

SEQ ID NO: 2501809 - protein, 23 aa, Entamoeba dispar
QYIRLKELPSFFSKFPSLINLDL

SEQ ID NO: 2501810 - protein, 24 aa, Entamoeba dispar
QYKEVVEIFKSCPLPNESDGKEDP

SEQ ID NO: 2501811 - protein, 22 aa, Entamoeba dispar
QYKLFPRVMIYFKQVEDSDKVS

SEQ ID NO: 2501812 - protein, 20 aa, Entamoeba dispar
QYKLNILFFHCKLLLFHISE

SEQ ID NO: 2501813 - protein, 24 aa, Entamoeba dispar
QYLFELLNILTLKLLEIHVPPHRN

SEQ ID NO: 2501814 - protein, 17 aa, Entamoeba dispar
QYLLKYLPLYTSLAASG

SEQ ID NO: 2501815 - protein, 19 aa, Entamoeba dispar
QYNGGIFVTQFTLNGKYIV

SEQ ID NO: 2501816 - protein, 24 aa, Entamoeba dispar
QYQQGYIGPMGYWPDTIYHPQEKQ

SEQ ID NO: 2501817 - protein, 26 aa, Entamoeba dispar
QYRERIRGKMFEWVPNIAKEDVKQTP

SEQ ID NO: 2501818 - protein, 18 aa, Entamoeba dispar
QYRIKKEKTYAISKNEEY

SEQ ID NO: 2501819 - protein, 31 aa, Entamoeba dispar
QYRKITISLVESWNGVMKGYIEQTENGISEY

SEQ ID NO: 2501820 - protein, 18 aa, Entamoeba dispar
QYSLVLLKYCQTVTILEE

SEQ ID NO: 2501821 - protein, 23 aa, Entamoeba dispar
QYSRLNLTAIYIVNSFYIQALMN

SEQ ID NO: 2501822 - protein, 20 aa, Entamoeba dispar
QYSYVKVFFLPKEDLSPDLF

SEQ ID NO: 2501823 - protein, 22 aa, Entamoeba dispar
QYTIPFPYYLFIPKCYKMIAKL

SEQ ID NO: 2501824 - protein, 22 aa, Entamoeba dispar
QYTKECDIWSIGIILYIILSGT

SEQ ID NO: 2501825 - protein, 29 aa, Entamoeba dispar
QYTQDFKKRFSLLLGFEFKSMSAVDAFKL

SEQ ID NO: 2501826 - protein, 25 aa, Entamoeba dispar
QYTQLCDIWSFGVTIFVSMCGYYPF

SEQ ID NO: 2501827 - protein, 18 aa, Entamoeba dispar
QYVCSGFGMTETCGIVYK

SEQ ID NO: 2501828 - protein, 17 aa, Entamoeba dispar
QYVKRLCENIIRVKPDL

SEQ ID NO: 2501829 - protein, 25 aa, Entamoeba dispar
QYVWFMTKQGFVWSTLLQTLINIEN

SEQ ID NO: 2501830 - protein, 20 aa, Entamoeba dispar
QYYGETYIILNVYYKQYLIP

SEQ ID NO: 2501831 - protein, 26 aa, Entamoeba dispar
QYYLPLFRMAEHLKRSHEDRTNKLVT

SEQ ID NO: 2501832 - protein, 29 aa, Entamoeba dispar
QYYPKGENWQHVFTLGGIESDFLYKVNTT

SEQ ID NO: 2501833 - protein, 17 aa, Entamoeba dispar
QYYYCLSQAVLHDSKNV

SEQ ID NO: 2501834 - protein, 18 aa, Entamoeba dispar
RAAFEKFGTVTDCKVVTD

SEQ ID NO: 2501835 - protein, 25 aa, Entamoeba dispar
RAAISSIQINGGILLTTYNLVQNDE

SEQ ID NO: 2501836 - protein, 23 aa, Entamoeba dispar
RAASIRSLYRIFLLSDHDSQSII

SEQ ID NO: 2501837 - protein, 25 aa, Entamoeba dispar
RAAVELADQVLICVGNIIGHYYTQI

SEQ ID NO: 2501838 - protein, 25 aa, Entamoeba dispar
RADRTCKKFSVACSRKDMFKKLVIC

SEQ ID NO: 2501839 - protein, 22 aa, Entamoeba dispar
RAEKIEGLFTFIDRMLDSGKTV

SEQ ID NO: 2501840 - protein, 22 aa, Entamoeba dispar
RAEKSHPFYDLVVKRFKELYTE

SEQ ID NO: 2501841 - protein, 19 aa, Entamoeba dispar
RAELLRRIRKNNGSLSIES

SEQ ID NO: 2501842 - protein, 17 aa, Entamoeba dispar
RAERLKIIVLHHPPFNE

SEQ ID NO: 2501843 - protein, 19 aa, Entamoeba dispar
RAFACIRKQGSLFIYLFRL

SEQ ID NO: 2501844 - protein, 19 aa, Entamoeba dispar
RAFKSKHLPFITVFQDPTF

SEQ ID NO: 2501845 - protein, 20 aa, Entamoeba dispar
RAFSKTVLPLVEYIQTSMRP

SEQ ID NO: 2501846 - protein, 23 aa, Entamoeba dispar
RAGRFDREIAMGIPSEAQRKQIL

SEQ ID NO: 2501847 - protein, 17 aa, Entamoeba dispar
RAGRSGLCIVFVEKEDK

SEQ ID NO: 2501848 - protein, 27 aa, Entamoeba dispar
RAGRTRPGQCYRLYTEKGFNESLPKQT

SEQ ID NO: 2501849 - protein, 21 aa, Entamoeba dispar
RAHIYWRILFNHPQQTYDIML

SEQ ID NO: 2501850 - protein, 22 aa, Entamoeba dispar
RAIEWCFQAIAFKELPKDHVKF

SEQ ID NO: 2501851 - protein, 18 aa, Entamoeba dispar
RAKEWYNKAITLSENIER

SEQ ID NO: 2501852 - protein, 18 aa, Entamoeba dispar
RAKGIQILLEIIKIEKKN

SEQ ID NO: 2501853 - protein, 19 aa, Entamoeba dispar
RAKIWKLLLRYYTAEQKTW

SEQ ID NO: 2501854 - protein, 17 aa, Entamoeba dispar
RAKMIKWNLGKLPNQLT

SEQ ID NO: 2501855 - protein, 18 aa, Entamoeba dispar
RAKTNLTRICNLLNQESD

SEQ ID NO: 2501856 - protein, 17 aa, Entamoeba dispar
RALELCLLQINNHCNSF

SEQ ID NO: 2501857 - protein, 18 aa, Entamoeba dispar
RALFEAWSDTNLLRKNNL

SEQ ID NO: 2501858 - protein, 18 aa, Entamoeba dispar
RALIKVNHTKGLIKLIPK

SEQ ID NO: 2501859 - protein, 20 aa, Entamoeba dispar
RALKMLDIFHEIKKYVIIKV

SEQ ID NO: 2501860 - protein, 19 aa, Entamoeba dispar
RALLCKKVLEEILKDPSKF

SEQ ID NO: 2501861 - protein, 20 aa, Entamoeba dispar
RALLDVIEMLEGYHLSHSRK

SEQ ID NO: 2501862 - protein, 19 aa, Entamoeba dispar
RALLRTCNKFGEFRKDDPS

SEQ ID NO: 2501863 - protein, 22 aa, Entamoeba dispar
RALYRKCTKKIIKILLNQNGGV

SEQ ID NO: 2501864 - protein, 20 aa, Entamoeba dispar
RAMCVPDPVKVILTNVPDDY

SEQ ID NO: 2501865 - protein, 28 aa, Entamoeba dispar
RAMWLKYFDERGIRVIFYSALKENKLAE

SEQ ID NO: 2501866 - protein, 30 aa, Entamoeba dispar
RANAELLISYYNTRIEVLKTNIEMIRNRLQ

SEQ ID NO: 2501867 - protein, 24 aa, Entamoeba dispar
RANALKWIIQLLLHDCPITEKIRI

SEQ ID NO: 2501868 - protein, 20 aa, Entamoeba dispar
RANALKWVVDLIIHSRSLLR

SEQ ID NO: 2501869 - protein, 19 aa, Entamoeba dispar
RANNLVIRRQFNLSNQSNW

SEQ ID NO: 2501870 - protein, 19 aa, Entamoeba dispar
RANRQFELISLSTCLNEPI

SEQ ID NO: 2501871 - protein, 20 aa, Entamoeba dispar
RANRYKGELEDIRIEWESKR

SEQ ID NO: 2501872 - protein, 26 aa, Entamoeba dispar
RAPIKCSHCGAIINPYCSVDYNSNLW

SEQ ID NO: 2501873 - protein, 17 aa, Entamoeba dispar
RAPNVVQIIKGVVGEEV

SEQ ID NO: 2501874 - protein, 21 aa, Entamoeba dispar
RAPSLLKELRHTIGNKLIDIF

SEQ ID NO: 2501875 - protein, 22 aa, Entamoeba dispar
RAQDVPLIKGWYLEHVQKNYPV

SEQ ID NO: 2501876 - protein, 21 aa, Entamoeba dispar
RAQFIPVCLNNSYEMFEIGLR

SEQ ID NO: 2501877 - protein, 21 aa, Entamoeba dispar
RAQILSMDYLHSAIQPNITTT

SEQ ID NO: 2501878 - protein, 17 aa, Entamoeba dispar
RARFEEINIDLFKSTIG

SEQ ID NO: 2501879 - protein, 21 aa, Entamoeba dispar
RARMWECFTHATSTKAVHEEY

SEQ ID NO: 2501880 - protein, 29 aa, Entamoeba dispar
RASEATVLYEFLTNFARQMMQKVVSLHFD

SEQ ID NO: 2501881 - protein, 26 aa, Entamoeba dispar
RASFKFGTPCNYPTQSEWRGWKHVTY

SEQ ID NO: 2501882 - protein, 17 aa, Entamoeba dispar
RASGIRFYEHICPGSKT

SEQ ID NO: 2501883 - protein, 21 aa, Entamoeba dispar
RASLILTCSLNFPVLPTPLTK

SEQ ID NO: 2501884 - protein, 18 aa, Entamoeba dispar
RASLYDFLLRCFVYNPKD

SEQ ID NO: 2501885 - protein, 29 aa, Entamoeba dispar
RASSRELLKHKWFITNGIKVVEEVKKTNM

SEQ ID NO: 2501886 - protein, 17 aa, Entamoeba dispar
RATEIYDSFYFNQQPMT

SEQ ID NO: 2501887 - protein, 25 aa, Entamoeba dispar
RATEKDLRLSLQYNPEDNILGPQKT

SEQ ID NO: 2501888 - protein, 20 aa, Entamoeba dispar
RATFCYAATVALNYSLTCGI

SEQ ID NO: 2501889 - protein, 26 aa, Entamoeba dispar
RATLQYRAKTFLPYYIQPLLNLIPVD

SEQ ID NO: 2501890 - protein, 26 aa, Entamoeba dispar
RATSYFPFSGVHGVFLVYRNDDDMSF

SEQ ID NO: 2501891 - protein, 21 aa, Entamoeba dispar
RAVKEDKFFEDEEVKKYLAER

SEQ ID NO: 2501892 - protein, 30 aa, Entamoeba dispar
RAVYICGDKGYMPAALLLGFTMQKHYLSEY

SEQ ID NO: 2501893 - protein, 31 aa, Entamoeba dispar
RAVYICGDKGYMPAALLLGFTMQKHYLSEYE

SEQ ID NO: 2501894 - protein, 21 aa, Entamoeba dispar
RAVYIRIVFQQTFTSLEVKKV

SEQ ID NO: 2501895 - protein, 21 aa, Entamoeba dispar
RAWKTVLEMLRDRGYITSEED

SEQ ID NO: 2501896 - protein, 23 aa, Entamoeba dispar
RAWRKDHPPGFIARPIMKKGQPD

SEQ ID NO: 2501897 - protein, 18 aa, Entamoeba dispar
RAYHVLRQNASLIVSFFT

SEQ ID NO: 2501898 - protein, 19 aa, Entamoeba dispar
RAYIKAPIFKGVLTQMQYQ

SEQ ID NO: 2501899 - protein, 18 aa, Entamoeba dispar
RCAEDNYQACMQRDEAIQ

SEQ ID NO: 2501900 - protein, 20 aa, Entamoeba dispar
RCAKMRFGPLSPNALTKIVE

SEQ ID NO: 2501901 - protein, 25 aa, Entamoeba dispar
RCAQGDKYRMGNLFIVGPTKTGKTE

SEQ ID NO: 2501902 - protein, 19 aa, Entamoeba dispar
RCEQIVCLMKRCPPLNNLH

SEQ ID NO: 2501903 - protein, 23 aa, Entamoeba dispar
RCGHKFCLTCWNEYLSMNGTLSY

SEQ ID NO: 2501904 - protein, 24 aa, Entamoeba dispar
RCGLNCNNLCYSRNDFLLLNKIYS

SEQ ID NO: 2501905 - protein, 17 aa, Entamoeba dispar
RCHFNISDIISRPPINL

SEQ ID NO: 2501906 - protein, 20 aa, Entamoeba dispar
RCICTGRCIYYSKKDLIIPS

SEQ ID NO: 2501907 - protein, 17 aa, Entamoeba dispar
RCIEIPESVVFNNKENE

SEQ ID NO: 2501908 - protein, 20 aa, Entamoeba dispar
RCIEIPESVVFNNKENEYEK

SEQ ID NO: 2501909 - protein, 17 aa, Entamoeba dispar
RCIEIPESVVLNNKENK

SEQ ID NO: 2501910 - protein, 22 aa, Entamoeba dispar
RCIEMVTKIFLGSHIIILEKNK

SEQ ID NO: 2501911 - protein, 17 aa, Entamoeba dispar
RCIICNKFSDRKKCLLC

SEQ ID NO: 2501912 - protein, 26 aa, Entamoeba dispar
RCKGKSKEEAICLVSKEAVVVITQER

SEQ ID NO: 2501913 - protein, 21 aa, Entamoeba dispar
RCLLCKEIQDAFVQLVKTISK

SEQ ID NO: 2501914 - protein, 23 aa, Entamoeba dispar
RCNPKFDFSSIITKRALTSPSTP

SEQ ID NO: 2501915 - protein, 17 aa, Entamoeba dispar
RCPRLCEFLEHFNAVTN

SEQ ID NO: 2501916 - protein, 20 aa, Entamoeba dispar
RCQDRISFDISIGIPSETAK

SEQ ID NO: 2501917 - protein, 18 aa, Entamoeba dispar
RCSEELFNDLGINKTPTQ

SEQ ID NO: 2501918 - protein, 17 aa, Entamoeba dispar
RCSGRKLVRQKLVKTLP

SEQ ID NO: 2501919 - protein, 22 aa, Entamoeba dispar
RCSSLRCLSRLMTPQITPSIER

SEQ ID NO: 2501920 - protein, 19 aa, Entamoeba dispar
RCSSMFDTLNRWLYSSSGL

SEQ ID NO: 2501921 - protein, 20 aa, Entamoeba dispar
RCSSMFDTLNRWLYSSSGLT

SEQ ID NO: 2501922 - protein, 21 aa, Entamoeba dispar
RCTEDSYHLISLKVLSTVFQW

SEQ ID NO: 2501923 - protein, 21 aa, Entamoeba dispar
RCVDDFIFFCFLVGNDFLPRI

SEQ ID NO: 2501924 - protein, 20 aa, Entamoeba dispar
RCVGFNVGIEEFWRRYDDEE

SEQ ID NO: 2501925 - protein, 20 aa, Entamoeba dispar
RCYLPEGFFHPNVFPNGQIC

SEQ ID NO: 2501926 - protein, 26 aa, Entamoeba dispar
RDAIPQVVFNLCWWIYTYGYLVEGIF

SEQ ID NO: 2501927 - protein, 24 aa, Entamoeba dispar
RDCGYKLIVTLGFDNVNSVTEMNE

SEQ ID NO: 2501928 - protein, 17 aa, Entamoeba dispar
RDCMISHGVSSLLKERL

SEQ ID NO: 2501929 - protein, 27 aa, Entamoeba dispar
RDCWDAEIRLSYGWVECVGHADRGDFD

SEQ ID NO: 2501930 - protein, 21 aa, Entamoeba dispar
RDDLAIVFALFSVDPTNFKIP

SEQ ID NO: 2501931 - protein, 25 aa, Entamoeba dispar
RDEAAKLCKYCCQYSITPYNTPIKD

SEQ ID NO: 2501932 - protein, 25 aa, Entamoeba dispar
RDEIKDLRLDIVDLKGELESKEQEV

SEQ ID NO: 2501933 - protein, 18 aa, Entamoeba dispar
RDEILGGKTIEFSPYDSG

SEQ ID NO: 2501934 - protein, 19 aa, Entamoeba dispar
RDELIEMGKLTLRLMEQHQ

SEQ ID NO: 2501935 - protein, 20 aa, Entamoeba dispar
RDELIEMGKLTLRLMEQHQT

SEQ ID NO: 2501936 - protein, 25 aa, Entamoeba dispar
RDELRVPYWKLVYSLADKLRFNAFS

SEQ ID NO: 2501937 - protein, 23 aa, Entamoeba dispar
RDEMWKLGVPVCTIHNEVAPAQY

SEQ ID NO: 2501938 - protein, 19 aa, Entamoeba dispar
RDEVFKYLNKVQIKSLYNK

SEQ ID NO: 2501939 - protein, 18 aa, Entamoeba dispar
RDEYSIRKDVNMLLVTYN

SEQ ID NO: 2501940 - protein, 21 aa, Entamoeba dispar
RDFTKTTGFYGPHFRMPPSYQ

SEQ ID NO: 2501941 - protein, 27 aa, Entamoeba dispar
RDFTTNRVEGFFGHLKKIIKHSQVPFY

SEQ ID NO: 2501942 - protein, 20 aa, Entamoeba dispar
RDFVLRKLINGERMAMFSPT

SEQ ID NO: 2501943 - protein, 40 aa, Entamoeba dispar
RDGEKCVELCPTFAKGYSRLSAALMKMGKLQEAKEAIDKA

SEQ ID NO: 2501944 - protein, 25 aa, Entamoeba dispar
RDGEPADCILYYNYRDKYTYERFFE

SEQ ID NO: 2501945 - protein, 19 aa, Entamoeba dispar
RDGLKWLELFEDELIKRIK

SEQ ID NO: 2501946 - protein, 17 aa, Entamoeba dispar
RDGLPGKLDHSTIIVYS

SEQ ID NO: 2501947 - protein, 19 aa, Entamoeba dispar
RDGLSKKGVQNSIKNKSNV

SEQ ID NO: 2501948 - protein, 17 aa, Entamoeba dispar
RDGNLLCLILLLQTFPS

SEQ ID NO: 2501949 - protein, 18 aa, Entamoeba dispar
RDHQPCVIFMDEIDAIAG

SEQ ID NO: 2501950 - protein, 19 aa, Entamoeba dispar
RDIAQLMVIAVSKAIKDTS

SEQ ID NO: 2501951 - protein, 20 aa, Entamoeba dispar
RDIFKKEANLLIVHAPVVII

SEQ ID NO: 2501952 - protein, 20 aa, Entamoeba dispar
RDIFLPFGMPMVVQSHKIHI

SEQ ID NO: 2501953 - protein, 21 aa, Entamoeba dispar
RDIGKRCEFDVQIYVYSIKFG

SEQ ID NO: 2501954 - protein, 19 aa, Entamoeba dispar
RDIHHPAILGMAGIVLSSS

SEQ ID NO: 2501955 - protein, 25 aa, Entamoeba dispar
RDIIQVCLKICKFIAQNDLMKNVDI

SEQ ID NO: 2501956 - protein, 22 aa, Entamoeba dispar
RDIKEKLCYVAEDFNEEMQKAA

SEQ ID NO: 2501957 - protein, 18 aa, Entamoeba dispar
RDIKLLIRKYNFFNYNIK

SEQ ID NO: 2501958 - protein, 19 aa, Entamoeba dispar
RDIMSYKKGYNCISYPSVM

SEQ ID NO: 2501959 - protein, 25 aa, Entamoeba dispar
RDIPKAFSKFLARNTFYFGSNEQLM

SEQ ID NO: 2501960 - protein, 18 aa, Entamoeba dispar
RDIPTLCSSIIIKNGSFE

SEQ ID NO: 2501961 - protein, 21 aa, Entamoeba dispar
RDIRKYQCCEQAILIGVLNLY

SEQ ID NO: 2501962 - protein, 21 aa, Entamoeba dispar
RDIRRIVCETILNSFEDEYEE

SEQ ID NO: 2501963 - protein, 19 aa, Entamoeba dispar
RDIVKIISDVFQFKDFWKH

SEQ ID NO: 2501964 - protein, 18 aa, Entamoeba dispar
RDIVKSVFRELFYNYTLS

SEQ ID NO: 2501965 - protein, 24 aa, Entamoeba dispar
RDIYLEFCSIKGISYVSVDEPLKE

SEQ ID NO: 2501966 - protein, 23 aa, Entamoeba dispar
RDKDSVFNDFGFESEDEKENKQP

SEQ ID NO: 2501967 - protein, 17 aa, Entamoeba dispar
RDKGLYGFIKSPRSSST

SEQ ID NO: 2501968 - protein, 17 aa, Entamoeba dispar
RDKNVFIASFRSPLRKA

SEQ ID NO: 2501969 - protein, 23 aa, Entamoeba dispar
RDKQGFAGFIIEITQYVQNHTKK

SEQ ID NO: 2501970 - protein, 23 aa, Entamoeba dispar
RDKSLECVRWLQEYLQLPLEIIS

SEQ ID NO: 2501971 - protein, 18 aa, Entamoeba dispar
RDKVYWKESIIFTQTGVL

SEQ ID NO: 2501972 - protein, 17 aa, Entamoeba dispar
RDKYCSLDGSFFIQNTL

SEQ ID NO: 2501973 - protein, 25 aa, Entamoeba dispar
RDLDVDYLLVVFGGYLGYSSDDINK

SEQ ID NO: 2501974 - protein, 20 aa, Entamoeba dispar
RDLFSLLTEIVLKYSEQLDN

SEQ ID NO: 2501975 - protein, 24 aa, Entamoeba dispar
RDLGDKKKTCLFSHRLDAENYNKK

SEQ ID NO: 2501976 - protein, 23 aa, Entamoeba dispar
RDLKCQYLDLYLIHWPIALKVGT

SEQ ID NO: 2501977 - protein, 21 aa, Entamoeba dispar
RDLQFPSKELIQLLDKENEEY

SEQ ID NO: 2501978 - protein, 18 aa, Entamoeba dispar
RDLTVPWTLIGNKIDLKE

SEQ ID NO: 2501979 - protein, 17 aa, Entamoeba dispar
RDLVSSLGMSGGSQIHI

SEQ ID NO: 2501980 - protein, 19 aa, Entamoeba dispar
RDMSAAINLIADIQEEVGK

SEQ ID NO: 2501981 - protein, 18 aa, Entamoeba dispar
RDNCFRNCSSLTSIIIPS

SEQ ID NO: 2501982 - protein, 21 aa, Entamoeba dispar
RDNGCAYIECYNPLTQNTEGF

SEQ ID NO: 2501983 - protein, 25 aa, Entamoeba dispar
RDNLLKRKYYDSFLFNSFSDELAKS

SEQ ID NO: 2501984 - protein, 17 aa, Entamoeba dispar
RDNRSSFDINNFQYIKS

SEQ ID NO: 2501985 - protein, 20 aa, Entamoeba dispar
RDNVHIINNWTGLRCKEILI

SEQ ID NO: 2501986 - protein, 28 aa, Entamoeba dispar
RDNVTILCYQRLLTLQFIIIFNNKGIHR

SEQ ID NO: 2501987 - protein, 17 aa, Entamoeba dispar
RDPIIYCTKKGMRSYTI

SEQ ID NO: 2501988 - protein, 21 aa, Entamoeba dispar
  misc_feature (16)..(17): Xaa can be any naturally occurring amino acid
RDPVHLFNYFHAVCFXXRLTN

SEQ ID NO: 2501989 - protein, 24 aa, Entamoeba dispar
RDQCAKGIIWALLTIKGVIQNEPD

SEQ ID NO: 2501990 - protein, 25 aa, Entamoeba dispar
RDQLNGLIIECIGLMGMHTVDDINE

SEQ ID NO: 2501991 - protein, 19 aa, Entamoeba dispar
RDRERLLRRFLFAENNEHC

SEQ ID NO: 2501992 - protein, 22 aa, Entamoeba dispar
RDRQLRIGRFHQHHVDQLPMNI

SEQ ID NO: 2501993 - protein, 19 aa, Entamoeba dispar
RDRRSSCAEITLKVSKHGG

SEQ ID NO: 2501994 - protein, 25 aa, Entamoeba dispar
RDSFSRLKDLPIRRDFDYSRSYEPY

SEQ ID NO: 2501995 - protein, 18 aa, Entamoeba dispar
RDSIPLKVSCHTYNIDQN

SEQ ID NO: 2501996 - protein, 17 aa, Entamoeba dispar
RDTFVSIHEPKTLNTVM

SEQ ID NO: 2501997 - protein, 20 aa, Entamoeba dispar
RDTLFNKCVEFAKMSDWPHR

SEQ ID NO: 2501998 - protein, 21 aa, Entamoeba dispar
RDTRSRRVLVTKLYSVQPSDG

SEQ ID NO: 2501999 - protein, 29 aa, Entamoeba dispar
RDVGCIKTFFWKRFGFGTEEVITLKDIEQ

SEQ ID NO: 2502000 - protein, 24 aa, Entamoeba dispar
RDVIVPFIFCENLEIVAKSQIILA

SEQ ID NO: 2502001 - protein, 23 aa, Entamoeba dispar
RDVKLERPSFVLDPTVNEKLKKL

SEQ ID NO: 2502002 - protein, 17 aa, Entamoeba dispar
RDVKPENILICADGYIR

SEQ ID NO: 2502003 - protein, 18 aa, Entamoeba dispar
RDVLEKSGVLIFKDSSAN

SEQ ID NO: 2502004 - protein, 19 aa, Entamoeba dispar
RDVMLCVSSSLAYLHSKGY

SEQ ID NO: 2502005 - protein, 17 aa, Entamoeba dispar
RDVMLSLCVYLSRCQKF

SEQ ID NO: 2502006 - protein, 27 aa, Entamoeba dispar
RDVPLSGICLYFDCTFLKKSYLTTKPD

SEQ ID NO: 2502007 - protein, 27 aa, Entamoeba dispar
RDVRVAYEATRILCNLIILNSDYANTI

SEQ ID NO: 2502008 - protein, 17 aa, Entamoeba dispar
RDYEVDFLKLISEVTSG

SEQ ID NO: 2502009 - protein, 26 aa, Entamoeba dispar
RDYQVCVQCTLIALLNEQYSFLIQRP

SEQ ID NO: 2502010 - protein, 17 aa, Entamoeba dispar
REACFKTLLDITLHYGV

SEQ ID NO: 2502011 - protein, 20 aa, Entamoeba dispar
REAEQFKKHVEEVLRQEKEM

SEQ ID NO: 2502012 - protein, 18 aa, Entamoeba dispar
RECFSWCGSLQSITIPSS

SEQ ID NO: 2502013 - protein, 23 aa, Entamoeba dispar
RECLLDLLQRILVYDPKERLTPN

SEQ ID NO: 2502014 - protein, 18 aa, Entamoeba dispar
REEALKFKIGDSGRGEET

SEQ ID NO: 2502015 - protein, 22 aa, Entamoeba dispar
REEEMKRKQELIGEQFEISQEE

SEQ ID NO: 2502016 - protein, 23 aa, Entamoeba dispar
REEGRRLRGRWEVTNERIKNYIK

SEQ ID NO: 2502017 - protein, 17 aa, Entamoeba dispar
REEHPIVETCKTYQQLF

SEQ ID NO: 2502018 - protein, 26 aa, Entamoeba dispar
REEKKQKVHIALRLPNGEIKKEYFEK

SEQ ID NO: 2502019 - protein, 23 aa, Entamoeba dispar
REEMADLIKIWPGISPIQVIGLL

SEQ ID NO: 2502020 - protein, 18 aa, Entamoeba dispar
REEMKLCELFGDCIEELN

SEQ ID NO: 2502021 - protein, 18 aa, Entamoeba dispar
REEWGEFDLIVVSNVSFE

SEQ ID NO: 2502022 - protein, 24 aa, Entamoeba dispar
REEYGEIMDVFYKRSFEREHHRRM

SEQ ID NO: 2502023 - protein, 19 aa, Entamoeba dispar
REFNEWNTTIGKDLSQIDI

SEQ ID NO: 2502024 - protein, 21 aa, Entamoeba dispar
REFSHPEFALYYLFNKNTYCI

SEQ ID NO: 2502025 - protein, 19 aa, Entamoeba dispar
REFYELKNAQEGMWIALLL

SEQ ID NO: 2502026 - protein, 23 aa, Entamoeba dispar
REFYGNPPLREWRNLNVVEINSG

SEQ ID NO: 2502027 - protein, 17 aa, Entamoeba dispar
REFYHQFILSRSPENVW

SEQ ID NO: 2502028 - protein, 23 aa, Entamoeba dispar
REGCDMKQLITFLKGRSNRKLIE

SEQ ID NO: 2502029 - protein, 22 aa, Entamoeba dispar
REGKKYIGEYIWLKNKEVLEMT

SEQ ID NO: 2502030 - protein, 19 aa, Entamoeba dispar
REGLPMSLLAGMKCSFDYS

SEQ ID NO: 2502031 - protein, 24 aa, Entamoeba dispar
REGNIIRMFLFRWKNGQHYINNEK

SEQ ID NO: 2502032 - protein, 20 aa, Entamoeba dispar
REGQFLKKFIVNSDGLNSIN

SEQ ID NO: 2502033 - protein, 21 aa, Entamoeba dispar
REGRLSIDCALELVRKAKKLL

SEQ ID NO: 2502034 - protein, 20 aa, Entamoeba dispar
REGSRYGPFTDRGMTPDDSG

SEQ ID NO: 2502035 - protein, 21 aa, Entamoeba dispar
REHLLPGDWFGLFKKSSMSQK

SEQ ID NO: 2502036 - protein, 21 aa, Entamoeba dispar
REHPDYYLSSVLHSFGGCCPP

SEQ ID NO: 2502037 - protein, 21 aa, Entamoeba dispar
REHSKFPGIYIASGKEEQLLT

SEQ ID NO: 2502038 - protein, 17 aa, Entamoeba dispar
REIAKLNYLNGLKKKYK

SEQ ID NO: 2502039 - protein, 18 aa, Entamoeba dispar
REIELIKILIHPNIVETI

SEQ ID NO: 2502040 - protein, 25 aa, Entamoeba dispar
REIFQPKVVRRKDRVSDDMMRIIKN

SEQ ID NO: 2502041 - protein, 18 aa, Entamoeba dispar
REIGFLAALLYSVTRETN

SEQ ID NO: 2502042 - protein, 19 aa, Entamoeba dispar
REIIEKKEVYGIIISPTRE

SEQ ID NO: 2502043 - protein, 23 aa, Entamoeba dispar
REIIKTIPKFWYFTLKNSGYLDI

SEQ ID NO: 2502044 - protein, 20 aa, Entamoeba dispar
REIIPNYIILVDDQLIKLNR

SEQ ID NO: 2502045 - protein, 22 aa, Entamoeba dispar
REIKLRKAFEVFDQDKDGKIKA

SEQ ID NO: 2502046 - protein, 34 aa, Entamoeba dispar
REIKMKTAQQYFDLHYSKQCHFVGMKPKEQNVDI

SEQ ID NO: 2502047 - protein, 27 aa, Entamoeba dispar
REILLLPCRHITMCAGCYEEVKERTHQ

SEQ ID NO: 2502048 - protein, 30 aa, Entamoeba dispar
REIMAMWFNLPDRMIWKQCQEEYSVEERKA

SEQ ID NO: 2502049 - protein, 17 aa, Entamoeba dispar
REIPPFCFDRCGLKQLD

SEQ ID NO: 2502050 - protein, 17 aa, Entamoeba dispar
REIPTYALWNAFVSSGF

SEQ ID NO: 2502051 - protein, 21 aa, Entamoeba dispar
REISKVFLVGGSSYIPAVENL

SEQ ID NO: 2502052 - protein, 26 aa, Entamoeba dispar
REISSLLKLRHPFIIKLISVENKVDS

SEQ ID NO: 2502053 - protein, 17 aa, Entamoeba dispar
REITALCEPPCIPFLGS

SEQ ID NO: 2502054 - protein, 19 aa, Entamoeba dispar
REIVSFQSLCEEFLQIGFS

SEQ ID NO: 2502055 - protein, 18 aa, Entamoeba dispar
REKDALIKQIKEYDSIKA

SEQ ID NO: 2502056 - protein, 19 aa, Entamoeba dispar
REKEKRRSSEISIKKEKKN

SEQ ID NO: 2502057 - protein, 23 aa, Entamoeba dispar
REKEKRRSSEISIKKEKKNIEVT

SEQ ID NO: 2502058 - protein, 18 aa, Entamoeba dispar
REKIMLVRIKSGDVQYIA

SEQ ID NO: 2502059 - protein, 26 aa, Entamoeba dispar
REKIPSELLFFFDYYIDKHVEKGIAE

SEQ ID NO: 2502060 - protein, 24 aa, Entamoeba dispar
REKLMKYRDVVVIGTDLLFDTTTF

SEQ ID NO: 2502061 - protein, 20 aa, Entamoeba dispar
REKRIPYRGKVSYTEWKQIN

SEQ ID NO: 2502062 - protein, 23 aa, Entamoeba dispar
REKRSKMIWTYDIFQTLRRMKLY

SEQ ID NO: 2502063 - protein, 18 aa, Entamoeba dispar
REKYNLGTELVIDKKLLK

SEQ ID NO: 2502064 - protein, 21 aa, Entamoeba dispar
RELCREFGIPDTLRLEIWKLF

SEQ ID NO: 2502065 - protein, 23 aa, Entamoeba dispar
RELDASGIGIRWHQSLDPGLVDS

SEQ ID NO: 2502066 - protein, 18 aa, Entamoeba dispar
RELENLRLQEQLRKQKEE

SEQ ID NO: 2502067 - protein, 17 aa, Entamoeba dispar
RELEVWQEQLFQLKSTI

SEQ ID NO: 2502068 - protein, 21 aa, Entamoeba dispar
RELEVWQEQLFQLKSTIEKKE

SEQ ID NO: 2502069 - protein, 23 aa, Entamoeba dispar
RELFGYLSCKLLQPYLNLKELKH

SEQ ID NO: 2502070 - protein, 22 aa, Entamoeba dispar
RELGKGCFNGCGSLKEINIPTS

SEQ ID NO: 2502071 - protein, 21 aa, Entamoeba dispar
RELGTKIKLIEMVKNEKDIME

SEQ ID NO: 2502072 - protein, 22 aa, Entamoeba dispar
RELKEVVQYPVEFPDKFRKFGM

SEQ ID NO: 2502073 - protein, 24 aa, Entamoeba dispar
RELKKIAMKGVVQLFNAIAEHQHK

SEQ ID NO: 2502074 - protein, 26 aa, Entamoeba dispar
RELKKNIFTLIPFLGNSVLNIFYNIP

SEQ ID NO: 2502075 - protein, 27 aa, Entamoeba dispar
RELKLIEPLLCPISFDGDISISISHKV

SEQ ID NO: 2502076 - protein, 24 aa, Entamoeba dispar
RELKMPVFIAHGLNDTIIHVSHAT

SEQ ID NO: 2502077 - protein, 25 aa, Entamoeba dispar
RELLEKGKNCFFEIVKSYRKMIRTI

SEQ ID NO: 2502078 - protein, 18 aa, Entamoeba dispar
RELLKPGTSVAHHKQSNA

SEQ ID NO: 2502079 - protein, 18 aa, Entamoeba dispar
RELLKSMIELCGGIYMED

SEQ ID NO: 2502080 - protein, 17 aa, Entamoeba dispar
RELLVFMASAKPINCTT

SEQ ID NO: 2502081 - protein, 24 aa, Entamoeba dispar
RELNGKYIGTRPCKLSKGKWEKRS

SEQ ID NO: 2502082 - protein, 27 aa, Entamoeba dispar
RELNLRLEVLKHFNFVDEHNLLTLKGK

SEQ ID NO: 2502083 - protein, 23 aa, Entamoeba dispar
RELVYKLSFICNCIQQSEKSVNN

SEQ ID NO: 2502084 - protein, 21 aa, Entamoeba dispar
REMAHRASLKFMKYTGCTAVA

SEQ ID NO: 2502085 - protein, 25 aa, Entamoeba dispar
REMHKPISCLEFMKWNDLVTNDSES

SEQ ID NO: 2502086 - protein, 17 aa, Entamoeba dispar
REMIKLIFIAMRGNDYY

SEQ ID NO: 2502087 - protein, 33 aa, Entamoeba dispar
REMLYCAHSGFISHLLCCPRLDDWTEVCICVIH

SEQ ID NO: 2502088 - protein, 24 aa, Entamoeba dispar
REMPEYLDELIIYCHSRDEIVEEA

SEQ ID NO: 2502089 - protein, 23 aa, Entamoeba dispar
REMSLDYYNDVVGFRRSLRKKEE

SEQ ID NO: 2502090 - protein, 20 aa, Entamoeba dispar
REMSNAVLYSSLANCKTETV

SEQ ID NO: 2502091 - protein, 19 aa, Entamoeba dispar
RENCIREIILSTLSLKKKV

SEQ ID NO: 2502092 - protein, 25 aa, Entamoeba dispar
RENCRCFECGTANPTWASVTYGIFL

SEQ ID NO: 2502093 - protein, 17 aa, Entamoeba dispar
RENGEFLKSSSYVESSH

SEQ ID NO: 2502094 - protein, 20 aa, Entamoeba dispar
RENLLKCTIVRIMKHSKIMS

SEQ ID NO: 2502095 - protein, 25 aa, Entamoeba dispar
RENPDVKISYGLVKKVLEQQALLPA

SEQ ID NO: 2502096 - protein, 17 aa, Entamoeba dispar
RENQALFVNCLIGLLIS

SEQ ID NO: 2502097 - protein, 17 aa, Entamoeba dispar
RENVHLLNLPFYQTGKT

SEQ ID NO: 2502098 - protein, 17 aa, Entamoeba dispar
RENVNVFLYVKGNPDIY

SEQ ID NO: 2502099 - protein, 27 aa, Entamoeba dispar
REPIGNIKSAILLYWNVRARYEHDIGL

SEQ ID NO: 2502100 - protein, 23 aa, Entamoeba dispar
REPKYREIFLLMYRLYTSPECVI

SEQ ID NO: 2502101 - protein, 23 aa, Entamoeba dispar
REPKYVCGQPRKLTVPTNSDIDM

SEQ ID NO: 2502102 - protein, 17 aa, Entamoeba dispar
REPLLFKQLFSDWVEPI

SEQ ID NO: 2502103 - protein, 21 aa, Entamoeba dispar
REPPGAGLFCDLLWSDPIDES

SEQ ID NO: 2502104 - protein, 17 aa, Entamoeba dispar
REQEINHIITILNSMGE

SEQ ID NO: 2502105 - protein, 18 aa, Entamoeba dispar
REQIKGWLQTEIKNKNQL

SEQ ID NO: 2502106 - protein, 20 aa, Entamoeba dispar
REQLLVIGLMPVNKMFKEKK

SEQ ID NO: 2502107 - protein, 19 aa, Entamoeba dispar
REQPQIIEPFLQHIESENP

SEQ ID NO: 2502108 - protein, 17 aa, Entamoeba dispar
REQTIKFTIQINEKGVM

SEQ ID NO: 2502109 - protein, 21 aa, Entamoeba dispar
REQWSTLIYRDFFQHGFDGSG

SEQ ID NO: 2502110 - protein, 18 aa, Entamoeba dispar
REQYAVCLAFMIDGDIKV

SEQ ID NO: 2502111 - protein, 21 aa, Entamoeba dispar
RERAKEMFDSRTCIDINKTFR

SEQ ID NO: 2502112 - protein, 19 aa, Entamoeba dispar
RERIIKLKNRIEGIQEITE

SEQ ID NO: 2502113 - protein, 17 aa, Entamoeba dispar
RERIKAQIEGLRISLNN

SEQ ID NO: 2502114 - protein, 21 aa, Entamoeba dispar
RERRGRKRNNRIIKGKNKKKN

SEQ ID NO: 2502115 - protein, 25 aa, Entamoeba dispar
RERYRPSYYSPRRSRSISPRDFHRD

SEQ ID NO: 2502116 - protein, 23 aa, Entamoeba dispar
RESAFNSFLSWILIEKGIKLMCR

SEQ ID NO: 2502117 - protein, 22 aa, Entamoeba dispar
RESCFDECRFKWIKIPISVTRI

SEQ ID NO: 2502118 - protein, 18 aa, Entamoeba dispar
RESIIWNSVEGIKGEEDS

SEQ ID NO: 2502119 - protein, 25 aa, Entamoeba dispar
RESLDLLKLRYGKELTQDDIQLLVR

SEQ ID NO: 2502120 - protein, 18 aa, Entamoeba dispar
RESLSRSVSRSSSNIDFV

SEQ ID NO: 2502121 - protein, 30 aa, Entamoeba dispar
RESNEFKILYTRNQKYIFAFEKTYRSDQRK

SEQ ID NO: 2502122 - protein, 21 aa, Entamoeba dispar
RESRENSGMIMSAMGGKTNVR

SEQ ID NO: 2502123 - protein, 23 aa, Entamoeba dispar
RETEIQLSIVLLLFKTMKLKEEQ

SEQ ID NO: 2502124 - protein, 25 aa, Entamoeba dispar
RETIEACGLFSAVFTVTVGDITKDL

SEQ ID NO: 2502125 - protein, 26 aa, Entamoeba dispar
RETKKSKGCAFVSFKTPLEAQKCFSN

SEQ ID NO: 2502126 - protein, 28 aa, Entamoeba dispar
RETKKSKGCGFVKFVYRDDAVSCYNYHK

SEQ ID NO: 2502127 - protein, 18 aa, Entamoeba dispar
RETLNSMMLFNSKQDAEV

SEQ ID NO: 2502128 - protein, 22 aa, Entamoeba dispar
RETLRALNFIHGLHCIHRDIKS

SEQ ID NO: 2502129 - protein, 19 aa, Entamoeba dispar
RETMVLIKEAFLSRRMMEQ

SEQ ID NO: 2502130 - protein, 25 aa, Entamoeba dispar
RETVEACGLFSAVFTVTVGDIAEDL

SEQ ID NO: 2502131 - protein, 19 aa, Entamoeba dispar
REVCKNRGFYKLKSEIKKS

SEQ ID NO: 2502132 - protein, 30 aa, Entamoeba dispar
REVSRSVGMIACASFKKTAIQFGTRMAKLL

SEQ ID NO: 2502133 - protein, 20 aa, Entamoeba dispar
REVVVPVIKIDSGINDPNRR

SEQ ID NO: 2502134 - protein, 20 aa, Entamoeba dispar
REVYLIKELEKIAPKEKGIV

SEQ ID NO: 2502135 - protein, 21 aa, Entamoeba dispar
REVYRLVSGIFIKEFHEKNEC

SEQ ID NO: 2502136 - protein, 20 aa, Entamoeba dispar
REYFSYKTLEDIAMKVTFRV

SEQ ID NO: 2502137 - protein, 17 aa, Entamoeba dispar
REYHIEGVLSIGTKPLY

SEQ ID NO: 2502138 - protein, 23 aa, Entamoeba dispar
REYIKSGSLLKICRKDNKERYFY

SEQ ID NO: 2502139 - protein, 20 aa, Entamoeba dispar
REYKMFSSSVLFVYDSAASL

SEQ ID NO: 2502140 - protein, 19 aa, Entamoeba dispar
REYLTAINIPTSVKEIGNN

SEQ ID NO: 2502141 - protein, 17 aa, Entamoeba dispar
REYQCHRIIQPDPLMKR

SEQ ID NO: 2502142 - protein, 22 aa, Entamoeba dispar
RFAELEIPEFQPLTAKALNTLS

SEQ ID NO: 2502143 - protein, 19 aa, Entamoeba dispar
RFAIPTVIRNELQKTKVII

SEQ ID NO: 2502144 - protein, 19 aa, Entamoeba dispar
RFAPFLPTVLQIVLSRAQM

SEQ ID NO: 2502145 - protein, 21 aa, Entamoeba dispar
RFCQRQCSLLDKLTDLVCFLL

SEQ ID NO: 2502146 - protein, 25 aa, Entamoeba dispar
RFDDRIINFFPDYTNPIMFINCDGR

SEQ ID NO: 2502147 - protein, 18 aa, Entamoeba dispar
RFDLLKQIVGRFIQFGNT

SEQ ID NO: 2502148 - protein, 20 aa, Entamoeba dispar
RFDNTVLHLLLAYIRKPVPT

SEQ ID NO: 2502149 - protein, 28 aa, Entamoeba dispar
RFEICRREIQMLPKLIIRKEQFLKPEDI

SEQ ID NO: 2502150 - protein, 26 aa, Entamoeba dispar
RFELYFKGYIFNILFDVPQELALLRM

SEQ ID NO: 2502151 - protein, 20 aa, Entamoeba dispar
RFENKTAMNLWNKRIDLSDY

SEQ ID NO: 2502152 - protein, 26 aa, Entamoeba dispar
RFESITVFPKNCYKEIVDSLKNYSSE

SEQ ID NO: 2502153 - protein, 18 aa, Entamoeba dispar
RFESSKYSTLLPFMKSAT

SEQ ID NO: 2502154 - protein, 19 aa, Entamoeba dispar
RFFDICINIIKDLPKDPII

SEQ ID NO: 2502155 - protein, 23 aa, Entamoeba dispar
RFFECGYELHGYCLVFELHIINL

SEQ ID NO: 2502156 - protein, 21 aa, Entamoeba dispar
RFFINKFHLYIINFFIKELTT

SEQ ID NO: 2502157 - protein, 19 aa, Entamoeba dispar
RFGGCGSVMTVIKSSPYKS

SEQ ID NO: 2502158 - protein, 27 aa, Entamoeba dispar
RFGPNDMKVAEKIFLGRRERTKEVRRA

SEQ ID NO: 2502159 - protein, 21 aa, Entamoeba dispar
RFGRTGIAINFVLKNEMDNLR

SEQ ID NO: 2502160 - protein, 24 aa, Entamoeba dispar
RFHFFNRFRIKGIQHILFYEIPTP

SEQ ID NO: 2502161 - protein, 19 aa, Entamoeba dispar
RFHQCLNSHQFKNFVEEIA

SEQ ID NO: 2502162 - protein, 22 aa, Entamoeba dispar
RFIEGKTLFSYVNHVVGPKEIE

SEQ ID NO: 2502163 - protein, 33 aa, Entamoeba dispar
RFIENYKTIFPFKVYKCLIEVLGDYKKSKILLI

SEQ ID NO: 2502164 - protein, 24 aa, Entamoeba dispar
RFIESFKGYHFVKPIITPRFAVSC

SEQ ID NO: 2502165 - protein, 20 aa, Entamoeba dispar
RFIFERDYIYIGGRYRKYSR

SEQ ID NO: 2502166 - protein, 24 aa, Entamoeba dispar
RFIIKDWSIDYLVRINEIINSIKQ

SEQ ID NO: 2502167 - protein, 24 aa, Entamoeba dispar
RFIKYKKEYCCPLQHVLYPIEGIK

SEQ ID NO: 2502168 - protein, 35 aa, Entamoeba dispar
RFINEWNEIRKWVGLSPCIGCWIPFNESWGQFNTK

SEQ ID NO: 2502169 - protein, 20 aa, Entamoeba dispar
RFISLSIAFYRGADCCGLVF

SEQ ID NO: 2502170 - protein, 24 aa, Entamoeba dispar
RFIYNIFELLKFDELFVNTSILLE

SEQ ID NO: 2502171 - protein, 19 aa, Entamoeba dispar
RFKHLECNQPYQVRKGVKF

SEQ ID NO: 2502172 - protein, 17 aa, Entamoeba dispar
RFKNRLHEWPTYCYLLK

SEQ ID NO: 2502173 - protein, 19 aa, Entamoeba dispar
RFKSIAKNFTTQFTNELYE

SEQ ID NO: 2502174 - protein, 24 aa, Entamoeba dispar
RFLCPEILFRPELFINDDILAKGL

SEQ ID NO: 2502175 - protein, 22 aa, Entamoeba dispar
RFLDIEISFNFHGVFHSATGTM

SEQ ID NO: 2502176 - protein, 22 aa, Entamoeba dispar
RFLKETRVTIEIIPNIDNYPPN

SEQ ID NO: 2502177 - protein, 25 aa, Entamoeba dispar
RFLLIKEFIKLLFINTALHSEESIN

SEQ ID NO: 2502178 - protein, 21 aa, Entamoeba dispar
RFMSKTSPVLTLWADYNEPSS

SEQ ID NO: 2502179 - protein, 30 aa, Entamoeba dispar
RFMVDAGLVGCSWVKVPAKRYILVKDEANK

SEQ ID NO: 2502180 - protein, 20 aa, Entamoeba dispar
RFNIKLGKIEGNIRIDTAIE

SEQ ID NO: 2502181 - protein, 25 aa, Entamoeba dispar
RFNQNFKVNERFGFINKKCYDVLLM

SEQ ID NO: 2502182 - protein, 31 aa, Entamoeba dispar
RFNQQLIKHFCIMRELSLISFISCKRSLYTE

SEQ ID NO: 2502183 - protein, 22 aa, Entamoeba dispar
RFPNSYLIRCFVTSLSQCEGLK

SEQ ID NO: 2502184 - protein, 24 aa, Entamoeba dispar
RFQKEKRIRIAILSVTAAGTGITL

SEQ ID NO: 2502185 - protein, 23 aa, Entamoeba dispar
RFRCPEALFQPSFLGMECNGIHE

SEQ ID NO: 2502186 - protein, 19 aa, Entamoeba dispar
RFRGNIERFHFNPIPLNEH

SEQ ID NO: 2502187 - protein, 19 aa, Entamoeba dispar
RFRGNIERFHFNPIPLNEY

SEQ ID NO: 2502188 - protein, 19 aa, Entamoeba dispar
RFRGNMERFHFNPIPLNEY

SEQ ID NO: 2502189 - protein, 31 aa, Entamoeba dispar
RFRILTSSFYRKSCGIFLVFDLSDEESFKNL

SEQ ID NO: 2502190 - protein, 31 aa, Entamoeba dispar
RFRILTSSFYRKSCGIFLVFDLTDETSFKNL

SEQ ID NO: 2502191 - protein, 21 aa, Entamoeba dispar
RFRLNNCAHIHVGECINVMCK

SEQ ID NO: 2502192 - protein, 26 aa, Entamoeba dispar
RFSIERTRFYAAELLIGIKYLHDAGI

SEQ ID NO: 2502193 - protein, 23 aa, Entamoeba dispar
RFSKIGIEVARLYHWKHPNIVGF

SEQ ID NO: 2502194 - protein, 20 aa, Entamoeba dispar
RFSLKTVLMLLNQMLKRLQF

SEQ ID NO: 2502195 - protein, 30 aa, Entamoeba dispar
RFSQELRAYNCIIKRGWERLEKSKVAFEGI

SEQ ID NO: 2502196 - protein, 29 aa, Entamoeba dispar
RFTIPKWAKGIECNFEIFTYQSVNFSDYF

SEQ ID NO: 2502197 - protein, 29 aa, Entamoeba dispar
RFVFLLCTRAGGIGINLSEADTVIIYDSD

SEQ ID NO: 2502198 - protein, 22 aa, Entamoeba dispar
RFVHGGSYFKRSAIIDEAVLKE

SEQ ID NO: 2502199 - protein, 26 aa, Entamoeba dispar
RFVRELPGMLFCNSLAKDVLSKYQES

SEQ ID NO: 2502200 - protein, 24 aa, Entamoeba dispar
RFWYFKDSQGVGWNIKFKNDIDRL

SEQ ID NO: 2502201 - protein, 25 aa, Entamoeba dispar
RFYDLMWEYNFSLRLRSEEENKEKC

SEQ ID NO: 2502202 - protein, 18 aa, Entamoeba dispar
RFYEYSSLDAEPYQPRRG

SEQ ID NO: 2502203 - protein, 26 aa, Entamoeba dispar
RFYIQEFILESGLSYYIRQIVISSTG

SEQ ID NO: 2502204 - protein, 17 aa, Entamoeba dispar
RFYPLKLGNSVYIFQND

SEQ ID NO: 2502205 - protein, 21 aa, Entamoeba dispar
RFYSYNFKFLEGFEKRILNIH

SEQ ID NO: 2502206 - protein, 25 aa, Entamoeba dispar
RGAKVRSGKIWSEYIDKVITKYGKD

SEQ ID NO: 2502207 - protein, 27 aa, Entamoeba dispar
RGALTLNGTCIFVCFNNYPFSLPKIYP

SEQ ID NO: 2502208 - protein, 36 aa, Entamoeba dispar
RGAMFPCSHCFHILCIKKEFAQHPTLFARSVTQSIM

SEQ ID NO: 2502209 - protein, 17 aa, Entamoeba dispar
RGATIIVNGKREPNIVR

SEQ ID NO: 2502210 - protein, 20 aa, Entamoeba dispar
RGDCTGKIFFDMYKEEENKW

SEQ ID NO: 2502211 - protein, 23 aa, Entamoeba dispar
RGDLKILFEVICHDFIRNKENVI

SEQ ID NO: 2502212 - protein, 19 aa, Entamoeba dispar
RGDVFGCYVSKRCVKKDNW

SEQ ID NO: 2502213 - protein, 21 aa, Entamoeba dispar
RGEFLFPGLIDCHLHAPQYAF

SEQ ID NO: 2502214 - protein, 19 aa, Entamoeba dispar
RGEIRKLLFQAIFSSTQLI

SEQ ID NO: 2502215 - protein, 17 aa, Entamoeba dispar
RGFLDIIEIKKFIKNEF

SEQ ID NO: 2502216 - protein, 18 aa, Entamoeba dispar
RGFLIMPVQRLPRYNLLL

SEQ ID NO: 2502217 - protein, 19 aa, Entamoeba dispar
RGFLPSFFMITVIRELLKD

SEQ ID NO: 2502218 - protein, 24 aa, Entamoeba dispar
RGFLYHKRYITYKAFSATKFQQYN

SEQ ID NO: 2502219 - protein, 22 aa, Entamoeba dispar
RGFSSFRLLTIKTFDEETQYLI

SEQ ID NO: 2502220 - protein, 19 aa, Entamoeba dispar
RGGAAKVILKVFQMGEKQL

SEQ ID NO: 2502221 - protein, 20 aa, Entamoeba dispar
RGGLKSTVYSVGVKSIQFAI

SEQ ID NO: 2502222 - protein, 17 aa, Entamoeba dispar
RGGPEYKAIITEEKSRR

SEQ ID NO: 2502223 - protein, 23 aa, Entamoeba dispar
RGGPRGAPRGRGGMMPPAQAPEH

SEQ ID NO: 2502224 - protein, 18 aa, Entamoeba dispar
RGGRVGMTNVIFTGEGDN

SEQ ID NO: 2502225 - protein, 28 aa, Entamoeba dispar
RGHELEFLESGLIYELFNYLDYPFNDQT

SEQ ID NO: 2502226 - protein, 19 aa, Entamoeba dispar
RGHISKIYAMHWASDSTHL

SEQ ID NO: 2502227 - protein, 27 aa, Entamoeba dispar
RGIDIKRLKTVINFDCPVSTQLYVHRA

SEQ ID NO: 2502228 - protein, 19 aa, Entamoeba dispar
RGIEEFNRVKGERDKLIRS

SEQ ID NO: 2502229 - protein, 40 aa, Entamoeba dispar
RGIPLNRILMFISIFYLECFRCSQLRFEYITDYLDDSVVE

SEQ ID NO: 2502230 - protein, 20 aa, Entamoeba dispar
RGIVKLAGIILINAQVEKNS

SEQ ID NO: 2502231 - protein, 22 aa, Entamoeba dispar
RGKIKTNCFNKTYNLFGSAYQL

SEQ ID NO: 2502232 - protein, 17 aa, Entamoeba dispar
RGKIWRISMNKNGSFVI

SEQ ID NO: 2502233 - protein, 17 aa, Entamoeba dispar
RGKKTSVFTTRSPHRPN

SEQ ID NO: 2502234 - protein, 17 aa, Entamoeba dispar
RGKRCSHLRTFDMKAFI

SEQ ID NO: 2502235 - protein, 17 aa, Entamoeba dispar
RGKSYYKGEIREYEMKE

SEQ ID NO: 2502236 - protein, 19 aa, Entamoeba dispar
RGKTFGGYGNEPGKFNEPM

SEQ ID NO: 2502237 - protein, 19 aa, Entamoeba dispar
RGKTLLLIETLDFRQRTFV

SEQ ID NO: 2502238 - protein, 24 aa, Entamoeba dispar
RGKVIELLETIAFKEIDETSYCNE

SEQ ID NO: 2502239 - protein, 19 aa, Entamoeba dispar
RGKVWKILLGIYKIDSFEY

SEQ ID NO: 2502240 - protein, 28 aa, Entamoeba dispar
RGKYGVEVLCLLYALKIKYPDNIHFIRG

SEQ ID NO: 2502241 - protein, 21 aa, Entamoeba dispar
RGKYKFELFRTLVKIGSISMK

SEQ ID NO: 2502242 - protein, 24 aa, Entamoeba dispar
RGLFDEVYKIFSQVEKKVGAHNGR

SEQ ID NO: 2502243 - protein, 26 aa, Entamoeba dispar
RGLFGGDWRRSCILFEEECSSEWYVE

SEQ ID NO: 2502244 - protein, 19 aa, Entamoeba dispar
RGLFHFKSTVGISKKTVDK

SEQ ID NO: 2502245 - protein, 19 aa, Entamoeba dispar
RGLIGRSGTFFSIENDEDS

SEQ ID NO: 2502246 - protein, 20 aa, Entamoeba dispar
RGLIKMGIKKGDNLGFFSRR

SEQ ID NO: 2502247 - protein, 30 aa, Entamoeba dispar
RGLMNCWSTLRLCVEHQFGGVNSQQKKDSM

SEQ ID NO: 2502248 - protein, 19 aa, Entamoeba dispar
RGLQRKVIFIIDMSLSMIQ

SEQ ID NO: 2502249 - protein, 17 aa, Entamoeba dispar
RGLRSLRQSEWDCDEEL

SEQ ID NO: 2502250 - protein, 22 aa, Entamoeba dispar
RGMSYELFISCFPQLKTKSFNK

SEQ ID NO: 2502251 - protein, 24 aa, Entamoeba dispar
RGMTHKKLCLRFTQDAIIKRFNKT

SEQ ID NO: 2502252 - protein, 38 aa, Entamoeba dispar
RGNEVFKKKKMCLYDKCRIIKILVGWMKEATEKGESIE

SEQ ID NO: 2502253 - protein, 25 aa, Entamoeba dispar
RGNILKKDLEAIALLIEETIGGMNL

SEQ ID NO: 2502254 - protein, 28 aa, Entamoeba dispar
RGNLEVIHPRGVILDIIIDLLKKKDYKQ

SEQ ID NO: 2502255 - protein, 26 aa, Entamoeba dispar
RGNLQIIIKILLEFHTGLGDDKVIDL

SEQ ID NO: 2502256 - protein, 18 aa, Entamoeba dispar
RGNPISCVFDCDDEGLNM

SEQ ID NO: 2502257 - protein, 20 aa, Entamoeba dispar
RGNSAFTRLFFYYIESTSTK

SEQ ID NO: 2502258 - protein, 20 aa, Entamoeba dispar
RGNTPFLIAIEKGHLDLAMT

SEQ ID NO: 2502259 - protein, 35 aa, Entamoeba dispar
RGNTSFTRLYGEYCHLCLLPYLRAVTKEVIQLLIN

SEQ ID NO: 2502260 - protein, 30 aa, Entamoeba dispar
RGQDSILKRCWYKKRPTILKIYNKDMQSYF

SEQ ID NO: 2502261 - protein, 18 aa, Entamoeba dispar
RGQHFTWDSEAKYYFQFC

SEQ ID NO: 2502262 - protein, 27 aa, Entamoeba dispar
RGQLTFTVPKVYGWVDVELIHKKNIVL

SEQ ID NO: 2502263 - protein, 19 aa, Entamoeba dispar
RGQSGWIIIDCMSTIASSS

SEQ ID NO: 2502264 - protein, 17 aa, Entamoeba dispar
RGRISECNHYKEKEDLL

SEQ ID NO: 2502265 - protein, 28 aa, Entamoeba dispar
RGTAGCGMYWMFGLLLGAGFKQIGVIPK

SEQ ID NO: 2502266 - protein, 18 aa, Entamoeba dispar
RGTDWKWSDQDGGEGKTG

SEQ ID NO: 2502267 - protein, 19 aa, Entamoeba dispar
RGTEFGFAVASIMKNKEEI

SEQ ID NO: 2502268 - protein, 23 aa, Entamoeba dispar
RGTWGVPKLKPNDMERWADVGDI

SEQ ID NO: 2502269 - protein, 25 aa, Entamoeba dispar
RGVFEIKEIASLFGYSFNEMHLTGG

SEQ ID NO: 2502270 - protein, 23 aa, Entamoeba dispar
RGVKGEREFLIFVESETDLKGFL

SEQ ID NO: 2502271 - protein, 27 aa, Entamoeba dispar
RGVLRGMKRFGFARIDDIMTIVRSSYK

SEQ ID NO: 2502272 - protein, 26 aa, Entamoeba dispar
RGVLSLNSTCIFVCYNNRPFSLPHIY

SEQ ID NO: 2502273 - protein, 19 aa, Entamoeba dispar
RGVPQIEVTFDIDANGILN

SEQ ID NO: 2502274 - protein, 25 aa, Entamoeba dispar
RGWDDPRMPTIMGFKRKGYSADAIN

SEQ ID NO: 2502275 - protein, 23 aa, Entamoeba dispar
RGYHCLETVLLLLALKVKFPERI

SEQ ID NO: 2502276 - protein, 27 aa, Entamoeba dispar
RGYKPAVVGADTFRAGAYEQLQMNAKR

SEQ ID NO: 2502277 - protein, 17 aa, Entamoeba dispar
RGYLCAMRHGLIPNLLD

SEQ ID NO: 2502278 - protein, 17 aa, Entamoeba dispar
RGYLIGVVLKLVEMRKY

SEQ ID NO: 2502279 - protein, 18 aa, Entamoeba dispar
RGYLKRGIAVVGVGAPAC

SEQ ID NO: 2502280 - protein, 20 aa, Entamoeba dispar
RGYPRPVSATGEIVLQSIHR

SEQ ID NO: 2502281 - protein, 20 aa, Entamoeba dispar
RGYTAWDYTSPVFVVKDQLG

SEQ ID NO: 2502282 - protein, 19 aa, Entamoeba dispar
RHCKSEAFNNIIPGNDTEK

SEQ ID NO: 2502283 - protein, 18 aa, Entamoeba dispar
RHELPVPCLLPIIHEDND

SEQ ID NO: 2502284 - protein, 25 aa, Entamoeba dispar
RHFFYSFCPFSVVDSSIFVFLNSIS

SEQ ID NO: 2502285 - protein, 18 aa, Entamoeba dispar
RHFSGFIMIGLQVFNSPQ

SEQ ID NO: 2502286 - protein, 21 aa, Entamoeba dispar
RHGILGCIFKDKFNNKLNVVT

SEQ ID NO: 2502287 - protein, 21 aa, Entamoeba dispar
RHGRIALRLANAYLEVKELEN

SEQ ID NO: 2502288 - protein, 25 aa, Entamoeba dispar
RHHKTLIGTPHFLAPEIVDETGYNE

SEQ ID NO: 2502289 - protein, 23 aa, Entamoeba dispar
RHIGVSIINCYLLPSLLNGMKLL

SEQ ID NO: 2502290 - protein, 24 aa, Entamoeba dispar
RHINEPFDRYSIHKSLNSLGVQHS

SEQ ID NO: 2502291 - protein, 17 aa, Entamoeba dispar
RHKSCDIVLSSLMISNF

SEQ ID NO: 2502292 - protein, 21 aa, Entamoeba dispar
RHKYQLKHMLYIKFLENPELL

SEQ ID NO: 2502293 - protein, 17 aa, Entamoeba dispar
RHLAEVCADAVLSVYDK

SEQ ID NO: 2502294 - protein, 17 aa, Entamoeba dispar
RHLKLRHFQSGLEPIYN

SEQ ID NO: 2502295 - protein, 27 aa, Entamoeba dispar
RHLKTTIIVNLHIWKALNPSFKTQIAT

SEQ ID NO: 2502296 - protein, 26 aa, Entamoeba dispar
RHLKTTIIVNMHIWKGLNASFKTQVA

SEQ ID NO: 2502297 - protein, 26 aa, Entamoeba dispar
RHLKTTIIVNMHIWKSLNPSFKTQVA

SEQ ID NO: 2502298 - protein, 27 aa, Entamoeba dispar
RHLKTTIIVNMHIWKSLNPSFKTQVAT

SEQ ID NO: 2502299 - protein, 18 aa, Entamoeba dispar
RHLNHIFIIQSFQSQHSS

SEQ ID NO: 2502300 - protein, 17 aa, Entamoeba dispar
RHLRSAVLLGKSSLQLL

SEQ ID NO: 2502301 - protein, 25 aa, Entamoeba dispar
RHNFRPRHGYKYGYGEESHQWKNGT

SEQ ID NO: 2502302 - protein, 18 aa, Entamoeba dispar
RHNTVIFILSHEGYPNLR

SEQ ID NO: 2502303 - protein, 22 aa, Entamoeba dispar
RHPKIRVSHQVFKELRAIQEEK

SEQ ID NO: 2502304 - protein, 21 aa, Entamoeba dispar
RHPRYKTEICQTFHQTGTCKY

SEQ ID NO: 2502305 - protein, 22 aa, Entamoeba dispar
RHPTESLEIFCNDDKMLTNEQK

SEQ ID NO: 2502306 - protein, 19 aa, Entamoeba dispar
RHRPSLLFSTPRVFEKLNK

SEQ ID NO: 2502307 - protein, 17 aa, Entamoeba dispar
RHTIGNKLIDIFLVEGG

SEQ ID NO: 2502308 - protein, 21 aa, Entamoeba dispar
RHVFLQFVFRSFEGSKKSILK

SEQ ID NO: 2502309 - protein, 18 aa, Entamoeba dispar
RHVFWDCYDTQLIDLLEK

SEQ ID NO: 2502310 - protein, 19 aa, Entamoeba dispar
RHVIPEFDNSDGFFHGYDY

SEQ ID NO: 2502311 - protein, 25 aa, Entamoeba dispar
RHYRAPEIILGIPYNNAIDMWSAGC

SEQ ID NO: 2502312 - protein, 27 aa, Entamoeba dispar
RHYRAPEIVLGLPYSCAIDMWSVGCIA

SEQ ID NO: 2502313 - protein, 25 aa, Entamoeba dispar
RHYRAPEVILGLPYSCAIDVWSAGC

SEQ ID NO: 2502314 - protein, 20 aa, Entamoeba dispar
RHYRAPEVILGLPYSTSIDM

SEQ ID NO: 2502315 - protein, 26 aa, Entamoeba dispar
RHYRSPEVLLGIKYTTAIDMWSFGCI

SEQ ID NO: 2502316 - protein, 27 aa, Entamoeba dispar
RIADALKVLFPFSFTSIMSLFEGKNGI

SEQ ID NO: 2502317 - protein, 19 aa, Entamoeba dispar
RIAGKDGKTKFSIENTTHT

SEQ ID NO: 2502318 - protein, 17 aa, Entamoeba dispar
RIAKFIITKYGPLLDNF

SEQ ID NO: 2502319 - protein, 24 aa, Entamoeba dispar
RIANTLPHHCDFILQNKEDDHGFL

SEQ ID NO: 2502320 - protein, 20 aa, Entamoeba dispar
RIDEQRVVGLYCLQLDQKQV

SEQ ID NO: 2502321 - protein, 22 aa, Entamoeba dispar
RIDFSFKYIRHGNYLSIKIDRQ

SEQ ID NO: 2502322 - protein, 19 aa, Entamoeba dispar
RIDKLKVYEEYFILYHKNI

SEQ ID NO: 2502323 - protein, 19 aa, Entamoeba dispar
RIDLSFKENIDITSLTNLR

SEQ ID NO: 2502324 - protein, 18 aa, Entamoeba dispar
RIDLYKKYILNSSYILPP

SEQ ID NO: 2502325 - protein, 21 aa, Entamoeba dispar
RIDMPSIFKYQIKGVQDVKCI

SEQ ID NO: 2502326 - protein, 18 aa, Entamoeba dispar
RIDNWKIQCNEVKKQWYY

SEQ ID NO: 2502327 - protein, 18 aa, Entamoeba dispar
RIDPAARAAGINKQIHLM

SEQ ID NO: 2502328 - protein, 27 aa, Entamoeba dispar
RIDPIKRRFLIFMLNLYYSIAQQQEIN

SEQ ID NO: 2502329 - protein, 17 aa, Entamoeba dispar
RIDPRYHIIREYNDESN

SEQ ID NO: 2502330 - protein, 19 aa, Entamoeba dispar
RIDVIQMVCWPWKYYHDSN

SEQ ID NO: 2502331 - protein, 22 aa, Entamoeba dispar
RIEAEGIFRISGKLNDINIIKA

SEQ ID NO: 2502332 - protein, 22 aa, Entamoeba dispar
RIEECDWRKVFMPSDAKFIEKW

SEQ ID NO: 2502333 - protein, 17 aa, Entamoeba dispar
RIEELCKVVENYYIGVI

SEQ ID NO: 2502334 - protein, 19 aa, Entamoeba dispar
RIEELECEEKWAIVRDEIN

SEQ ID NO: 2502335 - protein, 19 aa, Entamoeba dispar
RIEEMKVEINSHVDINTLL

SEQ ID NO: 2502336 - protein, 19 aa, Entamoeba dispar
RIEGEFVSALGYNYHPQCF

SEQ ID NO: 2502337 - protein, 19 aa, Entamoeba dispar
RIEKEKKKETIKMKKGGIT

SEQ ID NO: 2502338 - protein, 18 aa, Entamoeba dispar
RIEREAKKKLAKGQLQRK

SEQ ID NO: 2502339 - protein, 18 aa, Entamoeba dispar
RIFGEGDAAWVVLVKCEK

SEQ ID NO: 2502340 - protein, 21 aa, Entamoeba dispar
RIFKEIIWYDISCSRYTKEKE

SEQ ID NO: 2502341 - protein, 21 aa, Entamoeba dispar
RIFKKVIWYLVSYSKYLKEKE

SEQ ID NO: 2502342 - protein, 21 aa, Entamoeba dispar
RIFNTRILNVLINILNSREDK

SEQ ID NO: 2502343 - protein, 21 aa, Entamoeba dispar
RIFPNLQTLYLRRCPEKLYKI

SEQ ID NO: 2502344 - protein, 17 aa, Entamoeba dispar
RIFQFMPFIDKMKYLQE

SEQ ID NO: 2502345 - protein, 29 aa, Entamoeba dispar
RIFVEMMQYLDIYVHRWGKLSEEVVTFMM

SEQ ID NO: 2502346 - protein, 30 aa, Entamoeba dispar
RIGARCFEGCLLESFELPISVYELGRGCFE

SEQ ID NO: 2502347 - protein, 22 aa, Entamoeba dispar
RIGDTEFQRLFIVKSADAKNVK

SEQ ID NO: 2502348 - protein, 26 aa, Entamoeba dispar
RIGEGVGGCDSCGFINDSVFYGKGKQ

SEQ ID NO: 2502349 - protein, 18 aa, Entamoeba dispar
RIGKWEQQKVLSFIPPDG

SEQ ID NO: 2502350 - protein, 18 aa, Entamoeba dispar
RIGNGCFEGSQIKEITIP

SEQ ID NO: 2502351 - protein, 27 aa, Entamoeba dispar
RIGQYKYNWIIRNYLRAIEYSNESGNH

SEQ ID NO: 2502352 - protein, 26 aa, Entamoeba dispar
RIGTEILKLLKKHRCGDLIRVSINVA

SEQ ID NO: 2502353 - protein, 19 aa, Entamoeba dispar
RIGWDVFMGAVNFDLQYFP

SEQ ID NO: 2502354 - protein, 24 aa, Entamoeba dispar
RIGWKEFFLHPYVRQCLELKGASM

SEQ ID NO: 2502355 - protein, 24 aa, Entamoeba dispar
RIGYDGIASFGAWKEEKSKIKMQE

SEQ ID NO: 2502356 - protein, 18 aa, Entamoeba dispar
RIGYKNGVIKDINIVSGI

SEQ ID NO: 2502357 - protein, 23 aa, Entamoeba dispar
RIGYNGIINCGDWEVVANNTNSN

SEQ ID NO: 2502358 - protein, 36 aa, Entamoeba dispar
RIHFKTLCKNECCVKWRKGICPWNKGKQTIKGFCFG

SEQ ID NO: 2502359 - protein, 26 aa, Entamoeba dispar
RIHIKGLEILKEVYLFPITKSTNSES

SEQ ID NO: 2502360 - protein, 17 aa, Entamoeba dispar
RIHNKECTKKKKVTIES

SEQ ID NO: 2502361 - protein, 26 aa, Entamoeba dispar
RIIDHLEVIEGIPFVGYHTRKHIFGR

SEQ ID NO: 2502362 - protein, 23 aa, Entamoeba dispar
RIIDNCLWPKLFSVTPSPIELFE

SEQ ID NO: 2502363 - protein, 30 aa, Entamoeba dispar
RIIEGMPLLDCVKGQIAWDLHILATPSHPC

SEQ ID NO: 2502364 - protein, 26 aa, Entamoeba dispar
RIIELCIYLLLAAVIEKLPLPSTLFE

SEQ ID NO: 2502365 - protein, 17 aa, Entamoeba dispar
RIIEMMMNVCKSINWYE

SEQ ID NO: 2502366 - protein, 17 aa, Entamoeba dispar
RIIFKSIEEYIKVPLKE

SEQ ID NO: 2502367 - protein, 19 aa, Entamoeba dispar
RIIGEHYIYLQNWCNLNEC

SEQ ID NO: 2502368 - protein, 24 aa, Entamoeba dispar
RIIKNMRRRGYKAKEISILTDLTK

SEQ ID NO: 2502369 - protein, 19 aa, Entamoeba dispar
RIILKHFYSPLLLENIDNV

SEQ ID NO: 2502370 - protein, 26 aa, Entamoeba dispar
RIILLLWKGIDWRNVPLDQLQKLIRL

SEQ ID NO: 2502371 - protein, 18 aa, Entamoeba dispar
RIIRAIVNVFRVIKEYIC

SEQ ID NO: 2502372 - protein, 20 aa, Entamoeba dispar
RIITIICNYEGKRICEGDKK

SEQ ID NO: 2502373 - protein, 18 aa, Entamoeba dispar
RIITLLLNEQFELRSSVI

SEQ ID NO: 2502374 - protein, 19 aa, Entamoeba dispar
RIITNEFMYVNTLTLLIDR

SEQ ID NO: 2502375 - protein, 18 aa, Entamoeba dispar
RIIYLCLHDETISYIIIN

SEQ ID NO: 2502376 - protein, 29 aa, Entamoeba dispar
RIKEDIDHCFERYKQLWEYVSADFDDFDR

SEQ ID NO: 2502377 - protein, 24 aa, Entamoeba dispar
RIKELLIVCMFKGFDILKLLSESA

SEQ ID NO: 2502378 - protein, 19 aa, Entamoeba dispar
RIKISMFGFQASGKTCLYN

SEQ ID NO: 2502379 - protein, 22 aa, Entamoeba dispar
RIKLPSIPFKCHSLSAVISIDF

SEQ ID NO: 2502380 - protein, 24 aa, Entamoeba dispar
RIKLWDLRTKNCIKEMGGHQDGII

SEQ ID NO: 2502381 - protein, 23 aa, Entamoeba dispar
RIKNDGTVEYSEWEVIKTKYKNK

SEQ ID NO: 2502382 - protein, 21 aa, Entamoeba dispar
RIKNDMLINIDISLRSLEKRL

SEQ ID NO: 2502383 - protein, 20 aa, Entamoeba dispar
RIKNHLCGRGNIFEEGRKEW

SEQ ID NO: 2502384 - protein, 23 aa, Entamoeba dispar
RIKNTIKQICCKDNFSSKLVINV

SEQ ID NO: 2502385 - protein, 20 aa, Entamoeba dispar
RIKQIIERVSKIPVCAENLI

SEQ ID NO: 2502386 - protein, 18 aa, Entamoeba dispar
RIKRESGKLMKRAPQQRR

SEQ ID NO: 2502387 - protein, 23 aa, Entamoeba dispar
RILANRYPYFLVRNKYIPLFLQN

SEQ ID NO: 2502388 - protein, 19 aa, Entamoeba dispar
RILFSLRHSHFIALMQQKF

SEQ ID NO: 2502389 - protein, 23 aa, Entamoeba dispar
RILGRSEVMGVFEYHLKQLSLPY

SEQ ID NO: 2502390 - protein, 24 aa, Entamoeba dispar
RILLDPFALPAIQDFHSNKMTIDI

SEQ ID NO: 2502391 - protein, 25 aa, Entamoeba dispar
RILNYFKRHHIPIALATSTTKSVFE

SEQ ID NO: 2502392 - protein, 20 aa, Entamoeba dispar
RILPFIKFLINREFEESHSR

SEQ ID NO: 2502393 - protein, 19 aa, Entamoeba dispar
RIMRYPILLKQILKQTSKS

SEQ ID NO: 2502394 - protein, 20 aa, Entamoeba dispar
RINDEFSNSLLIPNKIGINI

SEQ ID NO: 2502395 - protein, 17 aa, Entamoeba dispar
RINEFKKSLQILEDAKV

SEQ ID NO: 2502396 - protein, 18 aa, Entamoeba dispar
RINGGAYSSVYLVRKKVT

SEQ ID NO: 2502397 - protein, 27 aa, Entamoeba dispar
RINGLRVLQEIRLLKYLNHENIIHLEE

SEQ ID NO: 2502398 - protein, 26 aa, Entamoeba dispar
RINIIKRRKLSIGRVESEVYNIGPEQ

SEQ ID NO: 2502399 - protein, 17 aa, Entamoeba dispar
RINKAIIWYTVDYSTYL

SEQ ID NO: 2502400 - protein, 18 aa, Entamoeba dispar
RINKLPPIEVFISQNDFC

SEQ ID NO: 2502401 - protein, 18 aa, Entamoeba dispar
RINRCEKEINILKLQAQK

SEQ ID NO: 2502402 - protein, 20 aa, Entamoeba dispar
RINSPYLLQYRNWRYQQPEY

SEQ ID NO: 2502403 - protein, 25 aa, Entamoeba dispar
RINVDELFIALGRKLLQINHKGEDA

SEQ ID NO: 2502404 - protein, 25 aa, Entamoeba dispar
RIPCYIPCYVELQFDSLLRYLKSNR

SEQ ID NO: 2502405 - protein, 17 aa, Entamoeba dispar
RIPEHFVSSTLTNNKYP

SEQ ID NO: 2502406 - protein, 19 aa, Entamoeba dispar
RIPGNKTWVTALCQSDDLT

SEQ ID NO: 2502407 - protein, 18 aa, Entamoeba dispar
RIPIDQFLIQPIQRLPRY

SEQ ID NO: 2502408 - protein, 24 aa, Entamoeba dispar
RIPKPFTQRIFSIFPEKISFETVV

SEQ ID NO: 2502409 - protein, 22 aa, Entamoeba dispar
RIPKQRLEKSLKDTYKNIEQIM

SEQ ID NO: 2502410 - protein, 22 aa, Entamoeba dispar
RIPPSPLLPIIANLAAQKQLSD

SEQ ID NO: 2502411 - protein, 19 aa, Entamoeba dispar
RIPQDYPIEFGALDDLKYL

SEQ ID NO: 2502412 - protein, 22 aa, Entamoeba dispar
RIPQVYYKPLLDFFKGTFQPNS

SEQ ID NO: 2502413 - protein, 21 aa, Entamoeba dispar
RIPTYHRYCVLNPKTSSMEAV

SEQ ID NO: 2502414 - protein, 26 aa, Entamoeba dispar
RIQCINNLHCALTFMERDMLVKNPGC

SEQ ID NO: 2502415 - protein, 18 aa, Entamoeba dispar
RIQKRITALEARVEQFQK

SEQ ID NO: 2502416 - protein, 27 aa, Entamoeba dispar
RIQPEMDIRLIAFKEFLSYERIGDTLY

SEQ ID NO: 2502417 - protein, 28 aa, Entamoeba dispar
RIQQEINVHKALCKNEFIVPLFDSAVYS

SEQ ID NO: 2502418 - protein, 25 aa, Entamoeba dispar
RIQTILDIYRACFSINNECVYDHLL

SEQ ID NO: 2502419 - protein, 18 aa, Entamoeba dispar
RIQYYIMKEEWEKSEKES

SEQ ID NO: 2502420 - protein, 21 aa, Entamoeba dispar
RIREEFGKYGKIEIVTILAKR

SEQ ID NO: 2502421 - protein, 19 aa, Entamoeba dispar
RIREEVTKLFDIQTFADES

SEQ ID NO: 2502422 - protein, 23 aa, Entamoeba dispar
RIREIVAVLCDFKARHEEGRSRQ

SEQ ID NO: 2502423 - protein, 19 aa, Entamoeba dispar
RIRELSAYYRRVYLGEGYP

SEQ ID NO: 2502424 - protein, 18 aa, Entamoeba dispar
RIRGRREAFYHAQQPVFD

SEQ ID NO: 2502425 - protein, 27 aa, Entamoeba dispar
RIRISMTDVMFCKKFLPERSLHRYETK

SEQ ID NO: 2502426 - protein, 19 aa, Entamoeba dispar
RIRKACKVKESQDKDFDIT

SEQ ID NO: 2502427 - protein, 24 aa, Entamoeba dispar
RIRNNCFFNCLSLQKFDYHPFDKT

SEQ ID NO: 2502428 - protein, 31 aa, Entamoeba dispar
RIRSEGLNKLYAYLCDEIRANFDSELAENII

SEQ ID NO: 2502429 - protein, 19 aa, Entamoeba dispar
RIRSVFVKILFAQELFLPT

SEQ ID NO: 2502430 - protein, 19 aa, Entamoeba dispar
RISADFDEIVFEKKLTATV

SEQ ID NO: 2502431 - protein, 22 aa, Entamoeba dispar
RISEALAKMQLREKVNARDVKE

SEQ ID NO: 2502432 - protein, 17 aa, Entamoeba dispar
RISGKLMYIPHNNVISS

SEQ ID NO: 2502433 - protein, 19 aa, Entamoeba dispar
RISGKLNDINIIKAKYDNG

SEQ ID NO: 2502434 - protein, 19 aa, Entamoeba dispar
RISKPKITVSLYLFPEVDP

SEQ ID NO: 2502435 - protein, 17 aa, Entamoeba dispar
RISKRGCRCKGVCDKNC

SEQ ID NO: 2502436 - protein, 18 aa, Entamoeba dispar
RISKSTINDSVRVHQIPK

SEQ ID NO: 2502437 - protein, 21 aa, Entamoeba dispar
RISLQKELIKAGVIDESSSKY

SEQ ID NO: 2502438 - protein, 19 aa, Entamoeba dispar
RISPEFQNFCKYLRERQNQ

SEQ ID NO: 2502439 - protein, 26 aa, Entamoeba dispar
RISTLWRICQTYDYFFVKTVVREYTD

SEQ ID NO: 2502440 - protein, 17 aa, Entamoeba dispar
RITFAHIIFTNKQSCAK

SEQ ID NO: 2502441 - protein, 17 aa, Entamoeba dispar
RITIHELYNQFKIPNET

SEQ ID NO: 2502442 - protein, 18 aa, Entamoeba dispar
RITKEIIWYKVNYSTYLK

SEQ ID NO: 2502443 - protein, 19 aa, Entamoeba dispar
RITKLRINKIIKENTLICS

SEQ ID NO: 2502444 - protein, 21 aa, Entamoeba dispar
RITQSQCPVSIDLHISLDGVV

SEQ ID NO: 2502445 - protein, 17 aa, Entamoeba dispar
RITSLGYSSFRDCVKLS

SEQ ID NO: 2502446 - protein, 19 aa, Entamoeba dispar
RITVSGWFYLKNVYLENDS

SEQ ID NO: 2502447 - protein, 18 aa, Entamoeba dispar
RIVCFQKTTFIGSIEMSE

SEQ ID NO: 2502448 - protein, 24 aa, Entamoeba dispar
RIVQPPWFVCVICRRQFKDKDELQ

SEQ ID NO: 2502449 - protein, 20 aa, Entamoeba dispar
RIVSCGGVIRNGRVNGNLSL

SEQ ID NO: 2502450 - protein, 19 aa, Entamoeba dispar
RIVSEGVVTLGEYIGQDRC

SEQ ID NO: 2502451 - protein, 19 aa, Entamoeba dispar
RIVSVGVGFWKVDINGKNN

SEQ ID NO: 2502452 - protein, 23 aa, Entamoeba dispar
RIVTPRLALTTAEYFAYTCDMHV

SEQ ID NO: 2502453 - protein, 24 aa, Entamoeba dispar
RIVTPRLALTTAEYFAYTCDMHVL

SEQ ID NO: 2502454 - protein, 20 aa, Entamoeba dispar
RIVVGIEGKVTWKEYKERNK

SEQ ID NO: 2502455 - protein, 23 aa, Entamoeba dispar
RIWHEECFVCNECGEHFGGEHKL

SEQ ID NO: 2502456 - protein, 19 aa, Entamoeba dispar
RIYDCAIELIKRGKAYVCH

SEQ ID NO: 2502457 - protein, 17 aa, Entamoeba dispar
RIYGMYFALYAELHVII

SEQ ID NO: 2502458 - protein, 24 aa, Entamoeba dispar
RIYNEWCGYARDCYHTQRMQKVFN

SEQ ID NO: 2502459 - protein, 25 aa, Entamoeba dispar
RIYNEWCGYARDCYHTQRMQKVFNV

SEQ ID NO: 2502460 - protein, 24 aa, Entamoeba dispar
RIYNSYMGFCINLLPRGWHGLLSL

SEQ ID NO: 2502461 - protein, 20 aa, Entamoeba dispar
RIYRCSKCKREFEVEAQVET

SEQ ID NO: 2502462 - protein, 17 aa, Entamoeba dispar
RIYRCYSGILNIKESEI

SEQ ID NO: 2502463 - protein, 21 aa, Entamoeba dispar
RIYVDGCYDMFHWGHANVIRQ

SEQ ID NO: 2502464 - protein, 18 aa, Entamoeba dispar
RKADGIVVALKQMEVNSD

SEQ ID NO: 2502465 - protein, 17 aa, Entamoeba dispar
RKAGIAWRKEEDQKLLR

SEQ ID NO: 2502466 - protein, 23 aa, Entamoeba dispar
RKAKTIVYGCIYGIGPFSLADQL

SEQ ID NO: 2502467 - protein, 17 aa, Entamoeba dispar
RKANRVDMSKHFVNSKK

SEQ ID NO: 2502468 - protein, 18 aa, Entamoeba dispar
RKAVKRFGCDVTMTEMIM

SEQ ID NO: 2502469 - protein, 19 aa, Entamoeba dispar
RKAVRGMLPKNNYRGKLAL

SEQ ID NO: 2502470 - protein, 17 aa, Entamoeba dispar
RKCDCYAHLIKESTDSN

SEQ ID NO: 2502471 - protein, 18 aa, Entamoeba dispar
RKCRELVQEWKFKFPNEL

SEQ ID NO: 2502472 - protein, 19 aa, Entamoeba dispar
RKDEDFQKRIELIQDTEFP

SEQ ID NO: 2502473 - protein, 19 aa, Entamoeba dispar
RKDGLIPIEEMHNLCYEVI

SEQ ID NO: 2502474 - protein, 18 aa, Entamoeba dispar
RKDISKEVLDCFEESKEE

SEQ ID NO: 2502475 - protein, 28 aa, Entamoeba dispar
RKDVIGIYLPNCVQFIISEASIETCGFI

SEQ ID NO: 2502476 - protein, 30 aa, Entamoeba dispar
RKDVISEFVRRSCDIVPCPVLLDTISSICV

SEQ ID NO: 2502477 - protein, 19 aa, Entamoeba dispar
RKEAFYIGKPIKFKVTQCL

SEQ ID NO: 2502478 - protein, 17 aa, Entamoeba dispar
RKEEIIEGYKEKRKEVE

SEQ ID NO: 2502479 - protein, 25 aa, Entamoeba dispar
RKEESLVKFIFSFVLAISKMVAKLE

SEQ ID NO: 2502480 - protein, 20 aa, Entamoeba dispar
RKEFEEECYKRGIYEEFINK

SEQ ID NO: 2502481 - protein, 19 aa, Entamoeba dispar
RKEGKFFDSFDKAYGCCGF

SEQ ID NO: 2502482 - protein, 22 aa, Entamoeba dispar
RKEGKRVICISSDIKTTTEKED

SEQ ID NO: 2502483 - protein, 23 aa, Entamoeba dispar
RKEGKRVICISSDIKTTTEKEDE

SEQ ID NO: 2502484 - protein, 17 aa, Entamoeba dispar
RKEILPLGKAIRSMQKN

SEQ ID NO: 2502485 - protein, 19 aa, Entamoeba dispar
RKELERIRLMNYFDINTQD

SEQ ID NO: 2502486 - protein, 26 aa, Entamoeba dispar
RKENRFCAECGCENPQWISVNLGIVF

SEQ ID NO: 2502487 - protein, 21 aa, Entamoeba dispar
RKENTFHIIEKSFLRGEAFSE

SEQ ID NO: 2502488 - protein, 27 aa, Entamoeba dispar
RKEPFMFINNIRFIRFAFSLRYQFIDY

SEQ ID NO: 2502489 - protein, 19 aa, Entamoeba dispar
RKERFEAMKGLSKKSRQKR

SEQ ID NO: 2502490 - protein, 17 aa, Entamoeba dispar
RKETIDAVNNWGSSPVK

SEQ ID NO: 2502491 - protein, 22 aa, Entamoeba dispar
RKEVEHKNGLLMLLNGLKNDIE

SEQ ID NO: 2502492 - protein, 26 aa, Entamoeba dispar
RKEVGCVADCVCMWYNVADDSVKCLS

SEQ ID NO: 2502493 - protein, 25 aa, Entamoeba dispar
RKEVIPEIIIKVVMLYDENLDNILV

SEQ ID NO: 2502494 - protein, 20 aa, Entamoeba dispar
RKEVLMLMEYCPSSLVQILE

SEQ ID NO: 2502495 - protein, 23 aa, Entamoeba dispar
RKEYFKLLVQFSDLKKELTVKDN

SEQ ID NO: 2502496 - protein, 22 aa, Entamoeba dispar
RKEYLLEVIQKITLPLLTESDE

SEQ ID NO: 2502497 - protein, 20 aa, Entamoeba dispar
RKFAELMLLSERRYQLGCRV

SEQ ID NO: 2502498 - protein, 18 aa, Entamoeba dispar
RKFFPGIETFHIYNRKDE

SEQ ID NO: 2502499 - protein, 20 aa, Entamoeba dispar
RKFIECSKLLSTKQGIYAYL

SEQ ID NO: 2502500 - protein, 19 aa, Entamoeba dispar
RKFNDLVLLLADKINKSNM

SEQ ID NO: 2502501 - protein, 19 aa, Entamoeba dispar
RKFRKTICFGKIKNEQVEE

SEQ ID NO: 2502502 - protein, 23 aa, Entamoeba dispar
RKFYKELKPTIGVDIKNKTININ

SEQ ID NO: 2502503 - protein, 29 aa, Entamoeba dispar
RKGGMNQLWASKILQIFKFLNGKDTFEQH

SEQ ID NO: 2502504 - protein, 19 aa, Entamoeba dispar
RKGIQKCLDGKNIQTKQSR

SEQ ID NO: 2502505 - protein, 20 aa, Entamoeba dispar
RKGKGPKLLDVRMMLPMSVR

SEQ ID NO: 2502506 - protein, 19 aa, Entamoeba dispar
RKGKRAGGFHDILRTNYLN

SEQ ID NO: 2502507 - protein, 26 aa, Entamoeba dispar
RKGKYRFPGTDLWYNTIEEYKKLQKE

SEQ ID NO: 2502508 - protein, 22 aa, Entamoeba dispar
RKGLGDFVIYVTIDDIWVVLTE

SEQ ID NO: 2502509 - protein, 17 aa, Entamoeba dispar
RKGRRELMLASQRIVSV

SEQ ID NO: 2502510 - protein, 20 aa, Entamoeba dispar
RKGSEFIRCECNKLTLSQFG

SEQ ID NO: 2502511 - protein, 20 aa, Entamoeba dispar
RKGSLFWNKQMIEIIGERLC

SEQ ID NO: 2502512 - protein, 27 aa, Entamoeba dispar
RKGYKRGNIKLVILNSGICKIQRIREE

SEQ ID NO: 2502513 - protein, 23 aa, Entamoeba dispar
RKHEVILKALFVDKVKRIITRIN

SEQ ID NO: 2502514 - protein, 24 aa, Entamoeba dispar
RKHFKCIDYFPTDRMLLHEDQVLL

SEQ ID NO: 2502515 - protein, 25 aa, Entamoeba dispar
RKHHCNYCGKVFCDKCLSYRIVLPK

SEQ ID NO: 2502516 - protein, 21 aa, Entamoeba dispar
RKHIFGRIWLKNHKDINKVRK

SEQ ID NO: 2502517 - protein, 24 aa, Entamoeba dispar
RKHSRRGFYISVHRNNIFQESYSQ

SEQ ID NO: 2502518 - protein, 22 aa, Entamoeba dispar
RKHWRKVFDIDNRIKDICYSLE

SEQ ID NO: 2502519 - protein, 26 aa, Entamoeba dispar
RKIEEIHFYQSILQSFGYKFIFYKNP

SEQ ID NO: 2502520 - protein, 20 aa, Entamoeba dispar
RKIFKYVIWYLVSYSKYLQE

SEQ ID NO: 2502521 - protein, 21 aa, Entamoeba dispar
RKIIASCFVDNVARLVRREEL

SEQ ID NO: 2502522 - protein, 20 aa, Entamoeba dispar
RKIIDGFSIITARDVSSNGS

SEQ ID NO: 2502523 - protein, 19 aa, Entamoeba dispar
RKIIKSNYFPTTVLCSDNK

SEQ ID NO: 2502524 - protein, 20 aa, Entamoeba dispar
RKIINRMIHVMKGADRESSI

SEQ ID NO: 2502525 - protein, 17 aa, Entamoeba dispar
RKILEIESGIKTPKHNL

SEQ ID NO: 2502526 - protein, 18 aa, Entamoeba dispar
RKILNEVIIHSNYGEGDQ

SEQ ID NO: 2502527 - protein, 21 aa, Entamoeba dispar
RKILPEPISPIGLELSSYDIH

SEQ ID NO: 2502528 - protein, 26 aa, Entamoeba dispar
RKIMKELLEDLLFEYGIIVIDSTNRI

SEQ ID NO: 2502529 - protein, 23 aa, Entamoeba dispar
RKIPGMKRYVLWYDVNYTRYLKE

SEQ ID NO: 2502530 - protein, 17 aa, Entamoeba dispar
RKIPWVIPATNDEVEEY

SEQ ID NO: 2502531 - protein, 20 aa, Entamoeba dispar
RKITTLRLGFIPLSPIEESF

SEQ ID NO: 2502532 - protein, 19 aa, Entamoeba dispar
RKIYSRKSLSPILAGNDTN

SEQ ID NO: 2502533 - protein, 20 aa, Entamoeba dispar
RKKCFSQCKSLKSINIPTTI

SEQ ID NO: 2502534 - protein, 32 aa, Entamoeba dispar
RKKCGITKMEIMSLYEMMVWAELKNNNEVMPK

SEQ ID NO: 2502535 - protein, 22 aa, Entamoeba dispar
RKKDRCINDFTFSVNIPLVEKG

SEQ ID NO: 2502536 - protein, 18 aa, Entamoeba dispar
RKKEIIKVNGTLITPMIN

SEQ ID NO: 2502537 - protein, 21 aa, Entamoeba dispar
RKKELQYSFYCMSRATMTALC

SEQ ID NO: 2502538 - protein, 17 aa, Entamoeba dispar
RKKEMPIVGPLLNGMEI

SEQ ID NO: 2502539 - protein, 17 aa, Entamoeba dispar
RKKFCEMIISWMNENAD

SEQ ID NO: 2502540 - protein, 18 aa, Entamoeba dispar
RKKIKELLKESFSADEIN

SEQ ID NO: 2502541 - protein, 19 aa, Entamoeba dispar
RKKIMLHIIHIYKEKKEVE

SEQ ID NO: 2502542 - protein, 25 aa, Entamoeba dispar
RKKNWKCVFPNCNEPVKTRFNCYAH

SEQ ID NO: 2502543 - protein, 18 aa, Entamoeba dispar
RKKSVIPWTSNDDEKLLN

SEQ ID NO: 2502544 - protein, 20 aa, Entamoeba dispar
RKKTLCLMKKISEIKNKEIK

SEQ ID NO: 2502545 - protein, 17 aa, Entamoeba dispar
RKLADLFSADPQKKMDS

SEQ ID NO: 2502546 - protein, 23 aa, Entamoeba dispar
RKLAMWPKYNFYKADQRYMELAQ

SEQ ID NO: 2502547 - protein, 18 aa, Entamoeba dispar
RKLDEIIITPSPTHLNER

SEQ ID NO: 2502548 - protein, 27 aa, Entamoeba dispar
RKLFEKYGEIKKVFCQIENRGIAFVTF

SEQ ID NO: 2502549 - protein, 19 aa, Entamoeba dispar
RKLGLEKIGECLANLYLIR

SEQ ID NO: 2502550 - protein, 26 aa, Entamoeba dispar
RKLICSCSTEQYCVMLYHQLLEKIKK

SEQ ID NO: 2502551 - protein, 24 aa, Entamoeba dispar
RKLKMTNPHFIRCILPNTQKKQRY

SEQ ID NO: 2502552 - protein, 18 aa, Entamoeba dispar
RKLLKSHFPIPQGVKRII

SEQ ID NO: 2502553 - protein, 19 aa, Entamoeba dispar
RKLLSRKFPLNFEVKQPNC

SEQ ID NO: 2502554 - protein, 19 aa, Entamoeba dispar
RKLPDADVKYISMIGDDEW

SEQ ID NO: 2502555 - protein, 27 aa, Entamoeba dispar
RKLQDINIFSGRVFDPFNYVDDLLSEQ

SEQ ID NO: 2502556 - protein, 19 aa, Entamoeba dispar
RKLQHRFGVDPIVTLMNPK

SEQ ID NO: 2502557 - protein, 25 aa, Entamoeba dispar
RKLSDKLKGPWDWKEKFSTYERIKK

SEQ ID NO: 2502558 - protein, 19 aa, Entamoeba dispar
RKLTYERLIQCGIACPQFI

SEQ ID NO: 2502559 - protein, 23 aa, Entamoeba dispar
RKMFERGMRICLSTDTPLHTHIT

SEQ ID NO: 2502560 - protein, 17 aa, Entamoeba dispar
RKMLHQFIGPLNPIDVN

SEQ ID NO: 2502561 - protein, 19 aa, Entamoeba dispar
RKMPIIIKKIKGINHYVNE

SEQ ID NO: 2502562 - protein, 20 aa, Entamoeba dispar
RKMPIIIKKIKGINHYVNEE

SEQ ID NO: 2502563 - protein, 23 aa, Entamoeba dispar
RKMQFKILMGFVNEFVDQAISYF

SEQ ID NO: 2502564 - protein, 17 aa, Entamoeba dispar
RKMTPKQFLCVLGNIEQ

SEQ ID NO: 2502565 - protein, 22 aa, Entamoeba dispar
RKNARKAVKLFRVHDTNRDGFL

SEQ ID NO: 2502566 - protein, 19 aa, Entamoeba dispar
RKNDALAIGECLGLDNVPV

SEQ ID NO: 2502567 - protein, 20 aa, Entamoeba dispar
RKNECLRCPINPKHKFCEGC

SEQ ID NO: 2502568 - protein, 23 aa, Entamoeba dispar
RKNKIRFEWLVNLFDTENNELKK

SEQ ID NO: 2502569 - protein, 26 aa, Entamoeba dispar
RKNLFKELSICICGQPKILATKLSAW

SEQ ID NO: 2502570 - protein, 22 aa, Entamoeba dispar
RKNLVKKCLELFVEISENKEDF

SEQ ID NO: 2502571 - protein, 21 aa, Entamoeba dispar
RKNNNWTDLYWRDVMSDEAIV

SEQ ID NO: 2502572 - protein, 26 aa, Entamoeba dispar
RKNVDARTKWHVMNAYTLHREQLDIM

SEQ ID NO: 2502573 - protein, 24 aa, Entamoeba dispar
RKNVYCDLMKVGIIDPTKVVRNAF

SEQ ID NO: 2502574 - protein, 20 aa, Entamoeba dispar
RKPFPQPWRGLRDNALEDVC

SEQ ID NO: 2502575 - protein, 24 aa, Entamoeba dispar
RKPHSFKIDCKDQFNVISETSRVL

SEQ ID NO: 2502576 - protein, 21 aa, Entamoeba dispar
RKPIINEIMLKYGNLPRTDIT

SEQ ID NO: 2502577 - protein, 17 aa, Entamoeba dispar
RKPSEHCSLLLSQEALN

SEQ ID NO: 2502578 - protein, 24 aa, Entamoeba dispar
RKPTFSLKAPYVVTTRILPYPLNY

SEQ ID NO: 2502579 - protein, 17 aa, Entamoeba dispar
RKQAFNFYAEENFQEAL

SEQ ID NO: 2502580 - protein, 20 aa, Entamoeba dispar
RKQEYCLDSSLALKLSVIFL

SEQ ID NO: 2502581 - protein, 24 aa, Entamoeba dispar
RKQITKQGFAYRKTLSCETDQSLN

SEQ ID NO: 2502582 - protein, 18 aa, Entamoeba dispar
RKQLECMSYPLNTTHCFI

SEQ ID NO: 2502583 - protein, 27 aa, Entamoeba dispar
RKQMAEFFRMMKFQRYFESGDALSGDF

SEQ ID NO: 2502584 - protein, 25 aa, Entamoeba dispar
RKQSLCVISCLLFGLYSIKLRKDER

SEQ ID NO: 2502585 - protein, 28 aa, Entamoeba dispar
RKQYSHFLYFIFRCIGTPVKLKCFEIFL

SEQ ID NO: 2502586 - protein, 20 aa, Entamoeba dispar
RKQYTYSISDLLSFKPSAIP

SEQ ID NO: 2502587 - protein, 18 aa, Entamoeba dispar
RKRAIKIGLIKTNEVKHK

SEQ ID NO: 2502588 - protein, 19 aa, Entamoeba dispar
RKRALRLFGNYLGNSLYDT

SEQ ID NO: 2502589 - protein, 21 aa, Entamoeba dispar
RKRFGRRFDHFERLRKKRARD

SEQ ID NO: 2502590 - protein, 17 aa, Entamoeba dispar
RKRGISLSSISQQTENN

SEQ ID NO: 2502591 - protein, 20 aa, Entamoeba dispar
RKRIKENSFLSEPKRSSFVV

SEQ ID NO: 2502592 - protein, 17 aa, Entamoeba dispar
RKRIYRNILETIGGTPL

SEQ ID NO: 2502593 - protein, 21 aa, Entamoeba dispar
RKRLQRVGSTLNLDRKRKYIT

SEQ ID NO: 2502594 - protein, 23 aa, Entamoeba dispar
RKRRILKEEVNILEERRINISNQ

SEQ ID NO: 2502595 - protein, 26 aa, Entamoeba dispar
RKSDIWALGCLLFEIAIGAPPFSAPL

SEQ ID NO: 2502596 - protein, 38 aa, Entamoeba dispar
RKSFIEFEGKYLLGERFFRLNPKLPYQIDLDYCKDVEL

SEQ ID NO: 2502597 - protein, 26 aa, Entamoeba dispar
RKSIKRKRKPLLFANRLNNEEVNDNI

SEQ ID NO: 2502598 - protein, 21 aa, Entamoeba dispar
RKSKELFFNEIEPFQMKKYVI

SEQ ID NO: 2502599 - protein, 21 aa, Entamoeba dispar
RKSKEVFFNEIAPFQMKKYVI

SEQ ID NO: 2502600 - protein, 24 aa, Entamoeba dispar
RKSKRTKQTIKMLLPETVVLNNTT

SEQ ID NO: 2502601 - protein, 17 aa, Entamoeba dispar
RKSMSMICLYTKKINED

SEQ ID NO: 2502602 - protein, 25 aa, Entamoeba dispar
RKSNMNMHILFKIILKNTIHLSITN

SEQ ID NO: 2502603 - protein, 19 aa, Entamoeba dispar
RKSQGFVIVTYYDIRNAKV

SEQ ID NO: 2502604 - protein, 23 aa, Entamoeba dispar
RKSVEIQRQFLMKVIDWKIQMDL

SEQ ID NO: 2502605 - protein, 19 aa, Entamoeba dispar
RKTAKVLPVITNKKSYFIF

SEQ ID NO: 2502606 - protein, 17 aa, Entamoeba dispar
RKTEIFNGLQVQRLYSV

SEQ ID NO: 2502607 - protein, 17 aa, Entamoeba dispar
RKTEVIAHQANWAAIDN

SEQ ID NO: 2502608 - protein, 18 aa, Entamoeba dispar
RKTIKPRYFYLFNDILIY

SEQ ID NO: 2502609 - protein, 22 aa, Entamoeba dispar
RKTLSFKGKIFSSTSSNDEKKN

SEQ ID NO: 2502610 - protein, 20 aa, Entamoeba dispar
RKTQNCYAVYSTPEEAEKAA

SEQ ID NO: 2502611 - protein, 20 aa, Entamoeba dispar
RKTSTAFRVTSKIAPGDIIL

SEQ ID NO: 2502612 - protein, 17 aa, Entamoeba dispar
RKVAAAVVMARRGGAIH

SEQ ID NO: 2502613 - protein, 19 aa, Entamoeba dispar
RKVDIIYAKQLFKDKPNDG

SEQ ID NO: 2502614 - protein, 21 aa, Entamoeba dispar
RKVFEKCGRVLAVTLSKTKDK

SEQ ID NO: 2502615 - protein, 23 aa, Entamoeba dispar
RKVFKGKEVYAMKILHYSDLTDK

SEQ ID NO: 2502616 - protein, 26 aa, Entamoeba dispar
RKVFSKEIPLNFLLEVHDKIVATQDN

SEQ ID NO: 2502617 - protein, 21 aa, Entamoeba dispar
RKVGDDYILYNFSVVHDKFPP

SEQ ID NO: 2502618 - protein, 24 aa, Entamoeba dispar
RKVGKTAIETINFRKLEEKLNIWK

SEQ ID NO: 2502619 - protein, 20 aa, Entamoeba dispar
RKVGKVVVTVPVSFTPRQKK

SEQ ID NO: 2502620 - protein, 21 aa, Entamoeba dispar
RKVHDICVIKQLESVSCHYND

SEQ ID NO: 2502621 - protein, 17 aa, Entamoeba dispar
RKVLVGINFELNIETPH

SEQ ID NO: 2502622 - protein, 31 aa, Entamoeba dispar
RKVNIKKNIKIEDIVAAWSIVNKAKDSLQIG

SEQ ID NO: 2502623 - protein, 18 aa, Entamoeba dispar
RKVPEKRNQISFAPPPKR

SEQ ID NO: 2502624 - protein, 19 aa, Entamoeba dispar
RKVPMLGEVGELARMSMSI

SEQ ID NO: 2502625 - protein, 18 aa, Entamoeba dispar
RKVREFVLKQEEIFEEQR

SEQ ID NO: 2502626 - protein, 17 aa, Entamoeba dispar
RKVVSLFSIIKIDNNLE

SEQ ID NO: 2502627 - protein, 25 aa, Entamoeba dispar
RKVYEIRSSYKFAEKSIDTDFKEIH

SEQ ID NO: 2502628 - protein, 19 aa, Entamoeba dispar
RKWEFKKAEIIGEESEEEE

SEQ ID NO: 2502629 - protein, 20 aa, Entamoeba dispar
RKYCHGVFDQLYRATIGVDF

SEQ ID NO: 2502630 - protein, 19 aa, Entamoeba dispar
RKYFDVLVLKQLVCAMEHE

SEQ ID NO: 2502631 - protein, 19 aa, Entamoeba dispar
RKYFRGITIPTFISTVTHQ

SEQ ID NO: 2502632 - protein, 17 aa, Entamoeba dispar
RKYIEFESFEKAMDEFH

SEQ ID NO: 2502633 - protein, 23 aa, Entamoeba dispar
RKYKGQSGIIYCLSQKNTMDVAQ

SEQ ID NO: 2502634 - protein, 31 aa, Entamoeba dispar
RKYLERNRITVGFPIKGYKEALVLDIRNGDD

SEQ ID NO: 2502635 - protein, 18 aa, Entamoeba dispar
RKYLSAVFRERCNKTTAQ

SEQ ID NO: 2502636 - protein, 19 aa, Entamoeba dispar
RLADLISRNLLRNEGLLPH

SEQ ID NO: 2502637 - protein, 19 aa, Entamoeba dispar
RLADRCFQNGMALDITKYV

SEQ ID NO: 2502638 - protein, 24 aa, Entamoeba dispar
RLAKELKKKLAKDVENYENAINDM

SEQ ID NO: 2502639 - protein, 19 aa, Entamoeba dispar
RLCDLKREVVVPVIKIDSG

SEQ ID NO: 2502640 - protein, 21 aa, Entamoeba dispar
RLCFSNCTSLKSIEFPSSLKH

SEQ ID NO: 2502641 - protein, 20 aa, Entamoeba dispar
RLCIHTIQCIERIFKRIYDE

SEQ ID NO: 2502642 - protein, 32 aa, Entamoeba dispar
RLDCDWKVDYILPRQKWEFFRDFSDPTLRKLS

SEQ ID NO: 2502643 - protein, 18 aa, Entamoeba dispar
RLDDWTEVCICVIHILDD

SEQ ID NO: 2502644 - protein, 22 aa, Entamoeba dispar
RLDELCKIILLIIDSYNPHVRY

SEQ ID NO: 2502645 - protein, 18 aa, Entamoeba dispar
RLDLLKIQFKESREIILF

SEQ ID NO: 2502646 - protein, 17 aa, Entamoeba dispar
RLDMIRPKLTWASIDVF

SEQ ID NO: 2502647 - protein, 21 aa, Entamoeba dispar
RLDNVLKENLSIIFGNIIDIE

SEQ ID NO: 2502648 - protein, 22 aa, Entamoeba dispar
RLDYLKQLNITSVVLYNYPSFS

SEQ ID NO: 2502649 - protein, 18 aa, Entamoeba dispar
RLECCSYRGEIPCNFIKL

SEQ ID NO: 2502650 - protein, 17 aa, Entamoeba dispar
RLEDILNGFRVVGGLEE

SEQ ID NO: 2502651 - protein, 20 aa, Entamoeba dispar
RLEDILNGFRVVGGLEEENR

SEQ ID NO: 2502652 - protein, 23 aa, Entamoeba dispar
RLEGISFAGLFNVLPYVRLESNQ

SEQ ID NO: 2502653 - protein, 19 aa, Entamoeba dispar
RLEIMKCNSFEFIDVTHYI

SEQ ID NO: 2502654 - protein, 26 aa, Entamoeba dispar
RLESKSSFKKLCFNLQSKISVGHALN

SEQ ID NO: 2502655 - protein, 26 aa, Entamoeba dispar
RLFFSEKRLPPFGSLKVKPSIIDLMK

SEQ ID NO: 2502656 - protein, 20 aa, Entamoeba dispar
RLFNVALDVIEKVFGEKSLL

SEQ ID NO: 2502657 - protein, 17 aa, Entamoeba dispar
RLFRLNLLSNIKFNSSI

SEQ ID NO: 2502658 - protein, 26 aa, Entamoeba dispar
RLFSKCGKCGRILLKVIGDQTYLSCP

SEQ ID NO: 2502659 - protein, 25 aa, Entamoeba dispar
RLFSYELARALGYIHSFGMCHRDIK

SEQ ID NO: 2502660 - protein, 17 aa, Entamoeba dispar
RLGDIDIAKALKMPDLE

SEQ ID NO: 2502661 - protein, 19 aa, Entamoeba dispar
RLGDIDIGKALKMPDLEEA

SEQ ID NO: 2502662 - protein, 19 aa, Entamoeba dispar
RLGDIDIGKALKMTDLEEA

SEQ ID NO: 2502663 - protein, 19 aa, Entamoeba dispar
RLGDLIIGRSGIRGIMREI

SEQ ID NO: 2502664 - protein, 21 aa, Entamoeba dispar
RLGKEIKISYMRAYETIKLLH

SEQ ID NO: 2502665 - protein, 18 aa, Entamoeba dispar
RLGTCSLDTTVTVWSVET

SEQ ID NO: 2502666 - protein, 18 aa, Entamoeba dispar
RLHKMKKYCEEFIGLMKG

SEQ ID NO: 2502667 - protein, 17 aa, Entamoeba dispar
RLHRMTRYNLKVKLGDV

SEQ ID NO: 2502668 - protein, 20 aa, Entamoeba dispar
RLHSGILRKLSRCTLETFLS

SEQ ID NO: 2502669 - protein, 29 aa, Entamoeba dispar
RLHSRIACLRLIIFLLRKDIKMFKFVYAK

SEQ ID NO: 2502670 - protein, 17 aa, Entamoeba dispar
RLHYIYSNFCYSDIFDS

SEQ ID NO: 2502671 - protein, 23 aa, Entamoeba dispar
RLICERARYEAMSKFNEEASKIY

SEQ ID NO: 2502672 - protein, 25 aa, Entamoeba dispar
RLIDEACFYIRETIMDDCEVKIKDL

SEQ ID NO: 2502673 - protein, 19 aa, Entamoeba dispar
RLIECLSVIALELKGDYCS

SEQ ID NO: 2502674 - protein, 23 aa, Entamoeba dispar
RLIEESKCYFGLEENVVHVYDNT

SEQ ID NO: 2502675 - protein, 18 aa, Entamoeba dispar
RLIETEVRFHPGRQLNIQ

SEQ ID NO: 2502676 - protein, 19 aa, Entamoeba dispar
RLIFVCKKGIYSIDKHQKK

SEQ ID NO: 2502677 - protein, 30 aa, Entamoeba dispar
RLIGEKHSSLILCRFSEGVTEGYQLRGNEH

SEQ ID NO: 2502678 - protein, 36 aa, Entamoeba dispar
RLIGKLYIQGAVVCRLPLICCNELLQVGNDLTIEAL

SEQ ID NO: 2502679 - protein, 19 aa, Entamoeba dispar
RLIIIKFLIDVANHCKILN

SEQ ID NO: 2502680 - protein, 23 aa, Entamoeba dispar
RLIKCEYCSLMFPVNQIQQHKDY

SEQ ID NO: 2502681 - protein, 17 aa, Entamoeba dispar
RLIKRMNKVLEQVSFDY

SEQ ID NO: 2502682 - protein, 18 aa, Entamoeba dispar
RLILKGNEELLGIDAIQL

SEQ ID NO: 2502683 - protein, 18 aa, Entamoeba dispar
RLILVELLLKAGAEVDAR

SEQ ID NO: 2502684 - protein, 30 aa, Entamoeba dispar
RLIPIEIPQLPEFVKHFSIKAIYSKFIINN

SEQ ID NO: 2502685 - protein, 25 aa, Entamoeba dispar
RLIPQHSVPFAWTDPDGCRSLIINE

SEQ ID NO: 2502686 - protein, 18 aa, Entamoeba dispar
RLISEEVFNEKEVIESIE

SEQ ID NO: 2502687 - protein, 19 aa, Entamoeba dispar
RLITPPSYLLGKKLKSIIN

SEQ ID NO: 2502688 - protein, 21 aa, Entamoeba dispar
RLKADVIICSYQVISKEKSLL

SEQ ID NO: 2502689 - protein, 18 aa, Entamoeba dispar
RLKEELFEGYNNIDSKQK

SEQ ID NO: 2502690 - protein, 17 aa, Entamoeba dispar
RLKEIVEQYKLTQAEDE

SEQ ID NO: 2502691 - protein, 17 aa, Entamoeba dispar
RLKEKRTSITTNRSYDV

SEQ ID NO: 2502692 - protein, 19 aa, Entamoeba dispar
RLKIADYGLSRAFGDDSTL

SEQ ID NO: 2502693 - protein, 21 aa, Entamoeba dispar
RLKLFEILRYIFKSLTCYLNL

SEQ ID NO: 2502694 - protein, 20 aa, Entamoeba dispar
RLKNLLGKCLKKEAKKRCKI

SEQ ID NO: 2502695 - protein, 18 aa, Entamoeba dispar
RLKSSFFKIKSMASHNLH

SEQ ID NO: 2502696 - protein, 18 aa, Entamoeba dispar
RLKTHTFDGVPLILENSF

SEQ ID NO: 2502697 - protein, 17 aa, Entamoeba dispar
RLKTLIENGVKLGERTF

SEQ ID NO: 2502698 - protein, 17 aa, Entamoeba dispar
RLKVKAAVKTALKKKTE

SEQ ID NO: 2502699 - protein, 19 aa, Entamoeba dispar
RLLDCVVIAIHHCNKNISI

SEQ ID NO: 2502700 - protein, 24 aa, Entamoeba dispar
RLLDELWMFCFPNGMKASQQKRPF

SEQ ID NO: 2502701 - protein, 29 aa, Entamoeba dispar
RLLEKFFQVYSSWDWLRAPVMLGTNDDFN

SEQ ID NO: 2502702 - protein, 25 aa, Entamoeba dispar
RLLFEELRKSLVRCIEDQNGNHVIQ

SEQ ID NO: 2502703 - protein, 19 aa, Entamoeba dispar
RLLHRSCLPSTTPRNKRGL

SEQ ID NO: 2502704 - protein, 17 aa, Entamoeba dispar
RLLNCPESLFQAVTILK

SEQ ID NO: 2502705 - protein, 27 aa, Entamoeba dispar
RLLSFLRLQKIGFVFQTFNLIASMTAI

SEQ ID NO: 2502706 - protein, 19 aa, Entamoeba dispar
RLLSLCKPTIFTNFINLDR

SEQ ID NO: 2502707 - protein, 19 aa, Entamoeba dispar
RLLVSWNCHSLVVYTEKTE

SEQ ID NO: 2502708 - protein, 19 aa, Entamoeba dispar
RLLYSPVIDGSKELQIILF

SEQ ID NO: 2502709 - protein, 28 aa, Entamoeba dispar
RLLYYVNDWWLRDGIAAAWNVLLDAYDR

SEQ ID NO: 2502710 - protein, 19 aa, Entamoeba dispar
RLMRIFDIDLSGSIGFFEF

SEQ ID NO: 2502711 - protein, 29 aa, Entamoeba dispar
RLNEQFLPMQFGPSFAERIQLEKAIFSYP

SEQ ID NO: 2502712 - protein, 18 aa, Entamoeba dispar
RLNIFGWYNTKKIPSNGF

SEQ ID NO: 2502713 - protein, 18 aa, Entamoeba dispar
RLNIQLKEELFKYVKKYQ

SEQ ID NO: 2502714 - protein, 28 aa, Entamoeba dispar
RLNKFKILRDIAVGLAFIHSLAKIPHGN

SEQ ID NO: 2502715 - protein, 22 aa, Entamoeba dispar
RLNPVEIPFFIPINQHSDTIFK

SEQ ID NO: 2502716 - protein, 17 aa, Entamoeba dispar
RLNQIGVVIGIYSNTLE

SEQ ID NO: 2502717 - protein, 19 aa, Entamoeba dispar
RLNSVTINGKFFGFKHINE

SEQ ID NO: 2502718 - protein, 25 aa, Entamoeba dispar
RLNYLKKLKLCLDNYCKDVKAKKNR

SEQ ID NO: 2502719 - protein, 26 aa, Entamoeba dispar
RLPEDMKRLQLPQMIQLIVNEFHEKT

SEQ ID NO: 2502720 - protein, 26 aa, Entamoeba dispar
RLPEHCIAWASQIAWENPTINTEFPH

SEQ ID NO: 2502721 - protein, 18 aa, Entamoeba dispar
RLPFELMQMDSLSAIPAQ

SEQ ID NO: 2502722 - protein, 24 aa, Entamoeba dispar
RLPFPNICGRVCPHYCQSKCVKAR

SEQ ID NO: 2502723 - protein, 21 aa, Entamoeba dispar
RLPGCTRMIVPLISMLQQLPT

SEQ ID NO: 2502724 - protein, 26 aa, Entamoeba dispar
RLPKANKFIWLFPVHIGEALRYSPER

SEQ ID NO: 2502725 - protein, 24 aa, Entamoeba dispar
RLQFDLSPSSSFLFIPIEDDDLLL

SEQ ID NO: 2502726 - protein, 25 aa, Entamoeba dispar
RLQFDLSPSSSFLFIPIEDDDLLLM

SEQ ID NO: 2502727 - protein, 19 aa, Entamoeba dispar
RLQFKGWDQRKIVDRETQQ

SEQ ID NO: 2502728 - protein, 25 aa, Entamoeba dispar
RLQFQYRMHPCLSEFSSQTFYDGVL

SEQ ID NO: 2502729 - protein, 18 aa, Entamoeba dispar
RLQIDSCNSIHELNLENY

SEQ ID NO: 2502730 - protein, 26 aa, Entamoeba dispar
RLRDLAIEVCERYKGIIPSNVDKLLN

SEQ ID NO: 2502731 - protein, 19 aa, Entamoeba dispar
RLRGIGIALCCHFKGDGHD

SEQ ID NO: 2502732 - protein, 21 aa, Entamoeba dispar
RLRKELERIGLLLINENRMNE

SEQ ID NO: 2502733 - protein, 25 aa, Entamoeba dispar
RLRKELERIRLLLINENRMNEELRN

SEQ ID NO: 2502734 - protein, 21 aa, Entamoeba dispar
RLRKIFFPDFFMKHQNISESH

SEQ ID NO: 2502735 - protein, 22 aa, Entamoeba dispar
RLRPLSYPSTDVFLICYSIMSK

SEQ ID NO: 2502736 - protein, 18 aa, Entamoeba dispar
RLRQITICLDYGSDTVDI

SEQ ID NO: 2502737 - protein, 40 aa, Entamoeba dispar
RLRRYERNKIALAFNELVEIAIKFGYEFGEKNTRKAQKTV

SEQ ID NO: 2502738 - protein, 26 aa, Entamoeba dispar
RLRTIPFTVCKLNQLRNFKLLMNEKL

SEQ ID NO: 2502739 - protein, 29 aa, Entamoeba dispar
RLSDVLQAFLLQRRVSIISMLQDKTSNCL

SEQ ID NO: 2502740 - protein, 20 aa, Entamoeba dispar
RLSISEPILQYNQKKQVQSV

SEQ ID NO: 2502741 - protein, 25 aa, Entamoeba dispar
RLSKELREKYNVIAIPIHKDDEVKI

SEQ ID NO: 2502742 - protein, 24 aa, Entamoeba dispar
RLSWKEVYKHPYVIQSLKLSKRIR

SEQ ID NO: 2502743 - protein, 19 aa, Entamoeba dispar
RLTEAIFEYIKLVDNLDDL

SEQ ID NO: 2502744 - protein, 19 aa, Entamoeba dispar
RLTECYLKGILSLQSPIDS

SEQ ID NO: 2502745 - protein, 22 aa, Entamoeba dispar
RLTEYMNRLVVLPKVHAATAKR

SEQ ID NO: 2502746 - protein, 20 aa, Entamoeba dispar
RLTHFACLYSKLIGANTELF

SEQ ID NO: 2502747 - protein, 21 aa, Entamoeba dispar
RLTKEFADLVLEGCNLIYFPD

SEQ ID NO: 2502748 - protein, 18 aa, Entamoeba dispar
RLTLPGFVLASDTIFISQ

SEQ ID NO: 2502749 - protein, 18 aa, Entamoeba dispar
RLTSVLFPNSLTTIASSS

SEQ ID NO: 2502750 - protein, 18 aa, Entamoeba dispar
RLTSWEFIQTLPEKIQEY

SEQ ID NO: 2502751 - protein, 20 aa, Entamoeba dispar
RLTTSQKYIFGNIIDLFGND

SEQ ID NO: 2502752 - protein, 25 aa, Entamoeba dispar
RLVKSFTDNCFRNSISLINISIPSS

SEQ ID NO: 2502753 - protein, 24 aa, Entamoeba dispar
RLVRYSLDCLNRLSTNPKATLQLH

SEQ ID NO: 2502754 - protein, 18 aa, Entamoeba dispar
RLWSVKSLSALRTLQGHN

SEQ ID NO: 2502755 - protein, 26 aa, Entamoeba dispar
RLYDDCNFKTFSWDIFKALCSTRGES

SEQ ID NO: 2502756 - protein, 23 aa, Entamoeba dispar
RLYKRGSITYQMFTIKSVKKDNK

SEQ ID NO: 2502757 - protein, 27 aa, Entamoeba dispar
RLYNDYFYKRHEGLWEATARKRLPAMA

SEQ ID NO: 2502758 - protein, 24 aa, Entamoeba dispar
RLYNLRLVTILPGFEVQSMVPKSF

SEQ ID NO: 2502759 - protein, 24 aa, Entamoeba dispar
RLYPGERVCQMIFMRMDGTAQYKG

SEQ ID NO: 2502760 - protein, 22 aa, Entamoeba dispar
RLYSRKFIGIKVHSGLLNQQTK

SEQ ID NO: 2502761 - protein, 18 aa, Entamoeba dispar
RLYYKTIPLPFDYQTYFL

SEQ ID NO: 2502762 - protein, 21 aa, Entamoeba dispar
RMCKDLKHIIYYRFNTNSIEK

SEQ ID NO: 2502763 - protein, 18 aa, Entamoeba dispar
RMENGSIRMIKKEGNRIV

SEQ ID NO: 2502764 - protein, 19 aa, Entamoeba dispar
RMGTKFVIHDPAVYKLPSS

SEQ ID NO: 2502765 - protein, 17 aa, Entamoeba dispar
RMHLLRGNHECRLLTTY

SEQ ID NO: 2502766 - protein, 19 aa, Entamoeba dispar
RMIELEILKTQLLNNKISV

SEQ ID NO: 2502767 - protein, 18 aa, Entamoeba dispar
RMIENILIYLYNKGCTTH

SEQ ID NO: 2502768 - protein, 20 aa, Entamoeba dispar
RMIFETIFFNGCMNKVYKEL

SEQ ID NO: 2502769 - protein, 24 aa, Entamoeba dispar
RMIKKEGNRIVLTWERNTGGLVET

SEQ ID NO: 2502770 - protein, 19 aa, Entamoeba dispar
RMILLKTVDLYREFLNHLA

SEQ ID NO: 2502771 - protein, 26 aa, Entamoeba dispar
RMIQCIRLIPCLIFGRGDEECISYYK

SEQ ID NO: 2502772 - protein, 23 aa, Entamoeba dispar
RMKEGARKLFAFEKIENPKLIYI

SEQ ID NO: 2502773 - protein, 20 aa, Entamoeba dispar
RMKGLEVVKDLYWVGVFDKE

SEQ ID NO: 2502774 - protein, 17 aa, Entamoeba dispar
RMKRRSELLKRDINNNQ

SEQ ID NO: 2502775 - protein, 32 aa, Entamoeba dispar
RMLLTICYDTRFPMFVRYNYDYDIIINPINYN

SEQ ID NO: 2502776 - protein, 26 aa, Entamoeba dispar
RMMMMKKELYRMEIVIDELQVQPKET

SEQ ID NO: 2502777 - protein, 24 aa, Entamoeba dispar
RMNAEGPLKFSARQIAQRAITNKR

SEQ ID NO: 2502778 - protein, 24 aa, Entamoeba dispar
RMNFKNIFLEMGFEEMKTDMYVES

SEQ ID NO: 2502779 - protein, 38 aa, Entamoeba dispar
RMNRECWLVYDGKEPFVFTNYFHGWRVNKKQVISVNDN

SEQ ID NO: 2502780 - protein, 23 aa, Entamoeba dispar
RMNRKEINSRMGLKEIIENMKGD

SEQ ID NO: 2502781 - protein, 18 aa, Entamoeba dispar
RMPSSNIIDGNIVESYLE

SEQ ID NO: 2502782 - protein, 19 aa, Entamoeba dispar
RMSKKLPYVKQMLLENTMV

SEQ ID NO: 2502783 - protein, 22 aa, Entamoeba dispar
RMSQRLVTCLAEGMNEEEEIYK

SEQ ID NO: 2502784 - protein, 23 aa, Entamoeba dispar
RMSQRLVTCLAEGMNEEEEIYKG

SEQ ID NO: 2502785 - protein, 17 aa, Entamoeba dispar
RMSTLLGAFSALISLTI

SEQ ID NO: 2502786 - protein, 17 aa, Entamoeba dispar
RMTELICELIKKSNKGW

SEQ ID NO: 2502787 - protein, 28 aa, Entamoeba dispar
RMTENLMKRRAEFIVNHFDELIKRTDSS

SEQ ID NO: 2502788 - protein, 20 aa, Entamoeba dispar
RMTSIQFPKLPSLSRSDKQR

SEQ ID NO: 2502789 - protein, 19 aa, Entamoeba dispar
RMVHFGISFVPSFQTSLTY

SEQ ID NO: 2502790 - protein, 30 aa, Entamoeba dispar
RMVHYNSSLLFNFFVKLSFDDQYENGYILN

SEQ ID NO: 2502791 - protein, 19 aa, Entamoeba dispar
RNACDHLSSCFERGTMIET

SEQ ID NO: 2502792 - protein, 21 aa, Entamoeba dispar
RNAFNKFDIIIGLFNDLKQIH

SEQ ID NO: 2502793 - protein, 25 aa, Entamoeba dispar
RNAFYKNCRIVLDLHEFSVNEFNID

SEQ ID NO: 2502794 - protein, 24 aa, Entamoeba dispar
RNAIKSAFSSFLFPIYSQITKYIT

SEQ ID NO: 2502795 - protein, 20 aa, Entamoeba dispar
RNARHLPEIRGMKERKNLVK

SEQ ID NO: 2502796 - protein, 22 aa, Entamoeba dispar
RNCSYYFGYKAIDEFLQNNNII

SEQ ID NO: 2502797 - protein, 27 aa, Entamoeba dispar
RNDPDFKWEFPKELEIPAELKPKLLKN

SEQ ID NO: 2502798 - protein, 24 aa, Entamoeba dispar
RNDREGSKILLADKEMWEEFQQFV

SEQ ID NO: 2502799 - protein, 18 aa, Entamoeba dispar
RNDVDFIQRILLMKQTNA

SEQ ID NO: 2502800 - protein, 18 aa, Entamoeba dispar
RNEAKKAKEELIKLAEQQ

SEQ ID NO: 2502801 - protein, 19 aa, Entamoeba dispar
RNEELRNLVFFKYPKWTGG

SEQ ID NO: 2502802 - protein, 17 aa, Entamoeba dispar
RNEIPKPVRVISHSPSF

SEQ ID NO: 2502803 - protein, 18 aa, Entamoeba dispar
RNEKGFDYEGYIKKNHSL

SEQ ID NO: 2502804 - protein, 25 aa, Entamoeba dispar
RNELFVPCNYRIASVDVERIGINEI

SEQ ID NO: 2502805 - protein, 24 aa, Entamoeba dispar
RNEMNEIFPYFLVDCKEIKPEHFS

SEQ ID NO: 2502806 - protein, 20 aa, Entamoeba dispar
RNEMTLKYQTEFNLPEKHFI

SEQ ID NO: 2502807 - protein, 23 aa, Entamoeba dispar
RNEWFIKQFHPINLRERRMAKQR

SEQ ID NO: 2502808 - protein, 24 aa, Entamoeba dispar
RNEWFIKQFHPINLRERRMAKQRQ

SEQ ID NO: 2502809 - protein, 30 aa, Entamoeba dispar
RNFLDKRSKSILKHWFMNHLQYPYPSELEK

SEQ ID NO: 2502810 - protein, 20 aa, Entamoeba dispar
RNFLIYSVNDGCGWGVEPSY

SEQ ID NO: 2502811 - protein, 22 aa, Entamoeba dispar
RNFPDLFPSFLSSSLLPDSVFK

SEQ ID NO: 2502812 - protein, 23 aa, Entamoeba dispar
RNFSYEMLEIIQPDVIILGDCAG

SEQ ID NO: 2502813 - protein, 19 aa, Entamoeba dispar
RNFYEMRKNILAKAEKTIE

SEQ ID NO: 2502814 - protein, 18 aa, Entamoeba dispar
RNGCCPTPLIYSDNFPLL

SEQ ID NO: 2502815 - protein, 31 aa, Entamoeba dispar
RNGHWKMIWEELKFKKCKIVDHDYIIWMGDL

SEQ ID NO: 2502816 - protein, 17 aa, Entamoeba dispar
RNGILKERLNLFTNYSN

SEQ ID NO: 2502817 - protein, 33 aa, Entamoeba dispar
RNGISLPIVLCGGDWFIGLFVRQLSCVNQRKKI

SEQ ID NO: 2502818 - protein, 22 aa, Entamoeba dispar
RNGMKEYIPIVSKRESDIYIVF

SEQ ID NO: 2502819 - protein, 20 aa, Entamoeba dispar
RNGMKEYIPLVSKRESDIYI

SEQ ID NO: 2502820 - protein, 19 aa, Entamoeba dispar
RNIAAYPRYHKVFNNLLQE

SEQ ID NO: 2502821 - protein, 25 aa, Entamoeba dispar
RNIEFYLLEMNRLFKRKSKADHLKI

SEQ ID NO: 2502822 - protein, 25 aa, Entamoeba dispar
RNIFIKKQLELLIPIIEARLSDGCV

SEQ ID NO: 2502823 - protein, 17 aa, Entamoeba dispar
RNIIKILGVCSGKNELE

SEQ ID NO: 2502824 - protein, 18 aa, Entamoeba dispar
RNIISIMQMIEWYYQGLL

SEQ ID NO: 2502825 - protein, 19 aa, Entamoeba dispar
RNILETIGGTPLVELHGVT

SEQ ID NO: 2502826 - protein, 19 aa, Entamoeba dispar
RNIPFTIATSSDWGNVQLF

SEQ ID NO: 2502827 - protein, 24 aa, Entamoeba dispar
RNIRMGKYFLEIDIMDLQNFDESL

SEQ ID NO: 2502828 - protein, 23 aa, Entamoeba dispar
RNKHLRKYYFVKDLSHSHSSVER

SEQ ID NO: 2502829 - protein, 17 aa, Entamoeba dispar
RNKITFLPRSSFNENDG

SEQ ID NO: 2502830 - protein, 23 aa, Entamoeba dispar
RNKKGIRCVYRYGKGLIKTDDIH

SEQ ID NO: 2502831 - protein, 21 aa, Entamoeba dispar
RNKMVPVYCVAFGAVPAVSSN

SEQ ID NO: 2502832 - protein, 25 aa, Entamoeba dispar
RNKNRIGHQFFWFLKAELHDNRVTE

SEQ ID NO: 2502833 - protein, 18 aa, Entamoeba dispar
RNKPPFYGYVKRSMNRAP

SEQ ID NO: 2502834 - protein, 27 aa, Entamoeba dispar
RNKRAICNRELLLLSFICGAEVTIDKT

SEQ ID NO: 2502835 - protein, 20 aa, Entamoeba dispar
RNKRPGIGMDSEFLDTLLKT

SEQ ID NO: 2502836 - protein, 25 aa, Entamoeba dispar
RNKSYQIYNCFKLATEVVGRLQSTA

SEQ ID NO: 2502837 - protein, 20 aa, Entamoeba dispar
RNKYPKEDFENMVISEPTDF

SEQ ID NO: 2502838 - protein, 28 aa, Entamoeba dispar
RNLKEVIETVKYLKCLKDKVKEVEELLK

SEQ ID NO: 2502839 - protein, 23 aa, Entamoeba dispar
RNLLLKKINIWLGDNRSQSISFT

SEQ ID NO: 2502840 - protein, 20 aa, Entamoeba dispar
RNLNDSWAFVSPFDRITGHK

SEQ ID NO: 2502841 - protein, 21 aa, Entamoeba dispar
RNLPDRYELYIPAVPSARSLN

SEQ ID NO: 2502842 - protein, 20 aa, Entamoeba dispar
RNLQCIDALLKHLIRINPNL

SEQ ID NO: 2502843 - protein, 27 aa, Entamoeba dispar
RNLQHLTELFISYGYCKVEHFMSMSPD

SEQ ID NO: 2502844 - protein, 18 aa, Entamoeba dispar
RNLYAVVVNSDFKILDGV

SEQ ID NO: 2502845 - protein, 17 aa, Entamoeba dispar
RNMLLFYKDIESLEYAV

SEQ ID NO: 2502846 - protein, 23 aa, Entamoeba dispar
RNMPQMVAAIIRKGKTSLGDKMF

SEQ ID NO: 2502847 - protein, 25 aa, Entamoeba dispar
RNNFRIRYDYEISWGSQPDQILELK

SEQ ID NO: 2502848 - protein, 18 aa, Entamoeba dispar
RNNLFFIIHKSILYHPFI

SEQ ID NO: 2502849 - protein, 22 aa, Entamoeba dispar
RNPENCALILKINRSNNSIDVE

SEQ ID NO: 2502850 - protein, 25 aa, Entamoeba dispar
RNPKYSILLNENWSHLIIPTQKALT

SEQ ID NO: 2502851 - protein, 17 aa, Entamoeba dispar
RNPLKTTTFGVGELIYD

SEQ ID NO: 2502852 - protein, 18 aa, Entamoeba dispar
RNPLLASLQLQIDNKPYP

SEQ ID NO: 2502853 - protein, 21 aa, Entamoeba dispar
RNPRKFKWTKAYRMTTGREMT

SEQ ID NO: 2502854 - protein, 18 aa, Entamoeba dispar
RNPWGCCEWKGKWRDDDP

SEQ ID NO: 2502855 - protein, 19 aa, Entamoeba dispar
RNQIEEYCISNGLDFEKFI

SEQ ID NO: 2502856 - protein, 17 aa, Entamoeba dispar
RNQNFVVLTLREIKGNW

SEQ ID NO: 2502857 - protein, 30 aa, Entamoeba dispar
RNQQFEFKKLFALCVFLAWHYKMPLKKLIN

SEQ ID NO: 2502858 - protein, 22 aa, Entamoeba dispar
RNQRICKFYQIGQCKFGDNCKF

SEQ ID NO: 2502859 - protein, 26 aa, Entamoeba dispar
RNREASFSNALAWLLIDRGYSLQLGI

SEQ ID NO: 2502860 - protein, 19 aa, Entamoeba dispar
RNREGAELMVSYSQATFAT

SEQ ID NO: 2502861 - protein, 24 aa, Entamoeba dispar
RNRKLWNELFYWNSFNTPLTKELL

SEQ ID NO: 2502862 - protein, 18 aa, Entamoeba dispar
RNRLFDRLICDLLYEDAL

SEQ ID NO: 2502863 - protein, 17 aa, Entamoeba dispar
RNRPLEYGPNRHFFDQV

SEQ ID NO: 2502864 - protein, 17 aa, Entamoeba dispar
RNRRYGDSYIFIGKDNV

SEQ ID NO: 2502865 - protein, 19 aa, Entamoeba dispar
RNSGCGLPYLEIPNESLKI

SEQ ID NO: 2502866 - protein, 22 aa, Entamoeba dispar
RNSHIIELIRNWSFGTSNNEIK

SEQ ID NO: 2502867 - protein, 20 aa, Entamoeba dispar
RNSLEKISPFLVSETSEEAI

SEQ ID NO: 2502868 - protein, 19 aa, Entamoeba dispar
RNSLEKISPFLYANSPEEA

SEQ ID NO: 2502869 - protein, 22 aa, Entamoeba dispar
RNSRYGNAFIFIGKSNWYYRKD

SEQ ID NO: 2502870 - protein, 19 aa, Entamoeba dispar
RNSYQWCDNPKFIITSTHP

SEQ ID NO: 2502871 - protein, 23 aa, Entamoeba dispar
RNTESKSSFSLYCNDSHVVLNCY

SEQ ID NO: 2502872 - protein, 23 aa, Entamoeba dispar
RNTIPRVCHLHLSKITAKMPLKA

SEQ ID NO: 2502873 - protein, 18 aa, Entamoeba dispar
RNTMAPVRVFEGHKAPVW

SEQ ID NO: 2502874 - protein, 24 aa, Entamoeba dispar
RNTNKRRGFAIVEFASLASVEKAL

SEQ ID NO: 2502875 - protein, 24 aa, Entamoeba dispar
RNVHLYGGVFLKINGKALVDAEWM

SEQ ID NO: 2502876 - protein, 25 aa, Entamoeba dispar
RNVKYGNCSQFVWSDNGGYAVLEKN

SEQ ID NO: 2502877 - protein, 17 aa, Entamoeba dispar
RNVPGACSLLINTMQHD

SEQ ID NO: 2502878 - protein, 18 aa, Entamoeba dispar
RNVVLEGYTKESLQIVWL

SEQ ID NO: 2502879 - protein, 17 aa, Entamoeba dispar
RNWKPLPGYIKQESSGN

SEQ ID NO: 2502880 - protein, 20 aa, Entamoeba dispar
RPAANAPMWYWFATEQGQAV

SEQ ID NO: 2502881 - protein, 24 aa, Entamoeba dispar
RPAKKGIKNQVIRLLPEQVSALIL

SEQ ID NO: 2502882 - protein, 20 aa, Entamoeba dispar
RPASVALKKASSFAGCIDKI

SEQ ID NO: 2502883 - protein, 21 aa, Entamoeba dispar
RPASYLCRYFGISLAAATNTD

SEQ ID NO: 2502884 - protein, 22 aa, Entamoeba dispar
RPDEAVSWGKIKIESENVKVLA

SEQ ID NO: 2502885 - protein, 21 aa, Entamoeba dispar
RPDKQIVMFSATFPISVEQHA

SEQ ID NO: 2502886 - protein, 25 aa, Entamoeba dispar
RPEKLPDVCYSWWVLTSLIILGKVD

SEQ ID NO: 2502887 - protein, 19 aa, Entamoeba dispar
RPELVPGGGASEMHIATTL

SEQ ID NO: 2502888 - protein, 23 aa, Entamoeba dispar
RPENRPRCCTFSMKGQFNSTFDR

SEQ ID NO: 2502889 - protein, 17 aa, Entamoeba dispar
RPESVCSSTPCKSISQI

SEQ ID NO: 2502890 - protein, 39 aa, Entamoeba dispar
RPFYIKPPNSMGYLTLKFSKSGKIIPQYLYDDQLSLAAQ

SEQ ID NO: 2502891 - protein, 24 aa, Entamoeba dispar
RPGQTCTFVGILIAAPDTTRLSVG

SEQ ID NO: 2502892 - protein, 18 aa, Entamoeba dispar
RPGRFDCLIEVPKPDHKT

SEQ ID NO: 2502893 - protein, 18 aa, Entamoeba dispar
RPGYLKLVNGYRKLKQAN

SEQ ID NO: 2502894 - protein, 19 aa, Entamoeba dispar
RPHQYGILIEIYRKENIPL

SEQ ID NO: 2502895 - protein, 22 aa, Entamoeba dispar
RPIFKRLYLNYTQMKDFHKEQG

SEQ ID NO: 2502896 - protein, 18 aa, Entamoeba dispar
RPIIDKLDLIKEISDKDI

SEQ ID NO: 2502897 - protein, 20 aa, Entamoeba dispar
RPIPNNKRRTSIDPLEQLEN

SEQ ID NO: 2502898 - protein, 18 aa, Entamoeba dispar
RPITIQFHKLKSYFQKDP

SEQ ID NO: 2502899 - protein, 21 aa, Entamoeba dispar
RPIYIYLGCCIKKDFHQQVYL

SEQ ID NO: 2502900 - protein, 19 aa, Entamoeba dispar
RPKITKIIWNEQGDACSVS

SEQ ID NO: 2502901 - protein, 18 aa, Entamoeba dispar
RPKKDLGAIAMAYGDVYV

SEQ ID NO: 2502902 - protein, 23 aa, Entamoeba dispar
RPKLPKEAVCSFFGDSSKNLFGI

SEQ ID NO: 2502903 - protein, 20 aa, Entamoeba dispar
RPKLTEVLSHLASRAVNLET

SEQ ID NO: 2502904 - protein, 19 aa, Entamoeba dispar
RPKPGLAEQHIVCIKSIGE

SEQ ID NO: 2502905 - protein, 21 aa, Entamoeba dispar
RPKSESMALAIMFIDNNDNTI

SEQ ID NO: 2502906 - protein, 19 aa, Entamoeba dispar
RPLGAGREVGRSCFILKYM

SEQ ID NO: 2502907 - protein, 20 aa, Entamoeba dispar
RPLIDMAVSICDRTSKISSI

SEQ ID NO: 2502908 - protein, 20 aa, Entamoeba dispar
RPLKNLSLPLFITYLSFKEC

SEQ ID NO: 2502909 - protein, 25 aa, Entamoeba dispar
RPLLGRTGILKDFNLILGTDKTGMM

SEQ ID NO: 2502910 - protein, 19 aa, Entamoeba dispar
RPLLPTLKFSEGVSEWKVF

SEQ ID NO: 2502911 - protein, 19 aa, Entamoeba dispar
RPLLTCEPITKCVRDLLVL

SEQ ID NO: 2502912 - protein, 19 aa, Entamoeba dispar
RPLSEILPPVIDLLQDPKV

SEQ ID NO: 2502913 - protein, 22 aa, Entamoeba dispar
RPMQGNCILFAIDQFCFESVKD

SEQ ID NO: 2502914 - protein, 19 aa, Entamoeba dispar
RPNEYDVHHILLAHSASLF

SEQ ID NO: 2502915 - protein, 21 aa, Entamoeba dispar
RPNVCGLILAGIADFKTVLNK

SEQ ID NO: 2502916 - protein, 17 aa, Entamoeba dispar
RPPELLLGCTLYGSEID

SEQ ID NO: 2502917 - protein, 18 aa, Entamoeba dispar
RPPELLLGETRYKGEVDM

SEQ ID NO: 2502918 - protein, 17 aa, Entamoeba dispar
RPQIKKKYATILADLRK

SEQ ID NO: 2502919 - protein, 17 aa, Entamoeba dispar
RPQLRAETEKELTKICS

SEQ ID NO: 2502920 - protein, 19 aa, Entamoeba dispar
RPQVKVTMGDPFLGGNDID

SEQ ID NO: 2502921 - protein, 21 aa, Entamoeba dispar
RPRSFKARPIINHADGTKQTF

SEQ ID NO: 2502922 - protein, 19 aa, Entamoeba dispar
RPSFSDIFFSSESGTDGEV

SEQ ID NO: 2502923 - protein, 19 aa, Entamoeba dispar
RPSGPRKGQSIQVPLKCDL

SEQ ID NO: 2502924 - protein, 19 aa, Entamoeba dispar
RPSVESIRGHPLIRLCRQH

SEQ ID NO: 2502925 - protein, 17 aa, Entamoeba dispar
RPSVKINKQEFILKIYP

SEQ ID NO: 2502926 - protein, 18 aa, Entamoeba dispar
RPSYCKTHNFSLTPRQRG

SEQ ID NO: 2502927 - protein, 19 aa, Entamoeba dispar
RPSYHCELFSEWVLKQANR

SEQ ID NO: 2502928 - protein, 19 aa, Entamoeba dispar
RPTINWYNLFKNTSIGSYT

SEQ ID NO: 2502929 - protein, 18 aa, Entamoeba dispar
RPTLDKLPELSLPNNLPK

SEQ ID NO: 2502930 - protein, 23 aa, Entamoeba dispar
RPTPLCHYLFPAGGNGIYLVVDK

SEQ ID NO: 2502931 - protein, 21 aa, Entamoeba dispar
RPTRDISLNDNCHHITPMEKF

SEQ ID NO: 2502932 - protein, 20 aa, Entamoeba dispar
RPVAHGNGGLGISNLTMTAG

SEQ ID NO: 2502933 - protein, 28 aa, Entamoeba dispar
RPVKKGDHFLCHGGMRTVEFKVVDIDPS

SEQ ID NO: 2502934 - protein, 28 aa, Entamoeba dispar
RQACAAFDYKCVLVLGIVNNEIIEQHKG

SEQ ID NO: 2502935 - protein, 17 aa, Entamoeba dispar
RQAVILVENEITDMECN

SEQ ID NO: 2502936 - protein, 21 aa, Entamoeba dispar
RQAYELLKKDATNFMNAYDSA

SEQ ID NO: 2502937 - protein, 22 aa, Entamoeba dispar
RQAYELLKKDATNFMNAYDSAS

SEQ ID NO: 2502938 - protein, 21 aa, Entamoeba dispar
RQDKPCCIKPFPSSSSICKPV

SEQ ID NO: 2502939 - protein, 22 aa, Entamoeba dispar
RQEEYYYLFQIVSYLYFAPFRQ

SEQ ID NO: 2502940 - protein, 17 aa, Entamoeba dispar
RQEGMFFDIIGYVIDII

SEQ ID NO: 2502941 - protein, 26 aa, Entamoeba dispar
RQEIDLRVGVAFTRLQTKFLKERFPK

SEQ ID NO: 2502942 - protein, 28 aa, Entamoeba dispar
RQENNLFQSVAIPQAYRNQMFQCSIPCI

SEQ ID NO: 2502943 - protein, 19 aa, Entamoeba dispar
RQESFPSISSIKMTKDGNT

SEQ ID NO: 2502944 - protein, 20 aa, Entamoeba dispar
RQFEFRKMNKLYAYRTNVAQ

SEQ ID NO: 2502945 - protein, 24 aa, Entamoeba dispar
RQFIPELIEQIPITTKPLIKKEIS

SEQ ID NO: 2502946 - protein, 23 aa, Entamoeba dispar
RQFPSLKYFWFKQNKPMMFIAAN

SEQ ID NO: 2502947 - protein, 20 aa, Entamoeba dispar
RQGVEMPLNEVLQLTRIYQS

SEQ ID NO: 2502948 - protein, 21 aa, Entamoeba dispar
RQHCEKEIRSIFKHIRELLHI

SEQ ID NO: 2502949 - protein, 23 aa, Entamoeba dispar
RQIKKKVLKYIVTFRGDLSQISE

SEQ ID NO: 2502950 - protein, 23 aa, Entamoeba dispar
RQILRNEYQFGIINKINEIERKM

SEQ ID NO: 2502951 - protein, 17 aa, Entamoeba dispar
RQIVKSDHCSINFPSIG

SEQ ID NO: 2502952 - protein, 25 aa, Entamoeba dispar
RQKEMCTMCGKQIDISKDIIIDKKT

SEQ ID NO: 2502953 - protein, 26 aa, Entamoeba dispar
RQKKLEYLFSQLIRYVPQFNKEAQSA

SEQ ID NO: 2502954 - protein, 19 aa, Entamoeba dispar
RQKPEVLKKIVKRRYGDVL

SEQ ID NO: 2502955 - protein, 28 aa, Entamoeba dispar
RQKYLNCMLEHLSLIFTQRSCSINQSNQ

SEQ ID NO: 2502956 - protein, 19 aa, Entamoeba dispar
RQLEIESFLSPIPSQPISK

SEQ ID NO: 2502957 - protein, 19 aa, Entamoeba dispar
RQLEWDKRCVTVVVTPNET

SEQ ID NO: 2502958 - protein, 17 aa, Entamoeba dispar
RQLIQHYEWFYLNKDEK

SEQ ID NO: 2502959 - protein, 22 aa, Entamoeba dispar
RQLKLMHSYSIFLRKKKESVNR

SEQ ID NO: 2502960 - protein, 21 aa, Entamoeba dispar
RQLQKTKKCYLVSKRDNGSEF

SEQ ID NO: 2502961 - protein, 25 aa, Entamoeba dispar
RQMIETYCPIDFVMRGVGGKHGWNS

SEQ ID NO: 2502962 - protein, 17 aa, Entamoeba dispar
RQMKQKGLMKINEVRQA

SEQ ID NO: 2502963 - protein, 23 aa, Entamoeba dispar
RQMLHRILFLFAIKHPELNYTQG

SEQ ID NO: 2502964 - protein, 19 aa, Entamoeba dispar
RQMLPGQIPSSGGVQQQPP

SEQ ID NO: 2502965 - protein, 20 aa, Entamoeba dispar
RQNEVLQLLDIVSHYEEYST

SEQ ID NO: 2502966 - protein, 21 aa, Entamoeba dispar
RQNEVLQLLDIVSHYEEYSTY

SEQ ID NO: 2502967 - protein, 20 aa, Entamoeba dispar
RQNQRCEICQQFGKMTHVFH

SEQ ID NO: 2502968 - protein, 19 aa, Entamoeba dispar
RQNSIKAIDVFQPDKYYFI

SEQ ID NO: 2502969 - protein, 21 aa, Entamoeba dispar
RQQDFCFVMILSLLGESELPC

SEQ ID NO: 2502970 - protein, 18 aa, Entamoeba dispar
RQQISLLLKQLEIAQNEI

SEQ ID NO: 2502971 - protein, 18 aa, Entamoeba dispar
RQQLPPREGRRYGERKEH

SEQ ID NO: 2502972 - protein, 32 aa, Entamoeba dispar
RQQRPWCLRFEYWKQILPMSASIVEKVNTLIK

SEQ ID NO: 2502973 - protein, 22 aa, Entamoeba dispar
RQRKSSFKKWMISSPENSRNLY

SEQ ID NO: 2502974 - protein, 24 aa, Entamoeba dispar
RQRPIQFAHGGFQPTIPGTKNVIE

SEQ ID NO: 2502975 - protein, 17 aa, Entamoeba dispar
RQRPTGKYVIEWGAILA

SEQ ID NO: 2502976 - protein, 18 aa, Entamoeba dispar
RQRYSIPKKTKRRITNKT

SEQ ID NO: 2502977 - protein, 24 aa, Entamoeba dispar
RQSEFRFKLDGVISSRMDKVHSAF

SEQ ID NO: 2502978 - protein, 21 aa, Entamoeba dispar
RQSSELMEIDSTFNFDNKKEE

SEQ ID NO: 2502979 - protein, 17 aa, Entamoeba dispar
RQSSILCDDKKHFMFTL

SEQ ID NO: 2502980 - protein, 19 aa, Entamoeba dispar
RQTEVLKMTGNVIKMNLFK

SEQ ID NO: 2502981 - protein, 18 aa, Entamoeba dispar
RQTLMFSATFPKQIQRLA

SEQ ID NO: 2502982 - protein, 19 aa, Entamoeba dispar
RQTQLLISNIIQWKDEELL

SEQ ID NO: 2502983 - protein, 25 aa, Entamoeba dispar
RQTSCKSRVILLLISALKYFTKNGE

SEQ ID NO: 2502984 - protein, 28 aa, Entamoeba dispar
RQVPLCNGFDPSSCEQRYMWVWTTRDFY

SEQ ID NO: 2502985 - protein, 21 aa, Entamoeba dispar
RQVRARVSVLLKDAAEQRKEH

SEQ ID NO: 2502986 - protein, 23 aa, Entamoeba dispar
RQVSRFPFGYVVNNRLNDTLCLP

SEQ ID NO: 2502987 - protein, 17 aa, Entamoeba dispar
RQWCITNGYEFFECSAK

SEQ ID NO: 2502988 - protein, 35 aa, Entamoeba dispar
RQYFPEPIVFKVLFEVYKRLYGITFCYNKTVKGWH

SEQ ID NO: 2502989 - protein, 21 aa, Entamoeba dispar
RQYIIDLINTWNGSFPNEIIQ

SEQ ID NO: 2502990 - protein, 21 aa, Entamoeba dispar
RQYLEKIFKVFGYELPTDPKF

SEQ ID NO: 2502991 - protein, 17 aa, Entamoeba dispar
RQYLNDIFTILIKKNKN

SEQ ID NO: 2502992 - protein, 25 aa, Entamoeba dispar
RQYRCPEVMLGLHWGCPADVWSHAC

SEQ ID NO: 2502993 - protein, 19 aa, Entamoeba dispar
RRAETMKRYGATVILHGVT

SEQ ID NO: 2502994 - protein, 21 aa, Entamoeba dispar
RRAKVIKVNTMLSGLHDLQLV

SEQ ID NO: 2502995 - protein, 20 aa, Entamoeba dispar
RRALKGNISPLFSLKLQDNI

SEQ ID NO: 2502996 - protein, 18 aa, Entamoeba dispar
RRDFYFWEGKKSTPLYYS

SEQ ID NO: 2502997 - protein, 20 aa, Entamoeba dispar
RRDIFFLLLHGIKLKNLDYP

SEQ ID NO: 2502998 - protein, 24 aa, Entamoeba dispar
RRDKTRAGLRFSSRGADSSGNVSN

SEQ ID NO: 2502999 - protein, 24 aa, Entamoeba dispar
RRDLMKEIYEEVSVKEEENDDDDD

SEQ ID NO: 2503000 - protein, 25 aa, Entamoeba dispar
RRDLNRAALTFNWLVEYAEQNGYTI

SEQ ID NO: 2503001 - protein, 26 aa, Entamoeba dispar
RRDNLLKRKYYDSFLFNSFSDELAKS

SEQ ID NO: 2503002 - protein, 17 aa, Entamoeba dispar
RRDTFRASKTMQERVLN

SEQ ID NO: 2503003 - protein, 17 aa, Entamoeba dispar
RRECLTINILNDENLKL

SEQ ID NO: 2503004 - protein, 19 aa, Entamoeba dispar
RRECTKCNKGYELEHGECK

SEQ ID NO: 2503005 - protein, 24 aa, Entamoeba dispar
RREEVCKILRKPYYGDNVIAVYGK

SEQ ID NO: 2503006 - protein, 23 aa, Entamoeba dispar
RREFIPVKAINKGVEVIGHLVQL

SEQ ID NO: 2503007 - protein, 19 aa, Entamoeba dispar
RREIHCSRKGNGNHNRSHS

SEQ ID NO: 2503008 - protein, 19 aa, Entamoeba dispar
RREKGIAELRKSRRERRLE

SEQ ID NO: 2503009 - protein, 21 aa, Entamoeba dispar
RREMKQLDMVYLMKVALHVKD

SEQ ID NO: 2503010 - protein, 22 aa, Entamoeba dispar
RREQLIKERESFLTKREEELHR

SEQ ID NO: 2503011 - protein, 25 aa, Entamoeba dispar
RREREEFYRKAGLKGLEKEMEREKR

SEQ ID NO: 2503012 - protein, 19 aa, Entamoeba dispar
RRFAFQILSALNFLQQPGI

SEQ ID NO: 2503013 - protein, 17 aa, Entamoeba dispar
RRFILKIKPTLYSFILI

SEQ ID NO: 2503014 - protein, 21 aa, Entamoeba dispar
RRFQMVVSILVRIMKRLKRIS

SEQ ID NO: 2503015 - protein, 28 aa, Entamoeba dispar
RRFSNFKFPECFCIIAERPFESLFKKIL

SEQ ID NO: 2503016 - protein, 18 aa, Entamoeba dispar
RRFTDFRTQKAVQLSGGK

SEQ ID NO: 2503017 - protein, 20 aa, Entamoeba dispar
RRFYIFLCLQPHVIWLVKAL

SEQ ID NO: 2503018 - protein, 22 aa, Entamoeba dispar
RRGGCDYCAMLSTSIECDASDA

SEQ ID NO: 2503019 - protein, 28 aa, Entamoeba dispar
RRGIQILKMRYLIIYKYYSDKSVILALI

SEQ ID NO: 2503020 - protein, 31 aa, Entamoeba dispar
RRGKQIYKIFCSLRLLVLDVLTQILKTIPEE

SEQ ID NO: 2503021 - protein, 18 aa, Entamoeba dispar
RRGLRKDEHGIWRRRSLS

SEQ ID NO: 2503022 - protein, 17 aa, Entamoeba dispar
RRHFYELFKSCEEGEVI

SEQ ID NO: 2503023 - protein, 26 aa, Entamoeba dispar
RRHHCRKCGKCICGECSKGRIPITPQ

SEQ ID NO: 2503024 - protein, 26 aa, Entamoeba dispar
RRHHCRKCGRVLCAECTKRRVVIPHI

SEQ ID NO: 2503025 - protein, 20 aa, Entamoeba dispar
RRHLSFKMIGIMIILKNGNK

SEQ ID NO: 2503026 - protein, 21 aa, Entamoeba dispar
RRHSLSAFSPAAPTEFTVTAF

SEQ ID NO: 2503027 - protein, 22 aa, Entamoeba dispar
RRIALAAQVRRVIKNGHIKDKN

SEQ ID NO: 2503028 - protein, 17 aa, Entamoeba dispar
RRIEVAAKLGGMKNFEV

SEQ ID NO: 2503029 - protein, 18 aa, Entamoeba dispar
RRIGHYAMMIVSKYFNDI

SEQ ID NO: 2503030 - protein, 23 aa, Entamoeba dispar
RRIIKKVIWYKVSYSTYLQEKEQ

SEQ ID NO: 2503031 - protein, 18 aa, Entamoeba dispar
RRIKQLGTAHYIFPSGTH

SEQ ID NO: 2503032 - protein, 22 aa, Entamoeba dispar
RRILDDMLPPFIGKYTRGLLLG

SEQ ID NO: 2503033 - protein, 25 aa, Entamoeba dispar
RRILVKRLEDGLSIVSILDSSQIYS

SEQ ID NO: 2503034 - protein, 19 aa, Entamoeba dispar
RRIVFGIPEERSRSKSSLA

SEQ ID NO: 2503035 - protein, 24 aa, Entamoeba dispar
RRKATKCCFCQNDLVIGYNDGIIK

SEQ ID NO: 2503036 - protein, 22 aa, Entamoeba dispar
RRKDFIKRAHIRKLQEETTTYL

SEQ ID NO: 2503037 - protein, 25 aa, Entamoeba dispar
RRKEIRILFEYCDMGTFDQFIPSCS

SEQ ID NO: 2503038 - protein, 17 aa, Entamoeba dispar
RRKHSIILPQHLTSLTI

SEQ ID NO: 2503039 - protein, 25 aa, Entamoeba dispar
RRKKRKSYVIFIQKRLDLVEQLQNQ

SEQ ID NO: 2503040 - protein, 21 aa, Entamoeba dispar
RRKLLYYGLLIPINEEFPKKG

SEQ ID NO: 2503041 - protein, 22 aa, Entamoeba dispar
RRKRIPLRKNTLIWGLKNDFTL

SEQ ID NO: 2503042 - protein, 21 aa, Entamoeba dispar
RRKTTRFSAEFGKELQEALLR

SEQ ID NO: 2503043 - protein, 17 aa, Entamoeba dispar
RRLAIMVDIPKYLNELC

SEQ ID NO: 2503044 - protein, 18 aa, Entamoeba dispar
RRLDSCVPNDVIIDTEYL

SEQ ID NO: 2503045 - protein, 21 aa, Entamoeba dispar
RRLGSSLDWSREVFTMDEKRG

SEQ ID NO: 2503046 - protein, 19 aa, Entamoeba dispar
RRLIELLLVRGYSFNRTAD

SEQ ID NO: 2503047 - protein, 26 aa, Entamoeba dispar
RRLLFEELRKSLVRCIEDQNGNHVIQ

SEQ ID NO: 2503048 - protein, 17 aa, Entamoeba dispar
RRLNPRKVDDNAIEEKK

SEQ ID NO: 2503049 - protein, 19 aa, Entamoeba dispar
RRLPHCQYVGVYKRRKFEE

SEQ ID NO: 2503050 - protein, 21 aa, Entamoeba dispar
RRLPHCQYVGVYKRRKFEEKK

SEQ ID NO: 2503051 - protein, 24 aa, Entamoeba dispar
RRLPWSKYVRRPSTRAVRLPDPQG

SEQ ID NO: 2503052 - protein, 19 aa, Entamoeba dispar
RRLQTLVYRKGFAKSIHHA

SEQ ID NO: 2503053 - protein, 21 aa, Entamoeba dispar
RRLRVGVSFEKELKKCWGESV

SEQ ID NO: 2503054 - protein, 20 aa, Entamoeba dispar
RRLSQHVLKMHRHFDALSEQ

SEQ ID NO: 2503055 - protein, 22 aa, Entamoeba dispar
RRLWRREHPPGFIARPRTTKEG

SEQ ID NO: 2503056 - protein, 18 aa, Entamoeba dispar
RRMIPVLLNNIVLQKTNT

SEQ ID NO: 2503057 - protein, 21 aa, Entamoeba dispar
RRMKEGPFIFSVDRHTLVGYL

SEQ ID NO: 2503058 - protein, 17 aa, Entamoeba dispar
RRNECYEEYKKVYREIV

SEQ ID NO: 2503059 - protein, 21 aa, Entamoeba dispar
RRNFKEYSWGKSQYLMTHTWH

SEQ ID NO: 2503060 - protein, 20 aa, Entamoeba dispar
RRNRIKWSDLIYEDSTYVNN

SEQ ID NO: 2503061 - protein, 20 aa, Entamoeba dispar
RRNVNEFIIPTTISKLGKYC

SEQ ID NO: 2503062 - protein, 22 aa, Entamoeba dispar
RRPFKCILDVGLARTTTGSKVF

SEQ ID NO: 2503063 - protein, 17 aa, Entamoeba dispar
RRPHSFKARPIINHSDG

SEQ ID NO: 2503064 - protein, 25 aa, Entamoeba dispar
RRPIQITCRFYQLGLLMLFNDNKEI

SEQ ID NO: 2503065 - protein, 24 aa, Entamoeba dispar
RRPKDYNPVLPFISGLSQLMEPGT

SEQ ID NO: 2503066 - protein, 31 aa, Entamoeba dispar
RRPKISVRRRRFKTFNGRTLEECRQFGYALN

SEQ ID NO: 2503067 - protein, 17 aa, Entamoeba dispar
RRPLPPLPIQETKTRST

SEQ ID NO: 2503068 - protein, 25 aa, Entamoeba dispar
RRPSGICGVALYLAGRLHGEPRTLE

SEQ ID NO: 2503069 - protein, 19 aa, Entamoeba dispar
RRQASHFCHVLPHRFIANA

SEQ ID NO: 2503070 - protein, 26 aa, Entamoeba dispar
RRQAYELLKKDAANFMNAYDSATEHD

SEQ ID NO: 2503071 - protein, 26 aa, Entamoeba dispar
RRQAYELLKKDAINFMNAYDSATEHD

SEQ ID NO: 2503072 - protein, 23 aa, Entamoeba dispar
RRQELEMAMGSVPAGLSVTSDLL

SEQ ID NO: 2503073 - protein, 23 aa, Entamoeba dispar
RRQIEIKTLHSFQKIKESTGQDV

SEQ ID NO: 2503074 - protein, 17 aa, Entamoeba dispar
RRQRVMRQNGYTFKVID

SEQ ID NO: 2503075 - protein, 21 aa, Entamoeba dispar
RRQSCALAIDEVHEIQKVVGV

SEQ ID NO: 2503076 - protein, 31 aa, Entamoeba dispar
RRQTQVSIRFFKMLLDISGLMTEEIPLYIEL

SEQ ID NO: 2503077 - protein, 21 aa, Entamoeba dispar
RRREEFNKRENLPMANREEKE

SEQ ID NO: 2503078 - protein, 17 aa, Entamoeba dispar
RRRIKVEIWDTPGQEIF

SEQ ID NO: 2503079 - protein, 18 aa, Entamoeba dispar
RRRILKKIEGTFDINKEY

SEQ ID NO: 2503080 - protein, 22 aa, Entamoeba dispar
RRRIQSQSFIFVKGVPLNFERY

SEQ ID NO: 2503081 - protein, 26 aa, Entamoeba dispar
RRRLVKRLYIPLPDIEARMTLVKTLL

SEQ ID NO: 2503082 - protein, 20 aa, Entamoeba dispar
RRRTKDYILLAWYYSPALAV

SEQ ID NO: 2503083 - protein, 21 aa, Entamoeba dispar
RRRVCVDGKTLSLYDLIVQEL

SEQ ID NO: 2503084 - protein, 25 aa, Entamoeba dispar
RRSKKTECPFRINLNYRTKTKTWNI

SEQ ID NO: 2503085 - protein, 22 aa, Entamoeba dispar
RRSLEGVFRISTDVNVIDNYMD

SEQ ID NO: 2503086 - protein, 25 aa, Entamoeba dispar
RRSLSFKLGEIAGMMNSQVIGSSPQ

SEQ ID NO: 2503087 - protein, 24 aa, Entamoeba dispar
RRSSPPLPEYRNSYRSPINKNYRS

SEQ ID NO: 2503088 - protein, 17 aa, Entamoeba dispar
RRTEIEEGIKYLINCMK

SEQ ID NO: 2503089 - protein, 25 aa, Entamoeba dispar
RRTIASKFRIGRQAQSAFMKVTKPT

SEQ ID NO: 2503090 - protein, 22 aa, Entamoeba dispar
RRTLLNEIRKNAGLEKDIQDME

SEQ ID NO: 2503091 - protein, 21 aa, Entamoeba dispar
RRTSTEYDYPYSLRNTQRDYQ

SEQ ID NO: 2503092 - protein, 25 aa, Entamoeba dispar
RRVKCSKNGLLACCSFDSTVSLWEL

SEQ ID NO: 2503093 - protein, 20 aa, Entamoeba dispar
RRVSFAKVCLEVMTKDSDVN

SEQ ID NO: 2503094 - protein, 21 aa, Entamoeba dispar
RRVTKELLTIIGKIHPQAIVY

SEQ ID NO: 2503095 - protein, 22 aa, Entamoeba dispar
RRWIKEIYYDTSLVCSKREFSI

SEQ ID NO: 2503096 - protein, 18 aa, Entamoeba dispar
RRWKDRGASVASMSFAEK

SEQ ID NO: 2503097 - protein, 17 aa, Entamoeba dispar
RRWTLRGILPQYTLCHK

SEQ ID NO: 2503098 - protein, 30 aa, Entamoeba dispar
RRYDRLRYSIVMRLLDICSNFSIKESTRLS

SEQ ID NO: 2503099 - protein, 21 aa, Entamoeba dispar
RRYFQTWDFIKERIGSKEDGK

SEQ ID NO: 2503100 - protein, 21 aa, Entamoeba dispar
RRYICSGPMFVVPNLKDKPKD

SEQ ID NO: 2503101 - protein, 17 aa, Entamoeba dispar
RRYLHRDLKPQNILIDK

SEQ ID NO: 2503102 - protein, 21 aa, Entamoeba dispar
RRYPRMLSYYMEYANWCKSIE

SEQ ID NO: 2503103 - protein, 22 aa, Entamoeba dispar
RRYTILDAPGHRSFVPNMISAA

SEQ ID NO: 2503104 - protein, 25 aa, Entamoeba dispar
RSAEERKPSMKFTMLEQEKEDLKKK

SEQ ID NO: 2503105 - protein, 19 aa, Entamoeba dispar
RSAGLPYHLSALLNEDAMV

SEQ ID NO: 2503106 - protein, 18 aa, Entamoeba dispar
RSASFGKGGERIAFEGIF

SEQ ID NO: 2503107 - protein, 19 aa, Entamoeba dispar
RSCFSRGHHFDLKKGIQLS

SEQ ID NO: 2503108 - protein, 20 aa, Entamoeba dispar
RSDFEIHWKTFINLKDITFD

SEQ ID NO: 2503109 - protein, 17 aa, Entamoeba dispar
RSDGLEVIGQQQPLTLG

SEQ ID NO: 2503110 - protein, 21 aa, Entamoeba dispar
RSDMLAVQMIELFDRINKHAG

SEQ ID NO: 2503111 - protein, 21 aa, Entamoeba dispar
RSDTKLLWLHYPQRSICQCAL

SEQ ID NO: 2503112 - protein, 25 aa, Entamoeba dispar
RSDYFFCGTFNILLERDEVINRGNK

SEQ ID NO: 2503113 - protein, 25 aa, Entamoeba dispar
RSEEDIKIFITQFVKRCVNENKFCK

SEQ ID NO: 2503114 - protein, 18 aa, Entamoeba dispar
RSEGFIIQTLFKEDIKME

SEQ ID NO: 2503115 - protein, 27 aa, Entamoeba dispar
RSEPELTERFELFILKREIANAYTELN

SEQ ID NO: 2503116 - protein, 23 aa, Entamoeba dispar
RSERFKNNFLQVVDRYNENLVKD

SEQ ID NO: 2503117 - protein, 24 aa, Entamoeba dispar
RSERSLPIRFSRGDLYMKDGDNEL

SEQ ID NO: 2503118 - protein, 17 aa, Entamoeba dispar
RSESIIVHPNFRLIGTR

SEQ ID NO: 2503119 - protein, 21 aa, Entamoeba dispar
RSEYALTLLECINQVNKQVIS

SEQ ID NO: 2503120 - protein, 22 aa, Entamoeba dispar
RSFEEYFQWFIAGLKNVMNKLI

SEQ ID NO: 2503121 - protein, 29 aa, Entamoeba dispar
RSFEKYKIILKVSCCLYMGTDKLCNKEYF

SEQ ID NO: 2503122 - protein, 18 aa, Entamoeba dispar
RSFGEWISSIFKKTLNGF

SEQ ID NO: 2503123 - protein, 19 aa, Entamoeba dispar
RSFGGQCLHTINPQDPTFN

SEQ ID NO: 2503124 - protein, 23 aa, Entamoeba dispar
RSFGKSCFYGCGCEEELKKNKTI

SEQ ID NO: 2503125 - protein, 19 aa, Entamoeba dispar
RSFHPTDLLEIIQKKLEKE

SEQ ID NO: 2503126 - protein, 17 aa, Entamoeba dispar
RSFLERLSRFLPHLQTL

SEQ ID NO: 2503127 - protein, 26 aa, Entamoeba dispar
RSFRGNWPVPYIKKILVFSTDEECAN

SEQ ID NO: 2503128 - protein, 17 aa, Entamoeba dispar
RSFRIEGKINIMKEVMI

SEQ ID NO: 2503129 - protein, 29 aa, Entamoeba dispar
RSFSTVCLLLSLWNVVDCPFRAMDEFDVY

SEQ ID NO: 2503130 - protein, 19 aa, Entamoeba dispar
RSFTSACEFNKQIVTALNR

SEQ ID NO: 2503131 - protein, 20 aa, Entamoeba dispar
RSFYKAIALIGFINQKKLLS

SEQ ID NO: 2503132 - protein, 19 aa, Entamoeba dispar
RSGAINVLQSRFIQSYVPQ

SEQ ID NO: 2503133 - protein, 24 aa, Entamoeba dispar
RSGSLKISSLMIGVSNILKLYFPD

SEQ ID NO: 2503134 - protein, 19 aa, Entamoeba dispar
RSHEEYFQRVYKWKDCGKI

SEQ ID NO: 2503135 - protein, 23 aa, Entamoeba dispar
RSIAEKMTPCLAWDSHDALDKRM

SEQ ID NO: 2503136 - protein, 21 aa, Entamoeba dispar
RSIEEFKQWLLQRPQSKEIDL

SEQ ID NO: 2503137 - protein, 20 aa, Entamoeba dispar
RSIKCNYKYPIVATTCSVVN

SEQ ID NO: 2503138 - protein, 23 aa, Entamoeba dispar
RSILELWILPEYVMTTKKMLNDL

SEQ ID NO: 2503139 - protein, 17 aa, Entamoeba dispar
RSILNFFTELSMLNENL

SEQ ID NO: 2503140 - protein, 25 aa, Entamoeba dispar
RSIPPKCFLECISLQNIVIPEGIAS

SEQ ID NO: 2503141 - protein, 27 aa, Entamoeba dispar
RSISSRKTISWMPLCLNDFNEKAQIHV

SEQ ID NO: 2503142 - protein, 27 aa, Entamoeba dispar
RSKCSIVAPLPKRVWQKKVESPNYKHG

SEQ ID NO: 2503143 - protein, 20 aa, Entamoeba dispar
RSKGKGVFVGCEISKNNLPG

SEQ ID NO: 2503144 - protein, 20 aa, Entamoeba dispar
RSKIRREHPQFFVINKDFVK

SEQ ID NO: 2503145 - protein, 19 aa, Entamoeba dispar
RSKISHYALKVLRGDSIII

SEQ ID NO: 2503146 - protein, 18 aa, Entamoeba dispar
RSKKIEIMREKKEYQSRK

SEQ ID NO: 2503147 - protein, 26 aa, Entamoeba dispar
RSKKTMKFRIPHSMELNDMKLGINEL

SEQ ID NO: 2503148 - protein, 21 aa, Entamoeba dispar
RSKLLYAHLMIIAGQKQMAHV

SEQ ID NO: 2503149 - protein, 17 aa, Entamoeba dispar
RSKNLLFRHNEMEEEYP

SEQ ID NO: 2503150 - protein, 18 aa, Entamoeba dispar
RSLFSRVVDFEFLATLVG

SEQ ID NO: 2503151 - protein, 18 aa, Entamoeba dispar
RSLIPNYIRGASVVVIVY

SEQ ID NO: 2503152 - protein, 26 aa, Entamoeba dispar
RSLLLNEVIIPPGRIYKFDPKNPNAR

SEQ ID NO: 2503153 - protein, 20 aa, Entamoeba dispar
RSLVKCKYLCPGGGAMEMEL

SEQ ID NO: 2503154 - protein, 22 aa, Entamoeba dispar
RSLYDIPLPYCVINCQTMQVAI

SEQ ID NO: 2503155 - protein, 24 aa, Entamoeba dispar
RSMKIEVVKSLRLICKLNGNDSVT

SEQ ID NO: 2503156 - protein, 24 aa, Entamoeba dispar
RSMKLPDWMAPSSYSVTILNKDFL

SEQ ID NO: 2503157 - protein, 20 aa, Entamoeba dispar
RSNFHISMKRFEFKKPNLIS

SEQ ID NO: 2503158 - protein, 17 aa, Entamoeba dispar
RSNHSYLVADRVEDLTE

SEQ ID NO: 2503159 - protein, 17 aa, Entamoeba dispar
RSPEFVNESSIEPVHRI

SEQ ID NO: 2503160 - protein, 19 aa, Entamoeba dispar
RSPFVLEIREIAKIQRNLI

SEQ ID NO: 2503161 - protein, 25 aa, Entamoeba dispar
RSPLRKAKDVFVIRQIYSAILNLSK

SEQ ID NO: 2503162 - protein, 18 aa, Entamoeba dispar
RSPPDYIKSVLIEQMENI

SEQ ID NO: 2503163 - protein, 18 aa, Entamoeba dispar
RSPREYLRQRACNGLSDN

SEQ ID NO: 2503164 - protein, 21 aa, Entamoeba dispar
RSQFVGCVSFLGLIRSIYQKT

SEQ ID NO: 2503165 - protein, 24 aa, Entamoeba dispar
RSQKVCKVAPVAGETKVWQYITLL

SEQ ID NO: 2503166 - protein, 18 aa, Entamoeba dispar
RSQLKYGLQNSFDGLINS

SEQ ID NO: 2503167 - protein, 20 aa, Entamoeba dispar
RSQSRLGNCQSNRIPEQQQM

SEQ ID NO: 2503168 - protein, 18 aa, Entamoeba dispar
RSQTYWKNNFEGLEKYLN

SEQ ID NO: 2503169 - protein, 22 aa, Entamoeba dispar
RSRIIYKEKLIFVFKTENGFIG

SEQ ID NO: 2503170 - protein, 18 aa, Entamoeba dispar
RSRLNIKTISEFTSLDGH

SEQ ID NO: 2503171 - protein, 26 aa, Entamoeba dispar
RSRNVISWQYICRVIFYCLSVIHKKN

SEQ ID NO: 2503172 - protein, 25 aa, Entamoeba dispar
RSRWTELDGLCSIILSPTRELAQQI

SEQ ID NO: 2503173 - protein, 17 aa, Entamoeba dispar
RSSEFVFQPILMHSTST

SEQ ID NO: 2503174 - protein, 24 aa, Entamoeba dispar
RSSFSKVLQCLSFYETEKSDSQRQ

SEQ ID NO: 2503175 - protein, 20 aa, Entamoeba dispar
RSSKRLFSFVQTSILVEKRV

SEQ ID NO: 2503176 - protein, 24 aa, Entamoeba dispar
RSSRSHCIFTVFISKLENGIGKKV

SEQ ID NO: 2503177 - protein, 20 aa, Entamoeba dispar
RSSSAALMFIDLHDSQTKLQ

SEQ ID NO: 2503178 - protein, 18 aa, Entamoeba dispar
RSSSFPLSIKSMFENLTM

SEQ ID NO: 2503179 - protein, 18 aa, Entamoeba dispar
RSSSFVQRFNISLSSDTK

SEQ ID NO: 2503180 - protein, 19 aa, Entamoeba dispar
RSSSGFPLNKSIDVNNSME

SEQ ID NO: 2503181 - protein, 20 aa, Entamoeba dispar
RSSTPIRICSYQSVKSTIDD

SEQ ID NO: 2503182 - protein, 18 aa, Entamoeba dispar
RSTIGYARSISINKCENI

SEQ ID NO: 2503183 - protein, 19 aa, Entamoeba dispar
RSTILKQKFFASIVDEAAQ

SEQ ID NO: 2503184 - protein, 18 aa, Entamoeba dispar
RSTLLKQKFFASIVDEAA

SEQ ID NO: 2503185 - protein, 19 aa, Entamoeba dispar
RSTLLKQKFFASIVDEAAQ

SEQ ID NO: 2503186 - protein, 17 aa, Entamoeba dispar
RSVCVYGGSDAYIQIQE

SEQ ID NO: 2503187 - protein, 22 aa, Entamoeba dispar
RSVFPNHLLVIYKREKGMEEEI

SEQ ID NO: 2503188 - protein, 22 aa, Entamoeba dispar
RSVNNLKQLKLHGVNKLKINEM

SEQ ID NO: 2503189 - protein, 23 aa, Entamoeba dispar
RSVNPKVAWYCYHLMKERKNMSL

SEQ ID NO: 2503190 - protein, 20 aa, Entamoeba dispar
RSVQICSALSLPTHFHNRAH

SEQ ID NO: 2503191 - protein, 17 aa, Entamoeba dispar
RSYFKKEIGIITKYIYF

SEQ ID NO: 2503192 - protein, 20 aa, Entamoeba dispar
RSYITDCLMLKEQVKTIKYV

SEQ ID NO: 2503193 - protein, 21 aa, Entamoeba dispar
RSYLFSIPMFHYLQPYSNFIS

SEQ ID NO: 2503194 - protein, 30 aa, Entamoeba dispar
RSYLIMPVQRLPRYVLLFTDLIKHTPEKFP

SEQ ID NO: 2503195 - protein, 19 aa, Entamoeba dispar
RSYNILFQPPLRIVKKQKI

SEQ ID NO: 2503196 - protein, 20 aa, Entamoeba dispar
RTACERAKRTLSSAATANIE

SEQ ID NO: 2503197 - protein, 18 aa, Entamoeba dispar
RTCTPSIYTLLLVSQSGN

SEQ ID NO: 2503198 - protein, 22 aa, Entamoeba dispar
RTDDMFPVKIEFDVDQTYSGLK

SEQ ID NO: 2503199 - protein, 19 aa, Entamoeba dispar
RTDDPGWTYSLDLLLIRSI

SEQ ID NO: 2503200 - protein, 22 aa, Entamoeba dispar
RTDEVVKKLCSKEMSSDKKRTR

SEQ ID NO: 2503201 - protein, 17 aa, Entamoeba dispar
RTEEGYRIYTLEELGLD

SEQ ID NO: 2503202 - protein, 20 aa, Entamoeba dispar
RTEGFAVKEEWLYDCISEMK

SEQ ID NO: 2503203 - protein, 18 aa, Entamoeba dispar
RTEIYYWGKTASTLDHCP

SEQ ID NO: 2503204 - protein, 30 aa, Entamoeba dispar
RTELNNMKFIIPKKIGIIPFKLKMDKELRI

SEQ ID NO: 2503205 - protein, 27 aa, Entamoeba dispar
RTENEIKELESLIIIIKEEIEQENKII

SEQ ID NO: 2503206 - protein, 27 aa, Entamoeba dispar
RTEYRMLWFRFDIRKLYFLRHGDPREE

SEQ ID NO: 2503207 - protein, 20 aa, Entamoeba dispar
RTFIQMTFDRLSSIIPVKNF

SEQ ID NO: 2503208 - protein, 21 aa, Entamoeba dispar
RTGDFSAIIKYITKKGEGLHE

SEQ ID NO: 2503209 - protein, 28 aa, Entamoeba dispar
RTGDISAIIKYITKKGAGMFKGDPSNKE

SEQ ID NO: 2503210 - protein, 30 aa, Entamoeba dispar
RTGDISAIIKYLKKRGEGMHKGNPDNKEDI

SEQ ID NO: 2503211 - protein, 17 aa, Entamoeba dispar
RTGLRKEQNLSTRSDEF

SEQ ID NO: 2503212 - protein, 20 aa, Entamoeba dispar
RTGSCADLQPSLSLSLEPII

SEQ ID NO: 2503213 - protein, 20 aa, Entamoeba dispar
RTGTQFKCYPLYDFGVSIID

SEQ ID NO: 2503214 - protein, 25 aa, Entamoeba dispar
RTGVQCLIHPTSALFNMGFKSKYVI

SEQ ID NO: 2503215 - protein, 35 aa, Entamoeba dispar
RTHKLMKMSFCSMGSIPRSSFVKKFSLAAQKRRMS

SEQ ID NO: 2503216 - protein, 18 aa, Entamoeba dispar
RTIAAAIGQFCKELQKAQ

SEQ ID NO: 2503217 - protein, 36 aa, Entamoeba dispar
RTIENFKLLLFPLQWVCVCVPILPRILLEYLTSPFP

SEQ ID NO: 2503218 - protein, 26 aa, Entamoeba dispar
RTIIPQHYRGVCGVIFVVDVTLRTSF

SEQ ID NO: 2503219 - protein, 22 aa, Entamoeba dispar
RTIPEVKIRCVGIQKMKKICYA

SEQ ID NO: 2503220 - protein, 30 aa, Entamoeba dispar
RTIRIWNYLSFKCIAILTGHDHYVLSAHFH

SEQ ID NO: 2503221 - protein, 21 aa, Entamoeba dispar
RTISGFAVLIEKDWLSFGHQF

SEQ ID NO: 2503222 - protein, 17 aa, Entamoeba dispar
RTISILLQFGVGINSSV

SEQ ID NO: 2503223 - protein, 18 aa, Entamoeba dispar
RTKASCGCGEFLDLKKVV

SEQ ID NO: 2503224 - protein, 19 aa, Entamoeba dispar
RTKINPCYGLNSLAVAISN

SEQ ID NO: 2503225 - protein, 21 aa, Entamoeba dispar
RTKKYECINYLNGSSKIPSTV

SEQ ID NO: 2503226 - protein, 29 aa, Entamoeba dispar
RTKLLGKIKICKYIELINCTIDTTNCKPN

SEQ ID NO: 2503227 - protein, 17 aa, Entamoeba dispar
RTKPELVKMPSNYNTSQ

SEQ ID NO: 2503228 - protein, 21 aa, Entamoeba dispar
RTKQLLDRWKFKPKEFPLQLT

SEQ ID NO: 2503229 - protein, 25 aa, Entamoeba dispar
RTKVVKEYLNGLGLTYETKLAPHIF

SEQ ID NO: 2503230 - protein, 24 aa, Entamoeba dispar
RTKYLMMWLDFLIKDVESNLLDSK

SEQ ID NO: 2503231 - protein, 17 aa, Entamoeba dispar
RTKYSVLIDDFEKNQKK

SEQ ID NO: 2503232 - protein, 23 aa, Entamoeba dispar
RTLDICSVPEQPSLEFFIDKVLT

SEQ ID NO: 2503233 - protein, 23 aa, Entamoeba dispar
RTLEEYNLNYSFRTSLEPLNKTP

SEQ ID NO: 2503234 - protein, 21 aa, Entamoeba dispar
RTLELFCLFIEIGLTEEVLNA

SEQ ID NO: 2503235 - protein, 21 aa, Entamoeba dispar
RTLERLRIINKRYFKITQKLL

SEQ ID NO: 2503236 - protein, 33 aa, Entamoeba dispar
RTLFKKVKGSCKVYKKYCNFLMRNNREEEIKNT

SEQ ID NO: 2503237 - protein, 26 aa, Entamoeba dispar
RTLIPSLLYRVLCSPTPDIMAAFVRV

SEQ ID NO: 2503238 - protein, 22 aa, Entamoeba dispar
RTLKHYKDSIVLNYESVLSKWN

SEQ ID NO: 2503239 - protein, 20 aa, Entamoeba dispar
RTLKKLGVISKVWSTTDLGS

SEQ ID NO: 2503240 - protein, 17 aa, Entamoeba dispar
RTLKLPIEENISSMKNI

SEQ ID NO: 2503241 - protein, 23 aa, Entamoeba dispar
RTLKMSTYLIAFVNGEFTSYYGE

SEQ ID NO: 2503242 - protein, 17 aa, Entamoeba dispar
RTLLEHWQRHKTFGDEL

SEQ ID NO: 2503243 - protein, 23 aa, Entamoeba dispar
RTLMYKFCLDVSKAMDYLQESQI

SEQ ID NO: 2503244 - protein, 17 aa, Entamoeba dispar
RTLRFHARFLLVCLLTD

SEQ ID NO: 2503245 - protein, 29 aa, Entamoeba dispar
RTLSEPRVTLFPCYWDKEEHIEMVEEKPE

SEQ ID NO: 2503246 - protein, 31 aa, Entamoeba dispar
RTLSYKHLLRLYGRMNLLLSQIDKKQQLKQD

SEQ ID NO: 2503247 - protein, 19 aa, Entamoeba dispar
RTLVREGILRKQCRKAVKE

SEQ ID NO: 2503248 - protein, 25 aa, Entamoeba dispar
RTMRRRGRRSTLRRQAFGNFASAMQ

SEQ ID NO: 2503249 - protein, 22 aa, Entamoeba dispar
RTNDCVCRLALYSMISDAVKLD

SEQ ID NO: 2503250 - protein, 17 aa, Entamoeba dispar
RTNKTFESGKEFRKQHE

SEQ ID NO: 2503251 - protein, 21 aa, Entamoeba dispar
RTNLYAFLALARVMAKYGRQD

SEQ ID NO: 2503252 - protein, 26 aa, Entamoeba dispar
RTNSRPCPSCGAFIEKNGGCQWMSCY

SEQ ID NO: 2503253 - protein, 24 aa, Entamoeba dispar
RTPEICTAFDSLLRLKHKTKEIKN

SEQ ID NO: 2503254 - protein, 19 aa, Entamoeba dispar
RTPEPWLKGLGCSDDEVLL

SEQ ID NO: 2503255 - protein, 24 aa, Entamoeba dispar
RTPFKFTQHFAHVMGGKGSTQFSI

SEQ ID NO: 2503256 - protein, 18 aa, Entamoeba dispar
RTPPIKIIDTPGFGDSRG

SEQ ID NO: 2503257 - protein, 25 aa, Entamoeba dispar
RTPQGVSRKFGFIGFENEDQAQTAI

SEQ ID NO: 2503258 - protein, 18 aa, Entamoeba dispar
RTQQMGALNLSQINQQAQ

SEQ ID NO: 2503259 - protein, 25 aa, Entamoeba dispar
RTRKLFKRPFRGHGISNTSTILHTY

SEQ ID NO: 2503260 - protein, 22 aa, Entamoeba dispar
RTRPTGKYIVEWGGFFTSEYQN

SEQ ID NO: 2503261 - protein, 19 aa, Entamoeba dispar
RTSCTFCNAKSTYIFKENE

SEQ ID NO: 2503262 - protein, 25 aa, Entamoeba dispar
RTSEELWKNLIIISIDIKDYRQAIS

SEQ ID NO: 2503263 - protein, 24 aa, Entamoeba dispar
RTSELKKSRCIGEMDQTVSSPNLN

SEQ ID NO: 2503264 - protein, 19 aa, Entamoeba dispar
RTSFKFTTVQYIFKKTLIG

SEQ ID NO: 2503265 - protein, 25 aa, Entamoeba dispar
RTSLNLFCAFLMTRFGVENNIPSIS

SEQ ID NO: 2503266 - protein, 20 aa, Entamoeba dispar
RTSTFIKFEEFKFFIPSIND

SEQ ID NO: 2503267 - protein, 18 aa, Entamoeba dispar
RTSVYGVILVHKNNFPHL

SEQ ID NO: 2503268 - protein, 29 aa, Entamoeba dispar
RTTKNEIAESFSFLHWYISDGSNVLNEMI

SEQ ID NO: 2503269 - protein, 28 aa, Entamoeba dispar
RTTKNEIVESFSFLHWYISDGSTVLNEM

SEQ ID NO: 2503270 - protein, 18 aa, Entamoeba dispar
RTTYARPTTTGMRLAQQA

SEQ ID NO: 2503271 - protein, 26 aa, Entamoeba dispar
RTVEGFLGLIEYEWIMLGHKFQSRLR

SEQ ID NO: 2503272 - protein, 18 aa, Entamoeba dispar
RTVKWKKMLEQWKCDGKI

SEQ ID NO: 2503273 - protein, 19 aa, Entamoeba dispar
RTVNEWNFLGEFHSISMQK

SEQ ID NO: 2503274 - protein, 18 aa, Entamoeba dispar
RTVPIEVIRATYPSLRYF

SEQ ID NO: 2503275 - protein, 19 aa, Entamoeba dispar
RTYLRYLRGSVFCEKKLTV

SEQ ID NO: 2503276 - protein, 21 aa, Entamoeba dispar
RTYTTWKWFMMAKWDMKEHKI

SEQ ID NO: 2503277 - protein, 20 aa, Entamoeba dispar
RVAIREGKSKIFARDYIIRF

SEQ ID NO: 2503278 - protein, 18 aa, Entamoeba dispar
RVAQGMMERGFLTGYTKL

SEQ ID NO: 2503279 - protein, 20 aa, Entamoeba dispar
RVCKDFRIINENTRIQVYVS

SEQ ID NO: 2503280 - protein, 23 aa, Entamoeba dispar
RVDFPFERLFDLTSVQLGELIRL

SEQ ID NO: 2503281 - protein, 20 aa, Entamoeba dispar
RVDLSVCKALRILHILISKE

SEQ ID NO: 2503282 - protein, 23 aa, Entamoeba dispar
RVDNEVLKGISFKAEQGKTIAIV

SEQ ID NO: 2503283 - protein, 17 aa, Entamoeba dispar
RVEDAIRCVCDAKEKKG

SEQ ID NO: 2503284 - protein, 21 aa, Entamoeba dispar
RVEGFFGYLKKIINHSNLHLY

SEQ ID NO: 2503285 - protein, 23 aa, Entamoeba dispar
RVEKKFNCKVGYLNGGIIFDNYH

SEQ ID NO: 2503286 - protein, 17 aa, Entamoeba dispar
RVENPDIAFAVAALQEV

SEQ ID NO: 2503287 - protein, 21 aa, Entamoeba dispar
RVFEVSKYFVGSSIDNDFTVK

SEQ ID NO: 2503288 - protein, 20 aa, Entamoeba dispar
RVFQRFSAVAERFWSNKNLI

SEQ ID NO: 2503289 - protein, 26 aa, Entamoeba dispar
RVFRGIRFSAKYGFKIEDNTLNAMTS

SEQ ID NO: 2503290 - protein, 22 aa, Entamoeba dispar
RVFSLNNAKAFYSLYSKESKEE

SEQ ID NO: 2503291 - protein, 20 aa, Entamoeba dispar
RVGACGLNITGASRVVIFDE

SEQ ID NO: 2503292 - protein, 18 aa, Entamoeba dispar
RVGELQGVSQIACSEEHY

SEQ ID NO: 2503293 - protein, 21 aa, Entamoeba dispar
RVGGGIPKLLFEATKGSKNTH

SEQ ID NO: 2503294 - protein, 18 aa, Entamoeba dispar
RVGHFPDIVRVISSSTFF

SEQ ID NO: 2503295 - protein, 20 aa, Entamoeba dispar
RVGNDLKQDFTIFDAVPESE

SEQ ID NO: 2503296 - protein, 19 aa, Entamoeba dispar
RVGTLEFSNNQVIDVYKKV

SEQ ID NO: 2503297 - protein, 23 aa, Entamoeba dispar
RVHECTKLKNLFEHYLSQHKCEL

SEQ ID NO: 2503298 - protein, 17 aa, Entamoeba dispar
RVHGKPTIVPLLYNNIE

SEQ ID NO: 2503299 - protein, 23 aa, Entamoeba dispar
RVICCGIIKERLIFVCKKGIYSI

SEQ ID NO: 2503300 - protein, 32 aa, Entamoeba dispar
RVIDPQKLKECFKWDIKCQNIKTFWKRMKRYG

SEQ ID NO: 2503301 - protein, 17 aa, Entamoeba dispar
RVIEIRGNETFKLKEEV

SEQ ID NO: 2503302 - protein, 25 aa, Entamoeba dispar
RVIEMFSIRYAECMSEKMNELNITS

SEQ ID NO: 2503303 - protein, 28 aa, Entamoeba dispar
RVIENIHMCLMKNGLNTKGIFRESTATT

SEQ ID NO: 2503304 - protein, 22 aa, Entamoeba dispar
RVIRGANILFIGKYLRIEKDGE

SEQ ID NO: 2503305 - protein, 26 aa, Entamoeba dispar
RVKGISFHPTRSWVLASLHNGKIQLW

SEQ ID NO: 2503306 - protein, 25 aa, Entamoeba dispar
RVKKVGERWVILRAFDRFFEESPIP

SEQ ID NO: 2503307 - protein, 24 aa, Entamoeba dispar
RVKNDILLSLGINEAVVFSQSFNR

SEQ ID NO: 2503308 - protein, 20 aa, Entamoeba dispar
RVLCEGYWDKIPLRSKDEKA

SEQ ID NO: 2503309 - protein, 18 aa, Entamoeba dispar
RVLDIKFSPANDVVAVGD

SEQ ID NO: 2503310 - protein, 18 aa, Entamoeba dispar
RVLFNYPSSNVMINPNIM

SEQ ID NO: 2503311 - protein, 24 aa, Entamoeba dispar
RVLLNEVNGIIIIQFLEKLSSVKY

SEQ ID NO: 2503312 - protein, 17 aa, Entamoeba dispar
RVLNNIVNILIALNKRE

SEQ ID NO: 2503313 - protein, 21 aa, Entamoeba dispar
RVLPFSTFRMNLCDTTPYNAD

SEQ ID NO: 2503314 - protein, 20 aa, Entamoeba dispar
RVLRDKIDFSTFIMGVILKS

SEQ ID NO: 2503315 - protein, 21 aa, Entamoeba dispar
RVLRLQSIIVSWVNLMKDEII

SEQ ID NO: 2503316 - protein, 27 aa, Entamoeba dispar
RVLSKSPGGGLVFFASYSMLNRVVELW

SEQ ID NO: 2503317 - protein, 24 aa, Entamoeba dispar
RVLYWKNKIFHLIFNLEKEQYKTV

SEQ ID NO: 2503318 - protein, 18 aa, Entamoeba dispar
RVMKLCIHPNVVEFHDYF

SEQ ID NO: 2503319 - protein, 20 aa, Entamoeba dispar
RVMKQCTCFNPNLRPDCVEL

SEQ ID NO: 2503320 - protein, 20 aa, Entamoeba dispar
RVNGATFKKQPFVGLENLGC

SEQ ID NO: 2503321 - protein, 18 aa, Entamoeba dispar
RVRCGSGFSSFNVATNGD

SEQ ID NO: 2503322 - protein, 26 aa, Entamoeba dispar
RVSIERLICIFAYFHVMIEIDEKTLQ

SEQ ID NO: 2503323 - protein, 18 aa, Entamoeba dispar
RVSIRPSLQPPLRQSLSI

SEQ ID NO: 2503324 - protein, 26 aa, Entamoeba dispar
RVSKCCKELIIGGGERKFKIEVNEGI

SEQ ID NO: 2503325 - protein, 21 aa, Entamoeba dispar
RVSSLCSVRCIKHVLKELGEE

SEQ ID NO: 2503326 - protein, 19 aa, Entamoeba dispar
RVSTVNIMKTLGFVEKLKT

SEQ ID NO: 2503327 - protein, 20 aa, Entamoeba dispar
RVSVKRGKSLILSKLDNQLT

SEQ ID NO: 2503328 - protein, 19 aa, Entamoeba dispar
RVTECSICHSSSETFEEFI

SEQ ID NO: 2503329 - protein, 17 aa, Entamoeba dispar
RVTKELYSKIQTNPSIT

SEQ ID NO: 2503330 - protein, 19 aa, Entamoeba dispar
RVTKPFNFFRKVQIFPSQL

SEQ ID NO: 2503331 - protein, 17 aa, Entamoeba dispar
RVTNLLEALGYDNTFLE

SEQ ID NO: 2503332 - protein, 17 aa, Entamoeba dispar
RVTQTFFSAPNPLFSRL

SEQ ID NO: 2503333 - protein, 28 aa, Entamoeba dispar
RVVDVGGYITKGRVNGVLAITRSIGDVR

SEQ ID NO: 2503334 - protein, 26 aa, Entamoeba dispar
RVVELSKHMYGCRVIQKVIERSNTNE

SEQ ID NO: 2503335 - protein, 24 aa, Entamoeba dispar
RVVKSTVCDLLMKCLTVNVADERI

SEQ ID NO: 2503336 - protein, 25 aa, Entamoeba dispar
RVVQEDEVVLALRGILTARRQDTNI

SEQ ID NO: 2503337 - protein, 19 aa, Entamoeba dispar
RVWDRKKKKFVMASGGLDQ

SEQ ID NO: 2503338 - protein, 35 aa, Entamoeba dispar
RVYFSLKKDIYWWIVDHWYCFGSLQQFKTSPSKWK

SEQ ID NO: 2503339 - protein, 17 aa, Entamoeba dispar
RVYYEWRDELDNSDSEE

SEQ ID NO: 2503340 - protein, 24 aa, Entamoeba dispar
RWAPSARNLQEWRIVLTDQNQLHF

SEQ ID NO: 2503341 - protein, 20 aa, Entamoeba dispar
RWDICVCASKGEPMQISFVN

SEQ ID NO: 2503342 - protein, 17 aa, Entamoeba dispar
RWESIGFLPNSPRNCSF

SEQ ID NO: 2503343 - protein, 19 aa, Entamoeba dispar
RWFSLSRLVMRYNSEKAII

SEQ ID NO: 2503344 - protein, 20 aa, Entamoeba dispar
RWGNSFRQTLRWLTEEPNKE

SEQ ID NO: 2503345 - protein, 20 aa, Entamoeba dispar
RWIEAMYCLEDGITSSEPVV

SEQ ID NO: 2503346 - protein, 18 aa, Entamoeba dispar
RWIYKEINEETYIKTIIE

SEQ ID NO: 2503347 - protein, 17 aa, Entamoeba dispar
RWKEIEWNDNIKKEFDK

SEQ ID NO: 2503348 - protein, 18 aa, Entamoeba dispar
RWLFLGCSSLTSINIPTS

SEQ ID NO: 2503349 - protein, 26 aa, Entamoeba dispar
RWRRMLLETFRIIKLIKENDLVPLVE

SEQ ID NO: 2503350 - protein, 21 aa, Entamoeba dispar
RYADGEIKSAHILDPNVTLGT

SEQ ID NO: 2503351 - protein, 26 aa, Entamoeba dispar
RYALDSTFKYLCQFLTNVGILIKYTY

SEQ ID NO: 2503352 - protein, 21 aa, Entamoeba dispar
RYANNLLPVVIRYSRSTNDNI

SEQ ID NO: 2503353 - protein, 24 aa, Entamoeba dispar
RYCSEFLASSTLQFIELLKTNKHY

SEQ ID NO: 2503354 - protein, 20 aa, Entamoeba dispar
RYCSEFLIRVKKDFDSSSNH

SEQ ID NO: 2503355 - protein, 19 aa, Entamoeba dispar
RYDAFVLNMVLFNLHKRQQ

SEQ ID NO: 2503356 - protein, 21 aa, Entamoeba dispar
RYDFFDNLCLFENNYKNLRDT

SEQ ID NO: 2503357 - protein, 19 aa, Entamoeba dispar
RYDLTLYCHSLLTSTMTFL

SEQ ID NO: 2503358 - protein, 27 aa, Entamoeba dispar
RYDTGSHLPFIVSWGKEYWMKKDEYDE

SEQ ID NO: 2503359 - protein, 19 aa, Entamoeba dispar
RYECSQLKTAYKATTTTTE

SEQ ID NO: 2503360 - protein, 20 aa, Entamoeba dispar
RYEEIWKRKEIEEELDENDK

SEQ ID NO: 2503361 - protein, 19 aa, Entamoeba dispar
RYEIKMALPPKIDPSVSVM

SEQ ID NO: 2503362 - protein, 18 aa, Entamoeba dispar
RYEKVICDCFNYVEKQIS

SEQ ID NO: 2503363 - protein, 17 aa, Entamoeba dispar
RYFLADFRYILQVINIL

SEQ ID NO: 2503364 - protein, 17 aa, Entamoeba dispar
RYFTREGLRYSIDKLDV

SEQ ID NO: 2503365 - protein, 17 aa, Entamoeba dispar
RYGATRISEGVDLVQFW

SEQ ID NO: 2503366 - protein, 19 aa, Entamoeba dispar
RYGEFMGVSYYQFTPFIEY

SEQ ID NO: 2503367 - protein, 19 aa, Entamoeba dispar
RYGGAKGFVNRPTFACIDK

SEQ ID NO: 2503368 - protein, 19 aa, Entamoeba dispar
RYGGAKGLVNRPTFGCIDE

SEQ ID NO: 2503369 - protein, 20 aa, Entamoeba dispar
RYGNEIPSMISVIEQKAFDG

SEQ ID NO: 2503370 - protein, 19 aa, Entamoeba dispar
RYGNVLLLSSYCATLTGII

SEQ ID NO: 2503371 - protein, 18 aa, Entamoeba dispar
RYGPDKGNVPKFLCGNKT

SEQ ID NO: 2503372 - protein, 19 aa, Entamoeba dispar
RYGYEIPRDPAIKSIGKDC

SEQ ID NO: 2503373 - protein, 19 aa, Entamoeba dispar
RYIDKFYIVLRFTEEESKE

SEQ ID NO: 2503374 - protein, 18 aa, Entamoeba dispar
RYIFGNIINLFGKDVKKN

SEQ ID NO: 2503375 - protein, 27 aa, Entamoeba dispar
RYIFKSLTCYLNLFRIYIKHYRIIKTY

SEQ ID NO: 2503376 - protein, 19 aa, Entamoeba dispar
RYIFYPFFLVTDFEGFEGP

SEQ ID NO: 2503377 - protein, 17 aa, Entamoeba dispar
RYIIISINITLNQMEYI

SEQ ID NO: 2503378 - protein, 18 aa, Entamoeba dispar
RYINGRFLPDKAIDLRNT

SEQ ID NO: 2503379 - protein, 19 aa, Entamoeba dispar
RYKDVTCIFKNVILESLNG

SEQ ID NO: 2503380 - protein, 29 aa, Entamoeba dispar
RYKKRDLINWNEFIVRSCISRLEKKELIS

SEQ ID NO: 2503381 - protein, 27 aa, Entamoeba dispar
RYKMEKLRNRKSCQFIPKKLSEDQQRR

SEQ ID NO: 2503382 - protein, 17 aa, Entamoeba dispar
RYKVFDVELKKALDKYY

SEQ ID NO: 2503383 - protein, 18 aa, Entamoeba dispar
RYLGNSCAFDCWSNQLLK

SEQ ID NO: 2503384 - protein, 18 aa, Entamoeba dispar
RYLHFEKGFIHRDIKLEN

SEQ ID NO: 2503385 - protein, 18 aa, Entamoeba dispar
RYLIWSCSVINKKKTKLH

SEQ ID NO: 2503386 - protein, 17 aa, Entamoeba dispar
RYLMIIGTMKEKEIEES

SEQ ID NO: 2503387 - protein, 23 aa, Entamoeba dispar
RYLSELIGDIIIFSEHAQNVQPT

SEQ ID NO: 2503388 - protein, 21 aa, Entamoeba dispar
RYLYCGNVVKEFITTENTYCE

SEQ ID NO: 2503389 - protein, 19 aa, Entamoeba dispar
RYLYLTLWGDEVKNELQFK

SEQ ID NO: 2503390 - protein, 25 aa, Entamoeba dispar
RYMAPEILFNPSLIGRESLGIHHCL

SEQ ID NO: 2503391 - protein, 18 aa, Entamoeba dispar
RYMFERASMKLGLDQAIL

SEQ ID NO: 2503392 - protein, 17 aa, Entamoeba dispar
RYMLKVGQFVLSAESKE

SEQ ID NO: 2503393 - protein, 18 aa, Entamoeba dispar
RYNCYLINESIHLLIDLL

SEQ ID NO: 2503394 - protein, 18 aa, Entamoeba dispar
RYNEIELKNSILEEEQVN

SEQ ID NO: 2503395 - protein, 20 aa, Entamoeba dispar
RYNGLPLFPYMCRSAALTYS

SEQ ID NO: 2503396 - protein, 19 aa, Entamoeba dispar
RYNMPPIMMSHFYSIWTAF

SEQ ID NO: 2503397 - protein, 18 aa, Entamoeba dispar
RYNPNKRISCERALKHSY

SEQ ID NO: 2503398 - protein, 23 aa, Entamoeba dispar
RYNSYLSKRMRVILSTEKDIIET

SEQ ID NO: 2503399 - protein, 17 aa, Entamoeba dispar
RYPDLWINTLDPGTVNT

SEQ ID NO: 2503400 - protein, 29 aa, Entamoeba dispar
RYPLPECKMLPKGWGIGMDRGEMYFINWN

SEQ ID NO: 2503401 - protein, 20 aa, Entamoeba dispar
RYQFLERMCDPCGKPPPEKN

SEQ ID NO: 2503402 - protein, 17 aa, Entamoeba dispar
RYRCFKECLSLTSINIP

SEQ ID NO: 2503403 - protein, 27 aa, Entamoeba dispar
RYRGTYCFICGYNGYIYLFTLSEISRI

SEQ ID NO: 2503404 - protein, 18 aa, Entamoeba dispar
RYRHVSFEIGRVVASQWV

SEQ ID NO: 2503405 - protein, 17 aa, Entamoeba dispar
RYRMRVTHVEIYNEKVY

SEQ ID NO: 2503406 - protein, 24 aa, Entamoeba dispar
RYRNVSLPSLFVFSMKDQYIPLDN

SEQ ID NO: 2503407 - protein, 19 aa, Entamoeba dispar
RYRVISLLGNGAFGQVVKA

SEQ ID NO: 2503408 - protein, 24 aa, Entamoeba dispar
RYRYCSLTHKLFKKRVVCDVVGRL

SEQ ID NO: 2503409 - protein, 20 aa, Entamoeba dispar
RYSPLPSKESRIFVTNQDNQ

SEQ ID NO: 2503410 - protein, 24 aa, Entamoeba dispar
RYSVGVCFQLLMPYVKAEDTRAFF

SEQ ID NO: 2503411 - protein, 18 aa, Entamoeba dispar
RYTIGIYGVMGLKPKDLV

SEQ ID NO: 2503412 - protein, 21 aa, Entamoeba dispar
RYTKLRDAIVIASDTVLDKNL

SEQ ID NO: 2503413 - protein, 26 aa, Entamoeba dispar
RYTKSSFKTLRMEKITDILLNEKIII

SEQ ID NO: 2503414 - protein, 17 aa, Entamoeba dispar
RYTRCEFTGDVLTIPVS

SEQ ID NO: 2503415 - protein, 20 aa, Entamoeba dispar
RYVREKLPFLELAKHPGDSR

SEQ ID NO: 2503416 - protein, 24 aa, Entamoeba dispar
  misc_feature (22)..(23): Xaa can be any naturally occurring amino acid
RYVRFQVIVNFGKFIQFIGKDXXK

SEQ ID NO: 2503417 - protein, 22 aa, Entamoeba dispar
RYWKEIQEIANIFSSLEEFQLN

SEQ ID NO: 2503418 - protein, 31 aa, Entamoeba dispar
RYWTDVECIAFKKAIKYFGYTTARGINTLLI

SEQ ID NO: 2503419 - protein, 24 aa, Entamoeba dispar
RYYAPWCGFCKMMSYDYKKLFRKY

SEQ ID NO: 2503420 - protein, 24 aa, Entamoeba dispar
RYYLSKGILKRTIFAIKKRKEGSE

SEQ ID NO: 2503421 - protein, 24 aa, Entamoeba dispar
RYYNRFPALVWYDNKYKNVLMRNS

SEQ ID NO: 2503422 - protein, 19 aa, Entamoeba dispar
RYYPLALKLLIQNVSLHSF

SEQ ID NO: 2503423 - protein, 26 aa, Entamoeba dispar
RYYRPPEVMIGYPFDGSFDNWSSGVT

SEQ ID NO: 2503424 - protein, 19 aa, Entamoeba dispar
SAALGLTIACSVALGYSNI

SEQ ID NO: 2503425 - protein, 24 aa, Entamoeba dispar
SAARIIDEIVIWRHSHQIGAAANI

SEQ ID NO: 2503426 - protein, 18 aa, Entamoeba dispar
SAASMCGVVHQMLHDLKK

SEQ ID NO: 2503427 - protein, 18 aa, Entamoeba dispar
SACLDLLSILVVRSDDIE

SEQ ID NO: 2503428 - protein, 26 aa, Entamoeba dispar
SACSYDRIVTCWDLRTPCRSPILQFT

SEQ ID NO: 2503429 - protein, 17 aa, Entamoeba dispar
SADFDRNRVKGLIVTLF

SEQ ID NO: 2503430 - protein, 20 aa, Entamoeba dispar
SADISIQPIEVCLVNDLQGR

SEQ ID NO: 2503431 - protein, 23 aa, Entamoeba dispar
SADKLKLSYLIDLLKGIVDEDDI

SEQ ID NO: 2503432 - protein, 37 aa, Entamoeba dispar
SADKSAKLWAPKEGFALHGVLKGHTKAVISAEFSPIE

SEQ ID NO: 2503433 - protein, 29 aa, Entamoeba dispar
SADKSIKVWGLQYGECIKTFKGHEDLITG

SEQ ID NO: 2503434 - protein, 19 aa, Entamoeba dispar
SADLKVEYITKMDNNLWSI

SEQ ID NO: 2503435 - protein, 23 aa, Entamoeba dispar
SAEKRKIILEAIRKMPLENVTLL

SEQ ID NO: 2503436 - protein, 18 aa, Entamoeba dispar
SAELYLCRVNREIENRIL

SEQ ID NO: 2503437 - protein, 18 aa, Entamoeba dispar
SAFDELKLIISQFNIINI

SEQ ID NO: 2503438 - protein, 18 aa, Entamoeba dispar
SAFEGCINLKIIDIPMCS

SEQ ID NO: 2503439 - protein, 18 aa, Entamoeba dispar
SAFELKPGQTITLNIKST

SEQ ID NO: 2503440 - protein, 20 aa, Entamoeba dispar
SAFGERIYGMYFALYAELHV

SEQ ID NO: 2503441 - protein, 18 aa, Entamoeba dispar
SAFLCIFETKAVIATTTK

SEQ ID NO: 2503442 - protein, 18 aa, Entamoeba dispar
SAGAYSRIYLVKKKSTGD

SEQ ID NO: 2503443 - protein, 27 aa, Entamoeba dispar
SAGNVLRPHVFAAFRALYESNKKKGLK

SEQ ID NO: 2503444 - protein, 17 aa, Entamoeba dispar
SAGRQRAVLALLRNNTK

SEQ ID NO: 2503445 - protein, 24 aa, Entamoeba dispar
SAHFICAWCKLAVDGKCIEKLPST

SEQ ID NO: 2503446 - protein, 19 aa, Entamoeba dispar
SAHGACLLASQLIKNSRPI

SEQ ID NO: 2503447 - protein, 27 aa, Entamoeba dispar
SAIGEAVPVFGWICVEKTPAPYVADLI

SEQ ID NO: 2503448 - protein, 17 aa, Entamoeba dispar
SAIIIVCDILQPNIVIK

SEQ ID NO: 2503449 - protein, 19 aa, Entamoeba dispar
SAIKGRGAFMNGKQIHVSH

SEQ ID NO: 2503450 - protein, 19 aa, Entamoeba dispar
SAIKRYGRDLNLWKIDFTQ

SEQ ID NO: 2503451 - protein, 17 aa, Entamoeba dispar
SAILCFRISDGGKSMIM

SEQ ID NO: 2503452 - protein, 18 aa, Entamoeba dispar
SAIPPELIIESFRKLEPE

SEQ ID NO: 2503453 - protein, 19 aa, Entamoeba dispar
SAKKFDCFLNIKNRISSHA

SEQ ID NO: 2503454 - protein, 20 aa, Entamoeba dispar
SAKSCCEFMDQIVSVCPHGL

SEQ ID NO: 2503455 - protein, 23 aa, Entamoeba dispar
SAKSKHIPVIVCCETYKMTDEIM

SEQ ID NO: 2503456 - protein, 21 aa, Entamoeba dispar
SAKTCGVVFEILRELEQFRDK

SEQ ID NO: 2503457 - protein, 18 aa, Entamoeba dispar
SAKTGAGINEMFETLTKE

SEQ ID NO: 2503458 - protein, 17 aa, Entamoeba dispar
SALIKFNQRFSYCPCCG

SEQ ID NO: 2503459 - protein, 24 aa, Entamoeba dispar
SALKEAYKIYYFFTTLINSRCKQK

SEQ ID NO: 2503460 - protein, 25 aa, Entamoeba dispar
SALKLHKEFGVLVIVTLGDKGCLIV

SEQ ID NO: 2503461 - protein, 25 aa, Entamoeba dispar
SALKLKKLEPYYGYNSSIPLYYQRL

SEQ ID NO: 2503462 - protein, 18 aa, Entamoeba dispar
SALLSFLVHLLLEKDNKS

SEQ ID NO: 2503463 - protein, 25 aa, Entamoeba dispar
SALSIEIINLLLLESSDFVTGFINE

SEQ ID NO: 2503464 - protein, 18 aa, Entamoeba dispar
SALSRINPQLVFNTKPKT

SEQ ID NO: 2503465 - protein, 19 aa, Entamoeba dispar
SAMHSYRIDLFVKQDGKIY

SEQ ID NO: 2503466 - protein, 20 aa, Entamoeba dispar
SAMSRRAEYMYGTRLNESKT

SEQ ID NO: 2503467 - protein, 18 aa, Entamoeba dispar
SANKIWYGITLKGDDIAI

SEQ ID NO: 2503468 - protein, 19 aa, Entamoeba dispar
SAPGIPILVDGSFFFWMAY

SEQ ID NO: 2503469 - protein, 21 aa, Entamoeba dispar
SAPGMVVGGWTSVRVASEIIA

SEQ ID NO: 2503470 - protein, 28 aa, Entamoeba dispar
SAQQSFLFRILVDNGFTIFLKKLYKKGK

SEQ ID NO: 2503471 - protein, 18 aa, Entamoeba dispar
SAQSYYLCSASRDGIIKI

SEQ ID NO: 2503472 - protein, 19 aa, Entamoeba dispar
SARIYFLLAASYTNYKNIE

SEQ ID NO: 2503473 - protein, 28 aa, Entamoeba dispar
SARNRILYIYRVIRPFRLIEVDVIPNVF

SEQ ID NO: 2503474 - protein, 21 aa, Entamoeba dispar
SARSILFNNCESIEFNMYKIR

SEQ ID NO: 2503475 - protein, 23 aa, Entamoeba dispar
SASDYCSFKIFNYLVSNPHFTEN

SEQ ID NO: 2503476 - protein, 17 aa, Entamoeba dispar
SASEINECSELIHETLK

SEQ ID NO: 2503477 - protein, 17 aa, Entamoeba dispar
SASIVIAYMMKKYDMTY

SEQ ID NO: 2503478 - protein, 27 aa, Entamoeba dispar
SASLNCFSHFTYVRSGRRLLISDLQGV

SEQ ID NO: 2503479 - protein, 18 aa, Entamoeba dispar
SASTDRKALIWDLYPIET

SEQ ID NO: 2503480 - protein, 19 aa, Entamoeba dispar
SASTDRKALIWDLYPIETL

SEQ ID NO: 2503481 - protein, 18 aa, Entamoeba dispar
SASTEFMQTFMWTHTMFM

SEQ ID NO: 2503482 - protein, 24 aa, Entamoeba dispar
SATDPRANIAIKYLDSFTFNKRDY

SEQ ID NO: 2503483 - protein, 19 aa, Entamoeba dispar
SATEFQPVLSALRTNKYFT

SEQ ID NO: 2503484 - protein, 26 aa, Entamoeba dispar
SATELSQRCTMEWAKDEYEENKLQET

SEQ ID NO: 2503485 - protein, 26 aa, Entamoeba dispar
SATFERIKPIKGFILLFEYNKQAINY

SEQ ID NO: 2503486 - protein, 26 aa, Entamoeba dispar
SATPERLNLFFIDFYRSQAIQQLLVA

SEQ ID NO: 2503487 - protein, 24 aa, Entamoeba dispar
SATQMSCVMVAFGTAMTMGNGVTG

SEQ ID NO: 2503488 - protein, 27 aa, Entamoeba dispar
SATSVSLMPSFRSLEWNHMYITFETDI

SEQ ID NO: 2503489 - protein, 20 aa, Entamoeba dispar
SAVEYFKFSPIELTTPIATF

SEQ ID NO: 2503490 - protein, 17 aa, Entamoeba dispar
SAVLRNWDVSLFKTSSL

SEQ ID NO: 2503491 - protein, 21 aa, Entamoeba dispar
SAVMKRLSVMWKNLSEKEREK

SEQ ID NO: 2503492 - protein, 26 aa, Entamoeba dispar
SAVRCVLLRMGIIGIKVTIMLDTDPS

SEQ ID NO: 2503493 - protein, 27 aa, Entamoeba dispar
SAVRCVLLRMGIIGIKVTIMLDTDPSG

SEQ ID NO: 2503494 - protein, 28 aa, Entamoeba dispar
SAVSRAYYPGARWGITRRLIASSLQEKS

SEQ ID NO: 2503495 - protein, 18 aa, Entamoeba dispar
SAVYVVADGCGWGTASCK

SEQ ID NO: 2503496 - protein, 19 aa, Entamoeba dispar
SAWNPDFLLSVLLGNQTAT

SEQ ID NO: 2503497 - protein, 19 aa, Entamoeba dispar
SAYPVVKVLQSFVTAVNSN

SEQ ID NO: 2503498 - protein, 20 aa, Entamoeba dispar
SAYSKCIACSEAIKEAYTKS

SEQ ID NO: 2503499 - protein, 19 aa, Entamoeba dispar
SCCPIYDKFLYDIIEHPFY

SEQ ID NO: 2503500 - protein, 24 aa, Entamoeba dispar
SCDEILEILTYLIVQCQPPMLYSN

SEQ ID NO: 2503501 - protein, 24 aa, Entamoeba dispar
SCDFNEYHPLPLIHSLHLRFNKNN

SEQ ID NO: 2503502 - protein, 19 aa, Entamoeba dispar
SCDLLQRFGVLENEINEEI

SEQ ID NO: 2503503 - protein, 19 aa, Entamoeba dispar
SCDLSKYGPHFIIERDFKV

SEQ ID NO: 2503504 - protein, 20 aa, Entamoeba dispar
SCDMKFAISLKELIQLAPKI

SEQ ID NO: 2503505 - protein, 18 aa, Entamoeba dispar
SCDSETLFDITGLVKGEN

SEQ ID NO: 2503506 - protein, 21 aa, Entamoeba dispar
SCDVVVGPIVFMTCNIVCYNS

SEQ ID NO: 2503507 - protein, 26 aa, Entamoeba dispar
SCECVPLDAALIIALQCNGDIKQTTA

SEQ ID NO: 2503508 - protein, 24 aa, Entamoeba dispar
SCELRRFRDGRLLYVVSSDRLWTE

SEQ ID NO: 2503509 - protein, 20 aa, Entamoeba dispar
SCFEDCSFLPTLQLESLPLI

SEQ ID NO: 2503510 - protein, 17 aa, Entamoeba dispar
SCFENCPQYEKVSIPQT

SEQ ID NO: 2503511 - protein, 18 aa, Entamoeba dispar
SCFEQCINLSILEIPSSI

SEQ ID NO: 2503512 - protein, 19 aa, Entamoeba dispar
SCFGACRSLSSIIIPISIN

SEQ ID NO: 2503513 - protein, 19 aa, Entamoeba dispar
SCFKDCRSLKSIKIPTNIT

SEQ ID NO: 2503514 - protein, 18 aa, Entamoeba dispar
SCFKECKSLTSINIPSSV

SEQ ID NO: 2503515 - protein, 17 aa, Entamoeba dispar
SCFKGCETLTIVTIPSM

SEQ ID NO: 2503516 - protein, 25 aa, Entamoeba dispar
SCFSNCSKLKLLLIPNTVVDLAYSS

SEQ ID NO: 2503517 - protein, 19 aa, Entamoeba dispar
SCFYECSRLTTVNIPSTVS

SEQ ID NO: 2503518 - protein, 20 aa, Entamoeba dispar
SCFYKCRNAEELKKNKTIPR

SEQ ID NO: 2503519 - protein, 18 aa, Entamoeba dispar
SCGISKFKEEVEIKYKSD

SEQ ID NO: 2503520 - protein, 25 aa, Entamoeba dispar
SCIDGRLTSAWNWCSMIEKYSYYPL

SEQ ID NO: 2503521 - protein, 30 aa, Entamoeba dispar
SCIDGRLTSAWNWCSMIERYIFYPFFLVTD

SEQ ID NO: 2503522 - protein, 23 aa, Entamoeba dispar
SCIEGSRVLFCYNSENEPFNKFT

SEQ ID NO: 2503523 - protein, 17 aa, Entamoeba dispar
SCIGANGYCNVCGCHYI

SEQ ID NO: 2503524 - protein, 20 aa, Entamoeba dispar
SCIHCNLTVHTYCVYPLQFQ

SEQ ID NO: 2503525 - protein, 17 aa, Entamoeba dispar
SCIISLFVELVQGDCFQ

SEQ ID NO: 2503526 - protein, 20 aa, Entamoeba dispar
SCISSSCTSAAVIGAGAGGT

SEQ ID NO: 2503527 - protein, 29 aa, Entamoeba dispar
SCITQITQGFKWVRSGGICEIVDNRQLKT

SEQ ID NO: 2503528 - protein, 19 aa, Entamoeba dispar
SCKRPIKVEVEMPSEEVVQ

SEQ ID NO: 2503529 - protein, 21 aa, Entamoeba dispar
SCKRSLYTESIEIFYEKNYIE

SEQ ID NO: 2503530 - protein, 25 aa, Entamoeba dispar
SCKSNKLEPRESFMVRTDKKTSNNI

SEQ ID NO: 2503531 - protein, 19 aa, Entamoeba dispar
SCKVLRAQCSIVSHVLHSF

SEQ ID NO: 2503532 - protein, 28 aa, Entamoeba dispar
SCNCKYIAWCLNPPCGKSKSAHFASASK

SEQ ID NO: 2503533 - protein, 26 aa, Entamoeba dispar
SCNICGMKFLRKHDCNVHMRVHTGEK

SEQ ID NO: 2503534 - protein, 21 aa, Entamoeba dispar
SCNKGKCKGCVDGYYKNEESC

SEQ ID NO: 2503535 - protein, 17 aa, Entamoeba dispar
SCNKVILNNSTRVNEII

SEQ ID NO: 2503536 - protein, 21 aa, Entamoeba dispar
SCNRAAGAMYLFPRITLPEKF

SEQ ID NO: 2503537 - protein, 24 aa, Entamoeba dispar
SCPFYKTCGIIRNIIHFYNEAFQA

SEQ ID NO: 2503538 - protein, 20 aa, Entamoeba dispar
SCPITMLQIITWKEPFPKEI

SEQ ID NO: 2503539 - protein, 25 aa, Entamoeba dispar
SCPSYDIPFEYYNNFILTKQPSSSE

SEQ ID NO: 2503540 - protein, 29 aa, Entamoeba dispar
SCQNISLKIAAFVRRLADETGHLGTYNII

SEQ ID NO: 2503541 - protein, 23 aa, Entamoeba dispar
SCRLNELKTFFVALIDNYYELFP

SEQ ID NO: 2503542 - protein, 20 aa, Entamoeba dispar
SCRTFLRTTLKNVINEINVC

SEQ ID NO: 2503543 - protein, 25 aa, Entamoeba dispar
SCRTYLEKHFELFKELDEEQLIKQA

SEQ ID NO: 2503544 - protein, 19 aa, Entamoeba dispar
SCSVIELEFQIGKLKMIKK

SEQ ID NO: 2503545 - protein, 22 aa, Entamoeba dispar
SCVGIWQNDRVEIIANDQGNRT

SEQ ID NO: 2503546 - protein, 23 aa, Entamoeba dispar
SDADWCRYVHLFCIYCGKRYTSL

SEQ ID NO: 2503547 - protein, 30 aa, Entamoeba dispar
SDAFPIKDFWKHVCIVWTKCYNCYSQKKIE

SEQ ID NO: 2503548 - protein, 20 aa, Entamoeba dispar
SDALKRYGYENLPVDTFMTL

SEQ ID NO: 2503549 - protein, 19 aa, Entamoeba dispar
SDCDKIFASCWINEDTVVL

SEQ ID NO: 2503550 - protein, 19 aa, Entamoeba dispar
SDCIEKLKLERAIQTQFKL

SEQ ID NO: 2503551 - protein, 18 aa, Entamoeba dispar
SDCLKKWTGKKQCKEIYN

SEQ ID NO: 2503552 - protein, 20 aa, Entamoeba dispar
SDCYKNLCGPRCYYCKQPIE

SEQ ID NO: 2503553 - protein, 21 aa, Entamoeba dispar
SDDGELEWHRALLKNKTEIAL

SEQ ID NO: 2503554 - protein, 17 aa, Entamoeba dispar
SDDGNIIFYKLSPKKVD

SEQ ID NO: 2503555 - protein, 23 aa, Entamoeba dispar
SDDGVCKLADFGVSTKMGGTNKL

SEQ ID NO: 2503556 - protein, 25 aa, Entamoeba dispar
SDDIRKSALLCFGRTINKIDDLRSI

SEQ ID NO: 2503557 - protein, 25 aa, Entamoeba dispar
SDDITVDMVIEWLCLNIPSRLLPNS

SEQ ID NO: 2503558 - protein, 21 aa, Entamoeba dispar
SDDLIKHIVRFITSLNGQCQL

SEQ ID NO: 2503559 - protein, 24 aa, Entamoeba dispar
SDDLKQILKDAGVKRRDLADPDTV

SEQ ID NO: 2503560 - protein, 18 aa, Entamoeba dispar
SDDLLSLLTFSLLNSTMR

SEQ ID NO: 2503561 - protein, 28 aa, Entamoeba dispar
SDDSIELYKRFDLESLKMQIQQEELEEE

SEQ ID NO: 2503562 - protein, 25 aa, Entamoeba dispar
SDDTFKPFFLKCAEGFNEVVGTSEI

SEQ ID NO: 2503563 - protein, 19 aa, Entamoeba dispar
SDEDKIHWPFTVQGNENGK

SEQ ID NO: 2503564 - protein, 24 aa, Entamoeba dispar
SDEEIPEDVQLLLIQLNSIQPCLN

SEQ ID NO: 2503565 - protein, 24 aa, Entamoeba dispar
SDEHGTVCPINWKAGKDTIEPTPE

SEQ ID NO: 2503566 - protein, 24 aa, Entamoeba dispar
SDEHGTVCPINWKTGKDTIEPTPE

SEQ ID NO: 2503567 - protein, 20 aa, Entamoeba dispar
SDEIIPFNLILPTEKLSPSF

SEQ ID NO: 2503568 - protein, 25 aa, Entamoeba dispar
SDEIWICRGDMGVQLGFVGMAKFVR

SEQ ID NO: 2503569 - protein, 25 aa, Entamoeba dispar
SDELWKEKKEVLKVHFEEAFETENF

SEQ ID NO: 2503570 - protein, 21 aa, Entamoeba dispar
SDEMKLCRSICNGSGSQNECS

SEQ ID NO: 2503571 - protein, 17 aa, Entamoeba dispar
SDEPYAFQIRFAGVKGV

SEQ ID NO: 2503572 - protein, 24 aa, Entamoeba dispar
SDESHKPCFEKRLFETCKSSNKSN

SEQ ID NO: 2503573 - protein, 23 aa, Entamoeba dispar
SDEVKKLLQLMGIPCVEANCEAE

SEQ ID NO: 2503574 - protein, 23 aa, Entamoeba dispar
SDEVKRTAVLVLGFILNKRLDEL

SEQ ID NO: 2503575 - protein, 26 aa, Entamoeba dispar
SDEYRQLLCECCEKIMTETELKLEKA

SEQ ID NO: 2503576 - protein, 25 aa, Entamoeba dispar
SDFDIRFYSMELLKILMKNRQENVL

SEQ ID NO: 2503577 - protein, 17 aa, Entamoeba dispar
SDFEIQRNIPIPDNVKI

SEQ ID NO: 2503578 - protein, 19 aa, Entamoeba dispar
SDFGEIFCKEVCKDALNQL

SEQ ID NO: 2503579 - protein, 21 aa, Entamoeba dispar
SDFHFEMKYSRTKGATKTVKM

SEQ ID NO: 2503580 - protein, 23 aa, Entamoeba dispar
SDFIKICTSIEWVVERTQHFTIL

SEQ ID NO: 2503581 - protein, 23 aa, Entamoeba dispar
SDFKFGKPSNKEWKIVTYNKEPF

SEQ ID NO: 2503582 - protein, 25 aa, Entamoeba dispar
SDFKKEKRGILVIDFESVIFYGFEK

SEQ ID NO: 2503583 - protein, 22 aa, Entamoeba dispar
SDFNNRVNLFISVRNYGVGQCV

SEQ ID NO: 2503584 - protein, 17 aa, Entamoeba dispar
SDFSNLMIEGSKVKIKR

SEQ ID NO: 2503585 - protein, 23 aa, Entamoeba dispar
SDFTQAVFIKCFTNYIPSSSQEA

SEQ ID NO: 2503586 - protein, 27 aa, Entamoeba dispar
SDGEKKKACGFVKFKRVEDAIRCVCDA

SEQ ID NO: 2503587 - protein, 28 aa, Entamoeba dispar
SDGKAILRFKGINIPGGKALPKGYKMSK

SEQ ID NO: 2503588 - protein, 30 aa, Entamoeba dispar
SDGNELYIFRSGKYFNFIKEYILSRKLLIN

SEQ ID NO: 2503589 - protein, 17 aa, Entamoeba dispar
SDGQLLLRPINSEPNSV

SEQ ID NO: 2503590 - protein, 21 aa, Entamoeba dispar
SDHMYRMAILAMIFCPSHLDR

SEQ ID NO: 2503591 - protein, 23 aa, Entamoeba dispar
SDIEAAALCLKTMHSVEKKNVLI

SEQ ID NO: 2503592 - protein, 17 aa, Entamoeba dispar
SDIFISGEFTYEIIDDG

SEQ ID NO: 2503593 - protein, 19 aa, Entamoeba dispar
SDIFTSINLELMKKEIFST

SEQ ID NO: 2503594 - protein, 17 aa, Entamoeba dispar
SDIFYYLLEFLTFPFEQ

SEQ ID NO: 2503595 - protein, 25 aa, Entamoeba dispar
SDILLKVKLPPLLLKLNSTTLSSYN

SEQ ID NO: 2503596 - protein, 17 aa, Entamoeba dispar
SDIMLLIHLRGNKKSTY

SEQ ID NO: 2503597 - protein, 31 aa, Entamoeba dispar
SDINGVIALLRFCGKYAKLSHKPLIDDSQCL

SEQ ID NO: 2503598 - protein, 24 aa, Entamoeba dispar
SDIPKMIARQVIKTYFIQYNTMDT

SEQ ID NO: 2503599 - protein, 26 aa, Entamoeba dispar
SDIRKKLEIVTCITKGFIFEDEERNK

SEQ ID NO: 2503600 - protein, 25 aa, Entamoeba dispar
SDIRKKLEIVTCITKGFVFEDQERN

SEQ ID NO: 2503601 - protein, 18 aa, Entamoeba dispar
SDIRRMNVALTRAKNALW

SEQ ID NO: 2503602 - protein, 17 aa, Entamoeba dispar
SDITFRMSTIRMSSINL

SEQ ID NO: 2503603 - protein, 35 aa, Entamoeba dispar
SDIWSLGVLIFVLFCNRFPFPPNKVFETLSQQKKI

SEQ ID NO: 2503604 - protein, 23 aa, Entamoeba dispar
SDKEYKFMIDFTSFLSRYYSFDD

SEQ ID NO: 2503605 - protein, 18 aa, Entamoeba dispar
SDKKWASRLIKRSMDAIA

SEQ ID NO: 2503606 - protein, 19 aa, Entamoeba dispar
SDKSYGKLIYCIKRIRELL

SEQ ID NO: 2503607 - protein, 19 aa, Entamoeba dispar
SDLELIKGYQNNKMEEVLD

SEQ ID NO: 2503608 - protein, 20 aa, Entamoeba dispar
SDLGARCLCYSIIGYYKLLL

SEQ ID NO: 2503609 - protein, 21 aa, Entamoeba dispar
SDLGARCLCYSIIGYYKLLLN

SEQ ID NO: 2503610 - protein, 24 aa, Entamoeba dispar
SDLGKSCFNGCACEHLLKQNTNIP

SEQ ID NO: 2503611 - protein, 17 aa, Entamoeba dispar
SDLICLIKKEFNQHQQV

SEQ ID NO: 2503612 - protein, 23 aa, Entamoeba dispar
SDLIGKIRQGITCITSKDEKLTK

SEQ ID NO: 2503613 - protein, 18 aa, Entamoeba dispar
SDLIKLPPLDQGVYKILF

SEQ ID NO: 2503614 - protein, 17 aa, Entamoeba dispar
SDLKEILSYTSPQILCL

SEQ ID NO: 2503615 - protein, 17 aa, Entamoeba dispar
SDLKGENIVSYKLLHSL

SEQ ID NO: 2503616 - protein, 21 aa, Entamoeba dispar
SDLKITMISSYNFTQTKDDNK

SEQ ID NO: 2503617 - protein, 21 aa, Entamoeba dispar
SDLKKIRRVVSKDLVNNKVTK

SEQ ID NO: 2503618 - protein, 23 aa, Entamoeba dispar
SDLKRSDPYIIFIANKEKYKTKV

SEQ ID NO: 2503619 - protein, 17 aa, Entamoeba dispar
SDLLCNACNAPTQQMFD

SEQ ID NO: 2503620 - protein, 19 aa, Entamoeba dispar
SDLLLILFHRALCSCLGSF

SEQ ID NO: 2503621 - protein, 20 aa, Entamoeba dispar
SDLLNIFIAKAYKFNEYIDT

SEQ ID NO: 2503622 - protein, 22 aa, Entamoeba dispar
SDLMTFKGVILGITRYGISKMK

SEQ ID NO: 2503623 - protein, 20 aa, Entamoeba dispar
SDLNAICFVAQSSNARLTAN

SEQ ID NO: 2503624 - protein, 17 aa, Entamoeba dispar
SDLNIILFRILSSGTPL

SEQ ID NO: 2503625 - protein, 35 aa, Entamoeba dispar
SDLQDGIIFRDLLRALGVPCGNSLEDVITASSTIG

SEQ ID NO: 2503626 - protein, 23 aa, Entamoeba dispar
SDLRMIKPFLSYYHNAAVKAIKF

SEQ ID NO: 2503627 - protein, 17 aa, Entamoeba dispar
SDLRPNLFGEINNRERW

SEQ ID NO: 2503628 - protein, 19 aa, Entamoeba dispar
SDLSLWGLGALSFSLYSSL

SEQ ID NO: 2503629 - protein, 21 aa, Entamoeba dispar
SDLTHLFALNIFESTIKSPEY

SEQ ID NO: 2503630 - protein, 23 aa, Entamoeba dispar
SDLVCMSSYYLFRKGIEPKWEDE

SEQ ID NO: 2503631 - protein, 17 aa, Entamoeba dispar
SDLYQKFFEDLEVLFID

SEQ ID NO: 2503632 - protein, 32 aa, Entamoeba dispar
SDLYSIGVCLYRLTTCRFPFATTKTEFIQQMK

SEQ ID NO: 2503633 - protein, 17 aa, Entamoeba dispar
SDLYSLFLQEKLFLHEC

SEQ ID NO: 2503634 - protein, 18 aa, Entamoeba dispar
SDLYSLFLQEKLFLHECT

SEQ ID NO: 2503635 - protein, 18 aa, Entamoeba dispar
SDLYSVGVILYVLATNQF

SEQ ID NO: 2503636 - protein, 23 aa, Entamoeba dispar
SDMLIKYPILKGLFDNGELLDDD

SEQ ID NO: 2503637 - protein, 25 aa, Entamoeba dispar
SDMPRCAYCRAFMSKEMNWIRLGGK

SEQ ID NO: 2503638 - protein, 25 aa, Entamoeba dispar
SDMRVCLFSGEIIRESIQIDIEQVR

SEQ ID NO: 2503639 - protein, 17 aa, Entamoeba dispar
SDMWSLGCILYELCTLT

SEQ ID NO: 2503640 - protein, 24 aa, Entamoeba dispar
SDNEIKSLLGWARCLRPINVDKIK

SEQ ID NO: 2503641 - protein, 30 aa, Entamoeba dispar
SDNEIKSMLTWIRFLPHINVEEIQEPDSKY

SEQ ID NO: 2503642 - protein, 25 aa, Entamoeba dispar
SDNFPREEIPTLLSVLKSLYEENKR

SEQ ID NO: 2503643 - protein, 43 aa, Entamoeba dispar
SDNGVMFLQFAFRWINCCLLREFKLGTALRLWDSYMSVEDGTG

SEQ ID NO: 2503644 - protein, 23 aa, Entamoeba dispar
SDNKDLPVCFVLTKSDQLHPTVD

SEQ ID NO: 2503645 - protein, 23 aa, Entamoeba dispar
SDNKRLFVNVAISSSVRDMKEKI

SEQ ID NO: 2503646 - protein, 25 aa, Entamoeba dispar
SDNRWLLVQHPVYGLGYVPLSYVQC

SEQ ID NO: 2503647 - protein, 18 aa, Entamoeba dispar
SDPEGWLGAETIDGSRGW

SEQ ID NO: 2503648 - protein, 24 aa, Entamoeba dispar
SDPINSLFLLFGTRFNKDVPSQKN

SEQ ID NO: 2503649 - protein, 25 aa, Entamoeba dispar
SDPLPPRLFRKYLAYARANIHPQLN

SEQ ID NO: 2503650 - protein, 24 aa, Entamoeba dispar
SDPMGRAAMIGAIEKQKLVYIFNR

SEQ ID NO: 2503651 - protein, 18 aa, Entamoeba dispar
SDPNRIATFSSYGDRVVV

SEQ ID NO: 2503652 - protein, 32 aa, Entamoeba dispar
SDPRIGCCMKGHPCCKRIDGQYVLTEDSKCIL

SEQ ID NO: 2503653 - protein, 22 aa, Entamoeba dispar
SDPSIYHPIKIVGKGSYGTVMY

SEQ ID NO: 2503654 - protein, 25 aa, Entamoeba dispar
SDPVPRIVSRVCDFVSSLLDNIDPS

SEQ ID NO: 2503655 - protein, 19 aa, Entamoeba dispar
SDQCIQFLRILVATLSNDF

SEQ ID NO: 2503656 - protein, 29 aa, Entamoeba dispar
SDQFLIVACDGVWDFLRNEEVYSIVKNRI

SEQ ID NO: 2503657 - protein, 17 aa, Entamoeba dispar
SDQGNRIIVAGACGGVV

SEQ ID NO: 2503658 - protein, 32 aa, Entamoeba dispar
SDQQITFKFIRIYRLFINFLGGDIVDLSTGEI

SEQ ID NO: 2503659 - protein, 21 aa, Entamoeba dispar
SDQQPKCTILYSHHSTERLET

SEQ ID NO: 2503660 - protein, 24 aa, Entamoeba dispar
SDQRKTKCKHEYYIDCKVLNLNEF

SEQ ID NO: 2503661 - protein, 22 aa, Entamoeba dispar
SDQYCYHSFGWDENGIVCYCRV

SEQ ID NO: 2503662 - protein, 25 aa, Entamoeba dispar
SDRCPPGGLGRLQFIIAKHGDASRL

SEQ ID NO: 2503663 - protein, 21 aa, Entamoeba dispar
SDRGARLAVLQGFSSTTQIFD

SEQ ID NO: 2503664 - protein, 23 aa, Entamoeba dispar
SDRKKCLLCGGINEPITKQDISL

SEQ ID NO: 2503665 - protein, 18 aa, Entamoeba dispar
SDSANIKIEMSILESEGD

SEQ ID NO: 2503666 - protein, 27 aa, Entamoeba dispar
SDSDFHRSWCAFRCTQLLTLLDQIVSV

SEQ ID NO: 2503667 - protein, 25 aa, Entamoeba dispar
SDSEEMKKFIALLVMKAGTKEKAIK

SEQ ID NO: 2503668 - protein, 19 aa, Entamoeba dispar
SDSGEFLQGQFRPMNDKDD

SEQ ID NO: 2503669 - protein, 18 aa, Entamoeba dispar
SDSHFFRDKIRPCQSDDE

SEQ ID NO: 2503670 - protein, 20 aa, Entamoeba dispar
SDTDLALPFLQGNYLLEQGL

SEQ ID NO: 2503671 - protein, 22 aa, Entamoeba dispar
SDTIPFGALYVYNDRTHHVLMQ

SEQ ID NO: 2503672 - protein, 23 aa, Entamoeba dispar
SDTIPFGALYVYNDRTHHVLMQT

SEQ ID NO: 2503673 - protein, 20 aa, Entamoeba dispar
SDTRLLSVIQYFDDSQFEWN

SEQ ID NO: 2503674 - protein, 26 aa, Entamoeba dispar
SDTYKGVPAGETWVWYTNPNPRPKTE

SEQ ID NO: 2503675 - protein, 24 aa, Entamoeba dispar
SDVATLISMCFAHHYDSRPDFNDI

SEQ ID NO: 2503676 - protein, 24 aa, Entamoeba dispar
SDVAVSFFDIYSLIQQFKIKDILD

SEQ ID NO: 2503677 - protein, 21 aa, Entamoeba dispar
SDVCGQPSSPGYVIVLHFPTI

SEQ ID NO: 2503678 - protein, 17 aa, Entamoeba dispar
SDVFSFGILMYETFSKQ

SEQ ID NO: 2503679 - protein, 27 aa, Entamoeba dispar
SDVGRYAVLCALQFSLTLCLPHDTISI

SEQ ID NO: 2503680 - protein, 26 aa, Entamoeba dispar
SDVIKMTICGGSYPPDIEKVKSISDF

SEQ ID NO: 2503681 - protein, 24 aa, Entamoeba dispar
SDVISKFAPYCCLLNLDECKDVNK

SEQ ID NO: 2503682 - protein, 27 aa, Entamoeba dispar
SDVLRFLRRIRCWELRHLPRIHRVARP

SEQ ID NO: 2503683 - protein, 28 aa, Entamoeba dispar
SDVPKFIVRGRMNKAFFKVRKIVAEQFC

SEQ ID NO: 2503684 - protein, 18 aa, Entamoeba dispar
SDVSLRILSGMLNEKFKN

SEQ ID NO: 2503685 - protein, 36 aa, Entamoeba dispar
SDVYSKLQWCGNMNITLFSFILFKMEIHNMLCIYFD

SEQ ID NO: 2503686 - protein, 19 aa, Entamoeba dispar
SDWEKSDVCTFHREHMTMP

SEQ ID NO: 2503687 - protein, 18 aa, Entamoeba dispar
SDYFEHFLTLLGDKVELF

SEQ ID NO: 2503688 - protein, 20 aa, Entamoeba dispar
SDYHKPFCIIVMDVNGIWKK

SEQ ID NO: 2503689 - protein, 23 aa, Entamoeba dispar
SDYHKPFCIIVMDVNGIWKKFYG

SEQ ID NO: 2503690 - protein, 19 aa, Entamoeba dispar
SDYIIYFYGSVLFKNKRYL

SEQ ID NO: 2503691 - protein, 20 aa, Entamoeba dispar
SDYLIPKIVEYVIEFMELSC

SEQ ID NO: 2503692 - protein, 19 aa, Entamoeba dispar
SDYSVCLREKILGMKINSF

SEQ ID NO: 2503693 - protein, 18 aa, Entamoeba dispar
SEAERACRRANGMRIEEK

SEQ ID NO: 2503694 - protein, 22 aa, Entamoeba dispar
SEAHAKIHLRGVVTTEDVKIAL

SEQ ID NO: 2503695 - protein, 21 aa, Entamoeba dispar
SEAIKAYFKAISLTPQLPEVW

SEQ ID NO: 2503696 - protein, 17 aa, Entamoeba dispar
SEAILSRNGKIILSGIR

SEQ ID NO: 2503697 - protein, 23 aa, Entamoeba dispar
SEAKRRNCPVIAYTYNEPTVFTE

SEQ ID NO: 2503698 - protein, 23 aa, Entamoeba dispar
SECIKRVKHIPALTMTIVKEIMS

SEQ ID NO: 2503699 - protein, 22 aa, Entamoeba dispar
SECLMIPLLKVERCWAYSNELQ

SEQ ID NO: 2503700 - protein, 21 aa, Entamoeba dispar
SEDAIWKWKEDCSNSEDYSRF

SEQ ID NO: 2503701 - protein, 17 aa, Entamoeba dispar
SEDAVVVFRVYCYHVEK

SEQ ID NO: 2503702 - protein, 24 aa, Entamoeba dispar
SEDEIVMLLTWARSLPSINVGKVI

SEQ ID NO: 2503703 - protein, 19 aa, Entamoeba dispar
SEDELIILLKAIVLGDESV

SEQ ID NO: 2503704 - protein, 27 aa, Entamoeba dispar
SEDELRTVLMIAPWFPHKSIQQISLRM

SEQ ID NO: 2503705 - protein, 18 aa, Entamoeba dispar
SEDLPQWFEVPNEAFGRI

SEQ ID NO: 2503706 - protein, 19 aa, Entamoeba dispar
SEDNIKPLCKLFDIENEEK

SEQ ID NO: 2503707 - protein, 21 aa, Entamoeba dispar
SEDQNQCFIAGFINPQFEEGH

SEQ ID NO: 2503708 - protein, 22 aa, Entamoeba dispar
SEDQNQCFIAGFINPQFEEGHV

SEQ ID NO: 2503709 - protein, 22 aa, Entamoeba dispar
SEDRKKDILDLINPSSTVIITN

SEQ ID NO: 2503710 - protein, 20 aa, Entamoeba dispar
SEDSFSLKLADFSFSRRIDE

SEQ ID NO: 2503711 - protein, 19 aa, Entamoeba dispar
SEDVDWKLAQKLCGLDKTA

SEQ ID NO: 2503712 - protein, 26 aa, Entamoeba dispar
SEDYKVFATEFFKEGVHGFLPQAKQF

SEQ ID NO: 2503713 - protein, 22 aa, Entamoeba dispar
SEEAFRVMVRTIKLWTKKRGIY

SEQ ID NO: 2503714 - protein, 23 aa, Entamoeba dispar
SEEARFNEILLRRKSSNELKKRK

SEQ ID NO: 2503715 - protein, 30 aa, Entamoeba dispar
SEEEKKKWLLESWNRVVNFYNELNDKVNDL

SEQ ID NO: 2503716 - protein, 38 aa, Entamoeba dispar
SEEFCGHYMFPYCILNKHLPFWGGYVGSHFEIEWDDRS

SEQ ID NO: 2503717 - protein, 26 aa, Entamoeba dispar
SEEIGTRLGGMVGYTVRFEDVTSDRT

SEQ ID NO: 2503718 - protein, 27 aa, Entamoeba dispar
SEEIWKKFVEWCMKRTPSIAESLLKKI

SEQ ID NO: 2503719 - protein, 20 aa, Entamoeba dispar
SEELALFKLLYNHPITTPSL

SEQ ID NO: 2503720 - protein, 20 aa, Entamoeba dispar
SEELWKLRKKPNIWTYEEII

SEQ ID NO: 2503721 - protein, 18 aa, Entamoeba dispar
SEEMRHVWDQLKEIDYSQ

SEQ ID NO: 2503722 - protein, 21 aa, Entamoeba dispar
SEENPRKALSLLGKSAKILKR

SEQ ID NO: 2503723 - protein, 17 aa, Entamoeba dispar
SEESIKLLTEFQSLVNY

SEQ ID NO: 2503724 - protein, 25 aa, Entamoeba dispar
SEEVKEMKASVILCINGDGKGARPL

SEQ ID NO: 2503725 - protein, 33 aa, Entamoeba dispar
SEEYILILGCNCIKEIMNCYGIGYNVNHQNKEE

SEQ ID NO: 2503726 - protein, 17 aa, Entamoeba dispar
SEFDRSRIQQIEIDRNQ

SEQ ID NO: 2503727 - protein, 23 aa, Entamoeba dispar
SEFELPGPLPLPKEFNTLNDNFG

SEQ ID NO: 2503728 - protein, 19 aa, Entamoeba dispar
SEFGSFLSYCRNLKFDEEP

SEQ ID NO: 2503729 - protein, 18 aa, Entamoeba dispar
SEFINHFLQLLRFYHHNQ

SEQ ID NO: 2503730 - protein, 22 aa, Entamoeba dispar
SEFKFPSLNDFCTRELNDLISK

SEQ ID NO: 2503731 - protein, 19 aa, Entamoeba dispar
SEFKKPLCQSHITVVSSIP

SEQ ID NO: 2503732 - protein, 19 aa, Entamoeba dispar
SEFKLLGEFHQLIYCDINE

SEQ ID NO: 2503733 - protein, 22 aa, Entamoeba dispar
SEFLEPTLICLKVIAEGIFGTL

SEQ ID NO: 2503734 - protein, 18 aa, Entamoeba dispar
SEFSVWSEYYFRNASNIL

SEQ ID NO: 2503735 - protein, 17 aa, Entamoeba dispar
SEFVFQPILMHSTSTLV

SEQ ID NO: 2503736 - protein, 23 aa, Entamoeba dispar
SEFYEYSVIFSKQFPTVNQRLKN

SEQ ID NO: 2503737 - protein, 22 aa, Entamoeba dispar
SEGDLIRTGIRPNRKTGRQAPT

SEQ ID NO: 2503738 - protein, 19 aa, Entamoeba dispar
SEGEILNCLVLANYVVQNS

SEQ ID NO: 2503739 - protein, 26 aa, Entamoeba dispar
SEGFKSFKNALTWEFKSFSFEKGVEY

SEQ ID NO: 2503740 - protein, 17 aa, Entamoeba dispar
SEGHRPLRCNGSVISVA

SEQ ID NO: 2503741 - protein, 18 aa, Entamoeba dispar
SEGIDFGDDMARVVIIVG

SEQ ID NO: 2503742 - protein, 19 aa, Entamoeba dispar
SEGILKYRSIQDVVTTIVH

SEQ ID NO: 2503743 - protein, 21 aa, Entamoeba dispar
SEGLDLWTFNRNEIVQHYDTE

SEQ ID NO: 2503744 - protein, 18 aa, Entamoeba dispar
SEGVFRLAGEQGMVKSLK

SEQ ID NO: 2503745 - protein, 24 aa, Entamoeba dispar
SEGYLIVLECNGIIKIYNNQFELT

SEQ ID NO: 2503746 - protein, 25 aa, Entamoeba dispar
SEHFSMKFKYGWYSSHIKNICKEIE

SEQ ID NO: 2503747 - protein, 24 aa, Entamoeba dispar
SEHPTHFVKPCANKGVKISCSADR

SEQ ID NO: 2503748 - protein, 23 aa, Entamoeba dispar
SEHSYYGFVCLLQISTRSSDYII

SEQ ID NO: 2503749 - protein, 19 aa, Entamoeba dispar
SEIALHLNLPSSFVKTAIS

SEQ ID NO: 2503750 - protein, 19 aa, Entamoeba dispar
SEIEDWLFISGEMTAADPE

SEQ ID NO: 2503751 - protein, 23 aa, Entamoeba dispar
SEIESMPNLIAFNIIGNELETHC

SEQ ID NO: 2503752 - protein, 20 aa, Entamoeba dispar
SEIGDWCFQGCYSLKSINIP

SEQ ID NO: 2503753 - protein, 25 aa, Entamoeba dispar
SEIGDYCFRECYSLKSINIPSSVIS

SEQ ID NO: 2503754 - protein, 22 aa, Entamoeba dispar
SEIGNKCFYRCLSFKSINIPSS

SEQ ID NO: 2503755 - protein, 22 aa, Entamoeba dispar
SEIGNYCFYGCSSLQLINIPSS

SEQ ID NO: 2503756 - protein, 23 aa, Entamoeba dispar
SEIGQGCFRGCSSLKSISIPSSV

SEQ ID NO: 2503757 - protein, 39 aa, Entamoeba dispar
SEIKDGRIIISLPFRLKYVCSFENIPFVKIGDIIPLSVI

SEQ ID NO: 2503758 - protein, 20 aa, Entamoeba dispar
SEIKKWYGYILNSFLQYPKN

SEQ ID NO: 2503759 - protein, 21 aa, Entamoeba dispar
SEILASCGLVNYLIPKSFEEE

SEQ ID NO: 2503760 - protein, 21 aa, Entamoeba dispar
SEILKGLWYLHSEHHIVHRDL

SEQ ID NO: 2503761 - protein, 21 aa, Entamoeba dispar
SEILKNVVISGISKVTVIDTY

SEQ ID NO: 2503762 - protein, 22 aa, Entamoeba dispar
SEILKTRIGITLNLAQNQIRKQ

SEQ ID NO: 2503763 - protein, 23 aa, Entamoeba dispar
SEINFIPLLRTVFYKFFGERNLT

SEQ ID NO: 2503764 - protein, 22 aa, Entamoeba dispar
SEINQLLPLFIDKFFNQFNEGT

SEQ ID NO: 2503765 - protein, 17 aa, Entamoeba dispar
SEIPKFVDPLHWLQYFP

SEQ ID NO: 2503766 - protein, 25 aa, Entamoeba dispar
SEIQLKLLRIVHCDSLKLKINYINT

SEQ ID NO: 2503767 - protein, 24 aa, Entamoeba dispar
SEIRDSCFRECKSLKSINIPTTVS

SEQ ID NO: 2503768 - protein, 20 aa, Entamoeba dispar
SEIRYCLNSTLLNTLLYEWY

SEQ ID NO: 2503769 - protein, 18 aa, Entamoeba dispar
SEISEIKPILAPIKNKCN

SEQ ID NO: 2503770 - protein, 18 aa, Entamoeba dispar
SEITEEVHTIPLPPSNVP

SEQ ID NO: 2503771 - protein, 24 aa, Entamoeba dispar
SEITLLRGCIKRLFNSITSLSNAV

SEQ ID NO: 2503772 - protein, 19 aa, Entamoeba dispar
SEIVGTCCVCGQNCMDLEC

SEQ ID NO: 2503773 - protein, 28 aa, Entamoeba dispar
SEKDFRDGILLIKLCSKITHTKKPMYKH

SEQ ID NO: 2503774 - protein, 18 aa, Entamoeba dispar
SEKEIKMVDAYGIKGQQH

SEQ ID NO: 2503775 - protein, 30 aa, Entamoeba dispar
SEKELKEIVKLQMGEVIKMIKKRYPLSEVE

SEQ ID NO: 2503776 - protein, 24 aa, Entamoeba dispar
SEKEWKVNAGWKLVQTKGTEEVPF

SEQ ID NO: 2503777 - protein, 23 aa, Entamoeba dispar
SEKIKVLKFHLILCNKLTEMNVQ

SEQ ID NO: 2503778 - protein, 22 aa, Entamoeba dispar
SEKLSGALIQDWKRLMDEKIHL

SEQ ID NO: 2503779 - protein, 21 aa, Entamoeba dispar
SEKLVRYIFQLAMYDNSFDIR

SEQ ID NO: 2503780 - protein, 25 aa, Entamoeba dispar
SEKQDWKSFLFPFAADIRPRANEWL

SEQ ID NO: 2503781 - protein, 23 aa, Entamoeba dispar
SEKRIKMINSITEFNEESEAKSR

SEQ ID NO: 2503782 - protein, 25 aa, Entamoeba dispar
SEKVMCIYCALKAVEQTCYYVSLKC

SEQ ID NO: 2503783 - protein, 18 aa, Entamoeba dispar
SEKWLIDECENIHLLTNT

SEQ ID NO: 2503784 - protein, 23 aa, Entamoeba dispar
SEKYVICIQMEYCTGGDLSKIIK

SEQ ID NO: 2503785 - protein, 25 aa, Entamoeba dispar
SELECSLLTLPMVWNENRFKKTIEM

SEQ ID NO: 2503786 - protein, 23 aa, Entamoeba dispar
SELEPKSSLLPSITKILPTEENL

SEQ ID NO: 2503787 - protein, 23 aa, Entamoeba dispar
SELFKEMFEEGITYTEENATDEL

SEQ ID NO: 2503788 - protein, 25 aa, Entamoeba dispar
SELGNNCFRGCASLRNITIPISITK

SEQ ID NO: 2503789 - protein, 26 aa, Entamoeba dispar
SELGNYCFRYCLSLRSINIPSSITSI

SEQ ID NO: 2503790 - protein, 22 aa, Entamoeba dispar
SELGSYCFNKCLSLKSINIPSS

SEQ ID NO: 2503791 - protein, 22 aa, Entamoeba dispar
SELHAMRAIFLIPNRPPPTLSA

SEQ ID NO: 2503792 - protein, 27 aa, Entamoeba dispar
SELIEPLPRFAIGIAQTRGIRESMEDV

SEQ ID NO: 2503793 - protein, 21 aa, Entamoeba dispar
SELKATIAAMFSYLTNNADDI

SEQ ID NO: 2503794 - protein, 20 aa, Entamoeba dispar
SELKGMPFLIYVNKTDKKQF

SEQ ID NO: 2503795 - protein, 18 aa, Entamoeba dispar
SELKLQVEKVAGKTGIEQ

SEQ ID NO: 2503796 - protein, 21 aa, Entamoeba dispar
SELKPILPSLDTFQSASSPIK

SEQ ID NO: 2503797 - protein, 21 aa, Entamoeba dispar
SELKRVCVQSISFSCKPPNVE

SEQ ID NO: 2503798 - protein, 18 aa, Entamoeba dispar
SELKTRLTPQRRSPLSPS

SEQ ID NO: 2503799 - protein, 20 aa, Entamoeba dispar
SELNIPPGKIVKEIIISIVK

SEQ ID NO: 2503800 - protein, 21 aa, Entamoeba dispar
SELNIPPGKIVKEIIISIVKP

SEQ ID NO: 2503801 - protein, 17 aa, Entamoeba dispar
SELNKTCINQVIEEKFI

SEQ ID NO: 2503802 - protein, 20 aa, Entamoeba dispar
SELNNVFLIIAIYNSYIFDK

SEQ ID NO: 2503803 - protein, 18 aa, Entamoeba dispar
SELNRLKKSFSIEKQEDL

SEQ ID NO: 2503804 - protein, 18 aa, Entamoeba dispar
SELPCQWVENHIDYINEK

SEQ ID NO: 2503805 - protein, 21 aa, Entamoeba dispar
SELPIASTVLHYFIELAVKIA

SEQ ID NO: 2503806 - protein, 17 aa, Entamoeba dispar
SELPSIPIVNPQQLNKQ

SEQ ID NO: 2503807 - protein, 20 aa, Entamoeba dispar
SELRMSLKENKHERMLNEIV

SEQ ID NO: 2503808 - protein, 20 aa, Entamoeba dispar
SELSCNCFYKCVSLKSINIP

SEQ ID NO: 2503809 - protein, 23 aa, Entamoeba dispar
SELSISLLRMMYALEFNYQLMAP

SEQ ID NO: 2503810 - protein, 20 aa, Entamoeba dispar
SELSKRGFVVVFISDNITCV

SEQ ID NO: 2503811 - protein, 19 aa, Entamoeba dispar
SELYILKLLPVLNLHIEKV

SEQ ID NO: 2503812 - protein, 19 aa, Entamoeba dispar
SEMECPLCMNTHNTNDIFT

SEQ ID NO: 2503813 - protein, 21 aa, Entamoeba dispar
SEMEGKFVIVDIVEECIALIL

SEQ ID NO: 2503814 - protein, 24 aa, Entamoeba dispar
SEMFPKFIHCVVAMGYEKILVYLL

SEQ ID NO: 2503815 - protein, 17 aa, Entamoeba dispar
SEMIIQGNVTRNWIKNG

SEQ ID NO: 2503816 - protein, 19 aa, Entamoeba dispar
  misc_feature (19)..(19): Xaa can be any naturally occurring amino acid
SEMIIYGRINNNWIKAREX

SEQ ID NO: 2503817 - protein, 19 aa, Entamoeba dispar
SEMIIYGRVNNNWIKAREN

SEQ ID NO: 2503818 - protein, 17 aa, Entamoeba dispar
SEMKFQIDHIVPVLSPI

SEQ ID NO: 2503819 - protein, 23 aa, Entamoeba dispar
SEMKRIIKNRVFKEIEQVSKEMS

SEQ ID NO: 2503820 - protein, 21 aa, Entamoeba dispar
SENDFILPITKLIISIISHPS

SEQ ID NO: 2503821 - protein, 24 aa, Entamoeba dispar
SENEIISMLSWVRTLPSLKNKEVK

SEQ ID NO: 2503822 - protein, 24 aa, Entamoeba dispar
SENEIKNLLNWAYYLTPLDKKRSE

SEQ ID NO: 2503823 - protein, 18 aa, Entamoeba dispar
SENIAFFGVFDGHLGTST

SEQ ID NO: 2503824 - protein, 21 aa, Entamoeba dispar
SENKRVLNISTLEGKQNSINL

SEQ ID NO: 2503825 - protein, 25 aa, Entamoeba dispar
SENLYFSLPFPFCVIDPLKQTIARS

SEQ ID NO: 2503826 - protein, 19 aa, Entamoeba dispar
SENRLINDFLRERETGRLD

SEQ ID NO: 2503827 - protein, 19 aa, Entamoeba dispar
SENTFLQDRIRDFLNSNNG

SEQ ID NO: 2503828 - protein, 26 aa, Entamoeba dispar
SENTLRCLFASILNERRVVIIGQNPS

SEQ ID NO: 2503829 - protein, 17 aa, Entamoeba dispar
SEPDGFGSVPITNEQFR

SEQ ID NO: 2503830 - protein, 21 aa, Entamoeba dispar
SEPFSLLQLPIMKNLSFLKKV

SEQ ID NO: 2503831 - protein, 18 aa, Entamoeba dispar
SEPQILKNKIVVVYASAY

SEQ ID NO: 2503832 - protein, 21 aa, Entamoeba dispar
SEPSFKSSFGKKLVSTLLKKL

SEQ ID NO: 2503833 - protein, 19 aa, Entamoeba dispar
SEPSFRFNLKTIKEDCFSS

SEQ ID NO: 2503834 - protein, 17 aa, Entamoeba dispar
SEQGDFAIIEFGKKMKF

SEQ ID NO: 2503835 - protein, 20 aa, Entamoeba dispar
SEQQLAHVISQFRQRCLKKK

SEQ ID NO: 2503836 - protein, 19 aa, Entamoeba dispar
SERCKCQWLLELISFSIED

SEQ ID NO: 2503837 - protein, 25 aa, Entamoeba dispar
SERLGRLAALLAEAGNPWEIVRQDV

SEQ ID NO: 2503838 - protein, 26 aa, Entamoeba dispar
SERRYIPELIGWIRKGFKIVKDSKRK

SEQ ID NO: 2503839 - protein, 18 aa, Entamoeba dispar
SERYNFDLTHGIAKKTCQ

SEQ ID NO: 2503840 - protein, 19 aa, Entamoeba dispar
SESDLFVWEAVIIGPEGTE

SEQ ID NO: 2503841 - protein, 17 aa, Entamoeba dispar
SESDVVVLKRGEFLFPG

SEQ ID NO: 2503842 - protein, 20 aa, Entamoeba dispar
SESDYALTQGRLSLQPLSKN

SEQ ID NO: 2503843 - protein, 25 aa, Entamoeba dispar
SESECASLIPPFMIDLLRKNTSTAA

SEQ ID NO: 2503844 - protein, 24 aa, Entamoeba dispar
SESFKKLLINNGIVPMLIQKYIVL

SEQ ID NO: 2503845 - protein, 17 aa, Entamoeba dispar
SESKIKVLMKGEDELMN

SEQ ID NO: 2503846 - protein, 21 aa, Entamoeba dispar
SESKMKWTSLTRRIDQLDQMF

SEQ ID NO: 2503847 - protein, 20 aa, Entamoeba dispar
SESLFEFYIHESKVLTVAAE

SEQ ID NO: 2503848 - protein, 29 aa, Entamoeba dispar
SESLFNTSFKRMWDFKILTSFNETLELIL

SEQ ID NO: 2503849 - protein, 23 aa, Entamoeba dispar
SESLRGGGLMSKLMYLFIDESTE

SEQ ID NO: 2503850 - protein, 17 aa, Entamoeba dispar
SESLWIDTFDQFEMELK

SEQ ID NO: 2503851 - protein, 25 aa, Entamoeba dispar
SESNFQLTLRFKFKKDNSIIRIEVP

SEQ ID NO: 2503852 - protein, 26 aa, Entamoeba dispar
SESQYEMIRWIASTINFSGKEIVLKQ

SEQ ID NO: 2503853 - protein, 17 aa, Entamoeba dispar
SESRFNKELTIEEYESI

SEQ ID NO: 2503854 - protein, 23 aa, Entamoeba dispar
SESSAQIFIEWCYCKSSPTLEKM

SEQ ID NO: 2503855 - protein, 27 aa, Entamoeba dispar
SESSLCDVIRSFLSLNITRQFINISNN

SEQ ID NO: 2503856 - protein, 27 aa, Entamoeba dispar
SESTKNIYCLKQFFMILYYCFKSSKEV

SEQ ID NO: 2503857 - protein, 19 aa, Entamoeba dispar
SESVASCKPAEGEFLKTHQ

SEQ ID NO: 2503858 - protein, 21 aa, Entamoeba dispar
SETFNSIPFQLYFNPMNIKKI

SEQ ID NO: 2503859 - protein, 19 aa, Entamoeba dispar
SETHCYIALVNDIQYSSKK

SEQ ID NO: 2503860 - protein, 23 aa, Entamoeba dispar
SETKSLLLICRNYYGKQCYLLNM

SEQ ID NO: 2503861 - protein, 18 aa, Entamoeba dispar
SETLSLELLGEVNVGGCV

SEQ ID NO: 2503862 - protein, 19 aa, Entamoeba dispar
SETSFYCVSRFKETIEKIL

SEQ ID NO: 2503863 - protein, 21 aa, Entamoeba dispar
SETTETCIIFGVSNTVKEIEE

SEQ ID NO: 2503864 - protein, 18 aa, Entamoeba dispar
SETVMPSLNYGSMAFNPN

SEQ ID NO: 2503865 - protein, 26 aa, Entamoeba dispar
SETYLFKFHYCDGTTILHPMREDVLA

SEQ ID NO: 2503866 - protein, 26 aa, Entamoeba dispar
SEVFWFFKDLMEIMGDWFKGGDDGVR

SEQ ID NO: 2503867 - protein, 18 aa, Entamoeba dispar
SEVICWGVSRKERRIQVA

SEQ ID NO: 2503868 - protein, 22 aa, Entamoeba dispar
SEVKCVDWSFGSNMVATCSRDK

SEQ ID NO: 2503869 - protein, 20 aa, Entamoeba dispar
SEVKSLGDECFKDCTTLTSI

SEQ ID NO: 2503870 - protein, 23 aa, Entamoeba dispar
SEVKSLGDKCFKECSLLTTINIP

SEQ ID NO: 2503871 - protein, 20 aa, Entamoeba dispar
SEVKSLGKECFKYCKELTSI

SEQ ID NO: 2503872 - protein, 24 aa, Entamoeba dispar
SEVKSLGYDCFRYCDSLTTINIPS

SEQ ID NO: 2503873 - protein, 25 aa, Entamoeba dispar
SEVKSLGYKCFDECYSLKSINIPSS

SEQ ID NO: 2503874 - protein, 26 aa, Entamoeba dispar
SEVKSLGYKCFKECSSLQSINIPSSI

SEQ ID NO: 2503875 - protein, 20 aa, Entamoeba dispar
SEVKSLGYQCFKGCDRLTSI

SEQ ID NO: 2503876 - protein, 18 aa, Entamoeba dispar
SEVKSLGYQCFSYCKSLT

SEQ ID NO: 2503877 - protein, 23 aa, Entamoeba dispar
SEVKSLGYRCFDECISLKSINIP

SEQ ID NO: 2503878 - protein, 19 aa, Entamoeba dispar
SEVKSLVNGCFKGCTSLTT

SEQ ID NO: 2503879 - protein, 27 aa, Entamoeba dispar
SEVLAWYGAACTGALSSIVERYCTKEQ

SEQ ID NO: 2503880 - protein, 24 aa, Entamoeba dispar
SEVTRCVLSAIGNWGLKTSEPFFE

SEQ ID NO: 2503881 - protein, 20 aa, Entamoeba dispar
SEWNELLINMFTLGNDLDIE

SEQ ID NO: 2503882 - protein, 25 aa, Entamoeba dispar
SEYAQAIKFLGIRPQKRVLGNEKAW

SEQ ID NO: 2503883 - protein, 17 aa, Entamoeba dispar
SEYGGVLFNLLVKPDGL

SEQ ID NO: 2503884 - protein, 25 aa, Entamoeba dispar
SEYHRHKFRVITSIGSIVEKNSLMV

SEQ ID NO: 2503885 - protein, 21 aa, Entamoeba dispar
SEYIGKIPIQILKTIAQHYGE

SEQ ID NO: 2503886 - protein, 17 aa, Entamoeba dispar
SEYLLLKEITLPSTITS

SEQ ID NO: 2503887 - protein, 22 aa, Entamoeba dispar
SEYPVKVSIEMKRMYSNIQTFY

SEQ ID NO: 2503888 - protein, 24 aa, Entamoeba dispar
SEYRREVWKILLQCHPLDKNKKEN

SEQ ID NO: 2503889 - protein, 21 aa, Entamoeba dispar
SFADSFPLTLLNTRLKQYFSQ

SEQ ID NO: 2503890 - protein, 26 aa, Entamoeba dispar
SFANWVSRRIEIHFANRVLEDCWISL

SEQ ID NO: 2503891 - protein, 32 aa, Entamoeba dispar
SFAVSKKNPLQCSLGLMNGCIIFVEAQTPNLW

SEQ ID NO: 2503892 - protein, 22 aa, Entamoeba dispar
SFCRALEVLDPFESVVYSEGDL

SEQ ID NO: 2503893 - protein, 18 aa, Entamoeba dispar
SFCSRCLTVYTLMTMSNQ

SEQ ID NO: 2503894 - protein, 22 aa, Entamoeba dispar
SFDDCRVAAAILKDYLRQLPEP

SEQ ID NO: 2503895 - protein, 19 aa, Entamoeba dispar
SFDKNEWKTKEKINKISKI

SEQ ID NO: 2503896 - protein, 22 aa, Entamoeba dispar
SFDLLKHSWLSNAQVRLDTEEE

SEQ ID NO: 2503897 - protein, 17 aa, Entamoeba dispar
SFDLSIPKRKVIIRNKK

SEQ ID NO: 2503898 - protein, 17 aa, Entamoeba dispar
SFDWPIVPPEFLKTLGN

SEQ ID NO: 2503899 - protein, 20 aa, Entamoeba dispar
SFDYLQDWIDDVSMYCPQGV

SEQ ID NO: 2503900 - protein, 24 aa, Entamoeba dispar
SFECKDFIRRCLVADPTRRMNIEG

SEQ ID NO: 2503901 - protein, 24 aa, Entamoeba dispar
SFEEFKRNITLSLDEYYKLKSSEE

SEQ ID NO: 2503902 - protein, 29 aa, Entamoeba dispar
SFEHLGVKCVLEILPLNLDVSIVQRGNDG

SEQ ID NO: 2503903 - protein, 35 aa, Entamoeba dispar
SFEIKCSMTPKYLLLFYMKFMHLIGNICNIQKADV

SEQ ID NO: 2503904 - protein, 18 aa, Entamoeba dispar
SFEQLLHDIAKYCNANAF

SEQ ID NO: 2503905 - protein, 26 aa, Entamoeba dispar
SFERKVLFLPLSVPKYAVIESTEEIN

SEQ ID NO: 2503906 - protein, 24 aa, Entamoeba dispar
SFEVGECSILLSLLGEEENKNTFV

SEQ ID NO: 2503907 - protein, 24 aa, Entamoeba dispar
SFEVPCQIALYLPIRGLSYEKKDC

SEQ ID NO: 2503908 - protein, 28 aa, Entamoeba dispar
SFEWRECYKKYTPIMFNGFWEFLKEFKR

SEQ ID NO: 2503909 - protein, 24 aa, Entamoeba dispar
SFFARCNFKKIVVFERSAHLGGIL

SEQ ID NO: 2503910 - protein, 20 aa, Entamoeba dispar
SFFEELRSLQLNDFLEGKKV

SEQ ID NO: 2503911 - protein, 20 aa, Entamoeba dispar
SFFMKSELIAHVKEKHQNII

SEQ ID NO: 2503912 - protein, 18 aa, Entamoeba dispar
SFFPLPIPLLRSNAGYIT

SEQ ID NO: 2503913 - protein, 20 aa, Entamoeba dispar
SFFTFVTHYSFFRTAKRLIL

SEQ ID NO: 2503914 - protein, 19 aa, Entamoeba dispar
SFFTLPQFNEWKDARIQEG

SEQ ID NO: 2503915 - protein, 22 aa, Entamoeba dispar
SFGDGCFCECGCEKELKKNKRI

SEQ ID NO: 2503916 - protein, 18 aa, Entamoeba dispar
SFGDGCFYDCGCEKELKK

SEQ ID NO: 2503917 - protein, 18 aa, Entamoeba dispar
SFGDGCFYGCGCEEELKK

SEQ ID NO: 2503918 - protein, 21 aa, Entamoeba dispar
SFGDGCFYKCGCEDELKKNER

SEQ ID NO: 2503919 - protein, 22 aa, Entamoeba dispar
SFGDGCFYKCGCEEELMKNETI

SEQ ID NO: 2503920 - protein, 17 aa, Entamoeba dispar
SFGEFKEEIQIKLKEFL

SEQ ID NO: 2503921 - protein, 21 aa, Entamoeba dispar
SFGIILWEIAHRLYPYEKNKQ

SEQ ID NO: 2503922 - protein, 26 aa, Entamoeba dispar
SFGIRRRIVKDYGFKERYKILKDTRG

SEQ ID NO: 2503923 - protein, 23 aa, Entamoeba dispar
SFGKSCFFNCGCGLELKQNMTIP

SEQ ID NO: 2503924 - protein, 18 aa, Entamoeba dispar
SFGKSCFYECGCEEELKR

SEQ ID NO: 2503925 - protein, 22 aa, Entamoeba dispar
SFGKSCFYGCGCEKELKKNERI

SEQ ID NO: 2503926 - protein, 17 aa, Entamoeba dispar
SFGKSCFYKCGCEDELK

SEQ ID NO: 2503927 - protein, 18 aa, Entamoeba dispar
SFGNMKWEVFSICEKGND

SEQ ID NO: 2503928 - protein, 23 aa, Entamoeba dispar
SFGNRVMNFYSFLDSEEEILFGF

SEQ ID NO: 2503929 - protein, 23 aa, Entamoeba dispar
SFGNYCFYKCYSLTSMNIENLQF

SEQ ID NO: 2503930 - protein, 22 aa, Entamoeba dispar
SFGSGCFYKCGCVEELMKNKTI

SEQ ID NO: 2503931 - protein, 24 aa, Entamoeba dispar
SFHISSLILGYFMKEYEYSFETAL

SEQ ID NO: 2503932 - protein, 29 aa, Entamoeba dispar
SFHKEIIRSLPLIISKGYFDFLIDITIMQ

SEQ ID NO: 2503933 - protein, 19 aa, Entamoeba dispar
SFHRKKGWKRLERKEPKVI

SEQ ID NO: 2503934 - protein, 36 aa, Entamoeba dispar
SFIEFEGKYLLGERFFRLNPKLPYQIDLDYCKDVEL

SEQ ID NO: 2503935 - protein, 20 aa, Entamoeba dispar
SFIFVKGVPLNFERYSQIKE

SEQ ID NO: 2503936 - protein, 18 aa, Entamoeba dispar
SFIGRNFSKFSIKNIIIL

SEQ ID NO: 2503937 - protein, 23 aa, Entamoeba dispar
SFIKPDITPIHAFVSGEYDPIYP

SEQ ID NO: 2503938 - protein, 21 aa, Entamoeba dispar
SFIKRRITIDPVIVTIDNAWN

SEQ ID NO: 2503939 - protein, 24 aa, Entamoeba dispar
SFIKTNSWFIYKLYYVPTQIENNK

SEQ ID NO: 2503940 - protein, 18 aa, Entamoeba dispar
SFILLKKGKYIGFISENS

SEQ ID NO: 2503941 - protein, 23 aa, Entamoeba dispar
SFILQIRIPSLFNHIKNNIIYIN

SEQ ID NO: 2503942 - protein, 20 aa, Entamoeba dispar
SFIMLRYINPAIFSPEKYGI

SEQ ID NO: 2503943 - protein, 26 aa, Entamoeba dispar
SFINRCLSFSYGIEEFWENYNRQDEE

SEQ ID NO: 2503944 - protein, 18 aa, Entamoeba dispar
SFIPLKFSLDKKNYIGGK

SEQ ID NO: 2503945 - protein, 18 aa, Entamoeba dispar
SFIPPRSYNILFQPPLRI

SEQ ID NO: 2503946 - protein, 18 aa, Entamoeba dispar
SFITLDYRLIKQLEPTDS

SEQ ID NO: 2503947 - protein, 27 aa, Entamoeba dispar
SFKDGKVFCALIHRHRPDLLDWETVGE

SEQ ID NO: 2503948 - protein, 17 aa, Entamoeba dispar
SFKECNQTLLLNHLSLL

SEQ ID NO: 2503949 - protein, 22 aa, Entamoeba dispar
SFKEDAIDIISRITTFKPQGMF

SEQ ID NO: 2503950 - protein, 24 aa, Entamoeba dispar
SFKEGFKHLIYYFSDLYEKCSDIW

SEQ ID NO: 2503951 - protein, 24 aa, Entamoeba dispar
SFKKEFLPLIDLMFFKQRYNRDIN

SEQ ID NO: 2503952 - protein, 21 aa, Entamoeba dispar
SFKNPKLWTTQLVDFVAQCLI

SEQ ID NO: 2503953 - protein, 23 aa, Entamoeba dispar
SFKTNEFLIILPFLSSLNTVINI

SEQ ID NO: 2503954 - protein, 19 aa, Entamoeba dispar
SFLGLEKFIRVCGDEVVPL

SEQ ID NO: 2503955 - protein, 17 aa, Entamoeba dispar
SFLIKIALSIKGGNVCE

SEQ ID NO: 2503956 - protein, 18 aa, Entamoeba dispar
SFLKSYQPIHLRIDCMNI

SEQ ID NO: 2503957 - protein, 21 aa, Entamoeba dispar
SFLNKRGLTIKGFQESLQEKQ

SEQ ID NO: 2503958 - protein, 19 aa, Entamoeba dispar
SFLPMIGINSLKLVIKSAK

SEQ ID NO: 2503959 - protein, 26 aa, Entamoeba dispar
SFLRYRNLCSVQHLLDQIHSCSNLLE

SEQ ID NO: 2503960 - protein, 18 aa, Entamoeba dispar
SFLSPPIIMGIITASTNS

SEQ ID NO: 2503961 - protein, 26 aa, Entamoeba dispar
SFMELFKRAIRSMAMGHVVTLKSFDS

SEQ ID NO: 2503962 - protein, 19 aa, Entamoeba dispar
SFMIIGAPVSNNFFPTSEQ

SEQ ID NO: 2503963 - protein, 23 aa, Entamoeba dispar
SFMSCLKLSSIILPTTLCSLPHL

SEQ ID NO: 2503964 - protein, 18 aa, Entamoeba dispar
SFNFKLFFEEETNRMRKI

SEQ ID NO: 2503965 - protein, 21 aa, Entamoeba dispar
SFNGTLLRKKSLSEIEQMIVL

SEQ ID NO: 2503966 - protein, 18 aa, Entamoeba dispar
SFNKCFRCDNKKCIQCVD

SEQ ID NO: 2503967 - protein, 19 aa, Entamoeba dispar
SFNKCLKKLEDARVKKGFP

SEQ ID NO: 2503968 - protein, 18 aa, Entamoeba dispar
SFNLMGLNLPGDYCTTMI

SEQ ID NO: 2503969 - protein, 37 aa, Entamoeba dispar
SFNPRTAGNFVDLTWVFEMLKSQHFIHPSEFSSIPPP

SEQ ID NO: 2503970 - protein, 18 aa, Entamoeba dispar
SFNQFIINQEFYKGIFSI

SEQ ID NO: 2503971 - protein, 19 aa, Entamoeba dispar
SFNSLRNIPPTIIELPQLK

SEQ ID NO: 2503972 - protein, 20 aa, Entamoeba dispar
SFNTGFPLVAKVGTVHAGFG

SEQ ID NO: 2503973 - protein, 21 aa, Entamoeba dispar
SFNTIKFNGFFGINSESIRFS

SEQ ID NO: 2503974 - protein, 20 aa, Entamoeba dispar
SFNTLLKGKENILLMVFTKK

SEQ ID NO: 2503975 - protein, 18 aa, Entamoeba dispar
SFNTVWNTNYAYRVSTDN

SEQ ID NO: 2503976 - protein, 25 aa, Entamoeba dispar
SFNVKRLSTSFGSEFTDVIIGNTLP

SEQ ID NO: 2503977 - protein, 18 aa, Entamoeba dispar
SFPKIPVYAFSKNVVEMS

SEQ ID NO: 2503978 - protein, 24 aa, Entamoeba dispar
SFPLELKAKFETFIRPRKSQEITP

SEQ ID NO: 2503979 - protein, 25 aa, Entamoeba dispar
SFPRIQHFSNLIKLLTIMKEAVEKL

SEQ ID NO: 2503980 - protein, 25 aa, Entamoeba dispar
SFPSFQNIYVLLRIEINIASNKACI

SEQ ID NO: 2503981 - protein, 22 aa, Entamoeba dispar
SFPSSICSIYLESCRGLTSISL

SEQ ID NO: 2503982 - protein, 21 aa, Entamoeba dispar
SFPVETFYKWITRNKKYSDTR

SEQ ID NO: 2503983 - protein, 25 aa, Entamoeba dispar
SFQEYMWLTQLEFVRTVRGQLVTIE

SEQ ID NO: 2503984 - protein, 19 aa, Entamoeba dispar
SFQFNLSIEKTMRHKITLE

SEQ ID NO: 2503985 - protein, 23 aa, Entamoeba dispar
SFQKLPGPFLVVTPLSTLEHWRR

SEQ ID NO: 2503986 - protein, 33 aa, Entamoeba dispar
SFQNTPCCLAAFYLRVSLEIAQGVCESLEFLSK

SEQ ID NO: 2503987 - protein, 20 aa, Entamoeba dispar
SFQSLCEEFLQIGFSDSLFE

SEQ ID NO: 2503988 - protein, 34 aa, Entamoeba dispar
SFRIFPWKKRSKLVFCVPGAFIISNPQGVIYPYI

SEQ ID NO: 2503989 - protein, 17 aa, Entamoeba dispar
SFRKAGMTYGRLEPWSV

SEQ ID NO: 2503990 - protein, 23 aa, Entamoeba dispar
SFRKRLMDIFNEFQKQAFSNYST

SEQ ID NO: 2503991 - protein, 23 aa, Entamoeba dispar
SFSCPSTMKSIFVSRNKLLNLSF

SEQ ID NO: 2503992 - protein, 19 aa, Entamoeba dispar
SFSEILILFANVCNDMVQK

SEQ ID NO: 2503993 - protein, 22 aa, Entamoeba dispar
SFSLRSFAKLIIWLKTDKEDDL

SEQ ID NO: 2503994 - protein, 19 aa, Entamoeba dispar
SFSPEKYLALIHNDTSFNR

SEQ ID NO: 2503995 - protein, 21 aa, Entamoeba dispar
SFSSFRRNGSPINEDKNEDIP

SEQ ID NO: 2503996 - protein, 19 aa, Entamoeba dispar
SFTGGWKKKMMGMKKEEID

SEQ ID NO: 2503997 - protein, 23 aa, Entamoeba dispar
SFTNNHYKVWAGLYITDTLKPLA

SEQ ID NO: 2503998 - protein, 18 aa, Entamoeba dispar
SFTVPRLTECYLKGILSL

SEQ ID NO: 2503999 - protein, 23 aa, Entamoeba dispar
SFVFKSKQTIINWTDKSISNIEL

SEQ ID NO: 2504000 - protein, 17 aa, Entamoeba dispar
SFVFLKQVFDSYGPRTL

SEQ ID NO: 2504001 - protein, 18 aa, Entamoeba dispar
SFVGKTSIINRFINAEYS

SEQ ID NO: 2504002 - protein, 23 aa, Entamoeba dispar
SFVHEYPPMYGVGLKIKEGMTTS

SEQ ID NO: 2504003 - protein, 24 aa, Entamoeba dispar
SFVKKHYPYVTSYTRDDSVKEVTI

SEQ ID NO: 2504004 - protein, 29 aa, Entamoeba dispar
SFVKYYLKCRFPLLFGVSLIDGERLIYSH

SEQ ID NO: 2504005 - protein, 24 aa, Entamoeba dispar
SFVQIRGTIPLIWKTNEEDTFRPK

SEQ ID NO: 2504006 - protein, 23 aa, Entamoeba dispar
SFVRVKVLQMWQMLVEHRCIPLE

SEQ ID NO: 2504007 - protein, 17 aa, Entamoeba dispar
SFVSKKEYDEVWPSIKE

SEQ ID NO: 2504008 - protein, 25 aa, Entamoeba dispar
SFVTHCFKAKFKITKSRDNRFVNVN

SEQ ID NO: 2504009 - protein, 18 aa, Entamoeba dispar
SFYCMSRATMTALCRNNY

SEQ ID NO: 2504010 - protein, 23 aa, Entamoeba dispar
SFYFRPSHCLLISNINKNNKYDD

SEQ ID NO: 2504011 - protein, 18 aa, Entamoeba dispar
SFYKRKNDSVTIFGKLYD

SEQ ID NO: 2504012 - protein, 18 aa, Entamoeba dispar
SFYKSFKLVISGLDNLGA

SEQ ID NO: 2504013 - protein, 25 aa, Entamoeba dispar
SFYNHANCIIALFDLSNKDSLQNCK

SEQ ID NO: 2504014 - protein, 19 aa, Entamoeba dispar
SFYQKIRLVNYIIDDDGSV

SEQ ID NO: 2504015 - protein, 25 aa, Entamoeba dispar
SFYVNRIGILYGIFKEDRVQVEAIY

SEQ ID NO: 2504016 - protein, 19 aa, Entamoeba dispar
SFYVYSINIKREWSDDFDL

SEQ ID NO: 2504017 - protein, 19 aa, Entamoeba dispar
SFYYGEAMLSNIQVLEGLG

SEQ ID NO: 2504018 - protein, 20 aa, Entamoeba dispar
SGAADCLGMAKLLEENATLK

SEQ ID NO: 2504019 - protein, 21 aa, Entamoeba dispar
SGADIKWIVSEACTHTLRNDI

SEQ ID NO: 2504020 - protein, 19 aa, Entamoeba dispar
SGALCTAILDWAANQHVGF

SEQ ID NO: 2504021 - protein, 19 aa, Entamoeba dispar
SGCKCCITIDIVRSLVDDY

SEQ ID NO: 2504022 - protein, 25 aa, Entamoeba dispar
SGCKEELLCPLEFIEKNDLLDIMME

SEQ ID NO: 2504023 - protein, 23 aa, Entamoeba dispar
SGCLPFDDFCLLAILQSSPPLET

SEQ ID NO: 2504024 - protein, 21 aa, Entamoeba dispar
SGCLRDFIRQAIIGGRNMTNQ

SEQ ID NO: 2504025 - protein, 18 aa, Entamoeba dispar
SGCTRISTYFLTNILQNT

SEQ ID NO: 2504026 - protein, 17 aa, Entamoeba dispar
SGCYYLITKGWSFLFSK

SEQ ID NO: 2504027 - protein, 20 aa, Entamoeba dispar
SGDEKGIFRIWDFRTMKTIK

SEQ ID NO: 2504028 - protein, 25 aa, Entamoeba dispar
SGDIIPRSRIPRVGNKRRRIMSYNE

SEQ ID NO: 2504029 - protein, 21 aa, Entamoeba dispar
SGDKYRMGNLFIVGPTKTGKT

SEQ ID NO: 2504030 - protein, 25 aa, Entamoeba dispar
SGEMAITIIRFILSDCMSTQLFNSS

SEQ ID NO: 2504031 - protein, 25 aa, Entamoeba dispar
SGEPCTLETVPFDVCVTDPDDEELE

SEQ ID NO: 2504032 - protein, 18 aa, Entamoeba dispar
SGEYKLVPIEQYDKLVRS

SEQ ID NO: 2504033 - protein, 28 aa, Entamoeba dispar
SGEYRWCYESWIVLGFEALGLNKNSEAV

SEQ ID NO: 2504034 - protein, 18 aa, Entamoeba dispar
SGFIGYYLYLGMNKEQIL

SEQ ID NO: 2504035 - protein, 20 aa, Entamoeba dispar
SGFLVLRRHVGMIIRLSMIV

SEQ ID NO: 2504036 - protein, 17 aa, Entamoeba dispar
SGFNWGRIKIDKSSVQL

SEQ ID NO: 2504037 - protein, 24 aa, Entamoeba dispar
SGFPHGGACTVVLRGPSKQLLGEM

SEQ ID NO: 2504038 - protein, 24 aa, Entamoeba dispar
SGFPQEFSPFLVKLFEMLNDKESK

SEQ ID NO: 2504039 - protein, 19 aa, Entamoeba dispar
SGFVGYYLYLGMNKEQVLK

SEQ ID NO: 2504040 - protein, 20 aa, Entamoeba dispar
SGGICAECQKAFKSKESVVK

SEQ ID NO: 2504041 - protein, 17 aa, Entamoeba dispar
SGGICLHDSKRLIGETV

SEQ ID NO: 2504042 - protein, 20 aa, Entamoeba dispar
SGGTWTGCIYDVNKIGAALR

SEQ ID NO: 2504043 - protein, 23 aa, Entamoeba dispar
SGHFLHIDFAHFLGNKLKVAGVI

SEQ ID NO: 2504044 - protein, 24 aa, Entamoeba dispar
SGHSAAVRTVCWGKEMLYSSGDDM

SEQ ID NO: 2504045 - protein, 22 aa, Entamoeba dispar
SGIELFPPCMYSIYRKFLHDKH

SEQ ID NO: 2504046 - protein, 17 aa, Entamoeba dispar
SGIGLNSFNAWNRKFAK

SEQ ID NO: 2504047 - protein, 19 aa, Entamoeba dispar
SGIIECLMKQLVDCDDENI

SEQ ID NO: 2504048 - protein, 25 aa, Entamoeba dispar
SGILEMKIGGGIIRVITCQPEIKEL

SEQ ID NO: 2504049 - protein, 19 aa, Entamoeba dispar
SGIRILNRLLLLSFPSQEI

SEQ ID NO: 2504050 - protein, 17 aa, Entamoeba dispar
SGISYFEIVHEKPYFYS

SEQ ID NO: 2504051 - protein, 20 aa, Entamoeba dispar
SGKGFGFVTEYLRGEEISEF

SEQ ID NO: 2504052 - protein, 25 aa, Entamoeba dispar
SGKHLNVLNSLHLCVQISEGEEEKM

SEQ ID NO: 2504053 - protein, 22 aa, Entamoeba dispar
SGKKICSGVIDLAQFADLDGKT

SEQ ID NO: 2504054 - protein, 27 aa, Entamoeba dispar
SGKKIKEGFISKAKDSFNIKKNVMKTV

SEQ ID NO: 2504055 - protein, 26 aa, Entamoeba dispar
SGKRLGYRITKDFTVHYFSSIFSVPN

SEQ ID NO: 2504056 - protein, 17 aa, Entamoeba dispar
SGKRLGYRITTAFANHF

SEQ ID NO: 2504057 - protein, 26 aa, Entamoeba dispar
SGKSAILVALAICFGAKAQFTNRGKR

SEQ ID NO: 2504058 - protein, 27 aa, Entamoeba dispar
SGKSAILVALAICFGAKATFTNRGKRV

SEQ ID NO: 2504059 - protein, 26 aa, Entamoeba dispar
SGKVWRMRASCVTFVSLVKVGAMTDL

SEQ ID NO: 2504060 - protein, 19 aa, Entamoeba dispar
SGKYEIIGFISHIGANVNC

SEQ ID NO: 2504061 - protein, 18 aa, Entamoeba dispar
SGKYVIGPIRSWMEQNKS

SEQ ID NO: 2504062 - protein, 18 aa, Entamoeba dispar
SGLASQLCVLKYLQDMQM

SEQ ID NO: 2504063 - protein, 19 aa, Entamoeba dispar
SGLHKCVIFYSFTDSDLVL

SEQ ID NO: 2504064 - protein, 20 aa, Entamoeba dispar
SGLREICLLRQLNHRNIIKI

SEQ ID NO: 2504065 - protein, 25 aa, Entamoeba dispar
SGLRIPGFCLTIGKIKEIIQCLGMK

SEQ ID NO: 2504066 - protein, 26 aa, Entamoeba dispar
SGLVFDLNIKFGLYIKEIDEEEAKSA

SEQ ID NO: 2504067 - protein, 17 aa, Entamoeba dispar
SGLVMRNELYQSLFEHQ

SEQ ID NO: 2504068 - protein, 24 aa, Entamoeba dispar
SGNAFKYLILLSHLFVCDEFNNPK

SEQ ID NO: 2504069 - protein, 20 aa, Entamoeba dispar
SGNELFTLAGCSLKCLEDEK

SEQ ID NO: 2504070 - protein, 18 aa, Entamoeba dispar
SGNKLVAICRFNEESNWW

SEQ ID NO: 2504071 - protein, 21 aa, Entamoeba dispar
SGNKYRMGNLFIVGPTKTGKT

SEQ ID NO: 2504072 - protein, 33 aa, Entamoeba dispar
SGNVDSFCYFSFNKEKYFLVGDHSGRIILFNYM

SEQ ID NO: 2504073 - protein, 25 aa, Entamoeba dispar
SGNVYDCIGGICARIHSILDPYDTV

SEQ ID NO: 2504074 - protein, 18 aa, Entamoeba dispar
SGNWRKNQQFVLRVKENT

SEQ ID NO: 2504075 - protein, 19 aa, Entamoeba dispar
SGRIILFNYMTGVEIKSIT

SEQ ID NO: 2504076 - protein, 19 aa, Entamoeba dispar
SGRMRWSPMHRSEQFWTEN

SEQ ID NO: 2504077 - protein, 21 aa, Entamoeba dispar
SGRRVLRYQNIKGRKRTYPIW

SEQ ID NO: 2504078 - protein, 19 aa, Entamoeba dispar
SGRVIQMIPGKSVSKPISP

SEQ ID NO: 2504079 - protein, 36 aa, Entamoeba dispar
SGRYKHSLIRYIPGYKCIKLLHERNAFKEIRRDNLL

SEQ ID NO: 2504080 - protein, 31 aa, Entamoeba dispar
SGRYTCCMLFLKEIYGNVVLELGQEKYEIDE

SEQ ID NO: 2504081 - protein, 19 aa, Entamoeba dispar
SGSFSRRSCLVKTPCPKTP

SEQ ID NO: 2504082 - protein, 18 aa, Entamoeba dispar
SGSIKPKIYASATGGSNV

SEQ ID NO: 2504083 - protein, 17 aa, Entamoeba dispar
SGSKLTIDKNWNSVQPT

SEQ ID NO: 2504084 - protein, 26 aa, Entamoeba dispar
SGSLGHRAAKAFFRSLCEIILEQIDQ

SEQ ID NO: 2504085 - protein, 17 aa, Entamoeba dispar
SGSVIVLGRSAARSKDF

SEQ ID NO: 2504086 - protein, 23 aa, Entamoeba dispar
SGTDVPRLKEIISKWNGTVIGKQ

SEQ ID NO: 2504087 - protein, 17 aa, Entamoeba dispar
SGTFSFGSLGLQAEPPK

SEQ ID NO: 2504088 - protein, 32 aa, Entamoeba dispar
SGTLTLKRPNFWKLRRKDCPWVKQKKSSLVEE

SEQ ID NO: 2504089 - protein, 18 aa, Entamoeba dispar
SGTTFLHHLLACGEKART

SEQ ID NO: 2504090 - protein, 20 aa, Entamoeba dispar
SGTYISSIVKLVLKGNSIFE

SEQ ID NO: 2504091 - protein, 21 aa, Entamoeba dispar
SGVGKSCLLLRFADDTYTDTH

SEQ ID NO: 2504092 - protein, 22 aa, Entamoeba dispar
SGVGKSSLLLRFSEDAFNPMYI

SEQ ID NO: 2504093 - protein, 25 aa, Entamoeba dispar
SGVIHSVGLFSILAVLEKEEFINCF

SEQ ID NO: 2504094 - protein, 30 aa, Entamoeba dispar
SGVKDPKISECLMVLMGVDMNQFLNVQNTK

SEQ ID NO: 2504095 - protein, 17 aa, Entamoeba dispar
SGVLLFVMVCGYPPFSR

SEQ ID NO: 2504096 - protein, 27 aa, Entamoeba dispar
SGVTFVFINCVQYLKALVFMTKDPVSS

SEQ ID NO: 2504097 - protein, 18 aa, Entamoeba dispar
SGYCFPPLCCTQTEQMSK

SEQ ID NO: 2504098 - protein, 21 aa, Entamoeba dispar
SGYYECPLCSESIQPSDLIID

SEQ ID NO: 2504099 - protein, 19 aa, Entamoeba dispar
SHCGLPVGVFGTRNGVVGF

SEQ ID NO: 2504100 - protein, 29 aa, Entamoeba dispar
SHCLRIICKDLRVLSFRIVGPIQLYEEMI

SEQ ID NO: 2504101 - protein, 25 aa, Entamoeba dispar
SHCNQMKIILCNIYKTIASSSFFKQ

SEQ ID NO: 2504102 - protein, 22 aa, Entamoeba dispar
SHDIRKLPCEEFKQRKINKIEF

SEQ ID NO: 2504103 - protein, 24 aa, Entamoeba dispar
SHELPRYGVKLGLTNYAAAYCTGL

SEQ ID NO: 2504104 - protein, 21 aa, Entamoeba dispar
SHEVVAWLKRILKVEKTGHSG

SEQ ID NO: 2504105 - protein, 18 aa, Entamoeba dispar
SHFFYHFLELYRTQCSSF

SEQ ID NO: 2504106 - protein, 18 aa, Entamoeba dispar
SHFHLLEVMIKVLLPVSE

SEQ ID NO: 2504107 - protein, 19 aa, Entamoeba dispar
SHFQSKIIIFQRALHELPG

SEQ ID NO: 2504108 - protein, 17 aa, Entamoeba dispar
SHFYPPFSMQGFAQLSQ

SEQ ID NO: 2504109 - protein, 18 aa, Entamoeba dispar
SHHLNLPLHFKVQEIIQN

SEQ ID NO: 2504110 - protein, 19 aa, Entamoeba dispar
SHIIYDLLGVLIRRSSTNT

SEQ ID NO: 2504111 - protein, 30 aa, Entamoeba dispar
SHIRFSAIIRFIGHLNLRGFLPSFFMITVI

SEQ ID NO: 2504112 - protein, 32 aa, Entamoeba dispar
SHITLFKNGIKFICGMNGYIFISLNNESDYSN

SEQ ID NO: 2504113 - protein, 21 aa, Entamoeba dispar
SHIYMFKTLRSFVFDEKCPNP

SEQ ID NO: 2504114 - protein, 17 aa, Entamoeba dispar
SHKELKRVPTYFETYSS

SEQ ID NO: 2504115 - protein, 29 aa, Entamoeba dispar
SHKEMKIRIPFVASHSVSLSPDMFDTSIL

SEQ ID NO: 2504116 - protein, 22 aa, Entamoeba dispar
SHKFVSAIIKYYVFEDSGELTN

SEQ ID NO: 2504117 - protein, 17 aa, Entamoeba dispar
SHKSSIVSSCWENDNIF

SEQ ID NO: 2504118 - protein, 30 aa, Entamoeba dispar
SHKSWKKRWFQTTPRNPFRLDYYTNDSCSS

SEQ ID NO: 2504119 - protein, 26 aa, Entamoeba dispar
SHLFFNFYNLCSLELPKSIVKINNKK

SEQ ID NO: 2504120 - protein, 22 aa, Entamoeba dispar
SHLKGRQNIIVFIITEHNYIFG

SEQ ID NO: 2504121 - protein, 25 aa, Entamoeba dispar
SHLLSLRFRFPSTSDLRFVLLSENK

SEQ ID NO: 2504122 - protein, 22 aa, Entamoeba dispar
SHLLSVLCILLASLNYKVLICA

SEQ ID NO: 2504123 - protein, 25 aa, Entamoeba dispar
SHLNCSLSCTLCNYLTVTDCSLSYL

SEQ ID NO: 2504124 - protein, 25 aa, Entamoeba dispar
SHLPELHILLSKFVMIRRLKEEVLS

SEQ ID NO: 2504125 - protein, 24 aa, Entamoeba dispar
SHLPPKTVHWFKNFDNYEYSFYTS

SEQ ID NO: 2504126 - protein, 20 aa, Entamoeba dispar
SHLYLQPKYFGYDGPIEYLN

SEQ ID NO: 2504127 - protein, 24 aa, Entamoeba dispar
SHNFELFTSFILKWKYNKINEDHK

SEQ ID NO: 2504128 - protein, 24 aa, Entamoeba dispar
SHNGYGVAMGNAFDSVKEKSNFIT

SEQ ID NO: 2504129 - protein, 18 aa, Entamoeba dispar
SHNPKPWNGLKFVDSDGL

SEQ ID NO: 2504130 - protein, 19 aa, Entamoeba dispar
SHNPKPWNGLKFVDSDGLF

SEQ ID NO: 2504131 - protein, 19 aa, Entamoeba dispar
SHPDFRFGEFSSLLRLFQV

SEQ ID NO: 2504132 - protein, 31 aa, Entamoeba dispar
SHPERVIYHVCKWLGNKRPSIVKGKECVDGY

SEQ ID NO: 2504133 - protein, 20 aa, Entamoeba dispar
SHPQCICLNDGFSGNDIIFN

SEQ ID NO: 2504134 - protein, 28 aa, Entamoeba dispar
SHPQGICNRTKFMLMDLIDLREMNWAKQ

SEQ ID NO: 2504135 - protein, 25 aa, Entamoeba dispar
SHPQRLGSIVPLIIKVIEQIIQSDL

SEQ ID NO: 2504136 - protein, 21 aa, Entamoeba dispar
SHRGRGGYRNNYRNGEKRDYK

SEQ ID NO: 2504137 - protein, 22 aa, Entamoeba dispar
SHRRKYCECIKHIQSKNTKPQC

SEQ ID NO: 2504138 - protein, 20 aa, Entamoeba dispar
SHSFGATMFDSVLSGKKVHI

SEQ ID NO: 2504139 - protein, 25 aa, Entamoeba dispar
SHSFPMVICDECHFIKTDSSKRSKE

SEQ ID NO: 2504140 - protein, 19 aa, Entamoeba dispar
SHSKPSSPVICHVKTNEFH

SEQ ID NO: 2504141 - protein, 27 aa, Entamoeba dispar
SHSPRVSPRFSPKISPRSSFNSSHGSS

SEQ ID NO: 2504142 - protein, 20 aa, Entamoeba dispar
SHSPYFLGIIDIVKQIFKEN

SEQ ID NO: 2504143 - protein, 23 aa, Entamoeba dispar
SHTRYCPKCGCAIVGTRRKPRIV

SEQ ID NO: 2504144 - protein, 19 aa, Entamoeba dispar
SHVDRLPITAVIITHSHGD

SEQ ID NO: 2504145 - protein, 23 aa, Entamoeba dispar
SHVIKRWTMTKVDRLTKLEEVHM

SEQ ID NO: 2504146 - protein, 25 aa, Entamoeba dispar
SIANFCLPLTRLFWNIENEIMKYTN

SEQ ID NO: 2504147 - protein, 18 aa, Entamoeba dispar
SIARCSQPLCGLTGKKCQ

SEQ ID NO: 2504148 - protein, 18 aa, Entamoeba dispar
SIATCITLSISRKPPSSK

SEQ ID NO: 2504149 - protein, 27 aa, Entamoeba dispar
SIDISRLKDDFIYRKSIMQEYISDTEY

SEQ ID NO: 2504150 - protein, 18 aa, Entamoeba dispar
SIDLKKLAQDDVLGDAVV

SEQ ID NO: 2504151 - protein, 24 aa, Entamoeba dispar
SIDLLLRAVPWTDYKAREEMADLI

SEQ ID NO: 2504152 - protein, 20 aa, Entamoeba dispar
SIDNLSCLLQLQGIRKEGKR

SEQ ID NO: 2504153 - protein, 25 aa, Entamoeba dispar
SIDPERRKLEGIKLFGDTKIPETSK

SEQ ID NO: 2504154 - protein, 21 aa, Entamoeba dispar
SIDRGLFRSMAFKTFSEDAKK

SEQ ID NO: 2504155 - protein, 27 aa, Entamoeba dispar
SIDRGYGRCFVYRKAECVIKKYKNGAC

SEQ ID NO: 2504156 - protein, 19 aa, Entamoeba dispar
SIDSVYEGLYWILFKNQSN

SEQ ID NO: 2504157 - protein, 23 aa, Entamoeba dispar
SIDTLGNIPLEWYNELEHQGYDH

SEQ ID NO: 2504158 - protein, 21 aa, Entamoeba dispar
SIECWCFKRCSSLISMNIENF

SEQ ID NO: 2504159 - protein, 17 aa, Entamoeba dispar
SIEDFEFIEFLRNKTPS

SEQ ID NO: 2504160 - protein, 25 aa, Entamoeba dispar
SIEDMRRVLLFPSISSYSIGIKGVK

SEQ ID NO: 2504161 - protein, 20 aa, Entamoeba dispar
SIEEYVSFRLGEKELSTIRN

SEQ ID NO: 2504162 - protein, 18 aa, Entamoeba dispar
SIEFKYAKSYYNLTDVVL

SEQ ID NO: 2504163 - protein, 24 aa, Entamoeba dispar
SIEGKRIVSGVIDLAQHAGLDGST

SEQ ID NO: 2504164 - protein, 23 aa, Entamoeba dispar
SIEGSLSFLQMFVHLFQFLNIKK

SEQ ID NO: 2504165 - protein, 24 aa, Entamoeba dispar
SIEIILEHKCCTISFINHEDALKW

SEQ ID NO: 2504166 - protein, 26 aa, Entamoeba dispar
SIEIIPEHRCCFVSFVRHDDAMRFKV

SEQ ID NO: 2504167 - protein, 33 aa, Entamoeba dispar
SIEIKLFPSLIFKSSKCVFGGNITSSRGKTVTV

SEQ ID NO: 2504168 - protein, 19 aa, Entamoeba dispar
SIEINGRIGKIVFTSYNNF

SEQ ID NO: 2504169 - protein, 18 aa, Entamoeba dispar
SIEKCIDSLIYIMLIHIY

SEQ ID NO: 2504170 - protein, 25 aa, Entamoeba dispar
SIENECFKCCYNLKKINIPNSINAI

SEQ ID NO: 2504171 - protein, 23 aa, Entamoeba dispar
SIENGCFKNCFKLKKINIPTSIK

SEQ ID NO: 2504172 - protein, 20 aa, Entamoeba dispar
SIERKFIFLISLQLEIVSCQ

SEQ ID NO: 2504173 - protein, 18 aa, Entamoeba dispar
SIESEYGTSFLVADVSGN

SEQ ID NO: 2504174 - protein, 24 aa, Entamoeba dispar
SIETCPQCHIKCELLSLNRHMNGS

SEQ ID NO: 2504175 - protein, 19 aa, Entamoeba dispar
SIETLLCCNLIRKIDARET

SEQ ID NO: 2504176 - protein, 22 aa, Entamoeba dispar
SIEVFTLLMLYKVMYPTRIALM

SEQ ID NO: 2504177 - protein, 18 aa, Entamoeba dispar
SIFDIYSLIQQFKIKDIL

SEQ ID NO: 2504178 - protein, 17 aa, Entamoeba dispar
SIFEQDLAYLMSIKDVS

SEQ ID NO: 2504179 - protein, 25 aa, Entamoeba dispar
SIFFPERNRFPGVIDLYRKEIGKPC

SEQ ID NO: 2504180 - protein, 23 aa, Entamoeba dispar
SIFRKTNAIIFLFPSDVGMEEMQ

SEQ ID NO: 2504181 - protein, 24 aa, Entamoeba dispar
SIFYCPHHLCFRAFSTIQPKQQIM

SEQ ID NO: 2504182 - protein, 18 aa, Entamoeba dispar
SIGAFCFYGCSSLKTIII

SEQ ID NO: 2504183 - protein, 21 aa, Entamoeba dispar
SIGDCRLFHYSLRECKVKKII

SEQ ID NO: 2504184 - protein, 24 aa, Entamoeba dispar
SIGDECFKCCYDIKEINLPTRISE

SEQ ID NO: 2504185 - protein, 19 aa, Entamoeba dispar
SIGDLCFFQCNRITSIKLP

SEQ ID NO: 2504186 - protein, 18 aa, Entamoeba dispar
SIGEEINEEFSFVSTFQY

SEQ ID NO: 2504187 - protein, 24 aa, Entamoeba dispar
SIGFFPVLFISQTMRFEGCEWGYL

SEQ ID NO: 2504188 - protein, 19 aa, Entamoeba dispar
SIGKISTKFFSRVGFKTLS

SEQ ID NO: 2504189 - protein, 17 aa, Entamoeba dispar
SIGKYGIQYDFIHKHNK

SEQ ID NO: 2504190 - protein, 21 aa, Entamoeba dispar
SIGMFAFKWCESLTSLSIPSN

SEQ ID NO: 2504191 - protein, 24 aa, Entamoeba dispar
SIGNEKVLMVWDIRNLKSSSHYIE

SEQ ID NO: 2504192 - protein, 22 aa, Entamoeba dispar
SIGNKCFKNCFKLKKINISTSI

SEQ ID NO: 2504193 - protein, 19 aa, Entamoeba dispar
SIGNYCFKECSSLTTINIP

SEQ ID NO: 2504194 - protein, 24 aa, Entamoeba dispar
SIGNYCFYKCLSLKSINIPSSITS

SEQ ID NO: 2504195 - protein, 19 aa, Entamoeba dispar
SIGRQCFINCFDLESILLP

SEQ ID NO: 2504196 - protein, 27 aa, Entamoeba dispar
SIGTEYCKYLKYADSLYRCKQLKRAAL

SEQ ID NO: 2504197 - protein, 19 aa, Entamoeba dispar
SIGVPFLHTTFRIRSVPDM

SEQ ID NO: 2504198 - protein, 22 aa, Entamoeba dispar
SIGYECFKYCYSITSINIPITN

SEQ ID NO: 2504199 - protein, 18 aa, Entamoeba dispar
SIGYKNCNILIYKEETRE

SEQ ID NO: 2504200 - protein, 18 aa, Entamoeba dispar
SIGYKNCNMMIYKEETRE

SEQ ID NO: 2504201 - protein, 18 aa, Entamoeba dispar
SIGYKNCNMMIYKEKTKE

SEQ ID NO: 2504202 - protein, 18 aa, Entamoeba dispar
SIGYKYPPNYNEVLDQTY

SEQ ID NO: 2504203 - protein, 20 aa, Entamoeba dispar
SIGYWCFYECSSLTSMNIDN

SEQ ID NO: 2504204 - protein, 17 aa, Entamoeba dispar
SIHIPQIKMICAVGCCY

SEQ ID NO: 2504205 - protein, 17 aa, Entamoeba dispar
SIHKEFCVCASMKRDKD

SEQ ID NO: 2504206 - protein, 19 aa, Entamoeba dispar
SIHLKEFITYLNVFCEGDD

SEQ ID NO: 2504207 - protein, 18 aa, Entamoeba dispar
SIHLPQCKVLYDNEIDCL

SEQ ID NO: 2504208 - protein, 25 aa, Entamoeba dispar
SIHSELKTLFALPSLPLVIPYLTLL

SEQ ID NO: 2504209 - protein, 18 aa, Entamoeba dispar
SIIDFLYNFFEQKMNTSC

SEQ ID NO: 2504210 - protein, 23 aa, Entamoeba dispar
SIIDLLPCFAKYSQVIALNDSDE

SEQ ID NO: 2504211 - protein, 18 aa, Entamoeba dispar
SIIEEIKQKGFRLPQPGD

SEQ ID NO: 2504212 - protein, 19 aa, Entamoeba dispar
SIIERWTKQEYSIRRVGSN

SEQ ID NO: 2504213 - protein, 24 aa, Entamoeba dispar
SIIKKIKHPFIISYYNDYSINNNK

SEQ ID NO: 2504214 - protein, 19 aa, Entamoeba dispar
SIIKRRYCSDASDHIATMK

SEQ ID NO: 2504215 - protein, 18 aa, Entamoeba dispar
SIIKSIINDVLFSIVTLY

SEQ ID NO: 2504216 - protein, 17 aa, Entamoeba dispar
SIIKYSLDDYIWYNFIL

SEQ ID NO: 2504217 - protein, 19 aa, Entamoeba dispar
SIIPIMWNELKVMNDLKAY

SEQ ID NO: 2504218 - protein, 21 aa, Entamoeba dispar
SIIREGWDNWFGIRGSVTVNN

SEQ ID NO: 2504219 - protein, 25 aa, Entamoeba dispar
SIISFGRGCFYKCGCEEELKKNKRI

SEQ ID NO: 2504220 - protein, 17 aa, Entamoeba dispar
SIITHLSYFRIPLPDIL

SEQ ID NO: 2504221 - protein, 17 aa, Entamoeba dispar
SIIVFRYDDKESFKNVV

SEQ ID NO: 2504222 - protein, 26 aa, Entamoeba dispar
SIIVHCIRCVFYIGRNKTGLIKMFNS

SEQ ID NO: 2504223 - protein, 22 aa, Entamoeba dispar
SIIVMRRIFSFAPFPFHPAVPL

SEQ ID NO: 2504224 - protein, 23 aa, Entamoeba dispar
SIKDLLMNICIEYQYSSNCELQQ

SEQ ID NO: 2504225 - protein, 20 aa, Entamoeba dispar
SIKDREWYCQTSCATNGDGL

SEQ ID NO: 2504226 - protein, 18 aa, Entamoeba dispar
SIKECKKRYYNYLDPTID

SEQ ID NO: 2504227 - protein, 24 aa, Entamoeba dispar
SIKEGRLKMNLLMKSLSSSLYNFK

SEQ ID NO: 2504228 - protein, 21 aa, Entamoeba dispar
SIKINIKYSSIILESIPTIII

SEQ ID NO: 2504229 - protein, 18 aa, Entamoeba dispar
SIKIWDIMPDGLTKDINE

SEQ ID NO: 2504230 - protein, 24 aa, Entamoeba dispar
SIKKELFGIVKLYENGHIAIQPGK

SEQ ID NO: 2504231 - protein, 25 aa, Entamoeba dispar
SIKKIPIEFTKLQSLHMFSIACNQL

SEQ ID NO: 2504232 - protein, 26 aa, Entamoeba dispar
SIKNKAIKLFDRWCEAVNEDNEKIGI

SEQ ID NO: 2504233 - protein, 18 aa, Entamoeba dispar
SIKNLIIKVFDTIKYRHL

SEQ ID NO: 2504234 - protein, 29 aa, Entamoeba dispar
SIKQRCPTILPAHLLALFDVTKTDEPQDQ

SEQ ID NO: 2504235 - protein, 17 aa, Entamoeba dispar
SIKRLIDVQFEIYVMEE

SEQ ID NO: 2504236 - protein, 24 aa, Entamoeba dispar
SIKSPKLPGYNKFDISSKRVNKMF

SEQ ID NO: 2504237 - protein, 25 aa, Entamoeba dispar
SIKTGDYYGMLGLGTVRWEATDDDI

SEQ ID NO: 2504238 - protein, 26 aa, Entamoeba dispar
SIKTRLPVSYSPVLYSDFPHWDISIG

SEQ ID NO: 2504239 - protein, 23 aa, Entamoeba dispar
SIKYLKEPFGWTTYVYQIQTETG

SEQ ID NO: 2504240 - protein, 25 aa, Entamoeba dispar
SIKYLLTIQWCKPFFDNPTLKYIES

SEQ ID NO: 2504241 - protein, 26 aa, Entamoeba dispar
SILENRLSIKILFLIIYQLIQENLLS

SEQ ID NO: 2504242 - protein, 28 aa, Entamoeba dispar
SILGLRTGRKTIMVMAGNKCDLEEQRQI

SEQ ID NO: 2504243 - protein, 19 aa, Entamoeba dispar
SILHPKEVDAAIPYISTIE

SEQ ID NO: 2504244 - protein, 23 aa, Entamoeba dispar
SILIKLLLPYCDVVFGRPSKRTT

SEQ ID NO: 2504245 - protein, 18 aa, Entamoeba dispar
SILIKRIGEEVIYKIFNK

SEQ ID NO: 2504246 - protein, 25 aa, Entamoeba dispar
SILIMPVQRIPRYVLLLKDLLKNTD

SEQ ID NO: 2504247 - protein, 18 aa, Entamoeba dispar
SILIQDIIGLFMRARPLH

SEQ ID NO: 2504248 - protein, 21 aa, Entamoeba dispar
SILKDDITDVIGIDSDINGFV

SEQ ID NO: 2504249 - protein, 17 aa, Entamoeba dispar
SILKSLYPNSLVQRKSV

SEQ ID NO: 2504250 - protein, 26 aa, Entamoeba dispar
SILQSDCGDSCFILKTLFERMEQNKN

SEQ ID NO: 2504251 - protein, 19 aa, Entamoeba dispar
SILRGMISLGFEKMWTKLV

SEQ ID NO: 2504252 - protein, 24 aa, Entamoeba dispar
SILRKEARTLHKVHKYHLKINAKL

SEQ ID NO: 2504253 - protein, 17 aa, Entamoeba dispar
SILRLPQMYNLCNYYIG

SEQ ID NO: 2504254 - protein, 18 aa, Entamoeba dispar
SILSCDGMSKMFEFLSIE

SEQ ID NO: 2504255 - protein, 20 aa, Entamoeba dispar
SILYKPGIVNGGNFQHTCNN

SEQ ID NO: 2504256 - protein, 22 aa, Entamoeba dispar
SIMDPFYIVLHFLCLHNVNETT

SEQ ID NO: 2504257 - protein, 23 aa, Entamoeba dispar
SIMNFHCISVHFSVFNPSNKRGY

SEQ ID NO: 2504258 - protein, 24 aa, Entamoeba dispar
SIMPEKRYTCVAGFLEVGESVEEC

SEQ ID NO: 2504259 - protein, 17 aa, Entamoeba dispar
SIMPGKVNPVIAEVMNQ

SEQ ID NO: 2504260 - protein, 24 aa, Entamoeba dispar
SINCPNALCSLSLINDTQLESTLL

SEQ ID NO: 2504261 - protein, 21 aa, Entamoeba dispar
SINEIGNWCFHYCSSLTSINI

SEQ ID NO: 2504262 - protein, 23 aa, Entamoeba dispar
SINELRYGSVMIMADQDFDGSHI

SEQ ID NO: 2504263 - protein, 20 aa, Entamoeba dispar
SINKKCFDVLNIVRKSPLFK

SEQ ID NO: 2504264 - protein, 19 aa, Entamoeba dispar
SINKLGDNCFRGCSSLTSI

SEQ ID NO: 2504265 - protein, 27 aa, Entamoeba dispar
SINKNCLWYLIDFLHLVSINKAINLMS

SEQ ID NO: 2504266 - protein, 19 aa, Entamoeba dispar
SINKRKDCPLQIGYTTCSD

SEQ ID NO: 2504267 - protein, 18 aa, Entamoeba dispar
SINMKLVGMFYKMNLDER

SEQ ID NO: 2504268 - protein, 19 aa, Entamoeba dispar
SINSPKSYLNFLSQENKSS

SEQ ID NO: 2504269 - protein, 20 aa, Entamoeba dispar
SINSSIYFNPSISLTHLESK

SEQ ID NO: 2504270 - protein, 24 aa, Entamoeba dispar
SINVELRILVLSSQHEDMLFRVKF

SEQ ID NO: 2504271 - protein, 20 aa, Entamoeba dispar
SIPAIRGWVTKQGGSHKSWK

SEQ ID NO: 2504272 - protein, 18 aa, Entamoeba dispar
SIPALVMSQLYFKQIHFD

SEQ ID NO: 2504273 - protein, 23 aa, Entamoeba dispar
SIPDNCFEKCIFLNEIIIPENIR

SEQ ID NO: 2504274 - protein, 18 aa, Entamoeba dispar
SIPDPAMRAGAKRRFDAK

SEQ ID NO: 2504275 - protein, 23 aa, Entamoeba dispar
SIPIYNMIYDWILQGTFNDPFHD

SEQ ID NO: 2504276 - protein, 18 aa, Entamoeba dispar
SIPLKRIALSYLDDFDPH

SEQ ID NO: 2504277 - protein, 20 aa, Entamoeba dispar
SIPPPRRKSLFIQNTTQFKK

SEQ ID NO: 2504278 - protein, 23 aa, Entamoeba dispar
SIPPSEFQWIYNILNGTAEQDNV

SEQ ID NO: 2504279 - protein, 20 aa, Entamoeba dispar
SIPRRGQLRQRPQSRVGDNR

SEQ ID NO: 2504280 - protein, 24 aa, Entamoeba dispar
SIPSSITKLGIRCFEFCSSLRRIN

SEQ ID NO: 2504281 - protein, 25 aa, Entamoeba dispar
SIQEKRLSPFDGLYLSKYDYPDRNY

SEQ ID NO: 2504282 - protein, 25 aa, Entamoeba dispar
SIQEMWDRWICFIQQTTKSHWEITF

SEQ ID NO: 2504283 - protein, 19 aa, Entamoeba dispar
SIQIPLGIHCLDEGTFKGC

SEQ ID NO: 2504284 - protein, 26 aa, Entamoeba dispar
SIQKCFYVKLFLDLFSIPSVVLNSDL

SEQ ID NO: 2504285 - protein, 22 aa, Entamoeba dispar
SIQKEIINFFILAIQTAAIDLI

SEQ ID NO: 2504286 - protein, 20 aa, Entamoeba dispar
SIQLCPEKETSFTIKMDEIR

SEQ ID NO: 2504287 - protein, 19 aa, Entamoeba dispar
SIQNKCTIYQPFVSQQKPI

SEQ ID NO: 2504288 - protein, 19 aa, Entamoeba dispar
SIQQLKSIKFEQSQKLSQK

SEQ ID NO: 2504289 - protein, 18 aa, Entamoeba dispar
SIQSCFFNTISFSYNSQF

SEQ ID NO: 2504290 - protein, 19 aa, Entamoeba dispar
SIQSCPIDCRRDLYKNIIL

SEQ ID NO: 2504291 - protein, 19 aa, Entamoeba dispar
SIQTSLFLQPEYPWKQLKK

SEQ ID NO: 2504292 - protein, 24 aa, Entamoeba dispar
SIRDFIKPFMLRRLKTDVQKELPP

SEQ ID NO: 2504293 - protein, 17 aa, Entamoeba dispar
SIRFPIKNIIPTKVNEA

SEQ ID NO: 2504294 - protein, 22 aa, Entamoeba dispar
SIRGECFIYCISLTSINIPSTI

SEQ ID NO: 2504295 - protein, 22 aa, Entamoeba dispar
SIRIFWSNKVPKGYFNKEFIRQ

SEQ ID NO: 2504296 - protein, 24 aa, Entamoeba dispar
SIRKGASYTPYFNVLGVILCFDYQ

SEQ ID NO: 2504297 - protein, 19 aa, Entamoeba dispar
SIRKVGWIGNCICVNRLKK

SEQ ID NO: 2504298 - protein, 23 aa, Entamoeba dispar
SIRLYDFKKTQIVNGMNPQAKLL

SEQ ID NO: 2504299 - protein, 20 aa, Entamoeba dispar
SIRNMMLIRLRRIYDEACNS

SEQ ID NO: 2504300 - protein, 21 aa, Entamoeba dispar
SIRPLSYPSTDVFLLCYSVVQ

SEQ ID NO: 2504301 - protein, 32 aa, Entamoeba dispar
SIRQTSCCLVYKCLNCGDDVCCIKGKEGIINR

SEQ ID NO: 2504302 - protein, 17 aa, Entamoeba dispar
SIRRCERISRYLDENSI

SEQ ID NO: 2504303 - protein, 31 aa, Entamoeba dispar
SIRTWKKRYFVLKDRRIWYFSSCKDKAAKGY

SEQ ID NO: 2504304 - protein, 21 aa, Entamoeba dispar
SISCNIFACSMDQIGILEMSS

SEQ ID NO: 2504305 - protein, 29 aa, Entamoeba dispar
SISDRLLKQICHFICYYIIEEMLQRNKIN

SEQ ID NO: 2504306 - protein, 19 aa, Entamoeba dispar
SISEIGDWCFNECSSLTSI

SEQ ID NO: 2504307 - protein, 22 aa, Entamoeba dispar
SISELGFSCFKECLSLISINIP

SEQ ID NO: 2504308 - protein, 20 aa, Entamoeba dispar
SISFFIFACDCRLRYTQKLS

SEQ ID NO: 2504309 - protein, 18 aa, Entamoeba dispar
SISFKINIINKFLLEPIS

SEQ ID NO: 2504310 - protein, 25 aa, Entamoeba dispar
SISHICLFTSFAIDLPQDISNYRKK

SEQ ID NO: 2504311 - protein, 23 aa, Entamoeba dispar
SISKIGHFCFNRCTSLTTINIPS

SEQ ID NO: 2504312 - protein, 17 aa, Entamoeba dispar
SISKIGINCFSGCSSLT

SEQ ID NO: 2504313 - protein, 18 aa, Entamoeba dispar
SISKLGDLCFRKCSLTTI

SEQ ID NO: 2504314 - protein, 18 aa, Entamoeba dispar
SISKLGYECFDGCSSLKS

SEQ ID NO: 2504315 - protein, 22 aa, Entamoeba dispar
SISLECFAGSLAFFSTTLNNVW

SEQ ID NO: 2504316 - protein, 18 aa, Entamoeba dispar
SISLLETLCHRFDDVFNN

SEQ ID NO: 2504317 - protein, 18 aa, Entamoeba dispar
SISNLNVMNFARRAIEKF

SEQ ID NO: 2504318 - protein, 24 aa, Entamoeba dispar
SISNRISLSLSRIIEDEIHSLKEF

SEQ ID NO: 2504319 - protein, 18 aa, Entamoeba dispar
SITKIGRECFSWCGSLQS

SEQ ID NO: 2504320 - protein, 19 aa, Entamoeba dispar
SITKLGKCCFYECSTLTSI

SEQ ID NO: 2504321 - protein, 32 aa, Entamoeba dispar
SITPMIACATIIPPCHSESELSLSPVNFQLTS

SEQ ID NO: 2504322 - protein, 22 aa, Entamoeba dispar
SITPRIPVYSFWISDMNGFEIS

SEQ ID NO: 2504323 - protein, 22 aa, Entamoeba dispar
SITRKPIYGIGWFRTHQNQSKV

SEQ ID NO: 2504324 - protein, 24 aa, Entamoeba dispar
SITRLNLFCFYKCESLKSITIPSS

SEQ ID NO: 2504325 - protein, 20 aa, Entamoeba dispar
SITSFGIGCFYGCGCEKELK

SEQ ID NO: 2504326 - protein, 19 aa, Entamoeba dispar
SITSFGYGCFEYCSSIQSI

SEQ ID NO: 2504327 - protein, 21 aa, Entamoeba dispar
SITSFGYRCFYGCGCEEELKK

SEQ ID NO: 2504328 - protein, 24 aa, Entamoeba dispar
SIVASTAYLKCLINGIGNESKDIF

SEQ ID NO: 2504329 - protein, 19 aa, Entamoeba dispar
SIVCGGIIRKIVVIKETLW

SEQ ID NO: 2504330 - protein, 25 aa, Entamoeba dispar
SIVEPLMKHLRVCQDNTNAILKVLN

SEQ ID NO: 2504331 - protein, 25 aa, Entamoeba dispar
SIVKRFEVMDGIPIKGEKIPIRIPL

SEQ ID NO: 2504332 - protein, 18 aa, Entamoeba dispar
SIVNKAKDSLQIGAIEKT

SEQ ID NO: 2504333 - protein, 30 aa, Entamoeba dispar
SIVRRCHLTMPLCCSGGMLTKIANEYKRWK

SEQ ID NO: 2504334 - protein, 20 aa, Entamoeba dispar
SIVSKCGRSTELQSFDLEAM

SEQ ID NO: 2504335 - protein, 19 aa, Entamoeba dispar
SIVSLRCKNVLLIVDDSLG

SEQ ID NO: 2504336 - protein, 18 aa, Entamoeba dispar
SIVYCIDNGILITAGEDS

SEQ ID NO: 2504337 - protein, 22 aa, Entamoeba dispar
SIYKALPFFKDFILSIEQHKND

SEQ ID NO: 2504338 - protein, 23 aa, Entamoeba dispar
SIYRIKKIFLSFDINITNEIIDQ

SEQ ID NO: 2504339 - protein, 20 aa, Entamoeba dispar
SKAAIALALFGGEQRVLVDK

SEQ ID NO: 2504340 - protein, 31 aa, Entamoeba dispar
SKAEFPFNLQVKLADYGFCRAINSGIEHVKV

SEQ ID NO: 2504341 - protein, 18 aa, Entamoeba dispar
SKAFPGKSGDEILKTIAE

SEQ ID NO: 2504342 - protein, 24 aa, Entamoeba dispar
SKAGKFISCKVITHITDNTVSMIP

SEQ ID NO: 2504343 - protein, 19 aa, Entamoeba dispar
SKAIYDVEFLRAFIGNAKN

SEQ ID NO: 2504344 - protein, 18 aa, Entamoeba dispar
SKAKGIVFYGFKEAPIHF

SEQ ID NO: 2504345 - protein, 17 aa, Entamoeba dispar
SKAKIPLNSKGEIDRVC

SEQ ID NO: 2504346 - protein, 20 aa, Entamoeba dispar
SKAKMGIIEMAKHDLVDAYT

SEQ ID NO: 2504347 - protein, 17 aa, Entamoeba dispar
SKALALVEFEIANDAKT

SEQ ID NO: 2504348 - protein, 21 aa, Entamoeba dispar
SKALIRWINFVNNESVVSVSN

SEQ ID NO: 2504349 - protein, 18 aa, Entamoeba dispar
SKALLPSLLLYPKIYHHL

SEQ ID NO: 2504350 - protein, 19 aa, Entamoeba dispar
SKASIWFNAVLRGDMAKIV

SEQ ID NO: 2504351 - protein, 25 aa, Entamoeba dispar
SKASTKLRKTICVRNIGNASDDKIQ

SEQ ID NO: 2504352 - protein, 18 aa, Entamoeba dispar
SKCPINKLLIARSKQVNI

SEQ ID NO: 2504353 - protein, 27 aa, Entamoeba dispar
SKCQQQTLHLFCVSGEIISYIHHTNKP

SEQ ID NO: 2504354 - protein, 23 aa, Entamoeba dispar
SKDGIPECLKKAAEEREARKRRD

SEQ ID NO: 2504355 - protein, 17 aa, Entamoeba dispar
SKDGSVMAVSFKTAITI

SEQ ID NO: 2504356 - protein, 21 aa, Entamoeba dispar
SKDHIFNCAYFFVLKRKEGKF

SEQ ID NO: 2504357 - protein, 24 aa, Entamoeba dispar
SKDKCPLVRCSIIYLIIHIIPKIK

SEQ ID NO: 2504358 - protein, 23 aa, Entamoeba dispar
SKDMSPRVSMLIGQKEKTEQAHV

SEQ ID NO: 2504359 - protein, 29 aa, Entamoeba dispar
SKDSLLRDWSLFYLRCIHHMSVQKMQKLL

SEQ ID NO: 2504360 - protein, 17 aa, Entamoeba dispar
SKDSMTFVNKVRDKDLF

SEQ ID NO: 2504361 - protein, 21 aa, Entamoeba dispar
SKEAANRWTDGIFMIQKYAKD

SEQ ID NO: 2504362 - protein, 18 aa, Entamoeba dispar
SKEAYGFSDISSKLNFSD

SEQ ID NO: 2504363 - protein, 18 aa, Entamoeba dispar
SKECYVCHQQGHIARNCP

SEQ ID NO: 2504364 - protein, 23 aa, Entamoeba dispar
SKEEIPLIILYINKIFPFTFCEN

SEQ ID NO: 2504365 - protein, 18 aa, Entamoeba dispar
SKEFIKKLVEAHRTGDKA

SEQ ID NO: 2504366 - protein, 23 aa, Entamoeba dispar
SKEFLRCQFINFNSGLESYIERA

SEQ ID NO: 2504367 - protein, 21 aa, Entamoeba dispar
SKEFNKWAPKLNCVVYTGDGE

SEQ ID NO: 2504368 - protein, 26 aa, Entamoeba dispar
SKEIETIYYWKYYLNLVLPQQMSVFV

SEQ ID NO: 2504369 - protein, 24 aa, Entamoeba dispar
SKEILSKLVEMWNALDVEQKAAYK

SEQ ID NO: 2504370 - protein, 18 aa, Entamoeba dispar
SKEINIIKIHGWSTTIVN

SEQ ID NO: 2504371 - protein, 19 aa, Entamoeba dispar
SKEKGIYPIFVFDGKTQTY

SEQ ID NO: 2504372 - protein, 30 aa, Entamoeba dispar
SKEKIEMFAKLPFLISNVVEILDMPEEEND

SEQ ID NO: 2504373 - protein, 26 aa, Entamoeba dispar
SKEKRIAGKLDHFFPIQKIWNQSGVI

SEQ ID NO: 2504374 - protein, 26 aa, Entamoeba dispar
SKEKRIAGKLNHFFPIQKIWNQNGVI

SEQ ID NO: 2504375 - protein, 26 aa, Entamoeba dispar
SKEKRTAKKLDHFFPIQKIWNQNGVI

SEQ ID NO: 2504376 - protein, 33 aa, Entamoeba dispar
SKELFSRPIYAVICMFLRIVVSEVQLQISSYNA

SEQ ID NO: 2504377 - protein, 17 aa, Entamoeba dispar
SKEMFYYNMKLFQTRKD

SEQ ID NO: 2504378 - protein, 18 aa, Entamoeba dispar
SKENPPYFYYMYYTYANI

SEQ ID NO: 2504379 - protein, 19 aa, Entamoeba dispar
SKEPCYISSLPLSKSGEDF

SEQ ID NO: 2504380 - protein, 30 aa, Entamoeba dispar
SKEQVKRMCCGGIEGDWNASVLLYTKNTEM

SEQ ID NO: 2504381 - protein, 36 aa, Entamoeba dispar
SKESYCCILPCNDNRFIISWGQLKINIDISPSMIVE

SEQ ID NO: 2504382 - protein, 18 aa, Entamoeba dispar
SKEVEEFMLKNNIIKELI

SEQ ID NO: 2504383 - protein, 23 aa, Entamoeba dispar
SKEVTTTVGIDFRMKRIECNGSP

SEQ ID NO: 2504384 - protein, 22 aa, Entamoeba dispar
SKEYSEAVIVVWERHPEEALKI

SEQ ID NO: 2504385 - protein, 19 aa, Entamoeba dispar
SKFGCSRELFLFSRNILEG

SEQ ID NO: 2504386 - protein, 24 aa, Entamoeba dispar
SKFIRLGGFVRLFNSLRSVRRVYK

SEQ ID NO: 2504387 - protein, 26 aa, Entamoeba dispar
SKFKDELRGALALSKLENIFVVPEKQ

SEQ ID NO: 2504388 - protein, 17 aa, Entamoeba dispar
SKFKLGISDHSRDNTRK

SEQ ID NO: 2504389 - protein, 18 aa, Entamoeba dispar
SKFSEASIHFIDKFQQPL

SEQ ID NO: 2504390 - protein, 23 aa, Entamoeba dispar
SKFTLLSCVLFSLIIQKNNDILF

SEQ ID NO: 2504391 - protein, 22 aa, Entamoeba dispar
SKFVIRCYSSKCIKEEINEIIT

SEQ ID NO: 2504392 - protein, 19 aa, Entamoeba dispar
SKFWELVEFTLKYFEHLKE

SEQ ID NO: 2504393 - protein, 25 aa, Entamoeba dispar
SKGEIDRVCNLCFSKATGKKLDNGL

SEQ ID NO: 2504394 - protein, 33 aa, Entamoeba dispar
SKGFQRIQLLLCCFRLRHEMVFDEEVKQYLRDK

SEQ ID NO: 2504395 - protein, 22 aa, Entamoeba dispar
SKGIKPSPFIKVEEFVNPTIEI

SEQ ID NO: 2504396 - protein, 23 aa, Entamoeba dispar
SKGIPIKLLYFIVSSRNDIKIFS

SEQ ID NO: 2504397 - protein, 18 aa, Entamoeba dispar
SKGKIEWENDVKEYINKL

SEQ ID NO: 2504398 - protein, 18 aa, Entamoeba dispar
SKGKLRWYSTTSKNDDKL

SEQ ID NO: 2504399 - protein, 33 aa, Entamoeba dispar
SKGKMAHNILLPWKVYVYDGGNDVYLWIGTKAS

SEQ ID NO: 2504400 - protein, 25 aa, Entamoeba dispar
SKGLFLRSYLLYVIKNYLPTTLIEN

SEQ ID NO: 2504401 - protein, 26 aa, Entamoeba dispar
SKGMYCAQCGMTIHQFCIDLCNEPCL

SEQ ID NO: 2504402 - protein, 23 aa, Entamoeba dispar
SKGNKKYDVKFMRVDVDKSLLKG

SEQ ID NO: 2504403 - protein, 19 aa, Entamoeba dispar
SKGRFIIRKVSNINLLSPS

SEQ ID NO: 2504404 - protein, 18 aa, Entamoeba dispar
SKGYFDFLIDITIMQPEK

SEQ ID NO: 2504405 - protein, 19 aa, Entamoeba dispar
SKHHVAYRLLKKCDDVQEM

SEQ ID NO: 2504406 - protein, 23 aa, Entamoeba dispar
SKHKTVLCLNCFFGYDHFYVNDT

SEQ ID NO: 2504407 - protein, 18 aa, Entamoeba dispar
SKHMLQWLDFLIKDVGSN

SEQ ID NO: 2504408 - protein, 20 aa, Entamoeba dispar
SKIAEQFFVYDLKLIKELTI

SEQ ID NO: 2504409 - protein, 24 aa, Entamoeba dispar
SKICIKGCEIFKLKIESNNEQNIE

SEQ ID NO: 2504410 - protein, 24 aa, Entamoeba dispar
SKIFKRVKKSTVKCIFDSDVDGWD

SEQ ID NO: 2504411 - protein, 19 aa, Entamoeba dispar
SKIGCARSISINKCENIDF

SEQ ID NO: 2504412 - protein, 25 aa, Entamoeba dispar
SKIGCGRFYEWSSLTPINIGNIKFI

SEQ ID NO: 2504413 - protein, 27 aa, Entamoeba dispar
SKIGDNWFKDCSSLRSINVPYTVSEIG

SEQ ID NO: 2504414 - protein, 21 aa, Entamoeba dispar
SKIGIACFKKCFSLTKINIPT

SEQ ID NO: 2504415 - protein, 24 aa, Entamoeba dispar
SKIGIACFRGCLSLTSINIPPSIS

SEQ ID NO: 2504416 - protein, 24 aa, Entamoeba dispar
SKIGKECFYGCLSLTTINIPTSVI

SEQ ID NO: 2504417 - protein, 24 aa, Entamoeba dispar
SKIGKLCFYSCCSLTSIDIPTLVS

SEQ ID NO: 2504418 - protein, 23 aa, Entamoeba dispar
SKIGKSCFYECISLKSFNIQSSV

SEQ ID NO: 2504419 - protein, 23 aa, Entamoeba dispar
SKIGKSCFYECISLTSFNIQSSV

SEQ ID NO: 2504420 - protein, 20 aa, Entamoeba dispar
SKIGKYCFKDCTSLRLINVP

SEQ ID NO: 2504421 - protein, 17 aa, Entamoeba dispar
SKIGLIHFCYSNSVCEQ

SEQ ID NO: 2504422 - protein, 25 aa, Entamoeba dispar
SKIGNYCFYGCLSLTSINIPSSVSK

SEQ ID NO: 2504423 - protein, 18 aa, Entamoeba dispar
SKIGPKEIRDIVEGFKSI

SEQ ID NO: 2504424 - protein, 23 aa, Entamoeba dispar
SKIGYECFRECYSLKSINIPSSI

SEQ ID NO: 2504425 - protein, 23 aa, Entamoeba dispar
SKIGYGCFDNCAILTNINIPTTI

SEQ ID NO: 2504426 - protein, 17 aa, Entamoeba dispar
SKIGYGCFECCSSLQTI

SEQ ID NO: 2504427 - protein, 20 aa, Entamoeba dispar
SKIGYYCFFECTSLTSFTIP

SEQ ID NO: 2504428 - protein, 19 aa, Entamoeba dispar
SKIHFRVAQYYDLQAQEID

SEQ ID NO: 2504429 - protein, 27 aa, Entamoeba dispar
SKIIHIVWRKRRVIAFTDENRGLILTS

SEQ ID NO: 2504430 - protein, 24 aa, Entamoeba dispar
SKIIPVKYSYLFCIIHHYQDALTL

SEQ ID NO: 2504431 - protein, 31 aa, Entamoeba dispar
SKIKDIFLLMKRMLINLDMDQIEFKKELHKE

SEQ ID NO: 2504432 - protein, 20 aa, Entamoeba dispar
SKIKPLMIVSTHYHQLCEEF

SEQ ID NO: 2504433 - protein, 18 aa, Entamoeba dispar
SKIKRSTIVLTHTTQSVF

SEQ ID NO: 2504434 - protein, 24 aa, Entamoeba dispar
SKILEGVSLFPAVLTEILSGDLKE

SEQ ID NO: 2504435 - protein, 25 aa, Entamoeba dispar
SKINLRRNVCCTLSEEYEGISDLDL

SEQ ID NO: 2504436 - protein, 25 aa, Entamoeba dispar
SKINQILDFCCKRYHSGLSSIHCVD

SEQ ID NO: 2504437 - protein, 23 aa, Entamoeba dispar
SKIPDSCFEYCSLLTEINIPTSI

SEQ ID NO: 2504438 - protein, 21 aa, Entamoeba dispar
SKIPVCAENLIGFPKEVFRIL

SEQ ID NO: 2504439 - protein, 18 aa, Entamoeba dispar
SKIQLFFVQLYMQILKSL

SEQ ID NO: 2504440 - protein, 23 aa, Entamoeba dispar
SKIRCARSISINKCENINFEIYG

SEQ ID NO: 2504441 - protein, 22 aa, Entamoeba dispar
SKIRCARSISINKCENINFKID

SEQ ID NO: 2504442 - protein, 19 aa, Entamoeba dispar
SKISKGYAFIYFSSLNEAN

SEQ ID NO: 2504443 - protein, 20 aa, Entamoeba dispar
SKISKLGDRCFSRCSILTSI

SEQ ID NO: 2504444 - protein, 18 aa, Entamoeba dispar
SKITFSRTNKRNENITSQ

SEQ ID NO: 2504445 - protein, 27 aa, Entamoeba dispar
SKIVIPQVVFNLCWWIYTYGYLVEGVF

SEQ ID NO: 2504446 - protein, 19 aa, Entamoeba dispar
SKIYQGRGSNEFTGGRNTE

SEQ ID NO: 2504447 - protein, 20 aa, Entamoeba dispar
SKIYQGRGSNEFTGGRNTEK

SEQ ID NO: 2504448 - protein, 20 aa, Entamoeba dispar
SKKAMSFAMMLVENVKKSGL

SEQ ID NO: 2504449 - protein, 19 aa, Entamoeba dispar
SKKCSLCGFHYFYNPAAAV

SEQ ID NO: 2504450 - protein, 22 aa, Entamoeba dispar
SKKDYATAICEYSRAIECDPFN

SEQ ID NO: 2504451 - protein, 24 aa, Entamoeba dispar
SKKEPQELFCYSTADKTIKNKEVR

SEQ ID NO: 2504452 - protein, 20 aa, Entamoeba dispar
SKKFTAVICYQVKLMKQRKD

SEQ ID NO: 2504453 - protein, 25 aa, Entamoeba dispar
SKKIFPKLTNQFLYSRNDNKIKGVH

SEQ ID NO: 2504454 - protein, 21 aa, Entamoeba dispar
SKKIRLCYINENIVADIMTEL

SEQ ID NO: 2504455 - protein, 27 aa, Entamoeba dispar
SKKLKGGEGMFKFYYIPVGKTCELMTV

SEQ ID NO: 2504456 - protein, 22 aa, Entamoeba dispar
SKKLLRLMEVILLIGNYLNQGT

SEQ ID NO: 2504457 - protein, 18 aa, Entamoeba dispar
SKKLYGLIHARYIVTSAG

SEQ ID NO: 2504458 - protein, 19 aa, Entamoeba dispar
SKKNFRLMLLSLIEHEPNK

SEQ ID NO: 2504459 - protein, 24 aa, Entamoeba dispar
SKKPCKDYFKRALELNKNYAPALI

SEQ ID NO: 2504460 - protein, 25 aa, Entamoeba dispar
SKKPCKDYFKRALELNKNYAPALIG

SEQ ID NO: 2504461 - protein, 21 aa, Entamoeba dispar
SKKPTSLVFIREFRVPVNTMV

SEQ ID NO: 2504462 - protein, 36 aa, Entamoeba dispar
SKKQLTVELIIPIGSFCVLDSIKIESSPTFLIVNKS

SEQ ID NO: 2504463 - protein, 23 aa, Entamoeba dispar
SKKSPCFKDLDFVEQKAQIHIGP

SEQ ID NO: 2504464 - protein, 30 aa, Entamoeba dispar
SKKYAREMLEGMSGKFGRMLREMEEDETSF

SEQ ID NO: 2504465 - protein, 24 aa, Entamoeba dispar
SKKYLMKITSLFFSIKSIPTEYNQ

SEQ ID NO: 2504466 - protein, 20 aa, Entamoeba dispar
SKLALNKVAVWAIGEYGDLL

SEQ ID NO: 2504467 - protein, 23 aa, Entamoeba dispar
SKLDELLRTVVISGIEGITKVII

SEQ ID NO: 2504468 - protein, 25 aa, Entamoeba dispar
SKLENCSQCYLANIHVGWGQELISV

SEQ ID NO: 2504469 - protein, 19 aa, Entamoeba dispar
SKLENSLMLDQWVFNTIAK

SEQ ID NO: 2504470 - protein, 24 aa, Entamoeba dispar
SKLGDKCFLECSSLTKINIPTSVT

SEQ ID NO: 2504471 - protein, 19 aa, Entamoeba dispar
SKLGKCCFRRCPSLKSINI

SEQ ID NO: 2504472 - protein, 20 aa, Entamoeba dispar
SKLGNNCFKDCYSLSKINIP

SEQ ID NO: 2504473 - protein, 21 aa, Entamoeba dispar
SKLGNYCFSRCTSLKSINISS

SEQ ID NO: 2504474 - protein, 21 aa, Entamoeba dispar
SKLGSACFYGCGCEEELKKNE

SEQ ID NO: 2504475 - protein, 22 aa, Entamoeba dispar
SKLGYDCFKECYSLTSINIPSS

SEQ ID NO: 2504476 - protein, 19 aa, Entamoeba dispar
SKLHPWDIQFCDELEKDTL

SEQ ID NO: 2504477 - protein, 25 aa, Entamoeba dispar
SKLKGELKEVCFDKVIAPVFENKYY

SEQ ID NO: 2504478 - protein, 25 aa, Entamoeba dispar
SKLKNDRIVLILIKHCASLNITNKE

SEQ ID NO: 2504479 - protein, 18 aa, Entamoeba dispar
SKLKSVCKEDYMIVNTEW

SEQ ID NO: 2504480 - protein, 20 aa, Entamoeba dispar
SKLLKRTISMFRVLNVNGLV

SEQ ID NO: 2504481 - protein, 19 aa, Entamoeba dispar
SKLLLDVINEFSLQCSLNE

SEQ ID NO: 2504482 - protein, 33 aa, Entamoeba dispar
SKLLPFTMVGGFLFLRIICPSLAAPEASGIEMT

SEQ ID NO: 2504483 - protein, 26 aa, Entamoeba dispar
SKLLPVIKNFLCKDSNIEVRKETFKT

SEQ ID NO: 2504484 - protein, 21 aa, Entamoeba dispar
SKLPFKPTLVFLPIVLNHLIH

SEQ ID NO: 2504485 - protein, 23 aa, Entamoeba dispar
SKLRGSCFSGCISLTTINIPTTV

SEQ ID NO: 2504486 - protein, 25 aa, Entamoeba dispar
SKLRKWCFSGCKLLTSIELPTTISK

SEQ ID NO: 2504487 - protein, 25 aa, Entamoeba dispar
SKLRSEATIHYVFVVTLILTNKNHY

SEQ ID NO: 2504488 - protein, 25 aa, Entamoeba dispar
SKLSGEFPFNRSIEHNIKLRKAFDK

SEQ ID NO: 2504489 - protein, 24 aa, Entamoeba dispar
SKLSHCRIFCACFKMSSNIPQTII

SEQ ID NO: 2504490 - protein, 17 aa, Entamoeba dispar
SKLSIIFNNIKKEVEKK

SEQ ID NO: 2504491 - protein, 17 aa, Entamoeba dispar
SKLSLIRPIYIYLGCCI

SEQ ID NO: 2504492 - protein, 17 aa, Entamoeba dispar
SKLSMIFNNIKKEVEKK

SEQ ID NO: 2504493 - protein, 22 aa, Entamoeba dispar
SKLSSISFLLSQKIISQVISTI

SEQ ID NO: 2504494 - protein, 22 aa, Entamoeba dispar
SKLTLFLKRMVLIKNGAELSEQ

SEQ ID NO: 2504495 - protein, 23 aa, Entamoeba dispar
SKLTLFLKRMVLIKNGAELSEQP

SEQ ID NO: 2504496 - protein, 19 aa, Entamoeba dispar
SKLTYIPYPSFFEVTRIVG

SEQ ID NO: 2504497 - protein, 31 aa, Entamoeba dispar
SKLVPSDIVFLKGWIPVKINKFYNPMTDLTG

SEQ ID NO: 2504498 - protein, 24 aa, Entamoeba dispar
SKMEMSVYCYFKLEEQFHGGVDIN

SEQ ID NO: 2504499 - protein, 17 aa, Entamoeba dispar
SKMKMNVKFQVSDRGNN

SEQ ID NO: 2504500 - protein, 19 aa, Entamoeba dispar
SKMKRIKLSKTICIAPDAL

SEQ ID NO: 2504501 - protein, 18 aa, Entamoeba dispar
SKMKVWRAHFNSLVPDEI

SEQ ID NO: 2504502 - protein, 23 aa, Entamoeba dispar
SKMPNRFPPVVFYTPKELGGLGM

SEQ ID NO: 2504503 - protein, 28 aa, Entamoeba dispar
SKMSQLLCCICGDGSSFPLYCVVNNENQ

SEQ ID NO: 2504504 - protein, 24 aa, Entamoeba dispar
SKNESACLCALCFNSSNHKGHDYS

SEQ ID NO: 2504505 - protein, 34 aa, Entamoeba dispar
SKNEYSLCIDFIRFCILSFTSLFPQDIDPVVTKR

SEQ ID NO: 2504506 - protein, 20 aa, Entamoeba dispar
SKNGKTFDVHKCVVSQFHLP

SEQ ID NO: 2504507 - protein, 18 aa, Entamoeba dispar
SKNIKCILTVPAQFNDEQ

SEQ ID NO: 2504508 - protein, 20 aa, Entamoeba dispar
SKNLFGIFYGYWLKVNKTYI

SEQ ID NO: 2504509 - protein, 23 aa, Entamoeba dispar
SKNLKTLVLRGNFDEISSIYNIT

SEQ ID NO: 2504510 - protein, 29 aa, Entamoeba dispar
SKNLSWSEFEYCVVLPFKMIKDEQISVFI

SEQ ID NO: 2504511 - protein, 25 aa, Entamoeba dispar
SKNSVYFCGINDYQIEYSLLNQLNS

SEQ ID NO: 2504512 - protein, 22 aa, Entamoeba dispar
SKNTMNKICFVMKQNINPYLDI

SEQ ID NO: 2504513 - protein, 18 aa, Entamoeba dispar
SKPAVLSLVVGDFNIFKL

SEQ ID NO: 2504514 - protein, 22 aa, Entamoeba dispar
SKPEFWQHLCIILTNCYYYIPE

SEQ ID NO: 2504515 - protein, 23 aa, Entamoeba dispar
SKPFSWPTTDFISIKEIQTAMNL

SEQ ID NO: 2504516 - protein, 24 aa, Entamoeba dispar
SKPKFQIDLSIAIFNIHINKGNKM

SEQ ID NO: 2504517 - protein, 17 aa, Entamoeba dispar
SKPLEEKEMVSIKSIKI

SEQ ID NO: 2504518 - protein, 19 aa, Entamoeba dispar
SKPPIIAIDICKQKKDKQH

SEQ ID NO: 2504519 - protein, 25 aa, Entamoeba dispar
SKPQVKSCNVFDNIALQNPQAQQPQ

SEQ ID NO: 2504520 - protein, 18 aa, Entamoeba dispar
SKPSPQFAQPSLASQSKS

SEQ ID NO: 2504521 - protein, 22 aa, Entamoeba dispar
SKQATALLGCFVLDEKPKESIQ

SEQ ID NO: 2504522 - protein, 17 aa, Entamoeba dispar
SKQCLIDKLLSVFIQQG

SEQ ID NO: 2504523 - protein, 24 aa, Entamoeba dispar
SKQEELRIAYGVYQNTLLELLKFK

SEQ ID NO: 2504524 - protein, 19 aa, Entamoeba dispar
SKQGIRFVFEDGSRIIFRL

SEQ ID NO: 2504525 - protein, 24 aa, Entamoeba dispar
SKQIAFLCHVSYLALNGDYSGASL

SEQ ID NO: 2504526 - protein, 25 aa, Entamoeba dispar
SKQKLRGTVPLDFASVKSCEIVDHP

SEQ ID NO: 2504527 - protein, 23 aa, Entamoeba dispar
SKQLKIIFMLNHVIIPFNYTQWF

SEQ ID NO: 2504528 - protein, 18 aa, Entamoeba dispar
SKQMKFLLHRLNTLSSLP

SEQ ID NO: 2504529 - protein, 17 aa, Entamoeba dispar
SKQPIGQHGIYQNDVIM

SEQ ID NO: 2504530 - protein, 17 aa, Entamoeba dispar
SKQPIGQHGIYQNDVNM

SEQ ID NO: 2504531 - protein, 20 aa, Entamoeba dispar
SKQTKHWSLSITKLQDTLNE

SEQ ID NO: 2504532 - protein, 25 aa, Entamoeba dispar
SKQYKLLVKECMRELTNDLTSVEIK

SEQ ID NO: 2504533 - protein, 25 aa, Entamoeba dispar
SKRDIRGVFELNLNVAELFRDLLSV

SEQ ID NO: 2504534 - protein, 35 aa, Entamoeba dispar
SKRDMCKIMWVIKKWKISNCFQSREPLLFKQLFSD

SEQ ID NO: 2504535 - protein, 23 aa, Entamoeba dispar
SKREIDVMINFVDFIMTDARDIL

SEQ ID NO: 2504536 - protein, 17 aa, Entamoeba dispar
SKRFQIMIYTASRKEYA

SEQ ID NO: 2504537 - protein, 24 aa, Entamoeba dispar
SKRIKESGGMIFSGRVNGVIAITR

SEQ ID NO: 2504538 - protein, 23 aa, Entamoeba dispar
SKRKLPPVLSKKFIKEEAQKLQQ

SEQ ID NO: 2504539 - protein, 23 aa, Entamoeba dispar
SKRLPALSCEGFVMDDSQHFIFT

SEQ ID NO: 2504540 - protein, 18 aa, Entamoeba dispar
SKRMKILYLTGLLDQYQN

SEQ ID NO: 2504541 - protein, 30 aa, Entamoeba dispar
SKRNCDFEALKFRPFFVGINFDKFQKKEVS

SEQ ID NO: 2504542 - protein, 21 aa, Entamoeba dispar
SKRPRFDVIVSKLNDIIKDYS

SEQ ID NO: 2504543 - protein, 31 aa, Entamoeba dispar
SKSDIWACGIMFYEMILRRSPFDGMLNENDK

SEQ ID NO: 2504544 - protein, 25 aa, Entamoeba dispar
SKSEEWKKSIELVIKNADYHYLVNE

SEQ ID NO: 2504545 - protein, 22 aa, Entamoeba dispar
SKSEGLAECYKSMIPTQLKFES

SEQ ID NO: 2504546 - protein, 21 aa, Entamoeba dispar
SKSEIIPKFYGIEEHDFGYGE

SEQ ID NO: 2504547 - protein, 18 aa, Entamoeba dispar
SKSIKKFAIYNTEEIDEE

SEQ ID NO: 2504548 - protein, 21 aa, Entamoeba dispar
SKSILFPKIVFNIIIKNVEMI

SEQ ID NO: 2504549 - protein, 23 aa, Entamoeba dispar
SKSKEIFDSLELITIKCDEQEQI

SEQ ID NO: 2504550 - protein, 24 aa, Entamoeba dispar
SKSLRAYFFCILLKIFRVYMKIAR

SEQ ID NO: 2504551 - protein, 22 aa, Entamoeba dispar
SKSPSSSVVFDFLTNTSPSNSP

SEQ ID NO: 2504552 - protein, 17 aa, Entamoeba dispar
SKSPTFESVIPKQKPQP

SEQ ID NO: 2504553 - protein, 21 aa, Entamoeba dispar
SKSRIIDIITQFTHPENWDFI

SEQ ID NO: 2504554 - protein, 20 aa, Entamoeba dispar
SKSSSSCFNPLNALSSNTSS

SEQ ID NO: 2504555 - protein, 22 aa, Entamoeba dispar
SKSVCLNINLKLNSQKNIEEKP

SEQ ID NO: 2504556 - protein, 17 aa, Entamoeba dispar
SKSVFLWLCDLNDEKMN

SEQ ID NO: 2504557 - protein, 30 aa, Entamoeba dispar
SKSVSIPLPSEWKSPILVNECSIDMQYFQM

SEQ ID NO: 2504558 - protein, 20 aa, Entamoeba dispar
SKTFLESFLDQFPSFKKWKE

SEQ ID NO: 2504559 - protein, 25 aa, Entamoeba dispar
SKTIAEVFYSLGFDGYYDTQDPSFD

SEQ ID NO: 2504560 - protein, 18 aa, Entamoeba dispar
SKTIARGLIKMGIKKGDN

SEQ ID NO: 2504561 - protein, 20 aa, Entamoeba dispar
SKTIKFARPTECLPKVLPFP

SEQ ID NO: 2504562 - protein, 20 aa, Entamoeba dispar
SKTKVVYRYSFINDTPENRT

SEQ ID NO: 2504563 - protein, 20 aa, Entamoeba dispar
SKTTSQMFVILEIRKEITTI

SEQ ID NO: 2504564 - protein, 29 aa, Entamoeba dispar
SKTVSELYLRWTPLFWNFLRNPNISFDNK

SEQ ID NO: 2504565 - protein, 24 aa, Entamoeba dispar
SKTYKGRIIRIILPVEIDTVKKTI

SEQ ID NO: 2504566 - protein, 24 aa, Entamoeba dispar
SKVDIPYACKLLFQELMSMAVCPR

SEQ ID NO: 2504567 - protein, 25 aa, Entamoeba dispar
SKVFNLDCVPPIFRPIMSDLICVSP

SEQ ID NO: 2504568 - protein, 27 aa, Entamoeba dispar
SKVFSHIWFLFEVIIHSLIKYLDKQHA

SEQ ID NO: 2504569 - protein, 27 aa, Entamoeba dispar
SKVIIKIICFICSFITEKEEIQEIVSS

SEQ ID NO: 2504570 - protein, 21 aa, Entamoeba dispar
SKVLCPIQDLVSFIYSLFESL

SEQ ID NO: 2504571 - protein, 18 aa, Entamoeba dispar
SKVLEKYQLIGLSVGDCK

SEQ ID NO: 2504572 - protein, 18 aa, Entamoeba dispar
SKVLLKFVKEGPYREGTS

SEQ ID NO: 2504573 - protein, 35 aa, Entamoeba dispar
SKVQRIYIPFCFTSYRYEGELNYVLINTVSGEVYG

SEQ ID NO: 2504574 - protein, 26 aa, Entamoeba dispar
SKWKIPYQLIDSFGFEGNNIDIRLKS

SEQ ID NO: 2504575 - protein, 18 aa, Entamoeba dispar
SKWKMPIPPNNTLERVCA

SEQ ID NO: 2504576 - protein, 23 aa, Entamoeba dispar
SKYATRFNILFPPQSSKQLEQRM

SEQ ID NO: 2504577 - protein, 17 aa, Entamoeba dispar
SKYKSVVSVAEEVLKQY

SEQ ID NO: 2504578 - protein, 19 aa, Entamoeba dispar
SKYLHVLQCPSHPKELDNC

SEQ ID NO: 2504579 - protein, 26 aa, Entamoeba dispar
SKYLKMSIKLATRITQFIANTKMFGI

SEQ ID NO: 2504580 - protein, 17 aa, Entamoeba dispar
SKYLPGRAPNSVKNRYF

SEQ ID NO: 2504581 - protein, 27 aa, Entamoeba dispar
SKYQLNYKCGYIPLTHQQGYVVGMEPM

SEQ ID NO: 2504582 - protein, 19 aa, Entamoeba dispar
SKYRHVFGTEFKIDQQYSG

SEQ ID NO: 2504583 - protein, 20 aa, Entamoeba dispar
SKYSAILCGNKIDSENRTVT

SEQ ID NO: 2504584 - protein, 17 aa, Entamoeba dispar
SKYYHAGMDTKERTKVQ

SEQ ID NO: 2504585 - protein, 19 aa, Entamoeba dispar
SKYYPKINTNIGFLKAKCK

SEQ ID NO: 2504586 - protein, 20 aa, Entamoeba dispar
SKYYWIKNEMEIHLESEHLK

SEQ ID NO: 2504587 - protein, 19 aa, Entamoeba dispar
SLAKNCCTLATGSRDNTVQ

SEQ ID NO: 2504588 - protein, 17 aa, Entamoeba dispar
SLAQLYSIYSYFDITLG

SEQ ID NO: 2504589 - protein, 22 aa, Entamoeba dispar
SLARLLLNVRIDVGRVEQFIIN

SEQ ID NO: 2504590 - protein, 20 aa, Entamoeba dispar
SLCGEKLFRDDEIVEEVPIE

SEQ ID NO: 2504591 - protein, 26 aa, Entamoeba dispar
SLCKVKRFGGKYCEVDGIYDCTTLTY

SEQ ID NO: 2504592 - protein, 26 aa, Entamoeba dispar
SLCMALLMRHGVNFVLLKPRKIKQKN

SEQ ID NO: 2504593 - protein, 32 aa, Entamoeba dispar
SLDALIGFICEPCSDIATREAFIYTFRCYADQ

SEQ ID NO: 2504594 - protein, 18 aa, Entamoeba dispar
SLDDCMLKPEFDNKRTEM

SEQ ID NO: 2504595 - protein, 28 aa, Entamoeba dispar
SLDEEIKYIYTIIKGIRSLNGIYSQAII

SEQ ID NO: 2504596 - protein, 29 aa, Entamoeba dispar
SLDEEIKYIYTIIKGIRSLNGIYSQAIIS

SEQ ID NO: 2504597 - protein, 20 aa, Entamoeba dispar
SLDESVGFYPVQRSKGSPSS

SEQ ID NO: 2504598 - protein, 20 aa, Entamoeba dispar
SLDIVRYGHYLSIVVDKSRR

SEQ ID NO: 2504599 - protein, 20 aa, Entamoeba dispar
SLDKRKAMNIIPTHLGKQFV

SEQ ID NO: 2504600 - protein, 19 aa, Entamoeba dispar
SLDSEWIKSLIKLEDKNKK

SEQ ID NO: 2504601 - protein, 20 aa, Entamoeba dispar
SLDVVESYGQIGVKLPSMNL

SEQ ID NO: 2504602 - protein, 21 aa, Entamoeba dispar
SLEALEKFIIYCTDLSSVLSL

SEQ ID NO: 2504603 - protein, 26 aa, Entamoeba dispar
SLEERACIIKRKYIRKQFIIPSDENW

SEQ ID NO: 2504604 - protein, 18 aa, Entamoeba dispar
SLEFKNRVQHVGFLDHHP

SEQ ID NO: 2504605 - protein, 23 aa, Entamoeba dispar
SLEHCITNTYLLLSSMKPSPVDT

SEQ ID NO: 2504606 - protein, 19 aa, Entamoeba dispar
SLEIIRFPLSLEYLNISKC

SEQ ID NO: 2504607 - protein, 26 aa, Entamoeba dispar
SLEKAFYFKYLNDVRLEMKHIETENQ

SEQ ID NO: 2504608 - protein, 29 aa, Entamoeba dispar
SLEKEGLEEFGIFCLAKIFSYDSSLISHY

SEQ ID NO: 2504609 - protein, 25 aa, Entamoeba dispar
SLEKEGYPVVGVEAALLIRANWPII

SEQ ID NO: 2504610 - protein, 19 aa, Entamoeba dispar
SLEKVELFKSVSTANKTKF

SEQ ID NO: 2504611 - protein, 18 aa, Entamoeba dispar
SLEKVELPKGIVFEEHCF

SEQ ID NO: 2504612 - protein, 21 aa, Entamoeba dispar
SLEKYCFAGLPSLSSICIPSS

SEQ ID NO: 2504613 - protein, 25 aa, Entamoeba dispar
SLELSFKKGDIIKIYSTDDEWFEGE

SEQ ID NO: 2504614 - protein, 18 aa, Entamoeba dispar
SLEMVLRKPYKIEGNTSL

SEQ ID NO: 2504615 - protein, 31 aa, Entamoeba dispar
SLENISYWSFKEVWKELGMNKELLLESLTND

SEQ ID NO: 2504616 - protein, 24 aa, Entamoeba dispar
SLERKRFVGNDVVVVVFKEQLNKD

SEQ ID NO: 2504617 - protein, 20 aa, Entamoeba dispar
SLESLEWLNVLKKIMKKLQS

SEQ ID NO: 2504618 - protein, 19 aa, Entamoeba dispar
SLFCLQCAENFYFVSSNIC

SEQ ID NO: 2504619 - protein, 19 aa, Entamoeba dispar
SLFCREGTIIPSLTEIILD

SEQ ID NO: 2504620 - protein, 17 aa, Entamoeba dispar
SLFDCSRSLEYLYDELQ

SEQ ID NO: 2504621 - protein, 23 aa, Entamoeba dispar
SLFETCYLYAAFNKFCYSFFDSA

SEQ ID NO: 2504622 - protein, 17 aa, Entamoeba dispar
SLFIHHFMLGLIAVCEK

SEQ ID NO: 2504623 - protein, 18 aa, Entamoeba dispar
SLFIKFLLFQNSLNEPYH

SEQ ID NO: 2504624 - protein, 20 aa, Entamoeba dispar
SLFIKGFGKDATRQEIIDAL

SEQ ID NO: 2504625 - protein, 17 aa, Entamoeba dispar
SLFKSVFLVAKTEASKL

SEQ ID NO: 2504626 - protein, 22 aa, Entamoeba dispar
SLFNFLWPPIIERNEGDVVFEC

SEQ ID NO: 2504627 - protein, 22 aa, Entamoeba dispar
SLFPKIETLYLYNFTDTIYPNY

SEQ ID NO: 2504628 - protein, 23 aa, Entamoeba dispar
SLFSTCFCSLQFPIGNYSQQKIL

SEQ ID NO: 2504629 - protein, 28 aa, Entamoeba dispar
SLFTPETRKRLLLCSIARSGKDVVKEMR

SEQ ID NO: 2504630 - protein, 19 aa, Entamoeba dispar
SLFVKGEINDVEYASLVDN

SEQ ID NO: 2504631 - protein, 20 aa, Entamoeba dispar
SLGADCFSDCYNLTGVTISS

SEQ ID NO: 2504632 - protein, 19 aa, Entamoeba dispar
SLGEFVLQPGKFRYQGYGF

SEQ ID NO: 2504633 - protein, 21 aa, Entamoeba dispar
SLGIECFRECYSLTTINIPSS

SEQ ID NO: 2504634 - protein, 24 aa, Entamoeba dispar
SLGITCREMADGTPPYMDFPPMKA

SEQ ID NO: 2504635 - protein, 18 aa, Entamoeba dispar
SLGKVMQTPECLRVYVSS

SEQ ID NO: 2504636 - protein, 24 aa, Entamoeba dispar
SLGLLEIIGSLSLSDIPYPPSFLL

SEQ ID NO: 2504637 - protein, 23 aa, Entamoeba dispar
SLGMLQVKLLRLWDPSKDLIKIC

SEQ ID NO: 2504638 - protein, 19 aa, Entamoeba dispar
SLGNFILKKLNKFKVGDGA

SEQ ID NO: 2504639 - protein, 20 aa, Entamoeba dispar
SLGRSCRQLHGIIFGIEGEK

SEQ ID NO: 2504640 - protein, 19 aa, Entamoeba dispar
SLGSCLMNLTAILATKEKK

SEQ ID NO: 2504641 - protein, 20 aa, Entamoeba dispar
SLGTNCFRECSSISTLSIPA

SEQ ID NO: 2504642 - protein, 19 aa, Entamoeba dispar
SLGYECFYNGYELTTINIP

SEQ ID NO: 2504643 - protein, 18 aa, Entamoeba dispar
SLGYPEADTALYECALYL

SEQ ID NO: 2504644 - protein, 17 aa, Entamoeba dispar
SLHAALRAAGPVPQPRH

SEQ ID NO: 2504645 - protein, 18 aa, Entamoeba dispar
SLHALRFMDLSINRIQSV

SEQ ID NO: 2504646 - protein, 23 aa, Entamoeba dispar
SLHFLSDIITEFGYVLERRNTKG

SEQ ID NO: 2504647 - protein, 22 aa, Entamoeba dispar
SLHGVGLGRSCDIELIRNIGRI

SEQ ID NO: 2504648 - protein, 18 aa, Entamoeba dispar
SLHKAIDIPHIIPLSPKF

SEQ ID NO: 2504649 - protein, 25 aa, Entamoeba dispar
SLHKMYLLTFIVRFFIDNFKRIDSI

SEQ ID NO: 2504650 - protein, 22 aa, Entamoeba dispar
SLHKYFPLRFIPTLWTEDCDLL

SEQ ID NO: 2504651 - protein, 23 aa, Entamoeba dispar
SLHLPDRWFVSRKVVLQINNISI

SEQ ID NO: 2504652 - protein, 18 aa, Entamoeba dispar
SLHLRFNKNNSYYVDISQ

SEQ ID NO: 2504653 - protein, 21 aa, Entamoeba dispar
SLHLVINCIYVLMNIYVDFKE

SEQ ID NO: 2504654 - protein, 24 aa, Entamoeba dispar
SLHREILEPLDLLNADLINGYTTL

SEQ ID NO: 2504655 - protein, 25 aa, Entamoeba dispar
SLIAEPGFKSKAFVCDECLQIVLHK

SEQ ID NO: 2504656 - protein, 24 aa, Entamoeba dispar
SLIAQRALGFYIKYVEKGYALLAG

SEQ ID NO: 2504657 - protein, 24 aa, Entamoeba dispar
SLICCLKLPIDIVQKYLPEINSCV

SEQ ID NO: 2504658 - protein, 19 aa, Entamoeba dispar
SLICSEPLIPFSIVEIIIN

SEQ ID NO: 2504659 - protein, 19 aa, Entamoeba dispar
SLIEGLKNALPVASSDKDE

SEQ ID NO: 2504660 - protein, 23 aa, Entamoeba dispar
SLIELCIDKCILLTSLENLNKAK

SEQ ID NO: 2504661 - protein, 21 aa, Entamoeba dispar
SLIHLKEFYYSNIIDPINKKF

SEQ ID NO: 2504662 - protein, 19 aa, Entamoeba dispar
SLIHPCLPPSLIKTKYFTQ

SEQ ID NO: 2504663 - protein, 18 aa, Entamoeba dispar
SLIKLHKRDIPFVSSIIT

SEQ ID NO: 2504664 - protein, 24 aa, Entamoeba dispar
SLIKTMLTHVGKGFFELELLKKAY

SEQ ID NO: 2504665 - protein, 29 aa, Entamoeba dispar
SLINCIKKKCYIEYIFAYSVVDMNVMAKM

SEQ ID NO: 2504666 - protein, 25 aa, Entamoeba dispar
SLIPGAPSIFLYSNFMGGLSALIPL

SEQ ID NO: 2504667 - protein, 24 aa, Entamoeba dispar
SLIQRVCKALALLQTIASHPKTQH

SEQ ID NO: 2504668 - protein, 21 aa, Entamoeba dispar
SLIRELKFSFDCDSVTLELPY

SEQ ID NO: 2504669 - protein, 18 aa, Entamoeba dispar
SLITGGLYFKLKEKHLDF

SEQ ID NO: 2504670 - protein, 25 aa, Entamoeba dispar
SLITKLGGHCFRKCSPLISINLPSS

SEQ ID NO: 2504671 - protein, 19 aa, Entamoeba dispar
SLKEECFNKEMGRLTEENN

SEQ ID NO: 2504672 - protein, 22 aa, Entamoeba dispar
SLKEIDVSFNFIKEIPSEIESM

SEQ ID NO: 2504673 - protein, 19 aa, Entamoeba dispar
SLKELKLTDYTSIALTSLD

SEQ ID NO: 2504674 - protein, 22 aa, Entamoeba dispar
SLKEVILPSSICKIPDNCFKEN

SEQ ID NO: 2504675 - protein, 24 aa, Entamoeba dispar
SLKEYGSDILTVFLQKAESVCENK

SEQ ID NO: 2504676 - protein, 29 aa, Entamoeba dispar
SLKGEMKPSLSLQKIMIAFGVDPITINCL

SEQ ID NO: 2504677 - protein, 18 aa, Entamoeba dispar
SLKKFEMEECDLIDIDND

SEQ ID NO: 2504678 - protein, 21 aa, Entamoeba dispar
SLKKKRINPQIVDPKEIQQIE

SEQ ID NO: 2504679 - protein, 24 aa, Entamoeba dispar
SLKKLEMEECNGIAIPSNVKGKEV

SEQ ID NO: 2504680 - protein, 30 aa, Entamoeba dispar
SLKKNSFTPFCFPRLNLLDISNNEIMTLEN

SEQ ID NO: 2504681 - protein, 23 aa, Entamoeba dispar
SLKKSTFKPMKWNPIGDNSSNAL

SEQ ID NO: 2504682 - protein, 25 aa, Entamoeba dispar
SLKLCDGFFLAMLHYIRNDIVEHDD

SEQ ID NO: 2504683 - protein, 22 aa, Entamoeba dispar
SLKLWWNVMRHMSLLWIMNDKD

SEQ ID NO: 2504684 - protein, 33 aa, Entamoeba dispar
SLKNELGDPFYFISDALRFALVPFLDAAKGIET

SEQ ID NO: 2504685 - protein, 24 aa, Entamoeba dispar
SLKPGTLFVNVCPFMKLVTDQEIE

SEQ ID NO: 2504686 - protein, 19 aa, Entamoeba dispar
SLKRFKENVIQLLVATDVA

SEQ ID NO: 2504687 - protein, 17 aa, Entamoeba dispar
SLKRVVQLFKRCKRVAV

SEQ ID NO: 2504688 - protein, 28 aa, Entamoeba dispar
SLKSDLYSVGVMLFRMVCGCFPNETNTS

SEQ ID NO: 2504689 - protein, 20 aa, Entamoeba dispar
SLLAGMKCSFDYSNDLYVYF

SEQ ID NO: 2504690 - protein, 19 aa, Entamoeba dispar
SLLCNKLKGLINYCKINHI

SEQ ID NO: 2504691 - protein, 19 aa, Entamoeba dispar
SLLDDLFVVMSYKNTKSGF

SEQ ID NO: 2504692 - protein, 18 aa, Entamoeba dispar
SLLDLSLISCKSRKSIPS

SEQ ID NO: 2504693 - protein, 17 aa, Entamoeba dispar
SLLECALTALPEDTKSI

SEQ ID NO: 2504694 - protein, 19 aa, Entamoeba dispar
SLLECCCQLIELRNSKIII

SEQ ID NO: 2504695 - protein, 17 aa, Entamoeba dispar
SLLEEIRSLLLQFKSGL

SEQ ID NO: 2504696 - protein, 18 aa, Entamoeba dispar
SLLHDYRAKSIKQFINNC

SEQ ID NO: 2504697 - protein, 19 aa, Entamoeba dispar
SLLKFTFNSSESFKLKVNN

SEQ ID NO: 2504698 - protein, 21 aa, Entamoeba dispar
SLLKKRCFAVNLNLTQQDKKE

SEQ ID NO: 2504699 - protein, 24 aa, Entamoeba dispar
SLLLQFKSGLLLLNGKYLEDYHEY

SEQ ID NO: 2504700 - protein, 17 aa, Entamoeba dispar
SLLMKWDPTIIDRIPGV

SEQ ID NO: 2504701 - protein, 20 aa, Entamoeba dispar
SLLNFPFIIPVDYKMKFLHK

SEQ ID NO: 2504702 - protein, 19 aa, Entamoeba dispar
SLLNICIQTLFSSSQILEN

SEQ ID NO: 2504703 - protein, 20 aa, Entamoeba dispar
SLLNPSGIQPRAFYLQDNES

SEQ ID NO: 2504704 - protein, 26 aa, Entamoeba dispar
SLLPEYIKNLYIYSSDQKLIINQQSV

SEQ ID NO: 2504705 - protein, 22 aa, Entamoeba dispar
SLLPPKYDLLSFIQISEIPSKC

SEQ ID NO: 2504706 - protein, 23 aa, Entamoeba dispar
SLLQRWKFERGPFPLELNEYQQQ

SEQ ID NO: 2504707 - protein, 27 aa, Entamoeba dispar
SLLREIPIEILINPNIQFVLNVKRAFD

SEQ ID NO: 2504708 - protein, 24 aa, Entamoeba dispar
SLLSGMMKCLYYNKAYPMPIRMFE

SEQ ID NO: 2504709 - protein, 24 aa, Entamoeba dispar
SLLSIHISQLFPRSNILPYKCFSL

SEQ ID NO: 2504710 - protein, 19 aa, Entamoeba dispar
SLLSSSGRRKELLNFVLEG

SEQ ID NO: 2504711 - protein, 18 aa, Entamoeba dispar
SLLTLKWLFLHNLVNTDC

SEQ ID NO: 2504712 - protein, 23 aa, Entamoeba dispar
SLLYKMKEYEFFKNILNECTKEE

SEQ ID NO: 2504713 - protein, 19 aa, Entamoeba dispar
SLLYSLAYWAKRVMFNDEY

SEQ ID NO: 2504714 - protein, 22 aa, Entamoeba dispar
SLMAAWMKYGLPQTQQEVINLH

SEQ ID NO: 2504715 - protein, 23 aa, Entamoeba dispar
SLMKKDIAILFLLQQFYPFFDNF

SEQ ID NO: 2504716 - protein, 17 aa, Entamoeba dispar
SLMKPYFGDLLKRLLSL

SEQ ID NO: 2504717 - protein, 17 aa, Entamoeba dispar
SLMKYKQSISYGAYENN

SEQ ID NO: 2504718 - protein, 22 aa, Entamoeba dispar
SLMLRINIRNGKICHQKEFNMI

SEQ ID NO: 2504719 - protein, 24 aa, Entamoeba dispar
SLMSPMDAFLCIRGVKTLPMRMKV

SEQ ID NO: 2504720 - protein, 19 aa, Entamoeba dispar
SLMTFRNIIQLSGYSDPLY

SEQ ID NO: 2504721 - protein, 19 aa, Entamoeba dispar
SLNAARFVFDGSINGIESD

SEQ ID NO: 2504722 - protein, 24 aa, Entamoeba dispar
SLNARICGRSNILIIVLTTKGYVF

SEQ ID NO: 2504723 - protein, 25 aa, Entamoeba dispar
SLNIKESYWYLGLLYEYGVGGIQNQ

SEQ ID NO: 2504724 - protein, 20 aa, Entamoeba dispar
SLNKILPLLIKLHGTDLLPL

SEQ ID NO: 2504725 - protein, 18 aa, Entamoeba dispar
SLNKSGLIMCIEQVKDTD

SEQ ID NO: 2504726 - protein, 25 aa, Entamoeba dispar
SLNLKKAYPLFGIKNFRSTCFANSV

SEQ ID NO: 2504727 - protein, 18 aa, Entamoeba dispar
SLNMAGGDKKVISRLHEM

SEQ ID NO: 2504728 - protein, 22 aa, Entamoeba dispar
SLNNCCGYFCPLAEDKTSMKKG

SEQ ID NO: 2504729 - protein, 20 aa, Entamoeba dispar
SLNNGNNWYQIISINPRVEE

SEQ ID NO: 2504730 - protein, 25 aa, Entamoeba dispar
SLNNVQWFFDWCSINYEQTYILYGN

SEQ ID NO: 2504731 - protein, 22 aa, Entamoeba dispar
SLNNYCWFQNGNVVFNMNSSLP

SEQ ID NO: 2504732 - protein, 18 aa, Entamoeba dispar
SLNRLLYYVNDWWLRDGI

SEQ ID NO: 2504733 - protein, 23 aa, Entamoeba dispar
SLNSCSYCIIPISSSLKHFRREF

SEQ ID NO: 2504734 - protein, 21 aa, Entamoeba dispar
SLNSFQLLLNMLKQYSTLKND

SEQ ID NO: 2504735 - protein, 19 aa, Entamoeba dispar
SLNTALEFVKKGKTPELQK

SEQ ID NO: 2504736 - protein, 23 aa, Entamoeba dispar
SLNVRIVGIDGFDLSVGNEKTFL

SEQ ID NO: 2504737 - protein, 19 aa, Entamoeba dispar
SLPESFGILTQLKKLNLSD

SEQ ID NO: 2504738 - protein, 25 aa, Entamoeba dispar
SLPFSENFTVFAYLYLLNSLIKKYG

SEQ ID NO: 2504739 - protein, 24 aa, Entamoeba dispar
SLPHYLFLQLNRFDSFDVNVMKIN

SEQ ID NO: 2504740 - protein, 32 aa, Entamoeba dispar
SLPIKTLKWSVNWSVNSLGHWDDDIIENDSSY

SEQ ID NO: 2504741 - protein, 19 aa, Entamoeba dispar
SLPLARIPLLKMKGIQDEI

SEQ ID NO: 2504742 - protein, 18 aa, Entamoeba dispar
SLPLPITLLKFFKQPTPM

SEQ ID NO: 2504743 - protein, 25 aa, Entamoeba dispar
SLPNKCKYGSYIFKKVRSLTSITIN

SEQ ID NO: 2504744 - protein, 23 aa, Entamoeba dispar
SLPPESIHYLGFIDLVHKLLPIF

SEQ ID NO: 2504745 - protein, 23 aa, Entamoeba dispar
SLPSLKICFYCRISYQRSLKEIK

SEQ ID NO: 2504746 - protein, 18 aa, Entamoeba dispar
SLPYETLQIIELLIKDRE

SEQ ID NO: 2504747 - protein, 22 aa, Entamoeba dispar
SLQACVCCNILDLLKKIYTKKY

SEQ ID NO: 2504748 - protein, 18 aa, Entamoeba dispar
SLQEVLQNLIFVPSIPHE

SEQ ID NO: 2504749 - protein, 19 aa, Entamoeba dispar
SLQKEGIDNLAIVNEEGEI

SEQ ID NO: 2504750 - protein, 24 aa, Entamoeba dispar
SLQKSSVIDLHLLGNGTPLFIKVN

SEQ ID NO: 2504751 - protein, 24 aa, Entamoeba dispar
SLQLIKMRLYLTINYNTEFNIVDL

SEQ ID NO: 2504752 - protein, 25 aa, Entamoeba dispar
SLQQIMKFSSAFAAALNGTSTDIHT

SEQ ID NO: 2504753 - protein, 21 aa, Entamoeba dispar
SLQSFYIGVLNKFYDIRIEKP

SEQ ID NO: 2504754 - protein, 20 aa, Entamoeba dispar
SLRGVGLMRKLMVLFIDENT

SEQ ID NO: 2504755 - protein, 19 aa, Entamoeba dispar
SLRGYPFVYTYSIQHYSQL

SEQ ID NO: 2504756 - protein, 19 aa, Entamoeba dispar
SLRKCRIKKKEEIITMEKE

SEQ ID NO: 2504757 - protein, 19 aa, Entamoeba dispar
SLRKWTQMTEELTLNLDDE

SEQ ID NO: 2504758 - protein, 17 aa, Entamoeba dispar
SLRRKFFDSKKISINEI

SEQ ID NO: 2504759 - protein, 22 aa, Entamoeba dispar
SLRRKSNEIIGIYDGLLDFPGE

SEQ ID NO: 2504760 - protein, 24 aa, Entamoeba dispar
SLRRMLDCSKSVRITWPNLDDPSV

SEQ ID NO: 2504761 - protein, 20 aa, Entamoeba dispar
SLRSYQIYKIINGMVSALHY

SEQ ID NO: 2504762 - protein, 24 aa, Entamoeba dispar
SLRVNEVIEDFPLLRDEYNKILDQ

SEQ ID NO: 2504763 - protein, 23 aa, Entamoeba dispar
SLSFPDNLVWLGIDCLRGCSSLK

SEQ ID NO: 2504764 - protein, 19 aa, Entamoeba dispar
SLSHTWCCDVLLFVIRLLK

SEQ ID NO: 2504765 - protein, 20 aa, Entamoeba dispar
SLSLQYRAGIKLVNTEGRGV

SEQ ID NO: 2504766 - protein, 20 aa, Entamoeba dispar
SLSQIYYRDATVALLVYDIT

SEQ ID NO: 2504767 - protein, 21 aa, Entamoeba dispar
SLSRCKCFIQFGSSQLTRFIL

SEQ ID NO: 2504768 - protein, 18 aa, Entamoeba dispar
SLSRFCNVFDSFDNLNEG

SEQ ID NO: 2504769 - protein, 17 aa, Entamoeba dispar
SLSRLTSLTSFEIDHNN

SEQ ID NO: 2504770 - protein, 19 aa, Entamoeba dispar
SLSSIEWDYLDYAFMRLNK

SEQ ID NO: 2504771 - protein, 18 aa, Entamoeba dispar
SLSSINIEFRFSKLTKIN

SEQ ID NO: 2504772 - protein, 18 aa, Entamoeba dispar
SLSSMPFQHIMRYKIQLN

SEQ ID NO: 2504773 - protein, 20 aa, Entamoeba dispar
SLSVHIINILSIISSLHKDK

SEQ ID NO: 2504774 - protein, 18 aa, Entamoeba dispar
SLSVNIIYQLLSNFHTDE

SEQ ID NO: 2504775 - protein, 23 aa, Entamoeba dispar
SLTGFKLTIPFLDGSEVSKKIEN

SEQ ID NO: 2504776 - protein, 23 aa, Entamoeba dispar
SLTKLCGILHNYVPSPLNDHCLN

SEQ ID NO: 2504777 - protein, 22 aa, Entamoeba dispar
SLTKQRLVIEPSLTQLHQQYII

SEQ ID NO: 2504778 - protein, 18 aa, Entamoeba dispar
SLTLMLNIFLTTSKNLKC

SEQ ID NO: 2504779 - protein, 20 aa, Entamoeba dispar
SLTLRFQMLGVIPKVSSKQV

SEQ ID NO: 2504780 - protein, 20 aa, Entamoeba dispar
SLTLWWNVMQNMPLLWNTTD

SEQ ID NO: 2504781 - protein, 19 aa, Entamoeba dispar
SLTNHAFLIIGYDLNQPFS

SEQ ID NO: 2504782 - protein, 18 aa, Entamoeba dispar
SLTRLEITTSFNFSLPNL

SEQ ID NO: 2504783 - protein, 18 aa, Entamoeba dispar
SLTRLELGSAREFTPELS

SEQ ID NO: 2504784 - protein, 19 aa, Entamoeba dispar
SLTSMGDFCFSRCDNLTTV

SEQ ID NO: 2504785 - protein, 26 aa, Entamoeba dispar
SLTTMFFKSANIVFIVYQIGHPETAE

SEQ ID NO: 2504786 - protein, 19 aa, Entamoeba dispar
SLTYSECYDGDLIFMCSDG

SEQ ID NO: 2504787 - protein, 20 aa, Entamoeba dispar
SLVFRELCDCFDQFKIMDVH

SEQ ID NO: 2504788 - protein, 21 aa, Entamoeba dispar
SLVFRELCDCFDQFKIMDVHI

SEQ ID NO: 2504789 - protein, 19 aa, Entamoeba dispar
SLVILCGINSFGSDTLSQI

SEQ ID NO: 2504790 - protein, 17 aa, Entamoeba dispar
SLVKCKYLCPGGGAMEM

SEQ ID NO: 2504791 - protein, 23 aa, Entamoeba dispar
SLVKNARAWLKIVKSGKVKRTKL

SEQ ID NO: 2504792 - protein, 26 aa, Entamoeba dispar
SLVLKCLKAIIISNPNLIGFCVDYLC

SEQ ID NO: 2504793 - protein, 26 aa, Entamoeba dispar
SLVRIKKELNFEPTFIPHQSLLVCPS

SEQ ID NO: 2504794 - protein, 17 aa, Entamoeba dispar
SLVRPQIIGSMIEITKN

SEQ ID NO: 2504795 - protein, 17 aa, Entamoeba dispar
SLVTLIDLPAFFLQPEL

SEQ ID NO: 2504796 - protein, 17 aa, Entamoeba dispar
SLYCISFIEELNKKIKE

SEQ ID NO: 2504797 - protein, 17 aa, Entamoeba dispar
SLYELTLFTGIEMKDFL

SEQ ID NO: 2504798 - protein, 17 aa, Entamoeba dispar
SLYKFNCVCKSCDEAIK

SEQ ID NO: 2504799 - protein, 17 aa, Entamoeba dispar
SLYPSEMIIYGRVNNNW

SEQ ID NO: 2504800 - protein, 17 aa, Entamoeba dispar
SLYRPSQQYLPSQYTSP

SEQ ID NO: 2504801 - protein, 21 aa, Entamoeba dispar
SLYSFSIEDFNAFTSHTTEIA

SEQ ID NO: 2504802 - protein, 17 aa, Entamoeba dispar
SLYYFKNQMEPYSDDDD

SEQ ID NO: 2504803 - protein, 19 aa, Entamoeba dispar
SMCPCLKTIGLEGVNSLTR

SEQ ID NO: 2504804 - protein, 28 aa, Entamoeba dispar
SMCTLEFLPRRESYFWLLDALDMYKPVV

SEQ ID NO: 2504805 - protein, 25 aa, Entamoeba dispar
SMDCVPRLSKAQCMDALSSQNNLAG

SEQ ID NO: 2504806 - protein, 28 aa, Entamoeba dispar
SMDFFIDIQHRLRIAKQMCIDGKPLNLI

SEQ ID NO: 2504807 - protein, 23 aa, Entamoeba dispar
SMDISKLTKYRVIEPLGQGTFGQ

SEQ ID NO: 2504808 - protein, 18 aa, Entamoeba dispar
SMDPDLFKKIIGRMKINS

SEQ ID NO: 2504809 - protein, 30 aa, Entamoeba dispar
SMEDWIDCVWLIKIMETFKVIKFGYEEENN

SEQ ID NO: 2504810 - protein, 18 aa, Entamoeba dispar
SMEYEISKPITMKIGTSI

SEQ ID NO: 2504811 - protein, 20 aa, Entamoeba dispar
SMGSYFCVVLSKGKLYSWGA

SEQ ID NO: 2504812 - protein, 17 aa, Entamoeba dispar
SMIEKYSYYPLFLLCGF

SEQ ID NO: 2504813 - protein, 23 aa, Entamoeba dispar
SMIKFPERLIRGSIDGNIIINYT

SEQ ID NO: 2504814 - protein, 20 aa, Entamoeba dispar
SMILLIVIWLYHKVQLDMHL

SEQ ID NO: 2504815 - protein, 22 aa, Entamoeba dispar
SMISMITLMWSWKSDDIEHLKH

SEQ ID NO: 2504816 - protein, 25 aa, Entamoeba dispar
SMKDYMKASSFSLVSAKYTAGEFSH

SEQ ID NO: 2504817 - protein, 17 aa, Entamoeba dispar
SMKEFTVPQLTYNLKNK

SEQ ID NO: 2504818 - protein, 24 aa, Entamoeba dispar
SMKQENRCPFNYNYEHNSVFWAIK

SEQ ID NO: 2504819 - protein, 19 aa, Entamoeba dispar
SMKVLKGVALAGTDAVIKL

SEQ ID NO: 2504820 - protein, 22 aa, Entamoeba dispar
SMKVPHPFGTFYKLQMKQAPEH

SEQ ID NO: 2504821 - protein, 21 aa, Entamoeba dispar
SMLIRKQWNPTLIKSVISPYE

SEQ ID NO: 2504822 - protein, 17 aa, Entamoeba dispar
SMLKGCINDQIIIEPEY

SEQ ID NO: 2504823 - protein, 19 aa, Entamoeba dispar
SMLKMAEQSLKELDSGIQR

SEQ ID NO: 2504824 - protein, 17 aa, Entamoeba dispar
SMLNRWKLMQNDQEIGN

SEQ ID NO: 2504825 - protein, 18 aa, Entamoeba dispar
SMLYGIDVNGIFVAVELH

SEQ ID NO: 2504826 - protein, 19 aa, Entamoeba dispar
SMMSRSYYEGCNVVIVVFD

SEQ ID NO: 2504827 - protein, 19 aa, Entamoeba dispar
SMNQVEPLKAFLKAQQDGS

SEQ ID NO: 2504828 - protein, 17 aa, Entamoeba dispar
SMQEIYNEQVIDLIDKN

SEQ ID NO: 2504829 - protein, 21 aa, Entamoeba dispar
SMQKCFLNTFLTLIVANKDGT

SEQ ID NO: 2504830 - protein, 19 aa, Entamoeba dispar
SMRMAHDLLGVSELLTTED

SEQ ID NO: 2504831 - protein, 20 aa, Entamoeba dispar
SMRSQARITIWIKTNEYITL

SEQ ID NO: 2504832 - protein, 17 aa, Entamoeba dispar
SMRSVFENVPFELHWHL

SEQ ID NO: 2504833 - protein, 28 aa, Entamoeba dispar
SMTAFQEMLRLLSVHPFGNKEEILTKSN

SEQ ID NO: 2504834 - protein, 23 aa, Entamoeba dispar
SMTKLSNFLSIFGSKALPRTPFY

SEQ ID NO: 2504835 - protein, 25 aa, Entamoeba dispar
SMTLKGCSIYTFLNNPIIITKWYPF

SEQ ID NO: 2504836 - protein, 23 aa, Entamoeba dispar
SMTLSFFPPYPFAKQIIINRLSS

SEQ ID NO: 2504837 - protein, 23 aa, Entamoeba dispar
SMTRRPRNKILYGSTLGSISDIT

SEQ ID NO: 2504838 - protein, 19 aa, Entamoeba dispar
SMTRVVIFSVITRYLPEHA

SEQ ID NO: 2504839 - protein, 26 aa, Entamoeba dispar
SMVPAKGSAGWVIDRINMFSHLTVFT

SEQ ID NO: 2504840 - protein, 24 aa, Entamoeba dispar
SMWFEAWGALFDSCIADSLCVADE

SEQ ID NO: 2504841 - protein, 23 aa, Entamoeba dispar
SMYEEYCGMINKCALLETENIQL

SEQ ID NO: 2504842 - protein, 19 aa, Entamoeba dispar
SMYGEGWAAKFKEENDEVD

SEQ ID NO: 2504843 - protein, 17 aa, Entamoeba dispar
SMYPSEMIIYGRVNNNW

SEQ ID NO: 2504844 - protein, 21 aa, Entamoeba dispar
SMYSIRFGTMLYTLEHPNMAC

SEQ ID NO: 2504845 - protein, 20 aa, Entamoeba dispar
SNADALAAFDNADDNENDDL

SEQ ID NO: 2504846 - protein, 18 aa, Entamoeba dispar
SNAIPFRDSQYLYRCFVF

SEQ ID NO: 2504847 - protein, 25 aa, Entamoeba dispar
SNAYGECVKKLVSMYETCNEKQLIK

SEQ ID NO: 2504848 - protein, 19 aa, Entamoeba dispar
SNCCITTKIVISIVTFLLA

SEQ ID NO: 2504849 - protein, 19 aa, Entamoeba dispar
SNCFSCIHCNLTVHTYCVY

SEQ ID NO: 2504850 - protein, 27 aa, Entamoeba dispar
SNCSVALRFIEKVYRIKPLCSAENIVN

SEQ ID NO: 2504851 - protein, 18 aa, Entamoeba dispar
SNCVGLLDGMKEEDILSI

SEQ ID NO: 2504852 - protein, 26 aa, Entamoeba dispar
SNDFYYYKDIHCIELDNSIGDINQKI

SEQ ID NO: 2504853 - protein, 22 aa, Entamoeba dispar
SNDIFSGLSYSAPKKQHNSNSQ

SEQ ID NO: 2504854 - protein, 25 aa, Entamoeba dispar
SNDMKEGMLYFLLNDFKNTLIGIQY

SEQ ID NO: 2504855 - protein, 17 aa, Entamoeba dispar
SNDSIKNIGNWIEEGKR

SEQ ID NO: 2504856 - protein, 24 aa, Entamoeba dispar
SNDVKEIIKWLSNNIIKLTKSKDT

SEQ ID NO: 2504857 - protein, 27 aa, Entamoeba dispar
SNDWKKDCFYTVLSISVARCIKAFEVE

SEQ ID NO: 2504858 - protein, 23 aa, Entamoeba dispar
SNDWPDDMLCITLDRLSVDSLLT

SEQ ID NO: 2504859 - protein, 23 aa, Entamoeba dispar
SNEDFWKHVCVIWSKCYSYVDEK

SEQ ID NO: 2504860 - protein, 26 aa, Entamoeba dispar
SNEIKEKSFIIGCVIRCGISLELERK

SEQ ID NO: 2504861 - protein, 23 aa, Entamoeba dispar
SNEILQRIRLLFVDLISTTLQSI

SEQ ID NO: 2504862 - protein, 18 aa, Entamoeba dispar
SNEKRVDPFTAFLQGDQK

SEQ ID NO: 2504863 - protein, 23 aa, Entamoeba dispar
SNEKRVIPFLTFYSSRGKVTQLL

SEQ ID NO: 2504864 - protein, 27 aa, Entamoeba dispar
SNELFKEYACSFVIILGAVSYKDSESI

SEQ ID NO: 2504865 - protein, 18 aa, Entamoeba dispar
SNELKSCHPTIIPHPILT

SEQ ID NO: 2504866 - protein, 20 aa, Entamoeba dispar
SNELVLYRGLHFAAELGESI

SEQ ID NO: 2504867 - protein, 18 aa, Entamoeba dispar
SNEWSRKYVIEIIAHQSF

SEQ ID NO: 2504868 - protein, 18 aa, Entamoeba dispar
SNFGDGLVEVVGFKSVIE

SEQ ID NO: 2504869 - protein, 17 aa, Entamoeba dispar
SNFGKFYIDNNIMSDLI

SEQ ID NO: 2504870 - protein, 19 aa, Entamoeba dispar
SNFHISMKRFEFKKPNLIS

SEQ ID NO: 2504871 - protein, 26 aa, Entamoeba dispar
SNFKLLPKLILLDIINSFNNFEESEY

SEQ ID NO: 2504872 - protein, 21 aa, Entamoeba dispar
SNFMAYILISRGYKLHLNTNN

SEQ ID NO: 2504873 - protein, 24 aa, Entamoeba dispar
SNFSIKESTRLSAISLLINLGNND

SEQ ID NO: 2504874 - protein, 22 aa, Entamoeba dispar
SNFSIKGFGQIIVHSYIEQLAK

SEQ ID NO: 2504875 - protein, 28 aa, Entamoeba dispar
SNFSVFYLPPGIYEICAYNDQSLENIGY

SEQ ID NO: 2504876 - protein, 17 aa, Entamoeba dispar
SNFVEWRDSTIVYRRYA

SEQ ID NO: 2504877 - protein, 19 aa, Entamoeba dispar
SNFVKTWENYFYKFLPPFP

SEQ ID NO: 2504878 - protein, 19 aa, Entamoeba dispar
SNFYDAIQFVLCDEKFGNL

SEQ ID NO: 2504879 - protein, 24 aa, Entamoeba dispar
SNFYMWQFAGEIALQLNAVKEARK

SEQ ID NO: 2504880 - protein, 26 aa, Entamoeba dispar
SNGFIKNDPGHFVFTLQNPFNIAPTP

SEQ ID NO: 2504881 - protein, 19 aa, Entamoeba dispar
SNGGRLFVRDPTMSATKKT

SEQ ID NO: 2504882 - protein, 21 aa, Entamoeba dispar
SNGHISKAFIVYDRLRKLQIF

SEQ ID NO: 2504883 - protein, 17 aa, Entamoeba dispar
SNGIFLLNYLEDEEIEI

SEQ ID NO: 2504884 - protein, 18 aa, Entamoeba dispar
SNGIPFAKSDAVWKIVTE

SEQ ID NO: 2504885 - protein, 18 aa, Entamoeba dispar
SNGKFFYILEGNPETQFA

SEQ ID NO: 2504886 - protein, 23 aa, Entamoeba dispar
SNGLCKSKVPAYFLNNLRARNQT

SEQ ID NO: 2504887 - protein, 17 aa, Entamoeba dispar
SNGSLLVCFPSLIHTDS

SEQ ID NO: 2504888 - protein, 31 aa, Entamoeba dispar
SNGWAYCQVGYRFGYVPIKYLEKVNLAKELG

SEQ ID NO: 2504889 - protein, 25 aa, Entamoeba dispar
SNHELKRYLTFIKFNPWTYCGDMLF

SEQ ID NO: 2504890 - protein, 21 aa, Entamoeba dispar
SNHIFKLSAIKLIAELQLSIG

SEQ ID NO: 2504891 - protein, 22 aa, Entamoeba dispar
SNHLKRFCKSIKLTSLTEINLS

SEQ ID NO: 2504892 - protein, 18 aa, Entamoeba dispar
SNHLLWKTWDSVLELAIP

SEQ ID NO: 2504893 - protein, 22 aa, Entamoeba dispar
SNHLRKVTVVKQFIPSVYISGS

SEQ ID NO: 2504894 - protein, 23 aa, Entamoeba dispar
SNIELPNTYSLIGNVVVNKMKHN

SEQ ID NO: 2504895 - protein, 17 aa, Entamoeba dispar
SNIELYYKWNQKITNWV

SEQ ID NO: 2504896 - protein, 25 aa, Entamoeba dispar
SNIGETYIRMIIHLPISNKEKMEKI

SEQ ID NO: 2504897 - protein, 18 aa, Entamoeba dispar
SNIGKYFGIIEDIVVIIT

SEQ ID NO: 2504898 - protein, 21 aa, Entamoeba dispar
SNIIYQIGIEKCMSEYQQNHC

SEQ ID NO: 2504899 - protein, 19 aa, Entamoeba dispar
SNIKICLGSELLGIVEASL

SEQ ID NO: 2504900 - protein, 17 aa, Entamoeba dispar
SNIKQFICQLPEANQDT

SEQ ID NO: 2504901 - protein, 17 aa, Entamoeba dispar
SNIKWRWESIGFLPNSP

SEQ ID NO: 2504902 - protein, 18 aa, Entamoeba dispar
SNILIDFSPFKVYVDELS

SEQ ID NO: 2504903 - protein, 20 aa, Entamoeba dispar
SNILITFKIDNNVFGLYIND

SEQ ID NO: 2504904 - protein, 17 aa, Entamoeba dispar
SNILRKIMNNIYYEVIS

SEQ ID NO: 2504905 - protein, 21 aa, Entamoeba dispar
SNIPIKEGIEFCCKITEGVLL

SEQ ID NO: 2504906 - protein, 35 aa, Entamoeba dispar
SNIPIKEGIEFCCKITEGVLLRMVLSDLIKQSQSK

SEQ ID NO: 2504907 - protein, 21 aa, Entamoeba dispar
SNIPRELRALMTNKKQSYVNL

SEQ ID NO: 2504908 - protein, 28 aa, Entamoeba dispar
SNIQLIDCRFPYEFAGGRIHGAINVWNE

SEQ ID NO: 2504909 - protein, 28 aa, Entamoeba dispar
SNIQRIQYGYLFILQCLNNIDINERKKI

SEQ ID NO: 2504910 - protein, 18 aa, Entamoeba dispar
SNIVIRIVEMIGGDVNKL

SEQ ID NO: 2504911 - protein, 25 aa, Entamoeba dispar
SNIWLFCFPDGLRLSEFPIEAELKP

SEQ ID NO: 2504912 - protein, 18 aa, Entamoeba dispar
SNKAIKRITQMAQKIRNN

SEQ ID NO: 2504913 - protein, 24 aa, Entamoeba dispar
SNKFVLQCLLTLLTELSTILVKES

SEQ ID NO: 2504914 - protein, 28 aa, Entamoeba dispar
SNKGCACLRSAAKVPILVNMTVKDRFTG

SEQ ID NO: 2504915 - protein, 25 aa, Entamoeba dispar
SNKIEDEFLMFLFYYAQGTELQLQA

SEQ ID NO: 2504916 - protein, 26 aa, Entamoeba dispar
SNKIMVWECSLIKKVFIALIATSVVV

SEQ ID NO: 2504917 - protein, 21 aa, Entamoeba dispar
SNKKGDCVIYINAEKEGKTDE

SEQ ID NO: 2504918 - protein, 22 aa, Entamoeba dispar
SNKKWIIEPLVEPFDIKGKCIL

SEQ ID NO: 2504919 - protein, 27 aa, Entamoeba dispar
SNKLKSIEIINCRECKINIKSDCIERL

SEQ ID NO: 2504920 - protein, 22 aa, Entamoeba dispar
SNKRAEFALNILEERKELPSNA

SEQ ID NO: 2504921 - protein, 21 aa, Entamoeba dispar
SNKRPNFLEEFYSYVNNMKEV

SEQ ID NO: 2504922 - protein, 17 aa, Entamoeba dispar
SNKRQSVYFTRYKPKQK

SEQ ID NO: 2504923 - protein, 20 aa, Entamoeba dispar
SNKVFNHFCEAAIKFAPTFK

SEQ ID NO: 2504924 - protein, 20 aa, Entamoeba dispar
SNKVSHLFKIITMEKQGELI

SEQ ID NO: 2504925 - protein, 20 aa, Entamoeba dispar
SNLCGKCGKPVEGKILKAMG

SEQ ID NO: 2504926 - protein, 18 aa, Entamoeba dispar
SNLIDVLKILPTKKVVAC

SEQ ID NO: 2504927 - protein, 22 aa, Entamoeba dispar
SNLIVECAWCVGEYIYYLTSEE

SEQ ID NO: 2504928 - protein, 22 aa, Entamoeba dispar
SNLKYTVNNNIDWKNRIKRYHW

SEQ ID NO: 2504929 - protein, 22 aa, Entamoeba dispar
SNLLKEILNFKGYSHIKKESPE

SEQ ID NO: 2504930 - protein, 17 aa, Entamoeba dispar
SNLLKKPLPLLLPNFTQ

SEQ ID NO: 2504931 - protein, 23 aa, Entamoeba dispar
SNLLRCFRTLGLFAGNQHATCCS

SEQ ID NO: 2504932 - protein, 20 aa, Entamoeba dispar
SNLRSRRIVFNSPTQVNYIL

SEQ ID NO: 2504933 - protein, 24 aa, Entamoeba dispar
SNLSEIMKSLALIIGNLQGDKTAL

SEQ ID NO: 2504934 - protein, 25 aa, Entamoeba dispar
SNLSKINFYYCNRIRSFKIPTKITS

SEQ ID NO: 2504935 - protein, 26 aa, Entamoeba dispar
SNLTPFAFDCAIRLRKPNFINVDYVN

SEQ ID NO: 2504936 - protein, 19 aa, Entamoeba dispar
SNMLELLRIIKDPQQISQT

SEQ ID NO: 2504937 - protein, 21 aa, Entamoeba dispar
SNMTMCAAVEIVIKNGKVTGL

SEQ ID NO: 2504938 - protein, 24 aa, Entamoeba dispar
SNMTQTAICTRLFTHPLEDHKIIP

SEQ ID NO: 2504939 - protein, 25 aa, Entamoeba dispar
SNNASCSRKQCIIRRTNDGDIFFED

SEQ ID NO: 2504940 - protein, 32 aa, Entamoeba dispar
SNNEILYFLGEICNGLWYLHFTKRLIHRDLKP

SEQ ID NO: 2504941 - protein, 22 aa, Entamoeba dispar
SNNELRGLISRMLVYDENRRIT

SEQ ID NO: 2504942 - protein, 20 aa, Entamoeba dispar
SNNGQCCIYLVPLLLFDLFY

SEQ ID NO: 2504943 - protein, 25 aa, Entamoeba dispar
SNNKLTEIPIFFTELINLKKLDVSR

SEQ ID NO: 2504944 - protein, 24 aa, Entamoeba dispar
SNNRITEVPLFIDSFERLRQFDCS

SEQ ID NO: 2504945 - protein, 26 aa, Entamoeba dispar
SNNSACFACTRFLIENYKEVFDIVHD

SEQ ID NO: 2504946 - protein, 22 aa, Entamoeba dispar
SNNVFAYKWIVLLFKRYISDSY

SEQ ID NO: 2504947 - protein, 27 aa, Entamoeba dispar
SNPELFKVLKMIIGSSFTDEQLQQVVD

SEQ ID NO: 2504948 - protein, 20 aa, Entamoeba dispar
SNPELLRMMISNNPMMGMAG

SEQ ID NO: 2504949 - protein, 31 aa, Entamoeba dispar
SNPILKEYLTHFLLYIHFPWERNIENGSTNQ

SEQ ID NO: 2504950 - protein, 26 aa, Entamoeba dispar
SNPKEFLDCYSAYFGQLYQQYHNYLK

SEQ ID NO: 2504951 - protein, 20 aa, Entamoeba dispar
SNPKIFSILNSFRYPCQPFD

SEQ ID NO: 2504952 - protein, 26 aa, Entamoeba dispar
SNPMVKWQVPDTFTFKYKELENELCI

SEQ ID NO: 2504953 - protein, 18 aa, Entamoeba dispar
SNPRILNENVLKRFRTIK

SEQ ID NO: 2504954 - protein, 23 aa, Entamoeba dispar
SNPRWYENPQFLLTLTGKLHIKV

SEQ ID NO: 2504955 - protein, 18 aa, Entamoeba dispar
SNPSYWKNSCIDSLEGVF

SEQ ID NO: 2504956 - protein, 30 aa, Entamoeba dispar
SNPTFKSQVYTFVWCKQVATFFNSPHPEEF

SEQ ID NO: 2504957 - protein, 18 aa, Entamoeba dispar
SNQFIIWFNSIKQYIINK

SEQ ID NO: 2504958 - protein, 24 aa, Entamoeba dispar
SNQIPGWPALLIPFIQQISSLKKE

SEQ ID NO: 2504959 - protein, 19 aa, Entamoeba dispar
SNQLKDRFIEIIRVLSQAE

SEQ ID NO: 2504960 - protein, 18 aa, Entamoeba dispar
SNQLPVDDKCRWSPIKPE

SEQ ID NO: 2504961 - protein, 23 aa, Entamoeba dispar
SNQLREGIKIIYFEEENYEDTEV

SEQ ID NO: 2504962 - protein, 18 aa, Entamoeba dispar
SNQSNWFINGRTASHKEV

SEQ ID NO: 2504963 - protein, 23 aa, Entamoeba dispar
SNQSPRLTIGMRGLSPRRRGNSS

SEQ ID NO: 2504964 - protein, 17 aa, Entamoeba dispar
SNRDWRTDIKNFVFYDL

SEQ ID NO: 2504965 - protein, 20 aa, Entamoeba dispar
SNRKVDAFTLPTMFDSKSCY

SEQ ID NO: 2504966 - protein, 17 aa, Entamoeba dispar
SNRTVILYLCLSSETQS

SEQ ID NO: 2504967 - protein, 17 aa, Entamoeba dispar
SNSDLFLHVIIRKTDEL

SEQ ID NO: 2504968 - protein, 19 aa, Entamoeba dispar
SNSELTNFMNLWADHANVM

SEQ ID NO: 2504969 - protein, 18 aa, Entamoeba dispar
SNSFTFTKPQQWKLIDNI

SEQ ID NO: 2504970 - protein, 18 aa, Entamoeba dispar
SNSGMTMCRKVSLFPNKI

SEQ ID NO: 2504971 - protein, 18 aa, Entamoeba dispar
SNSIPNMGTNTFGGNGTG

SEQ ID NO: 2504972 - protein, 25 aa, Entamoeba dispar
SNSLRFIPINPKHQGLYESIKDGKE

SEQ ID NO: 2504973 - protein, 28 aa, Entamoeba dispar
SNSSLCLFIKILSFFVKEWRYRNKNKSN

SEQ ID NO: 2504974 - protein, 23 aa, Entamoeba dispar
SNSTRSGIRLGMRKGTPSPSSTP

SEQ ID NO: 2504975 - protein, 18 aa, Entamoeba dispar
SNTCIVGYLPYFKQTQVL

SEQ ID NO: 2504976 - protein, 25 aa, Entamoeba dispar
SNTFKYSMMYKMCYHNFYKASNGYH

SEQ ID NO: 2504977 - protein, 19 aa, Entamoeba dispar
SNTLFLRLNPFQLLIKTSA

SEQ ID NO: 2504978 - protein, 18 aa, Entamoeba dispar
SNTLLFKAVEMGFVTIVE

SEQ ID NO: 2504979 - protein, 25 aa, Entamoeba dispar
SNTMWKRRHFPLFSHIVQTMNPRLV

SEQ ID NO: 2504980 - protein, 39 aa, Entamoeba dispar
SNTSWICLGGFIFLRYICPAIIRPLEWGLVYDIPTDMLE

SEQ ID NO: 2504981 - protein, 19 aa, Entamoeba dispar
SNTTPLGFLDKILKTKKEV

SEQ ID NO: 2504982 - protein, 18 aa, Entamoeba dispar
SNTVGLCQYLDTNTYIQT

SEQ ID NO: 2504983 - protein, 26 aa, Entamoeba dispar
SNVDLGTACGRYFSVSVLSIIDGGDS

SEQ ID NO: 2504984 - protein, 25 aa, Entamoeba dispar
SNVDLGTACGRYFTVSVLSIIDGGD

SEQ ID NO: 2504985 - protein, 23 aa, Entamoeba dispar
SNVELPKSYSLIGNVVVNKMKHN

SEQ ID NO: 2504986 - protein, 22 aa, Entamoeba dispar
SNVENAFVRLCEDVLINNSTKQ

SEQ ID NO: 2504987 - protein, 25 aa, Entamoeba dispar
SNVKSWKKRWFVFTTDGNISYYTNR

SEQ ID NO: 2504988 - protein, 19 aa, Entamoeba dispar
SNVSIFFIKTTFCFIQTIG

SEQ ID NO: 2504989 - protein, 24 aa, Entamoeba dispar
SNYCIPLILAKCFKIIDEYQYQPS

SEQ ID NO: 2504990 - protein, 23 aa, Entamoeba dispar
SNYCIPLILAKCFKTIDEYQYQP

SEQ ID NO: 2504991 - protein, 18 aa, Entamoeba dispar
SNYINSVRLPSSLENINI

SEQ ID NO: 2504992 - protein, 29 aa, Entamoeba dispar
SNYKATVDPCRFMGCGPSSSTSSGYRRQG

SEQ ID NO: 2504993 - protein, 21 aa, Entamoeba dispar
SNYKVKWSWINIFSDEAYICS

SEQ ID NO: 2504994 - protein, 19 aa, Entamoeba dispar
SNYLSGLVETVFDKLKEMK

SEQ ID NO: 2504995 - protein, 24 aa, Entamoeba dispar
SNYNFERPFLWIARKLTGNPNLVF

SEQ ID NO: 2504996 - protein, 17 aa, Entamoeba dispar
SNYPGTLPIQMGGGIEN

SEQ ID NO: 2504997 - protein, 26 aa, Entamoeba dispar
SNYPKLPILFVWMGDLFHTNELPVMF

SEQ ID NO: 2504998 - protein, 29 aa, Entamoeba dispar
SNYRGRSGIPLVIECGIQYFSANIDAFTT

SEQ ID NO: 2504999 - protein, 18 aa, Entamoeba dispar
SNYRICFDSILKKYIPIQ

SEQ ID NO: 2505000 - protein, 22 aa, Entamoeba dispar
SPAEPPTCYRKFHATVDLNCRD

SEQ ID NO: 2505001 - protein, 25 aa, Entamoeba dispar
SPAYKEFVEGLGWTLDIKTHSGFLG

SEQ ID NO: 2505002 - protein, 22 aa, Entamoeba dispar
SPCGFLLFKEMILFMRALAEQN

SEQ ID NO: 2505003 - protein, 18 aa, Entamoeba dispar
SPCLPESEASFAITTNGI

SEQ ID NO: 2505004 - protein, 17 aa, Entamoeba dispar
SPCNTLAPVSSLNTTIV

SEQ ID NO: 2505005 - protein, 28 aa, Entamoeba dispar
SPDFSDLFFRRTFFYSFPSFAKAKEVVD

SEQ ID NO: 2505006 - protein, 26 aa, Entamoeba dispar
SPDIAFNAILFVGRFAELEIPEFQPL

SEQ ID NO: 2505007 - protein, 17 aa, Entamoeba dispar
SPDILVFGDCAGAPYQF

SEQ ID NO: 2505008 - protein, 24 aa, Entamoeba dispar
SPENKRVLFNFAFESLTSDEEERF

SEQ ID NO: 2505009 - protein, 21 aa, Entamoeba dispar
SPFDIKTFLWKDHPFQLPEFQ

SEQ ID NO: 2505010 - protein, 21 aa, Entamoeba dispar
SPFDYTPIYVVNWLNKQIGKE

SEQ ID NO: 2505011 - protein, 25 aa, Entamoeba dispar
SPFHLPVEYLKFFPHLTKQQINKPE

SEQ ID NO: 2505012 - protein, 17 aa, Entamoeba dispar
SPFIVCTYNYILDPKEE

SEQ ID NO: 2505013 - protein, 19 aa, Entamoeba dispar
SPFNDFFMRGLNVSLSSDD

SEQ ID NO: 2505014 - protein, 22 aa, Entamoeba dispar
SPFSCLEQVTLEGIKIVNQKHF

SEQ ID NO: 2505015 - protein, 21 aa, Entamoeba dispar
SPGKCYRLYTKDAFTKELPES

SEQ ID NO: 2505016 - protein, 18 aa, Entamoeba dispar
SPHLIPIVENGLGIGSET

SEQ ID NO: 2505017 - protein, 25 aa, Entamoeba dispar
SPIDREKIQLVSWLNQQLLTDKKIT

SEQ ID NO: 2505018 - protein, 24 aa, Entamoeba dispar
SPIDRSFCSNINYLSGKGEINEIS

SEQ ID NO: 2505019 - protein, 21 aa, Entamoeba dispar
SPINDKWGFPKPFFSNDQEFN

SEQ ID NO: 2505020 - protein, 18 aa, Entamoeba dispar
SPIPASVVLAHFDNPIED

SEQ ID NO: 2505021 - protein, 20 aa, Entamoeba dispar
SPIPHYFFLLRILREKENMN

SEQ ID NO: 2505022 - protein, 17 aa, Entamoeba dispar
SPIQIRWNTPLDTESTN

SEQ ID NO: 2505023 - protein, 23 aa, Entamoeba dispar
SPIRRYADVMVHRLLAQAIGFDQ

SEQ ID NO: 2505024 - protein, 19 aa, Entamoeba dispar
SPISFDVFGMTLLVVETNS

SEQ ID NO: 2505025 - protein, 23 aa, Entamoeba dispar
SPISVKTLNYFGAKFTQTAQNMK

SEQ ID NO: 2505026 - protein, 24 aa, Entamoeba dispar
SPKNPCLFSRIFSLDFDNPYNLIE

SEQ ID NO: 2505027 - protein, 26 aa, Entamoeba dispar
SPKRKRLSLNQFKKLLTRSTISLETA

SEQ ID NO: 2505028 - protein, 19 aa, Entamoeba dispar
SPLCPDFKQKASNIYMNQK

SEQ ID NO: 2505029 - protein, 18 aa, Entamoeba dispar
SPLFKMELVLSPVELSSF

SEQ ID NO: 2505030 - protein, 20 aa, Entamoeba dispar
SPLILRCIPTSVKRIYLQKE

SEQ ID NO: 2505031 - protein, 22 aa, Entamoeba dispar
SPLKQRRLRNLTFASRDELSSG

SEQ ID NO: 2505032 - protein, 24 aa, Entamoeba dispar
SPLNKCCSCVSILSNITQLNQKKI

SEQ ID NO: 2505033 - protein, 18 aa, Entamoeba dispar
SPLPSKESRIFVTNQDNQ

SEQ ID NO: 2505034 - protein, 17 aa, Entamoeba dispar
SPLSFIMQINFEEFEAL

SEQ ID NO: 2505035 - protein, 25 aa, Entamoeba dispar
SPLWKVVSSYLFKRNDCKIALNPFN

SEQ ID NO: 2505036 - protein, 18 aa, Entamoeba dispar
SPLYCLTLLQLGLTSITI

SEQ ID NO: 2505037 - protein, 25 aa, Entamoeba dispar
SPMKRLISFATPRSARRHNEIREET

SEQ ID NO: 2505038 - protein, 18 aa, Entamoeba dispar
SPMKRLSQMINEKELSQK

SEQ ID NO: 2505039 - protein, 20 aa, Entamoeba dispar
SPMLNPMLGRMINKVSHIST

SEQ ID NO: 2505040 - protein, 35 aa, Entamoeba dispar
SPMLPYILSGLCRFSEANDAGFIQCLGPIVQIILK

SEQ ID NO: 2505041 - protein, 20 aa, Entamoeba dispar
SPNAFNLHSFILLNISLNDL

SEQ ID NO: 2505042 - protein, 30 aa, Entamoeba dispar
SPNAKMLLELKFNKLYGLLDSFYKISKKIS

SEQ ID NO: 2505043 - protein, 26 aa, Entamoeba dispar
SPNFIPTVIVALVFNYLYPKETIEFR

SEQ ID NO: 2505044 - protein, 26 aa, Entamoeba dispar
SPNILSLIDCLKFPPEEPNTIDSLKD

SEQ ID NO: 2505045 - protein, 22 aa, Entamoeba dispar
SPNIYIDEGIIFDIEKLTRTVR

SEQ ID NO: 2505046 - protein, 17 aa, Entamoeba dispar
SPNPSPNFVHWGDSSQQ

SEQ ID NO: 2505047 - protein, 24 aa, Entamoeba dispar
SPNQFKLLLDFVKTFFSSDQSNEE

SEQ ID NO: 2505048 - protein, 18 aa, Entamoeba dispar
SPNYAFCQTEIMVLVVTK

SEQ ID NO: 2505049 - protein, 25 aa, Entamoeba dispar
SPPFTKLRLFFTCFDHIIEGMTGFF

SEQ ID NO: 2505050 - protein, 17 aa, Entamoeba dispar
SPQKPSLADEHRNELKK

SEQ ID NO: 2505051 - protein, 17 aa, Entamoeba dispar
SPQKPSLIDEHKKEVLK

SEQ ID NO: 2505052 - protein, 22 aa, Entamoeba dispar
SPQKRLSEELHRIKEQIEYRDS

SEQ ID NO: 2505053 - protein, 25 aa, Entamoeba dispar
SPQLFDISGKWVRYSGGSDQGTFLY

SEQ ID NO: 2505054 - protein, 24 aa, Entamoeba dispar
SPQLRVVSRYGHFIMKISDIISSP

SEQ ID NO: 2505055 - protein, 17 aa, Entamoeba dispar
SPQVNFIVGENGSGKSA

SEQ ID NO: 2505056 - protein, 20 aa, Entamoeba dispar
SPRDRIGYRSNRRKTRREYS

SEQ ID NO: 2505057 - protein, 18 aa, Entamoeba dispar
SPRGCIEIDCPDKVIIKG

SEQ ID NO: 2505058 - protein, 25 aa, Entamoeba dispar
SPRHTRACFIVDLYIGNKNQLTRDQ

SEQ ID NO: 2505059 - protein, 26 aa, Entamoeba dispar
SPRTQLFAPRVSKVVFGQRNTLGSSR

SEQ ID NO: 2505060 - protein, 21 aa, Entamoeba dispar
SPRYRLAASIDSINFNQLDMN

SEQ ID NO: 2505061 - protein, 21 aa, Entamoeba dispar
SPSCLTALFFNVLKERAISLS

SEQ ID NO: 2505062 - protein, 19 aa, Entamoeba dispar
SPSSFDFDKQILTPSKSPS

SEQ ID NO: 2505063 - protein, 18 aa, Entamoeba dispar
SPSSFKPKLTISVNNGKG

SEQ ID NO: 2505064 - protein, 17 aa, Entamoeba dispar
SPVACNFGCIPERNKSS

SEQ ID NO: 2505065 - protein, 23 aa, Entamoeba dispar
SPVKETPGWTVRTLIHHKMDIIH

SEQ ID NO: 2505066 - protein, 19 aa, Entamoeba dispar
SPVKRRPVIGMTQRGQRNS

SEQ ID NO: 2505067 - protein, 17 aa, Entamoeba dispar
SPWIFWFESGKDSDRST

SEQ ID NO: 2505068 - protein, 23 aa, Entamoeba dispar
SPYKALEIYGNIISYIDHQQYIN

SEQ ID NO: 2505069 - protein, 21 aa, Entamoeba dispar
SPYMFDMLPTLAFPDTENNPC

SEQ ID NO: 2505070 - protein, 19 aa, Entamoeba dispar
SPYRRTTWQGLPLAQLPKR

SEQ ID NO: 2505071 - protein, 19 aa, Entamoeba dispar
SPYSFKKGSSMLSVECVDG

SEQ ID NO: 2505072 - protein, 19 aa, Entamoeba dispar
SQALSQWCDDFIGFFTINL

SEQ ID NO: 2505073 - protein, 19 aa, Entamoeba dispar
SQCFSECSTLRSINLPSSI

SEQ ID NO: 2505074 - protein, 27 aa, Entamoeba dispar
SQCIDALKMYKDRVNLLEQQVQSKQVT

SEQ ID NO: 2505075 - protein, 17 aa, Entamoeba dispar
SQCKYMAIASGKADVYL

SEQ ID NO: 2505076 - protein, 17 aa, Entamoeba dispar
SQCPHCIKIISRDNRVL

SEQ ID NO: 2505077 - protein, 25 aa, Entamoeba dispar
SQDDFKIIINREILQQMISGFQEEA

SEQ ID NO: 2505078 - protein, 17 aa, Entamoeba dispar
SQDVKRNPSSSLTQNNV

SEQ ID NO: 2505079 - protein, 19 aa, Entamoeba dispar
SQEGVVPPVYDKLSISGFY

SEQ ID NO: 2505080 - protein, 19 aa, Entamoeba dispar
SQEKIFLNKCLHYKLEVHQ

SEQ ID NO: 2505081 - protein, 22 aa, Entamoeba dispar
SQELKRNYHLWIHHLENEKRYC

SEQ ID NO: 2505082 - protein, 19 aa, Entamoeba dispar
SQERYCFKLPSNDQPFQIN

SEQ ID NO: 2505083 - protein, 21 aa, Entamoeba dispar
SQERYRSLVTMYYRNTNGCLI

SEQ ID NO: 2505084 - protein, 17 aa, Entamoeba dispar
SQESFILEMKKENEKIQ

SEQ ID NO: 2505085 - protein, 19 aa, Entamoeba dispar
SQETMIFKPMEDIENEDVL

SEQ ID NO: 2505086 - protein, 37 aa, Entamoeba dispar
SQEVKELYKLFPKLFTLWISFYEFRKVFVQFILVIQK

SEQ ID NO: 2505087 - protein, 20 aa, Entamoeba dispar
SQEVRLLDHINLLKKVMDGV

SEQ ID NO: 2505088 - protein, 24 aa, Entamoeba dispar
SQFHFLKKCRIEMEITEPWKRCFR

SEQ ID NO: 2505089 - protein, 18 aa, Entamoeba dispar
SQFHLYVCVAIIEKYSSK

SEQ ID NO: 2505090 - protein, 18 aa, Entamoeba dispar
SQFISWFYSSLIQKINTK

SEQ ID NO: 2505091 - protein, 24 aa, Entamoeba dispar
SQFIVPQCRSIVGCSIHKEFCVCA

SEQ ID NO: 2505092 - protein, 27 aa, Entamoeba dispar
SQFPSRISKKYGIIVGGGFNLKGDLIV

SEQ ID NO: 2505093 - protein, 26 aa, Entamoeba dispar
SQFYITYWMMLNWVCFGGDDLTQQMM

SEQ ID NO: 2505094 - protein, 17 aa, Entamoeba dispar
SQGNKRRIIFGGACQNY

SEQ ID NO: 2505095 - protein, 18 aa, Entamoeba dispar
SQGNSFTFNGFEIHRELK

SEQ ID NO: 2505096 - protein, 19 aa, Entamoeba dispar
SQGVALSLGDKILMIQKQQ

SEQ ID NO: 2505097 - protein, 22 aa, Entamoeba dispar
SQGYRNSPAFQVRSTQFQQSQP

SEQ ID NO: 2505098 - protein, 19 aa, Entamoeba dispar
SQHFAERGNGIFIQSDGKI

SEQ ID NO: 2505099 - protein, 26 aa, Entamoeba dispar
SQHPLYKIKEIYSFSKHAIRIYDQPE

SEQ ID NO: 2505100 - protein, 18 aa, Entamoeba dispar
SQIARKLNLESHMIAWSG

SEQ ID NO: 2505101 - protein, 17 aa, Entamoeba dispar
SQIELIGSGSYGKVYSV

SEQ ID NO: 2505102 - protein, 24 aa, Entamoeba dispar
SQIEPKCFIQIEGIFSQPENSNPN

SEQ ID NO: 2505103 - protein, 25 aa, Entamoeba dispar
SQILIVCLDLLPSPFINDIPNQLID

SEQ ID NO: 2505104 - protein, 41 aa, Entamoeba dispar
SQILKDPKLVLVFKVNTPIDEKWGFAKPFFSNDEEFNDETI

SEQ ID NO: 2505105 - protein, 19 aa, Entamoeba dispar
SQILSRSEMAFIELKAKHH

SEQ ID NO: 2505106 - protein, 20 aa, Entamoeba dispar
SQILTRAEMAFVELKSKHHV

SEQ ID NO: 2505107 - protein, 25 aa, Entamoeba dispar
SQKERLNNILSFCGFENDDQVEKCK

SEQ ID NO: 2505108 - protein, 23 aa, Entamoeba dispar
SQKEVKVLISFPAEKYVNGSIFL

SEQ ID NO: 2505109 - protein, 17 aa, Entamoeba dispar
SQKFCSILKPIIDDYKK

SEQ ID NO: 2505110 - protein, 23 aa, Entamoeba dispar
SQKIPYSLIWLIRCISSKVHDEK

SEQ ID NO: 2505111 - protein, 18 aa, Entamoeba dispar
SQKYIFDNIINLFGNDVK

SEQ ID NO: 2505112 - protein, 26 aa, Entamoeba dispar
SQLAKPLELPQMFYMPFTVEDIQQLL

SEQ ID NO: 2505113 - protein, 17 aa, Entamoeba dispar
SQLHTGLGLTREIHYCV

SEQ ID NO: 2505114 - protein, 25 aa, Entamoeba dispar
SQLIKRLTGSFVELSLHMYGCRVVQ

SEQ ID NO: 2505115 - protein, 24 aa, Entamoeba dispar
SQLKELYIDCFIHLISHLNQLPNG

SEQ ID NO: 2505116 - protein, 20 aa, Entamoeba dispar
SQLKRRLPKDITFLHTEDME

SEQ ID NO: 2505117 - protein, 17 aa, Entamoeba dispar
SQLLVLAAACGAQIRLR

SEQ ID NO: 2505118 - protein, 19 aa, Entamoeba dispar
SQLNPDLTRICFGNSRLND

SEQ ID NO: 2505119 - protein, 25 aa, Entamoeba dispar
SQLPMSIHIPALVVIGNEIIPDSIS

SEQ ID NO: 2505120 - protein, 23 aa, Entamoeba dispar
SQLPNNLFLFLPYLKILKLGINQ

SEQ ID NO: 2505121 - protein, 20 aa, Entamoeba dispar
SQLTMRCFIYPELHQKIMNT

SEQ ID NO: 2505122 - protein, 20 aa, Entamoeba dispar
SQLYFKQIHFDLHHKSFRNI

SEQ ID NO: 2505123 - protein, 21 aa, Entamoeba dispar
SQLYLFEGCLLVFSNQKNGDM

SEQ ID NO: 2505124 - protein, 25 aa, Entamoeba dispar
SQMFVHFPTRIELFNLVKRSSSTEQ

SEQ ID NO: 2505125 - protein, 17 aa, Entamoeba dispar
SQMKDVVIVPIKSTSEF

SEQ ID NO: 2505126 - protein, 21 aa, Entamoeba dispar
SQMPFSFPSILGLKDIIVNDI

SEQ ID NO: 2505127 - protein, 22 aa, Entamoeba dispar
SQMRFDDLFIWTLKLEHKIPLQ

SEQ ID NO: 2505128 - protein, 24 aa, Entamoeba dispar
SQNPPLCHRDLKVENVLFKNKKFL

SEQ ID NO: 2505129 - protein, 18 aa, Entamoeba dispar
SQPNVFNYFLSVSKQQIG

SEQ ID NO: 2505130 - protein, 22 aa, Entamoeba dispar
SQPPEDDEFLFGGNDQEQEEEE

SEQ ID NO: 2505131 - protein, 17 aa, Entamoeba dispar
SQPRYDDKIAFRMWGID

SEQ ID NO: 2505132 - protein, 25 aa, Entamoeba dispar
SQQLRRVGKIFAVLSEDRKKDILDL

SEQ ID NO: 2505133 - protein, 23 aa, Entamoeba dispar
SQRIPLTGVYLIRSNQCQNATRI

SEQ ID NO: 2505134 - protein, 31 aa, Entamoeba dispar
SQRWIPEIKHFCPDVPFILVATKSDLRQSQS

SEQ ID NO: 2505135 - protein, 23 aa, Entamoeba dispar
SQRYTRKPIRYFQKSSYNNFSIT

SEQ ID NO: 2505136 - protein, 33 aa, Entamoeba dispar
SQSDIKTRIDFCSRNIITLLFIKYKVIEGLLQF

SEQ ID NO: 2505137 - protein, 25 aa, Entamoeba dispar
SQSGHPFAKLVLEYRKISKLLSGVI

SEQ ID NO: 2505138 - protein, 18 aa, Entamoeba dispar
SQSIAFVYQHLMIHKPII

SEQ ID NO: 2505139 - protein, 20 aa, Entamoeba dispar
SQTCCISVGSILGVPCIGKN

SEQ ID NO: 2505140 - protein, 20 aa, Entamoeba dispar
SQTCCISVSSILGVPCIGKN

SEQ ID NO: 2505141 - protein, 22 aa, Entamoeba dispar
SQTHKVILGRCLNYEPKNRPLM

SEQ ID NO: 2505142 - protein, 18 aa, Entamoeba dispar
SQTLKWVFVGGKGGVGKT

SEQ ID NO: 2505143 - protein, 24 aa, Entamoeba dispar
SQTLRLTLFNEFLIRIKKQKIPMT

SEQ ID NO: 2505144 - protein, 18 aa, Entamoeba dispar
SQTMSFAGLIIISTELLY

SEQ ID NO: 2505145 - protein, 27 aa, Entamoeba dispar
SQTWNSRIIKDQALALINVYSVRDEVY

SEQ ID NO: 2505146 - protein, 24 aa, Entamoeba dispar
SQVKVICIGYCLSILAIIPATNVK

SEQ ID NO: 2505147 - protein, 17 aa, Entamoeba dispar
SQVLKHCSYTESKPFQQ

SEQ ID NO: 2505148 - protein, 21 aa, Entamoeba dispar
SQWCDDFIGFFTINLSIQPTL

SEQ ID NO: 2505149 - protein, 27 aa, Entamoeba dispar
SQWGPGRPGWHIECSAMASNVFGDTLD

SEQ ID NO: 2505150 - protein, 24 aa, Entamoeba dispar
SQYFQFPFPICLIDSNQSIVQSMK

SEQ ID NO: 2505151 - protein, 19 aa, Entamoeba dispar
SQYKVECCLKRVSKNEFKL

SEQ ID NO: 2505152 - protein, 21 aa, Entamoeba dispar
SQYLMKYICSLYNVGVERGIR

SEQ ID NO: 2505153 - protein, 18 aa, Entamoeba dispar
SQYLRIGFERDETTWRVF

SEQ ID NO: 2505154 - protein, 24 aa, Entamoeba dispar
SQYRDAFDSFDFYNKNDFIGFQSQ

SEQ ID NO: 2505155 - protein, 22 aa, Entamoeba dispar
SQYRRELSLCLTNQPESKFQII

SEQ ID NO: 2505156 - protein, 26 aa, Entamoeba dispar
SRAGIIKKLKRFIASLSKEGTRQLDK

SEQ ID NO: 2505157 - protein, 19 aa, Entamoeba dispar
SRAKKVFVGSSITFDGKYS

SEQ ID NO: 2505158 - protein, 34 aa, Entamoeba dispar
SRALFVASLLNELPIEFIGLYLLVKTILNIFNLT

SEQ ID NO: 2505159 - protein, 17 aa, Entamoeba dispar
SRALRIQLVNKFKSYFN

SEQ ID NO: 2505160 - protein, 22 aa, Entamoeba dispar
SRAMRNRALELFVPSLGDIDIE

SEQ ID NO: 2505161 - protein, 20 aa, Entamoeba dispar
SRATKECLNSIIAIQTKIRC

SEQ ID NO: 2505162 - protein, 22 aa, Entamoeba dispar
SRAVLCRGGKAIQLSEDHKPNG

SEQ ID NO: 2505163 - protein, 24 aa, Entamoeba dispar
SRCILRNGQGVTRCLIGKEESEKP

SEQ ID NO: 2505164 - protein, 29 aa, Entamoeba dispar
SRDKSVWLWKSYSGIDYECCSVLTGHNGD

SEQ ID NO: 2505165 - protein, 24 aa, Entamoeba dispar
SRDLLDWLFSLLVHVSLFKDQNKM

SEQ ID NO: 2505166 - protein, 25 aa, Entamoeba dispar
SRDLYCIYNPIRICDDKNYWCTAKP

SEQ ID NO: 2505167 - protein, 32 aa, Entamoeba dispar
SRECGFDVNIWLCLPGTLTVSISIDGHMIKGF

SEQ ID NO: 2505168 - protein, 23 aa, Entamoeba dispar
SRECRWLPSMLCSVYNKICITVG

SEQ ID NO: 2505169 - protein, 22 aa, Entamoeba dispar
SREFFNSRFIYGFNYLSIENVE

SEQ ID NO: 2505170 - protein, 17 aa, Entamoeba dispar
SRELTQLSEYICVKTLE

SEQ ID NO: 2505171 - protein, 19 aa, Entamoeba dispar
SRERRGRSYSRSRTRSRSS

SEQ ID NO: 2505172 - protein, 24 aa, Entamoeba dispar
SRFADALYQCISCYIKYLSNEELR

SEQ ID NO: 2505173 - protein, 19 aa, Entamoeba dispar
SRFAKALFNRFQQWPPNLY

SEQ ID NO: 2505174 - protein, 23 aa, Entamoeba dispar
SRFEKMIICWIDIMGNAIREECS

SEQ ID NO: 2505175 - protein, 18 aa, Entamoeba dispar
SRFGNSFHLIREILKMTK

SEQ ID NO: 2505176 - protein, 28 aa, Entamoeba dispar
SRFIEIFFKLYIAYCQFGELNRKSSTPI

SEQ ID NO: 2505177 - protein, 21 aa, Entamoeba dispar
SRFKFLEFNNLIKLTIQSHSI

SEQ ID NO: 2505178 - protein, 23 aa, Entamoeba dispar
SRFKGDINFQCVGIFRKKTNLKM

SEQ ID NO: 2505179 - protein, 23 aa, Entamoeba dispar
SRFKRFNEMYLFNPISISSLNLF

SEQ ID NO: 2505180 - protein, 19 aa, Entamoeba dispar
SRGAGCMFNALAVQEFNQV

SEQ ID NO: 2505181 - protein, 18 aa, Entamoeba dispar
SRGIAFDIEITRQIKEAF

SEQ ID NO: 2505182 - protein, 19 aa, Entamoeba dispar
SRGKCKTCGDVIEQGEIKV

SEQ ID NO: 2505183 - protein, 27 aa, Entamoeba dispar
SRGKCSIEHWLNWIIKNSMISNDVFIR

SEQ ID NO: 2505184 - protein, 21 aa, Entamoeba dispar
SRGSLKFEKKQFITCKSNPEK

SEQ ID NO: 2505185 - protein, 20 aa, Entamoeba dispar
SRGWSGKSFNEMYNDTVGKD

SEQ ID NO: 2505186 - protein, 28 aa, Entamoeba dispar
SRHLHAMKRQRGEGGRFCSKKKIEQSQV

SEQ ID NO: 2505187 - protein, 24 aa, Entamoeba dispar
SRHPPPSLNFAYLLQVQQQSTCRI

SEQ ID NO: 2505188 - protein, 20 aa, Entamoeba dispar
SRHRCDFINCVLRFRHREYF

SEQ ID NO: 2505189 - protein, 20 aa, Entamoeba dispar
SRIAQLIGQYEQLEAKKQED

SEQ ID NO: 2505190 - protein, 24 aa, Entamoeba dispar
SRIDFKCIVYGKGFHVGITCDYAS

SEQ ID NO: 2505191 - protein, 25 aa, Entamoeba dispar
SRIELLPEFYCCPEVFMNLNHLKGE

SEQ ID NO: 2505192 - protein, 18 aa, Entamoeba dispar
SRIGRSLELRFNEIKGGY

SEQ ID NO: 2505193 - protein, 17 aa, Entamoeba dispar
SRIIFRLSGTGSVGATI

SEQ ID NO: 2505194 - protein, 25 aa, Entamoeba dispar
SRIIPELISGIFLYLNKPLLDTVIV

SEQ ID NO: 2505195 - protein, 24 aa, Entamoeba dispar
SRILVSTDLCGRGIDIEKVNLVVN

SEQ ID NO: 2505196 - protein, 25 aa, Entamoeba dispar
SRINGCGFLGYSFDSIVNAFEQEIR

SEQ ID NO: 2505197 - protein, 22 aa, Entamoeba dispar
SRIPEFEKLLGQYGNDINAING

SEQ ID NO: 2505198 - protein, 19 aa, Entamoeba dispar
SRIRRLARGSGRDIREVNE

SEQ ID NO: 2505199 - protein, 20 aa, Entamoeba dispar
SRISKASSVLKSFKAKHKIA

SEQ ID NO: 2505200 - protein, 18 aa, Entamoeba dispar
SRITILDMIKEYISKNSP

SEQ ID NO: 2505201 - protein, 22 aa, Entamoeba dispar
SRKDMHIGFISNTFMKAMSIEK

SEQ ID NO: 2505202 - protein, 23 aa, Entamoeba dispar
SRKEFPGYFKDVINHFDKHKANF

SEQ ID NO: 2505203 - protein, 20 aa, Entamoeba dispar
SRKIYLELCDVIGSELQALS

SEQ ID NO: 2505204 - protein, 20 aa, Entamoeba dispar
SRKNFYKSPFIVCTYNYILD

SEQ ID NO: 2505205 - protein, 20 aa, Entamoeba dispar
SRKNKKILGNEFLGVFSEEI

SEQ ID NO: 2505206 - protein, 21 aa, Entamoeba dispar
SRKSNFYDLGGDSFVGAQTVA

SEQ ID NO: 2505207 - protein, 18 aa, Entamoeba dispar
SRKYCLAAIKALLQTPIK

SEQ ID NO: 2505208 - protein, 21 aa, Entamoeba dispar
SRKYWHFIKVMGRSASHIALE

SEQ ID NO: 2505209 - protein, 19 aa, Entamoeba dispar
SRLAKRKVSVLSDQEKKAI

SEQ ID NO: 2505210 - protein, 18 aa, Entamoeba dispar
SRLERIFHTIKDPRQIDF

SEQ ID NO: 2505211 - protein, 20 aa, Entamoeba dispar
SRLFIITSSFSFFEYLHSNP

SEQ ID NO: 2505212 - protein, 17 aa, Entamoeba dispar
SRLFLWNDKIREHWNSY

SEQ ID NO: 2505213 - protein, 25 aa, Entamoeba dispar
SRLFPRVTPKLVVTIKRFLPNIRNF

SEQ ID NO: 2505214 - protein, 19 aa, Entamoeba dispar
SRLFSAIIFESIESLEDKS

SEQ ID NO: 2505215 - protein, 18 aa, Entamoeba dispar
SRLKAFCKERLKDFDIIC

SEQ ID NO: 2505216 - protein, 20 aa, Entamoeba dispar
SRLLCTPDYVAPEVINERLY

SEQ ID NO: 2505217 - protein, 28 aa, Entamoeba dispar
SRLSKCRCALCRYQQLCEVLTQPPFPHE

SEQ ID NO: 2505218 - protein, 19 aa, Entamoeba dispar
SRLTIPSTITEEYLNNQNI

SEQ ID NO: 2505219 - protein, 25 aa, Entamoeba dispar
SRLTRGRSSLILKPGQLPRFVLIKI

SEQ ID NO: 2505220 - protein, 20 aa, Entamoeba dispar
SRLTSLPSHDKFRNLISTLD

SEQ ID NO: 2505221 - protein, 21 aa, Entamoeba dispar
SRLYPQIIRVINGFAKEVVQE

SEQ ID NO: 2505222 - protein, 19 aa, Entamoeba dispar
SRMKLGYNEIMITSMYFND

SEQ ID NO: 2505223 - protein, 18 aa, Entamoeba dispar
SRMKLGYNEIMIVSMYFN

SEQ ID NO: 2505224 - protein, 19 aa, Entamoeba dispar
SRMKLGYNEIMIVSMYFND

SEQ ID NO: 2505225 - protein, 29 aa, Entamoeba dispar
SRMMFKNNYFRLDPHLPIEVDIADAKNIE

SEQ ID NO: 2505226 - protein, 20 aa, Entamoeba dispar
SRMSGPWAEKIVIKALEECG

SEQ ID NO: 2505227 - protein, 23 aa, Entamoeba dispar
SRNCLRALRVIAPIAEDRVVKST

SEQ ID NO: 2505228 - protein, 25 aa, Entamoeba dispar
SRNELESFIIFNLIMKLIRPLYLIQ

SEQ ID NO: 2505229 - protein, 18 aa, Entamoeba dispar
SRNELRLNDELQIKKLRR

SEQ ID NO: 2505230 - protein, 19 aa, Entamoeba dispar
SRNHFLFAFDNTEDLSGHP

SEQ ID NO: 2505231 - protein, 22 aa, Entamoeba dispar
SRNHFSPAFSCITIKSNEIYIT

SEQ ID NO: 2505232 - protein, 25 aa, Entamoeba dispar
SRNKCPAYKFGLVVATQGQKLEQQF

SEQ ID NO: 2505233 - protein, 18 aa, Entamoeba dispar
SRNMVCLVYQLLQYFEEL

SEQ ID NO: 2505234 - protein, 29 aa, Entamoeba dispar
SRNPLNCFFEISHLIAIDLYKYVTSQYSI

SEQ ID NO: 2505235 - protein, 21 aa, Entamoeba dispar
SRNVISWQYICRVIFYCLSVI

SEQ ID NO: 2505236 - protein, 35 aa, Entamoeba dispar
SRPDDIFIRILSICLIKFDSILPSKEWIYSNIPQI

SEQ ID NO: 2505237 - protein, 18 aa, Entamoeba dispar
SRPIISFGAEFEASNENK

SEQ ID NO: 2505238 - protein, 21 aa, Entamoeba dispar
SRPQMAQILAPLVRSKLLYAH

SEQ ID NO: 2505239 - protein, 38 aa, Entamoeba dispar
SRPSELYPQMQALRFPIFPSFHKFGVRYCNAKVTQFGW

SEQ ID NO: 2505240 - protein, 19 aa, Entamoeba dispar
SRPTLKRTIPGAFSSTRNI

SEQ ID NO: 2505241 - protein, 19 aa, Entamoeba dispar
SRQEVKWYHNGTLLKENEI

SEQ ID NO: 2505242 - protein, 21 aa, Entamoeba dispar
SRQEVVSMLPAILLDVHEGSS

SEQ ID NO: 2505243 - protein, 29 aa, Entamoeba dispar
SRQITLIEWEMFKAIKPPELYAWNKKDKE

SEQ ID NO: 2505244 - protein, 30 aa, Entamoeba dispar
SRQVKCTTSPILDEKVDLLSLRKLSNQSSE

SEQ ID NO: 2505245 - protein, 25 aa, Entamoeba dispar
SRRDCSRTGLRFSSRGGDINGNVSN

SEQ ID NO: 2505246 - protein, 18 aa, Entamoeba dispar
SRRWTLRGILPQYTLCHK

SEQ ID NO: 2505247 - protein, 17 aa, Entamoeba dispar
SRSALEFACNEAERATF

SEQ ID NO: 2505248 - protein, 19 aa, Entamoeba dispar
SRSALTFYQHKIVDPSREA

SEQ ID NO: 2505249 - protein, 24 aa, Entamoeba dispar
SRSFHPRDLLMLIWDKLKEDGERI

SEQ ID NO: 2505250 - protein, 19 aa, Entamoeba dispar
SRSLGKCVVLHPFKAEEIN

SEQ ID NO: 2505251 - protein, 21 aa, Entamoeba dispar
SRSLKVLKQIIEPCEDQEGNS

SEQ ID NO: 2505252 - protein, 18 aa, Entamoeba dispar
SRSPTPLYRNSFNHDSPG

SEQ ID NO: 2505253 - protein, 21 aa, Entamoeba dispar
SRSSTILIAYLMYKKMWSYKE

SEQ ID NO: 2505254 - protein, 17 aa, Entamoeba dispar
SRTEILEKAFSVAEENG

SEQ ID NO: 2505255 - protein, 22 aa, Entamoeba dispar
SRTMKIIKHIGWWGNGKLDDGL

SEQ ID NO: 2505256 - protein, 22 aa, Entamoeba dispar
SRTRLIKLFNNYIFCNTTQSII

SEQ ID NO: 2505257 - protein, 21 aa, Entamoeba dispar
SRTRTPLPLVNCIEKKVSELK

SEQ ID NO: 2505258 - protein, 20 aa, Entamoeba dispar
SRTRYYVMARLTPFKNEIQL

SEQ ID NO: 2505259 - protein, 26 aa, Entamoeba dispar
SRVFLKIMFQNLFEEMGMKEFKEKLF

SEQ ID NO: 2505260 - protein, 24 aa, Entamoeba dispar
SRVPLEILNTLSYETMKYCTYKFP

SEQ ID NO: 2505261 - protein, 20 aa, Entamoeba dispar
SRVYYNGALGAIVMCDVTNK

SEQ ID NO: 2505262 - protein, 20 aa, Entamoeba dispar
SRVYYNGALGGLVMCDVTNN

SEQ ID NO: 2505263 - protein, 24 aa, Entamoeba dispar
SRWGNSFRQTLRWLTEEPNKEKKS

SEQ ID NO: 2505264 - protein, 22 aa, Entamoeba dispar
SRWRKREISPVRECRTYKERIK

SEQ ID NO: 2505265 - protein, 17 aa, Entamoeba dispar
SRYELMDGAPVKGESMP

SEQ ID NO: 2505266 - protein, 18 aa, Entamoeba dispar
SRYFCVHGGISDRLSTID

SEQ ID NO: 2505267 - protein, 24 aa, Entamoeba dispar
SRYFSELYLEKGILQRLVEILATT

SEQ ID NO: 2505268 - protein, 28 aa, Entamoeba dispar
SRYGELFDYTILIDKRIGYICYNEYDNA

SEQ ID NO: 2505269 - protein, 17 aa, Entamoeba dispar
SRYIIMKTFEKFDQNKT

SEQ ID NO: 2505270 - protein, 20 aa, Entamoeba dispar
SRYLYLTLWGDEIKNNIQFK

SEQ ID NO: 2505271 - protein, 20 aa, Entamoeba dispar
SRYNPKLSVLDNIQMPPSLL

SEQ ID NO: 2505272 - protein, 20 aa, Entamoeba dispar
SRYPLIRTIDHIKHLLYQFK

SEQ ID NO: 2505273 - protein, 18 aa, Entamoeba dispar
SRYRFEYVTETKQQTAQE

SEQ ID NO: 2505274 - protein, 25 aa, Entamoeba dispar
SRYRGIPLYLEWAPEKVFDEEKLNK

SEQ ID NO: 2505275 - protein, 25 aa, Entamoeba dispar
SRYVRFQVIVNFGKFIQFIGKDLIN

SEQ ID NO: 2505276 - protein, 21 aa, Entamoeba dispar
SSAEPLPLLLSTSIIPSSPII

SEQ ID NO: 2505277 - protein, 23 aa, Entamoeba dispar
SSAHEFGLRLALHSLAENAARHK

SEQ ID NO: 2505278 - protein, 23 aa, Entamoeba dispar
SSAKRSQIDYSFPGNYDVKKGVS

SEQ ID NO: 2505279 - protein, 20 aa, Entamoeba dispar
SSALDLVICTDFCKTDNSIF

SEQ ID NO: 2505280 - protein, 18 aa, Entamoeba dispar
SSALGHVEAMFDMGPEEI

SEQ ID NO: 2505281 - protein, 23 aa, Entamoeba dispar
SSAVLPFELIKNIITLHQLSNIL

SEQ ID NO: 2505282 - protein, 25 aa, Entamoeba dispar
SSAYKEFVEGLGWTIDMETHSGFVG

SEQ ID NO: 2505283 - protein, 28 aa, Entamoeba dispar
SSCFCASQFPNCFANILSKNPHQSIEDA

SEQ ID NO: 2505284 - protein, 21 aa, Entamoeba dispar
SSCICLGLSYFNTFNKDIIQL

SEQ ID NO: 2505285 - protein, 23 aa, Entamoeba dispar
SSCKNNCLQLVKYIIEKFPHRLN

SEQ ID NO: 2505286 - protein, 17 aa, Entamoeba dispar
SSCLRKILVSEVTLNVY

SEQ ID NO: 2505287 - protein, 23 aa, Entamoeba dispar
SSCPDIRLVWIHRSPYDIIKSSI

SEQ ID NO: 2505288 - protein, 24 aa, Entamoeba dispar
SSCWKYLEDFSISLSYLLPDVSIE

SEQ ID NO: 2505289 - protein, 23 aa, Entamoeba dispar
SSDAGWGCAIRATQMMIVNTLVI

SEQ ID NO: 2505290 - protein, 23 aa, Entamoeba dispar
SSDDEFKRQLSLLQKRQPSVKST

SEQ ID NO: 2505291 - protein, 30 aa, Entamoeba dispar
SSDDYCYLHDFYLLPSFRGQGLGHKLMYKV

SEQ ID NO: 2505292 - protein, 26 aa, Entamoeba dispar
SSDILWKRYKFLLVKKIIERHNSFDN

SEQ ID NO: 2505293 - protein, 24 aa, Entamoeba dispar
SSDKKPDECITCIDGNKLDQSIFA

SEQ ID NO: 2505294 - protein, 21 aa, Entamoeba dispar
SSDKTPLCPICHSQISPITSH

SEQ ID NO: 2505295 - protein, 26 aa, Entamoeba dispar
SSDQFKMPWDIAKFVIAGKRLERKDN

SEQ ID NO: 2505296 - protein, 28 aa, Entamoeba dispar
SSDRFDPRWLTSHFNSIFLVVTPEKTTE

SEQ ID NO: 2505297 - protein, 20 aa, Entamoeba dispar
SSDSKCLLCEDGYKVGLSNY

SEQ ID NO: 2505298 - protein, 20 aa, Entamoeba dispar
SSDSWMDVPANTFKHKKDIK

SEQ ID NO: 2505299 - protein, 28 aa, Entamoeba dispar
SSEEIKRFLFKIGLIVTDGYGTSETGSL

SEQ ID NO: 2505300 - protein, 19 aa, Entamoeba dispar
SSEICQFLDLVRIYGKNIN

SEQ ID NO: 2505301 - protein, 25 aa, Entamoeba dispar
SSEIKIAVPSIRFFGNLLTYEDEIA

SEQ ID NO: 2505302 - protein, 26 aa, Entamoeba dispar
SSEKIFKKRIEQMWGSIQTTTITLNC

SEQ ID NO: 2505303 - protein, 22 aa, Entamoeba dispar
SSETFKLLLDYISITIGIIKTF

SEQ ID NO: 2505304 - protein, 24 aa, Entamoeba dispar
SSEYERIRFLFLTSALLKAVDEHY

SEQ ID NO: 2505305 - protein, 21 aa, Entamoeba dispar
SSFDKTVEFWDIRNLEQTAIR

SEQ ID NO: 2505306 - protein, 19 aa, Entamoeba dispar
SSFEIGKLAVLGCSVSLKV

SEQ ID NO: 2505307 - protein, 20 aa, Entamoeba dispar
SSFELIKFDSLHPQDIINNL

SEQ ID NO: 2505308 - protein, 27 aa, Entamoeba dispar
SSFGIRRRVVRDYGFKKRYEIQIGEYG

SEQ ID NO: 2505309 - protein, 24 aa, Entamoeba dispar
SSFIEALVGFQFNVVESTIGTRRP

SEQ ID NO: 2505310 - protein, 21 aa, Entamoeba dispar
SSFLTKLQIIFPETINIQKAK

SEQ ID NO: 2505311 - protein, 22 aa, Entamoeba dispar
SSFLTKLQIIFPETINIQKAKS

SEQ ID NO: 2505312 - protein, 17 aa, Entamoeba dispar
SSFPFLVFLLQSPNNEI

SEQ ID NO: 2505313 - protein, 20 aa, Entamoeba dispar
SSFVKTAISGIIYKQVLCQN

SEQ ID NO: 2505314 - protein, 18 aa, Entamoeba dispar
SSFYEYSPELSLENIIKK

SEQ ID NO: 2505315 - protein, 27 aa, Entamoeba dispar
SSFYYSRLSFLPVIRPLFLNYPNDQTT

SEQ ID NO: 2505316 - protein, 23 aa, Entamoeba dispar
SSGAYSRLYLVKKKTTGDVYAMK

SEQ ID NO: 2505317 - protein, 25 aa, Entamoeba dispar
SSGEIKSEIPIHVFGTNKGSTNYKR

SEQ ID NO: 2505318 - protein, 17 aa, Entamoeba dispar
SSGINWLFKTFPNINTI

SEQ ID NO: 2505319 - protein, 18 aa, Entamoeba dispar
SSGKFLFNTGGLNIGRST

SEQ ID NO: 2505320 - protein, 18 aa, Entamoeba dispar
SSGPRKGKSIQVSLNCTL

SEQ ID NO: 2505321 - protein, 18 aa, Entamoeba dispar
SSGYDRGVFEIKEIASLF

SEQ ID NO: 2505322 - protein, 18 aa, Entamoeba dispar
SSHDCARDGNLLCLILLL

SEQ ID NO: 2505323 - protein, 24 aa, Entamoeba dispar
SSHKPIIFCSSIGGIGSFYVTNIN

SEQ ID NO: 2505324 - protein, 18 aa, Entamoeba dispar
SSICSNVVTCMRTLIEQS

SEQ ID NO: 2505325 - protein, 24 aa, Entamoeba dispar
SSIDECWKGVLSHTSDVKELVPEF

SEQ ID NO: 2505326 - protein, 22 aa, Entamoeba dispar
SSIESFGYRCFYGCGCEEELMK

SEQ ID NO: 2505327 - protein, 23 aa, Entamoeba dispar
SSIFKKTLNGFTCNEPNDIGIEL

SEQ ID NO: 2505328 - protein, 17 aa, Entamoeba dispar
SSIGLDLLIYFAAKSSK

SEQ ID NO: 2505329 - protein, 17 aa, Entamoeba dispar
SSIIFDREKEFQIGTLV

SEQ ID NO: 2505330 - protein, 17 aa, Entamoeba dispar
SSIIKIGHWCFKECYSL

SEQ ID NO: 2505331 - protein, 25 aa, Entamoeba dispar
SSIIKIGKCCFRRCKSLKSINIPSS

SEQ ID NO: 2505332 - protein, 18 aa, Entamoeba dispar
SSIIKKGLINPIELISSL

SEQ ID NO: 2505333 - protein, 18 aa, Entamoeba dispar
SSIIKLGDDCFRECSSLT

SEQ ID NO: 2505334 - protein, 18 aa, Entamoeba dispar
SSIIKLGDRCFNECSSLT

SEQ ID NO: 2505335 - protein, 25 aa, Entamoeba dispar
SSIIKRTILSDVFWLKSTNYPGRIW

SEQ ID NO: 2505336 - protein, 17 aa, Entamoeba dispar
SSIIPVKNFIVVTSIQY

SEQ ID NO: 2505337 - protein, 24 aa, Entamoeba dispar
SSIISFGGGCFYGCGCEEELMKNE

SEQ ID NO: 2505338 - protein, 27 aa, Entamoeba dispar
SSIISFGRSCFYGCGYVEELTQNKRIP

SEQ ID NO: 2505339 - protein, 37 aa, Entamoeba dispar
SSIKLEALKAIYFCIQRFELKYVYAYFTHIWESIEQN

SEQ ID NO: 2505340 - protein, 25 aa, Entamoeba dispar
SSIKYQSIVCTFLIKYYPLIFRDTC

SEQ ID NO: 2505341 - protein, 28 aa, Entamoeba dispar
SSILPIPRVKFYATELLLAINALHKCNY

SEQ ID NO: 2505342 - protein, 23 aa, Entamoeba dispar
SSINELGDWCFYNCYELISINIP

SEQ ID NO: 2505343 - protein, 24 aa, Entamoeba dispar
SSINELGSWCFRECSSLKSINIPS

SEQ ID NO: 2505344 - protein, 19 aa, Entamoeba dispar
SSINKIGFNCFYRCSSLKS

SEQ ID NO: 2505345 - protein, 18 aa, Entamoeba dispar
SSINKLGRYCFSGCESLQ

SEQ ID NO: 2505346 - protein, 20 aa, Entamoeba dispar
SSIPFKKLISYVGTTDEFLK

SEQ ID NO: 2505347 - protein, 23 aa, Entamoeba dispar
SSIPFNIKHGIIQTDCTIFKLSK

SEQ ID NO: 2505348 - protein, 17 aa, Entamoeba dispar
SSIPIQLTDNFVEQSNG

SEQ ID NO: 2505349 - protein, 35 aa, Entamoeba dispar
SSIPKQETSLLFGIAFDRRLEKLKEQYAEQPVVQT

SEQ ID NO: 2505350 - protein, 20 aa, Entamoeba dispar
SSIPSHCFDNCYNLKSIILP

SEQ ID NO: 2505351 - protein, 36 aa, Entamoeba dispar
SSIPSIWKCLYKQKFEKLRLDCYFDDLCQWTKLNAI

SEQ ID NO: 2505352 - protein, 19 aa, Entamoeba dispar
SSIQKLSLRSNFFSSSISN

SEQ ID NO: 2505353 - protein, 21 aa, Entamoeba dispar
SSIQPTTHWYLSKDYDFCFSL

SEQ ID NO: 2505354 - protein, 20 aa, Entamoeba dispar
SSIRGFQILFCIYDVNDKES

SEQ ID NO: 2505355 - protein, 24 aa, Entamoeba dispar
SSISDLGDWCRFNGCTSLTSINIL

SEQ ID NO: 2505356 - protein, 25 aa, Entamoeba dispar
SSISELGKLCFRECSSLKSINIPSS

SEQ ID NO: 2505357 - protein, 23 aa, Entamoeba dispar
SSISELGSWCFYGCTSLTTINIP

SEQ ID NO: 2505358 - protein, 17 aa, Entamoeba dispar
SSISEWQNLIIDYGGNI

SEQ ID NO: 2505359 - protein, 24 aa, Entamoeba dispar
SSISKIGAYCFYKCSSLTSMNIPS

SEQ ID NO: 2505360 - protein, 20 aa, Entamoeba dispar
SSISKIGFDCFDGCTSLTSM

SEQ ID NO: 2505361 - protein, 17 aa, Entamoeba dispar
SSISKLGDRCFYECFAL

SEQ ID NO: 2505362 - protein, 19 aa, Entamoeba dispar
SSISKLGYDCFYRCSSLTS

SEQ ID NO: 2505363 - protein, 18 aa, Entamoeba dispar
SSISKLGYECFSDCSSLT

SEQ ID NO: 2505364 - protein, 19 aa, Entamoeba dispar
SSISYLFHRYCIECIEIKD

SEQ ID NO: 2505365 - protein, 29 aa, Entamoeba dispar
SSITKIGAFCFKDCFGLIEFESLAEHIII

SEQ ID NO: 2505366 - protein, 18 aa, Entamoeba dispar
SSITKLGDHCFSRCSSLK

SEQ ID NO: 2505367 - protein, 17 aa, Entamoeba dispar
SSITKLGDYCFSKCHSL

SEQ ID NO: 2505368 - protein, 26 aa, Entamoeba dispar
SSITKLGGHCFYRCRSLTSINIPTTI

SEQ ID NO: 2505369 - protein, 18 aa, Entamoeba dispar
SSITKLGNHCFSGCSSLK

SEQ ID NO: 2505370 - protein, 20 aa, Entamoeba dispar
SSITKLGYDCFKECTSLISI

SEQ ID NO: 2505371 - protein, 25 aa, Entamoeba dispar
SSITLIPYCCFDGCSSLEKVELPKG

SEQ ID NO: 2505372 - protein, 21 aa, Entamoeba dispar
SSITSFGDWCFNTCSSLQSIN

SEQ ID NO: 2505373 - protein, 21 aa, Entamoeba dispar
SSITSFGDWCFNTCSSLTSIN

SEQ ID NO: 2505374 - protein, 25 aa, Entamoeba dispar
SSITSFGYKCFYRCLSLTLITIPSS

SEQ ID NO: 2505375 - protein, 27 aa, Entamoeba dispar
SSITSIGDWCFKGCSLLKSINIPSSII

SEQ ID NO: 2505376 - protein, 22 aa, Entamoeba dispar
SSITSIGIRCFNECYSLTTINI

SEQ ID NO: 2505377 - protein, 27 aa, Entamoeba dispar
SSITSIGYKCFKYCPSLTSINIPSSIT

SEQ ID NO: 2505378 - protein, 20 aa, Entamoeba dispar
SSIVCAIALGLGTAPKVLGR

SEQ ID NO: 2505379 - protein, 20 aa, Entamoeba dispar
SSIVHLPPSLAVIFQPFKQF

SEQ ID NO: 2505380 - protein, 22 aa, Entamoeba dispar
SSKDRFSSIVIEQLKKEFTKVN

SEQ ID NO: 2505381 - protein, 23 aa, Entamoeba dispar
SSKEIKVTIFIRVIKNENVVVLH

SEQ ID NO: 2505382 - protein, 22 aa, Entamoeba dispar
SSKEQKIQFMLKKKYQNLRNDR

SEQ ID NO: 2505383 - protein, 23 aa, Entamoeba dispar
SSKEYLSLTCCFAIQCNCPAILR

SEQ ID NO: 2505384 - protein, 21 aa, Entamoeba dispar
SSKGIINCIGLLPPSIHKIST

SEQ ID NO: 2505385 - protein, 19 aa, Entamoeba dispar
SSKGTILEPFFNDNSPISS

SEQ ID NO: 2505386 - protein, 19 aa, Entamoeba dispar
SSKGYKVACIFFNENSIHY

SEQ ID NO: 2505387 - protein, 17 aa, Entamoeba dispar
SSKICLIGSASYGPFAF

SEQ ID NO: 2505388 - protein, 25 aa, Entamoeba dispar
SSKQGRLRLNLMGKRVDFSARTVIS

SEQ ID NO: 2505389 - protein, 23 aa, Entamoeba dispar
SSKQVKRKSIFFSNSLFQEDDTF

SEQ ID NO: 2505390 - protein, 27 aa, Entamoeba dispar
SSKYCMKYLRRYCKATPMTIHSYHIRI

SEQ ID NO: 2505391 - protein, 19 aa, Entamoeba dispar
SSLALKYGIDVGGGVIDED

SEQ ID NO: 2505392 - protein, 24 aa, Entamoeba dispar
SSLALRFQMLGVIPIVNMKEINLI

SEQ ID NO: 2505393 - protein, 18 aa, Entamoeba dispar
SSLARLPSNIIEVLGQKK

SEQ ID NO: 2505394 - protein, 17 aa, Entamoeba dispar
SSLCSVGNFYEVRVAAI

SEQ ID NO: 2505395 - protein, 17 aa, Entamoeba dispar
SSLDYTIRFFVKNINVD

SEQ ID NO: 2505396 - protein, 33 aa, Entamoeba dispar
SSLELRYVKNLKKLKLRGVNKLKINEINEEQEI

SEQ ID NO: 2505397 - protein, 26 aa, Entamoeba dispar
SSLIKSGNCTAFIRGLPLKWGDIEFS

SEQ ID NO: 2505398 - protein, 24 aa, Entamoeba dispar
SSLILLHLIISFNWNRNYLIWNDI

SEQ ID NO: 2505399 - protein, 30 aa, Entamoeba dispar
SSLISIYKSAKWIGVDAIWKTKTKEFKSSL

SEQ ID NO: 2505400 - protein, 18 aa, Entamoeba dispar
SSLISPRGISQTALTNGR

SEQ ID NO: 2505401 - protein, 18 aa, Entamoeba dispar
SSLKEIKGLNFVKKYEQS

SEQ ID NO: 2505402 - protein, 36 aa, Entamoeba dispar
SSLKGIITVRIFNIPFTWKEHDVLEYFKEFHPLKAL

SEQ ID NO: 2505403 - protein, 35 aa, Entamoeba dispar
SSLKIGKYECRIFCKESTEGFLFKTYHACGDNTFL

SEQ ID NO: 2505404 - protein, 21 aa, Entamoeba dispar
SSLKISIKPQFIITNSTTKTF

SEQ ID NO: 2505405 - protein, 23 aa, Entamoeba dispar
SSLKKSNPYSIIFNAAKGINEEF

SEQ ID NO: 2505406 - protein, 17 aa, Entamoeba dispar
SSLKSFYIPTTVSKKAA

SEQ ID NO: 2505407 - protein, 17 aa, Entamoeba dispar
SSLLVLIQLQSCQSYQT

SEQ ID NO: 2505408 - protein, 26 aa, Entamoeba dispar
SSLNELRRWNSLYGEGASTASTSLKY

SEQ ID NO: 2505409 - protein, 25 aa, Entamoeba dispar
SSLPKDYKSLVGIQRRKDNPNRRRL

SEQ ID NO: 2505410 - protein, 25 aa, Entamoeba dispar
SSLPKETKMIISLYMTELPVGISVN

SEQ ID NO: 2505411 - protein, 20 aa, Entamoeba dispar
SSLPKRGSIKFKVSNGNMLV

SEQ ID NO: 2505412 - protein, 19 aa, Entamoeba dispar
SSLQFIIVACDGFWNVFKY

SEQ ID NO: 2505413 - protein, 29 aa, Entamoeba dispar
SSLQVKYKVCLELSSYQGIFVLLKNFCIY

SEQ ID NO: 2505414 - protein, 19 aa, Entamoeba dispar
SSLRQIKLPPLLEVIKDYS

SEQ ID NO: 2505415 - protein, 19 aa, Entamoeba dispar
SSLSELGDYCFNNCCSLES

SEQ ID NO: 2505416 - protein, 28 aa, Entamoeba dispar
SSLTKLRQLCCSGCGIREIPDNLLNNFK

SEQ ID NO: 2505417 - protein, 26 aa, Entamoeba dispar
SSLTRIVRIYKELKFKRLDLPIENEI

SEQ ID NO: 2505418 - protein, 24 aa, Entamoeba dispar
SSLYIKSCYEINCSEAQVKEIIIF

SEQ ID NO: 2505419 - protein, 26 aa, Entamoeba dispar
SSMKNELPWWKTVFAIVMKYISTNCP

SEQ ID NO: 2505420 - protein, 24 aa, Entamoeba dispar
SSMKQRMVSFFLSLLDSMNLAVKF

SEQ ID NO: 2505421 - protein, 24 aa, Entamoeba dispar
SSMRRKSRLFLLIDGRIINKQTGK

SEQ ID NO: 2505422 - protein, 24 aa, Entamoeba dispar
SSMVKHVMMLLAFETPQKEAEKTP

SEQ ID NO: 2505423 - protein, 18 aa, Entamoeba dispar
SSMYRKSLDLERKKEDAI

SEQ ID NO: 2505424 - protein, 20 aa, Entamoeba dispar
SSNAFTFGGIRIVNKSLANK

SEQ ID NO: 2505425 - protein, 19 aa, Entamoeba dispar
SSNDFPVTLQNDFSQPSQF

SEQ ID NO: 2505426 - protein, 17 aa, Entamoeba dispar
SSNHFKEFRYVIFNINV

SEQ ID NO: 2505427 - protein, 25 aa, Entamoeba dispar
SSNILPCVMVAFATTMTLGNGTTGY

SEQ ID NO: 2505428 - protein, 17 aa, Entamoeba dispar
SSNKYLYAIAFGSVNNS

SEQ ID NO: 2505429 - protein, 20 aa, Entamoeba dispar
SSNLGFRMQWICPFNASQKT

SEQ ID NO: 2505430 - protein, 19 aa, Entamoeba dispar
SSNSIAFIIGCFTHNFVNI

SEQ ID NO: 2505431 - protein, 25 aa, Entamoeba dispar
SSNVIEKCFKFATPNERQQILEEIY

SEQ ID NO: 2505432 - protein, 32 aa, Entamoeba dispar
SSNVLATKEFISWIMFRMFHLFEKLNQFKEMV

SEQ ID NO: 2505433 - protein, 24 aa, Entamoeba dispar
SSNWRIAEGSLHILTCLHQNMNEI

SEQ ID NO: 2505434 - protein, 19 aa, Entamoeba dispar
SSPDEMKSFLLKTTSINSN

SEQ ID NO: 2505435 - protein, 24 aa, Entamoeba dispar
SSPECVLYAAKIFPFGEQMIALCR

SEQ ID NO: 2505436 - protein, 24 aa, Entamoeba dispar
SSPIELSEGLSFEEKAEFFVNELG

SEQ ID NO: 2505437 - protein, 24 aa, Entamoeba dispar
SSPIKATSGLFVFIISFEPKEAVN

SEQ ID NO: 2505438 - protein, 21 aa, Entamoeba dispar
SSPIYGQWIECVEIIRKQQPD

SEQ ID NO: 2505439 - protein, 22 aa, Entamoeba dispar
SSPKNSIGICVGFVAAQCALEI

SEQ ID NO: 2505440 - protein, 22 aa, Entamoeba dispar
SSPKTIPPYSIYPSTYQPPYTS

SEQ ID NO: 2505441 - protein, 19 aa, Entamoeba dispar
SSPLEIVEAYNFTGQTVSH

SEQ ID NO: 2505442 - protein, 23 aa, Entamoeba dispar
SSPPKSRWEAVRDDDKFFVFTCK

SEQ ID NO: 2505443 - protein, 22 aa, Entamoeba dispar
SSPSDCALMLLFVINEYNMGFF

SEQ ID NO: 2505444 - protein, 26 aa, Entamoeba dispar
SSPSFARNVFPCYSISQNSFIQPPQT

SEQ ID NO: 2505445 - protein, 26 aa, Entamoeba dispar
SSPSTVLRCLFRLRPYTDMILKEMSG

SEQ ID NO: 2505446 - protein, 21 aa, Entamoeba dispar
SSPVHRWEIVLKIKRLLDASH

SEQ ID NO: 2505447 - protein, 18 aa, Entamoeba dispar
SSQFARYILSSMNIGSLI

SEQ ID NO: 2505448 - protein, 25 aa, Entamoeba dispar
SSQNVKEIRCEYEFNELRSGDTFKK

SEQ ID NO: 2505449 - protein, 24 aa, Entamoeba dispar
SSQQCPRAYVLSGSKSYTAVQLTS

SEQ ID NO: 2505450 - protein, 24 aa, Entamoeba dispar
SSQRILSLIARLQFDMMEEETYPS

SEQ ID NO: 2505451 - protein, 19 aa, Entamoeba dispar
SSQSFFLIYPISGETINGL

SEQ ID NO: 2505452 - protein, 26 aa, Entamoeba dispar
SSQSIPLQPLVCSSYPLNNTTSCNFN

SEQ ID NO: 2505453 - protein, 18 aa, Entamoeba dispar
SSQVHWWYYEDKWVQFRQ

SEQ ID NO: 2505454 - protein, 22 aa, Entamoeba dispar
SSREKIPHYWSYVLQNSGVLKK

SEQ ID NO: 2505455 - protein, 28 aa, Entamoeba dispar
SSRISPSIFRPLADYGILNPVSRKGDPM

SEQ ID NO: 2505456 - protein, 22 aa, Entamoeba dispar
SSSADHSFIVWMRSKEQIFVEE

SEQ ID NO: 2505457 - protein, 18 aa, Entamoeba dispar
SSSALIVLYRSGTLICYD

SEQ ID NO: 2505458 - protein, 21 aa, Entamoeba dispar
SSSDVIDWNGIIPKSEEDVQF

SEQ ID NO: 2505459 - protein, 17 aa, Entamoeba dispar
SSSEEVITMKKDKKDEI

SEQ ID NO: 2505460 - protein, 26 aa, Entamoeba dispar
SSSFDIKPSPSFSLFGDTASDTKKST

SEQ ID NO: 2505461 - protein, 26 aa, Entamoeba dispar
SSSFFKQYIEILTLFYSKLVMFLKLN

SEQ ID NO: 2505462 - protein, 22 aa, Entamoeba dispar
SSSFKGIAMLVCRTRKSVIKYT

SEQ ID NO: 2505463 - protein, 18 aa, Entamoeba dispar
SSSFNFRYEVLKKGENPT

SEQ ID NO: 2505464 - protein, 17 aa, Entamoeba dispar
SSSFPCLQINANQLLLE

SEQ ID NO: 2505465 - protein, 22 aa, Entamoeba dispar
SSSFPFIISIELAYNDIFIVLH

SEQ ID NO: 2505466 - protein, 19 aa, Entamoeba dispar
SSSGKIFFVEYYKLQDHLN

SEQ ID NO: 2505467 - protein, 21 aa, Entamoeba dispar
SSSHSCWYDLLIKLSAILSFD

SEQ ID NO: 2505468 - protein, 21 aa, Entamoeba dispar
SSSIPPIFSVCSMEIQDQLIS

SEQ ID NO: 2505469 - protein, 20 aa, Entamoeba dispar
SSSLISRLFRITEGIAGSSG

SEQ ID NO: 2505470 - protein, 25 aa, Entamoeba dispar
SSSNLIDTLSCFSISSNINLDDDIL

SEQ ID NO: 2505471 - protein, 28 aa, Entamoeba dispar
SSSPRSSPMLMQFTPRFTSGPSPYNPAT

SEQ ID NO: 2505472 - protein, 17 aa, Entamoeba dispar
SSSRLHSRIACLRLIIF

SEQ ID NO: 2505473 - protein, 24 aa, Entamoeba dispar
SSSTTKELFVWNAINGEQIKTISI

SEQ ID NO: 2505474 - protein, 25 aa, Entamoeba dispar
SSSYNHQYCCDKTCPCLNQENQPHT

SEQ ID NO: 2505475 - protein, 23 aa, Entamoeba dispar
SSTGIFRLAGRADTVALYAKYPL

SEQ ID NO: 2505476 - protein, 19 aa, Entamoeba dispar
SSTIKKIVRFQCSDKPASR

SEQ ID NO: 2505477 - protein, 25 aa, Entamoeba dispar
SSTIMPCVMVAFATTMTLGNGTTGY

SEQ ID NO: 2505478 - protein, 24 aa, Entamoeba dispar
SSTKELPSLIIGKYHFKQSAKDHT

SEQ ID NO: 2505479 - protein, 26 aa, Entamoeba dispar
SSTLLLRSALYYIQKMLKVFGIEEKQ

SEQ ID NO: 2505480 - protein, 28 aa, Entamoeba dispar
SSTPRAQPRLGLGGGLGIQPAGLGLGLG

SEQ ID NO: 2505481 - protein, 19 aa, Entamoeba dispar
SSTVKSSLCSSEERDKGVY

SEQ ID NO: 2505482 - protein, 18 aa, Entamoeba dispar
SSVCKIGDYCFYKCTSLT

SEQ ID NO: 2505483 - protein, 28 aa, Entamoeba dispar
SSVDIKYGYEYIFPLIPIIIVNKEDYIN

SEQ ID NO: 2505484 - protein, 38 aa, Entamoeba dispar
SSVEYFCFKYNKSLLNDFKYALVWGNSVAHSPQQVNKD

SEQ ID NO: 2505485 - protein, 28 aa, Entamoeba dispar
SSVFKRWKKRYCVLASNVIALFENAKDL

SEQ ID NO: 2505486 - protein, 24 aa, Entamoeba dispar
SSVGKKGVCAMLASQLSVCLDNHA

SEQ ID NO: 2505487 - protein, 20 aa, Entamoeba dispar
SSVGKTCCMNRFVSDQFSEV

SEQ ID NO: 2505488 - protein, 32 aa, Entamoeba dispar
SSVIMSKWMAFECITRMVGFYDLDRKDLDGVQ

SEQ ID NO: 2505489 - protein, 20 aa, Entamoeba dispar
SSVIPEIDEPWYLKFNNSAI

SEQ ID NO: 2505490 - protein, 26 aa, Entamoeba dispar
SSVISLGRLCFACCCSLSEVNIPHDI

SEQ ID NO: 2505491 - protein, 33 aa, Entamoeba dispar
SSVLEELINFWVFKGLLEMSAKVATAVQREACT

SEQ ID NO: 2505492 - protein, 20 aa, Entamoeba dispar
SSVLVSPSFTVPRLTECYLK

SEQ ID NO: 2505493 - protein, 26 aa, Entamoeba dispar
SSVSELPAYCFLCCRALKSINIPSSV

SEQ ID NO: 2505494 - protein, 26 aa, Entamoeba dispar
SSVSKFGWGCFYKCGCKEELKKNKRI

SEQ ID NO: 2505495 - protein, 17 aa, Entamoeba dispar
SSVSKIGYYCFFECTSL

SEQ ID NO: 2505496 - protein, 26 aa, Entamoeba dispar
SSVSKIGYYCFYKCYSLKSINIPSSI

SEQ ID NO: 2505497 - protein, 24 aa, Entamoeba dispar
SSVSKLGNYCFSRCTSLKSINIPS

SEQ ID NO: 2505498 - protein, 17 aa, Entamoeba dispar
SSVTKLGKRCFDFCLGL

SEQ ID NO: 2505499 - protein, 17 aa, Entamoeba dispar
SSVTSLGERCFKGCTSL

SEQ ID NO: 2505500 - protein, 23 aa, Entamoeba dispar
SSVTSLGEYCFKNCINLTSITIP

SEQ ID NO: 2505501 - protein, 25 aa, Entamoeba dispar
SSYDFIKGCLIFIPKTAITKLASFN

SEQ ID NO: 2505502 - protein, 18 aa, Entamoeba dispar
SSYFPFKNVTIAVVVFNS

SEQ ID NO: 2505503 - protein, 23 aa, Entamoeba dispar
SSYKKSVSPAFCELLKKKRSCSP

SEQ ID NO: 2505504 - protein, 39 aa, Entamoeba dispar
SSYLDAIRIGMCFFWHSKVDLPFRIVIIGAGGCTLTLGI

SEQ ID NO: 2505505 - protein, 20 aa, Entamoeba dispar
SSYQEVLESFIFNPISSTRL

SEQ ID NO: 2505506 - protein, 20 aa, Entamoeba dispar
SSYRHSYHGRSYDRSRSHSS

SEQ ID NO: 2505507 - protein, 19 aa, Entamoeba dispar
SSYSFKADVPAGYYDIRIC

SEQ ID NO: 2505508 - protein, 25 aa, Entamoeba dispar
SSYVCSGFVGNRCGMIILDSFQIQS

SEQ ID NO: 2505509 - protein, 23 aa, Entamoeba dispar
SSYVSCPVIFNLGGVPQSLPKTV

SEQ ID NO: 2505510 - protein, 17 aa, Entamoeba dispar
STASSFNRILLGIMNNS

SEQ ID NO: 2505511 - protein, 18 aa, Entamoeba dispar
STAVIICKECCLHKIPEP

SEQ ID NO: 2505512 - protein, 21 aa, Entamoeba dispar
STCCGTELCGFNLELDITYSY

SEQ ID NO: 2505513 - protein, 25 aa, Entamoeba dispar
STCLNEPIHSFVFLPSNSADDDVLF

SEQ ID NO: 2505514 - protein, 26 aa, Entamoeba dispar
STCMKTKAGEVLKVIEKNVRIGWLYC

SEQ ID NO: 2505515 - protein, 19 aa, Entamoeba dispar
STCPFPFSLPSSITSLHLS

SEQ ID NO: 2505516 - protein, 18 aa, Entamoeba dispar
STCPYKFTFNKKIVYESE

SEQ ID NO: 2505517 - protein, 20 aa, Entamoeba dispar
STCSCIRGDVTTFPKEIDAK

SEQ ID NO: 2505518 - protein, 22 aa, Entamoeba dispar
STCTKFAGIRIVNELAVKSPEV

SEQ ID NO: 2505519 - protein, 22 aa, Entamoeba dispar
STCYSFLQVCPNRFEFIHKHYI

SEQ ID NO: 2505520 - protein, 18 aa, Entamoeba dispar
STDGFVFGVFSSSFQSPK

SEQ ID NO: 2505521 - protein, 27 aa, Entamoeba dispar
STDIIFFLSQQLFDWKKVFREIIKGTI

SEQ ID NO: 2505522 - protein, 23 aa, Entamoeba dispar
STEDIKKAFEIFDKEKNGYISAS

SEQ ID NO: 2505523 - protein, 19 aa, Entamoeba dispar
STEGISFKTIPLIQNELFC

SEQ ID NO: 2505524 - protein, 17 aa, Entamoeba dispar
STEKINFFNEWNDNSNK

SEQ ID NO: 2505525 - protein, 23 aa, Entamoeba dispar
STEKPKVVGIAFTFNIHQTSIGL

SEQ ID NO: 2505526 - protein, 23 aa, Entamoeba dispar
STEKRLAYIEARDDVSIIAGDGT

SEQ ID NO: 2505527 - protein, 25 aa, Entamoeba dispar
STELIEIKLSFILLTLKNLNIKKVP

SEQ ID NO: 2505528 - protein, 24 aa, Entamoeba dispar
STELKLKALSAVAIDLSLTDSADS

SEQ ID NO: 2505529 - protein, 26 aa, Entamoeba dispar
STELREMMVHFSLGMLQVKLLRLWDP

SEQ ID NO: 2505530 - protein, 19 aa, Entamoeba dispar
STETTEWGEFAHKPGIVYR

SEQ ID NO: 2505531 - protein, 35 aa, Entamoeba dispar
STEWKYKEAAIFVFGCIICKGWNPNNQQFNQQVKI

SEQ ID NO: 2505532 - protein, 31 aa, Entamoeba dispar
STFFKAGSSELIWSPRANIVLCKAQTNIDST

SEQ ID NO: 2505533 - protein, 38 aa, Entamoeba dispar
STFHQWKCQITSIFFKQLEDVECLLLLLNKIIPYSYDY

SEQ ID NO: 2505534 - protein, 24 aa, Entamoeba dispar
STFKLLYRRDEVISVILDLITKLC

SEQ ID NO: 2505535 - protein, 17 aa, Entamoeba dispar
STFLKQHLSVVVDTYQN

SEQ ID NO: 2505536 - protein, 17 aa, Entamoeba dispar
STFPKELLSSLLQVVCL

SEQ ID NO: 2505537 - protein, 22 aa, Entamoeba dispar
STFPKKPKKAFVTVKDPDMFVF

SEQ ID NO: 2505538 - protein, 20 aa, Entamoeba dispar
STFPKWKAKDLHTIFHTDER

SEQ ID NO: 2505539 - protein, 17 aa, Entamoeba dispar
STFSKFRSFKCYDPDIN

SEQ ID NO: 2505540 - protein, 26 aa, Entamoeba dispar
STGDLFTQMYWKIGMKNFDKFIEKLI

SEQ ID NO: 2505541 - protein, 33 aa, Entamoeba dispar
STGFKEPFCGWYHSHPSYKCWLSGIDVATEKLH

SEQ ID NO: 2505542 - protein, 23 aa, Entamoeba dispar
STGIIQFSWLRRPIQITCRFYQL

SEQ ID NO: 2505543 - protein, 25 aa, Entamoeba dispar
STGIPIKGGYCVRIKQGYAAFDKGA

SEQ ID NO: 2505544 - protein, 27 aa, Entamoeba dispar
STGMLFDRESVRFITKIVQEVKEKREV

SEQ ID NO: 2505545 - protein, 18 aa, Entamoeba dispar
STGSEGFYEQSLQLRREQ

SEQ ID NO: 2505546 - protein, 18 aa, Entamoeba dispar
STHDFKALSACHSSVTEL

SEQ ID NO: 2505547 - protein, 19 aa, Entamoeba dispar
STHEYLVYQTLLSITSCVS

SEQ ID NO: 2505548 - protein, 19 aa, Entamoeba dispar
STIATALARSFALVGKKTG

SEQ ID NO: 2505549 - protein, 19 aa, Entamoeba dispar
STIELRSVNNLKQLKLHGV

SEQ ID NO: 2505550 - protein, 17 aa, Entamoeba dispar
STIFDLWRQCHQPYSKM

SEQ ID NO: 2505551 - protein, 29 aa, Entamoeba dispar
STIHPSFARFALECSEYKCVGSTIRALRF

SEQ ID NO: 2505552 - protein, 24 aa, Entamoeba dispar
STIIAFRYLLAYYRQPEVKQCEVL

SEQ ID NO: 2505553 - protein, 27 aa, Entamoeba dispar
STIIPEIDEPWYLKFNNSAIYDDDIKD

SEQ ID NO: 2505554 - protein, 19 aa, Entamoeba dispar
STIIPEIDKPWNLKFNNSA

SEQ ID NO: 2505555 - protein, 18 aa, Entamoeba dispar
STIKMMKYFDQFVGNNNW

SEQ ID NO: 2505556 - protein, 17 aa, Entamoeba dispar
STIKSGIPSGGFAPSAP

SEQ ID NO: 2505557 - protein, 17 aa, Entamoeba dispar
STIPCYGAILMDEDLQH

SEQ ID NO: 2505558 - protein, 24 aa, Entamoeba dispar
STIPNKWVKTMMMFVLLLKNLEEK

SEQ ID NO: 2505559 - protein, 17 aa, Entamoeba dispar
STIQCSQQLIIKANGIK

SEQ ID NO: 2505560 - protein, 21 aa, Entamoeba dispar
STIRFKVHHVIMKKQESVKPV

SEQ ID NO: 2505561 - protein, 25 aa, Entamoeba dispar
STIRMWDIIAGKCMKTLTQHTKGVR

SEQ ID NO: 2505562 - protein, 21 aa, Entamoeba dispar
STISTIGFNCFYWCTSLTSIN

SEQ ID NO: 2505563 - protein, 24 aa, Entamoeba dispar
STISTIGFNCFYWCTSLTSINNQN

SEQ ID NO: 2505564 - protein, 17 aa, Entamoeba dispar
STITFSYIHTPLINELI

SEQ ID NO: 2505565 - protein, 19 aa, Entamoeba dispar
STITKFGYGCFDRCHSLKS

SEQ ID NO: 2505566 - protein, 19 aa, Entamoeba dispar
STKGSICVQYTILPSPSSA

SEQ ID NO: 2505567 - protein, 25 aa, Entamoeba dispar
STKIDFNVVFNKEYAYRVSTDSGTS

SEQ ID NO: 2505568 - protein, 22 aa, Entamoeba dispar
STKNLTKIICWLKKTENTTNQQ

SEQ ID NO: 2505569 - protein, 21 aa, Entamoeba dispar
STKRCISRFIEIGVIDNVIQI

SEQ ID NO: 2505570 - protein, 36 aa, Entamoeba dispar
STKSYLKKELELIKANISYLDIIHLYSSFNKTQEPT

SEQ ID NO: 2505571 - protein, 20 aa, Entamoeba dispar
STLCYKCHDIGILCNAITYL

SEQ ID NO: 2505572 - protein, 23 aa, Entamoeba dispar
STLFIPASCLMKMTPFEKQYWNI

SEQ ID NO: 2505573 - protein, 32 aa, Entamoeba dispar
STLFWMFKYVMDFLQPFYFCKGDIIMKALRKN

SEQ ID NO: 2505574 - protein, 18 aa, Entamoeba dispar
STLHAFAHWTWVHTKGTL

SEQ ID NO: 2505575 - protein, 22 aa, Entamoeba dispar
STLKEVVSLLIKKLDGKEFSEE

SEQ ID NO: 2505576 - protein, 22 aa, Entamoeba dispar
STLKRLLPRANIQVVRGTFHQA

SEQ ID NO: 2505577 - protein, 24 aa, Entamoeba dispar
STLKRQDAGTLLREKPEEQFERPK

SEQ ID NO: 2505578 - protein, 18 aa, Entamoeba dispar
STLNKLTIEKCYSLNKLP

SEQ ID NO: 2505579 - protein, 23 aa, Entamoeba dispar
STLQCNFIRIGIDDYSICDTLAL

SEQ ID NO: 2505580 - protein, 23 aa, Entamoeba dispar
STLRCVKRLLSTTACVEVVAKSK

SEQ ID NO: 2505581 - protein, 28 aa, Entamoeba dispar
STLREVRVLRMLDHLNVLKFIAYSPNII

SEQ ID NO: 2505582 - protein, 21 aa, Entamoeba dispar
STLTFPDMRIVYASRTHSQLA

SEQ ID NO: 2505583 - protein, 25 aa, Entamoeba dispar
STLYICGFDEMLKIIKIETFVALNN

SEQ ID NO: 2505584 - protein, 21 aa, Entamoeba dispar
STMFRVTYRNGFTYHLPHCSL

SEQ ID NO: 2505585 - protein, 18 aa, Entamoeba dispar
STMKEFIDKFISQNKIMA

SEQ ID NO: 2505586 - protein, 26 aa, Entamoeba dispar
STMKLKAVCGNLFIKDAQPMVWEIAV

SEQ ID NO: 2505587 - protein, 18 aa, Entamoeba dispar
STMYLGRAMMIVYEMCIN

SEQ ID NO: 2505588 - protein, 22 aa, Entamoeba dispar
STNEAISFFHLIGRIIHTEPVY

SEQ ID NO: 2505589 - protein, 18 aa, Entamoeba dispar
STNEYGLFDGEDFATTLV

SEQ ID NO: 2505590 - protein, 24 aa, Entamoeba dispar
STNEYLRLLCVIFIIIKHDSDNAL

SEQ ID NO: 2505591 - protein, 25 aa, Entamoeba dispar
STNNEIFKFLFFVADIHNQGFITKT

SEQ ID NO: 2505592 - protein, 23 aa, Entamoeba dispar
STNPETPDTFALFVPENSKKNVP

SEQ ID NO: 2505593 - protein, 24 aa, Entamoeba dispar
STNSLLSEIIFKFDNNNLSYNEFT

SEQ ID NO: 2505594 - protein, 22 aa, Entamoeba dispar
STNYPGRIWVHRRFLMNEAEKI

SEQ ID NO: 2505595 - protein, 30 aa, Entamoeba dispar
STPAYVVFFLVRLVPEFMLHLQSGVFDKPD

SEQ ID NO: 2505596 - protein, 20 aa, Entamoeba dispar
STPEALSFGGGTGHPSLSFD

SEQ ID NO: 2505597 - protein, 24 aa, Entamoeba dispar
STPFIPYFSCLCGNDFTKSFNQKL

SEQ ID NO: 2505598 - protein, 19 aa, Entamoeba dispar
STPNPKPFHQIKFQLNGKT

SEQ ID NO: 2505599 - protein, 22 aa, Entamoeba dispar
STPRKGFIGRNRAKSGLVKTVP

SEQ ID NO: 2505600 - protein, 23 aa, Entamoeba dispar
STPYRLMKMPLRRYTSSSKHNEL

SEQ ID NO: 2505601 - protein, 17 aa, Entamoeba dispar
STQFAFNSFENVFSGNF

SEQ ID NO: 2505602 - protein, 24 aa, Entamoeba dispar
STQFPCVYHIPTYREVPPLFYQPP

SEQ ID NO: 2505603 - protein, 23 aa, Entamoeba dispar
STQMFNFISSFFVNMILNTESLE

SEQ ID NO: 2505604 - protein, 17 aa, Entamoeba dispar
STQMVLKTFHFAGVASM

SEQ ID NO: 2505605 - protein, 24 aa, Entamoeba dispar
STQQRILAFLSIRKITPTTHQSVK

SEQ ID NO: 2505606 - protein, 26 aa, Entamoeba dispar
STQSKRGRRAQSIDITSLVESQNQTV

SEQ ID NO: 2505607 - protein, 25 aa, Entamoeba dispar
STQWVFQQLFFVRFLFPLLENPLFI

SEQ ID NO: 2505608 - protein, 26 aa, Entamoeba dispar
STQYGLRFCGMRVFNKDINMFIQHDK

SEQ ID NO: 2505609 - protein, 19 aa, Entamoeba dispar
STRCSYFYQYFSLEKQPMI

SEQ ID NO: 2505610 - protein, 19 aa, Entamoeba dispar
STRGYGYDLADNFIDDDYA

SEQ ID NO: 2505611 - protein, 17 aa, Entamoeba dispar
STRKSHRKMISVNTRKT

SEQ ID NO: 2505612 - protein, 20 aa, Entamoeba dispar
STRLRKALDNCFIVDEVNPL

SEQ ID NO: 2505613 - protein, 19 aa, Entamoeba dispar
STSDLRFVLLSENKRQCEF

SEQ ID NO: 2505614 - protein, 27 aa, Entamoeba dispar
STSFNLKTAVSWLFVNIILYSEDDNIG

SEQ ID NO: 2505615 - protein, 25 aa, Entamoeba dispar
STSVPLKLYEIIAVPLAESVKRTFE

SEQ ID NO: 2505616 - protein, 17 aa, Entamoeba dispar
STTKCKMISSLKNSLNQ

SEQ ID NO: 2505617 - protein, 24 aa, Entamoeba dispar
STTLPRCGLVPRSLDVEIRSVVFF

SEQ ID NO: 2505618 - protein, 25 aa, Entamoeba dispar
STTPIYFKIMVKIIKKGGIEIIKKY

SEQ ID NO: 2505619 - protein, 19 aa, Entamoeba dispar
STVIPRFFKHSNFSSFVRQ

SEQ ID NO: 2505620 - protein, 17 aa, Entamoeba dispar
STVLKKRQSVLDFSQKQ

SEQ ID NO: 2505621 - protein, 30 aa, Entamoeba dispar
STVLKQLRCNGVLEGIRITRMGYPNRMIYS

SEQ ID NO: 2505622 - protein, 26 aa, Entamoeba dispar
STVNKLGNWCFYKCSSLTTINIPSVV

SEQ ID NO: 2505623 - protein, 30 aa, Entamoeba dispar
STVQIKRWEVFGILACSFFNVQWEDKVERI

SEQ ID NO: 2505624 - protein, 19 aa, Entamoeba dispar
STVRMLCGIPSSGLGNLFM

SEQ ID NO: 2505625 - protein, 20 aa, Entamoeba dispar
STWGNLWQYIGIERHAQYGY

SEQ ID NO: 2505626 - protein, 27 aa, Entamoeba dispar
STWNSLWRYIGIEKHATYGFYWMIGAA

SEQ ID NO: 2505627 - protein, 22 aa, Entamoeba dispar
STWPKPPACLGDDETYFSFNRT

SEQ ID NO: 2505628 - protein, 17 aa, Entamoeba dispar
STWTLKTNILFVNATSY

SEQ ID NO: 2505629 - protein, 25 aa, Entamoeba dispar
STYIGKSVFFTKFIVPDKYYIYHSN

SEQ ID NO: 2505630 - protein, 26 aa, Entamoeba dispar
STYIWGYCDAHFKKDMTFEEAKQFII

SEQ ID NO: 2505631 - protein, 18 aa, Entamoeba dispar
STYLLTLDIFNQGYYTPI

SEQ ID NO: 2505632 - protein, 26 aa, Entamoeba dispar
SVAGHVYTCEFERAFQNWSVDPRDLF

SEQ ID NO: 2505633 - protein, 26 aa, Entamoeba dispar
SVAIIPFKFLSKFYELSLQYRKINKE

SEQ ID NO: 2505634 - protein, 19 aa, Entamoeba dispar
SVAISRGINEEGIFRISSE

SEQ ID NO: 2505635 - protein, 19 aa, Entamoeba dispar
SVAIVGKDTPFRFITDNEL

SEQ ID NO: 2505636 - protein, 27 aa, Entamoeba dispar
SVASFPSLRCWYKFDSPTFVCSKIRSL

SEQ ID NO: 2505637 - protein, 28 aa, Entamoeba dispar
SVATFHLGMCYRKGMGVYENSIKSAEMY

SEQ ID NO: 2505638 - protein, 23 aa, Entamoeba dispar
SVCEIKKIIPLDVQTILVSATYP

SEQ ID NO: 2505639 - protein, 21 aa, Entamoeba dispar
SVCVPRIPFDDSLLEIPRTLN

SEQ ID NO: 2505640 - protein, 33 aa, Entamoeba dispar
SVDAFKTFYKITIGFNFLSNFIIIKDYAIYCVQ

SEQ ID NO: 2505641 - protein, 24 aa, Entamoeba dispar
SVDELNMIFTMFADVFESYENSTK

SEQ ID NO: 2505642 - protein, 26 aa, Entamoeba dispar
SVDFYEYLVFCWMKILVVDKKKTFHQ

SEQ ID NO: 2505643 - protein, 26 aa, Entamoeba dispar
SVDIKYGYEYIFPLIPIIIVNKEDYI

SEQ ID NO: 2505644 - protein, 18 aa, Entamoeba dispar
SVDIWSIGAIFGELAYGA

SEQ ID NO: 2505645 - protein, 26 aa, Entamoeba dispar
SVDVCLSAFAGMISKIVKRRLLLMKN

SEQ ID NO: 2505646 - protein, 25 aa, Entamoeba dispar
SVDYYKISPLIPFLLKQLGSSSCEA

SEQ ID NO: 2505647 - protein, 25 aa, Entamoeba dispar
SVEEKRINSSLIYSQLVPILARPLQ

SEQ ID NO: 2505648 - protein, 35 aa, Entamoeba dispar
SVEGKMIRKIMKWMLKCLICQEQIFDMTKMFCPKC

SEQ ID NO: 2505649 - protein, 22 aa, Entamoeba dispar
SVEGQIEFTALLFVPQRAPFDM

SEQ ID NO: 2505650 - protein, 17 aa, Entamoeba dispar
SVEIAQEALINIFIHSA

SEQ ID NO: 2505651 - protein, 18 aa, Entamoeba dispar
SVEIAQEALINVFIHSAM

SEQ ID NO: 2505652 - protein, 23 aa, Entamoeba dispar
SVELKYCKVTSLSPLNQTNHLES

SEQ ID NO: 2505653 - protein, 17 aa, Entamoeba dispar
SVELRMCSGVTDNGIEI

SEQ ID NO: 2505654 - protein, 19 aa, Entamoeba dispar
SVEPLKGSIIDGLENLQET

SEQ ID NO: 2505655 - protein, 23 aa, Entamoeba dispar
SVEYKPKCIKKYHSKYPVDTQPH

SEQ ID NO: 2505656 - protein, 24 aa, Entamoeba dispar
SVFENVPFELHWHLIVQDEYQIPS

SEQ ID NO: 2505657 - protein, 17 aa, Entamoeba dispar
SVFISKEMVEFCQKFIY

SEQ ID NO: 2505658 - protein, 17 aa, Entamoeba dispar
SVFKIDYKIELIVSSLL

SEQ ID NO: 2505659 - protein, 23 aa, Entamoeba dispar
SVFQLPSIITHLSYFRIPLPDIL

SEQ ID NO: 2505660 - protein, 19 aa, Entamoeba dispar
SVFVPKEKTGIVYIEAMTE

SEQ ID NO: 2505661 - protein, 23 aa, Entamoeba dispar
SVGKSSIVLRVCKDEYKEFQENT

SEQ ID NO: 2505662 - protein, 24 aa, Entamoeba dispar
SVGLKNEGCIKFYSINGNGEITEK

SEQ ID NO: 2505663 - protein, 25 aa, Entamoeba dispar
SVGLTTFLGCVILKIKGDDDKYAIA

SEQ ID NO: 2505664 - protein, 25 aa, Entamoeba dispar
SVGSCAQLKFPFEIEPPIQKLTFGR

SEQ ID NO: 2505665 - protein, 18 aa, Entamoeba dispar
SVIEIGSKCFCGCFELNI

SEQ ID NO: 2505666 - protein, 17 aa, Entamoeba dispar
SVIERARSVFSLPAQLR

SEQ ID NO: 2505667 - protein, 18 aa, Entamoeba dispar
SVILPEFDHPVKIQRNEK

SEQ ID NO: 2505668 - protein, 17 aa, Entamoeba dispar
SVILPYDVSFECGNLSS

SEQ ID NO: 2505669 - protein, 17 aa, Entamoeba dispar
SVIPKRQSSILCDDKKH

SEQ ID NO: 2505670 - protein, 22 aa, Entamoeba dispar
SVIPPHLFKITSLKKLILSQNN

SEQ ID NO: 2505671 - protein, 24 aa, Entamoeba dispar
SVIRSLCGCFEDISSMSIEQIKKE

SEQ ID NO: 2505672 - protein, 17 aa, Entamoeba dispar
SVISSALSLIQQVYERL

SEQ ID NO: 2505673 - protein, 23 aa, Entamoeba dispar
SVISTRWFGKLSLFDCSRSLEYL

SEQ ID NO: 2505674 - protein, 17 aa, Entamoeba dispar
SVITKKWLEEIGKTASI

SEQ ID NO: 2505675 - protein, 24 aa, Entamoeba dispar
SVIYKLVDEFGFIQSLLDIFYDER

SEQ ID NO: 2505676 - protein, 19 aa, Entamoeba dispar
SVKATCFIDFGFNSTECYV

SEQ ID NO: 2505677 - protein, 26 aa, Entamoeba dispar
SVKCSALRALMYVDLSAAVHYVIKKS

SEQ ID NO: 2505678 - protein, 23 aa, Entamoeba dispar
SVKCSPSIFSCALQNQGIFFDSL

SEQ ID NO: 2505679 - protein, 24 aa, Entamoeba dispar
SVKDRVGFNIVYQAIKDGRLKPGM

SEQ ID NO: 2505680 - protein, 23 aa, Entamoeba dispar
SVKDRVGFNIVYQAIKNGRLKPG

SEQ ID NO: 2505681 - protein, 18 aa, Entamoeba dispar
SVKEIIYLRNFAKSEVDE

SEQ ID NO: 2505682 - protein, 23 aa, Entamoeba dispar
SVKESLKNGLSFIDEIPTLRESI

SEQ ID NO: 2505683 - protein, 26 aa, Entamoeba dispar
SVKIVRESKSGMGRGIGFVTFTNKED

SEQ ID NO: 2505684 - protein, 25 aa, Entamoeba dispar
SVKLPGEFEPGIIIWMTEGKTTFLH

SEQ ID NO: 2505685 - protein, 20 aa, Entamoeba dispar
SVKMITHLIDMYIKERRQKK

SEQ ID NO: 2505686 - protein, 19 aa, Entamoeba dispar
SVKNLKKLKLNGVNKLKIN

SEQ ID NO: 2505687 - protein, 24 aa, Entamoeba dispar
SVKTAELMTGATLESRRINIESTS

SEQ ID NO: 2505688 - protein, 25 aa, Entamoeba dispar
SVKVFSKAAGIFVACTELADKCGLK

SEQ ID NO: 2505689 - protein, 18 aa, Entamoeba dispar
SVLADFLVSSGLKLQSIV

SEQ ID NO: 2505690 - protein, 31 aa, Entamoeba dispar
SVLDEAYCIECIPSDFWQRLGDLNDTIKSFE

SEQ ID NO: 2505691 - protein, 31 aa, Entamoeba dispar
SVLDLKEAIKFFGSICQYKIPKGARALKKTL

SEQ ID NO: 2505692 - protein, 24 aa, Entamoeba dispar
SVLEEYKEMFGLTLELYQKYWNDK

SEQ ID NO: 2505693 - protein, 22 aa, Entamoeba dispar
SVLFHKMVPLLSGVTKFDIPSD

SEQ ID NO: 2505694 - protein, 23 aa, Entamoeba dispar
SVLGKCCFYKCSSLTSINIPSTI

SEQ ID NO: 2505695 - protein, 23 aa, Entamoeba dispar
SVLGKSCFSGCCSLTSITIPSSI

SEQ ID NO: 2505696 - protein, 19 aa, Entamoeba dispar
SVLHLWLMVSIPKLDTNKS

SEQ ID NO: 2505697 - protein, 17 aa, Entamoeba dispar
SVLKGMVILSSEQFFES

SEQ ID NO: 2505698 - protein, 29 aa, Entamoeba dispar
SVLKHSFKHVFFKYLIKKINLFNILINII

SEQ ID NO: 2505699 - protein, 17 aa, Entamoeba dispar
SVLKKLKALYLQSNNLF

SEQ ID NO: 2505700 - protein, 24 aa, Entamoeba dispar
SVLKSFKAKHKIAATGTPMMNNLL

SEQ ID NO: 2505701 - protein, 17 aa, Entamoeba dispar
SVLKSLIGFLVQITEKS

SEQ ID NO: 2505702 - protein, 19 aa, Entamoeba dispar
SVLLCPHKTEFLMMLLENY

SEQ ID NO: 2505703 - protein, 19 aa, Entamoeba dispar
SVLMYLPLSLVHSIHLPSK

SEQ ID NO: 2505704 - protein, 19 aa, Entamoeba dispar
SVLNCSVAIVGKDTPFRFI

SEQ ID NO: 2505705 - protein, 22 aa, Entamoeba dispar
SVLNGECIVSFEIEDDESDDNK

SEQ ID NO: 2505706 - protein, 27 aa, Entamoeba dispar
SVLPPLLHLAANLSFLSPIFCSELYSG

SEQ ID NO: 2505707 - protein, 24 aa, Entamoeba dispar
SVLSETLFCLLLVCEPSQEVKELY

SEQ ID NO: 2505708 - protein, 25 aa, Entamoeba dispar
SVLTPEIIKFIPNRLHLLIQTLGDE

SEQ ID NO: 2505709 - protein, 25 aa, Entamoeba dispar
SVLVEWPSLTPFGFDKDLLKRLNNV

SEQ ID NO: 2505710 - protein, 18 aa, Entamoeba dispar
SVMICLFTSVKHSHSRHR

SEQ ID NO: 2505711 - protein, 26 aa, Entamoeba dispar
SVMKEVMEEIRLLKKLKHKHIVRYIA

SEQ ID NO: 2505712 - protein, 17 aa, Entamoeba dispar
SVMLRSKIAGGAVDLLR

SEQ ID NO: 2505713 - protein, 26 aa, Entamoeba dispar
SVMSGITCSLRFPGQLNQDLKKLTVN

SEQ ID NO: 2505714 - protein, 26 aa, Entamoeba dispar
SVMSGITCSLRFPGQLNQDLRKLAVN

SEQ ID NO: 2505715 - protein, 18 aa, Entamoeba dispar
SVNAHLDGGVIINEPCGG

SEQ ID NO: 2505716 - protein, 29 aa, Entamoeba dispar
SVNAHPAWLKGCELMHIKPIIISADKRNA

SEQ ID NO: 2505717 - protein, 19 aa, Entamoeba dispar
SVNDGCGWGVEPSYVARVA

SEQ ID NO: 2505718 - protein, 24 aa, Entamoeba dispar
SVNEWVMRYSEMFDSAVEQNGMIR

SEQ ID NO: 2505719 - protein, 26 aa, Entamoeba dispar
SVNNFPGAMPVNFGRTSFDIIQKNAY

SEQ ID NO: 2505720 - protein, 23 aa, Entamoeba dispar
SVNRLSNLIIYNLIVYGINVEEW

SEQ ID NO: 2505721 - protein, 20 aa, Entamoeba dispar
SVPCVAIALGYDLLSVEKMM

SEQ ID NO: 2505722 - protein, 19 aa, Entamoeba dispar
SVPEVAGLAILASIDRAVL

SEQ ID NO: 2505723 - protein, 24 aa, Entamoeba dispar
SVPEVKPRFYLHPSRPLECSYRQL

SEQ ID NO: 2505724 - protein, 18 aa, Entamoeba dispar
SVPGLCWITNAFKPSLVY

SEQ ID NO: 2505725 - protein, 25 aa, Entamoeba dispar
SVPLHPEIKPVISINGELLELDIDI

SEQ ID NO: 2505726 - protein, 23 aa, Entamoeba dispar
SVPLPDFIINKFVALAVRLYVKL

SEQ ID NO: 2505727 - protein, 20 aa, Entamoeba dispar
SVPNELFLSLTPKLTSFSTP

SEQ ID NO: 2505728 - protein, 22 aa, Entamoeba dispar
SVPQTRLQFRAKISKLDFDTLL

SEQ ID NO: 2505729 - protein, 17 aa, Entamoeba dispar
SVPSSVAMLAKKYSSKT

SEQ ID NO: 2505730 - protein, 26 aa, Entamoeba dispar
SVPTLLRLLYKGYFGDFIVSQTIENT

SEQ ID NO: 2505731 - protein, 24 aa, Entamoeba dispar
SVPVSALCLWNLVPSSNSWMNSRV

SEQ ID NO: 2505732 - protein, 22 aa, Entamoeba dispar
SVPYKFFKLFLSSHNFHKRIQI

SEQ ID NO: 2505733 - protein, 22 aa, Entamoeba dispar
SVQDLIRLSLRHPEYISVDEKA

SEQ ID NO: 2505734 - protein, 28 aa, Entamoeba dispar
SVQNCVVKMNFAFLAALMKWKKEQDEIE

SEQ ID NO: 2505735 - protein, 24 aa, Entamoeba dispar
SVQTMFRFVFNNTLIESNFIEHFA

SEQ ID NO: 2505736 - protein, 17 aa, Entamoeba dispar
SVRKAYEKRGIKELFEW

SEQ ID NO: 2505737 - protein, 20 aa, Entamoeba dispar
SVRKVCDLLMRYDKENKVDL

SEQ ID NO: 2505738 - protein, 25 aa, Entamoeba dispar
SVRPECFISLILFEVLLDNEAVLIK

SEQ ID NO: 2505739 - protein, 18 aa, Entamoeba dispar
SVRQCIKTDDGVVVILNE

SEQ ID NO: 2505740 - protein, 25 aa, Entamoeba dispar
SVSEFGWDCFRECYSLTSIDIGNVQ

SEQ ID NO: 2505741 - protein, 22 aa, Entamoeba dispar
SVSEVGYWCFYGCTSLKSINIP

SEQ ID NO: 2505742 - protein, 17 aa, Entamoeba dispar
SVSKEGLAVPSFQNLSG

SEQ ID NO: 2505743 - protein, 20 aa, Entamoeba dispar
SVSKIGGWCFELCSSLKSVN

SEQ ID NO: 2505744 - protein, 24 aa, Entamoeba dispar
SVSKIGYGCFNWCTSLTSINIPSS

SEQ ID NO: 2505745 - protein, 23 aa, Entamoeba dispar
SVSNALRIYSYCVASDSSDFDMN

SEQ ID NO: 2505746 - protein, 18 aa, Entamoeba dispar
SVSNALRIYSYGVASDSS

SEQ ID NO: 2505747 - protein, 24 aa, Entamoeba dispar
SVSNFPFKFCSTSGGRSNLCSSKS

SEQ ID NO: 2505748 - protein, 24 aa, Entamoeba dispar
SVSPSGRYITVWQLIPLQYTQGVN

SEQ ID NO: 2505749 - protein, 17 aa, Entamoeba dispar
SVSSILGVPCIGKNIRL

SEQ ID NO: 2505750 - protein, 17 aa, Entamoeba dispar
SVSTFVASFSFDKAYIE

SEQ ID NO: 2505751 - protein, 26 aa, Entamoeba dispar
SVTHPEILTTLALDFKIARSCPNGIE

SEQ ID NO: 2505752 - protein, 24 aa, Entamoeba dispar
SVTKIGRECFSWCGSLQSITIPSS

SEQ ID NO: 2505753 - protein, 24 aa, Entamoeba dispar
SVTLCGIPFKYSIDKVNEFNIAMG

SEQ ID NO: 2505754 - protein, 24 aa, Entamoeba dispar
SVTLELKNGFKYTGTLDRCDRMMN

SEQ ID NO: 2505755 - protein, 21 aa, Entamoeba dispar
SVTLGPKGRTVIIDQPYGNPR

SEQ ID NO: 2505756 - protein, 17 aa, Entamoeba dispar
SVTRPTRDISLNDNCHH

SEQ ID NO: 2505757 - protein, 18 aa, Entamoeba dispar
SVVDCIQGSIVNRILTNI

SEQ ID NO: 2505758 - protein, 22 aa, Entamoeba dispar
SVVDDILAWAIKKGEMDLNKSG

SEQ ID NO: 2505759 - protein, 23 aa, Entamoeba dispar
SVVDLRLGNKLDYDDSTYELQKV

SEQ ID NO: 2505760 - protein, 21 aa, Entamoeba dispar
SVVEVYLKLGKEIGNIEEKRF

SEQ ID NO: 2505761 - protein, 24 aa, Entamoeba dispar
SVVKCTKCGVVLHSKKCEEKYSKK

SEQ ID NO: 2505762 - protein, 30 aa, Entamoeba dispar
SVVLVKRGLMEMIYKLLLKDDIKLDLHADL

SEQ ID NO: 2505763 - protein, 22 aa, Entamoeba dispar
SVVPHREIIKFFSNILPIIEAY

SEQ ID NO: 2505764 - protein, 21 aa, Entamoeba dispar
SVVTLPCESLVGYKRMNKSKI

SEQ ID NO: 2505765 - protein, 28 aa, Entamoeba dispar
SVYHCKIVLRFVFNLIQIAFTSQHKLLT

SEQ ID NO: 2505766 - protein, 18 aa, Entamoeba dispar
SVYHNVFPQFIPQDNDFV

SEQ ID NO: 2505767 - protein, 18 aa, Entamoeba dispar
SVYLRYGSIQTIRQLAVE

SEQ ID NO: 2505768 - protein, 18 aa, Entamoeba dispar
SWCGLVCHQCCVRKAPRQ

SEQ ID NO: 2505769 - protein, 25 aa, Entamoeba dispar
SWCSPCTTIRCSSCQVGTYLSNGLC

SEQ ID NO: 2505770 - protein, 17 aa, Entamoeba dispar
SWDKIAIMIPGRNRKQC

SEQ ID NO: 2505771 - protein, 24 aa, Entamoeba dispar
SWDVTLKHLVDWKVFDKIKSTNKC

SEQ ID NO: 2505772 - protein, 18 aa, Entamoeba dispar
SWERIVLMGHSLGGGVSI

SEQ ID NO: 2505773 - protein, 34 aa, Entamoeba dispar
SWISGTEWLLRVLSGMLFVPLIQRVFENKEIKKL

SEQ ID NO: 2505774 - protein, 25 aa, Entamoeba dispar
SWLDIESRMSWIICGITGNGEEIPS

SEQ ID NO: 2505775 - protein, 19 aa, Entamoeba dispar
SWLPKEEWSLFNKSIVAFG

SEQ ID NO: 2505776 - protein, 28 aa, Entamoeba dispar
SWMPCICNSFQLVCYEMTFIVPDPYVVI

SEQ ID NO: 2505777 - protein, 24 aa, Entamoeba dispar
SWNQCFRITESIGEEIVFHIFDRD

SEQ ID NO: 2505778 - protein, 35 aa, Entamoeba dispar
SWSCVKGLKNVLCIKVTQIGSVFGYFHSKEHPAVT

SEQ ID NO: 2505779 - protein, 25 aa, Entamoeba dispar
SWSEAMKKLKFMVELYSKEKEENTK

SEQ ID NO: 2505780 - protein, 20 aa, Entamoeba dispar
SWVPRFGMGSAKQIKKKTEG

SEQ ID NO: 2505781 - protein, 18 aa, Entamoeba dispar
SWVQCVGYNGKIFYVNCK

SEQ ID NO: 2505782 - protein, 29 aa, Entamoeba dispar
SYAKFTCFFEMSQLYPLFIQNLPNSYMHN

SEQ ID NO: 2505783 - protein, 17 aa, Entamoeba dispar
SYARAIRRIKMTKNDIF

SEQ ID NO: 2505784 - protein, 21 aa, Entamoeba dispar
SYCELYKCSSAMKVSPFGQQN

SEQ ID NO: 2505785 - protein, 17 aa, Entamoeba dispar
SYCKICSVFNNISPFLI

SEQ ID NO: 2505786 - protein, 20 aa, Entamoeba dispar
SYCYHHYNPIKGRAGDKSVY

SEQ ID NO: 2505787 - protein, 27 aa, Entamoeba dispar
SYDSFLRMRARGVFLPNVKWNEDDELK

SEQ ID NO: 2505788 - protein, 28 aa, Entamoeba dispar
SYEEALVKFLDSWLCVFSSDLFIGKSFK

SEQ ID NO: 2505789 - protein, 34 aa, Entamoeba dispar
SYEGMYSTIFPSRWKVGEALVLEFVSSTKVAFSM

SEQ ID NO: 2505790 - protein, 18 aa, Entamoeba dispar
SYEIAICQSIGRRGKMED

SEQ ID NO: 2505791 - protein, 17 aa, Entamoeba dispar
SYEIFASIESFKLEPTA

SEQ ID NO: 2505792 - protein, 34 aa, Entamoeba dispar
SYEKKDCKCLFKCEGEWPFSLETIAIVQDPISFP

SEQ ID NO: 2505793 - protein, 24 aa, Entamoeba dispar
SYELARFRAFDGFITVIELMKQHK

SEQ ID NO: 2505794 - protein, 26 aa, Entamoeba dispar
SYESWRIMRKGSIIILKEQQIFGRVC

SEQ ID NO: 2505795 - protein, 18 aa, Entamoeba dispar
SYETKWLLLQRHSPDASQ

SEQ ID NO: 2505796 - protein, 18 aa, Entamoeba dispar
SYEVLGFCTYNIDTSIMT

SEQ ID NO: 2505797 - protein, 21 aa, Entamoeba dispar
SYFEDLETFILEEDIDTGDKE

SEQ ID NO: 2505798 - protein, 26 aa, Entamoeba dispar
SYFEEWDCLWKIKLTNEVSSSQVSTL

SEQ ID NO: 2505799 - protein, 22 aa, Entamoeba dispar
SYFNREACDLSYDIRRELERNI

SEQ ID NO: 2505800 - protein, 27 aa, Entamoeba dispar
SYFRNRHVMCFCFDITKKASFSSISGW

SEQ ID NO: 2505801 - protein, 31 aa, Entamoeba dispar
SYFTKDCSFDAWKILRRGTIVLYKMPAGEYQ

SEQ ID NO: 2505802 - protein, 17 aa, Entamoeba dispar
SYFYGRGALEPFLQRNN

SEQ ID NO: 2505803 - protein, 27 aa, Entamoeba dispar
SYFYIMRNCNMLRFLDSNNTALFASTM

SEQ ID NO: 2505804 - protein, 17 aa, Entamoeba dispar
SYGEIEGGIPFLALSDL

SEQ ID NO: 2505805 - protein, 19 aa, Entamoeba dispar
SYGIKSIRSIFGPKTDLDF

SEQ ID NO: 2505806 - protein, 24 aa, Entamoeba dispar
SYGKEIYSAFNVFIRYLSYYTTYM

SEQ ID NO: 2505807 - protein, 26 aa, Entamoeba dispar
SYGKPAIPYLKFFLKEMSQIFEEEEE

SEQ ID NO: 2505808 - protein, 20 aa, Entamoeba dispar
SYGRAGAKIDYTGYGCNNLI

SEQ ID NO: 2505809 - protein, 21 aa, Entamoeba dispar
SYGRTDLWGSSFSQLKASIKN

SEQ ID NO: 2505810 - protein, 17 aa, Entamoeba dispar
SYGTVIRGSEKIFSYLY

SEQ ID NO: 2505811 - protein, 30 aa, Entamoeba dispar
SYHGKDFSRIFCIQRLVKVSIIDKEGLEGT

SEQ ID NO: 2505812 - protein, 25 aa, Entamoeba dispar
SYICWDPMGLFLGAVRSYVYSPHAK

SEQ ID NO: 2505813 - protein, 22 aa, Entamoeba dispar
SYIEEWRKVFNMDNKTWEELVE

SEQ ID NO: 2505814 - protein, 20 aa, Entamoeba dispar
SYIHSFIQWLAIKYESETLK

SEQ ID NO: 2505815 - protein, 17 aa, Entamoeba dispar
SYIIPSFNKYYNDTTQV

SEQ ID NO: 2505816 - protein, 18 aa, Entamoeba dispar
SYIKAVDLPPELAPLPPL

SEQ ID NO: 2505817 - protein, 20 aa, Entamoeba dispar
SYIKVFYIPYGILDNSDPIN

SEQ ID NO: 2505818 - protein, 18 aa, Entamoeba dispar
SYILPRFGDVGIPITASM

SEQ ID NO: 2505819 - protein, 18 aa, Entamoeba dispar
SYIMKIMGYITVRFKQLR

SEQ ID NO: 2505820 - protein, 24 aa, Entamoeba dispar
SYIPKEFIREYLLSTMINGQIASY

SEQ ID NO: 2505821 - protein, 23 aa, Entamoeba dispar
SYIPQQRIIYVPMQQVIDPYTGQ

SEQ ID NO: 2505822 - protein, 43 aa, Entamoeba dispar
SYIQWSRENFTQFIPSFIHLLRGCGYLGSLAIICADELVSFYQ

SEQ ID NO: 2505823 - protein, 17 aa, Entamoeba dispar
SYISDPQAFLFTIQINN

SEQ ID NO: 2505824 - protein, 18 aa, Entamoeba dispar
SYIYNGFLSFAMIATAAE

SEQ ID NO: 2505825 - protein, 17 aa, Entamoeba dispar
SYKDCDLLEEIDVSQMK

SEQ ID NO: 2505826 - protein, 31 aa, Entamoeba dispar
SYKEFKDPYSILSSPLIKFPYIIDSTKNLLF

SEQ ID NO: 2505827 - protein, 19 aa, Entamoeba dispar
SYKFPSRLDLSDEVKDLIH

SEQ ID NO: 2505828 - protein, 18 aa, Entamoeba dispar
SYKIPKKYAEELLKECKE

SEQ ID NO: 2505829 - protein, 23 aa, Entamoeba dispar
SYKKELLLFILTYVFYPNIIIPQ

SEQ ID NO: 2505830 - protein, 25 aa, Entamoeba dispar
SYKKNEEMHRLWASSQVQIDEPDGD

SEQ ID NO: 2505831 - protein, 22 aa, Entamoeba dispar
SYKLRHLLFIINQIDRPDEIDC

SEQ ID NO: 2505832 - protein, 22 aa, Entamoeba dispar
SYKRYTEVITFVLMSIADAATN

SEQ ID NO: 2505833 - protein, 19 aa, Entamoeba dispar
SYLDECIKHYLNIRKNLLM

SEQ ID NO: 2505834 - protein, 19 aa, Entamoeba dispar
SYLDSSVISTRWFGKLSLF

SEQ ID NO: 2505835 - protein, 20 aa, Entamoeba dispar
SYLEIIKIYSSFNISTVPVI

SEQ ID NO: 2505836 - protein, 19 aa, Entamoeba dispar
SYLFDDFKDILSLPKTHQE

SEQ ID NO: 2505837 - protein, 20 aa, Entamoeba dispar
SYLFPNCVPRLEVYRKSMFE

SEQ ID NO: 2505838 - protein, 19 aa, Entamoeba dispar
SYLHLGVFLSVMNYLIHTN

SEQ ID NO: 2505839 - protein, 19 aa, Entamoeba dispar
SYLIERVLLMLSRLSGKGP

SEQ ID NO: 2505840 - protein, 18 aa, Entamoeba dispar
SYLILPIQRLPRYQMLLI

SEQ ID NO: 2505841 - protein, 19 aa, Entamoeba dispar
SYLNCIMIDPEILFITPSP

SEQ ID NO: 2505842 - protein, 17 aa, Entamoeba dispar
SYLNYRTLERLRIINKR

SEQ ID NO: 2505843 - protein, 19 aa, Entamoeba dispar
SYLPAYKIEVVYIADRKTA

SEQ ID NO: 2505844 - protein, 18 aa, Entamoeba dispar
SYLRIDIGFFNRPTQIEI

SEQ ID NO: 2505845 - protein, 29 aa, Entamoeba dispar
SYLSKLKINKCVLKTYLLLIKLLPHSQEQ

SEQ ID NO: 2505846 - protein, 25 aa, Entamoeba dispar
SYLTCLKMVLVLGGDNTLGEDRIGM

SEQ ID NO: 2505847 - protein, 17 aa, Entamoeba dispar
SYMRIKRFIIVKDSVTD

SEQ ID NO: 2505848 - protein, 18 aa, Entamoeba dispar
SYNCVSHPFWLPKFANAF

SEQ ID NO: 2505849 - protein, 22 aa, Entamoeba dispar
SYNELFFNVLISYACATSSQYI

SEQ ID NO: 2505850 - protein, 25 aa, Entamoeba dispar
SYNFCKVGGLKIMFDILNARTTLFN

SEQ ID NO: 2505851 - protein, 19 aa, Entamoeba dispar
SYNRICEMIHNYWEEETDP

SEQ ID NO: 2505852 - protein, 26 aa, Entamoeba dispar
SYNSCPKVIVLYCYNSAPLLNKEMHH

SEQ ID NO: 2505853 - protein, 25 aa, Entamoeba dispar
SYNYKCDIWSLGAMYYYLRTGMFPL

SEQ ID NO: 2505854 - protein, 24 aa, Entamoeba dispar
SYPDYNPLLFLCLSKPLYKQPQLS

SEQ ID NO: 2505855 - protein, 25 aa, Entamoeba dispar
SYPSRHAVIHFINFIKIHKQKIFDK

SEQ ID NO: 2505856 - protein, 19 aa, Entamoeba dispar
SYQINCPIFFGESPNKERI

SEQ ID NO: 2505857 - protein, 20 aa, Entamoeba dispar
SYQYPPQYYPLSVQIQPPNN

SEQ ID NO: 2505858 - protein, 20 aa, Entamoeba dispar
SYRALYICHLGGFVADSTIL

SEQ ID NO: 2505859 - protein, 20 aa, Entamoeba dispar
SYRGEIPCNFIKLHSTVSMT

SEQ ID NO: 2505860 - protein, 20 aa, Entamoeba dispar
SYSIYSFISLNVWEVVSSLS

SEQ ID NO: 2505861 - protein, 25 aa, Entamoeba dispar
SYSKRISKETICFVYNGEIVDPLLS

SEQ ID NO: 2505862 - protein, 24 aa, Entamoeba dispar
SYSNRLKMFLQFISKEGEFNESEL

SEQ ID NO: 2505863 - protein, 18 aa, Entamoeba dispar
SYSSGLFGGQSISSAKLR

SEQ ID NO: 2505864 - protein, 26 aa, Entamoeba dispar
SYSTVCLLLALWNVVDCPFRAMDEFD

SEQ ID NO: 2505865 - protein, 25 aa, Entamoeba dispar
SYTEVKPIICAPVIQDKASAKEDIE

SEQ ID NO: 2505866 - protein, 18 aa, Entamoeba dispar
SYTFGKNVVESFLKKNNF

SEQ ID NO: 2505867 - protein, 19 aa, Entamoeba dispar
SYTLKDWKDSITVHPITTG

SEQ ID NO: 2505868 - protein, 35 aa, Entamoeba dispar
SYVAAIIARACCPRYHLTIGKEYYERVEFTNKTDS

SEQ ID NO: 2505869 - protein, 18 aa, Entamoeba dispar
SYVFCPVDTCGRAIHYFD

SEQ ID NO: 2505870 - protein, 18 aa, Entamoeba dispar
SYVGTPVFMAPEVFNGVQ

SEQ ID NO: 2505871 - protein, 19 aa, Entamoeba dispar
SYVPVPGIDTVFITLLNQG

SEQ ID NO: 2505872 - protein, 25 aa, Entamoeba dispar
SYVRCLEISYTFFISFFLIPDNEIY

SEQ ID NO: 2505873 - protein, 21 aa, Entamoeba dispar
SYYRGVMGIVLVYDITSRESF

SEQ ID NO: 2505874 - protein, 21 aa, Entamoeba dispar
SYYRRSFPRMKQFKREDELKI

SEQ ID NO: 2505875 - protein, 25 aa, Entamoeba dispar
TAAALLWVFYIRQSFIKQHGFDKTK

SEQ ID NO: 2505876 - protein, 23 aa, Entamoeba dispar
TAACPPYHLAVVIGGTSAEKNLE

SEQ ID NO: 2505877 - protein, 18 aa, Entamoeba dispar
TAALLRFHINTLVKPNIS

SEQ ID NO: 2505878 - protein, 17 aa, Entamoeba dispar
TAAVVLIIGRFLICANV

SEQ ID NO: 2505879 - protein, 29 aa, Entamoeba dispar
TAAVWQVKWSHPRFGPVLASCGYDKQVLI

SEQ ID NO: 2505880 - protein, 20 aa, Entamoeba dispar
TACKLWGYYNEHIDKNEPQT

SEQ ID NO: 2505881 - protein, 23 aa, Entamoeba dispar
TADCKRCIQDLLVKDPEKRLTNP

SEQ ID NO: 2505882 - protein, 17 aa, Entamoeba dispar
TADEVCVAMGIHAIGGM

SEQ ID NO: 2505883 - protein, 21 aa, Entamoeba dispar
TADILLPSFIYIVIRANTTHL

SEQ ID NO: 2505884 - protein, 17 aa, Entamoeba dispar
TADPLSVQFVYEKFNYK

SEQ ID NO: 2505885 - protein, 28 aa, Entamoeba dispar
TAEANIKWTNRWGRFIGYSDTASITLSS

SEQ ID NO: 2505886 - protein, 18 aa, Entamoeba dispar
TAEKRVIIVQQDVKDKEE

SEQ ID NO: 2505887 - protein, 17 aa, Entamoeba dispar
TAELFKYDINNFNIIFA

SEQ ID NO: 2505888 - protein, 24 aa, Entamoeba dispar
TAERVGLIEACIVRLMKKNRKMQH

SEQ ID NO: 2505889 - protein, 23 aa, Entamoeba dispar
TAFKDYKGCTVYKKIKALPNEGL

SEQ ID NO: 2505890 - protein, 25 aa, Entamoeba dispar
TAFLKGVMIESCIQSKFGVIGASIH

SEQ ID NO: 2505891 - protein, 19 aa, Entamoeba dispar
TAFSKQIEEMFGREMTITV

SEQ ID NO: 2505892 - protein, 24 aa, Entamoeba dispar
TAFVLFRLIQEMAEFIGKNKKEIG

SEQ ID NO: 2505893 - protein, 17 aa, Entamoeba dispar
TAFYGISGVVISNSHLL

SEQ ID NO: 2505894 - protein, 24 aa, Entamoeba dispar
TAGAALKWIRDIGILKDYNEISKI

SEQ ID NO: 2505895 - protein, 17 aa, Entamoeba dispar
TAGNLFGIFAPSISESC

SEQ ID NO: 2505896 - protein, 25 aa, Entamoeba dispar
TAHPTYPLLLVGCIDGRILIINHSL

SEQ ID NO: 2505897 - protein, 18 aa, Entamoeba dispar
TAHSELIREVSFSPNDLR

SEQ ID NO: 2505898 - protein, 23 aa, Entamoeba dispar
TAIAVCLCKEGKGMIRVNGVPLD

SEQ ID NO: 2505899 - protein, 18 aa, Entamoeba dispar
TAIELPHSLSYLGKTAFI

SEQ ID NO: 2505900 - protein, 23 aa, Entamoeba dispar
TAIKRFPLYHFFVKNTRLYPLEC

SEQ ID NO: 2505901 - protein, 18 aa, Entamoeba dispar
TAIKRYPVVARWRNDVDF

SEQ ID NO: 2505902 - protein, 20 aa, Entamoeba dispar
TAITRFNLFVVIGLADGKAK

SEQ ID NO: 2505903 - protein, 19 aa, Entamoeba dispar
TAIVPSQCMSEFNSFEHQL

SEQ ID NO: 2505904 - protein, 20 aa, Entamoeba dispar
TAIVYRFIINDIKHTSQQKG

SEQ ID NO: 2505905 - protein, 24 aa, Entamoeba dispar
TAKEKRANRILKMMEGAKEVNALD

SEQ ID NO: 2505906 - protein, 17 aa, Entamoeba dispar
TAKFLQSYCDAIDINLG

SEQ ID NO: 2505907 - protein, 19 aa, Entamoeba dispar
TAKLKWKRFSIKKFGSLST

SEQ ID NO: 2505908 - protein, 18 aa, Entamoeba dispar
TAKLPRNFVASVELPKPQ

SEQ ID NO: 2505909 - protein, 26 aa, Entamoeba dispar
TAKMPLKAPKSFLISVCMNKTKSLIK

SEQ ID NO: 2505910 - protein, 20 aa, Entamoeba dispar
TALKGIIFKKRFVLTQCSVR

SEQ ID NO: 2505911 - protein, 18 aa, Entamoeba dispar
TALNDHYTPCLTPRIYRD

SEQ ID NO: 2505912 - protein, 24 aa, Entamoeba dispar
TALRVGCDLAHIFCHQDAAMAIKS

SEQ ID NO: 2505913 - protein, 18 aa, Entamoeba dispar
TALRYPPFRTNAENTRRQ

SEQ ID NO: 2505914 - protein, 22 aa, Entamoeba dispar
TAMECLDIYISTLCCVEDSETE

SEQ ID NO: 2505915 - protein, 23 aa, Entamoeba dispar
TAMLQQLCLHFGLVDTMRAEIWK

SEQ ID NO: 2505916 - protein, 24 aa, Entamoeba dispar
TAMLWRVDPLVSMGAYACAGAVSS

SEQ ID NO: 2505917 - protein, 19 aa, Entamoeba dispar
TANQKYIFGNIIDLFGNDV

SEQ ID NO: 2505918 - protein, 23 aa, Entamoeba dispar
TANVREWVCRKIYEEFISVGSEK

SEQ ID NO: 2505919 - protein, 20 aa, Entamoeba dispar
TAQISSLCRLILSKEYRTTK

SEQ ID NO: 2505920 - protein, 18 aa, Entamoeba dispar
TAQKAEVVPVDLLDPEKV

SEQ ID NO: 2505921 - protein, 28 aa, Entamoeba dispar
TAQTRVARYWPMFPRTFGLFKKLFEEES

SEQ ID NO: 2505922 - protein, 21 aa, Entamoeba dispar
TAREEMEWALSNFCFGATNQM

SEQ ID NO: 2505923 - protein, 20 aa, Entamoeba dispar
TAREYFMIAAHITRTDAELW

SEQ ID NO: 2505924 - protein, 19 aa, Entamoeba dispar
TARRFLKPNGIILPNQCRL

SEQ ID NO: 2505925 - protein, 27 aa, Entamoeba dispar
TASITLSSSWAFIIMWKGSDNEAYIQL

SEQ ID NO: 2505926 - protein, 30 aa, Entamoeba dispar
TASITLSSSWPFLIMWKGSDNEAYIQLQRS

SEQ ID NO: 2505927 - protein, 30 aa, Entamoeba dispar
TASITLSSSWPFLIMWKGSDSEAYIQLQRS

SEQ ID NO: 2505928 - protein, 22 aa, Entamoeba dispar
TASLVLGFIWMLFDKFQEKNIK

SEQ ID NO: 2505929 - protein, 22 aa, Entamoeba dispar
TASSIQPEWLFEASPKYFAQLD

SEQ ID NO: 2505930 - protein, 22 aa, Entamoeba dispar
TATCLLRKVACEGVQAINTGLS

SEQ ID NO: 2505931 - protein, 24 aa, Entamoeba dispar
TATIPVSDSWIGKVVLDNATGLGV

SEQ ID NO: 2505932 - protein, 23 aa, Entamoeba dispar
TATPTSKCLRLFGTHKDGLIRPF

SEQ ID NO: 2505933 - protein, 25 aa, Entamoeba dispar
TATYFRNRHCILFMFDVTNRESFTH

SEQ ID NO: 2505934 - protein, 23 aa, Entamoeba dispar
TAVSLRLPILTVVSHEDNYSDHF

SEQ ID NO: 2505935 - protein, 23 aa, Entamoeba dispar
TAVSRTYATLSFICVFDDNENEL

SEQ ID NO: 2505936 - protein, 17 aa, Entamoeba dispar
TAYNLEFFIYLSFNNKV

SEQ ID NO: 2505937 - protein, 21 aa, Entamoeba dispar
TCAICLSNINECCVTKCGHAF

SEQ ID NO: 2505938 - protein, 19 aa, Entamoeba dispar
TCCFYKCSSLTSINIPSSI

SEQ ID NO: 2505939 - protein, 20 aa, Entamoeba dispar
TCDDKGYLANVFRVHPNGYL

SEQ ID NO: 2505940 - protein, 28 aa, Entamoeba dispar
TCEPCIMCAEALKQCGITKIIYGCSNAR

SEQ ID NO: 2505941 - protein, 19 aa, Entamoeba dispar
TCFCYDIISVNSLVNINVM

SEQ ID NO: 2505942 - protein, 22 aa, Entamoeba dispar
TCGGLCPGLNNVIRGLVLNLYN

SEQ ID NO: 2505943 - protein, 19 aa, Entamoeba dispar
TCGKKLYEDVMKRFDYLLQ

SEQ ID NO: 2505944 - protein, 18 aa, Entamoeba dispar
TCGMYFNLVKCMENEFKY

SEQ ID NO: 2505945 - protein, 19 aa, Entamoeba dispar
TCGYTAPTLMGIISDKEIQ

SEQ ID NO: 2505946 - protein, 19 aa, Entamoeba dispar
TCHKRVYFNERLTFAGKDY

SEQ ID NO: 2505947 - protein, 21 aa, Entamoeba dispar
TCHYCKKRKPVSFQCLKSPPH

SEQ ID NO: 2505948 - protein, 17 aa, Entamoeba dispar
TCIDYCKKYSMIKRSRV

SEQ ID NO: 2505949 - protein, 18 aa, Entamoeba dispar
TCIGTRGGEYGIFNEGNT

SEQ ID NO: 2505950 - protein, 18 aa, Entamoeba dispar
TCKACQEAHTRGELSRVM

SEQ ID NO: 2505951 - protein, 18 aa, Entamoeba dispar
TCKEFKQFFKIIEIAQNI

SEQ ID NO: 2505952 - protein, 17 aa, Entamoeba dispar
TCKFVFFLFKPFYFRIF

SEQ ID NO: 2505953 - protein, 25 aa, Entamoeba dispar
TCKMPRIREEVAKLFDIQTFSDKKF

SEQ ID NO: 2505954 - protein, 19 aa, Entamoeba dispar
TCLCRTCRYNTTIQNLGWD

SEQ ID NO: 2505955 - protein, 19 aa, Entamoeba dispar
TCLFILFDCIVQYTELFDA

SEQ ID NO: 2505956 - protein, 17 aa, Entamoeba dispar
TCLHVGDPDTPGYIKAL

SEQ ID NO: 2505957 - protein, 18 aa, Entamoeba dispar
TCLKEYPLLLRIVENDII

SEQ ID NO: 2505958 - protein, 17 aa, Entamoeba dispar
TCLLLTYTTNSFPDSYV

SEQ ID NO: 2505959 - protein, 23 aa, Entamoeba dispar
TCNEAMGALYLFPKIKFSNKYID

SEQ ID NO: 2505960 - protein, 25 aa, Entamoeba dispar
TCNSCNEKEIWICLHCLHIGCSRYC

SEQ ID NO: 2505961 - protein, 19 aa, Entamoeba dispar
TCNSGEYNGKIGIKSQIQS

SEQ ID NO: 2505962 - protein, 20 aa, Entamoeba dispar
TCNTFNLILLKANIIASLLT

SEQ ID NO: 2505963 - protein, 35 aa, Entamoeba dispar
TCQTLVFNLTWSWVVSLRGLRKSTLDVIPIPNANS

SEQ ID NO: 2505964 - protein, 18 aa, Entamoeba dispar
TCSLNFPVLPTPLTKNHF

SEQ ID NO: 2505965 - protein, 17 aa, Entamoeba dispar
TCSRNPLLASLQLQIDN

SEQ ID NO: 2505966 - protein, 33 aa, Entamoeba dispar
TCVPEGQCVFVGGAIESLGKWDVSKAIKMTPTH

SEQ ID NO: 2505967 - protein, 18 aa, Entamoeba dispar
TCVVKFADCVVARIVAET

SEQ ID NO: 2505968 - protein, 24 aa, Entamoeba dispar
TCWPAEAQNGLTLSMSYEATQELK

SEQ ID NO: 2505969 - protein, 21 aa, Entamoeba dispar
TCYMNCILQSLAHSKLFQNFC

SEQ ID NO: 2505970 - protein, 17 aa, Entamoeba dispar
TDALHTIVILRDSYGKR

SEQ ID NO: 2505971 - protein, 17 aa, Entamoeba dispar
TDATSFNNVMMWYTALK

SEQ ID NO: 2505972 - protein, 20 aa, Entamoeba dispar
TDAVIKLHCTLFEKSTTGFY

SEQ ID NO: 2505973 - protein, 32 aa, Entamoeba dispar
TDCKEGYGLKFWLRILHCCGNPTSISDNKVFA

SEQ ID NO: 2505974 - protein, 31 aa, Entamoeba dispar
TDDALGEVCQMLNWTSFSFDEYMEGLMAPIP

SEQ ID NO: 2505975 - protein, 18 aa, Entamoeba dispar
TDDFIWKLVRLLVNNGLS

SEQ ID NO: 2505976 - protein, 17 aa, Entamoeba dispar
TDDIKLFEQKEMFYVDG

SEQ ID NO: 2505977 - protein, 23 aa, Entamoeba dispar
TDDKLCKVLIQFLSPIKIVNVSF

SEQ ID NO: 2505978 - protein, 21 aa, Entamoeba dispar
TDDMICFIVKMAQQQPSEEAK

SEQ ID NO: 2505979 - protein, 19 aa, Entamoeba dispar
TDEAIICGAHVSFKKKQCF

SEQ ID NO: 2505980 - protein, 21 aa, Entamoeba dispar
TDEEIKNLLLFKENSNGSTPS

SEQ ID NO: 2505981 - protein, 19 aa, Entamoeba dispar
TDEICPICYDNKVNVSLPC

SEQ ID NO: 2505982 - protein, 23 aa, Entamoeba dispar
TDEIIKFLVGFIPDLAGYFNGDE

SEQ ID NO: 2505983 - protein, 32 aa, Entamoeba dispar
TDEIRVKCVLRCGDQTLSCPIEKVSFKPIIVT

SEQ ID NO: 2505984 - protein, 20 aa, Entamoeba dispar
TDEITSFLPLIPQLDKDTTT

SEQ ID NO: 2505985 - protein, 22 aa, Entamoeba dispar
TDEIYKKVLIFLNDIPKDEKYK

SEQ ID NO: 2505986 - protein, 25 aa, Entamoeba dispar
TDELHLKAGAFVMINKNIDVERGLV

SEQ ID NO: 2505987 - protein, 26 aa, Entamoeba dispar
TDELVDEFMLCISVYGFGNMEPILKS

SEQ ID NO: 2505988 - protein, 17 aa, Entamoeba dispar
TDETKWKKLILDQKTKQ

SEQ ID NO: 2505989 - protein, 19 aa, Entamoeba dispar
TDEVVKKLCSKEMSSDKKR

SEQ ID NO: 2505990 - protein, 20 aa, Entamoeba dispar
TDEWKKCWLTSQIHVGMIIS

SEQ ID NO: 2505991 - protein, 18 aa, Entamoeba dispar
TDFFQFFMMTLFKQINAQ

SEQ ID NO: 2505992 - protein, 17 aa, Entamoeba dispar
TDFGKPFPKEIYKYPWD

SEQ ID NO: 2505993 - protein, 17 aa, Entamoeba dispar
TDFKARIFNAFNKTIDP

SEQ ID NO: 2505994 - protein, 25 aa, Entamoeba dispar
TDFKLKGCPVSAILTQNLLAIANKE

SEQ ID NO: 2505995 - protein, 25 aa, Entamoeba dispar
TDFNKKLCQEFITWISNNQKIAAFM

SEQ ID NO: 2505996 - protein, 17 aa, Entamoeba dispar
TDFQEWYNNVVIQHSIK

SEQ ID NO: 2505997 - protein, 24 aa, Entamoeba dispar
TDFTCLHLHFVIIQFNSVTDSIIC

SEQ ID NO: 2505998 - protein, 26 aa, Entamoeba dispar
TDGILKECLLYGIGMHHAGLNDHDRE

SEQ ID NO: 2505999 - protein, 18 aa, Entamoeba dispar
TDGIRFNPDIVVCGMQEL

SEQ ID NO: 2506000 - protein, 25 aa, Entamoeba dispar
TDGLRRSMCIKLEMREKFAKDLKIG

SEQ ID NO: 2506001 - protein, 24 aa, Entamoeba dispar
TDGVRFLFRLCEDVYIVLITTLSS

SEQ ID NO: 2506002 - protein, 17 aa, Entamoeba dispar
TDIDFTIHYSRMKEGEC

SEQ ID NO: 2506003 - protein, 25 aa, Entamoeba dispar
TDIFKEGKHLFGLHDIVQKGIEINE

SEQ ID NO: 2506004 - protein, 17 aa, Entamoeba dispar
TDIFLLCFAVIYEPSFQ

SEQ ID NO: 2506005 - protein, 24 aa, Entamoeba dispar
TDIFLLCFSVVYHASYINVRDKWV

SEQ ID NO: 2506006 - protein, 21 aa, Entamoeba dispar
TDIKCVFNLLQRYRNGSSINL

SEQ ID NO: 2506007 - protein, 17 aa, Entamoeba dispar
TDIKNCPKNKGASFSAV

SEQ ID NO: 2506008 - protein, 27 aa, Entamoeba dispar
TDINKLRGCAMCSALSNRGYFLKQNQE

SEQ ID NO: 2506009 - protein, 21 aa, Entamoeba dispar
TDIPEYAHRWIFSVIKDHSNF

SEQ ID NO: 2506010 - protein, 28 aa, Entamoeba dispar
TDIYGCLFLPSFNLRSYLSLEEESKVPE

SEQ ID NO: 2506011 - protein, 24 aa, Entamoeba dispar
TDKDWKLLLNYSRSMFRVLNKLLP

SEQ ID NO: 2506012 - protein, 17 aa, Entamoeba dispar
TDKGEIFGSYNSIQIPK

SEQ ID NO: 2506013 - protein, 23 aa, Entamoeba dispar
TDKIHQGEMVFKEKASVFYEGPE

SEQ ID NO: 2506014 - protein, 26 aa, Entamoeba dispar
TDKLLTIPALFPLLNMIKKQYISPQY

SEQ ID NO: 2506015 - protein, 22 aa, Entamoeba dispar
TDKLRIIAFSLYSILSPFTKIH

SEQ ID NO: 2506016 - protein, 22 aa, Entamoeba dispar
TDKLVECYQLILDVAAWINEKK

SEQ ID NO: 2506017 - protein, 29 aa, Entamoeba dispar
TDKQLHCVHVFNMIEGRGKTFGGYGNEPG

SEQ ID NO: 2506018 - protein, 23 aa, Entamoeba dispar
TDLDYSIAWRTMSDWGNIISYNT

SEQ ID NO: 2506019 - protein, 19 aa, Entamoeba dispar
TDLECALSIDISVDCDNGI

SEQ ID NO: 2506020 - protein, 18 aa, Entamoeba dispar
TDLEKEFDYFDPIKSEKS

SEQ ID NO: 2506021 - protein, 33 aa, Entamoeba dispar
TDLEKLRLCCLPKVPYFVEMHASEFILLTKQEH

SEQ ID NO: 2506022 - protein, 23 aa, Entamoeba dispar
TDLKKKVDILAYWVSQSLYESVQ

SEQ ID NO: 2506023 - protein, 24 aa, Entamoeba dispar
TDLKNKRIGEVCYKIFERLKTNSV

SEQ ID NO: 2506024 - protein, 22 aa, Entamoeba dispar
TDLKRNILINAFQFDSGENNPN

SEQ ID NO: 2506025 - protein, 20 aa, Entamoeba dispar
TDLLEPLGCIGDRQYSFKKN

SEQ ID NO: 2506026 - protein, 26 aa, Entamoeba dispar
TDLLILLEGLLAYFGSVPPVRKNSQL

SEQ ID NO: 2506027 - protein, 24 aa, Entamoeba dispar
TDLMCFYMIKGYKSFFQKRYFQFL

SEQ ID NO: 2506028 - protein, 17 aa, Entamoeba dispar
TDLNLGLNEQVKITKFE

SEQ ID NO: 2506029 - protein, 18 aa, Entamoeba dispar
TDLPLYFNGSSLEGQMNN

SEQ ID NO: 2506030 - protein, 25 aa, Entamoeba dispar
TDLPPEIPQPMMGELPYDGEVNELY

SEQ ID NO: 2506031 - protein, 23 aa, Entamoeba dispar
TDLSFDICAACIKSSERFVQLGV

SEQ ID NO: 2506032 - protein, 31 aa, Entamoeba dispar
TDLYKIARTIPFTRALECVSLLNEIDRSKRC

SEQ ID NO: 2506033 - protein, 23 aa, Entamoeba dispar
TDMLKHLLLTALCYSFKNDTFFF

SEQ ID NO: 2506034 - protein, 21 aa, Entamoeba dispar
TDMLLFLKLVDYFQDDNDKEL

SEQ ID NO: 2506035 - protein, 25 aa, Entamoeba dispar
TDMLYKLQSLFPNKSSQQILNRIKW

SEQ ID NO: 2506036 - protein, 24 aa, Entamoeba dispar
TDNDCKRWFWELVQNAKDSIVNDP

SEQ ID NO: 2506037 - protein, 17 aa, Entamoeba dispar
TDNFIELLKKWWSDNDA

SEQ ID NO: 2506038 - protein, 22 aa, Entamoeba dispar
TDNTLYFGFRSLNVIRYISDII

SEQ ID NO: 2506039 - protein, 29 aa, Entamoeba dispar
TDPFRFFEEMFGGFGMFAGGPSFQRKKLQ

SEQ ID NO: 2506040 - protein, 24 aa, Entamoeba dispar
TDPLKSVNFFKGYLEVIKQNCDAM

SEQ ID NO: 2506041 - protein, 19 aa, Entamoeba dispar
TDPYFEIFKNMKFSRTLEQ

SEQ ID NO: 2506042 - protein, 23 aa, Entamoeba dispar
TDQKRKKIVIGFQEINQITKESQ

SEQ ID NO: 2506043 - protein, 18 aa, Entamoeba dispar
TDRFRLVEFYEFRDEIKK

SEQ ID NO: 2506044 - protein, 23 aa, Entamoeba dispar
TDRYLVLACDGVWDVMSDEKVYS

SEQ ID NO: 2506045 - protein, 34 aa, Entamoeba dispar
TDSELRLQTFREIKFLQQLRHEKIIKIKNFIVEQ

SEQ ID NO: 2506046 - protein, 17 aa, Entamoeba dispar
TDSFPFLRLKNYQTSDL

SEQ ID NO: 2506047 - protein, 19 aa, Entamoeba dispar
TDSIICFHKIHSKQFCGRY

SEQ ID NO: 2506048 - protein, 27 aa, Entamoeba dispar
TDSRGIVSWQHICRVILFSLTVKESPK

SEQ ID NO: 2506049 - protein, 22 aa, Entamoeba dispar
TDSVAWLISFGILNRIKTYILC

SEQ ID NO: 2506050 - protein, 17 aa, Entamoeba dispar
TDSVLIAGMFDNVEVDY

SEQ ID NO: 2506051 - protein, 23 aa, Entamoeba dispar
TDSWDCGAYAMKISKFPKLKKSN

SEQ ID NO: 2506052 - protein, 18 aa, Entamoeba dispar
TDSYSRFASMNQTNNRFP

SEQ ID NO: 2506053 - protein, 25 aa, Entamoeba dispar
TDTCGICGASFGLITRRHHCRRCGK

SEQ ID NO: 2506054 - protein, 19 aa, Entamoeba dispar
TDTCLYKINGWGSIGKDSY

SEQ ID NO: 2506055 - protein, 17 aa, Entamoeba dispar
TDTFDVLNQINPVVIRL

SEQ ID NO: 2506056 - protein, 23 aa, Entamoeba dispar
TDTFSCLLCLVNIIKLSTGIKYI

SEQ ID NO: 2506057 - protein, 19 aa, Entamoeba dispar
TDTRLLSVIQYFDDSQLEW

SEQ ID NO: 2506058 - protein, 20 aa, Entamoeba dispar
TDTYLPLPFMPKLQTLTIRF

SEQ ID NO: 2506059 - protein, 18 aa, Entamoeba dispar
TDVFPLMKYWFINKQKKS

SEQ ID NO: 2506060 - protein, 23 aa, Entamoeba dispar
TDVICCTCCGALDNRLNGILEHI

SEQ ID NO: 2506061 - protein, 26 aa, Entamoeba dispar
TDVIKVCVIGAMKTSNMYLRIVALDF

SEQ ID NO: 2506062 - protein, 27 aa, Entamoeba dispar
TDVKQAVAVALKFGLEKEIWDEMVKIG

SEQ ID NO: 2506063 - protein, 26 aa, Entamoeba dispar
TDVVWSIKCHEEFPIIASASEDSTIR

SEQ ID NO: 2506064 - protein, 17 aa, Entamoeba dispar
TDWKLYQISSEWNNRNN

SEQ ID NO: 2506065 - protein, 22 aa, Entamoeba dispar
TDYFEHWNYLSLAANEDDPYKR

SEQ ID NO: 2506066 - protein, 17 aa, Entamoeba dispar
TDYIPTVFDNYVANVVV

SEQ ID NO: 2506067 - protein, 25 aa, Entamoeba dispar
TDYIVRFFGHFFVDKDLWIVMEICG

SEQ ID NO: 2506068 - protein, 33 aa, Entamoeba dispar
TEADYPIIHFHCGHSYHKKCFTNSKLECTKDHG

SEQ ID NO: 2506069 - protein, 18 aa, Entamoeba dispar
TEALKYCQEMNCIHRDLK

SEQ ID NO: 2506070 - protein, 20 aa, Entamoeba dispar
TEALNILLTKSFIMRNINLM

SEQ ID NO: 2506071 - protein, 27 aa, Entamoeba dispar
TEANINWTNRWGRFIGYSDTASITLSS

SEQ ID NO: 2506072 - protein, 23 aa, Entamoeba dispar
TECENEIKIGVGVNQKNNAIMDE

SEQ ID NO: 2506073 - protein, 18 aa, Entamoeba dispar
TECLHLLMDILSEFGYFF

SEQ ID NO: 2506074 - protein, 23 aa, Entamoeba dispar
TECTFDFLKLVLQKSQRPFLDKL

SEQ ID NO: 2506075 - protein, 24 aa, Entamoeba dispar
TEDECPCCRKSLNRLASYSSPGFI

SEQ ID NO: 2506076 - protein, 23 aa, Entamoeba dispar
TEDEIRGAYGMGTSDELAARVIV

SEQ ID NO: 2506077 - protein, 21 aa, Entamoeba dispar
TEDEIRPVILVDYVNDHFSPK

SEQ ID NO: 2506078 - protein, 24 aa, Entamoeba dispar
TEDFLVMACDGIWDVLSNEDVVTI

SEQ ID NO: 2506079 - protein, 28 aa, Entamoeba dispar
TEDLFTQMFWKLGMKSFDEFIEKLIKLP

SEQ ID NO: 2506080 - protein, 22 aa, Entamoeba dispar
TEDVSLPLGYVISIINNSNACI

SEQ ID NO: 2506081 - protein, 25 aa, Entamoeba dispar
TEEAMKIIERLGGIKALTKKTNTDP

SEQ ID NO: 2506082 - protein, 24 aa, Entamoeba dispar
TEEEIKKLLTWGCYLTPINKKRDT

SEQ ID NO: 2506083 - protein, 23 aa, Entamoeba dispar
TEEEMKASLLFCKQKIEKLGNEV

SEQ ID NO: 2506084 - protein, 24 aa, Entamoeba dispar
TEEFIKLIYYFGLDPSTLKRNSVI

SEQ ID NO: 2506085 - protein, 20 aa, Entamoeba dispar
TEEKGTEGIYSFSTDMDETD

SEQ ID NO: 2506086 - protein, 19 aa, Entamoeba dispar
TEEKMGVSMCITENEKYIK

SEQ ID NO: 2506087 - protein, 25 aa, Entamoeba dispar
TEELLPSICLHQIIIPLPAQGITMP

SEQ ID NO: 2506088 - protein, 25 aa, Entamoeba dispar
TEEMARFYIAELFLAIDSIHKLSYI

SEQ ID NO: 2506089 - protein, 19 aa, Entamoeba dispar
TEEPTRIIAKNAGIDGGIV

SEQ ID NO: 2506090 - protein, 19 aa, Entamoeba dispar
TEETYQFYQALKIFGTDFE

SEQ ID NO: 2506091 - protein, 28 aa, Entamoeba dispar
TEEVNLGFGVCKCIEFLKTHGGVDDGIK

SEQ ID NO: 2506092 - protein, 19 aa, Entamoeba dispar
TEFCLYQFTVPLNYGKEDE

SEQ ID NO: 2506093 - protein, 17 aa, Entamoeba dispar
TEFDYEWMIPLKSIHSF

SEQ ID NO: 2506094 - protein, 26 aa, Entamoeba dispar
TEFGCIPATSIPAVVRELRWDSKALS

SEQ ID NO: 2506095 - protein, 19 aa, Entamoeba dispar
TEFITQIGLLSLKDIIPFF

SEQ ID NO: 2506096 - protein, 17 aa, Entamoeba dispar
TEFPHLHRAPILSKDVL

SEQ ID NO: 2506097 - protein, 22 aa, Entamoeba dispar
TEFQHPSFIPYQPIKREPIDPD

SEQ ID NO: 2506098 - protein, 18 aa, Entamoeba dispar
TEGEFKWLGVKFDTFDLN

SEQ ID NO: 2506099 - protein, 25 aa, Entamoeba dispar
TEGGQTALHWAVYMQRVDLLSILLL

SEQ ID NO: 2506100 - protein, 17 aa, Entamoeba dispar
TEGHYWVGNYNYEAPKH

SEQ ID NO: 2506101 - protein, 20 aa, Entamoeba dispar
TEGILKPEIKEMIQNAHVIR

SEQ ID NO: 2506102 - protein, 20 aa, Entamoeba dispar
TEGKLSAWYHYESRPEFVEE

SEQ ID NO: 2506103 - protein, 21 aa, Entamoeba dispar
TEGKTTFLHVFKYKNEKLVEC

SEQ ID NO: 2506104 - protein, 23 aa, Entamoeba dispar
TEGLFRIPGNMLVVNNLKKEYNE

SEQ ID NO: 2506105 - protein, 21 aa, Entamoeba dispar
TEGTGILYVVMTFDLKDHTIH

SEQ ID NO: 2506106 - protein, 26 aa, Entamoeba dispar
TEGVNFRAVLQFGNLVDVDSVETNDV

SEQ ID NO: 2506107 - protein, 30 aa, Entamoeba dispar
TEHILRRIKMLYPHLWYEGICCVHTVCNNE

SEQ ID NO: 2506108 - protein, 27 aa, Entamoeba dispar
TEHLVFRQTRCAACGQEFKDTEADYPI

SEQ ID NO: 2506109 - protein, 23 aa, Entamoeba dispar
TEHQIKRLVLIYLESIDKMDKGE

SEQ ID NO: 2506110 - protein, 20 aa, Entamoeba dispar
TEICELKLEIITLLVQETNC

SEQ ID NO: 2506111 - protein, 31 aa, Entamoeba dispar
TEIFLRCTSPLSELRTIIEFFNQVGSPEEQI

SEQ ID NO: 2506112 - protein, 17 aa, Entamoeba dispar
TEIFNGLQVQRLYSVED

SEQ ID NO: 2506113 - protein, 22 aa, Entamoeba dispar
TEIGYKCFYNCLSLKTINIPTA

SEQ ID NO: 2506114 - protein, 20 aa, Entamoeba dispar
TEIITLWYRPPEILLGATHY

SEQ ID NO: 2506115 - protein, 22 aa, Entamoeba dispar
TEIITPIVRRTRRSNYSPQSTP

SEQ ID NO: 2506116 - protein, 20 aa, Entamoeba dispar
TEIKGNSSLNEMSEEEDNKE

SEQ ID NO: 2506117 - protein, 18 aa, Entamoeba dispar
TEIKRLNERIEQLQLNLH

SEQ ID NO: 2506118 - protein, 26 aa, Entamoeba dispar
TEIPACIFKLTNLEIFEMERNEITEV

SEQ ID NO: 2506119 - protein, 21 aa, Entamoeba dispar
TEIPKKCFKWNNCRREEMGSI

SEQ ID NO: 2506120 - protein, 22 aa, Entamoeba dispar
TEIPNKIRIKFMIDGAKGISYL

SEQ ID NO: 2506121 - protein, 23 aa, Entamoeba dispar
TEIPNKIRIKFMIDGAKGISYLH

SEQ ID NO: 2506122 - protein, 22 aa, Entamoeba dispar
TEIPNKIRIKFMLDGAKGISYL

SEQ ID NO: 2506123 - protein, 26 aa, Entamoeba dispar
TEIPQKWMYCFLFNDRLVETMPISID

SEQ ID NO: 2506124 - protein, 19 aa, Entamoeba dispar
  misc_feature (15)..(16): Xaa can be any naturally occurring amino acid
TEIQMLCLLEIVDYXXIEF

SEQ ID NO: 2506125 - protein, 25 aa, Entamoeba dispar
TEITNIRFGIGFGQESKTAFIQNTE

SEQ ID NO: 2506126 - protein, 17 aa, Entamoeba dispar
TEIYDSFYFNQQPMTDA

SEQ ID NO: 2506127 - protein, 27 aa, Entamoeba dispar
TEKEKKEVLKIVTIEAYKDALNLLRGS

SEQ ID NO: 2506128 - protein, 20 aa, Entamoeba dispar
TEKEWKAKVEEKVVEINNLK

SEQ ID NO: 2506129 - protein, 25 aa, Entamoeba dispar
TEKFGFKTETIWKYNNAIYDLFCEF

SEQ ID NO: 2506130 - protein, 17 aa, Entamoeba dispar
TEKGICITNAFNNAFLT

SEQ ID NO: 2506131 - protein, 22 aa, Entamoeba dispar
TEKGICITNAFNNAFLTSYDPY

SEQ ID NO: 2506132 - protein, 18 aa, Entamoeba dispar
TEKGTMFYYFGWNSWNGW

SEQ ID NO: 2506133 - protein, 31 aa, Entamoeba dispar
TEKGTMFYYFGWNSWNGWIPAWCVNKATKTM

SEQ ID NO: 2506134 - protein, 26 aa, Entamoeba dispar
TEKHKSFRLSKQISFSKKDKKKDKKE

SEQ ID NO: 2506135 - protein, 27 aa, Entamoeba dispar
TEKKMVLDFTAPFKRISYVHALEEKFG

SEQ ID NO: 2506136 - protein, 25 aa, Entamoeba dispar
TEKKRLFKKWEVILFRKQDRKKKYS

SEQ ID NO: 2506137 - protein, 20 aa, Entamoeba dispar
TEKLIILACDGIWDVLTNEQ

SEQ ID NO: 2506138 - protein, 18 aa, Entamoeba dispar
TEKLKLYFRCFKTNKKGE

SEQ ID NO: 2506139 - protein, 19 aa, Entamoeba dispar
TEKQECIISMFQLYDCSIV

SEQ ID NO: 2506140 - protein, 24 aa, Entamoeba dispar
TEKTKLVLNPSVIKTKEELTNKKD

SEQ ID NO: 2506141 - protein, 29 aa, Entamoeba dispar
TEKYIKIVTDFFPSLPLTIFQICNVYREL

SEQ ID NO: 2506142 - protein, 20 aa, Entamoeba dispar
TEKYIYLLIVQFINELIKSK

SEQ ID NO: 2506143 - protein, 18 aa, Entamoeba dispar
TELAKLIVDTAYCRFSSD

SEQ ID NO: 2506144 - protein, 18 aa, Entamoeba dispar
TELASLALRYCGLSHSNP

SEQ ID NO: 2506145 - protein, 19 aa, Entamoeba dispar
TELDGSIEITREEFEEQCK

SEQ ID NO: 2506146 - protein, 25 aa, Entamoeba dispar
TELFRTKANYDLRFNVKLSNDDNND

SEQ ID NO: 2506147 - protein, 25 aa, Entamoeba dispar
TELFRTKANYDLRFNVKLSNDDSNN

SEQ ID NO: 2506148 - protein, 18 aa, Entamoeba dispar
TELGDYCFYGCSLLKSIN

SEQ ID NO: 2506149 - protein, 23 aa, Entamoeba dispar
TELIEIKLSFILLTLKNLNIKKV

SEQ ID NO: 2506150 - protein, 20 aa, Entamoeba dispar
TELIKGLVMDHGTRHPGMPH

SEQ ID NO: 2506151 - protein, 23 aa, Entamoeba dispar
TELIRCFHPLQIAHDIYNFIDES

SEQ ID NO: 2506152 - protein, 17 aa, Entamoeba dispar
TELKNHMELSFYLVLHF

SEQ ID NO: 2506153 - protein, 27 aa, Entamoeba dispar
TELLKRWTGMRNFRIIFEKTIGDIDLV

SEQ ID NO: 2506154 - protein, 18 aa, Entamoeba dispar
TELLKYSQFNEFWKLTNK

SEQ ID NO: 2506155 - protein, 25 aa, Entamoeba dispar
TELLLRKAPFQALVREIAQVSKSDL

SEQ ID NO: 2506156 - protein, 24 aa, Entamoeba dispar
TELMFSIPNLSYVHEWKNLTEKAS

SEQ ID NO: 2506157 - protein, 22 aa, Entamoeba dispar
TELMIELPIIKHYAEKSIDAYI

SEQ ID NO: 2506158 - protein, 23 aa, Entamoeba dispar
TELNEIIGRLSIKIDKTLFGRTV

SEQ ID NO: 2506159 - protein, 21 aa, Entamoeba dispar
TELPCSGDIDLSCNQIIELDL

SEQ ID NO: 2506160 - protein, 25 aa, Entamoeba dispar
TELSFEICAHCLRSSERFVQLGVGC

SEQ ID NO: 2506161 - protein, 21 aa, Entamoeba dispar
TELVKRNNICILWKEETGEVF

SEQ ID NO: 2506162 - protein, 21 aa, Entamoeba dispar
TEMDKMADIEETWRKMKSQTE

SEQ ID NO: 2506163 - protein, 17 aa, Entamoeba dispar
TEMFLGPAPKEFVYVPK

SEQ ID NO: 2506164 - protein, 17 aa, Entamoeba dispar
TEMIEYVKYIGIIDFQL

SEQ ID NO: 2506165 - protein, 22 aa, Entamoeba dispar
TENCKYFYVSFLNKRGLTIKGF

SEQ ID NO: 2506166 - protein, 25 aa, Entamoeba dispar
TENMIIKLIENVSCSMYSENSTCSL

SEQ ID NO: 2506167 - protein, 29 aa, Entamoeba dispar
TENNHCKFVWLFLLRNAFYKNCRIVLDLH

SEQ ID NO: 2506168 - protein, 24 aa, Entamoeba dispar
TENTKRVIQFLAMTAGQSKKAGQL

SEQ ID NO: 2506169 - protein, 25 aa, Entamoeba dispar
TEPIPEIIQNPSLGKEGIETQEEKL

SEQ ID NO: 2506170 - protein, 18 aa, Entamoeba dispar
TEPSVALHKIETFNTMIK

SEQ ID NO: 2506171 - protein, 22 aa, Entamoeba dispar
TEPYFRAPASFLPIRERREETL

SEQ ID NO: 2506172 - protein, 23 aa, Entamoeba dispar
TEQNIPPAQNWKLQLSEKLGSLR

SEQ ID NO: 2506173 - protein, 26 aa, Entamoeba dispar
TEQVRLRIGNILIYRTILEDAAVQRL

SEQ ID NO: 2506174 - protein, 23 aa, Entamoeba dispar
TEQYKAIIFIGPVWWWGLNAPIK

SEQ ID NO: 2506175 - protein, 24 aa, Entamoeba dispar
TERFRCISDSFFRGTDGCVLVCSV

SEQ ID NO: 2506176 - protein, 26 aa, Entamoeba dispar
TERGMTLKECESAHNFISETIKKLSN

SEQ ID NO: 2506177 - protein, 21 aa, Entamoeba dispar
TERKWKIIITKRNKIEEEIKS

SEQ ID NO: 2506178 - protein, 19 aa, Entamoeba dispar
TERLEVILFSLQIIKHWIY

SEQ ID NO: 2506179 - protein, 26 aa, Entamoeba dispar
TERTCPGRNVSSIPIRLRIFSSSVVD

SEQ ID NO: 2506180 - protein, 17 aa, Entamoeba dispar
TESATGFAQCGIDEKEW

SEQ ID NO: 2506181 - protein, 27 aa, Entamoeba dispar
TESDIKWTNRWGRFIGYSDTASITLSS

SEQ ID NO: 2506182 - protein, 27 aa, Entamoeba dispar
TESDINWTNRWGRFIGYSDTASITLSS

SEQ ID NO: 2506183 - protein, 18 aa, Entamoeba dispar
TESFKECIKLKEININPN

SEQ ID NO: 2506184 - protein, 25 aa, Entamoeba dispar
TESHGFLYIIMEYMESGSLLNIVKK

SEQ ID NO: 2506185 - protein, 28 aa, Entamoeba dispar
TESIFKFDFSSLFGSYPPALKLHAQNML

SEQ ID NO: 2506186 - protein, 26 aa, Entamoeba dispar
TESLLKPSALSPRFTRDSFDLSIPKR

SEQ ID NO: 2506187 - protein, 22 aa, Entamoeba dispar
TESTCFKQLILGPAPTDVEAVD

SEQ ID NO: 2506188 - protein, 24 aa, Entamoeba dispar
TESTFKRILPYALLKYLESEEQPK

SEQ ID NO: 2506189 - protein, 23 aa, Entamoeba dispar
TETCPLCTTGKPLNFGLLEGTKK

SEQ ID NO: 2506190 - protein, 26 aa, Entamoeba dispar
TETDCLKCSFVVTTTMAFQFRVNVEF

SEQ ID NO: 2506191 - protein, 19 aa, Entamoeba dispar
TETFPHLFPSFSNNQIKVE

SEQ ID NO: 2506192 - protein, 17 aa, Entamoeba dispar
TETGIVPKFYGVELHEF

SEQ ID NO: 2506193 - protein, 19 aa, Entamoeba dispar
TETKCRTIIRQIFSALEYL

SEQ ID NO: 2506194 - protein, 22 aa, Entamoeba dispar
TETKIRIIAFEGLVKGIISMAL

SEQ ID NO: 2506195 - protein, 19 aa, Entamoeba dispar
TETMGRIQLQIAYASPLDR

SEQ ID NO: 2506196 - protein, 23 aa, Entamoeba dispar
TEVCGFIAISFLKLIPEKFTLPD

SEQ ID NO: 2506197 - protein, 25 aa, Entamoeba dispar
TEVDGFRISVDFARREEARDKTPGR

SEQ ID NO: 2506198 - protein, 24 aa, Entamoeba dispar
TEVKEAFISLCQRLRKFAKPEMKV

SEQ ID NO: 2506199 - protein, 23 aa, Entamoeba dispar
TEVKESAARELIRMKYGEGGMKE

SEQ ID NO: 2506200 - protein, 23 aa, Entamoeba dispar
TEVKESAARELIRMKYGERGMKE

SEQ ID NO: 2506201 - protein, 22 aa, Entamoeba dispar
TEVKESAAREVIRMKYGERGMK

SEQ ID NO: 2506202 - protein, 18 aa, Entamoeba dispar
TEVLLSLLTFLVSNLSTE

SEQ ID NO: 2506203 - protein, 17 aa, Entamoeba dispar
TEYIPSTPIEKIIDVCQ

SEQ ID NO: 2506204 - protein, 23 aa, Entamoeba dispar
TEYMQRLLRSCGYIYTTSQQMEL

SEQ ID NO: 2506205 - protein, 23 aa, Entamoeba dispar
TEYRFKISGHERANIVKDFFEKC

SEQ ID NO: 2506206 - protein, 17 aa, Entamoeba dispar
TEYYLYKKIQSISSTPI

SEQ ID NO: 2506207 - protein, 19 aa, Entamoeba dispar
TFADFKIPSQGDFNGLSSF

SEQ ID NO: 2506208 - protein, 17 aa, Entamoeba dispar
TFAEMFLDGDIDEEEMT

SEQ ID NO: 2506209 - protein, 25 aa, Entamoeba dispar
TFAIESFSFFELCFNTIIYSLMANI

SEQ ID NO: 2506210 - protein, 18 aa, Entamoeba dispar
TFAVCYVNIGDCRGLLVH

SEQ ID NO: 2506211 - protein, 18 aa, Entamoeba dispar
TFCGIPLWNVTDDDYIFG

SEQ ID NO: 2506212 - protein, 31 aa, Entamoeba dispar
TFCGTPDYLAPEILKGVGHGPGVDWWSLGIL

SEQ ID NO: 2506213 - protein, 24 aa, Entamoeba dispar
TFCGTPEYLAPEVIQNVAYTNAVD

SEQ ID NO: 2506214 - protein, 25 aa, Entamoeba dispar
TFCIPFEFFEDVLPLIITTLSKVEK

SEQ ID NO: 2506215 - protein, 20 aa, Entamoeba dispar
TFDEPFGIDIEKTMEEFEKK

SEQ ID NO: 2506216 - protein, 23 aa, Entamoeba dispar
TFDGKSVMEYAFFAKKNSGNIIQ

SEQ ID NO: 2506217 - protein, 26 aa, Entamoeba dispar
TFDQMKEWFIKKVIPQIINRKMKFQG

SEQ ID NO: 2506218 - protein, 22 aa, Entamoeba dispar
TFECLPLCCLISTLHSRYFCVH

SEQ ID NO: 2506219 - protein, 18 aa, Entamoeba dispar
TFEDFKRRTDICMRRAFT

SEQ ID NO: 2506220 - protein, 20 aa, Entamoeba dispar
TFEFIGMLQAQGFPKVIGCL

SEQ ID NO: 2506221 - protein, 25 aa, Entamoeba dispar
TFEKLTFYCCDSMKTAKYFFAHIIA

SEQ ID NO: 2506222 - protein, 18 aa, Entamoeba dispar
TFEPKGVFSTDMKEDIIL

SEQ ID NO: 2506223 - protein, 23 aa, Entamoeba dispar
TFESVLHYFSFFGKVRAITQDGN

SEQ ID NO: 2506224 - protein, 18 aa, Entamoeba dispar
TFEYPLKIAELVDAYEKE

SEQ ID NO: 2506225 - protein, 24 aa, Entamoeba dispar
TFFKENIQYFKNCRDSMNNYWIKA

SEQ ID NO: 2506226 - protein, 26 aa, Entamoeba dispar
TFFNGYPFQVCKGIIHQNDYLVLYIQ

SEQ ID NO: 2506227 - protein, 24 aa, Entamoeba dispar
TFGGVCCGCPGLNDPKILSIGVPF

SEQ ID NO: 2506228 - protein, 18 aa, Entamoeba dispar
TFGQVFKCVDLLDKEKEV

SEQ ID NO: 2506229 - protein, 19 aa, Entamoeba dispar
TFGQVFKCYDHINNKFCAL

SEQ ID NO: 2506230 - protein, 24 aa, Entamoeba dispar
TFGSLPIPFIVNYSLIMEIIGNKF

SEQ ID NO: 2506231 - protein, 17 aa, Entamoeba dispar
TFGYGCFYKCGCEEELK

SEQ ID NO: 2506232 - protein, 23 aa, Entamoeba dispar
TFHIKLSSGAVYHFKTKSRELLG

SEQ ID NO: 2506233 - protein, 26 aa, Entamoeba dispar
TFHTECLRCKSCDCFLFEKESFDRQC

SEQ ID NO: 2506234 - protein, 26 aa, Entamoeba dispar
TFIIPFKKFDLLLCFVSQSENTLVVV

SEQ ID NO: 2506235 - protein, 18 aa, Entamoeba dispar
TFILELFNELSIDSFNSF

SEQ ID NO: 2506236 - protein, 18 aa, Entamoeba dispar
TFILTRKSYLQQFTVLME

SEQ ID NO: 2506237 - protein, 21 aa, Entamoeba dispar
TFIPFIQKLVESYCVNTKFKR

SEQ ID NO: 2506238 - protein, 24 aa, Entamoeba dispar
TFITCKGVGFGIVLQTEGDNVIGL

SEQ ID NO: 2506239 - protein, 18 aa, Entamoeba dispar
TFIVEVFESINTIEPNNQ

SEQ ID NO: 2506240 - protein, 23 aa, Entamoeba dispar
TFIYRGCQVLYHLYEEKNALEKI

SEQ ID NO: 2506241 - protein, 22 aa, Entamoeba dispar
TFKQMKELYITRENALSYADTA

SEQ ID NO: 2506242 - protein, 22 aa, Entamoeba dispar
TFKRLWKSQCEELENQSDDETE

SEQ ID NO: 2506243 - protein, 21 aa, Entamoeba dispar
TFKWIKVIFEQNGFGEWVYHI

SEQ ID NO: 2506244 - protein, 25 aa, Entamoeba dispar
TFKYIAMKIVLLWLSTKIITVSCND

SEQ ID NO: 2506245 - protein, 32 aa, Entamoeba dispar
TFLEEIHFILKRGIRINDHFLTLLQLINIAKE

SEQ ID NO: 2506246 - protein, 24 aa, Entamoeba dispar
TFLPIQYLLIYSFDPLFGKSLDTF

SEQ ID NO: 2506247 - protein, 25 aa, Entamoeba dispar
TFLRMFHYKKSCIHLPESIVSVELK

SEQ ID NO: 2506248 - protein, 18 aa, Entamoeba dispar
TFMFKPGHFEIAPEARYG

SEQ ID NO: 2506249 - protein, 23 aa, Entamoeba dispar
TFNDFFYALSVILPRSTIGSFKQ

SEQ ID NO: 2506250 - protein, 24 aa, Entamoeba dispar
TFNKWKLISEITKLMGNRFYINEN

SEQ ID NO: 2506251 - protein, 18 aa, Entamoeba dispar
TFNLIGILLELEKAVKDK

SEQ ID NO: 2506252 - protein, 24 aa, Entamoeba dispar
TFNLKAVAGLVLFNQYWYWYPFTL

SEQ ID NO: 2506253 - protein, 19 aa, Entamoeba dispar
TFNLLFFIRTVFPVFHAPQ

SEQ ID NO: 2506254 - protein, 17 aa, Entamoeba dispar
TFNTSALLSFICVSPPL

SEQ ID NO: 2506255 - protein, 24 aa, Entamoeba dispar
TFNYPHTVLNFGIGMKDFEKIEIN

SEQ ID NO: 2506256 - protein, 29 aa, Entamoeba dispar
TFPIKDIWKHVCIVWTKCYNCYSQNQIEK

SEQ ID NO: 2506257 - protein, 34 aa, Entamoeba dispar
TFPRLKTIYCSFQLLCSLPSLSFLNLSFKIIGMR

SEQ ID NO: 2506258 - protein, 21 aa, Entamoeba dispar
TFPSICTAWDRNGVKIKVVEV

SEQ ID NO: 2506259 - protein, 21 aa, Entamoeba dispar
TFPTCSLFYYISFVAHFIKWI

SEQ ID NO: 2506260 - protein, 23 aa, Entamoeba dispar
TFQGVLQLNGWFCNGTEIRFNLP

SEQ ID NO: 2506261 - protein, 24 aa, Entamoeba dispar
TFQKRFGYFPKIFSRGQYSHQLAE

SEQ ID NO: 2506262 - protein, 23 aa, Entamoeba dispar
TFQYGKTISLGWYNPSIPKEITM

SEQ ID NO: 2506263 - protein, 26 aa, Entamoeba dispar
TFSEPFIMVVLKFIRLIYKSTPQFKS

SEQ ID NO: 2506264 - protein, 20 aa, Entamoeba dispar
TFSGFFSRLFGFVEPEPVSP

SEQ ID NO: 2506265 - protein, 24 aa, Entamoeba dispar
TFSKEIEKVYSFRATMKRDKNPAE

SEQ ID NO: 2506266 - protein, 22 aa, Entamoeba dispar
TFSKLPVVFDLIDFSPYNEIFI

SEQ ID NO: 2506267 - protein, 24 aa, Entamoeba dispar
TFSLGMSILHIFSGKKPYRGMNKQ

SEQ ID NO: 2506268 - protein, 26 aa, Entamoeba dispar
TFSLKRRIEQTIDFDEGWYVIFGCTY

SEQ ID NO: 2506269 - protein, 23 aa, Entamoeba dispar
TFSREFYTYFKAVCSEEESKLRQ

SEQ ID NO: 2506270 - protein, 30 aa, Entamoeba dispar
TFSRGQAFVQSWFDHWGIVPGDPLDKEIKP

SEQ ID NO: 2506271 - protein, 26 aa, Entamoeba dispar
TFSVSFYGVSAWAYLNGVQKIKLLKY

SEQ ID NO: 2506272 - protein, 19 aa, Entamoeba dispar
TFSVWDLGGQREYITMLPM

SEQ ID NO: 2506273 - protein, 24 aa, Entamoeba dispar
TFSYTIRSSDEFAMTTFSTYAVVN

SEQ ID NO: 2506274 - protein, 22 aa, Entamoeba dispar
TFTDMYKRILSLHERPMAETSV

SEQ ID NO: 2506275 - protein, 21 aa, Entamoeba dispar
TFVCNKSALFIIRRNGMKEYE

SEQ ID NO: 2506276 - protein, 21 aa, Entamoeba dispar
TFVCNKSALFIIRRNGMKEYI

SEQ ID NO: 2506277 - protein, 18 aa, Entamoeba dispar
TFVPYKFNFFTSVNNTSF

SEQ ID NO: 2506278 - protein, 18 aa, Entamoeba dispar
TFYERLGMVFGDIIKMMT

SEQ ID NO: 2506279 - protein, 22 aa, Entamoeba dispar
TFYSRLIFNLYYEDRQIDVGGI

SEQ ID NO: 2506280 - protein, 17 aa, Entamoeba dispar
TGASIVYRTEDLKETDV

SEQ ID NO: 2506281 - protein, 20 aa, Entamoeba dispar
TGCVFGMDVLNEFLDENNLQ

SEQ ID NO: 2506282 - protein, 18 aa, Entamoeba dispar
TGCVFLKFTDNYKQHRVI

SEQ ID NO: 2506283 - protein, 20 aa, Entamoeba dispar
TGDFSAIIKYITKKGEGLHE

SEQ ID NO: 2506284 - protein, 24 aa, Entamoeba dispar
TGDGKSALCNFILKKSVFGESDYT

SEQ ID NO: 2506285 - protein, 23 aa, Entamoeba dispar
TGDGKSSFGNFILKKNAFVVNDS

SEQ ID NO: 2506286 - protein, 23 aa, Entamoeba dispar
TGDGKSSLGNFILKKNIFNESND

SEQ ID NO: 2506287 - protein, 23 aa, Entamoeba dispar
TGDGKSSLGNFVLKKKDKSNAFR

SEQ ID NO: 2506288 - protein, 20 aa, Entamoeba dispar
TGDIKAIIKYITKKGEGMHK

SEQ ID NO: 2506289 - protein, 21 aa, Entamoeba dispar
TGDISAIIKYITKKGEGLHQG

SEQ ID NO: 2506290 - protein, 23 aa, Entamoeba dispar
TGDISAIIRYITKKGAGMSKGDP

SEQ ID NO: 2506291 - protein, 24 aa, Entamoeba dispar
TGDISAIIRYITKKGAGMSKGDPS

SEQ ID NO: 2506292 - protein, 21 aa, Entamoeba dispar
TGDISALIKYITKKGEGMHQG

SEQ ID NO: 2506293 - protein, 19 aa, Entamoeba dispar
TGDISALVKYITKKGKGIF

SEQ ID NO: 2506294 - protein, 19 aa, Entamoeba dispar
TGDLCKNKKFVQCGNGETI

SEQ ID NO: 2506295 - protein, 25 aa, Entamoeba dispar
TGDLFTQMFLELGMKSFDKFIEKLI

SEQ ID NO: 2506296 - protein, 17 aa, Entamoeba dispar
TGDLIEIKIDCRELHGE

SEQ ID NO: 2506297 - protein, 22 aa, Entamoeba dispar
TGEKSLSVELIFTMINGNRFKI

SEQ ID NO: 2506298 - protein, 18 aa, Entamoeba dispar
TGEVHLSGVLFFFDSKKE

SEQ ID NO: 2506299 - protein, 22 aa, Entamoeba dispar
TGEVPSRVKVIVNIIRRSLMLL

SEQ ID NO: 2506300 - protein, 18 aa, Entamoeba dispar
TGFDGEITYTEWKVISYQ

SEQ ID NO: 2506301 - protein, 24 aa, Entamoeba dispar
TGFQTRLGVMVARQLNALFSQKPN

SEQ ID NO: 2506302 - protein, 19 aa, Entamoeba dispar
TGFSHCFCKGVSVGVKCNI

SEQ ID NO: 2506303 - protein, 26 aa, Entamoeba dispar
TGFYKSCIEYGIIPAFELVERSQAEK

SEQ ID NO: 2506304 - protein, 26 aa, Entamoeba dispar
TGGIVLFKWGQGKLRGEPINTVIKDH

SEQ ID NO: 2506305 - protein, 20 aa, Entamoeba dispar
TGGLKCSWCGLVCHQCCVRK

SEQ ID NO: 2506306 - protein, 17 aa, Entamoeba dispar
TGGSSIEYLGKRYCLAC

SEQ ID NO: 2506307 - protein, 22 aa, Entamoeba dispar
TGHGKSSLGNFILKKNVFSVSV

SEQ ID NO: 2506308 - protein, 19 aa, Entamoeba dispar
TGHLNIYEFIAIYRYLEIC

SEQ ID NO: 2506309 - protein, 18 aa, Entamoeba dispar
TGHPSFVMSNSFSNQTLA

SEQ ID NO: 2506310 - protein, 25 aa, Entamoeba dispar
TGHTLRFLSLPSVLRDMLEKVIKLQ

SEQ ID NO: 2506311 - protein, 24 aa, Entamoeba dispar
TGHTLRLLDHFVFHNHVCIVTELL

SEQ ID NO: 2506312 - protein, 24 aa, Entamoeba dispar
TGICSMFHPSVCCEEYSSKEEIKK

SEQ ID NO: 2506313 - protein, 24 aa, Entamoeba dispar
TGICSTFHPSVCCEEYSSKEEIKK

SEQ ID NO: 2506314 - protein, 25 aa, Entamoeba dispar
TGICYRLFTENTFKYELLESPIPEI

SEQ ID NO: 2506315 - protein, 17 aa, Entamoeba dispar
TGILSLGVKAIIVSKKI

SEQ ID NO: 2506316 - protein, 27 aa, Entamoeba dispar
TGIPGFPVNFLQYFQLFPSVFNTSINR

SEQ ID NO: 2506317 - protein, 17 aa, Entamoeba dispar
TGIPIEIIATVPVVSGI

SEQ ID NO: 2506318 - protein, 20 aa, Entamoeba dispar
TGIQQCWAAHMIGHEVTTYY

SEQ ID NO: 2506319 - protein, 29 aa, Entamoeba dispar
TGISRPVGYGGKLINGFSIPPPQPDAAQV

SEQ ID NO: 2506320 - protein, 17 aa, Entamoeba dispar
TGKNVLKCISSLFGIKC

SEQ ID NO: 2506321 - protein, 24 aa, Entamoeba dispar
TGKSRGFGYLDFVDLEAAKKFVQE

SEQ ID NO: 2506322 - protein, 24 aa, Entamoeba dispar
TGLDFGVLLPVVEWLMTKVEEART

SEQ ID NO: 2506323 - protein, 24 aa, Entamoeba dispar
TGLLKIANLLLPKVEIVPEKISLT

SEQ ID NO: 2506324 - protein, 25 aa, Entamoeba dispar
TGLLKRLKDFMLIKVIQGSVHVPQN

SEQ ID NO: 2506325 - protein, 33 aa, Entamoeba dispar
TGLQWKGSPTIDLSIRQACIFEYDVVSNKEQPV

SEQ ID NO: 2506326 - protein, 19 aa, Entamoeba dispar
TGLTCRLGDFGFAKCFQNE

SEQ ID NO: 2506327 - protein, 24 aa, Entamoeba dispar
TGMDFKGIFRFSPYANLKEIEEGT

SEQ ID NO: 2506328 - protein, 25 aa, Entamoeba dispar
TGMSCLWQPSLIIDRGIALHKMIRL

SEQ ID NO: 2506329 - protein, 25 aa, Entamoeba dispar
TGMVQRLRIAINAADEILKILPQSI

SEQ ID NO: 2506330 - protein, 19 aa, Entamoeba dispar
TGMWKLSHIIAPWEDDKLS

SEQ ID NO: 2506331 - protein, 17 aa, Entamoeba dispar
TGNGFVFQGFAHGDLVF

SEQ ID NO: 2506332 - protein, 27 aa, Entamoeba dispar
TGNGKSALCNFILKKSFFKESNNPQSV

SEQ ID NO: 2506333 - protein, 17 aa, Entamoeba dispar
TGNVMLPIIPRVVTVSP

SEQ ID NO: 2506334 - protein, 17 aa, Entamoeba dispar
TGPFVPLLLFKTIMNEL

SEQ ID NO: 2506335 - protein, 20 aa, Entamoeba dispar
TGPILEREPEEKIKMKEQIQ

SEQ ID NO: 2506336 - protein, 25 aa, Entamoeba dispar
TGQRKGDNFFSYWVLTKDNIYFYRN

SEQ ID NO: 2506337 - protein, 21 aa, Entamoeba dispar
TGRQAPTKNLMEFRNSLPTSN

SEQ ID NO: 2506338 - protein, 18 aa, Entamoeba dispar
TGRYVCYVNPTLPTYRFE

SEQ ID NO: 2506339 - protein, 22 aa, Entamoeba dispar
TGSEMNCGFVISRKSDNMKMAG

SEQ ID NO: 2506340 - protein, 24 aa, Entamoeba dispar
TGSGKSALCNFILKKAVFNESDNP

SEQ ID NO: 2506341 - protein, 25 aa, Entamoeba dispar
TGSIRRYLAEHPKDFDPRQYLGPAR

SEQ ID NO: 2506342 - protein, 20 aa, Entamoeba dispar
TGSLIFPKNNFRLFFSEKRL

SEQ ID NO: 2506343 - protein, 19 aa, Entamoeba dispar
TGSLIYISVILPEFDHPVK

SEQ ID NO: 2506344 - protein, 23 aa, Entamoeba dispar
TGSSPCVFARIFFSGIQDVKVKP

SEQ ID NO: 2506345 - protein, 23 aa, Entamoeba dispar
TGVQAVVIVLDFNKEVLSDNVER

SEQ ID NO: 2506346 - protein, 24 aa, Entamoeba dispar
TGYGEMYLDCVLRDIRNMFTPIEI

SEQ ID NO: 2506347 - protein, 24 aa, Entamoeba dispar
TGYGKLPLNYAIESPHIDVIIKLL

SEQ ID NO: 2506348 - protein, 22 aa, Entamoeba dispar
THCKIPHLEKKCEFFQIQRPVL

SEQ ID NO: 2506349 - protein, 17 aa, Entamoeba dispar
THCSWGKDGNFDVTVIS

SEQ ID NO: 2506350 - protein, 21 aa, Entamoeba dispar
THEQFKIIYIAPMKSLVQEIV

SEQ ID NO: 2506351 - protein, 25 aa, Entamoeba dispar
THGPARKELLSSFFNSAITTLYTPL

SEQ ID NO: 2506352 - protein, 37 aa, Entamoeba dispar
THHKIDLSYFIKLFQKFGEIYSIWGSSSGKIFFVEYY

SEQ ID NO: 2506353 - protein, 23 aa, Entamoeba dispar
THIENGSRKILLISMGNQEIAQE

SEQ ID NO: 2506354 - protein, 26 aa, Entamoeba dispar
THIIFSRRNSMEISINPILTSIIERI

SEQ ID NO: 2506355 - protein, 24 aa, Entamoeba dispar
THIRKICLNGGATLVLFDKNPQYD

SEQ ID NO: 2506356 - protein, 19 aa, Entamoeba dispar
THKMESFNSYVILPIQRIP

SEQ ID NO: 2506357 - protein, 23 aa, Entamoeba dispar
THKMKVTLLRFILENTQHLDEDS

SEQ ID NO: 2506358 - protein, 23 aa, Entamoeba dispar
THLDFPDEIFIAPPLDDKFSYYF

SEQ ID NO: 2506359 - protein, 29 aa, Entamoeba dispar
THLRKFYFRLCEFLQYPSLPLSCINLNSI

SEQ ID NO: 2506360 - protein, 30 aa, Entamoeba dispar
THLSEATVLYNLRIRYMEDIIHTYSGLFCV

SEQ ID NO: 2506361 - protein, 17 aa, Entamoeba dispar
THLVYSKGLVWHVSIVD

SEQ ID NO: 2506362 - protein, 22 aa, Entamoeba dispar
THMLGYGAVWLGVYPEKDRMES

SEQ ID NO: 2506363 - protein, 24 aa, Entamoeba dispar
THNKALHFTSRFMYLTLWGDEISN

SEQ ID NO: 2506364 - protein, 21 aa, Entamoeba dispar
THPTIPLLYILEGDNNSCKVG

SEQ ID NO: 2506365 - protein, 18 aa, Entamoeba dispar
THPVMPKPLLDDIRSSTG

SEQ ID NO: 2506366 - protein, 22 aa, Entamoeba dispar
THQDCYWRETVSLIMNNSGECD

SEQ ID NO: 2506367 - protein, 25 aa, Entamoeba dispar
THRGELRKIFSIKKLHIGHICKSFG

SEQ ID NO: 2506368 - protein, 17 aa, Entamoeba dispar
THRKCTRVVLKALEQLE

SEQ ID NO: 2506369 - protein, 33 aa, Entamoeba dispar
THSLEYPKFPTFPCKDYLYHILEFTGNGIALHF

SEQ ID NO: 2506370 - protein, 25 aa, Entamoeba dispar
THSNSGVCPLPPAGTTGQQPNYEIQ

SEQ ID NO: 2506371 - protein, 24 aa, Entamoeba dispar
THSPRLMKSNSIVQPPPTKVSLKT

SEQ ID NO: 2506372 - protein, 20 aa, Entamoeba dispar
THTCYKCNKKFNKGGIYCKN

SEQ ID NO: 2506373 - protein, 21 aa, Entamoeba dispar
THTINGYAFRKTSSTKMNSQS

SEQ ID NO: 2506374 - protein, 29 aa, Entamoeba dispar
THTKIGEKMIKEWIRQPLIDKDKINKRLE

SEQ ID NO: 2506375 - protein, 18 aa, Entamoeba dispar
THTPRGILFGEVTLVTPI

SEQ ID NO: 2506376 - protein, 26 aa, Entamoeba dispar
THVELLFALCDSLRNLFKVKGTSSID

SEQ ID NO: 2506377 - protein, 26 aa, Entamoeba dispar
THVFGFESECLWKYNRNVYMEFINLF

SEQ ID NO: 2506378 - protein, 17 aa, Entamoeba dispar
THVQKIVNFLIEVKKKV

SEQ ID NO: 2506379 - protein, 22 aa, Entamoeba dispar
THYKRPALQSGDYVEFKYTKDR

SEQ ID NO: 2506380 - protein, 27 aa, Entamoeba dispar
THYSFFRTAKRLILFDFVTKTIENKQF

SEQ ID NO: 2506381 - protein, 21 aa, Entamoeba dispar
TICIPICIKNNLPSTFNYPPH

SEQ ID NO: 2506382 - protein, 19 aa, Entamoeba dispar
TICQQPIRLHQQLIYTLPS

SEQ ID NO: 2506383 - protein, 24 aa, Entamoeba dispar
TIDCSDRWKEWLIIEDNYHDGWTY

SEQ ID NO: 2506384 - protein, 27 aa, Entamoeba dispar
TIDDLYCNNCTFVPADIISSCQYTKNN

SEQ ID NO: 2506385 - protein, 18 aa, Entamoeba dispar
TIDFGKCYYTGSVTSDYY

SEQ ID NO: 2506386 - protein, 22 aa, Entamoeba dispar
TIDFIKIPTFYKVQYKWDTCVI

SEQ ID NO: 2506387 - protein, 22 aa, Entamoeba dispar
TIDHCYYYFSKIAFFSKDRYDR

SEQ ID NO: 2506388 - protein, 22 aa, Entamoeba dispar
TIDISLCHDIKFEVQYLNFWIE

SEQ ID NO: 2506389 - protein, 24 aa, Entamoeba dispar
TIDYSNSCVIIYLAKTIVNKASRD

SEQ ID NO: 2506390 - protein, 22 aa, Entamoeba dispar
TIDYWCFKGCSSLTSITIPTTI

SEQ ID NO: 2506391 - protein, 17 aa, Entamoeba dispar
TIEAAFTKLTWLLAQGM

SEQ ID NO: 2506392 - protein, 20 aa, Entamoeba dispar
TIECLNCQRSDITTINANEI

SEQ ID NO: 2506393 - protein, 17 aa, Entamoeba dispar
TIEEFPGNFPKFNPQKE

SEQ ID NO: 2506394 - protein, 25 aa, Entamoeba dispar
TIEEIGNYCFYGCSSLKSINIPSSI

SEQ ID NO: 2506395 - protein, 20 aa, Entamoeba dispar
TIEEKYRNSIIVKGKISQDF

SEQ ID NO: 2506396 - protein, 26 aa, Entamoeba dispar
TIEEQVKFVLKRGEYVTNCLKCNRTC

SEQ ID NO: 2506397 - protein, 21 aa, Entamoeba dispar
TIEILSRACELFIKDLTTRAG

SEQ ID NO: 2506398 - protein, 22 aa, Entamoeba dispar
TIELKSGMILTGTIVGVDNYMN

SEQ ID NO: 2506399 - protein, 26 aa, Entamoeba dispar
TIELTLRLFGNYPYSIILPKTLVKLT

SEQ ID NO: 2506400 - protein, 17 aa, Entamoeba dispar
TIEMLTIEKQCLQKRVE

SEQ ID NO: 2506401 - protein, 20 aa, Entamoeba dispar
TIEMWYEMLWDIGLSEYYKN

SEQ ID NO: 2506402 - protein, 19 aa, Entamoeba dispar
TIENCYRKTLTVDNRICVL

SEQ ID NO: 2506403 - protein, 17 aa, Entamoeba dispar
TIENFWGFYEDFPNITS

SEQ ID NO: 2506404 - protein, 18 aa, Entamoeba dispar
TIENFWGFYEDFPNITSV

SEQ ID NO: 2506405 - protein, 19 aa, Entamoeba dispar
TIEPVWPQSHFDQLMFITG

SEQ ID NO: 2506406 - protein, 17 aa, Entamoeba dispar
TIEQMWYHQQMHLLICL

SEQ ID NO: 2506407 - protein, 17 aa, Entamoeba dispar
TIESLESLEWLNVLKKI

SEQ ID NO: 2506408 - protein, 30 aa, Entamoeba dispar
TIEVFKKRRVVLMKILLRLHRIYKLDELKH

SEQ ID NO: 2506409 - protein, 26 aa, Entamoeba dispar
TIFCEGRNYLKCFYKPHNGEHSAENE

SEQ ID NO: 2506410 - protein, 20 aa, Entamoeba dispar
TIFFLRFLFPALNHAEKYIP

SEQ ID NO: 2506411 - protein, 19 aa, Entamoeba dispar
TIFKELVRYINNFKLPESI

SEQ ID NO: 2506412 - protein, 21 aa, Entamoeba dispar
TIFKTKVINFIGLIQGLITDE

SEQ ID NO: 2506413 - protein, 25 aa, Entamoeba dispar
TIGDIAMRAPMMWSLVELPKPPELF

SEQ ID NO: 2506414 - protein, 23 aa, Entamoeba dispar
TIGDIQFFNGIIVIAFKKEIYRI

SEQ ID NO: 2506415 - protein, 23 aa, Entamoeba dispar
TIGGLRIIGRLAVGNRKGLLLPN

SEQ ID NO: 2506416 - protein, 28 aa, Entamoeba dispar
TIGKIKEIIQCLGMKEWQKVLNWLTRNG

SEQ ID NO: 2506417 - protein, 26 aa, Entamoeba dispar
TIGNENARRIWLGRWTTADYPLPESG

SEQ ID NO: 2506418 - protein, 20 aa, Entamoeba dispar
TIGYWIKIDIIYQNLGDKKT

SEQ ID NO: 2506419 - protein, 19 aa, Entamoeba dispar
TIHKLYSPLFFYTQTLISK

SEQ ID NO: 2506420 - protein, 25 aa, Entamoeba dispar
TIHLKLNCIVFRPVINTYLIATVCQ

SEQ ID NO: 2506421 - protein, 25 aa, Entamoeba dispar
TIHLSEGIIHLGIRAFKNCYSLTNI

SEQ ID NO: 2506422 - protein, 19 aa, Entamoeba dispar
TIHNIPFNILGQIIELAEI

SEQ ID NO: 2506423 - protein, 23 aa, Entamoeba dispar
TIHPSFARFALECSEYKCVGSTI

SEQ ID NO: 2506424 - protein, 22 aa, Entamoeba dispar
TIIELPQLKALILNNNNINTIP

SEQ ID NO: 2506425 - protein, 18 aa, Entamoeba dispar
TIIESVRYACTGTSPPNS

SEQ ID NO: 2506426 - protein, 24 aa, Entamoeba dispar
TIIFKAKGLLSFPIEVINNSNFIT

SEQ ID NO: 2506427 - protein, 27 aa, Entamoeba dispar
TIIFPFSSKNKYGLIAYVNKINIIGKE

SEQ ID NO: 2506428 - protein, 28 aa, Entamoeba dispar
TIIGKGEFPIPVMYIIDGNGNYRSVPLS

SEQ ID NO: 2506429 - protein, 22 aa, Entamoeba dispar
TIIKEIGSYCFLNCKRLKSVTI

SEQ ID NO: 2506430 - protein, 18 aa, Entamoeba dispar
TIIKEVYKTQSYKIQTLI

SEQ ID NO: 2506431 - protein, 22 aa, Entamoeba dispar
TIIKEYPIITVFIKGLPNGFET

SEQ ID NO: 2506432 - protein, 17 aa, Entamoeba dispar
TIIKLKIPIGLGEFSRF

SEQ ID NO: 2506433 - protein, 27 aa, Entamoeba dispar
TIIKSNELWKKWIIQPQIDQVIKEIVD

SEQ ID NO: 2506434 - protein, 34 aa, Entamoeba dispar
TIILGDSCISDFSKRLCTGLSIDWNTSFNLYSFD

SEQ ID NO: 2506435 - protein, 18 aa, Entamoeba dispar
TIIPILLSELTKIKYSKK

SEQ ID NO: 2506436 - protein, 17 aa, Entamoeba dispar
TIIPISLTKFLRINTPT

SEQ ID NO: 2506437 - protein, 19 aa, Entamoeba dispar
TIISCGYQKIEYLPVHVNY

SEQ ID NO: 2506438 - protein, 27 aa, Entamoeba dispar
TIITRKFLCCGPLFIVEKVTEIPQKWM

SEQ ID NO: 2506439 - protein, 25 aa, Entamoeba dispar
TIIWPSPKLSSGVVEPYNAVLNTHA

SEQ ID NO: 2506440 - protein, 23 aa, Entamoeba dispar
TIKCPVAGCDHSFGINDLIEDYE

SEQ ID NO: 2506441 - protein, 28 aa, Entamoeba dispar
TIKDPCKYLVPIDKLDIDEEIKRIQITN

SEQ ID NO: 2506442 - protein, 24 aa, Entamoeba dispar
TIKEHYKSFISYTLEHIREDDTSL

SEQ ID NO: 2506443 - protein, 22 aa, Entamoeba dispar
TIKEVWRDGLQILNDSQVKIFS

SEQ ID NO: 2506444 - protein, 20 aa, Entamoeba dispar
TIKGLSNEETIIFSKRNHGS

SEQ ID NO: 2506445 - protein, 28 aa, Entamoeba dispar
TIKKATVKCLKRVIPMLNETDFRGYVYS

SEQ ID NO: 2506446 - protein, 21 aa, Entamoeba dispar
TIKLPQCYHTDYLINIEMNSL

SEQ ID NO: 2506447 - protein, 18 aa, Entamoeba dispar
TIKMNWDALMAGTQMSGI

SEQ ID NO: 2506448 - protein, 21 aa, Entamoeba dispar
TIKPHPQFMLFATQNPPNTYG

SEQ ID NO: 2506449 - protein, 23 aa, Entamoeba dispar
TIKQKWAKITIFMKIWTDLLPYD

SEQ ID NO: 2506450 - protein, 23 aa, Entamoeba dispar
TIKVEGCTFYFFVSSMIGSRLVT

SEQ ID NO: 2506451 - protein, 19 aa, Entamoeba dispar
TIKVGMCNVFLMHTSASLC

SEQ ID NO: 2506452 - protein, 21 aa, Entamoeba dispar
TILGDRFLRFSPMIHNTNEED

SEQ ID NO: 2506453 - protein, 27 aa, Entamoeba dispar
TILITRFAPYIFRCYNPTKISPFIHFL

SEQ ID NO: 2506454 - protein, 25 aa, Entamoeba dispar
TILKCLHCKCDICASERDDPKTIIV

SEQ ID NO: 2506455 - protein, 18 aa, Entamoeba dispar
TILNSFVNAVCGIKITDD

SEQ ID NO: 2506456 - protein, 17 aa, Entamoeba dispar
TILRLVGLLNGRTIQQI

SEQ ID NO: 2506457 - protein, 19 aa, Entamoeba dispar
TILSFPFTYNGMFHIKEHP

SEQ ID NO: 2506458 - protein, 23 aa, Entamoeba dispar
TILYCGVLKRLIMNCMSSFDKFI

SEQ ID NO: 2506459 - protein, 18 aa, Entamoeba dispar
TIMNELIESIKLLTNSSQ

SEQ ID NO: 2506460 - protein, 17 aa, Entamoeba dispar
TIMNLQWNEEVKEWIQL

SEQ ID NO: 2506461 - protein, 28 aa, Entamoeba dispar
TINCISVKIPIGVWFHFALCCDEISTVY

SEQ ID NO: 2506462 - protein, 22 aa, Entamoeba dispar
TINGKTALHFAVQEGRLTLTRI

SEQ ID NO: 2506463 - protein, 23 aa, Entamoeba dispar
TINGPIHLEWYYLVKVHNKIQRI

SEQ ID NO: 2506464 - protein, 34 aa, Entamoeba dispar
TINGSFWKKFKIPWRSVAVAISFGRFHPIHINSG

SEQ ID NO: 2506465 - protein, 23 aa, Entamoeba dispar
TINHCNNMGFEIYGIKKSLEIID

SEQ ID NO: 2506466 - protein, 23 aa, Entamoeba dispar
TINIIKEFLLQCGLHPHESVAKE

SEQ ID NO: 2506467 - protein, 26 aa, Entamoeba dispar
TINIWDLKKMRCRSLIYDDGAINVTS

SEQ ID NO: 2506468 - protein, 18 aa, Entamoeba dispar
TINKIGFNCFKECTSLKS

SEQ ID NO: 2506469 - protein, 32 aa, Entamoeba dispar
TINKSKMSLLYSRLDIVKKIIILGDYFVGKSS

SEQ ID NO: 2506470 - protein, 18 aa, Entamoeba dispar
TINLLRKHLTVLAQKSGL

SEQ ID NO: 2506471 - protein, 18 aa, Entamoeba dispar
TINNLLFSGIWDMANENS

SEQ ID NO: 2506472 - protein, 17 aa, Entamoeba dispar
TINSCTSLKNVSFPMTL

SEQ ID NO: 2506473 - protein, 17 aa, Entamoeba dispar
TINVCVHYSMKMLHSQY

SEQ ID NO: 2506474 - protein, 24 aa, Entamoeba dispar
TINVDGKVCVLDILDTAGREEYQT

SEQ ID NO: 2506475 - protein, 34 aa, Entamoeba dispar
TIPITIEVSLCFACQFHLLRLLYYKNLSIPIENA

SEQ ID NO: 2506476 - protein, 28 aa, Entamoeba dispar
TIPKMCPEIPQAIAARMVNPEFPEPKNI

SEQ ID NO: 2506477 - protein, 26 aa, Entamoeba dispar
TIPKSFEFGWEWMIEKLLQENIIVPS

SEQ ID NO: 2506478 - protein, 19 aa, Entamoeba dispar
TIPNQWKLVQEYEKKQKKD

SEQ ID NO: 2506479 - protein, 28 aa, Entamoeba dispar
TIPQSVSKIGDWCFYDCTSLTNTDIPST

SEQ ID NO: 2506480 - protein, 17 aa, Entamoeba dispar
TIPRGEQTYAFVKFENE

SEQ ID NO: 2506481 - protein, 24 aa, Entamoeba dispar
TIPSEVKSIVFFCFSNCGELETVN

SEQ ID NO: 2506482 - protein, 27 aa, Entamoeba dispar
TIPSEVKSLGAWCFNRCKSLTTINIPT

SEQ ID NO: 2506483 - protein, 25 aa, Entamoeba dispar
TIPSEVKSLGAWCFSKCSSLTSINI

SEQ ID NO: 2506484 - protein, 23 aa, Entamoeba dispar
TIPVLRKDSTFIFHLSINGEIKY

SEQ ID NO: 2506485 - protein, 26 aa, Entamoeba dispar
TIQLKRLMKKNCQFSYSMLLMKLSLQ

SEQ ID NO: 2506486 - protein, 17 aa, Entamoeba dispar
TIQRFSKVVKEIEIGVI

SEQ ID NO: 2506487 - protein, 18 aa, Entamoeba dispar
TIQSPYVIFGERIVDLAV

SEQ ID NO: 2506488 - protein, 19 aa, Entamoeba dispar
TIQTYILMIRTIQRNRDRT

SEQ ID NO: 2506489 - protein, 26 aa, Entamoeba dispar
TIRFWDVRSKECIDINKSIHTSSVSD

SEQ ID NO: 2506490 - protein, 22 aa, Entamoeba dispar
TIRMWDIIAGKCMKTLTQHTKG

SEQ ID NO: 2506491 - protein, 18 aa, Entamoeba dispar
TIRPCDRIETKNFKEIKP

SEQ ID NO: 2506492 - protein, 18 aa, Entamoeba dispar
TIRSRKSMLQKYDCEEDF

SEQ ID NO: 2506493 - protein, 18 aa, Entamoeba dispar
TIRVIWITLLSCIQQPQL

SEQ ID NO: 2506494 - protein, 18 aa, Entamoeba dispar
TIRYRNSLLIGIQKPSLT

SEQ ID NO: 2506495 - protein, 25 aa, Entamoeba dispar
TISEIGTWCFYKCTSLKSINIPSSI

SEQ ID NO: 2506496 - protein, 28 aa, Entamoeba dispar
TISELGDYCFRCCASLKSITLPTTISEV

SEQ ID NO: 2506497 - protein, 18 aa, Entamoeba dispar
TISELGTWCFSHCSSLKS

SEQ ID NO: 2506498 - protein, 20 aa, Entamoeba dispar
TISEMCINCLLKMTTDSQAL

SEQ ID NO: 2506499 - protein, 18 aa, Entamoeba dispar
TISEMIGFQAYYRNRDNQ

SEQ ID NO: 2506500 - protein, 19 aa, Entamoeba dispar
TISFSNRELEDFAFIEVTP

SEQ ID NO: 2506501 - protein, 18 aa, Entamoeba dispar
TISGMALPIAREIIDSFK

SEQ ID NO: 2506502 - protein, 22 aa, Entamoeba dispar
TISIYHQWLFGEHIPKIIQDNR

SEQ ID NO: 2506503 - protein, 25 aa, Entamoeba dispar
TISKIGDDCFRWCSSLQTIKIPSTV

SEQ ID NO: 2506504 - protein, 19 aa, Entamoeba dispar
TISKIGWNCFYECSSLISI

SEQ ID NO: 2506505 - protein, 26 aa, Entamoeba dispar
TISKLSPKCPIHIVDYQLNIHSTLII

SEQ ID NO: 2506506 - protein, 25 aa, Entamoeba dispar
TISLYKAHWDAMDFVRMHEAANETF

SEQ ID NO: 2506507 - protein, 20 aa, Entamoeba dispar
TISREVPCQFAMSLTGGYYI

SEQ ID NO: 2506508 - protein, 22 aa, Entamoeba dispar
TISTRRRWILLTSLKTVHNINE

SEQ ID NO: 2506509 - protein, 18 aa, Entamoeba dispar
TISYLKKELELLRKGVKY

SEQ ID NO: 2506510 - protein, 20 aa, Entamoeba dispar
TISYRNKLLYSIRDINRKAS

SEQ ID NO: 2506511 - protein, 24 aa, Entamoeba dispar
TITHPILCGYYYILYEEKDSTETC

SEQ ID NO: 2506512 - protein, 18 aa, Entamoeba dispar
TITKEMENILGLNQPQNL

SEQ ID NO: 2506513 - protein, 21 aa, Entamoeba dispar
TITKIGFDCFKGCKSLKSITI

SEQ ID NO: 2506514 - protein, 27 aa, Entamoeba dispar
TITKIGWSCFSGCPWLNEVIIPSSVSK

SEQ ID NO: 2506515 - protein, 38 aa, Entamoeba dispar
TITLRFQNYYFFKEKVSFRVIRCLEPFVKESENEYMIA

SEQ ID NO: 2506516 - protein, 26 aa, Entamoeba dispar
TITMERLRFSSFFVQSVKGRSNVMFI

SEQ ID NO: 2506517 - protein, 23 aa, Entamoeba dispar
TITMPIKIMFIKFLANSFITTPP

SEQ ID NO: 2506518 - protein, 25 aa, Entamoeba dispar
TITPREFKYAIGEFAPQFSGYQQHD

SEQ ID NO: 2506519 - protein, 24 aa, Entamoeba dispar
TITRCFKRHGAVTIDTPVFELKDI

SEQ ID NO: 2506520 - protein, 19 aa, Entamoeba dispar
TITSIGVGCFEYCSSLQSI

SEQ ID NO: 2506521 - protein, 18 aa, Entamoeba dispar
TITTIIIPIVLKLLTDKV

SEQ ID NO: 2506522 - protein, 27 aa, Entamoeba dispar
TIVDWNKIIGWCEEWNKIDIQMNNKEE

SEQ ID NO: 2506523 - protein, 22 aa, Entamoeba dispar
TIVECDRYLLGHDYPMIKIATI

SEQ ID NO: 2506524 - protein, 20 aa, Entamoeba dispar
TIVKCIELLLTKEDLITEDI

SEQ ID NO: 2506525 - protein, 18 aa, Entamoeba dispar
TIVKRICYLFNDSILFVR

SEQ ID NO: 2506526 - protein, 27 aa, Entamoeba dispar
TIVNEIGSWCFYKCYSLTSINIPTRIN

SEQ ID NO: 2506527 - protein, 22 aa, Entamoeba dispar
TIVTEFPCADIALSPNQFKLLL

SEQ ID NO: 2506528 - protein, 17 aa, Entamoeba dispar
TIYDVSFCEVTRRINPY

SEQ ID NO: 2506529 - protein, 25 aa, Entamoeba dispar
TIYTLLIRRMKLCSFLILTKNDDEI

SEQ ID NO: 2506530 - protein, 21 aa, Entamoeba dispar
TIYYQWEWEEVKGVFFSSRWT

SEQ ID NO: 2506531 - protein, 25 aa, Entamoeba dispar
TKAECTDCAIAINPIFECQQLHGDI

SEQ ID NO: 2506532 - protein, 17 aa, Entamoeba dispar
TKAICEIMKCPSEKSAE

SEQ ID NO: 2506533 - protein, 25 aa, Entamoeba dispar
TKAIKRKCIDDCFGIFSKYKRLCIH

SEQ ID NO: 2506534 - protein, 22 aa, Entamoeba dispar
TKAKRLKRCCVIMKEQFNNQVP

SEQ ID NO: 2506535 - protein, 22 aa, Entamoeba dispar
TKAKTAPRRGLVRMAGMIGLTR

SEQ ID NO: 2506536 - protein, 18 aa, Entamoeba dispar
TKAVLKLNLLNEVTEYLK

SEQ ID NO: 2506537 - protein, 19 aa, Entamoeba dispar
TKAVLKLNLLNEVTEYLKV

SEQ ID NO: 2506538 - protein, 20 aa, Entamoeba dispar
TKCCPICKFETIMTSSLKST

SEQ ID NO: 2506539 - protein, 17 aa, Entamoeba dispar
TKCKEIVTSFFKHLVNS

SEQ ID NO: 2506540 - protein, 19 aa, Entamoeba dispar
TKCKYKLQKCLKRCKHFEL

SEQ ID NO: 2506541 - protein, 20 aa, Entamoeba dispar
TKCYNCFPPVMIEKSKIRKR

SEQ ID NO: 2506542 - protein, 17 aa, Entamoeba dispar
TKDEWDFDLELSPQEIN

SEQ ID NO: 2506543 - protein, 21 aa, Entamoeba dispar
TKDIMNLYLVFGTSSSFNKKF

SEQ ID NO: 2506544 - protein, 26 aa, Entamoeba dispar
TKDKIKKFIESFGVIIFSIKIDTNKI

SEQ ID NO: 2506545 - protein, 22 aa, Entamoeba dispar
TKDMPDWYFKIVSMGWDQQPLN

SEQ ID NO: 2506546 - protein, 23 aa, Entamoeba dispar
TKDNICVKFSFLKNREERKSICT

SEQ ID NO: 2506547 - protein, 21 aa, Entamoeba dispar
TKDTFPLKERIIIEHSTHDFR

SEQ ID NO: 2506548 - protein, 19 aa, Entamoeba dispar
TKEDFVHMIMVSKKYQELP

SEQ ID NO: 2506549 - protein, 27 aa, Entamoeba dispar
TKEDLEIDPALLLKHAQRVMVDEPEET

SEQ ID NO: 2506550 - protein, 24 aa, Entamoeba dispar
TKEECEAWNSLIFDQVERVNVLAK

SEQ ID NO: 2506551 - protein, 21 aa, Entamoeba dispar
TKEEISSIFKLICFSHEIGSY

SEQ ID NO: 2506552 - protein, 25 aa, Entamoeba dispar
TKEEITQCFQIFKQIHFQISKRCCT

SEQ ID NO: 2506553 - protein, 19 aa, Entamoeba dispar
TKEELRIWEPKKLIQEKRN

SEQ ID NO: 2506554 - protein, 22 aa, Entamoeba dispar
TKEEVEKVFSILGITMESDIDL

SEQ ID NO: 2506555 - protein, 24 aa, Entamoeba dispar
TKEIEIKRLLPFLEDKIIEKGIDK

SEQ ID NO: 2506556 - protein, 17 aa, Entamoeba dispar
TKEIITWTTGNPSDANK

SEQ ID NO: 2506557 - protein, 25 aa, Entamoeba dispar
TKEIKEILNGFGLRQPMETRIIVGT

SEQ ID NO: 2506558 - protein, 21 aa, Entamoeba dispar
TKEKRIEALKVISDKVKLKRI

SEQ ID NO: 2506559 - protein, 17 aa, Entamoeba dispar
TKELCEGFIDLAKYADL

SEQ ID NO: 2506560 - protein, 17 aa, Entamoeba dispar
TKELDLNAICFVAQSSN

SEQ ID NO: 2506561 - protein, 18 aa, Entamoeba dispar
TKEMKAWLWNDLLGMESI

SEQ ID NO: 2506562 - protein, 18 aa, Entamoeba dispar
TKENSFAYIYAIKQQLND

SEQ ID NO: 2506563 - protein, 24 aa, Entamoeba dispar
TKENTFKSIERWLSELKDNADPKI

SEQ ID NO: 2506564 - protein, 19 aa, Entamoeba dispar
TKEPFKYSTLQFELENKKS

SEQ ID NO: 2506565 - protein, 19 aa, Entamoeba dispar
TKEQIIWVALEQVYPLSHR

SEQ ID NO: 2506566 - protein, 21 aa, Entamoeba dispar
TKESTYLVACESMEDKSKYIN

SEQ ID NO: 2506567 - protein, 18 aa, Entamoeba dispar
TKETDLFKPRGKFVEDSR

SEQ ID NO: 2506568 - protein, 29 aa, Entamoeba dispar
TKETKGRIGYELIKRIPYGGMICNTARKE

SEQ ID NO: 2506569 - protein, 27 aa, Entamoeba dispar
TKETSNCFIQFKCMKYINLALFTSNSN

SEQ ID NO: 2506570 - protein, 19 aa, Entamoeba dispar
TKEVALAWVDVTLRLQKTF

SEQ ID NO: 2506571 - protein, 28 aa, Entamoeba dispar
TKEVLLFIRIQWIFIHLCNCKNPYEPNK

SEQ ID NO: 2506572 - protein, 27 aa, Entamoeba dispar
TKFADIPVLLMIPWKDDPLYKVYYFVS

SEQ ID NO: 2506573 - protein, 20 aa, Entamoeba dispar
TKFKEFSVINNFWNKQHEFI

SEQ ID NO: 2506574 - protein, 19 aa, Entamoeba dispar
TKFKVGYNSSLFRKGNYAC

SEQ ID NO: 2506575 - protein, 24 aa, Entamoeba dispar
TKFNLKYFDCYELNLNENYVVLDH

SEQ ID NO: 2506576 - protein, 23 aa, Entamoeba dispar
TKFTCCHFFNGRTKKYECINYLN

SEQ ID NO: 2506577 - protein, 17 aa, Entamoeba dispar
TKFYATQIILALEHLHN

SEQ ID NO: 2506578 - protein, 26 aa, Entamoeba dispar
TKFYGECPFFPTPIPERIQHVVISSG

SEQ ID NO: 2506579 - protein, 20 aa, Entamoeba dispar
TKGFFVYGIEQTRLRERFKR

SEQ ID NO: 2506580 - protein, 29 aa, Entamoeba dispar
TKGGSKLLKEWILRIEIDKYIIKERQEFQ

SEQ ID NO: 2506581 - protein, 19 aa, Entamoeba dispar
TKGIDWKVNLLEINSSSFF

SEQ ID NO: 2506582 - protein, 24 aa, Entamoeba dispar
TKGLKEWGSAILVGFNGDPNGKDD

SEQ ID NO: 2506583 - protein, 30 aa, Entamoeba dispar
TKGTFCSKSRRLLFKCLLMIISQSEDLTEY

SEQ ID NO: 2506584 - protein, 18 aa, Entamoeba dispar
TKGTVLLKDAEQFKNFSK

SEQ ID NO: 2506585 - protein, 19 aa, Entamoeba dispar
TKHAIRWGVPVLSQQWLFD

SEQ ID NO: 2506586 - protein, 18 aa, Entamoeba dispar
TKHIFKQIMEGVLYMHEN

SEQ ID NO: 2506587 - protein, 20 aa, Entamoeba dispar
TKHYFCPISKIYRTPPIPSK

SEQ ID NO: 2506588 - protein, 18 aa, Entamoeba dispar
TKIEMLDNYISFIGDEII

SEQ ID NO: 2506589 - protein, 26 aa, Entamoeba dispar
TKIERIDIKTGFCFVVCETEEDAKKI

SEQ ID NO: 2506590 - protein, 24 aa, Entamoeba dispar
TKIFKRLFRVYAHMFYSHANHLKE

SEQ ID NO: 2506591 - protein, 19 aa, Entamoeba dispar
TKIGEPLTWSSWFSNEKGR

SEQ ID NO: 2506592 - protein, 23 aa, Entamoeba dispar
TKIKCITSPSIFDRIHIKEGVYI

SEQ ID NO: 2506593 - protein, 29 aa, Entamoeba dispar
TKILFTSSDWSCWGGYPGALMTYYSTELI

SEQ ID NO: 2506594 - protein, 24 aa, Entamoeba dispar
TKIPKLSGKTIRPPVIETQNNTDE

SEQ ID NO: 2506595 - protein, 17 aa, Entamoeba dispar
TKISETFIIKCKPGDKI

SEQ ID NO: 2506596 - protein, 25 aa, Entamoeba dispar
TKITRSSLFLAYLIENPFNREICLL

SEQ ID NO: 2506597 - protein, 25 aa, Entamoeba dispar
TKIYKRMFRVYAHMFYSHMEHLKEV

SEQ ID NO: 2506598 - protein, 18 aa, Entamoeba dispar
TKIYMPPEYFYEGVEETT

SEQ ID NO: 2506599 - protein, 21 aa, Entamoeba dispar
TKKARDCLFNGDLDELEDAMV

SEQ ID NO: 2506600 - protein, 22 aa, Entamoeba dispar
TKKARVKDIWGAGVHKKKYHLP

SEQ ID NO: 2506601 - protein, 26 aa, Entamoeba dispar
TKKCEGIECPICLQLTRNVMTTQCGH

SEQ ID NO: 2506602 - protein, 24 aa, Entamoeba dispar
TKKDTRKYYSLKNMEIEEYPHTWT

SEQ ID NO: 2506603 - protein, 19 aa, Entamoeba dispar
TKKFLKGYFEKNGVNYYDA

SEQ ID NO: 2506604 - protein, 23 aa, Entamoeba dispar
TKKFSLQFALKCAEERGLKEVKI

SEQ ID NO: 2506605 - protein, 22 aa, Entamoeba dispar
TKKGPLAKVWIAAHWEGKLTKQ

SEQ ID NO: 2506606 - protein, 29 aa, Entamoeba dispar
TKKHLHKIKWLLPSLRELFRRNDRRCSKK

SEQ ID NO: 2506607 - protein, 18 aa, Entamoeba dispar
TKKKEIKYILKLLEELLI

SEQ ID NO: 2506608 - protein, 20 aa, Entamoeba dispar
TKKKIVLVCQCSGKYRSCSY

SEQ ID NO: 2506609 - protein, 22 aa, Entamoeba dispar
TKKKRWCILTKNKLFYFNCKPE

SEQ ID NO: 2506610 - protein, 18 aa, Entamoeba dispar
TKKMFWISDGYRVNGDGK

SEQ ID NO: 2506611 - protein, 19 aa, Entamoeba dispar
TKKNFAMLLKSLIKANPKP

SEQ ID NO: 2506612 - protein, 25 aa, Entamoeba dispar
TKKQELPKILSFWEKQKMFLFNLNQ

SEQ ID NO: 2506613 - protein, 24 aa, Entamoeba dispar
TKKQKRLSAHFGVEIGAEDQFFFE

SEQ ID NO: 2506614 - protein, 25 aa, Entamoeba dispar
TKKQVFRYILGFTDFAFFQPTVFGI

SEQ ID NO: 2506615 - protein, 21 aa, Entamoeba dispar
TKKSKGFGFVLFVVPQDAVKA

SEQ ID NO: 2506616 - protein, 21 aa, Entamoeba dispar
TKLCNHPALISKYLMEEKISL

SEQ ID NO: 2506617 - protein, 17 aa, Entamoeba dispar
TKLEGIIGTVIHQQGID

SEQ ID NO: 2506618 - protein, 17 aa, Entamoeba dispar
TKLGDAVSYEINQKKLF

SEQ ID NO: 2506619 - protein, 25 aa, Entamoeba dispar
TKLLHLGFHKLPFIPKESAELFYFR

SEQ ID NO: 2506620 - protein, 24 aa, Entamoeba dispar
TKLPRKRLRDVSARLDYYKQLQNN

SEQ ID NO: 2506621 - protein, 23 aa, Entamoeba dispar
TKLPSEEPLSIGIKENIPSKHKN

SEQ ID NO: 2506622 - protein, 23 aa, Entamoeba dispar
TKLPTLIPRLINFMLEHPTFPIA

SEQ ID NO: 2506623 - protein, 20 aa, Entamoeba dispar
TKLQCSNLIKEMDKQNTNHP

SEQ ID NO: 2506624 - protein, 26 aa, Entamoeba dispar
TKLRSEGIFDDSHWVPIKVNTEIKTS

SEQ ID NO: 2506625 - protein, 27 aa, Entamoeba dispar
TKLTIYLRKLFYLYALKYPFDSVDIVH

SEQ ID NO: 2506626 - protein, 28 aa, Entamoeba dispar
TKLYTAPEMLKFITAKTYKGKKRIEFLK

SEQ ID NO: 2506627 - protein, 17 aa, Entamoeba dispar
TKMELKDVFRGHNSSVF

SEQ ID NO: 2506628 - protein, 25 aa, Entamoeba dispar
TKMFTPCMLPCDWVEAEDKTTNDIY

SEQ ID NO: 2506629 - protein, 22 aa, Entamoeba dispar
TKMGENRICRFMMDGHNESLKY

SEQ ID NO: 2506630 - protein, 30 aa, Entamoeba dispar
TKMVRELYCGLIQLFCNLFEKEKNALQQIV

SEQ ID NO: 2506631 - protein, 23 aa, Entamoeba dispar
TKNCILSIPFEEGGGCNLYIEGI

SEQ ID NO: 2506632 - protein, 24 aa, Entamoeba dispar
TKNEVFGGYCSDVPVVDDIARGVF

SEQ ID NO: 2506633 - protein, 25 aa, Entamoeba dispar
TKNHLFKNLNWVGSILGNPTIIFDY

SEQ ID NO: 2506634 - protein, 24 aa, Entamoeba dispar
TKNIKCLYSLILTRVKLEELIIFE

SEQ ID NO: 2506635 - protein, 17 aa, Entamoeba dispar
TKNKIIFPEQITKPDIP

SEQ ID NO: 2506636 - protein, 25 aa, Entamoeba dispar
TKNKQRMSVKLSELVSNTTNDIYES

SEQ ID NO: 2506637 - protein, 19 aa, Entamoeba dispar
TKNKYIWKILRNVSDKCSP

SEQ ID NO: 2506638 - protein, 17 aa, Entamoeba dispar
TKNLILLYPNYIKTIYT

SEQ ID NO: 2506639 - protein, 26 aa, Entamoeba dispar
TKNTRFCLICNYISRILPPISSRCIK

SEQ ID NO: 2506640 - protein, 28 aa, Entamoeba dispar
TKNVVVKFYVPWCNICKSIQSKYEQLID

SEQ ID NO: 2506641 - protein, 26 aa, Entamoeba dispar
TKPGVPRIWVDGCFDMFHWGHANVIR

SEQ ID NO: 2506642 - protein, 22 aa, Entamoeba dispar
TKPLPSREVVPITLPQPDSEKC

SEQ ID NO: 2506643 - protein, 18 aa, Entamoeba dispar
TKQEGWYLIIIKPDGGLA

SEQ ID NO: 2506644 - protein, 26 aa, Entamoeba dispar
TKQLRLNQIIGREWYCQTSCTINGDG

SEQ ID NO: 2506645 - protein, 19 aa, Entamoeba dispar
TKQRSDVVMKFAQDAINDM

SEQ ID NO: 2506646 - protein, 21 aa, Entamoeba dispar
TKQSLPIKMSECIQENKRTTD

SEQ ID NO: 2506647 - protein, 18 aa, Entamoeba dispar
TKRAIYLGMLKNILELLN

SEQ ID NO: 2506648 - protein, 20 aa, Entamoeba dispar
TKRFLGEDGNRIFDKLEEIT

SEQ ID NO: 2506649 - protein, 31 aa, Entamoeba dispar
TKRIFNEYVQLCFVKGMSLLMKGYEEHLGIM

SEQ ID NO: 2506650 - protein, 21 aa, Entamoeba dispar
TKRIKTLVIVSDTKMGKTEFV

SEQ ID NO: 2506651 - protein, 24 aa, Entamoeba dispar
TKRKEEYHPYLLFCKENRDRVKAE

SEQ ID NO: 2506652 - protein, 25 aa, Entamoeba dispar
TKRPKSFKARPIINHADGTKQTFWY

SEQ ID NO: 2506653 - protein, 20 aa, Entamoeba dispar
TKRTPPIKIIDTPGFGDTRG

SEQ ID NO: 2506654 - protein, 31 aa, Entamoeba dispar
TKSELKEIVQWPVLHPELFKQYGQPPSRGVL

SEQ ID NO: 2506655 - protein, 22 aa, Entamoeba dispar
TKSEQDIICGVSATMMNKRTKN

SEQ ID NO: 2506656 - protein, 24 aa, Entamoeba dispar
TKSGEWKLGGLQYVTQLGQLGDFK

SEQ ID NO: 2506657 - protein, 23 aa, Entamoeba dispar
TKSICLQTLLLVLFRTDNPCGIT

SEQ ID NO: 2506658 - protein, 31 aa, Entamoeba dispar
TKSKPFLKRNLCVCLGRIALRKPELIIPHIT

SEQ ID NO: 2506659 - protein, 28 aa, Entamoeba dispar
TKSKWKIPYQLIDSFGFDGNNIVVALKV

SEQ ID NO: 2506660 - protein, 25 aa, Entamoeba dispar
TKSMLNKWVLIKSIQFNKYSSFITL

SEQ ID NO: 2506661 - protein, 32 aa, Entamoeba dispar
TKSPIYQHGCSWAWKLMDGNAPLSFNEYTIEL

SEQ ID NO: 2506662 - protein, 17 aa, Entamoeba dispar
TKSQMIIINSLSQLIQG

SEQ ID NO: 2506663 - protein, 25 aa, Entamoeba dispar
TKSRICSKLSLLLSYISQEDIIQTN

SEQ ID NO: 2506664 - protein, 20 aa, Entamoeba dispar
TKSVTLFAAELMKYSQGNYE

SEQ ID NO: 2506665 - protein, 19 aa, Entamoeba dispar
TKTILPYFFRTLKIDSSSQ

SEQ ID NO: 2506666 - protein, 20 aa, Entamoeba dispar
TKTKLEGIFGNKPIMGGPTP

SEQ ID NO: 2506667 - protein, 20 aa, Entamoeba dispar
TKTKLVYDILKKGSYKKGSG

SEQ ID NO: 2506668 - protein, 18 aa, Entamoeba dispar
TKTLCDYSYEYSFITYGD

SEQ ID NO: 2506669 - protein, 26 aa, Entamoeba dispar
TKTLKDSFNVIAPIRMKKVAEMISKK

SEQ ID NO: 2506670 - protein, 24 aa, Entamoeba dispar
TKTPKIHPIYSYKTNLSYHTSVQW

SEQ ID NO: 2506671 - protein, 30 aa, Entamoeba dispar
TKTSLPSLFCRYKLLPFYIDLFRSNMPEAS

SEQ ID NO: 2506672 - protein, 18 aa, Entamoeba dispar
TKTVISFNHFTIKKDFPS

SEQ ID NO: 2506673 - protein, 19 aa, Entamoeba dispar
TKVCSYLVRLIQRYNNKIK

SEQ ID NO: 2506674 - protein, 18 aa, Entamoeba dispar
TKVFELHFYPLLQQYLYS

SEQ ID NO: 2506675 - protein, 24 aa, Entamoeba dispar
TKVIEFKSPITIKNLFYLICNIIF

SEQ ID NO: 2506676 - protein, 24 aa, Entamoeba dispar
TKVKEIIDRYGVLHMTCSAKTGTN

SEQ ID NO: 2506677 - protein, 19 aa, Entamoeba dispar
TKVKNLLMIISYLEKNQNN

SEQ ID NO: 2506678 - protein, 33 aa, Entamoeba dispar
TKVPTLRWVELEYCIKYPLKILQIDQQHMPLFH

SEQ ID NO: 2506679 - protein, 17 aa, Entamoeba dispar
TKWFCSKIRKLRININF

SEQ ID NO: 2506680 - protein, 25 aa, Entamoeba dispar
TKWTQSCIVLPNFLILPVQRLPRYI

SEQ ID NO: 2506681 - protein, 20 aa, Entamoeba dispar
TKYKMGLRMIQLKKLDKAIE

SEQ ID NO: 2506682 - protein, 19 aa, Entamoeba dispar
TKYLLLWLDFLMKDIESNL

SEQ ID NO: 2506683 - protein, 22 aa, Entamoeba dispar
TKYLLMWLDFLIKDVESNLIDS

SEQ ID NO: 2506684 - protein, 22 aa, Entamoeba dispar
TKYPFLPNFLKLEEFSTIPPSF

SEQ ID NO: 2506685 - protein, 20 aa, Entamoeba dispar
TKYSVYRIDPMMSLNEILET

SEQ ID NO: 2506686 - protein, 17 aa, Entamoeba dispar
TKYTCVATHSLFSKNYL

SEQ ID NO: 2506687 - protein, 24 aa, Entamoeba dispar
TLACKRGFLPIAEYLLFHSNGLAP

SEQ ID NO: 2506688 - protein, 31 aa, Entamoeba dispar
TLAHNVNCLRWSKDGKLLACGCDDSSVTIYK

SEQ ID NO: 2506689 - protein, 24 aa, Entamoeba dispar
TLAIELCKYLPNAIGEFRKLIPNL

SEQ ID NO: 2506690 - protein, 25 aa, Entamoeba dispar
TLAKVSPRILFQMGITENEEQMKLV

SEQ ID NO: 2506691 - protein, 18 aa, Entamoeba dispar
TLAMIYIKYIEYVSNLFK

SEQ ID NO: 2506692 - protein, 23 aa, Entamoeba dispar
TLARLIGGFLCNAAGEKETQIQF

SEQ ID NO: 2506693 - protein, 17 aa, Entamoeba dispar
TLCKLIKGYFEKSFIEL

SEQ ID NO: 2506694 - protein, 26 aa, Entamoeba dispar
TLDDFCGGSMGLLAVRQSELLIVLSN

SEQ ID NO: 2506695 - protein, 22 aa, Entamoeba dispar
TLDDRKKLLWGYYHNHQSQVLK

SEQ ID NO: 2506696 - protein, 19 aa, Entamoeba dispar
TLDFYELINMIGHTKKITQ

SEQ ID NO: 2506697 - protein, 21 aa, Entamoeba dispar
TLDGYYRKALFVDFVADQIKA

SEQ ID NO: 2506698 - protein, 20 aa, Entamoeba dispar
TLDLKWLKYLIYDETDKLLT

SEQ ID NO: 2506699 - protein, 17 aa, Entamoeba dispar
TLDRIAVINDRCKPGKC

SEQ ID NO: 2506700 - protein, 25 aa, Entamoeba dispar
TLDRKDVVEQLLLYQAMLHKNNLEM

SEQ ID NO: 2506701 - protein, 20 aa, Entamoeba dispar
TLDVCCCFIEKHGIKVLSNG

SEQ ID NO: 2506702 - protein, 25 aa, Entamoeba dispar
TLEALKKKRFDEFINGLTEISFKLK

SEQ ID NO: 2506703 - protein, 17 aa, Entamoeba dispar
TLEECFETFEAEELMDE

SEQ ID NO: 2506704 - protein, 23 aa, Entamoeba dispar
TLEEICSLNMSFNSHYLNTPNIG

SEQ ID NO: 2506705 - protein, 25 aa, Entamoeba dispar
TLEFHYYLWKVFEFEMKKLNLDTNV

SEQ ID NO: 2506706 - protein, 26 aa, Entamoeba dispar
TLEFLHNCAPFIAKLYLLVNSPQSNS

SEQ ID NO: 2506707 - protein, 24 aa, Entamoeba dispar
TLEGFKERFYKGGEGVDHKELTIK

SEQ ID NO: 2506708 - protein, 18 aa, Entamoeba dispar
TLEKCIIDEFPFDNIEIA

SEQ ID NO: 2506709 - protein, 17 aa, Entamoeba dispar
TLEKVFVHYNLMNEKVL

SEQ ID NO: 2506710 - protein, 18 aa, Entamoeba dispar
TLETCRAVVNTDLLADLN

SEQ ID NO: 2506711 - protein, 27 aa, Entamoeba dispar
TLFAHLIDCLKYIYSVQEQCELISDNK

SEQ ID NO: 2506712 - protein, 25 aa, Entamoeba dispar
TLFDCFPLAALIEGNGLGRFLCTHG

SEQ ID NO: 2506713 - protein, 20 aa, Entamoeba dispar
TLFFEMIKPSTMYFIAQEDE

SEQ ID NO: 2506714 - protein, 24 aa, Entamoeba dispar
TLFGKSCFRGCGCEEVLRQNERLP

SEQ ID NO: 2506715 - protein, 24 aa, Entamoeba dispar
TLFGRGCFYKCGCEEILKMNKRIP

SEQ ID NO: 2506716 - protein, 18 aa, Entamoeba dispar
TLFINPYFTSLINCESDI

SEQ ID NO: 2506717 - protein, 30 aa, Entamoeba dispar
TLFKKVKGSCKVYKKYCKFIMRNNREEEIK

SEQ ID NO: 2506718 - protein, 25 aa, Entamoeba dispar
TLFKLKRINEFGAQMLLMDYSQGKN

SEQ ID NO: 2506719 - protein, 21 aa, Entamoeba dispar
TLFRRGCFYKCGCEEELKQNK

SEQ ID NO: 2506720 - protein, 23 aa, Entamoeba dispar
TLFRRGCFYKCGCEEELKQNKRI

SEQ ID NO: 2506721 - protein, 35 aa, Entamoeba dispar
TLGRGDGIYNWIFGGLRNWNLRGLLVYKESISAYD

SEQ ID NO: 2506722 - protein, 17 aa, Entamoeba dispar
TLHCSLQRFLSLKEQTN

SEQ ID NO: 2506723 - protein, 19 aa, Entamoeba dispar
TLHGQAFVFPLSINQNNNF

SEQ ID NO: 2506724 - protein, 33 aa, Entamoeba dispar
TLHLKRKDVIAIYLPNCIPFIIMEAVIESSGFI

SEQ ID NO: 2506725 - protein, 24 aa, Entamoeba dispar
TLHPFNPLAEMVIRMEFNRVTHLG

SEQ ID NO: 2506726 - protein, 25 aa, Entamoeba dispar
TLHPSHLPILLPIIQLIPFDRIPNS

SEQ ID NO: 2506727 - protein, 17 aa, Entamoeba dispar
TLHWELQTWVPLGTYLL

SEQ ID NO: 2506728 - protein, 17 aa, Entamoeba dispar
TLIAKYCSYKIGKQVYY

SEQ ID NO: 2506729 - protein, 28 aa, Entamoeba dispar
TLIFLFRVEPYMKMHIQFFDGHFDTDRL

SEQ ID NO: 2506730 - protein, 21 aa, Entamoeba dispar
TLIFREYELVFILRGHNDSVT

SEQ ID NO: 2506731 - protein, 23 aa, Entamoeba dispar
TLIKELITFGLFVPHNDELRSTE

SEQ ID NO: 2506732 - protein, 17 aa, Entamoeba dispar
TLIKSMVLNFLYLEQQT

SEQ ID NO: 2506733 - protein, 18 aa, Entamoeba dispar
TLILRFAISELSAEGLSA

SEQ ID NO: 2506734 - protein, 24 aa, Entamoeba dispar
TLINFFTVRGCDLISLNLNSCLAL

SEQ ID NO: 2506735 - protein, 18 aa, Entamoeba dispar
TLINRMMEEYAQKYPFVC

SEQ ID NO: 2506736 - protein, 18 aa, Entamoeba dispar
TLIRRLKRSLPKGESIFV

SEQ ID NO: 2506737 - protein, 18 aa, Entamoeba dispar
TLKCIKLITRYHANDSSQ

SEQ ID NO: 2506738 - protein, 21 aa, Entamoeba dispar
TLKCMKDILKDEGHDISISYL

SEQ ID NO: 2506739 - protein, 21 aa, Entamoeba dispar
TLKFSEGVSEWKVFDKHFTVM

SEQ ID NO: 2506740 - protein, 26 aa, Entamoeba dispar
TLKHGLNWMNQWACSRNFGLGTLIPW

SEQ ID NO: 2506741 - protein, 21 aa, Entamoeba dispar
TLKIIHNMYIRGYKAKEIAII

SEQ ID NO: 2506742 - protein, 23 aa, Entamoeba dispar
TLKKRGSGLSGLSFKSESNESSV

SEQ ID NO: 2506743 - protein, 18 aa, Entamoeba dispar
TLKNSGYLDIVFANQNDE

SEQ ID NO: 2506744 - protein, 25 aa, Entamoeba dispar
TLKRCKGVSSWKVFNKEGEELTIKP

SEQ ID NO: 2506745 - protein, 23 aa, Entamoeba dispar
TLKSISLIMKWMLSNELKEDSSW

SEQ ID NO: 2506746 - protein, 34 aa, Entamoeba dispar
TLKTWDVNKGYCLKTTVCFSSCNCMMMGGMGNLV

SEQ ID NO: 2506747 - protein, 19 aa, Entamoeba dispar
TLKVLKTEVFNFLDKKKQI

SEQ ID NO: 2506748 - protein, 19 aa, Entamoeba dispar
TLKVWNRRIVFGGNDRQIG

SEQ ID NO: 2506749 - protein, 17 aa, Entamoeba dispar
TLLACKLAGIKNVELAN

SEQ ID NO: 2506750 - protein, 17 aa, Entamoeba dispar
TLLACKLAGIKNVSIED

SEQ ID NO: 2506751 - protein, 17 aa, Entamoeba dispar
TLLACKLAGIKNVSLAN

SEQ ID NO: 2506752 - protein, 18 aa, Entamoeba dispar
TLLIDSCINSSEIQNHFP

SEQ ID NO: 2506753 - protein, 21 aa, Entamoeba dispar
TLLIHLALRLTVYSQKLHSKD

SEQ ID NO: 2506754 - protein, 17 aa, Entamoeba dispar
TLLLEGLNSFVSSIQQL

SEQ ID NO: 2506755 - protein, 22 aa, Entamoeba dispar
TLLLRKLKVILLLPSLNSNNRN

SEQ ID NO: 2506756 - protein, 24 aa, Entamoeba dispar
TLLNTRLKQYFSQWKKMTSLENEA

SEQ ID NO: 2506757 - protein, 24 aa, Entamoeba dispar
TLLPFPSIIEDWFYLQPTPFTDNV

SEQ ID NO: 2506758 - protein, 17 aa, Entamoeba dispar
TLLSLSLSRHIPIPLDI

SEQ ID NO: 2506759 - protein, 23 aa, Entamoeba dispar
TLLTICVLLNWTFKPPVTRAFVS

SEQ ID NO: 2506760 - protein, 20 aa, Entamoeba dispar
TLLYCLNINPVIRYINKPNE

SEQ ID NO: 2506761 - protein, 17 aa, Entamoeba dispar
TLMDVCCTFTSATELLK

SEQ ID NO: 2506762 - protein, 25 aa, Entamoeba dispar
TLMNATNLSICWTPVLFDMTTFLLK

SEQ ID NO: 2506763 - protein, 22 aa, Entamoeba dispar
TLMSELIFEILIKKKAFDGKED

SEQ ID NO: 2506764 - protein, 18 aa, Entamoeba dispar
TLMYCLSNIIACKQGNAA

SEQ ID NO: 2506765 - protein, 20 aa, Entamoeba dispar
TLNDVLLLWDEFILNSNKYL

SEQ ID NO: 2506766 - protein, 34 aa, Entamoeba dispar
TLNEWRRTQFCFVINRVNYFLTREEELLSDKKRY

SEQ ID NO: 2506767 - protein, 19 aa, Entamoeba dispar
TLNFFSLFHQICFQVNQRH

SEQ ID NO: 2506768 - protein, 26 aa, Entamoeba dispar
TLNPYESFTIAFPIHLKKEFVEEKVE

SEQ ID NO: 2506769 - protein, 21 aa, Entamoeba dispar
TLNQFCILSIQYLFYQKSKQE

SEQ ID NO: 2506770 - protein, 30 aa, Entamoeba dispar
TLNYAFRWFNCFLLREFSPEQGIRLFDTLI

SEQ ID NO: 2506771 - protein, 25 aa, Entamoeba dispar
TLPEGPKLMKFVIIHSSAKARKGLL

SEQ ID NO: 2506772 - protein, 34 aa, Entamoeba dispar
TLPGVVASLAMPDAHSGYGFSIGGVVAMRLDNSE

SEQ ID NO: 2506773 - protein, 20 aa, Entamoeba dispar
TLPKETRLTLSIYMTDTPIN

SEQ ID NO: 2506774 - protein, 23 aa, Entamoeba dispar
TLPNCGDVGIFLNCKKENVFVFG

SEQ ID NO: 2506775 - protein, 22 aa, Entamoeba dispar
TLPPIYWKYSFEDGIWSDQIPL

SEQ ID NO: 2506776 - protein, 17 aa, Entamoeba dispar
TLPQRFQSISKFQHPYI

SEQ ID NO: 2506777 - protein, 31 aa, Entamoeba dispar
TLPQRNLKILAFYMNLFYVFTINSDVHKMQA

SEQ ID NO: 2506778 - protein, 19 aa, Entamoeba dispar
TLPRSYRIKKFVVVDLPDV

SEQ ID NO: 2506779 - protein, 26 aa, Entamoeba dispar
TLQELLKIINIRAGIENVELSEQALL

SEQ ID NO: 2506780 - protein, 17 aa, Entamoeba dispar
TLQKLRGTYAYCAPEIY

SEQ ID NO: 2506781 - protein, 31 aa, Entamoeba dispar
TLQKVYNFVMGFGFDKFVLIDGVKKNEFTDL

SEQ ID NO: 2506782 - protein, 22 aa, Entamoeba dispar
TLQRKTYSTIPERYQLPPQPNF

SEQ ID NO: 2506783 - protein, 19 aa, Entamoeba dispar
TLRALQYIHEYGFIHRDIK

SEQ ID NO: 2506784 - protein, 30 aa, Entamoeba dispar
TLRECFPTFLSFFALPLVSAIPYTAVSLRL

SEQ ID NO: 2506785 - protein, 19 aa, Entamoeba dispar
TLREFKNICSLLPTETKQT

SEQ ID NO: 2506786 - protein, 27 aa, Entamoeba dispar
TLRFDYQKEFIKWCLKVPGYYPSWFVG

SEQ ID NO: 2506787 - protein, 20 aa, Entamoeba dispar
TLRLERIRKVFFNSKYLCSQ

SEQ ID NO: 2506788 - protein, 23 aa, Entamoeba dispar
TLRNVIWMICEYCNHYDEVINMF

SEQ ID NO: 2506789 - protein, 21 aa, Entamoeba dispar
TLRNVKFVAEKDLINSFMDNI

SEQ ID NO: 2506790 - protein, 22 aa, Entamoeba dispar
TLRPEEISAIILNEVKKAIIAR

SEQ ID NO: 2506791 - protein, 28 aa, Entamoeba dispar
TLRRLMKFPPVFALRPLIDMAVSICDRT

SEQ ID NO: 2506792 - protein, 21 aa, Entamoeba dispar
TLRVIECDIVRTFPEGAEYLF

SEQ ID NO: 2506793 - protein, 23 aa, Entamoeba dispar
TLRWTAKDAIKCSWLECVDTSKP

SEQ ID NO: 2506794 - protein, 24 aa, Entamoeba dispar
TLSCGHTFCYTCDLEYSMKYGNCY

SEQ ID NO: 2506795 - protein, 18 aa, Entamoeba dispar
TLSDAFRNFGNIISSVKI

SEQ ID NO: 2506796 - protein, 25 aa, Entamoeba dispar
TLSERLFVGSCCDLLRKDLTKRYLC

SEQ ID NO: 2506797 - protein, 17 aa, Entamoeba dispar
TLSFLIPIVQRLIELDK

SEQ ID NO: 2506798 - protein, 17 aa, Entamoeba dispar
TLSFLIPLFEIIKRERE

SEQ ID NO: 2506799 - protein, 17 aa, Entamoeba dispar
TLSLVGICTVPFLHQIR

SEQ ID NO: 2506800 - protein, 18 aa, Entamoeba dispar
TLSQYPIYPWVICSYDSK

SEQ ID NO: 2506801 - protein, 26 aa, Entamoeba dispar
TLSRCVLKKQFPLMTCLTYLNCNKTE

SEQ ID NO: 2506802 - protein, 29 aa, Entamoeba dispar
TLSSYKIIFPRIQYCKTLNSSTNIYKQLF

SEQ ID NO: 2506803 - protein, 29 aa, Entamoeba dispar
TLSYKHLLRLYGRMNLLLSQIDKKQQLKQ

SEQ ID NO: 2506804 - protein, 18 aa, Entamoeba dispar
TLTCDTIECLSCQRSDIT

SEQ ID NO: 2506805 - protein, 26 aa, Entamoeba dispar
TLTDRILPFISMLIQWEILHTNNKEN

SEQ ID NO: 2506806 - protein, 19 aa, Entamoeba dispar
TLTGFKWIGNKAKEIVDTQ

SEQ ID NO: 2506807 - protein, 23 aa, Entamoeba dispar
TLTGKLHIKVCLKQDNINNRVTF

SEQ ID NO: 2506808 - protein, 25 aa, Entamoeba dispar
TLTGMYRYKYKVIQQIRMCKDLKHI

SEQ ID NO: 2506809 - protein, 23 aa, Entamoeba dispar
TLTKGGEILSIFDARPPLNAQAN

SEQ ID NO: 2506810 - protein, 28 aa, Entamoeba dispar
TLTNLFCTRILYLIICITPVQYRLHIIS

SEQ ID NO: 2506811 - protein, 28 aa, Entamoeba dispar
TLTNYKIVFVVKCVIFNVSIPLTKIADF

SEQ ID NO: 2506812 - protein, 20 aa, Entamoeba dispar
TLTPIYEWFLLNTFSIEHSN

SEQ ID NO: 2506813 - protein, 18 aa, Entamoeba dispar
TLTSFKLLLSSCFRNEAM

SEQ ID NO: 2506814 - protein, 32 aa, Entamoeba dispar
TLTSLELVSCIKAGFLLPNLRLFRGDNSNIYI

SEQ ID NO: 2506815 - protein, 19 aa, Entamoeba dispar
TLTTLNMRGLRRMPDLTQH

SEQ ID NO: 2506816 - protein, 25 aa, Entamoeba dispar
TLVLSRAITNIGLIDCFVSIARCSQ

SEQ ID NO: 2506817 - protein, 19 aa, Entamoeba dispar
TLVNGWRMVDNNNQLIYIN

SEQ ID NO: 2506818 - protein, 19 aa, Entamoeba dispar
TLVNYAVTTIRGWFVELAH

SEQ ID NO: 2506819 - protein, 21 aa, Entamoeba dispar
  misc_feature (19)..(20): Xaa can be any naturally occurring amino acid
TLVRFEGVYGLNLLWNMLXXE

SEQ ID NO: 2506820 - protein, 24 aa, Entamoeba dispar
TLVVYSEPFIVYGVNLPNQSGGTA

SEQ ID NO: 2506821 - protein, 19 aa, Entamoeba dispar
TLWGDEIKNNIQFKEVVDR

SEQ ID NO: 2506822 - protein, 17 aa, Entamoeba dispar
TLYGSLRPFGCSLLIGG

SEQ ID NO: 2506823 - protein, 19 aa, Entamoeba dispar
TLYPHPWLIADAITTGKRP

SEQ ID NO: 2506824 - protein, 19 aa, Entamoeba dispar
TLYRIYRMNPVDLVGTENG

SEQ ID NO: 2506825 - protein, 23 aa, Entamoeba dispar
TLYSGLMNSCIGMYIKYNNYSEY

SEQ ID NO: 2506826 - protein, 24 aa, Entamoeba dispar
TLYSHRFFPYYSFSLLAGINSKGK

SEQ ID NO: 2506827 - protein, 21 aa, Entamoeba dispar
TLYTNCTKFIILDESDKLTKD

SEQ ID NO: 2506828 - protein, 23 aa, Entamoeba dispar
TMAEDFPLYYAIKKRNKDAVRIL

SEQ ID NO: 2506829 - protein, 19 aa, Entamoeba dispar
TMAGSRLSEKLDLEDYEEL

SEQ ID NO: 2506830 - protein, 18 aa, Entamoeba dispar
TMANCPYNIMSHNTPIEV

SEQ ID NO: 2506831 - protein, 25 aa, Entamoeba dispar
TMASILLQWCHANKFCIIYNSENQE

SEQ ID NO: 2506832 - protein, 30 aa, Entamoeba dispar
TMCFIFPFFDFWDHVCIVWTKCYYYTPKNR

SEQ ID NO: 2506833 - protein, 22 aa, Entamoeba dispar
TMDIRSIAWRIFLGALHGVCGN

SEQ ID NO: 2506834 - protein, 21 aa, Entamoeba dispar
TMEIKKPLFVIGLPRSGTTFL

SEQ ID NO: 2506835 - protein, 25 aa, Entamoeba dispar
TMERISEFLKVFVIALQRHGPQILL

SEQ ID NO: 2506836 - protein, 17 aa, Entamoeba dispar
TMEYLFKLYDAVDQTIT

SEQ ID NO: 2506837 - protein, 24 aa, Entamoeba dispar
TMFLLKEINYCILFDSHLLLSRIK

SEQ ID NO: 2506838 - protein, 17 aa, Entamoeba dispar
TMFSPPVLYEMKNGALY

SEQ ID NO: 2506839 - protein, 18 aa, Entamoeba dispar
TMIETMCFIFPFFDFWDH

SEQ ID NO: 2506840 - protein, 29 aa, Entamoeba dispar
TMIFKKAKELFEIGAYQGTIDWMKEYLMM

SEQ ID NO: 2506841 - protein, 35 aa, Entamoeba dispar
TMIFKKAKELFEIGAYQGTIDWMKEYLMMKGNKKE

SEQ ID NO: 2506842 - protein, 22 aa, Entamoeba dispar
TMKDRLKDGGYGISVSYLSKTI

SEQ ID NO: 2506843 - protein, 18 aa, Entamoeba dispar
TMKFPDYYIYTFEGECVY

SEQ ID NO: 2506844 - protein, 25 aa, Entamoeba dispar
TMKLKAVCGNLFIKDAQPMVWEIAV

SEQ ID NO: 2506845 - protein, 27 aa, Entamoeba dispar
TMKLYFKYLHLEKWFSIDQIILYDKSC

SEQ ID NO: 2506846 - protein, 24 aa, Entamoeba dispar
TMKQGRSSPIYKLMFKPVEDDSYF

SEQ ID NO: 2506847 - protein, 23 aa, Entamoeba dispar
TMKSGFCPVKRALSKGIKMGMGT

SEQ ID NO: 2506848 - protein, 21 aa, Entamoeba dispar
TMKTFRFERIETIFFEQKPIL

SEQ ID NO: 2506849 - protein, 19 aa, Entamoeba dispar
TMLSPFKNYLLHSSQNNIL

SEQ ID NO: 2506850 - protein, 24 aa, Entamoeba dispar
TMNDCKECIIDGYIHHKIVNIIEE

SEQ ID NO: 2506851 - protein, 24 aa, Entamoeba dispar
TMNFDHWDCLILLITIETIVFSLL

SEQ ID NO: 2506852 - protein, 17 aa, Entamoeba dispar
TMPKELNKFIIAGCRNP

SEQ ID NO: 2506853 - protein, 17 aa, Entamoeba dispar
TMSKAFKKIQMNYIQNE

SEQ ID NO: 2506854 - protein, 18 aa, Entamoeba dispar
TMTALCRNNYELTREDID

SEQ ID NO: 2506855 - protein, 18 aa, Entamoeba dispar
TMVECVRAALTADKIATE

SEQ ID NO: 2506856 - protein, 19 aa, Entamoeba dispar
TMVLIKVIGKLSIDNENPH

SEQ ID NO: 2506857 - protein, 27 aa, Entamoeba dispar
TMYGQTNCWIHPDINYKLFEMKNGEIA

SEQ ID NO: 2506858 - protein, 31 aa, Entamoeba dispar
TMYTELILKFMTFYLNLFFSRIELVDEEGWK

SEQ ID NO: 2506859 - protein, 22 aa, Entamoeba dispar
TNAFKPSLVYRNFSNIYNDNGD

SEQ ID NO: 2506860 - protein, 17 aa, Entamoeba dispar
TNAVGYCDCGIFRNGGF

SEQ ID NO: 2506861 - protein, 18 aa, Entamoeba dispar
TNCFKGKASYGIYLFLEK

SEQ ID NO: 2506862 - protein, 22 aa, Entamoeba dispar
TNCKSIKSSLQFSSSQTTVTKE

SEQ ID NO: 2506863 - protein, 17 aa, Entamoeba dispar
TNCSICRKQGVEGVNNL

SEQ ID NO: 2506864 - protein, 18 aa, Entamoeba dispar
TNCVKIVSSWLTTRGDTF

SEQ ID NO: 2506865 - protein, 19 aa, Entamoeba dispar
TNDAERMWEMKLFVEEKVK

SEQ ID NO: 2506866 - protein, 18 aa, Entamoeba dispar
TNDCLIKIASDYCWACFE

SEQ ID NO: 2506867 - protein, 18 aa, Entamoeba dispar
TNDLYFCMHELDTSELPK

SEQ ID NO: 2506868 - protein, 22 aa, Entamoeba dispar
TNDRKKKAFNIIDTNNEIIIQK

SEQ ID NO: 2506869 - protein, 23 aa, Entamoeba dispar
TNDRKKKAFNIIDTNNEIIIQKS

SEQ ID NO: 2506870 - protein, 18 aa, Entamoeba dispar
TNDVFVCTLSGCSSPTLR

SEQ ID NO: 2506871 - protein, 18 aa, Entamoeba dispar
TNDWVVKMYYSFQDEEYL

SEQ ID NO: 2506872 - protein, 19 aa, Entamoeba dispar
TNEASFKSLDTWKKEFLNG

SEQ ID NO: 2506873 - protein, 23 aa, Entamoeba dispar
TNECVLCPVCIEEGIPDVGEMLV

SEQ ID NO: 2506874 - protein, 27 aa, Entamoeba dispar
TNEFIMLCCDILKFLFDTVPDLYQRLK

SEQ ID NO: 2506875 - protein, 23 aa, Entamoeba dispar
TNEFKEVYGCIGNVINYEDYESS

SEQ ID NO: 2506876 - protein, 23 aa, Entamoeba dispar
TNEFRKVFFSTVVKIRELLFSDE

SEQ ID NO: 2506877 - protein, 23 aa, Entamoeba dispar
TNEFRLVAIPNRNIEMNEMTVME

SEQ ID NO: 2506878 - protein, 26 aa, Entamoeba dispar
TNEKRTVFSPVMFPMAPSFPPVVFPS

SEQ ID NO: 2506879 - protein, 26 aa, Entamoeba dispar
TNELFLYKNFAKFGAIEQCNCLYEPT

SEQ ID NO: 2506880 - protein, 23 aa, Entamoeba dispar
TNEVKKWKDIAILKDVQQTQSVQ

SEQ ID NO: 2506881 - protein, 28 aa, Entamoeba dispar
TNFARIEGFDCVIQFAKSLNVRIVGIDG

SEQ ID NO: 2506882 - protein, 17 aa, Entamoeba dispar
TNFKNIYNSIQYSINYY

SEQ ID NO: 2506883 - protein, 18 aa, Entamoeba dispar
TNFLLLWNKINNFIWTFT

SEQ ID NO: 2506884 - protein, 19 aa, Entamoeba dispar
TNFMLCLTSIEPIENAEVT

SEQ ID NO: 2506885 - protein, 25 aa, Entamoeba dispar
TNFNEIPCDVVASVFKKFLRNLPIH

SEQ ID NO: 2506886 - protein, 17 aa, Entamoeba dispar
TNFPFNLTLNAPFDSYL

SEQ ID NO: 2506887 - protein, 22 aa, Entamoeba dispar
TNFRKNRQSCFSPSSITQPIDY

SEQ ID NO: 2506888 - protein, 18 aa, Entamoeba dispar
TNGDVLWIDTLSHPDFDI

SEQ ID NO: 2506889 - protein, 17 aa, Entamoeba dispar
TNGELRKDLFLFELEKI

SEQ ID NO: 2506890 - protein, 25 aa, Entamoeba dispar
TNGFPLCLLDGSTLTSIRTGGIGGL

SEQ ID NO: 2506891 - protein, 19 aa, Entamoeba dispar
TNGMISFNFCAKNLYNFDQ

SEQ ID NO: 2506892 - protein, 26 aa, Entamoeba dispar
TNHFKSIRIPNCYEIILKNKRYSFVF

SEQ ID NO: 2506893 - protein, 19 aa, Entamoeba dispar
TNHFLAIFEFMVIRLGKDP

SEQ ID NO: 2506894 - protein, 25 aa, Entamoeba dispar
TNHNMWKKRRFHLSQVLQIVPCGSF

SEQ ID NO: 2506895 - protein, 26 aa, Entamoeba dispar
TNICLGFKENLPILATHLSLRVNKIK

SEQ ID NO: 2506896 - protein, 19 aa, Entamoeba dispar
TNIGFVVKLLHHLQQLDIL

SEQ ID NO: 2506897 - protein, 24 aa, Entamoeba dispar
TNIHIRYEGINGWINTKYAIGSVI

SEQ ID NO: 2506898 - protein, 25 aa, Entamoeba dispar
TNIKLAACIVLPLVISSLIQATGKS

SEQ ID NO: 2506899 - protein, 18 aa, Entamoeba dispar
TNIMPQYLHQVRSEKQIL

SEQ ID NO: 2506900 - protein, 23 aa, Entamoeba dispar
TNIPWQLDTAIRRRFEKRIYIGL

SEQ ID NO: 2506901 - protein, 27 aa, Entamoeba dispar
TNISCIKLNCYGCRNLNIYIKRINELN

SEQ ID NO: 2506902 - protein, 27 aa, Entamoeba dispar
TNITLQWRISAVYSIKNKVICGSENGT

SEQ ID NO: 2506903 - protein, 19 aa, Entamoeba dispar
TNKAEVIDGTNLVKEQVQK

SEQ ID NO: 2506904 - protein, 18 aa, Entamoeba dispar
TNKFLKVMGERLLSNLTI

SEQ ID NO: 2506905 - protein, 19 aa, Entamoeba dispar
TNKHIKTIINYVFSSEDNP

SEQ ID NO: 2506906 - protein, 24 aa, Entamoeba dispar
TNKILEEFICYFIIDKSLNENEIV

SEQ ID NO: 2506907 - protein, 24 aa, Entamoeba dispar
TNKKIWKFICQVLSTHKMKVTLLR

SEQ ID NO: 2506908 - protein, 24 aa, Entamoeba dispar
TNKLCKDFQGIVLPVVRALMVNFT

SEQ ID NO: 2506909 - protein, 18 aa, Entamoeba dispar
TNKLWNYVSFYAKEASVY

SEQ ID NO: 2506910 - protein, 26 aa, Entamoeba dispar
TNKNSIEGAMKWKANIDDRVLFNNEK

SEQ ID NO: 2506911 - protein, 23 aa, Entamoeba dispar
TNKPIADIFGFIFEIAKEGNIHL

SEQ ID NO: 2506912 - protein, 23 aa, Entamoeba dispar
TNKPIGCILVFLPGIYEITSLQK

SEQ ID NO: 2506913 - protein, 17 aa, Entamoeba dispar
TNKPKRVRKEKDIKPER

SEQ ID NO: 2506914 - protein, 27 aa, Entamoeba dispar
TNKQLFCNICQQLLREVVIQLTVVPAI

SEQ ID NO: 2506915 - protein, 25 aa, Entamoeba dispar
TNKREIICKIILELIDVIVILHKKG

SEQ ID NO: 2506916 - protein, 23 aa, Entamoeba dispar
TNKYRISKVIGYGAFGIVFLANN

SEQ ID NO: 2506917 - protein, 19 aa, Entamoeba dispar
TNLELVSGIALHSPKLFEQ

SEQ ID NO: 2506918 - protein, 22 aa, Entamoeba dispar
TNLICKHCNKIIDIKWVGNIIC

SEQ ID NO: 2506919 - protein, 19 aa, Entamoeba dispar
TNLIQELKNASSQVLGAIA

SEQ ID NO: 2506920 - protein, 25 aa, Entamoeba dispar
TNLISISSLPEWAQRSLTPLKYLNR

SEQ ID NO: 2506921 - protein, 17 aa, Entamoeba dispar
TNLKIFKTGKWRKSILD

SEQ ID NO: 2506922 - protein, 17 aa, Entamoeba dispar
TNLLCKSLFEAIVPEVF

SEQ ID NO: 2506923 - protein, 23 aa, Entamoeba dispar
TNLLELKLKMYLKENYISIDHFN

SEQ ID NO: 2506924 - protein, 20 aa, Entamoeba dispar
TNLLGIMLYYIDLRVDTYLQ

SEQ ID NO: 2506925 - protein, 25 aa, Entamoeba dispar
TNLLPMVYKLWFKYVRLEETVENFD

SEQ ID NO: 2506926 - protein, 26 aa, Entamoeba dispar
TNLPHKRLRDVAARVKYLKYIETHPT

SEQ ID NO: 2506927 - protein, 29 aa, Entamoeba dispar
TNLPTKRLRDISLRLQFMKAKEKTITLSW

SEQ ID NO: 2506928 - protein, 18 aa, Entamoeba dispar
TNLRRCYSQLKDILATNT

SEQ ID NO: 2506929 - protein, 20 aa, Entamoeba dispar
TNLSLISSRLIRLETNQKDI

SEQ ID NO: 2506930 - protein, 18 aa, Entamoeba dispar
TNLWIRYSSVLKSIKADK

SEQ ID NO: 2506931 - protein, 23 aa, Entamoeba dispar
TNLYIHFNECYNFIESNKNKGSI

SEQ ID NO: 2506932 - protein, 28 aa, Entamoeba dispar
TNLYQFCPCKHVFCLDCLAPNLNESIKD

SEQ ID NO: 2506933 - protein, 25 aa, Entamoeba dispar
TNMMKCIAIALPIHLRNFPNNPFYG

SEQ ID NO: 2506934 - protein, 19 aa, Entamoeba dispar
TNNCVELIALEALKKEESF

SEQ ID NO: 2506935 - protein, 20 aa, Entamoeba dispar
TNNEIIKFLVNHPHIQIHLR

SEQ ID NO: 2506936 - protein, 23 aa, Entamoeba dispar
TNNQQPFGFGTTNNLSFNVFNSD

SEQ ID NO: 2506937 - protein, 25 aa, Entamoeba dispar
TNNVLRYGGMYTIGLAYCGTSNEKA

SEQ ID NO: 2506938 - protein, 18 aa, Entamoeba dispar
TNPFLVDLICSFIKKYKH

SEQ ID NO: 2506939 - protein, 22 aa, Entamoeba dispar
TNPKMLKFILENGGRVEQLNGW

SEQ ID NO: 2506940 - protein, 25 aa, Entamoeba dispar
TNPNCLSFMKFNFNHTITFPLQQQK

SEQ ID NO: 2506941 - protein, 24 aa, Entamoeba dispar
TNPNCPKPGCYKSYGSAKEDNPIC

SEQ ID NO: 2506942 - protein, 24 aa, Entamoeba dispar
TNPPEFNKIIFKSMIEELSEEVLT

SEQ ID NO: 2506943 - protein, 21 aa, Entamoeba dispar
TNPRLRIKMIEKRINQMNKRI

SEQ ID NO: 2506944 - protein, 17 aa, Entamoeba dispar
TNQCKIRDGAAVRIAKC

SEQ ID NO: 2506945 - protein, 19 aa, Entamoeba dispar
TNQIGRLCEIGFPDGFISV

SEQ ID NO: 2506946 - protein, 23 aa, Entamoeba dispar
TNQIRIFPYPTKPISPNSSHQVT

SEQ ID NO: 2506947 - protein, 24 aa, Entamoeba dispar
TNQLDCFKKFFVFDDGYSSLKEVG

SEQ ID NO: 2506948 - protein, 24 aa, Entamoeba dispar
TNQNLKWKVKEDIVDFDACSLYPS

SEQ ID NO: 2506949 - protein, 24 aa, Entamoeba dispar
TNQQQSLGWGFRFWNSSPKASDQL

SEQ ID NO: 2506950 - protein, 22 aa, Entamoeba dispar
TNQYRIGEYFIIGKHQQGTEIK

SEQ ID NO: 2506951 - protein, 17 aa, Entamoeba dispar
TNRDSFDYLQDWIDDVS

SEQ ID NO: 2506952 - protein, 19 aa, Entamoeba dispar
TNRRLTRSIAPIKLKKSKK

SEQ ID NO: 2506953 - protein, 17 aa, Entamoeba dispar
TNSFVFVLPEGFKTNTT

SEQ ID NO: 2506954 - protein, 19 aa, Entamoeba dispar
TNSGFGLSSFGGFNTSTSG

SEQ ID NO: 2506955 - protein, 23 aa, Entamoeba dispar
TNSMLHPSFIDWALDEKRASQIP

SEQ ID NO: 2506956 - protein, 27 aa, Entamoeba dispar
TNSPFPSLFSFEINDFISPSYGILMNY

SEQ ID NO: 2506957 - protein, 25 aa, Entamoeba dispar
TNSYIKELFNFRGLLKAQLDMAYRD

SEQ ID NO: 2506958 - protein, 25 aa, Entamoeba dispar
TNTKEPACLALDIEEDFCVLRKKND

SEQ ID NO: 2506959 - protein, 31 aa, Entamoeba dispar
TNTLLPLCLPFKPLFFFNRENYLVLLNEKEI

SEQ ID NO: 2506960 - protein, 17 aa, Entamoeba dispar
TNTNASCSVCYITDEFT

SEQ ID NO: 2506961 - protein, 25 aa, Entamoeba dispar
TNTPSFDALKHWSYFYTSKRLIFTS

SEQ ID NO: 2506962 - protein, 18 aa, Entamoeba dispar
TNTRDIIETFSHESQQSN

SEQ ID NO: 2506963 - protein, 29 aa, Entamoeba dispar
TNTVIEWSKRMTLCAGICYGKNSGCIIRL

SEQ ID NO: 2506964 - protein, 20 aa, Entamoeba dispar
TNTYSGPFLYPPSDVQQEVE

SEQ ID NO: 2506965 - protein, 25 aa, Entamoeba dispar
TNTYSGVLRLFGKVTPQSITKVSKI

SEQ ID NO: 2506966 - protein, 22 aa, Entamoeba dispar
TNVALICQMNAIFGLLQQYPGL

SEQ ID NO: 2506967 - protein, 19 aa, Entamoeba dispar
TNVHACDWDYGLIAIAFNS

SEQ ID NO: 2506968 - protein, 25 aa, Entamoeba dispar
TNVKQLCEYREVLVEFKRYNKGNLY

SEQ ID NO: 2506969 - protein, 25 aa, Entamoeba dispar
TNVKSKCPINKLIIVESKEVNITGN

SEQ ID NO: 2506970 - protein, 31 aa, Entamoeba dispar
TNVQPIGALVTRTFTESGFYEIKRPQDYYMS

SEQ ID NO: 2506971 - protein, 20 aa, Entamoeba dispar
TNVTCSRNPLLASLQLQIDN

SEQ ID NO: 2506972 - protein, 24 aa, Entamoeba dispar
TNYELKLAIGKFISESPFVLSQSP

SEQ ID NO: 2506973 - protein, 24 aa, Entamoeba dispar
TNYFKSGKSEAVIAPKVITTTHTF

SEQ ID NO: 2506974 - protein, 24 aa, Entamoeba dispar
TNYKEVFVSLFLMNYSSSLANSFI

SEQ ID NO: 2506975 - protein, 17 aa, Entamoeba dispar
TNYKLYFIACQKISHVF

SEQ ID NO: 2506976 - protein, 18 aa, Entamoeba dispar
TNYPGIGVIDGDLCDYFN

SEQ ID NO: 2506977 - protein, 26 aa, Entamoeba dispar
TNYSCLNLKICPEFVVKVKECKTKFD

SEQ ID NO: 2506978 - protein, 17 aa, Entamoeba dispar
TPAPRPIQPPPITTSIT

SEQ ID NO: 2506979 - protein, 18 aa, Entamoeba dispar
TPDCGIILSGIHSLQYLD

SEQ ID NO: 2506980 - protein, 21 aa, Entamoeba dispar
TPDKFFLKLMERLDIPEDFEP

SEQ ID NO: 2506981 - protein, 20 aa, Entamoeba dispar
TPDYSSWPLLLQNFDQLEIK

SEQ ID NO: 2506982 - protein, 22 aa, Entamoeba dispar
TPEAYKVLCSIFERMIDPEDEK

SEQ ID NO: 2506983 - protein, 23 aa, Entamoeba dispar
TPEDNDLFLARQVLKNITHNTVN

SEQ ID NO: 2506984 - protein, 21 aa, Entamoeba dispar
TPEEAKTLIGMISQLETMYIN

SEQ ID NO: 2506985 - protein, 24 aa, Entamoeba dispar
TPEELILATCPWKEIEQDGKLVYK

SEQ ID NO: 2506986 - protein, 26 aa, Entamoeba dispar
TPEGESCGLVKMLSLMAQITVALQDE

SEQ ID NO: 2506987 - protein, 33 aa, Entamoeba dispar
TPEHYKNICRLTHQYECGLVCDTLLHRLGDDGK

SEQ ID NO: 2506988 - protein, 21 aa, Entamoeba dispar
TPELGRFSTIGGIGVLINELT

SEQ ID NO: 2506989 - protein, 30 aa, Entamoeba dispar
TPELSPEHPPRFSITKAPALSEKELENKKS

SEQ ID NO: 2506990 - protein, 22 aa, Entamoeba dispar
TPEPSLMLIGSMCYSLEASFAP

SEQ ID NO: 2506991 - protein, 25 aa, Entamoeba dispar
TPERVCCYEAMMAGKMRLQDKDIEV

SEQ ID NO: 2506992 - protein, 18 aa, Entamoeba dispar
TPFIKYIFGILSQIHCKV

SEQ ID NO: 2506993 - protein, 19 aa, Entamoeba dispar
TPFIRLYKSYVLNWCNRYL

SEQ ID NO: 2506994 - protein, 23 aa, Entamoeba dispar
TPFLHCIEHSFICFSSLKIFLNF

SEQ ID NO: 2506995 - protein, 22 aa, Entamoeba dispar
TPFSEFKFFSEIREKVLMGYRP

SEQ ID NO: 2506996 - protein, 24 aa, Entamoeba dispar
TPFVEGILFELCFDSVKDIFIKKE

SEQ ID NO: 2506997 - protein, 25 aa, Entamoeba dispar
TPGHSPGSCSFYFKDEEIVINGDTL

SEQ ID NO: 2506998 - protein, 18 aa, Entamoeba dispar
TPIECCIDDVIKKKKQLT

SEQ ID NO: 2506999 - protein, 19 aa, Entamoeba dispar
TPIEPEIVFCDFPISDYFN

SEQ ID NO: 2507000 - protein, 25 aa, Entamoeba dispar
TPIFYPKDRFGLIFYGSQNTTKSLP

SEQ ID NO: 2507001 - protein, 32 aa, Entamoeba dispar
TPIGQGNVCYVEFGGPVPPQLPLGTENNGYMG

SEQ ID NO: 2507002 - protein, 18 aa, Entamoeba dispar
TPIHVGIDLGTTYSSIAI

SEQ ID NO: 2507003 - protein, 19 aa, Entamoeba dispar
TPIHVGIDLGTTYSSIAIY

SEQ ID NO: 2507004 - protein, 23 aa, Entamoeba dispar
TPIIKGESLGIMMSKREYKVIKL

SEQ ID NO: 2507005 - protein, 24 aa, Entamoeba dispar
TPIKYGVGCFRGCKILSQVEGAKQ

SEQ ID NO: 2507006 - protein, 20 aa, Entamoeba dispar
TPILISRGSTFISNQITKNI

SEQ ID NO: 2507007 - protein, 24 aa, Entamoeba dispar
TPIQCPRCEKTFCSKCLSNNHIGQ

SEQ ID NO: 2507008 - protein, 27 aa, Entamoeba dispar
TPIQRLPRYRLLLKDLLKHLRPSDIDY

SEQ ID NO: 2507009 - protein, 17 aa, Entamoeba dispar
TPISVSWIEVIKQNREK

SEQ ID NO: 2507010 - protein, 17 aa, Entamoeba dispar
TPITGIWQTVWVEPVHD

SEQ ID NO: 2507011 - protein, 18 aa, Entamoeba dispar
TPITIKWKNEEKVTVNYK

SEQ ID NO: 2507012 - protein, 19 aa, Entamoeba dispar
TPITKLGNNCFGECTSLKT

SEQ ID NO: 2507013 - protein, 19 aa, Entamoeba dispar
TPITLCLNHLPLTLQPLTE

SEQ ID NO: 2507014 - protein, 18 aa, Entamoeba dispar
TPIYPTVETIIRIRIIVS

SEQ ID NO: 2507015 - protein, 21 aa, Entamoeba dispar
TPIYSFLCSYLLKTNTPQSKG

SEQ ID NO: 2507016 - protein, 24 aa, Entamoeba dispar
TPKEYELFKFSTLKNELIINGVYI

SEQ ID NO: 2507017 - protein, 17 aa, Entamoeba dispar
TPKKFFGTDFIKSVLPP

SEQ ID NO: 2507018 - protein, 20 aa, Entamoeba dispar
TPKKKIEIVECDEDTTEESS

SEQ ID NO: 2507019 - protein, 25 aa, Entamoeba dispar
TPKKTLPFGLLVLRFDKPDIQIYLL

SEQ ID NO: 2507020 - protein, 17 aa, Entamoeba dispar
TPKLRYAGLLEYDSDNH

SEQ ID NO: 2507021 - protein, 26 aa, Entamoeba dispar
TPKMYFKSIDVYGSHHLSAFVTSGNI

SEQ ID NO: 2507022 - protein, 23 aa, Entamoeba dispar
TPKRNIYWIGVNALLVKRINTEI

SEQ ID NO: 2507023 - protein, 22 aa, Entamoeba dispar
TPKYVSCPVINTFNILLTSTLT

SEQ ID NO: 2507024 - protein, 20 aa, Entamoeba dispar
TPLEKVMYIFSSFKILEQMI

SEQ ID NO: 2507025 - protein, 17 aa, Entamoeba dispar
TPLHAFCWKEMAKRIRG

SEQ ID NO: 2507026 - protein, 24 aa, Entamoeba dispar
TPLHPRIQDLFTIILNVSLNMSYD

SEQ ID NO: 2507027 - protein, 17 aa, Entamoeba dispar
TPLKRKAITPLLESKRK

SEQ ID NO: 2507028 - protein, 19 aa, Entamoeba dispar
TPLLELSSLIVLKVKENKI

SEQ ID NO: 2507029 - protein, 23 aa, Entamoeba dispar
TPLMIYLCKMKSILSELPIASTV

SEQ ID NO: 2507030 - protein, 17 aa, Entamoeba dispar
TPLSGCYYPLEKHQESI

SEQ ID NO: 2507031 - protein, 27 aa, Entamoeba dispar
TPLSTMKGWEKLRWDDILHIKTIVEDD

SEQ ID NO: 2507032 - protein, 23 aa, Entamoeba dispar
TPMFKHKRFICIVNCDDVQESFC

SEQ ID NO: 2507033 - protein, 19 aa, Entamoeba dispar
TPMFKHKRFVCIVNCADVQ

SEQ ID NO: 2507034 - protein, 20 aa, Entamoeba dispar
TPMFKHKRFVCIVNCADVQE

SEQ ID NO: 2507035 - protein, 22 aa, Entamoeba dispar
TPMKERLMFLISNLCRGQPFVD

SEQ ID NO: 2507036 - protein, 25 aa, Entamoeba dispar
TPNCEELLSMLWRITSKSDDVGIET

SEQ ID NO: 2507037 - protein, 31 aa, Entamoeba dispar
TPNFFLDFYKTFKIFFSLGNTFFSDNPFISD

SEQ ID NO: 2507038 - protein, 22 aa, Entamoeba dispar
TPNIIKCFYYNCPLLSVEQFNT

SEQ ID NO: 2507039 - protein, 25 aa, Entamoeba dispar
TPNILPRHCSLIVCDKDWGRCVCNL

SEQ ID NO: 2507040 - protein, 24 aa, Entamoeba dispar
TPNKRPRFRDCFKSLTEIYDSLQE

SEQ ID NO: 2507041 - protein, 19 aa, Entamoeba dispar
TPNQLQCRSSCAYETVFAR

SEQ ID NO: 2507042 - protein, 24 aa, Entamoeba dispar
TPNRDLAAFILFRVVNLTLQNEVM

SEQ ID NO: 2507043 - protein, 24 aa, Entamoeba dispar
TPQKSDKSINCFDLSHSNPQRVSL

SEQ ID NO: 2507044 - protein, 25 aa, Entamoeba dispar
TPQLLVEIIWILSRFSCTKEEILTS

SEQ ID NO: 2507045 - protein, 22 aa, Entamoeba dispar
TPRRQCLQRLKISYRCTTCYGK

SEQ ID NO: 2507046 - protein, 17 aa, Entamoeba dispar
TPRVISIHQKLLKEKKP

SEQ ID NO: 2507047 - protein, 28 aa, Entamoeba dispar
TPSDESYRFYQLLLFNFSQFIADEDFNR

SEQ ID NO: 2507048 - protein, 28 aa, Entamoeba dispar
TPSFYGRRVGTCFVKIVLQLSLPLTIII

SEQ ID NO: 2507049 - protein, 27 aa, Entamoeba dispar
TPSKVECPYWLAPEVINGNTFTQKSDV

SEQ ID NO: 2507050 - protein, 20 aa, Entamoeba dispar
TPSLFDFGDFSSSQEKPNQS

SEQ ID NO: 2507051 - protein, 26 aa, Entamoeba dispar
TPSLFKRVVSGFSYNLLSTHFYYSVL

SEQ ID NO: 2507052 - protein, 22 aa, Entamoeba dispar
TPSLFRCYRYSSSRLIGHSYEV

SEQ ID NO: 2507053 - protein, 19 aa, Entamoeba dispar
TPSLLFKYNVNFILEIIHI

SEQ ID NO: 2507054 - protein, 23 aa, Entamoeba dispar
TPSTRLRLSRSIGHSTEPLLSSH

SEQ ID NO: 2507055 - protein, 24 aa, Entamoeba dispar
TPTHLELRLSIYGRSLDEWEKLAE

SEQ ID NO: 2507056 - protein, 28 aa, Entamoeba dispar
TPVGLRASYKCGYNYFAPELLEKKQPTA

SEQ ID NO: 2507057 - protein, 24 aa, Entamoeba dispar
TPVHNLCFYKNKLYGVIPSPTKSS

SEQ ID NO: 2507058 - protein, 18 aa, Entamoeba dispar
TPVIKSALLAQASLYVNK

SEQ ID NO: 2507059 - protein, 22 aa, Entamoeba dispar
TPVKKSLYCIIWDTTVSNSTES

SEQ ID NO: 2507060 - protein, 18 aa, Entamoeba dispar
TPVVPGMHKIEVVVNDEP

SEQ ID NO: 2507061 - protein, 22 aa, Entamoeba dispar
TPVYNFLCSYLLKTNTPQLKGL

SEQ ID NO: 2507062 - protein, 22 aa, Entamoeba dispar
TPYYRPCLTGNISNVDKACEIY

SEQ ID NO: 2507063 - protein, 25 aa, Entamoeba dispar
TQAEGLLRMGLHPTIIADGYRTGLK

SEQ ID NO: 2507064 - protein, 19 aa, Entamoeba dispar
TQCNLKKLRLERLKDILLI

SEQ ID NO: 2507065 - protein, 31 aa, Entamoeba dispar
TQCYLLDCENEMFLWLGNKCQVKVRQRINKF

SEQ ID NO: 2507066 - protein, 25 aa, Entamoeba dispar
TQDAFAVMLSRPLKNLSLPLFITYL

SEQ ID NO: 2507067 - protein, 25 aa, Entamoeba dispar
TQDTSLRLLLRMIKILQFIHKEGIV

SEQ ID NO: 2507068 - protein, 30 aa, Entamoeba dispar
TQEKTCIILPEYCIQHLIHFLGYGEMIENG

SEQ ID NO: 2507069 - protein, 19 aa, Entamoeba dispar
TQENLALKPDYDYNEQMYS

SEQ ID NO: 2507070 - protein, 18 aa, Entamoeba dispar
TQESLKLTQNFIIRGLTQ

SEQ ID NO: 2507071 - protein, 21 aa, Entamoeba dispar
TQESMDWAVLGMRFLFTDMKY

SEQ ID NO: 2507072 - protein, 26 aa, Entamoeba dispar
TQETLLKLVKFFSVESKYLITESGFA

SEQ ID NO: 2507073 - protein, 22 aa, Entamoeba dispar
TQFKNSVILLIQLISYSPLMVV

SEQ ID NO: 2507074 - protein, 22 aa, Entamoeba dispar
TQFKTLLKMDGFSIETTEDLVV

SEQ ID NO: 2507075 - protein, 26 aa, Entamoeba dispar
TQFLIPKRFDCLVALNVSATSIATNC

SEQ ID NO: 2507076 - protein, 18 aa, Entamoeba dispar
TQFMCNKFPNAVREVRPT

SEQ ID NO: 2507077 - protein, 19 aa, Entamoeba dispar
TQFNHAFIVVGFDITQQNA

SEQ ID NO: 2507078 - protein, 19 aa, Entamoeba dispar
TQFNHVFIIVSPVIIKGVP

SEQ ID NO: 2507079 - protein, 19 aa, Entamoeba dispar
TQFTYGILLSDSWNVLMIK

SEQ ID NO: 2507080 - protein, 17 aa, Entamoeba dispar
TQFYISQVILALECLHQ

SEQ ID NO: 2507081 - protein, 33 aa, Entamoeba dispar
TQGLIWKKLKTLKCIKCKVNVIGAGIFEKKLFP

SEQ ID NO: 2507082 - protein, 19 aa, Entamoeba dispar
TQHFTRFPVSLINDLAQCF

SEQ ID NO: 2507083 - protein, 24 aa, Entamoeba dispar
TQHSFEIPIQPCLTFVLRKYNSFI

SEQ ID NO: 2507084 - protein, 17 aa, Entamoeba dispar
TQIKNIVLWSIGVTIVL

SEQ ID NO: 2507085 - protein, 24 aa, Entamoeba dispar
TQINEVFSGIGLELHKLKCVLVQS

SEQ ID NO: 2507086 - protein, 23 aa, Entamoeba dispar
TQISLHPLLKCLIKYENQTLQSN

SEQ ID NO: 2507087 - protein, 30 aa, Entamoeba dispar
TQISQQRILNWLMAFFDAHITLLITDQQFT

SEQ ID NO: 2507088 - protein, 17 aa, Entamoeba dispar
TQKEVKGEYKYLFDTII

SEQ ID NO: 2507089 - protein, 24 aa, Entamoeba dispar
TQKIEYGLCAILFASTTHPELLEN

SEQ ID NO: 2507090 - protein, 19 aa, Entamoeba dispar
TQKLCLRNRDVNGFGFRSP

SEQ ID NO: 2507091 - protein, 29 aa, Entamoeba dispar
TQKLIKFKWIDPFNEYGFYAFGAAVIEIV

SEQ ID NO: 2507092 - protein, 23 aa, Entamoeba dispar
TQKLNIIPCCLVDGDVYGIEIFL

SEQ ID NO: 2507093 - protein, 24 aa, Entamoeba dispar
TQKRACLWTDSIYFLQAQKEIAQG

SEQ ID NO: 2507094 - protein, 17 aa, Entamoeba dispar
TQKRRFGLLASCGSLIH

SEQ ID NO: 2507095 - protein, 18 aa, Entamoeba dispar
TQKSLLIGFSRGTVMEIM

SEQ ID NO: 2507096 - protein, 20 aa, Entamoeba dispar
TQKYFAGSRPTFARCVNKAK

SEQ ID NO: 2507097 - protein, 24 aa, Entamoeba dispar
TQKYGSICASLFGDEPTRLVKSIG

SEQ ID NO: 2507098 - protein, 22 aa, Entamoeba dispar
TQLEFEISICIVIFDGYGNVIG

SEQ ID NO: 2507099 - protein, 23 aa, Entamoeba dispar
TQLKDEIQSFILKQQKAEEYIKE

SEQ ID NO: 2507100 - protein, 21 aa, Entamoeba dispar
TQLKLDEEALMKCISEGQMKE

SEQ ID NO: 2507101 - protein, 21 aa, Entamoeba dispar
TQLPLSLVIRPFLHEVQQIPM

SEQ ID NO: 2507102 - protein, 26 aa, Entamoeba dispar
TQLRSLLFTFFLCYSQSHFEDSKKLY

SEQ ID NO: 2507103 - protein, 21 aa, Entamoeba dispar
TQLVKRNNICILWKEETGEVF

SEQ ID NO: 2507104 - protein, 22 aa, Entamoeba dispar
TQMGYGVFYSWLKLKEQEVRNI

SEQ ID NO: 2507105 - protein, 24 aa, Entamoeba dispar
TQNRMAEMQKSFEGSENEMISSLN

SEQ ID NO: 2507106 - protein, 19 aa, Entamoeba dispar
TQNYFCFRSQYGKKLYVKI

SEQ ID NO: 2507107 - protein, 23 aa, Entamoeba dispar
TQPEVIIRKGMNIEPMKPLHKKK

SEQ ID NO: 2507108 - protein, 31 aa, Entamoeba dispar
TQPIVFPSVFFFNGAGLQKVFIKNEITKDTI

SEQ ID NO: 2507109 - protein, 24 aa, Entamoeba dispar
TQPVCPYKKVVVGSIQQPHTQQNT

SEQ ID NO: 2507110 - protein, 17 aa, Entamoeba dispar
TQQIKIWAKLFCSPLED

SEQ ID NO: 2507111 - protein, 24 aa, Entamoeba dispar
TQQNRLSGLGSFGNTTGFGQNNTQ

SEQ ID NO: 2507112 - protein, 23 aa, Entamoeba dispar
TQRADIFQILGFITDSTKLPNPY

SEQ ID NO: 2507113 - protein, 28 aa, Entamoeba dispar
TQRIKKKFDGYAIFRPKYRRFELYEDDD

SEQ ID NO: 2507114 - protein, 23 aa, Entamoeba dispar
TQRKFSFHSFFILGMTKNQIIQQ

SEQ ID NO: 2507115 - protein, 30 aa, Entamoeba dispar
TQRKIEFRSQWKYTICINLNDKKSICDARQ

SEQ ID NO: 2507116 - protein, 17 aa, Entamoeba dispar
TQRQLAERTIILKNQVK

SEQ ID NO: 2507117 - protein, 23 aa, Entamoeba dispar
TQRRFSFHSFFIIGMTKNQIIQQ

SEQ ID NO: 2507118 - protein, 23 aa, Entamoeba dispar
TQRRFSFHSFFILGMTKNQIIQQ

SEQ ID NO: 2507119 - protein, 33 aa, Entamoeba dispar
TQSELCIAALKFAVTFLKKGGWFISKVFRSQDY

SEQ ID NO: 2507120 - protein, 17 aa, Entamoeba dispar
TQSFEFIEKAIGLNQKV

SEQ ID NO: 2507121 - protein, 22 aa, Entamoeba dispar
TQSFEISMGMIQQASYFNHDRL

SEQ ID NO: 2507122 - protein, 19 aa, Entamoeba dispar
TQSGILLQRIIHKIAGTYL

SEQ ID NO: 2507123 - protein, 18 aa, Entamoeba dispar
TQSTPCNLLLPQTDSKSK

SEQ ID NO: 2507124 - protein, 44 aa, Entamoeba dispar
TQTAIECLRYVKEQRSRVVLTFLCLKELKTKDFFELDEEIKDIG

SEQ ID NO: 2507125 - protein, 20 aa, Entamoeba dispar
TQTEFNRFIPLTSKTLPFTS

SEQ ID NO: 2507126 - protein, 22 aa, Entamoeba dispar
TQTELYPIVVMYEADQSFILDS

SEQ ID NO: 2507127 - protein, 24 aa, Entamoeba dispar
TQTIKYLYCRPTVSALEQPKKWWK

SEQ ID NO: 2507128 - protein, 19 aa, Entamoeba dispar
TQTLFAMKVIPKKQVIERD

SEQ ID NO: 2507129 - protein, 18 aa, Entamoeba dispar
TQTLKFKIFEDIANGVAA

SEQ ID NO: 2507130 - protein, 17 aa, Entamoeba dispar
TQTMPFDIAIIADAINV

SEQ ID NO: 2507131 - protein, 18 aa, Entamoeba dispar
TQTPGKILLRRKLSRLSE

SEQ ID NO: 2507132 - protein, 25 aa, Entamoeba dispar
TQTQCKCKRLFGKSLETYMKENEPD

SEQ ID NO: 2507133 - protein, 22 aa, Entamoeba dispar
TQVMPYTLGFGLVDDSFSIFAS

SEQ ID NO: 2507134 - protein, 22 aa, Entamoeba dispar
TQVMPYTLGFGLVENKYDVFAP

SEQ ID NO: 2507135 - protein, 17 aa, Entamoeba dispar
TQVVSSFVWNETNENNP

SEQ ID NO: 2507136 - protein, 17 aa, Entamoeba dispar
TQYRELESAFNPGNGEF

SEQ ID NO: 2507137 - protein, 18 aa, Entamoeba dispar
TQYSFYFIPYVEESIVTK

SEQ ID NO: 2507138 - protein, 20 aa, Entamoeba dispar
TRAAEYVKFGHIPAGINAIV

SEQ ID NO: 2507139 - protein, 17 aa, Entamoeba dispar
TRADFKMQVKFDENDSI

SEQ ID NO: 2507140 - protein, 30 aa, Entamoeba dispar
TRAKQRRSKEWKKTQKLLGRTNQLIGTINK

SEQ ID NO: 2507141 - protein, 20 aa, Entamoeba dispar
TRALIFGVGFEIFEKFLKTM

SEQ ID NO: 2507142 - protein, 19 aa, Entamoeba dispar
TRALLRRLTHLQIVPENGE

SEQ ID NO: 2507143 - protein, 29 aa, Entamoeba dispar
TRANKEGKRVVGVLLGFIRKGVVDVMNSF

SEQ ID NO: 2507144 - protein, 25 aa, Entamoeba dispar
TRCNKEDIVSLLLLNGCNVNTQDEQ

SEQ ID NO: 2507145 - protein, 21 aa, Entamoeba dispar
TRDEFLLFLSRRVQKGTIPNV

SEQ ID NO: 2507146 - protein, 19 aa, Entamoeba dispar
TRDGFILMYSITSRYSFDL

SEQ ID NO: 2507147 - protein, 23 aa, Entamoeba dispar
TRDGIKLPSLRISWSSIGLGLAV

SEQ ID NO: 2507148 - protein, 18 aa, Entamoeba dispar
TRDLLTFEAEQPISKQQY

SEQ ID NO: 2507149 - protein, 38 aa, Entamoeba dispar
TRDRRLPLIDIISFTLNICKAIQILHTREFVHNHLNEK

SEQ ID NO: 2507150 - protein, 27 aa, Entamoeba dispar
TREAQICNGLLYLLRSLGYSFTIRKTK

SEQ ID NO: 2507151 - protein, 25 aa, Entamoeba dispar
TREEKEIERSLGLMLLRGDCIQGYT

SEQ ID NO: 2507152 - protein, 18 aa, Entamoeba dispar
TREKEAALRKKEQVETDL

SEQ ID NO: 2507153 - protein, 22 aa, Entamoeba dispar
TRELAIQIAEEFTQCSCGKFKV

SEQ ID NO: 2507154 - protein, 25 aa, Entamoeba dispar
TRELAVQINEHFKKLIKYLPQFTSS

SEQ ID NO: 2507155 - protein, 24 aa, Entamoeba dispar
TRELPLFKKNIESIDTIQKDIKLK

SEQ ID NO: 2507156 - protein, 25 aa, Entamoeba dispar
TREMGDGLIVYLARWVEGKMKETIT

SEQ ID NO: 2507157 - protein, 23 aa, Entamoeba dispar
TRETKDRPCTVIINSNDECVSPR

SEQ ID NO: 2507158 - protein, 20 aa, Entamoeba dispar
TRFASLPINISNYILEQPHL

SEQ ID NO: 2507159 - protein, 19 aa, Entamoeba dispar
TRFDTELHCCNKWNKIEGV

SEQ ID NO: 2507160 - protein, 28 aa, Entamoeba dispar
TRFHLKGEVGDIVFVESIIASWAVVHVN

SEQ ID NO: 2507161 - protein, 18 aa, Entamoeba dispar
TRFLELFLTKIIRNDETL

SEQ ID NO: 2507162 - protein, 17 aa, Entamoeba dispar
TRFLTCASCGFFWKMSC

SEQ ID NO: 2507163 - protein, 18 aa, Entamoeba dispar
TRFVELKFDNKNTLKFYT

SEQ ID NO: 2507164 - protein, 26 aa, Entamoeba dispar
TRGAHSCYFCNFVAAVSFITQMNENS

SEQ ID NO: 2507165 - protein, 25 aa, Entamoeba dispar
TRGMTHKKLCLRFTQDAIIKRFNKT

SEQ ID NO: 2507166 - protein, 27 aa, Entamoeba dispar
TRGSSSIIYLCVGGVVLKQINSDFKSL

SEQ ID NO: 2507167 - protein, 24 aa, Entamoeba dispar
TRGYPRPVSATGEIVLQSIHRSMF

SEQ ID NO: 2507168 - protein, 21 aa, Entamoeba dispar
TRHMMILDRLIHLINIDDNIL

SEQ ID NO: 2507169 - protein, 26 aa, Entamoeba dispar
TRHPFIVHLYWSFATETCFYFIMDYC

SEQ ID NO: 2507170 - protein, 18 aa, Entamoeba dispar
TRHTGSRYRFDYITETKQ

SEQ ID NO: 2507171 - protein, 18 aa, Entamoeba dispar
TRHYSCFYRSDTYGEKLY

SEQ ID NO: 2507172 - protein, 24 aa, Entamoeba dispar
TRICTEIYPFIPGGFRNGIVPILK

SEQ ID NO: 2507173 - protein, 25 aa, Entamoeba dispar
TRIESVIEIFLKYQIFILSNEQKIE

SEQ ID NO: 2507174 - protein, 17 aa, Entamoeba dispar
TRIGPQFLDSILNQIHS

SEQ ID NO: 2507175 - protein, 26 aa, Entamoeba dispar
TRIIRIFLDNELKQFLKEVINIVQKH

SEQ ID NO: 2507176 - protein, 17 aa, Entamoeba dispar
TRIKSFISTGNFETSST

SEQ ID NO: 2507177 - protein, 21 aa, Entamoeba dispar
TRIPAKIPLIKKVAKPIYNGA

SEQ ID NO: 2507178 - protein, 18 aa, Entamoeba dispar
TRIPSQFNQRIQEFINIY

SEQ ID NO: 2507179 - protein, 19 aa, Entamoeba dispar
TRIQKELILHAIDSVNPKS

SEQ ID NO: 2507180 - protein, 17 aa, Entamoeba dispar
TRIRFIELRSAIFNFHF

SEQ ID NO: 2507181 - protein, 25 aa, Entamoeba dispar
TRIVMQYKKIHIMGSYANIKIARDA

SEQ ID NO: 2507182 - protein, 22 aa, Entamoeba dispar
TRKCPKCNATIEKNRGCNHMTC

SEQ ID NO: 2507183 - protein, 25 aa, Entamoeba dispar
TRKDAMAVFHFLFRYDTGSHLPFIV

SEQ ID NO: 2507184 - protein, 22 aa, Entamoeba dispar
TRKEFEEECYKRGIYEEFINKI

SEQ ID NO: 2507185 - protein, 19 aa, Entamoeba dispar
TRKGCRRIIREIDFNIIIT

SEQ ID NO: 2507186 - protein, 25 aa, Entamoeba dispar
TRKILKEPRVINILANAIFHNDAKV

SEQ ID NO: 2507187 - protein, 21 aa, Entamoeba dispar
TRKKICIRMLQNGSIPIYNMI

SEQ ID NO: 2507188 - protein, 18 aa, Entamoeba dispar
TRKSFVRGSLAFVYCTIF

SEQ ID NO: 2507189 - protein, 37 aa, Entamoeba dispar
TRKSVEIQRQFLMKVIDWKIQMDLMINKQLSKFEINE

SEQ ID NO: 2507190 - protein, 17 aa, Entamoeba dispar
TRLETFNAVTDWVAELK

SEQ ID NO: 2507191 - protein, 20 aa, Entamoeba dispar
TRLKEIRMNKDIGYVGGSFW

SEQ ID NO: 2507192 - protein, 19 aa, Entamoeba dispar
TRLPIKISNHKLVIAGTRL

SEQ ID NO: 2507193 - protein, 17 aa, Entamoeba dispar
TRLPTKHIQEFKTSTEY

SEQ ID NO: 2507194 - protein, 17 aa, Entamoeba dispar
TRLQGIVLTMNYNVKRY

SEQ ID NO: 2507195 - protein, 20 aa, Entamoeba dispar
TRLSQLTGLTFISKTEPEFI

SEQ ID NO: 2507196 - protein, 17 aa, Entamoeba dispar
TRLTLSIYMTDTPINLP

SEQ ID NO: 2507197 - protein, 21 aa, Entamoeba dispar
TRLYLRKGKGEARICKVYDSP

SEQ ID NO: 2507198 - protein, 17 aa, Entamoeba dispar
TRMNINIIPRLKEINEL

SEQ ID NO: 2507199 - protein, 23 aa, Entamoeba dispar
TRMQRVGQFISFFNPNFKPFKRE

SEQ ID NO: 2507200 - protein, 29 aa, Entamoeba dispar
TRMRYLYIALEWLSQCSFYCKEKVKGPNG

SEQ ID NO: 2507201 - protein, 24 aa, Entamoeba dispar
TRNDKKTAIALIFNTLSSYIIQTN

SEQ ID NO: 2507202 - protein, 27 aa, Entamoeba dispar
TRNEFEPEKKFTIGVEFATRTIEYEGK

SEQ ID NO: 2507203 - protein, 18 aa, Entamoeba dispar
TRNGISYLTAQRRIQDLK

SEQ ID NO: 2507204 - protein, 18 aa, Entamoeba dispar
TRNKILILLKNITKCNDQ

SEQ ID NO: 2507205 - protein, 18 aa, Entamoeba dispar
TRNLCLRSLTSLNHLHSL

SEQ ID NO: 2507206 - protein, 18 aa, Entamoeba dispar
TRNLIGVTILYGPDSSAP

SEQ ID NO: 2507207 - protein, 18 aa, Entamoeba dispar
TRNPSWNKSFIMEVFPGE

SEQ ID NO: 2507208 - protein, 19 aa, Entamoeba dispar
TRPFKRMTYADAIKYCNDH

SEQ ID NO: 2507209 - protein, 29 aa, Entamoeba dispar
TRPFYIKPPNSMGYLTLKFSNSGKIIPQY

SEQ ID NO: 2507210 - protein, 19 aa, Entamoeba dispar
TRPMVSLIAQMIGMPVEDL

SEQ ID NO: 2507211 - protein, 20 aa, Entamoeba dispar
TRPTTNISILSKYDILLNGL

SEQ ID NO: 2507212 - protein, 27 aa, Entamoeba dispar
TRQIKRVFETSIEFKGLLTDFYNACQT

SEQ ID NO: 2507213 - protein, 17 aa, Entamoeba dispar
TRQSIIQFLKLMKPNSF

SEQ ID NO: 2507214 - protein, 29 aa, Entamoeba dispar
TRRHHCRRCGKVFCGSCCVDSVLMKDLGF

SEQ ID NO: 2507215 - protein, 23 aa, Entamoeba dispar
TRRICPLFVTKGFDSISITSQTP

SEQ ID NO: 2507216 - protein, 18 aa, Entamoeba dispar
TRRTLPNIIQKLIEKGLD

SEQ ID NO: 2507217 - protein, 30 aa, Entamoeba dispar
TRRYFVGYCILVMKKLYCCCKIKEDENDII

SEQ ID NO: 2507218 - protein, 19 aa, Entamoeba dispar
TRSEICYLGNLIADGYNGI

SEQ ID NO: 2507219 - protein, 20 aa, Entamoeba dispar
TRSIPPHMFIDINALTAAFY

SEQ ID NO: 2507220 - protein, 25 aa, Entamoeba dispar
TRSIWPTYRPIVIDIIDCLCDKTNE

SEQ ID NO: 2507221 - protein, 18 aa, Entamoeba dispar
TRSKKGLLHNCELAKILF

SEQ ID NO: 2507222 - protein, 24 aa, Entamoeba dispar
TRSLLLRDRLIELIDSLLKVEINA

SEQ ID NO: 2507223 - protein, 25 aa, Entamoeba dispar
TRSMYCMYHYYAGMTMLIKNKPSDA

SEQ ID NO: 2507224 - protein, 21 aa, Entamoeba dispar
TRSVLLDWLFLVSQDEFATTI

SEQ ID NO: 2507225 - protein, 18 aa, Entamoeba dispar
TRTTGLYGDYNILSYWLQ

SEQ ID NO: 2507226 - protein, 27 aa, Entamoeba dispar
TRVKVLKRLVASLPDTNKYTLWYLCDF

SEQ ID NO: 2507227 - protein, 20 aa, Entamoeba dispar
TRVNKLWDFCFEGCSSLTSI

SEQ ID NO: 2507228 - protein, 19 aa, Entamoeba dispar
TRVNQLWDFCFEGCSSLTS

SEQ ID NO: 2507229 - protein, 19 aa, Entamoeba dispar
TRWFPSAKRSKYILNIPLN

SEQ ID NO: 2507230 - protein, 22 aa, Entamoeba dispar
TRYCDVYTKLLLVFLPYIKEFN

SEQ ID NO: 2507231 - protein, 21 aa, Entamoeba dispar
TRYIRVCTIAIPVVSQLHQCL

SEQ ID NO: 2507232 - protein, 24 aa, Entamoeba dispar
TRYLPEHAIKFLISISQQITTFSE

SEQ ID NO: 2507233 - protein, 24 aa, Entamoeba dispar
TRYLSELIGDIIIFSEHAQNVQPT

SEQ ID NO: 2507234 - protein, 24 aa, Entamoeba dispar
TRYPRTDIIQSFCYGFVELVTSCK

SEQ ID NO: 2507235 - protein, 25 aa, Entamoeba dispar
TSAPWLQILLFRLLSTIDLETTTQK

SEQ ID NO: 2507236 - protein, 23 aa, Entamoeba dispar
TSARAGGFIASRFLTGVPPQEFF

SEQ ID NO: 2507237 - protein, 19 aa, Entamoeba dispar
TSARLTVDFHKTLKSDTKE

SEQ ID NO: 2507238 - protein, 18 aa, Entamoeba dispar
TSCAIFIQKPRGMTVTSK

SEQ ID NO: 2507239 - protein, 25 aa, Entamoeba dispar
TSCEFCPFEDFIAIGRYNGVSTIPI

SEQ ID NO: 2507240 - protein, 17 aa, Entamoeba dispar
TSCFFNCGCDEELKYNT

SEQ ID NO: 2507241 - protein, 20 aa, Entamoeba dispar
TSCGWWEIQQPILQEQVDEM

SEQ ID NO: 2507242 - protein, 26 aa, Entamoeba dispar
TSCIMLQTKIKGIIKNVPKTSVTEQP

SEQ ID NO: 2507243 - protein, 20 aa, Entamoeba dispar
TSDGSNLIWVGEVQQRRDSS

SEQ ID NO: 2507244 - protein, 26 aa, Entamoeba dispar
TSEFLKDGGVLLGFDLTATQLIGYNC

SEQ ID NO: 2507245 - protein, 23 aa, Entamoeba dispar
TSEGCLKDTIMFVYIKVQIEGET

SEQ ID NO: 2507246 - protein, 19 aa, Entamoeba dispar
TSEINKFMEHYKIQQRDQP

SEQ ID NO: 2507247 - protein, 24 aa, Entamoeba dispar
TSELPKRIISVFSAVRQAILYDGY

SEQ ID NO: 2507248 - protein, 18 aa, Entamoeba dispar
TSELPLLLNHGISPVNIN

SEQ ID NO: 2507249 - protein, 18 aa, Entamoeba dispar
TSERCMVQLLQFMSNKNS

SEQ ID NO: 2507250 - protein, 19 aa, Entamoeba dispar
TSEVCCLHSTYDFIQSIQY

SEQ ID NO: 2507251 - protein, 25 aa, Entamoeba dispar
TSFCLPKSLSSWAFHIESKKFKINL

SEQ ID NO: 2507252 - protein, 17 aa, Entamoeba dispar
TSFERPASVALKKASSF

SEQ ID NO: 2507253 - protein, 17 aa, Entamoeba dispar
TSFEVIAAINISKGFKI

SEQ ID NO: 2507254 - protein, 24 aa, Entamoeba dispar
TSFGDGCFYGCGCEDELMKNKRIP

SEQ ID NO: 2507255 - protein, 22 aa, Entamoeba dispar
TSFGDGCFYGCGCEEELKKNKR

SEQ ID NO: 2507256 - protein, 24 aa, Entamoeba dispar
TSFGDGRILLALVDNFMGKEIYQS

SEQ ID NO: 2507257 - protein, 20 aa, Entamoeba dispar
TSFGGFVFTGFGNNEKPKEE

SEQ ID NO: 2507258 - protein, 26 aa, Entamoeba dispar
TSFGKSCFFNCGCEFELKRNIQIPRN

SEQ ID NO: 2507259 - protein, 23 aa, Entamoeba dispar
TSFGKSCFYGCGCEEELKKNKRI

SEQ ID NO: 2507260 - protein, 24 aa, Entamoeba dispar
TSFGKSCFYKCGCEDELKKNKRIP

SEQ ID NO: 2507261 - protein, 24 aa, Entamoeba dispar
TSFGKSCFYKCGCEEMLRENKSIP

SEQ ID NO: 2507262 - protein, 23 aa, Entamoeba dispar
TSFGRGCFYKCGCEEELMKNETI

SEQ ID NO: 2507263 - protein, 23 aa, Entamoeba dispar
TSFGRGCFYKCGCKDELKQNKRI

SEQ ID NO: 2507264 - protein, 24 aa, Entamoeba dispar
TSFGRSCFFKCGCEEMLKKNERIP

SEQ ID NO: 2507265 - protein, 25 aa, Entamoeba dispar
TSFKSLRSLQHFGRTLGLTPSQSYD

SEQ ID NO: 2507266 - protein, 19 aa, Entamoeba dispar
TSFKSLRYLTIILEKEISW

SEQ ID NO: 2507267 - protein, 24 aa, Entamoeba dispar
TSFLIKEGTAYIVVKNRVPYISIS

SEQ ID NO: 2507268 - protein, 23 aa, Entamoeba dispar
TSFNLKYIQEWTGHKNHNIIFDS

SEQ ID NO: 2507269 - protein, 19 aa, Entamoeba dispar
TSFQPCRPISSAISPDQIH

SEQ ID NO: 2507270 - protein, 18 aa, Entamoeba dispar
TSFSKQIEEMFGREMTIT

SEQ ID NO: 2507271 - protein, 21 aa, Entamoeba dispar
TSFTPKKLRTGFSCSTSIFGQ

SEQ ID NO: 2507272 - protein, 20 aa, Entamoeba dispar
TSGFIGYYLYLGMNKDQLLK

SEQ ID NO: 2507273 - protein, 30 aa, Entamoeba dispar
TSGKDFLRRRACLMMYPMCKEYPDALRPSF

SEQ ID NO: 2507274 - protein, 26 aa, Entamoeba dispar
TSGSFLSYGTLCFIKENLGENDVAMQ

SEQ ID NO: 2507275 - protein, 26 aa, Entamoeba dispar
TSGSFLSYGTLCFVKENLGENDVAMQ

SEQ ID NO: 2507276 - protein, 23 aa, Entamoeba dispar
TSGVGCKGVLCYVPRLCNEDVQN

SEQ ID NO: 2507277 - protein, 17 aa, Entamoeba dispar
TSHTCNPVNLFIRDYDY

SEQ ID NO: 2507278 - protein, 33 aa, Entamoeba dispar
TSIAEVIVYPCLSRPELIPIYLSLIQVHHKTFH

SEQ ID NO: 2507279 - protein, 19 aa, Entamoeba dispar
TSICCPVIPDVKKYVQEKG

SEQ ID NO: 2507280 - protein, 22 aa, Entamoeba dispar
TSIGCQCFDWCIALTRIDIPSR

SEQ ID NO: 2507281 - protein, 18 aa, Entamoeba dispar
TSIHHIVWAILYESSVQL

SEQ ID NO: 2507282 - protein, 18 aa, Entamoeba dispar
TSIIKLGYGCFYGCSSLK

SEQ ID NO: 2507283 - protein, 19 aa, Entamoeba dispar
TSIISRYGGAKGFVNRPTF

SEQ ID NO: 2507284 - protein, 17 aa, Entamoeba dispar
TSIKFNIYKGFGKCVNS

SEQ ID NO: 2507285 - protein, 22 aa, Entamoeba dispar
TSIKSFNSMTSFQFSPEEDEIV

SEQ ID NO: 2507286 - protein, 23 aa, Entamoeba dispar
TSIKSFNSMTSFQFSPEEDEIVS

SEQ ID NO: 2507287 - protein, 25 aa, Entamoeba dispar
TSIKYIGNYCFKGCSSLQTINIPTS

SEQ ID NO: 2507288 - protein, 20 aa, Entamoeba dispar
TSINELGCDCFSYCLLLKSI

SEQ ID NO: 2507289 - protein, 29 aa, Entamoeba dispar
TSINGLGNWYFKGCTSLTRIDIPTTVNVI

SEQ ID NO: 2507290 - protein, 17 aa, Entamoeba dispar
TSINIPSSVIFIGKAAF

SEQ ID NO: 2507291 - protein, 19 aa, Entamoeba dispar
TSIPEVCRQLSHLQSLDLH

SEQ ID NO: 2507292 - protein, 17 aa, Entamoeba dispar
TSIPVDVPIQISPMYSQ

SEQ ID NO: 2507293 - protein, 25 aa, Entamoeba dispar
TSIRKLVPEAWGFMCPVHTPDGAPC

SEQ ID NO: 2507294 - protein, 21 aa, Entamoeba dispar
TSISEIGDWCFKQCSSLKTIN

SEQ ID NO: 2507295 - protein, 23 aa, Entamoeba dispar
TSISERRNAILLFALLNNDSIKR

SEQ ID NO: 2507296 - protein, 19 aa, Entamoeba dispar
TSISFRLTDISAMLRSPIY

SEQ ID NO: 2507297 - protein, 24 aa, Entamoeba dispar
TSISKIGHFCFNRCTSLTTINIPS

SEQ ID NO: 2507298 - protein, 25 aa, Entamoeba dispar
TSISKIGYRCFRFCSSLKSINVPSS

SEQ ID NO: 2507299 - protein, 23 aa, Entamoeba dispar
TSISKIGYYCFKKCFLLTKINLP

SEQ ID NO: 2507300 - protein, 27 aa, Entamoeba dispar
TSISKLGDYCFYKCISLTSINIPTSIN

SEQ ID NO: 2507301 - protein, 17 aa, Entamoeba dispar
TSISKLGHNCFLGCSSM

SEQ ID NO: 2507302 - protein, 24 aa, Entamoeba dispar
TSISKLGNRCFSRCYSLISLHLPT

SEQ ID NO: 2507303 - protein, 19 aa, Entamoeba dispar
TSITKLGDYCFFGCCSLTS

SEQ ID NO: 2507304 - protein, 23 aa, Entamoeba dispar
TSITSIGDWCFNKCSSITTINIP

SEQ ID NO: 2507305 - protein, 22 aa, Entamoeba dispar
TSITSIGDWCFNKCSSLQSINI

SEQ ID NO: 2507306 - protein, 19 aa, Entamoeba dispar
TSITSIGMYCFSNCTSLSS

SEQ ID NO: 2507307 - protein, 18 aa, Entamoeba dispar
TSITSIGNYCFKECSSLT

SEQ ID NO: 2507308 - protein, 20 aa, Entamoeba dispar
TSKFYYFLVVALIKEYADDI

SEQ ID NO: 2507309 - protein, 24 aa, Entamoeba dispar
TSKKKGRLSFIFKQNVTKSQNEPI

SEQ ID NO: 2507310 - protein, 19 aa, Entamoeba dispar
TSKKNEWVCIICDEDGKFS

SEQ ID NO: 2507311 - protein, 30 aa, Entamoeba dispar
TSKKQIKRICHFCATASRLRTMKFDPKGEL

SEQ ID NO: 2507312 - protein, 27 aa, Entamoeba dispar
TSKLLNKRRVSICVAPKFSIPSRASPG

SEQ ID NO: 2507313 - protein, 28 aa, Entamoeba dispar
TSKQLPEMIEVMILLILETGMDFKGIFR

SEQ ID NO: 2507314 - protein, 19 aa, Entamoeba dispar
TSLCCKAIISRTLIGALGL

SEQ ID NO: 2507315 - protein, 25 aa, Entamoeba dispar
TSLDIDGTVCVLEILDTAGQEEYNS

SEQ ID NO: 2507316 - protein, 24 aa, Entamoeba dispar
TSLEAFKLLLPQSMPIVQLPQNLS

SEQ ID NO: 2507317 - protein, 18 aa, Entamoeba dispar
TSLFCGVSASSLLSTQFA

SEQ ID NO: 2507318 - protein, 18 aa, Entamoeba dispar
TSLFILLVALGIDEDTEI

SEQ ID NO: 2507319 - protein, 17 aa, Entamoeba dispar
TSLILFLKDRVSSSAHE

SEQ ID NO: 2507320 - protein, 22 aa, Entamoeba dispar
TSLIPRRTCSDLIENKEISQAL

SEQ ID NO: 2507321 - protein, 17 aa, Entamoeba dispar
TSLKEIIKRAINAEYSK

SEQ ID NO: 2507322 - protein, 30 aa, Entamoeba dispar
TSLKHFNNLCLRFHFFQSILNKVIVNSDGI

SEQ ID NO: 2507323 - protein, 27 aa, Entamoeba dispar
TSLKLSCLHIAVYFDKFDFVEKLIDQK

SEQ ID NO: 2507324 - protein, 25 aa, Entamoeba dispar
TSLLCGVQLCGGAHAIGHEITNYYG

SEQ ID NO: 2507325 - protein, 25 aa, Entamoeba dispar
TSLPEFPHAFTISACTGSIEWDGLY

SEQ ID NO: 2507326 - protein, 22 aa, Entamoeba dispar
TSLPTCCFNKCFALEKINLENL

SEQ ID NO: 2507327 - protein, 20 aa, Entamoeba dispar
TSLRRRPIYALTLDISLTYK

SEQ ID NO: 2507328 - protein, 18 aa, Entamoeba dispar
TSLSSLPVHCTKLKMDQC

SEQ ID NO: 2507329 - protein, 28 aa, Entamoeba dispar
TSMTFSDLWDIFDIILINVEGEYKEIYE

SEQ ID NO: 2507330 - protein, 24 aa, Entamoeba dispar
TSNCPPKPKHIRTIVVKSFSGGVP

SEQ ID NO: 2507331 - protein, 22 aa, Entamoeba dispar
TSNFWKWLRKDWIESHGGLQTV

SEQ ID NO: 2507332 - protein, 18 aa, Entamoeba dispar
TSNIPIDFIYSLTSLTKI

SEQ ID NO: 2507333 - protein, 25 aa, Entamoeba dispar
TSNMYLRIVALDFSYFLLKKANNKT

SEQ ID NO: 2507334 - protein, 30 aa, Entamoeba dispar
TSNNPFTCFPFFVPRRNWFVKAIFLTELEQ

SEQ ID NO: 2507335 - protein, 29 aa, Entamoeba dispar
TSNVFSFGNIDFGKGLNFGTSSNVEKTSE

SEQ ID NO: 2507336 - protein, 20 aa, Entamoeba dispar
TSPKMSCCDNTPLHISSIKF

SEQ ID NO: 2507337 - protein, 22 aa, Entamoeba dispar
TSPLIKCNLILSHSLNEECDAV

SEQ ID NO: 2507338 - protein, 20 aa, Entamoeba dispar
TSPNRWKKAFLDGLSHSPYF

SEQ ID NO: 2507339 - protein, 28 aa, Entamoeba dispar
TSPPQIRYCYYFYYYLSVFPREVPFKPI

SEQ ID NO: 2507340 - protein, 23 aa, Entamoeba dispar
TSPPQVRYCYAFDYYMKVFNNTI

SEQ ID NO: 2507341 - protein, 24 aa, Entamoeba dispar
TSPSRVACLHWLKIFKKYTSPKGI

SEQ ID NO: 2507342 - protein, 21 aa, Entamoeba dispar
TSQIHFCNLPTGVAMITVDET

SEQ ID NO: 2507343 - protein, 23 aa, Entamoeba dispar
TSQLFTLLYQRLVEYSQKGKITC

SEQ ID NO: 2507344 - protein, 24 aa, Entamoeba dispar
TSQLPEYIKYISFSLSDSKLIMNN

SEQ ID NO: 2507345 - protein, 26 aa, Entamoeba dispar
TSRIKWCQIPSHSRPSWEDYCQNENY

SEQ ID NO: 2507346 - protein, 23 aa, Entamoeba dispar
TSRLNEFPIQFFIADINNKELNS

SEQ ID NO: 2507347 - protein, 18 aa, Entamoeba dispar
TSRMARKNIEYLINKEYF

SEQ ID NO: 2507348 - protein, 27 aa, Entamoeba dispar
TSRRKEDWHPYLLFCKVKRDSVVNDGI

SEQ ID NO: 2507349 - protein, 25 aa, Entamoeba dispar
TSRTIKSYVYKQCEEKKLFIEGNAR

SEQ ID NO: 2507350 - protein, 25 aa, Entamoeba dispar
TSSAKLCKRYMKYLMKKYLKKNNLR

SEQ ID NO: 2507351 - protein, 20 aa, Entamoeba dispar
TSSILFELINACIIGLNKHI

SEQ ID NO: 2507352 - protein, 18 aa, Entamoeba dispar
TSSLSYYDFKLLFLDHYT

SEQ ID NO: 2507353 - protein, 23 aa, Entamoeba dispar
TSSNLCVCFSPSLFRSPDNDMTR

SEQ ID NO: 2507354 - protein, 20 aa, Entamoeba dispar
TSSQELLSFQSNEELSTSHS

SEQ ID NO: 2507355 - protein, 17 aa, Entamoeba dispar
TSSSFVIHQENERKSFS

SEQ ID NO: 2507356 - protein, 20 aa, Entamoeba dispar
TSSSGIQWAYFVTHRLFVYK

SEQ ID NO: 2507357 - protein, 17 aa, Entamoeba dispar
TSSVKIMLFLNEIGSFD

SEQ ID NO: 2507358 - protein, 23 aa, Entamoeba dispar
TSSYSEQCYLQFLNSLQMINKFD

SEQ ID NO: 2507359 - protein, 18 aa, Entamoeba dispar
TSTKLQCTILSLLMKMNI

SEQ ID NO: 2507360 - protein, 24 aa, Entamoeba dispar
TSTKQEIFNTFSFDQPIENKIPTS

SEQ ID NO: 2507361 - protein, 30 aa, Entamoeba dispar
TSTNICGRCGKSIAPGVSFISAMGQKFHPE

SEQ ID NO: 2507362 - protein, 25 aa, Entamoeba dispar
TSTRRLPVKLISKFVGTRTPVQVRT

SEQ ID NO: 2507363 - protein, 17 aa, Entamoeba dispar
TSTYDGFGIAWGISEYL

SEQ ID NO: 2507364 - protein, 17 aa, Entamoeba dispar
TSVEGFIKIDFHNGEVT

SEQ ID NO: 2507365 - protein, 30 aa, Entamoeba dispar
TSVELMWNVYRRWKEFIKYLISLQKLTTTR

SEQ ID NO: 2507366 - protein, 19 aa, Entamoeba dispar
TSVGIGLVMFGMQDKADEI

SEQ ID NO: 2507367 - protein, 28 aa, Entamoeba dispar
TSVGSILYRYCIGIGTLIIISQNYLNCH

SEQ ID NO: 2507368 - protein, 17 aa, Entamoeba dispar
TSVLRQIEKNNVMEEEE

SEQ ID NO: 2507369 - protein, 23 aa, Entamoeba dispar
TSVMPPFISFIIKLIGSHRSLYQ

SEQ ID NO: 2507370 - protein, 22 aa, Entamoeba dispar
TSVSEIGDWCFNKCSSLQTINI

SEQ ID NO: 2507371 - protein, 17 aa, Entamoeba dispar
TSVSKIGEWCFYECSSL

SEQ ID NO: 2507372 - protein, 25 aa, Entamoeba dispar
TSVSKLGYRCFRYCSSLKSINIPSS

SEQ ID NO: 2507373 - protein, 20 aa, Entamoeba dispar
TSWDVCSSLVKGFSQSKYKS

SEQ ID NO: 2507374 - protein, 25 aa, Entamoeba dispar
TSWELFERRCHELPTADILGYKTKQ

SEQ ID NO: 2507375 - protein, 19 aa, Entamoeba dispar
TSYLAQCRTIYQLTFDTHM

SEQ ID NO: 2507376 - protein, 17 aa, Entamoeba dispar
TSYRLYNVISQLKLSSK

SEQ ID NO: 2507377 - protein, 24 aa, Entamoeba dispar
TTAQEFFYLILIETFPVPLQLVCM

SEQ ID NO: 2507378 - protein, 17 aa, Entamoeba dispar
TTDIKIKAPTLIAYLPS

SEQ ID NO: 2507379 - protein, 17 aa, Entamoeba dispar
TTDKLLRRFIFNLNVKM

SEQ ID NO: 2507380 - protein, 34 aa, Entamoeba dispar
TTDKPCNMFQAFLIRLVIPFPLSLIVNEEATLRY

SEQ ID NO: 2507381 - protein, 17 aa, Entamoeba dispar
TTDSGWGCMIRSLQMVL

SEQ ID NO: 2507382 - protein, 24 aa, Entamoeba dispar
TTDSIRKSLEWQRKSNENLELKTK

SEQ ID NO: 2507383 - protein, 26 aa, Entamoeba dispar
TTEAVKIISYKVCGWNNPEMEMLEPE

SEQ ID NO: 2507384 - protein, 18 aa, Entamoeba dispar
TTELSMEVIHTFLNNMEN

SEQ ID NO: 2507385 - protein, 20 aa, Entamoeba dispar
TTEPRFIVYSYKFETRDGRI

SEQ ID NO: 2507386 - protein, 23 aa, Entamoeba dispar
TTEPYIKWDYDFRIQKIGDHYRA

SEQ ID NO: 2507387 - protein, 19 aa, Entamoeba dispar
TTEYLRRPITISIGKTGNV

SEQ ID NO: 2507388 - protein, 24 aa, Entamoeba dispar
TTFFGHLIHLFGVFYKSKDVFKSM

SEQ ID NO: 2507389 - protein, 23 aa, Entamoeba dispar
TTFKTEVLLSLLTFLVSNLSTEL

SEQ ID NO: 2507390 - protein, 17 aa, Entamoeba dispar
TTFNRYIIDYAPNKQSK

SEQ ID NO: 2507391 - protein, 19 aa, Entamoeba dispar
TTFPSLSVNIIYQLLSNFH

SEQ ID NO: 2507392 - protein, 24 aa, Entamoeba dispar
TTFRPELILPANKWYEIKHQNKVS

SEQ ID NO: 2507393 - protein, 17 aa, Entamoeba dispar
TTGMCFAEMKKLMKGEH

SEQ ID NO: 2507394 - protein, 18 aa, Entamoeba dispar
TTGSNPFGNFNTTNNTTS

SEQ ID NO: 2507395 - protein, 23 aa, Entamoeba dispar
TTGSNPFGNFTVSNNSTSSTTTG

SEQ ID NO: 2507396 - protein, 27 aa, Entamoeba dispar
TTHEPCLMCGMALLHSRFGRVFFIHQH

SEQ ID NO: 2507397 - protein, 18 aa, Entamoeba dispar
TTICYGKCFTEVPVKSSD

SEQ ID NO: 2507398 - protein, 18 aa, Entamoeba dispar
TTIFNCPSAFSVDDQLNC

SEQ ID NO: 2507399 - protein, 27 aa, Entamoeba dispar
TTIGKLGYKFFKGCISLTNVNIPASVS

SEQ ID NO: 2507400 - protein, 21 aa, Entamoeba dispar
TTIKTIGDWCFNECSSLQTIN

SEQ ID NO: 2507401 - protein, 18 aa, Entamoeba dispar
TTILPLLMIKSILPRIES

SEQ ID NO: 2507402 - protein, 20 aa, Entamoeba dispar
TTILYKLKIGDLVTTIPTIG

SEQ ID NO: 2507403 - protein, 23 aa, Entamoeba dispar
TTILYKLQCGKVIQTMPTIGFNV

SEQ ID NO: 2507404 - protein, 25 aa, Entamoeba dispar
TTIPKSVCCSLNMVYEVDNSMINGS

SEQ ID NO: 2507405 - protein, 20 aa, Entamoeba dispar
TTISELGCDCFNGCEVLTAV

SEQ ID NO: 2507406 - protein, 22 aa, Entamoeba dispar
TTISELGIKCFMGCSSLTSVTI

SEQ ID NO: 2507407 - protein, 20 aa, Entamoeba dispar
TTISKIGDWCLYSCTSLTNI

SEQ ID NO: 2507408 - protein, 21 aa, Entamoeba dispar
TTISKIGYRCFNGCSSLPTIN

SEQ ID NO: 2507409 - protein, 17 aa, Entamoeba dispar
TTISKLGERCFGDCLSL

SEQ ID NO: 2507410 - protein, 21 aa, Entamoeba dispar
TTISKLGFNCFKGCTLLKSID

SEQ ID NO: 2507411 - protein, 19 aa, Entamoeba dispar
TTISSIIFNDCHYINKCSL

SEQ ID NO: 2507412 - protein, 26 aa, Entamoeba dispar
TTITSFGRKCFKGCGCEEELKKNERI

SEQ ID NO: 2507413 - protein, 24 aa, Entamoeba dispar
TTITSLGNYCFLRCSSLKSINIPT

SEQ ID NO: 2507414 - protein, 17 aa, Entamoeba dispar
TTITSLGNYCFSKREYL

SEQ ID NO: 2507415 - protein, 24 aa, Entamoeba dispar
TTKAKRLKRCCVIMKEQFNNQVPQ

SEQ ID NO: 2507416 - protein, 23 aa, Entamoeba dispar
TTKEYVSTVGVYMLNYNDGTLTY

SEQ ID NO: 2507417 - protein, 25 aa, Entamoeba dispar
TTKGAMCETCMTLSALENVDSNGLQ

SEQ ID NO: 2507418 - protein, 18 aa, Entamoeba dispar
TTKGKILIGKVVFITEEF

SEQ ID NO: 2507419 - protein, 19 aa, Entamoeba dispar
TTKGLKGIFIEGSEYIVVS

SEQ ID NO: 2507420 - protein, 22 aa, Entamoeba dispar
TTKLCKGVGFVTYMDSSDAYKA

SEQ ID NO: 2507421 - protein, 20 aa, Entamoeba dispar
TTKMKCLNCLKEREKTEDSY

SEQ ID NO: 2507422 - protein, 26 aa, Entamoeba dispar
TTKQCFNCPICYKPVPIKEVVIDNKV

SEQ ID NO: 2507423 - protein, 21 aa, Entamoeba dispar
TTLELLIRMYETFKPKMAKFM

SEQ ID NO: 2507424 - protein, 24 aa, Entamoeba dispar
TTLFEMKQFPVIILKDNPVIFLLR

SEQ ID NO: 2507425 - protein, 17 aa, Entamoeba dispar
TTLFSNIMLFHSISIDM

SEQ ID NO: 2507426 - protein, 28 aa, Entamoeba dispar
TTLIFLFRVEPYMKMHIQLFDGHFDTDR

SEQ ID NO: 2507427 - protein, 19 aa, Entamoeba dispar
TTLKIEIVIDSLEKFAEVQ

SEQ ID NO: 2507428 - protein, 23 aa, Entamoeba dispar
TTLKKLLIKSCYNIIINNLEEVP

SEQ ID NO: 2507429 - protein, 23 aa, Entamoeba dispar
TTLLKMEPSELVLTRSKKFRLMG

SEQ ID NO: 2507430 - protein, 18 aa, Entamoeba dispar
TTLLWAIPKTGRMHQIRV

SEQ ID NO: 2507431 - protein, 17 aa, Entamoeba dispar
TTLMARYAAYKAETEDS

SEQ ID NO: 2507432 - protein, 18 aa, Entamoeba dispar
TTLNNVWANKCTKQILCI

SEQ ID NO: 2507433 - protein, 21 aa, Entamoeba dispar
TTLPKIMAIKKCQEIDIDPLI

SEQ ID NO: 2507434 - protein, 25 aa, Entamoeba dispar
TTLPLRWKVFLSCLPPTPELWKSID

SEQ ID NO: 2507435 - protein, 17 aa, Entamoeba dispar
TTLPQQIQNTIPIIQQT

SEQ ID NO: 2507436 - protein, 23 aa, Entamoeba dispar
TTLPRFKMINALVQYSTTLPRCG

SEQ ID NO: 2507437 - protein, 26 aa, Entamoeba dispar
TTLQSILKNMCELYKLLYTIPQFQKV

SEQ ID NO: 2507438 - protein, 25 aa, Entamoeba dispar
TTLTEWVFSPSFIFFKALSPEVTVD

SEQ ID NO: 2507439 - protein, 19 aa, Entamoeba dispar
TTLTQMVHCFQQTMNQEIK

SEQ ID NO: 2507440 - protein, 26 aa, Entamoeba dispar
TTLVEDFCCHHSWLNIKIIRGSELLS

SEQ ID NO: 2507441 - protein, 24 aa, Entamoeba dispar
TTMAFQFRVNVEFDIVIIDTEPSL

SEQ ID NO: 2507442 - protein, 20 aa, Entamoeba dispar
TTMMCIPTDIMLRNATLVAS

SEQ ID NO: 2507443 - protein, 18 aa, Entamoeba dispar
TTMTELPNLFKRKNELSK

SEQ ID NO: 2507444 - protein, 25 aa, Entamoeba dispar
TTNELSIFLDMLFKKSINEPKFASL

SEQ ID NO: 2507445 - protein, 18 aa, Entamoeba dispar
TTNGFVFGSYNGKRIPLK

SEQ ID NO: 2507446 - protein, 24 aa, Entamoeba dispar
TTNILSIINFDFMKIYDLQEYLRL

SEQ ID NO: 2507447 - protein, 23 aa, Entamoeba dispar
TTPCTYTKMICCKKELDNKKTFQ

SEQ ID NO: 2507448 - protein, 24 aa, Entamoeba dispar
TTPEYRAPELISVYEYLPIGCKSD

SEQ ID NO: 2507449 - protein, 20 aa, Entamoeba dispar
TTPRRRLFSASDNFIQQNSD

SEQ ID NO: 2507450 - protein, 26 aa, Entamoeba dispar
TTQCGHLFCKACLAIVFTSSDKTPLC

SEQ ID NO: 2507451 - protein, 23 aa, Entamoeba dispar
TTQREMFFYMSLLSQQLPIESQF

SEQ ID NO: 2507452 - protein, 18 aa, Entamoeba dispar
TTRIALYGMSYKKNEEMH

SEQ ID NO: 2507453 - protein, 26 aa, Entamoeba dispar
TTRNEIVETYSFLRWSISDGTTNYNE

SEQ ID NO: 2507454 - protein, 25 aa, Entamoeba dispar
TTRNEVVETYSFMRWSISDGTHNYS

SEQ ID NO: 2507455 - protein, 25 aa, Entamoeba dispar
TTSFESFILPFGKFFVIPKNNNRPL

SEQ ID NO: 2507456 - protein, 23 aa, Entamoeba dispar
TTSFIKEKFMLIEKRINEIENKI

SEQ ID NO: 2507457 - protein, 18 aa, Entamoeba dispar
TTSFPKTNTVTITNNSTI

SEQ ID NO: 2507458 - protein, 41 aa, Entamoeba dispar
TTSIYPKLAFEIIKTYLKRLAEPILGIYYFDIKKGLATEDL

SEQ ID NO: 2507459 - protein, 24 aa, Entamoeba dispar
TTSLDHVFKVWVLVTRQTIKTKGE

SEQ ID NO: 2507460 - protein, 18 aa, Entamoeba dispar
TTSLKNLILEGGNKTDQQ

SEQ ID NO: 2507461 - protein, 23 aa, Entamoeba dispar
TTSVLRKNIPVIRVIVENEGKTF

SEQ ID NO: 2507462 - protein, 26 aa, Entamoeba dispar
TTTFKKHLICFKMRVEEVTGDTNISK

SEQ ID NO: 2507463 - protein, 25 aa, Entamoeba dispar
TTTFYRLCCYIQAYFDTIINAPPNS

SEQ ID NO: 2507464 - protein, 21 aa, Entamoeba dispar
TTTKCDIIFDLYCGTGTITQL

SEQ ID NO: 2507465 - protein, 17 aa, Entamoeba dispar
TTTLQFLYIKELRFKNY

SEQ ID NO: 2507466 - protein, 22 aa, Entamoeba dispar
TTTPRKVPCLNLNTTKKTGVFD

SEQ ID NO: 2507467 - protein, 27 aa, Entamoeba dispar
TTTQPQFGTTPSFGGFNTNQTSGTTNP

SEQ ID NO: 2507468 - protein, 18 aa, Entamoeba dispar
TTVIYCIIKCIKHYPKMF

SEQ ID NO: 2507469 - protein, 26 aa, Entamoeba dispar
TTVKYIGNYCFKGCSSLQTINIPTSI

SEQ ID NO: 2507470 - protein, 27 aa, Entamoeba dispar
TTVSELGWKCFKWCSLKSINIPTTITK

SEQ ID NO: 2507471 - protein, 26 aa, Entamoeba dispar
TTVSELGWNCFKGCSSLKSIDLPTSI

SEQ ID NO: 2507472 - protein, 23 aa, Entamoeba dispar
TTVSKIGNWCFYGCKSLTSVTIP

SEQ ID NO: 2507473 - protein, 25 aa, Entamoeba dispar
TTVTPRSGVICRICEAKVLAEHLAR

SEQ ID NO: 2507474 - protein, 24 aa, Entamoeba dispar
TTWAGQCLILANFLILPVQRLPRY

SEQ ID NO: 2507475 - protein, 17 aa, Entamoeba dispar
TTWSTGRPSYCKTHNFS

SEQ ID NO: 2507476 - protein, 28 aa, Entamoeba dispar
TTYFNFRQECLWKYTSQIYDEFMNTFDC

SEQ ID NO: 2507477 - protein, 36 aa, Entamoeba dispar
TTYGKKMFTCLKCIKIIGDIMYWEAALPYELVVLNC

SEQ ID NO: 2507478 - protein, 21 aa, Entamoeba dispar
TTYLVLVEWDDLYIKQPTWVL

SEQ ID NO: 2507479 - protein, 17 aa, Entamoeba dispar
TTYRLYFNNCLLNPDDT

SEQ ID NO: 2507480 - protein, 17 aa, Entamoeba dispar
TTYSCVGIWENDRVEII

SEQ ID NO: 2507481 - protein, 18 aa, Entamoeba dispar
TVAAELCMLKIFRDTPDK

SEQ ID NO: 2507482 - protein, 25 aa, Entamoeba dispar
TVADEIKKFFGYDPKCVQLKKKYEA

SEQ ID NO: 2507483 - protein, 26 aa, Entamoeba dispar
TVAEEIWKFTHMFSEFEIENHENGCD

SEQ ID NO: 2507484 - protein, 28 aa, Entamoeba dispar
TVCDECKNDKSCYSCQFENIRIEMNKKY

SEQ ID NO: 2507485 - protein, 17 aa, Entamoeba dispar
TVCPCKARCQAFRKEVI

SEQ ID NO: 2507486 - protein, 22 aa, Entamoeba dispar
TVDAIVCYKILSIMFEKDGLLH

SEQ ID NO: 2507487 - protein, 26 aa, Entamoeba dispar
TVDDYCLYFYLTFFIMKENVFDDNEV

SEQ ID NO: 2507488 - protein, 25 aa, Entamoeba dispar
TVDDYCLYFYLTFFIMKETHFEDNE

SEQ ID NO: 2507489 - protein, 25 aa, Entamoeba dispar
TVDFGESFVSIFPFYNGTYIFNASD

SEQ ID NO: 2507490 - protein, 18 aa, Entamoeba dispar
TVDWKTNLDFIIQICTGM

SEQ ID NO: 2507491 - protein, 24 aa, Entamoeba dispar
TVEDKWRLIPAFVKARGLVRQHID

SEQ ID NO: 2507492 - protein, 26 aa, Entamoeba dispar
TVEGETYCGIKIYRLYFKCTRCKTLF

SEQ ID NO: 2507493 - protein, 19 aa, Entamoeba dispar
TVENCYRKTINVDGKVCVL

SEQ ID NO: 2507494 - protein, 19 aa, Entamoeba dispar
TVETIIRIRIIVSPLKTVK

SEQ ID NO: 2507495 - protein, 19 aa, Entamoeba dispar
TVFDAKRLIGRRFSDPAIQ

SEQ ID NO: 2507496 - protein, 25 aa, Entamoeba dispar
TVFEFAVKGLEIFGMKEHLDFDVIQ

SEQ ID NO: 2507497 - protein, 17 aa, Entamoeba dispar
TVFPEDYFVLKYTNISK

SEQ ID NO: 2507498 - protein, 20 aa, Entamoeba dispar
TVGHAMPLYNLRKNPPSRKP

SEQ ID NO: 2507499 - protein, 23 aa, Entamoeba dispar
TVGICLNGKPLIKKQFSKNISLS

SEQ ID NO: 2507500 - protein, 26 aa, Entamoeba dispar
TVGKSNIGKIEWKDVDVRNINFDISV

SEQ ID NO: 2507501 - protein, 18 aa, Entamoeba dispar
TVHGELRVYLVYFYDDNL

SEQ ID NO: 2507502 - protein, 27 aa, Entamoeba dispar
TVIQCLSHTPLIRDFFLSQSFKEDTTN

SEQ ID NO: 2507503 - protein, 34 aa, Entamoeba dispar
TVITESLCAISFIALKMKLDFAQYYPEVLQVLKT

SEQ ID NO: 2507504 - protein, 25 aa, Entamoeba dispar
TVIWPSPKLSSGVVEPYNAVLNTHA

SEQ ID NO: 2507505 - protein, 24 aa, Entamoeba dispar
TVKAESTDDFFLFGYNNYTNNPIY

SEQ ID NO: 2507506 - protein, 24 aa, Entamoeba dispar
TVKGTCLICKNTLFDGQPVTIYPC

SEQ ID NO: 2507507 - protein, 17 aa, Entamoeba dispar
TVKIGDFGIGRMLSEKE

SEQ ID NO: 2507508 - protein, 26 aa, Entamoeba dispar
TVKIIGKECFKGCTSLSSITLPSQLE

SEQ ID NO: 2507509 - protein, 23 aa, Entamoeba dispar
TVKKIYPVLMMFRSELTLPSMSM

SEQ ID NO: 2507510 - protein, 23 aa, Entamoeba dispar
TVKKLKEIQSIFIEQLNKDPSSI

SEQ ID NO: 2507511 - protein, 18 aa, Entamoeba dispar
TVKKVFYFSLNFIIDKIP

SEQ ID NO: 2507512 - protein, 17 aa, Entamoeba dispar
TVKLCDFGSAQLSETFY

SEQ ID NO: 2507513 - protein, 25 aa, Entamoeba dispar
TVKMKHSKILVCAPSNAAVDEIVLR

SEQ ID NO: 2507514 - protein, 24 aa, Entamoeba dispar
TVKQCVLDWSFKSLFDQYAKGKNY

SEQ ID NO: 2507515 - protein, 25 aa, Entamoeba dispar
TVKRVLSSTVKPHFDFKYTTIVDTI

SEQ ID NO: 2507516 - protein, 17 aa, Entamoeba dispar
TVKSYLEGMNWVFNYYC

SEQ ID NO: 2507517 - protein, 22 aa, Entamoeba dispar
TVKYIPEFEISKDYYGLLYCNL

SEQ ID NO: 2507518 - protein, 30 aa, Entamoeba dispar
TVLHFKLSTIIRVVGGWVRDKLLGKESHDI

SEQ ID NO: 2507519 - protein, 23 aa, Entamoeba dispar
TVLKGGVLFECAMRKLWGEKRIR

SEQ ID NO: 2507520 - protein, 25 aa, Entamoeba dispar
TVLKGLNIFFCFSQTAWFARGPRHH

SEQ ID NO: 2507521 - protein, 17 aa, Entamoeba dispar
TVLLKKFGTNEMFRGSF

SEQ ID NO: 2507522 - protein, 31 aa, Entamoeba dispar
TVLQRLLYTRVFKYIWPPSINTVEKMNLKEV

SEQ ID NO: 2507523 - protein, 17 aa, Entamoeba dispar
TVLREIYITDIPSFCNN

SEQ ID NO: 2507524 - protein, 29 aa, Entamoeba dispar
TVLSDPWIKDTPTYCNITLDSFKKQNETN

SEQ ID NO: 2507525 - protein, 18 aa, Entamoeba dispar
TVLSKMGIYSIVAFLQRL

SEQ ID NO: 2507526 - protein, 23 aa, Entamoeba dispar
TVMIEIFYRGFGVSFVEREVMKK

SEQ ID NO: 2507527 - protein, 22 aa, Entamoeba dispar
TVNGLDVFSAFFNKPIPQKLST

SEQ ID NO: 2507528 - protein, 21 aa, Entamoeba dispar
TVNKIGKWCFNGCSSLKSITI

SEQ ID NO: 2507529 - protein, 24 aa, Entamoeba dispar
TVNMLDCIELLLTLLSKLLRCKPI

SEQ ID NO: 2507530 - protein, 25 aa, Entamoeba dispar
TVNNVICPYFFFPLTTFNEYSIAGW

SEQ ID NO: 2507531 - protein, 19 aa, Entamoeba dispar
TVNVMDCSDSSVQLFYINH

SEQ ID NO: 2507532 - protein, 25 aa, Entamoeba dispar
TVNYKKVCEILSLMVRNKWYEPNSS

SEQ ID NO: 2507533 - protein, 24 aa, Entamoeba dispar
TVPCPWLDGKHVVFGQVVEGYDVV

SEQ ID NO: 2507534 - protein, 18 aa, Entamoeba dispar
TVPFNCRLYFEVILPNEQ

SEQ ID NO: 2507535 - protein, 26 aa, Entamoeba dispar
TVPMERLIEIGISFQSAVENLFGRNQ

SEQ ID NO: 2507536 - protein, 19 aa, Entamoeba dispar
TVRFLKDYLDSNQLFEDQF

SEQ ID NO: 2507537 - protein, 24 aa, Entamoeba dispar
TVRKYKFGVVCVKPGQDENAIFGN

SEQ ID NO: 2507538 - protein, 25 aa, Entamoeba dispar
TVRLCDIRATKTCSSAIKFFVNSDD

SEQ ID NO: 2507539 - protein, 26 aa, Entamoeba dispar
TVRLEDCLACSGCITSAETVLIEQQG

SEQ ID NO: 2507540 - protein, 29 aa, Entamoeba dispar
TVSELGRKCFKWCSLKSINIPTTITTFGS

SEQ ID NO: 2507541 - protein, 18 aa, Entamoeba dispar
TVSETVPTFDFVQTSSTS

SEQ ID NO: 2507542 - protein, 27 aa, Entamoeba dispar
TVSPEERGLFCYCPNVVAFPLASVSPR

SEQ ID NO: 2507543 - protein, 22 aa, Entamoeba dispar
TVSRKIRLNFVIEAPKIDIGEV

SEQ ID NO: 2507544 - protein, 20 aa, Entamoeba dispar
TVSVSWFPTYIKTENETTTP

SEQ ID NO: 2507545 - protein, 21 aa, Entamoeba dispar
TVSVSWFPTYIKTENETTTPE

SEQ ID NO: 2507546 - protein, 18 aa, Entamoeba dispar
TVTKIGDECFKECSSLIS

SEQ ID NO: 2507547 - protein, 18 aa, Entamoeba dispar
TVTKIGDECFKGCSSLIS

SEQ ID NO: 2507548 - protein, 18 aa, Entamoeba dispar
TVTLMSATETTMNKWSSV

SEQ ID NO: 2507549 - protein, 24 aa, Entamoeba dispar
TVVAEGACKFCYSKETKADGSIIP

SEQ ID NO: 2507550 - protein, 25 aa, Entamoeba dispar
TVVELWKKQEIIDGFVDLDGMSVGE

SEQ ID NO: 2507551 - protein, 26 aa, Entamoeba dispar
TVVFAELYWTPGVLRQAEDRVHRIGQ

SEQ ID NO: 2507552 - protein, 17 aa, Entamoeba dispar
TVVNGKQLKAKDLFTSD

SEQ ID NO: 2507553 - protein, 25 aa, Entamoeba dispar
TVVNLFFFEDCDSFIGSFSSIASIT

SEQ ID NO: 2507554 - protein, 29 aa, Entamoeba dispar
TVVSLFLFEFLRVFQCQLVIPIHVVCNEI

SEQ ID NO: 2507555 - protein, 29 aa, Entamoeba dispar
TVVTLPCELCIGSKLKTYIFIDNEVVSFS

SEQ ID NO: 2507556 - protein, 25 aa, Entamoeba dispar
TVYEGICYSTPLPTRSFFYDESIGI

SEQ ID NO: 2507557 - protein, 38 aa, Entamoeba dispar
TVYEKYILKPCRFLRQREKECVEFPCIPPRIKTPPLEH

SEQ ID NO: 2507558 - protein, 24 aa, Entamoeba dispar
TVYFSLNPFEGFAIVLQNQGSKAL

SEQ ID NO: 2507559 - protein, 24 aa, Entamoeba dispar
TWDSEAKYYFQFCPCEKHKQWIVN

SEQ ID NO: 2507560 - protein, 17 aa, Entamoeba dispar
TWEKLSLAARVIAGISN

SEQ ID NO: 2507561 - protein, 18 aa, Entamoeba dispar
TWFIENLMIHIERRKQLL

SEQ ID NO: 2507562 - protein, 25 aa, Entamoeba dispar
TWGDTFEFYNVVPGTMATFTVMDYD

SEQ ID NO: 2507563 - protein, 35 aa, Entamoeba dispar
TWGIKFDNLNGFKWNNMRIIQCKEDKLNLDIKDWM

SEQ ID NO: 2507564 - protein, 29 aa, Entamoeba dispar
TWGNTLIPFSFRNGGSFFIIIGGEKSTKP

SEQ ID NO: 2507565 - protein, 18 aa, Entamoeba dispar
TWIFNGVNKLVFTDKWEK

SEQ ID NO: 2507566 - protein, 23 aa, Entamoeba dispar
TWKVSRPNFATVRKYENRKVILE

SEQ ID NO: 2507567 - protein, 17 aa, Entamoeba dispar
TWNSIIFDQVERIKSIA

SEQ ID NO: 2507568 - protein, 21 aa, Entamoeba dispar
TWPQAIQQFALGFMFHPLQIN

SEQ ID NO: 2507569 - protein, 27 aa, Entamoeba dispar
TWTNFGSKILPEFNIKKALNIYFVCTE

SEQ ID NO: 2507570 - protein, 19 aa, Entamoeba dispar
TWVAPFLFRNKYNQWDRTI

SEQ ID NO: 2507571 - protein, 18 aa, Entamoeba dispar
TWVYINIHKLYKLYCFEG

SEQ ID NO: 2507572 - protein, 18 aa, Entamoeba dispar
TYASPCKEVLDIKITRDN

SEQ ID NO: 2507573 - protein, 24 aa, Entamoeba dispar
TYAVPFKPIHFISMINEIPNIDII

SEQ ID NO: 2507574 - protein, 24 aa, Entamoeba dispar
TYCKKCGTKLMQRKIFKTTFTQNF

SEQ ID NO: 2507575 - protein, 22 aa, Entamoeba dispar
TYCTGIPILFVGSGQHYTDLKL

SEQ ID NO: 2507576 - protein, 18 aa, Entamoeba dispar
TYDLKYRIGDNVFTAAQD

SEQ ID NO: 2507577 - protein, 19 aa, Entamoeba dispar
TYDSGLRMHPIRITDLSTY

SEQ ID NO: 2507578 - protein, 25 aa, Entamoeba dispar
TYDSVEVFPGKGLNVIIGPNGAGKS

SEQ ID NO: 2507579 - protein, 20 aa, Entamoeba dispar
TYEDVRRLSLTFRRMADTDR

SEQ ID NO: 2507580 - protein, 24 aa, Entamoeba dispar
TYEEVELILSIGVELIKKSNKFVG

SEQ ID NO: 2507581 - protein, 26 aa, Entamoeba dispar
TYEKPKRRFSLSISKGSRSSSRKRED

SEQ ID NO: 2507582 - protein, 25 aa, Entamoeba dispar
TYEMLRLAIEKQIRKFGLPYTADVD

SEQ ID NO: 2507583 - protein, 25 aa, Entamoeba dispar
TYESVKGWLKDVGYYAPKDIIKYLI

SEQ ID NO: 2507584 - protein, 25 aa, Entamoeba dispar
TYESVKGWLKDVGYYAPKDIIKYLV

SEQ ID NO: 2507585 - protein, 21 aa, Entamoeba dispar
TYFANCLQWILPSMGDDIYLF

SEQ ID NO: 2507586 - protein, 19 aa, Entamoeba dispar
TYFHYYLKYFAIRDKVSAR

SEQ ID NO: 2507587 - protein, 24 aa, Entamoeba dispar
TYFIFGRIDGCLDLLEFKNKSFTF

SEQ ID NO: 2507588 - protein, 19 aa, Entamoeba dispar
TYFIHFTGDFVIPKYSFSS

SEQ ID NO: 2507589 - protein, 22 aa, Entamoeba dispar
TYFIKIGLQFFVGSSCGIKTCS

SEQ ID NO: 2507590 - protein, 17 aa, Entamoeba dispar
TYFKKNAKWSINKNVPN

SEQ ID NO: 2507591 - protein, 26 aa, Entamoeba dispar
TYGFYPEKSYFYLIKNADTIRLMDQN

SEQ ID NO: 2507592 - protein, 26 aa, Entamoeba dispar
TYGIKCLKSGMSMICKRNEVDGVRLS

SEQ ID NO: 2507593 - protein, 29 aa, Entamoeba dispar
TYGKDICFRKGDEMICFSTSDNRWLLVQH

SEQ ID NO: 2507594 - protein, 23 aa, Entamoeba dispar
TYIDGGVVKLFFPMNKKIKAPIK

SEQ ID NO: 2507595 - protein, 17 aa, Entamoeba dispar
TYIILNVYYKQYLIPLM

SEQ ID NO: 2507596 - protein, 17 aa, Entamoeba dispar
TYIQLRISVGFTGPETK

SEQ ID NO: 2507597 - protein, 25 aa, Entamoeba dispar
TYKESEWKLIFSVVGQCIEEEYQKT

SEQ ID NO: 2507598 - protein, 23 aa, Entamoeba dispar
TYKHIPHCFIQFQNMFISLETPF

SEQ ID NO: 2507599 - protein, 18 aa, Entamoeba dispar
TYKITKYIRCKKVKYNRE

SEQ ID NO: 2507600 - protein, 24 aa, Entamoeba dispar
TYKNAIPLARRVVPYSNPLYHLSI

SEQ ID NO: 2507601 - protein, 23 aa, Entamoeba dispar
TYKNLKFFLDFVSQRKTTLIEKV

SEQ ID NO: 2507602 - protein, 21 aa, Entamoeba dispar
TYKNPFNVIGVLPEDDNDTIH

SEQ ID NO: 2507603 - protein, 30 aa, Entamoeba dispar
TYKRGVDRFKTFICVGSTYIGKSVFFTKFI

SEQ ID NO: 2507604 - protein, 19 aa, Entamoeba dispar
TYLEFKRKYEEHGKNKDYY

SEQ ID NO: 2507605 - protein, 18 aa, Entamoeba dispar
TYLYPRIDINVSVQLNHL

SEQ ID NO: 2507606 - protein, 18 aa, Entamoeba dispar
TYMKRVLSTMSYNKQVII

SEQ ID NO: 2507607 - protein, 21 aa, Entamoeba dispar
TYMRMLECVEKVGEAAECRTD

SEQ ID NO: 2507608 - protein, 23 aa, Entamoeba dispar
TYNTEDGLEWIIGNVEQGSTGAM

SEQ ID NO: 2507609 - protein, 17 aa, Entamoeba dispar
TYPIWKDIFNVASKREI

SEQ ID NO: 2507610 - protein, 26 aa, Entamoeba dispar
TYQEWFKMLWYKGLFTYYREDLHLSE

SEQ ID NO: 2507611 - protein, 24 aa, Entamoeba dispar
TYQFIKPRISETIQLSETSLYHVR

SEQ ID NO: 2507612 - protein, 18 aa, Entamoeba dispar
TYQIPFELPHPIHEALTG

SEQ ID NO: 2507613 - protein, 18 aa, Entamoeba dispar
TYSLDLLLIRSIATKGYK

SEQ ID NO: 2507614 - protein, 19 aa, Entamoeba dispar
TYSLFSFGVQMFDLSTLLS

SEQ ID NO: 2507615 - protein, 18 aa, Entamoeba dispar
TYSLFSFSIQMFDLSTLL

SEQ ID NO: 2507616 - protein, 18 aa, Entamoeba dispar
TYVPRYYVPALKDKNGNA

SEQ ID NO: 2507617 - protein, 25 aa, Entamoeba dispar
TYVPTRFLFCYGTCPFNGTEVEDVV

SEQ ID NO: 2507618 - protein, 24 aa, Entamoeba dispar
TYVRRCSLMALGKVFKDKVTTTKS

SEQ ID NO: 2507619 - protein, 19 aa, Entamoeba dispar
TYYCAKSFCTPKMIEARNM

SEQ ID NO: 2507620 - protein, 24 aa, Entamoeba dispar
TYYVDCPKGIVIFNQSYLITYQEG

SEQ ID NO: 2507621 - protein, 22 aa, Entamoeba dispar
VAACFNYFLSCIVGERSSEFKV

SEQ ID NO: 2507622 - protein, 17 aa, Entamoeba dispar
VAAHHGWVFGGDPFFDF

SEQ ID NO: 2507623 - protein, 17 aa, Entamoeba dispar
VAARAGIHVSETLKSYN

SEQ ID NO: 2507624 - protein, 20 aa, Entamoeba dispar
VAAWKKYPSLIPQIVQDICI

SEQ ID NO: 2507625 - protein, 17 aa, Entamoeba dispar
VACDGLWDVFDNQTVAR

SEQ ID NO: 2507626 - protein, 25 aa, Entamoeba dispar
VACIPFKASCALVDNNVEWVPVEQL

SEQ ID NO: 2507627 - protein, 32 aa, Entamoeba dispar
VACKKRGQTAWARRDMIIFNGLFVLYGETGRI

SEQ ID NO: 2507628 - protein, 23 aa, Entamoeba dispar
VADCGVEFIHIIAAQAKDVAANT

SEQ ID NO: 2507629 - protein, 18 aa, Entamoeba dispar
VADGYVFNSNIMKSSKIT

SEQ ID NO: 2507630 - protein, 19 aa, Entamoeba dispar
VADILLLELTIAFYKINFY

SEQ ID NO: 2507631 - protein, 17 aa, Entamoeba dispar
VADKFAACRAIENGCWV

SEQ ID NO: 2507632 - protein, 22 aa, Entamoeba dispar
VADKLKIISSWYEKLSKELSSN

SEQ ID NO: 2507633 - protein, 24 aa, Entamoeba dispar
VADLMKSNLGVRLPHDSFSLNVIR

SEQ ID NO: 2507634 - protein, 23 aa, Entamoeba dispar
VAEAIAALINFFATMIRRTTFEE

SEQ ID NO: 2507635 - protein, 17 aa, Entamoeba dispar
VAEFSAHCTTEWYWTYD

SEQ ID NO: 2507636 - protein, 27 aa, Entamoeba dispar
VAELISRLCAECIVGDTTLAQNIIEEA

SEQ ID NO: 2507637 - protein, 25 aa, Entamoeba dispar
VAENIYRVVLYFARSLENESTSDET

SEQ ID NO: 2507638 - protein, 23 aa, Entamoeba dispar
VAESLRKKLIVFLVGNTIVECDR

SEQ ID NO: 2507639 - protein, 20 aa, Entamoeba dispar
VAESWYGRFIYANNQREGLK

SEQ ID NO: 2507640 - protein, 23 aa, Entamoeba dispar
VAFDCLKKHGVIIYMEPQDFLMK

SEQ ID NO: 2507641 - protein, 32 aa, Entamoeba dispar
VAFGMKEWAEELGAVCFAHWFQPLTSKSAKKF

SEQ ID NO: 2507642 - protein, 20 aa, Entamoeba dispar
VAGTELCINKILLMNLYQFF

SEQ ID NO: 2507643 - protein, 25 aa, Entamoeba dispar
VAHDGAIWDLQWHPVGHLLASCAHD

SEQ ID NO: 2507644 - protein, 24 aa, Entamoeba dispar
VAHDISLLIPEIWSKMRRYEQEPK

SEQ ID NO: 2507645 - protein, 24 aa, Entamoeba dispar
VAHDISLLIPEIWSRMRRYEQEPK

SEQ ID NO: 2507646 - protein, 27 aa, Entamoeba dispar
VAHTRKRPFADWGDIDIGKALKMPDLE

SEQ ID NO: 2507647 - protein, 17 aa, Entamoeba dispar
VAIKCGDQWIARENKIL

SEQ ID NO: 2507648 - protein, 17 aa, Entamoeba dispar
VAILRYELNLEDEDEGE

SEQ ID NO: 2507649 - protein, 24 aa, Entamoeba dispar
VAINSLKISPWFTSEKDVNKFCRI

SEQ ID NO: 2507650 - protein, 20 aa, Entamoeba dispar
VAITRAKKGLIIVGNYNTLR

SEQ ID NO: 2507651 - protein, 26 aa, Entamoeba dispar
VAIYLPNCCEYVYSQLAALCGGYIMM

SEQ ID NO: 2507652 - protein, 22 aa, Entamoeba dispar
VAKEAIKMIFNFNENNVFGKSS

SEQ ID NO: 2507653 - protein, 24 aa, Entamoeba dispar
VAKIKKYRRALLFNYDKETDMVEL

SEQ ID NO: 2507654 - protein, 25 aa, Entamoeba dispar
VAKKYGAVCVIGIGYPLPISKVTHD

SEQ ID NO: 2507655 - protein, 19 aa, Entamoeba dispar
VAKLCCALNVFPNTTTLKQ

SEQ ID NO: 2507656 - protein, 30 aa, Entamoeba dispar
VAKNELGKWFKIKILTFKDGGNISLDRSLL

SEQ ID NO: 2507657 - protein, 19 aa, Entamoeba dispar
VAKTACYGRFCLERYLEGE

SEQ ID NO: 2507658 - protein, 22 aa, Entamoeba dispar
VALEMIKTQFLAVFEGSLNLYE

SEQ ID NO: 2507659 - protein, 25 aa, Entamoeba dispar
VALIKPLGTYPIRIDTTGAGDTTII

SEQ ID NO: 2507660 - protein, 20 aa, Entamoeba dispar
VALIRCVVTYGKEKPLRSPY

SEQ ID NO: 2507661 - protein, 26 aa, Entamoeba dispar
VALKTEIRTLLSILSLLCITQKDINE

SEQ ID NO: 2507662 - protein, 18 aa, Entamoeba dispar
VALLKLYIKTSCTPFFIM

SEQ ID NO: 2507663 - protein, 20 aa, Entamoeba dispar
VALLNCLTTLIGEPYTDNGE

SEQ ID NO: 2507664 - protein, 17 aa, Entamoeba dispar
VALPLIRKTVFPSLKNQ

SEQ ID NO: 2507665 - protein, 19 aa, Entamoeba dispar
VALQQFGEIVYNFVQVLDQ

SEQ ID NO: 2507666 - protein, 17 aa, Entamoeba dispar
VALSRGFTDIVVGKSGF

SEQ ID NO: 2507667 - protein, 24 aa, Entamoeba dispar
VALSRLKSLDGLYIEGTVIKERIK

SEQ ID NO: 2507668 - protein, 24 aa, Entamoeba dispar
VALSSLRKSIYFEMTPIILNEVIE

SEQ ID NO: 2507669 - protein, 21 aa, Entamoeba dispar
VAMDRRCVYMFGQNLPQSKEG

SEQ ID NO: 2507670 - protein, 18 aa, Entamoeba dispar
VAMGIHAIGGMLNGGERV

SEQ ID NO: 2507671 - protein, 20 aa, Entamoeba dispar
VAPADKVNAVFLHFQSVLSI

SEQ ID NO: 2507672 - protein, 17 aa, Entamoeba dispar
VAPRQVTEPVPILHEPP

SEQ ID NO: 2507673 - protein, 26 aa, Entamoeba dispar
VAQLYKLGKNEIMCDWLRNEENKGRT

SEQ ID NO: 2507674 - protein, 17 aa, Entamoeba dispar
VAQYYDLQAQEIDEYNK

SEQ ID NO: 2507675 - protein, 23 aa, Entamoeba dispar
VARGAALVGFDLFKEGLIKKNKF

SEQ ID NO: 2507676 - protein, 25 aa, Entamoeba dispar
VARIHFKLAKRTAAIKTLKLKIYKE

SEQ ID NO: 2507677 - protein, 24 aa, Entamoeba dispar
VARIVLKDYCCGKLVYCKPPPGIT

SEQ ID NO: 2507678 - protein, 19 aa, Entamoeba dispar
VARLYHWKHPNIVGFEGCW

SEQ ID NO: 2507679 - protein, 29 aa, Entamoeba dispar
VASESILTFNCFDWDNAFKFSSDDFLGKF

SEQ ID NO: 2507680 - protein, 22 aa, Entamoeba dispar
VASILYSRVRKSIINKFNSKNI

SEQ ID NO: 2507681 - protein, 34 aa, Entamoeba dispar
VASIVSKCFFLKVGKTFIKRYFSKYFSQLLAEKL

SEQ ID NO: 2507682 - protein, 18 aa, Entamoeba dispar
VASMNIALGVPRIKEIIN

SEQ ID NO: 2507683 - protein, 19 aa, Entamoeba dispar
VASRIPIALLSRVLEYLTK

SEQ ID NO: 2507684 - protein, 24 aa, Entamoeba dispar
VASYYRGVLGIAMIYDVTSKDSFD

SEQ ID NO: 2507685 - protein, 22 aa, Entamoeba dispar
VATDLFLKFIRVLESKVELHTN

SEQ ID NO: 2507686 - protein, 20 aa, Entamoeba dispar
VAVGKSCLLLQFQDKRFQPI

SEQ ID NO: 2507687 - protein, 21 aa, Entamoeba dispar
VAVGKSCLLLQFQDKRFQPIH

SEQ ID NO: 2507688 - protein, 18 aa, Entamoeba dispar
VAVSPHYLALGGTDDLIR

SEQ ID NO: 2507689 - protein, 28 aa, Entamoeba dispar
VAYKCFKLGDFNMAFIIYSCIVRASYKH

SEQ ID NO: 2507690 - protein, 19 aa, Entamoeba dispar
VAYLTCQKALYVYSDDNSK

SEQ ID NO: 2507691 - protein, 26 aa, Entamoeba dispar
VAYTNAVDWWGLGILIYEMLYGTVPF

SEQ ID NO: 2507692 - protein, 17 aa, Entamoeba dispar
VCALIKKPFIFNINTVY

SEQ ID NO: 2507693 - protein, 17 aa, Entamoeba dispar
VCCGMHCASNLKYRESA

SEQ ID NO: 2507694 - protein, 23 aa, Entamoeba dispar
VCCGSYNPIHYIHLLLFELTKNY

SEQ ID NO: 2507695 - protein, 19 aa, Entamoeba dispar
VCCICNVGFGIPEFPKLLP

SEQ ID NO: 2507696 - protein, 24 aa, Entamoeba dispar
VCDERSKLLLELTVGTELQNPKYS

SEQ ID NO: 2507697 - protein, 26 aa, Entamoeba dispar
VCDGMRRMGYAKGNLEAIIQIITHLD

SEQ ID NO: 2507698 - protein, 17 aa, Entamoeba dispar
VCDKNCVCVKHGQSCIF

SEQ ID NO: 2507699 - protein, 27 aa, Entamoeba dispar
VCDQIKKRKNGILALREPVFEWVESVM

SEQ ID NO: 2507700 - protein, 18 aa, Entamoeba dispar
VCEMVPCHFEILRTELID

SEQ ID NO: 2507701 - protein, 24 aa, Entamoeba dispar
VCFEEGFHYNEFWDILHGVEKGYL

SEQ ID NO: 2507702 - protein, 18 aa, Entamoeba dispar
VCFPDYDFSLGVTTNTNI

SEQ ID NO: 2507703 - protein, 17 aa, Entamoeba dispar
VCFPTPLYQANKFCKML

SEQ ID NO: 2507704 - protein, 22 aa, Entamoeba dispar
VCGCGYCYKCHKKVKHFSPHIL

SEQ ID NO: 2507705 - protein, 19 aa, Entamoeba dispar
VCGCYFNLQEIIKSPNNTI

SEQ ID NO: 2507706 - protein, 18 aa, Entamoeba dispar
VCGGDGTVGWVMNELRKA

SEQ ID NO: 2507707 - protein, 22 aa, Entamoeba dispar
VCGKGNIAFIVLRNGGECFGCY

SEQ ID NO: 2507708 - protein, 20 aa, Entamoeba dispar
VCGSDLFIAPEILKKLYNGT

SEQ ID NO: 2507709 - protein, 19 aa, Entamoeba dispar
VCGVLKRIISIMKSINEKK

SEQ ID NO: 2507710 - protein, 18 aa, Entamoeba dispar
VCHGCGKPFELTQAKEIF

SEQ ID NO: 2507711 - protein, 17 aa, Entamoeba dispar
VCHVPSIAVRNMAGHTG

SEQ ID NO: 2507712 - protein, 27 aa, Entamoeba dispar
VCICICSDGSFLPLLVCLPKEYLSSLI

SEQ ID NO: 2507713 - protein, 20 aa, Entamoeba dispar
VCINTYLVQHGLAFVDKHFH

SEQ ID NO: 2507714 - protein, 17 aa, Entamoeba dispar
VCIQSAAAPGYFGSVNA

SEQ ID NO: 2507715 - protein, 23 aa, Entamoeba dispar
VCKCDVSTNKCCKSTQVQNGNYC

SEQ ID NO: 2507716 - protein, 20 aa, Entamoeba dispar
VCKMFSLRMDMTRIEKDLLE

SEQ ID NO: 2507717 - protein, 22 aa, Entamoeba dispar
VCKQLKIGKYIPGYDKNSEPIY

SEQ ID NO: 2507718 - protein, 17 aa, Entamoeba dispar
VCKRFELSTSEMIGKVT

SEQ ID NO: 2507719 - protein, 28 aa, Entamoeba dispar
VCKVCKEKISGKFAWRENGFICGNCVSK

SEQ ID NO: 2507720 - protein, 17 aa, Entamoeba dispar
VCKYLNYLSKFYTHDRF

SEQ ID NO: 2507721 - protein, 23 aa, Entamoeba dispar
VCLERYWGISFANWVSRRIEIHF

SEQ ID NO: 2507722 - protein, 22 aa, Entamoeba dispar
VCNKGSFEMLDYWIEEYKREQP

SEQ ID NO: 2507723 - protein, 17 aa, Entamoeba dispar
VCNKSALFIIRRNGMKE

SEQ ID NO: 2507724 - protein, 19 aa, Entamoeba dispar
VCNKSALFIIRRNGMKEYI

SEQ ID NO: 2507725 - protein, 19 aa, Entamoeba dispar
VCPDGSLAIIDRKKNLFKL

SEQ ID NO: 2507726 - protein, 19 aa, Entamoeba dispar
VCPEQSFFNYFFPTSQFTL

SEQ ID NO: 2507727 - protein, 22 aa, Entamoeba dispar
VCPKQSFFNYFFRTSQFTLTKI

SEQ ID NO: 2507728 - protein, 25 aa, Entamoeba dispar
VCPLSHRFKLCVITKQPVVKVYKSW

SEQ ID NO: 2507729 - protein, 25 aa, Entamoeba dispar
VCPTPRTNMISQILPEFAELSQSGD

SEQ ID NO: 2507730 - protein, 18 aa, Entamoeba dispar
VCQCSGKYRSCSGSPTEE

SEQ ID NO: 2507731 - protein, 18 aa, Entamoeba dispar
VCQTCSGIHREFGHRVKS

SEQ ID NO: 2507732 - protein, 18 aa, Entamoeba dispar
VCRCEFCDGHFSVPSIPK

SEQ ID NO: 2507733 - protein, 23 aa, Entamoeba dispar
VCREWKMFLNYFPLQCSIYSKSQ

SEQ ID NO: 2507734 - protein, 25 aa, Entamoeba dispar
VCSALKEMKCPRLLQPHQITGLDFG

SEQ ID NO: 2507735 - protein, 24 aa, Entamoeba dispar
VCSEEGFEIPIPLFYEIKKEKVLL

SEQ ID NO: 2507736 - protein, 18 aa, Entamoeba dispar
VCSNSSPNCLVCKNGYGL

SEQ ID NO: 2507737 - protein, 18 aa, Entamoeba dispar
VCSSCFGIYCEKQKERCP

SEQ ID NO: 2507738 - protein, 20 aa, Entamoeba dispar
VCSTLTICTRSTLLKQKFFA

SEQ ID NO: 2507739 - protein, 22 aa, Entamoeba dispar
VCSVTLPLQILIQLMKSPTDEN

SEQ ID NO: 2507740 - protein, 19 aa, Entamoeba dispar
VCTVCQSKGPFSIDVQNTI

SEQ ID NO: 2507741 - protein, 18 aa, Entamoeba dispar
VCVPINFNTIDSFDPNKV

SEQ ID NO: 2507742 - protein, 20 aa, Entamoeba dispar
VCVTLKYLMEHIVQLEVPLV

SEQ ID NO: 2507743 - protein, 19 aa, Entamoeba dispar
VCWFECSSNTVGLCQYLDT

SEQ ID NO: 2507744 - protein, 18 aa, Entamoeba dispar
VCYSARVSPYLPSPKLMN

SEQ ID NO: 2507745 - protein, 23 aa, Entamoeba dispar
VCYWQVPSMYTGQMIYDILEIDK

SEQ ID NO: 2507746 - protein, 18 aa, Entamoeba dispar
VDAAIPYISTIEIEGDIV

SEQ ID NO: 2507747 - protein, 18 aa, Entamoeba dispar
VDAEIAFYVSAQVEDIPF

SEQ ID NO: 2507748 - protein, 17 aa, Entamoeba dispar
VDAIEFWSDRFSDGDVP

SEQ ID NO: 2507749 - protein, 24 aa, Entamoeba dispar
VDALVSLSKYVGWVSTDTLIASNF

SEQ ID NO: 2507750 - protein, 18 aa, Entamoeba dispar
VDATAFVKKVIGAFKDCS

SEQ ID NO: 2507751 - protein, 31 aa, Entamoeba dispar
VDATWKKPQEWNHKCVMCVSKMGKFSSDRSM

SEQ ID NO: 2507752 - protein, 17 aa, Entamoeba dispar
VDCAAPERFGESKKELD

SEQ ID NO: 2507753 - protein, 24 aa, Entamoeba dispar
VDCGVFMLYFIRKFMEYTPSDGIK

SEQ ID NO: 2507754 - protein, 17 aa, Entamoeba dispar
VDCHVLRQYLNKTIKVE

SEQ ID NO: 2507755 - protein, 18 aa, Entamoeba dispar
VDCIMKCPIDCRSDLFGT

SEQ ID NO: 2507756 - protein, 20 aa, Entamoeba dispar
VDCKGVLCFVPKLCGEDVQE

SEQ ID NO: 2507757 - protein, 18 aa, Entamoeba dispar
VDCPIKLFDGNTIPVRII

SEQ ID NO: 2507758 - protein, 24 aa, Entamoeba dispar
VDDGWVMRKFTSSIEWTKKDLMSL

SEQ ID NO: 2507759 - protein, 27 aa, Entamoeba dispar
VDDICKNFSCSASFKLKQIIKDYTLSL

SEQ ID NO: 2507760 - protein, 23 aa, Entamoeba dispar
VDDIKIATAFMKTMILLHNLRTI

SEQ ID NO: 2507761 - protein, 18 aa, Entamoeba dispar
VDDKCRWSPIKPESKKTS

SEQ ID NO: 2507762 - protein, 19 aa, Entamoeba dispar
VDDLIWPLLEKKLKISGET

SEQ ID NO: 2507763 - protein, 19 aa, Entamoeba dispar
VDDNVCWLLVGCKSDLVNS

SEQ ID NO: 2507764 - protein, 20 aa, Entamoeba dispar
VDDSLNFHCCVKPNGHQVDM

SEQ ID NO: 2507765 - protein, 24 aa, Entamoeba dispar
VDDYTVRVVDVFAMPQNGTGVSVE

SEQ ID NO: 2507766 - protein, 19 aa, Entamoeba dispar
VDEAFRVLVKMEPNDHFGI

SEQ ID NO: 2507767 - protein, 18 aa, Entamoeba dispar
VDEGCIGLTSTIKANNKK

SEQ ID NO: 2507768 - protein, 33 aa, Entamoeba dispar
VDEIIPIKTQEAWKMARIVVKYEGIMCGMSSGA

SEQ ID NO: 2507769 - protein, 17 aa, Entamoeba dispar
VDEILAMFSHELVITQV

SEQ ID NO: 2507770 - protein, 25 aa, Entamoeba dispar
VDEISHWIGTMILMFPDVEMRAKLM

SEQ ID NO: 2507771 - protein, 18 aa, Entamoeba dispar
VDEIVLFLSSHNVYQHFM

SEQ ID NO: 2507772 - protein, 27 aa, Entamoeba dispar
VDELLKMPYFLERFSLDDVADTFRPLF

SEQ ID NO: 2507773 - protein, 18 aa, Entamoeba dispar
VDFADFINKCFIFESKDR

SEQ ID NO: 2507774 - protein, 23 aa, Entamoeba dispar
VDFDTVVCWFGEFFNDPKIIDEM

SEQ ID NO: 2507775 - protein, 20 aa, Entamoeba dispar
VDFEADFPFYKEFFYGNDQV

SEQ ID NO: 2507776 - protein, 20 aa, Entamoeba dispar
VDFICSFGRILEILILNKEM

SEQ ID NO: 2507777 - protein, 26 aa, Entamoeba dispar
VDFINVRDIFKFLSVHWDILSHLEQM

SEQ ID NO: 2507778 - protein, 27 aa, Entamoeba dispar
VDFIVPEGFMPRMIDGINIVLLIDLNC

SEQ ID NO: 2507779 - protein, 17 aa, Entamoeba dispar
VDFKPKILNIRNKTVKM

SEQ ID NO: 2507780 - protein, 19 aa, Entamoeba dispar
VDFKPMILNLGERTVKLQI

SEQ ID NO: 2507781 - protein, 21 aa, Entamoeba dispar
VDFPAWDISLSIPSGYINLTK

SEQ ID NO: 2507782 - protein, 24 aa, Entamoeba dispar
VDFRVFCFYFEFLMNAFKNKSSVI

SEQ ID NO: 2507783 - protein, 26 aa, Entamoeba dispar
VDFTNKQGYEWYRFMSKTSPVLTLWA

SEQ ID NO: 2507784 - protein, 17 aa, Entamoeba dispar
VDGAFSIMFPLNEVVSE

SEQ ID NO: 2507785 - protein, 24 aa, Entamoeba dispar
VDGASAFDLLNYISSLPLEQALPP

SEQ ID NO: 2507786 - protein, 28 aa, Entamoeba dispar
VDGDDRLWLRLGKEYTISKEKSSNVIVN

SEQ ID NO: 2507787 - protein, 25 aa, Entamoeba dispar
VDGNVKLTLGLVWTLILRFAISELS

SEQ ID NO: 2507788 - protein, 26 aa, Entamoeba dispar
VDGNVKLTLGLVWTLILRFAISELSA

SEQ ID NO: 2507789 - protein, 19 aa, Entamoeba dispar
VDGQCPCGHKHQLGNQIYD

SEQ ID NO: 2507790 - protein, 17 aa, Entamoeba dispar
VDGRTASINFIRATLQY

SEQ ID NO: 2507791 - protein, 26 aa, Entamoeba dispar
VDGWYDPRFPTIQGLIRRGLTLEAMK

SEQ ID NO: 2507792 - protein, 30 aa, Entamoeba dispar
VDIDLSYKILKLCVEDGVLVNKSSPSVVAE

SEQ ID NO: 2507793 - protein, 19 aa, Entamoeba dispar
VDIGERVLHIHSMILKTTP

SEQ ID NO: 2507794 - protein, 25 aa, Entamoeba dispar
VDIGSYCYAELDFLAFENATKKSKP

SEQ ID NO: 2507795 - protein, 24 aa, Entamoeba dispar
VDIIPSPRVRPSLSQIKENETPNT

SEQ ID NO: 2507796 - protein, 24 aa, Entamoeba dispar
VDIIPSPRVRPSLSQIKENETSNT

SEQ ID NO: 2507797 - protein, 25 aa, Entamoeba dispar
VDIIYNLVKRPSLGHYFTPELSHEI

SEQ ID NO: 2507798 - protein, 20 aa, Entamoeba dispar
VDIKTGKSLNVFSSSTNQFR

SEQ ID NO: 2507799 - protein, 23 aa, Entamoeba dispar
VDIPEFHIKKLINFIQNLIQLTP

SEQ ID NO: 2507800 - protein, 17 aa, Entamoeba dispar
VDIPQFVPFIPKVLQSV

SEQ ID NO: 2507801 - protein, 20 aa, Entamoeba dispar
VDIYSGYFFHVEFVGEALKS

SEQ ID NO: 2507802 - protein, 17 aa, Entamoeba dispar
VDKDLWIVMEICGAGSV

SEQ ID NO: 2507803 - protein, 19 aa, Entamoeba dispar
VDKEFKKWLEQQNISMYGE

SEQ ID NO: 2507804 - protein, 26 aa, Entamoeba dispar
VDKFKVYKIPLPPTIEMPSQSSNKME

SEQ ID NO: 2507805 - protein, 24 aa, Entamoeba dispar
VDKIYTQRIILFVGSPLNINSEEA

SEQ ID NO: 2507806 - protein, 22 aa, Entamoeba dispar
VDKKCFEGELVIPTAEEEKKVK

SEQ ID NO: 2507807 - protein, 18 aa, Entamoeba dispar
VDKLKKRLFDLSLSSRQT

SEQ ID NO: 2507808 - protein, 23 aa, Entamoeba dispar
VDKLLHCLFMKELSFESEKKYDI

SEQ ID NO: 2507809 - protein, 28 aa, Entamoeba dispar
VDKLNRICRVFKPIITKDWKTLRHDMLC

SEQ ID NO: 2507810 - protein, 25 aa, Entamoeba dispar
VDKMTICIRKSMGIIDDYLVNDYYL

SEQ ID NO: 2507811 - protein, 23 aa, Entamoeba dispar
VDKVDLLIFFTELRRFCLDIINW

SEQ ID NO: 2507812 - protein, 19 aa, Entamoeba dispar
VDLFIQMKLALERGERIEN

SEQ ID NO: 2507813 - protein, 31 aa, Entamoeba dispar
VDLIPEEHRELFLYVCSKIHILRKNHLEQIS

SEQ ID NO: 2507814 - protein, 20 aa, Entamoeba dispar
VDLIRQCINIPFKRPSVESI

SEQ ID NO: 2507815 - protein, 25 aa, Entamoeba dispar
VDLKDGIRVINFFELLSGKTLKEKY

SEQ ID NO: 2507816 - protein, 23 aa, Entamoeba dispar
VDLKDKWRNLEFSRLRNNKQKSN

SEQ ID NO: 2507817 - protein, 22 aa, Entamoeba dispar
VDLLCYERYNIIKRLGDGQYSK

SEQ ID NO: 2507818 - protein, 23 aa, Entamoeba dispar
VDLLSRIGVIRAVGGIHFTLVET

SEQ ID NO: 2507819 - protein, 19 aa, Entamoeba dispar
VDLLTDMFVMDSFECTRAI

SEQ ID NO: 2507820 - protein, 27 aa, Entamoeba dispar
VDLMETCVRRSLIYPVVRNWELSIKTL

SEQ ID NO: 2507821 - protein, 26 aa, Entamoeba dispar
VDLMPLKLSSLYVRGTLKNVVIPTTL

SEQ ID NO: 2507822 - protein, 23 aa, Entamoeba dispar
VDLREIITPLALELGGSGGGHFN

SEQ ID NO: 2507823 - protein, 30 aa, Entamoeba dispar
VDLSSFRYTDVLKKYCYDKILMKQNKELSN

SEQ ID NO: 2507824 - protein, 19 aa, Entamoeba dispar
VDMAYKRDFRIIKKKMREK

SEQ ID NO: 2507825 - protein, 19 aa, Entamoeba dispar
VDMIEWSKSGLVVYDSQVP

SEQ ID NO: 2507826 - protein, 29 aa, Entamoeba dispar
VDMWSVGCVFLEIFKHRPVFHGKTENEQL

SEQ ID NO: 2507827 - protein, 25 aa, Entamoeba dispar
VDNLKRLKLQGVNKLKISKMKEEQQ

SEQ ID NO: 2507828 - protein, 24 aa, Entamoeba dispar
VDNSCSRMFLDLSMIDIVINLSNE

SEQ ID NO: 2507829 - protein, 19 aa, Entamoeba dispar
VDPEILAMLNGDKETNDMD

SEQ ID NO: 2507830 - protein, 18 aa, Entamoeba dispar
VDPFMMRVVKKYFNDDYI

SEQ ID NO: 2507831 - protein, 20 aa, Entamoeba dispar
VDPHSSFVFLFDIVNPDTNP

SEQ ID NO: 2507832 - protein, 17 aa, Entamoeba dispar
VDPKAFVERILKLKEGK

SEQ ID NO: 2507833 - protein, 18 aa, Entamoeba dispar
VDPKAFVERILKLKEGKK

SEQ ID NO: 2507834 - protein, 22 aa, Entamoeba dispar
VDPPLYLAHVMQDFLWDNDECI

SEQ ID NO: 2507835 - protein, 23 aa, Entamoeba dispar
VDQERFIFPSSFICLLSESDKKI

SEQ ID NO: 2507836 - protein, 28 aa, Entamoeba dispar
VDRFDMCLKVVFRLICVHVALCSKMEEF

SEQ ID NO: 2507837 - protein, 29 aa, Entamoeba dispar
VDRGSFGVECVLTLFSFMIIYPNSVFLAR

SEQ ID NO: 2507838 - protein, 17 aa, Entamoeba dispar
VDRMKRTNFLIVDNRTI

SEQ ID NO: 2507839 - protein, 21 aa, Entamoeba dispar
VDRPKWCKIQDEFEGKETEAF

SEQ ID NO: 2507840 - protein, 23 aa, Entamoeba dispar
VDRSGAYCARWIAKSLVHAGLCH

SEQ ID NO: 2507841 - protein, 24 aa, Entamoeba dispar
VDRSGAYCARWIAKSLVHAGLCHR

SEQ ID NO: 2507842 - protein, 17 aa, Entamoeba dispar
VDSANWKVGDVNYVLAI

SEQ ID NO: 2507843 - protein, 25 aa, Entamoeba dispar
VDSARLLFKNDLKGVEQFIKTFMKG

SEQ ID NO: 2507844 - protein, 27 aa, Entamoeba dispar
VDSICPEGIDVVWLWVNGSDPGFRKEF

SEQ ID NO: 2507845 - protein, 18 aa, Entamoeba dispar
VDSIHEFHLWQLANETNV

SEQ ID NO: 2507846 - protein, 28 aa, Entamoeba dispar
VDSKVIFKIICFICSFITEKEEIQEILS

SEQ ID NO: 2507847 - protein, 29 aa, Entamoeba dispar
VDSKVIFKIICFICSFITEKEEIQEIVSS

SEQ ID NO: 2507848 - protein, 19 aa, Entamoeba dispar
VDSLKKRVIELSNELNQTF

SEQ ID NO: 2507849 - protein, 18 aa, Entamoeba dispar
VDTAVTMLKRHLFPYVNV

SEQ ID NO: 2507850 - protein, 18 aa, Entamoeba dispar
VDTIEFVFNLVLKGKSYI

SEQ ID NO: 2507851 - protein, 22 aa, Entamoeba dispar
VDTIITSYVRWRHSATAYNKLY

SEQ ID NO: 2507852 - protein, 28 aa, Entamoeba dispar
VDTLEEFRKLLPRLSKKVDIKSYEENTK

SEQ ID NO: 2507853 - protein, 19 aa, Entamoeba dispar
VDTLLKFIIIKSQMPHLAS

SEQ ID NO: 2507854 - protein, 25 aa, Entamoeba dispar
VDTWRNFCEVFRYLPVSALIEGKIL

SEQ ID NO: 2507855 - protein, 17 aa, Entamoeba dispar
VDVAFWRGLLVSASQDN

SEQ ID NO: 2507856 - protein, 18 aa, Entamoeba dispar
VDVAKSIFVDHDYTIPIN

SEQ ID NO: 2507857 - protein, 20 aa, Entamoeba dispar
VDVCLIKIIPYLIQLYPEEE

SEQ ID NO: 2507858 - protein, 23 aa, Entamoeba dispar
VDVDLPICFVIGVAKHPRTHEKV

SEQ ID NO: 2507859 - protein, 19 aa, Entamoeba dispar
VDVHKILPLFATIGDDAEI

SEQ ID NO: 2507860 - protein, 25 aa, Entamoeba dispar
VDVIDFAKRCYYWIHFGFTELGDLG

SEQ ID NO: 2507861 - protein, 18 aa, Entamoeba dispar
VDVKFYAAQIILALEHMH

SEQ ID NO: 2507862 - protein, 29 aa, Entamoeba dispar
VDVLGYPDCKCCLVEGVLYLARARKSNFL

SEQ ID NO: 2507863 - protein, 19 aa, Entamoeba dispar
VDVNPEFIPYIPTLSKFLS

SEQ ID NO: 2507864 - protein, 26 aa, Entamoeba dispar
VDVTIWRPPQVLIFQLKRFEFTEKYE

SEQ ID NO: 2507865 - protein, 18 aa, Entamoeba dispar
VDVWDWQSIVGIQPSTQN

SEQ ID NO: 2507866 - protein, 23 aa, Entamoeba dispar
VDYIREFWEWDSPQNRKRRYRCS

SEQ ID NO: 2507867 - protein, 21 aa, Entamoeba dispar
VDYPNSSWCFGLCSLQYTIED

SEQ ID NO: 2507868 - protein, 24 aa, Entamoeba dispar
VEAIKEIEQILILFSPQVFSLKNI

SEQ ID NO: 2507869 - protein, 26 aa, Entamoeba dispar
VEAKDRFRLLYTFLRKNKNKKTIVFM

SEQ ID NO: 2507870 - protein, 22 aa, Entamoeba dispar
VEAKSSFKRLFFDKDSNTSVIE

SEQ ID NO: 2507871 - protein, 25 aa, Entamoeba dispar
VEALKRILMCYGIYDMETMYMQGMN

SEQ ID NO: 2507872 - protein, 24 aa, Entamoeba dispar
VEAPFRTSINMGIFRGNYKDLQYI

SEQ ID NO: 2507873 - protein, 31 aa, Entamoeba dispar
VEARLFCFACSVFIREFRVPVNTMVWQLAAG

SEQ ID NO: 2507874 - protein, 23 aa, Entamoeba dispar
VEASKFDAVWGIKMEELDEGAND

SEQ ID NO: 2507875 - protein, 17 aa, Entamoeba dispar
VEAVRKGYWIVLDELNL

SEQ ID NO: 2507876 - protein, 22 aa, Entamoeba dispar
VECENLRCFVWSPSFVSMQKLS

SEQ ID NO: 2507877 - protein, 23 aa, Entamoeba dispar
VECICKCGGISILLSIIEKSTTS

SEQ ID NO: 2507878 - protein, 24 aa, Entamoeba dispar
VECNGVILPPHLCIGTIYDLFVKD

SEQ ID NO: 2507879 - protein, 19 aa, Entamoeba dispar
VECRKEYWNLISKSFQSKQ

SEQ ID NO: 2507880 - protein, 22 aa, Entamoeba dispar
VECSSEELWSLALDPFLPEYLT

SEQ ID NO: 2507881 - protein, 19 aa, Entamoeba dispar
VEDCVCIGLYYWTYDITSF

SEQ ID NO: 2507882 - protein, 17 aa, Entamoeba dispar
VEDICRALTSCGERLLA

SEQ ID NO: 2507883 - protein, 18 aa, Entamoeba dispar
VEDLKFIDWKCIVGKLTV

SEQ ID NO: 2507884 - protein, 24 aa, Entamoeba dispar
VEDMLMLCCYDINQHQSEYNQIVN

SEQ ID NO: 2507885 - protein, 23 aa, Entamoeba dispar
VEDYKFRYNRAIERMSDLEKNDS

SEQ ID NO: 2507886 - protein, 18 aa, Entamoeba dispar
VEDYKKSPSIELEKNTVY

SEQ ID NO: 2507887 - protein, 26 aa, Entamoeba dispar
VEECYLCAVFNFPTCHFVCRTVKNLE

SEQ ID NO: 2507888 - protein, 24 aa, Entamoeba dispar
VEEDELKTEFNIEPKKSPRIAIDI

SEQ ID NO: 2507889 - protein, 20 aa, Entamoeba dispar
VEEECKKRYLQKRKEKNERR

SEQ ID NO: 2507890 - protein, 17 aa, Entamoeba dispar
VEEHIFELFPFPHSYEI

SEQ ID NO: 2507891 - protein, 23 aa, Entamoeba dispar
VEEKSNVMILVITKEGYSFGCFN

SEQ ID NO: 2507892 - protein, 29 aa, Entamoeba dispar
VEELELFLKSTCRVLGLNWDEMKQFFNTE

SEQ ID NO: 2507893 - protein, 24 aa, Entamoeba dispar
VEELELRLGKMNGLSQSEDIIGGI

SEQ ID NO: 2507894 - protein, 19 aa, Entamoeba dispar
VEENNLYPLLSFKPDTVVQ

SEQ ID NO: 2507895 - protein, 21 aa, Entamoeba dispar
VEESNRIIIEYADENCENSHP

SEQ ID NO: 2507896 - protein, 17 aa, Entamoeba dispar
VEFCFYPSNNISLLSIG

SEQ ID NO: 2507897 - protein, 24 aa, Entamoeba dispar
VEFCKEYAIPIAHKGCCKVKMLDT

SEQ ID NO: 2507898 - protein, 20 aa, Entamoeba dispar
VEFFNSIVLLYAIGQMAING

SEQ ID NO: 2507899 - protein, 25 aa, Entamoeba dispar
VEFKESEEGWFFGCWQPKDILSGKK

SEQ ID NO: 2507900 - protein, 18 aa, Entamoeba dispar
VEFLIDEYIPYMYLKENT

SEQ ID NO: 2507901 - protein, 24 aa, Entamoeba dispar
VEFLSLLINYPFYNLFDWNDDMNT

SEQ ID NO: 2507902 - protein, 17 aa, Entamoeba dispar
VEFNKRNDAALAMKALD

SEQ ID NO: 2507903 - protein, 28 aa, Entamoeba dispar
VEFPDKFRKFGMEPSKGVLFFGPPGCGK

SEQ ID NO: 2507904 - protein, 19 aa, Entamoeba dispar
VEFSGCSNLTIIDTPGFRL

SEQ ID NO: 2507905 - protein, 17 aa, Entamoeba dispar
VEFSKQILPKFFKHSNI

SEQ ID NO: 2507906 - protein, 27 aa, Entamoeba dispar
VEFSLKRAGSKFVINQPAVYKLPSSEH

SEQ ID NO: 2507907 - protein, 17 aa, Entamoeba dispar
VEFSVNVLPQYAGKLYI

SEQ ID NO: 2507908 - protein, 17 aa, Entamoeba dispar
VEGAINFVKNMISDLLQ

SEQ ID NO: 2507909 - protein, 21 aa, Entamoeba dispar
VEGEIPRYGATRISEGVDLVQ

SEQ ID NO: 2507910 - protein, 26 aa, Entamoeba dispar
VEGGCKTCDMAEFIIHAVNPSGEPCT

SEQ ID NO: 2507911 - protein, 22 aa, Entamoeba dispar
VEGIAICLKTFLKMKEFPKYTV

SEQ ID NO: 2507912 - protein, 17 aa, Entamoeba dispar
VEGIERIEREVDKDTIK

SEQ ID NO: 2507913 - protein, 25 aa, Entamoeba dispar
VEGMKITKFPVMWMNQIYALHSSYE

SEQ ID NO: 2507914 - protein, 18 aa, Entamoeba dispar
VEGSFPIVVSNKISNPLT

SEQ ID NO: 2507915 - protein, 22 aa, Entamoeba dispar
VEGTEIKEIILPKEPIGTRKET

SEQ ID NO: 2507916 - protein, 24 aa, Entamoeba dispar
VEGTFRITCENVMTVLRENKDSLM

SEQ ID NO: 2507917 - protein, 21 aa, Entamoeba dispar
VEHPEGEILKLINHILNELYK

SEQ ID NO: 2507918 - protein, 18 aa, Entamoeba dispar
VEIADGCERCRQKIRQVQ

SEQ ID NO: 2507919 - protein, 37 aa, Entamoeba dispar
VEIAKKFKPTLVFGVPRFYEKLLFRAKEISGSSKIIK

SEQ ID NO: 2507920 - protein, 20 aa, Entamoeba dispar
VEIAKTWLKQSWSHNISSSF

SEQ ID NO: 2507921 - protein, 24 aa, Entamoeba dispar
VEIEIPMSILWIGDYCFKDCTRLK

SEQ ID NO: 2507922 - protein, 19 aa, Entamoeba dispar
VEIEPKLTINQLLEVTELN

SEQ ID NO: 2507923 - protein, 25 aa, Entamoeba dispar
VEILRLKMKANYGLERYEECYESFL

SEQ ID NO: 2507924 - protein, 24 aa, Entamoeba dispar
VEINIPFPTFIKKIQLVVVSCFTG

SEQ ID NO: 2507925 - protein, 17 aa, Entamoeba dispar
VEINIPTSIEWIGESCF

SEQ ID NO: 2507926 - protein, 19 aa, Entamoeba dispar
VEIPLLLPVDENIKDGTRF

SEQ ID NO: 2507927 - protein, 22 aa, Entamoeba dispar
VEIRSVVFFSERLEDIKELVDI

SEQ ID NO: 2507928 - protein, 26 aa, Entamoeba dispar
VEISALRGLFFIRLLGNYFVTNLESK

SEQ ID NO: 2507929 - protein, 24 aa, Entamoeba dispar
VEKFIKVVEKTGGEEYAEKYKELR

SEQ ID NO: 2507930 - protein, 18 aa, Entamoeba dispar
VEKIPFIAPKPVWAKEEK

SEQ ID NO: 2507931 - protein, 24 aa, Entamoeba dispar
VEKKCLKKRMTFIPLNKIAPQMPN

SEQ ID NO: 2507932 - protein, 27 aa, Entamoeba dispar
VEKKYGIKVPFMYGTMVECVRAALTAD

SEQ ID NO: 2507933 - protein, 29 aa, Entamoeba dispar
VEKLILLPMDRFRRFVPIIDAFIHNTPDC

SEQ ID NO: 2507934 - protein, 20 aa, Entamoeba dispar
VEKMISYGILDILKELIKKN

SEQ ID NO: 2507935 - protein, 25 aa, Entamoeba dispar
VEKNLKVLLFFRNEYGGIPSRESYF

SEQ ID NO: 2507936 - protein, 21 aa, Entamoeba dispar
VEKNSGFGFVEYARHEDAINA

SEQ ID NO: 2507937 - protein, 24 aa, Entamoeba dispar
VEKQRFLKMCESIMEYLEKHKEYR

SEQ ID NO: 2507938 - protein, 25 aa, Entamoeba dispar
VEKRKELYKNGGIFFITTRILISDL

SEQ ID NO: 2507939 - protein, 24 aa, Entamoeba dispar
VEKSCTMLHFLIRDDCSFKLYNNP

SEQ ID NO: 2507940 - protein, 20 aa, Entamoeba dispar
VEKVRIVIILMTLLSSKTAN

SEQ ID NO: 2507941 - protein, 17 aa, Entamoeba dispar
VELAGPMEKIFYNPETT

SEQ ID NO: 2507942 - protein, 24 aa, Entamoeba dispar
VELECGKLGYKVNWNHHKRKKEQW

SEQ ID NO: 2507943 - protein, 26 aa, Entamoeba dispar
VELEKSCKFNDVLDLLRSHLPGDNQL

SEQ ID NO: 2507944 - protein, 24 aa, Entamoeba dispar
VELEQLRMSFNYICSLPNELSMLS

SEQ ID NO: 2507945 - protein, 18 aa, Entamoeba dispar
VELFIPCLSILNESIQKQ

SEQ ID NO: 2507946 - protein, 25 aa, Entamoeba dispar
VELGKEIEEEIALIIGGISDDVKQI

SEQ ID NO: 2507947 - protein, 20 aa, Entamoeba dispar
VELKGEYATNCKKCHQTCHY

SEQ ID NO: 2507948 - protein, 21 aa, Entamoeba dispar
VELLKIRYEMIHKYFEDKSLV

SEQ ID NO: 2507949 - protein, 25 aa, Entamoeba dispar
VELLQLPVAFPKKDDKIRIGLKSEK

SEQ ID NO: 2507950 - protein, 20 aa, Entamoeba dispar
VELLQRFEECFYNFFNKIKT

SEQ ID NO: 2507951 - protein, 27 aa, Entamoeba dispar
VELPIANGRLKFDLEILTDATPMTIKD

SEQ ID NO: 2507952 - protein, 23 aa, Entamoeba dispar
VELPLRHPQLFQAIGIKPPKGVL

SEQ ID NO: 2507953 - protein, 19 aa, Entamoeba dispar
VELPPFIKLIKSHCFSNCS

SEQ ID NO: 2507954 - protein, 19 aa, Entamoeba dispar
VELRTAFVDDHTWVAELNS

SEQ ID NO: 2507955 - protein, 24 aa, Entamoeba dispar
VELSLHMYGCRVVQKAIEFVDDID

SEQ ID NO: 2507956 - protein, 23 aa, Entamoeba dispar
VELSPILFKLIWKTENEIDNLTT

SEQ ID NO: 2507957 - protein, 25 aa, Entamoeba dispar
VELTWTCPSVFLPQQYLSYLTTQQP

SEQ ID NO: 2507958 - protein, 19 aa, Entamoeba dispar
VELYHQYYLGFFKSNSEMY

SEQ ID NO: 2507959 - protein, 17 aa, Entamoeba dispar
VEMCKELLAKAEAKKVE

SEQ ID NO: 2507960 - protein, 23 aa, Entamoeba dispar
VEMFKKALNVEGVYDTTKQLLHQ

SEQ ID NO: 2507961 - protein, 24 aa, Entamoeba dispar
VEMKISEPMGIVLSSFKGESPNEL

SEQ ID NO: 2507962 - protein, 17 aa, Entamoeba dispar
VEMNPWYTIAFKGVPDS

SEQ ID NO: 2507963 - protein, 19 aa, Entamoeba dispar
VENDMYWYAAIGVCDQYIS

SEQ ID NO: 2507964 - protein, 24 aa, Entamoeba dispar
VENLVKIQLAYPVVVPQIRKVLVN

SEQ ID NO: 2507965 - protein, 22 aa, Entamoeba dispar
VENPQKQFSIFASWADENQPNG

SEQ ID NO: 2507966 - protein, 26 aa, Entamoeba dispar
VENSPYCKDCFIAKFAKICARCGKPI

SEQ ID NO: 2507967 - protein, 29 aa, Entamoeba dispar
VEPEFDLQFLRSILQTNINIISEEYNKTK

SEQ ID NO: 2507968 - protein, 20 aa, Entamoeba dispar
VEPFDLIKRSAFKEYVKKKM

SEQ ID NO: 2507969 - protein, 29 aa, Entamoeba dispar
VEPHRCYIKEGMLMKVCRKTIKPRYFYLF

SEQ ID NO: 2507970 - protein, 27 aa, Entamoeba dispar
VEPQLFLLRWVRILFCQMFNTNELYYI

SEQ ID NO: 2507971 - protein, 25 aa, Entamoeba dispar
VEPSRKCFRLVNGVMVERTASEVIP

SEQ ID NO: 2507972 - protein, 24 aa, Entamoeba dispar
VEQKPELCQPSFTQSLGGAAENLL

SEQ ID NO: 2507973 - protein, 17 aa, Entamoeba dispar
VEQLCSILYLLYNELFK

SEQ ID NO: 2507974 - protein, 17 aa, Entamoeba dispar
VEQLKSFIPLLIATKGR

SEQ ID NO: 2507975 - protein, 17 aa, Entamoeba dispar
VEQRRTFTFKHTFNQYF

SEQ ID NO: 2507976 - protein, 23 aa, Entamoeba dispar
VERIKGCNFIRCDLKKGGCGCGF

SEQ ID NO: 2507977 - protein, 25 aa, Entamoeba dispar
VERVNQCISLLFRYNIPTPNVESPT

SEQ ID NO: 2507978 - protein, 17 aa, Entamoeba dispar
VERVVGADIVLRKQIEQ

SEQ ID NO: 2507979 - protein, 19 aa, Entamoeba dispar
VESGTVIRRTCFKYFFQLC

SEQ ID NO: 2507980 - protein, 20 aa, Entamoeba dispar
VESIIASWAVVHVNDKKYVF

SEQ ID NO: 2507981 - protein, 25 aa, Entamoeba dispar
VESIIDWNTCLIKDAIKKIKDMNKM

SEQ ID NO: 2507982 - protein, 19 aa, Entamoeba dispar
VESNYALACSSPIELFIQS

SEQ ID NO: 2507983 - protein, 17 aa, Entamoeba dispar
VESRFKVMESRHDYVQW

SEQ ID NO: 2507984 - protein, 22 aa, Entamoeba dispar
VESRIGSLYLEKYLKNTGEERN

SEQ ID NO: 2507985 - protein, 20 aa, Entamoeba dispar
VESSIKCVSLIKEVCGIDIN

SEQ ID NO: 2507986 - protein, 17 aa, Entamoeba dispar
VESTLEYSIINFSNSEF

SEQ ID NO: 2507987 - protein, 19 aa, Entamoeba dispar
VETELLYCYAKLKKNEEIE

SEQ ID NO: 2507988 - protein, 17 aa, Entamoeba dispar
VETFSSINKKCFDVLNI

SEQ ID NO: 2507989 - protein, 25 aa, Entamoeba dispar
VETLKPLVCIGSCYALCKPSQFPVG

SEQ ID NO: 2507990 - protein, 24 aa, Entamoeba dispar
VETLLKLISLQGIANDIKTKILTQ

SEQ ID NO: 2507991 - protein, 20 aa, Entamoeba dispar
VETLPRRPTQSIPNKKKMSK

SEQ ID NO: 2507992 - protein, 18 aa, Entamoeba dispar
VETLQARISYSDIIVNQK

SEQ ID NO: 2507993 - protein, 18 aa, Entamoeba dispar
VETMLKHQMISNIRNKNN

SEQ ID NO: 2507994 - protein, 22 aa, Entamoeba dispar
VETSVFFRNLILNIIVDKIELD

SEQ ID NO: 2507995 - protein, 20 aa, Entamoeba dispar
VETVRQCYELMTYHNDEIIN

SEQ ID NO: 2507996 - protein, 24 aa, Entamoeba dispar
VETVYRYLERKDLLKILDDELIEV

SEQ ID NO: 2507997 - protein, 20 aa, Entamoeba dispar
VEVGEKLMLQIMDKDVGKKD

SEQ ID NO: 2507998 - protein, 25 aa, Entamoeba dispar
VEVKPIVNDEIIVFESSAVGGVETL

SEQ ID NO: 2507999 - protein, 22 aa, Entamoeba dispar
VEVMPYTLGFGLVDNKFSIFAP

SEQ ID NO: 2508000 - protein, 26 aa, Entamoeba dispar
VEWPKSMKELTCLRHLDLSNNKIQFI

SEQ ID NO: 2508001 - protein, 26 aa, Entamoeba dispar
VEYGHLFRPVICEGKKVGKLEVGYIL

SEQ ID NO: 2508002 - protein, 28 aa, Entamoeba dispar
VEYINGFGFRNICEWIKKIKTPYYLYAF

SEQ ID NO: 2508003 - protein, 17 aa, Entamoeba dispar
VEYLEMFNSADNDTKKS

SEQ ID NO: 2508004 - protein, 23 aa, Entamoeba dispar
VEYPELLNHTSFFPKDVINHAKK

SEQ ID NO: 2508005 - protein, 30 aa, Entamoeba dispar
VEYPVRAFAEFKGMVLAGVGNVLRLYDIGL

SEQ ID NO: 2508006 - protein, 18 aa, Entamoeba dispar
VEYSQLTMRCFIYPELHQ

SEQ ID NO: 2508007 - protein, 17 aa, Entamoeba dispar
VFARKGQQLPITFETVI

SEQ ID NO: 2508008 - protein, 18 aa, Entamoeba dispar
VFCDFPISDYFNGKEEVI

SEQ ID NO: 2508009 - protein, 27 aa, Entamoeba dispar
VFCGSVLRTEVIFRMFKSMEIKATVLH

SEQ ID NO: 2508010 - protein, 19 aa, Entamoeba dispar
VFCKKAVKQKDSFQCISCK

SEQ ID NO: 2508011 - protein, 24 aa, Entamoeba dispar
VFCMIRSICKIRIGSEAKDYILIG

SEQ ID NO: 2508012 - protein, 19 aa, Entamoeba dispar
VFCPCGGRPYTLNENNAQS

SEQ ID NO: 2508013 - protein, 18 aa, Entamoeba dispar
VFDCMKYIDPVLYSHFYS

SEQ ID NO: 2508014 - protein, 18 aa, Entamoeba dispar
VFDDILFVTVHPTFNNPF

SEQ ID NO: 2508015 - protein, 18 aa, Entamoeba dispar
VFDIFAFEGTDYITTVSL

SEQ ID NO: 2508016 - protein, 18 aa, Entamoeba dispar
VFDLTKYLTNLKVVSPDQ

SEQ ID NO: 2508017 - protein, 18 aa, Entamoeba dispar
VFDRMKLDWEKVTVDQSI

SEQ ID NO: 2508018 - protein, 37 aa, Entamoeba dispar
VFDTIKYRHLWSYILHIIRLFISFSFNNPKLPCFNNP

SEQ ID NO: 2508019 - protein, 24 aa, Entamoeba dispar
VFEGHKAPVWSISFSKTDPNIFAT

SEQ ID NO: 2508020 - protein, 23 aa, Entamoeba dispar
VFEKDVFESPDFTSIDIVGFGTS

SEQ ID NO: 2508021 - protein, 19 aa, Entamoeba dispar
VFEKLLVFQQEMLKKDRTK

SEQ ID NO: 2508022 - protein, 19 aa, Entamoeba dispar
VFEPIEIEEVMKLNLNESI

SEQ ID NO: 2508023 - protein, 18 aa, Entamoeba dispar
VFEPYKIPTNILDALHQT

SEQ ID NO: 2508024 - protein, 21 aa, Entamoeba dispar
VFERRSDILSVVFSPLRYVSE

SEQ ID NO: 2508025 - protein, 20 aa, Entamoeba dispar
VFESLFWKTLYGRIVSGKIK

SEQ ID NO: 2508026 - protein, 23 aa, Entamoeba dispar
VFFLCQMDQLFYIFADFDNRDDR

SEQ ID NO: 2508027 - protein, 18 aa, Entamoeba dispar
VFFSSRWTPYRRAENKLL

SEQ ID NO: 2508028 - protein, 21 aa, Entamoeba dispar
VFGESWGVVANSVYAPSMYPN

SEQ ID NO: 2508029 - protein, 22 aa, Entamoeba dispar
VFGHCHNCYGIRTIENTIYANA

SEQ ID NO: 2508030 - protein, 22 aa, Entamoeba dispar
VFGKIKSCILMTQRGHSKGFGF

SEQ ID NO: 2508031 - protein, 22 aa, Entamoeba dispar
VFGKSIGKKGVKEVVEQLQNVL

SEQ ID NO: 2508032 - protein, 20 aa, Entamoeba dispar
VFGNRCHFIKSLGDGSTIVH

SEQ ID NO: 2508033 - protein, 20 aa, Entamoeba dispar
VFGPCMQRFNREFPSHRKLN

SEQ ID NO: 2508034 - protein, 23 aa, Entamoeba dispar
VFGSNKRPGLTFINTKVEPPTQF

SEQ ID NO: 2508035 - protein, 19 aa, Entamoeba dispar
VFHMFARSQIQPSDLNREL

SEQ ID NO: 2508036 - protein, 26 aa, Entamoeba dispar
VFIGKADAIVAVFSFDDYKSFEDTEG

SEQ ID NO: 2508037 - protein, 23 aa, Entamoeba dispar
VFIKNINEFICFALSTDNYQFDT

SEQ ID NO: 2508038 - protein, 18 aa, Entamoeba dispar
VFIKNLYVKSSFYELRIF

SEQ ID NO: 2508039 - protein, 18 aa, Entamoeba dispar
VFILEPLVVRLCQEIKND

SEQ ID NO: 2508040 - protein, 18 aa, Entamoeba dispar
VFIQEWTKYIKLPRLVRC

SEQ ID NO: 2508041 - protein, 27 aa, Entamoeba dispar
VFISKKFSFLLCFMAEIILENKDRLLL

SEQ ID NO: 2508042 - protein, 20 aa, Entamoeba dispar
VFITEEFVEYGHLFRPVICE

SEQ ID NO: 2508043 - protein, 20 aa, Entamoeba dispar
VFKCKKRMDGKNCQKGYDSH

SEQ ID NO: 2508044 - protein, 26 aa, Entamoeba dispar
VFKETMKLCYKIVCHSEINSMNAKNL

SEQ ID NO: 2508045 - protein, 18 aa, Entamoeba dispar
VFKKGFAQSGIIILPCGS

SEQ ID NO: 2508046 - protein, 24 aa, Entamoeba dispar
VFKNELILFYMFYVMVGEESQLKA

SEQ ID NO: 2508047 - protein, 19 aa, Entamoeba dispar
VFKNIPVALFLYNKGSSLY

SEQ ID NO: 2508048 - protein, 21 aa, Entamoeba dispar
VFKSSHPFPSHPKSLSRSVPT

SEQ ID NO: 2508049 - protein, 23 aa, Entamoeba dispar
VFLNKGPLQFCCVSNTKEQPEII

SEQ ID NO: 2508050 - protein, 19 aa, Entamoeba dispar
VFLSKGFKTYLFSTLCPTP

SEQ ID NO: 2508051 - protein, 18 aa, Entamoeba dispar
VFMLRGNHETRLMCEYMT

SEQ ID NO: 2508052 - protein, 18 aa, Entamoeba dispar
VFNKCIRLILVELLLKAG

SEQ ID NO: 2508053 - protein, 29 aa, Entamoeba dispar
VFNLKDIWKRVCIVWTRCYNYLPQKIIEK

SEQ ID NO: 2508054 - protein, 18 aa, Entamoeba dispar
VFNLSVSCNKAILNNSTG

SEQ ID NO: 2508055 - protein, 19 aa, Entamoeba dispar
VFNLSVSCNKAILNNSTGV

SEQ ID NO: 2508056 - protein, 22 aa, Entamoeba dispar
VFNQIHFPKLEWLDLSYNSINV

SEQ ID NO: 2508057 - protein, 30 aa, Entamoeba dispar
VFNQRFDNKFSKYTLERVPKEFANVTQYKK

SEQ ID NO: 2508058 - protein, 19 aa, Entamoeba dispar
VFNVLWMKSSFLAHPTAFD

SEQ ID NO: 2508059 - protein, 26 aa, Entamoeba dispar
VFPIYDFWEHVCIVWTKCYNYTPKKI

SEQ ID NO: 2508060 - protein, 18 aa, Entamoeba dispar
VFPQIPIIEQNTLKTEQN

SEQ ID NO: 2508061 - protein, 24 aa, Entamoeba dispar
VFQKRSNEIFDMMYGFNQNYISID

SEQ ID NO: 2508062 - protein, 24 aa, Entamoeba dispar
VFQNYRFNELLSFNYSFFERAVLT

SEQ ID NO: 2508063 - protein, 24 aa, Entamoeba dispar
VFQPKKMTGVLFMPNAIPNHVKLA

SEQ ID NO: 2508064 - protein, 20 aa, Entamoeba dispar
VFRIFDCFNDVSSMVTCVKA

SEQ ID NO: 2508065 - protein, 23 aa, Entamoeba dispar
VFRRRWGSYGSIKNNWYSNNYSL

SEQ ID NO: 2508066 - protein, 24 aa, Entamoeba dispar
VFSASCKGNFFAIKEMSNYESAIK

SEQ ID NO: 2508067 - protein, 21 aa, Entamoeba dispar
VFSIHFPFFIEKVGGSRASLI

SEQ ID NO: 2508068 - protein, 22 aa, Entamoeba dispar
VFSKQLLCKLGESIEQTEREQL

SEQ ID NO: 2508069 - protein, 24 aa, Entamoeba dispar
VFSPCDSLLFSSRRIFDIRQKNPI

SEQ ID NO: 2508070 - protein, 23 aa, Entamoeba dispar
VFSQEIKAIVPIGRKNEVQELKE

SEQ ID NO: 2508071 - protein, 22 aa, Entamoeba dispar
VFSQPRFNDMPSVTVSIEDIIN

SEQ ID NO: 2508072 - protein, 37 aa, Entamoeba dispar
VFSQSGKLFTCELHVEKEFASNLVILLTGFFDSIETL

SEQ ID NO: 2508073 - protein, 21 aa, Entamoeba dispar
VFTALPFIRTFLLNETESLLN

SEQ ID NO: 2508074 - protein, 26 aa, Entamoeba dispar
VFTQEELKCLWERRHSLLKTNPHALA

SEQ ID NO: 2508075 - protein, 26 aa, Entamoeba dispar
VFTYLYPRLDINVSMKRNHLLKAPFC

SEQ ID NO: 2508076 - protein, 26 aa, Entamoeba dispar
VFTYNEFEYFLPYLYIVCYYSHLSIP

SEQ ID NO: 2508077 - protein, 17 aa, Entamoeba dispar
VFVCKQMVGNIIININN

SEQ ID NO: 2508078 - protein, 24 aa, Entamoeba dispar
VFVLKGCSPIPGAIIYDYDTEEEL

SEQ ID NO: 2508079 - protein, 17 aa, Entamoeba dispar
VFVNLGFDEDMLKKIQQ

SEQ ID NO: 2508080 - protein, 17 aa, Entamoeba dispar
VFVPRKVSHEEYRHENN

SEQ ID NO: 2508081 - protein, 21 aa, Entamoeba dispar
VFYLTKTVWLFEGEKISHLNE

SEQ ID NO: 2508082 - protein, 23 aa, Entamoeba dispar
VFYNHGWRVDGLLGVSRSIGDES

SEQ ID NO: 2508083 - protein, 23 aa, Entamoeba dispar
VGADWRINLLFDDVKENYCIIVK

SEQ ID NO: 2508084 - protein, 18 aa, Entamoeba dispar
VGADYSLYLWDIELEKYI

SEQ ID NO: 2508085 - protein, 17 aa, Entamoeba dispar
VGAMSGKLANKGGVAYR

SEQ ID NO: 2508086 - protein, 29 aa, Entamoeba dispar
VGAPACPITACRVRFCISAAHTDEDIEKA

SEQ ID NO: 2508087 - protein, 36 aa, Entamoeba dispar
VGARGIPGMQMGGIRMGIPVGFNPASVQLKATGGRR

SEQ ID NO: 2508088 - protein, 23 aa, Entamoeba dispar
VGCGQCSSACNFGAIKPVSHIER

SEQ ID NO: 2508089 - protein, 21 aa, Entamoeba dispar
VGCGTGILSMFAARNGAKHVY

SEQ ID NO: 2508090 - protein, 26 aa, Entamoeba dispar
VGCIAAEFFLGIPLFAGTSEYNLLFK

SEQ ID NO: 2508091 - protein, 22 aa, Entamoeba dispar
VGDGKSSLGNFILKTIKFDVSS

SEQ ID NO: 2508092 - protein, 20 aa, Entamoeba dispar
VGDGRRCAGALLTVKENEVQ

SEQ ID NO: 2508093 - protein, 17 aa, Entamoeba dispar
VGDKCIVESKGFFYRAE

SEQ ID NO: 2508094 - protein, 25 aa, Entamoeba dispar
VGDPILCSYCKSSLSHLDGIENNKW

SEQ ID NO: 2508095 - protein, 17 aa, Entamoeba dispar
VGDRVKVTDGMYANETG

SEQ ID NO: 2508096 - protein, 19 aa, Entamoeba dispar
VGEKVFIRGDENCIFCNEC

SEQ ID NO: 2508097 - protein, 17 aa, Entamoeba dispar
VGEMKRSVMVQSSLNDG

SEQ ID NO: 2508098 - protein, 23 aa, Entamoeba dispar
VGEMLKMKSIDIESGQRLYRVAM

SEQ ID NO: 2508099 - protein, 23 aa, Entamoeba dispar
VGEVGVIRRIFERIVKQKLNTKT

SEQ ID NO: 2508100 - protein, 23 aa, Entamoeba dispar
VGEVGVIRRIFERIVKQKLSTKT

SEQ ID NO: 2508101 - protein, 24 aa, Entamoeba dispar
VGEVGVIRRIFERIVKQKLSTKTM

SEQ ID NO: 2508102 - protein, 22 aa, Entamoeba dispar
VGFIPRSYQVFFTKNGKKIKNS

SEQ ID NO: 2508103 - protein, 17 aa, Entamoeba dispar
VGFISGGISSLVDDLKL

SEQ ID NO: 2508104 - protein, 18 aa, Entamoeba dispar
VGFKKNRGKEPFFQPYQN

SEQ ID NO: 2508105 - protein, 19 aa, Entamoeba dispar
VGGCCYCKESGNAYIGFNM

SEQ ID NO: 2508106 - protein, 19 aa, Entamoeba dispar
VGGGFNLKGDLIVVTQQWL

SEQ ID NO: 2508107 - protein, 18 aa, Entamoeba dispar
VGGGLKLFRKHSVGQNSN

SEQ ID NO: 2508108 - protein, 24 aa, Entamoeba dispar
VGGIGESAIFVFGYQGTTLFFLDP

SEQ ID NO: 2508109 - protein, 25 aa, Entamoeba dispar
VGGMGDRAIFVFGFHALQFLYLDPH

SEQ ID NO: 2508110 - protein, 18 aa, Entamoeba dispar
VGGNGVLLNDFISIMDSL

SEQ ID NO: 2508111 - protein, 24 aa, Entamoeba dispar
VGGYDYLLGMKIWTLTYEKAKKLM

SEQ ID NO: 2508112 - protein, 17 aa, Entamoeba dispar
VGIALNYMHMRLRDGGD

SEQ ID NO: 2508113 - protein, 25 aa, Entamoeba dispar
VGIGKICGKWMTIILECIKKDERIT

SEQ ID NO: 2508114 - protein, 17 aa, Entamoeba dispar
VGIMKGVIAKHCPRIVN

SEQ ID NO: 2508115 - protein, 20 aa, Entamoeba dispar
VGIPTMPLGNNFPIPIQTNL

SEQ ID NO: 2508116 - protein, 23 aa, Entamoeba dispar
VGIRSIDVGEEFEIQDKHIDHFT

SEQ ID NO: 2508117 - protein, 26 aa, Entamoeba dispar
VGISYSFMYKWIILLFRRDFPHSACV

SEQ ID NO: 2508118 - protein, 27 aa, Entamoeba dispar
VGKGKFKLPNIEIKSTLNIGLDDGGRV

SEQ ID NO: 2508119 - protein, 21 aa, Entamoeba dispar
VGKGSRSSLKILTHGLNPDEC

SEQ ID NO: 2508120 - protein, 18 aa, Entamoeba dispar
VGKGVSWKKIKQNKKQKI

SEQ ID NO: 2508121 - protein, 24 aa, Entamoeba dispar
VGKIGKGLLLYFGINEEDKESDID

SEQ ID NO: 2508122 - protein, 17 aa, Entamoeba dispar
VGKLGFPLISDIKRCIS

SEQ ID NO: 2508123 - protein, 24 aa, Entamoeba dispar
VGKSNLLLRFTRNEFDPDKRSTIG

SEQ ID NO: 2508124 - protein, 27 aa, Entamoeba dispar
VGKSYLLLMERLFRLLQMIDKNSGVNK

SEQ ID NO: 2508125 - protein, 18 aa, Entamoeba dispar
VGKTAILERYCENIFNES

SEQ ID NO: 2508126 - protein, 22 aa, Entamoeba dispar
VGKTCLINQLLYGYFKDNNKST

SEQ ID NO: 2508127 - protein, 27 aa, Entamoeba dispar
VGKTMLCNLLFEYLDYYTPIAYIKEYI

SEQ ID NO: 2508128 - protein, 27 aa, Entamoeba dispar
VGKTMLCNLLFEYLDYYTPIAYVKEYI

SEQ ID NO: 2508129 - protein, 30 aa, Entamoeba dispar
VGLARALGDLKCHPALTCEPEVLTVNRSNE

SEQ ID NO: 2508130 - protein, 24 aa, Entamoeba dispar
VGLKGIGCLTSLQLINLDLTDNDI

SEQ ID NO: 2508131 - protein, 20 aa, Entamoeba dispar
VGLLSGHRSFGEIFDVMDVI

SEQ ID NO: 2508132 - protein, 20 aa, Entamoeba dispar
VGLNRLYHLIANNLELMSQV

SEQ ID NO: 2508133 - protein, 25 aa, Entamoeba dispar
VGLTLELRHILKWDQADIQALMERC

SEQ ID NO: 2508134 - protein, 24 aa, Entamoeba dispar
VGLVKELLSFLQLSDIQFKQDVVI

SEQ ID NO: 2508135 - protein, 26 aa, Entamoeba dispar
VGMLNIANMFSMWKNNLIEITDQFKI

SEQ ID NO: 2508136 - protein, 20 aa, Entamoeba dispar
VGMNKLHSNFAFSGSLDGIV

SEQ ID NO: 2508137 - protein, 17 aa, Entamoeba dispar
VGNGFLIVYSIISKQSF

SEQ ID NO: 2508138 - protein, 22 aa, Entamoeba dispar
VGNRKLLFEKKSDYNGNVLVEE

SEQ ID NO: 2508139 - protein, 25 aa, Entamoeba dispar
VGNSGVFRPEMLRTMGVPEDITVIA

SEQ ID NO: 2508140 - protein, 22 aa, Entamoeba dispar
VGQTKIKLGFIVLSLLLSNYSV

SEQ ID NO: 2508141 - protein, 25 aa, Entamoeba dispar
VGRDYYGVFPLRGKPLNAREIAPSK

SEQ ID NO: 2508142 - protein, 24 aa, Entamoeba dispar
VGRGRIHEMFYFRGNYESPIYYDK

SEQ ID NO: 2508143 - protein, 25 aa, Entamoeba dispar
VGRIPPSPLLPIIANLAAQKQLSDI

SEQ ID NO: 2508144 - protein, 23 aa, Entamoeba dispar
VGRRICPLFVTKGFDRIAITSQL

SEQ ID NO: 2508145 - protein, 19 aa, Entamoeba dispar
VGSLQCPKSIRSIKLSHSS

SEQ ID NO: 2508146 - protein, 20 aa, Entamoeba dispar
VGSRKHCCDIAMEYGATDII

SEQ ID NO: 2508147 - protein, 23 aa, Entamoeba dispar
VGSSLKISIWYSESNKTMLNEVV

SEQ ID NO: 2508148 - protein, 27 aa, Entamoeba dispar
VGSTFDLKRLCRVTGATPFISLTTECD

SEQ ID NO: 2508149 - protein, 26 aa, Entamoeba dispar
VGSTIRALRFIECIIQTIKASKLTQS

SEQ ID NO: 2508150 - protein, 17 aa, Entamoeba dispar
VGSYKLAIAQVVNDCIG

SEQ ID NO: 2508151 - protein, 20 aa, Entamoeba dispar
VGTECCLIPSKKIRTNSYGL

SEQ ID NO: 2508152 - protein, 27 aa, Entamoeba dispar
VGTFAKLYCICFEVIPSSMFTRCNIMF

SEQ ID NO: 2508153 - protein, 18 aa, Entamoeba dispar
VGTIWFDKMIHICCENDY

SEQ ID NO: 2508154 - protein, 25 aa, Entamoeba dispar
VGTKAFEFAKGWFGTAVASMTVKDS

SEQ ID NO: 2508155 - protein, 24 aa, Entamoeba dispar
VGTLFKLRLKVLVAQNGQQAIAAM

SEQ ID NO: 2508156 - protein, 21 aa, Entamoeba dispar
VGTVVKRLCNIWVDVNKEIQF

SEQ ID NO: 2508157 - protein, 25 aa, Entamoeba dispar
VGTYQCKLCLTTHLTEANYLAHTQG

SEQ ID NO: 2508158 - protein, 18 aa, Entamoeba dispar
VGVARTLGNHFVKNLNIG

SEQ ID NO: 2508159 - protein, 21 aa, Entamoeba dispar
VGVEVGQLFYFVLRNETGEYE

SEQ ID NO: 2508160 - protein, 18 aa, Entamoeba dispar
VGVIPLDFSNPLRYELQK

SEQ ID NO: 2508161 - protein, 29 aa, Entamoeba dispar
VGVKKSGWRFPLPIYRCLEYLEKNDGLRA

SEQ ID NO: 2508162 - protein, 18 aa, Entamoeba dispar
VGVPECADETRIREEFGK

SEQ ID NO: 2508163 - protein, 17 aa, Entamoeba dispar
VGVTSFKKISMINFLIF

SEQ ID NO: 2508164 - protein, 21 aa, Entamoeba dispar
VGVVVYWYLMKQFHFIEHIAI

SEQ ID NO: 2508165 - protein, 24 aa, Entamoeba dispar
VGYEIKRQLNLRVGVQILAAANKQ

SEQ ID NO: 2508166 - protein, 19 aa, Entamoeba dispar
VGYNSSLFRKGNYACIAEM

SEQ ID NO: 2508167 - protein, 20 aa, Entamoeba dispar
VGYYNRFPTIQSYKLLTEKI

SEQ ID NO: 2508168 - protein, 17 aa, Entamoeba dispar
VHDCLTCQLKVSKARYC

SEQ ID NO: 2508169 - protein, 17 aa, Entamoeba dispar
VHFSVLKSLIGFLVQIT

SEQ ID NO: 2508170 - protein, 21 aa, Entamoeba dispar
VHGEPRLCLSVNTGFGNVFDI

SEQ ID NO: 2508171 - protein, 18 aa, Entamoeba dispar
VHGYKPYFYISVEKEYTQ

SEQ ID NO: 2508172 - protein, 25 aa, Entamoeba dispar
VHHISDVVFGRAFNVAMSQKPPCSY

SEQ ID NO: 2508173 - protein, 26 aa, Entamoeba dispar
VHHPYRSIPFVKNFFASPPFLNSMFS

SEQ ID NO: 2508174 - protein, 30 aa, Entamoeba dispar
VHIDFDMLFWKGEILPVPETVPFRLTTNMI

SEQ ID NO: 2508175 - protein, 18 aa, Entamoeba dispar
VHIGEALRYSPERNIFRS

SEQ ID NO: 2508176 - protein, 18 aa, Entamoeba dispar
VHIPSFLKKKQLQIRKSK

SEQ ID NO: 2508177 - protein, 17 aa, Entamoeba dispar
VHIVSFISSEQALSDAV

SEQ ID NO: 2508178 - protein, 17 aa, Entamoeba dispar
VHIVSFITSEEALSDVV

SEQ ID NO: 2508179 - protein, 34 aa, Entamoeba dispar
VHLGICGRKGHIGILEWKTQKLINEFHVGEQCYG

SEQ ID NO: 2508180 - protein, 18 aa, Entamoeba dispar
VHLSHPILSISIPFGDTI

SEQ ID NO: 2508181 - protein, 25 aa, Entamoeba dispar
VHPKTNCVICFNMSIYFQSDEIVER

SEQ ID NO: 2508182 - protein, 18 aa, Entamoeba dispar
VHPPKRGKKTSVFTTRSP

SEQ ID NO: 2508183 - protein, 18 aa, Entamoeba dispar
VHPQCIQQAPAFCYHGVL

SEQ ID NO: 2508184 - protein, 17 aa, Entamoeba dispar
VHPRPVSSLMFHPTEHL

SEQ ID NO: 2508185 - protein, 19 aa, Entamoeba dispar
VHRDLSTDNVFVFSVIPTD

SEQ ID NO: 2508186 - protein, 20 aa, Entamoeba dispar
VHRMKRVNCEGSQMFVVTNQ

SEQ ID NO: 2508187 - protein, 25 aa, Entamoeba dispar
VHRSKCGKYALKMCNPQKLASTLRE

SEQ ID NO: 2508188 - protein, 19 aa, Entamoeba dispar
VHRVVKLIIQYPVSYTEIA

SEQ ID NO: 2508189 - protein, 23 aa, Entamoeba dispar
VHRYSEIISLHFFNSFNYLPIAC

SEQ ID NO: 2508190 - protein, 21 aa, Entamoeba dispar
VHSIHSYYLYAPVPNKNEKNI

SEQ ID NO: 2508191 - protein, 20 aa, Entamoeba dispar
VHSLAKWKRLQLHELKIPVG

SEQ ID NO: 2508192 - protein, 23 aa, Entamoeba dispar
VIASKAALCARVDALADNADSSM

SEQ ID NO: 2508193 - protein, 23 aa, Entamoeba dispar
VICELRKVTILMLQQNRIKEVPE

SEQ ID NO: 2508194 - protein, 21 aa, Entamoeba dispar
VICSKFPNLVSVNLKESQITS

SEQ ID NO: 2508195 - protein, 28 aa, Entamoeba dispar
VICTLTFKPEIISFWGRGEERLVKIKKL

SEQ ID NO: 2508196 - protein, 24 aa, Entamoeba dispar
VIDKIKPGVINWSMYARPKNGRTL

SEQ ID NO: 2508197 - protein, 30 aa, Entamoeba dispar
VIDLLRKDGLWWFGELNGIKGYFPSNYVQI

SEQ ID NO: 2508198 - protein, 24 aa, Entamoeba dispar
VIDPKAPRSFKTVFRHVIDNDMVL

SEQ ID NO: 2508199 - protein, 18 aa, Entamoeba dispar
VIEAKKALYCFIAEDCDN

SEQ ID NO: 2508200 - protein, 19 aa, Entamoeba dispar
VIECEKCGCVLFQSDKKIH

SEQ ID NO: 2508201 - protein, 23 aa, Entamoeba dispar
VIEDCLDIIVGWWQQRSPMRLEK

SEQ ID NO: 2508202 - protein, 18 aa, Entamoeba dispar
VIEFIKKYVQFFSRDGLK

SEQ ID NO: 2508203 - protein, 23 aa, Entamoeba dispar
VIEIGLRVLHPFMPFITEELWQR

SEQ ID NO: 2508204 - protein, 18 aa, Entamoeba dispar
VIEIKKKIARLISIVLEQ

SEQ ID NO: 2508205 - protein, 25 aa, Entamoeba dispar
VIEITKIKWLLSFYKLIFGALEKEI

SEQ ID NO: 2508206 - protein, 20 aa, Entamoeba dispar
VIEKGIRMITGFYEENESIL

SEQ ID NO: 2508207 - protein, 19 aa, Entamoeba dispar
VIEKGRREYWRIVNNKVRI

SEQ ID NO: 2508208 - protein, 26 aa, Entamoeba dispar
VIEKKLKYKGEFIFKDENDMTWTHSP

SEQ ID NO: 2508209 - protein, 24 aa, Entamoeba dispar
VIEKRFGQELSLFKNRKITLLTKT

SEQ ID NO: 2508210 - protein, 27 aa, Entamoeba dispar
VIELQCLIRGHFVRRTQEVQGMITRKY

SEQ ID NO: 2508211 - protein, 27 aa, Entamoeba dispar
VIEMNKDALCGLVYSITTDYIVIGERK

SEQ ID NO: 2508212 - protein, 18 aa, Entamoeba dispar
VIESHGILTPRISLIKQH

SEQ ID NO: 2508213 - protein, 24 aa, Entamoeba dispar
VIESIYKRYLMIIGTMKEKEIEES

SEQ ID NO: 2508214 - protein, 19 aa, Entamoeba dispar
VIETENCCIGVYLPAEHKK

SEQ ID NO: 2508215 - protein, 21 aa, Entamoeba dispar
VIEYPDTSILGFGQRGHVDVL

SEQ ID NO: 2508216 - protein, 23 aa, Entamoeba dispar
VIEYPDTSILGFGQRGHVDVLSN

SEQ ID NO: 2508217 - protein, 18 aa, Entamoeba dispar
VIFDEGWSTIGNQAVDRA

SEQ ID NO: 2508218 - protein, 17 aa, Entamoeba dispar
VIFKLIMNSCYGKTIQK

SEQ ID NO: 2508219 - protein, 25 aa, Entamoeba dispar
VIFPTCLRILITAIQNRMYVHTRLC

SEQ ID NO: 2508220 - protein, 17 aa, Entamoeba dispar
VIFYGFEKVDLFIKYGN

SEQ ID NO: 2508221 - protein, 20 aa, Entamoeba dispar
VIGAGAKVLGNITISSNVKI

SEQ ID NO: 2508222 - protein, 25 aa, Entamoeba dispar
VIGHCLKEVYCLLEQSNIPIDSQSI

SEQ ID NO: 2508223 - protein, 18 aa, Entamoeba dispar
VIGSWAICKVGDKKYIMP

SEQ ID NO: 2508224 - protein, 17 aa, Entamoeba dispar
VIICGSALLVLDIHCRL

SEQ ID NO: 2508225 - protein, 21 aa, Entamoeba dispar
VIICRCGDSPIYVLTTDDEIM

SEQ ID NO: 2508226 - protein, 22 aa, Entamoeba dispar
VIIEGWRIALKAAQEKLETMQF

SEQ ID NO: 2508227 - protein, 27 aa, Entamoeba dispar
VIIGEELFEGIYHCTIHNIPFNILGQI

SEQ ID NO: 2508228 - protein, 17 aa, Entamoeba dispar
VIIIFEFSLLDNVLMDI

SEQ ID NO: 2508229 - protein, 26 aa, Entamoeba dispar
VIILKDNPVIFLLRSHREALKKEYEN

SEQ ID NO: 2508230 - protein, 18 aa, Entamoeba dispar
VIINAGRALSDLIPYIMK

SEQ ID NO: 2508231 - protein, 28 aa, Entamoeba dispar
VIIPMTILPNFFGKFTIVIHELLRSTFE

SEQ ID NO: 2508232 - protein, 19 aa, Entamoeba dispar
VIIPSEYSTPISMPTSIPQ

SEQ ID NO: 2508233 - protein, 17 aa, Entamoeba dispar
VIIPYIYTQFKYDGMST

SEQ ID NO: 2508234 - protein, 18 aa, Entamoeba dispar
VIISCGGLKGMISDTNSI

SEQ ID NO: 2508235 - protein, 18 aa, Entamoeba dispar
VIIVVPIWSEGELKSNIV

SEQ ID NO: 2508236 - protein, 23 aa, Entamoeba dispar
VIKAFGCVVGDSFGDCKVGVLTK

SEQ ID NO: 2508237 - protein, 18 aa, Entamoeba dispar
VIKEGYKVTIRRNKKENS

SEQ ID NO: 2508238 - protein, 23 aa, Entamoeba dispar
VIKESIPIHLTITLHFIGINQTE

SEQ ID NO: 2508239 - protein, 18 aa, Entamoeba dispar
VIKRIEMLHIDRFSVSPS

SEQ ID NO: 2508240 - protein, 33 aa, Entamoeba dispar
VIKVIPKREEKILCKIFPLYFSYIQENPQTLIP

SEQ ID NO: 2508241 - protein, 24 aa, Entamoeba dispar
VIKVKTVEGYYRYKKQEQDDSELQ

SEQ ID NO: 2508242 - protein, 18 aa, Entamoeba dispar
VILCIKKKSFDIISSVIE

SEQ ID NO: 2508243 - protein, 25 aa, Entamoeba dispar
VILCPCTICRKVGFFSSEKPKIKTT

SEQ ID NO: 2508244 - protein, 17 aa, Entamoeba dispar
VILGITRYGISKMKDSV

SEQ ID NO: 2508245 - protein, 17 aa, Entamoeba dispar
VILKCPMRLENKLLALV

SEQ ID NO: 2508246 - protein, 19 aa, Entamoeba dispar
VILKEKRIAHSKTLRSFLG

SEQ ID NO: 2508247 - protein, 18 aa, Entamoeba dispar
VILLEGFTAMFSVSDTIF

SEQ ID NO: 2508248 - protein, 27 aa, Entamoeba dispar
VILPSSTISFGWRCFTECNKVLHEIKR

SEQ ID NO: 2508249 - protein, 22 aa, Entamoeba dispar
VILPTSIIKLGNYCFNNCSSLT

SEQ ID NO: 2508250 - protein, 33 aa, Entamoeba dispar
VILVNGFLKRGDRIVVCGMNGPIVTQIRALLLP

SEQ ID NO: 2508251 - protein, 17 aa, Entamoeba dispar
VILYEMITGTVLNIQKT

SEQ ID NO: 2508252 - protein, 17 aa, Entamoeba dispar
VILYRMITGYIPQHDEN

SEQ ID NO: 2508253 - protein, 17 aa, Entamoeba dispar
VIMCLNKLIDIFTLLGR

SEQ ID NO: 2508254 - protein, 17 aa, Entamoeba dispar
VIMIRVWSGQLMICDTC

SEQ ID NO: 2508255 - protein, 24 aa, Entamoeba dispar
VINHIGCSFFGHYYSYVKFQDKWY

SEQ ID NO: 2508256 - protein, 25 aa, Entamoeba dispar
VINQECWGFISCLCNKEDCTNQKIK

SEQ ID NO: 2508257 - protein, 23 aa, Entamoeba dispar
VINQPRIVFVVPPQFFTYHQITP

SEQ ID NO: 2508258 - protein, 18 aa, Entamoeba dispar
VINTYLLVCDQAVDRDVV

SEQ ID NO: 2508259 - protein, 18 aa, Entamoeba dispar
VINVFTMAFDRCLHNSEE

SEQ ID NO: 2508260 - protein, 19 aa, Entamoeba dispar
VIPLFLDIIQIFLKSGDDK

SEQ ID NO: 2508261 - protein, 19 aa, Entamoeba dispar
VIPLQFIKVHFCNEIFCQV

SEQ ID NO: 2508262 - protein, 20 aa, Entamoeba dispar
VIPSHYYLFSLIGWIANQLM

SEQ ID NO: 2508263 - protein, 22 aa, Entamoeba dispar
VIPSNCETFCYIIISYSFGFNI

SEQ ID NO: 2508264 - protein, 18 aa, Entamoeba dispar
VIPYYCFSGCSSLTSVIL

SEQ ID NO: 2508265 - protein, 19 aa, Entamoeba dispar
VIQCHGGMRTVEFKVVELT

SEQ ID NO: 2508266 - protein, 21 aa, Entamoeba dispar
VIQEIIKKCCTVIDSSSQTQP

SEQ ID NO: 2508267 - protein, 19 aa, Entamoeba dispar
VIQFCKEQKLNACVVSCIK

SEQ ID NO: 2508268 - protein, 26 aa, Entamoeba dispar
VIQKLINEFKICFASRGEALTQKIFS

SEQ ID NO: 2508269 - protein, 31 aa, Entamoeba dispar
VIQNNELCSVPIKRPFENEIFTQPTTSLFES

SEQ ID NO: 2508270 - protein, 23 aa, Entamoeba dispar
VIQPIRSRCVMIRVPLPDKQQMT

SEQ ID NO: 2508271 - protein, 25 aa, Entamoeba dispar
VIQSGRCQNSFFAKYIAFKQEPKGD

SEQ ID NO: 2508272 - protein, 27 aa, Entamoeba dispar
VIQTLKGECKFTFKEMQTLNVKRDKLN

SEQ ID NO: 2508273 - protein, 18 aa, Entamoeba dispar
VIQTYCGIVVNKDKSMYW

SEQ ID NO: 2508274 - protein, 20 aa, Entamoeba dispar
VIQYCLRLLNPLQVFDILNG

SEQ ID NO: 2508275 - protein, 22 aa, Entamoeba dispar
VIRELRLQKMLVETLPKEIERI

SEQ ID NO: 2508276 - protein, 25 aa, Entamoeba dispar
VIRKNFWSYNCFTVYLTCSNLVEYL

SEQ ID NO: 2508277 - protein, 17 aa, Entamoeba dispar
VIRLCLNNHIIQISERT

SEQ ID NO: 2508278 - protein, 18 aa, Entamoeba dispar
VIRLITLNVTQRIGEIGN

SEQ ID NO: 2508279 - protein, 17 aa, Entamoeba dispar
VIRNGRVNGNLSLTRAI

SEQ ID NO: 2508280 - protein, 19 aa, Entamoeba dispar
VIRNNERFISFLITSTANQ

SEQ ID NO: 2508281 - protein, 27 aa, Entamoeba dispar
VIRRTCFKYFFQLCFEDYIQVVNSTGI

SEQ ID NO: 2508282 - protein, 18 aa, Entamoeba dispar
VIRVHSGFHNEYILNQLK

SEQ ID NO: 2508283 - protein, 19 aa, Entamoeba dispar
VISELFFGMLLKRTLCDCG

SEQ ID NO: 2508284 - protein, 26 aa, Entamoeba dispar
VISFGKSCFFNCGFILELKQNMKIPR

SEQ ID NO: 2508285 - protein, 19 aa, Entamoeba dispar
VISINCCDVIEPLIVPMSI

SEQ ID NO: 2508286 - protein, 22 aa, Entamoeba dispar
VISPGCFKECYSLKSINIPSSV

SEQ ID NO: 2508287 - protein, 31 aa, Entamoeba dispar
VISPKYAYNFWICCLHFIGTPLISNNASVVE

SEQ ID NO: 2508288 - protein, 24 aa, Entamoeba dispar
VITEKHSSGWWFATNSQGQSGFVP

SEQ ID NO: 2508289 - protein, 18 aa, Entamoeba dispar
VITISSPIIFNILIDHIN

SEQ ID NO: 2508290 - protein, 23 aa, Entamoeba dispar
VITNYFEIHFSKIHFVSYKAKFI

SEQ ID NO: 2508291 - protein, 18 aa, Entamoeba dispar
VITSLSITFKNCIEPLNY

SEQ ID NO: 2508292 - protein, 19 aa, Entamoeba dispar
VITSRNWMQYGLKIIDQKK

SEQ ID NO: 2508293 - protein, 24 aa, Entamoeba dispar
VITYPEFYIQLSIDRYEGYYNYLL

SEQ ID NO: 2508294 - protein, 18 aa, Entamoeba dispar
VIVLKYDILNPFSEQICE

SEQ ID NO: 2508295 - protein, 24 aa, Entamoeba dispar
VIVPRTKGGFSYGYVDSMKQENRC

SEQ ID NO: 2508296 - protein, 18 aa, Entamoeba dispar
VIVSFFLSLCHHQLLKIG

SEQ ID NO: 2508297 - protein, 24 aa, Entamoeba dispar
VIWERHLGEALSIFCENDDSLTDE

SEQ ID NO: 2508298 - protein, 19 aa, Entamoeba dispar
VIWYHRKWSISKMEHPKFE

SEQ ID NO: 2508299 - protein, 22 aa, Entamoeba dispar
VIYCTRHIKLISEFLNELKPNE

SEQ ID NO: 2508300 - protein, 21 aa, Entamoeba dispar
VIYLEERWSIDMTSDIEETLE

SEQ ID NO: 2508301 - protein, 20 aa, Entamoeba dispar
VIYNLVEWREYRNFQYSRFP

SEQ ID NO: 2508302 - protein, 24 aa, Entamoeba dispar
VKADQHVFLALSFAGKSNPGDKGS

SEQ ID NO: 2508303 - protein, 23 aa, Entamoeba dispar
VKAKSITLNGCYFVSNLDIDCDS

SEQ ID NO: 2508304 - protein, 29 aa, Entamoeba dispar
VKALYKRAVELNSKFNVLFVKYINTATNT

SEQ ID NO: 2508305 - protein, 19 aa, Entamoeba dispar
VKALYRIGVVLNKKEQYSL

SEQ ID NO: 2508306 - protein, 21 aa, Entamoeba dispar
VKAVIRIKVERIEYGTTIAIS

SEQ ID NO: 2508307 - protein, 18 aa, Entamoeba dispar
VKAWKPNTKMVYLESPAN

SEQ ID NO: 2508308 - protein, 18 aa, Entamoeba dispar
VKCDLSLSSRIVEIGSEK

SEQ ID NO: 2508309 - protein, 17 aa, Entamoeba dispar
VKCGGPVSPKAKKLIFK

SEQ ID NO: 2508310 - protein, 26 aa, Entamoeba dispar
VKCKKRGQTAWAHRQMIIYNGEFILF

SEQ ID NO: 2508311 - protein, 25 aa, Entamoeba dispar
VKCSYLEGFMTLFIRPLLGRTGILK

SEQ ID NO: 2508312 - protein, 25 aa, Entamoeba dispar
VKDAKVCILSCPFEPPKTKTTTNMN

SEQ ID NO: 2508313 - protein, 24 aa, Entamoeba dispar
VKDDNCAVFVIGAFAHGHINVEYT

SEQ ID NO: 2508314 - protein, 18 aa, Entamoeba dispar
VKDFSVFTKPHWKKILLD

SEQ ID NO: 2508315 - protein, 18 aa, Entamoeba dispar
VKDGCACIGDNGYCKVCG

SEQ ID NO: 2508316 - protein, 22 aa, Entamoeba dispar
VKDIAIKCMTSFAPHITYASSV

SEQ ID NO: 2508317 - protein, 23 aa, Entamoeba dispar
VKDIFTTPCLPFIGTYLTDYTFL

SEQ ID NO: 2508318 - protein, 18 aa, Entamoeba dispar
VKDIVEFLYRCMTNEHLV

SEQ ID NO: 2508319 - protein, 22 aa, Entamoeba dispar
VKDKDGVLYYCYTYTVKNKDGQ

SEQ ID NO: 2508320 - protein, 35 aa, Entamoeba dispar
VKDKREIGKSISFVWKLNLEYGEYDLQYFDSDQLA

SEQ ID NO: 2508321 - protein, 20 aa, Entamoeba dispar
VKDLFEFFKDIPMGTISIPH

SEQ ID NO: 2508322 - protein, 22 aa, Entamoeba dispar
VKDLIKKRWETLIQENNDPPIT

SEQ ID NO: 2508323 - protein, 18 aa, Entamoeba dispar
VKDLRGCNINMDKPYASG

SEQ ID NO: 2508324 - protein, 17 aa, Entamoeba dispar
VKDLYWVGVFDKELRVF

SEQ ID NO: 2508325 - protein, 18 aa, Entamoeba dispar
VKDMWLKDLDAFVKKYPQ

SEQ ID NO: 2508326 - protein, 24 aa, Entamoeba dispar
VKDNVKYLMEWVEMNKMRILYDSV

SEQ ID NO: 2508327 - protein, 32 aa, Entamoeba dispar
VKDRLQPNFSWPKEWRGMYGYELKNIIGNGVI

SEQ ID NO: 2508328 - protein, 22 aa, Entamoeba dispar
VKDRVGFNIVYQAIKNGRLKPG

SEQ ID NO: 2508329 - protein, 21 aa, Entamoeba dispar
VKDSLELFGTLVSWIDISFST

SEQ ID NO: 2508330 - protein, 24 aa, Entamoeba dispar
VKDTLIKFVEFKSNYFSYSNADYP

SEQ ID NO: 2508331 - protein, 21 aa, Entamoeba dispar
VKDYRIEKLRNWIGKSNYKII

SEQ ID NO: 2508332 - protein, 18 aa, Entamoeba dispar
VKEACALINLAHSKGEKV

SEQ ID NO: 2508333 - protein, 18 aa, Entamoeba dispar
VKEEFQVGIDNILDSYID

SEQ ID NO: 2508334 - protein, 19 aa, Entamoeba dispar
VKEIGCQSFRGCSGLESIN

SEQ ID NO: 2508335 - protein, 17 aa, Entamoeba dispar
VKEIIIFGSIDKFINTR

SEQ ID NO: 2508336 - protein, 23 aa, Entamoeba dispar
VKEIMSLKGIYIVQLISEFMYKD

SEQ ID NO: 2508337 - protein, 27 aa, Entamoeba dispar
VKEIQRRISGHLSRISSYSTMRLLTQR

SEQ ID NO: 2508338 - protein, 19 aa, Entamoeba dispar
VKEIRTWIKKALERKEKRV

SEQ ID NO: 2508339 - protein, 19 aa, Entamoeba dispar
VKEKLLIGTVIQTFSKYTA

SEQ ID NO: 2508340 - protein, 18 aa, Entamoeba dispar
VKELNGLVIKYNKKTNGM

SEQ ID NO: 2508341 - protein, 22 aa, Entamoeba dispar
VKEMIIRGGHNIWPAEINDTLI

SEQ ID NO: 2508342 - protein, 30 aa, Entamoeba dispar
VKENAFYPAISLRSYKDFTINFGEEPFKYD

SEQ ID NO: 2508343 - protein, 20 aa, Entamoeba dispar
VKERAIELLRELDKKYGESY

SEQ ID NO: 2508344 - protein, 28 aa, Entamoeba dispar
VKERTHQCPICRTPITAAINFSRKSVPL

SEQ ID NO: 2508345 - protein, 19 aa, Entamoeba dispar
VKESAAREVIRMKYGERGM

SEQ ID NO: 2508346 - protein, 24 aa, Entamoeba dispar
VKESELRRILLHNGHTNLVELFCK

SEQ ID NO: 2508347 - protein, 19 aa, Entamoeba dispar
VKETKRANAKIVVDDANEK

SEQ ID NO: 2508348 - protein, 17 aa, Entamoeba dispar
VKEVIKPTMEIKSKLST

SEQ ID NO: 2508349 - protein, 22 aa, Entamoeba dispar
VKEVIPQLPTRITIDKPNVEED

SEQ ID NO: 2508350 - protein, 25 aa, Entamoeba dispar
VKEYAEAFEIIPYTLAENAGLNPME

SEQ ID NO: 2508351 - protein, 22 aa, Entamoeba dispar
VKEYERALELFEVIRKVNGQDN

SEQ ID NO: 2508352 - protein, 19 aa, Entamoeba dispar
VKFESVVPFTNFNHHFYYD

SEQ ID NO: 2508353 - protein, 23 aa, Entamoeba dispar
VKFIRGVEILMFYSQPPPIYYAY

SEQ ID NO: 2508354 - protein, 20 aa, Entamoeba dispar
VKFIRPLIEVPVVFIQEWTK

SEQ ID NO: 2508355 - protein, 25 aa, Entamoeba dispar
VKFQLKKVLCMGVAVGNVKLTEDQL

SEQ ID NO: 2508356 - protein, 21 aa, Entamoeba dispar
VKFSPDYPLFALGFEKKIEIW

SEQ ID NO: 2508357 - protein, 21 aa, Entamoeba dispar
VKFSVSLLCPHCLNHSIKKED

SEQ ID NO: 2508358 - protein, 20 aa, Entamoeba dispar
VKGEYKYLFDTIIPVNELKE

SEQ ID NO: 2508359 - protein, 18 aa, Entamoeba dispar
VKGFKEFIKRQSIIKDLN

SEQ ID NO: 2508360 - protein, 17 aa, Entamoeba dispar
VKGGSILPENDFKRLCS

SEQ ID NO: 2508361 - protein, 22 aa, Entamoeba dispar
VKGGTLIRYGDKLKMLEIAQVP

SEQ ID NO: 2508362 - protein, 24 aa, Entamoeba dispar
VKGIECIKMKLGEPDASGRAAPVP

SEQ ID NO: 2508363 - protein, 26 aa, Entamoeba dispar
VKGIEEYSHLIILFKFHLNKNHVYHP

SEQ ID NO: 2508364 - protein, 21 aa, Entamoeba dispar
VKGKCDLSDIMLLIHLRGNKK

SEQ ID NO: 2508365 - protein, 23 aa, Entamoeba dispar
VKGKDPRFKITRKKTNKKGRNQQ

SEQ ID NO: 2508366 - protein, 17 aa, Entamoeba dispar
VKGKSKWYTGGEQPLTS

SEQ ID NO: 2508367 - protein, 21 aa, Entamoeba dispar
VKGLQLCFGLDKQFRSIGLFL

SEQ ID NO: 2508368 - protein, 17 aa, Entamoeba dispar
VKGPHKFDYQGMEIKLP

SEQ ID NO: 2508369 - protein, 17 aa, Entamoeba dispar
VKGPYLGSVVFGTKEEA

SEQ ID NO: 2508370 - protein, 20 aa, Entamoeba dispar
VKGSCKVYKKYCNFIMRNNR

SEQ ID NO: 2508371 - protein, 24 aa, Entamoeba dispar
VKGTELFQGRGIPLGSSKRIKEGI

SEQ ID NO: 2508372 - protein, 17 aa, Entamoeba dispar
VKGTLLANVREIEEPIA

SEQ ID NO: 2508373 - protein, 17 aa, Entamoeba dispar
VKHFDPRLFTSHFNHIF

SEQ ID NO: 2508374 - protein, 18 aa, Entamoeba dispar
VKHFNAALRDARRSVSDI

SEQ ID NO: 2508375 - protein, 23 aa, Entamoeba dispar
VKIATKVIQDFLLKGVVGTSVAN

SEQ ID NO: 2508376 - protein, 25 aa, Entamoeba dispar
VKIDGVSSYKCGTYYRIGTVNTCAC

SEQ ID NO: 2508377 - protein, 24 aa, Entamoeba dispar
VKIDKCPKCGGDELVCKIKTKTMM

SEQ ID NO: 2508378 - protein, 17 aa, Entamoeba dispar
VKIEKFICNSIAFHLTI

SEQ ID NO: 2508379 - protein, 18 aa, Entamoeba dispar
VKIFSLIIHRFRSYFKKE

SEQ ID NO: 2508380 - protein, 19 aa, Entamoeba dispar
VKIGANCWITQNIDQDQII

SEQ ID NO: 2508381 - protein, 26 aa, Entamoeba dispar
VKIGNDIYQFCRTFVLILSPNPIILN

SEQ ID NO: 2508382 - protein, 23 aa, Entamoeba dispar
VKIHLCETKEQIIIPFEDNDKRL

SEQ ID NO: 2508383 - protein, 17 aa, Entamoeba dispar
VKIKELEDIVSGKEEEI

SEQ ID NO: 2508384 - protein, 25 aa, Entamoeba dispar
VKIKGKNVNLVWKIIFEGLMFEARV

SEQ ID NO: 2508385 - protein, 22 aa, Entamoeba dispar
VKIKKLRCGTIGKIQGEEYLDC

SEQ ID NO: 2508386 - protein, 18 aa, Entamoeba dispar
VKILKEFINNGGKYLGIC

SEQ ID NO: 2508387 - protein, 18 aa, Entamoeba dispar
VKILRKAIDEEYYYSKID

SEQ ID NO: 2508388 - protein, 26 aa, Entamoeba dispar
VKISLRTSRRPELGDKFSSRHGQKGV

SEQ ID NO: 2508389 - protein, 17 aa, Entamoeba dispar
VKISMLLLRTYFIMLDP

SEQ ID NO: 2508390 - protein, 20 aa, Entamoeba dispar
VKISRYFTKEDMTALSRTNK

SEQ ID NO: 2508391 - protein, 18 aa, Entamoeba dispar
VKITKCKNTEIIGKLDNI

SEQ ID NO: 2508392 - protein, 24 aa, Entamoeba dispar
VKITLRLPKYVPVLRHILQETQRI

SEQ ID NO: 2508393 - protein, 20 aa, Entamoeba dispar
VKIYRTLYSLAKFKDGNWLI

SEQ ID NO: 2508394 - protein, 21 aa, Entamoeba dispar
VKKCEIGRFILLNSKCDTLYK

SEQ ID NO: 2508395 - protein, 22 aa, Entamoeba dispar
VKKEHTGRCKITSISSSVCAIL

SEQ ID NO: 2508396 - protein, 34 aa, Entamoeba dispar
VKKELCSSLLQTAYCRKEKRCFVQVNGVNESQME

SEQ ID NO: 2508397 - protein, 28 aa, Entamoeba dispar
VKKEPKKWWKYAFNVILEDVRKKNQPHW

SEQ ID NO: 2508398 - protein, 21 aa, Entamoeba dispar
VKKERANVLLFEYAQNKRNYY

SEQ ID NO: 2508399 - protein, 23 aa, Entamoeba dispar
VKKGLDVPLRYAIPSTKKEIKTV

SEQ ID NO: 2508400 - protein, 25 aa, Entamoeba dispar
VKKIKRYQIGKVYRRDQPYMTRGRQ

SEQ ID NO: 2508401 - protein, 24 aa, Entamoeba dispar
VKKIVLFLRKFLRQLEGVVSNYAD

SEQ ID NO: 2508402 - protein, 19 aa, Entamoeba dispar
VKKLLHFIDSVIKKFNDDI

SEQ ID NO: 2508403 - protein, 24 aa, Entamoeba dispar
VKKPKHIIEWLELFDDFGNRTYEE

SEQ ID NO: 2508404 - protein, 19 aa, Entamoeba dispar
VKKPLNYNNLYDILGGINE

SEQ ID NO: 2508405 - protein, 19 aa, Entamoeba dispar
VKKQRKAGIAWRKEEDQKL

SEQ ID NO: 2508406 - protein, 21 aa, Entamoeba dispar
VKKRALITLRQLYKSQPNVLN

SEQ ID NO: 2508407 - protein, 29 aa, Entamoeba dispar
VKKSGMIIRCPFISMEVIKKVVNSFKVDL

SEQ ID NO: 2508408 - protein, 17 aa, Entamoeba dispar
VKKSMWELGIPVTTIHN

SEQ ID NO: 2508409 - protein, 21 aa, Entamoeba dispar
VKKVYDVWCTIGRVESDTVKI

SEQ ID NO: 2508410 - protein, 23 aa, Entamoeba dispar
VKKYWKGMIKPVMIRVKTCFIEI

SEQ ID NO: 2508411 - protein, 23 aa, Entamoeba dispar
VKLAECGLIHCDLNEFNLILSDD

SEQ ID NO: 2508412 - protein, 17 aa, Entamoeba dispar
VKLGDGFIIVYSIIEQQ

SEQ ID NO: 2508413 - protein, 21 aa, Entamoeba dispar
VKLIAGSTIEFLVYDRDLIGR

SEQ ID NO: 2508414 - protein, 18 aa, Entamoeba dispar
VKLIHQWIATLVGQPIRS

SEQ ID NO: 2508415 - protein, 17 aa, Entamoeba dispar
VKLIKWARGLKPFDKEE

SEQ ID NO: 2508416 - protein, 20 aa, Entamoeba dispar
VKLKKECIYEAASPHIKILV

SEQ ID NO: 2508417 - protein, 19 aa, Entamoeba dispar
VKLLGDLVEAWKEIEIKGM

SEQ ID NO: 2508418 - protein, 18 aa, Entamoeba dispar
VKLLKEFINNGGKYLGIC

SEQ ID NO: 2508419 - protein, 25 aa, Entamoeba dispar
VKLLKFVTGQVRAPVGGFANLKTSN

SEQ ID NO: 2508420 - protein, 21 aa, Entamoeba dispar
VKLLRSICMKCHSLKASKQVI

SEQ ID NO: 2508421 - protein, 23 aa, Entamoeba dispar
VKMDIVKSIAFNGVIYDRIAIER

SEQ ID NO: 2508422 - protein, 24 aa, Entamoeba dispar
VKMKDLFFGCCIILNSKEILYTYT

SEQ ID NO: 2508423 - protein, 24 aa, Entamoeba dispar
VKMKECGKEIWPKLIEYESRNKCP

SEQ ID NO: 2508424 - protein, 18 aa, Entamoeba dispar
VKMLESYNNLYVLYKSSL

SEQ ID NO: 2508425 - protein, 19 aa, Entamoeba dispar
VKMLMGFFRALMVWETSLK

SEQ ID NO: 2508426 - protein, 18 aa, Entamoeba dispar
VKMMGGLKRRAISSEQYI

SEQ ID NO: 2508427 - protein, 21 aa, Entamoeba dispar
VKMMIPESITIIGTVIDQNNL

SEQ ID NO: 2508428 - protein, 18 aa, Entamoeba dispar
VKMPFTIKNRDWVNMRSW

SEQ ID NO: 2508429 - protein, 20 aa, Entamoeba dispar
VKMRIRKAYYELYAMVKSAQ

SEQ ID NO: 2508430 - protein, 19 aa, Entamoeba dispar
VKMVNSFITSIAFTISSPK

SEQ ID NO: 2508431 - protein, 19 aa, Entamoeba dispar
VKNAICQQVCILKEKHPKQ

SEQ ID NO: 2508432 - protein, 19 aa, Entamoeba dispar
VKNAVKYVGCDDESRCIAW

SEQ ID NO: 2508433 - protein, 19 aa, Entamoeba dispar
VKNDMIINLPTFIVEVFES

SEQ ID NO: 2508434 - protein, 22 aa, Entamoeba dispar
VKNEIVSSILFNGKLILTSEQI

SEQ ID NO: 2508435 - protein, 20 aa, Entamoeba dispar
VKNFIVVTSIQYRELVQEQL

SEQ ID NO: 2508436 - protein, 33 aa, Entamoeba dispar
VKNGKKVTHWIWYVFPVIQGLWGGRNNDLYNIR

SEQ ID NO: 2508437 - protein, 17 aa, Entamoeba dispar
VKNHPFVKKDGFIQNVQ

SEQ ID NO: 2508438 - protein, 20 aa, Entamoeba dispar
VKNILMLYKRENIVTRGQVP

SEQ ID NO: 2508439 - protein, 28 aa, Entamoeba dispar
VKNKIMLALVFKKWWGDSLVQSIIPPIA

SEQ ID NO: 2508440 - protein, 19 aa, Entamoeba dispar
VKNLFSILLREYKVIRNVE

SEQ ID NO: 2508441 - protein, 18 aa, Entamoeba dispar
VKNSRIWLDTILNGNKKR

SEQ ID NO: 2508442 - protein, 19 aa, Entamoeba dispar
VKNSRIWLNSALSGKTKRV

SEQ ID NO: 2508443 - protein, 20 aa, Entamoeba dispar
VKNSRIWLNSALSGRTKRIK

SEQ ID NO: 2508444 - protein, 23 aa, Entamoeba dispar
VKNSRIWLNSALSGRTKRIKTLV

SEQ ID NO: 2508445 - protein, 20 aa, Entamoeba dispar
VKNSRIWLNSALSGRTKRVK

SEQ ID NO: 2508446 - protein, 24 aa, Entamoeba dispar
VKNSRIWLNSALSRRTKRIKTLVI

SEQ ID NO: 2508447 - protein, 19 aa, Entamoeba dispar
VKNVQEFGEQVVGRILVGN

SEQ ID NO: 2508448 - protein, 21 aa, Entamoeba dispar
VKPENILICADGYIRLTDFGL

SEQ ID NO: 2508449 - protein, 31 aa, Entamoeba dispar
VKPFPKALEILKFLKQKGLKIAIATSSAKTI

SEQ ID NO: 2508450 - protein, 20 aa, Entamoeba dispar
VKPKAPWSRCLILASRGVSA

SEQ ID NO: 2508451 - protein, 18 aa, Entamoeba dispar
VKPKRPKLPNSLQEKRLK

SEQ ID NO: 2508452 - protein, 25 aa, Entamoeba dispar
VKPQSRRISLSSGIQSLSFDDESQL

SEQ ID NO: 2508453 - protein, 24 aa, Entamoeba dispar
VKPYRKEYTEGITHFKNQTAARKT

SEQ ID NO: 2508454 - protein, 21 aa, Entamoeba dispar
VKQCPEFRPQMMNSDFMILFE

SEQ ID NO: 2508455 - protein, 23 aa, Entamoeba dispar
VKQCSVEAYDIFVAFLKMYKTIS

SEQ ID NO: 2508456 - protein, 23 aa, Entamoeba dispar
VKQFIFRMCCEVEKRLHKANSIT

SEQ ID NO: 2508457 - protein, 33 aa, Entamoeba dispar
VKQGGSWKSWKKRWCVLTPTGMIFYFKDKKDVN

SEQ ID NO: 2508458 - protein, 20 aa, Entamoeba dispar
VKQPNVFDLKKACETLKVNF

SEQ ID NO: 2508459 - protein, 31 aa, Entamoeba dispar
VKREHFDMALGEMKPAFGVDSDDQIPTLPNP

SEQ ID NO: 2508460 - protein, 21 aa, Entamoeba dispar
VKREKRLSWEIPQPQQEKNDE

SEQ ID NO: 2508461 - protein, 19 aa, Entamoeba dispar
VKRIICIDDNPSAWKKLEN

SEQ ID NO: 2508462 - protein, 19 aa, Entamoeba dispar
VKRIIRIGSAGAFDESLKL

SEQ ID NO: 2508463 - protein, 19 aa, Entamoeba dispar
VKRIIRIGSAGAINSKLDI

SEQ ID NO: 2508464 - protein, 19 aa, Entamoeba dispar
VKRILNCGGSVVDINGTKR

SEQ ID NO: 2508465 - protein, 21 aa, Entamoeba dispar
VKRINLEYGKGVFSKKRYQKE

SEQ ID NO: 2508466 - protein, 20 aa, Entamoeba dispar
VKRIRGGEILEIKDRDNKTK

SEQ ID NO: 2508467 - protein, 22 aa, Entamoeba dispar
VKRLLTTLIPIYGQYQGYRCGC

SEQ ID NO: 2508468 - protein, 20 aa, Entamoeba dispar
VKRTEQFYCSALEVEHYQTI

SEQ ID NO: 2508469 - protein, 21 aa, Entamoeba dispar
VKRTTFYMPLNMNIGNTIQPG

SEQ ID NO: 2508470 - protein, 22 aa, Entamoeba dispar
VKSEEPPGISFCRALEVLDPFE

SEQ ID NO: 2508471 - protein, 21 aa, Entamoeba dispar
VKSEIRRRKSIKEISQTPQNS

SEQ ID NO: 2508472 - protein, 24 aa, Entamoeba dispar
VKSFTSKSCSIDWVTETDKGVEQY

SEQ ID NO: 2508473 - protein, 20 aa, Entamoeba dispar
VKSKECFEKALNMDKGSELR

SEQ ID NO: 2508474 - protein, 26 aa, Entamoeba dispar
VKSKEELKCFDGIEYHYIAFSDGQCE

SEQ ID NO: 2508475 - protein, 17 aa, Entamoeba dispar
VKSLGAECFSNYKDLTA

SEQ ID NO: 2508476 - protein, 25 aa, Entamoeba dispar
VKSPHSRIQEKACFTLQSMLDNLGE

SEQ ID NO: 2508477 - protein, 24 aa, Entamoeba dispar
VKSQLRLVVPWKRQLGSKGDQTKM

SEQ ID NO: 2508478 - protein, 18 aa, Entamoeba dispar
VKSRGRWIESQDVMNYGS

SEQ ID NO: 2508479 - protein, 25 aa, Entamoeba dispar
VKSSHSIRDDFNFSKPQNHSRPPKT

SEQ ID NO: 2508480 - protein, 24 aa, Entamoeba dispar
VKSSLPNVGTIVIPQPISTETINS

SEQ ID NO: 2508481 - protein, 23 aa, Entamoeba dispar
VKSTELKALMNRNISSVDIKYGY

SEQ ID NO: 2508482 - protein, 20 aa, Entamoeba dispar
VKSTPEWEEKPIDKWKKTTT

SEQ ID NO: 2508483 - protein, 25 aa, Entamoeba dispar
VKSVFRELFYNYTLSPLITNAEKYI

SEQ ID NO: 2508484 - protein, 17 aa, Entamoeba dispar
VKSYWLPELKRYEPEVP

SEQ ID NO: 2508485 - protein, 38 aa, Entamoeba dispar
VKTIEIFKILLFPLEWVCISIALLPRLLLNQLTSPFPY

SEQ ID NO: 2508486 - protein, 23 aa, Entamoeba dispar
VKTIKRRWFVLTTNKLFYFTSQN

SEQ ID NO: 2508487 - protein, 25 aa, Entamoeba dispar
VKTKFEISNGLYLPVTINKPKTVNL

SEQ ID NO: 2508488 - protein, 26 aa, Entamoeba dispar
VKTKLGWGHFSTVWLVEFQNNGKVEQ

SEQ ID NO: 2508489 - protein, 17 aa, Entamoeba dispar
VKTLVIVSDTKMGKTEF

SEQ ID NO: 2508490 - protein, 17 aa, Entamoeba dispar
VKTNLFGWNNIIKHYCN

SEQ ID NO: 2508491 - protein, 18 aa, Entamoeba dispar
VKTPCSHLTFSYQNNALY

SEQ ID NO: 2508492 - protein, 26 aa, Entamoeba dispar
VKTPMCVKMDCQLMLLRHWTLYDSLF

SEQ ID NO: 2508493 - protein, 18 aa, Entamoeba dispar
VKTPQFFSMKEMFIEFKV

SEQ ID NO: 2508494 - protein, 17 aa, Entamoeba dispar
VKTREGAETIIKKVDGL

SEQ ID NO: 2508495 - protein, 20 aa, Entamoeba dispar
VKTTEGFIFGSYHQNTLKIT

SEQ ID NO: 2508496 - protein, 17 aa, Entamoeba dispar
VKTWKISHSPIITTSRP

SEQ ID NO: 2508497 - protein, 26 aa, Entamoeba dispar
VKVEPCKKSNCSISLDVEEYERQRLQ

SEQ ID NO: 2508498 - protein, 18 aa, Entamoeba dispar
VKVIKRGAPPVGDGEVLI

SEQ ID NO: 2508499 - protein, 17 aa, Entamoeba dispar
VKVYRLVSKNTYERYMF

SEQ ID NO: 2508500 - protein, 26 aa, Entamoeba dispar
VKWNMKDMNLFYGICFSNDPSILSIR

SEQ ID NO: 2508501 - protein, 21 aa, Entamoeba dispar
VKYAKSLLCNPTLATTGMSMA

SEQ ID NO: 2508502 - protein, 30 aa, Entamoeba dispar
VKYICSVCQARLGPYFINKEMNKVPQLQVC

SEQ ID NO: 2508503 - protein, 17 aa, Entamoeba dispar
VKYKAKVPGIYDVQVLL

SEQ ID NO: 2508504 - protein, 17 aa, Entamoeba dispar
VKYKLSETFNHKINMKE

SEQ ID NO: 2508505 - protein, 19 aa, Entamoeba dispar
VKYLFKIYSSIIPKIPKSS

SEQ ID NO: 2508506 - protein, 18 aa, Entamoeba dispar
VKYLKFVDQSIMELDDKI

SEQ ID NO: 2508507 - protein, 18 aa, Entamoeba dispar
VKYPRRVTLLRGNHETRQ

SEQ ID NO: 2508508 - protein, 24 aa, Entamoeba dispar
VKYQKMYPALGFSTAYAVEVNFGQ

SEQ ID NO: 2508509 - protein, 17 aa, Entamoeba dispar
VKYRKMLAPIKFESCIT

SEQ ID NO: 2508510 - protein, 23 aa, Entamoeba dispar
VKYSELQPLGIVFNKEQDADEFI

SEQ ID NO: 2508511 - protein, 18 aa, Entamoeba dispar
VKYYCQMCQKQCRDANGF

SEQ ID NO: 2508512 - protein, 19 aa, Entamoeba dispar
VLACDPCAKTIKLYEHLSP

SEQ ID NO: 2508513 - protein, 23 aa, Entamoeba dispar
VLAETLNSFNLVLFSRVTYEELI

SEQ ID NO: 2508514 - protein, 19 aa, Entamoeba dispar
VLAILCYKMPCYYICDKRF

SEQ ID NO: 2508515 - protein, 19 aa, Entamoeba dispar
VLALEEIRKSRGLCQNYSI

SEQ ID NO: 2508516 - protein, 22 aa, Entamoeba dispar
VLCGQKIIPNYCFSRCSNLISV

SEQ ID NO: 2508517 - protein, 23 aa, Entamoeba dispar
VLCLDHIRYELAVNVAVTTIGTV

SEQ ID NO: 2508518 - protein, 19 aa, Entamoeba dispar
VLCRICFQLQGKKEIGVDE

SEQ ID NO: 2508519 - protein, 18 aa, Entamoeba dispar
VLCTKGIDNWRVFDCIYC

SEQ ID NO: 2508520 - protein, 27 aa, Entamoeba dispar
VLDGRKGSYCVLSLTSRSSFVSQALSF

SEQ ID NO: 2508521 - protein, 17 aa, Entamoeba dispar
VLDILEKYLSYKKYTYE

SEQ ID NO: 2508522 - protein, 21 aa, Entamoeba dispar
VLDRCFYKEKMALVELMSLVL

SEQ ID NO: 2508523 - protein, 23 aa, Entamoeba dispar
VLEAIFKKFGRNRISQDVEGKFL

SEQ ID NO: 2508524 - protein, 21 aa, Entamoeba dispar
VLEDMAIHLLKIIKEKYSSQI

SEQ ID NO: 2508525 - protein, 25 aa, Entamoeba dispar
VLEEVGCLRNIIFINEFEVEQPSKD

SEQ ID NO: 2508526 - protein, 18 aa, Entamoeba dispar
VLEFYKEYLPSLQEYQKM

SEQ ID NO: 2508527 - protein, 26 aa, Entamoeba dispar
VLEIINKRCKALMEIDIFNGIVHETA

SEQ ID NO: 2508528 - protein, 32 aa, Entamoeba dispar
VLEKEEFINCFPLRVKALQLINSVMGKNSMVR

SEQ ID NO: 2508529 - protein, 18 aa, Entamoeba dispar
VLEKIRFSARTLKRRYDE

SEQ ID NO: 2508530 - protein, 26 aa, Entamoeba dispar
VLEKVCNSKPSAFVIQHFGGDGFGIF

SEQ ID NO: 2508531 - protein, 18 aa, Entamoeba dispar
VLELKDSFFSKIPNNKDD

SEQ ID NO: 2508532 - protein, 27 aa, Entamoeba dispar
VLELPSEIKLPATIQLYCHLYKDGQLK

SEQ ID NO: 2508533 - protein, 21 aa, Entamoeba dispar
VLEMICAFIGEDPHIASCAFI

SEQ ID NO: 2508534 - protein, 18 aa, Entamoeba dispar
VLEQQALLPANKKTYYKL

SEQ ID NO: 2508535 - protein, 17 aa, Entamoeba dispar
VLERVCKVCFNEYSSNH

SEQ ID NO: 2508536 - protein, 23 aa, Entamoeba dispar
VLERYKKIIGIVWKKYGVTKGFE

SEQ ID NO: 2508537 - protein, 25 aa, Entamoeba dispar
VLESFYICVSLIYSNQLDQWANNYI

SEQ ID NO: 2508538 - protein, 17 aa, Entamoeba dispar
VLESGAYFNVDIHDNGI

SEQ ID NO: 2508539 - protein, 25 aa, Entamoeba dispar
VLESIVGRDFLPRGSGMVTKRPLIL

SEQ ID NO: 2508540 - protein, 17 aa, Entamoeba dispar
VLEWSEKKQILLAQKIG

SEQ ID NO: 2508541 - protein, 27 aa, Entamoeba dispar
VLEYFKEFHPLKALIIYDKESKISKGY

SEQ ID NO: 2508542 - protein, 17 aa, Entamoeba dispar
VLFDGTKVTDAILIKNV

SEQ ID NO: 2508543 - protein, 19 aa, Entamoeba dispar
VLFEIGNKCTSLKHFNNLC

SEQ ID NO: 2508544 - protein, 18 aa, Entamoeba dispar
VLFFETSAKAKINIAETF

SEQ ID NO: 2508545 - protein, 25 aa, Entamoeba dispar
VLFILDEFLQWGFVEKISVSNVRAN

SEQ ID NO: 2508546 - protein, 17 aa, Entamoeba dispar
VLFSCLYNGKIINPPVI

SEQ ID NO: 2508547 - protein, 24 aa, Entamoeba dispar
VLFVKKWKKRYVVWKDDKLFFFEK

SEQ ID NO: 2508548 - protein, 17 aa, Entamoeba dispar
VLFVLVMEKIMGRIDLP

SEQ ID NO: 2508549 - protein, 20 aa, Entamoeba dispar
VLFYLPNLYEIMKFESVSKS

SEQ ID NO: 2508550 - protein, 22 aa, Entamoeba dispar
VLGCPNFEGGLIVAAQKGCGAK

SEQ ID NO: 2508551 - protein, 19 aa, Entamoeba dispar
VLGKSCFSGCYSLTSITIP

SEQ ID NO: 2508552 - protein, 23 aa, Entamoeba dispar
VLGNCCFQGCLSLNSINIPSSIS

SEQ ID NO: 2508553 - protein, 18 aa, Entamoeba dispar
VLGSECFSECTTLKSINI

SEQ ID NO: 2508554 - protein, 22 aa, Entamoeba dispar
VLGVILCFDYQKSNTFANLMNW

SEQ ID NO: 2508555 - protein, 25 aa, Entamoeba dispar
VLGWLKIIFYPRNYFRTKYNDNLLY

SEQ ID NO: 2508556 - protein, 17 aa, Entamoeba dispar
VLIDFLKKIFVYDPNER

SEQ ID NO: 2508557 - protein, 19 aa, Entamoeba dispar
VLIDSTLNKIFSWTESSIP

SEQ ID NO: 2508558 - protein, 26 aa, Entamoeba dispar
VLIEEMKIISSPRFKVSEIPNTLRNL

SEQ ID NO: 2508559 - protein, 23 aa, Entamoeba dispar
VLIEHQTCLISTVAMKMIQESTD

SEQ ID NO: 2508560 - protein, 18 aa, Entamoeba dispar
VLIEKDWLSFGHQFQTRS

SEQ ID NO: 2508561 - protein, 21 aa, Entamoeba dispar
VLIGPNCNLIGISHTTCEKIR

SEQ ID NO: 2508562 - protein, 19 aa, Entamoeba dispar
VLIIGRFLICANVGDSEVL

SEQ ID NO: 2508563 - protein, 25 aa, Entamoeba dispar
VLIKSLSSLLLWNLSDEILDKDDIN

SEQ ID NO: 2508564 - protein, 18 aa, Entamoeba dispar
VLIKTVNVMDCSDSSVQL

SEQ ID NO: 2508565 - protein, 19 aa, Entamoeba dispar
VLILRKLYKTNTLSNIYER

SEQ ID NO: 2508566 - protein, 18 aa, Entamoeba dispar
VLIPWPNRIANGCYRYQG

SEQ ID NO: 2508567 - protein, 19 aa, Entamoeba dispar
VLIQCVRFAAEYEETKLNG

SEQ ID NO: 2508568 - protein, 18 aa, Entamoeba dispar
VLIQEWTKYIELPRLIRC

SEQ ID NO: 2508569 - protein, 17 aa, Entamoeba dispar
VLIQILATFQWYIRSDY

SEQ ID NO: 2508570 - protein, 25 aa, Entamoeba dispar
VLISKDFLGLRVLKGINLITPTTME

SEQ ID NO: 2508571 - protein, 28 aa, Entamoeba dispar
VLISNKSCEKGLCVLSGLIQLVIDPHYR

SEQ ID NO: 2508572 - protein, 22 aa, Entamoeba dispar
VLKAEELLDMSFRRRDKMEFVI

SEQ ID NO: 2508573 - protein, 27 aa, Entamoeba dispar
VLKCVCPICKRIYCHGDERIKNIKSTG

SEQ ID NO: 2508574 - protein, 26 aa, Entamoeba dispar
VLKEMLPCFKYLYGHFEGLLEVCHSL

SEQ ID NO: 2508575 - protein, 17 aa, Entamoeba dispar
VLKHLKYTMELKTSKTK

SEQ ID NO: 2508576 - protein, 26 aa, Entamoeba dispar
VLKKGYKAIRFEGIVGQWAKEGAIVV

SEQ ID NO: 2508577 - protein, 18 aa, Entamoeba dispar
VLKLSGIERQLFEEKTRE

SEQ ID NO: 2508578 - protein, 19 aa, Entamoeba dispar
VLKMKSIKIMIKYPKIGDH

SEQ ID NO: 2508579 - protein, 26 aa, Entamoeba dispar
VLKPCSEKLSILDSMNNLKLMINQMK

SEQ ID NO: 2508580 - protein, 23 aa, Entamoeba dispar
VLKRLHCKCDICASERDDPKTII

SEQ ID NO: 2508581 - protein, 25 aa, Entamoeba dispar
VLKRPKSFKARPIITHADGTKQTFW

SEQ ID NO: 2508582 - protein, 18 aa, Entamoeba dispar
VLLDPSVGGNEKFHDTMA

SEQ ID NO: 2508583 - protein, 25 aa, Entamoeba dispar
VLLEIVYCYLNFCIAAQPDLLKTFK

SEQ ID NO: 2508584 - protein, 26 aa, Entamoeba dispar
VLLFVMVCGYPPFSRINNQYTESILK

SEQ ID NO: 2508585 - protein, 23 aa, Entamoeba dispar
VLLIKSILCCYDFHQPANGGLGT

SEQ ID NO: 2508586 - protein, 17 aa, Entamoeba dispar
VLLKVFNGIVLNQLQDT

SEQ ID NO: 2508587 - protein, 18 aa, Entamoeba dispar
VLLLRNCIDENGLSELFN

SEQ ID NO: 2508588 - protein, 18 aa, Entamoeba dispar
VLLPLSFDIIQWLFFGIP

SEQ ID NO: 2508589 - protein, 22 aa, Entamoeba dispar
VLLPQLSQYLSFDECKLSDRIY

SEQ ID NO: 2508590 - protein, 19 aa, Entamoeba dispar
VLMNRRIYLMEGVINGISI

SEQ ID NO: 2508591 - protein, 22 aa, Entamoeba dispar
VLMPVSLQLFGKVMNSGNLKLI

SEQ ID NO: 2508592 - protein, 31 aa, Entamoeba dispar
VLMVGGSCKCPRIKGMLIDFFGSEKVDQINT

SEQ ID NO: 2508593 - protein, 17 aa, Entamoeba dispar
VLNDSKTGFVFYGENTD

SEQ ID NO: 2508594 - protein, 24 aa, Entamoeba dispar
VLNEFKFSNIVYLTRYKNMIEYLE

SEQ ID NO: 2508595 - protein, 17 aa, Entamoeba dispar
VLNFQWLFDCLKEGRVI

SEQ ID NO: 2508596 - protein, 19 aa, Entamoeba dispar
VLNHYRLSQQLTLDQQHFL

SEQ ID NO: 2508597 - protein, 17 aa, Entamoeba dispar
VLNKCYFNFYQLPKSIR

SEQ ID NO: 2508598 - protein, 19 aa, Entamoeba dispar
VLNKIWEIFCKVEVNKEHI

SEQ ID NO: 2508599 - protein, 28 aa, Entamoeba dispar
VLNKLKSIEIISCRECKINIKSDCIEKL

SEQ ID NO: 2508600 - protein, 18 aa, Entamoeba dispar
VLNLWKKKYETLQLQWNS

SEQ ID NO: 2508601 - protein, 24 aa, Entamoeba dispar
VLNPFKYSVCLKDFPLSNYHSLEP

SEQ ID NO: 2508602 - protein, 24 aa, Entamoeba dispar
VLPCTHVICRDCIVSLIQSQKSHN

SEQ ID NO: 2508603 - protein, 22 aa, Entamoeba dispar
VLPDSMLLFGEFEKRISNYNKG

SEQ ID NO: 2508604 - protein, 21 aa, Entamoeba dispar
VLPIPPSRFRQLNKFGELISD

SEQ ID NO: 2508605 - protein, 18 aa, Entamoeba dispar
VLPLTRFDDEIIFTMFTL

SEQ ID NO: 2508606 - protein, 17 aa, Entamoeba dispar
VLPNKAKSLSIYGVSEM

SEQ ID NO: 2508607 - protein, 24 aa, Entamoeba dispar
VLPNNCCTEGMFLLNPQVPSLFEQ

SEQ ID NO: 2508608 - protein, 26 aa, Entamoeba dispar
VLPQLSQSFMCWKELNTILQDEEFKN

SEQ ID NO: 2508609 - protein, 19 aa, Entamoeba dispar
VLPTIKLLLQNGTPVIKSA

SEQ ID NO: 2508610 - protein, 19 aa, Entamoeba dispar
VLQEYKFIENVICFPNEIF

SEQ ID NO: 2508611 - protein, 24 aa, Entamoeba dispar
VLQHGACLGVGLAGIATENYELYQ

SEQ ID NO: 2508612 - protein, 18 aa, Entamoeba dispar
VLQNLIFVPSIPHEQLIT

SEQ ID NO: 2508613 - protein, 18 aa, Entamoeba dispar
VLQYFIDKLNCYYLNTSH

SEQ ID NO: 2508614 - protein, 18 aa, Entamoeba dispar
VLQYFIDKLNCYYLNVSH

SEQ ID NO: 2508615 - protein, 26 aa, Entamoeba dispar
VLQYICKLPSLNLWNITINPIPLKIM

SEQ ID NO: 2508616 - protein, 28 aa, Entamoeba dispar
VLRDLPCLTSLDCSRCHFNISDIISRPP

SEQ ID NO: 2508617 - protein, 24 aa, Entamoeba dispar
VLRDVCWSILFIINIKFFLTSQLV

SEQ ID NO: 2508618 - protein, 18 aa, Entamoeba dispar
VLRERIRKALQLYSSEPT

SEQ ID NO: 2508619 - protein, 18 aa, Entamoeba dispar
VLRPYVGGVEKIPFIAPK

SEQ ID NO: 2508620 - protein, 21 aa, Entamoeba dispar
VLRRYCFESYIMKNGISSTRN

SEQ ID NO: 2508621 - protein, 24 aa, Entamoeba dispar
VLSEYKSEMVLSILQSIVKIESTN

SEQ ID NO: 2508622 - protein, 18 aa, Entamoeba dispar
VLSGCLKISPMAYCSIVN

SEQ ID NO: 2508623 - protein, 25 aa, Entamoeba dispar
VLSILAANCGLEFQKAALCIFAEMT

SEQ ID NO: 2508624 - protein, 26 aa, Entamoeba dispar
VLSKALRFPMGLQFEELQSYMKATDI

SEQ ID NO: 2508625 - protein, 17 aa, Entamoeba dispar
VLSNYCFESSLIQSIEL

SEQ ID NO: 2508626 - protein, 17 aa, Entamoeba dispar
VLSQIYQFIVSKRSKGL

SEQ ID NO: 2508627 - protein, 29 aa, Entamoeba dispar
VLSRILALIPPWVRVHRIQRDIPIPLVSA

SEQ ID NO: 2508628 - protein, 17 aa, Entamoeba dispar
VLSSILINNEIKVNTNV

SEQ ID NO: 2508629 - protein, 17 aa, Entamoeba dispar
VLSTLGFEASIHWMNFA

SEQ ID NO: 2508630 - protein, 35 aa, Entamoeba dispar
VLTEYFKFNFSFRLIEILTLVALCRDEQKKSVLLI

SEQ ID NO: 2508631 - protein, 24 aa, Entamoeba dispar
VLTHQWLCGASVYSNPYFANLLKE

SEQ ID NO: 2508632 - protein, 23 aa, Entamoeba dispar
VLTLNELKHLICNSQKERDNTEF

SEQ ID NO: 2508633 - protein, 19 aa, Entamoeba dispar
VLTNFKFLVELDCQNNQGI

SEQ ID NO: 2508634 - protein, 17 aa, Entamoeba dispar
VLVKKVRLIANKELQMC

SEQ ID NO: 2508635 - protein, 19 aa, Entamoeba dispar
VLVKMEPNDHFGIIVNEMH

SEQ ID NO: 2508636 - protein, 30 aa, Entamoeba dispar
VLVLNKCDLVPTWATARWVKVLSKEFPTIA

SEQ ID NO: 2508637 - protein, 21 aa, Entamoeba dispar
VLVMVGSSIGVLSTATTAQAE

SEQ ID NO: 2508638 - protein, 26 aa, Entamoeba dispar
VLVQFKIDISQVFRLKNQIGGFETKE

SEQ ID NO: 2508639 - protein, 26 aa, Entamoeba dispar
VLYGKGAGCGPTLFQAFETRKENEVG

SEQ ID NO: 2508640 - protein, 18 aa, Entamoeba dispar
VLYIIAINYLKYLKSDLM

SEQ ID NO: 2508641 - protein, 21 aa, Entamoeba dispar
VLYNKVEFIESLIVDYQINVN

SEQ ID NO: 2508642 - protein, 20 aa, Entamoeba dispar
VLYPKIIKIDAAFISPSPTG

SEQ ID NO: 2508643 - protein, 20 aa, Entamoeba dispar
VLYREKNGWTLVKQGDKIGY

SEQ ID NO: 2508644 - protein, 19 aa, Entamoeba dispar
VLYSLYLNNEIEWNGDYPI

SEQ ID NO: 2508645 - protein, 17 aa, Entamoeba dispar
VLYSQLRLFGGIGTSVK

SEQ ID NO: 2508646 - protein, 18 aa, Entamoeba dispar
VMAKRKVPMLGEVGELAR

SEQ ID NO: 2508647 - protein, 29 aa, Entamoeba dispar
VMDDSRYQFKYGLRPGEDIQQFGQMKNFP

SEQ ID NO: 2508648 - protein, 20 aa, Entamoeba dispar
VMDSFECTRAIYSTISINGE

SEQ ID NO: 2508649 - protein, 24 aa, Entamoeba dispar
VMDTSYRVVYSFKENEYLQSNEIF

SEQ ID NO: 2508650 - protein, 30 aa, Entamoeba dispar
VMEFLTGIMKMRYGDFQKFVLQFISNCHDK

SEQ ID NO: 2508651 - protein, 18 aa, Entamoeba dispar
VMEKIMGRIDLPFIQRIY

SEQ ID NO: 2508652 - protein, 33 aa, Entamoeba dispar
VMGKKGVMGIIFNGSKKAFGFVFHSLTIEGKWL

SEQ ID NO: 2508653 - protein, 17 aa, Entamoeba dispar
VMGSILTCERVDLRTSH

SEQ ID NO: 2508654 - protein, 25 aa, Entamoeba dispar
VMHKMCLTLIILLRIAINHSTYEEV

SEQ ID NO: 2508655 - protein, 18 aa, Entamoeba dispar
VMIIDEVHLLHDTRGPVL

SEQ ID NO: 2508656 - protein, 24 aa, Entamoeba dispar
VMIKGELFDGIDYIGVFDGHNGKD

SEQ ID NO: 2508657 - protein, 29 aa, Entamoeba dispar
VMKEHMKPMYFKLADFLIHVIKKTVENEN

SEQ ID NO: 2508658 - protein, 21 aa, Entamoeba dispar
VMKLFHPIFIAVMTRIQIVSF

SEQ ID NO: 2508659 - protein, 20 aa, Entamoeba dispar
VMKPLKMYLETVTVLEKRVK

SEQ ID NO: 2508660 - protein, 23 aa, Entamoeba dispar
VMKRPKSFNAQPIINHKDGTKQK

SEQ ID NO: 2508661 - protein, 25 aa, Entamoeba dispar
VMKRPKSFNARPIFNHKDGTQQKFW

SEQ ID NO: 2508662 - protein, 25 aa, Entamoeba dispar
VMKRPKSFNARPLFNHKDGTQQKFW

SEQ ID NO: 2508663 - protein, 18 aa, Entamoeba dispar
VMKVFSLITYKTFADLGK

SEQ ID NO: 2508664 - protein, 17 aa, Entamoeba dispar
VMLMLSKKLKQKRIDAG

SEQ ID NO: 2508665 - protein, 35 aa, Entamoeba dispar
VMLRDVLRTYALYNWRIGYGQGMNDICSLIMEITL

SEQ ID NO: 2508666 - protein, 18 aa, Entamoeba dispar
VMLSLCVYLSRCQKFVPY

SEQ ID NO: 2508667 - protein, 17 aa, Entamoeba dispar
VMMGAKIQKFVYLDGPN

SEQ ID NO: 2508668 - protein, 19 aa, Entamoeba dispar
VMMSLELMNCLPFKEVLFH

SEQ ID NO: 2508669 - protein, 22 aa, Entamoeba dispar
VMNCVIRTYQFIGALIATEIPV

SEQ ID NO: 2508670 - protein, 17 aa, Entamoeba dispar
VMNGIIISIPESYINSD

SEQ ID NO: 2508671 - protein, 18 aa, Entamoeba dispar
VMNILKYLIQQFESNTQI

SEQ ID NO: 2508672 - protein, 17 aa, Entamoeba dispar
VMNKAMVQWCGLLLNRI

SEQ ID NO: 2508673 - protein, 17 aa, Entamoeba dispar
VMRIRKLNVNGTQNLLF

SEQ ID NO: 2508674 - protein, 24 aa, Entamoeba dispar
VMRKIKVQLTRYEKNLPFNKKVLD

SEQ ID NO: 2508675 - protein, 18 aa, Entamoeba dispar
VMRSLKIIFEKFSDEETK

SEQ ID NO: 2508676 - protein, 35 aa, Entamoeba dispar
VMSCEGGWWYGRSGCSMGYFPGEYVEVSGTINKEV

SEQ ID NO: 2508677 - protein, 22 aa, Entamoeba dispar
VMSRPFGVALLIAGVDETGPRL

SEQ ID NO: 2508678 - protein, 24 aa, Entamoeba dispar
VMVPECQNLLSGCIKLSNQIAQFC

SEQ ID NO: 2508679 - protein, 22 aa, Entamoeba dispar
VMYNMGCCCMALGSSFSKTTDA

SEQ ID NO: 2508680 - protein, 21 aa, Entamoeba dispar
VMYPTRIALMRGNHESRQVTQ

SEQ ID NO: 2508681 - protein, 25 aa, Entamoeba dispar
VMYYYRNKWCFINLFTNQISYVDPR

SEQ ID NO: 2508682 - protein, 17 aa, Entamoeba dispar
VNAHLDGGVIINEPCGG

SEQ ID NO: 2508683 - protein, 23 aa, Entamoeba dispar
VNAIKEERDELVKQIRNIEEEKR

SEQ ID NO: 2508684 - protein, 18 aa, Entamoeba dispar
VNAILKDQERLFRRSQQL

SEQ ID NO: 2508685 - protein, 18 aa, Entamoeba dispar
VNAKGRWIGRTIVDVFVN

SEQ ID NO: 2508686 - protein, 19 aa, Entamoeba dispar
VNALPSLLIEKSKEEMWNA

SEQ ID NO: 2508687 - protein, 26 aa, Entamoeba dispar
VNALYGIKVTDDFRYIIINEGNLEQS

SEQ ID NO: 2508688 - protein, 17 aa, Entamoeba dispar
VNARVSILGEAYVTTSL

SEQ ID NO: 2508689 - protein, 25 aa, Entamoeba dispar
VNASLESCGDCFGRVTMNKKAFVQA

SEQ ID NO: 2508690 - protein, 20 aa, Entamoeba dispar
VNAVFLHFQSVLSINKELLK

SEQ ID NO: 2508691 - protein, 19 aa, Entamoeba dispar
VNCFDFFNNILLIYSAVSD

SEQ ID NO: 2508692 - protein, 19 aa, Entamoeba dispar
VNCFKIFKYNENELNKLSN

SEQ ID NO: 2508693 - protein, 18 aa, Entamoeba dispar
VNCLKLFQRHIKSYSDLH

SEQ ID NO: 2508694 - protein, 22 aa, Entamoeba dispar
VNCNSPLTSICKVHESQFLVGS

SEQ ID NO: 2508695 - protein, 17 aa, Entamoeba dispar
VNCQMILSSKNERYIII

SEQ ID NO: 2508696 - protein, 22 aa, Entamoeba dispar
VNDCNHLVFRNGLLLMSSSKGD

SEQ ID NO: 2508697 - protein, 24 aa, Entamoeba dispar
VNDIRPPFSRSWKNYVKKGIGLHY

SEQ ID NO: 2508698 - protein, 24 aa, Entamoeba dispar
VNDLCQRKAKLLTRLYKKKKNMEP

SEQ ID NO: 2508699 - protein, 19 aa, Entamoeba dispar
VNDLLLMWDVTKPKISTLK

SEQ ID NO: 2508700 - protein, 17 aa, Entamoeba dispar
VNDLSFDIKDGVLIVLV

SEQ ID NO: 2508701 - protein, 27 aa, Entamoeba dispar
VNDRVSLPTVWKYFFLFSDILVVTEVI

SEQ ID NO: 2508702 - protein, 24 aa, Entamoeba dispar
VNDSRYVIWGGMVQTLLRALGNVS

SEQ ID NO: 2508703 - protein, 18 aa, Entamoeba dispar
VNDVCWSKSNPEWIGAAM

SEQ ID NO: 2508704 - protein, 20 aa, Entamoeba dispar
VNDVLRRSLATPGIASITPL

SEQ ID NO: 2508705 - protein, 32 aa, Entamoeba dispar
VNDYKRLNVALTRAKCGLIVIGNIQTLIGSKV

SEQ ID NO: 2508706 - protein, 21 aa, Entamoeba dispar
VNEATKLPAMQKVMNDFEKQN

SEQ ID NO: 2508707 - protein, 26 aa, Entamoeba dispar
VNEEWDLRPLFSQLINSPSIQNSISK

SEQ ID NO: 2508708 - protein, 18 aa, Entamoeba dispar
VNEIAAFQFHKIHEYLKV

SEQ ID NO: 2508709 - protein, 25 aa, Entamoeba dispar
VNEICFWVASLILSFPDLNNRAKMM

SEQ ID NO: 2508710 - protein, 23 aa, Entamoeba dispar
VNEKGDNLLSFDINDSNKTVKEQ

SEQ ID NO: 2508711 - protein, 25 aa, Entamoeba dispar
VNEKKENKIEIGIDINDESNNKKEE

SEQ ID NO: 2508712 - protein, 19 aa, Entamoeba dispar
VNEKLEFLSLYIVGKITKK

SEQ ID NO: 2508713 - protein, 26 aa, Entamoeba dispar
VNEKRLRPSFRMSLNDGIFVKLLNGR

SEQ ID NO: 2508714 - protein, 25 aa, Entamoeba dispar
VNELLPISTLYKWNEVVRKRQILEF

SEQ ID NO: 2508715 - protein, 22 aa, Entamoeba dispar
VNERLPLTCLQELSKDVNDMKI

SEQ ID NO: 2508716 - protein, 17 aa, Entamoeba dispar
VNEVFVTLCERINEILQ

SEQ ID NO: 2508717 - protein, 20 aa, Entamoeba dispar
VNFRGFRMLLTICYDTRFPM

SEQ ID NO: 2508718 - protein, 25 aa, Entamoeba dispar
VNFVKCSLTTKVIEDMLFYKRYYEY

SEQ ID NO: 2508719 - protein, 23 aa, Entamoeba dispar
VNGEIIKGWLISKAVCINEFNII

SEQ ID NO: 2508720 - protein, 24 aa, Entamoeba dispar
VNGKPYPLLYLWGEFFGTYEDVQT

SEQ ID NO: 2508721 - protein, 24 aa, Entamoeba dispar
VNGLLKRYFYLMKEPSYIDWKLNN

SEQ ID NO: 2508722 - protein, 36 aa, Entamoeba dispar
VNGMLEYLKFFNIHKIIPIFVFDGATLPSKKLIEEE

SEQ ID NO: 2508723 - protein, 17 aa, Entamoeba dispar
VNGTFLKRKIRIKKQTT

SEQ ID NO: 2508724 - protein, 22 aa, Entamoeba dispar
VNHKVAWYCYHLMKERKNMSLK

SEQ ID NO: 2508725 - protein, 23 aa, Entamoeba dispar
VNHKVAWYCYHLMKERKNMSLKY

SEQ ID NO: 2508726 - protein, 17 aa, Entamoeba dispar
VNIACFRSKGRIPLVTY

SEQ ID NO: 2508727 - protein, 21 aa, Entamoeba dispar
VNICKKRSVIAADFLAIMAQF

SEQ ID NO: 2508728 - protein, 27 aa, Entamoeba dispar
VNIDEEFARRLTVRKVNTDTNEEEKEQ

SEQ ID NO: 2508729 - protein, 18 aa, Entamoeba dispar
VNIFNSSLNFLRMNVQSF

SEQ ID NO: 2508730 - protein, 25 aa, Entamoeba dispar
VNIFSCLDGELLVTFSGHRTGVRIL

SEQ ID NO: 2508731 - protein, 17 aa, Entamoeba dispar
VNIISLFAKNGELVNTI

SEQ ID NO: 2508732 - protein, 17 aa, Entamoeba dispar
VNIKRKDFSHFYHSSEK

SEQ ID NO: 2508733 - protein, 22 aa, Entamoeba dispar
VNIKSKWELIAFSQNAIISGNG

SEQ ID NO: 2508734 - protein, 22 aa, Entamoeba dispar
VNILNCVEEIGVLKTTQALQSF

SEQ ID NO: 2508735 - protein, 17 aa, Entamoeba dispar
VNIPADFKITGKDNNGK

SEQ ID NO: 2508736 - protein, 23 aa, Entamoeba dispar
VNIPECPEINGFVRALCEMSGYM

SEQ ID NO: 2508737 - protein, 19 aa, Entamoeba dispar
VNIPRLCVNASPTKPLSPR

SEQ ID NO: 2508738 - protein, 20 aa, Entamoeba dispar
VNIPRLCVNASPTKPLSPRK

SEQ ID NO: 2508739 - protein, 21 aa, Entamoeba dispar
VNKELFSRCFISVEKVLQVTQ

SEQ ID NO: 2508740 - protein, 22 aa, Entamoeba dispar
VNKELSELMLILINDKRENTDE

SEQ ID NO: 2508741 - protein, 19 aa, Entamoeba dispar
VNKEMKMILSASALHEEEL

SEQ ID NO: 2508742 - protein, 22 aa, Entamoeba dispar
VNKEYKIVGWYAGMANGEPLTS

SEQ ID NO: 2508743 - protein, 26 aa, Entamoeba dispar
VNKFYTFWYSFKSWRDPPLDEMYNIE

SEQ ID NO: 2508744 - protein, 24 aa, Entamoeba dispar
VNKIGVECFFGCYSLESINLPTLI

SEQ ID NO: 2508745 - protein, 18 aa, Entamoeba dispar
VNKKCYEAVFFIKTNPLI

SEQ ID NO: 2508746 - protein, 18 aa, Entamoeba dispar
VNKLITSIVFDYDVVPSL

SEQ ID NO: 2508747 - protein, 20 aa, Entamoeba dispar
VNKPLPSDRVHQMCEDSLLV

SEQ ID NO: 2508748 - protein, 22 aa, Entamoeba dispar
VNKRIIPQIKEIVPPPYGLYPE

SEQ ID NO: 2508749 - protein, 29 aa, Entamoeba dispar
VNKVKPFLRQCGFSDIYSIPISGFSGLNL

SEQ ID NO: 2508750 - protein, 22 aa, Entamoeba dispar
VNKYCLFGGAGLFSDVQTMAEK

SEQ ID NO: 2508751 - protein, 19 aa, Entamoeba dispar
VNLAIGLLYGHFGVKLKDN

SEQ ID NO: 2508752 - protein, 21 aa, Entamoeba dispar
VNLDISIIIERGYCDVYPDGI

SEQ ID NO: 2508753 - protein, 25 aa, Entamoeba dispar
VNLIKKSFEGMEILAKTALYAVHRA

SEQ ID NO: 2508754 - protein, 23 aa, Entamoeba dispar
VNLISRFLLVFDISQSHVVECNG

SEQ ID NO: 2508755 - protein, 21 aa, Entamoeba dispar
VNLKISGFVPVEGRTEMIDIL

SEQ ID NO: 2508756 - protein, 17 aa, Entamoeba dispar
VNLLEINSSSFFNVFIQ

SEQ ID NO: 2508757 - protein, 21 aa, Entamoeba dispar
VNLPHIPRCSLLNSDGSFIFK

SEQ ID NO: 2508758 - protein, 23 aa, Entamoeba dispar
VNLSDIKLSIVYRDPSINIKECY

SEQ ID NO: 2508759 - protein, 20 aa, Entamoeba dispar
VNLTFSHQIFKIFYDEFKQL

SEQ ID NO: 2508760 - protein, 19 aa, Entamoeba dispar
VNLTINIPQILKIDYIQDS

SEQ ID NO: 2508761 - protein, 17 aa, Entamoeba dispar
VNLYCSFQTPANLHYVI

SEQ ID NO: 2508762 - protein, 19 aa, Entamoeba dispar
VNMHIWKSLNASFKIQVAT

SEQ ID NO: 2508763 - protein, 17 aa, Entamoeba dispar
VNMPMGIFMAKLDFIIA

SEQ ID NO: 2508764 - protein, 19 aa, Entamoeba dispar
VNMSGHIIAFIAGPCTAGP

SEQ ID NO: 2508765 - protein, 18 aa, Entamoeba dispar
VNNDSSLEWEDKFTNVTN

SEQ ID NO: 2508766 - protein, 20 aa, Entamoeba dispar
VNNIMKFKGLISDLSDDQKE

SEQ ID NO: 2508767 - protein, 24 aa, Entamoeba dispar
VNNKYPTFPFSLGMLENESKAKMG

SEQ ID NO: 2508768 - protein, 21 aa, Entamoeba dispar
VNNPLLWKSYGTFETFNCGKI

SEQ ID NO: 2508769 - protein, 25 aa, Entamoeba dispar
VNNQEMYKSVALQFLTRELPLFKKN

SEQ ID NO: 2508770 - protein, 17 aa, Entamoeba dispar
VNPEFIPYIPTLSKFLS

SEQ ID NO: 2508771 - protein, 19 aa, Entamoeba dispar
VNPIRSRYCGNVGDVVVGR

SEQ ID NO: 2508772 - protein, 25 aa, Entamoeba dispar
VNPIRSRYCGNVGYVVVGRIVSVGV

SEQ ID NO: 2508773 - protein, 17 aa, Entamoeba dispar
VNPLSFILTSNVNELIL

SEQ ID NO: 2508774 - protein, 31 aa, Entamoeba dispar
VNPQLRIPRTYKRFAGLMVQLLHKLSIHAAD

SEQ ID NO: 2508775 - protein, 22 aa, Entamoeba dispar
VNPSFWKKSFIDKLEGVYEVIP

SEQ ID NO: 2508776 - protein, 24 aa, Entamoeba dispar
VNPSLKFYACDIAPKAVDAVSADE

SEQ ID NO: 2508777 - protein, 25 aa, Entamoeba dispar
VNPTLPTYRFEAIVNLINADVAFID

SEQ ID NO: 2508778 - protein, 24 aa, Entamoeba dispar
VNPTWVPLCAELLKGTGVKVCTVI

SEQ ID NO: 2508779 - protein, 17 aa, Entamoeba dispar
VNPWFTSERDINKFCNI

SEQ ID NO: 2508780 - protein, 17 aa, Entamoeba dispar
VNQCVFNRGEIDRLTSG

SEQ ID NO: 2508781 - protein, 29 aa, Entamoeba dispar
VNQEIKEAIHLLMRLGYKDIKIIMKELYD

SEQ ID NO: 2508782 - protein, 17 aa, Entamoeba dispar
VNQPLLCSICNKPLIVV

SEQ ID NO: 2508783 - protein, 25 aa, Entamoeba dispar
VNQTESWCWFNGCMSLTAITITTRV

SEQ ID NO: 2508784 - protein, 32 aa, Entamoeba dispar
VNRKHHCRLCGRCVCSNCSKAKIPLNSKGEID

SEQ ID NO: 2508785 - protein, 22 aa, Entamoeba dispar
VNRKIRCLKIYKQWLTTSNSPI

SEQ ID NO: 2508786 - protein, 25 aa, Entamoeba dispar
VNRLPRKYLELALIELSSHSSLEPK

SEQ ID NO: 2508787 - protein, 17 aa, Entamoeba dispar
VNRYPALKKELPPTKPN

SEQ ID NO: 2508788 - protein, 27 aa, Entamoeba dispar
VNSCYILDCYSEMYMWVGTRVIKDRRQ

SEQ ID NO: 2508789 - protein, 25 aa, Entamoeba dispar
VNSEPTDVVYICFDNGQSAHQFIQK

SEQ ID NO: 2508790 - protein, 20 aa, Entamoeba dispar
VNSFVKRLYYVMKEPSYLDW

SEQ ID NO: 2508791 - protein, 28 aa, Entamoeba dispar
VNSSRYFVKEGFLTKQCRKTPKPRYFIL

SEQ ID NO: 2508792 - protein, 29 aa, Entamoeba dispar
VNSWKLCPIRCVMCSNVSIPTHELSKLPF

SEQ ID NO: 2508793 - protein, 17 aa, Entamoeba dispar
VNSYLASLLQKEKSVTI

SEQ ID NO: 2508794 - protein, 24 aa, Entamoeba dispar
VNSYPKMYIIHGFFNGQCFDRKYE

SEQ ID NO: 2508795 - protein, 18 aa, Entamoeba dispar
VNTDIVFPKLENFKCPVE

SEQ ID NO: 2508796 - protein, 21 aa, Entamoeba dispar
VNTFILKSFISFHTLSPYYKT

SEQ ID NO: 2508797 - protein, 18 aa, Entamoeba dispar
VNTMLSGLHDLQLVDPDR

SEQ ID NO: 2508798 - protein, 19 aa, Entamoeba dispar
VNVHQGGSYQSCYCSTWNP

SEQ ID NO: 2508799 - protein, 21 aa, Entamoeba dispar
VNVIAEFKFLLEVFQMEENGP

SEQ ID NO: 2508800 - protein, 21 aa, Entamoeba dispar
VNVLINIIFNRYIGSTIATSK

SEQ ID NO: 2508801 - protein, 30 aa, Entamoeba dispar
VNVLQYFIDKLNCYYLNTSHIQNLREISTI

SEQ ID NO: 2508802 - protein, 18 aa, Entamoeba dispar
VNVNPYFNTTIELTKSVN

SEQ ID NO: 2508803 - protein, 24 aa, Entamoeba dispar
VNYALKANELFKFEGNDNYSVKMI

SEQ ID NO: 2508804 - protein, 19 aa, Entamoeba dispar
VNYHFERKTFAAIIPEQSK

SEQ ID NO: 2508805 - protein, 21 aa, Entamoeba dispar
VNYKEVMKDYGLGPNGAIVTS

SEQ ID NO: 2508806 - protein, 32 aa, Entamoeba dispar
VNYLGWKINLAICYDLRFPNWLRNSKEDPYDI

SEQ ID NO: 2508807 - protein, 24 aa, Entamoeba dispar
VNYYISCVIFYITHIRNSKRIRSL

SEQ ID NO: 2508808 - protein, 18 aa, Entamoeba dispar
VPAAKYHLAEGFHKTGVI

SEQ ID NO: 2508809 - protein, 21 aa, Entamoeba dispar
VPAEYRFNDFISNFEEFKNYK

SEQ ID NO: 2508810 - protein, 20 aa, Entamoeba dispar
VPAFRECLEQLVTLQNDTEL

SEQ ID NO: 2508811 - protein, 20 aa, Entamoeba dispar
VPAQPALYLLMKTFSVCVPR

SEQ ID NO: 2508812 - protein, 19 aa, Entamoeba dispar
VPATITKLGNWCFNSCSSL

SEQ ID NO: 2508813 - protein, 23 aa, Entamoeba dispar
VPCCSVPVRLPSVGFDNLEVQGN

SEQ ID NO: 2508814 - protein, 23 aa, Entamoeba dispar
VPCFYRIETLDLFVRVLNQKTKY

SEQ ID NO: 2508815 - protein, 19 aa, Entamoeba dispar
VPCQFAMSLTGGYYILIEP

SEQ ID NO: 2508816 - protein, 29 aa, Entamoeba dispar
VPDGILCFFPSYSYMNICISYWDEMKIIE

SEQ ID NO: 2508817 - protein, 29 aa, Entamoeba dispar
VPDGVLCFFPSYAYMNICISYWNEMKIFE

SEQ ID NO: 2508818 - protein, 23 aa, Entamoeba dispar
VPDLYINHFLLFYTFIGDKFIYS

SEQ ID NO: 2508819 - protein, 19 aa, Entamoeba dispar
VPEDAKYWQNFKHNSEKKK

SEQ ID NO: 2508820 - protein, 19 aa, Entamoeba dispar
VPEEVGFDIEIKYWNCPEE

SEQ ID NO: 2508821 - protein, 19 aa, Entamoeba dispar
VPELVEFIHQLVNKYPGQK

SEQ ID NO: 2508822 - protein, 26 aa, Entamoeba dispar
VPENKRMEASILLDEFNKFNENEHIL

SEQ ID NO: 2508823 - protein, 21 aa, Entamoeba dispar
VPEVMLHLRSLGLLHEDVMTV

SEQ ID NO: 2508824 - protein, 18 aa, Entamoeba dispar
VPFFEAGKNLKNRRLLLY

SEQ ID NO: 2508825 - protein, 25 aa, Entamoeba dispar
VPFGFDVFLDFGVKLDLGLTGTAIV

SEQ ID NO: 2508826 - protein, 23 aa, Entamoeba dispar
VPFKSSLKFTKIVAENCKVLDSL

SEQ ID NO: 2508827 - protein, 24 aa, Entamoeba dispar
VPFLEFILSTALNFSPETFQNGLN

SEQ ID NO: 2508828 - protein, 22 aa, Entamoeba dispar
VPFLFQRIVTSYSLVLLSTHNH

SEQ ID NO: 2508829 - protein, 24 aa, Entamoeba dispar
VPFRELKFGGTIKRNTATLVPTVK

SEQ ID NO: 2508830 - protein, 19 aa, Entamoeba dispar
VPFVINLFMGNTCENCKFA

SEQ ID NO: 2508831 - protein, 24 aa, Entamoeba dispar
VPGDGYLKYYLYNWACPKVEPNKL

SEQ ID NO: 2508832 - protein, 18 aa, Entamoeba dispar
VPHFTRYSVIDEDNNTQE

SEQ ID NO: 2508833 - protein, 22 aa, Entamoeba dispar
VPHPFWLPKFQNGISYSLPIFC

SEQ ID NO: 2508834 - protein, 23 aa, Entamoeba dispar
VPHRSAAIPQVFLERLNTGRIQT

SEQ ID NO: 2508835 - protein, 24 aa, Entamoeba dispar
VPIEEPKELHCCCHSIEESKLSVP

SEQ ID NO: 2508836 - protein, 23 aa, Entamoeba dispar
VPIEGFEPIPVRFILSKENPYNF

SEQ ID NO: 2508837 - protein, 18 aa, Entamoeba dispar
VPIELFKYYINEHCFIPF

SEQ ID NO: 2508838 - protein, 18 aa, Entamoeba dispar
VPIELGQFFMAINIESFR

SEQ ID NO: 2508839 - protein, 26 aa, Entamoeba dispar
VPIISIFLKDVISFKEMESFLNGNIN

SEQ ID NO: 2508840 - protein, 21 aa, Entamoeba dispar
VPIKGSELLKNEKGKLKIYLY

SEQ ID NO: 2508841 - protein, 30 aa, Entamoeba dispar
VPINLMDRIKYKLEIPVMWNEDSNTHEDEI

SEQ ID NO: 2508842 - protein, 19 aa, Entamoeba dispar
VPINYAFDGIQNLYFHGGN

SEQ ID NO: 2508843 - protein, 20 aa, Entamoeba dispar
VPIRLKVMGLLRMWIQNRKA

SEQ ID NO: 2508844 - protein, 17 aa, Entamoeba dispar
VPKHRLIPQKTKGVPEI

SEQ ID NO: 2508845 - protein, 17 aa, Entamoeba dispar
VPKIPIFSPTLFKFIPK

SEQ ID NO: 2508846 - protein, 20 aa, Entamoeba dispar
VPKKAIEAMLRKEAKAKKHS

SEQ ID NO: 2508847 - protein, 25 aa, Entamoeba dispar
VPKSNRFVAPFSFKRLIETTKKGLT

SEQ ID NO: 2508848 - protein, 28 aa, Entamoeba dispar
VPKVGPCLDCIISLFPPQKTFPMCTIAS

SEQ ID NO: 2508849 - protein, 27 aa, Entamoeba dispar
VPLEFTKELLLAHAYHAIELFRKAKMT

SEQ ID NO: 2508850 - protein, 21 aa, Entamoeba dispar
VPLESLLCIECNKVSTLTIGT

SEQ ID NO: 2508851 - protein, 20 aa, Entamoeba dispar
VPLKEAEEICIVSMKDYIFE

SEQ ID NO: 2508852 - protein, 20 aa, Entamoeba dispar
VPLKEAEEIYIVSMKDYIFE

SEQ ID NO: 2508853 - protein, 27 aa, Entamoeba dispar
VPLKLRRLGELESMFPDIDSGLLEMLL

SEQ ID NO: 2508854 - protein, 19 aa, Entamoeba dispar
VPLKRVFQRYNPKDNMSST

SEQ ID NO: 2508855 - protein, 25 aa, Entamoeba dispar
VPLYPADCFYLKVIKLEQCRNIFLQ

SEQ ID NO: 2508856 - protein, 22 aa, Entamoeba dispar
VPNVRIHLCHAIYLISSKYPNF

SEQ ID NO: 2508857 - protein, 25 aa, Entamoeba dispar
VPNWVRRYGHKIGYSALKQFNEKNN

SEQ ID NO: 2508858 - protein, 19 aa, Entamoeba dispar
VPPCSTELFSGLRNDKFVA

SEQ ID NO: 2508859 - protein, 17 aa, Entamoeba dispar
VPPEGIELFAVGRKKHL

SEQ ID NO: 2508860 - protein, 21 aa, Entamoeba dispar
VPPLIDMSFFSAGLKPQRYQN

SEQ ID NO: 2508861 - protein, 23 aa, Entamoeba dispar
VPQACIPLRIQIINKMKAYHNKF

SEQ ID NO: 2508862 - protein, 21 aa, Entamoeba dispar
VPQCLIKKAKGLEHINGVEAI

SEQ ID NO: 2508863 - protein, 21 aa, Entamoeba dispar
VPQGKGTLVMLKKPYEKEQFT

SEQ ID NO: 2508864 - protein, 19 aa, Entamoeba dispar
VPQIFCKEVALNVFPSFMK

SEQ ID NO: 2508865 - protein, 18 aa, Entamoeba dispar
VPQSMCRRIMSDGCCVLT

SEQ ID NO: 2508866 - protein, 24 aa, Entamoeba dispar
VPQSSRSPSSFNFYSKKFIPTTKR

SEQ ID NO: 2508867 - protein, 18 aa, Entamoeba dispar
VPREAEWGFVATNNVSTK

SEQ ID NO: 2508868 - protein, 23 aa, Entamoeba dispar
VPRLYLMCTIGSICIAKKEVQIT

SEQ ID NO: 2508869 - protein, 17 aa, Entamoeba dispar
VPSENDYSISLRIQLGD

SEQ ID NO: 2508870 - protein, 28 aa, Entamoeba dispar
VPSHRSANFKNVFSLQTFNTCGGFSGIY

SEQ ID NO: 2508871 - protein, 18 aa, Entamoeba dispar
VPSPEHMELPIVQSDSVR

SEQ ID NO: 2508872 - protein, 20 aa, Entamoeba dispar
VPSRSRKQCRERFLNNLSNT

SEQ ID NO: 2508873 - protein, 25 aa, Entamoeba dispar
VPSTIMIKECIEFLIEKEYMKRKDD

SEQ ID NO: 2508874 - protein, 23 aa, Entamoeba dispar
VPSVCKQLRTRGYGIYIESGAGL

SEQ ID NO: 2508875 - protein, 24 aa, Entamoeba dispar
VPTGCASIAYTLFTKHMKFDVKDP

SEQ ID NO: 2508876 - protein, 18 aa, Entamoeba dispar
VPTLAAIVPYFTKQTLSK

SEQ ID NO: 2508877 - protein, 22 aa, Entamoeba dispar
VPVEICIKPTLLNGTINIECFQ

SEQ ID NO: 2508878 - protein, 17 aa, Entamoeba dispar
VPVENRITLSIAPLYTT

SEQ ID NO: 2508879 - protein, 19 aa, Entamoeba dispar
VPVHIGIDLGTTYSSIAIY

SEQ ID NO: 2508880 - protein, 17 aa, Entamoeba dispar
VPVNFTLLIICDEDCGF

SEQ ID NO: 2508881 - protein, 18 aa, Entamoeba dispar
VQALPMLGFNCNKRSIDV

SEQ ID NO: 2508882 - protein, 25 aa, Entamoeba dispar
VQCETEFYPIMKYVFGNVLIADDAE

SEQ ID NO: 2508883 - protein, 19 aa, Entamoeba dispar
VQCGLWELSAPNFISMCSE

SEQ ID NO: 2508884 - protein, 24 aa, Entamoeba dispar
VQCNLQHVCFSKFIAPGLKQLTID

SEQ ID NO: 2508885 - protein, 18 aa, Entamoeba dispar
VQCNMCSLYCPHAAIRCF

SEQ ID NO: 2508886 - protein, 20 aa, Entamoeba dispar
VQDICLLSNTLLNALGYTRM

SEQ ID NO: 2508887 - protein, 26 aa, Entamoeba dispar
VQELAKLRGLMFYEEIKARRQNKIKS

SEQ ID NO: 2508888 - protein, 19 aa, Entamoeba dispar
VQEVCYLRQIAYKIVSEEK

SEQ ID NO: 2508889 - protein, 34 aa, Entamoeba dispar
VQEYSRSCIRHNFLYGKERLMASILEGKSKSEEW

SEQ ID NO: 2508890 - protein, 23 aa, Entamoeba dispar
VQEYWECTLKALKFGENQGPQII

SEQ ID NO: 2508891 - protein, 25 aa, Entamoeba dispar
VQFQFRVCDLLESFCKAECNNKEFI

SEQ ID NO: 2508892 - protein, 20 aa, Entamoeba dispar
VQFYRYGVRPYVPYDSYYKK

SEQ ID NO: 2508893 - protein, 22 aa, Entamoeba dispar
VQGPYEGYGMPIGTTGKRGDLY

SEQ ID NO: 2508894 - protein, 27 aa, Entamoeba dispar
VQGVIYIWNFINEFKKEIEIEDSSFKS

SEQ ID NO: 2508895 - protein, 18 aa, Entamoeba dispar
VQIFPSQLLFKYPKETII

SEQ ID NO: 2508896 - protein, 19 aa, Entamoeba dispar
VQINPHKLLGCVGQHDFPI

SEQ ID NO: 2508897 - protein, 22 aa, Entamoeba dispar
VQIPDYYLSNIVQIPDYYHNVS

SEQ ID NO: 2508898 - protein, 18 aa, Entamoeba dispar
VQIQPIYTIKNGKIIIAD

SEQ ID NO: 2508899 - protein, 26 aa, Entamoeba dispar
VQKKRLDLVLLLLKFGARIYIANNAG

SEQ ID NO: 2508900 - protein, 17 aa, Entamoeba dispar
VQKKSTRGYGYDLADNF

SEQ ID NO: 2508901 - protein, 26 aa, Entamoeba dispar
VQKNARTVCFEWLDHFYEVLSNNAMK

SEQ ID NO: 2508902 - protein, 23 aa, Entamoeba dispar
VQLAGCSQGAMVMAVKKSKTLTD

SEQ ID NO: 2508903 - protein, 17 aa, Entamoeba dispar
VQLCIEPSELILNQCKE

SEQ ID NO: 2508904 - protein, 17 aa, Entamoeba dispar
VQLCQLVAMNLSILSNL

SEQ ID NO: 2508905 - protein, 19 aa, Entamoeba dispar
VQLFKRCKRVAVNAEDIEQ

SEQ ID NO: 2508906 - protein, 18 aa, Entamoeba dispar
VQLFPRLSTIKISNFSSF

SEQ ID NO: 2508907 - protein, 23 aa, Entamoeba dispar
VQLQSLPLGMLWINCMRNEMQSY

SEQ ID NO: 2508908 - protein, 19 aa, Entamoeba dispar
VQLRVKGCQQRINVLQKNL

SEQ ID NO: 2508909 - protein, 23 aa, Entamoeba dispar
VQLVGVACLHLCIKFQEIKYSNV

SEQ ID NO: 2508910 - protein, 17 aa, Entamoeba dispar
VQLWDTAGQEKFRNITT

SEQ ID NO: 2508911 - protein, 23 aa, Entamoeba dispar
VQMCSSVQKWSYDIVDEIISGTK

SEQ ID NO: 2508912 - protein, 17 aa, Entamoeba dispar
VQNDCINYVLTQVMKLS

SEQ ID NO: 2508913 - protein, 20 aa, Entamoeba dispar
VQNIKRGVVYGAYQSSSPIL

SEQ ID NO: 2508914 - protein, 28 aa, Entamoeba dispar
VQNQIPWEMNWKGFKVIRRKEFIQNEQK

SEQ ID NO: 2508915 - protein, 22 aa, Entamoeba dispar
VQPGSPFFLSFDEYDEIDKGFA

SEQ ID NO: 2508916 - protein, 20 aa, Entamoeba dispar
VQPLNELFESMIHKINNFNK

SEQ ID NO: 2508917 - protein, 25 aa, Entamoeba dispar
VQPNALCSYGVFILLTPKTKFIWKG

SEQ ID NO: 2508918 - protein, 26 aa, Entamoeba dispar
VQQSDGGWFSSWWKTDKDEVNMIKKV

SEQ ID NO: 2508919 - protein, 25 aa, Entamoeba dispar
VQRGEWKVPLPIYRAIQYLLEGDNL

SEQ ID NO: 2508920 - protein, 23 aa, Entamoeba dispar
VQRIMRYPMLIKEVIKQTPHSHP

SEQ ID NO: 2508921 - protein, 27 aa, Entamoeba dispar
VQRIPRYRLLLQELLKTLPPQHSEYSS

SEQ ID NO: 2508922 - protein, 19 aa, Entamoeba dispar
VQRLMRYPLLLKEIIKNTG

SEQ ID NO: 2508923 - protein, 23 aa, Entamoeba dispar
VQRLPRYKLLLEDLIRNTPEGHC

SEQ ID NO: 2508924 - protein, 26 aa, Entamoeba dispar
VQRLPRYKLLLTDLLRHYNWEHPDYY

SEQ ID NO: 2508925 - protein, 25 aa, Entamoeba dispar
VQSIITPNCRLFFSSKTVLLEYYNI

SEQ ID NO: 2508926 - protein, 23 aa, Entamoeba dispar
VQSKWMGEQICKRGIEEGYKINV

SEQ ID NO: 2508927 - protein, 24 aa, Entamoeba dispar
VQSPDWRIRKSIAKQLGLLAQSTP

SEQ ID NO: 2508928 - protein, 26 aa, Entamoeba dispar
VQSRNEFWCVFKGTNYEFSRYGTLCI

SEQ ID NO: 2508929 - protein, 17 aa, Entamoeba dispar
VQSRWSVLNEEYRISKR

SEQ ID NO: 2508930 - protein, 17 aa, Entamoeba dispar
VQSSFPFLVFLLQSPNN

SEQ ID NO: 2508931 - protein, 17 aa, Entamoeba dispar
VQSTIGMLEECRVFERF

SEQ ID NO: 2508932 - protein, 18 aa, Entamoeba dispar
VQSVMRRIYIPQFKENQL

SEQ ID NO: 2508933 - protein, 25 aa, Entamoeba dispar
VQSWRYCLYYGWLLINSPTTLSFAF

SEQ ID NO: 2508934 - protein, 18 aa, Entamoeba dispar
VQVFLIKRLNLMSKSVLK

SEQ ID NO: 2508935 - protein, 18 aa, Entamoeba dispar
VQWCIDYYNLNKELMSEE

SEQ ID NO: 2508936 - protein, 18 aa, Entamoeba dispar
VQYHLGGHGWHIEGNEKI

SEQ ID NO: 2508937 - protein, 28 aa, Entamoeba dispar
VQYLIRYVYRQNIQFARNAVWALTTAIL

SEQ ID NO: 2508938 - protein, 29 aa, Entamoeba dispar
VRAESLRPVLGFDLLEYLSKLPIEESEEK

SEQ ID NO: 2508939 - protein, 21 aa, Entamoeba dispar
VRCALGVQLCGIDFIKENEQG

SEQ ID NO: 2508940 - protein, 22 aa, Entamoeba dispar
VRCHKCVQKKILRAFLINEHNL

SEQ ID NO: 2508941 - protein, 17 aa, Entamoeba dispar
VRCSQILTYLCDIRDAT

SEQ ID NO: 2508942 - protein, 17 aa, Entamoeba dispar
VRCVEVWDKENMVSASF

SEQ ID NO: 2508943 - protein, 22 aa, Entamoeba dispar
VRCWYCGLADKKKLIRCGCGKY

SEQ ID NO: 2508944 - protein, 21 aa, Entamoeba dispar
VRCYPGFQATMIYRVAHVLYE

SEQ ID NO: 2508945 - protein, 23 aa, Entamoeba dispar
VRDEDLPKIGVRVEDDGKTAWKL

SEQ ID NO: 2508946 - protein, 19 aa, Entamoeba dispar
VRDFTFLRVIKIVLPSCSF

SEQ ID NO: 2508947 - protein, 29 aa, Entamoeba dispar
VRDVSFKFRLSVLDHPNFFIDPNNDSNLV

SEQ ID NO: 2508948 - protein, 27 aa, Entamoeba dispar
VREAAFSFVIDCFFKYGEQEQLTDMFI

SEQ ID NO: 2508949 - protein, 18 aa, Entamoeba dispar
VREEELVIAPGFLPQKQE

SEQ ID NO: 2508950 - protein, 17 aa, Entamoeba dispar
VRENICFLEKFNREKYN

SEQ ID NO: 2508951 - protein, 20 aa, Entamoeba dispar
VREQKLNISKSIREITRESK

SEQ ID NO: 2508952 - protein, 18 aa, Entamoeba dispar
VRFDPKVEMNFNIELNIK

SEQ ID NO: 2508953 - protein, 17 aa, Entamoeba dispar
VRFGPRDNQLVSLDKIK

SEQ ID NO: 2508954 - protein, 18 aa, Entamoeba dispar
VRGEWEMFVAVVDKEKTK

SEQ ID NO: 2508955 - protein, 20 aa, Entamoeba dispar
VRGIKLGLHFPKSHKNVSKF

SEQ ID NO: 2508956 - protein, 24 aa, Entamoeba dispar
VRGIPIRCGSIWKKVERLDEVMEI

SEQ ID NO: 2508957 - protein, 25 aa, Entamoeba dispar
VRGKGNMVFLFLRKGIYTCQALVMK

SEQ ID NO: 2508958 - protein, 21 aa, Entamoeba dispar
VRGLAIRCMSNFEVDTVREHL

SEQ ID NO: 2508959 - protein, 17 aa, Entamoeba dispar
VRGLDYYTGVIFEAVMV

SEQ ID NO: 2508960 - protein, 20 aa, Entamoeba dispar
  misc_feature (18)..(19): Xaa can be any naturally occurring amino acid
VRGNLFYPRSLELSDYDXXK

SEQ ID NO: 2508961 - protein, 20 aa, Entamoeba dispar
VRHCGLPKDIVHSILKGLAD

SEQ ID NO: 2508962 - protein, 18 aa, Entamoeba dispar
VRHNDCDRFQDQVNNSKG

SEQ ID NO: 2508963 - protein, 17 aa, Entamoeba dispar
VRIEKSRVSDSEIIQNS

SEQ ID NO: 2508964 - protein, 19 aa, Entamoeba dispar
VRIGANCWINSDVGDNQIV

SEQ ID NO: 2508965 - protein, 25 aa, Entamoeba dispar
VRIHACGVWGELCSVYCNEIKQVLP

SEQ ID NO: 2508966 - protein, 26 aa, Entamoeba dispar
VRILDLILMEGWEIVFSIFSAILHYS

SEQ ID NO: 2508967 - protein, 19 aa, Entamoeba dispar
VRIPPGKIVSRIVITALLP

SEQ ID NO: 2508968 - protein, 17 aa, Entamoeba dispar
VRISICVKKADNLEVIL

SEQ ID NO: 2508969 - protein, 18 aa, Entamoeba dispar
VRISICVKKADNLEVILL

SEQ ID NO: 2508970 - protein, 25 aa, Entamoeba dispar
VRKAPRQCSYGVLSHIIIPPDYVEE

SEQ ID NO: 2508971 - protein, 26 aa, Entamoeba dispar
VRKIFKRLFRVYAHMFYNHMEHLEQL

SEQ ID NO: 2508972 - protein, 21 aa, Entamoeba dispar
VRKILRKCAKFNRKGNDSGGS

SEQ ID NO: 2508973 - protein, 37 aa, Entamoeba dispar
VRKILSKYCNYIFTKRVDFSFQLLKNIIKLCSSENDR

SEQ ID NO: 2508974 - protein, 24 aa, Entamoeba dispar
VRKNRYIILPADFEKAYKKVVRKQ

SEQ ID NO: 2508975 - protein, 25 aa, Entamoeba dispar
VRKVKRISDGTLWAMKKINISKARA

SEQ ID NO: 2508976 - protein, 28 aa, Entamoeba dispar
VRKYCSFLEFVGKIAGSPIIQLQQILFW

SEQ ID NO: 2508977 - protein, 18 aa, Entamoeba dispar
VRLDRFVKPESIGFTSVS

SEQ ID NO: 2508978 - protein, 20 aa, Entamoeba dispar
VRLFSGELFGSYYSKTVPCR

SEQ ID NO: 2508979 - protein, 25 aa, Entamoeba dispar
VRLGDMWKESLIELSGGQKSLLALS

SEQ ID NO: 2508980 - protein, 18 aa, Entamoeba dispar
VRLIRKLLEGLIVSVTNV

SEQ ID NO: 2508981 - protein, 17 aa, Entamoeba dispar
VRLIYQRIIEGMPLLDC

SEQ ID NO: 2508982 - protein, 23 aa, Entamoeba dispar
VRLKSIRELENFPSYQTAVQMFL

SEQ ID NO: 2508983 - protein, 18 aa, Entamoeba dispar
VRLWKYNDTRVWEVCCLR

SEQ ID NO: 2508984 - protein, 25 aa, Entamoeba dispar
VRLYFKDIKGVLLVFQIDRQESFDH

SEQ ID NO: 2508985 - protein, 19 aa, Entamoeba dispar
VRMGNTIVEAVVFGPLEGR

SEQ ID NO: 2508986 - protein, 17 aa, Entamoeba dispar
VRMLFILAPHSHLLFKI

SEQ ID NO: 2508987 - protein, 27 aa, Entamoeba dispar
VRMRCTPGIKPNESIKVYVTISNNTGK

SEQ ID NO: 2508988 - protein, 17 aa, Entamoeba dispar
VRMRDIWDDPSVNDLVV

SEQ ID NO: 2508989 - protein, 19 aa, Entamoeba dispar
VRNGLTFLDIIILQLKALS

SEQ ID NO: 2508990 - protein, 19 aa, Entamoeba dispar
VRPKTGHCFVDFKDDTSMR

SEQ ID NO: 2508991 - protein, 25 aa, Entamoeba dispar
VRPPIPVKKCLVSPIAQNLINLSFT

SEQ ID NO: 2508992 - protein, 17 aa, Entamoeba dispar
VRPYVPYDRYYKNDEEE

SEQ ID NO: 2508993 - protein, 17 aa, Entamoeba dispar
VRPYVPYDRYYKNEEEE

SEQ ID NO: 2508994 - protein, 17 aa, Entamoeba dispar
VRQAFHHFILYKFLFTR

SEQ ID NO: 2508995 - protein, 18 aa, Entamoeba dispar
VRQDFSLSDTEDVVQCYK

SEQ ID NO: 2508996 - protein, 27 aa, Entamoeba dispar
VRQEIDLRTGAAFTRFQTTLLKNKSKA

SEQ ID NO: 2508997 - protein, 24 aa, Entamoeba dispar
VRRDNCLLVKYVIENVLNKILLDS

SEQ ID NO: 2508998 - protein, 21 aa, Entamoeba dispar
VRRIREMYGMTEIRKNMNRMK

SEQ ID NO: 2508999 - protein, 30 aa, Entamoeba dispar
VRRKHHCRFCGSCICSDCSRNKVKNGNSYE

SEQ ID NO: 2509000 - protein, 26 aa, Entamoeba dispar
VRRRHHCRACGRCICGECSKWKMPIP

SEQ ID NO: 2509001 - protein, 22 aa, Entamoeba dispar
VRRTACGIWECKGCGKQIAGGA

SEQ ID NO: 2509002 - protein, 18 aa, Entamoeba dispar
VRSELGAYFVKNNDRPTL

SEQ ID NO: 2509003 - protein, 17 aa, Entamoeba dispar
VRSRSYSDIEVKENVEQ

SEQ ID NO: 2509004 - protein, 24 aa, Entamoeba dispar
VRSSQIKPSIGFLSDIRRMNVALT

SEQ ID NO: 2509005 - protein, 19 aa, Entamoeba dispar
VRTAPFFTLQEKLFIAYQL

SEQ ID NO: 2509006 - protein, 29 aa, Entamoeba dispar
VRTLEMWTCTEGFHLKKEFDSLKTVFNEN

SEQ ID NO: 2509007 - protein, 21 aa, Entamoeba dispar
VRTLQAATHFKYVTGPSPITG

SEQ ID NO: 2509008 - protein, 22 aa, Entamoeba dispar
VRTLQSWLKEIQRYCDPDVDVG

SEQ ID NO: 2509009 - protein, 24 aa, Entamoeba dispar
VRVIDFGSACFSTYTLYTYIQSRH

SEQ ID NO: 2509010 - protein, 21 aa, Entamoeba dispar
VRVKLPLSIKSLYLYCSSITI

SEQ ID NO: 2509011 - protein, 18 aa, Entamoeba dispar
VRVLIGICKKYFEHLKLP

SEQ ID NO: 2509012 - protein, 24 aa, Entamoeba dispar
VRVRPCFKTEVAERCCSVDEEKES

SEQ ID NO: 2509013 - protein, 17 aa, Entamoeba dispar
VRYARKRCKPVLTDEAR

SEQ ID NO: 2509014 - protein, 20 aa, Entamoeba dispar
VRYGEMEIVKSFIEQDHDIL

SEQ ID NO: 2509015 - protein, 24 aa, Entamoeba dispar
VRYKLVKRRGGKRGGRGRPAAAVR

SEQ ID NO: 2509016 - protein, 31 aa, Entamoeba dispar
VRYTAARKFLFPNSYNFISFMMFKENPCTVQ

SEQ ID NO: 2509017 - protein, 18 aa, Entamoeba dispar
VSAIPFHPFNFVVTENKR

SEQ ID NO: 2509018 - protein, 21 aa, Entamoeba dispar
VSAKLLKALEIPACCYDDFLV

SEQ ID NO: 2509019 - protein, 18 aa, Entamoeba dispar
VSALGYNYHPQCFVANVT

SEQ ID NO: 2509020 - protein, 20 aa, Entamoeba dispar
VSALPQRTSVDFKVSNTNLF

SEQ ID NO: 2509021 - protein, 20 aa, Entamoeba dispar
VSALSVSWCKTNSFTRHIFL

SEQ ID NO: 2509022 - protein, 19 aa, Entamoeba dispar
VSCKHFFNGTAMQRIPQGN

SEQ ID NO: 2509023 - protein, 20 aa, Entamoeba dispar
VSCVHYLFEKYLFIKYKTNN

SEQ ID NO: 2509024 - protein, 24 aa, Entamoeba dispar
VSDCGGRIGPFIDHLYPDLRNANI

SEQ ID NO: 2509025 - protein, 22 aa, Entamoeba dispar
VSDLNPTPAISRFEVISNIIKK

SEQ ID NO: 2509026 - protein, 24 aa, Entamoeba dispar
VSDPSFIPQYDWFLSSVCNNLNII

SEQ ID NO: 2509027 - protein, 27 aa, Entamoeba dispar
VSDRMMYKLGYVDRVMDVLKRRSNEVE

SEQ ID NO: 2509028 - protein, 24 aa, Entamoeba dispar
VSDRMVYKLGYVERIMEILKRRRN

SEQ ID NO: 2509029 - protein, 23 aa, Entamoeba dispar
VSDYKDWCLYWLGLSEQKPPIVG

SEQ ID NO: 2509030 - protein, 19 aa, Entamoeba dispar
VSECILMIDDAMVNLKENV

SEQ ID NO: 2509031 - protein, 24 aa, Entamoeba dispar
VSEDCNICIWNIPEECPAGNIHEA

SEQ ID NO: 2509032 - protein, 21 aa, Entamoeba dispar
VSEGKLLLKEPFNVSFETLLS

SEQ ID NO: 2509033 - protein, 21 aa, Entamoeba dispar
VSEHKGTVLSLDYSPFNNDLI

SEQ ID NO: 2509034 - protein, 23 aa, Entamoeba dispar
VSEIDIIFDFARAYVVLDEVINA

SEQ ID NO: 2509035 - protein, 24 aa, Entamoeba dispar
VSEIGKKCFRYCSSLKSIDIPTSV

SEQ ID NO: 2509036 - protein, 24 aa, Entamoeba dispar
VSEKFKFGVLYGTMGQLTENEFYN

SEQ ID NO: 2509037 - protein, 24 aa, Entamoeba dispar
VSELRGWCFKNCKLLTSIEIPLTI

SEQ ID NO: 2509038 - protein, 23 aa, Entamoeba dispar
VSELWKQQLETFLKEKKEEMIEI

SEQ ID NO: 2509039 - protein, 24 aa, Entamoeba dispar
VSEMFKKWAIERNAFIDKFDSTRK

SEQ ID NO: 2509040 - protein, 24 aa, Entamoeba dispar
VSEMGCGCFCRCSSLTSIQLSEIN

SEQ ID NO: 2509041 - protein, 19 aa, Entamoeba dispar
VSEMGNYCFGYCTRLSSID

SEQ ID NO: 2509042 - protein, 17 aa, Entamoeba dispar
VSEMSYRYNELVSTVRI

SEQ ID NO: 2509043 - protein, 26 aa, Entamoeba dispar
VSENLFIKKKYHLIPTLSPSNVIDWV

SEQ ID NO: 2509044 - protein, 19 aa, Entamoeba dispar
VSFCLKAGTFANELIVSYV

SEQ ID NO: 2509045 - protein, 17 aa, Entamoeba dispar
VSFFNKLFHNIIILNCD

SEQ ID NO: 2509046 - protein, 20 aa, Entamoeba dispar
VSFHPCIRIGKWEQQKVLSF

SEQ ID NO: 2509047 - protein, 18 aa, Entamoeba dispar
VSFIKINGDEILKYLEGV

SEQ ID NO: 2509048 - protein, 19 aa, Entamoeba dispar
VSFIPLKLFIETPRTSSLR

SEQ ID NO: 2509049 - protein, 27 aa, Entamoeba dispar
VSFNLKCMGELPGPYIKYFVQSIGPAG

SEQ ID NO: 2509050 - protein, 19 aa, Entamoeba dispar
VSFNLPRKEGNSIYQEDLY

SEQ ID NO: 2509051 - protein, 19 aa, Entamoeba dispar
VSFVFGVKELNQFLDDNNL

SEQ ID NO: 2509052 - protein, 23 aa, Entamoeba dispar
VSGAAKFRGLWKSYYPNVKCIAF

SEQ ID NO: 2509053 - protein, 17 aa, Entamoeba dispar
VSGCGKSTSIQLIERFY

SEQ ID NO: 2509054 - protein, 21 aa, Entamoeba dispar
VSGCPLKILRMAGGKKESQKL

SEQ ID NO: 2509055 - protein, 17 aa, Entamoeba dispar
VSGDWWVKVLGNGEGGN

SEQ ID NO: 2509056 - protein, 17 aa, Entamoeba dispar
VSGDYPVYVQAFSGNTY

SEQ ID NO: 2509057 - protein, 23 aa, Entamoeba dispar
VSGENHKPFCIIVMDENGLWKSF

SEQ ID NO: 2509058 - protein, 18 aa, Entamoeba dispar
VSGGICLHDSKRLIGETV

SEQ ID NO: 2509059 - protein, 18 aa, Entamoeba dispar
VSGGIPLQYQPVRRDTKV

SEQ ID NO: 2509060 - protein, 23 aa, Entamoeba dispar
VSGIERENWFVALGITKFDLIHA

SEQ ID NO: 2509061 - protein, 19 aa, Entamoeba dispar
VSGLLRYESTLRWTAKDAI

SEQ ID NO: 2509062 - protein, 21 aa, Entamoeba dispar
VSGPLEVLINWAVTPENLESN

SEQ ID NO: 2509063 - protein, 19 aa, Entamoeba dispar
VSGVLRVNGKITITRSIGD

SEQ ID NO: 2509064 - protein, 25 aa, Entamoeba dispar
VSHPFWLPKFANAFYYTLPLLIQQM

SEQ ID NO: 2509065 - protein, 26 aa, Entamoeba dispar
VSIAEKSGSIFIPRGISVASLDHQRE

SEQ ID NO: 2509066 - protein, 20 aa, Entamoeba dispar
VSIEFKYAKSYYNLTDVVLG

SEQ ID NO: 2509067 - protein, 17 aa, Entamoeba dispar
VSIENALEYGIKHFAVN

SEQ ID NO: 2509068 - protein, 19 aa, Entamoeba dispar
VSIFDIYSLIQQFKIKDIL

SEQ ID NO: 2509069 - protein, 22 aa, Entamoeba dispar
VSIFIQAAYDWILQGDKETDSG

SEQ ID NO: 2509070 - protein, 17 aa, Entamoeba dispar
VSIFNGHFIFYDKNNKG

SEQ ID NO: 2509071 - protein, 17 aa, Entamoeba dispar
VSILGNSCFEWCSLLNT

SEQ ID NO: 2509072 - protein, 26 aa, Entamoeba dispar
VSILRKYCFCWCRSLKTINIPTSVSV

SEQ ID NO: 2509073 - protein, 18 aa, Entamoeba dispar
VSILSSVITSFAFSIQQE

SEQ ID NO: 2509074 - protein, 28 aa, Entamoeba dispar
VSILVMFPLWEWNRLLVHSIEIPSNINS

SEQ ID NO: 2509075 - protein, 22 aa, Entamoeba dispar
VSIPIERACYYLKRVNPEGPLL

SEQ ID NO: 2509076 - protein, 22 aa, Entamoeba dispar
VSIPIERACYYLKRVNPEGPML

SEQ ID NO: 2509077 - protein, 25 aa, Entamoeba dispar
VSISLKRKQSCIFFLYCSDPLQQKR

SEQ ID NO: 2509078 - protein, 27 aa, Entamoeba dispar
VSIVPFKMKECMNSLIVATKENIIIGN

SEQ ID NO: 2509079 - protein, 18 aa, Entamoeba dispar
VSIVPSCLTFNRKSSKEQ

SEQ ID NO: 2509080 - protein, 24 aa, Entamoeba dispar
VSKDCVQPFPPFLVPSHTQPILPV

SEQ ID NO: 2509081 - protein, 17 aa, Entamoeba dispar
VSKDRLRIVQAKVNGES

SEQ ID NO: 2509082 - protein, 25 aa, Entamoeba dispar
VSKIGGWCFYGCKSLTSVTIPSSVS

SEQ ID NO: 2509083 - protein, 26 aa, Entamoeba dispar
VSKKYLKEFIMSIIINASYSTSVSGV

SEQ ID NO: 2509084 - protein, 24 aa, Entamoeba dispar
VSKPFSWPSTDFISIREIQTAMEL

SEQ ID NO: 2509085 - protein, 21 aa, Entamoeba dispar
VSKPFSYGCLKNFPEQWRGLR

SEQ ID NO: 2509086 - protein, 21 aa, Entamoeba dispar
VSKRSGLTYGSRNTIQLSTEL

SEQ ID NO: 2509087 - protein, 23 aa, Entamoeba dispar
VSKRSVECWMYPNLFHLDKSTGA

SEQ ID NO: 2509088 - protein, 23 aa, Entamoeba dispar
VSKTCPLLKFEKLLIPKTNNEII

SEQ ID NO: 2509089 - protein, 17 aa, Entamoeba dispar
VSLAKVFGLTLNVPQTT

SEQ ID NO: 2509090 - protein, 19 aa, Entamoeba dispar
VSLASWKLTSKDKMFQIIT

SEQ ID NO: 2509091 - protein, 20 aa, Entamoeba dispar
VSLEEIVIFGNMVKDFLHSL

SEQ ID NO: 2509092 - protein, 19 aa, Entamoeba dispar
VSLEGMITFQWKKKETPII

SEQ ID NO: 2509093 - protein, 18 aa, Entamoeba dispar
VSLFGINQHAPFNVEKKQ

SEQ ID NO: 2509094 - protein, 25 aa, Entamoeba dispar
VSLGRSCRQLHGIIFGIEGEKYWED

SEQ ID NO: 2509095 - protein, 21 aa, Entamoeba dispar
VSLIDLCRYAFLSMDNNQDVK

SEQ ID NO: 2509096 - protein, 17 aa, Entamoeba dispar
VSLISKTLHSFRLDSYN

SEQ ID NO: 2509097 - protein, 18 aa, Entamoeba dispar
VSLKEHYNNALKVIKISG

SEQ ID NO: 2509098 - protein, 20 aa, Entamoeba dispar
VSLKFKRTFSTVVINLEEYF

SEQ ID NO: 2509099 - protein, 24 aa, Entamoeba dispar
VSLKGRASLPLSIKIPHPDTDRIE

SEQ ID NO: 2509100 - protein, 24 aa, Entamoeba dispar
VSLKNCKTEEIIPFQQKVEEEASF

SEQ ID NO: 2509101 - protein, 30 aa, Entamoeba dispar
VSLLCKGSLLICHPELCKSVGINVTDMMNE

SEQ ID NO: 2509102 - protein, 27 aa, Entamoeba dispar
VSLLELYRSLKVLFVKGTHIKSESNAK

SEQ ID NO: 2509103 - protein, 24 aa, Entamoeba dispar
VSLPCGHSFCDNCIINWAQQHCYC

SEQ ID NO: 2509104 - protein, 26 aa, Entamoeba dispar
VSLPKLLCNFSYCIVYLLTSFYPVLL

SEQ ID NO: 2509105 - protein, 28 aa, Entamoeba dispar
VSMEIFYDIFIELCVRYYSMVSSESEKL

SEQ ID NO: 2509106 - protein, 25 aa, Entamoeba dispar
VSMKDCVFEKLFDKCQMLCIDECEN

SEQ ID NO: 2509107 - protein, 21 aa, Entamoeba dispar
VSMMHVVDFIPILGQEKSVTI

SEQ ID NO: 2509108 - protein, 24 aa, Entamoeba dispar
VSMTYRSCEFCVSFADCSGMDKQT

SEQ ID NO: 2509109 - protein, 17 aa, Entamoeba dispar
VSNALNCIVEGFEIIFD

SEQ ID NO: 2509110 - protein, 18 aa, Entamoeba dispar
VSNEKWKQTPYILNGTTV

SEQ ID NO: 2509111 - protein, 30 aa, Entamoeba dispar
VSNFNIFVCPTCSGIHMEFGHRVKSVSLAI

SEQ ID NO: 2509112 - protein, 24 aa, Entamoeba dispar
VSNPSFKEPILYDLFGIVNHQGKI

SEQ ID NO: 2509113 - protein, 17 aa, Entamoeba dispar
VSPECIIEWESQGAKKV

SEQ ID NO: 2509114 - protein, 18 aa, Entamoeba dispar
VSPINCIHYFSIFQKAIP

SEQ ID NO: 2509115 - protein, 25 aa, Entamoeba dispar
VSPMKRSWRKSRIQSAIIDLPKLQQ

SEQ ID NO: 2509116 - protein, 22 aa, Entamoeba dispar
VSPSSIITLQFQPLIEWSINND

SEQ ID NO: 2509117 - protein, 30 aa, Entamoeba dispar
VSPVIIKGVPLYRVCVCCKSAVQGFLPHFP

SEQ ID NO: 2509118 - protein, 17 aa, Entamoeba dispar
VSPVVVQCIDYCCVVYI

SEQ ID NO: 2509119 - protein, 25 aa, Entamoeba dispar
VSQHLNEWIDLIFGFKQTGEPAIKA

SEQ ID NO: 2509120 - protein, 24 aa, Entamoeba dispar
VSQLGGVCIIGFVRKEIENKIKYF

SEQ ID NO: 2509121 - protein, 37 aa, Entamoeba dispar
VSQMKDCKQFGIEMLPELRVLKLSTSIVHLNIVDVES

SEQ ID NO: 2509122 - protein, 21 aa, Entamoeba dispar
VSQPSVMKWEQMKLMRKPRKP

SEQ ID NO: 2509123 - protein, 23 aa, Entamoeba dispar
VSQRLKAAHLIRSLITPENYVIV

SEQ ID NO: 2509124 - protein, 25 aa, Entamoeba dispar
VSQVKKRLSEVMSRDIEQLRAEAEK

SEQ ID NO: 2509125 - protein, 24 aa, Entamoeba dispar
VSQYEVWYPVSICEALKYKNTIKK

SEQ ID NO: 2509126 - protein, 24 aa, Entamoeba dispar
VSRDRLSQILIYFINNKIQDASDL

SEQ ID NO: 2509127 - protein, 34 aa, Entamoeba dispar
VSRIGRGRYSSVFKGVMTEGLYPCAIKCLRSIKE

SEQ ID NO: 2509128 - protein, 25 aa, Entamoeba dispar
VSRRSSFALPAPRQSIRRSIVPPRQ

SEQ ID NO: 2509129 - protein, 18 aa, Entamoeba dispar
VSSAGFLPPHASEIEAAL

SEQ ID NO: 2509130 - protein, 18 aa, Entamoeba dispar
VSSEGNFRISNGTLLTAK

SEQ ID NO: 2509131 - protein, 17 aa, Entamoeba dispar
VSSFCLLEANSKRKLTA

SEQ ID NO: 2509132 - protein, 18 aa, Entamoeba dispar
VSSFFLFVACLDQKHFEL

SEQ ID NO: 2509133 - protein, 19 aa, Entamoeba dispar
VSSKDRWTLPGKVKDFISI

SEQ ID NO: 2509134 - protein, 19 aa, Entamoeba dispar
VSSLLKERLFLASDKYQIY

SEQ ID NO: 2509135 - protein, 17 aa, Entamoeba dispar
VSSLMFLFPRTSNEVTC

SEQ ID NO: 2509136 - protein, 24 aa, Entamoeba dispar
VSSLVYHLSCSTAISVKPYIIQCG

SEQ ID NO: 2509137 - protein, 26 aa, Entamoeba dispar
VSSMKVPHPFGTFYKLQMKQAPEHLQ

SEQ ID NO: 2509138 - protein, 17 aa, Entamoeba dispar
VSSRGAGYLFGKKPVDE

SEQ ID NO: 2509139 - protein, 17 aa, Entamoeba dispar
VSSSIQLILTFSGSTVP

SEQ ID NO: 2509140 - protein, 25 aa, Entamoeba dispar
VSSSYEILGGLALDDDQFIAIKKQY

SEQ ID NO: 2509141 - protein, 18 aa, Entamoeba dispar
VSSVELYPLPTIPSNLAI

SEQ ID NO: 2509142 - protein, 26 aa, Entamoeba dispar
VSTACGHVFCRNCMCELFKNKEKVQC

SEQ ID NO: 2509143 - protein, 20 aa, Entamoeba dispar
VSTEMLQRHGYPYTTDLNVF

SEQ ID NO: 2509144 - protein, 29 aa, Entamoeba dispar
VSTLFYYMRLCVLSYGKWVYIQGDKDDNI

SEQ ID NO: 2509145 - protein, 25 aa, Entamoeba dispar
VSTPLKIECGWVLVNALEKVDDMGL

SEQ ID NO: 2509146 - protein, 17 aa, Entamoeba dispar
VSTQLYVHRAGRTGRAG

SEQ ID NO: 2509147 - protein, 20 aa, Entamoeba dispar
VSVEKWDFERDIWRRDFYFW

SEQ ID NO: 2509148 - protein, 25 aa, Entamoeba dispar
VSVFISKEMVEFCQKFIHKNRYLVL

SEQ ID NO: 2509149 - protein, 18 aa, Entamoeba dispar
VSVKRGKSLILSKLDNQL

SEQ ID NO: 2509150 - protein, 50 aa, Entamoeba dispar
VSVRRLGRTFIRFCEELKFDLPFVDPCLYLQRFGEDLAFEKTGDVVRTAM

SEQ ID NO: 2509151 - protein, 19 aa, Entamoeba dispar
VSVSWFPTYIKTENETITP

SEQ ID NO: 2509152 - protein, 19 aa, Entamoeba dispar
VSYCVVCRKIIPPQFKCCL

SEQ ID NO: 2509153 - protein, 17 aa, Entamoeba dispar
VSYKKGHINLQMWDTAG

SEQ ID NO: 2509154 - protein, 27 aa, Entamoeba dispar
VSYLLLHGLMCPLLAPRISKKLCSLLA

SEQ ID NO: 2509155 - protein, 18 aa, Entamoeba dispar
VSYLSAYCGNIQSMVKLN

SEQ ID NO: 2509156 - protein, 25 aa, Entamoeba dispar
VSYPYQRYAVWYGGSVMAELPVFVQ

SEQ ID NO: 2509157 - protein, 19 aa, Entamoeba dispar
VSYQKLLKCYVINELQKKP

SEQ ID NO: 2509158 - protein, 24 aa, Entamoeba dispar
VSYTFYFKDCQIITLSAYEPSMPC

SEQ ID NO: 2509159 - protein, 26 aa, Entamoeba dispar
VTAAVLKSFMRGMIEPVVDINTAFTL

SEQ ID NO: 2509160 - protein, 25 aa, Entamoeba dispar
VTAIRRYCFRECFSLTSIDIPSEIK

SEQ ID NO: 2509161 - protein, 19 aa, Entamoeba dispar
VTALCISKEYSIIVSGDEM

SEQ ID NO: 2509162 - protein, 24 aa, Entamoeba dispar
VTALTVLCGTTFDLTNHPNIKSMN

SEQ ID NO: 2509163 - protein, 19 aa, Entamoeba dispar
VTCLAPSLRGYPFVYTYSI

SEQ ID NO: 2509164 - protein, 23 aa, Entamoeba dispar
VTCPTGYPVIVVDVGVYLPKGII

SEQ ID NO: 2509165 - protein, 23 aa, Entamoeba dispar
VTCSRNPLFASLQMQIDNKPYPD

SEQ ID NO: 2509166 - protein, 18 aa, Entamoeba dispar
VTCSRNPLLASLQLQIDN

SEQ ID NO: 2509167 - protein, 22 aa, Entamoeba dispar
VTCSRNPLLASLQLQIDNKPYP

SEQ ID NO: 2509168 - protein, 20 aa, Entamoeba dispar
VTDFEWYLKLLSRLSTQQLE

SEQ ID NO: 2509169 - protein, 25 aa, Entamoeba dispar
VTDITSRFKFPFTAEYKYDGERGQI

SEQ ID NO: 2509170 - protein, 26 aa, Entamoeba dispar
VTDKAMRIVQSWGILFPQEFKVYTEM

SEQ ID NO: 2509171 - protein, 18 aa, Entamoeba dispar
VTDLPIFFHSHNTSGTII

SEQ ID NO: 2509172 - protein, 18 aa, Entamoeba dispar
VTECSICHSSSETFEEFI

SEQ ID NO: 2509173 - protein, 23 aa, Entamoeba dispar
VTEELYLHPSIFQKYLVTPANKY

SEQ ID NO: 2509174 - protein, 29 aa, Entamoeba dispar
VTEEQCVICGFPSSTHCPDCTTPYCCSLH

SEQ ID NO: 2509175 - protein, 19 aa, Entamoeba dispar
VTEISFCAHSDFAHTRKFI

SEQ ID NO: 2509176 - protein, 25 aa, Entamoeba dispar
VTEKAMKIVQSWGQMFPDDLYEYSQ

SEQ ID NO: 2509177 - protein, 25 aa, Entamoeba dispar
VTEKAMRILQTWGPLYPNELYDYQL

SEQ ID NO: 2509178 - protein, 18 aa, Entamoeba dispar
VTELGIRCFYECSSLTSI

SEQ ID NO: 2509179 - protein, 17 aa, Entamoeba dispar
VTELRLSHCDKLEAIYF

SEQ ID NO: 2509180 - protein, 18 aa, Entamoeba dispar
VTFFKIPTSLLYLYLPKP

SEQ ID NO: 2509181 - protein, 17 aa, Entamoeba dispar
VTFKGDVITIQYNPDDP

SEQ ID NO: 2509182 - protein, 26 aa, Entamoeba dispar
VTFSCDVYALGLIMWQTFTQKQLFPE

SEQ ID NO: 2509183 - protein, 24 aa, Entamoeba dispar
VTFSKWKLISDITKLMGNKFYINE

SEQ ID NO: 2509184 - protein, 26 aa, Entamoeba dispar
VTGEYGWSANMERIMKAQALRDNSMS

SEQ ID NO: 2509185 - protein, 27 aa, Entamoeba dispar
VTGEYGWSANMERIMKAQALRDNSMST

SEQ ID NO: 2509186 - protein, 18 aa, Entamoeba dispar
VTGGYRGEKIIEIIKNIE

SEQ ID NO: 2509187 - protein, 19 aa, Entamoeba dispar
VTGPRGSLTREFQHPKVDI

SEQ ID NO: 2509188 - protein, 19 aa, Entamoeba dispar
VTGRYGVLMEAFLNGCGKY

SEQ ID NO: 2509189 - protein, 24 aa, Entamoeba dispar
VTHFCKDAKIVLVATKSDRRKDKS

SEQ ID NO: 2509190 - protein, 18 aa, Entamoeba dispar
VTHGYPFNTITFYDTQHW

SEQ ID NO: 2509191 - protein, 24 aa, Entamoeba dispar
VTHPEILTTLVLDFDLLSSCPNGI

SEQ ID NO: 2509192 - protein, 23 aa, Entamoeba dispar
VTHREMNDVISFQGHKNEVVCCR

SEQ ID NO: 2509193 - protein, 18 aa, Entamoeba dispar
VTIAICFNTVATVGLTGS

SEQ ID NO: 2509194 - protein, 20 aa, Entamoeba dispar
VTIASLGDRIICNNTLEHRM

SEQ ID NO: 2509195 - protein, 19 aa, Entamoeba dispar
VTICAGGDLMKAKGKEDID

SEQ ID NO: 2509196 - protein, 27 aa, Entamoeba dispar
VTICVRRVCGGRLKYSLRIFDSIEIPI

SEQ ID NO: 2509197 - protein, 17 aa, Entamoeba dispar
VTIFVSMCGYYPFDGNS

SEQ ID NO: 2509198 - protein, 17 aa, Entamoeba dispar
VTIKMKKFISVTLKNKN

SEQ ID NO: 2509199 - protein, 17 aa, Entamoeba dispar
VTINVNVLQYFIDKLNC

SEQ ID NO: 2509200 - protein, 26 aa, Entamoeba dispar
VTIYFKNSRELLQFPIREKMFHSIVM

SEQ ID NO: 2509201 - protein, 27 aa, Entamoeba dispar
VTKASECYDLLYGQEMVETVRQCYELM

SEQ ID NO: 2509202 - protein, 24 aa, Entamoeba dispar
VTKCGHAFCKKCLDCALNFNEKCP

SEQ ID NO: 2509203 - protein, 32 aa, Entamoeba dispar
VTKDEFSFIVDFLKEFPTVSSMKLSQEQIEEK

SEQ ID NO: 2509204 - protein, 20 aa, Entamoeba dispar
VTKDGFKFDFGKNETAKPEN

SEQ ID NO: 2509205 - protein, 24 aa, Entamoeba dispar
VTKFLYQQVEPFILLKYQLEKDEQ

SEQ ID NO: 2509206 - protein, 23 aa, Entamoeba dispar
VTKIGKGLGAKVYYYSTTGKHED

SEQ ID NO: 2509207 - protein, 24 aa, Entamoeba dispar
VTKLGQSCFKNCCSLTSVSLPSSI

SEQ ID NO: 2509208 - protein, 27 aa, Entamoeba dispar
VTKLKELECGKKILLFDTIQFKNLGYK

SEQ ID NO: 2509209 - protein, 32 aa, Entamoeba dispar
VTKRCAECHAVLKKDEGTICRNCHEKTGEIYA

SEQ ID NO: 2509210 - protein, 26 aa, Entamoeba dispar
VTKSEMFSIGMVRPSHHNDIMFYRGY

SEQ ID NO: 2509211 - protein, 22 aa, Entamoeba dispar
VTLCHGMEVVGRYTTQREAESY

SEQ ID NO: 2509212 - protein, 17 aa, Entamoeba dispar
VTLEFARYLQDAFNVQV

SEQ ID NO: 2509213 - protein, 24 aa, Entamoeba dispar
VTLELPYVRRIYGVDDLIEIKRKQ

SEQ ID NO: 2509214 - protein, 25 aa, Entamoeba dispar
VTLKPEIKLALIFEKCLSEIQKKER

SEQ ID NO: 2509215 - protein, 17 aa, Entamoeba dispar
VTLKPPRFNEIVPAVVE

SEQ ID NO: 2509216 - protein, 23 aa, Entamoeba dispar
VTLKSPHPFAKFISDQMKHAPVG

SEQ ID NO: 2509217 - protein, 25 aa, Entamoeba dispar
VTLLPRCYSELVDLPTPFICGISTY

SEQ ID NO: 2509218 - protein, 18 aa, Entamoeba dispar
VTLQNDFSQPSQFSNFDP

SEQ ID NO: 2509219 - protein, 33 aa, Entamoeba dispar
VTLRFIFKKQEFFIPVVLLLRVYGGMSDREIFE

SEQ ID NO: 2509220 - protein, 32 aa, Entamoeba dispar
VTLSCGHSFCLVCLRQIFKKDNICPSCQKPFG

SEQ ID NO: 2509221 - protein, 17 aa, Entamoeba dispar
VTLTNDFGKILSGLHET

SEQ ID NO: 2509222 - protein, 18 aa, Entamoeba dispar
VTLTRLRIFGGNIKQVNE

SEQ ID NO: 2509223 - protein, 18 aa, Entamoeba dispar
VTLYKYWWDGLKEKVDIE

SEQ ID NO: 2509224 - protein, 24 aa, Entamoeba dispar
VTMNAAMCALLFSGVDMKGIVVGM

SEQ ID NO: 2509225 - protein, 17 aa, Entamoeba dispar
VTNCLRCKNTSCHYPCF

SEQ ID NO: 2509226 - protein, 29 aa, Entamoeba dispar
VTNFHYSWKNGLAFCALIHSFHPEAIDFN

SEQ ID NO: 2509227 - protein, 17 aa, Entamoeba dispar
VTNGIVYFKYFFDLSDL

SEQ ID NO: 2509228 - protein, 25 aa, Entamoeba dispar
VTNKKDLYCFIKKSVIGSTFMISDK

SEQ ID NO: 2509229 - protein, 19 aa, Entamoeba dispar
VTNQISMFFAFAAPMILCL

SEQ ID NO: 2509230 - protein, 24 aa, Entamoeba dispar
VTNSFEWFKDCGDYFFNWFNTVLK

SEQ ID NO: 2509231 - protein, 21 aa, Entamoeba dispar
VTNYILSFLFYFIQKNALIDC

SEQ ID NO: 2509232 - protein, 22 aa, Entamoeba dispar
VTPEIFPYLLVNVGSGVSILKV

SEQ ID NO: 2509233 - protein, 17 aa, Entamoeba dispar
VTPSFKLESKKGLIEKS

SEQ ID NO: 2509234 - protein, 19 aa, Entamoeba dispar
VTPSKFCSAISIPNDKGKS

SEQ ID NO: 2509235 - protein, 26 aa, Entamoeba dispar
VTPSLCKIGGLLLCVVGEDVAFSLLR

SEQ ID NO: 2509236 - protein, 19 aa, Entamoeba dispar
VTQFFKFEHFILIEIFTQM

SEQ ID NO: 2509237 - protein, 18 aa, Entamoeba dispar
VTQILKRLWKGVWKVVCG

SEQ ID NO: 2509238 - protein, 24 aa, Entamoeba dispar
VTQLFEIIGYLFIYHSEYCEIYFE

SEQ ID NO: 2509239 - protein, 17 aa, Entamoeba dispar
VTQLKLAHLNGEKNAGI

SEQ ID NO: 2509240 - protein, 25 aa, Entamoeba dispar
VTQMKALEIIHRIMLDGPQQACTTK

SEQ ID NO: 2509241 - protein, 23 aa, Entamoeba dispar
VTREAGIYLFIIFYKEGKLFRTV

SEQ ID NO: 2509242 - protein, 25 aa, Entamoeba dispar
VTRSEIVTCSILERVLASLLHITSY

SEQ ID NO: 2509243 - protein, 26 aa, Entamoeba dispar
VTSAPTFFKYFMAFIRKIVTENSDYL

SEQ ID NO: 2509244 - protein, 17 aa, Entamoeba dispar
VTSFASYFLQVFDKSDS

SEQ ID NO: 2509245 - protein, 23 aa, Entamoeba dispar
VTSGRIKLRLAYLEHPMALTEVN

SEQ ID NO: 2509246 - protein, 21 aa, Entamoeba dispar
VTSIISRYGGAKGLVNRPTFG

SEQ ID NO: 2509247 - protein, 19 aa, Entamoeba dispar
VTSIRWSGNENILYTSSRD

SEQ ID NO: 2509248 - protein, 20 aa, Entamoeba dispar
VTSRNCKRVVLQFPEGLIAQ

SEQ ID NO: 2509249 - protein, 21 aa, Entamoeba dispar
VTSSKWLYHINKILKGTYLTT

SEQ ID NO: 2509250 - protein, 20 aa, Entamoeba dispar
VTTEGLWDPTIEKVKKACIG

SEQ ID NO: 2509251 - protein, 21 aa, Entamoeba dispar
VTTELQSLVVILTLKEINDEL

SEQ ID NO: 2509252 - protein, 24 aa, Entamoeba dispar
VTTESFGSLSLKGIESLFTNKILE

SEQ ID NO: 2509253 - protein, 31 aa, Entamoeba dispar
VTTIRGWFVELAHPFPLCLISRKEPVTCTVF

SEQ ID NO: 2509254 - protein, 19 aa, Entamoeba dispar
VTVEICLNKKHLVERQLNK

SEQ ID NO: 2509255 - protein, 19 aa, Entamoeba dispar
VTVFFECCHSGGLFQPDES

SEQ ID NO: 2509256 - protein, 19 aa, Entamoeba dispar
VTVGVCFMKGVGVKKDVNL

SEQ ID NO: 2509257 - protein, 20 aa, Entamoeba dispar
VTYAPLLIRCMAFLLRCRLL

SEQ ID NO: 2509258 - protein, 20 aa, Entamoeba dispar
VTYCAAPMPYVIGVKNNFLP

SEQ ID NO: 2509259 - protein, 17 aa, Entamoeba dispar
VVACPAPSIAAHFGKYD

SEQ ID NO: 2509260 - protein, 29 aa, Entamoeba dispar
VVAGCANGVIILYEFKDNFLVELDTINNE

SEQ ID NO: 2509261 - protein, 19 aa, Entamoeba dispar
VVALPRSGSTFTHTLLSAD

SEQ ID NO: 2509262 - protein, 20 aa, Entamoeba dispar
VVATRFIRQLGLYSYENDQH

SEQ ID NO: 2509263 - protein, 19 aa, Entamoeba dispar
VVCDEIEWDSDVKKLIQQA

SEQ ID NO: 2509264 - protein, 30 aa, Entamoeba dispar
VVCIDCNTNSSLIFFDFIDIVIDLRSDYSP

SEQ ID NO: 2509265 - protein, 26 aa, Entamoeba dispar
VVCKSCIKPFPPFIEDKWYYHSIDFS

SEQ ID NO: 2509266 - protein, 18 aa, Entamoeba dispar
VVCPKIIIEPSIITIDQV

SEQ ID NO: 2509267 - protein, 18 aa, Entamoeba dispar
VVCTCYFIDTAFDIINYI

SEQ ID NO: 2509268 - protein, 23 aa, Entamoeba dispar
VVDCIRMEVSYMRMFHHPNIISF

SEQ ID NO: 2509269 - protein, 19 aa, Entamoeba dispar
VVDCPFRAMDEFDVYMDSM

SEQ ID NO: 2509270 - protein, 22 aa, Entamoeba dispar
VVDFYFHRNLLYMVMEYHPSDL

SEQ ID NO: 2509271 - protein, 24 aa, Entamoeba dispar
VVDHETREILPIGLAGELEVRSPI

SEQ ID NO: 2509272 - protein, 19 aa, Entamoeba dispar
VVDIRLGNELLLNKENVDI

SEQ ID NO: 2509273 - protein, 33 aa, Entamoeba dispar
VVDLMKYNGGYNWWKRNSLKVFIDKKLYKDPEE

SEQ ID NO: 2509274 - protein, 33 aa, Entamoeba dispar
VVDLMKYNGGYNWWKRNSLTVFIDKKLYKDPED

SEQ ID NO: 2509275 - protein, 25 aa, Entamoeba dispar
VVDPFERINTFQLMDMIAKEVNLPN

SEQ ID NO: 2509276 - protein, 24 aa, Entamoeba dispar
VVDRAIEIYPSFRIPAELAKPSGK

SEQ ID NO: 2509277 - protein, 31 aa, Entamoeba dispar
VVDRLKKRPSFILFIKYYFIHVLQLEVNETS

SEQ ID NO: 2509278 - protein, 19 aa, Entamoeba dispar
VVEELITIVSIQFNKYKPL

SEQ ID NO: 2509279 - protein, 22 aa, Entamoeba dispar
VVEIVVRISFIYSQILILWEVK

SEQ ID NO: 2509280 - protein, 17 aa, Entamoeba dispar
VVELPMLHPEAFENLGI

SEQ ID NO: 2509281 - protein, 24 aa, Entamoeba dispar
VVEPRGSNGFGFDSCFIPEGYDKT

SEQ ID NO: 2509282 - protein, 19 aa, Entamoeba dispar
VVEQLMVLVRLCLLHGQIY

SEQ ID NO: 2509283 - protein, 23 aa, Entamoeba dispar
VVFMSFELIHSMFLDQTAKICDI

SEQ ID NO: 2509284 - protein, 17 aa, Entamoeba dispar
VVFWEILTKGIIPYSSI

SEQ ID NO: 2509285 - protein, 17 aa, Entamoeba dispar
VVGCFCADESSDFLLEK

SEQ ID NO: 2509286 - protein, 25 aa, Entamoeba dispar
VVGGDKTFKSTLCKVLVGNTFSSNY

SEQ ID NO: 2509287 - protein, 19 aa, Entamoeba dispar
VVGGHEVHIPSFLKKKQLQ

SEQ ID NO: 2509288 - protein, 20 aa, Entamoeba dispar
VVGGRLVFWFPSIFPEDRGK

SEQ ID NO: 2509289 - protein, 17 aa, Entamoeba dispar
VVGISFYHVESFEIRAV

SEQ ID NO: 2509290 - protein, 26 aa, Entamoeba dispar
VVHPKTNCVICFNMSIYFQSDEIVER

SEQ ID NO: 2509291 - protein, 24 aa, Entamoeba dispar
VVIDARGSIPGWLAGTAKKDDAGR

SEQ ID NO: 2509292 - protein, 18 aa, Entamoeba dispar
VVIDNCNIFAAINCTQYH

SEQ ID NO: 2509293 - protein, 18 aa, Entamoeba dispar
VVIEDGWQNYIVMSEEST

SEQ ID NO: 2509294 - protein, 24 aa, Entamoeba dispar
VVIFKDRVIKFAEWVDNDNQKNIT

SEQ ID NO: 2509295 - protein, 29 aa, Entamoeba dispar
VVILLDFLVDICLNLGYFFETTRMRNPLA

SEQ ID NO: 2509296 - protein, 29 aa, Entamoeba dispar
VVINPYKFFPIYTPFIVSKYQGRRREDVA

SEQ ID NO: 2509297 - protein, 24 aa, Entamoeba dispar
VVIPIKRKSFRVEEKGNQERQTTP

SEQ ID NO: 2509298 - protein, 19 aa, Entamoeba dispar
VVIQMEYCSGSNLSRIIES

SEQ ID NO: 2509299 - protein, 18 aa, Entamoeba dispar
VVISDWDFVESAVVGTLY

SEQ ID NO: 2509300 - protein, 22 aa, Entamoeba dispar
VVKCETCSLLIHEDCTGYCYLP

SEQ ID NO: 2509301 - protein, 18 aa, Entamoeba dispar
VVKCFKSGRFIEDIDKLP

SEQ ID NO: 2509302 - protein, 27 aa, Entamoeba dispar
VVKEVMKYSNLHFIGIMTIGMVGDSKK

SEQ ID NO: 2509303 - protein, 19 aa, Entamoeba dispar
VVKHSKYFAQWTERHYGYK

SEQ ID NO: 2509304 - protein, 21 aa, Entamoeba dispar
VVKKCCCPRIKAFKKFMNTFE

SEQ ID NO: 2509305 - protein, 33 aa, Entamoeba dispar
VVKKSRWRVPNIIYRCIEFLKNHDAINVEGIFR

SEQ ID NO: 2509306 - protein, 28 aa, Entamoeba dispar
VVKNRSCYSILYYDYWPSGSYQNVLQFI

SEQ ID NO: 2509307 - protein, 24 aa, Entamoeba dispar
VVKNSRIWLNSALSGRTKRIKTLV

SEQ ID NO: 2509308 - protein, 25 aa, Entamoeba dispar
VVKNSRIWLSSALSGRTKRVKTLVI

SEQ ID NO: 2509309 - protein, 21 aa, Entamoeba dispar
VVKTLRYGKSLLRPADLSSAS

SEQ ID NO: 2509310 - protein, 23 aa, Entamoeba dispar
VVKVRLHTGYGFVDFENAAAREK

SEQ ID NO: 2509311 - protein, 32 aa, Entamoeba dispar
VVKYGKYLLKKVCAIPAFIVTFTVCIDEVVAR

SEQ ID NO: 2509312 - protein, 25 aa, Entamoeba dispar
VVLELPRPLLTPGYEAVIHIHTSQE

SEQ ID NO: 2509313 - protein, 20 aa, Entamoeba dispar
VVLKCYKHSIFFFEDETRCS

SEQ ID NO: 2509314 - protein, 19 aa, Entamoeba dispar
VVLNCYCAFWMNDKGLIQF

SEQ ID NO: 2509315 - protein, 19 aa, Entamoeba dispar
VVLNKRLSSEFPLFSTYIA

SEQ ID NO: 2509316 - protein, 19 aa, Entamoeba dispar
VVLQPPEKVDIFAQLDTKP

SEQ ID NO: 2509317 - protein, 19 aa, Entamoeba dispar
VVLTDEIIRPITPVRSSHP

SEQ ID NO: 2509318 - protein, 28 aa, Entamoeba dispar
VVMGLPYSHPIDMWSLGCILPELLTTEP

SEQ ID NO: 2509319 - protein, 19 aa, Entamoeba dispar
VVNEIKEKLIKIEEYNNLI

SEQ ID NO: 2509320 - protein, 25 aa, Entamoeba dispar
VVNHRLNVLIPYFTYLQKWSKCSKF

SEQ ID NO: 2509321 - protein, 18 aa, Entamoeba dispar
VVNSFKVDLVYVMDSEQL

SEQ ID NO: 2509322 - protein, 23 aa, Entamoeba dispar
VVPHKMLRIYSGFYDIYGEDEEF

SEQ ID NO: 2509323 - protein, 26 aa, Entamoeba dispar
VVPSELEMTFRVLFDGTKVTDAILIK

SEQ ID NO: 2509324 - protein, 19 aa, Entamoeba dispar
VVPVKALPPKPSQKEGDKR

SEQ ID NO: 2509325 - protein, 18 aa, Entamoeba dispar
VVQCIDYCCVVYIALTRM

SEQ ID NO: 2509326 - protein, 25 aa, Entamoeba dispar
VVQFRKSICKFIKRRDGTAPSPDEV

SEQ ID NO: 2509327 - protein, 17 aa, Entamoeba dispar
VVQRLKGVLDRTNEYEA

SEQ ID NO: 2509328 - protein, 19 aa, Entamoeba dispar
VVQTEVFQSYGIQEGIILD

SEQ ID NO: 2509329 - protein, 22 aa, Entamoeba dispar
VVRKNETIMLMGNVNTLPKKED

SEQ ID NO: 2509330 - protein, 25 aa, Entamoeba dispar
VVRREWCPLSKEIGYYCIDLILSDP

SEQ ID NO: 2509331 - protein, 38 aa, Entamoeba dispar
VVRSNIKLAKLLSSKLGFPHELLLHINKEVADLMKSNL

SEQ ID NO: 2509332 - protein, 25 aa, Entamoeba dispar
VVSALPLPMNIVTEINLNDEINLSI

SEQ ID NO: 2509333 - protein, 19 aa, Entamoeba dispar
VVSCGYCNEGSQHVYPFEN

SEQ ID NO: 2509334 - protein, 25 aa, Entamoeba dispar
VVSEIGGYCFIQCRSLTSIVIPTSI

SEQ ID NO: 2509335 - protein, 25 aa, Entamoeba dispar
VVSKFVVNCLQPFYDNGKIQDRDRF

SEQ ID NO: 2509336 - protein, 19 aa, Entamoeba dispar
VVSMLAEVLSIICMSLSKK

SEQ ID NO: 2509337 - protein, 24 aa, Entamoeba dispar
VVSPMVKPIIKFDVMDPQDIPLSI

SEQ ID NO: 2509338 - protein, 20 aa, Entamoeba dispar
VVSSFIPSVMLEYSPTTPNR

SEQ ID NO: 2509339 - protein, 22 aa, Entamoeba dispar
VVTCLEHEFTLVIPHRTLTLTP

SEQ ID NO: 2509340 - protein, 21 aa, Entamoeba dispar
VVTDFGTFVCQTCSGIHREFG

SEQ ID NO: 2509341 - protein, 23 aa, Entamoeba dispar
VVTEKCKFVDRVILKLQETPENV

SEQ ID NO: 2509342 - protein, 24 aa, Entamoeba dispar
VVTIELKSGVILTGTIVGVDNYMN

SEQ ID NO: 2509343 - protein, 18 aa, Entamoeba dispar
VVTKRANFLGERKPQQIN

SEQ ID NO: 2509344 - protein, 20 aa, Entamoeba dispar
VVVEGVCINTYLVQHGLAFV

SEQ ID NO: 2509345 - protein, 18 aa, Entamoeba dispar
VVVGKNAFLKVVNSKESV

SEQ ID NO: 2509346 - protein, 18 aa, Entamoeba dispar
VVVINSFFVIKKSRELWI

SEQ ID NO: 2509347 - protein, 22 aa, Entamoeba dispar
VVVPQIRKVLVNMLKYINPGTG

SEQ ID NO: 2509348 - protein, 18 aa, Entamoeba dispar
VVWEFNRLNITYTVMSKR

SEQ ID NO: 2509349 - protein, 21 aa, Entamoeba dispar
VVWINYCYWITCDNIIYLWHH

SEQ ID NO: 2509350 - protein, 20 aa, Entamoeba dispar
VVYCQYLDKLARLFDYLWKK

SEQ ID NO: 2509351 - protein, 22 aa, Entamoeba dispar
VVYSDSFTVYGINLPNQSGATA

SEQ ID NO: 2509352 - protein, 24 aa, Entamoeba dispar
VWERHPIEALDIFCKEDTTLTEKE

SEQ ID NO: 2509353 - protein, 21 aa, Entamoeba dispar
VWFEPKDVWEIKGADLSLSLQ

SEQ ID NO: 2509354 - protein, 19 aa, Entamoeba dispar
VWKTYCTEVDAVIYIVDCA

SEQ ID NO: 2509355 - protein, 22 aa, Entamoeba dispar
VWRQCCYLCPSPLNKCKIDDVI

SEQ ID NO: 2509356 - protein, 19 aa, Entamoeba dispar
VWSEGLLSCAKKIVEWAQY

SEQ ID NO: 2509357 - protein, 19 aa, Entamoeba dispar
VWSEYYFRNASNILRVPQT

SEQ ID NO: 2509358 - protein, 19 aa, Entamoeba dispar
VWSLGILLFKCFTSYYPFE

SEQ ID NO: 2509359 - protein, 23 aa, Entamoeba dispar
VWSMLVHHFYLRDALFELKGHGF

SEQ ID NO: 2509360 - protein, 20 aa, Entamoeba dispar
VWVKFCRNLIRLEEVHVKDQ

SEQ ID NO: 2509361 - protein, 19 aa, Entamoeba dispar
VWVQCLVDLHFLMIQEILN

SEQ ID NO: 2509362 - protein, 18 aa, Entamoeba dispar
VYCGLKEPLRILVDEQFL

SEQ ID NO: 2509363 - protein, 18 aa, Entamoeba dispar
VYCPICYDGIVVTHTINY

SEQ ID NO: 2509364 - protein, 17 aa, Entamoeba dispar
VYDLTAYLTNLKVVSPD

SEQ ID NO: 2509365 - protein, 23 aa, Entamoeba dispar
VYDPRTGKMRLLNTLQEYLDYRL

SEQ ID NO: 2509366 - protein, 20 aa, Entamoeba dispar
VYDSTICFVVSHLAAHQEFW

SEQ ID NO: 2509367 - protein, 29 aa, Entamoeba dispar
VYEAKAGTHGIVYPYTWIFNGVNKLVFTD

SEQ ID NO: 2509368 - protein, 17 aa, Entamoeba dispar
VYEGLYWILFKNQSNDF

SEQ ID NO: 2509369 - protein, 25 aa, Entamoeba dispar
VYEITETFLSSGFYTGCEVPSVSEL

SEQ ID NO: 2509370 - protein, 18 aa, Entamoeba dispar
VYESEQFQVAKKEGEKKT

SEQ ID NO: 2509371 - protein, 18 aa, Entamoeba dispar
VYEVCKKVNEFIEEEAAK

SEQ ID NO: 2509372 - protein, 21 aa, Entamoeba dispar
VYFMKGSLPWQGIKGKKVDKN

SEQ ID NO: 2509373 - protein, 17 aa, Entamoeba dispar
VYFNYKTSFYVSVIFNG

SEQ ID NO: 2509374 - protein, 26 aa, Entamoeba dispar
VYFQRRINNTIPYWDKTLIKYSTYNE

SEQ ID NO: 2509375 - protein, 20 aa, Entamoeba dispar
VYGATFKKLAAEQEKMRDLA

SEQ ID NO: 2509376 - protein, 18 aa, Entamoeba dispar
VYGFNAFYSKKPCKDYFK

SEQ ID NO: 2509377 - protein, 17 aa, Entamoeba dispar
VYGLLLRQFHRLNEEVK

SEQ ID NO: 2509378 - protein, 23 aa, Entamoeba dispar
VYGRELKVNWSYTAQQENQGSYK

SEQ ID NO: 2509379 - protein, 17 aa, Entamoeba dispar
VYGTKGYMKEFKKQVDK

SEQ ID NO: 2509380 - protein, 26 aa, Entamoeba dispar
VYINFAKEKLRYCEKMLKDDLNSFVS

SEQ ID NO: 2509381 - protein, 19 aa, Entamoeba dispar
VYINGCGKFIQLLQDSFQK

SEQ ID NO: 2509382 - protein, 19 aa, Entamoeba dispar
VYITLDFTTIFNCPSAFSV

SEQ ID NO: 2509383 - protein, 24 aa, Entamoeba dispar
VYITMPYCNCGSVKQVVKDKSHVF

SEQ ID NO: 2509384 - protein, 23 aa, Entamoeba dispar
VYKRGIKYVMHFGEELPTSLSLT

SEQ ID NO: 2509385 - protein, 18 aa, Entamoeba dispar
VYKSIKYLAMITETEGLF

SEQ ID NO: 2509386 - protein, 30 aa, Entamoeba dispar
VYKSWKCMRCNSCSIFPLLSSQEQELLKPL

SEQ ID NO: 2509387 - protein, 21 aa, Entamoeba dispar
VYLAKILLKFSTSNDVKNFIM

SEQ ID NO: 2509388 - protein, 18 aa, Entamoeba dispar
VYLEVAIIACDYGWNDMA

SEQ ID NO: 2509389 - protein, 17 aa, Entamoeba dispar
VYLKASQMIPSLIEITH

SEQ ID NO: 2509390 - protein, 24 aa, Entamoeba dispar
VYLREFLKRIFDTIHAQQQLNLPK

SEQ ID NO: 2509391 - protein, 25 aa, Entamoeba dispar
VYLSQWNFDECIKIHDNVRNLLNKN

SEQ ID NO: 2509392 - protein, 18 aa, Entamoeba dispar
VYLTSHRAVMEMEYMNGG

SEQ ID NO: 2509393 - protein, 28 aa, Entamoeba dispar
VYMCPRDEYKYSYIDAMDYYDTTTHRMF

SEQ ID NO: 2509394 - protein, 17 aa, Entamoeba dispar
VYMQRVDLLSILLLYGA

SEQ ID NO: 2509395 - protein, 17 aa, Entamoeba dispar
VYMRPDGRKVFVENKQN

SEQ ID NO: 2509396 - protein, 19 aa, Entamoeba dispar
VYNEFRLTVDAVIERYLQI

SEQ ID NO: 2509397 - protein, 17 aa, Entamoeba dispar
VYNELLQSISIVILSSG

SEQ ID NO: 2509398 - protein, 26 aa, Entamoeba dispar
VYNEYCSNFRHTIGLIKTLKYPHKFA

SEQ ID NO: 2509399 - protein, 20 aa, Entamoeba dispar
VYNIYAIFVILWNQETSKKI

SEQ ID NO: 2509400 - protein, 25 aa, Entamoeba dispar
VYNKICITVGLGFDSFVVMRHGDSS

SEQ ID NO: 2509401 - protein, 30 aa, Entamoeba dispar
VYNLCDHFKYTVPFLNYWTFDNTVFHFKNL

SEQ ID NO: 2509402 - protein, 21 aa, Entamoeba dispar
VYNLTAGKTLPQWLSQKKKKE

SEQ ID NO: 2509403 - protein, 20 aa, Entamoeba dispar
VYPDGTLKPGEGEKLNKSAT

SEQ ID NO: 2509404 - protein, 25 aa, Entamoeba dispar
VYQHIKRLSVQNVIATIGRCTILDI

SEQ ID NO: 2509405 - protein, 24 aa, Entamoeba dispar
VYQNASACVFVYDITKNDSLLSLQ

SEQ ID NO: 2509406 - protein, 23 aa, Entamoeba dispar
VYRIVDCAFGRFFSKISTLSSNS

SEQ ID NO: 2509407 - protein, 19 aa, Entamoeba dispar
VYSEGQYGIPKGIFFSMPV

SEQ ID NO: 2509408 - protein, 23 aa, Entamoeba dispar
VYSFAITSWEIFYQDEPYKEFKS

SEQ ID NO: 2509409 - protein, 18 aa, Entamoeba dispar
VYSLKFIFTPVNKIPPTE

SEQ ID NO: 2509410 - protein, 24 aa, Entamoeba dispar
VYSSRVAQIYQVYHNHCSKFGKAF

SEQ ID NO: 2509411 - protein, 25 aa, Entamoeba dispar
VYTCECCGAMLCGECIKKRKYQKKN

SEQ ID NO: 2509412 - protein, 19 aa, Entamoeba dispar
VYYLRDYFSNILLDTPSKP

SEQ ID NO: 2509413 - protein, 18 aa, Entamoeba dispar
VYYVPSFHEEYLKDISTN

SEQ ID NO: 2509414 - protein, 20 aa, Entamoeba dispar
WAEAFTDYYERPAGSDRNMS

SEQ ID NO: 2509415 - protein, 26 aa, Entamoeba dispar
WAEAIRRYGPPPSYREIIPLLYQNKT

SEQ ID NO: 2509416 - protein, 17 aa, Entamoeba dispar
WAEECGVVLRKGSGNNK

SEQ ID NO: 2509417 - protein, 21 aa, Entamoeba dispar
WAFGCVVAEMVMRKPLFRGDN

SEQ ID NO: 2509418 - protein, 17 aa, Entamoeba dispar
WAKKQGGSVKNWKKRWF

SEQ ID NO: 2509419 - protein, 17 aa, Entamoeba dispar
WAKTKEVALAWVDVTLR

SEQ ID NO: 2509420 - protein, 18 aa, Entamoeba dispar
WANVQLSGAYVINDVETD

SEQ ID NO: 2509421 - protein, 22 aa, Entamoeba dispar
WAPFLADLFMLARRDETVKEGK

SEQ ID NO: 2509422 - protein, 17 aa, Entamoeba dispar
WAPYLKSEEGFGQEDPK

SEQ ID NO: 2509423 - protein, 17 aa, Entamoeba dispar
WATVPILGKLSKCQVHP

SEQ ID NO: 2509424 - protein, 19 aa, Entamoeba dispar
WCCDVLLFVIRLLKEAKGI

SEQ ID NO: 2509425 - protein, 17 aa, Entamoeba dispar
WCFELCSSLKSVNIPTS

SEQ ID NO: 2509426 - protein, 17 aa, Entamoeba dispar
WCFHYCSSLTSINIPLS

SEQ ID NO: 2509427 - protein, 17 aa, Entamoeba dispar
WCFSGCTSLKSINIPTT

SEQ ID NO: 2509428 - protein, 17 aa, Entamoeba dispar
WCFSYCSSLKSINIPSS

SEQ ID NO: 2509429 - protein, 19 aa, Entamoeba dispar
WCFYGCKSLKSINIPSSVS

SEQ ID NO: 2509430 - protein, 18 aa, Entamoeba dispar
WCFYGCKSLTSVTIPSSV

SEQ ID NO: 2509431 - protein, 17 aa, Entamoeba dispar
WCFYNCYELISINIPSS

SEQ ID NO: 2509432 - protein, 20 aa, Entamoeba dispar
WCIQFGHGNIKLHYGSIEKE

SEQ ID NO: 2509433 - protein, 17 aa, Entamoeba dispar
WCITNGYEFFECSAKTG

SEQ ID NO: 2509434 - protein, 25 aa, Entamoeba dispar
WCLKVPGYYPSWFVGIRQKDNHELI

SEQ ID NO: 2509435 - protein, 23 aa, Entamoeba dispar
WCQNKYIRLCISKDFTQDKMIEF

SEQ ID NO: 2509436 - protein, 17 aa, Entamoeba dispar
WCSMIEKYSYYPLFLLC

SEQ ID NO: 2509437 - protein, 17 aa, Entamoeba dispar
WDAIFAFGHQLKLVDSL

SEQ ID NO: 2509438 - protein, 18 aa, Entamoeba dispar
WDALRDILDASGILYSVL

SEQ ID NO: 2509439 - protein, 17 aa, Entamoeba dispar
WDCSCDIELLQLIIENG

SEQ ID NO: 2509440 - protein, 20 aa, Entamoeba dispar
WDELEMAKVISVLETVDSPF

SEQ ID NO: 2509441 - protein, 20 aa, Entamoeba dispar
WDFCFEGCSSLTSITIPPLV

SEQ ID NO: 2509442 - protein, 22 aa, Entamoeba dispar
WDFKFLEWRDTNYLPGLHRLID

SEQ ID NO: 2509443 - protein, 23 aa, Entamoeba dispar
WDFKHDIGHGVGHYSFVHEYPPM

SEQ ID NO: 2509444 - protein, 20 aa, Entamoeba dispar
WDFSFIPTIELTLRLFGNYP

SEQ ID NO: 2509445 - protein, 23 aa, Entamoeba dispar
WDHMGRTALHYCALYGNAVMANI

SEQ ID NO: 2509446 - protein, 27 aa, Entamoeba dispar
WDINLKRGVLGWGRKIMKKEKIKGYIG

SEQ ID NO: 2509447 - protein, 21 aa, Entamoeba dispar
WDIQFCDELEKDTLFGVFHGA

SEQ ID NO: 2509448 - protein, 22 aa, Entamoeba dispar
WDKLKEDGERIVFPELSIQTES

SEQ ID NO: 2509449 - protein, 29 aa, Entamoeba dispar
WDKNNNYLFGFGVSDIRIGKIQNKTISFC

SEQ ID NO: 2509450 - protein, 23 aa, Entamoeba dispar
WDLFKMWTGKACCHVLYDSTVDE

SEQ ID NO: 2509451 - protein, 19 aa, Entamoeba dispar
WDLHSFKIIRSFDHHTCIT

SEQ ID NO: 2509452 - protein, 17 aa, Entamoeba dispar
WDLLYVVGEGKEFVFVC

SEQ ID NO: 2509453 - protein, 24 aa, Entamoeba dispar
WDMAHSRCKLSCPTGSAVSGLTLM

SEQ ID NO: 2509454 - protein, 22 aa, Entamoeba dispar
WDMLIHHFYLRDALFELKGHDF

SEQ ID NO: 2509455 - protein, 24 aa, Entamoeba dispar
WDNDDIIWDYPISQLEQFKPQATE

SEQ ID NO: 2509456 - protein, 17 aa, Entamoeba dispar
WDNEIEVIKETAQEVFE

SEQ ID NO: 2509457 - protein, 21 aa, Entamoeba dispar
WDNFVKLVYERGILCEILGNE

SEQ ID NO: 2509458 - protein, 25 aa, Entamoeba dispar
WDNISLELKDLISHMLIVNPKQRYD

SEQ ID NO: 2509459 - protein, 19 aa, Entamoeba dispar
WDNLDLILIGILLRKIEST

SEQ ID NO: 2509460 - protein, 20 aa, Entamoeba dispar
WDQRPCHVIYSNTFPKEIQP

SEQ ID NO: 2509461 - protein, 23 aa, Entamoeba dispar
WDRHPSEALEIFCKDENSLSKEE

SEQ ID NO: 2509462 - protein, 23 aa, Entamoeba dispar
WDRLGYLCNIFQIPLRPMQLQIL

SEQ ID NO: 2509463 - protein, 19 aa, Entamoeba dispar
WDSCSSSALIVLYRSGTLI

SEQ ID NO: 2509464 - protein, 18 aa, Entamoeba dispar
WDSVFEAIAMEYPDVTAE

SEQ ID NO: 2509465 - protein, 27 aa, Entamoeba dispar
WDTKTFCSHCAYSKAGISRSVDVFNDP

SEQ ID NO: 2509466 - protein, 17 aa, Entamoeba dispar
WDTRGFIIHDCELGELL

SEQ ID NO: 2509467 - protein, 23 aa, Entamoeba dispar
WDTVHPLFQFKTLPVQVLLKLQQ

SEQ ID NO: 2509468 - protein, 18 aa, Entamoeba dispar
WDVKFCDDLEKDMLFEML

SEQ ID NO: 2509469 - protein, 23 aa, Entamoeba dispar
WDVQYCPLEYYMLSSSYDRTARL

SEQ ID NO: 2509470 - protein, 24 aa, Entamoeba dispar
WDVQYCPLEYYMLSSSYDRTARLW

SEQ ID NO: 2509471 - protein, 20 aa, Entamoeba dispar
WDWKNEKFSSDEEINTNNKD

SEQ ID NO: 2509472 - protein, 19 aa, Entamoeba dispar
WDYRYSGIEKKECGGKIIR

SEQ ID NO: 2509473 - protein, 18 aa, Entamoeba dispar
WEASKCVQCNMCSLYCPH

SEQ ID NO: 2509474 - protein, 17 aa, Entamoeba dispar
WEDFDRIFRDVKNEINE

SEQ ID NO: 2509475 - protein, 17 aa, Entamoeba dispar
WEDSMIWIQLYYQKINE

SEQ ID NO: 2509476 - protein, 23 aa, Entamoeba dispar
WEDWKNSLELYSIYLKNHELTLT

SEQ ID NO: 2509477 - protein, 24 aa, Entamoeba dispar
WEEAWEIIQKGFTLRHTSATLSND

SEQ ID NO: 2509478 - protein, 24 aa, Entamoeba dispar
WEEIKSIISSLGFIIISERLIPCT

SEQ ID NO: 2509479 - protein, 20 aa, Entamoeba dispar
WEEVKGVFFSSRWTPYRRAE

SEQ ID NO: 2509480 - protein, 25 aa, Entamoeba dispar
WEFKSFSFEKGVEYYGTWRDEIIFN

SEQ ID NO: 2509481 - protein, 28 aa, Entamoeba dispar
WEFLKEFKRRGGIICICSHGLKQVIEDF

SEQ ID NO: 2509482 - protein, 18 aa, Entamoeba dispar
WEIGLMNSIVCKRFHELN

SEQ ID NO: 2509483 - protein, 20 aa, Entamoeba dispar
WEIKGADLSLSLQYRAGIKL

SEQ ID NO: 2509484 - protein, 24 aa, Entamoeba dispar
WEKEFKKCLNLIFLNSFSVEGQNL

SEQ ID NO: 2509485 - protein, 20 aa, Entamoeba dispar
WEKLAEWIDMWDLRHPQNKW

SEQ ID NO: 2509486 - protein, 24 aa, Entamoeba dispar
WEKMKLKLIMPKGIWEEDVEGYMI

SEQ ID NO: 2509487 - protein, 21 aa, Entamoeba dispar
WELGEFKGVIKNAVDIQDKKQ

SEQ ID NO: 2509488 - protein, 20 aa, Entamoeba dispar
WEMKYPKNWQEQSLVTTSCI

SEQ ID NO: 2509489 - protein, 17 aa, Entamoeba dispar
WENAIQWDVPVKITAKE

SEQ ID NO: 2509490 - protein, 22 aa, Entamoeba dispar
WENLKEKIELLISRTFDAGIQT

SEQ ID NO: 2509491 - protein, 26 aa, Entamoeba dispar
WENYFYKFLPPFPRHLIQPHIKTYVI

SEQ ID NO: 2509492 - protein, 17 aa, Entamoeba dispar
WEPPCELLDCGKTYLLK

SEQ ID NO: 2509493 - protein, 26 aa, Entamoeba dispar
WEQDELRSMAIIFLKQCAAMADKISV

SEQ ID NO: 2509494 - protein, 22 aa, Entamoeba dispar
WEQSPRGAGFIFGKDASDQFNQ

SEQ ID NO: 2509495 - protein, 28 aa, Entamoeba dispar
WERLRLLRKRIPNILFQMLLRGRNAVGY

SEQ ID NO: 2509496 - protein, 22 aa, Entamoeba dispar
WERRIAMVTTMTFIKNGQFEDS

SEQ ID NO: 2509497 - protein, 18 aa, Entamoeba dispar
WERRILKTQEDHLFFEKL

SEQ ID NO: 2509498 - protein, 22 aa, Entamoeba dispar
WESLFPWPNLDVSRFIYTGTKF

SEQ ID NO: 2509499 - protein, 25 aa, Entamoeba dispar
WESLKEVIRYGINIFQEKEKKDIQI

SEQ ID NO: 2509500 - protein, 18 aa, Entamoeba dispar
WESLNSGDAFIFDPGKGA

SEQ ID NO: 2509501 - protein, 18 aa, Entamoeba dispar
WETLASTLKRFVRELPGM

SEQ ID NO: 2509502 - protein, 19 aa, Entamoeba dispar
WETPLLFSNIFHGFQTLFT

SEQ ID NO: 2509503 - protein, 32 aa, Entamoeba dispar
WETTSGTLLKEFRRGMNPAHVYCVALSDDGKL

SEQ ID NO: 2509504 - protein, 32 aa, Entamoeba dispar
WEVLPIYHINCIFLHRFERYYGSINVIERTEE

SEQ ID NO: 2509505 - protein, 18 aa, Entamoeba dispar
WFADLFIDVFPVRLVIRI

SEQ ID NO: 2509506 - protein, 18 aa, Entamoeba dispar
WFCEHGFITMLLNSFLEE

SEQ ID NO: 2509507 - protein, 22 aa, Entamoeba dispar
WFEETELSKTVSYIFNEPIYYP

SEQ ID NO: 2509508 - protein, 17 aa, Entamoeba dispar
WFFTLFTHWNYYVRQAF

SEQ ID NO: 2509509 - protein, 18 aa, Entamoeba dispar
WFGGILLGPDRFKDIITA

SEQ ID NO: 2509510 - protein, 19 aa, Entamoeba dispar
WFIEKELRLNRFALNTSLI

SEQ ID NO: 2509511 - protein, 26 aa, Entamoeba dispar
WFIHSLKFELAIRVFDVILLEGFTAM

SEQ ID NO: 2509512 - protein, 26 aa, Entamoeba dispar
WFKGGDDGVRWIAKRCEVIESILETK

SEQ ID NO: 2509513 - protein, 21 aa, Entamoeba dispar
WFKGNDSFITKDIPKRLFEDS

SEQ ID NO: 2509514 - protein, 17 aa, Entamoeba dispar
WFKQPFRKVRRHQTRVE

SEQ ID NO: 2509515 - protein, 20 aa, Entamoeba dispar
WFMEQGVKSFLAIRQYYPSI

SEQ ID NO: 2509516 - protein, 17 aa, Entamoeba dispar
WFNGFRALITVNLPTSV

SEQ ID NO: 2509517 - protein, 26 aa, Entamoeba dispar
WFPFPDHHNPSLIVLCHIVDDMYKYY

SEQ ID NO: 2509518 - protein, 17 aa, Entamoeba dispar
WFRDILDKTWAIDPTQR

SEQ ID NO: 2509519 - protein, 19 aa, Entamoeba dispar
WFTFSEDIIRNGFINEKKC

SEQ ID NO: 2509520 - protein, 20 aa, Entamoeba dispar
WFTQLCKKDSIQLVSIPIGG

SEQ ID NO: 2509521 - protein, 22 aa, Entamoeba dispar
WFVYCKSSLITKVKQIISSMLT

SEQ ID NO: 2509522 - protein, 22 aa, Entamoeba dispar
WFWDYRSPYWEDIKRLVLKPIQ

SEQ ID NO: 2509523 - protein, 29 aa, Entamoeba dispar
WGCPADVWSHACMIFELLTGDFLFAPKQT

SEQ ID NO: 2509524 - protein, 19 aa, Entamoeba dispar
WGCTLRSIQMLFLNSLIRL

SEQ ID NO: 2509525 - protein, 17 aa, Entamoeba dispar
WGDEIKNNIQFKEVVDR

SEQ ID NO: 2509526 - protein, 17 aa, Entamoeba dispar
WGDSLVQSIIPPIAPTI

SEQ ID NO: 2509527 - protein, 19 aa, Entamoeba dispar
WGEKRIRSTNELNINSEVI

SEQ ID NO: 2509528 - protein, 23 aa, Entamoeba dispar
WGFGCILGSLIFKKEPIFEGRDL

SEQ ID NO: 2509529 - protein, 22 aa, Entamoeba dispar
WGIMPQRILNCLDDIRDEMWKL

SEQ ID NO: 2509530 - protein, 19 aa, Entamoeba dispar
WGLELSKRQIEIICENENL

SEQ ID NO: 2509531 - protein, 19 aa, Entamoeba dispar
WGQILKFIGGYLKVNTEIP

SEQ ID NO: 2509532 - protein, 22 aa, Entamoeba dispar
WGRDKPCLVSSLSELENGPYAE

SEQ ID NO: 2509533 - protein, 25 aa, Entamoeba dispar
WGSYYPNEMCEYSVLYKKYCSEEVI

SEQ ID NO: 2509534 - protein, 17 aa, Entamoeba dispar
WGVTSARAAHIAVESVL

SEQ ID NO: 2509535 - protein, 24 aa, Entamoeba dispar
WGYGIRYQYGMFKQGIVGGYQVEM

SEQ ID NO: 2509536 - protein, 21 aa, Entamoeba dispar
WGYGIRYQYGMFKQQISHGYQ

SEQ ID NO: 2509537 - protein, 23 aa, Entamoeba dispar
WGYGIRYQYGMFKQQISHGYQIE

SEQ ID NO: 2509538 - protein, 25 aa, Entamoeba dispar
WHAKRCHMKEMWGVKIANERNDKGL

SEQ ID NO: 2509539 - protein, 28 aa, Entamoeba dispar
WHDCLSISKRGYLYVSLYCKKGISVSTL

SEQ ID NO: 2509540 - protein, 24 aa, Entamoeba dispar
WHEFTRRKLEIFKLSEKVIPIYGS

SEQ ID NO: 2509541 - protein, 17 aa, Entamoeba dispar
WHGLLSLTHMILLYYFP

SEQ ID NO: 2509542 - protein, 18 aa, Entamoeba dispar
WHGLLSLTHMILLYYFPD

SEQ ID NO: 2509543 - protein, 22 aa, Entamoeba dispar
WHLEEGRWYPDTGFDENENICQ

SEQ ID NO: 2509544 - protein, 17 aa, Entamoeba dispar
WHPERKFVKKLTNQTRY

SEQ ID NO: 2509545 - protein, 19 aa, Entamoeba dispar
WHPHCFICSICNKPIEGDF

SEQ ID NO: 2509546 - protein, 19 aa, Entamoeba dispar
WHQVRYMVGALFAIGQGAN

SEQ ID NO: 2509547 - protein, 19 aa, Entamoeba dispar
WHSGMEFEEALELMKKCIK

SEQ ID NO: 2509548 - protein, 18 aa, Entamoeba dispar
WHVHSFMGRPKKEWLKPQ

SEQ ID NO: 2509549 - protein, 20 aa, Entamoeba dispar
WHVPCECLTTGFQTRLGVMV

SEQ ID NO: 2509550 - protein, 18 aa, Entamoeba dispar
WIAICAFAAQSRSAYQMI

SEQ ID NO: 2509551 - protein, 22 aa, Entamoeba dispar
WIAKMFDHIPVEFYHTEIEDSK

SEQ ID NO: 2509552 - protein, 27 aa, Entamoeba dispar
WIDIPKCPKCGGLIKLDVVLFGEELEK

SEQ ID NO: 2509553 - protein, 18 aa, Entamoeba dispar
WIDIRGGKYKNYKKLFMV

SEQ ID NO: 2509554 - protein, 19 aa, Entamoeba dispar
WIDVQLRWGDFDQHNIESY

SEQ ID NO: 2509555 - protein, 17 aa, Entamoeba dispar
WIEEKCKPFPMDPIIPY

SEQ ID NO: 2509556 - protein, 17 aa, Entamoeba dispar
WIELQLMSPTDSILQPL

SEQ ID NO: 2509557 - protein, 17 aa, Entamoeba dispar
WIERGRLYVKNGDVLSG

SEQ ID NO: 2509558 - protein, 25 aa, Entamoeba dispar
WIERLNGQCCWFEVIINGVVRIPKL

SEQ ID NO: 2509559 - protein, 18 aa, Entamoeba dispar
WIESILFKINCNEDNEYQ

SEQ ID NO: 2509560 - protein, 24 aa, Entamoeba dispar
WIFDCVNENFILPCGEYAIGQKLP

SEQ ID NO: 2509561 - protein, 17 aa, Entamoeba dispar
WIFDNRVYIGMEYCSQG

SEQ ID NO: 2509562 - protein, 17 aa, Entamoeba dispar
WIFKREKGMKLWADTTL

SEQ ID NO: 2509563 - protein, 22 aa, Entamoeba dispar
WIGCKTCKLIYDSNKGFTGDIL

SEQ ID NO: 2509564 - protein, 20 aa, Entamoeba dispar
WIGIKSCLLTSTPMVASIQY

SEQ ID NO: 2509565 - protein, 17 aa, Entamoeba dispar
WIGNTVVIVMSNRSGDG

SEQ ID NO: 2509566 - protein, 17 aa, Entamoeba dispar
WIHRDIKPDNFIMGNGE

SEQ ID NO: 2509567 - protein, 17 aa, Entamoeba dispar
WIIEIIQGISITIYPPQ

SEQ ID NO: 2509568 - protein, 28 aa, Entamoeba dispar
WIKCASGNKFRMGNLFIVGPTKTGKTEF

SEQ ID NO: 2509569 - protein, 17 aa, Entamoeba dispar
WILFYELVLTTKEYVRQ

SEQ ID NO: 2509570 - protein, 17 aa, Entamoeba dispar
WILSPVLHTSYRLLEKK

SEQ ID NO: 2509571 - protein, 20 aa, Entamoeba dispar
WINKMRLIIGTEVDEIAPKI

SEQ ID NO: 2509572 - protein, 26 aa, Entamoeba dispar
WINQKDRIMHLFSVFVPKEKTGIVYI

SEQ ID NO: 2509573 - protein, 17 aa, Entamoeba dispar
WINVEMDKVRTLREQPE

SEQ ID NO: 2509574 - protein, 22 aa, Entamoeba dispar
WIPEIYRVAPGASIILVSTKKD

SEQ ID NO: 2509575 - protein, 27 aa, Entamoeba dispar
WIRIGKAEILPGVLFIDEVHMLDLECF

SEQ ID NO: 2509576 - protein, 18 aa, Entamoeba dispar
WIRNCFFGDVDIANVIIK

SEQ ID NO: 2509577 - protein, 20 aa, Entamoeba dispar
WISERCEAVKVFLKEFTDVE

SEQ ID NO: 2509578 - protein, 19 aa, Entamoeba dispar
WISHFPVNIFNSSLNFLRM

SEQ ID NO: 2509579 - protein, 18 aa, Entamoeba dispar
WITQHFKNQLNIIVIYLN

SEQ ID NO: 2509580 - protein, 18 aa, Entamoeba dispar
WITTKLVELIPKYTTSHQ

SEQ ID NO: 2509581 - protein, 18 aa, Entamoeba dispar
WIVAPIVKTTTRIIKDNN

SEQ ID NO: 2509582 - protein, 23 aa, Entamoeba dispar
WIVLCPSSVIPVFSEAATQATLL

SEQ ID NO: 2509583 - protein, 17 aa, Entamoeba dispar
WIVSEACTHTLRNDINA

SEQ ID NO: 2509584 - protein, 27 aa, Entamoeba dispar
WIVSGKTWKCCLCGHINTQLTERYLQL

SEQ ID NO: 2509585 - protein, 20 aa, Entamoeba dispar
WIYKQFSVVNEISYEIIRKV

SEQ ID NO: 2509586 - protein, 17 aa, Entamoeba dispar
WIYTYGYLVEGIFRVSG

SEQ ID NO: 2509587 - protein, 20 aa, Entamoeba dispar
WKALQTRAKEFEDFDWLEKN

SEQ ID NO: 2509588 - protein, 24 aa, Entamoeba dispar
WKCSQCGKKVNARQKCIIEYPPNV

SEQ ID NO: 2509589 - protein, 17 aa, Entamoeba dispar
WKDGTKIRFEGYGDESP

SEQ ID NO: 2509590 - protein, 18 aa, Entamoeba dispar
WKDGVALVKLTEAVSGGQ

SEQ ID NO: 2509591 - protein, 22 aa, Entamoeba dispar
WKDKEMELNGLVLHSGTTEMGH

SEQ ID NO: 2509592 - protein, 23 aa, Entamoeba dispar
WKDLVDGIIVCWINGEQCGNAVA

SEQ ID NO: 2509593 - protein, 25 aa, Entamoeba dispar
WKEALKVCVELGLQKEALNCCSSCN

SEQ ID NO: 2509594 - protein, 17 aa, Entamoeba dispar
WKEECEKTIQLFDYSIF

SEQ ID NO: 2509595 - protein, 20 aa, Entamoeba dispar
WKEELFNLVYERFIESHQVT

SEQ ID NO: 2509596 - protein, 17 aa, Entamoeba dispar
WKEETGEVFGVYIQEEI

SEQ ID NO: 2509597 - protein, 21 aa, Entamoeba dispar
WKEFDLSNIIVMILSLIIEQP

SEQ ID NO: 2509598 - protein, 18 aa, Entamoeba dispar
WKEIKEGINTFTNLEELR

SEQ ID NO: 2509599 - protein, 20 aa, Entamoeba dispar
WKEIKKNKCVIALIENNLKI

SEQ ID NO: 2509600 - protein, 22 aa, Entamoeba dispar
WKEKIKNFEVMNSMIKEKEEKL

SEQ ID NO: 2509601 - protein, 17 aa, Entamoeba dispar
WKEKVVVVGVDMSSDEY

SEQ ID NO: 2509602 - protein, 19 aa, Entamoeba dispar
WKELVFLYVQVDQVKAIET

SEQ ID NO: 2509603 - protein, 25 aa, Entamoeba dispar
WKEPTEILKSILFFIFKEKKEKIIN

SEQ ID NO: 2509604 - protein, 19 aa, Entamoeba dispar
WKERGRGDIKILRHPKTQY

SEQ ID NO: 2509605 - protein, 19 aa, Entamoeba dispar
WKESDKWIETMFDRTDELF

SEQ ID NO: 2509606 - protein, 20 aa, Entamoeba dispar
WKESFSISYEQLIPFNSKFV

SEQ ID NO: 2509607 - protein, 17 aa, Entamoeba dispar
WKFSNFKDGVFSEIFHV

SEQ ID NO: 2509608 - protein, 19 aa, Entamoeba dispar
WKGAMKHLGGRDYSDVHTI

SEQ ID NO: 2509609 - protein, 17 aa, Entamoeba dispar
WKGAMKHLSGRDYSDVH

SEQ ID NO: 2509610 - protein, 20 aa, Entamoeba dispar
WKGDITKLKIDSIVNAANNT

SEQ ID NO: 2509611 - protein, 20 aa, Entamoeba dispar
WKGKFRNEKYVEFAVGLGKV

SEQ ID NO: 2509612 - protein, 20 aa, Entamoeba dispar
WKGNKCLFEILFSEQAIVCW

SEQ ID NO: 2509613 - protein, 21 aa, Entamoeba dispar
WKGTCNEKKGLFNITCATTSM

SEQ ID NO: 2509614 - protein, 19 aa, Entamoeba dispar
WKHPNIVGFEGCWIFDNRV

SEQ ID NO: 2509615 - protein, 19 aa, Entamoeba dispar
WKILLGIYKIDSFEYCDSG

SEQ ID NO: 2509616 - protein, 17 aa, Entamoeba dispar
WKIPGRAPPSVITERGM

SEQ ID NO: 2509617 - protein, 19 aa, Entamoeba dispar
WKISHSPIITTSRPSSGNT

SEQ ID NO: 2509618 - protein, 21 aa, Entamoeba dispar
WKKESLLSLILNYSPYPISRQ

SEQ ID NO: 2509619 - protein, 18 aa, Entamoeba dispar
WKKGKLVTRYKCNPLGTA

SEQ ID NO: 2509620 - protein, 29 aa, Entamoeba dispar
WKKKGDPFWNSTFSFSFKNANNINIQIKD

SEQ ID NO: 2509621 - protein, 18 aa, Entamoeba dispar
WKKKLYITTEHPLPSELI

SEQ ID NO: 2509622 - protein, 17 aa, Entamoeba dispar
WKKLGEIPQFFVSTENL

SEQ ID NO: 2509623 - protein, 18 aa, Entamoeba dispar
WKKMMSMTTKMMIMTMKT

SEQ ID NO: 2509624 - protein, 30 aa, Entamoeba dispar
WKKNMPTVRPCFAVKCNPEPHLVKLLGNLG

SEQ ID NO: 2509625 - protein, 30 aa, Entamoeba dispar
WKKQNEWYLSYLKRNCCENDVSLIWNCLGT

SEQ ID NO: 2509626 - protein, 20 aa, Entamoeba dispar
WKKRMQELYNKKDVVPKSQL

SEQ ID NO: 2509627 - protein, 20 aa, Entamoeba dispar
WKLCSGCVEIGDGSFETSTI

SEQ ID NO: 2509628 - protein, 21 aa, Entamoeba dispar
WKLDSEIAMTFLMSDKTVEFV

SEQ ID NO: 2509629 - protein, 18 aa, Entamoeba dispar
WKLISDITKLMGNRFYIN

SEQ ID NO: 2509630 - protein, 22 aa, Entamoeba dispar
WKLNEKEIKKMGSMVAASSFYL

SEQ ID NO: 2509631 - protein, 17 aa, Entamoeba dispar
WKLNIYDSIFQIIQLTT

SEQ ID NO: 2509632 - protein, 22 aa, Entamoeba dispar
WKLPMYCPVCIQEIDVNQMSIE

SEQ ID NO: 2509633 - protein, 17 aa, Entamoeba dispar
WKLVRLLVNNGLSPNEQ

SEQ ID NO: 2509634 - protein, 25 aa, Entamoeba dispar
WKMMVTQICSRRGFSDVLVVGAAKE

SEQ ID NO: 2509635 - protein, 21 aa, Entamoeba dispar
WKNGMTYNRVGTLYYIYADDL

SEQ ID NO: 2509636 - protein, 24 aa, Entamoeba dispar
WKNIRKNILFVFGTLDFCPHQKVN

SEQ ID NO: 2509637 - protein, 24 aa, Entamoeba dispar
WKNKSNCPCRMRACCSTFTKYCKE

SEQ ID NO: 2509638 - protein, 21 aa, Entamoeba dispar
WKNNLIEITDQFKIICENLVN

SEQ ID NO: 2509639 - protein, 20 aa, Entamoeba dispar
WKNNSLIIAQGLRDRYMEDP

SEQ ID NO: 2509640 - protein, 24 aa, Entamoeba dispar
WKNRIKRYHWEIFKINESNDKLPF

SEQ ID NO: 2509641 - protein, 18 aa, Entamoeba dispar
WKNSCIDSLEGVFEIIPK

SEQ ID NO: 2509642 - protein, 17 aa, Entamoeba dispar
WKPKMIKELEHVEYQPN

SEQ ID NO: 2509643 - protein, 17 aa, Entamoeba dispar
WKPLPGYIKQESSGNYS

SEQ ID NO: 2509644 - protein, 18 aa, Entamoeba dispar
WKPTISIKQILVGVQDLL

SEQ ID NO: 2509645 - protein, 18 aa, Entamoeba dispar
WKPVKEVKCHDAEVWTVA

SEQ ID NO: 2509646 - protein, 21 aa, Entamoeba dispar
WKQDLCKCIAHNTFSNEESIF

SEQ ID NO: 2509647 - protein, 24 aa, Entamoeba dispar
WKQQGKRVLSSFCDSQTIYIGQCE

SEQ ID NO: 2509648 - protein, 24 aa, Entamoeba dispar
WKQVIKEYIGFVIEQSKNLSWSEF

SEQ ID NO: 2509649 - protein, 18 aa, Entamoeba dispar
WKSIINDQIEAIKGREEK

SEQ ID NO: 2509650 - protein, 17 aa, Entamoeba dispar
WKSISKDAIIRMKKTSD

SEQ ID NO: 2509651 - protein, 18 aa, Entamoeba dispar
WKSLEKLYINYCGITSLK

SEQ ID NO: 2509652 - protein, 25 aa, Entamoeba dispar
WKSQECIDLITLLLYKGDYLFFKDI

SEQ ID NO: 2509653 - protein, 29 aa, Entamoeba dispar
WKTALNRKKEWRVIGALFNDSFEVGIDEY

SEQ ID NO: 2509654 - protein, 18 aa, Entamoeba dispar
WKTAMKKYGYEKLDEIST

SEQ ID NO: 2509655 - protein, 21 aa, Entamoeba dispar
WKTNLDFIIQICTGMKKLHSI

SEQ ID NO: 2509656 - protein, 19 aa, Entamoeba dispar
WKTQTLWIRLFRGKEKLIS

SEQ ID NO: 2509657 - protein, 18 aa, Entamoeba dispar
WKTSITVVKICDFGSSRI

SEQ ID NO: 2509658 - protein, 25 aa, Entamoeba dispar
WKTTPKRFSEFEAFHNLIKYVTNDP

SEQ ID NO: 2509659 - protein, 18 aa, Entamoeba dispar
WKTWDSVLELAIPKLINS

SEQ ID NO: 2509660 - protein, 17 aa, Entamoeba dispar
WKTYCTEVDAVIYIVDC

SEQ ID NO: 2509661 - protein, 34 aa, Entamoeba dispar
WKTYMLEYFMLWFCRCFHPEFEVRILDLILMEGW

SEQ ID NO: 2509662 - protein, 20 aa, Entamoeba dispar
WKVGDVNYVLAIGGSCSNPF

SEQ ID NO: 2509663 - protein, 19 aa, Entamoeba dispar
WKVKEKEWKEQLEKSQKEK

SEQ ID NO: 2509664 - protein, 17 aa, Entamoeba dispar
WKWLNEKVVSTLQQEVE

SEQ ID NO: 2509665 - protein, 21 aa, Entamoeba dispar
WKYNDTRVWEVCCLRGHSSIV

SEQ ID NO: 2509666 - protein, 26 aa, Entamoeba dispar
WLAELCYLVNGALVLKGEFIQEIGER

SEQ ID NO: 2509667 - protein, 24 aa, Entamoeba dispar
WLCEKGIESINFFSGGINFHSRRE

SEQ ID NO: 2509668 - protein, 30 aa, Entamoeba dispar
WLCKTVPNLSRRAIEHFDIDLTRNNPNGRE

SEQ ID NO: 2509669 - protein, 17 aa, Entamoeba dispar
WLDCDREGENISFEVIE

SEQ ID NO: 2509670 - protein, 18 aa, Entamoeba dispar
WLDDEKMKIFTINLNKPI

SEQ ID NO: 2509671 - protein, 17 aa, Entamoeba dispar
WLDYVLLDCCERMVYLT

SEQ ID NO: 2509672 - protein, 18 aa, Entamoeba dispar
WLEENGVNCAVLENGMKE

SEQ ID NO: 2509673 - protein, 19 aa, Entamoeba dispar
WLEVNPLWDGKIIFCCYNL

SEQ ID NO: 2509674 - protein, 17 aa, Entamoeba dispar
WLEYSKTQNFSMFNKWN

SEQ ID NO: 2509675 - protein, 22 aa, Entamoeba dispar
WLFPEIYVLEGGFKSFYKRNNE

SEQ ID NO: 2509676 - protein, 17 aa, Entamoeba dispar
WLFTDSYFQKTTLLDSE

SEQ ID NO: 2509677 - protein, 17 aa, Entamoeba dispar
WLGDIIHAHTAFSSNRS

SEQ ID NO: 2509678 - protein, 19 aa, Entamoeba dispar
WLGVLPTPISVSWIEVIKQ

SEQ ID NO: 2509679 - protein, 21 aa, Entamoeba dispar
WLIKIWSIVCLTHLIEEEETI

SEQ ID NO: 2509680 - protein, 19 aa, Entamoeba dispar
WLINTVKTNNFWEVFDEQE

SEQ ID NO: 2509681 - protein, 22 aa, Entamoeba dispar
WLKDHQISFVFVNNLFIPNPDF

SEQ ID NO: 2509682 - protein, 27 aa, Entamoeba dispar
WLKHIKKIIKGVCELCTSIINGNSVLV

SEQ ID NO: 2509683 - protein, 17 aa, Entamoeba dispar
WLKNCIKEFSSSFKTNE

SEQ ID NO: 2509684 - protein, 20 aa, Entamoeba dispar
WLKNSIEFISVFEEAVDSVE

SEQ ID NO: 2509685 - protein, 21 aa, Entamoeba dispar
WLKQRFPKIIDDCQPSSQEKY

SEQ ID NO: 2509686 - protein, 17 aa, Entamoeba dispar
WLKRILKVEKTGHSGTL

SEQ ID NO: 2509687 - protein, 18 aa, Entamoeba dispar
WLLENSVEGLEMKFCYER

SEQ ID NO: 2509688 - protein, 17 aa, Entamoeba dispar
WLLQALFGIKIAYRCVV

SEQ ID NO: 2509689 - protein, 20 aa, Entamoeba dispar
WLMEDPFQFTRVEGTLSRLQ

SEQ ID NO: 2509690 - protein, 23 aa, Entamoeba dispar
WLNCIESCIQRFGSNVSNWKIDK

SEQ ID NO: 2509691 - protein, 18 aa, Entamoeba dispar
WLNEKVVSTLQQEVERDA

SEQ ID NO: 2509692 - protein, 22 aa, Entamoeba dispar
WLPKEHWSYFSKATILFAKYIC

SEQ ID NO: 2509693 - protein, 17 aa, Entamoeba dispar
WLRAPVMLGTNDDFNDK

SEQ ID NO: 2509694 - protein, 20 aa, Entamoeba dispar
WLRKHLFRPNILLSAVEKHI

SEQ ID NO: 2509695 - protein, 17 aa, Entamoeba dispar
WLRRPIQITCRFYQLGL

SEQ ID NO: 2509696 - protein, 27 aa, Entamoeba dispar
WLSIPFRRKRMALLDFCRTEVEPIAAS

SEQ ID NO: 2509697 - protein, 17 aa, Entamoeba dispar
WLSNSSFIVGDELGNLN

SEQ ID NO: 2509698 - protein, 26 aa, Entamoeba dispar
WLSPELKEILKDAGVKPKHLADPTIV

SEQ ID NO: 2509699 - protein, 19 aa, Entamoeba dispar
WLTSQIHVGMIISPKWVRM

SEQ ID NO: 2509700 - protein, 20 aa, Entamoeba dispar
WLVHGYCLAPALVLSLNIAS

SEQ ID NO: 2509701 - protein, 17 aa, Entamoeba dispar
WLWNDLLGMESIVDEEK

SEQ ID NO: 2509702 - protein, 19 aa, Entamoeba dispar
WMCVKDGWICFKNSQLLCG

SEQ ID NO: 2509703 - protein, 22 aa, Entamoeba dispar
WMEEDDLLGLCLCTDETKTILQ

SEQ ID NO: 2509704 - protein, 20 aa, Entamoeba dispar
WMEKWKEKKDIIWKMKNNNN

SEQ ID NO: 2509705 - protein, 20 aa, Entamoeba dispar
WMFYCCSEEISLYDYNPSTQ

SEQ ID NO: 2509706 - protein, 25 aa, Entamoeba dispar
WMIKVLRIVLIIGEKYKSSNENVYA

SEQ ID NO: 2509707 - protein, 19 aa, Entamoeba dispar
WMLVRCHYPEITLITKSLL

SEQ ID NO: 2509708 - protein, 23 aa, Entamoeba dispar
WMSCGELLYNEFFIKKEEEKYIF

SEQ ID NO: 2509709 - protein, 24 aa, Entamoeba dispar
WMSRQCILILPGHEHYVMSAFFHP

SEQ ID NO: 2509710 - protein, 18 aa, Entamoeba dispar
WNDLSQHIICFPSQNICR

SEQ ID NO: 2509711 - protein, 24 aa, Entamoeba dispar
WNEDLSDVILLRLDMFPDEKDTVI

SEQ ID NO: 2509712 - protein, 17 aa, Entamoeba dispar
WNEHLGFGIFSKKWFGN

SEQ ID NO: 2509713 - protein, 18 aa, Entamoeba dispar
WNELVSFLEQLNYEDYCL

SEQ ID NO: 2509714 - protein, 17 aa, Entamoeba dispar
WNGLKFVDSDGLFIVPK

SEQ ID NO: 2509715 - protein, 19 aa, Entamoeba dispar
WNGYFPTIIEILRDPRPLQ

SEQ ID NO: 2509716 - protein, 17 aa, Entamoeba dispar
WNIFLQITFGLRYLHSI

SEQ ID NO: 2509717 - protein, 19 aa, Entamoeba dispar
WNIIGNGIIKFNYKEGIQP

SEQ ID NO: 2509718 - protein, 27 aa, Entamoeba dispar
WNIITQCWDHIPSKRPPFKDITIILQN

SEQ ID NO: 2509719 - protein, 22 aa, Entamoeba dispar
WNITFKTVEGILNENDFISSNN

SEQ ID NO: 2509720 - protein, 19 aa, Entamoeba dispar
WNIVKSIFFNSKVVKDLFV

SEQ ID NO: 2509721 - protein, 23 aa, Entamoeba dispar
WNKDKDCILYVLKMINSNSSRYT

SEQ ID NO: 2509722 - protein, 19 aa, Entamoeba dispar
WNKGDCVIDSEFLVYNKTD

SEQ ID NO: 2509723 - protein, 17 aa, Entamoeba dispar
WNKLFKQIGKLVIEGDE

SEQ ID NO: 2509724 - protein, 17 aa, Entamoeba dispar
WNKLVDMVDDWQELSKI

SEQ ID NO: 2509725 - protein, 17 aa, Entamoeba dispar
WNKVEVLIIDEISMIDG

SEQ ID NO: 2509726 - protein, 17 aa, Entamoeba dispar
WNLLGKIQGCTDIELTS

SEQ ID NO: 2509727 - protein, 17 aa, Entamoeba dispar
WNQAWEIVVQTFAYTNH

SEQ ID NO: 2509728 - protein, 24 aa, Entamoeba dispar
WNQDEMFRLYQFMRNDKECSLVLE

SEQ ID NO: 2509729 - protein, 25 aa, Entamoeba dispar
WNQLSTSAQNVFKEMFKTKGQYQEL

SEQ ID NO: 2509730 - protein, 17 aa, Entamoeba dispar
WNRKFAKKKGLKSVDQS

SEQ ID NO: 2509731 - protein, 17 aa, Entamoeba dispar
WNRKFNIKKGKKCINQD

SEQ ID NO: 2509732 - protein, 19 aa, Entamoeba dispar
WNSEMKNGVGVFIGTMAES

SEQ ID NO: 2509733 - protein, 26 aa, Entamoeba dispar
WNSSCRVYTFTVKRFMRITKKTEKSH

SEQ ID NO: 2509734 - protein, 25 aa, Entamoeba dispar
WNTFYGLNCGKEFIEYLSNFKNPIC

SEQ ID NO: 2509735 - protein, 17 aa, Entamoeba dispar
WNTLLSESREDIFVPRL

SEQ ID NO: 2509736 - protein, 25 aa, Entamoeba dispar
WNTMKLKLIMPKGIWEEDVEGYMID

SEQ ID NO: 2509737 - protein, 18 aa, Entamoeba dispar
WNVISYDFCADIVREYLY

SEQ ID NO: 2509738 - protein, 23 aa, Entamoeba dispar
WNVLPAEIFMKLFRQDIAVASLF

SEQ ID NO: 2509739 - protein, 25 aa, Entamoeba dispar
WNVLPRPLFYKLFRQDLLIASLYRN

SEQ ID NO: 2509740 - protein, 19 aa, Entamoeba dispar
WNVRARYEHDIGLDDIKWL

SEQ ID NO: 2509741 - protein, 23 aa, Entamoeba dispar
WNVYYKRISILKNRKIDMDRHFE

SEQ ID NO: 2509742 - protein, 17 aa, Entamoeba dispar
WPDDAFIQYPKQFVKKV

SEQ ID NO: 2509743 - protein, 23 aa, Entamoeba dispar
WPESYRYLCYSLYSECEKTTILQ

SEQ ID NO: 2509744 - protein, 17 aa, Entamoeba dispar
WPEVKLPKFNEGDDDRD

SEQ ID NO: 2509745 - protein, 17 aa, Entamoeba dispar
WPHRFAAVTSLAQVIQH

SEQ ID NO: 2509746 - protein, 19 aa, Entamoeba dispar
WPIIKYRSSNELIEAVTSV

SEQ ID NO: 2509747 - protein, 21 aa, Entamoeba dispar
WPITHSKEFKKLGIRPSHGVL

SEQ ID NO: 2509748 - protein, 17 aa, Entamoeba dispar
WPKAWGLSVDEMLQNIK

SEQ ID NO: 2509749 - protein, 18 aa, Entamoeba dispar
WPLECLASVLSVVQMNKK

SEQ ID NO: 2509750 - protein, 17 aa, Entamoeba dispar
WPNRIANGCYRYQGQEY

SEQ ID NO: 2509751 - protein, 18 aa, Entamoeba dispar
WPQGIIMKGNYKQLYRFQ

SEQ ID NO: 2509752 - protein, 21 aa, Entamoeba dispar
WPQSHFDQLMFITGQYASNPI

SEQ ID NO: 2509753 - protein, 18 aa, Entamoeba dispar
WPSLLKIDNFLVEFITPI

SEQ ID NO: 2509754 - protein, 18 aa, Entamoeba dispar
WPTVKPLPGAIRILNYFK

SEQ ID NO: 2509755 - protein, 20 aa, Entamoeba dispar
WPVKSAQFILKLLKNAVDNA

SEQ ID NO: 2509756 - protein, 20 aa, Entamoeba dispar
WQFEIIKECIFNTETYVEYC

SEQ ID NO: 2509757 - protein, 25 aa, Entamoeba dispar
WQGRCKGKEGIFPKNHVQELLKVFQ

SEQ ID NO: 2509758 - protein, 18 aa, Entamoeba dispar
WQHILIPILPLFLSSYLS

SEQ ID NO: 2509759 - protein, 30 aa, Entamoeba dispar
WQHKPWICCFCKQVCYWEDIELNIRLQEII

SEQ ID NO: 2509760 - protein, 24 aa, Entamoeba dispar
WQKMVYEGLQWAFANRPEQIQNNS

SEQ ID NO: 2509761 - protein, 17 aa, Entamoeba dispar
WQLFRNLDLPAIQATKC

SEQ ID NO: 2509762 - protein, 18 aa, Entamoeba dispar
WQLFSSLLQRKTLKNVIK

SEQ ID NO: 2509763 - protein, 17 aa, Entamoeba dispar
WQLKLTFIESVLHQADN

SEQ ID NO: 2509764 - protein, 19 aa, Entamoeba dispar
WQLVYKCIYNVYSKPFEEY

SEQ ID NO: 2509765 - protein, 25 aa, Entamoeba dispar
WQMKECKRKILSIMCKCISDEELDE

SEQ ID NO: 2509766 - protein, 18 aa, Entamoeba dispar
WQNIPIHWYFGSQRRYTD

SEQ ID NO: 2509767 - protein, 18 aa, Entamoeba dispar
WQSLEIVNDLSFDIKDGV

SEQ ID NO: 2509768 - protein, 22 aa, Entamoeba dispar
WQTEAKKWCPPVTLYSIHHMSP

SEQ ID NO: 2509769 - protein, 17 aa, Entamoeba dispar
WQTRTSLPNVHRCGVKS

SEQ ID NO: 2509770 - protein, 19 aa, Entamoeba dispar
WRDEVIKSQVIISSQIISA

SEQ ID NO: 2509771 - protein, 23 aa, Entamoeba dispar
WRDGDDIKTYAFGKNDVVHVSGK

SEQ ID NO: 2509772 - protein, 21 aa, Entamoeba dispar
WRECTEFCTSKTCLIADKLMD

SEQ ID NO: 2509773 - protein, 17 aa, Entamoeba dispar
WREEMEEVQTIRKWIKC

SEQ ID NO: 2509774 - protein, 19 aa, Entamoeba dispar
WRHYYEGTQGLVFVIDSSD

SEQ ID NO: 2509775 - protein, 19 aa, Entamoeba dispar
WRIIRENLNIFVNNNEVIK

SEQ ID NO: 2509776 - protein, 17 aa, Entamoeba dispar
WRIPVLTRPVSFTLVRQ

SEQ ID NO: 2509777 - protein, 19 aa, Entamoeba dispar
WRIRARLIYLNSKYKGLLE

SEQ ID NO: 2509778 - protein, 17 aa, Entamoeba dispar
WRKNNLLDHLSYYVDPE

SEQ ID NO: 2509779 - protein, 17 aa, Entamoeba dispar
WRKSLKEKAVTLGKDLG

SEQ ID NO: 2509780 - protein, 18 aa, Entamoeba dispar
WRKSLKEKAVTLGKDLGI

SEQ ID NO: 2509781 - protein, 17 aa, Entamoeba dispar
WRNVYGFNMTPMRAEVL

SEQ ID NO: 2509782 - protein, 17 aa, Entamoeba dispar
WRPSISVKQILLGIQEL

SEQ ID NO: 2509783 - protein, 21 aa, Entamoeba dispar
WRTDIKNFVFYDLKPLDRWTA

SEQ ID NO: 2509784 - protein, 18 aa, Entamoeba dispar
WRTMSDWGNIISYNTSLN

SEQ ID NO: 2509785 - protein, 24 aa, Entamoeba dispar
WRVIEKYFKITYFINIHSRRCNIY

SEQ ID NO: 2509786 - protein, 18 aa, Entamoeba dispar
WRVLNSTFSRMLLFIETT

SEQ ID NO: 2509787 - protein, 19 aa, Entamoeba dispar
WRYLVPFYIRCGLHPIEDV

SEQ ID NO: 2509788 - protein, 21 aa, Entamoeba dispar
WSASEIAAFVSYIATYAKKNE

SEQ ID NO: 2509789 - protein, 21 aa, Entamoeba dispar
WSDALKRYGYENLPVDTFMTI

SEQ ID NO: 2509790 - protein, 21 aa, Entamoeba dispar
WSDALKRYGYENLPVDTFMTL

SEQ ID NO: 2509791 - protein, 18 aa, Entamoeba dispar
WSDFIVCSTYQGDIVLLG

SEQ ID NO: 2509792 - protein, 62 aa, Entamoeba dispar
WSEIYLHELDKCGFIGLYYNQLHQWTGLTAPRVIYSCSNFRRIEVLHLNNAICNKPNVMIII

SEQ ID NO: 2509793 - protein, 20 aa, Entamoeba dispar
WSFIIMELIETGCLLDYLYK

SEQ ID NO: 2509794 - protein, 18 aa, Entamoeba dispar
WSGNENILYTSSRDRLIN

SEQ ID NO: 2509795 - protein, 24 aa, Entamoeba dispar
WSGNYRFVTSLAIKDIVSETHPQY

SEQ ID NO: 2509796 - protein, 20 aa, Entamoeba dispar
WSIESSRVIVSFSDHITQQI

SEQ ID NO: 2509797 - protein, 18 aa, Entamoeba dispar
WSIGCIFAEMARGEILFA

SEQ ID NO: 2509798 - protein, 21 aa, Entamoeba dispar
WSIHPYKQYLCTIISSQTIHL

SEQ ID NO: 2509799 - protein, 22 aa, Entamoeba dispar
WSIPLHRGGGEFMMMLNEAVSF

SEQ ID NO: 2509800 - protein, 23 aa, Entamoeba dispar
WSLGIILLRFWLGYKEASSPEEY

SEQ ID NO: 2509801 - protein, 24 aa, Entamoeba dispar
WSLVPQGMCGKCYVKDLINDFWKR

SEQ ID NO: 2509802 - protein, 26 aa, Entamoeba dispar
WSMYLEKKMCIAIEFAPNGSLGHILK

SEQ ID NO: 2509803 - protein, 17 aa, Entamoeba dispar
WSNIEFPIPSCFRVNKS

SEQ ID NO: 2509804 - protein, 17 aa, Entamoeba dispar
WSPDSRMLVSASKDSTV

SEQ ID NO: 2509805 - protein, 18 aa, Entamoeba dispar
WSPKGERLAVVTLNGNVI

SEQ ID NO: 2509806 - protein, 25 aa, Entamoeba dispar
WSPKTQESIKMSVCQPNESVEITSI

SEQ ID NO: 2509807 - protein, 17 aa, Entamoeba dispar
WSSGVLLFVMVCGYPPF

SEQ ID NO: 2509808 - protein, 17 aa, Entamoeba dispar
WSSIPIIVTEKIELSNV

SEQ ID NO: 2509809 - protein, 17 aa, Entamoeba dispar
WSSIRVEILQFIEKVLT

SEQ ID NO: 2509810 - protein, 17 aa, Entamoeba dispar
WSSMSFNTGFPLVAKVG

SEQ ID NO: 2509811 - protein, 17 aa, Entamoeba dispar
WSSPVVPIEKWEMKYPN

SEQ ID NO: 2509812 - protein, 17 aa, Entamoeba dispar
WSYSYCLPLLVITYGNG

SEQ ID NO: 2509813 - protein, 17 aa, Entamoeba dispar
WTAFAVGYLKTACGVMV

SEQ ID NO: 2509814 - protein, 18 aa, Entamoeba dispar
WTATWPQAIQQFALGFMF

SEQ ID NO: 2509815 - protein, 17 aa, Entamoeba dispar
WTDHLQVARFVKYLWTQ

SEQ ID NO: 2509816 - protein, 21 aa, Entamoeba dispar
WTDIYLFDYRKLMISGNYSQA

SEQ ID NO: 2509817 - protein, 18 aa, Entamoeba dispar
WTDPDGCRSLIINEDTID

SEQ ID NO: 2509818 - protein, 19 aa, Entamoeba dispar
WTDRRGVHEPNYYGSYTQS

SEQ ID NO: 2509819 - protein, 17 aa, Entamoeba dispar
WTEDIKQLLTLVNDTCF

SEQ ID NO: 2509820 - protein, 23 aa, Entamoeba dispar
WTFWDCSISSFKDVFNQYLPFNP

SEQ ID NO: 2509821 - protein, 22 aa, Entamoeba dispar
WTGLEKYKIIFNEKITSLTNER

SEQ ID NO: 2509822 - protein, 19 aa, Entamoeba dispar
WTIEQEGKKVYCGLLKQRT

SEQ ID NO: 2509823 - protein, 24 aa, Entamoeba dispar
WTIPKCIKELQLLKVNPVVVQNTM

SEQ ID NO: 2509824 - protein, 21 aa, Entamoeba dispar
WTKKGNLTPLINRADGDDPAR

SEQ ID NO: 2509825 - protein, 21 aa, Entamoeba dispar
WTKYIKLPRLVRCKYEKDSMR

SEQ ID NO: 2509826 - protein, 25 aa, Entamoeba dispar
WTLDSLKLYLNQVMYNMGISNVNAI

SEQ ID NO: 2509827 - protein, 18 aa, Entamoeba dispar
WTLTQQFLDDEFAGLMGA

SEQ ID NO: 2509828 - protein, 22 aa, Entamoeba dispar
WTNGCTACVVLLVGKRLYTANL

SEQ ID NO: 2509829 - protein, 23 aa, Entamoeba dispar
WTNGCTACVVLLVGKRLYTANLG

SEQ ID NO: 2509830 - protein, 21 aa, Entamoeba dispar
WTPFLRCLFEIERLRQIASGW

SEQ ID NO: 2509831 - protein, 24 aa, Entamoeba dispar
WTPKEYELFRFSSLQNELVLGGVY

SEQ ID NO: 2509832 - protein, 19 aa, Entamoeba dispar
WTPVLFDMTTFLLKMKEAN

SEQ ID NO: 2509833 - protein, 19 aa, Entamoeba dispar
WTSDMKQPHIDRIVFGSNF

SEQ ID NO: 2509834 - protein, 25 aa, Entamoeba dispar
WTSGHIWKGTITLVRPRTLKWSYSL

SEQ ID NO: 2509835 - protein, 26 aa, Entamoeba dispar
WTVDALKMYLNEVMYNIGVGKVDAIL

SEQ ID NO: 2509836 - protein, 19 aa, Entamoeba dispar
WTVREIDHLFVAGQQQPQK

SEQ ID NO: 2509837 - protein, 21 aa, Entamoeba dispar
WTYFRTARRLIVVDLQGVVNK

SEQ ID NO: 2509838 - protein, 17 aa, Entamoeba dispar
WVDGIVVKCMQRGYWLM

SEQ ID NO: 2509839 - protein, 17 aa, Entamoeba dispar
WVEEGSIGLSMIKGLGF

SEQ ID NO: 2509840 - protein, 17 aa, Entamoeba dispar
WVEKISLVFLKSNPSRI

SEQ ID NO: 2509841 - protein, 17 aa, Entamoeba dispar
WVETYSNLFGVGIVLCR

SEQ ID NO: 2509842 - protein, 19 aa, Entamoeba dispar
WVFGGDPFFDFVGDNKSKV

SEQ ID NO: 2509843 - protein, 18 aa, Entamoeba dispar
WVGKNECELIYSVHQLGS

SEQ ID NO: 2509844 - protein, 18 aa, Entamoeba dispar
WVICSYDSKDFRLSDIQM

SEQ ID NO: 2509845 - protein, 25 aa, Entamoeba dispar
WVIPDPLCLMCYLFPEIITHIDVVE

SEQ ID NO: 2509846 - protein, 21 aa, Entamoeba dispar
WVKEDWFQKKFIFIPQYQGDG

SEQ ID NO: 2509847 - protein, 21 aa, Entamoeba dispar
WVNGSDPVFRKALEENGQRGG

SEQ ID NO: 2509848 - protein, 25 aa, Entamoeba dispar
WVPEEKIVLFKAIVKLCHKIMLHSS

SEQ ID NO: 2509849 - protein, 23 aa, Entamoeba dispar
WVQCQKYPYLFGHNQAMQEWIES

SEQ ID NO: 2509850 - protein, 27 aa, Entamoeba dispar
WVQVACPRLSIDWGEDFRQVLITPYEA

SEQ ID NO: 2509851 - protein, 20 aa, Entamoeba dispar
WVRVQIKLFTLWMDEVLQQR

SEQ ID NO: 2509852 - protein, 17 aa, Entamoeba dispar
WVSGKMKGIDPVNPAQS

SEQ ID NO: 2509853 - protein, 17 aa, Entamoeba dispar
WVSVIGNCYNKVFTYNE

SEQ ID NO: 2509854 - protein, 18 aa, Entamoeba dispar
WVTLKMELLDEEDLDDSI

SEQ ID NO: 2509855 - protein, 24 aa, Entamoeba dispar
WVVKREEFNWSEVTRCVLSAIGNW

SEQ ID NO: 2509856 - protein, 20 aa, Entamoeba dispar
WVVPYVYWFEVIVKERWIGK

SEQ ID NO: 2509857 - protein, 17 aa, Entamoeba dispar
WWCTPYNFVKSFNIDYV

SEQ ID NO: 2509858 - protein, 19 aa, Entamoeba dispar
WWEKEGFFKPEYSSKSGKK

SEQ ID NO: 2509859 - protein, 19 aa, Entamoeba dispar
WWIYTYGYLVEGVFRVSGD

SEQ ID NO: 2509860 - protein, 19 aa, Entamoeba dispar
WWKDVKDSIGDRVKDVSER

SEQ ID NO: 2509861 - protein, 21 aa, Entamoeba dispar
WWMLTREILRYQGKLARDEKW

SEQ ID NO: 2509862 - protein, 19 aa, Entamoeba dispar
WYCQTSCTINGDGLYEGLD

SEQ ID NO: 2509863 - protein, 20 aa, Entamoeba dispar
WYESCGWCEDAIFFQQGTKF

SEQ ID NO: 2509864 - protein, 18 aa, Entamoeba dispar
WYETNGKILTEISEGKKI

SEQ ID NO: 2509865 - protein, 17 aa, Entamoeba dispar
WYFQKRIVHCKTQEERL

SEQ ID NO: 2509866 - protein, 19 aa, Entamoeba dispar
WYFSVCLSLTSITIPQSVS

SEQ ID NO: 2509867 - protein, 18 aa, Entamoeba dispar
WYGNQFEKFFGIGPQTQQ

SEQ ID NO: 2509868 - protein, 25 aa, Entamoeba dispar
WYGREIKMSPSLICINKNKEYLTPF

SEQ ID NO: 2509869 - protein, 18 aa, Entamoeba dispar
WYHTFCGDCLSNGKKRML

SEQ ID NO: 2509870 - protein, 21 aa, Entamoeba dispar
WYKEARAAINERVKKYYDNPE

SEQ ID NO: 2509871 - protein, 18 aa, Entamoeba dispar
WYLILCELSETLQKHKIH

SEQ ID NO: 2509872 - protein, 20 aa, Entamoeba dispar
WYLMKQFHFIEHIAISPEFR

SEQ ID NO: 2509873 - protein, 28 aa, Entamoeba dispar
WYNWLERDVYRYSLYFNLLKEKTAKELF

SEQ ID NO: 2509874 - protein, 17 aa, Entamoeba dispar
WYPDTGFDENENICQTV

SEQ ID NO: 2509875 - protein, 18 aa, Entamoeba dispar
WYQLLIKYWSGYSTITPR

SEQ ID NO: 2509876 - protein, 18 aa, Entamoeba dispar
WYRAPEVILGCQWTNKID

SEQ ID NO: 2509877 - protein, 20 aa, Entamoeba dispar
WYRPPEILLGATHYEASVDI

SEQ ID NO: 2509878 - protein, 17 aa, Entamoeba dispar
WYSQIVVQSGLIEYYDI

SEQ ID NO: 2509879 - protein, 33 aa, Entamoeba dispar
WYSSLTFIKRLKCFSDKEIMLFSRIKDIFNNEE

SEQ ID NO: 2509880 - protein, 19 aa, Entamoeba dispar
WYTSHSLKERERIIREVSN

SEQ ID NO: 2509881 - protein, 19 aa, Entamoeba dispar
WYTVKACYYNPLTKSIDTV

SEQ ID NO: 2509882 - protein, 18 aa, Entamoeba dispar
WYVSCERVAQGMMERGFL

SEQ ID NO: 2509883 - protein, 18 aa, Entamoeba dispar
WYYGGGLYMGKKMPEVCS

SEQ ID NO: 2509884 - protein, 17 aa, Entamoeba dispar
  misc_feature (1)..(1): Xaa can be any naturally occurring amino acid
XYYSSVFGIRWIKMLFA

SEQ ID NO: 2509885 - protein, 27 aa, Entamoeba dispar
YAASLSSQCPQGFSISKRERMTKKLYG

SEQ ID NO: 2509886 - protein, 17 aa, Entamoeba dispar
YAASRLVTYGSYDVFEL

SEQ ID NO: 2509887 - protein, 21 aa, Entamoeba dispar
YAAWNPDFLLSVLLGNQTATC

SEQ ID NO: 2509888 - protein, 20 aa, Entamoeba dispar
YADIIKLHFEKPFEQEEGDV

SEQ ID NO: 2509889 - protein, 17 aa, Entamoeba dispar
YADSDVVLLCFAVNNRT

SEQ ID NO: 2509890 - protein, 24 aa, Entamoeba dispar
YADSLPRWVVTAAPLNQSTVLASD

SEQ ID NO: 2509891 - protein, 24 aa, Entamoeba dispar
YADTDCFMICFSIADEDSFERIKT

SEQ ID NO: 2509892 - protein, 28 aa, Entamoeba dispar
YAEELECSIFRSLVCTPFSKSHRKILLT

SEQ ID NO: 2509893 - protein, 23 aa, Entamoeba dispar
YAEKMKFCLWKKLKDNKLISQRY

SEQ ID NO: 2509894 - protein, 19 aa, Entamoeba dispar
YAELCLKAISILRAIGTRY

SEQ ID NO: 2509895 - protein, 19 aa, Entamoeba dispar
YAELCLKAVNLLKQLSYKL

SEQ ID NO: 2509896 - protein, 17 aa, Entamoeba dispar
YAELKETIDISAILVDW

SEQ ID NO: 2509897 - protein, 17 aa, Entamoeba dispar
YAEMKGIKSESKQESSK

SEQ ID NO: 2509898 - protein, 21 aa, Entamoeba dispar
YAEPFRFFLSFTPTKFPCFNQ

SEQ ID NO: 2509899 - protein, 18 aa, Entamoeba dispar
YAFESCTSLTKVNIGNSV

SEQ ID NO: 2509900 - protein, 20 aa, Entamoeba dispar
YAGKGNLEFNDPIPKKSIIT

SEQ ID NO: 2509901 - protein, 25 aa, Entamoeba dispar
YAIHRIRAFYMRKVKYCSQSYHDKL

SEQ ID NO: 2509902 - protein, 17 aa, Entamoeba dispar
YAILKGGKFEILRPKRK

SEQ ID NO: 2509903 - protein, 23 aa, Entamoeba dispar
YAKELKKKFGVQAIEKSWQLKLT

SEQ ID NO: 2509904 - protein, 20 aa, Entamoeba dispar
YAKKVPRKHVIIMDEAKSNK

SEQ ID NO: 2509905 - protein, 18 aa, Entamoeba dispar
YAKLFGKVGLLKDHIPVG

SEQ ID NO: 2509906 - protein, 18 aa, Entamoeba dispar
YAKQAECIVNNLIQELNE

SEQ ID NO: 2509907 - protein, 22 aa, Entamoeba dispar
YALAITMWELFYERLPFEEFLK

SEQ ID NO: 2509908 - protein, 19 aa, Entamoeba dispar
YALCLHALHTKRIFSRLNW

SEQ ID NO: 2509909 - protein, 17 aa, Entamoeba dispar
YALRLIERPPLKYLFQT

SEQ ID NO: 2509910 - protein, 17 aa, Entamoeba dispar
YALSADIEFVRKSIQAF

SEQ ID NO: 2509911 - protein, 28 aa, Entamoeba dispar
YAMKYEPTLRIGFEPCQYDSVINTTMIT

SEQ ID NO: 2509912 - protein, 18 aa, Entamoeba dispar
YANATLLRNLAKGAVEYS

SEQ ID NO: 2509913 - protein, 26 aa, Entamoeba dispar
YANESKWWGDDGFKEVCVTVKEYIKM

SEQ ID NO: 2509914 - protein, 17 aa, Entamoeba dispar
YANRMFGYMEEEKEDDE

SEQ ID NO: 2509915 - protein, 17 aa, Entamoeba dispar
YAPAYPLVLYECKYDRV

SEQ ID NO: 2509916 - protein, 23 aa, Entamoeba dispar
YAPKFMWKVRILQGNIDASVKEI

SEQ ID NO: 2509917 - protein, 17 aa, Entamoeba dispar
YAPPEIVDLLRLLQEYD

SEQ ID NO: 2509918 - protein, 25 aa, Entamoeba dispar
YAPSMKFVACGGLDNIVSIYSIAPK

SEQ ID NO: 2509919 - protein, 24 aa, Entamoeba dispar
YAQPMCLVAAFLRLTLNENKVYKM

SEQ ID NO: 2509920 - protein, 26 aa, Entamoeba dispar
YASCLVKLPLILPFIKKKLHYRILGF

SEQ ID NO: 2509921 - protein, 18 aa, Entamoeba dispar
YASFSKKDLERIVETKNQ

SEQ ID NO: 2509922 - protein, 23 aa, Entamoeba dispar
YASTEFIHIFAFTGNILCEPKFI

SEQ ID NO: 2509923 - protein, 27 aa, Entamoeba dispar
YASYKQYRIPVVFGKSINKEIVDEKLF

SEQ ID NO: 2509924 - protein, 40 aa, Entamoeba dispar
YATRSWTIKSGRMFLGDRWLRFDPPLGCVINLDQTEQIPK

SEQ ID NO: 2509925 - protein, 24 aa, Entamoeba dispar
YAYGELFYLLNLYSDSIEWFFIGF

SEQ ID NO: 2509926 - protein, 21 aa, Entamoeba dispar
YCAEFVKGKMAPECNTNARLL

SEQ ID NO: 2509927 - protein, 20 aa, Entamoeba dispar
YCAPEIYFSQPFTDKSDIFS

SEQ ID NO: 2509928 - protein, 19 aa, Entamoeba dispar
YCAVAALALLGRIDEIDIN

SEQ ID NO: 2509929 - protein, 19 aa, Entamoeba dispar
YCDELFSWIANTFDNEKVF

SEQ ID NO: 2509930 - protein, 24 aa, Entamoeba dispar
YCDFKRIRLEALFQTNSFEVIYYS

SEQ ID NO: 2509931 - protein, 17 aa, Entamoeba dispar
YCDHLCISFELLNQNLY

SEQ ID NO: 2509932 - protein, 18 aa, Entamoeba dispar
YCDNLKYIVKVISDTFPI

SEQ ID NO: 2509933 - protein, 25 aa, Entamoeba dispar
YCELRNIEVPKYIPLPVANEEYDID

SEQ ID NO: 2509934 - protein, 20 aa, Entamoeba dispar
YCETCGKKIWVQKQAKKKAE

SEQ ID NO: 2509935 - protein, 17 aa, Entamoeba dispar
YCEVPYDAIQVVSQLFD

SEQ ID NO: 2509936 - protein, 24 aa, Entamoeba dispar
YCEYYCLRDVLVLREGFLKYRQMV

SEQ ID NO: 2509937 - protein, 29 aa, Entamoeba dispar
YCEYYCLRDVMVLREGFLKYREMVKNNLK

SEQ ID NO: 2509938 - protein, 25 aa, Entamoeba dispar
YCFCGCTRLKSIIIPSTVSKIGDEC

SEQ ID NO: 2509939 - protein, 18 aa, Entamoeba dispar
YCFDGCKSLLNVTIPSSI

SEQ ID NO: 2509940 - protein, 18 aa, Entamoeba dispar
YCFEGCLLVTLISLPPSI

SEQ ID NO: 2509941 - protein, 17 aa, Entamoeba dispar
YCFESCKSLLEMDLRHI

SEQ ID NO: 2509942 - protein, 23 aa, Entamoeba dispar
YCFKDCKKLELIGLHEGIEYEKG

SEQ ID NO: 2509943 - protein, 17 aa, Entamoeba dispar
YCFKDCTSLRLINVPTS

SEQ ID NO: 2509944 - protein, 21 aa, Entamoeba dispar
YCFLDEKRLLLSDNKGKMHLI

SEQ ID NO: 2509945 - protein, 17 aa, Entamoeba dispar
YCFYGCSLLISINIPSS

SEQ ID NO: 2509946 - protein, 18 aa, Entamoeba dispar
YCFYGCSLLKSINIPSTI

SEQ ID NO: 2509947 - protein, 17 aa, Entamoeba dispar
YCFYKCSLLTSINIPSS

SEQ ID NO: 2509948 - protein, 17 aa, Entamoeba dispar
YCGKMIYEKYEMQLEIK

SEQ ID NO: 2509949 - protein, 18 aa, Entamoeba dispar
YCGSHGILQTIIVGMFPD

SEQ ID NO: 2509950 - protein, 21 aa, Entamoeba dispar
YCGVCDKHFISQAVYLKHCTQ

SEQ ID NO: 2509951 - protein, 19 aa, Entamoeba dispar
YCGYGRIIRYINILSNGIG

SEQ ID NO: 2509952 - protein, 17 aa, Entamoeba dispar
YCHKNFISDIQWKPEVF

SEQ ID NO: 2509953 - protein, 20 aa, Entamoeba dispar
YCHSQVPFSLSWFNDEGKFI

SEQ ID NO: 2509954 - protein, 20 aa, Entamoeba dispar
YCIIEEPIVNIEALRIKVMK

SEQ ID NO: 2509955 - protein, 20 aa, Entamoeba dispar
YCIKCGTPMIGEPGITMVRC

SEQ ID NO: 2509956 - protein, 19 aa, Entamoeba dispar
YCKECFSLLHNDMDTGFEK

SEQ ID NO: 2509957 - protein, 23 aa, Entamoeba dispar
YCKKECCCPRIKAFKKFMNTFEK

SEQ ID NO: 2509958 - protein, 25 aa, Entamoeba dispar
YCKKECCCPRIKAFKKFMYTFEKAQ

SEQ ID NO: 2509959 - protein, 18 aa, Entamoeba dispar
YCKKLKAAGYIECSALEN

SEQ ID NO: 2509960 - protein, 18 aa, Entamoeba dispar
YCLAAIKALLQTPIKEGI

SEQ ID NO: 2509961 - protein, 23 aa, Entamoeba dispar
YCLKGCNVKPVLDKGPNVMTISR

SEQ ID NO: 2509962 - protein, 17 aa, Entamoeba dispar
YCLNKSYVNGKCVECSN

SEQ ID NO: 2509963 - protein, 27 aa, Entamoeba dispar
YCLRVKKGQPPYCCFEYIDEDSYGKTN

SEQ ID NO: 2509964 - protein, 32 aa, Entamoeba dispar
YCNGFLPKKEMYYCLCLADFLVKQCPEFRPQM

SEQ ID NO: 2509965 - protein, 18 aa, Entamoeba dispar
YCNRVLRDKIDFSTFIMG

SEQ ID NO: 2509966 - protein, 23 aa, Entamoeba dispar
YCNYPIQLGCRLAKKAKVIKFKH

SEQ ID NO: 2509967 - protein, 29 aa, Entamoeba dispar
YCPEYQKIKEIILRSKIVFDCYKDTIENI

SEQ ID NO: 2509968 - protein, 25 aa, Entamoeba dispar
YCPIGVCRFISFERLEEMPFDEQWK

SEQ ID NO: 2509969 - protein, 21 aa, Entamoeba dispar
YCPLGPDGRRDWECIEALRLG

SEQ ID NO: 2509970 - protein, 21 aa, Entamoeba dispar
YCPLLTSVELRMCSGVTDNGI

SEQ ID NO: 2509971 - protein, 25 aa, Entamoeba dispar
YCQNLKKPLLPLFIKGIKSGNEEVM

SEQ ID NO: 2509972 - protein, 21 aa, Entamoeba dispar
YCQPQKLIIRRKEEKGYQYSL

SEQ ID NO: 2509973 - protein, 18 aa, Entamoeba dispar
YCQTSCATNGDGLYEGLD

SEQ ID NO: 2509974 - protein, 21 aa, Entamoeba dispar
YCRMEKLRAGLRTINEESETI

SEQ ID NO: 2509975 - protein, 20 aa, Entamoeba dispar
YCSSIKFVSGMNIRSPIEFL

SEQ ID NO: 2509976 - protein, 23 aa, Entamoeba dispar
YCTEIRYNDAFDIMQEVVMMEPS

SEQ ID NO: 2509977 - protein, 19 aa, Entamoeba dispar
YCTMVPKGIEILKETIYRL

SEQ ID NO: 2509978 - protein, 17 aa, Entamoeba dispar
YCVEYINGFGFRNICEW

SEQ ID NO: 2509979 - protein, 23 aa, Entamoeba dispar
YCVKRSEFELFLKYIKDRQNDLN

SEQ ID NO: 2509980 - protein, 18 aa, Entamoeba dispar
YCVLKYQFNTEINYLLHC

SEQ ID NO: 2509981 - protein, 21 aa, Entamoeba dispar
YCYDCKITFSRFFFTSNKQKT

SEQ ID NO: 2509982 - protein, 17 aa, Entamoeba dispar
YCYDDSRSLRGFGSVPF

SEQ ID NO: 2509983 - protein, 21 aa, Entamoeba dispar
YCYESMFSVERIICIQMLCDE

SEQ ID NO: 2509984 - protein, 18 aa, Entamoeba dispar
YCYGLLTLIEPTRHGMNI

SEQ ID NO: 2509985 - protein, 21 aa, Entamoeba dispar
YCYNCRKQLLPTPIVKLPITL

SEQ ID NO: 2509986 - protein, 26 aa, Entamoeba dispar
YCYNEERCCKFVKFLIENVQNHNIND

SEQ ID NO: 2509987 - protein, 20 aa, Entamoeba dispar
YCYSACSVFTKGLKECGSAI

SEQ ID NO: 2509988 - protein, 19 aa, Entamoeba dispar
YCYYNLNLIGGILPNDYYK

SEQ ID NO: 2509989 - protein, 21 aa, Entamoeba dispar
YCYYPYFYSILIEDELVNKEV

SEQ ID NO: 2509990 - protein, 25 aa, Entamoeba dispar
YDAEASCIECISACSSQSLEKKEGI

SEQ ID NO: 2509991 - protein, 22 aa, Entamoeba dispar
YDARVAHDYILWAQLIDIRQRL

SEQ ID NO: 2509992 - protein, 20 aa, Entamoeba dispar
YDCGDEVFKDGRIFKHIIWC

SEQ ID NO: 2509993 - protein, 19 aa, Entamoeba dispar
YDCLIKYASYKQYRIPVVF

SEQ ID NO: 2509994 - protein, 23 aa, Entamoeba dispar
YDDEQPYRFIIFDDINYDRNLIR

SEQ ID NO: 2509995 - protein, 23 aa, Entamoeba dispar
YDDKESFKNVVNWYQETQRYSNL

SEQ ID NO: 2509996 - protein, 25 aa, Entamoeba dispar
YDDLGCLWWDVLKGDYITKLTGHEN

SEQ ID NO: 2509997 - protein, 19 aa, Entamoeba dispar
YDDLRLDAVNRMPIPENLH

SEQ ID NO: 2509998 - protein, 17 aa, Entamoeba dispar
YDDWSIPKCVLTLELTL

SEQ ID NO: 2509999 - protein, 21 aa, Entamoeba dispar
YDDYIPCLLQIIATPQYKPLQ

SEQ ID NO: 2510000 - protein, 25 aa, Entamoeba dispar
YDECLRKYGNLYIWNAFISTFNVYP

SEQ ID NO: 2510001 - protein, 17 aa, Entamoeba dispar
YDEEYTWAFPPTKASGF

SEQ ID NO: 2510002 - protein, 26 aa, Entamoeba dispar
YDEIAIRFRPSWYYNEVSKQLEWVDE

SEQ ID NO: 2510003 - protein, 22 aa, Entamoeba dispar
YDEISRMLTFMIESLVEGNNEG

SEQ ID NO: 2510004 - protein, 26 aa, Entamoeba dispar
YDEKVDIWSLGIMCMEMADGNPPYMD

SEQ ID NO: 2510005 - protein, 18 aa, Entamoeba dispar
YDESLKGLVMAPFPEGEP

SEQ ID NO: 2510006 - protein, 17 aa, Entamoeba dispar
YDEYLPKVNYFVYLSIN

SEQ ID NO: 2510007 - protein, 20 aa, Entamoeba dispar
YDFDSLKLFCCVNKKCEGAT

SEQ ID NO: 2510008 - protein, 25 aa, Entamoeba dispar
YDFIKKSFDGDGLFYLADSNEELNT

SEQ ID NO: 2510009 - protein, 26 aa, Entamoeba dispar
YDFIKKSFDGDGLFYLADSNEELNTN

SEQ ID NO: 2510010 - protein, 17 aa, Entamoeba dispar
YDFNVFIFLYCSDLDEQ

SEQ ID NO: 2510011 - protein, 34 aa, Entamoeba dispar
YDFYCLGIIPPQRIQTEILRFGMFVEQIEDCSHV

SEQ ID NO: 2510012 - protein, 18 aa, Entamoeba dispar
YDGANRGGVLFVGNDGMK

SEQ ID NO: 2510013 - protein, 18 aa, Entamoeba dispar
YDGKKTIKIIEEVLEENQ

SEQ ID NO: 2510014 - protein, 17 aa, Entamoeba dispar
YDGKNCFDCPWDKDCCG

SEQ ID NO: 2510015 - protein, 23 aa, Entamoeba dispar
YDGPFKRCCENVLRILRDNKDFV

SEQ ID NO: 2510016 - protein, 18 aa, Entamoeba dispar
YDGQSFCEECLHLHQEVS

SEQ ID NO: 2510017 - protein, 23 aa, Entamoeba dispar
YDHADVISLPTIVVLNTENWNLM

SEQ ID NO: 2510018 - protein, 24 aa, Entamoeba dispar
YDHECDIWSLGVITYVLLSGYLPF

SEQ ID NO: 2510019 - protein, 20 aa, Entamoeba dispar
YDHINNKFCALKILKNKKAY

SEQ ID NO: 2510020 - protein, 23 aa, Entamoeba dispar
YDIEYIKGLGIGCVLSVGKKPIH

SEQ ID NO: 2510021 - protein, 17 aa, Entamoeba dispar
YDIHYGGYEYQIKHMNI

SEQ ID NO: 2510022 - protein, 17 aa, Entamoeba dispar
YDILYPMTMTLSSKQNQ

SEQ ID NO: 2510023 - protein, 18 aa, Entamoeba dispar
YDINLCVKNDVPPIPPFI

SEQ ID NO: 2510024 - protein, 17 aa, Entamoeba dispar
YDINNFNIIFAGAEVND

SEQ ID NO: 2510025 - protein, 17 aa, Entamoeba dispar
YDIYKSKWETIPSPINL

SEQ ID NO: 2510026 - protein, 22 aa, Entamoeba dispar
YDKDRGVACQMSKKMAIGDGIK

SEQ ID NO: 2510027 - protein, 27 aa, Entamoeba dispar
YDKELKIIKCINILSSIALNDKITSSN

SEQ ID NO: 2510028 - protein, 28 aa, Entamoeba dispar
YDKEVEIIECINILSSIALNGKINSSNE

SEQ ID NO: 2510029 - protein, 28 aa, Entamoeba dispar
YDKQQRIVWCINRLSSIALNGRINSSNE

SEQ ID NO: 2510030 - protein, 18 aa, Entamoeba dispar
YDKSLLNYEIFDQVEGTN

SEQ ID NO: 2510031 - protein, 21 aa, Entamoeba dispar
YDKVYTFCCPSQIEFDEWMST

SEQ ID NO: 2510032 - protein, 18 aa, Entamoeba dispar
YDLCYPLDIPDIYNQPLS

SEQ ID NO: 2510033 - protein, 26 aa, Entamoeba dispar
YDLFCEFFNTIPLAALFKCSLGSFLL

SEQ ID NO: 2510034 - protein, 28 aa, Entamoeba dispar
YDLFIDSRLKYYLSFLPENIKKVSFVGE

SEQ ID NO: 2510035 - protein, 30 aa, Entamoeba dispar
YDLGKQILIRKCELDGFPSIINSLEVIGDK

SEQ ID NO: 2510036 - protein, 25 aa, Entamoeba dispar
YDLIVEVLETLPLIEDNSSRSALEF

SEQ ID NO: 2510037 - protein, 19 aa, Entamoeba dispar
YDLKCSMDIDMFDDVGDGE

SEQ ID NO: 2510038 - protein, 29 aa, Entamoeba dispar
YDLLIKLSAILSFDCCEKIVLSVNQKEEN

SEQ ID NO: 2510039 - protein, 18 aa, Entamoeba dispar
YDLLKPKVLAPMKYHIKI

SEQ ID NO: 2510040 - protein, 19 aa, Entamoeba dispar
YDLRPKNRIQMVHNLHLAM

SEQ ID NO: 2510041 - protein, 17 aa, Entamoeba dispar
YDMPLRYISKITRSNYI

SEQ ID NO: 2510042 - protein, 24 aa, Entamoeba dispar
YDNDFKFVLTISKSVWDVIDQNEL

SEQ ID NO: 2510043 - protein, 28 aa, Entamoeba dispar
YDNEIRACVPPEKYAVALHDYDASTDTE

SEQ ID NO: 2510044 - protein, 23 aa, Entamoeba dispar
YDNRKICHLFGINPTMKFGTINL

SEQ ID NO: 2510045 - protein, 23 aa, Entamoeba dispar
YDNRRLCTLFGIEKGLVLTTRRI

SEQ ID NO: 2510046 - protein, 18 aa, Entamoeba dispar
YDNTHLIIIRKEIEKVMK

SEQ ID NO: 2510047 - protein, 20 aa, Entamoeba dispar
YDNTRVVLFEGLSLTINQTI

SEQ ID NO: 2510048 - protein, 17 aa, Entamoeba dispar
YDPFLFIKEFRKYILQN

SEQ ID NO: 2510049 - protein, 22 aa, Entamoeba dispar
YDPKELLCIFQQYGDVKTIHYS

SEQ ID NO: 2510050 - protein, 20 aa, Entamoeba dispar
YDPRCLDDFRKHCILNNIPS

SEQ ID NO: 2510051 - protein, 24 aa, Entamoeba dispar
YDPSRIVDIAKFLASFNLSGISSE

SEQ ID NO: 2510052 - protein, 17 aa, Entamoeba dispar
YDPSWLVLFAKSLLKTV

SEQ ID NO: 2510053 - protein, 19 aa, Entamoeba dispar
YDQCRISIAANQVYDKKFR

SEQ ID NO: 2510054 - protein, 17 aa, Entamoeba dispar
YDQRLALMIYSKAHATG

SEQ ID NO: 2510055 - protein, 26 aa, Entamoeba dispar
YDREFLKDQFLLDGFDFPNQYNDLIS

SEQ ID NO: 2510056 - protein, 21 aa, Entamoeba dispar
YDRSIRTWGMEAQQLLLNSHI

SEQ ID NO: 2510057 - protein, 20 aa, Entamoeba dispar
YDSCFGDALVKCIELMAPLA

SEQ ID NO: 2510058 - protein, 33 aa, Entamoeba dispar
YDSKALVFCGCFPRRHFDNFIKVCPINAQESPS

SEQ ID NO: 2510059 - protein, 17 aa, Entamoeba dispar
YDSLKRYDAFVLNMVIV

SEQ ID NO: 2510060 - protein, 17 aa, Entamoeba dispar
YDSLPIFEFNSKINEIE

SEQ ID NO: 2510061 - protein, 24 aa, Entamoeba dispar
YDSMKKCVNAFILSHNELTIKEIC

SEQ ID NO: 2510062 - protein, 17 aa, Entamoeba dispar
YDSVGLAADMMASSFGK

SEQ ID NO: 2510063 - protein, 17 aa, Entamoeba dispar
YDTELELLISGMPDIDT

SEQ ID NO: 2510064 - protein, 31 aa, Entamoeba dispar
YDTKHFKRVCKFSSQCTTEWTWSNDNASIIC

SEQ ID NO: 2510065 - protein, 18 aa, Entamoeba dispar
YDTRFQVFGINFSFYDYK

SEQ ID NO: 2510066 - protein, 20 aa, Entamoeba dispar
YDTTICLVGSHLAAHQPEIN

SEQ ID NO: 2510067 - protein, 19 aa, Entamoeba dispar
YDVEFLRAFIGNAKNFNPI

SEQ ID NO: 2510068 - protein, 18 aa, Entamoeba dispar
YDVGEIAAKIAQLYYHYY

SEQ ID NO: 2510069 - protein, 17 aa, Entamoeba dispar
YDVISSYQIVGTFEIPG

SEQ ID NO: 2510070 - protein, 17 aa, Entamoeba dispar
YDYFKGNNIFGFTGEHH

SEQ ID NO: 2510071 - protein, 27 aa, Entamoeba dispar
YDYKLLEFSLIYNILETFKHNYKYNEN

SEQ ID NO: 2510072 - protein, 17 aa, Entamoeba dispar
YDYLISPLMRQADFDAK

SEQ ID NO: 2510073 - protein, 22 aa, Entamoeba dispar
YDYRLLMLESEVIIIQQPPSTK

SEQ ID NO: 2510074 - protein, 20 aa, Entamoeba dispar
YEAKEAGAYIVATGRGDFPN

SEQ ID NO: 2510075 - protein, 25 aa, Entamoeba dispar
YEALNALRLLLVFGDENDLDTKNYY

SEQ ID NO: 2510076 - protein, 18 aa, Entamoeba dispar
YEAPGFDNMTLIVAVFDR

SEQ ID NO: 2510077 - protein, 19 aa, Entamoeba dispar
YEAPWTVYSVSWSNRNDKP

SEQ ID NO: 2510078 - protein, 17 aa, Entamoeba dispar
YECHPYEKVSFVNNSII

SEQ ID NO: 2510079 - protein, 21 aa, Entamoeba dispar
YECIIGCKKDPLFGPVIVFGM

SEQ ID NO: 2510080 - protein, 24 aa, Entamoeba dispar
YECSKYNPNCLVCSNSSPNCLVCK

SEQ ID NO: 2510081 - protein, 18 aa, Entamoeba dispar
YEDCVWVNKMAIIVGTEG

SEQ ID NO: 2510082 - protein, 22 aa, Entamoeba dispar
YEDDCVYGLFRILQLLHKEKDG

SEQ ID NO: 2510083 - protein, 18 aa, Entamoeba dispar
YEDFDIINDIGFVEKQRF

SEQ ID NO: 2510084 - protein, 23 aa, Entamoeba dispar
YEDIKRKCFDREIITQCILPDTL

SEQ ID NO: 2510085 - protein, 30 aa, Entamoeba dispar
YEEAISLLTKWAEECGVVLRKGSGNNKTMK

SEQ ID NO: 2510086 - protein, 22 aa, Entamoeba dispar
YEECFEILTSECWNNPPEGMSQ

SEQ ID NO: 2510087 - protein, 25 aa, Entamoeba dispar
YEEECPWKDIGKLLSYFEEKKSLDN

SEQ ID NO: 2510088 - protein, 24 aa, Entamoeba dispar
YEEEEIRLLQTLQLEYLINNKLNL

SEQ ID NO: 2510089 - protein, 23 aa, Entamoeba dispar
YEEFLHLFYCYSIHTQKGFFKIQ

SEQ ID NO: 2510090 - protein, 19 aa, Entamoeba dispar
YEEGARKGYSLIGLIGSNN

SEQ ID NO: 2510091 - protein, 27 aa, Entamoeba dispar
YEEGIKYSIPLWLAVHFKQIGLCKLVI

SEQ ID NO: 2510092 - protein, 24 aa, Entamoeba dispar
YEEHPRYLLRKNIVADDMENGICW

SEQ ID NO: 2510093 - protein, 26 aa, Entamoeba dispar
YEEYFKSLSQICLKEIINKKDYSFVG

SEQ ID NO: 2510094 - protein, 19 aa, Entamoeba dispar
YEFCEGGNLYKYIDEQPTP

SEQ ID NO: 2510095 - protein, 24 aa, Entamoeba dispar
YEFCGYPYHDTCIKCNGCNKPLRF

SEQ ID NO: 2510096 - protein, 24 aa, Entamoeba dispar
YEFELIRELPFTLGACTFKPINDT

SEQ ID NO: 2510097 - protein, 22 aa, Entamoeba dispar
YEFKAMHGFVTINLRAETPMPS

SEQ ID NO: 2510098 - protein, 22 aa, Entamoeba dispar
YEFKAMHGFVTMNFAPAQKVPS

SEQ ID NO: 2510099 - protein, 23 aa, Entamoeba dispar
YEFKAMHGFVTMNFAPAQRVPSK

SEQ ID NO: 2510100 - protein, 22 aa, Entamoeba dispar
YEFKAMHGFVTMNFTPAQKVPN

SEQ ID NO: 2510101 - protein, 18 aa, Entamoeba dispar
YEFKDMHGFVTINVKDDY

SEQ ID NO: 2510102 - protein, 22 aa, Entamoeba dispar
YEFRSMHGFANINFKENTPTPS

SEQ ID NO: 2510103 - protein, 20 aa, Entamoeba dispar
YEGGLRFVLSTANLIPIDYN

SEQ ID NO: 2510104 - protein, 22 aa, Entamoeba dispar
YEGRCAFPSNFDSTYCYALGYT

SEQ ID NO: 2510105 - protein, 28 aa, Entamoeba dispar
YEHCSMCSKSECFKCEKGYGLNEEGKCT

SEQ ID NO: 2510106 - protein, 22 aa, Entamoeba dispar
YEHGCGPALQYATVLAERKKEK

SEQ ID NO: 2510107 - protein, 25 aa, Entamoeba dispar
YEHLNEFRIQLDMDRRMYSISKKSK

SEQ ID NO: 2510108 - protein, 22 aa, Entamoeba dispar
YEHMSGYGFDLFCEGQDYSSPY

SEQ ID NO: 2510109 - protein, 23 aa, Entamoeba dispar
YEHNPRLHLTWFNKMAAENRKNL

SEQ ID NO: 2510110 - protein, 19 aa, Entamoeba dispar
YEIAAPFLIHRVNSNVQVY

SEQ ID NO: 2510111 - protein, 26 aa, Entamoeba dispar
YEIDGMIKKDGCQDLLVKFEEDEGRT

SEQ ID NO: 2510112 - protein, 18 aa, Entamoeba dispar
YEIEPGASEFLSKVNRQK

SEQ ID NO: 2510113 - protein, 22 aa, Entamoeba dispar
YEIGNYLGSGGFSIVRDAFSRE

SEQ ID NO: 2510114 - protein, 30 aa, Entamoeba dispar
YEIGSIRIALLLWKHFFLSLPNPVIEEDVY

SEQ ID NO: 2510115 - protein, 23 aa, Entamoeba dispar
YEIKEGRIETGIAILEEAMDEVI

SEQ ID NO: 2510116 - protein, 18 aa, Entamoeba dispar
YEIPSAVEYCIVRRMRKE

SEQ ID NO: 2510117 - protein, 17 aa, Entamoeba dispar
YEIPSFQKIQVKEHELV

SEQ ID NO: 2510118 - protein, 18 aa, Entamoeba dispar
YEKALKLYNDWDKSKILE

SEQ ID NO: 2510119 - protein, 23 aa, Entamoeba dispar
YEKEAKSAVLVIVEDIDRLLEEE

SEQ ID NO: 2510120 - protein, 23 aa, Entamoeba dispar
YEKFKDSMKWTCIDARQSKEEVA

SEQ ID NO: 2510121 - protein, 19 aa, Entamoeba dispar
YEKFMPALIQYYKQPQEKH

SEQ ID NO: 2510122 - protein, 19 aa, Entamoeba dispar
YEKFMPALMQYYKQPQEKH

SEQ ID NO: 2510123 - protein, 20 aa, Entamoeba dispar
YEKKSLCICCINEEMKNKGI

SEQ ID NO: 2510124 - protein, 19 aa, Entamoeba dispar
YEKNLPFNKKVLDYQNELI

SEQ ID NO: 2510125 - protein, 25 aa, Entamoeba dispar
YEKQDFNRFLTLIIKACDMADKKIK

SEQ ID NO: 2510126 - protein, 21 aa, Entamoeba dispar
YELDLGLNHVIRKVAEPIDPT

SEQ ID NO: 2510127 - protein, 17 aa, Entamoeba dispar
YELFTHSFLFTGESNND

SEQ ID NO: 2510128 - protein, 27 aa, Entamoeba dispar
YELIGSCFSLPLSHSILTQRGLDIYKN

SEQ ID NO: 2510129 - protein, 20 aa, Entamoeba dispar
YELKSGASYIEVHDTSKRKG

SEQ ID NO: 2510130 - protein, 23 aa, Entamoeba dispar
YELNCACPIDYVYKKGMGAQLIE

SEQ ID NO: 2510131 - protein, 17 aa, Entamoeba dispar
YELRFSAFEKCHTPQYI

SEQ ID NO: 2510132 - protein, 19 aa, Entamoeba dispar
YELRIFKERGNLLMNELAD

SEQ ID NO: 2510133 - protein, 23 aa, Entamoeba dispar
YELSKFFLKVKLNGLSTVYPQSE

SEQ ID NO: 2510134 - protein, 17 aa, Entamoeba dispar
YELSNFFDFVENPFYED

SEQ ID NO: 2510135 - protein, 28 aa, Entamoeba dispar
YELTLFTGIEMKDFLGSAWTKKDKYERC

SEQ ID NO: 2510136 - protein, 24 aa, Entamoeba dispar
YELYDPVTVMFFYRKKHIQVDLGT

SEQ ID NO: 2510137 - protein, 21 aa, Entamoeba dispar
YEMIKETIKVKGWNEEQYDIM

SEQ ID NO: 2510138 - protein, 20 aa, Entamoeba dispar
YEMSQKFYLTQQMIIEETQQ

SEQ ID NO: 2510139 - protein, 17 aa, Entamoeba dispar
YENGIPINLGNVAIAVI

SEQ ID NO: 2510140 - protein, 25 aa, Entamoeba dispar
YENHLKRRAMILITLLLDYIDTPKG

SEQ ID NO: 2510141 - protein, 18 aa, Entamoeba dispar
YENIYPSYPYNFLQLSIK

SEQ ID NO: 2510142 - protein, 23 aa, Entamoeba dispar
YENSPVIFKNGFDVHIVNDHYHH

SEQ ID NO: 2510143 - protein, 24 aa, Entamoeba dispar
YENTFDFILCIIRMISCKRFFLLP

SEQ ID NO: 2510144 - protein, 19 aa, Entamoeba dispar
YENWSEIGYKDFINQVNKE

SEQ ID NO: 2510145 - protein, 23 aa, Entamoeba dispar
YEPAPPRRLLIRIFGEGDAAWVV

SEQ ID NO: 2510146 - protein, 20 aa, Entamoeba dispar
YEPCSCKKYSSPEQSEISIR

SEQ ID NO: 2510147 - protein, 34 aa, Entamoeba dispar
YEPEIFPGVVYRLADPKMVLLIFASGKIVFTGGK

SEQ ID NO: 2510148 - protein, 17 aa, Entamoeba dispar
YEPKEAIVVSYKKGSRI

SEQ ID NO: 2510149 - protein, 17 aa, Entamoeba dispar
YEPKKDFLRKFLFEPFP

SEQ ID NO: 2510150 - protein, 24 aa, Entamoeba dispar
YEQSCFRHCNKLTINELFSNLKSI

SEQ ID NO: 2510151 - protein, 18 aa, Entamoeba dispar
YERCGEILSPYKYAGYGL

SEQ ID NO: 2510152 - protein, 18 aa, Entamoeba dispar
YERCGEILSPYKYAGYSL

SEQ ID NO: 2510153 - protein, 18 aa, Entamoeba dispar
YERCKNPGMCLSLFSFSH

SEQ ID NO: 2510154 - protein, 23 aa, Entamoeba dispar
YERFNKESVSIIIPSHDFIIEKI

SEQ ID NO: 2510155 - protein, 29 aa, Entamoeba dispar
YERGTRSLWIWRNCKSYLFDDFKDILSLP

SEQ ID NO: 2510156 - protein, 17 aa, Entamoeba dispar
YERPQRYIIYDFLLTDP

SEQ ID NO: 2510157 - protein, 30 aa, Entamoeba dispar
YERTKTCLCSVCGGVMCLSSLQNKWSCFCN

SEQ ID NO: 2510158 - protein, 17 aa, Entamoeba dispar
YESFKQEQLHIIVVIQF

SEQ ID NO: 2510159 - protein, 26 aa, Entamoeba dispar
YESGIKCGFCGDSSHATCDCPLKKQK

SEQ ID NO: 2510160 - protein, 29 aa, Entamoeba dispar
YESKFPTPFLSLISHCLLIPLLPQGQYNK

SEQ ID NO: 2510161 - protein, 19 aa, Entamoeba dispar
YESLCPVYFSGGRMKVYGI

SEQ ID NO: 2510162 - protein, 18 aa, Entamoeba dispar
YESLDEFTQVDAFAAHTK

SEQ ID NO: 2510163 - protein, 23 aa, Entamoeba dispar
YESQCIIDLLVLLMKSITISYVR

SEQ ID NO: 2510164 - protein, 24 aa, Entamoeba dispar
YESVKGWLKDVGYYAPKDIIKYLV

SEQ ID NO: 2510165 - protein, 23 aa, Entamoeba dispar
YESYKYNLNCLKQIKKSLNKTID

SEQ ID NO: 2510166 - protein, 20 aa, Entamoeba dispar
YETFLYLGIEAGRTQLEAEF

SEQ ID NO: 2510167 - protein, 26 aa, Entamoeba dispar
YETMKYCTYKFPQLKNHLNFVEYIQK

SEQ ID NO: 2510168 - protein, 19 aa, Entamoeba dispar
YETNIPFMEVIGMFDGHHG

SEQ ID NO: 2510169 - protein, 17 aa, Entamoeba dispar
YEVDFLKLISEVTSGAQ

SEQ ID NO: 2510170 - protein, 25 aa, Entamoeba dispar
YEVDLRWCGYVHWSAGKRRYSDFLK

SEQ ID NO: 2510171 - protein, 19 aa, Entamoeba dispar
YEVRLFKDDSVLLLGNKYK

SEQ ID NO: 2510172 - protein, 19 aa, Entamoeba dispar
YEVSCAFKINDPSKQSIIC

SEQ ID NO: 2510173 - protein, 26 aa, Entamoeba dispar
YEVSFEFSSVLPFSIPVYQFETSECI

SEQ ID NO: 2510174 - protein, 21 aa, Entamoeba dispar
YEVSKSIFSLFPFFHYHMYFK

SEQ ID NO: 2510175 - protein, 18 aa, Entamoeba dispar
YEVVFNLVIFSPFQGELI

SEQ ID NO: 2510176 - protein, 20 aa, Entamoeba dispar
YEVWCKYGGSTNQRIMIEMK

SEQ ID NO: 2510177 - protein, 17 aa, Entamoeba dispar
YEWENVFLACGITREEI

SEQ ID NO: 2510178 - protein, 26 aa, Entamoeba dispar
YEWMIPLKSIHSFSVIANKITVVKND

SEQ ID NO: 2510179 - protein, 17 aa, Entamoeba dispar
YEYFGFLPSILPFIQCV

SEQ ID NO: 2510180 - protein, 32 aa, Entamoeba dispar
YEYLILKEYYFACAVCLVMYKQHQLAIELLLK

SEQ ID NO: 2510181 - protein, 22 aa, Entamoeba dispar
YEYSELYIAYQYYYFYDKDVDF

SEQ ID NO: 2510182 - protein, 19 aa, Entamoeba dispar
YEYTIAIVRLLYSMCLYQN

SEQ ID NO: 2510183 - protein, 25 aa, Entamoeba dispar
YFARIPEWIPYHVFITSHKDGSIKV

SEQ ID NO: 2510184 - protein, 17 aa, Entamoeba dispar
YFASYLFCKQHKLSGSI

SEQ ID NO: 2510185 - protein, 24 aa, Entamoeba dispar
YFAYKEQYYEIAFNMQHENAPIGS

SEQ ID NO: 2510186 - protein, 25 aa, Entamoeba dispar
YFDDLCQWTKLNAINHIETITMERL

SEQ ID NO: 2510187 - protein, 17 aa, Entamoeba dispar
YFDKKVQVISDMLNLIG

SEQ ID NO: 2510188 - protein, 18 aa, Entamoeba dispar
YFDLFMKYLQFVQPILTL

SEQ ID NO: 2510189 - protein, 28 aa, Entamoeba dispar
YFDSCCWGWRRGFNMTFREKNEFTIYNE

SEQ ID NO: 2510190 - protein, 25 aa, Entamoeba dispar
YFDSIPIALSLQFSKRGHLLCIGEY

SEQ ID NO: 2510191 - protein, 23 aa, Entamoeba dispar
YFDYLCDLLESIFFPQQQLKKVN

SEQ ID NO: 2510192 - protein, 18 aa, Entamoeba dispar
YFEFKYSSIYYKQLLINL

SEQ ID NO: 2510193 - protein, 18 aa, Entamoeba dispar
YFEFSIIVMRRIFSFAPF

SEQ ID NO: 2510194 - protein, 27 aa, Entamoeba dispar
YFEIISKEIVIEWILTKIGNIFNDGIH

SEQ ID NO: 2510195 - protein, 33 aa, Entamoeba dispar
YFEKMISGIYMGWLARLAIRELIEKKVIFERYA

SEQ ID NO: 2510196 - protein, 25 aa, Entamoeba dispar
YFENAHMYREFGGRINGFKHNEKQK

SEQ ID NO: 2510197 - protein, 18 aa, Entamoeba dispar
YFETVSPLIIQKRVIAYN

SEQ ID NO: 2510198 - protein, 24 aa, Entamoeba dispar
YFFFIKSPLPFISHKLFLVNEMQK

SEQ ID NO: 2510199 - protein, 18 aa, Entamoeba dispar
YFGDENYGWLSIQKTTIP

SEQ ID NO: 2510200 - protein, 19 aa, Entamoeba dispar
YFGKHGMRVFHLKANKYYC

SEQ ID NO: 2510201 - protein, 23 aa, Entamoeba dispar
YFGRKISSFILFPNQIITIRTES

SEQ ID NO: 2510202 - protein, 26 aa, Entamoeba dispar
YFHDKRIDDSLTFSQANIFSGSTLIY

SEQ ID NO: 2510203 - protein, 20 aa, Entamoeba dispar
YFHFSFHFMQYISFDFEHQC

SEQ ID NO: 2510204 - protein, 19 aa, Entamoeba dispar
YFHHGRMNSLFTWAFEKEL

SEQ ID NO: 2510205 - protein, 19 aa, Entamoeba dispar
YFHPTKPWILSCSDDRTIR

SEQ ID NO: 2510206 - protein, 19 aa, Entamoeba dispar
YFIDCLKLCPIEINQHYLY

SEQ ID NO: 2510207 - protein, 23 aa, Entamoeba dispar
YFIDKLNCYYLNTSHIQNLRDLS

SEQ ID NO: 2510208 - protein, 19 aa, Entamoeba dispar
YFIDTAFDIINYIKSIKSV

SEQ ID NO: 2510209 - protein, 19 aa, Entamoeba dispar
YFIDYGIKPSLQFKMYAQN

SEQ ID NO: 2510210 - protein, 24 aa, Entamoeba dispar
YFIFPFPLCLIVTKQLSVETMKEV

SEQ ID NO: 2510211 - protein, 20 aa, Entamoeba dispar
YFIFQCIHPNKFYDDPFVML

SEQ ID NO: 2510212 - protein, 23 aa, Entamoeba dispar
YFIGEPRIKLFVEFLTKKWFFTL

SEQ ID NO: 2510213 - protein, 27 aa, Entamoeba dispar
YFIHYSKYYANVCFSTYPVMNGAKFGK

SEQ ID NO: 2510214 - protein, 17 aa, Entamoeba dispar
YFIKVAQCCIDLNDLNM

SEQ ID NO: 2510215 - protein, 18 aa, Entamoeba dispar
YFILKVNEINGGRKATVG

SEQ ID NO: 2510216 - protein, 20 aa, Entamoeba dispar
YFIQRLNYFLSKASQRLGIM

SEQ ID NO: 2510217 - protein, 19 aa, Entamoeba dispar
YFKEVIEYLKGINVDTQEI

SEQ ID NO: 2510218 - protein, 19 aa, Entamoeba dispar
YFKFVCKLNDIRVEEALET

SEQ ID NO: 2510219 - protein, 26 aa, Entamoeba dispar
YFKGMIKCVKDIIGIHAKELLVDSVK

SEQ ID NO: 2510220 - protein, 24 aa, Entamoeba dispar
YFKKIEECKLKHCSKESVHKKEKE

SEQ ID NO: 2510221 - protein, 22 aa, Entamoeba dispar
YFKKIGIWRLNSFLKEEVIYGY

SEQ ID NO: 2510222 - protein, 21 aa, Entamoeba dispar
YFKLAHLSKVFILFLNVPNTV

SEQ ID NO: 2510223 - protein, 18 aa, Entamoeba dispar
YFKRALELNKNYAPALIG

SEQ ID NO: 2510224 - protein, 28 aa, Entamoeba dispar
YFLHLKFPRLVSHLFPFFNDLTHQKRSL

SEQ ID NO: 2510225 - protein, 18 aa, Entamoeba dispar
YFLTEHWAPLKNILRRYQ

SEQ ID NO: 2510226 - protein, 18 aa, Entamoeba dispar
YFLTLCEDFDKKLKGNLI

SEQ ID NO: 2510227 - protein, 18 aa, Entamoeba dispar
YFLVPVVRGSFTEEDYQE

SEQ ID NO: 2510228 - protein, 20 aa, Entamoeba dispar
YFMIEIKPSPQFVIEGDIVY

SEQ ID NO: 2510229 - protein, 30 aa, Entamoeba dispar
YFNAYRIDHILGFFRIWAIPAIHRTGLLGR

SEQ ID NO: 2510230 - protein, 21 aa, Entamoeba dispar
YFNFSCVDLSYFLDQPVEKPL

SEQ ID NO: 2510231 - protein, 18 aa, Entamoeba dispar
YFNGGSLFQYISKNHNIP

SEQ ID NO: 2510232 - protein, 17 aa, Entamoeba dispar
YFNGIEMDLSEYAFESI

SEQ ID NO: 2510233 - protein, 18 aa, Entamoeba dispar
YFNIPRQYFYLIKNGKLK

SEQ ID NO: 2510234 - protein, 17 aa, Entamoeba dispar
YFNNMFTTFSFNKIFEY

SEQ ID NO: 2510235 - protein, 17 aa, Entamoeba dispar
YFPENCQKKVTAKQLLA

SEQ ID NO: 2510236 - protein, 26 aa, Entamoeba dispar
YFPPRGEHFCCGKIEKSSCVNGVYNT

SEQ ID NO: 2510237 - protein, 22 aa, Entamoeba dispar
YFQFMAALKCAKGLRDMIAPFF

SEQ ID NO: 2510238 - protein, 18 aa, Entamoeba dispar
YFQFPHKKIYSTALAQLV

SEQ ID NO: 2510239 - protein, 19 aa, Entamoeba dispar
YFQQTIPFTIEMSAKLNND

SEQ ID NO: 2510240 - protein, 20 aa, Entamoeba dispar
YFQSICWIYCNLVCSNIMAR

SEQ ID NO: 2510241 - protein, 23 aa, Entamoeba dispar
YFRIPLPDILHWMNIDISSSSGK

SEQ ID NO: 2510242 - protein, 36 aa, Entamoeba dispar
YFSDFVQNIAGYFCPNSRPTQGIHRTATLPLSSSLS

SEQ ID NO: 2510243 - protein, 18 aa, Entamoeba dispar
YFTFKKVWRAYANYARRR

SEQ ID NO: 2510244 - protein, 17 aa, Entamoeba dispar
YFTSDVINTIFDCKIMT

SEQ ID NO: 2510245 - protein, 37 aa, Entamoeba dispar
YFVFSLKNPHGIVPTRFSRKRLSTTLRICPSDGDVVV

SEQ ID NO: 2510246 - protein, 18 aa, Entamoeba dispar
YFVHKRKLIIQIFVYEHL

SEQ ID NO: 2510247 - protein, 19 aa, Entamoeba dispar
YFVKLLLSFHDVKRKRRGK

SEQ ID NO: 2510248 - protein, 19 aa, Entamoeba dispar
YFYCLEDFTIYCSKQPIGQ

SEQ ID NO: 2510249 - protein, 18 aa, Entamoeba dispar
YFYWKYTEPSVMSLHEMY

SEQ ID NO: 2510250 - protein, 18 aa, Entamoeba dispar
YGAAHFLEHIILRGNNQF

SEQ ID NO: 2510251 - protein, 17 aa, Entamoeba dispar
YGADFGLIELMFDGRTR

SEQ ID NO: 2510252 - protein, 27 aa, Entamoeba dispar
YGAEHLLRLIAKLPQICYEIHFDKMDE

SEQ ID NO: 2510253 - protein, 29 aa, Entamoeba dispar
YGAKLMVPGLLRYSKGITMNEVVVLMTSK

SEQ ID NO: 2510254 - protein, 24 aa, Entamoeba dispar
YGALFCILDQFLVSGIKTITRYIL

SEQ ID NO: 2510255 - protein, 18 aa, Entamoeba dispar
YGANWKYEHPLEIRCIGV

SEQ ID NO: 2510256 - protein, 19 aa, Entamoeba dispar
YGCFRGCSSLTSINIPSSI

SEQ ID NO: 2510257 - protein, 19 aa, Entamoeba dispar
YGCFYKCGCEEELKKNKRI

SEQ ID NO: 2510258 - protein, 26 aa, Entamoeba dispar
YGCKRCKEGYYLTKDMKCLKCDDKCE

SEQ ID NO: 2510259 - protein, 19 aa, Entamoeba dispar
YGCLAKFALVQPIRRIPKL

SEQ ID NO: 2510260 - protein, 19 aa, Entamoeba dispar
YGDALSHYRECLKIIHEAN

SEQ ID NO: 2510261 - protein, 17 aa, Entamoeba dispar
YGDAWIWIYKILYEQKG

SEQ ID NO: 2510262 - protein, 19 aa, Entamoeba dispar
YGDEIKLAPFMGTLTALSS

SEQ ID NO: 2510263 - protein, 25 aa, Entamoeba dispar
YGDKSVCILSTFFFENMRRANDPNV

SEQ ID NO: 2510264 - protein, 18 aa, Entamoeba dispar
YGDSYIFIGKDNVKYFTT

SEQ ID NO: 2510265 - protein, 26 aa, Entamoeba dispar
YGELLKGFLKYYGIDFRSDIEGLSVF

SEQ ID NO: 2510266 - protein, 24 aa, Entamoeba dispar
YGEYFTSQVIFLGFPDRIQVNEII

SEQ ID NO: 2510267 - protein, 25 aa, Entamoeba dispar
YGFAPRISFLTSRTVQLGIKEPINK

SEQ ID NO: 2510268 - protein, 18 aa, Entamoeba dispar
YGFECDIYSFGMMLYEVI

SEQ ID NO: 2510269 - protein, 17 aa, Entamoeba dispar
YGFGEWKEEQKLEVQKL

SEQ ID NO: 2510270 - protein, 17 aa, Entamoeba dispar
YGFKFKLTLSEPSKIKV

SEQ ID NO: 2510271 - protein, 21 aa, Entamoeba dispar
YGFKGNPFVFPIPNEEPTVPY

SEQ ID NO: 2510272 - protein, 18 aa, Entamoeba dispar
YGFVCDLVVYSIQPTSQH

SEQ ID NO: 2510273 - protein, 18 aa, Entamoeba dispar
YGGIPIKVQTRFEDQWQI

SEQ ID NO: 2510274 - protein, 19 aa, Entamoeba dispar
YGGNGFKFDIKEEITTMEN

SEQ ID NO: 2510275 - protein, 23 aa, Entamoeba dispar
YGIESINSLSLFNSLKVFTKQYI

SEQ ID NO: 2510276 - protein, 19 aa, Entamoeba dispar
YGIEVDWWSLGVVVYEMLS

SEQ ID NO: 2510277 - protein, 18 aa, Entamoeba dispar
YGIFICIQCSGKHRGLGV

SEQ ID NO: 2510278 - protein, 24 aa, Entamoeba dispar
YGIISIGRGSLWAYESNVFTRWEV

SEQ ID NO: 2510279 - protein, 17 aa, Entamoeba dispar
YGIKITDDFRYIIINED

SEQ ID NO: 2510280 - protein, 18 aa, Entamoeba dispar
YGKDVIKIAEEYHFEIEL

SEQ ID NO: 2510281 - protein, 36 aa, Entamoeba dispar
YGKECDYWSIGCILFEMVCGFPPFLSDDAVQTCLKI

SEQ ID NO: 2510282 - protein, 37 aa, Entamoeba dispar
YGKECDYWSIGCILFEMVCGFPPFLSDDAVQTCLKIV

SEQ ID NO: 2510283 - protein, 23 aa, Entamoeba dispar
YGKGNLFRGVVVWITGRTHPSAS

SEQ ID NO: 2510284 - protein, 19 aa, Entamoeba dispar
YGKIEIVTILAKRDQYKTH

SEQ ID NO: 2510285 - protein, 37 aa, Entamoeba dispar
YGKKLPIPEIVPFRLTREILDPMGVLKYDGPFKRCCE

SEQ ID NO: 2510286 - protein, 18 aa, Entamoeba dispar
YGKNRKIFFSSFDPDTIA

SEQ ID NO: 2510287 - protein, 17 aa, Entamoeba dispar
YGKNSMCRIEYNSPKLL

SEQ ID NO: 2510288 - protein, 24 aa, Entamoeba dispar
YGKRTTVLCYLLFRLRTLNYPKPQ

SEQ ID NO: 2510289 - protein, 18 aa, Entamoeba dispar
YGKSDMYLKPIVRRNDII

SEQ ID NO: 2510290 - protein, 22 aa, Entamoeba dispar
YGKSRTVLEFVAGAKRNRKFNV

SEQ ID NO: 2510291 - protein, 20 aa, Entamoeba dispar
YGKWRRLADDKIEITELPIQ

SEQ ID NO: 2510292 - protein, 23 aa, Entamoeba dispar
YGLAAEIYTHFTSPIRRYADVMV

SEQ ID NO: 2510293 - protein, 25 aa, Entamoeba dispar
YGLASERLCVLYVLYKNLFIDQFKI

SEQ ID NO: 2510294 - protein, 22 aa, Entamoeba dispar
YGLDLPSRWNLFDSNQQNQYRI

SEQ ID NO: 2510295 - protein, 22 aa, Entamoeba dispar
YGLLKERISKIILNQFGTASPH

SEQ ID NO: 2510296 - protein, 23 aa, Entamoeba dispar
YGLNKEIRELICIGNEKKEKKKI

SEQ ID NO: 2510297 - protein, 22 aa, Entamoeba dispar
YGMYKSYFNNVAIQKFIETKFG

SEQ ID NO: 2510298 - protein, 22 aa, Entamoeba dispar
YGNECKRYIEAYLEKKQRIQTI

SEQ ID NO: 2510299 - protein, 20 aa, Entamoeba dispar
YGNKICPERIGSYIQLCSAE

SEQ ID NO: 2510300 - protein, 24 aa, Entamoeba dispar
YGNKIPNLFKFAGDMLGLTQFNEL

SEQ ID NO: 2510301 - protein, 19 aa, Entamoeba dispar
YGNVNVWKHCVALFEFMAT

SEQ ID NO: 2510302 - protein, 17 aa, Entamoeba dispar
YGNVVLELGQEKYEIDE

SEQ ID NO: 2510303 - protein, 21 aa, Entamoeba dispar
YGQCIITLISEPSFKSSFGKK

SEQ ID NO: 2510304 - protein, 20 aa, Entamoeba dispar
YGRKNILGMVITKNNDIFGS

SEQ ID NO: 2510305 - protein, 17 aa, Entamoeba dispar
YGSFWCGFMKVLLKDPY

SEQ ID NO: 2510306 - protein, 27 aa, Entamoeba dispar
YGSKIFKPVKFMVGRCPLSEVPCYNCP

SEQ ID NO: 2510307 - protein, 22 aa, Entamoeba dispar
YGSLIPIPILYDIIRTAIDHKR

SEQ ID NO: 2510308 - protein, 23 aa, Entamoeba dispar
YGSLRPFGCSLLIGGVDQHGYSL

SEQ ID NO: 2510309 - protein, 20 aa, Entamoeba dispar
YGSRCRFIHVLPGEPSPVSD

SEQ ID NO: 2510310 - protein, 25 aa, Entamoeba dispar
YGTANSWRWCTEVFDYLNIAALIDG

SEQ ID NO: 2510311 - protein, 18 aa, Entamoeba dispar
YGTPLESLDSEWIKSLIK

SEQ ID NO: 2510312 - protein, 22 aa, Entamoeba dispar
YGTQPYPGYNQMGGMPSYGSGF

SEQ ID NO: 2510313 - protein, 17 aa, Entamoeba dispar
YGTRLLVRQEFTPVYQI

SEQ ID NO: 2510314 - protein, 17 aa, Entamoeba dispar
YGVDEMKQVTGIQDDEQ

SEQ ID NO: 2510315 - protein, 24 aa, Entamoeba dispar
YGVDGLYDLYAIVVHLGKTKFSGH

SEQ ID NO: 2510316 - protein, 24 aa, Entamoeba dispar
YGVELFLLLCSLKVVFPNQFIILR

SEQ ID NO: 2510317 - protein, 17 aa, Entamoeba dispar
YGVIFGSTFIARAEAKN

SEQ ID NO: 2510318 - protein, 18 aa, Entamoeba dispar
YGVIQCFHSLNYEYMKSK

SEQ ID NO: 2510319 - protein, 22 aa, Entamoeba dispar
YGVKFIRPLIEVPVVLIQEWTK

SEQ ID NO: 2510320 - protein, 25 aa, Entamoeba dispar
YGVTSIGVFEYVKLGLDYLKLNNYT

SEQ ID NO: 2510321 - protein, 20 aa, Entamoeba dispar
YGYHLPKRANVIMTVGEKKK

SEQ ID NO: 2510322 - protein, 25 aa, Entamoeba dispar
YGYKDLKVHVLISVYSHQMYVDFSY

SEQ ID NO: 2510323 - protein, 17 aa, Entamoeba dispar
YGYKGANALGLTRWRDL

SEQ ID NO: 2510324 - protein, 24 aa, Entamoeba dispar
YGYNELRVPFGIENESIPLDYSFI

SEQ ID NO: 2510325 - protein, 24 aa, Entamoeba dispar
YGYSDIKKAILLMLVGSTPKIRLR

SEQ ID NO: 2510326 - protein, 20 aa, Entamoeba dispar
YHAIELFRKAKMTWFGVEVC

SEQ ID NO: 2510327 - protein, 26 aa, Entamoeba dispar
YHCKRLKRIKIPSLLFDSFKQINEEI

SEQ ID NO: 2510328 - protein, 19 aa, Entamoeba dispar
YHDSLKYIFFPGGSGNCYS

SEQ ID NO: 2510329 - protein, 17 aa, Entamoeba dispar
YHEVLKLLLESGSGSKE

SEQ ID NO: 2510330 - protein, 31 aa, Entamoeba dispar
YHFENLFLPSFFKKFGMDYSISAFDAAHAIG

SEQ ID NO: 2510331 - protein, 24 aa, Entamoeba dispar
YHFMFPIEPFKIITMIKPQEKCFG

SEQ ID NO: 2510332 - protein, 22 aa, Entamoeba dispar
YHGIKLLLYLLKHQSYSSEVEL

SEQ ID NO: 2510333 - protein, 18 aa, Entamoeba dispar
YHIECGFNLKFDEESKKV

SEQ ID NO: 2510334 - protein, 18 aa, Entamoeba dispar
YHIIERILSEAYNIETPI

SEQ ID NO: 2510335 - protein, 19 aa, Entamoeba dispar
YHINRIFYTGGFVAHNPVV

SEQ ID NO: 2510336 - protein, 17 aa, Entamoeba dispar
YHIRKARKTLIFVELRD

SEQ ID NO: 2510337 - protein, 18 aa, Entamoeba dispar
YHITACTKPSINPFPPFI

SEQ ID NO: 2510338 - protein, 18 aa, Entamoeba dispar
YHKDLQCHPINRKVKSIS

SEQ ID NO: 2510339 - protein, 18 aa, Entamoeba dispar
YHKKLTVIYSMKDKHEEG

SEQ ID NO: 2510340 - protein, 31 aa, Entamoeba dispar
YHLEKVLSKVFCEFIRCAYHRTREIAKIKAT

SEQ ID NO: 2510341 - protein, 20 aa, Entamoeba dispar
YHLIPQIEILPDNKFAIKYL

SEQ ID NO: 2510342 - protein, 24 aa, Entamoeba dispar
YHLKFLIQPFLHWPDTMMTVIEEL

SEQ ID NO: 2510343 - protein, 19 aa, Entamoeba dispar
YHLKLCFCPLCQKGMAVLA

SEQ ID NO: 2510344 - protein, 17 aa, Entamoeba dispar
YHLLYYLLNLFISSYSD

SEQ ID NO: 2510345 - protein, 17 aa, Entamoeba dispar
YHLNYFRAIKKALDQSK

SEQ ID NO: 2510346 - protein, 23 aa, Entamoeba dispar
YHMIYWYISILFSMSYEHLNEFR

SEQ ID NO: 2510347 - protein, 18 aa, Entamoeba dispar
YHNACFKCKECGLHLTLK

SEQ ID NO: 2510348 - protein, 28 aa, Entamoeba dispar
YHNHCSKFGKAFSRFHQCLNSHQFKNFV

SEQ ID NO: 2510349 - protein, 17 aa, Entamoeba dispar
YHNPIIQYQIEEINGIR

SEQ ID NO: 2510350 - protein, 30 aa, Entamoeba dispar
YHPECFVCSVCKAPFPRGQFYNLDGKPVCA

SEQ ID NO: 2510351 - protein, 29 aa, Entamoeba dispar
YHPHICIGEGYGALILYHFLTNHKYDGNS

SEQ ID NO: 2510352 - protein, 18 aa, Entamoeba dispar
YHPIIVLFYGLPRYPHEF

SEQ ID NO: 2510353 - protein, 37 aa, Entamoeba dispar
YHPQCFVANVTCKLCGKPFSFPKMEFKIYNDQAYHPL

SEQ ID NO: 2510354 - protein, 21 aa, Entamoeba dispar
YHQDGKCLGSLLTYCESSDYK

SEQ ID NO: 2510355 - protein, 23 aa, Entamoeba dispar
YHQIRLFKFTFWITSVDIEEIEQ

SEQ ID NO: 2510356 - protein, 25 aa, Entamoeba dispar
YHQQCFGCTICSRKLGASFVTVDNQ

SEQ ID NO: 2510357 - protein, 17 aa, Entamoeba dispar
YHRDWKRIEQHVKTKTV

SEQ ID NO: 2510358 - protein, 18 aa, Entamoeba dispar
YHRESLFFGDKVTIDQSI

SEQ ID NO: 2510359 - protein, 18 aa, Entamoeba dispar
YHRLPIFLREESFRKKPK

SEQ ID NO: 2510360 - protein, 31 aa, Entamoeba dispar
YHRMCGRCMKKFPGVVVCPICNNICTCATCK

SEQ ID NO: 2510361 - protein, 25 aa, Entamoeba dispar
YHSECFVCTKCSKPFPTPSFFQKDG

SEQ ID NO: 2510362 - protein, 22 aa, Entamoeba dispar
YHSEPYFLSLTFKNDIAKDGTE

SEQ ID NO: 2510363 - protein, 18 aa, Entamoeba dispar
YHSNPFTTLYALRVLDTF

SEQ ID NO: 2510364 - protein, 18 aa, Entamoeba dispar
YHSPFAFPVPEELSSEVI

SEQ ID NO: 2510365 - protein, 26 aa, Entamoeba dispar
YHTKCFRCCCCAKILEGNKLANCERL

SEQ ID NO: 2510366 - protein, 17 aa, Entamoeba dispar
YHTSVQWYCNDTMMITR

SEQ ID NO: 2510367 - protein, 21 aa, Entamoeba dispar
YHYIELLAANCLMKMNSDQSV

SEQ ID NO: 2510368 - protein, 20 aa, Entamoeba dispar
YHYKVHFDFEPNEYFTNETI

SEQ ID NO: 2510369 - protein, 18 aa, Entamoeba dispar
YIAHHCYFFRKSNLKRLY

SEQ ID NO: 2510370 - protein, 17 aa, Entamoeba dispar
YIAKLCKSFNIRYQNET

SEQ ID NO: 2510371 - protein, 24 aa, Entamoeba dispar
YIALRIIEMTTIFVTGNVSGDTFV

SEQ ID NO: 2510372 - protein, 19 aa, Entamoeba dispar
YIAYCKAYCIPRLTENASN

SEQ ID NO: 2510373 - protein, 25 aa, Entamoeba dispar
YICDSRTTLSILFQHEFELQVMIDS

SEQ ID NO: 2510374 - protein, 26 aa, Entamoeba dispar
YICQMYWKGIEWCCISTFRGIPDWDW

SEQ ID NO: 2510375 - protein, 23 aa, Entamoeba dispar
YICWDPMGLFLGAVRSYVYSPHA

SEQ ID NO: 2510376 - protein, 18 aa, Entamoeba dispar
YICYKRKNLDDELIDVTN

SEQ ID NO: 2510377 - protein, 18 aa, Entamoeba dispar
YIDFNYFNYISIRFTMAG

SEQ ID NO: 2510378 - protein, 22 aa, Entamoeba dispar
YIDFPKKLKIERLLNSQYDKKT

SEQ ID NO: 2510379 - protein, 26 aa, Entamoeba dispar
YIDLLIILFVQWKFGSDQWKLLKDDL

SEQ ID NO: 2510380 - protein, 18 aa, Entamoeba dispar
YIDVCISSTLTIWNCQIT

SEQ ID NO: 2510381 - protein, 18 aa, Entamoeba dispar
YIDVYRLLYPELPRLEFI

SEQ ID NO: 2510382 - protein, 18 aa, Entamoeba dispar
YIEAEWWSKLIARFPSSK

SEQ ID NO: 2510383 - protein, 24 aa, Entamoeba dispar
YIEAFNYCRITSFPLTEDPHIVTS

SEQ ID NO: 2510384 - protein, 30 aa, Entamoeba dispar
YIEQLAKINVCNELFEVPSIDKTNLSGNYA

SEQ ID NO: 2510385 - protein, 17 aa, Entamoeba dispar
YIERWCEILCNKPKSVT

SEQ ID NO: 2510386 - protein, 22 aa, Entamoeba dispar
YIEYLKLLPFNIALNSYNKSEK

SEQ ID NO: 2510387 - protein, 19 aa, Entamoeba dispar
YIFCGDLLSSEAFNMIDSG

SEQ ID NO: 2510388 - protein, 25 aa, Entamoeba dispar
YIFDGIKHVLIWNIGKNDPKIVPTI

SEQ ID NO: 2510389 - protein, 27 aa, Entamoeba dispar
YIFERKECFNYLFAQMREGIQWVIQNK

SEQ ID NO: 2510390 - protein, 19 aa, Entamoeba dispar
YIFNIPEGVQRCCMEYKLK

SEQ ID NO: 2510391 - protein, 18 aa, Entamoeba dispar
YIGCNGFSGRFGKYEEDN

SEQ ID NO: 2510392 - protein, 19 aa, Entamoeba dispar
YIGEGTFGIVRRVIEKETQ

SEQ ID NO: 2510393 - protein, 18 aa, Entamoeba dispar
YIGFELPIPLILNTSKIY

SEQ ID NO: 2510394 - protein, 23 aa, Entamoeba dispar
YIGKECFYGCYSLTSITVLTTIR

SEQ ID NO: 2510395 - protein, 24 aa, Entamoeba dispar
YIGQWKGNELIPTKSNFIIPQIIR

SEQ ID NO: 2510396 - protein, 23 aa, Entamoeba dispar
YIGTEGWISCQITFMKIYYDDIQ

SEQ ID NO: 2510397 - protein, 17 aa, Entamoeba dispar
YIHDYGFSYLTQEVTQL

SEQ ID NO: 2510398 - protein, 20 aa, Entamoeba dispar
YIHLDIRPKNILIRNQRAVI

SEQ ID NO: 2510399 - protein, 17 aa, Entamoeba dispar
YIHLGGLFYVYQINRFN

SEQ ID NO: 2510400 - protein, 18 aa, Entamoeba dispar
YIHSLGCIHRDLKPDNIL

SEQ ID NO: 2510401 - protein, 18 aa, Entamoeba dispar
YIHSLGCIHRDLKPDNVL

SEQ ID NO: 2510402 - protein, 20 aa, Entamoeba dispar
YIICIPRIYSRWKEEGYINN

SEQ ID NO: 2510403 - protein, 17 aa, Entamoeba dispar
YIIGGLIPIEGKTKGVP

SEQ ID NO: 2510404 - protein, 17 aa, Entamoeba dispar
YIIGILSDFIHSESFIR

SEQ ID NO: 2510405 - protein, 17 aa, Entamoeba dispar
YIIGQGGIQAIIIVLDF

SEQ ID NO: 2510406 - protein, 17 aa, Entamoeba dispar
YIIGQGGIQTIVIVLDF

SEQ ID NO: 2510407 - protein, 26 aa, Entamoeba dispar
YIIHMPCGPSFHFKLFNLMKPKDIKG

SEQ ID NO: 2510408 - protein, 20 aa, Entamoeba dispar
YIIICSHANLALDIKGGNDK

SEQ ID NO: 2510409 - protein, 27 aa, Entamoeba dispar
YIIPTEIKGLYGIFGLGDGFVIGSNKN

SEQ ID NO: 2510410 - protein, 19 aa, Entamoeba dispar
YIISSCLLIGYIYKTVEEG

SEQ ID NO: 2510411 - protein, 20 aa, Entamoeba dispar
YIIVTHCDEEDCTGGLIDEI

SEQ ID NO: 2510412 - protein, 22 aa, Entamoeba dispar
YIIYTTLAWRNVKYGNCSQFVW

SEQ ID NO: 2510413 - protein, 18 aa, Entamoeba dispar
YIKIKVPIELFKYYINEH

SEQ ID NO: 2510414 - protein, 20 aa, Entamoeba dispar
YIKILLRSAISSSPYKALEI

SEQ ID NO: 2510415 - protein, 23 aa, Entamoeba dispar
YIKKVIVHPLVLLSISDHQTRAN

SEQ ID NO: 2510416 - protein, 18 aa, Entamoeba dispar
YIKLGFKLQPKYMSHLIQ

SEQ ID NO: 2510417 - protein, 32 aa, Entamoeba dispar
YIKQEKLECPLLFLWGNLYGNLQFVKEQNENG

SEQ ID NO: 2510418 - protein, 22 aa, Entamoeba dispar
YIKSGSHFIALVTRIPAKIPLI

SEQ ID NO: 2510419 - protein, 23 aa, Entamoeba dispar
YIKVPLKEAEEICIVSMKDYIFE

SEQ ID NO: 2510420 - protein, 23 aa, Entamoeba dispar
YIKVPLKEAEEIYVVSMKDYIFE

SEQ ID NO: 2510421 - protein, 24 aa, Entamoeba dispar
YIKVPLKEAEEIYVVSMKDYIFEE

SEQ ID NO: 2510422 - protein, 22 aa, Entamoeba dispar
YIKYIPECLNLYKEQLMTRIPQ

SEQ ID NO: 2510423 - protein, 22 aa, Entamoeba dispar
YILDLYLKYFSNLEELFILKDI

SEQ ID NO: 2510424 - protein, 45 aa, Entamoeba dispar
YILECPKHIACIHCKAGRGRTGLICSCVLLSLGKCIDAKKALELF

SEQ ID NO: 2510425 - protein, 23 aa, Entamoeba dispar
YILEIPSCLSLLTNLYQLSLFAN

SEQ ID NO: 2510426 - protein, 17 aa, Entamoeba dispar
YILKACGPLSKAVETVF

SEQ ID NO: 2510427 - protein, 17 aa, Entamoeba dispar
YILKLLSIFGRYYRNRP

SEQ ID NO: 2510428 - protein, 23 aa, Entamoeba dispar
YILKMRTSVQIFREVNNKYPTFP

SEQ ID NO: 2510429 - protein, 17 aa, Entamoeba dispar
YILLSAIVKKYLRETIE

SEQ ID NO: 2510430 - protein, 17 aa, Entamoeba dispar
YILNFGETLLFEKIVGL

SEQ ID NO: 2510431 - protein, 24 aa, Entamoeba dispar
YILQEFLSTCLVKIPQARPSAYTL

SEQ ID NO: 2510432 - protein, 24 aa, Entamoeba dispar
YILQKLVQKFPMFIAKCNVISGVG

SEQ ID NO: 2510433 - protein, 25 aa, Entamoeba dispar
YILSGCYYLITKGWSFLFSKEKRIA

SEQ ID NO: 2510434 - protein, 26 aa, Entamoeba dispar
YILSGCYYLITKGWSFLFSKEKRIAG

SEQ ID NO: 2510435 - protein, 25 aa, Entamoeba dispar
YILSGCYYLITKGWSFLFSKEKRTA

SEQ ID NO: 2510436 - protein, 18 aa, Entamoeba dispar
YILSRYPLIRTIDHIKHL

SEQ ID NO: 2510437 - protein, 22 aa, Entamoeba dispar
YIMNKCSFPKTGTNTLVNPPMA

SEQ ID NO: 2510438 - protein, 22 aa, Entamoeba dispar
YINCLNLSWEKVPEMLRNMNNG

SEQ ID NO: 2510439 - protein, 19 aa, Entamoeba dispar
YINNHLVKMMGGLKRRAIS

SEQ ID NO: 2510440 - protein, 19 aa, Entamoeba dispar
YINQMKWIGNTVVIVMSNR

SEQ ID NO: 2510441 - protein, 18 aa, Entamoeba dispar
YINTFQCYHSVIKTKGEL

SEQ ID NO: 2510442 - protein, 23 aa, Entamoeba dispar
YINYWSAALKYRFNIGERTVKMV

SEQ ID NO: 2510443 - protein, 25 aa, Entamoeba dispar
YIPFTNNYFFKWQFNDTITCKLGIQ

SEQ ID NO: 2510444 - protein, 19 aa, Entamoeba dispar
YIPGSRMVHLSKTFKYFVP

SEQ ID NO: 2510445 - protein, 22 aa, Entamoeba dispar
YIPHKRNGFALLQSYVTYSEEN

SEQ ID NO: 2510446 - protein, 20 aa, Entamoeba dispar
YIPSFWHFHIHFCTIHSPLF

SEQ ID NO: 2510447 - protein, 26 aa, Entamoeba dispar
YIPTCPFPIDFNLILQRLINDNYYRT

SEQ ID NO: 2510448 - protein, 17 aa, Entamoeba dispar
YIPTIGVDVHPMLFNTN

SEQ ID NO: 2510449 - protein, 28 aa, Entamoeba dispar
YIQCNLCKTRNPFVLGFLQVKQNSDMTT

SEQ ID NO: 2510450 - protein, 25 aa, Entamoeba dispar
YIQFFSRLFIIKRVVKEDDLIQSIQ

SEQ ID NO: 2510451 - protein, 18 aa, Entamoeba dispar
YIQIDGLLGLLFCYLNTL

SEQ ID NO: 2510452 - protein, 25 aa, Entamoeba dispar
YIQIYDCRDYYSALGNKAFKQAGFE

SEQ ID NO: 2510453 - protein, 22 aa, Entamoeba dispar
YIQKCNTKPLFIFKSTSEEQLN

SEQ ID NO: 2510454 - protein, 18 aa, Entamoeba dispar
YIQPAIEVSGLLVLDHSA

SEQ ID NO: 2510455 - protein, 29 aa, Entamoeba dispar
YIQQEGRIKARWMRKNARRIDMEQYTKTD

SEQ ID NO: 2510456 - protein, 18 aa, Entamoeba dispar
YIQRKMVKCMEDVQCKYD

SEQ ID NO: 2510457 - protein, 22 aa, Entamoeba dispar
YIRCKKVKYNREVIYDESTEFN

SEQ ID NO: 2510458 - protein, 19 aa, Entamoeba dispar
YIRKCVRLNQNIDVVLFNR

SEQ ID NO: 2510459 - protein, 21 aa, Entamoeba dispar
YIRNTYDLSRIMLIGNVKNYI

SEQ ID NO: 2510460 - protein, 22 aa, Entamoeba dispar
YIRTRDGFILMYSITSRYSFDL

SEQ ID NO: 2510461 - protein, 19 aa, Entamoeba dispar
YIRVTTICRLFTSISSEGL

SEQ ID NO: 2510462 - protein, 17 aa, Entamoeba dispar
YISDGSSVLNEMIPLTG

SEQ ID NO: 2510463 - protein, 24 aa, Entamoeba dispar
YISDKQLHCVFIFNKKNGKISIFG

SEQ ID NO: 2510464 - protein, 18 aa, Entamoeba dispar
YISIGDNCIINFNCTVLE

SEQ ID NO: 2510465 - protein, 21 aa, Entamoeba dispar
YISMFTGFFVVEFDLEDGEVI

SEQ ID NO: 2510466 - protein, 26 aa, Entamoeba dispar
YISMNFRFTEPLWKKYENKIKEGIMS

SEQ ID NO: 2510467 - protein, 21 aa, Entamoeba dispar
YISSILSRSIMNWDLKGMDIM

SEQ ID NO: 2510468 - protein, 19 aa, Entamoeba dispar
YISTFSHERISYFSVTTSI

SEQ ID NO: 2510469 - protein, 26 aa, Entamoeba dispar
YISVMPEFRRSIFIDCPLFKSKEKPP

SEQ ID NO: 2510470 - protein, 25 aa, Entamoeba dispar
YITAYFLLYIDIEFVKPYIRNTYDL

SEQ ID NO: 2510471 - protein, 17 aa, Entamoeba dispar
YITCSFDRYICTPTEDE

SEQ ID NO: 2510472 - protein, 17 aa, Entamoeba dispar
YITGNFKVSEWRYQSFN

SEQ ID NO: 2510473 - protein, 18 aa, Entamoeba dispar
YITIYDCLIGYLYSFQTC

SEQ ID NO: 2510474 - protein, 26 aa, Entamoeba dispar
YITKEEFQADMLLVFDNALLFNHPDS

SEQ ID NO: 2510475 - protein, 17 aa, Entamoeba dispar
YITKRDEIIQSLKQLDG

SEQ ID NO: 2510476 - protein, 17 aa, Entamoeba dispar
YITNLYGAISFLLEING

SEQ ID NO: 2510477 - protein, 27 aa, Entamoeba dispar
YITPKMRQKLVDWIAEISTVLTLLSET

SEQ ID NO: 2510478 - protein, 19 aa, Entamoeba dispar
YIVEGEFEKAFVYALEEPV

SEQ ID NO: 2510479 - protein, 24 aa, Entamoeba dispar
YIVKSGIATKVYVPLSYEDEKNTL

SEQ ID NO: 2510480 - protein, 18 aa, Entamoeba dispar
YIVSEPIPKLYVSELIQL

SEQ ID NO: 2510481 - protein, 18 aa, Entamoeba dispar
YIVVSGFSKKGERTISLF

SEQ ID NO: 2510482 - protein, 17 aa, Entamoeba dispar
YIYCSKVVNEIISTEQT

SEQ ID NO: 2510483 - protein, 19 aa, Entamoeba dispar
YIYCVVGYLIYLRKKILDA

SEQ ID NO: 2510484 - protein, 27 aa, Entamoeba dispar
YIYDDLKYIYVWVGKKCNDFKKAKAKS

SEQ ID NO: 2510485 - protein, 26 aa, Entamoeba dispar
YIYFCDVCSLFYSSSQFISWFYSSLI

SEQ ID NO: 2510486 - protein, 20 aa, Entamoeba dispar
YIYQCLKTTMFEEPFPIERK

SEQ ID NO: 2510487 - protein, 17 aa, Entamoeba dispar
YIYSIIPSICPLLVHPN

SEQ ID NO: 2510488 - protein, 17 aa, Entamoeba dispar
YKAEEFSLPITFTCWPA

SEQ ID NO: 2510489 - protein, 22 aa, Entamoeba dispar
YKAESLVFSSMINKIMGTKYAL

SEQ ID NO: 2510490 - protein, 35 aa, Entamoeba dispar
YKAGEWTPEDFLWQGKCVVVARGDQCIVKFVDSNT

SEQ ID NO: 2510491 - protein, 26 aa, Entamoeba dispar
YKAMLACLFPVLKQVIYKEGCKEIVI

SEQ ID NO: 2510492 - protein, 17 aa, Entamoeba dispar
YKAVVPQLLKLKLKTKS

SEQ ID NO: 2510493 - protein, 18 aa, Entamoeba dispar
YKCGQVGHKSIDCPENTD

SEQ ID NO: 2510494 - protein, 21 aa, Entamoeba dispar
YKCIKLLHERNAFKEIRRDNL

SEQ ID NO: 2510495 - protein, 19 aa, Entamoeba dispar
YKCPKCLTPYCTVSCFKKH

SEQ ID NO: 2510496 - protein, 17 aa, Entamoeba dispar
YKCRAEVSNAETLNVKT

SEQ ID NO: 2510497 - protein, 28 aa, Entamoeba dispar
YKDCKTCPDCLQLGIPCEKHNDSYFPFV

SEQ ID NO: 2510498 - protein, 25 aa, Entamoeba dispar
YKDGIDCFKCETLELLLIQKEKGIE

SEQ ID NO: 2510499 - protein, 22 aa, Entamoeba dispar
YKDHVWFKGKYKPFKTREDERD

SEQ ID NO: 2510500 - protein, 29 aa, Entamoeba dispar
YKDLMIYENYRFLAGKSHEGKERITTIIV

SEQ ID NO: 2510501 - protein, 17 aa, Entamoeba dispar
YKDLPKKFSRYRNSNYQ

SEQ ID NO: 2510502 - protein, 22 aa, Entamoeba dispar
YKDPFELINEIVCDYELSTILL

SEQ ID NO: 2510503 - protein, 17 aa, Entamoeba dispar
YKDVLKYFGENVSKPPA

SEQ ID NO: 2510504 - protein, 22 aa, Entamoeba dispar
YKEARELFLHPDVADFSDYKLE

SEQ ID NO: 2510505 - protein, 20 aa, Entamoeba dispar
YKECSCHTIAGLFKSFVREL

SEQ ID NO: 2510506 - protein, 25 aa, Entamoeba dispar
YKEDRARIVKELQELGVEDIPEQPQ

SEQ ID NO: 2510507 - protein, 21 aa, Entamoeba dispar
YKEEVKKAIEFVFGNTMICEK

SEQ ID NO: 2510508 - protein, 17 aa, Entamoeba dispar
YKEGITIMKDMGFDEEI

SEQ ID NO: 2510509 - protein, 18 aa, Entamoeba dispar
YKEIEVITTHLTIDKINK

SEQ ID NO: 2510510 - protein, 22 aa, Entamoeba dispar
YKELIHICCCIIKYINYKELLS

SEQ ID NO: 2510511 - protein, 23 aa, Entamoeba dispar
YKELKRTVPEFQIPKHGYLIEWA

SEQ ID NO: 2510512 - protein, 22 aa, Entamoeba dispar
YKELKYDVLTLKSLDFTPQSLV

SEQ ID NO: 2510513 - protein, 19 aa, Entamoeba dispar
YKENIPPFLLIDGDASVTI

SEQ ID NO: 2510514 - protein, 32 aa, Entamoeba dispar
YKEPCNYFKGDICYKCPLGYYNINGICTKCKE

SEQ ID NO: 2510515 - protein, 31 aa, Entamoeba dispar
YKESINFVVDLLIELGYCITFFETSGRNKSL

SEQ ID NO: 2510516 - protein, 35 aa, Entamoeba dispar
YKFDELMGFIKLSNCIICIGIKGIKCIEINGQIIK

SEQ ID NO: 2510517 - protein, 20 aa, Entamoeba dispar
YKFFKELFFSKSQTQFYVFR

SEQ ID NO: 2510518 - protein, 17 aa, Entamoeba dispar
YKFGVIYMKKNQRSEEE

SEQ ID NO: 2510519 - protein, 21 aa, Entamoeba dispar
YKFKDSFKIKEYIPCPQPFWD

SEQ ID NO: 2510520 - protein, 19 aa, Entamoeba dispar
YKFKIKSLPFFKVKTLYNV

SEQ ID NO: 2510521 - protein, 17 aa, Entamoeba dispar
YKFPSRLDLSDEVKDLI

SEQ ID NO: 2510522 - protein, 25 aa, Entamoeba dispar
YKFSPEIAEPIASLIEGMLIYDEDK

SEQ ID NO: 2510523 - protein, 19 aa, Entamoeba dispar
YKFTKWRNYQALQEAFFIG

SEQ ID NO: 2510524 - protein, 17 aa, Entamoeba dispar
YKGFPVNIIRNYMKSLL

SEQ ID NO: 2510525 - protein, 19 aa, Entamoeba dispar
YKGIELMQAVFNGEQIQPF

SEQ ID NO: 2510526 - protein, 17 aa, Entamoeba dispar
YKGKGVVIPEPYINIYE

SEQ ID NO: 2510527 - protein, 22 aa, Entamoeba dispar
YKGVKEWICEKYLHTIQDFMKT

SEQ ID NO: 2510528 - protein, 21 aa, Entamoeba dispar
YKGWCGIAHASLELKLYSEAL

SEQ ID NO: 2510529 - protein, 17 aa, Entamoeba dispar
YKHGMKISAKYQKQCAL

SEQ ID NO: 2510530 - protein, 18 aa, Entamoeba dispar
YKHIEWLCGFTGSNATIV

SEQ ID NO: 2510531 - protein, 17 aa, Entamoeba dispar
YKIEIQGNNFIAHVGNT

SEQ ID NO: 2510532 - protein, 17 aa, Entamoeba dispar
YKIELIVSSLLEEKQPK

SEQ ID NO: 2510533 - protein, 26 aa, Entamoeba dispar
YKIFKGCSSLRLINLGKIKFISEERI

SEQ ID NO: 2510534 - protein, 19 aa, Entamoeba dispar
YKIFNKWISSGLFSSKKLL

SEQ ID NO: 2510535 - protein, 18 aa, Entamoeba dispar
YKIIRWAAPGSCVIGSFY

SEQ ID NO: 2510536 - protein, 21 aa, Entamoeba dispar
YKIKEMENVFSRIVTGIPNEN

SEQ ID NO: 2510537 - protein, 23 aa, Entamoeba dispar
YKIKSNEIIVIFTCNQESPSEIK

SEQ ID NO: 2510538 - protein, 20 aa, Entamoeba dispar
YKINQVFDMNKMELIGVMQS

SEQ ID NO: 2510539 - protein, 17 aa, Entamoeba dispar
YKINVMRPSFVVSDSKT

SEQ ID NO: 2510540 - protein, 17 aa, Entamoeba dispar
YKINVVCKSCIKPFPPF

SEQ ID NO: 2510541 - protein, 29 aa, Entamoeba dispar
YKIPETYIKDLLRLGAEMLPQDYLQRLVS

SEQ ID NO: 2510542 - protein, 26 aa, Entamoeba dispar
YKITCYLRSLHVIERISRTTSAPNQI

SEQ ID NO: 2510543 - protein, 25 aa, Entamoeba dispar
YKKANCIQTGFIYCTRCVKKEEKYE

SEQ ID NO: 2510544 - protein, 17 aa, Entamoeba dispar
YKKFEIADQPWINTSPT

SEQ ID NO: 2510545 - protein, 20 aa, Entamoeba dispar
YKKFIPALIQYYKQPQEKHL

SEQ ID NO: 2510546 - protein, 23 aa, Entamoeba dispar
YKKFKISAFLITPVQRLPRYKLL

SEQ ID NO: 2510547 - protein, 24 aa, Entamoeba dispar
YKKFKYYLNRGLKRNDQITFYIIN

SEQ ID NO: 2510548 - protein, 24 aa, Entamoeba dispar
YKKGNVKLILLIGGTCKMPRIRDE

SEQ ID NO: 2510549 - protein, 26 aa, Entamoeba dispar
YKKGSGKIVICFDRIIIVKGNTISHD

SEQ ID NO: 2510550 - protein, 20 aa, Entamoeba dispar
YKKGSRIFSKGFGFVEVSNK

SEQ ID NO: 2510551 - protein, 19 aa, Entamoeba dispar
YKKGYNCISYPSVMNVAGI

SEQ ID NO: 2510552 - protein, 18 aa, Entamoeba dispar
YKKIDIITNDFCPNGIDA

SEQ ID NO: 2510553 - protein, 17 aa, Entamoeba dispar
YKKIGIRVYDEVPNEST

SEQ ID NO: 2510554 - protein, 17 aa, Entamoeba dispar
YKKIGVHFHLPELTDLE

SEQ ID NO: 2510555 - protein, 23 aa, Entamoeba dispar
YKKKGFNSNLFGKIIKLTVTNFM

SEQ ID NO: 2510556 - protein, 25 aa, Entamoeba dispar
YKKLADACEGYFKAQLVMIKATDTL

SEQ ID NO: 2510557 - protein, 22 aa, Entamoeba dispar
YKKLDEINHLILIKNWTEALES

SEQ ID NO: 2510558 - protein, 22 aa, Entamoeba dispar
YKKLPKSFVIRRGKIGKSSKAL

SEQ ID NO: 2510559 - protein, 20 aa, Entamoeba dispar
YKKLTSVIIPTNITRLEENY

SEQ ID NO: 2510560 - protein, 24 aa, Entamoeba dispar
YKKMKGECWINVYNLKTFKLIHKT

SEQ ID NO: 2510561 - protein, 22 aa, Entamoeba dispar
YKKPKCLPKQYIKVRTISKYSY

SEQ ID NO: 2510562 - protein, 33 aa, Entamoeba dispar
YKKQFPDLKISEIGKKIGVEWKELPEEQKKKYI

SEQ ID NO: 2510563 - protein, 23 aa, Entamoeba dispar
YKKSKETLPHLCILHNNTISLYE

SEQ ID NO: 2510564 - protein, 25 aa, Entamoeba dispar
YKKVLFNPIIKKGCNDIYVYLSGFE

SEQ ID NO: 2510565 - protein, 35 aa, Entamoeba dispar
YKKYDYVCALKVVFKRQLQKCGMGIQMKREIELQS

SEQ ID NO: 2510566 - protein, 27 aa, Entamoeba dispar
YKLDLRIIRALYDLGFINPTEIQQLSI

SEQ ID NO: 2510567 - protein, 25 aa, Entamoeba dispar
YKLETIPSKIKFLSIFKKNVSNEVN

SEQ ID NO: 2510568 - protein, 20 aa, Entamoeba dispar
YKLGVVEIIHKFVWQNPWIH

SEQ ID NO: 2510569 - protein, 18 aa, Entamoeba dispar
YKLIKALHLINGNIRIVV

SEQ ID NO: 2510570 - protein, 22 aa, Entamoeba dispar
YKLKYPHSIFLLRGNHEDEKIC

SEQ ID NO: 2510571 - protein, 20 aa, Entamoeba dispar
YKLLCSQALHKSLIKGNMEL

SEQ ID NO: 2510572 - protein, 26 aa, Entamoeba dispar
YKLMLERHSHFFKKNESKFEFAQEMF

SEQ ID NO: 2510573 - protein, 18 aa, Entamoeba dispar
YKLNIIVRYYNKSKIVIN

SEQ ID NO: 2510574 - protein, 23 aa, Entamoeba dispar
YKLSMKLGNEFAKFHVGCVKMIK

SEQ ID NO: 2510575 - protein, 28 aa, Entamoeba dispar
YKLYFIACQKISHVFSYLDRFFIKQQKA

SEQ ID NO: 2510576 - protein, 18 aa, Entamoeba dispar
YKMMKDPFANYVLQRMFT

SEQ ID NO: 2510577 - protein, 18 aa, Entamoeba dispar
YKMNCFAIELERYNIVNI

SEQ ID NO: 2510578 - protein, 18 aa, Entamoeba dispar
YKMNCFAIELERYNTVNI

SEQ ID NO: 2510579 - protein, 21 aa, Entamoeba dispar
YKMTVYLTKILPRFVSDINNE

SEQ ID NO: 2510580 - protein, 19 aa, Entamoeba dispar
YKNDLKRADSNIALSQKKL

SEQ ID NO: 2510581 - protein, 28 aa, Entamoeba dispar
YKNELRLRLCVLFLRTLYEELLKHKSSD

SEQ ID NO: 2510582 - protein, 24 aa, Entamoeba dispar
YKNGIEGCDILSARLNELAHKKRS

SEQ ID NO: 2510583 - protein, 26 aa, Entamoeba dispar
YKNGVIKDINIVSGIANEVVTGFQVN

SEQ ID NO: 2510584 - protein, 25 aa, Entamoeba dispar
YKNIIKGHFNFKEVLTLSDIEAAAL

SEQ ID NO: 2510585 - protein, 20 aa, Entamoeba dispar
YKNIKNWHGEVSRYCGSHGI

SEQ ID NO: 2510586 - protein, 17 aa, Entamoeba dispar
YKNKLFVTVSFTTVLDT

SEQ ID NO: 2510587 - protein, 23 aa, Entamoeba dispar
YKNLPMQLLYSLQFSGQIHQITK

SEQ ID NO: 2510588 - protein, 20 aa, Entamoeba dispar
YKNLYIVGSGLKSIPSGKFF

SEQ ID NO: 2510589 - protein, 21 aa, Entamoeba dispar
YKNPRKEGGPHYDIVPGNDPA

SEQ ID NO: 2510590 - protein, 22 aa, Entamoeba dispar
YKNPRYCNSEIFNFEELKEVFE

SEQ ID NO: 2510591 - protein, 32 aa, Entamoeba dispar
YKNQLPYLFPGVPLTFIDHFPRDENVKSVIDM

SEQ ID NO: 2510592 - protein, 20 aa, Entamoeba dispar
YKNRSYRDVEWVKGKDLSEV

SEQ ID NO: 2510593 - protein, 21 aa, Entamoeba dispar
YKNYFICSAKTGDGCKEALKC

SEQ ID NO: 2510594 - protein, 21 aa, Entamoeba dispar
YKPEKLEIMQNVFNPRFKYGR

SEQ ID NO: 2510595 - protein, 21 aa, Entamoeba dispar
YKPGCQEFGGFCNRNEWMYLI

SEQ ID NO: 2510596 - protein, 29 aa, Entamoeba dispar
YKPIHRMIKKEVYVPAKLREWVNSKEIED

SEQ ID NO: 2510597 - protein, 25 aa, Entamoeba dispar
YKPLKVPGVCLICKQKNIRYAYHTV

SEQ ID NO: 2510598 - protein, 24 aa, Entamoeba dispar
YKPLQQIACIFLRQSISHTNMDVS

SEQ ID NO: 2510599 - protein, 19 aa, Entamoeba dispar
YKPMETFKMPFPQKEIKKY

SEQ ID NO: 2510600 - protein, 17 aa, Entamoeba dispar
YKPPRLVVNKSLHLEDF

SEQ ID NO: 2510601 - protein, 18 aa, Entamoeba dispar
YKPYFTTIDDLYCNNCTF

SEQ ID NO: 2510602 - protein, 21 aa, Entamoeba dispar
YKQTFEIVRRHKINYNFIRDY

SEQ ID NO: 2510603 - protein, 18 aa, Entamoeba dispar
YKQWETILPKTINLFNQL

SEQ ID NO: 2510604 - protein, 21 aa, Entamoeba dispar
YKRGNVQLVLLNGGTCKMPRI

SEQ ID NO: 2510605 - protein, 18 aa, Entamoeba dispar
YKRISILKNRKIDMDRHF

SEQ ID NO: 2510606 - protein, 19 aa, Entamoeba dispar
YKRRCAHFKDSMKKYNKCL

SEQ ID NO: 2510607 - protein, 20 aa, Entamoeba dispar
YKRYLNYTFLNDKRTSELKK

SEQ ID NO: 2510608 - protein, 19 aa, Entamoeba dispar
YKSCVFDMNSIVHQLDALI

SEQ ID NO: 2510609 - protein, 32 aa, Entamoeba dispar
YKSDKSLQHAISWLFLNMCRGTIINYNEVSQY

SEQ ID NO: 2510610 - protein, 19 aa, Entamoeba dispar
YKSFIKFISHQDKENEIDI

SEQ ID NO: 2510611 - protein, 21 aa, Entamoeba dispar
YKSKVIRRRKGSFSRPHEDGT

SEQ ID NO: 2510612 - protein, 35 aa, Entamoeba dispar
YKSKWTCSEIFRLLPGMCQSLLLRIIFLKERITIH

SEQ ID NO: 2510613 - protein, 18 aa, Entamoeba dispar
YKSNAILCNIIRDIIQFL

SEQ ID NO: 2510614 - protein, 22 aa, Entamoeba dispar
YKSTPGLFCIQSFCHISTNKHC

SEQ ID NO: 2510615 - protein, 23 aa, Entamoeba dispar
YKTCFGDGGIVHFFIEKEKLLKK

SEQ ID NO: 2510616 - protein, 18 aa, Entamoeba dispar
YKTLEDIAMKVTFRVNAP

SEQ ID NO: 2510617 - protein, 19 aa, Entamoeba dispar
YKTSFYVSVIFNGRNEWEH

SEQ ID NO: 2510618 - protein, 22 aa, Entamoeba dispar
YKTTCPKCMYLFCRKCREQWHE

SEQ ID NO: 2510619 - protein, 21 aa, Entamoeba dispar
YKTYGEYALVISVRNQLVTQF

SEQ ID NO: 2510620 - protein, 21 aa, Entamoeba dispar
YKVHLIFEYLDACIESSQQIV

SEQ ID NO: 2510621 - protein, 19 aa, Entamoeba dispar
YKVIPGGIGMALQIELIKT

SEQ ID NO: 2510622 - protein, 20 aa, Entamoeba dispar
YKVKDVSCSVSFDPNAYNLN

SEQ ID NO: 2510623 - protein, 23 aa, Entamoeba dispar
YKVKPCGIISSLISYTGELQEMG

SEQ ID NO: 2510624 - protein, 18 aa, Entamoeba dispar
YKVKRRYTKSSFKTLRME

SEQ ID NO: 2510625 - protein, 18 aa, Entamoeba dispar
YKVLPLRQPMLMVGLGGC

SEQ ID NO: 2510626 - protein, 25 aa, Entamoeba dispar
YKVMIAACDTFRAGAVDQLAVHAQK

SEQ ID NO: 2510627 - protein, 21 aa, Entamoeba dispar
YKVQYKWDTCVISKGESVNVI

SEQ ID NO: 2510628 - protein, 21 aa, Entamoeba dispar
YKVSVLFMGEKPITIGKKASD

SEQ ID NO: 2510629 - protein, 18 aa, Entamoeba dispar
YKWCFDKKLVTVWSAPNY

SEQ ID NO: 2510630 - protein, 19 aa, Entamoeba dispar
YKWMFNKKIVTVWSAPNYC

SEQ ID NO: 2510631 - protein, 18 aa, Entamoeba dispar
YKWSARFIETSALKDIGI

SEQ ID NO: 2510632 - protein, 22 aa, Entamoeba dispar
YKYGKKSILFIGDLVADKNELV

SEQ ID NO: 2510633 - protein, 18 aa, Entamoeba dispar
YKYIKFQWNSRINKEIQI

SEQ ID NO: 2510634 - protein, 18 aa, Entamoeba dispar
YKYIPGIIESDGKRLELI

SEQ ID NO: 2510635 - protein, 17 aa, Entamoeba dispar
YKYLRMLLLQPHNQICA

SEQ ID NO: 2510636 - protein, 25 aa, Entamoeba dispar
YKYNGYEIILFFLKQILIRNDVINI

SEQ ID NO: 2510637 - protein, 18 aa, Entamoeba dispar
YKYPPIRPLNPVLTDTNE

SEQ ID NO: 2510638 - protein, 21 aa, Entamoeba dispar
YKYPTEPAVSLMNKYSKKIYL

SEQ ID NO: 2510639 - protein, 20 aa, Entamoeba dispar
YKYSICLTNISSFYLYEDYD

SEQ ID NO: 2510640 - protein, 17 aa, Entamoeba dispar
YLAAFGIGKLVIVDNDI

SEQ ID NO: 2510641 - protein, 18 aa, Entamoeba dispar
YLAAPLIFVALRRRKEES

SEQ ID NO: 2510642 - protein, 26 aa, Entamoeba dispar
YLAHCLKTTIFVSIIFQPQNTLDLFD

SEQ ID NO: 2510643 - protein, 19 aa, Entamoeba dispar
YLAKMKKLLEEYKQVVVVK

SEQ ID NO: 2510644 - protein, 17 aa, Entamoeba dispar
YLANRWGLELSKRQIEI

SEQ ID NO: 2510645 - protein, 18 aa, Entamoeba dispar
YLAPEVRTTPAYYSFKSD

SEQ ID NO: 2510646 - protein, 19 aa, Entamoeba dispar
YLAPRKMLHQFIGPLNPID

SEQ ID NO: 2510647 - protein, 20 aa, Entamoeba dispar
YLCAMRHGLIPNLLDGGNHS

SEQ ID NO: 2510648 - protein, 20 aa, Entamoeba dispar
YLCESLRSLIDGELAMVTNG

SEQ ID NO: 2510649 - protein, 17 aa, Entamoeba dispar
YLCVHSINSNIVINQQN

SEQ ID NO: 2510650 - protein, 17 aa, Entamoeba dispar
YLCVYSTNSNIVINQQN

SEQ ID NO: 2510651 - protein, 25 aa, Entamoeba dispar
YLDELRAQPKFKILGEYPYKNYYNS

SEQ ID NO: 2510652 - protein, 33 aa, Entamoeba dispar
YLDKFKRYFRRIVNVAKNFPFVLVVEEATITDM

SEQ ID NO: 2510653 - protein, 32 aa, Entamoeba dispar
YLDKLARLFDYLWKKKCIVYADVIEPFTRTIQ

SEQ ID NO: 2510654 - protein, 21 aa, Entamoeba dispar
YLDSFFASELWEAFDDEKRVS

SEQ ID NO: 2510655 - protein, 17 aa, Entamoeba dispar
YLDSVIINTNVQPTEET

SEQ ID NO: 2510656 - protein, 25 aa, Entamoeba dispar
YLDTPRLHLKWFEKIAEEQSVRQHY

SEQ ID NO: 2510657 - protein, 19 aa, Entamoeba dispar
YLDYVFKCRDEMKWAEFEY

SEQ ID NO: 2510658 - protein, 26 aa, Entamoeba dispar
YLEERASSLVLKFLRKYEQIPFEMYS

SEQ ID NO: 2510659 - protein, 17 aa, Entamoeba dispar
YLEETFPLLNLLHLILL

SEQ ID NO: 2510660 - protein, 17 aa, Entamoeba dispar
YLEEVIEIMKEIMKEEN

SEQ ID NO: 2510661 - protein, 20 aa, Entamoeba dispar
YLEHDVYCLFEHLMDIVNIW

SEQ ID NO: 2510662 - protein, 20 aa, Entamoeba dispar
YLEKASVFKIDYKIELIVSS

SEQ ID NO: 2510663 - protein, 18 aa, Entamoeba dispar
YLELIPILLGLSNEDQIN

SEQ ID NO: 2510664 - protein, 22 aa, Entamoeba dispar
YLESKIYFGYIRMSIMDDSSNI

SEQ ID NO: 2510665 - protein, 19 aa, Entamoeba dispar
YLFEFGVGDIRVYKENNKT

SEQ ID NO: 2510666 - protein, 18 aa, Entamoeba dispar
YLFNLKVTLIDFELSSFK

SEQ ID NO: 2510667 - protein, 20 aa, Entamoeba dispar
YLFPPTRADFKMQVKFDEND

SEQ ID NO: 2510668 - protein, 26 aa, Entamoeba dispar
YLGALRPLLDFTPRNTLSHSIKNSLQ

SEQ ID NO: 2510669 - protein, 19 aa, Entamoeba dispar
YLGEYWYNLMNWKIPEEQI

SEQ ID NO: 2510670 - protein, 19 aa, Entamoeba dispar
YLGINCGNLGYLINPIQEV

SEQ ID NO: 2510671 - protein, 18 aa, Entamoeba dispar
YLGVKNVLCGVDLNHSDM

SEQ ID NO: 2510672 - protein, 22 aa, Entamoeba dispar
YLHHYFNKIGFFVLKSTLQATI

SEQ ID NO: 2510673 - protein, 20 aa, Entamoeba dispar
YLHILQEIILFYSQKTWNLS

SEQ ID NO: 2510674 - protein, 43 aa, Entamoeba dispar
YLHLKYEGIHLVIFGTRWLRLLFDREFHVMDVLNVWDAIFAYG

SEQ ID NO: 2510675 - protein, 18 aa, Entamoeba dispar
YLHSAGIVHRDIKPSNLL

SEQ ID NO: 2510676 - protein, 19 aa, Entamoeba dispar
YLHTFEILNMYKGDIESLI

SEQ ID NO: 2510677 - protein, 17 aa, Entamoeba dispar
YLIDIALKRHSFDNITV

SEQ ID NO: 2510678 - protein, 26 aa, Entamoeba dispar
YLIGRGAKTMHCFEITDEPPFVHPLN

SEQ ID NO: 2510679 - protein, 24 aa, Entamoeba dispar
YLIHKCIRCNKKIIGESYLCKACS

SEQ ID NO: 2510680 - protein, 18 aa, Entamoeba dispar
YLIISELNSIYFSSFLVR

SEQ ID NO: 2510681 - protein, 25 aa, Entamoeba dispar
YLIMPIQRLPRYVLLLNELKKHTWN

SEQ ID NO: 2510682 - protein, 24 aa, Entamoeba dispar
YLINRGDYSLAMIMNEKINCNEMK

SEQ ID NO: 2510683 - protein, 17 aa, Entamoeba dispar
YLISILLKCHLREELKF

SEQ ID NO: 2510684 - protein, 18 aa, Entamoeba dispar
YLIYLNFIAGRSYNDLTQ

SEQ ID NO: 2510685 - protein, 18 aa, Entamoeba dispar
YLKDFGIIGEIVSKYHLE

SEQ ID NO: 2510686 - protein, 29 aa, Entamoeba dispar
YLKECGTWIQKFCMWIRGGVDGLTKFLDE

SEQ ID NO: 2510687 - protein, 26 aa, Entamoeba dispar
YLKEHYPQIYFNFINRIKEITESLKH

SEQ ID NO: 2510688 - protein, 23 aa, Entamoeba dispar
YLKELTINSCFIVDFPELNVNSI

SEQ ID NO: 2510689 - protein, 31 aa, Entamoeba dispar
YLKKELELLRKGVKYGEVIKIYSTFNKTLKP

SEQ ID NO: 2510690 - protein, 20 aa, Entamoeba dispar
YLKKICQSVSFKTKIIDTKS

SEQ ID NO: 2510691 - protein, 20 aa, Entamoeba dispar
YLKQKLEQRLAQYYYENGQC

SEQ ID NO: 2510692 - protein, 19 aa, Entamoeba dispar
YLKRIAFEDNSMFLLPNSI

SEQ ID NO: 2510693 - protein, 28 aa, Entamoeba dispar
YLKSCKINMNAPWNMRYALPQCERYKQM

SEQ ID NO: 2510694 - protein, 26 aa, Entamoeba dispar
YLKSFSSKMIKFFGTQALKKLIVVSM

SEQ ID NO: 2510695 - protein, 22 aa, Entamoeba dispar
YLKSIPMKSCLKNEFERKTKVP

SEQ ID NO: 2510696 - protein, 22 aa, Entamoeba dispar
YLKTVPLIPSFKYQSSSERLFP

SEQ ID NO: 2510697 - protein, 24 aa, Entamoeba dispar
YLKVREFRTAIQFVNSTLTRNLSV

SEQ ID NO: 2510698 - protein, 21 aa, Entamoeba dispar
YLLECYGAFILESESSAKRSQ

SEQ ID NO: 2510699 - protein, 21 aa, Entamoeba dispar
YLLEHCVRILQDLVISIKDKK

SEQ ID NO: 2510700 - protein, 21 aa, Entamoeba dispar
YLLGIVPNWRVLNSTFSRMLL

SEQ ID NO: 2510701 - protein, 19 aa, Entamoeba dispar
YLLINKCNFKFSNENESAV

SEQ ID NO: 2510702 - protein, 18 aa, Entamoeba dispar
YLLKEWQKGRAKTRTTSA

SEQ ID NO: 2510703 - protein, 22 aa, Entamoeba dispar
YLLKRKKVGITLSNLQTHYQLS

SEQ ID NO: 2510704 - protein, 22 aa, Entamoeba dispar
YLLLCLLTNKIIGIWKTNNKIE

SEQ ID NO: 2510705 - protein, 24 aa, Entamoeba dispar
YLLLKYGFECIRAYSEADPVIIEK

SEQ ID NO: 2510706 - protein, 19 aa, Entamoeba dispar
YLLPKGIPFITFLRNDVII

SEQ ID NO: 2510707 - protein, 20 aa, Entamoeba dispar
YLLPSNKLSPVFIKQNEETL

SEQ ID NO: 2510708 - protein, 17 aa, Entamoeba dispar
YLLRILNQIICNLTIKE

SEQ ID NO: 2510709 - protein, 21 aa, Entamoeba dispar
YLLTEAFPGLLVTSQERKNLF

SEQ ID NO: 2510710 - protein, 17 aa, Entamoeba dispar
YLMCQQGVLLLLLNQHF

SEQ ID NO: 2510711 - protein, 27 aa, Entamoeba dispar
YLMDYRNWTALMFAQFLMYNKINKKKA

SEQ ID NO: 2510712 - protein, 17 aa, Entamoeba dispar
YLMELLKKYNSYDIEAK

SEQ ID NO: 2510713 - protein, 19 aa, Entamoeba dispar
YLMGSYRSPSPIKKEFLNC

SEQ ID NO: 2510714 - protein, 20 aa, Entamoeba dispar
YLMKCMNFDGAFGCIPGAES

SEQ ID NO: 2510715 - protein, 20 aa, Entamoeba dispar
YLMLEYIYPILLGEMEGDIF

SEQ ID NO: 2510716 - protein, 19 aa, Entamoeba dispar
YLMTCPICGKQKYCCEECY

SEQ ID NO: 2510717 - protein, 17 aa, Entamoeba dispar
YLNEISGILTFGPCYLV

SEQ ID NO: 2510718 - protein, 17 aa, Entamoeba dispar
YLNKRIHNKECTKKKKV

SEQ ID NO: 2510719 - protein, 17 aa, Entamoeba dispar
YLNNEFIINGSIALSNF

SEQ ID NO: 2510720 - protein, 19 aa, Entamoeba dispar
YLNQFFRCNYQIYNENLYE

SEQ ID NO: 2510721 - protein, 20 aa, Entamoeba dispar
YLNSLKLLFHYFKFSNTIVN

SEQ ID NO: 2510722 - protein, 17 aa, Entamoeba dispar
YLPDGILKKLTKKVGAK

SEQ ID NO: 2510723 - protein, 18 aa, Entamoeba dispar
YLPDTRFTVTRTVFRDGT

SEQ ID NO: 2510724 - protein, 29 aa, Entamoeba dispar
YLPEGNVKCLIKMKLALFYFQNAKLELAL

SEQ ID NO: 2510725 - protein, 22 aa, Entamoeba dispar
YLPIKEIKCVTIINHKCTQIIE

SEQ ID NO: 2510726 - protein, 26 aa, Entamoeba dispar
YLPKRSRLSNVIAIAASTLVFRNAIY

SEQ ID NO: 2510727 - protein, 25 aa, Entamoeba dispar
YLPMGVEMTDWFPLIGNGTDSLGIG

SEQ ID NO: 2510728 - protein, 19 aa, Entamoeba dispar
YLPPQYYLSFIAINKRYQK

SEQ ID NO: 2510729 - protein, 20 aa, Entamoeba dispar
YLPVRRIATETILQVLKHMI

SEQ ID NO: 2510730 - protein, 25 aa, Entamoeba dispar
YLQENSWIGIFDRFEMNMKNYINSA

SEQ ID NO: 2510731 - protein, 17 aa, Entamoeba dispar
YLQFYYTDDEIIRELEK

SEQ ID NO: 2510732 - protein, 18 aa, Entamoeba dispar
YLQISYDYFNSVFGPFKR

SEQ ID NO: 2510733 - protein, 29 aa, Entamoeba dispar
YLQITLKVEGFEFERCVDDFIFFCFLVGN

SEQ ID NO: 2510734 - protein, 31 aa, Entamoeba dispar
YLQMLKKAMPIIFEAGTLLRANAHDVFAVIF

SEQ ID NO: 2510735 - protein, 20 aa, Entamoeba dispar
YLRCDSCVLSSNLFLNSLHL

SEQ ID NO: 2510736 - protein, 18 aa, Entamoeba dispar
YLRGSVFCEKKLTVKKMA

SEQ ID NO: 2510737 - protein, 23 aa, Entamoeba dispar
YLRKPDMIHFLKYLQYWKQPNYI

SEQ ID NO: 2510738 - protein, 17 aa, Entamoeba dispar
YLRMDGLVSSNKRPEYI

SEQ ID NO: 2510739 - protein, 20 aa, Entamoeba dispar
YLRRCPEKLYKISTNNIPLI

SEQ ID NO: 2510740 - protein, 23 aa, Entamoeba dispar
YLRYKFMERDGINSFPELTNDVY

SEQ ID NO: 2510741 - protein, 19 aa, Entamoeba dispar
YLSEISFEKCGFIQNIYHY

SEQ ID NO: 2510742 - protein, 25 aa, Entamoeba dispar
YLSGLKYSAMPPFKRFHDLEQLSGG

SEQ ID NO: 2510743 - protein, 22 aa, Entamoeba dispar
YLSHYREVFTFIQVNKKFTSTL

SEQ ID NO: 2510744 - protein, 18 aa, Entamoeba dispar
YLSIVIRYVYTTTTVIDL

SEQ ID NO: 2510745 - protein, 34 aa, Entamoeba dispar
YLSSFPKKEVIGFKKLEYMFLLRQCGAKIVKDKK

SEQ ID NO: 2510746 - protein, 23 aa, Entamoeba dispar
YLSSYHFDLFLKLMVKMQLCVKE

SEQ ID NO: 2510747 - protein, 17 aa, Entamoeba dispar
YLSTDIFRRILEDYFGY

SEQ ID NO: 2510748 - protein, 18 aa, Entamoeba dispar
YLTASCIMRGKVSTHDVE

SEQ ID NO: 2510749 - protein, 21 aa, Entamoeba dispar
YLTNCYDPSQLLGLLNVINTF

SEQ ID NO: 2510750 - protein, 21 aa, Entamoeba dispar
YLTNYRLIWRTSNESLGSMAQ

SEQ ID NO: 2510751 - protein, 21 aa, Entamoeba dispar
YLTRLSNLFFDDDLIAKNEIN

SEQ ID NO: 2510752 - protein, 25 aa, Entamoeba dispar
YLTTEMKTSIALLLDYAVQNHEILP

SEQ ID NO: 2510753 - protein, 18 aa, Entamoeba dispar
YLTVFKKMLFELIHPPQP

SEQ ID NO: 2510754 - protein, 28 aa, Entamoeba dispar
YLVCWDLRHTIANIGWRVPTHSAITEIV

SEQ ID NO: 2510755 - protein, 22 aa, Entamoeba dispar
YLVECRKIMVFKASLLQEERTK

SEQ ID NO: 2510756 - protein, 18 aa, Entamoeba dispar
YLVFIGFTHCHLPISGVS

SEQ ID NO: 2510757 - protein, 25 aa, Entamoeba dispar
YLVIPECPCCILFDEWMNFNKEAVC

SEQ ID NO: 2510758 - protein, 17 aa, Entamoeba dispar
YLVKKGADFHTWKKRWF

SEQ ID NO: 2510759 - protein, 21 aa, Entamoeba dispar
YLVMEYCNFGTLAQYINTHEL

SEQ ID NO: 2510760 - protein, 19 aa, Entamoeba dispar
YLVSFVLPQWKSCLESIPV

SEQ ID NO: 2510761 - protein, 23 aa, Entamoeba dispar
YLYANGELPSFVSYKDLLSLNLK

SEQ ID NO: 2510762 - protein, 17 aa, Entamoeba dispar
YLYEIFNDIHLFVMNHL

SEQ ID NO: 2510763 - protein, 18 aa, Entamoeba dispar
YLYGHLMDCEHIFIISDI

SEQ ID NO: 2510764 - protein, 18 aa, Entamoeba dispar
YLYLTLWGDEVANQTQFK

SEQ ID NO: 2510765 - protein, 17 aa, Entamoeba dispar
YLYQVGHIGCFIIHQTG

SEQ ID NO: 2510766 - protein, 19 aa, Entamoeba dispar
YLYSEAMYFIGNIMSMAQD

SEQ ID NO: 2510767 - protein, 24 aa, Entamoeba dispar
YLYYKRFYSSISFKNISYTEEDCF

SEQ ID NO: 2510768 - protein, 19 aa, Entamoeba dispar
YMAIASGKADVYLRLPRNL

SEQ ID NO: 2510769 - protein, 25 aa, Entamoeba dispar
YMAPELYRRLPYGNKIDCWSCGVVI

SEQ ID NO: 2510770 - protein, 21 aa, Entamoeba dispar
YMDYPPMRALFLITTKGIPPL

SEQ ID NO: 2510771 - protein, 22 aa, Entamoeba dispar
YMEKYRMIGDNFVWLSGLVSIF

SEQ ID NO: 2510772 - protein, 25 aa, Entamoeba dispar
YMELYKKSLGYTFLPIITKNEIKEM

SEQ ID NO: 2510773 - protein, 22 aa, Entamoeba dispar
YMFLIECYLEYSKLPGEDELNA

SEQ ID NO: 2510774 - protein, 18 aa, Entamoeba dispar
YMFYEIIFNTFVSLHHDQ

SEQ ID NO: 2510775 - protein, 18 aa, Entamoeba dispar
YMIIGCLDNVAAFTESFL

SEQ ID NO: 2510776 - protein, 17 aa, Entamoeba dispar
YMIKKKYYDSFLFTPEN

SEQ ID NO: 2510777 - protein, 22 aa, Entamoeba dispar
YMKQHFCLAFIKIMINEYRNRS

SEQ ID NO: 2510778 - protein, 26 aa, Entamoeba dispar
YMLIIKIYGLLKCTNFTPNNIIEMLP

SEQ ID NO: 2510779 - protein, 17 aa, Entamoeba dispar
YMNIFVHRAIDSYGIHY

SEQ ID NO: 2510780 - protein, 19 aa, Entamoeba dispar
YMNNVSKFDSVWAQEHSRD

SEQ ID NO: 2510781 - protein, 20 aa, Entamoeba dispar
YMPYHGYHIIDFNDVDPRFG

SEQ ID NO: 2510782 - protein, 23 aa, Entamoeba dispar
YMRLKSLDFGNGEVIFLSEYLKR

SEQ ID NO: 2510783 - protein, 17 aa, Entamoeba dispar
YMRPDGRKVFVENVQNK

SEQ ID NO: 2510784 - protein, 19 aa, Entamoeba dispar
YMRREIRIGYNGIINCGDW

SEQ ID NO: 2510785 - protein, 22 aa, Entamoeba dispar
YMSKKFKTHYIFCGELLNLYSA

SEQ ID NO: 2510786 - protein, 17 aa, Entamoeba dispar
YMTKLLRLHPLPTTALK

SEQ ID NO: 2510787 - protein, 30 aa, Entamoeba dispar
YMVKDLKNGCCYRADHLLKTFYENKMEDPA

SEQ ID NO: 2510788 - protein, 22 aa, Entamoeba dispar
YMVKSIYFGTAFCTVQLAIQLG

SEQ ID NO: 2510789 - protein, 20 aa, Entamoeba dispar
YMYIIPSFRKIVIQLVSQLR

SEQ ID NO: 2510790 - protein, 17 aa, Entamoeba dispar
YMYLTLWGDEVSNQTQF

SEQ ID NO: 2510791 - protein, 25 aa, Entamoeba dispar
YNAKEGRWKYLRILSNDGNFDTIST

SEQ ID NO: 2510792 - protein, 28 aa, Entamoeba dispar
YNAQQQYPGYGINPEIQQYNQINSFDSQ

SEQ ID NO: 2510793 - protein, 18 aa, Entamoeba dispar
YNAVPHPFWLPKFQNGIS

SEQ ID NO: 2510794 - protein, 17 aa, Entamoeba dispar
YNCATEINLYRGEKDQQ

SEQ ID NO: 2510795 - protein, 28 aa, Entamoeba dispar
YNDEIWLMKPCTGSVLFDIIFNIDNISQ

SEQ ID NO: 2510796 - protein, 17 aa, Entamoeba dispar
YNDFRMVVWGFDQNIRE

SEQ ID NO: 2510797 - protein, 26 aa, Entamoeba dispar
YNDRLKEAVLFAYRFPQKAEDVRSML

SEQ ID NO: 2510798 - protein, 20 aa, Entamoeba dispar
YNDSSCWSEGTFRGHTHNVT

SEQ ID NO: 2510799 - protein, 23 aa, Entamoeba dispar
YNDTRLLNILLYLYNNGYVIKSA

SEQ ID NO: 2510800 - protein, 23 aa, Entamoeba dispar
YNDYQCFIKHWILYIKDKEWLDV

SEQ ID NO: 2510801 - protein, 21 aa, Entamoeba dispar
YNEDRICVATNIEGADLFAVF

SEQ ID NO: 2510802 - protein, 23 aa, Entamoeba dispar
YNEKCDLFSIGVILYEMITGTVL

SEQ ID NO: 2510803 - protein, 17 aa, Entamoeba dispar
YNESEWEPMKVYDPRTG

SEQ ID NO: 2510804 - protein, 22 aa, Entamoeba dispar
YNEYSKLFLMDYLKHVLTPVLD

SEQ ID NO: 2510805 - protein, 24 aa, Entamoeba dispar
YNFDSPSSFDWNLIIETLKKIKAK

SEQ ID NO: 2510806 - protein, 24 aa, Entamoeba dispar
YNFEECVHKLLSLKLREGEEKILV

SEQ ID NO: 2510807 - protein, 25 aa, Entamoeba dispar
YNFGLYVSWKKAILINSTEIHKIVP

SEQ ID NO: 2510808 - protein, 26 aa, Entamoeba dispar
YNFGLYVSWKKAILINSTEIHKIVPH

SEQ ID NO: 2510809 - protein, 23 aa, Entamoeba dispar
YNFIKRRRFSTEIIQQLLQHIMA

SEQ ID NO: 2510810 - protein, 17 aa, Entamoeba dispar
YNFIPFINSLIELINSP

SEQ ID NO: 2510811 - protein, 24 aa, Entamoeba dispar
YNFKDLRPLYQYDTGMNNKGLIAV

SEQ ID NO: 2510812 - protein, 23 aa, Entamoeba dispar
YNGIIKIKFRCPNGKSVMHEFYP

SEQ ID NO: 2510813 - protein, 22 aa, Entamoeba dispar
YNGKFLKLKYVLSVHIMSKSHI

SEQ ID NO: 2510814 - protein, 17 aa, Entamoeba dispar
YNGKIINPPVIWKVKNK

SEQ ID NO: 2510815 - protein, 18 aa, Entamoeba dispar
YNGKIVGVVVYWYLMKQF

SEQ ID NO: 2510816 - protein, 17 aa, Entamoeba dispar
YNGLKFLIFDSPTDDNV

SEQ ID NO: 2510817 - protein, 20 aa, Entamoeba dispar
YNGNEPVLFTITGDNFGNEP

SEQ ID NO: 2510818 - protein, 19 aa, Entamoeba dispar
YNGNSIITISIKFPICNNS

SEQ ID NO: 2510819 - protein, 18 aa, Entamoeba dispar
YNGQFIVDDAIHFLQSNK

SEQ ID NO: 2510820 - protein, 17 aa, Entamoeba dispar
YNHLFVYLISFLKKMIC

SEQ ID NO: 2510821 - protein, 17 aa, Entamoeba dispar
YNHQLGILYIYHIKFNI

SEQ ID NO: 2510822 - protein, 21 aa, Entamoeba dispar
YNIAVCLGLSTLISKNDIQTI

SEQ ID NO: 2510823 - protein, 17 aa, Entamoeba dispar
YNIIDGIEFYLRKNNET

SEQ ID NO: 2510824 - protein, 17 aa, Entamoeba dispar
YNKCYVLGYGQCRKDIP

SEQ ID NO: 2510825 - protein, 26 aa, Entamoeba dispar
YNKSILPKRTCDIIFAGIKSIYFTNK

SEQ ID NO: 2510826 - protein, 23 aa, Entamoeba dispar
YNLCFLIGRGFLFDCDVILHLYD

SEQ ID NO: 2510827 - protein, 24 aa, Entamoeba dispar
YNLDIPLDIIIPFISNEWSRKYVI

SEQ ID NO: 2510828 - protein, 22 aa, Entamoeba dispar
YNLDPQCDICGVHCHNIDQHKQ

SEQ ID NO: 2510829 - protein, 18 aa, Entamoeba dispar
YNLFIPIQLLRLTINSIN

SEQ ID NO: 2510830 - protein, 27 aa, Entamoeba dispar
YNLIGRYPLLGNWKESFSISYEQLIPF

SEQ ID NO: 2510831 - protein, 25 aa, Entamoeba dispar
YNLKQNNLFISFGRKSIDCSAIMKY

SEQ ID NO: 2510832 - protein, 23 aa, Entamoeba dispar
YNLKRRIDVAQHFALGKYSKDIS

SEQ ID NO: 2510833 - protein, 25 aa, Entamoeba dispar
YNLLFKMIDMLGMLPNEMLKNGTRT

SEQ ID NO: 2510834 - protein, 18 aa, Entamoeba dispar
YNLQRKKVQFIRIDGETK

SEQ ID NO: 2510835 - protein, 25 aa, Entamoeba dispar
YNLSKSNVCLLLFNENLFITETIRK

SEQ ID NO: 2510836 - protein, 17 aa, Entamoeba dispar
YNLWKPSNKPVIVSIKE

SEQ ID NO: 2510837 - protein, 24 aa, Entamoeba dispar
YNMLYKFINMLGMPPRSLLDKGSK

SEQ ID NO: 2510838 - protein, 18 aa, Entamoeba dispar
YNMRKMKNPIIINTIKNY

SEQ ID NO: 2510839 - protein, 19 aa, Entamoeba dispar
YNNAIYDLFCEFFNTIPLA

SEQ ID NO: 2510840 - protein, 21 aa, Entamoeba dispar
YNNCLYIFDFESLKWKKVILD

SEQ ID NO: 2510841 - protein, 27 aa, Entamoeba dispar
YNNGFLPSRLDLFFPSHPKMPNVPLSA

SEQ ID NO: 2510842 - protein, 18 aa, Entamoeba dispar
YNNIKLIRIEEGEEEVIC

SEQ ID NO: 2510843 - protein, 24 aa, Entamoeba dispar
YNNKKCWPKDCRMRLMRHDVNLGR

SEQ ID NO: 2510844 - protein, 45 aa, Entamoeba dispar
YNNLRFSTNLKYIIKFIYDIFEFKDIWKHVCIVWTKCYNDLSERR

SEQ ID NO: 2510845 - protein, 17 aa, Entamoeba dispar
YNNSFIIVYCRQTAEEL

SEQ ID NO: 2510846 - protein, 23 aa, Entamoeba dispar
YNPEMRLKFLGGKRKGGTTKENG

SEQ ID NO: 2510847 - protein, 17 aa, Entamoeba dispar
YNPHIDLLTVPHPFYNE

SEQ ID NO: 2510848 - protein, 24 aa, Entamoeba dispar
YNPHVRYGAALALGIAGCASNNST

SEQ ID NO: 2510849 - protein, 18 aa, Entamoeba dispar
YNPIPIYDLNFFRNIETQ

SEQ ID NO: 2510850 - protein, 24 aa, Entamoeba dispar
YNPQLGNWLFLWKQSLPLPLPSSS

SEQ ID NO: 2510851 - protein, 25 aa, Entamoeba dispar
YNPSGRFVIGGPMGDAGLTGRKIIV

SEQ ID NO: 2510852 - protein, 25 aa, Entamoeba dispar
YNPSKLCYMTSVLVQLLSIEEFQTL

SEQ ID NO: 2510853 - protein, 17 aa, Entamoeba dispar
YNQLGYFSQVMFNIGYY

SEQ ID NO: 2510854 - protein, 24 aa, Entamoeba dispar
YNQLKTILEFVNFIKQNIKPTSEN

SEQ ID NO: 2510855 - protein, 18 aa, Entamoeba dispar
YNRRSCSSRRSYSSSSRS

SEQ ID NO: 2510856 - protein, 26 aa, Entamoeba dispar
YNRYHVNNIFGLKWGYEGLVPELSEV

SEQ ID NO: 2510857 - protein, 19 aa, Entamoeba dispar
YNRYSWIGLFDINESDNRK

SEQ ID NO: 2510858 - protein, 18 aa, Entamoeba dispar
YNSIFSLYCQYAVYHCHD

SEQ ID NO: 2510859 - protein, 20 aa, Entamoeba dispar
YNSIYNCIEQFNLYKKIPYQ

SEQ ID NO: 2510860 - protein, 30 aa, Entamoeba dispar
YNSKYHLKYCFFNKLGFLIEIPLFYNSFDS

SEQ ID NO: 2510861 - protein, 25 aa, Entamoeba dispar
YNSLQFKFELFKMLYREMTMGVTGP

SEQ ID NO: 2510862 - protein, 25 aa, Entamoeba dispar
YNSLSFKCICIETIKFTMVNTIIEY

SEQ ID NO: 2510863 - protein, 26 aa, Entamoeba dispar
YNSNLWTCCFCLTRNQLQYQNLPELQ

SEQ ID NO: 2510864 - protein, 17 aa, Entamoeba dispar
YNSPKLLLVPDVINRIW

SEQ ID NO: 2510865 - protein, 21 aa, Entamoeba dispar
YNSYMGFCINLLPRGWHGLLS

SEQ ID NO: 2510866 - protein, 24 aa, Entamoeba dispar
YNTFFLDLLRAMLNIKEFLNPPLI

SEQ ID NO: 2510867 - protein, 18 aa, Entamoeba dispar
YNVKEWIERGRLYVKNGD

SEQ ID NO: 2510868 - protein, 17 aa, Entamoeba dispar
YNVTDVVRCCHPSYDKK

SEQ ID NO: 2510869 - protein, 22 aa, Entamoeba dispar
YNYALELLKKFSAVSSKTKIVV

SEQ ID NO: 2510870 - protein, 21 aa, Entamoeba dispar
YNYHRFGYKGPYYLYYGKYEL

SEQ ID NO: 2510871 - protein, 25 aa, Entamoeba dispar
YNYKCDLWSLGGLLYFLRTHTYPLS

SEQ ID NO: 2510872 - protein, 21 aa, Entamoeba dispar
YNYRLLMLESEVIIVQQPPST

SEQ ID NO: 2510873 - protein, 26 aa, Entamoeba dispar
YPAYHYRLFTELVINDLLNRVNDQKY

SEQ ID NO: 2510874 - protein, 26 aa, Entamoeba dispar
YPCDIKGDIKDGCYCIGDNGYCKICG

SEQ ID NO: 2510875 - protein, 25 aa, Entamoeba dispar
YPDCKTVLAECCLYLTRAKKSTAIY

SEQ ID NO: 2510876 - protein, 21 aa, Entamoeba dispar
YPDFDRLGGTISYIQKTFPLE

SEQ ID NO: 2510877 - protein, 18 aa, Entamoeba dispar
YPDIEFVIRIQKLKQLCR

SEQ ID NO: 2510878 - protein, 25 aa, Entamoeba dispar
YPDIREALFSFIRIVIEYCSEIICE

SEQ ID NO: 2510879 - protein, 26 aa, Entamoeba dispar
YPDSWRLRIGQFITFPNYQRKKLGRY

SEQ ID NO: 2510880 - protein, 20 aa, Entamoeba dispar
YPDTSILGFGQRGHVDVLSN

SEQ ID NO: 2510881 - protein, 17 aa, Entamoeba dispar
YPDWLDNHIKEIEKVDN

SEQ ID NO: 2510882 - protein, 21 aa, Entamoeba dispar
YPEADTALYECALYLARAPKS

SEQ ID NO: 2510883 - protein, 18 aa, Entamoeba dispar
YPEATILAKTNPIPPIEN

SEQ ID NO: 2510884 - protein, 19 aa, Entamoeba dispar
YPEITFRGDITILLMRQYY

SEQ ID NO: 2510885 - protein, 27 aa, Entamoeba dispar
YPFECVSTQCPISFKIIKEETEYRNFL

SEQ ID NO: 2510886 - protein, 18 aa, Entamoeba dispar
YPFFLKTNFISFLFEILP

SEQ ID NO: 2510887 - protein, 24 aa, Entamoeba dispar
YPFMIYALRLFKILYEMNIVNEFI

SEQ ID NO: 2510888 - protein, 23 aa, Entamoeba dispar
YPFNIIREFGKEYIRLRCPHAQF

SEQ ID NO: 2510889 - protein, 18 aa, Entamoeba dispar
YPGIPILMLTATATERVK

SEQ ID NO: 2510890 - protein, 18 aa, Entamoeba dispar
YPGKFSFSISHTTRKPRG

SEQ ID NO: 2510891 - protein, 20 aa, Entamoeba dispar
YPGRCCGDLVIPESKIKNEE

SEQ ID NO: 2510892 - protein, 19 aa, Entamoeba dispar
YPGTLPIQMGGGIENQKIN

SEQ ID NO: 2510893 - protein, 23 aa, Entamoeba dispar
YPHKRPVDYYAEMLKSDAHMERI

SEQ ID NO: 2510894 - protein, 19 aa, Entamoeba dispar
YPHLTWEIPSLTVSSDEIK

SEQ ID NO: 2510895 - protein, 23 aa, Entamoeba dispar
YPHVKIFLGDYVDRGKWSTETII

SEQ ID NO: 2510896 - protein, 22 aa, Entamoeba dispar
YPIHCACTIPPPSFIDVVQSLT

SEQ ID NO: 2510897 - protein, 18 aa, Entamoeba dispar
YPIIEFIKNIDVIKKPLS

SEQ ID NO: 2510898 - protein, 18 aa, Entamoeba dispar
YPIIPFKITDYINKLNQI

SEQ ID NO: 2510899 - protein, 24 aa, Entamoeba dispar
YPIKRFGDSDFWEQILLESENYDF

SEQ ID NO: 2510900 - protein, 18 aa, Entamoeba dispar
YPIPRPAINTNICPCGKE

SEQ ID NO: 2510901 - protein, 24 aa, Entamoeba dispar
YPKDECLKKYISVIKKLIHLKKIR

SEQ ID NO: 2510902 - protein, 24 aa, Entamoeba dispar
YPKHTTEFTELIPSIQMTYSDNSV

SEQ ID NO: 2510903 - protein, 24 aa, Entamoeba dispar
YPKKEIEWLMGISWNKGNKSRYKQ

SEQ ID NO: 2510904 - protein, 21 aa, Entamoeba dispar
YPKKRDFYTFFSYKDKSKSAG

SEQ ID NO: 2510905 - protein, 22 aa, Entamoeba dispar
YPKNKFHYFIAVSMLLEHRDII

SEQ ID NO: 2510906 - protein, 17 aa, Entamoeba dispar
YPLEILREIKVLRELDH

SEQ ID NO: 2510907 - protein, 17 aa, Entamoeba dispar
YPLFAIVDPCHSFTLPD

SEQ ID NO: 2510908 - protein, 18 aa, Entamoeba dispar
YPLFLLCGFEGFEGPYKK

SEQ ID NO: 2510909 - protein, 21 aa, Entamoeba dispar
YPLLGSDLMILEYQRVFKKCV

SEQ ID NO: 2510910 - protein, 26 aa, Entamoeba dispar
YPLLHPEIYKHLGIEPPRGILLHGPP

SEQ ID NO: 2510911 - protein, 18 aa, Entamoeba dispar
YPLLIPYFIQHLKSLNSN

SEQ ID NO: 2510912 - protein, 19 aa, Entamoeba dispar
YPLLLDIWDSISLEEYLKD

SEQ ID NO: 2510913 - protein, 20 aa, Entamoeba dispar
YPLLLKEIIKNTGPRHPDQP

SEQ ID NO: 2510914 - protein, 17 aa, Entamoeba dispar
YPLMALREIDHFHNDVC

SEQ ID NO: 2510915 - protein, 24 aa, Entamoeba dispar
YPLPKPEVLWGLMMSELVDIIKKK

SEQ ID NO: 2510916 - protein, 22 aa, Entamoeba dispar
YPLQHCRAFEVFMGGIYLEKIR

SEQ ID NO: 2510917 - protein, 22 aa, Entamoeba dispar
YPLQHCRAFEVFMVGIILEKIR

SEQ ID NO: 2510918 - protein, 18 aa, Entamoeba dispar
YPLVSYIFSTYVKVFKTC

SEQ ID NO: 2510919 - protein, 18 aa, Entamoeba dispar
YPNAFEFTPLLIKDLAIE

SEQ ID NO: 2510920 - protein, 27 aa, Entamoeba dispar
YPNEIIPCSLLKELFVRFQDEINKKIQ

SEQ ID NO: 2510921 - protein, 20 aa, Entamoeba dispar
YPNNCFEIGDDFQFTKQFLW

SEQ ID NO: 2510922 - protein, 20 aa, Entamoeba dispar
YPNQQILCFVNGNFISESKS

SEQ ID NO: 2510923 - protein, 19 aa, Entamoeba dispar
YPNQWKKISTFIPNRTDAQ

SEQ ID NO: 2510924 - protein, 17 aa, Entamoeba dispar
YPNSLKFLQCYSNSLPK

SEQ ID NO: 2510925 - protein, 25 aa, Entamoeba dispar
YPNVSIPIAFLLMRDTIIALGGNKL

SEQ ID NO: 2510926 - protein, 30 aa, Entamoeba dispar
YPQFIRQYIDWVIKIGFNFISFEKLFISCP

SEQ ID NO: 2510927 - protein, 21 aa, Entamoeba dispar
YPQIKLLIPFHTMKKNIHKIK

SEQ ID NO: 2510928 - protein, 21 aa, Entamoeba dispar
YPQNCRRFMHMLFTYTEELFN

SEQ ID NO: 2510929 - protein, 17 aa, Entamoeba dispar
YPQYKKQFPDLKISEIG

SEQ ID NO: 2510930 - protein, 24 aa, Entamoeba dispar
YPRMPWHDIHCMVNGTILNDLQYH

SEQ ID NO: 2510931 - protein, 17 aa, Entamoeba dispar
YPSDPSMFGRTINVLNK

SEQ ID NO: 2510932 - protein, 23 aa, Entamoeba dispar
YPSGARYGAPVVREQPPPQLASR

SEQ ID NO: 2510933 - protein, 20 aa, Entamoeba dispar
YPSIEFYLTHLIRRHPASQR

SEQ ID NO: 2510934 - protein, 20 aa, Entamoeba dispar
YPSLRYFECSAVNGKNIEEI

SEQ ID NO: 2510935 - protein, 24 aa, Entamoeba dispar
YPSPNIQCPFFLTSSKINQILQSF

SEQ ID NO: 2510936 - protein, 17 aa, Entamoeba dispar
YPSSNVMINPNIMLQQV

SEQ ID NO: 2510937 - protein, 19 aa, Entamoeba dispar
YPSTCSSFNKCFRCDNKKC

SEQ ID NO: 2510938 - protein, 20 aa, Entamoeba dispar
YPTFKTCFIIKNNLILFNEL

SEQ ID NO: 2510939 - protein, 22 aa, Entamoeba dispar
YPTNPLIAAIAARANRGGSSMK

SEQ ID NO: 2510940 - protein, 19 aa, Entamoeba dispar
YPVDTIPLGIDYHFQSFFN

SEQ ID NO: 2510941 - protein, 17 aa, Entamoeba dispar
YPVEMLLCVLFGVDMFD

SEQ ID NO: 2510942 - protein, 17 aa, Entamoeba dispar
YPVRIPFMAILPRPISE

SEQ ID NO: 2510943 - protein, 19 aa, Entamoeba dispar
YPYEYFHQIITLFLNTRPL

SEQ ID NO: 2510944 - protein, 19 aa, Entamoeba dispar
YPYGLRYLCKVINENSMEA

SEQ ID NO: 2510945 - protein, 24 aa, Entamoeba dispar
YPYMKELVPLPSIYYKSYIAANQD

SEQ ID NO: 2510946 - protein, 18 aa, Entamoeba dispar
YQALKIFGTDFEKIQKRL

SEQ ID NO: 2510947 - protein, 18 aa, Entamoeba dispar
YQCDCVCFYFVPRIIKMM

SEQ ID NO: 2510948 - protein, 18 aa, Entamoeba dispar
YQCKCTELIQTRKQNQSQ

SEQ ID NO: 2510949 - protein, 21 aa, Entamoeba dispar
YQCLGNSVSCFVIAQLMEYLF

SEQ ID NO: 2510950 - protein, 22 aa, Entamoeba dispar
YQDIMSRLNICEGIVLHTKMSI

SEQ ID NO: 2510951 - protein, 20 aa, Entamoeba dispar
YQDIPDLLSLNLSNNNINIT

SEQ ID NO: 2510952 - protein, 18 aa, Entamoeba dispar
YQEGITFGLKQREWNNDH

SEQ ID NO: 2510953 - protein, 40 aa, Entamoeba dispar
YQESPYKRYSLYFDYSACIIGARLLRKWNNTIIASEAYFK

SEQ ID NO: 2510954 - protein, 17 aa, Entamoeba dispar
YQFDCFVTEKGVFDLIH

SEQ ID NO: 2510955 - protein, 18 aa, Entamoeba dispar
YQFMAEHNGLICFEFNGQ

SEQ ID NO: 2510956 - protein, 18 aa, Entamoeba dispar
YQFNIIREFGKKYSTLKC

SEQ ID NO: 2510957 - protein, 21 aa, Entamoeba dispar
YQFPQSEPKILLNPNQQPTLN

SEQ ID NO: 2510958 - protein, 37 aa, Entamoeba dispar
YQFSFIRMTSGYSFEEFFKLFSLLMSMTYSSSSEPQN

SEQ ID NO: 2510959 - protein, 17 aa, Entamoeba dispar
YQHDGFESYGFSYYGIK

SEQ ID NO: 2510960 - protein, 21 aa, Entamoeba dispar
YQHDVCGYVFAFYVQKLIHHK

SEQ ID NO: 2510961 - protein, 19 aa, Entamoeba dispar
YQHPPNFYQPFTIPPDKQP

SEQ ID NO: 2510962 - protein, 24 aa, Entamoeba dispar
YQIFIKSNFLKLIKPYDIDEFISN

SEQ ID NO: 2510963 - protein, 29 aa, Entamoeba dispar
YQIKPFRKIQCPIVERLVCCMMQHGKNSG

SEQ ID NO: 2510964 - protein, 35 aa, Entamoeba dispar
YQILNKYRLGNCPVKMVHFAKWIKSSLKINNSDFD

SEQ ID NO: 2510965 - protein, 27 aa, Entamoeba dispar
YQILSKYRLGNCPVKMTDFTKWIKSIL

SEQ ID NO: 2510966 - protein, 19 aa, Entamoeba dispar
YQKEIPSLIPTVPQEFIDS

SEQ ID NO: 2510967 - protein, 21 aa, Entamoeba dispar
YQKFFEDLEVLFIDYSEAFPK

SEQ ID NO: 2510968 - protein, 19 aa, Entamoeba dispar
YQKICSLKTQIENEAKQQK

SEQ ID NO: 2510969 - protein, 22 aa, Entamoeba dispar
YQKLRESDNFIILELQFTETYV

SEQ ID NO: 2510970 - protein, 19 aa, Entamoeba dispar
YQKMIKPFEKKDEKKKRKY

SEQ ID NO: 2510971 - protein, 24 aa, Entamoeba dispar
YQKNKINILLGFTVKLIDLKNSIV

SEQ ID NO: 2510972 - protein, 17 aa, Entamoeba dispar
YQKPSNILITFKIDNNV

SEQ ID NO: 2510973 - protein, 21 aa, Entamoeba dispar
YQLEMLKYLIHCHNEAECAEK

SEQ ID NO: 2510974 - protein, 20 aa, Entamoeba dispar
YQLFNCCFIMNEAIKGLIEY

SEQ ID NO: 2510975 - protein, 17 aa, Entamoeba dispar
YQLIPFIPVDYFSSSLR

SEQ ID NO: 2510976 - protein, 19 aa, Entamoeba dispar
YQLKDDIIISFSLHDNNCS

SEQ ID NO: 2510977 - protein, 17 aa, Entamoeba dispar
YQLKRLFEIRNKIMQRH

SEQ ID NO: 2510978 - protein, 19 aa, Entamoeba dispar
YQLLLSKRLLYKGFQAEDE

SEQ ID NO: 2510979 - protein, 17 aa, Entamoeba dispar
YQLNTPFNYTSSSINPR

SEQ ID NO: 2510980 - protein, 20 aa, Entamoeba dispar
YQLWKLVHKVPIISLNDKVQ

SEQ ID NO: 2510981 - protein, 18 aa, Entamoeba dispar
YQMAGRLIGKCLNEKVSI

SEQ ID NO: 2510982 - protein, 17 aa, Entamoeba dispar
YQMIFHPIEYFSPKETK

SEQ ID NO: 2510983 - protein, 18 aa, Entamoeba dispar
YQMRIYKRVLSMKTTPET

SEQ ID NO: 2510984 - protein, 17 aa, Entamoeba dispar
YQNEYFKRLDYGKHSLH

SEQ ID NO: 2510985 - protein, 24 aa, Entamoeba dispar
YQNGIPCFWLHVLKNSGIFDGLSG

SEQ ID NO: 2510986 - protein, 36 aa, Entamoeba dispar
YQNIKGRKRTYPIWRRVNYYDYSWGMTINDFPELKR

SEQ ID NO: 2510987 - protein, 19 aa, Entamoeba dispar
YQNIPYWVWMILKEENNEV

SEQ ID NO: 2510988 - protein, 19 aa, Entamoeba dispar
YQNKDSWGVDDFYHSLIDL

SEQ ID NO: 2510989 - protein, 31 aa, Entamoeba dispar
YQPFANSGLFKWKYMTHWTIDYGITTSENGD

SEQ ID NO: 2510990 - protein, 18 aa, Entamoeba dispar
YQPILIPRTLWLLQQYEE

SEQ ID NO: 2510991 - protein, 19 aa, Entamoeba dispar
YQPKLAHLLSRLLKEDGKA

SEQ ID NO: 2510992 - protein, 18 aa, Entamoeba dispar
YQPNPLLDRVFWKKPTNA

SEQ ID NO: 2510993 - protein, 21 aa, Entamoeba dispar
YQPRRGFFSSLYQLIFHPIKF

SEQ ID NO: 2510994 - protein, 17 aa, Entamoeba dispar
YQPVSGLFQQYIDPKKG

SEQ ID NO: 2510995 - protein, 22 aa, Entamoeba dispar
YQQLVDGCRICGTNCIKLLQIV

SEQ ID NO: 2510996 - protein, 19 aa, Entamoeba dispar
YQSECHQFYEIVPKSNRFV

SEQ ID NO: 2510997 - protein, 25 aa, Entamoeba dispar
YQSFLCTPILIAAHRTLNLYSFVNK

SEQ ID NO: 2510998 - protein, 20 aa, Entamoeba dispar
YQSIPYWVWMILKEENNSVE

SEQ ID NO: 2510999 - protein, 22 aa, Entamoeba dispar
YQSNFRLLEKYGNFYDDDYKDL

SEQ ID NO: 2511000 - protein, 18 aa, Entamoeba dispar
YQSPLLFCQIRSLENIGI

SEQ ID NO: 2511001 - protein, 19 aa, Entamoeba dispar
YQTKCKFDLLQTSDPKSET

SEQ ID NO: 2511002 - protein, 26 aa, Entamoeba dispar
YQTSCLPPDMSVGWSKNQLVFINHSF

SEQ ID NO: 2511003 - protein, 22 aa, Entamoeba dispar
YQTVEIRPSVLFTKYEEECPWK

SEQ ID NO: 2511004 - protein, 27 aa, Entamoeba dispar
YQVSLPFCGQFAMKLMACVRMIKEIEL

SEQ ID NO: 2511005 - protein, 17 aa, Entamoeba dispar
YQVTEWMLRLFKESRGI

SEQ ID NO: 2511006 - protein, 18 aa, Entamoeba dispar
YQYIRLRCPHAQFTEAKS

SEQ ID NO: 2511007 - protein, 17 aa, Entamoeba dispar
YQYVFKYVIVGEVAVGK

SEQ ID NO: 2511008 - protein, 17 aa, Entamoeba dispar
YRACAPECAEVFLQTLL

SEQ ID NO: 2511009 - protein, 30 aa, Entamoeba dispar
YRADIKSHQSFPCIPFFGVYLQDLTFIHEG

SEQ ID NO: 2511010 - protein, 19 aa, Entamoeba dispar
YRAGIKLVNTEGRGVCLRF

SEQ ID NO: 2511011 - protein, 20 aa, Entamoeba dispar
YRAPNVCKMLARVDEISHWI

SEQ ID NO: 2511012 - protein, 23 aa, Entamoeba dispar
YRASSDLDQSCLVLQQFLQQLMT

SEQ ID NO: 2511013 - protein, 20 aa, Entamoeba dispar
YRATIGVDFAVKFTTVDERD

SEQ ID NO: 2511014 - protein, 18 aa, Entamoeba dispar
YRCEEELIMKRINDMQFM

SEQ ID NO: 2511015 - protein, 20 aa, Entamoeba dispar
YRCTTCYGKNVIICNECFNR

SEQ ID NO: 2511016 - protein, 21 aa, Entamoeba dispar
YRDECRKASAACILQRAIRSR

SEQ ID NO: 2511017 - protein, 20 aa, Entamoeba dispar
YRDTDCFVIVFSYIDKDSLV

SEQ ID NO: 2511018 - protein, 18 aa, Entamoeba dispar
YREEWKGDWQSRITVDKI

SEQ ID NO: 2511019 - protein, 17 aa, Entamoeba dispar
YREFNVIPINWNSDTIK

SEQ ID NO: 2511020 - protein, 24 aa, Entamoeba dispar
YRELIPRPMFEGIYAKVKQMAIGF

SEQ ID NO: 2511021 - protein, 17 aa, Entamoeba dispar
YRFEKVYFVSSLTGDGV

SEQ ID NO: 2511022 - protein, 17 aa, Entamoeba dispar
YRFFEGKNNAVAIAHMI

SEQ ID NO: 2511023 - protein, 33 aa, Entamoeba dispar
YRFHPSVKMAKRFFPHIQNMDGFFVCKLKVNVT

SEQ ID NO: 2511024 - protein, 21 aa, Entamoeba dispar
YRFPISYNEYLLFKSLGIYCN

SEQ ID NO: 2511025 - protein, 22 aa, Entamoeba dispar
YRGDFCSVFNCIKGSSLKEQSI

SEQ ID NO: 2511026 - protein, 18 aa, Entamoeba dispar
YRGNMERFHFNPIPLNKY

SEQ ID NO: 2511027 - protein, 18 aa, Entamoeba dispar
YRGNRFCLPLCIMYPYDY

SEQ ID NO: 2511028 - protein, 21 aa, Entamoeba dispar
YRGSSGIIVCYDVSENSSLDV

SEQ ID NO: 2511029 - protein, 23 aa, Entamoeba dispar
YRGTIKIDSWSTMEMPKDTYKEG

SEQ ID NO: 2511030 - protein, 17 aa, Entamoeba dispar
YRIGDNVFTAAQDFLTK

SEQ ID NO: 2511031 - protein, 17 aa, Entamoeba dispar
YRIKKFVVVDLPDVDCA

SEQ ID NO: 2511032 - protein, 19 aa, Entamoeba dispar
YRISQLIKQHDLIPLVEFV

SEQ ID NO: 2511033 - protein, 20 aa, Entamoeba dispar
YRITTAFANHFLRTLFSMPN

SEQ ID NO: 2511034 - protein, 23 aa, Entamoeba dispar
YRKEALRMICYLASNKFNKEAMQ

SEQ ID NO: 2511035 - protein, 24 aa, Entamoeba dispar
YRKEALRMICYLASNKFNKEAMQK

SEQ ID NO: 2511036 - protein, 22 aa, Entamoeba dispar
YRKELVPYFILQLNKMIEVMKK

SEQ ID NO: 2511037 - protein, 24 aa, Entamoeba dispar
YRKKEPYQRIEFSLTIEQSNEGTT

SEQ ID NO: 2511038 - protein, 22 aa, Entamoeba dispar
YRKQWCVLELLYSIEHIFPQLI

SEQ ID NO: 2511039 - protein, 18 aa, Entamoeba dispar
YRKTLTVDNRICVLDILD

SEQ ID NO: 2511040 - protein, 22 aa, Entamoeba dispar
YRKWTKLGIQGNKLFKPVCQTN

SEQ ID NO: 2511041 - protein, 21 aa, Entamoeba dispar
YRLACHTGKGAILFCVTRGRL

SEQ ID NO: 2511042 - protein, 21 aa, Entamoeba dispar
YRLKESFEFEWENNIKLPPHK

SEQ ID NO: 2511043 - protein, 18 aa, Entamoeba dispar
YRLLKKCDDVQEMQPLLP

SEQ ID NO: 2511044 - protein, 17 aa, Entamoeba dispar
YRLLMLESEVIIIQQPP

SEQ ID NO: 2511045 - protein, 18 aa, Entamoeba dispar
YRLLSTRMGYETFVQNKN

SEQ ID NO: 2511046 - protein, 22 aa, Entamoeba dispar
YRLLYPELPRLEFIDFVKQIAF

SEQ ID NO: 2511047 - protein, 20 aa, Entamoeba dispar
YRLQYKPVLPKHIADIDNIT

SEQ ID NO: 2511048 - protein, 27 aa, Entamoeba dispar
YRLSHFKCIRKALKHSKKITIMINQNK

SEQ ID NO: 2511049 - protein, 25 aa, Entamoeba dispar
YRLYFKCTRCKTLFTIKTDPKNSDY

SEQ ID NO: 2511050 - protein, 17 aa, Entamoeba dispar
YRLYFNNCLLNPDDTIA

SEQ ID NO: 2511051 - protein, 18 aa, Entamoeba dispar
YRLYNVISQLKLSSKIHL

SEQ ID NO: 2511052 - protein, 17 aa, Entamoeba dispar
YRNAQGVIIVYDVNDIG

SEQ ID NO: 2511053 - protein, 20 aa, Entamoeba dispar
YRNELEVIITPSLSGAIRML

SEQ ID NO: 2511054 - protein, 24 aa, Entamoeba dispar
YRNELKPFLSFVDFVKDLSDSERF

SEQ ID NO: 2511055 - protein, 20 aa, Entamoeba dispar
YRNIFKKSKIDKILTVVGNY

SEQ ID NO: 2511056 - protein, 20 aa, Entamoeba dispar
YRNPEILAFIRKIEIRCLTM

SEQ ID NO: 2511057 - protein, 17 aa, Entamoeba dispar
YRNYFGISIKRLLEEEN

SEQ ID NO: 2511058 - protein, 22 aa, Entamoeba dispar
YRPELPLILCGSHYGEQHEVIP

SEQ ID NO: 2511059 - protein, 18 aa, Entamoeba dispar
YRPVPLQQTFFGVADKKP

SEQ ID NO: 2511060 - protein, 25 aa, Entamoeba dispar
YRQELCSMFPPLVIESLINKYHINT

SEQ ID NO: 2511061 - protein, 21 aa, Entamoeba dispar
YRRFCSRRIKRIRQKVQLINK

SEQ ID NO: 2511062 - protein, 21 aa, Entamoeba dispar
YRRFIMGGFVRLQGHPTKFNL

SEQ ID NO: 2511063 - protein, 23 aa, Entamoeba dispar
YRRRLPIGYTRLFSYELARALGY

SEQ ID NO: 2511064 - protein, 17 aa, Entamoeba dispar
YRRSFSIVEAVHDAEVV

SEQ ID NO: 2511065 - protein, 18 aa, Entamoeba dispar
YRRYMKNTDIYVHADIHG

SEQ ID NO: 2511066 - protein, 20 aa, Entamoeba dispar
YRSIACWEKAVEEIKTLETK

SEQ ID NO: 2511067 - protein, 24 aa, Entamoeba dispar
YRSKFTINIYIGSLEIKWVNNVLF

SEQ ID NO: 2511068 - protein, 20 aa, Entamoeba dispar
YRTATRLMLLAEQFALPVIT

SEQ ID NO: 2511069 - protein, 28 aa, Entamoeba dispar
YRTKPCKYFFETGVCRKGEHCNFSHDLS

SEQ ID NO: 2511070 - protein, 21 aa, Entamoeba dispar
YRTLDELIMRIPMKLSDNPLE

SEQ ID NO: 2511071 - protein, 21 aa, Entamoeba dispar
YRTQCSSFSKTLFTNPILTDS

SEQ ID NO: 2511072 - protein, 19 aa, Entamoeba dispar
YRTTKGFCDLIYQEWISSG

SEQ ID NO: 2511073 - protein, 28 aa, Entamoeba dispar
YRVHICFSSSCSLILFYYLPNNYPFEEI

SEQ ID NO: 2511074 - protein, 18 aa, Entamoeba dispar
YRVTEEFHIEEDIYSVYH

SEQ ID NO: 2511075 - protein, 21 aa, Entamoeba dispar
YRVVRECAPNAFIIGNIGSVQ

SEQ ID NO: 2511076 - protein, 17 aa, Entamoeba dispar
YRYEASLRSDGYMRRLD

SEQ ID NO: 2511077 - protein, 25 aa, Entamoeba dispar
YRYFLKSWPHLCFFAKDKTTNKYVG

SEQ ID NO: 2511078 - protein, 20 aa, Entamoeba dispar
YRYLEICYALFNAYNGSGPE

SEQ ID NO: 2511079 - protein, 17 aa, Entamoeba dispar
YRYLVEKTKPGSLARLV

SEQ ID NO: 2511080 - protein, 19 aa, Entamoeba dispar
YRYLVEKTKPGSLARLVSA

SEQ ID NO: 2511081 - protein, 23 aa, Entamoeba dispar
YRYSDMRQTLLFTYSGHQRKVQI

SEQ ID NO: 2511082 - protein, 25 aa, Entamoeba dispar
YSAYPSCGFDWCRVNTDLVCTWYLN

SEQ ID NO: 2511083 - protein, 19 aa, Entamoeba dispar
YSCEILITLLCMKVNDPTG

SEQ ID NO: 2511084 - protein, 25 aa, Entamoeba dispar
YSCKYAPEFPGDYTVDIKLNGDKVG

SEQ ID NO: 2511085 - protein, 18 aa, Entamoeba dispar
YSCSPIGTLNPSYNCNIN

SEQ ID NO: 2511086 - protein, 24 aa, Entamoeba dispar
YSDFGIPCKTCFNKVKEKYINNKN

SEQ ID NO: 2511087 - protein, 25 aa, Entamoeba dispar
YSDFPHWDISIGGFADGNIVLYKMN

SEQ ID NO: 2511088 - protein, 23 aa, Entamoeba dispar
YSDKRIGYLALMLLLDETQEVLT

SEQ ID NO: 2511089 - protein, 20 aa, Entamoeba dispar
YSDSIEWFFIGFDPTKSNIK

SEQ ID NO: 2511090 - protein, 18 aa, Entamoeba dispar
YSDSRIIGFDSRMKEKAF

SEQ ID NO: 2511091 - protein, 22 aa, Entamoeba dispar
YSEFEVFYLFQGILELIKEFYG

SEQ ID NO: 2511092 - protein, 30 aa, Entamoeba dispar
YSEHLRKVCSVKPLGPRFISTSSDRSIHIW

SEQ ID NO: 2511093 - protein, 30 aa, Entamoeba dispar
YSEPVFKHCMSLFWCDFLRANSTSIVKSTM

SEQ ID NO: 2511094 - protein, 17 aa, Entamoeba dispar
YSERGAVIIPIYYQNNQ

SEQ ID NO: 2511095 - protein, 22 aa, Entamoeba dispar
YSESSIKPIFLRKASTSVSVNA

SEQ ID NO: 2511096 - protein, 22 aa, Entamoeba dispar
YSEYKDTLLLNGIKNINNSLKN

SEQ ID NO: 2511097 - protein, 30 aa, Entamoeba dispar
YSFAVTMYECFKWGEAYDREKFVYIWNIAD

SEQ ID NO: 2511098 - protein, 19 aa, Entamoeba dispar
YSFDGELIAAASATGKVGI

SEQ ID NO: 2511099 - protein, 21 aa, Entamoeba dispar
YSFDSMKEWIIISSQMHSIFG

SEQ ID NO: 2511100 - protein, 17 aa, Entamoeba dispar
YSFHPIITTIPIHLILS

SEQ ID NO: 2511101 - protein, 26 aa, Entamoeba dispar
YSFMKPAELLFTMNLIDKMNKIIENE

SEQ ID NO: 2511102 - protein, 25 aa, Entamoeba dispar
YSFSVCAQCKKVIYKKDKETETRRR

SEQ ID NO: 2511103 - protein, 19 aa, Entamoeba dispar
YSGFSKITITTNIPEETHI

SEQ ID NO: 2511104 - protein, 18 aa, Entamoeba dispar
YSGIEKKECGGKIIRIYP

SEQ ID NO: 2511105 - protein, 21 aa, Entamoeba dispar
YSGKIRLTITIKENETSKTIE

SEQ ID NO: 2511106 - protein, 18 aa, Entamoeba dispar
YSHARVISVPTILVLNPG

SEQ ID NO: 2511107 - protein, 17 aa, Entamoeba dispar
YSHFKSSVTTMLAQAEL

SEQ ID NO: 2511108 - protein, 21 aa, Entamoeba dispar
YSIAVGIKYKTGVISNSGKFA

SEQ ID NO: 2511109 - protein, 21 aa, Entamoeba dispar
YSIAVGVKYKTGVISNSGKFT

SEQ ID NO: 2511110 - protein, 20 aa, Entamoeba dispar
YSIIIFDIQHYFEIFNQYDS

SEQ ID NO: 2511111 - protein, 20 aa, Entamoeba dispar
YSIIPEKKMVFSFKGNDKII

SEQ ID NO: 2511112 - protein, 25 aa, Entamoeba dispar
YSIPVELSIKIKGVRIEKSRVSDSE

SEQ ID NO: 2511113 - protein, 20 aa, Entamoeba dispar
YSIPVLYAPQFDRINKKQDI

SEQ ID NO: 2511114 - protein, 24 aa, Entamoeba dispar
YSIRSVYNFAPFIKHYFIVTMGQT

SEQ ID NO: 2511115 - protein, 18 aa, Entamoeba dispar
YSITLEFMIRVKMGEEIQ

SEQ ID NO: 2511116 - protein, 24 aa, Entamoeba dispar
YSIVLKVRLDLAKNIGCENEYPSL

SEQ ID NO: 2511117 - protein, 27 aa, Entamoeba dispar
YSIYLATCGKLVFFAIKPSTPNKCPLK

SEQ ID NO: 2511118 - protein, 18 aa, Entamoeba dispar
YSKGELLSGELKKIVSSS

SEQ ID NO: 2511119 - protein, 17 aa, Entamoeba dispar
YSKNYIENIGWIIDICK

SEQ ID NO: 2511120 - protein, 22 aa, Entamoeba dispar
YSKRVGYPLILCSSYSGENITK

SEQ ID NO: 2511121 - protein, 18 aa, Entamoeba dispar
YSLCPFVSQCFIYGESTD

SEQ ID NO: 2511122 - protein, 19 aa, Entamoeba dispar
YSLDEISQWCYSNNIEFTI

SEQ ID NO: 2511123 - protein, 20 aa, Entamoeba dispar
YSLECNELDSSFVNNYNPEI

SEQ ID NO: 2511124 - protein, 17 aa, Entamoeba dispar
YSLLDSILKDVVKSLEE

SEQ ID NO: 2511125 - protein, 25 aa, Entamoeba dispar
YSLLISCLFDLHVILLPNAPEAQRV

SEQ ID NO: 2511126 - protein, 17 aa, Entamoeba dispar
YSLMKMTSFDPDNERLF

SEQ ID NO: 2511127 - protein, 19 aa, Entamoeba dispar
YSLMPSMMIFYETNVATFG

SEQ ID NO: 2511128 - protein, 21 aa, Entamoeba dispar
YSLMVALKLSRIVFYIYQPQA

SEQ ID NO: 2511129 - protein, 19 aa, Entamoeba dispar
YSLNNALNIFSWIIPCKKI

SEQ ID NO: 2511130 - protein, 25 aa, Entamoeba dispar
YSLSKMGLVKSFWYYFLNKNEDTEE

SEQ ID NO: 2511131 - protein, 28 aa, Entamoeba dispar
YSLSYCIYAMLILPKLRDPDSFLQSVDN

SEQ ID NO: 2511132 - protein, 20 aa, Entamoeba dispar
YSMQCSVYSYILIPNEFTLQ

SEQ ID NO: 2511133 - protein, 22 aa, Entamoeba dispar
YSMWKSNITVFSTSLKEQRSYQ

SEQ ID NO: 2511134 - protein, 25 aa, Entamoeba dispar
YSNAIPWELFSIIKLTDDDTTSSSR

SEQ ID NO: 2511135 - protein, 26 aa, Entamoeba dispar
YSNNCCIGVLCPYQYQNQLINFINKN

SEQ ID NO: 2511136 - protein, 21 aa, Entamoeba dispar
YSNRSAAYCSIDENDLAIEDA

SEQ ID NO: 2511137 - protein, 24 aa, Entamoeba dispar
YSNVCTTNKCELRKMSVNKTTWRM

SEQ ID NO: 2511138 - protein, 19 aa, Entamoeba dispar
YSNVGLKMNGIDGVFNGGK

SEQ ID NO: 2511139 - protein, 20 aa, Entamoeba dispar
YSPLYPKLPLVAGRHGLDYK

SEQ ID NO: 2511140 - protein, 24 aa, Entamoeba dispar
YSQECAVWRNIYLSGAHDLRREPI

SEQ ID NO: 2511141 - protein, 24 aa, Entamoeba dispar
YSQFLKKNYPVLVEYYEKNKNRKE

SEQ ID NO: 2511142 - protein, 18 aa, Entamoeba dispar
YSQIPYYVCFKNDGNKSI

SEQ ID NO: 2511143 - protein, 18 aa, Entamoeba dispar
YSQLAALCGGYIMMPLNP

SEQ ID NO: 2511144 - protein, 23 aa, Entamoeba dispar
YSQLKLVPPENGRYISTEESVLD

SEQ ID NO: 2511145 - protein, 18 aa, Entamoeba dispar
YSQLPSFYEDGSLNMIKV

SEQ ID NO: 2511146 - protein, 23 aa, Entamoeba dispar
YSQRCDWPLLHLYIISNNDNDGL

SEQ ID NO: 2511147 - protein, 17 aa, Entamoeba dispar
YSQVPWILSPVLHTSYR

SEQ ID NO: 2511148 - protein, 24 aa, Entamoeba dispar
YSQVPWILSPVLRTTRRMFSHKEL

SEQ ID NO: 2511149 - protein, 18 aa, Entamoeba dispar
YSQVPWIVAPIVKTTTRI

SEQ ID NO: 2511150 - protein, 24 aa, Entamoeba dispar
YSRCSDYFSLGSMIFEFICGVPPF

SEQ ID NO: 2511151 - protein, 17 aa, Entamoeba dispar
YSRFKEFIIEALQKPTK

SEQ ID NO: 2511152 - protein, 17 aa, Entamoeba dispar
YSRIFQMLFGIDYKENQ

SEQ ID NO: 2511153 - protein, 17 aa, Entamoeba dispar
YSRKLFPNIETFHIYNK

SEQ ID NO: 2511154 - protein, 18 aa, Entamoeba dispar
YSRRFFPNIETFHIYNEE

SEQ ID NO: 2511155 - protein, 20 aa, Entamoeba dispar
YSRRFFPNIETFHIYNKNDK

SEQ ID NO: 2511156 - protein, 19 aa, Entamoeba dispar
YSRRFFPNIETFYIYCYND

SEQ ID NO: 2511157 - protein, 31 aa, Entamoeba dispar
YSRRLYSLFRSWLEMHAEYFSRECPFLLEKI

SEQ ID NO: 2511158 - protein, 17 aa, Entamoeba dispar
YSRVNSYTARTGDISAI

SEQ ID NO: 2511159 - protein, 25 aa, Entamoeba dispar
YSSDECKYCKTPCGSGCCTKISSSM

SEQ ID NO: 2511160 - protein, 17 aa, Entamoeba dispar
YSSEYKSTIGVDLSTKA

SEQ ID NO: 2511161 - protein, 20 aa, Entamoeba dispar
YSSFKSLHVQFPFSNSSILV

SEQ ID NO: 2511162 - protein, 19 aa, Entamoeba dispar
YSSFKSLLVQFPFSNSSIL

SEQ ID NO: 2511163 - protein, 31 aa, Entamoeba dispar
YSSFKTQRLFFLFYLSCMTKIIRCKRRPNEM

SEQ ID NO: 2511164 - protein, 29 aa, Entamoeba dispar
YSSGDVGLLLRWSGGEIKDVIPKGYAFPN

SEQ ID NO: 2511165 - protein, 20 aa, Entamoeba dispar
YSSIILESIPTIIIFNEGQY

SEQ ID NO: 2511166 - protein, 19 aa, Entamoeba dispar
YSSIYYKQLLINLLKEKEK

SEQ ID NO: 2511167 - protein, 25 aa, Entamoeba dispar
YSSLCIRFNQVLGMMEKYLERVNKN

SEQ ID NO: 2511168 - protein, 17 aa, Entamoeba dispar
YSSMSPIDRSFCSNINY

SEQ ID NO: 2511169 - protein, 22 aa, Entamoeba dispar
YSSRNWGRCILQHFFQHAFDGM

SEQ ID NO: 2511170 - protein, 22 aa, Entamoeba dispar
YSSSFGRDMHKSFGQSWSKNHL

SEQ ID NO: 2511171 - protein, 26 aa, Entamoeba dispar
YSSSLNKMLLCYGTDYLHEISLDTIT

SEQ ID NO: 2511172 - protein, 27 aa, Entamoeba dispar
YSSVFGIRWIKMLFACEFHIEDVVEIW

SEQ ID NO: 2511173 - protein, 17 aa, Entamoeba dispar
YSSVSIWCDKEIKEIKI

SEQ ID NO: 2511174 - protein, 23 aa, Entamoeba dispar
YSTELPSKIIIKLCNEVLNEISK

SEQ ID NO: 2511175 - protein, 17 aa, Entamoeba dispar
YSTPISMPTSIPQRTLP

SEQ ID NO: 2511176 - protein, 21 aa, Entamoeba dispar
YSTRNPLDFTVEIAADEEADL

SEQ ID NO: 2511177 - protein, 21 aa, Entamoeba dispar
YSTSKPLGIICLFNEQKQARV

SEQ ID NO: 2511178 - protein, 20 aa, Entamoeba dispar
YSTSKPQGWIEMKRSTKNKW

SEQ ID NO: 2511179 - protein, 23 aa, Entamoeba dispar
YSTTCAPIEFGLIIKLNNKIKIK

SEQ ID NO: 2511180 - protein, 22 aa, Entamoeba dispar
YSTTLRLFAILRHDYSNYISSY

SEQ ID NO: 2511181 - protein, 17 aa, Entamoeba dispar
YSVKMPFTIKNRDWVNM

SEQ ID NO: 2511182 - protein, 21 aa, Entamoeba dispar
YSVYSRKDCFEIMYHVVPLLT

SEQ ID NO: 2511183 - protein, 23 aa, Entamoeba dispar
YSWLQDLLHICRVRVCPSNEPSH

SEQ ID NO: 2511184 - protein, 23 aa, Entamoeba dispar
YSYARKYFYLSIYSNAIKGLTIN

SEQ ID NO: 2511185 - protein, 26 aa, Entamoeba dispar
YSYEKGIAFPCCISLNNCCGYFCPLA

SEQ ID NO: 2511186 - protein, 24 aa, Entamoeba dispar
YSYGIILWELIYRVIYQKYQRPFQ

SEQ ID NO: 2511187 - protein, 24 aa, Entamoeba dispar
YSYPCDIYSLGMTMYFSFTKIDPY

SEQ ID NO: 2511188 - protein, 18 aa, Entamoeba dispar
YTCAVDCHKAMLWDSDAS

SEQ ID NO: 2511189 - protein, 17 aa, Entamoeba dispar
YTCRSCLDTKLWKYITP

SEQ ID NO: 2511190 - protein, 17 aa, Entamoeba dispar
YTCVATHSLFSKNYLQS

SEQ ID NO: 2511191 - protein, 25 aa, Entamoeba dispar
YTDAGRCTRPLFTVSNNNGHYTLNL

SEQ ID NO: 2511192 - protein, 34 aa, Entamoeba dispar
YTDECLEVRLALLTACGKIYCEVPFTETTQKVLE

SEQ ID NO: 2511193 - protein, 18 aa, Entamoeba dispar
YTDLMIRIGSSEFATKQY

SEQ ID NO: 2511194 - protein, 17 aa, Entamoeba dispar
YTDRLVTFLSYMGKNQP

SEQ ID NO: 2511195 - protein, 24 aa, Entamoeba dispar
YTDTDCFMICFSIAEEDSFERIKT

SEQ ID NO: 2511196 - protein, 21 aa, Entamoeba dispar
YTEGFSICFASNVLFIIMELK

SEQ ID NO: 2511197 - protein, 24 aa, Entamoeba dispar
YTEYCTYLKRMEEMNNEQNENIKK

SEQ ID NO: 2511198 - protein, 17 aa, Entamoeba dispar
YTFGDGYIGGPLECGLH

SEQ ID NO: 2511199 - protein, 17 aa, Entamoeba dispar
YTGLKALVLDSITTSIV

SEQ ID NO: 2511200 - protein, 22 aa, Entamoeba dispar
YTIACGFQPFRSENEIEDGKGG

SEQ ID NO: 2511201 - protein, 21 aa, Entamoeba dispar
YTIKTPPNYDGIKEVNLKIDV

SEQ ID NO: 2511202 - protein, 27 aa, Entamoeba dispar
YTKDRIFFKIAKDWDLLYVVGEGKEFV

SEQ ID NO: 2511203 - protein, 18 aa, Entamoeba dispar
YTKEEFLKSLPLPKTVLT

SEQ ID NO: 2511204 - protein, 27 aa, Entamoeba dispar
YTKERREIICPNPGFIIQLYEFQLKLG

SEQ ID NO: 2511205 - protein, 18 aa, Entamoeba dispar
YTKHKYESLFLFDSEDSY

SEQ ID NO: 2511206 - protein, 22 aa, Entamoeba dispar
YTKHQFGGLIIPVRGMDLGKDK

SEQ ID NO: 2511207 - protein, 19 aa, Entamoeba dispar
YTKKWANTHIKELDMKSYL

SEQ ID NO: 2511208 - protein, 22 aa, Entamoeba dispar
YTKLIFTLFCNIGMVSCDDFFG

SEQ ID NO: 2511209 - protein, 23 aa, Entamoeba dispar
YTKLIFTLFCNIGMVSCDDFFGN

SEQ ID NO: 2511210 - protein, 26 aa, Entamoeba dispar
YTKLSECGWRQYMIGKIGEDLRTLTE

SEQ ID NO: 2511211 - protein, 20 aa, Entamoeba dispar
YTLEESLSFKSLTDSGNNIE

SEQ ID NO: 2511212 - protein, 25 aa, Entamoeba dispar
YTLLKRIKIIKSFWRNIKENEKERF

SEQ ID NO: 2511213 - protein, 19 aa, Entamoeba dispar
YTLLPSGSLLKHSDFGFYE

SEQ ID NO: 2511214 - protein, 21 aa, Entamoeba dispar
YTLYRIYRMNPVDLVGTENGK

SEQ ID NO: 2511215 - protein, 21 aa, Entamoeba dispar
YTLYRKYRLSVLVDKKKGKSM

SEQ ID NO: 2511216 - protein, 23 aa, Entamoeba dispar
YTLYRKYRLSVLVDKKKGKSMKE

SEQ ID NO: 2511217 - protein, 33 aa, Entamoeba dispar
YTNEYTICIDFISFCISNYPLIFPNDIDEKLNK

SEQ ID NO: 2511218 - protein, 29 aa, Entamoeba dispar
YTNFIKSRFKTEESICCVFALKEKVIVGS

SEQ ID NO: 2511219 - protein, 25 aa, Entamoeba dispar
YTNKCKEAARLALGYYMNLSTSEEV

SEQ ID NO: 2511220 - protein, 20 aa, Entamoeba dispar
YTNKLVIYWDVERNGKSEII

SEQ ID NO: 2511221 - protein, 24 aa, Entamoeba dispar
YTNPKCGHSFCLSCISEHAKEKIK

SEQ ID NO: 2511222 - protein, 19 aa, Entamoeba dispar
YTPELFKTLKPLETKKPLV

SEQ ID NO: 2511223 - protein, 22 aa, Entamoeba dispar
YTPEYIVDFFLKGIESIQYYER

SEQ ID NO: 2511224 - protein, 19 aa, Entamoeba dispar
YTPITSCGWWEIQQPILQE

SEQ ID NO: 2511225 - protein, 23 aa, Entamoeba dispar
YTPKELGGLGMLSMGHVLIPQSD

SEQ ID NO: 2511226 - protein, 30 aa, Entamoeba dispar
YTPLIIPKEIWRLCNYVLPFIHDPNFISLS

SEQ ID NO: 2511227 - protein, 22 aa, Entamoeba dispar
YTPPEMISLIFSDLSVFTPSAV

SEQ ID NO: 2511228 - protein, 19 aa, Entamoeba dispar
YTPQKREFVSFEKPTIPTE

SEQ ID NO: 2511229 - protein, 17 aa, Entamoeba dispar
YTREEFDDVCNRLRISV

SEQ ID NO: 2511230 - protein, 19 aa, Entamoeba dispar
YTRFLCSIISGYIQSYYTI

SEQ ID NO: 2511231 - protein, 17 aa, Entamoeba dispar
YTRVNSYTSRTGDISAI

SEQ ID NO: 2511232 - protein, 23 aa, Entamoeba dispar
YTSEFSDLEWDRIYDDVVIPPRD

SEQ ID NO: 2511233 - protein, 23 aa, Entamoeba dispar
YTSEGIPYMFPIPYKDEPSYLIY

SEQ ID NO: 2511234 - protein, 18 aa, Entamoeba dispar
YTSITRARFEEINIDLFK

SEQ ID NO: 2511235 - protein, 19 aa, Entamoeba dispar
YTSNGWYIMQCEPMKNGIT

SEQ ID NO: 2511236 - protein, 20 aa, Entamoeba dispar
YTSRHCVFLCRHGFRLDYTD

SEQ ID NO: 2511237 - protein, 17 aa, Entamoeba dispar
YTTEIITLWYRPPEILL

SEQ ID NO: 2511238 - protein, 26 aa, Entamoeba dispar
YTTFNQKCSYPFGYGLSYTQFEYSNF

SEQ ID NO: 2511239 - protein, 25 aa, Entamoeba dispar
YTTLKLNICDFFPEHLRVRGIDVKK

SEQ ID NO: 2511240 - protein, 47 aa, Entamoeba dispar
YTYHYQECREIMDFLYKRLSEDGKNWREIYKSLLVLDNILKNGSEEA

SEQ ID NO: 2511241 - protein, 20 aa, Entamoeba dispar
YTYLYVCLKQSPGGISYDDL

SEQ ID NO: 2511242 - protein, 23 aa, Entamoeba dispar
YTYPSPKCIRFSPSQKQTFAVCS

SEQ ID NO: 2511243 - protein, 25 aa, Entamoeba dispar
YVAVECFKFSDSYPIEQEDVNLTLI

SEQ ID NO: 2511244 - protein, 31 aa, Entamoeba dispar
YVCFGCLKGIPLRNLCLLGNPLPEVDSLFLI

SEQ ID NO: 2511245 - protein, 20 aa, Entamoeba dispar
YVCSSPILPETKDFVSPVSD

SEQ ID NO: 2511246 - protein, 22 aa, Entamoeba dispar
YVDLDYGVFICDLCASLHTECK

SEQ ID NO: 2511247 - protein, 23 aa, Entamoeba dispar
YVDRVIACIGFLYTRSNYSYYFG

SEQ ID NO: 2511248 - protein, 19 aa, Entamoeba dispar
YVECLVKIPVNSGSITEKK

SEQ ID NO: 2511249 - protein, 21 aa, Entamoeba dispar
YVELKSNVIIFTNIPPDQQQQ

SEQ ID NO: 2511250 - protein, 19 aa, Entamoeba dispar
YVETRWYRAPEILLGSQRY

SEQ ID NO: 2511251 - protein, 24 aa, Entamoeba dispar
YVGPCGKRALLIAKNRVTALTDFV

SEQ ID NO: 2511252 - protein, 19 aa, Entamoeba dispar
YVHDFLMNSILNWCKEESK

SEQ ID NO: 2511253 - protein, 28 aa, Entamoeba dispar
YVHMKECYVHFEDAWKSAVDLYGLSSIH

SEQ ID NO: 2511254 - protein, 24 aa, Entamoeba dispar
YVHTRLCFKLFKYIIYTKVPSFFN

SEQ ID NO: 2511255 - protein, 19 aa, Entamoeba dispar
YVIFGERIVDLAVARLMNN

SEQ ID NO: 2511256 - protein, 17 aa, Entamoeba dispar
YVIPSIVGKELFTGCCY

SEQ ID NO: 2511257 - protein, 23 aa, Entamoeba dispar
YVIRHFFEAIQLCESKENIEESQ

SEQ ID NO: 2511258 - protein, 17 aa, Entamoeba dispar
YVIWYDVRKSYGNTIPS

SEQ ID NO: 2511259 - protein, 18 aa, Entamoeba dispar
YVIWYEVNYSTYLKEKEK

SEQ ID NO: 2511260 - protein, 17 aa, Entamoeba dispar
YVIWYKVSYSTYLQEKE

SEQ ID NO: 2511261 - protein, 17 aa, Entamoeba dispar
YVIWYLVSYSKYLQEKE

SEQ ID NO: 2511262 - protein, 18 aa, Entamoeba dispar
YVIWYPVDYLTYLFKKEQ

SEQ ID NO: 2511263 - protein, 19 aa, Entamoeba dispar
YVKKVLRIAMNGSMTKDLF

SEQ ID NO: 2511264 - protein, 18 aa, Entamoeba dispar
YVKLEGYGRRIKFSKEFE

SEQ ID NO: 2511265 - protein, 26 aa, Entamoeba dispar
YVKLKLRFENEMHSFKISPIDKLEKL

SEQ ID NO: 2511266 - protein, 19 aa, Entamoeba dispar
YVKSMSGTTPFLLACGYGQ

SEQ ID NO: 2511267 - protein, 26 aa, Entamoeba dispar
YVKTEFNKRLALWFTQQDIWNRMDVG

SEQ ID NO: 2511268 - protein, 18 aa, Entamoeba dispar
YVLDILCDTGCGYQGDEL

SEQ ID NO: 2511269 - protein, 37 aa, Entamoeba dispar
YVLFKKLPIKIPIYFINFLKKRFNDVQNDVFKSSHPF

SEQ ID NO: 2511270 - protein, 17 aa, Entamoeba dispar
YVLKCIQIKNTLKNIKI

SEQ ID NO: 2511271 - protein, 24 aa, Entamoeba dispar
YVLKGGEIYRMFEITKLNPKGLFW

SEQ ID NO: 2511272 - protein, 35 aa, Entamoeba dispar
YVLTFPRKVIKIYPLNVPFSLEYVVMIFWNGISIN

SEQ ID NO: 2511273 - protein, 18 aa, Entamoeba dispar
YVNDGSVILTINYSTLLL

SEQ ID NO: 2511274 - protein, 30 aa, Entamoeba dispar
YVQKIFKFRISNFYSVYVYKGYDEDPDFFW

SEQ ID NO: 2511275 - protein, 22 aa, Entamoeba dispar
YVRNGKMPLVITCNESIKNSIN

SEQ ID NO: 2511276 - protein, 18 aa, Entamoeba dispar
YVSCCKIVNDNVIIESSG

SEQ ID NO: 2511277 - protein, 27 aa, Entamoeba dispar
YVSKIKGKYCFISFYNGVTIVCYRMNV

SEQ ID NO: 2511278 - protein, 34 aa, Entamoeba dispar
YVSRISKPWKRRYCTKCWMPLTYSSFKTQRLFFL

SEQ ID NO: 2511279 - protein, 18 aa, Entamoeba dispar
YVSWDFKFLEWRDTNYLP

SEQ ID NO: 2511280 - protein, 21 aa, Entamoeba dispar
YVVADGCGWGTASCKAAEIAI

SEQ ID NO: 2511281 - protein, 17 aa, Entamoeba dispar
YVVKAKFVVKKEEDFGI

SEQ ID NO: 2511282 - protein, 17 aa, Entamoeba dispar
YVVKEFNKFVSEHKGLS

SEQ ID NO: 2511283 - protein, 31 aa, Entamoeba dispar
YVVNKCKHIFCSYCAQKAWLNGNYKCPLCQI

SEQ ID NO: 2511284 - protein, 24 aa, Entamoeba dispar
YVYDCGNEIFMWKGKKCSRKEWEL

SEQ ID NO: 2511285 - protein, 17 aa, Entamoeba dispar
YVYHDLTKCVARLHVCF

SEQ ID NO: 2511286 - protein, 18 aa, Entamoeba dispar
YVYYQIFFSKGINLDKQV

SEQ ID NO: 2511287 - protein, 20 aa, Entamoeba dispar
YWEDIKRLVLKPIQSKTIMN

SEQ ID NO: 2511288 - protein, 22 aa, Entamoeba dispar
YWEQAIFKYLRCDPQDHYFLLT

SEQ ID NO: 2511289 - protein, 19 aa, Entamoeba dispar
YWFKSRTSFVKELEEKYGM

SEQ ID NO: 2511290 - protein, 17 aa, Entamoeba dispar
YWIEPIMSNFLYESPMI

SEQ ID NO: 2511291 - protein, 24 aa, Entamoeba dispar
YWISCSETSFILLARGIYKVRFYA

SEQ ID NO: 2511292 - protein, 17 aa, Entamoeba dispar
YWNLMKWVVEHKLPESG

SEQ ID NO: 2511293 - protein, 28 aa, Entamoeba dispar
YWSLVYRIANGKGLMWDLPRKKKEEKTE

SEQ ID NO: 2511294 - protein, 18 aa, Entamoeba dispar
YWWDGLKEKVDIERWSYE

SEQ ID NO: 2511295 - protein, 18 aa, Entamoeba dispar
YYAVRLFLTAMGFCSSNF

SEQ ID NO: 2511296 - protein, 22 aa, Entamoeba dispar
YYCFEGCSMLKSINIPTSVREF

SEQ ID NO: 2511297 - protein, 21 aa, Entamoeba dispar
YYCPISISLPTQMKHELGKII

SEQ ID NO: 2511298 - protein, 24 aa, Entamoeba dispar
YYDISGCYILKPSAYGIWENIQHF

SEQ ID NO: 2511299 - protein, 21 aa, Entamoeba dispar
YYDRICLALKLVSTYDPRCLD

SEQ ID NO: 2511300 - protein, 22 aa, Entamoeba dispar
YYEKECHYNCCLSSPSTVLRCL

SEQ ID NO: 2511301 - protein, 25 aa, Entamoeba dispar
YYELFSRLLMIKDYLIKEIIQKQCD

SEQ ID NO: 2511302 - protein, 24 aa, Entamoeba dispar
YYELPWKQINEFISCSYTIQNIPT

SEQ ID NO: 2511303 - protein, 24 aa, Entamoeba dispar
YYEMKQWRFVIQICSNLINKITDQ

SEQ ID NO: 2511304 - protein, 24 aa, Entamoeba dispar
YYEPFGCYINHPFKKEGWNGDIHS

SEQ ID NO: 2511305 - protein, 25 aa, Entamoeba dispar
YYETLKLLIHYLRLIADASSINKMN

SEQ ID NO: 2511306 - protein, 23 aa, Entamoeba dispar
YYFFIPIEWNWKTKLYEKKSATY

SEQ ID NO: 2511307 - protein, 17 aa, Entamoeba dispar
YYFKSITIIGYIDEEMS

SEQ ID NO: 2511308 - protein, 25 aa, Entamoeba dispar
YYFNLTDWYIGYLIQLYKNGDKSIE

SEQ ID NO: 2511309 - protein, 24 aa, Entamoeba dispar
YYFYREWYDAMKWDYTNQVDDLLY

SEQ ID NO: 2511310 - protein, 24 aa, Entamoeba dispar
YYGKFKAADALSKISRQRSNTSCK

SEQ ID NO: 2511311 - protein, 18 aa, Entamoeba dispar
YYGKNGKYYGVWWGCKLV

SEQ ID NO: 2511312 - protein, 24 aa, Entamoeba dispar
YYGKYELIFIYSILNRVMNIGIDN

SEQ ID NO: 2511313 - protein, 23 aa, Entamoeba dispar
YYGSRSSYFLNIINKRLKVNTNV

SEQ ID NO: 2511314 - protein, 28 aa, Entamoeba dispar
YYHDKCVHCYKCNQRIYSTSKFYNHKGK

SEQ ID NO: 2511315 - protein, 27 aa, Entamoeba dispar
YYHKINWGMRTHERFGSGRRYFEPGDF

SEQ ID NO: 2511316 - protein, 19 aa, Entamoeba dispar
YYHSIDFSDFLIRKLINGD

SEQ ID NO: 2511317 - protein, 25 aa, Entamoeba dispar
YYICSCTEKILFICDSCNERMSMDN

SEQ ID NO: 2511318 - protein, 18 aa, Entamoeba dispar
YYIDEFNRFCCSHPQFIE

SEQ ID NO: 2511319 - protein, 24 aa, Entamoeba dispar
YYIHKGVWFLMNFVREEFSNAQSE

SEQ ID NO: 2511320 - protein, 18 aa, Entamoeba dispar
YYIPAAINLMKIGGFIDA

SEQ ID NO: 2511321 - protein, 22 aa, Entamoeba dispar
YYIQNYWEAIGGWKMMSGDKKK

SEQ ID NO: 2511322 - protein, 18 aa, Entamoeba dispar
YYIYDICYYCDLKSIHLL

SEQ ID NO: 2511323 - protein, 27 aa, Entamoeba dispar
YYKEKHIIPFEVIRFKIYEIIVEKDNN

SEQ ID NO: 2511324 - protein, 17 aa, Entamoeba dispar
YYKEYLKGFSYLLKENV

SEQ ID NO: 2511325 - protein, 17 aa, Entamoeba dispar
YYKHRVRALTLIIFTDV

SEQ ID NO: 2511326 - protein, 22 aa, Entamoeba dispar
YYKIIFTLVANEIFIFKNRIDS

SEQ ID NO: 2511327 - protein, 18 aa, Entamoeba dispar
YYKIIKKPMCIENIKTKL

SEQ ID NO: 2511328 - protein, 22 aa, Entamoeba dispar
YYKISIELNNSIPLNHPSNLQP

SEQ ID NO: 2511329 - protein, 28 aa, Entamoeba dispar
YYLEASYPFWILRLVWKKQNKSFNVIRK

SEQ ID NO: 2511330 - protein, 24 aa, Entamoeba dispar
YYLETCCVYAEYILMLHEQPQEAT

SEQ ID NO: 2511331 - protein, 18 aa, Entamoeba dispar
YYLITKGWSFLFSKEKRI

SEQ ID NO: 2511332 - protein, 18 aa, Entamoeba dispar
YYLKRTLRGFARKVLTPH

SEQ ID NO: 2511333 - protein, 18 aa, Entamoeba dispar
YYLNCYVPSISKNPLFTS

SEQ ID NO: 2511334 - protein, 27 aa, Entamoeba dispar
YYLQEGCLKQFIKYLIVREIEECFRTP

SEQ ID NO: 2511335 - protein, 17 aa, Entamoeba dispar
YYLRLSLNKETPKIEVH

SEQ ID NO: 2511336 - protein, 17 aa, Entamoeba dispar
YYLRSEEDIKIFITQFV

SEQ ID NO: 2511337 - protein, 28 aa, Entamoeba dispar
YYLRSEEDIKIFITQFVKRCVNENKFCK

SEQ ID NO: 2511338 - protein, 19 aa, Entamoeba dispar
YYLSPEICEGIPYDYKSDM

SEQ ID NO: 2511339 - protein, 24 aa, Entamoeba dispar
YYNASFLSFFKRPMKIQSISVVIP

SEQ ID NO: 2511340 - protein, 18 aa, Entamoeba dispar
YYNGFQWYFQKRIVHCKT

SEQ ID NO: 2511341 - protein, 18 aa, Entamoeba dispar
YYPIFQLAGFTGFDGAFA

SEQ ID NO: 2511342 - protein, 17 aa, Entamoeba dispar
YYPKRFKVECLIAVQWS

SEQ ID NO: 2511343 - protein, 20 aa, Entamoeba dispar
YYPTIPFDYCDIGEIREDSS

SEQ ID NO: 2511344 - protein, 25 aa, Entamoeba dispar
YYQFLKTVYRWLVILINEANKGVKK

SEQ ID NO: 2511345 - protein, 21 aa, Entamoeba dispar
YYQGVDCILFIVSMEDIGSLC

SEQ ID NO: 2511346 - protein, 24 aa, Entamoeba dispar
YYQLCGVVLYVFFDERLKSHITDV

SEQ ID NO: 2511347 - protein, 18 aa, Entamoeba dispar
YYRSELKLNQLTFPRLKT

SEQ ID NO: 2511348 - protein, 18 aa, Entamoeba dispar
YYRVRLMNLLPFDKILGG

SEQ ID NO: 2511349 - protein, 25 aa, Entamoeba dispar
YYSCNEFLAKLVVDLFGPKGAVDFM

SEQ ID NO: 2511350 - protein, 18 aa, Entamoeba dispar
YYSDKSVILALIRDSTVF

SEQ ID NO: 2511351 - protein, 19 aa, Entamoeba dispar
YYSIISVLRLCVFNNIYLP

SEQ ID NO: 2511352 - protein, 20 aa, Entamoeba dispar
YYSKAIIYMHEYFKQFFTEY

SEQ ID NO: 2511353 - protein, 27 aa, Entamoeba dispar
YYSLRPIFKRLYLNYTQMKDFHKEQGD

SEQ ID NO: 2511354 - protein, 19 aa, Entamoeba dispar
YYSYCRCGSEWFVFNDDTV

SEQ ID NO: 2511355 - protein, 18 aa, Entamoeba dispar
YYSYNFFKINCFTKDMLF

SEQ ID NO: 2511356 - protein, 17 aa, Entamoeba dispar
YYTGVIFEAVMVVGNTS

SEQ ID NO: 2511357 - protein, 17 aa, Entamoeba dispar
YYTSCFNEMERWIKMFD

SEQ ID NO: 2511358 - protein, 23 aa, Entamoeba dispar
YYVDLLCESMADKSVSFNQMNLL

SEQ ID NO: 2511359 - protein, 22 aa, Entamoeba dispar
YYVQAHCAIIMFDVTSRDTYKN

SEQ ID NO: 2511360 - protein, 22 aa, Entamoeba dispar
YYYEGCQSWDWYYPYYYAPFAK

SEQ ID NO: 2511361 - protein, 17 aa, Entamoeba dispar
YYYEKDMFFILKATTNI

SEQ ID NO: 2511362 - protein, 24 aa, Entamoeba dispar
YYYHFLSWPYLMYVAETINKKIVG

SEQ ID NO: 2511363 - protein, 18 aa, Entamoeba dispar
YYYIKGKNLILFNEKKGE

SEQ ID NO: 2511364 - protein, 23 aa, Entamoeba dispar
YYYIKGKNLILFNEKKGESIVTD

SEQ ID NO: 2511365 - protein, 18 aa, Entamoeba dispar
YYYNLNLIGGILPNDYYK

SEQ ID NO: 2511366 - protein, 23 aa, Entamoeba dispar
YYYPMNYKGFLVASYYPFNSLTS

SEQ ID NO: 2511367 - protein, 19 aa, Entamoeba dispar
YYYYEFGKRIKNGEEVDII

SEQ ID NO: 2511368 - protein, 17 aa, Entamoeba dispar
PTGSFMFLGPSGVGKTE

SEQ ID NO: 2511369 - protein, 17 aa, Entamoeba dispar
FKLFTIERIKTVDQEYQ

SEQ ID NO: 2511370 - protein, 18 aa, Entamoeba dispar
KPYSVILFDEIEKAHPQV

SEQ ID NO: 2511371 - protein, 23 aa, Entamoeba dispar
SIDCSAIMKYCCNSNSSDEYVYT

SEQ ID NO: 2511372 - protein, 20 aa, Entamoeba dispar
FCKCFKRVKIDKALAVLSIS

SEQ ID NO: 2511373 - protein, 18 aa, Entamoeba dispar
SIGKGFIREGWGCLLMNS

SEQ ID NO: 2511374 - protein, 18 aa, Entamoeba dispar
YYPGARWGITRRLIASSL

SEQ ID NO: 2511375 - protein, 17 aa, Entamoeba dispar
HGMKECLPLILILRNRL

SEQ ID NO: 2511376 - protein, 18 aa, Entamoeba dispar
HMYREFGGRINGFKHNEK

SEQ ID NO: 2511377 - protein, 17 aa, Entamoeba dispar
IEYSRYSTIFTMYRSLG

SEQ ID NO: 2511378 - protein, 25 aa, Entamoeba dispar
IHCNSFRLTPMWTYLTQIQIKEQFE

SEQ ID NO: 2511379 - protein, 23 aa, Entamoeba dispar
IRKELRGTCEFVMGKNTLIRKAI

SEQ ID NO: 2511380 - protein, 18 aa, Entamoeba dispar
IVKGKARLGQLIHRPTAA

SEQ ID NO: 2511381 - protein, 23 aa, Entamoeba dispar
KEKRIAGKLDHFFPIQKIWNQNG

SEQ ID NO: 2511382 - protein, 17 aa, Entamoeba dispar
KSKCPINKLIIVESYEV

SEQ ID NO: 2511383 - protein, 24 aa, Entamoeba dispar
LLPHIKGNVGFIFTKGDLYQLKAK

SEQ ID NO: 2511384 - protein, 25 aa, Entamoeba dispar
LPYLCKKLQVPYCIVKGKARLGQLI

SEQ ID NO: 2511385 - protein, 17 aa, Entamoeba dispar
PYSVILFDEIEKAHPQV

SEQ ID NO: 2511386 - protein, 18 aa, Entamoeba dispar
SPLEIVEAYNFVRCQSSW

SEQ ID NO: 2511387 - protein, 20 aa, Entamoeba dispar
TSFRLLFKMIKIVEYIHSKQ

SEQ ID NO: 2511388 - protein, 17 aa, Entamoeba dispar
VDALKMYLNEVMYNIGV

SEQ ID NO: 2511389 - protein, 21 aa, Entamoeba dispar
YGPTRVEGFWTYDENNISWNP

SEQ ID NO: 2511390 - protein, 18 aa, Entamoeba dispar
AHRGLRHYWGLRVRGQHT

SEQ ID NO: 2511391 - protein, 20 aa, Entamoeba dispar
CKITEGVLLRMVLSDLIKQS

SEQ ID NO: 2511392 - protein, 20 aa, Entamoeba dispar
CPIMLVCQDCFWRCTLQGGC

SEQ ID NO: 2511393 - protein, 18 aa, Entamoeba dispar
EGKRVICISSDIKTTTEK

SEQ ID NO: 2511394 - protein, 24 aa, Entamoeba dispar
EHKKKWRMCHSFKDYKKKEMKKAS

SEQ ID NO: 2511395 - protein, 20 aa, Entamoeba dispar
EITFPCIYGMAARRTIPNGF

SEQ ID NO: 2511396 - protein, 19 aa, Entamoeba dispar
EMMGGFGMMRGFIPNNMPM

SEQ ID NO: 2511397 - protein, 22 aa, Entamoeba dispar
FTTNRVEGFFGHLKKIIKHSQV

SEQ ID NO: 2511398 - protein, 17 aa, Entamoeba dispar
GKFSIEIIKEIKVKSPI

SEQ ID NO: 2511399 - protein, 20 aa, Entamoeba dispar
GKGSFKYAWVLDNLKAERER

SEQ ID NO: 2511400 - protein, 19 aa, Entamoeba dispar
GNHVIQIFIERSEEIKEVI

SEQ ID NO: 2511401 - protein, 17 aa, Entamoeba dispar
GRIGRLVARVVLERKDF

SEQ ID NO: 2511402 - protein, 19 aa, Entamoeba dispar
HPSRIIFVSGICRNEYENI

SEQ ID NO: 2511403 - protein, 18 aa, Entamoeba dispar
IIWPEFKSLISTRGEQIT

SEQ ID NO: 2511404 - protein, 19 aa, Entamoeba dispar
IKPPNSMGYLTLKFSNSGK

SEQ ID NO: 2511405 - protein, 20 aa, Entamoeba dispar
KEAKRYAAILNRYKVLKAHG

SEQ ID NO: 2511406 - protein, 24 aa, Entamoeba dispar
KPELQNGRFIPCILYGAKAQLPGM

SEQ ID NO: 2511407 - protein, 18 aa, Entamoeba dispar
LAWKGLRVTVKITVVNRV

SEQ ID NO: 2511408 - protein, 21 aa, Entamoeba dispar
LKAICCSHGPVLRTNIKENIE

SEQ ID NO: 2511409 - protein, 19 aa, Entamoeba dispar
LKTTIIVNMHIWKSLNASF

SEQ ID NO: 2511410 - protein, 22 aa, Entamoeba dispar
LLNPHFVKLVSWYDNEWGYSNR

SEQ ID NO: 2511411 - protein, 24 aa, Entamoeba dispar
LPFDRLPAFTARDVFRFLGVSRNQ

SEQ ID NO: 2511412 - protein, 20 aa, Entamoeba dispar
LRKVACVGAWHPARVSWTVA

SEQ ID NO: 2511413 - protein, 19 aa, Entamoeba dispar
LYYGSRWGVIRQLDAASMM

SEQ ID NO: 2511414 - protein, 17 aa, Entamoeba dispar
NQQIKKRVCFIVDEAVV

SEQ ID NO: 2511415 - protein, 23 aa, Entamoeba dispar
PTVIRDELHFVPARVLKKDGERY

SEQ ID NO: 2511416 - protein, 17 aa, Entamoeba dispar
QNYRFILFDDINYDKNL

SEQ ID NO: 2511417 - protein, 18 aa, Entamoeba dispar
QTPECLRVYVSSFWDQPF

SEQ ID NO: 2511418 - protein, 19 aa, Entamoeba dispar
SIDCSAIMKYCCNSNSSDE

SEQ ID NO: 2511419 - protein, 17 aa, Entamoeba dispar
SVISICIEYSRYSTIFT

SEQ ID NO: 2511420 - protein, 18 aa, Entamoeba dispar
SYLLKVMGYITVRFKQLR

SEQ ID NO: 2511421 - protein, 18 aa, Entamoeba dispar
TLHLPRKSAFLLGKYEDI

SEQ ID NO: 2511422 - protein, 18 aa, Entamoeba dispar
TNFNSFCKCFKRVKIDKA

SEQ ID NO: 2511423 - protein, 19 aa, Entamoeba dispar
TRKLFKRPFRGHGISNTST

SEQ ID NO: 2511424 - protein, 21 aa, Entamoeba dispar
TVKRKRISTFNGIRQEEIYEI

SEQ ID NO: 2511425 - protein, 17 aa, Entamoeba dispar
VETYSFLRWSISDGTTN

SEQ ID NO: 2511426 - protein, 21 aa, Entamoeba dispar
VFLKQCIKSGALIVTGPFKIN

SEQ ID NO: 2511427 - protein, 20 aa, Entamoeba dispar
YNCCGFCLKTLCSKEPKNKY

SEQ ID NO: 2511428 - protein, 24 aa, Entamoeba dispar
ADPRLPKPLFAWNLPKGYETVLKK

SEQ ID NO: 2511429 - protein, 17 aa, Entamoeba dispar
AEFKMRVTFRVQHQPVL

SEQ ID NO: 2511430 - protein, 23 aa, Entamoeba dispar
AEGVPICEWPMWINSQIEHTETR

SEQ ID NO: 2511431 - protein, 19 aa, Entamoeba dispar
AFWEFCYSNRYCPIGDELK

SEQ ID NO: 2511432 - protein, 19 aa, Entamoeba dispar
AGKIPFIIRRRLPNGSFED

SEQ ID NO: 2511433 - protein, 25 aa, Entamoeba dispar
AKIYSCKSCGFIMFAIPKKGLEKKF

SEQ ID NO: 2511434 - protein, 24 aa, Entamoeba dispar
AKVIPNCIGNIWVYVRDWPEEKGR

SEQ ID NO: 2511435 - protein, 20 aa, Entamoeba dispar
APQPPVIICREMLDTFIERT

SEQ ID NO: 2511436 - protein, 18 aa, Entamoeba dispar
AQIMFKWFNTIYKVGGDG

SEQ ID NO: 2511437 - protein, 19 aa, Entamoeba dispar
AQYLPDFVRMFFNRFFTLL

SEQ ID NO: 2511438 - protein, 18 aa, Entamoeba dispar
ARSLKWLCQCIYYNELII

SEQ ID NO: 2511439 - protein, 21 aa, Entamoeba dispar
ASLECITCFSIDEEIRIDMYN

SEQ ID NO: 2511440 - protein, 21 aa, Entamoeba dispar
AVGKTCLLLAFSKGEIPTAYV

SEQ ID NO: 2511441 - protein, 26 aa, Entamoeba dispar
AVLNLMKFNGGYSWWRRNSMTIFLDQ

SEQ ID NO: 2511442 - protein, 22 aa, Entamoeba dispar
CDAQCVKYGLAMIEGGTTGTKG

SEQ ID NO: 2511443 - protein, 20 aa, Entamoeba dispar
CGKYLFTLGMISSWNNGEIE

SEQ ID NO: 2511444 - protein, 21 aa, Entamoeba dispar
CKRCKKFLAGTTWFYCEPESR

SEQ ID NO: 2511445 - protein, 25 aa, Entamoeba dispar
CKRTPGGGFGICWSNLLLGTFTVCE

SEQ ID NO: 2511446 - protein, 17 aa, Entamoeba dispar
CRKYLKNQLEVFIDDGE

SEQ ID NO: 2511447 - protein, 17 aa, Entamoeba dispar
CSCLSSLFSCFESTQDL

SEQ ID NO: 2511448 - protein, 17 aa, Entamoeba dispar
CVIQWKIPTAGFTEKLS

SEQ ID NO: 2511449 - protein, 18 aa, Entamoeba dispar
CWELCKIRCQLAMEDQFY

SEQ ID NO: 2511450 - protein, 24 aa, Entamoeba dispar
DALHLGHLIPFIFTKYLQDAFDCQ

SEQ ID NO: 2511451 - protein, 17 aa, Entamoeba dispar
DECLRKLFECLPGESMK

SEQ ID NO: 2511452 - protein, 23 aa, Entamoeba dispar
DESYRFYQLLLFNFSQFIADEDF

SEQ ID NO: 2511453 - protein, 23 aa, Entamoeba dispar
DHLLRYKFLLAFEREMLHLEDQY

SEQ ID NO: 2511454 - protein, 17 aa, Entamoeba dispar
DKLNCYYLNVSHIQNLR

SEQ ID NO: 2511455 - protein, 18 aa, Entamoeba dispar
DTINCWDISTGVPSKRIT

SEQ ID NO: 2511456 - protein, 23 aa, Entamoeba dispar
EAKTGNGKLEFCEKGNETFKIIV

SEQ ID NO: 2511457 - protein, 18 aa, Entamoeba dispar
EEGYLCYFKIELNYIHKL

SEQ ID NO: 2511458 - protein, 18 aa, Entamoeba dispar
EEVIKYAKFISGTVAQQP

SEQ ID NO: 2511459 - protein, 18 aa, Entamoeba dispar
EGKRLCVISTDIAETSIT

SEQ ID NO: 2511460 - protein, 20 aa, Entamoeba dispar
ELKAKRYVECTSKDYETTHN

SEQ ID NO: 2511461 - protein, 22 aa, Entamoeba dispar
ENMKIRLGCSIGDITSTYSLFS

SEQ ID NO: 2511462 - protein, 18 aa, Entamoeba dispar
EQEEKRLLNAQTKVEDMK

SEQ ID NO: 2511463 - protein, 18 aa, Entamoeba dispar
ERFFRLNPKLPYQIDLDY

SEQ ID NO: 2511464 - protein, 19 aa, Entamoeba dispar
ERRRMSLKHLISYEDLPSF

SEQ ID NO: 2511465 - protein, 23 aa, Entamoeba dispar
EVPHWSSDMIYQFKENINKTHCK

SEQ ID NO: 2511466 - protein, 19 aa, Entamoeba dispar
EVQSRFAVQMDELPSSLKD

SEQ ID NO: 2511467 - protein, 17 aa, Entamoeba dispar
EYEAVLNLMKFNGGYSW

SEQ ID NO: 2511468 - protein, 18 aa, Entamoeba dispar
FAERADMIVLVFDAHKLD

SEQ ID NO: 2511469 - protein, 17 aa, Entamoeba dispar
FCMNGGLIIGTWDGANV

SEQ ID NO: 2511470 - protein, 20 aa, Entamoeba dispar
FFECGYELYGYCLVFELHII

SEQ ID NO: 2511471 - protein, 19 aa, Entamoeba dispar
FHSGYDFGYMLKLLTCEKL

SEQ ID NO: 2511472 - protein, 22 aa, Entamoeba dispar
FIKKSFDGDGLFYLADSNEELN

SEQ ID NO: 2511473 - protein, 20 aa, Entamoeba dispar
FKFDISKGILSRVERNPHLK

SEQ ID NO: 2511474 - protein, 17 aa, Entamoeba dispar
FKLACNHYILPYIKIKE

SEQ ID NO: 2511475 - protein, 19 aa, Entamoeba dispar
FKTQIATIIIFKGYSKENF

SEQ ID NO: 2511476 - protein, 17 aa, Entamoeba dispar
FMRKWLKSLYEINVEND

SEQ ID NO: 2511477 - protein, 22 aa, Entamoeba dispar
FNELFFTYTICQNVNDPFLMMY

SEQ ID NO: 2511478 - protein, 18 aa, Entamoeba dispar
FPHSKLFFCRIHIERSLT

SEQ ID NO: 2511479 - protein, 24 aa, Entamoeba dispar
FPITDFWRHVCIVWTKCYCYIPKE

SEQ ID NO: 2511480 - protein, 27 aa, Entamoeba dispar
FSEKIFYIKALRMFTIFQVKSLLEPIS

SEQ ID NO: 2511481 - protein, 23 aa, Entamoeba dispar
GDLPRLLKHLSIVRKTNENEISC

SEQ ID NO: 2511482 - protein, 17 aa, Entamoeba dispar
GFQSGRILACISSRPGQ

SEQ ID NO: 2511483 - protein, 20 aa, Entamoeba dispar
GIAICTYCLPVIKKEKIINL

SEQ ID NO: 2511484 - protein, 21 aa, Entamoeba dispar
GIELNQLWETLPFYLDEDKPL

SEQ ID NO: 2511485 - protein, 20 aa, Entamoeba dispar
GIVFWEIFRRVVFGSYTKPW

SEQ ID NO: 2511486 - protein, 18 aa, Entamoeba dispar
GKFMSCCMMYRGDVSSRE

SEQ ID NO: 2511487 - protein, 21 aa, Entamoeba dispar
GKQQWRDVCIKIQNYYHNLIN

SEQ ID NO: 2511488 - protein, 21 aa, Entamoeba dispar
GKYTPYCQYMFYDCLEILPDK

SEQ ID NO: 2511489 - protein, 24 aa, Entamoeba dispar
GNKIDCWSCGVVIYSLLYGTFPFA

SEQ ID NO: 2511490 - protein, 17 aa, Entamoeba dispar
GNVKLTLGLVWTLILRF

SEQ ID NO: 2511491 - protein, 21 aa, Entamoeba dispar
GSLLLKFNIYGGWTFIYQILY

SEQ ID NO: 2511492 - protein, 18 aa, Entamoeba dispar
GWEKLRWDDILHIKTIVE

SEQ ID NO: 2511493 - protein, 18 aa, Entamoeba dispar
GYQSYPWVRYMTFAGDYC

SEQ ID NO: 2511494 - protein, 24 aa, Entamoeba dispar
GYYYKGCQSWDWYYPYLYAPFAED

SEQ ID NO: 2511495 - protein, 20 aa, Entamoeba dispar
HKEPHMWLRRGLFFCHRDIN

SEQ ID NO: 2511496 - protein, 19 aa, Entamoeba dispar
HPREALKVFCEIDKTLTEK

SEQ ID NO: 2511497 - protein, 17 aa, Entamoeba dispar
HRGLRKVACVGAWHPAR

SEQ ID NO: 2511498 - protein, 23 aa, Entamoeba dispar
HSKRLKIKLTIEKEVFKNTVIQQ

SEQ ID NO: 2511499 - protein, 25 aa, Entamoeba dispar
HTIQWARDRFEGFFKTEIEPIKNYK

SEQ ID NO: 2511500 - protein, 23 aa, Entamoeba dispar
IEKEIYSIISIIWERGINDCLNK

SEQ ID NO: 2511501 - protein, 17 aa, Entamoeba dispar
IELKGFYYTLAMQQFGT

SEQ ID NO: 2511502 - protein, 21 aa, Entamoeba dispar
IEMGKSCFYGCGCEEELRQME

SEQ ID NO: 2511503 - protein, 18 aa, Entamoeba dispar
IICFDYLQSQGWSMLMEA

SEQ ID NO: 2511504 - protein, 19 aa, Entamoeba dispar
IIKIICFICSFITEKEEIQ

SEQ ID NO: 2511505 - protein, 17 aa, Entamoeba dispar
IIWPEFKSLISTRGEQI

SEQ ID NO: 2511506 - protein, 22 aa, Entamoeba dispar
IKKMIPCIVNIFIVGDNLQKEF

SEQ ID NO: 2511507 - protein, 23 aa, Entamoeba dispar
IKRFWPGALTIIFPRNETVPNEV

SEQ ID NO: 2511508 - protein, 17 aa, Entamoeba dispar
IKTKGSFVLPGISQEYE

SEQ ID NO: 2511509 - protein, 17 aa, Entamoeba dispar
IKTVVLIDVSMNRIQEI

SEQ ID NO: 2511510 - protein, 17 aa, Entamoeba dispar
IKYIYTIIKGIRSLNGI

SEQ ID NO: 2511511 - protein, 17 aa, Entamoeba dispar
ILPTGAIVYEKCPNCGN

SEQ ID NO: 2511512 - protein, 18 aa, Entamoeba dispar
IMAFISMTLLSPVAVSQL

SEQ ID NO: 2511513 - protein, 18 aa, Entamoeba dispar
IPHEGAFCDLMWSDPDDS

SEQ ID NO: 2511514 - protein, 19 aa, Entamoeba dispar
IPPNKRWGALLPVGLIPPE

SEQ ID NO: 2511515 - protein, 25 aa, Entamoeba dispar
ITLSSSWPFLIMWKGSDNEAYIQLQ

SEQ ID NO: 2511516 - protein, 18 aa, Entamoeba dispar
IVEAYNFVRCQSSWKDTQ

SEQ ID NO: 2511517 - protein, 18 aa, Entamoeba dispar
IVEAYNFVRCQSSWKDTR

SEQ ID NO: 2511518 - protein, 23 aa, Entamoeba dispar
IVVKRLISAIGYLHSMNIVHRDL

SEQ ID NO: 2511519 - protein, 22 aa, Entamoeba dispar
KAEMLCCVCGALIEVNPSSMCA

SEQ ID NO: 2511520 - protein, 22 aa, Entamoeba dispar
KAKIGVCQFCISPPKTNMDGNV

SEQ ID NO: 2511521 - protein, 26 aa, Entamoeba dispar
KAKVIPDCVSSIWVCCVDKRYENGRN

SEQ ID NO: 2511522 - protein, 27 aa, Entamoeba dispar
KAKVIPDCVSSIWVCCVDKRYENGRNG

SEQ ID NO: 2511523 - protein, 20 aa, Entamoeba dispar
KDGFKYGCDFVVYKKHPQCC

SEQ ID NO: 2511524 - protein, 19 aa, Entamoeba dispar
KEACCIGFKWAMSSGPLCE

SEQ ID NO: 2511525 - protein, 20 aa, Entamoeba dispar
KEFYPKGAAIVMPKDNNTYT

SEQ ID NO: 2511526 - protein, 24 aa, Entamoeba dispar
KEKRIAGKLDHFFPIQKIWNQSGV

SEQ ID NO: 2511527 - protein, 19 aa, Entamoeba dispar
KESWDVWGLGVIIIEMMNG

SEQ ID NO: 2511528 - protein, 19 aa, Entamoeba dispar
KFIKRRGKEYFEIHKNKRA

SEQ ID NO: 2511529 - protein, 17 aa, Entamoeba dispar
KIFKGCSSLRLINLGKI

SEQ ID NO: 2511530 - protein, 17 aa, Entamoeba dispar
KIGYRCFSCCGSLTTIN

SEQ ID NO: 2511531 - protein, 18 aa, Entamoeba dispar
KKAKELFEIGAYQGTIDW

SEQ ID NO: 2511532 - protein, 18 aa, Entamoeba dispar
KKGLVKFKVTFNVDINGM

SEQ ID NO: 2511533 - protein, 19 aa, Entamoeba dispar
KKLTEKWVHLACTDKKIVE

SEQ ID NO: 2511534 - protein, 21 aa, Entamoeba dispar
KLKSVEVINCRECQINIKSDC

SEQ ID NO: 2511535 - protein, 18 aa, Entamoeba dispar
KNFESYALYISRVLKSVF

SEQ ID NO: 2511536 - protein, 21 aa, Entamoeba dispar
KPQEWNHKCVMCVSKMGKFSS

SEQ ID NO: 2511537 - protein, 23 aa, Entamoeba dispar
KRERKVCLIRMDYDIVSKGIEQR

SEQ ID NO: 2511538 - protein, 20 aa, Entamoeba dispar
KSIHADSSFSYRERIAQVNN

SEQ ID NO: 2511539 - protein, 19 aa, Entamoeba dispar
KSSFKVCIDFGRMIESHRR

SEQ ID NO: 2511540 - protein, 18 aa, Entamoeba dispar
KTTIIVNMHIWKSLNPSF

SEQ ID NO: 2511541 - protein, 18 aa, Entamoeba dispar
LDEPAAFAGRIYRMVKLG

SEQ ID NO: 2511542 - protein, 21 aa, Entamoeba dispar
LDTLKPQGWVCAMQISSVLQT

SEQ ID NO: 2511543 - protein, 20 aa, Entamoeba dispar
LEFIQWLYSLGISIISLHGR

SEQ ID NO: 2511544 - protein, 18 aa, Entamoeba dispar
LEFRSCLSSMGLIDIDFT

SEQ ID NO: 2511545 - protein, 19 aa, Entamoeba dispar
LFEELRKSLVRCIEDQNGN

SEQ ID NO: 2511546 - protein, 19 aa, Entamoeba dispar
LHLEWKRLACEVVNIPTGS

SEQ ID NO: 2511547 - protein, 20 aa, Entamoeba dispar
LIFLQCVSNLLGIPREVPVI

SEQ ID NO: 2511548 - protein, 25 aa, Entamoeba dispar
LISLKKLWIILGWYYFYENIKESEL

SEQ ID NO: 2511549 - protein, 19 aa, Entamoeba dispar
LKEFLIGCIQLKQKVNATK

SEQ ID NO: 2511550 - protein, 20 aa, Entamoeba dispar
LKKACFSWCETLRTITIPPS

SEQ ID NO: 2511551 - protein, 21 aa, Entamoeba dispar
LKTTIIVNLHIWKALNPSFKT

SEQ ID NO: 2511552 - protein, 18 aa, Entamoeba dispar
LNNCPLYQLLPLQTFCDL

SEQ ID NO: 2511553 - protein, 20 aa, Entamoeba dispar
LPSLLLLPIKFLPQFYSLIK

SEQ ID NO: 2511554 - protein, 20 aa, Entamoeba dispar
LRRFLPFESDCIGLLSETIY

SEQ ID NO: 2511555 - protein, 17 aa, Entamoeba dispar
LRRGLFFCHRDINPILD

SEQ ID NO: 2511556 - protein, 17 aa, Entamoeba dispar
LSKEEFLEYPIFDEYQF

SEQ ID NO: 2511557 - protein, 18 aa, Entamoeba dispar
LWETLPFYLDEDKPLHGT

SEQ ID NO: 2511558 - protein, 17 aa, Entamoeba dispar
MCANCLHKTIDITEGIP

SEQ ID NO: 2511559 - protein, 21 aa, Entamoeba dispar
MDNRPASALPFKISAAKLDAL

SEQ ID NO: 2511560 - protein, 20 aa, Entamoeba dispar
MKCSGCTKLVMMLRQLGYAA

SEQ ID NO: 2511561 - protein, 21 aa, Entamoeba dispar
MKCSGCTKLVMMLRQLGYAAI

SEQ ID NO: 2511562 - protein, 23 aa, Entamoeba dispar
MKLEYCVSCGIHGRVVRVRSRTD

SEQ ID NO: 2511563 - protein, 20 aa, Entamoeba dispar
MKYNGGYNWWKRNSLTVFID

SEQ ID NO: 2511564 - protein, 20 aa, Entamoeba dispar
MNFRVCFIKSISLQVSTDNG

SEQ ID NO: 2511565 - protein, 21 aa, Entamoeba dispar
MTSTFCGTAAYLAPEILLGEK

SEQ ID NO: 2511566 - protein, 17 aa, Entamoeba dispar
MVHCKPVIASKRFNLPI

SEQ ID NO: 2511567 - protein, 18 aa, Entamoeba dispar
NATKEVVNQIALKSSYTN

SEQ ID NO: 2511568 - protein, 20 aa, Entamoeba dispar
NEMMGGFGMMRGFIPNNMPM

SEQ ID NO: 2511569 - protein, 21 aa, Entamoeba dispar
NETRVAWKIAIERNNGPTLLI

SEQ ID NO: 2511570 - protein, 24 aa, Entamoeba dispar
NGCRGFGLNVSRTFLSQILESLNI

SEQ ID NO: 2511571 - protein, 26 aa, Entamoeba dispar
NLKSLLFPFEWCNICIDSLPYSLIDY

SEQ ID NO: 2511572 - protein, 23 aa, Entamoeba dispar
NNQLNFPLCFTIFGATHYSFKNK

SEQ ID NO: 2511573 - protein, 21 aa, Entamoeba dispar
NRKARIGVFAQHFVDQLNFKV

SEQ ID NO: 2511574 - protein, 26 aa, Entamoeba dispar
NTYTFPLSTLMSWGTDSSKTFKNTST

SEQ ID NO: 2511575 - protein, 18 aa, Entamoeba dispar
NVRLRYYLRVSVNKKYSS

SEQ ID NO: 2511576 - protein, 19 aa, Entamoeba dispar
NYPINFGYIYPINENVALD

SEQ ID NO: 2511577 - protein, 22 aa, Entamoeba dispar
PELQNGRFIPCVLYGAKAQLPG

SEQ ID NO: 2511578 - protein, 18 aa, Entamoeba dispar
PFLIMWKGSDNEAYIQLQ

SEQ ID NO: 2511579 - protein, 21 aa, Entamoeba dispar
PIKHPELFESLGIAQPKGVLL

SEQ ID NO: 2511580 - protein, 17 aa, Entamoeba dispar
PPSKGIICDLLWSDPIT

SEQ ID NO: 2511581 - protein, 25 aa, Entamoeba dispar
PSFYGRRVGTCFVKIVLQLSLPLTI

SEQ ID NO: 2511582 - protein, 20 aa, Entamoeba dispar
PSRCTVCYLRCIFGCIENYC

SEQ ID NO: 2511583 - protein, 20 aa, Entamoeba dispar
PSSITKLGYRCFSKCSTLKS

SEQ ID NO: 2511584 - protein, 23 aa, Entamoeba dispar
QCINNLHCALTFMERDMLVKNPG

SEQ ID NO: 2511585 - protein, 18 aa, Entamoeba dispar
QCVFDHWQLLNGDVTDAT

SEQ ID NO: 2511586 - protein, 22 aa, Entamoeba dispar
QEGRIKARWMRKNARRIDMEQY

SEQ ID NO: 2511587 - protein, 25 aa, Entamoeba dispar
QKIRDALKFILQYYGINGIIIDNFT

SEQ ID NO: 2511588 - protein, 23 aa, Entamoeba dispar
QMIFKRLFRVYAHIYLHHLNQIT

SEQ ID NO: 2511589 - protein, 22 aa, Entamoeba dispar
RCYRGHQLHIVFGIPIDINEGP

SEQ ID NO: 2511590 - protein, 18 aa, Entamoeba dispar
RERYGLKIPKGFNGIGDE

SEQ ID NO: 2511591 - protein, 19 aa, Entamoeba dispar
RFKKFSIQFEDIFVDYSKN

SEQ ID NO: 2511592 - protein, 19 aa, Entamoeba dispar
RIDNVFALPYGRYNVDVTQ

SEQ ID NO: 2511593 - protein, 17 aa, Entamoeba dispar
RLQEQIIKEKQENEKHL

SEQ ID NO: 2511594 - protein, 22 aa, Entamoeba dispar
RQIDLWPNFQFFLNEQAKEKYG

SEQ ID NO: 2511595 - protein, 22 aa, Entamoeba dispar
RRFKGRLHPYVSIPNKHVVDAL

SEQ ID NO: 2511596 - protein, 20 aa, Entamoeba dispar
RRVNHPCILGCLNVYLTSHR

SEQ ID NO: 2511597 - protein, 19 aa, Entamoeba dispar
RTQLVPVLYKLEFVALVIQ

SEQ ID NO: 2511598 - protein, 22 aa, Entamoeba dispar
SEPVDWWGFGILIYEMIHGHAP

SEQ ID NO: 2511599 - protein, 19 aa, Entamoeba dispar
SGLHGWAFTLEKFAKMWSA

SEQ ID NO: 2511600 - protein, 17 aa, Entamoeba dispar
SLFSFEINDFISPSYGI

SEQ ID NO: 2511601 - protein, 27 aa, Entamoeba dispar
SNDRCPIMLVCQDCFWRCTLQGGCEYI

SEQ ID NO: 2511602 - protein, 18 aa, Entamoeba dispar
SPVISIGHWCFRECSSLT

SEQ ID NO: 2511603 - protein, 23 aa, Entamoeba dispar
SQHLNEWIDLIFGYKQRGKNAEE

SEQ ID NO: 2511604 - protein, 25 aa, Entamoeba dispar
SSILSRSIMNWDLKGMFYLINNNDY

SEQ ID NO: 2511605 - protein, 23 aa, Entamoeba dispar
STDFKTGIVLINFFEIISKKILR

SEQ ID NO: 2511606 - protein, 23 aa, Entamoeba dispar
SVKTWKKRWFVLKENRLWYFASK

SEQ ID NO: 2511607 - protein, 18 aa, Entamoeba dispar
SYILKVMGYITVRFKQLR

SEQ ID NO: 2511608 - protein, 20 aa, Entamoeba dispar
SYILKVMGYITVRFKQLRTT

SEQ ID NO: 2511609 - protein, 19 aa, Entamoeba dispar
TESPANCGVFYNNRIYVGT

SEQ ID NO: 2511610 - protein, 17 aa, Entamoeba dispar
TKGSFVLPGISQEYEIE

SEQ ID NO: 2511611 - protein, 24 aa, Entamoeba dispar
TKIGEKMIKEWIRQPLIDKDKINK

SEQ ID NO: 2511612 - protein, 17 aa, Entamoeba dispar
TKIGLPVPQGFVITTEM

SEQ ID NO: 2511613 - protein, 18 aa, Entamoeba dispar
TKRASFMNYLWRGYSVDG

SEQ ID NO: 2511614 - protein, 19 aa, Entamoeba dispar
TLMFLRYLFVPFLKHPYIL

SEQ ID NO: 2511615 - protein, 21 aa, Entamoeba dispar
TLSSSWPFLIMWKGSDNEAYI

SEQ ID NO: 2511616 - protein, 23 aa, Entamoeba dispar
TPEKIKGGLVFFHLFRSFMKHTR

SEQ ID NO: 2511617 - protein, 17 aa, Entamoeba dispar
TQLSCVMIAFGTAMTMG

SEQ ID NO: 2511618 - protein, 17 aa, Entamoeba dispar
VCSEFYKSLPLAAVVAN

SEQ ID NO: 2511619 - protein, 18 aa, Entamoeba dispar
VEAFNHFLWCQSSESVSD

SEQ ID NO: 2511620 - protein, 23 aa, Entamoeba dispar
VEDKLRVGLLYALKYEDKAQDII

SEQ ID NO: 2511621 - protein, 17 aa, Entamoeba dispar
VEFKSKFIPIIYHEENG

SEQ ID NO: 2511622 - protein, 18 aa, Entamoeba dispar
VESLRPALFEGWGKKQGG

SEQ ID NO: 2511623 - protein, 24 aa, Entamoeba dispar
VFCVTEYGNVFGIFFHSVKILRNQ

SEQ ID NO: 2511624 - protein, 17 aa, Entamoeba dispar
VFNLCWWIYTYGYLVEG

SEQ ID NO: 2511625 - protein, 17 aa, Entamoeba dispar
VFRRRWGSYGSIKNNWY

SEQ ID NO: 2511626 - protein, 17 aa, Entamoeba dispar
VKLTLGLVWTLILRFAI

SEQ ID NO: 2511627 - protein, 20 aa, Entamoeba dispar
VKTLLNTRMHLWLEYYTINQ

SEQ ID NO: 2511628 - protein, 22 aa, Entamoeba dispar
VLKQKALCLFYERYPEAVSEVM

SEQ ID NO: 2511629 - protein, 20 aa, Entamoeba dispar
VNCLKLRLLDGGNLLTKMVE

SEQ ID NO: 2511630 - protein, 17 aa, Entamoeba dispar
VNLHIWKALNPSFKTQI

SEQ ID NO: 2511631 - protein, 19 aa, Entamoeba dispar
VPFVGWCPCSFKCGINSQP

SEQ ID NO: 2511632 - protein, 17 aa, Entamoeba dispar
VSVKGYFAAGLVEKAMY

SEQ ID NO: 2511633 - protein, 20 aa, Entamoeba dispar
VVLARPGFRVSRRKRMQDKI

SEQ ID NO: 2511634 - protein, 18 aa, Entamoeba dispar
VYIPLDFTTIFNCPSAFS

SEQ ID NO: 2511635 - protein, 17 aa, Entamoeba dispar
VYSEPFAVYGINLPNQS

SEQ ID NO: 2511636 - protein, 18 aa, Entamoeba dispar
WNSWNGWIPAWCVNKATK

SEQ ID NO: 2511637 - protein, 17 aa, Entamoeba dispar
YAPYAVGVTSDFPLHTF

SEQ ID NO: 2511638 - protein, 23 aa, Entamoeba dispar
YEPEVFPGLVYRMASPKVTLLVF

SEQ ID NO: 2511639 - protein, 20 aa, Entamoeba dispar
YIMRNCNMLRFLDSNNTAMF

SEQ ID NO: 2511640 - protein, 19 aa, Entamoeba dispar
YKAIMWILYLCEDMIEALQ

SEQ ID NO: 2511641 - protein, 19 aa, Entamoeba dispar
YNLLFLIAHGLMFGPNQTV

SEQ ID NO: 2511642 - protein, 17 aa, Entamoeba dispar
YYALSCGKYVQYYGPLP

SEQ ID NO: 2511643 - protein, 24 aa, Entamoeba dispar
YYNGLPLRFGYSIEDFCERKYQME

SEQ ID NO: 2511644 - protein, 21 aa, Entamoeba dispar
AAAFCSGCDFIRAEGYVFGHV

SEQ ID NO: 2511645 - protein, 22 aa, Entamoeba dispar
AAFDYKCCLCVGLHSDKTITTQ

SEQ ID NO: 2511646 - protein, 17 aa, Entamoeba dispar
AAISIAVVHHFSTFERR

SEQ ID NO: 2511647 - protein, 24 aa, Entamoeba dispar
AALFKCSLGSFLLCHGGISPKLNM

SEQ ID NO: 2511648 - protein, 20 aa, Entamoeba dispar
ACALCSIQAYEFMETTLIDI

SEQ ID NO: 2511649 - protein, 23 aa, Entamoeba dispar
ACFCKKELFLLCGTILSSSDNTR

SEQ ID NO: 2511650 - protein, 23 aa, Entamoeba dispar
ACGGHSLFNWSFFPPSTFISNVS

SEQ ID NO: 2511651 - protein, 19 aa, Entamoeba dispar
ACGVWGELCSVYCNEIKQV

SEQ ID NO: 2511652 - protein, 18 aa, Entamoeba dispar
ACIPLRIQIINKMKAYHN

SEQ ID NO: 2511653 - protein, 19 aa, Entamoeba dispar
ACPITACRVRFCISAAHTD

SEQ ID NO: 2511654 - protein, 23 aa, Entamoeba dispar
ACSYDRIVTCWDLRTPCRSPILQ

SEQ ID NO: 2511655 - protein, 19 aa, Entamoeba dispar
ACVVVKFLAMNGIIMEKMG

SEQ ID NO: 2511656 - protein, 20 aa, Entamoeba dispar
ADALARIFSTLCSFKPYPIV

SEQ ID NO: 2511657 - protein, 23 aa, Entamoeba dispar
ADALKVLFPFSFTSIMSLFEGKN

SEQ ID NO: 2511658 - protein, 24 aa, Entamoeba dispar
ADDHPFELFSQFGITQVIQEKNLG

SEQ ID NO: 2511659 - protein, 23 aa, Entamoeba dispar
ADEIRRYGEFFGMIEENIKKEHD

SEQ ID NO: 2511660 - protein, 17 aa, Entamoeba dispar
ADGCGWGVTSARAAHIA

SEQ ID NO: 2511661 - protein, 21 aa, Entamoeba dispar
ADINWTNRWGRFIGYSDTASI

SEQ ID NO: 2511662 - protein, 25 aa, Entamoeba dispar
ADKIWNIRFIKGLSWGRIFEDKESK

SEQ ID NO: 2511663 - protein, 28 aa, Entamoeba dispar
ADKTKQIGICWKELLIVPSEVVDPSSFG

SEQ ID NO: 2511664 - protein, 17 aa, Entamoeba dispar
ADLIKIWPGISPIQVIG

SEQ ID NO: 2511665 - protein, 25 aa, Entamoeba dispar
ADPQVVYDLCRWIYMHGIEVEGIFR

SEQ ID NO: 2511666 - protein, 26 aa, Entamoeba dispar
ADRKRLRVGFKLVFEFEKNEWFEETE

SEQ ID NO: 2511667 - protein, 18 aa, Entamoeba dispar
ADVWSAGVVFFVMATKEY

SEQ ID NO: 2511668 - protein, 25 aa, Entamoeba dispar
AEAVRLARRIAMEWEAYIKHTNAIR

SEQ ID NO: 2511669 - protein, 23 aa, Entamoeba dispar
AECLMNFKWRQGLVLTNESFSLR

SEQ ID NO: 2511670 - protein, 27 aa, Entamoeba dispar
AECYKTCCYPCRVPFFISNFTARGCSC

SEQ ID NO: 2511671 - protein, 19 aa, Entamoeba dispar
AEEIWKFTHMFSEFEIENH

SEQ ID NO: 2511672 - protein, 23 aa, Entamoeba dispar
AEFDRLSGLFQRNFGGFRNEVKD

SEQ ID NO: 2511673 - protein, 19 aa, Entamoeba dispar
AEFEYCILFPFNVLKMKSI

SEQ ID NO: 2511674 - protein, 17 aa, Entamoeba dispar
AEFKRLTLLMTNLPNKR

SEQ ID NO: 2511675 - protein, 18 aa, Entamoeba dispar
AEFMFRNCCEIPLMKKTA

SEQ ID NO: 2511676 - protein, 18 aa, Entamoeba dispar
AEGKICCFKLPELAEEAK

SEQ ID NO: 2511677 - protein, 19 aa, Entamoeba dispar
AEGLLRMGLHPTIIADGYR

SEQ ID NO: 2511678 - protein, 17 aa, Entamoeba dispar
AEHLLRLIAKLPQICYE

SEQ ID NO: 2511679 - protein, 20 aa, Entamoeba dispar
AEIRLSYGWVECVGHADRGD

SEQ ID NO: 2511680 - protein, 23 aa, Entamoeba dispar
AEKLRPLYWNRIVIDMNNDKSIW

SEQ ID NO: 2511681 - protein, 17 aa, Entamoeba dispar
AELMTGATLESRRINIE

SEQ ID NO: 2511682 - protein, 17 aa, Entamoeba dispar
AELPLFLCVALINKYSS

SEQ ID NO: 2511683 - protein, 18 aa, Entamoeba dispar
AELQEWRNLLAYRDECRK

SEQ ID NO: 2511684 - protein, 17 aa, Entamoeba dispar
AEMLDYLGVAFGYTPQL

SEQ ID NO: 2511685 - protein, 23 aa, Entamoeba dispar
AENIYRVVLYFARSLENESTSDE

SEQ ID NO: 2511686 - protein, 17 aa, Entamoeba dispar
AEPYDSFPIIMNGFVKD

SEQ ID NO: 2511687 - protein, 19 aa, Entamoeba dispar
AESTDDFFLFGYNNYTNNP

SEQ ID NO: 2511688 - protein, 17 aa, Entamoeba dispar
AETFKTFGFKSNESCVL

SEQ ID NO: 2511689 - protein, 19 aa, Entamoeba dispar
AEVLFYLLAHKICYPERVF

SEQ ID NO: 2511690 - protein, 18 aa, Entamoeba dispar
AEWWKEAICLCCAIHAPC

SEQ ID NO: 2511691 - protein, 23 aa, Entamoeba dispar
AEYIKVVICKKCYNCTRRKTEDT

SEQ ID NO: 2511692 - protein, 17 aa, Entamoeba dispar
AFAGMISKIVKRRLLLM

SEQ ID NO: 2511693 - protein, 27 aa, Entamoeba dispar
AFDLANHFCEWCGFDCNWDSYPNEETQ

SEQ ID NO: 2511694 - protein, 24 aa, Entamoeba dispar
AFFKSSYPVNGFPLFPKRSISYPM

SEQ ID NO: 2511695 - protein, 18 aa, Entamoeba dispar
AFHFCVKAKTLIEEQYQG

SEQ ID NO: 2511696 - protein, 24 aa, Entamoeba dispar
AFKAKEYRLVYKLLHDLIQTNHVQ

SEQ ID NO: 2511697 - protein, 17 aa, Entamoeba dispar
AFLLQRRVSIISMLQDK

SEQ ID NO: 2511698 - protein, 17 aa, Entamoeba dispar
AFLQILIPFEWQGVLIP

SEQ ID NO: 2511699 - protein, 19 aa, Entamoeba dispar
AFTKLTWLLAQGMTPDEVR

SEQ ID NO: 2511700 - protein, 18 aa, Entamoeba dispar
AFVKYKWTSEIFDPAYFI

SEQ ID NO: 2511701 - protein, 18 aa, Entamoeba dispar
AFVPIVICLSFRRGVQCI

SEQ ID NO: 2511702 - protein, 17 aa, Entamoeba dispar
AGVYGAFLLACRDEDSG

SEQ ID NO: 2511703 - protein, 22 aa, Entamoeba dispar
AHCLKTTIFVSIIFQPQNTLDL

SEQ ID NO: 2511704 - protein, 18 aa, Entamoeba dispar
AHCQARFALFKTVEKSGA

SEQ ID NO: 2511705 - protein, 17 aa, Entamoeba dispar
AHPAWLKGCELMHIKPI

SEQ ID NO: 2511706 - protein, 18 aa, Entamoeba dispar
AICSRAGIYPNMLLSLVT

SEQ ID NO: 2511707 - protein, 22 aa, Entamoeba dispar
AIDLLKRIFLIASRPDRQNDRE

SEQ ID NO: 2511708 - protein, 18 aa, Entamoeba dispar
AIESFSFFELCFNTIIYS

SEQ ID NO: 2511709 - protein, 17 aa, Entamoeba dispar
AIFARALSEIGIDTTYI

SEQ ID NO: 2511710 - protein, 19 aa, Entamoeba dispar
AIFEVLKVYPFITDKQKSM

SEQ ID NO: 2511711 - protein, 23 aa, Entamoeba dispar
AIKIKEIFNAFCFGNSDIQNILI

SEQ ID NO: 2511712 - protein, 17 aa, Entamoeba dispar
AIMSMKFMKRARAKEIE

SEQ ID NO: 2511713 - protein, 17 aa, Entamoeba dispar
AINRFALHDSLKYNFLV

SEQ ID NO: 2511714 - protein, 24 aa, Entamoeba dispar
AIPKFKVIMKLAIEKVRLKGLMLL

SEQ ID NO: 2511715 - protein, 21 aa, Entamoeba dispar
AIRRYCFRECFSLTSIDIPSE

SEQ ID NO: 2511716 - protein, 23 aa, Entamoeba dispar
AISNKPSLWCCFYYSTNKISGSP

SEQ ID NO: 2511717 - protein, 18 aa, Entamoeba dispar
AKCGGKISGGFVNWDGKP

SEQ ID NO: 2511718 - protein, 22 aa, Entamoeba dispar
AKCKWIEQMFGKGWDMIEVKED

SEQ ID NO: 2511719 - protein, 21 aa, Entamoeba dispar
AKDMYLLYFWQGRSCAVIDKG

SEQ ID NO: 2511720 - protein, 17 aa, Entamoeba dispar
AKEAILITTDIAARGLD

SEQ ID NO: 2511721 - protein, 24 aa, Entamoeba dispar
AKELKRRVPLLIGEVWFGGCERRI

SEQ ID NO: 2511722 - protein, 21 aa, Entamoeba dispar
AKEPRFSLAINEGNEGSRLSH

SEQ ID NO: 2511723 - protein, 27 aa, Entamoeba dispar
AKFKGIPCFWGRIIKRLPYFTPNTKEY

SEQ ID NO: 2511724 - protein, 23 aa, Entamoeba dispar
AKGLQLKFFFSIMEAEMSDIKKL

SEQ ID NO: 2511725 - protein, 17 aa, Entamoeba dispar
AKHLACRIFYQSKTQTI

SEQ ID NO: 2511726 - protein, 19 aa, Entamoeba dispar
AKHPVCLYVSGSNTQVIAF

SEQ ID NO: 2511727 - protein, 19 aa, Entamoeba dispar
AKIKVPEMMTGEYWHDCLS

SEQ ID NO: 2511728 - protein, 27 aa, Entamoeba dispar
AKLFKPRHLFCGYYIFIEFIVTSSSLE

SEQ ID NO: 2511729 - protein, 17 aa, Entamoeba dispar
AKLKGVCSFLDKMIIEG

SEQ ID NO: 2511730 - protein, 19 aa, Entamoeba dispar
AKLRGLMFYEEIKARRQNK

SEQ ID NO: 2511731 - protein, 19 aa, Entamoeba dispar
AKMKECINILLSISENNEV

SEQ ID NO: 2511732 - protein, 20 aa, Entamoeba dispar
AKPDMSTFVFVRVLTNVDNF

SEQ ID NO: 2511733 - protein, 21 aa, Entamoeba dispar
AKPKYRSVYLFLFNDTIILTK

SEQ ID NO: 2511734 - protein, 17 aa, Entamoeba dispar
AKQIFLFVVDMIDLLNA

SEQ ID NO: 2511735 - protein, 20 aa, Entamoeba dispar
AKQYGYRARSAFKLVQMNKR

SEQ ID NO: 2511736 - protein, 17 aa, Entamoeba dispar
AKRRNCPVIAYTYNEPT

SEQ ID NO: 2511737 - protein, 25 aa, Entamoeba dispar
AKSMLRMVQEFRQKRICGQSTLYYG

SEQ ID NO: 2511738 - protein, 17 aa, Entamoeba dispar
AKTFLPYYIQPLLNLIP

SEQ ID NO: 2511739 - protein, 20 aa, Entamoeba dispar
AKVIPNCIGNIWVYVYDCPE

SEQ ID NO: 2511740 - protein, 23 aa, Entamoeba dispar
AKVIPNCIGNIWVYVYDCPENEG

SEQ ID NO: 2511741 - protein, 17 aa, Entamoeba dispar
AKYRVTYKVSEHGDYTI

SEQ ID NO: 2511742 - protein, 17 aa, Entamoeba dispar
ALEAGICKLEYHFCKQV

SEQ ID NO: 2511743 - protein, 21 aa, Entamoeba dispar
ALELFKLFVKYKCFIKVTYRS

SEQ ID NO: 2511744 - protein, 18 aa, Entamoeba dispar
ALELGTLIMKRIIKEDKT

SEQ ID NO: 2511745 - protein, 20 aa, Entamoeba dispar
ALELWYNFYYLFEGIFNHSL

SEQ ID NO: 2511746 - protein, 17 aa, Entamoeba dispar
ALFCILDQFLVSGIKTI

SEQ ID NO: 2511747 - protein, 19 aa, Entamoeba dispar
ALFGFDGWSCCITNLNVDY

SEQ ID NO: 2511748 - protein, 17 aa, Entamoeba dispar
ALHYRMAQVLFREKNYI

SEQ ID NO: 2511749 - protein, 20 aa, Entamoeba dispar
ALKEMKCPRLLQPHQITGLD

SEQ ID NO: 2511750 - protein, 23 aa, Entamoeba dispar
ALKHPFCCLSVLNLIVAFRQHTF

SEQ ID NO: 2511751 - protein, 17 aa, Entamoeba dispar
ALLKPLGTYTIRIDTTG

SEQ ID NO: 2511752 - protein, 20 aa, Entamoeba dispar
ALLRFCGKYAKLSHKPLIDD

SEQ ID NO: 2511753 - protein, 21 aa, Entamoeba dispar
ALNALRLLLVFGDENDLDTKN

SEQ ID NO: 2511754 - protein, 19 aa, Entamoeba dispar
ALNFIKFLKEMVVYIKQYH

SEQ ID NO: 2511755 - protein, 19 aa, Entamoeba dispar
ALPFFISLFSEIKWDDEIS

SEQ ID NO: 2511756 - protein, 25 aa, Entamoeba dispar
ALTNMCHLHGWKLDNSYTIPTQIVL

SEQ ID NO: 2511757 - protein, 19 aa, Entamoeba dispar
ALTRKGLKEVFETAVKYVL

SEQ ID NO: 2511758 - protein, 17 aa, Entamoeba dispar
ALWIAIGFFRLGKDYQN

SEQ ID NO: 2511759 - protein, 17 aa, Entamoeba dispar
ALYGIKVTDDFRYIIIN

SEQ ID NO: 2511760 - protein, 17 aa, Entamoeba dispar
AMADVFKGLQFTNPFSN

SEQ ID NO: 2511761 - protein, 19 aa, Entamoeba dispar
AMDIRSSDPYVIVSVGIEQ

SEQ ID NO: 2511762 - protein, 19 aa, Entamoeba dispar
AMEKGYCCKITRFPQTGDS

SEQ ID NO: 2511763 - protein, 24 aa, Entamoeba dispar
AMFPCSHCFHILCIKKEFAQHPTL

SEQ ID NO: 2511764 - protein, 22 aa, Entamoeba dispar
AMKELYPLFLWILSGLFPQITN

SEQ ID NO: 2511765 - protein, 21 aa, Entamoeba dispar
AMKRQRGEGGRFCSKKKIEQS

SEQ ID NO: 2511766 - protein, 18 aa, Entamoeba dispar
AMLACLFPVLKQVIYKEG

SEQ ID NO: 2511767 - protein, 25 aa, Entamoeba dispar
AMLVDGICSIYCSKGIYHICGYYDS

SEQ ID NO: 2511768 - protein, 18 aa, Entamoeba dispar
AMWPRKGFYLGNFDIDYR

SEQ ID NO: 2511769 - protein, 23 aa, Entamoeba dispar
AMYNYGLCFYKGFGHLKKNQIKA

SEQ ID NO: 2511770 - protein, 17 aa, Entamoeba dispar
ANAFNLKWMKSNINGKW

SEQ ID NO: 2511771 - protein, 17 aa, Entamoeba dispar
ANCGLEFQKAALCIFAE

SEQ ID NO: 2511772 - protein, 23 aa, Entamoeba dispar
ANELHCSWCLVSAKTGEGVSNAF

SEQ ID NO: 2511773 - protein, 23 aa, Entamoeba dispar
ANETRVAWKIAIERNNGPTLLIL

SEQ ID NO: 2511774 - protein, 22 aa, Entamoeba dispar
ANINWTNRWGRFIGYSDTASIT

SEQ ID NO: 2511775 - protein, 19 aa, Entamoeba dispar
ANISSNISFVYCININVFD

SEQ ID NO: 2511776 - protein, 23 aa, Entamoeba dispar
ANKFCCREFYGVLSFNIKSQYQL

SEQ ID NO: 2511777 - protein, 18 aa, Entamoeba dispar
ANPFLVIVLLKYFFLSLP

SEQ ID NO: 2511778 - protein, 18 aa, Entamoeba dispar
ANSIPCIISKYIIEPLLL

SEQ ID NO: 2511779 - protein, 22 aa, Entamoeba dispar
APAIHCGRLYFKPSGDCAFNIT

SEQ ID NO: 2511780 - protein, 18 aa, Entamoeba dispar
APHDGAFCDLLWSDPEPE

SEQ ID NO: 2511781 - protein, 24 aa, Entamoeba dispar
APHKCPVCNALIYSPFTICDIVIQ

SEQ ID NO: 2511782 - protein, 26 aa, Entamoeba dispar
AQFSNGKWRSEWTISVGSKVTCEGRI

SEQ ID NO: 2511783 - protein, 25 aa, Entamoeba dispar
AQFSNGKWRSEWTITVGSKVTCEGR

SEQ ID NO: 2511784 - protein, 20 aa, Entamoeba dispar
AQICIRWLIQNGIIAIPKST

SEQ ID NO: 2511785 - protein, 19 aa, Entamoeba dispar
AQKAFSVMHLRWFNMHLLR

SEQ ID NO: 2511786 - protein, 25 aa, Entamoeba dispar
AQKDSSSFCSFEFMKQKDFIIREEK

SEQ ID NO: 2511787 - protein, 21 aa, Entamoeba dispar
ARAPKSCAVFETMKYTEEIIK

SEQ ID NO: 2511788 - protein, 18 aa, Entamoeba dispar
ARFYIAELFLAIDSIHKL

SEQ ID NO: 2511789 - protein, 21 aa, Entamoeba dispar
ARGAAPCVLFFDELDSIAQSR

SEQ ID NO: 2511790 - protein, 18 aa, Entamoeba dispar
ARGPSIVKMYSFLTNQLL

SEQ ID NO: 2511791 - protein, 17 aa, Entamoeba dispar
ARITFCYAATVALNTTL

SEQ ID NO: 2511792 - protein, 23 aa, Entamoeba dispar
ARLFCFACSVFIREFRVPVNTMV

SEQ ID NO: 2511793 - protein, 17 aa, Entamoeba dispar
ARMGEACKLCDRPFDVY

SEQ ID NO: 2511794 - protein, 18 aa, Entamoeba dispar
ARNGLNCLEFIFNYFNHL

SEQ ID NO: 2511795 - protein, 19 aa, Entamoeba dispar
ARNSAPCVIFFDELDALAP

SEQ ID NO: 2511796 - protein, 17 aa, Entamoeba dispar
ARQDFKFYTAVNNEASK

SEQ ID NO: 2511797 - protein, 19 aa, Entamoeba dispar
ARVCIACKLCINILIITNQ

SEQ ID NO: 2511798 - protein, 18 aa, Entamoeba dispar
ARVSILAFQFFKQIYKLF

SEQ ID NO: 2511799 - protein, 21 aa, Entamoeba dispar
ARWNPNCYGFIASVAEEYDIH

SEQ ID NO: 2511800 - protein, 17 aa, Entamoeba dispar
ASCFAHWFQPLSQTTAR

SEQ ID NO: 2511801 - protein, 17 aa, Entamoeba dispar
ASCLLKLKDYAGAVEAA

SEQ ID NO: 2511802 - protein, 23 aa, Entamoeba dispar
ASFPSLRCWYKFDSPTFVCSKIR

SEQ ID NO: 2511803 - protein, 18 aa, Entamoeba dispar
ASGLWYLHFCKHIIHRDL

SEQ ID NO: 2511804 - protein, 17 aa, Entamoeba dispar
ASIASMLDCEWIKKNSV

SEQ ID NO: 2511805 - protein, 19 aa, Entamoeba dispar
ASLVFPLIVSKTFAVTKRF

SEQ ID NO: 2511806 - protein, 27 aa, Entamoeba dispar
ASSRELLKHKWFITNGIKVVEEVKKTN

SEQ ID NO: 2511807 - protein, 19 aa, Entamoeba dispar
ASVISICIEYSRYSTIFTM

SEQ ID NO: 2511808 - protein, 21 aa, Entamoeba dispar
ATDMALRMAISLTKTKRLRGI

SEQ ID NO: 2511809 - protein, 24 aa, Entamoeba dispar
ATELSQRCTMEWAKDEYEENKLQE

SEQ ID NO: 2511810 - protein, 18 aa, Entamoeba dispar
ATKRIAIVNCDWENTSAR

SEQ ID NO: 2511811 - protein, 24 aa, Entamoeba dispar
ATLEELHFWPSFYLHAVLFNKTDP

SEQ ID NO: 2511812 - protein, 25 aa, Entamoeba dispar
ATLEELHFWPSFYLHAVLFNKTDPS

SEQ ID NO: 2511813 - protein, 18 aa, Entamoeba dispar
ATLYPEWVCASVGNQIQA

SEQ ID NO: 2511814 - protein, 19 aa, Entamoeba dispar
ATLYPEWVCASVGNQIQAL

SEQ ID NO: 2511815 - protein, 18 aa, Entamoeba dispar
ATQLSCVMIAFGTAMTMG

SEQ ID NO: 2511816 - protein, 24 aa, Entamoeba dispar
ATTMCPKCRELLCEESITYIEEIK

SEQ ID NO: 2511817 - protein, 22 aa, Entamoeba dispar
ATVDPCRFMGCGPSSSTSSGYR

SEQ ID NO: 2511818 - protein, 18 aa, Entamoeba dispar
AVAKGAACLAYLEQDECV

SEQ ID NO: 2511819 - protein, 17 aa, Entamoeba dispar
AVCPINWKTGKDTIEPT

SEQ ID NO: 2511820 - protein, 20 aa, Entamoeba dispar
AVCRKCFFKDAAMLKTQKSA

SEQ ID NO: 2511821 - protein, 21 aa, Entamoeba dispar
AVEILRINPLFSIKPLIGPKD

SEQ ID NO: 2511822 - protein, 19 aa, Entamoeba dispar
AVPVCGPYECISKYKYHIK

SEQ ID NO: 2511823 - protein, 18 aa, Entamoeba dispar
AVPVFGWICVEKTPAPYV

SEQ ID NO: 2511824 - protein, 18 aa, Entamoeba dispar
AWCSLCPKQVLDFKLSYH

SEQ ID NO: 2511825 - protein, 21 aa, Entamoeba dispar
AWFHIKILRLFTDSVLHYGLP

SEQ ID NO: 2511826 - protein, 18 aa, Entamoeba dispar
AWKSIIYDQFRYVDEIIE

SEQ ID NO: 2511827 - protein, 17 aa, Entamoeba dispar
AWYFGEVELQFEDEDQF

SEQ ID NO: 2511828 - protein, 17 aa, Entamoeba dispar
AYEATRILCNLIILNSD

SEQ ID NO: 2511829 - protein, 21 aa, Entamoeba dispar
AYEKRGIKELFEWQEECLKEK

SEQ ID NO: 2511830 - protein, 18 aa, Entamoeba dispar
AYELLKKDAANFMNAYDS

SEQ ID NO: 2511831 - protein, 17 aa, Entamoeba dispar
AYELLKKDATNFMNAYD

SEQ ID NO: 2511832 - protein, 18 aa, Entamoeba dispar
AYGECVKKLVSMYETCNE

SEQ ID NO: 2511833 - protein, 19 aa, Entamoeba dispar
AYHYRLFTELVINDLLNRV

SEQ ID NO: 2511834 - protein, 20 aa, Entamoeba dispar
AYNLDFFIYFSFNNKKITYI

SEQ ID NO: 2511835 - protein, 18 aa, Entamoeba dispar
AYPFCLPAPLSLPKKNYN

SEQ ID NO: 2511836 - protein, 20 aa, Entamoeba dispar
AYPFCLPASLSLPKKSYNKM

SEQ ID NO: 2511837 - protein, 18 aa, Entamoeba dispar
AYRKLALKWHPDRNPNNK

SEQ ID NO: 2511838 - protein, 22 aa, Entamoeba dispar
CAAFDYKCVLVLGIVNNEIIEQ

SEQ ID NO: 2511839 - protein, 19 aa, Entamoeba dispar
CAECGQPLGPQRITALGKS

SEQ ID NO: 2511840 - protein, 19 aa, Entamoeba dispar
CALKVVFKRQLQKCGMGIQ

SEQ ID NO: 2511841 - protein, 17 aa, Entamoeba dispar
CASCKRKELKRLGIEAP

SEQ ID NO: 2511842 - protein, 22 aa, Entamoeba dispar
CASQFPNCFANILSKNPHQSIE

SEQ ID NO: 2511843 - protein, 20 aa, Entamoeba dispar
CATPLLIQWTYQAMIHEFLG

SEQ ID NO: 2511844 - protein, 18 aa, Entamoeba dispar
CAVFNFPTCHFVCRTVKN

SEQ ID NO: 2511845 - protein, 17 aa, Entamoeba dispar
CCDILKFLFDTVPDLYQ

SEQ ID NO: 2511846 - protein, 20 aa, Entamoeba dispar
CCLKTGIIYTNWLKTGIVII

SEQ ID NO: 2511847 - protein, 23 aa, Entamoeba dispar
CCVKWRKGICPWNKGKQTIKGFC

SEQ ID NO: 2511848 - protein, 21 aa, Entamoeba dispar
CCYCYCCSESLGLTFKCPKCN

SEQ ID NO: 2511849 - protein, 18 aa, Entamoeba dispar
CCYFDCLFYGKAHLTTKP

SEQ ID NO: 2511850 - protein, 19 aa, Entamoeba dispar
CDDLFKLLLEWCDREEEST

SEQ ID NO: 2511851 - protein, 22 aa, Entamoeba dispar
CDELEFPLCFTVFSASLYSLNN

SEQ ID NO: 2511852 - protein, 18 aa, Entamoeba dispar
CDGFKLIMELVHSHIAAV

SEQ ID NO: 2511853 - protein, 20 aa, Entamoeba dispar
CDGMRRMGYAKGNLEAIIQI

SEQ ID NO: 2511854 - protein, 18 aa, Entamoeba dispar
CDIWKKCLGYSFEEEKYS

SEQ ID NO: 2511855 - protein, 19 aa, Entamoeba dispar
CDYWSIGCILFEMVCGFPP

SEQ ID NO: 2511856 - protein, 17 aa, Entamoeba dispar
CEAKRFIGRRVKPSEIE

SEQ ID NO: 2511857 - protein, 20 aa, Entamoeba dispar
CEFCPFEDFIAIGRYNGVST

SEQ ID NO: 2511858 - protein, 17 aa, Entamoeba dispar
CEGEWPFSLETIAIVQD

SEQ ID NO: 2511859 - protein, 18 aa, Entamoeba dispar
CEHWGIIWLNFEKLIRSH

SEQ ID NO: 2511860 - protein, 34 aa, Entamoeba dispar
CELFCDICLVPLCKELGCFDWCCDCCCDCCDCGD

SEQ ID NO: 2511861 - protein, 18 aa, Entamoeba dispar
CELFRIDLFGSIVYSILI

SEQ ID NO: 2511862 - protein, 17 aa, Entamoeba dispar
CELLRCFIKILKRIKDI

SEQ ID NO: 2511863 - protein, 17 aa, Entamoeba dispar
CENEIKIGVGVNQKNNA

SEQ ID NO: 2511864 - protein, 17 aa, Entamoeba dispar
CERARYEAMSKFNEEAS

SEQ ID NO: 2511865 - protein, 18 aa, Entamoeba dispar
CESDCLISVAFANKVTTP

SEQ ID NO: 2511866 - protein, 19 aa, Entamoeba dispar
CESRNRLIILLPWLEQRLS

SEQ ID NO: 2511867 - protein, 24 aa, Entamoeba dispar
CETKPTECLGCFFTGITNVDSSSS

SEQ ID NO: 2511868 - protein, 23 aa, Entamoeba dispar
CEVKADISGAVIFNGLLEISVRQ

SEQ ID NO: 2511869 - protein, 17 aa, Entamoeba dispar
CEYYCLRDVLVLREGFL

SEQ ID NO: 2511870 - protein, 21 aa, Entamoeba dispar
CFFPSYSYMNICISYWDEMKI

SEQ ID NO: 2511871 - protein, 19 aa, Entamoeba dispar
CFINFLFTKCCKEILVIFT

SEQ ID NO: 2511872 - protein, 19 aa, Entamoeba dispar
CFPAALPAIFSFSNGNSIR

SEQ ID NO: 2511873 - protein, 19 aa, Entamoeba dispar
CFPTFLSFFALPLVSAIPY

SEQ ID NO: 2511874 - protein, 20 aa, Entamoeba dispar
CFRTPSSIFRRNSIFTRIIR

SEQ ID NO: 2511875 - protein, 17 aa, Entamoeba dispar
CFRYCKNLEKVDCYRNY

SEQ ID NO: 2511876 - protein, 17 aa, Entamoeba dispar
CFYKCGCEEMLRENKSI

SEQ ID NO: 2511877 - protein, 17 aa, Entamoeba dispar
CFYKCLLLTTLHIPRTV

SEQ ID NO: 2511878 - protein, 17 aa, Entamoeba dispar
CFYSCCSLTSIDIPTLV

SEQ ID NO: 2511879 - protein, 18 aa, Entamoeba dispar
CGANIYPGHGMMFVRNDA

SEQ ID NO: 2511880 - protein, 17 aa, Entamoeba dispar
CGAPAKMISQFYITYWM

SEQ ID NO: 2511881 - protein, 23 aa, Entamoeba dispar
CGCFPRRHFDNFIKVCPINAQES

SEQ ID NO: 2511882 - protein, 18 aa, Entamoeba dispar
CGFDEMLKIIKIETFVAL

SEQ ID NO: 2511883 - protein, 20 aa, Entamoeba dispar
CGFRPKFGKLQLVNGKIIEE

SEQ ID NO: 2511884 - protein, 17 aa, Entamoeba dispar
CGGRIGPFIDHLYPDLR

SEQ ID NO: 2511885 - protein, 22 aa, Entamoeba dispar
CGHLFCKACLAIVFTSSDKTPL

SEQ ID NO: 2511886 - protein, 18 aa, Entamoeba dispar
CGIFSCAYLKLSEKQEVC

SEQ ID NO: 2511887 - protein, 17 aa, Entamoeba dispar
CGKRYTSLWSLENDCGG

SEQ ID NO: 2511888 - protein, 18 aa, Entamoeba dispar
CGKSAYPLERITAGGKDY

SEQ ID NO: 2511889 - protein, 18 aa, Entamoeba dispar
CGKYALKMCNPQKLASTL

SEQ ID NO: 2511890 - protein, 17 aa, Entamoeba dispar
CGMENCGATCYINSVIQ

SEQ ID NO: 2511891 - protein, 23 aa, Entamoeba dispar
CGTWIQKFCMWIRGGVDGLTKFL

SEQ ID NO: 2511892 - protein, 19 aa, Entamoeba dispar
CGVQLCGGAHAIGHEITNY

SEQ ID NO: 2511893 - protein, 17 aa, Entamoeba dispar
CGWVGRVYLSMLINKQD

SEQ ID NO: 2511894 - protein, 17 aa, Entamoeba dispar
CGYKLIVTLGFDNVNSV

SEQ ID NO: 2511895 - protein, 17 aa, Entamoeba dispar
CGYSDFGYIMVMDIHGI

SEQ ID NO: 2511896 - protein, 18 aa, Entamoeba dispar
CHGEWCWMCRGDWKTHGT

SEQ ID NO: 2511897 - protein, 19 aa, Entamoeba dispar
CHITTRLVRVSSLTFGTKT

SEQ ID NO: 2511898 - protein, 19 aa, Entamoeba dispar
CHKSAEIIRMFPTDISEQF

SEQ ID NO: 2511899 - protein, 23 aa, Entamoeba dispar
CIAAEFFLGIPLFAGTSEYNLLF

SEQ ID NO: 2511900 - protein, 22 aa, Entamoeba dispar
CIAAELILGIPIFPGSSEYNQL

SEQ ID NO: 2511901 - protein, 20 aa, Entamoeba dispar
CIECIPSDFWQRLGDLNDTI

SEQ ID NO: 2511902 - protein, 28 aa, Entamoeba dispar
CIGSIFVEFSHFFKVYKLIVGNSEAVLA

SEQ ID NO: 2511903 - protein, 27 aa, Entamoeba dispar
CIHCGLCVCNGCYRGRFIFNGVNKRGC

SEQ ID NO: 2511904 - protein, 18 aa, Entamoeba dispar
CIHLKRKILEILVKCFFE

SEQ ID NO: 2511905 - protein, 17 aa, Entamoeba dispar
CIIKRKYIRKQFIIPSD

SEQ ID NO: 2511906 - protein, 24 aa, Entamoeba dispar
CIKKKCYIEYIFAYSVVDMNVMAK

SEQ ID NO: 2511907 - protein, 21 aa, Entamoeba dispar
CIKTKRFADALIMTENNKEIH

SEQ ID NO: 2511908 - protein, 18 aa, Entamoeba dispar
CILPHLFLGSVESTTKPF

SEQ ID NO: 2511909 - protein, 19 aa, Entamoeba dispar
CIMSSYLLEKSRVVYQARE

SEQ ID NO: 2511910 - protein, 19 aa, Entamoeba dispar
CIWKNLILMCIGENFENSE

SEQ ID NO: 2511911 - protein, 19 aa, Entamoeba dispar
CIYCGGLIYPDENEWICHT

SEQ ID NO: 2511912 - protein, 17 aa, Entamoeba dispar
CKALRKMHVIDGVDGKY

SEQ ID NO: 2511913 - protein, 19 aa, Entamoeba dispar
CKCNYYPPPLYRIPPPNIP

SEQ ID NO: 2511914 - protein, 23 aa, Entamoeba dispar
CKEKISGKFAWRENGFICGNCVS

SEQ ID NO: 2511915 - protein, 21 aa, Entamoeba dispar
CKERVLKMVLVWCKKCNSLWL

SEQ ID NO: 2511916 - protein, 20 aa, Entamoeba dispar
CKFLQFRSASFLSLEHLRIH

SEQ ID NO: 2511917 - protein, 17 aa, Entamoeba dispar
CKFSSQCTTEWTWSNDN

SEQ ID NO: 2511918 - protein, 21 aa, Entamoeba dispar
CKGDVLACSWCPDINGMLAVG

SEQ ID NO: 2511919 - protein, 22 aa, Entamoeba dispar
CKHIFCSYCAQKAWLNGNYKCP

SEQ ID NO: 2511920 - protein, 21 aa, Entamoeba dispar
CKITEGVLLRMVLSDLIKQSQ

SEQ ID NO: 2511921 - protein, 17 aa, Entamoeba dispar
CKLCGKPFSFPKMEFKI

SEQ ID NO: 2511922 - protein, 19 aa, Entamoeba dispar
CKLDSFYFIGWIGKTTLNH

SEQ ID NO: 2511923 - protein, 18 aa, Entamoeba dispar
CKLLESLFIPSSVQNYGS

SEQ ID NO: 2511924 - protein, 18 aa, Entamoeba dispar
CKMCRECIREERSEYIKL

SEQ ID NO: 2511925 - protein, 25 aa, Entamoeba dispar
CKRRKCIRASIVFGEYQKICKLQLV

SEQ ID NO: 2511926 - protein, 18 aa, Entamoeba dispar
CKRYMKYLMKKYLKKNNL

SEQ ID NO: 2511927 - protein, 18 aa, Entamoeba dispar
CKSQCKLMLIFHHSPQSP

SEQ ID NO: 2511928 - protein, 17 aa, Entamoeba dispar
CKSTCAIQLIQTVSPQQ

SEQ ID NO: 2511929 - protein, 19 aa, Entamoeba dispar
CKSTYGTGCFVVKNIGNSI

SEQ ID NO: 2511930 - protein, 20 aa, Entamoeba dispar
CKTCDMAEFIIHAVNPSGEP

SEQ ID NO: 2511931 - protein, 24 aa, Entamoeba dispar
CKTFSFKRFVKFDCVLVDVQKEEN

SEQ ID NO: 2511932 - protein, 26 aa, Entamoeba dispar
CKTIDFRFVRPLSIDFLRRFNKAAKA

SEQ ID NO: 2511933 - protein, 18 aa, Entamoeba dispar
CKVQREMGELITIEEYLT

SEQ ID NO: 2511934 - protein, 19 aa, Entamoeba dispar
CKVQREMGELITIEEYLTK

SEQ ID NO: 2511935 - protein, 20 aa, Entamoeba dispar
CLCFLLPSCCPVSQSQIICR

SEQ ID NO: 2511936 - protein, 19 aa, Entamoeba dispar
CLCFLLPSCCPVSQSQILC

SEQ ID NO: 2511937 - protein, 20 aa, Entamoeba dispar
CLCFLLPSCCPVSQSQILCK

SEQ ID NO: 2511938 - protein, 24 aa, Entamoeba dispar
CLEAMKFLKINPCFTRNFYKNQTT

SEQ ID NO: 2511939 - protein, 18 aa, Entamoeba dispar
CLEFEGCLECTRRECTKC

SEQ ID NO: 2511940 - protein, 26 aa, Entamoeba dispar
CLFSHFSIDEIYGWQSFVSKKEYDEV

SEQ ID NO: 2511941 - protein, 19 aa, Entamoeba dispar
CLGCGLIDFLPIKCSYCHN

SEQ ID NO: 2511942 - protein, 17 aa, Entamoeba dispar
CLGDCYFLAALASLSEF

SEQ ID NO: 2511943 - protein, 18 aa, Entamoeba dispar
CLIWDIGMLMCLHVIEVG

SEQ ID NO: 2511944 - protein, 22 aa, Entamoeba dispar
CLKELSLLCGLSLSHMLCADAP

SEQ ID NO: 2511945 - protein, 24 aa, Entamoeba dispar
CLKSGWRYPVPFFRSIQYLRYNGG

SEQ ID NO: 2511946 - protein, 17 aa, Entamoeba dispar
CLKSSPLNTIWKSYVLM

SEQ ID NO: 2511947 - protein, 32 aa, Entamoeba dispar
CLLIYKFMYCGAPYKVYGCYDEKFNVFIVITK

SEQ ID NO: 2511948 - protein, 25 aa, Entamoeba dispar
CLMGRIGVLIPFNFREDVEFFSKLE

SEQ ID NO: 2511949 - protein, 18 aa, Entamoeba dispar
CLNEPIHSFVFLPSNSAD

SEQ ID NO: 2511950 - protein, 17 aa, Entamoeba dispar
CLTSVIIELCIKLLDSN

SEQ ID NO: 2511951 - protein, 25 aa, Entamoeba dispar
CLYCAEPNCMRCCPTQLDAKRMVHA

SEQ ID NO: 2511952 - protein, 18 aa, Entamoeba dispar
CMPEILAGLTSPMCKIDL

SEQ ID NO: 2511953 - protein, 22 aa, Entamoeba dispar
CMRCNSCSIFPLLSSQEQELLK

SEQ ID NO: 2511954 - protein, 24 aa, Entamoeba dispar
CMYEKGCYCKGIFRESQNASIRKV

SEQ ID NO: 2511955 - protein, 24 aa, Entamoeba dispar
CMYNKGCFCKGIFRESSNASIRQI

SEQ ID NO: 2511956 - protein, 18 aa, Entamoeba dispar
CNCIKEIMNCYGIGYNVN

SEQ ID NO: 2511957 - protein, 18 aa, Entamoeba dispar
CNEYKFEVLISMMSEQWF

SEQ ID NO: 2511958 - protein, 17 aa, Entamoeba dispar
CNKTCHYPCHIKGDIKK

SEQ ID NO: 2511959 - protein, 22 aa, Entamoeba dispar
CNLCKTRNPFVLGFLQVKQNSD

SEQ ID NO: 2511960 - protein, 19 aa, Entamoeba dispar
CNLKLIMCEGISESLQSES

SEQ ID NO: 2511961 - protein, 21 aa, Entamoeba dispar
CNQMKIILCNIYKTIASSSFF

SEQ ID NO: 2511962 - protein, 17 aa, Entamoeba dispar
CPANIFDFSKFRVLLYI

SEQ ID NO: 2511963 - protein, 17 aa, Entamoeba dispar
CPCCRKSLNRLASYSSP

SEQ ID NO: 2511964 - protein, 20 aa, Entamoeba dispar
CPFCSLQFCSLECKEKMNNQ

SEQ ID NO: 2511965 - protein, 22 aa, Entamoeba dispar
CPICNFCYCELPIQCKICNAIL

SEQ ID NO: 2511966 - protein, 17 aa, Entamoeba dispar
CPIDCRSDLFGTINLIG

SEQ ID NO: 2511967 - protein, 22 aa, Entamoeba dispar
CPIMLVCQDCFWRCTLQGGCEY

SEQ ID NO: 2511968 - protein, 23 aa, Entamoeba dispar
CPIMLVCQDCFWRCTLQGGCEYI

SEQ ID NO: 2511969 - protein, 20 aa, Entamoeba dispar
CPLLKLYQSFCLMIQGNIEK

SEQ ID NO: 2511970 - protein, 19 aa, Entamoeba dispar
CQFPTLGFVVDRYYQIKAF

SEQ ID NO: 2511971 - protein, 22 aa, Entamoeba dispar
CQMYWKGIEWCCISTFRGIPDW

SEQ ID NO: 2511972 - protein, 20 aa, Entamoeba dispar
CQRCKQMLYSHIDLSKTMNE

SEQ ID NO: 2511973 - protein, 17 aa, Entamoeba dispar
CQSCGPTSIVKKIQIPY

SEQ ID NO: 2511974 - protein, 17 aa, Entamoeba dispar
CRFCGSCICSDCSRNKV

SEQ ID NO: 2511975 - protein, 19 aa, Entamoeba dispar
CRGKLVFKDGVFVGEKGYG

SEQ ID NO: 2511976 - protein, 21 aa, Entamoeba dispar
CRKGIKKRVCFLFSDQVFIYG

SEQ ID NO: 2511977 - protein, 17 aa, Entamoeba dispar
CRKYLKNPFEVFIDDGE

SEQ ID NO: 2511978 - protein, 22 aa, Entamoeba dispar
CRREIQMLPKLIIRKEQFLKPE

SEQ ID NO: 2511979 - protein, 19 aa, Entamoeba dispar
CRRWCFLRIDIASTVPESF

SEQ ID NO: 2511980 - protein, 18 aa, Entamoeba dispar
CRSSCAYETVFARNFVGI

SEQ ID NO: 2511981 - protein, 17 aa, Entamoeba dispar
CRTRCKVPKLGRVDYVC

SEQ ID NO: 2511982 - protein, 19 aa, Entamoeba dispar
CRTYLEKHFELFKELDEEQ

SEQ ID NO: 2511983 - protein, 20 aa, Entamoeba dispar
CSALRALMYVDLSAAVHYVI

SEQ ID NO: 2511984 - protein, 17 aa, Entamoeba dispar
CSCLAPWCEGEECEKSI

SEQ ID NO: 2511985 - protein, 19 aa, Entamoeba dispar
CSCLCSLKILGLVSYLILL

SEQ ID NO: 2511986 - protein, 22 aa, Entamoeba dispar
CSCRRKCLLKYFGETSFKPNKR

SEQ ID NO: 2511987 - protein, 17 aa, Entamoeba dispar
CSEAFNMFLKRGADVNA

SEQ ID NO: 2511988 - protein, 19 aa, Entamoeba dispar
CSESLGLTFKCPKCNKINV

SEQ ID NO: 2511989 - protein, 18 aa, Entamoeba dispar
CSHCGAIINPYCSVDYNS

SEQ ID NO: 2511990 - protein, 17 aa, Entamoeba dispar
CSIELKFSPIESVILQD

SEQ ID NO: 2511991 - protein, 18 aa, Entamoeba dispar
CSIFLLLCCGDDVLESFF

SEQ ID NO: 2511992 - protein, 17 aa, Entamoeba dispar
CSILKYIIEHETVNLNK

SEQ ID NO: 2511993 - protein, 18 aa, Entamoeba dispar
CSIMAAKIVRDAAIAAGA

SEQ ID NO: 2511994 - protein, 19 aa, Entamoeba dispar
CSIMAAKIVRDAAIAAGAP

SEQ ID NO: 2511995 - protein, 17 aa, Entamoeba dispar
CSIPIVRRLICGMFSKD

SEQ ID NO: 2511996 - protein, 21 aa, Entamoeba dispar
CSIVAPLPKRVWQKKVESPNY

SEQ ID NO: 2511997 - protein, 23 aa, Entamoeba dispar
CSIYRLKESWVLLSTEEVNLFKQ

SEQ ID NO: 2511998 - protein, 21 aa, Entamoeba dispar
CSLYYKMVMSIGVEEEEMDFS

SEQ ID NO: 2511999 - protein, 18 aa, Entamoeba dispar
CSMFPPLVIESLINKYHI

SEQ ID NO: 2512000 - protein, 26 aa, Entamoeba dispar
CSMTPKYLLLFYMKFMHLIGNICNIQ

SEQ ID NO: 2512001 - protein, 23 aa, Entamoeba dispar
CSNFRRIEVLHLNNAICNKPNVM

SEQ ID NO: 2512002 - protein, 19 aa, Entamoeba dispar
CSPAFWKFLDLIGNKIELN

SEQ ID NO: 2512003 - protein, 18 aa, Entamoeba dispar
CSPAFWKFMNLIGTKKQL

SEQ ID NO: 2512004 - protein, 18 aa, Entamoeba dispar
CSQFKLKFLNIFEQAANG

SEQ ID NO: 2512005 - protein, 19 aa, Entamoeba dispar
CSRTGLRFSSRGGDINGNV

SEQ ID NO: 2512006 - protein, 17 aa, Entamoeba dispar
CSSYIPSHFKTILRKIY

SEQ ID NO: 2512007 - protein, 21 aa, Entamoeba dispar
CSVALRFIEKVYRIKPLCSAE

SEQ ID NO: 2512008 - protein, 20 aa, Entamoeba dispar
CSVCQARLGPYFINKEMNKV

SEQ ID NO: 2512009 - protein, 19 aa, Entamoeba dispar
CSVPIKRPFENEIFTQPTT

SEQ ID NO: 2512010 - protein, 18 aa, Entamoeba dispar
CTGKRFIENFIMPKTYSA

SEQ ID NO: 2512011 - protein, 19 aa, Entamoeba dispar
CTIQLGDYCILKRDEIMTI

SEQ ID NO: 2512012 - protein, 19 aa, Entamoeba dispar
CTRCGKPFNGSYMLINGQP

SEQ ID NO: 2512013 - protein, 21 aa, Entamoeba dispar
CTSLQRIQLPLGIDIIEDESF

SEQ ID NO: 2512014 - protein, 18 aa, Entamoeba dispar
CTVEYGLKIGRLGCMKCF

SEQ ID NO: 2512015 - protein, 18 aa, Entamoeba dispar
CVAAELFLGIPLFPGENE

SEQ ID NO: 2512016 - protein, 17 aa, Entamoeba dispar
CVCKNCNRILLTNEERD

SEQ ID NO: 2512017 - protein, 18 aa, Entamoeba dispar
CVEYLSPYMIYVIDNENS

SEQ ID NO: 2512018 - protein, 18 aa, Entamoeba dispar
CVHCYKCNQRIYSTSKFY

SEQ ID NO: 2512019 - protein, 23 aa, Entamoeba dispar
CVRCNRSCHPRCFIPGDVKDGCS

SEQ ID NO: 2512020 - protein, 27 aa, Entamoeba dispar
CVRCNSCGTDCCLLCDGEIIINPSLKD

SEQ ID NO: 2512021 - protein, 19 aa, Entamoeba dispar
CVTKYGNVFGIFFHSVKIL

SEQ ID NO: 2512022 - protein, 17 aa, Entamoeba dispar
CVYGEGVSTVFKKFTGF

SEQ ID NO: 2512023 - protein, 18 aa, Entamoeba dispar
CWDAEIRLSYGWVECVGH

SEQ ID NO: 2512024 - protein, 18 aa, Entamoeba dispar
CWHEEFLRMSCVILGEYP

SEQ ID NO: 2512025 - protein, 23 aa, Entamoeba dispar
CWSTLRLCVEHQFGGVNSQQKKD

SEQ ID NO: 2512026 - protein, 17 aa, Entamoeba dispar
CYDICYLWIGKDVSAID

SEQ ID NO: 2512027 - protein, 19 aa, Entamoeba dispar
CYERSVIFIDEIDSLLSAR

SEQ ID NO: 2512028 - protein, 24 aa, Entamoeba dispar
CYFFKRLPWVLPIQLKRFTWDEKK

SEQ ID NO: 2512029 - protein, 20 aa, Entamoeba dispar
CYFVPELMRLTGMSDDMRAD

SEQ ID NO: 2512030 - protein, 23 aa, Entamoeba dispar
CYKTCCYPCRVPFFISNFTARGC

SEQ ID NO: 2512031 - protein, 21 aa, Entamoeba dispar
CYLHDFYLLPSFRGQGLGHKL

SEQ ID NO: 2512032 - protein, 24 aa, Entamoeba dispar
CYSISRRFIIMFTELIRLINRIIP

SEQ ID NO: 2512033 - protein, 23 aa, Entamoeba dispar
DAFVGSYARCWAIGLDPKRSAEI

SEQ ID NO: 2512034 - protein, 20 aa, Entamoeba dispar
DAGRCTRPLFTVSNNNGHYT

SEQ ID NO: 2512035 - protein, 18 aa, Entamoeba dispar
DALGEVCQMLNWTSFSFD

SEQ ID NO: 2512036 - protein, 21 aa, Entamoeba dispar
DALKMYKDRVNLLEQQVQSKQ

SEQ ID NO: 2512037 - protein, 22 aa, Entamoeba dispar
DALSAYCRYLPPAGTLFQPLVA

SEQ ID NO: 2512038 - protein, 20 aa, Entamoeba dispar
DARTKWHVMNAYTLHREQLD

SEQ ID NO: 2512039 - protein, 20 aa, Entamoeba dispar
DAVGCPWTPFDLSTTPLASR

SEQ ID NO: 2512040 - protein, 18 aa, Entamoeba dispar
DCAKRIIIEATKILKQEP

SEQ ID NO: 2512041 - protein, 18 aa, Entamoeba dispar
DCALMLLSLNIDNLSETI

SEQ ID NO: 2512042 - protein, 22 aa, Entamoeba dispar
DCCLELPLNLIIPVLYFAFNNM

SEQ ID NO: 2512043 - protein, 18 aa, Entamoeba dispar
DCENEMFLWLGNKCQVKV

SEQ ID NO: 2512044 - protein, 23 aa, Entamoeba dispar
DCGKIWRMRACCVIYVNFANKKE

SEQ ID NO: 2512045 - protein, 20 aa, Entamoeba dispar
DCITGFVIECCQKMSGHINQ

SEQ ID NO: 2512046 - protein, 18 aa, Entamoeba dispar
DCKIKELYFPRALALFCE

SEQ ID NO: 2512047 - protein, 20 aa, Entamoeba dispar
DCKLISCGLLKMKLKKRDVM

SEQ ID NO: 2512048 - protein, 18 aa, Entamoeba dispar
DCLLKMVLIDSVKFFPHQ

SEQ ID NO: 2512049 - protein, 21 aa, Entamoeba dispar
DCNRIRFIPSTSFIVTQQSLI

SEQ ID NO: 2512050 - protein, 17 aa, Entamoeba dispar
DCWSVGCVLYCLITGNF

SEQ ID NO: 2512051 - protein, 19 aa, Entamoeba dispar
DCYRTIYQLIGHIFNDKRD

SEQ ID NO: 2512052 - protein, 18 aa, Entamoeba dispar
DCYSEMYMWVGTRVIKDR

SEQ ID NO: 2512053 - protein, 22 aa, Entamoeba dispar
DDFCGGSMGLLAVRQSELLIVL

SEQ ID NO: 2512054 - protein, 22 aa, Entamoeba dispar
DDFRKAAAVQIVMLGGEYIGNK

SEQ ID NO: 2512055 - protein, 17 aa, Entamoeba dispar
DDIKYQIAWFFTNLAVS

SEQ ID NO: 2512056 - protein, 22 aa, Entamoeba dispar
DDIRKSALLCFGRTINKIDDLR

SEQ ID NO: 2512057 - protein, 17 aa, Entamoeba dispar
DDITVDMVIEWLCLNIP

SEQ ID NO: 2512058 - protein, 17 aa, Entamoeba dispar
DDKELNQMLSIKRLAPY

SEQ ID NO: 2512059 - protein, 18 aa, Entamoeba dispar
DDKRTCCFTKSYTKIVEG

SEQ ID NO: 2512060 - protein, 20 aa, Entamoeba dispar
DDLCQWTKLNAINHIETITM

SEQ ID NO: 2512061 - protein, 22 aa, Entamoeba dispar
DDLRQDCLILRAFKLFDNLWRM

SEQ ID NO: 2512062 - protein, 17 aa, Entamoeba dispar
DDSLTFSQANIFSGSTL

SEQ ID NO: 2512063 - protein, 17 aa, Entamoeba dispar
DDSRYQFKYGLRPGEDI

SEQ ID NO: 2512064 - protein, 18 aa, Entamoeba dispar
DEAHLIAFMAIRTFFAKK

SEQ ID NO: 2512065 - protein, 18 aa, Entamoeba dispar
DEALRLLQHYPLKNFNDL

SEQ ID NO: 2512066 - protein, 20 aa, Entamoeba dispar
DECKYCKTPCGSGCCTKISS

SEQ ID NO: 2512067 - protein, 19 aa, Entamoeba dispar
DEFMLCISVYGFGNMEPIL

SEQ ID NO: 2512068 - protein, 19 aa, Entamoeba dispar
DEHYCGMSFRGDEKKSIFG

SEQ ID NO: 2512069 - protein, 24 aa, Entamoeba dispar
DEIKKEDKGSCLILIELENKEKIK

SEQ ID NO: 2512070 - protein, 21 aa, Entamoeba dispar
DEIRITLDYTFRLVKQITSKQ

SEQ ID NO: 2512071 - protein, 18 aa, Entamoeba dispar
DEITRLGSVPVFVSNWHD

SEQ ID NO: 2512072 - protein, 19 aa, Entamoeba dispar
DEKCTVCTLIPSAAPTERS

SEQ ID NO: 2512073 - protein, 18 aa, Entamoeba dispar
DEKSIFCIIKSQIGIDEA

SEQ ID NO: 2512074 - protein, 18 aa, Entamoeba dispar
DELLRSIYSYGFEKPSAI

SEQ ID NO: 2512075 - protein, 19 aa, Entamoeba dispar
DENCGYCHIGVVANINSNE

SEQ ID NO: 2512076 - protein, 21 aa, Entamoeba dispar
DEPFRWEGCSWGWGWDTVDSW

SEQ ID NO: 2512077 - protein, 17 aa, Entamoeba dispar
DEPWYLKFNNSAIFANK

SEQ ID NO: 2512078 - protein, 21 aa, Entamoeba dispar
DEVLTMYLVYYVLKDKNIRDD

SEQ ID NO: 2512079 - protein, 17 aa, Entamoeba dispar
DEYEFLGLEPNDLIAFK

SEQ ID NO: 2512080 - protein, 23 aa, Entamoeba dispar
DFCCCSVCKIAYCEQHKNKLEII

SEQ ID NO: 2512081 - protein, 22 aa, Entamoeba dispar
DFGESFVSIFPFYNGTYIFNAS

SEQ ID NO: 2512082 - protein, 19 aa, Entamoeba dispar
DFICCLCVSMLVEIKRQLL

SEQ ID NO: 2512083 - protein, 17 aa, Entamoeba dispar
DFIKLKLTVSIPEATAF

SEQ ID NO: 2512084 - protein, 20 aa, Entamoeba dispar
DFIPLFSCICGNDFTKPFSH

SEQ ID NO: 2512085 - protein, 18 aa, Entamoeba dispar
DFIRFCILSFTSLFPQDI

SEQ ID NO: 2512086 - protein, 23 aa, Entamoeba dispar
DFITACTNIRCAIFNLQGISRFE

SEQ ID NO: 2512087 - protein, 17 aa, Entamoeba dispar
DFKFPDQRVRDFALKCL

SEQ ID NO: 2512088 - protein, 25 aa, Entamoeba dispar
DFNSSIPKPQPASVIRSRTNTFNFD

SEQ ID NO: 2512089 - protein, 17 aa, Entamoeba dispar
DFPEFPGKLIVHSEEGL

SEQ ID NO: 2512090 - protein, 24 aa, Entamoeba dispar
DFRFPDEQVRLFALKCLDAMKDYE

SEQ ID NO: 2512091 - protein, 25 aa, Entamoeba dispar
DFRFPDEQVRLFALKCLDAMKDYEL

SEQ ID NO: 2512092 - protein, 24 aa, Entamoeba dispar
DFSPVCGFMGMILMDQRPELKIID

SEQ ID NO: 2512093 - protein, 18 aa, Entamoeba dispar
DFVRMFFNRFFTLLREGD

SEQ ID NO: 2512094 - protein, 26 aa, Entamoeba dispar
DGDDRLWLRLGKEYTISKEKSSNVIV

SEQ ID NO: 2512095 - protein, 19 aa, Entamoeba dispar
DGFISRSLPHFALHSRTPQ

SEQ ID NO: 2512096 - protein, 18 aa, Entamoeba dispar
DGIIFRDLLRALGVPCGN

SEQ ID NO: 2512097 - protein, 23 aa, Entamoeba dispar
DGILKECLLYGIGMHHAGLNDHD

SEQ ID NO: 2512098 - protein, 25 aa, Entamoeba dispar
DGKNWREIYKSLLVLDNILKNGSEE

SEQ ID NO: 2512099 - protein, 27 aa, Entamoeba dispar
DGKTYRFYPEKSYCYLIKNADTIRLMD

SEQ ID NO: 2512100 - protein, 26 aa, Entamoeba dispar
DGKYWRHIYKSLLLIYYIIINGTPEA

SEQ ID NO: 2512101 - protein, 22 aa, Entamoeba dispar
DGLKLYPCLVIRGTRLYEMWRK

SEQ ID NO: 2512102 - protein, 19 aa, Entamoeba dispar
DGLLREMMRTELETKLHQA

SEQ ID NO: 2512103 - protein, 21 aa, Entamoeba dispar
DGLRRSMCIKLEMREKFAKDL

SEQ ID NO: 2512104 - protein, 19 aa, Entamoeba dispar
DGRPIPFWLYKLHGLGTEF

SEQ ID NO: 2512105 - protein, 19 aa, Entamoeba dispar
DGRYCYGWGKSISIIELES

SEQ ID NO: 2512106 - protein, 17 aa, Entamoeba dispar
DGVLFYKKFKSIEHSSQ

SEQ ID NO: 2512107 - protein, 17 aa, Entamoeba dispar
DGWRGLSVVHMGDQDVP

SEQ ID NO: 2512108 - protein, 30 aa, Entamoeba dispar
DGYQFCIGFYFSIQSVKEWEWIVVGQNSFA

SEQ ID NO: 2512109 - protein, 18 aa, Entamoeba dispar
DHPYVLKCCGGFFASPYN

SEQ ID NO: 2512110 - protein, 18 aa, Entamoeba dispar
DHVCDYCPYEGMTYRVFN

SEQ ID NO: 2512111 - protein, 18 aa, Entamoeba dispar
DIAKEMFKWLMSNNPEGV

SEQ ID NO: 2512112 - protein, 25 aa, Entamoeba dispar
DIAKYCNANAFFRYDCFEDKIMVSS

SEQ ID NO: 2512113 - protein, 18 aa, Entamoeba dispar
DIDVRRCLFGNILCAGGN

SEQ ID NO: 2512114 - protein, 23 aa, Entamoeba dispar
DIFKEGKHLFGLHDIVQKGIEIN

SEQ ID NO: 2512115 - protein, 19 aa, Entamoeba dispar
DIGKIEWKKNIFDLLEKQI

SEQ ID NO: 2512116 - protein, 22 aa, Entamoeba dispar
DIHRAIRCGFILSGGPAAGGHN

SEQ ID NO: 2512117 - protein, 18 aa, Entamoeba dispar
DIIPHLLTLISLQNIIST

SEQ ID NO: 2512118 - protein, 23 aa, Entamoeba dispar
DIKLLKILFYFPMIQTIQVQYCD

SEQ ID NO: 2512119 - protein, 18 aa, Entamoeba dispar
DILSEFGYFFQVSRTIGK

SEQ ID NO: 2512120 - protein, 17 aa, Entamoeba dispar
DILSWLGNSDFGFACYK

SEQ ID NO: 2512121 - protein, 21 aa, Entamoeba dispar
DILWKRYKFLLVKKIIERHNS

SEQ ID NO: 2512122 - protein, 23 aa, Entamoeba dispar
DIPKCPKCGGLIKLDVVLFGEEL

SEQ ID NO: 2512123 - protein, 24 aa, Entamoeba dispar
DIQCKSMLLSIFSKFTFPEANQII

SEQ ID NO: 2512124 - protein, 24 aa, Entamoeba dispar
DIQNELYESFSLCFSNELSQKQMK

SEQ ID NO: 2512125 - protein, 19 aa, Entamoeba dispar
DIQRYILINAFQFDSGEND

SEQ ID NO: 2512126 - protein, 25 aa, Entamoeba dispar
DIRIMASLCLLELIQKFDIGVAYQE

SEQ ID NO: 2512127 - protein, 22 aa, Entamoeba dispar
DIRLRLCPHISLDDIKTFLYLN

SEQ ID NO: 2512128 - protein, 20 aa, Entamoeba dispar
DISPLIIMLIFEWNDVVEEL

SEQ ID NO: 2512129 - protein, 26 aa, Entamoeba dispar
DISSCLSIALDSCWKLNKEIELIIQS

SEQ ID NO: 2512130 - protein, 20 aa, Entamoeba dispar
DISWTNRWGRFIGYSDTASI

SEQ ID NO: 2512131 - protein, 22 aa, Entamoeba dispar
DISWTNRWGRFIGYSDTASITL

SEQ ID NO: 2512132 - protein, 17 aa, Entamoeba dispar
DIVSLLLLNGCNVNTQD

SEQ ID NO: 2512133 - protein, 18 aa, Entamoeba dispar
DIWALGCLLYELYTSKML

SEQ ID NO: 2512134 - protein, 23 aa, Entamoeba dispar
DIYEVHGLLPLFTKVYQFVGKEK

SEQ ID NO: 2512135 - protein, 19 aa, Entamoeba dispar
DKAQRIELFISFYNESVKP

SEQ ID NO: 2512136 - protein, 17 aa, Entamoeba dispar
DKESFKNVVNWYQETQR

SEQ ID NO: 2512137 - protein, 23 aa, Entamoeba dispar
DKESWKAIPAMRLMPLLETALGY

SEQ ID NO: 2512138 - protein, 24 aa, Entamoeba dispar
DKGEWSTKCVLAYCDSGYKFDYNK

SEQ ID NO: 2512139 - protein, 24 aa, Entamoeba dispar
DKHGWTLLHYAAWFNKSHICSMLM

SEQ ID NO: 2512140 - protein, 18 aa, Entamoeba dispar
DKKCIWYDLQAGLDPFKV

SEQ ID NO: 2512141 - protein, 21 aa, Entamoeba dispar
DKKTEICIVKGYATGEVNEVI

SEQ ID NO: 2512142 - protein, 17 aa, Entamoeba dispar
DKLEWKRLIVVLENAPI

SEQ ID NO: 2512143 - protein, 17 aa, Entamoeba dispar
DKLFEIINKYLLHQHPR

SEQ ID NO: 2512144 - protein, 18 aa, Entamoeba dispar
DKLMINWFKIRSIGNLVK

SEQ ID NO: 2512145 - protein, 18 aa, Entamoeba dispar
DKLNCYYLNVSHIQNLRE

SEQ ID NO: 2512146 - protein, 21 aa, Entamoeba dispar
DKPCPYCKTVSPKIVLNDSKT

SEQ ID NO: 2512147 - protein, 22 aa, Entamoeba dispar
DKPWYLKFNCLYIYKDNTENPL

SEQ ID NO: 2512148 - protein, 20 aa, Entamoeba dispar
DKQKAAGIIIDWDDNGDEED

SEQ ID NO: 2512149 - protein, 18 aa, Entamoeba dispar
DKSINCFDLSHSNPQRVS

SEQ ID NO: 2512150 - protein, 19 aa, Entamoeba dispar
DKTLINWFKIRGIGNLIKE

SEQ ID NO: 2512151 - protein, 17 aa, Entamoeba dispar
DKTSFEMVGYWLSEMEK

SEQ ID NO: 2512152 - protein, 17 aa, Entamoeba dispar
DLAAFILFRVVNLTLQN

SEQ ID NO: 2512153 - protein, 19 aa, Entamoeba dispar
DLECLTFIRDVWKSSSVRW

SEQ ID NO: 2512154 - protein, 19 aa, Entamoeba dispar
DLFRSLRVNWIITKVREGL

SEQ ID NO: 2512155 - protein, 19 aa, Entamoeba dispar
DLHYSKQCHFVGMKPKEQN

SEQ ID NO: 2512156 - protein, 20 aa, Entamoeba dispar
DLIEICRLFCLGGASKEKTK

SEQ ID NO: 2512157 - protein, 19 aa, Entamoeba dispar
DLIPKAVIHFLVFKTRDSL

SEQ ID NO: 2512158 - protein, 19 aa, Entamoeba dispar
DLKDGLILIRFLTNISGKE

SEQ ID NO: 2512159 - protein, 24 aa, Entamoeba dispar
DLKTEFSDGILFARILNYYKPNII

SEQ ID NO: 2512160 - protein, 18 aa, Entamoeba dispar
DLLFEFGYLFEIQKETKE

SEQ ID NO: 2512161 - protein, 17 aa, Entamoeba dispar
DLLKPKIFYGLRSDCYI

SEQ ID NO: 2512162 - protein, 23 aa, Entamoeba dispar
DLLKRKLEILEWFNKELALLINE

SEQ ID NO: 2512163 - protein, 25 aa, Entamoeba dispar
DLMEIEICFFKGLEMRSKYQDERQV

SEQ ID NO: 2512164 - protein, 18 aa, Entamoeba dispar
DLNIKFGLYIKEIDEEEA

SEQ ID NO: 2512165 - protein, 22 aa, Entamoeba dispar
DLNRTAISFSWLIQLAEQNGIS

SEQ ID NO: 2512166 - protein, 23 aa, Entamoeba dispar
DLPCLTSLDCSRCHFNISDIISR

SEQ ID NO: 2512167 - protein, 26 aa, Entamoeba dispar
DLQSDIKRFQEISEKIKTQNESIMKA

SEQ ID NO: 2512168 - protein, 17 aa, Entamoeba dispar
DLYCIYNPIRICDDKNY

SEQ ID NO: 2512169 - protein, 22 aa, Entamoeba dispar
DNCARAALHGIDFSKDKITFYG

SEQ ID NO: 2512170 - protein, 29 aa, Entamoeba dispar
DNCPPEQLPESWKIILREAGVKKKDLQNP

SEQ ID NO: 2512171 - protein, 22 aa, Entamoeba dispar
DNDCKRWFWELVQNAKDSIVND

SEQ ID NO: 2512172 - protein, 18 aa, Entamoeba dispar
DNDLFLARQVLKNITHNT

SEQ ID NO: 2512173 - protein, 18 aa, Entamoeba dispar
DNDSKFPSFEPIQQQPQQ

SEQ ID NO: 2512174 - protein, 23 aa, Entamoeba dispar
DNELKILILQTFHMVQKQIDELK

SEQ ID NO: 2512175 - protein, 17 aa, Entamoeba dispar
DNEWAIAEWNRYKQRND

SEQ ID NO: 2512176 - protein, 23 aa, Entamoeba dispar
DNFIRRFDCTFNFDGTSGSIAKM

SEQ ID NO: 2512177 - protein, 17 aa, Entamoeba dispar
DNFWKIICEEIGNHNPL

SEQ ID NO: 2512178 - protein, 24 aa, Entamoeba dispar
DNGEWSTKCVLSYCDEGYKFDYNN

SEQ ID NO: 2512179 - protein, 23 aa, Entamoeba dispar
DNIKWIFELAMKFIELEDIQNAV

SEQ ID NO: 2512180 - protein, 18 aa, Entamoeba dispar
DNKFSKYTLERVPKEFAN

SEQ ID NO: 2512181 - protein, 22 aa, Entamoeba dispar
DNLKTKFVYYSRDWEDFLKSNN

SEQ ID NO: 2512182 - protein, 20 aa, Entamoeba dispar
DNLNGFKWNNMRIIQCKEDK

SEQ ID NO: 2512183 - protein, 18 aa, Entamoeba dispar
DPAQCWAEGPGVEGGCKT

SEQ ID NO: 2512184 - protein, 22 aa, Entamoeba dispar
DPFKVLRLHTAAVRAVDVHKIL

SEQ ID NO: 2512185 - protein, 20 aa, Entamoeba dispar
DPKRSAEISVRIASDSVTRH

SEQ ID NO: 2512186 - protein, 24 aa, Entamoeba dispar
DPQKLKECFKWDIKCQNIKTFWKR

SEQ ID NO: 2512187 - protein, 19 aa, Entamoeba dispar
DQFFWVYKFLKGVQERDVF

SEQ ID NO: 2512188 - protein, 23 aa, Entamoeba dispar
DQFKMPWDIAKFVIAGKRLERKD

SEQ ID NO: 2512189 - protein, 17 aa, Entamoeba dispar
DQHHCFYDWMLKRGEGE

SEQ ID NO: 2512190 - protein, 23 aa, Entamoeba dispar
DQIGLKSDEFFPFGDTALIKNNL

SEQ ID NO: 2512191 - protein, 22 aa, Entamoeba dispar
DQKSIPGWGNWVGEGIQKKTKK

SEQ ID NO: 2512192 - protein, 17 aa, Entamoeba dispar
DQLFRYFGLKKAEFLQA

SEQ ID NO: 2512193 - protein, 22 aa, Entamoeba dispar
DQMKEWFIKKVIPQIINRKMKF

SEQ ID NO: 2512194 - protein, 24 aa, Entamoeba dispar
DRFNKFIRRYFQVSAQQQVIQQQP

SEQ ID NO: 2512195 - protein, 24 aa, Entamoeba dispar
DRGDVRFVIHWNIPKTIEGFMQEA

SEQ ID NO: 2512196 - protein, 17 aa, Entamoeba dispar
DRIKEMIKRGASPYQYY

SEQ ID NO: 2512197 - protein, 23 aa, Entamoeba dispar
DRIKYKLEIPVMWNEDSNTHEDE

SEQ ID NO: 2512198 - protein, 21 aa, Entamoeba dispar
DRILPFISMLIQWEILHTNNK

SEQ ID NO: 2512199 - protein, 19 aa, Entamoeba dispar
DRKRYGLKIPKGFNAIGDE

SEQ ID NO: 2512200 - protein, 17 aa, Entamoeba dispar
DRLKAVIGNVHRLGITN

SEQ ID NO: 2512201 - protein, 20 aa, Entamoeba dispar
DRLSLFYSIISKINFQFHSS

SEQ ID NO: 2512202 - protein, 20 aa, Entamoeba dispar
DRMMYKLGYVDRVMDVLKRR

SEQ ID NO: 2512203 - protein, 17 aa, Entamoeba dispar
DRMSCIRSSCFYDSDNF

SEQ ID NO: 2512204 - protein, 20 aa, Entamoeba dispar
DRSFVDWLLCKTINGERASL

SEQ ID NO: 2512205 - protein, 17 aa, Entamoeba dispar
DRTCKKFSVACSRKDMF

SEQ ID NO: 2512206 - protein, 19 aa, Entamoeba dispar
DRVGFNIVYQAIKDGRLKP

SEQ ID NO: 2512207 - protein, 17 aa, Entamoeba dispar
DRYLVLACDGVWDVMSD

SEQ ID NO: 2512208 - protein, 19 aa, Entamoeba dispar
DSCGVVRGMMSSVMNYLLN

SEQ ID NO: 2512209 - protein, 25 aa, Entamoeba dispar
DSDFHRSWCAFRCTQLLTLLDQIVS

SEQ ID NO: 2512210 - protein, 18 aa, Entamoeba dispar
DSFIFVFKRIRIIMFKDI

SEQ ID NO: 2512211 - protein, 21 aa, Entamoeba dispar
DSIELYKRFDLESLKMQIQQE

SEQ ID NO: 2512212 - protein, 17 aa, Entamoeba dispar
DSIRKSLEWQRKSNENL

SEQ ID NO: 2512213 - protein, 18 aa, Entamoeba dispar
DSISWKILCETISVYELP

SEQ ID NO: 2512214 - protein, 18 aa, Entamoeba dispar
DSLCCGYGMFPLPQCDNV

SEQ ID NO: 2512215 - protein, 18 aa, Entamoeba dispar
DSLPRWVVTAAPLNQSTV

SEQ ID NO: 2512216 - protein, 19 aa, Entamoeba dispar
DSMKCCIKGYVVHKSRINE

SEQ ID NO: 2512217 - protein, 21 aa, Entamoeba dispar
DSMKKCVNAFILSHNELTIKE

SEQ ID NO: 2512218 - protein, 19 aa, Entamoeba dispar
DSRIRYSIMSNFDERFDYY

SEQ ID NO: 2512219 - protein, 21 aa, Entamoeba dispar
DSTGKICLCIGKKYMKVVDLY

SEQ ID NO: 2512220 - protein, 20 aa, Entamoeba dispar
DSVFRFVLNNTLLVDTLDNA

SEQ ID NO: 2512221 - protein, 22 aa, Entamoeba dispar
DSWRLRIGQFITFPNYQRKKLG

SEQ ID NO: 2512222 - protein, 24 aa, Entamoeba dispar
DSYFKLKANFLAVALKTRTAEKSS

SEQ ID NO: 2512223 - protein, 17 aa, Entamoeba dispar
DTGDFKPSPGFKMPCKE

SEQ ID NO: 2512224 - protein, 24 aa, Entamoeba dispar
DTLRLLTILFKFGKYYEVEHAISS

SEQ ID NO: 2512225 - protein, 19 aa, Entamoeba dispar
DTRKYYSLKNMEIEEYPHT

SEQ ID NO: 2512226 - protein, 18 aa, Entamoeba dispar
DTVDSWKVTRVEFIDNNI

SEQ ID NO: 2512227 - protein, 24 aa, Entamoeba dispar
DTYKGVPAGETWVWYTNPNPRPKT

SEQ ID NO: 2512228 - protein, 17 aa, Entamoeba dispar
DVCYSWWVLTSLIILGK

SEQ ID NO: 2512229 - protein, 18 aa, Entamoeba dispar
DVDFLFKIADFDGDDKIG

SEQ ID NO: 2512230 - protein, 22 aa, Entamoeba dispar
DVGEFRLIFAGRVLKDDEVLST

SEQ ID NO: 2512231 - protein, 18 aa, Entamoeba dispar
DVGLIVCFLLRYEIFEPY

SEQ ID NO: 2512232 - protein, 25 aa, Entamoeba dispar
DVGRYAVLCALQFSLTLCLPHDTIS

SEQ ID NO: 2512233 - protein, 24 aa, Entamoeba dispar
DVKQAVAVALKFGLEKEIWDEMVK

SEQ ID NO: 2512234 - protein, 21 aa, Entamoeba dispar
DVLHLSTFFPIIFRCSALSPD

SEQ ID NO: 2512235 - protein, 17 aa, Entamoeba dispar
DVLSTVCSMTWREFSLK

SEQ ID NO: 2512236 - protein, 23 aa, Entamoeba dispar
DVNIWLCLPGTLTVSISIDGHMI

SEQ ID NO: 2512237 - protein, 17 aa, Entamoeba dispar
DVPAGYYDIRICTYSGL

SEQ ID NO: 2512238 - protein, 21 aa, Entamoeba dispar
DVTLCKYCDFIYIAITEDEKY

SEQ ID NO: 2512239 - protein, 18 aa, Entamoeba dispar
DVVFGRAFNVAMSQKPPC

SEQ ID NO: 2512240 - protein, 21 aa, Entamoeba dispar
DVYFARWSPIISICNKVGGNL

SEQ ID NO: 2512241 - protein, 21 aa, Entamoeba dispar
DWCCDCCCDCCDCGDCCSDKK

SEQ ID NO: 2512242 - protein, 20 aa, Entamoeba dispar
DWDIKCFAFAPAAAFSKEIA

SEQ ID NO: 2512243 - protein, 21 aa, Entamoeba dispar
DWNKIIGWCEEWNKIDIQMNN

SEQ ID NO: 2512244 - protein, 24 aa, Entamoeba dispar
DWQQSDFLWSGRCLVTRSPEHCIV

SEQ ID NO: 2512245 - protein, 20 aa, Entamoeba dispar
DYCLYFYLTFFIMKETHFED

SEQ ID NO: 2512246 - protein, 18 aa, Entamoeba dispar
DYCWACFEFKKGKPSVVC

SEQ ID NO: 2512247 - protein, 22 aa, Entamoeba dispar
DYKQCVWLLIGIKDLGGKIRKS

SEQ ID NO: 2512248 - protein, 21 aa, Entamoeba dispar
DYLTVRICLWVLYQLLCQIKT

SEQ ID NO: 2512249 - protein, 18 aa, Entamoeba dispar
DYNIAKCRIITFKGKSES

SEQ ID NO: 2512250 - protein, 18 aa, Entamoeba dispar
DYPCCLRLIKIDVSDSRK

SEQ ID NO: 2512251 - protein, 23 aa, Entamoeba dispar
DYQVCVQCTLIALLNEQYSFLIQ

SEQ ID NO: 2512252 - protein, 19 aa, Entamoeba dispar
DYSEFKRLTLLLTKLPRKR

SEQ ID NO: 2512253 - protein, 17 aa, Entamoeba dispar
DYSPSLNVDLCWDDPYP

SEQ ID NO: 2512254 - protein, 17 aa, Entamoeba dispar
DYYKISPLIPFLLKQLG

SEQ ID NO: 2512255 - protein, 20 aa, Entamoeba dispar
DYYRVCSSEELILKDQEKKS

SEQ ID NO: 2512256 - protein, 26 aa, Entamoeba dispar
DYYVIRTNWYWRHQIRIMRFGKEHFY

SEQ ID NO: 2512257 - protein, 18 aa, Entamoeba dispar
EACKIGLEFQKKVFCVLG

SEQ ID NO: 2512258 - protein, 19 aa, Entamoeba dispar
EACVLKFYLAPKFDEEDEP

SEQ ID NO: 2512259 - protein, 19 aa, Entamoeba dispar
EAHRACMKYCKPGMYEFEL

SEQ ID NO: 2512260 - protein, 22 aa, Entamoeba dispar
EAIRRYGPPPSYREIIPLLYQN

SEQ ID NO: 2512261 - protein, 24 aa, Entamoeba dispar
EAKDRFRLLYTFLRKNKNKKTIVF

SEQ ID NO: 2512262 - protein, 19 aa, Entamoeba dispar
EAKMIYEMICKKKAPKVSS

SEQ ID NO: 2512263 - protein, 18 aa, Entamoeba dispar
EAKYRVTYKVSEHGDYTI

SEQ ID NO: 2512264 - protein, 17 aa, Entamoeba dispar
EALICWKQAIDITPFHA

SEQ ID NO: 2512265 - protein, 23 aa, Entamoeba dispar
EALKIVGAFVFLRLINPVLLTPL

SEQ ID NO: 2512266 - protein, 22 aa, Entamoeba dispar
EALKRILMCYGIYDMETMYMQG

SEQ ID NO: 2512267 - protein, 18 aa, Entamoeba dispar
EALLRPGRFDRILYVGLP

SEQ ID NO: 2512268 - protein, 23 aa, Entamoeba dispar
EALTSVIGPIAFEYTIELWKTLL

SEQ ID NO: 2512269 - protein, 24 aa, Entamoeba dispar
EANIKWTNRWGRFIGYSDTASITL

SEQ ID NO: 2512270 - protein, 18 aa, Entamoeba dispar
EAPCAGVAEVLRRYNEIT

SEQ ID NO: 2512271 - protein, 18 aa, Entamoeba dispar
EAWEIIQKGFTLRHTSAT

SEQ ID NO: 2512272 - protein, 19 aa, Entamoeba dispar
EAWRCWKANIPWKVPGLPE

SEQ ID NO: 2512273 - protein, 20 aa, Entamoeba dispar
ECDYWSVGCILFEMLAGYPP

SEQ ID NO: 2512274 - protein, 17 aa, Entamoeba dispar
ECFKCCYNLKKINIPNS

SEQ ID NO: 2512275 - protein, 20 aa, Entamoeba dispar
ECFSCCYIAGEIKCSSKIMK

SEQ ID NO: 2512276 - protein, 17 aa, Entamoeba dispar
ECFYGCLSLTTINIPTS

SEQ ID NO: 2512277 - protein, 19 aa, Entamoeba dispar
ECHAVLKKDEGTICRNCHE

SEQ ID NO: 2512278 - protein, 19 aa, Entamoeba dispar
ECIAFKKAIKYFGYTTARG

SEQ ID NO: 2512279 - protein, 17 aa, Entamoeba dispar
ECIMAFISMTLLSPVAV

SEQ ID NO: 2512280 - protein, 21 aa, Entamoeba dispar
ECKHLRIGIQLDDLSVFEPIE

SEQ ID NO: 2512281 - protein, 19 aa, Entamoeba dispar
ECVFLFATECFKIYNIEPF

SEQ ID NO: 2512282 - protein, 24 aa, Entamoeba dispar
ECYGKILAIVIRWVMYRYGKTIET

SEQ ID NO: 2512283 - protein, 21 aa, Entamoeba dispar
ECYTCQCDIWSIGVITYLVLS

SEQ ID NO: 2512284 - protein, 23 aa, Entamoeba dispar
EDEHICIINEGFPVKIHLCETKE

SEQ ID NO: 2512285 - protein, 24 aa, Entamoeba dispar
EDELRTVLMIAPWFPHKSIQQISL

SEQ ID NO: 2512286 - protein, 18 aa, Entamoeba dispar
EDFLKVLHFLLVKKKLPT

SEQ ID NO: 2512287 - protein, 19 aa, Entamoeba dispar
EDIIKSGILPLVISLLSEQ

SEQ ID NO: 2512288 - protein, 17 aa, Entamoeba dispar
EDIKIFITQFVKRCVNE

SEQ ID NO: 2512289 - protein, 24 aa, Entamoeba dispar
EDQKSIPGWGNWVGEGIQKKTKKN

SEQ ID NO: 2512290 - protein, 19 aa, Entamoeba dispar
EDVNPIFIRQMVNNIKKKI

SEQ ID NO: 2512291 - protein, 20 aa, Entamoeba dispar
EDVVSFALRCEGHYLNVLKD

SEQ ID NO: 2512292 - protein, 17 aa, Entamoeba dispar
EDYCRRLINSIKRGDDI

SEQ ID NO: 2512293 - protein, 22 aa, Entamoeba dispar
EDYKDVIVCVGQNKKILSNSSL

SEQ ID NO: 2512294 - protein, 20 aa, Entamoeba dispar
EECTRCWTIVYSHGNSQDLG

SEQ ID NO: 2512295 - protein, 20 aa, Entamoeba dispar
EEDIKIFITQFVKRCVNENK

SEQ ID NO: 2512296 - protein, 33 aa, Entamoeba dispar
EEFCGHYMFPYCILNKHLPFWGGYVGSHFEIEW

SEQ ID NO: 2512297 - protein, 23 aa, Entamoeba dispar
EEFKECACAAAIIKEYLRELPDP

SEQ ID NO: 2512298 - protein, 17 aa, Entamoeba dispar
EEFKFKGFRQLLKEMTV

SEQ ID NO: 2512299 - protein, 19 aa, Entamoeba dispar
EEFTCITMGKKIYLGGKGG

SEQ ID NO: 2512300 - protein, 17 aa, Entamoeba dispar
EEFVRYYSLLIIQNANC

SEQ ID NO: 2512301 - protein, 17 aa, Entamoeba dispar
EEIKYIYTIIKGIRSLN

SEQ ID NO: 2512302 - protein, 20 aa, Entamoeba dispar
EEIRLLFIKKERDMIIMGFN

SEQ ID NO: 2512303 - protein, 17 aa, Entamoeba dispar
EEITQCFQIFKQIHFQI

SEQ ID NO: 2512304 - protein, 24 aa, Entamoeba dispar
EEIWKKFVEWCMKRTPSIAESLLK

SEQ ID NO: 2512305 - protein, 22 aa, Entamoeba dispar
EEKEFYTIFGTYFKKNAKWSIN

SEQ ID NO: 2512306 - protein, 23 aa, Entamoeba dispar
EEKLRKDRFQNFNWSGHNYLRVT

SEQ ID NO: 2512307 - protein, 18 aa, Entamoeba dispar
EELIKVYEWCLGVDEIKT

SEQ ID NO: 2512308 - protein, 22 aa, Entamoeba dispar
EELKTLFIHLLRLCNKIAQNEQ

SEQ ID NO: 2512309 - protein, 19 aa, Entamoeba dispar
EELPKSWKILVVDKEALKV

SEQ ID NO: 2512310 - protein, 24 aa, Entamoeba dispar
EELRRGCDQLARLLYALDQSKITT

SEQ ID NO: 2512311 - protein, 20 aa, Entamoeba dispar
EELRTIILTDFFKHAFDGSG

SEQ ID NO: 2512312 - protein, 21 aa, Entamoeba dispar
EELSNYCILTLKNFKNFKNNE

SEQ ID NO: 2512313 - protein, 20 aa, Entamoeba dispar
EELWKNLIIISIDIKDYRQA

SEQ ID NO: 2512314 - protein, 21 aa, Entamoeba dispar
EEMKKFIALLVMKAGTKEKAI

SEQ ID NO: 2512315 - protein, 17 aa, Entamoeba dispar
EEMPMHIDIRWLFTDSY

SEQ ID NO: 2512316 - protein, 21 aa, Entamoeba dispar
EENRCGIGLAKPEPKKLEFNG

SEQ ID NO: 2512317 - protein, 23 aa, Entamoeba dispar
EEQYKMPLSWIILKRVVQGRDWH

SEQ ID NO: 2512318 - protein, 24 aa, Entamoeba dispar
EERAYTLKLCRAIQKSGCNVLLIQ

SEQ ID NO: 2512319 - protein, 24 aa, Entamoeba dispar
EERIKELQKDAGVNFDQHFMDEDF

SEQ ID NO: 2512320 - protein, 18 aa, Entamoeba dispar
EESKELLIEIGFNKYAVQ

SEQ ID NO: 2512321 - protein, 17 aa, Entamoeba dispar
EESRLSGNFKREYEDNG

SEQ ID NO: 2512322 - protein, 24 aa, Entamoeba dispar
EESVKLFCPRCGDLYIPMPPYDSH

SEQ ID NO: 2512323 - protein, 27 aa, Entamoeba dispar
EETKECKDCGFVLMDIDDVKIQDLRQK

SEQ ID NO: 2512324 - protein, 26 aa, Entamoeba dispar
EETYNCSFCPFTFCVECYKHLCLTLG

SEQ ID NO: 2512325 - protein, 23 aa, Entamoeba dispar
EEVMCCGSFGASLFSAWMKTSSG

SEQ ID NO: 2512326 - protein, 20 aa, Entamoeba dispar
EEWDLRPLFSQLINSPSIQN

SEQ ID NO: 2512327 - protein, 19 aa, Entamoeba dispar
EEWHPYLLFCKEHREELKQ

SEQ ID NO: 2512328 - protein, 24 aa, Entamoeba dispar
EEYFRFLWELRLVFNKEMTQLQEL

SEQ ID NO: 2512329 - protein, 17 aa, Entamoeba dispar
EEYKGIIDIIRKYLKKT

SEQ ID NO: 2512330 - protein, 25 aa, Entamoeba dispar
EFEEWKIIFVDGFIRSTKFEYGINY

SEQ ID NO: 2512331 - protein, 21 aa, Entamoeba dispar
EFEPRFLFKVIEKEANQMVGK

SEQ ID NO: 2512332 - protein, 21 aa, Entamoeba dispar
EFGYWCFYKCYSLTSISIPPS

SEQ ID NO: 2512333 - protein, 22 aa, Entamoeba dispar
EFICKTCDFIIIFIDISIELNQ

SEQ ID NO: 2512334 - protein, 23 aa, Entamoeba dispar
EFIKEYFKFAGINEENIPIDMKV

SEQ ID NO: 2512335 - protein, 23 aa, Entamoeba dispar
EFKCPNLEFIGCTSMNKNEDMGI

SEQ ID NO: 2512336 - protein, 20 aa, Entamoeba dispar
EFLESGLIYELFNYLDYPFN

SEQ ID NO: 2512337 - protein, 22 aa, Entamoeba dispar
EFRSQWKYTICINLNDKKSICD

SEQ ID NO: 2512338 - protein, 18 aa, Entamoeba dispar
EFYPIMKYVFGNVLIADD

SEQ ID NO: 2512339 - protein, 18 aa, Entamoeba dispar
EGFFRINFNVPRETEEGT

SEQ ID NO: 2512340 - protein, 24 aa, Entamoeba dispar
EGFKSFKNALTWEFKSFSFEKGVE

SEQ ID NO: 2512341 - protein, 22 aa, Entamoeba dispar
EGFKTRTAFCLETQHFPDSPHH

SEQ ID NO: 2512342 - protein, 18 aa, Entamoeba dispar
EGFPFCLDCATSIVQRGK

SEQ ID NO: 2512343 - protein, 23 aa, Entamoeba dispar
EGICTNCGLVVYGHETYVNDIIN

SEQ ID NO: 2512344 - protein, 19 aa, Entamoeba dispar
EGIHLVIFGTRWLRLLFDR

SEQ ID NO: 2512345 - protein, 22 aa, Entamoeba dispar
EGIKYSIPLWLAVHFKQIGLCK

SEQ ID NO: 2512346 - protein, 17 aa, Entamoeba dispar
EGKKWGKKWVVMKKNCL

SEQ ID NO: 2512347 - protein, 21 aa, Entamoeba dispar
EGKLPSVQQFSALKSNLPSSN

SEQ ID NO: 2512348 - protein, 18 aa, Entamoeba dispar
EGKVSWLMERSMYEEAFK

SEQ ID NO: 2512349 - protein, 19 aa, Entamoeba dispar
EGLEEFGIFCLAKIFSYDS

SEQ ID NO: 2512350 - protein, 18 aa, Entamoeba dispar
EGLLRMGLHPTIIADGYR

SEQ ID NO: 2512351 - protein, 18 aa, Entamoeba dispar
EGLVRVIPNQAEILAGQQ

SEQ ID NO: 2512352 - protein, 17 aa, Entamoeba dispar
EGMKVFDVMAIIYQHIT

SEQ ID NO: 2512353 - protein, 20 aa, Entamoeba dispar
EGMPKYLWKQGVEDTVEIIE

SEQ ID NO: 2512354 - protein, 20 aa, Entamoeba dispar
EGNSGGFGWCDGLLLRAMKS

SEQ ID NO: 2512355 - protein, 18 aa, Entamoeba dispar
EGRFKILVELFGKTDDSE

SEQ ID NO: 2512356 - protein, 21 aa, Entamoeba dispar
EGRGVCLRFPRYIRTRDDKEV

SEQ ID NO: 2512357 - protein, 17 aa, Entamoeba dispar
EGRKLILEQGITKNLIE

SEQ ID NO: 2512358 - protein, 21 aa, Entamoeba dispar
EGTSGIVFKGRFREHTVAIKD

SEQ ID NO: 2512359 - protein, 18 aa, Entamoeba dispar
EGTTCCKFLVKLKGIESK

SEQ ID NO: 2512360 - protein, 18 aa, Entamoeba dispar
EGVCDCILQLISPLNNDW

SEQ ID NO: 2512361 - protein, 24 aa, Entamoeba dispar
EGVRYKFDCCGTPIDGRIRDLIVI

SEQ ID NO: 2512362 - protein, 25 aa, Entamoeba dispar
EGYILKRWVTRYVLVKRNYLIYFVS

SEQ ID NO: 2512363 - protein, 17 aa, Entamoeba dispar
EHFCYRATAQVSIAAKA

SEQ ID NO: 2512364 - protein, 21 aa, Entamoeba dispar
EHFMYPILIIRISRIIDNCLW

SEQ ID NO: 2512365 - protein, 21 aa, Entamoeba dispar
EHIIFAFNFFKGIGLVELAKP

SEQ ID NO: 2512366 - protein, 18 aa, Entamoeba dispar
EHIKRVCVIYSLEHSELQ

SEQ ID NO: 2512367 - protein, 25 aa, Entamoeba dispar
EHLGVKCVLEILPLNLDVSIVQRGN

SEQ ID NO: 2512368 - protein, 21 aa, Entamoeba dispar
EHLKRTGGIYVTRFPPEPNGY

SEQ ID NO: 2512369 - protein, 19 aa, Entamoeba dispar
EHLRLQICSSFSYDESVLY

SEQ ID NO: 2512370 - protein, 24 aa, Entamoeba dispar
EHPAFKCLYSFREIRNYQSEQESV

SEQ ID NO: 2512371 - protein, 20 aa, Entamoeba dispar
EHPHKVFLIDGFPRNEENKN

SEQ ID NO: 2512372 - protein, 26 aa, Entamoeba dispar
EHPKLFWRYILELLLLCELKVVKVYC

SEQ ID NO: 2512373 - protein, 21 aa, Entamoeba dispar
EIAESFSFLHWYISDGSNVLN

SEQ ID NO: 2512374 - protein, 22 aa, Entamoeba dispar
EIAIRFRPSWYYNEVSKQLEWV

SEQ ID NO: 2512375 - protein, 20 aa, Entamoeba dispar
EICATLPVLCEGGIAENEHL

SEQ ID NO: 2512376 - protein, 26 aa, Entamoeba dispar
EICKEIVWTPSMRRLFCLIIECIKHK

SEQ ID NO: 2512377 - protein, 19 aa, Entamoeba dispar
EICNGLWYLHFTKRLIHRD

SEQ ID NO: 2512378 - protein, 18 aa, Entamoeba dispar
EIDEFCHLYFLKKREMAI

SEQ ID NO: 2512379 - protein, 20 aa, Entamoeba dispar
EIESLCFCRCYSLSNIIIPS

SEQ ID NO: 2512380 - protein, 19 aa, Entamoeba dispar
EIFELAAKVSMGLLDAVVS

SEQ ID NO: 2512381 - protein, 20 aa, Entamoeba dispar
EIFFKLYIAYCQFGELNRKS

SEQ ID NO: 2512382 - protein, 19 aa, Entamoeba dispar
  misc_feature (16)..(17): Xaa can be any naturally occurring amino acid
EIFHFCFRKCTSLTSXXLS

SEQ ID NO: 2512383 - protein, 18 aa, Entamoeba dispar
EIFLEVYNVFSLKEEERE

SEQ ID NO: 2512384 - protein, 19 aa, Entamoeba dispar
EIFNILSPFIFSSEKFRNY

SEQ ID NO: 2512385 - protein, 19 aa, Entamoeba dispar
EIGSSCFNECISLISINIP

SEQ ID NO: 2512386 - protein, 18 aa, Entamoeba dispar
EIGSWCFCRCYSLSNIII

SEQ ID NO: 2512387 - protein, 19 aa, Entamoeba dispar
EIGSWCFCRCYSLSNIIIP

SEQ ID NO: 2512388 - protein, 22 aa, Entamoeba dispar
EIHGKWSVCWDLINKPDINKPL

SEQ ID NO: 2512389 - protein, 22 aa, Entamoeba dispar
EIHLYNRFQIISSLPYKTNYHL

SEQ ID NO: 2512390 - protein, 24 aa, Entamoeba dispar
EIICLDCVKSQWSIEEIIWLFSCV

SEQ ID NO: 2512391 - protein, 18 aa, Entamoeba dispar
EIIKSCFVIINILPQYFI

SEQ ID NO: 2512392 - protein, 19 aa, Entamoeba dispar
EIIKSRLTGLGFIGATQCT

SEQ ID NO: 2512393 - protein, 22 aa, Entamoeba dispar
EIKLFPSLFFKSSKCVFGGNIT

SEQ ID NO: 2512394 - protein, 21 aa, Entamoeba dispar
EIKLFPSLIFKSSKCVFGGNI

SEQ ID NO: 2512395 - protein, 20 aa, Entamoeba dispar
EIKNLLNWAYYLTPLDKKRS

SEQ ID NO: 2512396 - protein, 25 aa, Entamoeba dispar
EIKRIGLECPKIWIKNPFLQISMIK

SEQ ID NO: 2512397 - protein, 20 aa, Entamoeba dispar
EIKSCVWASGSMTYPITGIS

SEQ ID NO: 2512398 - protein, 24 aa, Entamoeba dispar
EIKSMLTWIRFLPHINVEEIQEPD

SEQ ID NO: 2512399 - protein, 18 aa, Entamoeba dispar
EILLPFDFVACDKFGEDA

SEQ ID NO: 2512400 - protein, 18 aa, Entamoeba dispar
EILWRWYVKKGMYEEAIK

SEQ ID NO: 2512401 - protein, 21 aa, Entamoeba dispar
EINIFLFRWGKGNHYIINNNI

SEQ ID NO: 2512402 - protein, 23 aa, Entamoeba dispar
EINNLRIPFGFYKRTLPHYWKED

SEQ ID NO: 2512403 - protein, 22 aa, Entamoeba dispar
EIPTIKLPVMFSLSESRLECLK

SEQ ID NO: 2512404 - protein, 18 aa, Entamoeba dispar
EIPYYFNKEMHLFSMNMY

SEQ ID NO: 2512405 - protein, 22 aa, Entamoeba dispar
EIQRRISGHLSRISSYSTMRLL

SEQ ID NO: 2512406 - protein, 18 aa, Entamoeba dispar
EIQRRVYGFLSRKSSKST

SEQ ID NO: 2512407 - protein, 23 aa, Entamoeba dispar
EIRACVPPEKYAVALHDYDASTD

SEQ ID NO: 2512408 - protein, 19 aa, Entamoeba dispar
EIRILFEYCDMGTFDQFIP

SEQ ID NO: 2512409 - protein, 23 aa, Entamoeba dispar
EISFKLKEMYYLLTQGGVAELEL

SEQ ID NO: 2512410 - protein, 21 aa, Entamoeba dispar
EISHWIGTMILMFPDVEMRAK

SEQ ID NO: 2512411 - protein, 21 aa, Entamoeba dispar
EITNIRFGIGFGQESKTAFIQ

SEQ ID NO: 2512412 - protein, 21 aa, Entamoeba dispar
EIVNILLRPCCFKFLHIPIQS

SEQ ID NO: 2512413 - protein, 22 aa, Entamoeba dispar
EIWLMKPCTGSVLFDIIFNIDN

SEQ ID NO: 2512414 - protein, 25 aa, Entamoeba dispar
EIYYIIASCVIKRKLYLLFTKGEIT

SEQ ID NO: 2512415 - protein, 21 aa, Entamoeba dispar
EKAFYFKYLNDVRLEMKHIET

SEQ ID NO: 2512416 - protein, 22 aa, Entamoeba dispar
EKAKAFAIAVEWYRALRSICWS

SEQ ID NO: 2512417 - protein, 23 aa, Entamoeba dispar
EKCPYCSSVLRKGEYYRFYQFDS

SEQ ID NO: 2512418 - protein, 17 aa, Entamoeba dispar
EKCSAEGKICCFKLPEL

SEQ ID NO: 2512419 - protein, 19 aa, Entamoeba dispar
EKCVFKIGFFLSEMKLRCH

SEQ ID NO: 2512420 - protein, 20 aa, Entamoeba dispar
EKDNFLCFLISFGMTSSPPI

SEQ ID NO: 2512421 - protein, 21 aa, Entamoeba dispar
EKEIKAGLTFSFAVEQIAIDK

SEQ ID NO: 2512422 - protein, 22 aa, Entamoeba dispar
EKELKYLLTTVMIRRLKNDVLK

SEQ ID NO: 2512423 - protein, 17 aa, Entamoeba dispar
EKELSIGLLWFINNNDF

SEQ ID NO: 2512424 - protein, 22 aa, Entamoeba dispar
EKENPQMIALRVRKRGKISSQM

SEQ ID NO: 2512425 - protein, 20 aa, Entamoeba dispar
EKEWFCRVCSYRLGITKLDI

SEQ ID NO: 2512426 - protein, 25 aa, Entamoeba dispar
EKFFQVYSSWDWLRAPVMLGTNDDF

SEQ ID NO: 2512427 - protein, 20 aa, Entamoeba dispar
EKHISLNLGDFVDDFIKEVN

SEQ ID NO: 2512428 - protein, 23 aa, Entamoeba dispar
EKHKSFRLSKQISFSKKDKKKDK

SEQ ID NO: 2512429 - protein, 22 aa, Entamoeba dispar
EKHLRLLWITLIPCLNVSSLTP

SEQ ID NO: 2512430 - protein, 23 aa, Entamoeba dispar
EKHPKQKVCIVRFSKDVKILGDC

SEQ ID NO: 2512431 - protein, 23 aa, Entamoeba dispar
EKIKEYFLSFFIKQEPSFDTKTL

SEQ ID NO: 2512432 - protein, 17 aa, Entamoeba dispar
EKIPFRLTRMIVNAMEV

SEQ ID NO: 2512433 - protein, 23 aa, Entamoeba dispar
EKKLDGIVLEGEWKKGFDSGNII

SEQ ID NO: 2512434 - protein, 24 aa, Entamoeba dispar
EKKNARYGFFYGIFQTTIESAFFG

SEQ ID NO: 2512435 - protein, 21 aa, Entamoeba dispar
EKKRMLIKLTLKDYIFARHDI

SEQ ID NO: 2512436 - protein, 20 aa, Entamoeba dispar
EKKVKEKKAFKLVEEHNKMV

SEQ ID NO: 2512437 - protein, 21 aa, Entamoeba dispar
EKLRNRKSCQFIPKKLSEDQQ

SEQ ID NO: 2512438 - protein, 24 aa, Entamoeba dispar
EKLVSNEIWEWILLPKEKFQKRKK

SEQ ID NO: 2512439 - protein, 17 aa, Entamoeba dispar
EKMIHCMYEKGCYCKGI

SEQ ID NO: 2512440 - protein, 19 aa, Entamoeba dispar
EKMREVIKVLPKREQYRLL

SEQ ID NO: 2512441 - protein, 22 aa, Entamoeba dispar
EKPKRRFSLSISKGSRSSSRKR

SEQ ID NO: 2512442 - protein, 18 aa, Entamoeba dispar
EKQKLCWELCKIRCQLAM

SEQ ID NO: 2512443 - protein, 19 aa, Entamoeba dispar
EKQKLCWELCKIRCQLAME

SEQ ID NO: 2512444 - protein, 24 aa, Entamoeba dispar
EKRCCKRIKLLLAQYYIDIQNNEQ

SEQ ID NO: 2512445 - protein, 18 aa, Entamoeba dispar
EKRCHFLSCGGSFGDLMK

SEQ ID NO: 2512446 - protein, 22 aa, Entamoeba dispar
EKRIAGKLDHFFPIQKIWNQNG

SEQ ID NO: 2512447 - protein, 22 aa, Entamoeba dispar
EKRIAGKLDHFFPIQKIWNQSG

SEQ ID NO: 2512448 - protein, 18 aa, Entamoeba dispar
EKRLPPFGSLKVKPSIID

SEQ ID NO: 2512449 - protein, 22 aa, Entamoeba dispar
EKRTVFSPVMFPMAPSFPPVVF

SEQ ID NO: 2512450 - protein, 21 aa, Entamoeba dispar
EKRYECITTFFQLLIKLIQKK

SEQ ID NO: 2512451 - protein, 18 aa, Entamoeba dispar
EKSLPGLLIYKGDCMVKS

SEQ ID NO: 2512452 - protein, 18 aa, Entamoeba dispar
EKTCFKCLNEISIETQKE

SEQ ID NO: 2512453 - protein, 20 aa, Entamoeba dispar
EKTTRCLLFYLMYSLGNSQI

SEQ ID NO: 2512454 - protein, 23 aa, Entamoeba dispar
EKWLKIHLQHVIWKQSGYYFHNR

SEQ ID NO: 2512455 - protein, 20 aa, Entamoeba dispar
EKYKSIICELYFELHPIFIK

SEQ ID NO: 2512456 - protein, 28 aa, Entamoeba dispar
ELCIAALKFAVTFLKKGGWFISKVFRSQ

SEQ ID NO: 2512457 - protein, 23 aa, Entamoeba dispar
ELCVKRKRPLVIISDTIDGDALT

SEQ ID NO: 2512458 - protein, 23 aa, Entamoeba dispar
ELEADVYWSFCWILQSIQSHYTY

SEQ ID NO: 2512459 - protein, 21 aa, Entamoeba dispar
ELEDLKRIVLLMLDHCPQTFN

SEQ ID NO: 2512460 - protein, 22 aa, Entamoeba dispar
ELEVIRRACDVLGSGIEESSIN

SEQ ID NO: 2512461 - protein, 22 aa, Entamoeba dispar
ELGDYCFRCCASLKSITLPTTI

SEQ ID NO: 2512462 - protein, 21 aa, Entamoeba dispar
ELGNPCIPYFGSFQNIFEKVL

SEQ ID NO: 2512463 - protein, 21 aa, Entamoeba dispar
ELIEIKLSFILLTLKNLNIKK

SEQ ID NO: 2512464 - protein, 21 aa, Entamoeba dispar
ELIHILRIILPLKKENNIKQE

SEQ ID NO: 2512465 - protein, 19 aa, Entamoeba dispar
ELIRLALICVINISSSDNV

SEQ ID NO: 2512466 - protein, 19 aa, Entamoeba dispar
ELISRLCAECIVGDTTLAQ

SEQ ID NO: 2512467 - protein, 23 aa, Entamoeba dispar
ELKKRFCKRIEFGTAGLRGKMCA

SEQ ID NO: 2512468 - protein, 22 aa, Entamoeba dispar
ELLARRIIPNFVVHEGREEQTL

SEQ ID NO: 2512469 - protein, 19 aa, Entamoeba dispar
ELLDLLHLIAMNKEITKMN

SEQ ID NO: 2512470 - protein, 20 aa, Entamoeba dispar
ELLKGFLKYYGIDFRSDIEG

SEQ ID NO: 2512471 - protein, 17 aa, Entamoeba dispar
ELLNQLVAISWRDEVIK

SEQ ID NO: 2512472 - protein, 21 aa, Entamoeba dispar
ELLSYTGYFMFYRFVGNYIAS

SEQ ID NO: 2512473 - protein, 22 aa, Entamoeba dispar
ELMKYNGGYNWWKRNSLTVFID

SEQ ID NO: 2512474 - protein, 18 aa, Entamoeba dispar
ELNNMKFIIPKKIGIIPF

SEQ ID NO: 2512475 - protein, 20 aa, Entamoeba dispar
ELPAYCFLCCRALKSINIPS

SEQ ID NO: 2512476 - protein, 22 aa, Entamoeba dispar
ELPEKFKAALLPENIKKNRYTD

SEQ ID NO: 2512477 - protein, 18 aa, Entamoeba dispar
ELPELFKSNFIEICNILK

SEQ ID NO: 2512478 - protein, 23 aa, Entamoeba dispar
ELPLSTKGSICIQYTIISSSSSA

SEQ ID NO: 2512479 - protein, 19 aa, Entamoeba dispar
ELQWCKAYLIGLLILCETR

SEQ ID NO: 2512480 - protein, 21 aa, Entamoeba dispar
ELREMMVHFSLGMLQVKLLRL

SEQ ID NO: 2512481 - protein, 23 aa, Entamoeba dispar
ELRLRLCVLFLRTLYEELLKHKS

SEQ ID NO: 2512482 - protein, 19 aa, Entamoeba dispar
ELSCLKEQFFLKEKRYRHY

SEQ ID NO: 2512483 - protein, 19 aa, Entamoeba dispar
ELSEIYLLFNIFGQLMNKP

SEQ ID NO: 2512484 - protein, 21 aa, Entamoeba dispar
ELSHISKLVGMEVHTVEKVIS

SEQ ID NO: 2512485 - protein, 17 aa, Entamoeba dispar
ELSIGFAAIERVSVLPY

SEQ ID NO: 2512486 - protein, 21 aa, Entamoeba dispar
ELTERFELFILKREIANAYTE

SEQ ID NO: 2512487 - protein, 18 aa, Entamoeba dispar
ELTLRLFGNYPYSIILPK

SEQ ID NO: 2512488 - protein, 17 aa, Entamoeba dispar
ELWNCKSTCAIQLIQTV

SEQ ID NO: 2512489 - protein, 21 aa, Entamoeba dispar
ELYIFRSGKYFNFIKEYILSR

SEQ ID NO: 2512490 - protein, 19 aa, Entamoeba dispar
ELYIGGVFIRILNKNPTCP

SEQ ID NO: 2512491 - protein, 19 aa, Entamoeba dispar
ELYISIPLVHVIRDSVFVV

SEQ ID NO: 2512492 - protein, 18 aa, Entamoeba dispar
ELYRRAANMGSWKQVLIK

SEQ ID NO: 2512493 - protein, 20 aa, Entamoeba dispar
ELYYRSIEFLKQLPDIDKII

SEQ ID NO: 2512494 - protein, 19 aa, Entamoeba dispar
EMEPGKDWLLFPNMGAYTI

SEQ ID NO: 2512495 - protein, 22 aa, Entamoeba dispar
EMKHLYFTGSVNFAIGRMIISQ

SEQ ID NO: 2512496 - protein, 23 aa, Entamoeba dispar
EMKKRLEMMFGKIKIGILGLEEM

SEQ ID NO: 2512497 - protein, 17 aa, Entamoeba dispar
EMLKEFRKLGGIIGVVS

SEQ ID NO: 2512498 - protein, 19 aa, Entamoeba dispar
EMMGGFGMMRGFGGGNMPM

SEQ ID NO: 2512499 - protein, 17 aa, Entamoeba dispar
EMMKRILTDPSLYKGNN

SEQ ID NO: 2512500 - protein, 24 aa, Entamoeba dispar
EMNKDALCGLVYSITTDYIVIGER

SEQ ID NO: 2512501 - protein, 18 aa, Entamoeba dispar
EMVCGFPPFLSDDAVQTC

SEQ ID NO: 2512502 - protein, 17 aa, Entamoeba dispar
ENECFKCCYNLKKINIP

SEQ ID NO: 2512503 - protein, 19 aa, Entamoeba dispar
ENEIKELESLIIIIKEEIE

SEQ ID NO: 2512504 - protein, 17 aa, Entamoeba dispar
ENFPLLFDFIGSYFSFV

SEQ ID NO: 2512505 - protein, 17 aa, Entamoeba dispar
ENFPRELIEMIKKCKLN

SEQ ID NO: 2512506 - protein, 17 aa, Entamoeba dispar
ENGWKMIYFERMKKMFG

SEQ ID NO: 2512507 - protein, 20 aa, Entamoeba dispar
ENILFRFYLKFIGSPIATKI

SEQ ID NO: 2512508 - protein, 17 aa, Entamoeba dispar
ENKELYEILSLLEINNY

SEQ ID NO: 2512509 - protein, 19 aa, Entamoeba dispar
ENKRFGIDTTHIFYDLFKN

SEQ ID NO: 2512510 - protein, 17 aa, Entamoeba dispar
  misc_feature (14)..(15): Xaa can be any naturally occurring amino acid
ENLATEMLWKWIFXXVI

SEQ ID NO: 2512511 - protein, 19 aa, Entamoeba dispar
ENLPATWVAFFKKAGIKKK

SEQ ID NO: 2512512 - protein, 23 aa, Entamoeba dispar
ENTKLPLFLGREGKEFKEEGTFI

SEQ ID NO: 2512513 - protein, 20 aa, Entamoeba dispar
EPELYRKRLLLFINSVFMIM

SEQ ID NO: 2512514 - protein, 19 aa, Entamoeba dispar
EPFMFINNIRFIRFAFSLR

SEQ ID NO: 2512515 - protein, 17 aa, Entamoeba dispar
EPFRTGYICRGCFEILH

SEQ ID NO: 2512516 - protein, 20 aa, Entamoeba dispar
EPHLPFFFKYPILFEPHSFV

SEQ ID NO: 2512517 - protein, 18 aa, Entamoeba dispar
EPIVFKVLFEVYKRLYGI

SEQ ID NO: 2512518 - protein, 20 aa, Entamoeba dispar
EPKAKCKRTERVLDKCKEAV

SEQ ID NO: 2512519 - protein, 19 aa, Entamoeba dispar
EPLAQVVLCLDHIRYELAV

SEQ ID NO: 2512520 - protein, 19 aa, Entamoeba dispar
EPLYRIATCAPHLDKRYPK

SEQ ID NO: 2512521 - protein, 18 aa, Entamoeba dispar
EPNKRYIRCVTDYLETYV

SEQ ID NO: 2512522 - protein, 17 aa, Entamoeba dispar
EPQELFCYSTADKTIKN

SEQ ID NO: 2512523 - protein, 20 aa, Entamoeba dispar
EPRVTLFPCYWDKEEHIEMV

SEQ ID NO: 2512524 - protein, 19 aa, Entamoeba dispar
EPTLRIGFEPCQYDSVINT

SEQ ID NO: 2512525 - protein, 23 aa, Entamoeba dispar
EPVFKHCMSLFWCDFLRANSTSI

SEQ ID NO: 2512526 - protein, 18 aa, Entamoeba dispar
EPYIKWDYDFRIQKIGDH

SEQ ID NO: 2512527 - protein, 17 aa, Entamoeba dispar
EQFKRCAYTLGVMNKII

SEQ ID NO: 2512528 - protein, 18 aa, Entamoeba dispar
EQFLPMQFGPSFAERIQL

SEQ ID NO: 2512529 - protein, 19 aa, Entamoeba dispar
EQPYRFIIFDDINYDRNLI

SEQ ID NO: 2512530 - protein, 25 aa, Entamoeba dispar
EQQVLSLRCPISFQTIEIPVRGKRC

SEQ ID NO: 2512531 - protein, 19 aa, Entamoeba dispar
EQVCYRIGEMIRRGGIKCT

SEQ ID NO: 2512532 - protein, 22 aa, Entamoeba dispar
EQVKRMCCGGIEGDWNASVLLY

SEQ ID NO: 2512533 - protein, 24 aa, Entamoeba dispar
ERAEKENKWILAYVFKENDLECLT

SEQ ID NO: 2512534 - protein, 21 aa, Entamoeba dispar
ERALKLLCRFLDLGPWACDQA

SEQ ID NO: 2512535 - protein, 23 aa, Entamoeba dispar
ERAYTLKLCRAIQKSGCNVLLIQ

SEQ ID NO: 2512536 - protein, 23 aa, Entamoeba dispar
ERCMKDLKELFARVPFTYTDPIV

SEQ ID NO: 2512537 - protein, 19 aa, Entamoeba dispar
ERDVYRYSLYFNLLKEKTA

SEQ ID NO: 2512538 - protein, 19 aa, Entamoeba dispar
ERFRRALSFIRIGMPIPFY

SEQ ID NO: 2512539 - protein, 18 aa, Entamoeba dispar
ERGERLIKLFGLLDEENF

SEQ ID NO: 2512540 - protein, 18 aa, Entamoeba dispar
ERIELMKTLFPIIKFDSI

SEQ ID NO: 2512541 - protein, 18 aa, Entamoeba dispar
ERIGKCIISPEVIPPNII

SEQ ID NO: 2512542 - protein, 17 aa, Entamoeba dispar
ERIGYKMIQVININQIK

SEQ ID NO: 2512543 - protein, 29 aa, Entamoeba dispar
ERISFGVNVKAMFLFRECVQRCISHRLEI

SEQ ID NO: 2512544 - protein, 24 aa, Entamoeba dispar
ERIYKVAICLSEKVEIEQEKIGMY

SEQ ID NO: 2512545 - protein, 21 aa, Entamoeba dispar
ERKLYYFICSAIILKNGDQIV

SEQ ID NO: 2512546 - protein, 25 aa, Entamoeba dispar
ERKVFGVPMLIAFTYNYPLSPPELS

SEQ ID NO: 2512547 - protein, 20 aa, Entamoeba dispar
ERLDDILLFSGFKDIKQREA

SEQ ID NO: 2512548 - protein, 17 aa, Entamoeba dispar
ERNRITVGFPIKGYKEA

SEQ ID NO: 2512549 - protein, 23 aa, Entamoeba dispar
ERRRALCFTPLFTTAAHFQIDAI

SEQ ID NO: 2512550 - protein, 21 aa, Entamoeba dispar
ERTAAVLACEWVDEVVDGIVW

SEQ ID NO: 2512551 - protein, 18 aa, Entamoeba dispar
ERYREIVGLIMINLGELS

SEQ ID NO: 2512552 - protein, 20 aa, Entamoeba dispar
ESCNACACFSAIVNESLARD

SEQ ID NO: 2512553 - protein, 23 aa, Entamoeba dispar
ESDIKWTNRWGRFIGYSDTASIT

SEQ ID NO: 2512554 - protein, 19 aa, Entamoeba dispar
ESEEGWFFGCWQPKDILSG

SEQ ID NO: 2512555 - protein, 19 aa, Entamoeba dispar
ESFIKFVIKRGLIEAFIRR

SEQ ID NO: 2512556 - protein, 17 aa, Entamoeba dispar
ESFKAVVLMLHKENIDD

SEQ ID NO: 2512557 - protein, 18 aa, Entamoeba dispar
ESFYICVSLIYSNQLDQW

SEQ ID NO: 2512558 - protein, 22 aa, Entamoeba dispar
ESGYKFILGMMFSLYRKYCICR

SEQ ID NO: 2512559 - protein, 17 aa, Entamoeba dispar
ESHKPCFEKRLFETCKS

SEQ ID NO: 2512560 - protein, 18 aa, Entamoeba dispar
ESIFKFDFSSLFGSYPPA

SEQ ID NO: 2512561 - protein, 20 aa, Entamoeba dispar
ESIKYIYELILSPPLSDRFT

SEQ ID NO: 2512562 - protein, 17 aa, Entamoeba dispar
ESITVFPKNCYKEIVDS

SEQ ID NO: 2512563 - protein, 21 aa, Entamoeba dispar
ESLALHLFRFRHYYLHHYFNK

SEQ ID NO: 2512564 - protein, 20 aa, Entamoeba dispar
ESLKWKKVILDIQFERAYHT

SEQ ID NO: 2512565 - protein, 20 aa, Entamoeba dispar
ESPLLREARLFRSPFIKSFH

SEQ ID NO: 2512566 - protein, 21 aa, Entamoeba dispar
ESQCLLCIGAPGYGLVIYKPP

SEQ ID NO: 2512567 - protein, 19 aa, Entamoeba dispar
ESTEGFLFKTYHACGDNTF

SEQ ID NO: 2512568 - protein, 17 aa, Entamoeba dispar
ESVKGWLKDVGYYAPKD

SEQ ID NO: 2512569 - protein, 21 aa, Entamoeba dispar
ESYRFYQLLLFNFSQFIADEE

SEQ ID NO: 2512570 - protein, 17 aa, Entamoeba dispar
ETARIAALFGMNQILRR

SEQ ID NO: 2512571 - protein, 17 aa, Entamoeba dispar
ETHCKVSVYLRNRGEGA

SEQ ID NO: 2512572 - protein, 18 aa, Entamoeba dispar
ETIDISAILVDWDQDYVR

SEQ ID NO: 2512573 - protein, 22 aa, Entamoeba dispar
ETIEACGLFSAVFTVTVGDITK

SEQ ID NO: 2512574 - protein, 24 aa, Entamoeba dispar
ETIEFRLGGVFSFLNMLQPYFTHL

SEQ ID NO: 2512575 - protein, 19 aa, Entamoeba dispar
ETIFNWRQVNGLKHDDYTR

SEQ ID NO: 2512576 - protein, 18 aa, Entamoeba dispar
ETIMKLGERCFIWCSSLS

SEQ ID NO: 2512577 - protein, 27 aa, Entamoeba dispar
ETLKEIARYCNMYQFFGYECKEDKVIV

SEQ ID NO: 2512578 - protein, 20 aa, Entamoeba dispar
ETLLKLVKFFSVESKYLITE

SEQ ID NO: 2512579 - protein, 18 aa, Entamoeba dispar
ETMAIRLTVVSGKQLKAM

SEQ ID NO: 2512580 - protein, 19 aa, Entamoeba dispar
ETQIKLIVCQKIVTTDLLG

SEQ ID NO: 2512581 - protein, 23 aa, Entamoeba dispar
ETQTNLWEGFALRNEKLSEKVSE

SEQ ID NO: 2512582 - protein, 21 aa, Entamoeba dispar
ETRTNEVFVVYNLCDVVVENE

SEQ ID NO: 2512583 - protein, 20 aa, Entamoeba dispar
ETSWKISQKFNMKKGNEMSH

SEQ ID NO: 2512584 - protein, 26 aa, Entamoeba dispar
ETTCAISLFVFEGWLNTFIKFINNQR

SEQ ID NO: 2512585 - protein, 21 aa, Entamoeba dispar
ETWKLISGIVCKDNNAVIKIT

SEQ ID NO: 2512586 - protein, 17 aa, Entamoeba dispar
EVCGIDFNGSGTYIGTG

SEQ ID NO: 2512587 - protein, 20 aa, Entamoeba dispar
EVCQMLNWTSFSFDEYMEGL

SEQ ID NO: 2512588 - protein, 23 aa, Entamoeba dispar
EVDISICDKIMCRIGAGDNIVEG

SEQ ID NO: 2512589 - protein, 20 aa, Entamoeba dispar
EVDLRWCGYVHWSAGKRRYS

SEQ ID NO: 2512590 - protein, 17 aa, Entamoeba dispar
EVEGIFRTSASYKIVGR

SEQ ID NO: 2512591 - protein, 28 aa, Entamoeba dispar
EVFGVKRPVSWILICRVILYSLMELHKG

SEQ ID NO: 2512592 - protein, 20 aa, Entamoeba dispar
EVFPRILANYSHMLLKKGSK

SEQ ID NO: 2512593 - protein, 17 aa, Entamoeba dispar
EVFSRMNFSYVLLSKRN

SEQ ID NO: 2512594 - protein, 19 aa, Entamoeba dispar
EVFVSLFLMNYSSSLANSF

SEQ ID NO: 2512595 - protein, 17 aa, Entamoeba dispar
EVIRYGINIFQEKEKKD

SEQ ID NO: 2512596 - protein, 21 aa, Entamoeba dispar
EVITPITMNWILYGYRASKNI

SEQ ID NO: 2512597 - protein, 24 aa, Entamoeba dispar
EVKAKEYYLPFVFVDGKAEQEQID

SEQ ID NO: 2512598 - protein, 19 aa, Entamoeba dispar
EVKPRFYLHPSRPLECSYR

SEQ ID NO: 2512599 - protein, 17 aa, Entamoeba dispar
EVKRFYEEWTHFKCQLE

SEQ ID NO: 2512600 - protein, 23 aa, Entamoeba dispar
EVPRRVSDCFVICACDGVWDVFS

SEQ ID NO: 2512601 - protein, 23 aa, Entamoeba dispar
EVSNCFSCILAAVTINMIIRISS

SEQ ID NO: 2512602 - protein, 23 aa, Entamoeba dispar
EVTSIGYQCFDWCIALTRIDIPS

SEQ ID NO: 2512603 - protein, 17 aa, Entamoeba dispar
EVVLALRGILTARRQDT

SEQ ID NO: 2512604 - protein, 21 aa, Entamoeba dispar
EVYHWAVKLKKQFETLWKNAF

SEQ ID NO: 2512605 - protein, 19 aa, Entamoeba dispar
EWLCGFSGFTGEIVITQKR

SEQ ID NO: 2512606 - protein, 18 aa, Entamoeba dispar
EWLLTFGYSVRWPEKSDI

SEQ ID NO: 2512607 - protein, 21 aa, Entamoeba dispar
EWYSKELICYGMYIEKINKIR

SEQ ID NO: 2512608 - protein, 28 aa, Entamoeba dispar
EYFKFNFSFRLIEILTLVALCRDEQKKS

SEQ ID NO: 2512609 - protein, 22 aa, Entamoeba dispar
EYFRFLWELRLVFNKEMTQLQE

SEQ ID NO: 2512610 - protein, 22 aa, Entamoeba dispar
EYFRFLWELRLVFNSNLTQLEE

SEQ ID NO: 2512611 - protein, 19 aa, Entamoeba dispar
EYILILGCNCIKEIMNCYG

SEQ ID NO: 2512612 - protein, 17 aa, Entamoeba dispar
EYIWPPCYDKFQTSKEV

SEQ ID NO: 2512613 - protein, 22 aa, Entamoeba dispar
EYKFKLVGVLVHLGTLDSGHYY

SEQ ID NO: 2512614 - protein, 18 aa, Entamoeba dispar
EYLRASITFNEIMKTKDI

SEQ ID NO: 2512615 - protein, 24 aa, Entamoeba dispar
EYLRKLLIERGIIFSTECEKIEVE

SEQ ID NO: 2512616 - protein, 25 aa, Entamoeba dispar
EYMKWLKKRVVDLMAVFPSYMRIKR

SEQ ID NO: 2512617 - protein, 19 aa, Entamoeba dispar
EYNTAMAFVQSWLNVTSQN

SEQ ID NO: 2512618 - protein, 17 aa, Entamoeba dispar
EYQRIGVQFGLRKKGRL

SEQ ID NO: 2512619 - protein, 21 aa, Entamoeba dispar
EYRLKITTLLPAFDFGMDIFI

SEQ ID NO: 2512620 - protein, 20 aa, Entamoeba dispar
EYRMLWFRFDIRKLYFLRHG

SEQ ID NO: 2512621 - protein, 19 aa, Entamoeba dispar
EYRQLLCECCEKIMTETEL

SEQ ID NO: 2512622 - protein, 22 aa, Entamoeba dispar
EYRWCYESWIVLGFEALGLNKN

SEQ ID NO: 2512623 - protein, 26 aa, Entamoeba dispar
EYSRSCIRHNFLYGKERLMASILEGK

SEQ ID NO: 2512624 - protein, 19 aa, Entamoeba dispar
EYVPRSPIYFSHLSLTPTV

SEQ ID NO: 2512625 - protein, 19 aa, Entamoeba dispar
EYWLEAGNPWEIVRQDVKY

SEQ ID NO: 2512626 - protein, 23 aa, Entamoeba dispar
FADDLRLMLQIAKYGIGVYELYL

SEQ ID NO: 2512627 - protein, 18 aa, Entamoeba dispar
FAELYWTPGVLRQAEDRV

SEQ ID NO: 2512628 - protein, 19 aa, Entamoeba dispar
FAERADMIVLVFDAHKLDI

SEQ ID NO: 2512629 - protein, 20 aa, Entamoeba dispar
FAICMLEVWISKDPYNSIKF

SEQ ID NO: 2512630 - protein, 19 aa, Entamoeba dispar
FAQRCGYNFTIRGTRSSIY

SEQ ID NO: 2512631 - protein, 27 aa, Entamoeba dispar
FARMLILRFVFCRLVLLSLKLPGDSDN

SEQ ID NO: 2512632 - protein, 17 aa, Entamoeba dispar
FASLCFEASILSQKVGD

SEQ ID NO: 2512633 - protein, 17 aa, Entamoeba dispar
FASNLVILLTGFFDSIE

SEQ ID NO: 2512634 - protein, 19 aa, Entamoeba dispar
FATWCGPCRSIGPYFEELA

SEQ ID NO: 2512635 - protein, 17 aa, Entamoeba dispar
FCEVFRYLPVSALIEGK

SEQ ID NO: 2512636 - protein, 22 aa, Entamoeba dispar
FCFCPKCLHKGIFTPMQFSLDS

SEQ ID NO: 2512637 - protein, 20 aa, Entamoeba dispar
FCFDCGKGGATFVVSNFNIF

SEQ ID NO: 2512638 - protein, 23 aa, Entamoeba dispar
FCFFIVCLFLLYKTYPTQFEFNE

SEQ ID NO: 2512639 - protein, 19 aa, Entamoeba dispar
FCGCTRLKSIIIPSTVSKI

SEQ ID NO: 2512640 - protein, 18 aa, Entamoeba dispar
FCHLYFLKKREMAIMLPD

SEQ ID NO: 2512641 - protein, 18 aa, Entamoeba dispar
FCIISTKLFHFFSKKEIS

SEQ ID NO: 2512642 - protein, 20 aa, Entamoeba dispar
FCINLRLLLRLTDSKAKPNK

SEQ ID NO: 2512643 - protein, 18 aa, Entamoeba dispar
FCIQRFELKYVYAYFTHI

SEQ ID NO: 2512644 - protein, 23 aa, Entamoeba dispar
FCNKFKIPFLFFKSQHPLYKIKE

SEQ ID NO: 2512645 - protein, 17 aa, Entamoeba dispar
FCPELFKKVDFIEKLSS

SEQ ID NO: 2512646 - protein, 24 aa, Entamoeba dispar
FCSKIRKLRMTDFFYMKDTIKHPE

SEQ ID NO: 2512647 - protein, 19 aa, Entamoeba dispar
FCSSESFVSFFKRFQTDTF

SEQ ID NO: 2512648 - protein, 18 aa, Entamoeba dispar
FCTECKSIRTCPHAFLCC

SEQ ID NO: 2512649 - protein, 21 aa, Entamoeba dispar
FCVQCSYQPFTISTYQKYTEH

SEQ ID NO: 2512650 - protein, 17 aa, Entamoeba dispar
FCYSCIRIGNFYTNPEC

SEQ ID NO: 2512651 - protein, 17 aa, Entamoeba dispar
FDCATPLLIQWTYQAMI

SEQ ID NO: 2512652 - protein, 18 aa, Entamoeba dispar
FDDDRLIPVFGFGDSKTQ

SEQ ID NO: 2512653 - protein, 18 aa, Entamoeba dispar
FDDPITLVNGWRMVDNNN

SEQ ID NO: 2512654 - protein, 17 aa, Entamoeba dispar
FDFIFKIIISSIECKNK

SEQ ID NO: 2512655 - protein, 17 aa, Entamoeba dispar
FDFKVIYSLVIDKHNLK

SEQ ID NO: 2512656 - protein, 17 aa, Entamoeba dispar
FDIGAVFDKLLIGVTNT

SEQ ID NO: 2512657 - protein, 27 aa, Entamoeba dispar
FDILILARCWLKFSYVYSFYSSEEGKI

SEQ ID NO: 2512658 - protein, 19 aa, Entamoeba dispar
FDISGKWVRYSGGSDQGTF

SEQ ID NO: 2512659 - protein, 17 aa, Entamoeba dispar
FDISNLIWRKLGNLENF

SEQ ID NO: 2512660 - protein, 18 aa, Entamoeba dispar
FDIWRLLIDILRGIDQLL

SEQ ID NO: 2512661 - protein, 19 aa, Entamoeba dispar
FDKELALFVCKSHRGEVGE

SEQ ID NO: 2512662 - protein, 19 aa, Entamoeba dispar
FDKILGGLAWGISATCYPL

SEQ ID NO: 2512663 - protein, 21 aa, Entamoeba dispar
FDLGIDIPNEFIIKEKKDLTS

SEQ ID NO: 2512664 - protein, 17 aa, Entamoeba dispar
FDLYELFFPLNDNSKKM

SEQ ID NO: 2512665 - protein, 25 aa, Entamoeba dispar
FDPGKGAKCIYVWLGKSSNKMEKGK

SEQ ID NO: 2512666 - protein, 17 aa, Entamoeba dispar
FDPHYNIIIGRNGTGKS

SEQ ID NO: 2512667 - protein, 18 aa, Entamoeba dispar
FDPRWLTSHFNSIFLVVT

SEQ ID NO: 2512668 - protein, 18 aa, Entamoeba dispar
FDPSYVFLCDEFGINLIG

SEQ ID NO: 2512669 - protein, 17 aa, Entamoeba dispar
FDRESVRFITKIVQEVK

SEQ ID NO: 2512670 - protein, 18 aa, Entamoeba dispar
FDSLFGIDIKDWIVSFID

SEQ ID NO: 2512671 - protein, 17 aa, Entamoeba dispar
FDSMKEWIIISSQMHSI

SEQ ID NO: 2512672 - protein, 35 aa, Entamoeba dispar
FDTIKYRHLWSYILHIIRLFISFSFNNPKLPCFNN

SEQ ID NO: 2512673 - protein, 24 aa, Entamoeba dispar
FDTMSRWLLCYGKNMFSIRLLDET

SEQ ID NO: 2512674 - protein, 17 aa, Entamoeba dispar
FDTVVCWFGEFFNDPKI

SEQ ID NO: 2512675 - protein, 17 aa, Entamoeba dispar
FDYLWKKKCIVYADVIE

SEQ ID NO: 2512676 - protein, 22 aa, Entamoeba dispar
FEALKFRPFFVGINFDKFQKKE

SEQ ID NO: 2512677 - protein, 18 aa, Entamoeba dispar
FECIKEVLTIVAMLTVPN

SEQ ID NO: 2512678 - protein, 18 aa, Entamoeba dispar
FEDTEGWLFFGMSHSDPK

SEQ ID NO: 2512679 - protein, 17 aa, Entamoeba dispar
FEECIKLVLTLSTLHPS

SEQ ID NO: 2512680 - protein, 17 aa, Entamoeba dispar
FEECWTLDKSCVYNDCL

SEQ ID NO: 2512681 - protein, 19 aa, Entamoeba dispar
FEEEFPYQIVFGVIQKDPT

SEQ ID NO: 2512682 - protein, 20 aa, Entamoeba dispar
FEFPIPIEIIIDCYKNNNNE

SEQ ID NO: 2512683 - protein, 17 aa, Entamoeba dispar
FEIGAYQGTIDWMKEYL

SEQ ID NO: 2512684 - protein, 19 aa, Entamoeba dispar
FEISNGLYLPVTINKPKTV

SEQ ID NO: 2512685 - protein, 17 aa, Entamoeba dispar
FEKALLIKYCVQNELYL

SEQ ID NO: 2512686 - protein, 17 aa, Entamoeba dispar
FEKGYGMGFGTRKHVFL

SEQ ID NO: 2512687 - protein, 18 aa, Entamoeba dispar
FEKYYCIFTPEVIKKTKI

SEQ ID NO: 2512688 - protein, 17 aa, Entamoeba dispar
FELFGIQCEFYFLFNNE

SEQ ID NO: 2512689 - protein, 18 aa, Entamoeba dispar
FELHRGVIYEGMIGMYLG

SEQ ID NO: 2512690 - protein, 19 aa, Entamoeba dispar
FELQKKWYFPIIQSIKPQQ

SEQ ID NO: 2512691 - protein, 20 aa, Entamoeba dispar
FEMVCGFPPFLSDDAVQTCL

SEQ ID NO: 2512692 - protein, 20 aa, Entamoeba dispar
FEMWYFLSAIILDRNFVQET

SEQ ID NO: 2512693 - protein, 23 aa, Entamoeba dispar
FENCSKAQCSLELQMKGEVNKEE

SEQ ID NO: 2512694 - protein, 25 aa, Entamoeba dispar
FEQEIRNTLPYGFSFSFNKENNKEE

SEQ ID NO: 2512695 - protein, 17 aa, Entamoeba dispar
FEQIKLFQQCIDRLPKA

SEQ ID NO: 2512696 - protein, 18 aa, Entamoeba dispar
FEQWAIIFDECARKLFNM

SEQ ID NO: 2512697 - protein, 22 aa, Entamoeba dispar
FERKECFNYLFAQMREGIQWVI

SEQ ID NO: 2512698 - protein, 18 aa, Entamoeba dispar
FERPFLWIARKLTGNPNL

SEQ ID NO: 2512699 - protein, 20 aa, Entamoeba dispar
FESGNSIYLSLDMFDPSIIN

SEQ ID NO: 2512700 - protein, 24 aa, Entamoeba dispar
FEVSRPGYGKVMWSNVDLTNVNLD

SEQ ID NO: 2512701 - protein, 24 aa, Entamoeba dispar
FEYLSKWPEMCFIAKDCNGRVEGY

SEQ ID NO: 2512702 - protein, 25 aa, Entamoeba dispar
FEYNMYLAYYCWIKSSGSNVERHKA

SEQ ID NO: 2512703 - protein, 21 aa, Entamoeba dispar
FFECKFCIYCNSYGYWPTFTL

SEQ ID NO: 2512704 - protein, 19 aa, Entamoeba dispar
FFERMYCLFYPLDEKARCV

SEQ ID NO: 2512705 - protein, 20 aa, Entamoeba dispar
FFETFKKLRVGAVLYLLYGR

SEQ ID NO: 2512706 - protein, 18 aa, Entamoeba dispar
FFFLKRNIIVGIYFITPL

SEQ ID NO: 2512707 - protein, 18 aa, Entamoeba dispar
FFGTFLRQKVEAFNQTLP

SEQ ID NO: 2512708 - protein, 18 aa, Entamoeba dispar
FFIPVVLLLRVYGGMSDR

SEQ ID NO: 2512709 - protein, 19 aa, Entamoeba dispar
FFKKEVEEIIKYKKEQTGN

SEQ ID NO: 2512710 - protein, 22 aa, Entamoeba dispar
FFKPKEDWFFYAFSKFYFEAAL

SEQ ID NO: 2512711 - protein, 19 aa, Entamoeba dispar
FFKPLASFIESWKNARKDN

SEQ ID NO: 2512712 - protein, 17 aa, Entamoeba dispar
FFLCLPKPMINDSVLKV

SEQ ID NO: 2512713 - protein, 23 aa, Entamoeba dispar
FFLDFYKTFKIFFSLGNTFFSDN

SEQ ID NO: 2512714 - protein, 19 aa, Entamoeba dispar
FFNGYPFQVCKGIIHQNDY

SEQ ID NO: 2512715 - protein, 18 aa, Entamoeba dispar
FFQEWYFDLLLSHTDKVL

SEQ ID NO: 2512716 - protein, 18 aa, Entamoeba dispar
FFRMMKFQRYFESGDALS

SEQ ID NO: 2512717 - protein, 17 aa, Entamoeba dispar
FFRVKVTVLLEGKNIGD

SEQ ID NO: 2512718 - protein, 24 aa, Entamoeba dispar
FFTYKRYKFGVLYAAPGQTKEMEF

SEQ ID NO: 2512719 - protein, 24 aa, Entamoeba dispar
FFTYKRYKFGVLYAAVGQTKEMEF

SEQ ID NO: 2512720 - protein, 17 aa, Entamoeba dispar
FFWKYLFKCYDAYDQIT

SEQ ID NO: 2512721 - protein, 25 aa, Entamoeba dispar
FGCMAAELFVGIPIFPGNSEYNMLY

SEQ ID NO: 2512722 - protein, 18 aa, Entamoeba dispar
FGCSMFKDICCVFHTLLN

SEQ ID NO: 2512723 - protein, 17 aa, Entamoeba dispar
FGDWDTIRILRVIIKVQ

SEQ ID NO: 2512724 - protein, 21 aa, Entamoeba dispar
FGDYCFCKCLSLKEINIPTTI

SEQ ID NO: 2512725 - protein, 23 aa, Entamoeba dispar
FGELPKDITGLCALQHRKDNPQR

SEQ ID NO: 2512726 - protein, 22 aa, Entamoeba dispar
FGIKWLKMMFAREFLLADSVII

SEQ ID NO: 2512727 - protein, 18 aa, Entamoeba dispar
FGKKMKFKWYKLKIPSFI

SEQ ID NO: 2512728 - protein, 18 aa, Entamoeba dispar
FGKSLGLKYHSVEAIHIV

SEQ ID NO: 2512729 - protein, 19 aa, Entamoeba dispar
FGPKWKKGDVISICVDFNQ

SEQ ID NO: 2512730 - protein, 17 aa, Entamoeba dispar
FGSACFENSTLYSYIQS

SEQ ID NO: 2512731 - protein, 17 aa, Entamoeba dispar
FGSACFERSTLYTYIQS

SEQ ID NO: 2512732 - protein, 17 aa, Entamoeba dispar
FGSHFDGWFDLRGSPYG

SEQ ID NO: 2512733 - protein, 21 aa, Entamoeba dispar
FGSNKRPGLTFINTKVEPPTQ

SEQ ID NO: 2512734 - protein, 17 aa, Entamoeba dispar
FGSSCFENSTLYTYIQS

SEQ ID NO: 2512735 - protein, 22 aa, Entamoeba dispar
FGSWPHAGCGIGLERITMLYLG

SEQ ID NO: 2512736 - protein, 17 aa, Entamoeba dispar
FGTMEWNHLYLIFDANI

SEQ ID NO: 2512737 - protein, 28 aa, Entamoeba dispar
FGTRWLRLLFDREFHVMDVLNVWDAIFA

SEQ ID NO: 2512738 - protein, 21 aa, Entamoeba dispar
FGVECVLTLFSFMIIYPNSVF

SEQ ID NO: 2512739 - protein, 23 aa, Entamoeba dispar
FGVPRFYEKLLFRAKEISGSSKI

SEQ ID NO: 2512740 - protein, 18 aa, Entamoeba dispar
FGYVPIKYLEKVNLAKEL

SEQ ID NO: 2512741 - protein, 20 aa, Entamoeba dispar
FHALIWLEEVLKNWDGTLLI

SEQ ID NO: 2512742 - protein, 18 aa, Entamoeba dispar
FHFSHSLNPSGLCEKVEI

SEQ ID NO: 2512743 - protein, 18 aa, Entamoeba dispar
FHHSYKLFIQFIIRHIEH

SEQ ID NO: 2512744 - protein, 19 aa, Entamoeba dispar
FHILFPYFLKQSFRRIILL

SEQ ID NO: 2512745 - protein, 23 aa, Entamoeba dispar
FHKEIIRSLPLIISKGYFDFLID

SEQ ID NO: 2512746 - protein, 17 aa, Entamoeba dispar
FHLIPSLVHKNYYQLFN

SEQ ID NO: 2512747 - protein, 22 aa, Entamoeba dispar
FHLKGEVGDIVFVESIIASWAV

SEQ ID NO: 2512748 - protein, 18 aa, Entamoeba dispar
FHPTRSWVLASLHNGKIQ

SEQ ID NO: 2512749 - protein, 23 aa, Entamoeba dispar
FHVASGLSICWGSLFGHIGMKTA

SEQ ID NO: 2512750 - protein, 23 aa, Entamoeba dispar
FHYSKLFFCRIHIERSLIKYFKS

SEQ ID NO: 2512751 - protein, 17 aa, Entamoeba dispar
FHYSWKNGLAFCALIHS

SEQ ID NO: 2512752 - protein, 17 aa, Entamoeba dispar
FIACQKISHVFSYLDRF

SEQ ID NO: 2512753 - protein, 17 aa, Entamoeba dispar
FIAETFKTFGFKSNESC

SEQ ID NO: 2512754 - protein, 17 aa, Entamoeba dispar
FIATFAMDSDKVIIIDV

SEQ ID NO: 2512755 - protein, 21 aa, Entamoeba dispar
FIDKLNCYYLNTSHIQNLREI

SEQ ID NO: 2512756 - protein, 17 aa, Entamoeba dispar
FIFRMCCEVEKRLHKAN

SEQ ID NO: 2512757 - protein, 30 aa, Entamoeba dispar
FIGHSLGGLYLRFAIPILFKRGIFNNLNWI

SEQ ID NO: 2512758 - protein, 17 aa, Entamoeba dispar
FIHLCGTPAQLQDAAVV

SEQ ID NO: 2512759 - protein, 17 aa, Entamoeba dispar
FIIFCFVNEPSIKQPHF

SEQ ID NO: 2512760 - protein, 18 aa, Entamoeba dispar
FIKAITWLGCTSTRRLPV

SEQ ID NO: 2512761 - protein, 17 aa, Entamoeba dispar
FIKGCLIFIPKTAITKL

SEQ ID NO: 2512762 - protein, 20 aa, Entamoeba dispar
FIKKRMGDLISEDLVWNIFL

SEQ ID NO: 2512763 - protein, 24 aa, Entamoeba dispar
FIKLSNCIICIGIKGIKCIEINGQ

SEQ ID NO: 2512764 - protein, 25 aa, Entamoeba dispar
FIKQFSFRLLEIITLVSMCRDIQKQ

SEQ ID NO: 2512765 - protein, 19 aa, Entamoeba dispar
FIKRVCPFVQSYYRSLIQT

SEQ ID NO: 2512766 - protein, 18 aa, Entamoeba dispar
FILDEEWEYWINVLYECL

SEQ ID NO: 2512767 - protein, 17 aa, Entamoeba dispar
FILQCIEYLLSEVAQKK

SEQ ID NO: 2512768 - protein, 27 aa, Entamoeba dispar
FINEWNEIRKWVGLSPCIGCWIPFNES

SEQ ID NO: 2512769 - protein, 17 aa, Entamoeba dispar
FIPYLKVYKMFIGNNEI

SEQ ID NO: 2512770 - protein, 23 aa, Entamoeba dispar
FIQCIKEAFTLFFKERISFGVNV

SEQ ID NO: 2512771 - protein, 18 aa, Entamoeba dispar
FIQMCWKGIFEILYIASL

SEQ ID NO: 2512772 - protein, 18 aa, Entamoeba dispar
FIQSCVFHPLKPMIAIAT

SEQ ID NO: 2512773 - protein, 17 aa, Entamoeba dispar
FIRIYRLFINFLGGDIV

SEQ ID NO: 2512774 - protein, 17 aa, Entamoeba dispar
FISFCISNYPLIFPNDI

SEQ ID NO: 2512775 - protein, 18 aa, Entamoeba dispar
FIVPQCRSIVGCSIHKEF

SEQ ID NO: 2512776 - protein, 21 aa, Entamoeba dispar
FIWWCYDYDFEFGYDVQFDNI

SEQ ID NO: 2512777 - protein, 23 aa, Entamoeba dispar
FIYSNRLIQCFGSFGWSGEGVKN

SEQ ID NO: 2512778 - protein, 18 aa, Entamoeba dispar
FKAMHGFVTMNFAPAQRV

SEQ ID NO: 2512779 - protein, 17 aa, Entamoeba dispar
FKAVVLMLHKENIDDPF

SEQ ID NO: 2512780 - protein, 18 aa, Entamoeba dispar
FKCDNCGKQLGGKFGLRG

SEQ ID NO: 2512781 - protein, 18 aa, Entamoeba dispar
FKCEICGNKSYFGRKEYE

SEQ ID NO: 2512782 - protein, 19 aa, Entamoeba dispar
FKCGIKFCSAGSVIALMTD

SEQ ID NO: 2512783 - protein, 22 aa, Entamoeba dispar
FKDFWKHICIVWTKCYNYTPKN

SEQ ID NO: 2512784 - protein, 18 aa, Entamoeba dispar
FKEKDCGEGIGFELGYGM

SEQ ID NO: 2512785 - protein, 20 aa, Entamoeba dispar
FKEMHSICLLNHIQLIFVFD

SEQ ID NO: 2512786 - protein, 30 aa, Entamoeba dispar
FKFDLIYKWLRREGKSILKLSSFLNSQKQN

SEQ ID NO: 2512787 - protein, 17 aa, Entamoeba dispar
FKFKLVQRIDLEKKTER

SEQ ID NO: 2512788 - protein, 18 aa, Entamoeba dispar
FKFPWKIAEFISTGKRPP

SEQ ID NO: 2512789 - protein, 18 aa, Entamoeba dispar
FKFVLTISKSVWDVIDQN

SEQ ID NO: 2512790 - protein, 21 aa, Entamoeba dispar
FKGDICYKCPLGYYNINGICT

SEQ ID NO: 2512791 - protein, 26 aa, Entamoeba dispar
FKGEILDFIGVKKWKTVRVVVYNKSP

SEQ ID NO: 2512792 - protein, 19 aa, Entamoeba dispar
FKGIPAFWHRIFIIENLSD

SEQ ID NO: 2512793 - protein, 23 aa, Entamoeba dispar
FKGKEWKLCLLFNDILLIAKIDV

SEQ ID NO: 2512794 - protein, 18 aa, Entamoeba dispar
FKGRYYPYILGIRKDFLS

SEQ ID NO: 2512795 - protein, 17 aa, Entamoeba dispar
FKIGFFLSEMKLRCHEM

SEQ ID NO: 2512796 - protein, 17 aa, Entamoeba dispar
FKIIYFISIASFGEIIQ

SEQ ID NO: 2512797 - protein, 22 aa, Entamoeba dispar
FKKEIPRTLIFSKFNIIETIPC

SEQ ID NO: 2512798 - protein, 19 aa, Entamoeba dispar
FKKEKRGILVIDFESVIFY

SEQ ID NO: 2512799 - protein, 19 aa, Entamoeba dispar
FKKKCKSYVSQIFQAIKQS

SEQ ID NO: 2512800 - protein, 19 aa, Entamoeba dispar
FKKNVELFGVLDEDDRKSL

SEQ ID NO: 2512801 - protein, 19 aa, Entamoeba dispar
FKKPLKRTFKVSSPQKKVV

SEQ ID NO: 2512802 - protein, 22 aa, Entamoeba dispar
FKKRRVVLMKILLRLHRIYKLD

SEQ ID NO: 2512803 - protein, 21 aa, Entamoeba dispar
FKLKEIVGIFIARIIDTINLW

SEQ ID NO: 2512804 - protein, 20 aa, Entamoeba dispar
FKLKGCPVSAILTQNLLAIA

SEQ ID NO: 2512805 - protein, 24 aa, Entamoeba dispar
FKLTFFFFQCFIKSCVVADKEIKE

SEQ ID NO: 2512806 - protein, 17 aa, Entamoeba dispar
FKLVQRIDLEKKTERFI

SEQ ID NO: 2512807 - protein, 20 aa, Entamoeba dispar
FKMKECMNSLIVATKENIII

SEQ ID NO: 2512808 - protein, 19 aa, Entamoeba dispar
FKNIIKFICECYNMKIFEE

SEQ ID NO: 2512809 - protein, 20 aa, Entamoeba dispar
FKQLRCVRLFLQKQGKVSDF

SEQ ID NO: 2512810 - protein, 18 aa, Entamoeba dispar
FKRMWDFKILTSFNETLE

SEQ ID NO: 2512811 - protein, 21 aa, Entamoeba dispar
FKSFCDFFKRRGHTQLIEEFS

SEQ ID NO: 2512812 - protein, 20 aa, Entamoeba dispar
FKSHCSQLLTAARVSMEDQS

SEQ ID NO: 2512813 - protein, 19 aa, Entamoeba dispar
FKSQLFLFFINFFSKDSDA

SEQ ID NO: 2512814 - protein, 19 aa, Entamoeba dispar
FKSRYFGGIVVRQMEKNVR

SEQ ID NO: 2512815 - protein, 17 aa, Entamoeba dispar
FKSSLKFTKIVAENCKV

SEQ ID NO: 2512816 - protein, 20 aa, Entamoeba dispar
FKSVEIELVFQMLEKLLNTY

SEQ ID NO: 2512817 - protein, 17 aa, Entamoeba dispar
FKTFNGRTLEECRQFGY

SEQ ID NO: 2512818 - protein, 25 aa, Entamoeba dispar
FKTFYKITIGFNFLSNFIIIKDYAI

SEQ ID NO: 2512819 - protein, 19 aa, Entamoeba dispar
FKTKIEFIDIASLNIISTV

SEQ ID NO: 2512820 - protein, 20 aa, Entamoeba dispar
FKTQIATIIIFKGYSKENFG

SEQ ID NO: 2512821 - protein, 18 aa, Entamoeba dispar
FKVSFFNAMVDKFYSSII

SEQ ID NO: 2512822 - protein, 17 aa, Entamoeba dispar
FKVYKCLIEVLGDYKKS

SEQ ID NO: 2512823 - protein, 19 aa, Entamoeba dispar
FKWELQIADPSLFECSSKY

SEQ ID NO: 2512824 - protein, 19 aa, Entamoeba dispar
FKWNNMRIIQCKEDKLNLD

SEQ ID NO: 2512825 - protein, 17 aa, Entamoeba dispar
FKWYKLKIPSFITSACV

SEQ ID NO: 2512826 - protein, 23 aa, Entamoeba dispar
FKYHCERCGFVVCDVCSRNRKIV

SEQ ID NO: 2512827 - protein, 17 aa, Entamoeba dispar
FKYLFMFLTKVMAESKI

SEQ ID NO: 2512828 - protein, 17 aa, Entamoeba dispar
FLARAIEVYSIYHSIVK

SEQ ID NO: 2512829 - protein, 18 aa, Entamoeba dispar
FLDMCTLVLKTLRHNKSV

SEQ ID NO: 2512830 - protein, 24 aa, Entamoeba dispar
FLEKGYCIFTNWIVSFYSFIISNI

SEQ ID NO: 2512831 - protein, 19 aa, Entamoeba dispar
FLEKYPKVLFFKTTISDPE

SEQ ID NO: 2512832 - protein, 19 aa, Entamoeba dispar
FLEYDLEWFPPQWKVNFAK

SEQ ID NO: 2512833 - protein, 19 aa, Entamoeba dispar
FLFILFIRRFVELLKSNGC

SEQ ID NO: 2512834 - protein, 23 aa, Entamoeba dispar
FLFKFLLWLRKWLYPRNFLGGLF

SEQ ID NO: 2512835 - protein, 18 aa, Entamoeba dispar
FLFKIGLIVTDGYGTSET

SEQ ID NO: 2512836 - protein, 24 aa, Entamoeba dispar
FLFSEFWKHTCIVWTKCYNFIPRK

SEQ ID NO: 2512837 - protein, 24 aa, Entamoeba dispar
FLFTRRSHLNWARFDKTETDVYKR

SEQ ID NO: 2512838 - protein, 22 aa, Entamoeba dispar
FLGDRWLRFDPPLGCVINLDQT

SEQ ID NO: 2512839 - protein, 17 aa, Entamoeba dispar
FLGIPLFAGSSEHNQLS

SEQ ID NO: 2512840 - protein, 21 aa, Entamoeba dispar
FLIDAGKIWLWFGSKALNETK

SEQ ID NO: 2512841 - protein, 17 aa, Entamoeba dispar
FLIMWKGSDSEAYIQLQ

SEQ ID NO: 2512842 - protein, 17 aa, Entamoeba dispar
FLIPLIFHYQELYWFER

SEQ ID NO: 2512843 - protein, 18 aa, Entamoeba dispar
FLIQPFLHWPDTMMTVIE

SEQ ID NO: 2512844 - protein, 19 aa, Entamoeba dispar
FLKEFKRRGGIICICSHGL

SEQ ID NO: 2512845 - protein, 19 aa, Entamoeba dispar
FLKQCIKSGALIVTGPFKI

SEQ ID NO: 2512846 - protein, 17 aa, Entamoeba dispar
FLKQRFESLQGDEYYQF

SEQ ID NO: 2512847 - protein, 22 aa, Entamoeba dispar
FLLCTRAGGFGINLSEADTVII

SEQ ID NO: 2512848 - protein, 17 aa, Entamoeba dispar
FLLKWSFSSMKGVIENL

SEQ ID NO: 2512849 - protein, 19 aa, Entamoeba dispar
FLLRCCSDCANALLYLSQH

SEQ ID NO: 2512850 - protein, 17 aa, Entamoeba dispar
FLPEFLVSLHYNFHTLL

SEQ ID NO: 2512851 - protein, 20 aa, Entamoeba dispar
FLPQVLICLLNWLTSVSDDD

SEQ ID NO: 2512852 - protein, 17 aa, Entamoeba dispar
FLQGFVMKKRRGDDLEM

SEQ ID NO: 2512853 - protein, 17 aa, Entamoeba dispar
FLQQLRHEKIIKIKNFI

SEQ ID NO: 2512854 - protein, 19 aa, Entamoeba dispar
FLRAIRLVTRYTKTNPDII

SEQ ID NO: 2512855 - protein, 24 aa, Entamoeba dispar
FLSAKKKWDGIVNMTVPLDFPSCF

SEQ ID NO: 2512856 - protein, 18 aa, Entamoeba dispar
FLSKEFFQEILILPPPII

SEQ ID NO: 2512857 - protein, 24 aa, Entamoeba dispar
FLTEIYFDVAITFGKRTEYRMLYF

SEQ ID NO: 2512858 - protein, 17 aa, Entamoeba dispar
FLWELRMVFNRDLTQLE

SEQ ID NO: 2512859 - protein, 17 aa, Entamoeba dispar
FLYPRLINYKGDIKKIQ

SEQ ID NO: 2512860 - protein, 21 aa, Entamoeba dispar
FMGELYLKCFDQFNEQIRSTE

SEQ ID NO: 2512861 - protein, 23 aa, Entamoeba dispar
FMLRCPGCLQMYYCEGCNENEHT

SEQ ID NO: 2512862 - protein, 18 aa, Entamoeba dispar
FMPAIGLGTWLAAPGEVG

SEQ ID NO: 2512863 - protein, 17 aa, Entamoeba dispar
FMSFELIHSMFLDQTAK

SEQ ID NO: 2512864 - protein, 17 aa, Entamoeba dispar
FMVYDFFVTDGLFYKIL

SEQ ID NO: 2512865 - protein, 19 aa, Entamoeba dispar
FMYSIPFFFHLKKLKIGYS

SEQ ID NO: 2512866 - protein, 18 aa, Entamoeba dispar
FNAILFVGRFAELEIPEF

SEQ ID NO: 2512867 - protein, 25 aa, Entamoeba dispar
FNAYRIDHILGFFRIWAIPAIHRTG

SEQ ID NO: 2512868 - protein, 23 aa, Entamoeba dispar
FNELKLPRLTAISSDNQTSLNQN

SEQ ID NO: 2512869 - protein, 17 aa, Entamoeba dispar
FNFLSPFAKNVMKTDGE

SEQ ID NO: 2512870 - protein, 17 aa, Entamoeba dispar
FNHLASLYFIDKKKEGY

SEQ ID NO: 2512871 - protein, 18 aa, Entamoeba dispar
FNKEFIRQKCLTFGDVVG

SEQ ID NO: 2512872 - protein, 18 aa, Entamoeba dispar
FNKLYGLLDSFYKISKKI

SEQ ID NO: 2512873 - protein, 23 aa, Entamoeba dispar
FNKTFWCSSLFYPVEFHEDKIFE

SEQ ID NO: 2512874 - protein, 22 aa, Entamoeba dispar
FNLKTAVSWLFVNIILYSEDDN

SEQ ID NO: 2512875 - protein, 18 aa, Entamoeba dispar
FNLPDRMIWKQCQEEYSV

SEQ ID NO: 2512876 - protein, 19 aa, Entamoeba dispar
FNLTDWYIGYLIQLYKNGD

SEQ ID NO: 2512877 - protein, 21 aa, Entamoeba dispar
FNLTVLRCCCSILANVGPYII

SEQ ID NO: 2512878 - protein, 19 aa, Entamoeba dispar
FNLTWSWVVSLRGLRKSTL

SEQ ID NO: 2512879 - protein, 18 aa, Entamoeba dispar
FNNRVNLFISVRNYGVGQ

SEQ ID NO: 2512880 - protein, 17 aa, Entamoeba dispar
FNPKCIVCVGDPMQLDP

SEQ ID NO: 2512881 - protein, 17 aa, Entamoeba dispar
FNQRLISIFSFNLFAGM

SEQ ID NO: 2512882 - protein, 18 aa, Entamoeba dispar
FNRHICIVFELLGMNLYD

SEQ ID NO: 2512883 - protein, 20 aa, Entamoeba dispar
FNSSIPKPQPASVIRSRTNT

SEQ ID NO: 2512884 - protein, 21 aa, Entamoeba dispar
FPFKGIHILCVVFDFSNDSIK

SEQ ID NO: 2512885 - protein, 19 aa, Entamoeba dispar
FPFPLCLIVTKQLSVETMK

SEQ ID NO: 2512886 - protein, 22 aa, Entamoeba dispar
FPFSSKNKYGLIAYVNKINIIG

SEQ ID NO: 2512887 - protein, 22 aa, Entamoeba dispar
FPFSSKNKYGLIVYVNKINIIR

SEQ ID NO: 2512888 - protein, 17 aa, Entamoeba dispar
FPHAFTISACTGSIEWD

SEQ ID NO: 2512889 - protein, 17 aa, Entamoeba dispar
FPHGGACTVVLRGPSKQ

SEQ ID NO: 2512890 - protein, 19 aa, Entamoeba dispar
FPHSACVRLWDAIFAYPEN

SEQ ID NO: 2512891 - protein, 18 aa, Entamoeba dispar
FPHSKLFFCRIHIERSLI

SEQ ID NO: 2512892 - protein, 24 aa, Entamoeba dispar
FPIADFWRHVCIVWTKCYCYFPTE

SEQ ID NO: 2512893 - protein, 19 aa, Entamoeba dispar
FPICNNSLPWSWKMKPSQF

SEQ ID NO: 2512894 - protein, 19 aa, Entamoeba dispar
FPIHPSFPILNGITKLDLS

SEQ ID NO: 2512895 - protein, 24 aa, Entamoeba dispar
FPIKDFWKHVCIVWTKCYNCYSQK

SEQ ID NO: 2512896 - protein, 20 aa, Entamoeba dispar
FPIKTSDVLKHWRRPSWSDD

SEQ ID NO: 2512897 - protein, 21 aa, Entamoeba dispar
FPILSYRSGIFSSLINSLELT

SEQ ID NO: 2512898 - protein, 20 aa, Entamoeba dispar
FPLFLCDAGLIIISRFPIVE

SEQ ID NO: 2512899 - protein, 20 aa, Entamoeba dispar
FPLFLCDAGLVIISRFPIVE

SEQ ID NO: 2512900 - protein, 17 aa, Entamoeba dispar
FPLLFDFIGSYFSFVLP

SEQ ID NO: 2512901 - protein, 22 aa, Entamoeba dispar
FPPHPLHFFSLPILPSIIHTPS

SEQ ID NO: 2512902 - protein, 17 aa, Entamoeba dispar
FPPLLSQVGMGARIRNY

SEQ ID NO: 2512903 - protein, 20 aa, Entamoeba dispar
FPREEIPTLLSVLKSLYEEN

SEQ ID NO: 2512904 - protein, 18 aa, Entamoeba dispar
FPRKILKIAAAQIAMSAG

SEQ ID NO: 2512905 - protein, 18 aa, Entamoeba dispar
FPTCLRILITAIQNRMYV

SEQ ID NO: 2512906 - protein, 19 aa, Entamoeba dispar
FPVQREFVAQLFLLIGVKQ

SEQ ID NO: 2512907 - protein, 17 aa, Entamoeba dispar
FPYQIVFGVIQKDPTNV

SEQ ID NO: 2512908 - protein, 21 aa, Entamoeba dispar
FPYSKLFLCRIHIERSLIKYF

SEQ ID NO: 2512909 - protein, 18 aa, Entamoeba dispar
FQDGFSFSLPYLLEHCVR

SEQ ID NO: 2512910 - protein, 22 aa, Entamoeba dispar
FQFAFRWFNCFLLREMSLEKGL

SEQ ID NO: 2512911 - protein, 21 aa, Entamoeba dispar
FQFPKRLICLTKMVMTNSSFN

SEQ ID NO: 2512912 - protein, 19 aa, Entamoeba dispar
FQFRVCDLLESFCKAECNN

SEQ ID NO: 2512913 - protein, 23 aa, Entamoeba dispar
FQIIKSRMTSIIIGKIKTFLVYP

SEQ ID NO: 2512914 - protein, 19 aa, Entamoeba dispar
FQKCHGCALVFDRTSQESF

SEQ ID NO: 2512915 - protein, 22 aa, Entamoeba dispar
FQKEKRIRIAILSVTAAGTGIT

SEQ ID NO: 2512916 - protein, 23 aa, Entamoeba dispar
FQRCFLDYHFLMFFIDNNGLSLL

SEQ ID NO: 2512917 - protein, 17 aa, Entamoeba dispar
FQRDAILALHFIAEDFL

SEQ ID NO: 2512918 - protein, 17 aa, Entamoeba dispar
FQRRINNTIPYWDKTLI

SEQ ID NO: 2512919 - protein, 17 aa, Entamoeba dispar
FQTRLGVMVARQLNALF

SEQ ID NO: 2512920 - protein, 18 aa, Entamoeba dispar
FQVCKGIIHQNDYLVLYI

SEQ ID NO: 2512921 - protein, 20 aa, Entamoeba dispar
FRATSLLTYCLIKYPLKEES

SEQ ID NO: 2512922 - protein, 19 aa, Entamoeba dispar
FRDGILLIKLCSKITHTKK

SEQ ID NO: 2512923 - protein, 17 aa, Entamoeba dispar
FRFDIRKLYFLRHGDPR

SEQ ID NO: 2512924 - protein, 17 aa, Entamoeba dispar
FRGDEKKSIFGIFDGYG

SEQ ID NO: 2512925 - protein, 23 aa, Entamoeba dispar
FRGIRFSAKYGFKIEDNTLNAMT

SEQ ID NO: 2512926 - protein, 19 aa, Entamoeba dispar
FRGNWPVPYIKKILVFSTD

SEQ ID NO: 2512927 - protein, 17 aa, Entamoeba dispar
FRHCNKLTINELFSNLK

SEQ ID NO: 2512928 - protein, 18 aa, Entamoeba dispar
FRIGEWMIINGLKTKSEI

SEQ ID NO: 2512929 - protein, 21 aa, Entamoeba dispar
FRIKECLRKLLVGKKFEAKEC

SEQ ID NO: 2512930 - protein, 25 aa, Entamoeba dispar
FRKHHCRNCGYIICANCRTRCKVPK

SEQ ID NO: 2512931 - protein, 21 aa, Entamoeba dispar
FRKMNCCLFCTQPFVSNKELE

SEQ ID NO: 2512932 - protein, 19 aa, Entamoeba dispar
FRKSFKLPFSRNSLGINLD

SEQ ID NO: 2512933 - protein, 20 aa, Entamoeba dispar
FRLDRCMRFLPQLQNTGGFF

SEQ ID NO: 2512934 - protein, 18 aa, Entamoeba dispar
FRLLPGMCQSLLLRIIFL

SEQ ID NO: 2512935 - protein, 17 aa, Entamoeba dispar
FRNGERFFYGKNVDDDE

SEQ ID NO: 2512936 - protein, 19 aa, Entamoeba dispar
FRNRHCILFMFDVTNRESF

SEQ ID NO: 2512937 - protein, 17 aa, Entamoeba dispar
FRPPHHIDLTEFQPKIQ

SEQ ID NO: 2512938 - protein, 20 aa, Entamoeba dispar
FRQECLWKYTSQIYDEFMNT

SEQ ID NO: 2512939 - protein, 17 aa, Entamoeba dispar
FRRSIFIDCPLFKSKEK

SEQ ID NO: 2512940 - protein, 24 aa, Entamoeba dispar
FRSKGRIPAICWRGAGNQTISRSA

SEQ ID NO: 2512941 - protein, 24 aa, Entamoeba dispar
FRTFWFYCVVLKFVIKEEYNEIYY

SEQ ID NO: 2512942 - protein, 17 aa, Entamoeba dispar
FRYSFSLLGEGEQNNGL

SEQ ID NO: 2512943 - protein, 18 aa, Entamoeba dispar
FSCFAIGTTVGFRVFGIE

SEQ ID NO: 2512944 - protein, 18 aa, Entamoeba dispar
FSCSASFKLKQIIKDYTL

SEQ ID NO: 2512945 - protein, 18 aa, Entamoeba dispar
FSDIWKFIERNAIIYPEQ

SEQ ID NO: 2512946 - protein, 22 aa, Entamoeba dispar
FSDLFFRRTFFYSFPSFAKAKE

SEQ ID NO: 2512947 - protein, 19 aa, Entamoeba dispar
FSEELGMRGNIFFNSVKYG

SEQ ID NO: 2512948 - protein, 19 aa, Entamoeba dispar
FSFLLCFMAEIILENKDRL

SEQ ID NO: 2512949 - protein, 17 aa, Entamoeba dispar
FSFRNGGSFFIIIGGEK

SEQ ID NO: 2512950 - protein, 17 aa, Entamoeba dispar
FSIPLLNFFSLKELTDI

SEQ ID NO: 2512951 - protein, 20 aa, Entamoeba dispar
FSIPVARNFFKQLLSGVKYC

SEQ ID NO: 2512952 - protein, 17 aa, Entamoeba dispar
FSKAAGIFVACTELADK

SEQ ID NO: 2512953 - protein, 23 aa, Entamoeba dispar
FSKCGKCGRILLKVIGDQTYLSC

SEQ ID NO: 2512954 - protein, 22 aa, Entamoeba dispar
FSKFYFEAALKFSDKFPTLINK

SEQ ID NO: 2512955 - protein, 17 aa, Entamoeba dispar
FSKIFSFFIHKLCKHQQ

SEQ ID NO: 2512956 - protein, 20 aa, Entamoeba dispar
FSKYLPSKCNPEYLFDYALK

SEQ ID NO: 2512957 - protein, 18 aa, Entamoeba dispar
FSLKRAGSKFVINQPAVY

SEQ ID NO: 2512958 - protein, 21 aa, Entamoeba dispar
FSLKYGFKYLYYIIPKIISLS

SEQ ID NO: 2512959 - protein, 17 aa, Entamoeba dispar
FSLLLHEVMLEFNMSWN

SEQ ID NO: 2512960 - protein, 20 aa, Entamoeba dispar
FSLYLPMLFGYQIYISSKSV

SEQ ID NO: 2512961 - protein, 23 aa, Entamoeba dispar
FSLYRKYCICRSVSDESNNKFKT

SEQ ID NO: 2512962 - protein, 20 aa, Entamoeba dispar
FSMKFKYGWYSSHIKNICKE

SEQ ID NO: 2512963 - protein, 22 aa, Entamoeba dispar
FSMRIKEWYSWHFPELYNILNN

SEQ ID NO: 2512964 - protein, 24 aa, Entamoeba dispar
FSNFKFPECFCIIAERPFESLFKK

SEQ ID NO: 2512965 - protein, 23 aa, Entamoeba dispar
FSNYLKFRFTDGIGVKKSDEIIF

SEQ ID NO: 2512966 - protein, 27 aa, Entamoeba dispar
FSRPIYAVICMFLRIVVSEVQLQISSY

SEQ ID NO: 2512967 - protein, 19 aa, Entamoeba dispar
FSSSFNFCYQIKTNDSIRC

SEQ ID NO: 2512968 - protein, 21 aa, Entamoeba dispar
FSSVLPFPFSVPISSPTPSPS

SEQ ID NO: 2512969 - protein, 17 aa, Entamoeba dispar
FSSVLPFSIPVYQFETS

SEQ ID NO: 2512970 - protein, 24 aa, Entamoeba dispar
FSVMHLRWFNMHLLRVEYYPESKI

SEQ ID NO: 2512971 - protein, 17 aa, Entamoeba dispar
FSVNEFVTYSLDNPEVY

SEQ ID NO: 2512972 - protein, 21 aa, Entamoeba dispar
FSWNSWNGWIPTWVVNKATKS

SEQ ID NO: 2512973 - protein, 17 aa, Entamoeba dispar
FSYELIRGLAYIHSLNI

SEQ ID NO: 2512974 - protein, 22 aa, Entamoeba dispar
FTDLRSGLALIRLMEKLTGKTL

SEQ ID NO: 2512975 - protein, 18 aa, Entamoeba dispar
FTDNCFRNSISLINISIP

SEQ ID NO: 2512976 - protein, 22 aa, Entamoeba dispar
FTHSVWRLLLWAADYYHHPIGD

SEQ ID NO: 2512977 - protein, 17 aa, Entamoeba dispar
FTICTWFYIHSFPEYQT

SEQ ID NO: 2512978 - protein, 19 aa, Entamoeba dispar
FTKPHWKKILLDTFNHCTN

SEQ ID NO: 2512979 - protein, 18 aa, Entamoeba dispar
FTMFKRNLEFNGGKVPFG

SEQ ID NO: 2512980 - protein, 17 aa, Entamoeba dispar
FTMVGGFLFLRIICPSL

SEQ ID NO: 2512981 - protein, 24 aa, Entamoeba dispar
FTPETRKRLLLCSIARSGKDVVKE

SEQ ID NO: 2512982 - protein, 18 aa, Entamoeba dispar
FTQMYWKIGMKNFDKFIE

SEQ ID NO: 2512983 - protein, 19 aa, Entamoeba dispar
FTSELPVAVKSYGEIVIAY

SEQ ID NO: 2512984 - protein, 18 aa, Entamoeba dispar
FTVKQCLSHEFFSRKRDK

SEQ ID NO: 2512985 - protein, 17 aa, Entamoeba dispar
FTVMCLNTFGTLYKDGF

SEQ ID NO: 2512986 - protein, 17 aa, Entamoeba dispar
FVAQLFLLIGVKQNEDL

SEQ ID NO: 2512987 - protein, 17 aa, Entamoeba dispar
FVCPTCESFCCNRLASK

SEQ ID NO: 2512988 - protein, 22 aa, Entamoeba dispar
FVDGKAFLALLCSLDKDQKTFD

SEQ ID NO: 2512989 - protein, 18 aa, Entamoeba dispar
FVDYLFLAMMIQIREPIL

SEQ ID NO: 2512990 - protein, 20 aa, Entamoeba dispar
FVELAHPFPLCLISRKEPVT

SEQ ID NO: 2512991 - protein, 22 aa, Entamoeba dispar
FVFGCIICKGWNPNNQQFNQQV

SEQ ID NO: 2512992 - protein, 17 aa, Entamoeba dispar
FVFYIPSMKAFCASEEI

SEQ ID NO: 2512993 - protein, 17 aa, Entamoeba dispar
FVILRPAIIYGPGDVTG

SEQ ID NO: 2512994 - protein, 17 aa, Entamoeba dispar
FVLSFIFRNIIQSISTN

SEQ ID NO: 2512995 - protein, 20 aa, Entamoeba dispar
FVNACLRKGILPIMLEEMLS

SEQ ID NO: 2512996 - protein, 18 aa, Entamoeba dispar
FVNSCLELAWSQIQTFLI

SEQ ID NO: 2512997 - protein, 19 aa, Entamoeba dispar
FVPLKGCSFLLHINGKNNN

SEQ ID NO: 2512998 - protein, 20 aa, Entamoeba dispar
FVVQCLYRFVTHSTSLDIKQ

SEQ ID NO: 2512999 - protein, 17 aa, Entamoeba dispar
FVYFVSFLLGYYLFETY

SEQ ID NO: 2513000 - protein, 17 aa, Entamoeba dispar
FWCVFKGTNYEFSRYGT

SEQ ID NO: 2513001 - protein, 17 aa, Entamoeba dispar
FWEHVCIVWTKCFNYTP

SEQ ID NO: 2513002 - protein, 17 aa, Entamoeba dispar
FWEHVCIVWTKCYNYTP

SEQ ID NO: 2513003 - protein, 19 aa, Entamoeba dispar
FWMDIPFNEIEMIQNAATA

SEQ ID NO: 2513004 - protein, 18 aa, Entamoeba dispar
FWMFKYVMDFLQPFYFCK

SEQ ID NO: 2513005 - protein, 17 aa, Entamoeba dispar
FWQLGMKNFDEFIKKLK

SEQ ID NO: 2513006 - protein, 17 aa, Entamoeba dispar
FWQRDLFEIYGFEEKDQ

SEQ ID NO: 2513007 - protein, 18 aa, Entamoeba dispar
FYADLCVSLSIFISSNFT

SEQ ID NO: 2513008 - protein, 18 aa, Entamoeba dispar
FYEYSVIFSKQFPTVNQR

SEQ ID NO: 2513009 - protein, 17 aa, Entamoeba dispar
FYFLIDFNKQFKDNDSF

SEQ ID NO: 2513010 - protein, 23 aa, Entamoeba dispar
FYGPTRVEGFWTYDENNISWNPY

SEQ ID NO: 2513011 - protein, 17 aa, Entamoeba dispar
FYGVLSFNIKSQYQLYL

SEQ ID NO: 2513012 - protein, 20 aa, Entamoeba dispar
FYKNCRIVLDLHEFSVNEFN

SEQ ID NO: 2513013 - protein, 21 aa, Entamoeba dispar
FYLKSEWKFADDLRLMLQIAK

SEQ ID NO: 2513014 - protein, 18 aa, Entamoeba dispar
FYLVCITIQLPIPHREVI

SEQ ID NO: 2513015 - protein, 21 aa, Entamoeba dispar
FYLYFYKRFPGLLILVYNIVK

SEQ ID NO: 2513016 - protein, 20 aa, Entamoeba dispar
FYNHANCIIALFDLSNKDSL

SEQ ID NO: 2513017 - protein, 18 aa, Entamoeba dispar
FYPYCSFTLNGSVYSTYY

SEQ ID NO: 2513018 - protein, 20 aa, Entamoeba dispar
FYQRIQIIIISSIVIFKNKT

SEQ ID NO: 2513019 - protein, 20 aa, Entamoeba dispar
FYQYARWAWEKVKELSQNII

SEQ ID NO: 2513020 - protein, 17 aa, Entamoeba dispar
FYRRIRSNPSYYFVEGR

SEQ ID NO: 2513021 - protein, 24 aa, Entamoeba dispar
FYYSRLSFLPVIRPLFLNYPNDQT

SEQ ID NO: 2513022 - protein, 18 aa, Entamoeba dispar
GAALKWIRDIGILKDYNE

SEQ ID NO: 2513023 - protein, 19 aa, Entamoeba dispar
GAFCFKDCFGLIEFESLAE

SEQ ID NO: 2513024 - protein, 19 aa, Entamoeba dispar
GAIDCLRQLITMFGDMKEE

SEQ ID NO: 2513025 - protein, 22 aa, Entamoeba dispar
GAINCFFYPIIPFKWIADETVT

SEQ ID NO: 2513026 - protein, 19 aa, Entamoeba dispar
GALVTRTFTESGFYEIKRP

SEQ ID NO: 2513027 - protein, 18 aa, Entamoeba dispar
GCCDKECKQQCTHLLSYI

SEQ ID NO: 2513028 - protein, 19 aa, Entamoeba dispar
GCCFYKCSLLKSINIPSSV

SEQ ID NO: 2513029 - protein, 18 aa, Entamoeba dispar
GCFKRCLLKSINIPSSIN

SEQ ID NO: 2513030 - protein, 19 aa, Entamoeba dispar
GCFLCLKCGMVHKNFSKKL

SEQ ID NO: 2513031 - protein, 24 aa, Entamoeba dispar
GCIAAEFFLGIPIFPGNSEYNQLY

SEQ ID NO: 2513032 - protein, 17 aa, Entamoeba dispar
GCLMGGVHGGIYNICEI

SEQ ID NO: 2513033 - protein, 22 aa, Entamoeba dispar
GCNARPSVCPCWSVEPKLGTNP

SEQ ID NO: 2513034 - protein, 20 aa, Entamoeba dispar
GCVVAELFLGIPLFAGSSEH

SEQ ID NO: 2513035 - protein, 19 aa, Entamoeba dispar
GCYACSPKESFYCVIKDGF

SEQ ID NO: 2513036 - protein, 21 aa, Entamoeba dispar
GDAVDCWKKCLVILSSVDMLV

SEQ ID NO: 2513037 - protein, 17 aa, Entamoeba dispar
GDDCFRWCSSLQTIKIP

SEQ ID NO: 2513038 - protein, 17 aa, Entamoeba dispar
GDECFKCCYDIKEINLP

SEQ ID NO: 2513039 - protein, 23 aa, Entamoeba dispar
GDLPRLLKHLSIVREISEGNYDT

SEQ ID NO: 2513040 - protein, 20 aa, Entamoeba dispar
GDVRYGINMLQSFVKCGVTL

SEQ ID NO: 2513041 - protein, 17 aa, Entamoeba dispar
GDWCFCYCYSLTSIIIP

SEQ ID NO: 2513042 - protein, 17 aa, Entamoeba dispar
GDYCSECGNIILQEVDK

SEQ ID NO: 2513043 - protein, 21 aa, Entamoeba dispar
GDYRWAVTILNYLIFSNPKNE

SEQ ID NO: 2513044 - protein, 20 aa, Entamoeba dispar
GEAFSQFIPMMNVYKLFLGN

SEQ ID NO: 2513045 - protein, 18 aa, Entamoeba dispar
GECKFTFKEMQTLNVKRD

SEQ ID NO: 2513046 - protein, 18 aa, Entamoeba dispar
GEEGINCLLQTNQVNIEP

SEQ ID NO: 2513047 - protein, 20 aa, Entamoeba dispar
GEEKTGKVVKLWQPSLSDFK

SEQ ID NO: 2513048 - protein, 17 aa, Entamoeba dispar
GEFANSFISSFQGDQSM

SEQ ID NO: 2513049 - protein, 17 aa, Entamoeba dispar
GEFCFELIKSLGHSMKQ

SEQ ID NO: 2513050 - protein, 21 aa, Entamoeba dispar
GEGSCCQECYSIFEEIDMKGH

SEQ ID NO: 2513051 - protein, 19 aa, Entamoeba dispar
GEGWRPLYQRTFTTFAKLW

SEQ ID NO: 2513052 - protein, 22 aa, Entamoeba dispar
GEICSGLWYLHFNKRLIHRDLK

SEQ ID NO: 2513053 - protein, 19 aa, Entamoeba dispar
GEIDRVCNLCFSKATGKKL

SEQ ID NO: 2513054 - protein, 23 aa, Entamoeba dispar
GEKKKACGFVKFKRVEDAIRCVC

SEQ ID NO: 2513055 - protein, 18 aa, Entamoeba dispar
GEKQSYKHIFGISNQAKD

SEQ ID NO: 2513056 - protein, 21 aa, Entamoeba dispar
GELCIQCWKGLIKYKEIQTKL

SEQ ID NO: 2513057 - protein, 19 aa, Entamoeba dispar
GELKKAKFPGGIKVDDKTI

SEQ ID NO: 2513058 - protein, 23 aa, Entamoeba dispar
GELWVSGWCILSFQNKATNKSYC

SEQ ID NO: 2513059 - protein, 23 aa, Entamoeba dispar
GEMELRAFLVFDVYKEVKKEEKV

SEQ ID NO: 2513060 - protein, 19 aa, Entamoeba dispar
GENILMLAIQLGFNDIAFE

SEQ ID NO: 2513061 - protein, 22 aa, Entamoeba dispar
GEPRTMFKFVLEFLKLSLQNED

SEQ ID NO: 2513062 - protein, 20 aa, Entamoeba dispar
GESGLHLMIKMCYNSITKNE

SEQ ID NO: 2513063 - protein, 20 aa, Entamoeba dispar
GETYIRMIIHLPISNKEKME

SEQ ID NO: 2513064 - protein, 19 aa, Entamoeba dispar
GEVLLRIQWEGDVLPVQPE

SEQ ID NO: 2513065 - protein, 20 aa, Entamoeba dispar
GEYKFCRFCEGEPYETNVCY

SEQ ID NO: 2513066 - protein, 20 aa, Entamoeba dispar
GEYRWAATILNHLVFANPSN

SEQ ID NO: 2513067 - protein, 21 aa, Entamoeba dispar
GFEELRLEFCRLMIQYNIHEN

SEQ ID NO: 2513068 - protein, 27 aa, Entamoeba dispar
GFRKLETQTGFCFRHESFIAGHPELLP

SEQ ID NO: 2513069 - protein, 17 aa, Entamoeba dispar
GFTQMFWELGMKSFDEF

SEQ ID NO: 2513070 - protein, 19 aa, Entamoeba dispar
GFVRLKIRVGDSIVTQVIS

SEQ ID NO: 2513071 - protein, 18 aa, Entamoeba dispar
GGCGCGFCYACGKEVSHH

SEQ ID NO: 2513072 - protein, 19 aa, Entamoeba dispar
GGCSLKNLIIQNIPSIVQI

SEQ ID NO: 2513073 - protein, 19 aa, Entamoeba dispar
GGEGMFKFYYIPVGKTCEL

SEQ ID NO: 2513074 - protein, 18 aa, Entamoeba dispar
GGFDSCWLCEKGIESINF

SEQ ID NO: 2513075 - protein, 18 aa, Entamoeba dispar
GGGLKLLLDYGCVDQLYS

SEQ ID NO: 2513076 - protein, 19 aa, Entamoeba dispar
GGKWKSWKRRFFVFDQTTL

SEQ ID NO: 2513077 - protein, 17 aa, Entamoeba dispar
GGRDGKLCFWKMDKKPS

SEQ ID NO: 2513078 - protein, 25 aa, Entamoeba dispar
GGSWKSWKRRWFVIKDRKMWYFAGK

SEQ ID NO: 2513079 - protein, 18 aa, Entamoeba dispar
GGVGLNLIGCSRLILFDP

SEQ ID NO: 2513080 - protein, 19 aa, Entamoeba dispar
GGWRMRISIAKAIYMHPDL

SEQ ID NO: 2513081 - protein, 23 aa, Entamoeba dispar
GHIIWNWYNRWLVLTKEQLYYYD

SEQ ID NO: 2513082 - protein, 22 aa, Entamoeba dispar
GHSFEILDAVAFSKEILPKYYK

SEQ ID NO: 2513083 - protein, 18 aa, Entamoeba dispar
GHVYSLRDDFSWIEESVK

SEQ ID NO: 2513084 - protein, 19 aa, Entamoeba dispar
GHWYLFIVCCQLYKKSEEK

SEQ ID NO: 2513085 - protein, 22 aa, Entamoeba dispar
GICKAHGLGVMFTCKFYDRFIK

SEQ ID NO: 2513086 - protein, 18 aa, Entamoeba dispar
GIEVLCLLYALKVKYPGS

SEQ ID NO: 2513087 - protein, 19 aa, Entamoeba dispar
GIFDISMLFSLKICNEDID

SEQ ID NO: 2513088 - protein, 21 aa, Entamoeba dispar
GIIFCKNCGIVLDKSAMEYIP

SEQ ID NO: 2513089 - protein, 17 aa, Entamoeba dispar
GIIKICIILIKKSQVKF

SEQ ID NO: 2513090 - protein, 17 aa, Entamoeba dispar
GILCFFPSYSYMNICIS

SEQ ID NO: 2513091 - protein, 18 aa, Entamoeba dispar
GILKRIIEVGIRMNDLNN

SEQ ID NO: 2513092 - protein, 17 aa, Entamoeba dispar
GILPLVISLLSEQDTKT

SEQ ID NO: 2513093 - protein, 18 aa, Entamoeba dispar
GILPRFLQVISHILYFEY

SEQ ID NO: 2513094 - protein, 19 aa, Entamoeba dispar
GILPSRRFICCGPMYLTNN

SEQ ID NO: 2513095 - protein, 23 aa, Entamoeba dispar
GILYCIRKNFFLWLLENKPSSAL

SEQ ID NO: 2513096 - protein, 19 aa, Entamoeba dispar
GINKCAFVAMKVMKKYHPK

SEQ ID NO: 2513097 - protein, 17 aa, Entamoeba dispar
GINTLKLFKICYNSTTF

SEQ ID NO: 2513098 - protein, 21 aa, Entamoeba dispar
GIQILKMRYLIIYKYYSDKSV

SEQ ID NO: 2513099 - protein, 18 aa, Entamoeba dispar
GIRRRIVKDYGFKERYKI

SEQ ID NO: 2513100 - protein, 17 aa, Entamoeba dispar
GISSPLYAGRNVNDLST

SEQ ID NO: 2513101 - protein, 20 aa, Entamoeba dispar
GIVLFKWGQGKLRGEPINTV

SEQ ID NO: 2513102 - protein, 19 aa, Entamoeba dispar
GIYNWIFGGLRNWNLRGLL

SEQ ID NO: 2513103 - protein, 21 aa, Entamoeba dispar
GKADAIVAVFSFDDYKSFEDT

SEQ ID NO: 2513104 - protein, 23 aa, Entamoeba dispar
GKDWYKKRMQWLSKVGPGLDEES

SEQ ID NO: 2513105 - protein, 20 aa, Entamoeba dispar
GKELCKGYVDLAHYADLNGV

SEQ ID NO: 2513106 - protein, 20 aa, Entamoeba dispar
GKEPFVFTNYFHGWRVNKKQ

SEQ ID NO: 2513107 - protein, 19 aa, Entamoeba dispar
GKFKVICVYGGVDIQGQIN

SEQ ID NO: 2513108 - protein, 17 aa, Entamoeba dispar
GKFNEIFLLNSWFSSNP

SEQ ID NO: 2513109 - protein, 19 aa, Entamoeba dispar
GKFNNEWAVTLYNATDKDI

SEQ ID NO: 2513110 - protein, 18 aa, Entamoeba dispar
GKGNLLFVNCVYPEKFAL

SEQ ID NO: 2513111 - protein, 17 aa, Entamoeba dispar
GKHKVLIASFIPGICEQ

SEQ ID NO: 2513112 - protein, 17 aa, Entamoeba dispar
GKHLFPFCIPLKNFPHS

SEQ ID NO: 2513113 - protein, 22 aa, Entamoeba dispar
GKICQCIKCGYRGNADVILPKG

SEQ ID NO: 2513114 - protein, 21 aa, Entamoeba dispar
GKIKICKYIELINCTIDTTNC

SEQ ID NO: 2513115 - protein, 22 aa, Entamoeba dispar
GKKFGIPLLIGFTYEYPISAPE

SEQ ID NO: 2513116 - protein, 19 aa, Entamoeba dispar
GKKGITMLFTFDCNDTHDQ

SEQ ID NO: 2513117 - protein, 26 aa, Entamoeba dispar
GKKISCAVLYCWCVSLLLEKLNNTEK

SEQ ID NO: 2513118 - protein, 18 aa, Entamoeba dispar
GKKLPIPEIVPFRLTREI

SEQ ID NO: 2513119 - protein, 21 aa, Entamoeba dispar
GKLCFCGCCLLTSISIPSSIS

SEQ ID NO: 2513120 - protein, 17 aa, Entamoeba dispar
GKLKFIFNGGAPLTYGL

SEQ ID NO: 2513121 - protein, 20 aa, Entamoeba dispar
GKLLLVWKWTPSVILNVECK

SEQ ID NO: 2513122 - protein, 17 aa, Entamoeba dispar
GKLVWKITVCVHIINDC

SEQ ID NO: 2513123 - protein, 17 aa, Entamoeba dispar
GKMLFMSPFFLNKLQSY

SEQ ID NO: 2513124 - protein, 22 aa, Entamoeba dispar
GKNKVVCLLFPWIIRPQQNIMF

SEQ ID NO: 2513125 - protein, 20 aa, Entamoeba dispar
GKPFSFPKMEFKIYNDQAYH

SEQ ID NO: 2513126 - protein, 17 aa, Entamoeba dispar
GKPIIQWQIEVLEKLNV

SEQ ID NO: 2513127 - protein, 17 aa, Entamoeba dispar
GKQILIRKCELDGFPSI

SEQ ID NO: 2513128 - protein, 25 aa, Entamoeba dispar
GKQIYKIFCSLRLLVLDVLTQILKT

SEQ ID NO: 2513129 - protein, 21 aa, Entamoeba dispar
GKQQWRDVCIKIQNYYHNLIT

SEQ ID NO: 2513130 - protein, 17 aa, Entamoeba dispar
GKRSLAFRLFSCKITGK

SEQ ID NO: 2513131 - protein, 24 aa, Entamoeba dispar
GKSAILVALAICFGAKAQFTNRGK

SEQ ID NO: 2513132 - protein, 24 aa, Entamoeba dispar
GKSAILVALAICFGAKATFTNRGK

SEQ ID NO: 2513133 - protein, 22 aa, Entamoeba dispar
GKSKEEAICLVSKEAVVVITQE

SEQ ID NO: 2513134 - protein, 18 aa, Entamoeba dispar
GKTEAYFPYRLPSRAIYG

SEQ ID NO: 2513135 - protein, 23 aa, Entamoeba dispar
GKTLCPFCGLWISENKFKIHQSQ

SEQ ID NO: 2513136 - protein, 20 aa, Entamoeba dispar
GKTRACVLAHLITAGITPKF

SEQ ID NO: 2513137 - protein, 17 aa, Entamoeba dispar
GKYELIFIYSILNRVMN

SEQ ID NO: 2513138 - protein, 24 aa, Entamoeba dispar
GKYLERFSSFLLNFIKLPTPNVLP

SEQ ID NO: 2513139 - protein, 17 aa, Entamoeba dispar
GLACLLALMELHQKFEH

SEQ ID NO: 2513140 - protein, 17 aa, Entamoeba dispar
GLELRFDSLFGIDIKDW

SEQ ID NO: 2513141 - protein, 24 aa, Entamoeba dispar
GLEMKFCYEREEFGKTIIDDLIPN

SEQ ID NO: 2513142 - protein, 17 aa, Entamoeba dispar
GLEYIRPVGCMRCALHV

SEQ ID NO: 2513143 - protein, 18 aa, Entamoeba dispar
GLFLRSYLLYVIKNYLPT

SEQ ID NO: 2513144 - protein, 18 aa, Entamoeba dispar
GLHGWAFTLEKFAKMWSA

SEQ ID NO: 2513145 - protein, 17 aa, Entamoeba dispar
GLIEACIVRLMKKNRKM

SEQ ID NO: 2513146 - protein, 17 aa, Entamoeba dispar
GLIKYRNYWNIPLVSNQ

SEQ ID NO: 2513147 - protein, 19 aa, Entamoeba dispar
GLIQFKGPMNLKHNRGSAR

SEQ ID NO: 2513148 - protein, 19 aa, Entamoeba dispar
GLKKFQIECCDRLDEIINI

SEQ ID NO: 2513149 - protein, 23 aa, Entamoeba dispar
GLLDKIMFCYGIGYKNPRKEGGP

SEQ ID NO: 2513150 - protein, 18 aa, Entamoeba dispar
GLLKECYSLLVQELSNGV

SEQ ID NO: 2513151 - protein, 19 aa, Entamoeba dispar
GLLLRAMKSGSWVLLDELN

SEQ ID NO: 2513152 - protein, 20 aa, Entamoeba dispar
GLMEGVALWALRKPFNEVIE

SEQ ID NO: 2513153 - protein, 17 aa, Entamoeba dispar
GLMSACFLVYMLDSLNA

SEQ ID NO: 2513154 - protein, 19 aa, Entamoeba dispar
GLNKLYAYLCDEIRANFDS

SEQ ID NO: 2513155 - protein, 17 aa, Entamoeba dispar
GLPLPVYDSLKYFKENP

SEQ ID NO: 2513156 - protein, 21 aa, Entamoeba dispar
GLSPRCWWGFYGKLLNRQQLN

SEQ ID NO: 2513157 - protein, 19 aa, Entamoeba dispar
GLTIPGFCLTIGKIKEIMH

SEQ ID NO: 2513158 - protein, 22 aa, Entamoeba dispar
GLTPFYFKEFVETLIGKSIGKK

SEQ ID NO: 2513159 - protein, 20 aa, Entamoeba dispar
GMIKCVKDIIGIHAKELLVD

SEQ ID NO: 2513160 - protein, 18 aa, Entamoeba dispar
GMPLPFAMRLTIAVPVNE

SEQ ID NO: 2513161 - protein, 22 aa, Entamoeba dispar
GMPPPPPGGFGFRPAAPKPNAY

SEQ ID NO: 2513162 - protein, 26 aa, Entamoeba dispar
GMPPPPPGGFGFRPAAPVINGLVDTL

SEQ ID NO: 2513163 - protein, 22 aa, Entamoeba dispar
GMYCAQCGMTIHQFCIDLCNEP

SEQ ID NO: 2513164 - protein, 17 aa, Entamoeba dispar
GMYWMFGLLLGAGFKQI

SEQ ID NO: 2513165 - protein, 18 aa, Entamoeba dispar
GNAFKYLILLSHLFVCDE

SEQ ID NO: 2513166 - protein, 19 aa, Entamoeba dispar
GNDIIFFWVARMVMMSLEL

SEQ ID NO: 2513167 - protein, 19 aa, Entamoeba dispar
GNENVMIFFFLKRNIIVGI

SEQ ID NO: 2513168 - protein, 17 aa, Entamoeba dispar
GNEPMCVSFERLTPNKL

SEQ ID NO: 2513169 - protein, 19 aa, Entamoeba dispar
GNETFKIIVQIGRNNDKQR

SEQ ID NO: 2513170 - protein, 20 aa, Entamoeba dispar
GNEYKFLFCVKGGGSANKSY

SEQ ID NO: 2513171 - protein, 23 aa, Entamoeba dispar
GNGIEVFCGLAFAETTGFCCLNR

SEQ ID NO: 2513172 - protein, 23 aa, Entamoeba dispar
GNKIDCWSCGVVIYSLLYGTFPF

SEQ ID NO: 2513173 - protein, 25 aa, Entamoeba dispar
GNNQLNFPLCFTIFGATHYSFKNKA

SEQ ID NO: 2513174 - protein, 18 aa, Entamoeba dispar
GNPLENFDVFQPTERTQN

SEQ ID NO: 2513175 - protein, 23 aa, Entamoeba dispar
GNQIEALICWKQAIDITPFHASK

SEQ ID NO: 2513176 - protein, 17 aa, Entamoeba dispar
GNSDFGFACYKPGKDES

SEQ ID NO: 2513177 - protein, 24 aa, Entamoeba dispar
GNSDFKYLLGLLFQVYMNHHKSNL

SEQ ID NO: 2513178 - protein, 23 aa, Entamoeba dispar
GNVLRPHVFAAFRALYESNKKKG

SEQ ID NO: 2513179 - protein, 20 aa, Entamoeba dispar
GNYKCPLCQITLTEDDISRN

SEQ ID NO: 2513180 - protein, 22 aa, Entamoeba dispar
GPALRGCPFCYNYATVHHSEIF

SEQ ID NO: 2513181 - protein, 17 aa, Entamoeba dispar
GPCRSIGPYFEELAGQH

SEQ ID NO: 2513182 - protein, 19 aa, Entamoeba dispar
GPKLMKFVIIHSSAKARKG

SEQ ID NO: 2513183 - protein, 18 aa, Entamoeba dispar
GPLLTAICNTVCTFLKIF

SEQ ID NO: 2513184 - protein, 23 aa, Entamoeba dispar
GPNDMKVAEKIFLGRRERTKEVR

SEQ ID NO: 2513185 - protein, 18 aa, Entamoeba dispar
GPQYPGYNVQQADGKQNT

SEQ ID NO: 2513186 - protein, 23 aa, Entamoeba dispar
GPRYCMRCIKILAGCFSGSVVYL

SEQ ID NO: 2513187 - protein, 25 aa, Entamoeba dispar
GPSLKCTKCSFVIHKGCKDTFYLKC

SEQ ID NO: 2513188 - protein, 19 aa, Entamoeba dispar
GPYLCCFENWLSVQHKLIT

SEQ ID NO: 2513189 - protein, 20 aa, Entamoeba dispar
GQFYLGNAFVEFVTEAEKDK

SEQ ID NO: 2513190 - protein, 19 aa, Entamoeba dispar
GQKVSFCICKIRKGKCPGG

SEQ ID NO: 2513191 - protein, 19 aa, Entamoeba dispar
GQLFTVWFNTWFVKGTTLT

SEQ ID NO: 2513192 - protein, 18 aa, Entamoeba dispar
GQLLWDFGVPTAMSIWEA

SEQ ID NO: 2513193 - protein, 20 aa, Entamoeba dispar
GQLRLDQKVQLFQAITPQGT

SEQ ID NO: 2513194 - protein, 23 aa, Entamoeba dispar
GQRKGDNFFSYWVLTKDNIYFYR

SEQ ID NO: 2513195 - protein, 19 aa, Entamoeba dispar
GRCVCNLSDLAPVLVNGVK

SEQ ID NO: 2513196 - protein, 26 aa, Entamoeba dispar
GRGHPRFRKPRIGGDGVYEFDILHYA

SEQ ID NO: 2513197 - protein, 20 aa, Entamoeba dispar
GRIFKTIIWYTVDYSTYLFE

SEQ ID NO: 2513198 - protein, 17 aa, Entamoeba dispar
GRIFKYIIWYTISYSTY

SEQ ID NO: 2513199 - protein, 17 aa, Entamoeba dispar
GRIGPFIDHLYPDLRNA

SEQ ID NO: 2513200 - protein, 22 aa, Entamoeba dispar
GRIIKLLIWYAVNYSTYLKEKK

SEQ ID NO: 2513201 - protein, 17 aa, Entamoeba dispar
GRKGHIGILEWKTQKLI

SEQ ID NO: 2513202 - protein, 21 aa, Entamoeba dispar
GRKGLPQSFLNRFTEVYVNKM

SEQ ID NO: 2513203 - protein, 21 aa, Entamoeba dispar
GRLCTCLALIKAQRVNETETV

SEQ ID NO: 2513204 - protein, 18 aa, Entamoeba dispar
GRLKKGLIYNFGSNTCWH

SEQ ID NO: 2513205 - protein, 22 aa, Entamoeba dispar
GRLPAIEFMFGLPLETPRNKQR

SEQ ID NO: 2513206 - protein, 19 aa, Entamoeba dispar
GRNELKEKLIIESNSNTID

SEQ ID NO: 2513207 - protein, 17 aa, Entamoeba dispar
GRNGLKIDTVFKNKDTV

SEQ ID NO: 2513208 - protein, 17 aa, Entamoeba dispar
GRSCFRECISLKSINIP

SEQ ID NO: 2513209 - protein, 22 aa, Entamoeba dispar
GRSGIPLVIECGIQYFSANIDA

SEQ ID NO: 2513210 - protein, 18 aa, Entamoeba dispar
GRSNVMFIFRTIDQHIFG

SEQ ID NO: 2513211 - protein, 22 aa, Entamoeba dispar
GRSRFARLGLFVHITASFMNPG

SEQ ID NO: 2513212 - protein, 18 aa, Entamoeba dispar
GRTFIRFCEELKFDLPFV

SEQ ID NO: 2513213 - protein, 18 aa, Entamoeba dispar
GRTFKFLTELGIPTEHIR

SEQ ID NO: 2513214 - protein, 17 aa, Entamoeba dispar
GRTRPGQCYRLYTEKGF

SEQ ID NO: 2513215 - protein, 17 aa, Entamoeba dispar
GRYSLWSAIGLTIMISI

SEQ ID NO: 2513216 - protein, 24 aa, Entamoeba dispar
GSCKCPRIKGMLIDFFGSEKVDQI

SEQ ID NO: 2513217 - protein, 18 aa, Entamoeba dispar
GSELKLASAQVMALFNKA

SEQ ID NO: 2513218 - protein, 21 aa, Entamoeba dispar
GSEYWTCFGTAYKEMCNYFDS

SEQ ID NO: 2513219 - protein, 20 aa, Entamoeba dispar
GSGKIVICFDRIIIVKGNTI

SEQ ID NO: 2513220 - protein, 20 aa, Entamoeba dispar
GSIDALIRWAVNPNIDNNIK

SEQ ID NO: 2513221 - protein, 17 aa, Entamoeba dispar
GSIPRSSFVKKFSLAAQ

SEQ ID NO: 2513222 - protein, 24 aa, Entamoeba dispar
GSIRIALLLWKHFFLSLPNPVIEE

SEQ ID NO: 2513223 - protein, 19 aa, Entamoeba dispar
GSIVFKFKLKINENGLMEL

SEQ ID NO: 2513224 - protein, 18 aa, Entamoeba dispar
GSKSWVFGIEKGFWIHSK

SEQ ID NO: 2513225 - protein, 19 aa, Entamoeba dispar
GSLMCYHRLLLKGNNETEK

SEQ ID NO: 2513226 - protein, 21 aa, Entamoeba dispar
GSLPGIIPFLFEKLQKKKSFF

SEQ ID NO: 2513227 - protein, 20 aa, Entamoeba dispar
GSLPIPFIVNYSLIMEIIGN

SEQ ID NO: 2513228 - protein, 18 aa, Entamoeba dispar
GSNGFGFDSCFIPEGYDK

SEQ ID NO: 2513229 - protein, 18 aa, Entamoeba dispar
GSSELIWSPRANIVLCKA

SEQ ID NO: 2513230 - protein, 17 aa, Entamoeba dispar
GSSMFPGMKQRFIKEIT

SEQ ID NO: 2513231 - protein, 31 aa, Entamoeba dispar
GSVKNWKKRWFVLKPTRLWYFKAKNSTSAQG

SEQ ID NO: 2513232 - protein, 18 aa, Entamoeba dispar
GSVLRTEVIFRMFKSMEI

SEQ ID NO: 2513233 - protein, 17 aa, Entamoeba dispar
GSWCFYKCYSLTSINIP

SEQ ID NO: 2513234 - protein, 21 aa, Entamoeba dispar
GSWKSWKRRFFVLKDRKLWYF

SEQ ID NO: 2513235 - protein, 18 aa, Entamoeba dispar
GTAILFCELHFGYDIHIQ

SEQ ID NO: 2513236 - protein, 17 aa, Entamoeba dispar
GTCAALVKAGKCYATAT

SEQ ID NO: 2513237 - protein, 25 aa, Entamoeba dispar
GTFPKNFPFIIGVVVKKGEEDKESS

SEQ ID NO: 2513238 - protein, 18 aa, Entamoeba dispar
GTIPVFRIDVSKWVEQTY

SEQ ID NO: 2513239 - protein, 18 aa, Entamoeba dispar
GTLKICSFSVFFASNEQS

SEQ ID NO: 2513240 - protein, 26 aa, Entamoeba dispar
GTLYELFCSYCLPFLFYKQIILVNRD

SEQ ID NO: 2513241 - protein, 22 aa, Entamoeba dispar
GTNICKKCWTLLVAAVQVLNYI

SEQ ID NO: 2513242 - protein, 21 aa, Entamoeba dispar
GTRLGGMVGYTVRFEDVTSDR

SEQ ID NO: 2513243 - protein, 17 aa, Entamoeba dispar
GTRPCLYVPQSAFENLI

SEQ ID NO: 2513244 - protein, 22 aa, Entamoeba dispar
GTRSLWIWRNCKSYLFDDFKDI

SEQ ID NO: 2513245 - protein, 18 aa, Entamoeba dispar
GTVIRFIWDLADPTTLPI

SEQ ID NO: 2513246 - protein, 18 aa, Entamoeba dispar
GVAEVLRRYNEITPSVQM

SEQ ID NO: 2513247 - protein, 24 aa, Entamoeba dispar
GVDRFKTFICVGSTYIGKSVFFTK

SEQ ID NO: 2513248 - protein, 23 aa, Entamoeba dispar
GVELCALLEIIGETTIKCVTNPK

SEQ ID NO: 2513249 - protein, 19 aa, Entamoeba dispar
GVEVLCLLYALKIKYPDNI

SEQ ID NO: 2513250 - protein, 18 aa, Entamoeba dispar
GVEVLCLLYALKIKYPEH

SEQ ID NO: 2513251 - protein, 17 aa, Entamoeba dispar
GVGICYELYPTVVLLKG

SEQ ID NO: 2513252 - protein, 17 aa, Entamoeba dispar
GVKEMLNIYGFRNSISL

SEQ ID NO: 2513253 - protein, 20 aa, Entamoeba dispar
GVKVCTVIGFPLGATPSDVK

SEQ ID NO: 2513254 - protein, 19 aa, Entamoeba dispar
GVMTEGLYPCAIKCLRSIK

SEQ ID NO: 2513255 - protein, 22 aa, Entamoeba dispar
GVNFRAVLQFGNLVDVDSVETN

SEQ ID NO: 2513256 - protein, 19 aa, Entamoeba dispar
GVQKWYKKAVILIHPDKNQ

SEQ ID NO: 2513257 - protein, 18 aa, Entamoeba dispar
GVQLCGGAHAIGHEITNY

SEQ ID NO: 2513258 - protein, 19 aa, Entamoeba dispar
GVSSFKVFMVYDFFVTDGL

SEQ ID NO: 2513259 - protein, 19 aa, Entamoeba dispar
GVSSYKCGTYYRIGTVNTC

SEQ ID NO: 2513260 - protein, 18 aa, Entamoeba dispar
GVSYKFERLYGYAEGDTA

SEQ ID NO: 2513261 - protein, 17 aa, Entamoeba dispar
GVYCLLSRIIEMVTYEI

SEQ ID NO: 2513262 - protein, 23 aa, Entamoeba dispar
GWFDFKCSFFYKHIRTANYYTKK

SEQ ID NO: 2513263 - protein, 17 aa, Entamoeba dispar
GWFSRLAIRELIEKKVI

SEQ ID NO: 2513264 - protein, 25 aa, Entamoeba dispar
GWLQKELFCDVFGWVVQKIFIELKT

SEQ ID NO: 2513265 - protein, 18 aa, Entamoeba dispar
GWVCPHCQAICSATSVIS

SEQ ID NO: 2513266 - protein, 25 aa, Entamoeba dispar
GWWYGRSGCSMGYFPGEYVEVSGTI

SEQ ID NO: 2513267 - protein, 19 aa, Entamoeba dispar
GYAAIPMMYIRNTIMRLMS

SEQ ID NO: 2513268 - protein, 18 aa, Entamoeba dispar
GYEVHSWKRRYFVIKNQF

SEQ ID NO: 2513269 - protein, 18 aa, Entamoeba dispar
GYFMFYRFVGNYIASSSN

SEQ ID NO: 2513270 - protein, 21 aa, Entamoeba dispar
GYKKREIELLNSLKRTPLNDE

SEQ ID NO: 2513271 - protein, 19 aa, Entamoeba dispar
GYPWWPAKIIIMDKLNEKK

SEQ ID NO: 2513272 - protein, 25 aa, Entamoeba dispar
GYSFEEFFKLFSLLMSMTYSSSSEP

SEQ ID NO: 2513273 - protein, 17 aa, Entamoeba dispar
GYWCFCKCISLTTITIP

SEQ ID NO: 2513274 - protein, 21 aa, Entamoeba dispar
HATCCSVGKLLHLMVPVEHSF

SEQ ID NO: 2513275 - protein, 18 aa, Entamoeba dispar
HAVIHFINFIKIHKQKIF

SEQ ID NO: 2513276 - protein, 18 aa, Entamoeba dispar
HDFSCGIVLENGKRTNDC

SEQ ID NO: 2513277 - protein, 18 aa, Entamoeba dispar
HDIAIKIALRIGIEDLSK

SEQ ID NO: 2513278 - protein, 17 aa, Entamoeba dispar
HDIGHGVGHYSFVHEYP

SEQ ID NO: 2513279 - protein, 19 aa, Entamoeba dispar
HDLKELFSIGGTPPQTHYI

SEQ ID NO: 2513280 - protein, 23 aa, Entamoeba dispar
HDTKLPAVFFIFSRRLVMDYAKK

SEQ ID NO: 2513281 - protein, 23 aa, Entamoeba dispar
HEEYSFYCLWILQSIVQNNPIGQ

SEQ ID NO: 2513282 - protein, 19 aa, Entamoeba dispar
HFFERFLLCNNLYLTTYRI

SEQ ID NO: 2513283 - protein, 20 aa, Entamoeba dispar
HFFLRCNKITIGKGVITELR

SEQ ID NO: 2513284 - protein, 22 aa, Entamoeba dispar
HFGEKWPGYEFEVHGLVCKNGK

SEQ ID NO: 2513285 - protein, 18 aa, Entamoeba dispar
HFLCHGGMRTVEFKVVDI

SEQ ID NO: 2513286 - protein, 20 aa, Entamoeba dispar
HFSDIWKFIERNAIIYPEQK

SEQ ID NO: 2513287 - protein, 23 aa, Entamoeba dispar
HFTMFSQFIKLCYKIHTYSDINL

SEQ ID NO: 2513288 - protein, 19 aa, Entamoeba dispar
HFVALKCCVEVGGTAAQAK

SEQ ID NO: 2513289 - protein, 17 aa, Entamoeba dispar
HGEWCWMCRGDWKTHGE

SEQ ID NO: 2513290 - protein, 17 aa, Entamoeba dispar
HGGACTVVLRGPSKQLL

SEQ ID NO: 2513291 - protein, 17 aa, Entamoeba dispar
HGGIVIEKGRREYWRIV

SEQ ID NO: 2513292 - protein, 17 aa, Entamoeba dispar
HGISLRRGYSFKGNDEL

SEQ ID NO: 2513293 - protein, 23 aa, Entamoeba dispar
HGKLIKMVECINVLSSNALNGKI

SEQ ID NO: 2513294 - protein, 17 aa, Entamoeba dispar
HHCRFCGSCICSDCSRN

SEQ ID NO: 2513295 - protein, 23 aa, Entamoeba dispar
HHQKRFKVFIAHDGIFNTEEQYI

SEQ ID NO: 2513296 - protein, 23 aa, Entamoeba dispar
HICFSSSCSLILFYYLPNNYPFE

SEQ ID NO: 2513297 - protein, 25 aa, Entamoeba dispar
HICIGEGYGALILYHFLTNHKYDGN

SEQ ID NO: 2513298 - protein, 18 aa, Entamoeba dispar
HICLLRGKLVKYRKMLAP

SEQ ID NO: 2513299 - protein, 17 aa, Entamoeba dispar
HIGSFFRDGGKWDVSKG

SEQ ID NO: 2513300 - protein, 18 aa, Entamoeba dispar
HIIQPRFLVLIKDNDGKI

SEQ ID NO: 2513301 - protein, 21 aa, Entamoeba dispar
HIKEYLQKRIELIEKDIEKDI

SEQ ID NO: 2513302 - protein, 17 aa, Entamoeba dispar
HIPHCFIQFQNMFISLE

SEQ ID NO: 2513303 - protein, 22 aa, Entamoeba dispar
HIQAVCAITVWLKERNYNFWMD

SEQ ID NO: 2513304 - protein, 20 aa, Entamoeba dispar
HIQPRCCYECLISLECLKNA

SEQ ID NO: 2513305 - protein, 23 aa, Entamoeba dispar
HKAKILPWRTLRFNECVCTPYNA

SEQ ID NO: 2513306 - protein, 17 aa, Entamoeba dispar
HKHLLLPYCELFIKNVL

SEQ ID NO: 2513307 - protein, 23 aa, Entamoeba dispar
HKINWGMRTHERFGSGRRYFEPG

SEQ ID NO: 2513308 - protein, 18 aa, Entamoeba dispar
HKKGWAIGGINGRYGMFP

SEQ ID NO: 2513309 - protein, 18 aa, Entamoeba dispar
HKLMKMSFCSMGSIPRSS

SEQ ID NO: 2513310 - protein, 19 aa, Entamoeba dispar
HKMEIIPLLIIITTLFEMY

SEQ ID NO: 2513311 - protein, 18 aa, Entamoeba dispar
HKTECMYCPISIGTEIND

SEQ ID NO: 2513312 - protein, 21 aa, Entamoeba dispar
HLAWLSFLLYKSFKDSSEKSD

SEQ ID NO: 2513313 - protein, 20 aa, Entamoeba dispar
HLIDCLKYIYSVQEQCELIS

SEQ ID NO: 2513314 - protein, 17 aa, Entamoeba dispar
HLIPLKRLLIITNNKVT

SEQ ID NO: 2513315 - protein, 19 aa, Entamoeba dispar
HLIVYDVNKRWGWKEIETS

SEQ ID NO: 2513316 - protein, 22 aa, Entamoeba dispar
HLSEGIIHLGIRAFKNCYSLTN

SEQ ID NO: 2513317 - protein, 18 aa, Entamoeba dispar
HLSFKLVKFTSVLEEYWS

SEQ ID NO: 2513318 - protein, 24 aa, Entamoeba dispar
HLYKCSKCGFGVCSECLKKGPTCR

SEQ ID NO: 2513319 - protein, 25 aa, Entamoeba dispar
HMYCWRCLLQYLVLCPAPHKCPVCN

SEQ ID NO: 2513320 - protein, 19 aa, Entamoeba dispar
HNFELFTSFILKWKYNKIN

SEQ ID NO: 2513321 - protein, 24 aa, Entamoeba dispar
HNKCGKLFCKKCLYQWWDIQRMMT

SEQ ID NO: 2513322 - protein, 18 aa, Entamoeba dispar
HNLYHKWSVDGISFCLLK

SEQ ID NO: 2513323 - protein, 25 aa, Entamoeba dispar
HNTLKCPACLGVTGGLFSRFKRGEV

SEQ ID NO: 2513324 - protein, 17 aa, Entamoeba dispar
HPCCKRIDGQYVLTEDS

SEQ ID NO: 2513325 - protein, 24 aa, Entamoeba dispar
HPERVIYHVCKWLGNKRPSIVKGK

SEQ ID NO: 2513326 - protein, 18 aa, Entamoeba dispar
HPFWLPKFANAFYYTLPL

SEQ ID NO: 2513327 - protein, 19 aa, Entamoeba dispar
HPGCGKSFYTKKCLSVHMQ

SEQ ID NO: 2513328 - protein, 18 aa, Entamoeba dispar
HPGFGCWLSSIDISTQQS

SEQ ID NO: 2513329 - protein, 25 aa, Entamoeba dispar
HPKLFWRYILELLLLCELKVVKVYC

SEQ ID NO: 2513330 - protein, 18 aa, Entamoeba dispar
HPLRCLRKSLFITQQRQW

SEQ ID NO: 2513331 - protein, 25 aa, Entamoeba dispar
HPQGICNRTKFMLMDLIDLREMNWA

SEQ ID NO: 2513332 - protein, 19 aa, Entamoeba dispar
HPREALKVFCEIDKTKKKQ

SEQ ID NO: 2513333 - protein, 18 aa, Entamoeba dispar
HPYEALSIFCKNDQTLSV

SEQ ID NO: 2513334 - protein, 17 aa, Entamoeba dispar
HQCPICRTPITAAINFS

SEQ ID NO: 2513335 - protein, 22 aa, Entamoeba dispar
HRKRLGMNTILFLDEIHSLNRL

SEQ ID NO: 2513336 - protein, 19 aa, Entamoeba dispar
HRLPFPVNLVWQLTVAMQK

SEQ ID NO: 2513337 - protein, 17 aa, Entamoeba dispar
HSACRSCIERHMEHHNE

SEQ ID NO: 2513338 - protein, 18 aa, Entamoeba dispar
HSCDFLFPMNFPQSLQSL

SEQ ID NO: 2513339 - protein, 20 aa, Entamoeba dispar
HSFCKQCILEQILTGMRENG

SEQ ID NO: 2513340 - protein, 23 aa, Entamoeba dispar
HSFITLRELFKWADRHANSYEEL

SEQ ID NO: 2513341 - protein, 17 aa, Entamoeba dispar
HSILLFISLGSRVKKDE

SEQ ID NO: 2513342 - protein, 21 aa, Entamoeba dispar
HSLIFCIRGTFSINDIVSDMI

SEQ ID NO: 2513343 - protein, 19 aa, Entamoeba dispar
HSRRGFYISVHRNNIFQES

SEQ ID NO: 2513344 - protein, 18 aa, Entamoeba dispar
HSTLSLKINTLWRNNLKY

SEQ ID NO: 2513345 - protein, 24 aa, Entamoeba dispar
HTCPQRIGTMLSFFLEALTRNDKV

SEQ ID NO: 2513346 - protein, 24 aa, Entamoeba dispar
HTFCQFCIFHGFKIILVSRRSIEI

SEQ ID NO: 2513347 - protein, 17 aa, Entamoeba dispar
HTLRLLDHFVFHNHVCI

SEQ ID NO: 2513348 - protein, 18 aa, Entamoeba dispar
HVLIPAFLIDSGIDSETR

SEQ ID NO: 2513349 - protein, 19 aa, Entamoeba dispar
HVPKFCGVSSLTIRSFISS

SEQ ID NO: 2513350 - protein, 24 aa, Entamoeba dispar
HVYGEIIGNICFQWKEYREKIIIK

SEQ ID NO: 2513351 - protein, 17 aa, Entamoeba dispar
HYCDRAGIIIVRVGSTF

SEQ ID NO: 2513352 - protein, 17 aa, Entamoeba dispar
HYFCFGISSLIKLLQSV

SEQ ID NO: 2513353 - protein, 22 aa, Entamoeba dispar
HYFVFCYELPYSTAVILKEKMI

SEQ ID NO: 2513354 - protein, 19 aa, Entamoeba dispar
HYLMNWKKSLLLVSHDTSF

SEQ ID NO: 2513355 - protein, 18 aa, Entamoeba dispar
HYLYCGMLIYLLQFNKEA

SEQ ID NO: 2513356 - protein, 18 aa, Entamoeba dispar
HYPQIYFNFINRIKEITE

SEQ ID NO: 2513357 - protein, 19 aa, Entamoeba dispar
HYRCSISMTELLPYNTNHV

SEQ ID NO: 2513358 - protein, 19 aa, Entamoeba dispar
HYVDMDFGCFLCLKCGMVH

SEQ ID NO: 2513359 - protein, 17 aa, Entamoeba dispar
IAALFGMNQILRRETSE

SEQ ID NO: 2513360 - protein, 21 aa, Entamoeba dispar
IAALIIRYSIQFNLLLSYLKP

SEQ ID NO: 2513361 - protein, 23 aa, Entamoeba dispar
IAEFGEALDLFFYVLQQSAERVV

SEQ ID NO: 2513362 - protein, 17 aa, Entamoeba dispar
IAFMAIRTFFAKKQPIL

SEQ ID NO: 2513363 - protein, 17 aa, Entamoeba dispar
IAFRGTYSFKDCIYDIQ

SEQ ID NO: 2513364 - protein, 17 aa, Entamoeba dispar
IAKCRIITFKGKSESRG

SEQ ID NO: 2513365 - protein, 24 aa, Entamoeba dispar
IAKKFKPTLVFGVPRFYEKLLFRA

SEQ ID NO: 2513366 - protein, 19 aa, Entamoeba dispar
IALKGEEGINCLLQTNQVN

SEQ ID NO: 2513367 - protein, 24 aa, Entamoeba dispar
IARECECFGCFGIPLDIAVQRGEW

SEQ ID NO: 2513368 - protein, 18 aa, Entamoeba dispar
IARLEEYVKFFATTIKQS

SEQ ID NO: 2513369 - protein, 18 aa, Entamoeba dispar
ICCLKLPIDIVQKYLPEI

SEQ ID NO: 2513370 - protein, 17 aa, Entamoeba dispar
ICEQVKLDLVIGEEIIF

SEQ ID NO: 2513371 - protein, 18 aa, Entamoeba dispar
ICFTEKWFVERDASSYTV

SEQ ID NO: 2513372 - protein, 19 aa, Entamoeba dispar
ICFWVASLILSFPDLNNRA

SEQ ID NO: 2513373 - protein, 19 aa, Entamoeba dispar
ICGSSQKLVICDFTENVKI

SEQ ID NO: 2513374 - protein, 19 aa, Entamoeba dispar
ICIKGCEIFKLKIESNNEQ

SEQ ID NO: 2513375 - protein, 18 aa, Entamoeba dispar
ICLLNHIQLIFVFDGMTQ

SEQ ID NO: 2513376 - protein, 18 aa, Entamoeba dispar
ICLYFDCTFLKKSYLTTK

SEQ ID NO: 2513377 - protein, 19 aa, Entamoeba dispar
ICVALKMGNPDYERTHLSV

SEQ ID NO: 2513378 - protein, 19 aa, Entamoeba dispar
IDAALDFRNVSIIAHYIKE

SEQ ID NO: 2513379 - protein, 17 aa, Entamoeba dispar
IDAALVLAKASDKPTLI

SEQ ID NO: 2513380 - protein, 17 aa, Entamoeba dispar
IDACALCSIQAYEFMET

SEQ ID NO: 2513381 - protein, 21 aa, Entamoeba dispar
IDEEFARRLTVRKVNTDTNEE

SEQ ID NO: 2513382 - protein, 23 aa, Entamoeba dispar
IDESLRLKIKYALKLSTGKRDLI

SEQ ID NO: 2513383 - protein, 18 aa, Entamoeba dispar
IDFNLQWYITCSFDRYIC

SEQ ID NO: 2513384 - protein, 18 aa, Entamoeba dispar
IDGCIRLQKFPFLSRFHH

SEQ ID NO: 2513385 - protein, 17 aa, Entamoeba dispar
IDGIFSLQQQKLISRIE

SEQ ID NO: 2513386 - protein, 18 aa, Entamoeba dispar
IDGLYVWLGSKCSANTKK

SEQ ID NO: 2513387 - protein, 27 aa, Entamoeba dispar
IDGSLQLCKMCFEIAFQSIHIVLLSDF

SEQ ID NO: 2513388 - protein, 17 aa, Entamoeba dispar
IDIKIEFGWFYLNVLST

SEQ ID NO: 2513389 - protein, 18 aa, Entamoeba dispar
IDIKRLKTVINFDCPVST

SEQ ID NO: 2513390 - protein, 19 aa, Entamoeba dispar
IDILCNISFIIIGIVLHTN

SEQ ID NO: 2513391 - protein, 21 aa, Entamoeba dispar
IDIQGILCFYKNNTLNKKENE

SEQ ID NO: 2513392 - protein, 19 aa, Entamoeba dispar
IDIVKVFKIMWTKNSPKKQ

SEQ ID NO: 2513393 - protein, 19 aa, Entamoeba dispar
IDKITWWAGRLFFNEFEML

SEQ ID NO: 2513394 - protein, 19 aa, Entamoeba dispar
IDKLNCYYLNTSHIQNLRD

SEQ ID NO: 2513395 - protein, 19 aa, Entamoeba dispar
IDKLNCYYLNVSHIQNLRD

SEQ ID NO: 2513396 - protein, 17 aa, Entamoeba dispar
IDLAEGCLLDYVQNKGG

SEQ ID NO: 2513397 - protein, 20 aa, Entamoeba dispar
IDLCILLGCDYCDTIKGVGP

SEQ ID NO: 2513398 - protein, 20 aa, Entamoeba dispar
IDLLPILPIEQWKNTSSFVK

SEQ ID NO: 2513399 - protein, 17 aa, Entamoeba dispar
IDLSFIMGYSFRSSFTS

SEQ ID NO: 2513400 - protein, 17 aa, Entamoeba dispar
IDLWKKLRERAGITRDE

SEQ ID NO: 2513401 - protein, 18 aa, Entamoeba dispar
IDMEWKRKISQKFQTNER

SEQ ID NO: 2513402 - protein, 17 aa, Entamoeba dispar
IDNCQFFYFGLKQSICA

SEQ ID NO: 2513403 - protein, 19 aa, Entamoeba dispar
IDPAMLRPGRLDRLISVDL

SEQ ID NO: 2513404 - protein, 19 aa, Entamoeba dispar
IDPQISVFWGWKEGGKVKT

SEQ ID NO: 2513405 - protein, 20 aa, Entamoeba dispar
IDREKIQLVSWLNQQLLTDK

SEQ ID NO: 2513406 - protein, 17 aa, Entamoeba dispar
IDRSFCSNINYLSGKGE

SEQ ID NO: 2513407 - protein, 18 aa, Entamoeba dispar
IDTLSCFSISSNINLDDD

SEQ ID NO: 2513408 - protein, 17 aa, Entamoeba dispar
IDVWSLGIMCREMMEGY

SEQ ID NO: 2513409 - protein, 20 aa, Entamoeba dispar
IDWFSRFGIEVGDFKTSFND

SEQ ID NO: 2513410 - protein, 21 aa, Entamoeba dispar
IDWKLWCFHCKKPLDHGYVCS

SEQ ID NO: 2513411 - protein, 17 aa, Entamoeba dispar
IDYKGCWIKLNIHKDEK

SEQ ID NO: 2513412 - protein, 17 aa, Entamoeba dispar
IDYLWAYMAGKLPTGGD

SEQ ID NO: 2513413 - protein, 18 aa, Entamoeba dispar
IEAFKYCLRYEKEYKEGE

SEQ ID NO: 2513414 - protein, 21 aa, Entamoeba dispar
IECGECKKVFTYRAYQERDMK

SEQ ID NO: 2513415 - protein, 17 aa, Entamoeba dispar
IECGYCYDKAGAYGIQD

SEQ ID NO: 2513416 - protein, 17 aa, Entamoeba dispar
IEEFPPLLSQVGMGARI

SEQ ID NO: 2513417 - protein, 23 aa, Entamoeba dispar
IEEMKRKVICITFSTNEKTKEFE

SEQ ID NO: 2513418 - protein, 19 aa, Entamoeba dispar
IEGAMKWKANIDDRVLFNN

SEQ ID NO: 2513419 - protein, 18 aa, Entamoeba dispar
IEGILDYLISVTMFDSKR

SEQ ID NO: 2513420 - protein, 23 aa, Entamoeba dispar
IEGKFNCCWKVTVKDVRIIIWQM

SEQ ID NO: 2513421 - protein, 30 aa, Entamoeba dispar
IEIFKILLFPLEWVCISIALLPRLLLNQLT

SEQ ID NO: 2513422 - protein, 18 aa, Entamoeba dispar
IEIGISFPDFYSSIQLTE

SEQ ID NO: 2513423 - protein, 20 aa, Entamoeba dispar
IEIIKLPPFNELKLPRLTAI

SEQ ID NO: 2513424 - protein, 23 aa, Entamoeba dispar
IEIIPEHRCCFVSFVRHDDAMRF

SEQ ID NO: 2513425 - protein, 19 aa, Entamoeba dispar
IEIKELYLSYLIGIIHGSL

SEQ ID NO: 2513426 - protein, 21 aa, Entamoeba dispar
IEITKIKWLLSFYKLIFGALE

SEQ ID NO: 2513427 - protein, 23 aa, Entamoeba dispar
IEKELPVVISFSIQRISDVFKEE

SEQ ID NO: 2513428 - protein, 22 aa, Entamoeba dispar
IEKGCSIQKLLARNNEISFIDS

SEQ ID NO: 2513429 - protein, 22 aa, Entamoeba dispar
IEKIKIALELSRYNHLHDLRKY

SEQ ID NO: 2513430 - protein, 17 aa, Entamoeba dispar
IEKRFGQELSLFKNRKI

SEQ ID NO: 2513431 - protein, 17 aa, Entamoeba dispar
IELCIYLLLAAVIEKLP

SEQ ID NO: 2513432 - protein, 19 aa, Entamoeba dispar
IELFTSHSLCDGRTIFNCF

SEQ ID NO: 2513433 - protein, 17 aa, Entamoeba dispar
IELIKSFVFNGGKFLGI

SEQ ID NO: 2513434 - protein, 20 aa, Entamoeba dispar
IELKSGVILTGTIVGVDNYM

SEQ ID NO: 2513435 - protein, 23 aa, Entamoeba dispar
IELMKYNGGYSWWRHNSLTVFID

SEQ ID NO: 2513436 - protein, 18 aa, Entamoeba dispar
IELRSAIFNFHFDIGGEF

SEQ ID NO: 2513437 - protein, 25 aa, Entamoeba dispar
IELSKGCFRVCDFLKSFTFNSIIVS

SEQ ID NO: 2513438 - protein, 17 aa, Entamoeba dispar
IELVQLFPNCEIISQTT

SEQ ID NO: 2513439 - protein, 21 aa, Entamoeba dispar
IELYKFIGRVVAKTVYDGEFL

SEQ ID NO: 2513440 - protein, 18 aa, Entamoeba dispar
IEMFSIRYAECMSEKMNE

SEQ ID NO: 2513441 - protein, 20 aa, Entamoeba dispar
IEMNGGVVFGMFGVKRVNGQ

SEQ ID NO: 2513442 - protein, 25 aa, Entamoeba dispar
IENFKLLLFPLQWVCVCVPILPRIL

SEQ ID NO: 2513443 - protein, 19 aa, Entamoeba dispar
IENMLEWFNKMLFFVDLLK

SEQ ID NO: 2513444 - protein, 24 aa, Entamoeba dispar
IENYKTIFPFKVYKCLIEVLGDYK

SEQ ID NO: 2513445 - protein, 27 aa, Entamoeba dispar
IEPEFKSPIYIDGFRLSMPYLFDKLQI

SEQ ID NO: 2513446 - protein, 21 aa, Entamoeba dispar
IEPLPRFAIGIAQTRGIRESM

SEQ ID NO: 2513447 - protein, 20 aa, Entamoeba dispar
IEQFPGLAFFVSKEESLAGD

SEQ ID NO: 2513448 - protein, 17 aa, Entamoeba dispar
IEQRISGAIGFDSEIFG

SEQ ID NO: 2513449 - protein, 22 aa, Entamoeba dispar
IERIDIKTGFCFVVCETEEDAK

SEQ ID NO: 2513450 - protein, 22 aa, Entamoeba dispar
IERLICIFAYFHVMIEIDEKTL

SEQ ID NO: 2513451 - protein, 17 aa, Entamoeba dispar
IERSLGLMLLRGDCIQG

SEQ ID NO: 2513452 - protein, 18 aa, Entamoeba dispar
IERYRVPKEFVIDSTKYV

SEQ ID NO: 2513453 - protein, 23 aa, Entamoeba dispar
IESEQRLGILINQFNWFISPKRS

SEQ ID NO: 2513454 - protein, 20 aa, Entamoeba dispar
IESYLKYGWIFEIKNKYKEA

SEQ ID NO: 2513455 - protein, 24 aa, Entamoeba dispar
IETPKLVNRFSFFSIFKEKESEED

SEQ ID NO: 2513456 - protein, 23 aa, Entamoeba dispar
IETRLGQIFKLFTPFFKVYFLYI

SEQ ID NO: 2513457 - protein, 17 aa, Entamoeba dispar
IEVCIRSPSLELSQSLY

SEQ ID NO: 2513458 - protein, 18 aa, Entamoeba dispar
IEVCSNCYHLLGEMDLAQ

SEQ ID NO: 2513459 - protein, 23 aa, Entamoeba dispar
IEVWPRIVKIYHYIGNESDILLD

SEQ ID NO: 2513460 - protein, 18 aa, Entamoeba dispar
IEYAPLWLPQSIQNCQLC

SEQ ID NO: 2513461 - protein, 17 aa, Entamoeba dispar
IEYVWKFITKQLHQSPS

SEQ ID NO: 2513462 - protein, 20 aa, Entamoeba dispar
IFDECARKLFNMSADEMNVL

SEQ ID NO: 2513463 - protein, 19 aa, Entamoeba dispar
IFDGCSWGWVGDGLQPGFL

SEQ ID NO: 2513464 - protein, 17 aa, Entamoeba dispar
IFERYRPLMVIDDDENQ

SEQ ID NO: 2513465 - protein, 21 aa, Entamoeba dispar
IFFIRKGRTSTHFSYNVKKNG

SEQ ID NO: 2513466 - protein, 24 aa, Entamoeba dispar
IFIDLSWRLDIVLSYKNVYKLIQP

SEQ ID NO: 2513467 - protein, 17 aa, Entamoeba dispar
IFIELCVRYYSMVSSES

SEQ ID NO: 2513468 - protein, 24 aa, Entamoeba dispar
IFIRILSICLIKFDSILPSKEWIY

SEQ ID NO: 2513469 - protein, 19 aa, Entamoeba dispar
IFKARCISFDYPGYGLNKN

SEQ ID NO: 2513470 - protein, 19 aa, Entamoeba dispar
IFKDRVIKFAEWVDNDNQK

SEQ ID NO: 2513471 - protein, 18 aa, Entamoeba dispar
IFKIICFICSFITEKEEI

SEQ ID NO: 2513472 - protein, 18 aa, Entamoeba dispar
IFKSLTCYLNLFRIYIKH

SEQ ID NO: 2513473 - protein, 18 aa, Entamoeba dispar
IFKVLSFVREKGCNHIVQ

SEQ ID NO: 2513474 - protein, 24 aa, Entamoeba dispar
IFKYNPRIGFDFAYSEISFASLLG

SEQ ID NO: 2513475 - protein, 19 aa, Entamoeba dispar
IFMTRIRRVLGFSNTKESV

SEQ ID NO: 2513476 - protein, 17 aa, Entamoeba dispar
IFRCIWCSLFVHNTCQP

SEQ ID NO: 2513477 - protein, 23 aa, Entamoeba dispar
IFYAQEIFKIYPIVIVHLLDKFL

SEQ ID NO: 2513478 - protein, 22 aa, Entamoeba dispar
IFYPKDRFGLIFYGSQNTTKSL

SEQ ID NO: 2513479 - protein, 20 aa, Entamoeba dispar
IGAPRLVGFMSLGGGNVQQT

SEQ ID NO: 2513480 - protein, 24 aa, Entamoeba dispar
IGCASVKVFNAWGVLKRGVQLVHL

SEQ ID NO: 2513481 - protein, 20 aa, Entamoeba dispar
IGDACFRDCYSLTSINIPSS

SEQ ID NO: 2513482 - protein, 21 aa, Entamoeba dispar
IGDACFRDCYSLTSINIPSSI

SEQ ID NO: 2513483 - protein, 18 aa, Entamoeba dispar
IGDEGFLIAKFCKQPKNL

SEQ ID NO: 2513484 - protein, 17 aa, Entamoeba dispar
IGDELSFVFHILNKSRH

SEQ ID NO: 2513485 - protein, 18 aa, Entamoeba dispar
IGDIAMRAPMMWSLVELP

SEQ ID NO: 2513486 - protein, 17 aa, Entamoeba dispar
IGDRCFVHSISLTSINI

SEQ ID NO: 2513487 - protein, 19 aa, Entamoeba dispar
IGEGAYGVWSWRRNLQPST

SEQ ID NO: 2513488 - protein, 17 aa, Entamoeba dispar
IGEMIRRGGIKCTNVVL

SEQ ID NO: 2513489 - protein, 25 aa, Entamoeba dispar
IGGITCCACGIYICSNCRQTYTIDN

SEQ ID NO: 2513490 - protein, 19 aa, Entamoeba dispar
IGGLFIKLAPFLKIYGEYC

SEQ ID NO: 2513491 - protein, 18 aa, Entamoeba dispar
IGHWCFRECSSLTSMNID

SEQ ID NO: 2513492 - protein, 19 aa, Entamoeba dispar
IGHWCFRECSSLTSMNIDN

SEQ ID NO: 2513493 - protein, 18 aa, Entamoeba dispar
IGIEGRFGKIIFLVEKGN

SEQ ID NO: 2513494 - protein, 19 aa, Entamoeba dispar
IGIKCPLKIYKEGSPQYFQ

SEQ ID NO: 2513495 - protein, 17 aa, Entamoeba dispar
IGKFFCCHGGISPEINK

SEQ ID NO: 2513496 - protein, 17 aa, Entamoeba dispar
IGKGFIREGWGCLLMNS

SEQ ID NO: 2513497 - protein, 18 aa, Entamoeba dispar
IGKIEWKDVDVRNINFDI

SEQ ID NO: 2513498 - protein, 18 aa, Entamoeba dispar
IGLCWSFLFGEEGLQLDP

SEQ ID NO: 2513499 - protein, 24 aa, Entamoeba dispar
IGLLLRLILCLSRSLNYDGDKRIS

SEQ ID NO: 2513500 - protein, 18 aa, Entamoeba dispar
IGLWIKFQLEPSAYATML

SEQ ID NO: 2513501 - protein, 20 aa, Entamoeba dispar
IGNSCFHKCLSLKSINIPST

SEQ ID NO: 2513502 - protein, 20 aa, Entamoeba dispar
IGRPESISNFMIKYDLNKND

SEQ ID NO: 2513503 - protein, 20 aa, Entamoeba dispar
IGSFCVLDSIKIESSPTFLI

SEQ ID NO: 2513504 - protein, 18 aa, Entamoeba dispar
IGVQFGLRKKGRLLIGDE

SEQ ID NO: 2513505 - protein, 17 aa, Entamoeba dispar
IGYKCFKYCPSLTSINI

SEQ ID NO: 2513506 - protein, 17 aa, Entamoeba dispar
IGYNGIINCGDWEVVAN

SEQ ID NO: 2513507 - protein, 18 aa, Entamoeba dispar
IGYNGIINCGDWEVVANN

SEQ ID NO: 2513508 - protein, 18 aa, Entamoeba dispar
IGYYCFYKCYSLKSINIP

SEQ ID NO: 2513509 - protein, 17 aa, Entamoeba dispar
IHFLVALAYTLPRLDLD

SEQ ID NO: 2513510 - protein, 20 aa, Entamoeba dispar
IHFYYRFLIILTDYKMYIYN

SEQ ID NO: 2513511 - protein, 19 aa, Entamoeba dispar
IHIVWRKRRVIAFTDENRG

SEQ ID NO: 2513512 - protein, 17 aa, Entamoeba dispar
IHKGVWFLMNFVREEFS

SEQ ID NO: 2513513 - protein, 17 aa, Entamoeba dispar
IHLIDALIRFIRKKELQ

SEQ ID NO: 2513514 - protein, 19 aa, Entamoeba dispar
IHLLRGCGYLGSLAIICAD

SEQ ID NO: 2513515 - protein, 24 aa, Entamoeba dispar
IHVLWLRILYKISLPDDNNCFILF

SEQ ID NO: 2513516 - protein, 17 aa, Entamoeba dispar
IHYLGGRFIPLELKDKL

SEQ ID NO: 2513517 - protein, 17 aa, Entamoeba dispar
IIASLLFKSMGHERLSE

SEQ ID NO: 2513518 - protein, 19 aa, Entamoeba dispar
IICAIGFKKIEGITVDQRS

SEQ ID NO: 2513519 - protein, 17 aa, Entamoeba dispar
IICELYFELHPIFIKSC

SEQ ID NO: 2513520 - protein, 26 aa, Entamoeba dispar
IICFKRMSRGYACCHCIEEHQDITDE

SEQ ID NO: 2513521 - protein, 25 aa, Entamoeba dispar
IIDHLEVIEGIPFVGYHTRKHIFGR

SEQ ID NO: 2513522 - protein, 19 aa, Entamoeba dispar
IIDQLYLFPSIFIIQLSFT

SEQ ID NO: 2513523 - protein, 17 aa, Entamoeba dispar
IIDRIAGATNNVQYAHI

SEQ ID NO: 2513524 - protein, 17 aa, Entamoeba dispar
IIDRYGVLHMTCSAKTG

SEQ ID NO: 2513525 - protein, 24 aa, Entamoeba dispar
IIDWFSRFGIEVGDFKTSFNDGLL

SEQ ID NO: 2513526 - protein, 18 aa, Entamoeba dispar
IIEGWRIALKAAQEKLET

SEQ ID NO: 2513527 - protein, 18 aa, Entamoeba dispar
IIELKPEYLNSGDVFIID

SEQ ID NO: 2513528 - protein, 18 aa, Entamoeba dispar
IIEMTTIFVTGNVSGDTF

SEQ ID NO: 2513529 - protein, 20 aa, Entamoeba dispar
IIFKFNEAFGVAKTKGTNEL

SEQ ID NO: 2513530 - protein, 21 aa, Entamoeba dispar
IIFKFNEAFGVAKTKGTNELH

SEQ ID NO: 2513531 - protein, 18 aa, Entamoeba dispar
IIFWGLRICGLMLYSTAE

SEQ ID NO: 2513532 - protein, 20 aa, Entamoeba dispar
IIHVKIIIKPGCQKIFHFSF

SEQ ID NO: 2513533 - protein, 19 aa, Entamoeba dispar
IIIEFDFGKKLALLSGKKE

SEQ ID NO: 2513534 - protein, 23 aa, Entamoeba dispar
IIIKCSYCSTPFFVNIEKIHQFN

SEQ ID NO: 2513535 - protein, 17 aa, Entamoeba dispar
IIIPFIFNFIKPQYIDS

SEQ ID NO: 2513536 - protein, 18 aa, Entamoeba dispar
IIKGVCELCTSIINGNSV

SEQ ID NO: 2513537 - protein, 17 aa, Entamoeba dispar
IIKKLIIKRLLQRTKAD

SEQ ID NO: 2513538 - protein, 21 aa, Entamoeba dispar
IIKPEYGEYYWVAKVEDEETE

SEQ ID NO: 2513539 - protein, 17 aa, Entamoeba dispar
IIKRTILSDVFWLKSTN

SEQ ID NO: 2513540 - protein, 24 aa, Entamoeba dispar
IIKSNELWKKWIIQPQIDQVIKEI

SEQ ID NO: 2513541 - protein, 18 aa, Entamoeba dispar
IIKYLPIKRQIVLCSATL

SEQ ID NO: 2513542 - protein, 17 aa, Entamoeba dispar
IILTFKFLRECDEWYQM

SEQ ID NO: 2513543 - protein, 23 aa, Entamoeba dispar
IIPGEFWLYYVINVNKHKEEYLK

SEQ ID NO: 2513544 - protein, 17 aa, Entamoeba dispar
IIPKEINNFYGMITCYI

SEQ ID NO: 2513545 - protein, 18 aa, Entamoeba dispar
IIPSPRVRPSLSQIKENE

SEQ ID NO: 2513546 - protein, 17 aa, Entamoeba dispar
IIQVCLKICKFIAQNDL

SEQ ID NO: 2513547 - protein, 17 aa, Entamoeba dispar
IIRPLEWGLVYDIPTDM

SEQ ID NO: 2513548 - protein, 18 aa, Entamoeba dispar
IIRQIVFRILKIPLIEER

SEQ ID NO: 2513549 - protein, 19 aa, Entamoeba dispar
IIRRLKEINIRDISNGISS

SEQ ID NO: 2513550 - protein, 21 aa, Entamoeba dispar
IISCYCYGKLIPKYSKCFLSI

SEQ ID NO: 2513551 - protein, 25 aa, Entamoeba dispar
IISFGRSCFYGCGCVEELKQNKRIP

SEQ ID NO: 2513552 - protein, 26 aa, Entamoeba dispar
IISLGFPKKVKVSLCFIKTIQEAINI

SEQ ID NO: 2513553 - protein, 19 aa, Entamoeba dispar
IISMLSWVRTLPSLKNKEV

SEQ ID NO: 2513554 - protein, 18 aa, Entamoeba dispar
IISPSNVCISDFGSDFSK

SEQ ID NO: 2513555 - protein, 22 aa, Entamoeba dispar
IISRLPSLPLYRIELLCDDINY

SEQ ID NO: 2513556 - protein, 19 aa, Entamoeba dispar
IITTLRFILCSAAQYDISS

SEQ ID NO: 2513557 - protein, 22 aa, Entamoeba dispar
IIVHCIRCVFYIGRNKTGLIKM

SEQ ID NO: 2513558 - protein, 22 aa, Entamoeba dispar
IIYRKTYCGFALSNAFDSFETN

SEQ ID NO: 2513559 - protein, 19 aa, Entamoeba dispar
IKARMFLGKCVIDKDLQIH

SEQ ID NO: 2513560 - protein, 17 aa, Entamoeba dispar
IKARWMRKNARRLDIEH

SEQ ID NO: 2513561 - protein, 17 aa, Entamoeba dispar
IKARWMRKNARRLDIEN

SEQ ID NO: 2513562 - protein, 18 aa, Entamoeba dispar
IKARWMRKNARRLDVEQY

SEQ ID NO: 2513563 - protein, 18 aa, Entamoeba dispar
IKCLYSLILTRVKLEELI

SEQ ID NO: 2513564 - protein, 17 aa, Entamoeba dispar
IKCPMTIPFYEEYINNS

SEQ ID NO: 2513565 - protein, 20 aa, Entamoeba dispar
IKDIWKHVCIVWTKCYNCYS

SEQ ID NO: 2513566 - protein, 19 aa, Entamoeba dispar
IKEAIHLLMRLGYKDIKII

SEQ ID NO: 2513567 - protein, 19 aa, Entamoeba dispar
IKEIFKRYYQGIIQLPNFN

SEQ ID NO: 2513568 - protein, 18 aa, Entamoeba dispar
IKEIGCKSFGYCRSLKSI

SEQ ID NO: 2513569 - protein, 23 aa, Entamoeba dispar
IKEIKRVYPFASIIVLGNKLDLA

SEQ ID NO: 2513570 - protein, 20 aa, Entamoeba dispar
IKEIYSILGNDIFVILRNIA

SEQ ID NO: 2513571 - protein, 17 aa, Entamoeba dispar
IKEKIFKICSSFEEEFN

SEQ ID NO: 2513572 - protein, 18 aa, Entamoeba dispar
IKELFEWQEECLKEKGVR

SEQ ID NO: 2513573 - protein, 20 aa, Entamoeba dispar
IKEMIKRGASPYQYYDSWDQ

SEQ ID NO: 2513574 - protein, 21 aa, Entamoeba dispar
IKESFTAFKTEMDKMADIEET

SEQ ID NO: 2513575 - protein, 17 aa, Entamoeba dispar
IKETISWENYWKTFQRK

SEQ ID NO: 2513576 - protein, 17 aa, Entamoeba dispar
IKEVLTIVAMLTVPNIF

SEQ ID NO: 2513577 - protein, 22 aa, Entamoeba dispar
IKFRYKFLITIFGEIFKRCKCL

SEQ ID NO: 2513578 - protein, 17 aa, Entamoeba dispar
IKFVVQCLYRFVTHSTS

SEQ ID NO: 2513579 - protein, 20 aa, Entamoeba dispar
IKGFPSILAVDVFKEYTRLK

SEQ ID NO: 2513580 - protein, 19 aa, Entamoeba dispar
IKGISCLNETIILYGIEKR

SEQ ID NO: 2513581 - protein, 20 aa, Entamoeba dispar
IKGVPLYRVCVCCKSAVQGF

SEQ ID NO: 2513582 - protein, 19 aa, Entamoeba dispar
IKHCIKPMIHDGDYVNGIE

SEQ ID NO: 2513583 - protein, 20 aa, Entamoeba dispar
IKHEIMEVWHFIRLTGTTAF

SEQ ID NO: 2513584 - protein, 18 aa, Entamoeba dispar
IKHFCPNAPFLLAATKTD

SEQ ID NO: 2513585 - protein, 17 aa, Entamoeba dispar
IKIALRIGIEDLSKMLL

SEQ ID NO: 2513586 - protein, 17 aa, Entamoeba dispar
IKIATAFMKTMILLHNL

SEQ ID NO: 2513587 - protein, 18 aa, Entamoeba dispar
IKIAVPSIRFFGNLLTYE

SEQ ID NO: 2513588 - protein, 21 aa, Entamoeba dispar
IKIEDIVAAWSIVNKAKDSLQ

SEQ ID NO: 2513589 - protein, 17 aa, Entamoeba dispar
IKIEFGWFYLNVLSTSP

SEQ ID NO: 2513590 - protein, 19 aa, Entamoeba dispar
IKIMLEKHVHVFLGDKQLS

SEQ ID NO: 2513591 - protein, 18 aa, Entamoeba dispar
IKITLVFRHYATMGLTGQ

SEQ ID NO: 2513592 - protein, 20 aa, Entamoeba dispar
IKIWRITKPIIIWETLPQKS

SEQ ID NO: 2513593 - protein, 20 aa, Entamoeba dispar
IKIYGLLKCTNFTPNNIIEM

SEQ ID NO: 2513594 - protein, 22 aa, Entamoeba dispar
IKKDCYKTMMFWNQPNELDAVI

SEQ ID NO: 2513595 - protein, 17 aa, Entamoeba dispar
IKKEFIKEFSLLNCPIN

SEQ ID NO: 2513596 - protein, 18 aa, Entamoeba dispar
IKKFFGYDPKCVQLKKKY

SEQ ID NO: 2513597 - protein, 22 aa, Entamoeba dispar
IKKFKVAVIFSYVGRGYFGLMY

SEQ ID NO: 2513598 - protein, 17 aa, Entamoeba dispar
IKKGCACIGAKECCEVC

SEQ ID NO: 2513599 - protein, 17 aa, Entamoeba dispar
IKKGILINSKWSKIISL

SEQ ID NO: 2513600 - protein, 18 aa, Entamoeba dispar
IKKGMGLDRFFRITTDMS

SEQ ID NO: 2513601 - protein, 17 aa, Entamoeba dispar
IKKLIKVNVFNAYYDLV

SEQ ID NO: 2513602 - protein, 18 aa, Entamoeba dispar
IKKLLTWGCYLTPINKKR

SEQ ID NO: 2513603 - protein, 22 aa, Entamoeba dispar
IKKMLLEFVEFKNQFISFTNDD

SEQ ID NO: 2513604 - protein, 19 aa, Entamoeba dispar
IKKPKLRAVMSILKGDVKN

SEQ ID NO: 2513605 - protein, 20 aa, Entamoeba dispar
IKKSFDGDGLFYLADSNEEL

SEQ ID NO: 2513606 - protein, 19 aa, Entamoeba dispar
IKLAFKFGCHAVDQLLNKG

SEQ ID NO: 2513607 - protein, 18 aa, Entamoeba dispar
IKLFPSLIFKSSKCVFGG

SEQ ID NO: 2513608 - protein, 20 aa, Entamoeba dispar
IKLFPSLIFKSSKCVFGGNI

SEQ ID NO: 2513609 - protein, 18 aa, Entamoeba dispar
IKLFQKFGEIYSIWGSSS

SEQ ID NO: 2513610 - protein, 21 aa, Entamoeba dispar
IKLKECKGIEVISCNILPSFE

SEQ ID NO: 2513611 - protein, 24 aa, Entamoeba dispar
IKLKKSCFFNCLLLKETCQTIPLY

SEQ ID NO: 2513612 - protein, 17 aa, Entamoeba dispar
IKLKLNDEVISTIEINK

SEQ ID NO: 2513613 - protein, 25 aa, Entamoeba dispar
IKLNPRVANFFACRAQYYNKAKKPN

SEQ ID NO: 2513614 - protein, 17 aa, Entamoeba dispar
IKLTCCESFNEEVIKLV

SEQ ID NO: 2513615 - protein, 18 aa, Entamoeba dispar
IKLWDLRTKNCIKEMGGH

SEQ ID NO: 2513616 - protein, 18 aa, Entamoeba dispar
IKMIRCFNLSLKDHDISP

SEQ ID NO: 2513617 - protein, 17 aa, Entamoeba dispar
IKMKLLFPPKLDNDEWK

SEQ ID NO: 2513618 - protein, 22 aa, Entamoeba dispar
IKMKRIKSISGFGVDYQTWKDI

SEQ ID NO: 2513619 - protein, 17 aa, Entamoeba dispar
IKMWDKMFCEIRGMRYL

SEQ ID NO: 2513620 - protein, 22 aa, Entamoeba dispar
IKNDICEIQKLLGYFANNFVTR

SEQ ID NO: 2513621 - protein, 22 aa, Entamoeba dispar
IKNEKKIKCEFTYNSIVASTAY

SEQ ID NO: 2513622 - protein, 20 aa, Entamoeba dispar
IKNKYDILAQIQLEQQQQPS

SEQ ID NO: 2513623 - protein, 22 aa, Entamoeba dispar
IKNNRLPSCINVGSLNKITLSY

SEQ ID NO: 2513624 - protein, 18 aa, Entamoeba dispar
IKPCVACCACQKTGKCWQ

SEQ ID NO: 2513625 - protein, 18 aa, Entamoeba dispar
IKPIKGFILLFEYNKQAI

SEQ ID NO: 2513626 - protein, 20 aa, Entamoeba dispar
IKPPNSMGYLTLKFSKSGKI

SEQ ID NO: 2513627 - protein, 17 aa, Entamoeba dispar
IKQAKVFEQILVVDSIS

SEQ ID NO: 2513628 - protein, 18 aa, Entamoeba dispar
IKQIRAFKKHIRKLTARK

SEQ ID NO: 2513629 - protein, 24 aa, Entamoeba dispar
IKQNRWYPKFSIYPVNEITIFFNY

SEQ ID NO: 2513630 - protein, 19 aa, Entamoeba dispar
IKRAFSLSLCDGDRIFYDD

SEQ ID NO: 2513631 - protein, 21 aa, Entamoeba dispar
IKRICHFCATASRLRTMKFDP

SEQ ID NO: 2513632 - protein, 21 aa, Entamoeba dispar
IKRKCIDDCFGIFSKYKRLCI

SEQ ID NO: 2513633 - protein, 21 aa, Entamoeba dispar
IKRWTEMKSFKKICNIEGDGD

SEQ ID NO: 2513634 - protein, 19 aa, Entamoeba dispar
IKSEIPIHVFGTNKGSTNY

SEQ ID NO: 2513635 - protein, 20 aa, Entamoeba dispar
IKSFLPDDVKLFQFNALTQK

SEQ ID NO: 2513636 - protein, 17 aa, Entamoeba dispar
IKSGALIVTGPFKINGV

SEQ ID NO: 2513637 - protein, 18 aa, Entamoeba dispar
IKSLLGWARCLRPINVDK

SEQ ID NO: 2513638 - protein, 20 aa, Entamoeba dispar
IKSLRSSECINIFTKDIDPS

SEQ ID NO: 2513639 - protein, 19 aa, Entamoeba dispar
IKSRWLRKNARRIDMENYT

SEQ ID NO: 2513640 - protein, 17 aa, Entamoeba dispar
IKTIPKFWYFTLKNSGY

SEQ ID NO: 2513641 - protein, 17 aa, Entamoeba dispar
IKTRNPIVFSFHPSALK

SEQ ID NO: 2513642 - protein, 17 aa, Entamoeba dispar
IKVEDLLAFVLVDDKGN

SEQ ID NO: 2513643 - protein, 19 aa, Entamoeba dispar
IKVLRIVLIIGEKYKSSNE

SEQ ID NO: 2513644 - protein, 21 aa, Entamoeba dispar
IKVLSKEGDWWIGELNGQTGQ

SEQ ID NO: 2513645 - protein, 18 aa, Entamoeba dispar
IKVTDDFRYIIINEGNLE

SEQ ID NO: 2513646 - protein, 19 aa, Entamoeba dispar
IKVTEKWGDFDAHFTCSTL

SEQ ID NO: 2513647 - protein, 20 aa, Entamoeba dispar
IKWVGNIICCIGGLYDGKEY

SEQ ID NO: 2513648 - protein, 21 aa, Entamoeba dispar
IKYFWEIAKSLTLDQKKKLLI

SEQ ID NO: 2513649 - protein, 17 aa, Entamoeba dispar
IKYQIAWFFTNLAVSLD

SEQ ID NO: 2513650 - protein, 24 aa, Entamoeba dispar
IKYTKICQFIDAFIFKYKTFTIAH

SEQ ID NO: 2513651 - protein, 20 aa, Entamoeba dispar
ILCPCTICRKVGFFSSEKPK

SEQ ID NO: 2513652 - protein, 18 aa, Entamoeba dispar
ILCPYNFVTSVSIRHSSD

SEQ ID NO: 2513653 - protein, 17 aa, Entamoeba dispar
ILFLLLHIVETISKMNT

SEQ ID NO: 2513654 - protein, 18 aa, Entamoeba dispar
ILFPFNVLKMKSIKIMIK

SEQ ID NO: 2513655 - protein, 23 aa, Entamoeba dispar
ILFTSSDWSCWGGYPGALMTYYS

SEQ ID NO: 2513656 - protein, 18 aa, Entamoeba dispar
ILFVFETKSGVIGFYQED

SEQ ID NO: 2513657 - protein, 18 aa, Entamoeba dispar
ILIISSIKLGKDVTQFEE

SEQ ID NO: 2513658 - protein, 18 aa, Entamoeba dispar
ILIPFEWQHIIITHLPVS

SEQ ID NO: 2513659 - protein, 20 aa, Entamoeba dispar
ILKNSWKLVLSIFDFNSSCR

SEQ ID NO: 2513660 - protein, 18 aa, Entamoeba dispar
ILKRGIRINDHFLTLLQL

SEQ ID NO: 2513661 - protein, 21 aa, Entamoeba dispar
ILLISRMGYIYGFYSGDGTLF

SEQ ID NO: 2513662 - protein, 18 aa, Entamoeba dispar
ILLKRGPLLTAICNTVCT

SEQ ID NO: 2513663 - protein, 17 aa, Entamoeba dispar
ILLNENWSHLIIPTQKA

SEQ ID NO: 2513664 - protein, 17 aa, Entamoeba dispar
ILLPHVWPAQQVITPQD

SEQ ID NO: 2513665 - protein, 18 aa, Entamoeba dispar
ILLPWKVYVYDGGNDVYL

SEQ ID NO: 2513666 - protein, 17 aa, Entamoeba dispar
ILLSLGINEAVVFSQSF

SEQ ID NO: 2513667 - protein, 19 aa, Entamoeba dispar
ILMELLWPIIKYRSSNELI

SEQ ID NO: 2513668 - protein, 17 aa, Entamoeba dispar
ILMGISFLENIEKLCGK

SEQ ID NO: 2513669 - protein, 19 aa, Entamoeba dispar
ILMPILFEYFFKRKAFIEE

SEQ ID NO: 2513670 - protein, 23 aa, Entamoeba dispar
ILNKFSPFFIHLVKIIFKRIDQL

SEQ ID NO: 2513671 - protein, 26 aa, Entamoeba dispar
ILPLLKWKGKCIDLSTSMFIIKSSIV

SEQ ID NO: 2513672 - protein, 18 aa, Entamoeba dispar
ILQILFVDSIMKFSEKLF

SEQ ID NO: 2513673 - protein, 23 aa, Entamoeba dispar
ILSKYRLGNCPVKMTDFTKWIKS

SEQ ID NO: 2513674 - protein, 18 aa, Entamoeba dispar
ILSLIARLQFDMMEEETY

SEQ ID NO: 2513675 - protein, 23 aa, Entamoeba dispar
ILSPSCLCRILLKTLGITSFENK

SEQ ID NO: 2513676 - protein, 17 aa, Entamoeba dispar
ILTICFCKSPLCSQMII

SEQ ID NO: 2513677 - protein, 25 aa, Entamoeba dispar
ILYFFKSDIELFKWNIEQIEYLSKK

SEQ ID NO: 2513678 - protein, 20 aa, Entamoeba dispar
IMACCGNDAIGCFVRKPIES

SEQ ID NO: 2513679 - protein, 22 aa, Entamoeba dispar
IMCLCDRPTLVSIYKGKIKTLS

SEQ ID NO: 2513680 - protein, 17 aa, Entamoeba dispar
IMIPPGITIVQAVSVSL

SEQ ID NO: 2513681 - protein, 18 aa, Entamoeba dispar
IMLQLAFKRNQMLQNEKK

SEQ ID NO: 2513682 - protein, 17 aa, Entamoeba dispar
IMLRYHVITVFVLIAQK

SEQ ID NO: 2513683 - protein, 17 aa, Entamoeba dispar
IMNAGICQLLYHMRVNS

SEQ ID NO: 2513684 - protein, 18 aa, Entamoeba dispar
IMNFVRTWMKNAWKDFEA

SEQ ID NO: 2513685 - protein, 18 aa, Entamoeba dispar
IMNPELFQTCPLHIRNQI

SEQ ID NO: 2513686 - protein, 17 aa, Entamoeba dispar
IMRIPLKLGGGMKEQIT

SEQ ID NO: 2513687 - protein, 17 aa, Entamoeba dispar
IMSSLLVCYTKYLKSVS

SEQ ID NO: 2513688 - protein, 22 aa, Entamoeba dispar
IMTRFCLLYSYFPLQETIDVYE

SEQ ID NO: 2513689 - protein, 18 aa, Entamoeba dispar
INDFIVYWIAKLNKNYYK

SEQ ID NO: 2513690 - protein, 21 aa, Entamoeba dispar
INEFPKLQWFFLLNCTSPKQE

SEQ ID NO: 2513691 - protein, 17 aa, Entamoeba dispar
INEIGNWCFSYCSSLKS

SEQ ID NO: 2513692 - protein, 21 aa, Entamoeba dispar
INIIKRRKLSIGRVESEVYNI

SEQ ID NO: 2513693 - protein, 18 aa, Entamoeba dispar
INILFPIEIGYDIKGPQL

SEQ ID NO: 2513694 - protein, 19 aa, Entamoeba dispar
INIPFEFMDRSMIELNDRG

SEQ ID NO: 2513695 - protein, 21 aa, Entamoeba dispar
INKLRGCAMCSALSNRGYFLK

SEQ ID NO: 2513696 - protein, 23 aa, Entamoeba dispar
INLKRGVLGWGRKIMKKEKIKGY

SEQ ID NO: 2513697 - protein, 22 aa, Entamoeba dispar
INLLICFIDLFTPPSLIKGKLS

SEQ ID NO: 2513698 - protein, 19 aa, Entamoeba dispar
INLRLPLKDLLVFFESALI

SEQ ID NO: 2513699 - protein, 24 aa, Entamoeba dispar
INMGFGDKGKWILVSEKKEVHNLN

SEQ ID NO: 2513700 - protein, 19 aa, Entamoeba dispar
INNTIPYWDKTLIKYSTYN

SEQ ID NO: 2513701 - protein, 18 aa, Entamoeba dispar
INNYWSFHFQEDHSSLKD

SEQ ID NO: 2513702 - protein, 18 aa, Entamoeba dispar
INPKEHWAPFANALKNEL

SEQ ID NO: 2513703 - protein, 19 aa, Entamoeba dispar
INQMKVLIVNSIQKAKEEI

SEQ ID NO: 2513704 - protein, 22 aa, Entamoeba dispar
INRLRQFLDYYLKAAIELLPND

SEQ ID NO: 2513705 - protein, 24 aa, Entamoeba dispar
INSNHLICLPSIIKNIHLIEIDIS

SEQ ID NO: 2513706 - protein, 17 aa, Entamoeba dispar
INTLKYVFEKLAKEKEI

SEQ ID NO: 2513707 - protein, 17 aa, Entamoeba dispar
IPCKTCFNKVKEKYINN

SEQ ID NO: 2513708 - protein, 20 aa, Entamoeba dispar
IPCWIKIRYYQSFTFDVFKL

SEQ ID NO: 2513709 - protein, 21 aa, Entamoeba dispar
IPDFWEHVSIVWTKCFCYISE

SEQ ID NO: 2513710 - protein, 19 aa, Entamoeba dispar
IPEIVPFRLTREILDPMGV

SEQ ID NO: 2513711 - protein, 18 aa, Entamoeba dispar
IPEQNEFFLTKGSKSDFD

SEQ ID NO: 2513712 - protein, 20 aa, Entamoeba dispar
IPFEFFEDVLPLIITTLSKV

SEQ ID NO: 2513713 - protein, 18 aa, Entamoeba dispar
IPFNNCIISNSLLITLLN

SEQ ID NO: 2513714 - protein, 23 aa, Entamoeba dispar
IPFSYCFYKPLPLNKFGNIVNYS

SEQ ID NO: 2513715 - protein, 24 aa, Entamoeba dispar
IPGFPVNFLQYFQLFPSVFNTSIN

SEQ ID NO: 2513716 - protein, 20 aa, Entamoeba dispar
IPHCSVCNCVICTINENLDI

SEQ ID NO: 2513717 - protein, 17 aa, Entamoeba dispar
IPIAFLLMRDTIIALGG

SEQ ID NO: 2513718 - protein, 19 aa, Entamoeba dispar
IPIFLERLVAFPLDKLTIN

SEQ ID NO: 2513719 - protein, 19 aa, Entamoeba dispar
IPILCYNFYFQVYPIHPEY

SEQ ID NO: 2513720 - protein, 18 aa, Entamoeba dispar
IPIMPGLFAPYSCISSSC

SEQ ID NO: 2513721 - protein, 17 aa, Entamoeba dispar
IPIVRRLICGMFSKDKV

SEQ ID NO: 2513722 - protein, 17 aa, Entamoeba dispar
IPKEFYRLTSYIISHYQ

SEQ ID NO: 2513723 - protein, 19 aa, Entamoeba dispar
IPKGLLATIGWEIDGKITY

SEQ ID NO: 2513724 - protein, 20 aa, Entamoeba dispar
IPKRFDCLVALNVSATSIAT

SEQ ID NO: 2513725 - protein, 23 aa, Entamoeba dispar
IPKRKTGKCVIEFTTQVNENGIM

SEQ ID NO: 2513726 - protein, 18 aa, Entamoeba dispar
IPKSFVFKDQEGFEIPTD

SEQ ID NO: 2513727 - protein, 23 aa, Entamoeba dispar
IPLDCPWYICYFMGRPQAHFVCT

SEQ ID NO: 2513728 - protein, 23 aa, Entamoeba dispar
IPMKGVVRPVLYTSLYNSTEFTQ

SEQ ID NO: 2513729 - protein, 19 aa, Entamoeba dispar
IPMKLPNTFGLIKGNEFCV

SEQ ID NO: 2513730 - protein, 21 aa, Entamoeba dispar
IPPKCFLECISLQNIVIPEGI

SEQ ID NO: 2513731 - protein, 17 aa, Entamoeba dispar
IPPSPLLPIIANLAAQK

SEQ ID NO: 2513732 - protein, 20 aa, Entamoeba dispar
IPQARASIVWVIGEYSQMVP

SEQ ID NO: 2513733 - protein, 21 aa, Entamoeba dispar
IPQKWMYCFLFNDRLVETMPI

SEQ ID NO: 2513734 - protein, 19 aa, Entamoeba dispar
IPQLLRFVSDLSPQESMVI

SEQ ID NO: 2513735 - protein, 20 aa, Entamoeba dispar
IPQLPEFVKHFSIKAIYSKF

SEQ ID NO: 2513736 - protein, 21 aa, Entamoeba dispar
IPRLSELFPSITFYQSECDVN

SEQ ID NO: 2513737 - protein, 22 aa, Entamoeba dispar
IPSSITKLGYRCFKECSTLKSI

SEQ ID NO: 2513738 - protein, 20 aa, Entamoeba dispar
IPTERYCIIVPFKFNVEKLQ

SEQ ID NO: 2513739 - protein, 18 aa, Entamoeba dispar
IPVGYGCPKHISIGSTSI

SEQ ID NO: 2513740 - protein, 20 aa, Entamoeba dispar
IPWRSVAVAISFGRFHPIHI

SEQ ID NO: 2513741 - protein, 17 aa, Entamoeba dispar
IPYEMYKRKEGKIETQV

SEQ ID NO: 2513742 - protein, 17 aa, Entamoeba dispar
IPYFLGWYDSLKQLEKN

SEQ ID NO: 2513743 - protein, 19 aa, Entamoeba dispar
IPYFNDWYIRDGISGAWSV

SEQ ID NO: 2513744 - protein, 18 aa, Entamoeba dispar
IQAAKYWRQMIIKEILQK

SEQ ID NO: 2513745 - protein, 20 aa, Entamoeba dispar
IQCLIFEKGIFAVGGREGKV

SEQ ID NO: 2513746 - protein, 22 aa, Entamoeba dispar
IQDSLRWNYSFSGIKFSESLRF

SEQ ID NO: 2513747 - protein, 23 aa, Entamoeba dispar
IQFAFRWFNCCLIREFPIELSLI

SEQ ID NO: 2513748 - protein, 18 aa, Entamoeba dispar
IQFPKRFVEIKGENTLFT

SEQ ID NO: 2513749 - protein, 17 aa, Entamoeba dispar
IQFWRQLWRTCEQSDVI

SEQ ID NO: 2513750 - protein, 22 aa, Entamoeba dispar
IQHFGRLGALLFYLMSKTSEPS

SEQ ID NO: 2513751 - protein, 21 aa, Entamoeba dispar
IQIHLRLLFALNFKEGCDPLP

SEQ ID NO: 2513752 - protein, 18 aa, Entamoeba dispar
IQIIPWKNITSITISTTS

SEQ ID NO: 2513753 - protein, 17 aa, Entamoeba dispar
IQIKITLVFRHYATMGL

SEQ ID NO: 2513754 - protein, 18 aa, Entamoeba dispar
IQIMPKCTLAGFNWFNAY

SEQ ID NO: 2513755 - protein, 19 aa, Entamoeba dispar
IQIQWLWEILAEYGKEDHV

SEQ ID NO: 2513756 - protein, 17 aa, Entamoeba dispar
IQKACLNICSLLFEKID

SEQ ID NO: 2513757 - protein, 18 aa, Entamoeba dispar
IQKKSVKRKLLIVVQNDE

SEQ ID NO: 2513758 - protein, 18 aa, Entamoeba dispar
IQKLLGYFANNFVTRSEI

SEQ ID NO: 2513759 - protein, 17 aa, Entamoeba dispar
IQLPLTYAWGLSIHKSQ

SEQ ID NO: 2513760 - protein, 24 aa, Entamoeba dispar
IQMEFKFSVTMFPVFPPEYNFLAP

SEQ ID NO: 2513761 - protein, 19 aa, Entamoeba dispar
IQMYFSFRFLKQESAEEKR

SEQ ID NO: 2513762 - protein, 19 aa, Entamoeba dispar
IQNSWIFGVGYGFHIRGED

SEQ ID NO: 2513763 - protein, 18 aa, Entamoeba dispar
IQQPMGGMGMMNQPMQGM

SEQ ID NO: 2513764 - protein, 19 aa, Entamoeba dispar
IQREWWYPLATSISGTEFK

SEQ ID NO: 2513765 - protein, 18 aa, Entamoeba dispar
IQSIEIMSLLPFINANDF

SEQ ID NO: 2513766 - protein, 17 aa, Entamoeba dispar
IQYAVGFLCQMDPSHAE

SEQ ID NO: 2513767 - protein, 17 aa, Entamoeba dispar
IRCGSIWKKVERLDEVM

SEQ ID NO: 2513768 - protein, 23 aa, Entamoeba dispar
IRDLPIEIGELFNLEDLNLNNNQ

SEQ ID NO: 2513769 - protein, 22 aa, Entamoeba dispar
IREFPIELSLILWDGYISEPNG

SEQ ID NO: 2513770 - protein, 20 aa, Entamoeba dispar
IREGWKYIFTLLSRIEQVFL

SEQ ID NO: 2513771 - protein, 18 aa, Entamoeba dispar
IREHCWQKNFEFIGYNYI

SEQ ID NO: 2513772 - protein, 17 aa, Entamoeba dispar
IRFNVLRLIGLLISTAP

SEQ ID NO: 2513773 - protein, 18 aa, Entamoeba dispar
IRFPEIFYEMLSRDSGTL

SEQ ID NO: 2513774 - protein, 20 aa, Entamoeba dispar
IRIFIKACFIEKQWTTENIQ

SEQ ID NO: 2513775 - protein, 20 aa, Entamoeba dispar
IRIGKFPKYLLIKLERQIIL

SEQ ID NO: 2513776 - protein, 20 aa, Entamoeba dispar
IRIGMPIPFYVLKRNIAAYP

SEQ ID NO: 2513777 - protein, 18 aa, Entamoeba dispar
IRKEDIFTIGGSVMKYIK

SEQ ID NO: 2513778 - protein, 19 aa, Entamoeba dispar
IRKELKYEIQININGNNCI

SEQ ID NO: 2513779 - protein, 23 aa, Entamoeba dispar
IRKIVLRKGCCLLPVECGGRIME

SEQ ID NO: 2513780 - protein, 17 aa, Entamoeba dispar
IRKSLEWQRKSNENLEL

SEQ ID NO: 2513781 - protein, 21 aa, Entamoeba dispar
IRKYESICLFGGKDDSFIMKL

SEQ ID NO: 2513782 - protein, 17 aa, Entamoeba dispar
IRLICKIFPISDFWEHV

SEQ ID NO: 2513783 - protein, 19 aa, Entamoeba dispar
IRLVIPFPLSLIVNEEATL

SEQ ID NO: 2513784 - protein, 18 aa, Entamoeba dispar
IRMGKYFLEIDIMDLQNF

SEQ ID NO: 2513785 - protein, 18 aa, Entamoeba dispar
IRMRCLKCQKSSEVWTLR

SEQ ID NO: 2513786 - protein, 17 aa, Entamoeba dispar
IRNVCRFCDDNKVNIND

SEQ ID NO: 2513787 - protein, 20 aa, Entamoeba dispar
IRPGFTKSWEDFDRIFRDVK

SEQ ID NO: 2513788 - protein, 17 aa, Entamoeba dispar
IRRGGVMMGDLEGEYDS

SEQ ID NO: 2513789 - protein, 21 aa, Entamoeba dispar
IRSDLREVLKINPKIYPTSYP

SEQ ID NO: 2513790 - protein, 17 aa, Entamoeba dispar
IRSRYCGNVGYVVVGRI

SEQ ID NO: 2513791 - protein, 18 aa, Entamoeba dispar
IRTLLSILSLLCITQKDI

SEQ ID NO: 2513792 - protein, 17 aa, Entamoeba dispar
IRVKLKLKKIYDNMRNT

SEQ ID NO: 2513793 - protein, 17 aa, Entamoeba dispar
IRWKNNFHYVIDEKVAI

SEQ ID NO: 2513794 - protein, 18 aa, Entamoeba dispar
IRWVVCPKCLEIFTKKLK

SEQ ID NO: 2513795 - protein, 17 aa, Entamoeba dispar
IRYVYRQNIQFARNAVW

SEQ ID NO: 2513796 - protein, 18 aa, Entamoeba dispar
ISALKYIHKWQICHRDIK

SEQ ID NO: 2513797 - protein, 19 aa, Entamoeba dispar
ISDALRFALVPFLDAAKGI

SEQ ID NO: 2513798 - protein, 18 aa, Entamoeba dispar
ISDIIDWNGIIPKSEEDV

SEQ ID NO: 2513799 - protein, 19 aa, Entamoeba dispar
ISDIPRFGSLIIEKMTPNE

SEQ ID NO: 2513800 - protein, 19 aa, Entamoeba dispar
ISDIPRFGSLIIERMTIAE

SEQ ID NO: 2513801 - protein, 25 aa, Entamoeba dispar
ISDRLLKQICHFICYYIIEEMLQRN

SEQ ID NO: 2513802 - protein, 18 aa, Entamoeba dispar
ISEFLKVFVIALQRHGPQ

SEQ ID NO: 2513803 - protein, 24 aa, Entamoeba dispar
ISEKEMYYTFCLIDYVLCNSPSFR

SEQ ID NO: 2513804 - protein, 24 aa, Entamoeba dispar
ISEKIKTQNESIMKAEKEIEELKK

SEQ ID NO: 2513805 - protein, 24 aa, Entamoeba dispar
ISFGKSCFFNCGFILELKQNMKIP

SEQ ID NO: 2513806 - protein, 22 aa, Entamoeba dispar
ISFGRSCFYGCGYVEELTQNKR

SEQ ID NO: 2513807 - protein, 21 aa, Entamoeba dispar
ISFRYDWRTLLAVIRMHLPPI

SEQ ID NO: 2513808 - protein, 17 aa, Entamoeba dispar
ISGAIGFDSEIFGQNMW

SEQ ID NO: 2513809 - protein, 17 aa, Entamoeba dispar
ISGFAVLIEKDWLSFGH

SEQ ID NO: 2513810 - protein, 18 aa, Entamoeba dispar
ISHICLFTSFAIDLPQDI

SEQ ID NO: 2513811 - protein, 19 aa, Entamoeba dispar
ISKKYGIIVGGGFNLKGDL

SEQ ID NO: 2513812 - protein, 19 aa, Entamoeba dispar
ISKMLGCIVSGLMIISASK

SEQ ID NO: 2513813 - protein, 17 aa, Entamoeba dispar
ISKRFQIVLSYFQSNPI

SEQ ID NO: 2513814 - protein, 17 aa, Entamoeba dispar
ISKRTSYIITFLFYNKE

SEQ ID NO: 2513815 - protein, 18 aa, Entamoeba dispar
ISLCTSLVYRCHNYFASY

SEQ ID NO: 2513816 - protein, 21 aa, Entamoeba dispar
ISLGRLCFACCCSLSEVNIPH

SEQ ID NO: 2513817 - protein, 20 aa, Entamoeba dispar
ISLIGAGGFGEVWKVRHKSM

SEQ ID NO: 2513818 - protein, 18 aa, Entamoeba dispar
ISLKSCTIKQLLFQKNIF

SEQ ID NO: 2513819 - protein, 18 aa, Entamoeba dispar
ISLLDMFFEYGMSTKYLK

SEQ ID NO: 2513820 - protein, 18 aa, Entamoeba dispar
ISLLLPLFLEFIKQNKLN

SEQ ID NO: 2513821 - protein, 17 aa, Entamoeba dispar
ISLLRWSLLRPSDTKGI

SEQ ID NO: 2513822 - protein, 19 aa, Entamoeba dispar
ISLLTKWAEECGVVLRKGS

SEQ ID NO: 2513823 - protein, 18 aa, Entamoeba dispar
ISMTDVMFCKKFLPERSL

SEQ ID NO: 2513824 - protein, 17 aa, Entamoeba dispar
ISMWYPQFIEAMKCYAR

SEQ ID NO: 2513825 - protein, 21 aa, Entamoeba dispar
ISPKDFHEWIPPEREFPFKVY

SEQ ID NO: 2513826 - protein, 18 aa, Entamoeba dispar
ISPLIPFLLKQLGSSSCE

SEQ ID NO: 2513827 - protein, 17 aa, Entamoeba dispar
ISQKFNMKKGNEMSHVF

SEQ ID NO: 2513828 - protein, 24 aa, Entamoeba dispar
ISSGLKWVRFGAMCMAIANRRLNT

SEQ ID NO: 2513829 - protein, 19 aa, Entamoeba dispar
ISSLLKLRHPFIIKLISVE

SEQ ID NO: 2513830 - protein, 22 aa, Entamoeba dispar
ISSRCIKFRFSALPKEIVSNRL

SEQ ID NO: 2513831 - protein, 18 aa, Entamoeba dispar
ISVFWGWKEGGKVKTIKR

SEQ ID NO: 2513832 - protein, 23 aa, Entamoeba dispar
ISVKGPELLTMWFGESEANVRNI

SEQ ID NO: 2513833 - protein, 21 aa, Entamoeba dispar
ISYRIGDSFGITSFQTEPKQC

SEQ ID NO: 2513834 - protein, 24 aa, Entamoeba dispar
ITCDYCLPELLSLVAECVTNDSMN

SEQ ID NO: 2513835 - protein, 18 aa, Entamoeba dispar
ITCKGVGFGIVLQTEGDN

SEQ ID NO: 2513836 - protein, 27 aa, Entamoeba dispar
ITDKYRLAYLIACLRTFLKESIQRKII

SEQ ID NO: 2513837 - protein, 20 aa, Entamoeba dispar
ITEIKRIYNLFIERSSTINY

SEQ ID NO: 2513838 - protein, 18 aa, Entamoeba dispar
ITEIPLFFTQEILPESTQ

SEQ ID NO: 2513839 - protein, 18 aa, Entamoeba dispar
ITELRGGNGEEALKIKAQ

SEQ ID NO: 2513840 - protein, 19 aa, Entamoeba dispar
ITEVPLFIDSFERLRQFDC

SEQ ID NO: 2513841 - protein, 23 aa, Entamoeba dispar
ITFAGNCLMSFPVALTSISSLSS

SEQ ID NO: 2513842 - protein, 18 aa, Entamoeba dispar
ITFLPRFSMFDFKLLASS

SEQ ID NO: 2513843 - protein, 17 aa, Entamoeba dispar
ITFPCIYGMAARRTIPN

SEQ ID NO: 2513844 - protein, 17 aa, Entamoeba dispar
ITGLCYVKENIIVGTPS

SEQ ID NO: 2513845 - protein, 17 aa, Entamoeba dispar
ITHYKFGVIYVKPDQTE

SEQ ID NO: 2513846 - protein, 29 aa, Entamoeba dispar
ITIEVSLCFACQFHLLRLLYYKNLSIPIE

SEQ ID NO: 2513847 - protein, 19 aa, Entamoeba dispar
ITIRYAWISSQFVPSKKDK

SEQ ID NO: 2513848 - protein, 17 aa, Entamoeba dispar
ITKKLARPHEMIQFNDG

SEQ ID NO: 2513849 - protein, 18 aa, Entamoeba dispar
ITKLGWKCFEYCTSLTSI

SEQ ID NO: 2513850 - protein, 21 aa, Entamoeba dispar
ITLIEWEMFKAIKPPELYAWN

SEQ ID NO: 2513851 - protein, 17 aa, Entamoeba dispar
ITLKRLKIGIGEDKQYF

SEQ ID NO: 2513852 - protein, 21 aa, Entamoeba dispar
ITMKLQIALIYYKKEEIEKYR

SEQ ID NO: 2513853 - protein, 22 aa, Entamoeba dispar
ITNEFLNTIIIDALYQLEELEL

SEQ ID NO: 2513854 - protein, 19 aa, Entamoeba dispar
ITQGFKWVRSGGICEIVDN

SEQ ID NO: 2513855 - protein, 17 aa, Entamoeba dispar
ITQRSSVIFSFTLTEIV

SEQ ID NO: 2513856 - protein, 20 aa, Entamoeba dispar
ITRFAPYIFRCYNPTKISPF

SEQ ID NO: 2513857 - protein, 18 aa, Entamoeba dispar
ITSFGYRCFYGCGCEEEL

SEQ ID NO: 2513858 - protein, 22 aa, Entamoeba dispar
ITSLCLRTGIKIGCSRLKLDQN

SEQ ID NO: 2513859 - protein, 20 aa, Entamoeba dispar
ITVDMVIEWLCLNIPSRLLP

SEQ ID NO: 2513860 - protein, 18 aa, Entamoeba dispar
ITVRIFNIPFTWKEHDVL

SEQ ID NO: 2513861 - protein, 21 aa, Entamoeba dispar
ITWPEFKSLISTRGEQITINI

SEQ ID NO: 2513862 - protein, 17 aa, Entamoeba dispar
ITYWMMLNWVCFGGDDL

SEQ ID NO: 2513863 - protein, 19 aa, Entamoeba dispar
IVEAYNFVRCQSSWKDTQT

SEQ ID NO: 2513864 - protein, 24 aa, Entamoeba dispar
IVEYSMRLLCRIIKGDEVLITNII

SEQ ID NO: 2513865 - protein, 26 aa, Entamoeba dispar
IVEYSMRLLCRIIKGDGVLITNIVDK

SEQ ID NO: 2513866 - protein, 17 aa, Entamoeba dispar
IVFPSVFFFNGAGLQKV

SEQ ID NO: 2513867 - protein, 23 aa, Entamoeba dispar
IVGCLMCGCEILPPSTYYICSEC

SEQ ID NO: 2513868 - protein, 17 aa, Entamoeba dispar
IVGKELFTGCCYPDCFC

SEQ ID NO: 2513869 - protein, 17 aa, Entamoeba dispar
IVIEWILTKIGNIFNDG

SEQ ID NO: 2513870 - protein, 19 aa, Entamoeba dispar
IVKRFEVMDGIPIKGEKIP

SEQ ID NO: 2513871 - protein, 29 aa, Entamoeba dispar
IVKSVPVQFGWKVVIEWIKNNNQLYSQSH

SEQ ID NO: 2513872 - protein, 21 aa, Entamoeba dispar
IVLCFDMLFCFDQEIKYVFST

SEQ ID NO: 2513873 - protein, 18 aa, Entamoeba dispar
IVRRLICGMFSKDKVVGT

SEQ ID NO: 2513874 - protein, 20 aa, Entamoeba dispar
IVSKCFFLKVGKTFIKRYFS

SEQ ID NO: 2513875 - protein, 19 aa, Entamoeba dispar
IVSLIPLRLHLLIKALGDE

SEQ ID NO: 2513876 - protein, 17 aa, Entamoeba dispar
IVSRVCDFVSSLLDNID

SEQ ID NO: 2513877 - protein, 17 aa, Entamoeba dispar
IVVDSCVRLEELLGINN

SEQ ID NO: 2513878 - protein, 17 aa, Entamoeba dispar
IVYCFNDGKGIEERIQI

SEQ ID NO: 2513879 - protein, 17 aa, Entamoeba dispar
IWCSLFVHNTCQPKLLN

SEQ ID NO: 2513880 - protein, 18 aa, Entamoeba dispar
IWEPCYLMLIGSILYIYK

SEQ ID NO: 2513881 - protein, 20 aa, Entamoeba dispar
IWFSRIIKSICKIQMKEEIR

SEQ ID NO: 2513882 - protein, 18 aa, Entamoeba dispar
IWTNIALAAYSWEGEIEE

SEQ ID NO: 2513883 - protein, 18 aa, Entamoeba dispar
IYAYELFNFYGVKRIIRI

SEQ ID NO: 2513884 - protein, 19 aa, Entamoeba dispar
IYAYELFNFYGVKRIIRIG

SEQ ID NO: 2513885 - protein, 20 aa, Entamoeba dispar
IYCKNCGRVFVCDKCRENVD

SEQ ID NO: 2513886 - protein, 21 aa, Entamoeba dispar
IYCVARFSFRIGERYYSQSME

SEQ ID NO: 2513887 - protein, 17 aa, Entamoeba dispar
IYEHWGIIWASLRMLLE

SEQ ID NO: 2513888 - protein, 18 aa, Entamoeba dispar
IYKIFGFKTEIALSTRNE

SEQ ID NO: 2513889 - protein, 20 aa, Entamoeba dispar
IYKLTELFITFNFSNTFLYF

SEQ ID NO: 2513890 - protein, 21 aa, Entamoeba dispar
IYKRMFRVYAHMFYSHMEHLK

SEQ ID NO: 2513891 - protein, 17 aa, Entamoeba dispar
IYLFRLMLATGIPELQS

SEQ ID NO: 2513892 - protein, 17 aa, Entamoeba dispar
IYLLLAAVIEKLPLPST

SEQ ID NO: 2513893 - protein, 19 aa, Entamoeba dispar
IYLPNCVQFIISEASIETC

SEQ ID NO: 2513894 - protein, 17 aa, Entamoeba dispar
IYMRMSVTNFLELPPDV

SEQ ID NO: 2513895 - protein, 20 aa, Entamoeba dispar
IYNCVFKWIHFFVMKDVKIV

SEQ ID NO: 2513896 - protein, 17 aa, Entamoeba dispar
IYPHKRFYVKIQDIITQ

SEQ ID NO: 2513897 - protein, 18 aa, Entamoeba dispar
IYPKLAFEIIKTYLKRLA

SEQ ID NO: 2513898 - protein, 17 aa, Entamoeba dispar
IYRFRPFIIKLTINTSF

SEQ ID NO: 2513899 - protein, 17 aa, Entamoeba dispar
IYRGCQVLYHLYEEKNA

SEQ ID NO: 2513900 - protein, 19 aa, Entamoeba dispar
IYRPACEVISELASFTKYF

SEQ ID NO: 2513901 - protein, 18 aa, Entamoeba dispar
IYSFWLYDFCDVYLEASK

SEQ ID NO: 2513902 - protein, 20 aa, Entamoeba dispar
KACLNICSLLFEKIDEYKMT

SEQ ID NO: 2513903 - protein, 19 aa, Entamoeba dispar
KADNKFCFDCGKGGATFVV

SEQ ID NO: 2513904 - protein, 20 aa, Entamoeba dispar
KAEGLKSFFMTMSSEFHGEA

SEQ ID NO: 2513905 - protein, 18 aa, Entamoeba dispar
KAEKCVICDTSFLFQMRR

SEQ ID NO: 2513906 - protein, 20 aa, Entamoeba dispar
KAEMPAVCGDIVIHFRELAK

SEQ ID NO: 2513907 - protein, 17 aa, Entamoeba dispar
KAETFTIPFGTKQQNQI

SEQ ID NO: 2513908 - protein, 20 aa, Entamoeba dispar
KAFKDTDWIGAIRMYSSALG

SEQ ID NO: 2513909 - protein, 21 aa, Entamoeba dispar
KAGFVRYNWIYPFLTKESFYK

SEQ ID NO: 2513910 - protein, 21 aa, Entamoeba dispar
KAHRFCVCPNPAFAQQLQKYK

SEQ ID NO: 2513911 - protein, 22 aa, Entamoeba dispar
KAILRFKGINIPGGKALPKGYK

SEQ ID NO: 2513912 - protein, 19 aa, Entamoeba dispar
KALEFGKSLGLKYHSVEAI

SEQ ID NO: 2513913 - protein, 20 aa, Entamoeba dispar
KALELCKSVTRRLFNSQCPL

SEQ ID NO: 2513914 - protein, 19 aa, Entamoeba dispar
KALWVAWKLGAKDYKINEN

SEQ ID NO: 2513915 - protein, 17 aa, Entamoeba dispar
KAMPIIFEAGTLLRANA

SEQ ID NO: 2513916 - protein, 20 aa, Entamoeba dispar
KAMRILQTWGPLYPNELYDY

SEQ ID NO: 2513917 - protein, 17 aa, Entamoeba dispar
KAPNWLVNWCFVEYVQY

SEQ ID NO: 2513918 - protein, 17 aa, Entamoeba dispar
KAPVWSISFSKTDPNIF

SEQ ID NO: 2513919 - protein, 20 aa, Entamoeba dispar
KAQMILLEFINRSDTYLKVP

SEQ ID NO: 2513920 - protein, 23 aa, Entamoeba dispar
KARQAAPCVLFFDELDSIGKARG

SEQ ID NO: 2513921 - protein, 22 aa, Entamoeba dispar
KASECYDLLYGQEMVETVRQCY

SEQ ID NO: 2513922 - protein, 19 aa, Entamoeba dispar
KAVYCTVCNIYLHEKKCID

SEQ ID NO: 2513923 - protein, 17 aa, Entamoeba dispar
KAYEWKGTYCSDGVSNC

SEQ ID NO: 2513924 - protein, 19 aa, Entamoeba dispar
KCEEDIRVILGYNKMMYQS

SEQ ID NO: 2513925 - protein, 20 aa, Entamoeba dispar
KCHGYWPELFCCQDGVSLTE

SEQ ID NO: 2513926 - protein, 19 aa, Entamoeba dispar
KCIKIIGDIMYWEAALPYE

SEQ ID NO: 2513927 - protein, 20 aa, Entamoeba dispar
KCKEAARLALGYYMNLSTSE

SEQ ID NO: 2513928 - protein, 20 aa, Entamoeba dispar
KCKKMCSVVRNFDKINSIPY

SEQ ID NO: 2513929 - protein, 20 aa, Entamoeba dispar
KCLHCKCDICASERDDPKTI

SEQ ID NO: 2513930 - protein, 19 aa, Entamoeba dispar
KCMGELPGPYIKYFVQSIG

SEQ ID NO: 2513931 - protein, 19 aa, Entamoeba dispar
KCNIALFVLRERIRKALQL

SEQ ID NO: 2513932 - protein, 19 aa, Entamoeba dispar
KCPAYKFGLVVATQGQKLE

SEQ ID NO: 2513933 - protein, 17 aa, Entamoeba dispar
KCPKCGGLIKLDVVLFG

SEQ ID NO: 2513934 - protein, 22 aa, Entamoeba dispar
KCSIEHWLNWIIKNSMISNDVF

SEQ ID NO: 2513935 - protein, 19 aa, Entamoeba dispar
KCSLFDFIPSFLLNKNDVP

SEQ ID NO: 2513936 - protein, 18 aa, Entamoeba dispar
KCSYCLNCGAFVCDNQEC

SEQ ID NO: 2513937 - protein, 20 aa, Entamoeba dispar
KCTSMGLSTVWLGGTFTVSA

SEQ ID NO: 2513938 - protein, 21 aa, Entamoeba dispar
KCVELCPTFAKGYSRLSAALM

SEQ ID NO: 2513939 - protein, 23 aa, Entamoeba dispar
KDAKVCILSCPFEPPKTKTTTNM

SEQ ID NO: 2513940 - protein, 17 aa, Entamoeba dispar
KDAKWSWNNYVNQRALK

SEQ ID NO: 2513941 - protein, 18 aa, Entamoeba dispar
KDAMAVFHFLFRYDTGSH

SEQ ID NO: 2513942 - protein, 20 aa, Entamoeba dispar
KDCGEGIGFELGYGMDSEDE

SEQ ID NO: 2513943 - protein, 19 aa, Entamoeba dispar
KDCSFMFMDVLKIIQTNDV

SEQ ID NO: 2513944 - protein, 18 aa, Entamoeba dispar
KDDFIYRKSIMQEYISDT

SEQ ID NO: 2513945 - protein, 18 aa, Entamoeba dispar
KDEGTICRNCHEKTGEIY

SEQ ID NO: 2513946 - protein, 24 aa, Entamoeba dispar
KDELFYILGCWDIKTNDCVIDSVK

SEQ ID NO: 2513947 - protein, 25 aa, Entamoeba dispar
KDEVFRKFICCGPMYFIENVNTPPS

SEQ ID NO: 2513948 - protein, 23 aa, Entamoeba dispar
KDFLRRRACLMMYPMCKEYPDAL

SEQ ID NO: 2513949 - protein, 17 aa, Entamoeba dispar
KDFLSNIFITFPNEPII

SEQ ID NO: 2513950 - protein, 24 aa, Entamoeba dispar
KDFSRIFCIQRLVKVSIIDKEGLE

SEQ ID NO: 2513951 - protein, 23 aa, Entamoeba dispar
KDGDEFPFHISVPIDLPPTIKND

SEQ ID NO: 2513952 - protein, 18 aa, Entamoeba dispar
KDGVVYGFWIYKETISCG

SEQ ID NO: 2513953 - protein, 20 aa, Entamoeba dispar
KDICFRKGDEMICFSTSDNR

SEQ ID NO: 2513954 - protein, 22 aa, Entamoeba dispar
KDICRICLKGGVAVVGVGFPAC

SEQ ID NO: 2513955 - protein, 17 aa, Entamoeba dispar
KDIHCIELDNSIGDINQ

SEQ ID NO: 2513956 - protein, 17 aa, Entamoeba dispar
KDIKGVLLVFQIDRQES

SEQ ID NO: 2513957 - protein, 17 aa, Entamoeba dispar
KDINEFIIPSSINKLGY

SEQ ID NO: 2513958 - protein, 17 aa, Entamoeba dispar
KDINEFIIPSSITKIGY

SEQ ID NO: 2513959 - protein, 17 aa, Entamoeba dispar
KDINEFIIPSSITKLGY

SEQ ID NO: 2513960 - protein, 18 aa, Entamoeba dispar
KDKDCILYVLKMINSNSS

SEQ ID NO: 2513961 - protein, 26 aa, Entamoeba dispar
KDKREIGKSISFVWKLNLEYGEYDLQ

SEQ ID NO: 2513962 - protein, 20 aa, Entamoeba dispar
KDLIDWIGLIPHFFNSFTLN

SEQ ID NO: 2513963 - protein, 20 aa, Entamoeba dispar
KDLKDGLVLIRLLRNLSGCD

SEQ ID NO: 2513964 - protein, 19 aa, Entamoeba dispar
KDLLGCGSFGKVYRGIVAG

SEQ ID NO: 2513965 - protein, 17 aa, Entamoeba dispar
KDLLPRMQVEWRNVVQF

SEQ ID NO: 2513966 - protein, 19 aa, Entamoeba dispar
KDMFKKLVICILVTIKDGV

SEQ ID NO: 2513967 - protein, 18 aa, Entamoeba dispar
KDMHIGFISNTFMKAMSI

SEQ ID NO: 2513968 - protein, 20 aa, Entamoeba dispar
KDNCFHCVLNLICVDAANAI

SEQ ID NO: 2513969 - protein, 17 aa, Entamoeba dispar
KDNCLLSDFTIHSINTI

SEQ ID NO: 2513970 - protein, 18 aa, Entamoeba dispar
KDNYAFTSVCMFKPIETS

SEQ ID NO: 2513971 - protein, 24 aa, Entamoeba dispar
KDQKKLWIQLAIKLNYEERDDIAL

SEQ ID NO: 2513972 - protein, 18 aa, Entamoeba dispar
KDQLRLMATINITGLIQT

SEQ ID NO: 2513973 - protein, 21 aa, Entamoeba dispar
KDSVLWCYKKELAFSSNQKKR

SEQ ID NO: 2513974 - protein, 24 aa, Entamoeba dispar
KDTLFYYRMMWNLDVGPSYSLPPK

SEQ ID NO: 2513975 - protein, 22 aa, Entamoeba dispar
KDVMGLTGWKIFESRKYKSEPK

SEQ ID NO: 2513976 - protein, 21 aa, Entamoeba dispar
KDYMKASSFSLVSAKYTAGEF

SEQ ID NO: 2513977 - protein, 18 aa, Entamoeba dispar
KEAFSIAPNGIWKIVLST

SEQ ID NO: 2513978 - protein, 19 aa, Entamoeba dispar
KEAICLCCAIHAPCDGVLV

SEQ ID NO: 2513979 - protein, 24 aa, Entamoeba dispar
KEAIKFFGSICQYKIPKGARALKK

SEQ ID NO: 2513980 - protein, 19 aa, Entamoeba dispar
KEAKRYAAILNRYKVLKAH

SEQ ID NO: 2513981 - protein, 21 aa, Entamoeba dispar
KEASVILLRYFNPIGAHKSGL

SEQ ID NO: 2513982 - protein, 17 aa, Entamoeba dispar
KEAWQVIPLLLTSEPNV

SEQ ID NO: 2513983 - protein, 18 aa, Entamoeba dispar
KECSLTFIDHSPFCRIHT

SEQ ID NO: 2513984 - protein, 20 aa, Entamoeba dispar
KEDWHPYLLFCKVKRDSVVN

SEQ ID NO: 2513985 - protein, 17 aa, Entamoeba dispar
KEEFQADMLLVFDNALL

SEQ ID NO: 2513986 - protein, 18 aa, Entamoeba dispar
KEEIKDVILVGGPTKLCC

SEQ ID NO: 2513987 - protein, 17 aa, Entamoeba dispar
KEEKLKILPIIKKLEEE

SEQ ID NO: 2513988 - protein, 19 aa, Entamoeba dispar
KEFDCLKSLEIEEKINVVK

SEQ ID NO: 2513989 - protein, 23 aa, Entamoeba dispar
KEFKELFEPILILTKKIVEELDR

SEQ ID NO: 2513990 - protein, 19 aa, Entamoeba dispar
KEFLDCYSAYFGQLYQQYH

SEQ ID NO: 2513991 - protein, 18 aa, Entamoeba dispar
KEFSSLTSYVVYSSGKIK

SEQ ID NO: 2513992 - protein, 23 aa, Entamoeba dispar
KEGCGNPRCDIAYCKSNPEHCSI

SEQ ID NO: 2513993 - protein, 22 aa, Entamoeba dispar
KEGKLLFGERFLRVDPILPGQI

SEQ ID NO: 2513994 - protein, 24 aa, Entamoeba dispar
KEGKRVVGVLLGFIRKGVVDVMNS

SEQ ID NO: 2513995 - protein, 18 aa, Entamoeba dispar
KEHIPINNWNMWLIERLT

SEQ ID NO: 2513996 - protein, 17 aa, Entamoeba dispar
KEIERSLGLMLLRGDCI

SEQ ID NO: 2513997 - protein, 17 aa, Entamoeba dispar
KEIEWLMGISWNKGNKS

SEQ ID NO: 2513998 - protein, 20 aa, Entamoeba dispar
KEIIDSFEFYADRLLDLYTL

SEQ ID NO: 2513999 - protein, 18 aa, Entamoeba dispar
KEIIQCLGMKEWQKVLNW

SEQ ID NO: 2514000 - protein, 23 aa, Entamoeba dispar
KEIKEILNGFGLRQPMETRIIVG

SEQ ID NO: 2514001 - protein, 23 aa, Entamoeba dispar
KEIKKRFPRVFGFDDMFDLLDGD

SEQ ID NO: 2514002 - protein, 22 aa, Entamoeba dispar
KEIKMLKLLSSKVLKNLKNEEE

SEQ ID NO: 2514003 - protein, 18 aa, Entamoeba dispar
KEILKWFDDVDESFKQIG

SEQ ID NO: 2514004 - protein, 29 aa, Entamoeba dispar
KEINGKEFLGYHLRADWEVNKGMKRNIRK

SEQ ID NO: 2514005 - protein, 21 aa, Entamoeba dispar
KEIVQWPVLHPELFKQYGQPP

SEQ ID NO: 2514006 - protein, 19 aa, Entamoeba dispar
KEIWRLCNYVLPFIHDPNF

SEQ ID NO: 2514007 - protein, 18 aa, Entamoeba dispar
KEIYYENSLSILFNTDNK

SEQ ID NO: 2514008 - protein, 23 aa, Entamoeba dispar
KEKEIKAGLTFSFAVEQIAIDKG

SEQ ID NO: 2514009 - protein, 21 aa, Entamoeba dispar
KEKKPRISSIVKESSDLLPKK

SEQ ID NO: 2514010 - protein, 18 aa, Entamoeba dispar
KEKLPEKKQFVLEKPQVV

SEQ ID NO: 2514011 - protein, 23 aa, Entamoeba dispar
KEKRIAGKLNHFFPIQKIWNQNG

SEQ ID NO: 2514012 - protein, 17 aa, Entamoeba dispar
KEKRKSAELELENKKDD

SEQ ID NO: 2514013 - protein, 17 aa, Entamoeba dispar
KEKSFIIGCVIRCGISL

SEQ ID NO: 2514014 - protein, 17 aa, Entamoeba dispar
KELFKKACWTIEINNHF

SEQ ID NO: 2514015 - protein, 18 aa, Entamoeba dispar
KELFNFRGLLKAQLDMAY

SEQ ID NO: 2514016 - protein, 23 aa, Entamoeba dispar
KELFSRVGMELGIYFDEAYIKKL

SEQ ID NO: 2514017 - protein, 17 aa, Entamoeba dispar
KELKNDEFIEGDAEEAQ

SEQ ID NO: 2514018 - protein, 20 aa, Entamoeba dispar
KELLIEIGFNKYAVQKQDIA

SEQ ID NO: 2514019 - protein, 20 aa, Entamoeba dispar
KELMKIIGMSIVVERNRDLM

SEQ ID NO: 2514020 - protein, 21 aa, Entamoeba dispar
KELMKLGAKFIYLSNGSFMQK

SEQ ID NO: 2514021 - protein, 17 aa, Entamoeba dispar
KELNQMLSIKRLAPYDE

SEQ ID NO: 2514022 - protein, 21 aa, Entamoeba dispar
KELPETLVFHLKRFVYNDQYE

SEQ ID NO: 2514023 - protein, 18 aa, Entamoeba dispar
KELVCSFSKLWAVHYADN

SEQ ID NO: 2514024 - protein, 20 aa, Entamoeba dispar
KELYKNGGIFFITTRILISD

SEQ ID NO: 2514025 - protein, 24 aa, Entamoeba dispar
KEMFPELLQRILLASKISFEKSKE

SEQ ID NO: 2514026 - protein, 22 aa, Entamoeba dispar
KEMKEMIEAIVLPMTQKEKFEK

SEQ ID NO: 2514027 - protein, 26 aa, Entamoeba dispar
KEMKIRIPFVASHSVSLSPDMFDTSI

SEQ ID NO: 2514028 - protein, 21 aa, Entamoeba dispar
KEMLPCFKYLYGHFEGLLEVC

SEQ ID NO: 2514029 - protein, 23 aa, Entamoeba dispar
KENCDIKVPIVHRQGTYQLVNQH

SEQ ID NO: 2514030 - protein, 17 aa, Entamoeba dispar
KENIPLFGPLVTGSIVC

SEQ ID NO: 2514031 - protein, 20 aa, Entamoeba dispar
KENIVRIGILLNEKPLIKKQ

SEQ ID NO: 2514032 - protein, 22 aa, Entamoeba dispar
KENLLRFVFPLSRITLLPCNSK

SEQ ID NO: 2514033 - protein, 28 aa, Entamoeba dispar
KENNDILLLEFCKYCQLESLKIQNIGGC

SEQ ID NO: 2514034 - protein, 19 aa, Entamoeba dispar
KENRLDCTFDISIINENRG

SEQ ID NO: 2514035 - protein, 21 aa, Entamoeba dispar
KENVRGFGWKKCLGGSYEELY

SEQ ID NO: 2514036 - protein, 17 aa, Entamoeba dispar
KEPYQRIEFSLTIEQSN

SEQ ID NO: 2514037 - protein, 25 aa, Entamoeba dispar
KEQRSRVVLTFLCLKELKTKDFFEL

SEQ ID NO: 2514038 - protein, 21 aa, Entamoeba dispar
KERLNNILSFCGFENDDQVEK

SEQ ID NO: 2514039 - protein, 23 aa, Entamoeba dispar
KESERKKRMVILYERKLDSMREL

SEQ ID NO: 2514040 - protein, 19 aa, Entamoeba dispar
KESEWKLIFSVVGQCIEEE

SEQ ID NO: 2514041 - protein, 18 aa, Entamoeba dispar
KESFAYKKFLGIVISLGN

SEQ ID NO: 2514042 - protein, 20 aa, Entamoeba dispar
KESFTAFKTEMDKMADIEET

SEQ ID NO: 2514043 - protein, 22 aa, Entamoeba dispar
KESLTLECFMHWNYYESKENGI

SEQ ID NO: 2514044 - protein, 20 aa, Entamoeba dispar
KESRASKLLTFDIFGPPNNS

SEQ ID NO: 2514045 - protein, 20 aa, Entamoeba dispar
KESRRGISITIKQYCSTLVL

SEQ ID NO: 2514046 - protein, 20 aa, Entamoeba dispar
KESYWYLGLLYEYGVGGIQN

SEQ ID NO: 2514047 - protein, 17 aa, Entamoeba dispar
KETKMIISLYMTELPVG

SEQ ID NO: 2514048 - protein, 23 aa, Entamoeba dispar
KETSPICILVFLPGMAEIEEMKS

SEQ ID NO: 2514049 - protein, 17 aa, Entamoeba dispar
KETWKVRALEAENASTK

SEQ ID NO: 2514050 - protein, 22 aa, Entamoeba dispar
KEVPKMKGLVLIPKFVEEREKQ

SEQ ID NO: 2514051 - protein, 18 aa, Entamoeba dispar
KEVYGNGIAQCFIGEFGK

SEQ ID NO: 2514052 - protein, 18 aa, Entamoeba dispar
KEYACSFVIILGAVSYKD

SEQ ID NO: 2514053 - protein, 19 aa, Entamoeba dispar
KEYELFKFSTLKNELIING

SEQ ID NO: 2514054 - protein, 17 aa, Entamoeba dispar
KEYELFRFSSLQNELVL

SEQ ID NO: 2514055 - protein, 24 aa, Entamoeba dispar
KFADIPVLLMIPWKDDPLYKVYYF

SEQ ID NO: 2514056 - protein, 25 aa, Entamoeba dispar
KFAEMIVSYLLRFGNDINTWNSGNE

SEQ ID NO: 2514057 - protein, 20 aa, Entamoeba dispar
KFEAKECYRRSFTKEEKTIE

SEQ ID NO: 2514058 - protein, 21 aa, Entamoeba dispar
KFELSEGSALVFGDLWNVIKR

SEQ ID NO: 2514059 - protein, 18 aa, Entamoeba dispar
KFEQGICYAMETLLKIFI

SEQ ID NO: 2514060 - protein, 18 aa, Entamoeba dispar
KFFKCPKPSYPLVEYLTD

SEQ ID NO: 2514061 - protein, 17 aa, Entamoeba dispar
KFICPIENCRRCFTTKS

SEQ ID NO: 2514062 - protein, 24 aa, Entamoeba dispar
KFKDELRGALALSKLENIFVVPEK

SEQ ID NO: 2514063 - protein, 19 aa, Entamoeba dispar
KFKECCFVKLLSDRCTGLI

SEQ ID NO: 2514064 - protein, 18 aa, Entamoeba dispar
KFKFIVCSFNEYDRQMAN

SEQ ID NO: 2514065 - protein, 17 aa, Entamoeba dispar
KFPFSVLDLNIYKQHTV

SEQ ID NO: 2514066 - protein, 20 aa, Entamoeba dispar
KFPNLRLVGISAYANLFESC

SEQ ID NO: 2514067 - protein, 24 aa, Entamoeba dispar
KFPTPRLGLIEVIKGEVSKPNVNT

SEQ ID NO: 2514068 - protein, 18 aa, Entamoeba dispar
KFRLSVLDHPNFFIDPNN

SEQ ID NO: 2514069 - protein, 22 aa, Entamoeba dispar
KFTLPINCYSSWINLALLIIFK

SEQ ID NO: 2514070 - protein, 17 aa, Entamoeba dispar
KFTRLWNGKGYIYMYVT

SEQ ID NO: 2514071 - protein, 17 aa, Entamoeba dispar
KFTVSRLKLLKTLDQDV

SEQ ID NO: 2514072 - protein, 22 aa, Entamoeba dispar
KFYFRLCEFLQYPSLPLSCINL

SEQ ID NO: 2514073 - protein, 22 aa, Entamoeba dispar
KGCACLRSAAKVPILVNMTVKD

SEQ ID NO: 2514074 - protein, 21 aa, Entamoeba dispar
KGDGEGCWWGCVIKGDHVIDV

SEQ ID NO: 2514075 - protein, 20 aa, Entamoeba dispar
KGDIESLISYSKRNELIRDN

SEQ ID NO: 2514076 - protein, 20 aa, Entamoeba dispar
KGDIIPVRFFLKNLQLTPTQ

SEQ ID NO: 2514077 - protein, 17 aa, Entamoeba dispar
KGDVISICVDFNQRTIK

SEQ ID NO: 2514078 - protein, 19 aa, Entamoeba dispar
KGECKFTFKEMQTLNVKRD

SEQ ID NO: 2514079 - protein, 18 aa, Entamoeba dispar
KGEITFRILKEFIEEGKY

SEQ ID NO: 2514080 - protein, 21 aa, Entamoeba dispar
KGELKEVCFDKVIAPVFENKY

SEQ ID NO: 2514081 - protein, 22 aa, Entamoeba dispar
KGELRPELILAINGLLQDLNHP

SEQ ID NO: 2514082 - protein, 17 aa, Entamoeba dispar
KGFEIIPIILMEELYDI

SEQ ID NO: 2514083 - protein, 18 aa, Entamoeba dispar
KGFFEWKKSLTLSGKAKK

SEQ ID NO: 2514084 - protein, 20 aa, Entamoeba dispar
KGGEIYRMFEITKLNPKGLF

SEQ ID NO: 2514085 - protein, 22 aa, Entamoeba dispar
KGICLLLLESCCEILKYYKEGK

SEQ ID NO: 2514086 - protein, 19 aa, Entamoeba dispar
KGIGCLTSLQLINLDLTDN

SEQ ID NO: 2514087 - protein, 17 aa, Entamoeba dispar
KGIISIGCNKRKKISLP

SEQ ID NO: 2514088 - protein, 17 aa, Entamoeba dispar
KGKRVAIDISEIIIRCM

SEQ ID NO: 2514089 - protein, 19 aa, Entamoeba dispar
KGKTCVLMMVGLQGAGKTT

SEQ ID NO: 2514090 - protein, 18 aa, Entamoeba dispar
KGKYSWYFNIVDRVLMTN

SEQ ID NO: 2514091 - protein, 21 aa, Entamoeba dispar
KGLIVEGFFGYLKKIINHSNL

SEQ ID NO: 2514092 - protein, 17 aa, Entamoeba dispar
KGLQCLLKLLKTQKSSD

SEQ ID NO: 2514093 - protein, 19 aa, Entamoeba dispar
KGLRFGARIFSLFPEASKA

SEQ ID NO: 2514094 - protein, 17 aa, Entamoeba dispar
KGNEMSHVFLLDIISYP

SEQ ID NO: 2514095 - protein, 20 aa, Entamoeba dispar
KGNMVFLFLRKGIYTCQALV

SEQ ID NO: 2514096 - protein, 19 aa, Entamoeba dispar
KGNVGFIFTKGDLYQLKAK

SEQ ID NO: 2514097 - protein, 19 aa, Entamoeba dispar
KGPSILILPHFFKKIIQDQ

SEQ ID NO: 2514098 - protein, 19 aa, Entamoeba dispar
KGRIPIVSWISEGNGLLVR

SEQ ID NO: 2514099 - protein, 19 aa, Entamoeba dispar
KGSALVFCSAFSSFPRDTE

SEQ ID NO: 2514100 - protein, 23 aa, Entamoeba dispar
KGVPKSFIFCIGNFGGILDLYKP

SEQ ID NO: 2514101 - protein, 23 aa, Entamoeba dispar
KHACKIIDFAHAWDVTEEECNVD

SEQ ID NO: 2514102 - protein, 18 aa, Entamoeba dispar
KHCFSAICHIYRLYPDLI

SEQ ID NO: 2514103 - protein, 17 aa, Entamoeba dispar
KHIKEQLKAGGLQHQQI

SEQ ID NO: 2514104 - protein, 25 aa, Entamoeba dispar
KHLHKIKWLLPSLRELFRRNDRRCS

SEQ ID NO: 2514105 - protein, 18 aa, Entamoeba dispar
KHLICFKMRVEEVTGDTN

SEQ ID NO: 2514106 - protein, 17 aa, Entamoeba dispar
KHLWEVFTTSLFNFLWP

SEQ ID NO: 2514107 - protein, 17 aa, Entamoeba dispar
KHYAEKSIDAYIYSLTK

SEQ ID NO: 2514108 - protein, 21 aa, Entamoeba dispar
KHYRCSISMTELLPYNTNHVK

SEQ ID NO: 2514109 - protein, 21 aa, Entamoeba dispar
KIADACLRSSAAVGYYPPYQG

SEQ ID NO: 2514110 - protein, 20 aa, Entamoeba dispar
KICQCIKCGYRGNADVILPK

SEQ ID NO: 2514111 - protein, 19 aa, Entamoeba dispar
KIDKCPKCGGDELVCKIKT

SEQ ID NO: 2514112 - protein, 22 aa, Entamoeba dispar
KIDLSYFIKLFQKFGEIYSIWG

SEQ ID NO: 2514113 - protein, 22 aa, Entamoeba dispar
KIEIAQAIYIRWKTKKLINERM

SEQ ID NO: 2514114 - protein, 18 aa, Entamoeba dispar
KIESFKFEKCVGVVATVS

SEQ ID NO: 2514115 - protein, 22 aa, Entamoeba dispar
KIFKRLFRVYAHMFYNHMEHLE

SEQ ID NO: 2514116 - protein, 22 aa, Entamoeba dispar
KIFKRLFRVYAHMFYSHANHLK

SEQ ID NO: 2514117 - protein, 18 aa, Entamoeba dispar
KIGGCIRIRAKSQGVALS

SEQ ID NO: 2514118 - protein, 23 aa, Entamoeba dispar
KIGWSCFSGCPWLNEVIIPSSVS

SEQ ID NO: 2514119 - protein, 18 aa, Entamoeba dispar
KIGYSFMYKWLILLFRRD

SEQ ID NO: 2514120 - protein, 19 aa, Entamoeba dispar
KIIEPIIAYMLFKNIIIRE

SEQ ID NO: 2514121 - protein, 19 aa, Entamoeba dispar
KIIGGFCFKGCSSLKTINI

SEQ ID NO: 2514122 - protein, 18 aa, Entamoeba dispar
KIIKCINILSSIALNDKI

SEQ ID NO: 2514123 - protein, 18 aa, Entamoeba dispar
KIISSPRFKVSEIPNTLR

SEQ ID NO: 2514124 - protein, 19 aa, Entamoeba dispar
KIITSLGCCTLVADTDDDN

SEQ ID NO: 2514125 - protein, 18 aa, Entamoeba dispar
KIIYLALMVNWILKADET

SEQ ID NO: 2514126 - protein, 20 aa, Entamoeba dispar
KIKGKYCFISFYNGVTIVCY

SEQ ID NO: 2514127 - protein, 20 aa, Entamoeba dispar
KIKLRFTVRYDLLLTIFCDK

SEQ ID NO: 2514128 - protein, 22 aa, Entamoeba dispar
KIKRIVLPIAVFARTPNSRNVD

SEQ ID NO: 2514129 - protein, 17 aa, Entamoeba dispar
KIKRKYIAFKKVFEEHG

SEQ ID NO: 2514130 - protein, 21 aa, Entamoeba dispar
KIKSRWLRKNARRIDMENYTK

SEQ ID NO: 2514131 - protein, 25 aa, Entamoeba dispar
KIKTETYSGISLRVIFPAFGGDAKT

SEQ ID NO: 2514132 - protein, 18 aa, Entamoeba dispar
KILICSDTHLGAGEKSHC

SEQ ID NO: 2514133 - protein, 18 aa, Entamoeba dispar
KILKSGGMLGFFAMDNLN

SEQ ID NO: 2514134 - protein, 19 aa, Entamoeba dispar
KILKWEVLGIQGGILANHF

SEQ ID NO: 2514135 - protein, 17 aa, Entamoeba dispar
KILRDIAVGLAFIHSLA

SEQ ID NO: 2514136 - protein, 18 aa, Entamoeba dispar
KIMEDIVVGLAFLHENQI

SEQ ID NO: 2514137 - protein, 22 aa, Entamoeba dispar
KIMLEQCPLCWIDSVEKDNLKE

SEQ ID NO: 2514138 - protein, 18 aa, Entamoeba dispar
KINGRYGVDMSMKTIVQK

SEQ ID NO: 2514139 - protein, 19 aa, Entamoeba dispar
KINVCNELFEVPSIDKTNL

SEQ ID NO: 2514140 - protein, 21 aa, Entamoeba dispar
KIPCLNSIVNIDCEFNETIIL

SEQ ID NO: 2514141 - protein, 19 aa, Entamoeba dispar
KIRFDAGVTDLIWRNQTNF

SEQ ID NO: 2514142 - protein, 25 aa, Entamoeba dispar
KISDACLRSAAAVGYYPPYQGYADG

SEQ ID NO: 2514143 - protein, 19 aa, Entamoeba dispar
KISECLMVLMGVDMNQFLN

SEQ ID NO: 2514144 - protein, 23 aa, Entamoeba dispar
KISEIGKKIGVEWKELPEEQKKK

SEQ ID NO: 2514145 - protein, 19 aa, Entamoeba dispar
KISEPMGIVLSSFKGESPN

SEQ ID NO: 2514146 - protein, 22 aa, Entamoeba dispar
KISIPCVYLYPCVIPKEALDNS

SEQ ID NO: 2514147 - protein, 17 aa, Entamoeba dispar
KITEFFNNIVLVTVINN

SEQ ID NO: 2514148 - protein, 18 aa, Entamoeba dispar
KITEGVLLRMVLSDLIKQ

SEQ ID NO: 2514149 - protein, 19 aa, Entamoeba dispar
KITEGVLLRMVLSDLIKQS

SEQ ID NO: 2514150 - protein, 23 aa, Entamoeba dispar
KITFPFREIIAFSYVQTKTTTTI

SEQ ID NO: 2514151 - protein, 17 aa, Entamoeba dispar
KITIPLYFGEFVVANES

SEQ ID NO: 2514152 - protein, 20 aa, Entamoeba dispar
KITRLGCLVVIFQMSIHLEL

SEQ ID NO: 2514153 - protein, 23 aa, Entamoeba dispar
KITRSSLFLAYLIENPFNREICL

SEQ ID NO: 2514154 - protein, 18 aa, Entamoeba dispar
KIVGCIMSSYLLEKSRVV

SEQ ID NO: 2514155 - protein, 20 aa, Entamoeba dispar
KIVLRFVFNLIQIAFTSQHK

SEQ ID NO: 2514156 - protein, 19 aa, Entamoeba dispar
KIVLVFLCDLEMEKVYNAF

SEQ ID NO: 2514157 - protein, 18 aa, Entamoeba dispar
KIVRESKSGMGRGIGFVT

SEQ ID NO: 2514158 - protein, 20 aa, Entamoeba dispar
KIYNCFFCYFNGSLQFWIVM

SEQ ID NO: 2514159 - protein, 18 aa, Entamoeba dispar
KIYSWSKMEMGIFFDEQQ

SEQ ID NO: 2514160 - protein, 20 aa, Entamoeba dispar
KKAINEWILKSLIKNIQKKR

SEQ ID NO: 2514161 - protein, 18 aa, Entamoeba dispar
KKAYEWKGTYCSDGVSNC

SEQ ID NO: 2514162 - protein, 19 aa, Entamoeba dispar
KKAYEWKGTYCSDGVSNCV

SEQ ID NO: 2514163 - protein, 21 aa, Entamoeba dispar
KKAYKKLALKWHPDRNINNQQ

SEQ ID NO: 2514164 - protein, 21 aa, Entamoeba dispar
KKCCVFCHKANISTKCPVCNK

SEQ ID NO: 2514165 - protein, 23 aa, Entamoeba dispar
KKCKKTCHYPCHVPSLVSFFTIR

SEQ ID NO: 2514166 - protein, 19 aa, Entamoeba dispar
KKCREMFKEVLNIVMDDNP

SEQ ID NO: 2514167 - protein, 19 aa, Entamoeba dispar
KKCWGESVIKELEKTDILE

SEQ ID NO: 2514168 - protein, 17 aa, Entamoeba dispar
KKCWPKDCRMRLMRHDV

SEQ ID NO: 2514169 - protein, 18 aa, Entamoeba dispar
KKDLEAIALLIEETIGGM

SEQ ID NO: 2514170 - protein, 21 aa, Entamoeba dispar
KKDLILNVVMYKNGFVVNDGP

SEQ ID NO: 2514171 - protein, 18 aa, Entamoeba dispar
KKEIGCIISSMKQKEKLK

SEQ ID NO: 2514172 - protein, 23 aa, Entamoeba dispar
KKEKLPCPFTYLQLSEMCGWNDT

SEQ ID NO: 2514173 - protein, 20 aa, Entamoeba dispar
KKEVLKIVTIEAYKDALNLL

SEQ ID NO: 2514174 - protein, 17 aa, Entamoeba dispar
KKFTIGVEFATRTIEYE

SEQ ID NO: 2514175 - protein, 19 aa, Entamoeba dispar
KKGILSFMYQILSKYRLGN

SEQ ID NO: 2514176 - protein, 20 aa, Entamoeba dispar
KKIGECLIHLSKEQKQDLYQ

SEQ ID NO: 2514177 - protein, 17 aa, Entamoeba dispar
KKIIIWGNLPRRRIDLM

SEQ ID NO: 2514178 - protein, 20 aa, Entamoeba dispar
KKIKEGFISKAKDSFNIKKN

SEQ ID NO: 2514179 - protein, 22 aa, Entamoeba dispar
KKIKRYQIGKVYRRDQPYMTRG

SEQ ID NO: 2514180 - protein, 17 aa, Entamoeba dispar
KKIMLHMIHIYKEKKEV

SEQ ID NO: 2514181 - protein, 17 aa, Entamoeba dispar
KKKCIVYADVIEPFTRT

SEQ ID NO: 2514182 - protein, 20 aa, Entamoeba dispar
KKKHCYAFLFSDELVFAKEQ

SEQ ID NO: 2514183 - protein, 17 aa, Entamoeba dispar
KKKVLKYIVTFRGDLSQ

SEQ ID NO: 2514184 - protein, 21 aa, Entamoeba dispar
KKKWLLESWNRVVNFYNELND

SEQ ID NO: 2514185 - protein, 18 aa, Entamoeba dispar
KKLCQEFITWISNNQKIA

SEQ ID NO: 2514186 - protein, 19 aa, Entamoeba dispar
KKLHYRILGFYAIPHENEL

SEQ ID NO: 2514187 - protein, 19 aa, Entamoeba dispar
KKLKLRGVNKLKINEINEE

SEQ ID NO: 2514188 - protein, 19 aa, Entamoeba dispar
KKLKYKGEFIFKDENDMTW

SEQ ID NO: 2514189 - protein, 23 aa, Entamoeba dispar
KKMFECLSEIPIYVGLEKAGFCS

SEQ ID NO: 2514190 - protein, 21 aa, Entamoeba dispar
KKNEPIICLGLGKPIEQQLFS

SEQ ID NO: 2514191 - protein, 23 aa, Entamoeba dispar
KKNFLIRIAHGFHDLFIRTIKKL

SEQ ID NO: 2514192 - protein, 19 aa, Entamoeba dispar
KKNRLIWDKEIERLKNDLY

SEQ ID NO: 2514193 - protein, 20 aa, Entamoeba dispar
KKPDECITCIDGNKLDQSIF

SEQ ID NO: 2514194 - protein, 18 aa, Entamoeba dispar
KKPIRICRMNGSGSSEYL

SEQ ID NO: 2514195 - protein, 19 aa, Entamoeba dispar
KKPQWANGFEWKNEYDQQI

SEQ ID NO: 2514196 - protein, 22 aa, Entamoeba dispar
KKRCKISEIFVHEWIKDNLCES

SEQ ID NO: 2514197 - protein, 19 aa, Entamoeba dispar
KKREEVWEKLEVLKLSNCE

SEQ ID NO: 2514198 - protein, 22 aa, Entamoeba dispar
KKRLFKKWEVILFRKQDRKKKY

SEQ ID NO: 2514199 - protein, 23 aa, Entamoeba dispar
KKRLSFLGRKSFSKRSSTENTGH

SEQ ID NO: 2514200 - protein, 17 aa, Entamoeba dispar
KKRMELFAPKTRAKPKR

SEQ ID NO: 2514201 - protein, 18 aa, Entamoeba dispar
KKRWCILTKNKLFYFNCK

SEQ ID NO: 2514202 - protein, 20 aa, Entamoeba dispar
KKRWEIPKSGKLTMKNGIGI

SEQ ID NO: 2514203 - protein, 18 aa, Entamoeba dispar
KKSCIICIQLLFHRIDES

SEQ ID NO: 2514204 - protein, 23 aa, Entamoeba dispar
KKSKEWKVDTLILKKYPALVDEI

SEQ ID NO: 2514205 - protein, 20 aa, Entamoeba dispar
KKSKGCAFVSFKTPLEAQKC

SEQ ID NO: 2514206 - protein, 23 aa, Entamoeba dispar
KKSQWRVPLPIFRAMQYLEEHKG

SEQ ID NO: 2514207 - protein, 26 aa, Entamoeba dispar
KKSSWRFPIPVFRSLQYLLTHEGKEL

SEQ ID NO: 2514208 - protein, 21 aa, Entamoeba dispar
KKTECPFRINLNYRANTNTWN

SEQ ID NO: 2514209 - protein, 18 aa, Entamoeba dispar
KKTLLSICEYLIDSGINC

SEQ ID NO: 2514210 - protein, 18 aa, Entamoeba dispar
KKTLLSICEYLIDSGINS

SEQ ID NO: 2514211 - protein, 24 aa, Entamoeba dispar
KKTSLWIVCELFRIIVSSNLQEFD

SEQ ID NO: 2514212 - protein, 21 aa, Entamoeba dispar
KKVFCVLGGYGLFDSTQVQIK

SEQ ID NO: 2514213 - protein, 20 aa, Entamoeba dispar
KKVGERWVILRAFDRFFEES

SEQ ID NO: 2514214 - protein, 24 aa, Entamoeba dispar
KKVVILCFKEFVGALLELKNNESP

SEQ ID NO: 2514215 - protein, 19 aa, Entamoeba dispar
KKVYKRWVVLKSKTMMLFK

SEQ ID NO: 2514216 - protein, 19 aa, Entamoeba dispar
KKWFEKYSMLSNFPFVYIV

SEQ ID NO: 2514217 - protein, 17 aa, Entamoeba dispar
KKWLCLMKEEEQIELLA

SEQ ID NO: 2514218 - protein, 17 aa, Entamoeba dispar
KKYGAVCVIGIGYPLPI

SEQ ID NO: 2514219 - protein, 24 aa, Entamoeba dispar
KKYGIKVPFMYGTMVECVRAALTA

SEQ ID NO: 2514220 - protein, 27 aa, Entamoeba dispar
KKYKMTVFIPMHFPRFSTMQGNRCKEN

SEQ ID NO: 2514221 - protein, 23 aa, Entamoeba dispar
KKYLKEFIMSIIINASYSTSVSG

SEQ ID NO: 2514222 - protein, 17 aa, Entamoeba dispar
KKYQMMFEWGRIGGTLH

SEQ ID NO: 2514223 - protein, 23 aa, Entamoeba dispar
KKYYCEICGIVLNGEKEWDIHLI

SEQ ID NO: 2514224 - protein, 20 aa, Entamoeba dispar
KLCKDFQGIVLPVVRALMVN

SEQ ID NO: 2514225 - protein, 18 aa, Entamoeba dispar
KLCYSHFVSYQWNDEITI

SEQ ID NO: 2514226 - protein, 25 aa, Entamoeba dispar
KLDCKEGLCFKHEFFQRTHPELLEK

SEQ ID NO: 2514227 - protein, 21 aa, Entamoeba dispar
KLDFPRAFLIMELCDGGDLDT

SEQ ID NO: 2514228 - protein, 23 aa, Entamoeba dispar
KLEPSEFFGQAWAKAKLRHKAPN

SEQ ID NO: 2514229 - protein, 19 aa, Entamoeba dispar
KLFSEWTFWFDGFSNKSTE

SEQ ID NO: 2514230 - protein, 18 aa, Entamoeba dispar
KLFTLWISFYEFRKVFVQ

SEQ ID NO: 2514231 - protein, 20 aa, Entamoeba dispar
KLGAGVYRLSLSIHESLKIS

SEQ ID NO: 2514232 - protein, 21 aa, Entamoeba dispar
KLGDWCFYEYSSLISINIPST

SEQ ID NO: 2514233 - protein, 18 aa, Entamoeba dispar
KLGILVYQFDCFVTEKGV

SEQ ID NO: 2514234 - protein, 21 aa, Entamoeba dispar
KLGKYCFKECYSLTSIIIPTT

SEQ ID NO: 2514235 - protein, 24 aa, Entamoeba dispar
KLHHVYRYKVDYSFYLKHREDNCD

SEQ ID NO: 2514236 - protein, 20 aa, Entamoeba dispar
KLHYRMIEFNKPVKMNTFTA

SEQ ID NO: 2514237 - protein, 21 aa, Entamoeba dispar
KLIDFGSACFENFTMNTYIQS

SEQ ID NO: 2514238 - protein, 18 aa, Entamoeba dispar
KLIVYRNLFDLVQKSLGT

SEQ ID NO: 2514239 - protein, 23 aa, Entamoeba dispar
KLKDIYEFWGFLWSQMFKILQEH

SEQ ID NO: 2514240 - protein, 20 aa, Entamoeba dispar
KLKFIKNFHETIGMYPRSDQ

SEQ ID NO: 2514241 - protein, 20 aa, Entamoeba dispar
KLKKGRWSGMRVYDAEKEGG

SEQ ID NO: 2514242 - protein, 21 aa, Entamoeba dispar
KLKLRFENEMHSFKISPIDKL

SEQ ID NO: 2514243 - protein, 21 aa, Entamoeba dispar
KLKSVEVINCRECKINIKSDC

SEQ ID NO: 2514244 - protein, 20 aa, Entamoeba dispar
KLLCTCYGYFFADIFMLIPE

SEQ ID NO: 2514245 - protein, 18 aa, Entamoeba dispar
KLLFNYVALGVKLMNASN

SEQ ID NO: 2514246 - protein, 20 aa, Entamoeba dispar
KLLHEYGILYSFRKSQFRSL

SEQ ID NO: 2514247 - protein, 18 aa, Entamoeba dispar
KLMEAFCNKQGLNMSSVR

SEQ ID NO: 2514248 - protein, 19 aa, Entamoeba dispar
KLMKYRDVVVIGTDLLFDT

SEQ ID NO: 2514249 - protein, 20 aa, Entamoeba dispar
KLNEIKGIEFIKESNGMIIS

SEQ ID NO: 2514250 - protein, 19 aa, Entamoeba dispar
KLNELIELVQLFPNCEIIS

SEQ ID NO: 2514251 - protein, 18 aa, Entamoeba dispar
KLNIPFESGNSIYLSLDM

SEQ ID NO: 2514252 - protein, 25 aa, Entamoeba dispar
KLNMVQCFICPSFITRSLKIIGSDS

SEQ ID NO: 2514253 - protein, 24 aa, Entamoeba dispar
KLNWEIICGIAIDIAEGLVCLKEN

SEQ ID NO: 2514254 - protein, 18 aa, Entamoeba dispar
KLPGEFEPGIIIWMTEGK

SEQ ID NO: 2514255 - protein, 18 aa, Entamoeba dispar
KLPNIEIKSTLNIGLDDG

SEQ ID NO: 2514256 - protein, 24 aa, Entamoeba dispar
KLPSLRKLSCCEFIPSEFITNLTF

SEQ ID NO: 2514257 - protein, 24 aa, Entamoeba dispar
KLRLCCLPKVPYFVEMHASEFILL

SEQ ID NO: 2514258 - protein, 18 aa, Entamoeba dispar
KLRLERLKDILLIQRDFI

SEQ ID NO: 2514259 - protein, 23 aa, Entamoeba dispar
KLSLKRPIPLVGFCTYFEADISN

SEQ ID NO: 2514260 - protein, 20 aa, Entamoeba dispar
KLSNGKLWFTIGILNENEEL

SEQ ID NO: 2514261 - protein, 20 aa, Entamoeba dispar
KLTEIPIFFTELINLKKLDV

SEQ ID NO: 2514262 - protein, 24 aa, Entamoeba dispar
KLTSPEFFEFFSFIDNLLMNEAVA

SEQ ID NO: 2514263 - protein, 17 aa, Entamoeba dispar
KLVPLKTDFIFTVNYKK

SEQ ID NO: 2514264 - protein, 19 aa, Entamoeba dispar
KLWDIVKFYLFRESDTNTR

SEQ ID NO: 2514265 - protein, 18 aa, Entamoeba dispar
KLYCNGALDGDEVSISIL

SEQ ID NO: 2514266 - protein, 23 aa, Entamoeba dispar
KLYFKYLHLEKWFSIDQIILYDK

SEQ ID NO: 2514267 - protein, 19 aa, Entamoeba dispar
KLYGDMGLVITIYRNFSYE

SEQ ID NO: 2514268 - protein, 21 aa, Entamoeba dispar
KLYHCIVALGYLHIVKFLVST

SEQ ID NO: 2514269 - protein, 22 aa, Entamoeba dispar
KMARIIVPLCSDWEQWKSLSIT

SEQ ID NO: 2514270 - protein, 18 aa, Entamoeba dispar
KMAVPFLLRCCSDCANAL

SEQ ID NO: 2514271 - protein, 18 aa, Entamoeba dispar
KMCCDLFDLLALSALIDN

SEQ ID NO: 2514272 - protein, 21 aa, Entamoeba dispar
KMGLTFPHGRYVMKWFEEDTH

SEQ ID NO: 2514273 - protein, 19 aa, Entamoeba dispar
KMILPILKFIHGIVSIELV

SEQ ID NO: 2514274 - protein, 23 aa, Entamoeba dispar
KMKELLEGIFLRLFSFKMIPDSF

SEQ ID NO: 2514275 - protein, 18 aa, Entamoeba dispar
KMLMGFFRALMVWETSLK

SEQ ID NO: 2514276 - protein, 21 aa, Entamoeba dispar
KMVNRFKRIFVRDSNPHLPIH

SEQ ID NO: 2514277 - protein, 21 aa, Entamoeba dispar
KMVYEGLQWAFANRPEQIQNN

SEQ ID NO: 2514278 - protein, 20 aa, Entamoeba dispar
KNELPWWKTVFAIVMKYIST

SEQ ID NO: 2514279 - protein, 17 aa, Entamoeba dispar
KNFYLLHGLYCQLLETA

SEQ ID NO: 2514280 - protein, 23 aa, Entamoeba dispar
KNGLKVMLFSGINKYSTYLIYSQ

SEQ ID NO: 2514281 - protein, 20 aa, Entamoeba dispar
KNGWRLPLGNSFKFLNEIIS

SEQ ID NO: 2514282 - protein, 22 aa, Entamoeba dispar
KNHLFKNLNWVGSILGNPTIIF

SEQ ID NO: 2514283 - protein, 17 aa, Entamoeba dispar
KNILFVFGTLDFCPHQK

SEQ ID NO: 2514284 - protein, 18 aa, Entamoeba dispar
KNINEFICFALSTDNYQF

SEQ ID NO: 2514285 - protein, 23 aa, Entamoeba dispar
KNKELLKRITFCYKECYKKGFDN

SEQ ID NO: 2514286 - protein, 23 aa, Entamoeba dispar
KNKELLKRITFCYKECYKKGFNN

SEQ ID NO: 2514287 - protein, 23 aa, Entamoeba dispar
KNKELLKRITFCYKECYNNMSNS

SEQ ID NO: 2514288 - protein, 22 aa, Entamoeba dispar
KNKLKNLWGEAVTEVGKVIIQK

SEQ ID NO: 2514289 - protein, 23 aa, Entamoeba dispar
KNLCLLHCNLHFGKFYDFFDHIA

SEQ ID NO: 2514290 - protein, 23 aa, Entamoeba dispar
KNPDAWGKWNIMRGINLHKTQCT

SEQ ID NO: 2514291 - protein, 19 aa, Entamoeba dispar
KNRLKFMMRNGLINNVTQC

SEQ ID NO: 2514292 - protein, 22 aa, Entamoeba dispar
KNRNLYCLVYYLLLGEITLNKK

SEQ ID NO: 2514293 - protein, 24 aa, Entamoeba dispar
KNSFTPFCFPRLNLLDISNNEIMT

SEQ ID NO: 2514294 - protein, 17 aa, Entamoeba dispar
KNSRIWLSSALSGRTKR

SEQ ID NO: 2514295 - protein, 17 aa, Entamoeba dispar
KNVNLVWKIIFEGLMFE

SEQ ID NO: 2514296 - protein, 19 aa, Entamoeba dispar
KNVRPGISFEQFVAQLYKL

SEQ ID NO: 2514297 - protein, 29 aa, Entamoeba dispar
KNYIIKKSMKFLVFMIIFVVSKGLEPIEV

SEQ ID NO: 2514298 - protein, 18 aa, Entamoeba dispar
KNYPTGFSYFMHKVSIEL

SEQ ID NO: 2514299 - protein, 22 aa, Entamoeba dispar
KPCNMFQAFLIRLVIPFPLSLI

SEQ ID NO: 2514300 - protein, 18 aa, Entamoeba dispar
KPEMPFVISSSYDNTVRV

SEQ ID NO: 2514301 - protein, 20 aa, Entamoeba dispar
KPFKCVFERTIERSLPKQDE

SEQ ID NO: 2514302 - protein, 17 aa, Entamoeba dispar
KPFPPARIRKITKINTN

SEQ ID NO: 2514303 - protein, 17 aa, Entamoeba dispar
KPFQFLHCHILRGYLQI

SEQ ID NO: 2514304 - protein, 19 aa, Entamoeba dispar
KPILRRVCVNLKEECEKYS

SEQ ID NO: 2514305 - protein, 17 aa, Entamoeba dispar
KPISCLEFMKWNDLVTN

SEQ ID NO: 2514306 - protein, 23 aa, Entamoeba dispar
KPIYRLVERIGFIRRNIGIKTEK

SEQ ID NO: 2514307 - protein, 19 aa, Entamoeba dispar
KPLGTYPIRIDTTGAGDTT

SEQ ID NO: 2514308 - protein, 23 aa, Entamoeba dispar
KPNIILPFQFCNFVHLKQLIVEN

SEQ ID NO: 2514309 - protein, 17 aa, Entamoeba dispar
KPQPASVIRSRTNTFNF

SEQ ID NO: 2514310 - protein, 20 aa, Entamoeba dispar
KPRKDCVCGLDLLQEPKRDK

SEQ ID NO: 2514311 - protein, 19 aa, Entamoeba dispar
KPRYVKIVYKNNGPQYSNK

SEQ ID NO: 2514312 - protein, 17 aa, Entamoeba dispar
KPSPGFKMPCKEILHGV

SEQ ID NO: 2514313 - protein, 18 aa, Entamoeba dispar
KPTFKGCVCVASDKESHQ

SEQ ID NO: 2514314 - protein, 25 aa, Entamoeba dispar
KPVEIEFFKPLTLITGPNGAGKTTI

SEQ ID NO: 2514315 - protein, 18 aa, Entamoeba dispar
KQCMLFKIIGKDGQVKKN

SEQ ID NO: 2514316 - protein, 26 aa, Entamoeba dispar
KQEKLECPLLFLWGNLYGNLQFVKEQ

SEQ ID NO: 2514317 - protein, 18 aa, Entamoeba dispar
KQFPAMIIPISLRVNEVI

SEQ ID NO: 2514318 - protein, 19 aa, Entamoeba dispar
KQGLLCEYCNTILHNNCVN

SEQ ID NO: 2514319 - protein, 21 aa, Entamoeba dispar
KQGRLRLNLMGKRVDFSARTV

SEQ ID NO: 2514320 - protein, 18 aa, Entamoeba dispar
KQIREFKERVGIVHKGID

SEQ ID NO: 2514321 - protein, 17 aa, Entamoeba dispar
KQKVVVVIPVATRADKV

SEQ ID NO: 2514322 - protein, 21 aa, Entamoeba dispar
KQLFCNICQQLLREVVIQLTV

SEQ ID NO: 2514323 - protein, 18 aa, Entamoeba dispar
KQLHCVFIFNKKNGKISI

SEQ ID NO: 2514324 - protein, 21 aa, Entamoeba dispar
KQLHCVHVFNMIEGRGKTFGG

SEQ ID NO: 2514325 - protein, 21 aa, Entamoeba dispar
KQLRCNGVLEGIRITRMGYPN

SEQ ID NO: 2514326 - protein, 18 aa, Entamoeba dispar
KQNFRLVLINGKYYLQAE

SEQ ID NO: 2514327 - protein, 19 aa, Entamoeba dispar
KQRRNVKCITLPFFQIKRL

SEQ ID NO: 2514328 - protein, 20 aa, Entamoeba dispar
KRAGSKFVINQPAVYKLPSS

SEQ ID NO: 2514329 - protein, 18 aa, Entamoeba dispar
KRAKLKKSDFETIKVIGR

SEQ ID NO: 2514330 - protein, 18 aa, Entamoeba dispar
KRDFAIDIFEDVALGKVN

SEQ ID NO: 2514331 - protein, 19 aa, Entamoeba dispar
KRFGALIIRITNPKTTALV

SEQ ID NO: 2514332 - protein, 20 aa, Entamoeba dispar
KRFICTLCLLFHPKFNLERC

SEQ ID NO: 2514333 - protein, 18 aa, Entamoeba dispar
KRGFQLERIIHIFYKNKF

SEQ ID NO: 2514334 - protein, 17 aa, Entamoeba dispar
KRGILVIDFESVIFYGF

SEQ ID NO: 2514335 - protein, 21 aa, Entamoeba dispar
KRGKISSQMMVFKRMVNFDGQ

SEQ ID NO: 2514336 - protein, 21 aa, Entamoeba dispar
KRGRCISLICYDRLMWVIPLG

SEQ ID NO: 2514337 - protein, 20 aa, Entamoeba dispar
KRGTICWSPKGNLLAVGTTA

SEQ ID NO: 2514338 - protein, 17 aa, Entamoeba dispar
KRIEAFVKCPVNFIFSR

SEQ ID NO: 2514339 - protein, 17 aa, Entamoeba dispar
KRIKLKLNDEVISTIEI

SEQ ID NO: 2514340 - protein, 17 aa, Entamoeba dispar
KRILFLLLHIVETISKM

SEQ ID NO: 2514341 - protein, 18 aa, Entamoeba dispar
KRINEFGAQMLLMDYSQG

SEQ ID NO: 2514342 - protein, 19 aa, Entamoeba dispar
KRKAFDMDEPNRFMVFPVK

SEQ ID NO: 2514343 - protein, 21 aa, Entamoeba dispar
KRKIGKFFCCHGGISPEINKI

SEQ ID NO: 2514344 - protein, 19 aa, Entamoeba dispar
KRKKRLSGLSSLFTKRKPD

SEQ ID NO: 2514345 - protein, 23 aa, Entamoeba dispar
KRKPVVGCFFELLVLKTQGVIDL

SEQ ID NO: 2514346 - protein, 19 aa, Entamoeba dispar
KRLCLLYVIDMIVKIDVNR

SEQ ID NO: 2514347 - protein, 21 aa, Entamoeba dispar
KRLDLVLLLLKFGARIYIANN

SEQ ID NO: 2514348 - protein, 19 aa, Entamoeba dispar
KRLHEELAQLVIQEGNCVC

SEQ ID NO: 2514349 - protein, 20 aa, Entamoeba dispar
KRLKTVINFDCPVSTQLYVH

SEQ ID NO: 2514350 - protein, 17 aa, Entamoeba dispar
KRLKWAMKAMYQAYNMA

SEQ ID NO: 2514351 - protein, 19 aa, Entamoeba dispar
KRLLKCWTLYNFDGGYQQG

SEQ ID NO: 2514352 - protein, 21 aa, Entamoeba dispar
KRLNKIIGCGGGERLVSASDD

SEQ ID NO: 2514353 - protein, 19 aa, Entamoeba dispar
KRLSEVMSRDIEQLRAEAE

SEQ ID NO: 2514354 - protein, 20 aa, Entamoeba dispar
KRLSPFDGLYLSKYDYPDRN

SEQ ID NO: 2514355 - protein, 18 aa, Entamoeba dispar
KRLTECLLKTNDCTNELV

SEQ ID NO: 2514356 - protein, 18 aa, Entamoeba dispar
KRLYGFFDEDIIFPKLPK

SEQ ID NO: 2514357 - protein, 19 aa, Entamoeba dispar
KRMKEIIDQISFTLSQIEM

SEQ ID NO: 2514358 - protein, 17 aa, Entamoeba dispar
KRNITLSLDEYYKLKSS

SEQ ID NO: 2514359 - protein, 17 aa, Entamoeba dispar
KRNKYLLKIKNWIEEKC

SEQ ID NO: 2514360 - protein, 20 aa, Entamoeba dispar
KRPKSFNARPIFNHKDGTQQ

SEQ ID NO: 2514361 - protein, 21 aa, Entamoeba dispar
KRPKSFNARPLFNHKDGTQQK

SEQ ID NO: 2514362 - protein, 18 aa, Entamoeba dispar
KRRFFVLKDRKLWYFESE

SEQ ID NO: 2514363 - protein, 18 aa, Entamoeba dispar
KRRIPICTYFNQITHGAI

SEQ ID NO: 2514364 - protein, 18 aa, Entamoeba dispar
KRRVNLFLLRWKNNNHYI

SEQ ID NO: 2514365 - protein, 25 aa, Entamoeba dispar
KRSGIGVVCPHGQYSPIFFQFLDCV

SEQ ID NO: 2514366 - protein, 20 aa, Entamoeba dispar
KRSKITLPFFNVIRISTEKE

SEQ ID NO: 2514367 - protein, 21 aa, Entamoeba dispar
KRSKLVFCVPGAFIISNPQGV

SEQ ID NO: 2514368 - protein, 23 aa, Entamoeba dispar
KRSQIPLQLAWAISIHKSQGMTL

SEQ ID NO: 2514369 - protein, 17 aa, Entamoeba dispar
KRTSYIITFLFYNKEII

SEQ ID NO: 2514370 - protein, 17 aa, Entamoeba dispar
KRVAIDISEIIIRCMKK

SEQ ID NO: 2514371 - protein, 20 aa, Entamoeba dispar
KRVHLEWEELLGLLEEFAAF

SEQ ID NO: 2514372 - protein, 18 aa, Entamoeba dispar
KRVIPFLTFYSSRGKVTQ

SEQ ID NO: 2514373 - protein, 19 aa, Entamoeba dispar
KRVRKCLTITFLSIDTLVH

SEQ ID NO: 2514374 - protein, 17 aa, Entamoeba dispar
KRVVLVHCECGVSRSAS

SEQ ID NO: 2514375 - protein, 18 aa, Entamoeba dispar
KRWFQTTPRNPFRLDYYT

SEQ ID NO: 2514376 - protein, 17 aa, Entamoeba dispar
KRYCIILENGLKALGFN

SEQ ID NO: 2514377 - protein, 20 aa, Entamoeba dispar
KRYDEILAQIVYFIISYNFN

SEQ ID NO: 2514378 - protein, 17 aa, Entamoeba dispar
KRYDLILERVIKKDMDI

SEQ ID NO: 2514379 - protein, 20 aa, Entamoeba dispar
KRYLCAASFNALIQKVEKSA

SEQ ID NO: 2514380 - protein, 19 aa, Entamoeba dispar
KSCACPKCKVCGEAIEGKI

SEQ ID NO: 2514381 - protein, 20 aa, Entamoeba dispar
KSCFFNCGCEFELKRNIQIP

SEQ ID NO: 2514382 - protein, 21 aa, Entamoeba dispar
KSCGIPNFWIEVFNEVGLIGN

SEQ ID NO: 2514383 - protein, 21 aa, Entamoeba dispar
KSDEGRSWFNYKGNNIIVIDL

SEQ ID NO: 2514384 - protein, 18 aa, Entamoeba dispar
KSDGGWGCTIRACQMLLA

SEQ ID NO: 2514385 - protein, 22 aa, Entamoeba dispar
KSDIWACGIMFYEMILRRSPFD

SEQ ID NO: 2514386 - protein, 25 aa, Entamoeba dispar
KSDKSLQHAISWLFLNMCRGTIINY

SEQ ID NO: 2514387 - protein, 20 aa, Entamoeba dispar
KSDLYSVGVMLFRMVCGCFP

SEQ ID NO: 2514388 - protein, 21 aa, Entamoeba dispar
KSDMNDLCWFLPQIAIATNSG

SEQ ID NO: 2514389 - protein, 18 aa, Entamoeba dispar
KSEMTGIIFPSQRMRGGP

SEQ ID NO: 2514390 - protein, 20 aa, Entamoeba dispar
KSFEFGWEWMIEKLLQENII

SEQ ID NO: 2514391 - protein, 17 aa, Entamoeba dispar
KSFKARPIITHADGTKQ

SEQ ID NO: 2514392 - protein, 20 aa, Entamoeba dispar
KSFYKGCLMGGVHGGIYNIC

SEQ ID NO: 2514393 - protein, 22 aa, Entamoeba dispar
KSGCGKTSLAQRFFSNKLQVGE

SEQ ID NO: 2514394 - protein, 20 aa, Entamoeba dispar
KSGGMLGFFAMDNLNAITSL

SEQ ID NO: 2514395 - protein, 17 aa, Entamoeba dispar
KSGSYLLSCIEILIECF

SEQ ID NO: 2514396 - protein, 18 aa, Entamoeba dispar
KSGSYLLSCIEILIKCFK

SEQ ID NO: 2514397 - protein, 24 aa, Entamoeba dispar
KSILRRLPHVFFYKRILSDNDKHF

SEQ ID NO: 2514398 - protein, 21 aa, Entamoeba dispar
KSIRIPNCYEIILKNKRYSFV

SEQ ID NO: 2514399 - protein, 17 aa, Entamoeba dispar
KSIRNVCRFCDDNKVNI

SEQ ID NO: 2514400 - protein, 18 aa, Entamoeba dispar
KSIRTCPHAFLCCIKNLN

SEQ ID NO: 2514401 - protein, 20 aa, Entamoeba dispar
KSKSSLKRKSLSLMKKSSIS

SEQ ID NO: 2514402 - protein, 18 aa, Entamoeba dispar
KSLCFEVVYDKQFVFFCK

SEQ ID NO: 2514403 - protein, 20 aa, Entamoeba dispar
KSLGEYCFYGLKSINIPSTI

SEQ ID NO: 2514404 - protein, 17 aa, Entamoeba dispar
KSLGWMAPLYKEYPGGE

SEQ ID NO: 2514405 - protein, 18 aa, Entamoeba dispar
KSLGYTFLPIITKNEIKE

SEQ ID NO: 2514406 - protein, 21 aa, Entamoeba dispar
KSLKTFQCMRCMKLTKIELPI

SEQ ID NO: 2514407 - protein, 21 aa, Entamoeba dispar
KSLKTFQCMRCMKLTKTELPI

SEQ ID NO: 2514408 - protein, 18 aa, Entamoeba dispar
KSLWLIALRNAFVRFNIA

SEQ ID NO: 2514409 - protein, 17 aa, Entamoeba dispar
KSLYPSIIMEFGVCFLN

SEQ ID NO: 2514410 - protein, 17 aa, Entamoeba dispar
KSMEVYGGVLSVEAFNH

SEQ ID NO: 2514411 - protein, 20 aa, Entamoeba dispar
KSMFCFNALYTIWGMSKETI

SEQ ID NO: 2514412 - protein, 21 aa, Entamoeba dispar
KSNCFRHCNKLAFIELPSRLE

SEQ ID NO: 2514413 - protein, 19 aa, Entamoeba dispar
KSNVCLLLFNENLFITETI

SEQ ID NO: 2514414 - protein, 25 aa, Entamoeba dispar
KSPIPIRLPYSMAIKLFPLPTELHN

SEQ ID NO: 2514415 - protein, 27 aa, Entamoeba dispar
KSPIYQHGCSWAWKLMDGNAPLSFNEY

SEQ ID NO: 2514416 - protein, 17 aa, Entamoeba dispar
KSPRIAIDIEENKPNQK

SEQ ID NO: 2514417 - protein, 25 aa, Entamoeba dispar
KSRLVFAEICWKKPHLLLLDEPTNH

SEQ ID NO: 2514418 - protein, 19 aa, Entamoeba dispar
KSTILEIGYFYTITLEEIC

SEQ ID NO: 2514419 - protein, 18 aa, Entamoeba dispar
KSVEELRSTFGITNDFTK

SEQ ID NO: 2514420 - protein, 21 aa, Entamoeba dispar
KSVNEALRFLGYTTVSQLILL

SEQ ID NO: 2514421 - protein, 21 aa, Entamoeba dispar
KSVRCHPCLPFTIVLQQKSTK

SEQ ID NO: 2514422 - protein, 18 aa, Entamoeba dispar
KSVSPAFCELLKKKRSCS

SEQ ID NO: 2514423 - protein, 18 aa, Entamoeba dispar
KSVVAKIVCYGRYCMERN

SEQ ID NO: 2514424 - protein, 24 aa, Entamoeba dispar
KSWIKRLNIVISFLRDMRLIQRDI

SEQ ID NO: 2514425 - protein, 19 aa, Entamoeba dispar
KSWKKRWFVFTTDGNISYY

SEQ ID NO: 2514426 - protein, 18 aa, Entamoeba dispar
KSYIGIGTINGFYVFDIN

SEQ ID NO: 2514427 - protein, 20 aa, Entamoeba dispar
KSYKKMLVCNDIIFIVVDNS

SEQ ID NO: 2514428 - protein, 22 aa, Entamoeba dispar
KSYLPRKVRLHSLHHKKVQHEE

SEQ ID NO: 2514429 - protein, 25 aa, Entamoeba dispar
KTCLCSVCGGVMCLSSLQNKWSCFC

SEQ ID NO: 2514430 - protein, 22 aa, Entamoeba dispar
KTCPDCLQLGIPCEKHNDSYFP

SEQ ID NO: 2514431 - protein, 20 aa, Entamoeba dispar
KTDIWCCGVMLFYMSTGMFP

SEQ ID NO: 2514432 - protein, 20 aa, Entamoeba dispar
KTGICFKHEFFVRDAPEFLD

SEQ ID NO: 2514433 - protein, 17 aa, Entamoeba dispar
KTGIQFKTYFIHFTGDF

SEQ ID NO: 2514434 - protein, 23 aa, Entamoeba dispar
KTIAEVFYSLGFDGYYDTQDPSF

SEQ ID NO: 2514435 - protein, 17 aa, Entamoeba dispar
KTIMIPPGITIVQAVSV

SEQ ID NO: 2514436 - protein, 17 aa, Entamoeba dispar
KTISWMPLCLNDFNEKA

SEQ ID NO: 2514437 - protein, 20 aa, Entamoeba dispar
KTKGRYTIRVSYIQIEDKKI

SEQ ID NO: 2514438 - protein, 20 aa, Entamoeba dispar
KTKRIVSVPKKWSIKKSINC

SEQ ID NO: 2514439 - protein, 19 aa, Entamoeba dispar
KTKRVCILYPSFSDIYYVF

SEQ ID NO: 2514440 - protein, 17 aa, Entamoeba dispar
KTLFALPSLPLVIPYLT

SEQ ID NO: 2514441 - protein, 17 aa, Entamoeba dispar
KTLKAKLLISITSTQGV

SEQ ID NO: 2514442 - protein, 23 aa, Entamoeba dispar
KTLLNDVPVCFVLNKADLSSQMN

SEQ ID NO: 2514443 - protein, 18 aa, Entamoeba dispar
KTLLPWSCFVKVAHDMKL

SEQ ID NO: 2514444 - protein, 19 aa, Entamoeba dispar
KTLPFGLLVLRFDKPDIQI

SEQ ID NO: 2514445 - protein, 19 aa, Entamoeba dispar
KTLQCYDLSPAVMTTTLYQ

SEQ ID NO: 2514446 - protein, 20 aa, Entamoeba dispar
KTLQLYSCDELLSIKKIEKL

SEQ ID NO: 2514447 - protein, 17 aa, Entamoeba dispar
KTLRVSFVLSFTFKQNP

SEQ ID NO: 2514448 - protein, 17 aa, Entamoeba dispar
KTMKFRIPHSMELNDMK

SEQ ID NO: 2514449 - protein, 17 aa, Entamoeba dispar
KTMLCNLLFEYLDYYTP

SEQ ID NO: 2514450 - protein, 20 aa, Entamoeba dispar
KTMLCNLLFEYLDYYTPIAY

SEQ ID NO: 2514451 - protein, 23 aa, Entamoeba dispar
KTQCPSYEGILFPQILNSKQFPN

SEQ ID NO: 2514452 - protein, 20 aa, Entamoeba dispar
KTQEAWKMARIVVKYEGIMC

SEQ ID NO: 2514453 - protein, 18 aa, Entamoeba dispar
KTQIATIIIFKGYSKENF

SEQ ID NO: 2514454 - protein, 19 aa, Entamoeba dispar
KTRMLEPLLTFAQTQQQLS

SEQ ID NO: 2514455 - protein, 17 aa, Entamoeba dispar
KTSIALLLDYAVQNHEI

SEQ ID NO: 2514456 - protein, 18 aa, Entamoeba dispar
KTSLTRRFIGEEFKEEVE

SEQ ID NO: 2514457 - protein, 19 aa, Entamoeba dispar
KTSLWIVCELFRIIVSSNL

SEQ ID NO: 2514458 - protein, 20 aa, Entamoeba dispar
KTSSIYIRYCFNIYNELSSY

SEQ ID NO: 2514459 - protein, 17 aa, Entamoeba dispar
KTTFCFIQTIGIQCLQF

SEQ ID NO: 2514460 - protein, 19 aa, Entamoeba dispar
KTTIIVNLHIWKALNPSFK

SEQ ID NO: 2514461 - protein, 18 aa, Entamoeba dispar
KTTIIVNMHIWKGLNASF

SEQ ID NO: 2514462 - protein, 23 aa, Entamoeba dispar
KTVGFKMGIDLAFNTNFHLLCVE

SEQ ID NO: 2514463 - protein, 19 aa, Entamoeba dispar
KTYLVYGHMRWYDDTNMLG

SEQ ID NO: 2514464 - protein, 23 aa, Entamoeba dispar
KVCFKCGKPGHIGRDCPQPDDRV

SEQ ID NO: 2514465 - protein, 18 aa, Entamoeba dispar
KVEPCKKSNCSISLDVEE

SEQ ID NO: 2514466 - protein, 18 aa, Entamoeba dispar
KVFCRLFKYISAIIQNIL

SEQ ID NO: 2514467 - protein, 18 aa, Entamoeba dispar
KVGNTWRVEGVIALSRSL

SEQ ID NO: 2514468 - protein, 23 aa, Entamoeba dispar
KVGPCLDCIISLFPPQKTFPMCT

SEQ ID NO: 2514469 - protein, 20 aa, Entamoeba dispar
KVIIEFISWIFGEVKSMDEG

SEQ ID NO: 2514470 - protein, 22 aa, Entamoeba dispar
KVIPDRRAVLLAGAPGVGKTTV

SEQ ID NO: 2514471 - protein, 20 aa, Entamoeba dispar
KVIPKREEKILCKIFPLYFS

SEQ ID NO: 2514472 - protein, 23 aa, Entamoeba dispar
KVIPNCIGNIWVYVRDWPEEKGR

SEQ ID NO: 2514473 - protein, 17 aa, Entamoeba dispar
KVIWYKVDYSIYLKDER

SEQ ID NO: 2514474 - protein, 18 aa, Entamoeba dispar
KVKKWKDGIAIYYKDNKK

SEQ ID NO: 2514475 - protein, 18 aa, Entamoeba dispar
KVKTVEGYYRYKKQEQDD

SEQ ID NO: 2514476 - protein, 23 aa, Entamoeba dispar
KVLRIGMRPLKVIPLKSLSPIER

SEQ ID NO: 2514477 - protein, 21 aa, Entamoeba dispar
KVMNFVRIWIKNAWRDFEGQT

SEQ ID NO: 2514478 - protein, 19 aa, Entamoeba dispar
KVNMCALNIKMGYENLYEF

SEQ ID NO: 2514479 - protein, 17 aa, Entamoeba dispar
KVPEIKKLIQFGNGFGN

SEQ ID NO: 2514480 - protein, 19 aa, Entamoeba dispar
KVRCAKYLYTYICADKAKA

SEQ ID NO: 2514481 - protein, 19 aa, Entamoeba dispar
KVREFRTAIQFVNSTLTRN

SEQ ID NO: 2514482 - protein, 18 aa, Entamoeba dispar
KVRSGKIWSEYIDKVITK

SEQ ID NO: 2514483 - protein, 20 aa, Entamoeba dispar
KVSRERLLSFMFKRKTNEKT

SEQ ID NO: 2514484 - protein, 23 aa, Entamoeba dispar
KVVDCFKRFIPYLKVYKMFIGNN

SEQ ID NO: 2514485 - protein, 18 aa, Entamoeba dispar
KVVKEYLNGLGLTYETKL

SEQ ID NO: 2514486 - protein, 22 aa, Entamoeba dispar
KVYEIRSSYKFAEKSIDTDFKE

SEQ ID NO: 2514487 - protein, 20 aa, Entamoeba dispar
KWATVCYKAALEFVGNSSIQ

SEQ ID NO: 2514488 - protein, 18 aa, Entamoeba dispar
KWILSEDWIEAIIKNNAI

SEQ ID NO: 2514489 - protein, 18 aa, Entamoeba dispar
KWKGLSYLHIEWISEEQF

SEQ ID NO: 2514490 - protein, 19 aa, Entamoeba dispar
KWLLPYIVYKCCGMNGVPT

SEQ ID NO: 2514491 - protein, 23 aa, Entamoeba dispar
KWMAFECITRMVGFYDLDRKDLD

SEQ ID NO: 2514492 - protein, 18 aa, Entamoeba dispar
KWRHCFIDGISLKDRLQE

SEQ ID NO: 2514493 - protein, 19 aa, Entamoeba dispar
KYAKEFTRFFSYSKKKPNF

SEQ ID NO: 2514494 - protein, 18 aa, Entamoeba dispar
KYATRFNILFPPQSSKQL

SEQ ID NO: 2514495 - protein, 20 aa, Entamoeba dispar
KYFFCFRFIKTPDLIELHWS

SEQ ID NO: 2514496 - protein, 24 aa, Entamoeba dispar
KYFKLSGLLPICYFLEKKDYTSEE

SEQ ID NO: 2514497 - protein, 18 aa, Entamoeba dispar
KYIAWCLNPPCGKSKSAH

SEQ ID NO: 2514498 - protein, 20 aa, Entamoeba dispar
KYKVIEGLLQFVIQTFVNKQ

SEQ ID NO: 2514499 - protein, 19 aa, Entamoeba dispar
KYLKMSIKLATRITQFIAN

SEQ ID NO: 2514500 - protein, 20 aa, Entamoeba dispar
KYLLTIQWCKPFFDNPTLKY

SEQ ID NO: 2514501 - protein, 23 aa, Entamoeba dispar
KYLNCMLEHLSLIFTQRSCSINQ

SEQ ID NO: 2514502 - protein, 20 aa, Entamoeba dispar
KYNGGYNWWKRNSLTVFINK

SEQ ID NO: 2514503 - protein, 21 aa, Entamoeba dispar
KYPELSILCVNTFYKDCRDSN

SEQ ID NO: 2514504 - protein, 17 aa, Entamoeba dispar
KYPESLISFEFITSKFV

SEQ ID NO: 2514505 - protein, 22 aa, Entamoeba dispar
KYPKLKLGITLSKYSSNQYISL

SEQ ID NO: 2514506 - protein, 18 aa, Entamoeba dispar
KYQHALSFLAEMKFISKD

SEQ ID NO: 2514507 - protein, 18 aa, Entamoeba dispar
KYQKCLCASLFFCQNRNG

SEQ ID NO: 2514508 - protein, 19 aa, Entamoeba dispar
KYQLPSCGFDWCNQNPDLL

SEQ ID NO: 2514509 - protein, 20 aa, Entamoeba dispar
KYRADFCLAATYALNGILAT

SEQ ID NO: 2514510 - protein, 21 aa, Entamoeba dispar
KYSGEIRPYFTINDPLIHSEK

SEQ ID NO: 2514511 - protein, 19 aa, Entamoeba dispar
KYWPYSLHCHRLMIYANTI

SEQ ID NO: 2514512 - protein, 18 aa, Entamoeba dispar
KYYFAVAVFDSIETANEV

SEQ ID NO: 2514513 - protein, 18 aa, Entamoeba dispar
LADGCGWGDKPSFAAKLA

SEQ ID NO: 2514514 - protein, 17 aa, Entamoeba dispar
LAEGCLLDYVQNKGGKY

SEQ ID NO: 2514515 - protein, 23 aa, Entamoeba dispar
LAFCRRYVDKIGFAKWQMPFKFL

SEQ ID NO: 2514516 - protein, 25 aa, Entamoeba dispar
LAFPERRLYYFISMCIIKEYSDIII

SEQ ID NO: 2514517 - protein, 26 aa, Entamoeba dispar
LAGGKVFYFHGWRVEGLLGVSRSIGD

SEQ ID NO: 2514518 - protein, 20 aa, Entamoeba dispar
LAGKWPFWLSPRQVMVCTVS

SEQ ID NO: 2514519 - protein, 19 aa, Entamoeba dispar
LAHKICYPERVFMLRGNHE

SEQ ID NO: 2514520 - protein, 22 aa, Entamoeba dispar
LAKSSKLLAQWIVLCPSSVIPV

SEQ ID NO: 2514521 - protein, 18 aa, Entamoeba dispar
LALEEIRKSSGLCQNYSI

SEQ ID NO: 2514522 - protein, 17 aa, Entamoeba dispar
LALHPSVVNCLTPSQRT

SEQ ID NO: 2514523 - protein, 24 aa, Entamoeba dispar
LALLTACGKIYCEVPFTETTQKVL

SEQ ID NO: 2514524 - protein, 17 aa, Entamoeba dispar
LALLWVFYIRQSFIGSY

SEQ ID NO: 2514525 - protein, 24 aa, Entamoeba dispar
LANELHCSWCLVSAKTGEGVSNAF

SEQ ID NO: 2514526 - protein, 19 aa, Entamoeba dispar
LANKKTVCFFEYEIDKLNS

SEQ ID NO: 2514527 - protein, 17 aa, Entamoeba dispar
LARRILRDMNYRGRTLD

SEQ ID NO: 2514528 - protein, 17 aa, Entamoeba dispar
LATVWGMYGIPLKSAIK

SEQ ID NO: 2514529 - protein, 22 aa, Entamoeba dispar
LAWTTLCRLVFLSIYQRSPVDF

SEQ ID NO: 2514530 - protein, 17 aa, Entamoeba dispar
LCALKVTPPNSLALRSF

SEQ ID NO: 2514531 - protein, 18 aa, Entamoeba dispar
LCCAAAMRPIRDYIAKEN

SEQ ID NO: 2514532 - protein, 25 aa, Entamoeba dispar
LCDHFKYTVPFLNYWTFDNTVFHFK

SEQ ID NO: 2514533 - protein, 17 aa, Entamoeba dispar
LCEKFFFNYQIPKQTTI

SEQ ID NO: 2514534 - protein, 21 aa, Entamoeba dispar
LCEKLRIVLEPSLASQMKGDY

SEQ ID NO: 2514535 - protein, 22 aa, Entamoeba dispar
LCFFPSYAYMNICISYWNEMKI

SEQ ID NO: 2514536 - protein, 21 aa, Entamoeba dispar
LCGVLQMIVSFAMPSFLYHIE

SEQ ID NO: 2514537 - protein, 19 aa, Entamoeba dispar
LCICILYGLINRLVKYSSI

SEQ ID NO: 2514538 - protein, 18 aa, Entamoeba dispar
LCIPEFIHFFSINVTQGH

SEQ ID NO: 2514539 - protein, 19 aa, Entamoeba dispar
LCLCPLCKHGMEVFGVKRP

SEQ ID NO: 2514540 - protein, 18 aa, Entamoeba dispar
LCSSLLQTAYCRKEKRCF

SEQ ID NO: 2514541 - protein, 17 aa, Entamoeba dispar
LCVMTGYTIGDGMRLSI

SEQ ID NO: 2514542 - protein, 23 aa, Entamoeba dispar
LCVSCSSCKRVAVSTNNLINLYD

SEQ ID NO: 2514543 - protein, 20 aa, Entamoeba dispar
LDAPPPFSLNGFSFSNSTEK

SEQ ID NO: 2514544 - protein, 18 aa, Entamoeba dispar
LDCLKPVYTPLLSETMFD

SEQ ID NO: 2514545 - protein, 19 aa, Entamoeba dispar
LDDTEYWLKEQAVISLNRL

SEQ ID NO: 2514546 - protein, 19 aa, Entamoeba dispar
LDEFLQWGFVEKISVSNVR

SEQ ID NO: 2514547 - protein, 21 aa, Entamoeba dispar
LDETLRLVVFLNNISAEYKKY

SEQ ID NO: 2514548 - protein, 20 aa, Entamoeba dispar
LDFPRAFLIMELCDGGDLDT

SEQ ID NO: 2514549 - protein, 19 aa, Entamoeba dispar
LDGCFTCIELPTSLTSLKF

SEQ ID NO: 2514550 - protein, 18 aa, Entamoeba dispar
LDIDGTVCVLEILDTAGQ

SEQ ID NO: 2514551 - protein, 18 aa, Entamoeba dispar
LDIILSFCLCINVTIDQN

SEQ ID NO: 2514552 - protein, 22 aa, Entamoeba dispar
LDKLRISFRLKIIVSDVNSFLR

SEQ ID NO: 2514553 - protein, 19 aa, Entamoeba dispar
LDLLKLRYGKELTQDDIQL

SEQ ID NO: 2514554 - protein, 17 aa, Entamoeba dispar
LDLLRAMLNIKEFLNPP

SEQ ID NO: 2514555 - protein, 17 aa, Entamoeba dispar
LDLTRFVKHYDPTTPPI

SEQ ID NO: 2514556 - protein, 18 aa, Entamoeba dispar
LDNIITMEAVIRGFLIRR

SEQ ID NO: 2514557 - protein, 18 aa, Entamoeba dispar
LDQWILHRLNVMITLVHQ

SEQ ID NO: 2514558 - protein, 22 aa, Entamoeba dispar
LDRNEFLLALALLKNQKAGFPV

SEQ ID NO: 2514559 - protein, 18 aa, Entamoeba dispar
LDSLKLYLNQVMYNMGIS

SEQ ID NO: 2514560 - protein, 20 aa, Entamoeba dispar
LDVIEIFKIASLTGLGGISN

SEQ ID NO: 2514561 - protein, 18 aa, Entamoeba dispar
LEAFILMIYRMIDLYSNQ

SEQ ID NO: 2514562 - protein, 18 aa, Entamoeba dispar
LEAFKLLLPQSMPIVQLP

SEQ ID NO: 2514563 - protein, 17 aa, Entamoeba dispar
LEEGRWYPDTGFDENEN

SEQ ID NO: 2514564 - protein, 17 aa, Entamoeba dispar
LEFYQWFASMVEQYSDF

SEQ ID NO: 2514565 - protein, 20 aa, Entamoeba dispar
LEGFLPIVYERKVFGVPMLI

SEQ ID NO: 2514566 - protein, 18 aa, Entamoeba dispar
LEGLLAYFGSVPPVRKNS

SEQ ID NO: 2514567 - protein, 17 aa, Entamoeba dispar
LEHCVRILQDLVISIKD

SEQ ID NO: 2514568 - protein, 22 aa, Entamoeba dispar
LEIDPALLLKHAQRVMVDEPEE

SEQ ID NO: 2514569 - protein, 18 aa, Entamoeba dispar
LEISCLQQGFGYEVFDEG

SEQ ID NO: 2514570 - protein, 21 aa, Entamoeba dispar
LEIWKRTKSILSFKSPLKLRK

SEQ ID NO: 2514571 - protein, 24 aa, Entamoeba dispar
LEKEEFINCFPLRVKALQLINSVM

SEQ ID NO: 2514572 - protein, 23 aa, Entamoeba dispar
LELFLKSTCRVLGLNWDEMKQFF

SEQ ID NO: 2514573 - protein, 19 aa, Entamoeba dispar
LELFTQGNFEWKEKVVVVG

SEQ ID NO: 2514574 - protein, 17 aa, Entamoeba dispar
LELHFVYFHAIETQEIV

SEQ ID NO: 2514575 - protein, 18 aa, Entamoeba dispar
LELLSGKVPIYCSGGITG

SEQ ID NO: 2514576 - protein, 17 aa, Entamoeba dispar
LELMYKYHHELMYIYTY

SEQ ID NO: 2514577 - protein, 20 aa, Entamoeba dispar
LELPRPLLTPGYEAVIHIHT

SEQ ID NO: 2514578 - protein, 17 aa, Entamoeba dispar
LELRLGKMNGLSQSEDI

SEQ ID NO: 2514579 - protein, 19 aa, Entamoeba dispar
LELYGRFYPIIPLKFTEGE

SEQ ID NO: 2514580 - protein, 19 aa, Entamoeba dispar
LEMTFRVLFDGTKVTDAIL

SEQ ID NO: 2514581 - protein, 22 aa, Entamoeba dispar
LEMWTCTEGFHLKKEFDSLKTV

SEQ ID NO: 2514582 - protein, 22 aa, Entamoeba dispar
LENRLSIKILFLIIYQLIQENL

SEQ ID NO: 2514583 - protein, 17 aa, Entamoeba dispar
LEPKEWLNISLIILSNI

SEQ ID NO: 2514584 - protein, 18 aa, Entamoeba dispar
LEPLIPFNLYEQFIQLPK

SEQ ID NO: 2514585 - protein, 19 aa, Entamoeba dispar
LERIFSLYLPMLFGYQIYI

SEQ ID NO: 2514586 - protein, 17 aa, Entamoeba dispar
LESCGDCFGRVTMNKKA

SEQ ID NO: 2514587 - protein, 19 aa, Entamoeba dispar
LESCLWIFINITSMSDVYV

SEQ ID NO: 2514588 - protein, 23 aa, Entamoeba dispar
LESKSSFKKLCFNLQSKISVGHA

SEQ ID NO: 2514589 - protein, 19 aa, Entamoeba dispar
LESSLSFNLNDSFFLFGEN

SEQ ID NO: 2514590 - protein, 18 aa, Entamoeba dispar
LETCCVYAEYILMLHEQP

SEQ ID NO: 2514591 - protein, 17 aa, Entamoeba dispar
LETVPFDVCVTDPDDEE

SEQ ID NO: 2514592 - protein, 19 aa, Entamoeba dispar
LEVFIRFFPIIPLKNTKTQ

SEQ ID NO: 2514593 - protein, 21 aa, Entamoeba dispar
LEVIRRACDVLGSGIEESSIN

SEQ ID NO: 2514594 - protein, 19 aa, Entamoeba dispar
LEVRLALLTACGKIYCEVP

SEQ ID NO: 2514595 - protein, 17 aa, Entamoeba dispar
LEYICSFLIKIILEEKK

SEQ ID NO: 2514596 - protein, 18 aa, Entamoeba dispar
LFALTCWRRIVWHCVLPL

SEQ ID NO: 2514597 - protein, 18 aa, Entamoeba dispar
LFANFSFDGLKGSENKED

SEQ ID NO: 2514598 - protein, 22 aa, Entamoeba dispar
LFCTICSIIPFPSIQNIFDQSY

SEQ ID NO: 2514599 - protein, 22 aa, Entamoeba dispar
LFCVICGCPLLLDEGIRSMTTQ

SEQ ID NO: 2514600 - protein, 19 aa, Entamoeba dispar
LFCYRDLYEAQEFILKYGK

SEQ ID NO: 2514601 - protein, 18 aa, Entamoeba dispar
LFDEVYKIFSQVEKKVGA

SEQ ID NO: 2514602 - protein, 19 aa, Entamoeba dispar
LFDLCYLPVIGNPGEDSYQ

SEQ ID NO: 2514603 - protein, 24 aa, Entamoeba dispar
LFDLFGGLCLKCLDSVKYFETICA

SEQ ID NO: 2514604 - protein, 17 aa, Entamoeba dispar
LFELCGISAMGNEEATR

SEQ ID NO: 2514605 - protein, 18 aa, Entamoeba dispar
LFEMLGHVFNYCFINYEN

SEQ ID NO: 2514606 - protein, 18 aa, Entamoeba dispar
LFFYCFNHSPSIYALQVI

SEQ ID NO: 2514607 - protein, 20 aa, Entamoeba dispar
LFHCPFCLKFTVLRNQLPEG

SEQ ID NO: 2514608 - protein, 25 aa, Entamoeba dispar
LFIACSYIGARICSLYESLGKEAVK

SEQ ID NO: 2514609 - protein, 25 aa, Entamoeba dispar
LFIDSRLKYYLSFLPENIKKVSFVG

SEQ ID NO: 2514610 - protein, 19 aa, Entamoeba dispar
LFIKILSFFVKEWRYRNKN

SEQ ID NO: 2514611 - protein, 23 aa, Entamoeba dispar
LFIRKCKYCKLPAISFETLNLLI

SEQ ID NO: 2514612 - protein, 25 aa, Entamoeba dispar
LFIRYCSFIRKWLKWNIVKENDDNS

SEQ ID NO: 2514613 - protein, 21 aa, Entamoeba dispar
LFKKACWTIEINNHFYVTLKE

SEQ ID NO: 2514614 - protein, 25 aa, Entamoeba dispar
LFKKLPIKIPIYFINFLKKRFNDVQ

SEQ ID NO: 2514615 - protein, 17 aa, Entamoeba dispar
LFKLRLKVLVAQNGQQA

SEQ ID NO: 2514616 - protein, 20 aa, Entamoeba dispar
LFKPNCKILIAFSKSDLPNS

SEQ ID NO: 2514617 - protein, 25 aa, Entamoeba dispar
LFKRCIWRYPPQYFYLLLNPRFVAQ

SEQ ID NO: 2514618 - protein, 18 aa, Entamoeba dispar
LFKSIPIAPLLVSNKKEK

SEQ ID NO: 2514619 - protein, 19 aa, Entamoeba dispar
LFKVLKMIIGSSFTDEQLQ

SEQ ID NO: 2514620 - protein, 18 aa, Entamoeba dispar
LFLFPFKKPKNMYELQLT

SEQ ID NO: 2514621 - protein, 18 aa, Entamoeba dispar
LFLKEIYGNVVLELGQEK

SEQ ID NO: 2514622 - protein, 17 aa, Entamoeba dispar
LFLPLSVPKYAVIESTE

SEQ ID NO: 2514623 - protein, 17 aa, Entamoeba dispar
LFLPSFNLRSYLSLEEE

SEQ ID NO: 2514624 - protein, 18 aa, Entamoeba dispar
LFLQNGMFKEFFEKHPEM

SEQ ID NO: 2514625 - protein, 18 aa, Entamoeba dispar
LFMLSKWMSSFPHDFMDG

SEQ ID NO: 2514626 - protein, 20 aa, Entamoeba dispar
LFNFNKLRIMHKVVMDIINY

SEQ ID NO: 2514627 - protein, 19 aa, Entamoeba dispar
LFNTSFKRMWDFKILTSFN

SEQ ID NO: 2514628 - protein, 18 aa, Entamoeba dispar
LFPDLGMKFIESRYDQIM

SEQ ID NO: 2514629 - protein, 23 aa, Entamoeba dispar
LFPQSFIQFLAWQRLMQIYSKLD

SEQ ID NO: 2514630 - protein, 21 aa, Entamoeba dispar
LFPRVTPKLVVTIKRFLPNIR

SEQ ID NO: 2514631 - protein, 18 aa, Entamoeba dispar
LFPSITFYQSECDVNPLV

SEQ ID NO: 2514632 - protein, 17 aa, Entamoeba dispar
LFPWREEMEEIQLIRKW

SEQ ID NO: 2514633 - protein, 25 aa, Entamoeba dispar
LFQLECFTFKIVYNFVNLDEIEDKI

SEQ ID NO: 2514634 - protein, 17 aa, Entamoeba dispar
LFRKDFLALDWQEKIKT

SEQ ID NO: 2514635 - protein, 18 aa, Entamoeba dispar
LFSLLLHEVMLEFNMSWN

SEQ ID NO: 2514636 - protein, 18 aa, Entamoeba dispar
LFTGCCYPDCFCVDKLFV

SEQ ID NO: 2514637 - protein, 17 aa, Entamoeba dispar
LFTSFILKWKYNKINED

SEQ ID NO: 2514638 - protein, 19 aa, Entamoeba dispar
LFVMVCGYPPFSRINNQYT

SEQ ID NO: 2514639 - protein, 17 aa, Entamoeba dispar
LFVSQLFCFYISYEDPI

SEQ ID NO: 2514640 - protein, 18 aa, Entamoeba dispar
LFYLRILMERCKPIEKKL

SEQ ID NO: 2514641 - protein, 17 aa, Entamoeba dispar
LGAGVYRLSLSIHESLK

SEQ ID NO: 2514642 - protein, 18 aa, Entamoeba dispar
LGANLRWASCNIFSTQDH

SEQ ID NO: 2514643 - protein, 29 aa, Entamoeba dispar
LGAPLPIEFKWKIPITKKKTGLFSIIETT

SEQ ID NO: 2514644 - protein, 18 aa, Entamoeba dispar
LGCVLAYLFLENSLFDVS

SEQ ID NO: 2514645 - protein, 18 aa, Entamoeba dispar
LGDLKCHPALTCEPEVLT

SEQ ID NO: 2514646 - protein, 18 aa, Entamoeba dispar
LGDTCGRDLSFLYKVHVL

SEQ ID NO: 2514647 - protein, 18 aa, Entamoeba dispar
LGDWCFKGCYSLTSINIP

SEQ ID NO: 2514648 - protein, 21 aa, Entamoeba dispar
LGFGVCKCIEFLKTHGGVDDG

SEQ ID NO: 2514649 - protein, 17 aa, Entamoeba dispar
LGFKENLPILATHLSLR

SEQ ID NO: 2514650 - protein, 19 aa, Entamoeba dispar
LGGHCFYRCRSLTSINIPT

SEQ ID NO: 2514651 - protein, 20 aa, Entamoeba dispar
LGGVCIIGFVRKEIENKIKY

SEQ ID NO: 2514652 - protein, 25 aa, Entamoeba dispar
LGGVYFRLAIPILFNRNIFNNPNYI

SEQ ID NO: 2514653 - protein, 19 aa, Entamoeba dispar
LGHDFCLKHLLNLPGNFTA

SEQ ID NO: 2514654 - protein, 19 aa, Entamoeba dispar
LGKFNEIFLLNSWFSSNPN

SEQ ID NO: 2514655 - protein, 17 aa, Entamoeba dispar
LGKLCFRECSSLKSINI

SEQ ID NO: 2514656 - protein, 23 aa, Entamoeba dispar
LGLGCALDLLKRIDIDFKLNGCR

SEQ ID NO: 2514657 - protein, 19 aa, Entamoeba dispar
LGLIVFRIDIHISKRDIRG

SEQ ID NO: 2514658 - protein, 18 aa, Entamoeba dispar
LGLLEIIGSLSLSDIPYP

SEQ ID NO: 2514659 - protein, 22 aa, Entamoeba dispar
LGNCAICSFNLGKKEIGIKLAE

SEQ ID NO: 2514660 - protein, 18 aa, Entamoeba dispar
LGNKCQIELFSVDHPFIP

SEQ ID NO: 2514661 - protein, 18 aa, Entamoeba dispar
LGNLKWIVVGKLFGLRTI

SEQ ID NO: 2514662 - protein, 20 aa, Entamoeba dispar
LGNYCFRYCLSLRSINIPSS

SEQ ID NO: 2514663 - protein, 19 aa, Entamoeba dispar
LGTTFSCMAVWKENSKRVE

SEQ ID NO: 2514664 - protein, 17 aa, Entamoeba dispar
LGVEITWKYQVQQENLI

SEQ ID NO: 2514665 - protein, 17 aa, Entamoeba dispar
LGVLIFVLFCNRFPFPP

SEQ ID NO: 2514666 - protein, 20 aa, Entamoeba dispar
LGWYCFKGCYSLMSINIPSS

SEQ ID NO: 2514667 - protein, 17 aa, Entamoeba dispar
LGYKCFKECYSLKSINI

SEQ ID NO: 2514668 - protein, 18 aa, Entamoeba dispar
LGYKCFKECYSLKSINIP

SEQ ID NO: 2514669 - protein, 19 aa, Entamoeba dispar
LGYWCFYKCLSLTTINIPS

SEQ ID NO: 2514670 - protein, 17 aa, Entamoeba dispar
LGYWCFYKCVSLTTINI

SEQ ID NO: 2514671 - protein, 18 aa, Entamoeba dispar
LHCHILRGYLQITLKVEG

SEQ ID NO: 2514672 - protein, 19 aa, Entamoeba dispar
LHCHILRGYLQITLKVEGF

SEQ ID NO: 2514673 - protein, 17 aa, Entamoeba dispar
LHKEFGVLVIVTLGDKG

SEQ ID NO: 2514674 - protein, 17 aa, Entamoeba dispar
LHMYGCRVVQKAIEFVD

SEQ ID NO: 2514675 - protein, 17 aa, Entamoeba dispar
LHPEIKPVISINGELLE

SEQ ID NO: 2514676 - protein, 18 aa, Entamoeba dispar
LHRMEARMLKAFSEVEKK

SEQ ID NO: 2514677 - protein, 17 aa, Entamoeba dispar
LHYCARYGRALICREIL

SEQ ID NO: 2514678 - protein, 17 aa, Entamoeba dispar
LHYCCVYGMVHLIDDII

SEQ ID NO: 2514679 - protein, 23 aa, Entamoeba dispar
LHYFEMVNWLLAKGAYVNAADKF

SEQ ID NO: 2514680 - protein, 20 aa, Entamoeba dispar
LIASCGIDWVKSRILPSVIS

SEQ ID NO: 2514681 - protein, 17 aa, Entamoeba dispar
LICKSCYNLGTFLNLNI

SEQ ID NO: 2514682 - protein, 17 aa, Entamoeba dispar
LIDLCRYAFLSMDNNQD

SEQ ID NO: 2514683 - protein, 21 aa, Entamoeba dispar
LIECYPLRVGHGIFLNKKAIE

SEQ ID NO: 2514684 - protein, 20 aa, Entamoeba dispar
LIEIKLSFILLTLKNLNIKK

SEQ ID NO: 2514685 - protein, 17 aa, Entamoeba dispar
LIELISIINEFQKSIEE

SEQ ID NO: 2514686 - protein, 17 aa, Entamoeba dispar
LIESCARCVAKHLVGKS

SEQ ID NO: 2514687 - protein, 17 aa, Entamoeba dispar
LIFKEYFHDLAVKDDIV

SEQ ID NO: 2514688 - protein, 26 aa, Entamoeba dispar
LIFKLLTGFCPFELIQMDPFTAIHVQ

SEQ ID NO: 2514689 - protein, 18 aa, Entamoeba dispar
LIGSCFSLPLSHSILTQR

SEQ ID NO: 2514690 - protein, 19 aa, Entamoeba dispar
LIHPKRYECVLSNASTFSE

SEQ ID NO: 2514691 - protein, 23 aa, Entamoeba dispar
LIICRRGSYIFGVFVAESFEMKK

SEQ ID NO: 2514692 - protein, 28 aa, Entamoeba dispar
LIIRSKFLRRRFCTFVIMKLGGLCTVED

SEQ ID NO: 2514693 - protein, 19 aa, Entamoeba dispar
LIKEFIKLLFINTALHSEE

SEQ ID NO: 2514694 - protein, 25 aa, Entamoeba dispar
LILKEYYFACAVCLVMYKQHQLAIE

SEQ ID NO: 2514695 - protein, 17 aa, Entamoeba dispar
LILNVLIEILCKGDGRE

SEQ ID NO: 2514696 - protein, 18 aa, Entamoeba dispar
LIMRIPLKLGGGMKEQIT

SEQ ID NO: 2514697 - protein, 21 aa, Entamoeba dispar
LINRGDYSLAMIMNEKINCNE

SEQ ID NO: 2514698 - protein, 18 aa, Entamoeba dispar
LINTKLVFYDRFVKPINK

SEQ ID NO: 2514699 - protein, 17 aa, Entamoeba dispar
LIPVFGFGDSKTQDDTV

SEQ ID NO: 2514700 - protein, 20 aa, Entamoeba dispar
LIRFFSQIWICYQPTEIELW

SEQ ID NO: 2514701 - protein, 17 aa, Entamoeba dispar
LISFEFITSKFVADLTD

SEQ ID NO: 2514702 - protein, 18 aa, Entamoeba dispar
LISYYNTRIEVLKTNIEM

SEQ ID NO: 2514703 - protein, 20 aa, Entamoeba dispar
LIVCFLLRYEIFEPYHAFFI

SEQ ID NO: 2514704 - protein, 17 aa, Entamoeba dispar
LIVTLGFDKVNSVLEIN

SEQ ID NO: 2514705 - protein, 19 aa, Entamoeba dispar
LKAICTLGRALGKATKLEN

SEQ ID NO: 2514706 - protein, 21 aa, Entamoeba dispar
LKAIKTAVDFARLGEVKMLES

SEQ ID NO: 2514707 - protein, 17 aa, Entamoeba dispar
LKCCGGFFASPYNTLEY

SEQ ID NO: 2514708 - protein, 26 aa, Entamoeba dispar
LKDIRLRPRYLMKFLDTDGDWVTLID

SEQ ID NO: 2514709 - protein, 20 aa, Entamoeba dispar
LKDIWKHVCIVWTKCYNYSQ

SEQ ID NO: 2514710 - protein, 22 aa, Entamoeba dispar
LKDNDCYLCLKGVNHFATMAPM

SEQ ID NO: 2514711 - protein, 21 aa, Entamoeba dispar
LKDSFNVIAPIRMKKVAEMIS

SEQ ID NO: 2514712 - protein, 17 aa, Entamoeba dispar
LKEEIGILKSLKSSDNN

SEQ ID NO: 2514713 - protein, 22 aa, Entamoeba dispar
LKEFKFPISDCGKLEDVESVRK

SEQ ID NO: 2514714 - protein, 22 aa, Entamoeba dispar
LKEFRKLGGIIGVVSFSDEQNI

SEQ ID NO: 2514715 - protein, 26 aa, Entamoeba dispar
LKEIAQEIYIRWKVRKLLREQSYDVE

SEQ ID NO: 2514716 - protein, 19 aa, Entamoeba dispar
LKEIYRLFGELPKDITGLC

SEQ ID NO: 2514717 - protein, 18 aa, Entamoeba dispar
LKELIPVIPKKKIKNEQL

SEQ ID NO: 2514718 - protein, 18 aa, Entamoeba dispar
LKELPVCTFFNCIKLEKI

SEQ ID NO: 2514719 - protein, 17 aa, Entamoeba dispar
LKELWKREFGVFQSRNT

SEQ ID NO: 2514720 - protein, 23 aa, Entamoeba dispar
LKEMCKKCRVVIEIDTINNVKEF

SEQ ID NO: 2514721 - protein, 21 aa, Entamoeba dispar
LKENRFAVGIDNRMKDFINDL

SEQ ID NO: 2514722 - protein, 20 aa, Entamoeba dispar
LKEVVSFLVMVWTKVKPPME

SEQ ID NO: 2514723 - protein, 23 aa, Entamoeba dispar
LKFPRLVSHLFPFFNDLTHQKRS

SEQ ID NO: 2514724 - protein, 18 aa, Entamoeba dispar
LKFVDVFKLYSSFVNNYD

SEQ ID NO: 2514725 - protein, 17 aa, Entamoeba dispar
LKGIPLRNLCLLGNPLP

SEQ ID NO: 2514726 - protein, 17 aa, Entamoeba dispar
LKGVCSFLDKMIIEGKK

SEQ ID NO: 2514727 - protein, 18 aa, Entamoeba dispar
LKHIKKIIKGVCELCTSI

SEQ ID NO: 2514728 - protein, 18 aa, Entamoeba dispar
LKHLVDWKVFDKIKSTNK

SEQ ID NO: 2514729 - protein, 20 aa, Entamoeba dispar
LKIECGWVLVNALEKVDDMG

SEQ ID NO: 2514730 - protein, 17 aa, Entamoeba dispar
LKIEFSRPGGRETGFIT

SEQ ID NO: 2514731 - protein, 20 aa, Entamoeba dispar
LKIHASNIFSMFKDCPIVKK

SEQ ID NO: 2514732 - protein, 23 aa, Entamoeba dispar
LKIKDIIPLFGIGIYSEGDNAFS

SEQ ID NO: 2514733 - protein, 18 aa, Entamoeba dispar
LKILFEVICHDFIRNKEN

SEQ ID NO: 2514734 - protein, 17 aa, Entamoeba dispar
LKILPIIKKLEEEKSEW

SEQ ID NO: 2514735 - protein, 21 aa, Entamoeba dispar
LKILVRLCSLFPLIKKYVLAC

SEQ ID NO: 2514736 - protein, 18 aa, Entamoeba dispar
LKINTLWRNNLKYLEMVN

SEQ ID NO: 2514737 - protein, 18 aa, Entamoeba dispar
LKISIPFIPKRIGDVNIQ

SEQ ID NO: 2514738 - protein, 22 aa, Entamoeba dispar
LKKELKKVVGFVGVLKEHQPKE

SEQ ID NO: 2514739 - protein, 18 aa, Entamoeba dispar
LKKFWWKAMDYLSFKTLN

SEQ ID NO: 2514740 - protein, 19 aa, Entamoeba dispar
LKKKGCQIEEIFEDPHYLL

SEQ ID NO: 2514741 - protein, 17 aa, Entamoeba dispar
LKKKGYEVHSWKRRYFV

SEQ ID NO: 2514742 - protein, 23 aa, Entamoeba dispar
LKKKWKLRFVIVNGSTLYYYKTE

SEQ ID NO: 2514743 - protein, 18 aa, Entamoeba dispar
LKKMRCRSLIYDDGAINV

SEQ ID NO: 2514744 - protein, 18 aa, Entamoeba dispar
LKKSECGFIPQSVTALTV

SEQ ID NO: 2514745 - protein, 17 aa, Entamoeba dispar
LKLASAQVMALFNKAIR

SEQ ID NO: 2514746 - protein, 26 aa, Entamoeba dispar
LKLATPFGLRVCCCIGGESIQPQIEE

SEQ ID NO: 2514747 - protein, 21 aa, Entamoeba dispar
LKLCLCPLCKHGIEVFGSKRP

SEQ ID NO: 2514748 - protein, 21 aa, Entamoeba dispar
LKLIEPLLCPISFDGDISISI

SEQ ID NO: 2514749 - protein, 28 aa, Entamoeba dispar
LKLKLEIQRQCIDKLRMYTTALESEMSE

SEQ ID NO: 2514750 - protein, 18 aa, Entamoeba dispar
LKLKTMRANSNYDVTDND

SEQ ID NO: 2514751 - protein, 18 aa, Entamoeba dispar
LKLRFPQRISLLRGNHEC

SEQ ID NO: 2514752 - protein, 18 aa, Entamoeba dispar
LKLRRLGELESMFPDIDS

SEQ ID NO: 2514753 - protein, 19 aa, Entamoeba dispar
LKLSSLYVRGTLKNVVIPT

SEQ ID NO: 2514754 - protein, 18 aa, Entamoeba dispar
LKMFLQFISKEGEFNESE

SEQ ID NO: 2514755 - protein, 22 aa, Entamoeba dispar
LKNARIADQIPFIIVCDKHGYV

SEQ ID NO: 2514756 - protein, 22 aa, Entamoeba dispar
LKPGKDALHWGVLRPFDSSYPG

SEQ ID NO: 2514757 - protein, 24 aa, Entamoeba dispar
LKPKCCLKEELCIVPLRKQLNWKA

SEQ ID NO: 2514758 - protein, 19 aa, Entamoeba dispar
LKPLGTYTIRIDTTGAGDI

SEQ ID NO: 2514759 - protein, 21 aa, Entamoeba dispar
LKPNGVFALHWDEFTGDDDFK

SEQ ID NO: 2514760 - protein, 18 aa, Entamoeba dispar
LKPVPKWTGKQVFTQILP

SEQ ID NO: 2514761 - protein, 21 aa, Entamoeba dispar
LKQIKSGIIPKGIEEIKEINK

SEQ ID NO: 2514762 - protein, 27 aa, Entamoeba dispar
LKQLEWKWGICMAIGFQEFIECKVKGI

SEQ ID NO: 2514763 - protein, 25 aa, Entamoeba dispar
LKQQTWRWFVCLFSREFTVEKVIVI

SEQ ID NO: 2514764 - protein, 17 aa, Entamoeba dispar
LKRCPKCDLCLEPITGS

SEQ ID NO: 2514765 - protein, 17 aa, Entamoeba dispar
LKRILCSVQFLRKLEKV

SEQ ID NO: 2514766 - protein, 20 aa, Entamoeba dispar
LKRLRPLLEISVKKVDSNIC

SEQ ID NO: 2514767 - protein, 22 aa, Entamoeba dispar
LKRLVLRPIGWLSLSQLFIDKS

SEQ ID NO: 2514768 - protein, 18 aa, Entamoeba dispar
LKRPNFWKLRRKDCPWVK

SEQ ID NO: 2514769 - protein, 17 aa, Entamoeba dispar
LKSGMSMICKRNEVDGV

SEQ ID NO: 2514770 - protein, 17 aa, Entamoeba dispar
LKSIEIINCRECKINIK

SEQ ID NO: 2514771 - protein, 18 aa, Entamoeba dispar
LKSIEIISCRECKINIKS

SEQ ID NO: 2514772 - protein, 18 aa, Entamoeba dispar
LKTEFASFIMSRYGINIT

SEQ ID NO: 2514773 - protein, 23 aa, Entamoeba dispar
LKTLKCIKCKVNVIGAGIFEKKL

SEQ ID NO: 2514774 - protein, 21 aa, Entamoeba dispar
LKTMPYFCCISAAQGIGLDKL

SEQ ID NO: 2514775 - protein, 17 aa, Entamoeba dispar
LKTSLKILLRFQECQSF

SEQ ID NO: 2514776 - protein, 23 aa, Entamoeba dispar
LKTTIIVNLHIWKALNPSFKTQI

SEQ ID NO: 2514777 - protein, 24 aa, Entamoeba dispar
LKTTIIVNLHIWKALNPSFKTQIA

SEQ ID NO: 2514778 - protein, 18 aa, Entamoeba dispar
LKVLLFFRNEYGGIPSRE

SEQ ID NO: 2514779 - protein, 20 aa, Entamoeba dispar
LKVMLFSGINKYSTYLIYSQ

SEQ ID NO: 2514780 - protein, 22 aa, Entamoeba dispar
LKVPGYYPSWFVGIRQKDNHEL

SEQ ID NO: 2514781 - protein, 17 aa, Entamoeba dispar
LKYFGIFMSQSFLFIKE

SEQ ID NO: 2514782 - protein, 17 aa, Entamoeba dispar
LKYIHKWQICHRDIKLE

SEQ ID NO: 2514783 - protein, 18 aa, Entamoeba dispar
LKYVCSFENIPFVKIGDI

SEQ ID NO: 2514784 - protein, 17 aa, Entamoeba dispar
LLALCGRITNCPESKMD

SEQ ID NO: 2514785 - protein, 22 aa, Entamoeba dispar
LLCTRAGGIGINLSEADTVIIY

SEQ ID NO: 2514786 - protein, 21 aa, Entamoeba dispar
LLCTWYLDNTCCVWNVETRRI

SEQ ID NO: 2514787 - protein, 21 aa, Entamoeba dispar
LLDDIRMGSPMLKETRQNKEK

SEQ ID NO: 2514788 - protein, 22 aa, Entamoeba dispar
LLDKIMFCYGIGYKNPRKEGGP

SEQ ID NO: 2514789 - protein, 24 aa, Entamoeba dispar
LLDKISLFFGFPITFYKAHCPLQT

SEQ ID NO: 2514790 - protein, 17 aa, Entamoeba dispar
LLEATGFSTFNVVYDSK

SEQ ID NO: 2514791 - protein, 18 aa, Entamoeba dispar
LLEILLRFYGAQHTSIFM

SEQ ID NO: 2514792 - protein, 17 aa, Entamoeba dispar
LLFALNFKEGCDPLPQT

SEQ ID NO: 2514793 - protein, 18 aa, Entamoeba dispar
LLFKNDLKGVEQFIKTFM

SEQ ID NO: 2514794 - protein, 25 aa, Entamoeba dispar
LLFLCSCLPCISLGMNCKLNNKIIT

SEQ ID NO: 2514795 - protein, 19 aa, Entamoeba dispar
LLFPLCLFLTIKAQLPYFD

SEQ ID NO: 2514796 - protein, 17 aa, Entamoeba dispar
LLGGYGFNVRLEDIING

SEQ ID NO: 2514797 - protein, 18 aa, Entamoeba dispar
LLGNGYGFAVDWWSYGTL

SEQ ID NO: 2514798 - protein, 23 aa, Entamoeba dispar
LLHPEIYKHLGIEPPRGILLHGP

SEQ ID NO: 2514799 - protein, 19 aa, Entamoeba dispar
LLHRLLGLIVFRIDIHISK

SEQ ID NO: 2514800 - protein, 22 aa, Entamoeba dispar
LLICLYQRIKIILPTILECHKT

SEQ ID NO: 2514801 - protein, 22 aa, Entamoeba dispar
LLIEVGRCFKIFNNKCLNETHS

SEQ ID NO: 2514802 - protein, 19 aa, Entamoeba dispar
LLKCISYFLPFISDKNILK

SEQ ID NO: 2514803 - protein, 20 aa, Entamoeba dispar
LLKCKKCGGLLTQACFMRCC

SEQ ID NO: 2514804 - protein, 23 aa, Entamoeba dispar
LLKCSILKRPWVNPFNQTTTNNP

SEQ ID NO: 2514805 - protein, 20 aa, Entamoeba dispar
LLKDRFNLIVFGHEHCSQVE

SEQ ID NO: 2514806 - protein, 17 aa, Entamoeba dispar
LLKEIWGLSLAYPDNTP

SEQ ID NO: 2514807 - protein, 17 aa, Entamoeba dispar
LLKPSALSPRFTRDSFD

SEQ ID NO: 2514808 - protein, 19 aa, Entamoeba dispar
LLKRIKIIKSFWRNIKENE

SEQ ID NO: 2514809 - protein, 24 aa, Entamoeba dispar
LLKRLVLNCFYHFNSLFSSFHKEI

SEQ ID NO: 2514810 - protein, 20 aa, Entamoeba dispar
LLLCCFRLRHEMVFDEEVKQ

SEQ ID NO: 2514811 - protein, 17 aa, Entamoeba dispar
LLLDYGCVDQLYSLLKC

SEQ ID NO: 2514812 - protein, 18 aa, Entamoeba dispar
LLLFPTIRELTCDNYFLD

SEQ ID NO: 2514813 - protein, 18 aa, Entamoeba dispar
LLLIRSVFDFLTILKDSM

SEQ ID NO: 2514814 - protein, 17 aa, Entamoeba dispar
LLLNDSFSIPLLNFFSL

SEQ ID NO: 2514815 - protein, 21 aa, Entamoeba dispar
LLLNELFPGFGFEKKKTGINK

SEQ ID NO: 2514816 - protein, 18 aa, Entamoeba dispar
LLLSLWNVVDCPFRAMDE

SEQ ID NO: 2514817 - protein, 23 aa, Entamoeba dispar
LLNDFKYALVWGNSVAHSPQQVN

SEQ ID NO: 2514818 - protein, 17 aa, Entamoeba dispar
LLNIYSCYFTYCYSFMK

SEQ ID NO: 2514819 - protein, 17 aa, Entamoeba dispar
LLQRLALSLHSFSKSFV

SEQ ID NO: 2514820 - protein, 19 aa, Entamoeba dispar
LLRALGVPCGNSLEDVITA

SEQ ID NO: 2514821 - protein, 17 aa, Entamoeba dispar
LLREFGFFFDSIYAKKT

SEQ ID NO: 2514822 - protein, 18 aa, Entamoeba dispar
LLRIIKWSSIQKHIILVL

SEQ ID NO: 2514823 - protein, 19 aa, Entamoeba dispar
LLRKKRYAATMILDGGKKK

SEQ ID NO: 2514824 - protein, 23 aa, Entamoeba dispar
LLSCITLPISEGVNFVKKEESFL

SEQ ID NO: 2514825 - protein, 18 aa, Entamoeba dispar
LLSQLAFDSCEIIDHIAK

SEQ ID NO: 2514826 - protein, 25 aa, Entamoeba dispar
LLSSFLRFHCCLLLLDYFDYINRIQ

SEQ ID NO: 2514827 - protein, 22 aa, Entamoeba dispar
LLVCKGCAFLAQSIATEDISNI

SEQ ID NO: 2514828 - protein, 25 aa, Entamoeba dispar
LLYTRVFKYIWPPSINTVEKMNLKE

SEQ ID NO: 2514829 - protein, 17 aa, Entamoeba dispar
LMCDWYIPIDLKYKHLI

SEQ ID NO: 2514830 - protein, 18 aa, Entamoeba dispar
LMDPSGKAPLMWRYDEIN

SEQ ID NO: 2514831 - protein, 18 aa, Entamoeba dispar
LMERLFRLLQMIDKNSGV

SEQ ID NO: 2514832 - protein, 17 aa, Entamoeba dispar
LMIKRYCNNFIYMYQWF

SEQ ID NO: 2514833 - protein, 18 aa, Entamoeba dispar
LMIPLLKVERCWAYSNEL

SEQ ID NO: 2514834 - protein, 22 aa, Entamoeba dispar
LMKEFINAFFIIKNYFSVLSIH

SEQ ID NO: 2514835 - protein, 18 aa, Entamoeba dispar
LMKIRFIIELSRCSIVEP

SEQ ID NO: 2514836 - protein, 22 aa, Entamoeba dispar
LMKLLVCPRLTLYALQSLQFIL

SEQ ID NO: 2514837 - protein, 18 aa, Entamoeba dispar
LMNELEIDMLRGFQCTSS

SEQ ID NO: 2514838 - protein, 18 aa, Entamoeba dispar
LMSRCNLVILKRLENESI

SEQ ID NO: 2514839 - protein, 21 aa, Entamoeba dispar
LNAELVYFNYFIPFPIPIDKN

SEQ ID NO: 2514840 - protein, 17 aa, Entamoeba dispar
LNCGDTICEKCLEKGVC

SEQ ID NO: 2514841 - protein, 17 aa, Entamoeba dispar
LNCGKEFIEYLSNFKNP

SEQ ID NO: 2514842 - protein, 19 aa, Entamoeba dispar
LNEIIRLSLLIEFDKQRIS

SEQ ID NO: 2514843 - protein, 17 aa, Entamoeba dispar
LNEKEIKKMGSMVAASS

SEQ ID NO: 2514844 - protein, 19 aa, Entamoeba dispar
LNELRRWNSLYGEGASTAS

SEQ ID NO: 2514845 - protein, 19 aa, Entamoeba dispar
LNEMIKYIIGQGGIQAIII

SEQ ID NO: 2514846 - protein, 19 aa, Entamoeba dispar
LNEMIKYIIGQGGIQTIVI

SEQ ID NO: 2514847 - protein, 36 aa, Entamoeba dispar
LNGEPKPIITLMFYLMYRFRLNDTPVRIIDFSKWIK

SEQ ID NO: 2514848 - protein, 17 aa, Entamoeba dispar
LNGKYIGTRPCKLSKGK

SEQ ID NO: 2514849 - protein, 18 aa, Entamoeba dispar
LNICDFFPEHLRVRGIDV

SEQ ID NO: 2514850 - protein, 18 aa, Entamoeba dispar
LNIYGFRNSISLLPYSKR

SEQ ID NO: 2514851 - protein, 20 aa, Entamoeba dispar
LNKCCSCVSILSNITQLNQK

SEQ ID NO: 2514852 - protein, 28 aa, Entamoeba dispar
LNKLRLSKRIKIIIINGVIDMMKNDILL

SEQ ID NO: 2514853 - protein, 18 aa, Entamoeba dispar
LNKMLLCYGTDYLHEISL

SEQ ID NO: 2514854 - protein, 28 aa, Entamoeba dispar
LNKRLFETMPYCFSESGSIREPFYNIGK

SEQ ID NO: 2514855 - protein, 22 aa, Entamoeba dispar
LNKYRLGNCPVKMVHFAKWIKS

SEQ ID NO: 2514856 - protein, 19 aa, Entamoeba dispar
LNLANSVLFCILDLNNDGK

SEQ ID NO: 2514857 - protein, 17 aa, Entamoeba dispar
LNLFCAFLMTRFGVENN

SEQ ID NO: 2514858 - protein, 18 aa, Entamoeba dispar
LNLIPSFLNNVEWIIMDE

SEQ ID NO: 2514859 - protein, 23 aa, Entamoeba dispar
LNLMKYNGGYSWWRRNSLTVFID

SEQ ID NO: 2514860 - protein, 22 aa, Entamoeba dispar
LNLQYRCCPPISNIVNRLYYNG

SEQ ID NO: 2514861 - protein, 23 aa, Entamoeba dispar
LNLQYRCCPPISNIVNRLYYNGL

SEQ ID NO: 2514862 - protein, 17 aa, Entamoeba dispar
LNLRKAGIHKKDLKDEK

SEQ ID NO: 2514863 - protein, 18 aa, Entamoeba dispar
LNMIFTMFADVFESYENS

SEQ ID NO: 2514864 - protein, 19 aa, Entamoeba dispar
LNMKQCKVCFVNNGVRLKE

SEQ ID NO: 2514865 - protein, 20 aa, Entamoeba dispar
LNMKQCKVCFVNNGVRLKEI

SEQ ID NO: 2514866 - protein, 17 aa, Entamoeba dispar
LNQLVAISWRDEVIKSQ

SEQ ID NO: 2514867 - protein, 19 aa, Entamoeba dispar
LNQMLSIKRLAPYDERKIT

SEQ ID NO: 2514868 - protein, 20 aa, Entamoeba dispar
LNTLLYEWYELRKLKTVDCR

SEQ ID NO: 2514869 - protein, 26 aa, Entamoeba dispar
LNYAFRWFNCFLLREFSPEQGIRLFD

SEQ ID NO: 2514870 - protein, 23 aa, Entamoeba dispar
LNYGCFLCCACGRAHMLFPKVQN

SEQ ID NO: 2514871 - protein, 18 aa, Entamoeba dispar
LNYLRDVVVARFLDEASS

SEQ ID NO: 2514872 - protein, 21 aa, Entamoeba dispar
LPECLICPSLSLDQWYIIIVC

SEQ ID NO: 2514873 - protein, 24 aa, Entamoeba dispar
LPFFMFEWNYLWFIHSLKFELAIR

SEQ ID NO: 2514874 - protein, 18 aa, Entamoeba dispar
LPGAAAWKVNKKVLEFYK

SEQ ID NO: 2514875 - protein, 20 aa, Entamoeba dispar
LPGCIGCTVVSNTFSPTTQL

SEQ ID NO: 2514876 - protein, 21 aa, Entamoeba dispar
LPIANGRLKFDLEILTDATPM

SEQ ID NO: 2514877 - protein, 18 aa, Entamoeba dispar
LPIEQHIECIGRKVLTVN

SEQ ID NO: 2514878 - protein, 20 aa, Entamoeba dispar
LPIGNICYLYKCCQMNPYQI

SEQ ID NO: 2514879 - protein, 27 aa, Entamoeba dispar
LPIKTLKWSVNWSVNSLGHWDDDIIEN

SEQ ID NO: 2514880 - protein, 20 aa, Entamoeba dispar
LPKAYGFHVCVTKWLTLVQL

SEQ ID NO: 2514881 - protein, 17 aa, Entamoeba dispar
LPKDYKSLVGIQRRKDN

SEQ ID NO: 2514882 - protein, 17 aa, Entamoeba dispar
LPKRIISVFSAVRQAIL

SEQ ID NO: 2514883 - protein, 17 aa, Entamoeba dispar
LPKTIRCCADIIQENET

SEQ ID NO: 2514884 - protein, 17 aa, Entamoeba dispar
LPKVVPFDFIVGGEFLR

SEQ ID NO: 2514885 - protein, 19 aa, Entamoeba dispar
LPLCKEINQIFSLIDHYCK

SEQ ID NO: 2514886 - protein, 18 aa, Entamoeba dispar
LPLDYRLAKLVFFGLYFG

SEQ ID NO: 2514887 - protein, 17 aa, Entamoeba dispar
LPLFLCVALINKYSSEL

SEQ ID NO: 2514888 - protein, 18 aa, Entamoeba dispar
LPLGNSFKFLNEIISQCW

SEQ ID NO: 2514889 - protein, 17 aa, Entamoeba dispar
LPLGVEITWKYQVQQEN

SEQ ID NO: 2514890 - protein, 17 aa, Entamoeba dispar
LPLHLILSWYEQKAVAV

SEQ ID NO: 2514891 - protein, 19 aa, Entamoeba dispar
LPMPLLMEIIWNCVMSNNL

SEQ ID NO: 2514892 - protein, 17 aa, Entamoeba dispar
LPMPRPGQILGLVGTNG

SEQ ID NO: 2514893 - protein, 18 aa, Entamoeba dispar
LPMPRPGQILGLVGTNGI

SEQ ID NO: 2514894 - protein, 18 aa, Entamoeba dispar
LPPDMSVGWSKNQLVFIN

SEQ ID NO: 2514895 - protein, 17 aa, Entamoeba dispar
LPPLRALFLITTKGIPP

SEQ ID NO: 2514896 - protein, 18 aa, Entamoeba dispar
LPPPRRGTSPANRSLNPS

SEQ ID NO: 2514897 - protein, 21 aa, Entamoeba dispar
LPQPPSFELQKKWYFPIIQSI

SEQ ID NO: 2514898 - protein, 20 aa, Entamoeba dispar
LPRKRLRDVSARLDYYKQLQ

SEQ ID NO: 2514899 - protein, 19 aa, Entamoeba dispar
LPRRESYFWLLDALDMYKP

SEQ ID NO: 2514900 - protein, 17 aa, Entamoeba dispar
LPSEIKLPATIQLYCHL

SEQ ID NO: 2514901 - protein, 18 aa, Entamoeba dispar
LPSIKVALMGGTRESRED

SEQ ID NO: 2514902 - protein, 19 aa, Entamoeba dispar
LPSLCTFGNLPFRKAVKRF

SEQ ID NO: 2514903 - protein, 23 aa, Entamoeba dispar
LPSLFCRYKLLPFYIDLFRSNMP

SEQ ID NO: 2514904 - protein, 21 aa, Entamoeba dispar
LPSSIKINFSFEIKQIKNKLI

SEQ ID NO: 2514905 - protein, 17 aa, Entamoeba dispar
LPSWSYDGLNLIYKLSQ

SEQ ID NO: 2514906 - protein, 20 aa, Entamoeba dispar
LPTGCYCTYSLISKQECIFD

SEQ ID NO: 2514907 - protein, 17 aa, Entamoeba dispar
LPTGYPFLMTKPINWYW

SEQ ID NO: 2514908 - protein, 20 aa, Entamoeba dispar
LPTIINLCYILSVIGKEEKA

SEQ ID NO: 2514909 - protein, 17 aa, Entamoeba dispar
LPTYRFEAIVNLINADV

SEQ ID NO: 2514910 - protein, 24 aa, Entamoeba dispar
LQAICCSHGLIIRKDIKKIIEKYK

SEQ ID NO: 2514911 - protein, 17 aa, Entamoeba dispar
LQECFKVLWEFEDYQKK

SEQ ID NO: 2514912 - protein, 24 aa, Entamoeba dispar
LQELCVLKGKLCWIIYVDVVVVED

SEQ ID NO: 2514913 - protein, 23 aa, Entamoeba dispar
LQELLKIINIRAGIENVELSEQA

SEQ ID NO: 2514914 - protein, 17 aa, Entamoeba dispar
LQFLRSILQTNINIISE

SEQ ID NO: 2514915 - protein, 21 aa, Entamoeba dispar
LQFRLVINIGDAAIFRNNNEI

SEQ ID NO: 2514916 - protein, 18 aa, Entamoeba dispar
LQGEFKISTIAKIDLENQ

SEQ ID NO: 2514917 - protein, 18 aa, Entamoeba dispar
LQGGWAFSVPQSMCRRIM

SEQ ID NO: 2514918 - protein, 23 aa, Entamoeba dispar
LQHLTELFISYGYCKVEHFMSMS

SEQ ID NO: 2514919 - protein, 21 aa, Entamoeba dispar
LQILIPFEWQGVLIPMLPIEE

SEQ ID NO: 2514920 - protein, 17 aa, Entamoeba dispar
LQIRISSLIGYENVLPM

SEQ ID NO: 2514921 - protein, 19 aa, Entamoeba dispar
LQLPILDCRALRVQGKFND

SEQ ID NO: 2514922 - protein, 22 aa, Entamoeba dispar
LQLSIKILECLSLNCHHGVILK

SEQ ID NO: 2514923 - protein, 21 aa, Entamoeba dispar
LQMLTSLWIKRMKSLDLLLLN

SEQ ID NO: 2514924 - protein, 17 aa, Entamoeba dispar
LQPLVCSSYPLNNTTSC

SEQ ID NO: 2514925 - protein, 18 aa, Entamoeba dispar
LQPNFSWPKEWRGMYGYE

SEQ ID NO: 2514926 - protein, 18 aa, Entamoeba dispar
LQQIACIFLRQSISHTNM

SEQ ID NO: 2514927 - protein, 24 aa, Entamoeba dispar
LQQRAIEFSQFFSYDDLRLDAVNR

SEQ ID NO: 2514928 - protein, 20 aa, Entamoeba dispar
LQRPQLIFRDSFLQLPTLKE

SEQ ID NO: 2514929 - protein, 17 aa, Entamoeba dispar
LQRSAIMAIQIAKKRKD

SEQ ID NO: 2514930 - protein, 17 aa, Entamoeba dispar
LQRTLCWDPKFRLTPAQ

SEQ ID NO: 2514931 - protein, 18 aa, Entamoeba dispar
LQRYAAWRGGAMIANTRS

SEQ ID NO: 2514932 - protein, 18 aa, Entamoeba dispar
LQVSLCLLIYKFMYCGAP

SEQ ID NO: 2514933 - protein, 17 aa, Entamoeba dispar
LRAGLNCISEISKSLYF

SEQ ID NO: 2514934 - protein, 20 aa, Entamoeba dispar
LRAYDIFLRKRFGYSERILE

SEQ ID NO: 2514935 - protein, 17 aa, Entamoeba dispar
LRAYVWYALLLRPSNPW

SEQ ID NO: 2514936 - protein, 19 aa, Entamoeba dispar
LRDFPALSIKVGDKEESIM

SEQ ID NO: 2514937 - protein, 18 aa, Entamoeba dispar
LRDLFSLFFNVEFFERVW

SEQ ID NO: 2514938 - protein, 22 aa, Entamoeba dispar
LRDMIAPFFLRRIKKEVLPSLP

SEQ ID NO: 2514939 - protein, 19 aa, Entamoeba dispar
LRGGFDIGLTICKLELVKS

SEQ ID NO: 2514940 - protein, 17 aa, Entamoeba dispar
LRHILKWDQADIQALME

SEQ ID NO: 2514941 - protein, 18 aa, Entamoeba dispar
LRHPQLFKNIGIKPPRGI

SEQ ID NO: 2514942 - protein, 24 aa, Entamoeba dispar
LRHPRVCGYLMKQSYIFGTWTERY

SEQ ID NO: 2514943 - protein, 21 aa, Entamoeba dispar
LRIGKKLIRYGFAPRISFLTS

SEQ ID NO: 2514944 - protein, 17 aa, Entamoeba dispar
LRIGNVFQICHLKKYIE

SEQ ID NO: 2514945 - protein, 17 aa, Entamoeba dispar
LRIIRALYDLGFINPTE

SEQ ID NO: 2514946 - protein, 21 aa, Entamoeba dispar
LRIITKLLNKWNVLNKENIHQ

SEQ ID NO: 2514947 - protein, 18 aa, Entamoeba dispar
LRIKGIEGMENFEGLPDK

SEQ ID NO: 2514948 - protein, 20 aa, Entamoeba dispar
LRIKIFLWKTIQCDKSLGTV

SEQ ID NO: 2514949 - protein, 20 aa, Entamoeba dispar
LRILCPLNFVLLNPQYPLLN

SEQ ID NO: 2514950 - protein, 18 aa, Entamoeba dispar
LRILHCLNSNFEESLLQE

SEQ ID NO: 2514951 - protein, 18 aa, Entamoeba dispar
LRKAIFIALMGAMDYVDG

SEQ ID NO: 2514952 - protein, 17 aa, Entamoeba dispar
LRKGVKYGEVIKIYSTF

SEQ ID NO: 2514953 - protein, 17 aa, Entamoeba dispar
LRKPRFVVQSLLRPYIQ

SEQ ID NO: 2514954 - protein, 22 aa, Entamoeba dispar
LRKRSVKFIQIFTKTIKDLLNG

SEQ ID NO: 2514955 - protein, 24 aa, Entamoeba dispar
LRKVCSVKPLGPRFISTSSDRSIH

SEQ ID NO: 2514956 - protein, 20 aa, Entamoeba dispar
LRLDVKYVLGLVLGYGLNHG

SEQ ID NO: 2514957 - protein, 17 aa, Entamoeba dispar
LRLESFSTIPISITELL

SEQ ID NO: 2514958 - protein, 19 aa, Entamoeba dispar
LRLEVLKHFNFVDEHNLLT

SEQ ID NO: 2514959 - protein, 20 aa, Entamoeba dispar
LRLIKLRKIRESNLKKIQSQ

SEQ ID NO: 2514960 - protein, 17 aa, Entamoeba dispar
LRLKMKANYGLERYEEC

SEQ ID NO: 2514961 - protein, 22 aa, Entamoeba dispar
LRLLRKRIPNILFQMLLRGRNA

SEQ ID NO: 2514962 - protein, 18 aa, Entamoeba dispar
LRLPLSISSFHFYDSSGN

SEQ ID NO: 2514963 - protein, 21 aa, Entamoeba dispar
LRLSMKSSYPFFSEKFILSGN

SEQ ID NO: 2514964 - protein, 17 aa, Entamoeba dispar
LRLYIDWDKANLKEVPK

SEQ ID NO: 2514965 - protein, 17 aa, Entamoeba dispar
LRMEFGDFIPRNIRTQI

SEQ ID NO: 2514966 - protein, 17 aa, Entamoeba dispar
LRMKATSFKAVNIEEIT

SEQ ID NO: 2514967 - protein, 17 aa, Entamoeba dispar
LRMMRICRASFEKVIEA

SEQ ID NO: 2514968 - protein, 18 aa, Entamoeba dispar
LRMRRARYGNAKKPIPSG

SEQ ID NO: 2514969 - protein, 17 aa, Entamoeba dispar
LRMSFNYICSLPNELSM

SEQ ID NO: 2514970 - protein, 18 aa, Entamoeba dispar
LRNLCLLGNPLPEVDSLF

SEQ ID NO: 2514971 - protein, 17 aa, Entamoeba dispar
LRPELFKKGSLTKRSKG

SEQ ID NO: 2514972 - protein, 17 aa, Entamoeba dispar
LRPLLFIFREIDPLCTL

SEQ ID NO: 2514973 - protein, 18 aa, Entamoeba dispar
LRPVPLIAHIDGFPTKAY

SEQ ID NO: 2514974 - protein, 20 aa, Entamoeba dispar
LRQCDNCSFILSLNNLKNFN

SEQ ID NO: 2514975 - protein, 17 aa, Entamoeba dispar
LRREIDVMRKLSNHPNV

SEQ ID NO: 2514976 - protein, 20 aa, Entamoeba dispar
LRRKVEIMVLEWAEKNCKTM

SEQ ID NO: 2514977 - protein, 18 aa, Entamoeba dispar
LRRNVCCTLSEEYEGISD

SEQ ID NO: 2514978 - protein, 38 aa, Entamoeba dispar
LRRYERNKIALAFNELVEIAIKFGYEFGEKNTRKAQKT

SEQ ID NO: 2514979 - protein, 19 aa, Entamoeba dispar
LRSATIWHLYGIVCRSEKR

SEQ ID NO: 2514980 - protein, 17 aa, Entamoeba dispar
LRSSFDWLKSIKDSQVD

SEQ ID NO: 2514981 - protein, 20 aa, Entamoeba dispar
LRSTKTINLRGKYNTWLQQI

SEQ ID NO: 2514982 - protein, 17 aa, Entamoeba dispar
LRTAAFYVYSTIYQNYV

SEQ ID NO: 2514983 - protein, 21 aa, Entamoeba dispar
LRTGRKTIMVMAGNKCDLEEQ

SEQ ID NO: 2514984 - protein, 17 aa, Entamoeba dispar
LRVGAVLYLLYGRQSQN

SEQ ID NO: 2514985 - protein, 20 aa, Entamoeba dispar
LRVGGKICCFCPCIEQIQKS

SEQ ID NO: 2514986 - protein, 23 aa, Entamoeba dispar
LRVKKGQPPYCCFEYIDEDSYGK

SEQ ID NO: 2514987 - protein, 17 aa, Entamoeba dispar
LRVPFGIENESIPLDYS

SEQ ID NO: 2514988 - protein, 17 aa, Entamoeba dispar
LRVSFVLSFTFKQNPYL

SEQ ID NO: 2514989 - protein, 21 aa, Entamoeba dispar
LRYCLEAIKLYININIEDCFE

SEQ ID NO: 2514990 - protein, 17 aa, Entamoeba dispar
LRYGSVMIMADQDFDGS

SEQ ID NO: 2514991 - protein, 19 aa, Entamoeba dispar
LRYHVITVFVLIAQKKLVP

SEQ ID NO: 2514992 - protein, 19 aa, Entamoeba dispar
LRYILVVDALNFCFWPTEG

SEQ ID NO: 2514993 - protein, 17 aa, Entamoeba dispar
LRYQVIFKFLFDIEYHR

SEQ ID NO: 2514994 - protein, 21 aa, Entamoeba dispar
LRYRNLCSVQHLLDQIHSCSN

SEQ ID NO: 2514995 - protein, 19 aa, Entamoeba dispar
LSCLHIAVYFDKFDFVEKL

SEQ ID NO: 2514996 - protein, 25 aa, Entamoeba dispar
LSEAKCVLHLLNAFKRCNFADGICA

SEQ ID NO: 2514997 - protein, 17 aa, Entamoeba dispar
LSEGILFAKLINYLQND

SEQ ID NO: 2514998 - protein, 18 aa, Entamoeba dispar
LSEGVLLAKLLNYLQKDI

SEQ ID NO: 2514999 - protein, 21 aa, Entamoeba dispar
LSEIMKSLALIIGNLQGDKTA

SEQ ID NO: 2515000 - protein, 20 aa, Entamoeba dispar
LSGELVFECWDWDRMNSDDL

SEQ ID NO: 2515001 - protein, 18 aa, Entamoeba dispar
LSGLGSFGNTTGFGQNNT

SEQ ID NO: 2515002 - protein, 24 aa, Entamoeba dispar
LSHFKCIRKALKHSKKITIMINQN

SEQ ID NO: 2515003 - protein, 18 aa, Entamoeba dispar
LSHTPLIRDFFLSQSFKE

SEQ ID NO: 2515004 - protein, 22 aa, Entamoeba dispar
LSIEIINLLLLESSDFVTGFIN

SEQ ID NO: 2515005 - protein, 19 aa, Entamoeba dispar
LSIMGWFRLCGGIYNIVEI

SEQ ID NO: 2515006 - protein, 19 aa, Entamoeba dispar
LSKEEFLEYPIFDEYQFNC

SEQ ID NO: 2515007 - protein, 22 aa, Entamoeba dispar
LSKRFKKGFLIYYYREMIYSKR

SEQ ID NO: 2515008 - protein, 19 aa, Entamoeba dispar
LSKRIGPYILRRTKKDVFG

SEQ ID NO: 2515009 - protein, 23 aa, Entamoeba dispar
LSKSPGGGLVFFASYSMLNRVVE

SEQ ID NO: 2515010 - protein, 20 aa, Entamoeba dispar
LSLHMYGCRVIQKILEVLSS

SEQ ID NO: 2515011 - protein, 17 aa, Entamoeba dispar
LSLKIPVIEIWKHEMKI

SEQ ID NO: 2515012 - protein, 23 aa, Entamoeba dispar
LSLLISCCYLCFDSFVEPIGINK

SEQ ID NO: 2515013 - protein, 23 aa, Entamoeba dispar
LSLWALQEMYIFLPVMLSSNNYE

SEQ ID NO: 2515014 - protein, 17 aa, Entamoeba dispar
LSMFKIKPTYTFTMLNL

SEQ ID NO: 2515015 - protein, 18 aa, Entamoeba dispar
LSNEMARMLSAVDEQSIG

SEQ ID NO: 2515016 - protein, 22 aa, Entamoeba dispar
LSPECLDCLLPQILKDDGISIP

SEQ ID NO: 2515017 - protein, 19 aa, Entamoeba dispar
LSPKCPIHIVDYQLNIHST

SEQ ID NO: 2515018 - protein, 19 aa, Entamoeba dispar
LSPRAKKYLPYMLSISKTI

SEQ ID NO: 2515019 - protein, 23 aa, Entamoeba dispar
LSREYGVVVPLVLMNSFSTNVET

SEQ ID NO: 2515020 - protein, 24 aa, Entamoeba dispar
LSSFIVKLFPEFSLLFNGAELEKL

SEQ ID NO: 2515021 - protein, 20 aa, Entamoeba dispar
LSSFLRFLSSFTRGLPKEYN

SEQ ID NO: 2515022 - protein, 23 aa, Entamoeba dispar
LSSKAGGCGLNLVGGANLVMFDP

SEQ ID NO: 2515023 - protein, 22 aa, Entamoeba dispar
LSSVEFCLFPSFFTGLASFKDQ

SEQ ID NO: 2515024 - protein, 21 aa, Entamoeba dispar
LSTVCSMTWREFSLKTKDWTM

SEQ ID NO: 2515025 - protein, 17 aa, Entamoeba dispar
LSVAFQWFVGDSTEQNI

SEQ ID NO: 2515026 - protein, 19 aa, Entamoeba dispar
LSYIEICKFLEYYQQKARI

SEQ ID NO: 2515027 - protein, 17 aa, Entamoeba dispar
LSYLKRNCCENDVSLIW

SEQ ID NO: 2515028 - protein, 23 aa, Entamoeba dispar
LTDFRCCYCGMFVHPQCIQQAPA

SEQ ID NO: 2515029 - protein, 24 aa, Entamoeba dispar
LTEGIFSFIKKLFVKRTYNKIYVD

SEQ ID NO: 2515030 - protein, 20 aa, Entamoeba dispar
LTELPSFFSLLSNLNSLDID

SEQ ID NO: 2515031 - protein, 21 aa, Entamoeba dispar
LTFHSGYDFGYLLRLLTCEKL

SEQ ID NO: 2515032 - protein, 20 aa, Entamoeba dispar
LTFIRDVWKSSSVRWQMARN

SEQ ID NO: 2515033 - protein, 18 aa, Entamoeba dispar
LTFNCFDWDNAFKFSSDD

SEQ ID NO: 2515034 - protein, 18 aa, Entamoeba dispar
LTHDIPFLFHKKIQELMK

SEQ ID NO: 2515035 - protein, 18 aa, Entamoeba dispar
LTIFEIFIERSLIYTEEV

SEQ ID NO: 2515036 - protein, 18 aa, Entamoeba dispar
LTKEFLMNMSYLFNNQPN

SEQ ID NO: 2515037 - protein, 18 aa, Entamoeba dispar
LTKPFSIVLENKYQKIPF

SEQ ID NO: 2515038 - protein, 19 aa, Entamoeba dispar
LTLELRHILKWDQADIQAL

SEQ ID NO: 2515039 - protein, 17 aa, Entamoeba dispar
LTLGLVWTLILRFAISE

SEQ ID NO: 2515040 - protein, 18 aa, Entamoeba dispar
LTNAFGVLNVINFAGQGM

SEQ ID NO: 2515041 - protein, 17 aa, Entamoeba dispar
LTNESMFDWALVHVDKK

SEQ ID NO: 2515042 - protein, 17 aa, Entamoeba dispar
LTNHLYIIFSMNGESYY

SEQ ID NO: 2515043 - protein, 18 aa, Entamoeba dispar
LTPFAFDCAIRLRKPNFI

SEQ ID NO: 2515044 - protein, 24 aa, Entamoeba dispar
LTPGSFSVIFPKEIGVFEYTQPTK

SEQ ID NO: 2515045 - protein, 21 aa, Entamoeba dispar
LTPKTKFIWKGKFRNEKYVEF

SEQ ID NO: 2515046 - protein, 18 aa, Entamoeba dispar
LTPYALNSCVAFGTVNLA

SEQ ID NO: 2515047 - protein, 18 aa, Entamoeba dispar
LTQIPGLIQFKGPMNLKH

SEQ ID NO: 2515048 - protein, 20 aa, Entamoeba dispar
LTQYIPFIFKSILTLEEKEY

SEQ ID NO: 2515049 - protein, 17 aa, Entamoeba dispar
LTRLGCEIIPLNIKPTG

SEQ ID NO: 2515050 - protein, 19 aa, Entamoeba dispar
LTSKCIFTGSGMRADMKEL

SEQ ID NO: 2515051 - protein, 24 aa, Entamoeba dispar
LTSMLRKAMEVRRSDIADDEDDDD

SEQ ID NO: 2515052 - protein, 18 aa, Entamoeba dispar
LTTFEIPYAFFVVLDAKK

SEQ ID NO: 2515053 - protein, 18 aa, Entamoeba dispar
LTTFLGCVILKIKGDDDK

SEQ ID NO: 2515054 - protein, 17 aa, Entamoeba dispar
LTVKLLLLFGDRIFSTP

SEQ ID NO: 2515055 - protein, 23 aa, Entamoeba dispar
LTYKGCGFHRVIKDFMIQGGDFT

SEQ ID NO: 2515056 - protein, 20 aa, Entamoeba dispar
LVALNCLVEYGSYDERYGEV

SEQ ID NO: 2515057 - protein, 17 aa, Entamoeba dispar
LVCAVYFILKYCGKKGN

SEQ ID NO: 2515058 - protein, 18 aa, Entamoeba dispar
LVCRVVLLLLSYVIEERY

SEQ ID NO: 2515059 - protein, 18 aa, Entamoeba dispar
LVDICLNLGYFFETTRMR

SEQ ID NO: 2515060 - protein, 17 aa, Entamoeba dispar
LVECYQLILDVAAWINE

SEQ ID NO: 2515061 - protein, 17 aa, Entamoeba dispar
LVFCWMKILVVDKKKTF

SEQ ID NO: 2515062 - protein, 17 aa, Entamoeba dispar
LVFDCGSSFIKVGVAGE

SEQ ID NO: 2515063 - protein, 18 aa, Entamoeba dispar
LVFDLAIQIIDAISFLHK

SEQ ID NO: 2515064 - protein, 17 aa, Entamoeba dispar
LVFFKYPKWTGGLYCSP

SEQ ID NO: 2515065 - protein, 17 aa, Entamoeba dispar
LVFNLTWSWVVSLRGLR

SEQ ID NO: 2515066 - protein, 17 aa, Entamoeba dispar
LVGCSWVKVPAKRYILV

SEQ ID NO: 2515067 - protein, 17 aa, Entamoeba dispar
LVHEWFKEMKFLKTITI

SEQ ID NO: 2515068 - protein, 17 aa, Entamoeba dispar
LVKFFSVESKYLITESG

SEQ ID NO: 2515069 - protein, 17 aa, Entamoeba dispar
LVKFTSVLEEYWSVVVF

SEQ ID NO: 2515070 - protein, 17 aa, Entamoeba dispar
LVLKHRWFPKLVKSKEP

SEQ ID NO: 2515071 - protein, 17 aa, Entamoeba dispar
LVMKKLYCCCKIKEDEN

SEQ ID NO: 2515072 - protein, 23 aa, Entamoeba dispar
LVPFTLYCCSILVMLNIPPSDYS

SEQ ID NO: 2515073 - protein, 24 aa, Entamoeba dispar
LVSCIKAGFLLPNLRLFRGDNSNI

SEQ ID NO: 2515074 - protein, 18 aa, Entamoeba dispar
LVYHLSCSTAISVKPYII

SEQ ID NO: 2515075 - protein, 23 aa, Entamoeba dispar
LWLKEWFVFLNFFHNKCIHRIEN

SEQ ID NO: 2515076 - protein, 18 aa, Entamoeba dispar
LWQPSLIIDRGIALHKMI

SEQ ID NO: 2515077 - protein, 19 aa, Entamoeba dispar
LWRICQTYDYFFVKTVVRE

SEQ ID NO: 2515078 - protein, 19 aa, Entamoeba dispar
LWSLLQFLLPEIFNMKELD

SEQ ID NO: 2515079 - protein, 24 aa, Entamoeba dispar
LWTRHFPIAFLMRQHMLLLGRSEE

SEQ ID NO: 2515080 - protein, 18 aa, Entamoeba dispar
LWYLCYFCQEVVKNVEKT

SEQ ID NO: 2515081 - protein, 17 aa, Entamoeba dispar
LWYLIDFLHLVSINKAI

SEQ ID NO: 2515082 - protein, 17 aa, Entamoeba dispar
LYAKLLFQSSGIGSIKK

SEQ ID NO: 2515083 - protein, 20 aa, Entamoeba dispar
LYCLKNPFFYYEIDNEYLYV

SEQ ID NO: 2515084 - protein, 19 aa, Entamoeba dispar
LYCVFPLVGSEAIQVPFML

SEQ ID NO: 2515085 - protein, 17 aa, Entamoeba dispar
LYDCVCLVFLEGAKNDI

SEQ ID NO: 2515086 - protein, 18 aa, Entamoeba dispar
LYDILCKILNGWNEQEFI

SEQ ID NO: 2515087 - protein, 18 aa, Entamoeba dispar
LYEILSLLEINNYFILPF

SEQ ID NO: 2515088 - protein, 19 aa, Entamoeba dispar
LYETVPFDIGFEVSGKRLD

SEQ ID NO: 2515089 - protein, 19 aa, Entamoeba dispar
LYEVFSIPFKTFWKNDAER

SEQ ID NO: 2515090 - protein, 18 aa, Entamoeba dispar
LYFYLTFFIMKENVFDDN

SEQ ID NO: 2515091 - protein, 23 aa, Entamoeba dispar
LYGKGAGCGPTLFQAFETRKENE

SEQ ID NO: 2515092 - protein, 24 aa, Entamoeba dispar
LYGKGAGCGPTLYLAHKIQKSIKP

SEQ ID NO: 2515093 - protein, 17 aa, Entamoeba dispar
LYILLWRIFGLTEYCLD

SEQ ID NO: 2515094 - protein, 19 aa, Entamoeba dispar
LYKAHWDAMDFVRMHEAAN

SEQ ID NO: 2515095 - protein, 23 aa, Entamoeba dispar
LYKDPRTILIFKVNSPINDKWGF

SEQ ID NO: 2515096 - protein, 18 aa, Entamoeba dispar
LYKLFPKLFTLWISFYEF

SEQ ID NO: 2515097 - protein, 17 aa, Entamoeba dispar
LYKPCFDYLLSCLATND

SEQ ID NO: 2515098 - protein, 18 aa, Entamoeba dispar
LYLQRFGEDLAFEKTGDV

SEQ ID NO: 2515099 - protein, 18 aa, Entamoeba dispar
LYNGMFLKLVFIIKKCFA

SEQ ID NO: 2515100 - protein, 20 aa, Entamoeba dispar
LYPLECYPFFPIESSSQFDY

SEQ ID NO: 2515101 - protein, 20 aa, Entamoeba dispar
LYPRLKLDQFELLWNNITTT

SEQ ID NO: 2515102 - protein, 19 aa, Entamoeba dispar
LYQQVEPFILLKYQLEKDE

SEQ ID NO: 2515103 - protein, 22 aa, Entamoeba dispar
LYRFGQTVSVCFWSEHWKPSSY

SEQ ID NO: 2515104 - protein, 19 aa, Entamoeba dispar
LYRSLKVLFVKGTHIKSES

SEQ ID NO: 2515105 - protein, 22 aa, Entamoeba dispar
LYRYGCFIYNCFMIPCIDPMEY

SEQ ID NO: 2515106 - protein, 18 aa, Entamoeba dispar
LYSYYLFFYCSDFMNKTT

SEQ ID NO: 2515107 - protein, 18 aa, Entamoeba dispar
LYTKGCYTKGIFRENSLA

SEQ ID NO: 2515108 - protein, 18 aa, Entamoeba dispar
LYTMFGWPLAKKYGTLHD

SEQ ID NO: 2515109 - protein, 18 aa, Entamoeba dispar
LYVRRVFIMDDCRELIPE

SEQ ID NO: 2515110 - protein, 17 aa, Entamoeba dispar
LYWTPGVLRQAEDRVHR

SEQ ID NO: 2515111 - protein, 18 aa, Entamoeba dispar
LYYKRFYSSISFKNISYT

SEQ ID NO: 2515112 - protein, 24 aa, Entamoeba dispar
LYYVNDWWLRDGIAAAWNVLLDAY

SEQ ID NO: 2515113 - protein, 17 aa, Entamoeba dispar
MARRSEILIARYALHKL

SEQ ID NO: 2515114 - protein, 18 aa, Entamoeba dispar
MCETCMTLSALENVDSNG

SEQ ID NO: 2515115 - protein, 19 aa, Entamoeba dispar
MDELGKFLSVFMSISNKIP

SEQ ID NO: 2515116 - protein, 19 aa, Entamoeba dispar
MDIRLIAFKEFLSYERIGD

SEQ ID NO: 2515117 - protein, 23 aa, Entamoeba dispar
MDISEKIELLWEVVDPIFNSNVE

SEQ ID NO: 2515118 - protein, 20 aa, Entamoeba dispar
MDKKNCFMRNPMKFDGVDDM

SEQ ID NO: 2515119 - protein, 21 aa, Entamoeba dispar
MDLGFKGPFLIITDKENLGFY

SEQ ID NO: 2515120 - protein, 29 aa, Entamoeba dispar
MEFLKEWLAAPSFQEWKERVIIDNALKLN

SEQ ID NO: 2515121 - protein, 18 aa, Entamoeba dispar
MELFKRAIRSMAMGHVVT

SEQ ID NO: 2515122 - protein, 21 aa, Entamoeba dispar
MERLIEIGISFQSAVENLFGR

SEQ ID NO: 2515123 - protein, 21 aa, Entamoeba dispar
MERLRFSSFFVQSVKGRSNVM

SEQ ID NO: 2515124 - protein, 21 aa, Entamoeba dispar
MERSRIKSECGIRRGDDKPVS

SEQ ID NO: 2515125 - protein, 17 aa, Entamoeba dispar
MEYKLKLPRMTKILFTS

SEQ ID NO: 2515126 - protein, 19 aa, Entamoeba dispar
MFAKLPFLISNVVEILDMP

SEQ ID NO: 2515127 - protein, 17 aa, Entamoeba dispar
MFCPKCGYHDLRRISYY

SEQ ID NO: 2515128 - protein, 17 aa, Entamoeba dispar
MFDQLFRYFGLKKAEFL

SEQ ID NO: 2515129 - protein, 22 aa, Entamoeba dispar
MFIERFRIIKEFTEYMIQYINW

SEQ ID NO: 2515130 - protein, 19 aa, Entamoeba dispar
MFLPFVMQFLENFENFTKW

SEQ ID NO: 2515131 - protein, 25 aa, Entamoeba dispar
MFLQFAFRWINCCLLREFKLGTALR

SEQ ID NO: 2515132 - protein, 18 aa, Entamoeba dispar
MFNKRLGSYYQLECEPEG

SEQ ID NO: 2515133 - protein, 18 aa, Entamoeba dispar
MFRRYLKLENPLVAFINL

SEQ ID NO: 2515134 - protein, 17 aa, Entamoeba dispar
MFTPCMLPCDWVEAEDK

SEQ ID NO: 2515135 - protein, 19 aa, Entamoeba dispar
MFWEFGMKSFDEFIKKLIK

SEQ ID NO: 2515136 - protein, 19 aa, Entamoeba dispar
MFWELGMKSFDEFIEKLKK

SEQ ID NO: 2515137 - protein, 18 aa, Entamoeba dispar
MFWKLGMKSFDEFIEKLI

SEQ ID NO: 2515138 - protein, 17 aa, Entamoeba dispar
MFWQLGMKNFDDFIEKL

SEQ ID NO: 2515139 - protein, 18 aa, Entamoeba dispar
MFWQLGMKNFDEFIKKLI

SEQ ID NO: 2515140 - protein, 18 aa, Entamoeba dispar
MFWQLGMKSFDEFIEKLI

SEQ ID NO: 2515141 - protein, 22 aa, Entamoeba dispar
MGCCFYTKYQIIKFIGSGSFGK

SEQ ID NO: 2515142 - protein, 18 aa, Entamoeba dispar
MGCSIGLYNNGCKLNIRL

SEQ ID NO: 2515143 - protein, 18 aa, Entamoeba dispar
MGDGLIVYLARWVEGKMK

SEQ ID NO: 2515144 - protein, 19 aa, Entamoeba dispar
MGLSRGRAGVITRASFEQT

SEQ ID NO: 2515145 - protein, 17 aa, Entamoeba dispar
MGVEMTDWFPLIGNGTD

SEQ ID NO: 2515146 - protein, 23 aa, Entamoeba dispar
MHIPFPLILIWALNQWRKEKNQT

SEQ ID NO: 2515147 - protein, 21 aa, Entamoeba dispar
MICGGGCVEMELSLAVEEAAK

SEQ ID NO: 2515148 - protein, 20 aa, Entamoeba dispar
MIEECLKHKIHFEFRGTRSA

SEQ ID NO: 2515149 - protein, 24 aa, Entamoeba dispar
MIFATEFAYNWYVRKFFFEEGLKD

SEQ ID NO: 2515150 - protein, 18 aa, Entamoeba dispar
MIKQLSVIFLERISKGIC

SEQ ID NO: 2515151 - protein, 19 aa, Entamoeba dispar
MISCKRFFLLPKLQQKNDV

SEQ ID NO: 2515152 - protein, 17 aa, Entamoeba dispar
MISSFRFLRLDDLDKIK

SEQ ID NO: 2515153 - protein, 20 aa, Entamoeba dispar
MIWEELKFKKCKIVDHDYII

SEQ ID NO: 2515154 - protein, 19 aa, Entamoeba dispar
MKAFLSWKFVRLERLVLSW

SEQ ID NO: 2515155 - protein, 24 aa, Entamoeba dispar
MKCLDPLLEFCRLLTMPMSLEIIQ

SEQ ID NO: 2515156 - protein, 18 aa, Entamoeba dispar
MKDCGDVNAIGRIHNFLE

SEQ ID NO: 2515157 - protein, 18 aa, Entamoeba dispar
MKDLRLAAELQKKKLGDK

SEQ ID NO: 2515158 - protein, 19 aa, Entamoeba dispar
MKEICSMYSNLERRQRELA

SEQ ID NO: 2515159 - protein, 23 aa, Entamoeba dispar
MKETCKVMHFFVWNAVTSPQNVY

SEQ ID NO: 2515160 - protein, 17 aa, Entamoeba dispar
MKFKYGIIQKELTDEEQ

SEQ ID NO: 2515161 - protein, 17 aa, Entamoeba dispar
MKFMKRARAKEIEEMKD

SEQ ID NO: 2515162 - protein, 20 aa, Entamoeba dispar
MKIIERLGGIKALTKKTNTD

SEQ ID NO: 2515163 - protein, 18 aa, Entamoeba dispar
MKIVQSWGQMFPDDLYEY

SEQ ID NO: 2515164 - protein, 18 aa, Entamoeba dispar
MKIWCFNAGHILGAAMFC

SEQ ID NO: 2515165 - protein, 20 aa, Entamoeba dispar
MKKERSWRTAQIFQKEKVLK

SEQ ID NO: 2515166 - protein, 18 aa, Entamoeba dispar
MKKLLLQKQMKGIWIHVK

SEQ ID NO: 2515167 - protein, 22 aa, Entamoeba dispar
MKLEYCVSCGIHGRVVRVRSRT

SEQ ID NO: 2515168 - protein, 20 aa, Entamoeba dispar
MKLFPRIMIYFGQTDNETRC

SEQ ID NO: 2515169 - protein, 19 aa, Entamoeba dispar
MKLRHCTRLVLKDFYSPLL

SEQ ID NO: 2515170 - protein, 17 aa, Entamoeba dispar
MKMPSIDLISAEGNKEQ

SEQ ID NO: 2515171 - protein, 19 aa, Entamoeba dispar
MKRKEEWHPYLLFCKEHRE

SEQ ID NO: 2515172 - protein, 17 aa, Entamoeba dispar
MKRKRIEINKVLHEVAS

SEQ ID NO: 2515173 - protein, 19 aa, Entamoeba dispar
MKSKGGIVFNGRVYGSMVV

SEQ ID NO: 2515174 - protein, 25 aa, Entamoeba dispar
MKSRMYLNFTICFSSKISSELLQYF

SEQ ID NO: 2515175 - protein, 20 aa, Entamoeba dispar
MKTKAGEVLKVIEKNVRIGW

SEQ ID NO: 2515176 - protein, 22 aa, Entamoeba dispar
MKYKFAELALLFVRDVHAKFAI

SEQ ID NO: 2515177 - protein, 21 aa, Entamoeba dispar
MKYNGGYNWWKRNSLKVFIDK

SEQ ID NO: 2515178 - protein, 21 aa, Entamoeba dispar
MKYNGGYNWWKRNSLTVFIDK

SEQ ID NO: 2515179 - protein, 17 aa, Entamoeba dispar
MKYPIAFLTEGKFDNRI

SEQ ID NO: 2515180 - protein, 17 aa, Entamoeba dispar
MLCCYDINQHQSEYNQI

SEQ ID NO: 2515181 - protein, 18 aa, Entamoeba dispar
MLCNLLFEYLDYYTPIAY

SEQ ID NO: 2515182 - protein, 19 aa, Entamoeba dispar
MLLELKFNKLYGLLDSFYK

SEQ ID NO: 2515183 - protein, 19 aa, Entamoeba dispar
MLRMYGITFNTTFSSGKHN

SEQ ID NO: 2515184 - protein, 25 aa, Entamoeba dispar
MLTNQFKRDICWVFANLASENIKLR

SEQ ID NO: 2515185 - protein, 17 aa, Entamoeba dispar
MLVHHFYLRDALFELKG

SEQ ID NO: 2515186 - protein, 17 aa, Entamoeba dispar
MLWQIRRMIGFAIVLTN

SEQ ID NO: 2515187 - protein, 23 aa, Entamoeba dispar
MMESILICYSRLYKGSDQSIINF

SEQ ID NO: 2515188 - protein, 17 aa, Entamoeba dispar
MMKCIAIALPIHLRNFP

SEQ ID NO: 2515189 - protein, 18 aa, Entamoeba dispar
MMNWLGLRNDQLGGIVPT

SEQ ID NO: 2515190 - protein, 17 aa, Entamoeba dispar
MMYRAFCDGCLRVTKQI

SEQ ID NO: 2515191 - protein, 18 aa, Entamoeba dispar
MNKMFSVVFMLYGSTQFQ

SEQ ID NO: 2515192 - protein, 21 aa, Entamoeba dispar
MNNIRLKSVIKRMIITRLYPY

SEQ ID NO: 2515193 - protein, 17 aa, Entamoeba dispar
MNNRVAMMMKFIEVANE

SEQ ID NO: 2515194 - protein, 18 aa, Entamoeba dispar
MNNSYCIFVGKVSAITTE

SEQ ID NO: 2515195 - protein, 17 aa, Entamoeba dispar
MNTDFFPRVWALRDNGV

SEQ ID NO: 2515196 - protein, 20 aa, Entamoeba dispar
MPCGPSFHFKLFNLMKPKDI

SEQ ID NO: 2515197 - protein, 17 aa, Entamoeba dispar
MPEKRYTCVAGFLEVGE

SEQ ID NO: 2515198 - protein, 19 aa, Entamoeba dispar
MPETLFIFPRLFKIEIAIL

SEQ ID NO: 2515199 - protein, 17 aa, Entamoeba dispar
MPFKFLVDDGCVNPYPP

SEQ ID NO: 2515200 - protein, 18 aa, Entamoeba dispar
MPLFEILKSLDIGPSATN

SEQ ID NO: 2515201 - protein, 17 aa, Entamoeba dispar
MPLKLSSLYVRGTLKNV

SEQ ID NO: 2515202 - protein, 20 aa, Entamoeba dispar
MPMHIDIRWLFTDSYFQKTT

SEQ ID NO: 2515203 - protein, 20 aa, Entamoeba dispar
MPRCAYCRAFMSKEMNWIRL

SEQ ID NO: 2515204 - protein, 23 aa, Entamoeba dispar
MPVIWKLYIEWLIENREITQMRR

SEQ ID NO: 2515205 - protein, 20 aa, Entamoeba dispar
MPVQRLPRYVLLLKELQKNT

SEQ ID NO: 2515206 - protein, 22 aa, Entamoeba dispar
MPWLVIDLIKLIPLICIEKREI

SEQ ID NO: 2515207 - protein, 26 aa, Entamoeba dispar
MQMGGIRMGIPVGFNPASVQLKATGG

SEQ ID NO: 2515208 - protein, 20 aa, Entamoeba dispar
MRCGTPFTLFFRKHHCRNCG

SEQ ID NO: 2515209 - protein, 19 aa, Entamoeba dispar
MRCNEVFGVPLSVGVKKSG

SEQ ID NO: 2515210 - protein, 17 aa, Entamoeba dispar
MRESIKYIYELILSPPL

SEQ ID NO: 2515211 - protein, 19 aa, Entamoeba dispar
MRFLREYKKIINIMKNCST

SEQ ID NO: 2515212 - protein, 18 aa, Entamoeba dispar
MRHPFAISILLECFLTDE

SEQ ID NO: 2515213 - protein, 18 aa, Entamoeba dispar
MRISIAKAIYMHPDLLLL

SEQ ID NO: 2515214 - protein, 17 aa, Entamoeba dispar
MRIVQSWGILFPQEFKV

SEQ ID NO: 2515215 - protein, 22 aa, Entamoeba dispar
MRTLCVHLGYLMGCGAHMEELR

SEQ ID NO: 2515216 - protein, 19 aa, Entamoeba dispar
MRTPPGYWCVFTQNGKTMQ

SEQ ID NO: 2515217 - protein, 17 aa, Entamoeba dispar
MRVCLFSGEIIRESIQI

SEQ ID NO: 2515218 - protein, 24 aa, Entamoeba dispar
MSCYKCHCFFCWICMQITNDHQHK

SEQ ID NO: 2515219 - protein, 17 aa, Entamoeba dispar
MSIHIPALVVIGNEIIP

SEQ ID NO: 2515220 - protein, 22 aa, Entamoeba dispar
MSLSRLKYIFGEKIKIEEKLEN

SEQ ID NO: 2515221 - protein, 20 aa, Entamoeba dispar
MSLYEMMVWAELKNNNEVMP

SEQ ID NO: 2515222 - protein, 20 aa, Entamoeba dispar
MSMKFMKRARAKEIEEMKDI

SEQ ID NO: 2515223 - protein, 17 aa, Entamoeba dispar
MSPRVSMLIGQKEKTEQ

SEQ ID NO: 2515224 - protein, 20 aa, Entamoeba dispar
MSVSVKQRYKVIEGKQRTQP

SEQ ID NO: 2515225 - protein, 22 aa, Entamoeba dispar
MTCVNCGYQFCWLCMQEYTSSH

SEQ ID NO: 2515226 - protein, 17 aa, Entamoeba dispar
MTGTFDGVMSFDHNRFL

SEQ ID NO: 2515227 - protein, 17 aa, Entamoeba dispar
MTICIRKSMGIIDDYLV

SEQ ID NO: 2515228 - protein, 19 aa, Entamoeba dispar
MTILPNFFGKFTIVIHELL

SEQ ID NO: 2515229 - protein, 20 aa, Entamoeba dispar
MTKCFLKFVDVFKLYSSFVN

SEQ ID NO: 2515230 - protein, 22 aa, Entamoeba dispar
MTKTCKIYRALFSSITKKDITE

SEQ ID NO: 2515231 - protein, 22 aa, Entamoeba dispar
MTLKGCSIYTFLNNPIIITKWY

SEQ ID NO: 2515232 - protein, 27 aa, Entamoeba dispar
MTYYYICILRSPLLYGLQPNDFTNDPT

SEQ ID NO: 2515233 - protein, 17 aa, Entamoeba dispar
MVFRGYSRGFAFVEYET

SEQ ID NO: 2515234 - protein, 17 aa, Entamoeba dispar
MVGIFFPNRAEWIIISQ

SEQ ID NO: 2515235 - protein, 24 aa, Entamoeba dispar
MVKDLKNGCCYRADHLLKTFYENK

SEQ ID NO: 2515236 - protein, 17 aa, Entamoeba dispar
MVKMWAEKEMRNLKRLN

SEQ ID NO: 2515237 - protein, 17 aa, Entamoeba dispar
MVQISFMLEKYIVERYF

SEQ ID NO: 2515238 - protein, 23 aa, Entamoeba dispar
MVREIRSGFHFPMRTNEVVLSTQ

SEQ ID NO: 2515239 - protein, 19 aa, Entamoeba dispar
MVRELYCGLIQLFCNLFEK

SEQ ID NO: 2515240 - protein, 25 aa, Entamoeba dispar
MVRVSGKFFMKWRIIELKPEYLNSG

SEQ ID NO: 2515241 - protein, 19 aa, Entamoeba dispar
MWDKMFCEIRGMRYLFAFL

SEQ ID NO: 2515242 - protein, 19 aa, Entamoeba dispar
MWKKRRFHLSQVLQIVPCG

SEQ ID NO: 2515243 - protein, 20 aa, Entamoeba dispar
MWKRRHFPLFSHIVQTMNPR

SEQ ID NO: 2515244 - protein, 19 aa, Entamoeba dispar
MYHSLLLIICRRGSYIFGV

SEQ ID NO: 2515245 - protein, 18 aa, Entamoeba dispar
MYKFCLDVSKAMDYLQES

SEQ ID NO: 2515246 - protein, 18 aa, Entamoeba dispar
MYKSVALQFLTRELPLFK

SEQ ID NO: 2515247 - protein, 19 aa, Entamoeba dispar
MYLSEFAKALVLIYYAQQN

SEQ ID NO: 2515248 - protein, 18 aa, Entamoeba dispar
MYRKVCYDFYAKEGEYYR

SEQ ID NO: 2515249 - protein, 18 aa, Entamoeba dispar
MYRVKWLGKELFLSDELS

SEQ ID NO: 2515250 - protein, 18 aa, Entamoeba dispar
MYYCLCLVDYLVLNCPQF

SEQ ID NO: 2515251 - protein, 19 aa, Entamoeba dispar
NAAYVRFLMKLFRILGRSE

SEQ ID NO: 2515252 - protein, 18 aa, Entamoeba dispar
NAEFKRLTLLMTNLPNKR

SEQ ID NO: 2515253 - protein, 22 aa, Entamoeba dispar
NAIEFYTKFGFRKIKIIPRAYP

SEQ ID NO: 2515254 - protein, 20 aa, Entamoeba dispar
NAIPWELFSIIKLTDDDTTS

SEQ ID NO: 2515255 - protein, 22 aa, Entamoeba dispar
NAKEGRWKYLRILSNDGNFDTI

SEQ ID NO: 2515256 - protein, 17 aa, Entamoeba dispar
NAQGCGWYVRKTEWKGM

SEQ ID NO: 2515257 - protein, 19 aa, Entamoeba dispar
NASCDIWALGCLLYELYTS

SEQ ID NO: 2515258 - protein, 22 aa, Entamoeba dispar
NASCDIWALGCLLYELYTSKML

SEQ ID NO: 2515259 - protein, 19 aa, Entamoeba dispar
NCAFFFKIGACRHGDSCTR

SEQ ID NO: 2515260 - protein, 18 aa, Entamoeba dispar
NCHQRQALAYAFVAVSKG

SEQ ID NO: 2515261 - protein, 21 aa, Entamoeba dispar
NCIELLMKCWILYDLDKGYQQ

SEQ ID NO: 2515262 - protein, 17 aa, Entamoeba dispar
NCIIALFDLSNKDSLQN

SEQ ID NO: 2515263 - protein, 19 aa, Entamoeba dispar
NCIQTGFIYCTRCVKKEEK

SEQ ID NO: 2515264 - protein, 24 aa, Entamoeba dispar
NCKAICCSHGPILRGYIRERVDLW

SEQ ID NO: 2515265 - protein, 18 aa, Entamoeba dispar
NCKEWDIGIVTPYRQQLL

SEQ ID NO: 2515266 - protein, 17 aa, Entamoeba dispar
NCLKGCCDKECKQQCTH

SEQ ID NO: 2515267 - protein, 22 aa, Entamoeba dispar
NCQKFNCNFIKQFQCDIIAIEN

SEQ ID NO: 2515268 - protein, 21 aa, Entamoeba dispar
NCQYGKCGIHLKYCLRIIEEA

SEQ ID NO: 2515269 - protein, 22 aa, Entamoeba dispar
NCVDCGCYMLYYIRKIASQPKR

SEQ ID NO: 2515270 - protein, 22 aa, Entamoeba dispar
NCVVKMNFAFLAALMKWKKEQD

SEQ ID NO: 2515271 - protein, 18 aa, Entamoeba dispar
NCYGKWIINQSVVSSWKD

SEQ ID NO: 2515272 - protein, 19 aa, Entamoeba dispar
NDARLGYVSAMAVAPSGEY

SEQ ID NO: 2515273 - protein, 25 aa, Entamoeba dispar
NDEAYCMYKKCGVCENGTTYKCGNK

SEQ ID NO: 2515274 - protein, 18 aa, Entamoeba dispar
NDEFHYFQGLVEFNEIYV

SEQ ID NO: 2515275 - protein, 21 aa, Entamoeba dispar
NDFTFFLPFFLKDDIKEYMLW

SEQ ID NO: 2515276 - protein, 22 aa, Entamoeba dispar
NDIWKRKTICTMERREKEKRRS

SEQ ID NO: 2515277 - protein, 18 aa, Entamoeba dispar
NDKTQCLSIWKGLENKNN

SEQ ID NO: 2515278 - protein, 18 aa, Entamoeba dispar
NDLMKYILAFGFNEDKTF

SEQ ID NO: 2515279 - protein, 20 aa, Entamoeba dispar
NDLPRNCCIQSFLIDTGKDN

SEQ ID NO: 2515280 - protein, 19 aa, Entamoeba dispar
NDNRFIISWGQLKINIDIS

SEQ ID NO: 2515281 - protein, 20 aa, Entamoeba dispar
NDVYCPFKYITTHEMKDDSF

SEQ ID NO: 2515282 - protein, 20 aa, Entamoeba dispar
NECKKRRGIARSIYDHLKSQ

SEQ ID NO: 2515283 - protein, 26 aa, Entamoeba dispar
NEDDCFRVGIKFGMNGVHFYSNFYES

SEQ ID NO: 2515284 - protein, 22 aa, Entamoeba dispar
NEEMDLMLAFLIRDFGKLLVNE

SEQ ID NO: 2515285 - protein, 18 aa, Entamoeba dispar
NEERCCKFVKFLIENVQN

SEQ ID NO: 2515286 - protein, 23 aa, Entamoeba dispar
NEERCLFCIDLLLKYYEILTKSR

SEQ ID NO: 2515287 - protein, 20 aa, Entamoeba dispar
NEERIRFVLGKPIYRAHLSL

SEQ ID NO: 2515288 - protein, 19 aa, Entamoeba dispar
NEFEPEKKFTIGVEFATRT

SEQ ID NO: 2515289 - protein, 23 aa, Entamoeba dispar
NEGLLMPYLCCILQRIYVISSSY

SEQ ID NO: 2515290 - protein, 20 aa, Entamoeba dispar
NEIFKFLWKIKCMSISIDKA

SEQ ID NO: 2515291 - protein, 21 aa, Entamoeba dispar
NEIRFILRILKGVFRIGFTDR

SEQ ID NO: 2515292 - protein, 21 aa, Entamoeba dispar
NEIRIKIVFGIFSLIGLDDRI

SEQ ID NO: 2515293 - protein, 24 aa, Entamoeba dispar
NEISEPFLFLGIGMKDGYCYGYKI

SEQ ID NO: 2515294 - protein, 21 aa, Entamoeba dispar
NEIVESFSFLHWYISDGSTVL

SEQ ID NO: 2515295 - protein, 23 aa, Entamoeba dispar
NEKRLRPSFRMSLNDGIFVKLLN

SEQ ID NO: 2515296 - protein, 17 aa, Entamoeba dispar
NELKIIFLFTSSHPLIV

SEQ ID NO: 2515297 - protein, 20 aa, Entamoeba dispar
NELKPFLSFVDFVKDLSDSE

SEQ ID NO: 2515298 - protein, 17 aa, Entamoeba dispar
NELLYEFEILPSIISLI

SEQ ID NO: 2515299 - protein, 19 aa, Entamoeba dispar
NELPIEFIGLYLLVKTILN

SEQ ID NO: 2515300 - protein, 17 aa, Entamoeba dispar
NELRGGFDIGLTICKLE

SEQ ID NO: 2515301 - protein, 17 aa, Entamoeba dispar
NELRYGSVMIMADQDFD

SEQ ID NO: 2515302 - protein, 17 aa, Entamoeba dispar
NELSIFLDMLFKKSINE

SEQ ID NO: 2515303 - protein, 18 aa, Entamoeba dispar
NELWKVVMKFVITLDTPL

SEQ ID NO: 2515304 - protein, 17 aa, Entamoeba dispar
NELYYIWDILFAHNNPL

SEQ ID NO: 2515305 - protein, 21 aa, Entamoeba dispar
NEMMGGFGMMRGFIPNNMPMG

SEQ ID NO: 2515306 - protein, 19 aa, Entamoeba dispar
NENARRIWLGRWTTADYPL

SEQ ID NO: 2515307 - protein, 18 aa, Entamoeba dispar
NEPFDRYSIHKSLNSLGV

SEQ ID NO: 2515308 - protein, 17 aa, Entamoeba dispar
NEQRLNGILNMFTGIIY

SEQ ID NO: 2515309 - protein, 18 aa, Entamoeba dispar
NETFKIIVQIGRNNDKQR

SEQ ID NO: 2515310 - protein, 17 aa, Entamoeba dispar
NETRCSFAVSAMGTVIC

SEQ ID NO: 2515311 - protein, 35 aa, Entamoeba dispar
NEVFKKKKMCLYDKCRIIKILVGWMKEATEKGESI

SEQ ID NO: 2515312 - protein, 20 aa, Entamoeba dispar
NEYANRFLVDFAKNSLQEVL

SEQ ID NO: 2515313 - protein, 17 aa, Entamoeba dispar
NEYRDYIGYTWIADKES

SEQ ID NO: 2515314 - protein, 19 aa, Entamoeba dispar
NFAGLLWRPQPTNIIKPEM

SEQ ID NO: 2515315 - protein, 23 aa, Entamoeba dispar
NFCGFSRQLSLYGFKKFDNEYRF

SEQ ID NO: 2515316 - protein, 18 aa, Entamoeba dispar
NFEFNHLASLYFIDKKKE

SEQ ID NO: 2515317 - protein, 17 aa, Entamoeba dispar
NFIPLLRTVFYKFFGER

SEQ ID NO: 2515318 - protein, 17 aa, Entamoeba dispar
NFNSFCKCFKRVKIDKA

SEQ ID NO: 2515319 - protein, 18 aa, Entamoeba dispar
NFSFYWDLLKICQMKIKE

SEQ ID NO: 2515320 - protein, 23 aa, Entamoeba dispar
NGAFGVVCKGMWLGTTPVAMKAI

SEQ ID NO: 2515321 - protein, 23 aa, Entamoeba dispar
NGAFGVVCKGMWLGTTPVAMKAV

SEQ ID NO: 2515322 - protein, 24 aa, Entamoeba dispar
NGDIIFYKWVRDMFGYKRNPEHKK

SEQ ID NO: 2515323 - protein, 18 aa, Entamoeba dispar
NGFIRIIACLSIEERKYF

SEQ ID NO: 2515324 - protein, 23 aa, Entamoeba dispar
NGFLPSRLDLFFPSHPKMPNVPL

SEQ ID NO: 2515325 - protein, 20 aa, Entamoeba dispar
NGICWECWKIYFPDEKWPDL

SEQ ID NO: 2515326 - protein, 23 aa, Entamoeba dispar
NGIPTRLRVVLLRIKGSNSIEEV

SEQ ID NO: 2515327 - protein, 18 aa, Entamoeba dispar
NGKESWAIKSIFLGKKSY

SEQ ID NO: 2515328 - protein, 18 aa, Entamoeba dispar
NGKGAYPFKLERKDTLRS

SEQ ID NO: 2515329 - protein, 23 aa, Entamoeba dispar
NGLGNWYFKGCTSLTRIDIPTTV

SEQ ID NO: 2515330 - protein, 17 aa, Entamoeba dispar
NGLKVMLFSGINKYSTY

SEQ ID NO: 2515331 - protein, 23 aa, Entamoeba dispar
NGNGWVCILLLHIGKGAINQTTK

SEQ ID NO: 2515332 - protein, 18 aa, Entamoeba dispar
NGRWRFELHRGVIYEGMI

SEQ ID NO: 2515333 - protein, 24 aa, Entamoeba dispar
NGVELCALLEIIGETTIKCVTNPK

SEQ ID NO: 2515334 - protein, 22 aa, Entamoeba dispar
NHCKFVWLFLLRNAFYKNCRIV

SEQ ID NO: 2515335 - protein, 17 aa, Entamoeba dispar
NIAVEWLRQSLFSERIL

SEQ ID NO: 2515336 - protein, 20 aa, Entamoeba dispar
NICLFRGKFILEETTDGSRF

SEQ ID NO: 2515337 - protein, 23 aa, Entamoeba dispar
NIDAFWLQRIIKGVVEDDNTAQE

SEQ ID NO: 2515338 - protein, 18 aa, Entamoeba dispar
NIELAINFLERGRAAVNC

SEQ ID NO: 2515339 - protein, 18 aa, Entamoeba dispar
NIESIKVRRCELFRCFVN

SEQ ID NO: 2515340 - protein, 18 aa, Entamoeba dispar
NIFKKCFNLRELSCANNR

SEQ ID NO: 2515341 - protein, 17 aa, Entamoeba dispar
NIFKSYYFCESWNNPVF

SEQ ID NO: 2515342 - protein, 20 aa, Entamoeba dispar
NIFLRMDIRTELICLGAEKF

SEQ ID NO: 2515343 - protein, 17 aa, Entamoeba dispar
NIIKEFLLQCGLHPHES

SEQ ID NO: 2515344 - protein, 18 aa, Entamoeba dispar
NIIKEIKEWFGINESKEA

SEQ ID NO: 2515345 - protein, 24 aa, Entamoeba dispar
NIILKEYFIHYSFIINYYAPCELN

SEQ ID NO: 2515346 - protein, 19 aa, Entamoeba dispar
NIIPLKMRCNEVFGVPLSV

SEQ ID NO: 2515347 - protein, 24 aa, Entamoeba dispar
NIIPPRKTLGVGMGGMGMPQVTLA

SEQ ID NO: 2515348 - protein, 23 aa, Entamoeba dispar
NIKKMIPCIVNIFIVGDNLQKEF

SEQ ID NO: 2515349 - protein, 24 aa, Entamoeba dispar
NIKKMIPCIVNIFIVGDNLQKEFV

SEQ ID NO: 2515350 - protein, 20 aa, Entamoeba dispar
NIKREWSDDFDLFFQNKEGL

SEQ ID NO: 2515351 - protein, 25 aa, Entamoeba dispar
NIKSHPWFKGFDWEGLFQKKLSPPF

SEQ ID NO: 2515352 - protein, 22 aa, Entamoeba dispar
NIKVEGFWPIIMAKALANANIE

SEQ ID NO: 2515353 - protein, 24 aa, Entamoeba dispar
NIMKDVLEAISFLHKNFIVHRDIK

SEQ ID NO: 2515354 - protein, 18 aa, Entamoeba dispar
NIPCTPFLISEPLNSYIA

SEQ ID NO: 2515355 - protein, 18 aa, Entamoeba dispar
NIQDCLNLLVSSWKNTES

SEQ ID NO: 2515356 - protein, 24 aa, Entamoeba dispar
NISCIKLNCYGCRNLNIYIKRINE

SEQ ID NO: 2515357 - protein, 25 aa, Entamoeba dispar
NITLQWRISAVYSIKNKVICGSENG

SEQ ID NO: 2515358 - protein, 18 aa, Entamoeba dispar
NIVRIGILLNEKPLIKKQ

SEQ ID NO: 2515359 - protein, 19 aa, Entamoeba dispar
NIWLFCFPDGLRLSEFPIE

SEQ ID NO: 2515360 - protein, 17 aa, Entamoeba dispar
NKAECLMNFKWRQGLVL

SEQ ID NO: 2515361 - protein, 24 aa, Entamoeba dispar
NKAFFDEKFHLMITNVLRTPPGYR

SEQ ID NO: 2515362 - protein, 18 aa, Entamoeba dispar
NKAGWCFEDFEGSGSIKP

SEQ ID NO: 2515363 - protein, 21 aa, Entamoeba dispar
NKAIKLFDRWCEAVNEDNEKI

SEQ ID NO: 2515364 - protein, 22 aa, Entamoeba dispar
NKCKYSERMTCLLIAIIFEIPD

SEQ ID NO: 2515365 - protein, 20 aa, Entamoeba dispar
NKEFCCYCGIGIDAYQLRTK

SEQ ID NO: 2515366 - protein, 18 aa, Entamoeba dispar
NKEFKLLLNDSFSIPLLN

SEQ ID NO: 2515367 - protein, 18 aa, Entamoeba dispar
NKEFKTWFIENLMIHIER

SEQ ID NO: 2515368 - protein, 22 aa, Entamoeba dispar
NKELLKRITFCYKECYKKGFNN

SEQ ID NO: 2515369 - protein, 20 aa, Entamoeba dispar
NKERINILISRYIPIEKNNE

SEQ ID NO: 2515370 - protein, 23 aa, Entamoeba dispar
NKFLAYSVGYDWHQGVEGLLQQQ

SEQ ID NO: 2515371 - protein, 19 aa, Entamoeba dispar
NKFLFCLNGNTVHISPHEI

SEQ ID NO: 2515372 - protein, 18 aa, Entamoeba dispar
NKHHICWTDRRGVHEPNY

SEQ ID NO: 2515373 - protein, 20 aa, Entamoeba dispar
NKIEVCSGVDGFKHLPKASL

SEQ ID NO: 2515374 - protein, 21 aa, Entamoeba dispar
NKKIIKYLVYFVSKQPFCESE

SEQ ID NO: 2515375 - protein, 26 aa, Entamoeba dispar
NKKIPLCQWPLYVSTSFDNEINGGNE

SEQ ID NO: 2515376 - protein, 25 aa, Entamoeba dispar
NKKMIINFSIRRCGIIVLNEVKEIM

SEQ ID NO: 2515377 - protein, 18 aa, Entamoeba dispar
NKKRCLPFKAVVVNMKRS

SEQ ID NO: 2515378 - protein, 17 aa, Entamoeba dispar
NKLIEWVESSLITDFNT

SEQ ID NO: 2515379 - protein, 17 aa, Entamoeba dispar
NKLKKLWGDAVIEVGKV

SEQ ID NO: 2515380 - protein, 27 aa, Entamoeba dispar
NKMSISFNWILDRCLSFGYEFKKRSTK

SEQ ID NO: 2515381 - protein, 17 aa, Entamoeba dispar
NKNCLLEALTIAGSLLK

SEQ ID NO: 2515382 - protein, 17 aa, Entamoeba dispar
NKNPRWILFYELVLTTK

SEQ ID NO: 2515383 - protein, 24 aa, Entamoeba dispar
NKPFGGICFRPFPTQGFVEIVFCA

SEQ ID NO: 2515384 - protein, 25 aa, Entamoeba dispar
NKQYDCIWIQWSILYLRDDDLIDML

SEQ ID NO: 2515385 - protein, 17 aa, Entamoeba dispar
NKRIIRKAIEFLINKGL

SEQ ID NO: 2515386 - protein, 22 aa, Entamoeba dispar
NKSCEKGLCVLSGLIQLVIDPH

SEQ ID NO: 2515387 - protein, 19 aa, Entamoeba dispar
NKSEFCFNQTPKLNFTSIL

SEQ ID NO: 2515388 - protein, 24 aa, Entamoeba dispar
NKSKMSLLYSRLDIVKKIIILGDY

SEQ ID NO: 2515389 - protein, 21 aa, Entamoeba dispar
NKTCHYPCSVPSIVSFFTMKF

SEQ ID NO: 2515390 - protein, 19 aa, Entamoeba dispar
NKTKLVIMLLKYQCLSSEI

SEQ ID NO: 2515391 - protein, 17 aa, Entamoeba dispar
NKYDILAQIQLEQQQQP

SEQ ID NO: 2515392 - protein, 24 aa, Entamoeba dispar
NKYIKFFTKYCVKYYHKLKKGYNI

SEQ ID NO: 2515393 - protein, 23 aa, Entamoeba dispar
NLEAKCALIYLCGEFVTKITNAK

SEQ ID NO: 2515394 - protein, 24 aa, Entamoeba dispar
NLEMKIIQWEGGKSLYSPTSHYAQ

SEQ ID NO: 2515395 - protein, 23 aa, Entamoeba dispar
NLEMYKGIIPFKWLKEEENEEIL

SEQ ID NO: 2515396 - protein, 19 aa, Entamoeba dispar
NLFVFKYLFMFLTKVMAES

SEQ ID NO: 2515397 - protein, 17 aa, Entamoeba dispar
NLGLSYQGLNMWTEAVE

SEQ ID NO: 2515398 - protein, 18 aa, Entamoeba dispar
NLHKHIWRCTGPCRNKPP

SEQ ID NO: 2515399 - protein, 26 aa, Entamoeba dispar
NLIPREWLTKFDIVFQCGIPEETFYT

SEQ ID NO: 2515400 - protein, 24 aa, Entamoeba dispar
NLITCSLCFCCFSCFNYYNPIFTD

SEQ ID NO: 2515401 - protein, 24 aa, Entamoeba dispar
NLKDIWKRVCIVWTRCYNYLPQKI

SEQ ID NO: 2515402 - protein, 17 aa, Entamoeba dispar
NLKTVYVLFQFRFPETI

SEQ ID NO: 2515403 - protein, 20 aa, Entamoeba dispar
NLLLSLRWRLFLKCLPEDSS

SEQ ID NO: 2515404 - protein, 20 aa, Entamoeba dispar
NLLRCNFCGEPIFNQFKNAS

SEQ ID NO: 2515405 - protein, 24 aa, Entamoeba dispar
NLPHKRLRDVAARVKYLKYIETHP

SEQ ID NO: 2515406 - protein, 19 aa, Entamoeba dispar
NLQIIIKILLEFHTGLGDD

SEQ ID NO: 2515407 - protein, 18 aa, Entamoeba dispar
NLSKSNVCLLLFNENLFI

SEQ ID NO: 2515408 - protein, 24 aa, Entamoeba dispar
NLTLPKWFPTQPIPFDFKSNKIED

SEQ ID NO: 2515409 - protein, 17 aa, Entamoeba dispar
NLYLLLGSVDFLGNPVG

SEQ ID NO: 2515410 - protein, 18 aa, Entamoeba dispar
NMIIKLIENVSCSMYSEN

SEQ ID NO: 2515411 - protein, 18 aa, Entamoeba dispar
NMIYRAFINLPYKTFPNY

SEQ ID NO: 2515412 - protein, 17 aa, Entamoeba dispar
NNCFEIGDDFQFTKQFL

SEQ ID NO: 2515413 - protein, 21 aa, Entamoeba dispar
NNEIFKFLFFVADIHNQGFIT

SEQ ID NO: 2515414 - protein, 22 aa, Entamoeba dispar
NNFKCIIEKAISLTVYLIYIPE

SEQ ID NO: 2515415 - protein, 19 aa, Entamoeba dispar
NNFRIRYDYEISWGSQPDQ

SEQ ID NO: 2515416 - protein, 18 aa, Entamoeba dispar
NNHYKVWAGLYITDTLKP

SEQ ID NO: 2515417 - protein, 19 aa, Entamoeba dispar
NNKRCCVSRLSELYKEMND

SEQ ID NO: 2515418 - protein, 18 aa, Entamoeba dispar
NNLCLRFHFFQSILNKVI

SEQ ID NO: 2515419 - protein, 20 aa, Entamoeba dispar
NNPFTCFPFFVPRRNWFVKA

SEQ ID NO: 2515420 - protein, 19 aa, Entamoeba dispar
NNSKEVFNQLGIIRTNCID

SEQ ID NO: 2515421 - protein, 21 aa, Entamoeba dispar
NNVICPYFFFPLTTFNEYSIA

SEQ ID NO: 2515422 - protein, 20 aa, Entamoeba dispar
NNVQWFFDWCSINYEQTYIL
